US011400116B2

(12) United States Patent
Lim et al.

(10) Patent No.: US 11,400,116 B2
(45) Date of Patent: Aug. 2, 2022

(54) SYSTEMS AND METHODS FOR TARGETING CANCER CELLS

(71) Applicants: The Regents of the University of California, Oakland, CA (US); The Trustees of Princeton University, Princeton, NJ (US); The Simons Foundation, Inc., New York, NY (US)

(72) Inventors: Wendell A. Lim, San Francisco, CA (US); Olga G. Troyanskaya, Princeton, NJ (US); Benjamin VanderSluis, New York, NY (US); Ruth Dannenfelser, Princeton, NJ (US)

(73) Assignees: THE REGENTS OF THE UNIVERSITY OF CALIFORNIA, Oakland, CA (US); THE TRUSTEES OF PRINCETON UNIVERSITY, Princeton, NJ (US); THE SIMONS FOUNDATION INC., New York, NY (US)

( * ) Notice: Subject to any disclaimer, the term of this patent is extended or adjusted under 35 U.S.C. 154(b) by 671 days.

(21) Appl. No.: 16/096,248

(22) PCT Filed: May 5, 2017

(86) PCT No.: PCT/US2017/031389
§ 371 (c)(1),
(2) Date: Oct. 24, 2018

(87) PCT Pub. No.: WO2017/193059
PCT Pub. Date: Nov. 9, 2017

(65) Prior Publication Data
US 2019/0134093 A1     May 9, 2019

Related U.S. Application Data

(60) Provisional application No. 62/333,106, filed on May 6, 2016.

(51) Int. Cl.
| | |
|---|---|
| *A61P 35/00* | (2006.01) |
| *A61K 35/17* | (2015.01) |
| *C07K 14/725* | (2006.01) |
| *C12N 5/0783* | (2010.01) |
| *A61K 38/17* | (2006.01) |
| *G16Z 99/00* | (2019.01) |
| *G16B 5/20* | (2019.01) |
| *C07K 14/705* | (2006.01) |
| *C07K 16/28* | (2006.01) |

(52) U.S. Cl.
CPC ............ *A61K 35/17* (2013.01); *A61K 38/177* (2013.01); *A61K 38/1774* (2013.01); *A61K 38/1793* (2013.01); *A61P 35/00* (2018.01); *C07K 14/705* (2013.01); *C07K 14/7051* (2013.01); *C07K 16/28* (2013.01); *C12N 5/0636* (2013.01); *C12N 5/0638* (2013.01);

*G16B 5/20* (2019.02); *G16Z 99/00* (2019.02); *C07K 2317/622* (2013.01); *C07K 2317/73* (2013.01); *C07K 2319/01* (2013.01); *C07K 2319/03* (2013.01); *C07K 2319/30* (2013.01); *C12N 2501/42* (2013.01); *C12N 2510/00* (2013.01)

(58) Field of Classification Search
None
See application file for complete search history.

(56) References Cited

U.S. PATENT DOCUMENTS

| | | | |
|---|---|---|---|
| 8,226,943 B2 | 7/2012 | Gurney et al. | |
| 9,670,281 B2 * | 6/2017 | Lim | ............... C07K 14/715 |
| 9,834,608 B2 | 12/2017 | Lim et al. | |
| 10,590,182 B2 * | 3/2020 | Lim | ................ C07K 14/71 |
| 10,822,387 B2 * | 11/2020 | Lim | ................ A61K 39/0011 |
| 10,836,808 B2 * | 11/2020 | Lim | ................ C07K 19/00 |
| 2004/0058443 A1 | 3/2004 | Artavanis-Tsakonas et al. | |
| 2006/0140943 A1 | 6/2006 | Champion et al. | |
| 2010/0304410 A1 | 12/2010 | Kijanka et al. | |
| 2014/0099309 A1 | 4/2014 | Powell et al. | |
| 2014/0308746 A1 | 10/2014 | Rossi et al. | |
| 2015/0164896 A1 | 6/2015 | Lu et al. | |

(Continued)

FOREIGN PATENT DOCUMENTS

| | | |
|---|---|---|
| WO | WO 2014/055668 | 4/2014 |
| WO | WO2014055657 A1 † | 4/2014 |
| WO | WO2015075468 A1 † | 5/2015 |

(Continued)

OTHER PUBLICATIONS

Shi et al. (World J Gastroenterol Feb. 28, 2012; 18(8): 840-846). (Year: 2012).*
Morello et al. (Cancer Discov; 6(2); 133-46 (2015)). (Year: 2015).*
Lanitis et al. (Cancer Immunol Res 2013; 1: 43-53). (Year: 2013).*
Raff et al. (Cancer Letters 277 (2009) 126-132). (Year: 2009).*
Tanyi et al. (Proceedings of the 106th Annual Meeting of the American Association for Cancer Research; Apr. 18-22, 2015; Philadelphia, PA. Philadelphia (PA): AACR; Cancer Res 2015;75(15 Suppl):Abstract nr CT105). (Year: 2015).*

(Continued)

*Primary Examiner* — Zachary S Skelding
(74) *Attorney, Agent, or Firm* — James S. Keddie; Bozicevic, Field & Francis LLP

(57) ABSTRACT

The present disclosure provides an immune cell genetically modified to produce two antigentriggered polypeptides, each recognizing a different cell surface antigen. The present disclosure provides a system two antigen-triggered polypeptides, each recognizing a different cell surface antigen. The present disclosure provides a method of killing a target cancer cell, using a genetically modified immune cell or a system of the present disclosure. The present disclosure provides a computational method to identify target antigen pairs on a cancer cell.

3 Claims, 407 Drawing Sheets

Specification includes a Sequence Listing.

(56) References Cited

U.S. PATENT DOCUMENTS

2016/0250258 A1    9/2016  Delaney et al.
2016/0264665 A1*   9/2016  Lim .................. C07K 16/30

FOREIGN PATENT DOCUMENTS

| WO | WO2015075470 | A1 | † | 5/2015 | |
| WO | WO-2015090230 | A1 | * | 6/2015 | ......... A61K 38/1774 |
| WO | WO 2015/123642 | | | 8/2015 | |
| WO | WO 2015/124715 | | | 8/2015 | |
| WO | WO 2016/033331 | | | 8/2015 | |
| WO | WO 2015/105995 | | | 11/2015 | |
| WO | WO-2016138034 | A1 | * | 9/2016 | ......... C07K 16/2803 |
| WO | WO 2019/099689 | A1 | | 5/2019 | |

OTHER PUBLICATIONS

Brooks, et al.; "IL-10 and PD-L1 operate through distinct pathways to suppress T-cell activity during persistent viral infection"; PNAS; vol. 105, No. 51, pp. 20428-20433 (Dec. 23, 2008).

Cao, et al.; "Design of Switchable Chimeric Antigen Receptor T Cells Targeting Breast Cancer"; Angew. Chem. Int. Ed.; vol. 55, 6 pages (2016).

Cohen, et al.; "T-Cell Receptor-Like Antibodies: Targeting the Intracellular Proteome Therapeutic Potential and Clinical Applications"; Antibodies; vol. 2, pp. 517-534 (2013).

Dahan, et al.; "T-cell-receptor-like antibodies—generation, function and applications"; Expert Reviews in Molecular Medicine; vol. 14, 17 pages (Feb. 2012).

Dhanik, et al.; "In-silico discovery of cancer-specific peptide-HLA complexes for targeted therapy"; BMC Bioinformatics; vol. 17, No. 286, 14 pages (2016).

Inaguma, et al.; "Construction and molecular characterization of a T-cell receptor-like antibody and CAR-T cells specific for minor histocompatibility antigen HA-1H"; Gene Therapy; vol. 21, pp. 575-584 (2014).

Jain, et al.; "Antitumor Activity of a Monoclonal Antibody Targeting Major Histocompatibility Complex Class I-Her2 Peptide Complexes"; JNCI; 17 pages (Nov. 5, 2012).

Ma, et al.; "A novel TCR-like CAR with specificity for PR1/HLA-A2 effectively targets myeloid leukemia in vitro when expressed in human adult peripheral blood and cord blood T cells"; Cytotherapy; vol. 18, pp. 985-994 (2016).

Ma, et al.; "Versatile strategy for controlling the specificity and activity of engineered T cells"; PNAS; 31 pages (Jan. 12, 2016).

Mahmud, et al.; "Antibody immunosuppressive therapy in solid-organ transplant"; Mabs; vol. 2, No. 2, pp. 148-156 (2010).

Sastry, et al.; "Targeting Hepatitis B Virus-Infected Cells with a T-Cell Receptor-Like Antibody"; Journal of Virology; vol. 85, No. 5, pp. 1935-1942 (Mar. 2011).

Sergeeva, et al.; "Activity of 8F4, a T-cell receptor-like anti-PR1/HLA-A2 antibody, against primary human AML in vivo"; Leukemia; vol. 30, pp. 1475-1484 (2016).

Sergeeva, et al.; "An anti-PR1/HLA-A2 T-cell receptor-like antibody mediates complement-dependent cytotoxicity against acute myeloid leukemia progenitor cells"; Immunobiology; vol. 117, No. 16, pp. 4262-4272 (Apr. 2011).

Stewart-Jones; "Rational development of high-affinity T-cell receptor-like antibodies"; PNAS; vol. 106, No. 14, pp. 5784-5788 (Apr. 7, 2009).

Willemsen, et al.; "A phage display selected Fab fragment with MHC class I-restricted specificity for MAGE-A1 allows for retargeting of primary human T lymphocytes"; Gene Therapy; vol. 8, pp. 1601-1608 (2001).

Wittman, et al.; "Antibody Targeting to a Class I MHC-Peptide Epitope Promotes Tumor Cell Death"; The Journal of Immunology; vol. 177, pp. 4187-4195 (2006).

Wong; "Altor Bioscience Corporation; Company Profile"; Biomarkers Med.; vol. 4, No. 4, pp. 499-504 (2010).

Abate-Daga, et a.; "CAR models: next-generation CAR modifications for enhanced T-cell function"; Molecular Therapy-Oncolytics; vol. 3, 7 pages (2016).

Baitsch, et al.; "Extended Co-Expression of Inhibitory Receptors by Human CD8 T-Cells Depending on Differentiation, Antigen-Specificity and Anatomical Localization"; PLoS One; vol. 7, No. 2, 10 pages (Feb. 2012).

Barnea, et al.; "The genetic design of signaling cascades to record receptor activation"; PNAS; vol. 105, No. 1, pp. 64-69 (Jan. 8, 2008).

Barrett, et al.; "Chimeric Antigen Receptor Therapy for Cancer"; Annu Rev Med; vol. 65, pp. 333-347 (2014).

Chillakuri, et al.; "Notch receptor-ligand binding and activation: Insights from molecular studies"; Seminars in Cell & Developmental Biology; vol. 23, pp. 421-428 (2012).

Daringer, et al.; "Modular Extracellular Sensor Architecture for Engineering Mammalian Cell-based Devices"; ACS Synthetic Biology; vol. 3, pp. 892-902 (2014).

Dotti, et al.; "Design and development of therapies using chimeric antigen receptor-expressing T cells"; Immunological Reviews; vol. 257, pp. 107-126 (2014).

Fridy, et al.; "A robust pipeline for rapid production of versatile nanobody repertoires"; Nat. Methods; vol. 11, No. 12, pp. 1253-1260 (Dec. 2014).

Fridy, et al.; "A robust pipeline for rapid production of versatile nanobody repertoires"; Nat. Methods; vol. 11, No. 12, pp. 1253-1260 (Dec. 2014)—Supplemental Materials.

Gooz; "ADAM-17: The Enzyme That Does It All"; Crit. Rev. Biochem. Mol. Biol.; vol. 45, No. 2, pp. 146-169, 146-169 (Apr. 2010).

Gordon, et al.; "Effects of S1 cleavage on the structure, surface export, and signaling activity of human Notch1 and Notch2"; PLoS One; vol. 4, No. 8, 12 pages (Aug. 2009).

Gordon, et al.; Mechanical Allostery: Evidence for a Force Requirement in the Proteolytic Activation of Notch; Cell; vol. 33, pp. 729-736 (2015).

Kimchi-Sarfaty, et al.; "A 'Silent' Polymorphism in the MDR1 Gene Changes Substrate Specificity"; Science; vol. 315, pp. 525-528 (Jan. 26, 2007).

Kopan, et al.; "The Canonical Notch Signaling Pathway: Unfolding the Activation Mechanism"; Cell; vol. 137, pp. 216-233 (Apr. 17, 2009).

Lecourtois, et al.; "Indirect evidence for Delta-dependent intracellular processing of notch in *Drosophila embryos*"; Curr. Biol.; vol. 8, No. 13, pp. 771-774 (Jun. 1998).

Lim; "Designing customized cell signalling circuits"; Nature Reviews Molecular Cell Biology; vol. 11, No. 6, pp. 393-403 (Jun. 2010).

Matsuda, et al.; "Synthetic Signal Propagation Through Direct Cell-Cell Interaction"; Sci. Signal; vol. 5, No. 220, 9 pages (Apr. 17, 2012).

Mumm, et al.; "A ligand-induced extracellular cleavage regulates gamma-secretase-like proteolytic activation of Notch1"; Mol. Cell; vol. 5, No. 2, pp. 197-206 (Feb. 2000).

Musse, et al.; "Notch ligand endocytosis: Mechanistic basis of signaling activity"; Seminars in Cell & Developmental Biology; vol. 23, pp. 429-436 (2012).

Ngo, et al.; "Computational Complexity, Protein Structure Prediction, and the Levinthal Paradox"; The Protein Folding Problem and Tertiary Structure Prediction; pp. 433 and 492-495 (1994).

Odorizzi, et al.; "Inhibitory Receptors on Lymphocytes: Insights from Infections"; J. Immunol.; vol. 188, No. 7, pp. 2957-2965 (Apr. 1, 2012).

PDB-2004: Structure of LNR-HD (Negative Regulatory Region) from human Notch 2 [online] Apr. 3, 2007 [retrieved May 11, 2016]. Available on the internet: <URL: http://www.rcsb.org/pdb/explore/explore.do?structureId=2004>.

Pratt, et al.; "The cell giveth and the cell taketh away: An overview of Notch pathway activation by endocytic trafficking of ligands and receptors"; acta histochemica; vol. 113, pp. 248-255 (2011).

Roybal, et al.; "Engineering T Cells with Customized Therapeutic Response Programs Using Synthetic Notch Receptors"; Cell; vol. 167, pp. 419-432 (2016).

(56) References Cited

OTHER PUBLICATIONS

Roybal, et al.; "Precision Tumor Recognition by T Cells With Combinatorial Antigen-Sensing Circuits"; Cell; vol. 164, No. 4, pp. 770-779 (Feb. 11, 2016).
Sanchez-Irizarry, et al.; "Notch Subunit Heterodimerization and Prevention of Ligand-Independent Proteolytic Activation Depend, Respectively, on a Novel Domain and the LNR Repeats"; Molecular and Cellular Biology; vol. 24, No. 21, 9265-9273 (Nov. 2004).
Struhl, et al.; "Nuclear access and action of notch in vivo"; Cell; vol. 93, No. 4, pp. 649-660 (May 15, 1998).
Voet, et al.; Biochemistry; pp. 126-128 (1990).
Vooijs, et al.; "Mapping the consequence of Notch1 proteolysis in vivo with NIP-CRE"; Development; vol. 132, No. 3, pp. 535-544 (Feb. 2007).
Weissman, et al.; "Molecular cloning and chromosomal localization of the human T-cell receptor zeta chain: distinction from the molecular CD3 complex"; PNAS; vol. 85, No. 24, pp. 9709-9713 (Dec. 1988).
Wu, et al.; "Remote control of therapeutic T cells through a small molecule-gated chimeric receptor"; Science; vol. 350, No. 6258, 12 pages (Oct. 16, 2015).
Wu, et al.; "Synthetic Approaches to Engineer T cells"; Curr. Opin. Immunol.; vol. 35, pp. 123-130 (Aug. 2015).
Heyman, et al.; Chimeric antigen receptor T cell therapy for solid tumors: current status, obstacles, and future strategies. Cancers 11:191, 2019 (21 total pages).
Lanitis et al.; Chimeric antigen receptor T cells with dissociated signaling domains exhibit focused antitumor activity with reduced potential for toxicity in vivo. Cancer Immunol Res 1(1): 1-11, 2013.
Sanz et al.; Antibodies and gene therapy: teaching old "magic bullets" new tricks. TRENDS Immunol 25(2): 85-91, 2004.
Morsut, et al.; "Engineering Customized Cell Sensing and Response Behaviors Using Synthetic Notch Receptors"; Cell; vol. 164, No. 4, pp. 1-25 (Feb. 11, 2016).
Barnea et al., "The genetic design of signaling cascades to record receptor activation", Proc Natl Acad Sci, 2008, 105(1), 64-69.
Daringer et al., "Modular Extracellular Sensor Architecture for Engineering Mammalian Cell-based Devices", ACS Synth. Biol., 2014, 3: 892-902.
Kroeze et al., "PRESTO-Tango as an open-source resource for interrogation of the druggable human GPCRome", Nat Struct Mol Biol, 2015, 22(5): 362-369.
Kovall et al., "The Canonical Notch Signaling Pathway: Structural and Biochemical Insights into Shape, Sugar, and Force", Dev Cell., 2017, 41(3): 228-241.
Kawase et al., "Fibroblast activation protein-α-expressing fibroblasts promote the progression of pancreatic ductal adenocarcinoma", BMC Gastroenterol., 2015, 15:109.
Zhu et al., "Design and modular assembly of synthetic intramembrane proteolysis receptors for custom gene regulation in therapeutic cells", Posted to bioRxiv on May 23, 2021.
D'Souza et al., "The many facets of Notch ligands", Oncogene, 2008, 27, 5148-5167.
Kloss et al., Nature Biotechnology, Combinatorial Antigen Recognition with Balanced Signaling Promotes Selective Tumor Eradication by Engineered T Cells, pp. 71-76, Jan. 2013, Nature America, Inc.†
Hedge et al., Molecular Therapy, Combination Targeting Offset Antigen Escape and Enhances Effector Functions of Adoptively Transferred T Cells in Glioblastoma, pp. 2087-2101, Nov. 11, 2013, The American Society of Cell Therapy.†
Duong et al., Immunotherapy, Enhancing the Specificity of T-Cell Cultures for Adoptive Immunotherapy of Cancer, pp. 33-48, 2011, Future Medicine Ltd.†
Wilkie et al., Journal of Clinical Immunology, Dual Targeting of ErbB2 and MUC1 in Breast Cancer Using Chimeric Antigen Receptors Engineered to Provide Complimentary Signaling, pp. 1059-1070, Apr. 17, 2012, Springer Science + Business Media, LLC, published online.†

\* cited by examiner
† cited by third party

FIG. 1

| Antigen Pair Logic | F1 | Precision | Recall | Antigen Pair Logic | F1 | Precision | Recall |
|---|---|---|---|---|---|---|---|
| Liposarcoma (Liposarcoma) | | | | (cont.) | | | |
| EVA1B AND NOT-ITGA6 | 0.904109589 | 0.89189189 | 0.916666667 | CHRNA3 AND NOT-GOLGB1 | 0.950617284 | 0.987179487 | 0.916666667 |
| ADAM12 AND NOT-TACSTD2 | 0.904109589 | 0.89189189 | 0.916666667 | CHRNA3 AND NOT-GP2 | 0.950617284 | 0.987179487 | 0.916666667 |
| Glioblastoma (Glioblastoma) | | | | CHRNA3 AND NOT-GP5 | 0.950617284 | 0.987179487 | 0.916666667 |
| PTPRZ1 | 0.9375 | 1 | 0.882352941 | CHRNA3 AND NOT-IFNL2 | 0.95 | 1 | 0.904761905 |
| PTPRZ1 AND FOLR2 | 0.903225806 | 1 | 0.823529412 | CHRNA3 AND NOT-OR51B5 | 0.950617284 | 0.987179487 | 0.916666667 |
| PTPRZ1 AND IGF1R | 0.9375 | 1 | 0.882352941 | CHRNA3 AND NOT-OR5J2 | 0.956521739 | 1 | 0.916666667 |
| PTPRZ1 AND NCAM1 | 0.9375 | 1 | 0.882352941 | CHRNA3 AND NOT-GPR3 | 0.95 | 1 | 0.904761905 |
| PTPRZ1 AND CD70 | 0.9375 | 1 | 0.882352941 | CHRNA3 AND NOT-XCR1 | 0.950617284 | 0.987179487 | 0.916666667 |
| PTPRZ1 AND AXL | 0.903225806 | 1 | 0.823529412 | CHRNA3 AND NOT-OR8D1 | 0.950617284 | 0.987179487 | 0.916666667 |
| PTPRZ1 AND NOT-NAALAD2 | 0.9375 | 1 | 0.882352941 | CHRNA3 AND NOT-OR8D2 | 0.956521739 | 1 | 0.916666667 |
| PTPRZ1 AND NOT-TMEM170B | 0.903225806 | 1 | 0.823529412 | CHRNA3 AND NOT-OR10A4 | 0.950617284 | 0.987179487 | 0.916666667 |
| PTPRZ1 AND NOT-PIGK | 0.903225806 | 1 | 0.823529412 | CHRNA3 AND NOT-NPBWR2 | 0.950617284 | 0.987179487 | 0.916666667 |
| PTPRZ1 AND CDH5 | 0.9375 | 1 | 0.882352941 | CHRNA3 AND NOT-B4GALNT3 | 0.950617284 | 0.987179487 | 0.916666667 |
| PTPRZ1 AND NOT-100507547? | 0.9375 | 1 | 0.882352941 | CHRNA3 AND NOT-CXCR3 | 0.950617284 | 0.987179487 | 0.916666667 |
| PTPRZ1 AND SCAMP2 | 0.903225806 | 1 | 0.823529412 | CHRNA3 AND NOT-DPY19L2 | 0.950617284 | 0.987179487 | 0.916666667 |
| PTPRZ1 AND NOT-CDH8 | 0.903225806 | 1 | 0.823529412 | CHRNA3 AND NOT-TMPRSS12 | 0.943396226 | 1 | 0.892857143 |
| PTPRZ1 AND NOT-CDH12 | 0.903225806 | 1 | 0.823529412 | CHRNA3 AND NOT-ZDHHC22 | 0.936708861 | 1 | 0.880952381 |
| PTPRZ1 AND NOT-LPAR6 | 0.9375 | 1 | 0.882352941 | CHRNA3 AND NOT-GPR12 | 0.95 | 1 | 0.904761905 |
| PTPRZ1 AND NOT-CDH18 | 0.903225806 | 1 | 0.823529412 | CHRNA3 AND NOT-GPR15 | 0.950617284 | 0.987179487 | 0.916666667 |
| PTPRZ1 AND TENM1 | 0.9375 | 1 | 0.882352941 | CHRNA3 AND NOT-C17orf78 | 0.956521739 | 1 | 0.916666667 |
| PTPRZ1 AND LHFPL2 | 0.903225806 | 1 | 0.823529412 | CHRNA3 AND NOT-IZUMO1 | 0.950617284 | 0.987179487 | 0.916666667 |
| PTPRZ1 AND NOT-LHFP | 0.903225806 | 1 | 0.823529412 | CHRNA3 AND NOT-SIGLECL1 | 0.950617284 | 0.987179487 | 0.916666667 |
| PTPRZ1 AND NOT-TIMM17B | 0.9375 | 1 | 0.882352941 | CHRNA3 AND NOT-GPR20 | 0.950617284 | 0.987179487 | 0.916666667 |
| PTPRZ1 AND NOT-PRSS16 | 0.9375 | 1 | 0.882352941 | CHRNA3 AND NOT-OR2L13 | 0.950617284 | 0.987179487 | 0.916666667 |
| PTPRZ1 AND NOT-MARCH6 | 0.903225806 | 1 | 0.823529412 | CHRNA3 AND NOT-GPR25 | 0.950617284 | 0.987179487 | 0.916666667 |
| PTPRZ1 AND NOT-RTN3 | 0.9375 | 1 | 0.882352941 | CHRNA3 AND NOT-CCDC141 | 0.936708861 | 1 | 0.880952381 |
| PTPRZ1 AND NOT-MRVI1 | 0.9375 | 1 | 0.882352941 | CHRNA3 AND NOT-DNAJC5G | 0.950617284 | 0.987179487 | 0.916666667 |
| PTPRZ1 AND NOT-PCGF3 | 0.9375 | 1 | 0.882352941 | CHRNA3 AND NOT-PRRT3 | 0.950617284 | 0.987179487 | 0.916666667 |
| PTPRZ1 AND BTN3A3 | 0.9375 | 1 | 0.882352941 | CHRNA3 AND NOT-CYP4V2 | 0.950617284 | 0.987179487 | 0.916666667 |
| PTPRZ1 AND NOT-ATP8A1 | 0.9375 | 1 | 0.882352941 | CHRNA3 AND NOT-GPR32 | 0.950617284 | 0.987179487 | 0.916666667 |
| PTPRZ1 AND NOT-CDS1 | 0.903225806 | 1 | 0.823529412 | CHRNA3 AND NOT-RNF180 | 0.943396226 | 1 | 0.892857143 |
| PTPRZ1 AND NOT-CDIPT | 0.9375 | 1 | 0.882352941 | CHRNA3 AND NOT-GPR37 | 0.956521739 | 1 | 0.916666667 |
| PTPRZ1 AND NOT-TMEM147 | 0.903225806 | 1 | 0.823529412 | CHRNA3 AND NOT-CRB2 | 0.950617284 | 0.987179487 | 0.916666667 |
| PTPRZ1 AND NOT-LYPLA1 | 0.903225806 | 1 | 0.823529412 | CHRNA3 AND NOT-GPR39 | 0.950617284 | 0.987179487 | 0.916666667 |
| PTPRZ1 AND NOT-CD52 | 0.9375 | 1 | 0.882352941 | CHRNA3 AND NOT-FFAR1 | 0.950617284 | 0.987179487 | 0.916666667 |
| PTPRZ1 AND NOT-TIMM17A | 0.9375 | 1 | 0.882352941 | CHRNA3 AND NOT-ILDR1 | 0.950617284 | 0.987179487 | 0.916666667 |
| PTPRZ1 AND NOT-SLC25A17 | 0.9375 | 1 | 0.882352941 | CHRNA3 AND NOT-GRIA3 | 0.956521739 | 1 | 0.916666667 |
| PTPRZ1 AND NOT-VTI1B | 0.9375 | 1 | 0.882352941 | CHRNA3 AND NOT-SLC6A16 | 0.950617284 | 0.987179487 | 0.916666667 |
| PTPRZ1 AND CRTAP | 0.9375 | 1 | 0.882352941 | CHRNA3 AND NOT-GRIK1 | 0.95 | 1 | 0.904761905 |
| PTPRZ1 AND NOT-PROCR | 0.9375 | 1 | 0.882352941 | CHRNA3 AND NOT-TMPRSS11E | 0.950617284 | 0.987179487 | 0.916666667 |
| PTPRZ1 AND PRDX4 | 0.9375 | 1 | 0.882352941 | CHRNA3 AND NOT-ABO | 0.950617284 | 0.987179487 | 0.916666667 |
| PTPRZ1 AND NOT-AGPAT2 | 0.9375 | 1 | 0.882352941 | CHRNA3 AND NOT-GRIN1 | 0.950617284 | 0.987179487 | 0.916666667 |
| PTPRZ1 AND NOT-SPTLC1 | 0.9375 | 1 | 0.882352941 | CHRNA3 AND NOT-GRIN2A | 0.950617284 | 0.987179487 | 0.916666667 |
| PTPRZ1 AND IFITM2 | 0.903225806 | 1 | 0.823529412 | CHRNA3 AND NOT-GRIN2B | 0.956521739 | 1 | 0.916666667 |
| PTPRZ1 AND NOT-ERLIN1 | 0.9375 | 1 | 0.882352941 | CHRNA3 AND NOT-GRM2 | 0.950617284 | 0.987179487 | 0.916666667 |
| PTPRZ1 AND TNFSF13B | 0.9375 | 1 | 0.882352941 | CHRNA3 AND NOT-GRM3 | 0.936708861 | 1 | 0.880952381 |
| PTPRZ1 AND NOT-B3GNT2 | 0.9375 | 1 | 0.882352941 | CHRNA3 AND NOT-GRM5 | 0.950617284 | 0.987179487 | 0.916666667 |
| PTPRZ1 AND CERS1 | 0.9375 | 1 | 0.882352941 | CHRNA3 AND NOT-GRM6 | 0.950617284 | 0.987179487 | 0.916666667 |
| PTPRZ1 AND NOT-NUP50 | 0.9375 | 1 | 0.882352941 | CHRNA3 AND NOT-GRPR | 0.950617284 | 0.987179487 | 0.916666667 |
| PTPRZ1 AND NOT-HBS1L | 0.903225806 | 1 | 0.823529412 | CHRNA3 AND NOT-CYP2S1 | 0.950617284 | 0.987179487 | 0.916666667 |
| PTPRZ1 AND NOT-ZMYND11 | 0.903225806 | 1 | 0.823529412 | CHRNA3 AND NOT-ZDHHC1 | 0.950617284 | 0.987179487 | 0.916666667 |
| PTPRZ1 AND VAMP5 | 0.9375 | 1 | 0.882352941 | CHRNA3 AND NOT-GUCA2A | 0.950617284 | 0.987179487 | 0.916666667 |
| PTPRZ1 AND NOT-CFTR | 0.9375 | 1 | 0.882352941 | CHRNA3 AND NOT-GUCY2C | 0.950617284 | 0.987179487 | 0.916666667 |
| PTPRZ1 AND NOT-FAXDC2 | 0.903225806 | 1 | 0.823529412 | CHRNA3 AND NOT-TRPM5 | 0.950617284 | 0.987179487 | 0.916666667 |
| PTPRZ1 AND NOT-TSPAN9 | 0.9375 | 1 | 0.882352941 | CHRNA3 AND NOT-GUCY2F | 0.950617284 | 0.987179487 | 0.916666667 |
| PTPRZ1 AND USP19 | 0.903225806 | 1 | 0.823529412 | CHRNA3 AND NOT-PCDHB1 | 0.950617284 | 0.987179487 | 0.916666667 |
| PTPRZ1 AND NOT-GPR83 | 0.9375 | 1 | 0.882352941 | CHRNA3 AND NOT-SLC39A3 | 0.950617284 | 0.987179487 | 0.916666667 |
| PTPRZ1 AND NOT-ADCY2 | 0.9375 | 1 | 0.882352941 | CHRNA3 AND NOT-SLC39A2 | 0.950617284 | 0.987179487 | 0.916666667 |
| PTPRZ1 AND NOT-ERP29 | 0.903225806 | 1 | 0.823529412 | CHRNA3 AND NOT-GUCY2D | 0.950617284 | 0.987179487 | 0.916666667 |
| PTPRZ1 AND NOT-UQCR11 | 0.9375 | 1 | 0.882352941 | CHRNA3 AND NOT-HFE | 0.950617284 | 0.987179487 | 0.916666667 |
| PTPRZ1 AND NOT-ADCY3 | 0.9375 | 1 | 0.882352941 | CHRNA3 AND NOT-PLA2G2E | 0.950617284 | 0.987179487 | 0.916666667 |
| PTPRZ1 AND NOT-SLC27A2 | 0.903225806 | 1 | 0.823529412 | CHRNA3 AND NOT-ST6GALNAC6 | 0.950617284 | 0.987179487 | 0.916666667 |
| PTPRZ1 AND NOT-RER1 | 0.9375 | 1 | 0.882352941 | CHRNA3 AND NOT-ERVW-1 | 0.950617284 | 0.987179487 | 0.916666667 |
| PTPRZ1 AND ADAM29 | 0.903225806 | 1 | 0.823529412 | CHRNA3 AND NOT-KCNIP3 | 0.950617284 | 0.987179487 | 0.916666667 |
| PTPRZ1 AND BTN3A2 | 0.903225806 | 1 | 0.823529412 | CHRNA3 AND NOT-MR1 | 0.950617284 | 0.987179487 | 0.916666667 |
| PTPRZ1 AND BTN3A1 | 0.903225806 | 1 | 0.823529412 | CHRNA3 AND NOT-HRH2 | 0.950617284 | 0.987179487 | 0.916666667 |
| PTPRZ1 AND NOT-BTN2A1 | 0.9375 | 1 | 0.882352941 | CHRNA3 AND NOT-SERPINA9 | 0.950617284 | 0.987179487 | 0.916666667 |
| PTPRZ1 AND NOT-PTPRT | 0.903225806 | 1 | 0.823529412 | CHRNA3 AND NOT-NDST1 | 0.950617284 | 0.987179487 | 0.916666667 |
| PTPRZ1 AND NOT-IL1RAPL1 | 0.903225806 | 1 | 0.823529412 | CHRNA3 AND NOT-HTR1A | 0.950617284 | 0.987179487 | 0.916666667 |
| PTPRZ1 AND NOT-PLA2G16 | 0.903225806 | 1 | 0.823529412 | CHRNA3 AND NOT-HTR1F | 0.950617284 | 0.987179487 | 0.916666667 |
| PTPRZ1 AND NOT-C14orf1 | 0.9375 | 1 | 0.882352941 | CHRNA3 AND NOT-HTR5A | 0.950617284 | 0.987179487 | 0.916666667 |
| PTPRZ1 AND CHI3L2 | 0.903225806 | 1 | 0.823529412 | CHRNA3 AND NOT-HTR6 | 0.950617284 | 0.987179487 | 0.916666667 |
| PTPRZ1 AND NOT-FZD10 | 0.9375 | 1 | 0.882352941 | CHRNA3 AND NOT-KRTAP19-3 | 0.950617284 | 0.987179487 | 0.916666667 |
| PTPRZ1 AND NOT-GALNT6 | 0.9375 | 1 | 0.882352941 | CHRNA3 AND NOT-IFNE | 0.950617284 | 0.987179487 | 0.916666667 |
| PTPRZ1 AND NOT-SEC63 | 0.9375 | 1 | 0.882352941 | CHRNA3 AND NOT-339166? | 0.950617284 | 0.987179487 | 0.916666667 |

FIG. 1 (CONT.)

| Antigen Pair Logic | F1 | Precision | Recall |
|---|---|---|---|
| PTPRZ1 AND NOT-PRRT2 | 0.9375 | 1 | 0.882352941 |
| PTPRZ1 AND NOT-KLHL2 | 0.9375 | 1 | 0.882352941 |
| PTPRZ1 AND MGAT4A | 0.9375 | 1 | 0.882352941 |
| VSIG4 AND NOT-CYB5A | 0.903225806 | 1 | 0.823529412 |
| PTPRZ1 AND NOT-SMIM12 | 0.9375 | 1 | 0.882352941 |
| PTPRZ1 AND SDSL | 0.903225806 | 1 | 0.823529412 |
| PTPRZ1 AND NOT-PIK3IP1 | 0.9375 | 1 | 0.882352941 |
| PTPRZ1 AND NOT-SLC2A13 | 0.9375 | 1 | 0.882352941 |
| PTPRZ1 AND NOT-MAL2 | 0.903225806 | 1 | 0.823529412 |
| PTPRZ1 AND CSMD2 | 0.903225806 | 1 | 0.823529412 |
| PTPRZ1 AND NOT-XKR4 | 0.9375 | 1 | 0.882352941 |
| PTPRZ1 AND TMEM132B | 0.903225806 | 1 | 0.823529412 |
| PTPRZ1 AND MARCH3 | 0.903225806 | 1 | 0.823529412 |
| PTPRZ1 AND NOT-GPR146 | 0.9375 | 1 | 0.882352941 |
| PTPRZ1 AND NOT-LYSMD3 | 0.9375 | 1 | 0.882352941 |
| PTPRZ1 AND NOT-LRRC3B | 0.903225806 | 1 | 0.823529412 |
| PTPRZ1 AND NOT-FAM210B | 0.903225806 | 1 | 0.823529412 |
| PTPRZ1 AND NOT-GINM1 | 0.903225806 | 1 | 0.823529412 |
| PTPRZ1 AND TM4SF18 | 0.903225806 | 1 | 0.823529412 |
| PTPRZ1 AND NOT-SLC18B1 | 0.9375 | 1 | 0.882352941 |
| PTPRZ1 AND NOT-CLCN4 | 0.903225806 | 1 | 0.823529412 |
| PTPRZ1 AND ANTXR2 | 0.903225806 | 1 | 0.823529412 |
| PTPRZ1 AND NOT-ZFYVE27 | 0.9375 | 1 | 0.882352941 |
| PTPRZ1 AND NOT-SLC36A4 | 0.903225806 | 1 | 0.823529412 |
| PTPRZ1 AND FAT3 | 0.903225806 | 1 | 0.823529412 |
| PTPRZ1 AND NOT-TMEM45B | 0.9375 | 1 | 0.882352941 |
| PTPRZ1 AND NOT-CLN5 | 0.9375 | 1 | 0.882352941 |
| NOT-PTPRZ1 AND PTPRZ1 | 0.9375 | 1 | 0.882352941 |
| PTPRZ1 AND NOT-SPPL3 | 0.9375 | 1 | 0.882352941 |
| PTPRZ1 AND CCR1 | 0.903225806 | 1 | 0.823529412 |
| PTPRZ1 AND NOT-C15orf27 | 0.9375 | 1 | 0.882352941 |
| PTPRZ1 AND NOT-NIPA1 | 0.903225806 | 1 | 0.823529412 |
| PTPRZ1 AND NOT-TMEM219 | 0.9375 | 1 | 0.882352941 |
| PTPRZ1 AND NOT-CYB5D2 | 0.9375 | 1 | 0.882352941 |
| PTPRZ1 AND NOT-SPNS2 | 0.9375 | 1 | 0.882352941 |
| PTPRZ1 AND FAM69C | 0.903225806 | 1 | 0.823529412 |
| PTPRZ1 AND B3GALT6 | 0.903225806 | 1 | 0.823529412 |
| PTPRZ1 AND CNR1 | 0.9375 | 1 | 0.882352941 |
| PTPRZ1 AND SLC44A3 | 0.9375 | 1 | 0.882352941 |
| PTPRZ1 AND NOT-CNTN1 | 0.9375 | 1 | 0.882352941 |
| PTPRZ1 AND DRAM2 | 0.9375 | 1 | 0.882352941 |
| PTPRZ1 AND C1orf162 | 0.9375 | 1 | 0.882352941 |
| PTPRZ1 AND NOT-TBC1D20 | 0.9375 | 1 | 0.882352941 |
| PTPRZ1 AND NOT-PIGU | 0.9375 | 1 | 0.882352941 |
| PTPRZ1 AND EMID1 | 0.903225806 | 1 | 0.823529412 |
| PTPRZ1 AND NOT-MBOAT2 | 0.9375 | 1 | 0.882352941 |
| PTPRZ1 AND NOT-TMEM18 | 0.903225806 | 1 | 0.823529412 |
| PTPRZ1 AND NOT-SGPP2 | 0.903225806 | 1 | 0.823529412 |
| PTPRZ1 AND NOT-ACVR1C | 0.903225806 | 1 | 0.823529412 |
| PTPRZ1 AND NOT-TMEM178A | 0.903225806 | 1 | 0.823529412 |
| PTPRZ1 AND NOT-COL17A1 | 0.9375 | 1 | 0.882352941 |
| PTPRZ1 AND COMT | 0.903225806 | 1 | 0.823529412 |
| PTPRZ1 AND NOT-TMEM42 | 0.9375 | 1 | 0.882352941 |
| PTPRZ1 AND NOT-SLC31A1 | 0.903225806 | 1 | 0.823529412 |
| PTPRZ1 AND NOT-SLC31A2 | 0.903225806 | 1 | 0.823529412 |
| PTPRZ1 AND NOT-SYNPR | 0.903225806 | 1 | 0.823529412 |
| PTPRZ1 AND NOT-SLC9B2 | 0.903225806 | 1 | 0.823529412 |
| PTPRZ1 AND B3GAT2 | 0.903225806 | 1 | 0.823529412 |
| PTPRZ1 AND NOT-TMEM68 | 0.9375 | 1 | 0.882352941 |
| PTPRZ1 AND NOT-HGSNAT | 0.9375 | 1 | 0.882352941 |
| PTPRZ1 AND NOT-FAM69B | 0.9375 | 1 | 0.882352941 |
| PTPRZ1 AND NOT-SLITRK4 | 0.903225806 | 1 | 0.823529412 |
| PTPRZ1 AND PTCHD1 | 0.9375 | 1 | 0.882352941 |
| LTBP3 AND NOT-SELM | 0.909090909 | 0.9375 | 0.882352941 |
| PTPRZ1 AND NOT-SELM | 0.9375 | 1 | 0.882352941 |
| PTPRZ1 AND ROMO1 | 0.9375 | 1 | 0.882352941 |
| PTPRZ1 AND NOT-CRY2 | 0.9375 | 1 | 0.882352941 |
| TPST1 AND NOT-CRY2 | 0.903225806 | 1 | 0.823529412 |
| PTPRZ1 AND ADORA3 | 0.903225806 | 1 | 0.823529412 |
| PTPRZ1 AND SAMD8 | 0.9375 | 1 | 0.882352941 |
| PTPRZ1 AND NOT-FAM76B | 0.9375 | 1 | 0.882352941 |
| PTPRZ1 AND CSF1R | 0.903225806 | 1 | 0.823529412 |
| PTPRZ1 AND NOT-ALG10B | 0.9375 | 1 | 0.882352941 |
| PTPRZ1 AND B3GLCT | 0.903225806 | 1 | 0.823529412 |
| PTPRZ1 AND NOT-CMTM4 | 0.9375 | 1 | 0.882352941 |
| PTPRZ1 AND NOT-RBFOX3 | 0.903225806 | 1 | 0.823529412 |

| Antigen Pair Logic | F1 | Precision | Recall |
|---|---|---|---|
| CHRNA3 AND NOT-NAT8L | 0.936708861 | 1 | 0.880952381 |
| CHRNA3 AND NOT-SLC6A19 | 0.950617284 | 0.987179487 | 0.916666667 |
| CHRNA3 AND NOT-VSIG1 | 0.950617284 | 0.987179487 | 0.916666667 |
| CHRNA3 AND NOT-GLDN | 0.943396226 | 1 | 0.892857143 |
| CHRNA3 AND NOT-AQP8 | 0.956521739 | 1 | 0.916666667 |
| CHRNA3 AND NOT-ATP13A5 | 0.950617284 | 0.987179487 | 0.916666667 |
| CHRNA3 AND NOT-IFNB1 | 0.956521739 | 1 | 0.916666667 |
| CHRNA3 AND NOT-MOGAT3 | 0.950617284 | 0.987179487 | 0.916666667 |
| CHRNA3 AND NOT-CATSPER3 | 0.950617284 | 0.987179487 | 0.916666667 |
| CHRNA3 AND NOT-FAM159A | 0.950617284 | 0.987179487 | 0.916666667 |
| CHRNA3 AND NOT-HCN1 | 0.950617284 | 0.987179487 | 0.916666667 |
| CHRNA3 AND NOT-IHH | 0.950617284 | 0.987179487 | 0.916666667 |
| CHRNA3 AND NOT-FASLG | 0.950617284 | 0.987179487 | 0.916666667 |
| CHRNA3 AND NOT-IL6R | 0.950617284 | 0.987179487 | 0.916666667 |
| CHRNA3 AND NOT-IL12B | 0.950617284 | 0.987179487 | 0.916666667 |
| CHRNA3 AND NOT-IL12RB2 | 0.950617284 | 0.987179487 | 0.916666667 |
| CHRNA3 AND NOT-AQP4 | 0.956521739 | 1 | 0.916666667 |
| CHRNA3 AND NOT-AQP5 | 0.950617284 | 0.987179487 | 0.916666667 |
| CHRNA3 AND NOT-ITGA9 | 0.950617284 | 0.987179487 | 0.916666667 |
| CHRNA3 AND NOT-ITGAD | 0.950617284 | 0.987179487 | 0.916666667 |
| CHRNA3 AND NOT-ITGB3 | 0.95 | 1 | 0.904761905 |
| CHRNA3 AND NOT-ITGB6 | 0.943396226 | 1 | 0.892857143 |
| CHRNA3 AND NOT-ITPR2 | 0.950617284 | 0.987179487 | 0.916666667 |
| CHRNA3 AND NOT-ITPR3 | 0.950617284 | 0.987179487 | 0.916666667 |
| CHRNA3 AND NOT-KCNA1 | 0.956521739 | 1 | 0.916666667 |
| CHRNA3 AND NOT-KCNA2 | 0.956521739 | 1 | 0.916666667 |
| CHRNA3 AND NOT-KCNA5 | 0.950617284 | 0.987179487 | 0.916666667 |
| CHRNA3 AND NOT-KCNA6 | 0.950617284 | 0.987179487 | 0.916666667 |
| CHRNA3 AND NOT-GALNT18 | 0.956521739 | 1 | 0.916666667 |
| CHRNA3 AND NOT-KCNC1 | 0.95 | 1 | 0.904761905 |
| CHRNA3 AND NOT-SPEM1 | 0.950617284 | 0.987179487 | 0.916666667 |
| CHRNA3 AND NOT-KCNC2 | 0.950617284 | 0.987179487 | 0.916666667 |
| CHRNA3 AND NOT-KCNC3 | 0.950617284 | 0.987179487 | 0.916666667 |
| CHRNA3 AND NOT-C1orf95 | 0.936708861 | 1 | 0.880952381 |
| CHRNA3 AND NOT-KCND1 | 0.950617284 | 0.987179487 | 0.916666667 |
| CHRNA3 AND NOT-KCND3 | 0.950617284 | 0.987179487 | 0.916666667 |
| CHRNA3 AND NOT-KCNE1 | 0.950617284 | 0.987179487 | 0.916666667 |
| CHRNA3 AND NOT-LHFPL3 | 0.956521739 | 1 | 0.916666667 |
| CHRNA3 AND NOT-PNPLA7 | 0.950617284 | 0.987179487 | 0.916666667 |
| CHRNA3 AND NOT-KCNJ1 | 0.950617284 | 0.987179487 | 0.916666667 |
| CHRNA3 AND NOT-KCNJ4 | 0.950617284 | 0.987179487 | 0.916666667 |
| CHRNA3 AND NOT-KCNJ6 | 0.950617284 | 0.987179487 | 0.916666667 |
| CHRNA3 AND NOT-KCNJ9 | 0.956521739 | 1 | 0.916666667 |
| CHRNA3 AND NOT-KCNJ10 | 0.956521739 | 1 | 0.916666667 |
| CHRNA3 AND NOT-KCNJ11 | 0.950617284 | 0.987179487 | 0.916666667 |
| CHRNA3 AND NOT-KCNJ13 | 0.950617284 | 0.987179487 | 0.916666667 |
| CHRNA3 AND NOT-KCNJ14 | 0.950617284 | 0.987179487 | 0.916666667 |
| CHRNA3 AND NOT-KCNK1 | 0.950617284 | 0.987179487 | 0.916666667 |
| CHRNA3 AND NOT-KCNK2 | 0.950617284 | 0.987179487 | 0.916666667 |
| CHRNA3 AND NOT-KCNMA1 | 0.950617284 | 0.987179487 | 0.916666667 |
| CHRNA3 AND NOT-KCNN3 | 0.95 | 1 | 0.904761905 |
| CHRNA3 AND NOT-KCNS1 | 0.950617284 | 0.987179487 | 0.916666667 |
| CHRNA3 AND NOT-KCNS2 | 0.95 | 1 | 0.904761905 |
| CHRNA3 AND NOT-KEL | 0.950617284 | 0.987179487 | 0.916666667 |
| CHRNA3 AND NOT-KIR2DL4 | 0.950617284 | 0.987179487 | 0.916666667 |
| CHRNA3 AND NOT-KRT5 | 0.950617284 | 0.987179487 | 0.916666667 |
| CHRNA3 AND NOT-C10orf99 | 0.950617284 | 0.987179487 | 0.916666667 |
| CHRNA3 AND NOT-CLEC12B | 0.950617284 | 0.987179487 | 0.916666667 |
| CHRNA3 AND NOT-SCIMP | 0.950617284 | 0.987179487 | 0.916666667 |
| CHRNA3 AND NOT-RPRML | 0.950617284 | 0.987179487 | 0.916666667 |
| CHRNA3 AND NOT-RGS9BP | 0.950617284 | 0.987179487 | 0.916666667 |
| CHRNA3 AND NOT-FAM132A | 0.950617284 | 0.987179487 | 0.916666667 |
| CHRNA3 AND NOT-FAM209B | 0.950617284 | 0.987179487 | 0.916666667 |
| CHRNA3 AND NOT-SPATA31D1 | 0.956521739 | 1 | 0.916666667 |
| CHRNA3 AND NOT-OR51B6 | 0.950617284 | 0.987179487 | 0.916666667 |
| CHRNA3 AND NOT-OR51I1 | 0.943396226 | 1 | 0.892857143 |
| CHRNA3 AND NOT-OR51I2 | 0.950617284 | 0.987179487 | 0.916666667 |
| CHRNA3 AND NOT-OR52D1 | 0.950617284 | 0.987179487 | 0.916666667 |
| CHRNA3 AND NOT-OR7A10 | 0.936708861 | 1 | 0.880952381 |
| CHRNA3 AND NOT-LCT | 0.950617284 | 0.987179487 | 0.916666667 |
| CHRNA3 AND NOT-LETM1 | 0.950617284 | 0.987179487 | 0.916666667 |
| CHRNA3 AND NOT-LHCGR | 0.950617284 | 0.987179487 | 0.916666667 |
| CHRNA3 AND NOT-LIM2 | 0.950617284 | 0.987179487 | 0.916666667 |
| CHRNA3 AND NOT-FADS3 | 0.950617284 | 0.987179487 | 0.916666667 |
| CHRNA3 AND NOT-C11orf87 | 0.956521739 | 1 | 0.916666667 |
| CHRNA3 AND NOT-C14orf180 | 0.950617284 | 0.987179487 | 0.916666667 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-ANKRD29 | 0.903225806 | 1 | 0.823529412 | CHRNA3 AND NOT-LMO7 | 0.950617284 | 0.987179487 | 0.916666667 |
| PTPRZ1 AND NOT-APCDD1 | 0.9375 | 1 | 0.882352941 | CHRNA3 AND NOT-HACD4 | 0.950617284 | 0.987179487 | 0.916666667 |
| PTPRZ1 AND NOT-SMIM17 | 0.903225806 | 1 | 0.823529412 | CHRNA3 AND NOT-XKRX | 0.950617284 | 0.987179487 | 0.916666667 |
| PTPRZ1 AND NOT-MFSD4 | 0.903225806 | 1 | 0.823529412 | CHRNA3 AND NOT-IFITM10 | 0.950617284 | 0.987179487 | 0.916666667 |
| PTPRZ1 AND NOT-SLC30A7 | 0.9375 | 1 | 0.882352941 | CHRNA3 AND NOT-LRP2 | 0.950617284 | 0.987179487 | 0.916666667 |
| PTPRZ1 AND CTNS | 0.903225806 | 1 | 0.823529412 | CHRNA3 AND NOT-LRP4 | 0.95 | 1 | 0.904761905 |
| PTPRZ1 AND NOT-KANSL1L | 0.9375 | 1 | 0.882352941 | CHRNA3 AND NOT-HAPLN4 | 0.956521739 | 1 | 0.916666667 |
| PTPRZ1 AND NOT-RMDN2 | 0.9375 | 1 | 0.882352941 | CHRNA3 AND NOT-SPINK6 | 0.956521739 | 1 | 0.916666667 |
| PTPRZ1 AND NOT-GPR155 | 0.9375 | 1 | 0.882352941 | CHRNA3 AND NOT-LSAMP | 0.95 | 1 | 0.904761905 |
| PTPRZ1 AND NOT-XXYLT1 | 0.9375 | 1 | 0.882352941 | CHRNA3 AND NOT-MAL | 0.95 | 1 | 0.904761905 |
| PTPRZ1 AND NOT-CUX1 | 0.903225806 | 1 | 0.823529412 | CHRNA3 AND NOT-STS | 0.956521739 | 1 | 0.916666667 |
| PTPRZ1 AND IGSF11 | 0.9375 | 1 | 0.882352941 | CHRNA3 AND NOT-LCN10 | 0.943396226 | 1 | 0.892857143 |
| PTPRZ1 AND PAQR3 | 0.903225806 | 1 | 0.823529412 | CHRNA3 AND NOT-MC5R | 0.950617284 | 0.987179487 | 0.916666667 |
| PTPRZ1 AND NOT-CXADR | 0.9375 | 1 | 0.882352941 | CHRNA3 AND NOT-CD46 | 0.950617284 | 0.987179487 | 0.916666667 |
| PTPRZ1 AND NOT-CYB5A | 0.903225806 | 1 | 0.823529412 | CHRNA3 AND NOT-ADAM11 | 0.950617284 | 0.987179487 | 0.916666667 |
| PTPRZ1 AND NOT-ADRA2C | 0.9375 | 1 | 0.882352941 | CHRNA3 AND NOT-MEP1B | 0.950617284 | 0.987179487 | 0.916666667 |
| PTPRZ1 AND NOT-CYB561 | 0.9375 | 1 | 0.882352941 | CHRNA3 AND NOT-MGAT3 | 0.950617284 | 0.987179487 | 0.916666667 |
| PTPRZ1 AND CYBA | 0.903225806 | 1 | 0.823529412 | CHRNA3 AND NOT-CTAGE5 | 0.950617284 | 0.987179487 | 0.916666667 |
| PTPRZ1 AND NOT-RNF145 | 0.9375 | 1 | 0.882352941 | CHRNA3 AND NOT-MGST2 | 0.950617284 | 0.987179487 | 0.916666667 |
| PTPRZ1 AND NOT-ADRB1 | 0.903225806 | 1 | 0.823529412 | CHRNA3 AND NOT-MIP | 0.950617284 | 0.987179487 | 0.916666667 |
| PTPRZ1 AND NOT-SLC2A12 | 0.9375 | 1 | 0.882352941 | CHRNA3 AND NOT-TRPM1 | 0.950617284 | 0.987179487 | 0.916666667 |
| PTPRZ1 AND NOT-RNF217 | 0.9375 | 1 | 0.882352941 | CHRNA3 AND NOT-MME | 0.95 | 1 | 0.904761905 |
| NRCAM AND NOT-CLEC2L | 0.903225806 | 1 | 0.823529412 | CHRNA3 AND NOT-MOG | 0.956521739 | 1 | 0.916666667 |
| PIPRZ1 AND NOT-CLEC2L | 0.9375 | 1 | 0.882352941 | CHRNA3 AND NOT-LRRC52 | 0.956521739 | 1 | 0.916666667 |
| PTPRZ1 AND NOT-TMEM65 | 0.9375 | 1 | 0.882352941 | MARCH11 AND CHRNA3 | 0.952380952 | 0.952380952 | 0.952380952 |
| PTPRZ1 AND RDH10 | 0.903225806 | 1 | 0.823529412 | CHRNA3 AND NOT-OR2B3 | 0.950617284 | 0.987179487 | 0.916666667 |
| PTPRZ1 AND NOT-MOSPD2 | 0.903225806 | 1 | 0.823529412 | CHRNA3 AND NOT-OR14J1 | 0.950617284 | 0.987179487 | 0.916666667 |
| PTPRZ1 AND NOT-FAM134C | 0.9375 | 1 | 0.882352941 | CHRNA3 AND NOT-OR10C1 | 0.950617284 | 0.987179487 | 0.916666667 |
| PTPRZ1 AND NOT-CNST | 0.903225806 | 1 | 0.823529412 | CHRNA3 AND NOT-PTCHD4 | 0.950617284 | 0.987179487 | 0.916666667 |
| PTPRZ1 AND NOT-TMEM64 | 0.9375 | 1 | 0.882352941 | CHRNA3 AND NOT-MTHFD1 | 0.950617284 | 0.987179487 | 0.916666667 |
| PTPRZ1 AND NOT-SPTSSA | 0.903225806 | 1 | 0.823529412 | CHRNA3 AND NOT-MTNR1A | 0.950617284 | 0.987179487 | 0.916666667 |
| PTPRZ1 AND NOT-ABHD3 | 0.9375 | 1 | 0.882352941 | CHRNA3 AND NOT-MUC1 | 0.950617284 | 0.987179487 | 0.916666667 |
| PTPRZ1 AND NOT-DHCR7 | 0.903225806 | 1 | 0.823529412 | CHRNA3 AND NOT-ATP1A2 | 0.956521739 | 1 | 0.916666667 |
| PTPRZ1 AND DSCAM | 0.903225806 | 1 | 0.823529412 | CHRNA3 AND NOT-ATP12A | 0.950617284 | 0.987179487 | 0.916666667 |
| PTPRZ1 AND DTNA | 0.9375 | 1 | 0.882352941 | CHRNA3 AND NOT-NINJ2 | 0.950617284 | 0.987179487 | 0.916666667 |
| PTPRZ1 AND NOT-AGTR1 | 0.9375 | 1 | 0.882352941 | CHRNA3 AND NOT-NMBR | 0.950617284 | 0.987179487 | 0.916666667 |
| PTPRZ1 AND GPR183 | 0.903225806 | 1 | 0.823529412 | CHRNA3 AND NOT-NOTCH2 | 0.950617284 | 0.987179487 | 0.916666667 |
| PTPRZ1 AND NOT-LPAR1 | 0.903225806 | 1 | 0.823529412 | CHRNA3 AND NOT-NPHS1 | 0.950617284 | 0.987179487 | 0.916666667 |
| PTPRZ1 AND EDNRB | 0.9375 | 1 | 0.882352941 | CHRNA3 AND NOT-NPY5R | 0.950617284 | 0.987179487 | 0.916666667 |
| PTPRZ1 AND NOT-HIGD2A | 0.9375 | 1 | 0.882352941 | CHRNA3 AND NOT-NTRK2 | 0.956521739 | 1 | 0.916666667 |
| PTPRZ1 AND NOT-CELSR2 | 0.903225806 | 1 | 0.823529412 | CHRNA3 AND NOT-ATP2B2 | 0.956521739 | 1 | 0.916666667 |
| PTPRZ1 AND NOT-MPZL3 | 0.9375 | 1 | 0.882352941 | CHRNA3 AND NOT-NTSR1 | 0.950617284 | 0.987179487 | 0.916666667 |
| PTPRZ1 AND ABCA1 | 0.903225806 | 1 | 0.823529412 | CHRNA3 AND NOT-ATP2B3 | 0.936708861 | 1 | 0.880952381 |
| PTPRZ1 AND EMP1 | 0.903225806 | 1 | 0.823529412 | CHRNA3 AND NOT-GPR143 | 0.950617284 | 0.987179487 | 0.916666667 |
| PTPRZ1 AND NOT-EMP2 | 0.9375 | 1 | 0.882352941 | CHRNA3 AND NOT-OMG | 0.95 | 1 | 0.904761905 |
| TPST1 AND NOT-EMP2 | 0.903225806 | 1 | 0.823529412 | CHRNA3 AND NOT-OPCML | 0.956521739 | 1 | 0.916666667 |
| PTPRZ1 AND NOT-SMIM14 | 0.9375 | 1 | 0.882352941 | CHRNA3 AND NOT-OPRK1 | 0.950617284 | 0.987179487 | 0.916666667 |
| NOT-PTPRZ1 AND PTPRZ1 | 0.9375 | 1 | 0.882352941 | CHRNA3 AND NOT-OR1D2 | 0.950617284 | 0.987179487 | 0.916666667 |
| PTPRZ1 AND NOT-SLC25A43 | 0.9375 | 1 | 0.882352941 | CHRNA3 AND NOT-OR1F1 | 0.950617284 | 0.987179487 | 0.916666667 |
| PTPRZ1 AND NOT-EPHA1 | 0.9375 | 1 | 0.882352941 | CHRNA3 AND NOT-OR2C1 | 0.950617284 | 0.987179487 | 0.916666667 |
| PTPRZ1 AND NOT-CERS3 | 0.9375 | 1 | 0.882352941 | CHRNA3 AND NOT-CLDN11 | 0.950617284 | 0.987179487 | 0.916666667 |
| PTPRZ1 AND NOT-EPHA7 | 0.903225806 | 1 | 0.823529412 | CHRNA3 AND NOT-P2RY1 | 0.950617284 | 0.987179487 | 0.916666667 |
| PTPRZ1 AND NOT-EPHB6 | 0.903225806 | 1 | 0.823529412 | CHRNA3 AND NOT-P2RY2 | 0.950617284 | 0.987179487 | 0.916666667 |
| PTPRZ1 AND NOT-CLN8 | 0.903225806 | 1 | 0.823529412 | CHRNA3 AND NOT-GALNT9 | 0.950617284 | 0.987179487 | 0.916666667 |
| PTPRZ1 AND NOT-ETV6 | 0.9375 | 1 | 0.882352941 | CHRNA3 AND NOT-IL22 | 0.950617284 | 0.987179487 | 0.916666667 |
| PTPRZ1 AND NOT-EVI2A | 0.903225806 | 1 | 0.823529412 | CHRNA3 AND NOT-ANO7 | 0.950617284 | 0.987179487 | 0.916666667 |
| PTPRZ1 AND NOT-EXTL2 | 0.9375 | 1 | 0.882352941 | CHRNA3 AND NOT-TAS2R3 | 0.950617284 | 0.987179487 | 0.916666667 |
| PTPRZ1 AND NOT-F10 | 0.9375 | 1 | 0.882352941 | CHRNA3 AND NOT-TAS2R9 | 0.950617284 | 0.987179487 | 0.916666667 |
| PTPRZ1 AND NOT-FAAH | 0.903225806 | 1 | 0.823529412 | CHRNA3 AND NOT-TAS2R8 | 0.950617284 | 0.987179487 | 0.916666667 |
| PTPRZ1 AND NOT-ACSL1 | 0.903225806 | 1 | 0.823529412 | CHRNA3 AND NOT-TAS2R7 | 0.950617284 | 0.987179487 | 0.916666667 |
| PTPRZ1 AND NOT-FAT1 | 0.9375 | 1 | 0.882352941 | CHRNA3 AND NOT-TAS2R13 | 0.950617284 | 0.987179487 | 0.916666667 |
| PTPRZ1 AND NOT-FAT2 | 0.9375 | 1 | 0.882352941 | CHRNA3 AND NOT-NTM | 0.956521739 | 1 | 0.916666667 |
| PTPRZ1 AND MPEG1 | 0.903225806 | 1 | 0.823529412 | CHRNA3 AND NOT-IMPG2 | 0.950617284 | 0.987179487 | 0.916666667 |
| PTPRZ1 AND ABCA3 | 0.903225806 | 1 | 0.823529412 | CHRNA3 AND NOT-PCDH1 | 0.950617284 | 0.987179487 | 0.916666667 |
| PTPRZ1 AND CYB561A3 | 0.9375 | 1 | 0.882352941 | CHRNA3 AND NOT-SLC45A2 | 0.956521739 | 1 | 0.916666667 |
| PTPRZ1 AND HEPACAM | 0.9375 | 1 | 0.882352941 | CHRNA3 AND NOT-CLDN18 | 0.950617284 | 0.987179487 | 0.916666667 |
| PTPRZ1 AND SLC16A9 | 0.9375 | 1 | 0.882352941 | CHRNA3 AND NOT-CLEC1A | 0.95 | 1 | 0.904761905 |
| PTPRZ1 AND NOT-MARCH8 | 0.9375 | 1 | 0.882352941 | CHRNA3 AND NOT-RXFP3 | 0.950617284 | 0.987179487 | 0.916666667 |
| PTPRZ1 AND NOT-SLC39A12 | 0.903225806 | 1 | 0.823529412 | CHRNA3 AND NOT-GCNT4 | 0.950617284 | 0.987179487 | 0.916666667 |
| PTPRZ1 AND NOT-C6orf136 | 0.9375 | 1 | 0.882352941 | CHRNA3 AND NOT-KCNK9 | 0.950617284 | 0.987179487 | 0.916666667 |
| PTPRZ1 AND FKTN | 0.9375 | 1 | 0.882352941 | CHRNA3 AND NOT-PDCD1 | 0.950617284 | 0.987179487 | 0.916666667 |
| PTPRZ1 AND NOT-THSD7A | 0.9375 | 1 | 0.882352941 | CHRNA3 AND NOT-CHST15 | 0.950617284 | 0.987179487 | 0.916666667 |
| PTPRZ1 AND TMED4 | 0.903225806 | 1 | 0.823529412 | CHRNA3 AND NOT-WNT16 | 0.950617284 | 0.987179487 | 0.916666667 |
| GPM6A AND NOT-TMEM130 | 0.903225806 | 1 | 0.823529412 | CHRNA3 AND NOT-RHCG | 0.950617284 | 0.987179487 | 0.916666667 |
| PTPRZ1 AND NOT-TMEM130 | 0.903225806 | 1 | 0.823529412 | CHRNA3 AND NOT-ENPP3 | 0.943396226 | 1 | 0.892857143 |
| PTPRZ1 AND NOT-ALDH3A2 | 0.9375 | 1 | 0.882352941 | CHRNA3 AND NOT-GHRL | 0.950617284 | 0.987179487 | 0.916666667 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-FGFR2 | 0.9375 | 1 | 0.882352941 | CHRNA3 AND NOT-CD244 | 0.950617284 | 0.987179487 | 0.916666667 |
| PTPRZ1 AND NLGN1 | 0.9375 | 1 | 0.882352941 | CHRNA3 AND NOT-ASIC5 | 0.950617284 | 0.987179487 | 0.916666667 |
| NRCAM AND NOT-CLSTN1 | 0.903225806 | 1 | 0.823529412 | CHRNA3 AND NOT-ATP8B1 | 0.950617284 | 0.987179487 | 0.916666667 |
| PTPRZ1 AND NOT-CLSTN1 | 0.903225806 | 1 | 0.823529412 | CHRNA3 AND PFN2 | 0.950617284 | 0.987179487 | 0.916666667 |
| PTPRZ1 AND NOT-PCNX | 0.9375 | 1 | 0.882352941 | CHRNA3 AND SLC25A3 | 0.956521739 | 1 | 0.916666667 |
| PTPRZ1 AND KLHDC10 | 0.9375 | 1 | 0.882352941 | CHRNA3 AND NOT-PHEX | 0.950617284 | 0.987179487 | 0.916666667 |
| PTPRZ1 AND NOT-FAIM2 | 0.903225806 | 1 | 0.823529412 | CHRNA3 AND NOT-SERPINB13 | 0.950617284 | 0.987179487 | 0.916666667 |
| PTPRZ1 AND NFASC | 0.903225806 | 1 | 0.823529412 | CHRNA3 AND NOT-IL17D | 0.950617284 | 0.987179487 | 0.916666667 |
| PTPRZ1 AND ANKLE2 | 0.903225806 | 1 | 0.823529412 | CHRNA3 AND NOT-TM6SF2 | 0.950617284 | 0.987179487 | 0.916666667 |
| PTPRZ1 AND NOT-LRCH1 | 0.9375 | 1 | 0.882352941 | CHRNA3 AND NOT-LRP1B | 0.950617284 | 0.987179487 | 0.916666667 |
| PTPRZ1 AND GRAMD4 | 0.9375 | 1 | 0.882352941 | CHRNA3 AND NOT-TPCN1 | 0.950617284 | 0.987179487 | 0.916666667 |
| PTPRZ1 AND STAB1 | 0.903225806 | 1 | 0.823529412 | CHRNA3 AND NOT-FXYD4 | 0.950617284 | 0.987179487 | 0.916666667 |
| PTPRZ1 AND SYT11 | 0.9375 | 1 | 0.882352941 | CHRNA3 AND NOT-FGFRL1 | 0.950617284 | 0.987179487 | 0.916666667 |
| PTPRZ1 AND MLC1 | 0.903225806 | 1 | 0.823529412 | CHRNA3 AND NOT-DUOX1 | 0.950617284 | 0.987179487 | 0.916666667 |
| PTPRZ1 AND ASTN2 | 0.9375 | 1 | 0.882352941 | CHRNA3 AND NOT-SLCO1C1 | 0.950617284 | 0.987179487 | 0.916666667 |
| PTPRZ1 AND WSCD1 | 0.903225806 | 1 | 0.823529412 | CHRNA3 AND NOT-SMIM11 | 0.950617284 | 0.987179487 | 0.916666667 |
| PTPRZ1 AND NOT-DNAJC16 | 0.9375 | 1 | 0.882352941 | CHRNA3 AND NOT-GPR88 | 0.950617284 | 0.987179487 | 0.916666667 |
| PTPRZ1 AND NOT-ESYT1 | 0.903225806 | 1 | 0.823529412 | CHRNA3 AND SLC38A2 | 0.936708861 | 1 | 0.880952381 |
| PTPRZ1 AND NOT-SLC35A3 | 0.9375 | 1 | 0.882352941 | CHRNA3 AND NOT-RNF186 | 0.950617284 | 0.987179487 | 0.916666667 |
| PTPRZ1 AND NOT-ABCB10 | 0.9375 | 1 | 0.882352941 | CHRNA3 AND NOT-DLL4 | 0.950617284 | 0.987179487 | 0.916666667 |
| PTPRZ1 AND NPTXR | 0.903225806 | 1 | 0.823529412 | CHRNA3 AND NOT-UGT1A8 | 0.950617284 | 0.987179487 | 0.916666667 |
| PTPRZ1 AND TRAM1 | 0.9375 | 1 | 0.882352941 | CHRNA3 AND NOT-VSIG10 | 0.950617284 | 0.987179487 | 0.916666667 |
| PTPRZ1 AND NOT-LEPROTL1 | 0.9375 | 1 | 0.882352941 | CHRNA3 AND NOT-DCHS2 | 0.956521739 | 1 | 0.916666667 |
| PTPRZ1 AND NOT-PIGN | 0.9375 | 1 | 0.882352941 | CHRNA3 AND NOT-SIDT1 | 0.943396226 | 1 | 0.892857143 |
| PTPRZ1 AND FPR1 | 0.9375 | 1 | 0.882352941 | CHRNA3 AND NOT-GDPD2 | 0.936708861 | 1 | 0.880952381 |
| PTPRZ1 AND SLC7A11 | 0.9375 | 1 | 0.882352941 | CHRNA3 AND NOT-MS4A12 | 0.950617284 | 0.987179487 | 0.916666667 |
| PTPRZ1 AND CADM1 | 0.9375 | 1 | 0.882352941 | CHRNA3 AND NOT-DNAJC25 | 0.950617284 | 0.987179487 | 0.916666667 |
| PTPRZ1 AND NOT-TMEM245 | 0.9375 | 1 | 0.882352941 | CHRNA3 AND NOT-RETSAT | 0.950617284 | 0.987179487 | 0.916666667 |
| PTPRZ1 AND NOT-EML2 | 0.9375 | 1 | 0.882352941 | CHRNA3 AND NOT-PQLC2 | 0.950617284 | 0.987179487 | 0.916666667 |
| PTPRZ1 AND PANX1 | 0.903225806 | 1 | 0.823529412 | CHRNA3 AND NOT-C1orf159 | 0.950617284 | 0.987179487 | 0.916666667 |
| PTPRZ1 AND NOT-FUT8 | 0.9375 | 1 | 0.882352941 | CHRNA3 AND NOT-SLC52A1 | 0.950617284 | 0.987179487 | 0.916666667 |
| PTPRZ1 AND NOT-EPHX4 | 0.903225806 | 1 | 0.823529412 | CHRNA3 AND NOT-PPP1R3A | 0.950617284 | 0.987179487 | 0.916666667 |
| PTPRZ1 AND NOT-KDSR | 0.9375 | 1 | 0.882352941 | CHRNA3 AND NOT-KIRREL | 0.950617284 | 0.987179487 | 0.916666667 |
| PTPRZ1 AND NOT-ACKR1 | 0.903225806 | 1 | 0.823529412 | CHRNA3 AND NOT-TMEM39A | 0.950617284 | 0.987179487 | 0.916666667 |
| PTPRZ1 AND CADM2 | 0.903225806 | 1 | 0.823529412 | CHRNA3 AND NOT-TMEM143 | 0.950617284 | 0.987179487 | 0.916666667 |
| NRCAM AND NOT-LPCAT4 | 0.903225806 | 1 | 0.823529412 | CHRNA3 AND NOT-AVPR1A | 0.950617284 | 0.987179487 | 0.916666667 |
| PTPRZ1 AND NOT-LPCAT4 | 0.9375 | 1 | 0.882352941 | CHRNA3 AND NOT-TMEM144 | 0.95 | 1 | 0.904761905 |
| PTPRZ1 AND NOT-TMEM256 | 0.903225806 | 1 | 0.823529412 | CHRNA3 AND NOT-VNN3 | 0.950617284 | 0.987179487 | 0.916666667 |
| PTPRZ1 AND NOT-GABRA4 | 0.903225806 | 1 | 0.823529412 | CHRNA3 AND NOT-LGR4 | 0.950617284 | 0.987179487 | 0.916666667 |
| NRCAM AND NOT-GABRB2 | 0.903225806 | 1 | 0.823529412 | CHRNA3 AND NOT-AVPR1B | 0.950617284 | 0.987179487 | 0.916666667 |
| PTPRZ1 AND NOT-GABRB2 | 0.903225806 | 1 | 0.823529412 | CHRNA3 AND NOT-ST6GALNAC1 | 0.950617284 | 0.987179487 | 0.916666667 |
| NRCAM AND NOT-GABRD | 0.903225806 | 1 | 0.823529412 | CHRNA3 AND NOT-GABRQ | 0.943396226 | 1 | 0.892857143 |
| PTPRZ1 AND NOT-MFSD8 | 0.903225806 | 1 | 0.823529412 | CHRNA3 AND NOT-GPRC5C | 0.950617284 | 0.987179487 | 0.916666667 |
| PTPRZ1 AND NOT-GABRG1 | 0.903225806 | 1 | 0.823529412 | CHRNA3 AND NOT-TMEM234 | 0.950617284 | 0.987179487 | 0.916666667 |
| PTPRZ1 AND NOT-KIAA1549L | 0.9375 | 1 | 0.882352941 | CHRNA3 AND NOT-PCDHGC5 | 0.950617284 | 0.987179487 | 0.916666667 |
| PTPRZ1 AND NOT-SUN2 | 0.903225806 | 1 | 0.823529412 | CHRNA3 AND NOT-PCDHGC4 | 0.950617284 | 0.987179487 | 0.916666667 |
| PTPRZ1 AND SLC39A6 | 0.9375 | 1 | 0.882352941 | CHRNA3 AND NOT-PCDHGA10 | 0.950617284 | 0.987179487 | 0.916666667 |
| PTPRZ1 AND NOT-GALC | 0.9375 | 1 | 0.882352941 | CHRNA3 AND NOT-PCDHGA9 | 0.950617284 | 0.987179487 | 0.916666667 |
| PTPRZ1 AND NOT-TMEM184B | 0.9375 | 1 | 0.882352941 | CHRNA3 AND NOT-PCDHB9 | 0.950617284 | 0.987179487 | 0.916666667 |
| PTPRZ1 AND NOT-YIPF3 | 0.9375 | 1 | 0.882352941 | CHRNA3 AND NOT-PCDHAC2 | 0.950617284 | 0.987179487 | 0.916666667 |
| PTPRZ1 AND NOT-PARM1 | 0.903225806 | 1 | 0.823529412 | CHRNA3 AND NOT-PCDHAC1 | 0.950617284 | 0.987179487 | 0.916666667 |
| PTPRZ1 AND NOT-ABHD14A | 0.903225806 | 1 | 0.823529412 | CHRNA3 AND NOT-BTNL2 | 0.950617284 | 0.987179487 | 0.916666667 |
| PTPRZ1 AND NOT-GALNS | 0.9375 | 1 | 0.882352941 | CHRNA3 AND NOT-SLC7A10 | 0.956521739 | 1 | 0.916666667 |
| PTPRZ1 AND NOT-GALNT3 | 0.9375 | 1 | 0.882352941 | CHRNA3 AND NOT-TMPRSS4 | 0.950617284 | 0.987179487 | 0.916666667 |
| PTPRZ1 AND NOT-ZDHHC5 | 0.9375 | 1 | 0.882352941 | CHRNA3 AND NOT-CLDND1 | 0.950617284 | 0.987179487 | 0.916666667 |
| PTPRZ1 AND NOT-NALCN | 0.903225806 | 1 | 0.823529412 | CHRNA3 AND NOT-KCNK13 | 0.950617284 | 0.987179487 | 0.916666667 |
| PTPRZ1 AND NOT-PVRL3 | 0.903225806 | 1 | 0.823529412 | CHRNA3 AND NOT-PANX2 | 0.950617284 | 0.987179487 | 0.916666667 |
| PTPRZ1 AND NOT-PNKD | 0.903225806 | 1 | 0.823529412 | CHRNA3 AND NOT-MUC13 | 0.950617284 | 0.987179487 | 0.916666667 |
| PTPRZ1 AND NOT-ADGRA2 | 0.9375 | 1 | 0.882352941 | CHRNA3 AND NOT-AGPAT3 | 0.956521739 | 1 | 0.916666667 |
| PTPRZ1 AND NOT-CYP4X1 | 0.903225806 | 1 | 0.823529412 | CHRNA3 AND NOT-OTOR | 0.936708861 | 1 | 0.880952381 |
| PTPRZ1 AND NOT-SUSD5 | 0.903225806 | 1 | 0.823529412 | CHRNA3 AND NOT-C2orf83 | 0.936708861 | 1 | 0.880952381 |
| PTPRZ1 AND NOT-GLCE | 0.9375 | 1 | 0.882352941 | CHRNA3 AND NOT-NMUR2 | 0.950617284 | 0.987179487 | 0.916666667 |
| PTPRZ1 AND LRRTM2 | 0.9375 | 1 | 0.882352941 | CHRNA3 AND NOT-GPR108 | 0.950617284 | 0.987179487 | 0.916666667 |
| PTPRZ1 AND NOT-CNTNAP2 | 0.903225806 | 1 | 0.823529412 | CHRNA3 AND NOT-PYY | 0.950617284 | 0.987179487 | 0.916666667 |
| PTPRZ1 AND NOT-SLITRK5 | 0.903225806 | 1 | 0.823529412 | CHRNA3 AND NOT-ANO2 | 0.950617284 | 0.987179487 | 0.916666667 |
| PTPRZ1 AND GIMAP2 | 0.903225806 | 1 | 0.823529412 | CHRNA3 AND NOT-TRPC7 | 0.950617284 | 0.987179487 | 0.916666667 |
| PTPRZ1 AND NOT-NPHP4 | 0.903225806 | 1 | 0.823529412 | CHRNA3 AND NOT-JPH2 | 0.950617284 | 0.987179487 | 0.916666667 |
| PTPRZ1 AND TMEM251 | 0.903225806 | 1 | 0.823529412 | CHRNA3 AND NOT-GJC2 | 0.943396226 | 1 | 0.892857143 |
| PTPRZ1 AND NOT-FAM162A | 0.9375 | 1 | 0.882352941 | CHRNA3 AND NOT-SLC45A4 | 0.950617284 | 0.987179487 | 0.916666667 |
| NRCAM AND NOT-SEZ6L2 | 0.903225806 | 1 | 0.823529412 | CHRNA3 AND NOT-TAS2R38 | 0.950617284 | 0.987179487 | 0.916666667 |
| PTPRZ1 AND NOT-CNNM4 | 0.9375 | 1 | 0.882352941 | CHRNA3 AND NOT-PTGDR | 0.950617284 | 0.987179487 | 0.916666667 |
| PTPRZ1 AND NOT-MYOF | 0.9375 | 1 | 0.882352941 | CHRNA3 AND NOT-DSCAML1 | 0.950617284 | 0.987179487 | 0.916666667 |
| NRCAM AND NOT-HS6ST3 | 0.903225806 | 1 | 0.823529412 | CHRNA3 AND NOT-HHATL | 0.956521739 | 1 | 0.916666667 |
| PTPRZ1 AND NOT-HS6ST3 | 0.903225806 | 1 | 0.823529412 | CHRNA3 AND NOT-SORCS2 | 0.950617284 | 0.987179487 | 0.916666667 |
| PTPRZ1 AND AMFR | 0.903225806 | 1 | 0.823529412 | CHRNA3 AND NOT-PTCHD2 | 0.950617284 | 0.987179487 | 0.916666667 |
| PTPRZ1 AND NOT-GJA1 | 0.9375 | 1 | 0.882352941 | CHRNA3 AND NOT-NCEH1 | 0.950617284 | 0.987179487 | 0.916666667 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-SEC22A | 0.903225806 | 1 | 0.823529412 | CHRNA3 AND NOT-ADGRB1 | 0.950617284 | 0.987179487 | 0.916666667 |
| PTPRZ1 AND NOT-ATP2C1 | 0.9375 | 1 | 0.882352941 | CHRNA3 AND NOT-DPP10 | 0.936708861 | 1 | 0.880952381 |
| PTPRZ1 AND NOT-GHITM | 0.903225806 | 1 | 0.823529412 | CHRNA3 AND NOT-G6PC2 | 0.950617284 | 0.987179487 | 0.916666667 |
| PTPRZ1 AND NOT-GJB2 | 0.9375 | 1 | 0.882352941 | CHRNA3 AND NOT-CATSPERG | 0.950617284 | 0.987179487 | 0.916666667 |
| PTPRZ1 AND NOT-NAAA | 0.9375 | 1 | 0.882352941 | CHRNA3 AND NOT-SLC46A2 | 0.950617284 | 0.987179487 | 0.916666667 |
| PTPRZ1 AND PCDH17 | 0.903225806 | 1 | 0.823529412 | CHRNA3 AND NOT-PVRL2 | 0.950617284 | 0.987179487 | 0.916666667 |
| PTPRZ1 AND NOT-GCLC | 0.9375 | 1 | 0.882352941 | CHRNA3 AND NOT-LY6G6D | 0.950617284 | 0.987179487 | 0.916666667 |
| PTPRZ1 AND GOLIM4 | 0.903225806 | 1 | 0.823529412 | CHRNA3 AND NOT-ACE2 | 0.956521739 | 1 | 0.916666667 |
| PTPRZ1 AND NOT-TMEM97 | 0.9375 | 1 | 0.882352941 | CHRNA3 AND NOT-CACNG8 | 0.950617284 | 0.987179487 | 0.916666667 |
| PTPRZ1 AND NOT-TOR1B | 0.903225806 | 1 | 0.823529412 | CHRNA3 AND NOT-CACNG7 | 0.950617284 | 0.987179487 | 0.916666667 |
| PTPRZ1 AND NOT-TOR2A | 0.9375 | 1 | 0.882352941 | CHRNA3 AND NOT-CACNG6 | 0.943396226 | 1 | 0.892857143 |
| PTPRZ1 AND NOT-GLRB | 0.903225806 | 1 | 0.823529412 | CHRNA3 AND NOT-HRH4 | 0.950617284 | 0.987179487 | 0.916666667 |
| PTPRZ1 AND NOT-GPD2 | 0.903225806 | 1 | 0.823529412 | CHRNA3 AND NOT-EDA2R | 0.950617284 | 0.987179487 | 0.916666667 |
| PTPRZ1 AND NOT-SLCO4A1 | 0.9375 | 1 | 0.882352941 | CHRNA3 AND NOT-CDH26 | 0.950617284 | 0.987179487 | 0.916666667 |
| PTPRZ1 AND SLCO1B3 | 0.903225806 | 1 | 0.823529412 | CHRNA3 AND NOT-NYX | 0.950617284 | 0.987179487 | 0.916666667 |
| PTPRZ1 AND GPM6B | 0.903225806 | 1 | 0.823529412 | CHRNA3 AND NOT-KCNK15 | 0.950617284 | 0.987179487 | 0.916666667 |
| GPM6B AND GAL3ST4 | 0.914285714 | 0.88888889 | 0.941176471 | CHRNA3 AND NOT-ROS1 | 0.950617284 | 0.987179487 | 0.916666667 |
| PTPRZ1 AND NOT-AQP11 | 0.9375 | 1 | 0.882352941 | CHRNA3 AND NOT-CTXN3 | 0.956521739 | 1 | 0.916666667 |
| PTPRZ1 AND NOT-BRICD5 | 0.903225806 | 1 | 0.823529412 | CHRNA3 AND NOT-RRBP1 | 0.950617284 | 0.987179487 | 0.916666667 |
| PTPRZ1 AND NOT-ANG | 0.9375 | 1 | 0.882352941 | CHRNA3 AND NOT-SLC22A23 | 0.950617284 | 0.987179487 | 0.916666667 |
| PTPRZ1 AND NOT-PIGW | 0.9375 | 1 | 0.882352941 | CHRNA3 AND NOT-SCN1A | 0.956521739 | 1 | 0.916666667 |
| PTPRZ1 AND NOT-GDPD1 | 0.903225806 | 1 | 0.823529412 | CHRNA3 AND NOT-SCN1B | 0.936708861 | 1 | 0.880952381 |
| PTPRZ1 AND NOT-GPR22 | 0.903225806 | 1 | 0.823529412 | CHRNA3 AND NOT-SCN4A | 0.950617284 | 0.987179487 | 0.916666667 |
| PTPRZ1 AND NOT-CYB561D1 | 0.9375 | 1 | 0.882352941 | CHRNA3 AND NOT-SCN4B | 0.936708861 | 1 | 0.880952381 |
| PTPRZ1 AND NOT-RNF149 | 0.9375 | 1 | 0.882352941 | CHRNA3 AND NOT-SCN8A | 0.950617284 | 0.987179487 | 0.916666667 |
| PTPRZ1 AND NOT-GPR26 | 0.903225806 | 1 | 0.823529412 | CHRNA3 AND NOT-SCN10A | 0.950617284 | 0.987179487 | 0.916666667 |
| PTPRZ1 AND NOT-EOGT | 0.9375 | 1 | 0.882352941 | CHRNA3 AND NOT-SCNN1A | 0.950617284 | 0.987179487 | 0.916666667 |
| PTPRZ1 AND NOT-CYP4V2 | 0.9375 | 1 | 0.882352941 | CHRNA3 AND NOT-SCNN1B | 0.950617284 | 0.987179487 | 0.916666667 |
| PTPRZ1 AND GPR34 | 0.903225806 | 1 | 0.823529412 | CHRNA3 AND NOT-SCNN1D | 0.950617284 | 0.987179487 | 0.916666667 |
| PTPRZ1 AND XKR6 | 0.903225806 | 1 | 0.823529412 | CHRNA3 AND NOT-SCNN1G | 0.950617284 | 0.987179487 | 0.916666667 |
| PTPRZ1 AND NOT-MICU3 | 0.9375 | 1 | 0.882352941 | CHRNA3 AND NOT-CEACAM1 | 0.950617284 | 0.987179487 | 0.916666667 |
| PTPRZ1 AND GPR37 | 0.903225806 | 1 | 0.823529412 | CHRNA3 AND NOT-CX3CL1 | 0.956521739 | 1 | 0.916666667 |
| PTPRZ1 AND NOT-MLNR | 0.9375 | 1 | 0.882352941 | CHRNA3 AND NOT-63914? | 0.950617284 | 0.987179487 | 0.916666667 |
| PTPRZ1 AND NOT-YIPF6 | 0.903225806 | 1 | 0.823529412 | CHRNA3 AND NOT-CDH23 | 0.950617284 | 0.987179487 | 0.916666667 |
| PTPRZ1 AND GRIA3 | 0.9375 | 1 | 0.882352941 | CHRNA3 AND NOT-TNMD | 0.950617284 | 0.987179487 | 0.916666667 |
| PTPRZ1 AND NOT-DEXI | 0.9375 | 1 | 0.882352941 | CHRNA3 AND NOT-XYLT1 | 0.950617284 | 0.987179487 | 0.916666667 |
| PTPRZ1 AND TMEM176B | 0.903225806 | 1 | 0.823529412 | CHRNA3 AND NOT-ROBO3 | 0.950617284 | 0.987179487 | 0.916666667 |
| PTPRZ1 AND NOT-OSTM1 | 0.9375 | 1 | 0.882352941 | CHRNA3 AND NOT-MS4A5 | 0.95 | 1 | 0.904761905 |
| PTPRZ1 AND NOT-FLVCR1 | 0.903225806 | 1 | 0.823529412 | CHRNA3 AND NOT-CCDC168 | 0.950617284 | 0.987179487 | 0.916666667 |
| PTPRZ1 AND NOT-MAGEH1 | 0.903225806 | 1 | 0.823529412 | CHRNA3 AND NOT-WBSCR17 | 0.956521739 | 1 | 0.916666667 |
| PTPRZ1 AND GRIK2 | 0.903225806 | 1 | 0.823529412 | CHRNA3 AND NOT-SFTPC | 0.950617284 | 0.987179487 | 0.916666667 |
| PTPRZ1 AND NOT-GRIN2A | 0.903225806 | 1 | 0.823529412 | CHRNA3 AND NOT-SFTPD | 0.950617284 | 0.987179487 | 0.916666667 |
| PTPRZ1 AND GRIN2C | 0.903225806 | 1 | 0.823529412 | CHRNA3 AND NOT-SGCA | 0.950617284 | 0.987179487 | 0.916666667 |
| PTPRZ1 AND NOT-ORMDL2 | 0.9375 | 1 | 0.882352941 | CHRNA3 AND NOT-SGCD | 0.950617284 | 0.987179487 | 0.916666667 |
| PTPRZ1 AND NOT-DNAJC15 | 0.903225806 | 1 | 0.823529412 | CHRNA3 AND NOT-SMIM10 | 0.950617284 | 0.987179487 | 0.916666667 |
| PTPRZ1 AND NOT-GRM3 | 0.903225806 | 1 | 0.823529412 | CHRNA3 AND NOT-CSMD1 | 0.950617284 | 0.987179487 | 0.916666667 |
| PTPRZ1 AND NOT-GRM5 | 0.903225806 | 1 | 0.823529412 | CHRNA3 AND NOT-NDST4 | 0.956521739 | 1 | 0.916666667 |
| PTPRZ1 AND NOT-GRM7 | 0.9375 | 1 | 0.882352941 | CHRNA3 AND NOT-GPR135 | 0.950617284 | 0.987179487 | 0.916666667 |
| PTPRZ1 AND NOT-UBIAD1 | 0.903225806 | 1 | 0.823529412 | CHRNA3 AND NOT-SYNDIG1L | 0.95 | 1 | 0.904761905 |
| PTPRZ1 AND NOT-TRHDE | 0.903225806 | 1 | 0.823529412 | CHRNA3 AND NOT-CTAGE1 | 0.950617284 | 0.987179487 | 0.916666667 |
| PTPRZ1 AND CERS2 | 0.9375 | 1 | 0.882352941 | CHRNA3 AND NOT-SHH | 0.950617284 | 0.987179487 | 0.916666667 |
| PTPRZ1 AND NOT-SLC2A8 | 0.903225806 | 1 | 0.823529412 | CHRNA3 AND NOT-LMF1 | 0.956521739 | 1 | 0.916666667 |
| PTPRZ1 AND NOT-HAS1 | 0.9375 | 1 | 0.882352941 | CHRNA3 AND NOT-SLC13A3 | 0.950617284 | 0.987179487 | 0.916666667 |
| PTPRZ1 AND NOT-HDAC2 | 0.9375 | 1 | 0.882352941 | CHRNA3 AND NOT-ST3GAL4 | 0.950617284 | 0.987179487 | 0.916666667 |
| PTPRZ1 AND NOT-ST6GALNAC6 | 0.903225806 | 1 | 0.823529412 | CHRNA3 AND NOT-LRRC19 | 0.956521739 | 1 | 0.916666667 |
| PTPRZ1 AND HLA-B | 0.9375 | 1 | 0.882352941 | CHRNA3 AND NOT-SLAMF1 | 0.950617284 | 0.987179487 | 0.916666667 |
| PTPRZ1 AND HLA-DMA | 0.903225806 | 1 | 0.823529412 | CHRNA3 AND NOT-SLC1A3 | 0.950617284 | 0.987179487 | 0.916666667 |
| PTPRZ1 AND HLA-DMB | 0.903225806 | 1 | 0.823529412 | CHRNA3 AND NOT-SLC4A3 | 0.95 | 1 | 0.904761905 |
| PTPRZ1 AND HLA-DRA | 0.903225806 | 1 | 0.823529412 | CHRNA3 AND NOT-SLC1A7 | 0.950617284 | 0.987179487 | 0.916666667 |
| PTPRZ1 AND HLA-DRB1 | 0.903225806 | 1 | 0.823529412 | CHRNA3 AND NOT-SLC2A4 | 0.950617284 | 0.987179487 | 0.916666667 |
| PTPRZ1 AND HLA-F | 0.903225806 | 1 | 0.823529412 | CHRNA3 AND NOT-PCDH15 | 0.950617284 | 0.987179487 | 0.916666667 |
| PTPRZ1 AND NOT-HMOX2 | 0.9375 | 1 | 0.882352941 | CHRNA3 AND NOT-SLC5A1 | 0.950617284 | 0.987179487 | 0.916666667 |
| PTPRZ1 AND NOT-NDST1 | 0.9375 | 1 | 0.882352941 | CHRNA3 AND NOT-SLC5A4 | 0.950617284 | 0.987179487 | 0.916666667 |
| PTPRZ1 AND APLP2 | 0.9375 | 1 | 0.882352941 | CHRNA3 AND NOT-SLC6A1 | 0.956521739 | 1 | 0.916666667 |
| PTPRZ1 AND NOT-HTR2A | 0.903225806 | 1 | 0.823529412 | CHRNA3 AND NOT-SLC6A4 | 0.95 | 1 | 0.904761905 |
| TNC AND NOT-AOC3 | 0.903225806 | 1 | 0.823529412 | CHRNA3 AND NOT-SLC6A12 | 0.950617284 | 0.987179487 | 0.916666667 |
| PTPRZ1 AND TMEM119 | 0.903225806 | 1 | 0.823529412 | CHRNA3 AND NOT-SLC6A13 | 0.950617284 | 0.987179487 | 0.916666667 |
| PTPRZ1 AND NOT-FAM19A2 | 0.903225806 | 1 | 0.823529412 | CHRNA3 AND NOT-SLC8A2 | 0.950617284 | 0.987179487 | 0.916666667 |
| PTPRZ1 AND NOT-NAT8L | 0.9375 | 1 | 0.882352941 | CHRNA3 AND NOT-LRTM2 | 0.956521739 | 1 | 0.916666667 |
| PTPRZ1 AND TSPAN33 | 0.903225806 | 1 | 0.823529412 | CHRNA3 AND NOT-SLC8A3 | 0.950617284 | 0.987179487 | 0.916666667 |
| PTPRZ1 AND APOC1 | 0.9375 | 1 | 0.882352941 | CHRNA3 AND NOT-SLC9A2 | 0.950617284 | 0.987179487 | 0.916666667 |
| PTPRZ1 AND NOT-FAM174A | 0.9375 | 1 | 0.882352941 | CHRNA3 AND NOT-SLC9A5 | 0.950617284 | 0.987179487 | 0.916666667 |
| PTPRZ1 AND IGF1R | 0.9375 | 1 | 0.882352941 | CHRNA3 AND NOT-SLC12A3 | 0.950617284 | 0.987179487 | 0.916666667 |
| PTPRZ1 AND NOT-HCN1 | 0.903225806 | 1 | 0.823529412 | CHRNA3 AND NOT-SLC13A1 | 0.950617284 | 0.987179487 | 0.916666667 |
| PTPRZ1 AND NOT-SLCO4C1 | 0.903225806 | 1 | 0.823529412 | CHRNA3 AND NOT-SLC15A2 | 0.956521739 | 1 | 0.916666667 |
| PTPRZ1 AND NOT-IL1R1 | 0.9375 | 1 | 0.882352941 | CHRNA3 AND NOT-SLC34A1 | 0.950617284 | 0.987179487 | 0.916666667 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-IL4R | 0.9375 | 1 | 0.882352941 | CHRNA3 AND NOT-SLC22A2 | 0.950617284 | 0.987179487 | 0.916666667 |
| PTPRZ1 AND IL6R | 0.903225806 | 1 | 0.823529412 | CHRNA3 AND NOT-CYP4F12 | 0.943396226 | 1 | 0.892857143 |
| PTPRZ1 AND IL10RA | 0.903225806 | 1 | 0.823529412 | CHRNA3 AND NOT-SOX1 | 0.950617284 | 0.987179487 | 0.916666667 |
| PTPRZ1 AND IL13RA1 | 0.903225806 | 1 | 0.823529412 | CHRNA3 AND NOT-SPAM1 | 0.950617284 | 0.987179487 | 0.916666667 |
| PTPRZ1 AND NOT-IL15RA | 0.9375 | 1 | 0.882352941 | CHRNA3 AND NOT-SPINK2 | 0.950617284 | 0.987179487 | 0.916666667 |
| PTPRZ1 AND NOT-AQP3 | 0.903225806 | 1 | 0.823529412 | CHRNA3 AND NOT-SPN | 0.950617284 | 0.987179487 | 0.916666667 |
| PTPRZ1 AND AQP4 | 0.9375 | 1 | 0.882352941 | CHRNA3 AND NOT-SSTR3 | 0.950617284 | 0.987179487 | 0.916666667 |
| PTPRZ1 AND NOT-INPP4A | 0.9375 | 1 | 0.882352941 | CHRNA3 AND NOT-SSTR5 | 0.950617284 | 0.987179487 | 0.916666667 |
| PTPRZ1 AND NOT-INSIG1 | 0.903225806 | 1 | 0.823529412 | CHRNA3 AND NOT-BRS3 | 0.950617284 | 0.987179487 | 0.916666667 |
| PTPRZ1 AND NOT-AQP7 | 0.9375 | 1 | 0.882352941 | CHRNA3 AND NOT-VAMP1 | 0.95 | 1 | 0.904761905 |
| PTPRZ1 AND ITGA2 | 0.9375 | 1 | 0.882352941 | CHRNA3 AND NOT-SYPL1 | 0.950617284 | 0.987179487 | 0.916666667 |
| PTPRZ1 AND ITGAM | 0.903225806 | 1 | 0.823529412 | CHRNA3 AND NOT-TACR2 | 0.950617284 | 0.987179487 | 0.916666667 |
| PTPRZ1 AND NOT-JAG2 | 0.9375 | 1 | 0.882352941 | CHRNA3 AND NOT-TACR1 | 0.950617284 | 0.987179487 | 0.916666667 |
| PTPRZ1 AND NOT-KCNA1 | 0.903225806 | 1 | 0.823529412 | CHRNA3 AND NOT-TAZ | 0.950617284 | 0.987179487 | 0.916666667 |
| PTPRZ1 AND TMEM179B | 0.903225806 | 1 | 0.823529412 | CHRNA3 AND NOT-TGFA | 0.950617284 | 0.987179487 | 0.916666667 |
| PTPRZ1 AND NOT-KCNB1 | 0.9375 | 1 | 0.882352941 | CHRNA3 AND NOT-ICAM5 | 0.950617284 | 0.987179487 | 0.916666667 |
| PTPRZ1 AND NOT-KCNC1 | 0.9375 | 1 | 0.882352941 | CHRNA3 AND NOT-TRHR | 0.950617284 | 0.987179487 | 0.916666667 |
| NOT-PTPRZ1 AND PTPRZ1 | 0.9375 | 1 | 0.882352941 | CHRNA3 AND NOT-TRPC3 | 0.956521739 | 1 | 0.916666667 |
| PTPRZ1 AND NOT-TMEM205 | 0.9375 | 1 | 0.882352941 | CHRNA3 AND NOT-TRPC4 | 0.95 | 1 | 0.904761905 |
| PTPRZ1 AND NOT-FAM73A | 0.9375 | 1 | 0.882352941 | CHRNA3 AND NOT-TRPC5 | 0.950617284 | 0.987179487 | 0.916666667 |
| PTPRZ1 AND NOT-MIA3 | 0.9375 | 1 | 0.882352941 | CHRNA3 AND NOT-TRPC6 | 0.950617284 | 0.987179487 | 0.916666667 |
| PTPRZ1 AND NOT-C1orf95 | 0.9375 | 1 | 0.882352941 | CHRNA3 AND NOT-TLCD2 | 0.950617284 | 0.987179487 | 0.916666667 |
| PTPRZ1 AND LHFPL4 | 0.9375 | 1 | 0.882352941 | CHRNA3 AND NOT-TYR | 0.956521739 | 1 | 0.916666667 |
| PTPRZ1 AND LHFPL3 | 0.903225806 | 1 | 0.823529412 | CHRNA3 AND NOT-TYRO3 | 0.950617284 | 0.987179487 | 0.916666667 |
| PTPRZ1 AND NOT-ENHO | 0.9375 | 1 | 0.882352941 | CHRNA3 AND NOT-UPK1B | 0.95 | 1 | 0.904761905 |
| NRCAM AND NOT-KCNJ3 | 0.903225806 | 1 | 0.823529412 | CHRNA3 AND NOT-UGT8 | 0.936708861 | 1 | 0.880952381 |
| PTPRZ1 AND NOT-KCNJ6 | 0.9375 | 1 | 0.882352941 | CHRNA3 AND NOT-UMOD | 0.950617284 | 0.987179487 | 0.916666667 |
| NOT-PTPRZ1 AND PTPRZ1 | 0.9375 | 1 | 0.882352941 | CHRNA3 AND NOT-UPK3A | 0.950617284 | 0.987179487 | 0.916666667 |
| PTPRZ1 AND KCNJ8 | 0.903225806 | 1 | 0.823529412 | CHRNA3 AND NOT-VIPR2 | 0.950617284 | 0.987179487 | 0.916666667 |
| PTPRZ1 AND KCNJ10 | 0.9375 | 1 | 0.882352941 | CHRNA3 AND NOT-BEST1 | 0.950617284 | 0.987179487 | 0.916666667 |
| PTPRZ1 AND NOT-KCNN2 | 0.903225806 | 1 | 0.823529412 | CHRNA3 AND NOT-MYRF | 0.950617284 | 0.987179487 | 0.916666667 |
| PTPRZ1 AND NOT-GPR153 | 0.9375 | 1 | 0.882352941 | CHRNA3 AND NOT-WNT1 | 0.950617284 | 0.987179487 | 0.916666667 |
| PTPRZ1 AND C10orf99 | 0.9375 | 1 | 0.882352941 | CHRNA3 AND NOT-WNT7B | 0.950617284 | 0.987179487 | 0.916666667 |
| PTPRZ1 AND NOT-SHISA2 | 0.903225806 | 1 | 0.823529412 | CHRNA3 AND NOT-WNT11 | 0.950617284 | 0.987179487 | 0.916666667 |
| PTPRZ1 AND GLTPD2 | 0.903225806 | 1 | 0.823529412 | CHRNA3 AND NOT-XG | 0.950617284 | 0.987179487 | 0.916666667 |
| PTPRZ1 AND NOT-USP27X | 0.9375 | 1 | 0.882352941 | CHRNA3 AND NOT-CA12 | 0.95 | 1 | 0.904761905 |
| PTPRZ1 AND OR51B6 | 0.903225806 | 1 | 0.823529412 | CHRNA3 AND NOT-CACNA1A | 0.95 | 1 | 0.904761905 |
| PTPRZ1 AND NOT-LAMP1 | 0.9375 | 1 | 0.882352941 | CHRNA3 AND NOT-CACNA1C | 0.950617284 | 0.987179487 | 0.916666667 |
| PTPRZ1 AND NOT-LDLR | 0.9375 | 1 | 0.882352941 | CHRNA3 AND NOT-SLC30A2 | 0.950617284 | 0.987179487 | 0.916666667 |
| PTPRZ1 AND NOT-LEPR | 0.9375 | 1 | 0.882352941 | CHRNA3 AND NOT-CACNA1F | 0.950617284 | 0.987179487 | 0.916666667 |
| PTPRZ1 AND NOT-TMEM200B | 0.9375 | 1 | 0.882352941 | CHRNA3 AND NOT-CACNA1S | 0.950617284 | 0.987179487 | 0.916666667 |
| NRCAM AND NOT-C11orf87 | 0.903225806 | 1 | 0.823529412 | CHRNA3 AND NOT-BSND | 0.936708861 | 1 | 0.880952381 |
| PTPRZ1 AND NOT-C11orf87 | 0.9375 | 1 | 0.882352941 | CHRNA3 AND NOT-NPHS2 | 0.950617284 | 0.987179487 | 0.916666667 |
| PTPRZ1 AND NOT-LMO7 | 0.903225806 | 1 | 0.823529412 | CHRNA3 AND NOT-RNF103 | 0.950617284 | 0.987179487 | 0.916666667 |
| PTPRZ1 AND NOT-C3orf80 | 0.903225806 | 1 | 0.823529412 | CHRNA3 AND NOT-CACNG1 | 0.936708861 | 1 | 0.880952381 |
| PTPRZ1 AND NOT-C4orf3 | 0.9375 | 1 | 0.882352941 | CHRNA3 AND NOT-SLC25A20 | 0.950617284 | 0.987179487 | 0.916666667 |
| PTPRZ1 AND NOT-LRP3 | 0.9375 | 1 | 0.882352941 | CHRNA3 AND NOT-SMIM2 | 0.950617284 | 0.987179487 | 0.916666667 |
| PTPRZ1 AND NOT-LRP4 | 0.903225806 | 1 | 0.823529412 | CHRNA3 AND NOT-FA2H | 0.956521739 | 1 | 0.916666667 |
| PTPRZ1 AND LTBP3 | 0.903225806 | 1 | 0.823529412 | CHRNA3 AND NOT-OR51B4 | 0.95 | 1 | 0.904761905 |
| LTBP3 AND NOT-DNAJC1 | 0.9375 | 1 | 0.882352941 | CHRNA3 AND NOT-OR51B2 | 0.950617284 | 0.987179487 | 0.916666667 |
| PTPRZ1 AND NOT-LY75 | 0.9375 | 1 | 0.882352941 | CHRNA3 AND NOT-NOX5 | 0.950617284 | 0.987179487 | 0.916666667 |
| PTPRZ1 AND NOT-TM4SF1 | 0.903225806 | 1 | 0.823529412 | CHRNA3 AND NOT-ACSS3 | 0.950617284 | 0.987179487 | 0.916666667 |
| PTPRZ1 AND NOT-EPCAM | 0.903225806 | 1 | 0.823529412 | CHRNA3 AND NOT-ZDHHC14 | 0.95 | 1 | 0.904761905 |
| PTPRZ1 AND NOT-FAM19A1 | 0.903225806 | 1 | 0.823529412 | CHRNA3 AND NOT-STEAP4 | 0.950617284 | 0.987179487 | 0.916666667 |
| PTPRZ1 AND NOT-MAN1A1 | 0.9375 | 1 | 0.882352941 | CHRNA3 AND NOT-MCTP1 | 0.950617284 | 0.987179487 | 0.916666667 |
| PTPRZ1 AND NOT-STS | 0.9375 | 1 | 0.882352941 | CHRNA3 AND NOT-HHIPL2 | 0.950617284 | 0.987179487 | 0.916666667 |
| PTPRZ1 AND MARS | 0.903225806 | 1 | 0.823529412 | CHRNA3 AND NOT-NIPAL2 | 0.950617284 | 0.987179487 | 0.916666667 |
| NRCAM AND NOT-ADAM11 | 0.903225806 | 1 | 0.823529412 | CHRNA3 AND NOT-ST7 | 0.950617284 | 0.987179487 | 0.916666667 |
| PTPRZ1 AND NOT-DNAJB9 | 0.9375 | 1 | 0.882352941 | CHRNA3 AND NOT-TMC5 | 0.956521739 | 1 | 0.916666667 |
| PTPRZ1 AND MFAP3 | 0.903225806 | 1 | 0.823529412 | CHRNA3 AND NOT-ZDHHC11 | 0.950617284 | 0.987179487 | 0.916666667 |
| PTPRZ1 AND NOT-MGAT5 | 0.9375 | 1 | 0.882352941 | CHRNA3 AND NOT-TM4SF20 | 0.95 | 1 | 0.904761905 |
| PTPRZ1 AND NOT-MGST1 | 0.9375 | 1 | 0.882352941 | CHRNA3 AND NOT-THSD4 | 0.943396226 | 1 | 0.892857143 |
| PTPRZ1 AND CD99 | 0.9375 | 1 | 0.882352941 | CHRNA3 AND NOT-TMC7 | 0.950617284 | 0.987179487 | 0.916666667 |
| PTPRZ1 AND NOT-MID1 | 0.903225806 | 1 | 0.823529412 | CHRNA3 AND NOT-BTNL8 | 0.950617284 | 0.987179487 | 0.916666667 |
| PTPRZ1 AND MMP16 | 0.903225806 | 1 | 0.823529412 | CHRNA3 AND NOT-PAQR6 | 0.956521739 | 1 | 0.916666667 |
| PTPRZ1 AND NOT-ALDH6A1 | 0.9375 | 1 | 0.882352941 | CHRNA3 AND NOT-WLS | 0.950617284 | 0.987179487 | 0.916666667 |
| PTPRZ1 AND NOT-MXRA7 | 0.9375 | 1 | 0.882352941 | CHRNA3 AND NOT-CPED1 | 0.950617284 | 0.987179487 | 0.916666667 |
| PTPRZ1 AND NOT-MINOS1 | 0.903225806 | 1 | 0.823529412 | CHRNA3 AND NOT-GLRA3 | 0.956521739 | 1 | 0.916666667 |
| NRCAM AND NOT-TMEM151B | 0.903225806 | 1 | 0.823529412 | CHRNA3 AND NOT-LRRC8E | 0.950617284 | 0.987179487 | 0.916666667 |
| PTPRZ1 AND FAM26F | 0.903225806 | 1 | 0.823529412 | CHRNA3 AND NOT-CWH43 | 0.950617284 | 0.987179487 | 0.916666667 |
| PTPRZ1 AND NOT-ASPH | 0.9375 | 1 | 0.882352941 | CHRNA3 AND NOT-TMEM254 | 0.950617284 | 0.987179487 | 0.916666667 |
| PTPRZ1 AND NOT-MSMB | 0.9375 | 1 | 0.882352941 | CHRNA3 AND NOT-ALPK1 | 0.950617284 | 0.987179487 | 0.916666667 |
| PTPRZ1 AND NOT-MST1R | 0.9375 | 1 | 0.882352941 | CHRNA3 AND NOT-SLC35F5 | 0.950617284 | 0.987179487 | 0.916666667 |
| PTPRZ1 AND ASTN1 | 0.9375 | 1 | 0.882352941 | CHRNA3 AND NOT-DNAJC5 | 0.950617284 | 0.987179487 | 0.916666667 |
| PTPRZ1 AND NCAM1 | 0.9375 | 1 | 0.882352941 | CHRNA3 AND NOT-BPIFB2 | 0.95 | 1 | 0.904761905 |
| PTPRZ1 AND NOT-NDUFA1 | 0.9375 | 1 | 0.882352941 | CHRNA3 AND NOT-PDCD1LG2 | 0.950617284 | 0.987179487 | 0.916666667 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-NDUFB1 | 0.9375 | 1 | 0.882352941 | CHRNA3 AND NOT-SLC44A4 | 0.950617284 | 0.987179487 | 0.916666667 |
| PTPRZ1 AND NOT-NDUFB8 | 0.9375 | 1 | 0.882352941 | CHRNA3 AND NOT-LY6G5C | 0.950617284 | 0.987179487 | 0.916666667 |
| PTPRZ1 AND NOT-NEO1 | 0.9375 | 1 | 0.882352941 | CHRNA3 AND NOT-UPK3B | 0.950617284 | 0.987179487 | 0.916666667 |
| PTPRZ1 AND ATP1A2 | 0.9375 | 1 | 0.882352941 | CHRNA3 AND NOT-TAS1R1 | 0.950617284 | 0.987179487 | 0.916666667 |
| PTPRZ1 AND NMB | 0.903225806 | 1 | 0.823529412 | CHRNA3 AND NOT-TMPRSS5 | 0.950617284 | 0.987179487 | 0.916666667 |
| PTPRZ1 AND ATP1B2 | 0.9375 | 1 | 0.882352941 | CHRNA3 AND NOT-KCNH6 | 0.950617284 | 0.987179487 | 0.916666667 |
| PTPRZ1 AND ATP2A2 | 0.9375 | 1 | 0.882352941 | CHRNA3 AND NOT-OR2C3 | 0.95 | 1 | 0.904761905 |
| NRCAM AND NOT-CALY | 0.903225806 | 1 | 0.823529412 | CHRNA3 AND NOT-ACSBG2 | 0.950617284 | 0.987179487 | 0.916666667 |
| NRCAM AND NOT-TMEM63C | 0.903225806 | 1 | 0.823529412 | CHRNA3 AND NOT-DEFB126 | 0.950617284 | 0.987179487 | 0.916666667 |
| NRCAM AND NOT-SLC9A7 | 0.903225806 | 1 | 0.823529412 | CHRNA3 AND NOT-OR5V1 | 0.950617284 | 0.987179487 | 0.916666667 |
| NRCAM AND NOT-GABBR2 | 0.903225806 | 1 | 0.823529412 | CHRNA3 AND NOT-OR2B2 | 0.950617284 | 0.987179487 | 0.916666667 |
| PTPRZ1 AND NOT-ATP2B1 | 0.903225806 | 1 | 0.823529412 | CHRNA3 AND NOT-SLC14A2 | 0.943396226 | 1 | 0.892857143 |
| PTPRZ1 AND NOT-ATP2B2 | 0.903225806 | 1 | 0.823529412 | CHRNA3 AND NOT-OR12D3 | 0.950617284 | 0.987179487 | 0.916666667 |
| PTPRZ1 AND NOT-ATP2B3 | 0.9375 | 1 | 0.882352941 | CHRNA3 AND NOT-SPACA1 | 0.950617284 | 0.987179487 | 0.916666667 |
| PTPRZ1 AND NOT-SLC22A18 | 0.903225806 | 1 | 0.823529412 | CHRNA3 AND NOT-SLC10A3 | 0.950617284 | 0.987179487 | 0.916666667 |
| PTPRZ1 AND NOT-CLDN11 | 0.9375 | 1 | 0.882352941 | CHRNA3 AND NOT-FZD9 | 0.950617284 | 0.987179487 | 0.916666667 |
| PTPRZ1 AND P2RY1 | 0.903225806 | 1 | 0.823529412 | CHRNA3 AND NOT-ELOVL3 | 0.950617284 | 0.987179487 | 0.916666667 |
| PTPRZ1 AND NOT-CALY | 0.903225806 | 1 | 0.823529412 | CHRNA3 AND NOT-FCRL4 | 0.950617284 | 0.987179487 | 0.916666667 |
| PTPRZ1 AND NOT-F11R | 0.9375 | 1 | 0.882352941 | CHRNA3 AND NOT-SLC25A31 | 0.95 | 1 | 0.904761905 |
| PTPRZ1 AND CLEC4A | 0.9375 | 1 | 0.882352941 | CHRNA3 AND NOT-CHST9 | 0.950617284 | 0.987179487 | 0.916666667 |
| PTPRZ1 AND TMED5 | 0.9375 | 1 | 0.882352941 | CHRNA3 AND NOT-GPR101 | 0.950617284 | 0.987179487 | 0.916666667 |
| PTPRZ1 AND NOT-SLC35B3 | 0.9375 | 1 | 0.882352941 | CHRNA3 AND NOT-CD99L2 | 0.956521739 | 1 | 0.916666667 |
| PTPRZ1 AND SLC35C2 | 0.903225806 | 1 | 0.823529412 | CHRNA3 AND NOT-SLC25A18 | 0.950617284 | 0.987179487 | 0.916666667 |
| PTPRZ1 AND PCDH8 | 0.9375 | 1 | 0.882352941 | CHRNA3 AND NOT-SYT15 | 0.950617284 | 0.987179487 | 0.916666667 |
| PTPRZ1 AND NOT-PCDH9 | 0.903225806 | 1 | 0.823529412 | CHRNA3 AND NOT-SPATA9 | 0.950617284 | 0.987179487 | 0.916666667 |
| PTPRZ1 AND NOT-GOLT1B | 0.903225806 | 1 | 0.823529412 | CHRNA3 AND NOT-OR1G1 | 0.950617284 | 0.987179487 | 0.916666667 |
| PTPRZ1 AND NOT-ST8SIA3 | 0.903225806 | 1 | 0.823529412 | CHRNA3 AND NOT-SLC4A11 | 0.950617284 | 0.987179487 | 0.916666667 |
| PTPRZ1 AND NDUFA13 | 0.9375 | 1 | 0.882352941 | CHRNA3 AND NOT-KREMEN1 | 0.950617284 | 0.987179487 | 0.916666667 |
| PTPRZ1 AND GAL | 0.903225806 | 1 | 0.823529412 | CHRNA3 AND NOT-PLA2G10 | 0.950617284 | 0.987179487 | 0.916666667 |
| PTPRZ1 AND NOT-SIDT2 | 0.903225806 | 1 | 0.823529412 | CHRNA3 AND NOT-USP48 | 0.950617284 | 0.987179487 | 0.916666667 |
| PTPRZ1 AND NOT-ADIPOR1 | 0.9375 | 1 | 0.882352941 | CHRNA3 AND NOT-ATP13A4 | 0.950617284 | 0.987179487 | 0.916666667 |
| PTPRZ1 AND NOT-TUBD1 | 0.9375 | 1 | 0.882352941 | CHRNA3 AND NOT-ACSS1 | 0.950617284 | 0.987179487 | 0.916666667 |
| PTPRZ1 AND NOT-ZDHHC2 | 0.9375 | 1 | 0.882352941 | CHRNA3 AND NOT-FUT10 | 0.956521739 | 1 | 0.916666667 |
| PTPRZ1 AND NOT-PIGP | 0.9375 | 1 | 0.882352941 | CHRNA3 AND NOT-IL17RC | 0.950617284 | 0.987179487 | 0.916666667 |
| PTPRZ1 AND NOT-CRIM1 | 0.9375 | 1 | 0.882352941 | CHRNA3 AND NOT-TMEM25 | 0.950617284 | 0.987179487 | 0.916666667 |
| PTPRZ1 AND NOT-TMEM216 | 0.903225806 | 1 | 0.823529412 | CHRNA3 AND NOT-PTPN5 | 0.950617284 | 0.987179487 | 0.916666667 |
| PTPRZ1 AND PIPOX | 0.903225806 | 1 | 0.823529412 | CHRNA3 AND NOT-FIBCD1 | 0.950617284 | 0.987179487 | 0.916666667 |
| PTPRZ1 AND NOT-CEND1 | 0.903225806 | 1 | 0.823529412 | CHRNA3 AND NOT-DISP1 | 0.950617284 | 0.987179487 | 0.916666667 |
| PTPRZ1 AND NOT-TIMMDC1 | 0.9375 | 1 | 0.882352941 | CHRNA3 AND NOT-ITGA10 | 0.950617284 | 0.987179487 | 0.916666667 |
| PTPRZ1 AND NOT-CYP39A1 | 0.9375 | 1 | 0.882352941 | CHRNA3 AND NOT-ABCC11 | 0.950617284 | 0.987179487 | 0.916666667 |
| PTPRZ1 AND NOT-FKBP11 | 0.9375 | 1 | 0.882352941 | CHRNA3 AND NOT-KIAA1644 | 0.956521739 | 1 | 0.916666667 |
| PTPRZ1 AND NOT-ZDHHC3 | 0.903225806 | 1 | 0.823529412 | CHRNA3 AND NOT-SLC45A3 | 0.956521739 | 1 | 0.916666667 |
| PTPRZ1 AND SLC22A17 | 0.903225806 | 1 | 0.823529412 | CHRNA3 AND NOT-CDC14B | 0.936708861 | 1 | 0.880952381 |
| PTPRZ1 AND MBTPS2 | 0.9375 | 1 | 0.882352941 | CHRNA3 AND NOT-SLC4A4 | 0.950617284 | 0.987179487 | 0.916666667 |
| PTPRZ1 AND CHST15 | 0.903225806 | 1 | 0.823529412 | CHRNA3 AND NOT-DGAT1 | 0.950617284 | 0.987179487 | 0.916666667 |
| PTPRZ1 AND NOT-TEX264 | 0.9375 | 1 | 0.882352941 | CHRNA3 AND NOT-B3GALT2 | 0.950617284 | 0.987179487 | 0.916666667 |
| PTPRZ1 AND NOT-ATRAID | 0.903225806 | 1 | 0.823529412 | CHRNA3 AND NOT-ABCC3 | 0.950617284 | 0.987179487 | 0.916666667 |
| PTPRZ1 AND NOT-GULP1 | 0.9375 | 1 | 0.882352941 | CHRNA3 AND NOT-ADAM23 | 0.956521739 | 1 | 0.916666667 |
| PTPRZ1 AND RHCG | 0.9375 | 1 | 0.882352941 | CHRNA3 AND NOT-ADAM18 | 0.950617284 | 0.987179487 | 0.916666667 |
| PTPRZ1 AND NOT-UBE2J1 | 0.903225806 | 1 | 0.823529412 | CHRNA3 AND NOT-ADAM7 | 0.950617284 | 0.987179487 | 0.916666667 |
| PTPRZ1 AND TMEM138 | 0.9375 | 1 | 0.882352941 | CHRNA3 AND NOT-TNFRSF10C | 0.956521739 | 1 | 0.916666667 |
| PTPRZ1 AND NOT-GDE1 | 0.9375 | 1 | 0.882352941 | CHRNA3 AND NOT-CACNA1I | 0.950617284 | 0.987179487 | 0.916666667 |
| PTPRZ1 AND NOT-LSR | 0.9375 | 1 | 0.882352941 | CHRNA3 AND NOT-LMLN | 0.943396226 | 1 | 0.892857143 |
| PTPRZ1 AND ERGIC3 | 0.9375 | 1 | 0.882352941 | CHRNA3 AND NOT-CEACAM21 | 0.950617284 | 0.987179487 | 0.916666667 |
| PTPRZ1 AND NOT-HMP19 | 0.9375 | 1 | 0.882352941 | CHRNA3 AND NOT-ANGPTL1 | 0.950617284 | 0.987179487 | 0.916666667 |
| PTPRZ1 AND NOT-MPC1 | 0.903225806 | 1 | 0.823529412 | CHRNA3 AND NOT-CLDN2 | 0.950617284 | 0.987179487 | 0.916666667 |
| PTPRZ1 AND NOT-CYB5R2 | 0.903225806 | 1 | 0.823529412 | CHRNA3 AND NOT-CLDN1 | 0.950617284 | 0.987179487 | 0.916666667 |
| PTPRZ1 AND NOT-EMCN | 0.9375 | 1 | 0.882352941 | CHRNA3 AND NOT-CLDN9 | 0.950617284 | 0.987179487 | 0.916666667 |
| PTPRZ1 AND NOT-CYB5R1 | 0.9375 | 1 | 0.882352941 | CHRNA3 AND NOT-TMEM67 | 0.950617284 | 0.987179487 | 0.916666667 |
| PTPRZ1 AND NOT-SELT | 0.903225806 | 1 | 0.823529412 | CHRNA3 AND NOT-SLC16A5 | 0.950617284 | 0.987179487 | 0.916666667 |
| PTPRZ1 AND DNAJB11 | 0.9375 | 1 | 0.882352941 | CHRNA3 AND NOT-P2RX6 | 0.950617284 | 0.987179487 | 0.916666667 |
| PTPRZ1 AND PECAM1 | 0.903225806 | 1 | 0.823529412 | CHRNA3 AND NOT-SLC28A1 | 0.950617284 | 0.987179487 | 0.916666667 |
| PTPRZ1 AND NOT-ATP8A2 | 0.903225806 | 1 | 0.823529412 | CHRNA3 AND NOT-SYT12 | 0.943396226 | 1 | 0.892857143 |
| PTPRZ1 AND CECR1 | 0.903225806 | 1 | 0.823529412 | CHRNA3 AND NOT-KIAA1919 | 0.950617284 | 0.987179487 | 0.916666667 |
| PTPRZ1 AND NOT-ATP8B1 | 0.9375 | 1 | 0.882352941 | CHRNA3 AND NOT-HTR3B | 0.950617284 | 0.987179487 | 0.916666667 |
| PTPRZ1 AND NOT-ATP6V0C | 0.903225806 | 1 | 0.823529412 | CHRNA3 AND NOT-SLC33A1 | 0.950617284 | 0.987179487 | 0.916666667 |
| PTPRZ1 AND NOT-PIGF | 0.9375 | 1 | 0.882352941 | CHRNA3 AND NOT-GGTLC1 | 0.95 | 1 | 0.904761905 |
| PTPRZ1 AND NOT-PIGH | 0.9375 | 1 | 0.882352941 | CHRNA3 AND NOT-VAPB | 0.943396226 | 1 | 0.892857143 |
| PTPRZ1 AND PLP1 | 0.903225806 | 1 | 0.823529412 | CHRNA3 AND NOT-DAPL1 | 0.95 | 1 | 0.904761905 |
| PTPRZ1 AND PLXNA1 | 0.903225806 | 1 | 0.823529412 | CHRNA3 AND NOT-TMEM129 | 0.950617284 | 0.987179487 | 0.916666667 |
| PTPRZ1 AND NOT-S1PR5 | 0.903225806 | 1 | 0.823529412 | CHRNA3 AND NOT-REEP6 | 0.950617284 | 0.987179487 | 0.916666667 |
| PTPRZ1 AND NOT-IL20RA | 0.9375 | 1 | 0.882352941 | CHRNA3 AND NOT-TAAR2 | 0.950617284 | 0.987179487 | 0.916666667 |
| PTPRZ1 AND SLCO1C1 | 0.9375 | 1 | 0.882352941 | CHRNA3 AND NOT-GPR55 | 0.950617284 | 0.987179487 | 0.916666667 |
| PTPRZ1 AND NOT-FTHL17 | 0.903225806 | 1 | 0.823529412 | CHRNA3 AND NOT-GPR52 | 0.950617284 | 0.987179487 | 0.916666667 |
| PTPRZ1 AND NOT-SLC37A1 | 0.9375 | 1 | 0.882352941 | CHRNA3 AND NOT-PEX11G | 0.950617284 | 0.987179487 | 0.916666667 |
| PTPRZ1 AND NOT-PODXL | 0.9375 | 1 | 0.882352941 | CHRNA3 AND NOT-KCNB2 | 0.950617284 | 0.987179487 | 0.916666667 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-GDAP1 | 0.903225806 | 1 | 0.823529412 | CHRNA3 AND NOT-MMP20 | 0.950617284 | 0.987179487 | 0.916666667 |
| PTPRZ1 AND PON2 | 0.9375 | 1 | 0.882352941 | CHRNA3 AND NOT-OPALIN | 0.956521739 | 1 | 0.916666667 |
| PTPRZ1 AND NOT-FAM134B | 0.9375 | 1 | 0.882352941 | CHRNA3 AND NOT-GLP2R | 0.950617284 | 0.987179487 | 0.916666667 |
| PTPRZ1 AND NOT-PON3 | 0.9375 | 1 | 0.882352941 | CHRNA3 AND NOT-SLC22A6 | 0.950617284 | 0.987179487 | 0.916666667 |
| PTPRZ1 AND NOT-TMX3 | 0.9375 | 1 | 0.882352941 | CHRNA3 AND NOT-ACPT | 0.950617284 | 0.987179487 | 0.916666667 |
| PTPRZ1 AND NOT-TMCO1 | 0.903225806 | 1 | 0.823529412 | CHRNA3 AND NOT-NRXN3 | 0.950617284 | 0.987179487 | 0.916666667 |
| PTPRZ1 AND NOT-TOMM7 | 0.9375 | 1 | 0.882352941 | CHRNA3 AND NOT-TTYH2 | 0.950617284 | 0.987179487 | 0.916666667 |
| PTPRZ1 AND NOT-NDFIP2 | 0.9375 | 1 | 0.882352941 | CHRNA3 AND NOT-MUC16 | 0.950617284 | 0.987179487 | 0.916666667 |
| PTPRZ1 AND NOT-VSIG10 | 0.9375 | 1 | 0.882352941 | CHRNA3 AND NOT-TMPRSS11D | 0.950617284 | 0.987179487 | 0.916666667 |
| PTPRZ1 AND LRRN3 | 0.9375 | 1 | 0.882352941 | CHRNA3 AND NOT-SFXN5 | 0.95 | 1 | 0.904761905 |
| PTPRZ1 AND NOT-MANSC1 | 0.9375 | 1 | 0.882352941 | CHRNA3 AND NOT-ABCC12 | 0.950617284 | 0.987179487 | 0.916666667 |
| PTPRZ1 AND NOT-MARCH5 | 0.9375 | 1 | 0.882352941 | CHRNA3 AND NOT-CD80 | 0.950617284 | 0.987179487 | 0.916666667 |
| PTPRZ1 AND SLC35F2 | 0.903225806 | 1 | 0.823529412 | CHRNA3 AND NOT-CYP7B1 | 0.950617284 | 0.987179487 | 0.916666667 |
| PTPRZ1 AND NOT-LEPROT | 0.9375 | 1 | 0.882352941 | CHRNA3 AND NOT-OPN4 | 0.950617284 | 0.987179487 | 0.916666667 |
| PTPRZ1 AND NOT-GRAMD1C | 0.903225806 | 1 | 0.823529412 | CHRNA3 AND NOT-NCR2 | 0.950617284 | 0.987179487 | 0.916666667 |
| PTPRZ1 AND NOT-CTSA | 0.903225806 | 1 | 0.823529412 | CHRNA3 AND NOT-CHST3 | 0.950617284 | 0.987179487 | 0.916666667 |
| PTPRZ1 AND NOT-DNAJB12 | 0.9375 | 1 | 0.882352941 | CHRNA3 AND NOT-SIGLEC6 | 0.95 | 1 | 0.904761905 |
| PTPRZ1 AND NOT-TRPM4 | 0.9375 | 1 | 0.882352941 | CHRNA3 AND NOT-PIGL | 0.950617284 | 0.987179487 | 0.916666667 |
| PTPRZ1 AND PPIB | 0.9375 | 1 | 0.882352941 | CHRNA3 AND NOT-ENTPD2 | 0.950617284 | 0.987179487 | 0.916666667 |
| PTPRZ1 AND NOT-TRPM7 | 0.9375 | 1 | 0.882352941 | CHRNA3 AND NOT-CELSR1 | 0.950617284 | 0.987179487 | 0.916666667 |
| PTPRZ1 AND NOT-CDHR2 | 0.9375 | 1 | 0.882352941 | CHRNA3 AND NOT-CLCA2 | 0.950617284 | 0.987179487 | 0.916666667 |
| PTPRZ1 AND NOT-WBP1L | 0.9375 | 1 | 0.882352941 | CHRNA3 AND NOT-TMEM63A | 0.956521739 | 1 | 0.916666667 |
| PTPRZ1 AND NOT-MFSD6 | 0.903225806 | 1 | 0.823529412 | CHRNA3 AND NOT-KIAA0319 | 0.950617284 | 0.987179487 | 0.916666667 |
| PTPRZ1 AND NOT-PAQR5 | 0.9375 | 1 | 0.882352941 | CHRNA3 AND NOT-SV2B | 0.950617284 | 0.987179487 | 0.916666667 |
| PTPRZ1 AND MS4A12 | 0.903225806 | 1 | 0.823529412 | CHRNA3 AND NOT-ATP2C2 | 0.950617284 | 0.987179487 | 0.916666667 |
| PTPRZ1 AND NOT-DPP8 | 0.9375 | 1 | 0.882352941 | CHRNA3 AND NOT-KCNE2 | 0.950617284 | 0.987179487 | 0.916666667 |
| PTPRZ1 AND LPPR1 | 0.903225806 | 1 | 0.823529412 | FAM163A AND NOT-SLC2A13 | 0.922222222 | 0.864583333 | 0.988095238 |
| PTPRZ1 AND NOT-RNF43 | 0.9375 | 1 | 0.882352941 | SLC10A4 AND NOT-SLC2A13 | 0.959537572 | 0.93258427 | 0.988095238 |
| PTPRZ1 AND CMTM6 | 0.9375 | 1 | 0.882352941 | MARCH11 AND NOT-SLC2A13 | 0.946745562 | 0.941176471 | 0.952380952 |
| PTPRZ1 AND NOT-RHBDL2 | 0.903225806 | 1 | 0.823529412 | SLC10A4 AND NOT-CHRNB2 | 0.922222222 | 0.864583333 | 0.988095238 |
| PTPRZ1 AND NOT-SLC41A3 | 0.9375 | 1 | 0.882352941 | SLC10A4 AND NOT-CHRNB3 | 0.93258427 | 0.882978723 | 0.988095238 |
| PTPRZ1 AND NOT-C1orf27 | 0.9375 | 1 | 0.882352941 | SLC10A4 AND NOT-CSMD3 | 0.922222222 | 0.864583333 | 0.988095238 |
| PTPRZ1 AND NOT-TMEM160 | 0.903225806 | 1 | 0.823529412 | MARCH11 AND NOT-CSMD3 | 0.946745562 | 0.941176471 | 0.952380952 |
| PTPRZ1 AND NOT-PIGX | 0.9375 | 1 | 0.882352941 | FAM163A AND NOT-ELFN2 | 0.922222222 | 0.864583333 | 0.988095238 |
| PTPRZ1 AND NOT-MARC2 | 0.9375 | 1 | 0.882352941 | ST8SIA2 AND NOT-ELFN2 | 0.943396226 | 1 | 0.892857143 |
| PTPRZ1 AND NOT-TMCO3 | 0.9375 | 1 | 0.882352941 | SLC10A4 AND NOT-TMEM132B | 0.927374302 | 0.873684211 | 0.988095238 |
| PTPRZ1 AND NOT-STX17 | 0.9375 | 1 | 0.882352941 | MARCH11 AND NOT-TMEM132B | 0.946745562 | 0.941176471 | 0.952380952 |
| PTPRZ1 AND TMEM248 | 0.903225806 | 1 | 0.823529412 | SLC10A4 AND NOT-C1QTNF1 | 0.922222222 | 0.864583333 | 0.988095238 |
| PTPRZ1 AND TMEM45A | 0.9375 | 1 | 0.882352941 | ST8SIA2 AND NOT-SLC26A9 | 0.95 | 1 | 0.904761905 |
| PTPRZ1 AND NOT-SLC6A15 | 0.903225806 | 1 | 0.823529412 | SLC10A4 AND NOT-OMA1 | 0.922222222 | 0.864583333 | 0.988095238 |
| PTPRZ1 AND NOT-ANO10 | 0.9375 | 1 | 0.882352941 | FAM163A AND NOT-SLC5A11 | 0.922222222 | 0.864583333 | 0.988095238 |
| PTPRZ1 AND NOT-TMEM38B | 0.903225806 | 1 | 0.823529412 | SLC10A4 AND NOT-SLC5A11 | 0.970760234 | 0.954022989 | 0.988095238 |
| PTPRZ1 AND TMEM33 | 0.903225806 | 1 | 0.823529412 | ST8SIA2 AND NOT-SLC5A11 | 0.943396226 | 1 | 0.892857143 |
| PTPRZ1 AND SEC61A2 | 0.903225806 | 1 | 0.823529412 | SLC10A4 AND NOT-CMTM5 | 0.965116279 | 0.943181818 | 0.988095238 |
| PTPRZ1 AND NOT-RMDN3 | 0.903225806 | 1 | 0.823529412 | ST8SIA2 AND NOT-CMTM5 | 0.943396226 | 1 | 0.892857143 |
| PTPRZ1 AND NOT-TMEM57 | 0.9375 | 1 | 0.882352941 | MARCH11 AND NOT-SLC26A8 | 0.963855422 | 0.975609756 | 0.952380952 |
| PTPRZ1 AND NAT10 | 0.903225806 | 1 | 0.823529412 | FAM163A AND NOT-GRIN3B | 0.93258427 | 0.882978723 | 0.988095238 |
| PTPRZ1 AND NOT-TMEM19 | 0.903225806 | 1 | 0.823529412 | SLC10A4 AND NOT-GRIN3B | 0.927374302 | 0.873684211 | 0.988095238 |
| PTPRZ1 AND TMEM100 | 0.9375 | 1 | 0.882352941 | SLC10A4 AND NOT-SLC18B1 | 0.954022989 | 0.922222222 | 0.988095238 |
| PTPRZ1 AND NOT-FBXW7 | 0.903225806 | 1 | 0.823529412 | GPR19 AND NOT-SLC18B1 | 0.946745562 | 0.941176471 | 0.952380952 |
| PTPRZ1 AND NOT-RNF121 | 0.9375 | 1 | 0.882352941 | MARCH11 AND NOT-SLC18B1 | 0.946745562 | 0.941176471 | 0.952380952 |
| PTPRZ1 AND NOT-TMEM74B | 0.9375 | 1 | 0.882352941 | FAM163A AND NOT-MRGPRX2 | 0.948571429 | 0.912087912 | 0.988095238 |
| PTPRZ1 AND NOT-SLC39A9 | 0.9375 | 1 | 0.882352941 | SLC10A4 AND NOT-MRGPRX2 | 0.948571429 | 0.912087912 | 0.988095238 |
| PTPRZ1 AND NOT-WDR33 | 0.9375 | 1 | 0.882352941 | ST8SIA2 AND NOT-MRGPRX2 | 0.956521739 | 1 | 0.916666667 |
| PTPRZ1 AND NOT-STYK1 | 0.903225806 | 1 | 0.823529412 | FAM163A AND NOT-MRGPRX3 | 0.965116279 | 0.943181818 | 0.988095238 |
| PTPRZ1 AND NOT-LGR4 | 0.9375 | 1 | 0.882352941 | SLC10A4 AND NOT-MRGPRX3 | 0.959537572 | 0.93258427 | 0.988095238 |
| PTPRZ1 AND LRRC59 | 0.9375 | 1 | 0.882352941 | ST8SIA2 AND NOT-MRGPRX3 | 0.956521739 | 1 | 0.916666667 |
| PTPRZ1 AND NOT-ETNK1 | 0.9375 | 1 | 0.882352941 | SLC10A4 AND NOT-GALNT15 | 0.976470588 | 0.965116279 | 0.988095238 |
| PTPRZ1 AND CHST12 | 0.903225806 | 1 | 0.823529412 | ST8SIA2 AND NOT-GALNT15 | 0.943396226 | 1 | 0.892857143 |
| PTPRZ1 AND NOT-SMPD3 | 0.9375 | 1 | 0.882352941 | SLC10A4 AND NOT-ADCYAP1R1 | 0.927374302 | 0.873684211 | 0.988095238 |
| PTPRZ1 AND NOT-SVOP | 0.903225806 | 1 | 0.823529412 | SLC10A4 AND NOT-GPR62 | 0.937853107 | 0.892473118 | 0.988095238 |
| PTPRZ1 AND IL17RB | 0.9375 | 1 | 0.882352941 | GPR19 AND NOT-GPR62 | 0.951219512 | 0.975 | 0.928571429 |
| PTPRZ1 AND NOT-SLC39A4 | 0.9375 | 1 | 0.882352941 | MARCH11 AND NOT-GPR62 | 0.946745562 | 0.941176471 | 0.952380952 |
| PTPRZ1 AND NOT-TMEM127 | 0.9375 | 1 | 0.882352941 | ST8SIA2 AND NOT-GPR62 | 0.943396226 | 1 | 0.892857143 |
| PTPRZ1 AND SLC30A6 | 0.903225806 | 1 | 0.823529412 | SLC10A4 AND NOT-CLCN5 | 0.922222222 | 0.864583333 | 0.988095238 |
| PTPRZ1 AND NDC1 | 0.9375 | 1 | 0.882352941 | SLC10A4 AND NOT-CLCN7 | 0.922222222 | 0.864583333 | 0.988095238 |
| PTPRZ1 AND SAYSD1 | 0.903225806 | 1 | 0.823529412 | SLC10A4 AND NOT-SFXN2 | 0.922222222 | 0.864583333 | 0.988095238 |
| PTPRZ1 AND NOT-CSGALNACT1 | 0.9375 | 1 | 0.882352941 | SLC10A4 AND NOT-PDZD8 | 0.927374302 | 0.873684211 | 0.988095238 |
| PTPRZ1 AND NOT-SCN3B | 0.903225806 | 1 | 0.823529412 | ST8SIA2 AND NOT-OR5P2 | 0.950617284 | 0.987179487 | 0.916666667 |
| PTPRZ1 AND PAG1 | 0.9375 | 1 | 0.882352941 | ST8SIA2 AND NOT-OR5P3 | 0.950617284 | 0.987179487 | 0.916666667 |
| PTPRZ1 AND NOT-GLT8D1 | 0.9375 | 1 | 0.882352941 | FAM163A AND NOT-TMEM52B | 0.943181818 | 0.902173913 | 0.988095238 |
| PTPRZ1 AND NOT-TEX2 | 0.903225806 | 1 | 0.823529412 | SLC10A4 AND NOT-TMEM52B | 0.93258427 | 0.882978723 | 0.988095238 |
| PTPRZ1 AND TMEM165 | 0.9375 | 1 | 0.882352941 | MARCH11 AND NOT-TMEM52B | 0.946745562 | 0.941176471 | 0.952380952 |
| PTPRZ1 AND NOT-TMEM126B | 0.903225806 | 1 | 0.823529412 | MARCH11 AND NOT-TEX29 | 0.963855422 | 0.975609756 | 0.952380952 |
| PTPRZ1 AND NOT-PKN2 | 0.9375 | 1 | 0.882352941 | FAM163A AND NOT-SLC24A4 | 0.976470588 | 0.965116279 | 0.988095238 |
| PTPRZ1 AND AXL | 0.903225806 | 1 | 0.823529412 | SLC10A4 AND NOT-SLC24A4 | 0.982248521 | 0.976470588 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-ACSS2 | 0.903225806 | 1 | 0.823529412 | GPR19 AND NOT-SLC24A4 | 0.96969697 | 0.987654321 | 0.952380952 |
| PTPRZ1 AND NOT-KMT2E | 0.9375 | 1 | 0.882352941 | MARCH11 AND NOT-SLC24A4 | 0.946745562 | 0.941176471 | 0.952380952 |
| PTPRZ1 AND NOT-BCAP29 | 0.9375 | 1 | 0.882352941 | ST8SIA2 AND NOT-SLC24A4 | 0.956521739 | 1 | 0.916666667 |
| PTPRZ1 AND PCDHB9 | 0.9375 | 1 | 0.882352941 | SLC10A4 AND NOT-SLC51B | 0.93258427 | 0.882978723 | 0.988095238 |
| PTPRZ1 AND NOT-ANKH | 0.903225806 | 1 | 0.823529412 | ST8SIA2 AND NOT-SLC51B | 0.950617284 | 0.987179487 | 0.916666667 |
| PTPRZ1 AND NOT-MOSPD1 | 0.903225806 | 1 | 0.823529412 | SLC10A4 AND NOT-NIPA1 | 0.927374302 | 0.873684211 | 0.988095238 |
| PTPRZ1 AND NOT-PRNP | 0.903225806 | 1 | 0.823529412 | RTN1 AND CANT1 | 0.950617284 | 0.987179487 | 0.916666667 |
| PTPRZ1 AND PROS1 | 0.903225806 | 1 | 0.823529412 | ST8SIA2 AND NOT-SPNS2 | 0.95 | 1 | 0.904761905 |
| PTPRZ1 AND NOT-CYP26B1 | 0.9375 | 1 | 0.882352941 | SLC10A4 AND NOT-FAM69C | 0.963414634 | 0.9875 | 0.94047619 |
| PTPRZ1 AND NOT-PSEN1 | 0.9375 | 1 | 0.882352941 | MARCH11 AND NOT-FAM69C | 0.951807229 | 0.963414634 | 0.94047619 |
| PTPRZ1 AND NOT-PSEN2 | 0.9375 | 1 | 0.882352941 | ST8SIA2 AND NOT-FAM69C | 0.936708861 | 1 | 0.880952381 |
| PTPRZ1 AND NOT-CLDND1 | 0.9375 | 1 | 0.882352941 | ST8SIA2 AND NOT-IZUMO2 | 0.950617284 | 0.987179487 | 0.916666667 |
| PTPRZ1 AND NOT-TMEM9B | 0.9375 | 1 | 0.882352941 | SLC10A4 AND NOT-CNGA4 | 0.93258427 | 0.882978723 | 0.988095238 |
| PTPRZ1 AND NOT-JPH1 | 0.903225806 | 1 | 0.823529412 | ST8SIA2 AND NOT-CNGA4 | 0.950617284 | 0.987179487 | 0.916666667 |
| PTPRZ1 AND NOT-CELF4 | 0.903225806 | 1 | 0.823529412 | FAM163A AND NOT-TMEM125 | 0.988095238 | 0.988095238 | 0.988095238 |
| PTPRZ1 AND NOT-TM9SF3 | 0.9375 | 1 | 0.882352941 | SLC10A4 AND NOT-TMEM125 | 0.988095238 | 0.988095238 | 0.988095238 |
| TPST1 AND NOT-TM9SF3 | 0.903225806 | 1 | 0.823529412 | GABRB3 AND NOT-TMEM125 | 0.950617284 | 0.987179487 | 0.916666667 |
| NOT-PTPRZ1 AND PTPRZ1 | 0.9375 | 1 | 0.882352941 | GPR19 AND NOT-TMEM125 | 0.96969697 | 0.987654321 | 0.952380952 |
| PTPRZ1 AND PMEPA1 | 0.903225806 | 1 | 0.823529412 | MARCH11 AND NOT-TMEM125 | 0.952380952 | 0.952380952 | 0.952380952 |
| PTPRZ1 AND NOT-MFF | 0.9375 | 1 | 0.882352941 | ST8SIA3 AND NOT-TMEM125 | 0.946745562 | 0.941176471 | 0.952380952 |
| PTPRZ1 AND ACKR3 | 0.903225806 | 1 | 0.823529412 | SCN3B AND NOT-TMEM125 | 0.97005988 | 0.975903614 | 0.964285714 |
| PTPRZ1 AND PNPLA2 | 0.9375 | 1 | 0.882352941 | ST8SIA2 AND NOT-TMEM125 | 0.956521739 | 1 | 0.916666667 |
| PTPRZ1 AND NOT-RHBG | 0.9375 | 1 | 0.882352941 | SLC10A4 AND NOT-DRAM2 | 0.922222222 | 0.864583333 | 0.988095238 |
| PTPRZ1 AND NOT-RIN4 | 0.9375 | 1 | 0.882352941 | FAM163A AND MBOAT2 | 0.931818182 | 0.891304348 | 0.976190476 |
| PTPRZ1 AND NOT-SMIM8 | 0.903225806 | 1 | 0.823529412 | SLC10A4 AND NOT-CNTNAP5 | 0.941860465 | 0.920454545 | 0.964285714 |
| PTPRZ1 AND NOT-TMEM63C | 0.9375 | 1 | 0.882352941 | ST8SIA2 AND NOT-CNTNAP5 | 0.95 | 1 | 0.904761905 |
| PTPRZ1 AND NOT-SNX14 | 0.9375 | 1 | 0.882352941 | SLC10A4 AND NOT-KCNH8 | 0.927374302 | 0.873684211 | 0.988095238 |
| PTPRZ1 AND PTCH1 | 0.9375 | 1 | 0.882352941 | MARCH11 AND NOT-SYNPR | 0.946745562 | 0.941176471 | 0.952380952 |
| TPST1 AND NOT-PTGER2 | 0.903225806 | 1 | 0.823529412 | ST8SIA2 AND NOT-TMPRSS11B | 0.956521739 | 1 | 0.916666667 |
| PTPRZ1 AND NOT-ZNF304 | 0.9375 | 1 | 0.882352941 | FAM163A AND COX4I1 | 0.943181818 | 0.902173913 | 0.988095238 |
| PTPRZ1 AND NOT-MRS2 | 0.903225806 | 1 | 0.823529412 | ST8SIA2 AND COX4I1 | 0.936708861 | 1 | 0.880952381 |
| PTPRZ1 AND NOT-ABHD6 | 0.903225806 | 1 | 0.823529412 | SLC10A4 AND NOT-SLC9B2 | 0.922222222 | 0.864583333 | 0.988095238 |
| PTPRZ1 AND NOT-SLC24A3 | 0.9375 | 1 | 0.882352941 | ST8SIA2 AND NOT-IL31RA | 0.936708861 | 1 | 0.880952381 |
| PTPRZ1 AND PTGS1 | 0.903225806 | 1 | 0.823529412 | FAM163A AND NOT-TAAR9 | 0.959537572 | 0.93258427 | 0.988095238 |
| PTPRZ1 AND NOT-TMCC3 | 0.903225806 | 1 | 0.823529412 | SLC10A4 AND NOT-TAAR9 | 0.948571429 | 0.912087912 | 0.988095238 |
| PTPRZ1 AND NOT-PTH1R | 0.9375 | 1 | 0.882352941 | FAM163A AND NOT-ADORA1 | 0.941860465 | 0.920454545 | 0.964285714 |
| PTPRZ1 AND NOT-SLC12A5 | 0.903225806 | 1 | 0.823529412 | SLC10A4 AND NOT-ADORA1 | 0.964285714 | 0.964285714 | 0.964285714 |
| PTPRZ1 AND GRAMD1B | 0.9375 | 1 | 0.882352941 | MARCH11 AND NOT-ADORA1 | 0.957575758 | 0.975308642 | 0.94047619 |
| PTPRZ1 AND HEG1 | 0.9375 | 1 | 0.882352941 | ST8SIA2 AND NOT-ADORA1 | 0.943396226 | 1 | 0.892857143 |
| PTPRZ1 AND GPR158 | 0.9375 | 1 | 0.882352941 | MARCH11 AND NOT-B3GAT2 | 0.946745562 | 0.941176471 | 0.952380952 |
| PTPRZ1 AND SERINC1 | 0.9375 | 1 | 0.882352941 | ST8SIA2 AND NOT-B3GAT2 | 0.950617284 | 0.987179487 | 0.916666667 |
| PTPRZ1 AND NOT-KIAA1324 | 0.9375 | 1 | 0.882352941 | ST8SIA2 AND NOT-TMEM139 | 0.956521739 | 1 | 0.916666667 |
| PTPRZ1 AND NOT-NCEH1 | 0.9375 | 1 | 0.882352941 | MARCH11 AND NOT-ADORA2B | 0.946745562 | 0.941176471 | 0.952380952 |
| PTPRZ1 AND NOT-SYT13 | 0.903225806 | 1 | 0.823529412 | SLC10A4 AND NOT-TMEM71 | 0.922222222 | 0.864583333 | 0.988095238 |
| PTPRZ1 AND NOT-KIAA1467 | 0.903225806 | 1 | 0.823529412 | FAM163A AND AGPAT6 | 0.927374302 | 0.873684211 | 0.988095238 |
| PTPRZ1 AND LRFN1 | 0.903225806 | 1 | 0.823529412 | ST8SIA2 AND NOT-RNF183 | 0.950617284 | 0.987179487 | 0.916666667 |
| PTPRZ1 AND NOT-LRRC4C | 0.903225806 | 1 | 0.823529412 | SLC10A4 AND NOT-CRHR2 | 0.948571429 | 0.912087912 | 0.988095238 |
| PTPRZ1 AND PCDHB16 | 0.903225806 | 1 | 0.823529412 | ST8SIA2 AND NOT-CRHR2 | 0.943396226 | 1 | 0.892857143 |
| PTPRZ1 AND NOT-PTPN2 | 0.903225806 | 1 | 0.823529412 | FAM163A AND NOT-ASB5 | 0.947976879 | 0.921348315 | 0.976190476 |
| PTPRZ1 AND PTPRA | 0.9375 | 1 | 0.882352941 | SLC10A4 AND NOT-ASB5 | 0.982035928 | 0.987951807 | 0.976190476 |
| PTPRZ1 AND PTPRC | 0.903225806 | 1 | 0.823529412 | ST8SIA2 AND NOT-ASB5 | 0.950617284 | 0.987179487 | 0.916666667 |
| PTPRZ1 AND NOT-PTPRF | 0.9375 | 1 | 0.882352941 | NRSN1 AND NOT-SLC2A12 | 0.95 | 1 | 0.904761905 |
| PTPRZ1 AND PTPRO | 0.903225806 | 1 | 0.823529412 | NRSN1 AND NOT-MLC1 | 0.95 | 1 | 0.904761905 |
| PTPRZ1 AND NOT-PTPRR | 0.9375 | 1 | 0.882352941 | NRSN1 AND NOT-SLC7A11 | 0.936708861 | 1 | 0.880952381 |
| PTPRZ1 AND NOT-PTPRS | 0.9375 | 1 | 0.882352941 | NRSN1 AND NOT-GPR37 | 0.936708861 | 1 | 0.880952381 |
| PTPRZ1 AND MS4A7 | 0.9375 | 1 | 0.882352941 | NRSN1 AND NOT-GRM3 | 0.95 | 1 | 0.904761905 |
| PTPRZ1 AND NOT-OSTC | 0.9375 | 1 | 0.882352941 | NRSN1 AND NOT-AQP4 | 0.936708861 | 1 | 0.880952381 |
| PTPRZ1 AND NOT-IL22RA1 | 0.9375 | 1 | 0.882352941 | NRSN1 AND NOT-KCNA2 | 0.943396226 | 1 | 0.892857143 |
| PTPRZ1 AND RARRES3 | 0.903225806 | 1 | 0.823529412 | NRSN1 AND NOT-KCNJ10 | 0.95 | 1 | 0.904761905 |
| PTPRZ1 AND NOT-SIGIRR | 0.9375 | 1 | 0.882352941 | NRSN1 AND NOT-KCNJ16 | 0.95 | 1 | 0.904761905 |
| PTPRZ1 AND NOT-TMEM35 | 0.9375 | 1 | 0.882352941 | NRSN1 AND NOT-LRP4 | 0.95 | 1 | 0.904761905 |
| PTPRZ1 AND NOT-BCL2 | 0.9375 | 1 | 0.882352941 | NRSN1 AND NOT-MOG | 0.95 | 1 | 0.904761905 |
| PTPRZ1 AND NOT-BCL2L2 | 0.903225806 | 1 | 0.823529412 | NRSN1 AND NOT-HHATL | 0.95 | 1 | 0.904761905 |
| PTPRZ1 AND NOT-FAM3A | 0.9375 | 1 | 0.882352941 | NRSN1 AND NOT-SLC6A1 | 0.95 | 1 | 0.904761905 |
| PTPRZ1 AND RNASE4 | 0.903225806 | 1 | 0.823529412 | NRSN1 AND NOT-SLC15A2 | 0.95 | 1 | 0.904761905 |
| PTPRZ1 AND RNASE6 | 0.903225806 | 1 | 0.823529412 | NRSN1 AND NOT-FA2H | 0.95 | 1 | 0.904761905 |
| PTPRZ1 AND KCNK15 | 0.903225806 | 1 | 0.823529412 | NRSN1 AND NOT-PAQR6 | 0.936708861 | 1 | 0.880952381 |
| PTPRZ1 AND NOT-ROBO2 | 0.903225806 | 1 | 0.823529412 | NRSN1 AND NOT-SLC25A18 | 0.95 | 1 | 0.904761905 |
| PTPRZ1 AND NOT-RPL37A | 0.9375 | 1 | 0.882352941 | NRSN1 AND NOT-SLITRK2 | 0.943396226 | 1 | 0.892857143 |
| PTPRZ1 AND RPN2 | 0.903225806 | 1 | 0.823529412 | NRSN1 AND NOT-SLC4A4 | 0.95 | 1 | 0.904761905 |
| PTPRZ1 AND NOT-RPS23 | 0.903225806 | 1 | 0.823529412 | NRSN1 AND NOT-OPALIN | 0.95 | 1 | 0.904761905 |
| PTPRZ1 AND RYK | 0.903225806 | 1 | 0.823529412 | ST8SIA2 AND NOT-TRPM6 | 0.956521739 | 1 | 0.916666667 |
| PTPRZ1 AND NOT-RYR2 | 0.903225806 | 1 | 0.823529412 | SLC10A4 AND NOT-SIRPA | 0.937853107 | 0.892473118 | 0.988095238 |
| PTPRZ1 AND SORT1 | 0.903225806 | 1 | 0.823529412 | MARCH11 AND NOT-SIRPA | 0.946745562 | 0.941176471 | 0.952380952 |
| PTPRZ1 AND NOT-SLC22A23 | 0.9375 | 1 | 0.882352941 | SLC10A4 AND NOT-SAMD8 | 0.927374302 | 0.873684211 | 0.988095238 |
| PTPRZ1 AND NOT-SC5D | 0.9375 | 1 | 0.882352941 | SLC10A4 AND NOT-VTI1A | 0.931818182 | 0.891304348 | 0.976190476 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND SCD | 0.903225806 | 1 | 0.823529412 | SLC10A4 AND NOT-SYT9 | 0.922222222 | 0.864583333 | 0.988095238 |
| PTPRZ1 AND SCN1A | 0.903225806 | 1 | 0.823529412 | SLC10A4 AND NOT-CSF1 | 0.922222222 | 0.864583333 | 0.988095238 |
| PTPRZ1 AND NOT-SCN1B | 0.903225806 | 1 | 0.823529412 | FAM163A AND ALG10B | 0.947368421 | 0.931034483 | 0.964285714 |
| PTPRZ1 AND NOT-SCN2A | 0.903225806 | 1 | 0.823529412 | MARCH11 AND NOT-B3GLCT | 0.952380952 | 0.952380952 | 0.952380952 |
| PTPRZ1 AND NOT-SCN2B | 0.9375 | 1 | 0.882352941 | SLC10A4 AND NOT-C14orf41 | 0.93258427 | 0.882978723 | 0.988095238 |
| PTPRZ1 AND NOT-SCN8A | 0.903225806 | 1 | 0.823529412 | MARCH11 AND NOT-C14orf37 | 0.946745562 | 0.941176471 | 0.952380952 |
| PTPRZ1 AND NOT-SCNN1G | 0.9375 | 1 | 0.882352941 | ST8SIA2 AND NOT-C14orf37 | 0.943396226 | 1 | 0.892857143 |
| PTPRZ1 AND CCL4 | 0.903225806 | 1 | 0.823529412 | SLC10A4 AND NOT-LRFN5 | 0.927374302 | 0.873684211 | 0.988095238 |
| PTPRZ1 AND SDC2 | 0.903225806 | 1 | 0.823529412 | MARCH11 AND NOT-LRFN5 | 0.946745562 | 0.941176471 | 0.952380952 |
| PTPRZ1 AND THADA | 0.903225806 | 1 | 0.823529412 | ST8SIA2 AND NOT-LRFN5 | 0.950617284 | 0.987179487 | 0.916666667 |
| PTPRZ1 AND NOT-SDHC | 0.9375 | 1 | 0.882352941 | MARCH11 AND NOT-LYSMD4 | 0.946745562 | 0.941176471 | 0.952380952 |
| PTPRZ1 AND NOT-SEL1L | 0.9375 | 1 | 0.882352941 | ST8SIA2 AND NOT-TMCO5A | 0.956521739 | 1 | 0.916666667 |
| PTPRZ1 AND NOT-PERP | 0.9375 | 1 | 0.882352941 | ST8SIA2 AND NOT-NRG4 | 0.95 | 1 | 0.904761905 |
| PTPRZ1 AND NOT-POPDC2 | 0.9375 | 1 | 0.882352941 | ST8SIA2 AND NOT-GSG1L | 0.936708861 | 1 | 0.880952381 |
| PTPRZ1 AND NOT-SMOC2 | 0.903225806 | 1 | 0.823529412 | MARCH11 AND NOT-RBFOX3 | 0.946745562 | 0.941176471 | 0.952380952 |
| PTPRZ1 AND NOT-LRRC4 | 0.9375 | 1 | 0.882352941 | SLC10A4 AND NOT-CD300LF | 0.922222222 | 0.864583333 | 0.988095238 |
| PTPRZ1 AND NOT-ADGRL4 | 0.9375 | 1 | 0.882352941 | SLC10A4 AND NOT-ANKRD29 | 0.927374302 | 0.873684211 | 0.988095238 |
| PTPRZ1 AND NOT-SEPP1 | 0.9375 | 1 | 0.882352941 | MARCH11 AND NOT-ANKRD29 | 0.946745562 | 0.941176471 | 0.952380952 |
| PTPRZ1 AND NOT-TMEM91 | 0.9375 | 1 | 0.882352941 | SLC10A4 AND NOT-APCDD1 | 0.922222222 | 0.864583333 | 0.988095238 |
| PTPRZ1 AND NOT-DNAJC1 | 0.9375 | 1 | 0.882352941 | SLC10A4 AND NOT-VSIG10L | 0.922222222 | 0.864583333 | 0.988095238 |
| PTPRZ1 AND NOT-SEMA4A | 0.9375 | 1 | 0.882352941 | SMIM17 AND NOT-FGFR3 | 0.95 | 1 | 0.904761905 |
| PTPRZ1 AND NOT-ATL2 | 0.9375 | 1 | 0.882352941 | FAM163A AND NOT-C19orf18 | 0.922222222 | 0.864583333 | 0.988095238 |
| PTPRZ1 AND MS4A6A | 0.903225806 | 1 | 0.823529412 | SLC10A4 AND NOT-C19orf18 | 0.93258427 | 0.882978723 | 0.988095238 |
| PTPRZ1 AND NOT-C1orf233 | 0.9375 | 1 | 0.882352941 | SLC10A4 AND NOT-TMEM190 | 0.922222222 | 0.864583333 | 0.988095238 |
| PTPRZ1 AND NOT-CDH22 | 0.9375 | 1 | 0.882352941 | ST8SIA2 AND NOT-TMC4 | 0.943396226 | 1 | 0.892857143 |
| PTPRZ1 AND NOT-C5orf28 | 0.9375 | 1 | 0.882352941 | FAM163A AND NOT-DCST1 | 0.954022989 | 0.922222222 | 0.988095238 |
| PTPRZ1 AND NOT-TMEM168 | 0.9375 | 1 | 0.882352941 | FAM163A AND NOT-SLC9B1 | 0.93258427 | 0.882978723 | 0.988095238 |
| PTPRZ1 AND FNDC3B | 0.903225806 | 1 | 0.823529412 | FAM163A AND NOT-GPBAR1 | 0.941860465 | 0.920454545 | 0.964285714 |
| PTPRZ1 AND NOT-ELOVL1 | 0.9375 | 1 | 0.882352941 | FAM163A AND NOT-SLC25A48 | 0.965116279 | 0.943181818 | 0.988095238 |
| PTPRZ1 AND FNDC4 | 0.903225806 | 1 | 0.823529412 | FAM163A AND NOT-MARVELD2 | 0.93258427 | 0.882978723 | 0.988095238 |
| PTPRZ1 AND NOT-FBXL17 | 0.9375 | 1 | 0.882352941 | FAM163A AND CCDC112 | 0.942528736 | 0.911111111 | 0.976190476 |
| PTPRZ1 AND NOT-NDRG4 | 0.9375 | 1 | 0.882352941 | FAM163A AND NOT-NKAIN2 | 0.937853107 | 0.892473118 | 0.988095238 |
| PTPRZ1 AND NOT-TMEM237 | 0.9375 | 1 | 0.882352941 | FAM163A AND CCDC167 | 0.947368421 | 0.931034483 | 0.964285714 |
| PTPRZ1 AND BMP2 | 0.903225806 | 1 | 0.823529412 | FAM163A AND NOT-CLEC2L | 0.93258427 | 0.882978723 | 0.988095238 |
| PTPRZ1 AND NOT-SLC1A6 | 0.9375 | 1 | 0.882352941 | FAM163A AND NOT-PEBP4 | 0.964285714 | 0.964285714 | 0.964285714 |
| PTPRZ1 AND SLC2A3 | 0.9375 | 1 | 0.882352941 | FAM163A AND NOT-KCNU1 | 0.947976879 | 0.921348315 | 0.976190476 |
| PTPRZ1 AND NOT-SLC3A1 | 0.9375 | 1 | 0.882352941 | FAM163A AND NOT-CYP4B1 | 0.954022989 | 0.922222222 | 0.988095238 |
| PTPRZ1 AND SLC3A2 | 0.9375 | 1 | 0.882352941 | FAM163A AND NOT-OR1Q1 | 0.982248521 | 0.976470588 | 0.988095238 |
| PTPRZ1 AND SLC4A2 | 0.9375 | 1 | 0.882352941 | FAM163A AND NOT-FAAH2 | 0.931818182 | 0.891304348 | 0.976190476 |
| PTPRZ1 AND NOT-SLC6A1 | 0.903225806 | 1 | 0.823529412 | FAM163A AND NOT-TMEM229B | 0.922222222 | 0.864583333 | 0.988095238 |
| PTPRZ1 AND NOT-SLC6A6 | 0.9375 | 1 | 0.882352941 | FAM163A AND NOT-HTR3C | 0.936416185 | 0.91011236 | 0.964285714 |
| PTPRZ1 AND NOT-SLC6A12 | 0.903225806 | 1 | 0.823529412 | FAM163A AND SPTSSA | 0.931818182 | 0.891304348 | 0.976190476 |
| PTPRZ1 AND NOT-SLC12A2 | 0.9375 | 1 | 0.882352941 | FAM163A AND NOT-DIO2 | 0.959064327 | 0.942528736 | 0.976190476 |
| PTPRZ1 AND NOT-SLC18A2 | 0.9375 | 1 | 0.882352941 | FAM163A AND NOT-EGFR | 0.922222222 | 0.864583333 | 0.988095238 |
| PTPRZ1 AND NOT-SLC20A1 | 0.903225806 | 1 | 0.823529412 | FAM163A AND NOT-TMEM61 | 0.927374302 | 0.873684211 | 0.988095238 |
| PTPRZ1 AND BMPR1A | 0.903225806 | 1 | 0.823529412 | FAM163A AND NOT-CERS3 | 0.937142857 | 0.901098901 | 0.976190476 |
| PTPRZ1 AND SLC22A4 | 0.903225806 | 1 | 0.823529412 | FAM163A AND NOT-FAAH | 0.954022989 | 0.922222222 | 0.988095238 |
| PTPRZ1 AND BMPR1B | 0.9375 | 1 | 0.882352941 | FAM163A AND NOT-OPN5 | 0.954022989 | 0.922222222 | 0.988095238 |
| PTPRZ1 AND NOT-DLK2 | 0.9375 | 1 | 0.882352941 | FAM163A AND NOT-GPRC6A | 0.953488372 | 0.931818182 | 0.976190476 |
| PTPRZ1 AND SOAT1 | 0.9375 | 1 | 0.882352941 | FAM163A AND NOT-MLC1 | 0.948571429 | 0.912087912 | 0.988095238 |
| PTPRZ1 AND NOT-BNIP3 | 0.9375 | 1 | 0.882352941 | FAM163A AND NOT-SLC7A8 | 0.936416185 | 0.91011236 | 0.964285714 |
| PTPRZ1 AND SPAM1 | 0.903225806 | 1 | 0.823529412 | FAM163A AND ABCB10 | 0.937142857 | 0.901098901 | 0.976190476 |
| PTPRZ1 AND NOT-DST | 0.9375 | 1 | 0.882352941 | FAM163A AND SEC11A | 0.952380952 | 0.952380952 | 0.952380952 |
| PTPRZ1 AND NOT-SPAST | 0.9375 | 1 | 0.882352941 | FAM163A AND SEC61G | 0.947976879 | 0.921348315 | 0.976190476 |
| PTPRZ1 AND NOT-SPG7 | 0.9375 | 1 | 0.882352941 | FAM163A AND MMD | 0.970760234 | 0.954022989 | 0.988095238 |
| PTPRZ1 AND NOT-SQLE | 0.9375 | 1 | 0.882352941 | FAM163A AND LCLAT1 | 0.93258427 | 0.882978723 | 0.988095238 |
| PTPRZ1 AND BRCA1 | 0.903225806 | 1 | 0.823529412 | FAM163A AND NOT-GABRA6 | 0.937142857 | 0.901098901 | 0.976190476 |
| PTPRZ1 AND NOT-SSR1 | 0.9375 | 1 | 0.882352941 | FAM163A AND NOT-GABRD | 0.937142857 | 0.901098901 | 0.976190476 |
| PTPRZ1 AND NOT-SSTR1 | 0.9375 | 1 | 0.882352941 | FAM163A AND NOT-SLC24A2 | 0.927374302 | 0.873684211 | 0.988095238 |
| PTPRZ1 AND HSPA13 | 0.9375 | 1 | 0.882352941 | FAM163A AND LETMD1 | 0.93258427 | 0.882978723 | 0.988095238 |
| PTPRZ1 AND NOT-ELOVL4 | 0.903225806 | 1 | 0.823529412 | FAM163A AND NOT-TAS2R41 | 0.954022989 | 0.922222222 | 0.988095238 |
| PTPRZ1 AND NOT-STIM1 | 0.9375 | 1 | 0.882352941 | FAM163A AND NOT-OR7A17 | 0.93258427 | 0.882978723 | 0.988095238 |
| PTPRZ1 AND NOT-STX3 | 0.903225806 | 1 | 0.823529412 | FAM163A AND NOT-OR8G1 | 0.943181818 | 0.902173913 | 0.988095238 |
| PTPRZ1 AND NOT-VAMP1 | 0.903225806 | 1 | 0.823529412 | FAM163A AND NOT-OR10A3 | 0.93258427 | 0.882978723 | 0.988095238 |
| PTPRZ1 AND BST2 | 0.9375 | 1 | 0.882352941 | FAM163A AND NOT-OR10H3 | 0.982248521 | 0.976470588 | 0.988095238 |
| PTPRZ1 AND NOT-SYT4 | 0.9375 | 1 | 0.882352941 | FAM163A AND NOT-OR4D1 | 0.958579862 | 0.952941176 | 0.964285714 |
| PTPRZ1 AND TEK | 0.9375 | 1 | 0.882352941 | FAM163A AND NOT-ADGRF1 | 0.954022989 | 0.922222222 | 0.988095238 |
| PTPRZ1 AND TGFBR2 | 0.903225806 | 1 | 0.823529412 | FAM163A AND NOT-PCDH11X | 0.952941176 | 0.941860465 | 0.964285714 |
| PTPRZ1 AND NOT-TSPO | 0.903225806 | 1 | 0.823529412 | FAM163A AND NOT-GLP1R | 0.947976879 | 0.921348315 | 0.976190476 |
| PTPRZ1 AND NOT-ICAM5 | 0.903225806 | 1 | 0.823529412 | FAM163A AND NOT-GNRHR | 0.948571429 | 0.912087912 | 0.988095238 |
| PTPRZ1 AND NOT-SEC62 | 0.903225806 | 1 | 0.823529412 | FAM163A AND NOT-XCR1 | 0.93258427 | 0.882978723 | 0.988095238 |
| PTPRZ1 AND TLR2 | 0.903225806 | 1 | 0.823529412 | FAM163A AND NOT-GPR6 | 0.922222222 | 0.864583333 | 0.988095238 |
| PTPRZ1 AND TSPAN6 | 0.903225806 | 1 | 0.823529412 | FAM163A AND NOT-IZUMO1 | 0.922222222 | 0.864583333 | 0.988095238 |
| PTPRZ1 AND C1QB | 0.903225806 | 1 | 0.823529412 | FAM163A AND NOT-GPR37 | 0.947976879 | 0.921348315 | 0.976190476 |
| PTPRZ1 AND NOT-TPBG | 0.903225806 | 1 | 0.823529412 | FAM163A AND NOT-SLC6A16 | 0.922222222 | 0.864583333 | 0.988095238 |
| PTPRZ1 AND C3AR1 | 0.9375 | 1 | 0.882352941 | FAM163A AND TMEM14A | 0.937142857 | 0.901098901 | 0.976190476 |

FIG. 1 (CONT.)

| Antigen Pair Logic | F1 | Precision | Recall |
|---|---|---|---|
| PTPRZ1 AND NOT-TRPC1 | 0.9375 | 1 | 0.882352941 |
| PTPRZ1 AND NOT-TLCD2 | 0.9375 | 1 | 0.882352941 |
| PTPRZ1 AND NOT-C12orf73 | 0.9375 | 1 | 0.882352941 |
| PTPRZ1 AND NOT-TMEM242 | 0.9375 | 1 | 0.882352941 |
| PTPRZ1 AND TYROBP | 0.9375 | 1 | 0.882352941 |
| PTPRZ1 AND VCAM1 | 0.9375 | 1 | 0.882352941 |
| PTPRZ1 AND NOT-VIPR1 | 0.9375 | 1 | 0.882352941 |
| PTPRZ1 AND NOT-TRPV1 | 0.9375 | 1 | 0.882352941 |
| PTPRZ1 AND NOT-WFS1 | 0.903225806 | 1 | 0.823529412 |
| PTPRZ1 AND NOT-TMEM258 | 0.903225806 | 1 | 0.823529412 |
| PTPRZ1 AND NOT-WNT3 | 0.9375 | 1 | 0.882352941 |
| PTPRZ1 AND WNT11 | 0.9375 | 1 | 0.882352941 |
| PTPRZ1 AND NOT-XK | 0.903225806 | 1 | 0.823529412 |
| PTPRZ1 AND NOT-ZNF7 | 0.9375 | 1 | 0.882352941 |
| PTPRZ1 AND NOT-TMEM50B | 0.9375 | 1 | 0.882352941 |
| PTPRZ1 AND RELL1 | 0.9375 | 1 | 0.882352941 |
| PTPRZ1 AND NOT-ZNF138 | 0.9375 | 1 | 0.882352941 |
| PTPRZ1 AND NOT-CACNA1A | 0.9375 | 1 | 0.882352941 |
| PTPRZ1 AND NOT-CACNA1B | 0.903225806 | 1 | 0.823529412 |
| PTPRZ1 AND NOT-CACNA1E | 0.903225806 | 1 | 0.823529412 |
| PTPRZ1 AND LAPTM5 | 0.9375 | 1 | 0.882352941 |
| PTPRZ1 AND DDR1 | 0.903225806 | 1 | 0.823529412 |
| PTPRZ1 AND PXDN | 0.903225806 | 1 | 0.823529412 |
| PTPRZ1 AND RNF103 | 0.9375 | 1 | 0.882352941 |
| PTPRZ1 AND SCG2 | 0.903225806 | 1 | 0.823529412 |
| PTPRZ1 AND NOT-SLMAP | 0.9375 | 1 | 0.882352941 |
| PTPRZ1 AND NOT-SLC25A20 | 0.903225806 | 1 | 0.823529412 |
| PTPRZ1 AND NOT-CRELD1 | 0.9375 | 1 | 0.882352941 |
| PTPRZ1 AND NOT-VKORC1 | 0.903225806 | 1 | 0.823529412 |
| PTPRZ1 AND ALG8 | 0.903225806 | 1 | 0.823529412 |
| PTPRZ1 AND NOT-REEP5 | 0.9375 | 1 | 0.882352941 |
| PTPRZ1 AND SMIM7 | 0.903225806 | 1 | 0.823529412 |
| PTPRZ1 AND NOT-APOO | 0.9375 | 1 | 0.882352941 |
| PTPRZ1 AND NOT-DHRS11 | 0.9375 | 1 | 0.882352941 |
| PTPRZ1 AND NOT-MFSD11 | 0.9375 | 1 | 0.882352941 |
| PTPRZ1 AND NOT-GNPTAB | 0.903225806 | 1 | 0.823529412 |
| PTPRZ1 AND NOT-TMEM243 | 0.9375 | 1 | 0.882352941 |
| PTPRZ1 AND NOT-TMEM43 | 0.9375 | 1 | 0.882352941 |
| PTPRZ1 AND NOT-LRFN3 | 0.9375 | 1 | 0.882352941 |
| PTPRZ1 AND MUL1 | 0.9375 | 1 | 0.882352941 |
| PTPRZ1 AND NOT-GALNT14 | 0.903225806 | 1 | 0.823529412 |
| PTPRZ1 AND NOT-SRD5A3 | 0.9375 | 1 | 0.882352941 |
| PTPRZ1 AND GAL3ST4 | 0.9375 | 1 | 0.882352941 |
| PTPRZ1 AND MANEA | 0.9375 | 1 | 0.882352941 |
| PTPRZ1 AND NOT-GALNT12 | 0.903225806 | 1 | 0.823529412 |
| PTPRZ1 AND NOT-C1orf115 | 0.903225806 | 1 | 0.823529412 |
| PTPRZ1 AND NOT-NIPAL2 | 0.9375 | 1 | 0.882352941 |
| PTPRZ1 AND NOT-CAMKMT | 0.9375 | 1 | 0.882352941 |
| PTPRZ1 AND NOT-CCDC134 | 0.9375 | 1 | 0.882352941 |
| PTPRZ1 AND CYBRD1 | 0.903225806 | 1 | 0.823529412 |
| PTPRZ1 AND NOT-SLC35E1 | 0.903225806 | 1 | 0.823529412 |
| PTPRZ1 AND SYNDIG1 | 0.903225806 | 1 | 0.823529412 |
| PTPRZ1 AND NOT-ERMP1 | 0.903225806 | 1 | 0.823529412 |
| PTPRZ1 AND NOT-PCNXL2 | 0.903225806 | 1 | 0.823529412 |
| PTPRZ1 AND SEMA6D | 0.903225806 | 1 | 0.823529412 |
| PTPRZ1 AND NOT-PGAP1 | 0.9375 | 1 | 0.882352941 |
| PTPRZ1 AND LRRTM4 | 0.9375 | 1 | 0.882352941 |
| PTPRZ1 AND NOT-MYCT1 | 0.9375 | 1 | 0.882352941 |
| PTPRZ1 AND NOT-TMEM254 | 0.9375 | 1 | 0.882352941 |
| PTPRZ1 AND NOT-PIGZ | 0.9375 | 1 | 0.882352941 |
| PTPRZ1 AND NOT-MLLT10 | 0.9375 | 1 | 0.882352941 |
| PTPRZ1 AND NOT-DNAJC5 | 0.9375 | 1 | 0.882352941 |
| PTPRZ1 AND NOT-REEP4 | 0.9375 | 1 | 0.882352941 |
| PTPRZ1 AND NOT-CYB5B | 0.9375 | 1 | 0.882352941 |
| PTPRZ1 AND NOT-PRRT1 | 0.9375 | 1 | 0.882352941 |
| PTPRZ1 AND SLC2A10 | 0.903225806 | 1 | 0.823529412 |
| PTPRZ1 AND TMX1 | 0.903225806 | 1 | 0.823529412 |
| PTPRZ1 AND NOT-GDPD5 | 0.9375 | 1 | 0.882352941 |
| PTPRZ1 AND NOT-YIPF5 | 0.9375 | 1 | 0.882352941 |
| PTPRZ1 AND VWA9 | 0.9375 | 1 | 0.882352941 |
| PTPRZ1 AND LMAN2L | 0.903225806 | 1 | 0.823529412 |
| PTPRZ1 AND APOLD1 | 0.9375 | 1 | 0.882352941 |
| PTPRZ1 AND TMEM163 | 0.903225806 | 1 | 0.823529412 |
| PTPRZ1 AND NOT-TSPAN14 | 0.9375 | 1 | 0.882352941 |
| PTPRZ1 AND NOT-AKAP1 | 0.9375 | 1 | 0.882352941 |
| PTPRZ1 AND NOT-RNF170 | 0.9375 | 1 | 0.882352941 |

| Antigen Pair Logic | F1 | Precision | Recall |
|---|---|---|---|
| FAM163A AND NOT-GRIK1 | 0.931818182 | 0.891304348 | 0.976190476 |
| FAM163A AND CNIH4 | 0.927374302 | 0.873684211 | 0.988095238 |
| FAM163A AND ALG5 | 0.927374302 | 0.873684211 | 0.988095238 |
| FAM163A AND GUSB | 0.947976879 | 0.921348315 | 0.976190476 |
| FAM163A AND NOT-VN1R2 | 0.957575758 | 0.975308642 | 0.94047619 |
| FAM163A AND NOT-HTR1B | 0.927374302 | 0.873684211 | 0.988095238 |
| FAM163A AND NOT-HTR6 | 0.922222222 | 0.864583333 | 0.988095238 |
| FAM163A AND NOT-CLEC4D | 0.948571429 | 0.912087912 | 0.988095238 |
| FAM163A AND NOT-3391667 | 0.93258427 | 0.882978723 | 0.988095238 |
| FAM163A AND NOT-FREM2 | 0.947368421 | 0.931034483 | 0.964285714 |
| FAM163A AND NOT-COX8C | 0.959537572 | 0.93258427 | 0.988095238 |
| FAM163A AND NOT-IL12B | 0.954022989 | 0.922222222 | 0.988095238 |
| FAM163A AND NOT-IL12RB2 | 0.93258427 | 0.882978723 | 0.988095238 |
| FAM163A AND NOT-ITGB6 | 0.952941176 | 0.941860465 | 0.964285714 |
| FAM163A AND NOT-KCNA1 | 0.982248521 | 0.976470588 | 0.988095238 |
| FAM163A AND NOT-SPEM1 | 0.922222222 | 0.864583333 | 0.988095238 |
| FAM163A AND NOT-KCND3 | 0.922222222 | 0.864583333 | 0.988095238 |
| FAM163A AND NOT-KCNJ10 | 0.937853107 | 0.892473118 | 0.988095238 |
| FAM163A AND NOT-CLEC12B | 0.948571429 | 0.912087912 | 0.988095238 |
| FAM163A AND NOT-LHCGR | 0.922222222 | 0.864583333 | 0.988095238 |
| FAM163A AND PPAPDC2 | 0.942528736 | 0.911111111 | 0.976190476 |
| FAM163A AND NOT-LRP4 | 0.937142857 | 0.901098901 | 0.976190476 |
| FAM163A AND NOT-HAPLN4 | 0.931818182 | 0.891304348 | 0.976190476 |
| FAM163A AND NOT-ERVFRD-1 | 0.927374302 | 0.873684211 | 0.988095238 |
| FAM163A AND NOT-LCN10 | 0.931818182 | 0.891304348 | 0.976190476 |
| FAM163A AND NOT-MME | 0.953488372 | 0.931818182 | 0.976190476 |
| FAM163A AND NOT-MOG | 0.943181818 | 0.902173913 | 0.988095238 |
| FAM163A AND MARCH11 | 0.931818182 | 0.891304348 | 0.976190476 |
| FAM163A AND NOT-ATP1A2 | 0.927374302 | 0.873684211 | 0.988095238 |
| FAM163A AND NOT-ATP1B2 | 0.958579882 | 0.952941176 | 0.964285714 |
| FAM163A AND NOT-NPY5R | 0.970760234 | 0.954022989 | 0.988095238 |
| FAM163A AND NOT-NTRK2 | 0.927374302 | 0.873684211 | 0.988095238 |
| FAM163A AND NOT-ATP2B2 | 0.93258427 | 0.882978723 | 0.988095238 |
| FAM163A AND NOT-CD207 | 0.937142857 | 0.901098901 | 0.976190476 |
| FAM163A AND IER3IP1 | 0.948571429 | 0.912087912 | 0.988095238 |
| FAM163A AND FAM8A1 | 0.964705882 | 0.953488372 | 0.976190476 |
| FAM163A AND TMEM14C | 0.942528736 | 0.911111111 | 0.976190476 |
| FAM163A AND ATP5F1 | 0.954022989 | 0.922222222 | 0.988095238 |
| FAM163A AND PFN2 | 0.959537572 | 0.93258427 | 0.988095238 |
| FAM163A AND SLC25A3 | 0.965116279 | 0.943181818 | 0.988095238 |
| FAM163A AND NOT-PI3 | 0.947976879 | 0.921348315 | 0.976190476 |
| FAM163A AND SLC38A2 | 0.96969697 | 0.987654321 | 0.952380952 |
| FAM163A AND NDUFB11 | 0.954022989 | 0.922222222 | 0.988095238 |
| FAM163A AND NOT-EQTN | 0.937142857 | 0.901098901 | 0.976190476 |
| FAM163A AND CRLS1 | 0.922222222 | 0.864583333 | 0.988095238 |
| FAM163A AND NOT-DCHS2 | 0.976470588 | 0.965116279 | 0.988095238 |
| FAM163A AND ZDHHC4 | 0.93258427 | 0.882978723 | 0.988095238 |
| FAM163A AND NOT-TMEM144 | 0.937142857 | 0.901098901 | 0.976190476 |
| FAM163A AND NOT-STYK1 | 0.975903614 | 0.987804878 | 0.964285714 |
| FAM163A AND LRRC59 | 0.93258427 | 0.882978723 | 0.988095238 |
| FAM163A AND PLGRKT | 0.948571429 | 0.912087912 | 0.988095238 |
| FAM163A AND NOT-SLC7A10 | 0.948571429 | 0.912087912 | 0.988095238 |
| FAM163A AND DIABLO | 0.957575758 | 0.975308642 | 0.94047619 |
| FAM163A AND NOT-C2orf83 | 0.959064327 | 0.942528736 | 0.976190476 |
| FAM163A AND C5orf15 | 0.937142857 | 0.901098901 | 0.976190476 |
| FAM163A AND NOT-SLC17A7 | 0.927374302 | 0.873684211 | 0.988095238 |
| FAM163A AND VANGL2 | 0.942528736 | 0.911111111 | 0.976190476 |
| FAM163A AND NOT-HHATL | 0.937853107 | 0.892473118 | 0.988095238 |
| FAM163A AND TXNDC16 | 0.952941176 | 0.941860465 | 0.964285714 |
| FAM163A AND SELK | 0.936416185 | 0.91011236 | 0.964285714 |
| FAM163A AND NOT-RAD51B | 0.953488372 | 0.931818182 | 0.976190476 |
| FAM163A AND NOT-CACNG6 | 0.954022989 | 0.922222222 | 0.988095238 |
| FAM163A AND NOT-LGR6 | 0.958083832 | 0.963855422 | 0.952380952 |
| FAM163A AND NOT-CDH26 | 0.922222222 | 0.864583333 | 0.988095238 |
| FAM163A AND NOT-ROS1 | 0.93258427 | 0.882978723 | 0.988095238 |
| FAM163A AND NOT-CTXN3 | 0.965116279 | 0.943181818 | 0.988095238 |
| FAM163A AND RTN1 | 0.937142857 | 0.901098901 | 0.976190476 |
| FAM163A AND NOT-SLC22A23 | 0.927374302 | 0.873684211 | 0.988095238 |
| FAM163A AND NOT-SCN1A | 0.93258427 | 0.882978723 | 0.988095238 |
| FAM163A AND NOT-SCN1B | 0.941860465 | 0.920454545 | 0.964285714 |
| FAM163A AND NOT-SCN10A | 0.93258427 | 0.882978723 | 0.988095238 |
| FAM163A AND SMIM15 | 0.922222222 | 0.864583333 | 0.988095238 |
| FAM163A AND NOT-SMIM10 | 0.93258427 | 0.882978723 | 0.988095238 |
| FAM163A AND MFSD1 | 0.941860465 | 0.920454545 | 0.964285714 |
| FAM163A AND NOT-LMF1 | 0.937853107 | 0.892473118 | 0.988095238 |
| FAM163A AND NOT-LRRC19 | 0.959537572 | 0.93258427 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NETO2 | 0.9375 | 1 | 0.882352941 | FAM163A AND NOT-SLC1A3 | 0.93258427 | 0.882978723 | 0.988095238 |
| PTPRZ1 AND NOT-SFXN3 | 0.9375 | 1 | 0.882352941 | FAM163A AND NOT-SLC5A1 | 0.954022989 | 0.922222222 | 0.988095238 |
| PTPRZ1 AND NOT-PNPLA4 | 0.903225806 | 1 | 0.823529412 | FAM163A AND NOT-SLC13A1 | 0.982248521 | 0.976470588 | 0.988095238 |
| PTPRZ1 AND NOT-TMEM187 | 0.903225806 | 1 | 0.823529412 | FAM163A AND NOT-SLC15A2 | 0.959537572 | 0.93258427 | 0.988095238 |
| PTPRZ1 AND KLRC4 | 0.903225806 | 1 | 0.823529412 | FAM163A AND SLC20A1 | 0.93258427 | 0.882978723 | 0.988095238 |
| PTPRZ1 AND NOT-FZD6 | 0.9375 | 1 | 0.882352941 | FAM163A AND NOT-CYP4F12 | 0.941860465 | 0.920454545 | 0.964285714 |
| PTPRZ1 AND FZD7 | 0.9375 | 1 | 0.882352941 | FAM163A AND SSR2 | 0.922222222 | 0.864583333 | 0.988095238 |
| PTPRZ1 AND FZD8 | 0.9375 | 1 | 0.882352941 | FAM163A AND NOT-SSTR1 | 0.927374302 | 0.873684211 | 0.988095238 |
| PTPRZ1 AND EMC6 | 0.9375 | 1 | 0.882352941 | FAM163A AND NOT-BRS3 | 0.937853107 | 0.892473118 | 0.988095238 |
| PTPRZ1 AND NOT-TMEM47 | 0.9375 | 1 | 0.882352941 | FAM163A AND NOT-BTC | 0.93258427 | 0.882978723 | 0.988095238 |
| PTPRZ1 AND NOT-CRISPLD2 | 0.903225806 | 1 | 0.823529412 | FAM163A AND NOT-TRPC3 | 0.987951807 | 1 | 0.976190476 |
| PTPRZ1 AND L3MBTL2 | 0.9375 | 1 | 0.882352941 | FAM163A AND NOT-C1orf234 | 0.937142857 | 0.901098901 | 0.976190476 |
| PTPRZ1 AND NOT-ARMC10 | 0.9375 | 1 | 0.882352941 | FAM163A AND NOT-TYR | 0.937853107 | 0.892473118 | 0.988095238 |
| PTPRZ1 AND OR1A1 | 0.9375 | 1 | 0.882352941 | FAM163A AND NOT-UPK1B | 0.964705882 | 0.953488372 | 0.976190476 |
| PTPRZ1 AND NOT-ESYT3 | 0.9375 | 1 | 0.882352941 | FAM163A AND TMEM258 | 0.943181818 | 0.902173913 | 0.988095238 |
| PTPRZ1 AND NOT-TMTC1 | 0.903225806 | 1 | 0.823529412 | FAM163A AND NOT-CACNA1A | 0.931818182 | 0.891304348 | 0.976190476 |
| PTPRZ1 AND TMEM120A | 0.9375 | 1 | 0.882352941 | FAM163A AND NOT-BSND | 0.946745562 | 0.941176471 | 0.952380952 |
| PTPRZ1 AND NOT-TM2D2 | 0.903225806 | 1 | 0.823529412 | FAM163A AND NOT-YIPF2 | 0.943181818 | 0.902173913 | 0.988095238 |
| PTPRZ1 AND NOT-OR3A3 | 0.9375 | 1 | 0.882352941 | FAM163A AND GDAP1L1 | 0.927374302 | 0.873684211 | 0.988095238 |
| PTPRZ1 AND NOT-STARD3NL | 0.9375 | 1 | 0.882352941 | FAM163A AND NOT-SMIM2 | 0.943181818 | 0.902173913 | 0.988095238 |
| PTPRZ1 AND TMEM133 | 0.903225806 | 1 | 0.823529412 | FAM163A AND DERL1 | 0.922222222 | 0.864583333 | 0.988095238 |
| PTPRZ1 AND NOT-TM2D1 | 0.9375 | 1 | 0.882352941 | FAM163A AND NOT-C1orf115 | 0.931818182 | 0.891304348 | 0.976190476 |
| PTPRZ1 AND B3GNT5 | 0.903225806 | 1 | 0.823529412 | FAM163A AND NOT-TMC5 | 0.948571429 | 0.912087912 | 0.988095238 |
| PTPRZ1 AND NOT-ZNRF3 | 0.9375 | 1 | 0.882352941 | FAM163A AND TUSC3 | 0.93258427 | 0.882978723 | 0.988095238 |
| PTPRZ1 AND NOT-SLITRK6 | 0.9375 | 1 | 0.882352941 | FAM163A AND NOT-PAQR6 | 0.937853107 | 0.892473118 | 0.988095238 |
| PTPRZ1 AND NOT-USP48 | 0.903225806 | 1 | 0.823529412 | FAM163A AND NOT-GLRA3 | 0.988095238 | 0.988095238 | 0.988095238 |
| PTPRZ1 AND NOT-TMEM117 | 0.9375 | 1 | 0.882352941 | FAM163A AND NOT-PRRT1 | 0.942528736 | 0.911111111 | 0.976190476 |
| PTPRZ1 AND NOT-RHBDD1 | 0.9375 | 1 | 0.882352941 | FAM163A AND NIPA2 | 0.947976879 | 0.921348315 | 0.976190476 |
| PTPRZ1 AND NOT-SLC37A3 | 0.9375 | 1 | 0.882352941 | FAM163A AND EMC6 | 0.93258427 | 0.882978723 | 0.988095238 |
| PTPRZ1 AND NOT-FAM213A | 0.903225806 | 1 | 0.823529412 | FAM163A AND NOT-ESYT3 | 0.964705882 | 0.953488372 | 0.976190476 |
| PTPRZ1 AND NOT-TMEM246 | 0.903225806 | 1 | 0.823529412 | FAM163A AND NOT-SLC25A2 | 0.931818182 | 0.891304348 | 0.976190476 |
| PTPRZ1 AND NOT-PPAPDC1B | 0.9375 | 1 | 0.882352941 | FAM163A AND NOT-SPATA9 | 0.937853107 | 0.892473118 | 0.988095238 |
| PTPRZ1 AND ZNF559 | 0.9375 | 1 | 0.882352941 | FAM163A AND NOT-C2orf40 | 0.927374302 | 0.873684211 | 0.988095238 |
| PTPRZ1 AND NOT-ATRN | 0.9375 | 1 | 0.882352941 | FAM163A AND JAGN1 | 0.937853107 | 0.892473118 | 0.988095238 |
| PTPRZ1 AND NOT-SLC12A8 | 0.9375 | 1 | 0.882352941 | FAM163A AND NOT-FUT10 | 0.970760234 | 0.954022989 | 0.988095238 |
| PTPRZ1 AND NOT-TPST2 | 0.903225806 | 1 | 0.823529412 | FAM163A AND NOT-SLC22A16 | 0.931818182 | 0.891304348 | 0.976190476 |
| PTPRZ1 AND TPST1 | 0.903225806 | 1 | 0.823529412 | FAM163A AND NOT-SLC4A4 | 0.93258427 | 0.882978723 | 0.988095238 |
| PTPRZ1 AND NOT-KIRREL3 | 0.903225806 | 1 | 0.823529412 | FAM163A AND NOT-ADAM7 | 0.93258427 | 0.882978723 | 0.988095238 |
| PTPRZ1 AND NOT-HIATL1 | 0.9375 | 1 | 0.882352941 | FAM163A AND NOT-CACNA1I | 0.937853107 | 0.892473118 | 0.988095238 |
| PTPRZ1 AND NOT-DGAT2 | 0.9375 | 1 | 0.882352941 | FAM163A AND NOT-LMLN | 0.927374302 | 0.873684211 | 0.988095238 |
| PTPRZ1 AND MGARP | 0.903225806 | 1 | 0.823529412 | FAM163A AND NOT-OPALIN | 0.943181818 | 0.902173913 | 0.988095238 |
| PTPRZ1 AND NOT-USP30 | 0.9375 | 1 | 0.882352941 | FAM163A AND NOT-SFXN5 | 0.922222222 | 0.864583333 | 0.988095238 |
| PTPRZ1 AND NOT-PPAPDC3 | 0.9375 | 1 | 0.882352941 | FAM163A AND NOT-SIGLEC6 | 0.976190476 | 0.976190476 | 0.976190476 |
| PTPRZ1 AND NOT-LINGO1 | 0.9375 | 1 | 0.882352941 | FAM163A AND NOT-TMEM63A | 0.937853107 | 0.892473118 | 0.988095238 |
| PTPRZ1 AND NOT-TMTC4 | 0.903225806 | 1 | 0.823529412 | SLC10A4 AND NOT-MFSD4 | 0.927374302 | 0.873684211 | 0.988095238 |
| PTPRZ1 AND NOT-TMEM87B | 0.9375 | 1 | 0.882352941 | MARCH11 AND NOT-MFSD4 | 0.946745562 | 0.941176471 | 0.952380952 |
| PTPRZ1 AND NOT-LRP11 | 0.903225806 | 1 | 0.823529412 | SLC10A4 AND NOT-DCST1 | 0.954022989 | 0.922222222 | 0.988095238 |
| PTPRZ1 AND DISP1 | 0.903225806 | 1 | 0.823529412 | ST8SIA2 AND NOT-DCST1 | 0.950617284 | 0.987179487 | 0.916666667 |
| PTPRZ1 AND FRMD5 | 0.9375 | 1 | 0.882352941 | SLC10A4 AND NOT-SLC9B1 | 0.948571429 | 0.912087912 | 0.988095238 |
| PTPRZ1 AND NOT-COX14 | 0.903225806 | 1 | 0.823529412 | ST8SIA2 AND NOT-SLC9B1 | 0.950617284 | 0.987179487 | 0.916666667 |
| PTPRZ1 AND NOT-TMEM128 | 0.9375 | 1 | 0.882352941 | MARCH11 AND NOT-SLC38A11 | 0.946745562 | 0.941176471 | 0.952380952 |
| PTPRZ1 AND NOT-TMEM141 | 0.903225806 | 1 | 0.823529412 | ST8SIA2 AND NOT-SLC38A11 | 0.936708861 | 1 | 0.880952381 |
| PTPRZ1 AND NOT-NDST2 | 0.9375 | 1 | 0.882352941 | ST8SIA2 AND NOT-SLC23A3 | 0.936708861 | 1 | 0.880952381 |
| PTPRZ1 AND NOT-IFITM1 | 0.903225806 | 1 | 0.823529412 | SLC10A4 AND NOT-PPM1L | 0.927374302 | 0.873684211 | 0.988095238 |
| PTPRZ1 AND NOT-DGKE | 0.9375 | 1 | 0.882352941 | SLC10A4 AND NOT-IGSF11 | 0.982035928 | 0.987951807 | 0.976190476 |
| PTPRZ1 AND NOT-KIAA1644 | 0.903225806 | 1 | 0.823529412 | ST8SIA2 AND NOT-IGSF11 | 0.95 | 1 | 0.904761905 |
| PTPRZ1 AND NOT-LGR5 | 0.903225806 | 1 | 0.823529412 | SLC10A4 AND NOT-SLC38A9 | 0.922222222 | 0.864583333 | 0.988095238 |
| PTPRZ1 AND NOT-CDC14B | 0.9375 | 1 | 0.882352941 | SLC10A4 AND NOT-SLC25A48 | 0.976470588 | 0.965116279 | 0.988095238 |
| PTPRZ1 AND NOT-CAV1 | 0.903225806 | 1 | 0.823529412 | ST8SIA2 AND NOT-SLC25A48 | 0.956521739 | 1 | 0.916666667 |
| PTPRZ1 AND NOT-LY6D | 0.9375 | 1 | 0.882352941 | SLC10A4 AND NOT-MARVELD2 | 0.927374302 | 0.873684211 | 0.988095238 |
| PTPRZ1 AND NOT-CAV2 | 0.9375 | 1 | 0.882352941 | SLC10A4 AND CCDC112 | 0.953488372 | 0.931818182 | 0.976190476 |
| PTPRZ1 AND NOT-PPAP2A | 0.9375 | 1 | 0.882352941 | SLC10A4 AND NOT-ADRB1 | 0.982035928 | 0.987951807 | 0.976190476 |
| PTPRZ1 AND VAMP8 | 0.903225806 | 1 | 0.823529412 | GPR19 AND NOT-ADRB1 | 0.957575758 | 0.975308642 | 0.94047619 |
| PTPRZ1 AND NOT-DGAT1 | 0.9375 | 1 | 0.882352941 | MARCH11 AND NOT-ADRB1 | 0.958083832 | 0.963855422 | 0.952380952 |
| PTPRZ1 AND NOT-B3GALT4 | 0.903225806 | 1 | 0.823529412 | SLC10A4 AND NOT-SLC2A12 | 0.959537572 | 0.93258427 | 0.988095238 |
| PTPRZ1 AND NOT-B3GALNT1 | 0.9375 | 1 | 0.882352941 | GPR19 AND NOT-SLC2A12 | 0.96969697 | 0.987654321 | 0.952380952 |
| PTPRZ1 AND NOT-TNFSF10 | 0.9375 | 1 | 0.882352941 | MARCH11 AND NOT-SLC2A12 | 0.958083832 | 0.963855422 | 0.952380952 |
| PTPRZ1 AND ADAM23 | 0.903225806 | 1 | 0.823529412 | ADGRB3 AND NOT-SLC2A12 | 0.950617284 | 0.987179487 | 0.916666667 |
| PTPRZ1 AND NOT-CDS2 | 0.9375 | 1 | 0.882352941 | ST8SIA2 AND NOT-SLC2A12 | 0.956521739 | 1 | 0.916666667 |
| PTPRZ1 AND NOT-PEX11A | 0.9375 | 1 | 0.882352941 | SLC10A4 AND NOT-MBOAT1 | 0.922222222 | 0.864583333 | 0.988095238 |
| PTPRZ1 AND NOT-PROM1 | 0.9375 | 1 | 0.882352941 | SLC10A4 AND NOT-NKAIN2 | 0.988095238 | 0.988095238 | 0.988095238 |
| PTPRZ1 AND NOT-SGPL1 | 0.9375 | 1 | 0.882352941 | ST8SIA2 AND NOT-CYP1A1 | 0.956521739 | 1 | 0.916666667 |
| PTPRZ1 AND NOT-CCKBR | 0.9375 | 1 | 0.882352941 | SLC10A4 AND CCDC167 | 0.947368421 | 0.931034483 | 0.964285714 |
| PTPRZ1 AND NOT-PPP1R3F | 0.9375 | 1 | 0.882352941 | MARCH11 AND NOT-CLEC2L | 0.946745562 | 0.941176471 | 0.952380952 |
| PTPRZ1 AND NOT-ABCC10 | 0.9375 | 1 | 0.882352941 | SLC10A4 AND NOT-PEBP4 | 0.975903614 | 0.987804878 | 0.964285714 |
| PTPRZ1 AND NOT-RHOT2 | 0.9375 | 1 | 0.882352941 | MARCH11 AND NOT-PEBP4 | 0.969325153 | 1 | 0.94047619 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-C9orf69 | 0.9375 | 1 | 0.882352941 | SLC10A4 AND NOT-KCNU1 | 0.947976879 | 0.921348315 | 0.976190476 |
| PTPRZ1 AND PKD2L1 | 0.9375 | 1 | 0.882352941 | SLC10A4 AND NOT-CYP4B1 | 0.943181818 | 0.902173913 | 0.988095238 |
| PTPRZ1 AND NOT-MCU | 0.9375 | 1 | 0.882352941 | SLC10A4 AND NOT-OR1Q1 | 0.976470588 | 0.965116279 | 0.988095238 |
| PTPRZ1 AND SLC7A7 | 0.903225806 | 1 | 0.823529412 | MARCH11 AND NOT-FAAH2 | 0.946745562 | 0.941176471 | 0.952380952 |
| PTPRZ1 AND SLC7A6 | 0.9375 | 1 | 0.882352941 | ST8SIA2 AND NOT-MOSPD2 | 0.956521739 | 1 | 0.916666667 |
| PTPRZ1 AND NOT-ANGPTL1 | 0.9375 | 1 | 0.882352941 | SLC10A4 AND NOT-CLEC12A | 0.922222222 | 0.864583333 | 0.988095238 |
| PTPRZ1 AND NOT-CCDC126 | 0.9375 | 1 | 0.882352941 | SLC10A4 AND NOT-TMTC3 | 0.922222222 | 0.864583333 | 0.988095238 |
| PTPRZ1 AND NOT-CLDN12 | 0.9375 | 1 | 0.882352941 | ST8SIA2 AND NOT-TMEM229B | 0.95 | 1 | 0.904761905 |
| PTPRZ1 AND NOT-CLDN8 | 0.9375 | 1 | 0.882352941 | MARCH11 AND NOT-RHBDL3 | 0.946745562 | 0.941176471 | 0.952380952 |
| PTPRZ1 AND NOT-TMEM261 | 0.9375 | 1 | 0.882352941 | SLC10A4 AND NOT-CNST | 0.927374302 | 0.873684211 | 0.988095238 |
| PTPRZ1 AND NOT-ACVR1 | 0.9375 | 1 | 0.882352941 | ST8SIA2 AND NOT-CABP7 | 0.95 | 1 | 0.904761905 |
| PTPRZ1 AND AIFM1 | 0.903225806 | 1 | 0.823529412 | SLC10A4 AND NOT-FAM171B | 0.927374302 | 0.873684211 | 0.988095238 |
| PTPRZ1 AND NOT-SYNGR3 | 0.903225806 | 1 | 0.823529412 | MARCH11 AND NOT-SPTSSB | 0.946745562 | 0.941176471 | 0.952380952 |
| PTPRZ1 AND NOT-SYNGR2 | 0.9375 | 1 | 0.882352941 | ST8SIA2 AND NOT-SPTSSB | 0.936708861 | 1 | 0.880952381 |
| PTPRZ1 AND NOT-SYNGR1 | 0.9375 | 1 | 0.882352941 | MARCH11 AND NOT-GALNTL5 | 0.957575758 | 0.975308642 | 0.94047619 |
| PTPRZ1 AND NOT-PKDCC | 0.9375 | 1 | 0.882352941 | ST8SIA2 AND NOT-PKD1L1 | 0.956521739 | 1 | 0.916666667 |
| PTPRZ1 AND NOT-BOC | 0.9375 | 1 | 0.882352941 | SLC10A4 AND NOT-HTR3C | 0.941860465 | 0.920454545 | 0.964285714 |
| PTPRZ1 AND NOT-MYADM | 0.9375 | 1 | 0.882352941 | SLC10A4 AND NOT-KCNG3 | 0.922222222 | 0.864583333 | 0.988095238 |
| PTPRZ1 AND NOT-RFT1 | 0.9375 | 1 | 0.882352941 | SLC10A4 AND NOT-CLYBL | 0.927374302 | 0.873684211 | 0.988095238 |
| PTPRZ1 AND NOT-SLC33A1 | 0.9375 | 1 | 0.882352941 | MARCH11 AND NOT-CLYBL | 0.951219512 | 0.975 | 0.928571429 |
| PTPRZ1 AND NOT-ACVR1B | 0.9375 | 1 | 0.882352941 | GPR19 AND NOT-DIO2 | 0.963414634 | 0.9875 | 0.94047619 |
| PTPRZ1 AND NOT-LARGE | 0.903225806 | 1 | 0.823529412 | MARCH11 AND NOT-DIO2 | 0.957575758 | 0.975308642 | 0.94047619 |
| PTPRZ1 AND NOT-VAPA | 0.903225806 | 1 | 0.823529412 | ST8SIA2 AND NOT-DIO2 | 0.95 | 1 | 0.904761905 |
| PTPRZ1 AND NOT-DAPL1 | 0.903225806 | 1 | 0.823529412 | ST8SIA2 AND NOT-SLC26A3 | 0.956521739 | 1 | 0.916666667 |
| PTPRZ1 AND NOT-CCPG1 | 0.903225806 | 1 | 0.823529412 | ST8SIA2 AND NOT-DRD1 | 0.950617284 | 0.987179487 | 0.916666667 |
| PTPRZ1 AND PXYLP1 | 0.903225806 | 1 | 0.823529412 | MARCH11 AND NOT-DSCAM | 0.946745562 | 0.941176471 | 0.952380952 |
| PTPRZ1 AND NOT-DHRS3 | 0.9375 | 1 | 0.882352941 | SLC10A4 AND NOT-DTNA | 0.937853107 | 0.892473118 | 0.988095238 |
| PTPRZ1 AND TIMM50 | 0.903225806 | 1 | 0.823529412 | SLC10A4 AND NOT-HBEGF | 0.922222222 | 0.864583333 | 0.988095238 |
| PTPRZ1 AND NOT-DTD1 | 0.9375 | 1 | 0.882352941 | SLC10A4 AND NOT-APLNR | 0.922222222 | 0.864583333 | 0.988095238 |
| PTPRZ1 AND NOT-TMEM183A | 0.9375 | 1 | 0.882352941 | SLC10A4 AND NOT-S1PR1 | 0.931818182 | 0.891304348 | 0.976190476 |
| PTPRZ1 AND NOT-BPIFB1 | 0.9375 | 1 | 0.882352941 | SLC10A4 AND NOT-EDNRB | 0.931818182 | 0.891304348 | 0.976190476 |
| PTPRZ1 AND NOT-REEP6 | 0.9375 | 1 | 0.882352941 | GPR19 AND NOT-EGF | 0.950617284 | 0.987179487 | 0.916666667 |
| PTPRZ1 AND CD83 | 0.903225806 | 1 | 0.823529412 | MARCH11 AND NOT-EGF | 0.958083832 | 0.963855422 | 0.952380952 |
| PTPRZ1 AND PIGM | 0.903225806 | 1 | 0.823529412 | ST8SIA2 AND NOT-EGF | 0.950617284 | 0.987179487 | 0.916666667 |
| PTPRZ1 AND NOT-IGSF8 | 0.9375 | 1 | 0.882352941 | SLC10A4 AND NOT-MEGF8 | 0.922222222 | 0.864583333 | 0.988095238 |
| PTPRZ1 AND NOT-PGAP3 | 0.9375 | 1 | 0.882352941 | SLC10A4 AND NOT-MEGF9 | 0.943181818 | 0.902173913 | 0.988095238 |
| PTPRZ1 AND NOT-GTF3C3 | 0.903225806 | 1 | 0.823529412 | SLC10A4 AND NOT-EGFR | 0.948571429 | 0.912087912 | 0.988095238 |
| PTPRZ1 AND B4GALT5 | 0.903225806 | 1 | 0.823529412 | GPR19 AND NOT-EGFR | 0.951807229 | 0.963414634 | 0.94047619 |
| PTPRZ1 AND NOT-OPALIN | 0.903225806 | 1 | 0.823529412 | MARCH11 AND NOT-EGFR | 0.963414634 | 0.9875 | 0.94047619 |
| PTPRZ1 AND NOT-SDR42E1 | 0.9375 | 1 | 0.882352941 | ST8SIA2 AND NOT-EGFR | 0.956521739 | 1 | 0.916666667 |
| PTPRZ1 AND NOT-TM9SF2 | 0.9375 | 1 | 0.882352941 | GPR19 AND NOT-GRAMD2 | 0.946745562 | 0.941176471 | 0.952380952 |
| PTPRZ1 AND NOT-NRXN1 | 0.9375 | 1 | 0.882352941 | MARCH11 AND NOT-GRAMD2 | 0.946745562 | 0.941176471 | 0.952380952 |
| PTPRZ1 AND NOT-NRXN2 | 0.9375 | 1 | 0.882352941 | ST8SIA2 AND NOT-GRAMD2 | 0.950617284 | 0.987179487 | 0.916666667 |
| PTPRZ1 AND NOT-STOML1 | 0.903225806 | 1 | 0.823529412 | SLC10A4 AND NOT-MCEMP1 | 0.922222222 | 0.864583333 | 0.988095238 |
| PTPRZ1 AND TTYH2 | 0.903225806 | 1 | 0.823529412 | ST8SIA2 AND NOT-APLF | 0.943396226 | 1 | 0.892857143 |
| PTPRZ1 AND NOT-SFXN1 | 0.9375 | 1 | 0.882352941 | SLC10A4 AND NOT-SPNS3 | 0.922222222 | 0.864583333 | 0.988095238 |
| PTPRZ1 AND SFXN5 | 0.903225806 | 1 | 0.823529412 | SLC10A4 AND NOT-GAPT | 0.922222222 | 0.864583333 | 0.988095238 |
| PTPRZ1 AND NOT-TMEM203 | 0.9375 | 1 | 0.882352941 | SLC10A4 AND NOT-C9orf91 | 0.927374302 | 0.873684211 | 0.988095238 |
| PTPRZ1 AND ABCG2 | 0.9375 | 1 | 0.882352941 | SLC10A4 AND NOT-VMA21 | 0.927374302 | 0.873684211 | 0.988095238 |
| PTPRZ1 AND EIF2AK3 | 0.9375 | 1 | 0.882352941 | SLC10A4 AND NOT-CERS3 | 0.942528736 | 0.911111111 | 0.976190476 |
| PTPRZ1 AND NOT-ITM2A | 0.9375 | 1 | 0.882352941 | SLC10A4 AND NOT-ERBB4 | 0.927374302 | 0.873684211 | 0.988095238 |
| PTPRZ1 AND NOT-AKAP6 | 0.903225806 | 1 | 0.823529412 | SLC10A4 AND NOT-ABCA2 | 0.959537572 | 0.93258427 | 0.988095238 |
| PTPRZ1 AND NOT-STX8 | 0.903225806 | 1 | 0.823529412 | SLC10A4 AND NOT-ETV6 | 0.922222222 | 0.864583333 | 0.988095238 |
| PTPRZ1 AND SLC4A8 | 0.9375 | 1 | 0.882352941 | SLC10A4 AND NOT-F3 | 0.927374302 | 0.873684211 | 0.988095238 |
| PTPRZ1 AND NOT-SCAMP1 | 0.903225806 | 1 | 0.823529412 | SLC10A4 AND NOT-FAAH | 0.959537572 | 0.93258427 | 0.988095238 |
| PTPRZ1 AND NOT-GOSR1 | 0.9375 | 1 | 0.882352941 | SLC10A4 AND NOT-LRRC55 | 0.922222222 | 0.864583333 | 0.988095238 |
| PTPRZ1 AND ENTPD1 | 0.903225806 | 1 | 0.823529412 | SLC10A4 AND NOT-MS4A15 | 0.922222222 | 0.864583333 | 0.988095238 |
| PTPRZ1 AND NOT-GABBR2 | 0.903225806 | 1 | 0.823529412 | SLC10A4 AND NOT-FCER1A | 0.922222222 | 0.864583333 | 0.988095238 |
| PTPRZ1 AND SLC25A44 | 0.903225806 | 1 | 0.823529412 | SLC10A4 AND NOT-SLC39A12 | 0.948571429 | 0.912087912 | 0.988095238 |
| PTPRZ1 AND CD69 | 0.903225806 | 1 | 0.823529412 | SLC10A4 AND NOT-OPN5 | 0.954022989 | 0.922222222 | 0.988095238 |
| PTPRZ1 AND CD70 | 0.9375 | 1 | 0.882352941 | SLC10A4 AND NOT-MMD2 | 0.922222222 | 0.864583333 | 0.988095238 |
| PTPRZ1 AND NOT-LAPTM4A | 0.9375 | 1 | 0.882352941 | SLC10A4 AND NOT-GPRC6A | 0.947976879 | 0.921348315 | 0.976190476 |
| PTPRZ1 AND NOT-CLSTN3 | 0.9375 | 1 | 0.882352941 | SLC10A4 AND NOT-LHFPL5 | 0.922222222 | 0.864583333 | 0.988095238 |
| PTPRZ1 AND MLEC | 0.903225806 | 1 | 0.823529412 | SLC10A4 AND NOT-CLCA4 | 0.937853107 | 0.892473118 | 0.988095238 |
| PTPRZ1 AND SUSD6 | 0.903225806 | 1 | 0.823529412 | SLC10A4 AND NOT-SLITRK3 | 0.927374302 | 0.873684211 | 0.988095238 |
| PTPRZ1 AND NOT-TOMM20 | 0.9375 | 1 | 0.882352941 | SLC10A4 AND NOT-ENPP4 | 0.922222222 | 0.864583333 | 0.988095238 |
| PTPRZ1 AND NOT-C2CD5 | 0.903225806 | 1 | 0.823529412 | SLC10A4 AND NOT-KLHDC10 | 0.927374302 | 0.873684211 | 0.988095238 |
| PTPRZ1 AND NOT-MFAP3L | 0.9375 | 1 | 0.882352941 | SLC10A4 AND NOT-FAIM2 | 0.927374302 | 0.873684211 | 0.988095238 |
| PTPRZ1 AND NOT-C2CD2L | 0.9375 | 1 | 0.882352941 | SLC10A4 AND NOT-NFASC | 0.927374302 | 0.873684211 | 0.988095238 |
| PTPRZ1 AND NOT-KIAA0319 | 0.903225806 | 1 | 0.823529412 | SLC10A4 AND NOT-CLCC1 | 0.922222222 | 0.864583333 | 0.988095238 |
| PTPRZ1 AND NOT-TOMM70A | 0.9375 | 1 | 0.882352941 | SLC10A4 AND NOT-MLC1 | 0.959537572 | 0.93258427 | 0.988095238 |
| PTPRZ1 AND NOT-LPPR4 | 0.9375 | 1 | 0.882352941 | SLC10A4 AND NOT-FLT3 | 0.922222222 | 0.864583333 | 0.988095238 |
| PTPRZ1 AND NOT-SV2B | 0.903225806 | 1 | 0.823529412 | SLC10A4 AND NOT-KIAA1024 | 0.927374302 | 0.873684211 | 0.988095238 |
| PTPRZ1 AND SV2A | 0.9375 | 1 | 0.882352941 | SLC10A4 AND NOT-ACSL6 | 0.948571429 | 0.912087912 | 0.988095238 |
| PTPRZ1 AND NOT-ATP2C2 | 0.9375 | 1 | 0.882352941 | SLC10A4 AND NOT-FAM189A1 | 0.952941176 | 0.941860465 | 0.964285714 |
| PTPRZ1 AND NOT-FAM20B | 0.9375 | 1 | 0.882352941 | SLC10A4 AND NOT-SLC7A8 | 0.936416185 | 0.91011236 | 0.964285714 |

FIG. 1 (CONT.)

| Antigen Pair Logic | F1 | Precision | Recall |
|---|---|---|---|
| PTPRZ1 AND NOT-MFN2 | 0.9375 | 1 | 0.882352941 |
| PTPRZ1 AND NOT-CLEC2B | 0.903225806 | 1 | 0.823529412 |
| PTPRZ1 AND NOT-SLC12A6 | 0.9375 | 1 | 0.882352941 |
| PTPRZ1 AND DGCR2 | 0.9375 | 1 | 0.882352941 |
| TPST1 AND NOT-SIGIRR | 0.903225806 | 1 | 0.823529412 |
| TPST1 AND NOT-PERP | 0.903225806 | 1 | 0.823529412 |
| TPST1 AND NOT-VIPR1 | 0.903225806 | 1 | 0.823529412 |
| TPST1 AND NOT-SLMAP | 0.903225806 | 1 | 0.823529412 |
| NOT-TNFSF10 AND GAL3ST4 | 0.9375 | 1 | 0.882352941 |
| TPST1 AND NOT-TNFSF10 | 0.903225806 | 1 | 0.823529412 |
| TPST1 AND NOT-TM9SF2 | 0.903225806 | 1 | 0.823529412 |
| Adenocarcinoma | Breast Neoplasms (Breast A) | | |
| CYB561 AND NOT-SLC2A12 | 0.923076923 | 0.92307692 | 0.923076923 |
| RHBDF1 AND NOT-TMEM256 | 0.916666667 | 1 | 0.846153846 |
| HSD3B7 AND NOT-TMEM256 | 0.916666667 | 1 | 0.846153846 |
| ADAM12 AND NOT-TMEM256 | 0.916666667 | 1 | 0.846153846 |
| SLC5A6 AND NOT-TMEM256 | 0.916666667 | 1 | 0.846153846 |
| GGT5 AND NOT-TSPAN8 | 0.916666667 | 1 | 0.846153846 |
| ADAM12 AND NOT-ADGRD1 | 0.916666667 | 1 | 0.846153846 |
| LTBP3 AND NOT-HBD | 0.916666667 | 1 | 0.846153846 |
| MARVELD3 AND NOT-TMEM220 | 0.916666667 | 1 | 0.846153846 |
| RHBDF1 AND NOT-SMIM5 | 0.96 | 1 | 0.923076923 |
| LMLN AND NOT-XK | 0.916666667 | 1 | 0.846153846 |
| Glioma (Glioma) | | | |
| PTPRZ1 | 0.985507246 | 0.98550725 | 0.985507246 |
| NLGN1 | 0.917293233 | 0.953125 | 0.884057971 |
| SCRG1 | 0.909090909 | 0.87837838 | 0.942028986 |
| PRAF2 | 0.905109489 | 0.91176471 | 0.898550725 |
| SYT11 | 0.951048951 | 0.91891892 | 0.985507246 |
| AGPAT5 | 0.905109489 | 0.91176471 | 0.898550725 |
| CHST10 | 0.915492958 | 0.89041096 | 0.942028986 |
| TPST1 | 0.917293233 | 0.953125 | 0.884057971 |
| NLGN1 AND NOT-TNFRSF17 | 0.938461538 | 1 | 0.884057971 |
| ITGAV AND NOT-TNFRSF17 | 0.928571429 | 0.91549296 | 0.942028986 |
| PRAF2 AND PRAF2 | 0.905109489 | 0.91176471 | 0.898550725 |
| SYT11 AND TNFRSF17 | 0.943661972 | 0.91780822 | 0.971014493 |
| SCRG1 AND TNFRSF17 | 0.907801418 | 0.88888889 | 0.927536232 |
| TPST1 AND TPST1 | 0.917293233 | 0.953125 | 0.884057971 |
| AGPAT5 AND NOT-TNFRSF17 | 0.946564885 | 1 | 0.898550725 |
| PTPRZ1 AND NOT-TNFRSF17 | 0.97810219 | 0.98529412 | 0.971014493 |
| NRCAM AND NOT-FOLH1 | 0.909090909 | 0.95238095 | 0.869565217 |
| NLGN1 AND NLGN1 | 0.917293233 | 0.953125 | 0.884057971 |
| PRAF2 AND NOT-FOLH1 | 0.909090909 | 0.95238095 | 0.869565217 |
| XPR1 AND FOLH1 | 0.909090909 | 0.95238095 | 0.869565217 |
| SYT11 AND NOT-FOLH1 | 0.956521739 | 0.95652174 | 0.956521739 |
| SCRG1 AND NOT-FOLH1 | 0.919708029 | 0.92647059 | 0.913043478 |
| TPST1 AND TPST1 | 0.917293233 | 0.953125 | 0.884057971 |
| AGPAT5 AND FOLH1 | 0.905109489 | 0.91176471 | 0.898550725 |
| CHST10 AND NOT-FOLH1 | 0.935251799 | 0.92857143 | 0.942028986 |
| PTPRZ1 AND NOT-FOLH1 | 0.970588235 | 0.98507463 | 0.956521739 |
| PRAF2 AND PRAF2 | 0.905109489 | 0.91176471 | 0.898550725 |
| SYT11 AND CD44 | 0.928571429 | 0.91549296 | 0.942028986 |
| SCRG1 AND CD44 | 0.909090909 | 0.87837838 | 0.942028986 |
| TPST1 AND TPST1 | 0.917293233 | 0.953125 | 0.884057971 |
| CHST10 AND CD44 | 0.925373134 | 0.95384615 | 0.898550725 |
| PTPRZ1 AND CD44 | 0.985507246 | 0.98550725 | 0.985507246 |
| NLGN1 AND NLGN1 | 0.917293233 | 0.953125 | 0.884057971 |
| ITGAV AND NOT-WT1 | 0.921985816 | 0.90277778 | 0.942028986 |
| PRAF2 AND PRAF2 | 0.905109489 | 0.91176471 | 0.898550725 |
| SYT11 AND WT1 | 0.920863309 | 0.91428571 | 0.927536232 |
| SCRG1 AND SCRG1 | 0.909090909 | 0.87837838 | 0.942028986 |
| TPST1 AND TPST1 | 0.917293233 | 0.953125 | 0.884057971 |
| AGPAT5 AND WT1 | 0.905109489 | 0.91176471 | 0.898550725 |
| PTPRZ1 AND WT1 | 0.985507246 | 0.98550725 | 0.985507246 |
| NLGN1 AND NLGN1 | 0.917293233 | 0.953125 | 0.884057971 |
| ITGAV AND CD33 | 0.929577465 | 0.90410959 | 0.956521739 |
| PRAF2 AND PRAF2 | 0.905109489 | 0.91176471 | 0.898550725 |
| SYT11 AND CD33 | 0.951048951 | 0.91891892 | 0.985507246 |
| SCRG1 AND CD33 | 0.909090909 | 0.87837838 | 0.942028986 |
| TPST1 AND TPST1 | 0.917293233 | 0.953125 | 0.884057971 |
| AGPAT5 AND NOT-CD33 | 0.939393939 | 0.98412698 | 0.898550725 |
| CHST10 AND CD33 | 0.9 | 0.88732394 | 0.913043478 |
| PTPRZ1 AND CD33 | 0.985507246 | 0.98550725 | 0.985507246 |
| NLGN1 AND NLGN1 | 0.917293233 | 0.953125 | 0.884057971 |
| NOT-PRAF2 AND ST8SIA1 | 0.90647482 | 0.9 | 0.913043478 |
| SYT11 AND ST8SIA1 | 0.951048951 | 0.91891892 | 0.985507246 |

| Antigen Pair Logic | F1 | Precision | Recall |
|---|---|---|---|
| SLC10A4 AND NOT-SLC44A1 | 0.970760234 | 0.954022989 | 0.988095238 |
| SLC10A4 AND NOT-FOLH1 | 0.954022989 | 0.922222222 | 0.988095238 |
| SLC10A4 AND SEC11A | 0.946745562 | 0.941176471 | 0.952380952 |
| SLC10A4 AND SEC61G | 0.947976879 | 0.921348315 | 0.976190476 |
| SLC10A4 AND MMD | 0.954022989 | 0.922222222 | 0.988095238 |
| SLC10A4 AND NOT-SEZ6L | 0.927374302 | 0.873684211 | 0.988095238 |
| SLC10A4 AND NOT-HYAL4 | 0.937142857 | 0.901098901 | 0.976190476 |
| SLC10A4 AND NOT-PIGN | 0.922222222 | 0.864583333 | 0.988095238 |
| SLC10A4 AND NOT-BACE1 | 0.948571429 | 0.912087912 | 0.988095238 |
| SLC10A4 AND NOT-CA14 | 0.93258427 | 0.882978723 | 0.988095238 |
| SLC10A4 AND NOT-RABGAP1 | 0.927374302 | 0.873684211 | 0.988095238 |
| SLC10A4 AND NOT-SLC7A11 | 0.954022989 | 0.922222222 | 0.988095238 |
| SLC10A4 AND NOT-FRRS1L | 0.927374302 | 0.873684211 | 0.988095238 |
| SLC10A4 AND NOT-APOL2 | 0.927374302 | 0.873684211 | 0.988095238 |
| SLC10A4 AND NOT-EML2 | 0.958579882 | 0.952941176 | 0.964285714 |
| SLC10A4 AND NOT-ABCA4 | 0.927374302 | 0.873684211 | 0.988095238 |
| SLC10A4 AND NOT-FUT2 | 0.922222222 | 0.864583333 | 0.988095238 |
| SLC10A4 AND NOT-FUT4 | 0.922222222 | 0.864583333 | 0.988095238 |
| SLC10A4 AND NOT-FUT7 | 0.941860465 | 0.920454545 | 0.964285714 |
| SLC10A4 AND NOT-CADM2 | 0.957055215 | 0.987341772 | 0.928571429 |
| SLC10A4 AND NOT-ZDHHC20 | 0.927374302 | 0.873684211 | 0.988095238 |
| SLC10A4 AND NOT-MYADML2 | 0.927374302 | 0.873684211 | 0.988095238 |
| SLC10A4 AND NOT-RNF144B | 0.927374302 | 0.873684211 | 0.988095238 |
| SLC10A4 AND NOT-GABRA1 | 0.948571429 | 0.912087912 | 0.988095238 |
| SLC10A4 AND NOT-GABRA3 | 0.927374302 | 0.873684211 | 0.988095238 |
| SLC10A4 AND NOT-GABRA4 | 0.927374302 | 0.873684211 | 0.988095238 |
| SLC10A4 AND NOT-GABRA6 | 0.959064327 | 0.942528736 | 0.976190476 |
| SLC10A4 AND NOT-GABRB2 | 0.937853107 | 0.892473118 | 0.988095238 |
| SLC10A4 AND NOT-SLC24A2 | 0.976470588 | 0.965116279 | 0.988095238 |
| SLC10A4 AND NOT-METTL7A | 0.927374302 | 0.873684211 | 0.988095238 |
| SLC10A4 AND NOT-SUMF2 | 0.927374302 | 0.873684211 | 0.988095238 |
| SLC10A4 AND NOT-LY6G6F | 0.937853107 | 0.892473118 | 0.988095238 |
| SLC10A4 AND NOT-SGMS1 | 0.927374302 | 0.873684211 | 0.988095238 |
| SLC10A4 AND NOT-NALCN | 0.922222222 | 0.864583333 | 0.988095238 |
| SLC10A4 AND NOT-TAS2R41 | 0.954022989 | 0.922222222 | 0.988095238 |
| SLC10A4 AND NOT-OR2L2 | 0.927374302 | 0.873684211 | 0.988095238 |
| SLC10A4 AND NOT-IL1RAPL2 | 0.922222222 | 0.864583333 | 0.988095238 |
| SLC10A4 AND NOT-OR7A17 | 0.948571429 | 0.912087912 | 0.988095238 |
| SLC10A4 AND NOT-OR8G1 | 0.943181818 | 0.902173913 | 0.988095238 |
| SLC10A4 AND NOT-OR10A3 | 0.943181818 | 0.902173913 | 0.988095238 |
| SLC10A4 AND NOT-GCNT1 | 0.922222222 | 0.864583333 | 0.988095238 |
| SLC10A4 AND NOT-OR10H3 | 0.948571429 | 0.912087912 | 0.988095238 |
| SLC10A4 AND NOT-OR7C2 | 0.951807229 | 0.963414634 | 0.94047619 |
| SLC10A4 AND NOT-OR7A5 | 0.93258427 | 0.882978723 | 0.988095238 |
| SLC10A4 AND NOT-OR4D1 | 0.941860465 | 0.920454545 | 0.964285714 |
| SLC10A4 AND NOT-ADGRF1 | 0.954022989 | 0.922222222 | 0.988095238 |
| SLC10A4 AND NOT-B3GAT1 | 0.922222222 | 0.864583333 | 0.988095238 |
| SLC10A4 AND NOT-C5AR2 | 0.937853107 | 0.892473118 | 0.988095238 |
| SLC10A4 AND NOT-COQ2 | 0.922222222 | 0.864583333 | 0.988095238 |
| SLC10A4 AND NOT-PCDH11X | 0.952941176 | 0.941860465 | 0.964285714 |
| SLC10A4 AND NOT-GLP1R | 0.947976879 | 0.921348315 | 0.976190476 |
| SLC10A4 AND NOT-GNRHR | 0.948571429 | 0.912087912 | 0.988095238 |
| SLC10A4 AND NOT-SLCO4A1 | 0.922222222 | 0.864583333 | 0.988095238 |
| SLC10A4 AND NOT-XCR1 | 0.954022989 | 0.922222222 | 0.988095238 |
| SLC10A4 AND NOT-GPR6 | 0.922222222 | 0.864583333 | 0.988095238 |
| SLC10A4 AND NOT-C16orf54 | 0.922222222 | 0.864583333 | 0.988095238 |
| SLC10A4 AND NOT-TMEM235 | 0.93258427 | 0.882978723 | 0.988095238 |
| SLC10A4 AND NOT-IZUMO1 | 0.93258427 | 0.882978723 | 0.988095238 |
| SLC10A4 AND NOT-SMIM24 | 0.922222222 | 0.864583333 | 0.988095238 |
| SLC10A4 AND NOT-OR2L13 | 0.922222222 | 0.864583333 | 0.988095238 |
| SLC10A4 AND NOT-GPR26 | 0.93258427 | 0.882978723 | 0.988095238 |
| SLC10A4 AND NOT-PRRT3 | 0.927374302 | 0.873684211 | 0.988095238 |
| SLC10A4 AND NOT-ARL10 | 0.976190476 | 0.976190476 | 0.976190476 |
| SLC10A4 AND NOT-RELL2 | 0.922222222 | 0.864583333 | 0.988095238 |
| SLC10A4 AND NOT-RNF180 | 0.937853107 | 0.892473118 | 0.988095238 |
| SLC10A4 AND NOT-GPR37 | 0.982248521 | 0.976470588 | 0.988095238 |
| SLC10A4 AND NOT-GPR39 | 0.922222222 | 0.864583333 | 0.988095238 |
| SLC10A4 AND NOT-YIPF6 | 0.927374302 | 0.873684211 | 0.988095238 |
| SLC10A4 AND NOT-ILDR1 | 0.922222222 | 0.864583333 | 0.988095238 |
| SLC10A4 AND NOT-ANK1 | 0.927374302 | 0.873684211 | 0.988095238 |
| SLC10A4 AND NOT-GRIA3 | 0.976470588 | 0.965116279 | 0.988095238 |
| SLC10A4 AND NOT-GRID2 | 0.959064327 | 0.942528736 | 0.976190476 |
| SLC10A4 AND NOT-SLC6A16 | 0.922222222 | 0.864583333 | 0.988095238 |
| SLC10A4 AND NOT-GRIK1 | 0.922222222 | 0.864583333 | 0.988095238 |
| SLC10A4 AND NOT-GRIN2A | 0.922222222 | 0.864583333 | 0.988095238 |
| SLC10A4 AND NOT-GRM3 | 0.965116279 | 0.943181818 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| SCRG1 AND ST8SIA1 | 0.909090909 | 0.87837838 | 0.942028986 | SLC10A4 AND NOT-GRM5 | 0.927374302 | 0.873684211 | 0.988095238 |
| PTPRZ1 AND ST8SIA1 | 0.985507246 | 0.98550725 | 0.985507246 | SLC10A4 AND NOT-SLC25A4 | 0.927374302 | 0.873684211 | 0.988095238 |
| NCAM1 AND NOT-CYP4F12 | 0.904761905 | 1 | 0.826086957 | SLC10A4 AND NOT-CYP2S1 | 0.959537572 | 0.93258427 | 0.988095238 |
| NCAM1 AND TMEM14C | 0.900763359 | 0.9516129 | 0.855072464 | SLC10A4 AND NOT-ALG6 | 0.922222222 | 0.864583333 | 0.988095238 |
| NRCAM AND NOT-NCAM1 | 0.909090909 | 0.95238095 | 0.869565217 | SLC10A4 AND NOT-HFE | 0.922222222 | 0.864583333 | 0.988095238 |
| NCAM1 AND WDR83OS | 0.903703704 | 0.92424242 | 0.884057971 | SLC10A4 AND NOT-ADGRE2 | 0.922222222 | 0.864583333 | 0.988095238 |
| NCAM1 AND NOT-OTOR | 0.916030534 | 0.96774194 | 0.869565217 | SLC10A4 AND NOT-SLC29A2 | 0.937142857 | 0.901098901 | 0.976190476 |
| NLGN1 AND NLGN1 | 0.917293233 | 0.953125 | 0.884057971 | SLC10A4 AND NOT-HRH2 | 0.93258427 | 0.882978723 | 0.988095238 |
| NCAM1 AND NOT-SIGLEC6 | 0.918518519 | 0.93939394 | 0.898550725 | SLC10A4 AND NOT-HSD11B1 | 0.922222222 | 0.864583333 | 0.988095238 |
| NCAM1 AND PTTG1IP | 0.907692308 | 0.96721311 | 0.855072464 | SLC10A4 AND NOT-APLP1 | 0.927374302 | 0.873684211 | 0.988095238 |
| NCAM1 AND ITGAV | 0.914728682 | 0.98333333 | 0.855072464 | SLC10A4 AND NOT-HTR1B | 0.954022989 | 0.922222222 | 0.988095238 |
| NCAM1 AND TMX1 | 0.903703704 | 0.92424242 | 0.884057971 | SLC10A4 AND NOT-HTR1F | 0.922222222 | 0.864583333 | 0.988095238 |
| NCAM1 AND SERP1 | 0.903703704 | 0.92424242 | 0.884057971 | SLC10A4 AND NOT-HTR6 | 0.943181818 | 0.902173913 | 0.988095238 |
| NCAM1 AND NOT-CYP3A4 | 0.924242424 | 0.96825397 | 0.884057971 | SLC10A4 AND NOT-CLEC4D | 0.943181818 | 0.902173913 | 0.988095238 |
| NOT-PRAF2 AND NCAM1 | 0.905109489 | 0.91176471 | 0.898550725 | SLC10A4 AND NOT-ICAM4 | 0.922222222 | 0.864583333 | 0.988095238 |
| NCAM1 AND NOT-TMEM26 | 0.911764706 | 0.92537313 | 0.898550725 | SLC10A4 AND NOT-339166? | 0.927374302 | 0.873684211 | 0.988095238 |
| NCAM1 AND UBXN8 | 0.905109489 | 0.91176471 | 0.898550725 | SLC10A4 AND NOT-NAT8L | 0.943181818 | 0.902173913 | 0.988095238 |
| NCAM1 AND NOT-AQP8 | 0.918518519 | 0.93939394 | 0.898550725 | SLC10A4 AND NOT-TREML1 | 0.959064327 | 0.942528736 | 0.976190476 |
| NCAM1 AND SLC38A9 | 0.903703704 | 0.92424242 | 0.884057971 | SLC10A4 AND NOT-COX8C | 0.937853107 | 0.892473118 | 0.988095238 |
| NCAM1 AND NOT-CHST4 | 0.914728682 | 0.98333333 | 0.855072464 | SLC10A4 AND NOT-GLDN | 0.976190476 | 0.976190476 | 0.976190476 |
| PON2 AND NCAM1 | 0.918518519 | 0.93939394 | 0.898550725 | SLC10A4 AND NOT-SLC35B2 | 0.922222222 | 0.864583333 | 0.988095238 |
| XPR1 AND NCAM1 | 0.909090909 | 0.95238095 | 0.869565217 | SLC10A4 AND NOT-IL6ST | 0.927374302 | 0.873684211 | 0.988095238 |
| NCAM1 AND GOLM1 | 0.916030534 | 0.96774194 | 0.869565217 | SLC10A4 AND NOT-AQP1 | 0.937853107 | 0.892473118 | 0.988095238 |
| NCAM1 AND WRB | 0.917293233 | 0.953125 | 0.884057971 | SLC10A4 AND NOT-IL12B | 0.948571429 | 0.912087912 | 0.988095238 |
| NCAM1 AND SELK | 0.916030534 | 0.96774194 | 0.869565217 | SLC10A4 AND NOT-IL12RB2 | 0.943181818 | 0.902173913 | 0.988095238 |
| NCAM1 AND GALNT1 | 0.911764706 | 0.92537313 | 0.898550725 | SLC10A4 AND NOT-AQP4 | 0.982248521 | 0.976470588 | 0.988095238 |
| NCAM1 AND ATRAID | 0.903703704 | 0.92424242 | 0.884057971 | SLC10A4 AND NOT-INPP4A | 0.922222222 | 0.864583333 | 0.988095238 |
| NCAM1 AND ATP5F1 | 0.903703704 | 0.92424242 | 0.884057971 | SLC10A4 AND NOT-INSIG1 | 0.922222222 | 0.864583333 | 0.988095238 |
| NCAM1 AND SLC30A5 | 0.903703704 | 0.92424242 | 0.884057971 | SLC10A4 AND NOT-ITGA2B | 0.947976879 | 0.921348315 | 0.976190476 |
| NCAM1 AND NOT-CD1B | 0.930232558 | 1 | 0.869565217 | SLC10A4 AND NOT-ITGA4 | 0.922222222 | 0.864583333 | 0.988095238 |
| NCAM1 AND NOT-AADAC | 0.921875 | 1 | 0.855072464 | SLC10A4 AND NOT-ITGA9 | 0.927374302 | 0.873684211 | 0.988095238 |
| FJX1 AND NCAM1 | 0.905109489 | 0.91176471 | 0.898550725 | SLC10A4 AND NOT-ITGB6 | 0.941860465 | 0.920454545 | 0.964285714 |
| SYT11 AND SYT11 | 0.951048951 | 0.91891892 | 0.985507246 | SLC10A4 AND NOT-KCNA2 | 0.927374302 | 0.873684211 | 0.988095238 |
| SCRG1 AND SCRG1 | 0.909090909 | 0.87837838 | 0.942028986 | SLC10A4 AND NOT-KCNA3 | 0.927374302 | 0.873684211 | 0.988095238 |
| NCAM1 AND SPCS1 | 0.907692308 | 0.96721311 | 0.855072464 | SLC10A4 AND NOT-KCNA6 | 0.922222222 | 0.864583333 | 0.988095238 |
| NCAM1 AND JTB | 0.907692308 | 0.96721311 | 0.855072464 | SLC10A4 AND NOT-KCNA7 | 0.941860465 | 0.920454545 | 0.964285714 |
| NCAM1 AND UBA2 | 0.932330827 | 0.96875 | 0.898550725 | SLC10A4 AND NOT-KCNA10 | 0.931818182 | 0.891304348 | 0.976190476 |
| NCAM1 AND NOT-UGT2B15 | 0.914728682 | 0.98333333 | 0.855072464 | SLC10A4 AND NOT-SPEM1 | 0.93258427 | 0.882978723 | 0.988095238 |
| NCAM1 AND E2F5 | 0.903703704 | 0.92424242 | 0.884057971 | SLC10A4 AND NOT-SFT2D2 | 0.922222222 | 0.864583333 | 0.988095238 |
| TPST1 AND NCAM1 | 0.917293233 | 0.953125 | 0.884057971 | SLC10A4 AND NOT-KCND3 | 0.937853107 | 0.892473118 | 0.988095238 |
| AGPAT5 AND NCAM1 | 0.918518519 | 0.93939394 | 0.898550725 | SLC10A4 AND NOT-LHFPL3 | 0.982248521 | 0.976470588 | 0.988095238 |
| NCAM1 AND SEC11A | 0.902255639 | 0.9375 | 0.869565217 | SLC10A4 AND NOT-ENHO | 0.943181818 | 0.902173913 | 0.988095238 |
| NCAM1 AND NOT-TMPRSS15 | 0.925373134 | 0.95384615 | 0.898550725 | SLC10A4 AND NOT-KCNJ2 | 0.93258427 | 0.882978723 | 0.988095238 |
| NCAM1 AND TMEM69 | 0.911764706 | 0.92537313 | 0.898550725 | SLC10A4 AND NOT-KCNJ4 | 0.943181818 | 0.902173913 | 0.988095238 |
| CHST10 AND NCAM1 | 0.915492958 | 0.89041096 | 0.942028986 | SLC10A4 AND NOT-KCNJ6 | 0.948571429 | 0.912087912 | 0.988095238 |
| NCAM1 AND IER3IP1 | 0.909090909 | 0.95238095 | 0.869565217 | SLC10A4 AND NOT-KCNJ9 | 0.927374302 | 0.873684211 | 0.988095238 |
| NCAM1 AND PIGF | 0.903703704 | 0.92424242 | 0.884057971 | SLC10A4 AND NOT-KCNJ10 | 0.954022989 | 0.922222222 | 0.988095238 |
| PTPRZ1 AND NCAM1 | 0.985507246 | 0.98550725 | 0.985507246 | SLC10A4 AND NOT-KCNJ11 | 0.922222222 | 0.864583333 | 0.988095238 |
| NCAM1 AND CDYL | 0.900763359 | 0.9516129 | 0.855072464 | SLC10A4 AND NOT-KCNJ16 | 0.922222222 | 0.864583333 | 0.988095238 |
| NCAM1 AND NDUFA4 | 0.910447761 | 0.93846154 | 0.884057971 | SLC10A4 AND NOT-KCNK1 | 0.954022989 | 0.922222222 | 0.988095238 |
| NCAM1 AND NOT-SIGLECL1 | 0.909090909 | 0.95238095 | 0.869565217 | SLC10A4 AND NOT-KCNN3 | 0.982035928 | 0.987951807 | 0.976190476 |
| NCAM1 AND TMEM203 | 0.903703704 | 0.92424242 | 0.884057971 | SLC10A4 AND NOT-KCNQ3 | 0.927374302 | 0.873684211 | 0.988095238 |
| NLGN1 AND NOT-CD19 | 0.938461538 | 1 | 0.884057971 | SLC10A4 AND NOT-CLEC12B | 0.943181818 | 0.902173913 | 0.988095238 |
| PRAF2 AND PRAF2 | 0.905109489 | 0.91176471 | 0.898550725 | SLC10A4 AND NOT-USP27X | 0.927374302 | 0.873684211 | 0.988095238 |
| SYT11 AND CD19 | 0.928571429 | 0.91549296 | 0.942028986 | SLC10A4 AND NOT-LAIR1 | 0.922222222 | 0.864583333 | 0.988095238 |
| SCRG1 AND CD19 | 0.907801418 | 0.88888889 | 0.927536232 | SLC10A4 AND NOT-LHCGR | 0.927374302 | 0.873684211 | 0.988095238 |
| TPST1 AND TPST1 | 0.917293233 | 0.953125 | 0.884057971 | SLC10A4 AND NOT-LIFR | 0.922222222 | 0.864583333 | 0.988095238 |
| AGPAT5 AND NOT-CD19 | 0.946564885 | 1 | 0.898550725 | SLC10A4 AND NOT-FADS3 | 0.922222222 | 0.864583333 | 0.988095238 |
| PTPRZ1 AND NOT-CD19 | 0.985507246 | 0.98550725 | 0.985507246 | SLC10A4 AND NOT-C14orf180 | 0.927374302 | 0.873684211 | 0.988095238 |
| NLGN1 AND NLGN1 | 0.917293233 | 0.953125 | 0.884057971 | SLC10A4 AND NOT-LNPEP | 0.927374302 | 0.873684211 | 0.988095238 |
| ITGAV AND NOT-GPC3 | 0.913385827 | 1 | 0.84057971 | SLC10A4 AND NOT-HACD4 | 0.922222222 | 0.864583333 | 0.988095238 |
| PRAF2 AND PRAF2 | 0.905109489 | 0.91176471 | 0.898550725 | SLC10A4 AND NOT-LRP2 | 0.943181818 | 0.902173913 | 0.988095238 |
| FJX1 AND NOT-GPC3 | 0.909090909 | 0.95238095 | 0.869565217 | SLC10A4 AND NOT-LRP4 | 0.988095238 | 0.988095238 | 0.988095238 |
| SYT11 AND GPC3 | 0.928571429 | 0.91549296 | 0.942028986 | SLC10A4 AND NOT-LSAMP | 0.965116279 | 0.943181818 | 0.988095238 |
| SCRG1 AND GPC3 | 0.901408451 | 0.87671233 | 0.927536232 | SLC10A4 AND NOT-ERVFRD-1 | 0.954022989 | 0.922222222 | 0.988095238 |
| TPST1 AND TPST1 | 0.917293233 | 0.953125 | 0.884057971 | SLC10A4 AND NOT-M6PR | 0.927374302 | 0.873684211 | 0.988095238 |
| CHST10 AND GPC3 | 0.907801418 | 0.88888889 | 0.927536232 | SLC10A4 AND NOT-MAG | 0.976470588 | 0.965116279 | 0.988095238 |
| PTPRZ1 AND NOT-GPC3 | 0.985507246 | 0.98550725 | 0.985507246 | SLC10A4 AND NOT-MAL | 0.970414201 | 0.964705882 | 0.976190476 |
| NLGN1 AND NLGN1 | 0.917293233 | 0.953125 | 0.884057971 | SLC10A4 AND NOT-MAN2A2 | 0.927374302 | 0.873684211 | 0.988095238 |
| PRAF2 AND PRAF2 | 0.905109489 | 0.91176471 | 0.898550725 | SLC10A4 AND NOT-STS | 0.922222222 | 0.864583333 | 0.988095238 |
| SYT11 AND SYT11 | 0.951048951 | 0.91891892 | 0.985507246 | SLC10A4 AND NOT-LCN10 | 0.942528736 | 0.911111111 | 0.976190476 |
| SCRG1 AND SCRG1 | 0.909090909 | 0.87837838 | 0.942028986 | SLC10A4 AND NOT-MGST1 | 0.922222222 | 0.864583333 | 0.988095238 |
| TPST1 AND NOT-MET | 0.917293233 | 0.953125 | 0.884057971 | SLC10A4 AND NOT-MGST2 | 0.922222222 | 0.864583333 | 0.988095238 |
| CHST10 AND NOT-MET | 0.915492958 | 0.89041096 | 0.942028986 | SLC10A4 AND NOT-MME | 0.922222222 | 0.864583333 | 0.988095238 |
| PTPRZ1 AND NOT-MET | 0.985507246 | 0.98550725 | 0.985507246 | SLC10A4 AND NOT-ALDH6A1 | 0.948571429 | 0.912087912 | 0.988095238 |
| NRCAM AND NOT-B4GALNT1 | 0.921875 | 1 | 0.855072464 | SLC10A4 AND NOT-MOG | 0.976470588 | 0.965116279 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| NLGN1 AND NOT-B4GALNT1 | 0.930232558 | 1 | 0.869565217 | SLC10A4 AND NOT-C1orf186 | 0.922222222 | 0.864583333 | 0.988095238 |
| PRAF2 AND NOT-B4GALNT1 | 0.909090909 | 0.95238095 | 0.869565217 | SLC10A4 AND MARCH11 | 0.953488372 | 0.931818182 | 0.976190476 |
| SYT11 AND NOT-B4GALNT1 | 0.956521739 | 0.95652174 | 0.956521739 | SLC10A4 AND NOT-NCAM1 | 0.937142857 | 0.901098901 | 0.976190476 |
| SCRG1 AND NOT-B4GALNT1 | 0.913043478 | 0.91304348 | 0.913043478 | SLC10A4 AND NOT-ATP1A2 | 0.976470588 | 0.965116279 | 0.988095238 |
| AGPAT5 AND B4GALNT1 | 0.905109489 | 0.91176471 | 0.898550725 | SLC10A4 AND NOT-ATP1A3 | 0.927374302 | 0.873684211 | 0.988095238 |
| CHST10 AND NOT-B4GALNT1 | 0.940298507 | 0.96923077 | 0.913043478 | SLC10A4 AND NOT-NINJ2 | 0.937853107 | 0.892473118 | 0.988095238 |
| PTPRZ1 AND NOT-B4GALNT1 | 0.970588235 | 0.98507463 | 0.956521739 | SLC10A4 AND NNAT | 0.947368421 | 0.931034483 | 0.964285714 |
| NRCAM AND NOT-CD160 | 0.900763359 | 0.9516129 | 0.855072464 | SLC10A4 AND NOT-NMBR | 0.927374302 | 0.873684211 | 0.988095238 |
| FKTN AND NOT-CD160 | 0.904761905 | 1 | 0.826086957 | SLC10A4 AND NOT-ATP1B2 | 0.97005988 | 0.975903614 | 0.964285714 |
| NLGN1 AND NOT-CD160 | 0.921875 | 1 | 0.855072464 | SLC10A4 AND NOT-NPC1 | 0.941860465 | 0.920454545 | 0.964285714 |
| LRRC37A3 AND NOT-CD160 | 0.939393939 | 0.98412698 | 0.898550725 | SLC10A4 AND NOT-NPY5R | 0.954022989 | 0.922222222 | 0.988095238 |
| ITGAV AND NOT-CD160 | 0.954545455 | 1 | 0.913043478 | SLC10A4 AND NOT-NTRK2 | 0.943181818 | 0.902173913 | 0.988095238 |
| MARS AND NOT-CD160 | 0.911764706 | 0.92537313 | 0.898550725 | SLC10A4 AND NOT-ATP2B2 | 0.927374302 | 0.873684211 | 0.988095238 |
| PRAF2 AND NOT-CD160 | 0.923076923 | 0.98360656 | 0.869565217 | SLC10A4 AND NOT-GPR143 | 0.927374302 | 0.873684211 | 0.988095238 |
| XPR1 AND NOT-CD160 | 0.904761905 | 1 | 0.826086957 | SLC10A4 AND NOT-OLR1 | 0.922222222 | 0.864583333 | 0.988095238 |
| GOLM1 AND NOT-CD160 | 0.925373134 | 0.95384615 | 0.898550725 | SLC10A4 AND NOT-OMG | 0.982035928 | 0.987951807 | 0.976190476 |
| WRB AND NOT-CD160 | 0.90625 | 0.98305085 | 0.84057971 | SLC10A4 AND NOT-P2RX1 | 0.922222222 | 0.864583333 | 0.988095238 |
| FJX1 AND NOT-CD160 | 0.918518519 | 0.93939394 | 0.898550725 | SLC10A4 AND NOT-P2RX5 | 0.922222222 | 0.864583333 | 0.988095238 |
| SYT11 AND NOT-CD160 | 0.96350365 | 0.97058824 | 0.956521739 | SLC10A4 AND NOT-P2RY2 | 0.93258427 | 0.882978723 | 0.988095238 |
| SCRG1 AND NOT-CD160 | 0.933333333 | 0.95454545 | 0.913043478 | SLC10A4 AND NOT-CD207 | 0.942528736 | 0.911111111 | 0.976190476 |
| B3GALT6 AND NOT-CD160 | 0.923076923 | 0.98360656 | 0.869565217 | SLC10A4 AND NOT-DUOX2 | 0.922222222 | 0.864583333 | 0.988095238 |
| TPST1 AND NOT-CD160 | 0.913385827 | 1 | 0.84057971 | SLC10A4 AND NOT-CHST11 | 0.922222222 | 0.864583333 | 0.988095238 |
| AGPAT5 AND NOT-CD160 | 0.93129771 | 0.98387097 | 0.884057971 | SLC10A4 AND NOT-TAS2R3 | 0.922222222 | 0.864583333 | 0.988095238 |
| CHST10 AND CD160 | 0.915492958 | 0.89041096 | 0.942028986 | SLC10A4 AND NOT-TAS2R1 | 0.946745562 | 0.941176471 | 0.952380952 |
| JAM2 AND NOT-CD160 | 0.900763359 | 0.9516129 | 0.855072464 | SLC10A4 AND NOT-SPOCK3 | 0.937853107 | 0.892473118 | 0.988095238 |
| PTPRZ1 AND NOT-CD160 | 0.970588235 | 0.98507463 | 0.956521739 | SLC10A4 AND NOT-NTM | 0.948571429 | 0.912087912 | 0.988095238 |
| FKTN AND NOT-ERBB2 | 0.90625 | 0.98305085 | 0.84057971 | SLC10A4 AND NOT-ST8SIA3 | 0.922222222 | 0.864583333 | 0.988095238 |
| NLGN1 AND ERBB2 | 0.917293233 | 0.953125 | 0.884057971 | SLC10A4 AND NOT-PLLP | 0.927374302 | 0.873684211 | 0.988095238 |
| LRRC37A3 AND NOT-ERBB2 | 0.90647482 | 0.9 | 0.913043478 | SLC10A4 AND NOT-ZDHHC9 | 0.937853107 | 0.892473118 | 0.988095238 |
| ITGAV AND NOT-ERBB2 | 0.948148148 | 0.96969697 | 0.927536232 | SLC10A4 AND IER3IP1 | 0.937853107 | 0.892473118 | 0.988095238 |
| PRAF2 AND PRAF2 | 0.905109489 | 0.91176471 | 0.898550725 | SLC10A4 AND NOT-ZDHHC2 | 0.927374302 | 0.873684211 | 0.988095238 |
| FJX1 AND NOT-ERBB2 | 0.90647482 | 0.9 | 0.913043478 | SLC10A4 AND NOT-CRIM1 | 0.922222222 | 0.864583333 | 0.988095238 |
| SYT11 AND ERBB2 | 0.951048951 | 0.91891892 | 0.985507246 | SLC10A4 AND NOT-RXFP3 | 0.922222222 | 0.864583333 | 0.988095238 |
| SCRG1 AND ERBB2 | 0.909090909 | 0.87837838 | 0.942028986 | SLC10A4 AND FAM8A1 | 0.942528736 | 0.911111111 | 0.976190476 |
| TPST1 AND NOT-ERBB2 | 0.930232558 | 1 | 0.869565217 | SLC10A4 AND CUTA | 0.931818182 | 0.891304348 | 0.976190476 |
| AGPAT5 AND ERBB2 | 0.905109489 | 0.91176471 | 0.898550725 | SLC10A4 AND ATP5F1 | 0.93258427 | 0.882978723 | 0.988095238 |
| CHST10 AND ERBB2 | 0.915492958 | 0.89041096 | 0.942028986 | SLC10A4 AND NOT-ACSL5 | 0.922222222 | 0.864583333 | 0.988095238 |
| PTPRZ1 AND NOT-ERBB2 | 0.97810219 | 0.98529412 | 0.971014493 | SLC10A4 AND NOT-GPRC5B | 0.959537572 | 0.93258427 | 0.988095238 |
| NLGN1 AND NLGN1 | 0.917293233 | 0.953125 | 0.884057971 | SLC10A4 AND NOT-ATP8A2 | 0.927374302 | 0.873684211 | 0.988095238 |
| ITGAV AND NOT-IL11RA | 0.924242424 | 0.96825397 | 0.884057971 | SLC10A4 AND NOT-TM7SF3 | 0.922222222 | 0.864583333 | 0.988095238 |
| PRAF2 AND PRAF2 | 0.905109489 | 0.91176471 | 0.898550725 | SLC10A4 AND NOT-GALNT7 | 0.922222222 | 0.864583333 | 0.988095238 |
| FJX1 AND NOT-IL11RA | 0.913043478 | 0.91304348 | 0.913043478 | SLC10A4 AND NOT-PEX10 | 0.937853107 | 0.892473118 | 0.988095238 |
| SYT11 AND SYT11 | 0.951048951 | 0.91891892 | 0.985507246 | SLC10A4 AND PFN2 | 0.937853107 | 0.892473118 | 0.988095238 |
| SCRG1 AND SCRG1 | 0.909090909 | 0.87837838 | 0.942028986 | SLC10A4 AND NOT-PHEX | 0.927374302 | 0.873684211 | 0.988095238 |
| TPST1 AND TPST1 | 0.917293233 | 0.953125 | 0.884057971 | SLC10A4 AND NOT-IL17D | 0.965116279 | 0.943181818 | 0.988095238 |
| AGPAT5 AND AGPAT5 | 0.905109489 | 0.91176471 | 0.898550725 | SLC10A4 AND NOT-STX18 | 0.927374302 | 0.873684211 | 0.988095238 |
| CHST10 AND IL11RA | 0.915492958 | 0.89041096 | 0.942028986 | SLC10A4 AND NOT-FXYD1 | 0.927374302 | 0.873684211 | 0.988095238 |
| PTPRZ1 AND NOT-IL11RA | 0.97810219 | 0.98529412 | 0.971014493 | SLC10A4 AND NOT-ADAM22 | 0.927374302 | 0.873684211 | 0.988095238 |
| NLGN1 AND NOT-PSCA | 0.921875 | 1 | 0.855072464 | SLC10A4 AND NOT-SMIM11 | 0.927374302 | 0.873684211 | 0.988095238 |
| LRRC37A3 AND NOT-PSCA | 0.9 | 0.88732394 | 0.913043478 | SLC10A4 AND NOT-PON2 | 0.922222222 | 0.864583333 | 0.988095238 |
| ITGAV AND NOT-PSCA | 0.948148148 | 0.96969697 | 0.927536232 | SLC10A4 AND NOT-DCHS2 | 0.959537572 | 0.93258427 | 0.988095238 |
| PRAF2 AND PRAF2 | 0.905109489 | 0.91176471 | 0.898550725 | SLC10A4 AND NOT-DPP8 | 0.927374302 | 0.873684211 | 0.988095238 |
| FJX1 AND NOT-PSCA | 0.905109489 | 0.91176471 | 0.898550725 | SLC10A4 AND NOT-LPCAT2 | 0.922222222 | 0.864583333 | 0.988095238 |
| SYT11 AND PSCA | 0.943661972 | 0.91780822 | 0.971014493 | SLC10A4 AND NOT-STX17 | 0.922222222 | 0.864583333 | 0.988095238 |
| SCRG1 AND PSCA | 0.907801418 | 0.88888889 | 0.927536232 | SLC10A4 AND NOT-SUSD4 | 0.922222222 | 0.864583333 | 0.988095238 |
| TPST1 AND NOT-PSCA | 0.938461538 | 1 | 0.884057971 | SLC10A4 AND NOT-SLC52A1 | 0.927374302 | 0.873684211 | 0.988095238 |
| AGPAT5 AND PSCA | 0.905109489 | 0.91176471 | 0.898550725 | SLC10A4 AND NOT-AUP1 | 0.927374302 | 0.873684211 | 0.988095238 |
| CHST10 AND PSCA | 0.907801418 | 0.88888889 | 0.927536232 | SLC10A4 AND NOT-NAT10 | 0.922222222 | 0.864583333 | 0.988095238 |
| PCDHB10 AND NOT-PSCA | 0.904761905 | 1 | 0.826086957 | SLC10A4 AND NOT-FBXW7 | 0.927374302 | 0.873684211 | 0.988095238 |
| PTPRZ1 AND NOT-PSCA | 0.970588235 | 0.98507463 | 0.956521739 | SLC10A4 AND NOT-SPTLC3 | 0.922222222 | 0.864583333 | 0.988095238 |
| NLGN1 AND NLGN1 | 0.917293233 | 0.953125 | 0.884057971 | SLC10A4 AND NOT-TMEM144 | 0.982035928 | 0.987951807 | 0.976190476 |
| LRRC37A3 AND NOT-MS4A1 | 0.90647482 | 0.9 | 0.913043478 | SLC10A4 AND NOT-ACER3 | 0.927374302 | 0.873684211 | 0.988095238 |
| ITGAV AND NOT-MS4A1 | 0.941176471 | 0.95522388 | 0.927536232 | SLC10A4 AND NOT-SLC39A9 | 0.927374302 | 0.873684211 | 0.988095238 |
| PRAF2 AND PRAF2 | 0.905109489 | 0.91176471 | 0.898550725 | SLC10A4 AND NOT-STYK1 | 0.975903614 | 0.987804878 | 0.964285714 |
| XPR1 AND NOT-MS4A1 | 0.913385827 | 1 | 0.84057971 | SLC10A4 AND NOT-AVPR2 | 0.931818182 | 0.891304348 | 0.976190476 |
| TMEM255A AND NOT-MS4A1 | 0.901408451 | 0.87671233 | 0.927536232 | SLC10A4 AND NOT-CDCA7L | 0.922222222 | 0.864583333 | 0.988095238 |
| SYT11 AND MS4A1 | 0.943661972 | 0.91780822 | 0.971014493 | SLC10A4 AND NOT-GALNT10 | 0.927374302 | 0.873684211 | 0.988095238 |
| SCRG1 AND MS4A1 | 0.901408451 | 0.87671233 | 0.927536232 | SLC10A4 AND NOT-GPATCH2L | 0.927374302 | 0.873684211 | 0.988095238 |
| TPST1 AND NOT-MS4A1 | 0.913385827 | 1 | 0.84057971 | SLC10A4 AND NOT-RNF130 | 0.922222222 | 0.864583333 | 0.988095238 |
| AGPAT5 AND NOT-MS4A1 | 0.938461538 | 1 | 0.884057971 | SLC10A4 AND PCDHB10 | 0.946745562 | 0.941176471 | 0.952380952 |
| CHST10 AND MS4A1 | 0.907801418 | 0.88888889 | 0.927536232 | SLC10A4 AND NOT-PCDHAC2 | 0.922222222 | 0.864583333 | 0.988095238 |
| PTPRZ1 AND NOT-MS4A1 | 0.977777778 | 1 | 0.956521739 | SLC10A4 AND NOT-PCDHAC1 | 0.948571429 | 0.912087912 | 0.988095238 |
| KCNH2 AND NOT-MS4A1 | 0.907801418 | 0.88888889 | 0.927536232 | SLC10A4 AND NOT-SLC7A10 | 0.988095238 | 0.988095238 | 0.988095238 |
| BCHE AND NOT-MS4A1 | 0.924242424 | 0.96825397 | 0.884057971 | SLC10A4 AND NOT-PRRG1 | 0.976470588 | 0.965116279 | 0.988095238 |
| NOT-RNF180 AND IL13RA2 | 0.910344828 | 0.86842105 | 0.956521739 | SLC10A4 AND DIABLO | 0.951807229 | 0.963414634 | 0.94047619 |
| NLGN1 AND NLGN1 | 0.917293233 | 0.953125 | 0.884057971 | SLC10A4 AND NOT-AGPAT3 | 0.954022989 | 0.922222222 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| PRAF2 AND PRAF2 | 0.905109489 | 0.91176471 | 0.898550725 | SLC10A4 AND NOT-C2orf83 | 0.937142857 | 0.901098901 | 0.976190476 |
| SYT11 AND IL13RA2 | 0.951048951 | 0.91891892 | 0.985507246 | SLC10A4 AND NOT-SLC17A7 | 0.922222222 | 0.864583333 | 0.988095238 |
| SCRG1 AND IL13RA2 | 0.909090909 | 0.87837838 | 0.942028986 | SLC10A4 AND NOT-MAN1C1 | 0.937853107 | 0.892473118 | 0.988095238 |
| TPST1 AND TPST1 | 0.917293233 | 0.953125 | 0.884057971 | SLC10A4 AND NOT-NIPAL3 | 0.969325153 | 1 | 0.94047619 |
| AGPAT5 AND IL13RA2 | 0.918518519 | 0.93939394 | 0.898550725 | SLC10A4 AND NOT-PTGER2 | 0.922222222 | 0.864583333 | 0.988095238 |
| CHST10 AND IL13RA2 | 0.915492958 | 0.89041096 | 0.942028986 | SLC10A4 AND NOT-TTYH1 | 0.970760234 | 0.954022989 | 0.988095238 |
| PTPRZ1 AND IL13RA2 | 0.985507246 | 0.98550725 | 0.985507246 | SLC10A4 AND NOT-NDRG2 | 0.982248521 | 0.976470588 | 0.988095238 |
| NOT-CRB1 AND IL13RA2 | 0.905109489 | 0.91176471 | 0.898550725 | SLC10A4 AND NOT-TMCC3 | 0.942528736 | 0.911111111 | 0.976190476 |
| NLGN1 AND NLGN1 | 0.917293233 | 0.953125 | 0.884057971 | SLC10A4 AND NOT-KIAA1161 | 0.931818182 | 0.891304348 | 0.976190476 |
| PRAF2 AND PRAF2 | 0.905109489 | 0.91176471 | 0.898550725 | SLC10A4 AND NOT-HHATL | 0.976470588 | 0.965116279 | 0.988095238 |
| SYT11 AND SYT11 | 0.951048951 | 0.91891892 | 0.985507246 | SLC10A4 AND NOT-SLC12A5 | 0.964705882 | 0.953488372 | 0.976190476 |
| SCRG1 AND SCRG1 | 0.909090909 | 0.87837838 | 0.942028986 | SLC10A4 AND NOT-NCEH1 | 0.927374302 | 0.873684211 | 0.988095238 |
| TPST1 AND NOT-IGF1R | 0.938461538 | 1 | 0.884057971 | SLC10A4 AND NOT-PCDH10 | 0.927374302 | 0.873684211 | 0.988095238 |
| AGPAT5 AND AGPAT5 | 0.905109489 | 0.91176471 | 0.898550725 | SLC10A4 AND NOT-SLC7A14 | 0.927374302 | 0.873684211 | 0.988095238 |
| PTPRZ1 AND NOT-IGF1R | 0.97810219 | 0.98529412 | 0.971014493 | SLC10A4 AND NOT-CADM3 | 0.927374302 | 0.873684211 | 0.988095238 |
| NLGN1 AND NOT-MAGEA1 | 0.904761905 | 1 | 0.826086957 | SLC10A4 AND NOT-SLC46A2 | 0.927374302 | 0.873684211 | 0.988095238 |
| ITGAV AND MAGEA1 | 0.914285714 | 0.90140845 | 0.927536232 | SLC10A4 AND NOT-SRPRB | 0.927374302 | 0.873684211 | 0.988095238 |
| PRAF2 AND PRAF2 | 0.905109489 | 0.91176471 | 0.898550725 | SLC10A4 AND NOT-BBS4 | 0.927374302 | 0.873684211 | 0.988095238 |
| SYT11 AND MAGEA1 | 0.936170213 | 0.91666667 | 0.956521739 | SLC10A4 AND NOT-RAD51B | 0.953488372 | 0.931818182 | 0.976190476 |
| SCRG1 AND MAGEA1 | 0.907801418 | 0.88888889 | 0.927536232 | SLC10A4 AND NOT-ENPP5 | 0.97005988 | 0.975903614 | 0.964285714 |
| TPST1 AND MAGEA1 | 0.909090909 | 0.95238095 | 0.869565217 | SLC10A4 AND NOT-CACNG6 | 0.948571429 | 0.912087912 | 0.988095238 |
| CHST10 AND MAGEA1 | 0.9 | 0.88732394 | 0.913043478 | SLC10A4 AND NOT-LGR6 | 0.963855422 | 0.975609756 | 0.952380952 |
| PTPRZ1 AND NOT-MAGEA1 | 0.955223881 | 0.98461538 | 0.927536232 | SLC10A4 AND NOT-RET | 0.927374302 | 0.873684211 | 0.988095238 |
| SRR AND NOT-MLANA | 0.904761905 | 1 | 0.826086957 | SLC10A4 AND NOT-BCL2L2 | 0.927374302 | 0.873684211 | 0.988095238 |
| NLGN1 AND MLANA | 0.917293233 | 0.953125 | 0.884057971 | SLC10A4 AND NOT-CDH26 | 0.937853107 | 0.892473118 | 0.988095238 |
| LRRC37A3 AND NOT-MLANA | 0.915492958 | 0.89041096 | 0.942028986 | SLC10A4 AND NOT-ROS1 | 0.937853107 | 0.892473118 | 0.988095238 |
| ITGAV AND NOT-MLANA | 0.96350365 | 0.97058824 | 0.956521739 | SLC10A4 AND NOT-CTXN3 | 0.988095238 | 0.988095238 | 0.988095238 |
| PRAF2 AND NOT-MLANA | 0.925373134 | 0.95384615 | 0.898550725 | SLC10A4 AND RTN2 | 0.922222222 | 0.864583333 | 0.988095238 |
| FJX1 AND NOT-MLANA | 0.920863309 | 0.91428571 | 0.927536232 | SLC10A4 AND NOT-SORT1 | 0.948571429 | 0.912087912 | 0.988095238 |
| SYT11 AND MLANA | 0.928571429 | 0.91549296 | 0.942028986 | SLC10A4 AND NOT-BDNF | 0.922222222 | 0.864583333 | 0.988095238 |
| TPST1 AND TPST1 | 0.917293233 | 0.953125 | 0.884057971 | SLC10A4 AND NOT-SC5D | 0.927374302 | 0.873684211 | 0.988095238 |
| PTPRZ1 AND NOT-MLANA | 0.985507246 | 0.98550725 | 0.985507246 | SLC10A4 AND NOT-SCD | 0.954022989 | 0.922222222 | 0.988095238 |
| NLGN1 AND NLGN1 | 0.917293233 | 0.953125 | 0.884057971 | SLC10A4 AND NOT-SCN1B | 0.964285714 | 0.964285714 | 0.964285714 |
| PRAF2 AND PRAF2 | 0.905109489 | 0.91176471 | 0.898550725 | SLC10A4 AND NOT-SCN2B | 0.963414634 | 0.9875 | 0.94047619 |
| SYT11 AND SYT11 | 0.951048951 | 0.91891892 | 0.985507246 | SLC10A4 AND NOT-SCN4B | 0.958083832 | 0.963855422 | 0.952380952 |
| SCRG1 AND SCRG1 | 0.909090909 | 0.87837838 | 0.942028986 | SLC10A4 AND NOT-SCN8A | 0.927374302 | 0.873684211 | 0.988095238 |
| TPST1 AND TPST1 | 0.917293233 | 0.953125 | 0.884057971 | SLC10A4 AND NOT-SCN10A | 0.937853107 | 0.892473118 | 0.988095238 |
| CHST10 AND ERBB3 | 0.915492958 | 0.89041096 | 0.942028986 | SLC10A4 AND NOT-SCNN1G | 0.959537572 | 0.93258427 | 0.988095238 |
| PTPRZ1 AND NOT-ERBB3 | 0.985507246 | 0.98550725 | 0.985507246 | SLC10A4 AND NOT-CX3CL1 | 0.922222222 | 0.864583333 | 0.988095238 |
| NLGN1 AND NLGN1 | 0.917293233 | 0.953125 | 0.884057971 | SLC10A4 AND NOT-SDC1 | 0.922222222 | 0.864583333 | 0.988095238 |
| PRAF2 AND PRAF2 | 0.905109489 | 0.91176471 | 0.898550725 | SLC10A4 AND NOT-SDHC | 0.927374302 | 0.873684211 | 0.988095238 |
| SYT11 AND NOT-ERBB4 | 0.964028777 | 0.95714286 | 0.971014493 | SLC10A4 AND NOT-SEL1L | 0.927374302 | 0.873684211 | 0.988095238 |
| SCRG1 AND NOT-ERBB4 | 0.909090909 | 0.87837838 | 0.942028986 | SLC10A4 AND NOT-SMIM10 | 0.948571429 | 0.912087912 | 0.988095238 |
| TPST1 AND ERBB4 | 0.900763359 | 0.9516129 | 0.855072464 | SLC10A4 AND NOT-TMEM200C | 0.927374302 | 0.873684211 | 0.988095238 |
| AGPAT5 AND ERBB4 | 0.910447761 | 0.93846154 | 0.884057971 | SLC10A4 AND NOT-LMF1 | 0.976470588 | 0.965116279 | 0.988095238 |
| CHST10 AND NOT-ERBB4 | 0.927536232 | 0.92753623 | 0.927536232 | SLC10A4 AND NOT-P2RY12 | 0.957575758 | 0.975308642 | 0.94047619 |
| PTPRZ1 AND NOT-ERBB4 | 0.985507246 | 0.98550725 | 0.985507246 | SLC10A4 AND NOT-ELOVL1 | 0.948571429 | 0.912087912 | 0.988095238 |
| NLGN1 AND NOT-GPA33 | 0.938461538 | 1 | 0.884057971 | SLC10A4 AND NOT-LRRC19 | 0.943181818 | 0.902173913 | 0.988095238 |
| ITGAV AND NOT-GPA33 | 0.927536232 | 0.92753623 | 0.927536232 | SLC10A4 AND NOT-SLC1A2 | 0.93258427 | 0.882978723 | 0.988095238 |
| GPR19 AND NOT-GPA33 | 0.914728682 | 0.98333333 | 0.855072464 | SLC10A4 AND NOT-SLC2A5 | 0.922222222 | 0.864583333 | 0.988095238 |
| PRAF2 AND PRAF2 | 0.905109489 | 0.91176471 | 0.898550725 | SLC10A4 AND NOT-SLC3A1 | 0.927374302 | 0.873684211 | 0.988095238 |
| XPR1 AND NOT-GPA33 | 0.921875 | 1 | 0.855072464 | SLC10A4 AND NOT-SLC5A1 | 0.954022989 | 0.922222222 | 0.988095238 |
| TMEM255A AND NOT-GPA33 | 0.901408451 | 0.87671233 | 0.927536232 | SLC10A4 AND NOT-SLC5A3 | 0.927374302 | 0.873684211 | 0.988095238 |
| SYT11 AND GPA33 | 0.943661972 | 0.91780822 | 0.971014493 | SLC10A4 AND NOT-SLC6A1 | 0.976470588 | 0.965116279 | 0.988095238 |
| SCRG1 AND GPA33 | 0.901408451 | 0.87671233 | 0.927536232 | SLC10A4 AND NOT-SLC6A3 | 0.937142857 | 0.901098901 | 0.976190476 |
| HSPA13 AND NOT-GPA33 | 0.904761905 | 1 | 0.826086957 | SLC10A4 AND NOT-SLC6A4 | 0.927374302 | 0.873684211 | 0.988095238 |
| PCDH17 AND NOT-GPA33 | 0.900763359 | 0.9516129 | 0.855072464 | SLC10A4 AND NOT-SLC6A9 | 0.922222222 | 0.864583333 | 0.988095238 |
| TPST1 AND TPST1 | 0.917293233 | 0.953125 | 0.884057971 | SLC10A4 AND NOT-SLC8A1 | 0.927374302 | 0.873684211 | 0.988095238 |
| AGPAT5 AND NOT-GPA33 | 0.930232558 | 1 | 0.869565217 | SLC10A4 AND NOT-SLC12A1 | 0.922222222 | 0.864583333 | 0.988095238 |
| GPR137C AND NOT-GPA33 | 0.907692308 | 0.96721311 | 0.855072464 | SLC10A4 AND NOT-SLC12A3 | 0.93258427 | 0.882978723 | 0.988095238 |
| CHST10 AND GPA33 | 0.907801418 | 0.88888889 | 0.927536232 | SLC10A4 AND NOT-SLC13A1 | 0.959537572 | 0.93258427 | 0.988095238 |
| CDH2 AND NOT-GPA33 | 0.916666667 | 0.88 | 0.956521739 | SLC10A4 AND NOT-SLC14A1 | 0.963855422 | 0.975609756 | 0.952380952 |
| PCDHB10 AND NOT-GPA33 | 0.907692308 | 0.96721311 | 0.855072464 | SLC10A4 AND NOT-SLC15A2 | 0.988095238 | 0.988095238 | 0.988095238 |
| PTPRZ1 AND NOT-GPA33 | 0.985507246 | 0.98550725 | 0.985507246 | SLC10A4 AND NOT-SLC20A2 | 0.937853107 | 0.892473118 | 0.988095238 |
| TMEM206 AND NOT-GPA33 | 0.916030534 | 0.96774194 | 0.869565217 | SLC10A4 AND NOT-GRAMD3 | 0.953488372 | 0.931818182 | 0.976190476 |
| BCHE AND NOT-GPA33 | 0.911764706 | 0.92537313 | 0.898550725 | SLC10A4 AND NOT-BNIP2 | 0.922222222 | 0.864583333 | 0.988095238 |
| NRCAM AND CD276 | 0.910447761 | 0.93846154 | 0.884057971 | SLC10A4 AND NOT-SPINK2 | 0.922222222 | 0.864583333 | 0.988095238 |
| NLGN1 AND NLGN1 | 0.917293233 | 0.953125 | 0.884057971 | SLC10A4 AND NOT-SRD5A1 | 0.922222222 | 0.864583333 | 0.988095238 |
| ITGAV AND CD276 | 0.942857143 | 0.92957746 | 0.956521739 | SLC10A4 AND NOT-SSR3 | 0.922222222 | 0.864583333 | 0.988095238 |
| NOT-C1orf186 AND CD276 | 0.962962963 | 0.98484848 | 0.942028986 | SLC10A4 AND NOT-SSTR1 | 0.927374302 | 0.873684211 | 0.988095238 |
| NOT-C1orf210 AND CD276 | 0.955882353 | 0.97014925 | 0.942028986 | SLC10A4 AND NOT-BRS3 | 0.937853107 | 0.892473118 | 0.988095238 |
| GPM6A AND CD276 | 0.936170213 | 0.91666667 | 0.956521739 | SLC10A4 AND NOT-STX4 | 0.922222222 | 0.864583333 | 0.988095238 |
| XPR1 AND CD276 | 0.900763359 | 0.9516129 | 0.855072464 | SLC10A4 AND NOT-BST1 | 0.922222222 | 0.864583333 | 0.988095238 |
| NOT-AADAC AND CD276 | 0.940298507 | 0.96923077 | 0.913043478 | SLC10A4 AND NOT-VAMP1 | 0.93258427 | 0.882978723 | 0.988095238 |
| SYT11 AND CD276 | 0.943661972 | 0.91780822 | 0.971014493 | SLC10A4 AND NOT-SYP | 0.927374302 | 0.873684211 | 0.988095238 |
| SCRG1 AND CD276 | 0.914285714 | 0.90140845 | 0.927536232 | SLC10A4 AND NOT-SYPL1 | 0.937853107 | 0.892473118 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| TPST1 AND TPST1 | 0.917293233 | 0.953125 | 0.884057971 | SLC10A4 AND NOT-BTC | 0.93258427 | 0.882978723 | 0.988095238 |
| GRIA2 AND CD276 | 0.90647482 | 0.9 | 0.913043478 | SLC10A4 AND NOT-TRPC4 | 0.953488372 | 0.931818182 | 0.976190476 |
| AGPAT5 AND CD276 | 0.918518519 | 0.93939394 | 0.898550725 | SLC10A4 AND NOT-TRPC5 | 0.927374302 | 0.873684211 | 0.988095238 |
| CHST10 AND CD276 | 0.934306569 | 0.94117647 | 0.927536232 | SLC10A4 AND NOT-TRPC6 | 0.927374302 | 0.873684211 | 0.988095238 |
| PTPRZ1 AND CD276 | 0.985294118 | 1 | 0.971014493 | SLC10A4 AND NOT-C1orf234 | 0.931818182 | 0.891304348 | 0.976190476 |
| NRCAM AND NOT-CD22 | 0.917293233 | 0.953125 | 0.884057971 | SLC10A4 AND NOT-TNFSF4 | 0.922222222 | 0.864583333 | 0.988095238 |
| NLGN1 AND NOT-CD22 | 0.930232558 | 1 | 0.869565217 | SLC10A4 AND NOT-TYR | 0.948571429 | 0.912087912 | 0.988095238 |
| ITGAV AND NOT-CD22 | 0.948905109 | 0.95588235 | 0.942028986 | SLC10A4 AND NOT-UPK1B | 0.959064327 | 0.942528736 | 0.976190476 |
| PRAF2 AND NOT-CD22 | 0.938461538 | 1 | 0.884057971 | SLC10A4 AND NOT-UGT8 | 0.976190476 | 0.976190476 | 0.976190476 |
| XPR1 AND NOT-CD22 | 0.909090909 | 0.95238095 | 0.869565217 | SLC10A4 AND NOT-BEST1 | 0.922222222 | 0.864583333 | 0.988095238 |
| SYT11 AND NOT-CD22 | 0.971428571 | 0.95774648 | 0.985507246 | SLC10A4 AND NOT-TRPV1 | 0.927374302 | 0.873684211 | 0.988095238 |
| SCRG1 AND NOT-CD22 | 0.942028986 | 0.94202899 | 0.942028986 | SLC10A4 AND NOT-VRK2 | 0.922222222 | 0.864583333 | 0.988095238 |
| TPST1 AND TPST1 | 0.917293233 | 0.953125 | 0.884057971 | SLC10A4 AND TMEM258 | 0.954022989 | 0.922222222 | 0.988095238 |
| AGPAT5 AND NOT-CD22 | 0.939393939 | 0.98412698 | 0.898550725 | SLC10A4 AND NOT-LDLRAD4 | 0.922222222 | 0.864583333 | 0.988095238 |
| CHST10 AND CD22 | 0.907801418 | 0.88888889 | 0.927536232 | SLC10A4 AND NOT-CACNA1A | 0.970414201 | 0.964705882 | 0.976190476 |
| PTPRZ1 AND NOT-CD22 | 0.985294118 | 1 | 0.971014493 | SLC10A4 AND NOT-CACNA1E | 0.927374302 | 0.873684211 | 0.988095238 |
| TMEM206 AND NOT-CD22 | 0.932330827 | 0.96875 | 0.898550725 | SLC10A4 AND NOT-BSND | 0.946745562 | 0.941176471 | 0.952380952 |
| NLGN1 AND NLGN1 | 0.917293233 | 0.953125 | 0.884057971 | SLC10A4 AND NOT-DDR1 | 0.937853107 | 0.892473118 | 0.988095238 |
| ITGAV AND NOT-ROR1 | 0.916030534 | 0.96774194 | 0.869565217 | SLC10A4 AND NOT-RNF103 | 0.922222222 | 0.864583333 | 0.988095238 |
| PRAF2 AND PRAF2 | 0.905109489 | 0.91176471 | 0.898550725 | SLC10A4 AND NOT-SEMA3B | 0.922222222 | 0.864583333 | 0.988095238 |
| SYT11 AND ROR1 | 0.951048951 | 0.91891892 | 0.985507246 | SLC10A4 AND NOT-SLC25A20 | 0.922222222 | 0.864583333 | 0.988095238 |
| SCRG1 AND ROR1 | 0.909090909 | 0.87837838 | 0.942028986 | SLC10A4 AND GDAP1L1 | 0.922222222 | 0.864583333 | 0.988095238 |
| TPST1 AND TPST1 | 0.917293233 | 0.953125 | 0.884057971 | SLC10A4 AND NOT-SMIM2 | 0.959537572 | 0.93258427 | 0.988095238 |
| AGPAT5 AND ROR1 | 0.905109489 | 0.91176471 | 0.898550725 | SLC10A4 AND NOT-TMEM109 | 0.922222222 | 0.864583333 | 0.988095238 |
| CHST10 AND ROR1 | 0.915492958 | 0.89041096 | 0.942028986 | SLC10A4 AND NOT-FA2H | 0.937853107 | 0.892473118 | 0.988095238 |
| PTPRZ1 AND NOT-ROR1 | 0.985507246 | 0.98550725 | 0.985507246 | SLC10A4 AND NOT-NIPAL2 | 0.927374302 | 0.873684211 | 0.988095238 |
| NLGN1 AND NLGN1 | 0.917293233 | 0.953125 | 0.884057971 | SLC10A4 AND NOT-TMC5 | 0.954022989 | 0.922222222 | 0.988095238 |
| PRAF2 AND PRAF2 | 0.905109489 | 0.91176471 | 0.898550725 | SLC10A4 AND NOT-ATP8B4 | 0.922222222 | 0.864583333 | 0.988095238 |
| SYT11 AND CA9 | 0.943661972 | 0.91780822 | 0.971014493 | SLC10A4 AND NOT-ERMP1 | 0.965116279 | 0.943181818 | 0.988095238 |
| SCRG1 AND CA9 | 0.907801418 | 0.88888889 | 0.927536232 | SLC10A4 AND NOT-PAQR6 | 0.988095238 | 0.988095238 | 0.988095238 |
| TPST1 AND TPST1 | 0.917293233 | 0.953125 | 0.884057971 | SLC10A4 AND NOT-WLS | 0.922222222 | 0.864583333 | 0.988095238 |
| AGPAT5 AND CA9 | 0.905109489 | 0.91176471 | 0.898550725 | SLC10A4 AND NOT-ELOVL7 | 0.937142857 | 0.901098901 | 0.976190476 |
| CHST10 AND CA9 | 0.9 | 0.88732394 | 0.913043478 | SLC10A4 AND NOT-GLRA3 | 0.965116279 | 0.943181818 | 0.988095238 |
| PTPRZ1 AND CA9 | 0.985507246 | 0.98550725 | 0.985507246 | SLC10A4 AND NOT-LRRC8E | 0.922222222 | 0.864583333 | 0.988095238 |
| NLGN1 AND NLGN1 | 0.917293233 | 0.953125 | 0.884057971 | SLC10A4 AND NOT-ALPK1 | 0.922222222 | 0.864583333 | 0.988095238 |
| ITGAV AND NOT-EPHA2 | 0.90625 | 0.98305085 | 0.84057971 | SLC10A4 AND NOT-PIGZ | 0.927374302 | 0.873684211 | 0.988095238 |
| PRAF2 AND PRAF2 | 0.905109489 | 0.91176471 | 0.898550725 | SLC10A4 AND NOT-PRRT1 | 0.982035928 | 0.987951807 | 0.976190476 |
| SYT11 AND EPHA2 | 0.943661972 | 0.91780822 | 0.971014493 | SLC10A4 AND NOT-ELOVL3 | 0.922222222 | 0.864583333 | 0.988095238 |
| SCRG1 AND EPHA2 | 0.909090909 | 0.87837838 | 0.942028986 | SLC10A4 AND NOT-TMEM47 | 0.953488372 | 0.931818182 | 0.976190476 |
| TPST1 AND NOT-EPHA2 | 0.904761905 | 1 | 0.826086957 | SLC10A4 AND NOT-CD99L2 | 0.922222222 | 0.864583333 | 0.988095238 |
| CHST10 AND EPHA2 | 0.907801418 | 0.88888889 | 0.927536232 | SLC10A4 AND NOT-SLC4A9 | 0.937142857 | 0.901098901 | 0.976190476 |
| PTPRZ1 AND NOT-EPHA2 | 0.970588235 | 0.98507463 | 0.956521739 | SLC10A4 AND NOT-CALN1 | 0.927374302 | 0.873684211 | 0.988095238 |
| NLGN1 AND NOT-TNFSF11 | 0.930232558 | 1 | 0.869565217 | SLC10A4 AND NOT-SLC25A18 | 0.943181818 | 0.902173913 | 0.988095238 |
| ITGAV AND NOT-TNFSF11 | 0.928571429 | 0.91549296 | 0.942028986 | SLC10A4 AND NOT-ESYT3 | 0.959064327 | 0.942528736 | 0.976190476 |
| PRAF2 AND PRAF2 | 0.905109489 | 0.91176471 | 0.898550725 | SLC10A4 AND NOT-SPATA9 | 0.93258427 | 0.882978723 | 0.988095238 |
| SYT11 AND TNFSF11 | 0.936170213 | 0.91666667 | 0.956521739 | SLC10A4 AND NOT-SLC41A2 | 0.922222222 | 0.864583333 | 0.988095238 |
| SCRG1 AND TNFSF11 | 0.9 | 0.88732394 | 0.913043478 | SLC10A4 AND NOT-KIAA1109 | 0.927374302 | 0.873684211 | 0.988095238 |
| TPST1 AND TPST1 | 0.917293233 | 0.953125 | 0.884057971 | SLC10A4 AND NOT-USP48 | 0.922222222 | 0.864583333 | 0.988095238 |
| CHST10 AND TNFSF11 | 0.9 | 0.88732394 | 0.913043478 | SLC10A4 AND NOT-DCUN1D5 | 0.927374302 | 0.873684211 | 0.988095238 |
| PTPRZ1 AND NOT-TNFSF11 | 0.97810219 | 0.98529412 | 0.971014493 | SLC10A4 AND NOT-MEGF10 | 0.927374302 | 0.873684211 | 0.988095238 |
| FKTN AND NOT-SDC1 | 0.904761905 | 1 | 0.826086957 | SLC10A4 AND NOT-ACSS1 | 0.922222222 | 0.864583333 | 0.988095238 |
| ITGAV AND NOT-SDC1 | 0.955882353 | 0.97014925 | 0.942028986 | SLC10A4 AND NOT-CASR | 0.922222222 | 0.864583333 | 0.988095238 |
| PRAF2 AND NOT-SDC1 | 0.917293233 | 0.953125 | 0.884057971 | SLC10A4 AND NOT-FUT10 | 0.976470588 | 0.965116279 | 0.988095238 |
| FJX1 AND NOT-SDC1 | 0.905109489 | 0.91176471 | 0.898550725 | SLC10A4 AND NOT-MFSD2A | 0.922222222 | 0.864583333 | 0.988095238 |
| SYT11 AND SDC1 | 0.928571429 | 0.91549296 | 0.942028986 | SLC10A4 AND NOT-PLXDC2 | 0.927374302 | 0.873684211 | 0.988095238 |
| JAM2 AND NOT-SDC1 | 0.909090909 | 0.95238095 | 0.869565217 | SLC10A4 AND NOT-DGKE | 0.927374302 | 0.873684211 | 0.988095238 |
| PTPRZ1 AND NOT-SDC1 | 0.985507246 | 0.98550725 | 0.985507246 | SLC10A4 AND NOT-PAQR8 | 0.93258427 | 0.882978723 | 0.988095238 |
| NLGN1 AND NOT-TNFRSF8 | 0.930232558 | 1 | 0.869565217 | SLC10A4 AND NOT-SLC22A16 | 0.947976879 | 0.921348315 | 0.976190476 |
| LRRC37A3 AND NOT-TNFRSF8 | 0.909090909 | 0.87837838 | 0.942028986 | SLC10A4 AND NOT-EPT1 | 0.927374302 | 0.873684211 | 0.988095238 |
| ITGAV AND NOT-TNFRSF8 | 0.940298507 | 0.96923077 | 0.913043478 | SLC10A4 AND NOT-SLC4A4 | 0.922222222 | 0.864583333 | 0.988095238 |
| PRAF2 AND PRAF2 | 0.905109489 | 0.91176471 | 0.898550725 | SLC10A4 AND NOT-S1PR4 | 0.922222222 | 0.864583333 | 0.988095238 |
| XPR1 AND NOT-TNFRSF8 | 0.914728682 | 0.98333333 | 0.855072464 | SLC10A4 AND NOT-B3GALT1 | 0.927374302 | 0.873684211 | 0.988095238 |
| FJX1 AND NOT-TNFRSF8 | 0.913043478 | 0.91304348 | 0.913043478 | SLC10A4 AND NOT-TNFSF9 | 0.927374302 | 0.873684211 | 0.988095238 |
| SYT11 AND SYT11 | 0.951048951 | 0.91891892 | 0.985507246 | SLC10A4 AND NOT-ADAM23 | 0.927374302 | 0.873684211 | 0.988095238 |
| SCRG1 AND SCRG1 | 0.909090909 | 0.87837838 | 0.942028986 | SLC10A4 AND NOT-ADAM7 | 0.948571429 | 0.912087912 | 0.988095238 |
| TPST1 AND TPST1 | 0.917293233 | 0.953125 | 0.884057971 | SLC10A4 AND NOT-CDS2 | 0.927374302 | 0.873684211 | 0.988095238 |
| AGPAT5 AND NOT-TNFRSF8 | 0.930232558 | 1 | 0.869565217 | SLC10A4 AND NOT-PROM1 | 0.922222222 | 0.864583333 | 0.988095238 |
| CHST10 AND TNFRSF8 | 0.9 | 0.88732394 | 0.913043478 | SLC10A4 AND NOT-APLN | 0.959064327 | 0.942528736 | 0.976190476 |
| PCDHB10 AND NOT-TNFRSF8 | 0.904761905 | 1 | 0.826086957 | SLC10A4 AND NOT-CCKAR | 0.927374302 | 0.873684211 | 0.988095238 |
| PTPRZ1 AND NOT-TNFRSF8 | 0.97810219 | 0.98529412 | 0.971014493 | SLC10A4 AND NOT-SLC5A6 | 0.922222222 | 0.864583333 | 0.988095238 |
| NLGN1 AND NLGN1 | 0.917293233 | 0.953125 | 0.884057971 | SLC10A4 AND NOT-CACNA1I | 0.93258427 | 0.882978723 | 0.988095238 |
| PTPRZ1 AND CSPG4 | 0.985507246 | 0.98550725 | 0.985507246 | SLC10A4 AND NOT-LMLN | 0.927374302 | 0.873684211 | 0.988095238 |
| NLGN1 AND NLGN1 | 0.917293233 | 0.953125 | 0.884057971 | SLC10A4 AND NOT-DUOXA1 | 0.941860465 | 0.920454545 | 0.964285714 |
| PRAF2 AND PRAF2 | 0.905109489 | 0.91176471 | 0.898550725 | SLC10A4 AND NOT-GPRC5A | 0.927374302 | 0.873684211 | 0.988095238 |
| SYT11 AND CD70 | 0.936170213 | 0.91666667 | 0.956521739 | SLC10A4 AND NOT-MCU | 0.922222222 | 0.864583333 | 0.988095238 |
| TPST1 AND TPST1 | 0.917293233 | 0.953125 | 0.884057971 | SLC10A4 AND NOT-CLDN10 | 0.922222222 | 0.864583333 | 0.988095238 |

FIG. 1 (CONT.)

| Antigen Pair Logic | F1 | Precision | Recall | Antigen Pair Logic | F1 | Precision | Recall |
|---|---|---|---|---|---|---|---|
| CHST10 AND CD70 | 0.907801418 | 0.88888889 | 0.927536232 | SLC10A4 AND NOT-ACBD5 | 0.927374302 | 0.873684211 | 0.988095238 |
| PTPRZ1 AND CD70 | 0.962962963 | 0.98484848 | 0.942028986 | SLC10A4 AND NOT-SLC6A5 | 0.936416185 | 0.91011236 | 0.964285714 |
| NLGN1 AND NLGN1 | 0.917293233 | 0.953125 | 0.884057971 | SLC10A4 AND NOT-SLC28A1 | 0.937853107 | 0.892473118 | 0.988095238 |
| PRAF2 AND NOT-AXL | 0.932330827 | 0.96875 | 0.898550725 | SLC10A4 AND NOT-IL1RL1 | 0.922222222 | 0.864583333 | 0.988095238 |
| NOT-AADAC AND AXL | 0.907692308 | 0.96721311 | 0.855072464 | SLC10A4 AND NOT-VAPB | 0.927374302 | 0.873684211 | 0.988095238 |
| SYT11 AND AXL | 0.943661972 | 0.91780822 | 0.971014493 | SLC10A4 AND NOT-DAPL1 | 0.943181818 | 0.902173913 | 0.988095238 |
| SCRG1 AND SCRG1 | 0.909090909 | 0.87837838 | 0.942028986 | SLC10A4 AND NOT-LMBRD2 | 0.927374302 | 0.873684211 | 0.988095238 |
| TPST1 AND TPST1 | 0.917293233 | 0.953125 | 0.884057971 | SLC10A4 AND NOT-OPALIN | 0.982248521 | 0.976470588 | 0.988095238 |
| AGPAT5 AND AXL | 0.910447761 | 0.93846154 | 0.884057971 | SLC10A4 AND NOT-NRXN3 | 0.943181818 | 0.902173913 | 0.988095238 |
| CHST10 AND AXL | 0.919708029 | 0.92647059 | 0.913043478 | SLC10A4 AND NOT-SLC22A8 | 0.941860465 | 0.920454545 | 0.964285714 |
| PTPRZ1 AND AXL | 0.985507246 | 0.98550725 | 0.985507246 | SLC10A4 AND NOT-TTYH2 | 0.937853107 | 0.892473118 | 0.988095238 |
| NLGN1 AND NOT-MUC13 | 0.938461538 | 1 | 0.884057971 | SLC10A4 AND NOT-SFXN5 | 0.982248521 | 0.976470588 | 0.988095238 |
| PRAF2 AND NOT-MUC13 | 0.946564885 | 1 | 0.898550725 | SLC10A4 AND NOT-FAM189A2 | 0.941860465 | 0.920454545 | 0.964285714 |
| GOLM1 AND NOT-MUC13 | 0.934306569 | 0.94117647 | 0.927536232 | SLC10A4 AND NOT-CYP7B1 | 0.922222222 | 0.864583333 | 0.988095238 |
| SYT11 AND MUC13 | 0.951048951 | 0.91891892 | 0.985507246 | SLC10A4 AND NOT-ABCG2 | 0.976190476 | 0.976190476 | 0.976190476 |
| SCRG1 AND MUC13 | 0.909090909 | 0.87837838 | 0.942028986 | SLC10A4 AND NOT-CD33 | 0.922222222 | 0.864583333 | 0.988095238 |
| TPST1 AND NOT-MUC13 | 0.938461538 | 1 | 0.884057971 | SLC10A4 AND NOT-CHST3 | 0.927374302 | 0.873684211 | 0.988095238 |
| AGPAT5 AND MUC13 | 0.905109489 | 0.91176471 | 0.898550725 | SLC10A4 AND NOT-SIGLEC6 | 0.953488372 | 0.931818182 | 0.976190476 |
| CHST10 AND NOT-MUC13 | 0.935251799 | 0.92857143 | 0.942028986 | SLC10A4 AND NOT-AKAP6 | 0.927374302 | 0.873684211 | 0.988095238 |
| PTPRZ1 AND NOT-MUC13 | 0.97810219 | 0.98529412 | 0.971014493 | SLC10A4 AND NOT-CD34 | 0.922222222 | 0.864583333 | 0.988095238 |
| NLGN1 AND NLGN1 | 0.917293233 | 0.953125 | 0.884057971 | SLC10A4 AND NOT-PIGB | 0.927374302 | 0.873684211 | 0.988095238 |
| PRAF2 AND PRAF2 | 0.905109489 | 0.91176471 | 0.898550725 | SLC10A4 AND NOT-GABBR2 | 0.964285714 | 0.964285714 | 0.964285714 |
| SYT11 AND SYT11 | 0.951048951 | 0.91891892 | 0.985507246 | SLC10A4 AND NOT-ABCG1 | 0.927374302 | 0.873684211 | 0.988095238 |
| SCRG1 AND SCRG1 | 0.909090909 | 0.87837838 | 0.942028986 | SLC10A4 AND NOT-CD47 | 0.927374302 | 0.873684211 | 0.988095238 |
| TPST1 AND ALK | 0.900763359 | 0.9516129 | 0.855072464 | SLC10A4 AND NOT-EDEM1 | 0.922222222 | 0.864583333 | 0.988095238 |
| CHST10 AND ALK | 0.915492958 | 0.89041096 | 0.942028986 | SLC10A4 AND NOT-TMEM63A | 0.976470588 | 0.965116279 | 0.988095238 |
| PTPRZ1 AND ALK | 0.985507246 | 0.98550725 | 0.985507246 | SLC10A4 AND NOT-CD79B | 0.922222222 | 0.864583333 | 0.988095238 |
| SYT11 AND TNFRSF10B | 0.928571429 | 0.91549296 | 0.942028986 | SLC10A4 AND NOT-EFCAB14 | 0.927374302 | 0.873684211 | 0.988095238 |
| TPST1 AND TPST1 | 0.917293233 | 0.953125 | 0.884057971 | SLC10A4 AND NOT-MFAP3L | 0.922222222 | 0.864583333 | 0.988095238 |
| AGPAT5 AND AGPAT5 | 0.905109489 | 0.91176471 | 0.898550725 | SLC10A4 AND NOT-KIAA0319 | 0.927374302 | 0.873684211 | 0.988095238 |
| PTPRZ1 AND TNFRSF10B | 0.985507246 | 0.98550725 | 0.985507246 | SLC10A4 AND NOT-P2RY14 | 0.922222222 | 0.864583333 | 0.988095238 |
| NLGN1 AND NLGN1 | 0.917293233 | 0.953125 | 0.884057971 | SLC10A4 AND NOT-SLC12A6 | 0.927374302 | 0.873684211 | 0.988095238 |
| PRAF2 AND PRAF2 | 0.905109489 | 0.91176471 | 0.898550725 | MARCH11 AND NOT-CCDC107 | 0.951807229 | 0.963414634 | 0.94047619 |
| SYT11 AND SYT11 | 0.951048951 | 0.91891892 | 0.985507246 | MARCH11 AND NOT-CERS3 | 0.969325153 | 1 | 0.94047619 |
| SCRG1 AND SCRG1 | 0.909090909 | 0.87837838 | 0.942028986 | MARCH11 AND NOT-EPHA4 | 0.963414634 | 0.9875 | 0.94047619 |
| PTPRZ1 AND NOT-FAP | 0.985507246 | 0.98550725 | 0.985507246 | MARCH11 AND NOT-ERBB4 | 0.946745562 | 0.941176471 | 0.952380952 |
| NLGN1 AND NLGN1 | 0.917293233 | 0.953125 | 0.884057971 | MARCH11 AND NOT-F3 | 0.952380952 | 0.952380952 | 0.952380952 |
| PRAF2 AND PRAF2 | 0.905109489 | 0.91176471 | 0.898550725 | ST8SIA2 AND NOT-F3 | 0.95 | 1 | 0.904761905 |
| SYT11 AND FOLR2 | 0.928571429 | 0.91549296 | 0.942028986 | MARCH11 AND NOT-FAAH | 0.963855422 | 0.975609756 | 0.952380952 |
| SCRG1 AND FOLR2 | 0.909090909 | 0.87837838 | 0.942028986 | ST8SIA2 AND NOT-FAT2 | 0.956521739 | 1 | 0.916666667 |
| AGPAT5 AND AGPAT5 | 0.905109489 | 0.91176471 | 0.898550725 | RTN1 AND NOT-HEPACAM | 0.95 | 1 | 0.904761905 |
| PTPRZ1 AND FOLR2 | 0.985507246 | 0.98550725 | 0.985507246 | ST8SIA2 AND NOT-HEPACAM | 0.95 | 1 | 0.904761905 |
| NLGN1 AND KDR | 0.917293233 | 0.953125 | 0.884057971 | GPR19 AND NOT-SLC39A12 | 0.963855422 | 0.975609756 | 0.952380952 |
| PRAF2 AND PRAF2 | 0.905109489 | 0.91176471 | 0.898550725 | MARCH11 AND NOT-SLC39A12 | 0.946745562 | 0.941176471 | 0.952380952 |
| SYT11 AND KDR | 0.951048951 | 0.91891892 | 0.985507246 | ST8SIA2 AND NOT-SLC39A12 | 0.956521739 | 1 | 0.916666667 |
| SCRG1 AND KDR | 0.909090909 | 0.87837838 | 0.942028986 | ST8SIA2 AND NOT-OPN5 | 0.956521739 | 1 | 0.916666667 |
| TPST1 AND TPST1 | 0.917293233 | 0.953125 | 0.884057971 | MARCH11 AND NOT-MMD2 | 0.952380952 | 0.952380952 | 0.952380952 |
| AGPAT5 AND KDR | 0.902255639 | 0.9375 | 0.869565217 | ST8SIA2 AND NOT-GPRC6A | 0.95 | 1 | 0.904761905 |
| CHST10 AND KDR | 0.907801418 | 0.88888889 | 0.927536232 | GABRB3 AND NOT-FGFR3 | 0.956521739 | 1 | 0.916666667 |
| PTPRZ1 AND KDR | 0.977777778 | 1 | 0.956521739 | PCSK1N AND NOT-FGFR3 | 0.946745562 | 0.941176471 | 0.952380952 |
| NLGN1 AND NLGN1 | 0.917293233 | 0.953125 | 0.884057971 | GPR19 AND NOT-FGFR3 | 0.96969697 | 0.987654321 | 0.952380952 |
| PRAF2 AND PRAF2 | 0.905109489 | 0.91176471 | 0.898550725 | MARCH11 AND NOT-FGFR3 | 0.946745562 | 0.941176471 | 0.952380952 |
| SYT11 AND CD38 | 0.951048951 | 0.91891892 | 0.985507246 | ST8SIA3 AND NOT-FGFR3 | 0.975609756 | 1 | 0.952380952 |
| SCRG1 AND CD38 | 0.909090909 | 0.87837838 | 0.942028986 | HMP19 AND NOT-FGFR3 | 0.962962963 | 1 | 0.928571429 |
| TPST1 AND NOT-CD38 | 0.921875 | 1 | 0.855072464 | SCN3B AND NOT-FGFR3 | 0.97005988 | 0.975903614 | 0.964285714 |
| CHST10 AND CD38 | 0.915492958 | 0.89041096 | 0.942028986 | SCN2A AND NOT-FGFR3 | 0.936708861 | 1 | 0.880952381 |
| PTPRZ1 AND NOT-CD38 | 0.970588235 | 0.98507463 | 0.956521739 | ST8SIA2 AND NOT-FGFR3 | 0.956521739 | 1 | 0.916666667 |
| NRCAM AND NOT-ITGB3 | 0.900763359 | 0.9516129 | 0.855072464 | MARCH11 AND NOT-CLCA4 | 0.946745562 | 0.941176471 | 0.952380952 |
| NLGN1 AND NOT-ITGB3 | 0.904761905 | 1 | 0.826086957 | MARCH11 AND NOT-SLITRK3 | 0.946745562 | 0.941176471 | 0.952380952 |
| PRAF2 AND PRAF2 | 0.905109489 | 0.91176471 | 0.898550725 | MARCH11 AND NOT-PLA2R1 | 0.946745562 | 0.941176471 | 0.952380952 |
| SYT11 AND NOT-ITGB3 | 0.913385827 | 1 | 0.84057971 | FAIM2 AND NOT-SLC15A2 | 0.952941176 | 0.941860465 | 0.964285714 |
| TPST1 AND TPST1 | 0.917293233 | 0.953125 | 0.884057971 | FAIM2 AND NOT-SLC4A4 | 0.943396226 | 1 | 0.892857143 |
| AGPAT5 AND NOT-ITGB3 | 0.913385827 | 1 | 0.84057971 | ST8SIA2 AND NOT-ATP10B | 0.943396226 | 1 | 0.892857143 |
| PTPRZ1 AND NOT-ITGB3 | 0.985507246 | 0.98550725 | 0.985507246 | SYT11 AND NOT-NIPAL3 | 0.936708861 | 1 | 0.880952381 |
| NLGN1 AND NLGN1 | 0.917293233 | 0.953125 | 0.884057971 | GPR19 AND NOT-MLC1 | 0.958083832 | 0.963855422 | 0.952380952 |
| ITGAV AND NOT-MUC16 | 0.948148148 | 0.96969697 | 0.927536232 | MARCH11 AND NOT-MLC1 | 0.952380952 | 0.952380952 | 0.952380952 |
| PRAF2 AND PRAF2 | 0.905109489 | 0.91176471 | 0.898550725 | HMP19 AND NOT-MLC1 | 0.962962963 | 1 | 0.928571429 |
| FJX1 AND NOT-MUC16 | 0.902255639 | 0.9375 | 0.869565217 | ST8SIA2 AND NOT-MLC1 | 0.956521739 | 1 | 0.916666667 |
| SYT11 AND MUC16 | 0.951048951 | 0.91891892 | 0.985507246 | MARCH11 AND NOT-FLT3 | 0.952380952 | 0.952380952 | 0.952380952 |
| SCRG1 AND MUC16 | 0.915492958 | 0.89041096 | 0.942028986 | MARCH11 AND NOT-ACSL6 | 0.946745562 | 0.941176471 | 0.952380952 |
| TPST1 AND NOT-MUC16 | 0.938461538 | 1 | 0.884057971 | ST8SIA2 AND NOT-FAM189A1 | 0.943396226 | 1 | 0.892857143 |
| AGPAT5 AND MUC16 | 0.905109489 | 0.91176471 | 0.898550725 | MARCH11 AND CTDNEP1 | 0.946745562 | 0.941176471 | 0.952380952 |
| CHST10 AND MUC16 | 0.915492958 | 0.89041096 | 0.942028986 | MARCH11 AND NOT-SLC44A1 | 0.946745562 | 0.941176471 | 0.952380952 |
| PTPRZ1 AND NOT-MUC16 | 0.962962963 | 0.98484848 | 0.942028986 | ST8SIA2 AND NOT-SLC44A1 | 0.956521739 | 1 | 0.916666667 |
| FKTN AND NOT-IL3RA | 0.913385827 | 1 | 0.84057971 | MARCH11 AND MMD | 0.943396226 | 1 | 0.892857143 |
| NLGN1 AND NOT-IL3RA | 0.938461538 | 1 | 0.884057971 | ST8SIA2 AND NOT-CA14 | 0.95 | 1 | 0.904761905 |

FIG. 1 (CONT.)

| Antigen Pair Logic | F1 | Precision | Recall |
|---|---|---|---|
| ITGAV AND NOT-IL3RA | 0.924242424 | 0.96825397 | 0.884057971 |
| PRAF2 AND PRAF2 | 0.905109489 | 0.91176471 | 0.898550725 |
| XPR1 AND NOT-IL3RA | 0.930232558 | 1 | 0.869565217 |
| FJX1 AND NOT-IL3RA | 0.920863309 | 0.91428571 | 0.927536232 |
| SYT11 AND IL3RA | 0.913043478 | 0.91304348 | 0.913043478 |
| SCRG1 AND IL3RA | 0.901408451 | 0.87671233 | 0.927536232 |
| HSPA13 AND NOT-IL3RA | 0.904761905 | 1 | 0.826086957 |
| TPST1 AND IL3RA | 0.909090909 | 0.95238095 | 0.869565217 |
| AGPAT5 AND NOT-IL3RA | 0.946564885 | 1 | 0.898550725 |
| CHST10 AND IL3RA | 0.907801418 | 0.88888889 | 0.927536232 |
| PCDHB10 AND NOT-IL3RA | 0.921875 | 1 | 0.855072464 |
| PTPRZ1 AND NOT-IL3RA | 0.985507246 | 0.98550725 | 0.985507246 |
| NRCAM AND NOT-MUC17 | 0.938461538 | 1 | 0.884057971 |
| SRR AND NOT-MUC17 | 0.904761905 | 1 | 0.826086957 |
| FKTN AND NOT-MUC17 | 0.913385827 | 1 | 0.84057971 |
| NLGN1 AND NOT-MUC17 | 0.938461538 | 1 | 0.884057971 |
| LRRC37A3 AND NOT-MUC17 | 0.955882353 | 0.97014925 | 0.942028986 |
| ITGAV AND NOT-MUC17 | 0.96350365 | 0.97058824 | 0.956521739 |
| PRAF2 AND PRAF2 | 0.905109489 | 0.91176471 | 0.898550725 |
| FJX1 AND NOT-MUC17 | 0.927536232 | 0.92753623 | 0.927536232 |
| SYT11 AND MUC17 | 0.951048951 | 0.91891892 | 0.985507246 |
| SCRG1 AND NOT-MUC17 | 0.935251799 | 0.92857143 | 0.942028986 |
| TPST1 AND NOT-MUC17 | 0.938461538 | 1 | 0.884057971 |
| AGPAT5 AND NOT-MUC17 | 0.932330827 | 0.96875 | 0.898550725 |
| CHST10 AND MUC17 | 0.915492958 | 0.89041096 | 0.942028986 |
| PCDHB10 AND NOT-MUC17 | 0.921875 | 1 | 0.855072464 |
| PTPRZ1 AND NOT-MUC17 | 0.985507246 | 0.98550725 | 0.985507246 |
| NLGN1 AND NLGN1 | 0.917293233 | 0.953125 | 0.884057971 |
| ITGAV AND L1CAM | 0.920863309 | 0.91428571 | 0.927536232 |
| PRAF2 AND PRAF2 | 0.905109489 | 0.91176471 | 0.898550725 |
| SYT11 AND SYT11 | 0.951048951 | 0.91891892 | 0.985507246 |
| SCRG1 AND L1CAM | 0.909090909 | 0.87837838 | 0.942028986 |
| TPST1 AND L1CAM | 0.900763359 | 0.9516129 | 0.855072464 |
| CHST10 AND NOT-L1CAM | 0.915492958 | 0.89041096 | 0.942028986 |
| PTPRZ1 AND NOT-L1CAM | 0.985507246 | 0.98550725 | 0.985507246 |
| NLGN1 AND NLGN1 | 0.917293233 | 0.953125 | 0.884057971 |
| ITGAV AND EPHA3 | 0.914285714 | 0.90140845 | 0.927536232 |
| PRAF2 AND EPHA3 | 0.910447761 | 0.93846154 | 0.884057971 |
| SYT11 AND SYT11 | 0.951048951 | 0.91891892 | 0.985507246 |
| SCRG1 AND EPHA3 | 0.901408451 | 0.87671233 | 0.927536232 |
| TPST1 AND EPHA3 | 0.917293233 | 0.953125 | 0.884057971 |
| CHST10 AND EPHA3 | 0.907801418 | 0.88888889 | 0.927536232 |
| PTPRZ1 AND EPHA3 | 0.97810219 | 0.98529412 | 0.971014493 |
| NLGN1 AND NOT-MSLN | 0.930232558 | 1 | 0.869565217 |
| ITGAV AND MSLN | 0.936170213 | 0.91666667 | 0.956521739 |
| NOT-C1orf210 AND MSLN | 0.905405405 | 0.84810127 | 0.971014493 |
| PRAF2 AND PRAF2 | 0.905109489 | 0.91176471 | 0.898550725 |
| SYT11 AND MSLN | 0.951048951 | 0.91891892 | 0.985507246 |
| SCRG1 AND MSLN | 0.909090909 | 0.87837838 | 0.942028986 |
| TPST1 AND NOT-MSLN | 0.930232558 | 1 | 0.869565217 |
| AGPAT5 AND MSLN | 0.905109489 | 0.91176471 | 0.898550725 |
| CHST10 AND MSLN | 0.915492958 | 0.89041096 | 0.942028986 |
| PTPRZ1 AND NOT-MSLN | 0.970588235 | 0.98507463 | 0.956521739 |
| NOT-SLAMF7 AND TNFSF13B | 0.900763359 | 0.9516129 | 0.855072464 |
| NOT-SLAMF7 AND C5orf28 | 0.921985816 | 0.90277778 | 0.942028986 |
| NOT-SLAMF7 AND ATP2A2 | 0.905405405 | 0.84810127 | 0.971014493 |
| NOT-SLAMF7 AND LPCAT1 | 0.925373134 | 0.95384615 | 0.898550725 |
| TM2D2 AND NOT-SLAMF7 | 0.926470588 | 0.94029851 | 0.913043478 |
| NOT-SLAMF7 AND ERGIC2 | 0.903703704 | 0.92424242 | 0.884057971 |
| NOT-SLAMF7 AND WDR83OS | 0.927536232 | 0.92753623 | 0.927536232 |
| NOT-SLAMF7 AND TSPAN6 | 0.90647482 | 0.9 | 0.913043478 |
| NOT-SLAMF7 AND TMEM209 | 0.909090909 | 0.95238095 | 0.869565217 |
| NLGN1 AND NLGN1 | 0.917293233 | 0.953125 | 0.884057971 |
| NOT-SLAMF7 AND C17orf62 | 0.933333333 | 0.95454545 | 0.913043478 |
| LRRC37A3 AND NOT-SLAMF7 | 0.914285714 | 0.90140845 | 0.927536232 |
| NOT-SLAMF7 AND TMEM230 | 0.913043478 | 0.91304348 | 0.913043478 |
| NOT-SLAMF7 AND ALG8 | 0.919708029 | 0.92647059 | 0.913043478 |
| NOT-SLAMF7 AND TMEM167A | 0.923076923 | 0.98360656 | 0.869565217 |
| ITGAV AND NOT-SLAMF7 | 0.962962963 | 0.98484848 | 0.942028986 |
| NOT-SLAMF7 AND TMX1 | 0.96350365 | 0.97058824 | 0.956521739 |
| NOT-SLAMF7 AND MANBAL | 0.913043478 | 0.91304348 | 0.913043478 |
| NOT-SLAMF7 AND MARS | 0.941176471 | 0.95522388 | 0.927536232 |
| NOT-SLAMF7 AND COX8A | 0.921985816 | 0.90277778 | 0.942028986 |
| NOT-SLAMF7 AND TSPAN3 | 0.910344828 | 0.86842105 | 0.956521739 |
| NOT-SLAMF7 AND TMEM68 | 0.909090909 | 0.95238095 | 0.869565217 |
| PRAF2 AND NOT-SLAMF7 | 0.938461538 | 1 | 0.884057971 |

| Antigen Pair Logic | F1 | Precision | Recall |
|---|---|---|---|
| ST8SIA2 AND NOT-SLC7A11 | 0.95 | 1 | 0.904761905 |
| MARCH11 AND NOT-FLRT2 | 0.946745562 | 0.941176471 | 0.952380952 |
| ST8SIA2 AND NOT-CADM2 | 0.936708861 | 1 | 0.880952381 |
| MARCH11 AND NOT-LPCAT4 | 0.946745562 | 0.941176471 | 0.952380952 |
| MARCH11 AND NOT-ZDHHC23 | 0.958083832 | 0.963855422 | 0.952380952 |
| ST8SIA2 AND NOT-CALHM1 | 0.956521739 | 1 | 0.916666667 |
| MARCH11 AND NOT-GABRA1 | 0.946745562 | 0.941176471 | 0.952380952 |
| MARCH11 AND NOT-GABRA2 | 0.946745562 | 0.941176471 | 0.952380952 |
| MARCH11 AND NOT-COL24A1 | 0.946745562 | 0.941176471 | 0.952380952 |
| MARCH11 AND NOT-GABRA4 | 0.952380952 | 0.952380952 | 0.952380952 |
| MARCH11 AND NOT-GABRB2 | 0.946745562 | 0.941176471 | 0.952380952 |
| MARCH11 AND NOT-GABRD | 0.946745562 | 0.941176471 | 0.952380952 |
| ST8SIA2 AND NOT-GABRD | 0.95 | 1 | 0.904761905 |
| MARCH11 AND NOT-C1orf101 | 0.963855422 | 0.975609756 | 0.952380952 |
| MARCH11 AND NOT-SLC24A2 | 0.946745562 | 0.941176471 | 0.952380952 |
| ST8SIA2 AND NOT-SLC24A2 | 0.936708861 | 1 | 0.880952381 |
| ST8SIA2 AND NOT-MRGPRX1 | 0.95 | 1 | 0.904761905 |
| MARCH11 AND NOT-HIGD1A | 0.946745562 | 0.941176471 | 0.952380952 |
| MARCH11 AND NOT-GLCE | 0.946745562 | 0.941176471 | 0.952380952 |
| MARCH11 AND NOT-STEAP2 | 0.946745562 | 0.941176471 | 0.952380952 |
| ST8SIA2 AND NOT-OR1C1 | 0.956521739 | 1 | 0.916666667 |
| MARCH11 AND NOT-OR2F1 | 0.951807229 | 0.963414634 | 0.94047619 |
| ST8SIA2 AND NOT-OR1J4 | 0.943396226 | 1 | 0.892857143 |
| ST8SIA2 AND NOT-OR5K1 | 0.956521739 | 1 | 0.916666667 |
| ST8SIA2 AND NOT-OR10A3 | 0.956521739 | 1 | 0.916666667 |
| ST8SIA2 AND NOT-TSPAN16 | 0.95 | 1 | 0.904761905 |
| ST8SIA2 AND NOT-OR12D2 | 0.95 | 1 | 0.904761905 |
| ST8SIA2 AND NOT-OR10H1 | 0.95 | 1 | 0.904761905 |
| ST8SIA2 AND NOT-OR8B2 | 0.956521739 | 1 | 0.916666667 |
| ST8SIA2 AND NOT-OR7C2 | 0.936708861 | 1 | 0.880952381 |
| MARCH11 AND NOT-OR7A5 | 0.95 | 1 | 0.904761905 |
| ST8SIA2 AND NOT-OR4D1 | 0.95 | 1 | 0.904761905 |
| ST8SIA2 AND NOT-ADGRF1 | 0.956521739 | 1 | 0.916666667 |
| ST8SIA2 AND NOT-OR2H1 | 0.956521739 | 1 | 0.916666667 |
| ST8SIA2 AND NOT-OR1J2 | 0.936708861 | 1 | 0.880952381 |
| MARCH11 AND NOT-KCNV1 | 0.946745562 | 0.941176471 | 0.952380952 |
| MARCH11 AND NOT-ATP2C1 | 0.946745562 | 0.941176471 | 0.952380952 |
| ST8SIA2 AND NOT-GJB1 | 0.956521739 | 1 | 0.916666667 |
| MARCH11 AND NOT-B3GAT1 | 0.946745562 | 0.941176471 | 0.952380952 |
| DIABLO AND NOT-SERP1 | 0.936708861 | 1 | 0.880952381 |
| PCSK1N AND TMEM258 | 0.957575758 | 0.975308642 | 0.94047619 |
| ST8SIA2 AND NOT-GLP1R | 0.95 | 1 | 0.904761905 |
| CECR6 AND NOT-SLC15A2 | 0.953488372 | 0.931818182 | 0.976190476 |
| MARCH11 AND NOT-GLRB | 0.946745562 | 0.941176471 | 0.952380952 |
| ST8SIA2 AND NOT-OR51B5 | 0.95 | 1 | 0.904761905 |
| MARCH11 AND NOT-GPR6 | 0.946745562 | 0.941176471 | 0.952380952 |
| MARCH11 AND NOT-SLC46A3 | 0.946745562 | 0.941176471 | 0.952380952 |
| ST8SIA2 AND NOT-C17orf78 | 0.956521739 | 1 | 0.916666667 |
| GPR19 AND NOT-GRM3 | 0.952380952 | 0.952380952 | 0.952380952 |
| GPR19 AND NOT-KCNA1 | 0.958083832 | 0.963855422 | 0.952380952 |
| GPR19 AND NOT-PNPLA7 | 0.951219512 | 0.975 | 0.928571429 |
| GPR19 AND NOT-KCNJ16 | 0.963855422 | 0.975609756 | 0.952380952 |
| GPR19 AND NOT-LRP4 | 0.951807229 | 0.963414634 | 0.94047619 |
| GPR19 AND NOT-MOG | 0.963855422 | 0.975609756 | 0.952380952 |
| GPR19 AND NOT-SLCO1C1 | 0.951219512 | 0.975 | 0.928571429 |
| GPR19 AND NOT-GRAMD1C | 0.969325153 | 1 | 0.94047619 |
| GPR19 AND NOT-STYK1 | 0.95 | 1 | 0.904761905 |
| GPR19 AND NOT-HHATL | 0.952380952 | 0.952380952 | 0.952380952 |
| GPR19 AND NOT-CTXN3 | 0.952380952 | 0.952380952 | 0.952380952 |
| GPR19 AND NOT-SLC22A23 | 0.951807229 | 0.963414634 | 0.94047619 |
| GPR19 AND NOT-SLC1A3 | 0.952380952 | 0.952380952 | 0.952380952 |
| GPR19 AND NOT-SLC15A2 | 0.975609756 | 1 | 0.952380952 |
| GPR19 AND NOT-TRPC3 | 0.957055215 | 0.987341772 | 0.928571429 |
| GPR19 AND TMEM258 | 0.951219512 | 0.975 | 0.928571429 |
| GPR19 AND NOT-CA12 | 0.936708861 | 1 | 0.880952381 |
| GPR19 AND NOT-CACNA1A | 0.957055215 | 0.987341772 | 0.928571429 |
| GPR19 AND NOT-FA2H | 0.96969697 | 0.987654321 | 0.952380952 |
| GPR19 AND NOT-PRRT1 | 0.943396226 | 1 | 0.892857143 |
| GPR19 AND NOT-SLC25A18 | 0.952380952 | 0.952380952 | 0.952380952 |
| GPR19 AND NOT-ATP13A4 | 0.963855422 | 0.975609756 | 0.952380952 |
| GPR19 AND NOT-SLC4A4 | 0.943396226 | 1 | 0.892857143 |
| GPR19 AND NOT-CACNA1I | 0.952380952 | 0.952380952 | 0.952380952 |
| GPR19 AND NOT-SYT12 | 0.957055215 | 0.987341772 | 0.928571429 |
| GPR19 AND NOT-OPALIN | 0.963855422 | 0.975609756 | 0.952380952 |
| GPR19 AND NOT-SFXN5 | 0.951807229 | 0.963414634 | 0.94047619 |
| TMEM145 AND NOT-MOG | 0.937142857 | 0.901098901 | 0.976190476 |

FIG. 1 (CONT.)

| Antigen Pair Logic | F1 | Precision | Recall | Antigen Pair Logic | F1 | Precision | Recall |
|---|---|---|---|---|---|---|---|
| TMX2 AND NOT-SLAMF7 | 0.917293233 | 0.953125 | 0.884057971 | TMEM145 AND SLC38A2 | 0.951219512 | 0.975 | 0.928571429 |
| COA1 AND NOT-SLAMF7 | 0.914285714 | 0.90140845 | 0.927536232 | TMEM145 AND TMEM258 | 0.957575758 | 0.975308642 | 0.94047619 |
| NOT-SLAMF7 AND ITGAE | 0.927536232 | 0.92753623 | 0.927536232 | MARCH11 AND NOT-GPR21 | 0.951807229 | 0.963414634 | 0.94047619 |
| PON2 AND NOT-SLAMF7 | 0.954545455 | 1 | 0.913043478 | MARCH11 AND NOT-OR2L13 | 0.946745562 | 0.941176471 | 0.952380952 |
| XPR1 AND NOT-SLAMF7 | 0.921875 | 1 | 0.855072464 | ST8SIA2 AND NOT-OR2L13 | 0.936708861 | 1 | 0.880952381 |
| GOLM1 AND NOT-SLAMF7 | 0.941176471 | 0.95522388 | 0.927536232 | MARCH11 AND NOT-GPR26 | 0.946745562 | 0.941176471 | 0.952380952 |
| NOT-SLAMF7 AND ETNK1 | 0.921985816 | 0.90277778 | 0.942028986 | MARCH11 AND NOT-RNF180 | 0.946745562 | 0.941176471 | 0.952380952 |
| WRB AND NOT-SLAMF7 | 0.924242424 | 0.96825397 | 0.884057971 | MARCH11 AND NOT-GPR37 | 0.958083832 | 0.963855422 | 0.952380952 |
| NOT-SLAMF7 AND METTL21A | 0.901408451 | 0.87671233 | 0.927536232 | ST8SIA2 AND NOT-GPR37 | 0.95 | 1 | 0.904761905 |
| NOT-SLAMF7 AND ARL6IP1 | 0.909090909 | 0.87837838 | 0.942028986 | ST8SIA2 AND NOT-GRIA3 | 0.95 | 1 | 0.904761905 |
| NOT-SLAMF7 AND CNEP1R1 | 0.925373134 | 0.95384615 | 0.898550725 | MARCH11 AND NOT-SLC6A16 | 0.963855422 | 0.975609756 | 0.952380952 |
| CANX AND NOT-SLAMF7 | 0.924242424 | 0.96825397 | 0.884057971 | MARCH11 AND NOT-GRIK1 | 0.946745562 | 0.941176471 | 0.952380952 |
| VMA21 AND NOT-SLAMF7 | 0.900763359 | 0.9516129 | 0.855072464 | ST8SIA2 AND NOT-GRIK1 | 0.956521739 | 1 | 0.916666667 |
| NOT-SLAMF7 AND CHST11 | 0.955882353 | 0.97014925 | 0.942028986 | MARCH11 AND NOT-GRIN1 | 0.946745562 | 0.941176471 | 0.952380952 |
| NOT-SLAMF7 AND DNAJC19 | 0.920863309 | 0.91428571 | 0.927536232 | MARCH11 AND NOT-GRIN2A | 0.946745562 | 0.941176471 | 0.952380952 |
| NOT-SLAMF7 AND CCDC127 | 0.911764706 | 0.92537313 | 0.898550725 | ST8SIA2 AND NOT-GRIN2B | 0.956521739 | 1 | 0.916666667 |
| NOT-SLAMF7 AND MCUR1 | 0.925373134 | 0.95384615 | 0.898550725 | MARCH11 AND NOT-GRIN2C | 0.946745562 | 0.941176471 | 0.952380952 |
| SPNS1 AND NOT-SLAMF7 | 0.913385827 | 1 | 0.84057971 | MARCH11 AND NOT-GRM1 | 0.952380952 | 0.952380952 | 0.952380952 |
| NOT-SLAMF7 AND DPY19L4 | 0.920863309 | 0.91428571 | 0.927536232 | MARCH11 AND NOT-GRM2 | 0.958083832 | 0.963855422 | 0.952380952 |
| NOT-SLAMF7 AND TMX3 | 0.911764706 | 0.92537313 | 0.898550725 | ST8SIA2 AND NOT-GRM2 | 0.956521739 | 1 | 0.916666667 |
| NOT-SLAMF7 AND ORMDL1 | 0.934306569 | 0.94117647 | 0.927536232 | MARCH11 AND NOT-GRM3 | 0.946745562 | 0.941176471 | 0.952380952 |
| NOT-SLAMF7 AND BET1 | 0.910447761 | 0.93846154 | 0.884057971 | HMP19 AND NOT-GRM3 | 0.95 | 1 | 0.904761905 |
| NOT-SLAMF7 AND STX18 | 0.914285714 | 0.90140845 | 0.927536232 | ST8SIA2 AND NOT-GRM3 | 0.956521739 | 1 | 0.916666667 |
| FJX1 AND NOT-SLAMF7 | 0.913043478 | 0.91304348 | 0.913043478 | MARCH11 AND NOT-GRM5 | 0.946745562 | 0.941176471 | 0.952380952 |
| NOT-SLAMF7 AND BRCA1 | 0.905109489 | 0.91176471 | 0.898550725 | ST8SIA2 AND NOT-GRM6 | 0.956521739 | 1 | 0.916666667 |
| NOT-SLAMF7 AND TOR1B | 0.948905109 | 0.95588235 | 0.942028986 | MARCH11 AND NOT-GRM7 | 0.946745562 | 0.941176471 | 0.952380952 |
| SYT11 AND SLAMF7 | 0.951048951 | 0.91891892 | 0.985507246 | MARCH11 AND NOT-SLC25A4 | 0.946745562 | 0.941176471 | 0.952380952 |
| RNF145 AND NOT-SLAMF7 | 0.909090909 | 0.95238095 | 0.869565217 | MARCH11 AND NOT-CYP2S1 | 0.952380952 | 0.952380952 | 0.952380952 |
| SCRG1 AND SLAMF7 | 0.909090909 | 0.87837838 | 0.942028986 | ST8SIA2 AND NOT-PCDHB1 | 0.936708861 | 1 | 0.880952381 |
| NOT-SLAMF7 AND STIM2 | 0.902255639 | 0.9375 | 0.869565217 | MARCH11 AND NOT-GUCY2D | 0.946745562 | 0.941176471 | 0.952380952 |
| NOT-SLAMF7 AND TMEM126B | 0.913043478 | 0.91304348 | 0.913043478 | MARCH11 AND NOT-KCNIP3 | 0.958083832 | 0.963855422 | 0.952380952 |
| NOT-SLAMF7 AND EEF1E1 | 0.936170213 | 0.91666667 | 0.956521739 | ST8SIA2 AND NOT-SLC29A2 | 0.956521739 | 1 | 0.916666667 |
| NOT-SLAMF7 AND RNASE6 | 0.900763359 | 0.9516129 | 0.855072464 | ST8SIA2 AND NOT-HTR1F | 0.956521739 | 1 | 0.916666667 |
| NOT-SLAMF7 AND TMCO1 | 0.932330827 | 0.96875 | 0.898550725 | MARCH11 AND NOT-NAT8L | 0.946745562 | 0.941176471 | 0.952380952 |
| NOT-SLAMF7 AND SLC20A1 | 0.911564626 | 0.85897436 | 0.971014493 | ST8SIA2 AND NOT-TREML1 | 0.943396226 | 1 | 0.892857143 |
| B3GALT6 AND NOT-SLAMF7 | 0.946564885 | 1 | 0.898550725 | ST8SIA2 AND NOT-AQP8 | 0.95 | 1 | 0.904761905 |
| TPST1 AND NOT-SLAMF7 | 0.930232558 | 1 | 0.869565217 | MARCH11 AND NOT-PAQR9 | 0.975609756 | 1 | 0.952380952 |
| NOT-SLAMF7 AND NIPA2 | 0.911764706 | 0.92537313 | 0.898550725 | MARCH11 AND NOT-CATSPER3 | 0.963855422 | 0.975609756 | 0.952380952 |
| ZDHHC4 AND NOT-SLAMF7 | 0.914285714 | 0.90140845 | 0.927536232 | ST8SIA2 AND NOT-CATSPER3 | 0.943396226 | 1 | 0.892857143 |
| NOT-SLAMF7 AND UBE2J1 | 0.9 | 0.88732394 | 0.913043478 | ST8SIA2 AND NOT-AQP4 | 0.95 | 1 | 0.904761905 |
| AGPAT5 AND NOT-SLAMF7 | 0.946564885 | 1 | 0.898550725 | ST8SIA2 AND NOT-AQP6 | 0.943396226 | 1 | 0.892857143 |
| NOT-SLAMF7 AND ATP13A1 | 0.914728682 | 0.98333333 | 0.855072464 | MARCH11 AND NOT-ITGAE | 0.946745562 | 0.941176471 | 0.952380952 |
| CHST10 AND SLAMF7 | 0.915492958 | 0.89041096 | 0.942028986 | ST8SIA2 AND NOT-ITGB3 | 0.95 | 1 | 0.904761905 |
| NOT-SLAMF7 AND PAG1 | 0.919708029 | 0.92647059 | 0.913043478 | MARCH11 AND NOT-ITPR1 | 0.946745562 | 0.941176471 | 0.952380952 |
| NOT-SLAMF7 AND TMED5 | 0.909090909 | 0.95238095 | 0.869565217 | MARCH11 AND NOT-KCNA1 | 0.946745562 | 0.941176471 | 0.952380952 |
| JAM2 AND NOT-SLAMF7 | 0.903703704 | 0.92424242 | 0.884057971 | ST8SIA2 AND NOT-KCNA1 | 0.956521739 | 1 | 0.916666667 |
| NOT-SLAMF7 AND TMEM9B | 0.933333333 | 0.95454545 | 0.913043478 | ST8SIA2 AND NOT-KCNA5 | 0.936708861 | 1 | 0.880952381 |
| NOT-SLAMF7 AND TMBIM6 | 0.916030534 | 0.96774194 | 0.869565217 | MARCH11 AND NOT-GALNT18 | 0.946745562 | 0.941176471 | 0.952380952 |
| NOT-SLAMF7 AND PEX2 | 0.905109489 | 0.91176471 | 0.898550725 | ST8SIA2 AND NOT-C1orf95 | 0.936708861 | 1 | 0.880952381 |
| PTPRZ1 AND NOT-SLAMF7 | 0.985294118 | 1 | 0.971014493 | LHFPL4 AND NOT-SLC15A2 | 0.95 | 1 | 0.904761905 |
| NOT-SLAMF7 AND LRRC59 | 0.934306569 | 0.94117647 | 0.927536232 | MARCH11 AND NOT-KCNF1 | 0.946745562 | 0.941176471 | 0.952380952 |
| NOT-SLAMF7 AND NEMP1 | 0.948905109 | 0.95588235 | 0.942028986 | ST8SIA2 AND NOT-LHFPL3 | 0.956521739 | 1 | 0.916666667 |
| HTRA2 AND NOT-SLAMF7 | 0.916030534 | 0.96774194 | 0.869565217 | ST8SIA2 AND NOT-KCNJ1 | 0.936708861 | 1 | 0.880952381 |
| NDUFA4 AND NOT-SLAMF7 | 0.918518519 | 0.93939394 | 0.898550725 | MARCH11 AND NOT-KCNJ4 | 0.958083832 | 0.963855422 | 0.952380952 |
| NOT-SLAMF7 AND C12orf73 | 0.910344828 | 0.86842105 | 0.956521739 | MARCH11 AND NOT-KCNJ6 | 0.946745562 | 0.941176471 | 0.952380952 |
| NOT-SLAMF7 AND GAL3ST4 | 0.920863309 | 0.91428571 | 0.927536232 | ST8SIA2 AND NOT-KCNJ6 | 0.936708861 | 1 | 0.880952381 |
| NOT-SLAMF7 AND LEPROTL1 | 0.934306569 | 0.94117647 | 0.927536232 | MARCH11 AND NOT-KCNJ10 | 0.946745562 | 0.941176471 | 0.952380952 |
| NOT-SLAMF7 AND MANEA | 0.947368421 | 0.984375 | 0.913043478 | HMP19 AND NOT-KCNJ10 | 0.95 | 1 | 0.904761905 |
| BCHE AND NOT-SLAMF7 | 0.916030534 | 0.96774194 | 0.869565217 | ST8SIA2 AND NOT-KCNJ10 | 0.95 | 1 | 0.904761905 |
| NOT-SLAMF7 AND SSR2 | 0.948148148 | 0.96969697 | 0.927536232 | MARCH11 AND NOT-KCNJ16 | 0.946745562 | 0.941176471 | 0.952380952 |
| NRCAM AND NOT-TNFRSF10A | 0.900763359 | 0.9516129 | 0.855072464 | ST8SIA2 AND NOT-KCNJ16 | 0.956521739 | 1 | 0.916666667 |
| FKTN AND NOT-TNFRSF10A | 0.913385827 | 1 | 0.84057971 | ST8SIA2 AND NOT-KCNK1 | 0.956521739 | 1 | 0.916666667 |
| NLGN1 AND NOT-TNFRSF10A | 0.930232558 | 1 | 0.869565217 | MARCH11 AND NOT-KCNS1 | 0.952380952 | 0.952380952 | 0.952380952 |
| LRRC37A3 AND NOT-TNFRSF10A | 0.905109489 | 0.91176471 | 0.898550725 | MARCH11 AND NOT-KCNS2 | 0.946745562 | 0.941176471 | 0.952380952 |
| ITGAV AND NOT-TNFRSF10A | 0.948148148 | 0.96969697 | 0.927536232 | ST8SIA2 AND NOT-KCNS2 | 0.956521739 | 1 | 0.916666667 |
| MARS AND NOT-TNFRSF10A | 0.913043478 | 0.91304348 | 0.913043478 | ST8SIA2 AND NOT-KIR2DL4 | 0.95 | 1 | 0.904761905 |
| PRAF2 AND PRAF2 | 0.905109489 | 0.91176471 | 0.898550725 | MARCH11 AND NOT-ILDR2 | 0.951807229 | 0.963414634 | 0.94047619 |
| XPR1 AND NOT-TNFRSF10A | 0.913385827 | 1 | 0.84057971 | ST8SIA2 AND NOT-CLEC12B | 0.956521739 | 1 | 0.916666667 |
| GOLM1 AND NOT-TNFRSF10A | 0.913043478 | 0.91304348 | 0.913043478 | MARCH11 AND NOT-RPRML | 0.946745562 | 0.941176471 | 0.952380952 |
| FJX1 AND NOT-TNFRSF10A | 0.932330827 | 0.96875 | 0.898550725 | MARCH11 AND NOT-FAM209B | 0.963855422 | 0.975609756 | 0.952380952 |
| SYT11 AND TNFRSF10A | 0.936170213 | 0.91666667 | 0.956521739 | ST8SIA2 AND NOT-FAM209B | 0.95 | 1 | 0.904761905 |
| SCRG1 AND NOT-TNFRSF10A | 0.926470588 | 0.94029851 | 0.913043478 | MARCH11 AND NOT-SPATA31D1 | 0.957575758 | 0.975308642 | 0.94047619 |
| CERS5 AND NOT-TNFRSF10A | 0.904761905 | 1 | 0.826086957 | ST8SIA2 AND NOT-OR51I1 | 0.936708861 | 1 | 0.880952381 |
| B3GALT6 AND NOT-TNFRSF10A | 0.910447761 | 0.93846154 | 0.884057971 | MARCH11 AND NOT-TMEM200B | 0.951807229 | 0.963414634 | 0.94047619 |
| TPST1 AND NOT-TNFRSF10A | 0.921875 | 1 | 0.855072464 | MARCH11 AND NOT-C11orf87 | 0.946745562 | 0.941176471 | 0.952380952 |
| AGPAT5 AND NOT-TNFRSF10A | 0.930232558 | 1 | 0.869565217 | MARCH11 AND NOT-LMO7 | 0.96969697 | 0.987654321 | 0.952380952 |

FIG. 1 (CONT.)

| Antigen Pair Logic | F1 | Precision | Recall | Antigen Pair Logic | F1 | Precision | Recall |
|---|---|---|---|---|---|---|---|
| CHST10 AND TNFRSF10A | 0.9 | 0.88732394 | 0.913043478 | ST8SIA2 AND NOT-XKRX | 0.95 | 1 | 0.904761905 |
| JAM2 AND NOT-TNFRSF10A | 0.916030534 | 0.96774194 | 0.869565217 | ST8SIA2 AND NOT-IFITM10 | 0.943396226 | 1 | 0.892857143 |
| PTPRZ1 AND NOT-TNFRSF10A | 0.962962963 | 0.98484848 | 0.942028986 | MARCH11 AND NOT-PPAPDC2 | 0.946745562 | 0.941176471 | 0.952380952 |
| NDUFA4 AND NOT-TNFRSF10A | 0.903703704 | 0.92424242 | 0.884057971 | MARCH11 AND NOT-LRP2 | 0.958083832 | 0.963855422 | 0.952380952 |
| NLGN1 AND NLGN1 | 0.917293233 | 0.953125 | 0.884057971 | RTN1 AND NOT-LRP2 | 0.936708861 | 1 | 0.880952381 |
| ITGAV AND NOT-MUC1 | 0.907692308 | 0.96721311 | 0.855072464 | ST8SIA2 AND NOT-LRP2 | 0.936708861 | 1 | 0.880952381 |
| TREM2 AND NOT-MUC1 | 0.90625 | 0.98305085 | 0.84057971 | MARCH11 AND NOT-LRP4 | 0.952380952 | 0.952380952 | 0.952380952 |
| PRAF2 AND PRAF2 | 0.905109489 | 0.91176471 | 0.898550725 | HMP19 AND NOT-LRP4 | 0.951219512 | 0.975 | 0.928571429 |
| SYT11 AND MUC1 | 0.936170213 | 0.91666667 | 0.956521739 | ST8SIA2 AND NOT-LRP4 | 0.956521739 | 1 | 0.916666667 |
| HSPA13 AND NOT-MUC1 | 0.904761905 | 1 | 0.826086957 | MARCH11 AND NOT-HAPLN4 | 0.946745562 | 0.941176471 | 0.952380952 |
| TPST1 AND NOT-MUC1 | 0.938461538 | 1 | 0.884057971 | ST8SIA2 AND NOT-LSAMP | 0.943396226 | 1 | 0.892857143 |
| AGPAT5 AND MUC1 | 0.905109489 | 0.91176471 | 0.898550725 | ST8SIA2 AND NOT-LCN10 | 0.95 | 1 | 0.904761905 |
| CHST10 AND MUC1 | 0.9 | 0.88732394 | 0.913043478 | MARCH11 AND NOT-ADAM11 | 0.946745562 | 0.941176471 | 0.952380952 |
| PTPRZ1 AND NOT-MUC1 | 0.985507246 | 0.98550725 | 0.985507246 | MARCH11 AND NOT-ART3 | 0.975609756 | 1 | 0.952380952 |
| PTPRZ1 AND NOT-NAALAD2 | 0.985507246 | 0.98550725 | 0.985507246 | ST8SIA2 AND NOT-MME | 0.95 | 1 | 0.904761905 |
| PTPRZ1 AND NOT-NAALADL1 | 0.985507246 | 0.98550725 | 0.985507246 | ST8SIA2 AND NOT-ALDH6A1 | 0.936708861 | 1 | 0.880952381 |
| PTPRZ1 AND KCNE3 | 0.985507246 | 0.98550725 | 0.985507246 | MARCH11 AND NOT-MOG | 0.952380952 | 0.952380952 | 0.952380952 |
| CDH2 AND NOT-MRGPRX3 | 0.985507246 | 0.98550725 | 0.985507246 | ST8SIA3 AND NOT-MOG | 0.963855422 | 0.975609756 | 0.952380952 |
| CDH2 AND NOT-RXFP2 | 0.985294118 | 1 | 0.971014493 | HMP19 AND NOT-MOG | 0.962962963 | 1 | 0.928571429 |
| CDH2 AND NOT-AADAC | 0.970149254 | 1 | 0.942028986 | SCN3B AND NOT-MOG | 0.952941176 | 0.941860465 | 0.964285714 |
| CDH2 AND NOT-CYP3A4 | 0.985294118 | 1 | 0.971014493 | ADGRB3 AND NOT-MOG | 0.956521739 | 1 | 0.916666667 |
| CDH2 AND NOT-DSC3 | 0.985294118 | 1 | 0.971014493 | RTN1 AND NOT-MOG | 0.963414634 | 0.9875 | 0.94047619 |
| CDH2 AND NOT-TMEM26 | 0.985294118 | 1 | 0.971014493 | ST8SIA2 AND NOT-MOG | 0.956521739 | 1 | 0.916666667 |
| CDH2 AND NOT-FUT3 | 0.977777778 | 1 | 0.956521739 | MARCH11 AND NOT-MINOS1 | 0.946745562 | 0.941176471 | 0.952380952 |
| CDH2 AND ITGAV | 0.970149254 | 1 | 0.942028986 | MARCH11 AND NOT-NDUFB8 | 0.946745562 | 0.941176471 | 0.952380952 |
| CDH2 AND NDUFA4 | 0.977777778 | 1 | 0.956521739 | MARCH11 AND NOT-NTRK2 | 0.946745562 | 0.941176471 | 0.952380952 |
| CDH2 AND NOT-GABRQ | 0.970149254 | 1 | 0.942028986 | MARCH11 AND NOT-ATP2B2 | 0.946745562 | 0.941176471 | 0.952380952 |
| CDH2 AND NOT-OTOR | 0.977777778 | 1 | 0.956521739 | MARCH11 AND NOT-OPCML | 0.946745562 | 0.941176471 | 0.952380952 |
| CDH2 AND NOT-SIGLEC6 | 0.970149254 | 1 | 0.942028986 | MARCH11 AND NOT-CLDN11 | 0.951219512 | 0.975 | 0.928571429 |
| GPM6B AND OST4 | 0.977777778 | 1 | 0.956521739 | MARCH11 AND NOT-GALNT9 | 0.946745562 | 0.941176471 | 0.952380952 |
| PTPRZ1 AND OST4 | 0.977777778 | 1 | 0.956521739 | MARCH11 AND NOT-PAM | 0.951807229 | 0.963414634 | 0.94047619 |
| PTPRZ1 AND TMEM221 | 0.985507246 | 0.98550725 | 0.985507246 | MARCH11 AND NOT-NTM | 0.946745562 | 0.941176471 | 0.952380952 |
| PTPRZ1 AND LRRC70 | 0.985507246 | 0.98550725 | 0.985507246 | MARCH11 AND NOT-C3orf18 | 0.946745562 | 0.941176471 | 0.952380952 |
| PTPRZ1 AND NOT-SMIM6 | 0.985294118 | 1 | 0.971014493 | MARCH11 AND NOT-KCNK9 | 0.946745562 | 0.941176471 | 0.952380952 |
| PTPRZ1 AND NOT-NEMP2 | 0.985294118 | 1 | 0.971014493 | MARCH11 AND NOT-CHST15 | 0.946745562 | 0.941176471 | 0.952380952 |
| PTPRZ1 AND ARMCX4 | 0.985507246 | 0.98550725 | 0.985507246 | MARCH11 AND CUTA | 0.951807229 | 0.963414634 | 0.94047619 |
| PTPRZ1 AND NOT-BCL2L10 | 0.985507246 | 0.98550725 | 0.985507246 | MARCH11 AND NOT-GPRC5B | 0.956521739 | 1 | 0.916666667 |
| PTPRZ1 AND NOT-HCN4 | 0.985507246 | 0.98550725 | 0.985507246 | MARCH11 AND NOT-SLC26A4 | 0.946745562 | 0.941176471 | 0.952380952 |
| PTPRZ1 AND NOT-TIMM23 | 0.985507246 | 0.98550725 | 0.985507246 | MARCH11 AND NOT-TUBA8 | 0.946745562 | 0.941176471 | 0.952380952 |
| PTPRZ1 AND NOT-ERVMER34-1 | 0.985294118 | 1 | 0.971014493 | MARCH11 AND NOT-SLCO1C1 | 0.946745562 | 0.941176471 | 0.952380952 |
| PTPRZ1 AND CDH4 | 0.985507246 | 0.98550725 | 0.985507246 | MARCH11 AND SLC38A2 | 0.951219512 | 0.975 | 0.928571429 |
| PTPRZ1 AND NOT-PET117 | 0.985507246 | 0.98550725 | 0.985507246 | MARCH11 AND TOMM7 | 0.946745562 | 0.941176471 | 0.952380952 |
| PTPRZ1 AND CDH5 | 0.99270073 | 1 | 0.985507246 | MARCH11 AND NOT-MANSC1 | 0.946745562 | 0.941176471 | 0.952380952 |
| PTPRZ1 AND CDH6 | 0.985507246 | 0.98550725 | 0.985507246 | MARCH11 AND NOT-GRAMD1C | 0.963855422 | 0.975609756 | 0.952380952 |
| PTPRZ1 AND 100505984? | 0.985507246 | 0.98550725 | 0.985507246 | MARCH11 AND NOT-PIGG | 0.946745562 | 0.941176471 | 0.952380952 |
| PTPRZ1 AND NOT-APELA | 0.985507246 | 0.98550725 | 0.985507246 | MARCH11 AND NOT-RNF43 | 0.957055215 | 0.987341772 | 0.928571429 |
| PTPRZ1 AND NOT-MRLN | 0.985507246 | 0.98550725 | 0.985507246 | MARCH11 AND NOT-FBXW7 | 0.946745562 | 0.941176471 | 0.952380952 |
| SYT11 AND NOT-TPBGL | 0.977777778 | 1 | 0.956521739 | MARCH11 AND NOT-TMEM144 | 0.952380952 | 0.952380952 | 0.952380952 |
| PTPRZ1 AND NOT-TPBGL | 0.977777778 | 1 | 0.956521739 | MARCH11 AND NOT-STYK1 | 0.946745562 | 0.941176471 | 0.952380952 |
| PTPRZ1 AND NOT-SMLR1 | 0.99270073 | 1 | 0.985507246 | MARCH11 AND NOT-GLT8D1 | 0.946745562 | 0.941176471 | 0.952380952 |
| PTPRZ1 AND TMEM178B | 0.985507246 | 0.98550725 | 0.985507246 | MARCH11 AND NOT-AJAP1 | 0.946745562 | 0.941176471 | 0.952380952 |
| PTPRZ1 AND NOT-MICA | 0.985507246 | 0.98550725 | 0.985507246 | MARCH11 AND NOT-SLC7A10 | 0.952380952 | 0.952380952 | 0.952380952 |
| PTPRZ1 AND NOT-100507547? | 0.985507246 | 0.98550725 | 0.985507246 | MARCH11 AND NOT-PRRG1 | 0.951807229 | 0.963414634 | 0.94047619 |
| PTPRZ1 AND GJC1 | 0.985507246 | 0.98550725 | 0.985507246 | MARCH11 AND NOT-PANX2 | 0.946745562 | 0.941176471 | 0.952380952 |
| PTPRZ1 AND NOT-UBA2 | 0.985507246 | 0.98550725 | 0.985507246 | MARCH11 AND NOT-AGPAT3 | 0.958083832 | 0.963855422 | 0.952380952 |
| PTPRZ1 AND ABCC9 | 0.985507246 | 0.98550725 | 0.985507246 | MARCH11 AND NOT-SLC17A7 | 0.946745562 | 0.941176471 | 0.952380952 |
| PTPRZ1 AND SCAMP3 | 0.99270073 | 1 | 0.985507246 | MARCH11 AND NOT-SLC45A4 | 0.946745562 | 0.941176471 | 0.952380952 |
| PTPRZ1 AND NOT-CDH8 | 0.985507246 | 0.98550725 | 0.985507246 | MARCH11 AND NOT-TTYH1 | 0.951807229 | 0.963414634 | 0.94047619 |
| CHST10 AND NOT-CDH8 | 0.970149254 | 1 | 0.942028986 | MARCH11 AND NOT-ABHD6 | 0.946745562 | 0.941176471 | 0.952380952 |
| PTPRZ1 AND MUC12 | 0.985507246 | 0.98550725 | 0.985507246 | MARCH11 AND NOT-LRTM1 | 0.946745562 | 0.941176471 | 0.952380952 |
| PTPRZ1 AND NOT-ATP9A | 0.985507246 | 0.98550725 | 0.985507246 | MARCH11 AND NOT-HHATL | 0.958083832 | 0.963855422 | 0.952380952 |
| PTPRZ1 AND CDH10 | 0.985507246 | 0.98550725 | 0.985507246 | MARCH11 AND NOT-NCEH1 | 0.958083832 | 0.963855422 | 0.952380952 |
| PTPRZ1 AND TSPAN5 | 0.985507246 | 0.98550725 | 0.985507246 | MARCH11 AND NOT-BBS4 | 0.946745562 | 0.941176471 | 0.952380952 |
| PTPRZ1 AND NOT-TSPAN1 | 0.985507246 | 0.98550725 | 0.985507246 | MARCH11 AND NOT-ENPP5 | 0.957575758 | 0.975308642 | 0.94047619 |
| PTPRZ1 AND PREB | 0.99270073 | 1 | 0.985507246 | MARCH11 AND NOT-EVA1C | 0.963855422 | 0.975609756 | 0.952380952 |
| PTPRZ1 AND BCAP31 | 0.99270073 | 1 | 0.985507246 | MARCH11 AND NOT-CACNG8 | 0.946745562 | 0.941176471 | 0.952380952 |
| PTPRZ1 AND NOT-ADGRG2 | 0.985507246 | 0.98550725 | 0.985507246 | MARCH11 AND NOT-LGR6 | 0.963855422 | 0.975609756 | 0.952380952 |
| PTPRZ1 AND NOT-CDH17 | 0.985507246 | 0.98550725 | 0.985507246 | MARCH11 AND NOT-CTXN3 | 0.946745562 | 0.941176471 | 0.952380952 |
| PTPRZ1 AND LPAR6 | 0.977777778 | 1 | 0.956521739 | MARCH11 AND NOT-SLC22A23 | 0.946745562 | 0.941176471 | 0.952380952 |
| PTPRZ1 AND NOT-CDH18 | 0.985507246 | 0.98550725 | 0.985507246 | MARCH11 AND NOT-SCN1A | 0.946745562 | 0.941176471 | 0.952380952 |
| PTPRZ1 AND NOT-DHRS9 | 0.985507246 | 0.98550725 | 0.985507246 | MARCH11 AND NOT-SCN1B | 0.958083832 | 0.963855422 | 0.952380952 |
| GPM6B AND CNIH1 | 0.977777778 | 1 | 0.956521739 | MARCH11 AND NOT-SCN4B | 0.946745562 | 0.941176471 | 0.952380952 |
| PTPRZ1 AND NOT-TENM1 | 0.985507246 | 0.98550725 | 0.985507246 | MARCH11 AND NOT-SCN8A | 0.946745562 | 0.941176471 | 0.952380952 |
| PTPRZ1 AND NOT-101805491? | 0.985507246 | 0.98550725 | 0.985507246 | MARCH11 AND NOT-SCNN1G | 0.958083832 | 0.963855422 | 0.952380952 |
| PTPRZ1 AND LHFPL2 | 0.985507246 | 0.98550725 | 0.985507246 | MARCH11 AND NOT-CX3CL1 | 0.946745562 | 0.941176471 | 0.952380952 |
| PTPRZ1 AND LHFP | 0.985507246 | 0.98550725 | 0.985507246 | MARCH11 AND NOT-XYLT2 | 0.951219512 | 0.975 | 0.928571429 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND ADAM8 | 0.985507246 | 0.98550725 | 0.985507246 | MARCH11 AND NOT-WBSCR17 | 0.946745562 | 0.941176471 | 0.952380952 |
| PTPRZ1 AND NOT-TRIM13 | 0.985507246 | 0.98550725 | 0.985507246 | MARCH11 AND NOT-SFTPD | 0.946745562 | 0.941176471 | 0.952380952 |
| PTPRZ1 AND NOT-ANGPTL7 | 0.985507246 | 0.98550725 | 0.985507246 | MARCH11 AND NOT-SGCD | 0.951807229 | 0.963414634 | 0.94047619 |
| PTPRZ1 AND NOT-GPA33 | 0.985507246 | 0.98550725 | 0.985507246 | MARCH11 AND NOT-SGCG | 0.958083832 | 0.963855422 | 0.952380952 |
| PTPRZ1 AND MFSD10 | 0.985507246 | 0.98550725 | 0.985507246 | MARCH11 AND NOT-LMF1 | 0.946745562 | 0.941176471 | 0.952380952 |
| PTPRZ1 AND STX6 | 0.985507246 | 0.98550725 | 0.985507246 | MARCH11 AND NOT-FBXL17 | 0.946745562 | 0.941176471 | 0.952380952 |
| PTPRZ1 AND COQ7 | 0.985507246 | 0.98550725 | 0.985507246 | MARCH11 AND NOT-SLC1A3 | 0.958083832 | 0.963855422 | 0.952380952 |
| GPM6B AND SLC35B1 | 0.970149254 | 1 | 0.942028986 | MARCH11 AND NOT-SLC3A1 | 0.946745562 | 0.941176471 | 0.952380952 |
| PTPRZ1 AND SLC35B1 | 0.99270073 | 1 | 0.985507246 | MARCH11 AND NOT-SLC6A1 | 0.946745562 | 0.941176471 | 0.952380952 |
| PTPRZ1 AND KCNMB2 | 0.985507246 | 0.98550725 | 0.985507246 | MARCH11 AND NOT-SLC6A13 | 0.963855422 | 0.975609756 | 0.952380952 |
| PTPRZ1 AND TIMM17B | 0.985507246 | 0.98550725 | 0.985507246 | MARCH11 AND NOT-LRTM2 | 0.946745562 | 0.941176471 | 0.952380952 |
| PTPRZ1 AND NOT-SLC17A2 | 0.970149254 | 1 | 0.942028986 | MARCH11 AND NOT-SLC9A5 | 0.946745562 | 0.941176471 | 0.952380952 |
| PTPRZ1 AND RAMP2 | 0.985507246 | 0.98550725 | 0.985507246 | MARCH11 AND NOT-SLC15A2 | 0.952380952 | 0.952380952 | 0.952380952 |
| PTPRZ1 AND NOT-RAMP3 | 0.985507246 | 0.98550725 | 0.985507246 | MARCH11 AND NOT-SOX1 | 0.946745562 | 0.941176471 | 0.952380952 |
| GPM6B AND ZMPSTE24 | 0.970149254 | 1 | 0.942028986 | MARCH11 AND NOT-SPAM1 | 0.963855422 | 0.975609756 | 0.952380952 |
| PTPRZ1 AND ZMPSTE24 | 0.99270073 | 1 | 0.985507246 | MARCH11 AND NOT-TAZ | 0.946745562 | 0.941176471 | 0.952380952 |
| PTPRZ1 AND NOT-PRSS16 | 0.985507246 | 0.98550725 | 0.985507246 | MARCH11 AND NOT-TGFA | 0.952380952 | 0.952380952 | 0.952380952 |
| PTPRZ1 AND BET1 | 0.985507246 | 0.98550725 | 0.985507246 | MARCH11 AND NOT-ICAM5 | 0.946745562 | 0.941176471 | 0.952380952 |
| PTPRZ1 AND LILRB2 | 0.985507246 | 0.98550725 | 0.985507246 | MARCH11 AND NOT-TRPC3 | 0.946745562 | 0.941176471 | 0.952380952 |
| PTPRZ1 AND NOT-MARCH6 | 0.985507246 | 0.98550725 | 0.985507246 | MARCH11 AND NOT-TYRP1 | 0.958083832 | 0.963855422 | 0.952380952 |
| PTPRZ1 AND TCIRG1 | 0.985507246 | 0.98550725 | 0.985507246 | MARCH11 AND NOT-VIPR2 | 0.958083832 | 0.963855422 | 0.952380952 |
| PTPRZ1 AND NOT-RTN3 | 0.985507246 | 0.98550725 | 0.985507246 | MARCH11 AND NOT-MYRF | 0.946745562 | 0.941176471 | 0.952380952 |
| PTPRZ1 AND NOT-B3GALT5 | 0.985507246 | 0.98550725 | 0.985507246 | MARCH11 AND NOT-RNF112 | 0.946745562 | 0.941176471 | 0.952380952 |
| PTPRZ1 AND NOT-CRISP3 | 0.985507246 | 0.98550725 | 0.985507246 | MARCH11 AND NOT-CACNA1C | 0.958083832 | 0.963855422 | 0.952380952 |
| PTPRZ1 AND TMEM5 | 0.985507246 | 0.98550725 | 0.985507246 | MARCH11 AND CXCR4 | 0.946745562 | 0.941176471 | 0.952380952 |
| PTPRZ1 AND NOT-B3GNT3 | 0.970149254 | 1 | 0.942028986 | MARCH11 AND NOT-CRELD1 | 0.946745562 | 0.941176471 | 0.952380952 |
| PTPRZ1 AND NOT-CLEC4M | 0.985507246 | 0.98550725 | 0.985507246 | NOT-MARCH11 AND GDAP1L1 | 0.943181818 | 0.902173913 | 0.988095238 |
| PTPRZ1 AND MRVI1 | 0.985507246 | 0.98550725 | 0.985507246 | MARCH11 AND NOT-FA2H | 0.946745562 | 0.941176471 | 0.952380952 |
| PTPRZ1 AND TRDN | 0.985507246 | 0.98550725 | 0.985507246 | MARCH11 AND NKAIN1 | 0.952380952 | 0.952380952 | 0.952380952 |
| PTPRZ1 AND NOT-CACNG3 | 0.970149254 | 1 | 0.942028986 | MARCH11 AND NOT-C1orf115 | 0.946745562 | 0.941176471 | 0.952380952 |
| PTPRZ1 AND BTN2A2 | 0.985507246 | 0.98550725 | 0.985507246 | MARCH11 AND NOT-PAQR6 | 0.946745562 | 0.941176471 | 0.952380952 |
| PTPRZ1 AND NOT-ATP8A1 | 0.985507246 | 0.98550725 | 0.985507246 | MARCH11 AND NOT-TMPRSS5 | 0.946745562 | 0.941176471 | 0.952380952 |
| PTPRZ1 AND NOT-NDRG1 | 0.985507246 | 0.98550725 | 0.985507246 | MARCH11 AND NOT-TMEM47 | 0.951807229 | 0.963414634 | 0.94047619 |
| PTPRZ1 AND PEMT | 0.99270073 | 1 | 0.985507246 | MARCH11 AND NOT-CD99L2 | 0.946745562 | 0.941176471 | 0.952380952 |
| PTPRZ1 AND ST3GAL6 | 0.985507246 | 0.98550725 | 0.985507246 | MARCH11 AND NOT-SLC25A18 | 0.946745562 | 0.941176471 | 0.952380952 |
| PTPRZ1 AND CDIPT | 0.977777778 | 1 | 0.956521739 | MARCH11 AND NOT-ESYT3 | 0.946745562 | 0.941176471 | 0.952380952 |
| GPM6B AND PGRMC2 | 0.970149254 | 1 | 0.942028986 | MARCH11 AND NOT-ATP13A4 | 0.946745562 | 0.941176471 | 0.952380952 |
| PTPRZ1 AND NOT-PGRMC2 | 0.985507246 | 0.98550725 | 0.985507246 | MARCH11 AND NOT-ACSS1 | 0.96969697 | 0.987654321 | 0.952380952 |
| PTPRZ1 AND TMEM147 | 0.99270073 | 1 | 0.985507246 | MARCH11 AND NOT-AGPAT9 | 0.957055215 | 0.987341772 | 0.928571429 |
| GPM6B AND LYPLA1 | 0.970149254 | 1 | 0.942028986 | MARCH11 AND NOT-TMEM25 | 0.946745562 | 0.941176471 | 0.952380952 |
| PTPRZ1 AND TIMM17A | 0.99270073 | 1 | 0.985507246 | MARCH11 AND NOT-NDST2 | 0.946745562 | 0.941176471 | 0.952380952 |
| PTPRZ1 AND NOT-N4BP2L2 | 0.985507246 | 0.98550725 | 0.985507246 | MARCH11 AND NOT-CDC14B | 0.946745562 | 0.941176471 | 0.952380952 |
| PTPRZ1 AND LRRN2 | 0.985507246 | 0.98550725 | 0.985507246 | MARCH11 AND NOT-SLC4A4 | 0.958083832 | 0.963855422 | 0.952380952 |
| PTPRZ1 AND GPNMB | 0.985507246 | 0.98550725 | 0.985507246 | MARCH11 AND NOT-B3GALT2 | 0.958083832 | 0.963855422 | 0.952380952 |
| PTPRZ1 AND MERTK | 0.985507246 | 0.98550725 | 0.985507246 | MARCH11 AND NOT-TNFSF9 | 0.957575758 | 0.975308642 | 0.94047619 |
| PTPRZ1 AND SLC30A9 | 0.985507246 | 0.98550725 | 0.985507246 | MARCH11 AND NOT-ADAM23 | 0.958083832 | 0.963855422 | 0.952380952 |
| PTPRZ1 AND CLGN | 0.985507246 | 0.98550725 | 0.985507246 | MARCH11 AND NOT-CCKBR | 0.946745562 | 0.941176471 | 0.952380952 |
| PTPRZ1 AND VTI1B | 0.970149254 | 1 | 0.942028986 | MARCH11 AND NOT-CACNA1I | 0.946745562 | 0.941176471 | 0.952380952 |
| PTPRZ1 AND CRTAP | 0.99270073 | 1 | 0.985507246 | MARCH11 AND NOT-LMLN | 0.958083832 | 0.963855422 | 0.952380952 |
| PTPRZ1 AND SEMA4B | 0.985507246 | 0.98550725 | 0.985507246 | MARCH11 AND NOT-TMEM257 | 0.946745562 | 0.941176471 | 0.952380952 |
| PTPRZ1 AND DEAF1 | 0.985507246 | 0.98550725 | 0.985507246 | MARCH11 AND NOT-SLC16A7 | 0.951807229 | 0.963414634 | 0.94047619 |
| GPM6B AND TM9SF1 | 0.970149254 | 1 | 0.942028986 | MARCH11 AND NOT-BPIFB1 | 0.957055215 | 0.987341772 | 0.928571429 |
| PTPRZ1 AND TM9SF1 | 0.970149254 | 1 | 0.942028986 | MARCH11 AND NOT-OPALIN | 0.946745562 | 0.941176471 | 0.952380952 |
| GPM6B AND PRDX4 | 0.985294118 | 1 | 0.971014493 | MARCH11 AND NOT-NRXN3 | 0.946745562 | 0.941176471 | 0.952380952 |
| PTPRZ1 AND PRDX4 | 0.985294118 | 1 | 0.971014493 | NOT-MARCH11 AND ACVR2B | 0.931818182 | 0.891304348 | 0.976190476 |
| PTPRZ1 AND ARL6IP5 | 0.970149254 | 1 | 0.942028986 | MARCH11 AND NOT-SFXN5 | 0.946745562 | 0.941176471 | 0.952380952 |
| PTPRZ1 AND NOT-HTATIP2 | 0.985507246 | 0.98550725 | 0.985507246 | MARCH11 AND NOT-FAM189A2 | 0.952380952 | 0.952380952 | 0.952380952 |
| PTPRZ1 AND AGPAT1 | 0.99270073 | 1 | 0.985507246 | MARCH11 AND NOT-OPN4 | 0.946745562 | 0.941176471 | 0.952380952 |
| PTPRZ1 AND SLC35A1 | 0.977777778 | 1 | 0.956521739 | MARCH11 AND NOT-ABCG2 | 0.946745562 | 0.941176471 | 0.952380952 |
| PTPRZ1 AND SLC19A2 | 0.99270073 | 1 | 0.985507246 | MARCH11 AND NOT-SV2B | 0.946745562 | 0.941176471 | 0.952380952 |
| PTPRZ1 AND RABAC1 | 0.985507246 | 0.98550725 | 0.985507246 | MARCH11 AND NOT-EXOG | 0.952380952 | 0.952380952 | 0.952380952 |
| PTPRZ1 AND SLC34A2 | 0.985507246 | 0.98550725 | 0.985507246 | MARCH11 AND NOT-SLC12A6 | 0.957055215 | 0.987341772 | 0.928571429 |
| PTPRZ1 AND IFITM2 | 0.977777778 | 1 | 0.956521739 | ASTN1 AND NOT-SLC15A2 | 0.952380952 | 0.952380952 | 0.952380952 |
| PTPRZ1 AND NOT-SLCO1B1 | 0.985294118 | 1 | 0.971014493 | HMP19 AND NOT-ATP1A2 | 0.936708861 | 1 | 0.880952381 |
| PTPRZ1 AND NOT-ST6GALNAC2 | 0.985507246 | 0.98550725 | 0.985507246 | ST8SIA2 AND NOT-ATP1A2 | 0.956521739 | 1 | 0.916666667 |
| PTPRZ1 AND TGOLN2 | 0.985507246 | 0.98550725 | 0.985507246 | ST8SIA2 AND NOT-ATP1B2 | 0.95 | 1 | 0.904761905 |
| PTPRZ1 AND PDPN | 0.985507246 | 0.98550725 | 0.985507246 | NOT-ST8SIA2 AND NPY | 0.937142857 | 0.901098901 | 0.976190476 |
| LRRC37A3 AND NOT-SPINT2 | 0.970149254 | 1 | 0.942028986 | ST8SIA2 AND NOT-NTRK2 | 0.956521739 | 1 | 0.916666667 |
| PTPRZ1 AND NOT-SPINT2 | 0.985507246 | 0.98550725 | 0.985507246 | ST8SIA2 AND NOT-ATP2B2 | 0.95 | 1 | 0.904761905 |
| PTPRZ1 AND NOT-CXCR6 | 0.977777778 | 1 | 0.956521739 | ST8SIA2 AND NOT-OMG | 0.95 | 1 | 0.904761905 |
| PTPRZ1 AND CD226 | 0.985507246 | 0.98550725 | 0.985507246 | ST8SIA2 AND NOT-OPRK1 | 0.936708861 | 1 | 0.880952381 |
| PTPRZ1 AND CGRRF1 | 0.985507246 | 0.98550725 | 0.985507246 | ST8SIA2 AND NOT-OR2C1 | 0.95 | 1 | 0.904761905 |
| PTPRZ1 AND TNFSF13B | 0.985507246 | 0.98550725 | 0.985507246 | ST8SIA2 AND NOT-CD207 | 0.943396226 | 1 | 0.892857143 |
| PTPRZ1 AND NOT-EBP | 0.985507246 | 0.98550725 | 0.985507246 | ST8SIA3 AND TMEM258 | 0.957575758 | 0.975308642 | 0.94047619 |
| PTPRZ1 AND DLL3 | 0.985507246 | 0.98550725 | 0.985507246 | ST8SIA3 AND NOT-PRRT1 | 0.943396226 | 1 | 0.892857143 |
| PTPRZ1 AND NOT-FUT9 | 0.985507246 | 0.98550725 | 0.985507246 | ST8SIA3 AND NOT-SLC4A4 | 0.936708861 | 1 | 0.880952381 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-RRH | 0.985507246 | 0.98550725 | 0.985507246 | ST8SIA3 AND NOT-OPALIN | 0.958083832 | 0.963855422 | 0.952380952 |
| PTPRZ1 AND CERS1 | 0.985507246 | 0.98550725 | 0.985507246 | ST8SIA2 AND NOT-SLC45A2 | 0.943396226 | 1 | 0.892857143 |
| CERS1 AND PTTG1IP | 0.970149254 | 1 | 0.942028986 | ST8SIA2 AND NOT-CRIM1 | 0.95 | 1 | 0.904761905 |
| PTPRZ1 AND NOT-NRG3 | 0.985507246 | 0.98550725 | 0.985507246 | ST8SIA2 AND ATP5F1 | 0.95 | 1 | 0.904761905 |
| PTPRZ1 AND YME1L1 | 0.970149254 | 1 | 0.942028986 | HMP19 AND NOT-TMEM144 | 0.943396226 | 1 | 0.892857143 |
| PTPRZ1 AND PHTF1 | 0.985507246 | 0.98550725 | 0.985507246 | HMP19 AND NOT-HHATL | 0.962962963 | 1 | 0.928571429 |
| PTPRZ1 AND CHL1 | 0.985507246 | 0.98550725 | 0.985507246 | HMP19 AND NOT-FA2H | 0.951219512 | 0.975 | 0.928571429 |
| PTPRZ1 AND NOT-NUP50 | 0.985507246 | 0.98550725 | 0.985507246 | HMP19 AND NOT-PAQR6 | 0.936708861 | 1 | 0.880952381 |
| PTPRZ1 AND NOT-HBS1L | 0.985507246 | 0.98550725 | 0.985507246 | HMP19 AND NOT-OPALIN | 0.962962963 | 1 | 0.928571429 |
| PTPRZ1 AND NOT-SLC17A3 | 0.985507246 | 0.98550725 | 0.985507246 | ST8SIA2 AND SLC25A3 | 0.956521739 | 1 | 0.916666667 |
| PTPRZ1 AND VAMP5 | 0.985507246 | 0.98550725 | 0.985507246 | ST8SIA2 AND NOT-PI3 | 0.95 | 1 | 0.904761905 |
| PTPRZ1 AND NOT-OR5I1 | 0.985507246 | 0.98550725 | 0.985507246 | ST8SIA2 AND NOT-S1PR5 | 0.95 | 1 | 0.904761905 |
| PTPRZ1 AND NOT-CYSLTR1 | 0.985507246 | 0.98550725 | 0.985507246 | ST8SIA2 AND SLC38A2 | 0.943396226 | 1 | 0.892857143 |
| PTPRZ1 AND NOT-CCR9 | 0.985507246 | 0.98550725 | 0.985507246 | ST8SIA2 AND NOT-SLC6A20 | 0.95 | 1 | 0.904761905 |
| PTPRZ1 AND NOT-GJB6 | 0.985294118 | 1 | 0.971014493 | ST8SIA2 AND NOT-GRAMD1C | 0.936708861 | 1 | 0.880952381 |
| PTPRZ1 AND NOT-CFTR | 0.985507246 | 0.98550725 | 0.985507246 | ST8SIA2 AND NOT-DCHS2 | 0.956521739 | 1 | 0.916666667 |
| PTPRZ1 AND NOT-FAXDC2 | 0.985507246 | 0.98550725 | 0.985507246 | ST8SIA2 AND NOT-NXPE4 | 0.943396226 | 1 | 0.892857143 |
| PTPRZ1 AND NOT-SLC26A1 | 0.985507246 | 0.98550725 | 0.985507246 | ST8SIA2 AND NOT-GDPD2 | 0.943396226 | 1 | 0.892857143 |
| PTPRZ1 AND ADAM28 | 0.985507246 | 0.98550725 | 0.985507246 | ST8SIA2 AND NOT-MS4A12 | 0.956521739 | 1 | 0.916666667 |
| PTPRZ1 AND TSPAN9 | 0.985294118 | 1 | 0.971014493 | ST8SIA2 AND NOT-RHBDL2 | 0.95 | 1 | 0.904761905 |
| PTPRZ1 AND NOT-USP19 | 0.985507246 | 0.98550725 | 0.985507246 | ST8SIA2 AND NOT-TMEM144 | 0.956521739 | 1 | 0.916666667 |
| PTPRZ1 AND HCST | 0.985507246 | 0.98550725 | 0.985507246 | ST8SIA2 AND NOT-STYK1 | 0.943396226 | 1 | 0.892857143 |
| PTPRZ1 AND NOT-CD300C | 0.985507246 | 0.98550725 | 0.985507246 | ST8SIA2 AND NOT-AVPR2 | 0.95 | 1 | 0.904761905 |
| PTPRZ1 AND NOT-EDDM3A | 0.985507246 | 0.98550725 | 0.985507246 | SCN3B AND NOT-HHATL | 0.941860465 | 0.920454545 | 0.964285714 |
| PTPRZ1 AND NOT-NPFFR2 | 0.985294118 | 1 | 0.971014493 | SCN3B AND NOT-SLC15A2 | 0.958579882 | 0.952941176 | 0.964285714 |
| SYT11 AND NOT-GPR83 | 0.985294118 | 1 | 0.971014493 | SCN3B AND NOT-FA2H | 0.936416185 | 0.91011236 | 0.964285714 |
| PTPRZ1 AND NOT-MMP24 | 0.985507246 | 0.98550725 | 0.985507246 | SCN3B AND DCHS1 | 0.952941176 | 0.941860465 | 0.964285714 |
| PTPRZ1 AND LYVE1 | 0.985507246 | 0.98550725 | 0.985507246 | SCN3B AND NOT-SLC4A4 | 0.943396226 | 1 | 0.892857143 |
| PTPRZ1 AND NOT-OCLM | 0.99270073 | 1 | 0.985507246 | SCN3B AND NOT-OPALIN | 0.952941176 | 0.941860465 | 0.964285714 |
| PTPRZ1 AND JTB | 0.970149254 | 1 | 0.942028986 | ST8SIA2 AND NOT-SLC22A11 | 0.95 | 1 | 0.904761905 |
| PTPRZ1 AND CEACAM4 | 0.985507246 | 0.98550725 | 0.985507246 | ST8SIA2 AND NOT-PRRG1 | 0.95 | 1 | 0.904761905 |
| PTPRZ1 AND MAN1A2 | 0.977777778 | 1 | 0.956521739 | NOT-ST8SIA2 AND DIABLO | 0.947368421 | 0.931034483 | 0.964285714 |
| PTPRZ1 AND PNPLA6 | 0.985507246 | 0.98550725 | 0.985507246 | DIABLO AND NOT-TMEM141 | 0.936708861 | 1 | 0.880952381 |
| PTPRZ1 AND NOT-BTNL3 | 0.977777778 | 1 | 0.956521739 | ST8SIA2 AND NOT-AGPAT3 | 0.956521739 | 1 | 0.916666667 |
| PTPRZ1 AND GPR75 | 0.985507246 | 0.98550725 | 0.985507246 | ST8SIA2 AND NOT-C2orf83 | 0.936708861 | 1 | 0.880952381 |
| PTPRZ1 AND NOT-AFG3L2 | 0.985507246 | 0.98550725 | 0.985507246 | ST8SIA2 AND NOT-SLC17A7 | 0.936708861 | 1 | 0.880952381 |
| PTPRZ1 AND KDELR1 | 0.985294118 | 1 | 0.971014493 | ST8SIA2 AND NOT-GJC2 | 0.956521739 | 1 | 0.916666667 |
| PTPRZ1 AND STARD3 | 0.985507246 | 0.98550725 | 0.985507246 | RTN1 AND NOT-NIPAL3 | 0.943396226 | 1 | 0.892857143 |
| PTPRZ1 AND NOT-SERINC3 | 0.985507246 | 0.98550725 | 0.985507246 | ST8SIA2 AND NOT-TTYH1 | 0.95 | 1 | 0.904761905 |
| PTPRZ1 AND OS9 | 0.99270073 | 1 | 0.985507246 | ST8SIA2 AND NOT-KIAA1161 | 0.95 | 1 | 0.904761905 |
| PTPRZ1 AND TMED2 | 0.985507246 | 0.98550725 | 0.985507246 | RTN1 AND NOT-HHATL | 0.957575758 | 0.975308642 | 0.94047619 |
| PTPRZ1 AND LMAN2 | 0.970149254 | 1 | 0.942028986 | ST8SIA2 AND NOT-SORCS2 | 0.95 | 1 | 0.904761905 |
| PTPRZ1 AND ERP29 | 0.977777778 | 1 | 0.956521739 | NOT-ST8SIA2 AND KIAA1549 | 0.947368421 | 0.931034483 | 0.964285714 |
| PTPRZ1 AND UQCR11 | 0.985294118 | 1 | 0.971014493 | ADGRB3 AND NOT-SLC4A4 | 0.936708861 | 1 | 0.880952381 |
| PTPRZ1 AND SLC38A3 | 0.985507246 | 0.98550725 | 0.985507246 | ST8SIA2 AND NOT-PTPRD | 0.95 | 1 | 0.904761905 |
| PTPRZ1 AND ILVBL | 0.985507246 | 0.98550725 | 0.985507246 | ST8SIA2 AND NOT-RAD51B | 0.943396226 | 1 | 0.892857143 |
| PTPRZ1 AND NOT-SLC27A5 | 0.985507246 | 0.98550725 | 0.985507246 | ST8SIA2 AND NOT-CACNG8 | 0.95 | 1 | 0.904761905 |
| PTPRZ1 AND NOT-NAT2 | 0.985507246 | 0.98550725 | 0.985507246 | ST8SIA2 AND NOT-CACNG6 | 0.943396226 | 1 | 0.892857143 |
| PTPRZ1 AND SLC27A3 | 0.985507246 | 0.98550725 | 0.985507246 | ST8SIA2 AND NOT-CTXN3 | 0.956521739 | 1 | 0.916666667 |
| PTPRZ1 AND LILRB4 | 0.985507246 | 0.98550725 | 0.985507246 | RTN1 AND NOT-PAQR6 | 0.956521739 | 1 | 0.916666667 |
| PTPRZ1 AND GLIPR1 | 0.985507246 | 0.98550725 | 0.985507246 | RTN1 AND DCHS1 | 0.957575758 | 0.975308642 | 0.94047619 |
| PTPRZ1 AND KDELR2 | 0.977777778 | 1 | 0.956521739 | RTN1 AND NOT-SLC4A4 | 0.936708861 | 1 | 0.880952381 |
| PTPRZ1 AND ATF7 | 0.985507246 | 0.98550725 | 0.985507246 | RTN1 AND NOT-OPALIN | 0.951807229 | 0.963414634 | 0.94047619 |
| PTPRZ1 AND TMED1 | 0.970149254 | 1 | 0.942028986 | ST8SIA2 AND NOT-SCN1A | 0.956521739 | 1 | 0.916666667 |
| PTPRZ1 AND TDRKH | 0.985507246 | 0.98550725 | 0.985507246 | ST8SIA2 AND NOT-SCN1B | 0.936708861 | 1 | 0.880952381 |
| PTPRZ1 AND NOT-LECT1 | 0.985507246 | 0.98550725 | 0.985507246 | ST8SIA2 AND NOT-SCN4B | 0.943396226 | 1 | 0.892857143 |
| PTPRZ1 AND CYB561D2 | 0.985507246 | 0.98550725 | 0.985507246 | ST8SIA2 AND NOT-MS4A5 | 0.956521739 | 1 | 0.916666667 |
| PTPRZ1 AND NOT-RER1 | 0.985507246 | 0.98550725 | 0.985507246 | ST8SIA2 AND NOT-NDST4 | 0.956521739 | 1 | 0.916666667 |
| PTPRZ1 AND NOT-ADAM30 | 0.985507246 | 0.98550725 | 0.985507246 | ST8SIA2 AND NOT-CTAGE1 | 0.956521739 | 1 | 0.916666667 |
| PTPRZ1 AND NOT-ADAMTS13 | 0.985507246 | 0.98550725 | 0.985507246 | ST8SIA2 AND NOT-LMF1 | 0.956521739 | 1 | 0.916666667 |
| PTPRZ1 AND CACFD1 | 0.985507246 | 0.98550725 | 0.985507246 | ST8SIA2 AND NOT-P2RY12 | 0.95 | 1 | 0.904761905 |
| PTPRZ1 AND BTN2A1 | 0.985507246 | 0.98550725 | 0.985507246 | ST8SIA2 AND NOT-ELOVL1 | 0.943396226 | 1 | 0.892857143 |
| PTPRZ1 AND NOT-IL1RAPL1 | 0.985507246 | 0.98550725 | 0.985507246 | ST8SIA2 AND NOT-SLC13A3 | 0.95 | 1 | 0.904761905 |
| PTPRZ1 AND NOT-PLA2G16 | 0.985507246 | 0.98550725 | 0.985507246 | ST8SIA2 AND NOT-CDCP1 | 0.95 | 1 | 0.904761905 |
| PTPRZ1 AND NOT-HHLA2 | 0.985507246 | 0.98550725 | 0.985507246 | ST8SIA2 AND NOT-LRRC19 | 0.956521739 | 1 | 0.916666667 |
| PTPRZ1 AND NOT-BVES | 0.985507246 | 0.98550725 | 0.985507246 | ST8SIA2 AND NOT-SLC1A3 | 0.956521739 | 1 | 0.916666667 |
| PTPRZ1 AND FICD | 0.985507246 | 0.98550725 | 0.985507246 | ST8SIA2 AND NOT-SLC5A1 | 0.95 | 1 | 0.904761905 |
| PTPRZ1 AND CHI3L2 | 0.985507246 | 0.98550725 | 0.985507246 | ST8SIA2 AND NOT-SLC6A1 | 0.956521739 | 1 | 0.916666667 |
| SYT11 AND NOT-SLC2A6 | 0.977777778 | 1 | 0.956521739 | ST8SIA2 AND NOT-SLC6A4 | 0.95 | 1 | 0.904761905 |
| PTPRZ1 AND NOT-CHIT1 | 0.985507246 | 0.98550725 | 0.985507246 | ST8SIA2 AND NOT-SLC13A1 | 0.956521739 | 1 | 0.916666667 |
| PTPRZ1 AND NOT-ADCY5 | 0.970149254 | 1 | 0.942028986 | ST8SIA2 AND NOT-SSTR1 | 0.95 | 1 | 0.904761905 |
| PTPRZ1 AND NOT-KLK8 | 0.985294118 | 1 | 0.971014493 | ST8SIA2 AND NOT-TGFA | 0.956521739 | 1 | 0.916666667 |
| PTPRZ1 AND GALNT5 | 0.985507246 | 0.98550725 | 0.985507246 | ST8SIA2 AND NOT-TNF | 0.943396226 | 1 | 0.892857143 |
| PTPRZ1 AND PRAF2 | 0.99270073 | 1 | 0.985507246 | ST8SIA2 AND NOT-TRHR | 0.956521739 | 1 | 0.916666667 |
| PTPRZ1 AND SEC63 | 0.99270073 | 1 | 0.985507246 | ST8SIA2 AND NOT-TRPC4 | 0.95 | 1 | 0.904761905 |
| GPM6B AND RNF139 | 0.977777778 | 1 | 0.956521739 | ST8SIA2 AND NOT-UPK1B | 0.943396226 | 1 | 0.892857143 |

FIG. 1 (CONT.)

| Antigen Pair Logic | F1 | Precision | Recall |
|---|---|---|---|
| PTPRZ1 AND RNF139 | 0.977777778 | 1 | 0.956521739 |
| PTPRZ1 AND GPR176 | 0.985507246 | 0.98550725 | 0.985507246 |
| PTPRZ1 AND NOT-GPR45 | 0.970149254 | 1 | 0.942028986 |
| PTPRZ1 AND NOT-PTGDR2 | 0.985507246 | 0.98550725 | 0.985507246 |
| PTPRZ1 AND MAN1B1 | 0.985507246 | 0.98550725 | 0.985507246 |
| PTPRZ1 AND NOT-SLC6A14 | 0.985507246 | 0.98550725 | 0.985507246 |
| PTPRZ1 AND NRM | 0.970149254 | 1 | 0.942028986 |
| PTPRZ1 AND NOT-KLHL2 | 0.985507246 | 0.98550725 | 0.985507246 |
| PTPRZ1 AND GLMP | 0.985507246 | 0.98550725 | 0.985507246 |
| PTPRZ1 AND HOGA1 | 0.985507246 | 0.98550725 | 0.985507246 |
| PTPRZ1 AND MGAT4B | 0.985294118 | 1 | 0.971014493 |
| PTPRZ1 AND NOT-CYP4F8 | 0.985507246 | 0.98550725 | 0.985507246 |
| PTPRZ1 AND B4GALT7 | 0.985507246 | 0.98550725 | 0.985507246 |
| PTPRZ1 AND NOT-CHRM2 | 0.985507246 | 0.98550725 | 0.985507246 |
| PTPRZ1 AND ADCY6 | 0.985507246 | 0.98550725 | 0.985507246 |
| PTPRZ1 AND PTH2 | 0.985507246 | 0.98550725 | 0.985507246 |
| PTPRZ1 AND SLCO2B1 | 0.985507246 | 0.98550725 | 0.985507246 |
| PTPRZ1 AND CD300A | 0.985507246 | 0.98550725 | 0.985507246 |
| PTPRZ1 AND NOT-CHRM3 | 0.985507246 | 0.98550725 | 0.985507246 |
| PTPRZ1 AND CASC4 | 0.985507246 | 0.98550725 | 0.985507246 |
| PTPRZ1 AND MGAT4A | 0.99270073 | 1 | 0.985507246 |
| PTPRZ1 AND NOT-TMC6 | 0.985507246 | 0.98550725 | 0.985507246 |
| PTPRZ1 AND SLC46A1 | 0.985507246 | 0.98550725 | 0.985507246 |
| PTPRZ1 AND GLCCI1 | 0.985507246 | 0.98550725 | 0.985507246 |
| PTPRZ1 AND TMEM106A | 0.985507246 | 0.98550725 | 0.985507246 |
| PTPRZ1 AND NOT-SLC52A3 | 0.985507246 | 0.98550725 | 0.985507246 |
| PTPRZ1 AND NOT-CHRM4 | 0.985507246 | 0.98550725 | 0.985507246 |
| PTPRZ1 AND TEX261 | 0.970149254 | 1 | 0.942028986 |
| SCRG1 AND NOT-C1orf210 | 0.970149254 | 1 | 0.942028986 |
| PTPRZ1 AND SCRG1 | 0.985294118 | 1 | 0.971014493 |
| PTPRZ1 AND RNF13 | 0.985507246 | 0.98550725 | 0.985507246 |
| PTPRZ1 AND NOT-SMIM12 | 0.985507246 | 0.98550725 | 0.985507246 |
| PTPRZ1 AND NOT-CMTM1 | 0.985507246 | 0.98550725 | 0.985507246 |
| PTPRZ1 AND NOT-CHRNA2 | 0.985507246 | 0.98550725 | 0.985507246 |
| PTPRZ1 AND NOT-MFSD3 | 0.985507246 | 0.98550725 | 0.985507246 |
| PTPRZ1 AND NOT-CHRNA3 | 0.985507246 | 0.98550725 | 0.985507246 |
| PTPRZ1 AND NOT-PIK3IP1 | 0.985507246 | 0.98550725 | 0.985507246 |
| PTPRZ1 AND NOT-CHRNA4 | 0.985507246 | 0.98550725 | 0.985507246 |
| PTPRZ1 AND ADCY7 | 0.985507246 | 0.98550725 | 0.985507246 |
| PTPRZ1 AND NOT-SLC2A13 | 0.985507246 | 0.98550725 | 0.985507246 |
| PTPRZ1 AND NOT-CHRNB3 | 0.99270073 | 1 | 0.985507246 |
| PTPRZ1 AND NOT-CHRND | 0.985507246 | 0.98550725 | 0.985507246 |
| PTPRZ1 AND NOT-SLC22A9 | 0.977777778 | 1 | 0.956521739 |
| PTPRZ1 AND NOT-CHRNE | 0.985507246 | 0.98550725 | 0.985507246 |
| PTPRZ1 AND NOT-ERMAP | 0.985507246 | 0.98550725 | 0.985507246 |
| PTPRZ1 AND LRRC37B | 0.985507246 | 0.98550725 | 0.985507246 |
| PTPRZ1 AND XKR4 | 0.985507246 | 0.98550725 | 0.985507246 |
| PTPRZ1 AND SLC25A25 | 0.985294118 | 1 | 0.971014493 |
| PTPRZ1 AND ELFN2 | 0.985507246 | 0.98550725 | 0.985507246 |
| PTPRZ1 AND TMEM132B | 0.985507246 | 0.98550725 | 0.985507246 |
| PTPRZ1 AND GALNT13 | 0.985507246 | 0.98550725 | 0.985507246 |
| PTPRZ1 AND C1QTNF1 | 0.985507246 | 0.98550725 | 0.985507246 |
| PTPRZ1 AND C1QTNF6 | 0.985507246 | 0.98550725 | 0.985507246 |
| PTPRZ1 AND TMEM123 | 0.99270073 | 1 | 0.985507246 |
| GPM6B AND SMIM19 | 0.985294118 | 1 | 0.971014493 |
| PTPRZ1 AND SMIM19 | 0.985294118 | 1 | 0.971014493 |
| PTPRZ1 AND NOT-VASN | 0.985507246 | 0.98550725 | 0.985507246 |
| PTPRZ1 AND ADCY8 | 0.985507246 | 0.98550725 | 0.985507246 |
| ITGAV AND NOT-SLC26A9 | 0.970149254 | 1 | 0.942028986 |
| PTPRZ1 AND MARCH3 | 0.985507246 | 0.98550725 | 0.985507246 |
| PTPRZ1 AND OMA1 | 0.985507246 | 0.98550725 | 0.985507246 |
| PTPRZ1 AND NOT-SLC25A26 | 0.985507246 | 0.98550725 | 0.985507246 |
| PTPRZ1 AND NOT-FCRL1 | 0.985294118 | 1 | 0.971014493 |
| PTPRZ1 AND EVI5L | 0.985507246 | 0.98550725 | 0.985507246 |
| PTPRZ1 AND NOT-ADCY9 | 0.985507246 | 0.98550725 | 0.985507246 |
| PTPRZ1 AND NOT-LYSMD3 | 0.985507246 | 0.98550725 | 0.985507246 |
| PTPRZ1 AND NOT-SLC22A12 | 0.985507246 | 0.98550725 | 0.985507246 |
| PTPRZ1 AND LRRC3B | 0.985507246 | 0.98550725 | 0.985507246 |
| PTPRZ1 AND FAM210B | 0.985507246 | 0.98550725 | 0.985507246 |
| PTPRZ1 AND CMTM5 | 0.985507246 | 0.98550725 | 0.985507246 |
| PTPRZ1 AND ABHD15 | 0.985507246 | 0.98550725 | 0.985507246 |
| PTPRZ1 AND NOT-TLCD1 | 0.985507246 | 0.98550725 | 0.985507246 |
| PTPRZ1 AND NOT-MOGAT1 | 0.985507246 | 0.98550725 | 0.985507246 |
| PTPRZ1 AND NOT-PANX3 | 0.985507246 | 0.98550725 | 0.985507246 |
| PTPRZ1 AND NOT-SLC26A8 | 0.985507246 | 0.98550725 | 0.985507246 |
| PTPRZ1 AND LYPD1 | 0.985507246 | 0.98550725 | 0.985507246 |

| Antigen Pair Logic | F1 | Precision | Recall |
|---|---|---|---|
| ST8SIA2 AND NOT-CLRN1 | 0.943396226 | 1 | 0.892857143 |
| ST8SIA2 AND NOT-BEST1 | 0.95 | 1 | 0.904761905 |
| ST8SIA2 AND NOT-MYRF | 0.936708861 | 1 | 0.880952381 |
| ST8SIA2 AND TMEM258 | 0.943396226 | 1 | 0.892857143 |
| ST8SIA2 AND NOT-CA4 | 0.936708861 | 1 | 0.880952381 |
| ST8SIA2 AND NOT-CACNA1A | 0.956521739 | 1 | 0.916666667 |
| ST8SIA2 AND NOT-FA2H | 0.956521739 | 1 | 0.916666667 |
| ST8SIA2 AND NOT-OR51B4 | 0.95 | 1 | 0.904761905 |
| ST8SIA2 AND NOT-NOX5 | 0.95 | 1 | 0.904761905 |
| ST8SIA2 AND NOT-TMC5 | 0.956521739 | 1 | 0.916666667 |
| ST8SIA2 AND NOT-BTNL8 | 0.956521739 | 1 | 0.916666667 |
| ST8SIA2 AND NOT-PAQR6 | 0.956521739 | 1 | 0.916666667 |
| ST8SIA2 AND NOT-LRRC8E | 0.956521739 | 1 | 0.916666667 |
| ST8SIA2 AND NOT-ADAM33 | 0.956521739 | 1 | 0.916666667 |
| ST8SIA2 AND NOT-SPX | 0.95 | 1 | 0.904761905 |
| ST8SIA2 AND NOT-ACSBG2 | 0.956521739 | 1 | 0.916666667 |
| ST8SIA2 AND NOT-OR5V1 | 0.956521739 | 1 | 0.916666667 |
| ST8SIA2 AND NOT-OR12D3 | 0.956521739 | 1 | 0.916666667 |
| ST8SIA2 AND NOT-SPACA1 | 0.95 | 1 | 0.904761905 |
| ST8SIA2 AND NOT-FZD9 | 0.943396226 | 1 | 0.892857143 |
| ST8SIA2 AND NOT-SLC25A18 | 0.95 | 1 | 0.904761905 |
| ST8SIA2 AND NOT-ESYT3 | 0.956521739 | 1 | 0.916666667 |
| ST8SIA2 AND NOT-OR1G1 | 0.956521739 | 1 | 0.916666667 |
| ST8SIA2 AND NOT-QRFPR | 0.943396226 | 1 | 0.892857143 |
| ST8SIA2 AND NOT-AGPAT9 | 0.943396226 | 1 | 0.892857143 |
| ST8SIA2 AND NOT-CDC14B | 0.936708861 | 1 | 0.880952381 |
| ST8SIA2 AND NOT-SLC4A4 | 0.956521739 | 1 | 0.916666667 |
| ST8SIA2 AND NOT-ADAM7 | 0.956521739 | 1 | 0.916666667 |
| ST8SIA2 AND NOT-KCNH7 | 0.956521739 | 1 | 0.916666667 |
| ST8SIA2 AND NOT-NUP210L | 0.956521739 | 1 | 0.916666667 |
| ST8SIA2 AND NOT-SYT12 | 0.943396226 | 1 | 0.892857143 |
| ST8SIA2 AND NOT-NXPE3 | 0.936708861 | 1 | 0.880952381 |
| ST8SIA2 AND NOT-VAPB | 0.95 | 1 | 0.904761905 |
| ST8SIA2 AND NOT-SLC38A5 | 0.936708861 | 1 | 0.880952381 |
| ST8SIA2 AND NOT-OPALIN | 0.956521739 | 1 | 0.916666667 |
| ST8SIA2 AND NOT-TTYH2 | 0.936708861 | 1 | 0.880952381 |
| ST8SIA2 AND NOT-SFXN5 | 0.956521739 | 1 | 0.916666667 |
| ST8SIA2 AND NOT-ABCG2 | 0.943396226 | 1 | 0.892857143 |
| ST8SIA2 AND NOT-SIGLEC6 | 0.95 | 1 | 0.904761905 |
| ST8SIA2 AND NOT-CLCA2 | 0.956521739 | 1 | 0.916666667 |
| ST8SIA2 AND NOT-TMEM63A | 0.956521739 | 1 | 0.916666667 |
| SV2A AND DCHS1 | 0.936416185 | 0.91011236 | 0.964285714 |
| Lymphoma, Mantle-Cell (Mantle-Cell Lymphoma) | | | |
| CLECL1 AND NOT-EPHA3 | 0.904761905 | 0.826086957 | 1 |
| CELSR1 AND NOT-ERBB2 | 0.923076923 | 0.9 | 0.947368421 |
| QSOX2 AND NOT-ERBB2 | 0.902439024 | 0.840909091 | 0.973684211 |
| CLECL1 AND NOT-CD160 | 0.926829268 | 0.863636364 | 1 |
| CELSR1 AND NOT-SDC1 | 0.923076923 | 0.9 | 0.947368421 |
| TNFRSF13C AND NOT-SDC1 | 0.904761905 | 0.826086957 | 1 |
| CELSR1 AND NOT-ERBB3 | 0.923076923 | 0.9 | 0.947368421 |
| TNFRSF13C AND NOT-FAP | 0.915662651 | 0.844444444 | 1 |
| SNN AND NOT-NCAM1 | 0.944444444 | 1 | 0.894736842 |
| TNFRSF10A AND NOT-NCAM1 | 0.902439024 | 0.840909091 | 0.973684211 |
| QSOX2 AND NOT-NCAM1 | 0.925 | 0.880952381 | 0.973684211 |
| TNFRSF13C AND NOT-NCAM1 | 0.938271605 | 0.88372093 | 1 |
| RHOT2 AND NOT-NCAM1 | 0.9 | 0.857142857 | 0.947368421 |
| ORAI2 AND NOT-NCAM1 | 0.9 | 0.857142857 | 0.947368421 |
| CLECL1 AND NOT-NCAM1 | 0.961038961 | 0.948717949 | 0.973684211 |
| QSOX2 AND NOT-MSLN | 0.925 | 0.880952381 | 0.973684211 |
| QSOX2 AND NOT-ALK | 0.948717949 | 0.925 | 0.973684211 |
| MS4A1 AND NOT-SORL1 | 0.913580247 | 0.860465116 | 0.973684211 |
| MS4A1 AND CELSR1 | 0.936708861 | 0.902439024 | 0.973684211 |
| MS4A1 AND QSOX2 | 0.902439024 | 0.840909091 | 0.973684211 |
| MS4A1 AND NOT-KIR3DL2 | 0.904761905 | 0.826086957 | 1 |
| MS4A1 AND NOT-SCN3A | 0.9 | 0.857142857 | 0.947368421 |
| QSOX2 AND NOT-PSCA | 0.913580247 | 0.860465116 | 0.973684211 |
| TNFRSF13C AND NOT-PSCA | 0.926829268 | 0.863636364 | 1 |
| CLECL1 AND NOT-PSCA | 0.904761905 | 0.826086957 | 1 |
| CELSR1 AND NOT-MUC1 | 0.9 | 0.857142857 | 0.947368421 |
| TNFRSF13C AND NOT-B4GALNT1 | 0.902439024 | 0.840909091 | 0.973684211 |
| NOT-FAM210A AND TNFRSF10A | 0.925 | 0.880952381 | 0.973684211 |
| TNFRSF10A AND NOT-SPN | 0.915662651 | 0.844444444 | 1 |
| NOT-C4orf32 AND TNFRSF10A | 0.935064935 | 0.923076923 | 0.947368421 |
| TNFRSF10A AND NOT-FURIN | 0.911392405 | 0.87804878 | 0.947368421 |
| TNFRSF10A AND NOT-STAB1 | 0.904761905 | 0.826086957 | 1 |
| TNFRSF10A AND NOT-SLC46A2 | 0.909090909 | 0.897435897 | 0.921052632 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND TM4SF18 | 0.985507246 | 0.98550725 | 0.985507246 | TNFRSF10A AND NOT-SLC19A1 | 0.925 | 0.880952381 | 0.973684211 |
| PTPRZ1 AND NOT-GRIN3B | 0.985507246 | 0.98550725 | 0.985507246 | QSOX2 AND NOT-GPC3 | 0.902439024 | 0.840909091 | 0.973684211 |
| PTPRZ1 AND NOT-MRGPRF | 0.985507246 | 0.98550725 | 0.985507246 | TNFRSF13C AND NOT-GPC3 | 0.915662651 | 0.844444444 | 1 |
| PTPRZ1 AND SLC18B1 | 0.985507246 | 0.98550725 | 0.985507246 | QSOX2 AND NOT-MAGEA1 | 0.925 | 0.880952381 | 0.973684211 |
| PTPRZ1 AND NOT-CATSPER1 | 0.985507246 | 0.98550725 | 0.985507246 | QSOX2 AND NOT-MUC17 | 0.906666667 | 0.918918919 | 0.894736842 |
| PTPRZ1 AND NOT-MRGPRX2 | 0.985507246 | 0.98550725 | 0.985507246 | TNFRSF13C AND NOT-MUC17 | 0.904761905 | 0.826086957 | 1 |
| PTPRZ1 AND NOT-MRGPRX3 | 0.99270073 | 1 | 0.985507246 | QSOX2 AND NOT-ITGB3 | 0.925 | 0.880952381 | 0.973684211 |
| PTPRZ1 AND NOT-MRGPRX4 | 0.985507246 | 0.98550725 | 0.985507246 | TNFRSF13C AND NOT-ITGB3 | 0.926829268 | 0.863636364 | 1 |
| PTPRZ1 AND GALNT15 | 0.985507246 | 0.98550725 | 0.985507246 | CLECL1 AND NOT-ITGB3 | 0.95 | 0.904761905 | 1 |
| PTPRZ1 AND NOT-TMC1 | 0.985507246 | 0.98550725 | 0.985507246 | TNFRSF13C AND NOT-GPA33 | 0.915662651 | 0.844444444 | 1 |
| PTPRZ1 AND NOT-TMC2 | 0.985507246 | 0.98550725 | 0.985507246 | QSOX2 AND NOT-TNFRSF8 | 0.947368421 | 0.947368421 | 0.947368421 |
| PTPRZ1 AND NOT-CLCN1 | 0.985507246 | 0.98550725 | 0.985507246 | TNFRSF13C AND NOT-TNFRSF8 | 0.938271605 | 0.88372093 | 1 |
| PTPRZ1 AND CLCN2 | 0.985507246 | 0.98550725 | 0.985507246 | CLECL1 AND NOT-TNFRSF8 | 0.948717949 | 0.925 | 0.973684211 |
| PTPRZ1 AND CLCN3 | 0.985507246 | 0.98550725 | 0.985507246 | CLECL1 AND NOT-CD33 | 0.926829268 | 0.863636364 | 1 |
| PTPRZ1 AND ANTXR2 | 0.985507246 | 0.98550725 | 0.985507246 | CELSR1 AND NOT-EPHA2 | 0.9 | 0.857142857 | 0.947368421 |
| PTPRZ1 AND NOT-GPR62 | 0.985507246 | 0.98550725 | 0.985507246 | TNFRSF13C AND NOT-CSPG4 | 0.904761905 | 0.826086957 | 1 |
| PTPRZ1 AND NOT-CLCN7 | 0.985507246 | 0.98550725 | 0.985507246 | CLECL1 AND NOT-CSPG4 | 0.915662651 | 0.844444444 | 1 |
| PTPRZ1 AND NOT-COMTD1 | 0.985507246 | 0.98550725 | 0.985507246 | CLECL1 AND NOT-NAALADL1 | 0.938271605 | 0.88372093 | 1 |
| PTPRZ1 AND SFXN2 | 0.985507246 | 0.98550725 | 0.985507246 | CLECL1 AND NOT-KCNE3 | 0.926829268 | 0.863636364 | 1 |
| PTPRZ1 AND NOT-PDZD8 | 0.985507246 | 0.98550725 | 0.985507246 | PTPN1 AND NOT-KCNE3 | 0.915662651 | 0.844444444 | 1 |
| PTPRZ1 AND NOT-CALHM3 | 0.985507246 | 0.98550725 | 0.985507246 | TNFRSF13C AND NOT-TMEM221 | 0.915662651 | 0.844444444 | 1 |
| PTPRZ1 AND NOT-OR5P2 | 0.985507246 | 0.98550725 | 0.985507246 | QSOX2 AND NOT-TMEM221 | 0.936708861 | 0.902439024 | 0.973684211 |
| PTPRZ1 AND NOT-OR5P3 | 0.985507246 | 0.98550725 | 0.985507246 | TNFRSF13C AND NOT-SMIM6 | 0.915662651 | 0.844444444 | 1 |
| PTPRZ1 AND NOT-GYLTL1B | 0.985507246 | 0.98550725 | 0.985507246 | TNFRSF13C AND NOT-NEMP2 | 0.95 | 0.904761905 | 1 |
| PTPRZ1 AND NOT-SLC36A4 | 0.985507246 | 0.98550725 | 0.985507246 | CLECL1 AND NOT-NEMP2 | 0.915662651 | 0.844444444 | 1 |
| PTPRZ1 AND CLN3 | 0.985507246 | 0.98550725 | 0.985507246 | TNFRSF13C AND NOT-ERVMER34-1 | 0.974358974 | 0.95 | 1 |
| PTPRZ1 AND NOT-TMEM45B | 0.985507246 | 0.98550725 | 0.985507246 | CLECL1 AND NOT-ERVMER34-1 | 0.962025316 | 0.926829268 | 1 |
| PTPRZ1 AND CYP2R1 | 0.985507246 | 0.98550725 | 0.985507246 | QSOX2 AND NOT-ERVMER34-1 | 0.948717949 | 0.925 | 0.973684211 |
| PTPRZ1 AND NOT-AMICA1 | 0.985507246 | 0.98550725 | 0.985507246 | TNFRSF13C AND NOT-CDH6 | 0.915662651 | 0.844444444 | 1 |
| PTPRZ1 AND NOT-CLPS | 0.985507246 | 0.98550725 | 0.985507246 | QSOX2 AND NOT-CDH7 | 0.935064935 | 0.923076923 | 0.947368421 |
| PTPRZ1 AND TMEM52B | 0.985507246 | 0.98550725 | 0.985507246 | TNFRSF13C AND NOT-MRLN | 0.915662651 | 0.844444444 | 1 |
| PTPRZ1 AND CLPTM1 | 0.985507246 | 0.98550725 | 0.985507246 | TNFRSF13C AND NOT-SMLR1 | 0.936708861 | 0.902439024 | 0.973684211 |
| PTPRZ1 AND NOT-LRIG3 | 0.985507246 | 0.98550725 | 0.985507246 | TNFRSF13C AND NOT-100507547? | 0.915662651 | 0.844444444 | 1 |
| PTPRZ1 AND NOT-TMEM132D | 0.985507246 | 0.98550725 | 0.985507246 | CLECL1 AND NOT-100507547? | 0.918918919 | 0.944444444 | 0.894736842 |
| PTPRZ1 AND SLC15A4 | 0.985507246 | 0.98550725 | 0.985507246 | TNFRSF13C AND NOT-ABCB6 | 0.987012987 | 0.974358974 | 1 |
| PTPRZ1 AND NOT-TEX29 | 0.985507246 | 0.98550725 | 0.985507246 | CLECL1 AND NOT-KCNK7 | 0.938271605 | 0.88372093 | 1 |
| PTPRZ1 AND NOT-RXFP2 | 0.99270073 | 1 | 0.985507246 | QSOX2 AND NOT-KCNK7 | 0.948717949 | 0.925 | 0.973684211 |
| PTPRZ1 AND NOT-IFI27L1 | 0.985507246 | 0.98550725 | 0.985507246 | TNFRSF13C AND NOT-CDH12 | 0.915662651 | 0.844444444 | 1 |
| PTPRZ1 AND PLD4 | 0.985507246 | 0.98550725 | 0.985507246 | TNFRSF13C AND NOT-CDH15 | 0.926829268 | 0.863636364 | 1 |
| PTPRZ1 AND NOT-ADSSL1 | 0.985507246 | 0.98550725 | 0.985507246 | QSOX2 AND NOT-CDH15 | 0.936708861 | 0.902439024 | 0.973684211 |
| PTPRZ1 AND NOT-GPHB5 | 0.985507246 | 0.98550725 | 0.985507246 | QSOX2 AND NOT-BCAP31 | 0.931506849 | 0.971428571 | 0.894736842 |
| PTPRZ1 AND NOT-SLC24A4 | 0.985507246 | 0.98550725 | 0.985507246 | CLECL1 AND NOT-PLXNC1 | 0.936708861 | 0.902439024 | 0.973684211 |
| PTPRZ1 AND NOT-DEGS2 | 0.985507246 | 0.98550725 | 0.985507246 | CLECL1 AND NOT-PDZK1IP1 | 0.915662651 | 0.844444444 | 1 |
| PTPRZ1 AND CCR1 | 0.985507246 | 0.98550725 | 0.985507246 | CLECL1 AND NOT-LPAR6 | 0.926829268 | 0.863636364 | 1 |
| PTPRZ1 AND NOT-CCR3 | 0.985507246 | 0.98550725 | 0.985507246 | TNFRSF13C AND NOT-CHST4 | 0.915662651 | 0.844444444 | 1 |
| PTPRZ1 AND NOT-CCR4 | 0.985507246 | 0.98550725 | 0.985507246 | TNFRSF13C AND NOT-DHRS9 | 0.926829268 | 0.863636364 | 1 |
| PTPRZ1 AND CCR5 | 0.985507246 | 0.98550725 | 0.985507246 | CLECL1 AND NOT-DHRS9 | 0.926829268 | 0.863636364 | 1 |
| PTPRZ1 AND NOT-C15orf27 | 0.985294118 | 1 | 0.971014493 | SLC37A1 AND NOT-DHRS9 | 0.915662651 | 0.844444444 | 1 |
| PTPRZ1 AND NOT-CCR6 | 0.99270073 | 1 | 0.985507246 | TNFRSF13C AND NOT-TENM1 | 0.915662651 | 0.844444444 | 1 |
| PTPRZ1 AND NOT-CCR8 | 0.985507246 | 0.98550725 | 0.985507246 | TNFRSF13C AND NOT-101805491? | 0.915662651 | 0.844444444 | 1 |
| PTPRZ1 AND NOT-ACKR2 | 0.985507246 | 0.98550725 | 0.985507246 | TNFRSF13C AND NOT-DHRS2 | 0.926829268 | 0.863636364 | 1 |
| PTPRZ1 AND CMTM3 | 0.977777778 | 1 | 0.956521739 | QSOX2 AND NOT-DHRS2 | 0.947368421 | 0.947368421 | 0.947368421 |
| PTPRZ1 AND CMKLR1 | 0.985507246 | 0.98550725 | 0.985507246 | CLECL1 AND NOT-MPZL2 | 0.926829268 | 0.863636364 | 1 |
| PTPRZ1 AND NOT-ZG16B | 0.985507246 | 0.98550725 | 0.985507246 | CLECL1 AND NOT-KLRG1 | 0.915662651 | 0.844444444 | 1 |
| PTPRZ1 AND NOT-PAQR4 | 0.985507246 | 0.98550725 | 0.985507246 | TNFRSF13C AND NOT-GPA33 | 0.915662651 | 0.844444444 | 1 |
| PTPRZ1 AND TMEM219 | 0.99270073 | 1 | 0.985507246 | CLECL1 AND NOT-IGSF6 | 0.915662651 | 0.844444444 | 1 |
| PTPRZ1 AND SLC38A10 | 0.985507246 | 0.98550725 | 0.985507246 | TNFRSF13C AND NOT-SIGMAR1 | 0.95 | 0.904761905 | 1 |
| PTPRZ1 AND CANT1 | 0.985507246 | 0.98550725 | 0.985507246 | CLECL1 AND NOT-SIGMAR1 | 0.926829268 | 0.863636364 | 1 |
| PTPRZ1 AND TMEM132E | 0.985507246 | 0.98550725 | 0.985507246 | QSOX2 AND NOT-SIGMAR1 | 0.936708861 | 0.902439024 | 0.973684211 |
| PTPRZ1 AND SEZ6 | 0.985507246 | 0.98550725 | 0.985507246 | SLC37A1 AND NOT-SIGMAR1 | 0.935064935 | 0.923076923 | 0.947368421 |
| PTPRZ1 AND CYB5D2 | 0.985294118 | 1 | 0.971014493 | CLECL1 AND NOT-LILRB2 | 0.915662651 | 0.844444444 | 1 |
| PTPRZ1 AND NOT-SPNS2 | 0.985507246 | 0.98550725 | 0.985507246 | TNFRSF13C AND NOT-NMUR1 | 0.915662651 | 0.844444444 | 1 |
| PTPRZ1 AND NOT-GJD3 | 0.985507246 | 0.98550725 | 0.985507246 | QSOX2 AND NOT-B3GALT5 | 0.935064935 | 0.923076923 | 0.947368421 |
| GPM6B AND FAM210A | 0.970149254 | 1 | 0.942028986 | CLECL1 AND NOT-MRVI1 | 0.915662651 | 0.844444444 | 1 |
| PTPRZ1 AND FAM210A | 0.99270073 | 1 | 0.985507246 | NOT-FAM210B AND PCGF3 | 0.96 | 0.972972973 | 0.947368421 |
| PTPRZ1 AND FAM69C | 0.985507246 | 0.98550725 | 0.985507246 | TNFRSF13C AND NOT-PKDREJ | 0.915662651 | 0.844444444 | 1 |
| PTPRZ1 AND CLDND2 | 0.985507246 | 0.98550725 | 0.985507246 | NOT-CDS1 AND CELSR1 | 0.935064935 | 0.923076923 | 0.947368421 |
| PTPRZ1 AND ACER1 | 0.99270073 | 1 | 0.985507246 | CLECL1 AND NOT-ST3GAL6 | 0.926829268 | 0.863636364 | 1 |
| SYT11 AND NOT-IZUMO2 | 0.985507246 | 0.98550725 | 0.985507246 | CLECL1 AND NOT-WFDC2 | 0.915662651 | 0.844444444 | 1 |
| PTPRZ1 AND NOT-IZUMO2 | 0.985507246 | 0.98550725 | 0.985507246 | CLECL1 AND NOT-CDIPT | 0.962025316 | 0.926829268 | 1 |
| PTPRZ1 AND CPT1C | 0.985507246 | 0.98550725 | 0.985507246 | CLECL1 AND NOT-CLEC10A | 0.915662651 | 0.844444444 | 1 |
| PTPRZ1 AND CNGA3 | 0.985507246 | 0.98550725 | 0.985507246 | CLECL1 AND NOT-CRTAP | 0.918918919 | 0.944444444 | 0.894736842 |
| PTPRZ1 AND TMIGD2 | 0.985507246 | 0.98550725 | 0.985507246 | QSOX2 AND NOT-CRTAP | 0.935064935 | 0.923076923 | 0.947368421 |
| PTPRZ1 AND NOT-CNGA4 | 0.985507246 | 0.98550725 | 0.985507246 | TNFRSF13C AND NOT-TM9SF1 | 0.918918919 | 0.944444444 | 0.894736842 |
| PTPRZ1 AND MFSD12 | 0.985507246 | 0.98550725 | 0.985507246 | NOT-ST6GALNAC2 AND SPPL3 | 0.936708861 | 0.902439024 | 0.973684211 |
| GPM6B AND NDUFA11 | 0.977777778 | 1 | 0.956521739 | CLECL1 AND NOT-ST6GALNAC2 | 0.938271605 | 0.88372093 | 1 |

FIG. 1 (CONT.)

| Antigen Pair Logic | F1 | Precision | Recall |
|---|---|---|---|
| PTPRZ1 AND NDUFA11 | 0.985294118 | 1 | 0.971014493 |
| PTPRZ1 AND LRRC25 | 0.985507246 | 0.98550725 | 0.985507246 |
| PTPRZ1 AND NOT-OR1I1 | 0.985507246 | 0.98550725 | 0.985507246 |
| PTPRZ1 AND NOT-ANKLE1 | 0.985507246 | 0.98550725 | 0.985507246 |
| GPM6B AND B3GALT6 | 0.985294118 | 1 | 0.971014493 |
| PTPRZ1 AND B3GALT6 | 0.977777778 | 1 | 0.956521739 |
| PTPRZ1 AND NOT-SLC44A3 | 0.985507246 | 0.98550725 | 0.985507246 |
| PTPRZ1 AND NOT-CNTN1 | 0.985507246 | 0.98550725 | 0.985507246 |
| PTPRZ1 AND NOT-TMCO2 | 0.985507246 | 0.98550725 | 0.985507246 |
| PTPRZ1 AND RNF19B | 0.985507246 | 0.98550725 | 0.985507246 |
| PTPRZ1 AND TEDDM1 | 0.985507246 | 0.98550725 | 0.985507246 |
| SYT11 AND NOT-SYT2 | 0.985294118 | 1 | 0.971014493 |
| PTPRZ1 AND NOT-SYT2 | 0.985507246 | 0.98550725 | 0.985507246 |
| PTPRZ1 AND NOT-GOLT1A | 0.970149254 | 1 | 0.942028986 |
| PTPRZ1 AND NOT-TMEM125 | 0.970149254 | 1 | 0.942028986 |
| PTPRZ1 AND DRAM2 | 0.99270073 | 1 | 0.985507246 |
| PTPRZ1 AND C1orf162 | 0.985507246 | 0.98550725 | 0.985507246 |
| PTPRZ1 AND NKAIN4 | 0.985507246 | 0.98550725 | 0.985507246 |
| SYT11 AND NOT-FITM2 | 0.977777778 | 1 | 0.956521739 |
| PTPRZ1 AND COL4A2 | 0.985507246 | 0.98550725 | 0.985507246 |
| PTPRZ1 AND TBC1D20 | 0.985507246 | 0.98550725 | 0.985507246 |
| PTPRZ1 AND NOT-PROKR2 | 0.985507246 | 0.98550725 | 0.985507246 |
| PTPRZ1 AND CST9L | 0.985507246 | 0.98550725 | 0.985507246 |
| PTPRZ1 AND EMID1 | 0.985507246 | 0.98550725 | 0.985507246 |
| PTPRZ1 AND TMEM150A | 0.985507246 | 0.98550725 | 0.985507246 |
| PTPRZ1 AND MBOAT2 | 0.977777778 | 1 | 0.956521739 |
| PTPRZ1 AND NOT-CNTNAP5 | 0.985507246 | 0.98550725 | 0.985507246 |
| SYT11 AND NOT-SGPP2 | 0.985294118 | 1 | 0.971014493 |
| PTPRZ1 AND NOT-ACVR1C | 0.985507246 | 0.98550725 | 0.985507246 |
| PTPRZ1 AND NOT-LYPD6B | 0.985294118 | 1 | 0.971014493 |
| PTPRZ1 AND PQLC3 | 0.985294118 | 1 | 0.971014493 |
| PTPRZ1 AND TMEM182 | 0.985507246 | 0.98550725 | 0.985507246 |
| PTPRZ1 AND NOT-COL17A1 | 0.985507246 | 0.98550725 | 0.985507246 |
| PTPRZ1 AND DNAJC19 | 0.985507246 | 0.98550725 | 0.985507246 |
| PTPRZ1 AND NOT-FAM3D | 0.985294118 | 1 | 0.971014493 |
| PTPRZ1 AND NOT-ZPLD1 | 0.985507246 | 0.98550725 | 0.985507246 |
| PTPRZ1 AND DCBLD2 | 0.985507246 | 0.98550725 | 0.985507246 |
| PTPRZ1 AND TPRA1 | 0.985507246 | 0.98550725 | 0.985507246 |
| PTPRZ1 AND SLC31A1 | 0.99270073 | 1 | 0.985507246 |
| PTPRZ1 AND NOT-TMEM207 | 0.985507246 | 0.98550725 | 0.985507246 |
| PTPRZ1 AND NOT-IL17RE | 0.985507246 | 0.98550725 | 0.985507246 |
| PTPRZ1 AND NOT-SYNPR | 0.985507246 | 0.98550725 | 0.985507246 |
| PTPRZ1 AND NOT-C4orf32 | 0.985507246 | 0.98550725 | 0.985507246 |
| PTPRZ1 AND COX4I1 | 0.985294118 | 1 | 0.971014493 |
| PTPRZ1 AND AASDH | 0.985507246 | 0.98550725 | 0.985507246 |
| PTPRZ1 AND NOT-TRAM1L1 | 0.985507246 | 0.98550725 | 0.985507246 |
| PTPRZ1 AND NOT-SLC9B2 | 0.985507246 | 0.98550725 | 0.985507246 |
| PTPRZ1 AND NOT-EMB | 0.985507246 | 0.98550725 | 0.985507246 |
| PTPRZ1 AND NOT-EGFLAM | 0.985507246 | 0.98550725 | 0.985507246 |
| PTPRZ1 AND NOT-UGT3A1 | 0.985507246 | 0.98550725 | 0.985507246 |
| PTPRZ1 AND NOT-TMEM174 | 0.985507246 | 0.98550725 | 0.985507246 |
| PTPRZ1 AND NOT-COX7A1 | 0.985507246 | 0.98550725 | 0.985507246 |
| PTPRZ1 AND COX7A2 | 0.985294118 | 1 | 0.971014493 |
| PTPRZ1 AND NOT-TAAR9 | 0.99270073 | 1 | 0.985507246 |
| PTPRZ1 AND NOT-TAAR1 | 0.99270073 | 1 | 0.985507246 |
| PTPRZ1 AND NOT-PACRG | 0.985507246 | 0.98550725 | 0.985507246 |
| PTPRZ1 AND B3GAT2 | 0.985507246 | 0.98550725 | 0.985507246 |
| PTPRZ1 AND COX8A | 0.985294118 | 1 | 0.971014493 |
| PTPRZ1 AND NOT-RAET1E | 0.985294118 | 1 | 0.971014493 |
| PTPRZ1 AND COX15 | 0.985507246 | 0.98550725 | 0.985507246 |
| PTPRZ1 AND NOT-DPCR1 | 0.99270073 | 1 | 0.985507246 |
| PTPRZ1 AND NOT-WBSCR28 | 0.985507246 | 0.98550725 | 0.985507246 |
| SYT11 AND NOT-TMEM139 | 0.985507246 | 0.98550725 | 0.985507246 |
| PTPRZ1 AND NOT-TMEM139 | 0.99270073 | 1 | 0.985507246 |
| PTPRZ1 AND CPD | 0.970149254 | 1 | 0.942028986 |
| PTPRZ1 AND NOT-CLDN4 | 0.985507246 | 0.98550725 | 0.985507246 |
| PTPRZ1 AND NOT-CLDN3 | 0.985507246 | 0.98550725 | 0.985507246 |
| PTPRZ1 AND NOT-CLDN23 | 0.985507246 | 0.98550725 | 0.985507246 |
| PTPRZ1 AND CPT1A | 0.985507246 | 0.98550725 | 0.985507246 |
| PTPRZ1 AND TMEM68 | 0.985507246 | 0.98550725 | 0.985507246 |
| PTPRZ1 AND CR1 | 0.985507246 | 0.98550725 | 0.985507246 |
| PTPRZ1 AND AGPAT6 | 0.985507246 | 0.98550725 | 0.985507246 |
| PTPRZ1 AND LETM2 | 0.985507246 | 0.98550725 | 0.985507246 |
| PTPRZ1 AND NOT-HGSNAT | 0.985507246 | 0.98550725 | 0.985507246 |
| PTPRZ1 AND NOT-C9orf57 | 0.985507246 | 0.98550725 | 0.985507246 |
| PTPRZ1 AND FAM69B | 0.985507246 | 0.98550725 | 0.985507246 |

| Antigen Pair Logic | F1 | Precision | Recall |
|---|---|---|---|
| NOT-ST6GALNAC2 AND ETV6 | 0.961038961 | 0.948717949 | 0.973684211 |
| NOT-ST6GALNAC2 AND ATP11B | 0.929577465 | 1 | 0.868421053 |
| NOT-ST6GALNAC2 AND FUT8 | 0.918918919 | 0.944444444 | 0.894736842 |
| NOT-ST6GALNAC2 AND ADAM17 | 0.961038961 | 0.948717949 | 0.973684211 |
| NOT-ST6GALNAC2 AND SNRNP40 | 0.986666667 | 1 | 0.973684211 |
| CLECL1 AND NOT-TGOLN2 | 0.974358974 | 0.95 | 1 |
| IL10RA AND NOT-TGOLN2 | 0.915662651 | 0.844444444 | 1 |
| PTPN1 AND NOT-TGOLN2 | 0.962025316 | 0.926829268 | 1 |
| TNFRSF13C AND NOT-DMRT2 | 0.915662651 | 0.844444444 | 1 |
| CLECL1 AND NOT-CD226 | 0.926829268 | 0.863636364 | 1 |
| CLECL1 AND NOT-TNFSF13B | 0.926829268 | 0.863636364 | 1 |
| TNFRSF13C AND NOT-DLL3 | 0.915662651 | 0.844444444 | 1 |
| TNFRSF13C AND NOT-CLDN16 | 0.915662651 | 0.844444444 | 1 |
| CLECL1 AND NOT-CLDN16 | 0.915662651 | 0.844444444 | 1 |
| TNFRSF13C AND NOT-RRH | 0.915662651 | 0.844444444 | 1 |
| TNFRSF13C AND NOT-ADCY1 | 0.974358974 | 0.95 | 1 |
| CLECL1 AND NOT-ADCY1 | 0.938271605 | 0.88372093 | 1 |
| QSOX2 AND NOT-ADCY1 | 0.948717949 | 0.925 | 0.973684211 |
| TNFRSF13C AND NOT-CERS1 | 0.95 | 0.904761905 | 1 |
| TNFRSF13C AND NOT-NRG3 | 0.915662651 | 0.844444444 | 1 |
| CLECL1 AND NOT-NUP50 | 0.961038961 | 0.948717949 | 0.973684211 |
| CLECL1 AND NOT-ZMYND11 | 0.915662651 | 0.844444444 | 1 |
| TNFRSF13C AND NOT-OR5I1 | 0.915662651 | 0.844444444 | 1 |
| QSOX2 AND NOT-CCR9 | 0.929577465 | 1 | 0.868421053 |
| TNFRSF13C AND NOT-GJB6 | 0.915662651 | 0.844444444 | 1 |
| CLECL1 AND NOT-CEACAM3 | 0.95 | 0.904761905 | 1 |
| TNFRSF13C AND NOT-SLC22A7 | 0.926829268 | 0.863636364 | 1 |
| TNFRSF13C AND NOT-CD300C | 0.936708861 | 0.902439024 | 0.973684211 |
| CLECL1 AND NOT-CD300C | 0.961038961 | 0.948717949 | 0.973684211 |
| QSOX2 AND NOT-CD300C | 0.935064935 | 0.923076923 | 0.947368421 |
| TNFRSF13C AND NOT-NMU | 0.915662651 | 0.844444444 | 1 |
| CLECL1 AND NOT-CEACAM4 | 0.915662651 | 0.844444444 | 1 |
| QSOX2 AND NOT-MMP24 | 0.936708861 | 0.902439024 | 0.973684211 |
| TNFRSF13C AND NOT-OCLM | 0.915662651 | 0.844444444 | 1 |
| TNFRSF13C AND NOT-MAN1A2 | 0.962025316 | 0.926829268 | 1 |
| CLECL1 AND NOT-MAN1A2 | 0.962025316 | 0.926829268 | 1 |
| TNFRSF13C AND NOT-BTNL3 | 0.915662651 | 0.844444444 | 1 |
| TNFRSF13C AND NOT-SLC38A3 | 0.926829268 | 0.863636364 | 1 |
| TNFRSF13C AND NOT-SLC27A4 | 0.948717949 | 0.925 | 0.973684211 |
| QSOX2 AND NOT-SLC27A4 | 0.948717949 | 0.925 | 0.973684211 |
| CLECL1 AND NOT-SLC27A3 | 0.935064935 | 0.923076923 | 0.947368421 |
| TNFRSF13C AND NOT-KDELR3 | 0.915662651 | 0.844444444 | 1 |
| TNFRSF13C AND NOT-TDRKH | 0.95 | 0.904761905 | 1 |
| CLECL1 AND NOT-TDRKH | 0.948717949 | 0.925 | 0.973684211 |
| QSOX2 AND NOT-TDRKH | 0.935064935 | 0.923076923 | 0.947368421 |
| CLECL1 AND NOT-LILRB3 | 0.961038961 | 0.948717949 | 0.973684211 |
| PTPN1 AND NOT-LILRB3 | 0.926829268 | 0.863636364 | 1 |
| TNFRSF13C AND NOT-ZPBP | 0.935064935 | 0.923076923 | 0.947368421 |
| QSOX2 AND NOT-ZPBP | 0.918918919 | 0.944444444 | 0.894736842 |
| CLECL1 AND NOT-TMEM115 | 0.947368421 | 0.947368421 | 0.947368421 |
| TNFRSF13C AND NOT-ADAM30 | 0.926829268 | 0.863636364 | 1 |
| TNFRSF13C AND NOT-PTPRT | 0.926829268 | 0.863636364 | 1 |
| QSOX2 AND NOT-PTPRT | 0.961038961 | 0.948717949 | 0.973684211 |
| TNFRSF13C AND NOT-IL1RAPL1 | 0.938271605 | 0.88372093 | 1 |
| TNFRSF13C AND NOT-KLK8 | 0.926829268 | 0.863636364 | 1 |
| TNFRSF13C AND NOT-GALNT6 | 0.926829268 | 0.863636364 | 1 |
| CLECL1 AND NOT-GALNT6 | 0.938271605 | 0.88372093 | 1 |
| TNFRSF13C AND NOT-GALNT5 | 0.915662651 | 0.844444444 | 1 |
| TNFRSF13C AND NOT-RNF24 | 0.935064935 | 0.923076923 | 0.947368421 |
| CLECL1 AND NOT-RNF24 | 0.947368421 | 0.947368421 | 0.947368421 |
| TNFRSF13C AND NOT-PRRT2 | 0.915662651 | 0.844444444 | 1 |
| TNFRSF13C AND NOT-PTGDR2 | 0.915662651 | 0.844444444 | 1 |
| CLECL1 AND NOT-PTGDR2 | 0.938271605 | 0.88372093 | 1 |
| QSOX2 AND NOT-PTGDR2 | 0.936708861 | 0.902439024 | 0.973684211 |
| TNFRSF13C AND NOT-HRH3 | 0.926829268 | 0.863636364 | 1 |
| CLECL1 AND NOT-HRH3 | 0.918918919 | 0.944444444 | 0.894736842 |
| TNFRSF13C AND NOT-MRAP2 | 0.915662651 | 0.844444444 | 1 |
| QSOX2 AND NOT-B4GALT7 | 0.936708861 | 0.902439024 | 0.973684211 |
| QSOX2 AND NOT-CHRM2 | 0.936708861 | 0.902439024 | 0.973684211 |
| CLECL1 AND NOT-ADCY7 | 0.938271605 | 0.88372093 | 1 |
| TNFRSF13C AND NOT-CHRM3 | 0.915662651 | 0.844444444 | 1 |
| CLECL1 AND NOT-CD300A | 0.926829268 | 0.863636364 | 1 |
| QSOX2 AND NOT-GPR182 | 0.918918919 | 0.944444444 | 0.894736842 |
| CLECL1 AND NOT-MGAT4A | 0.95 | 0.904761905 | 1 |
| TNFRSF13C AND NOT-SLC46A1 | 0.915662651 | 0.844444444 | 1 |
| CLECL1 AND NOT-SLC46A1 | 0.915662651 | 0.844444444 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-ADGRG4 | 0.985507246 | 0.98550725 | 0.985507246 | TNFRSF13C AND NOT-VSIG4 | 0.938271605 | 0.88372093 | 1 |
| PTPRZ1 AND PTCHD1 | 0.985507246 | 0.98550725 | 0.985507246 | CLECL1 AND NOT-VSIG4 | 0.95 | 0.904761905 | 1 |
| PTPRZ1 AND NOT-CRHR1 | 0.985507246 | 0.98550725 | 0.985507246 | TNFRSF13C AND NOT-SLC52A3 | 0.974358974 | 0.95 | 1 |
| GPM6A AND NOT-AADAC | 0.970149254 | 1 | 0.942028986 | QSOX2 AND NOT-SLC52A3 | 0.945945946 | 0.972222222 | 0.921052632 |
| GPM6B AND NOT-AADAC | 0.99270073 | 1 | 0.985507246 | TNFRSF13C AND NOT-CHRM5 | 0.915662651 | 0.844444444 | 1 |
| APLP1 AND NOT-AADAC | 0.977777778 | 1 | 0.956521739 | QSOX2 AND NOT-CHRM5 | 0.948717949 | 0.925 | 0.973684211 |
| NAT8L AND NOT-AADAC | 0.970149254 | 1 | 0.942028986 | CLECL1 AND NOT-SCRG1 | 0.95 | 0.904761905 | 1 |
| LRRC37A3 AND NOT-AADAC | 0.970149254 | 1 | 0.942028986 | QSOX2 AND NOT-TEX261 | 0.948717949 | 0.925 | 0.973684211 |
| TMEM255A AND NOT-AADAC | 0.977777778 | 1 | 0.956521739 | TNFRSF13C AND NOT-CMTM1 | 0.938271605 | 0.88372093 | 1 |
| PTPRZ1 AND NOT-AADAC | 0.970149254 | 1 | 0.942028986 | TNFRSF13C AND NOT-CHRNA3 | 0.915662651 | 0.844444444 | 1 |
| SCG2 AND NOT-AADAC | 0.970149254 | 1 | 0.942028986 | TNFRSF13C AND NOT-MFSD3 | 0.938271605 | 0.88372093 | 1 |
| PTPRZ1 AND NOT-MUC17 | 0.985507246 | 0.98550725 | 0.985507246 | CLECL1 AND NOT-MFSD3 | 0.926829268 | 0.863636364 | 1 |
| PTPRZ1 AND NOT-ASB11 | 0.985507246 | 0.98550725 | 0.985507246 | TNFRSF13C AND NOT-SDSL | 0.915662651 | 0.844444444 | 1 |
| PTPRZ1 AND NOT-SELM | 0.985507246 | 0.98550725 | 0.985507246 | CLECL1 AND NOT-SDSL | 0.915662651 | 0.844444444 | 1 |
| PTPRZ1 AND TMEM37 | 0.985507246 | 0.98550725 | 0.985507246 | TNFRSF13C AND NOT-CHRNA4 | 0.915662651 | 0.844444444 | 1 |
| PTPRZ1 AND NOT-TRPM6 | 0.970149254 | 1 | 0.942028986 | CLECL1 AND NOT-CHRNA4 | 0.938271605 | 0.88372093 | 1 |
| GPM6B AND ROMO1 | 0.977777778 | 1 | 0.956521739 | QSOX2 AND NOT-CHRNA4 | 0.935064935 | 0.923076923 | 0.947368421 |
| PTPRZ1 AND ROMO1 | 0.977777778 | 1 | 0.956521739 | TNFRSF13C AND NOT-ADCY8 | 0.915662651 | 0.844444444 | 1 |
| PTPRZ1 AND NOT-WFDC10A | 0.985507246 | 0.98550725 | 0.985507246 | CLECL1 AND NOT-CHRNB1 | 0.935064935 | 0.923076923 | 0.947368421 |
| PTPRZ1 AND NOT-CST11 | 0.985507246 | 0.98550725 | 0.985507246 | QSOX2 AND NOT-CHRNB1 | 0.947368421 | 0.947368421 | 0.947368421 |
| PTPRZ1 AND SIRPA | 0.985507246 | 0.98550725 | 0.985507246 | TNFRSF13C AND NOT-CHRNE | 0.915662651 | 0.844444444 | 1 |
| PTPRZ1 AND NOT-CRY2 | 0.985507246 | 0.98550725 | 0.985507246 | TNFRSF13C AND NOT-SLC22A9 | 0.915662651 | 0.844444444 | 1 |
| PTPRZ1 AND ADORA3 | 0.985507246 | 0.98550725 | 0.985507246 | TNFRSF13C AND NOT-CHRNG | 0.962025316 | 0.926829268 | 1 |
| PTPRZ1 AND SAMD8 | 0.985507246 | 0.98550725 | 0.985507246 | CLECL1 AND NOT-CHRNG | 0.918918919 | 0.944444444 | 0.894736842 |
| PTPRZ1 AND CSF1 | 0.985507246 | 0.98550725 | 0.985507246 | QSOX2 AND NOT-CHRNG | 0.933333333 | 0.945945946 | 0.921052632 |
| PTPRZ1 AND FAM76B | 0.985507246 | 0.98550725 | 0.985507246 | TNFRSF13C AND NOT-PKD1L2 | 0.926829268 | 0.863636364 | 1 |
| PTPRZ1 AND CSF2RA | 0.985507246 | 0.98550725 | 0.985507246 | TNFRSF13C AND NOT-CSMD3 | 0.915662651 | 0.844444444 | 1 |
| PTPRZ1 AND LAYN | 0.985507246 | 0.98550725 | 0.985507246 | TNFRSF13C AND NOT-TMEM132B | 0.915662651 | 0.844444444 | 1 |
| PTPRZ1 AND NOT-TMEM86A | 0.985507246 | 0.98550725 | 0.985507246 | TNFRSF13C AND NOT-SLC5A11 | 0.945945946 | 0.972222222 | 0.921052632 |
| PTPRZ1 AND OR10A5 | 0.985507246 | 0.98550725 | 0.985507246 | QSOX2 AND NOT-SLC5A11 | 0.944444444 | 1 | 0.894736842 |
| PTPRZ1 AND CSF3R | 0.985507246 | 0.98550725 | 0.985507246 | TNFRSF13C AND NOT-EVI5L | 0.95 | 0.904761905 | 1 |
| PTPRZ1 AND ALG10B | 0.985507246 | 0.98550725 | 0.985507246 | TNFRSF13C AND NOT-FAM210B | 0.95 | 0.904761905 | 1 |
| PTPRZ1 AND NOT-TMEM120B | 0.985507246 | 0.98550725 | 0.985507246 | TNFRSF13C AND NOT-CMTM5 | 0.926829268 | 0.863636364 | 1 |
| PTPRZ1 AND B3GLCT | 0.985507246 | 0.98550725 | 0.985507246 | TNFRSF13C AND NOT-MOGAT1 | 0.962025316 | 0.926829268 | 1 |
| PTPRZ1 AND PRIMA1 | 0.985507246 | 0.98550725 | 0.985507246 | TNFRSF13C AND NOT-LYPD1 | 0.915662651 | 0.844444444 | 1 |
| PTPRZ1 AND C14orf37 | 0.985507246 | 0.98550725 | 0.985507246 | TNFRSF13C AND NOT-GRIN3A | 0.915662651 | 0.844444444 | 1 |
| PTPRZ1 AND NOT-ISM2 | 0.985507246 | 0.98550725 | 0.985507246 | TNFRSF13C AND NOT-CATSPER2 | 0.926829268 | 0.863636364 | 1 |
| PTPRZ1 AND NOT-TMCO5A | 0.99270073 | 1 | 0.985507246 | TNFRSF13C AND NOT-MRGPRX2 | 0.915662651 | 0.844444444 | 1 |
| PTPRZ1 AND NOT-CMTM4 | 0.985507246 | 0.98550725 | 0.985507246 | TNFRSF13C AND NOT-SLC16A10 | 0.915662651 | 0.844444444 | 1 |
| PTPRZ1 AND CMTM2 | 0.985507246 | 0.98550725 | 0.985507246 | TNFRSF13C AND NOT-TMC1 | 0.915662651 | 0.844444444 | 1 |
| PTPRZ1 AND NOT-SLC22A31 | 0.985507246 | 0.98550725 | 0.985507246 | TNFRSF13C AND NOT-CLCN1 | 0.935064935 | 0.923076923 | 0.947368421 |
| PTPRZ1 AND NOT-TMED6 | 0.985507246 | 0.98550725 | 0.985507246 | TNFRSF13C AND NOT-CLCN2 | 0.926829268 | 0.863636364 | 1 |
| PTPRZ1 AND CSPG4 | 0.985507246 | 0.98550725 | 0.985507246 | TNFRSF13C AND NOT-CLCN4 | 0.947368421 | 0.947368421 | 0.947368421 |
| PTPRZ1 AND NOT-RBFOX3 | 0.985507246 | 0.98550725 | 0.985507246 | TNFRSF13C AND NOT-CLCNKB | 0.915662651 | 0.844444444 | 1 |
| PTPRZ1 AND CD300LF | 0.985507246 | 0.98550725 | 0.985507246 | TNFRSF13C AND NOT-COMTD1 | 0.915662651 | 0.844444444 | 1 |
| PTPRZ1 AND SLC47A2 | 0.985507246 | 0.98550725 | 0.985507246 | TNFRSF13C AND NOT-CALHM3 | 0.947368421 | 0.947368421 | 0.947368421 |
| PTPRZ1 AND NOT-ODF4 | 0.985507246 | 0.98550725 | 0.985507246 | TNFRSF13C AND NOT-CLRN3 | 0.948717949 | 0.925 | 0.973684211 |
| PTPRZ1 AND NOT-SLC35G3 | 0.985507246 | 0.98550725 | 0.985507246 | TNFRSF13C AND NOT-OR5P3 | 0.962025316 | 0.926829268 | 1 |
| PTPRZ1 AND TMEM199 | 0.985507246 | 0.98550725 | 0.985507246 | TNFRSF13C AND NOT-FAT3 | 0.915662651 | 0.844444444 | 1 |
| PTPRZ1 AND DHRS13 | 0.985507246 | 0.98550725 | 0.985507246 | TNFRSF13C AND NOT-TMEM52B | 0.915662651 | 0.844444444 | 1 |
| PTPRZ1 AND NOT-TMC8 | 0.985507246 | 0.98550725 | 0.985507246 | TNFRSF13C AND NOT-ANO4 | 0.915662651 | 0.844444444 | 1 |
| PTPRZ1 AND NOT-TMEM99 | 0.985507246 | 0.98550725 | 0.985507246 | TNFRSF13C AND NOT-SLC24A4 | 0.915662651 | 0.844444444 | 1 |
| PTPRZ1 AND NOT-SMIM17 | 0.985507246 | 0.98550725 | 0.985507246 | TNFRSF13C AND NOT-CCR3 | 0.915662651 | 0.844444444 | 1 |
| PTPRZ1 AND NOT-C19orf18 | 0.985507246 | 0.98550725 | 0.985507246 | TNFRSF13C AND NOT-CCR8 | 0.915662651 | 0.844444444 | 1 |
| PTPRZ1 AND NOT-TMEM190 | 0.985507246 | 0.98550725 | 0.985507246 | TNFRSF13C AND NOT-SLC38A10 | 0.95 | 0.904761905 | 1 |
| ITGAV AND NOT-TMC4 | 0.970149254 | 1 | 0.942028986 | TNFRSF13C AND NOT-WFIKKN2 | 0.915662651 | 0.844444444 | 1 |
| GPM6B AND DPY19L3 | 0.985294118 | 1 | 0.971014493 | TNFRSF13C AND NOT-SEZ6 | 0.962025316 | 0.926829268 | 1 |
| PTPRZ1 AND DPY19L3 | 0.970149254 | 1 | 0.942028986 | TNFRSF13C AND NOT-MIEF2 | 0.938271605 | 0.88372093 | 1 |
| PTPRZ1 AND NOT-FAM187B | 0.99270073 | 1 | 0.985507246 | TNFRSF13C AND NOT-CNGA3 | 0.95 | 0.904761905 | 1 |
| PTPRZ1 AND NOT-ATP8B3 | 0.985507246 | 0.98550725 | 0.985507246 | TNFRSF13C AND NOT-OR1I1 | 0.915662651 | 0.844444444 | 1 |
| PTPRZ1 AND SYT6 | 0.985507246 | 0.98550725 | 0.985507246 | TNFRSF13C AND NOT-GJB4 | 0.936708861 | 0.902439024 | 0.973684211 |
| PTPRZ1 AND NOT-HFE2 | 0.985294118 | 1 | 0.971014493 | TNFRSF13C AND NOT-KLHDC7A | 0.915662651 | 0.844444444 | 1 |
| PTPRZ1 AND NOT-FAM163A | 0.977777778 | 1 | 0.956521739 | TNFRSF13C AND NOT-NKAIN4 | 0.915662651 | 0.844444444 | 1 |
| PTPRZ1 AND NOT-MFSD4 | 0.977777778 | 1 | 0.956521739 | TNFRSF13C AND NOT-CST9L | 0.915662651 | 0.844444444 | 1 |
| PTPRZ1 AND NOT-PM20D1 | 0.985294118 | 1 | 0.971014493 | TNFRSF13C AND NOT-TMEM150A | 0.916666667 | 0.970588235 | 0.868421053 |
| PTPRZ1 AND SLC30A7 | 0.985507246 | 0.98550725 | 0.985507246 | TNFRSF13C AND NOT-CNTNAP5 | 0.915662651 | 0.844444444 | 1 |
| PTPRZ1 AND NOT-ADRA1A | 0.985507246 | 0.98550725 | 0.985507246 | TNFRSF13C AND NOT-AADAC | 0.915662651 | 0.844444444 | 1 |
| PTPRZ1 AND CNIH3 | 0.985507246 | 0.98550725 | 0.985507246 | TNFRSF13C AND NOT-ACMSD | 0.915662651 | 0.844444444 | 1 |
| PTPRZ1 AND MANEAL | 0.985507246 | 0.98550725 | 0.985507246 | TNFRSF13C AND NOT-SPATA3 | 0.926829268 | 0.863636364 | 1 |
| PTPRZ1 AND NOT-CTLA4 | 0.985294118 | 1 | 0.971014493 | TNFRSF13C AND NOT-TMEM198 | 0.962025316 | 0.926829268 | 1 |
| PTPRZ1 AND NOT-CLDN19 | 0.985507246 | 0.98550725 | 0.985507246 | TNFRSF13C AND NOT-ZPLD1 | 0.938271605 | 0.88372093 | 1 |
| ITGAV AND NOT-C1orf210 | 0.970149254 | 1 | 0.942028986 | TNFRSF13C AND NOT-SLC31A1 | 0.938271605 | 0.88372093 | 1 |
| LRRC37A3 AND NOT-C1orf210 | 0.970149254 | 1 | 0.942028986 | TNFRSF13C AND NOT-SLCO6A1 | 0.926829268 | 0.863636364 | 1 |
| PTPRZ1 AND NOT-C1orf210 | 0.99270073 | 1 | 0.985507246 | TNFRSF13C AND NOT-ADORA1 | 0.926829268 | 0.863636364 | 1 |
| NOT-C1orf210 AND FAM57A | 0.970149254 | 1 | 0.942028986 | TNFRSF13C AND COX7A2 | 0.915662651 | 0.844444444 | 1 |
| CHST10 AND NOT-C1orf210 | 0.970149254 | 1 | 0.942028986 | TNFRSF13C AND NOT-TAAR9 | 0.915662651 | 0.844444444 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-SLC9B1 | 0.985507246 | 0.98550725 | 0.985507246 | TNFRSF13C AND NOT-TAAR1 | 0.915662651 | 0.844444444 | 1 |
| PTPRZ1 AND NOT-PROM2 | 0.985507246 | 0.98550725 | 0.985507246 | TNFRSF13C AND NOT-B3GAT2 | 0.935064935 | 0.923076923 | 0.947368421 |
| PTPRZ1 AND ITPRIPL1 | 0.985507246 | 0.98550725 | 0.985507246 | TNFRSF13C AND NOT-DPCR1 | 0.962025316 | 0.926829268 | 1 |
| PTPRZ1 AND NOT-KANSL1L | 0.985507246 | 0.98550725 | 0.985507246 | TNFRSF13C AND NOT-TMEM139 | 0.915662651 | 0.844444444 | 1 |
| PTPRZ1 AND PLB1 | 0.985507246 | 0.98550725 | 0.985507246 | TNFRSF13C AND NOT-OR6B1 | 0.915662651 | 0.844444444 | 1 |
| PTPRZ1 AND NOT-FAM132B | 0.985507246 | 0.98550725 | 0.985507246 | TNFRSF13C AND NOT-OR2F2 | 0.915662651 | 0.844444444 | 1 |
| PTPRZ1 AND ARL6IP6 | 0.985507246 | 0.98550725 | 0.985507246 | TNFRSF13C AND NOT-ADORA2B | 0.915662651 | 0.844444444 | 1 |
| PTPRZ1 AND METTL21A | 0.977777778 | 1 | 0.956521739 | TNFRSF13C AND NOT-CPD | 0.915662651 | 0.844444444 | 1 |
| PTPRZ1 AND NOT-SLC23A3 | 0.970149254 | 1 | 0.942028986 | TNFRSF13C AND NOT-COL26A1 | 0.915662651 | 0.844444444 | 1 |
| PTPRZ1 AND NOT-GPBAR1 | 0.985294118 | 1 | 0.971014493 | TNFRSF13C AND NOT-SVOPL | 0.926829268 | 0.863636364 | 1 |
| PTPRZ1 AND NOT-RMDN2 | 0.985507246 | 0.98550725 | 0.985507246 | TNFRSF13C AND NOT-SGCZ | 0.915662651 | 0.844444444 | 1 |
| PTPRZ1 AND GPR155 | 0.985507246 | 0.98550725 | 0.985507246 | TNFRSF13C AND NOT-RNF183 | 0.915662651 | 0.844444444 | 1 |
| PTPRZ1 AND NOT-CCDC80 | 0.985507246 | 0.98550725 | 0.985507246 | TNFRSF13C AND NOT-SLITRK4 | 0.915662651 | 0.844444444 | 1 |
| PTPRZ1 AND NOT-ADRA2B | 0.985507246 | 0.98550725 | 0.985507246 | TNFRSF13C AND NOT-ADGRG4 | 0.974358974 | 0.95 | 1 |
| PTPRZ1 AND XXYLT1 | 0.985507246 | 0.98550725 | 0.985507246 | TNFRSF13C AND NOT-CRHR1 | 0.915662651 | 0.844444444 | 1 |
| PTPRZ1 AND NOT-CTSZ | 0.985507246 | 0.98550725 | 0.985507246 | TNFRSF13C AND NOT-PTCHD1 | 0.915662651 | 0.844444444 | 1 |
| PTPRZ1 AND IGSF11 | 0.985507246 | 0.98550725 | 0.985507246 | TNFRSF13C AND NOT-CRHR2 | 0.915662651 | 0.844444444 | 1 |
| PTPRZ1 AND CX3CR1 | 0.985507246 | 0.98550725 | 0.985507246 | TNFRSF13C AND NOT-CHODL | 0.915662651 | 0.844444444 | 1 |
| PTPRZ1 AND NOT-PAQR3 | 0.985507246 | 0.98550725 | 0.985507246 | TNFRSF13C AND NOT-SLC32A1 | 0.962025316 | 0.926829268 | 1 |
| PTPRZ1 AND MGAT4D | 0.985507246 | 0.98550725 | 0.985507246 | TNFRSF13C AND NOT-SYT9 | 0.915662651 | 0.844444444 | 1 |
| PTPRZ1 AND THAP6 | 0.99270073 | 1 | 0.985507246 | TNFRSF13C AND NOT-BEST3 | 0.915662651 | 0.844444444 | 1 |
| GPM6B AND SLC38A9 | 0.99270073 | 1 | 0.985507246 | TNFRSF13C AND NOT-ADRA1D | 0.962025316 | 0.926829268 | 1 |
| PTPRZ1 AND SLC38A9 | 0.99270073 | 1 | 0.985507246 | TNFRSF13C AND NOT-CMTM2 | 0.915662651 | 0.844444444 | 1 |
| PTPRZ1 AND SPINK13 | 0.985507246 | 0.98550725 | 0.985507246 | TNFRSF13C AND NOT-C16orf92 | 0.915662651 | 0.844444444 | 1 |
| PTPRZ1 AND NOT-SLC25A48 | 0.985507246 | 0.98550725 | 0.985507246 | TNFRSF13C AND NOT-MGAT5B | 0.962025316 | 0.926829268 | 1 |
| PTPRZ1 AND TMEM161B | 0.985507246 | 0.98550725 | 0.985507246 | TNFRSF13C AND NOT-RBFOX3 | 0.915662651 | 0.844444444 | 1 |
| PTPRZ1 AND NOT-MARVELD2 | 0.985507246 | 0.98550725 | 0.985507246 | TNFRSF13C AND NOT-ODF4 | 0.915662651 | 0.844444444 | 1 |
| PTPRZ1 AND NOT-BTNL9 | 0.985507246 | 0.98550725 | 0.985507246 | TNFRSF13C AND NOT-SLC35G3 | 0.915662651 | 0.844444444 | 1 |
| PTPRZ1 AND CYBA | 0.99270073 | 1 | 0.985507246 | TNFRSF13C AND NOT-ZNRF4 | 0.938271605 | 0.88372093 | 1 |
| PTPRZ1 AND ARSK | 0.985507246 | 0.98550725 | 0.985507246 | TNFRSF13C AND NOT-FAM187B | 0.915662651 | 0.844444444 | 1 |
| PTPRZ1 AND CYBB | 0.985507246 | 0.98550725 | 0.985507246 | TNFRSF13C AND NOT-FAM163A | 0.926829268 | 0.863636364 | 1 |
| PTPRZ1 AND CCDC112 | 0.985507246 | 0.98550725 | 0.985507246 | TNFRSF13C AND NOT-CNIH3 | 0.915662651 | 0.844444444 | 1 |
| SYT11 AND NOT-NKAIN2 | 0.985294118 | 1 | 0.971014493 | TNFRSF13C AND NOT-SHISA4 | 0.95 | 0.904761905 | 1 |
| PTPRZ1 AND NOT-NKAIN2 | 0.985507246 | 0.98550725 | 0.985507246 | TNFRSF13C AND NOT-ADIG | 0.915662651 | 0.844444444 | 1 |
| GPM6B AND CCDC167 | 0.977777778 | 1 | 0.956521739 | TNFRSF13C AND NOT-SLC9B1 | 0.915662651 | 0.844444444 | 1 |
| PTPRZ1 AND CCDC167 | 0.970149254 | 1 | 0.942028986 | TNFRSF13C AND NOT-NFAM1 | 0.915662651 | 0.844444444 | 1 |
| PTPRZ1 AND NOT-CYP1A2 | 0.99270073 | 1 | 0.985507246 | TNFRSF13C AND NOT-ITPRIPL1 | 0.95 | 0.904761905 | 1 |
| PTPRZ1 AND NOT-CYP1B1 | 0.985507246 | 0.98550725 | 0.985507246 | TNFRSF13C AND NOT-ADRA2B | 0.926829268 | 0.863636364 | 1 |
| PTPRZ1 AND ABCA13 | 0.985507246 | 0.98550725 | 0.985507246 | TNFRSF13C AND NOT-PLB1 | 0.915662651 | 0.844444444 | 1 |
| SYT11 AND NOT-CLEC2L | 0.977777778 | 1 | 0.956521739 | TNFRSF13C AND NOT-SLC23A3 | 0.926829268 | 0.863636364 | 1 |
| PTPRZ1 AND VKORC1L1 | 0.977777778 | 1 | 0.956521739 | TNFRSF13C AND NOT-GPBAR1 | 0.915662651 | 0.844444444 | 1 |
| PTPRZ1 AND NOT-CYP2A6 | 0.985507246 | 0.98550725 | 0.985507246 | TNFRSF13C AND NOT-FAM19A4 | 0.915662651 | 0.844444444 | 1 |
| PTPRZ1 AND NOT-CYP2A7 | 0.985507246 | 0.98550725 | 0.985507246 | TNFRSF13C AND NOT-PPM1L | 0.915662651 | 0.844444444 | 1 |
| PTPRZ1 AND ATP6V0E2 | 0.985507246 | 0.98550725 | 0.985507246 | TNFRSF13C AND NOT-CMTM8 | 0.915662651 | 0.844444444 | 1 |
| PTPRZ1 AND NOT-CYP3A7 | 0.985294118 | 1 | 0.971014493 | TNFRSF13C AND NOT-IGSF11 | 0.938271605 | 0.88372093 | 1 |
| PTPRZ1 AND NOT-CYP2E1 | 0.985507246 | 0.98550725 | 0.985507246 | TNFRSF13C AND NOT-KLB | 0.915662651 | 0.844444444 | 1 |
| PTPRZ1 AND NOT-PEBP4 | 0.985507246 | 0.98550725 | 0.985507246 | TNFRSF13C AND NOT-SLC25A48 | 0.915662651 | 0.844444444 | 1 |
| PTPRZ1 AND NOT-TMEM65 | 0.985507246 | 0.98550725 | 0.985507246 | TNFRSF13C AND NOT-ARSK | 0.936708861 | 0.902439024 | 0.973684211 |
| PTPRZ1 AND NOT-CYP2J2 | 0.985507246 | 0.98550725 | 0.985507246 | TNFRSF13C AND NOT-SLC2A12 | 0.95 | 0.904761905 | 1 |
| PTPRZ1 AND NOT-ANKRD46 | 0.985507246 | 0.98550725 | 0.985507246 | TNFRSF13C AND NOT-CYP1A1 | 0.95 | 0.904761905 | 1 |
| SYT11 AND NOT-CYP3A4 | 0.985294118 | 1 | 0.971014493 | TNFRSF13C AND NOT-CYP1A2 | 0.915662651 | 0.844444444 | 1 |
| GPM6A AND NOT-CYP3A4 | 0.985294118 | 1 | 0.971014493 | TNFRSF13C AND NOT-CLEC2L | 0.95 | 0.904761905 | 1 |
| PTPRZ1 AND NOT-CYP3A4 | 0.99270073 | 1 | 0.985507246 | TNFRSF13C AND NOT-CYP3A7 | 0.915662651 | 0.844444444 | 1 |
| CHST10 AND NOT-CYP3A4 | 0.970149254 | 1 | 0.942028986 | TNFRSF13C AND NOT-CYP3A4 | 0.945945946 | 0.972222222 | 0.921052632 |
| PTPRZ1 AND NOT-CYP3A5 | 0.985507246 | 0.98550725 | 0.985507246 | TNFRSF13C AND NOT-CYP3A5 | 0.915662651 | 0.844444444 | 1 |
| PTPRZ1 AND KCNU1 | 0.985507246 | 0.98550725 | 0.985507246 | TNFRSF13C AND NOT-TMEM74 | 0.915662651 | 0.844444444 | 1 |
| SYT11 AND NOT-LINGO2 | 0.977777778 | 1 | 0.956521739 | TNFRSF13C AND NOT-LINGO2 | 0.915662651 | 0.844444444 | 1 |
| CHST10 AND NOT-LINGO2 | 0.970149254 | 1 | 0.942028986 | TNFRSF13C AND NOT-FAAH2 | 0.915662651 | 0.844444444 | 1 |
| PTPRZ1 AND NOT-CYP4B1 | 0.99270073 | 1 | 0.985507246 | TNFRSF13C AND NOT-CYP19A1 | 0.973684211 | 0.973684211 | 0.973684211 |
| CHST10 AND NOT-CYP4B1 | 0.970149254 | 1 | 0.942028986 | TNFRSF13C AND NOT-ZDHHC15 | 0.915662651 | 0.844444444 | 1 |
| PTPRZ1 AND NOT-OR1Q1 | 0.977777778 | 1 | 0.956521739 | TNFRSF13C AND NOT-SLC5A12 | 0.915662651 | 0.844444444 | 1 |
| PTPRZ1 AND NOT-CYP8B1 | 0.985507246 | 0.98550725 | 0.985507246 | TNFRSF13C AND NOT-CCDC67 | 0.915662651 | 0.844444444 | 1 |
| PTPRZ1 AND NOT-FAAH2 | 0.985507246 | 0.98550725 | 0.985507246 | TNFRSF13C AND NOT-MFSD6L | 0.947368421 | 0.947368421 | 0.947368421 |
| PTPRZ1 AND NOT-MOSPD2 | 0.985507246 | 0.98550725 | 0.985507246 | TNFRSF13C AND NOT-RHBDL3 | 0.915662651 | 0.844444444 | 1 |
| PTPRZ1 AND ARHGAP36 | 0.985507246 | 0.98550725 | 0.985507246 | TNFRSF13C AND NOT-DCT | 0.915662651 | 0.844444444 | 1 |
| PTPRZ1 AND NOT-AWAT1 | 0.985507246 | 0.98550725 | 0.985507246 | TNFRSF13C AND NOT-ADGRF3 | 0.915662651 | 0.844444444 | 1 |
| PTPRZ1 AND CYP19A1 | 0.985507246 | 0.98550725 | 0.985507246 | TNFRSF13C AND NOT-SPTSSB | 0.915662651 | 0.844444444 | 1 |
| PTPRZ1 AND NOT-SLC35G1 | 0.985507246 | 0.98550725 | 0.985507246 | TNFRSF13C AND NOT-CHST13 | 0.915662651 | 0.844444444 | 1 |
| PTPRZ1 AND NOT-CYP51A1 | 0.985507246 | 0.98550725 | 0.985507246 | TNFRSF13C AND NOT-PKD1L1 | 0.915662651 | 0.844444444 | 1 |
| PTPRZ1 AND DAD1 | 0.970149254 | 1 | 0.942028986 | TNFRSF13C AND NOT-KCNG3 | 0.915662651 | 0.844444444 | 1 |
| GPM6B AND TMTC3 | 0.970149254 | 1 | 0.942028986 | TNFRSF13C AND NOT-PTCRA | 0.926829268 | 0.863636364 | 1 |
| PTPRZ1 AND NOT-TMTC3 | 0.985507246 | 0.98550725 | 0.985507246 | TNFRSF13C AND NOT-DHODH | 0.95 | 0.904761905 | 1 |
| PTPRZ1 AND NOT-SLC5A8 | 0.985507246 | 0.98550725 | 0.985507246 | TNFRSF13C AND NOT-DPP6 | 0.933333333 | 0.945945946 | 0.921052632 |
| PTPRZ1 AND NOT-GPR180 | 0.985507246 | 0.98550725 | 0.985507246 | TNFRSF13C AND NOT-DRD1 | 0.915662651 | 0.844444444 | 1 |
| PTPRZ1 AND NOT-STOML3 | 0.985507246 | 0.98550725 | 0.985507246 | TNFRSF13C AND NOT-DRD3 | 0.915662651 | 0.844444444 | 1 |
| PTPRZ1 AND TMEM229B | 0.985507246 | 0.98550725 | 0.985507246 | TNFRSF13C AND NOT-DSC1 | 0.915662651 | 0.844444444 | 1 |

FIG. 1 (CONT.)

| Antigen Pair Logic | F1 | Precision | Recall |
|---|---|---|---|
| PTPRZ1 AND NOT-SYNE3 | 0.985507246 | 0.98550725 | 0.985507246 |
| PTPRZ1 AND NOT-FITM1 | 0.985507246 | 0.98550725 | 0.985507246 |
| PTPRZ1 AND NOT-TMEM30B | 0.985507246 | 0.98550725 | 0.985507246 |
| PTPRZ1 AND MDGA2 | 0.985507246 | 0.98550725 | 0.985507246 |
| PTPRZ1 AND NOT-TMEM92 | 0.99270073 | 1 | 0.985507246 |
| PTPRZ1 AND RHBDL3 | 0.985507246 | 0.98550725 | 0.985507246 |
| PTPRZ1 AND NOT-TRPV3 | 0.985507246 | 0.98550725 | 0.985507246 |
| PTPRZ1 AND DCC | 0.985507246 | 0.98550725 | 0.985507246 |
| PTPRZ1 AND LPPR5 | 0.985507246 | 0.98550725 | 0.985507246 |
| PTPRZ1 AND DENND1B | 0.985507246 | 0.98550725 | 0.985507246 |
| PTPRZ1 AND TOR1AIP2 | 0.985507246 | 0.98550725 | 0.985507246 |
| PTPRZ1 AND ACE | 0.985507246 | 0.98550725 | 0.985507246 |
| PTPRZ1 AND NOT-CNST | 0.985507246 | 0.98550725 | 0.985507246 |
| PTPRZ1 AND NOT-LRRN4 | 0.985507246 | 0.98550725 | 0.985507246 |
| PTPRZ1 AND CABP7 | 0.985507246 | 0.98550725 | 0.985507246 |
| PTPRZ1 AND NOT-ADGRF3 | 0.99270073 | 1 | 0.985507246 |
| PTPRZ1 AND DDOST | 0.977777778 | 1 | 0.956521739 |
| FAM171B AND NOT-DSC3 | 0.970149254 | 1 | 0.942028986 |
| PTPRZ1 AND NOT-FAM171B | 0.970149254 | 1 | 0.942028986 |
| FAM171B AND NOT-SIGLEC6 | 0.977777778 | 1 | 0.956521739 |
| PTPRZ1 AND NOT-CLEC4F | 0.985507246 | 0.98550725 | 0.985507246 |
| PTPRZ1 AND NOT-SPTSSB | 0.985507246 | 0.98550725 | 0.985507246 |
| PTPRZ1 AND NOT-PKD1L1 | 0.99270073 | 1 | 0.985507246 |
| PTPRZ1 AND NOT-SLC30A8 | 0.985507246 | 0.98550725 | 0.985507246 |
| PTPRZ1 AND TMEM64 | 0.99270073 | 1 | 0.985507246 |
| PTPRZ1 AND TMEM252 | 0.985507246 | 0.98550725 | 0.985507246 |
| PTPRZ1 AND SSBP4 | 0.99270073 | 1 | 0.985507246 |
| PTPRZ1 AND NOT-HTR3C | 0.985507246 | 0.98550725 | 0.985507246 |
| SYT11 AND NOT-KCNG3 | 0.977777778 | 1 | 0.956521739 |
| PTPRZ1 AND NOT-KCNG3 | 0.977777778 | 1 | 0.956521739 |
| PTPRZ1 AND FAM9C | 0.985507246 | 0.98550725 | 0.985507246 |
| GPM6B AND SPTSSA | 0.985294118 | 1 | 0.971014493 |
| PTPRZ1 AND SPTSSA | 0.985294118 | 1 | 0.971014493 |
| PTPRZ1 AND NOT-PTCRA | 0.985507246 | 0.98550725 | 0.985507246 |
| PTPRZ1 AND ABHD3 | 0.985507246 | 0.98550725 | 0.985507246 |
| PTPRZ1 AND NOT-DHCR7 | 0.985507246 | 0.98550725 | 0.985507246 |
| PTPRZ1 AND NOT-DHCR24 | 0.985507246 | 0.98550725 | 0.985507246 |
| PTPRZ1 AND DHODH | 0.985507246 | 0.98550725 | 0.985507246 |
| PTPRZ1 AND NOT-DIO1 | 0.985507246 | 0.98550725 | 0.985507246 |
| PTPRZ1 AND NOT-DIO2 | 0.985507246 | 0.98550725 | 0.985507246 |
| PTPRZ1 AND NOT-DNASE1 | 0.985507246 | 0.98550725 | 0.985507246 |
| PTPRZ1 AND NOT-AGER | 0.985507246 | 0.98550725 | 0.985507246 |
| PTPRZ1 AND DPAGT1 | 0.985507246 | 0.98550725 | 0.985507246 |
| PTPRZ1 AND NOT-DPP4 | 0.985507246 | 0.98550725 | 0.985507246 |
| PTPRZ1 AND NOT-SLC26A3 | 0.985507246 | 0.98550725 | 0.985507246 |
| PTPRZ1 AND NOT-DRD4 | 0.985507246 | 0.98550725 | 0.985507246 |
| PTPRZ1 AND NOT-DSC2 | 0.985507246 | 0.98550725 | 0.985507246 |
| ITGAV AND NOT-DSC3 | 0.970149254 | 1 | 0.942028986 |
| PTPRZ1 AND NOT-DSC3 | 0.985294118 | 1 | 0.971014493 |
| PTPRZ1 AND DSCAM | 0.985507246 | 0.98550725 | 0.985507246 |
| PTPRZ1 AND JAG1 | 0.985294118 | 1 | 0.971014493 |
| PTPRZ1 AND SLC26A2 | 0.977777778 | 1 | 0.956521739 |
| PTPRZ1 AND DTNA | 0.985507246 | 0.98550725 | 0.985507246 |
| PTPRZ1 AND HBEGF | 0.985507246 | 0.98550725 | 0.985507246 |
| PTPRZ1 AND NOT-AGTR1 | 0.985507246 | 0.98550725 | 0.985507246 |
| PTPRZ1 AND NOT-AGTR2 | 0.985507246 | 0.98550725 | 0.985507246 |
| GPM6B AND E2F5 | 0.985507246 | 0.98550725 | 0.985507246 |
| PTPRZ1 AND E2F5 | 0.99270073 | 1 | 0.985507246 |
| PTPRZ1 AND APLNR | 0.985507246 | 0.98550725 | 0.985507246 |
| PTPRZ1 AND GPR183 | 0.985507246 | 0.98550725 | 0.985507246 |
| PTPRZ1 AND ECE1 | 0.985507246 | 0.98550725 | 0.985507246 |
| PTPRZ1 AND NOT-ECM1 | 0.985507246 | 0.98550725 | 0.985507246 |
| PTPRZ1 AND NOT-EDA | 0.99270073 | 1 | 0.985507246 |
| CHST10 AND NOT-EDA | 0.970149254 | 1 | 0.942028986 |
| PTPRZ1 AND S1PR1 | 0.985507246 | 0.98550725 | 0.985507246 |
| PTPRZ1 AND S1PR3 | 0.985507246 | 0.98550725 | 0.985507246 |
| PTPRZ1 AND EDNRA | 0.985294118 | 1 | 0.971014493 |
| PTPRZ1 AND EDNRB | 0.985507246 | 0.98550725 | 0.985507246 |
| PTPRZ1 AND NOT-PGAM5 | 0.985507246 | 0.98550725 | 0.985507246 |
| PTPRZ1 AND NOT-B3GNT6 | 0.985507246 | 0.98550725 | 0.985507246 |
| PTPRZ1 AND HIGD2A | 0.985294118 | 1 | 0.971014493 |
| PTPRZ1 AND NOT-EFNB2 | 0.985507246 | 0.98550725 | 0.985507246 |
| PTPRZ1 AND EFNB3 | 0.985507246 | 0.98550725 | 0.985507246 |
| PTPRZ1 AND EGF | 0.985507246 | 0.98550725 | 0.985507246 |
| PTPRZ1 AND CELSR3 | 0.985507246 | 0.98550725 | 0.985507246 |
| PTPRZ1 AND NOT-MEGF8 | 0.985507246 | 0.98550725 | 0.985507246 |

| Antigen Pair Logic | F1 | Precision | Recall |
|---|---|---|---|
| TNFRSF13C AND NOT-DSC3 | 0.926829268 | 0.863636364 | 1 |
| TNFRSF13C AND NOT-DTNA | 0.915662651 | 0.844444444 | 1 |
| TNFRSF13C AND NOT-AGTR2 | 0.95 | 0.904761905 | 1 |
| TNFRSF13C AND NOT-ECM1 | 0.926829268 | 0.863636364 | 1 |
| TNFRSF13C AND NOT-PGAM5 | 0.938271605 | 0.88372093 | 1 |
| TNFRSF13C AND NOT-B3GNT6 | 0.926829268 | 0.863636364 | 1 |
| TNFRSF13C AND NOT-EFNB1 | 0.915662651 | 0.844444444 | 1 |
| TNFRSF13C AND NOT-EFNB3 | 0.915662651 | 0.844444444 | 1 |
| TNFRSF13C AND NOT-EGF | 0.915662651 | 0.844444444 | 1 |
| TNFRSF13C AND NOT-PPAPDC1A | 0.915662651 | 0.844444444 | 1 |
| TNFRSF13C AND NOT-PLBD2 | 0.95 | 0.904761905 | 1 |
| TNFRSF13C AND NOT-VSTM4 | 0.915662651 | 0.844444444 | 1 |
| TNFRSF13C AND NOT-GRAMD2 | 0.926829268 | 0.863636364 | 1 |
| TNFRSF13C AND NOT-CADM4 | 0.915662651 | 0.844444444 | 1 |
| TNFRSF13C AND NOT-TMEM17 | 0.915662651 | 0.844444444 | 1 |
| TNFRSF13C AND NOT-GABRR3 | 0.915662651 | 0.844444444 | 1 |
| TNFRSF13C AND NOT-NRK | 0.926829268 | 0.863636364 | 1 |
| TNFRSF13C AND NOT-EPHA7 | 0.915662651 | 0.844444444 | 1 |
| TNFRSF13C AND NOT-EPHB3 | 0.915662651 | 0.844444444 | 1 |
| TNFRSF13C AND NOT-EPHB4 | 0.938271605 | 0.88372093 | 1 |
| TNFRSF13C AND NOT-EPO | 0.962025316 | 0.926829268 | 1 |
| TNFRSF13C AND NOT-EXTL1 | 0.915662651 | 0.844444444 | 1 |
| TNFRSF13C AND NOT-F2RL2 | 0.938271605 | 0.88372093 | 1 |
| TNFRSF13C AND NOT-FAP | 0.915662651 | 0.844444444 | 1 |
| TNFRSF13C AND NOT-MS4A15 | 0.915662651 | 0.844444444 | 1 |
| TNFRSF13C AND NOT-HEPACAM | 0.926829268 | 0.863636364 | 1 |
| TNFRSF13C AND NOT-FCAR | 0.938271605 | 0.88372093 | 1 |
| TNFRSF13C AND NOT-RNF152 | 0.915662651 | 0.844444444 | 1 |
| TNFRSF13C AND NOT-MS4A2 | 0.974358974 | 0.95 | 1 |
| TNFRSF13C AND NOT-SLC39A12 | 0.915662651 | 0.844444444 | 1 |
| TNFRSF13C AND NOT-OPN5 | 0.915662651 | 0.844444444 | 1 |
| TNFRSF13C AND NOT-MMD2 | 0.915662651 | 0.844444444 | 1 |
| TNFRSF13C AND NOT-FGF4 | 0.926829268 | 0.863636364 | 1 |
| TNFRSF13C AND NOT-FGF6 | 0.915662651 | 0.844444444 | 1 |
| TNFRSF13C AND NOT-FGF10 | 0.938271605 | 0.88372093 | 1 |
| TNFRSF13C AND NOT-FGFR3 | 0.935064935 | 0.923076923 | 0.947368421 |
| TNFRSF13C AND NOT-FGG | 0.915662651 | 0.844444444 | 1 |
| TNFRSF13C AND NOT-DOLK | 0.938271605 | 0.88372093 | 1 |
| TNFRSF13C AND NOT-ADGRL1 | 0.915662651 | 0.844444444 | 1 |
| TNFRSF13C AND NOT-SV2C | 0.915662651 | 0.844444444 | 1 |
| TNFRSF13C AND NOT-MLC1 | 0.926829268 | 0.863636364 | 1 |
| TNFRSF13C AND NOT-ASTN2 | 0.915662651 | 0.844444444 | 1 |
| TNFRSF13C AND NOT-ACSL6 | 0.915662651 | 0.844444444 | 1 |
| TNFRSF13C AND NOT-KCNH4 | 0.915662651 | 0.844444444 | 1 |
| TNFRSF13C AND NOT-KCNH3 | 0.948717949 | 0.925 | 0.973684211 |
| TNFRSF13C AND NOT-GPR161 | 0.938271605 | 0.88372093 | 1 |
| TNFRSF13C AND NOT-SLC44A1 | 0.926829268 | 0.863636364 | 1 |
| TNFRSF13C AND NOT-FOLR1 | 0.915662651 | 0.844444444 | 1 |
| TNFRSF13C AND NOT-OR52A1 | 0.915662651 | 0.844444444 | 1 |
| TNFRSF13C AND NOT-SLC16A8 | 0.938271605 | 0.88372093 | 1 |
| TNFRSF13C AND NOT-SEZ6L | 0.915662651 | 0.844444444 | 1 |
| TNFRSF13C AND NOT-HYAL4 | 0.915662651 | 0.844444444 | 1 |
| TNFRSF13C AND NOT-LPAR3 | 0.915662651 | 0.844444444 | 1 |
| TNFRSF13C AND NOT-FPR2 | 0.933333333 | 0.945945946 | 0.921052632 |
| TNFRSF13C AND NOT-CLEC5A | 0.938271605 | 0.88372093 | 1 |
| TNFRSF13C AND NOT-FLRT1 | 0.915662651 | 0.844444444 | 1 |
| TNFRSF13C AND NOT-ADAM2 | 0.948717949 | 0.925 | 0.973684211 |
| TNFRSF13C AND NOT-FUT2 | 0.95 | 0.904761905 | 1 |
| TNFRSF13C AND NOT-FUT5 | 0.95 | 0.904761905 | 1 |
| TNFRSF13C AND NOT-KDSR | 0.95 | 0.904761905 | 1 |
| TNFRSF13C AND NOT-CADM2 | 0.915662651 | 0.844444444 | 1 |
| TNFRSF13C AND NOT-FAM26E | 0.915662651 | 0.844444444 | 1 |
| TNFRSF13C AND NOT-GABRA2 | 0.915662651 | 0.844444444 | 1 |
| TNFRSF13C AND NOT-COL24A1 | 0.915662651 | 0.844444444 | 1 |
| TNFRSF13C AND NOT-GABRB1 | 0.915662651 | 0.844444444 | 1 |
| TNFRSF13C AND NOT-TMEM196 | 0.915662651 | 0.844444444 | 1 |
| TNFRSF13C AND NOT-CDRT15L2 | 0.96 | 0.972972973 | 0.947368421 |
| TNFRSF13C AND NOT-GABRD | 0.915662651 | 0.844444444 | 1 |
| TNFRSF13C AND NOT-GABRE | 0.915662651 | 0.844444444 | 1 |
| TNFRSF13C AND NOT-GABRG1 | 0.915662651 | 0.844444444 | 1 |
| TNFRSF13C AND NOT-GABRR1 | 0.915662651 | 0.844444444 | 1 |
| TNFRSF13C AND NOT-GABRR2 | 0.915662651 | 0.844444444 | 1 |
| TNFRSF13C AND NOT-UTS2B | 0.916666667 | 0.970588235 | 0.868421053 |
| TNFRSF13C AND NOT-TMEM59L | 0.962025316 | 0.926829268 | 1 |
| TNFRSF13C AND NOT-KLK5 | 0.95 | 0.904761905 | 1 |
| TNFRSF13C AND NOT-GALR1 | 0.926829268 | 0.863636364 | 1 |

FIG. 1 (CONT.)

| Antigen Pair Logic | F1 | Precision | Recall |
|---|---|---|---|
| SYT11 AND NOT-MEGF9 | 0.977777778 | 1 | 0.956521739 |
| PTPRZ1 AND NOT-MEGF9 | 0.985507246 | 0.98550725 | 0.985507246 |
| PTPRZ1 AND EGFR | 0.985507246 | 0.98550725 | 0.985507246 |
| PTPRZ1 AND NOT-MPZL3 | 0.985507246 | 0.98550725 | 0.985507246 |
| PTPRZ1 AND NOT-DNAH10 | 0.985507246 | 0.98550725 | 0.985507246 |
| PTPRZ1 AND METTL7B | 0.985507246 | 0.98550725 | 0.985507246 |
| PTPRZ1 AND MYRF | 0.985507246 | 0.98550725 | 0.985507246 |
| PTPRZ1 AND NOT-PLBD2 | 0.985507246 | 0.98550725 | 0.985507246 |
| PTPRZ1 AND NOT-VSTM4 | 0.985507246 | 0.98550725 | 0.985507246 |
| PTPRZ1 AND NOT-FAM24B | 0.985507246 | 0.98550725 | 0.985507246 |
| PTPRZ1 AND NOT-MCEMP1 | 0.985507246 | 0.98550725 | 0.985507246 |
| PTPRZ1 AND NOT-CYP4Z1 | 0.985294118 | 1 | 0.971014493 |
| PTPRZ1 AND ABCA1 | 0.985294118 | 1 | 0.971014493 |
| SYT11 AND KRTCAP2 | 0.970149254 | 1 | 0.942028986 |
| GPM6A AND KRTCAP2 | 0.970149254 | 1 | 0.942028986 |
| PTPRZ1 AND NOT-APLF | 0.985507246 | 0.98550725 | 0.985507246 |
| GOLM1 AND NOT-KRTCAP3 | 0.970149254 | 1 | 0.942028986 |
| PTPRZ1 AND NOT-KRTCAP3 | 0.985507246 | 0.98550725 | 0.985507246 |
| PTPRZ1 AND ELN | 0.99270073 | 1 | 0.985507246 |
| PTPRZ1 AND NOT-TMEM17 | 0.985507246 | 0.98550725 | 0.985507246 |
| PTPRZ1 AND NOT-PLD6 | 0.985507246 | 0.98550725 | 0.985507246 |
| PTPRZ1 AND NOT-SLC39A11 | 0.985507246 | 0.98550725 | 0.985507246 |
| PTPRZ1 AND RDM1 | 0.985507246 | 0.98550725 | 0.985507246 |
| PTPRZ1 AND EMP1 | 0.985294118 | 1 | 0.971014493 |
| PTPRZ1 AND NOT-SPNS3 | 0.985507246 | 0.98550725 | 0.985507246 |
| PTPRZ1 AND EMP3 | 0.985507246 | 0.98550725 | 0.985507246 |
| PTPRZ1 AND NOT-TIGIT | 0.985507246 | 0.98550725 | 0.985507246 |
| PTPRZ1 AND NOT-TMEM154 | 0.985507246 | 0.98550725 | 0.985507246 |
| PTPRZ1 AND NOT-TMEM192 | 0.985507246 | 0.98550725 | 0.985507246 |
| PTPRZ1 AND TAPT1 | 0.985507246 | 0.98550725 | 0.985507246 |
| PTPRZ1 AND DNAJC18 | 0.985507246 | 0.98550725 | 0.985507246 |
| PTPRZ1 AND ENG | 0.985507246 | 0.98550725 | 0.985507246 |
| PTPRZ1 AND ENPEP | 0.985507246 | 0.98550725 | 0.985507246 |
| PTPRZ1 AND NOT-TSNARE1 | 0.985507246 | 0.98550725 | 0.985507246 |
| PTPRZ1 AND HTRA4 | 0.985507246 | 0.98550725 | 0.985507246 |
| PTPRZ1 AND NOT-C9orf91 | 0.985507246 | 0.98550725 | 0.985507246 |
| PTPRZ1 AND NOT-CCDC107 | 0.985507246 | 0.98550725 | 0.985507246 |
| PTPRZ1 AND SUSD3 | 0.985507246 | 0.98550725 | 0.985507246 |
| PTPRZ1 AND NOT-CT83 | 0.985507246 | 0.98550725 | 0.985507246 |
| PTPRZ1 AND SLC25A43 | 0.985507246 | 0.98550725 | 0.985507246 |
| PTPRZ1 AND NOT-NRK | 0.985507246 | 0.98550725 | 0.985507246 |
| SYT11 AND NOT-ANO5 | 0.985294118 | 1 | 0.971014493 |
| PTPRZ1 AND NOT-ANO5 | 0.985507246 | 0.98550725 | 0.985507246 |
| PTPRZ1 AND STOM | 0.985507246 | 0.98550725 | 0.985507246 |
| PTPRZ1 AND NOT-EPHA1 | 0.985507246 | 0.98550725 | 0.985507246 |
| PTPRZ1 AND NOT-EPHA4 | 0.985507246 | 0.98550725 | 0.985507246 |
| PTPRZ1 AND NOT-EPHA8 | 0.985507246 | 0.98550725 | 0.985507246 |
| PTPRZ1 AND EPHB1 | 0.985507246 | 0.98550725 | 0.985507246 |
| PTPRZ1 AND EPHB2 | 0.985507246 | 0.98550725 | 0.985507246 |
| PTPRZ1 AND SLC44A5 | 0.985507246 | 0.98550725 | 0.985507246 |
| PTPRZ1 AND NOT-EPHB4 | 0.985507246 | 0.98550725 | 0.985507246 |
| PTPRZ1 AND NOT-EPHB6 | 0.985507246 | 0.98550725 | 0.985507246 |
| PTPRZ1 AND STX2 | 0.985507246 | 0.98550725 | 0.985507246 |
| PTPRZ1 AND CLN8 | 0.985507246 | 0.98550725 | 0.985507246 |
| PTPRZ1 AND NOT-EPO | 0.977777778 | 1 | 0.956521739 |
| PTPRZ1 AND EPOR | 0.985507246 | 0.98550725 | 0.985507246 |
| PTPRZ1 AND NOT-LVRN | 0.985507246 | 0.98550725 | 0.985507246 |
| PTPRZ1 AND NOT-SLC36A1 | 0.985507246 | 0.98550725 | 0.985507246 |
| PTPRZ1 AND NOT-ERBB3 | 0.985507246 | 0.98550725 | 0.985507246 |
| PTPRZ1 AND NOT-ERBB4 | 0.985507246 | 0.98550725 | 0.985507246 |
| PTPRZ1 AND NOT-EREG | 0.985507246 | 0.98550725 | 0.985507246 |
| PTPRZ1 AND ERF | 0.985507246 | 0.98550725 | 0.985507246 |
| PTPRZ1 AND ERN1 | 0.977777778 | 1 | 0.956521739 |
| PTPRZ1 AND NOT-ABCA2 | 0.985507246 | 0.98550725 | 0.985507246 |
| PTPRZ1 AND NOT-ETFDH | 0.985507246 | 0.98550725 | 0.985507246 |
| PTPRZ1 AND EVI2B | 0.985507246 | 0.98550725 | 0.985507246 |
| PTPRZ1 AND EXT1 | 0.970149254 | 1 | 0.942028986 |
| PTPRZ1 AND EXTL2 | 0.99270073 | 1 | 0.985507246 |
| GPM6B AND F2R | 0.99270073 | 1 | 0.985507246 |
| NOT-C1orf186 AND F2R | 0.970149254 | 1 | 0.942028986 |
| PTPRZ1 AND F2R | 0.985294118 | 1 | 0.971014493 |
| PTPRZ1 AND ALCAM | 0.985507246 | 0.98550725 | 0.985507246 |
| PTPRZ1 AND F3 | 0.985507246 | 0.98550725 | 0.985507246 |
| PTPRZ1 AND ACSL3 | 0.985507246 | 0.98550725 | 0.985507246 |
| PTPRZ1 AND NOT-FAP | 0.985507246 | 0.98550725 | 0.985507246 |
| PTPRZ1 AND LRRC55 | 0.985507246 | 0.98550725 | 0.985507246 |

| Antigen Pair Logic | F1 | Precision | Recall |
|---|---|---|---|
| TNFRSF13C AND NOT-LY6G6F | 0.915662651 | 0.844444444 | 1 |
| TNFRSF13C AND NOT-TMIE | 0.915662651 | 0.844444444 | 1 |
| TNFRSF13C AND NOT-WFDC11 | 0.915662651 | 0.844444444 | 1 |
| TNFRSF13C AND NOT-TAS2R41 | 0.915662651 | 0.844444444 | 1 |
| TNFRSF13C AND NOT-FAM205A | 0.915662651 | 0.844444444 | 1 |
| TNFRSF13C AND NOT-LRRTM2 | 0.973684211 | 0.973684211 | 0.973684211 |
| TNFRSF13C AND NOT-CFAP61 | 0.938271605 | 0.88372093 | 1 |
| TNFRSF13C AND NOT-LRIT1 | 0.915662651 | 0.844444444 | 1 |
| TNFRSF13C AND NOT-ABCA12 | 0.926829268 | 0.863636364 | 1 |
| TNFRSF13C AND NOT-OR2M4 | 0.915662651 | 0.844444444 | 1 |
| TNFRSF13C AND NOT-OR2L2 | 0.915662651 | 0.844444444 | 1 |
| TNFRSF13C AND NOT-KCNG2 | 0.961038961 | 0.948717949 | 0.973684211 |
| TNFRSF13C AND NOT-SLC13A4 | 0.926829268 | 0.863636364 | 1 |
| TNFRSF13C AND NOT-GALNT8 | 0.926829268 | 0.863636364 | 1 |
| TNFRSF13C AND NOT-OR5K1 | 0.915662651 | 0.844444444 | 1 |
| TNFRSF13C AND NOT-OR8B8 | 0.962025316 | 0.926829268 | 1 |
| TNFRSF13C AND NOT-OR8B2 | 0.915662651 | 0.844444444 | 1 |
| TNFRSF13C AND NOT-OR7C2 | 0.95 | 0.904761905 | 1 |
| TNFRSF13C AND NOT-HS6ST3 | 0.938271605 | 0.88372093 | 1 |
| TNFRSF13C AND NOT-GDNF | 0.915662651 | 0.844444444 | 1 |
| TNFRSF13C AND NOT-ADGRF1 | 0.915662651 | 0.844444444 | 1 |
| TNFRSF13C AND NOT-OR2H1 | 0.915662651 | 0.844444444 | 1 |
| TNFRSF13C AND NOT-OR1J2 | 0.915662651 | 0.844444444 | 1 |
| TNFRSF13C AND NOT-GGCX | 0.948717949 | 0.925 | 0.973684211 |
| TNFRSF13C AND NOT-GHSR | 0.915662651 | 0.844444444 | 1 |
| TNFRSF13C AND NOT-GJA8 | 0.926829268 | 0.863636364 | 1 |
| TNFRSF13C AND NOT-PKD2L2 | 0.926829268 | 0.863636364 | 1 |
| TNFRSF13C AND NOT-DKKL1 | 0.974358974 | 0.95 | 1 |
| TNFRSF13C AND NOT-KCNH5 | 0.915662651 | 0.844444444 | 1 |
| TNFRSF13C AND NOT-SIGLEC9 | 0.915662651 | 0.844444444 | 1 |
| TNFRSF13C AND NOT-GPR78 | 0.915662651 | 0.844444444 | 1 |
| TNFRSF13C AND NOT-PCDH17 | 0.915662651 | 0.844444444 | 1 |
| TNFRSF13C AND NOT-GLP1R | 0.915662651 | 0.844444444 | 1 |
| TNFRSF13C AND NOT-GLRB | 0.915662651 | 0.844444444 | 1 |
| TNFRSF13C AND NOT-CECR6 | 0.926829268 | 0.863636364 | 1 |
| TNFRSF13C AND NOT-PCLO | 0.915662651 | 0.844444444 | 1 |
| TNFRSF13C AND NOT-WFDC10B | 0.915662651 | 0.844444444 | 1 |
| TNFRSF13C AND NOT-GP2 | 0.915662651 | 0.844444444 | 1 |
| TNFRSF13C AND NOT-GP9 | 0.915662651 | 0.844444444 | 1 |
| TNFRSF13C AND NOT-SLCO3A1 | 0.915662651 | 0.844444444 | 1 |
| TNFRSF13C AND NOT-GPM6B | 0.961038961 | 0.948717949 | 0.973684211 |
| TNFRSF13C AND NOT-IFNL1 | 0.915662651 | 0.844444444 | 1 |
| TNFRSF13C AND NOT-GPR3 | 0.915662651 | 0.844444444 | 1 |
| TNFRSF13C AND NOT-GPR4 | 0.962025316 | 0.926829268 | 1 |
| TNFRSF13C AND NOT-XCR1 | 0.926829268 | 0.863636364 | 1 |
| TNFRSF13C AND NOT-OR8D2 | 0.938271605 | 0.88372093 | 1 |
| TNFRSF13C AND NOT-SLC39A5 | 0.915662651 | 0.844444444 | 1 |
| TNFRSF13C AND NOT-GPR12 | 0.926829268 | 0.863636364 | 1 |
| TNFRSF13C AND NOT-ZDHHC22 | 0.915662651 | 0.844444444 | 1 |
| TNFRSF13C AND NOT-OR4N4 | 0.915662651 | 0.844444444 | 1 |
| TNFRSF13C AND NOT-GPR15 | 0.926829268 | 0.863636364 | 1 |
| TNFRSF13C AND NOT-TMEM235 | 0.915662651 | 0.844444444 | 1 |
| TNFRSF13C AND NOT-FAM171A2 | 0.987012987 | 0.974358974 | 1 |
| TNFRSF13C AND NOT-SLC13A5 | 0.915662651 | 0.844444444 | 1 |
| TNFRSF13C AND NOT-TMEM145 | 0.926829268 | 0.863636364 | 1 |
| TNFRSF13C AND NOT-NKPD1 | 0.926829268 | 0.863636364 | 1 |
| TNFRSF13C AND NOT-GPR21 | 0.95 | 0.904761905 | 1 |
| TNFRSF13C AND NOT-VSTM1 | 0.915662651 | 0.844444444 | 1 |
| TNFRSF13C AND NOT-LPAR4 | 0.938271605 | 0.88372093 | 1 |
| TNFRSF13C AND NOT-GPR25 | 0.915662651 | 0.844444444 | 1 |
| TNFRSF13C AND NOT-DNAJC5G | 0.915662651 | 0.844444444 | 1 |
| TNFRSF13C AND NOT-CDH19 | 0.926829268 | 0.863636364 | 1 |
| TNFRSF13C AND NOT-LSMEM1 | 0.918918919 | 0.944444444 | 0.894736842 |
| TNFRSF13C AND NOT-SCARA5 | 0.915662651 | 0.844444444 | 1 |
| TNFRSF13C AND NOT-CRB2 | 0.961038961 | 0.948717949 | 0.973684211 |
| TNFRSF13C AND NOT-GPR39 | 0.95 | 0.904761905 | 1 |
| TNFRSF13C AND NOT-CFAP47 | 0.926829268 | 0.863636364 | 1 |
| TNFRSF13C AND NOT-TUSC5 | 0.974358974 | 0.95 | 1 |
| TNFRSF13C AND NOT-GRIA1 | 0.915662651 | 0.844444444 | 1 |
| TNFRSF13C AND NOT-GRIA2 | 0.915662651 | 0.844444444 | 1 |
| TNFRSF13C AND NOT-GRID2 | 0.95 | 0.904761905 | 1 |
| TNFRSF13C AND NOT-GRIK2 | 0.915662651 | 0.844444444 | 1 |
| TNFRSF13C AND NOT-TMPRSS11E | 0.915662651 | 0.844444444 | 1 |
| TNFRSF13C AND NOT-GRIN2A | 0.915662651 | 0.844444444 | 1 |
| TNFRSF13C AND NOT-GRIN2B | 0.915662651 | 0.844444444 | 1 |
| TNFRSF13C AND NOT-GRIN2D | 0.915662651 | 0.844444444 | 1 |

FIG. 1 (CONT.)

| Antigen Pair Logic | F1 | Precision | Recall |
|---|---|---|---|
| PTPRZ1 AND NOT-TMEM26 | 0.99270073 | 1 | 0.985507246 |
| PTPRZ1 AND NOT-FAT2 | 0.985507246 | 0.98550725 | 0.985507246 |
| PTPRZ1 AND NOT-C10orf35 | 0.985507246 | 0.98550725 | 0.985507246 |
| CHST10 AND NOT-C10orf35 | 0.970149254 | 1 | 0.942028986 |
| PTPRZ1 AND TMEM218 | 0.985507246 | 0.98550725 | 0.985507246 |
| PTPRZ1 AND NOT-TPCN2 | 0.985507246 | 0.98550725 | 0.985507246 |
| PTPRZ1 AND MPEG1 | 0.985507246 | 0.98550725 | 0.985507246 |
| PTPRZ1 AND NOT-MS4A15 | 0.985507246 | 0.98550725 | 0.985507246 |
| PTPRZ1 AND ABCA3 | 0.970149254 | 1 | 0.942028986 |
| PTPRZ1 AND NOT-LRTOMT | 0.985507246 | 0.98550725 | 0.985507246 |
| PTPRZ1 AND FBN2 | 0.985507246 | 0.98550725 | 0.985507246 |
| PTPRZ1 AND HEPACAM | 0.985507246 | 0.98550725 | 0.985507246 |
| PTPRZ1 AND NOT-FCAR | 0.985507246 | 0.98550725 | 0.985507246 |
| PTPRZ1 AND NOT-FCER1A | 0.985507246 | 0.98550725 | 0.985507246 |
| PTPRZ1 AND NOT-MS4A2 | 0.99270073 | 1 | 0.985507246 |
| PTPRZ1 AND NOT-FCER2 | 0.985507246 | 0.98550725 | 0.985507246 |
| PTPRZ1 AND NOT-MARCH8 | 0.985507246 | 0.98550725 | 0.985507246 |
| PTPRZ1 AND REEP3 | 0.985507246 | 0.98550725 | 0.985507246 |
| PTPRZ1 AND NOT-FAM171A1 | 0.985507246 | 0.98550725 | 0.985507246 |
| PTPRZ1 AND NOT-SLC39A12 | 0.985507246 | 0.98550725 | 0.985507246 |
| PTPRZ1 AND NOT-ADGRG5 | 0.985507246 | 0.98550725 | 0.985507246 |
| PTPRZ1 AND NOT-CES5A | 0.985507246 | 0.98550725 | 0.985507246 |
| PTPRZ1 AND NOT-FAM26D | 0.985507246 | 0.98550725 | 0.985507246 |
| PTPRZ1 AND FAM162B | 0.985507246 | 0.98550725 | 0.985507246 |
| PTPRZ1 AND NOT-OPN5 | 0.985507246 | 0.98550725 | 0.985507246 |
| PTPRZ1 AND ADGRF5 | 0.985507246 | 0.98550725 | 0.985507246 |
| PTPRZ1 AND NOT-TMEM217 | 0.985507246 | 0.98550725 | 0.985507246 |
| PTPRZ1 AND NOT-PI16 | 0.985507246 | 0.98550725 | 0.985507246 |
| PTPRZ1 AND C6orf89 | 0.99270073 | 1 | 0.985507246 |
| PTPRZ1 AND LEMD2 | 0.985507246 | 0.98550725 | 0.985507246 |
| PTPRZ1 AND FCGR3B | 0.985507246 | 0.98550725 | 0.985507246 |
| PTPRZ1 AND RNF182 | 0.985507246 | 0.98550725 | 0.985507246 |
| PTPRZ1 AND FCGRT | 0.985507246 | 0.98550725 | 0.985507246 |
| PTPRZ1 AND NOT-SDK1 | 0.985507246 | 0.98550725 | 0.985507246 |
| PTPRZ1 AND DAGLB | 0.985507246 | 0.98550725 | 0.985507246 |
| PTPRZ1 AND THSD7A | 0.985507246 | 0.98550725 | 0.985507246 |
| GPM6B AND TMED4 | 0.977777778 | 1 | 0.956521739 |
| PTPRZ1 AND TMED4 | 0.977777778 | 1 | 0.956521739 |
| PTPRZ1 AND FCN2 | 0.985507246 | 0.98550725 | 0.985507246 |
| PTPRZ1 AND NOT-KIAA1324L | 0.985507246 | 0.98550725 | 0.985507246 |
| PTPRZ1 AND NOT-FDPS | 0.985507246 | 0.98550725 | 0.985507246 |
| PTPRZ1 AND NOT-HS3ST5 | 0.970149254 | 1 | 0.942028986 |
| PTPRZ1 AND NOT-GPRC6A | 0.985507246 | 0.98550725 | 0.985507246 |
| PTPRZ1 AND NOT-ADGRF2 | 0.985507246 | 0.98550725 | 0.985507246 |
| PTPRZ1 AND LHFPL5 | 0.985507246 | 0.98550725 | 0.985507246 |
| GPM6B AND ALDH3A2 | 0.977777778 | 1 | 0.956521739 |
| PTPRZ1 AND ALDH3A2 | 0.977777778 | 1 | 0.956521739 |
| PTPRZ1 AND NOT-FGF6 | 0.985507246 | 0.98550725 | 0.985507246 |
| PTPRZ1 AND NOT-FGF10 | 0.985507246 | 0.98550725 | 0.985507246 |
| PTPRZ1 AND FGFR1 | 0.985507246 | 0.98550725 | 0.985507246 |
| PTPRZ1 AND NOT-CLCA4 | 0.985507246 | 0.98550725 | 0.985507246 |
| PTPRZ1 AND FKBP1A | 0.985507246 | 0.98550725 | 0.985507246 |
| PTPRZ1 AND NLGN4Y | 0.985507246 | 0.98550725 | 0.985507246 |
| PTPRZ1 AND NOT-LMTK2 | 0.985507246 | 0.98550725 | 0.985507246 |
| PTPRZ1 AND ADGRL1 | 0.985507246 | 0.98550725 | 0.985507246 |
| PTPRZ1 AND SLITRK3 | 0.985507246 | 0.98550725 | 0.985507246 |
| PTPRZ1 AND NLGN1 | 0.970149254 | 1 | 0.942028986 |
| PTPRZ1 AND SACM1L | 0.985507246 | 0.98550725 | 0.985507246 |
| PTPRZ1 AND NOT-ZP1 | 0.985507246 | 0.98550725 | 0.985507246 |
| PTPRZ1 AND NOT-SCAP | 0.985507246 | 0.98550725 | 0.985507246 |
| PTPRZ1 AND NOT-P2RX2 | 0.985507246 | 0.98550725 | 0.985507246 |
| PTPRZ1 AND DIP2C | 0.985507246 | 0.98550725 | 0.985507246 |
| PTPRZ1 AND SORCS3 | 0.985507246 | 0.98550725 | 0.985507246 |
| PTPRZ1 AND NOT-SV2C | 0.985294118 | 1 | 0.971014493 |
| PTPRZ1 AND NOT-PCNX | 0.985507246 | 0.98550725 | 0.985507246 |
| PTPRZ1 AND ABCB7 | 0.977777778 | 1 | 0.956521739 |
| PTPRZ1 AND KLHDC10 | 0.985507246 | 0.98550725 | 0.985507246 |
| PTPRZ1 AND TMCC1 | 0.985507246 | 0.98550725 | 0.985507246 |
| PTPRZ1 AND NOT-ENDOD1 | 0.985507246 | 0.98550725 | 0.985507246 |
| PTPRZ1 AND TBC1D2B | 0.985507246 | 0.98550725 | 0.985507246 |
| PTPRZ1 AND NFASC | 0.985507246 | 0.98550725 | 0.985507246 |
| PTPRZ1 AND NOT-ATP10B | 0.985507246 | 0.98550725 | 0.985507246 |
| PTPRZ1 AND PLXND1 | 0.985294118 | 1 | 0.971014493 |
| PTPRZ1 AND ANKLE2 | 0.99270073 | 1 | 0.985507246 |
| PTPRZ1 AND NOT-LRCH1 | 0.985507246 | 0.98550725 | 0.985507246 |
| PTPRZ1 AND GRAMD4 | 0.985507246 | 0.98550725 | 0.985507246 |
| TNFRSF13C AND NOT-GRM1 | 0.915662651 | 0.844444444 | 1 |
| TNFRSF13C AND NOT-GRM2 | 0.915662651 | 0.844444444 | 1 |
| TNFRSF13C AND NOT-GRM3 | 0.926829268 | 0.863636364 | 1 |
| TNFRSF13C AND NOT-GRM4 | 0.95 | 0.904761905 | 1 |
| TNFRSF13C AND NOT-GRM7 | 0.915662651 | 0.844444444 | 1 |
| TNFRSF13C AND NOT-CYP2S1 | 0.926829268 | 0.863636364 | 1 |
| TNFRSF13C AND NOT-GUCA2B | 0.915662651 | 0.844444444 | 1 |
| TNFRSF13C AND NOT-GUCY2F | 0.95 | 0.904761905 | 1 |
| TNFRSF13C AND NOT-NPC1L1 | 0.926829268 | 0.863636364 | 1 |
| TNFRSF13C AND NOT-PCDHB1 | 0.915662651 | 0.844444444 | 1 |
| TNFRSF13C AND NOT-LRP12 | 0.926829268 | 0.863636364 | 1 |
| TNFRSF13C AND NOT-HAS1 | 0.926829268 | 0.863636364 | 1 |
| TNFRSF13C AND NOT-HCRTR2 | 0.938271605 | 0.88372093 | 1 |
| TNFRSF13C AND NOT-HFE | 0.95 | 0.904761905 | 1 |
| TNFRSF13C AND NOT-ERVW-1 | 0.926829268 | 0.863636364 | 1 |
| TNFRSF13C AND NOT-HGF | 0.926829268 | 0.863636364 | 1 |
| TNFRSF13C AND HLA-DRA | 0.915662651 | 0.844444444 | 1 |
| TNFRSF13C AND NOT-SLC29A2 | 0.962025316 | 0.926829268 | 1 |
| TNFRSF13C AND NOT-HRH1 | 0.915662651 | 0.844444444 | 1 |
| TNFRSF13C AND NOT-HRH2 | 0.915662651 | 0.844444444 | 1 |
| TNFRSF13C AND NOT-HTR2C | 0.915662651 | 0.844444444 | 1 |
| TNFRSF13C AND NOT-HTR3A | 0.936708861 | 0.902439024 | 0.973684211 |
| TNFRSF13C AND NOT-HTR4 | 0.95 | 0.904761905 | 1 |
| TNFRSF13C AND NOT-HTR7 | 0.915662651 | 0.844444444 | 1 |
| TNFRSF13C AND NOT-CHSY3 | 0.948717949 | 0.925 | 0.973684211 |
| TNFRSF13C AND NOT-FFAR4 | 0.95 | 0.904761905 | 1 |
| TNFRSF13C AND NOT-ICAM4 | 0.95890411 | 1 | 0.921052632 |
| TNFRSF13C AND NOT-TMEM225 | 0.915662651 | 0.844444444 | 1 |
| TNFRSF13C AND NOT-B4GALNT4 | 0.926829268 | 0.863636364 | 1 |
| TNFRSF13C AND NOT-TMEM52 | 0.915662651 | 0.844444444 | 1 |
| TNFRSF13C AND NOT-SLC35E4 | 0.915662651 | 0.844444444 | 1 |
| TNFRSF13C AND NOT-LRRC66 | 0.915662651 | 0.844444444 | 1 |
| TNFRSF13C AND NOT-SLC35D3 | 0.915662651 | 0.844444444 | 1 |
| TNFRSF13C AND NOT-COX8C | 0.915662651 | 0.844444444 | 1 |
| TNFRSF13C AND NOT-KCNT2 | 0.915662651 | 0.844444444 | 1 |
| TNFRSF13C AND NOT-MOGAT3 | 0.926829268 | 0.863636364 | 1 |
| TNFRSF13C AND NOT-LRRTM1 | 0.926829268 | 0.863636364 | 1 |
| TNFRSF13C AND NOT-SERINC2 | 0.926829268 | 0.863636364 | 1 |
| TNFRSF13C AND NOT-SLC6A18 | 0.915662651 | 0.844444444 | 1 |
| TNFRSF13C AND NOT-RGSL1 | 0.95 | 0.904761905 | 1 |
| TNFRSF13C AND NOT-FASLG | 0.915662651 | 0.844444444 | 1 |
| TNFRSF13C AND NOT-IL12B | 0.915662651 | 0.844444444 | 1 |
| TNFRSF13C AND NOT-IL12RB2 | 0.962025316 | 0.926829268 | 1 |
| TNFRSF13C AND NOT-AQP6 | 0.915662651 | 0.844444444 | 1 |
| TNFRSF13C AND NOT-INSRR | 0.926829268 | 0.863636364 | 1 |
| TNFRSF13C AND NOT-ITGA5 | 0.938271605 | 0.88372093 | 1 |
| TNFRSF13C AND NOT-ABCC6 | 0.915662651 | 0.844444444 | 1 |
| TNFRSF13C AND NOT-ITGB3 | 0.926829268 | 0.863636364 | 1 |
| TNFRSF13C AND NOT-KCNA1 | 0.915662651 | 0.844444444 | 1 |
| TNFRSF13C AND NOT-KCNA4 | 0.961038961 | 0.948717949 | 0.973684211 |
| TNFRSF13C AND NOT-KCNB1 | 0.938271605 | 0.88372093 | 1 |
| TNFRSF13C AND NOT-KCNC2 | 0.948717949 | 0.925 | 0.973684211 |
| TNFRSF13C AND NOT-IGFL1 | 0.915662651 | 0.844444444 | 1 |
| TNFRSF13C AND NOT-KCND3 | 0.926829268 | 0.863636364 | 1 |
| TNFRSF13C AND NOT-KCNE1 | 0.915662651 | 0.844444444 | 1 |
| TNFRSF13C AND NOT-LHFPL4 | 0.926829268 | 0.863636364 | 1 |
| TNFRSF13C AND NOT-TMEM110 | 0.935064935 | 0.923076923 | 0.947368421 |
| TNFRSF13C AND NOT-KCNF1 | 0.915662651 | 0.844444444 | 1 |
| TNFRSF13C AND NOT-KCNG1 | 0.929577465 | 1 | 0.868421053 |
| TNFRSF13C AND NOT-KCNH1 | 0.915662651 | 0.844444444 | 1 |
| TNFRSF13C AND NOT-KCNJ4 | 0.915662651 | 0.844444444 | 1 |
| TNFRSF13C AND NOT-KCNJ12 | 0.938271605 | 0.88372093 | 1 |
| TNFRSF13C AND NOT-KCNJ14 | 0.915662651 | 0.844444444 | 1 |
| TNFRSF13C AND NOT-KCNK2 | 0.938271605 | 0.88372093 | 1 |
| TNFRSF13C AND NOT-KCNK3 | 0.915662651 | 0.844444444 | 1 |
| TNFRSF13C AND NOT-KCNN3 | 0.926829268 | 0.863636364 | 1 |
| TNFRSF13C AND NOT-KIR2DL4 | 0.95 | 0.904761905 | 1 |
| TNFRSF13C AND NOT-KIR2DS4 | 0.986666667 | 1 | 0.973684211 |
| TNFRSF13C AND NOT-KIR3DL2 | 0.987012987 | 0.974358974 | 1 |
| TNFRSF13C AND NOT-ILDR2 | 0.915662651 | 0.844444444 | 1 |
| TNFRSF13C AND NOT-CLEC12B | 0.915662651 | 0.844444444 | 1 |
| TNFRSF13C AND NOT-SMIM1 | 0.938271605 | 0.88372093 | 1 |
| TNFRSF13C AND NOT-TMEM212 | 0.926829268 | 0.863636364 | 1 |
| TNFRSF13C AND NOT-OR51I1 | 0.915662651 | 0.844444444 | 1 |
| TNFRSF13C AND NOT-OR52D1 | 0.915662651 | 0.844444444 | 1 |
| TNFRSF13C AND NOT-LHCGR | 0.915662651 | 0.844444444 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND CLCC1 | 0.977777778 | 1 | 0.956521739 | TNFRSF13C AND NOT-C11orf87 | 0.915662651 | 0.844444444 | 1 |
| PTPRZ1 AND NOT-MLANA | 0.985507246 | 0.98550725 | 0.985507246 | TNFRSF13C AND NOT-SERTM1 | 0.915662651 | 0.844444444 | 1 |
| PTPRZ1 AND STAB1 | 0.985507246 | 0.98550725 | 0.985507246 | TNFRSF13C AND NOT-C3orf80 | 0.915662651 | 0.844444444 | 1 |
| PTPRZ1 AND SLC35D1 | 0.985507246 | 0.98550725 | 0.985507246 | TNFRSF13C AND NOT-IFITM10 | 0.915662651 | 0.844444444 | 1 |
| PTPRZ1 AND GANAB | 0.977777778 | 1 | 0.956521739 | TNFRSF13C AND NOT-SPINK6 | 0.915662651 | 0.844444444 | 1 |
| PTPRZ1 AND NOT-ATP11B | 0.985507246 | 0.98550725 | 0.985507246 | TNFRSF13C AND NOT-CTXN1 | 0.915662651 | 0.844444444 | 1 |
| PTPRZ1 AND ARL6IP1 | 0.985507246 | 0.98550725 | 0.985507246 | TNFRSF13C AND NOT-ERVFRD-1 | 0.926829268 | 0.863636364 | 1 |
| SYT11 AND NOT-ABCB9 | 0.970149254 | 1 | 0.942028986 | TNFRSF13C AND NOT-FAM19A1 | 0.915662651 | 0.844444444 | 1 |
| SYT11 AND NOT-ABCA6 | 0.977777778 | 1 | 0.956521739 | TNFRSF13C AND NOT-MAG | 0.915662651 | 0.844444444 | 1 |
| SYT11 AND NOT-LPCAT4 | 0.99270073 | 1 | 0.985507246 | TNFRSF13C AND NOT-ARSB | 0.948717949 | 0.925 | 0.973684211 |
| SYT11 AND NOT-CDRT15L2 | 0.985507246 | 0.98550725 | 0.985507246 | TNFRSF13C AND NOT-MAS1 | 0.915662651 | 0.844444444 | 1 |
| SYT11 AND NOT-CYP4X1 | 0.99270073 | 1 | 0.985507246 | TNFRSF13C AND NOT-ARSE | 0.915662651 | 0.844444444 | 1 |
| SYT11 AND NOT-IL1RAPL2 | 0.985507246 | 0.98550725 | 0.985507246 | TNFRSF13C AND NOT-MC2R | 0.915662651 | 0.844444444 | 1 |
| SYT11 AND NOT-SMIM24 | 0.985507246 | 0.98550725 | 0.985507246 | TNFRSF13C AND NOT-ARSF | 0.926829268 | 0.863636364 | 1 |
| SYT11 AND SPCS1 | 0.970149254 | 1 | 0.942028986 | TNFRSF13C AND NOT-MC4R | 0.938271605 | 0.88372093 | 1 |
| SYT11 AND SLC25A5 | 0.99270073 | 1 | 0.985507246 | TNFRSF13C AND NOT-ADAM11 | 0.915662651 | 0.844444444 | 1 |
| SYT11 AND NOT-HCN1 | 0.985294118 | 1 | 0.971014493 | TNFRSF13C AND NOT-MLN | 0.95 | 0.904761905 | 1 |
| SYT11 AND ITGAV | 0.977777778 | 1 | 0.956521739 | TNFRSF13C AND NOT-ASGR1 | 0.926829268 | 0.863636364 | 1 |
| SYT11 AND NOT-KCNA1 | 0.985294118 | 1 | 0.971014493 | TNFRSF13C AND NOT-MOG | 0.915662651 | 0.844444444 | 1 |
| SYT11 AND NOT-KCNC4 | 0.970149254 | 1 | 0.942028986 | TNFRSF13C AND NOT-MPL | 0.938271605 | 0.88372093 | 1 |
| SYT11 AND NOT-KCNJ12 | 0.977777778 | 1 | 0.956521739 | TNFRSF13C AND NOT-MPZ | 0.938271605 | 0.88372093 | 1 |
| SYT11 AND NOT-KCNS1 | 0.99270073 | 1 | 0.985507246 | TNFRSF13C AND NOT-SMCO3 | 0.915662651 | 0.844444444 | 1 |
| SYT11 AND NOT-KEL | 0.977777778 | 1 | 0.956521739 | TNFRSF13C AND NOT-LRRC52 | 0.936708861 | 0.902439024 | 0.973684211 |
| SYT11 AND NOT-KIR3DL2 | 0.985507246 | 0.98550725 | 0.985507246 | TNFRSF13C AND NOT-SMIM4 | 0.915662651 | 0.844444444 | 1 |
| SYT11 AND NOT-FAM209B | 0.985507246 | 0.98550725 | 0.985507246 | TNFRSF13C AND NOT-PTCHD4 | 0.915662651 | 0.844444444 | 1 |
| SYT11 AND NOT-LMO7 | 0.977777778 | 1 | 0.956521739 | TNFRSF13C AND NOT-MSMB | 0.915662651 | 0.844444444 | 1 |
| SYT11 AND NOT-ADAM11 | 0.99270073 | 1 | 0.985507246 | TNFRSF13C AND NOT-MST1R | 0.938271605 | 0.88372093 | 1 |
| SYT11 AND NDUFB5 | 0.977777778 | 1 | 0.956521739 | TNFRSF13C AND NOT-NCAM1 | 0.938271605 | 0.88372093 | 1 |
| SYT11 AND NOT-NTF3 | 0.985294118 | 1 | 0.971014493 | TNFRSF13C AND NOT-NDUFB3 | 0.915662651 | 0.844444444 | 1 |
| SYT11 AND NOT-OCA2 | 0.985507246 | 0.98550725 | 0.985507246 | TNFRSF13C AND NOT-ATP1A2 | 0.915662651 | 0.844444444 | 1 |
| SYT11 AND NOT-OPRK1 | 0.970149254 | 1 | 0.942028986 | TNFRSF13C AND NOT-ATP1A3 | 0.95 | 0.904761905 | 1 |
| SYT11 AND NOT-OR1F1 | 0.99270073 | 1 | 0.985507246 | TNFRSF13C AND NOT-ATP1A4 | 0.95 | 0.904761905 | 1 |
| SYT11 AND NOT-ANO7 | 0.985507246 | 0.98550725 | 0.985507246 | TNFRSF13C AND NOT-NGFR | 0.915662651 | 0.844444444 | 1 |
| SYT11 AND NOT-ATL1 | 0.985507246 | 0.98550725 | 0.985507246 | TNFRSF13C AND NOT-NPY | 0.948717949 | 0.925 | 0.973684211 |
| SYT11 AND TMX2 | 0.970149254 | 1 | 0.942028986 | TNFRSF13C AND NOT-NPPA | 0.987012987 | 0.974358974 | 1 |
| SYT11 AND TMEM14C | 0.970149254 | 1 | 0.942028986 | TNFRSF13C AND NOT-NPR3 | 0.938271605 | 0.88372093 | 1 |
| SYT11 AND NOT-ATP8A2 | 0.985294118 | 1 | 0.971014493 | TNFRSF13C AND NOT-NT5E | 0.931506849 | 0.971428571 | 0.894736842 |
| SYT11 AND NOT-SMIM11 | 0.985507246 | 0.98550725 | 0.985507246 | TNFRSF13C AND NOT-NTF3 | 0.915662651 | 0.844444444 | 1 |
| SYT11 AND SLC38A2 | 0.977777778 | 1 | 0.956521739 | TNFRSF13C AND NOT-NTRK1 | 0.926829268 | 0.863636364 | 1 |
| SYT11 AND NOT-MRAP | 0.977777778 | 1 | 0.956521739 | TNFRSF13C AND NOT-ATP2B3 | 0.915662651 | 0.844444444 | 1 |
| SYT11 AND NOT-OTOR | 0.970149254 | 1 | 0.942028986 | TNFRSF13C AND NOT-OPRL1 | 0.915662651 | 0.844444444 | 1 |
| SYT11 AND NOT-PTGER3 | 0.99270073 | 1 | 0.985507246 | TNFRSF13C AND NOT-OR1F1 | 0.915662651 | 0.844444444 | 1 |
| SYT11 AND NOT-PTPRR | 0.970149254 | 1 | 0.942028986 | TNFRSF13C AND NOT-OR3A1 | 0.938271605 | 0.88372093 | 1 |
| PTPRZ1 AND SYT11 | 0.985294118 | 1 | 0.971014493 | TNFRSF13C AND NOT-OR3A2 | 0.926829268 | 0.863636364 | 1 |
| SYT11 AND SELK | 0.977777778 | 1 | 0.956521739 | TNFRSF13C AND NOT-GALNT9 | 0.926829268 | 0.863636364 | 1 |
| SYT11 AND NOT-ABCG4 | 0.985294118 | 1 | 0.971014493 | TNFRSF13C AND NOT-IL22 | 0.915662651 | 0.844444444 | 1 |
| SYT11 AND NOT-WBSCR17 | 0.970149254 | 1 | 0.942028986 | TNFRSF13C AND NOT-CALY | 0.915662651 | 0.844444444 | 1 |
| SYT11 AND NOT-SYNDIG1L | 0.970149254 | 1 | 0.942028986 | TNFRSF13C AND NOT-SLC45A1 | 0.938271605 | 0.88372093 | 1 |
| SYT11 AND NOT-SLC10A1 | 0.977777778 | 1 | 0.956521739 | TNFRSF13C AND NOT-KCNK4 | 0.915662651 | 0.844444444 | 1 |
| SYT11 AND NOT-SLC15A1 | 0.977777778 | 1 | 0.956521739 | TNFRSF13C AND NOT-TAS2R3 | 0.926829268 | 0.863636364 | 1 |
| SYT11 AND NOT-VAMP1 | 0.99270073 | 1 | 0.985507246 | TNFRSF13C AND NOT-TAS2R16 | 0.936708861 | 0.902439024 | 0.973684211 |
| SYT11 AND NOT-TSPAN8 | 0.99270073 | 1 | 0.985507246 | TNFRSF13C AND NOT-TAS2R13 | 0.915662651 | 0.844444444 | 1 |
| SYT11 AND NOT-TRPV1 | 0.99270073 | 1 | 0.985507246 | TNFRSF13C AND NOT-TAS2R14 | 0.915662651 | 0.844444444 | 1 |
| SYT11 AND WRB | 0.985507246 | 0.98550725 | 0.985507246 | TNFRSF13C AND NOT-CDON | 0.926829268 | 0.863636364 | 1 |
| SYT11 AND PTTG1IP | 0.985294118 | 1 | 0.971014493 | TNFRSF13C AND NOT-PCDHGC3 | 0.938271605 | 0.88372093 | 1 |
| SYT11 AND NOT-PQLC1 | 0.985294118 | 1 | 0.971014493 | TNFRSF13C AND NOT-SLC45A2 | 0.915662651 | 0.844444444 | 1 |
| SYT11 AND NOT-AGPAT9 | 0.970149254 | 1 | 0.942028986 | TNFRSF13C AND NOT-DUSP13 | 0.915662651 | 0.844444444 | 1 |
| SYT11 AND NOT-DGKE | 0.985294118 | 1 | 0.971014493 | TNFRSF13C AND NOT-AIG1 | 0.948717949 | 0.925 | 0.973684211 |
| SYT11 AND ATP6V0E1 | 0.970149254 | 1 | 0.942028986 | TNFRSF13C AND NOT-NBAS | 0.936708861 | 0.902439024 | 0.973684211 |
| SYT11 AND NOT-SYNGR3 | 0.985507246 | 0.98550725 | 0.985507246 | TNFRSF13C AND NOT-CD244 | 0.915662651 | 0.844444444 | 1 |
| SYT11 AND NOT-VAPB | 0.985294118 | 1 | 0.971014493 | TNFRSF13C AND NOT-ATP8A2 | 0.915662651 | 0.844444444 | 1 |
| SYT11 AND NOT-CD8B | 0.985507246 | 0.98550725 | 0.985507246 | TNFRSF13C AND NOT-TUBA8 | 0.915662651 | 0.844444444 | 1 |
| SYT11 AND NOT-CYP7B1 | 0.985507246 | 0.98550725 | 0.985507246 | TNFRSF13C AND SLC25A3 | 0.915662651 | 0.844444444 | 1 |
| SYT11 AND NOT-SIGLEC6 | 0.99270073 | 1 | 0.985507246 | TNFRSF13C AND NOT-PLA2G2A | 0.915662651 | 0.844444444 | 1 |
| SYT11 AND CD63 | 0.970149254 | 1 | 0.942028986 | TNFRSF13C AND NOT-IL17D | 0.915662651 | 0.844444444 | 1 |
| PTPRZ1 AND NUP210 | 0.985507246 | 0.98550725 | 0.985507246 | TNFRSF13C AND NOT-ADAM22 | 0.915662651 | 0.844444444 | 1 |
| PTPRZ1 AND NOT-FLT3 | 0.985294118 | 1 | 0.971014493 | TNFRSF13C AND NOT-FXYD4 | 0.948717949 | 0.925 | 0.973684211 |
| PTPRZ1 AND SEL1L3 | 0.985507246 | 0.98550725 | 0.985507246 | TNFRSF13C AND NOT-GPR84 | 0.926829268 | 0.863636364 | 1 |
| PTPRZ1 AND NOT-FLT3LG | 0.985507246 | 0.98550725 | 0.985507246 | TNFRSF13C AND NOT-IL20RA | 0.915662651 | 0.844444444 | 1 |
| PTPRZ1 AND ASTN2 | 0.985507246 | 0.98550725 | 0.985507246 | TNFRSF13C AND NOT-IL20RB | 0.915662651 | 0.844444444 | 1 |
| PTPRZ1 AND NOT-ATP11A | 0.985507246 | 0.98550725 | 0.985507246 | TNFRSF13C AND NOT-CDHR5 | 0.915662651 | 0.844444444 | 1 |
| PTPRZ1 AND DENND5A | 0.985507246 | 0.98550725 | 0.985507246 | TNFRSF13C AND NOT-ATP7B | 0.915662651 | 0.844444444 | 1 |
| PTPRZ1 AND NOT-ADGRL2 | 0.985507246 | 0.98550725 | 0.985507246 | TNFRSF13C AND NOT-GPR88 | 0.926829268 | 0.863636364 | 1 |
| PTPRZ1 AND NOT-FMO2 | 0.985507246 | 0.98550725 | 0.985507246 | TNFRSF13C AND NOT-TREM2 | 0.95 | 0.904761905 | 1 |
| PTPRZ1 AND ADGRL3 | 0.985507246 | 0.98550725 | 0.985507246 | TNFRSF13C AND NOT-GPR85 | 0.915662651 | 0.844444444 | 1 |
| PTPRZ1 AND FMO3 | 0.985507246 | 0.98550725 | 0.985507246 | TNFRSF13C AND NOT-WNT4 | 0.915662651 | 0.844444444 | 1 |

FIG. 1 (CONT.)

| Antigen Pair Logic | F1 | Precision | Recall |
|---|---|---|---|
| GPM6B AND NEMP1 | 0.970149254 | 1 | 0.942028986 |
| PTPRZ1 AND NEMP1 | 0.970149254 | 1 | 0.942028986 |
| PTPRZ1 AND NOT-FMO5 | 0.985507246 | 0.98550725 | 0.985507246 |
| PTPRZ1 AND SLC9A8 | 0.985507246 | 0.98550725 | 0.985507246 |
| PTPRZ1 AND DPY19L1 | 0.985507246 | 0.98550725 | 0.985507246 |
| PTPRZ1 AND SUN1 | 0.985507246 | 0.98550725 | 0.985507246 |
| PTPRZ1 AND NCSTN | 0.970149254 | 1 | 0.942028986 |
| PTPRZ1 AND NOT-KCNH3 | 0.99270073 | 1 | 0.985507246 |
| PTPRZ1 AND CRB1 | 0.985507246 | 0.98550725 | 0.985507246 |
| PTPRZ1 AND NOT-TMED3 | 0.985507246 | 0.98550725 | 0.985507246 |
| PTPRZ1 AND NOT-SLC7A8 | 0.985507246 | 0.98550725 | 0.985507246 |
| PTPRZ1 AND GPR161 | 0.985507246 | 0.98550725 | 0.985507246 |
| PTPRZ1 AND SLC35A3 | 0.99270073 | 1 | 0.985507246 |
| PTPRZ1 AND ABCB10 | 0.99270073 | 1 | 0.985507246 |
| PTPRZ1 AND NOT-ABCB9 | 0.970149254 | 1 | 0.942028986 |
| PTPRZ1 AND NOT-ABCA5 | 0.985507246 | 0.98550725 | 0.985507246 |
| PTPRZ1 AND NOT-ICMT | 0.985507246 | 0.98550725 | 0.985507246 |
| PTPRZ1 AND TRAM1 | 0.99270073 | 1 | 0.985507246 |
| GPM6B AND SEC11A | 0.977777778 | 1 | 0.956521739 |
| PTPRZ1 AND SEC11A | 0.977777778 | 1 | 0.956521739 |
| GPM6B AND SEC61G | 0.970149254 | 1 | 0.942028986 |
| GPM6B AND LEPROTL1 | 0.977777778 | 1 | 0.956521739 |
| PTPRZ1 AND LEPROTL1 | 0.977777778 | 1 | 0.956521739 |
| PTPRZ1 AND NOT-FOLR1 | 0.985507246 | 0.98550725 | 0.985507246 |
| PTPRZ1 AND MACF1 | 0.985507246 | 0.98550725 | 0.985507246 |
| PTPRZ1 AND TMEM131 | 0.977777778 | 1 | 0.956521739 |
| PTPRZ1 AND NOT-LRRC8B | 0.985507246 | 0.98550725 | 0.985507246 |
| PTPRZ1 AND SLC39A14 | 0.985507246 | 0.98550725 | 0.985507246 |
| PTPRZ1 AND NNT | 0.985507246 | 0.98550725 | 0.985507246 |
| PTPRZ1 AND MMD | 0.985507246 | 0.98550725 | 0.985507246 |
| PTPRZ1 AND NOT-SLC16A8 | 0.985507246 | 0.98550725 | 0.985507246 |
| PTPRZ1 AND SEZ6L | 0.985507246 | 0.98550725 | 0.985507246 |
| PTPRZ1 AND ATP6V0A2 | 0.985507246 | 0.98550725 | 0.985507246 |
| PTPRZ1 AND NOT-HYAL4 | 0.985507246 | 0.98550725 | 0.985507246 |
| PTPRZ1 AND TSPAN12 | 0.985507246 | 0.98550725 | 0.985507246 |
| PTPRZ1 AND NOT-TSPAN15 | 0.985507246 | 0.98550725 | 0.985507246 |
| PTPRZ1 AND PIGN | 0.985507246 | 0.98550725 | 0.985507246 |
| PTPRZ1 AND CLDN14 | 0.985507246 | 0.98550725 | 0.985507246 |
| PTPRZ1 AND FPR1 | 0.985507246 | 0.98550725 | 0.985507246 |
| PTPRZ1 AND NOT-VSIG2 | 0.985507246 | 0.98550725 | 0.985507246 |
| PTPRZ1 AND NOT-TMEM50A | 0.985507246 | 0.98550725 | 0.985507246 |
| PTPRZ1 AND LEMD3 | 0.99270073 | 1 | 0.985507246 |
| PTPRZ1 AND NOT-OPN3 | 0.985507246 | 0.98550725 | 0.985507246 |
| PTPRZ1 AND FPR3 | 0.985507246 | 0.98550725 | 0.985507246 |
| PTPRZ1 AND CLEC5A | 0.985507246 | 0.98550725 | 0.985507246 |
| PTPRZ1 AND NOT-NTSR2 | 0.985507246 | 0.98550725 | 0.985507246 |
| PTPRZ1 AND KCNE5 | 0.985507246 | 0.98550725 | 0.985507246 |
| PTPRZ1 AND CA14 | 0.985507246 | 0.98550725 | 0.985507246 |
| PTPRZ1 AND RABGAP1 | 0.985507246 | 0.98550725 | 0.985507246 |
| PTPRZ1 AND PLD3 | 0.985507246 | 0.98550725 | 0.985507246 |
| PTPRZ1 AND NOT-TMEM2 | 0.985507246 | 0.98550725 | 0.985507246 |
| PTPRZ1 AND KCNE4 | 0.985507246 | 0.98550725 | 0.985507246 |
| PTPRZ1 AND NOT-FRRS1L | 0.970149254 | 1 | 0.942028986 |
| PTPRZ1 AND SDF2L1 | 0.985507246 | 0.98550725 | 0.985507246 |
| PTPRZ1 AND IL17RA | 0.985507246 | 0.98550725 | 0.985507246 |
| PTPRZ1 AND NOT-FLRT3 | 0.985507246 | 0.98550725 | 0.985507246 |
| PTPRZ1 AND NOT-FLRT2 | 0.985507246 | 0.98550725 | 0.985507246 |
| PTPRZ1 AND FLRT1 | 0.985507246 | 0.98550725 | 0.985507246 |
| PTPRZ1 AND NOT-FKBP8 | 0.985507246 | 0.98550725 | 0.985507246 |
| PTPRZ1 AND BCL2L13 | 0.985507246 | 0.98550725 | 0.985507246 |
| PTPRZ1 AND NOT-LAMP5 | 0.985507246 | 0.98550725 | 0.985507246 |
| PTPRZ1 AND PANX1 | 0.99270073 | 1 | 0.985507246 |
| PTPRZ1 AND CLDN15 | 0.985507246 | 0.98550725 | 0.985507246 |
| PTPRZ1 AND FJX1 | 0.977777778 | 1 | 0.956521739 |
| PTPRZ1 AND ALOX5AP | 0.985507246 | 0.98550725 | 0.985507246 |
| PTPRZ1 AND NOT-MS4A6E | 0.985507246 | 0.98550725 | 0.985507246 |
| PTPRZ1 AND NOT-ABCA4 | 0.985507246 | 0.98550725 | 0.985507246 |
| PTPRZ1 AND NOT-FUT1 | 0.985507246 | 0.98550725 | 0.985507246 |
| PTPRZ1 AND NOT-FUT2 | 0.985507246 | 0.98550725 | 0.985507246 |
| PTPRZ1 AND NOT-FUT3 | 0.985294118 | 1 | 0.971014493 |
| PTPRZ1 AND FUT4 | 0.985507246 | 0.98550725 | 0.985507246 |
| PTPRZ1 AND NOT-FUT6 | 0.985507246 | 0.98550725 | 0.985507246 |
| PTPRZ1 AND NOT-FNDC5 | 0.985507246 | 0.98550725 | 0.985507246 |
| PTPRZ1 AND NOT-FUT7 | 0.99270073 | 1 | 0.985507246 |
| PTPRZ1 AND HEPACAM2 | 0.985507246 | 0.98550725 | 0.985507246 |
| PTPRZ1 AND TECRL | 0.985507246 | 0.98550725 | 0.985507246 |

| Antigen Pair Logic | F1 | Precision | Recall |
|---|---|---|---|
| TNFRSF13C AND NOT-NLGN3 | 0.926829268 | 0.863636364 | 1 |
| TNFRSF13C AND NOT-PON3 | 0.915662651 | 0.844444444 | 1 |
| TNFRSF13C AND NOT-FAM105A | 0.915662651 | 0.844444444 | 1 |
| TNFRSF13C AND NOT-EQTN | 0.915662651 | 0.844444444 | 1 |
| TNFRSF13C AND NOT-SLC6A20 | 0.926829268 | 0.863636364 | 1 |
| TNFRSF13C AND NOT-LY6K | 0.938271605 | 0.88372093 | 1 |
| TNFRSF13C AND NOT-FAM20A | 0.926829268 | 0.863636364 | 1 |
| TNFRSF13C AND NOT-DCHS2 | 0.915662651 | 0.844444444 | 1 |
| TNFRSF13C AND NOT-PQLC2 | 0.962025316 | 0.926829268 | 1 |
| TNFRSF13C AND NOT-HRASLS2 | 0.926829268 | 0.863636364 | 1 |
| TNFRSF13C AND NOT-ACPP | 0.938271605 | 0.88372093 | 1 |
| TNFRSF13C AND NOT-TMEM51 | 0.938271605 | 0.88372093 | 1 |
| TNFRSF13C AND NOT-SLC6A15 | 0.915662651 | 0.844444444 | 1 |
| TNFRSF13C AND NOT-EVA1B | 0.926829268 | 0.863636364 | 1 |
| TNFRSF13C AND NOT-KIRREL | 0.938271605 | 0.88372093 | 1 |
| TNFRSF13C AND NOT-TMEM40 | 0.915662651 | 0.844444444 | 1 |
| TNFRSF13C AND NOT-SLC35C1 | 0.987012987 | 0.974358974 | 1 |
| TNFRSF13C AND NOT-VNN3 | 0.915662651 | 0.844444444 | 1 |
| TNFRSF13C AND NOT-STYK1 | 0.915662651 | 0.844444444 | 1 |
| TNFRSF13C AND NOT-SVOP | 0.915662651 | 0.844444444 | 1 |
| TNFRSF13C AND NOT-POMGNT1 | 0.938271605 | 0.88372093 | 1 |
| TNFRSF13C AND NOT-FAR2 | 0.915662651 | 0.844444444 | 1 |
| TNFRSF13C AND NOT-TENM3 | 0.926829268 | 0.863636364 | 1 |
| TNFRSF13C AND NOT-TEX2 | 0.938271605 | 0.88372093 | 1 |
| TNFRSF13C AND NOT-GABRQ | 0.915662651 | 0.844444444 | 1 |
| TNFRSF13C AND NOT-ACSS2 | 0.926829268 | 0.863636364 | 1 |
| TNFRSF13C AND NOT-AJAP1 | 0.961038961 | 0.948717949 | 0.973684211 |
| TNFRSF13C AND NOT-PCDHGA11 | 0.915662651 | 0.844444444 | 1 |
| TNFRSF13C AND NOT-PCDHB12 | 0.915662651 | 0.844444444 | 1 |
| TNFRSF13C AND NOT-PCDHA10 | 0.938271605 | 0.88372093 | 1 |
| TNFRSF13C AND NOT-SLC7A10 | 0.95 | 0.904761905 | 1 |
| TNFRSF13C AND NOT-PRRG2 | 0.926829268 | 0.863636364 | 1 |
| TNFRSF13C AND NOT-TMPRSS4 | 0.962025316 | 0.926829268 | 1 |
| TNFRSF13C AND NOT-NDUFA4L2 | 0.95 | 0.904761905 | 1 |
| TNFRSF13C AND NOT-OTOR | 0.948717949 | 0.925 | 0.973684211 |
| TNFRSF13C AND NOT-C2orf83 | 0.915662651 | 0.844444444 | 1 |
| TNFRSF13C AND NOT-CEACAM19 | 0.915662651 | 0.844444444 | 1 |
| TNFRSF13C AND NOT-CHRNA10 | 0.915662651 | 0.844444444 | 1 |
| TNFRSF13C AND NOT-ENTPD7 | 0.95 | 0.904761905 | 1 |
| TNFRSF13C AND NOT-ANO2 | 0.936708861 | 0.902439024 | 0.973684211 |
| TNFRSF13C AND NOT-TMEM63C | 0.915662651 | 0.844444444 | 1 |
| TNFRSF13C AND NOT-JPH2 | 0.915662651 | 0.844444444 | 1 |
| TNFRSF13C AND NOT-GJC2 | 0.915662651 | 0.844444444 | 1 |
| TNFRSF13C AND NOT-PTAFR | 0.962025316 | 0.926829268 | 1 |
| TNFRSF13C AND NOT-TAS2R38 | 0.915662651 | 0.844444444 | 1 |
| TNFRSF13C AND NOT-PTGDR | 0.915662651 | 0.844444444 | 1 |
| TNFRSF13C AND NOT-PTGER1 | 0.948717949 | 0.925 | 0.973684211 |
| TNFRSF13C AND NOT-PTGER3 | 0.926829268 | 0.863636364 | 1 |
| TNFRSF13C AND NOT-JPH3 | 0.915662651 | 0.844444444 | 1 |
| TNFRSF13C AND NOT-PTGFR | 0.926829268 | 0.863636364 | 1 |
| TNFRSF13C AND NOT-PTGIS | 0.915662651 | 0.844444444 | 1 |
| TNFRSF13C AND NOT-KIAA1324 | 0.915662651 | 0.844444444 | 1 |
| TNFRSF13C AND NOT-PCDH10 | 0.915662651 | 0.844444444 | 1 |
| TNFRSF13C AND NOT-ISLR2 | 0.962025316 | 0.926829268 | 1 |
| TNFRSF13C AND NOT-DPP10 | 0.915662651 | 0.844444444 | 1 |
| TNFRSF13C AND NOT-KIAA1549 | 0.915662651 | 0.844444444 | 1 |
| TNFRSF13C AND NOT-BRINP2 | 0.915662651 | 0.844444444 | 1 |
| TNFRSF13C AND NOT-G6PC2 | 0.915662651 | 0.844444444 | 1 |
| TNFRSF13C AND NOT-SLC4A5 | 0.926829268 | 0.863636364 | 1 |
| TNFRSF13C AND NOT-CADM3 | 0.915662651 | 0.844444444 | 1 |
| TNFRSF13C AND NOT-PTPRH | 0.926829268 | 0.863636364 | 1 |
| TNFRSF13C AND NOT-PVR | 0.926829268 | 0.863636364 | 1 |
| TNFRSF13C AND NOT-DNASE2B | 0.915662651 | 0.844444444 | 1 |
| TNFRSF13C AND NOT-BCHE | 0.915662651 | 0.844444444 | 1 |
| TNFRSF13C AND NOT-ACE2 | 0.915662651 | 0.844444444 | 1 |
| TNFRSF13C AND NOT-CACNG8 | 0.926829268 | 0.863636364 | 1 |
| TNFRSF13C AND NOT-CACNG6 | 0.915662651 | 0.844444444 | 1 |
| TNFRSF13C AND NOT-HRH4 | 0.915662651 | 0.844444444 | 1 |
| TNFRSF13C AND NOT-LGR6 | 0.915662651 | 0.844444444 | 1 |
| TNFRSF13C AND NOT-PRPH2 | 0.938271605 | 0.88372093 | 1 |
| TNFRSF13C AND NOT-RHAG | 0.95 | 0.904761905 | 1 |
| TNFRSF13C AND NOT-RHCE | 0.973684211 | 0.973684211 | 0.973684211 |
| TNFRSF13C AND NOT-RHO | 0.962025316 | 0.926829268 | 1 |
| TNFRSF13C AND NOT-EDA2R | 0.915662651 | 0.844444444 | 1 |
| TNFRSF13C AND NOT-CDH26 | 0.938271605 | 0.88372093 | 1 |
| TNFRSF13C AND NOT-SLC5A7 | 0.915662651 | 0.844444444 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-FUT8 | 0.985507246 | 0.98550725 | 0.985507246 | TNFRSF13C AND NOT-CTXN3 | 0.926829268 | 0.863636364 | 1 |
| PTPRZ1 AND NOT-EPHX4 | 0.985507246 | 0.98550725 | 0.985507246 | TNFRSF13C AND NOT-RTN2 | 0.938271605 | 0.88372093 | 1 |
| PTPRZ1 AND KDSR | 0.985507246 | 0.98550725 | 0.985507246 | TNFRSF13C AND NOT-BDNF | 0.915662651 | 0.844444444 | 1 |
| PTPRZ1 AND NOT-ACKR1 | 0.985507246 | 0.98550725 | 0.985507246 | TNFRSF13C AND NOT-SCN1A | 0.915662651 | 0.844444444 | 1 |
| PTPRZ1 AND LCLAT1 | 0.970149254 | 1 | 0.942028986 | TNFRSF13C AND NOT-SCN1B | 0.915662651 | 0.844444444 | 1 |
| PTPRZ1 AND FZD2 | 0.985507246 | 0.98550725 | 0.985507246 | TNFRSF13C AND NOT-SCN2B | 0.926829268 | 0.863636364 | 1 |
| PTPRZ1 AND CERS6 | 0.99270073 | 1 | 0.985507246 | TNFRSF13C AND NOT-SCN3A | 0.935064935 | 0.923076923 | 0.947368421 |
| PTPRZ1 AND NOT-IFI6 | 0.985507246 | 0.98550725 | 0.985507246 | TNFRSF13C AND NOT-SCN8A | 0.915662651 | 0.844444444 | 1 |
| PTPRZ1 AND NOT-G6PC | 0.985507246 | 0.98550725 | 0.985507246 | TNFRSF13C AND NOT-SCN9A | 0.915662651 | 0.844444444 | 1 |
| PTPRZ1 AND NOT-FAM26E | 0.985294118 | 1 | 0.971014493 | TNFRSF13C AND NOT-CDH23 | 0.915662651 | 0.844444444 | 1 |
| PTPRZ1 AND ZDHHC24 | 0.985507246 | 0.98550725 | 0.985507246 | TNFRSF13C AND NOT-SLC39A8 | 0.936708861 | 0.902439024 | 0.973684211 |
| PTPRZ1 AND NOT-NAALADL2 | 0.985507246 | 0.98550725 | 0.985507246 | TNFRSF13C AND NOT-MS4A5 | 0.915662651 | 0.844444444 | 1 |
| PTPRZ1 AND TMEM256 | 0.985507246 | 0.98550725 | 0.985507246 | TNFRSF13C AND NOT-ABCG8 | 0.926829268 | 0.863636364 | 1 |
| PTPRZ1 AND NOT-ZDHHC23 | 0.985507246 | 0.98550725 | 0.985507246 | TNFRSF13C AND NOT-CHST8 | 0.938271605 | 0.88372093 | 1 |
| PTPRZ1 AND NOT-TMEM86B | 0.985507246 | 0.98550725 | 0.985507246 | TNFRSF13C AND NOT-SFTPC | 0.926829268 | 0.863636364 | 1 |
| PTPRZ1 AND NOT-GABBR1 | 0.985507246 | 0.98550725 | 0.985507246 | TNFRSF13C AND NOT-PIRT | 0.915662651 | 0.844444444 | 1 |
| PTPRZ1 AND NOT-CCDC108 | 0.985507246 | 0.98550725 | 0.985507246 | TNFRSF13C AND NOT-SGCD | 0.915662651 | 0.844444444 | 1 |
| PTPRZ1 AND NOT-TMCO4 | 0.985507246 | 0.98550725 | 0.985507246 | TNFRSF13C AND NOT-SMIM10 | 0.915662651 | 0.844444444 | 1 |
| PTPRZ1 AND NOT-MCOLN2 | 0.985507246 | 0.98550725 | 0.985507246 | TNFRSF13C AND NOT-CSMD1 | 0.915662651 | 0.844444444 | 1 |
| PTPRZ1 AND NOT-GABRA2 | 0.985507246 | 0.98550725 | 0.985507246 | TNFRSF13C AND NOT-NDST4 | 0.915662651 | 0.844444444 | 1 |
| PTPRZ1 AND INAFM1 | 0.985507246 | 0.98550725 | 0.985507246 | TNFRSF13C AND NOT-SHH | 0.936708861 | 0.902439024 | 0.973684211 |
| PTPRZ1 AND NOT-GABRA5 | 0.985507246 | 0.98550725 | 0.985507246 | TNFRSF13C AND NOT-HRCT1 | 0.915662651 | 0.844444444 | 1 |
| PTPRZ1 AND CNEP1R1 | 0.985507246 | 0.98550725 | 0.985507246 | TNFRSF13C AND NOT-MARC1 | 0.915662651 | 0.844444444 | 1 |
| PTPRZ1 AND SYT14 | 0.985507246 | 0.98550725 | 0.985507246 | TNFRSF13C AND NOT-P2RY12 | 0.915662651 | 0.844444444 | 1 |
| PTPRZ1 AND GABRB1 | 0.985507246 | 0.98550725 | 0.985507246 | TNFRSF13C AND NOT-IL25 | 0.948717949 | 0.925 | 0.973684211 |
| PTPRZ1 AND NOT-TMEM196 | 0.985507246 | 0.98550725 | 0.985507246 | TNFRSF13C AND NOT-ST3GAL4 | 0.915662651 | 0.844444444 | 1 |
| PTPRZ1 AND NOT-CDRT15L2 | 0.99270073 | 1 | 0.985507246 | TNFRSF13C AND NOT-ST3GAL3 | 0.936708861 | 0.902439024 | 0.973684211 |
| PTPRZ1 AND NOT-STEAP1B | 0.985507246 | 0.98550725 | 0.985507246 | TNFRSF13C AND NOT-PCDH20 | 0.915662651 | 0.844444444 | 1 |
| PTPRZ1 AND NOT-GABRB3 | 0.985507246 | 0.98550725 | 0.985507246 | TNFRSF13C AND NOT-SLC1A6 | 0.926829268 | 0.863636364 | 1 |
| PTPRZ1 AND NOT-ST6GALNAC3 | 0.985507246 | 0.98550725 | 0.985507246 | TNFRSF13C AND NOT-SLC2A4 | 0.915662651 | 0.844444444 | 1 |
| PTPRZ1 AND NOT-MFSD8 | 0.985507246 | 0.98550725 | 0.985507246 | TNFRSF13C AND NOT-SLC5A2 | 0.95 | 0.904761905 | 1 |
| PTPRZ1 AND NOT-GABRG1 | 0.970149254 | 1 | 0.942028986 | TNFRSF13C AND NOT-SLC6A2 | 0.918918919 | 0.944444444 | 0.894736842 |
| PTPRZ1 AND NOT-GABRG2 | 0.985507246 | 0.98550725 | 0.985507246 | TNFRSF13C AND NOT-SLC6A4 | 0.915662651 | 0.844444444 | 1 |
| PTPRZ1 AND GABRG3 | 0.985507246 | 0.98550725 | 0.985507246 | TNFRSF13C AND NOT-SLC6A8 | 0.915662651 | 0.844444444 | 1 |
| PTPRZ1 AND NOT-NPB | 0.985507246 | 0.98550725 | 0.985507246 | TNFRSF13C AND NOT-SLC6A9 | 0.926829268 | 0.863636364 | 1 |
| PTPRZ1 AND SERINC5 | 0.985507246 | 0.98550725 | 0.985507246 | TNFRSF13C AND NOT-SLC6A11 | 0.938271605 | 0.88372093 | 1 |
| PTPRZ1 AND FRMD3 | 0.985507246 | 0.98550725 | 0.985507246 | TNFRSF13C AND NOT-SLC8A2 | 0.915662651 | 0.844444444 | 1 |
| PTPRZ1 AND NOT-C1orf101 | 0.985507246 | 0.98550725 | 0.985507246 | TNFRSF13C AND NOT-SLC7A4 | 0.915662651 | 0.844444444 | 1 |
| PTPRZ1 AND NOT-GABRR2 | 0.977777778 | 1 | 0.956521739 | TNFRSF13C AND NOT-SLC8A1 | 0.915662651 | 0.844444444 | 1 |
| PTPRZ1 AND NOT-UTS2B | 0.985507246 | 0.98550725 | 0.985507246 | TNFRSF13C AND NOT-SLC13A1 | 0.915662651 | 0.844444444 | 1 |
| PTPRZ1 AND TMEM59L | 0.985507246 | 0.98550725 | 0.985507246 | TNFRSF13C AND NOT-SLC16A2 | 0.915662651 | 0.844444444 | 1 |
| GPM6B AND BRI3 | 0.977777778 | 1 | 0.956521739 | TNFRSF13C AND NOT-SLC18A2 | 0.915662651 | 0.844444444 | 1 |
| PTPRZ1 AND BRI3 | 0.985294118 | 1 | 0.971014493 | TNFRSF13C AND NOT-SLC22A1 | 0.926829268 | 0.863636364 | 1 |
| PTPRZ1 AND SLC39A6 | 0.970149254 | 1 | 0.942028986 | TNFRSF13C AND NOT-SLC22A2 | 0.915662651 | 0.844444444 | 1 |
| PTPRZ1 AND BAMBI | 0.985507246 | 0.98550725 | 0.985507246 | TNFRSF13C AND NOT-SLC22A4 | 0.915662651 | 0.844444444 | 1 |
| PTPRZ1 AND RHBDD3 | 0.985507246 | 0.98550725 | 0.985507246 | TNFRSF13C AND NOT-DLK2 | 0.915662651 | 0.844444444 | 1 |
| PTPRZ1 AND NOT-KLK5 | 0.985294118 | 1 | 0.971014493 | TNFRSF13C AND NOT-CYP4F12 | 0.938271605 | 0.88372093 | 1 |
| PTPRZ1 AND NOT-GALC | 0.985507246 | 0.98550725 | 0.985507246 | TNFRSF13C AND NOT-SMPD1 | 0.915662651 | 0.844444444 | 1 |
| PTPRZ1 AND NOT-TPSG1 | 0.985507246 | 0.98550725 | 0.985507246 | TNFRSF13C AND NOT-SSTR1 | 0.915662651 | 0.844444444 | 1 |
| PTPRZ1 AND NOT-TMEM184B | 0.985507246 | 0.98550725 | 0.985507246 | TNFRSF13C AND NOT-SSTR2 | 0.974358974 | 0.95 | 1 |
| PTPRZ1 AND METTL7A | 0.985507246 | 0.98550725 | 0.985507246 | TNFRSF13C AND NOT-BST1 | 0.915662651 | 0.844444444 | 1 |
| PTPRZ1 AND YIPF3 | 0.970149254 | 1 | 0.942028986 | TNFRSF13C AND NOT-SYT4 | 0.936708861 | 0.902439024 | 0.973684211 |
| PTPRZ1 AND NOT-ABHD14A | 0.985507246 | 0.98550725 | 0.985507246 | TNFRSF13C AND NOT-SYT5 | 0.915662651 | 0.844444444 | 1 |
| PTPRZ1 AND NOT-LETMD1 | 0.985507246 | 0.98550725 | 0.985507246 | TNFRSF13C AND NOT-TACR3 | 0.926829268 | 0.863636364 | 1 |
| PTPRZ1 AND GALR1 | 0.985507246 | 0.98550725 | 0.985507246 | TNFRSF13C AND NOT-TFR2 | 0.926829268 | 0.863636364 | 1 |
| PTPRZ1 AND TMEM186 | 0.985507246 | 0.98550725 | 0.985507246 | TNFRSF13C AND NOT-TSPAN8 | 0.915662651 | 0.844444444 | 1 |
| PTPRZ1 AND RNF19A | 0.985507246 | 0.98550725 | 0.985507246 | TNFRSF13C AND NOT-TRPC4 | 0.915662651 | 0.844444444 | 1 |
| GPM6B AND GALNT1 | 0.99270073 | 1 | 0.985507246 | TNFRSF13C AND NOT-TSHR | 0.926829268 | 0.863636364 | 1 |
| PTPRZ1 AND GALNT1 | 0.99270073 | 1 | 0.985507246 | TNFRSF13C AND NOT-CLRN1 | 0.915662651 | 0.844444444 | 1 |
| PTPRZ1 AND OLFML2B | 0.985507246 | 0.98550725 | 0.985507246 | TNFRSF13C AND NOT-VIPR1 | 0.915662651 | 0.844444444 | 1 |
| PTPRZ1 AND TMEM158 | 0.985507246 | 0.98550725 | 0.985507246 | TNFRSF13C AND NOT-ZAN | 0.915662651 | 0.844444444 | 1 |
| PTPRZ1 AND C1orf43 | 0.970149254 | 1 | 0.942028986 | TNFRSF13C AND NOT-WNT7B | 0.926829268 | 0.863636364 | 1 |
| PTPRZ1 AND NOT-LY6G6F | 0.985507246 | 0.98550725 | 0.985507246 | TNFRSF13C AND NOT-CA12 | 0.926829268 | 0.863636364 | 1 |
| GPM6B AND ZDHHC5 | 0.985294118 | 1 | 0.971014493 | TNFRSF13C AND NOT-CACNA1C | 0.915662651 | 0.844444444 | 1 |
| PTPRZ1 AND ZDHHC5 | 0.985294118 | 1 | 0.971014493 | TNFRSF13C AND NOT-SLC30A4 | 0.936708861 | 0.902439024 | 0.973684211 |
| PTPRZ1 AND NOT-NALCN | 0.985507246 | 0.98550725 | 0.985507246 | TNFRSF13C AND NOT-SEMA3B | 0.915662651 | 0.844444444 | 1 |
| PTPRZ1 AND TMIE | 0.985507246 | 0.98550725 | 0.985507246 | TNFRSF13C AND NOT-SMIM2 | 0.915662651 | 0.844444444 | 1 |
| PTPRZ1 AND NOT-WFDC11 | 0.985507246 | 0.98550725 | 0.985507246 | TNFRSF13C AND NOT-TRPM8 | 0.915662651 | 0.844444444 | 1 |
| PTPRZ1 AND NOT-WFDC9 | 0.985294118 | 1 | 0.971014493 | TNFRSF13C AND NOT-PRRG4 | 0.915662651 | 0.844444444 | 1 |
| PTPRZ1 AND NOT-MRGPRX1 | 0.985507246 | 0.98550725 | 0.985507246 | TNFRSF13C AND NOT-ELOVL6 | 0.962025316 | 0.926829268 | 1 |
| PTPRZ1 AND NOT-TAS2R39 | 0.985507246 | 0.98550725 | 0.985507246 | TNFRSF13C AND NOT-ALG12 | 0.938271605 | 0.88372093 | 1 |
| PTPRZ1 AND NOT-TAS2R41 | 0.985507246 | 0.98550725 | 0.985507246 | TNFRSF13C AND NOT-DHRS11 | 0.936708861 | 0.902439024 | 0.973684211 |
| PTPRZ1 AND NOT-TAS2R50 | 0.985507246 | 0.98550725 | 0.985507246 | TNFRSF13C AND NOT-OR2H2 | 0.915662651 | 0.844444444 | 1 |
| PTPRZ1 AND NOT-FAM205A | 0.99270073 | 1 | 0.985507246 | TNFRSF13C AND NOT-OR51B2 | 0.938271605 | 0.88372093 | 1 |
| PTPRZ1 AND PVRL3 | 0.985507246 | 0.98550725 | 0.985507246 | TNFRSF13C AND NOT-NOX5 | 0.915662651 | 0.844444444 | 1 |
| PTPRZ1 AND NOT-ADGRA2 | 0.985507246 | 0.98550725 | 0.985507246 | TNFRSF13C AND NOT-SRD5A3 | 0.926829268 | 0.863636364 | 1 |

FIG. 1 (CONT.)

| Antigen Pair Logic | F1 | Precision | Recall |
|---|---|---|---|
| PTPRZ1 AND NOT-C2CD2 | 0.985507246 | 0.98550725 | 0.985507246 |
| PTPRZ1 AND UNC50 | 0.985507246 | 0.98550725 | 0.985507246 |
| PTPRZ1 AND DHRS7B | 0.970149254 | 1 | 0.942028986 |
| PTPRZ1 AND RNF167 | 0.985507246 | 0.98550725 | 0.985507246 |
| PTPRZ1 AND TENM4 | 0.985507246 | 0.98550725 | 0.985507246 |
| PTPRZ1 AND LRP10 | 0.985507246 | 0.98550725 | 0.985507246 |
| PTPRZ1 AND NOT-CYP4X1 | 0.985507246 | 0.98550725 | 0.985507246 |
| PTPRZ1 AND SUSD5 | 0.985507246 | 0.98550725 | 0.985507246 |
| PTPRZ1 AND ATRNL1 | 0.985507246 | 0.98550725 | 0.985507246 |
| PTPRZ1 AND NOT-CFAP61 | 0.985507246 | 0.98550725 | 0.985507246 |
| PTPRZ1 AND NOT-HERC4 | 0.985507246 | 0.98550725 | 0.985507246 |
| GPM6B AND TCTN3 | 0.970149254 | 1 | 0.942028986 |
| PTPRZ1 AND TCTN3 | 0.977777778 | 1 | 0.956521739 |
| PTPRZ1 AND LRRC32 | 0.985507246 | 0.98550725 | 0.985507246 |
| PTPRZ1 AND PCDHB5 | 0.985507246 | 0.98550725 | 0.985507246 |
| PTPRZ1 AND NOT-STEAP2 | 0.985507246 | 0.98550725 | 0.985507246 |
| GPM6B AND TMEM251 | 0.977777778 | 1 | 0.956521739 |
| PTPRZ1 AND TMEM251 | 0.977777778 | 1 | 0.956521739 |
| PTPRZ1 AND OR1C1 | 0.985507246 | 0.98550725 | 0.985507246 |
| PTPRZ1 AND OR1A2 | 0.985507246 | 0.98550725 | 0.985507246 |
| PTPRZ1 AND OR2B6 | 0.985507246 | 0.98550725 | 0.985507246 |
| PTPRZ1 AND NOT-OR1J4 | 0.985294118 | 1 | 0.971014493 |
| PTPRZ1 AND B3GAT3 | 0.99270073 | 1 | 0.985507246 |
| PTPRZ1 AND NOT-OR2M4 | 0.985507246 | 0.98550725 | 0.985507246 |
| PTPRZ1 AND NOT-OR2L2 | 0.985507246 | 0.98550725 | 0.985507246 |
| PTPRZ1 AND CLEC4E | 0.985507246 | 0.98550725 | 0.985507246 |
| PTPRZ1 AND NOT-PLA2G2D | 0.985507246 | 0.98550725 | 0.985507246 |
| PTPRZ1 AND NOT-IL1RAPL2 | 0.977777778 | 1 | 0.956521739 |
| CHST10 AND NOT-IL1RAPL2 | 0.970149254 | 1 | 0.942028986 |
| PTPRZ1 AND GBGT1 | 0.985507246 | 0.98550725 | 0.985507246 |
| PTPRZ1 AND NOT-OR7A17 | 0.985507246 | 0.98550725 | 0.985507246 |
| PTPRZ1 AND SEZ6L2 | 0.985507246 | 0.98550725 | 0.985507246 |
| PTPRZ1 AND OR10J1 | 0.985507246 | 0.98550725 | 0.985507246 |
| PTPRZ1 AND NOT-OR8B8 | 0.970149254 | 1 | 0.942028986 |
| PTPRZ1 AND NOT-OR8G1 | 0.977777778 | 1 | 0.956521739 |
| PTPRZ1 AND NOT-OR10A3 | 0.985507246 | 0.98550725 | 0.985507246 |
| PTPRZ1 AND SLC17A5 | 0.985507246 | 0.98550725 | 0.985507246 |
| PTPRZ1 AND NOT-CNNM4 | 0.985507246 | 0.98550725 | 0.985507246 |
| PTPRZ1 AND CNNM3 | 0.985507246 | 0.98550725 | 0.985507246 |
| PTPRZ1 AND MYOF | 0.985507246 | 0.98550725 | 0.985507246 |
| PTPRZ1 AND NOT-GCNT1 | 0.985507246 | 0.98550725 | 0.985507246 |
| PTPRZ1 AND CHIC2 | 0.977777778 | 1 | 0.956521739 |
| PTPRZ1 AND NOT-GCNT2 | 0.985507246 | 0.98550725 | 0.985507246 |
| PTPRZ1 AND NOT-TSPAN16 | 0.985294118 | 1 | 0.971014493 |
| PTPRZ1 AND NOT-OR11A1 | 0.985507246 | 0.98550725 | 0.985507246 |
| PTPRZ1 AND NOT-GREM1 | 0.970149254 | 1 | 0.942028986 |
| PTPRZ1 AND NOT-OR8B2 | 0.977777778 | 1 | 0.956521739 |
| PTPRZ1 AND TBL2 | 0.99270073 | 1 | 0.985507246 |
| PTPRZ1 AND NOT-OR7C2 | 0.985294118 | 1 | 0.971014493 |
| PTPRZ1 AND NOT-BEST4 | 0.985507246 | 0.98550725 | 0.985507246 |
| PTPRZ1 AND NOT-OR4D1 | 0.985507246 | 0.98550725 | 0.985507246 |
| PTPRZ1 AND NOT-ADGRF1 | 0.985507246 | 0.98550725 | 0.985507246 |
| PTPRZ1 AND NOT-OR2J2 | 0.985507246 | 0.98550725 | 0.985507246 |
| PTPRZ1 AND NOT-OR2H1 | 0.99270073 | 1 | 0.985507246 |
| PTPRZ1 AND GGCX | 0.985507246 | 0.98550725 | 0.985507246 |
| PTPRZ1 AND NOT-B4GALT1 | 0.985507246 | 0.98550725 | 0.985507246 |
| PTPRZ1 AND NOT-STEAP1 | 0.985507246 | 0.98550725 | 0.985507246 |
| PTPRZ1 AND GGT5 | 0.970149254 | 1 | 0.942028986 |
| PTPRZ1 AND NOT-GIPR | 0.985507246 | 0.98550725 | 0.985507246 |
| PTPRZ1 AND GJA1 | 0.985507246 | 0.98550725 | 0.985507246 |
| PTPRZ1 AND GPR160 | 0.985507246 | 0.98550725 | 0.985507246 |
| PTPRZ1 AND GJA3 | 0.985507246 | 0.98550725 | 0.985507246 |
| PTPRZ1 AND NOT-KCNV1 | 0.985507246 | 0.98550725 | 0.985507246 |
| PTPRZ1 AND NOT-GJA4 | 0.985507246 | 0.98550725 | 0.985507246 |
| PTPRZ1 AND NOT-NPTN | 0.985507246 | 0.98550725 | 0.985507246 |
| PTPRZ1 AND NOT-GJA5 | 0.985507246 | 0.98550725 | 0.985507246 |
| PTPRZ1 AND NOT-ATP2C1 | 0.985507246 | 0.98550725 | 0.985507246 |
| PTPRZ1 AND SIGLEC7 | 0.985507246 | 0.98550725 | 0.985507246 |
| PTPRZ1 AND NOT-GJA8 | 0.977777778 | 1 | 0.956521739 |
| PTPRZ1 AND NOT-GJB1 | 0.985507246 | 0.98550725 | 0.985507246 |
| PTPRZ1 AND NOT-NSG1 | 0.985507246 | 0.98550725 | 0.985507246 |
| PTPRZ1 AND GHITM | 0.985507246 | 0.98550725 | 0.985507246 |
| PTPRZ1 AND NOT-GJB2 | 0.985507246 | 0.98550725 | 0.985507246 |
| PTPRZ1 AND NOT-TSPAN13 | 0.985507246 | 0.98550725 | 0.985507246 |
| PTPRZ1 AND NOT-GJB3 | 0.985507246 | 0.98550725 | 0.985507246 |
| PTPRZ1 AND B3GAT1 | 0.985507246 | 0.98550725 | 0.985507246 |

| Antigen Pair Logic | F1 | Precision | Recall |
|---|---|---|---|
| TNFRSF13C AND NOT-TMC5 | 0.915662651 | 0.844444444 | 1 |
| TNFRSF13C AND NOT-ZDHHC11 | 0.962025316 | 0.926829268 | 1 |
| TNFRSF13C AND NOT-TM4SF20 | 0.948717949 | 0.925 | 0.973684211 |
| TNFRSF13C AND NOT-THSD4 | 0.915662651 | 0.844444444 | 1 |
| TNFRSF13C AND NOT-CALCR | 0.915662651 | 0.844444444 | 1 |
| TNFRSF13C AND NOT-TMC7 | 0.938271605 | 0.88372093 | 1 |
| TNFRSF13C AND NOT-DNAJC22 | 0.938271605 | 0.88372093 | 1 |
| TNFRSF13C AND NOT-NRSN2 | 0.915662651 | 0.844444444 | 1 |
| TNFRSF13C AND NOT-TRPM3 | 0.948717949 | 0.925 | 0.973684211 |
| TNFRSF13C AND NOT-LRRC8E | 0.915662651 | 0.844444444 | 1 |
| TNFRSF13C AND NOT-FRAS1 | 0.915662651 | 0.844444444 | 1 |
| TNFRSF13C AND NOT-TMEM254 | 0.961038961 | 0.948717949 | 0.973684211 |
| TNFRSF13C AND NOT-ULBP2 | 0.915662651 | 0.844444444 | 1 |
| TNFRSF13C AND NOT-BPIFB2 | 0.938271605 | 0.88372093 | 1 |
| TNFRSF13C AND NOT-PDCD1LG2 | 0.915662651 | 0.844444444 | 1 |
| TNFRSF13C AND NOT-C6orf25 | 0.987012987 | 0.974358974 | 1 |
| TNFRSF13C AND NOT-TMEM121 | 0.915662651 | 0.844444444 | 1 |
| TNFRSF13C AND NOT-SPX | 0.915662651 | 0.844444444 | 1 |
| TNFRSF13C AND NOT-APOL4 | 0.926829268 | 0.863636364 | 1 |
| TNFRSF13C AND NOT-TAS1R1 | 0.915662651 | 0.844444444 | 1 |
| TNFRSF13C AND NOT-KCNH6 | 0.947368421 | 0.947368421 | 0.947368421 |
| TNFRSF13C AND NOT-ST8SIA2 | 0.915662651 | 0.844444444 | 1 |
| TNFRSF13C AND NOT-GPR63 | 0.915662651 | 0.844444444 | 1 |
| TNFRSF13C AND NOT-AMN | 0.926829268 | 0.863636364 | 1 |
| TNFRSF13C AND NOT-OR5V1 | 0.915662651 | 0.844444444 | 1 |
| TNFRSF13C AND NOT-OR2B2 | 0.915662651 | 0.844444444 | 1 |
| TNFRSF13C AND NOT-VANGL1 | 0.915662651 | 0.844444444 | 1 |
| TNFRSF13C AND NOT-ELOVL3 | 0.926829268 | 0.863636364 | 1 |
| TNFRSF13C AND NOT-GSG1 | 0.915662651 | 0.844444444 | 1 |
| TNFRSF13C AND NOT-SLC4A9 | 0.915662651 | 0.844444444 | 1 |
| TNFRSF13C AND NOT-CALN1 | 0.915662651 | 0.844444444 | 1 |
| TNFRSF13C AND NOT-FAM57B | 0.96 | 0.972972973 | 0.947368421 |
| TNFRSF13C AND NOT-SLC25A18 | 0.961038961 | 0.948717949 | 0.973684211 |
| TNFRSF13C AND NOT-GPR61 | 0.962025316 | 0.926829268 | 1 |
| TNFRSF13C AND NOT-SLC25A2 | 0.915662651 | 0.844444444 | 1 |
| TNFRSF13C AND NOT-SPATA9 | 0.938271605 | 0.88372093 | 1 |
| TNFRSF13C AND NOT-OR1G1 | 0.926829268 | 0.863636364 | 1 |
| TNFRSF13C AND NOT-B3GNT5 | 0.95 | 0.904761905 | 1 |
| TNFRSF13C AND NOT-ADGRV1 | 0.915662651 | 0.844444444 | 1 |
| TNFRSF13C AND NOT-QRFPR | 0.915662651 | 0.844444444 | 1 |
| TNFRSF13C AND NOT-EVA1A | 0.915662651 | 0.844444444 | 1 |
| TNFRSF13C AND NOT-SLC37A3 | 0.936708861 | 0.902439024 | 0.973684211 |
| TNFRSF13C AND NOT-TMEM246 | 0.915662651 | 0.844444444 | 1 |
| TNFRSF13C AND NOT-TMEM101 | 0.931506849 | 0.971428571 | 0.894736842 |
| TNFRSF13C AND NOT-MEGF11 | 0.962025316 | 0.926829268 | 1 |
| TNFRSF13C AND NOT-CASR | 0.926829268 | 0.863636364 | 1 |
| TNFRSF13C AND NOT-ST6GAL2 | 0.915662651 | 0.844444444 | 1 |
| TNFRSF13C AND NOT-DGAT2 | 0.96 | 0.972972973 | 0.947368421 |
| TNFRSF13C AND NOT-ABHD1 | 0.915662651 | 0.844444444 | 1 |
| TNFRSF13C AND NOT-FUT10 | 0.936708861 | 0.902439024 | 0.973684211 |
| TNFRSF13C AND NOT-AGPAT9 | 0.926829268 | 0.863636364 | 1 |
| TNFRSF13C AND NOT-GALR3 | 0.915662651 | 0.844444444 | 1 |
| TNFRSF13C AND NOT-TMEM25 | 0.915662651 | 0.844444444 | 1 |
| TNFRSF13C AND NOT-PLXDC2 | 0.915662651 | 0.844444444 | 1 |
| TNFRSF13C AND NOT-SLC43A1 | 0.915662651 | 0.844444444 | 1 |
| TNFRSF13C AND NOT-ITGA10 | 0.915662651 | 0.844444444 | 1 |
| TNFRSF13C AND NOT-CHST1 | 1 | 1 | 1 |
| TNFRSF13C AND NOT-CNTNAP4 | 0.915662651 | 0.844444444 | 1 |
| TNFRSF13C AND NOT-UNC5C | 0.915662651 | 0.844444444 | 1 |
| TNFRSF13C AND NOT-KCNK5 | 0.915662651 | 0.844444444 | 1 |
| TNFRSF13C AND NOT-SLC4A4 | 0.915662651 | 0.844444444 | 1 |
| TNFRSF13C AND NOT-TNFSF14 | 0.915662651 | 0.844444444 | 1 |
| TNFRSF13C AND NOT-ADAM23 | 0.926829268 | 0.863636364 | 1 |
| TNFRSF13C AND NOT-ADAM21 | 0.915662651 | 0.844444444 | 1 |
| TNFRSF13C AND NOT-TNFRSF10C | 0.915662651 | 0.844444444 | 1 |
| TNFRSF13C AND NOT-IL18RAP | 0.915662651 | 0.844444444 | 1 |
| TNFRSF13C AND NOT-GALR2 | 0.926829268 | 0.863636364 | 1 |
| TNFRSF13C AND NOT-INPP4B | 0.915662651 | 0.844444444 | 1 |
| TNFRSF13C AND NOT-CCKAR | 0.915662651 | 0.844444444 | 1 |
| TNFRSF13C AND NOT-CACNA1I | 0.938271605 | 0.88372093 | 1 |
| TNFRSF13C AND NOT-P4HA2 | 0.915662651 | 0.844444444 | 1 |
| TNFRSF13C AND NOT-PPP1R3F | 0.915662651 | 0.844444444 | 1 |
| TNFRSF13C AND NOT-KCNH7 | 0.948717949 | 0.925 | 0.973684211 |
| TNFRSF13C AND NOT-UCN2 | 0.915662651 | 0.844444444 | 1 |
| TNFRSF13C AND NOT-UNC5A | 0.974358974 | 0.95 | 1 |
| TNFRSF13C AND NOT-NAT8 | 0.938271605 | 0.88372093 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND ST6GALNAC4 | 0.985507246 | 0.98550725 | 0.985507246 | TNFRSF13C AND NOT-RHBDL1 | 0.915662651 | 0.844444444 | 1 |
| PTPRZ1 AND CACNG4 | 0.985507246 | 0.98550725 | 0.985507246 | TNFRSF13C AND NOT-CCRL2 | 0.931506849 | 0.971428571 | 0.894736842 |
| PTPRZ1 AND NOT-GJB5 | 0.985507246 | 0.98550725 | 0.985507246 | TNFRSF13C AND NOT-FER1L5 | 0.938271605 | 0.88372093 | 1 |
| PTPRZ1 AND SLC39A1 | 0.985294118 | 1 | 0.971014493 | TNFRSF13C AND NOT-GPRC5A | 0.915662651 | 0.844444444 | 1 |
| PTPRZ1 AND NOT-SIGLEC9 | 0.985507246 | 0.98550725 | 0.985507246 | TNFRSF13C AND NOT-SLC13A2 | 0.926829268 | 0.863636364 | 1 |
| PTPRZ1 AND SIGLEC8 | 0.985507246 | 0.98550725 | 0.985507246 | TNFRSF13C AND NOT-CLDN10 | 0.95 | 0.904761905 | 1 |
| PTPRZ1 AND GPR82 | 0.985507246 | 0.98550725 | 0.985507246 | TNFRSF13C AND NOT-CLDN6 | 0.962025316 | 0.926829268 | 1 |
| PTPRZ1 AND NOT-HCAR1 | 0.985507246 | 0.98550725 | 0.985507246 | TNFRSF13C AND NOT-CLDN2 | 0.915662651 | 0.844444444 | 1 |
| PTPRZ1 AND NOT-C5AR2 | 0.985507246 | 0.98550725 | 0.985507246 | TNFRSF13C AND NOT-CLDN9 | 0.915662651 | 0.844444444 | 1 |
| GPM6B AND SERP1 | 0.985294118 | 1 | 0.971014493 | TNFRSF13C AND NOT-PIGQ | 0.962025316 | 0.926829268 | 1 |
| PTPRZ1 AND SERP1 | 0.985294118 | 1 | 0.971014493 | TNFRSF13C AND NOT-SLC6A5 | 0.944444444 | 1 | 0.894736842 |
| PTPRZ1 AND COQ2 | 0.985294118 | 1 | 0.971014493 | TNFRSF13C AND NOT-SLC28A2 | 0.915662651 | 0.844444444 | 1 |
| PTPRZ1 AND NOT-GPR162 | 0.985507246 | 0.98550725 | 0.985507246 | TNFRSF13C AND NOT-HTR3B | 0.973684211 | 0.973684211 | 0.973684211 |
| PTPRZ1 AND TNFRSF21 | 0.977777778 | 1 | 0.956521739 | TNFRSF13C AND NOT-MARVELD3 | 0.915662651 | 0.844444444 | 1 |
| PTPRZ1 AND PCDH17 | 0.985507246 | 0.98550725 | 0.985507246 | TNFRSF13C AND NOT-DSEL | 0.915662651 | 0.844444444 | 1 |
| PTPRZ1 AND NOT-GCLC | 0.985507246 | 0.98550725 | 0.985507246 | TNFRSF13C AND NOT-CDHR1 | 0.915662651 | 0.844444444 | 1 |
| PTPRZ1 AND NOT-PGAP2 | 0.985507246 | 0.98550725 | 0.985507246 | TNFRSF13C AND NOT-TMEM169 | 0.915662651 | 0.844444444 | 1 |
| PTPRZ1 AND NOT-PCDH11X | 0.99270073 | 1 | 0.985507246 | TNFRSF13C AND NOT-REEP6 | 0.938271605 | 0.88372093 | 1 |
| PTPRZ1 AND GOLIM4 | 0.985507246 | 0.98550725 | 0.985507246 | TNFRSF13C AND NOT-TAAR2 | 0.915662651 | 0.844444444 | 1 |
| PTPRZ1 AND PCSK1N | 0.985507246 | 0.98550725 | 0.985507246 | TNFRSF13C AND NOT-GPR55 | 0.936708861 | 0.902439024 | 0.973684211 |
| PTPRZ1 AND KCNMB4 | 0.985507246 | 0.98550725 | 0.985507246 | TNFRSF13C AND NOT-OPALIN | 0.915662651 | 0.844444444 | 1 |
| GPM6B AND TOR1B | 0.970149254 | 1 | 0.942028986 | TNFRSF13C AND NOT-MGAM2 | 0.95 | 0.904761905 | 1 |
| PTPRZ1 AND TOR1B | 0.985294118 | 1 | 0.971014493 | TNFRSF13C AND NOT-NDST3 | 0.915662651 | 0.844444444 | 1 |
| PTPRZ1 AND GLG1 | 0.985507246 | 0.98550725 | 0.985507246 | TNFRSF13C AND NOT-SLC22A6 | 0.938271605 | 0.88372093 | 1 |
| PTPRZ1 AND NOT-GLP1R | 0.99270073 | 1 | 0.985507246 | TNFRSF13C AND NOT-SLC22A13 | 0.948717949 | 0.925 | 0.973684211 |
| PTPRZ1 AND NOT-GLRA1 | 0.985507246 | 0.98550725 | 0.985507246 | TNFRSF13C AND NOT-CD101 | 0.938271605 | 0.88372093 | 1 |
| PTPRZ1 AND GLRA2 | 0.985507246 | 0.98550725 | 0.985507246 | TNFRSF13C AND NOT-LRRC4B | 0.938271605 | 0.88372093 | 1 |
| PTPRZ1 AND NOT-TOR2A | 0.985507246 | 0.98550725 | 0.985507246 | TNFRSF13C AND NOT-ABCC12 | 0.915662651 | 0.844444444 | 1 |
| PTPRZ1 AND CECR6 | 0.985507246 | 0.98550725 | 0.985507246 | TNFRSF13C AND NOT-NTN1 | 0.938271605 | 0.88372093 | 1 |
| PTPRZ1 AND NOT-GLRB | 0.985507246 | 0.98550725 | 0.985507246 | TNFRSF13C AND NOT-KCNK6 | 0.938271605 | 0.88372093 | 1 |
| PTPRZ1 AND NOT-PCLO | 0.985507246 | 0.98550725 | 0.985507246 | TNFRSF13C AND NOT-ABCG2 | 0.95 | 0.904761905 | 1 |
| CHST10 AND NOT-PCLO | 0.970149254 | 1 | 0.942028986 | TNFRSF13C AND NOT-TNFRSF8 | 0.938271605 | 0.88372093 | 1 |
| PTPRZ1 AND NOT-GNRHR | 0.985507246 | 0.98550725 | 0.985507246 | TNFRSF13C AND NOT-NCR1 | 0.915662651 | 0.844444444 | 1 |
| PTPRZ1 AND GNS | 0.99270073 | 1 | 0.985507246 | TNFRSF13C AND NOT-SLC4A8 | 0.915662651 | 0.844444444 | 1 |
| PTPRZ1 AND GOLGB1 | 0.970149254 | 1 | 0.942028986 | TNFRSF13C AND NOT-ENTPD2 | 0.938271605 | 0.88372093 | 1 |
| ITGAV AND NOT-GP1BA | 0.977777778 | 1 | 0.956521739 | TNFRSF13C AND NOT-IGDCC3 | 0.938271605 | 0.88372093 | 1 |
| PTPRZ1 AND NOT-GP1BA | 0.985294118 | 1 | 0.971014493 | TNFRSF13C AND HERPUD1 | 0.915662651 | 0.844444444 | 1 |
| PTPRZ1 AND NOT-GP2 | 0.985294118 | 1 | 0.971014493 | TNFRSF13C AND NOT-ECE2 | 0.915662651 | 0.844444444 | 1 |
| PTPRZ1 AND NOT-GPD2 | 0.985507246 | 0.98550725 | 0.985507246 | TNFRSF13C AND NOT-MFAP3L | 0.915662651 | 0.844444444 | 1 |
| PTPRZ1 AND SLCO1B3 | 0.985507246 | 0.98550725 | 0.985507246 | TNFRSF13C AND NOT-KIAA0319 | 0.915662651 | 0.844444444 | 1 |
| GPM6A AND SPCS1 | 0.970149254 | 1 | 0.942028986 | TNFRSF13C AND NOT-LPPR4 | 0.915662651 | 0.844444444 | 1 |
| GPM6A AND ATRAID | 0.985294118 | 1 | 0.971014493 | TNFRSF13C AND NOT-HS3ST2 | 0.915662651 | 0.844444444 | 1 |
| GPM6A AND TMEM14C | 0.970149254 | 1 | 0.942028986 | TNFRSF13C AND NOT-FGF19 | 0.915662651 | 0.844444444 | 1 |
| GPM6A AND ATP5F1 | 0.985294118 | 1 | 0.971014493 | CLECL1 AND NOT-EVI5L | 0.938271605 | 0.88372093 | 1 |
| GPM6A AND SLC38A2 | 0.977777778 | 1 | 0.956521739 | QSOX2 AND NOT-EVI5L | 0.948717949 | 0.925 | 0.973684211 |
| PTPRZ1 AND GPM6A | 0.985507246 | 0.98550725 | 0.985507246 | NOT-FAM210B AND SPPL3 | 0.936708861 | 0.902439024 | 0.973684211 |
| GPM6A AND NOT-UGT2B15 | 0.970149254 | 1 | 0.942028986 | CLECL1 AND NOT-FAM210B | 0.962025316 | 0.926829268 | 1 |
| GPM6A AND PTTG1IP | 0.985294118 | 1 | 0.971014493 | QSOX2 AND NOT-FAM210B | 0.936708861 | 0.902439024 | 0.973684211 |
| GPM6A AND ATP6V0E1 | 0.970149254 | 1 | 0.942028986 | NOT-FAM210B AND ETV6 | 0.948717949 | 0.925 | 0.973684211 |
| GPM6A AND CD63 | 0.99270073 | 1 | 0.985507246 | NOT-FAM210B AND ST6GALNAC4 | 0.947368421 | 0.947368421 | 0.947368421 |
| GPM6A AND LAPTM4A | 0.99270073 | 1 | 0.985507246 | NOT-FAM210B AND IL10RA | 0.936708861 | 0.902439024 | 0.973684211 |
| GPM6B AND SPCS1 | 0.970149254 | 1 | 0.942028986 | NOT-FAM210B AND APH1A | 0.948717949 | 0.925 | 0.973684211 |
| GPM6B AND TMEM208 | 0.985294118 | 1 | 0.971014493 | NOT-FAM210B AND SLC37A1 | 0.948717949 | 0.925 | 0.973684211 |
| GPM6B AND ALG5 | 0.970149254 | 1 | 0.942028986 | NOT-FAM210B AND TRPM7 | 0.948717949 | 0.925 | 0.973684211 |
| GPM6B AND SEC61A1 | 0.970149254 | 1 | 0.942028986 | NOT-FAM210B AND ERGIC1 | 0.947368421 | 0.947368421 | 0.947368421 |
| GPM6B AND ITGAE | 0.985294118 | 1 | 0.971014493 | NOT-FAM210B AND SPG7 | 0.945945946 | 0.972222222 | 0.921052632 |
| GPM6B AND SMIM20 | 0.970149254 | 1 | 0.942028986 | NOT-FAM210B AND ST14 | 0.918918919 | 0.944444444 | 0.894736842 |
| GPM6B AND MFAP3 | 0.977777778 | 1 | 0.956521739 | NOT-FAM210B AND ADAM17 | 0.961038961 | 0.948717949 | 0.973684211 |
| GPM6B AND OXA1L | 0.99270073 | 1 | 0.985507246 | ORAI2 AND NOT-FAM210B | 0.936708861 | 0.902439024 | 0.973684211 |
| GPM6B AND TMED5 | 0.985294118 | 1 | 0.971014493 | NOT-FAM210B AND SNN | 0.947368421 | 0.947368421 | 0.947368421 |
| GPM6B AND DERL2 | 0.977777778 | 1 | 0.956521739 | NOT-FAM210B AND CELSR1 | 0.936708861 | 0.902439024 | 0.973684211 |
| GPM6B AND GOLT1B | 0.970149254 | 1 | 0.942028986 | CLECL1 AND NOT-CMTM5 | 0.915662651 | 0.844444444 | 1 |
| GPM6B AND IER3IP1 | 0.985294118 | 1 | 0.971014493 | CLECL1 AND NOT-MOGAT1 | 0.948717949 | 0.925 | 0.973684211 |
| GPM6B AND TMEM69 | 0.985294118 | 1 | 0.971014493 | QSOX2 AND NOT-MOGAT1 | 0.947368421 | 0.947368421 | 0.947368421 |
| GPM6B AND WDR83OS | 0.985294118 | 1 | 0.971014493 | CLECL1 AND NOT-LYPD1 | 0.938271605 | 0.88372093 | 1 |
| GPM6B AND UBE2J1 | 0.977777778 | 1 | 0.956521739 | QSOX2 AND NOT-MAS1L | 0.948717949 | 0.925 | 0.973684211 |
| GPM6B AND TMEM138 | 0.985294118 | 1 | 0.971014493 | CLECL1 AND NOT-CATSPER1 | 0.926829268 | 0.863636364 | 1 |
| GPM6B AND CUTA | 0.970149254 | 1 | 0.942028986 | QSOX2 AND NOT-CATSPER1 | 0.948717949 | 0.925 | 0.973684211 |
| GPM6B AND ATP5F1 | 0.985294118 | 1 | 0.971014493 | CLECL1 AND NOT-SLC16A10 | 0.948717949 | 0.925 | 0.973684211 |
| GPM6B AND PIGC | 0.977777778 | 1 | 0.956521739 | QSOX2 AND NOT-UBE2J2 | 0.961038961 | 0.948717949 | 0.973684211 |
| GPM6B AND PIGF | 0.977777778 | 1 | 0.956521739 | NOT-ELOVL6 AND CLCN6 | 0.948717949 | 0.925 | 0.973684211 |
| GPM6B AND ACP1 | 0.977777778 | 1 | 0.956521739 | CLECL1 AND NOT-FAM24A | 0.926829268 | 0.863636364 | 1 |
| GPM6B AND STX18 | 0.970149254 | 1 | 0.942028986 | QSOX2 AND NOT-FAM24A | 0.936708861 | 0.902439024 | 0.973684211 |
| GPM6B AND TMCO1 | 0.970149254 | 1 | 0.942028986 | QSOX2 AND NOT-GYLTL1B | 0.935064935 | 0.923076923 | 0.947368421 |
| GPM6B AND IMPAD1 | 0.970149254 | 1 | 0.942028986 | CLECL1 AND NOT-AMICA1 | 0.926829268 | 0.863636364 | 1 |
| GPM6B AND PRCP | 0.970149254 | 1 | 0.942028986 | NOT-ADSSL1 AND CELSR1 | 0.962025316 | 0.926829268 | 1 |

FIG. 1 (CONT.)

| Antigen Pair Logic | F1 | Precision | Recall | Antigen Pair Logic | F1 | Precision | Recall |
|---|---|---|---|---|---|---|---|
| GPM6B AND PARL | 0.977777778 | 1 | 0.956521739 | CLECL1 AND NOT-CCR1 | 0.918918919 | 0.944444444 | 0.894736842 |
| GPM6B AND ETNK1 | 0.970149254 | 1 | 0.942028986 | CLECL1 AND NOT-CCR3 | 0.95 | 0.904761905 | 1 |
| GPM6B AND SLC30A6 | 0.977777778 | 1 | 0.956521739 | CLECL1 AND NOT-ZG16B | 0.915662651 | 0.844444444 | 1 |
| GPM6B AND VIMP | 0.985294118 | 1 | 0.971014493 | QSOX2 AND NOT-WFIKKN2 | 0.936708861 | 0.902439024 | 0.973684211 |
| GPM6B AND EMC3 | 0.977777778 | 1 | 0.956521739 | QSOX2 AND NOT-SEZ6 | 0.948717949 | 0.925 | 0.973684211 |
| GPM6B AND PLGRKT | 0.970149254 | 1 | 0.942028986 | CLECL1 AND NOT-GJD3 | 0.926829268 | 0.863636364 | 1 |
| GPM6B AND DIABLO | 0.99270073 | 1 | 0.985507246 | QSOX2 AND NOT-GJD3 | 0.936708861 | 0.902439024 | 0.973684211 |
| GPM6B AND C5orf15 | 0.970149254 | 1 | 0.942028986 | QSOX2 AND NOT-ACER1 | 0.948717949 | 0.925 | 0.973684211 |
| GPM6B AND MAVS | 0.970149254 | 1 | 0.942028986 | CLECL1 AND NOT-LRRC25 | 0.926829268 | 0.863636364 | 1 |
| PTPRZ1 AND GPM6B | 0.985507246 | 0.98550725 | 0.985507246 | CLECL1 AND NOT-CYP4F22 | 0.915662651 | 0.844444444 | 1 |
| GPM6B AND PEX2 | 0.970149254 | 1 | 0.942028986 | NOT-SLC44A3 AND CELSR1 | 0.961038961 | 0.948717949 | 0.973684211 |
| GPM6B AND SELK | 0.977777778 | 1 | 0.956521739 | QSOX2 AND NOT-KLHDC7A | 0.935064935 | 0.923076923 | 0.947368421 |
| GPM6B AND SRR | 0.977777778 | 1 | 0.956521739 | QSOX2 AND NOT-CST9L | 0.936708861 | 0.902439024 | 0.973684211 |
| GPM6B AND C5orf28 | 0.970149254 | 1 | 0.942028986 | CLECL1 AND NOT-CST9 | 0.915662651 | 0.844444444 | 1 |
| GPM6B AND SLC30A5 | 0.985294118 | 1 | 0.971014493 | QSOX2 AND NOT-TMEM150A | 0.947368421 | 0.947368421 | 0.947368421 |
| GPM6B AND BNIP2 | 0.985507246 | 0.98550725 | 0.985507246 | QSOX2 AND NOT-ACMSD | 0.948717949 | 0.925 | 0.973684211 |
| GPM6B AND SOAT1 | 0.970149254 | 1 | 0.942028986 | QSOX2 AND NOT-SPATA3 | 0.948717949 | 0.925 | 0.973684211 |
| GPM6B AND SSR2 | 0.970149254 | 1 | 0.942028986 | CLECL1 AND NOT-TMEM198 | 0.938271605 | 0.88372093 | 1 |
| GPM6B AND HSPA13 | 0.99270073 | 1 | 0.985507246 | QSOX2 AND NOT-TMEM198 | 0.936708861 | 0.902439024 | 0.973684211 |
| GPM6B AND TMBIM6 | 0.970149254 | 1 | 0.942028986 | QSOX2 AND NOT-LRRC15 | 0.936708861 | 0.902439024 | 0.973684211 |
| GPM6B AND PTTG1IP | 0.985294118 | 1 | 0.971014493 | CLECL1 AND NOT-TPRA1 | 0.948717949 | 0.925 | 0.973684211 |
| GPM6B AND ZNF7 | 0.970149254 | 1 | 0.942028986 | QSOX2 AND NOT-TPRA1 | 0.947368421 | 0.947368421 | 0.947368421 |
| GPM6B AND ALG8 | 0.985294118 | 1 | 0.971014493 | CLECL1 AND NOT-SLC31A1 | 0.95 | 0.904761905 | 1 |
| GPM6B AND DERL1 | 0.977777778 | 1 | 0.956521739 | PTPN1 AND NOT-SLC31A1 | 0.915662651 | 0.844444444 | 1 |
| GPM6B AND TTC13 | 0.970149254 | 1 | 0.942028986 | CLECL1 AND NOT-SLC31A2 | 0.974358974 | 0.95 | 1 |
| GPM6B AND KIAA1715 | 0.970149254 | 1 | 0.942028986 | NOT-SLC31A2 AND ST6GALNAC4 | 0.935064935 | 0.923076923 | 0.947368421 |
| GPM6B AND CANX | 0.970149254 | 1 | 0.942028986 | NOT-SLC31A2 AND ADAM17 | 0.95 | 0.904761905 | 1 |
| GPM6B AND SPNS1 | 0.985294118 | 1 | 0.971014493 | NOT-SLC31A2 AND SNRNP40 | 0.974358974 | 0.95 | 1 |
| GPM6B AND TMEM126A | 0.970149254 | 1 | 0.942028986 | CLECL1 AND NOT-C4orf32 | 0.947368421 | 0.947368421 | 0.947368421 |
| GPM6B AND SLC37A3 | 0.970149254 | 1 | 0.942028986 | NOT-C4orf32 AND RNF149 | 0.931506849 | 0.971428571 | 0.894736842 |
| GPM6B AND JAGN1 | 0.977777778 | 1 | 0.956521739 | IFNGR2 AND NOT-C4orf32 | 0.933333333 | 0.945945946 | 0.921052632 |
| GPM6B AND ZNF559 | 0.977777778 | 1 | 0.956521739 | NOT-C4orf32 AND MARS | 0.918918919 | 0.944444444 | 0.894736842 |
| GPM6B AND ATP6V0E1 | 0.970149254 | 1 | 0.942028986 | MCTP2 AND NOT-C4orf32 | 0.901408451 | 0.96969697 | 0.842105263 |
| GPM6B AND NOT-CD1B | 0.977777778 | 1 | 0.956521739 | NOT-C4orf32 AND ADAM17 | 0.947368421 | 0.947368421 | 0.947368421 |
| GPM6B AND XPR1 | 0.970149254 | 1 | 0.942028986 | NOT-C4orf32 AND TNFRSF10A | 0.935064935 | 0.923076923 | 0.947368421 |
| GPM6B AND ORMDL1 | 0.970149254 | 1 | 0.942028986 | QSOX2 AND NOT-UGT3A1 | 0.948717949 | 0.925 | 0.973684211 |
| GPM6B AND TMEM203 | 0.985294118 | 1 | 0.971014493 | QSOX2 AND NOT-DPCR1 | 0.961038961 | 0.948717949 | 0.973684211 |
| GPM6B AND CDYL | 0.970149254 | 1 | 0.942028986 | QSOX2 AND NOT-OR6B1 | 0.935064935 | 0.923076923 | 0.947368421 |
| GPM6B AND NOT-SIGLEC6 | 0.985507246 | 0.98550725 | 0.985507246 | CLECL1 AND NOT-CPD | 0.938271605 | 0.88372093 | 1 |
| GPM6B AND STX8 | 0.970149254 | 1 | 0.942028986 | CLECL1 AND NOT-SVOPL | 0.938271605 | 0.88372093 | 1 |
| PTPRZ1 AND IFNL2 | 0.985507246 | 0.98550725 | 0.985507246 | QSOX2 AND NOT-SVOPL | 0.948717949 | 0.925 | 0.973684211 |
| PTPRZ1 AND NOT-IFNL1 | 0.970149254 | 1 | 0.942028986 | CELSR1 AND NOT-CLDN4 | 0.935064935 | 0.923076923 | 0.947368421 |
| PTPRZ1 AND NOT-OR51B5 | 0.985507246 | 0.98550725 | 0.985507246 | QSOX2 AND NOT-ADGRG4 | 0.948717949 | 0.925 | 0.973684211 |
| PTPRZ1 AND NOT-OR5J2 | 0.99270073 | 1 | 0.985507246 | QSOX2 AND NOT-CRHR1 | 0.936708861 | 0.902439024 | 0.973684211 |
| PTPRZ1 AND NOT-GPR3 | 0.985507246 | 0.98550725 | 0.985507246 | QSOX2 AND NOT-PTCHD1 | 0.918918919 | 0.944444444 | 0.894736842 |
| PTPRZ1 AND NOT-XCR1 | 0.985294118 | 1 | 0.971014493 | CLECL1 AND NOT-SLC32A1 | 0.926829268 | 0.863636364 | 1 |
| PTPRZ1 AND NOT-SLC25A45 | 0.985507246 | 0.98550725 | 0.985507246 | QSOX2 AND NOT-SLC32A1 | 0.961038961 | 0.948717949 | 0.973684211 |
| PTPRZ1 AND NOT-OR8D1 | 0.985507246 | 0.98550725 | 0.985507246 | CLECL1 AND NOT-CSF2RA | 0.95 | 0.904761905 | 1 |
| PTPRZ1 AND NOT-OR8D2 | 0.99270073 | 1 | 0.985507246 | CLECL1 AND NOT-ADRA1D | 0.938271605 | 0.88372093 | 1 |
| PTPRZ1 AND NPBWR1 | 0.985507246 | 0.98550725 | 0.985507246 | QSOX2 AND NOT-ADRA1D | 0.948717949 | 0.925 | 0.973684211 |
| PTPRZ1 AND TMEM80 | 0.985507246 | 0.98550725 | 0.985507246 | CLECL1 AND NOT-CMTM2 | 0.926829268 | 0.863636364 | 1 |
| PTPRZ1 AND SLC22A24 | 0.985507246 | 0.98550725 | 0.985507246 | CLECL1 AND NOT-CSPG4 | 0.915662651 | 0.844444444 | 1 |
| PTPRZ1 AND NOT-OR10A4 | 0.985507246 | 0.98550725 | 0.985507246 | CLECL1 AND NOT-MGAT5B | 0.926829268 | 0.863636364 | 1 |
| PTPRZ1 AND CD163L1 | 0.985507246 | 0.98550725 | 0.985507246 | QSOX2 AND NOT-ATP8B3 | 0.948717949 | 0.925 | 0.973684211 |
| PTPRZ1 AND NOT-B4GALNT3 | 0.985507246 | 0.98550725 | 0.985507246 | CLECL1 AND NOT-SYT6 | 0.936708861 | 0.902439024 | 0.973684211 |
| PTPRZ1 AND NOT-CXCR3 | 0.970149254 | 1 | 0.942028986 | QSOX2 AND NOT-SYT6 | 0.936708861 | 0.902439024 | 0.973684211 |
| PTPRZ1 AND DPY19L2 | 0.985507246 | 0.98550725 | 0.985507246 | CLECL1 AND NOT-NFAM1 | 0.926829268 | 0.863636364 | 1 |
| PTPRZ1 AND GXYLT1 | 0.985507246 | 0.98550725 | 0.985507246 | QSOX2 AND NOT-ADRA2B | 0.935064935 | 0.923076923 | 0.947368421 |
| PTPRZ1 AND NOT-TMPRSS12 | 0.99270073 | 1 | 0.985507246 | CLECL1 AND NOT-PLB1 | 0.926829268 | 0.863636364 | 1 |
| PTPRZ1 AND PRLHR | 0.985507246 | 0.98550725 | 0.985507246 | CLECL1 AND NOT-GPR155 | 0.936708861 | 0.902439024 | 0.973684211 |
| PTPRZ1 AND GPR137C | 0.985507246 | 0.98550725 | 0.985507246 | CLECL1 AND NOT-CMTM8 | 0.926829268 | 0.863636364 | 1 |
| PTPRZ1 AND ZDHHC22 | 0.985507246 | 0.98550725 | 0.985507246 | NOT-CMTM8 AND SNRNP40 | 0.926829268 | 0.863636364 | 1 |
| PTPRZ1 AND UTS2R | 0.985507246 | 0.98550725 | 0.985507246 | CLECL1 AND NOT-IGSF11 | 0.936708861 | 0.902439024 | 0.973684211 |
| PTPRZ1 AND C16orf91 | 0.985294118 | 1 | 0.971014493 | QSOX2 AND NOT-IGSF11 | 0.947368421 | 0.947368421 | 0.947368421 |
| PTPRZ1 AND NOT-TMEM235 | 0.977777778 | 1 | 0.956521739 | CLECL1 AND NOT-CYBB | 0.915662651 | 0.844444444 | 1 |
| PTPRZ1 AND NOT-ANG | 0.985507246 | 0.98550725 | 0.985507246 | CLECL1 AND NOT-RNF217 | 0.915662651 | 0.844444444 | 1 |
| PTPRZ1 AND MILR1 | 0.985507246 | 0.98550725 | 0.985507246 | NOT-RNF217 AND ADAM17 | 0.915662651 | 0.844444444 | 1 |
| PTPRZ1 AND NOT-C17orf78 | 0.99270073 | 1 | 0.985507246 | CLECL1 AND NOT-CYP1B1 | 0.926829268 | 0.863636364 | 1 |
| PTPRZ1 AND GPR17 | 0.985507246 | 0.98550725 | 0.985507246 | CLECL1 AND NOT-LINGO2 | 0.974358974 | 0.95 | 1 |
| PTPRZ1 AND SLC26A11 | 0.977777778 | 1 | 0.956521739 | QSOX2 AND NOT-LINGO2 | 0.936708861 | 0.902439024 | 0.973684211 |
| PTPRZ1 AND GDPD1 | 0.985507246 | 0.98550725 | 0.985507246 | QSOX2 AND NOT-FREM1 | 0.936708861 | 0.902439024 | 0.973684211 |
| PTPRZ1 AND NOT-TMEM105 | 0.985507246 | 0.98550725 | 0.985507246 | CLECL1 AND NOT-MOSPD2 | 0.918918919 | 0.944444444 | 0.894736842 |
| ITGAV AND NOT-GPR18 | 0.977777778 | 1 | 0.956521739 | QSOX2 AND NOT-CYP19A1 | 0.916666667 | 0.970588235 | 0.868421053 |
| PTPRZ1 AND NOT-GPR18 | 0.985507246 | 0.98550725 | 0.985507246 | CLECL1 AND NOT-DAG1 | 0.915662651 | 0.844444444 | 1 |
| PTPRZ1 AND TMEM145 | 0.985507246 | 0.98550725 | 0.985507246 | CLECL1 AND NOT-TMEM30B | 0.915662651 | 0.844444444 | 1 |
| PTPRZ1 AND NOT-SIGLECL1 | 0.970149254 | 1 | 0.942028986 | CLECL1 AND NOT-DBH | 0.915662651 | 0.844444444 | 1 |

FIG. 1 (CONT.)

| Antigen Pair Logic | F1 | Precision | Recall |
|---|---|---|---|
| CHST10 AND NOT-SIGLECL1 | 0.970149254 | 1 | 0.942028986 |
| PTPRZ1 AND NOT-GPR20 | 0.985507246 | 0.98550725 | 0.985507246 |
| PTPRZ1 AND NOT-VSTM1 | 0.985507246 | 0.98550725 | 0.985507246 |
| PTPRZ1 AND TMEM150B | 0.99270073 | 1 | 0.985507246 |
| PTPRZ1 AND NOT-OR2L13 | 0.985507246 | 0.98550725 | 0.985507246 |
| PTPRZ1 AND NOT-GPR22 | 0.985507246 | 0.98550725 | 0.985507246 |
| PTPRZ1 AND NOT-EPHA10 | 0.985507246 | 0.98550725 | 0.985507246 |
| PTPRZ1 AND LPAR4 | 0.985507246 | 0.98550725 | 0.985507246 |
| PTPRZ1 AND NOT-SLC25A34 | 0.985507246 | 0.98550725 | 0.985507246 |
| PTPRZ1 AND SIRPB2 | 0.985507246 | 0.98550725 | 0.985507246 |
| PTPRZ1 AND NOT-GPR25 | 0.985507246 | 0.98550725 | 0.985507246 |
| PTPRZ1 AND CCDC141 | 0.985507246 | 0.98550725 | 0.985507246 |
| PTPRZ1 AND NOT-GPR27 | 0.985507246 | 0.98550725 | 0.985507246 |
| PTPRZ1 AND NOT-CDH19 | 0.985507246 | 0.98550725 | 0.985507246 |
| PTPRZ1 AND DLL1 | 0.985507246 | 0.98550725 | 0.985507246 |
| PTPRZ1 AND SLC9A9 | 0.985507246 | 0.98550725 | 0.985507246 |
| PTPRZ1 AND NOT-EPHA6 | 0.985507246 | 0.98550725 | 0.985507246 |
| PTPRZ1 AND NOT-GPER1 | 0.985507246 | 0.98550725 | 0.985507246 |
| PTPRZ1 AND NOT-IGSF10 | 0.985507246 | 0.98550725 | 0.985507246 |
| PTPRZ1 AND CYP4V2 | 0.985507246 | 0.98550725 | 0.985507246 |
| PTPRZ1 AND NOT-RNF175 | 0.985507246 | 0.98550725 | 0.985507246 |
| PTPRZ1 AND NOT-ARL10 | 0.985507246 | 0.98550725 | 0.985507246 |
| PTPRZ1 AND RNF180 | 0.985507246 | 0.98550725 | 0.985507246 |
| PTPRZ1 AND DCBLD1 | 0.977777778 | 1 | 0.956521739 |
| PTPRZ1 AND NOT-SCARA5 | 0.985507246 | 0.98550725 | 0.985507246 |
| PTPRZ1 AND TRIQK | 0.985507246 | 0.98550725 | 0.985507246 |
| PTPRZ1 AND DPY19L4 | 0.970149254 | 1 | 0.942028986 |
| PTPRZ1 AND CRB2 | 0.985507246 | 0.98550725 | 0.985507246 |
| PTPRZ1 AND NOT-GPR39 | 0.985507246 | 0.98550725 | 0.985507246 |
| PTPRZ1 AND ATP11C | 0.985294118 | 1 | 0.971014493 |
| PTPRZ1 AND NOT-CFAP47 | 0.985507246 | 0.98550725 | 0.985507246 |
| PTPRZ1 AND P2RY8 | 0.985507246 | 0.98550725 | 0.985507246 |
| PTPRZ1 AND NOT-TUSC5 | 0.985294118 | 1 | 0.971014493 |
| PTPRZ1 AND NOT-TRIM59 | 0.977777778 | 1 | 0.956521739 |
| PTPRZ1 AND NOT-ANK1 | 0.985507246 | 0.98550725 | 0.985507246 |
| PTPRZ1 AND GRIA1 | 0.985507246 | 0.98550725 | 0.985507246 |
| GRIA2 AND SLC25A3 | 0.970149254 | 1 | 0.942028986 |
| PTPRZ1 AND NOT-GRID1 | 0.985507246 | 0.98550725 | 0.985507246 |
| PTPRZ1 AND COA3 | 0.977777778 | 1 | 0.956521739 |
| PTPRZ1 AND TMEM176B | 0.985507246 | 0.98550725 | 0.985507246 |
| PTPRZ1 AND GRID2 | 0.985507246 | 0.98550725 | 0.985507246 |
| PTPRZ1 AND SPCS1 | 0.977777778 | 1 | 0.956521739 |
| PTPRZ1 AND NOT-TMEM14A | 0.985507246 | 0.98550725 | 0.985507246 |
| PTPRZ1 AND NOT-GRIK1 | 0.985507246 | 0.98550725 | 0.985507246 |
| PTPRZ1 AND FLVCR1 | 0.985507246 | 0.98550725 | 0.985507246 |
| PTPRZ1 AND NOT-TMPRSS11E | 0.985507246 | 0.98550725 | 0.985507246 |
| PTPRZ1 AND MAGEH1 | 0.985507246 | 0.98550725 | 0.985507246 |
| PTPRZ1 AND GRIK2 | 0.985507246 | 0.98550725 | 0.985507246 |
| PTPRZ1 AND GRIK4 | 0.985507246 | 0.98550725 | 0.985507246 |
| PTPRZ1 AND SLC43A3 | 0.985507246 | 0.98550725 | 0.985507246 |
| PTPRZ1 AND GRIK5 | 0.985507246 | 0.98550725 | 0.985507246 |
| PTPRZ1 AND NOT-GRIN2A | 0.985507246 | 0.98550725 | 0.985507246 |
| PTPRZ1 AND NOT-GRIN2B | 0.99270073 | 1 | 0.985507246 |
| PTPRZ1 AND GRIN2D | 0.985507246 | 0.98550725 | 0.985507246 |
| PTPRZ1 AND C1GALT1C1 | 0.970149254 | 1 | 0.942028986 |
| PTPRZ1 AND GRINA | 0.985507246 | 0.98550725 | 0.985507246 |
| PTPRZ1 AND CNIH4 | 0.985294118 | 1 | 0.971014493 |
| PTPRZ1 AND NOT-ANPEP | 0.985507246 | 0.98550725 | 0.985507246 |
| PTPRZ1 AND TMEM208 | 0.970149254 | 1 | 0.942028986 |
| PTPRZ1 AND DNAJC15 | 0.985507246 | 0.98550725 | 0.985507246 |
| PTPRZ1 AND CLEC2D | 0.985507246 | 0.98550725 | 0.985507246 |
| PTPRZ1 AND CD274 | 0.985507246 | 0.98550725 | 0.985507246 |
| PTPRZ1 AND NOT-GRM2 | 0.985507246 | 0.98550725 | 0.985507246 |
| PTPRZ1 AND NOT-GRM3 | 0.99270073 | 1 | 0.985507246 |
| PTPRZ1 AND NOT-GRM6 | 0.977777778 | 1 | 0.956521739 |
| PTPRZ1 AND NOT-SLC25A4 | 0.985507246 | 0.98550725 | 0.985507246 |
| PTPRZ1 AND SLC25A5 | 0.99270073 | 1 | 0.985507246 |
| PTPRZ1 AND NOT-CYP2S1 | 0.985507246 | 0.98550725 | 0.985507246 |
| PTPRZ1 AND NOT-ZDHHC1 | 0.985507246 | 0.98550725 | 0.985507246 |
| PTPRZ1 AND NOT-ZDHHC8 | 0.985507246 | 0.98550725 | 0.985507246 |
| PTPRZ1 AND NOT-GRHL1 | 0.985507246 | 0.98550725 | 0.985507246 |
| PTPRZ1 AND NOT-GUCY2C | 0.985507246 | 0.98550725 | 0.985507246 |
| PTPRZ1 AND NOT-ICOS | 0.985507246 | 0.98550725 | 0.985507246 |
| PTPRZ1 AND NOT-GUCY2F | 0.985507246 | 0.98550725 | 0.985507246 |
| PTPRZ1 AND ALG5 | 0.977777778 | 1 | 0.956521739 |
| PTPRZ1 AND NOT-NPC1L1 | 0.977777778 | 1 | 0.956521739 |
| CLECL1 AND NOT-TRPV3 | 0.915662651 | 0.844444444 | 1 |
| CLECL1 AND NOT-DCT | 0.926829268 | 0.863636364 | 1 |
| CLECL1 AND NOT-OXER1 | 0.961038961 | 0.948717949 | 0.973684211 |
| CLECL1 AND NOT-SPTSSB | 0.926829268 | 0.863636364 | 1 |
| CLECL1 AND NOT-CHST13 | 0.938271605 | 0.88372093 | 1 |
| CLECL1 AND NOT-SGMS2 | 0.915662651 | 0.844444444 | 1 |
| CLECL1 AND NOT-PKD1L1 | 0.915662651 | 0.844444444 | 1 |
| CLECL1 AND NOT-GIMAP1 | 0.926829268 | 0.863636364 | 1 |
| CLECL1 AND NOT-SPTSSA | 0.918918919 | 0.944444444 | 0.894736842 |
| CLECL1 AND NOT-PTCRA | 0.974358974 | 0.95 | 1 |
| CLECL1 AND NOT-DHODH | 0.933333333 | 0.945945946 | 0.921052632 |
| CLECL1 AND NOT-DPP4 | 0.926829268 | 0.863636364 | 1 |
| CLECL1 AND NOT-HBEGF | 0.915662651 | 0.844444444 | 1 |
| CLECL1 AND NOT-ECM1 | 0.938271605 | 0.88372093 | 1 |
| CLECL1 AND NOT-PGAM5 | 0.938271605 | 0.88372093 | 1 |
| CLECL1 AND NOT-DHRS7C | 0.915662651 | 0.844444444 | 1 |
| CLECL1 AND NOT-EMP1 | 0.915662651 | 0.844444444 | 1 |
| CLECL1 AND NOT-ADGRE1 | 0.926829268 | 0.863636364 | 1 |
| CLECL1 AND NOT-ERN1 | 0.926829268 | 0.863636364 | 1 |
| CLECL1 AND NOT-ABCA3 | 0.926829268 | 0.863636364 | 1 |
| CLECL1 AND NOT-EXTL3 | 0.938271605 | 0.88372093 | 1 |
| CLECL1 AND NOT-F2RL1 | 0.926829268 | 0.863636364 | 1 |
| CLECL1 AND NOT-MS4A15 | 0.915662651 | 0.844444444 | 1 |
| CLECL1 AND NOT-HEPACAM | 0.915662651 | 0.844444444 | 1 |
| CLECL1 AND NOT-FCAR | 0.915662651 | 0.844444444 | 1 |
| CLECL1 AND NOT-C6orf89 | 0.948717949 | 0.925 | 0.973684211 |
| CLECL1 AND NOT-DOLK | 0.938271605 | 0.88372093 | 1 |
| CLECL1 AND NOT-CD93 | 0.926829268 | 0.863636364 | 1 |
| CLECL1 AND NOT-MLC1 | 0.918918919 | 0.944444444 | 0.894736842 |
| CLECL1 AND NOT-FLT3 | 0.938271605 | 0.88372093 | 1 |
| CLECL1 AND NOT-ACSL6 | 0.926829268 | 0.863636364 | 1 |
| CLECL1 AND NOT-KCNH3 | 0.936708861 | 0.902439024 | 0.973684211 |
| CLECL1 AND NOT-SLC44A1 | 0.95 | 0.904761905 | 1 |
| CLECL1 AND NOT-NNT | 0.915662651 | 0.844444444 | 1 |
| CLECL1 AND NOT-SLC16A8 | 0.915662651 | 0.844444444 | 1 |
| CLECL1 AND NOT-FPR2 | 0.926829268 | 0.863636364 | 1 |
| CLECL1 AND NOT-CLEC5A | 0.915662651 | 0.844444444 | 1 |
| CLECL1 AND NOT-IL17RA | 0.938271605 | 0.88372093 | 1 |
| CLECL1 AND NOT-BCL2L13 | 0.918918919 | 0.944444444 | 0.894736842 |
| CLECL1 AND NOT-FUT5 | 0.926829268 | 0.863636364 | 1 |
| CLECL1 AND NOT-KDSR | 0.918918919 | 0.944444444 | 0.894736842 |
| CLECL1 AND NOT-FAM26E | 0.926829268 | 0.863636364 | 1 |
| CLECL1 AND NOT-CCDC108 | 0.938271605 | 0.88372093 | 1 |
| CLECL1 AND NOT-TMEM186 | 0.915662651 | 0.844444444 | 1 |
| CLECL1 AND NOT-TMEM158 | 0.915662651 | 0.844444444 | 1 |
| CLECL1 AND NOT-LY6G6F | 0.961038961 | 0.948717949 | 0.973684211 |
| CLECL1 AND NOT-HIGD1A | 0.961038961 | 0.948717949 | 0.973684211 |
| CLECL1 AND NOT-LRIT1 | 0.938271605 | 0.88372093 | 1 |
| CLECL1 AND NOT-GIMAP2 | 0.926829268 | 0.863636364 | 1 |
| CLECL1 AND NOT-PCDHB5 | 0.915662651 | 0.844444444 | 1 |
| CLECL1 AND NOT-KCNG2 | 0.948717949 | 0.925 | 0.973684211 |
| CLECL1 AND NOT-OR10A3 | 0.915662651 | 0.844444444 | 1 |
| CLECL1 AND NOT-MYOF | 0.95 | 0.904761905 | 1 |
| CLECL1 AND NOT-GGCX | 0.948717949 | 0.925 | 0.973684211 |
| CLECL1 AND NOT-SIGLEC7 | 0.926829268 | 0.863636364 | 1 |
| CLECL1 AND NOT-KCNH5 | 0.915662651 | 0.844444444 | 1 |
| CLECL1 AND NOT-SIGLEC9 | 0.938271605 | 0.88372093 | 1 |
| CLECL1 AND NOT-GPR78 | 0.935064935 | 0.923076923 | 0.947368421 |
| CLECL1 AND NOT-GLRA1 | 0.926829268 | 0.863636364 | 1 |
| CLECL1 AND NOT-CECR6 | 0.962025316 | 0.926829268 | 1 |
| CLECL1 AND NOT-GNS | 0.962025316 | 0.926829268 | 1 |
| CLECL1 AND NOT-GP9 | 0.926829268 | 0.863636364 | 1 |
| CLECL1 AND NOT-SLCO3A1 | 0.926829268 | 0.863636364 | 1 |
| CLECL1 AND NOT-GPR4 | 0.938271605 | 0.88372093 | 1 |
| CLECL1 AND NOT-FAM171A2 | 0.938271605 | 0.88372093 | 1 |
| CLECL1 AND NOT-SLC13A5 | 0.915662651 | 0.844444444 | 1 |
| CLECL1 AND NOT-IZUMO1 | 0.915662651 | 0.844444444 | 1 |
| CLECL1 AND NOT-SLC9A9 | 0.926829268 | 0.863636364 | 1 |
| CLECL1 AND NOT-CRB2 | 0.95 | 0.904761905 | 1 |
| CLECL1 AND NOT-GPR39 | 0.915662651 | 0.844444444 | 1 |
| CLECL1 AND NOT-FFAR2 | 0.95 | 0.904761905 | 1 |
| CLECL1 AND NOT-GRID2 | 0.926829268 | 0.863636364 | 1 |
| CLECL1 AND NOT-DEXI | 0.915662651 | 0.844444444 | 1 |
| CLECL1 AND NOT-ANPEP | 0.961038961 | 0.948717949 | 0.973684211 |
| CLECL1 AND NOT-GRIN1 | 0.915662651 | 0.844444444 | 1 |
| CLECL1 AND NOT-CNIH4 | 0.974358974 | 0.95 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND GNL2 | 0.985507246 | 0.98550725 | 0.985507246 | CLECL1 AND NOT-GRM2 | 0.915662651 | 0.844444444 | 1 |
| PTPRZ1 AND GUSB | 0.970149254 | 1 | 0.942028986 | CLECL1 AND NOT-GRM3 | 0.938271605 | 0.88372093 | 1 |
| PTPRZ1 AND HILPDA | 0.985294118 | 1 | 0.971014493 | CLECL1 AND NOT-ZDHHC1 | 0.926829268 | 0.863636364 | 1 |
| PTPRZ1 AND SEC61A1 | 0.970149254 | 1 | 0.942028986 | CLECL1 AND NOT-GPR171 | 0.926829268 | 0.863636364 | 1 |
| ITGAV AND NOT-SLC39A2 | 0.970149254 | 1 | 0.942028986 | CLECL1 AND NOT-LRP12 | 0.938271605 | 0.88372093 | 1 |
| PTPRZ1 AND NOT-SLC39A2 | 0.977777778 | 1 | 0.956521739 | CLECL1 AND NOT-HFE | 0.948717949 | 0.925 | 0.973684211 |
| PTPRZ1 AND SLC40A1 | 0.977777778 | 1 | 0.956521739 | CLECL1 AND NOT-MR1 | 0.945945946 | 0.972222222 | 0.921052632 |
| PTPRZ1 AND NOT-HCRTR1 | 0.970149254 | 1 | 0.942028986 | CLECL1 AND NOT-HMOX2 | 0.974358974 | 0.95 | 1 |
| PTPRZ1 AND HEXB | 0.977777778 | 1 | 0.956521739 | CLECL1 AND NOT-CLEC4D | 0.915662651 | 0.844444444 | 1 |
| PTPRZ1 AND HLA-B | 0.99270073 | 1 | 0.985507246 | CLECL1 AND NOT-ICAM4 | 0.929577465 | 1 | 0.868421053 |
| PTPRZ1 AND HLA-DMA | 0.985294118 | 1 | 0.971014493 | CLECL1 AND NOT-VSIG1 | 0.945945946 | 0.972222222 | 0.921052632 |
| PTPRZ1 AND HLA-DRA | 0.977777778 | 1 | 0.956521739 | CLECL1 AND NOT-FASLG | 0.926829268 | 0.863636364 | 1 |
| PTPRZ1 AND HLA-DRB1 | 0.970149254 | 1 | 0.942028986 | CLECL1 AND NOT-IL6R | 0.926829268 | 0.863636364 | 1 |
| PTPRZ1 AND HLA-E | 0.99270073 | 1 | 0.985507246 | CLECL1 AND NOT-IL7R | 0.926829268 | 0.863636364 | 1 |
| PTPRZ1 AND HLA-F | 0.977777778 | 1 | 0.956521739 | CLECL1 AND NOT-CXCR1 | 0.961038961 | 0.948717949 | 0.973684211 |
| PTPRZ1 AND HLA-G | 0.99270073 | 1 | 0.985507246 | CLECL1 AND NOT-AQP2 | 0.915662651 | 0.844444444 | 1 |
| PTPRZ1 AND NOT-SERPINA9 | 0.99270073 | 1 | 0.985507246 | CLECL1 AND NOT-IL12RB1 | 0.935064935 | 0.923076923 | 0.947368421 |
| APLP1 AND PTTG1IP | 0.970149254 | 1 | 0.942028986 | CLECL1 AND NOT-IL12RB2 | 0.95 | 0.904761905 | 1 |
| PTPRZ1 AND TNC | 0.970149254 | 1 | 0.942028986 | CLECL1 AND NOT-AQP3 | 0.926829268 | 0.863636364 | 1 |
| PTPRZ1 AND NOT-ICAM4 | 0.977777778 | 1 | 0.956521739 | CLECL1 AND NOT-ITGA5 | 0.974358974 | 0.95 | 1 |
| PTPRZ1 AND NOT-AQP8 | 0.99270073 | 1 | 0.985507246 | CLECL1 AND NOT-ITGB3 | 0.95 | 0.904761905 | 1 |
| CHST10 AND NOT-AQP8 | 0.970149254 | 1 | 0.942028986 | CLECL1 AND NOT-ITGB5 | 0.926829268 | 0.863636364 | 1 |
| PTPRZ1 AND IFNGR2 | 0.99270073 | 1 | 0.985507246 | CLECL1 AND NOT-ITGB6 | 0.936708861 | 0.902439024 | 0.973684211 |
| PTPRZ1 AND NOT-IHH | 0.977777778 | 1 | 0.956521739 | CLECL1 AND NOT-KCNC2 | 0.936708861 | 0.902439024 | 0.973684211 |
| PTPRZ1 AND NOT-FASLG | 0.99270073 | 1 | 0.985507246 | CLECL1 AND NOT-IGFL1 | 0.95 | 0.904761905 | 1 |
| PTPRZ1 AND CXCR1 | 0.977777778 | 1 | 0.956521739 | CLECL1 AND NOT-KIR2DL4 | 0.926829268 | 0.863636364 | 1 |
| PTPRZ1 AND CXCR2 | 0.99270073 | 1 | 0.985507246 | CLECL1 AND NOT-KIR2DS4 | 0.961038961 | 0.948717949 | 0.973684211 |
| PTPRZ1 AND NOT-PRAC2 | 0.985294118 | 1 | 0.971014493 | CLECL1 AND NOT-KIR3DL2 | 0.974358974 | 0.95 | 1 |
| PTPRZ1 AND INPP4A | 0.99270073 | 1 | 0.985507246 | CLECL1 AND NOT-SMIM1 | 0.935064935 | 0.923076923 | 0.947368421 |
| PTPRZ1 AND INSL3 | 0.99270073 | 1 | 0.985507246 | CLECL1 AND NOT-ARHGAP1 | 0.926829268 | 0.863636364 | 1 |
| PTPRZ1 AND ITGAE | 0.985294118 | 1 | 0.971014493 | CLECL1 AND NOT-ERVFRD-1 | 0.938271605 | 0.88372093 | 1 |
| ITGAV AND NOT-C1orf186 | 0.977777778 | 1 | 0.956521739 | CLECL1 AND NOT-ARSB | 0.926829268 | 0.863636364 | 1 |
| ITGAV AND NOT-DUOX2 | 0.970149254 | 1 | 0.942028986 | CLECL1 AND NOT-MAL | 0.936708861 | 0.902439024 | 0.973684211 |
| ITGAV AND GOLM1 | 0.970149254 | 1 | 0.942028986 | CLECL1 AND NOT-CD46 | 0.938271605 | 0.88372093 | 1 |
| ITGAV AND NOT-MRAP | 0.970149254 | 1 | 0.942028986 | CLECL1 AND NOT-MLN | 0.926829268 | 0.863636364 | 1 |
| ITGAV AND TMEM9B | 0.970149254 | 1 | 0.942028986 | CLECL1 AND NOT-ASGR1 | 0.95 | 0.904761905 | 1 |
| PTPRZ1 AND ITGAV | 0.985294118 | 1 | 0.971014493 | CLECL1 AND NOT-SMIM4 | 0.926829268 | 0.863636364 | 1 |
| ITGAV AND NOT-TSPAN8 | 0.977777778 | 1 | 0.956521739 | CLECL1 AND NOT-NCAM1 | 0.961038961 | 0.948717949 | 0.973684211 |
| ITGAV AND WRB | 0.970149254 | 1 | 0.942028986 | CLECL1 AND NOT-NPY | 0.935064935 | 0.923076923 | 0.947368421 |
| ITGAV AND TMX1 | 0.970149254 | 1 | 0.942028986 | CLECL1 AND NOT-NT5E | 0.918918919 | 0.944444444 | 0.894736842 |
| ITGAV AND PKD2L1 | 0.970149254 | 1 | 0.942028986 | CLECL1 AND NOT-NTSR1 | 0.901408451 | 0.96969697 | 0.842105263 |
| ITGAV AND NOT-CD28 | 0.970149254 | 1 | 0.942028986 | CLECL1 AND NOT-P2RX7 | 0.936708861 | 0.902439024 | 0.973684211 |
| ITGAV AND NOT-SIGLEC6 | 0.970149254 | 1 | 0.942028986 | CLECL1 AND NOT-P2RY2 | 0.95 | 0.904761905 | 1 |
| PTPRZ1 AND NOT-KCNA4 | 0.985294118 | 1 | 0.971014493 | CLECL1 AND NOT-CD207 | 0.938271605 | 0.88372093 | 1 |
| PTPRZ1 AND TMEM179B | 0.99270073 | 1 | 0.985507246 | CLECL1 AND NOT-CALY | 0.935064935 | 0.923076923 | 0.947368421 |
| LRRC37A3 AND NOT-EPCAM | 0.970149254 | 1 | 0.942028986 | CLECL1 AND NOT-KCNK4 | 0.926829268 | 0.863636364 | 1 |
| LRRC37A3 AND NOT-SLC28A3 | 0.970149254 | 1 | 0.942028986 | CLECL1 AND NOT-TAS2R14 | 0.936708861 | 0.902439024 | 0.973684211 |
| PTPRZ1 AND TMEM205 | 0.99270073 | 1 | 0.985507246 | CLECL1 AND NOT-TRAT1 | 0.926829268 | 0.863636364 | 1 |
| PTPRZ1 AND KCNH2 | 0.985294118 | 1 | 0.971014493 | CLECL1 AND NOT-CLEC4A | 0.945945946 | 0.972222222 | 0.921052632 |
| CHST10 AND NOT-KCNS1 | 0.970149254 | 1 | 0.942028986 | CLECL1 AND NOT-PCDH1 | 0.938271605 | 0.88372093 | 1 |
| PTPRZ1 AND NOT-KCNS2 | 0.970149254 | 1 | 0.942028986 | CLECL1 AND NOT-PCSK5 | 0.926829268 | 0.863636364 | 1 |
| PTPRZ1 AND KDR | 0.977777778 | 1 | 0.956521739 | CLECL1 AND NOT-CLEC1B | 0.926829268 | 0.863636364 | 1 |
| PTPRZ1 AND NOT-KIR3DL2 | 0.99270073 | 1 | 0.985507246 | CLECL1 AND NOT-ZDHHC3 | 0.938271605 | 0.88372093 | 1 |
| CHST10 AND NOT-KIR3DL2 | 0.970149254 | 1 | 0.942028986 | CLECL1 AND NOT-FAM198B | 0.938271605 | 0.88372093 | 1 |
| PTPRZ1 AND NOT-SPATA31D1 | 0.985294118 | 1 | 0.971014493 | CLECL1 AND NOT-MS4A4A | 0.936708861 | 0.902439024 | 0.973684211 |
| PTPRZ1 AND NOT-OR51I1 | 0.985294118 | 1 | 0.971014493 | CLECL1 AND NOT-AIG1 | 0.961038961 | 0.948717949 | 0.973684211 |
| PTPRZ1 AND LAMP1 | 0.970149254 | 1 | 0.942028986 | CLECL1 AND NOT-TRPV2 | 0.987012987 | 0.974358974 | 1 |
| PTPRZ1 AND ARHGAP1 | 0.985294118 | 1 | 0.971014493 | CLECL1 AND NOT-PDE3B | 0.95 | 0.904761905 | 1 |
| PTPRZ1 AND LBR | 0.985294118 | 1 | 0.971014493 | CLECL1 AND NOT-GDE1 | 0.936708861 | 0.902439024 | 0.973684211 |
| PTPRZ1 AND NOT-LCT | 0.985294118 | 1 | 0.971014493 | CLECL1 AND NOT-NBAS | 0.948717949 | 0.925 | 0.973684211 |
| CHST10 AND NOT-C11orf87 | 0.970149254 | 1 | 0.942028986 | CLECL1 AND NOT-CD244 | 0.926829268 | 0.863636364 | 1 |
| CHST10 AND NOT-FAM174B | 0.970149254 | 1 | 0.942028986 | CLECL1 AND NOT-ATP5G3 | 0.938271605 | 0.88372093 | 1 |
| PTPRZ1 AND C4orf3 | 0.977777778 | 1 | 0.956521739 | CLECL1 AND NOT-S1PR5 | 0.926829268 | 0.863636364 | 1 |
| PTPRZ1 AND NOT-XKRX | 0.977777778 | 1 | 0.956521739 | CLECL1 AND NOT-TREM2 | 0.926829268 | 0.863636364 | 1 |
| PTPRZ1 AND NOT-LRP2 | 0.985294118 | 1 | 0.971014493 | CLECL1 AND NOT-NLGN3 | 0.926829268 | 0.863636364 | 1 |
| CHST10 AND NOT-HAPLN4 | 0.970149254 | 1 | 0.942028986 | CLECL1 AND NOT-FAM105A | 0.926829268 | 0.863636364 | 1 |
| PTPRZ1 AND LTBP3 | 0.970149254 | 1 | 0.942028986 | CLECL1 AND NOT-LY6K | 0.926829268 | 0.863636364 | 1 |
| PTPRZ1 AND NOT-DUOXA2 | 0.985294118 | 1 | 0.971014493 | CLECL1 AND NOT-QPCTL | 0.938271605 | 0.88372093 | 1 |
| PTPRZ1 AND NOT-LTK | 0.985294118 | 1 | 0.971014493 | CLECL1 AND NOT-CDKAL1 | 0.938271605 | 0.88372093 | 1 |
| PTPRZ1 AND NOT-MAL | 0.970149254 | 1 | 0.942028986 | CLECL1 AND NOT-LPCAT2 | 0.926829268 | 0.863636364 | 1 |
| PTPRZ1 AND MARS | 0.985294118 | 1 | 0.971014493 | CLECL1 AND NOT-SLC35F6 | 0.962025316 | 0.926829268 | 1 |
| PTPRZ1 AND MCL1 | 0.985294118 | 1 | 0.971014493 | CLECL1 AND NOT-ACPP | 0.961038961 | 0.948717949 | 0.973684211 |
| CHST10 AND NOT-ADAM11 | 0.970149254 | 1 | 0.942028986 | CLECL1 AND NOT-TMEM51 | 0.95 | 0.904761905 | 1 |
| PTPRZ1 AND NOT-ART4 | 0.985294118 | 1 | 0.971014493 | CLECL1 AND NOT-SLC35C1 | 0.96 | 0.972972973 | 0.947368421 |
| PTPRZ1 AND MFAP3 | 0.977777778 | 1 | 0.956521739 | CLECL1 AND NOT-CSGALNACT2 | 0.962025316 | 0.926829268 | 1 |
| PTPRZ1 AND MGAT2 | 0.985294118 | 1 | 0.971014493 | CLECL1 AND NOT-CHST12 | 0.947368421 | 0.947368421 | 0.947368421 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND MGAT5 | 0.977777778 | 1 | 0.956521739 | CLECL1 AND NOT-POMGNT1 | 0.938271605 | 0.88372093 | 1 |
| PTPRZ1 AND MGP | 0.985294118 | 1 | 0.971014493 | CLECL1 AND NOT-FLVCR2 | 0.974358974 | 0.95 | 1 |
| PTPRZ1 AND MPG | 0.977777778 | 1 | 0.956521739 | CLECL1 AND NOT-FAR2 | 0.926829268 | 0.863636364 | 1 |
| PTPRZ1 AND NOT-SMCO3 | 0.99270073 | 1 | 0.985507246 | CLECL1 AND NOT-TMEM30A | 0.974358974 | 0.95 | 1 |
| NOT-C1orf186 AND CHST11 | 0.970149254 | 1 | 0.942028986 | CLECL1 AND NOT-PAG1 | 0.95 | 0.904761905 | 1 |
| NOT-C1orf186 AND SLC35C2 | 0.970149254 | 1 | 0.942028986 | CLECL1 AND NOT-TEX2 | 0.95 | 0.904761905 | 1 |
| NOT-C1orf186 AND APMAP | 0.970149254 | 1 | 0.942028986 | CLECL1 AND NOT-ACSS2 | 0.95 | 0.904761905 | 1 |
| PTPRZ1 AND NOT-C1orf186 | 0.99270073 | 1 | 0.985507246 | CLECL1 AND NOT-PSEN2 | 0.918918919 | 0.944444444 | 0.894736842 |
| NOT-C1orf186 AND VAMP4 | 0.977777778 | 1 | 0.956521739 | CLECL1 AND NOT-PANX2 | 0.938271605 | 0.88372093 | 1 |
| CHST10 AND NOT-C1orf186 | 0.970149254 | 1 | 0.942028986 | CLECL1 AND NOT-SUCNR1 | 0.926829268 | 0.863636364 | 1 |
| PTPRZ1 AND NOT-PTCHD4 | 0.99270073 | 1 | 0.985507246 | CLECL1 AND NOT-UGGT1 | 0.95 | 0.904761905 | 1 |
| PTPRZ1 AND ASPH | 0.985294118 | 1 | 0.971014493 | CLECL1 AND NOT-FAM20C | 0.962025316 | 0.926829268 | 1 |
| PTPRZ1 AND MTHFD1 | 0.99270073 | 1 | 0.985507246 | CLECL1 AND NOT-ENTPD7 | 0.936708861 | 0.902439024 | 0.973684211 |
| PTPRZ1 AND NOT-MTNR1B | 0.977777778 | 1 | 0.956521739 | CLECL1 AND NOT-MAN1C1 | 0.926829268 | 0.863636364 | 1 |
| PTPRZ1 AND NDUFA3 | 0.99270073 | 1 | 0.985507246 | CLECL1 AND NOT-ADGRG6 | 0.926829268 | 0.863636364 | 1 |
| PTPRZ1 AND NDUFA4 | 0.99270073 | 1 | 0.985507246 | CLECL1 AND NOT-SNX14 | 0.933333333 | 0.945945946 | 0.921052632 |
| PTPRZ1 AND NDUFB1 | 0.99270073 | 1 | 0.985507246 | CLECL1 AND NOT-PTAFR | 0.926829268 | 0.863636364 | 1 |
| PTPRZ1 AND NDUFB5 | 0.977777778 | 1 | 0.956521739 | CLECL1 AND NOT-PTGDR | 0.926829268 | 0.863636364 | 1 |
| PTPRZ1 AND NDUFB6 | 0.985294118 | 1 | 0.971014493 | CLECL1 AND NOT-PTGER2 | 0.936708861 | 0.902439024 | 0.973684211 |
| ATP1B2 AND TMEM14C | 0.970149254 | 1 | 0.942028986 | CLECL1 AND NOT-ESYT2 | 0.926829268 | 0.863636364 | 1 |
| PTPRZ1 AND ATP1B3 | 0.99270073 | 1 | 0.985507246 | CLECL1 AND NOT-PCDH10 | 0.926829268 | 0.863636364 | 1 |
| PTPRZ1 AND NOTCH4 | 0.99270073 | 1 | 0.985507246 | CLECL1 AND NOT-ISLR2 | 0.938271605 | 0.88372093 | 1 |
| PTPRZ1 AND ATP2A1 | 0.970149254 | 1 | 0.942028986 | CLECL1 AND NOT-HAMP | 0.938271605 | 0.88372093 | 1 |
| PTPRZ1 AND ATP2A2 | 0.985294118 | 1 | 0.971014493 | CLECL1 AND NOT-PIPRA | 0.936708861 | 0.902439024 | 0.973684211 |
| PTPRZ1 AND NOT-NTF3 | 0.985294118 | 1 | 0.971014493 | CLECL1 AND NOT-SLC46A2 | 0.974358974 | 0.95 | 1 |
| CHST10 AND NOT-ATP2B3 | 0.970149254 | 1 | 0.942028986 | CLECL1 AND NOT-PVR | 0.95 | 0.904761905 | 1 |
| PTPRZ1 AND NOT-OR1F1 | 0.99270073 | 1 | 0.985507246 | CLECL1 AND NOT-LGR6 | 0.926829268 | 0.863636364 | 1 |
| PTPRZ1 AND OXA1L | 0.99270073 | 1 | 0.985507246 | CLECL1 AND NOT-RHD | 0.926829268 | 0.863636364 | 1 |
| PTPRZ1 AND P2RX4 | 0.977777778 | 1 | 0.956521739 | CLECL1 AND NOT-ROM1 | 0.926829268 | 0.863636364 | 1 |
| PTPRZ1 AND RRM2B | 0.985294118 | 1 | 0.971014493 | CLECL1 AND NOT-RTN1 | 0.926829268 | 0.863636364 | 1 |
| PTPRZ1 AND CHST11 | 0.977777778 | 1 | 0.956521739 | CLECL1 AND NOT-SCN3A | 0.935064935 | 0.923076923 | 0.947368421 |
| PTPRZ1 AND PAM | 0.99270073 | 1 | 0.985507246 | CLECL1 AND NOT-SDHC | 0.974358974 | 0.95 | 1 |
| PTPRZ1 AND NOT-TAS2R9 | 0.985294118 | 1 | 0.971014493 | CLECL1 AND NOT-SELPLG | 0.926829268 | 0.863636364 | 1 |
| PTPRZ1 AND NOT-TAS2R13 | 0.99270073 | 1 | 0.985507246 | CLECL1 AND NOT-CDH23 | 0.936708861 | 0.902439024 | 0.973684211 |
| PTPRZ1 AND TMED5 | 0.99270073 | 1 | 0.985507246 | CLECL1 AND NOT-SLC39A8 | 0.948717949 | 0.925 | 0.973684211 |
| PTPRZ1 AND SLC35C2 | 0.977777778 | 1 | 0.956521739 | CLECL1 AND NOT-MS4A6A | 0.926829268 | 0.863636364 | 1 |
| PTPRZ1 AND DERL2 | 0.977777778 | 1 | 0.956521739 | CLECL1 AND NOT-GPR135 | 0.926829268 | 0.863636364 | 1 |
| PTPRZ1 AND TMED7 | 0.970149254 | 1 | 0.942028986 | CLECL1 AND NOT-P2RY12 | 0.926829268 | 0.863636364 | 1 |
| PTPRZ1 AND FIS1 | 0.985294118 | 1 | 0.971014493 | CLECL1 AND NOT-SLC4A3 | 0.933333333 | 0.945945946 | 0.921052632 |
| PTPRZ1 AND GOLT1B | 0.977777778 | 1 | 0.956521739 | CLECL1 AND NOT-SLC1A5 | 0.95 | 0.904761905 | 1 |
| PTPRZ1 AND TXNDC12 | 0.99270073 | 1 | 0.985507246 | CLECL1 AND NOT-SLC8A1 | 0.938271605 | 0.88372093 | 1 |
| PTPRZ1 AND SCCPDH | 0.99270073 | 1 | 0.985507246 | CLECL1 AND NOT-SLC22A4 | 0.926829268 | 0.863636364 | 1 |
| PTPRZ1 AND IER3IP1 | 0.99270073 | 1 | 0.985507246 | CLECL1 AND NOT-SMPD1 | 0.926829268 | 0.863636364 | 1 |
| PTPRZ1 AND CKLF | 0.977777778 | 1 | 0.956521739 | CLECL1 AND NOT-SIGLEC1 | 0.926829268 | 0.863636364 | 1 |
| PTPRZ1 AND EMC4 | 0.99270073 | 1 | 0.985507246 | CLECL1 AND NOT-SORL1 | 0.933333333 | 0.945945946 | 0.921052632 |
| PTPRZ1 AND SHISA5 | 0.99270073 | 1 | 0.985507246 | CLECL1 AND NOT-SPN | 0.926829268 | 0.863636364 | 1 |
| PTPRZ1 AND TMEM69 | 0.99270073 | 1 | 0.985507246 | CLECL1 AND NOT-BPI | 0.918918919 | 0.944444444 | 0.894736842 |
| PTPRZ1 AND NT5C3A | 0.970149254 | 1 | 0.942028986 | CLECL1 AND NOT-SSR3 | 0.933333333 | 0.945945946 | 0.921052632 |
| PTPRZ1 AND TBC1D7 | 0.99270073 | 1 | 0.985507246 | CLECL1 AND NOT-SSTR5 | 0.938271605 | 0.88372093 | 1 |
| GOLM1 AND NOT-SCNN1A | 0.970149254 | 1 | 0.942028986 | CLECL1 AND NOT-BST1 | 0.926829268 | 0.863636364 | 1 |
| PTPRZ1 AND BFAR | 0.99270073 | 1 | 0.985507246 | CLECL1 AND NOT-TGFBR3 | 0.926829268 | 0.863636364 | 1 |
| PTPRZ1 AND ERGIC2 | 0.985294118 | 1 | 0.971014493 | CLECL1 AND NOT-TLR5 | 0.926829268 | 0.863636364 | 1 |
| PTPRZ1 AND TIMMDC1 | 0.985294118 | 1 | 0.971014493 | CLECL1 AND NOT-TRPC4 | 0.938271605 | 0.88372093 | 1 |
| PTPRZ1 AND NOT-GCNT4 | 0.99270073 | 1 | 0.985507246 | CLECL1 AND NOT-FZD5 | 0.95 | 0.904761905 | 1 |
| PTPRZ1 AND ARMCX1 | 0.985294118 | 1 | 0.971014493 | CLECL1 AND NOT-PRRG4 | 0.926829268 | 0.863636364 | 1 |
| PTPRZ1 AND CHST15 | 0.977777778 | 1 | 0.956521739 | CLECL1 AND NOT-ELOVL6 | 0.95 | 0.904761905 | 1 |
| PTPRZ1 AND ATRAID | 0.985294118 | 1 | 0.971014493 | CLECL1 AND NOT-ALG12 | 0.936708861 | 0.902439024 | 0.973684211 |
| PTPRZ1 AND WDR83OS | 0.985294118 | 1 | 0.971014493 | CLECL1 AND NOT-TMEM204 | 0.948717949 | 0.925 | 0.973684211 |
| PTPRZ1 AND TMEM14C | 0.985294118 | 1 | 0.971014493 | CLECL1 AND NOT-ATP8B4 | 0.926829268 | 0.863636364 | 1 |
| PTPRZ1 AND TMEM138 | 0.985294118 | 1 | 0.971014493 | CLECL1 AND NOT-DNAJC22 | 0.938271605 | 0.88372093 | 1 |
| PTPRZ1 AND ARMCX3 | 0.99270073 | 1 | 0.985507246 | CLECL1 AND NOT-TMEM254 | 0.961038961 | 0.948717949 | 0.973684211 |
| PTPRZ1 AND CUTA | 0.970149254 | 1 | 0.942028986 | CLECL1 AND NOT-DNAJC5 | 0.974358974 | 0.95 | 1 |
| GPR158 AND ATP5F1 | 0.977777778 | 1 | 0.956521739 | CLECL1 AND NOT-TAS1R1 | 0.935064935 | 0.923076923 | 0.947368421 |
| PTPRZ1 AND ATP5F1 | 0.985294118 | 1 | 0.971014493 | CLECL1 AND NOT-KIAA1715 | 0.901408451 | 0.96969697 | 0.842105263 |
| PTPRZ1 AND PIGT | 0.99270073 | 1 | 0.985507246 | CLECL1 AND NOT-HM13 | 0.95 | 0.904761905 | 1 |
| PTPRZ1 AND ERGIC3 | 0.985294118 | 1 | 0.971014493 | CLECL1 AND NOT-LRRC3 | 0.936708861 | 0.902439024 | 0.973684211 |
| PTPRZ1 AND SLC25A39 | 0.977777778 | 1 | 0.956521739 | CLECL1 AND NOT-VANGL1 | 0.926829268 | 0.863636364 | 1 |
| PTPRZ1 AND DHRS7 | 0.970149254 | 1 | 0.942028986 | CLECL1 AND NOT-SFXN3 | 0.938271605 | 0.88372093 | 1 |
| PTPRZ1 AND TMBIM4 | 0.99270073 | 1 | 0.985507246 | CLECL1 AND NOT-DYSF | 0.926829268 | 0.863636364 | 1 |
| PTPRZ1 AND PTRH2 | 0.99270073 | 1 | 0.985507246 | CLECL1 AND NOT-CRISPLD2 | 0.926829268 | 0.863636364 | 1 |
| PTPRZ1 AND FKBP7 | 0.99270073 | 1 | 0.985507246 | CLECL1 AND NOT-OR1G1 | 0.938271605 | 0.88372093 | 1 |
| PTPRZ1 AND DNAJB11 | 0.99270073 | 1 | 0.985507246 | CLECL1 AND NOT-B3GNT5 | 0.95 | 0.904761905 | 1 |
| PTPRZ1 AND PECAM1 | 0.99270073 | 1 | 0.985507246 | CLECL1 AND NOT-LRRC8C | 0.961038961 | 0.948717949 | 0.973684211 |
| PTPRZ1 AND NOT-ASIC5 | 0.970149254 | 1 | 0.942028986 | CLECL1 AND NOT-YIPF4 | 0.974358974 | 0.95 | 1 |
| PTPRZ1 AND SLC25A3 | 0.99270073 | 1 | 0.985507246 | CLECL1 AND NOT-C2orf40 | 0.974358974 | 0.95 | 1 |
| PTPRZ1 AND ATP6V0C | 0.99270073 | 1 | 0.985507246 | CLECL1 AND NOT-ATRN | 0.938271605 | 0.88372093 | 1 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND PIGF | 0.977777778 | 1 | 0.956521739 | CLECL1 AND NOT-CASR | 0.926829268 | 0.863636364 | 1 |
| PTPRZ1 AND ACP1 | 0.985294118 | 1 | 0.971014493 | CLECL1 AND NOT-DGAT2 | 0.931506849 | 0.971428571 | 0.894736842 |
| PTPRZ1 AND NOT-TM6SF2 | 0.985294118 | 1 | 0.971014493 | CLECL1 AND NOT-ADGRE3 | 0.926829268 | 0.863636364 | 1 |
| PTPRZ1 AND ATP6V0B | 0.99270073 | 1 | 0.985507246 | CLECL1 AND NOT-PIGO | 0.95 | 0.904761905 | 1 |
| PTPRZ1 AND ATP6AP1 | 0.977777778 | 1 | 0.956521739 | CLECL1 AND NOT-AGPAT9 | 0.95 | 0.904761905 | 1 |
| PTPRZ1 AND NOT-ATP7B | 0.985294118 | 1 | 0.971014493 | CLECL1 AND NOT-PLXDC2 | 0.926829268 | 0.863636364 | 1 |
| PTPRZ1 AND SLC38A2 | 0.977777778 | 1 | 0.956521739 | CLECL1 AND NOT-SMIM3 | 0.935064935 | 0.923076923 | 0.947368421 |
| PTPRZ1 AND DNAJC10 | 0.970149254 | 1 | 0.942028986 | CLECL1 AND NOT-VAMP4 | 0.947368421 | 0.947368421 | 0.947368421 |
| PTPRZ1 AND TMCO1 | 0.977777778 | 1 | 0.956521739 | CLECL1 AND NOT-TNFSF14 | 0.962025316 | 0.926829268 | 1 |
| PTPRZ1 AND NDUFB11 | 0.985294118 | 1 | 0.971014493 | CLECL1 AND NOT-TNFSF10 | 0.926829268 | 0.863636364 | 1 |
| PTPRZ1 AND NOT-RNF186 | 0.99270073 | 1 | 0.985507246 | CLECL1 AND NOT-ADAM9 | 0.938271605 | 0.88372093 | 1 |
| PTPRZ1 AND NOT-SLC6A20 | 0.970149254 | 1 | 0.942028986 | CLECL1 AND NOT-TNFRSF10C | 0.948717949 | 0.925 | 0.973684211 |
| PTPRZ1 AND SLC35F2 | 0.977777778 | 1 | 0.956521739 | CLECL1 AND NOT-IL18RAP | 0.926829268 | 0.863636364 | 1 |
| PTPRZ1 AND LEPROT | 0.99270073 | 1 | 0.985507246 | CLECL1 AND NOT-IL1RL2 | 0.938271605 | 0.88372093 | 1 |
| PTPRZ1 AND CTSA | 0.970149254 | 1 | 0.942028986 | CLECL1 AND NOT-GALR2 | 0.938271605 | 0.88372093 | 1 |
| PTPRZ1 AND PPIB | 0.970149254 | 1 | 0.942028986 | CLECL1 AND NOT-INPP4B | 0.926829268 | 0.863636364 | 1 |
| PTPRZ1 AND CMTM6 | 0.977777778 | 1 | 0.956521739 | CLECL1 AND NOT-CACNA1I | 0.935064935 | 0.923076923 | 0.947368421 |
| PTPRZ1 AND TMEM161A | 0.985294118 | 1 | 0.971014493 | CLECL1 AND NOT-CCRL2 | 0.926829268 | 0.863636364 | 1 |
| PTPRZ1 AND NOT-RHBDL2 | 0.970149254 | 1 | 0.942028986 | CLECL1 AND NOT-YIF1B | 0.95 | 0.904761905 | 1 |
| PTPRZ1 AND PIGX | 0.985294118 | 1 | 0.971014493 | CLECL1 AND NOT-PIGQ | 0.938271605 | 0.88372093 | 1 |
| PTPRZ1 AND TMEM70 | 0.99270073 | 1 | 0.985507246 | CLECL1 AND NOT-CD2 | 0.926829268 | 0.863636364 | 1 |
| PTPRZ1 AND NOT-HRASLS2 | 0.977777778 | 1 | 0.956521739 | CLECL1 AND NOT-CD3D | 0.926829268 | 0.863636364 | 1 |
| PTPRZ1 AND TMEM255A | 0.977777778 | 1 | 0.956521739 | CLECL1 AND NOT-PLXNA4 | 0.926829268 | 0.863636364 | 1 |
| TMEM255A AND WRB | 0.970149254 | 1 | 0.942028986 | CLECL1 AND NOT-SYT12 | 0.926829268 | 0.863636364 | 1 |
| TMEM255A AND NOT-SIGLEC6 | 0.977777778 | 1 | 0.956521739 | CLECL1 AND NOT-REEP6 | 0.926829268 | 0.863636364 | 1 |
| PTPRZ1 AND SLC35A5 | 0.977777778 | 1 | 0.956521739 | CLECL1 AND NOT-MS4A3 | 0.935064935 | 0.923076923 | 0.947368421 |
| PTPRZ1 AND TMEM248 | 0.985294118 | 1 | 0.971014493 | CLECL1 AND NOT-B4GALT6 | 0.95 | 0.904761905 | 1 |
| PTPRZ1 AND TMEM45A | 0.985294118 | 1 | 0.971014493 | CLECL1 AND NOT-CD163 | 0.95 | 0.904761905 | 1 |
| ZDHHC4 AND NOT-TSPAN8 | 0.970149254 | 1 | 0.942028986 | CLECL1 AND NOT-NDST3 | 0.936708861 | 0.902439024 | 0.973684211 |
| PTPRZ1 AND TMEM33 | 0.970149254 | 1 | 0.942028986 | CLECL1 AND NOT-NRXN1 | 0.926829268 | 0.863636364 | 1 |
| PTPRZ1 AND TMEM39A | 0.985294118 | 1 | 0.971014493 | CLECL1 AND NOT-CD101 | 0.926829268 | 0.863636364 | 1 |
| PTPRZ1 AND NOT-TMEM144 | 0.977777778 | 1 | 0.956521739 | CLECL1 AND NOT-CD28 | 0.926829268 | 0.863636364 | 1 |
| PTPRZ1 AND AGPAT5 | 0.977777778 | 1 | 0.956521739 | CLECL1 AND NOT-KCNK6 | 0.962025316 | 0.926829268 | 1 |
| PTPRZ1 AND DRAM1 | 0.970149254 | 1 | 0.942028986 | CLECL1 AND NOT-ABCG2 | 0.95 | 0.904761905 | 1 |
| PTPRZ1 AND LAPTM4B | 0.977777778 | 1 | 0.956521739 | CLECL1 AND NOT-TNFRSF8 | 0.948717949 | 0.925 | 0.973684211 |
| PTPRZ1 AND CSGALNACT2 | 0.99270073 | 1 | 0.985507246 | CLECL1 AND NOT-CD33 | 0.926829268 | 0.863636364 | 1 |
| PTPRZ1 AND PRCP | 0.977777778 | 1 | 0.956521739 | CLECL1 AND NOT-CD36 | 0.936708861 | 0.902439024 | 0.973684211 |
| PTPRZ1 AND PARL | 0.985294118 | 1 | 0.971014493 | CLECL1 AND NOT-SCAMP1 | 0.938271605 | 0.88372093 | 1 |
| PTPRZ1 AND ETNK1 | 0.985294118 | 1 | 0.971014493 | CLECL1 AND NOT-CD68 | 0.926829268 | 0.863636364 | 1 |
| PTPRZ1 AND ZDHHC7 | 0.977777778 | 1 | 0.956521739 | CLECL1 AND NOT-TM9SF4 | 0.926829268 | 0.863636364 | 1 |
| PTPRZ1 AND FLVCR2 | 0.985294118 | 1 | 0.971014493 | CLECL1 AND NOT-MFAP3L | 0.926829268 | 0.863636364 | 1 |
| PTPRZ1 AND TMEM127 | 0.977777778 | 1 | 0.956521739 | CLECL1 AND NOT-TRIL | 0.926829268 | 0.863636364 | 1 |
| PTPRZ1 AND SLC30A6 | 0.977777778 | 1 | 0.956521739 | NOT-DAG1 AND CELSR1 | 0.95 | 0.904761905 | 1 |
| PTPRZ1 AND TMEM30A | 0.970149254 | 1 | 0.942028986 | QSOX2 AND NOT-TMEM92 | 0.935064935 | 0.923076923 | 0.947368421 |
| PTPRZ1 AND NGLY1 | 0.99270073 | 1 | 0.985507246 | QSOX2 AND NOT-TRPV3 | 0.936708861 | 0.902439024 | 0.973684211 |
| PTPRZ1 AND RNF130 | 0.970149254 | 1 | 0.942028986 | QSOX2 AND NOT-SLC16A11 | 0.936708861 | 0.902439024 | 0.973684211 |
| PTPRZ1 AND PAG1 | 0.970149254 | 1 | 0.942028986 | QSOX2 AND NOT-PTCRA | 0.973684211 | 0.973684211 | 0.973684211 |
| PTPRZ1 AND VIMP | 0.985294118 | 1 | 0.971014493 | QSOX2 AND NOT-PGAM5 | 0.948717949 | 0.925 | 0.973684211 |
| PTPRZ1 AND GLT8D1 | 0.970149254 | 1 | 0.942028986 | QSOX2 AND NOT-SLC51A | 0.935064935 | 0.923076923 | 0.947368421 |
| PTPRZ1 AND EMC3 | 0.970149254 | 1 | 0.942028986 | QSOX2 AND NOT-EPO | 0.961038961 | 0.948717949 | 0.973684211 |
| PTPRZ1 AND PLGRKT | 0.970149254 | 1 | 0.942028986 | QSOX2 AND NOT-F10 | 0.935064935 | 0.923076923 | 0.947368421 |
| PTPRZ1 AND ECHDC1 | 0.985294118 | 1 | 0.971014493 | QSOX2 AND NOT-FCAR | 0.936708861 | 0.902439024 | 0.973684211 |
| PTPRZ1 AND TMEM126B | 0.985294118 | 1 | 0.971014493 | QSOX2 AND NOT-MS4A2 | 0.948717949 | 0.925 | 0.973684211 |
| PTPRZ1 AND NOT-GABRQ | 0.985294118 | 1 | 0.971014493 | QSOX2 AND NOT-ADGRG3 | 0.948717949 | 0.925 | 0.973684211 |
| PTPRZ1 AND BCAP29 | 0.970149254 | 1 | 0.942028986 | QSOX2 AND NOT-FGF10 | 0.936708861 | 0.902439024 | 0.973684211 |
| PTPRZ1 AND NOT-PCDHGB6 | 0.99270073 | 1 | 0.985507246 | QSOX2 AND NOT-MLC1 | 0.935064935 | 0.923076923 | 0.947368421 |
| PTPRZ1 AND NOT-GKN1 | 0.985294118 | 1 | 0.971014493 | QSOX2 AND NOT-FLT3LG | 0.936708861 | 0.902439024 | 0.973684211 |
| PTPRZ1 AND NOT-TRPV5 | 0.985294118 | 1 | 0.971014493 | QSOX2 AND NOT-NCSTN | 0.961038961 | 0.948717949 | 0.973684211 |
| PTPRZ1 AND NOT-TMPRSS15 | 0.985294118 | 1 | 0.971014493 | QSOX2 AND NOT-IL17RA | 0.948717949 | 0.925 | 0.973684211 |
| PTPRZ1 AND DIABLO | 0.970149254 | 1 | 0.942028986 | QSOX2 AND NOT-BCL2L13 | 0.935064935 | 0.923076923 | 0.947368421 |
| PTPRZ1 AND PSEN1 | 0.970149254 | 1 | 0.942028986 | QSOX2 AND NOT-FAM26E | 0.936708861 | 0.902439024 | 0.973684211 |
| PTPRZ1 AND NOT-TMPRSS4 | 0.985294118 | 1 | 0.971014493 | QSOX2 AND NOT-CCDC108 | 0.936708861 | 0.902439024 | 0.973684211 |
| PTPRZ1 AND NPDC1 | 0.985294118 | 1 | 0.971014493 | QSOX2 AND NOT-GABRA4 | 0.936708861 | 0.902439024 | 0.973684211 |
| PTPRZ1 AND TMEM9B | 0.99270073 | 1 | 0.985507246 | QSOX2 AND NOT-GABRD | 0.935064935 | 0.923076923 | 0.947368421 |
| PTPRZ1 AND EMC7 | 0.977777778 | 1 | 0.956521739 | QSOX2 AND NOT-LY6G6F | 0.961038961 | 0.948717949 | 0.973684211 |
| CHST10 AND NOT-CELF4 | 0.970149254 | 1 | 0.942028986 | QSOX2 AND NOT-TAS2R41 | 0.947368421 | 0.947368421 | 0.947368421 |
| PTPRZ1 AND NOT-OTOR | 0.99270073 | 1 | 0.985507246 | QSOX2 AND NOT-SLITRK5 | 0.935064935 | 0.923076923 | 0.947368421 |
| PTPRZ1 AND NOT-C2orf83 | 0.970149254 | 1 | 0.942028986 | QSOX2 AND NOT-OR2M4 | 0.935064935 | 0.923076923 | 0.947368421 |
| PTPRZ1 AND C5orf15 | 0.977777778 | 1 | 0.956521739 | QSOX2 AND NOT-KCNG2 | 0.961038961 | 0.948717949 | 0.973684211 |
| PTPRZ1 AND ACKR3 | 0.985294118 | 1 | 0.971014493 | QSOX2 AND NOT-GCGR | 0.936708861 | 0.902439024 | 0.973684211 |
| PTPRZ1 AND NOT-SLC17A7 | 0.977777778 | 1 | 0.956521739 | QSOX2 AND NOT-OR8B8 | 0.918918919 | 0.944444444 | 0.894736842 |
| PTPRZ1 AND ATP13A1 | 0.970149254 | 1 | 0.942028986 | QSOX2 AND NOT-HS6ST3 | 0.936708861 | 0.902439024 | 0.973684211 |
| PTPRZ1 AND SLC44A2 | 0.985294118 | 1 | 0.971014493 | QSOX2 AND NOT-B4GALT1 | 0.936708861 | 0.902439024 | 0.973684211 |
| PTPRZ1 AND SNX14 | 0.99270073 | 1 | 0.985507246 | QSOX2 AND NOT-DKKL1 | 0.961038961 | 0.948717949 | 0.973684211 |
| PTPRZ1 AND NOT-PTGDR | 0.99270073 | 1 | 0.985507246 | QSOX2 AND NOT-SIGLEC9 | 0.936708861 | 0.902439024 | 0.973684211 |
| PTPRZ1 AND NOT-PTGER3 | 0.985294118 | 1 | 0.971014493 | QSOX2 AND NOT-GPR78 | 0.96 | 0.972972973 | 0.947368421 |

FIG. 1 (CONT.)

| Antigen Pair Logic | F1 | Precision | Recall |
|---|---|---|---|
| PTPRZ1 AND CYP20A1 | 0.977777778 | 1 | 0.956521739 |
| PTPRZ1 AND MAVS | 0.970149254 | 1 | 0.942028986 |
| GPR158 AND NOT-UGT2B15 | 0.977777778 | 1 | 0.956521739 |
| GPR158 AND PTTG1IP | 0.977777778 | 1 | 0.956521739 |
| PTPRZ1 AND PTPN2 | 0.99270073 | 1 | 0.985507246 |
| PTPRZ1 AND NOT-SLAMF7 | 0.985294118 | 1 | 0.971014493 |
| PTPRZ1 AND PEX2 | 0.977777778 | 1 | 0.956521739 |
| PTPRZ1 AND MS4A7 | 0.970149254 | 1 | 0.942028986 |
| PTPRZ1 AND JAM2 | 0.985294118 | 1 | 0.971014493 |
| PTPRZ1 AND OSTC | 0.985294118 | 1 | 0.971014493 |
| PTPRZ1 AND SELK | 0.977777778 | 1 | 0.956521739 |
| PTPRZ1 AND NOT-ACE2 | 0.99270073 | 1 | 0.985507246 |
| PTPRZ1 AND NOT-CACNG6 | 0.977777778 | 1 | 0.956521739 |
| PTPRZ1 AND RBM3 | 0.99270073 | 1 | 0.985507246 |
| PTPRZ1 AND NOT-RHAG | 0.99270073 | 1 | 0.985507246 |
| PTPRZ1 AND RPN1 | 0.970149254 | 1 | 0.942028986 |
| PTPRZ1 AND RPN2 | 0.99270073 | 1 | 0.985507246 |
| PTPRZ1 AND RYK | 0.99270073 | 1 | 0.985507246 |
| PTPRZ1 AND CCL4 | 0.977777778 | 1 | 0.956521739 |
| PTPRZ1 AND NOT-CCL22 | 0.985294118 | 1 | 0.971014493 |
| PTPRZ1 AND SRR | 0.977777778 | 1 | 0.956521739 |
| PTPRZ1 AND SDCBP | 0.985294118 | 1 | 0.971014493 |
| PTPRZ1 AND MANBAL | 0.99270073 | 1 | 0.985507246 |
| PTPRZ1 AND MCUR1 | 0.977777778 | 1 | 0.956521739 |
| PTPRZ1 AND ADGRL4 | 0.970149254 | 1 | 0.942028986 |
| PTPRZ1 AND NOT-SEMA4A | 0.977777778 | 1 | 0.956521739 |
| PTPRZ1 AND MS4A6A | 0.970149254 | 1 | 0.942028986 |
| PTPRZ1 AND C5orf28 | 0.970149254 | 1 | 0.942028986 |
| PTPRZ1 AND PCNXL4 | 0.99270073 | 1 | 0.985507246 |
| PTPRZ1 AND SGCB | 0.985294118 | 1 | 0.971014493 |
| PTPRZ1 AND NOT-NDST4 | 0.977777778 | 1 | 0.956521739 |
| PTPRZ1 AND NOT-SYNDIG1L | 0.985294118 | 1 | 0.971014493 |
| PTPRZ1 AND NOT-TMPRSS3 | 0.977777778 | 1 | 0.956521739 |
| PTPRZ1 AND NOT-LRRC19 | 0.99270073 | 1 | 0.985507246 |
| PTPRZ1 AND SLC30A5 | 0.985294118 | 1 | 0.971014493 |
| PTPRZ1 AND NOT-SLAMF1 | 0.99270073 | 1 | 0.985507246 |
| PTPRZ1 AND SLC3A2 | 0.985294118 | 1 | 0.971014493 |
| PTPRZ1 AND NOT-SLC5A1 | 0.99270073 | 1 | 0.985507246 |
| PTPRZ1 AND MPPE1 | 0.977777778 | 1 | 0.956521739 |
| PTPRZ1 AND SLC5A3 | 0.985294118 | 1 | 0.971014493 |
| PTPRZ1 AND NOT-SLC6A2 | 0.985294118 | 1 | 0.971014493 |
| PTPRZ1 AND NOT-SLC6A4 | 0.985294118 | 1 | 0.971014493 |
| PTPRZ1 AND NOT-SLC10A1 | 0.977777778 | 1 | 0.956521739 |
| PTPRZ1 AND NOT-SLC18A2 | 0.985294118 | 1 | 0.971014493 |
| PTPRZ1 AND SLC20A1 | 0.99270073 | 1 | 0.985507246 |
| PTPRZ1 AND BMPR1A | 0.970149254 | 1 | 0.942028986 |
| PTPRZ1 AND NOT-SLC22A1 | 0.99270073 | 1 | 0.985507246 |
| PTPRZ1 AND NOT-CYP4F12 | 0.977777778 | 1 | 0.956521739 |
| PTPRZ1 AND BNIP2 | 0.99270073 | 1 | 0.985507246 |
| PTPRZ1 AND SOAT1 | 0.977777778 | 1 | 0.956521739 |
| PTPRZ1 AND NOT-SRD5A2 | 0.977777778 | 1 | 0.956521739 |
| PTPRZ1 AND NOT-BPI | 0.99270073 | 1 | 0.985507246 |
| PTPRZ1 AND SSR2 | 0.970149254 | 1 | 0.942028986 |
| PTPRZ1 AND SSR3 | 0.977777778 | 1 | 0.956521739 |
| PTPRZ1 AND HSPA13 | 0.99270073 | 1 | 0.985507246 |
| PTPRZ1 AND STX4 | 0.970149254 | 1 | 0.942028986 |
| PTPRZ1 AND SURF4 | 0.99270073 | 1 | 0.985507246 |
| PTPRZ1 AND VAMP7 | 0.970149254 | 1 | 0.942028986 |
| PTPRZ1 AND NOT-SYP | 0.970149254 | 1 | 0.942028986 |
| PTPRZ1 AND TAPBP | 0.985294118 | 1 | 0.971014493 |
| PTPRZ1 AND TGFBI | 0.977777778 | 1 | 0.956521739 |
| PTPRZ1 AND NOT-ICAM5 | 0.99270073 | 1 | 0.985507246 |
| PTPRZ1 AND NOT-TM4SF4 | 0.977777778 | 1 | 0.956521739 |
| PTPRZ1 AND TMPO | 0.99270073 | 1 | 0.985507246 |
| PTPRZ1 AND NOT-TYR | 0.985294118 | 1 | 0.971014493 |
| PTPRZ1 AND NOT-UPK1B | 0.977777778 | 1 | 0.956521739 |
| PTPRZ1 AND NOT-UGT2B15 | 0.985294118 | 1 | 0.971014493 |
| PTPRZ1 AND NOT-WNT7A | 0.977777778 | 1 | 0.956521739 |
| PTPRZ1 AND NOT-WNT9B | 0.985294118 | 1 | 0.971014493 |
| PTPRZ1 AND WRB | 0.99270073 | 1 | 0.985507246 |
| PTPRZ1 AND PTTG1IP | 0.99270073 | 1 | 0.985507246 |
| PTPRZ1 AND ZNF7 | 0.977777778 | 1 | 0.956521739 |
| PTPRZ1 AND TMEM50B | 0.99270073 | 1 | 0.985507246 |
| PTPRZ1 AND ZNF138 | 0.977777778 | 1 | 0.956521739 |
| PTPRZ1 AND NOT-SLC30A3 | 0.970149254 | 1 | 0.942028986 |
| PTPRZ1 AND TVP23A | 0.970149254 | 1 | 0.942028986 |

| Antigen Pair Logic | F1 | Precision | Recall |
|---|---|---|---|
| QSOX2 AND NOT-GLRA1 | 0.936708861 | 0.902439024 | 0.973684211 |
| QSOX2 AND NOT-GP9 | 0.936708861 | 0.902439024 | 0.973684211 |
| QSOX2 AND NOT-GPM6B | 0.948717949 | 0.925 | 0.973684211 |
| QSOX2 AND NOT-GPR4 | 0.948717949 | 0.925 | 0.973684211 |
| QSOX2 AND NOT-FAM171A2 | 0.961038961 | 0.948717949 | 0.973684211 |
| QSOX2 AND NOT-GPR20 | 0.918918919 | 0.944444444 | 0.894736842 |
| QSOX2 AND NOT-CRB2 | 0.947368421 | 0.947368421 | 0.947368421 |
| QSOX2 AND NOT-GPR39 | 0.936708861 | 0.902439024 | 0.973684211 |
| QSOX2 AND NOT-TUSC5 | 0.96 | 0.972972973 | 0.947368421 |
| QSOX2 AND NOT-GRID2 | 0.936708861 | 0.902439024 | 0.973684211 |
| QSOX2 AND NOT-ANPEP | 0.948717949 | 0.925 | 0.973684211 |
| QSOX2 AND NOT-GRIK4 | 0.948717949 | 0.925 | 0.973684211 |
| QSOX2 AND NOT-GRIN1 | 0.948717949 | 0.925 | 0.973684211 |
| QSOX2 AND NOT-CNIH4 | 0.936708861 | 0.902439024 | 0.973684211 |
| QSOX2 AND NOT-GRM3 | 0.948717949 | 0.925 | 0.973684211 |
| QSOX2 AND NOT-GRM4 | 0.948717949 | 0.925 | 0.973684211 |
| QSOX2 AND NOT-CYP2S1 | 0.936708861 | 0.902439024 | 0.973684211 |
| QSOX2 AND NOT-GUCY2F | 0.935064935 | 0.923076923 | 0.947368421 |
| QSOX2 AND NOT-HFE | 0.935064935 | 0.923076923 | 0.947368421 |
| QSOX2 AND NOT-SLC29A2 | 0.933333333 | 0.945945946 | 0.921052632 |
| QSOX2 AND NOT-B4GALNT4 | 0.935064935 | 0.923076923 | 0.947368421 |
| QSOX2 AND NOT-MOGAT3 | 0.936708861 | 0.902439024 | 0.973684211 |
| QSOX2 AND NOT-IL12RB2 | 0.948717949 | 0.925 | 0.973684211 |
| QSOX2 AND NOT-INSRR | 0.935064935 | 0.923076923 | 0.947368421 |
| QSOX2 AND NOT-KCNC2 | 0.947368421 | 0.947368421 | 0.947368421 |
| QSOX2 AND NOT-IGFL1 | 0.936708861 | 0.902439024 | 0.973684211 |
| QSOX2 AND NOT-KCND3 | 0.936708861 | 0.902439024 | 0.973684211 |
| QSOX2 AND NOT-KIR2DL4 | 0.947368421 | 0.947368421 | 0.947368421 |
| QSOX2 AND NOT-KIR2DS4 | 0.947368421 | 0.947368421 | 0.947368421 |
| QSOX2 AND NOT-KIR3DL2 | 0.973684211 | 0.973684211 | 0.973684211 |
| QSOX2 AND NOT-LCAT | 0.935064935 | 0.923076923 | 0.947368421 |
| QSOX2 AND NOT-SPINK6 | 0.936708861 | 0.902439024 | 0.973684211 |
| QSOX2 AND NOT-ERVFRD-1 | 0.936708861 | 0.902439024 | 0.973684211 |
| QSOX2 AND NOT-MC5R | 0.948717949 | 0.925 | 0.973684211 |
| QSOX2 AND NOT-MOG | 0.948717949 | 0.925 | 0.973684211 |
| QSOX2 AND NOT-CD200 | 0.918918919 | 0.944444444 | 0.894736842 |
| QSOX2 AND NOT-PTCHD4 | 0.936708861 | 0.902439024 | 0.973684211 |
| QSOX2 AND NOT-MTHFD1 | 0.948717949 | 0.925 | 0.973684211 |
| QSOX2 AND NOT-ATP1A4 | 0.948717949 | 0.925 | 0.973684211 |
| QSOX2 AND NOT-NPY | 0.935064935 | 0.923076923 | 0.947368421 |
| QSOX2 AND NOT-NT5E | 0.929577465 | 1 | 0.868421053 |
| QSOX2 AND NOT-NUCB1 | 0.948717949 | 0.925 | 0.973684211 |
| QSOX2 AND NOT-OPCML | 0.935064935 | 0.923076923 | 0.947368421 |
| QSOX2 AND NOT-OR3A1 | 0.935064935 | 0.923076923 | 0.947368421 |
| QSOX2 AND NOT-CALY | 0.933333333 | 0.945945946 | 0.921052632 |
| QSOX2 AND NOT-KCNK4 | 0.961038961 | 0.948717949 | 0.973684211 |
| QSOX2 AND NOT-TAS2R3 | 0.936708861 | 0.902439024 | 0.973684211 |
| QSOX2 AND NOT-TAS2R16 | 0.935064935 | 0.923076923 | 0.947368421 |
| QSOX2 AND NOT-TAS2R14 | 0.947368421 | 0.947368421 | 0.947368421 |
| QSOX2 AND NOT-CLEC4A | 0.931506849 | 0.971428571 | 0.894736842 |
| QSOX2 AND NOT-CDON | 0.935064935 | 0.923076923 | 0.947368421 |
| QSOX2 AND NOT-PRLH | 0.933333333 | 0.945945946 | 0.921052632 |
| QSOX2 AND NOT-TMEM69 | 0.936708861 | 0.902439024 | 0.973684211 |
| QSOX2 AND NOT-TEX264 | 0.935064935 | 0.923076923 | 0.947368421 |
| QSOX2 AND NOT-AIG1 | 0.947368421 | 0.947368421 | 0.947368421 |
| QSOX2 AND NOT-TRPV2 | 0.948717949 | 0.925 | 0.973684211 |
| QSOX2 AND NOT-GDE1 | 0.948717949 | 0.925 | 0.973684211 |
| QSOX2 AND NOT-NBAS | 0.948717949 | 0.925 | 0.973684211 |
| QSOX2 AND NOT-ATP5G3 | 0.936708861 | 0.902439024 | 0.973684211 |
| QSOX2 AND NOT-PI3 | 0.936708861 | 0.902439024 | 0.973684211 |
| QSOX2 AND NOT-PKHD1 | 0.948717949 | 0.925 | 0.973684211 |
| QSOX2 AND NOT-IL20RA | 0.936708861 | 0.902439024 | 0.973684211 |
| QSOX2 AND NOT-NLGN3 | 0.948717949 | 0.925 | 0.973684211 |
| QSOX2 AND NOT-TAS2R5 | 0.936708861 | 0.902439024 | 0.973684211 |
| QSOX2 AND NOT-POR | 0.948717949 | 0.925 | 0.973684211 |
| QSOX2 AND NOT-QPCTL | 0.948717949 | 0.925 | 0.973684211 |
| QSOX2 AND NOT-BEST2 | 0.935064935 | 0.923076923 | 0.947368421 |
| QSOX2 AND NOT-RETSAT | 0.936708861 | 0.902439024 | 0.973684211 |
| QSOX2 AND NOT-PIGX | 0.936708861 | 0.902439024 | 0.973684211 |
| QSOX2 AND NOT-SLC35F6 | 0.948717949 | 0.925 | 0.973684211 |
| QSOX2 AND NOT-ACPP | 0.935064935 | 0.923076923 | 0.947368421 |
| QSOX2 AND NOT-SLC35C1 | 0.973684211 | 0.973684211 | 0.973684211 |
| QSOX2 AND NOT-AVPR2 | 0.936708861 | 0.902439024 | 0.973684211 |
| QSOX2 AND NOT-CHST12 | 0.95890411 | 1 | 0.921052632 |
| QSOX2 AND NOT-POMGNT1 | 0.948717949 | 0.925 | 0.973684211 |
| QSOX2 AND NOT-FLVCR2 | 0.948717949 | 0.925 | 0.973684211 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-BSND | 0.985294118 | 1 | 0.971014493 | QSOX2 AND NOT-AJAP1 | 0.947368421 | 0.947368421 | 0.947368421 |
| PTPRZ1 AND DDR1 | 0.977777778 | 1 | 0.956521739 | QSOX2 AND NOT-PCDHA10 | 0.947368421 | 0.947368421 | 0.947368421 |
| PTPRZ1 AND PXDN | 0.970149254 | 1 | 0.942028986 | QSOX2 AND NOT-PRRG2 | 0.918918919 | 0.944444444 | 0.894736842 |
| PTPRZ1 AND ALG8 | 0.985294118 | 1 | 0.971014493 | QSOX2 AND NOT-SUCNR1 | 0.948717949 | 0.925 | 0.973684211 |
| PTPRZ1 AND REEP5 | 0.99270073 | 1 | 0.985507246 | QSOX2 AND NOT-NDUFA4L2 | 0.948717949 | 0.925 | 0.973684211 |
| PTPRZ1 AND ATG9A | 0.970149254 | 1 | 0.942028986 | QSOX2 AND NOT-ANO2 | 0.935064935 | 0.923076923 | 0.947368421 |
| PTPRZ1 AND APOO | 0.99270073 | 1 | 0.985507246 | QSOX2 AND NOT-TRPC7 | 0.935064935 | 0.923076923 | 0.947368421 |
| PTPRZ1 AND DERL1 | 0.977777778 | 1 | 0.956521739 | QSOX2 AND NOT-PTGER1 | 0.933333333 | 0.945945946 | 0.921052632 |
| PTPRZ1 AND MFSD11 | 0.99270073 | 1 | 0.985507246 | QSOX2 AND NOT-PTGER4 | 0.948717949 | 0.925 | 0.973684211 |
| PTPRZ1 AND TMEM243 | 0.970149254 | 1 | 0.942028986 | QSOX2 AND NOT-LRTM1 | 0.933333333 | 0.945945946 | 0.921052632 |
| PTPRZ1 AND TMEM43 | 0.99270073 | 1 | 0.985507246 | QSOX2 AND NOT-MAVS | 0.935064935 | 0.923076923 | 0.947368421 |
| PTPRZ1 AND NOT-OR2H2 | 0.99270073 | 1 | 0.985507246 | QSOX2 AND NOT-ISLR2 | 0.948717949 | 0.925 | 0.973684211 |
| PTPRZ1 AND NOT-FCRL2 | 0.977777778 | 1 | 0.956521739 | QSOX2 AND NOT-PTPRH | 0.936708861 | 0.902439024 | 0.973684211 |
| PTPRZ1 AND NOT-NOX5 | 0.99270073 | 1 | 0.985507246 | QSOX2 AND NOT-PVRL1 | 0.936708861 | 0.902439024 | 0.973684211 |
| PTPRZ1 AND C17orf62 | 0.985294118 | 1 | 0.971014493 | QSOX2 AND NOT-PRPH2 | 0.936708861 | 0.902439024 | 0.973684211 |
| PTPRZ1 AND ATP13A3 | 0.985294118 | 1 | 0.971014493 | QSOX2 AND NOT-RHCE | 0.973684211 | 0.973684211 | 0.973684211 |
| PTPRZ1 AND TTC13 | 0.99270073 | 1 | 0.985507246 | QSOX2 AND NOT-ROM1 | 0.936708861 | 0.902439024 | 0.973684211 |
| PTPRZ1 AND ADIPOR2 | 0.985294118 | 1 | 0.971014493 | QSOX2 AND NOT-SLC39A8 | 0.948717949 | 0.925 | 0.973684211 |
| PTPRZ1 AND RHBDF2 | 0.970149254 | 1 | 0.942028986 | QSOX2 AND NOT-POPDC3 | 0.936708861 | 0.902439024 | 0.973684211 |
| PTPRZ1 AND TMEM204 | 0.985294118 | 1 | 0.971014493 | QSOX2 AND NOT-NDST4 | 0.948717949 | 0.925 | 0.973684211 |
| PTPRZ1 AND MANEA | 0.970149254 | 1 | 0.942028986 | QSOX2 AND NOT-SHH | 0.935064935 | 0.923076923 | 0.947368421 |
| PTPRZ1 AND NOT-C1orf115 | 0.985294118 | 1 | 0.971014493 | QSOX2 AND NOT-IL25 | 0.936708861 | 0.902439024 | 0.973684211 |
| PTPRZ1 AND TXNDC15 | 0.985294118 | 1 | 0.971014493 | QSOX2 AND NOT-CYP3A43 | 0.936708861 | 0.902439024 | 0.973684211 |
| PTPRZ1 AND SI7 | 0.99270073 | 1 | 0.985507246 | QSOX2 AND NOT-ST3GAL2 | 0.935064935 | 0.923076923 | 0.947368421 |
| PTPRZ1 AND NOT-ZDHHC11 | 0.985294118 | 1 | 0.971014493 | QSOX2 AND NOT-PORCN | 0.961038961 | 0.948717949 | 0.973684211 |
| PTPRZ1 AND NOT-CALCR | 0.970149254 | 1 | 0.942028986 | QSOX2 AND NOT-SLC1A5 | 0.948717949 | 0.925 | 0.973684211 |
| PTPRZ1 AND UXS1 | 0.985294118 | 1 | 0.971014493 | QSOX2 AND NOT-SLC5A2 | 0.936708861 | 0.902439024 | 0.973684211 |
| PTPRZ1 AND ORAI2 | 0.977777778 | 1 | 0.956521739 | QSOX2 AND NOT-SLC6A2 | 0.936708861 | 0.902439024 | 0.973684211 |
| PTPRZ1 AND NOT-BPIFB2 | 0.99270073 | 1 | 0.985507246 | QSOX2 AND NOT-LRTM2 | 0.935064935 | 0.923076923 | 0.947368421 |
| PTPRZ1 AND CD276 | 0.985294118 | 1 | 0.971014493 | QSOX2 AND NOT-SLC9A2 | 0.935064935 | 0.923076923 | 0.947368421 |
| PTPRZ1 AND NOT-SPX | 0.970149254 | 1 | 0.942028986 | QSOX2 AND NOT-SLC9A3 | 0.936708861 | 0.902439024 | 0.973684211 |
| PTPRZ1 AND MLF2 | 0.977777778 | 1 | 0.956521739 | QSOX2 AND NOT-SMPD2 | 0.916666667 | 0.970588235 | 0.868421053 |
| PTPRZ1 AND CLPTM1L | 0.99270073 | 1 | 0.985507246 | QSOX2 AND NOT-SORL1 | 0.935064935 | 0.923076923 | 0.947368421 |
| PTPRZ1 AND SGPP1 | 0.977777778 | 1 | 0.956521739 | QSOX2 AND NOT-SOX1 | 0.936708861 | 0.902439024 | 0.973684211 |
| PTPRZ1 AND TMX1 | 0.985294118 | 1 | 0.971014493 | QSOX2 AND NOT-SSTR5 | 0.936708861 | 0.902439024 | 0.973684211 |
| PTPRZ1 AND YIPF5 | 0.99270073 | 1 | 0.985507246 | QSOX2 AND NOT-TRPC5 | 0.936708861 | 0.902439024 | 0.973684211 |
| PTPRZ1 AND APOLD1 | 0.977777778 | 1 | 0.956521739 | QSOX2 AND NOT-UPK1B | 0.936708861 | 0.902439024 | 0.973684211 |
| PTPRZ1 AND NOT-PVRL4 | 0.99270073 | 1 | 0.985507246 | QSOX2 AND NOT-CACNA1E | 0.935064935 | 0.923076923 | 0.947368421 |
| PTPRZ1 AND NIPA2 | 0.977777778 | 1 | 0.956521739 | QSOX2 AND NOT-FZD5 | 0.936708861 | 0.902439024 | 0.973684211 |
| PTPRZ1 AND NOT-ACSBG2 | 0.985294118 | 1 | 0.971014493 | QSOX2 AND NOT-VKORC1 | 0.948717949 | 0.925 | 0.973684211 |
| PTPRZ1 AND NOT-MADCAM1 | 0.970149254 | 1 | 0.942028986 | QSOX2 AND NOT-ALG12 | 0.948717949 | 0.925 | 0.973684211 |
| PTPRZ1 AND NOT-OR12D3 | 0.970149254 | 1 | 0.942028986 | QSOX2 AND NOT-SLC52A2 | 0.935064935 | 0.923076923 | 0.947368421 |
| PTPRZ1 AND NOT-SPACA1 | 0.977777778 | 1 | 0.956521739 | QSOX2 AND NOT-DNAJC22 | 0.948717949 | 0.925 | 0.973684211 |
| PTPRZ1 AND CANX | 0.970149254 | 1 | 0.942028986 | QSOX2 AND NOT-NRSN2 | 0.935064935 | 0.923076923 | 0.947368421 |
| PTPRZ1 AND CAPZA2 | 0.970149254 | 1 | 0.942028986 | QSOX2 AND NOT-TRPM3 | 0.936708861 | 0.902439024 | 0.973684211 |
| PTPRZ1 AND DDX59 | 0.99270073 | 1 | 0.985507246 | QSOX2 AND NOT-MLLT10 | 0.931506849 | 0.971428571 | 0.894736842 |
| PTPRZ1 AND ARMC10 | 0.977777778 | 1 | 0.956521739 | QSOX2 AND NOT-PDCD1LG2 | 0.936708861 | 0.902439024 | 0.973684211 |
| PTPRZ1 AND TM2D2 | 0.985294118 | 1 | 0.971014493 | QSOX2 AND NOT-C6orf25 | 0.973684211 | 0.973684211 | 0.973684211 |
| PTPRZ1 AND STARD3NL | 0.99270073 | 1 | 0.985507246 | QSOX2 AND NOT-LY6G6C | 0.918918919 | 0.944444444 | 0.894736842 |
| PTPRZ1 AND SPNS1 | 0.977777778 | 1 | 0.956521739 | QSOX2 AND NOT-TMEM121 | 0.948717949 | 0.925 | 0.973684211 |
| PTPRZ1 AND ITFG3 | 0.985294118 | 1 | 0.971014493 | QSOX2 AND NOT-MLF2 | 0.936708861 | 0.902439024 | 0.973684211 |
| PTPRZ1 AND ANTXR1 | 0.977777778 | 1 | 0.956521739 | QSOX2 AND NOT-KCNH6 | 0.933333333 | 0.945945946 | 0.921052632 |
| PTPRZ1 AND FAR1 | 0.985294118 | 1 | 0.971014493 | QSOX2 AND NOT-ST8SIA2 | 0.935064935 | 0.923076923 | 0.947368421 |
| PTPRZ1 AND TMEM126A | 0.977777778 | 1 | 0.956521739 | QSOX2 AND NOT-OR51E2 | 0.936708861 | 0.902439024 | 0.973684211 |
| PTPRZ1 AND SLC37A3 | 0.977777778 | 1 | 0.956521739 | QSOX2 AND NOT-HM13 | 0.936708861 | 0.902439024 | 0.973684211 |
| PTPRZ1 AND JAGN1 | 0.977777778 | 1 | 0.956521739 | QSOX2 AND NOT-LRRC3 | 0.947368421 | 0.947368421 | 0.947368421 |
| PTPRZ1 AND ZNF559 | 0.977777778 | 1 | 0.956521739 | QSOX2 AND NOT-AKAP1 | 0.948717949 | 0.925 | 0.973684211 |
| PTPRZ1 AND HIATL1 | 0.985294118 | 1 | 0.971014493 | QSOX2 AND NOT-SLC10A3 | 0.918918919 | 0.944444444 | 0.894736842 |
| PTPRZ1 AND SLC35B4 | 0.977777778 | 1 | 0.956521739 | QSOX2 AND NOT-GSG1 | 0.948717949 | 0.925 | 0.973684211 |
| PTPRZ1 AND CIRH1A | 0.985294118 | 1 | 0.971014493 | QSOX2 AND NOT-FAM57B | 0.947368421 | 0.947368421 | 0.947368421 |
| PTPRZ1 AND COX14 | 0.985294118 | 1 | 0.971014493 | QSOX2 AND NOT-SLC25A18 | 0.935064935 | 0.923076923 | 0.947368421 |
| PTPRZ1 AND TMEM128 | 0.977777778 | 1 | 0.956521739 | QSOX2 AND NOT-GPR61 | 0.948717949 | 0.925 | 0.973684211 |
| PTPRZ1 AND TMEM60 | 0.970149254 | 1 | 0.942028986 | QSOX2 AND NOT-OR1G1 | 0.948717949 | 0.925 | 0.973684211 |
| PTPRZ1 AND DEGS1 | 0.99270073 | 1 | 0.985507246 | QSOX2 AND NOT-ADGRV1 | 0.936708861 | 0.902439024 | 0.973684211 |
| PTPRZ1 AND CAV1 | 0.977777778 | 1 | 0.956521739 | QSOX2 AND NOT-LRRC8C | 0.935064935 | 0.923076923 | 0.947368421 |
| PTPRZ1 AND NOT-CAV3 | 0.977777778 | 1 | 0.956521739 | QSOX2 AND NOT-YIPF4 | 0.936708861 | 0.902439024 | 0.973684211 |
| PTPRZ1 AND PPAP2A | 0.977777778 | 1 | 0.956521739 | QSOX2 AND NOT-MEGF11 | 0.961038961 | 0.948717949 | 0.973684211 |
| PTPRZ1 AND VAMP8 | 0.977777778 | 1 | 0.956521739 | QSOX2 AND NOT-CASR | 0.936708861 | 0.902439024 | 0.973684211 |
| PTPRZ1 AND B4GALT4 | 0.970149254 | 1 | 0.942028986 | QSOX2 AND NOT-TPST1 | 0.933333333 | 0.945945946 | 0.921052632 |
| PTPRZ1 AND GPAA1 | 0.977777778 | 1 | 0.956521739 | QSOX2 AND NOT-DGAT2 | 0.945945946 | 0.972222222 | 0.921052632 |
| PTPRZ1 AND NOT-TNFSF9 | 0.985294118 | 1 | 0.971014493 | QSOX2 AND NOT-ADGRE3 | 0.936708861 | 0.902439024 | 0.973684211 |
| PTPRZ1 AND NOT-ADAM21 | 0.970149254 | 1 | 0.942028986 | QSOX2 AND NOT-PIGO | 0.948717949 | 0.925 | 0.973684211 |
| PTPRZ1 AND NOT-ADAM18 | 0.977777778 | 1 | 0.956521739 | QSOX2 AND NOT-DEGS1 | 0.933333333 | 0.945945946 | 0.921052632 |
| PTPRZ1 AND CDS2 | 0.970149254 | 1 | 0.942028986 | QSOX2 AND NOT-PPAP2C | 0.935064935 | 0.923076923 | 0.947368421 |
| PTPRZ1 AND CD164 | 0.985294118 | 1 | 0.971014493 | QSOX2 AND NOT-TNFSF14 | 0.948717949 | 0.925 | 0.973684211 |
| PTPRZ1 AND PEX11B | 0.985294118 | 1 | 0.971014493 | QSOX2 AND NOT-IL1RL2 | 0.948717949 | 0.925 | 0.973684211 |

FIG. 1 (CONT.)

| Antigen Pair Logic | F1 | Precision | Recall | Antigen Pair Logic | F1 | Precision | Recall |
|---|---|---|---|---|---|---|---|
| PTPRZ1 AND NOT-TRPA1 | 0.977777778 | 1 | 0.956521739 | QSOX2 AND NOT-GALR2 | 0.936708861 | 0.902439024 | 0.973684211 |
| PTPRZ1 AND ATP6V0E1 | 0.977777778 | 1 | 0.956521739 | QSOX2 AND NOT-CACNA1I | 0.936708861 | 0.902439024 | 0.973684211 |
| PTPRZ1 AND PKD2L1 | 0.99270073 | 1 | 0.985507246 | QSOX2 AND NOT-KCNH7 | 0.947368421 | 0.947368421 | 0.947368421 |
| PTPRZ1 AND TMEM263 | 0.970149254 | 1 | 0.942028986 | QSOX2 AND NOT-NAT8 | 0.947368421 | 0.947368421 | 0.947368421 |
| PTPRZ1 AND NOT-DUOXA1 | 0.970149254 | 1 | 0.942028986 | QSOX2 AND NOT-FER1L5 | 0.936708861 | 0.902439024 | 0.973684211 |
| PTPRZ1 AND CEP95 | 0.985294118 | 1 | 0.971014493 | QSOX2 AND NOT-YIF1B | 0.948717949 | 0.925 | 0.973684211 |
| PTPRZ1 AND NOT-CD1A | 0.99270073 | 1 | 0.985507246 | QSOX2 AND NOT-CLDN2 | 0.936708861 | 0.902439024 | 0.973684211 |
| PTPRZ1 AND NOT-CD1B | 0.977777778 | 1 | 0.956521739 | QSOX2 AND NOT-SLC6A5 | 0.929577465 | 1 | 0.868421053 |
| PTPRZ1 AND SLC39A13 | 0.985294118 | 1 | 0.971014493 | QSOX2 AND NOT-SLC28A1 | 0.948717949 | 0.925 | 0.973684211 |
| PTPRZ1 AND AIFM1 | 0.985294118 | 1 | 0.971014493 | QSOX2 AND NOT-SYT12 | 0.936708861 | 0.902439024 | 0.973684211 |
| PTPRZ1 AND NOT-HTR3B | 0.985294118 | 1 | 0.971014493 | QSOX2 AND NOT-LMBRD2 | 0.948717949 | 0.925 | 0.973684211 |
| PTPRZ1 AND NOT-CD3G | 0.977777778 | 1 | 0.956521739 | QSOX2 AND NOT-LEMD1 | 0.948717949 | 0.925 | 0.973684211 |
| PTPRZ1 AND NOT-TIMD4 | 0.99270073 | 1 | 0.985507246 | QSOX2 AND NOT-OPALIN | 0.947368421 | 0.947368421 | 0.947368421 |
| PTPRZ1 AND NOT-GGTLC1 | 0.99270073 | 1 | 0.985507246 | QSOX2 AND NOT-NDST3 | 0.935064935 | 0.923076923 | 0.947368421 |
| PTPRZ1 AND XPR1 | 0.970149254 | 1 | 0.942028986 | QSOX2 AND NOT-ACPT | 0.948717949 | 0.925 | 0.973684211 |
| PTPRZ1 AND MTDH | 0.977777778 | 1 | 0.956521739 | QSOX2 AND NOT-NRXN1 | 0.935064935 | 0.923076923 | 0.947368421 |
| PTPRZ1 AND NOT-CD5 | 0.985294118 | 1 | 0.971014493 | QSOX2 AND NOT-SLC22A13 | 0.935064935 | 0.923076923 | 0.947368421 |
| PTPRZ1 AND NOT-GCNT3 | 0.99270073 | 1 | 0.985507246 | QSOX2 AND NOT-ABCG2 | 0.936708861 | 0.902439024 | 0.973684211 |
| PTPRZ1 AND G6PC3 | 0.985294118 | 1 | 0.971014493 | QSOX2 AND NOT-TNFRSF8 | 0.947368421 | 0.947368421 | 0.947368421 |
| PTPRZ1 AND DTD1 | 0.970149254 | 1 | 0.942028986 | QSOX2 AND NOT-TRIL | 0.936708861 | 0.902439024 | 0.973684211 |
| PTPRZ1 AND NOT-CD8B | 0.99270073 | 1 | 0.985507246 | PTPN1 AND NOT-PTCRA | 0.974358974 | 0.95 | 1 |
| PTPRZ1 AND NOT-TAAR2 | 0.99270073 | 1 | 0.985507246 | CD83 AND NOT-PTCRA | 0.947368421 | 0.947368421 | 0.947368421 |
| PTPRZ1 AND ORAI3 | 0.970149254 | 1 | 0.942028986 | CELSR1 AND NOT-EDNRA | 0.935064935 | 0.923076923 | 0.947368421 |
| PTPRZ1 AND PIGM | 0.99270073 | 1 | 0.985507246 | CELSR1 AND NOT-EFNA5 | 0.918918919 | 0.944444444 | 0.894736842 |
| PTPRZ1 AND NOT-MS4A1 | 0.977777778 | 1 | 0.956521739 | SNN AND NOT-EGF | 0.918918919 | 0.944444444 | 0.894736842 |
| PTPRZ1 AND GTF3C3 | 0.977777778 | 1 | 0.956521739 | CELSR1 AND NOT-EMP1 | 0.947368421 | 0.947368421 | 0.947368421 |
| PTPRZ1 AND B4GALT5 | 0.985294118 | 1 | 0.971014493 | NOT-MGST1 AND ETV6 | 0.947368421 | 0.947368421 | 0.947368421 |
| PTPRZ1 AND NOT-OPALIN | 0.985294118 | 1 | 0.971014493 | PTPN1 AND NOT-MS4A2 | 0.974358974 | 0.95 | 1 |
| PTPRZ1 AND NOT-CD22 | 0.985294118 | 1 | 0.971014493 | ORAI2 AND NOT-MS4A2 | 0.986666667 | 1 | 0.973684211 |
| PTPRZ1 AND NOT-GLP2R | 0.970149254 | 1 | 0.942028986 | NOT-FGFR2 AND CELSR1 | 0.936708861 | 0.902439024 | 0.973684211 |
| PTPRZ1 AND SFXN1 | 0.977777778 | 1 | 0.956521739 | PTPN1 AND NOT-DOLK | 0.987012987 | 0.974358974 | 1 |
| PTPRZ1 AND TMEM203 | 0.985294118 | 1 | 0.971014493 | SPG7 AND NOT-DOLK | 0.933333333 | 0.945945946 | 0.921052632 |
| PTPRZ1 AND CDYL | 0.977777778 | 1 | 0.956521739 | TMEM55B AND NOT-DOLK | 0.936708861 | 0.902439024 | 0.973684211 |
| PTPRZ1 AND NOT-SIGLEC6 | 0.99270073 | 1 | 0.985507246 | CELSR1 AND NOT-DOLK | 0.935064935 | 0.923076923 | 0.947368421 |
| PTPRZ1 AND STX8 | 0.970149254 | 1 | 0.942028986 | NOT-TEX2 AND ANKLE2 | 0.96 | 0.972972973 | 0.947368421 |
| PTPRZ1 AND CHST10 | 0.970149254 | 1 | 0.942028986 | NOT-ELOVL6 AND ANKLE2 | 0.948717949 | 0.925 | 0.973684211 |
| PTPRZ1 AND EEF1E1 | 0.985294118 | 1 | 0.971014493 | NOT-AGPAT9 AND ATP11B | 0.918918919 | 0.944444444 | 0.894736842 |
| PTPRZ1 AND EI24 | 0.985294118 | 1 | 0.971014493 | NUP210 AND NOT-KIR3DL2 | 0.918918919 | 0.944444444 | 0.894736842 |
| PTPRZ1 AND ATP5J2 | 0.99270073 | 1 | 0.985507246 | NUP210 AND NOT-TRPV2 | 0.944444444 | 1 | 0.894736842 |
| PTPRZ1 AND PDIA4 | 0.985294118 | 1 | 0.971014493 | PTPN1 AND NOT-FMO5 | 0.918918919 | 0.944444444 | 0.894736842 |
| PTPRZ1 AND CD63 | 0.99270073 | 1 | 0.985507246 | PTPN1 AND NOT-FPR2 | 0.948717949 | 0.925 | 0.973684211 |
| PTPRZ1 AND HERPUD1 | 0.985294118 | 1 | 0.971014493 | PTPN1 AND NOT-CLEC5A | 0.926829268 | 0.863636364 | 1 |
| PTPRZ1 AND LAPTM4A | 0.99270073 | 1 | 0.985507246 | PTPN1 AND NOT-SDF2L1 | 0.933333333 | 0.945945946 | 0.921052632 |
| PTPRZ1 AND CD81 | 0.985294118 | 1 | 0.971014493 | PTPN1 AND NOT-FUT5 | 0.926829268 | 0.863636364 | 1 |
| PTPRZ1 AND SUSD6 | 0.977777778 | 1 | 0.956521739 | NOT-MYOF AND ADAM17 | 0.962025316 | 0.926829268 | 1 |
| PTPRZ1 AND ADGRE5 | 0.99270073 | 1 | 0.985507246 | NOT-MGST1 AND ST6GALNAC4 | 0.933333333 | 0.945945946 | 0.921052632 |
| PTPRZ1 AND PTDSS1 | 0.99270073 | 1 | 0.985507246 | NOT-ACSS2 AND ST6GALNAC4 | 0.916666667 | 0.970588235 | 0.868421053 |
| PTPRZ1 AND TOMM70A | 0.977777778 | 1 | 0.956521739 | NOT-SLC22A4 AND ST6GALNAC4 | 0.973684211 | 0.973684211 | 0.973684211 |
| PTPRZ1 AND NOT-ATP2C2 | 0.970149254 | 1 | 0.942028986 | SNN AND NOT-CECR6 | 0.95890411 | 1 | 0.921052632 |
| PTPRZ1 AND HELZ | 0.977777778 | 1 | 0.956521739 | CELSR1 AND NOT-PCLO | 0.947368421 | 0.947368421 | 0.947368421 |
| PTPRZ1 AND NOT-SLC23A1 | 0.985294118 | 1 | 0.971014493 | NOT-GPM6B AND CELSR1 | 0.961038961 | 0.948717949 | 0.973684211 |
| CHST10 AND NOT-SCN2B | 0.970149254 | 1 | 0.942028986 | SPG7 AND NOT-CCR10 | 0.916666667 | 0.970588235 | 0.868421053 |
| CHST10 AND NOT-VAMP1 | 0.970149254 | 1 | 0.942028986 | NOT-ELOVL6 AND SLC6A16 | 0.938271605 | 0.88372093 | 1 |
| CHST10 AND NOT-UGT2B15 | 0.970149254 | 1 | 0.942028986 | NOT-ANPEP AND SLC37A1 | 0.936708861 | 0.902439024 | 0.973684211 |
| CNTNAP1 AND WRB | 0.970149254 | 1 | 0.942028986 | NOT-CNIH4 AND SLC37A1 | 0.987012987 | 0.974358974 | 1 |
| CHST10 AND NOT-SIGLEC6 | 0.970149254 | 1 | 0.942028986 | SPG7 AND NOT-CNIH4 | 0.933333333 | 0.945945946 | 0.921052632 |
| CHST10 AND CD63 | 0.970149254 | 1 | 0.942028986 | CELSR1 AND NOT-SLC39A2 | 0.933333333 | 0.945945946 | 0.921052632 |
| CHST10 AND LAPTM4A | 0.970149254 | 1 | 0.942028986 | CELSR1 AND NOT-IGSF3 | 0.935064935 | 0.923076923 | 0.947368421 |
| Carcinoma, Ductal, Breast (Breast C) | | | | ICAM3 AND NOT-SORL1 | 0.947368421 | 0.947368421 | 0.947368421 |
| CACFD1 AND NOT-TMED6 | 0.901960784 | 0.95833333 | 0.851851852 | ORAI2 AND NOT-ICAM4 | 0.931506849 | 0.971428571 | 0.894736842 |
| CACFD1 AND NOT-TMEM61 | 0.9 | 0.97826087 | 0.833333333 | SPG7 AND NOT-SERINC2 | 0.916666667 | 0.970588235 | 0.868421053 |
| CACFD1 AND NOT-CDHR2 | 0.901960784 | 0.95833333 | 0.851851852 | SLC37A1 AND NOT-IL6R | 0.938271605 | 0.88372093 | 1 |
| NOT-TMEM246 AND CACFD1 | 0.907407407 | 0.90740741 | 0.907407407 | IL10RA AND NOT-TRPV2 | 0.974358974 | 0.95 | 1 |
| CACFD1 AND NOT-SLC4A4 | 0.909090909 | 1 | 0.833333333 | IL10RA AND NOT-CHST12 | 0.933333333 | 0.945945946 | 0.921052632 |
| NOT-SLC4A4 AND C10orf35 | 0.914285714 | 0.94117647 | 0.888888889 | IL10RA AND NOT-SORL1 | 0.945945946 | 0.972222222 | 0.921052632 |
| RNF121 AND NOT-PTCH1 | 0.903846154 | 0.94 | 0.87037037 | ADAM17 AND NOT-ITGA5 | 0.948717949 | 0.925 | 0.973684211 |
| Carcinoma, Renal Cell (Renal) | | | | CELSR1 AND NOT-IGFL1 | 0.933333333 | 0.945945946 | 0.921052632 |
| NOT-SCARA5 AND CAV2 | 0.909090909 | 1 | 0.833333333 | NRROS AND NOT-MARCO | 0.929577465 | 1 | 0.868421053 |
| Carcinoma, Pancreatic Ductal (Pancreas) | | | | KCNN4 AND NOT-VKORC1 | 0.936708861 | 0.902439024 | 0.973684211 |
| CTRB2 AND NOT-CDH18 | 0.9 | 1 | 0.818181818 | SIDT1 AND NOT-KIR3DL2 | 0.95 | 0.904761905 | 1 |
| TM4SF4 AND NOT-ABCC2 | 0.909090909 | 0.90909091 | 0.909090909 | CXCR4 AND NOT-KIR3DL2 | 0.926829268 | 0.863636364 | 1 |
| TM4SF4 AND NOT-TMEM56 | 0.909090909 | 0.90909091 | 0.909090909 | ORAI2 AND NOT-KIR3DL2 | 0.961038961 | 0.948717949 | 0.973684211 |
| TM4SF4 AND NOT-CYP3A7 | 0.909090909 | 0.90909091 | 0.909090909 | CELSR1 AND NOT-SAMD5 | 0.933333333 | 0.945945946 | 0.921052632 |
| TM4SF4 AND NOT-CYP2J2 | 0.909090909 | 0.90909091 | 0.909090909 | SNN AND NOT-LRP3 | 0.933333333 | 0.945945946 | 0.921052632 |
| TM4SF4 AND NOT-CLYBL | 0.909090909 | 0.90909091 | 0.909090909 | NOT-LTBR AND SLC37A1 | 0.926829268 | 0.863636364 | 1 |
| TM4SF4 AND NOT-SLC35D1 | 0.909090909 | 0.90909091 | 0.909090909 | NOT-KITLG AND CELSR1 | 0.936708861 | 0.902439024 | 0.973684211 |

FIG. 1 (CONT.)

| Antigen Pair Logic | F1 | Precision | Recall |
|---|---|---|---|
| TM4SF4 AND NOT-G6PC | 0.909090909 | 0.90909091 | 0.909090909 |
| TM4SF4 AND GJA1 | 0.9 | 1 | 0.818181818 |
| CTRB2 AND NPTN | 0.9 | 1 | 0.818181818 |
| TM4SF4 AND NOT-ABCC6 | 0.909090909 | 0.90909091 | 0.909090909 |
| CTRB2 AND NOT-KCNN2 | 0.9 | 1 | 0.818181818 |
| CTRB2 AND RTN4 | 0.9 | 1 | 0.818181818 |
| CTRB2 AND NOT-TMEM63C | 0.9 | 1 | 0.818181818 |
| CTRB2 AND SDCBP | 0.9 | 1 | 0.818181818 |
| TM4SF4 AND NOT-DNAJC22 | 0.909090909 | 0.90909091 | 0.909090909 |
| TM4SF4 AND NOT-NAT8 | 0.909090909 | 0.90909091 | 0.909090909 |
| TM4SF4 AND NOT-SLC28A1 | 0.909090909 | 0.90909091 | 0.909090909 |
| TM4SF4 AND NOT-ENTPD5 | 0.952380952 | 1 | 0.909090909 |
| TM4SF4 AND CD63 | 0.9 | 1 | 0.818181818 |
| TM4SF4 AND NOT-SLC23A1 | 0.909090909 | 0.90909091 | 0.909090909 |
| Melanoma (Melanoma) | | | |
| MLANA | 1 | 1 | 1 |
| PMEL | 0.952380952 | 1 | 0.909090909 |
| MLANA | 1 | 1 | 1 |
| TMEM147 | 0.9 | 1 | 0.818181818 |
| CIRH1A | 0.952380952 | 1 | 0.909090909 |
| ROMO1 | 0.952380952 | 1 | 0.909090909 |
| MANBAL | 0.952380952 | 1 | 0.909090909 |
| FDPS | 1 | 1 | 1 |
| SFXN3 | 0.952380952 | 1 | 0.909090909 |
| OS9 | 0.952380952 | 1 | 0.909090909 |
| ERGIC3 | 0.9 | 1 | 0.818181818 |
| TMEM138 | 0.952380952 | 1 | 0.909090909 |
| NOT-FCN2 AND DBI | 0.909090909 | 0.90909091 | 0.909090909 |
| OS9 AND OS9 | 0.9 | 1 | 0.818181818 |
| KIAA1549L AND DBI | 0.9 | 1 | 0.818181818 |
| MLANA AND MLANA | 1 | 1 | 1 |
| TMED3 AND DBI | 0.9 | 1 | 0.818181818 |
| SFXN3 AND NOT-DBI | 0.952380952 | 1 | 0.909090909 |
| GPR19 AND DBI | 0.9 | 1 | 0.818181818 |
| NOT-ITGA2B AND DBI | 0.952380952 | 1 | 0.909090909 |
| NOT-VSTM1 AND DBI | 0.9 | 1 | 0.818181818 |
| BNIP1 AND DBI | 0.909090909 | 0.90909091 | 0.909090909 |
| NOT-CD300LB AND DBI | 0.952380952 | 1 | 0.909090909 |
| MANBAL AND DBI | 0.952380952 | 1 | 0.909090909 |
| TMEM138 AND DBI | 0.9 | 1 | 0.818181818 |
| NPC1 AND DBI | 0.952380952 | 1 | 0.909090909 |
| NOT-CIRH1A AND CIRH1A | 0.952380952 | 1 | 0.909090909 |
| NOT-ERGIC3 AND ERGIC3 | 0.9 | 1 | 0.818181818 |
| CTSA AND DBI | 0.9 | 1 | 0.818181818 |
| ADIPOR2 AND DBI | 0.9 | 1 | 0.818181818 |
| SLC5A6 AND DBI | 0.952380952 | 1 | 0.909090909 |
| MC1R AND DBI | 0.9 | 1 | 0.818181818 |
| TMEM147 AND TMEM147 | 0.9 | 1 | 0.818181818 |
| EXT1 AND DBI | 0.909090909 | 0.90909091 | 0.909090909 |
| TNFSF9 AND DBI | 0.952380952 | 1 | 0.909090909 |
| C11orf24 AND DBI | 0.9 | 1 | 0.818181818 |
| NOT-PMEL AND PMEL | 0.952380952 | 1 | 0.909090909 |
| BCAP31 AND DBI | 0.952380952 | 1 | 0.909090909 |
| FDPS AND DBI | 0.952380952 | 1 | 0.909090909 |
| PNKD AND DBI | 0.952380952 | 1 | 0.909090909 |
| ROMO1 AND NOT-ROMO1 | 0.952380952 | 1 | 0.909090909 |
| NAT14 AND DBI | 0.9 | 1 | 0.818181818 |
| MLANA AND BNIP3L | 1 | 1 | 1 |
| TMEM138 AND TMEM138 | 0.952380952 | 1 | 0.909090909 |
| CIRH1A AND NOT-BNIP3L | 0.9 | 1 | 0.818181818 |
| NOT-PMEL AND PMEL | 0.952380952 | 1 | 0.909090909 |
| FDPS AND NOT-BNIP3L | 0.952380952 | 1 | 0.909090909 |
| ROMO1 AND NOT-BNIP3L | 0.9 | 1 | 0.818181818 |
| DENND5A AND ENPP2 | 0.9 | 1 | 0.818181818 |
| NOT-TAAR8 AND ENPP2 | 0.956521739 | 0.91666667 | 1 |
| MLANA AND MLANA | 1 | 1 | 1 |
| NOT-NNAT AND ENPP2 | 0.9 | 1 | 0.818181818 |
| NOT-TM4SF5 AND ENPP2 | 1 | 1 | 1 |
| NOT-WSCD2 AND ENPP2 | 0.952380952 | 1 | 0.909090909 |
| NOT-SERPINA9 AND ENPP2 | 0.952380952 | 1 | 0.909090909 |
| GPR137B AND ENPP2 | 0.956521739 | 0.91666667 | 1 |
| NOT-TMEM95 AND ENPP2 | 1 | 1 | 1 |
| NOT-ABCC8 AND ENPP2 | 0.9 | 1 | 0.818181818 |
| NOT-C2orf82 AND ENPP2 | 0.952380952 | 1 | 0.909090909 |
| CIRH1A AND ENPP2 | 0.952380952 | 1 | 0.909090909 |
| NOT-SLC5A5 AND ENPP2 | 1 | 1 | 1 |

| Antigen Pair Logic | F1 | Precision | Recall |
|---|---|---|---|
| NOT-MGST1 AND ADAM17 | 0.947368421 | 0.947368421 | 0.947368421 |
| CELSR1 AND NOT-MST1R | 0.944444444 | 1 | 0.894736842 |
| SNN AND NOT-NCAM1 | 0.944444444 | 1 | 0.894736842 |
| P2RX5 AND NOT-SORL1 | 0.918918919 | 0.944444444 | 0.894736842 |
| NOT-PCSK5 AND SNN | 0.947368421 | 0.947368421 | 0.947368421 |
| NOT-FAM198B AND ADAM17 | 0.936708861 | 0.902439024 | 0.973684211 |
| NOT-FAM198B AND SNRNP40 | 0.961038961 | 0.948717949 | 0.973684211 |
| PTPN1 AND NOT-TRPV2 | 0.974358974 | 0.95 | 1 |
| CELSR1 AND NOT-DUOX1 | 0.935064935 | 0.923076923 | 0.947368421 |
| SLC37A1 AND NOT-ST3GAL4 | 0.918918919 | 0.944444444 | 0.894736842 |
| SLC37A1 AND NOT-SORL1 | 0.914285714 | 1 | 0.842105263 |
| SLC37A1 AND NOT-HM13 | 0.926829268 | 0.863636364 | 1 |
| NOT-AGPAT9 AND SLC37A1 | 0.926829268 | 0.863636364 | 1 |
| CELSR1 AND NOT-LY6K | 0.933333333 | 0.945945946 | 0.921052632 |
| SPG7 AND NOT-TRPM4 | 0.944444444 | 1 | 0.894736842 |
| NOT-TRPM4 AND CELSR1 | 0.95890411 | 1 | 0.921052632 |
| SIDT1 AND NOT-SORL1 | 0.936708861 | 0.902439024 | 0.973684211 |
| NOT-LPCAT2 AND ADAM17 | 0.926829268 | 0.863636364 | 1 |
| NOT-ELOVL6 AND BANP | 0.935064935 | 0.923076923 | 0.947368421 |
| CELSR1 AND NOT-TMEM51 | 0.96 | 0.972972973 | 0.947368421 |
| CELSR1 AND NOT-ANO1 | 0.918918919 | 0.944444444 | 0.894736842 |
| NOT-ANO10 AND CELSR1 | 0.974358974 | 0.95 | 1 |
| CELSR1 AND NOT-SPTLC3 | 0.935064935 | 0.923076923 | 0.947368421 |
| PTPN1 AND NOT-SLC35C1 | 0.947368421 | 0.947368421 | 0.947368421 |
| RHOT2 AND NOT-SLC35C1 | 0.933333333 | 0.945945946 | 0.921052632 |
| PTPN1 AND NOT-CHST12 | 0.933333333 | 0.945945946 | 0.921052632 |
| NOT-ELOVL6 AND NGLY1 | 0.961038961 | 0.948717949 | 0.973684211 |
| NOT-TEX2 AND SPG7 | 0.973684211 | 0.973684211 | 0.973684211 |
| NOT-TEX2 AND ST14 | 0.931506849 | 0.971428571 | 0.894736842 |
| NOT-TEX2 AND CELSR1 | 0.962025316 | 0.926829268 | 1 |
| NOT-ACSS2 AND ERGIC1 | 0.918918919 | 0.944444444 | 0.894736842 |
| NOT-ACSS2 AND ADAM17 | 0.933333333 | 0.945945946 | 0.921052632 |
| NOT-FAM20C AND ERGIC1 | 0.933333333 | 0.945945946 | 0.921052632 |
| NOT-FAM20C AND ADAM17 | 0.961038961 | 0.948717949 | 0.973684211 |
| SNN AND NOT-FAM20C | 0.945945946 | 0.972222222 | 0.921052632 |
| NOT-FAM20C AND SNRNP40 | 0.973684211 | 0.973684211 | 0.973684211 |
| NOT-CRISPLD2 AND ERGIC1 | 0.935064935 | 0.923076923 | 0.947368421 |
| NOT-MTUS1 AND CELSR1 | 0.936708861 | 0.902439024 | 0.973684211 |
| CELSR1 AND NOT-PTN | 0.947368421 | 0.947368421 | 0.947368421 |
| PTPN1 AND NOT-C5AR1 | 0.926829268 | 0.863636364 | 1 |
| PTPN1 AND NOT-VKORC1 | 0.962025316 | 0.926829268 | 1 |
| NOT-SLC46A2 AND ADAM17 | 0.948717949 | 0.925 | 0.973684211 |
| CELSR1 AND NOT-PVR | 0.933333333 | 0.945945946 | 0.921052632 |
| CELSR1 AND NOT-SCNN1B | 0.935064935 | 0.923076923 | 0.947368421 |
| NOT-SLC6A8 AND ST14 | 0.935064935 | 0.923076923 | 0.947368421 |
| NOT-SLC6A8 AND CELSR1 | 0.986666667 | 1 | 0.973684211 |
| NOT-SLC18A2 AND ADAM17 | 0.938271605 | 0.88372093 | 1 |
| NOT-SLC22A4 AND ADAM17 | 0.962025316 | 0.926829268 | 1 |
| NOT-SLC22A4 AND SNRNP40 | 0.938271605 | 0.88372093 | 1 |
| CELSR1 AND NOT-SLC22A5 | 0.914285714 | 1 | 0.842105263 |
| CD1D AND NOT-SORL1 | 0.931506849 | 0.971428571 | 0.894736842 |
| SPG7 AND NOT-C6orf25 | 0.933333333 | 0.945945946 | 0.921052632 |
| NOT-ELOVL6 AND ST14 | 0.96 | 0.972972973 | 0.947368421 |
| CELSR1 AND NOT-ELOVL4 | 0.916666667 | 0.970588235 | 0.868421053 |
| NOT-CRISPLD2 AND ADAM17 | 0.938271605 | 0.88372093 | 1 |
| NOT-B3GNT5 AND ADAM17 | 0.901408451 | 0.96969697 | 0.842105263 |
| NOT-PLXDC2 AND ADAM17 | 0.947368421 | 0.947368421 | 0.947368421 |
| ADAM17 AND NOT-MARCO | 0.916666667 | 0.970588235 | 0.868421053 |
| CELSR1 AND NOT-TMPRSS2 | 0.901408451 | 0.96969697 | 0.842105263 |
| NOT-XK AND CELSR1 | 0.931506849 | 0.971428571 | 0.894736842 |
| CELSR1 AND NOT-CA12 | 0.947368421 | 0.947368421 | 0.947368421 |
| CXCR4 AND CELSR1 | 0.936708861 | 0.902439024 | 0.973684211 |
| NOT-FZD5 AND CELSR1 | 0.973684211 | 0.973684211 | 0.973684211 |
| ORAI2 AND NOT-ELOVL6 | 0.961038961 | 0.948717949 | 0.973684211 |
| NOT-ELOVL6 AND CELSR1 | 0.974358974 | 0.95 | 1 |
| NOT-C2orf40 AND FKRP | 0.938271605 | 0.88372093 | 1 |
| NOT-RNF128 AND CELSR1 | 0.936708861 | 0.902439024 | 0.973684211 |
| CELSR1 AND NOT-ERMP1 | 0.918918919 | 0.944444444 | 0.894736842 |
| NOT-CRISPLD2 AND SNRNP40 | 0.962025316 | 0.926829268 | 1 |
| CELSR1 AND NOT-KREMEN1 | 0.935064935 | 0.923076923 | 0.947368421 |
| CELSR1 AND NOT-FAM213A | 0.931506849 | 0.971428571 | 0.894736842 |
| NOT-TMEM246 AND CELSR1 | 0.947368421 | 0.947368421 | 0.947368421 |
| NOT-TMEM101 AND SNRNP40 | 0.933333333 | 0.945945946 | 0.921052632 |
| NOT-PLXDC2 AND SNRNP40 | 0.935064935 | 0.923076923 | 0.947368421 |
| NOT-LRP11 AND CELSR1 | 0.938271605 | 0.88372093 | 1 |
| NOT-SMIM3 AND SNRNP40 | 0.914285714 | 1 | 0.842105263 |

FIG. 1 (CONT.)

| Antigen Pair Logic | F1 | Precision | Recall |
|---|---|---|---|
| NOT-SLC34A2 AND ENPP2 | 1 | 1 | 1 |
| NOT-PTH2 AND ENPP2 | 1 | 1 | 1 |
| AUP1 AND ENPP2 | 1 | 1 | 1 |
| NOT-VTCN1 AND ENPP2 | 0.9 | 1 | 0.818181818 |
| NOT-CLDN19 AND ENPP2 | 1 | 1 | 1 |
| C14orf2 AND ENPP2 | 0.9 | 1 | 0.818181818 |
| NOT-TMEM235 AND ENPP2 | 0.952380952 | 1 | 0.909090909 |
| MC1R AND NOT-MC1R | 0.9 | 1 | 0.818181818 |
| TMEM147 AND ENPP2 | 0.9 | 1 | 0.818181818 |
| NOT-ATP13A5 AND ENPP2 | 0.9 | 1 | 0.818181818 |
| NOT-NTRK3 AND ENPP2 | 0.9 | 1 | 0.818181818 |
| NOT-PTCH2 AND ENPP2 | 0.956521739 | 0.91666667 | 1 |
| NOT-PMEL AND PMEL | 0.952380952 | 1 | 0.909090909 |
| NOT-C8B AND ENPP2 | 0.952380952 | 1 | 0.909090909 |
| NOT-AVPR1B AND ENPP2 | 1 | 1 | 1 |
| NOT-KCNB1 AND ENPP2 | 0.956521739 | 0.91666667 | 1 |
| NOT-FCN2 AND POLG2 | 0.9 | 1 | 0.818181818 |
| MLANA AND POLG2 | 0.9 | 1 | 0.818181818 |
| CIRH1A AND POLG2 | 0.952380952 | 1 | 0.909090909 |
| SLC45A2 AND NOT-POLG2 | 0.952380952 | 1 | 0.909090909 |
| NOT-FCN2 AND DDB2 | 1 | 1 | 1 |
| OS9 AND OS9 | 0.9 | 1 | 0.818181818 |
| NOT-MLANA AND DDB2 | 0.916666667 | 0.84615385 | 1 |
| TMED3 AND DDB2 | 0.9 | 1 | 0.818181818 |
| SFXN3 AND NOT-DDB2 | 0.952380952 | 1 | 0.909090909 |
| NOT-CD300LB AND DDB2 | 1 | 1 | 1 |
| MANBAL AND DDB2 | 0.952380952 | 1 | 0.909090909 |
| APMAP AND DDB2 | 0.909090909 | 0.90909091 | 0.909090909 |
| TMEM138 AND DDB2 | 0.952380952 | 1 | 0.909090909 |
| NOT-CIRH1A AND CIRH1A | 0.952380952 | 1 | 0.909090909 |
| ERGIC3 AND NOT-DDB2 | 0.9 | 1 | 0.818181818 |
| SLC45A2 AND NOT-DDB2 | 0.909090909 | 0.90909091 | 0.909090909 |
| NOT-GP6 AND DDB2 | 0.9 | 1 | 0.818181818 |
| MC1R AND NOT-MC1R | 0.9 | 1 | 0.818181818 |
| EDNRB AND DDB2 | 0.9 | 1 | 0.818181818 |
| TMEM147 AND TMEM147 | 0.9 | 1 | 0.818181818 |
| NOT-PMEL AND PMEL | 0.952380952 | 1 | 0.909090909 |
| BCAP31 AND DDB2 | 0.952380952 | 1 | 0.909090909 |
| FDPS AND DDB2 | 1 | 1 | 1 |
| ROMO1 AND DDB2 | 0.952380952 | 1 | 0.909090909 |
| STARD3NL AND DDB2 | 0.9 | 1 | 0.818181818 |
| MLANA AND BSG | 1 | 1 | 1 |
| NOT-CIRH1A AND CIRH1A | 0.952380952 | 1 | 0.909090909 |
| SLC45A2 AND NOT-BSG | 0.9 | 1 | 0.818181818 |
| MC1R AND NOT-MC1R | 0.9 | 1 | 0.818181818 |
| TMEM147 AND TMEM147 | 0.9 | 1 | 0.818181818 |
| NOT-PMEL AND PMEL | 0.952380952 | 1 | 0.909090909 |
| NOT-SCN4A AND CDKN3 | 0.952380952 | 1 | 0.909090909 |
| MLANA AND CDKN3 | 1 | 1 | 1 |
| NOT-ISM2 AND CDKN3 | 0.952380952 | 1 | 0.909090909 |
| SLC45A2 AND NOT-CDKN3 | 0.952380952 | 1 | 0.909090909 |
| NOT-PMEL AND PMEL | 0.952380952 | 1 | 0.909090909 |
| NDUFA1 AND CDKN3 | 0.9 | 1 | 0.818181818 |
| STARD3NL AND CDKN3 | 0.9 | 1 | 0.818181818 |
| OS9 AND OS9 | 0.9 | 1 | 0.818181818 |
| KIAA1549L AND NOT-CSH1 | 0.952380952 | 1 | 0.909090909 |
| MLANA AND NOT-CSH1 | 1 | 1 | 1 |
| SFXN3 AND CSH1 | 0.9 | 1 | 0.818181818 |
| GPR19 AND NOT-CSH1 | 0.909090909 | 0.90909091 | 0.909090909 |
| PPT2 AND NOT-CSH1 | 0.9 | 1 | 0.818181818 |
| BNIP1 AND NOT-CSH1 | 0.952380952 | 1 | 0.909090909 |
| CLCN5 AND NOT-CSH1 | 0.916666667 | 0.84615385 | 1 |
| NSDHL AND NOT-CSH1 | 0.9 | 1 | 0.818181818 |
| TMEM138 AND TMEM138 | 0.952380952 | 1 | 0.909090909 |
| LSAMP AND NOT-CSH1 | 0.9 | 1 | 0.818181818 |
| NPC1 AND NOT-CSH1 | 1 | 1 | 1 |
| CIRH1A AND NOT-CSH1 | 0.952380952 | 1 | 0.909090909 |
| NOT-ERGIC3 AND ERGIC3 | 0.9 | 1 | 0.818181818 |
| NOT-CSH1 AND MMP15 | 0.9 | 1 | 0.818181818 |
| GPR107 AND NOT-CSH1 | 0.9 | 1 | 0.818181818 |
| SDC3 AND NOT-CSH1 | 0.9 | 1 | 0.818181818 |
| SLC45A2 AND NOT-CSH1 | 0.952380952 | 1 | 0.909090909 |
| SLC5A6 AND NOT-CSH1 | 0.952380952 | 1 | 0.909090909 |
| MC1R AND NOT-CSH1 | 0.9 | 1 | 0.818181818 |
| TMEM147 AND NOT-CSH1 | 0.9 | 1 | 0.818181818 |
| EXT1 AND NOT-CSH1 | 0.952380952 | 1 | 0.909090909 |

| Antigen Pair Logic | F1 | Precision | Recall |
|---|---|---|---|
| CELSR1 AND NOT-PPAP2C | 0.935064935 | 0.923076923 | 0.947368421 |
| CELSR1 AND NOT-PEX11A | 0.96 | 0.972972973 | 0.947368421 |
| CELSR1 AND NOT-CLDN8 | 0.945945946 | 0.972222222 | 0.921052632 |
| MS4A1 AND CELSR1 | 0.936708861 | 0.902439024 | 0.973684211 |
| NOT-B4GALT6 AND SNRNP40 | 0.962025316 | 0.926829268 | 1 |
| NOT-B4GALT6 AND CELSR1 | 0.936708861 | 0.902439024 | 0.973684211 |
| CELSR1 AND NOT-FAM189A2 | 0.935064935 | 0.923076923 | 0.947368421 |
| CELSR1 AND NOT-TRIL | 0.931506849 | 0.971428571 | 0.894736842 |
| Sarcoma (Sarcoma) | | | |
| ADAM12 AND NOT-ERBB4 | 0.941176471 | 0.941176471 | 0.941176471 |
| NOT-ST6GALNAC2 AND AXL | 0.903225806 | 1 | 0.823529412 |
| ADAM12 AND NOT-ERBB3 | 0.909090909 | 0.9375 | 0.882352941 |
| ADAM12 AND NOT-NAALAD2 | 0.96969697 | 1 | 0.941176471 |
| TRAM2 AND NOT-TMEM265 | 0.903225806 | 1 | 0.823529412 |
| ADAM12 AND NOT-PDZK1IP1 | 0.903225806 | 1 | 0.823529412 |
| TRAM2 AND NOT-LPCAT3 | 0.903225806 | 1 | 0.823529412 |
| CD163L1 AND NOT-PRSS16 | 0.903225806 | 1 | 0.823529412 |
| ADAM12 AND NOT-PRSS16 | 0.944444444 | 0.894736842 | 1 |
| TRAM2 AND NOT-PRSS16 | 0.903225806 | 1 | 0.823529412 |
| HEXB AND NOT-ATP8A1 | 0.903225806 | 1 | 0.823529412 |
| TRAM2 AND NOT-ATP8A1 | 0.903225806 | 1 | 0.823529412 |
| ADAM12 AND NOT-ST3GAL6 | 0.918918919 | 0.85 | 1 |
| ADAM12 AND NOT-WFDC2 | 0.971428571 | 0.944444444 | 1 |
| TRAM2 AND NOT-CDS1 | 0.903225806 | 1 | 0.823529412 |
| TRAM2 AND NOT-LRRN2 | 0.903225806 | 1 | 0.823529412 |
| NOT-ST6GALNAC2 AND PROCR | 0.9375 | 1 | 0.882352941 |
| ADAM12 AND NOT-SLC34A2 | 0.914285714 | 0.888888889 | 0.941176471 |
| NOT-ST6GALNAC2 AND CSF1 | 0.903225806 | 1 | 0.823529412 |
| NOT-ST6GALNAC2 AND SLC38A6 | 0.903225806 | 1 | 0.823529412 |
| NOT-ST6GALNAC2 AND ACE | 0.909090909 | 0.9375 | 0.882352941 |
| NOT-ST6GALNAC2 AND CD93 | 0.909090909 | 0.9375 | 0.882352941 |
| PLXND1 AND NOT-ST6GALNAC2 | 0.903225806 | 1 | 0.823529412 |
| NOT-ST6GALNAC2 AND LRRC32 | 0.903225806 | 1 | 0.823529412 |
| NOT-ST6GALNAC2 AND MYOF | 0.9375 | 1 | 0.882352941 |
| NOT-ST6GALNAC2 AND DSE | 0.903225806 | 1 | 0.823529412 |
| HEXB AND NOT-ST6GALNAC2 | 0.903225806 | 1 | 0.823529412 |
| NOT-ST6GALNAC2 AND ITGB5 | 0.9375 | 1 | 0.882352941 |
| NOT-ST6GALNAC2 AND LTBR | 0.903225806 | 1 | 0.823529412 |
| NOT-ST6GALNAC2 AND LTC4S | 0.903225806 | 1 | 0.823529412 |
| NOT-ST6GALNAC2 AND PMP22 | 0.909090909 | 0.9375 | 0.882352941 |
| NOT-ST6GALNAC2 AND DRAM1 | 0.9375 | 1 | 0.882352941 |
| NOT-ST6GALNAC2 AND AXL | 0.903225806 | 1 | 0.823529412 |
| NOT-ST6GALNAC2 AND ACKR3 | 0.9375 | 1 | 0.882352941 |
| NOT-ST6GALNAC2 AND TGFBI | 0.903225806 | 1 | 0.823529412 |
| NOT-ST6GALNAC2 AND THBD | 0.903225806 | 1 | 0.823529412 |
| NOT-ST6GALNAC2 AND REEP4 | 0.909090909 | 0.9375 | 0.882352941 |
| ADAM12 AND NOT-ST6GALNAC2 | 0.971428571 | 0.944444444 | 1 |
| NOT-ST6GALNAC2 AND SLC2A10 | 0.903225806 | 1 | 0.823529412 |
| NOT-ST6GALNAC2 AND PHLDB2 | 0.909090909 | 0.9375 | 0.882352941 |
| NOT-ST6GALNAC2 AND MPZL1 | 0.903225806 | 1 | 0.823529412 |
| NOT-ST6GALNAC2 AND VAMP3 | 0.903225806 | 1 | 0.823529412 |
| NOT-ST6GALNAC2 AND ACVRL1 | 0.903225806 | 1 | 0.823529412 |
| TRAM2 AND NOT-ST6GALNAC2 | 0.903225806 | 1 | 0.823529412 |
| ADAM12 AND NOT-SPINT2 | 0.903225806 | 1 | 0.823529412 |
| TRAM2 AND NOT-CFTR | 0.903225806 | 1 | 0.823529412 |
| TRAM2 AND NOT-MMP24 | 0.903225806 | 1 | 0.823529412 |
| ADAM12 AND JTB | 0.941176471 | 0.941176471 | 0.941176471 |
| OS9 AND NOT-GALNT3 | 0.903225806 | 1 | 0.823529412 |
| TRAM2 AND NOT-ERP29 | 0.903225806 | 1 | 0.823529412 |
| TRAM2 AND NOT-SLC27A2 | 0.903225806 | 1 | 0.823529412 |
| ADAM12 AND NOT-ABCB8 | 0.914285714 | 0.888888889 | 0.941176471 |
| TRAM2 AND NOT-KLK8 | 0.903225806 | 1 | 0.823529412 |
| ADAM12 AND NOT-MRAP2 | 0.909090909 | 0.9375 | 0.882352941 |
| ADAM12 AND NOT-MAL2 | 0.941176471 | 0.941176471 | 0.941176471 |
| ADAM12 AND NOT-SLC26A7 | 0.909090909 | 0.9375 | 0.882352941 |
| ADAM12 AND NOT-SLC5A11 | 0.914285714 | 0.888888889 | 0.941176471 |
| TRAM2 AND NOT-GRIN3B | 0.903225806 | 1 | 0.823529412 |
| ADAM12 AND NOT-COMTD1 | 0.918918919 | 0.85 | 1 |
| TRAM2 AND NOT-COMTD1 | 0.903225806 | 1 | 0.823529412 |
| ADAM12 AND NOT-SFXN2 | 0.909090909 | 0.9375 | 0.882352941 |
| TRAM2 AND NOT-PDZD8 | 0.903225806 | 1 | 0.823529412 |
| TRAM2 AND NOT-GYLTL1B | 0.903225806 | 1 | 0.823529412 |
| TRAM2 AND NOT-GPHB5 | 0.903225806 | 1 | 0.823529412 |
| ADAM12 AND NOT-C15orf27 | 0.914285714 | 0.888888889 | 0.941176471 |
| TRAM2 AND NOT-TMEM170A | 0.903225806 | 1 | 0.823529412 |
| TRAM2 AND NOT-ACER1 | 0.903225806 | 1 | 0.823529412 |

FIG. 1 (CONT.)

| Antigen Pair Logic | F1 | Precision | Recall |
|---|---|---|---|
| TNFSF9 AND NOT-CSH1 | 0.952380952 | 1 | 0.909090909 |
| TYRP1 AND NOT-CSH1 | 0.9 | 1 | 0.818181818 |
| C11orf24 AND NOT-CSH1 | 0.9 | 1 | 0.818181818 |
| NOT-PMEL AND PMEL | 0.952380952 | 1 | 0.909090909 |
| BCAP31 AND NOT-CSH1 | 0.9 | 1 | 0.818181818 |
| FDPS AND NOT-CSH1 | 0.9 | 1 | 0.818181818 |
| IL12RB2 AND NOT-CSH1 | 0.9 | 1 | 0.818181818 |
| PNKD AND NOT-CSH1 | 0.952380952 | 1 | 0.909090909 |
| LPPR4 AND NOT-CSH1 | 0.9 | 1 | 0.818181818 |
| NAT14 AND NOT-CSH1 | 0.9 | 1 | 0.818181818 |
| MLANA AND NOT-FOLR1 | 1 | 1 | 1 |
| NOT-FOLR1 AND SLC4A11 | 0.9 | 1 | 0.818181818 |
| CTDNEP1 AND NOT-FOLR1 | 0.9 | 1 | 0.818181818 |
| NOT-FOLR1 AND IL20RB | 0.9 | 1 | 0.818181818 |
| STX18 AND NOT-FOLR1 | 0.9 | 1 | 0.818181818 |
| KIAA1024 AND NOT-FOLR1 | 0.9 | 1 | 0.818181818 |
| CLCN5 AND NOT-FOLR1 | 0.9 | 1 | 0.818181818 |
| MANBAL AND NOT-FOLR1 | 0.9 | 1 | 0.818181818 |
| RER1 AND NOT-FOLR1 | 0.9 | 1 | 0.818181818 |
| LMAN2L AND NOT-FOLR1 | 0.9 | 1 | 0.818181818 |
| NPC1 AND NOT-FOLR1 | 0.9 | 1 | 0.818181818 |
| NOT-FOLR1 AND DAPL1 | 0.9 | 1 | 0.818181818 |
| TMEM189 AND NOT-FOLR1 | 0.9 | 1 | 0.818181818 |
| YIPF1 AND NOT-FOLR1 | 0.9 | 1 | 0.818181818 |
| GALNS AND NOT-FOLR1 | 0.9 | 1 | 0.818181818 |
| SLC45A2 AND NOT-FOLR1 | 0.952380952 | 1 | 0.909090909 |
| MC1R AND NOT-FOLR1 | 0.9 | 1 | 0.818181818 |
| PTPRS AND NOT-FOLR1 | 0.9 | 1 | 0.818181818 |
| TYRP1 AND NOT-FOLR1 | 0.9 | 1 | 0.818181818 |
| NOT-PMEL AND PMEL | 0.952380952 | 1 | 0.909090909 |
| FDPS AND NOT-FOLR1 | 0.9 | 1 | 0.818181818 |
| NOT-FOLR1 AND WNT5A | 0.9 | 1 | 0.818181818 |
| MARVELD1 AND NOT-FOLR1 | 0.952380952 | 1 | 0.909090909 |
| OS9 AND OS9 | 0.9 | 1 | 0.818181818 |
| MLANA AND NOT-GNB2 | 1 | 1 | 1 |
| PPT2 AND NOT-GNB2 | 0.9 | 1 | 0.818181818 |
| MANBAL AND NOT-GNB2 | 0.952380952 | 1 | 0.909090909 |
| TMEM138 AND GNB2 | 0.9 | 1 | 0.818181818 |
| CIRH1A AND GNB2 | 0.952380952 | 1 | 0.909090909 |
| SLC45A2 AND NOT-GNB2 | 0.952380952 | 1 | 0.909090909 |
| SLC5A6 AND NOT-GNB2 | 0.952380952 | 1 | 0.909090909 |
| MC1R AND NOT-GNB2 | 0.9 | 1 | 0.818181818 |
| SLC35A4 AND NOT-GNB2 | 0.9 | 1 | 0.818181818 |
| TMEM147 AND TMEM147 | 0.9 | 1 | 0.818181818 |
| EXT1 AND NOT-GNB2 | 0.909090909 | 0.90909091 | 0.909090909 |
| TNFSF9 AND NOT-GNB2 | 0.909090909 | 0.90909091 | 0.909090909 |
| NOT-PMEL AND PMEL | 0.952380952 | 1 | 0.909090909 |
| BCAP31 AND NOT-GNB2 | 0.952380952 | 1 | 0.909090909 |
| IL12RB2 AND NOT-GNB2 | 0.9 | 1 | 0.818181818 |
| ROMO1 AND NOT-GNB2 | 0.952380952 | 1 | 0.909090909 |
| MLANA AND CSF3R | 1 | 1 | 1 |
| OXA1L AND NOT-CSF3R | 0.952380952 | 1 | 0.909090909 |
| PPT2 AND NOT-CSF3R | 0.9 | 1 | 0.818181818 |
| PARL AND NOT-CSF3R | 0.9 | 1 | 0.818181818 |
| LMAN2L AND NOT-CSF3R | 0.909090909 | 0.90909091 | 0.909090909 |
| CIRH1A AND CSF3R | 0.952380952 | 1 | 0.909090909 |
| AUP1 AND NOT-CSF3R | 0.9 | 1 | 0.818181818 |
| SLC45A2 AND NOT-CSF3R | 0.952380952 | 1 | 0.909090909 |
| SLC5A6 AND NOT-CSF3R | 0.952380952 | 1 | 0.909090909 |
| MC1R AND NOT-CSF3R | 0.9 | 1 | 0.818181818 |
| TMEM147 AND CSF3R | 0.9 | 1 | 0.818181818 |
| NOT-PMEL AND PMEL | 0.952380952 | 1 | 0.909090909 |
| IL12RB2 AND NOT-CSF3R | 0.9 | 1 | 0.818181818 |
| NOT-SCN10A AND BMPR1A | 0.9 | 1 | 0.818181818 |
| PQLC1 AND NOT-BMPR1A | 0.9 | 1 | 0.818181818 |
| OS9 AND NOT-BMPR1A | 0.9 | 1 | 0.818181818 |
| NOT-FUT6 AND BMPR1A | 0.952380952 | 1 | 0.909090909 |
| DENND5A AND BMPR1A | 0.9 | 1 | 0.818181818 |
| NOT-TAAR8 AND BMPR1A | 0.909090909 | 0.90909091 | 0.909090909 |
| NOT-SCN4A AND BMPR1A | 0.952380952 | 1 | 0.909090909 |
| MLANA AND NOT-BMPR1A | 1 | 1 | 1 |
| NOT-TM4SF5 AND BMPR1A | 0.952380952 | 1 | 0.909090909 |
| NOT-SERPINA9 AND BMPR1A | 0.9 | 1 | 0.818181818 |
| NOT-CHRNA2 AND BMPR1A | 0.952380952 | 1 | 0.909090909 |
| NOT-TMEM150B AND BMPR1A | 0.952380952 | 1 | 0.909090909 |
| SFXN3 AND BMPR1A | 0.952380952 | 1 | 0.909090909 |

| Antigen Pair Logic | F1 | Precision | Recall |
|---|---|---|---|
| ADAM12 AND NOT-CNR1 | 0.914285714 | 0.888888889 | 0.941176471 |
| TRAM2 AND NOT-CNR1 | 0.903225806 | 1 | 0.823529412 |
| TRAM2 AND NOT-SLC44A3 | 0.903225806 | 1 | 0.823529412 |
| ADAM12 AND NOT-TMEM125 | 0.941176471 | 0.941176471 | 0.941176471 |
| PLD3 AND NOT-SGPP2 | 0.903225806 | 1 | 0.823529412 |
| CD163L1 AND NOT-SGPP2 | 0.903225806 | 1 | 0.823529412 |
| ADAM12 AND NOT-SGPP2 | 0.944444444 | 0.894736842 | 1 |
| TRAM2 AND NOT-COL17A1 | 0.903225806 | 1 | 0.823529412 |
| TRAM2 AND NOT-RAET1E | 0.903225806 | 1 | 0.823529412 |
| TRAM2 AND NOT-COX15 | 0.903225806 | 1 | 0.823529412 |
| CD163L1 AND NOT-TMEM139 | 0.903225806 | 1 | 0.823529412 |
| ADAM12 AND NOT-TMEM139 | 0.971428571 | 0.944444444 | 1 |
| TRAM2 AND NOT-TMEM139 | 0.903225806 | 1 | 0.823529412 |
| ADAM12 AND NOT-CLDN4 | 0.914285714 | 0.888888889 | 0.941176471 |
| TRAM2 AND NOT-CLDN4 | 0.903225806 | 1 | 0.823529412 |
| ADAM12 AND NOT-CLDN3 | 0.971428571 | 0.944444444 | 1 |
| ADAM12 AND NOT-AADAC | 0.96969697 | 1 | 0.941176471 |
| TRAM2 AND NOT-TRPM6 | 0.903225806 | 1 | 0.823529412 |
| ADAM12 AND NOT-MUC15 | 0.96969697 | 1 | 0.941176471 |
| ADAM12 AND NOT-TMC4 | 0.909090909 | 0.9375 | 0.882352941 |
| ADAM12 AND NOT-MFSD4 | 0.914285714 | 0.888888889 | 0.941176471 |
| ADAM12 AND NOT-PROM2 | 0.914285714 | 0.888888889 | 0.941176471 |
| TRAM2 AND NOT-CXADR | 0.903225806 | 1 | 0.823529412 |
| ADAM12 AND NOT-KLB | 0.914285714 | 0.888888889 | 0.941176471 |
| ADAM12 AND NOT-MARVELD2 | 0.971428571 | 0.944444444 | 1 |
| TRAM2 AND NOT-MARVELD2 | 0.903225806 | 1 | 0.823529412 |
| ADAM12 AND NOT-CYP2J2 | 0.941176471 | 0.941176471 | 0.941176471 |
| TRAM2 AND NOT-CYP2J2 | 0.903225806 | 1 | 0.823529412 |
| ADAM12 AND NOT-FAAH2 | 0.909090909 | 0.9375 | 0.882352941 |
| ADAM12 AND NOT-SYNE4 | 0.944444444 | 0.894736842 | 1 |
| TRAM2 AND NOT-SYNE4 | 0.903225806 | 1 | 0.823529412 |
| HEXB AND NOT-IFNLR1 | 0.903225806 | 1 | 0.823529412 |
| ADAM12 AND NOT-IFNLR1 | 0.909090909 | 0.9375 | 0.882352941 |
| ADAM12 AND NOT-PAQR7 | 0.914285714 | 0.888888889 | 0.941176471 |
| CD163L1 AND NOT-CLYBL | 0.903225806 | 1 | 0.823529412 |
| ADAM12 AND NOT-CLYBL | 0.914285714 | 0.888888889 | 0.941176471 |
| TRAM2 AND NOT-AGER | 0.903225806 | 1 | 0.823529412 |
| ADAM12 AND NOT-DSC3 | 0.909090909 | 0.9375 | 0.882352941 |
| ADAM12 AND NOT-E2F5 | 0.918918919 | 0.85 | 1 |
| TRAM2 AND NOT-E2F5 | 0.903225806 | 1 | 0.823529412 |
| ADAM12 AND NOT-EDNRB | 0.918918919 | 0.85 | 1 |
| TRAM2 AND NOT-EFNB3 | 0.903225806 | 1 | 0.823529412 |
| EMP3 AND NOT-MPZL3 | 0.9375 | 1 | 0.882352941 |
| HEXB AND NOT-MPZL3 | 0.909090909 | 0.9375 | 0.882352941 |
| ADAM12 AND NOT-GRAMD2 | 1 | 1 | 1 |
| TRAM2 AND NOT-GRAMD2 | 0.903225806 | 1 | 0.823529412 |
| ADAM12 AND NOT-KRTCAP3 | 0.971428571 | 0.944444444 | 1 |
| EMP3 AND NOT-GALNT3 | 0.9375 | 1 | 0.882352941 |
| EMP3 AND NOT-GCNT2 | 0.909090909 | 0.9375 | 0.882352941 |
| EMP3 AND NOT-C16orf54 | 0.9375 | 1 | 0.882352941 |
| EMP3 AND NOT-HBD | 0.9375 | 1 | 0.882352941 |
| EMP3 AND NOT-HACD4 | 0.903225806 | 1 | 0.823529412 |
| EMP3 AND NOT-NIPAL3 | 0.903225806 | 1 | 0.823529412 |
| TGFBI AND NOT-TMEM154 | 0.903225806 | 1 | 0.823529412 |
| TRAM2 AND NOT-EPHA1 | 0.903225806 | 1 | 0.823529412 |
| TRAM2 AND NOT-CERS3 | 0.903225806 | 1 | 0.823529412 |
| ADAM12 AND NOT-ERBB3 | 0.909090909 | 0.9375 | 0.882352941 |
| ADAM12 AND NOT-ERBB4 | 0.941176471 | 0.941176471 | 0.941176471 |
| ADAM12 AND NOT-EXTL1 | 0.918918919 | 0.85 | 1 |
| TRAM2 AND NOT-F2RL1 | 0.903225806 | 1 | 0.823529412 |
| TRAM2 AND NOT-GJD4 | 0.903225806 | 1 | 0.823529412 |
| ADAM12 AND NOT-LRTOMT | 0.941176471 | 0.941176471 | 0.941176471 |
| TRAM2 AND NOT-ADGRF4 | 0.903225806 | 1 | 0.823529412 |
| ADAM12 AND NOT-FGFR3 | 0.944444444 | 0.894736842 | 1 |
| TRAM2 AND NOT-FGFR3 | 0.903225806 | 1 | 0.823529412 |
| TRAM2 AND NOT-LMTK2 | 0.903225806 | 1 | 0.823529412 |
| HEXB AND NOT-ENPP4 | 0.9375 | 1 | 0.882352941 |
| TRAM2 AND NOT-ENPP4 | 0.903225806 | 1 | 0.823529412 |
| ADAM12 AND NOT-PLA2R1 | 0.903225806 | 1 | 0.823529412 |
| TRAM2 AND NOT-CNOT1 | 0.903225806 | 1 | 0.823529412 |
| ADAM12 AND NOT-MLC1 | 0.914285714 | 0.888888889 | 0.941176471 |
| CD163L1 AND NOT-FMO5 | 0.903225806 | 1 | 0.823529412 |
| ADAM12 AND NOT-ABCB9 | 0.909090909 | 0.9375 | 0.882352941 |
| ADAM12 AND NOT-FOLR1 | 0.941176471 | 0.941176471 | 0.941176471 |
| ADAM12 AND NOT-HYAL4 | 0.918918919 | 0.85 | 1 |
| TRAM2 AND NOT-HYAL4 | 0.903225806 | 1 | 0.823529412 |

FIG. 1 (CONT.)

| Antigen Pair Logic | F1 | Precision | Recall |
|---|---|---|---|
| GPR137B AND BMPR1A | 0.909090909 | 0.90909091 | 0.909090909 |
| NOT-GRPR AND BMPR1A | 0.952380952 | 1 | 0.909090909 |
| OXA1L AND BMPR1A | 0.952380952 | 1 | 0.909090909 |
| PARL AND BMPR1A | 0.952380952 | 1 | 0.909090909 |
| BNIP1 AND NOT-BMPR1A | 0.9 | 1 | 0.818181818 |
| NOT-CTRB2 AND BMPR1A | 0.9 | 1 | 0.818181818 |
| NOT-NPFFR1 AND BMPR1A | 0.9 | 1 | 0.818181818 |
| NOT-HGFAC AND BMPR1A | 0.952380952 | 1 | 0.909090909 |
| NOT-CD300LB AND BMPR1A | 0.9 | 1 | 0.818181818 |
| MANBAL AND NOT-BMPR1A | 0.9 | 1 | 0.818181818 |
| NOT-CLDN7 AND BMPR1A | 0.9 | 1 | 0.818181818 |
| NOT-RTP3 AND BMPR1A | 0.9 | 1 | 0.818181818 |
| VANGL2 AND NOT-BMPR1A | 0.9 | 1 | 0.818181818 |
| NOT-SLC22A8 AND BMPR1A | 0.952380952 | 1 | 0.909090909 |
| NOT-ADAM29 AND BMPR1A | 0.909090909 | 0.90909091 | 0.909090909 |
| NOT-NMUR2 AND BMPR1A | 0.952380952 | 1 | 0.909090909 |
| NOT-TMEM95 AND BMPR1A | 0.952380952 | 1 | 0.909090909 |
| TMEM138 AND BMPR1A | 0.9 | 1 | 0.818181818 |
| NOT-ISM2 AND BMPR1A | 0.952380952 | 1 | 0.909090909 |
| NOT-TEX38 AND BMPR1A | 0.952380952 | 1 | 0.909090909 |
| CIRH1A AND NOT-BMPR1A | 0.952380952 | 1 | 0.909090909 |
| NOT-SLC5A5 AND BMPR1A | 0.952380952 | 1 | 0.909090909 |
| DERL2 AND BMPR1A | 0.9 | 1 | 0.818181818 |
| NOT-SLC6A13 AND BMPR1A | 0.9 | 1 | 0.818181818 |
| NOT-SLC34A2 AND BMPR1A | 0.952380952 | 1 | 0.909090909 |
| NOT-GIPR AND BMPR1A | 0.952380952 | 1 | 0.909090909 |
| NOT-PTH2 AND BMPR1A | 0.952380952 | 1 | 0.909090909 |
| AUP1 AND BMPR1A | 0.952380952 | 1 | 0.909090909 |
| NOT-GJD2 AND BMPR1A | 0.952380952 | 1 | 0.909090909 |
| YIF1B AND NOT-BMPR1A | 0.9 | 1 | 0.818181818 |
| NOT-CACNG6 AND BMPR1A | 0.952380952 | 1 | 0.909090909 |
| NOT-SLC34A3 AND BMPR1A | 0.952380952 | 1 | 0.909090909 |
| TMEM184B AND NOT-BMPR1A | 0.9 | 1 | 0.818181818 |
| NOT-ATCAY AND BMPR1A | 0.952380952 | 1 | 0.909090909 |
| NOT-CLDN19 AND BMPR1A | 0.952380952 | 1 | 0.909090909 |
| NOT-DNAH10 AND BMPR1A | 0.9 | 1 | 0.818181818 |
| NOT-CAV3 AND BMPR1A | 0.9 | 1 | 0.818181818 |
| YIPF1 AND NOT-BMPR1A | 0.9 | 1 | 0.818181818 |
| NOT-CLPS AND BMPR1A | 0.9 | 1 | 0.818181818 |
| NOT-SLC4A1 AND BMPR1A | 0.952380952 | 1 | 0.909090909 |
| DAD1 AND BMPR1A | 0.9 | 1 | 0.818181818 |
| MC1R AND NOT-MC1R | 0.9 | 1 | 0.818181818 |
| NOT-HTR4 AND BMPR1A | 0.952380952 | 1 | 0.909090909 |
| NOT-CALHM1 AND BMPR1A | 0.952380952 | 1 | 0.909090909 |
| NOT-TMPRSS6 AND BMPR1A | 0.9 | 1 | 0.818181818 |
| TMEM147 AND NOT-BMPR1A | 0.9 | 1 | 0.818181818 |
| EXT1 AND NOT-BMPR1A | 0.9 | 1 | 0.818181818 |
| NOT-PTCH2 AND BMPR1A | 0.952380952 | 1 | 0.909090909 |
| NOT-FTHL17 AND BMPR1A | 0.952380952 | 1 | 0.909090909 |
| NOT-TMEM105 AND BMPR1A | 0.952380952 | 1 | 0.909090909 |
| NOT-PCDHGB5 AND BMPR1A | 0.9 | 1 | 0.818181818 |
| NOT-PMEL AND PMEL | 0.952380952 | 1 | 0.909090909 |
| BCAP31 AND BCAP31 | 0.952380952 | 1 | 0.909090909 |
| ABHD12 AND NOT-BMPR1A | 0.9 | 1 | 0.818181818 |
| NOT-OR51M1 AND BMPR1A | 0.9 | 1 | 0.818181818 |
| FDPS AND NOT-BMPR1A | 0.952380952 | 1 | 0.909090909 |
| NOT-AMHR2 AND BMPR1A | 0.9 | 1 | 0.818181818 |
| ROMO1 AND NOT-BMPR1A | 0.9 | 1 | 0.818181818 |
| NOT-GRIK5 AND BMPR1A | 0.952380952 | 1 | 0.909090909 |
| NOT-MADCAM1 AND BMPR1A | 0.9 | 1 | 0.818181818 |
| NOT-C8B AND BMPR1A | 0.9 | 1 | 0.818181818 |
| CELSR2 AND NOT-BMPR1A | 0.9 | 1 | 0.818181818 |
| NOT-AVPR1B AND BMPR1A | 0.952380952 | 1 | 0.909090909 |
| STARD3NL AND BMPR1A | 0.9 | 1 | 0.818181818 |
| PQLC1 AND NOT-MOS | 0.952380952 | 1 | 0.909090909 |
| BCS1L AND NOT-MOS | 0.9 | 1 | 0.818181818 |
| MLANA AND NOT-MOS | 1 | 1 | 1 |
| SFXN3 AND NOT-MOS | 0.9 | 1 | 0.818181818 |
| PPT2 AND NOT-MOS | 0.9 | 1 | 0.818181818 |
| PIGW AND NOT-MOS | 0.9 | 1 | 0.818181818 |
| HSD3B7 AND NOT-MOS | 0.9 | 1 | 0.818181818 |
| MANBAL AND NOT-MOS | 0.952380952 | 1 | 0.909090909 |
| TMEM138 AND NOT-MOS | 0.9 | 1 | 0.818181818 |
| CIRH1A AND NOT-MOS | 0.9 | 1 | 0.818181818 |
| TIMM22 AND NOT-MOS | 0.9 | 1 | 0.818181818 |
| TMEM189 AND NOT-MOS | 0.952380952 | 1 | 0.909090909 |

| Antigen Pair Logic | F1 | Precision | Recall |
|---|---|---|---|
| CD163L1 AND NOT-VSIG2 | 0.903225806 | 1 | 0.823529412 |
| ADAM12 AND PLD3 | 0.918918919 | 0.85 | 1 |
| ADAM12 AND NOT-FUT1 | 0.971428571 | 0.944444444 | 1 |
| TRAM2 AND NOT-FUT1 | 0.903225806 | 1 | 0.823529412 |
| ADAM12 AND NOT-FUT2 | 0.9375 | 1 | 0.882352941 |
| ADAM12 AND NOT-FUT3 | 0.96969697 | 1 | 0.941176471 |
| ADAM12 AND NOT-FUT5 | 0.941176471 | 0.941176471 | 0.941176471 |
| ADAM12 AND NOT-ZDHHC23 | 0.914285714 | 0.888888889 | 0.941176471 |
| TRAM2 AND NOT-ZDHHC23 | 0.903225806 | 1 | 0.823529412 |
| ADAM12 AND NOT-GABRP | 0.941176471 | 0.941176471 | 0.941176471 |
| TRAM2 AND NOT-SERINC5 | 0.903225806 | 1 | 0.823529412 |
| TRAM2 AND NOT-FRMD3 | 0.903225806 | 1 | 0.823529412 |
| ADAM12 AND NOT-KLK5 | 1 | 1 | 1 |
| ADAM12 AND NOT-PARM1 | 0.9375 | 1 | 0.882352941 |
| NOT-PARM1 AND ACVRL1 | 0.903225806 | 1 | 0.823529412 |
| HEXB AND NOT-GALNT3 | 0.9375 | 1 | 0.882352941 |
| TGFBI AND NOT-GALNT3 | 0.903225806 | 1 | 0.823529412 |
| ADAM12 AND NOT-GALNT3 | 0.941176471 | 0.941176471 | 0.941176471 |
| TRAM2 AND NOT-GALNT3 | 0.903225806 | 1 | 0.823529412 |
| TRAM2 AND NOT-NALCN | 0.903225806 | 1 | 0.823529412 |
| HEXB AND NOT-HIGD1A | 0.903225806 | 1 | 0.823529412 |
| TRAM2 AND NOT-TKFC | 0.903225806 | 1 | 0.823529412 |
| ADAM12 AND NOT-LRRTM2 | 0.9375 | 1 | 0.882352941 |
| NOT-F11R AND MYOF | 0.918918919 | 0.85 | 1 |
| HEXB AND NOT-GCNT2 | 0.9375 | 1 | 0.882352941 |
| ADAM12 AND NOT-GCNT2 | 0.941176471 | 0.941176471 | 0.941176471 |
| ADAM12 AND NOT-NSG1 | 0.9375 | 1 | 0.882352941 |
| TRAM2 AND NOT-NSG1 | 0.903225806 | 1 | 0.823529412 |
| ADAM12 AND NOT-GP1BA | 0.9375 | 1 | 0.882352941 |
| TRAM2 AND NOT-SLCO4A1 | 0.903225806 | 1 | 0.823529412 |
| GPR1 AND NOT-DAPL1 | 0.903225806 | 1 | 0.823529412 |
| CD163L1 AND NOT-EPCAM | 0.903225806 | 1 | 0.823529412 |
| CD163L1 AND NOT-SMIM22 | 0.903225806 | 1 | 0.823529412 |
| CD163L1 AND NOT-P2RY2 | 0.903225806 | 1 | 0.823529412 |
| CD163L1 AND NOT-F11R | 0.903225806 | 1 | 0.823529412 |
| CD163L1 AND NOT-PLLP | 0.903225806 | 1 | 0.823529412 |
| CD163L1 AND NOT-ABCB1 | 0.903225806 | 1 | 0.823529412 |
| CD163L1 AND NOT-GRAMD1C | 0.903225806 | 1 | 0.823529412 |
| CD163L1 AND NOT-SMPD3 | 0.903225806 | 1 | 0.823529412 |
| CD163L1 AND NOT-ACSS2 | 0.903225806 | 1 | 0.823529412 |
| CD163L1 AND NOT-ENPP5 | 0.903225806 | 1 | 0.823529412 |
| CD163L1 AND NOT-SMPD2 | 0.903225806 | 1 | 0.823529412 |
| CD163L1 AND NOT-ST14 | 0.903225806 | 1 | 0.823529412 |
| CD163L1 AND NOT-MMEL1 | 0.903225806 | 1 | 0.823529412 |
| CD163L1 AND NOT-CRB3 | 0.903225806 | 1 | 0.823529412 |
| CD163L1 AND NOT-ATP2C2 | 0.903225806 | 1 | 0.823529412 |
| TRAM2 AND NOT-MCHR1 | 0.903225806 | 1 | 0.823529412 |
| ADAM12 AND NOT-PRRT3 | 0.918918919 | 0.85 | 1 |
| ADAM12 AND NOT-RNF180 | 0.96969697 | 1 | 0.941176471 |
| TRAM2 AND NOT-GPR35 | 0.903225806 | 1 | 0.823529412 |
| ADAM12 AND NOT-GPR37 | 0.918918919 | 0.85 | 1 |
| ADAM12 AND NOT-ILDR1 | 0.944444444 | 0.894736842 | 1 |
| TRAM2 AND NOT-ILDR1 | 0.903225806 | 1 | 0.823529412 |
| ADAM12 AND NOT-TUSC5 | 0.944444444 | 0.894736842 | 1 |
| ADAM12 AND NOT-TMPRSS11E | 0.9375 | 1 | 0.882352941 |
| ADAM12 AND NOT-HAS3 | 0.941176471 | 0.941176471 | 0.941176471 |
| TRAM2 AND NOT-HAS3 | 0.903225806 | 1 | 0.823529412 |
| HEXB AND NOT-HBD | 0.9375 | 1 | 0.882352941 |
| ADAM12 AND NOT-HBD | 0.941176471 | 0.941176471 | 0.941176471 |
| TRAM2 AND NOT-HDAC2 | 0.903225806 | 1 | 0.823529412 |
| HEXB AND NOT-LY75 | 0.903225806 | 1 | 0.823529412 |
| HEXB AND NOT-F11R | 0.96969697 | 1 | 0.941176471 |
| HEXB AND NOT-ABCB1 | 0.941176471 | 0.941176471 | 0.941176471 |
| HEXB AND NOT-MFSD6 | 0.903225806 | 1 | 0.823529412 |
| HEXB AND NOT-NIPAL3 | 0.903225806 | 1 | 0.823529412 |
| HEXB AND NOT-MARC1 | 0.903225806 | 1 | 0.823529412 |
| HEXB AND NOT-SPINT1 | 0.941176471 | 0.941176471 | 0.941176471 |
| HEXB AND NOT-XK | 0.903225806 | 1 | 0.823529412 |
| HEXB AND NOT-CLMN | 0.903225806 | 1 | 0.823529412 |
| ADAM12 AND HLA-B | 0.941176471 | 0.941176471 | 0.941176471 |
| ADAM12 AND HLA-C | 0.914285714 | 0.888888889 | 0.941176471 |
| ADAM12 AND NOT-HSD17B2 | 0.941176471 | 0.941176471 | 0.941176471 |
| ADAM12 AND NOT-ICA1 | 0.914285714 | 0.888888889 | 0.941176471 |
| ADAM12 AND NOT-NAT8L | 0.918918919 | 0.85 | 1 |
| TRAM2 AND NOT-ZDHHC21 | 0.903225806 | 1 | 0.823529412 |
| ADAM12 AND NOT-FREM2 | 0.941176471 | 0.941176471 | 0.941176471 |

FIG. 1 (CONT.)

| Antigen Pair Logic | F1 | Precision | Recall |
|---|---|---|---|
| YIF1B AND NOT-MOS | 0.9 | 1 | 0.818181818 |
| SLC45A2 AND NOT-MOS | 0.952380952 | 1 | 0.909090909 |
| MC1R AND NOT-MOS | 0.9 | 1 | 0.818181818 |
| SLC35A4 AND NOT-MOS | 0.9 | 1 | 0.818181818 |
| TMEM147 AND TMEM147 | 0.9 | 1 | 0.818181818 |
| EXT1 AND NOT-MOS | 0.9 | 1 | 0.818181818 |
| TNFSF9 AND NOT-MOS | 0.909090909 | 0.90909091 | 0.909090909 |
| NDST1 AND NOT-MOS | 0.9 | 1 | 0.818181818 |
| NOT-PMEL AND PMEL | 0.952380952 | 1 | 0.909090909 |
| BCAP31 AND BCAP31 | 0.952380952 | 1 | 0.909090909 |
| FDPS AND NOT-MOS | 0.952380952 | 1 | 0.909090909 |
| IL12RB2 AND NOT-MOS | 0.9 | 1 | 0.818181818 |
| CELSR2 AND NOT-MOS | 0.952380952 | 1 | 0.909090909 |
| MLANA AND NOT-BMX | 1 | 1 | 1 |
| SLC45A2 AND NOT-BMX | 0.952380952 | 1 | 0.909090909 |
| NOT-PMEL AND PMEL | 0.952380952 | 1 | 0.909090909 |
| IL12RB2 AND NOT-BMX | 0.9 | 1 | 0.818181818 |
| PQLC1 AND NOT-DDC | 0.9 | 1 | 0.818181818 |
| OS9 AND NOT-DDC | 0.9 | 1 | 0.818181818 |
| TMEM187 AND NOT-DDC | 0.952380952 | 1 | 0.909090909 |
| MLANA AND NOT-DDC | 1 | 1 | 1 |
| PIGL AND NOT-DDC | 0.9 | 1 | 0.818181818 |
| SFXN3 AND NOT-DDC | 0.9 | 1 | 0.818181818 |
| C1DNEP1 AND NOT-DDC | 0.9 | 1 | 0.818181818 |
| PPT2 AND NOT-DDC | 0.9 | 1 | 0.818181818 |
| BNIP1 AND NOT-DDC | 0.9 | 1 | 0.818181818 |
| CLCN5 AND NOT-DDC | 0.952380952 | 1 | 0.909090909 |
| RPN1 AND NOT-DDC | 0.9 | 1 | 0.818181818 |
| MANBAL AND NOT-DDC | 0.9 | 1 | 0.818181818 |
| YIF1A AND NOT-DDC | 0.9 | 1 | 0.818181818 |
| VANGL2 AND NOT-DDC | 0.9 | 1 | 0.818181818 |
| APMAP AND NOT-DDC | 0.9 | 1 | 0.818181818 |
| RER1 AND NOT-DDC | 0.9 | 1 | 0.818181818 |
| LMAN2L AND NOT-DDC | 0.952380952 | 1 | 0.909090909 |
| NPC1 AND NOT-DDC | 0.909090909 | 0.90909091 | 0.909090909 |
| CIRH1A AND NOT-DDC | 0.952380952 | 1 | 0.909090909 |
| TMEM189 AND NOT-DDC | 0.9 | 1 | 0.818181818 |
| TMEM184B AND NOT-DDC | 0.9 | 1 | 0.818181818 |
| FAM174B AND NOT-DDC | 0.9 | 1 | 0.818181818 |
| YIPF1 AND NOT-DDC | 0.9 | 1 | 0.818181818 |
| SLC45A2 AND NOT-DDC | 0.952380952 | 1 | 0.909090909 |
| SLC5A6 AND NOT-DDC | 0.9 | 1 | 0.818181818 |
| HSD17B12 AND NOT-DDC | 0.9 | 1 | 0.818181818 |
| MC1R AND NOT-DDC | 0.9 | 1 | 0.818181818 |
| PTPRS AND NOT-DDC | 0.9 | 1 | 0.818181818 |
| TMEM147 AND NOT-DDC | 0.9 | 1 | 0.818181818 |
| EXT1 AND NOT-DDC | 0.9 | 1 | 0.818181818 |
| TNFSF9 AND NOT-DDC | 0.9 | 1 | 0.818181818 |
| NDST1 AND NOT-DDC | 0.9 | 1 | 0.818181818 |
| C11orf24 AND NOT-DDC | 0.9 | 1 | 0.818181818 |
| NOT-PMEL AND PMEL | 0.952380952 | 1 | 0.909090909 |
| BCAP31 AND NOT-DDC | 0.9 | 1 | 0.818181818 |
| ABHD12 AND NOT-DDC | 0.9 | 1 | 0.818181818 |
| FDPS AND NOT-DDC | 0.952380952 | 1 | 0.909090909 |
| IL12RB2 AND NOT-DDC | 0.9 | 1 | 0.818181818 |
| PNKD AND NOT-DDC | 0.9 | 1 | 0.818181818 |
| PRRT3 AND NOT-DDC | 0.9 | 1 | 0.818181818 |
| ROMO1 AND NOT-DDC | 0.9 | 1 | 0.818181818 |
| MARVELD1 AND NOT-DDC | 0.9 | 1 | 0.818181818 |
| GCNT2 AND NOT-DDC | 0.9 | 1 | 0.818181818 |
| CELSR2 AND NOT-DDC | 0.9 | 1 | 0.818181818 |
| NOT-CHST4 AND DST | 0.9 | 1 | 0.818181818 |
| DENND5A AND DST | 0.9 | 1 | 0.818181818 |
| NOT-SCN4A AND DST | 0.909090909 | 0.90909091 | 0.909090909 |
| MLANA AND NOT-DST | 0.952380952 | 1 | 0.909090909 |
| NOT-TM4SF5 AND DST | 1 | 1 | 1 |
| NOT-KCNJ6 AND DST | 0.909090909 | 0.90909091 | 0.909090909 |
| NOT-CHRNA2 AND DST | 0.909090909 | 0.90909091 | 0.909090909 |
| NOT-TMEM150B AND DST | 0.952380952 | 1 | 0.909090909 |
| NOT-ITGA2B AND DST | 0.952380952 | 1 | 0.909090909 |
| NOT-SYT2 AND DST | 0.952380952 | 1 | 0.909090909 |
| GPR137B AND DST | 0.909090909 | 0.90909091 | 0.909090909 |
| OXA1L AND DST | 0.952380952 | 1 | 0.909090909 |
| PARL AND DST | 1 | 1 | 1 |
| NOT-NPFFR1 AND DST | 0.952380952 | 1 | 0.909090909 |
| NOT-TMPRSS2 AND DST | 0.909090909 | 0.90909091 | 0.909090909 |

| Antigen Pair Logic | F1 | Precision | Recall |
|---|---|---|---|
| TRAM2 AND NOT-ZACN | 0.903225806 | 1 | 0.823529412 |
| TRAM2 AND NOT-PRAC2 | 0.903225806 | 1 | 0.823529412 |
| TRAM2 AND NOT-ITGA2 | 0.903225806 | 1 | 0.823529412 |
| NOT-MAOB AND ITGB5 | 0.9375 | 1 | 0.882352941 |
| ADAM12 AND NOT-ITGB6 | 0.903225806 | 1 | 0.823529412 |
| ADAM12 AND NOT-ITGB8 | 0.971428571 | 0.944444444 | 1 |
| ADAM12 AND NOT-KCNC4 | 0.914285714 | 0.888888889 | 0.941176471 |
| TRAM2 AND NOT-KCNC4 | 0.903225806 | 1 | 0.823529412 |
| ADAM12 AND NOT-KRT5 | 0.941176471 | 0.941176471 | 0.941176471 |
| TRAM2 AND NOT-RPRML | 0.903225806 | 1 | 0.823529412 |
| ADAM12 AND NOT-LBR | 0.971428571 | 0.944444444 | 1 |
| TRAM2 AND NOT-LETM1 | 0.903225806 | 1 | 0.823529412 |
| ADAM12 AND NOT-C14orf180 | 0.9375 | 1 | 0.882352941 |
| TRAM2 AND NOT-C14orf180 | 0.903225806 | 1 | 0.823529412 |
| ADAM12 AND NOT-KLHL31 | 0.96969697 | 1 | 0.941176471 |
| TRAM2 AND NOT-LTA | 0.903225806 | 1 | 0.823529412 |
| NOT-F11R AND LTBR | 0.914285714 | 0.888888889 | 0.941176471 |
| ADAM12 AND NOT-ERVFRD-1 | 0.944444444 | 0.894736842 | 1 |
| ADAM12 AND NOT-LTF | 0.918918919 | 0.85 | 1 |
| ADAM12 AND NOT-TACSTD2 | 0.909090909 | 0.9375 | 0.882352941 |
| ADAM12 AND NOT-EPCAM | 0.971428571 | 0.944444444 | 1 |
| TRAM2 AND NOT-EPCAM | 0.903225806 | 1 | 0.823529412 |
| TGFBI AND NOT-MAL | 0.903225806 | 1 | 0.823529412 |
| TRAM2 AND NOT-MAL | 0.903225806 | 1 | 0.823529412 |
| PMP22 AND NOT-MAOB | 0.9375 | 1 | 0.882352941 |
| ADAM12 AND NOT-MAOB | 0.9375 | 1 | 0.882352941 |
| ADAM12 AND NOT-MGAT3 | 0.944444444 | 0.894736842 | 1 |
| TRAM2 AND NOT-MGAT3 | 0.903225806 | 1 | 0.823529412 |
| ADAM12 AND NOT-MPZ | 0.903225806 | 1 | 0.823529412 |
| ADAM12 AND NOT-SMIM22 | 0.971428571 | 0.944444444 | 1 |
| TRAM2 AND NOT-SMIM22 | 0.903225806 | 1 | 0.823529412 |
| TRAM2 AND NOT-MTHFD1 | 0.903225806 | 1 | 0.823529412 |
| ADAM12 AND NOT-MTNR1B | 1 | 1 | 1 |
| ADAM12 AND NOT-NNAT | 0.918918919 | 0.85 | 1 |
| ADAM12 AND NOT-ATP1B2 | 0.941176471 | 0.941176471 | 0.941176471 |
| ADAM12 AND NOT-NPY5R | 0.903225806 | 1 | 0.823529412 |
| TRAM2 AND NOT-NTRK3 | 0.903225806 | 1 | 0.823529412 |
| ADAM12 AND NOT-GPR143 | 0.914285714 | 0.888888889 | 0.941176471 |
| TRAM2 AND NOT-ATP4A | 0.903225806 | 1 | 0.823529412 |
| ADAM12 AND NOT-P2RY2 | 0.971428571 | 0.944444444 | 1 |
| TRAM2 AND NOT-P2RY2 | 0.903225806 | 1 | 0.823529412 |
| TRAM2 AND NOT-ATP6V0A4 | 0.903225806 | 1 | 0.823529412 |
| TGFBI AND NOT-F11R | 0.909090909 | 0.9375 | 0.882352941 |
| ADAM12 AND NOT-F11R | 0.971428571 | 0.944444444 | 1 |
| TRAM2 AND NOT-F11R | 0.903225806 | 1 | 0.823529412 |
| ADAM12 AND NOT-PLLP | 0.971428571 | 0.944444444 | 1 |
| TRAM2 AND NOT-PLLP | 0.903225806 | 1 | 0.823529412 |
| ADAM12 AND NOT-ATP8A2 | 0.918918919 | 0.85 | 1 |
| TRAM2 AND NOT-ATP8A2 | 0.903225806 | 1 | 0.823529412 |
| ADAM12 AND NOT-PF4 | 0.918918919 | 0.85 | 1 |
| ADAM12 AND NOT-ABCB1 | 0.918918919 | 0.85 | 1 |
| TRAM2 AND NOT-ABCB1 | 0.903225806 | 1 | 0.823529412 |
| ADAM12 AND NOT-PIGR | 0.941176471 | 0.941176471 | 0.941176471 |
| PMP22 AND NOT-SEMA6A | 0.9375 | 1 | 0.882352941 |
| NOT-MARC1 AND PMP22 | 0.903225806 | 1 | 0.823529412 |
| ADAM12 AND NOT-IL20RA | 0.903225806 | 1 | 0.823529412 |
| ADAM12 AND NOT-GPR87 | 0.918918919 | 0.85 | 1 |
| ADAM12 AND NOT-ATP7B | 0.9375 | 1 | 0.882352941 |
| TRAM2 AND NOT-FAM105A | 0.903225806 | 1 | 0.823529412 |
| ADAM12 AND NOT-SDK2 | 0.909090909 | 0.9375 | 0.882352941 |
| ADAM12 AND NOT-GRAMD1C | 0.918918919 | 0.85 | 1 |
| TRAM2 AND NOT-GRAMD1C | 0.903225806 | 1 | 0.823529412 |
| ADAM12 AND NOT-GDPD2 | 0.971428571 | 0.944444444 | 1 |
| TRAM2 AND NOT-GDPD2 | 0.903225806 | 1 | 0.823529412 |
| ADAM12 AND NOT-RNF43 | 0.914285714 | 0.888888889 | 0.941176471 |
| TRAM2 AND NOT-RNF43 | 0.903225806 | 1 | 0.823529412 |
| ADAM12 AND NOT-TMEM40 | 0.914285714 | 0.888888889 | 0.941176471 |
| ADAM12 AND NOT-TMEM144 | 0.918918919 | 0.85 | 1 |
| TRAM2 AND NOT-TMEM144 | 0.903225806 | 1 | 0.823529412 |
| ADAM12 AND NOT-STYK1 | 0.96969697 | 1 | 0.941176471 |
| ADAM12 AND NOT-VEZT | 0.918918919 | 0.85 | 1 |
| TRAM2 AND NOT-SLC39A4 | 0.903225806 | 1 | 0.823529412 |
| ADAM12 AND NOT-ST6GALNAC1 | 0.944444444 | 0.894736842 | 1 |
| TRAM2 AND NOT-ST6GALNAC1 | 0.903225806 | 1 | 0.823529412 |
| TRAM2 AND NOT-PLGRKT | 0.903225806 | 1 | 0.823529412 |
| TRAM2 AND NOT-ACSS2 | 0.903225806 | 1 | 0.823529412 |

FIG. 1 (CONT.)

| Antigen Pair Logic | F1 | Precision | Recall | Antigen Pair Logic | F1 | Precision | Recall |
|---|---|---|---|---|---|---|---|
| NOT-CLDN7 AND DST | 0.952380952 | 1 | 0.909090909 | ADAM12 AND NOT-ACPP | 0.918918919 | 0.85 | 1 |
| NOT-ADAM29 AND DST | 0.909090909 | 0.90909091 | 0.909090909 | TRAM2 AND NOT-ACPP | 0.903225806 | 1 | 0.823529412 |
| NOT-NMUR2 AND DST | 0.952380952 | 1 | 0.909090909 | ADAM12 AND NOT-MRAP | 0.918918919 | 0.85 | 1 |
| NOT-FNDC5 AND DST | 0.9 | 1 | 0.818181818 | TRAM2 AND NOT-MRAP | 0.903225806 | 1 | 0.823529412 |
| NOT-TMEM95 AND DST | 0.952380952 | 1 | 0.909090909 | ADAM12 AND NOT-SLC7A10 | 0.944444444 | 0.894736842 | 1 |
| TMEM138 AND DST | 0.952380952 | 1 | 0.909090909 | ADAM12 AND NOT-TMPRSS4 | 0.941176471 | 0.941176471 | 0.941176471 |
| NOT-ISM2 AND DST | 0.909090909 | 0.90909091 | 0.909090909 | TRAM2 AND NOT-PANX2 | 0.903225806 | 1 | 0.823529412 |
| DERL2 AND DST | 0.952380952 | 1 | 0.909090909 | ADAM12 AND NOT-PYY | 0.909090909 | 0.9375 | 0.882352941 |
| NOT-SLC34A2 AND DST | 0.909090909 | 0.90909091 | 0.909090909 | TRAM2 AND NOT-PYY | 0.903225806 | 1 | 0.823529412 |
| NOT-GIPR AND DST | 0.952380952 | 1 | 0.909090909 | TRAM2 AND NOT-SLC12A9 | 0.903225806 | 1 | 0.823529412 |
| AUP1 AND DST | 1 | 1 | 1 | NOT-SMIM5 AND AGTRAP | 0.903225806 | 1 | 0.823529412 |
| NOT-GP2 AND DST | 0.952380952 | 1 | 0.909090909 | ADAM12 AND NOT-ANO2 | 0.944444444 | 0.894736842 | 1 |
| GUSB AND DST | 0.909090909 | 0.90909091 | 0.909090909 | ADAM12 AND NOT-TMEM63C | 0.918918919 | 0.85 | 1 |
| NOT-CACNG6 AND DST | 0.909090909 | 0.90909091 | 0.909090909 | TRAM2 AND NOT-NIPAL3 | 0.903225806 | 1 | 0.823529412 |
| NOT-ATCAY AND DST | 0.956521739 | 0.91666667 | 1 | TRAM2 AND NOT-ADGRG6 | 0.903225806 | 1 | 0.823529412 |
| NOT-CLDN19 AND DST | 0.909090909 | 0.90909091 | 0.909090909 | TRAM2 AND NOT-SMAGP | 0.903225806 | 1 | 0.823529412 |
| NOT-CAV3 AND DST | 0.909090909 | 0.90909091 | 0.909090909 | TRAM2 AND NOT-ABHD6 | 0.903225806 | 1 | 0.823529412 |
| NOT-CLPS AND DST | 0.9 | 1 | 0.818181818 | ADAM12 AND NOT-KIAA1324 | 0.909090909 | 0.9375 | 0.882352941 |
| SLC45A2 AND NOT-DST | 0.9 | 1 | 0.818181818 | ADAM12 AND NOT-SEMA6A | 0.909090909 | 0.9375 | 0.882352941 |
| NOT-SLC4A1 AND DST | 0.909090909 | 0.90909091 | 0.909090909 | TRAM2 AND NOT-SEMA6A | 0.903225806 | 1 | 0.823529412 |
| DAD1 AND DST | 0.9 | 1 | 0.818181818 | ADAM12 AND NOT-SEMA4G | 0.909090909 | 0.9375 | 0.882352941 |
| NOT-ATP13A5 AND DST | 0.9 | 1 | 0.818181818 | TRAM2 AND NOT-PTPRF | 0.903225806 | 1 | 0.823529412 |
| NOT-FFAR2 AND DST | 0.909090909 | 0.90909091 | 0.909090909 | ADAM12 AND OSTC | 0.914285714 | 0.888888889 | 0.941176471 |
| COX8A AND DST | 0.909090909 | 0.90909091 | 0.909090909 | ADAM12 AND NOT-ACE2 | 0.909090909 | 0.9375 | 0.882352941 |
| NOT-ODF4 AND DST | 0.909090909 | 0.90909091 | 0.909090909 | ADAM12 AND NOT-SCN7A | 0.941176471 | 0.941176471 | 0.941176471 |
| NOT-PTCH2 AND DST | 0.909090909 | 0.90909091 | 0.909090909 | OSMR AND NOT-SCN7A | 0.903225806 | 1 | 0.823529412 |
| NOT-TMEM105 AND DST | 0.952380952 | 1 | 0.909090909 | TRAM2 AND NOT-SCN7A | 0.903225806 | 1 | 0.823529412 |
| NOT-PMEL AND PMEL | 0.952380952 | 1 | 0.909090909 | ADAM12 AND NOT-SCNN1A | 0.941176471 | 0.941176471 | 0.941176471 |
| BCAP31 AND DST | 0.952380952 | 1 | 0.909090909 | ADAM12 AND NOT-SCNN1B | 0.914285714 | 0.888888889 | 0.941176471 |
| NOT-OR51M1 AND DST | 0.9 | 1 | 0.818181818 | TRAM2 AND NOT-SCNN1B | 0.903225806 | 1 | 0.823529412 |
| NDUFA1 AND DST | 0.952380952 | 1 | 0.909090909 | ADAM12 AND NOT-SCNN1G | 0.941176471 | 0.941176471 | 0.941176471 |
| NOT-MADCAM1 AND DST | 0.909090909 | 0.90909091 | 0.909090909 | ADAM12 AND NOT-CCL22 | 0.918918919 | 0.85 | 1 |
| NOT-TMEM252 AND DST | 0.909090909 | 0.90909091 | 0.909090909 | TRAM2 AND NOT-CCL22 | 0.903225806 | 1 | 0.823529412 |
| STARD3NL AND DST | 0.9 | 1 | 0.818181818 | ADAM12 AND NOT-CLSTN2 | 0.903225806 | 1 | 0.823529412 |
| PQLC1 AND NOT-CRYGC | 0.952380952 | 1 | 0.909090909 | ADAM12 AND NOT-TNMD | 0.944444444 | 0.894736842 | 1 |
| OS9 AND OS9 | 0.9 | 1 | 0.818181818 | NOT-MARC1 AND ITSN1 | 0.903225806 | 1 | 0.823529412 |
| BCS1L AND NOT-CRYGC | 0.9 | 1 | 0.818181818 | ADAM12 AND NOT-TMPRSS3 | 0.941176471 | 0.941176471 | 0.941176471 |
| SLAMF8 AND NOT-CRYGC | 0.9 | 1 | 0.818181818 | ADAM12 AND NOT-MARC1 | 0.9375 | 1 | 0.882352941 |
| TMEM187 AND NOT-CRYGC | 0.916666667 | 0.84615385 | 1 | NOT-MARC1 AND ACVRL1 | 0.903225806 | 1 | 0.823529412 |
| FAM3A AND NOT-CRYGC | 0.9 | 1 | 0.818181818 | ADAM12 AND NOT-SLC4A3 | 0.971428571 | 0.944444444 | 1 |
| MLANA AND NOT-CRYGC | 1 | 1 | 1 | ADAM12 AND NOT-SLC6A2 | 0.903225806 | 1 | 0.823529412 |
| PIGL AND NOT-CRYGC | 0.952380952 | 1 | 0.909090909 | TRAM2 AND NOT-SLC6A2 | 0.903225806 | 1 | 0.823529412 |
| PQLC2 AND NOT-CRYGC | 0.952380952 | 1 | 0.909090909 | TRAM2 AND NOT-SLC8A2 | 0.903225806 | 1 | 0.823529412 |
| LARGE AND NOT-CRYGC | 0.9 | 1 | 0.818181818 | TRAM2 AND NOT-SLC12A2 | 0.903225806 | 1 | 0.823529412 |
| TMCO4 AND NOT-CRYGC | 0.9 | 1 | 0.818181818 | ADAM12 AND NOT-SLC15A1 | 0.9375 | 1 | 0.882352941 |
| SLC1A4 AND NOT-CRYGC | 0.9 | 1 | 0.818181818 | ADAM12 AND NOT-SMPD2 | 0.918918919 | 0.85 | 1 |
| SCAP AND NOT-CRYGC | 0.9 | 1 | 0.818181818 | TGFBI AND NOT-SPINT1 | 0.909090909 | 0.9375 | 0.882352941 |
| SFXN3 AND NOT-CRYGC | 0.952380952 | 1 | 0.909090909 | ADAM12 AND NOT-SPINT1 | 0.971428571 | 0.944444444 | 1 |
| PPT2 AND NOT-CRYGC | 0.9 | 1 | 0.818181818 | TRAM2 AND NOT-SPINT1 | 0.903225806 | 1 | 0.823529412 |
| PIGW AND NOT-CRYGC | 0.9 | 1 | 0.818181818 | ADAM12 AND NOT-ST14 | 0.971428571 | 0.944444444 | 1 |
| HGSNAT AND NOT-CRYGC | 0.9 | 1 | 0.818181818 | TRAM2 AND NOT-ST14 | 0.903225806 | 1 | 0.823529412 |
| HSD3B7 AND NOT-CRYGC | 0.9 | 1 | 0.818181818 | TRAM2 AND NOT-STXBP2 | 0.903225806 | 1 | 0.823529412 |
| ST7L AND NOT-CRYGC | 0.9 | 1 | 0.818181818 | TRAM2 AND NOT-BTC | 0.903225806 | 1 | 0.823529412 |
| BNIP1 AND NOT-CRYGC | 0.952380952 | 1 | 0.909090909 | ADAM12 AND NOT-SYT4 | 0.909090909 | 0.9375 | 0.882352941 |
| CLCN5 AND NOT-CRYGC | 0.916666667 | 0.84615385 | 1 | ADAM12 AND NOT-TACR1 | 0.944444444 | 0.894736842 | 1 |
| MANBAL AND NOT-CRYGC | 0.952380952 | 1 | 0.909090909 | ADAM12 AND NOT-TSPAN8 | 0.909090909 | 0.9375 | 0.882352941 |
| VANGL2 AND NOT-CRYGC | 0.952380952 | 1 | 0.909090909 | ADAM12 AND NOT-TRPC6 | 0.909090909 | 0.9375 | 0.882352941 |
| TMEM138 AND TMEM138 | 0.952380952 | 1 | 0.909090909 | ADAM12 AND NOT-UMOD | 0.914285714 | 0.888888889 | 0.941176471 |
| NPC1 AND NOT-CRYGC | 1 | 1 | 1 | TRAM2 AND NOT-UPK3A | 0.903225806 | 1 | 0.823529412 |
| NOT-CIRH1A AND CIRH1A | 0.952380952 | 1 | 0.909090909 | TRAM2 AND NOT-VIPR1 | 0.903225806 | 1 | 0.823529412 |
| NOT-ERGIC3 AND ERGIC3 | 0.9 | 1 | 0.818181818 | TRAM2 AND NOT-VIPR2 | 0.903225806 | 1 | 0.823529412 |
| TIMM22 AND NOT-CRYGC | 0.9 | 1 | 0.818181818 | ADAM12 AND NOT-WNT6 | 0.914285714 | 0.888888889 | 0.941176471 |
| TMEM189 AND NOT-CRYGC | 0.952380952 | 1 | 0.909090909 | ADAM12 AND NOT-WNT7A | 0.903225806 | 1 | 0.823529412 |
| YIF1B AND NOT-CRYGC | 0.9 | 1 | 0.818181818 | ADAM12 AND NOT-XK | 0.9375 | 1 | 0.882352941 |
| TMEM184B AND NOT-CRYGC | 0.952380952 | 1 | 0.909090909 | ADAM12 AND NOT-DDR1 | 0.9375 | 1 | 0.882352941 |
| FAM174B AND NOT-CRYGC | 0.952380952 | 1 | 0.909090909 | TRAM2 AND NOT-PRRG4 | 0.903225806 | 1 | 0.823529412 |
| GPR107 AND NOT-CRYGC | 0.9 | 1 | 0.818181818 | ADAM12 AND NOT-SLC25A23 | 0.941176471 | 0.941176471 | 0.941176471 |
| SDC3 AND NOT-CRYGC | 0.9 | 1 | 0.818181818 | ADAM12 AND NOT-MMEL1 | 0.971428571 | 0.944444444 | 1 |
| SLC45A2 AND NOT-CRYGC | 0.952380952 | 1 | 0.909090909 | ADAM12 AND NOT-NOX5 | 0.914285714 | 0.888888889 | 0.941176471 |
| SLC5A6 AND NOT-CRYGC | 0.952380952 | 1 | 0.909090909 | TRAM2 AND NOT-KREMEN2 | 0.903225806 | 1 | 0.823529412 |
| MC1R AND NOT-CRYGC | 0.9 | 1 | 0.818181818 | TRAM2 AND NOT-RNF128 | 0.903225806 | 1 | 0.823529412 |
| SLC35A4 AND NOT-CRYGC | 0.9 | 1 | 0.818181818 | ADAM12 AND NOT-CLMN | 0.941176471 | 0.941176471 | 0.941176471 |
| ARMCX1 AND NOT-CRYGC | 0.9 | 1 | 0.818181818 | ADAM12 AND NOT-TMC5 | 0.941176471 | 0.941176471 | 0.941176471 |
| TMEM147 AND TMEM147 | 0.9 | 1 | 0.818181818 | TRAM2 AND NOT-TMC5 | 0.903225806 | 1 | 0.823529412 |
| EXT1 AND NOT-CRYGC | 0.952380952 | 1 | 0.909090909 | ADAM12 AND NOT-ERMP1 | 0.909090909 | 0.9375 | 0.882352941 |
| TNFSF9 AND NOT-CRYGC | 0.909090909 | 0.90909091 | 0.909090909 | ADAM12 AND NOT-CWH43 | 0.941176471 | 0.941176471 | 0.941176471 |

FIG. 1 (CONT.)

| Antigen Pair Logic | F1 | Precision | Recall |
|---|---|---|---|
| NDST1 AND NOT-CRYGC | 0.952380952 | 1 | 0.909090909 |
| SMIM12 AND NOT-CRYGC | 0.9 | 1 | 0.818181818 |
| C11orf24 AND NOT-CRYGC | 0.9 | 1 | 0.818181818 |
| NOT-PMEL AND PMEL | 0.952380952 | 1 | 0.909090909 |
| BCAP31 AND CRYGC | 0.9 | 1 | 0.818181818 |
| ABHD12 AND NOT-CRYGC | 0.952380952 | 1 | 0.909090909 |
| FDPS AND NOT-CRYGC | 1 | 1 | 1 |
| IL12RB2 AND NOT-CRYGC | 0.9 | 1 | 0.818181818 |
| ICMT AND NOT-CRYGC | 0.9 | 1 | 0.818181818 |
| PNKD AND NOT-CRYGC | 0.952380952 | 1 | 0.909090909 |
| PRRT3 AND NOT-CRYGC | 0.952380952 | 1 | 0.909090909 |
| ROMO1 AND CRYGC | 0.952380952 | 1 | 0.909090909 |
| YIPF3 AND NOT-CRYGC | 0.9 | 1 | 0.818181818 |
| CELSR2 AND NOT-CRYGC | 0.952380952 | 1 | 0.909090909 |
| MLANA AND DHODH | 0.952380952 | 1 | 0.909090909 |
| NOT-CHRNA2 AND DHODH | 0.952380952 | 1 | 0.909090909 |
| PPT2 AND NOT-DHODH | 0.9 | 1 | 0.818181818 |
| TMEM138 AND DHODH | 0.9 | 1 | 0.818181818 |
| SLC45A2 AND NOT-DHODH | 0.952380952 | 1 | 0.909090909 |
| MC1R AND NOT-DHODH | 0.9 | 1 | 0.818181818 |
| TMEM147 AND DHODH | 0.9 | 1 | 0.818181818 |
| NOT-PMEL AND PMEL | 0.952380952 | 1 | 0.909090909 |
| OS9 AND OS9 | 0.9 | 1 | 0.818181818 |
| MLANA AND AES | 0.9 | 1 | 0.818181818 |
| SFXN3 AND AES | 0.952380952 | 1 | 0.909090909 |
| MANBAL AND AES | 0.952380952 | 1 | 0.909090909 |
| MC1R AND NOT-MC1R | 0.9 | 1 | 0.818181818 |
| TNFSF9 AND NOT-TNFSF9 | 0.909090909 | 0.90909091 | 0.909090909 |
| NOT-PMEL AND PMEL | 0.952380952 | 1 | 0.909090909 |
| BCAP31 AND AES | 0.9 | 1 | 0.818181818 |
| FDPS AND AES | 0.952380952 | 1 | 0.909090909 |
| ROMO1 AND AES | 0.952380952 | 1 | 0.909090909 |
| OS9 AND NOT-HADH | 0.9 | 1 | 0.818181818 |
| MLANA AND HADH | 0.952380952 | 1 | 0.909090909 |
| SFXN3 AND NOT-HADH | 0.9 | 1 | 0.818181818 |
| MANBAL AND NOT-HADH | 0.9 | 1 | 0.818181818 |
| CIRH1A AND NOT-HADH | 0.9 | 1 | 0.818181818 |
| MC1R AND NOT-MC1R | 0.9 | 1 | 0.818181818 |
| NOT-PMEL AND PMEL | 0.952380952 | 1 | 0.909090909 |
| BCAP31 AND NOT-HADH | 0.9 | 1 | 0.818181818 |
| FDPS AND NOT-HADH | 0.952380952 | 1 | 0.909090909 |
| ROMO1 AND NOT-HADH | 0.9 | 1 | 0.818181818 |
| MLANA AND GPX7 | 1 | 1 | 1 |
| CIRH1A AND GPX7 | 0.952380952 | 1 | 0.909090909 |
| TMEM147 AND GPX7 | 0.9 | 1 | 0.818181818 |
| OS9 AND OS9 | 0.9 | 1 | 0.818181818 |
| NOT-SCN4A AND ART3 | 0.9 | 1 | 0.818181818 |
| MLANA AND MLANA | 1 | 1 | 1 |
| NOT-CHRNA2 AND ART3 | 0.909090909 | 0.90909091 | 0.909090909 |
| SFXN3 AND ART3 | 0.9 | 1 | 0.818181818 |
| GPR137B AND ART3 | 0.909090909 | 0.90909091 | 0.909090909 |
| OXA1L AND ART3 | 0.9 | 1 | 0.818181818 |
| PARL AND ART3 | 0.952380952 | 1 | 0.909090909 |
| NOT-ADAM29 AND ART3 | 0.909090909 | 0.90909091 | 0.909090909 |
| NOT-NMUR2 AND ART3 | 0.909090909 | 0.90909091 | 0.909090909 |
| TMEM138 AND ART3 | 0.9 | 1 | 0.818181818 |
| NOT-CIRH1A AND CIRH1A | 0.952380952 | 1 | 0.909090909 |
| ERGIC3 AND ART3 | 0.9 | 1 | 0.818181818 |
| DERL2 AND ART3 | 0.9 | 1 | 0.818181818 |
| AUP1 AND ART3 | 0.952380952 | 1 | 0.909090909 |
| MC1R AND NOT-MC1R | 0.9 | 1 | 0.818181818 |
| TMEM147 AND TMEM147 | 0.9 | 1 | 0.818181818 |
| NOT-PMEL AND PMEL | 0.952380952 | 1 | 0.909090909 |
| FDPS AND ART3 | 0.952380952 | 1 | 0.909090909 |
| ROMO1 AND ART3 | 0.9 | 1 | 0.818181818 |
| OS9 AND OS9 | 0.9 | 1 | 0.818181818 |
| NOT-FUT6 AND DDB1 | 0.9 | 1 | 0.818181818 |
| NOT-ASIC5 AND DDB1 | 0.9 | 1 | 0.818181818 |
| NOT-TAAR8 AND DDB1 | 0.9 | 1 | 0.818181818 |
| MLANA AND DDB1 | 1 | 1 | 1 |
| NOT-GPR137 AND DDB1 | 0.9 | 1 | 0.818181818 |
| NOT-SYT13 AND DDB1 | 0.9 | 1 | 0.818181818 |
| NOT-CYP2A6 AND DDB1 | 0.9 | 1 | 0.818181818 |
| NOT-TM4SF5 AND DDB1 | 0.9 | 1 | 0.818181818 |
| NOT-CHRNA2 AND DDB1 | 0.9 | 1 | 0.818181818 |
| NOT-TMEM150B AND DDB1 | 0.9 | 1 | 0.818181818 |

| Antigen Pair Logic | F1 | Precision | Recall |
|---|---|---|---|
| TRAM2 AND NOT-DNAJC5 | 0.903225806 | 1 | 0.823529412 |
| ADAM12 AND NOT-SPX | 0.903225806 | 1 | 0.823529412 |
| ADAM12 AND NOT-SLC25A18 | 0.903225806 | 1 | 0.823529412 |
| ADAM12 AND NOT-FAM213A | 0.903225806 | 1 | 0.823529412 |
| ADAM12 AND NOT-PROM1 | 0.971428571 | 0.944444444 | 1 |
| ADAM12 AND NOT-GLB1L2 | 0.9375 | 1 | 0.882352941 |
| ADAM12 AND NOT-SLC13A2 | 0.914285714 | 0.888888889 | 0.941176471 |
| ADAM12 AND NOT-CLDN8 | 0.918918919 | 0.85 | 1 |
| ADAM12 AND NOT-SLC28A2 | 0.914285714 | 0.888888889 | 0.941176471 |
| ADAM12 AND NOT-KIAA1919 | 0.918918919 | 0.85 | 1 |
| ADAM12 AND NOT-MARVELD3 | 0.909090909 | 0.9375 | 0.882352941 |
| ADAM12 AND NOT-GGTLC1 | 0.941176471 | 0.941176471 | 0.941176471 |
| ADAM12 AND NOT-DAPL1 | 0.971428571 | 0.944444444 | 1 |
| ADAM12 AND NOT-TMEM132C | 0.96969697 | 1 | 0.941176471 |
| ADAM12 AND NOT-CRB3 | 0.971428571 | 0.944444444 | 1 |
| ADAM12 AND NOT-FAM189A2 | 0.903225806 | 1 | 0.823529412 |
| ADAM12 AND NOT-SIGLEC6 | 0.971428571 | 0.944444444 | 1 |
| ADAM12 AND NOT-NRG2 | 0.96969697 | 1 | 0.941176471 |
| ADAM12 AND NOT-ENTPD3 | 0.941176471 | 0.941176471 | 0.941176471 |
| ADAM12 AND NOT-KIAA0040 | 0.914285714 | 0.888888889 | 0.941176471 |
| ADAM12 AND NOT-TMEM63A | 0.918918919 | 0.85 | 1 |
| ADAM12 AND NOT-CD79B | 0.914285714 | 0.888888889 | 0.941176471 |
| ADAM12 AND NOT-MFAP3L | 0.971428571 | 0.944444444 | 1 |
| ADAM12 AND NOT-CDH1 | 0.909090909 | 0.9375 | 0.882352941 |
| TRAM2 AND NOT-ADGRV1 | 0.903225806 | 1 | 0.823529412 |
| TRAM2 AND NOT-SLC10A7 | 0.903225806 | 1 | 0.823529412 |
| TRAM2 AND NOT-MFSD7 | 0.903225806 | 1 | 0.823529412 |
| TRAM2 AND NOT-YIPF4 | 0.903225806 | 1 | 0.823529412 |
| TRAM2 AND NOT-AGPAT9 | 0.903225806 | 1 | 0.823529412 |
| TRAM2 AND NOT-GALR3 | 0.903225806 | 1 | 0.823529412 |
| TRAM2 AND NOT-ITGA8 | 0.903225806 | 1 | 0.823529412 |
| TRAM2 AND NOT-KCNK5 | 0.903225806 | 1 | 0.823529412 |
| TRAM2 AND NOT-PROM1 | 0.903225806 | 1 | 0.823529412 |
| TRAM2 AND NOT-CLDN8 | 0.903225806 | 1 | 0.823529412 |
| TRAM2 AND NOT-KCNQ4 | 0.903225806 | 1 | 0.823529412 |
| TRAM2 AND NOT-SLC28A2 | 0.903225806 | 1 | 0.823529412 |
| TRAM2 AND NOT-MARVELD3 | 0.903225806 | 1 | 0.823529412 |
| TRAM2 AND NOT-CRB3 | 0.903225806 | 1 | 0.823529412 |
| TRAM2 AND NOT-TMEM183A | 0.903225806 | 1 | 0.823529412 |
| TRAM2 AND NOT-GPR37L1 | 0.903225806 | 1 | 0.823529412 |
| TRAM2 AND NOT-SIGLEC6 | 0.903225806 | 1 | 0.823529412 |
| TRAM2 AND NOT-ACVRL1 | 0.903225806 | 1 | 0.823529412 |
| TRAM2 AND NOT-NRG2 | 0.903225806 | 1 | 0.823529412 |
| TRAM2 AND NOT-TMEM63A | 0.903225806 | 1 | 0.823529412 |
| TRAM2 AND NOT-DGCR2 | 0.903225806 | 1 | 0.823529412 |
| Carcinoma, Non-Small-Cell Lung (Lung NSCC) | | | |
| FAP AND NOT-LRRN4CL | 0.9 | 1 | 0.818181818 |
| FAP AND NOT-GALNT16 | 0.9 | 1 | 0.818181818 |
| FAP AND NOT-PTGFR | 0.9 | 1 | 0.818181818 |
| FAP AND NOT-LCAT | 0.9 | 1 | 0.818181818 |
| FAP AND NOT-SFRP1 | 0.9 | 1 | 0.818181818 |
| FAP AND NOT-ITGA7 | 0.9 | 1 | 0.818181818 |
| FAP AND NOT-ABCB1 | 0.9 | 1 | 0.818181818 |
| FAP AND NOT-RECK | 0.9 | 1 | 0.818181818 |
| FAP AND NOT-ENPP1 | 0.9 | 1 | 0.818181818 |
| FAP AND NOT-TGFBR3 | 0.9 | 1 | 0.818181818 |
| NOT-ACACB AND CD276 | 0.952380952 | 1 | 0.909090909 |
| FZD2 AND NOT-GPA33 | 0.9 | 1 | 0.818181818 |
| NOT-ACACB AND SDC1 | 0.9 | 1 | 0.818181818 |
| SCAMP3 AND NOT-TMEM170B | 0.9 | 1 | 0.818181818 |
| OST4 AND SEMA4F | 0.952380952 | 1 | 0.909090909 |
| SCAMP3 AND NOT-SCAMP2 | 0.9 | 1 | 0.818181818 |
| NOT-ACACB AND SCAMP3 | 0.9 | 1 | 0.818181818 |
| SCAMP3 AND NOT-MAN2A2 | 0.9 | 1 | 0.818181818 |
| SCAMP3 AND NOT-STX7 | 0.9 | 1 | 0.818181818 |
| NOT-ACACB AND CALCRL | 0.9 | 1 | 0.818181818 |
| FZD2 AND NOT-GPA33 | 0.9 | 1 | 0.818181818 |
| OSMR AND NOT-ABCA9 | 0.9 | 1 | 0.818181818 |
| GGCX AND NOT-N4BP2L2 | 0.909090909 | 0.909090909 | 0.909090909 |
| NOT-ACACB AND MERTK | 0.952380952 | 1 | 0.909090909 |
| DNAJB11 AND NOT-SLC30A9 | 0.9 | 1 | 0.818181818 |
| TMEM39A AND NOT-SLC30A9 | 0.9 | 1 | 0.818181818 |
| SEMA4F AND NOT-MAN2A2 | 0.9 | 1 | 0.818181818 |
| NOT-ACACB AND YIF1A | 0.9 | 1 | 0.818181818 |
| NOT-ACACB AND KDELR1 | 0.9 | 1 | 0.818181818 |
| NOT-ACACB AND TMED2 | 0.9 | 1 | 0.818181818 |

FIG. 1 (CONT.)

| Antigen Pair Logic | F1 | Precision | Recall |
|---|---|---|---|
| SFXN3 AND DDB1 | 0.9 | 1 | 0.818181818 |
| NOT-GRPR AND DDB1 | 0.9 | 1 | 0.818181818 |
| OXA1L AND DDB1 | 0.9 | 1 | 0.818181818 |
| PARL AND DDB1 | 0.9 | 1 | 0.818181818 |
| COX7A2L AND DDB1 | 0.9 | 1 | 0.818181818 |
| NOT-HGFAC AND DDB1 | 0.9 | 1 | 0.818181818 |
| MANBAL AND DDB1 | 0.9 | 1 | 0.818181818 |
| NOT-B4GALNT3 AND DDB1 | 0.9 | 1 | 0.818181818 |
| NOT-SLC22A8 AND DDB1 | 0.9 | 1 | 0.818181818 |
| NOT-NMUR2 AND DDB1 | 0.9 | 1 | 0.818181818 |
| NOT-TMEM95 AND DDB1 | 0.9 | 1 | 0.818181818 |
| NOT-CIRH1A AND CIRH1A | 0.952380952 | 1 | 0.909090909 |
| ERGIC3 AND DDB1 | 0.9 | 1 | 0.818181818 |
| NOT-SLC5A5 AND DDB1 | 0.9 | 1 | 0.818181818 |
| DERL2 AND DDB1 | 0.9 | 1 | 0.818181818 |
| NOT-SLC34A2 AND DDB1 | 0.9 | 1 | 0.818181818 |
| NOT-GIPR AND DDB1 | 0.9 | 1 | 0.818181818 |
| NOT-SLC22A14 AND DDB1 | 0.9 | 1 | 0.818181818 |
| NOT-PTH2 AND DDB1 | 0.9 | 1 | 0.818181818 |
| AUP1 AND DDB1 | 0.9 | 1 | 0.818181818 |
| NOT-GJD2 AND DDB1 | 0.9 | 1 | 0.818181818 |
| NOT-CACNG6 AND DDB1 | 0.9 | 1 | 0.818181818 |
| NOT-SLC34A3 AND DDB1 | 0.9 | 1 | 0.818181818 |
| NOT-ATCAY AND DDB1 | 0.9 | 1 | 0.818181818 |
| NOT-CLDN19 AND DDB1 | 0.9 | 1 | 0.818181818 |
| NOT-DNAH10 AND DDB1 | 0.9 | 1 | 0.818181818 |
| SLC45A2 AND NOT-DDB1 | 0.952380952 | 1 | 0.909090909 |
| NOT-CACNG5 AND DDB1 | 0.9 | 1 | 0.818181818 |
| TMEM147 AND TMEM147 | 0.9 | 1 | 0.818181818 |
| NOT-PTCH2 AND DDB1 | 0.9 | 1 | 0.818181818 |
| NOT-TMEM105 AND DDB1 | 0.9 | 1 | 0.818181818 |
| NOT-PMEL AND PMEL | 0.952380952 | 1 | 0.909090909 |
| NOT-MRGPRX4 AND DDB1 | 0.9 | 1 | 0.818181818 |
| BCAP31 AND DDB1 | 0.9 | 1 | 0.818181818 |
| FDPS AND DDB1 | 0.9 | 1 | 0.818181818 |
| NOT-SLC10A2 AND DDB1 | 0.9 | 1 | 0.818181818 |
| ROMO1 AND DDB1 | 0.952380952 | 1 | 0.909090909 |
| NOT-GRIK5 AND DDB1 | 0.9 | 1 | 0.818181818 |
| NOT-AVPR1B AND DDB1 | 0.9 | 1 | 0.818181818 |
| PQLC1 AND NOT-GABRD | 0.9 | 1 | 0.818181818 |
| OS9 AND OS9 | 0.9 | 1 | 0.818181818 |
| KIAA1549L AND NOT-GABRD | 0.9 | 1 | 0.818181818 |
| MLANA AND NOT-GABRD | 1 | 1 | 1 |
| PPT2 AND NOT-GABRD | 0.9 | 1 | 0.818181818 |
| NOT-CIRH1A AND CIRH1A | 0.952380952 | 1 | 0.909090909 |
| NOT-ERGIC3 AND ERGIC3 | 0.9 | 1 | 0.818181818 |
| TMEM189 AND NOT-GABRD | 0.9 | 1 | 0.818181818 |
| SLC45A2 AND NOT-GABRD | 0.952380952 | 1 | 0.909090909 |
| TMEM147 AND TMEM147 | 0.9 | 1 | 0.818181818 |
| EXT1 AND NOT-GABRD | 0.9 | 1 | 0.818181818 |
| NOT-PMEL AND PMEL | 0.952380952 | 1 | 0.909090909 |
| FDPS AND NOT-GABRD | 0.9 | 1 | 0.818181818 |
| IL12RB2 AND NOT-GABRD | 0.9 | 1 | 0.818181818 |
| DENND5A AND BMPR1B | 0.9 | 1 | 0.818181818 |
| NOT-SCN4A AND BMPR1B | 0.9 | 1 | 0.818181818 |
| MLANA AND MLANA | 1 | 1 | 1 |
| NOT-TM4SF5 AND BMPR1B | 0.9 | 1 | 0.818181818 |
| GPR137B AND BMPR1B | 0.909090909 | 0.90909091 | 0.909090909 |
| PPT2 AND NOT-BMPR1B | 0.9 | 1 | 0.818181818 |
| PARL AND BMPR1B | 0.952380952 | 1 | 0.909090909 |
| CIRH1A AND BMPR1B | 0.952380952 | 1 | 0.909090909 |
| DERL2 AND BMPR1B | 0.952380952 | 1 | 0.909090909 |
| AUP1 AND BMPR1B | 0.952380952 | 1 | 0.909090909 |
| SLC45A2 AND NOT-BMPR1B | 0.952380952 | 1 | 0.909090909 |
| MC1R AND NOT-BMPR1B | 0.9 | 1 | 0.818181818 |
| TMEM147 AND BMPR1B | 0.9 | 1 | 0.818181818 |
| NOT-PMEL AND PMEL | 0.952380952 | 1 | 0.909090909 |
| ROMO1 AND BMPR1B | 0.952380952 | 1 | 0.909090909 |
| NOT-GRIK5 AND BMPR1B | 0.9 | 1 | 0.818181818 |
| NOT-AVPR1B AND BMPR1B | 0.9 | 1 | 0.818181818 |
| MLANA AND GMFB | 1 | 1 | 1 |
| TMEM138 AND NOT-GMFB | 0.952380952 | 1 | 0.909090909 |
| CIRH1A AND GMFB | 0.952380952 | 1 | 0.909090909 |
| SLC5A6 AND NOT-GMFB | 0.909090909 | 0.90909091 | 0.909090909 |
| MC1R AND NOT-MC1R | 0.9 | 1 | 0.818181818 |
| TMEM147 AND GMFB | 0.9 | 1 | 0.818181818 |

| Antigen Pair Logic | F1 | Precision | Recall |
|---|---|---|---|
| NOT-ACACB AND ILVBL | 0.952380952 | 1 | 0.909090909 |
| CLPTM1L AND NOT-SEC63 | 0.9 | 1 | 0.818181818 |
| NOT-ACACB AND TLCD1 | 0.9 | 1 | 0.818181818 |
| NOT-ACACB AND CLCN2 | 0.9 | 1 | 0.818181818 |
| NOT-ACACB AND COL4A2 | 0.952380952 | 1 | 0.909090909 |
| C5orf28 AND NOT-TMEM18 | 0.9 | 1 | 0.818181818 |
| NOT-ACACB AND TMEM182 | 0.952380952 | 1 | 0.909090909 |
| NOT-ACACB AND DCBLD2 | 0.9 | 1 | 0.818181818 |
| LSR AND NOT-TMEM139 | 0.9 | 1 | 0.818181818 |
| NOT-ACACB AND CSF1 | 0.9 | 1 | 0.818181818 |
| DHRS13 AND NOT-MAN2A2 | 0.9 | 1 | 0.818181818 |
| NOT-ACACB AND ACE | 0.9 | 1 | 0.818181818 |
| TMEM41A AND NOT-PAQR7 | 0.9 | 1 | 0.818181818 |
| GGCX AND NOT-EDNRB | 0.916666667 | 0.846153846 | 1 |
| OSMR AND NOT-ADCY4 | 0.9 | 1 | 0.818181818 |
| GGCX AND NOT-TAPT1 | 0.909090909 | 0.909090909 | 0.909090909 |
| ATP6V0C AND NOT-TAPT1 | 0.9 | 1 | 0.818181818 |
| NOT-ACACB AND EXT1 | 0.9 | 1 | 0.818181818 |
| FAP AND NOT-LRRN4CL | 0.9 | 1 | 0.818181818 |
| FAP AND NOT-ITGA7 | 0.9 | 1 | 0.818181818 |
| FAP AND NOT-LCAT | 0.9 | 1 | 0.818181818 |
| FAP AND NOT-ENPP1 | 0.9 | 1 | 0.818181818 |
| FAP AND NOT-ABCB1 | 0.9 | 1 | 0.818181818 |
| FAP AND NOT-PIGFR | 0.9 | 1 | 0.818181818 |
| FAP AND NOT-GALNT16 | 0.9 | 1 | 0.818181818 |
| FAP AND NOT-SFRP1 | 0.9 | 1 | 0.818181818 |
| FAP AND NOT-TGFBR3 | 0.9 | 1 | 0.818181818 |
| FAP AND NOT-RECK | 0.9 | 1 | 0.818181818 |
| NOT-ACACB AND LEMD2 | 0.952380952 | 1 | 0.909090909 |
| NOT-ACACB AND P2RX2 | 0.909090909 | 0.909090909 | 0.909090909 |
| NOT-ACACB AND TMEM9 | 0.952380952 | 1 | 0.909090909 |
| GALNT2 AND NOT-WFDC9 | 0.9 | 1 | 0.818181818 |
| GALNT2 AND NOT-KCNS2 | 0.9 | 1 | 0.818181818 |
| GALNT2 AND NOT-OR1F1 | 0.9 | 1 | 0.818181818 |
| NOT-ACACB AND TKFC | 0.909090909 | 0.909090909 | 0.909090909 |
| NOT-ACACB AND B3GAT3 | 0.9 | 1 | 0.818181818 |
| GGCX AND NOT-ACACB | 1 | 1 | 1 |
| GGCX AND NOT-ABCB1 | 1 | 1 | 1 |
| GGCX AND NOT-LRRN3 | 0.9 | 1 | 0.818181818 |
| GGCX AND NOT-SLC22A5 | 0.9 | 1 | 0.818181818 |
| GGCX AND NOT-ANGPTL1 | 0.909090909 | 0.909090909 | 0.909090909 |
| NOT-ACACB AND GJA5 | 0.9 | 1 | 0.818181818 |
| NOT-ACACB AND TMEM97 | 0.9 | 1 | 0.818181818 |
| TMEM41A AND NOT-AQP11 | 0.9 | 1 | 0.818181818 |
| TMEM41A AND NOT-GPR22 | 0.9 | 1 | 0.818181818 |
| NOT-ACACB AND TMEM176B | 0.909090909 | 0.909090909 | 0.909090909 |
| NOT-ACACB AND SLC35B2 | 0.952380952 | 1 | 0.909090909 |
| NOT-ACACB AND JAG2 | 0.9 | 1 | 0.818181818 |
| NOT-ACACB AND KCNJ8 | 0.9 | 1 | 0.818181818 |
| NOT-ACACB AND OR51M1 | 0.909090909 | 0.909090909 | 0.909090909 |
| NOT-ACACB AND LTBP3 | 0.9 | 1 | 0.818181818 |
| NOT-ACACB AND EPCAM | 0.9 | 1 | 0.818181818 |
| NOT-ACACB AND NTRK1 | 0.952380952 | 1 | 0.909090909 |
| NOT-ACACB AND TBC1D7 | 0.952380952 | 1 | 0.909090909 |
| NOT-ACACB AND ATRAID | 0.909090909 | 0.909090909 | 0.909090909 |
| NOT-ACACB AND ACP2 | 0.952380952 | 1 | 0.909090909 |
| NOT-ACACB AND IMPAD1 | 0.952380952 | 1 | 0.909090909 |
| NOT-ACACB AND ZDHHC4 | 0.952380952 | 1 | 0.909090909 |
| NOT-ACACB AND CDCA7L | 0.9 | 1 | 0.818181818 |
| NOT-ACACB AND PTK7 | 0.909090909 | 0.909090909 | 0.909090909 |
| NOT-ACACB AND PVRL2 | 0.9 | 1 | 0.818181818 |
| NOT-ACACB AND SRPRB | 0.909090909 | 0.909090909 | 0.909090909 |
| NOT-ACACB AND SDC1 | 0.9 | 1 | 0.818181818 |
| NOT-ACACB AND LMBR1 | 0.9 | 1 | 0.818181818 |
| NOT-ACACB AND C5orf28 | 0.909090909 | 0.909090909 | 0.909090909 |
| NOT-ACACB AND GXYLT2 | 0.9 | 1 | 0.818181818 |
| NOT-ACACB AND SLC35A2 | 0.909090909 | 0.909090909 | 0.909090909 |
| NOT-ACACB AND MOGS | 0.909090909 | 0.909090909 | 0.909090909 |
| NOT-ACACB AND LRFN4 | 0.952380952 | 1 | 0.909090909 |
| NOT-ACACB AND RNF26 | 0.9 | 1 | 0.818181818 |
| NOT-ACACB AND TMEM185B | 0.952380952 | 1 | 0.909090909 |
| NOT-ACACB AND SLC39A7 | 0.909090909 | 0.909090909 | 0.909090909 |
| NOT-ACACB AND CD276 | 0.952380952 | 1 | 0.909090909 |
| NOT-ACACB AND AKAP1 | 0.9 | 1 | 0.818181818 |
| NOT-ACACB AND PLVAP | 0.952380952 | 1 | 0.909090909 |
| NOT-ACACB AND ANTXR1 | 0.9 | 1 | 0.818181818 |

FIG. 1 (CONT.)

| Antigen Pair Logic | F1 | Precision | Recall |
|---|---|---|---|
| NOT-PMEL AND PMEL | 0.952380952 | 1 | 0.909090909 |
| MLANA AND NOT-CLDN4 | 0.952380952 | 1 | 0.909090909 |
| CTDNEP1 AND NOT-CLDN4 | 0.9 | 1 | 0.818181818 |
| PPT2 AND NOT-CLDN4 | 0.9 | 1 | 0.818181818 |
| PIGW AND NOT-CLDN4 | 0.9 | 1 | 0.818181818 |
| STX18 AND NOT-CLDN4 | 0.9 | 1 | 0.818181818 |
| MANBAL AND NOT-CLDN4 | 0.9 | 1 | 0.818181818 |
| RER1 AND NOT-CLDN4 | 0.952380952 | 1 | 0.909090909 |
| LMAN2L AND NOT-CLDN4 | 0.952380952 | 1 | 0.909090909 |
| YIPF1 AND NOT-CLDN4 | 0.9 | 1 | 0.818181818 |
| GPR107 AND NOT-CLDN4 | 0.9 | 1 | 0.818181818 |
| SLC45A2 AND NOT-CLDN4 | 0.952380952 | 1 | 0.909090909 |
| SLC5A6 AND NOT-CLDN4 | 0.952380952 | 1 | 0.909090909 |
| MC1R AND NOT-CLDN4 | 0.9 | 1 | 0.818181818 |
| TMEM147 AND NOT-CLDN4 | 0.9 | 1 | 0.818181818 |
| TNFSF9 AND NOT-CLDN4 | 0.952380952 | 1 | 0.909090909 |
| TYRP1 AND NOT-CLDN4 | 0.9 | 1 | 0.818181818 |
| C11orf24 AND NOT-CLDN4 | 0.9 | 1 | 0.818181818 |
| NOT-PMEL AND PMEL | 0.952380952 | 1 | 0.909090909 |
| BCAP31 AND NOT-CLDN4 | 0.952380952 | 1 | 0.909090909 |
| ABHD12 AND NOT-CLDN4 | 0.952380952 | 1 | 0.909090909 |
| FDPS AND NOT-CLDN4 | 0.9 | 1 | 0.818181818 |
| IL12RB2 AND NOT-CLDN4 | 0.9 | 1 | 0.818181818 |
| PNKD AND NOT-CLDN4 | 0.909090909 | 0.90909091 | 0.909090909 |
| MARVELD1 AND NOT-CLDN4 | 0.9 | 1 | 0.818181818 |
| PQLC1 AND NOT-DRD3 | 0.909090909 | 0.90909091 | 0.909090909 |
| OS9 AND NOT-DRD3 | 0.952380952 | 1 | 0.909090909 |
| MLANA AND NOT-DRD3 | 1 | 1 | 1 |
| PIGL AND NOT-DRD3 | 0.909090909 | 0.90909091 | 0.909090909 |
| SFXN3 AND NOT-DRD3 | 0.952380952 | 1 | 0.909090909 |
| PPT2 AND NOT-DRD3 | 0.9 | 1 | 0.818181818 |
| HSD3B7 AND NOT-DRD3 | 0.9 | 1 | 0.818181818 |
| MANBAL AND NOT-DRD3 | 0.952380952 | 1 | 0.909090909 |
| TMEM138 AND TMEM138 | 0.952380952 | 1 | 0.909090909 |
| LMAN2L AND NOT-DRD3 | 0.952380952 | 1 | 0.909090909 |
| CIRH1A AND NOT-DRD3 | 0.952380952 | 1 | 0.909090909 |
| ERGIC3 AND NOT-DRD3 | 0.9 | 1 | 0.818181818 |
| TIMM22 AND NOT-DRD3 | 0.9 | 1 | 0.818181818 |
| TMEM189 AND NOT-DRD3 | 0.952380952 | 1 | 0.909090909 |
| TMEM184B AND NOT-DRD3 | 0.952380952 | 1 | 0.909090909 |
| GPR107 AND NOT-DRD3 | 0.9 | 1 | 0.818181818 |
| SLC45A2 AND NOT-DRD3 | 0.952380952 | 1 | 0.909090909 |
| SLC5A6 AND NOT-DRD3 | 0.952380952 | 1 | 0.909090909 |
| MC1R AND NOT-DRD3 | 0.9 | 1 | 0.818181818 |
| TMEM147 AND NOT-DRD3 | 0.9 | 1 | 0.818181818 |
| EXT1 AND NOT-DRD3 | 0.952380952 | 1 | 0.909090909 |
| TNFSF9 AND NOT-DRD3 | 0.909090909 | 0.90909091 | 0.909090909 |
| NDST1 AND NOT-DRD3 | 0.909090909 | 0.90909091 | 0.909090909 |
| C11orf24 AND NOT-DRD3 | 0.9 | 1 | 0.818181818 |
| NOT-PMEL AND PMEL | 0.952380952 | 1 | 0.909090909 |
| ABHD12 AND NOT-DRD3 | 0.909090909 | 0.90909091 | 0.909090909 |
| FDPS AND NOT-DRD3 | 1 | 1 | 1 |
| IL12RB2 AND NOT-DRD3 | 0.9 | 1 | 0.818181818 |
| PNKD AND NOT-DRD3 | 0.952380952 | 1 | 0.909090909 |
| ROMO1 AND NOT-DRD3 | 0.952380952 | 1 | 0.909090909 |
| NOT-SCN4A AND PICK1 | 0.9 | 1 | 0.818181818 |
| MLANA AND PICK1 | 0.952380952 | 1 | 0.909090909 |
| NOT-CHRNA2 AND PICK1 | 0.9 | 1 | 0.818181818 |
| SFXN3 AND PICK1 | 0.952380952 | 1 | 0.909090909 |
| OXA1L AND PICK1 | 0.9 | 1 | 0.818181818 |
| PARL AND PICK1 | 0.9 | 1 | 0.818181818 |
| MANBAL AND NOT-PICK1 | 0.952380952 | 1 | 0.909090909 |
| NOT-NMUR2 AND PICK1 | 0.9 | 1 | 0.818181818 |
| NOT-TMEM95 AND PICK1 | 0.9 | 1 | 0.818181818 |
| TMEM138 AND PICK1 | 0.9 | 1 | 0.818181818 |
| NOT-ISM2 AND PICK1 | 0.9 | 1 | 0.818181818 |
| AUP1 AND PICK1 | 0.9 | 1 | 0.818181818 |
| NOT-ATCAY AND PICK1 | 0.9 | 1 | 0.818181818 |
| SLC45A2 AND NOT-PICK1 | 0.952380952 | 1 | 0.909090909 |
| MC1R AND NOT-PICK1 | 0.9 | 1 | 0.818181818 |
| TNFSF9 AND NOT-PICK1 | 0.909090909 | 0.90909091 | 0.909090909 |
| NOT-CFTR AND PICK1 | 0.9 | 1 | 0.818181818 |
| NOT-PTCH2 AND PICK1 | 0.9 | 1 | 0.818181818 |
| NOT-PMEL AND PMEL | 0.952380952 | 1 | 0.909090909 |
| BCAP31 AND PICK1 | 0.9 | 1 | 0.818181818 |
| NDUFA1 AND PICK1 | 0.9 | 1 | 0.818181818 |

| Antigen Pair Logic | F1 | Precision | Recall |
|---|---|---|---|
| NOT-ACACB AND SOAT2 | 0.9 | 1 | 0.818181818 |
| NOT-ACACB AND PPAP2C | 0.952380952 | 1 | 0.909090909 |
| NOT-ACACB AND TNFRSF18 | 0.909090909 | 0.909090909 | 0.909090909 |
| NOT-ACACB AND MARVELD3 | 0.9 | 1 | 0.818181818 |
| NETO2 AND NOT-KCNS2 | 0.9 | 1 | 0.818181818 |
| ATP6V0C AND NOT-MAN2A2 | 0.952380952 | 1 | 0.909090909 |
| TMEM206 AND NOT-MAN2A2 | 0.909090909 | 0.909090909 | 0.909090909 |
| OSMR AND NOT-CRIM1 | 0.9 | 1 | 0.818181818 |
| LSR AND NOT-SEMA4G | 0.9 | 1 | 0.818181818 |
| LSR AND NOT-CYP4F12 | 0.9 | 1 | 0.818181818 |
| TMEM41A AND NOT-ENPP1 | 0.9 | 1 | 0.818181818 |
| DNAJB11 AND NOT-KIAA1109 | 0.9 | 1 | 0.818181818 |
| ATP6V0C AND PFN2 | 0.9 | 1 | 0.818181818 |
| MOGS AND NOT-ABCB1 | 0.9 | 1 | 0.818181818 |
| CLPTM1L AND NOT-ABCB1 | 0.9 | 1 | 0.818181818 |
| TMEM41A AND NOT-ABCB1 | 0.9 | 1 | 0.818181818 |
| ATP6V0C AND NOT-RNF130 | 0.9 | 1 | 0.818181818 |
| ATP6V0C AND NOT-TNFRSF14 | 0.9 | 1 | 0.818181818 |
| ATP6V0C AND NOT-CD101 | 0.9 | 1 | 0.818181818 |
| ATP6V0C AND NOT-FIG4 | 0.9 | 1 | 0.818181818 |
| OSMR AND NOT-FXYD1 | 0.9 | 1 | 0.818181818 |
| TMEM41A AND NOT-VSIG10 | 0.9 | 1 | 0.818181818 |
| PPAP2C AND NOT-PCDHA6 | 0.952380952 | 1 | 0.909090909 |
| OSMR AND NOT-SCN7A | 0.9 | 1 | 0.818181818 |
| C5orf28 AND NOT-SMIM15 | 0.9 | 1 | 0.818181818 |
| NOT-KIAA1109 AND C5orf28 | 0.9 | 1 | 0.818181818 |
| OSMR AND NOT-TGFBR3 | 0.9 | 1 | 0.818181818 |
| OSMR AND NOT-ACSS3 | 0.9 | 1 | 0.818181818 |
| OSMR AND NOT-UPK3B | 0.9 | 1 | 0.818181818 |
| TMEM41A AND NOT-PRRT1 | 0.9 | 1 | 0.818181818 |
| TMEM41A AND NOT-KIAA1109 | 0.9 | 1 | 0.818181818 |
| OSMR AND NOT-KIAA1109 | 0.9 | 1 | 0.818181818 |
| OSMR AND NOT-ANGPTL1 | 0.9 | 1 | 0.818181818 |
| OSMR AND NOT-ADAMTS1 | 0.9 | 1 | 0.818181818 |
| Leukemia, Myeloid, Acute (AML) | | | |
| FLT3 | 0.935222672 | 0.950617284 | 0.920318725 |
| NOT-SPINK2 AND SPINK2 | 0.912863071 | 0.952380952 | 0.876494024 |
| SLC22A16 AND NOT-SDC1 | 0.90513834 | 0.898039216 | 0.912350598 |
| FUT4 AND NOT-SDC1 | 0.964285714 | 0.960474308 | 0.96812749 |
| ELANE AND NOT-SDC1 | 0.909819639 | 0.915322581 | 0.90438247 |
| NOT-SPINK2 AND SPINK2 | 0.912863071 | 0.952380952 | 0.876494024 |
| MS4A3 AND NOT-SLAMF7 | 0.932270916 | 0.932270916 | 0.932270916 |
| TMC8 AND NOT-SLAMF7 | 0.90513834 | 0.898039216 | 0.912350598 |
| NOT-PFN2 AND NOT-SLAMF7 | 0.938461538 | 0.907063197 | 0.972111554 |
| CD33 AND NOT-SLAMF7 | 0.916996047 | 0.909803922 | 0.924302789 |
| NOT-SPINK2 AND SPINK2 | 0.912863071 | 0.952380952 | 0.876494024 |
| FUT4 AND NOT-SLAMF7 | 0.971544715 | 0.991701245 | 0.952191235 |
| NRROS AND NOT-SLAMF7 | 0.940936864 | 0.9625 | 0.920318725 |
| P2RY8 AND NOT-SLAMF7 | 0.909774436 | 0.861209964 | 0.964143426 |
| HCST AND NOT-SLAMF7 | 0.920454545 | 0.877256318 | 0.96812749 |
| CXCL8 AND NOT-SLAMF7 | 0.905027933 | 0.84965035 | 0.96812749 |
| TSPAN32 AND NOT-SLAMF7 | 0.947162427 | 0.930769231 | 0.964143426 |
| P2RX1 AND NOT-SLAMF7 | 0.907063197 | 0.850174216 | 0.972111554 |
| HBD AND NOT-SLAMF7 | 0.939096267 | 0.926356589 | 0.952191235 |
| ITGA4 AND NOT-SLAMF7 | 0.910569106 | 0.929460581 | 0.892430279 |
| NOT-TMTC3 AND CD44 | 0.901303538 | 0.846153846 | 0.964143426 |
| NOT-HEG1 AND CD44 | 0.909090909 | 0.944206009 | 0.876494024 |
| NOT-PFN2 AND CD44 | 0.911111111 | 0.851211073 | 0.980079681 |
| NOT-EXT1 AND CD44 | 0.900934579 | 0.848591549 | 0.960159363 |
| NOT-FAM69A AND CD44 | 0.944971537 | 0.902173913 | 0.992031873 |
| NOT-GPR155 AND CD44 | 0.923976608 | 0.904580153 | 0.944223108 |
| NOT-WLS AND CD44 | 0.908745247 | 0.869090909 | 0.952191235 |
| NOT-SPINK2 AND SPINK2 | 0.912863071 | 0.952380952 | 0.876494024 |
| NOT-BMPR1A AND CD44 | 0.912959381 | 0.887218045 | 0.940239044 |
| SLC22A16 AND CD44 | 0.914285714 | 0.937238494 | 0.892430279 |
| NOT-ARMCX2 AND CD44 | 0.922787194 | 0.875 | 0.976095618 |
| NOT-SLC37A3 AND CD44 | 0.923076923 | 0.892193309 | 0.956175299 |
| FUT4 AND CD44 | 0.903954802 | 0.857142857 | 0.956175299 |
| FLT3 AND CD44 | 0.930894309 | 0.950207469 | 0.912350598 |
| CD44 AND NOT-SMIM14 | 0.9140625 | 0.896551724 | 0.932270916 |
| NOT-GAL3ST4 AND CD44 | 0.901960784 | 0.888030888 | 0.916334661 |
| HBD AND CD44 | 0.903591682 | 0.85971223 | 0.952191235 |
| NOT-PHLDB2 AND CD44 | 0.947775629 | 0.921052632 | 0.976095618 |
| NOT-LRIG1 AND CD44 | 0.920222635 | 0.861111111 | 0.988047809 |
| NOT-SPINK2 AND SPINK2 | 0.912863071 | 0.952380952 | 0.876494024 |
| FLT3 AND NOT-IL11RA | 0.940936864 | 0.9625 | 0.920318725 |

FIG. 1 (CONT.)

| Antigen Pair Logic | F1 | Precision | Recall | Antigen Pair Logic | F1 | Precision | Recall |
|---|---|---|---|---|---|---|---|
| ROMO1 AND NOT-PICK1 | 0.952380952 | 1 | 0.909090909 | P2RX1 AND NOT-IL11RA | 0.908382066 | 0.889312977 | 0.928286853 |
| NOT-STX1B AND PICK1 | 0.9 | 1 | 0.818181818 | NOT-SPINK2 AND SPINK2 | 0.912863071 | 0.952380952 | 0.876494024 |
| PQLC1 AND PSMB7 | 0.9 | 1 | 0.818181818 | NOT-FLT3 AND FLT3 | 0.935222672 | 0.950617284 | 0.920318725 |
| OS9 AND OS9 | 0.9 | 1 | 0.818181818 | TMC8 AND NOT-CD19 | 0.906504065 | 0.925311203 | 0.888446215 |
| FAM3A AND PSMB7 | 0.9 | 1 | 0.818181818 | NOT-PFN2 AND NOT-CD19 | 0.933333333 | 0.946721311 | 0.920318725 |
| MLANA AND PSMB7 | 1 | 1 | 1 | NOT-SPINK2 AND SPINK2 | 0.912863071 | 0.952380952 | 0.876494024 |
| PIGL AND PSMB7 | 0.9 | 1 | 0.818181818 | NOT-FLT3 AND FLT3 | 0.935222672 | 0.950617284 | 0.920318725 |
| LARGE AND PSMB7 | 0.9 | 1 | 0.818181818 | NRROS AND NOT-CD19 | 0.933333333 | 0.946721311 | 0.920318725 |
| GPR137B AND PSMB7 | 0.9 | 1 | 0.818181818 | P2RY8 AND NOT-CD19 | 0.911538462 | 0.881040892 | 0.944223108 |
| HGSNAT AND PSMB7 | 0.9 | 1 | 0.818181818 | TSPAN32 AND NOT-CD19 | 0.918604651 | 0.894339623 | 0.944223108 |
| CLCN5 AND PSMB7 | 0.952380952 | 1 | 0.909090909 | NOT-ATP9A AND NOT-CD19 | 0.90234375 | 0.885057471 | 0.920318725 |
| VANGL2 AND PSMB7 | 0.952380952 | 1 | 0.909090909 | HBD AND NOT-CD19 | 0.918811881 | 0.913385827 | 0.924302789 |
| APMAP AND PSMB7 | 0.952380952 | 1 | 0.909090909 | NOT-SPINK2 AND SPINK2 | 0.912863071 | 0.952380952 | 0.876494024 |
| FAM134A AND PSMB7 | 0.952380952 | 1 | 0.909090909 | NOT-FLT3 AND FLT3 | 0.935222672 | 0.950617284 | 0.920318725 |
| TMEM138 AND PSMB7 | 0.9 | 1 | 0.818181818 | NOT-SPINK2 AND SPINK2 | 0.912863071 | 0.952380952 | 0.876494024 |
| NOT-CIRH1A AND CIRH1A | 0.952380952 | 1 | 0.909090909 | FUT4 AND NOT-MUC1 | 0.941883768 | 0.947580645 | 0.93625498 |
| NOT-ERGIC3 AND ERGIC3 | 0.9 | 1 | 0.818181818 | NOT-FLT3 AND FLT3 | 0.935222672 | 0.950617284 | 0.920318725 |
| YIF1B AND PSMB7 | 0.9 | 1 | 0.818181818 | NOT-SPINK2 AND SPINK2 | 0.912863071 | 0.952380952 | 0.876494024 |
| TMEM184B AND PSMB7 | 0.952380952 | 1 | 0.909090909 | SLC22A16 AND NOT-MUC13 | 0.901574803 | 0.891050584 | 0.912350598 |
| SLC5A6 AND PSMB7 | 0.952380952 | 1 | 0.909090909 | FUT4 AND NOT-MUC13 | 0.960474308 | 0.952941176 | 0.96812749 |
| PTPRS AND PSMB7 | 0.9 | 1 | 0.818181818 | TMC8 AND NOT-CD22 | 0.904483431 | 0.885496183 | 0.924302789 |
| TMEM147 AND TMEM147 | 0.9 | 1 | 0.818181818 | NOT-PFN2 AND NOT-CD22 | 0.959223301 | 0.935606061 | 0.984063745 |
| EXT1 AND PSMB7 | 0.952380952 | 1 | 0.909090909 | NOT-DIP2C AND NOT-CD22 | 0.903460838 | 0.832214765 | 0.988047809 |
| TNFSF9 AND PSMB7 | 0.909090909 | 0.90909091 | 0.909090909 | NOT-SPINK2 AND SPINK2 | 0.912863071 | 0.952380952 | 0.876494024 |
| NDST1 AND PSMB7 | 0.952380952 | 1 | 0.909090909 | NOT-FLT3 AND FLT3 | 0.935222672 | 0.950617284 | 0.920318725 |
| NOT-TMEM105 AND PSMB7 | 0.952380952 | 1 | 0.909090909 | NOT-CADM1 AND NOT-CD22 | 0.906309751 | 0.871323529 | 0.944223108 |
| NOT-PMEL AND PMEL | 0.952380952 | 1 | 0.909090909 | NRROS AND NOT-CD22 | 0.935742972 | 0.943319838 | 0.928286853 |
| CLCC1 AND PSMB7 | 0.9 | 1 | 0.818181818 | P2RY8 AND NOT-CD22 | 0.921052632 | 0.871886121 | 0.976095618 |
| ABHD12 AND PSMB7 | 0.952380952 | 1 | 0.909090909 | TSPAN32 AND NOT-CD22 | 0.931818182 | 0.888086643 | 0.980079681 |
| FDPS AND PSMB7 | 0.952380952 | 1 | 0.909090909 | NOT-ATP9A AND NOT-CD22 | 0.902857143 | 0.864963504 | 0.944223108 |
| ICMT AND PSMB7 | 0.9 | 1 | 0.818181818 | HBD AND NOT-CD22 | 0.92543021 | 0.889705882 | 0.964143426 |
| PNKD AND PSMB7 | 0.909090909 | 0.90909091 | 0.909090909 | NOT-SPINK2 AND SPINK2 | 0.912863071 | 0.952380952 | 0.876494024 |
| PFKP AND PSMB7 | 0.9 | 1 | 0.818181818 | ELANE AND NOT-EPHA3 | 0.90438247 | 0.90438247 | 0.90438247 |
| ROMO1 AND PSMB7 | 0.952380952 | 1 | 0.909090909 | NOT-SPINK2 AND CSPG4 | 0.912863071 | 0.952380952 | 0.876494024 |
| GCNT2 AND PSMB7 | 0.9 | 1 | 0.818181818 | NOT-SPINK2 AND MUC16 | 0.912863071 | 0.952380952 | 0.876494024 |
| CELSR2 AND PSMB7 | 0.952380952 | 1 | 0.909090909 | SLC22A16 AND NOT-MUC16 | 0.901574803 | 0.891050584 | 0.912350598 |
| PQLC1 AND NOT-CSF3 | 0.9 | 1 | 0.818181818 | NOT-SPINK2 AND SPINK2 | 0.912863071 | 0.952380952 | 0.876494024 |
| SLC35E3 AND NOT-CSF3 | 0.952380952 | 1 | 0.909090909 | ELANE AND NOT-ROR1 | 0.902584493 | 0.900793651 | 0.90438247 |
| OS9 AND OS9 | 0.9 | 1 | 0.818181818 | NOT-SPINK2 AND SPINK2 | 0.912863071 | 0.952380952 | 0.876494024 |
| SLAMF8 AND NOT-CSF3 | 0.9 | 1 | 0.818181818 | NOT-FLT3 AND FLT3 | 0.935222672 | 0.950617284 | 0.920318725 |
| WFS1 AND NOT-CSF3 | 0.9 | 1 | 0.818181818 | NOT-SPINK2 AND SPINK2 | 0.912863071 | 0.952380952 | 0.876494024 |
| TMEM187 AND NOT-CSF3 | 0.952380952 | 1 | 0.909090909 | NOT-SPINK2 AND SPINK2 | 0.912863071 | 0.952380952 | 0.876494024 |
| MLANA AND NOT-CSF3 | 0.952380952 | 1 | 0.909090909 | NOT-FLT3 AND FLT3 | 0.935222672 | 0.950617284 | 0.920318725 |
| CXCL9 AND NOT-CSF3 | 0.9 | 1 | 0.818181818 | NOT-SPINK2 AND TNFSF11 | 0.912863071 | 0.952380952 | 0.876494024 |
| PIGL AND NOT-CSF3 | 0.952380952 | 1 | 0.909090909 | NOT-SPINK2 AND SPINK2 | 0.912863071 | 0.952380952 | 0.876494024 |
| NOT-CSF3 AND NRM | 0.9 | 1 | 0.818181818 | FLT3 AND NOT-FOLR2 | 0.935281837 | 0.98245614 | 0.892430279 |
| PQLC2 AND NOT-CSF3 | 0.9 | 1 | 0.818181818 | ELANE AND NOT-FOLR2 | 0.904564315 | 0.943722944 | 0.868525896 |
| NOT-CSF3 AND CNNM4 | 0.9 | 1 | 0.818181818 | SMIM3 AND NOT-FOLR2 | 0.928425358 | 0.953781513 | 0.90438247 |
| SFXN3 AND CSF3 | 0.952380952 | 1 | 0.909090909 | NOT-SPINK2 AND SPINK2 | 0.912863071 | 0.952380952 | 0.876494024 |
| PPT2 AND NOT-CSF3 | 0.9 | 1 | 0.818181818 | MS4A3 AND NOT-TNFRSF17 | 0.920318725 | 0.920318725 | 0.920318725 |
| KIAA1024 AND NOT-CSF3 | 0.9 | 1 | 0.818181818 | TMC8 AND NOT-TNFRSF17 | 0.902970297 | 0.897637795 | 0.908366534 |
| ST7L AND NOT-CSF3 | 0.9 | 1 | 0.818181818 | CD33 AND NOT-TNFRSF17 | 0.900195695 | 0.884615385 | 0.916334661 |
| BNIP1 AND NOT-CSF3 | 0.9 | 1 | 0.818181818 | NOT-SPINK2 AND SPINK2 | 0.912863071 | 0.952380952 | 0.876494024 |
| CLCN5 AND NOT-CSF3 | 0.952380952 | 1 | 0.909090909 | FUT4 AND NOT-TNFRSF17 | 0.965376782 | 0.9875 | 0.944223108 |
| SMIM4 AND NOT-CSF3 | 0.9 | 1 | 0.818181818 | NRROS AND NOT-TNFRSF17 | 0.928716904 | 0.95 | 0.908366534 |
| VANGL2 AND NOT-CSF3 | 0.9 | 1 | 0.818181818 | P2RY8 AND NOT-TNFRSF17 | 0.909433962 | 0.863799283 | 0.960159363 |
| TMEM138 AND TMEM138 | 0.952380952 | 1 | 0.909090909 | HCST AND NOT-TNFRSF17 | 0.901303538 | 0.846153846 | 0.964143426 |
| NPC1 AND NOT-CSF3 | 0.952380952 | 1 | 0.909090909 | TSPAN32 AND NOT-TNFRSF17 | 0.936170213 | 0.909774436 | 0.964143426 |
| NOT-CIRH1A AND CIRH1A | 0.952380952 | 1 | 0.909090909 | HBD AND NOT-TNFRSF17 | 0.922178988 | 0.901140684 | 0.944223108 |
| ERGIC3 AND CSF3 | 0.9 | 1 | 0.818181818 | ITGA4 AND NOT-TNFRSF17 | 0.91206544 | 0.93697479 | 0.888446215 |
| NOT-CSF3 AND CDH24 | 0.9 | 1 | 0.818181818 | NOT-SPINK2 AND TNFRSF8 | 0.912863071 | 0.952380952 | 0.876494024 |
| TMEM184B AND NOT-CSF3 | 0.9 | 1 | 0.818181818 | NOT-SPINK2 AND SPINK2 | 0.912863071 | 0.952380952 | 0.876494024 |
| FAM174B AND NOT-CSF3 | 0.9 | 1 | 0.818181818 | NOT-FLT3 AND FLT3 | 0.935222672 | 0.950617284 | 0.920318725 |
| NOT-CSF3 AND PIGQ | 0.9 | 1 | 0.818181818 | NOT-SPINK2 AND SPINK2 | 0.912863071 | 0.952380952 | 0.876494024 |
| YIPF1 AND NOT-CSF3 | 0.909090909 | 0.90909091 | 0.909090909 | NOT-SPINK2 AND SPINK2 | 0.912863071 | 0.952380952 | 0.876494024 |
| SLC45A2 AND NOT-CSF3 | 0.952380952 | 1 | 0.909090909 | FLT3 AND NOT-FOLH1 | 0.944785276 | 0.970588235 | 0.920318725 |
| SLC5A6 AND NOT-CSF3 | 0.9 | 1 | 0.818181818 | NOT-SPINK2 AND SPINK2 | 0.912863071 | 0.952380952 | 0.876494024 |
| NOT-CSF3 AND LRRC8E | 0.9 | 1 | 0.818181818 | SLC22A16 AND NOT-ERBB4 | 0.903353057 | 0.89453125 | 0.912350598 |
| ARMCX1 AND NOT-CSF3 | 0.9 | 1 | 0.818181818 | NOT-SPINK2 AND SPINK2 | 0.912863071 | 0.952380952 | 0.876494024 |
| TMEM147 AND TMEM147 | 0.9 | 1 | 0.818181818 | SLC22A16 AND NOT-ERBB2 | 0.901574803 | 0.891050584 | 0.912350598 |
| EXT1 AND NOT-CSF3 | 0.9 | 1 | 0.818181818 | FUT4 AND NOT-ERBB2 | 0.960474308 | 0.952941176 | 0.96812749 |
| TNFSF9 AND NOT-CSF3 | 0.9 | 1 | 0.818181818 | ELANE AND NOT-ERBB2 | 0.902584493 | 0.900793651 | 0.90438247 |
| CDC14B AND NOT-CSF3 | 0.9 | 1 | 0.818181818 | SMIM24 AND NOT-KDR | 0.912 | 0.915662651 | 0.908366534 |
| TYRP1 AND NOT-CSF3 | 0.952380952 | 1 | 0.909090909 | LRRC70 AND NOT-KDR | 0.938613861 | 0.933070866 | 0.944223108 |
| NDST1 AND NOT-CSF3 | 0.9 | 1 | 0.818181818 | NOT-SPINK2 AND SPINK2 | 0.912863071 | 0.952380952 | 0.876494024 |
| NOT-PMEL AND PMEL | 0.952380952 | 1 | 0.909090909 | FLT3 AND NOT-KDR | 0.948665298 | 0.978813559 | 0.920318725 |

FIG. 1 (CONT.)

| Antigen Pair Logic | F1 | Precision | Recall | Antigen Pair Logic | F1 | Precision | Recall |
|---|---|---|---|---|---|---|---|
| NOT-CSF3 AND TLCD1 | 0.952380952 | 1 | 0.909090909 | CXCL8 AND NOT-KDR | 0.923364486 | 0.86971831 | 0.984063745 |
| BCAP31 AND NOT-CSF3 | 0.9 | 1 | 0.818181818 | ELANE AND NOT-KDR | 0.915322581 | 0.926530612 | 0.90438247 |
| NOT-CSF3 AND TMEM110 | 0.9 | 1 | 0.818181818 | SMIM3 AND NOT-KDR | 0.96812749 | 0.96812749 | 0.96812749 |
| CLCC1 AND NOT-CSF3 | 0.9 | 1 | 0.818181818 | CD33 AND NOT-ENDOD1 | 0.909465021 | 0.940425532 | 0.880478088 |
| ABHD12 AND NOT-CSF3 | 0.9 | 1 | 0.818181818 | CD33 AND NOT-NELL2 | 0.909803922 | 0.895752896 | 0.924302789 |
| PNKD AND NOT-CSF3 | 0.9 | 1 | 0.818181818 | NOT-TMTC3 AND CD33 | 0.908396947 | 0.871794872 | 0.948207171 |
| PRRT3 AND NOT-CSF3 | 0.9 | 1 | 0.818181818 | CD33 AND NOT-LY9 | 0.903100775 | 0.879245283 | 0.928286853 |
| ROMO1 AND NOT-CSF3 | 0.952380952 | 1 | 0.909090909 | CD33 AND NOT-S1PR1 | 0.92371134 | 0.957264957 | 0.892430279 |
| CELSR2 AND NOT-CSF3 | 0.9 | 1 | 0.818181818 | CD33 AND NOT-FAM200A | 0.90625 | 0.888888889 | 0.924302789 |
| PRADC1 AND NOT-CSF3 | 0.9 | 1 | 0.818181818 | CD33 AND NOT-CD1C | 0.907258065 | 0.918367347 | 0.896414343 |
| MLANA AND NOT-GCG | 1 | 1 | 1 | CD33 AND NOT-CDC14B | 0.906976744 | 0.883018868 | 0.932270916 |
| SFXN3 AND NOT-GCG | 0.952380952 | 1 | 0.909090909 | CD33 AND NOT-LPAR1 | 0.912280702 | 0.893129771 | 0.932270916 |
| PPT2 AND NOT-GCG | 0.9 | 1 | 0.818181818 | CD33 AND NOT-STX17 | 0.91322314 | 0.948497854 | 0.880478088 |
| SLC25A33 AND NOT-GCG | 0.9 | 1 | 0.818181818 | NOT-HEG1 AND CD33 | 0.918238994 | 0.969026549 | 0.87250996 |
| TMEM138 AND TMEM138 | 0.952380952 | 1 | 0.909090909 | CD33 AND NOT-TGFBI | 0.903361345 | 0.955555556 | 0.856573705 |
| LMAN2L AND NOT-GCG | 0.909090909 | 0.90909091 | 0.909090909 | CD33 AND NOT-IL7R | 0.919449902 | 0.906976744 | 0.932270916 |
| NPC1 AND NOT-GCG | 0.952380952 | 1 | 0.909090909 | CD33 AND NOT-SLC44A2 | 0.934156379 | 0.965957447 | 0.90438247 |
| CIRH1A AND NOT-GCG | 0.952380952 | 1 | 0.909090909 | CD33 AND NOT-PXYLP1 | 0.93081761 | 0.982300885 | 0.884462151 |
| TMEM189 AND NOT-GCG | 0.952380952 | 1 | 0.909090909 | NOT-PFN2 AND CD33 | 0.917293233 | 0.868327402 | 0.972111554 |
| SLC45A2 AND NOT-GCG | 0.952380952 | 1 | 0.909090909 | CD33 AND NOT-ADAM19 | 0.911591356 | 0.899224806 | 0.924302789 |
| SLC5A6 AND NOT-GCG | 0.952380952 | 1 | 0.909090909 | CD33 AND NOT-TMEM140 | 0.938016529 | 0.974248927 | 0.90438247 |
| MC1R AND NOT-GCG | 0.9 | 1 | 0.818181818 | CD33 AND NOT-SLC18B1 | 0.9 | 0.990430622 | 0.824701195 |
| SLC35A4 AND NOT-GCG | 0.9 | 1 | 0.818181818 | CD33 AND NOT-IFNLR1 | 0.924901186 | 0.917647059 | 0.932270916 |
| TNFSF9 AND NOT-GCG | 0.952380952 | 1 | 0.909090909 | CD33 AND NOT-INSIG2 | 0.913043478 | 0.905882353 | 0.920318725 |
| NOT-PMEL AND PMEL | 0.952380952 | 1 | 0.909090909 | NOT-EXT1 AND CD33 | 0.914396887 | 0.893536122 | 0.93625498 |
| FDPS AND NOT-GCG | 0.952380952 | 1 | 0.909090909 | NOT-FAM69A AND CD33 | 0.96031746 | 0.956521739 | 0.964143426 |
| IL12RB2 AND NOT-GCG | 0.9 | 1 | 0.818181818 | CD33 AND NOT-RTN1 | 0.934693878 | 0.958158996 | 0.912350598 |
| PNKD AND NOT-GCG | 0.952380952 | 1 | 0.909090909 | CD33 AND NOT-CPED1 | 0.901467505 | 0.951327434 | 0.856573705 |
| FDPS AND NOT-NAALAD2 | 1 | 1 | 1 | CD33 AND NOT-ENPP5 | 0.906614786 | 0.885931559 | 0.928286853 |
| MLANA AND NOT-NAALAD2 | 1 | 1 | 1 | CD33 AND NOT-SYNJ2BP | 0.916334661 | 0.916334661 | 0.916334661 |
| FDPS AND NAALADL1 | 1 | 1 | 1 | CD33 AND NOT-CCR7 | 0.900584795 | 0.881679389 | 0.920318725 |
| MLANA AND NOT-NAALADL1 | 1 | 1 | 1 | CD33 AND NOT-PVRIG | 0.904854369 | 0.882575758 | 0.928286853 |
| MLANA AND KCNE3 | 1 | 1 | 1 | CD33 AND NOT-C19orf12 | 0.904483431 | 0.885496183 | 0.924302789 |
| AUP1 AND NOT-KCNE3 | 1 | 1 | 1 | CD33 AND NOT-GPR155 | 0.929859719 | 0.935483871 | 0.924302789 |
| PARL AND NOT-KCNE3 | 1 | 1 | 1 | CD33 AND NOT-HLA-DOB | 0.914396887 | 0.893536122 | 0.93625498 |
| FDPS AND CDH2 | 1 | 1 | 1 | CD33 AND NOT-CD2 | 0.909448819 | 0.898832685 | 0.920318725 |
| MLANA AND MLANA | 1 | 1 | 1 | NOT-PTPRM AND CD33 | 0.900195695 | 0.884615385 | 0.916334661 |
| MLANA AND TMEM170B | 1 | 1 | 1 | CD33 AND NOT-ADTRP | 0.927021696 | 0.91796875 | 0.93625498 |
| AUP1 AND NOT-TMEM170B | 1 | 1 | 1 | CD33 AND NOT-LDLRAD4 | 0.905263158 | 0.959821429 | 0.856573705 |
| PARL AND NOT-TMEM170B | 1 | 1 | 1 | CD33 AND NOT-SEC63 | 0.908 | 0.911646586 | 0.90438247 |
| FDPS AND NOT-TMEM221 | 1 | 1 | 1 | CD33 AND NOT-NPC1 | 0.901185771 | 0.894117647 | 0.908366534 |
| MLANA AND NOT-TMEM221 | 1 | 1 | 1 | NOT-WLS AND CD33 | 0.922772277 | 0.917322835 | 0.928286853 |
| NPC1 AND NOT-TMEM221 | 1 | 1 | 1 | CD33 AND NOT-CD3G | 0.900195695 | 0.884615385 | 0.916334661 |
| MLANA AND NOT-LRRC70 | 1 | 1 | 1 | CD33 AND NOT-SLC46A3 | 0.92555332 | 0.93495935 | 0.916334661 |
| MLANA AND NEMP2 | 1 | 1 | 1 | CD33 AND NOT-IL18R1 | 0.901803607 | 0.907258065 | 0.896414343 |
| CLCN5 AND NOT-100132596? | 1 | 1 | 1 | CD33 AND NOT-CMTM8 | 0.925311203 | 0.965367965 | 0.888446215 |
| MLANA AND NOT-100132596? | 1 | 1 | 1 | CD33 AND NOT-GIMAP1 | 0.901353965 | 0.87593985 | 0.928286853 |
| MLANA AND NOT-BCL2L10 | 1 | 1 | 1 | CD33 AND NOT-ST3GAL5 | 0.926530612 | 0.949790795 | 0.90438247 |
| NOT-MLANA AND CDH3 | 1 | 1 | 1 | CD33 AND NOT-CLCN3 | 0.906560636 | 0.904761905 | 0.908366534 |
| NOT-PMEL AND CDH3 | 1 | 1 | 1 | CD33 AND NOT-PTPRO | 0.923076923 | 0.9140625 | 0.932270916 |
| MLANA AND NOT-HCN4 | 1 | 1 | 1 | CD33 AND NOT-IL21R | 0.908737864 | 0.886363636 | 0.932270916 |
| NPC1 AND NOT-HCN4 | 1 | 1 | 1 | CD33 AND NOT-FAM171A1 | 0.917695473 | 0.94893617 | 0.888446215 |
| SLC35E3 AND NOT-HCN4 | 1 | 1 | 1 | CD33 AND NOT-NT5E | 0.921529175 | 0.930894309 | 0.912350598 |
| MLANA AND PIGK | 1 | 1 | 1 | CD33 AND NOT-MAL | 0.903885481 | 0.928571429 | 0.880478088 |
| MLANA AND TIMM23 | 1 | 1 | 1 | CD33 AND NOT-STEAP4 | 0.918163673 | 0.92 | 0.916334661 |
| FDPS AND NOT-ERVMER34-1 | 1 | 1 | 1 | NOT-SPINK2 AND CD33 | 0.912863071 | 0.952380952 | 0.876494024 |
| MLANA AND MLANA | 1 | 1 | 1 | CD33 AND NOT-YIPF5 | 0.906976744 | 0.883018868 | 0.932270916 |
| MLANA AND NOT-TMEM239 | 1 | 1 | 1 | CD33 AND NOT-STX6 | 0.908382066 | 0.889312977 | 0.928286853 |
| MLANA AND NOT-CDH4 | 1 | 1 | 1 | CD33 AND NOT-FAM134B | 0.93442623 | 0.962025316 | 0.908366534 |
| MLANA AND MLANA | 1 | 1 | 1 | NOT-BMPR1A AND CD33 | 0.905222437 | 0.879699248 | 0.932270916 |
| FDPS AND APELA | 1 | 1 | 1 | CD33 AND NOT-BMPR2 | 0.929460581 | 0.96969697 | 0.892430279 |
| MLANA AND NOT-APELA | 1 | 1 | 1 | CD33 AND NOT-ARMCX2 | 0.915520629 | 0.903100775 | 0.928286853 |
| MLANA AND MLANA | 1 | 1 | 1 | CD33 AND NOT-ANKH | 0.910891089 | 0.905511811 | 0.916334661 |
| FDPS AND NOT-MRLN | 1 | 1 | 1 | NOT-SLC37A3 AND CD33 | 0.939759036 | 0.947368421 | 0.932270916 |
| MLANA AND NOT-MRLN | 1 | 1 | 1 | CD33 AND NOT-CD28 | 0.911591356 | 0.899224806 | 0.924302789 |
| MLANA AND MLANA | 1 | 1 | 1 | CD33 AND NOT-FCRL3 | 0.903474903 | 0.876404494 | 0.932270916 |
| MLANA AND NOT-SMLR1 | 1 | 1 | 1 | CD33 AND NOT-SEMA4B | 0.909090909 | 0.901960784 | 0.916334661 |
| NPC1 AND NOT-SMLR1 | 1 | 1 | 1 | NOT-FLT3 AND FLT3 | 0.935222672 | 0.950617284 | 0.920318725 |
| MLANA AND TMEM178B | 1 | 1 | 1 | CD33 AND NOT-MGAT5 | 0.929166667 | 0.973799127 | 0.888446215 |
| MLANA AND MLANA | 1 | 1 | 1 | CD33 AND NOT-CASD1 | 0.905511811 | 0.894941634 | 0.916334661 |
| NOT-CHRNA2 AND 100507547? | 1 | 1 | 1 | CD33 AND NOT-MGAT4A | 0.931726908 | 0.939271255 | 0.924302789 |
| MLANA AND 100507547? | 1 | 1 | 1 | CD33 AND NOT-DPP4 | 0.935222672 | 0.950617284 | 0.920318725 |
| MLANA AND MLANA | 1 | 1 | 1 | CD33 AND NOT-FCMR | 0.909090909 | 0.883458647 | 0.93625498 |
| MLANA AND UBA2 | 1 | 1 | 1 | CD33 AND NOT-PAG1 | 0.906560636 | 0.904761905 | 0.908366534 |
| FDPS AND ABCC5 | 1 | 1 | 1 | CD33 AND NOT-KLRD1 | 0.900383142 | 0.867158672 | 0.93625498 |
| MLANA AND ABCC5 | 1 | 1 | 1 | CD33 AND NOT-RARRES3 | 0.932790224 | 0.954166667 | 0.912350598 |

FIG. 1 (CONT.)

| Antigen Pair Logic | F1 | Precision | Recall | Antigen Pair Logic | F1 | Precision | Recall |
|---|---|---|---|---|---|---|---|
| NPC1 AND ABCC5 | 1 | 1 | 1 | CD33 AND NOT-BTN3A1 | 0.919765166 | 0.903846154 | 0.93625498 |
| FDPS AND ABCB6 | 1 | 1 | 1 | CD33 AND NOT-FCRLA | 0.901353965 | 0.87593985 | 0.928286853 |
| CLCN5 AND NOT-CDH7 | 1 | 1 | 1 | CD33 AND NOT-PTCH1 | 0.918811881 | 0.913385827 | 0.924302789 |
| FDPS AND NOT-CDH7 | 1 | 1 | 1 | CD33 AND NOT-GLCCI1 | 0.908730159 | 0.90513834 | 0.912350598 |
| MLANA AND NOT-CDH7 | 1 | 1 | 1 | CD33 AND NOT-GPR171 | 0.917835671 | 0.923387097 | 0.912350598 |
| FDPS AND NOT-ABCC9 | 1 | 1 | 1 | CD33 AND NOT-C12orf49 | 0.909803922 | 0.895752896 | 0.924302789 |
| MLANA AND NOT-ABCC9 | 1 | 1 | 1 | CD33 AND NOT-KMO | 0.903474903 | 0.876404494 | 0.932270916 |
| MLANA AND SCAMP2 | 1 | 1 | 1 | CD33 AND NOT-MFAP3L | 0.91015625 | 0.892720307 | 0.928286853 |
| MLANA AND SCAMP3 | 1 | 1 | 1 | CD33 AND NOT-LPAR5 | 0.901734104 | 0.873134328 | 0.932270916 |
| FDPS AND NOT-MUC12 | 1 | 1 | 1 | CD33 AND NOT-BTLA | 0.906976744 | 0.883018868 | 0.932270916 |
| MLANA AND NOT-MUC12 | 1 | 1 | 1 | CD33 AND NOT-PTGDR | 0.912280702 | 0.893129771 | 0.932270916 |
| MLANA AND NOT-PTPRU | 1 | 1 | 1 | CD33 AND NOT-BTN2A2 | 0.928286853 | 0.928286853 | 0.928286853 |
| MLANA AND MLANA | 1 | 1 | 1 | CD33 AND NOT-SLC17A5 | 0.901574803 | 0.891050584 | 0.912350598 |
| MLANA AND MLANA | 1 | 1 | 1 | CD33 AND NOT-EPHA4 | 0.927021696 | 0.91796875 | 0.93625498 |
| NPC1 AND ATP9A | 1 | 1 | 1 | CD33 AND NOT-MINOS1 | 0.934693878 | 0.958158996 | 0.912350598 |
| MLANA AND MLANA | 1 | 1 | 1 | NOT-TMCC1 AND CD33 | 0.922131148 | 0.949367089 | 0.896414343 |
| NPC1 AND NOT-CDH9 | 1 | 1 | 1 | CD33 AND NOT-SLC9A9 | 0.90729783 | 0.8984375 | 0.916334661 |
| MLANA AND MLANA | 1 | 1 | 1 | CD33 AND NOT-SLC4A7 | 0.905737705 | 0.932489451 | 0.880478088 |
| NOT-CDH10 AND TLCD1 | 1 | 1 | 1 | CD33 AND NOT-SLC16A7 | 0.905811623 | 0.911290323 | 0.900398406 |
| CLCN5 AND NOT-CDH10 | 1 | 1 | 1 | CD33 AND NOT-CHI3L2 | 0.934131737 | 0.936 | 0.932270916 |
| FDPS AND NOT-CDH10 | 1 | 1 | 1 | CD33 AND NOT-CCR6 | 0.9 | 0.869888476 | 0.932270916 |
| MLANA AND NOT-CDH10 | 1 | 1 | 1 | CD33 AND NOT-KIAA0040 | 0.919765166 | 0.903846154 | 0.93625498 |
| NOT-CDH10 AND SUSD5 | 1 | 1 | 1 | CD33 AND NOT-SGPL1 | 0.909819639 | 0.915322581 | 0.90438247 |
| NOT-CDH10 AND KRT5 | 1 | 1 | 1 | NOT-TGFBR3 AND CD33 | 0.909853249 | 0.960176991 | 0.864541833 |
| NPC1 AND NOT-CDH10 | 1 | 1 | 1 | CD33 AND NOT-SIRPG | 0.901734104 | 0.873134328 | 0.932270916 |
| NOT-CDH10 AND IL20RB | 1 | 1 | 1 | CD33 AND NOT-SMIM14 | 0.919587629 | 0.952991453 | 0.888446215 |
| SLC35E3 AND NOT-CDH10 | 1 | 1 | 1 | CD33 AND NOT-FAM73A | 0.902111324 | 0.87037037 | 0.93625498 |
| NOT-CDH10 AND TYRP1 | 1 | 1 | 1 | CD33 AND NOT-CYP2U1 | 0.917322835 | 0.906614786 | 0.928286853 |
| NOT-CDH10 AND DHRS11 | 1 | 1 | 1 | NOT-VAPB AND CD33 | 0.93592233 | 0.912878788 | 0.960159363 |
| TMEM187 AND NOT-CDH10 | 1 | 1 | 1 | CD33 AND NOT-SP4 | 0.913043478 | 0.905882353 | 0.920318725 |
| NOT-CDH10 AND LY6D | 1 | 1 | 1 | CD33 AND NOT-GAL3ST4 | 0.90797546 | 0.932773109 | 0.884462151 |
| MLANA AND MLANA | 1 | 1 | 1 | CD33 AND NOT-HMOX2 | 0.916666667 | 0.913043478 | 0.920318725 |
| MLANA AND NOT-TSPAN5 | 1 | 1 | 1 | CD33 AND NOT-BTN3A3 | 0.93495935 | 0.954356846 | 0.916334661 |
| MLANA AND TSPAN3 | 1 | 1 | 1 | CD33 AND NOT-TMEM204 | 0.910852713 | 0.886792453 | 0.93625498 |
| MLANA AND NOT-CDH11 | 1 | 1 | 1 | CD33 AND NOT-CD27 | 0.906614786 | 0.885931559 | 0.928286853 |
| MLANA AND NOT-TSPAN2 | 1 | 1 | 1 | CD33 AND NOT-ITPR3 | 0.914396887 | 0.893536122 | 0.93625498 |
| MLANA AND PREB | 1 | 1 | 1 | CD33 AND NOT-AMIGO2 | 0.931451613 | 0.942857143 | 0.920318725 |
| MLANA AND MLANA | 1 | 1 | 1 | CD33 AND NOT-TUBD1 | 0.919449902 | 0.906976744 | 0.932270916 |
| MLANA AND NOT-CLEC3A | 1 | 1 | 1 | CD33 AND NOT-TRAT1 | 0.903846154 | 0.873605948 | 0.93625498 |
| MLANA AND NOT-ADGRG2 | 1 | 1 | 1 | CD33 AND NOT-RHBDD1 | 0.906976744 | 0.883018868 | 0.932270916 |
| CLCN5 AND NOT-CDH16 | 1 | 1 | 1 | CD33 AND NOT-TMEM2 | 0.910505837 | 0.88973384 | 0.932270916 |
| FDPS AND NOT-CDH16 | 1 | 1 | 1 | NOT-PHLDB2 AND CD33 | 0.935420744 | 0.919230769 | 0.952191235 |
| MLANA AND NOT-CDH16 | 1 | 1 | 1 | CD33 AND NOT-SEC62 | 0.905349794 | 0.936170213 | 0.876494024 |
| MLANA AND MLANA | 1 | 1 | 1 | CD33 AND NOT-STX7 | 0.926441352 | 0.924603175 | 0.928286853 |
| MLANA AND MLANA | 1 | 1 | 1 | CD33 AND NOT-AQP3 | 0.904862579 | 0.963963964 | 0.852589641 |
| MLANA AND MLANA | 1 | 1 | 1 | CD33 AND NOT-LRRN3 | 0.926441352 | 0.924603175 | 0.928286853 |
| FDPS AND NOT-CDH17 | 1 | 1 | 1 | CD33 AND NOT-RNF13 | 0.903732809 | 0.891472868 | 0.916334661 |
| MLANA AND NOT-CDH17 | 1 | 1 | 1 | CD33 AND NOT-LRIG1 | 0.939516129 | 0.951020408 | 0.928286853 |
| NPC1 AND NOT-CDH17 | 1 | 1 | 1 | CD33 AND NOT-ANKRD46 | 0.905811623 | 0.911290323 | 0.900398406 |
| MLANA AND NOT-LPAR6 | 1 | 1 | 1 | CD33 AND NOT-MAN1C1 | 0.927966102 | 0.990950226 | 0.87250996 |
| MLANA AND MLANA | 1 | 1 | 1 | CD33 AND SMIM3 | 0.900398406 | 0.900398406 | 0.900398406 |
| MLANA AND NOT-CHST4 | 1 | 1 | 1 | CD33 AND NOT-INPP4A | 0.909090909 | 0.883458647 | 0.93625498 |
| CLCN5 AND NOT-CDH18 | 1 | 1 | 1 | NOT-SPINK2 AND SPINK2 | 0.912863071 | 0.952380952 | 0.876494024 |
| FDPS AND NOT-CDH18 | 1 | 1 | 1 | SLC22A16 AND NOT-PSCA | 0.901574803 | 0.891050584 | 0.912350598 |
| MLANA AND NOT-CDH18 | 1 | 1 | 1 | SMIM24 AND NOT-ERBB3 | 0.906930693 | 0.901574803 | 0.912350598 |
| NPC1 AND NOT-CDH18 | 1 | 1 | 1 | NOT-SPINK2 AND SPINK2 | 0.912863071 | 0.952380952 | 0.876494024 |
| MLANA AND NOT-DHRS9 | 1 | 1 | 1 | SLC22A16 AND NOT-ERBB3 | 0.901574803 | 0.891050584 | 0.912350598 |
| MLANA AND CNIH1 | 1 | 1 | 1 | FUT4 AND NOT-ERBB3 | 0.960474308 | 0.952941176 | 0.96812749 |
| MLANA AND NOT-TENM1 | 1 | 1 | 1 | ELANE AND NOT-ERBB3 | 0.902584493 | 0.900793651 | 0.90438247 |
| MLANA AND NOT-101805491? | 1 | 1 | 1 | NOT-PHLDB2 AND NOT-ERBB3 | 0.903460838 | 0.832214765 | 0.988047809 |
| NPC1 AND NOT-101805491? | 1 | 1 | 1 | NOT-SPINK2 AND SPINK2 | 0.912863071 | 0.952380952 | 0.876494024 |
| NOT-SLC34A2 AND LHFP | 1 | 1 | 1 | SLC22A16 AND NOT-MET | 0.902584493 | 0.900793651 | 0.90438247 |
| NOT-PTH2 AND LHFP | 1 | 1 | 1 | FUT4 AND NOT-MET | 0.952191235 | 0.952191235 | 0.952191235 |
| NOT-CHRNA2 AND LHFP | 1 | 1 | 1 | ELANE AND NOT-MET | 0.906504065 | 0.925311203 | 0.888446215 |
| NOT-CD300LB AND LHFP | 1 | 1 | 1 | LRRC70 AND NOT-AXL | 0.923076923 | 0.9140625 | 0.932270916 |
| NOT-SYT2 AND LHFP | 1 | 1 | 1 | NOT-SPINK2 AND SPINK2 | 0.912863071 | 0.952380952 | 0.876494024 |
| NOT-CLDN7 AND LHFP | 1 | 1 | 1 | SLC22A16 AND NOT-AXL | 0.90872211 | 0.925619835 | 0.892430279 |
| NOT-SLC34A3 AND LHFP | 1 | 1 | 1 | FLT3 AND NOT-AXL | 0.944329897 | 0.978632479 | 0.912350598 |
| NOT-ISM2 AND LHFP | 1 | 1 | 1 | CXCL8 AND NOT-AXL | 0.915254237 | 0.867857143 | 0.96812749 |
| NOT-ZNRF4 AND LHFP | 1 | 1 | 1 | ELANE AND NOT-AXL | 0.918367347 | 0.941422594 | 0.896414343 |
| NOT-CLDN19 AND LHFP | 1 | 1 | 1 | SMIM3 AND NOT-AXL | 0.964143426 | 0.964143426 | 0.964143426 |
| NOT-DNAH10 AND LHFP | 1 | 1 | 1 | NOT-SPINK2 AND SPINK2 | 0.912863071 | 0.952380952 | 0.876494024 |
| NOT-FCN2 AND LHFP | 1 | 1 | 1 | FLT3 AND IL13RA2 | 0.935222672 | 0.950617284 | 0.920318725 |
| FDPS AND LHFP | 1 | 1 | 1 | NOT-SPINK2 AND SPINK2 | 0.912863071 | 0.952380952 | 0.876494024 |
| MLANA AND LHFP | 1 | 1 | 1 | SLC22A16 AND NOT-EPHA2 | 0.901574803 | 0.891050584 | 0.912350598 |
| NOT-CALHM1 AND LHFP | 1 | 1 | 1 | ELANE AND NOT-EPHA2 | 0.908 | 0.911646586 | 0.90438247 |

FIG. 1 (CONT.)

| Antigen Pair Logic | F1 | Precision | Recall | Antigen Pair Logic | F1 | Precision | Recall |
|---|---|---|---|---|---|---|---|
| NOT-GIPR AND LHFP | 1 | 1 | 1 | NOT-SPINK2 AND SPINK2 | 0.912863071 | 0.952380952 | 0.876494024 |
| NOT-CACNG5 AND LHFP | 1 | 1 | 1 | FUT4 AND NOT-GPA33 | 0.956349206 | 0.95256917 | 0.960159363 |
| NOT-GLRA2 AND LHFP | 1 | 1 | 1 | NOT-SPINK2 AND SPINK2 | 0.912863071 | 0.952380952 | 0.876494024 |
| NOT-TMEM150B AND LHFP | 1 | 1 | 1 | NOT-FLT3 AND FLT3 | 0.935222672 | 0.950617284 | 0.920318725 |
| NOT-GRIK5 AND LHFP | 1 | 1 | 1 | NOT-SPINK2 AND SPINK2 | 0.912863071 | 0.952380952 | 0.876494024 |
| NOT-GRPR AND LHFP | 1 | 1 | 1 | SLC22A16 AND NOT-ST8SIA1 | 0.905811623 | 0.911290323 | 0.900398406 |
| NOT-HCRTR1 AND LHFP | 1 | 1 | 1 | CXCL8 AND NOT-ST8SIA1 | 0.912149533 | 0.85915493 | 0.972111554 |
| NOT-TMEM95 AND LHFP | 1 | 1 | 1 | P2RX1 AND NOT-ST8SIA1 | 0.912878788 | 0.870036101 | 0.960159363 |
| NOT-KCNB1 AND LHFP | 1 | 1 | 1 | HBD AND NOT-ST8SIA1 | 0.91221374 | 0.875457875 | 0.952191235 |
| NOT-TEX38 AND LHFP | 1 | 1 | 1 | ELANE AND NOT-ST8SIA1 | 0.9 | 0.903614458 | 0.896414343 |
| NOT-KCNS2 AND LHFP | 1 | 1 | 1 | NOT-SPINK2 AND ALK | 0.912863071 | 0.952380952 | 0.876494024 |
| NOT-ASIC5 AND LHFP | 1 | 1 | 1 | NOT-SPINK2 AND CA9 | 0.912863071 | 0.952380952 | 0.876494024 |
| AUP1 AND LHFP | 1 | 1 | 1 | NOT-HEG1 AND CD70 | 0.900608519 | 0.917355372 | 0.884462151 |
| NOT-AVPR1B AND LHFP | 1 | 1 | 1 | NOT-PFN2 AND CD70 | 0.911439114 | 0.848797251 | 0.984063745 |
| PARL AND LHFP | 1 | 1 | 1 | NOT-SPINK2 AND SPINK2 | 0.912863071 | 0.952380952 | 0.876494024 |
| NOT-GPR137 AND LHFP | 1 | 1 | 1 | NOT-FLT3 AND FLT3 | 0.935222672 | 0.950617284 | 0.920318725 |
| NOT-NMUR2 AND LHFP | 1 | 1 | 1 | NOT-MTUS1 AND CD70 | 0.920222635 | 0.861111111 | 0.988047809 |
| NOT-GJD2 AND LHFP | 1 | 1 | 1 | MS4A3 AND NOT-CD160 | 0.906976744 | 0.883018868 | 0.932270916 |
| NOT-CACNG6 AND LHFP | 1 | 1 | 1 | NOT-PFN2 AND NOT-CD160 | 0.931818182 | 0.888086643 | 0.980079681 |
| NOT-GAL3ST2 AND LHFP | 1 | 1 | 1 | CD33 AND NOT-CD160 | 0.906976744 | 0.883018868 | 0.932270916 |
| NOT-SLC4A1 AND LHFP | 1 | 1 | 1 | NOT-SPINK2 AND SPINK2 | 0.912863071 | 0.952380952 | 0.876494024 |
| NOT-SLC5A5 AND LHFP | 1 | 1 | 1 | FUT4 AND NOT-CD160 | 0.902621723 | 0.851590106 | 0.960159363 |
| NOT-ATCAY AND LHFP | 1 | 1 | 1 | NRROS AND NOT-CD160 | 0.928 | 0.931726908 | 0.924302789 |
| NOT-CAV3 AND LHFP | 1 | 1 | 1 | TSPAN32 AND NOT-CD160 | 0.933333333 | 0.894160584 | 0.976095618 |
| NOT-PTCH2 AND LHFP | 1 | 1 | 1 | HBD AND NOT-CD160 | 0.935672515 | 0.916030534 | 0.956175299 |
| NOT-TM4SF5 AND LHFP | 1 | 1 | 1 | NOT-MTUS1 AND NOT-CD160 | 0.928571429 | 0.879003559 | 0.984063745 |
| NOT-SLC22A8 AND LHFP | 1 | 1 | 1 | TMC8 AND NOT-MS4A1 | 0.910891089 | 0.905511811 | 0.916334661 |
| MLANA AND ALG3 | 1 | 1 | 1 | NOT-PFN2 AND NOT-MS4A1 | 0.95703125 | 0.938697318 | 0.976095618 |
| MLANA AND MLANA | 1 | 1 | 1 | NOT-DIP2C AND NOT-MS4A1 | 0.902752294 | 0.836734694 | 0.980079681 |
| FDPS AND CALCRL | 1 | 1 | 1 | NOT-SPINK2 AND SPINK2 | 0.912863071 | 0.952380952 | 0.876494024 |
| MLANA AND CALCRL | 1 | 1 | 1 | NOT-CADM1 AND NOT-MS4A1 | 0.905950096 | 0.874074074 | 0.940239044 |
| MLANA AND MLANA | 1 | 1 | 1 | NRROS AND NOT-MS4A1 | 0.93902439 | 0.958506224 | 0.920318725 |
| FDPS AND TRIM13 | 1 | 1 | 1 | P2RY8 AND NOT-MS4A1 | 0.918714556 | 0.874100719 | 0.96812749 |
| MLANA AND MLANA | 1 | 1 | 1 | TSPAN32 AND NOT-MS4A1 | 0.926553672 | 0.878571429 | 0.980079681 |
| MLANA AND NOT-ANGPTL7 | 1 | 1 | 1 | NOT-ATP9A AND NOT-MS4A1 | 0.903474903 | 0.876404494 | 0.932270916 |
| FDPS AND KLRG1 | 1 | 1 | 1 | HBD AND NOT-MS4A1 | 0.925143954 | 0.892592593 | 0.960159363 |
| MLANA AND MLANA | 1 | 1 | 1 | NOT-MTUS1 AND NOT-MS4A1 | 0.953488372 | 0.928301887 | 0.980079681 |
| AUP1 AND NOT-KLRG1 | 1 | 1 | 1 | NOT-SPINK2 AND SPINK2 | 0.912863071 | 0.952380952 | 0.876494024 |
| PARL AND NOT-KLRG1 | 1 | 1 | 1 | NOT-SPINK2 AND MSLN | 0.912863071 | 0.952380952 | 0.876494024 |
| MLANA AND MLANA | 1 | 1 | 1 | NOT-SPINK2 AND ITGB3 | 0.912863071 | 0.952380952 | 0.876494024 |
| MLANA AND MLANA | 1 | 1 | 1 | NOT-FAM171A1 AND LRRC70 | 0.935817805 | 0.974137931 | 0.900398406 |
| MLANA AND STX6 | 1 | 1 | 1 | NOT-LRIG1 AND LRRC70 | 0.950298211 | 0.948412698 | 0.952191235 |
| MLANA AND MLANA | 1 | 1 | 1 | NOT-FAM69A AND LRRC70 | 0.938697318 | 0.904059041 | 0.976095618 |
| MLANA AND NOT-MSLN | 1 | 1 | 1 | NOT-PFN2 AND LRRC70 | 0.929791271 | 0.887681159 | 0.976095618 |
| AUP1 AND MSLN | 1 | 1 | 1 | NOT-HEG1 AND LRRC70 | 0.926315789 | 0.982142857 | 0.876494024 |
| MLANA AND NOT-KCNMB2 | 1 | 1 | 1 | NOT-PTPRK AND LRRC70 | 0.951076321 | 0.934615385 | 0.96812749 |
| NPC1 AND NOT-KCNMB2 | 1 | 1 | 1 | NOT-SLC37A3 AND LRRC70 | 0.939334638 | 0.923076923 | 0.956175299 |
| MLANA AND MLANA | 1 | 1 | 1 | LRRC70 AND NOT-AOC3 | 0.944 | 0.947791165 | 0.940239044 |
| NOT-SLC17A2 AND TLCD1 | 1 | 1 | 1 | NOT-PHLDB2 AND LRRC70 | 0.954274354 | 0.952380952 | 0.956175299 |
| MLANA AND NOT-SLC17A2 | 1 | 1 | 1 | NOT-VAPB AND LRRC70 | 0.937984496 | 0.913207547 | 0.964143426 |
| NOT-SLC17A2 AND TNFRSF19 | 1 | 1 | 1 | SMIM3 AND NOT-CDH5 | 0.968 | 0.97188755 | 0.964143426 |
| NOT-SLC17A2 AND TYRP1 | 1 | 1 | 1 | FLT3 AND NOT-MICA | 0.920430108 | 1 | 0.852589641 |
| MLANA AND ABCC4 | 1 | 1 | 1 | FLT3 AND NOT-ABCC5 | 0.946502058 | 0.978723404 | 0.916334661 |
| MLANA AND IGSF6 | 1 | 1 | 1 | TSPAN32 AND NOT-BTN3A3 | 0.936902486 | 0.900735294 | 0.976095618 |
| MLANA AND MLANA | 1 | 1 | 1 | TSPAN32 AND NOT-BTN2A2 | 0.931818182 | 0.888086643 | 0.980079681 |
| MLANA AND NOT-RAMP1 | 1 | 1 | 1 | TSPAN32 AND NOT-BTN3A1 | 0.930581614 | 0.879432624 | 0.988047809 |
| NOT-CD300LB AND ZMPSTE24 | 1 | 1 | 1 | TSPAN32 AND NOT-CHI3L2 | 0.933837429 | 0.888489209 | 0.984063745 |
| NOT-FCN2 AND ZMPSTE24 | 1 | 1 | 1 | TSPAN32 AND NOT-MGAT4A | 0.938931298 | 0.901098901 | 0.980079681 |
| FDPS AND ZMPSTE24 | 1 | 1 | 1 | TSPAN32 AND NOT-CYP2U1 | 0.935361217 | 0.894545455 | 0.980079681 |
| MLANA AND MLANA | 1 | 1 | 1 | TSPAN32 AND NOT-SLAMF6 | 0.927102804 | 0.873239437 | 0.988047809 |
| MLANA AND SIGMAR1 | 1 | 1 | 1 | TSPAN32 AND NOT-FCRL3 | 0.942084942 | 0.913857678 | 0.972111554 |
| MLANA AND MLANA | 1 | 1 | 1 | TSPAN32 AND NOT-CCR6 | 0.926829268 | 0.875886525 | 0.984063745 |
| MLANA AND LILRB2 | 1 | 1 | 1 | TSPAN32 AND NOT-CCR7 | 0.936416185 | 0.906716418 | 0.96812749 |
| MLANA AND NOT-MARCH6 | 1 | 1 | 1 | TSPAN32 AND NOT-CR2 | 0.939163498 | 0.898181818 | 0.984063745 |
| MLANA AND ADAM10 | 1 | 1 | 1 | TSPAN32 AND NOT-GPR155 | 0.955165692 | 0.935114504 | 0.976095618 |
| MLANA AND MLANA | 1 | 1 | 1 | TSPAN32 AND NOT-BTLA | 0.931818182 | 0.888086643 | 0.980079681 |
| FDPS AND NOT-NMUR1 | 1 | 1 | 1 | TSPAN32 AND NOT-IFNLR1 | 0.935606061 | 0.891696751 | 0.984063745 |
| MLANA AND NOT-NMUR1 | 1 | 1 | 1 | TSPAN32 AND NOT-GIMAP1 | 0.928030303 | 0.884476534 | 0.976095618 |
| CLCN5 AND NOT-B3GALT5 | 1 | 1 | 1 | TSPAN32 AND NOT-DPP4 | 0.94049904 | 0.907407407 | 0.976095618 |
| MLANA AND NOT-B3GALT5 | 1 | 1 | 1 | TSPAN32 AND NOT-TIGIT | 0.928571429 | 0.879003559 | 0.984063745 |
| NPC1 AND NOT-B3GALT5 | 1 | 1 | 1 | TSPAN32 AND NOT-EPHA4 | 0.953846154 | 0.921933086 | 0.988047809 |
| MLANA AND NOT-CRISP3 | 1 | 1 | 1 | TSPAN32 AND NOT-TMEM2 | 0.927102804 | 0.873239437 | 0.988047809 |
| FDPS AND NOT-FDPS | 1 | 1 | 1 | TSPAN32 AND NOT-NCR3 | 0.921933086 | 0.864111498 | 0.988047809 |
| MLANA AND MLANA | 1 | 1 | 1 | TSPAN32 AND NOT-LRIG1 | 0.957364341 | 0.932075472 | 0.984063745 |
| AUP1 AND NOT-SIRPB1 | 1 | 1 | 1 | TSPAN32 AND NOT-SIT1 | 0.942748092 | 0.904761905 | 0.984063745 |
| PARL AND NOT-SIRPB1 | 1 | 1 | 1 | TSPAN32 AND NOT-SLC46A3 | 0.941860465 | 0.916981132 | 0.96812749 |

FIG. 1 (CONT.)

| Antigen Pair Logic | F1 | Precision | Recall |
|---|---|---|---|
| MLANA AND TMEM5 | 1 | 1 | 1 |
| CLCN5 AND NOT-CLEC4M | 1 | 1 | 1 |
| FDPS AND NOT-CLEC4M | 1 | 1 | 1 |
| MLANA AND NOT-CLEC4M | 1 | 1 | 1 |
| FDPS AND TLR6 | 1 | 1 | 1 |
| MLANA AND MLANA | 1 | 1 | 1 |
| MLANA AND NOT-PKDREJ | 1 | 1 | 1 |
| MLANA AND NOT-TRDN | 1 | 1 | 1 |
| MLANA AND NOT-ABCA9 | 1 | 1 | 1 |
| PARL AND ABCA9 | 1 | 1 | 1 |
| AUP1 AND ABCA8 | 1 | 1 | 1 |
| PARL AND ABCA8 | 1 | 1 | 1 |
| FDPS AND NOT-CACNG3 | 1 | 1 | 1 |
| MLANA AND NOT-CACNG3 | 1 | 1 | 1 |
| NPC1 AND NOT-CACNG3 | 1 | 1 | 1 |
| CLCN5 AND NOT-CACNG2 | 1 | 1 | 1 |
| FDPS AND NOT-CACNG2 | 1 | 1 | 1 |
| MLANA AND NOT-CACNG2 | 1 | 1 | 1 |
| MLANA AND BTN3A3 | 1 | 1 | 1 |
| MLANA AND BTN2A2 | 1 | 1 | 1 |
| MLANA AND CEPT1 | 1 | 1 | 1 |
| MLANA AND MLANA | 1 | 1 | 1 |
| FDPS AND NDRG1 | 1 | 1 | 1 |
| MLANA AND MLANA | 1 | 1 | 1 |
| FDPS AND PEMT | 1 | 1 | 1 |
| MLANA AND PEMT | 1 | 1 | 1 |
| MLANA AND MLANA | 1 | 1 | 1 |
| MLANA AND NOT-CDS1 | 1 | 1 | 1 |
| AUP1 AND CDS1 | 1 | 1 | 1 |
| MLANA AND NOT-CDSN | 1 | 1 | 1 |
| MLANA AND CDIPT | 1 | 1 | 1 |
| MLANA AND MLANA | 1 | 1 | 1 |
| NOT-PMEL AND TMEM147 | 1 | 1 | 1 |
| MLANA AND LYPLA1 | 1 | 1 | 1 |
| FDPS AND CD52 | 1 | 1 | 1 |
| MLANA AND MLANA | 1 | 1 | 1 |
| NPC1 AND CD52 | 1 | 1 | 1 |
| MLANA AND TIMM17A | 1 | 1 | 1 |
| MLANA AND NOT-LRRN2 | 1 | 1 | 1 |
| NOT-SLC34A2 AND GPNMB | 1 | 1 | 1 |
| NOT-CFTR AND GPNMB | 1 | 1 | 1 |
| NOT-PTH2 AND GPNMB | 1 | 1 | 1 |
| NOT-CHRNA2 AND GPNMB | 1 | 1 | 1 |
| NOT-CD300LB AND GPNMB | 1 | 1 | 1 |
| NOT-SYT2 AND GPNMB | 1 | 1 | 1 |
| NOT-PROKR2 AND GPNMB | 1 | 1 | 1 |
| NOT-CLDN7 AND GPNMB | 1 | 1 | 1 |
| NOT-SLC34A3 AND GPNMB | 1 | 1 | 1 |
| NOT-ISM2 AND GPNMB | 1 | 1 | 1 |
| NOT-ZNRF4 AND GPNMB | 1 | 1 | 1 |
| NOT-CLDN19 AND GPNMB | 1 | 1 | 1 |
| NOT-CYP2A6 AND GPNMB | 1 | 1 | 1 |
| NOT-MFSD6L AND GPNMB | 1 | 1 | 1 |
| NOT-DNAH10 AND GPNMB | 1 | 1 | 1 |
| FDPS AND GPNMB | 1 | 1 | 1 |
| MLANA AND MLANA | 1 | 1 | 1 |
| NOT-FSHR AND GPNMB | 1 | 1 | 1 |
| NOT-CALHM1 AND GPNMB | 1 | 1 | 1 |
| NOT-GIPR AND GPNMB | 1 | 1 | 1 |
| NOT-AMHR2 AND GPNMB | 1 | 1 | 1 |
| NOT-CACNG5 AND GPNMB | 1 | 1 | 1 |
| NOT-CACNG4 AND GPNMB | 1 | 1 | 1 |
| NOT-GLRA2 AND GPNMB | 1 | 1 | 1 |
| NOT-TMEM105 AND GPNMB | 1 | 1 | 1 |
| NOT-TMEM150B AND GPNMB | 1 | 1 | 1 |
| NOT-DNAJC5G AND GPNMB | 1 | 1 | 1 |
| NOT-FFAR2 AND GPNMB | 1 | 1 | 1 |
| NOT-GRIK5 AND GPNMB | 1 | 1 | 1 |
| NOT-GRPR AND GPNMB | 1 | 1 | 1 |
| NOT-GUCA2B AND GPNMB | 1 | 1 | 1 |
| NOT-HCRTR1 AND GPNMB | 1 | 1 | 1 |
| NOT-HTR4 AND GPNMB | 1 | 1 | 1 |
| NOT-TMEM95 AND GPNMB | 1 | 1 | 1 |
| NOT-KCNB1 AND GPNMB | 1 | 1 | 1 |
| NOT-TEX38 AND GPNMB | 1 | 1 | 1 |
| NOT-KCNS2 AND GPNMB | 1 | 1 | 1 |

| Antigen Pair Logic | F1 | Precision | Recall |
|---|---|---|---|
| TSPAN32 AND NOT-CLEC2D | 0.923364486 | 0.86971831 | 0.984063745 |
| TSPAN32 AND NOT-GPR171 | 0.931558935 | 0.890909091 | 0.976095618 |
| TSPAN32 AND NOT-HLA-DOB | 0.942965779 | 0.901818182 | 0.988047809 |
| TSPAN32 AND NOT-VSIG1 | 0.930581614 | 0.879432624 | 0.988047809 |
| TSPAN32 AND NOT-IL7R | 0.937142857 | 0.897810219 | 0.980079681 |
| TSPAN32 AND CXCL8 | 0.931558935 | 0.890909091 | 0.976095618 |
| TSPAN32 AND NOT-KLRD1 | 0.934086629 | 0.885714286 | 0.988047809 |
| NOT-FAM69A AND TSPAN32 | 0.970873786 | 0.946969697 | 0.996015936 |
| TSPAN32 AND NOT-MGAT5 | 0.959064327 | 0.938931298 | 0.980079681 |
| TSPAN32 AND NOT-MINOS1 | 0.95481336 | 0.941860465 | 0.96812749 |
| TSPAN32 AND NOT-NT5E | 0.934362934 | 0.906367041 | 0.964143426 |
| TSPAN32 AND NOT-IL21R | 0.942528736 | 0.907749077 | 0.980079681 |
| TSPAN32 AND NOT-TRAT1 | 0.929791271 | 0.887681159 | 0.976095618 |
| TSPAN32 AND NOT-TUBD1 | 0.955165692 | 0.935114504 | 0.976095618 |
| TSPAN32 AND NOT-FAM134B | 0.957746479 | 0.967479675 | 0.948207171 |
| TSPAN32 AND NOT-LRRN3 | 0.942307692 | 0.910780669 | 0.976095618 |
| TSPAN32 AND NOT-TMEM140 | 0.942574257 | 0.937007874 | 0.948207171 |
| TSPAN32 AND NOT-SYNJ2BP | 0.92952381 | 0.890510949 | 0.972111554 |
| TSPAN32 AND NOT-SIRPG | 0.935361217 | 0.894545455 | 0.980079681 |
| TSPAN32 AND NOT-LPAR5 | 0.930320151 | 0.882142857 | 0.984063745 |
| TSPAN32 AND NOT-SLC44A2 | 0.950884086 | 0.937984496 | 0.964143426 |
| TSPAN32 AND NOT-PTGDR | 0.939163498 | 0.898181818 | 0.984063745 |
| TSPAN32 AND NOT-SLAMF7 | 0.947162427 | 0.930769231 | 0.964143426 |
| TSPAN32 AND NOT-TNFRSF17 | 0.936170213 | 0.909774436 | 0.964143426 |
| TSPAN32 AND NOT-SCN3A | 0.929791271 | 0.887681159 | 0.976095618 |
| TSPAN32 AND NOT-BMPR2 | 0.944664032 | 0.937254902 | 0.952191235 |
| TSPAN32 AND NOT-SP4 | 0.938697318 | 0.904059041 | 0.976095618 |
| TSPAN32 AND SPINK2 | 0.930526316 | 0.986607143 | 0.880478088 |
| TSPAN32 AND NOT-TTC13 | 0.931558935 | 0.890909091 | 0.976095618 |
| TSPAN32 AND NOT-STEAP4 | 0.942574257 | 0.937007874 | 0.948207171 |
| TSPAN32 AND NOT-FCRL5 | 0.930056711 | 0.884892086 | 0.980079681 |
| TSPAN32 AND NOT-SLC37A3 | 0.956175299 | 0.956175299 | 0.956175299 |
| TSPAN32 AND NOT-FCRLA | 0.94026975 | 0.910447761 | 0.972111554 |
| TSPAN32 AND NOT-ADTRP | 0.932330827 | 0.882562278 | 0.988047809 |
| TSPAN32 AND NOT-LRCH3 | 0.935606061 | 0.891696751 | 0.984063745 |
| TSPAN32 AND SMIM3 | 0.954455446 | 0.948818898 | 0.960159363 |
| TSPAN32 AND NOT-CDC14B | 0.926829268 | 0.875886625 | 0.984063745 |
| TSPAN32 AND NOT-KMO | 0.930320151 | 0.882142857 | 0.984063745 |
| TSPAN32 AND NOT-ADAM19 | 0.936902486 | 0.900735294 | 0.976095618 |
| TSPAN32 AND NOT-ST3GAL5 | 0.9348659 | 0.900369004 | 0.972111554 |
| NOT-PHLDB2 AND TSPAN32 | 0.957364341 | 0.932075472 | 0.984063745 |
| TSPAN32 AND NOT-FCMR | 0.946564885 | 0.908424908 | 0.988047809 |
| TSPAN32 AND NOT-VAPB | 0.939393939 | 0.895306859 | 0.988047809 |
| TSPAN32 AND NOT-CD8B | 0.926553672 | 0.878571429 | 0.980079681 |
| TSPAN32 AND NOT-MS4A1 | 0.926553672 | 0.878571429 | 0.980079681 |
| TSPAN32 AND NOT-CD22 | 0.931818182 | 0.888086643 | 0.980079681 |
| TSPAN32 AND NOT-KIAA0040 | 0.921933086 | 0.864111498 | 0.988047809 |
| TSPAN32 AND NOT-CD72 | 0.936660269 | 0.903703704 | 0.972111554 |
| TSPAN32 AND NOT-ARMCX2 | 0.938931298 | 0.901098901 | 0.980079681 |
| NOT-ATP9A AND FUT4 | 0.951417004 | 0.967078189 | 0.93625498 |
| FUT4 AND NOT-TSPAN3 | 0.960474308 | 0.952941176 | 0.96812749 |
| CXCL8 AND NOT-CDH11 | 0.925373134 | 0.870175439 | 0.988047809 |
| SMIM3 AND NOT-CDH11 | 0.942084942 | 0.913857678 | 0.972111554 |
| FUT4 AND NOT-TSPAN1 | 0.960474308 | 0.952941176 | 0.96812749 |
| FLT3 AND NOT-PREB | 0.916129032 | 0.995327103 | 0.848605578 |
| FUT4 AND NOT-CDH17 | 0.960474308 | 0.952941176 | 0.96812749 |
| FLT3 AND NOT-LHFP | 0.948665298 | 0.978813559 | 0.920318725 |
| SMIM3 AND NOT-LHFP | 0.949019608 | 0.934362934 | 0.964143426 |
| FUT4 AND NOT-MPZL2 | 0.961770624 | 0.971544715 | 0.952191235 |
| FUT4 AND NOT-TRIM13 | 0.95 | 0.995633188 | 0.908366534 |
| FUT4 AND NOT-GPA33 | 0.956349206 | 0.95256917 | 0.960159363 |
| NOT-LRIG1 AND MFSD10 | 0.934615385 | 0.903345725 | 0.96812749 |
| NOT-VAPB AND MFSD10 | 0.92481203 | 0.87544484 | 0.980079681 |
| NOT-ARMCX2 AND MFSD10 | 0.936660269 | 0.903703704 | 0.972111554 |
| FLT3 AND NOT-COQ7 | 0.948665298 | 0.978813559 | 0.920318725 |
| FUT4 AND NOT-COQ7 | 0.954091816 | 0.956 | 0.952191235 |
| FUT4 AND NOT-PRSS16 | 0.960474308 | 0.952941176 | 0.96812749 |
| FLT3 AND NOT-BET1 | 0.943157895 | 1 | 0.892430279 |
| FUT4 AND NOT-BET1 | 0.95257732 | 0.987179487 | 0.920318725 |
| FLT3 AND NOT-TMEM5 | 0.943632568 | 0.99122807 | 0.900398406 |
| FUT4 AND NOT-B3GNT3 | 0.960474308 | 0.952941176 | 0.96812749 |
| FUT4 AND NOT-ABCA8 | 0.961923848 | 0.967741935 | 0.956175299 |
| NOT-FAM69A AND NOT-ABCA8 | 0.955684008 | 0.925373134 | 0.988047809 |
| HCST AND NOT-BTN3A3 | 0.941860465 | 0.916981132 | 0.96812749 |
| HBD AND NOT-BTN3A3 | 0.945525292 | 0.923954373 | 0.96812749 |
| NRROS AND NOT-BTN3A3 | 0.944785276 | 0.970588235 | 0.920318725 |

FIG. 1 (CONT.)

| Antigen Pair Logic | F1 | Precision | Recall | Antigen Pair Logic | F1 | Precision | Recall |
|---|---|---|---|---|---|---|---|
| NOT-MUC3A AND GPNMB | 1 | 1 | 1 | NOT-PFN2 AND NOT-BTN3A3 | 0.92393321 | 0.864583333 | 0.992031873 |
| NPC1 AND GPNMB | 1 | 1 | 1 | HCST AND NOT-BTN2A2 | 0.928301887 | 0.88172043 | 0.980079681 |
| NOT-ASIC5 AND GPNMB | 1 | 1 | 1 | FLT3 AND NOT-BTN2A2 | 0.956340956 | 1 | 0.916334661 |
| AUP1 AND GPNMB | 1 | 1 | 1 | P2RY8 AND NOT-BTN2A2 | 0.944123314 | 0.914179104 | 0.976095618 |
| NOT-AVPR1B AND GPNMB | 1 | 1 | 1 | HBD AND NOT-BTN2A2 | 0.937743191 | 0.91634981 | 0.960159363 |
| PARL AND GPNMB | 1 | 1 | 1 | P2RX1 AND NOT-BTN2A2 | 0.941860465 | 0.916981132 | 0.96812749 |
| NOT-PCDHA10 AND GPNMB | 1 | 1 | 1 | NOT-PFN2 AND NOT-BTN2A2 | 0.95 | 0.918215613 | 0.984063745 |
| NOT-GPR137 AND GPNMB | 1 | 1 | 1 | FXYD5 AND NOT-BTN2A2 | 0.922222222 | 0.861591696 | 0.992031873 |
| NOT-NMUR2 AND GPNMB | 1 | 1 | 1 | NOT-MTUS1 AND NOT-BTN2A2 | 0.96124031 | 0.935849057 | 0.988047809 |
| NOT-GJD2 AND GPNMB | 1 | 1 | 1 | FLT3 AND NOT-CEPT1 | 0.950413223 | 0.987124464 | 0.916334661 |
| NOT-LRFN2 AND GPNMB | 1 | 1 | 1 | FUT4 AND NOT-CDS1 | 0.960474308 | 0.952941176 | 0.96812749 |
| NOT-CACNG6 AND GPNMB | 1 | 1 | 1 | FLT3 AND NOT-CDSN | 0.940936864 | 0.9625 | 0.920318725 |
| NOT-GAL3ST2 AND GPNMB | 1 | 1 | 1 | FLT3 AND NOT-PGRMC2 | 0.938689218 | 1 | 0.884462151 |
| NOT-SLC4A1 AND GPNMB | 1 | 1 | 1 | FUT4 AND NOT-PGRMC2 | 0.933884298 | 0.969957082 | 0.900398406 |
| NOT-SLC5A5 AND GPNMB | 1 | 1 | 1 | FLT3 AND NOT-TIMM17A | 0.944785276 | 0.970588235 | 0.920318725 |
| NOT-RTP3 AND GPNMB | 1 | 1 | 1 | FLT3 AND NOT-N4BP2L2 | 0.939958592 | 0.978448276 | 0.90438247 |
| NOT-ATCAY AND GPNMB | 1 | 1 | 1 | FLT3 AND NOT-GPNMB | 0.928870293 | 0.977973568 | 0.884462151 |
| NOT-CAV3 AND GPNMB | 1 | 1 | 1 | FUT4 AND NOT-GPNMB | 0.934156379 | 0.965957447 | 0.90438247 |
| NOT-PTCH2 AND GPNMB | 1 | 1 | 1 | FLT3 AND NOT-SLC25A17 | 0.944785276 | 0.970588235 | 0.920318725 |
| GPNMB AND NOT-MARCO | 1 | 1 | 1 | FUT4 AND NOT-SEMA4B | 0.963709677 | 0.975510204 | 0.952191235 |
| NOT-TM4SF5 AND GPNMB | 1 | 1 | 1 | P2RX1 AND NOT-SEMA4B | 0.954274354 | 0.952380952 | 0.956175299 |
| NOT-SLC22A8 AND GPNMB | 1 | 1 | 1 | SMIM3 AND NOT-PROCR | 0.942386831 | 0.974468085 | 0.912350598 |
| GPNMB AND NOT-OTOF | 1 | 1 | 1 | FLT3 AND NOT-HTATIP2 | 0.920770878 | 0.99537037 | 0.856573705 |
| MLANA AND MLANA | 1 | 1 | 1 | FLT3 AND NOT-POM121 | 0.940936864 | 0.9625 | 0.920318725 |
| MLANA AND NOT-CLEC10A | 1 | 1 | 1 | NOT-ANKRD46 AND ERLIN1 | 0.940206186 | 0.974358974 | 0.908366534 |
| FDPS AND SLC30A9 | 1 | 1 | 1 | NOT-TMTC3 AND ERLIN1 | 0.946280992 | 0.982832618 | 0.912350598 |
| MLANA AND MLANA | 1 | 1 | 1 | NOT-TMCC1 AND ERLIN1 | 0.931106472 | 0.978070175 | 0.888446215 |
| NOT-FCN2 AND SLC9A6 | 1 | 1 | 1 | NOT-HEG1 AND ERLIN1 | 0.933054393 | 0.982378855 | 0.888446215 |
| FDPS AND SLC9A6 | 1 | 1 | 1 | NOT-PHLDB2 AND ERLIN1 | 0.958742633 | 0.945736434 | 0.972111554 |
| MLANA AND SLC9A6 | 1 | 1 | 1 | NOT-HEG1 AND TNFSF13B | 0.919491525 | 0.981900452 | 0.864541833 |
| MLANA AND NOT-CLGN | 1 | 1 | 1 | NOT-PHLDB2 AND TNFSF13B | 0.946954813 | 0.934108527 | 0.960159363 |
| MLANA AND MLANA | 1 | 1 | 1 | FLT3 AND NOT-CSPG5 | 0.940936864 | 0.9625 | 0.920318725 |
| MLANA AND CRTAP | 1 | 1 | 1 | FLT3 AND NOT-VAMP5 | 0.922746781 | 1 | 0.856573705 |
| MLANA AND NOT-SEMA6B | 1 | 1 | 1 | FUT4 AND NOT-CFTR | 0.960474308 | 0.952941176 | 0.96812749 |
| FDPS AND SEMA4B | 1 | 1 | 1 | HCST AND NOT-CHI3L2 | 0.937381404 | 0.894927536 | 0.984063745 |
| MLANA AND SEMA4B | 1 | 1 | 1 | HCST AND NOT-MGAT4A | 0.95256917 | 0.945098039 | 0.960159363 |
| MLANA AND MLANA | 1 | 1 | 1 | HCST AND NOT-CYP2U1 | 0.930056711 | 0.884892086 | 0.980079681 |
| MLANA AND HYOU1 | 1 | 1 | 1 | HCST AND NOT-CMTM8 | 0.938271605 | 0.970212766 | 0.908366534 |
| NOT-CHRNA2 AND PROCR | 1 | 1 | 1 | HCST AND NOT-IFNLR1 | 0.937381404 | 0.894927536 | 0.984063745 |
| NOT-CLDN19 AND PROCR | 1 | 1 | 1 | HCST AND NOT-DPP4 | 0.953125 | 0.9348659 | 0.972111554 |
| FDPS AND PROCR | 1 | 1 | 1 | HCST AND NOT-LPAR1 | 0.933837429 | 0.888489209 | 0.984063745 |
| MLANA AND MLANA | 1 | 1 | 1 | HCST AND NOT-SMIM14 | 0.944 | 0.947791165 | 0.940239044 |
| NOT-TMEM150B AND PROCR | 1 | 1 | 1 | HCST AND NOT-EPHA4 | 0.923364486 | 0.86971831 | 0.984063745 |
| NOT-TMEM95 AND PROCR | 1 | 1 | 1 | NOT-EXT1 AND HCST | 0.940038685 | 0.913533835 | 0.96812749 |
| AUP1 AND PROCR | 1 | 1 | 1 | HCST AND NOT-TMEM2 | 0.953307393 | 0.931558935 | 0.976095618 |
| NOT-AVPR1B AND PROCR | 1 | 1 | 1 | HCST AND NOT-LRIG1 | 0.960784314 | 0.945945946 | 0.976095618 |
| PARL AND PROCR | 1 | 1 | 1 | HCST AND NOT-SLC46A3 | 0.934615385 | 0.903345725 | 0.96812749 |
| NOT-NMUR2 AND PROCR | 1 | 1 | 1 | HCST AND NOT-HMOX2 | 0.92952381 | 0.890510949 | 0.972111554 |
| NOT-TM4SF5 AND PROCR | 1 | 1 | 1 | HCST AND NOT-AMIGO2 | 0.943907157 | 0.917293233 | 0.972111554 |
| MLANA AND PRDX4 | 1 | 1 | 1 | HCST AND NOT-IL7R | 0.935114504 | 0.897435897 | 0.976095618 |
| MLANA AND ARL6IP5 | 1 | 1 | 1 | HCST AND NOT-ITPR3 | 0.934086629 | 0.885714286 | 0.988047809 |
| MLANA AND MLANA | 1 | 1 | 1 | NOT-FAM69A AND HCST | 0.9765625 | 0.957854406 | 0.996015936 |
| MLANA AND AGPAT1 | 1 | 1 | 1 | HCST AND NOT-MINOS1 | 0.949019608 | 0.934362934 | 0.964143426 |
| MLANA AND MLANA | 1 | 1 | 1 | HCST AND NOT-NT5E | 0.936660269 | 0.903703704 | 0.972111554 |
| MLANA AND SLC19A2 | 1 | 1 | 1 | HCST AND NOT-TUBD1 | 0.92481203 | 0.87544484 | 0.980079681 |
| NOT-CAV3 AND SLC19A2 | 1 | 1 | 1 | NOT-PFN2 AND HCST | 0.925650558 | 0.867595819 | 0.992031873 |
| FDPS AND RABAC1 | 1 | 1 | 1 | NOT-FAM134B AND HCST | 0.944664032 | 0.937254902 | 0.952191235 |
| MLANA AND MLANA | 1 | 1 | 1 | HCST AND NOT-TMEM140 | 0.956 | 0.959839357 | 0.952191235 |
| NOT-SLC34A2 AND ADCY6 | 1 | 1 | 1 | HCST AND NOT-MAN1C1 | 0.952772074 | 0.983050847 | 0.924302789 |
| NOT-SLC34A2 AND TLCD1 | 1 | 1 | 1 | HCST AND NOT-SLC44A2 | 0.96 | 0.963855422 | 0.956175299 |
| CLCN5 AND NOT-SLC34A2 | 1 | 1 | 1 | HCST AND NOT-PTCH1 | 0.936902486 | 0.900735294 | 0.976095618 |
| NOT-SLC34A2 AND SLC44A3 | 1 | 1 | 1 | NOT-HEG1 AND HCST | 0.931106472 | 0.978070175 | 0.888446215 |
| NOT-SLC34A2 AND LRRC15 | 1 | 1 | 1 | HCST AND NOT-ENPP5 | 0.935361217 | 0.894545455 | 0.980079681 |
| NOT-SLC34A2 AND APCDD1 | 1 | 1 | 1 | HCST AND NOT-RARRES3 | 0.947162427 | 0.930769231 | 0.964143426 |
| NOT-SLC34A2 AND VSIG10L | 1 | 1 | 1 | HCST AND NOT-RTN1 | 0.939805825 | 0.916666667 | 0.964143426 |
| NOT-SLC34A2 AND PROM2 | 1 | 1 | 1 | HCST AND NOT-BMPR2 | 0.948412698 | 0.944664032 | 0.952191235 |
| NOT-SLC34A2 AND ADRA2A | 1 | 1 | 1 | NOT-TGFBR3 AND HCST | 0.924686192 | 0.973568282 | 0.880478088 |
| NOT-SLC34A2 AND CCDC80 | 1 | 1 | 1 | NOT-WLS AND HCST | 0.936170213 | 0.909774436 | 0.964143426 |
| NOT-SLC34A2 AND DSC3 | 1 | 1 | 1 | NOT-SLC37A3 AND HCST | 0.95481336 | 0.941860465 | 0.96812749 |
| NOT-SLC34A2 AND EFNB2 | 1 | 1 | 1 | HCST AND NOT-ADTRP | 0.940952381 | 0.901459854 | 0.984063745 |
| NOT-SLC34A2 AND ELN | 1 | 1 | 1 | NOT-PHLDB2 AND HCST | 0.96124031 | 0.935849057 | 0.988047809 |
| NOT-SLC34A2 AND ENG | 1 | 1 | 1 | NOT-VAPB AND HCST | 0.92936803 | 0.871080139 | 0.996015936 |
| FDPS AND NOT-SLC34A2 | 1 | 1 | 1 | HCST AND NOT-KIAA0040 | 0.927102804 | 0.873239437 | 0.988047809 |
| MLANA AND NOT-SLC34A2 | 1 | 1 | 1 | HCST AND NOT-ARMCX2 | 0.938931298 | 0.901098901 | 0.980079681 |
| NOT-SLC34A2 AND ABI3BP | 1 | 1 | 1 | FUT4 AND NOT-CEACAM7 | 0.958579882 | 0.94921875 | 0.96812749 |
| NOT-SLC34A2 AND PVRL3 | 1 | 1 | 1 | FLT3 AND NOT-BLCAP | 0.922746781 | 1 | 0.856573705 |

FIG. 1 (CONT.)

| Antigen Pair Logic | F1 | Precision | Recall |
|---|---|---|---|
| NOT-SLC34A2 AND GJA1 | 1 | 1 | 1 |
| NOT-SLC34A2 AND DLL1 | 1 | 1 | 1 |
| NOT-SLC34A2 AND IFI27 | 1 | 1 | 1 |
| NOT-SLC34A2 AND ITGA2 | 1 | 1 | 1 |
| NOT-SLC34A2 AND JAG2 | 1 | 1 | 1 |
| NOT-SLC34A2 AND KDR | 1 | 1 | 1 |
| NOT-SLC34A2 AND SAMD5 | 1 | 1 | 1 |
| NOT-SLC34A2 AND ATP1A1 | 1 | 1 | 1 |
| NPC1 AND NOT-SLC34A2 | 1 | 1 | 1 |
| NOT-SLC34A2 AND CDON | 1 | 1 | 1 |
| NOT-SLC34A2 AND PDGFRA | 1 | 1 | 1 |
| NOT-SLC34A2 AND ENPP2 | 1 | 1 | 1 |
| NOT-SLC34A2 AND PMP22 | 1 | 1 | 1 |
| NOT-SLC34A2 AND IL20RB | 1 | 1 | 1 |
| NOT-SLC34A2 AND SLC47A1 | 1 | 1 | 1 |
| NOT-SLC34A2 AND LGR4 | 1 | 1 | 1 |
| NOT-SLC34A2 AND SLC35E3 | 1 | 1 | 1 |
| NOT-SLC34A2 AND PCDHB14 | 1 | 1 | 1 |
| NOT-SLC34A2 AND GKN1 | 1 | 1 | 1 |
| NOT-SLC34A2 AND NTN4 | 1 | 1 | 1 |
| NOT-SLC34A2 AND SORT1 | 1 | 1 | 1 |
| NOT-SLC34A2 AND PERP | 1 | 1 | 1 |
| NOT-SLC34A2 AND SGCB | 1 | 1 | 1 |
| NOT-SLC34A2 AND SLC7A2 | 1 | 1 | 1 |
| NOT-SLC34A2 AND TPBG | 1 | 1 | 1 |
| NOT-SLC34A2 AND TYRP1 | 1 | 1 | 1 |
| NOT-SLC34A2 AND COL14A1 | 1 | 1 | 1 |
| NOT-SLC34A2 AND VCAM1 | 1 | 1 | 1 |
| NOT-SLC34A2 AND DHRS11 | 1 | 1 | 1 |
| NOT-SLC34A2 AND TMEM231 | 1 | 1 | 1 |
| NOT-SLC34A2 AND WLS | 1 | 1 | 1 |
| NOT-SLC34A2 AND PIGZ | 1 | 1 | 1 |
| TMEM187 AND NOT-SLC34A2 | 1 | 1 | 1 |
| NOT-SLC34A2 AND ZNRF3 | 1 | 1 | 1 |
| NOT-SLC34A2 AND LY6D | 1 | 1 | 1 |
| NOT-SLC34A2 AND OSMR | 1 | 1 | 1 |
| NOT-SLC34A2 AND DSEL | 1 | 1 | 1 |
| NOT-SLC34A2 AND REEP6 | 1 | 1 | 1 |
| NOT-SLC34A2 AND CLCA2 | 1 | 1 | 1 |
| NOT-SLC34A2 AND LPPR4 | 1 | 1 | 1 |
| MLANA AND IFITM2 | 1 | 1 | 1 |
| FDPS AND NOT-POMT1 | 1 | 1 | 1 |
| MLANA AND MLANA | 1 | 1 | 1 |
| MLANA AND NOT-SLCO1B1 | 1 | 1 | 1 |
| NOT-CHRNA2 AND ST6GALNAC2 | 1 | 1 | 1 |
| MLANA AND ST6GALNAC2 | 1 | 1 | 1 |
| NPC1 AND ST6GALNAC2 | 1 | 1 | 1 |
| AUP1 AND ST6GALNAC2 | 1 | 1 | 1 |
| PARL AND ST6GALNAC2 | 1 | 1 | 1 |
| MLANA AND ERLIN1 | 1 | 1 | 1 |
| FDPS AND TGOLN2 | 1 | 1 | 1 |
| MLANA AND MLANA | 1 | 1 | 1 |
| MLANA AND MLANA | 1 | 1 | 1 |
| FDPS AND DMRT2 | 1 | 1 | 1 |
| MLANA AND MLANA | 1 | 1 | 1 |
| FDPS AND CXCR6 | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| NOT-MLANA AND CGRRF1 | 1 | 1 | 1 |
| MLANA AND MLANA | 1 | 1 | 1 |
| NOT-CHRNA2 AND CSPG5 | 1 | 1 | 1 |
| MLANA AND MLANA | 1 | 1 | 1 |
| NPC1 AND CSPG5 | 1 | 1 | 1 |
| AUP1 AND CSPG5 | 1 | 1 | 1 |
| MLANA AND MLANA | 1 | 1 | 1 |
| MLANA AND EBP | 1 | 1 | 1 |
| MLANA AND MLANA | 1 | 1 | 1 |
| CLCN5 AND NOT-CLDN16 | 1 | 1 | 1 |
| FDPS AND NOT-CLDN16 | 1 | 1 | 1 |
| MLANA AND NOT-CLDN16 | 1 | 1 | 1 |
| FDPS AND NOT-FUT9 | 1 | 1 | 1 |
| MLANA AND NOT-FUT9 | 1 | 1 | 1 |
| FDPS AND NOT-RRH | 1 | 1 | 1 |
| MLANA AND NOT-RRH | 1 | 1 | 1 |
| MLANA AND NOT-CORIN | 1 | 1 | 1 |

| Antigen Pair Logic | F1 | Precision | Recall |
|---|---|---|---|
| FUT4 AND NOT-BLCAP | 0.922105263 | 0.977678571 | 0.87250996 |
| FUT4 AND NOT-BTNL3 | 0.960474308 | 0.952941176 | 0.96812749 |
| FLT3 AND NOT-AFG3L2 | 0.926315789 | 0.982142857 | 0.876494024 |
| FUT4 AND NOT-AFG3L2 | 0.940206186 | 0.974358974 | 0.908366534 |
| FLT3 AND NOT-LMAN2 | 0.906318083 | 1 | 0.828685259 |
| FLT3 AND NOT-UQCR11 | 0.95257732 | 0.987179487 | 0.920318725 |
| FUT4 AND NOT-UQCR11 | 0.950819672 | 0.978902954 | 0.924302789 |
| FUT4 AND NOT-ILVBL | 0.948616601 | 0.941176471 | 0.956175299 |
| FUT4 AND NOT-NAT2 | 0.960474308 | 0.952941176 | 0.96812749 |
| NOT-FAM69A AND GLIPR1 | 0.935114504 | 0.897435897 | 0.976095618 |
| FLT3 AND NOT-KDELR2 | 0.948240166 | 0.987068966 | 0.912350598 |
| FUT4 AND NOT-KDELR2 | 0.960985626 | 0.991525424 | 0.932270916 |
| FUT4 AND NOT-KDELR3 | 0.964143426 | 0.964143426 | 0.964143426 |
| SMIM3 AND NOT-KDELR3 | 0.938223938 | 0.91011236 | 0.96812749 |
| FLT3 AND NOT-TDRKH | 0.950617284 | 0.982978723 | 0.920318725 |
| FLT3 AND NOT-B4GAT1 | 0.935550936 | 0.97826087 | 0.896414343 |
| FLT3 AND NOT-SLC35D2 | 0.937759336 | 0.978354978 | 0.900398406 |
| FUT4 AND NOT-CACFD1 | 0.956349206 | 0.95256917 | 0.960159363 |
| NRROS AND NOT-BTN3A2 | 0.934156379 | 0.965957447 | 0.90438247 |
| P2RY8 AND NOT-BTN3A1 | 0.935361217 | 0.894545455 | 0.980079681 |
| HBD AND NOT-BTN3A1 | 0.932821497 | 0.9 | 0.96812749 |
| NRROS AND NOT-BTN3A1 | 0.947368421 | 0.962962963 | 0.932270916 |
| NOT-PFN2 AND NOT-BTN3A1 | 0.939622642 | 0.892473118 | 0.992031873 |
| P2RX1 AND NOT-BTN2A1 | 0.932821497 | 0.9 | 0.96812749 |
| FUT4 AND NOT-HHLA2 | 0.960474308 | 0.952941176 | 0.96812749 |
| NOT-DIP2C AND NOT-CHI3L2 | 0.918819188 | 0.855670103 | 0.992031873 |
| P2RY8 AND NOT-CHI3L2 | 0.935361217 | 0.894545455 | 0.980079681 |
| HBD AND NOT-CHI3L2 | 0.947368421 | 0.927480916 | 0.96812749 |
| P2RX1 AND NOT-CHI3L2 | 0.938461538 | 0.907063197 | 0.972111554 |
| NOT-PFN2 AND NOT-CHI3L2 | 0.953846154 | 0.921933086 | 0.988047809 |
| FXYD5 AND NOT-CHI3L2 | 0.931098696 | 0.874125874 | 0.996015936 |
| NOT-NDRG2 AND NOT-CHI3L2 | 0.929791271 | 0.887681159 | 0.976095618 |
| NOT-MTUS1 AND NOT-CHI3L2 | 0.957692308 | 0.925650558 | 0.992031873 |
| NOT-PTPRK AND NOT-CHI3L2 | 0.930841121 | 0.876760563 | 0.992031873 |
| NOT-FAM69A AND RNF139 | 0.943609023 | 0.893238434 | 1 |
| NOT-PFN2 AND RNF24 | 0.939622642 | 0.892473118 | 0.992031873 |
| NOT-DDR1 AND RNF24 | 0.930056711 | 0.884892086 | 0.980079681 |
| FLT3 AND NOT-GPR176 | 0.940936864 | 0.9625 | 0.920318725 |
| FUT4 AND NOT-MRAP2 | 0.960474308 | 0.952941176 | 0.96812749 |
| NOT-FAM69A AND CMTM7 | 0.935361217 | 0.894545455 | 0.980079681 |
| NOT-FAM69A AND NRM | 0.962962963 | 0.942748092 | 0.984063745 |
| NOT-PTPRK AND NRM | 0.928301887 | 0.88172043 | 0.980079681 |
| NOT-PHLDB2 AND NRM | 0.9348659 | 0.900369004 | 0.972111554 |
| FLT3 AND NOT-CHRM3 | 0.940936864 | 0.9625 | 0.920318725 |
| FUT4 AND NOT-MGAT4A | 0.973947896 | 0.97983871 | 0.96812749 |
| NOT-PFN2 AND NOT-MGAT4A | 0.930320151 | 0.882142857 | 0.984063745 |
| FLT3 AND NOT-SCRG1 | 0.940936864 | 0.9625 | 0.920318725 |
| FUT4 AND NOT-TMEM54 | 0.960474308 | 0.952941176 | 0.96812749 |
| FLT3 AND NOT-CYP2U1 | 0.952380952 | 0.99137931 | 0.916334661 |
| FUT4 AND NOT-CYP2U1 | 0.958250497 | 0.956349206 | 0.960159363 |
| CXCL8 AND NOT-CYP2U1 | 0.933837429 | 0.888489209 | 0.984063745 |
| P2RX1 AND NOT-CYP2U1 | 0.945525292 | 0.923954373 | 0.96812749 |
| FUT4 AND NOT-SLC2A13 | 0.957746479 | 0.967479675 | 0.948207171 |
| FUT4 AND NOT-MAL2 | 0.960474308 | 0.952941176 | 0.96812749 |
| FLT3 AND NOT-XKR4 | 0.940936864 | 0.9625 | 0.920318725 |
| FLT3 AND NOT-TMEM200A | 0.946058091 | 0.987012987 | 0.908366534 |
| FUT4 AND NOT-TMEM200A | 0.96 | 0.963855422 | 0.956175299 |
| FUT4 AND NOT-MARCH3 | 0.944785276 | 0.970588235 | 0.920318725 |
| NOT-PFN2 AND NOT-FCRL1 | 0.956349206 | 0.95256917 | 0.960159363 |
| NOT-PFN2 AND NOT-FCRL3 | 0.960629921 | 0.949416342 | 0.972111554 |
| NOT-MTUS1 AND NOT-FCRL3 | 0.968503937 | 0.957198444 | 0.980079681 |
| FLT3 AND NOT-LYSMD3 | 0.950617284 | 0.982978723 | 0.920318725 |
| FUT4 AND NOT-LYSMD3 | 0.943469786 | 0.923664122 | 0.964143426 |
| FLT3 AND NOT-CYYR1 | 0.931106472 | 0.978070175 | 0.888446215 |
| SMIM3 AND NOT-TM4SF18 | 0.962376238 | 0.956692913 | 0.96812749 |
| SMIM3 AND NOT-MRGPRF | 0.954990215 | 0.938461538 | 0.972111554 |
| FUT4 AND NOT-SLC18B1 | 0.913793103 | 0.995305164 | 0.844621514 |
| P2RX1 AND NOT-SLC18B1 | 0.914893617 | 0.98173516 | 0.856573705 |
| FLT3 AND NOT-SLC16A10 | 0.946502058 | 0.978723404 | 0.916334661 |
| FUT4 AND NOT-CLCN3 | 0.973843058 | 0.983739837 | 0.964143426 |
| FUT4 AND NOT-COMTD1 | 0.956521739 | 0.949019608 | 0.964143426 |
| FUT4 AND NOT-CLRN3 | 0.960474308 | 0.952941176 | 0.96812749 |
| FLT3 AND NOT-CPXM2 | 0.948665298 | 0.978813559 | 0.920318725 |
| FUT4 AND NOT-TMEM45B | 0.960474308 | 0.952941176 | 0.96812749 |
| FLT3 AND NOT-CLN5 | 0.950207469 | 0.991341991 | 0.912350598 |
| FUT4 AND NOT-NXPE1 | 0.958579882 | 0.94921875 | 0.96812749 |

FIG. 1 (CONT.)

| Antigen Pair Logic | F1 | Precision | Recall |
|---|---|---|---|
| MLANA AND NRG3 | 1 | 1 | 1 |
| MLANA AND MLANA | 1 | 1 | 1 |
| NOT-MLANA AND NUDC | 1 | 1 | 1 |
| NOT-PMEL AND NUDC | 1 | 1 | 1 |
| FDPS AND NOT-YME1L1 | 1 | 1 | 1 |
| MLANA AND MLANA | 1 | 1 | 1 |
| MLANA AND PHTF1 | 1 | 1 | 1 |
| MLANA AND CHL1 | 1 | 1 | 1 |
| MLANA AND MLANA | 1 | 1 | 1 |
| MLANA AND MLANA | 1 | 1 | 1 |
| MLANA AND MLANA | 1 | 1 | 1 |
| CLCN5 AND NOT-SLC17A3 | 1 | 1 | 1 |
| FDPS AND NOT-SLC17A3 | 1 | 1 | 1 |
| MLANA AND NOT-SLC17A3 | 1 | 1 | 1 |
| MLANA AND MLANA | 1 | 1 | 1 |
| MLANA AND NOT-OR5I1 | 1 | 1 | 1 |
| MLANA AND ADCY1 | 1 | 1 | 1 |
| MLANA AND NOT-CYSLTR1 | 1 | 1 | 1 |
| MLANA AND MLANA | 1 | 1 | 1 |
| NOT-CFTR AND TLCD1 | 1 | 1 | 1 |
| CLCN5 AND NOT-CFTR | 1 | 1 | 1 |
| FDPS AND NOT-CFTR | 1 | 1 | 1 |
| MLANA AND NOT-CFTR | 1 | 1 | 1 |
| GALNS AND NOT-CFTR | 1 | 1 | 1 |
| ATP1A1 AND NOT-CFTR | 1 | 1 | 1 |
| NPC1 AND NOT-CFTR | 1 | 1 | 1 |
| NOT-CFTR AND CDON | 1 | 1 | 1 |
| NOT-CFTR AND TNFRSF19 | 1 | 1 | 1 |
| SLC35E3 AND NOT-CFTR | 1 | 1 | 1 |
| NOT-CFTR AND WLS | 1 | 1 | 1 |
| TMEM187 AND NOT-CFTR | 1 | 1 | 1 |
| FDPS AND NOT-CGA | 1 | 1 | 1 |
| MLANA AND NOT-CGA | 1 | 1 | 1 |
| MLANA AND FAXDC2 | 1 | 1 | 1 |
| FDPS AND NOT-CEACAM3 | 1 | 1 | 1 |
| MLANA AND NOT-CEACAM3 | 1 | 1 | 1 |
| TMEM187 AND NOT-CEACAM3 | 1 | 1 | 1 |
| MLANA AND NOT-PGRMC1 | 1 | 1 | 1 |
| FDPS AND NOT-SLC26A1 | 1 | 1 | 1 |
| MLANA AND NOT-SLC26A1 | 1 | 1 | 1 |
| MLANA AND MLANA | 1 | 1 | 1 |
| CLCN5 AND NOT-SLC22A7 | 1 | 1 | 1 |
| FDPS AND NOT-SLC22A7 | 1 | 1 | 1 |
| MLANA AND NOT-SLC22A7 | 1 | 1 | 1 |
| MLANA AND NOT-TSPAN9 | 1 | 1 | 1 |
| MLANA AND USP19 | 1 | 1 | 1 |
| MLANA AND MLANA | 1 | 1 | 1 |
| NOT-CD300C AND TLCD1 | 1 | 1 | 1 |
| CLCN5 AND NOT-CD300C | 1 | 1 | 1 |
| FDPS AND NOT-CD300C | 1 | 1 | 1 |
| MLANA AND NOT-CD300C | 1 | 1 | 1 |
| GUSB AND NOT-CD300C | 1 | 1 | 1 |
| NPC1 AND NOT-CD300C | 1 | 1 | 1 |
| AUP1 AND NOT-CD300C | 1 | 1 | 1 |
| GPR137B AND NOT-CD300C | 1 | 1 | 1 |
| TMEM187 AND NOT-CD300C | 1 | 1 | 1 |
| MLANA AND NOT-NMU | 1 | 1 | 1 |
| FDPS AND NOT-CEACAM7 | 1 | 1 | 1 |
| MLANA AND NOT-CEACAM7 | 1 | 1 | 1 |
| MLANA AND NOT-NPFFR2 | 1 | 1 | 1 |
| MLANA AND MLANA | 1 | 1 | 1 |
| FDPS AND MMP24 | 1 | 1 | 1 |
| MLANA AND MLANA | 1 | 1 | 1 |
| MLANA AND NOT-LYVE1 | 1 | 1 | 1 |
| NPC1 AND NOT-LYVE1 | 1 | 1 | 1 |
| MLANA AND NOT-OCLM | 1 | 1 | 1 |
| MLANA AND YIF1A | 1 | 1 | 1 |
| MLANA AND MLANA | 1 | 1 | 1 |
| NOT-CHRNA2 AND ADCY2 | 1 | 1 | 1 |
| MLANA AND NOT-ADCY2 | 1 | 1 | 1 |
| AUP1 AND ADCY2 | 1 | 1 | 1 |
| PARL AND ADCY2 | 1 | 1 | 1 |
| MLANA AND MLANA | 1 | 1 | 1 |
| FDPS AND MAN1A2 | 1 | 1 | 1 |
| MLANA AND MLANA | 1 | 1 | 1 |
| MLANA AND PNPLA6 | 1 | 1 | 1 |

| Antigen Pair Logic | F1 | Precision | Recall |
|---|---|---|---|
| FUT4 AND NOT-LRIG3 | 0.960474308 | 0.952941176 | 0.96812749 |
| FLT3 AND NOT-SLC15A4 | 0.947589099 | 1 | 0.900398406 |
| FUT4 AND NOT-SLC51B | 0.960474308 | 0.952941176 | 0.96812749 |
| P2RY8 AND NOT-CCR6 | 0.937142857 | 0.897810219 | 0.980079681 |
| NOT-PFN2 AND NOT-CCR6 | 0.955684008 | 0.925373134 | 0.988047809 |
| NOT-MTUS1 AND NOT-CCR6 | 0.957692308 | 0.925650558 | 0.992031873 |
| NOT-PFN2 AND NOT-CCR7 | 0.948176583 | 0.914814815 | 0.984063745 |
| NOT-FAM69A AND CMTM3 | 0.930581614 | 0.879432624 | 0.988047809 |
| NOT-HEG1 AND CMTM3 | 0.922746781 | 1 | 0.856573705 |
| NOT-TGFBR3 AND CMTM3 | 0.920770878 | 0.99537037 | 0.856573705 |
| NOT-PHLDB2 AND CMTM3 | 0.946745562 | 0.9375 | 0.956175299 |
| FUT4 AND NOT-CANT1 | 0.952191235 | 0.952191235 | 0.952191235 |
| FUT4 AND NOT-ZNF816 | 0.93852459 | 0.966244726 | 0.912350598 |
| FUT4 AND NOT-SLC44A3 | 0.960474308 | 0.952941176 | 0.96812749 |
| FLT3 AND RNF19B | 0.93877551 | 0.962343096 | 0.916334661 |
| FUT4 AND NOT-TMEM125 | 0.960474308 | 0.952941176 | 0.96812749 |
| FLT3 AND NOT-DRAM2 | 0.945378151 | 1 | 0.896414343 |
| NOT-FAM69A AND C1orf162 | 0.923364486 | 0.86971831 | 0.984063745 |
| FUT4 AND NOT-COL4A2 | 0.96812749 | 0.96812749 | 0.96812749 |
| NOT-FAM69A AND NOT-COL4A2 | 0.927643785 | 0.868055556 | 0.996015936 |
| FLT3 AND NOT-TBC1D20 | 0.940695297 | 0.966386555 | 0.916334661 |
| FLT3 AND NOT-PIGU | 0.93877551 | 0.962343096 | 0.916334661 |
| NOT-PFN2 AND EMID1 | 0.941860465 | 0.916981132 | 0.96812749 |
| NOT-MTUS1 AND EMID1 | 0.953125 | 0.9348659 | 0.972111554 |
| NOT-PTPRK AND EMID1 | 0.94026975 | 0.910447761 | 0.972111554 |
| FUT4 AND NOT-SGPP2 | 0.9500998 | 0.952 | 0.948207171 |
| FUT4 AND NOT-ACVR1C | 0.97005988 | 0.972 | 0.96812749 |
| SMIM3 AND NOT-ACVR1C | 0.936416185 | 0.906716418 | 0.96812749 |
| FUT4 AND NOT-FAM3D | 0.960474308 | 0.952941176 | 0.96812749 |
| FLT3 AND NOT-TMEM42 | 0.930526316 | 0.986607143 | 0.880478088 |
| FUT4 AND NOT-SLC31A1 | 0.939203354 | 0.991150442 | 0.892430279 |
| FLT3 AND NOT-SYNPR | 0.940936864 | 0.9625 | 0.920318725 |
| FLT3 AND NOT-C4orf32 | 0.931106472 | 0.978070175 | 0.888446215 |
| FLT3 AND NOT-AASDH | 0.9375 | 0.982532751 | 0.896414343 |
| FLT3 AND NOT-EGFLAM | 0.948665298 | 0.978813559 | 0.920318725 |
| FUT4 AND NOT-TMEM171 | 0.960474308 | 0.952941176 | 0.96812749 |
| NOT-FAM69A AND NOT-COX7A1 | 0.958015267 | 0.919413919 | 1 |
| FLT3 AND NOT-COX10 | 0.93877551 | 0.962343096 | 0.916334661 |
| FUT4 AND NOT-COX10 | 0.943548387 | 0.955102041 | 0.932270916 |
| FLT3 AND NOT-COX11 | 0.909090909 | 0.995260664 | 0.836653386 |
| FUT4 AND NOT-TMEM139 | 0.958579882 | 0.94921875 | 0.96812749 |
| FUT4 AND NOT-CLDN4 | 0.960474308 | 0.952941176 | 0.96812749 |
| FUT4 AND NOT-CLDN3 | 0.960474308 | 0.952941176 | 0.96812749 |
| FUT4 AND NOT-CLDN7 | 0.960474308 | 0.952941176 | 0.96812749 |
| FUT4 AND NOT-CLDN23 | 0.958415842 | 0.952755906 | 0.964143426 |
| FLT3 AND NOT-TMEM68 | 0.952380952 | 0.99137931 | 0.916334661 |
| FUT4 AND NOT-TMEM68 | 0.963562753 | 0.979423868 | 0.948207171 |
| FLT3 AND NOT-AGPAT6 | 0.940936864 | 0.9625 | 0.920318725 |
| FUT4 AND NOT-CR2 | 0.936416185 | 0.906716418 | 0.96812749 |
| P2RY8 AND NOT-CR2 | 0.92481203 | 0.87544484 | 0.980079681 |
| NRROS AND NOT-CR2 | 0.943319838 | 0.958847737 | 0.928286853 |
| NOT-PFN2 AND NOT-CR2 | 0.96124031 | 0.935849057 | 0.988047809 |
| FLT3 AND NOT-SELM | 0.948453608 | 0.982905983 | 0.916334661 |
| NOT-SELM AND CXCL8 | 0.928030303 | 0.884476534 | 0.976095618 |
| NOT-SELM AND SMIM3 | 0.962524655 | 0.953125 | 0.972111554 |
| FUT4 AND NOT-TMEM37 | 0.964285714 | 0.960474308 | 0.96812749 |
| SMIM3 AND NOT-TMEM37 | 0.945736434 | 0.920754717 | 0.972111554 |
| FUT4 AND NOT-TRPM6 | 0.958415842 | 0.952755906 | 0.964143426 |
| NOT-FAM69A AND FAM76B | 0.945179584 | 0.899280576 | 0.996015936 |
| NOT-VAPB AND FAM76B | 0.925093633 | 0.872791519 | 0.984063745 |
| FLT3 AND NOT-LAYN | 0.94214876 | 0.978540773 | 0.908366534 |
| NOT-FAM69A AND CSF3R | 0.964 | 0.967871486 | 0.960159363 |
| NOT-PTPRK AND CSF3R | 0.936090226 | 0.886120996 | 0.992031873 |
| FLT3 AND NOT-SLC38A6 | 0.952182952 | 0.995652174 | 0.912350598 |
| FLT3 AND NOT-CMTM4 | 0.940936864 | 0.9625 | 0.920318725 |
| FUT4 AND NOT-CMTM4 | 0.960474308 | 0.952941176 | 0.96812749 |
| FUT4 AND NOT-TMED6 | 0.958415842 | 0.952755906 | 0.964143426 |
| FLT3 AND NOT-CD300LG | 0.942857143 | 0.966527197 | 0.920318725 |
| NOT-FAM69A AND TMC8 | 0.961538462 | 0.92936803 | 0.996015936 |
| NOT-PHLDB2 AND TMC8 | 0.930320151 | 0.882142857 | 0.984063745 |
| FLT3 AND NOT-TMEM99 | 0.952380952 | 0.99137931 | 0.916334661 |
| FUT4 AND NOT-TMEM99 | 0.949019608 | 0.934362934 | 0.964143426 |
| FUT4 AND NOT-APCDD1 | 0.93877551 | 0.962343096 | 0.916334661 |
| FLT3 AND NOT-SMIM17 | 0.93877551 | 0.962343096 | 0.916334661 |
| FUT4 AND NOT-TMC4 | 0.952191235 | 0.952191235 | 0.952191235 |
| FUT4 AND NOT-MFSD4 | 0.956692913 | 0.945525292 | 0.96812749 |

FIG. 1 (CONT.)

| Antigen Pair Logic | F1 | Precision | Recall | Antigen Pair Logic | F1 | Precision | Recall |
|---|---|---|---|---|---|---|---|
| FDPS AND NOT-EDAR | 1 | 1 | 1 | FUT4 AND NOT-C1orf210 | 0.960474308 | 0.952941176 | 0.96812749 |
| MLANA AND NOT-EDAR | 1 | 1 | 1 | FUT4 AND NOT-PROM2 | 0.958579882 | 0.94921875 | 0.96812749 |
| AUP1 AND NOT-EDAR | 1 | 1 | 1 | FUT4 AND NOT-ADRA2A | 0.956349206 | 0.95256917 | 0.960159363 |
| PARL AND NOT-EDAR | 1 | 1 | 1 | FLT3 AND NOT-ARL6IP6 | 0.944785276 | 0.970588235 | 0.920318725 |
| GPR137B AND NOT-EDAR | 1 | 1 | 1 | NOT-FAM69A AND METTL21A | 0.925373134 | 0.870175439 | 0.988047809 |
| TMEM187 AND NOT-EDAR | 1 | 1 | 1 | FLT3 AND NOT-RMDN2 | 0.948453608 | 0.982905983 | 0.916334661 |
| CLCN5 AND NOT-BTNL3 | 1 | 1 | 1 | FUT4 AND NOT-RMDN2 | 0.962075848 | 0.964 | 0.960159363 |
| FDPS AND NOT-BTNL3 | 1 | 1 | 1 | FLT3 AND NOT-SLC16A14 | 0.926624738 | 0.977876106 | 0.880478088 |
| MLANA AND NOT-BTNL3 | 1 | 1 | 1 | ADGRE1 AND NOT-GPR155 | 0.940206186 | 0.974358974 | 0.908366534 |
| NPC1 AND NOT-BTNL3 | 1 | 1 | 1 | FLT3 AND NOT-GPR155 | 0.944785276 | 0.970588235 | 0.920318725 |
| FDPS AND NOT-GPR75 | 1 | 1 | 1 | HBD AND NOT-GPR155 | 0.939805825 | 0.916666667 | 0.964143426 |
| MLANA AND NOT-GPR75 | 1 | 1 | 1 | P2RX1 AND NOT-GPR155 | 0.958415842 | 0.952755906 | 0.964143426 |
| MLANA AND AFG3L2 | 1 | 1 | 1 | NOT-GPR155 AND P2RX4 | 0.93852459 | 0.966244726 | 0.912350598 |
| NOT-MLANA AND KDELR1 | 1 | 1 | 1 | NOT-PFN2 AND NOT-GPR155 | 0.931818182 | 0.888086643 | 0.980079681 |
| MLANA AND MLANA | 1 | 1 | 1 | NOT-MTUS1 AND NOT-GPR155 | 0.935849057 | 0.888888889 | 0.988047809 |
| MLANA AND MLANA | 1 | 1 | 1 | NOT-PFN2 AND NOT-BTLA | 0.957364341 | 0.932075472 | 0.984063745 |
| MLANA AND OS9 | 1 | 1 | 1 | FLT3 AND NOT-CMTM8 | 0.938271605 | 0.970212766 | 0.908366534 |
| NOT-OS9 AND LRFN1 | 1 | 1 | 1 | FUT4 AND NOT-CMTM8 | 0.957575758 | 0.971311475 | 0.944223108 |
| NOT-OS9 AND NOT-NPFFR1 | 1 | 1 | 1 | HBD AND NOT-CMTM8 | 0.929460581 | 0.96969697 | 0.892430279 |
| MLANA AND MLANA | 1 | 1 | 1 | FLT3 AND NOT-NFXL1 | 0.939203354 | 0.991150442 | 0.892430279 |
| MLANA AND LMAN2 | 1 | 1 | 1 | FLT3 AND NOT-CXADR | 0.935550936 | 0.97826087 | 0.896414343 |
| MLANA AND MLANA | 1 | 1 | 1 | FUT4 AND NOT-CXADR | 0.9498998 | 0.955645161 | 0.944223108 |
| MLANA AND MLANA | 1 | 1 | 1 | FLT3 AND NOT-THAP6 | 0.954166667 | 1 | 0.912350598 |
| MLANA AND MLANA | 1 | 1 | 1 | FUT4 AND NOT-THAP6 | 0.957055215 | 0.983193277 | 0.932270916 |
| MLANA AND MLANA | 1 | 1 | 1 | FLT3 AND NOT-CYB5A | 0.918454936 | 0.995348837 | 0.852589641 |
| MLANA AND MLANA | 1 | 1 | 1 | FLT3 AND NOT-SLC38A9 | 0.939958592 | 0.978448276 | 0.90438247 |
| CLCN5 AND NOT-SLC38A3 | 1 | 1 | 1 | FLT3 AND NOT-TMEM161B | 0.950413223 | 0.987124464 | 0.916334661 |
| FDPS AND NOT-SLC38A3 | 1 | 1 | 1 | FUT4 AND NOT-CYB561 | 0.96031746 | 0.956521739 | 0.964143426 |
| MLANA AND NOT-SLC38A3 | 1 | 1 | 1 | FUT4 AND NOT-MARVELD2 | 0.960474308 | 0.952941176 | 0.96812749 |
| NPC1 AND NOT-SLC38A3 | 1 | 1 | 1 | FLT3 AND NOT-NKAIN2 | 0.93877551 | 0.962343096 | 0.916334661 |
| SLC35E3 AND NOT-SLC38A3 | 1 | 1 | 1 | SMIM3 AND NOT-VKORC1L1 | 0.934156379 | 0.965957447 | 0.90438247 |
| TYRP1 AND NOT-SLC38A3 | 1 | 1 | 1 | FLT3 AND NOT-CYP2J2 | 0.93877551 | 0.962343096 | 0.916334661 |
| FDPS AND ILVBL | 1 | 1 | 1 | FUT4 AND NOT-CYP2J2 | 0.958415842 | 0.952755906 | 0.964143426 |
| MLANA AND ILVBL | 1 | 1 | 1 | FUT4 AND NOT-RDH10 | 0.9500998 | 0.952 | 0.948207171 |
| MLANA AND SLC27A5 | 1 | 1 | 1 | FLT3 AND NOT-ANKRD46 | 0.950413223 | 0.987124464 | 0.916334661 |
| MLANA AND MLANA | 1 | 1 | 1 | FUT4 AND NOT-ANKRD46 | 0.959183673 | 0.983263598 | 0.93625498 |
| MLANA AND MLANA | 1 | 1 | 1 | FUT4 AND NOT-CYP3A5 | 0.960474308 | 0.952941176 | 0.96812749 |
| MLANA AND NOT-NAT2 | 1 | 1 | 1 | FLT3 AND NOT-FREM1 | 0.940936864 | 0.9625 | 0.920318725 |
| NPC1 AND NOT-NAT2 | 1 | 1 | 1 | FUT4 AND NOT-FAAH2 | 0.938223938 | 0.91011236 | 0.96812749 |
| FDPS AND SLC27A3 | 1 | 1 | 1 | FUT4 AND NOT-SLC35G1 | 0.960474308 | 0.952941176 | 0.96812749 |
| MLANA AND MLANA | 1 | 1 | 1 | NOT-FAM69A AND CLEC12A | 0.94368932 | 0.920454545 | 0.96812749 |
| FDPS AND NOT-SLC27A2 | 1 | 1 | 1 | FLT3 AND NOT-DAD1 | 0.920770878 | 0.99537037 | 0.856573705 |
| MLANA AND MLANA | 1 | 1 | 1 | FLT3 AND NOT-TMTC3 | 0.948665298 | 0.978813559 | 0.920318725 |
| MLANA AND LILRB4 | 1 | 1 | 1 | FUT4 AND NOT-TMTC3 | 0.971428571 | 0.9958159 | 0.948207171 |
| MLANA AND MLANA | 1 | 1 | 1 | NOT-TMTC3 AND SUSD1 | 0.934615385 | 0.903345725 | 0.96812749 |
| AUP1 AND NOT-GLIPR1 | 1 | 1 | 1 | NOT-TMTC3 AND SLC30A1 | 0.938697318 | 0.904059041 | 0.976095618 |
| PARL AND NOT-GLIPR1 | 1 | 1 | 1 | FLT3 AND NOT-DENND5B | 0.948665298 | 0.978813559 | 0.920318725 |
| MLANA AND KDELR2 | 1 | 1 | 1 | FLT3 AND NOT-DAG1 | 0.948665298 | 0.978813559 | 0.920318725 |
| MLANA AND KDELR3 | 1 | 1 | 1 | FUT4 AND NOT-DAG1 | 0.962376238 | 0.956692913 | 0.96812749 |
| MLANA AND MLANA | 1 | 1 | 1 | FLT3 AND NOT-GPR180 | 0.940936864 | 0.9625 | 0.920318725 |
| MLANA AND TMED1 | 1 | 1 | 1 | FLT3 AND NOT-FITM1 | 0.940936864 | 0.9625 | 0.920318725 |
| MLANA AND TDRKH | 1 | 1 | 1 | FUT4 AND NOT-TMEM30B | 0.960474308 | 0.952941176 | 0.96812749 |
| MLANA AND LILRB3 | 1 | 1 | 1 | FUT4 AND NOT-SYNE4 | 0.947368421 | 0.927480916 | 0.96812749 |
| MLANA AND B4GAT1 | 1 | 1 | 1 | FUT4 AND NOT-TOR1AIP2 | 0.940206186 | 0.974358974 | 0.908366534 |
| AUP1 AND B4GAT1 | 1 | 1 | 1 | FUT4 AND NOT-IFNLR1 | 0.964143426 | 0.964143426 | 0.964143426 |
| MLANA AND NOT-UPK1A | 1 | 1 | 1 | P2RY8 AND NOT-IFNLR1 | 0.940726577 | 0.904411765 | 0.980079681 |
| MLANA AND SLC35D2 | 1 | 1 | 1 | NRROS AND NOT-IFNLR1 | 0.947154472 | 0.966804979 | 0.928286853 |
| CLCN5 AND NOT-ZPBP | 1 | 1 | 1 | P2RX1 AND NOT-IFNLR1 | 0.954990215 | 0.938461538 | 0.972111554 |
| FDPS AND NOT-ZPBP | 1 | 1 | 1 | NOT-IFNLR1 AND UBE2J1 | 0.927643785 | 0.868055556 | 0.996015936 |
| MLANA AND NOT-ZPBP | 1 | 1 | 1 | HBD AND NOT-SPTSSB | 0.932821497 | 0.9 | 0.96812749 |
| NPC1 AND NOT-ZPBP | 1 | 1 | 1 | P2RX1 AND NOT-SPTSSB | 0.933078394 | 0.897058824 | 0.972111554 |
| TYRP1 AND NOT-ZPBP | 1 | 1 | 1 | FLT3 AND NOT-GIMAP1 | 0.958506224 | 1 | 0.920318725 |
| MLANA AND NOT-LECT1 | 1 | 1 | 1 | NOT-PFN2 AND NOT-GIMAP1 | 0.918819188 | 0.855670103 | 0.992031873 |
| NPC1 AND NOT-LECT1 | 1 | 1 | 1 | FLT3 AND NOT-CLYBL | 0.94214876 | 0.978540773 | 0.908366534 |
| MLANA AND CYB561D2 | 1 | 1 | 1 | FUT4 AND NOT-CLYBL | 0.952380952 | 0.948616601 | 0.956175299 |
| MLANA AND TMEM115 | 1 | 1 | 1 | FLT3 AND NOT-SPTSSA | 0.952380952 | 0.99137931 | 0.916334661 |
| FDPS AND RER1 | 1 | 1 | 1 | FUT4 AND NOT-SPTSSA | 0.957230143 | 0.979166667 | 0.93625498 |
| MLANA AND MLANA | 1 | 1 | 1 | FLT3 AND NOT-DHCR24 | 0.948665298 | 0.978813559 | 0.920318725 |
| MLANA AND NOT-ADAM30 | 1 | 1 | 1 | FUT4 AND NOT-DHCR24 | 0.954455446 | 0.948818898 | 0.960159363 |
| NPC1 AND NOT-ADAM30 | 1 | 1 | 1 | FUT4 AND NOT-DPP4 | 0.967741935 | 0.979591837 | 0.956175299 |
| FDPS AND NOT-ADAM29 | 1 | 1 | 1 | HBD AND NOT-DPP4 | 0.941176471 | 0.926640927 | 0.956175299 |
| MLANA AND NOT-ADAM29 | 1 | 1 | 1 | P2RX1 AND NOT-DPP4 | 0.937984496 | 0.913207547 | 0.964143426 |
| NOT-ADAM29 AND GPR19 | 1 | 1 | 1 | FUT4 AND NOT-SLC26A3 | 0.960474308 | 0.952941176 | 0.96812749 |
| NPC1 AND NOT-ADAM29 | 1 | 1 | 1 | FUT4 AND NOT-DSC2 | 0.95481336 | 0.941860465 | 0.96812749 |
| NOT-ADAM29 AND NOT-EDDM3B | 1 | 1 | 1 | FUT4 AND NOT-DSG2 | 0.960474308 | 0.952941176 | 0.96812749 |
| NOT-ADAM29 AND CD63 | 1 | 1 | 1 | FLT3 AND NOT-SLC26A2 | 0.942622951 | 0.970464135 | 0.916334661 |

FIG. 1 (CONT.)

| Antigen Pair Logic | F1 | Precision | Recall | Antigen Pair Logic | F1 | Precision | Recall |
|---|---|---|---|---|---|---|---|
| MLANA AND MLANA | 1 | 1 | 1 | FUT4 AND NOT-SLC26A2 | 0.96222664 | 0.96031746 | 0.964143426 |
| FDPS AND NOT-FDPS | 1 | 1 | 1 | FLT3 AND NOT-AGTR1 | 0.948665298 | 0.978813559 | 0.920318725 |
| MLANA AND MLANA | 1 | 1 | 1 | SMIM3 AND NOT-APLNR | 0.943907157 | 0.917293233 | 0.972111554 |
| MLANA AND MLANA | 1 | 1 | 1 | FLT3 AND NOT-S1PR1 | 0.956340956 | 1 | 0.916334661 |
| AUP1 AND NOT-BTN3A2 | 1 | 1 | 1 | NRROS AND NOT-S1PR1 | 0.931392931 | 0.973913043 | 0.892430279 |
| PARL AND NOT-BTN3A2 | 1 | 1 | 1 | FUT4 AND NOT-LPAR1 | 0.979757085 | 0.995884774 | 0.964143426 |
| AUP1 AND NOT-BTN3A1 | 1 | 1 | 1 | NOT-LPAR1 AND CXCL8 | 0.944550669 | 0.908088235 | 0.984063745 |
| PARL AND NOT-BTN3A1 | 1 | 1 | 1 | P2RX1 AND NOT-LPAR1 | 0.9348659 | 0.900369004 | 0.972111554 |
| MLANA AND BTN2A1 | 1 | 1 | 1 | NOT-LPAR1 AND B3GNT5 | 0.92936803 | 0.871080139 | 0.996015936 |
| MLANA AND MLANA | 1 | 1 | 1 | NOT-LPAR1 AND SMIM3 | 0.954198473 | 0.915750916 | 0.996015936 |
| FDPS AND NOT-IL1RAPL1 | 1 | 1 | 1 | FLT3 AND NOT-EDNRB | 0.948665298 | 0.978813559 | 0.920318725 |
| MLANA AND NOT-IL1RAPL1 | 1 | 1 | 1 | FUT4 AND NOT-EDNRB | 0.957915832 | 0.963709677 | 0.952191235 |
| MLANA AND MLANA | 1 | 1 | 1 | NOT-EDNRB AND SMIM3 | 0.962671906 | 0.949612403 | 0.976095618 |
| MLANA AND MLANA | 1 | 1 | 1 | FLT3 AND NOT-EFNB2 | 0.939958592 | 0.978448276 | 0.90438247 |
| MLANA AND BVES | 1 | 1 | 1 | FUT4 AND NOT-EFNB2 | 0.964 | 0.967871486 | 0.960159363 |
| MLANA AND MLANA | 1 | 1 | 1 | NOT-FAM69A AND NOT-EFNB2 | 0.935361217 | 0.894545455 | 0.980079681 |
| NPC1 AND NOT-FICD | 1 | 1 | 1 | FLT3 AND NOT-MEGF8 | 0.940936864 | 0.9625 | 0.920318725 |
| MLANA AND C14orf1 | 1 | 1 | 1 | FLT3 AND NOT-MPZL3 | 0.936082474 | 0.97008547 | 0.90438247 |
| MLANA AND MLANA | 1 | 1 | 1 | FUT4 AND NOT-MPZL3 | 0.935010482 | 0.986725664 | 0.888446215 |
| NPC1 AND CHI3L2 | 1 | 1 | 1 | ELANE AND NOT-FAM69A | 0.938016529 | 0.974248927 | 0.90438247 |
| MLANA AND SLC2A6 | 1 | 1 | 1 | ELANE AND NOT-PHLDB2 | 0.931392931 | 0.973913043 | 0.892430279 |
| MLANA AND MLANA | 1 | 1 | 1 | NOT-MTUS1 AND TMEM201 | 0.904761905 | 0.990521327 | 0.832669323 |
| MLANA AND NOT-ADCY5 | 1 | 1 | 1 | FLT3 AND NOT-PLD5 | 0.940936864 | 0.9625 | 0.920318725 |
| FDPS AND NOT-KLK8 | 1 | 1 | 1 | FLT3 AND NOT-KRTCAP3 | 0.93877551 | 0.962343096 | 0.916334661 |
| MLANA AND NOT-KLK8 | 1 | 1 | 1 | FUT4 AND NOT-KRTCAP3 | 0.958415842 | 0.952755906 | 0.964143426 |
| MLANA AND NOT-FZD10 | 1 | 1 | 1 | FUT4 AND NOT-EMP2 | 0.960474308 | 0.952941176 | 0.96812749 |
| FDPS AND NOT-GALNT6 | 1 | 1 | 1 | NOT-FAM69A AND NOT-EMP2 | 0.919413919 | 0.850847458 | 1 |
| MLANA AND MLANA | 1 | 1 | 1 | NOT-PTPRK AND EMP3 | 0.930841121 | 0.876760563 | 0.992031873 |
| MLANA AND MLANA | 1 | 1 | 1 | NOT-FAM69A AND ADGRE1 | 0.936660269 | 0.903703704 | 0.972111554 |
| MLANA AND PRAF2 | 1 | 1 | 1 | NOT-HEG1 AND ADGRE1 | 0.919148936 | 0.98630137 | 0.860557769 |
| MLANA AND MLANA | 1 | 1 | 1 | FLT3 AND NOT-TIGIT | 0.952380952 | 0.99137931 | 0.916334661 |
| MLANA AND MLANA | 1 | 1 | 1 | HBD AND NOT-TIGIT | 0.936416185 | 0.906716418 | 0.96812749 |
| MLANA AND MLANA | 1 | 1 | 1 | NOT-PFN2 AND NOT-TIGIT | 0.930581614 | 0.879432624 | 0.988047809 |
| MLANA AND MLANA | 1 | 1 | 1 | NOT-PTPRK AND NOT-TIGIT | 0.922222222 | 0.861591696 | 0.992031873 |
| CLCN5 AND NOT-GPR45 | 1 | 1 | 1 | FLT3 AND NOT-TMEM154 | 0.921775899 | 0.981981982 | 0.868525896 |
| FDPS AND NOT-GPR45 | 1 | 1 | 1 | FUT4 AND NOT-SMIM14 | 0.966202783 | 0.964285714 | 0.96812749 |
| MLANA AND NOT-GPR45 | 1 | 1 | 1 | ADGRE2 AND NOT-SMIM14 | 0.909090909 | 0.995260664 | 0.836653386 |
| NPC1 AND NOT-GPR45 | 1 | 1 | 1 | NRROS AND NOT-SMIM14 | 0.943089431 | 0.962655602 | 0.924302789 |
| TMEM187 AND NOT-GPR45 | 1 | 1 | 1 | P2RX1 AND NOT-SMIM14 | 0.948207171 | 0.948207171 | 0.948207171 |
| NOT-CD300LB AND PTGDR2 | 1 | 1 | 1 | FXYD5 AND NOT-SMIM14 | 0.940944882 | 0.929961089 | 0.952191235 |
| FDPS AND PTGDR2 | 1 | 1 | 1 | FLT3 AND NOT-C9orf91 | 0.951983299 | 1 | 0.908366534 |
| MLANA AND NOT-PTGDR2 | 1 | 1 | 1 | FLT3 AND NOT-CCDC107 | 0.943632568 | 0.99122807 | 0.900398406 |
| NOT-ITGA2B AND PTGDR2 | 1 | 1 | 1 | FUT4 AND NOT-CCDC107 | 0.933884298 | 0.969957082 | 0.900398406 |
| FDPS AND MAN1B1 | 1 | 1 | 1 | FUT4 AND NOT-SLC25A43 | 0.941414141 | 0.954918033 | 0.928286853 |
| MLANA AND MLANA | 1 | 1 | 1 | NOT-LRIG1 AND VMA21 | 0.923364486 | 0.86971831 | 0.984063745 |
| MLANA AND MLANA | 1 | 1 | 1 | NOT-MINOS1 AND VMA21 | 0.952941176 | 0.938223938 | 0.96812749 |
| CLCN5 AND NOT-HRH3 | 1 | 1 | 1 | NOT-SLC37A3 AND VMA21 | 0.938223938 | 0.91011236 | 0.96812749 |
| FDPS AND NOT-HRH3 | 1 | 1 | 1 | NOT-VAPB AND VMA21 | 0.924214418 | 0.862068966 | 0.996015936 |
| MLANA AND NOT-HRH3 | 1 | 1 | 1 | NOT-ARMCX2 AND VMA21 | 0.92393321 | 0.864583333 | 0.992031873 |
| NPC1 AND NOT-HRH3 | 1 | 1 | 1 | FLT3 AND NOT-CERS3 | 0.940936864 | 0.9625 | 0.920318725 |
| TMEM187 AND NOT-HRH3 | 1 | 1 | 1 | FUT4 AND NOT-EPHA4 | 0.952755906 | 0.941634241 | 0.964143426 |
| MLANA AND NOT-MRAP2 | 1 | 1 | 1 | HBD AND NOT-EPHA4 | 0.943469786 | 0.923664122 | 0.964143426 |
| MLANA AND CMTM7 | 1 | 1 | 1 | P2RX1 AND NOT-EPHA4 | 0.953307393 | 0.931558935 | 0.976095618 |
| CLCN5 AND NOT-STX1B | 1 | 1 | 1 | FUT4 AND NOT-EPHB2 | 0.960474308 | 0.952941176 | 0.96812749 |
| FDPS AND NOT-STX1B | 1 | 1 | 1 | FUT4 AND NOT-ERBB2 | 0.960474308 | 0.952941176 | 0.96812749 |
| MLANA AND NOT-STX1B | 1 | 1 | 1 | FUT4 AND NOT-ERBB3 | 0.960474308 | 0.952941176 | 0.96812749 |
| GALNS AND NOT-STX1B | 1 | 1 | 1 | FLT3 AND NOT-ETFDH | 0.9375 | 0.982532751 | 0.896414343 |
| NPC1 AND NOT-STX1B | 1 | 1 | 1 | FUT4 AND NOT-ETFDH | 0.953907816 | 0.959677419 | 0.948207171 |
| SLC35E3 AND NOT-STX1B | 1 | 1 | 1 | NOT-LRIG1 AND ETV6 | 0.946322068 | 0.944444444 | 0.948207171 |
| TMEM187 AND NOT-STX1B | 1 | 1 | 1 | NOT-FAM69A AND ETV6 | 0.952380952 | 0.912408759 | 0.996015936 |
| MLANA AND KLHL2 | 1 | 1 | 1 | NOT-MINOS1 AND ETV6 | 0.940944882 | 0.929961089 | 0.952191235 |
| MLANA AND GLMP | 1 | 1 | 1 | NOT-HEG1 AND ETV6 | 0.919831224 | 0.977578475 | 0.868525896 |
| MLANA AND NOT-SCN11A | 1 | 1 | 1 | NOT-SLC37A3 AND ETV6 | 0.958415842 | 0.952755906 | 0.964143426 |
| MLANA AND MLANA | 1 | 1 | 1 | NOT-PHLDB2 AND ETV6 | 0.954990215 | 0.938461538 | 0.972111554 |
| MLANA AND MGAT4B | 1 | 1 | 1 | NOT-VAPB AND ETV6 | 0.941176471 | 0.926640927 | 0.956175299 |
| MLANA AND MLANA | 1 | 1 | 1 | NOT-FAM69A AND EVI2A | 0.92962963 | 0.868512111 | 1 |
| MLANA AND MLANA | 1 | 1 | 1 | NOT-FAM69A AND EVI2B | 0.967117988 | 0.939849624 | 0.996015936 |
| CLCN5 AND NOT-CHRM2 | 1 | 1 | 1 | FLT3 AND NOT-EXT1 | 0.956521739 | 0.995689655 | 0.920318725 |
| FDPS AND NOT-CHRM2 | 1 | 1 | 1 | FUT4 AND NOT-EXT1 | 0.97188755 | 0.979757085 | 0.964143426 |
| MLANA AND NOT-CHRM2 | 1 | 1 | 1 | NOT-EXT1 AND SMIM3 | 0.951267057 | 0.93129771 | 0.972111554 |
| NOT-CHRNA2 AND ADCY6 | 1 | 1 | 1 | FUT4 AND NOT-F2RL1 | 0.960474308 | 0.952941176 | 0.96812749 |
| NOT-CLDN19 AND ADCY6 | 1 | 1 | 1 | FUT4 AND NOT-FAT1 | 0.958415842 | 0.952755906 | 0.964143426 |
| FDPS AND ADCY6 | 1 | 1 | 1 | FLT3 AND NOT-TMEM136 | 0.940936864 | 0.9625 | 0.920318725 |
| MLANA AND MLANA | 1 | 1 | 1 | FLT3 AND NOT-ABCA3 | 0.940936864 | 0.9625 | 0.920318725 |
| NOT-KCNS2 AND ADCY6 | 1 | 1 | 1 | FLT3 AND NOT-CYB561A3 | 0.911447084 | 0.995283019 | 0.84063745 |
| AUP1 AND ADCY6 | 1 | 1 | 1 | FUT4 AND NOT-SLC16A9 | 0.954635108 | 0.9453125 | 0.964143426 |

FIG. 1 (CONT.)

| Antigen Pair Logic | F1 | Precision | Recall | Antigen Pair Logic | F1 | Precision | Recall |
|---|---|---|---|---|---|---|---|
| PARL AND ADCY6 | 1 | 1 | 1 | FUT4 AND NOT-REEP3 | 0.944 | 0.947791165 | 0.940239044 |
| NOT-CACNG6 AND ADCY6 | 1 | 1 | 1 | NOT-FAM171A1 AND SMIM3 | 0.953156823 | 0.975 | 0.932270916 |
| NOT-SLC5A5 AND ADCY6 | 1 | 1 | 1 | NOT-FAM69A AND NOT-ADGRF5 | 0.945386064 | 0.896428571 | 1 |
| NOT-TM4SF5 AND ADCY6 | 1 | 1 | 1 | FLT3 AND NOT-FKTN | 0.940936864 | 0.9625 | 0.920318725 |
| NOT-SLC22A8 AND ADCY6 | 1 | 1 | 1 | FLT3 AND NOT-SLC35F1 | 0.940936864 | 0.9625 | 0.920318725 |
| NOT-PTH2 AND TLCD1 | 1 | 1 | 1 | FLT3 AND NOT-ALDH3A2 | 0.948665298 | 0.978813559 | 0.920318725 |
| NOT-PTH2 AND CLCN5 | 1 | 1 | 1 | FUT4 AND NOT-ALDH3A2 | 0.935010482 | 0.986725664 | 0.888446215 |
| NOT-PTH2 AND SLC44A3 | 1 | 1 | 1 | FUT4 AND NOT-FGFR3 | 0.949494949 | 0.963114754 | 0.93625498 |
| NOT-PTH2 AND LRRC15 | 1 | 1 | 1 | FUT4 AND NOT-FGFR2 | 0.960474308 | 0.952941176 | 0.96812749 |
| NOT-PTH2 AND MANEAL | 1 | 1 | 1 | FUT4 AND NOT-CLCA4 | 0.960474308 | 0.952941176 | 0.96812749 |
| NOT-PTH2 AND PROM2 | 1 | 1 | 1 | FLT3 AND NOT-DOLK | 0.944099379 | 0.982758621 | 0.908366534 |
| NOT-PTH2 AND CCDC80 | 1 | 1 | 1 | FUT4 AND NOT-DOLK | 0.961460446 | 0.979338843 | 0.944223108 |
| NOT-PTH2 AND DSC3 | 1 | 1 | 1 | FUT4 AND NOT-LMTK2 | 0.953535354 | 0.967213115 | 0.940239044 |
| NOT-PTH2 AND ELN | 1 | 1 | 1 | FLT3 AND NOT-ADGRL1 | 0.940936864 | 0.9625 | 0.920318725 |
| NOT-PTH2 AND EMP2 | 1 | 1 | 1 | NOT-DIP2C AND FUT4 | 0.952015355 | 0.918518519 | 0.988047809 |
| NOT-PTH2 AND ENG | 1 | 1 | 1 | NOT-DIP2C AND NOT-SIT1 | 0.918819188 | 0.855670103 | 0.992031873 |
| FDPS AND NOT-PTH2 | 1 | 1 | 1 | NOT-DIP2C AND NOT-HLA-DOB | 0.917431193 | 0.850340136 | 0.996015936 |
| MLANA AND NOT-PTH2 | 1 | 1 | 1 | NOT-DIP2C AND CXCL8 | 0.930320151 | 0.882142857 | 0.984063745 |
| NOT-PTH2 AND INAFM1 | 1 | 1 | 1 | NOT-FAM69A AND NOT-DIP2C | 0.922509225 | 0.859106529 | 0.996015936 |
| NOT-PTH2 AND SUSD5 | 1 | 1 | 1 | NOT-DIP2C AND SCCPDH | 0.94368932 | 0.920454545 | 0.96812749 |
| NOT-PTH2 AND GPR19 | 1 | 1 | 1 | NOT-DIP2C AND SMIM3 | 0.97415507 | 0.972222222 | 0.976095618 |
| NOT-PTH2 AND SLC2A8 | 1 | 1 | 1 | NOT-DIP2C AND NOT-PHLDB2 | 0.927102804 | 0.873239437 | 0.988047809 |
| NOT-PTH2 AND IL1R1 | 1 | 1 | 1 | NOT-DIP2C AND NOT-FCMR | 0.920810313 | 0.856164384 | 0.996015936 |
| NOT-PTH2 AND JAG2 | 1 | 1 | 1 | FUT4 AND NOT-KLHDC10 | 0.958083832 | 0.96 | 0.956175299 |
| NOT-PTH2 AND KIT | 1 | 1 | 1 | FLT3 AND NOT-TMCC1 | 0.945378151 | 1 | 0.896414343 |
| NOT-PTH2 AND TMEM220 | 1 | 1 | 1 | FUT4 AND NOT-TMCC1 | 0.947807933 | 0.995614035 | 0.90438247 |
| NOT-PTH2 AND TSPAN11 | 1 | 1 | 1 | P2RX1 AND NOT-TMCC1 | 0.952 | 0.955823293 | 0.948207171 |
| NOT-PTH2 AND ATP1A1 | 1 | 1 | 1 | NOT-PTPRK AND NOT-TMCC1 | 0.934615385 | 0.903345725 | 0.96812749 |
| NPC1 AND NOT-PTH2 | 1 | 1 | 1 | SLC22A16 AND NOT-TMCC1 | 0.926931106 | 0.973684211 | 0.884462151 |
| NOT-PTH2 AND CDON | 1 | 1 | 1 | FUT4 AND NOT-ENDOD1 | 0.956521739 | 0.995689655 | 0.920318725 |
| NOT-PTH2 AND ENPP2 | 1 | 1 | 1 | FUT4 AND NOT-ATP10B | 0.960474308 | 0.952941176 | 0.96812749 |
| NOT-PTH2 AND PMP22 | 1 | 1 | 1 | FLT3 AND NOT-LRCH1 | 0.948665298 | 0.978813559 | 0.920318725 |
| NOT-PTH2 AND IL20RB | 1 | 1 | 1 | FUT4 AND NOT-CLCC1 | 0.963709677 | 0.975510204 | 0.952191235 |
| NOT-PTH2 AND DNAJC25 | 1 | 1 | 1 | FUT4 AND NOT-SNX13 | 0.911447084 | 0.995283019 | 0.84063745 |
| NOT-PTH2 AND SLC47A1 | 1 | 1 | 1 | FUT4 AND NOT-SLC35D1 | 0.954274354 | 0.952380952 | 0.956175299 |
| NOT-PTH2 AND LGR4 | 1 | 1 | 1 | FLT3 AND NOT-SYT11 | 0.936708861 | 0.995515695 | 0.884462151 |
| NOT-PTH2 AND TNFRSF19 | 1 | 1 | 1 | NOT-FAM69A AND NUP210 | 0.956349206 | 0.95256917 | 0.960159363 |
| NOT-PTH2 AND SLC35E3 | 1 | 1 | 1 | FLT3 AND NOT-ABCA5 | 0.935817805 | 0.974137931 | 0.900398406 |
| NOT-PTH2 AND PCDHB14 | 1 | 1 | 1 | FLT3 AND NOT-ICMT | 0.938271605 | 0.970212766 | 0.908366534 |
| NOT-PTH2 AND IGDCC4 | 1 | 1 | 1 | FLT3 AND NOT-FOLH1 | 0.944785276 | 0.970588235 | 0.920318725 |
| NOT-PTH2 AND SORT1 | 1 | 1 | 1 | FLT3 AND NOT-NNT | 0.940936864 | 0.9625 | 0.920318725 |
| NOT-PTH2 AND SDC1 | 1 | 1 | 1 | FLT3 AND NOT-MMD | 0.906318083 | 1 | 0.828685259 |
| NOT-PTH2 AND PERP | 1 | 1 | 1 | FLT3 AND NOT-PIGN | 0.940936864 | 0.9625 | 0.920318725 |
| NOT-PTH2 AND TPBG | 1 | 1 | 1 | FLT3 AND NOT-LEMD3 | 0.945606695 | 0.995594714 | 0.900398406 |
| NOT-PTH2 AND TYRP1 | 1 | 1 | 1 | FLT3 AND NOT-RABGAP1 | 0.939958592 | 0.978448276 | 0.90438247 |
| NOT-PTH2 AND COL14A1 | 1 | 1 | 1 | FLT3 AND NOT-TMEM2 | 0.950413223 | 0.987124464 | 0.916334661 |
| NOT-PTH2 AND VCAM1 | 1 | 1 | 1 | FLT3 AND NOT-STX12 | 0.951983299 | 1 | 0.908366534 |
| NOT-PTH2 AND DHRS11 | 1 | 1 | 1 | FLT3 AND NOT-APOL2 | 0.942622951 | 0.970464135 | 0.916334661 |
| NOT-PTH2 AND WLS | 1 | 1 | 1 | FLT3 AND NOT-FJX1 | 0.948665298 | 0.978813559 | 0.920318725 |
| NOT-PTH2 AND PIGZ | 1 | 1 | 1 | FLT3 AND NOT-LCLAT1 | 0.942857143 | 0.966527197 | 0.920318725 |
| TMEM187 AND NOT-PTH2 | 1 | 1 | 1 | FLT3 AND NOT-MFSD8 | 0.948665298 | 0.978813559 | 0.920318725 |
| NOT-PTH2 AND FZD4 | 1 | 1 | 1 | FLT3 AND NOT-BACE2 | 0.948665298 | 0.978813559 | 0.920318725 |
| NOT-PTH2 AND PLVAP | 1 | 1 | 1 | FLT3 AND NOT-TMEM184B | 0.940936864 | 0.9625 | 0.920318725 |
| NOT-PTH2 AND ZNRF3 | 1 | 1 | 1 | FLT3 AND NOT-TMEM186 | 0.954166667 | 1 | 0.912350598 |
| NOT-PTH2 AND C15orf48 | 1 | 1 | 1 | FLT3 AND NOT-ABI3BP | 0.948665298 | 0.978813559 | 0.920318725 |
| NOT-PTH2 AND CNTNAP1 | 1 | 1 | 1 | FLT3 AND NOT-RNF19A | 0.948665298 | 0.978813559 | 0.920318725 |
| NOT-PTH2 AND LY6D | 1 | 1 | 1 | FLT3 AND NOT-C2CD2 | 0.946502058 | 0.978723404 | 0.916334661 |
| NOT-PTH2 AND OSMR | 1 | 1 | 1 | FLT3 AND NOT-UNC50 | 0.925053533 | 1 | 0.860557769 |
| NOT-PTH2 AND REEP6 | 1 | 1 | 1 | FLT3 AND NOT-DHRS7B | 0.913419913 | 1 | 0.84063745 |
| AUP1 AND NOT-CD300A | 1 | 1 | 1 | FLT3 AND NOT-LRIG1 | 0.954545455 | 0.991416309 | 0.920318725 |
| MLANA AND NOT-SCAMP4 | 1 | 1 | 1 | FLT3 AND NOT-TMEM98 | 0.933333333 | 0.978165939 | 0.892430279 |
| CLCN5 AND NOT-GPR182 | 1 | 1 | 1 | FLT3 AND NOT-GLCE | 0.940936864 | 0.9625 | 0.920318725 |
| FDPS AND NOT-GPR182 | 1 | 1 | 1 | FLT3 AND NOT-LRRTM2 | 0.940936864 | 0.9625 | 0.920318725 |
| MLANA AND NOT-GPR182 | 1 | 1 | 1 | FLT3 AND NOT-SEZ6L2 | 0.940936864 | 0.9625 | 0.920318725 |
| NPC1 AND NOT-GPR182 | 1 | 1 | 1 | FLT3 AND NOT-OR7A5 | 0.940936864 | 0.9625 | 0.920318725 |
| MLANA AND MLANA | 1 | 1 | 1 | FLT3 AND NOT-GHR | 0.948665298 | 0.978813559 | 0.920318725 |
| MLANA AND MGAT4A | 1 | 1 | 1 | FLT3 AND NOT-LAMP3 | 0.944785276 | 0.970588235 | 0.920318725 |
| MLANA AND MLANA | 1 | 1 | 1 | FLT3 AND NOT-GLG1 | 0.939203354 | 0.991150442 | 0.892430279 |
| AUP1 AND NOT-TMC6 | 1 | 1 | 1 | FLT3 AND NOT-SLC46A3 | 0.944785276 | 0.970588235 | 0.920318725 |
| PARL AND NOT-TMC6 | 1 | 1 | 1 | FLT3 AND NOT-ANG | 0.940695297 | 0.966386555 | 0.916334661 |
| MLANA AND SLC46A1 | 1 | 1 | 1 | FLT3 AND NOT-GPR18 | 0.947589099 | 1 | 0.900398406 |
| MLANA AND NOT-GLCCI1 | 1 | 1 | 1 | FLT3 AND NOT-CYB561D1 | 0.950617284 | 0.982978723 | 0.920318725 |
| AUP1 AND NOT-GLCCI1 | 1 | 1 | 1 | FLT3 AND NOT-SLC9A9 | 0.954545455 | 0.991416309 | 0.920318725 |
| MLANA AND MLANA | 1 | 1 | 1 | FLT3 AND NOT-PRRT3 | 0.940936864 | 0.9625 | 0.920318725 |
| MLANA AND TMEM106A | 1 | 1 | 1 | FLT3 AND NOT-CYP4V2 | 0.941908714 | 0.982683983 | 0.90438247 |
| FDPS AND NOT-SLC52A3 | 1 | 1 | 1 | FLT3 AND NOT-XKR6 | 0.940936864 | 0.9625 | 0.920318725 |

FIG. 1 (CONT.)

| Antigen Pair Logic | F1 | Precision | Recall | Antigen Pair Logic | F1 | Precision | Recall |
|---|---|---|---|---|---|---|---|
| MLANA AND NOT-SLC52A3 | 1 | 1 | 1 | FLT3 AND NOT-MICU3 | 0.937759336 | 0.978354978 | 0.900398406 |
| FDPS AND NOT-CHRM4 | 1 | 1 | 1 | FLT3 AND NOT-SLC6A16 | 0.940936864 | 0.9625 | 0.920318725 |
| MLANA AND NOT-CHRM4 | 1 | 1 | 1 | FLT3 AND NOT-MAGEH1 | 0.929637527 | 1 | 0.868525896 |
| NPC1 AND NOT-CHRM4 | 1 | 1 | 1 | FLT3 AND NOT-TIMM21 | 0.950207469 | 0.991341991 | 0.912350598 |
| TYRP1 AND NOT-CHRM4 | 1 | 1 | 1 | FLT3 AND NOT-DNAJC15 | 0.933054393 | 0.982378855 | 0.888446215 |
| TMEM187 AND NOT-CHRM4 | 1 | 1 | 1 | FLT3 AND NOT-GRM5 | 0.940936864 | 0.9625 | 0.920318725 |
| FDPS AND NOT-CHRM5 | 1 | 1 | 1 | FLT3 AND NOT-SLC25A4 | 0.942857143 | 0.966527197 | 0.920318725 |
| MLANA AND NOT-CHRM5 | 1 | 1 | 1 | FLT3 AND NOT-GNL2 | 0.901531729 | 1 | 0.820717131 |
| NPC1 AND NOT-CHRM5 | 1 | 1 | 1 | FLT3 AND NOT-ALG6 | 0.931677019 | 0.969827586 | 0.896414343 |
| MLANA AND SFT2D1 | 1 | 1 | 1 | FLT3 AND NOT-SLC2A8 | 0.944558522 | 0.974576271 | 0.916334661 |
| MLANA AND TEX261 | 1 | 1 | 1 | FLT3 AND NOT-GZMK | 0.945378151 | 1 | 0.896414343 |
| MLANA AND NOT-SCRG1 | 1 | 1 | 1 | FLT3 AND NOT-HLA-DQB2 | 0.942857143 | 0.966527197 | 0.920318725 |
| MLANA AND RNF13 | 1 | 1 | 1 | FLT3 AND NOT-HMGCR | 0.956340956 | 1 | 0.916334661 |
| MLANA AND MLANA | 1 | 1 | 1 | FLT3 AND NOT-HMOX2 | 0.954545455 | 0.991416309 | 0.920318725 |
| MLANA AND MLANA | 1 | 1 | 1 | FLT3 AND NOT-ACACB | 0.938271605 | 0.970212766 | 0.908366534 |
| MLANA AND CMTM1 | 1 | 1 | 1 | FLT3 AND NOT-UBAC2 | 0.947589099 | 1 | 0.900398406 |
| NOT-CHRNA2 AND ABHD15 | 1 | 1 | 1 | FLT3 AND NOT-ICAM2 | 0.922746781 | 1 | 0.856573705 |
| NOT-CHRNA2 AND TLCD1 | 1 | 1 | 1 | FLT3 AND NOT-C2orf74 | 0.95257732 | 0.987179487 | 0.920318725 |
| NOT-CHRNA2 AND CLCN5 | 1 | 1 | 1 | FLT3 AND NOT-FAM174A | 0.90712743 | 0.990566038 | 0.836653386 |
| NOT-CHRNA2 AND CPXM2 | 1 | 1 | 1 | FLT3 AND NOT-AMIGO2 | 0.956521739 | 0.995689655 | 0.920318725 |
| NOT-CHRNA2 AND SLC44A3 | 1 | 1 | 1 | FLT3 AND NOT-ZACN | 0.940936864 | 0.9625 | 0.920318725 |
| NOT-CHRNA2 AND TMEM178A | 1 | 1 | 1 | FLT3 AND NOT-IL1R1 | 0.940206186 | 0.974358974 | 0.908366534 |
| NOT-CHRNA2 AND LRRC15 | 1 | 1 | 1 | FLT3 AND NOT-IL11RA | 0.940936864 | 0.9625 | 0.920318725 |
| NOT-CHRNA2 AND TRAM1L1 | 1 | 1 | 1 | FLT3 AND NOT-AQP7 | 0.948453608 | 0.982905983 | 0.916334661 |
| NOT-CHRNA2 AND SLC47A2 | 1 | 1 | 1 | FLT3 AND NOT-ITGAV | 0.943866944 | 0.986956522 | 0.90438247 |
| NOT-CHRNA2 AND APCDD1 | 1 | 1 | 1 | FLT3 AND NOT-ITGB5 | 0.948665298 | 0.978813559 | 0.920318725 |
| NOT-CHRNA2 AND MANEAL | 1 | 1 | 1 | FLT3 AND NOT-SFT2D2 | 0.93220339 | 0.995475113 | 0.876494024 |
| NOT-CHRNA2 AND PROM2 | 1 | 1 | 1 | FLT3 AND NOT-KCNMA1 | 0.948665298 | 0.978813559 | 0.920318725 |
| NOT-CHRNA2 AND ADRA2A | 1 | 1 | 1 | FLT3 AND NOT-KDR | 0.948665298 | 0.978813559 | 0.920318725 |
| NOT-CHRNA2 AND CCDC80 | 1 | 1 | 1 | FLT3 AND NOT-SERP2 | 0.940936864 | 0.9625 | 0.920318725 |
| NOT-CHRNA2 AND ADRA2C | 1 | 1 | 1 | FLT3 AND NOT-SHISA6 | 0.940936864 | 0.9625 | 0.920318725 |
| NOT-CHRNA2 AND ADGRA3 | 1 | 1 | 1 | FLT3 AND NOT-FAM69A | 0.958506224 | 1 | 0.920318725 |
| NOT-CHRNA2 AND DSC3 | 1 | 1 | 1 | FLT3 AND NOT-OR7A10 | 0.940936864 | 0.9625 | 0.920318725 |
| NOT-CHRNA2 AND APLNR | 1 | 1 | 1 | FLT3 AND NOT-C4orf3 | 0.923728814 | 0.986425339 | 0.868525896 |
| NOT-CHRNA2 AND EFNB2 | 1 | 1 | 1 | FLT3 AND NOT-PPAPDC2 | 0.954545455 | 0.991416309 | 0.920318725 |
| NOT-CHRNA2 AND EMP1 | 1 | 1 | 1 | FLT3 AND NOT-LRMP | 0.928571429 | 0.982222222 | 0.880478088 |
| NOT-CHRNA2 AND EMP2 | 1 | 1 | 1 | FLT3 AND NOT-SMAD2 | 0.949790795 | 1 | 0.90438247 |
| NOT-CHRNA2 AND ENG | 1 | 1 | 1 | FLT3 AND CD46 | 0.931677019 | 0.969827586 | 0.896414343 |
| NOT-CHRNA2 AND FAT2 | 1 | 1 | 1 | FLT3 AND NOT-MME | 0.93852459 | 0.966244726 | 0.912350598 |
| FDPS AND NOT-CHRNA2 | 1 | 1 | 1 | FLT3 AND NOT-TMEM41B | 0.929637527 | 1 | 0.868525896 |
| MLANA AND NOT-CHRNA2 | 1 | 1 | 1 | FLT3 AND NOT-MINOS1 | 0.950617284 | 0.982978723 | 0.920318725 |
| NOT-CHRNA2 AND INAFM1 | 1 | 1 | 1 | FLT3 AND NOT-TMEM150C | 0.948665298 | 0.978813559 | 0.920318725 |
| NOT-CHRNA2 AND GABRE | 1 | 1 | 1 | FLT3 AND NOT-NDUFC2 | 0.94214876 | 0.978540773 | 0.908366534 |
| NOT-CHRNA2 AND KIAA1549L | 1 | 1 | 1 | FLT3 AND NOT-NPY | 0.940936864 | 0.9625 | 0.920318725 |
| NOT-CHRNA2 AND ATL3 | 1 | 1 | 1 | FLT3 AND NOT-NPC1 | 0.951983299 | 1 | 0.908366534 |
| NOT-CHRNA2 AND TENM4 | 1 | 1 | 1 | FLT3 AND NOT-OCA2 | 0.940936864 | 0.9625 | 0.920318725 |
| NOT-CHRNA2 AND SUSD5 | 1 | 1 | 1 | FLT3 AND NOT-NSDHL | 0.937759336 | 0.978354978 | 0.900398406 |
| NOT-CHRNA2 AND ABCA12 | 1 | 1 | 1 | FLT3 AND NOT-SLC35B3 | 0.945606695 | 0.995594714 | 0.900398406 |
| NOT-CHRNA2 AND GREM1 | 1 | 1 | 1 | FLT3 AND NOT-NDUFA13 | 0.901960784 | 0.995192308 | 0.824701195 |
| NOT-CHRNA2 AND GJA1 | 1 | 1 | 1 | FLT3 AND NOT-KLHL5 | 0.923728814 | 0.986425339 | 0.868525896 |
| NOT-CHRNA2 AND GJA4 | 1 | 1 | 1 | FLT3 AND NOT-SIDT2 | 0.933333333 | 0.978165939 | 0.892430279 |
| NOT-CHRNA2 AND GPR19 | 1 | 1 | 1 | FLT3 AND NOT-RDH11 | 0.927966102 | 0.990950226 | 0.87250996 |
| NOT-CHRNA2 AND DLL1 | 1 | 1 | 1 | FLT3 AND NOT-INSIG2 | 0.956340956 | 1 | 0.916334661 |
| NOT-CHRNA2 AND GUSB | 1 | 1 | 1 | FLT3 AND NOT-C3orf18 | 0.931392931 | 0.973913043 | 0.892430279 |
| NOT-CHRNA2 AND SLC2A8 | 1 | 1 | 1 | FLT3 AND NOT-TUBD1 | 0.958506224 | 1 | 0.920318725 |
| NOT-CHRNA2 AND HRH1 | 1 | 1 | 1 | FLT3 AND NOT-CRIM1 | 0.948665298 | 0.978813559 | 0.920318725 |
| NOT-CHRNA2 AND GLDN | 1 | 1 | 1 | FLT3 AND NOT-TMEM69 | 0.918803419 | 0.99078341 | 0.856573705 |
| NOT-CHRNA2 AND IFI27 | 1 | 1 | 1 | FLT3 AND NOT-GOLM1 | 0.948665298 | 0.978813559 | 0.920318725 |
| NOT-CHRNA2 AND IL1R1 | 1 | 1 | 1 | FLT3 AND NOT-BFAR | 0.93220339 | 0.995475113 | 0.876494024 |
| NOT-CHRNA2 AND AQP1 | 1 | 1 | 1 | FLT3 AND NOT-TIMMDC1 | 0.950413223 | 0.987124464 | 0.916334661 |
| NOT-CHRNA2 AND IL12B | 1 | 1 | 1 | FLT3 AND NOT-ARMCX1 | 0.926624738 | 0.977876106 | 0.880478088 |
| NOT-CHRNA2 AND JAG2 | 1 | 1 | 1 | FLT3 AND NOT-SLC22A17 | 0.940936864 | 0.9625 | 0.920318725 |
| NOT-CHRNA2 AND KCNJ8 | 1 | 1 | 1 | FLT3 AND NOT-TEX264 | 0.922105263 | 0.977678571 | 0.87250996 |
| NOT-CHRNA2 AND KDR | 1 | 1 | 1 | FLT3 AND NOT-WNT16 | 0.944785276 | 0.970588235 | 0.920318725 |
| NOT-CHRNA2 AND KIT | 1 | 1 | 1 | FLT3 AND NOT-TMEM138 | 0.940936864 | 0.9625 | 0.920318725 |
| NOT-CHRNA2 AND SERP2 | 1 | 1 | 1 | FLT3 AND NOT-FKBP7 | 0.93877551 | 0.962343096 | 0.916334661 |
| NOT-CHRNA2 AND TMEM220 | 1 | 1 | 1 | FLT3 AND NOT-ENPP2 | 0.948665298 | 0.978813559 | 0.920318725 |
| NOT-CHRNA2 AND SAMD5 | 1 | 1 | 1 | FLT3 AND NOT-ACSL5 | 0.948024948 | 0.991304348 | 0.908366534 |
| NOT-CHRNA2 AND FADS3 | 1 | 1 | 1 | FLT3 AND NOT-EMCN | 0.948665298 | 0.978813559 | 0.920318725 |
| NOT-CHRNA2 AND TSPAN11 | 1 | 1 | 1 | FLT3 AND NOT-ATP8B1 | 0.948665298 | 0.978813559 | 0.920318725 |
| NOT-CHRNA2 AND ATP1A1 | 1 | 1 | 1 | FLT3 AND NOT-PFN2 | 0.948665298 | 0.978813559 | 0.920318725 |
| NPC1 AND NOT-CHRNA2 | 1 | 1 | 1 | FLT3 AND NOT-PLA2G2A | 0.93877551 | 0.962343096 | 0.916334661 |
| NOT-CHRNA2 AND ROR1 | 1 | 1 | 1 | FLT3 AND NOT-IL17D | 0.940936864 | 0.9625 | 0.920318725 |
| NOT-CHRNA2 AND NSDHL | 1 | 1 | 1 | FLT3 AND NOT-FXYD1 | 0.942857143 | 0.966527197 | 0.920318725 |
| NOT-CHRNA2 AND NTM | 1 | 1 | 1 | FLT3 AND NOT-PLOD2 | 0.944329897 | 0.978632479 | 0.912350598 |
| NOT-CHRNA2 AND CDON | 1 | 1 | 1 | FLT3 AND NOT-PLP1 | 0.940936864 | 0.9625 | 0.920318725 |

FIG. 1 (CONT.)

| Antigen Pair Logic | F1 | Precision | Recall | Antigen Pair Logic | F1 | Precision | Recall |
|---|---|---|---|---|---|---|---|
| NOT-CHRNA2 AND ARMCX1 | 1 | 1 | 1 | FLT3 AND NOT-PLXNA1 | 0.940936864 | 0.9625 | 0.920318725 |
| NOT-CHRNA2 AND PDGFRA | 1 | 1 | 1 | FLT3 AND NOT-PLXNA2 | 0.940936864 | 0.9625 | 0.920318725 |
| NOT-CHRNA2 AND FKBP7 | 1 | 1 | 1 | FLT3 AND NOT-PMP22 | 0.946502058 | 0.978723404 | 0.916334661 |
| NOT-CHRNA2 AND SERPINB13 | 1 | 1 | 1 | FLT3 AND NOT-FXYD6 | 0.937759336 | 0.978354978 | 0.900398406 |
| NOT-CHRNA2 AND PMP22 | 1 | 1 | 1 | FLT3 AND NOT-ACP2 | 0.933884298 | 0.969957082 | 0.900398406 |
| NOT-CHRNA2 AND IL20RB | 1 | 1 | 1 | FLT3 AND NOT-PODXL | 0.948665298 | 0.978813559 | 0.920318725 |
| NOT-CHRNA2 AND PCDH18 | 1 | 1 | 1 | FLT3 AND NOT-GDAP1 | 0.948665298 | 0.978813559 | 0.920318725 |
| NOT-CHRNA2 AND ANO10 | 1 | 1 | 1 | FLT3 AND NOT-YIPF1 | 0.901960784 | 0.995192308 | 0.824701195 |
| NOT-CHRNA2 AND RMDN3 | 1 | 1 | 1 | FLT3 AND NOT-TMX3 | 0.947807933 | 0.995614035 | 0.90438247 |
| NOT-CHRNA2 AND SLC47A1 | 1 | 1 | 1 | FLT3 AND NOT-ZDHHC13 | 0.940451745 | 0.970338983 | 0.912350598 |
| NOT-CHRNA2 AND TMEM63B | 1 | 1 | 1 | FLT3 AND NOT-CRLS1 | 0.944099379 | 0.982758621 | 0.908366534 |
| NOT-CHRNA2 AND LGR4 | 1 | 1 | 1 | FLT3 AND NOT-WBP1L | 0.913793103 | 0.995305164 | 0.844621514 |
| NOT-CHRNA2 AND SLC35E3 | 1 | 1 | 1 | FLT3 AND NOT-RNF43 | 0.940936864 | 0.9625 | 0.920318725 |
| NOT-CHRNA2 AND ACSS2 | 1 | 1 | 1 | FLT3 AND NOT-SEMA4C | 0.928870293 | 0.977973568 | 0.884462151 |
| NOT-CHRNA2 AND PCDHB14 | 1 | 1 | 1 | FLT3 AND NOT-OCIAD1 | 0.93877551 | 0.962343096 | 0.916334661 |
| NOT-CHRNA2 AND GKN1 | 1 | 1 | 1 | FLT3 AND NOT-BANP | 0.943157895 | 1 | 0.892430279 |
| NOT-CHRNA2 AND TMEM27 | 1 | 1 | 1 | FLT3 AND NOT-SLC35A5 | 0.918103448 | 1 | 0.848605578 |
| NOT-CHRNA2 AND IGDCC4 | 1 | 1 | 1 | FLT3 AND NOT-TMEM248 | 0.936440678 | 1 | 0.880478088 |
| NOT-CHRNA2 AND ROBO2 | 1 | 1 | 1 | FLT3 AND NOT-PRPF38B | 0.937759336 | 0.978354978 | 0.900398406 |
| NOT-CHRNA2 AND SORT1 | 1 | 1 | 1 | FLT3 AND NOT-LRRC8D | 0.935010482 | 0.986725664 | 0.888446215 |
| NOT-CHRNA2 AND BDNF | 1 | 1 | 1 | FLT3 AND NOT-SLC38A7 | 0.940936864 | 0.9625 | 0.920318725 |
| NOT-CHRNA2 AND SCN4B | 1 | 1 | 1 | FLT3 AND NOT-SIRPG | 0.952182952 | 0.995652174 | 0.912350598 |
| NOT-CHRNA2 AND SDC1 | 1 | 1 | 1 | FLT3 AND NOT-SLC35E3 | 0.927659574 | 0.99543379 | 0.868525896 |
| NOT-CHRNA2 AND PERP | 1 | 1 | 1 | FLT3 AND NOT-VEZT | 0.935010482 | 0.986725664 | 0.888446215 |
| NOT-CHRNA2 AND ADGRL4 | 1 | 1 | 1 | FLT3 AND NOT-CARKD | 0.938689218 | 1 | 0.884462151 |
| NOT-CHRNA2 AND CDH24 | 1 | 1 | 1 | FLT3 AND NOT-COA1 | 0.918803419 | 0.99078341 | 0.856573705 |
| NOT-CHRNA2 AND SLC7A2 | 1 | 1 | 1 | FLT3 AND NOT-SAYSD1 | 0.946721311 | 0.974683544 | 0.920318725 |
| NOT-CHRNA2 AND SLC15A1 | 1 | 1 | 1 | FLT3 AND NOT-ERMARD | 0.944558522 | 0.974576271 | 0.916334661 |
| NOT-CHRNA2 AND TIE1 | 1 | 1 | 1 | FLT3 AND NOT-PAG1 | 0.948240166 | 0.987068966 | 0.912350598 |
| NOT-CHRNA2 AND TSPAN7 | 1 | 1 | 1 | FLT3 AND NOT-ECHDC1 | 0.925053533 | 1 | 0.860557769 |
| NOT-CHRNA2 AND TPBG | 1 | 1 | 1 | FLT3 AND NOT-AXL | 0.944329897 | 0.978632479 | 0.912350598 |
| NOT-CHRNA2 AND TYRO3 | 1 | 1 | 1 | FLT3 AND NOT-ALG1 | 0.944558522 | 0.974576271 | 0.916334661 |
| NOT-CHRNA2 AND TYRP1 | 1 | 1 | 1 | FLT3 AND NOT-ANKH | 0.940936864 | 0.9625 | 0.920318725 |
| NOT-CHRNA2 AND COL14A1 | 1 | 1 | 1 | FLT3 AND NOT-PROS1 | 0.944099379 | 0.982758621 | 0.908366534 |
| NOT-CHRNA2 AND VCAM1 | 1 | 1 | 1 | FLT3 AND NOT-DIABLO | 0.901960784 | 0.995192308 | 0.824701195 |
| NOT-CHRNA2 AND XG | 1 | 1 | 1 | FLT3 AND NOT-CLDND1 | 0.95257732 | 0.987179487 | 0.920318725 |
| NOT-CHRNA2 AND PTTG1IP | 1 | 1 | 1 | FLT3 AND NOT-MDM1 | 0.93852459 | 0.966244726 | 0.912350598 |
| NOT-CHRNA2 AND FZD5 | 1 | 1 | 1 | FLT3 AND NOT-PMEPA1 | 0.944558522 | 0.974576271 | 0.916334661 |
| NOT-CHRNA2 AND SEMA3B | 1 | 1 | 1 | FLT3 AND NOT-CEACAM19 | 0.940936864 | 0.9625 | 0.920318725 |
| NOT-CHRNA2 AND DHRS11 | 1 | 1 | 1 | FLT3 AND NOT-MAN1C1 | 0.95257732 | 0.987179487 | 0.920318725 |
| NOT-CHRNA2 AND TMEM231 | 1 | 1 | 1 | FLT3 AND NOT-SMIM8 | 0.942857143 | 0.966527197 | 0.920318725 |
| NOT-CHRNA2 AND EPHX3 | 1 | 1 | 1 | FLT3 AND NOT-NIPAL3 | 0.942857143 | 0.966527197 | 0.920318725 |
| NOT-CHRNA2 AND THSD4 | 1 | 1 | 1 | FLT3 AND NOT-ATP10D | 0.93418259 | 1 | 0.876494024 |
| NOT-CHRNA2 AND WLS | 1 | 1 | 1 | FLT3 AND NOT-SLC45A4 | 0.935550936 | 0.97826087 | 0.896414343 |
| NOT-CHRNA2 AND CWH43 | 1 | 1 | 1 | FLT3 AND NOT-MRS2 | 0.944558522 | 0.974576271 | 0.916334661 |
| NOT-CHRNA2 AND PIGZ | 1 | 1 | 1 | FLT3 AND NOT-ABHD6 | 0.948665298 | 0.978813559 | 0.920318725 |
| NOT-CHRNA2 AND COLEC12 | 1 | 1 | 1 | FLT3 AND NOT-RNF150 | 0.946502058 | 0.978723404 | 0.916334661 |
| TMEM187 AND NOT-CHRNA2 | 1 | 1 | 1 | FLT3 AND NOT-KIAA1467 | 0.940936864 | 0.9625 | 0.920318725 |
| NOT-CHRNA2 AND FZD4 | 1 | 1 | 1 | FLT3 AND NOT-PTN | 0.948665298 | 0.978813559 | 0.920318725 |
| NOT-CHRNA2 AND FZD6 | 1 | 1 | 1 | FLT3 AND NOT-GPR107 | 0.940936864 | 0.9625 | 0.920318725 |
| NOT-CHRNA2 AND FZD7 | 1 | 1 | 1 | FLT3 AND NOT-WDR19 | 0.940936864 | 0.9625 | 0.920318725 |
| NOT-CHRNA2 AND PLVAP | 1 | 1 | 1 | FLT3 AND NOT-SCUBE2 | 0.948665298 | 0.978813559 | 0.920318725 |
| NOT-CHRNA2 AND ZNRF3 | 1 | 1 | 1 | FLT3 AND NOT-PTPRM | 0.948665298 | 0.978813559 | 0.920318725 |
| NOT-CHRNA2 AND C15orf48 | 1 | 1 | 1 | FLT3 AND NOT-PTPRS | 0.940936864 | 0.9625 | 0.920318725 |
| NOT-CHRNA2 AND CNTNAP1 | 1 | 1 | 1 | FLT3 AND NOT-PTPRZ1 | 0.946721311 | 0.974683544 | 0.920318725 |
| NOT-CHRNA2 AND CAV1 | 1 | 1 | 1 | FLT3 AND NOT-SRPRB | 0.94214876 | 0.978540773 | 0.908366534 |
| NOT-CHRNA2 AND LY6D | 1 | 1 | 1 | FLT3 AND NOT-JAM2 | 0.940936864 | 0.9625 | 0.920318725 |
| NOT-CHRNA2 AND SEMA5A | 1 | 1 | 1 | FLT3 AND NOT-BBS4 | 0.927966102 | 0.990950226 | 0.87250996 |
| NOT-CHRNA2 AND DUOXA1 | 1 | 1 | 1 | FLT3 AND NOT-RARRES3 | 0.949790795 | 1 | 0.90438247 |
| NOT-CHRNA2 AND KCNQ4 | 1 | 1 | 1 | FLT3 AND NOT-EVA1C | 0.947807933 | 0.995614035 | 0.90438247 |
| NOT-CHRNA2 AND OSMR | 1 | 1 | 1 | FLT3 AND NOT-BCL2L2 | 0.940936864 | 0.9625 | 0.920318725 |
| NOT-CHRNA2 AND DSEL | 1 | 1 | 1 | NOT-FLT3 AND RHAG | 0.940952381 | 0.901459854 | 0.984063745 |
| NOT-CHRNA2 AND CDHR1 | 1 | 1 | 1 | NOT-FLT3 AND RHCE | 0.939805825 | 0.916666667 | 0.964143426 |
| NOT-CHRNA2 AND G6PC3 | 1 | 1 | 1 | FLT3 AND NOT-RNASE1 | 0.937759336 | 0.978354978 | 0.900398406 |
| NOT-CHRNA2 AND REEP6 | 1 | 1 | 1 | FLT3 AND NOT-RTN1 | 0.954545455 | 0.991416309 | 0.920318725 |
| NOT-CHRNA2 AND CLCA2 | 1 | 1 | 1 | FLT3 AND NOT-RYR1 | 0.940936864 | 0.9625 | 0.920318725 |
| NOT-CHRNA2 AND CD63 | 1 | 1 | 1 | FLT3 AND NOT-SCNN1G | 0.940936864 | 0.9625 | 0.920318725 |
| MLANA AND CYP2U1 | 1 | 1 | 1 | FLT3 AND NOT-CX3CL1 | 0.940936864 | 0.9625 | 0.920318725 |
| FDPS AND NOT-FDPS | 1 | 1 | 1 | FLT3 AND NOT-THADA | 0.944785276 | 0.970588235 | 0.920318725 |
| MLANA AND MLANA | 1 | 1 | 1 | FLT3 AND NOT-MANBAL | 0.945378151 | 1 | 0.896414343 |
| MLANA AND SDSL | 1 | 1 | 1 | FLT3 AND NOT-GALNT11 | 0.934736842 | 0.991071429 | 0.884462151 |
| MLANA AND NOT-CHRNA3 | 1 | 1 | 1 | FLT3 AND NOT-TMBIM1 | 0.914893617 | 0.98173516 | 0.856573705 |
| CLCN5 AND NOT-CHRNA4 | 1 | 1 | 1 | FLT3 AND NOT-ADGRL4 | 0.937759336 | 0.978354978 | 0.900398406 |
| FDPS AND NOT-CHRNA4 | 1 | 1 | 1 | FLT3 AND NOT-XYLT2 | 0.940936864 | 0.9625 | 0.920318725 |
| MLANA AND NOT-CHRNA4 | 1 | 1 | 1 | FLT3 AND NOT-SMIM15 | 0.925690021 | 0.990909091 | 0.868525896 |
| NPC1 AND NOT-CHRNA4 | 1 | 1 | 1 | FLT3 AND NOT-CDH22 | 0.940936864 | 0.9625 | 0.920318725 |

FIG. 1 (CONT.)

| Antigen Pair Logic | F1 | Precision | Recall | Antigen Pair Logic | F1 | Precision | Recall |
|---|---|---|---|---|---|---|---|
| MLANA AND MLANA | 1 | 1 | 1 | FLT3 AND NOT-ZDHHC6 | 0.927966102 | 0.990950226 | 0.87250996 |
| MLANA AND NOT-ADCY7 | 1 | 1 | 1 | FLT3 AND NOT-LMF1 | 0.940936864 | 0.9625 | 0.920318725 |
| FDPS AND CHRNB1 | 1 | 1 | 1 | FLT3 AND NOT-CASD1 | 0.95257732 | 0.987179487 | 0.920318725 |
| MLANA AND MLANA | 1 | 1 | 1 | FLT3 AND NOT-TMEM237 | 0.940936864 | 0.9625 | 0.920318725 |
| CLCN5 AND NOT-SIGLEC11 | 1 | 1 | 1 | FLT3 AND NOT-SLC1A6 | 0.940936864 | 0.9625 | 0.920318725 |
| MLANA AND NOT-SIGLEC11 | 1 | 1 | 1 | FLT3 AND NOT-SLC3A1 | 0.940451745 | 0.970338983 | 0.912350598 |
| NPC1 AND NOT-SIGLEC11 | 1 | 1 | 1 | FLT3 AND NOT-SLC8A3 | 0.940936864 | 0.9625 | 0.920318725 |
| SLC35E3 AND NOT-SIGLEC11 | 1 | 1 | 1 | FLT3 AND NOT-SLC22A5 | 0.940936864 | 0.9625 | 0.920318725 |
| TMEM187 AND NOT-SIGLEC11 | 1 | 1 | 1 | FLT3 AND NOT-SLN | 0.940936864 | 0.9625 | 0.920318725 |
| MLANA AND SLC2A13 | 1 | 1 | 1 | FLT3 AND NOT-GRAMD3 | 0.946502058 | 0.978723404 | 0.916334661 |
| MLANA AND NOT-CHRNB2 | 1 | 1 | 1 | FLT3 AND NOT-BMPR2 | 0.950413223 | 0.987124464 | 0.916334661 |
| MLANA AND NOT-CHRNB3 | 1 | 1 | 1 | FLT3 AND NOT-DST | 0.946502058 | 0.978723404 | 0.916334661 |
| NPC1 AND NOT-CHRNB3 | 1 | 1 | 1 | FLT3 AND NOT-SRD5A1 | 0.935281837 | 0.98245614 | 0.892430279 |
| FDPS AND CHRNB4 | 1 | 1 | 1 | FLT3 AND NOT-SSR1 | 0.922746781 | 1 | 0.856573705 |
| MLANA AND NOT-CHRNB4 | 1 | 1 | 1 | FLT3 AND NOT-BST2 | 0.911062907 | 1 | 0.836653386 |
| FDPS AND NOT-CHRND | 1 | 1 | 1 | FLT3 AND NOT-TEK | 0.948665298 | 0.978813559 | 0.920318725 |
| MLANA AND NOT-CHRND | 1 | 1 | 1 | FLT3 AND NOT-TGFB3 | 0.940936864 | 0.9625 | 0.920318725 |
| MLANA AND NOT-MAL2 | 1 | 1 | 1 | FLT3 AND NOT-SEC62 | 0.956340956 | 1 | 0.916334661 |
| NPC1 AND MAL2 | 1 | 1 | 1 | FLT3 AND NOT-TSPAN6 | 0.948665298 | 0.978813559 | 0.920318725 |
| AUP1 AND MAL2 | 1 | 1 | 1 | FLT3 AND NOT-GPR137B | 0.906318083 | 1 | 0.828685259 |
| PARL AND MAL2 | 1 | 1 | 1 | FLT3 AND NOT-CLDN5 | 0.948665298 | 0.978813559 | 0.920318725 |
| MLANA AND NOT-SLC22A9 | 1 | 1 | 1 | FLT3 AND NOT-TNFRSF1A | 0.923076923 | 0.995391705 | 0.860557769 |
| FDPS AND NOT-CHRNE | 1 | 1 | 1 | FLT3 AND NOT-TRPC1 | 0.944329897 | 0.978632479 | 0.912350598 |
| MLANA AND NOT-CHRNE | 1 | 1 | 1 | FLT3 AND NOT-TYRP1 | 0.940936864 | 0.9625 | 0.920318725 |
| MLANA AND NOT-ERMAP | 1 | 1 | 1 | FLT3 AND NOT-TRPV1 | 0.940936864 | 0.9625 | 0.920318725 |
| MLANA AND MLANA | 1 | 1 | 1 | FLT3 AND NOT-VRK2 | 0.926315789 | 0.982142857 | 0.876494024 |
| FDPS AND NOT-CHRNG | 1 | 1 | 1 | FLT3 AND NOT-ZNF7 | 0.946502058 | 0.978723404 | 0.916334661 |
| MLANA AND NOT-CHRNG | 1 | 1 | 1 | FLT3 AND NOT-LRP8 | 0.940936864 | 0.9625 | 0.920318725 |
| FDPS AND PKD1L2 | 1 | 1 | 1 | FLT3 AND NOT-PVRIG | 0.948453608 | 0.982905983 | 0.916334661 |
| MLANA AND MLANA | 1 | 1 | 1 | FLT3 AND NOT-ELOVL6 | 0.93877551 | 0.962343096 | 0.916334661 |
| MLANA AND NOT-LMTK3 | 1 | 1 | 1 | FLT3 AND NOT-TMEM109 | 0.947807933 | 0.995614035 | 0.90438247 |
| MLANA AND MLANA | 1 | 1 | 1 | FLT3 AND NOT-SMIM7 | 0.936440678 | 1 | 0.880478088 |
| MLANA AND NOT-XKR4 | 1 | 1 | 1 | FLT3 AND NOT-FAM134A | 0.935817805 | 0.974137931 | 0.900398406 |
| MLANA AND MLANA | 1 | 1 | 1 | FLT3 AND NOT-FA2H | 0.940936864 | 0.9625 | 0.920318725 |
| MLANA AND NOT-ELFN2 | 1 | 1 | 1 | FLT3 AND NOT-SLC39A7 | 0.938271605 | 0.970212766 | 0.908366534 |
| FDPS AND NOT-SLITRK1 | 1 | 1 | 1 | FLT3 AND NOT-TTC13 | 0.956340956 | 1 | 0.916334661 |
| MLANA AND NOT-SLITRK1 | 1 | 1 | 1 | FLT3 AND NOT-TMEM231 | 0.946721311 | 0.974683544 | 0.920318725 |
| MLANA AND NOT-TMEM200A | 1 | 1 | 1 | FLT3 AND NOT-RNF128 | 0.940936864 | 0.9625 | 0.920318725 |
| CLCN5 AND NOT-GALNT13 | 1 | 1 | 1 | FLT3 AND NOT-FAT4 | 0.948665298 | 0.978813559 | 0.920318725 |
| FDPS AND NOT-GALNT13 | 1 | 1 | 1 | FLT3 AND NOT-C3orf52 | 0.942857143 | 0.966527197 | 0.920318725 |
| MLANA AND NOT-GALNT13 | 1 | 1 | 1 | FLT3 AND NOT-CCDC51 | 0.94092827 | 1 | 0.888446215 |
| NPC1 AND NOT-GALNT13 | 1 | 1 | 1 | FLT3 AND NOT-FZD3 | 0.940936864 | 0.9625 | 0.920318725 |
| TYRP1 AND NOT-GALNT13 | 1 | 1 | 1 | FLT3 AND NOT-TXNDC15 | 0.936440678 | 1 | 0.880478088 |
| TMEM187 AND NOT-GALNT13 | 1 | 1 | 1 | FLT3 AND NOT-C12orf49 | 0.946721311 | 0.974683544 | 0.920318725 |
| MLANA AND SORCS1 | 1 | 1 | 1 | FLT3 AND NOT-UBA5 | 0.924369748 | 0.977777778 | 0.876494024 |
| MLANA AND MLANA | 1 | 1 | 1 | FLT3 AND NOT-PAQR6 | 0.940936864 | 0.9625 | 0.920318725 |
| FDPS AND NOT-FDPS | 1 | 1 | 1 | FLT3 AND NOT-ELOVL7 | 0.939958592 | 0.978448276 | 0.90438247 |
| MLANA AND MLANA | 1 | 1 | 1 | FLT3 AND NOT-MYCT1 | 0.94214876 | 0.978540773 | 0.908366534 |
| MLANA AND MLANA | 1 | 1 | 1 | FLT3 AND NOT-TMEM134 | 0.929936306 | 0.995454545 | 0.87250996 |
| MLANA AND MLANA | 1 | 1 | 1 | FLT3 AND NOT-ALPK1 | 0.940936864 | 0.9625 | 0.920318725 |
| MLANA AND MLANA | 1 | 1 | 1 | FLT3 AND NOT-PAAF1 | 0.935817805 | 0.974137931 | 0.900398406 |
| MLANA AND NOT-VASN | 1 | 1 | 1 | FLT3 AND NOT-PIGZ | 0.940936864 | 0.9625 | 0.920318725 |
| MLANA AND NOT-SLC26A9 | 1 | 1 | 1 | FLT3 AND NOT-SLC35F5 | 0.937759336 | 0.978354978 | 0.900398406 |
| FDPS AND NOT-SLC26A7 | 1 | 1 | 1 | FLT3 AND NOT-ADAM33 | 0.940936864 | 0.9625 | 0.920318725 |
| MLANA AND NOT-SLC26A7 | 1 | 1 | 1 | FLT3 AND NOT-LY6G6C | 0.940936864 | 0.9625 | 0.920318725 |
| MLANA AND SLC25A26 | 1 | 1 | 1 | FLT3 AND NOT-SSPN | 0.935550936 | 0.97826087 | 0.896414343 |
| NOT-PMEL AND SLC25A26 | 1 | 1 | 1 | FLT3 AND NOT-FXR1 | 0.942857143 | 0.966527197 | 0.920318725 |
| MLANA AND MLANA | 1 | 1 | 1 | FLT3 AND NOT-CLPTM1L | 0.941422594 | 0.991189427 | 0.896414343 |
| PARL AND NOT-FCRL1 | 1 | 1 | 1 | FLT3 AND NOT-ITFG1 | 0.946502058 | 0.978723404 | 0.916334661 |
| MLANA AND FCRL3 | 1 | 1 | 1 | FLT3 AND NOT-VWA9 | 0.948240166 | 0.987068966 | 0.912350598 |
| FDPS AND NOT-SLC5A11 | 1 | 1 | 1 | FLT3 AND NOT-APOLD1 | 0.944329897 | 0.978632479 | 0.912350598 |
| MLANA AND NOT-SLC5A11 | 1 | 1 | 1 | FLT3 AND NOT-NIPA2 | 0.936440678 | 1 | 0.880478088 |
| NPC1 AND NOT-SLC5A11 | 1 | 1 | 1 | FLT3 AND NOT-TMEM163 | 0.940206186 | 0.974358974 | 0.908366534 |
| FDPS AND NOT-TNFRSF13C | 1 | 1 | 1 | FLT3 AND NOT-CANX | 0.924686192 | 0.973568282 | 0.880478088 |
| MLANA AND NOT-TNFRSF13C | 1 | 1 | 1 | FLT3 AND NOT-FZD7 | 0.940936864 | 0.9625 | 0.920318725 |
| NPC1 AND NOT-TNFRSF13C | 1 | 1 | 1 | FLT3 AND NOT-SLC10A7 | 0.956521739 | 0.995689655 | 0.920318725 |
| TMEM187 AND NOT-TNFRSF13C | 1 | 1 | 1 | FLT3 AND NOT-ZNRF3 | 0.940936864 | 0.9625 | 0.920318725 |
| FDPS AND NOT-EVI5L | 1 | 1 | 1 | FLT3 AND NOT-STX7 | 0.954166667 | 1 | 0.912350598 |
| MLANA AND NOT-EVI5L | 1 | 1 | 1 | FLT3 AND NOT-SLC37A3 | 0.946721311 | 0.974683544 | 0.920318725 |
| NPC1 AND NOT-EVI5L | 1 | 1 | 1 | FLT3 AND NOT-DNAJC30 | 0.946280992 | 0.982832618 | 0.912350598 |
| MLANA AND MLANA | 1 | 1 | 1 | FLT3 AND NOT-FAM213A | 0.937759336 | 0.978354978 | 0.900398406 |
| MLANA AND LYSMD3 | 1 | 1 | 1 | FLT3 AND NOT-TMEM246 | 0.940936864 | 0.9625 | 0.920318725 |
| FDPS AND NOT-SLC22A12 | 1 | 1 | 1 | FLT3 AND NOT-TMEM101 | 0.948453608 | 0.982905983 | 0.916334661 |
| MLANA AND NOT-SLC22A12 | 1 | 1 | 1 | FLT3 AND NOT-ZNF559 | 0.948024948 | 0.991304348 | 0.908366534 |
| MLANA AND FAM210B | 1 | 1 | 1 | FLT3 AND NOT-ACSS1 | 0.919831224 | 0.977578475 | 0.868525896 |
| MLANA AND NOT-CYYR1 | 1 | 1 | 1 | FLT3 AND NOT-ST6GAL2 | 0.940936864 | 0.9625 | 0.920318725 |

FIG. 1 (CONT.)

| Antigen Pair Logic | F1 | Precision | Recall |
|---|---|---|---|
| MLANA AND NOT-CMTM5 | 1 | 1 | 1 |
| NOT-CD300LB AND ABHD15 | 1 | 1 | 1 |
| NOT-FCN2 AND ABHD15 | 1 | 1 | 1 |
| FDPS AND ABHD15 | 1 | 1 | 1 |
| MLANA AND ABHD15 | 1 | 1 | 1 |
| NOT-TMEM105 AND ABHD15 | 1 | 1 | 1 |
| NOT-TMEM150B AND ABHD15 | 1 | 1 | 1 |
| NPC1 AND ABHD15 | 1 | 1 | 1 |
| NOT-SLC4A1 AND ABHD15 | 1 | 1 | 1 |
| NOT-ACKR2 AND TLCD1 | 1 | 1 | 1 |
| NOT-CD300LB AND TLCD1 | 1 | 1 | 1 |
| NOT-SYT2 AND TLCD1 | 1 | 1 | 1 |
| NOT-PROKR2 AND TLCD1 | 1 | 1 | 1 |
| NOT-CLDN7 AND TLCD1 | 1 | 1 | 1 |
| NOT-SLC34A3 AND TLCD1 | 1 | 1 | 1 |
| NOT-ISM2 AND TLCD1 | 1 | 1 | 1 |
| NOT-ODF4 AND TLCD1 | 1 | 1 | 1 |
| NOT-CLDN19 AND TLCD1 | 1 | 1 | 1 |
| NOT-CYP2A6 AND TLCD1 | 1 | 1 | 1 |
| NOT-MFSD6L AND TLCD1 | 1 | 1 | 1 |
| NOT-DNAH10 AND TLCD1 | 1 | 1 | 1 |
| NOT-FCN2 AND TLCD1 | 1 | 1 | 1 |
| MLANA AND MLANA | 1 | 1 | 1 |
| NOT-FSHR AND TLCD1 | 1 | 1 | 1 |
| NOT-FUT6 AND TLCD1 | 1 | 1 | 1 |
| NOT-CALHM1 AND TLCD1 | 1 | 1 | 1 |
| NOT-OR2F1 AND TLCD1 | 1 | 1 | 1 |
| NOT-OR10J1 AND TLCD1 | 1 | 1 | 1 |
| NOT-GIPR AND TLCD1 | 1 | 1 | 1 |
| NOT-AMHR2 AND TLCD1 | 1 | 1 | 1 |
| NOT-NOX1 AND TLCD1 | 1 | 1 | 1 |
| NOT-CACNG5 AND TLCD1 | 1 | 1 | 1 |
| NOT-CACNG4 AND TLCD1 | 1 | 1 | 1 |
| NOT-GLP1R AND TLCD1 | 1 | 1 | 1 |
| NOT-GLRA2 AND TLCD1 | 1 | 1 | 1 |
| NOT-GP2 AND TLCD1 | 1 | 1 | 1 |
| NOT-B4GALNT3 AND TLCD1 | 1 | 1 | 1 |
| NOT-TMEM105 AND TLCD1 | 1 | 1 | 1 |
| NOT-TMEM150B AND TLCD1 | 1 | 1 | 1 |
| NOT-FFAR2 AND TLCD1 | 1 | 1 | 1 |
| Lymphoma, Large-Cell, Anaplastic (Anaplastic Lymphoma) | | | |
| TNFRSF8 AND NOT-GPC3 | 0.928571429 | 1 | 0.866666667 |
| TNFRSF8 AND NOT-L1CAM | 0.933333333 | 0.93333333 | 0.933333333 |
| TNFRSF8 AND NOT-SDC1 | 0.933333333 | 0.93333333 | 0.933333333 |
| TNFRSF8 AND NOT-TNFRSF10A | 0.965517241 | 1 | 0.933333333 |
| TNFRSF8 AND NOT-ERBB2 | 0.965517241 | 1 | 0.933333333 |
| TNFRSF8 AND NOT-IL11RA | 0.933333333 | 0.93333333 | 0.933333333 |
| TNFRSF8 AND NOT-SYT15 | 0.933333333 | 0.93333333 | 0.933333333 |
| TNFRSF8 AND NOT-CYP4F2 | 0.933333333 | 0.93333333 | 0.933333333 |
| TNFRSF8 AND NOT-KCNK13 | 0.933333333 | 0.93333333 | 0.933333333 |
| TNFRSF8 AND NOT-NTN1 | 0.933333333 | 0.93333333 | 0.933333333 |
| TNFRSF8 AND NOT-GGCX | 0.933333333 | 0.93333333 | 0.933333333 |
| TNFRSF8 AND NOT-ANO4 | 0.933333333 | 0.93333333 | 0.933333333 |
| TNFRSF8 AND NOT-CGA | 0.933333333 | 0.93333333 | 0.933333333 |
| TNFRSF8 AND NOT-HYAL4 | 0.933333333 | 0.93333333 | 0.933333333 |
| TNFRSF8 AND NOT-TMEM231 | 0.933333333 | 0.93333333 | 0.933333333 |
| TNFRSF8 AND NOT-AGPAT4 | 0.933333333 | 0.93333333 | 0.933333333 |
| TNFRSF8 AND NOT-FGFR4 | 0.933333333 | 0.93333333 | 0.933333333 |
| TNFRSF8 AND NOT-ITGA11 | 0.933333333 | 0.93333333 | 0.933333333 |
| TNFRSF8 AND NOT-OR7C2 | 0.933333333 | 0.93333333 | 0.933333333 |
| TNFRSF8 AND NOT-DNASE1 | 0.933333333 | 0.93333333 | 0.933333333 |
| TNFRSF8 AND NOT-CD151 | 0.933333333 | 0.93333333 | 0.933333333 |
| TNFRSF8 AND NOT-NPC1L1 | 0.933333333 | 0.93333333 | 0.933333333 |
| TNFRSF8 AND NOT-CMTM3 | 0.933333333 | 0.93333333 | 0.933333333 |
| TNFRSF8 AND NOT-LRRTM2 | 0.933333333 | 0.93333333 | 0.933333333 |
| TNFRSF8 AND NOT-TMEM169 | 0.965517241 | 1 | 0.933333333 |
| TNFRSF8 AND NOT-MMP24 | 0.933333333 | 0.93333333 | 0.933333333 |
| TNFRSF8 AND NOT-LRTOMT | 0.933333333 | 0.93333333 | 0.933333333 |
| TNFRSF8 AND NOT-PAQR6 | 0.933333333 | 0.93333333 | 0.933333333 |
| TNFRSF8 AND NOT-PTPRH | 0.933333333 | 0.93333333 | 0.933333333 |
| TNFRSF8 AND NOT-FAM69A | 0.933333333 | 0.93333333 | 0.933333333 |
| TNFRSF8 AND NOT-DKKL1 | 0.933333333 | 0.93333333 | 0.933333333 |
| TNFRSF8 AND NOT-OR7A17 | 0.933333333 | 0.93333333 | 0.933333333 |
| TNFRSF8 AND NOT-ITIH1 | 0.933333333 | 0.93333333 | 0.933333333 |
| TNFRSF8 AND NOT-PTAFR | 0.965517241 | 1 | 0.933333333 |
| TNFRSF8 AND NOT-KIR2DL3 | 0.933333333 | 0.93333333 | 0.933333333 |

| Antigen Pair Logic | F1 | Precision | Recall |
|---|---|---|---|
| FLT3 AND NOT-HIATL1 | 0.950207469 | 0.991341991 | 0.912350598 |
| FLT3 AND NOT-COX4I2 | 0.942857143 | 0.966527197 | 0.920318725 |
| FLT3 AND NOT-SFT2D3 | 0.950413223 | 0.987124464 | 0.916334661 |
| FLT3 AND NOT-LRCH3 | 0.944785276 | 0.970588235 | 0.920318725 |
| FLT3 AND NOT-TMEM128 | 0.947589099 | 1 | 0.900398406 |
| FLT3 AND NOT-CNTNAP1 | 0.940936864 | 0.9625 | 0.920318725 |
| FLT3 AND NOT-PAQR8 | 0.944329897 | 0.978632479 | 0.912350598 |
| FLT3 AND NOT-CDC14B | 0.940695297 | 0.966386555 | 0.916334661 |
| FLT3 AND NOT-CAV1 | 0.948665298 | 0.978813559 | 0.920318725 |
| FLT3 AND NOT-PPAP2A | 0.937759336 | 0.978354978 | 0.900398406 |
| FLT3 AND NOT-PPAP2B | 0.944329897 | 0.978632479 | 0.912350598 |
| FLT3 AND NOT-S1PR4 | 0.914893617 | 0.98173516 | 0.856573705 |
| FLT3 AND NOT-ST3GAL5 | 0.958506224 | 1 | 0.920318725 |
| FLT3 AND NOT-SGPL1 | 0.958506224 | 1 | 0.920318725 |
| FLT3 AND NOT-P4HA2 | 0.948665298 | 0.978813559 | 0.920318725 |
| FLT3 AND NOT-ABCC10 | 0.944558522 | 0.974576271 | 0.916334661 |
| FLT3 AND NOT-TMEM116 | 0.927350427 | 1 | 0.864541833 |
| FLT3 AND NOT-PHLDB2 | 0.954166667 | 1 | 0.912350598 |
| FLT3 AND NOT-SPAG9 | 0.9375 | 0.982532751 | 0.896414343 |
| FLT3 AND NOT-CLDN12 | 0.940695297 | 0.966386555 | 0.916334661 |
| FLT3 AND NOT-AIFM1 | 0.909871245 | 0.986046512 | 0.844621514 |
| FLT3 AND NOT-VAPB | 0.944785276 | 0.970588235 | 0.920318725 |
| FLT3 AND NOT-ATP6AP1L | 0.940936864 | 0.9625 | 0.920318725 |
| FLT3 AND NOT-PXYLP1 | 0.943866944 | 0.986956522 | 0.90438247 |
| FLT3 AND NOT-ACVR2A | 0.944329897 | 0.978632479 | 0.912350598 |
| FLT3 AND NOT-KL | 0.948453608 | 0.982905983 | 0.916334661 |
| FLT3 AND NOT-STOML1 | 0.940936864 | 0.9625 | 0.920318725 |
| FLT3 AND NOT-SFXN1 | 0.935550936 | 0.97826087 | 0.896414343 |
| FLT3 AND NOT-ORMDL1 | 0.929460581 | 0.96969697 | 0.892430279 |
| FLT3 AND NOT-KCNK6 | 0.944785276 | 0.970588235 | 0.920318725 |
| FLT3 AND NOT-CHST10 | 0.93877551 | 0.962343096 | 0.916334661 |
| FLT3 AND NOT-ABCG1 | 0.946502058 | 0.978723404 | 0.916334661 |
| FLT3 AND NOT-EDEM1 | 0.9375 | 0.982532751 | 0.896414343 |
| FLT3 AND NOT-CD79B | 0.909090909 | 0.995260664 | 0.836653386 |
| FLT3 AND NOT-RNF144A | 0.946502058 | 0.978723404 | 0.916334661 |
| FLT3 AND NOT-ARMCX2 | 0.946502058 | 0.978723404 | 0.916334661 |
| FLT3 AND NOT-HEPH | 0.948665298 | 0.978813559 | 0.920318725 |
| FLT3 AND NOT-C2CD5 | 0.932489451 | 0.99103139 | 0.880478088 |
| FLT3 AND NOT-AREL1 | 0.933884298 | 0.969957082 | 0.900398406 |
| FLT3 AND NOT-SLC35E2 | 0.940936864 | 0.9625 | 0.920318725 |
| FLT3 AND NOT-GOLGA5 | 0.925053533 | 1 | 0.860557769 |
| FLT3 AND NOT-HS3ST2 | 0.940936864 | 0.9625 | 0.920318725 |
| FUT4 AND DENND5A | 0.948616601 | 0.941176471 | 0.956175299 |
| FUT4 AND NOT-ADGRL2 | 0.964 | 0.967871486 | 0.960159363 |
| FUT4 AND NOT-FMO5 | 0.964143426 | 0.964143426 | 0.964143426 |
| FUT4 AND NOT-DNAJC16 | 0.9453125 | 0.927203065 | 0.964143426 |
| FUT4 AND NOT-SLC35A3 | 0.960474308 | 0.952941176 | 0.96812749 |
| FUT4 AND NOT-ICMT | 0.952380952 | 0.948616601 | 0.956175299 |
| FUT4 AND NOT-SLC39A14 | 0.960474308 | 0.952941176 | 0.96812749 |
| FUT4 AND NOT-TSPAN12 | 0.960159363 | 0.960159363 | 0.960159363 |
| FUT4 AND NOT-TSPAN15 | 0.960474308 | 0.952941176 | 0.96812749 |
| CXCL8 AND NOT-TSPAN15 | 0.927102804 | 0.873239437 | 0.988047809 |
| SMIM3 AND NOT-TSPAN15 | 0.947572816 | 0.924242424 | 0.972111554 |
| FUT4 AND NOT-VSIG2 | 0.958579882 | 0.94921875 | 0.96812749 |
| FUT4 AND NOT-TMEM2 | 0.972 | 0.975903614 | 0.96812749 |
| FUT4 AND NOT-STX12 | 0.951219512 | 0.970954357 | 0.932270916 |
| FUT4 AND NOT-CADM1 | 0.940451745 | 0.970338983 | 0.912350598 |
| FUT4 AND NOT-EML2 | 0.951076321 | 0.934615385 | 0.96812749 |
| FUT4 AND NOT-FUT2 | 0.960474308 | 0.952941176 | 0.96812749 |
| FUT4 AND NOT-FUT3 | 0.960474308 | 0.952941176 | 0.96812749 |
| FUT4 AND NOT-FUT6 | 0.960474308 | 0.952941176 | 0.96812749 |
| FUT4 AND NOT-HEPACAM2 | 0.958415842 | 0.952755906 | 0.964143426 |
| FUT4 AND NOT-LCLAT1 | 0.944 | 0.947791165 | 0.940239044 |
| FUT4 AND NOT-SLC37A4 | 0.9498998 | 0.955645161 | 0.944223108 |
| FUT4 AND NOT-LPCAT4 | 0.960474308 | 0.952941176 | 0.96812749 |
| FUT4 AND NOT-ZDHHC23 | 0.948 | 0.951807229 | 0.944223108 |
| FUT4 AND NOT-MCOLN2 | 0.943248532 | 0.926923077 | 0.960159363 |
| FUT4 AND NOT-MFSD8 | 0.964 | 0.967871486 | 0.960159363 |
| FUT4 AND NOT-SERINC5 | 0.967871486 | 0.975708502 | 0.960159363 |
| FUT4 AND NOT-TPSG1 | 0.958415842 | 0.952755906 | 0.964143426 |
| FUT4 AND NOT-BACE2 | 0.9498998 | 0.955645161 | 0.944223108 |
| FUT4 AND NOT-PARM1 | 0.960474308 | 0.952941176 | 0.96812749 |
| FUT4 AND NOT-TMEM186 | 0.95473251 | 0.987234043 | 0.924302789 |
| FUT4 AND NOT-ABI3BP | 0.966067864 | 0.968 | 0.964143426 |
| FUT4 AND NOT-PVRL3 | 0.958415842 | 0.952755906 | 0.964143426 |
| FUT4 AND NOT-HIGD1A | 0.966202783 | 0.964285714 | 0.96812749 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-PCDHB14 | 0.933333333 | 0.933333333 | 0.933333333 | FUT4 AND NOT-LRIG1 | 0.97983871 | 0.991836735 | 0.96812749 |
| TNFRSF8 AND NOT-SLC7A1 | 0.933333333 | 0.933333333 | 0.933333333 | FUT4 AND NOT-TMEM98 | 0.951807229 | 0.95951417 | 0.944223108 |
| TNFRSF8 AND NOT-C1orf233 | 0.933333333 | 0.933333333 | 0.933333333 | FUT4 AND NOT-GLCE | 0.96812749 | 0.96812749 | 0.96812749 |
| TNFRSF8 AND NOT-PTPRT | 0.933333333 | 0.933333333 | 0.933333333 | FUT4 AND NOT-ABHD12 | 0.946107784 | 0.948 | 0.944223108 |
| TNFRSF8 AND NOT-PIGB | 0.933333333 | 0.933333333 | 0.933333333 | FUT4 AND NOT-STEAP2 | 0.960474308 | 0.952941176 | 0.96812749 |
| TNFRSF8 AND NOT-VNN3 | 0.933333333 | 0.933333333 | 0.933333333 | FUT4 AND NOT-SLC17A5 | 0.968 | 0.97188755 | 0.964143426 |
| TNFRSF8 AND NOT-UCN2 | 0.933333333 | 0.933333333 | 0.933333333 | FUT4 AND NOT-CNNM4 | 0.960474308 | 0.952941176 | 0.96812749 |
| TNFRSF8 AND NOT-HHLA2 | 0.933333333 | 0.933333333 | 0.933333333 | FUT4 AND NOT-GCNT2 | 0.95951417 | 0.975308642 | 0.944223108 |
| TNFRSF8 AND NOT-KCNH7 | 0.933333333 | 0.933333333 | 0.933333333 | FUT4 AND NOT-TBL2 | 0.955823293 | 0.963562753 | 0.948207171 |
| TNFRSF8 AND NOT-CACNA1G | 0.933333333 | 0.933333333 | 0.933333333 | FUT4 AND NOT-STEAP1 | 0.954274354 | 0.952380952 | 0.956175299 |
| TNFRSF8 AND NOT-TMEM97 | 0.933333333 | 0.933333333 | 0.933333333 | FUT4 AND NOT-GHR | 0.961923848 | 0.967741935 | 0.956175299 |
| TNFRSF8 AND NOT-C2orf83 | 0.933333333 | 0.933333333 | 0.933333333 | FUT4 AND NOT-GJB1 | 0.960474308 | 0.952941176 | 0.96812749 |
| TNFRSF8 AND NOT-GAL3ST4 | 0.933333333 | 0.933333333 | 0.933333333 | FUT4 AND NOT-GJB2 | 0.956349206 | 0.95256917 | 0.960159363 |
| TNFRSF8 AND NOT-TNFRSF13C | 0.928571429 | 1 | 0.866666667 | FUT4 AND NOT-LAMP3 | 0.934615385 | 0.903345725 | 0.96812749 |
| TNFRSF8 AND NOT-NPY4R | 0.928571429 | 1 | 0.866666667 | FUT4 AND NOT-GPD2 | 0.945098039 | 0.930501931 | 0.960159363 |
| TNFRSF8 AND NOT-TMEM2 | 0.928571429 | 1 | 0.866666667 | FUT4 AND NOT-AQP11 | 0.956692913 | 0.945525292 | 0.96812749 |
| TNFRSF8 AND NOT-ERMP1 | 0.933333333 | 0.933333333 | 0.933333333 | FUT4 AND NOT-SLC39A5 | 0.960474308 | 0.952941176 | 0.96812749 |
| TNFRSF8 AND NOT-CHST8 | 0.933333333 | 0.933333333 | 0.933333333 | FUT4 AND NOT-SLC46A3 | 0.967741935 | 0.979591837 | 0.956175299 |
| TNFRSF8 AND NOT-CCL22 | 0.933333333 | 0.933333333 | 0.933333333 | FUT4 AND C16orf54 | 0.937743191 | 0.91634981 | 0.960159363 |
| TNFRSF8 AND NOT-TMEM132B | 0.933333333 | 0.933333333 | 0.933333333 | FUT4 AND NOT-ANG | 0.967871486 | 0.975708502 | 0.960159363 |
| TNFRSF8 AND NOT-WNT4 | 0.933333333 | 0.933333333 | 0.933333333 | FUT4 AND NOT-CYB561D1 | 0.93877551 | 0.962343096 | 0.916334661 |
| TNFRSF8 AND NOT-TMEM62 | 0.933333333 | 0.933333333 | 0.933333333 | FUT4 AND NOT-SLC25A34 | 0.954274354 | 0.952380952 | 0.956175299 |
| TNFRSF8 AND NOT-RGS9BP | 0.933333333 | 0.933333333 | 0.933333333 | FUT4 AND NOT-CYP4V2 | 0.953535354 | 0.967213115 | 0.940239044 |
| TNFRSF8 AND NOT-ADGRE3 | 0.965517241 | 1 | 0.933333333 | FUT4 AND NOT-DCBLD1 | 0.962376238 | 0.956692913 | 0.96812749 |
| TNFRSF8 AND NOT-RMDN3 | 0.933333333 | 0.933333333 | 0.933333333 | FUT4 AND NOT-YIPF6 | 0.961923848 | 0.967741935 | 0.956175299 |
| TNFRSF8 AND NOT-B4GALNT4 | 0.933333333 | 0.933333333 | 0.933333333 | FUT4 AND P2RY8 | 0.937743191 | 0.91634981 | 0.960159363 |
| TNFRSF8 AND NOT-MLC1 | 0.965517241 | 1 | 0.933333333 | FUT4 AND NOT-TIMM21 | 0.949698189 | 0.959349593 | 0.940239044 |
| TNFRSF8 AND NOT-WNT5A | 0.933333333 | 0.933333333 | 0.933333333 | FUT4 AND NOT-ORMDL2 | 0.914529915 | 0.986175115 | 0.852589641 |
| TNFRSF8 AND NOT-PPAPDC1A | 0.933333333 | 0.933333333 | 0.933333333 | FUT4 AND NOT-DNAJC15 | 0.93877551 | 0.962343096 | 0.916334661 |
| TNFRSF8 AND NOT-PCDHB11 | 0.933333333 | 0.933333333 | 0.933333333 | FUT4 AND NOT-SLC25A4 | 0.96812749 | 0.96812749 | 0.96812749 |
| TNFRSF8 AND NOT-COLEC11 | 0.933333333 | 0.933333333 | 0.933333333 | FUT4 AND NOT-GUCA2B | 0.960474308 | 0.952941176 | 0.96812749 |
| TNFRSF8 AND NOT-VIPR2 | 0.965517241 | 1 | 0.933333333 | FUT4 AND NOT-GUCY2C | 0.960474308 | 0.952941176 | 0.96812749 |
| TNFRSF8 AND NOT-SLC30A1 | 0.965517241 | 1 | 0.933333333 | FUT4 AND NOT-SLC2A8 | 0.956349206 | 0.95256917 | 0.960159363 |
| TNFRSF8 AND NOT-TMEM257 | 0.933333333 | 0.933333333 | 0.933333333 | FUT4 AND NOT-HAS3 | 0.934615385 | 0.903345725 | 0.96812749 |
| TNFRSF8 AND NOT-ANGPTL1 | 0.933333333 | 0.933333333 | 0.933333333 | FUT4 AND HBD | 0.937984496 | 0.913207547 | 0.964143426 |
| TNFRSF8 AND NOT-PRADC1 | 0.933333333 | 0.933333333 | 0.933333333 | FUT4 AND NOT-ST6GALNAC6 | 0.954635108 | 0.9453125 | 0.964143426 |
| TNFRSF8 AND NOT-KLHDC7A | 0.933333333 | 0.933333333 | 0.933333333 | FUT4 AND NOT-HMGCR | 0.965656566 | 0.979508197 | 0.952191235 |
| TNFRSF8 AND NOT-PCDHB12 | 0.928571429 | 1 | 0.866666667 | FUT4 AND NOT-HMOX2 | 0.961770624 | 0.971544715 | 0.952191235 |
| TNFRSF8 AND NOT-ANG | 0.933333333 | 0.933333333 | 0.933333333 | FUT4 AND NOT-HRH1 | 0.960474308 | 0.952941176 | 0.96812749 |
| TNFRSF8 AND NOT-SLC18A2 | 0.933333333 | 0.933333333 | 0.933333333 | FUT4 AND NOT-HSD17B2 | 0.960474308 | 0.952941176 | 0.96812749 |
| TNFRSF8 AND NOT-SLC35F5 | 0.933333333 | 0.933333333 | 0.933333333 | FUT4 AND NOT-ACACB | 0.956 | 0.959839357 | 0.952191235 |
| TNFRSF8 AND NOT-PLD6 | 0.933333333 | 0.933333333 | 0.933333333 | FUT4 AND NOT-ANO9 | 0.960474308 | 0.952941176 | 0.96812749 |
| TNFRSF8 AND NOT-SDK2 | 0.965517241 | 1 | 0.933333333 | FUT4 AND NOT-LRRC66 | 0.960474308 | 0.952941176 | 0.96812749 |
| TNFRSF8 AND NOT-SLC39A8 | 0.933333333 | 0.933333333 | 0.933333333 | FUT4 AND NOT-SERINC2 | 0.960474308 | 0.952941176 | 0.96812749 |
| TNFRSF8 AND NOT-MFSD6L | 0.933333333 | 0.933333333 | 0.933333333 | FUT4 AND NOT-IHH | 0.960474308 | 0.952941176 | 0.96812749 |
| TNFRSF8 AND NOT-PI3 | 0.965517241 | 1 | 0.933333333 | FUT4 AND CXCL8 | 0.958083832 | 0.96 | 0.956175299 |
| TNFRSF8 AND NOT-SLC44A4 | 0.933333333 | 0.933333333 | 0.933333333 | FUT4 AND NOT-ITGA2 | 0.958415842 | 0.952755906 | 0.964143426 |
| TNFRSF8 AND NOT-PTCHD2 | 0.933333333 | 0.933333333 | 0.933333333 | FUT4 AND NOT-ITGA3 | 0.960474308 | 0.952941176 | 0.96812749 |
| TNFRSF8 AND NOT-GRIA1 | 0.933333333 | 0.933333333 | 0.933333333 | FUT4 AND NOT-ITGAV | 0.918454936 | 0.995348837 | 0.852589641 |
| TNFRSF8 AND NOT-CA14 | 0.933333333 | 0.933333333 | 0.933333333 | FUT4 AND NOT-ITGB5 | 0.95951417 | 0.975308642 | 0.944223108 |
| TNFRSF8 AND NOT-C1orf186 | 0.928571429 | 1 | 0.866666667 | FUT4 AND NOT-ITGB6 | 0.964285714 | 0.960474308 | 0.96812749 |
| TNFRSF8 AND NOT-KCNA3 | 0.928571429 | 1 | 0.866666667 | FUT4 AND NOT-ITPR3 | 0.960474308 | 0.952941176 | 0.96812749 |
| TNFRSF8 AND NOT-MAVS | 0.933333333 | 0.933333333 | 0.933333333 | FUT4 AND NOT-FAM73A | 0.962075848 | 0.964 | 0.960159363 |
| TNFRSF8 AND NOT-CLEC2D | 0.933333333 | 0.933333333 | 0.933333333 | FUT4 AND NOT-MIA3 | 0.950690335 | 0.94140625 | 0.960159363 |
| TNFRSF8 AND NOT-NDUFC2 | 0.928571429 | 1 | 0.866666667 | FUT4 AND NOT-KCNJ2 | 0.950207469 | 0.991341991 | 0.912350598 |
| TNFRSF8 AND NOT-ZNRF3 | 0.933333333 | 0.933333333 | 0.933333333 | FUT4 AND NOT-KCNK1 | 0.952191235 | 0.952191235 | 0.952191235 |
| TNFRSF8 AND NOT-LY6K | 0.933333333 | 0.933333333 | 0.933333333 | FUT4 AND NOT-KCNMA1 | 0.96812749 | 0.96812749 | 0.96812749 |
| TNFRSF8 AND NOT-KCNJ1 | 0.933333333 | 0.933333333 | 0.933333333 | FUT4 AND NOT-C10orf99 | 0.960474308 | 0.952941176 | 0.96812749 |
| TNFRSF8 AND NOT-ADRB1 | 0.928571429 | 1 | 0.866666667 | NOT-FAM69A AND FUT4 | 0.990138067 | 0.98046875 | 1 |
| TNFRSF8 AND NOT-CACFD1 | 0.933333333 | 0.933333333 | 0.933333333 | FUT4 AND NOT-SAMD5 | 0.960474308 | 0.952941176 | 0.96812749 |
| TNFRSF8 AND NOT-GLP1R | 0.933333333 | 0.933333333 | 0.933333333 | FUT4 AND NOT-IYD | 0.960474308 | 0.952941176 | 0.96812749 |
| TNFRSF8 AND NOT-HS3ST3B1 | 0.933333333 | 0.933333333 | 0.933333333 | FUT4 AND NOT-LETM1 | 0.9500998 | 0.952 | 0.948207171 |
| TNFRSF8 AND NOT-TAS2R9 | 0.933333333 | 0.933333032 | 0.933333333 | FUT4 AND NOT-SNX19 | 0.948412698 | 0.944664032 | 0.952191235 |
| TNFRSF8 AND NOT-TAAR1 | 0.933333333 | 0.933333333 | 0.933333333 | FUT4 AND NOT-LMO7 | 0.960474308 | 0.952941176 | 0.96812749 |
| TNFRSF8 AND NOT-YIPF3 | 0.933333333 | 0.933333333 | 0.933333333 | FUT4 AND NOT-PPAPDC2 | 0.968 | 0.97188755 | 0.964143426 |
| TNFRSF8 AND NOT-ADSSL1 | 0.933333333 | 0.933333333 | 0.933333333 | FUT4 AND NOT-EPCAM | 0.952755906 | 0.941634241 | 0.964143426 |
| TNFRSF8 AND NOT-LRCH3 | 0.928571429 | 1 | 0.866666667 | FUT4 AND NOT-ARSE | 0.958579882 | 0.94921875 | 0.96812749 |
| TNFRSF8 AND NOT-TMEM130 | 0.933333333 | 0.933333333 | 0.933333333 | FUT4 AND NOT-MEP1A | 0.960474308 | 0.952941176 | 0.96812749 |
| TNFRSF8 AND NOT-XG | 0.933333333 | 0.933333333 | 0.933333333 | FUT4 AND NOT-MET | 0.952191235 | 0.952191235 | 0.952191235 |
| TNFRSF8 AND NOT-GYPA | 0.933333333 | 0.933333333 | 0.933333333 | FUT4 AND NOT-MFAP3 | 0.948616601 | 0.941176471 | 0.956175299 |
| TNFRSF8 AND NOT-GAL | 0.933333333 | 0.933333333 | 0.933333333 | FUT4 AND NOT-MGAT5 | 0.965931864 | 0.971774194 | 0.960159363 |
| TNFRSF8 AND NOT-FITM1 | 0.933333333 | 0.933333333 | 0.933333333 | FUT4 AND NOT-KITLG | 0.961923848 | 0.967741935 | 0.956175299 |
| TNFRSF8 AND NOT-SMIM6 | 0.933333333 | 0.933333333 | 0.933333333 | FUT4 AND NOT-MID1 | 0.960474308 | 0.952941176 | 0.96812749 |
| TNFRSF8 AND NOT-SLC39A1 | 0.933333333 | 0.933333333 | 0.933333333 | FUT4 AND NOT-ALDH6A1 | 0.944223108 | 0.944223108 | 0.944223108 |
| TNFRSF8 AND NOT-SYNGR1 | 0.965517241 | 1 | 0.933333333 | FUT4 AND NOT-TMEM41B | 0.940451745 | 0.970338983 | 0.912350598 |
| TNFRSF8 AND NOT-RNF121 | 0.928571429 | 1 | 0.866666667 | FUT4 AND NOT-SMIM22 | 0.960474308 | 0.952941176 | 0.96812749 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-GPER1 | 0.933333333 | 0.93333333 | 0.933333333 | FUT4 AND NOT-MINOS1 | 0.971544715 | 0.991701245 | 0.952191235 |
| TNFRSF8 AND NOT-KCNH1 | 0.933333333 | 0.93333333 | 0.933333333 | FUT4 AND NOT-TMEM150C | 0.964143426 | 0.964143426 | 0.964143426 |
| TNFRSF8 AND NOT-MYADML2 | 0.933333333 | 0.93333333 | 0.933333333 | FUT4 AND NOT-ASPH | 0.960159363 | 0.960159363 | 0.960159363 |
| TNFRSF8 AND NOT-ABHD3 | 0.933333333 | 0.93333333 | 0.933333333 | FUT4 AND NOT-MST1R | 0.960474308 | 0.952941176 | 0.96812749 |
| TNFRSF8 AND NOT-ALG1 | 0.928571429 | 1 | 0.866666667 | FUT4 AND NOT-MUC1 | 0.941883768 | 0.947580645 | 0.93625498 |
| TNFRSF8 AND NOT-SORCS3 | 0.965517241 | 1 | 0.933333333 | FUT4 AND NOT-MUC4 | 0.958579882 | 0.94921875 | 0.96812749 |
| TNFRSF8 AND NOT-SYS1 | 0.965517241 | 1 | 0.933333333 | FUT4 AND NOT-NEO1 | 0.954274354 | 0.952380952 | 0.956175299 |
| TNFRSF8 AND NOT-FAM187B | 0.933333333 | 0.93333333 | 0.933333333 | FUT4 AND NOT-NPY1R | 0.962075848 | 0.964 | 0.960159363 |
| TNFRSF8 AND NOT-TAS2R39 | 0.933333333 | 0.93333333 | 0.933333333 | FUT4 AND NOT-NT5E | 0.958250497 | 0.956349206 | 0.960159363 |
| TNFRSF8 AND NOT-TNMD | 0.933333333 | 0.93333333 | 0.933333333 | P2RX1 AND FUT4 | 0.936660269 | 0.903703704 | 0.972111554 |
| TNFRSF8 AND NOT-HSD3B2 | 0.933333333 | 0.93333333 | 0.933333333 | FUT4 AND NOT-NSDHL | 0.931392931 | 0.973913043 | 0.892430279 |
| TNFRSF8 AND NOT-ADRB2 | 0.928571429 | 1 | 0.866666667 | FUT4 AND NOT-SLC35B3 | 0.963562753 | 0.979423868 | 0.948207171 |
| TNFRSF8 AND NOT-FAM209B | 0.933333333 | 0.93333333 | 0.933333333 | FUT4 AND NOT-ZDHHC9 | 0.958415842 | 0.952755906 | 0.964143426 |
| TNFRSF8 AND NOT-CTAGE1 | 0.933333333 | 0.93333333 | 0.933333333 | FUT4 AND NOT-INSIG2 | 0.936170213 | 0.909774436 | 0.964143426 |
| TNFRSF8 AND NOT-FAR1 | 0.933333333 | 0.93333333 | 0.933333333 | FUT4 AND NOT-CRIM1 | 0.958415842 | 0.952755906 | 0.964143426 |
| TNFRSF8 AND NOT-ARSE | 0.933333333 | 0.93333333 | 0.933333333 | FUT4 AND NOT-GOLM1 | 0.955823293 | 0.963562753 | 0.948207171 |
| TNFRSF8 AND NOT-LRTM1 | 0.933333333 | 0.93333333 | 0.933333333 | FUT4 AND NOT-BFAR | 0.923728814 | 0.986425339 | 0.868525896 |
| TNFRSF8 AND NOT-KCNE5 | 0.933333333 | 0.93333333 | 0.933333333 | FUT4 AND NOT-CD320 | 0.948207171 | 0.948207171 | 0.948207171 |
| TNFRSF8 AND NOT-CHRNA4 | 0.933333333 | 0.93333333 | 0.933333333 | FUT4 AND NOT-ZDHHC3 | 0.947368421 | 0.962962963 | 0.932270916 |
| TNFRSF8 AND NOT-PCDHGA11 | 0.933333333 | 0.93333333 | 0.933333333 | FUT4 AND NOT-PDE3A | 0.960474308 | 0.952941176 | 0.96812749 |
| TNFRSF8 AND NOT-ATRN | 0.965517241 | 1 | 0.933333333 | FUT4 AND NOT-GULP1 | 0.949499499 | 0.963114754 | 0.93625498 |
| TNFRSF8 AND NOT-PANX3 | 0.933333333 | 0.93333333 | 0.933333333 | FUT4 AND NOT-PDGFRA | 0.966067864 | 0.968 | 0.964143426 |
| TNFRSF8 AND NOT-FGFR3 | 0.933333333 | 0.93333333 | 0.933333333 | FUT4 AND NOT-LSR | 0.956349206 | 0.95256917 | 0.960159363 |
| TNFRSF8 AND NOT-IL13 | 0.928571429 | 1 | 0.866666667 | FUT4 AND NOT-ENPP3 | 0.958415842 | 0.952755906 | 0.964143426 |
| TNFRSF8 AND NOT-TLR7 | 0.965517241 | 1 | 0.933333333 | FUT4 AND NOT-ACSL5 | 0.958083832 | 0.96 | 0.956175299 |
| TNFRSF8 AND NOT-GTF3C3 | 0.933333333 | 0.93333333 | 0.933333333 | FUT4 AND NOT-GALNT7 | 0.937743191 | 0.91634981 | 0.960159363 |
| TNFRSF8 AND NOT-GALNT15 | 0.933333333 | 0.93333333 | 0.933333333 | FUT4 AND NOT-ATP8B1 | 0.958415842 | 0.952755906 | 0.964143426 |
| TNFRSF8 AND NOT-FCGR3B | 0.928571429 | 1 | 0.866666667 | NOT-PFN2 AND FUT4 | 0.968627451 | 0.953667954 | 0.984063745 |
| TNFRSF8 AND NOT-KLK5 | 0.933333333 | 0.93333333 | 0.933333333 | FUT4 AND NOT-PIGR | 0.960474308 | 0.952941176 | 0.96812749 |
| TNFRSF8 AND NOT-OR52A1 | 0.933333333 | 0.93333333 | 0.933333333 | FUT4 AND NOT-PLA2G2A | 0.958579882 | 0.94921875 | 0.96812749 |
| TNFRSF8 AND NOT-THSD7B | 0.933333333 | 0.93333333 | 0.933333333 | FUT4 AND NOT-FXYD3 | 0.960474308 | 0.952941176 | 0.96812749 |
| TNFRSF8 AND NOT-SLC2A1 | 0.933333333 | 0.93333333 | 0.933333333 | FUT4 AND NOT-PLOD2 | 0.957746479 | 0.967479675 | 0.948207171 |
| TNFRSF8 AND NOT-KCNH6 | 0.933333333 | 0.93333333 | 0.933333333 | FUT4 AND NOT-PLXNA2 | 0.960474308 | 0.952941176 | 0.96812749 |
| TNFRSF8 AND NOT-TTYH2 | 0.933333333 | 0.93333333 | 0.933333333 | FUT4 AND NOT-PMP22 | 0.960159363 | 0.960159363 | 0.960159363 |
| TNFRSF8 AND NOT-TSPAN2 | 0.933333333 | 0.93333333 | 0.933333333 | FUT4 AND NOT-C11orf24 | 0.96 | 0.963855422 | 0.956175299 |
| TNFRSF8 AND NOT-LRRTM1 | 0.933333333 | 0.93333333 | 0.933333333 | FUT4 AND NOT-CDHR5 | 0.960474308 | 0.952941176 | 0.96812749 |
| TNFRSF8 AND NOT-SLC30A5 | 0.933333333 | 0.93333333 | 0.933333333 | NOT-PODXL AND FUT4 | 0.957528958 | 0.928838951 | 0.988047809 |
| TNFRSF8 AND NOT-MPPE1 | 0.928571429 | 1 | 0.866666667 | FUT4 AND NOT-PON2 | 0.954274354 | 0.952380952 | 0.956175299 |
| TNFRSF8 AND NOT-GHSR | 0.933333333 | 0.93333333 | 0.933333333 | FUT4 AND NOT-FAM134B | 0.969818913 | 0.979674797 | 0.960159363 |
| TNFRSF8 AND NOT-LNPEP | 0.933333333 | 0.93333333 | 0.933333333 | FUT4 AND NOT-FAM105A | 0.965656566 | 0.979508197 | 0.952191235 |
| TNFRSF8 AND NOT-GABRR1 | 0.933333333 | 0.93333333 | 0.933333333 | FUT4 AND NOT-ZDHHC13 | 0.955102041 | 0.979079498 | 0.932270916 |
| TNFRSF8 AND NOT-CLDN15 | 0.933333333 | 0.93333333 | 0.933333333 | FUT4 AND NOT-RNF186 | 0.960474308 | 0.952941176 | 0.96812749 |
| TNFRSF8 AND NOT-XPR1 | 0.933333333 | 0.93333333 | 0.933333333 | FUT4 AND NOT-NDFIP2 | 0.958415842 | 0.952755906 | 0.964143426 |
| TNFRSF8 AND NOT-PTPRJ | 0.965517241 | 1 | 0.933333333 | FUT4 AND NOT-VSIG10 | 0.952191235 | 0.952191235 | 0.952191235 |
| TNFRSF8 AND NOT-CYP2C8 | 0.933333333 | 0.93333333 | 0.933333333 | FUT4 AND NOT-TMEM106B | 0.961770624 | 0.971544715 | 0.952191235 |
| TNFRSF8 AND NOT-GABBR2 | 0.933333333 | 0.93333333 | 0.933333333 | FUT4 AND NOT-CRLS1 | 0.95 | 0.995633188 | 0.908366534 |
| TNFRSF8 AND NOT-GPRC5D | 0.933333333 | 0.93333333 | 0.933333333 | FUT4 AND NOT-MANSC1 | 0.958415842 | 0.952755906 | 0.964143426 |
| TNFRSF8 AND NOT-IGSF6 | 0.965517241 | 1 | 0.933333333 | FUT4 AND NOT-GRAMD1C | 0.956349206 | 0.95256917 | 0.960159363 |
| TNFRSF8 AND NOT-ACVR2A | 0.933333333 | 0.93333333 | 0.933333333 | FUT4 AND NOT-PPIC | 0.964143426 | 0.964143426 | 0.964143426 |
| TNFRSF8 AND NOT-B4GALNT2 | 0.933333333 | 0.93333333 | 0.933333333 | FUT4 AND NOT-PAQR5 | 0.960474308 | 0.952941176 | 0.96812749 |
| TNFRSF8 AND NOT-GABRG1 | 0.933333333 | 0.93333333 | 0.933333333 | FUT4 AND NOT-RETSAT | 0.960474308 | 0.952941176 | 0.96812749 |
| TNFRSF8 AND NOT-LY6G6D | 0.933333333 | 0.93333333 | 0.933333333 | FUT4 AND NOT-RNF43 | 0.960474308 | 0.952941176 | 0.96812749 |
| TNFRSF8 AND NOT-OR10A3 | 0.933333333 | 0.93333333 | 0.933333333 | FUT4 AND NOT-TMEM45A | 0.946938776 | 0.970711297 | 0.924302789 |
| TNFRSF8 AND NOT-SLC3A1 | 0.933333333 | 0.93333333 | 0.933333333 | FUT4 AND NOT-TMEM51 | 0.952191235 | 0.952191235 | 0.952191235 |
| TNFRSF8 AND NOT-OR8D2 | 0.933333333 | 0.93333333 | 0.933333333 | FUT4 AND NOT-ANO10 | 0.946322068 | 0.944444444 | 0.948207171 |
| TNFRSF8 AND NOT-FAM205A | 0.933333333 | 0.93333333 | 0.933333333 | FUT4 AND NOT-TMEM19 | 0.965931864 | 0.971774194 | 0.960159363 |
| TNFRSF8 AND NOT-GDAP1L1 | 0.933333333 | 0.93333333 | 0.933333333 | FUT4 AND NOT-TMEM144 | 0.948 | 0.951807229 | 0.944223108 |
| TNFRSF8 AND NOT-SLC29A4 | 0.933333333 | 0.93333333 | 0.933333333 | FUT4 AND NOT-ACER3 | 0.954091816 | 0.956 | 0.952191235 |
| TNFRSF8 AND NOT-UGT1A8 | 0.933333333 | 0.93333333 | 0.933333333 | FUT4 AND NOT-SYNJ2BP | 0.967741935 | 0.979591837 | 0.956175299 |
| TNFRSF8 AND NOT-CD207 | 0.933333333 | 0.93333333 | 0.933333333 | FUT4 AND NOT-SLC35C1 | 0.960474308 | 0.952941176 | 0.96812749 |
| TNFRSF8 AND NOT-ANKH | 0.933333333 | 0.93333333 | 0.933333333 | FUT4 AND NOT-STYK1 | 0.958415842 | 0.952755906 | 0.964143426 |
| TNFRSF8 AND NOT-SLC27A3 | 0.965517241 | 1 | 0.933333333 | FUT4 AND NOT-LGR4 | 0.954274354 | 0.952380952 | 0.956175299 |
| TNFRSF8 AND NOT-MS4A3 | 0.965517241 | 1 | 0.933333333 | FUT4 AND NOT-SMPD3 | 0.96031746 | 0.956521739 | 0.964143426 |
| TNFRSF8 AND NOT-CERS4 | 0.933333333 | 0.93333333 | 0.933333333 | FUT4 AND NOT-IL17RB | 0.958579882 | 0.94921875 | 0.96812749 |
| TNFRSF8 AND NOT-MGAT3 | 0.933333333 | 0.93333333 | 0.933333333 | FUT4 AND NOT-SLC30A6 | 0.965931864 | 0.971774194 | 0.960159363 |
| TNFRSF8 AND NOT-MEGF9 | 0.965517241 | 1 | 0.933333333 | FUT4 AND NOT-FAR2 | 0.926931106 | 0.973684211 | 0.884462151 |
| TNFRSF8 AND NOT-FXYD7 | 0.933333333 | 0.93333333 | 0.933333333 | FUT4 AND NOT-SAYSD1 | 0.94921875 | 0.931034483 | 0.96812749 |
| TNFRSF8 AND NOT-SLC38A11 | 0.933333333 | 0.93333333 | 0.933333333 | FUT4 AND NOT-ST6GALNAC1 | 0.956349206 | 0.95256917 | 0.960159363 |
| TNFRSF8 AND NOT-GPA33 | 0.965517241 | 1 | 0.933333333 | FUT4 AND NOT-PAG1 | 0.956 | 0.959839357 | 0.952191235 |
| TNFRSF8 AND NOT-GALR1 | 0.933333333 | 0.93333333 | 0.933333333 | FUT4 AND NOT-ACSS2 | 0.960474308 | 0.952941176 | 0.96812749 |
| TNFRSF8 AND NOT-CACNA1B | 0.933333333 | 0.93333333 | 0.933333333 | FUT4 AND NOT-ANKH | 0.956701031 | 0.991452991 | 0.924302789 |
| TNFRSF8 AND NOT-SLC13A2 | 0.933333333 | 0.93333333 | 0.933333333 | FUT4 AND NOT-PROS1 | 0.961616162 | 0.975409836 | 0.948207171 |
| TNFRSF8 AND NOT-PARM1 | 0.933333333 | 0.93333333 | 0.933333333 | FUT4 AND NOT-PRRG1 | 0.964285714 | 0.960474308 | 0.96812749 |
| TNFRSF8 AND NOT-TMPRSS12 | 0.933333333 | 0.93333333 | 0.933333333 | FUT4 AND NOT-PSEN1 | 0.94921875 | 0.931034483 | 0.96812749 |
| TNFRSF8 AND NOT-SLC5A3 | 0.933333333 | 0.93333333 | 0.933333333 | FUT4 AND NOT-TMPRSS4 | 0.960474308 | 0.952941176 | 0.96812749 |
| TNFRSF8 AND NOT-RECK | 0.965517241 | 1 | 0.933333333 | FUT4 AND NOT-MUC13 | 0.960474308 | 0.952941176 | 0.96812749 |

FIG. 1 (CONT.)

| Antigen Pair Logic | F1 | Precision | Recall |
|---|---|---|---|
| TNFRSF8 AND NOT-TNFRSF11A | 0.933333333 | 0.933333333 | 0.933333333 |
| TNFRSF8 AND NOT-S1PR2 | 0.933333333 | 0.933333333 | 0.933333333 |
| TNFRSF8 AND NOT-GSG1 | 0.933333333 | 0.933333333 | 0.933333333 |
| TNFRSF8 AND NOT-P2RY2 | 0.965517241 | 1 | 0.933333333 |
| TNFRSF8 AND NOT-NLGN3 | 0.933333333 | 0.933333333 | 0.933333333 |
| TNFRSF8 AND NOT-RNF182 | 0.933333333 | 0.933333333 | 0.933333333 |
| TNFRSF8 AND NOT-SLC38A3 | 0.933333333 | 0.933333333 | 0.933333333 |
| TNFRSF8 AND NOT-TMEM88 | 0.933333333 | 0.933333333 | 0.933333333 |
| TNFRSF8 AND NOT-TMEM33 | 0.965517241 | 1 | 0.933333333 |
| TNFRSF8 AND NOT-HLA-DOB | 0.933333333 | 0.933333333 | 0.933333333 |
| TNFRSF8 AND NOT-LRCH1 | 0.933333333 | 0.933333333 | 0.933333333 |
| TNFRSF8 AND NOT-XKR6 | 0.933333333 | 0.933333333 | 0.933333333 |
| TNFRSF8 AND NOT-KIAA1161 | 0.933333333 | 0.933333333 | 0.933333333 |
| TNFRSF8 AND NOT-RHOT2 | 0.933333333 | 0.933333333 | 0.933333333 |
| TNFRSF8 AND NOT-TCIRG1 | 0.933333333 | 0.933333333 | 0.933333333 |
| TNFRSF8 AND NOT-UPK3B | 0.933333333 | 0.933333333 | 0.933333333 |
| TNFRSF8 AND NOT-DCST2 | 0.933333333 | 0.933333333 | 0.933333333 |
| TNFRSF8 AND NOT-GLT8D1 | 0.933333333 | 0.933333333 | 0.933333333 |
| TNFRSF8 AND NOT-NDST4 | 0.933333333 | 0.933333333 | 0.933333333 |
| TNFRSF8 AND NOT-TAS2R13 | 0.933333333 | 0.933333333 | 0.933333333 |
| TNFRSF8 AND NOT-TNFRSF4 | 0.933333333 | 0.933333333 | 0.933333333 |
| TNFRSF8 AND NOT-GOLT1A | 0.933333333 | 0.933333333 | 0.933333333 |
| TNFRSF8 AND NOT-CYP4A11 | 0.933333333 | 0.933333333 | 0.933333333 |
| TNFRSF8 AND NOT-CHRNG | 0.965517241 | 1 | 0.933333333 |
| TNFRSF8 AND NOT-MUC4 | 0.933333333 | 0.933333333 | 0.933333333 |
| TNFRSF8 AND NOT-ITGB2 | 0.928571429 | 1 | 0.866666667 |
| TNFRSF8 AND NOT-CEP95 | 0.933333333 | 0.933333333 | 0.933333333 |
| TNFRSF8 AND NOT-TAAR5 | 0.933333333 | 0.933333333 | 0.933333333 |
| TNFRSF8 AND NOT-TXNDC15 | 0.928571429 | 1 | 0.866666667 |
| TNFRSF8 AND NOT-ADTRP | 0.928571429 | 1 | 0.866666667 |
| TNFRSF8 AND NOT-TNFSF9 | 0.933333333 | 0.933333333 | 0.933333333 |
| TNFRSF8 AND NOT-ABCC3 | 0.933333333 | 0.933333333 | 0.933333333 |
| TNFRSF8 AND NOT-PCDHB5 | 0.933333333 | 0.933333333 | 0.933333333 |
| TNFRSF8 AND NOT-CLDN23 | 0.933333333 | 0.933333333 | 0.933333333 |
| TNFRSF8 AND NOT-ASIC5 | 0.933333333 | 0.933333333 | 0.933333333 |
| TNFRSF8 AND NOT-GABBR1 | 0.933333333 | 0.933333333 | 0.933333333 |
| TNFRSF8 AND NOT-MUC12 | 0.933333333 | 0.933333333 | 0.933333333 |
| TNFRSF8 AND NOT-GABRA6 | 0.933333333 | 0.933333333 | 0.933333333 |
| TNFRSF8 AND NOT-STOML3 | 0.933333333 | 0.933333333 | 0.933333333 |
| TNFRSF8 AND NOT-PLXND1 | 0.933333333 | 0.933333333 | 0.933333333 |
| TNFRSF8 AND NOT-PCDHA6 | 0.933333333 | 0.933333333 | 0.933333333 |
| TNFRSF8 AND NOT-LECT1 | 0.933333333 | 0.933333333 | 0.933333333 |
| TNFRSF8 AND NOT-LRRN4 | 0.933333333 | 0.933333333 | 0.933333333 |
| TNFRSF8 AND NOT-COL17A1 | 0.933333333 | 0.933333333 | 0.933333333 |
| TNFRSF8 AND NOT-ST8SIA5 | 0.933333333 | 0.933333333 | 0.933333333 |
| TNFRSF8 AND NOT-ELOVL2 | 0.933333333 | 0.933333333 | 0.933333333 |
| TNFRSF8 AND NOT-PAQR8 | 0.965517241 | 1 | 0.933333333 |
| TNFRSF8 AND NOT-NFXL1 | 0.933333333 | 0.933333333 | 0.933333333 |
| TNFRSF8 AND NOT-KCNC2 | 0.933333333 | 0.933333333 | 0.933333333 |
| TNFRSF8 AND NOT-LRRC3 | 0.933333333 | 0.933333333 | 0.933333333 |
| TNFRSF8 AND NOT-ABCA7 | 0.965517241 | 1 | 0.933333333 |
| TNFRSF8 AND NOT-SPN | 0.928571429 | 1 | 0.866666667 |
| TNFRSF8 AND NOT-SLC26A11 | 0.928571429 | 1 | 0.866666667 |
| TNFRSF8 AND NOT-TPSG1 | 0.933333333 | 0.933333333 | 0.933333333 |
| TNFRSF8 AND NOT-EVC | 0.933333333 | 0.933333333 | 0.933333333 |
| TNFRSF8 AND NOT-SPINT1 | 0.928571429 | 1 | 0.866666667 |
| TNFRSF8 AND NOT-KCNK2 | 0.933333333 | 0.933333333 | 0.933333333 |
| TNFRSF8 AND NOT-HCN3 | 0.933333333 | 0.933333333 | 0.933333333 |
| TNFRSF8 AND NOT-SPATA3 | 0.933333333 | 0.933333333 | 0.933333333 |
| TNFRSF8 AND NOT-GPR146 | 0.933333333 | 0.933333333 | 0.933333333 |
| TNFRSF8 AND NOT-OR2B6 | 0.933333333 | 0.933333333 | 0.933333333 |
| TNFRSF8 AND NOT-SLC18A1 | 0.933333333 | 0.933333333 | 0.933333333 |
| TNFRSF8 AND NOT-SPTSSB | 0.965517241 | 1 | 0.933333333 |
| TNFRSF8 AND NOT-MFSD6 | 0.933333333 | 0.933333333 | 0.933333333 |
| TNFRSF8 AND NOT-RHAG | 0.933333333 | 0.933333333 | 0.933333333 |
| TNFRSF8 AND NOT-SPPL2C | 0.933333333 | 0.933333333 | 0.933333333 |
| TNFRSF8 AND NOT-NAAA | 0.965517241 | 1 | 0.933333333 |
| TNFRSF8 AND NOT-RFT1 | 0.933333333 | 0.933333333 | 0.933333333 |
| TNFRSF8 AND NOT-ADRA1D | 0.933333333 | 0.933333333 | 0.933333333 |
| TNFRSF8 AND NOT-PIRT | 0.933333333 | 0.933333333 | 0.933333333 |
| TNFRSF8 AND NOT-CCR3 | 0.965517241 | 1 | 0.933333333 |
| TNFRSF8 AND NOT-CES5A | 0.933333333 | 0.933333333 | 0.933333333 |
| TNFRSF8 AND NOT-SLCO6A1 | 0.933333333 | 0.933333333 | 0.933333333 |
| TNFRSF8 AND NOT-COX10 | 0.933333333 | 0.933333333 | 0.933333333 |
| TNFRSF8 AND NOT-SEMA3D | 0.933333333 | 0.933333333 | 0.933333333 |
| TNFRSF8 AND NOT-FBXW7 | 0.965517241 | 1 | 0.933333333 |

| Antigen Pair Logic | F1 | Precision | Recall |
|---|---|---|---|
| FUT4 AND NOT-AGPAT3 | 0.93970894 | 0.982608696 | 0.900398406 |
| FUT4 AND NOT-PMEPA1 | 0.964 | 0.967871486 | 0.960159363 |
| FUT4 AND NOT-ACKR3 | 0.91416309 | 0.990697674 | 0.848605578 |
| FUT4 AND NOT-LPAR5 | 0.97188755 | 0.979757085 | 0.964143426 |
| FUT4 AND NOT-SLC44A2 | 0.969325153 | 0.995798319 | 0.944223108 |
| FUT4 AND NOT-DOLPP1 | 0.95049505 | 0.94488189 | 0.956175299 |
| FUT4 AND NOT-SLC45A4 | 0.947580645 | 0.959183673 | 0.93625498 |
| FUT4 AND NOT-SMAGP | 0.956 | 0.959839357 | 0.952191235 |
| FUT4 AND NOT-PTCH1 | 0.967741935 | 0.979591837 | 0.956175299 |
| FUT4 AND NOT-PTGDR | 0.968 | 0.97188755 | 0.964143426 |
| FUT4 AND NOT-MRS2 | 0.928571429 | 0.982222222 | 0.880478088 |
| FUT4 AND NOT-PTGFRN | 0.960474308 | 0.952941176 | 0.96812749 |
| FUT4 AND NOT-CYP20A1 | 0.94302554 | 0.930232558 | 0.956175299 |
| FUT4 AND NOT-ABHD6 | 0.973947896 | 0.97983871 | 0.96812749 |
| FUT4 AND NOT-NDRG2 | 0.964 | 0.967871486 | 0.960159363 |
| FUT4 AND NOT-TMCC3 | 0.950617284 | 0.982978723 | 0.920318725 |
| FUT4 AND NOT-HEG1 | 0.948024948 | 0.991304348 | 0.908366534 |
| FUT4 AND NOT-MTUS1 | 0.97005988 | 0.972 | 0.96812749 |
| FUT4 AND NOT-KIAA1324 | 0.958415842 | 0.952755906 | 0.964143426 |
| FUT4 AND NOT-SEMA6A | 0.960474308 | 0.952941176 | 0.96812749 |
| FUT4 AND NOT-SYT13 | 0.960474308 | 0.952941176 | 0.96812749 |
| FUT4 AND NOT-PTN | 0.96812749 | 0.96812749 | 0.96812749 |
| FUT4 AND NOT-SLAMF7 | 0.971544715 | 0.991701245 | 0.952191235 |
| FUT4 AND NOT-PIPRD | 0.955823293 | 0.963562753 | 0.948207171 |
| FUT4 AND NOT-PTPRF | 0.960474308 | 0.952941176 | 0.96812749 |
| FUT4 AND NOT-PTPRH | 0.960474308 | 0.952941176 | 0.96812749 |
| NOT-PTPRK AND FUT4 | 0.952380952 | 0.912408759 | 0.996015936 |
| FUT4 AND NOT-PTPRM | 0.948240166 | 0.987068966 | 0.912350598 |
| FUT4 AND NOT-PTPRO | 0.938223938 | 0.91011236 | 0.96812749 |
| FUT4 AND NOT-PTPRR | 0.960474308 | 0.952941176 | 0.96812749 |
| FUT4 AND NOT-IL22RA1 | 0.960474308 | 0.952941176 | 0.96812749 |
| FUT4 AND NOT-ENPP5 | 0.967871486 | 0.975708502 | 0.960159363 |
| FUT4 AND NOT-EVA1C | 0.951417004 | 0.967078189 | 0.93625498 |
| FUT4 AND NOT-ACE2 | 0.960474308 | 0.952941176 | 0.96812749 |
| FUT4 AND NOT-NTN4 | 0.97005988 | 0.972 | 0.96812749 |
| FUT4 AND NOT-RNASE1 | 0.955645161 | 0.967346939 | 0.944223108 |
| FUT4 AND NOT-RNASE4 | 0.959016393 | 0.987341772 | 0.932270916 |
| FUT4 AND NOT-TNFRSF17 | 0.965376782 | 0.9875 | 0.944223108 |
| FUT4 AND NOT-RRBP1 | 0.960474308 | 0.952941176 | 0.96812749 |
| FUT4 AND NOT-BDKRB2 | 0.960474308 | 0.952941176 | 0.96812749 |
| FUT4 AND NOT-SLC22A23 | 0.960474308 | 0.952941176 | 0.96812749 |
| FUT4 AND NOT-TSPAN31 | 0.944444444 | 0.940711462 | 0.948207171 |
| FUT4 AND NOT-SCNN1A | 0.960474308 | 0.952941176 | 0.96812749 |
| FUT4 AND NOT-SCNN1G | 0.945525292 | 0.923954373 | 0.96812749 |
| FUT4 AND NOT-CEACAM1 | 0.951219512 | 0.970954357 | 0.932270916 |
| FUT4 AND NOT-SDC1 | 0.964285714 | 0.960474308 | 0.96812749 |
| FUT4 AND NOT-MCUR1 | 0.9500998 | 0.952 | 0.948207171 |
| FUT4 AND NOT-PERP | 0.965794769 | 0.975609756 | 0.956175299 |
| FUT4 AND NOT-SMOC2 | 0.962376238 | 0.956692913 | 0.96812749 |
| FUT4 AND NOT-ATL2 | 0.934615385 | 0.903345725 | 0.96812749 |
| FUT4 AND NOT-TMEM168 | 0.956349206 | 0.95256917 | 0.960159363 |
| FUT4 AND NOT-SGCB | 0.966067864 | 0.968 | 0.964143426 |
| FUT4 AND NOT-ITSN1 | 0.957403651 | 0.975206612 | 0.940239044 |
| FUT4 AND NOT-HRCT1 | 0.960474308 | 0.952941176 | 0.96812749 |
| FUT4 AND NOT-SI | 0.960474308 | 0.952941176 | 0.96812749 |
| FUT4 AND NOT-CDCP1 | 0.960474308 | 0.952941176 | 0.96812749 |
| FUT4 AND NOT-CASD1 | 0.952755906 | 0.941634241 | 0.964143426 |
| FUT4 AND NOT-LRRC19 | 0.960474308 | 0.952941176 | 0.96812749 |
| FUT4 AND NOT-SLC30A5 | 0.946322068 | 0.944444444 | 0.948207171 |
| FUT4 AND NOT-SLC26A6 | 0.954274354 | 0.952380952 | 0.956175299 |
| FUT4 AND NOT-SLC1A1 | 0.960474308 | 0.952941176 | 0.96812749 |
| FUT4 AND NOT-SLC3A1 | 0.956349206 | 0.95256917 | 0.960159363 |
| FUT4 AND NOT-SLC12A2 | 0.952755906 | 0.941634241 | 0.964143426 |
| FUT4 AND NOT-SLC16A1 | 0.954274354 | 0.952380952 | 0.956175299 |
| FUT4 AND NOT-SLC20A2 | 0.962376238 | 0.956692913 | 0.96812749 |
| FUT4 AND NOT-SLCO2A1 | 0.960474308 | 0.952941176 | 0.96812749 |
| FUT4 AND NOT-BMPR1A | 0.950617284 | 0.982978723 | 0.920318725 |
| FUT4 AND NOT-SLC22A5 | 0.960474308 | 0.952941176 | 0.96812749 |
| FUT4 AND NOT-GRAMD3 | 0.960474308 | 0.952941176 | 0.96812749 |
| FUT4 AND NOT-BMPR2 | 0.960824742 | 0.995726496 | 0.928286853 |
| FUT4 AND NOT-CYP4F12 | 0.958415842 | 0.952755906 | 0.964143426 |
| FUT4 AND NOT-SMPD1 | 0.958250497 | 0.956349206 | 0.960159363 |
| FUT4 AND NOT-SPINT1 | 0.954455446 | 0.948818898 | 0.960159363 |
| FUT4 AND NOT-SSTR1 | 0.958579882 | 0.94921875 | 0.96812749 |
| FUT4 AND NOT-ST14 | 0.956 | 0.959839357 | 0.952191235 |
| FUT4 AND NOT-TGFA | 0.956349206 | 0.95256917 | 0.960159363 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-C1orf27 | 0.933333333 | 0.93333333 | 0.933333333 | FUT4 AND NOT-TLR3 | 0.954274354 | 0.952380952 | 0.956175299 |
| TNFRSF8 AND NOT-HCRT | 0.933333333 | 0.93333333 | 0.933333333 | FUT4 AND NOT-TSPAN8 | 0.962376238 | 0.956692913 | 0.96812749 |
| TNFRSF8 AND NOT-NDUFA4L2 | 0.933333333 | 0.93333333 | 0.933333333 | FUT4 AND NOT-TSPAN6 | 0.966202783 | 0.964285714 | 0.96812749 |
| TNFRSF8 AND NOT-ECM1 | 0.933333333 | 0.93333333 | 0.933333333 | FUT4 AND NOT-TMPRSS2 | 0.960474308 | 0.952941176 | 0.96812749 |
| TNFRSF8 AND NOT-SLC6A12 | 0.965517241 | 1 | 0.933333333 | FUT4 AND NOT-TLCD2 | 0.960474308 | 0.952941176 | 0.96812749 |
| TNFRSF8 AND NOT-TMEM189 | 0.933333333 | 0.93333333 | 0.933333333 | FUT4 AND NOT-UGT2B15 | 0.94368932 | 0.920454545 | 0.96812749 |
| TNFRSF8 AND NOT-DSCAM | 0.933333333 | 0.93333333 | 0.933333333 | FUT4 AND NOT-UGT2B17 | 0.94368932 | 0.920454545 | 0.96812749 |
| TNFRSF8 AND NOT-GPR135 | 0.933333333 | 0.93333333 | 0.933333333 | FUT4 AND NOT-UGT8 | 0.960474308 | 0.952941176 | 0.96812749 |
| TNFRSF8 AND NOT-VSIG10 | 0.933333333 | 0.93333333 | 0.933333333 | FUT4 AND NOT-VIPR1 | 0.953907816 | 0.959677419 | 0.948207171 |
| TNFRSF8 AND NOT-TMEM79 | 0.933333333 | 0.93333333 | 0.933333333 | FUT4 AND NOT-WNT5A | 0.960474308 | 0.952941176 | 0.96812749 |
| TNFRSF8 AND NOT-CA9 | 0.933333333 | 0.93333333 | 0.933333333 | FUT4 AND NOT-CA4 | 0.955645161 | 0.967346939 | 0.944223108 |
| TNFRSF8 AND NOT-GOSR2 | 0.933333333 | 0.93333333 | 0.933333333 | FUT4 AND NOT-CA12 | 0.960474308 | 0.952941176 | 0.96812749 |
| TNFRSF8 AND NOT-RTN2 | 0.933333333 | 0.93333333 | 0.933333333 | FUT4 AND NOT-DDR1 | 0.960474308 | 0.952941176 | 0.96812749 |
| TNFRSF8 AND NOT-TMEM121 | 0.933333333 | 0.93333333 | 0.933333333 | FUT4 AND NOT-FZD5 | 0.956175299 | 0.956175299 | 0.956175299 |
| TNFRSF8 AND NOT-GPR63 | 0.933333333 | 0.93333333 | 0.933333333 | FUT4 AND NOT-SLMAP | 0.9375 | 0.982532751 | 0.896414343 |
| TNFRSF8 AND NOT-NPBWR2 | 0.933333333 | 0.93333333 | 0.933333333 | FUT4 AND NOT-ELOVL6 | 0.956349206 | 0.95256917 | 0.960159363 |
| TNFRSF8 AND NOT-TMEM52B | 0.933333333 | 0.93333333 | 0.933333333 | FUT4 AND NOT-FA2H | 0.960474308 | 0.952941176 | 0.96812749 |
| TNFRSF8 AND NOT-KCNJ5 | 0.933333333 | 0.93333333 | 0.933333333 | FUT4 AND NOT-GDPD3 | 0.960474308 | 0.952941176 | 0.96812749 |
| TNFRSF8 AND NOT-UNC93B1 | 0.933333333 | 0.93333333 | 0.933333333 | FUT4 AND NOT-DHRS11 | 0.960474308 | 0.952941176 | 0.96812749 |
| TNFRSF8 AND NOT-MAS1 | 0.933333333 | 0.93333333 | 0.933333333 | FUT4 AND NOT-MFSD11 | 0.94214876 | 0.978540773 | 0.908366534 |
| TNFRSF8 AND NOT-MARCH8 | 0.933333333 | 0.93333333 | 0.933333333 | FUT4 AND NOT-RNF128 | 0.962376238 | 0.956692913 | 0.96812749 |
| TNFRSF8 AND NOT-P2RY6 | 0.933333333 | 0.93333333 | 0.933333333 | FUT4 AND NOT-C3orf52 | 0.960474308 | 0.952941176 | 0.96812749 |
| TNFRSF8 AND NOT-PEBP4 | 0.933333333 | 0.93333333 | 0.933333333 | FUT4 AND NOT-GAL3ST4 | 0.934156379 | 0.965957447 | 0.90438247 |
| TNFRSF8 AND NOT-SCAMP5 | 0.933333333 | 0.93333333 | 0.933333333 | FUT4 AND NOT-GALNT12 | 0.943548387 | 0.955102041 | 0.932270916 |
| TNFRSF8 AND NOT-SLC12A9 | 0.933333333 | 0.93333333 | 0.933333333 | FUT4 AND NOT-CCDC51 | 0.948665298 | 0.978813559 | 0.920318725 |
| TNFRSF8 AND NOT-REEP2 | 0.965517241 | 1 | 0.933333333 | FUT4 AND NOT-C1orf115 | 0.964143426 | 0.964143426 | 0.964143426 |
| TNFRSF8 AND NOT-MTUS1 | 0.933333333 | 0.93333333 | 0.933333333 | FUT4 AND NOT-TXNDC15 | 0.921775899 | 0.981981982 | 0.868525896 |
| TNFRSF8 AND NOT-G6PC2 | 0.933333333 | 0.93333333 | 0.933333333 | FUT4 AND NOT-CLMN | 0.953346856 | 0.97107438 | 0.93625498 |
| TNFRSF8 AND NOT-ST8SIA3 | 0.933333333 | 0.93333333 | 0.933333333 | FUT4 AND NOT-C12orf49 | 0.96993988 | 0.975806452 | 0.964143426 |
| TNFRSF8 AND NOT-ARSB | 0.933333333 | 0.93333333 | 0.933333333 | FUT4 AND NOT-UGT2A3 | 0.956349206 | 0.95256917 | 0.960159363 |
| TNFRSF8 AND NOT-MRGPRX4 | 0.933333333 | 0.93333333 | 0.933333333 | FUT4 AND NOT-TMC5 | 0.960474308 | 0.952941176 | 0.96812749 |
| TNFRSF8 AND NOT-UTY | 0.933333333 | 0.93333333 | 0.933333333 | FUT4 AND NOT-THSD4 | 0.960474308 | 0.952941176 | 0.96812749 |
| TNFRSF8 AND NOT-SLC36A4 | 0.933333333 | 0.93333333 | 0.933333333 | FUT4 AND NOT-BTNL8 | 0.952755906 | 0.941634241 | 0.964143426 |
| TNFRSF8 AND NOT-GPR137 | 0.933333333 | 0.93333333 | 0.933333333 | FUT4 AND NOT-DNAJC22 | 0.960474308 | 0.952941176 | 0.96812749 |
| TNFRSF8 AND NOT-KCNJ12 | 0.933333333 | 0.93333333 | 0.933333333 | NOT-WLS AND FUT4 | 0.96222664 | 0.96031746 | 0.964143426 |
| TNFRSF8 AND NOT-HHATL | 0.933333333 | 0.93333333 | 0.933333333 | FUT4 AND NOT-CPED1 | 0.943632568 | 0.99122807 | 0.900398406 |
| TNFRSF8 AND NOT-ADGRG7 | 0.933333333 | 0.93333333 | 0.933333333 | FUT4 AND NOT-ELOVL7 | 0.961770624 | 0.971544715 | 0.952191235 |
| TNFRSF8 AND NOT-UPK1A | 0.933333333 | 0.93333333 | 0.933333333 | FUT4 AND NOT-TMEM62 | 0.960474308 | 0.952941176 | 0.96812749 |
| TNFRSF8 AND NOT-SLC25A2 | 0.933333333 | 0.93333333 | 0.933333333 | FUT4 AND NOT-SEMA6D | 0.960474308 | 0.952941176 | 0.96812749 |
| TNFRSF8 AND NOT-DCBLD2 | 0.933333333 | 0.93333333 | 0.933333333 | FUT4 AND NOT-CWH43 | 0.958579882 | 0.94921875 | 0.96812749 |
| TNFRSF8 AND NOT-OPRK1 | 0.933333333 | 0.93333333 | 0.933333333 | FUT4 AND NOT-TMEM254 | 0.954274354 | 0.952380952 | 0.956175299 |
| TNFRSF8 AND NOT-SLC15A3 | 0.933333333 | 0.93333333 | 0.933333333 | FUT4 AND NOT-PIGZ | 0.956521739 | 0.949019608 | 0.964143426 |
| TNFRSF8 AND NOT-GPR31 | 0.933333333 | 0.93333333 | 0.933333333 | FUT4 AND NOT-SLC35F5 | 0.957230143 | 0.979166667 | 0.93625498 |
| TNFRSF8 AND NOT-SSTR5 | 0.933333333 | 0.93333333 | 0.933333333 | FUT4 AND NOT-SLC44A4 | 0.960474308 | 0.952941176 | 0.96812749 |
| TNFRSF8 AND NOT-FAM9C | 0.933333333 | 0.93333333 | 0.933333333 | FUT4 AND NOT-CYB5B | 0.964 | 0.967871486 | 0.960159363 |
| TNFRSF8 AND NOT-LINGO3 | 0.933333333 | 0.93333333 | 0.933333333 | FUT4 AND NOT-SSPN | 0.953722334 | 0.963414634 | 0.944223108 |
| TNFRSF8 AND NOT-AASDH | 0.965517241 | 1 | 0.933333333 | FUT4 AND NOT-SLC2A10 | 0.962376238 | 0.956692913 | 0.96812749 |
| TNFRSF8 AND NOT-GPR12 | 0.933333333 | 0.93333333 | 0.933333333 | FUT4 AND NOT-SGPP1 | 0.901960784 | 0.995192308 | 0.824701195 |
| TNFRSF8 AND NOT-FIBCD1 | 0.933333333 | 0.93333333 | 0.933333333 | FUT4 AND NOT-YIPF5 | 0.973843058 | 0.983739837 | 0.964143426 |
| TNFRSF8 AND NOT-CD40LG | 0.965517241 | 1 | 0.933333333 | FUT4 AND NOT-VWA9 | 0.945674044 | 0.955284553 | 0.93625498 |
| TNFRSF8 AND NOT-TIMM50 | 0.933333333 | 0.93333333 | 0.933333333 | FUT4 AND NOT-AKAP1 | 0.96031746 | 0.956521739 | 0.964143426 |
| TNFRSF8 AND NOT-TRAF3IP3 | 0.965517241 | 1 | 0.933333333 | FUT4 AND NOT-RNF170 | 0.942386831 | 0.974468085 | 0.912350598 |
| TNFRSF8 AND NOT-TAS1R2 | 0.933333333 | 0.93333333 | 0.933333333 | FUT4 AND NOT-GLT8D2 | 0.96812749 | 0.96812749 | 0.96812749 |
| TNFRSF8 AND NOT-C9orf91 | 0.965517241 | 1 | 0.933333333 | FUT4 AND NOT-TMEM47 | 0.96812749 | 0.96812749 | 0.96812749 |
| TNFRSF8 AND NOT-NDST3 | 0.933333333 | 0.93333333 | 0.933333333 | FUT4 AND NOT-MS4A8 | 0.960474308 | 0.952941176 | 0.96812749 |
| TNFRSF8 AND NOT-MIEF2 | 0.965517241 | 1 | 0.933333333 | FUT4 AND NOT-TMEM133 | 0.96812749 | 0.96812749 | 0.96812749 |
| TNFRSF8 AND NOT-EPHB6 | 0.933333333 | 0.93333333 | 0.933333333 | FUT4 AND NOT-PLA2G10 | 0.960474308 | 0.952941176 | 0.96812749 |
| TNFRSF8 AND NOT-KCNA7 | 0.933333333 | 0.93333333 | 0.933333333 | FUT4 AND NOT-SLC41A2 | 0.960474308 | 0.952941176 | 0.96812749 |
| TNFRSF8 AND NOT-B3GALT2 | 0.933333333 | 0.93333333 | 0.933333333 | FUT4 AND NOT-ZNRF3 | 0.956349206 | 0.95256917 | 0.960159363 |
| TNFRSF8 AND NOT-ADAM20 | 0.933333333 | 0.93333333 | 0.933333333 | FUT4 AND NOT-TMEM117 | 0.960474308 | 0.952941176 | 0.96812749 |
| TNFRSF8 AND NOT-SMIM8 | 0.933333333 | 0.93333333 | 0.933333333 | FUT4 AND NOT-RHBDD1 | 0.936416185 | 0.906716418 | 0.96812749 |
| TNFRSF8 AND NOT-MGAT4A | 0.933333333 | 0.93333333 | 0.933333333 | FUT4 AND NOT-SLC37A3 | 0.963414634 | 0.98340249 | 0.944223108 |
| TNFRSF8 AND NOT-IL1RAPL2 | 0.933333333 | 0.93333333 | 0.933333333 | FUT4 AND NOT-YIPF4 | 0.968 | 0.97188755 | 0.964143426 |
| TNFRSF8 AND NOT-CACHD1 | 0.933333333 | 0.93333333 | 0.933333333 | FUT4 AND NOT-FAM213A | 0.959839357 | 0.967611336 | 0.952191235 |
| TNFRSF8 AND NOT-TMBIM1 | 0.965517241 | 1 | 0.933333333 | FUT4 AND NOT-TMEM246 | 0.960474308 | 0.952941176 | 0.96812749 |
| TNFRSF8 AND NOT-BEST1 | 0.933333333 | 0.93333333 | 0.933333333 | FUT4 AND NOT-SLC12A8 | 0.960474308 | 0.952941176 | 0.96812749 |
| TNFRSF8 AND NOT-MUC15 | 0.933333333 | 0.93333333 | 0.933333333 | FUT4 AND NOT-HIATL1 | 0.946322068 | 0.944444444 | 0.948207171 |
| TNFRSF8 AND NOT-MALRD1 | 0.933333333 | 0.93333333 | 0.933333333 | FUT4 AND NOT-MFSD9 | 0.958415842 | 0.952755906 | 0.964143426 |
| TNFRSF8 AND NOT-AMIGO2 | 0.928571429 | 1 | 0.866666667 | FUT4 AND NOT-ADTRP | 0.968 | 0.97188755 | 0.964143426 |
| TNFRSF8 AND NOT-PKD1L2 | 0.933333333 | 0.93333333 | 0.933333333 | FUT4 AND NOT-AIFM2 | 0.958415842 | 0.952755906 | 0.964143426 |
| TNFRSF8 AND NOT-GHRHR | 0.928571429 | 1 | 0.866666667 | FUT4 AND NOT-TMEM87B | 0.942857143 | 0.966527197 | 0.920318725 |
| TNFRSF8 AND NOT-CD5 | 0.965517241 | 1 | 0.933333333 | FUT4 AND NOT-LRP11 | 0.9437751 | 0.951417004 | 0.93625498 |
| TNFRSF8 AND NOT-KCNK7 | 0.933333333 | 0.93333333 | 0.933333333 | FUT4 AND NOT-PAQR8 | 0.961460446 | 0.979338843 | 0.944223108 |
| TNFRSF8 AND NOT-SMIM2 | 0.933333333 | 0.93333333 | 0.933333333 | FUT4 AND NOT-CDC14B | 0.975806452 | 0.987755102 | 0.964143426 |
| TNFRSF8 AND NOT-SELP | 0.933333333 | 0.93333333 | 0.933333333 | FUT4 AND NOT-PPAP2A | 0.941176471 | 0.958677686 | 0.924302789 |
| TNFRSF8 AND NOT-TMEM125 | 0.933333333 | 0.93333333 | 0.933333333 | FUT4 AND NOT-PPAP2C | 0.960474308 | 0.952941176 | 0.96812749 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-LY6G6F | 0.933333333 | 0.933333333 | 0.933333333 | FUT4 AND NOT-AOC3 | 0.966067864 | 0.968 | 0.964143426 |
| TNFRSF8 AND NOT-RPS23 | 0.933333333 | 0.933333333 | 0.933333333 | FUT4 AND NOT-SLC4A4 | 0.956349206 | 0.95256917 | 0.960159363 |
| TNFRSF8 AND NOT-CD1C | 0.965517241 | 1 | 0.933333333 | FUT4 AND NOT-B4GALT4 | 0.957915832 | 0.963709677 | 0.952191235 |
| TNFRSF8 AND NOT-SLC22A11 | 0.933333333 | 0.933333333 | 0.933333333 | FUT4 AND NOT-B3GALT4 | 0.948665298 | 0.978813559 | 0.920318725 |
| TNFRSF8 AND NOT-CHRNB4 | 0.933333333 | 0.933333333 | 0.933333333 | FUT4 AND NOT-ABCC3 | 0.960474308 | 0.952941176 | 0.96812749 |
| TNFRSF8 AND NOT-EPHA10 | 0.933333333 | 0.933333333 | 0.933333333 | FUT4 AND NOT-TNFSF10 | 0.937759336 | 0.978354978 | 0.900398406 |
| TNFRSF8 AND NOT-GABRA5 | 0.933333333 | 0.933333333 | 0.933333333 | FUT4 AND NOT-TNFRSF11A | 0.960474308 | 0.952941176 | 0.96812749 |
| TNFRSF8 AND NOT-PCDHGA9 | 0.933333333 | 0.933333333 | 0.933333333 | FUT4 AND NOT-PEX11B | 0.965931864 | 0.971774194 | 0.960159363 |
| TNFRSF8 AND NOT-SLC6A1 | 0.933333333 | 0.933333333 | 0.933333333 | FUT4 AND NOT-PEX11A | 0.960474308 | 0.952941176 | 0.96812749 |
| TNFRSF8 AND NOT-COL25A1 | 0.933333333 | 0.933333333 | 0.933333333 | FUT4 AND NOT-SGPL1 | 0.97188755 | 0.979757085 | 0.964143426 |
| TNFRSF8 AND NOT-SLC41A1 | 0.933333333 | 0.933333333 | 0.933333333 | FUT4 AND NOT-SGCE | 0.962075848 | 0.964 | 0.960159363 |
| TNFRSF8 AND NOT-HMGCR | 0.933333333 | 0.933333333 | 0.933333333 | FUT4 AND NOT-P4HA2 | 0.966202783 | 0.964285714 | 0.96812749 |
| TNFRSF8 AND NOT-ZDHHC21 | 0.933333333 | 0.933333333 | 0.933333333 | FUT4 AND NOT-GLB1L2 | 0.954274354 | 0.952380952 | 0.956175299 |
| TNFRSF8 AND NOT-ADAM8 | 0.965517241 | 1 | 0.933333333 | FUT4 AND NOT-PHLDB2 | 0.975708502 | 0.991769547 | 0.960159363 |
| TNFRSF8 AND NOT-VANGL2 | 0.933333333 | 0.933333333 | 0.933333333 | FUT4 AND NOT-MPZL1 | 0.958415842 | 0.952755906 | 0.964143426 |
| TNFRSF8 AND NOT-P2RY12 | 0.933333333 | 0.933333333 | 0.933333333 | FUT4 AND NOT-TM4SF5 | 0.958579882 | 0.94921875 | 0.96812749 |
| TNFRSF8 AND NOT-CDRT15L2 | 0.933333333 | 0.933333333 | 0.933333333 | FUT4 AND NOT-SEMA5A | 0.960474308 | 0.952941176 | 0.96812749 |
| TNFRSF8 AND NOT-NSG1 | 0.933333333 | 0.933333333 | 0.933333333 | FUT4 AND NOT-SPAG9 | 0.949290061 | 0.966942149 | 0.932270916 |
| TNFRSF8 AND NOT-TSPAN10 | 0.933333333 | 0.933333333 | 0.933333333 | FUT4 AND NOT-TMEM263 | 0.935817805 | 0.974137931 | 0.900398406 |
| TNFRSF8 AND NOT-NIPA1 | 0.933333333 | 0.933333333 | 0.933333333 | FUT4 AND NOT-GPRC5A | 0.960474308 | 0.952941176 | 0.96812749 |
| TNFRSF8 AND NOT-S1PR5 | 0.965517241 | 1 | 0.933333333 | FUT4 AND NOT-MCU | 0.954091816 | 0.956 | 0.952191235 |
| TNFRSF8 AND NOT-SCN3B | 0.933333333 | 0.933333333 | 0.933333333 | FUT4 AND NOT-SLC13A2 | 0.940038685 | 0.913533835 | 0.96812749 |
| TNFRSF8 AND NOT-SLC29A1 | 0.933333333 | 0.933333333 | 0.933333333 | FUT4 AND NOT-ANGPTL1 | 0.964285714 | 0.960474308 | 0.96812749 |
| TNFRSF8 AND NOT-SUSD3 | 0.928571429 | 1 | 0.866666667 | FUT4 AND NOT-CLDN8 | 0.960474308 | 0.952941176 | 0.96812749 |
| TNFRSF8 AND NOT-GLRA3 | 0.933333333 | 0.933333333 | 0.933333333 | FUT4 AND NOT-PKDCC | 0.96031746 | 0.956521739 | 0.964143426 |
| TNFRSF8 AND NOT-ITPR3 | 0.933333333 | 0.933333333 | 0.933333333 | FUT4 AND NOT-SLC28A2 | 0.938223938 | 0.91011236 | 0.96812749 |
| TNFRSF8 AND NOT-ACHE | 0.933333333 | 0.933333333 | 0.933333333 | FUT4 AND NOT-PCSK7 | 0.967741935 | 0.979591837 | 0.956175299 |
| TNFRSF8 AND NOT-OR4N4 | 0.933333333 | 0.933333333 | 0.933333333 | FUT4 AND NOT-MARVELD3 | 0.960474308 | 0.952941176 | 0.96812749 |
| TNFRSF8 AND NOT-CD300LB | 0.965517241 | 1 | 0.933333333 | FUT4 AND NOT-SLC33A1 | 0.95481336 | 0.941860465 | 0.96812749 |
| TNFRSF8 AND NOT-SIGLEC7 | 0.928571429 | 1 | 0.866666667 | FUT4 AND NOT-ACVR1B | 0.959839357 | 0.967611336 | 0.952191235 |
| TNFRSF8 AND NOT-RIC3 | 0.933333333 | 0.933333333 | 0.933333333 | FUT4 AND NOT-LARGE | 0.938223938 | 0.91011236 | 0.96812749 |
| TNFRSF8 AND NOT-ERMAP | 0.965517241 | 1 | 0.933333333 | FUT4 AND NOT-VAPB | 0.973947896 | 0.97983871 | 0.96812749 |
| TNFRSF8 AND NOT-ADGRG4 | 0.933333333 | 0.933333333 | 0.933333333 | FUT4 AND NOT-TMEM129 | 0.959839357 | 0.967611336 | 0.952191235 |
| TNFRSF8 AND NOT-PCDH11X | 0.933333333 | 0.933333333 | 0.933333333 | FUT4 AND NOT-CRB3 | 0.960474308 | 0.952941176 | 0.96812749 |
| TNFRSF8 AND NOT-KRT5 | 0.933333333 | 0.933333333 | 0.933333333 | FUT4 AND NOT-PXYLP1 | 0.948240166 | 0.987068966 | 0.912350598 |
| TNFRSF8 AND NOT-HTR2A | 0.933333333 | 0.933333333 | 0.933333333 | FUT4 AND NOT-GCNT3 | 0.960474308 | 0.952941176 | 0.96812749 |
| TNFRSF8 AND NOT-FREM1 | 0.933333333 | 0.933333333 | 0.933333333 | FUT4 AND NOT-ACVR2A | 0.967741935 | 0.979591837 | 0.956175299 |
| TNFRSF8 AND NOT-LVRN | 0.933333333 | 0.933333333 | 0.933333333 | FUT4 AND NOT-PGAP3 | 0.964 | 0.967871486 | 0.960159363 |
| TNFRSF8 AND NOT-GLTPD2 | 0.933333333 | 0.933333333 | 0.933333333 | FUT4 AND NOT-SDR42E1 | 0.960474308 | 0.952941176 | 0.96812749 |
| TNFRSF8 AND NOT-FXYD1 | 0.965517241 | 1 | 0.933333333 | FUT4 AND NOT-KL | 0.959677419 | 0.971428571 | 0.948207171 |
| TNFRSF8 AND NOT-TMCC1 | 0.933333333 | 0.933333333 | 0.933333333 | FUT4 AND NOT-CD27 | 0.929166667 | 0.973799127 | 0.888446215 |
| TNFRSF8 AND NOT-TNFRSF1B | 0.965517241 | 1 | 0.933333333 | FUT4 AND NOT-ORMDL3 | 0.939958592 | 0.978448276 | 0.90438247 |
| TNFRSF8 AND NOT-SLC2A12 | 0.933333333 | 0.933333333 | 0.933333333 | FUT4 AND NOT-KCNK6 | 0.959016393 | 0.987341772 | 0.932270916 |
| TNFRSF8 AND NOT-CAMKMT | 0.933333333 | 0.933333333 | 0.933333333 | FUT4 AND NOT-ACVRL1 | 0.958579882 | 0.94921875 | 0.96812749 |
| TNFRSF8 AND NOT-PGAP3 | 0.965517241 | 1 | 0.933333333 | FUT4 AND NOT-SCARB2 | 0.941649899 | 0.951219512 | 0.932270916 |
| TNFRSF8 AND NOT-SLC22A25 | 0.933333333 | 0.933333333 | 0.933333333 | FUT4 AND NOT-GOSR1 | 0.946280992 | 0.982832618 | 0.912350598 |
| TNFRSF8 AND NOT-LRP8 | 0.933333333 | 0.933333333 | 0.933333333 | FUT4 AND NOT-CXCL14 | 0.960474308 | 0.952941176 | 0.96812749 |
| TNFRSF8 AND NOT-ST7L | 0.933333333 | 0.933333333 | 0.933333333 | FUT4 AND NOT-ENTPD5 | 0.960474308 | 0.952941176 | 0.96812749 |
| TNFRSF8 AND NOT-NUP210 | 0.933333333 | 0.933333333 | 0.933333333 | FUT4 AND NOT-CD151 | 0.948 | 0.951807229 | 0.944223108 |
| TNFRSF8 AND NOT-TMPRSS13 | 0.933333333 | 0.933333333 | 0.933333333 | FUT4 AND NOT-HEPH | 0.954274354 | 0.952380952 | 0.956175299 |
| TNFRSF8 AND NOT-PCDHA2 | 0.933333333 | 0.933333333 | 0.933333333 | FUT4 AND NOT-ATP2C2 | 0.954091816 | 0.956 | 0.952191235 |
| TNFRSF8 AND NOT-TRPC3 | 0.933333333 | 0.933333333 | 0.933333333 | FUT4 AND NOT-MFN2 | 0.954918033 | 0.983122363 | 0.928286853 |
| TNFRSF8 AND NOT-IL22RA1 | 0.928571429 | 1 | 0.866666667 | FUT4 AND NOT-CDH1 | 0.960474308 | 0.952941176 | 0.96812749 |
| TNFRSF8 AND NOT-PHTF1 | 0.933333333 | 0.933333333 | 0.933333333 | P2RX1 AND NOT-MFSD8 | 0.929791271 | 0.887681159 | 0.976095618 |
| TNFRSF8 AND NOT-PSEN1 | 0.933333333 | 0.933333333 | 0.933333333 | SMIM3 AND NOT-PARM1 | 0.960629921 | 0.949416342 | 0.972111554 |
| TNFRSF8 AND NOT-NEMP2 | 0.933333333 | 0.933333333 | 0.933333333 | NOT-FAM69A AND NOT-ABI3BP | 0.956022945 | 0.919117647 | 0.996015936 |
| TNFRSF8 AND NOT-SLC13A5 | 0.933333333 | 0.933333333 | 0.933333333 | NOT-PFN2 AND NOT-NCR3 | 0.937853107 | 0.889285714 | 0.992031873 |
| TNFRSF8 AND NOT-PTPRC | 0.965517241 | 1 | 0.933333333 | NOT-LRIG1 AND CXCL8 | 0.946360153 | 0.911439114 | 0.984063745 |
| TNFRSF8 AND NOT-OS9 | 0.933333333 | 0.933333333 | 0.933333333 | NRROS AND NOT-LRIG1 | 0.940936864 | 0.9625 | 0.920318725 |
| TNFRSF8 AND NOT-OCLM | 0.933333333 | 0.933333333 | 0.933333333 | P2RX1 AND NOT-LRIG1 | 0.962524655 | 0.953125 | 0.972111554 |
| TNFRSF8 AND NOT-ABCA3 | 0.933333333 | 0.933333333 | 0.933333333 | NOT-LRIG1 AND UBE2J1 | 0.921933086 | 0.864111498 | 0.988047809 |
| TNFRSF8 AND NOT-AIFM1 | 0.933333333 | 0.933333333 | 0.933333333 | NOT-LRIG1 AND FXYD5 | 0.930581614 | 0.879432624 | 0.988047809 |
| TNFRSF8 AND NOT-RARRES3 | 0.965517241 | 1 | 0.933333333 | NOT-LRIG1 AND SUSD1 | 0.946322068 | 0.944444444 | 0.948207171 |
| TNFRSF8 AND NOT-TMEM86B | 0.933333333 | 0.933333333 | 0.933333333 | NOT-LRIG1 AND SMIM3 | 0.953846154 | 0.921933086 | 0.988047809 |
| TNFRSF8 AND NOT-NELL2 | 0.965517241 | 1 | 0.933333333 | SMIM3 AND NOT-STEAP1 | 0.946954813 | 0.934108527 | 0.960159363 |
| TNFRSF8 AND NOT-RNF167 | 0.933333333 | 0.933333333 | 0.933333333 | NOT-GHR AND SMIM3 | 0.961089494 | 0.939163498 | 0.984063745 |
| TNFRSF8 AND NOT-PCDHA10 | 0.933333333 | 0.933333333 | 0.933333333 | P2RY8 AND NOT-SIT1 | 0.940726577 | 0.904411765 | 0.980079681 |
| TNFRSF8 AND NOT-SV2C | 0.965517241 | 1 | 0.933333333 | HBD AND NOT-SIT1 | 0.941860465 | 0.916981132 | 0.96812749 |
| TNFRSF8 AND NOT-CACNG8 | 0.928571429 | 1 | 0.866666667 | NOT-PFN2 AND NOT-SIT1 | 0.966861598 | 0.946564885 | 0.988047809 |
| TNFRSF8 AND NOT-PCDHA9 | 0.933333333 | 0.933333333 | 0.933333333 | NOT-PFN2 AND NOT-P2RY10 | 0.953125 | 0.9348659 | 0.972111554 |
| TNFRSF8 AND NOT-HCRTR1 | 0.933333333 | 0.933333333 | 0.933333333 | NOT-MINOS1 AND TOR2A | 0.93957115 | 0.919847328 | 0.960159363 |
| TNFRSF8 AND NOT-CLPTM1 | 0.933333333 | 0.933333333 | 0.933333333 | NOT-VAPB AND TOR2A | 0.935849057 | 0.888888889 | 0.988047809 |
| TNFRSF8 AND NOT-DPM2 | 0.933333333 | 0.933333333 | 0.933333333 | NOT-PFN2 AND NOT-SLC46A3 | 0.9348659 | 0.900369004 | 0.972111554 |
| TNFRSF8 AND NOT-RPRML | 0.933333333 | 0.933333333 | 0.933333333 | NOT-FAM69A AND C16orf54 | 0.972762646 | 0.950570342 | 0.996015936 |
| TNFRSF8 AND NOT-KIAA1549L | 0.933333333 | 0.933333333 | 0.933333333 | SMIM3 AND NOT-ANG | 0.936170213 | 0.909774436 | 0.964143426 |
| TNFRSF8 AND NOT-CYP3A7 | 0.933333333 | 0.933333333 | 0.933333333 | NOT-MTUS1 AND NOT-CYB561D1 | 0.936660269 | 0.903703704 | 0.972111554 |

FIG. 1 (CONT.)

| Antigen Pair Logic | F1 | Precision | Recall |
|---|---|---|---|
| TNFRSF8 AND NOT-SLC43A2 | 0.965517241 | 1 | 0.933333333 |
| TNFRSF8 AND NOT-KCNN2 | 0.933333333 | 0.93333333 | 0.933333333 |
| TNFRSF8 AND NOT-TMEM35 | 0.933333333 | 0.93333333 | 0.933333333 |
| TNFRSF8 AND NOT-SLC9B1 | 0.933333333 | 0.93333333 | 0.933333333 |
| TNFRSF8 AND NOT-HAS3 | 0.933333333 | 0.93333333 | 0.933333333 |
| TNFRSF8 AND NOT-PTPN5 | 0.933333333 | 0.93333333 | 0.933333333 |
| TNFRSF8 AND NOT-GJD4 | 0.933333333 | 0.93333333 | 0.933333333 |
| TNFRSF8 AND NOT-PIGN | 0.933333333 | 0.93333333 | 0.933333333 |
| TNFRSF8 AND NOT-CHIC1 | 0.933333333 | 0.93333333 | 0.933333333 |
| TNFRSF8 AND NOT-MEGF6 | 0.933333333 | 0.93333333 | 0.933333333 |
| TNFRSF8 AND NOT-HSD17B2 | 0.933333333 | 0.93333333 | 0.933333333 |
| TNFRSF8 AND NOT-OR2B3 | 0.933333333 | 0.93333333 | 0.933333333 |
| TNFRSF8 AND NOT-ACSL6 | 0.965517241 | 1 | 0.933333333 |
| TNFRSF8 AND NOT-SPAST | 0.933333333 | 0.93333333 | 0.933333333 |
| TNFRSF8 AND NOT-GPR37 | 0.933333333 | 0.93333333 | 0.933333333 |
| TNFRSF8 AND NOT-TMEM63A | 0.928571429 | 1 | 0.866666667 |
| TNFRSF8 AND NOT-GPR180 | 0.933333333 | 0.93333333 | 0.933333333 |
| TNFRSF8 AND NOT-PLA2G2E | 0.933333333 | 0.93333333 | 0.933333333 |
| TNFRSF8 AND NOT-CACNG3 | 0.933333333 | 0.93333333 | 0.933333333 |
| TNFRSF8 AND NOT-ROMO1 | 0.933333333 | 0.93333333 | 0.933333333 |
| TNFRSF8 AND NOT-PDZD8 | 0.933333333 | 0.93333333 | 0.933333333 |
| TNFRSF8 AND NOT-SLC18B1 | 0.965517241 | 1 | 0.933333333 |
| TNFRSF8 AND NOT-TGFBR1 | 0.965517241 | 1 | 0.933333333 |
| TNFRSF8 AND NOT-FAIM2 | 0.933333333 | 0.93333333 | 0.933333333 |
| TNFRSF8 AND NOT-ACSS3 | 0.933333333 | 0.93333333 | 0.933333333 |
| TNFRSF8 AND NOT-SLITRK5 | 0.933333333 | 0.93333333 | 0.933333333 |
| TNFRSF8 AND NOT-XKRX | 0.933333333 | 0.93333333 | 0.933333333 |
| TNFRSF8 AND NOT-TNFRSF10C | 0.928571429 | 1 | 0.866666667 |
| TNFRSF8 AND NOT-MARCH3 | 0.933333333 | 0.93333333 | 0.933333333 |
| TNFRSF8 AND NOT-GPATCH2L | 0.933333333 | 0.93333333 | 0.933333333 |
| TNFRSF8 AND NOT-WNT6 | 0.933333333 | 0.93333333 | 0.933333333 |
| TNFRSF8 AND NOT-IFNE | 0.933333333 | 0.93333333 | 0.933333333 |
| TNFRSF8 AND NOT-KCNN3 | 0.933333333 | 0.93333333 | 0.933333333 |
| TNFRSF8 AND NOT-TMUB2 | 0.933333333 | 0.93333333 | 0.933333333 |
| TNFRSF8 AND NOT-MSR1 | 0.933333333 | 0.93333333 | 0.933333333 |
| TNFRSF8 AND NOT-CLCN4 | 0.965517241 | 1 | 0.933333333 |
| TNFRSF8 AND NOT-LRIT1 | 0.933333333 | 0.93333333 | 0.933333333 |
| TNFRSF8 AND NOT-CLMN | 0.965517241 | 1 | 0.933333333 |
| TNFRSF8 AND NOT-SEMA4B | 0.933333333 | 0.93333333 | 0.933333333 |
| TNFRSF8 AND NOT-HCN4 | 0.933333333 | 0.93333333 | 0.933333333 |
| TNFRSF8 AND NOT-IGSF3 | 0.933333333 | 0.93333333 | 0.933333333 |
| TNFRSF8 AND NOT-IL18R1 | 0.933333333 | 0.93333333 | 0.933333333 |
| TNFRSF8 AND NOT-DAGLB | 0.928571429 | 1 | 0.866666667 |
| TNFRSF8 AND NOT-KIAA1549 | 0.933333333 | 0.93333333 | 0.933333333 |
| TNFRSF8 AND NOT-SLC12A7 | 0.933333333 | 0.93333333 | 0.933333333 |
| TNFRSF8 AND NOT-TIMM21 | 0.933333333 | 0.93333333 | 0.933333333 |
| TNFRSF8 AND NOT-FCRLA | 0.928571429 | 1 | 0.866666667 |
| TNFRSF8 AND NOT-SYNDIG1 | 0.933333333 | 0.93333333 | 0.933333333 |
| TNFRSF8 AND NOT-DRD4 | 0.933333333 | 0.93333333 | 0.933333333 |
| TNFRSF8 AND NOT-SEC61A2 | 0.933333333 | 0.93333333 | 0.933333333 |
| TNFRSF8 AND NOT-NOX1 | 0.933333333 | 0.93333333 | 0.933333333 |
| TNFRSF8 AND NOT-VAMP5 | 0.933333333 | 0.93333333 | 0.933333333 |
| TNFRSF8 AND NOT-KCNH5 | 0.933333333 | 0.93333333 | 0.933333333 |
| TNFRSF8 AND NOT-CLDN2 | 0.933333333 | 0.93333333 | 0.933333333 |
| TNFRSF8 AND NOT-ALG10 | 0.933333333 | 0.93333333 | 0.933333333 |
| TNFRSF8 AND NOT-ARSF | 0.933333333 | 0.93333333 | 0.933333333 |
| TNFRSF8 AND NOT-SLC22A12 | 0.933333333 | 0.93333333 | 0.933333333 |
| TNFRSF8 AND NOT-ACSS1 | 0.933333333 | 0.93333333 | 0.933333333 |
| TNFRSF8 AND NOT-ICAM4 | 0.928571429 | 1 | 0.866666667 |
| TNFRSF8 AND NOT-PTDSS2 | 0.933333333 | 0.93333333 | 0.933333333 |
| TNFRSF8 AND NOT-SPTLC2 | 0.965517241 | 1 | 0.933333333 |
| TNFRSF8 AND NOT-CDH7 | 0.933333333 | 0.93333333 | 0.933333333 |
| TNFRSF8 AND NOT-APOB | 0.933333333 | 0.93333333 | 0.933333333 |
| TNFRSF8 AND NOT-CRY2 | 0.933333333 | 0.93333333 | 0.933333333 |
| TNFRSF8 AND NOT-TSPO | 0.928571429 | 1 | 0.866666667 |
| TNFRSF8 AND NOT-BMP10 | 0.933333333 | 0.93333333 | 0.933333333 |
| TNFRSF8 AND NOT-SCNN1B | 0.933333333 | 0.93333333 | 0.933333333 |
| TNFRSF8 AND NOT-CD180 | 0.933333333 | 0.93333333 | 0.933333333 |
| TNFRSF8 AND NOT-C12orf73 | 0.933333333 | 0.93333333 | 0.933333333 |
| TNFRSF8 AND NOT-CDHR1 | 0.933333333 | 0.93333333 | 0.933333333 |
| TNFRSF8 AND NOT-TSPAN16 | 0.965517241 | 1 | 0.933333333 |
| TNFRSF8 AND NOT-ADGRB1 | 0.933333333 | 0.93333333 | 0.933333333 |
| TNFRSF8 AND NOT-SMO | 0.933333333 | 0.93333333 | 0.933333333 |
| TNFRSF8 AND NOT-FAM210A | 0.933333333 | 0.93333333 | 0.933333333 |
| TNFRSF8 AND NOT-SCAMP4 | 0.933333333 | 0.93333333 | 0.933333333 |
| TNFRSF8 AND NOT-GPR3 | 0.933333333 | 0.93333333 | 0.933333333 |

| Antigen Pair Logic | F1 | Precision | Recall |
|---|---|---|---|
| NOT-DCBLD1 AND IL1RAP | 0.919148936 | 0.98630137 | 0.860557769 |
| SMIM3 AND NOT-SCARA5 | 0.964426877 | 0.956862745 | 0.972111554 |
| P2RY8 AND NOT-HLA-DOB | 0.944550669 | 0.908088235 | 0.984063745 |
| P2RY8 AND NOT-ITPR3 | 0.933837429 | 0.888489209 | 0.984063745 |
| NOT-FAM69A AND P2RY8 | 0.968627451 | 0.953667954 | 0.984063745 |
| P2RY8 AND NOT-SLC44A2 | 0.941176471 | 0.926640927 | 0.956175299 |
| P2RY8 AND NOT-ADAM19 | 0.93129771 | 0.893772894 | 0.972111554 |
| NOT-PHLDB2 AND P2RY8 | 0.933078394 | 0.897058824 | 0.972111554 |
| P2RY8 AND NOT-FCMR | 0.930320151 | 0.882142857 | 0.984063745 |
| NOT-PFN2 AND NOT-CLEC2D | 0.936090226 | 0.886120996 | 0.992031873 |
| NOT-SLC25A4 AND CXCL8 | 0.921933086 | 0.864111498 | 0.988047809 |
| NOT-SLC25A4 AND SMIM3 | 0.933586338 | 0.891304348 | 0.980079681 |
| NOT-PHLDB2 AND SEC61A1 | 0.946564885 | 0.908424908 | 0.988047809 |
| HBD AND NOT-HLA-DOB | 0.938223938 | 0.91011236 | 0.96812749 |
| HBD AND NOT-INPP4A | 0.934615385 | 0.903345725 | 0.96812749 |
| HBD AND NOT-KLRD1 | 0.934615385 | 0.903345725 | 0.96812749 |
| HBD AND NOT-LY9 | 0.936416185 | 0.906716418 | 0.96812749 |
| HBD AND NOT-MGAT5 | 0.942574257 | 0.937007874 | 0.948207171 |
| HBD AND NOT-INSIG2 | 0.936170213 | 0.909774436 | 0.964143426 |
| HBD AND NOT-TUBD1 | 0.94368932 | 0.920454545 | 0.96812749 |
| HBD AND NOT-TMEM140 | 0.942800789 | 0.93359375 | 0.952191235 |
| HBD AND NOT-SLC44A2 | 0.948207171 | 0.948207171 | 0.948207171 |
| HBD AND NOT-PTCH1 | 0.937743191 | 0.91634981 | 0.960159363 |
| HBD AND NOT-PIGDR | 0.941634241 | 0.920152091 | 0.964143426 |
| HBD AND NOT-PTPRO | 0.936416185 | 0.906716418 | 0.96812749 |
| HBD AND NOT-PVRIG | 0.939805825 | 0.916666667 | 0.964143426 |
| HBD AND NOT-RHBDD1 | 0.934362934 | 0.906367041 | 0.964143426 |
| HBD AND NOT-ADTRP | 0.936170213 | 0.909774436 | 0.964143426 |
| HBD AND NOT-KMO | 0.934615385 | 0.903345725 | 0.96812749 |
| HBD AND NOT-SLC16A7 | 0.937743191 | 0.91634981 | 0.960159363 |
| HBD AND NOT-FCMR | 0.941860465 | 0.916981132 | 0.96812749 |
| HBD AND NOT-CD27 | 0.937743191 | 0.91634981 | 0.960159363 |
| SMIM3 AND NOT-ST6GALNAC6 | 0.947368421 | 0.927480916 | 0.96812749 |
| NOT-FAM69A AND ADGRE2 | 0.967479675 | 0.987551867 | 0.948207171 |
| NOT-FAM134B AND ADGRE2 | 0.940206186 | 0.974358974 | 0.908366534 |
| ADGRE2 AND NOT-MAN1C1 | 0.907526882 | 0.985981308 | 0.84063745 |
| ADGRE2 AND NOT-SLC44A2 | 0.924686192 | 0.973568282 | 0.880478088 |
| NOT-HEG1 AND ADGRE2 | 0.918454936 | 0.995348837 | 0.852589641 |
| NOT-TGFBR3 AND ADGRE2 | 0.91416309 | 0.990697674 | 0.848605578 |
| NOT-SLC37A3 AND ADGRE2 | 0.945454545 | 0.959016393 | 0.932270916 |
| NOT-PHLDB2 AND ADGRE2 | 0.9500998 | 0.952 | 0.948207171 |
| NOT-PFN2 AND NOT-HLA-DOB | 0.966990291 | 0.943181818 | 0.992031873 |
| NOT-MTUS1 AND NOT-HLA-DOB | 0.970873786 | 0.946969697 | 0.996015936 |
| SMIM3 AND NOT-ACACB | 0.947162427 | 0.930769231 | 0.964143426 |
| NOT-FAM69A AND ICAM3 | 0.947169811 | 0.899641577 | 1 |
| NOT-PHLDB2 AND ICAM3 | 0.932330827 | 0.882562278 | 0.988047809 |
| SMIM3 AND NOT-TMEM119 | 0.94368932 | 0.920454545 | 0.96812749 |
| NRROS AND NOT-AMIGO2 | 0.944558522 | 0.974576271 | 0.916334661 |
| P2RX1 AND NOT-AMIGO2 | 0.940451745 | 0.970338983 | 0.912350598 |
| NOT-HEG1 AND IL1RAP | 0.911447084 | 0.995283019 | 0.84063745 |
| NOT-PHLDB2 AND IL1RAP | 0.943319838 | 0.958847737 | 0.928286853 |
| NRROS AND NOT-IL7R | 0.941176471 | 0.958677686 | 0.924302789 |
| NOT-PFN2 AND NOT-IL7R | 0.935361217 | 0.894545455 | 0.980079681 |
| CXCL8 AND NOT-ITPR3 | 0.927102804 | 0.873239437 | 0.988047809 |
| CXCL8 AND NOT-KDR | 0.923364486 | 0.86971831 | 0.984063745 |
| P2RX1 AND CXCL8 | 0.936170213 | 0.909774436 | 0.964143426 |
| CXCL8 AND NOT-FXYD1 | 0.923649907 | 0.867132867 | 0.988047809 |
| CXCL8 AND NOT-TMTC1 | 0.938223938 | 0.91011236 | 0.96812749 |
| SMIM3 AND CXCL8 | 0.93957115 | 0.919847328 | 0.960159363 |
| CXCL8 AND NOT-CDC14B | 0.930056711 | 0.884892086 | 0.980079681 |
| CXCL8 AND NOT-ST3GAL5 | 0.938223938 | 0.91011236 | 0.96812749 |
| CXCL8 AND NOT-SLC16A4 | 0.937618147 | 0.892086331 | 0.988047809 |
| NOT-ARMCX2 AND CXCL8 | 0.942748092 | 0.904761905 | 0.984063745 |
| NOT-PFN2 AND NOT-INPP4A | 0.922222222 | 0.861591696 | 0.992031873 |
| NOT-FAM69A AND ITGA4 | 0.948240166 | 0.987068966 | 0.912350598 |
| ITGA4 AND NOT-SLC44A2 | 0.926931106 | 0.973684211 | 0.884462151 |
| NOT-FAM69A AND ITGB2 | 0.91773309 | 0.847972973 | 1 |
| NOT-ITGB5 AND MGST1 | 0.929166667 | 0.973799127 | 0.888446215 |
| NOT-ITGB5 AND SMIM3 | 0.947368421 | 0.962962963 | 0.932270916 |
| P2RX1 AND NOT-ITPR3 | 0.945945946 | 0.917602996 | 0.976095618 |
| NOT-PFN2 AND NOT-ITPR3 | 0.941398866 | 0.895683453 | 0.992031873 |
| FXYD5 AND NOT-ITPR3 | 0.926199262 | 0.862542955 | 1 |
| P2RX1 AND NOT-FAM73A | 0.935114504 | 0.897435897 | 0.976095618 |
| NRROS AND NOT-FAM69A | 0.959016393 | 0.987341772 | 0.932270916 |
| NRROS AND NOT-LY9 | 0.941649899 | 0.951219512 | 0.932270916 |
| NRROS AND NOT-MINOS1 | 0.93877551 | 0.962343096 | 0.916334661 |

FIG. 1 (CONT.)

| Antigen Pair Logic | F1 | Precision | Recall | Antigen Pair Logic | F1 | Precision | Recall |
| --- | --- | --- | --- | --- | --- | --- | --- |
| TNFRSF8 AND NOT-ABCC6 | 0.933333333 | 0.933333333 | 0.933333333 | NRROS AND NOT-IL21R | 0.941176471 | 0.958677686 | 0.924302789 |
| TNFRSF8 AND NOT-CLEC3A | 0.933333333 | 0.933333333 | 0.933333333 | NRROS AND NOT-FAM134B | 0.931392931 | 0.973913043 | 0.892430279 |
| TNFRSF8 AND NOT-SLC9B2 | 0.933333333 | 0.933333333 | 0.933333333 | NRROS AND NOT-HEG1 | 0.948240166 | 0.987068966 | 0.912350598 |
| TNFRSF8 AND NOT-SLC13A3 | 0.933333333 | 0.933333333 | 0.933333333 | NRROS AND NOT-SLAMF7 | 0.940936864 | 0.9625 | 0.920318725 |
| TNFRSF8 AND NOT-POMK | 0.933333333 | 0.933333333 | 0.933333333 | NRROS AND NOT-PVRIG | 0.945233266 | 0.962809917 | 0.928286853 |
| TNFRSF8 AND NOT-NPHS2 | 0.933333333 | 0.933333333 | 0.933333333 | NRROS AND NOT-ST3GAL5 | 0.944329897 | 0.978632479 | 0.912350598 |
| TNFRSF8 AND NOT-PEX2 | 0.933333333 | 0.933333333 | 0.933333333 | NRROS AND NOT-PHLDB2 | 0.941176471 | 0.958677686 | 0.924302789 |
| TNFRSF8 AND NOT-LEPROT | 0.965517241 | 1 | 0.933333333 | NRROS AND NOT-KIAA0040 | 0.945454545 | 0.959016393 | 0.932270916 |
| TNFRSF8 AND NOT-CYP2U1 | 0.933333333 | 0.933333333 | 0.933333333 | NRROS AND NOT-CD72 | 0.943089431 | 0.962655602 | 0.924302789 |
| TNFRSF8 AND NOT-SLC1A2 | 0.933333333 | 0.933333333 | 0.933333333 | SMIM3 AND NOT-KDR | 0.96812749 | 0.96812749 | 0.96812749 |
| TNFRSF8 AND NOT-SPTSSA | 0.965517241 | 1 | 0.933333333 | NOT-PFN2 AND KIT | 0.941176471 | 0.995555556 | 0.892430279 |
| TNFRSF8 AND NOT-ITGA9 | 0.933333333 | 0.933333333 | 0.933333333 | NOT-PFN2 AND NOT-KLRD1 | 0.934333959 | 0.882978723 | 0.992031873 |
| TNFRSF8 AND NOT-SLITRK1 | 0.933333333 | 0.933333333 | 0.933333333 | NOT-FAM69A AND LAIR1 | 0.949698189 | 0.959349593 | 0.940239044 |
| TNFRSF8 AND NOT-BNIP2 | 0.965517241 | 1 | 0.933333333 | NOT-FAM69A AND NOT-LIFR | 0.925650558 | 0.867595819 | 0.992031873 |
| TNFRSF8 AND NOT-CHST12 | 0.933333333 | 0.933333333 | 0.933333333 | NOT-FAM69A AND HACD4 | 0.925925926 | 0.865051903 | 0.996015936 |
| TNFRSF8 AND NOT-SLC39A11 | 0.933333333 | 0.933333333 | 0.933333333 | NOT-FAM69A AND LRMP | 0.944761905 | 0.905109489 | 0.988047809 |
| TNFRSF8 AND NOT-TMEM8B | 0.965517241 | 1 | 0.933333333 | NOT-FAM69A AND NOT-MAOB | 0.943396226 | 0.896057348 | 0.996015936 |
| TNFRSF8 AND NOT-FAT2 | 0.933333333 | 0.933333333 | 0.933333333 | NOT-FAM69A AND NOT-MGP | 0.96484375 | 0.946360153 | 0.984063745 |
| TNFRSF8 AND NOT-PARP16 | 0.933333333 | 0.933333333 | 0.933333333 | NOT-FAM69A AND NOT-MID1 | 0.943609023 | 0.893238434 | 1 |
| TNFRSF8 AND NOT-SLC1A1 | 0.933333333 | 0.933333333 | 0.933333333 | NOT-FAM69A AND NKG7 | 0.946534653 | 0.940944882 | 0.952191235 |
| TNFRSF8 AND NOT-SFTPC | 0.965517241 | 1 | 0.933333333 | NOT-FAM69A AND P2RX1 | 0.986138614 | 0.980314961 | 0.992031873 |
| TNFRSF8 AND NOT-EFNB3 | 0.965517241 | 1 | 0.933333333 | NOT-FAM69A AND CHST11 | 0.952 | 0.955823293 | 0.948207171 |
| TNFRSF8 AND NOT-SYT2 | 0.933333333 | 0.933333333 | 0.933333333 | NOT-FAM69A AND TMED5 | 0.916058394 | 0.845117845 | 1 |
| TNFRSF8 AND NOT-CMTM1 | 0.933333333 | 0.933333333 | 0.933333333 | NOT-FAM69A AND UBE2J1 | 0.921100917 | 0.853741497 | 1 |
| TNFRSF8 AND NOT-GGT7 | 0.933333333 | 0.933333333 | 0.933333333 | NOT-FAM69A AND NOT-PDGFRA | 0.959692898 | 0.925925926 | 0.996015936 |
| TNFRSF8 AND NOT-HERPUD2 | 0.965517241 | 1 | 0.933333333 | NOT-FAM69A AND NOT-PFN2 | 0.97265625 | 0.954022989 | 0.992031873 |
| TNFRSF8 AND NOT-TOR1AIP2 | 0.965517241 | 1 | 0.933333333 | NOT-FAM69A AND FXYD5 | 0.940074906 | 0.886925795 | 1 |
| TNFRSF8 AND NOT-BSND | 0.933333333 | 0.933333333 | 0.933333333 | NOT-FAM69A AND ADPRM | 0.961089494 | 0.939163498 | 0.984063745 |
| TNFRSF8 AND NOT-CYSLTR2 | 0.933333333 | 0.933333333 | 0.933333333 | NOT-FAM69A AND PTGER2 | 0.946058091 | 0.987012987 | 0.908366534 |
| TNFRSF8 AND NOT-SLC12A1 | 0.933333333 | 0.933333333 | 0.933333333 | NOT-FAM69A AND NOT-NDRG2 | 0.943396226 | 0.896057348 | 0.996015936 |
| TNFRSF8 AND NOT-PIANP | 0.933333333 | 0.933333333 | 0.933333333 | NOT-FAM69A AND NOT-MTUS1 | 0.961538462 | 0.92936803 | 0.996015936 |
| TNFRSF8 AND NOT-OR2L2 | 0.933333333 | 0.933333333 | 0.933333333 | NOT-FAM69A AND NOT-PTN | 0.947169811 | 0.899641577 | 1 |
| TNFRSF8 AND NOT-APOL2 | 0.933333333 | 0.933333333 | 0.933333333 | NOT-FAM69A AND PTPRC | 0.942622951 | 0.970464135 | 0.916334661 |
| TNFRSF8 AND NOT-IFNL2 | 0.933333333 | 0.933333333 | 0.933333333 | NOT-FAM69A AND NOT-PTPRK | 0.940074906 | 0.886925795 | 1 |
| TNFRSF8 AND NOT-GUCY2D | 0.933333333 | 0.933333333 | 0.933333333 | NOT-FAM69A AND NOT-NTN4 | 0.922794118 | 0.85665529 | 1 |
| TNFRSF8 AND NOT-IFITM10 | 0.933333333 | 0.933333333 | 0.933333333 | NOT-FAM69A AND SELL | 0.94980695 | 0.921348315 | 0.980079681 |
| TNFRSF8 AND NOT-FANCM | 0.933333333 | 0.933333333 | 0.933333333 | NOT-FAM69A AND NOT-PERP | 0.934086629 | 0.885714286 | 0.988047809 |
| TNFRSF8 AND NOT-STX1B | 0.933333333 | 0.933333333 | 0.933333333 | NOT-FAM69A AND SLC39A8 | 0.95481336 | 0.941860465 | 0.96812749 |
| TNFRSF8 AND NOT-PCNXL2 | 0.933333333 | 0.933333333 | 0.933333333 | NOT-FAM69A AND SUSD1 | 0.96 | 0.963855422 | 0.956175299 |
| TNFRSF8 AND NOT-FAM73A | 0.933333333 | 0.933333333 | 0.933333333 | NOT-FAM69A AND VAMP7 | 0.919413919 | 0.850847458 | 1 |
| TNFRSF8 AND NOT-OR51I1 | 0.965517241 | 1 | 0.933333333 | NOT-FAM69A AND NOT-TSPAN6 | 0.934579439 | 0.88028169 | 0.996015936 |
| TNFRSF8 AND NOT-PMEL | 0.933333333 | 0.933333333 | 0.933333333 | NOT-FAM69A AND VRK1 | 0.936567164 | 0.880701754 | 1 |
| TNFRSF8 AND NOT-EI24 | 0.965517241 | 1 | 0.933333333 | NOT-FAM69A AND SLC30A1 | 0.936567164 | 0.880701754 | 1 |
| TNFRSF8 AND NOT-TMEM25 | 0.933333333 | 0.933333333 | 0.933333333 | NOT-FAM69A AND LAPTM5 | 0.947169811 | 0.899641577 | 1 |
| TNFRSF8 AND NOT-C16orf92 | 0.933333333 | 0.933333333 | 0.933333333 | NOT-FAM69A AND NOT-DDR1 | 0.953488372 | 0.928301887 | 0.980079681 |
| TNFRSF8 AND NOT-TMEM255B | 0.933333333 | 0.933333333 | 0.933333333 | NOT-FAM69A AND DERL1 | 0.921100917 | 0.853741497 | 1 |
| TNFRSF8 AND NOT-GPD2 | 0.933333333 | 0.933333333 | 0.933333333 | NOT-FAM69A AND NOT-RNF128 | 0.92962963 | 0.868512111 | 1 |
| TNFRSF8 AND NOT-OR6B1 | 0.933333333 | 0.933333333 | 0.933333333 | NOT-FAM69A AND NOT-C1orf115 | 0.925650558 | 0.867595819 | 0.992031873 |
| TNFRSF8 AND NOT-OR14J1 | 0.933333333 | 0.933333333 | 0.933333333 | NOT-FAM69A AND ATP8B4 | 0.95481336 | 0.941860465 | 0.96812749 |
| TNFRSF8 AND NOT-SLC9A8 | 0.933333333 | 0.933333333 | 0.933333333 | NOT-FAM69A AND NOT-SSPN | 0.929791271 | 0.887681159 | 0.976095618 |
| TNFRSF8 AND NOT-TMEM74 | 0.933333333 | 0.933333333 | 0.933333333 | NOT-FAM69A AND NOT-GLT8D2 | 0.933085502 | 0.87456446 | 1 |
| TNFRSF8 AND NOT-GPR50 | 0.933333333 | 0.933333333 | 0.933333333 | NOT-FAM69A AND NOT-TMEM47 | 0.974757282 | 0.950757576 | 1 |
| TNFRSF8 AND NOT-GJA10 | 0.933333333 | 0.933333333 | 0.933333333 | NOT-FAM69A AND USP48 | 0.938317757 | 0.883802817 | 1 |
| TNFRSF8 AND NOT-LDLRAD4 | 0.965517241 | 1 | 0.933333333 | NOT-FAM69A AND C9orf89 | 0.932835821 | 0.877192982 | 0.996015936 |
| TNFRSF8 AND NOT-NAALADL1 | 0.933333333 | 0.933333333 | 0.933333333 | NOT-FAM69A AND SMIM3 | 0.934823091 | 0.877622378 | 1 |
| TNFRSF8 AND NOT-PIGR | 0.933333333 | 0.933333333 | 0.933333333 | NOT-FAM69A AND SLC22A16 | 0.953125 | 0.9348659 | 0.972111554 |
| TNFRSF8 AND NOT-DNAJC14 | 0.928571429 | 1 | 0.866666667 | NOT-FAM69A AND NOT-SGCE | 0.936090226 | 0.886120996 | 0.992031873 |
| TNFRSF8 AND NOT-GPRC6A | 0.933333333 | 0.933333333 | 0.933333333 | NOT-FAM69A AND NOT-PHLDB2 | 0.942965779 | 0.901818182 | 0.988047809 |
| TNFRSF8 AND NOT-HCAR1 | 0.933333333 | 0.933333333 | 0.933333333 | NOT-FAM69A AND MYADM | 0.933586338 | 0.891304348 | 0.980079681 |
| TNFRSF8 AND NOT-IGSF1 | 0.933333333 | 0.933333333 | 0.933333333 | NOT-FAM69A AND CD33 | 0.96031746 | 0.956521739 | 0.964143426 |
| TNFRSF8 AND NOT-SHISA2 | 0.933333333 | 0.933333333 | 0.933333333 | NOT-FAM69A AND CD37 | 0.95703125 | 0.938697318 | 0.976095618 |
| TNFRSF8 AND NOT-CX3CR1 | 0.928571429 | 1 | 0.866666667 | NOT-FAM69A AND CD44 | 0.944971537 | 0.902173913 | 0.992031873 |
| TNFRSF8 AND NOT-TAAR2 | 0.933333333 | 0.933333333 | 0.933333333 | NOT-FAM69A AND CD53 | 0.943181818 | 0.898916968 | 0.992031873 |
| TNFRSF8 AND NOT-IL20RB | 0.933333333 | 0.933333333 | 0.933333333 | NOT-FAM69A AND CD69 | 0.934333959 | 0.882978723 | 0.992031873 |
| TNFRSF8 AND NOT-DPY19L3 | 0.933333333 | 0.933333333 | 0.933333333 | NOT-FAM69A AND ADGRE5 | 0.947169811 | 0.899641577 | 1 |
| TNFRSF8 AND NOT-ITGB7 | 0.933333333 | 0.933333333 | 0.933333333 | NOT-FAM69A AND PTDSS1 | 0.937618147 | 0.892086331 | 0.988047809 |
| TNFRSF8 AND NOT-SLC12A6 | 0.965517241 | 1 | 0.933333333 | NOT-MINOS1 AND HACD4 | 0.95049505 | 0.94488189 | 0.956175299 |
| TNFRSF8 AND NOT-C2CD2L | 0.933333333 | 0.933333333 | 0.933333333 | NOT-SLC37A3 AND HACD4 | 0.939334638 | 0.923076923 | 0.956175299 |
| TNFRSF8 AND NOT-TMEM170A | 0.965517241 | 1 | 0.933333333 | NOT-VAPB AND HACD4 | 0.946153846 | 0.914498141 | 0.980079681 |
| TNFRSF8 AND NOT-TREM1 | 0.965517241 | 1 | 0.933333333 | SMIM3 AND NOT-LRP1 | 0.949698189 | 0.959349593 | 0.940239044 |
| TNFRSF8 AND NOT-TAPT1 | 0.933333333 | 0.933333333 | 0.933333333 | NOT-PFN2 AND NOT-LTB | 0.941649899 | 0.951219512 | 0.932270916 |
| TNFRSF8 AND NOT-NGFR | 0.933333333 | 0.933333333 | 0.933333333 | NOT-PHLDB2 AND LTBR | 0.937743191 | 0.91634981 | 0.960159363 |
| TNFRSF8 AND NOT-DRD1 | 0.933333333 | 0.933333333 | 0.933333333 | NOT-MAOB AND HACD1 | 0.942574257 | 0.937007874 | 0.948207171 |
| TNFRSF8 AND NOT-MS4A6E | 0.933333333 | 0.933333333 | 0.933333333 | SMIM3 AND NOT-MCAM | 0.95481336 | 0.941860465 | 0.96812749 |
| TNFRSF8 AND NOT-CXCL8 | 0.928571429 | 1 | 0.866666667 | NOT-PFN2 AND CD46 | 0.926553672 | 0.878571429 | 0.980079681 |
| TNFRSF8 AND NOT-LHFPL1 | 0.933333333 | 0.933333333 | 0.933333333 | SUSD1 AND NOT-MGAT5 | 0.919831224 | 0.977578475 | 0.868525896 |

FIG. 1 (CONT.)

| Antigen Pair Logic | F1 | Precision | Recall |
|---|---|---|---|
| TNFRSF8 AND NOT-OR5I1 | 0.933333333 | 0.933333333 | 0.933333333 |
| TNFRSF8 AND NOT-ITGAM | 0.965517241 | 1 | 0.933333333 |
| TNFRSF8 AND NOT-ANO10 | 0.933333333 | 0.933333333 | 0.933333333 |
| TNFRSF8 AND NOT-SLC7A4 | 0.933333333 | 0.933333333 | 0.933333333 |
| TNFRSF8 AND NOT-VIPR1 | 0.965517241 | 1 | 0.933333333 |
| TNFRSF8 AND NOT-TMPRSS6 | 0.933333333 | 0.933333333 | 0.933333333 |
| TNFRSF8 AND NOT-OR10H3 | 0.928571429 | 1 | 0.866666667 |
| TNFRSF8 AND NOT-PTCHD4 | 0.933333333 | 0.933333333 | 0.933333333 |
| TNFRSF8 AND NOT-C6orf89 | 0.933333333 | 0.933333333 | 0.933333333 |
| TNFRSF8 AND NOT-STX7 | 0.965517241 | 1 | 0.933333333 |
| TNFRSF8 AND NOT-APLF | 0.933333333 | 0.933333333 | 0.933333333 |
| TNFRSF8 AND NOT-FBN2 | 0.965517241 | 1 | 0.933333333 |
| TNFRSF8 AND NOT-GPR17 | 0.933333333 | 0.933333333 | 0.933333333 |
| TNFRSF8 AND NOT-GDAP1 | 0.933333333 | 0.933333333 | 0.933333333 |
| TNFRSF8 AND NOT-CEPT1 | 0.965517241 | 1 | 0.933333333 |
| TNFRSF8 AND NOT-ERLIN1 | 0.933333333 | 0.933333333 | 0.933333333 |
| TNFRSF8 AND NOT-DRAXIN | 0.933333333 | 0.933333333 | 0.933333333 |
| TNFRSF8 AND NOT-GALNT3 | 0.928571429 | 1 | 0.866666667 |
| TNFRSF8 AND NOT-TLR6 | 0.965517241 | 1 | 0.933333333 |
| TNFRSF8 AND NOT-CLEC1B | 0.965517241 | 1 | 0.933333333 |
| TNFRSF8 AND NOT-DNAJC16 | 0.965517241 | 1 | 0.933333333 |
| TNFRSF8 AND NOT-RHBG | 0.965517241 | 1 | 0.933333333 |
| TNFRSF8 AND NOT-FAM105A | 0.933333333 | 0.933333333 | 0.933333333 |
| TNFRSF8 AND NOT-CYP4V2 | 0.965517241 | 1 | 0.933333333 |
| TNFRSF8 AND NOT-FRRS1L | 0.933333333 | 0.933333333 | 0.933333333 |
| TNFRSF8 AND NOT-CATSPER1 | 0.965517241 | 1 | 0.933333333 |
| TNFRSF8 AND NOT-GABRQ | 0.933333333 | 0.933333333 | 0.933333333 |
| TNFRSF8 AND NOT-SLC7A10 | 0.933333333 | 0.933333333 | 0.933333333 |
| TNFRSF8 AND NOT-KCNA5 | 0.933333333 | 0.933333333 | 0.933333333 |
| TNFRSF8 AND NOT-SFXN3 | 0.933333333 | 0.933333333 | 0.933333333 |
| TNFRSF8 AND NOT-B4GALT3 | 0.933333333 | 0.933333333 | 0.933333333 |
| TNFRSF8 AND NOT-RNF43 | 0.933333333 | 0.933333333 | 0.933333333 |
| TNFRSF8 AND NOT-CLDND1 | 0.933333333 | 0.933333333 | 0.933333333 |
| TNFRSF8 AND NOT-CFAP61 | 0.933333333 | 0.933333333 | 0.933333333 |
| TNFRSF8 AND NOT-SHISA4 | 0.933333333 | 0.933333333 | 0.933333333 |
| TNFRSF8 AND NOT-CATSPERB | 0.933333333 | 0.933333333 | 0.933333333 |
| TNFRSF8 AND NOT-GAPT | 0.965517241 | 1 | 0.933333333 |
| TNFRSF8 AND NOT-PPAPDC2 | 0.933333333 | 0.933333333 | 0.933333333 |
| TNFRSF8 AND NOT-PNPLA7 | 0.933333333 | 0.933333333 | 0.933333333 |
| TNFRSF8 AND NOT-GNPTAB | 0.965517241 | 1 | 0.933333333 |
| TNFRSF8 AND NOT-CAV3 | 0.933333333 | 0.933333333 | 0.933333333 |
| TNFRSF8 AND NOT-RHBDL3 | 0.933333333 | 0.933333333 | 0.933333333 |
| TNFRSF8 AND NOT-101805491? | 0.933333333 | 0.933333333 | 0.933333333 |
| TNFRSF8 AND NOT-GRID1 | 0.933333333 | 0.933333333 | 0.933333333 |
| TNFRSF8 AND NOT-PLIN1 | 0.933333333 | 0.933333333 | 0.933333333 |
| TNFRSF8 AND NOT-MCHR1 | 0.933333333 | 0.933333333 | 0.933333333 |
| TNFRSF8 AND NOT-SLC22A1 | 0.933333333 | 0.933333333 | 0.933333333 |
| TNFRSF8 AND NOT-MOSPD1 | 0.933333333 | 0.933333333 | 0.933333333 |
| TNFRSF8 AND NOT-LTB | 0.965517241 | 1 | 0.933333333 |
| TNFRSF8 AND NOT-SLC6A2 | 0.933333333 | 0.933333333 | 0.933333333 |
| TNFRSF8 AND NOT-ARMCX2 | 0.933333333 | 0.933333333 | 0.933333333 |
| TNFRSF8 AND NOT-ST6GALNAC5 | 0.933333333 | 0.933333333 | 0.933333333 |
| TNFRSF8 AND NOT-SLC25A45 | 0.933333333 | 0.933333333 | 0.933333333 |
| TNFRSF8 AND NOT-ITGA2B | 0.965517241 | 1 | 0.933333333 |
| TNFRSF8 AND NOT-TMEM159 | 0.965517241 | 1 | 0.933333333 |
| TNFRSF8 AND NOT-CTXN3 | 0.933333333 | 0.933333333 | 0.933333333 |
| TNFRSF8 AND NOT-GRM7 | 0.933333333 | 0.933333333 | 0.933333333 |
| TNFRSF8 AND NOT-CFTR | 0.933333333 | 0.933333333 | 0.933333333 |
| TNFRSF8 AND NOT-SPINK6 | 0.928571429 | 1 | 0.866666667 |
| TNFRSF8 AND NOT-TLR9 | 0.965517241 | 1 | 0.933333333 |
| TNFRSF8 AND NOT-SYT1 | 0.933333333 | 0.933333333 | 0.933333333 |
| TNFRSF8 AND NOT-CD101 | 0.933333333 | 0.933333333 | 0.933333333 |
| TNFRSF8 AND NOT-MFSD11 | 0.933333333 | 0.933333333 | 0.933333333 |
| TNFRSF8 AND NOT-WBSCR17 | 0.933333333 | 0.933333333 | 0.933333333 |
| TNFRSF8 AND NOT-SYT6 | 0.933333333 | 0.933333333 | 0.933333333 |
| TNFRSF8 AND NOT-LRMP | 0.965517241 | 1 | 0.933333333 |
| TNFRSF8 AND NOT-CLN5 | 0.933333333 | 0.933333333 | 0.933333333 |
| TNFRSF8 AND NOT-KLK4 | 0.933333333 | 0.933333333 | 0.933333333 |
| TNFRSF8 AND NOT-CEACAM3 | 0.965517241 | 1 | 0.933333333 |
| TNFRSF8 AND NOT-CHRNA1 | 0.933333333 | 0.933333333 | 0.933333333 |
| TNFRSF8 AND NOT-OR51B4 | 0.933333333 | 0.933333333 | 0.933333333 |
| TNFRSF8 AND NOT-PCDHGA1 | 0.933333333 | 0.933333333 | 0.933333333 |
| TNFRSF8 AND NOT-COQ7 | 0.933333333 | 0.933333333 | 0.933333333 |
| TNFRSF8 AND NOT-TRPV6 | 0.933333333 | 0.933333333 | 0.933333333 |
| TNFRSF8 AND NOT-CHRNB1 | 0.965517241 | 1 | 0.933333333 |
| TNFRSF8 AND NOT-NMBR | 0.933333333 | 0.933333333 | 0.933333333 |

| Antigen Pair Logic | F1 | Precision | Recall |
|---|---|---|---|
| CD33 AND NOT-MGAT5 | 0.929166667 | 0.973799127 | 0.888446215 |
| P2RX1 AND NOT-MINOS1 | 0.954455446 | 0.948818898 | 0.960159363 |
| NOT-MINOS1 AND PTGER4 | 0.94302554 | 0.930232558 | 0.956175299 |
| NOT-MINOS1 AND SUSD1 | 0.955823293 | 0.963562753 | 0.948207171 |
| NOT-MINOS1 AND TMEM183A | 0.947368421 | 0.927480916 | 0.96812749 |
| SMIM3 AND NOT-ASPH | 0.960474308 | 0.952941176 | 0.96812749 |
| SMIM3 AND NOT-NPY1R | 0.954635108 | 0.9453125 | 0.964143426 |
| P2RX1 AND NOT-NT5E | 0.950884086 | 0.937984496 | 0.964143426 |
| SMIM3 AND NOT-DDR2 | 0.966336634 | 0.960629921 | 0.972111554 |
| SMIM3 AND NOT-GPX8 | 0.947572816 | 0.924242424 | 0.972111554 |
| P2RX1 AND NOT-INSIG2 | 0.9348659 | 0.900369004 | 0.972111554 |
| P2RX1 AND NOT-TUBD1 | 0.936902486 | 0.900735294 | 0.976095618 |
| NOT-PFN2 AND P2RX1 | 0.923364486 | 0.86971831 | 0.984063745 |
| P2RX1 AND NOT-FAM134B | 0.947791165 | 0.955465587 | 0.940239044 |
| P2RX1 AND NOT-SYNJ2BP | 0.94302554 | 0.930232558 | 0.956175299 |
| P2RX1 AND NOT-ANKH | 0.942800789 | 0.93359375 | 0.952191235 |
| P2RX1 AND NOT-LPAR5 | 0.92952381 | 0.890510949 | 0.972111554 |
| P2RX1 AND NOT-PLXDC1 | 0.931558935 | 0.890909091 | 0.976095618 |
| P2RX1 AND NOT-SLC44A2 | 0.947368421 | 0.927480916 | 0.96812749 |
| P2RX1 AND NOT-PTCH1 | 0.941634241 | 0.920152091 | 0.964143426 |
| P2RX1 AND NOT-HEG1 | 0.973737374 | 0.987704918 | 0.960159363 |
| NOT-PTPRK AND P2RX1 | 0.948374761 | 0.911764706 | 0.988047809 |
| P2RX1 AND NOT-SCN3A | 0.949019608 | 0.934362934 | 0.964143426 |
| P2RX1 AND NOT-BMPR2 | 0.947791165 | 0.955465587 | 0.940239044 |
| P2RX1 AND NOT-SP4 | 0.942800789 | 0.93359375 | 0.952191235 |
| P2RX1 AND SPINK2 | 0.929460581 | 0.96969697 | 0.892430279 |
| P2RX1 AND NOT-TMEM204 | 0.931558935 | 0.890909091 | 0.976095618 |
| P2RX1 AND NOT-STEAP4 | 0.941883768 | 0.947580645 | 0.93625498 |
| P2RX1 AND NOT-SLC37A3 | 0.961616162 | 0.975409836 | 0.948207171 |
| P2RX1 AND NOT-ADTRP | 0.944123314 | 0.914179104 | 0.976095618 |
| P2RX1 AND NOT-LRCH3 | 0.931558935 | 0.890909091 | 0.976095618 |
| P2RX1 AND NOT-CDC14B | 0.936660269 | 0.903703704 | 0.972111554 |
| P2RX1 AND NOT-AOC3 | 0.92952381 | 0.890510949 | 0.972111554 |
| P2RX1 AND NOT-ST3GAL5 | 0.946745562 | 0.9375 | 0.956175299 |
| P2RX1 AND NOT-PHLDB2 | 0.962376238 | 0.956692913 | 0.96812749 |
| P2RX1 AND NOT-VAPB | 0.947775629 | 0.921052632 | 0.976095618 |
| P2RX1 AND NOT-ARMCX2 | 0.95481336 | 0.941860465 | 0.96812749 |
| P2RX1 AND NOT-MFAP3L | 0.934615385 | 0.903345725 | 0.96812749 |
| P2RX1 AND NOT-MFN2 | 0.934615385 | 0.903345725 | 0.96812749 |
| NOT-SLC37A3 AND P2RX4 | 0.942345924 | 0.94047619 | 0.944223108 |
| NOT-PHLDB2 AND P2RX4 | 0.936416185 | 0.906716418 | 0.96812749 |
| NOT-SLC37A3 AND CHST11 | 0.941176471 | 0.958677686 | 0.924302789 |
| NOT-PFN2 AND NOT-IL21R | 0.953488372 | 0.928301887 | 0.980079681 |
| NOT-MTUS1 AND NOT-IL21R | 0.959223301 | 0.935606061 | 0.984063745 |
| NOT-PTPRK AND NOT-IL21R | 0.928571429 | 0.879003559 | 0.984063745 |
| NOT-PHLDB2 AND TMED5 | 0.939393939 | 0.895306859 | 0.988047809 |
| NOT-PFN2 AND SCCPDH | 0.943248532 | 0.926923077 | 0.960159363 |
| NOT-MTUS1 AND SCCPDH | 0.958415842 | 0.952755906 | 0.964143426 |
| NOT-PFN2 AND NOT-TUBD1 | 0.929791271 | 0.887681159 | 0.976095618 |
| SMIM3 AND NOT-PDE3A | 0.9348659 | 0.900369004 | 0.972111554 |
| NOT-VAPB AND UBE2J1 | 0.917431193 | 0.850340136 | 0.996015936 |
| NOT-PFN2 AND GDE1 | 0.927374302 | 0.870629371 | 0.992031873 |
| SMIM3 AND NOT-PDGFRB | 0.92952381 | 0.890510949 | 0.972111554 |
| SMIM3 AND NOT-EMCN | 0.964285714 | 0.960474308 | 0.96812749 |
| NOT-ATP8B1 AND SMIM3 | 0.941176471 | 0.898550725 | 0.988047809 |
| NOT-PFN2 AND NOT-SIRPG | 0.937381404 | 0.894927536 | 0.984063745 |
| NOT-PFN2 AND RNF130 | 0.92051756 | 0.85862069 | 0.992031873 |
| NOT-PFN2 AND NOT-LPAR5 | 0.939393939 | 0.895306859 | 0.988047809 |
| NOT-PFN2 AND NOT-PTGDR | 0.930581614 | 0.879432624 | 0.988047809 |
| NOT-PFN2 AND NOT-HEG1 | 0.93129771 | 0.893772894 | 0.972111554 |
| NOT-PFN2 AND NOT-STIM2 | 0.923649907 | 0.867132867 | 0.988047809 |
| NOT-PFN2 AND NOT-SLAMF7 | 0.938461538 | 0.907063197 | 0.972111554 |
| NOT-PFN2 AND SUSD1 | 0.923364486 | 0.86971831 | 0.984063745 |
| NOT-PFN2 AND SLC30A1 | 0.922222222 | 0.861591696 | 0.992031873 |
| NOT-PFN2 AND NOT-PVRIG | 0.941649899 | 0.951219512 | 0.932270916 |
| NOT-PFN2 AND NOT-TTC13 | 0.935361217 | 0.894545455 | 0.980079681 |
| NOT-PFN2 AND NOT-TRAF3IP3 | 0.935849057 | 0.888888889 | 0.988047809 |
| NOT-PFN2 AND NOT-TLR10 | 0.941398866 | 0.895683453 | 0.992031873 |
| NOT-PFN2 AND NOT-FCRL5 | 0.957364341 | 0.932075472 | 0.984063745 |
| NOT-PFN2 AND B3GNT5 | 0.925650558 | 0.867595819 | 0.992031873 |
| NOT-PFN2 AND NOT-STX7 | 0.926829268 | 0.875886525 | 0.984063745 |
| NOT-PFN2 AND NOT-FCRLA | 0.959381044 | 0.932330827 | 0.988047809 |
| NOT-PFN2 AND NOT-ADTRP | 0.928838951 | 0.876325088 | 0.988047809 |
| NOT-PFN2 AND SMIM3 | 0.927374302 | 0.870629371 | 0.992031873 |
| NOT-PFN2 AND NOT-KMO | 0.944761905 | 0.905109489 | 0.988047809 |
| NOT-PFN2 AND NOT-PHLDB2 | 0.926553672 | 0.878571429 | 0.980079681 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-SMAD2 | 0.933333333 | 0.933333333 | 0.933333333 | NOT-PFN2 AND NOT-PCSK7 | 0.936170213 | 0.909774436 | 0.964143426 |
| TNFRSF8 AND NOT-SLC9A6 | 0.965517241 | 1 | 0.933333333 | NOT-PFN2 AND HACD1 | 0.954274354 | 0.952380952 | 0.956175299 |
| TNFRSF8 AND NOT-ART4 | 0.933333333 | 0.933333333 | 0.933333333 | NOT-PFN2 AND NOT-FCMR | 0.952198853 | 0.915441176 | 0.992031873 |
| TNFRSF8 AND NOT-LRRC8A | 0.928571429 | 1 | 0.866666667 | NOT-PFN2 AND NOT-CD8B | 0.930320151 | 0.882142857 | 0.984063745 |
| TNFRSF8 AND NOT-DCUN1D5 | 0.933333333 | 0.933333333 | 0.933333333 | NOT-PFN2 AND NOT-MS4A1 | 0.95703125 | 0.938697318 | 0.976095618 |
| TNFRSF8 AND NOT-AMICA1 | 0.965517241 | 1 | 0.933333333 | NOT-PFN2 AND NOT-CD22 | 0.959223301 | 0.935606061 | 0.984063745 |
| TNFRSF8 AND NOT-FXYD6 | 0.933333333 | 0.933333333 | 0.933333333 | NOT-PFN2 AND NOT-CD27 | 0.948 | 0.951807229 | 0.944223108 |
| TNFRSF8 AND NOT-HVCN1 | 0.965517241 | 1 | 0.933333333 | NOT-PFN2 AND NOT-CD40LG | 0.925373134 | 0.870175439 | 0.988047809 |
| TNFRSF8 AND NOT-GRID2 | 0.933333333 | 0.933333333 | 0.933333333 | NOT-PFN2 AND NOT-KIAA0040 | 0.937853107 | 0.889285714 | 0.992031873 |
| TNFRSF8 AND NOT-ZNF7 | 0.933333333 | 0.933333333 | 0.933333333 | SMIM3 AND NOT-PLA2G2A | 0.94368932 | 0.920454545 | 0.96812749 |
| TNFRSF8 AND NOT-FPR1 | 0.965517241 | 1 | 0.933333333 | SMIM3 AND NOT-PLN | 0.933078394 | 0.897058824 | 0.972111554 |
| TNFRSF8 AND NOT-MGST2 | 0.965517241 | 1 | 0.933333333 | NOT-PHLDB2 AND PLP2 | 0.925373134 | 0.870175439 | 0.988047809 |
| TNFRSF8 AND NOT-CA4 | 0.933333333 | 0.933333333 | 0.933333333 | NOT-PHLDB2 AND FXYD5 | 0.941176471 | 0.898550725 | 0.988047809 |
| TNFRSF8 AND NOT-STEAP4 | 0.933333333 | 0.933333333 | 0.933333333 | NOT-VAPB AND FXYD5 | 0.924214418 | 0.862068966 | 0.996015936 |
| TNFRSF8 AND NOT-AMN | 0.933333333 | 0.933333333 | 0.933333333 | NOT-FAM134B AND SLC39A8 | 0.941414141 | 0.954918033 | 0.928286853 |
| TNFRSF8 AND NOT-ADGRF2 | 0.933333333 | 0.933333333 | 0.933333333 | SMIM3 AND NOT-PCDH18 | 0.954990215 | 0.938461538 | 0.972111554 |
| TNFRSF8 AND NOT-MYCT1 | 0.933333333 | 0.933333333 | 0.933333333 | SMIM3 AND NOT-RETSAT | 0.94026975 | 0.910447761 | 0.972111554 |
| TNFRSF8 AND NOT-CD1E | 0.933333333 | 0.933333333 | 0.933333333 | NOT-TMEM45A AND SMIM3 | 0.942084942 | 0.913857678 | 0.972111554 |
| TNFRSF8 AND NOT-NRG4 | 0.933333333 | 0.933333333 | 0.933333333 | SMIM3 AND NOT-TMEM100 | 0.951267057 | 0.93129771 | 0.972111554 |
| TNFRSF8 AND NOT-TTC13 | 0.933333333 | 0.933333333 | 0.933333333 | NOT-MTUS1 AND NOT-TMEM140 | 0.933837429 | 0.888489209 | 0.984063745 |
| TNFRSF8 AND NOT-LRP1 | 0.965517241 | 1 | 0.933333333 | TLR2 AND NOT-TMEM140 | 0.926315789 | 0.982142857 | 0.876494024 |
| TNFRSF8 AND NOT-SLC18A3 | 0.933333333 | 0.933333333 | 0.933333333 | SMIM3 AND NOT-TMEM140 | 0.949494949 | 0.963114754 | 0.93625498 |
| TNFRSF8 AND NOT-UBXN8 | 0.933333333 | 0.933333333 | 0.933333333 | CD33 AND NOT-TMEM140 | 0.938016529 | 0.974248927 | 0.90438247 |
| TNFRSF8 AND NOT-MGAM | 0.965517241 | 1 | 0.933333333 | NOT-MTUS1 AND NOT-SIRPG | 0.934086629 | 0.885714286 | 0.988047809 |
| TNFRSF8 AND NOT-C10orf54 | 0.965517241 | 1 | 0.933333333 | NOT-PTPRK AND NOT-SIRPG | 0.928838951 | 0.876325088 | 0.988047809 |
| TNFRSF8 AND NOT-MAG | 0.933333333 | 0.933333333 | 0.933333333 | NOT-PTPRK AND RNF130 | 0.941619586 | 0.892857143 | 0.996015936 |
| TNFRSF8 AND NOT-TLR4 | 0.965517241 | 1 | 0.933333333 | SMIM3 AND NOT-AXL | 0.964143426 | 0.964143426 | 0.964143426 |
| TNFRSF8 AND NOT-DSCAML1 | 0.933333333 | 0.933333333 | 0.933333333 | NOT-PROS1 AND SMIM3 | 0.962671906 | 0.949612403 | 0.976095618 |
| TNFRSF8 AND NOT-C5AR1 | 0.965517241 | 1 | 0.933333333 | SMIM3 AND NOT-PRRG1 | 0.938461538 | 0.907063197 | 0.972111554 |
| TNFRSF8 AND NOT-CD300LF | 0.965517241 | 1 | 0.933333333 | NOT-PHLDB2 AND ADPRM | 0.94368932 | 0.920454545 | 0.96812749 |
| TNFRSF8 AND NOT-PRPF38B | 0.933333333 | 0.933333333 | 0.933333333 | NOT-VAPB AND ADPRM | 0.930056711 | 0.884892086 | 0.980079681 |
| TNFRSF8 AND NOT-GPR35 | 0.933333333 | 0.933333333 | 0.933333333 | CD33 AND NOT-MAN1C1 | 0.927966102 | 0.990950226 | 0.87250996 |
| TNFRSF8 AND NOT-ADAMTS13 | 0.933333333 | 0.933333333 | 0.933333333 | CD33 AND NOT-SLC44A2 | 0.934156379 | 0.965957447 | 0.90438247 |
| TNFRSF8 AND NOT-SLC14A1 | 0.928571429 | 1 | 0.866666667 | NOT-MTUS1 AND NOT-PTGDR | 0.930841121 | 0.876760563 | 0.992031873 |
| TNFRSF8 AND NOT-SLC13A4 | 0.933333333 | 0.933333333 | 0.933333333 | NOT-SLC37A3 AND PTGER2 | 0.924686192 | 0.973568282 | 0.880478088 |
| TNFRSF8 AND NOT-ADPRM | 0.933333333 | 0.933333333 | 0.933333333 | NOT-VAPB AND PTGER4 | 0.941398866 | 0.895683453 | 0.992031873 |
| TNFRSF8 AND NOT-FAM19A5 | 0.933333333 | 0.933333333 | 0.933333333 | NOT-HEG1 AND ESYT2 | 0.923404255 | 0.99086758 | 0.864541833 |
| TNFRSF8 AND NOT-FAM171A2 | 0.933333333 | 0.933333333 | 0.933333333 | NOT-HEG1 AND QSOX1 | 0.924050633 | 0.98206278 | 0.87250996 |
| TNFRSF8 AND NOT-LMF1 | 0.933333333 | 0.933333333 | 0.933333333 | NOT-HEG1 AND SUSD1 | 0.923076923 | 0.995391705 | 0.860557769 |
| TNFRSF8 AND NOT-YIPF1 | 0.933333333 | 0.933333333 | 0.933333333 | NOT-HEG1 AND SPNS1 | 0.913419913 | 1 | 0.84063745 |
| TNFRSF8 AND NOT-CXCR1 | 0.965517241 | 1 | 0.933333333 | NOT-HEG1 AND SMIM3 | 0.93697479 | 0.991111111 | 0.888446215 |
| TNFRSF8 AND NOT-ASGR1 | 0.965517241 | 1 | 0.933333333 | NOT-HEG1 AND MYADM | 0.921108742 | 0.990825688 | 0.860557769 |
| TNFRSF8 AND NOT-LEMD3 | 0.933333333 | 0.933333333 | 0.933333333 | MS4A3 AND NOT-HEG1 | 0.941414141 | 0.954918033 | 0.928286853 |
| TNFRSF8 AND NOT-PCSK1N | 0.933333333 | 0.933333333 | 0.933333333 | NOT-MTUS1 AND NOT-RARRES3 | 0.926553672 | 0.878571429 | 0.980079681 |
| TNFRSF8 AND NOT-TMTC4 | 0.933333333 | 0.933333333 | 0.933333333 | NOT-MTUS1 AND NOT-STX7 | 0.952015355 | 0.918518519 | 0.988047809 |
| TNFRSF8 AND NOT-SLC6A5 | 0.933333333 | 0.933333333 | 0.933333333 | NOT-PHLDB2 AND NOT-MTUS1 | 0.928838951 | 0.876325088 | 0.988047809 |
| TNFRSF8 AND NOT-KIR2DS4 | 0.933333333 | 0.933333333 | 0.933333333 | NOT-MTUS1 AND HACD1 | 0.953907816 | 0.959677419 | 0.948207171 |
| TNFRSF8 AND NOT-SCN11A | 0.933333333 | 0.933333333 | 0.933333333 | NOT-MTUS1 AND NOT-CD8B | 0.926829268 | 0.875886525 | 0.984063745 |
| TNFRSF8 AND NOT-ROS1 | 0.933333333 | 0.933333333 | 0.933333333 | NOT-MTUS1 AND NOT-MS4A1 | 0.953488372 | 0.928301887 | 0.980079681 |
| TNFRSF8 AND NOT-HTR1D | 0.933333333 | 0.933333333 | 0.933333333 | NOT-MTUS1 AND NOT-CD27 | 0.953907816 | 0.959677419 | 0.948207171 |
| TNFRSF8 AND NOT-OPRM1 | 0.933333333 | 0.933333333 | 0.933333333 | NOT-PHLDB2 AND NOT-PTN | 0.928838951 | 0.876325088 | 0.988047809 |
| TNFRSF8 AND NOT-ZMYM6 | 0.965517241 | 1 | 0.933333333 | NOT-PTPRK AND QSOX1 | 0.928301887 | 0.88172043 | 0.980079681 |
| TNFRSF8 AND NOT-SLC29A3 | 0.933333333 | 0.933333333 | 0.933333333 | SMIM3 AND NOT-PTPRG | 0.943907157 | 0.917293233 | 0.972111554 |
| TNFRSF8 AND NOT-SGMS2 | 0.965517241 | 1 | 0.933333333 | NOT-PTPRK AND SPINK2 | 0.941176471 | 0.926640927 | 0.956175299 |
| TNFRSF8 AND NOT-TAOK2 | 0.933333333 | 0.933333333 | 0.933333333 | NOT-PTPRK AND MLLT10 | 0.938931298 | 0.901098901 | 0.980079681 |
| TNFRSF8 AND NOT-ADAM22 | 0.933333333 | 0.933333333 | 0.933333333 | NOT-PTPRK AND B3GNT5 | 0.943396226 | 0.896057348 | 0.996015936 |
| TNFRSF8 AND NOT-BBS4 | 0.965517241 | 1 | 0.933333333 | NOT-PTPRK AND NOT-PHLDB2 | 0.939163498 | 0.898181818 | 0.984063745 |
| TNFRSF8 AND NOT-CADM4 | 0.933333333 | 0.933333333 | 0.933333333 | NOT-PTPRK AND SPTLC2 | 0.935606061 | 0.891696751 | 0.984063745 |
| TNFRSF8 AND NOT-IFNAR2 | 0.933333333 | 0.933333333 | 0.933333333 | NOT-PTPRM AND SMIM3 | 0.947791165 | 0.955465587 | 0.940239044 |
| TNFRSF8 AND NOT-TMEM39A | 0.933333333 | 0.933333333 | 0.933333333 | SMIM3 AND NOT-JAM2 | 0.949416342 | 0.927756654 | 0.972111554 |
| TNFRSF8 AND NOT-ACVR1C | 0.933333333 | 0.933333333 | 0.933333333 | NOT-EVA1C AND SMIM3 | 0.957575758 | 0.971311475 | 0.944223108 |
| TNFRSF8 AND NOT-SIRPG | 0.933333333 | 0.933333333 | 0.933333333 | NOT-PERP AND SLC30A1 | 0.921933086 | 0.864111498 | 0.988047809 |
| TNFRSF8 AND NOT-RGR | 0.933333333 | 0.933333333 | 0.933333333 | SMIM3 AND NOT-SMOC2 | 0.954990215 | 0.938461538 | 0.972111554 |
| TNFRSF8 AND NOT-GUCY2F | 0.933333333 | 0.933333333 | 0.933333333 | NOT-SLC37A3 AND SLC39A8 | 0.953907816 | 0.959677419 | 0.948207171 |
| TNFRSF8 AND NOT-FCRL4 | 0.933333333 | 0.933333333 | 0.933333333 | NOT-PHLDB2 AND SLC39A8 | 0.935281837 | 0.98245614 | 0.892430279 |
| TNFRSF8 AND NOT-KCNK4 | 0.965517241 | 1 | 0.933333333 | SMIM3 AND NOT-ADGRL4 | 0.956 | 0.959839357 | 0.952191235 |
| TNFRSF8 AND NOT-AQP4 | 0.933333333 | 0.933333333 | 0.933333333 | SMIM3 AND NOT-ECSCR | 0.934615385 | 0.903345725 | 0.96812749 |
| TNFRSF8 AND NOT-CDH8 | 0.933333333 | 0.933333333 | 0.933333333 | SMIM3 AND NOT-SFRP1 | 0.93129771 | 0.893772894 | 0.972111554 |
| TNFRSF8 AND NOT-FCRL1 | 0.933333333 | 0.933333333 | 0.933333333 | NOT-SLC37A3 AND SUSD1 | 0.957746479 | 0.967479675 | 0.948207171 |
| TNFRSF8 AND NOT-S1PR3 | 0.933333333 | 0.933333333 | 0.933333333 | NOT-VAPB AND SUSD1 | 0.951456311 | 0.928030303 | 0.976095618 |
| TNFRSF8 AND NOT-ELOVL5 | 0.933333333 | 0.933333333 | 0.933333333 | NOT-SGCB AND SMIM3 | 0.95703125 | 0.938697318 | 0.976095618 |
| TNFRSF8 AND NOT-GRIK4 | 0.933333333 | 0.933333333 | 0.933333333 | SMIM3 AND NOT-ITSN1 | 0.957403651 | 0.975206612 | 0.940239044 |
| TNFRSF8 AND NOT-CATSPER2 | 0.933333333 | 0.933333333 | 0.933333333 | NOT-PHLDB2 AND FNDC3B | 0.94026975 | 0.910447761 | 0.972111554 |
| TNFRSF8 AND NOT-ITGA4 | 0.965517241 | 1 | 0.933333333 | CD33 AND NOT-BMPR2 | 0.929460581 | 0.96969697 | 0.892430279 |
| TNFRSF8 AND NOT-SIGIRR | 0.965517241 | 1 | 0.933333333 | SMIM3 AND NOT-TGFBI | 0.921443737 | 0.986363636 | 0.864541833 |
| TNFRSF8 AND NOT-MANEA | 0.933333333 | 0.933333333 | 0.933333333 | NOT-TGFBR3 AND SMIM3 | 0.928571429 | 0.982222222 | 0.880478088 |

FIG. 1 (CONT.)

| Antigen Pair Logic | F1 | Precision | Recall |
|---|---|---|---|
| TNFRSF8 AND NOT-PIGW | 0.933333333 | 0.933333333 | 0.933333333 |
| TNFRSF8 AND NOT-MIP | 0.933333333 | 0.933333333 | 0.933333333 |
| TNFRSF8 AND NOT-TMPRSS11E | 0.928571429 | 1 | 0.866666667 |
| TNFRSF8 AND NOT-AVPR2 | 0.933333333 | 0.933333333 | 0.933333333 |
| TNFRSF8 AND NOT-CLEC4G | 0.933333333 | 0.933333333 | 0.933333333 |
| TNFRSF8 AND NOT-KCNQ1 | 0.965517241 | 1 | 0.933333333 |
| TNFRSF8 AND NOT-TRPC4 | 0.928571429 | 1 | 0.866666667 |
| TNFRSF8 AND NOT-TRPM2 | 0.933333333 | 0.933333333 | 0.933333333 |
| TNFRSF8 AND NOT-ADGRV1 | 0.933333333 | 0.933333333 | 0.933333333 |
| TNFRSF8 AND NOT-TSPAN32 | 0.928571429 | 1 | 0.866666667 |
| TNFRSF8 AND NOT-VSIG10L | 0.933333333 | 0.933333333 | 0.933333333 |
| TNFRSF8 AND NOT-DUOX2 | 0.933333333 | 0.933333333 | 0.933333333 |
| TNFRSF8 AND NOT-FZD2 | 0.933333333 | 0.933333333 | 0.933333333 |
| TNFRSF8 AND NOT-PYY | 0.933333333 | 0.933333333 | 0.933333333 |
| TNFRSF8 AND NOT-PPAP2C | 0.933333333 | 0.933333333 | 0.933333333 |
| TNFRSF8 AND NOT-FLT3LG | 0.965517241 | 1 | 0.933333333 |
| TNFRSF8 AND NOT-HFE2 | 0.933333333 | 0.933333333 | 0.933333333 |
| TNFRSF8 AND NOT-DNAJC18 | 0.933333333 | 0.933333333 | 0.933333333 |
| TNFRSF8 AND NOT-SLC35F4 | 0.933333333 | 0.933333333 | 0.933333333 |
| TNFRSF8 AND NOT-SLC34A1 | 0.933333333 | 0.933333333 | 0.933333333 |
| TNFRSF8 AND NOT-CLEC4A | 0.965517241 | 1 | 0.933333333 |
| TNFRSF8 AND NOT-MDM1 | 0.933333333 | 0.933333333 | 0.933333333 |
| TNFRSF8 AND NOT-CLEC12B | 0.933333333 | 0.933333333 | 0.933333333 |
| TNFRSF8 AND NOT-OR1G1 | 0.933333333 | 0.933333333 | 0.933333333 |
| TNFRSF8 AND NOT-CSF2RA | 0.933333333 | 0.933333333 | 0.933333333 |
| TNFRSF8 AND NOT-CNTNAP2 | 0.965517241 | 1 | 0.933333333 |
| TNFRSF8 AND NOT-KCNG3 | 0.933333333 | 0.933333333 | 0.933333333 |
| TNFRSF8 AND NOT-IFNB1 | 0.933333333 | 0.933333333 | 0.933333333 |
| TNFRSF8 AND NOT-XK | 0.933333333 | 0.933333333 | 0.933333333 |
| TNFRSF8 AND NOT-ERN1 | 0.965517241 | 1 | 0.933333333 |
| TNFRSF8 AND NOT-B3GNT3 | 0.933333333 | 0.933333333 | 0.933333333 |
| TNFRSF8 AND NOT-MMP15 | 0.933333333 | 0.933333333 | 0.933333333 |
| TNFRSF8 AND NOT-TMEM59L | 0.933333333 | 0.933333333 | 0.933333333 |
| TNFRSF8 AND NOT-ADGRG6 | 0.933333333 | 0.933333333 | 0.933333333 |
| TNFRSF8 AND NOT-PTPRO | 0.965517241 | 1 | 0.933333333 |
| TNFRSF8 AND NOT-FUT7 | 0.933333333 | 0.933333333 | 0.933333333 |
| TNFRSF8 AND NOT-FRMD3 | 0.965517241 | 1 | 0.933333333 |
| TNFRSF8 AND NOT-NPHS1 | 0.933333333 | 0.933333333 | 0.933333333 |
| TNFRSF8 AND NOT-TMEM86A | 0.933333333 | 0.933333333 | 0.933333333 |
| TNFRSF8 AND NOT-SLC44A1 | 0.933333333 | 0.933333333 | 0.933333333 |
| TNFRSF8 AND NOT-FAM19A1 | 0.928571429 | 1 | 0.866666667 |
| TNFRSF8 AND NOT-CHRNA9 | 0.933333333 | 0.933333333 | 0.933333333 |
| TNFRSF8 AND NOT-ATP10D | 0.928571429 | 1 | 0.866666667 |
| TNFRSF8 AND NOT-NKAIN2 | 0.933333333 | 0.933333333 | 0.933333333 |
| TNFRSF8 AND NOT-HFE | 0.933333333 | 0.933333333 | 0.933333333 |
| TNFRSF8 AND NOT-B3GALNT1 | 0.933333333 | 0.933333333 | 0.933333333 |
| TNFRSF8 AND NOT-AMELX | 0.933333333 | 0.933333333 | 0.933333333 |
| TNFRSF8 AND NOT-TMEM156 | 0.933333333 | 0.933333333 | 0.933333333 |
| TNFRSF8 AND NOT-CLN8 | 0.933333333 | 0.933333333 | 0.933333333 |
| TNFRSF8 AND NOT-EPDR1 | 0.933333333 | 0.933333333 | 0.933333333 |
| TNFRSF8 AND NOT-TRPV4 | 0.933333333 | 0.933333333 | 0.933333333 |
| TNFRSF8 AND NOT-CEACAM7 | 0.933333333 | 0.933333333 | 0.933333333 |
| TNFRSF8 AND NOT-CASR | 0.933333333 | 0.933333333 | 0.933333333 |
| TNFRSF8 AND NOT-KCNQ2 | 0.933333333 | 0.933333333 | 0.933333333 |
| TNFRSF8 AND NOT-ITPR2 | 0.933333333 | 0.933333333 | 0.933333333 |
| TNFRSF8 AND NOT-PM20D1 | 0.933333333 | 0.933333333 | 0.933333333 |
| TNFRSF8 AND NOT-LRRC4C | 0.933333333 | 0.933333333 | 0.933333333 |
| TNFRSF8 AND NOT-LPAR4 | 0.933333333 | 0.933333333 | 0.933333333 |
| TNFRSF8 AND NOT-SLC12A4 | 0.933333333 | 0.933333333 | 0.933333333 |
| TNFRSF8 AND NOT-GPR20 | 0.933333333 | 0.933333333 | 0.933333333 |
| TNFRSF8 AND NOT-MPZL2 | 0.965517241 | 1 | 0.933333333 |
| TNFRSF8 AND NOT-MFAP3L | 0.933333333 | 0.933333333 | 0.933333333 |
| TNFRSF8 AND NOT-SCN1A | 0.933333333 | 0.933333333 | 0.933333333 |
| TNFRSF8 AND NOT-KCND3 | 0.933333333 | 0.933333333 | 0.933333333 |
| TNFRSF8 AND NOT-B4GALT1 | 0.965517241 | 1 | 0.933333333 |
| TNFRSF8 AND NOT-SLC51B | 0.933333333 | 0.933333333 | 0.933333333 |
| TNFRSF8 AND NOT-KCNQ4 | 0.933333333 | 0.933333333 | 0.933333333 |
| TNFRSF8 AND NOT-PTGER4 | 0.933333333 | 0.933333333 | 0.933333333 |
| TNFRSF8 AND NOT-NIPAL3 | 0.933333333 | 0.933333333 | 0.933333333 |
| TNFRSF8 AND NOT-ACSL5 | 0.933333333 | 0.933333333 | 0.933333333 |
| TNFRSF8 AND NOT-SLITRK2 | 0.933333333 | 0.933333333 | 0.933333333 |
| TNFRSF8 AND NOT-SUSD4 | 0.933333333 | 0.933333333 | 0.933333333 |
| TNFRSF8 AND NOT-JPH3 | 0.933333333 | 0.933333333 | 0.933333333 |
| TNFRSF8 AND NOT-TMEM237 | 0.933333333 | 0.933333333 | 0.933333333 |
| TNFRSF8 AND NOT-EQTN | 0.933333333 | 0.933333333 | 0.933333333 |
| TNFRSF8 AND NOT-CCR10 | 0.933333333 | 0.933333333 | 0.933333333 |

| Antigen Pair Logic | F1 | Precision | Recall |
|---|---|---|---|
| NOT-TGFBR3 AND MYADM | 0.922105263 | 0.977678571 | 0.87250996 |
| SMIM3 AND NOT-TLCD2 | 0.945736434 | 0.920754717 | 0.972111554 |
| SMIM3 AND NOT-WFS1 | 0.938461538 | 0.907063197 | 0.972111554 |
| NOT-SLC37A3 AND SLC30A1 | 0.938223938 | 0.91011236 | 0.96812749 |
| NOT-PHLDB2 AND LAPTM5 | 0.932330827 | 0.882562278 | 0.988047809 |
| NOT-DDR1 AND SMIM3 | 0.941176471 | 0.926640927 | 0.956175299 |
| NOT-PHLDB2 AND CXCR4 | 0.932075472 | 0.885304659 | 0.984063745 |
| SMIM3 AND NOT-FAT4 | 0.943907157 | 0.917293233 | 0.972111554 |
| NOT-C1orf115 AND SMIM3 | 0.974358974 | 0.96484375 | 0.984063745 |
| NOT-WLS AND SMIM3 | 0.949019608 | 0.934362934 | 0.964143426 |
| SMIM3 AND NOT-CPED1 | 0.93697479 | 0.991111111 | 0.888446215 |
| SMIM3 AND NOT-SLC2A10 | 0.945525292 | 0.923954373 | 0.96812749 |
| SMIM3 AND NOT-COLEC12 | 0.941860465 | 0.916981132 | 0.96812749 |
| SMIM3 AND NOT-GLT8D2 | 0.964426877 | 0.956862745 | 0.972111554 |
| SMIM3 AND NOT-PLVAP | 0.958742633 | 0.945736434 | 0.972111554 |
| NOT-PHLDB2 AND NOT-TMEM47 | 0.934086629 | 0.885714286 | 0.988047809 |
| NOT-TMEM47 AND HACD1 | 0.946534653 | 0.940944882 | 0.952191235 |
| SMIM3 AND NOT-C19orf12 | 0.947368421 | 0.927480916 | 0.96812749 |
| SMIM3 AND NOT-TMTC1 | 0.96 | 0.963855422 | 0.956175299 |
| NOT-ANTXR1 AND HACD1 | 0.946534653 | 0.940944882 | 0.952191235 |
| NOT-VAPB AND USP48 | 0.9348659 | 0.900369004 | 0.972111554 |
| NOT-SLC37A3 AND SMIM3 | 0.947368421 | 0.927480916 | 0.96812749 |
| NOT-FAM213A AND SMIM3 | 0.952755906 | 0.941634241 | 0.964143426 |
| NOT-VAPB AND ABHD13 | 0.942965779 | 0.901818182 | 0.988047809 |
| SMIM3 AND NOT-AOC3 | 0.972 | 0.975903614 | 0.96812749 |
| SMIM3 AND NOT-NRP1 | 0.945736434 | 0.920754717 | 0.972111554 |
| NOT-PHLDB2 AND SMIM3 | 0.966861598 | 0.946564885 | 0.988047809 |
| SMIM3 AND NOT-ANGPTL1 | 0.966336634 | 0.960629921 | 0.972111554 |
| SMIM3 AND NOT-PKDCC | 0.966067864 | 0.968 | 0.964143426 |
| SMIM3 AND NOT-BOC | 0.933078394 | 0.897058824 | 0.972111554 |
| SMIM3 AND NOT-OSMR | 0.960629921 | 0.949416342 | 0.972111554 |
| NOT-VAPB AND SMIM3 | 0.945525292 | 0.923954373 | 0.96812749 |
| SMIM3 AND NOT-KL | 0.94140625 | 0.923371648 | 0.960159363 |
| NOT-ARMCX2 AND SMIM3 | 0.96875 | 0.950191571 | 0.988047809 |
| NOT-PHLDB2 AND MYADM | 0.954274354 | 0.952380952 | 0.956175299 |
| NOT-PHLDB2 AND CD44 | 0.947775629 | 0.921052632 | 0.976095618 |
| NOT-PHLDB2 AND CD53 | 0.928301887 | 0.88172043 | 0.980079681 |
| NOT-PHLDB2 AND CLEC2B | 0.942307692 | 0.910780669 | 0.976095618 |
| NOT-VAPB AND TMEM183A | 0.950381679 | 0.912087912 | 0.992031873 |
| NOT-VAPB AND PTDSS1 | 0.936902486 | 0.900735294 | 0.976095618 |
| CD33 AND NOT-PXYLP1 | 0.93081761 | 0.982300885 | 0.884462151 |
| NOT-ARMCX2 AND ADGRE5 | 0.931818182 | 0.888086643 | 0.980079681 |
| Stomach Neoplasms\| Adenocarcinoma (Stomach A) | | | |
| MUC13 AND NOT-SLC30A10 | 0.942528736 | 0.931818182 | 0.953488372 |
| MUC13 AND NOT-SCNN1B | 0.976744186 | 0.976744186 | 0.976744186 |
| MUC13 AND APOLD1 | 0.911111111 | 0.872340426 | 0.953488372 |
| GREM1 AND MUC13 | 0.926829268 | 0.974358974 | 0.88372093 |
| MUC13 AND NOT-DHRS9 | 0.921348315 | 0.891304348 | 0.953488372 |
| MUC13 AND NOT-TRPM6 | 0.9 | 0.972972973 | 0.837209302 |
| MUC13 AND NOT-CLDN8 | 0.952380952 | 0.975609756 | 0.930232558 |
| MUC13 AND NOT-SLC26A2 | 0.953488372 | 0.953488372 | 0.953488372 |
| MUC13 AND NOT-CWH43 | 0.930232558 | 0.930232558 | 0.930232558 |
| GREM1 AND TNFRSF10B | 0.915662651 | 0.95 | 0.88372093 |
| GREM1 AND MUC1 | 0.913580247 | 0.973684211 | 0.860465116 |
| GREM1 AND KCNE3 | 0.938271605 | 1 | 0.88372093 |
| GREM1 AND ATP9A | 0.9 | 0.972972973 | 0.837209302 |
| GREM1 AND TSPAN1 | 0.915662651 | 0.95 | 0.88372093 |
| TMC5 AND NOT-TSPAN1 | 0.904761905 | 0.926829268 | 0.88372093 |
| GREM1 AND PDZK1IP1 | 0.904761905 | 0.926829268 | 0.88372093 |
| MUC13 AND NOT-DHRS9 | 0.921348315 | 0.891304348 | 0.953488372 |
| GREM1 AND ADAM8 | 0.915662651 | 0.95 | 0.88372093 |
| GREM1 AND ZMPSTE24 | 0.938271605 | 1 | 0.88372093 |
| GREM1 AND PRSS16 | 0.904761905 | 0.926829268 | 0.88372093 |
| GREM1 AND LILRB2 | 0.926829268 | 0.974358974 | 0.88372093 |
| GREM1 AND B3GNT3 | 0.926829268 | 0.974358974 | 0.88372093 |
| B3GNT3 AND NOT-SCNN1B | 0.915662651 | 0.95 | 0.88372093 |
| B3GNT3 AND NOT-CLDN8 | 0.9 | 0.972972973 | 0.837209302 |
| GREM1 AND LYPLA1 | 0.925 | 1 | 0.860465116 |
| GREM1 AND HTATIP2 | 0.911392405 | 1 | 0.837209302 |
| GREM1 AND AGPAT2 | 0.938271605 | 1 | 0.88372093 |
| GREM1 AND TNFSF13B | 0.938271605 | 1 | 0.88372093 |
| GREM1 AND SLC12A7 | 0.911392405 | 1 | 0.837209302 |
| GREM1 AND ADAM28 | 0.902439024 | 0.948717949 | 0.860465116 |
| GRIN2D AND JTB | 0.909090909 | 0.888888889 | 0.930232558 |
| GREM1 AND AFG3L2 | 0.938271605 | 1 | 0.88372093 |
| GREM1 AND SLC35D2 | 0.938271605 | 1 | 0.88372093 |

FIG. 1 (CONT.)

| Antigen Pair Logic | F1 | Precision | Recall |
|---|---|---|---|
| TNFRSF8 AND NOT-FAM57A | 0.933333333 | 0.933333333 | 0.933333333 |
| TNFRSF8 AND NOT-STX3 | 0.965517241 | 1 | 0.933333333 |
| TNFRSF8 AND NOT-SLC25A34 | 0.933333333 | 0.933333333 | 0.933333333 |
| TNFRSF8 AND NOT-OR10C1 | 0.933333333 | 0.933333333 | 0.933333333 |
| TNFRSF8 AND NOT-SLC44A2 | 0.933333333 | 0.933333333 | 0.933333333 |
| TNFRSF8 AND NOT-MGAT4D | 0.933333333 | 0.933333333 | 0.933333333 |
| TNFRSF8 AND NOT-IL1RL2 | 0.933333333 | 0.933333333 | 0.933333333 |
| TNFRSF8 AND NOT-SV2A | 0.933333333 | 0.933333333 | 0.933333333 |
| TNFRSF8 AND NOT-CLDN6 | 0.933333333 | 0.933333333 | 0.933333333 |
| TNFRSF8 AND NOT-PTGER3 | 0.933333333 | 0.933333333 | 0.933333333 |
| TNFRSF8 AND NOT-TMEM198 | 0.933333333 | 0.933333333 | 0.933333333 |
| TNFRSF8 AND NOT-IZUMO1 | 0.933333333 | 0.933333333 | 0.933333333 |
| TNFRSF8 AND NOT-LTK | 0.933333333 | 0.933333333 | 0.933333333 |
| TNFRSF8 AND NOT-PILRA | 0.965517241 | 1 | 0.933333333 |
| TNFRSF8 AND NOT-VSTM4 | 0.933333333 | 0.933333333 | 0.933333333 |
| TNFRSF8 AND NOT-JPH1 | 0.933333333 | 0.933333333 | 0.933333333 |
| TNFRSF8 AND NOT-PLXDC1 | 0.933333333 | 0.933333333 | 0.933333333 |
| TNFRSF8 AND NOT-TMEM200C | 0.933333333 | 0.933333333 | 0.933333333 |
| TNFRSF8 AND NOT-ALG9 | 0.933333333 | 0.933333333 | 0.933333333 |
| TNFRSF8 AND NOT-ANTXR2 | 0.933333333 | 0.933333333 | 0.933333333 |
| TNFRSF8 AND NOT-LMAN2 | 0.965517241 | 1 | 0.933333333 |
| TNFRSF8 AND NOT-ABCC11 | 0.933333333 | 0.933333333 | 0.933333333 |
| TNFRSF8 AND NOT-TMEM199 | 0.933333333 | 0.933333333 | 0.933333333 |
| TNFRSF8 AND NOT-MS4A14 | 0.965517241 | 1 | 0.933333333 |
| TNFRSF8 AND NOT-GLMP | 0.933333333 | 0.933333333 | 0.933333333 |
| TNFRSF8 AND NOT-BEST4 | 0.933333333 | 0.933333333 | 0.933333333 |
| TNFRSF8 AND NOT-M6PR | 0.928571429 | 1 | 0.866666667 |
| TNFRSF8 AND NOT-CD36 | 0.965517241 | 1 | 0.933333333 |
| TNFRSF8 AND NOT-WDR33 | 0.933333333 | 0.933333333 | 0.933333333 |
| TNFRSF8 AND NOT-UXS1 | 0.965517241 | 1 | 0.933333333 |
| TNFRSF8 AND NOT-SLC8A1 | 0.965517241 | 1 | 0.933333333 |
| TNFRSF8 AND NOT-SLC39A14 | 0.933333333 | 0.933333333 | 0.933333333 |
| TNFRSF8 AND NOT-ISLR2 | 0.933333333 | 0.933333333 | 0.933333333 |
| TNFRSF8 AND NOT-UNC5C | 0.933333333 | 0.933333333 | 0.933333333 |
| TNFRSF8 AND NOT-KCNJ11 | 0.933333333 | 0.933333333 | 0.933333333 |
| TNFRSF8 AND NOT-HTR3A | 0.933333333 | 0.933333333 | 0.933333333 |
| TNFRSF8 AND NOT-ODF4 | 0.933333333 | 0.933333333 | 0.933333333 |
| TNFRSF8 AND NOT-NIPAL4 | 0.933333333 | 0.933333333 | 0.933333333 |
| TNFRSF8 AND NOT-SLC16A8 | 0.933333333 | 0.933333333 | 0.933333333 |
| TNFRSF8 AND NOT-SLC7A6 | 0.933333333 | 0.933333333 | 0.933333333 |
| TNFRSF8 AND NOT-SLC7A9 | 0.933333333 | 0.933333333 | 0.933333333 |
| TNFRSF8 AND NOT-MFSD9 | 0.933333333 | 0.933333333 | 0.933333333 |
| TNFRSF8 AND NOT-VSIG1 | 0.965517241 | 1 | 0.933333333 |
| TNFRSF8 AND NOT-P2RY4 | 0.933333333 | 0.933333333 | 0.933333333 |
| TNFRSF8 AND NOT-ECE2 | 0.933333333 | 0.933333333 | 0.933333333 |
| TNFRSF8 AND NOT-ELFN2 | 0.933333333 | 0.933333333 | 0.933333333 |
| TNFRSF8 AND NOT-THADA | 0.933333333 | 0.933333333 | 0.933333333 |
| TNFRSF8 AND NOT-SCNN1G | 0.933333333 | 0.933333333 | 0.933333333 |
| TNFRSF8 AND NOT-DERL2 | 0.933333333 | 0.933333333 | 0.933333333 |
| TNFRSF8 AND NOT-SLC27A1 | 0.965517241 | 1 | 0.933333333 |
| TNFRSF8 AND NOT-HTR3B | 0.933333333 | 0.933333333 | 0.933333333 |
| TNFRSF8 AND NOT-SLC16A1 | 0.933333333 | 0.933333333 | 0.933333333 |
| TNFRSF8 AND NOT-CDH15 | 0.933333333 | 0.933333333 | 0.933333333 |
| TNFRSF8 AND NOT-SAMD8 | 0.933333333 | 0.933333333 | 0.933333333 |
| TNFRSF8 AND NOT-TMEM251 | 0.965517241 | 1 | 0.933333333 |
| TNFRSF8 AND NOT-SOX1 | 0.933333333 | 0.933333333 | 0.933333333 |
| TNFRSF8 AND NOT-STX18 | 0.933333333 | 0.933333333 | 0.933333333 |
| TNFRSF8 AND NOT-SGCD | 0.933333333 | 0.933333333 | 0.933333333 |
| TNFRSF8 AND NOT-PPAPDC3 | 0.933333333 | 0.933333333 | 0.933333333 |
| TNFRSF8 AND NOT-ECEL1 | 0.965517241 | 1 | 0.933333333 |
| TNFRSF8 AND NOT-CDH24 | 0.933333333 | 0.933333333 | 0.933333333 |
| TNFRSF8 AND NOT-GP5 | 0.933333333 | 0.933333333 | 0.933333333 |
| TNFRSF8 AND NOT-OPN5 | 0.933333333 | 0.933333333 | 0.933333333 |
| TNFRSF8 AND NOT-PF4 | 0.965517241 | 1 | 0.933333333 |
| TNFRSF8 AND NOT-PCDHGC4 | 0.933333333 | 0.933333333 | 0.933333333 |
| TNFRSF8 AND NOT-TMEM27 | 0.933333333 | 0.933333333 | 0.933333333 |
| TNFRSF8 AND NOT-ADAM11 | 0.933333333 | 0.933333333 | 0.933333333 |
| TNFRSF8 AND NOT-NCR2 | 0.933333333 | 0.933333333 | 0.933333333 |
| TNFRSF8 AND NOT-ADGRG3 | 0.933333333 | 0.933333333 | 0.933333333 |
| TNFRSF8 AND NOT-EPHA5 | 0.933333333 | 0.933333333 | 0.933333333 |
| TNFRSF8 AND NOT-MGAT1 | 0.928571429 | 1 | 0.866666667 |
| TNFRSF8 AND NOT-SLMAP | 0.933333333 | 0.933333333 | 0.933333333 |
| TNFRSF8 AND NOT-FAM19A2 | 0.933333333 | 0.933333333 | 0.933333333 |
| TNFRSF8 AND NOT-NCAM1 | 0.965517241 | 1 | 0.933333333 |
| TNFRSF8 AND NOT-CHST13 | 0.965517241 | 1 | 0.933333333 |
| TNFRSF8 AND NOT-PVRL1 | 0.933333333 | 0.933333333 | 0.933333333 |

| Antigen Pair Logic | F1 | Precision | Recall |
|---|---|---|---|
| GREM1 AND GALNT6 | 0.925 | 1 | 0.860465116 |
| GREM1 AND GLMP | 0.925 | 1 | 0.860465116 |
| GREM1 AND MGAT4B | 0.938271605 | 1 | 0.88372093 |
| GREM1 AND MGAT4A | 0.911392405 | 1 | 0.837209302 |
| GREM1 AND TMC6 | 0.904761905 | 0.926829268 | 0.88372093 |
| GREM1 AND MAL2 | 0.915662651 | 0.95 | 0.88372093 |
| GREM1 AND NOT-GALNT13 | 0.938271605 | 1 | 0.88372093 |
| GREM1 AND SLC18B1 | 0.938271605 | 1 | 0.88372093 |
| GREM1 AND CLCN5 | 0.904761905 | 0.926829268 | 0.88372093 |
| GREM1 AND ZFYVE27 | 0.926829268 | 0.974358974 | 0.88372093 |
| GREM1 AND SFXN4 | 0.925 | 1 | 0.860465116 |
| GREM1 AND TMEM45B | 0.915662651 | 0.95 | 0.88372093 |
| GREM1 AND CLPTM1 | 0.904761905 | 0.926829268 | 0.88372093 |
| GREM1 AND NIPA1 | 0.904761905 | 0.926829268 | 0.88372093 |
| GREM1 AND TMEM219 | 0.926829268 | 0.974358974 | 0.88372093 |
| GREM1 AND CANT1 | 0.938271605 | 1 | 0.88372093 |
| GREM1 AND SLC44A3 | 0.926829268 | 0.974358974 | 0.88372093 |
| GREM1 AND TMEM125 | 0.915662651 | 0.95 | 0.88372093 |
| GREM1 AND NOT-TMEM207 | 0.9 | 0.972972973 | 0.837209302 |
| GREM1 AND COX8A | 0.926829268 | 0.974358974 | 0.88372093 |
| GREM1 AND CLDN4 | 0.915662651 | 0.95 | 0.88372093 |
| MUC13 AND NOT-TRPM6 | 0.9 | 0.972972973 | 0.837209302 |
| GREM1 AND CMTM4 | 0.926829268 | 0.974358974 | 0.88372093 |
| GREM1 AND TMC4 | 0.926829268 | 0.974358974 | 0.88372093 |
| GREM1 AND CXADR | 0.904761905 | 0.926829268 | 0.88372093 |
| GREM1 AND TMEM161B | 0.926829268 | 0.974358974 | 0.88372093 |
| GREM1 AND RDH10 | 0.926829268 | 0.974358974 | 0.837209302 |
| GREM1 AND CYP3A5 | 0.915662651 | 0.95 | 0.88372093 |
| GREM1 AND ABHD3 | 0.925 | 1 | 0.860465116 |
| GREM1 AND DPAGT1 | 0.938271605 | 1 | 0.88372093 |
| GREM1 AND DSG2 | 0.938271605 | 1 | 0.88372093 |
| DSG2 AND NOT-CLDN8 | 0.942528736 | 0.931818182 | 0.953488372 |
| MUC13 AND NOT-SLC26A2 | 0.953488372 | 0.953488372 | 0.953488372 |
| GREM1 AND NOT-PLD5 | 0.915662651 | 0.95 | 0.88372093 |
| GREM1 AND KRTCAP3 | 0.925 | 1 | 0.860465116 |
| GREM1 AND TIGIT | 0.904761905 | 0.926829268 | 0.88372093 |
| GREM1 AND EPHA1 | 0.904761905 | 0.926829268 | 0.88372093 |
| GREM1 AND ERN1 | 0.9 | 0.972972973 | 0.837209302 |
| GREM1 AND EVI2A | 0.915662651 | 0.95 | 0.88372093 |
| GREM1 AND EVI2B | 0.904761905 | 0.926829268 | 0.88372093 |
| GREM1 AND F2RL1 | 0.926829268 | 0.974358974 | 0.88372093 |
| GREM1 AND MPEG1 | 0.926829268 | 0.974358974 | 0.88372093 |
| GREM1 AND FCER1G | 0.925 | 1 | 0.860465116 |
| CYP2S1 AND NOT-SLC16A9 | 0.921348315 | 0.891304348 | 0.953488372 |
| GREM1 AND C6orf136 | 0.926829268 | 0.974358974 | 0.88372093 |
| GREM1 AND FCGR3B | 0.911392405 | 1 | 0.837209302 |
| GREM1 AND TMED4 | 0.911392405 | 1 | 0.837209302 |
| GREM1 AND UNC5CL | 0.915662651 | 0.95 | 0.88372093 |
| GREM1 AND CD93 | 0.913580247 | 0.973684211 | 0.860465116 |
| GREM1 AND NUP210 | 0.926829268 | 0.974358974 | 0.88372093 |
| GREM1 AND SEL1L3 | 0.938271605 | 1 | 0.88372093 |
| GREM1 AND ATP11A | 0.902439024 | 0.948717949 | 0.860465116 |
| GREM1 AND FMO5 | 0.9 | 0.972972973 | 0.837209302 |
| GREM1 AND SLC9A8 | 0.904761905 | 0.926829268 | 0.88372093 |
| GREM1 AND SLC35A3 | 0.926829268 | 0.974358974 | 0.88372093 |
| GREM1 AND TRAM1 | 0.911392405 | 1 | 0.837209302 |
| GREM1 AND SEC61G | 0.926829268 | 0.974358974 | 0.88372093 |
| GREM1 AND VSIG2 | 0.9 | 0.972972973 | 0.837209302 |
| GREM1 AND LEMD3 | 0.925 | 1 | 0.860465116 |
| GREM1 AND PLD3 | 0.926829268 | 0.974358974 | 0.88372093 |
| GREM1 AND TMEM2 | 0.938271605 | 1 | 0.88372093 |
| GREM1 AND ALOX5AP | 0.925 | 1 | 0.860465116 |
| GREM1 AND FUT2 | 0.904761905 | 0.926829268 | 0.88372093 |
| GREM1 AND FUT4 | 0.938271605 | 1 | 0.88372093 |
| GREM1 AND FUT8 | 0.913580247 | 0.973684211 | 0.860465116 |
| GREM1 AND CERS6 | 0.926829268 | 0.974358974 | 0.88372093 |
| GREM1 AND IFI6 | 0.911392405 | 1 | 0.837209302 |
| GREM1 AND ZDHHC23 | 0.926829268 | 0.974358974 | 0.88372093 |
| GREM1 AND GALNT3 | 0.938271605 | 1 | 0.88372093 |
| GREM1 AND IL4I1 | 0.904761905 | 0.926829268 | 0.88372093 |
| GREM1 AND PVRL3 | 0.9 | 0.972972973 | 0.837209302 |
| GREM1 AND PNKD | 0.911392405 | 1 | 0.837209302 |
| GREM1 AND STEAP2 | 0.915662651 | 0.95 | 0.88372093 |
| GREM1 AND KCNG2 | 0.904761905 | 0.926829268 | 0.88372093 |
| GREM1 AND CLEC4E | 0.902439024 | 0.948717949 | 0.860465116 |
| GREM1 AND CNNM4 | 0.915662651 | 0.95 | 0.88372093 |

FIG. 1 (CONT.)

| Antigen Pair Logic | F1 | Precision | Recall |
|---|---|---|---|
| TNFRSF8 AND NOT-RYR1 | 0.933333333 | 0.93333333 | 0.933333333 |
| TNFRSF8 AND NOT-TMEM151B | 0.933333333 | 0.93333333 | 0.933333333 |
| TNFRSF8 AND NOT-GABRA4 | 0.933333333 | 0.93333333 | 0.933333333 |
| TNFRSF8 AND NOT-NTSR1 | 0.933333333 | 0.93333333 | 0.933333333 |
| TNFRSF8 AND NOT-CNNM2 | 0.933333333 | 0.93333333 | 0.933333333 |
| TNFRSF8 AND NOT-B3GLCT | 0.933333333 | 0.93333333 | 0.933333333 |
| TNFRSF8 AND NOT-CLEC1A | 0.933333333 | 0.93333333 | 0.933333333 |
| TNFRSF8 AND NOT-GABRD | 0.933333333 | 0.93333333 | 0.933333333 |
| TNFRSF8 AND NOT-VKORC1L1 | 0.933333333 | 0.93333333 | 0.933333333 |
| TNFRSF8 AND NOT-MUC3A | 0.933333333 | 0.93333333 | 0.933333333 |
| TNFRSF8 AND NOT-OPN1SW | 0.933333333 | 0.93333333 | 0.933333333 |
| TNFRSF8 AND NOT-GCNT2 | 0.928571429 | 1 | 0.866666667 |
| TNFRSF8 AND NOT-BCL2 | 0.933333333 | 0.93333333 | 0.933333333 |
| TNFRSF8 AND NOT-SPI1 | 0.933333333 | 0.93333333 | 0.933333333 |
| TNFRSF8 AND NOT-EGF | 0.933333333 | 0.93333333 | 0.933333333 |
| TNFRSF8 AND NOT-PTPRS | 0.933333333 | 0.93333333 | 0.933333333 |
| TNFRSF8 AND NOT-DISP1 | 0.933333333 | 0.93333333 | 0.933333333 |
| TNFRSF8 AND NOT-COL11A2 | 0.933333333 | 0.93333333 | 0.933333333 |
| TNFRSF8 AND NOT-SMIM10 | 0.933333333 | 0.93333333 | 0.933333333 |
| TNFRSF8 AND NOT-TMEM19 | 0.933333333 | 0.93333333 | 0.933333333 |
| TNFRSF8 AND NOT-SNRNP40 | 0.965517241 | 1 | 0.933333333 |
| TNFRSF8 AND NOT-CGRRF1 | 0.933333333 | 0.93333333 | 0.933333333 |
| TNFRSF8 AND NOT-POMT1 | 0.933333333 | 0.93333333 | 0.933333333 |
| TNFRSF8 AND NOT-ST6GAL2 | 0.933333333 | 0.93333333 | 0.933333333 |
| TNFRSF8 AND NOT-PTCH1 | 0.933333333 | 0.93333333 | 0.933333333 |
| TNFRSF8 AND NOT-MUC17 | 0.933333333 | 0.93333333 | 0.933333333 |
| TNFRSF8 AND NOT-CFAP47 | 0.933333333 | 0.93333333 | 0.933333333 |
| TNFRSF8 AND NOT-TMEM221 | 0.933333333 | 0.93333333 | 0.933333333 |
| TNFRSF8 AND NOT-ATP10A | 0.933333333 | 0.93333333 | 0.933333333 |
| TNFRSF8 AND NOT-HMP19 | 0.933333333 | 0.93333333 | 0.933333333 |
| TNFRSF8 AND NOT-BTC | 0.933333333 | 0.93333333 | 0.933333333 |
| TNFRSF8 AND NOT-KCNA6 | 0.933333333 | 0.93333333 | 0.933333333 |
| TNFRSF8 AND NOT-TMEM141 | 0.965517241 | 1 | 0.933333333 |
| TNFRSF8 AND NOT-ERVMER34-1 | 0.933333333 | 0.93333333 | 0.933333333 |
| TNFRSF8 AND NOT-ESYT3 | 0.933333333 | 0.93333333 | 0.933333333 |
| TNFRSF8 AND NOT-HTR1B | 0.933333333 | 0.93333333 | 0.933333333 |
| TNFRSF8 AND NOT-STX17 | 0.933333333 | 0.93333333 | 0.933333333 |
| TNFRSF8 AND NOT-TMCC3 | 0.965517241 | 1 | 0.933333333 |
| TNFRSF8 AND NOT-CCL11 | 0.933333333 | 0.93333333 | 0.933333333 |
| TNFRSF8 AND NOT-PIGA | 0.933333333 | 0.93333333 | 0.933333333 |
| TNFRSF8 AND NOT-ELANE | 0.933333333 | 0.93333333 | 0.933333333 |
| TNFRSF8 AND NOT-GPR6 | 0.933333333 | 0.93333333 | 0.933333333 |
| TNFRSF8 AND NOT-C11orf87 | 0.933333333 | 0.93333333 | 0.933333333 |
| TNFRSF8 AND NOT-LGR6 | 0.965517241 | 1 | 0.933333333 |
| TNFRSF8 AND NOT-CD3G | 0.928571429 | 1 | 0.866666667 |
| TNFRSF8 AND NOT-KCNH8 | 0.933333333 | 0.93333333 | 0.933333333 |
| TNFRSF8 AND NOT-ENPP5 | 0.965517241 | 1 | 0.933333333 |
| TNFRSF8 AND NOT-NRXN2 | 0.933333333 | 0.93333333 | 0.933333333 |
| TNFRSF8 AND NOT-NPY5R | 0.933333333 | 0.93333333 | 0.933333333 |
| TNFRSF8 AND NOT-ABCG4 | 0.933333333 | 0.93333333 | 0.933333333 |
| TNFRSF8 AND NOT-SLC25A48 | 0.933333333 | 0.93333333 | 0.933333333 |
| TNFRSF8 AND NOT-GPR155 | 0.933333333 | 0.93333333 | 0.933333333 |
| TNFRSF8 AND NOT-SNX19 | 0.933333333 | 0.93333333 | 0.933333333 |
| TNFRSF8 AND NOT-KLRF1 | 0.965517241 | 1 | 0.933333333 |
| TNFRSF8 AND NOT-GRIK3 | 0.933333333 | 0.93333333 | 0.933333333 |
| TNFRSF8 AND NOT-ATP2A3 | 0.965517241 | 1 | 0.933333333 |
| TNFRSF8 AND NOT-PCDH19 | 0.933333333 | 0.93333333 | 0.933333333 |
| TNFRSF8 AND NOT-PCDHB16 | 0.933333333 | 0.93333333 | 0.933333333 |
| TNFRSF8 AND NOT-PCDHGC5 | 0.933333333 | 0.93333333 | 0.933333333 |
| TNFRSF8 AND NOT-ZFPL1 | 0.933333333 | 0.93333333 | 0.933333333 |
| TNFRSF8 AND NOT-SPCS2 | 0.933333333 | 0.93333333 | 0.933333333 |
| TNFRSF8 AND NOT-ENPP1 | 0.933333333 | 0.93333333 | 0.933333333 |
| TNFRSF8 AND NOT-COL24A1 | 0.933333333 | 0.93333333 | 0.933333333 |
| TNFRSF8 AND NOT-RTN1 | 0.965517241 | 1 | 0.933333333 |
| TNFRSF8 AND NOT-GPR107 | 0.933333333 | 0.93333333 | 0.933333333 |
| TNFRSF8 AND NOT-SLC30A3 | 0.933333333 | 0.93333333 | 0.933333333 |
| TNFRSF8 AND NOT-SLC4A9 | 0.933333333 | 0.93333333 | 0.933333333 |
| TNFRSF8 AND NOT-MTNR1B | 0.933333333 | 0.93333333 | 0.933333333 |
| TNFRSF8 AND NOT-DPCR1 | 0.933333333 | 0.93333333 | 0.933333333 |
| TNFRSF8 AND NOT-MARCH4 | 0.933333333 | 0.93333333 | 0.933333333 |
| TNFRSF8 AND NOT-SLC35D3 | 0.933333333 | 0.93333333 | 0.933333333 |
| TNFRSF8 AND NOT-LRRN1 | 0.933333333 | 0.93333333 | 0.933333333 |
| TNFRSF8 AND NOT-SLC47A2 | 0.933333333 | 0.93333333 | 0.933333333 |
| TNFRSF8 AND NOT-KLHL2 | 0.965517241 | 1 | 0.933333333 |
| TNFRSF8 AND NOT-SLC23A1 | 0.933333333 | 0.93333333 | 0.933333333 |
| TNFRSF8 AND NOT-MPZL3 | 0.933333333 | 0.93333333 | 0.933333333 |

| Antigen Pair Logic | F1 | Precision | Recall |
|---|---|---|---|
| GREM1 AND STEAP1 | 0.915662651 | 0.95 | 0.88372093 |
| GREM1 AND GPR160 | 0.938271605 | 1 | 0.88372093 |
| GREM1 AND CNPPD1 | 0.926829268 | 0.974358974 | 0.88372093 |
| GREM1 AND GJB1 | 0.926829268 | 0.974358974 | 0.88372093 |
| GREM1 AND NOT-GLRA2 | 0.9 | 0.972972973 | 0.837209302 |
| GREM1 AND GOLGB1 | 0.911392405 | 1 | 0.837209302 |
| GREM1 AND NOT-GPM6B | 0.902439024 | 0.948717949 | 0.860465116 |
| GREM1 AND B4GALNT3 | 0.904761905 | 0.926829268 | 0.88372093 |
| GREM1 AND TMEM176B | 0.915662651 | 0.95 | 0.88372093 |
| GREM1 AND CYP2S1 | 0.915662651 | 0.95 | 0.88372093 |
| GREM1 AND DPP7 | 0.925 | 1 | 0.860465116 |
| GREM1 AND HLA-DOA | 0.904761905 | 0.926829268 | 0.88372093 |
| GREM1 AND HLA-DRA | 0.911392405 | 1 | 0.837209302 |
| GREM1 AND HLA-F | 0.926829268 | 0.974358974 | 0.88372093 |
| GREM1 AND HSD17B2 | 0.915662651 | 0.95 | 0.88372093 |
| GREM1 AND ANO9 | 0.904761905 | 0.926829268 | 0.88372093 |
| GREM1 AND SERINC2 | 0.938271605 | 1 | 0.88372093 |
| GREM1 AND IL7R | 0.938271605 | 1 | 0.88372093 |
| GREM1 AND IL13 | 0.904761905 | 0.926829268 | 0.88372093 |
| GREM1 AND INPP4A | 0.926829268 | 0.974358974 | 0.88372093 |
| GREM1 AND INSR | 0.926829268 | 0.974358974 | 0.88372093 |
| GREM1 AND ITGA6 | 0.925 | 1 | 0.860465116 |
| GREM1 AND ITGAM | 0.911392405 | 1 | 0.837209302 |
| GREM1 AND ITGAX | 0.904761905 | 0.926829268 | 0.88372093 |
| GREM1 AND ITGB2 | 0.938271605 | 1 | 0.88372093 |
| GREM1 AND ITPR3 | 0.938271605 | 1 | 0.88372093 |
| GREM1 AND TMEM205 | 0.926829268 | 0.974358974 | 0.88372093 |
| GREM1 AND KCNK1 | 0.911392405 | 1 | 0.837209302 |
| GREM1 AND KCNN4 | 0.913580247 | 0.973684211 | 0.860465116 |
| GREM1 AND KCNQ1 | 0.926829268 | 0.974358974 | 0.88372093 |
| GREM1 AND TMEM189 | 0.915662651 | 0.95 | 0.88372093 |
| GREM1 AND NOT-SPATA31D1 | 0.915662651 | 0.95 | 0.88372093 |
| GREM1 AND LAMP1 | 0.913580247 | 0.973684211 | 0.860465116 |
| GREM1 AND EPCAM | 0.938271605 | 1 | 0.88372093 |
| GREM1 AND MGST2 | 0.926829268 | 0.974358974 | 0.88372093 |
| GREM1 AND ABCC1 | 0.915662651 | 0.95 | 0.88372093 |
| GREM1 AND NOT-SMCO3 | 0.925 | 1 | 0.860465116 |
| GREM1 AND SMIM22 | 0.925 | 1 | 0.860465116 |
| GREM1 AND MST1R | 0.926829268 | 0.974358974 | 0.88372093 |
| GREM1 AND MTHFD1 | 0.938271605 | 1 | 0.88372093 |
| GREM1 AND MUC1 | 0.913580247 | 0.973684211 | 0.860465116 |
| GREM1 AND MUC3A | 0.904761905 | 0.926829268 | 0.88372093 |
| GREM1 AND ATP2A3 | 0.904761905 | 0.926829268 | 0.88372093 |
| GREM1 AND NTRK1 | 0.913580247 | 0.973684211 | 0.860465116 |
| GREM1 AND NUCB1 | 0.904761905 | 0.926829268 | 0.88372093 |
| GREM1 AND P2RX4 | 0.926829268 | 0.974358974 | 0.88372093 |
| GREM1 AND F11R | 0.926829268 | 0.974358974 | 0.88372093 |
| GREM1 AND TMX2 | 0.925 | 1 | 0.860465116 |
| GREM1 AND SLC15A3 | 0.904761905 | 0.926829268 | 0.88372093 |
| GREM1 AND LSR | 0.926829268 | 0.974358974 | 0.88372093 |
| GREM1 AND PIGT | 0.925 | 1 | 0.860465116 |
| GREM1 AND TMBIM4 | 0.911392405 | 1 | 0.837209302 |
| GREM1 AND ACSL5 | 0.911392405 | 1 | 0.837209302 |
| GREM1 AND GALNT7 | 0.938271605 | 1 | 0.88372093 |
| GREM1 AND CECR1 | 0.913580247 | 0.973684211 | 0.860465116 |
| GREM1 AND SERPINA1 | 0.926829268 | 0.974358974 | 0.88372093 |
| GREM1 AND NOT-FXYD1 | 0.913580247 | 0.973684211 | 0.860465116 |
| GREM1 AND PLXNA1 | 0.904761905 | 0.926829268 | 0.88372093 |
| GREM1 AND ATP6AP1 | 0.938271605 | 1 | 0.88372093 |
| GREM1 AND PODXL | 0.9 | 0.972972973 | 0.837209302 |
| GREM1 AND POR | 0.938271605 | 1 | 0.88372093 |
| GREM1 AND VSIG10 | 0.904761905 | 0.926829268 | 0.88372093 |
| GREM1 AND P4HTM | 0.926829268 | 0.974358974 | 0.88372093 |
| GREM1 AND TRPM4 | 0.926829268 | 0.974358974 | 0.88372093 |
| GREM1 AND CDHR2 | 0.938271605 | 1 | 0.88372093 |
| GREM1 AND RETSAT | 0.915662651 | 0.95 | 0.88372093 |
| GREM1 AND TMEM248 | 0.938271605 | 1 | 0.88372093 |
| GREM1 AND TAPBPL | 0.904761905 | 0.926829268 | 0.88372093 |
| GREM1 AND TMEM51 | 0.915662651 | 0.95 | 0.88372093 |
| GREM1 AND ZDHHC4 | 0.913580247 | 0.973684211 | 0.860465116 |
| GREM1 AND TMEM57 | 0.9 | 0.972972973 | 0.837209302 |
| GREM1 AND NOT-SLC30A10 | 0.913580247 | 0.973684211 | 0.860465116 |
| GREM1 AND IL17RB | 0.902439024 | 0.948717949 | 0.860465116 |
| GREM1 AND SLC39A4 | 0.926829268 | 0.974358974 | 0.88372093 |
| GREM1 AND CARKD | 0.902439024 | 0.948717949 | 0.860465116 |
| GREM1 AND ST6GALNAC1 | 0.938271605 | 1 | 0.88372093 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-DGAT1 | 0.965517241 | 1 | 0.933333333 | GREM1 AND LRRC8A | 0.904761905 | 0.926829268 | 0.88372093 |
| TNFRSF8 AND NOT-LPPR3 | 0.933333333 | 0.93333333 | 0.933333333 | GREM1 AND TMPRSS4 | 0.904761905 | 0.926829268 | 0.88372093 |
| TNFRSF8 AND NOT-NRG3 | 0.933333333 | 0.93333333 | 0.933333333 | GREM1 AND MUC13 | 0.926829268 | 0.974358974 | 0.88372093 |
| TNFRSF8 AND NOT-KIDINS220 | 0.965517241 | 1 | 0.933333333 | GREM1 AND SLAMF8 | 0.904761905 | 0.926829268 | 0.88372093 |
| TNFRSF8 AND NOT-PRRG3 | 0.933333333 | 0.93333333 | 0.933333333 | GREM1 AND C1GALT1 | 0.911392405 | 1 | 0.837209302 |
| TNFRSF8 AND NOT-CALHM1 | 0.933333333 | 0.93333333 | 0.933333333 | GREM1 AND NOT-OTOR | 0.915662651 | 0.95 | 0.88372093 |
| TNFRSF8 AND NOT-SLC24A2 | 0.933333333 | 0.93333333 | 0.933333333 | GREM1 AND ATP13A1 | 0.926829268 | 0.974358974 | 0.88372093 |
| TNFRSF8 AND NOT-ZDHHC22 | 0.933333333 | 0.93333333 | 0.933333333 | GREM1 AND SLC45A4 | 0.925 | 1 | 0.860465116 |
| TNFRSF8 AND NOT-ZDHHC18 | 0.933333333 | 0.93333333 | 0.933333333 | GREM1 AND SYT13 | 0.913580247 | 0.973684211 | 0.860465116 |
| TNFRSF8 AND NOT-TMED3 | 0.933333333 | 0.93333333 | 0.933333333 | GREM1 AND SEMA4G | 0.926829268 | 0.974358974 | 0.88372093 |
| TNFRSF8 AND NOT-OPRD1 | 0.933333333 | 0.93333333 | 0.933333333 | GREM1 AND PTPRCAP | 0.904761905 | 0.926829268 | 0.88372093 |
| TNFRSF8 AND NOT-CLEC5A | 0.965517241 | 1 | 0.933333333 | GREM1 AND PTPRE | 0.926829268 | 0.974358974 | 0.88372093 |
| TNFRSF8 AND NOT-LCN10 | 0.933333333 | 0.93333333 | 0.933333333 | GREM1 AND PTPRH | 0.925 | 1 | 0.860465116 |
| TNFRSF8 AND NOT-C6orf25 | 0.933333333 | 0.93333333 | 0.933333333 | GREM1 AND PTPRK | 0.938271605 | 1 | 0.88372093 |
| TNFRSF8 AND NOT-UGT2B17 | 0.928571429 | 1 | 0.866666667 | GREM1 AND CXCL16 | 0.925 | 1 | 0.860465116 |
| TNFRSF8 AND NOT-DAGLA | 0.965517241 | 1 | 0.933333333 | GREM1 AND PVRL2 | 0.904761905 | 0.926829268 | 0.88372093 |
| TNFRSF8 AND NOT-TMEM265 | 0.933333333 | 0.93333333 | 0.933333333 | GREM1 AND BCL2L1 | 0.915662651 | 0.95 | 0.88372093 |
| TNFRSF8 AND NOT-BTN1A1 | 0.933333333 | 0.93333333 | 0.933333333 | GREM1 AND RNASE6 | 0.926829268 | 0.974358974 | 0.88372093 |
| TNFRSF8 AND NOT-WLS | 0.965517241 | 1 | 0.933333333 | GREM1 AND RPN2 | 0.911392405 | 1 | 0.837209302 |
| TNFRSF8 AND NOT-ABCC4 | 0.933333333 | 0.93333333 | 0.933333333 | GREM1 AND CEACAM1 | 0.902439024 | 0.948717949 | 0.860465116 |
| TNFRSF8 AND NOT-NIPAL2 | 0.933333333 | 0.93333333 | 0.933333333 | GREM1 AND SDC4 | 0.911392405 | 1 | 0.837209302 |
| TNFRSF8 AND NOT-HRH3 | 0.933333333 | 0.93333333 | 0.933333333 | GREM1 AND BIK | 0.938271605 | 1 | 0.88372093 |
| TNFRSF8 AND NOT-ATCAY | 0.933333333 | 0.93333333 | 0.933333333 | GREM1 AND ABCG4 | 0.902439024 | 0.948717949 | 0.860465116 |
| TNFRSF8 AND NOT-KCNK6 | 0.965517241 | 1 | 0.933333333 | GREM1 AND EDDM3B | 0.926829268 | 0.974358974 | 0.88372093 |
| TNFRSF8 AND NOT-ATP13A4 | 0.933333333 | 0.93333333 | 0.933333333 | GREM1 AND DNAJC1 | 0.926829268 | 0.974358974 | 0.88372093 |
| TNFRSF8 AND NOT-FMNL1 | 0.933333333 | 0.93333333 | 0.933333333 | GREM1 AND NOT-SFRP1 | 0.913580247 | 0.973684211 | 0.860465116 |
| TNFRSF8 AND NOT-ATP6V0A4 | 0.933333333 | 0.93333333 | 0.933333333 | GREM1 AND CYP3A43 | 0.904761905 | 0.926829268 | 0.88372093 |
| TNFRSF8 AND NOT-LRRN3 | 0.965517241 | 1 | 0.933333333 | GREM1 AND SLC4A2 | 0.926829268 | 0.974358974 | 0.88372093 |
| TNFRSF8 AND NOT-GDNF | 0.933333333 | 0.93333333 | 0.933333333 | GREM1 AND NOT-SLC10A1 | 0.926829268 | 0.974358974 | 0.88372093 |
| TNFRSF8 AND NOT-XCR1 | 0.933333333 | 0.93333333 | 0.933333333 | GREM1 AND SLC12A2 | 0.911392405 | 1 | 0.837209302 |
| TNFRSF8 AND NOT-DDX59 | 0.933333333 | 0.93333333 | 0.933333333 | GREM1 AND SLC16A1 | 0.913580247 | 0.973684211 | 0.860465116 |
| TNFRSF8 AND NOT-LMBR1 | 0.933333333 | 0.93333333 | 0.933333333 | GREM1 AND SLC20A1 | 0.911392405 | 1 | 0.837209302 |
| TNFRSF8 AND NOT-CHST10 | 0.933333333 | 0.93333333 | 0.933333333 | GREM1 AND SPAG4 | 0.915662651 | 0.95 | 0.88372093 |
| TNFRSF8 AND NOT-ADAM30 | 0.933333333 | 0.93333333 | 0.933333333 | GREM1 AND SPI1 | 0.915662651 | 0.95 | 0.88372093 |
| TNFRSF8 AND NOT-GALNTL5 | 0.933333333 | 0.93333333 | 0.933333333 | GREM1 AND SPINT1 | 0.904761905 | 0.926829268 | 0.88372093 |
| TNFRSF8 AND NOT-SLC5A1 | 0.933333333 | 0.93333333 | 0.933333333 | GREM1 AND ST14 | 0.913580247 | 0.973684211 | 0.860465116 |
| TNFRSF8 AND NOT-C17orf74 | 0.933333333 | 0.93333333 | 0.933333333 | GREM1 AND STX3 | 0.925 | 1 | 0.860465116 |
| TNFRSF8 AND NOT-CSF3R | 0.965517241 | 1 | 0.933333333 | GREM1 AND TAPBP | 0.915662651 | 0.95 | 0.88372093 |
| TNFRSF8 AND NOT-FAM132A | 0.933333333 | 0.93333333 | 0.933333333 | GREM1 AND TLR2 | 0.911392405 | 1 | 0.837209302 |
| TNFRSF8 AND NOT-ERBB4 | 0.933333333 | 0.93333333 | 0.933333333 | GREM1 AND TSPAN8 | 0.915662651 | 0.95 | 0.88372093 |
| TNFRSF8 AND NOT-CYP4F8 | 0.933333333 | 0.93333333 | 0.933333333 | GREM1 AND TMPRSS2 | 0.915662651 | 0.95 | 0.88372093 |
| TNFRSF8 AND NOT-SLC5A2 | 0.933333333 | 0.93333333 | 0.933333333 | GREM1 AND TNFRSF1B | 0.904761905 | 0.926829268 | 0.88372093 |
| TNFRSF8 AND NOT-MCU | 0.933333333 | 0.93333333 | 0.933333333 | GREM1 AND C1QB | 0.915662651 | 0.95 | 0.88372093 |
| TNFRSF8 AND NOT-CCPG1 | 0.933333333 | 0.93333333 | 0.933333333 | GREM1 AND TYROBP | 0.915662651 | 0.95 | 0.88372093 |
| TNFRSF8 AND NOT-USP27X | 0.965517241 | 1 | 0.933333333 | GREM1 AND UGT8 | 0.904761905 | 0.926829268 | 0.88372093 |
| TNFRSF8 AND NOT-CCDC109B | 0.933333333 | 0.93333333 | 0.933333333 | GREM1 AND XK | 0.902439024 | 0.948717949 | 0.860465116 |
| TNFRSF8 AND NOT-KMO | 0.933333333 | 0.93333333 | 0.933333333 | GREM1 AND FZD5 | 0.913580247 | 0.973684211 | 0.860465116 |
| TNFRSF8 AND NOT-PCDHGA10 | 0.933333333 | 0.93333333 | 0.933333333 | GREM1 AND FA2H | 0.926829268 | 0.974358974 | 0.88372093 |
| TNFRSF8 AND NOT-LRFN4 | 0.933333333 | 0.93333333 | 0.933333333 | GREM1 AND ABHD16A | 0.915662651 | 0.95 | 0.88372093 |
| TNFRSF8 AND NOT-PTPN2 | 0.933333333 | 0.93333333 | 0.933333333 | GREM1 AND LST1 | 0.904761905 | 0.926829268 | 0.88372093 |
| TNFRSF8 AND NOT-BTNL2 | 0.933333333 | 0.93333333 | 0.933333333 | GREM1 AND TTC13 | 0.925 | 1 | 0.860465116 |
| TNFRSF8 AND NOT-ADRA1B | 0.933333333 | 0.93333333 | 0.933333333 | GREM1 AND RNF128 | 0.926829268 | 0.974358974 | 0.88372093 |
| TNFRSF8 AND NOT-TMEM61 | 0.933333333 | 0.93333333 | 0.933333333 | GREM1 AND RHBDF2 | 0.902439024 | 0.948717949 | 0.860465116 |
| TNFRSF8 AND NOT-LAMP2 | 0.933333333 | 0.93333333 | 0.933333333 | GREM1 AND C3orf52 | 0.925 | 1 | 0.860465116 |
| TNFRSF8 AND NOT-GXYLT1 | 0.928571429 | 1 | 0.866666667 | GREM1 AND GALNT12 | 0.913580247 | 0.973684211 | 0.860465116 |
| TNFRSF8 AND NOT-PTGS1 | 0.965517241 | 1 | 0.933333333 | GREM1 AND TMC5 | 0.938271605 | 1 | 0.88372093 |
| TNFRSF8 AND NOT-KCNMB1 | 0.928571429 | 1 | 0.866666667 | GREM1 AND LPCAT1 | 0.911392405 | 1 | 0.837209302 |
| TNFRSF8 AND NOT-ADAM18 | 0.933333333 | 0.93333333 | 0.933333333 | GREM1 AND DNAJC22 | 0.904761905 | 0.926829268 | 0.88372093 |
| TNFRSF8 AND NOT-GDF9 | 0.933333333 | 0.93333333 | 0.933333333 | GREM1 AND ALPK1 | 0.926829268 | 0.974358974 | 0.88372093 |
| TNFRSF8 AND NOT-CDCP1 | 0.933333333 | 0.93333333 | 0.933333333 | GREM1 AND HSD3B7 | 0.904761905 | 0.926829268 | 0.88372093 |
| TNFRSF8 AND NOT-DERL1 | 0.933333333 | 0.93333333 | 0.933333333 | GREM1 AND TTYH3 | 0.915662651 | 0.95 | 0.88372093 |
| TNFRSF8 AND NOT-TMEM132D | 0.933333333 | 0.93333333 | 0.933333333 | GREM1 AND SLC44A4 | 0.926829268 | 0.974358974 | 0.88372093 |
| TNFRSF8 AND NOT-ZAN | 0.933333333 | 0.93333333 | 0.933333333 | GREM1 AND NOT-SPX | 0.913580247 | 0.973684211 | 0.860465116 |
| TNFRSF8 AND NOT-MRAP | 0.933333333 | 0.93333333 | 0.933333333 | GREM1 AND HM13 | 0.926829268 | 0.974358974 | 0.88372093 |
| TNFRSF8 AND NOT-MUC16 | 0.933333333 | 0.93333333 | 0.933333333 | GREM1 AND AKAP1 | 0.926829268 | 0.974358974 | 0.88372093 |
| TNFRSF8 AND NOT-SLCO4C1 | 0.965517241 | 1 | 0.933333333 | GREM1 AND CRISPLD2 | 0.911392405 | 1 | 0.837209302 |
| TNFRSF8 AND NOT-CDH26 | 0.933333333 | 0.93333333 | 0.933333333 | GREM1 AND ARMC10 | 0.911392405 | 1 | 0.837209302 |
| TNFRSF8 AND NOT-CACNA1F | 0.933333333 | 0.93333333 | 0.933333333 | GREM1 AND SPNS1 | 0.938271605 | 1 | 0.88372093 |
| TNFRSF8 AND NOT-TMEM144 | 0.933333333 | 0.93333333 | 0.933333333 | GREM1 AND PLA2G10 | 0.925 | 1 | 0.860465116 |
| TNFRSF8 AND NOT-ADGRA3 | 0.933333333 | 0.93333333 | 0.933333333 | GREM1 AND SLC41A2 | 0.9 | 0.972972973 | 0.837209302 |
| TNFRSF8 AND NOT-TAS2R7 | 0.933333333 | 0.93333333 | 0.933333333 | GREM1 AND FAR1 | 0.913580247 | 0.973684211 | 0.860465116 |
| TNFRSF8 AND NOT-ADCY10 | 0.933333333 | 0.93333333 | 0.933333333 | GREM1 AND SLC12A8 | 0.938271605 | 1 | 0.88372093 |
| TNFRSF8 AND NOT-LTB4R | 0.928571429 | 1 | 0.866666667 | GREM1 AND MFSD9 | 0.915662651 | 0.95 | 0.88372093 |
| TNFRSF8 AND NOT-RYR3 | 0.933333333 | 0.93333333 | 0.933333333 | GREM1 AND TMEM87B | 0.911392405 | 1 | 0.837209302 |
| TNFRSF8 AND NOT-SLAMF9 | 0.933333333 | 0.93333333 | 0.933333333 | GREM1 AND SLC43A1 | 0.913580247 | 0.973684211 | 0.860465116 |
| TNFRSF8 AND NOT-OR7C1 | 0.933333333 | 0.93333333 | 0.933333333 | GREM1 AND PAQR8 | 0.911392405 | 1 | 0.837209302 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-VAMP2 | 0.933333333 | 0.93333333 | 0.933333333 | GREM1 AND PPAP2C | 0.926829268 | 0.974358974 | 0.88372093 |
| TNFRSF8 AND NOT-RNASE7 | 0.933333333 | 0.93333333 | 0.933333333 | GREM1 AND NOT-PPAP2B | 0.902439024 | 0.948717949 | 0.860465116 |
| TNFRSF8 AND NOT-SMCO3 | 0.933333333 | 0.93333333 | 0.933333333 | GREM1 AND DGAT1 | 0.938271605 | 1 | 0.88372093 |
| TNFRSF8 AND NOT-ABCG8 | 0.933333333 | 0.93333333 | 0.933333333 | GREM1 AND CD164 | 0.911392405 | 1 | 0.837209302 |
| TNFRSF8 AND NOT-SLC28A2 | 0.933333333 | 0.93333333 | 0.933333333 | GREM1 AND TNFRSF14 | 0.938271605 | 1 | 0.88372093 |
| TNFRSF8 AND NOT-TMEM239 | 0.933333333 | 0.93333333 | 0.933333333 | GREM1 AND TNFRSF10B | 0.915662651 | 0.95 | 0.88372093 |
| TNFRSF8 AND NOT-C19orf18 | 0.933333333 | 0.93333333 | 0.933333333 | GREM1 AND GPRC5A | 0.926829268 | 0.974358974 | 0.88372093 |
| TNFRSF8 AND NOT-ABCB4 | 0.933333333 | 0.93333333 | 0.933333333 | GREM1 AND MCU | 0.911392405 | 1 | 0.837209302 |
| TNFRSF8 AND NOT-FAM69C | 0.933333333 | 0.93333333 | 0.933333333 | GREM1 AND SLC7A7 | 0.925 | 1 | 0.860465116 |
| TNFRSF8 AND NOT-100132596? | 0.933333333 | 0.93333333 | 0.933333333 | GREM1 AND CLDN12 | 0.938271605 | 1 | 0.88372093 |
| TNFRSF8 AND NOT-ABCB11 | 0.933333333 | 0.93333333 | 0.933333333 | GREM1 AND SYNGR2 | 0.938271605 | 1 | 0.88372093 |
| TNFRSF8 AND NOT-KCNA1 | 0.933333333 | 0.93333333 | 0.933333333 | GREM1 AND MARVELD3 | 0.925 | 1 | 0.860465116 |
| TNFRSF8 AND NOT-CISD2 | 0.933333333 | 0.93333333 | 0.933333333 | GREM1 AND CRB3 | 0.904761905 | 0.926829268 | 0.88372093 |
| TNFRSF8 AND NOT-CACNA1D | 0.933333333 | 0.93333333 | 0.933333333 | GREM1 AND GCNT3 | 0.904761905 | 0.926829268 | 0.88372093 |
| TNFRSF8 AND NOT-MXRA7 | 0.933333333 | 0.93333333 | 0.933333333 | GREM1 AND CD7 | 0.904761905 | 0.926829268 | 0.88372093 |
| TNFRSF8 AND NOT-SUMF2 | 0.933333333 | 0.93333333 | 0.933333333 | GREM1 AND CD27 | 0.913580247 | 0.973684211 | 0.860465116 |
| TNFRSF8 AND NOT-BTN2A1 | 0.933333333 | 0.93333333 | 0.933333333 | GREM1 AND PIGS | 0.915662651 | 0.95 | 0.88372093 |
| TNFRSF8 AND NOT-ABCD4 | 0.933333333 | 0.93333333 | 0.933333333 | GREM1 AND EPSTI1 | 0.925 | 1 | 0.860465116 |
| TNFRSF8 AND NOT-GDPD5 | 0.933333333 | 0.93333333 | 0.933333333 | GREM1 AND CD86 | 0.904761905 | 0.926829268 | 0.88372093 |
| TNFRSF8 AND NOT-SLC35E2 | 0.933333333 | 0.93333333 | 0.933333333 | GREM1 AND ENTPD6 | 0.938271605 | 1 | 0.88372093 |
| TNFRSF8 AND NOT-HRH2 | 0.933333333 | 0.93333333 | 0.933333333 | GREM1 AND ENTPD4 | 0.938271605 | 1 | 0.88372093 |
| TNFRSF8 AND NOT-ITGB3 | 0.928571429 | 1 | 0.866666667 | GREM1 AND MLEC | 0.925 | 1 | 0.860465116 |
| TNFRSF8 AND NOT-FLRT1 | 0.928571429 | 1 | 0.866666667 | GREM1 AND ADGRE5 | 0.904761905 | 0.926829268 | 0.88372093 |
| TNFRSF8 AND NOT-MSLN | 0.933333333 | 0.93333333 | 0.933333333 | GREM1 AND PIEZO1 | 0.904761905 | 0.926829268 | 0.88372093 |
| TNFRSF8 AND NOT-NAALAD2 | 0.933333333 | 0.93333333 | 0.933333333 | GREM1 AND EFCAB14 | 0.915662651 | 0.95 | 0.88372093 |
| TNFRSF8 AND NOT-C5AR2 | 0.933333333 | 0.93333333 | 0.933333333 | GREM1 AND AREL1 | 0.911392405 | 1 | 0.837209302 |
| TNFRSF8 AND NOT-TMEM55B | 0.928571429 | 1 | 0.866666667 | CYP2S1 AND NOT-SCNN1B | 0.954545455 | 0.933333333 | 0.976744186 |
| TNFRSF8 AND NOT-SLC16A6 | 0.933333333 | 0.93333333 | 0.933333333 | CYP2S1 AND NOT-CWH43 | 0.909090909 | 0.888888889 | 0.930232558 |
| TNFRSF8 AND NOT-HRH4 | 0.965517241 | 1 | 0.933333333 | MUC13 AND NOT-SLC30A10 | 0.942528736 | 0.931818182 | 0.953488372 |
| TNFRSF8 AND NOT-MFSD8 | 0.933333333 | 0.93333333 | 0.933333333 | MUC13 AND NOT-SCNN1B | 0.976744186 | 0.976744186 | 0.976744186 |
| TNFRSF8 AND NOT-LST1 | 0.965517241 | 1 | 0.933333333 | MUC13 AND NOT-CWH43 | 0.930232558 | 0.930232558 | 0.930232558 |
| TNFRSF8 AND NOT-SPPL2B | 0.933333333 | 0.93333333 | 0.933333333 | MUC13 AND APOLD1 | 0.911111111 | 0.872340426 | 0.953488372 |
| TNFRSF8 AND NOT-KCNK10 | 0.933333333 | 0.93333333 | 0.933333333 | MUC13 AND NOT-CLDN8 | 0.952380952 | 0.975609756 | 0.930232558 |
| TNFRSF8 AND NOT-ATP1A4 | 0.933333333 | 0.93333333 | 0.933333333 | SMAGP AND NOT-SCNN1B | 0.903225806 | 0.84 | 0.976744186 |
| TNFRSF8 AND NOT-SEZ6L | 0.928571429 | 1 | 0.866666667 | TMC5 AND NOT-SCNN1B | 0.904761905 | 0.926829268 | 0.88372093 |
| TNFRSF8 AND NOT-KCNA4 | 0.933333333 | 0.93333333 | 0.933333333 | BIK AND NOT-CLDN8 | 0.917647059 | 0.928571429 | 0.906976744 |
| TNFRSF8 AND NOT-NCR1 | 0.928571429 | 1 | 0.866666667 | Lymphoma, Large B-Cell, Diffuse (B-Cell Diffuse) | | | |
| TNFRSF8 AND NOT-SSTR4 | 0.965517241 | 1 | 0.933333333 | PLA2G2D AND NOT-GABRD | 0.916666667 | 0.942857143 | 0.891891892 |
| TNFRSF8 AND NOT-CYP2A6 | 0.928571429 | 1 | 0.866666667 | PLA2G2D AND NOT-BMPR1B | 0.931506849 | 0.944444444 | 0.918918919 |
| TNFRSF8 AND NOT-AGPAT9 | 0.965517241 | 1 | 0.933333333 | PLA2G2D AND NOT-CRYGC | 0.906666667 | 0.894736842 | 0.918918919 |
| TNFRSF8 AND NOT-SIRPA | 0.965517241 | 1 | 0.933333333 | PLA2G2D AND NOT-HCN4 | 0.906666667 | 0.894736842 | 0.918918919 |
| TNFRSF8 AND NOT-GCNT1 | 0.928571429 | 1 | 0.866666667 | PLA2G2D AND NOT-SLC17A4 | 0.918918919 | 0.918918919 | 0.918918919 |
| TNFRSF8 AND NOT-DNAJC4 | 0.965517241 | 1 | 0.933333333 | PLA2G2D AND NOT-CDH7 | 0.918918919 | 0.918918919 | 0.918918919 |
| TNFRSF8 AND NOT-CLEC4E | 0.965517241 | 1 | 0.933333333 | PLA2G2D AND NOT-CDH12 | 0.906666667 | 0.894736842 | 0.918918919 |
| TNFRSF8 AND NOT-USP30 | 0.928571429 | 1 | 0.866666667 | PLA2G2D AND NOT-CLEC3A | 0.918918919 | 0.918918919 | 0.918918919 |
| TNFRSF8 AND NOT-ADGRD1 | 0.965517241 | 1 | 0.933333333 | PLA2G2D AND NOT-PDZK1IP1 | 0.942857143 | 1 | 0.891891892 |
| TNFRSF8 AND NOT-XXYLT1 | 0.965517241 | 1 | 0.933333333 | PLA2G2D AND NOT-TENM1 | 0.916666667 | 0.942857143 | 0.891891892 |
| TNFRSF8 AND NOT-KLRC3 | 0.965517241 | 1 | 0.933333333 | PLA2G2D AND NOT-DHRS2 | 0.906666667 | 0.894736842 | 0.918918919 |
| TNFRSF8 AND NOT-SNX13 | 0.965517241 | 1 | 0.933333333 | PLA2G2D AND NOT-ANGPTL7 | 0.918918919 | 0.918918919 | 0.918918919 |
| TNFRSF8 AND NOT-ABCB1 | 0.928571429 | 1 | 0.866666667 | PLA2G2D AND NOT-GPA33 | 0.904109589 | 0.916666667 | 0.891891892 |
| TNFRSF8 AND NOT-SIGLEC9 | 0.928571429 | 1 | 0.866666667 | PLA2G2D AND NOT-MSLN | 0.918918919 | 0.918918919 | 0.918918919 |
| TNFRSF8 AND NOT-CCR2 | 0.928571429 | 1 | 0.866666667 | PLA2G2D AND NOT-NMUR1 | 0.929577465 | 0.970588235 | 0.891891892 |
| TNFRSF8 AND NOT-ORAI3 | 0.965517241 | 1 | 0.933333333 | PLA2G2D AND NOT-ABCA8 | 0.944444444 | 0.971428571 | 0.918918919 |
| TNFRSF8 AND NOT-TMCC2 | 0.965517241 | 1 | 0.933333333 | PLA2G2D AND NOT-CACNG2 | 0.931506849 | 0.944444444 | 0.918918919 |
| TNFRSF8 AND NOT-CLCN3 | 0.965517241 | 1 | 0.933333333 | PLA2G2D AND NOT-WFDC2 | 0.904109589 | 0.916666667 | 0.891891892 |
| TNFRSF8 AND NOT-SLC36A1 | 0.965517241 | 1 | 0.933333333 | PLA2G2D AND NOT-LRRN2 | 0.929577465 | 0.970588235 | 0.891891892 |
| TNFRSF8 AND NOT-FCGR2B | 0.965517241 | 1 | 0.933333333 | PLA2G2D AND NOT-SEMA6B | 0.914285714 | 0.96969697 | 0.864864865 |
| TNFRSF8 AND NOT-CD244 | 0.965517241 | 1 | 0.933333333 | PLA2G2D AND NOT-ST6GALNAC2 | 0.914285714 | 0.96969697 | 0.864864865 |
| TNFRSF8 AND NOT-CUX1 | 0.965517241 | 1 | 0.933333333 | PLA2G2D AND NOT-CERS1 | 0.906666667 | 0.894736842 | 0.918918919 |
| TNFRSF8 AND NOT-MAN2A2 | 0.965517241 | 1 | 0.933333333 | PLA2G2D AND NOT-NRG3 | 0.904109589 | 0.916666667 | 0.891891892 |
| TNFRSF8 AND NOT-CKLF | 0.965517241 | 1 | 0.933333333 | PLA2G2D AND NOT-CCR9 | 0.942857143 | 1 | 0.891891892 |
| TNFRSF8 AND NOT-LFNG | 0.965517241 | 1 | 0.933333333 | PLA2G2D AND NOT-FAXDC2 | 0.916666667 | 0.942857143 | 0.891891892 |
| TNFRSF8 AND NOT-CLEC12A | 0.965517241 | 1 | 0.933333333 | PLA2G2D AND NOT-SLC26A1 | 0.931506849 | 0.944444444 | 0.918918919 |
| TNFRSF8 AND NOT-CYSLTR1 | 0.965517241 | 1 | 0.933333333 | PLA2G2D AND NOT-NAT2 | 0.914285714 | 0.96969697 | 0.864864865 |
| TNFRSF8 AND NOT-S1PR1 | 0.928571429 | 1 | 0.866666667 | PLA2G2D AND NOT-SLC7A9 | 0.944444444 | 0.971428571 | 0.918918919 |
| TNFRSF8 AND NOT-CLEC10A | 0.928571429 | 1 | 0.866666667 | PLA2G2D AND NOT-GALNT5 | 0.904109589 | 0.916666667 | 0.891891892 |
| TNFRSF8 AND NOT-CKAP4 | 0.965517241 | 1 | 0.933333333 | PLA2G2D AND NOT-MRAP2 | 0.942857143 | 1 | 0.891891892 |
| TNFRSF8 AND NOT-ADCY5 | 0.928571429 | 1 | 0.866666667 | PLA2G2D AND NOT-SCN11A | 0.901408451 | 0.941176471 | 0.864864865 |
| TNFRSF8 AND NOT-VSTM1 | 0.965517241 | 1 | 0.933333333 | PLA2G2D AND NOT-CHRM2 | 0.906666667 | 0.894736842 | 0.918918919 |
| TNFRSF8 AND NOT-UPK3A | 0.965517241 | 1 | 0.933333333 | PLA2G2D AND NOT-PTH2 | 0.906666667 | 0.894736842 | 0.918918919 |
| TNFRSF8 AND NOT-SIRPB2 | 0.965517241 | 1 | 0.933333333 | PLA2G2D AND NOT-SCRG1 | 0.906666667 | 0.894736842 | 0.918918919 |
| TNFRSF8 AND NOT-P2RX7 | 0.928571429 | 1 | 0.866666667 | PLA2G2D AND NOT-MFSD3 | 0.904109589 | 0.916666667 | 0.891891892 |
| TNFRSF8 AND NOT-RHO | 0.965517241 | 1 | 0.933333333 | PLA2G2D AND NOT-SIGLEC11 | 0.904109589 | 0.916666667 | 0.891891892 |
| TNFRSF8 AND NOT-BPI | 0.965517241 | 1 | 0.933333333 | PLA2G2D AND NOT-CHRNE | 0.906666667 | 0.894736842 | 0.918918919 |
| TNFRSF8 AND NOT-SLC39A7 | 0.965517241 | 1 | 0.933333333 | PLA2G2D AND NOT-CSMD3 | 0.918918919 | 0.918918919 | 0.918918919 |
| TNFRSF8 AND NOT-TMEM175 | 0.965517241 | 1 | 0.933333333 | PLA2G2D AND NOT-GALNT13 | 0.918918919 | 0.918918919 | 0.918918919 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-SEMA4D | 0.965517241 | 1 | 0.933333333 | PLA2G2D AND NOT-GRIN3B | 0.906666667 | 0.894736842 | 0.918918919 |
| TNFRSF8 AND NOT-ARSD | 0.965517241 | 1 | 0.933333333 | PLA2G2D AND NOT-SLC16A10 | 0.916666667 | 0.942857143 | 0.891891892 |
| TNFRSF8 AND NOT-IL10RA | 0.965517241 | 1 | 0.933333333 | PLA2G2D AND NOT-CLRN3 | 0.906666667 | 0.894736842 | 0.918918919 |
| TNFRSF8 AND NOT-MARCH9 | 0.965517241 | 1 | 0.933333333 | PLA2G2D AND NOT-NXPE1 | 0.918918919 | 0.918918919 | 0.918918919 |
| TNFRSF8 AND NOT-KCNE3 | 0.965517241 | 1 | 0.933333333 | PLA2G2D AND NOT-LRIG3 | 0.914285714 | 0.96969697 | 0.864864865 |
| TNFRSF8 AND NOT-LPAR5 | 0.965517241 | 1 | 0.933333333 | PLA2G2D AND NOT-TMEM132D | 0.916666667 | 0.942857143 | 0.891891892 |
| TNFRSF8 AND NOT-NXPE3 | 0.965517241 | 1 | 0.933333333 | PLA2G2D AND NOT-GPHB5 | 0.906666667 | 0.894736842 | 0.918918919 |
| TNFRSF8 AND NOT-PPBP | 0.965517241 | 1 | 0.933333333 | PLA2G2D AND NOT-ABCC2 | 0.904109589 | 0.916666667 | 0.891891892 |
| TNFRSF8 AND NOT-MFSD2A | 0.965517241 | 1 | 0.933333333 | PLA2G2D AND NOT-WFIKKN2 | 0.944444444 | 0.971428571 | 0.918918919 |
| TNFRSF8 AND NOT-LPGAT1 | 0.965517241 | 1 | 0.933333333 | PLA2G2D AND NOT-SEZ6 | 0.929577465 | 0.970588235 | 0.891891892 |
| TNFRSF8 AND NOT-CHST11 | 0.965517241 | 1 | 0.933333333 | PLA2G2D AND NOT-CNGA1 | 0.927536232 | 1 | 0.864864865 |
| TNFRSF8 AND NOT-DRAM2 | 0.965517241 | 1 | 0.933333333 | PLA2G2D AND NOT-CYP4F22 | 0.918918919 | 0.918918919 | 0.918918919 |
| TNFRSF8 AND NOT-ATG9A | 0.965517241 | 1 | 0.933333333 | PLA2G2D AND NOT-SLC44A3 | 0.904109589 | 0.916666667 | 0.891891892 |
| TNFRSF8 AND NOT-KLRC4 | 0.965517241 | 1 | 0.933333333 | PLA2G2D AND NOT-CNTN1 | 0.911764706 | 1 | 0.837837838 |
| TNFRSF8 AND NOT-FMO5 | 0.928571429 | 1 | 0.866666667 | PLA2G2D AND NOT-DCST2 | 0.914285714 | 0.96969697 | 0.864864865 |
| TNFRSF8 AND NOT-SLC5A11 | 0.928571429 | 1 | 0.866666667 | PLA2G2D AND NOT-KLHDC7A | 0.914285714 | 0.96969697 | 0.864864865 |
| TNFRSF8 AND NOT-SSR1 | 0.965517241 | 1 | 0.933333333 | PLA2G2D AND NOT-FAM3D | 0.906666667 | 0.894736842 | 0.918918919 |
| TNFRSF8 AND NOT-SLC25A20 | 0.965517241 | 1 | 0.933333333 | PLA2G2D AND NOT-IL17RE | 0.929577465 | 0.970588235 | 0.891891892 |
| TNFRSF8 AND NOT-DPEP2 | 0.965517241 | 1 | 0.933333333 | PLA2G2D AND NOT-LSMEM2 | 0.927536232 | 1 | 0.864864865 |
| TNFRSF8 AND NOT-SLC22A15 | 0.928571429 | 1 | 0.866666667 | PLA2G2D AND NOT-ADORA1 | 0.929577465 | 0.970588235 | 0.891891892 |
| TNFRSF8 AND NOT-CLEC4D | 0.965517241 | 1 | 0.933333333 | PLA2G2D AND NOT-RAET1E | 0.918918919 | 0.918918919 | 0.918918919 |
| TNFRSF8 AND NOT-SLC16A7 | 0.965517241 | 1 | 0.933333333 | PLA2G2D AND NOT-WBSCR28 | 0.916666667 | 0.942857143 | 0.891891892 |
| TNFRSF8 AND NOT-MBOAT1 | 0.965517241 | 1 | 0.933333333 | PLA2G2D AND NOT-TMEM139 | 0.931506849 | 0.944444444 | 0.918918919 |
| TNFRSF8 AND NOT-NFAM1 | 0.965517241 | 1 | 0.933333333 | PLA2G2D AND NOT-CLDN3 | 0.904109589 | 0.916666667 | 0.891891892 |
| TNFRSF8 AND NOT-TM6SF1 | 0.965517241 | 1 | 0.933333333 | PLA2G2D AND NOT-TRPM6 | 0.904109589 | 0.916666667 | 0.891891892 |
| TNFRSF8 AND NOT-CYBB | 0.928571429 | 1 | 0.866666667 | PLA2G2D AND NOT-CST11 | 0.901408451 | 0.941176471 | 0.864864865 |
| TNFRSF8 AND NOT-PTGDR2 | 0.965517241 | 1 | 0.933333333 | PLA2G2D AND NOT-CRY2 | 0.914285714 | 0.96969697 | 0.864864865 |
| TNFRSF8 AND NOT-FUT4 | 0.928571429 | 1 | 0.866666667 | PLA2G2D AND NOT-SYT9 | 0.914285714 | 0.96969697 | 0.864864865 |
| TNFRSF8 AND NOT-ALDH6A1 | 0.928571429 | 1 | 0.866666667 | PLA2G2D AND NOT-PRIMA1 | 0.916666667 | 0.942857143 | 0.891891892 |
| TNFRSF8 AND NOT-CECR6 | 0.965517241 | 1 | 0.933333333 | PLA2G2D AND NOT-CSPG4 | 0.901408451 | 0.941176471 | 0.864864865 |
| TNFRSF8 AND NOT-RHBDF2 | 0.928571429 | 1 | 0.866666667 | PLA2G2D AND NOT-MGAT5B | 0.918918919 | 0.918918919 | 0.918918919 |
| TNFRSF8 AND NOT-BAX | 0.965517241 | 1 | 0.933333333 | PLA2G2D AND NOT-CD300LG | 0.904109589 | 0.916666667 | 0.891891892 |
| TNFRSF8 AND NOT-MYADM | 0.965517241 | 1 | 0.933333333 | PLA2G2D AND NOT-TMEM190 | 0.929577465 | 0.970588235 | 0.891891892 |
| TNFRSF8 AND NOT-DNAJB12 | 0.928571429 | 1 | 0.866666667 | PLA2G2D AND NOT-ADRA1B | 0.931506849 | 0.944444444 | 0.918918919 |
| TNFRSF8 AND NOT-LRP3 | 0.965517241 | 1 | 0.933333333 | PLA2G2D AND NOT-ATP8B3 | 0.918918919 | 0.918918919 | 0.918918919 |
| TNFRSF8 AND NOT-SLC46A2 | 0.928571429 | 1 | 0.866666667 | PLA2G2D AND NOT-SYT6 | 0.904109589 | 0.916666667 | 0.891891892 |
| TNFRSF8 AND NOT-GPR82 | 0.965517241 | 1 | 0.933333333 | PLA2G2D AND NOT-HFE2 | 0.901408451 | 0.941176471 | 0.864864865 |
| TNFRSF8 AND NOT-NOTCH2 | 0.965517241 | 1 | 0.933333333 | PLA2G2D AND NOT-PROM2 | 0.904109589 | 0.916666667 | 0.891891892 |
| TNFRSF8 AND NOT-TPST2 | 0.928571429 | 1 | 0.866666667 | PLA2G2D AND NOT-PLB1 | 0.916666667 | 0.942857143 | 0.891891892 |
| TNFRSF8 AND NOT-SMPD3 | 0.965517241 | 1 | 0.933333333 | PLA2G2D AND NOT-SLC38A11 | 0.931506849 | 0.944444444 | 0.918918919 |
| TNFRSF8 AND NOT-TMEM129 | 0.965517241 | 1 | 0.933333333 | PLA2G2D AND NOT-SLC2A12 | 0.901408451 | 0.941176471 | 0.864864865 |
| TNFRSF8 AND NOT-CEACAM4 | 0.965517241 | 1 | 0.933333333 | PLA2G2D AND NOT-CYP2A7 | 0.918918919 | 0.918918919 | 0.918918919 |
| TNFRSF8 AND NOT-ANPEP | 0.965517241 | 1 | 0.933333333 | PLA2G2D AND NOT-TMEM213 | 0.901408451 | 0.941176471 | 0.864864865 |
| TNFRSF8 AND NOT-BTN3A3 | 0.928571429 | 1 | 0.866666667 | PLA2G2D AND NOT-CYP2E1 | 0.944444444 | 0.971428571 | 0.918918919 |
| TNFRSF8 AND NOT-KLRB1 | 0.928571429 | 1 | 0.866666667 | PLA2G2D AND NOT-PRUNE2 | 0.901408451 | 0.941176471 | 0.864864865 |
| TNFRSF8 AND NOT-TGFBR3 | 0.965517241 | 1 | 0.933333333 | PLA2G2D AND NOT-SLC5A8 | 0.929577465 | 0.970588235 | 0.891891892 |
| TNFRSF8 AND NOT-SLC35B3 | 0.965517241 | 1 | 0.933333333 | PLA2G2D AND NOT-DBH | 0.931506849 | 0.944444444 | 0.918918919 |
| TNFRSF8 AND NOT-SUSD1 | 0.928571429 | 1 | 0.866666667 | PLA2G2D AND NOT-SLC16A11 | 0.931506849 | 0.944444444 | 0.918918919 |
| TNFRSF8 AND NOT-EXTL3 | 0.965517241 | 1 | 0.933333333 | PLA2G2D AND NOT-SPPL2C | 0.944444444 | 0.971428571 | 0.918918919 |
| TNFRSF8 AND NOT-EPHA4 | 0.965517241 | 1 | 0.933333333 | PLA2G2D AND NOT-CABP7 | 0.906666667 | 0.894736842 | 0.918918919 |
| TNFRSF8 AND NOT-CTAGE5 | 0.965517241 | 1 | 0.933333333 | PLA2G2D AND NOT-CLEC4F | 0.916666667 | 0.942857143 | 0.891891892 |
| TNFRSF8 AND NOT-TLR2 | 0.965517241 | 1 | 0.933333333 | PLA2G2D AND NOT-SLC30A8 | 0.906666667 | 0.894736842 | 0.918918919 |
| TNFRSF8 AND NOT-PLXDC2 | 0.928571429 | 1 | 0.866666667 | PLA2G2D AND NOT-KCNG3 | 0.906666667 | 0.894736842 | 0.918918919 |
| TNFRSF8 AND NOT-KCNA10 | 0.965517241 | 1 | 0.933333333 | PLA2G2D AND NOT-PTCRA | 0.906666667 | 0.894736842 | 0.918918919 |
| TNFRSF8 AND NOT-SFT2D3 | 0.965517241 | 1 | 0.933333333 | PLA2G2D AND NOT-AGER | 0.906666667 | 0.894736842 | 0.918918919 |
| TNFRSF8 AND NOT-XYLT1 | 0.965517241 | 1 | 0.933333333 | PLA2G2D AND NOT-DPP6 | 0.916666667 | 0.942857143 | 0.891891892 |
| TNFRSF8 AND NOT-CMTM5 | 0.965517241 | 1 | 0.933333333 | PLA2G2D AND NOT-DRD4 | 0.914285714 | 0.96969697 | 0.864864865 |
| TNFRSF8 AND NOT-TNFSF8 | 0.928571429 | 1 | 0.866666667 | PLA2G2D AND NOT-EGFR | 0.929577465 | 0.970588235 | 0.891891892 |
| TNFRSF8 AND NOT-TLR5 | 0.965517241 | 1 | 0.933333333 | PLA2G2D AND NOT-VSTM4 | 0.914285714 | 0.96969697 | 0.864864865 |
| TNFRSF8 AND NOT-ICAM2 | 0.965517241 | 1 | 0.933333333 | PLA2G2D AND NOT-CADM4 | 0.906666667 | 0.894736842 | 0.918918919 |
| TNFRSF8 AND NOT-P2RY14 | 0.928571429 | 1 | 0.866666667 | PLA2G2D AND NOT-SLC5A9 | 0.931506849 | 0.944444444 | 0.918918919 |
| TNFRSF8 AND NOT-CLCN5 | 0.965517241 | 1 | 0.933333333 | PLA2G2D AND NOT-SPNS3 | 0.931506849 | 0.944444444 | 0.918918919 |
| TNFRSF8 AND NOT-COQ2 | 0.965517241 | 1 | 0.933333333 | PLA2G2D AND NOT-ANO5 | 0.931506849 | 0.944444444 | 0.918918919 |
| TNFRSF8 AND NOT-GRM2 | 0.928571429 | 1 | 0.866666667 | PLA2G2D AND NOT-EPHA5 | 0.914285714 | 0.96969697 | 0.864864865 |
| TNFRSF8 AND NOT-MARC1 | 0.965517241 | 1 | 0.933333333 | PLA2G2D AND NOT-EPHA8 | 0.918918919 | 0.918918919 | 0.918918919 |
| TNFRSF8 AND NOT-FBXL17 | 0.928571429 | 1 | 0.866666667 | PLA2G2D AND NOT-ABCA2 | 0.904109589 | 0.916666667 | 0.891891892 |
| TNFRSF8 AND NOT-SUN2 | 0.965517241 | 1 | 0.933333333 | PLA2G2D AND NOT-EXTL1 | 0.914285714 | 0.96969697 | 0.864864865 |
| TNFRSF8 AND NOT-CAMP | 0.965517241 | 1 | 0.933333333 | PLA2G2D AND NOT-F2RL1 | 0.929577465 | 0.970588235 | 0.891891892 |
| TNFRSF8 AND NOT-NRG1 | 0.965517241 | 1 | 0.933333333 | PLA2G2D AND NOT-LRRC55 | 0.906666667 | 0.894736842 | 0.918918919 |
| TNFRSF8 AND NOT-TMEM242 | 0.965517241 | 1 | 0.933333333 | PLA2G2D AND NOT-FCER1A | 0.929577465 | 0.970588235 | 0.891891892 |
| TNFRSF8 AND NOT-KLRD1 | 0.928571429 | 1 | 0.866666667 | PLA2G2D AND NOT-LRRN4CL | 0.906666667 | 0.894736842 | 0.918918919 |
| TNFRSF8 AND NOT-STT3A | 0.928571429 | 1 | 0.866666667 | PLA2G2D AND NOT-SEMA3D | 0.929577465 | 0.970588235 | 0.891891892 |
| TNFRSF8 AND NOT-SFXN5 | 0.965517241 | 1 | 0.933333333 | PLA2G2D AND NOT-FGFR3 | 0.942857143 | 1 | 0.891891892 |
| TNFRSF8 AND NOT-SLC11A1 | 0.965517241 | 1 | 0.933333333 | PLA2G2D AND NOT-PLA2R1 | 0.914285714 | 0.96969697 | 0.864864865 |
| TNFRSF8 AND NOT-ACPP | 0.965517241 | 1 | 0.933333333 | PLA2G2D AND NOT-ATP10B | 0.916666667 | 0.942857143 | 0.891891892 |
| TNFRSF8 AND NOT-PRR7 | 0.965517241 | 1 | 0.933333333 | PLA2G2D AND NOT-STAB1 | 0.901408451 | 0.941176471 | 0.864864865 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-CD1D | 0.965517241 | 1 | 0.933333333 | PLA2G2D AND NOT-FLT4 | 0.911764706 | 1 | 0.837837838 |
| TNFRSF8 AND NOT-TLR1 | 0.928571429 | 1 | 0.866666667 | PLA2G2D AND NOT-WSCD1 | 0.944444444 | 0.971428571 | 0.918918919 |
| TNFRSF8 AND NOT-HGSNAT | 0.965517241 | 1 | 0.933333333 | PLA2G2D AND NOT-KCNH4 | 0.906666667 | 0.894736842 | 0.918918919 |
| TNFRSF8 AND NOT-MS4A2 | 0.928571429 | 1 | 0.866666667 | PLA2G2D AND NOT-CRB1 | 0.904109589 | 0.916666667 | 0.891891892 |
| TNFRSF8 AND NOT-LIM2 | 0.965517241 | 1 | 0.933333333 | PLA2G2D AND NOT-NPTXR | 0.914285714 | 0.96969697 | 0.864864865 |
| TNFRSF8 AND NOT-HCST | 0.965517241 | 1 | 0.933333333 | PLA2G2D AND NOT-SEZ6L | 0.931506849 | 0.944444444 | 0.918918919 |
| TNFRSF8 AND NOT-PTGER2 | 0.965517241 | 1 | 0.933333333 | PLA2G2D AND NOT-LPAR3 | 0.906666667 | 0.894736842 | 0.918918919 |
| TNFRSF8 AND NOT-ST3GAL3 | 0.965517241 | 1 | 0.933333333 | PLA2G2D AND NOT-FLRT3 | 0.914285714 | 0.96969697 | 0.864864865 |
| TNFRSF8 AND NOT-FKRP | 0.928571429 | 1 | 0.866666667 | PLA2G2D AND NOT-FLRT1 | 0.918918919 | 0.918918919 | 0.918918919 |
| TNFRSF8 AND NOT-TMEM154 | 0.965517241 | 1 | 0.933333333 | PLA2G2D AND NOT-FUT1 | 0.911764706 | 1 | 0.837837838 |
| TNFRSF8 AND NOT-CHIC2 | 0.965517241 | 1 | 0.933333333 | PLA2G2D AND NOT-FUT2 | 0.904109589 | 0.916666667 | 0.891891892 |
| TNFRSF8 AND NOT-FAM73B | 0.928571429 | 1 | 0.866666667 | PLA2G2D AND NOT-FUT3 | 0.904109589 | 0.916666667 | 0.891891892 |
| TNFRSF8 AND NOT-EPHA8 | 0.928571429 | 1 | 0.866666667 | PLA2G2D AND NOT-FUT6 | 0.906666667 | 0.894736842 | 0.918918919 |
| TNFRSF8 AND NOT-PCDH9 | 0.965517241 | 1 | 0.933333333 | PLA2G2D AND NOT-C19orf26 | 0.931506849 | 0.944444444 | 0.918918919 |
| TNFRSF8 AND NOT-SLC4A4 | 0.965517241 | 1 | 0.933333333 | PLA2G2D AND NOT-MYADML2 | 0.914285714 | 0.96969697 | 0.864864865 |
| TNFRSF8 AND NOT-SLC31A2 | 0.965517241 | 1 | 0.933333333 | PLA2G2D AND NOT-GABRD | 0.916666667 | 0.942857143 | 0.891891892 |
| TNFRSF8 AND NOT-TMEM170B | 0.965517241 | 1 | 0.933333333 | PLA2G2D AND NOT-FAM19A5 | 0.904109589 | 0.916666667 | 0.891891892 |
| TNFRSF8 AND NOT-LMTK2 | 0.965517241 | 1 | 0.933333333 | PLA2G2D AND NOT-KLK5 | 0.901408451 | 0.941176471 | 0.864864865 |
| TNFRSF8 AND NOT-BST1 | 0.965517241 | 1 | 0.933333333 | PLA2G2D AND NOT-MRGPRX1 | 0.914285714 | 0.96969697 | 0.864864865 |
| TNFRSF8 AND NOT-OSTM1 | 0.965517241 | 1 | 0.933333333 | PLA2G2D AND NOT-CYP4X1 | 0.931506849 | 0.944444444 | 0.918918919 |
| TNFRSF8 AND NOT-STX10 | 0.965517241 | 1 | 0.933333333 | PLA2G2D AND NOT-PCDHB5 | 0.918918919 | 0.918918919 | 0.918918919 |
| TNFRSF8 AND NOT-UGGT1 | 0.965517241 | 1 | 0.933333333 | PLA2G2D AND NOT-OR1A2 | 0.906666667 | 0.894736842 | 0.918918919 |
| TNFRSF8 AND NOT-PTGDR | 0.965517241 | 1 | 0.933333333 | PLA2G2D AND NOT-OR2L2 | 0.911764706 | 1 | 0.837837838 |
| TNFRSF8 AND NOT-LINGO2 | 0.928571429 | 1 | 0.866666667 | PLA2G2D AND NOT-GCGR | 0.906666667 | 0.894736842 | 0.918918919 |
| TNFRSF8 AND NOT-MCTP1 | 0.965517241 | 1 | 0.933333333 | PLA2G2D AND NOT-OR10H2 | 0.931506849 | 0.944444444 | 0.918918919 |
| TNFRSF8 AND NOT-SLC2A6 | 0.965517241 | 1 | 0.933333333 | PLA2G2D AND NOT-GDNF | 0.916666667 | 0.942857143 | 0.891891892 |
| TNFRSF8 AND NOT-NTSR2 | 0.965517241 | 1 | 0.933333333 | PLA2G2D AND NOT-ADGRF1 | 0.916666667 | 0.942857143 | 0.891891892 |
| TNFRSF8 AND NOT-ZACN | 0.928571429 | 1 | 0.866666667 | PLA2G2D AND NOT-GHRHR | 0.918918919 | 0.918918919 | 0.918918919 |
| TNFRSF8 AND NOT-VNN2 | 0.965517241 | 1 | 0.933333333 | PLA2G2D AND NOT-GIPR | 0.929577465 | 0.970588235 | 0.891891892 |
| TNFRSF8 AND NOT-MCHR2 | 0.965517241 | 1 | 0.933333333 | PLA2G2D AND NOT-AMHR2 | 0.929577465 | 0.970588235 | 0.891891892 |
| TNFRSF8 AND NOT-IFNAR1 | 0.965517241 | 1 | 0.933333333 | PLA2G2D AND NOT-GJA3 | 0.906666667 | 0.894736842 | 0.918918919 |
| TNFRSF8 AND NOT-NAALAD2 | 0.933333333 | 0.933333333 | 0.933333333 | PLA2G2D AND NOT-NSG1 | 0.929577465 | 0.970588235 | 0.891891892 |
| TNFRSF8 AND NOT-NAALADL1 | 0.933333333 | 0.933333333 | 0.933333333 | PLA2G2D AND NOT-GJB5 | 0.906666667 | 0.894736842 | 0.918918919 |
| TNFRSF8 AND NOT-KCNE3 | 0.965517241 | 1 | 0.933333333 | PLA2G2D AND NOT-GPR162 | 0.918918919 | 0.918918919 | 0.918918919 |
| TNFRSF8 AND NOT-TMEM170B | 0.965517241 | 1 | 0.933333333 | PLA2G2D AND NOT-BMP10 | 0.904109589 | 0.916666667 | 0.891891892 |
| TNFRSF8 AND NOT-TMEM221 | 0.933333333 | 0.933333333 | 0.933333333 | PLA2G2D AND NOT-GLP1R | 0.918918919 | 0.918918919 | 0.918918919 |
| TNFRSF8 AND NOT-LRRC70 | 0.933333333 | 0.933333333 | 0.933333333 | PLA2G2D AND NOT-GP2 | 0.906666667 | 0.894736842 | 0.918918919 |
| TNFRSF8 AND NOT-SMIM6 | 0.933333333 | 0.933333333 | 0.933333333 | PLA2G2D AND NOT-GP9 | 0.914285714 | 0.96969697 | 0.864864865 |
| TNFRSF8 AND NOT-NEMP2 | 0.933333333 | 0.933333333 | 0.933333333 | PLA2G2D AND NOT-SLC13A5 | 0.918918919 | 0.918918919 | 0.918918919 |
| TNFRSF8 AND NOT-100132596? | 0.933333333 | 0.933333333 | 0.933333333 | PLA2G2D AND NOT-IZUMO1 | 0.916666667 | 0.942857143 | 0.891891892 |
| TNFRSF8 AND NOT-HCN4 | 0.933333333 | 0.933333333 | 0.933333333 | PLA2G2D AND NOT-GPR20 | 0.931506849 | 0.944444444 | 0.918918919 |
| TNFRSF8 AND NOT-ERVMER34-1 | 0.933333333 | 0.933333333 | 0.933333333 | PLA2G2D AND NOT-GPR22 | 0.906666667 | 0.894736842 | 0.918918919 |
| TNFRSF8 AND NOT-TMEM239 | 0.933333333 | 0.933333333 | 0.933333333 | PLA2G2D AND NOT-GPR25 | 0.906666667 | 0.894736842 | 0.918918919 |
| TNFRSF8 AND NOT-CDH6 | 0.933333333 | 0.933333333 | 0.933333333 | PLA2G2D AND NOT-DNAJC5G | 0.931506849 | 0.944444444 | 0.918918919 |
| TNFRSF8 AND NOT-MRLN | 0.933333333 | 0.933333333 | 0.933333333 | PLA2G2D AND NOT-CDH19 | 0.942857143 | 1 | 0.891891892 |
| TNFRSF8 AND NOT-100507547? | 0.933333333 | 0.933333333 | 0.933333333 | PLA2G2D AND NOT-CYP4V2 | 0.916666667 | 0.942857143 | 0.891891892 |
| TNFRSF8 AND NOT-SLC17A4 | 0.933333333 | 0.933333333 | 0.933333333 | PLA2G2D AND NOT-GPR35 | 0.914285714 | 0.96969697 | 0.864864865 |
| TNFRSF8 AND NOT-ABCB6 | 0.933333333 | 0.933333333 | 0.933333333 | PLA2G2D AND NOT-GPR39 | 0.916666667 | 0.942857143 | 0.891891892 |
| TNFRSF8 AND NOT-CDH7 | 0.933333333 | 0.933333333 | 0.933333333 | PLA2G2D AND NOT-TUSC5 | 0.916666667 | 0.942857143 | 0.891891892 |
| TNFRSF8 AND NOT-SCAMP3 | 0.933333333 | 0.933333333 | 0.933333333 | PLA2G2D AND NOT-GRID2 | 0.918918919 | 0.918918919 | 0.918918919 |
| TNFRSF8 AND NOT-CDH8 | 0.933333333 | 0.933333333 | 0.933333333 | PLA2G2D AND NOT-ABO | 0.931506849 | 0.944444444 | 0.918918919 |
| TNFRSF8 AND NOT-MUC12 | 0.933333333 | 0.933333333 | 0.933333333 | PLA2G2D AND NOT-GRIN2C | 0.916666667 | 0.942857143 | 0.891891892 |
| TNFRSF8 AND NOT-TSPAN32 | 0.928571429 | 1 | 0.866666667 | PLA2G2D AND NOT-GRM3 | 0.904109589 | 0.916666667 | 0.891891892 |
| TNFRSF8 AND NOT-TMEM265 | 0.933333333 | 0.933333333 | 0.933333333 | PLA2G2D AND NOT-ZDHHC1 | 0.944444444 | 0.971428571 | 0.918918919 |
| TNFRSF8 AND NOT-KCNK7 | 0.933333333 | 0.933333333 | 0.933333333 | PLA2G2D AND NOT-GUCA2A | 0.906666667 | 0.894736842 | 0.918918919 |
| TNFRSF8 AND NOT-TSPAN2 | 0.933333333 | 0.933333333 | 0.933333333 | PLA2G2D AND NOT-GYPE | 0.918918919 | 0.918918919 | 0.918918919 |
| TNFRSF8 AND NOT-CDH15 | 0.933333333 | 0.933333333 | 0.933333333 | PLA2G2D AND NOT-GUCY2D | 0.916666667 | 0.942857143 | 0.891891892 |
| TNFRSF8 AND NOT-CLEC3A | 0.933333333 | 0.933333333 | 0.933333333 | PLA2G2D AND NOT-HCRTR1 | 0.957746479 | 1 | 0.918918919 |
| TNFRSF8 AND NOT-CDH16 | 0.933333333 | 0.933333333 | 0.933333333 | PLA2G2D AND NOT-KCNIP3 | 0.929577465 | 0.970588235 | 0.891891892 |
| TNFRSF8 AND NOT-PDZK1IP1 | 0.933333333 | 0.933333333 | 0.933333333 | PLA2G2D AND NOT-HPN | 0.904109589 | 0.916666667 | 0.891891892 |
| TNFRSF8 AND NOT-CHST4 | 0.933333333 | 0.933333333 | 0.933333333 | PLA2G2D AND NOT-HSD17B2 | 0.918918919 | 0.918918919 | 0.918918919 |
| TNFRSF8 AND NOT-101805491? | 0.933333333 | 0.933333333 | 0.933333333 | PLA2G2D AND NOT-ACACB | 0.931506849 | 0.944444444 | 0.918918919 |
| TNFRSF8 AND NOT-LHFPL2 | 0.933333333 | 0.933333333 | 0.933333333 | PLA2G2D AND NOT-HTR1A | 0.904109589 | 0.916666667 | 0.891891892 |
| TNFRSF8 AND NOT-ADAM8 | 0.965517241 | 1 | 0.933333333 | PLA2G2D AND NOT-HTR1B | 0.904109589 | 0.916666667 | 0.891891892 |
| TNFRSF8 AND NOT-MPZL2 | 0.965517241 | 1 | 0.933333333 | PLA2G2D AND NOT-HTR6 | 0.957746479 | 1 | 0.918918919 |
| TNFRSF8 AND NOT-GPA33 | 0.965517241 | 1 | 0.933333333 | PLA2G2D AND NOT-FFAR4 | 0.931506849 | 0.944444444 | 0.918918919 |
| TNFRSF8 AND NOT-COQ7 | 0.933333333 | 0.933333333 | 0.933333333 | PLA2G2D AND NOT-LRRC66 | 0.906666667 | 0.894736842 | 0.918918919 |
| TNFRSF8 AND NOT-MSLN | 0.933333333 | 0.933333333 | 0.933333333 | PLA2G2D AND NOT-MOGAT3 | 0.906666667 | 0.894736842 | 0.918918919 |
| TNFRSF8 AND NOT-KCNMB2 | 0.933333333 | 0.933333333 | 0.933333333 | PLA2G2D AND NOT-TMEM255B | 0.914285714 | 0.96969697 | 0.864864865 |
| TNFRSF8 AND NOT-ABCC4 | 0.933333333 | 0.933333333 | 0.933333333 | PLA2G2D AND NOT-IHH | 0.906666667 | 0.894736842 | 0.918918919 |
| TNFRSF8 AND NOT-IGSF6 | 0.965517241 | 1 | 0.933333333 | PLA2G2D AND NOT-IL13 | 0.906666667 | 0.894736842 | 0.918918919 |
| TNFRSF8 AND NOT-MARCH6 | 0.933333333 | 0.933333333 | 0.933333333 | PLA2G2D AND NOT-AQP2 | 0.906666667 | 0.894736842 | 0.918918919 |
| TNFRSF8 AND NOT-TCIRG1 | 0.933333333 | 0.933333333 | 0.933333333 | PLA2G2D AND NOT-AQP5 | 0.944444444 | 0.971428571 | 0.918918919 |
| TNFRSF8 AND NOT-B3GALT5 | 0.933333333 | 0.933333333 | 0.933333333 | PLA2G2D AND NOT-ITGA2B | 0.931506849 | 0.944444444 | 0.918918919 |
| TNFRSF8 AND NOT-B3GNT3 | 0.933333333 | 0.933333333 | 0.933333333 | PLA2G2D AND NOT-ITGA9 | 0.914285714 | 0.96969697 | 0.864864865 |
| TNFRSF8 AND NOT-TLR6 | 0.965517241 | 1 | 0.933333333 | PLA2G2D AND NOT-ABCC6 | 0.929577465 | 0.970588235 | 0.891891892 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-ABCA7 | 0.965517241 | 1 | 0.933333333 | PLA2G2D AND NOT-KCNA5 | 0.944444444 | 0.971428571 | 0.918918919 |
| TNFRSF8 AND NOT-CACNG3 | 0.933333333 | 0.93333333 | 0.933333333 | PLA2G2D AND NOT-KCNA6 | 0.931506849 | 0.944444444 | 0.918918919 |
| TNFRSF8 AND NOT-CACNG2 | 0.933333333 | 0.93333333 | 0.933333333 | PLA2G2D AND NOT-KCNC2 | 0.904109589 | 0.916666667 | 0.891891892 |
| TNFRSF8 AND NOT-BTN3A3 | 0.928571429 | 1 | 0.866666667 | PLA2G2D AND NOT-TEX38 | 0.901408451 | 0.941176471 | 0.864864865 |
| TNFRSF8 AND NOT-CEPT1 | 0.965517241 | 1 | 0.933333333 | PLA2G2D AND NOT-KCNF1 | 0.929577465 | 0.970588235 | 0.891891892 |
| TNFRSF8 AND NOT-WFDC2 | 0.933333333 | 0.93333333 | 0.933333333 | PLA2G2D AND NOT-ENHO | 0.929577465 | 0.970588235 | 0.891891892 |
| TNFRSF8 AND NOT-CLEC10A | 0.928571429 | 1 | 0.866666667 | PLA2G2D AND NOT-KCNJ3 | 0.918918919 | 0.918918919 | 0.918918919 |
| TNFRSF8 AND NOT-SLC25A17 | 0.933333333 | 0.93333333 | 0.933333333 | PLA2G2D AND NOT-KCNJ4 | 0.929577465 | 0.970588235 | 0.891891892 |
| TNFRSF8 AND NOT-SLC9A6 | 0.965517241 | 1 | 0.933333333 | PLA2G2D AND NOT-KCNJ12 | 0.929577465 | 0.970588235 | 0.891891892 |
| TNFRSF8 AND NOT-SEMA6B | 0.933333333 | 0.93333333 | 0.933333333 | PLA2G2D AND NOT-KCNK3 | 0.931506849 | 0.944444444 | 0.918918919 |
| TNFRSF8 AND NOT-SEMA4D | 0.965517241 | 1 | 0.933333333 | PLA2G2D AND NOT-KIR2DL1 | 0.904109589 | 0.916666667 | 0.891891892 |
| TNFRSF8 AND NOT-SEMA4B | 0.933333333 | 0.93333333 | 0.933333333 | PLA2G2D AND NOT-C10orf99 | 0.918918919 | 0.918918919 | 0.918918919 |
| TNFRSF8 AND NOT-POMT1 | 0.933333333 | 0.93333333 | 0.933333333 | PLA2G2D AND NOT-GLTPD2 | 0.929577465 | 0.970588235 | 0.891891892 |
| TNFRSF8 AND NOT-ERLIN1 | 0.933333333 | 0.93333333 | 0.933333333 | PLA2G2D AND NOT-SCIMP | 0.911764706 | 1 | 0.837837838 |
| TNFRSF8 AND NOT-CGRRF1 | 0.933333333 | 0.93333333 | 0.933333333 | PLA2G2D AND NOT-RPRML | 0.906666667 | 0.894736842 | 0.918918919 |
| TNFRSF8 AND NOT-B3GNT2 | 0.933333333 | 0.93333333 | 0.933333333 | PLA2G2D AND NOT-FAM132A | 0.916666667 | 0.942857143 | 0.891891892 |
| TNFRSF8 AND NOT-CLDN16 | 0.933333333 | 0.93333333 | 0.933333333 | PLA2G2D AND NOT-OR51I2 | 0.906666667 | 0.894736842 | 0.918918919 |
| TNFRSF8 AND NOT-RRH | 0.933333333 | 0.93333333 | 0.933333333 | PLA2G2D AND NOT-OR52D1 | 0.916666667 | 0.942857143 | 0.891891892 |
| TNFRSF8 AND NOT-CORIN | 0.933333333 | 0.93333333 | 0.933333333 | PLA2G2D AND NOT-C14orf180 | 0.931506849 | 0.944444444 | 0.918918919 |
| TNFRSF8 AND NOT-CERS1 | 0.933333333 | 0.93333333 | 0.933333333 | PLA2G2D AND NOT-KLHL31 | 0.904109589 | 0.916666667 | 0.891891892 |
| TNFRSF8 AND NOT-NRG3 | 0.933333333 | 0.93333333 | 0.933333333 | PLA2G2D AND NOT-LRP4 | 0.944444444 | 0.971428571 | 0.918918919 |
| TNFRSF8 AND NOT-SLC12A7 | 0.933333333 | 0.93333333 | 0.933333333 | PLA2G2D AND NOT-LTK | 0.914285714 | 0.96969697 | 0.864864865 |
| TNFRSF8 AND NOT-PHTF1 | 0.933333333 | 0.93333333 | 0.933333333 | PLA2G2D AND NOT-BCAM | 0.901408451 | 0.941176471 | 0.864864865 |
| TNFRSF8 AND NOT-SLC17A3 | 0.933333333 | 0.93333333 | 0.933333333 | PLA2G2D AND NOT-TACSTD2 | 0.904109589 | 0.916666667 | 0.891891892 |
| TNFRSF8 AND NOT-VAMP5 | 0.933333333 | 0.93333333 | 0.933333333 | PLA2G2D AND NOT-MAG | 0.914285714 | 0.96969697 | 0.864864865 |
| TNFRSF8 AND NOT-OR5I1 | 0.933333333 | 0.93333333 | 0.933333333 | PLA2G2D AND NOT-ARSE | 0.914285714 | 0.96969697 | 0.864864865 |
| TNFRSF8 AND NOT-CYSLTR1 | 0.965517241 | 1 | 0.933333333 | PLA2G2D AND NOT-MC5R | 0.906666667 | 0.894736842 | 0.918918919 |
| TNFRSF8 AND NOT-CFTR | 0.933333333 | 0.93333333 | 0.933333333 | PLA2G2D AND NOT-ADAM11 | 0.916666667 | 0.942857143 | 0.891891892 |
| TNFRSF8 AND NOT-CGA | 0.933333333 | 0.93333333 | 0.933333333 | PLA2G2D AND NOT-MIP | 0.918918919 | 0.918918919 | 0.918918919 |
| TNFRSF8 AND NOT-CEACAM3 | 0.965517241 | 1 | 0.933333333 | PLA2G2D AND NOT-MLN | 0.901408451 | 0.941176471 | 0.864864865 |
| TNFRSF8 AND NOT-HCST | 0.965517241 | 1 | 0.933333333 | PLA2G2D AND NOT-CTRB2 | 0.904109589 | 0.916666667 | 0.891891892 |
| TNFRSF8 AND NOT-CEACAM7 | 0.933333333 | 0.93333333 | 0.933333333 | PLA2G2D AND NOT-TMEM151B | 0.904109589 | 0.916666667 | 0.891891892 |
| TNFRSF8 AND NOT-GPR83 | 0.933333333 | 0.93333333 | 0.933333333 | PLA2G2D AND NOT-OR10C1 | 0.906666667 | 0.894736842 | 0.918918919 |
| TNFRSF8 AND NOT-MMP24 | 0.933333333 | 0.93333333 | 0.933333333 | PLA2G2D AND NOT-MUC3A | 0.929577465 | 0.970588235 | 0.891891892 |
| TNFRSF8 AND NOT-OCLM | 0.933333333 | 0.93333333 | 0.933333333 | PLA2G2D AND NOT-MUC4 | 0.929577465 | 0.970588235 | 0.891891892 |
| TNFRSF8 AND NOT-CEACAM4 | 0.965517241 | 1 | 0.933333333 | PLA2G2D AND NOT-ASTN1 | 0.904109589 | 0.916666667 | 0.891891892 |
| TNFRSF8 AND NOT-ADCY2 | 0.933333333 | 0.93333333 | 0.933333333 | PLA2G2D AND NOT-ATP1B2 | 0.906666667 | 0.894736842 | 0.918918919 |
| TNFRSF8 AND NOT-MAN1A2 | 0.933333333 | 0.93333333 | 0.933333333 | PLA2G2D AND NOT-NPR3 | 0.904109589 | 0.916666667 | 0.891891892 |
| TNFRSF8 AND NOT-GPR75 | 0.933333333 | 0.93333333 | 0.933333333 | PLA2G2D AND NOT-NPY5R | 0.904109589 | 0.916666667 | 0.891891892 |
| TNFRSF8 AND NOT-OS9 | 0.933333333 | 0.93333333 | 0.933333333 | PLA2G2D AND NOT-NTF3 | 0.904109589 | 0.916666667 | 0.891891892 |
| TNFRSF8 AND NOT-LMAN2 | 0.965517241 | 1 | 0.933333333 | PLA2G2D AND NOT-NTRK1 | 0.906666667 | 0.894736842 | 0.918918919 |
| TNFRSF8 AND NOT-CKAP4 | 0.965517241 | 1 | 0.933333333 | PLA2G2D AND NOT-NTRK2 | 0.944444444 | 0.971428571 | 0.918918919 |
| TNFRSF8 AND NOT-SLC38A3 | 0.933333333 | 0.93333333 | 0.933333333 | PLA2G2D AND NOT-NTRK3 | 0.918918919 | 0.918918919 | 0.918918919 |
| TNFRSF8 AND NOT-SLC27A4 | 0.933333333 | 0.93333333 | 0.933333333 | PLA2G2D AND NOT-ATP4A | 0.929577465 | 0.970588235 | 0.891891892 |
| TNFRSF8 AND NOT-SLC27A3 | 0.965517241 | 1 | 0.933333333 | PLA2G2D AND NOT-OMG | 0.906666667 | 0.894736842 | 0.918918919 |
| TNFRSF8 AND NOT-LILRB4 | 0.933333333 | 0.93333333 | 0.933333333 | PLA2G2D AND NOT-OPCML | 0.927536232 | 1 | 0.864864865 |
| TNFRSF8 AND NOT-ATF7 | 0.933333333 | 0.93333333 | 0.933333333 | PLA2G2D AND NOT-OPRD1 | 0.914285714 | 0.96969697 | 0.864864865 |
| TNFRSF8 AND NOT-TDRKH | 0.933333333 | 0.93333333 | 0.933333333 | PLA2G2D AND NOT-OPRL1 | 0.931506849 | 0.944444444 | 0.918918919 |
| TNFRSF8 AND NOT-UPK1A | 0.933333333 | 0.93333333 | 0.933333333 | PLA2G2D AND NOT-P2RY2 | 0.916666667 | 0.942857143 | 0.891891892 |
| TNFRSF8 AND NOT-SLC35D2 | 0.933333333 | 0.93333333 | 0.933333333 | PLA2G2D AND NOT-P2RY4 | 0.906666667 | 0.894736842 | 0.918918919 |
| TNFRSF8 AND NOT-LECT1 | 0.933333333 | 0.93333333 | 0.933333333 | PLA2G2D AND NOT-CD207 | 0.944444444 | 0.971428571 | 0.918918919 |
| TNFRSF8 AND NOT-TMEM115 | 0.933333333 | 0.93333333 | 0.933333333 | PLA2G2D AND NOT-PODXL2 | 0.906666667 | 0.894736842 | 0.918918919 |
| TNFRSF8 AND NOT-ADAM30 | 0.933333333 | 0.93333333 | 0.933333333 | PLA2G2D AND NOT-GALNT9 | 0.944444444 | 0.971428571 | 0.918918919 |
| TNFRSF8 AND NOT-ADAMTS13 | 0.933333333 | 0.93333333 | 0.933333333 | PLA2G2D AND NOT-CALY | 0.906666667 | 0.894736842 | 0.918918919 |
| TNFRSF8 AND NOT-CACFD1 | 0.933333333 | 0.93333333 | 0.933333333 | PLA2G2D AND NOT-KCNK4 | 0.931506849 | 0.944444444 | 0.918918919 |
| TNFRSF8 AND NOT-BTN2A1 | 0.933333333 | 0.93333333 | 0.933333333 | PLA2G2D AND NOT-PCDH1 | 0.916666667 | 0.942857143 | 0.891891892 |
| TNFRSF8 AND NOT-PTPRT | 0.933333333 | 0.93333333 | 0.933333333 | PLA2G2D AND NOT-CLDN18 | 0.918918919 | 0.918918919 | 0.918918919 |
| TNFRSF8 AND NOT-SLC7A9 | 0.933333333 | 0.93333333 | 0.933333333 | PLA2G2D AND NOT-CRIM1 | 0.929577465 | 0.970588235 | 0.891891892 |
| TNFRSF8 AND NOT-HHLA2 | 0.933333333 | 0.93333333 | 0.933333333 | PLA2G2D AND NOT-EMCN | 0.904109589 | 0.916666667 | 0.891891892 |
| TNFRSF8 AND NOT-C14orf1 | 0.933333333 | 0.93333333 | 0.933333333 | PLA2G2D AND NOT-FXYD3 | 0.904109589 | 0.916666667 | 0.891891892 |
| TNFRSF8 AND NOT-SLC2A6 | 0.965517241 | 1 | 0.933333333 | PLA2G2D AND NOT-PLP1 | 0.944444444 | 0.971428571 | 0.918918919 |
| TNFRSF8 AND NOT-CHIT1 | 0.933333333 | 0.93333333 | 0.933333333 | PLA2G2D AND NOT-S1PR5 | 0.918918919 | 0.918918919 | 0.918918919 |
| TNFRSF8 AND NOT-ADCY5 | 0.928571429 | 1 | 0.866666667 | PLA2G2D AND NOT-FXYD7 | 0.929577465 | 0.970588235 | 0.891891892 |
| TNFRSF8 AND NOT-PRRT2 | 0.933333333 | 0.93333333 | 0.933333333 | PLA2G2D AND NOT-FGFRL1 | 0.901408451 | 0.941176471 | 0.864864865 |
| TNFRSF8 AND NOT-PTGDR2 | 0.965517241 | 1 | 0.933333333 | PLA2G2D AND NOT-ATP7B | 0.904109589 | 0.916666667 | 0.891891892 |
| TNFRSF8 AND NOT-HRH3 | 0.933333333 | 0.93333333 | 0.933333333 | PLA2G2D AND NOT-GPR88 | 0.906666667 | 0.894736842 | 0.918918919 |
| TNFRSF8 AND NOT-MRAP2 | 0.933333333 | 0.93333333 | 0.933333333 | PLA2G2D AND NOT-KCNK10 | 0.914285714 | 0.96969697 | 0.864864865 |
| TNFRSF8 AND NOT-STX1B | 0.933333333 | 0.93333333 | 0.933333333 | PLA2G2D AND NOT-GPR173 | 0.929577465 | 0.970588235 | 0.891891892 |
| TNFRSF8 AND NOT-KLHL2 | 0.965517241 | 1 | 0.933333333 | PLA2G2D AND NOT-WNT4 | 0.918918919 | 0.918918919 | 0.918918919 |
| TNFRSF8 AND NOT-GLMP | 0.933333333 | 0.93333333 | 0.933333333 | PLA2G2D AND NOT-PON3 | 0.916666667 | 0.942857143 | 0.891891892 |
| TNFRSF8 AND NOT-SCN11A | 0.933333333 | 0.93333333 | 0.933333333 | PLA2G2D AND NOT-RNF186 | 0.904109589 | 0.916666667 | 0.891891892 |
| TNFRSF8 AND NOT-CYP4F8 | 0.933333333 | 0.93333333 | 0.933333333 | PLA2G2D AND NOT-SDK2 | 0.914285714 | 0.96969697 | 0.864864865 |
| TNFRSF8 AND NOT-CHRM1 | 0.933333333 | 0.93333333 | 0.933333333 | PLA2G2D AND NOT-NXPE4 | 0.906666667 | 0.894736842 | 0.918918919 |
| TNFRSF8 AND NOT-CHRM2 | 0.933333333 | 0.93333333 | 0.933333333 | PLA2G2D AND NOT-BEST2 | 0.927536232 | 1 | 0.864864865 |
| TNFRSF8 AND NOT-SCAMP4 | 0.933333333 | 0.93333333 | 0.933333333 | PLA2G2D AND NOT-GDPD2 | 0.944444444 | 0.971428571 | 0.918918919 |
| TNFRSF8 AND NOT-GPR182 | 0.933333333 | 0.93333333 | 0.933333333 | PLA2G2D AND NOT-MS4A12 | 0.906666667 | 0.894736842 | 0.918918919 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-CHRM3 | 0.933333333 | 0.933333333 | 0.933333333 | PLA2G2D AND NOT-ST7L | 0.916666667 | 0.942857143 | 0.891891892 |
| TNFRSF8 AND NOT-MGAT4A | 0.933333333 | 0.933333333 | 0.933333333 | PLA2G2D AND NOT-RHBDL2 | 0.916666667 | 0.942857143 | 0.891891892 |
| TNFRSF8 AND NOT-CHRM4 | 0.933333333 | 0.933333333 | 0.933333333 | PLA2G2D AND NOT-KIRREL | 0.906666667 | 0.894736842 | 0.918918919 |
| TNFRSF8 AND NOT-CHRM5 | 0.933333333 | 0.933333333 | 0.933333333 | PLA2G2D AND NOT-TMEM40 | 0.918918919 | 0.918918919 | 0.918918919 |
| TNFRSF8 AND NOT-CHRNA1 | 0.933333333 | 0.933333333 | 0.933333333 | PLA2G2D AND NOT-SPTLC3 | 0.929577465 | 0.970588235 | 0.891891892 |
| TNFRSF8 AND NOT-CMTM1 | 0.933333333 | 0.933333333 | 0.933333333 | PLA2G2D AND NOT-VNN3 | 0.914285714 | 0.96969697 | 0.864864865 |
| TNFRSF8 AND NOT-CYP2U1 | 0.933333333 | 0.933333333 | 0.933333333 | PLA2G2D AND NOT-NPY4R | 0.931506849 | 0.944444444 | 0.918918919 |
| TNFRSF8 AND NOT-MFSD3 | 0.933333333 | 0.933333333 | 0.933333333 | PLA2G2D AND NOT-AVPR2 | 0.944444444 | 0.971428571 | 0.918918919 |
| TNFRSF8 AND NOT-CHRNA3 | 0.933333333 | 0.933333333 | 0.933333333 | PLA2G2D AND NOT-TNFRSF19 | 0.916666667 | 0.942857143 | 0.891891892 |
| TNFRSF8 AND NOT-CHRNA4 | 0.933333333 | 0.933333333 | 0.933333333 | PLA2G2D AND NOT-SVOP | 0.918918919 | 0.918918919 | 0.918918919 |
| TNFRSF8 AND NOT-CHRNB1 | 0.965517241 | 1 | 0.933333333 | PLA2G2D AND NOT-SLC30A10 | 0.906666667 | 0.894736842 | 0.918918919 |
| TNFRSF8 AND NOT-SIGLEC11 | 0.933333333 | 0.933333333 | 0.933333333 | PLA2G2D AND NOT-PCDHGC5 | 0.931506849 | 0.944444444 | 0.918918919 |
| TNFRSF8 AND NOT-CHRNB3 | 0.933333333 | 0.933333333 | 0.933333333 | PLA2G2D AND NOT-PCDHGA11 | 0.931506849 | 0.944444444 | 0.918918919 |
| TNFRSF8 AND NOT-CHRNB4 | 0.933333333 | 0.933333333 | 0.933333333 | PLA2G2D AND NOT-PCDHB10 | 0.901408451 | 0.941176471 | 0.864864865 |
| TNFRSF8 AND NOT-ERMAP | 0.965517241 | 1 | 0.933333333 | PLA2G2D AND NOT-PCDHB9 | 0.918918919 | 0.918918919 | 0.918918919 |
| TNFRSF8 AND NOT-LRRC37B | 0.933333333 | 0.933333333 | 0.933333333 | PLA2G2D AND NOT-PCDHB7 | 0.916666667 | 0.942857143 | 0.891891892 |
| TNFRSF8 AND NOT-CHRNG | 0.965517241 | 1 | 0.933333333 | PLA2G2D AND NOT-PCDHB6 | 0.904109589 | 0.916666667 | 0.891891892 |
| TNFRSF8 AND NOT-PKD1L2 | 0.933333333 | 0.933333333 | 0.933333333 | PLA2G2D AND NOT-PCDHA10 | 0.906666667 | 0.894736842 | 0.918918919 |
| TNFRSF8 AND NOT-SLC25A25 | 0.933333333 | 0.933333333 | 0.933333333 | PLA2G2D AND NOT-PCDHA5 | 0.906666667 | 0.894736842 | 0.918918919 |
| TNFRSF8 AND NOT-ELFN2 | 0.933333333 | 0.933333333 | 0.933333333 | PLA2G2D AND NOT-PROS1 | 0.929577465 | 0.970588235 | 0.891891892 |
| TNFRSF8 AND NOT-TMEM132B | 0.933333333 | 0.933333333 | 0.933333333 | PLA2G2D AND NOT-PRRG1 | 0.914285714 | 0.96969697 | 0.864864865 |
| TNFRSF8 AND NOT-SLITRK1 | 0.933333333 | 0.933333333 | 0.933333333 | PLA2G2D AND NOT-LTB4R2 | 0.931506849 | 0.944444444 | 0.918918919 |
| TNFRSF8 AND NOT-C1QTNF6 | 0.933333333 | 0.933333333 | 0.933333333 | PLA2G2D AND NOT-RPRM | 0.906666667 | 0.894736842 | 0.918918919 |
| TNFRSF8 AND NOT-ADCY8 | 0.933333333 | 0.933333333 | 0.933333333 | PLA2G2D AND NOT-MUC13 | 0.918918919 | 0.918918919 | 0.918918919 |
| TNFRSF8 AND NOT-MARCH3 | 0.933333333 | 0.933333333 | 0.933333333 | PLA2G2D AND NOT-NMUR2 | 0.906666667 | 0.894736842 | 0.918918919 |
| TNFRSF8 AND NOT-GPR146 | 0.933333333 | 0.933333333 | 0.933333333 | PLA2G2D AND NOT-PYY | 0.944444444 | 0.971428571 | 0.918918919 |
| TNFRSF8 AND NOT-FCRL1 | 0.933333333 | 0.933333333 | 0.933333333 | PLA2G2D AND NOT-CHRNA10 | 0.914285714 | 0.96969697 | 0.864864865 |
| TNFRSF8 AND NOT-FCRL3 | 0.933333333 | 0.933333333 | 0.933333333 | PLA2G2D AND NOT-ANO2 | 0.906666667 | 0.894736842 | 0.918918919 |
| TNFRSF8 AND NOT-SLC5A11 | 0.928571429 | 1 | 0.866666667 | PLA2G2D AND NOT-CYSLTR2 | 0.906666667 | 0.894736842 | 0.918918919 |
| TNFRSF8 AND NOT-TNFRSF13C | 0.928571429 | 1 | 0.866666667 | PLA2G2D AND NOT-JPH2 | 0.904109589 | 0.916666667 | 0.891891892 |
| TNFRSF8 AND NOT-SLC22A12 | 0.933333333 | 0.933333333 | 0.933333333 | PLA2G2D AND NOT-GJC2 | 0.944444444 | 0.971428571 | 0.918918919 |
| TNFRSF8 AND NOT-CMTM5 | 0.965517241 | 1 | 0.933333333 | PLA2G2D AND NOT-ADGRG6 | 0.942857143 | 1 | 0.891891892 |
| TNFRSF8 AND NOT-ABHD15 | 0.933333333 | 0.933333333 | 0.933333333 | PLA2G2D AND NOT-PTGER1 | 0.906666667 | 0.894736842 | 0.918918919 |
| TNFRSF8 AND NOT-PANX3 | 0.933333333 | 0.933333333 | 0.933333333 | PLA2G2D AND NOT-TTYH1 | 0.901408451 | 0.941176471 | 0.864864865 |
| TNFRSF8 AND NOT-GRIN3B | 0.933333333 | 0.933333333 | 0.933333333 | PLA2G2D AND NOT-GJD2 | 0.931506849 | 0.944444444 | 0.918918919 |
| TNFRSF8 AND NOT-MAS1L | 0.933333333 | 0.933333333 | 0.933333333 | PLA2G2D AND NOT-KIAA1161 | 0.914285714 | 0.96969697 | 0.864864865 |
| TNFRSF8 AND NOT-SLC18B1 | 0.965517241 | 1 | 0.933333333 | PLA2G2D AND NOT-PCDH19 | 0.906666667 | 0.894736842 | 0.918918919 |
| TNFRSF8 AND NOT-CATSPER1 | 0.965517241 | 1 | 0.933333333 | PLA2G2D AND NOT-PTK7 | 0.901408451 | 0.941176471 | 0.864864865 |
| TNFRSF8 AND NOT-CATSPER2 | 0.933333333 | 0.933333333 | 0.933333333 | PLA2G2D AND NOT-SYT13 | 0.906666667 | 0.894736842 | 0.918918919 |
| TNFRSF8 AND NOT-MRGPRX2 | 0.933333333 | 0.933333333 | 0.933333333 | PLA2G2D AND NOT-SLC7A14 | 0.904109589 | 0.916666667 | 0.891891892 |
| TNFRSF8 AND NOT-MRGPRX4 | 0.933333333 | 0.933333333 | 0.933333333 | PLA2G2D AND NOT-SEMA4G | 0.906666667 | 0.894736842 | 0.918918919 |
| TNFRSF8 AND NOT-GALNT15 | 0.933333333 | 0.933333333 | 0.933333333 | PLA2G2D AND NOT-SCUBE2 | 0.916666667 | 0.942857143 | 0.891891892 |
| TNFRSF8 AND NOT-CLCN3 | 0.965517241 | 1 | 0.933333333 | PLA2G2D AND NOT-ADGRB3 | 0.918918919 | 0.918918919 | 0.918918919 |
| TNFRSF8 AND NOT-CLCN4 | 0.965517241 | 1 | 0.933333333 | PLA2G2D AND NOT-PTPRZ1 | 0.906666667 | 0.894736842 | 0.918918919 |
| TNFRSF8 AND NOT-ANTXR2 | 0.933333333 | 0.933333333 | 0.933333333 | PLA2G2D AND NOT-PVRL1 | 0.906666667 | 0.894736842 | 0.918918919 |
| TNFRSF8 AND NOT-GPR62 | 0.933333333 | 0.933333333 | 0.933333333 | PLA2G2D AND NOT-BCHE | 0.929577465 | 0.970588235 | 0.891891892 |
| TNFRSF8 AND NOT-CLCN5 | 0.965517241 | 1 | 0.933333333 | PLA2G2D AND NOT-NTN4 | 0.929577465 | 0.970588235 | 0.891891892 |
| TNFRSF8 AND NOT-CLCN6 | 0.933333333 | 0.933333333 | 0.933333333 | PLA2G2D AND NOT-CACNG7 | 0.906666667 | 0.894736842 | 0.918918919 |
| TNFRSF8 AND NOT-FAM24A | 0.933333333 | 0.933333333 | 0.933333333 | PLA2G2D AND NOT-PRPH2 | 0.929577465 | 0.970588235 | 0.891891892 |
| TNFRSF8 AND NOT-ZFYVE27 | 0.933333333 | 0.933333333 | 0.933333333 | PLA2G2D AND NOT-RHAG | 0.918918919 | 0.918918919 | 0.918918919 |
| TNFRSF8 AND NOT-PDZD8 | 0.933333333 | 0.933333333 | 0.933333333 | PLA2G2D AND NOT-NYX | 0.929577465 | 0.970588235 | 0.891891892 |
| TNFRSF8 AND NOT-SLC36A4 | 0.933333333 | 0.933333333 | 0.933333333 | PLA2G2D AND NOT-ROM1 | 0.901408451 | 0.941176471 | 0.864864865 |
| TNFRSF8 AND NOT-CYP2R1 | 0.933333333 | 0.933333333 | 0.933333333 | PLA2G2D AND NOT-BDKRB1 | 0.904109589 | 0.916666667 | 0.891891892 |
| TNFRSF8 AND NOT-CLN5 | 0.933333333 | 0.933333333 | 0.933333333 | PLA2G2D AND NOT-SCN7A | 0.929577465 | 0.970588235 | 0.891891892 |
| TNFRSF8 AND NOT-NXPE1 | 0.933333333 | 0.933333333 | 0.933333333 | PLA2G2D AND NOT-SCNN1A | 0.904109589 | 0.916666667 | 0.891891892 |
| TNFRSF8 AND NOT-AMICA1 | 0.965517241 | 1 | 0.933333333 | PLA2G2D AND NOT-SCNN1B | 0.929577465 | 0.970588235 | 0.891891892 |
| TNFRSF8 AND NOT-TMEM52B | 0.933333333 | 0.933333333 | 0.933333333 | PLA2G2D AND NOT-SCTR | 0.906666667 | 0.894736842 | 0.918918919 |
| TNFRSF8 AND NOT-CLPTM1 | 0.933333333 | 0.933333333 | 0.933333333 | PLA2G2D AND NOT-SDC1 | 0.927536232 | 1 | 0.864864865 |
| TNFRSF8 AND NOT-TMEM132D | 0.933333333 | 0.933333333 | 0.933333333 | PLA2G2D AND NOT-SFRP1 | 0.944444444 | 0.971428571 | 0.918918919 |
| TNFRSF8 AND NOT-ANO4 | 0.933333333 | 0.933333333 | 0.933333333 | PLA2G2D AND NOT-CHST8 | 0.906666667 | 0.894736842 | 0.918918919 |
| TNFRSF8 AND NOT-PLD4 | 0.933333333 | 0.933333333 | 0.933333333 | PLA2G2D AND NOT-SGCD | 0.929577465 | 0.970588235 | 0.891891892 |
| TNFRSF8 AND NOT-ADSSL1 | 0.933333333 | 0.933333333 | 0.933333333 | PLA2G2D AND NOT-ITSN1 | 0.914285714 | 0.96969697 | 0.864864865 |
| TNFRSF8 AND NOT-SLC51B | 0.933333333 | 0.933333333 | 0.933333333 | PLA2G2D AND NOT-LPPR2 | 0.901408451 | 0.941176471 | 0.864864865 |
| TNFRSF8 AND NOT-CCR3 | 0.965517241 | 1 | 0.933333333 | PLA2G2D AND NOT-IL25 | 0.906666667 | 0.894736842 | 0.918918919 |
| TNFRSF8 AND NOT-NIPA1 | 0.933333333 | 0.933333333 | 0.933333333 | PLA2G2D AND NOT-SLC13A3 | 0.929577465 | 0.970588235 | 0.891891892 |
| TNFRSF8 AND NOT-CMTM3 | 0.933333333 | 0.933333333 | 0.933333333 | PLA2G2D AND NOT-SLC1A7 | 0.914285714 | 0.96969697 | 0.864864865 |
| TNFRSF8 AND NOT-LTB4R | 0.928571429 | 1 | 0.866666667 | PLA2G2D AND NOT-SLC5A1 | 0.927536232 | 1 | 0.864864865 |
| TNFRSF8 AND NOT-TMEM170A | 0.965517241 | 1 | 0.933333333 | PLA2G2D AND NOT-SLC6A11 | 0.906666667 | 0.894736842 | 0.918918919 |
| TNFRSF8 AND NOT-CD300LB | 0.965517241 | 1 | 0.933333333 | PLA2G2D AND NOT-SLC6A13 | 0.918918919 | 0.918918919 | 0.918918919 |
| TNFRSF8 AND NOT-B4GALNT2 | 0.933333333 | 0.933333333 | 0.933333333 | PLA2G2D AND NOT-SLC7A4 | 0.914285714 | 0.96969697 | 0.864864865 |
| TNFRSF8 AND NOT-SLC43A2 | 0.965517241 | 1 | 0.933333333 | PLA2G2D AND NOT-SLC16A2 | 0.911764706 | 1 | 0.837837838 |
| TNFRSF8 AND NOT-MIEF2 | 0.965517241 | 1 | 0.933333333 | PLA2G2D AND NOT-SLC18A2 | 0.918918919 | 0.918918919 | 0.918918919 |
| TNFRSF8 AND NOT-SLC5A10 | 0.933333333 | 0.933333333 | 0.933333333 | PLA2G2D AND NOT-BMPR1B | 0.931506849 | 0.944444444 | 0.918918919 |
| TNFRSF8 AND NOT-FAM210A | 0.933333333 | 0.933333333 | 0.933333333 | PLA2G2D AND NOT-SOX1 | 0.906666667 | 0.894736842 | 0.918918919 |
| TNFRSF8 AND NOT-FAM69C | 0.933333333 | 0.933333333 | 0.933333333 | PLA2G2D AND NOT-SYT5 | 0.914285714 | 0.96969697 | 0.864864865 |
| TNFRSF8 AND NOT-CNGA3 | 0.933333333 | 0.933333333 | 0.933333333 | PLA2G2D AND NOT-TEK | 0.916666667 | 0.942857143 | 0.891891892 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-CNGA4 | 0.933333333 | 0.93333333 | 0.933333333 | PLA2G2D AND NOT-TPO | 0.906666667 | 0.894736842 | 0.918918919 |
| TNFRSF8 AND NOT-OR1I1 | 0.933333333 | 0.93333333 | 0.933333333 | PLA2G2D AND NOT-TLCD2 | 0.916666667 | 0.942857143 | 0.891891892 |
| TNFRSF8 AND NOT-TMCO2 | 0.933333333 | 0.93333333 | 0.933333333 | PLA2G2D AND NOT-FAM198A | 0.906666667 | 0.894736842 | 0.918918919 |
| TNFRSF8 AND NOT-GJB4 | 0.933333333 | 0.93333333 | 0.933333333 | PLA2G2D AND NOT-VIP | 0.911764706 | 1 | 0.837837838 |
| TNFRSF8 AND NOT-DCST2 | 0.933333333 | 0.93333333 | 0.933333333 | PLA2G2D AND NOT-VIPR2 | 0.904109589 | 0.916666667 | 0.891891892 |
| TNFRSF8 AND NOT-KLHDC7A | 0.933333333 | 0.93333333 | 0.933333333 | PLA2G2D AND NOT-CACNA1S | 0.931506849 | 0.944444444 | 0.918918919 |
| TNFRSF8 AND NOT-SYT2 | 0.933333333 | 0.93333333 | 0.933333333 | PLA2G2D AND NOT-SEMA3B | 0.901408451 | 0.941176471 | 0.864864865 |
| TNFRSF8 AND NOT-GOLT1A | 0.933333333 | 0.93333333 | 0.933333333 | PLA2G2D AND NOT-NOX5 | 0.916666667 | 0.942857143 | 0.891891892 |
| TNFRSF8 AND NOT-TMEM125 | 0.933333333 | 0.93333333 | 0.933333333 | PLA2G2D AND NOT-LRFN3 | 0.916666667 | 0.942857143 | 0.891891892 |
| TNFRSF8 AND NOT-DRAM2 | 0.965517241 | 1 | 0.933333333 | PLA2G2D AND NOT-EPHX3 | 0.904109589 | 0.916666667 | 0.891891892 |
| TNFRSF8 AND NOT-NKAIN4 | 0.933333333 | 0.93333333 | 0.933333333 | PLA2G2D AND NOT-BTNL8 | 0.916666667 | 0.942857143 | 0.891891892 |
| TNFRSF8 AND NOT-FITM2 | 0.933333333 | 0.93333333 | 0.933333333 | PLA2G2D AND NOT-SEMA6D | 0.914285714 | 0.96969697 | 0.864864865 |
| TNFRSF8 AND NOT-PROKR2 | 0.933333333 | 0.93333333 | 0.933333333 | PLA2G2D AND NOT-FRAS1 | 0.944444444 | 0.971428571 | 0.918918919 |
| TNFRSF8 AND NOT-CST9L | 0.933333333 | 0.93333333 | 0.933333333 | PLA2G2D AND NOT-BPIFB2 | 0.901408451 | 0.941176471 | 0.864864865 |
| TNFRSF8 AND NOT-CST9 | 0.933333333 | 0.93333333 | 0.933333333 | PLA2G2D AND NOT-PRRT1 | 0.906666667 | 0.894736842 | 0.918918919 |
| TNFRSF8 AND NOT-MBOAT2 | 0.933333333 | 0.93333333 | 0.933333333 | PLA2G2D AND NOT-LRRC3 | 0.906666667 | 0.894736842 | 0.918918919 |
| TNFRSF8 AND NOT-CNTNAP5 | 0.933333333 | 0.93333333 | 0.933333333 | PLA2G2D AND NOT-PVRL4 | 0.904109589 | 0.916666667 | 0.891891892 |
| TNFRSF8 AND NOT-COL11A2 | 0.933333333 | 0.93333333 | 0.933333333 | PLA2G2D AND NOT-AMN | 0.918918919 | 0.918918919 | 0.918918919 |
| TNFRSF8 AND NOT-SGPP2 | 0.933333333 | 0.93333333 | 0.933333333 | PLA2G2D AND NOT-RTP3 | 0.918918919 | 0.918918919 | 0.918918919 |
| TNFRSF8 AND NOT-ACVR1C | 0.933333333 | 0.93333333 | 0.933333333 | PLA2G2D AND NOT-MS4A8 | 0.906666667 | 0.894736842 | 0.918918919 |
| TNFRSF8 AND NOT-SPATA3 | 0.933333333 | 0.93333333 | 0.933333333 | PLA2G2D AND NOT-SLC4A9 | 0.914285714 | 0.96969697 | 0.864864865 |
| TNFRSF8 AND NOT-TMEM198 | 0.933333333 | 0.93333333 | 0.933333333 | PLA2G2D AND NOT-KCNK16 | 0.918918919 | 0.918918919 | 0.918918919 |
| TNFRSF8 AND NOT-TMEM182 | 0.933333333 | 0.93333333 | 0.933333333 | PLA2G2D AND NOT-KIAA1109 | 0.918918919 | 0.918918919 | 0.918918919 |
| TNFRSF8 AND NOT-COL17A1 | 0.933333333 | 0.93333333 | 0.933333333 | PLA2G2D AND NOT-TMEM246 | 0.944444444 | 0.971428571 | 0.918918919 |
| TNFRSF8 AND NOT-KCNH8 | 0.933333333 | 0.93333333 | 0.933333333 | PLA2G2D AND NOT-SOAT2 | 0.929577465 | 0.970588235 | 0.891891892 |
| TNFRSF8 AND NOT-DNAJC19 | 0.933333333 | 0.93333333 | 0.933333333 | PLA2G2D AND NOT-ADGRA1 | 0.904109589 | 0.916666667 | 0.891891892 |
| TNFRSF8 AND NOT-DCBLD2 | 0.933333333 | 0.93333333 | 0.933333333 | PLA2G2D AND NOT-ST6GAL2 | 0.906666667 | 0.894736842 | 0.918918919 |
| TNFRSF8 AND NOT-SLC31A2 | 0.965517241 | 1 | 0.933333333 | PLA2G2D AND NOT-KIRREL3 | 0.931506849 | 0.944444444 | 0.918918919 |
| TNFRSF8 AND NOT-RTP1 | 0.933333333 | 0.93333333 | 0.933333333 | PLA2G2D AND NOT-ABHD1 | 0.914285714 | 0.96969697 | 0.864864865 |
| TNFRSF8 AND NOT-LSMEM2 | 0.933333333 | 0.93333333 | 0.933333333 | PLA2G2D AND NOT-GALR3 | 0.918918919 | 0.918918919 | 0.918918919 |
| TNFRSF8 AND NOT-AASDH | 0.965517241 | 1 | 0.933333333 | PLA2G2D AND NOT-PTPN5 | 0.906666667 | 0.894736842 | 0.918918919 |
| TNFRSF8 AND NOT-SLC9B2 | 0.933333333 | 0.93333333 | 0.933333333 | PLA2G2D AND NOT-ABCC11 | 0.931506849 | 0.944444444 | 0.918918919 |
| TNFRSF8 AND NOT-SLCO6A1 | 0.933333333 | 0.93333333 | 0.933333333 | PLA2G2D AND NOT-LY6D | 0.904109589 | 0.916666667 | 0.891891892 |
| TNFRSF8 AND NOT-UGT3A1 | 0.933333333 | 0.93333333 | 0.933333333 | PLA2G2D AND NOT-CAV3 | 0.942857143 | 1 | 0.891891892 |
| TNFRSF8 AND NOT-FAM173B | 0.933333333 | 0.93333333 | 0.933333333 | PLA2G2D AND NOT-UNC5C | 0.911764706 | 1 | 0.837837838 |
| TNFRSF8 AND NOT-TAAR1 | 0.933333333 | 0.93333333 | 0.933333333 | PLA2G2D AND NOT-SLC4A4 | 0.927536232 | 1 | 0.864864865 |
| TNFRSF8 AND NOT-COX10 | 0.933333333 | 0.93333333 | 0.933333333 | PLA2G2D AND NOT-B3GALT1 | 0.911764706 | 1 | 0.837837838 |
| TNFRSF8 AND NOT-COX15 | 0.933333333 | 0.93333333 | 0.933333333 | PLA2G2D AND NOT-ADAM23 | 0.916666667 | 0.942857143 | 0.891891892 |
| TNFRSF8 AND NOT-DPCR1 | 0.933333333 | 0.93333333 | 0.933333333 | PLA2G2D AND NOT-GALR2 | 0.901408451 | 0.941176471 | 0.864864865 |
| TNFRSF8 AND NOT-OR6B1 | 0.933333333 | 0.93333333 | 0.933333333 | PLA2G2D AND NOT-PROM1 | 0.916666667 | 0.942857143 | 0.891891892 |
| TNFRSF8 AND NOT-CLDN3 | 0.933333333 | 0.93333333 | 0.933333333 | PLA2G2D AND NOT-CCKAR | 0.901408451 | 0.941176471 | 0.864864865 |
| TNFRSF8 AND NOT-CLDN23 | 0.933333333 | 0.93333333 | 0.933333333 | PLA2G2D AND NOT-CACNA1I | 0.904109589 | 0.916666667 | 0.891891892 |
| TNFRSF8 AND NOT-CR1 | 0.933333333 | 0.93333333 | 0.933333333 | PLA2G2D AND NOT-TSPAN18 | 0.914285714 | 0.96969697 | 0.864864865 |
| TNFRSF8 AND NOT-HGSNAT | 0.965517241 | 1 | 0.933333333 | PLA2G2D AND NOT-TM4SF5 | 0.906666667 | 0.894736842 | 0.918918919 |
| TNFRSF8 AND NOT-FAM69B | 0.933333333 | 0.93333333 | 0.933333333 | PLA2G2D AND NOT-SLC13A2 | 0.906666667 | 0.894736842 | 0.918918919 |
| TNFRSF8 AND NOT-ADGRG4 | 0.933333333 | 0.93333333 | 0.933333333 | PLA2G2D AND NOT-ANGPTL1 | 0.931506849 | 0.944444444 | 0.918918919 |
| TNFRSF8 AND NOT-MUC17 | 0.933333333 | 0.93333333 | 0.933333333 | PLA2G2D AND NOT-CLDN10 | 0.904109589 | 0.916666667 | 0.891891892 |
| TNFRSF8 AND NOT-ASB11 | 0.933333333 | 0.93333333 | 0.933333333 | PLA2G2D AND NOT-CLDN1 | 0.918918919 | 0.918918919 | 0.918918919 |
| TNFRSF8 AND NOT-TRPM6 | 0.933333333 | 0.93333333 | 0.933333333 | PLA2G2D AND NOT-TMEM257 | 0.904109589 | 0.916666667 | 0.891891892 |
| TNFRSF8 AND NOT-ROMO1 | 0.933333333 | 0.93333333 | 0.933333333 | PLA2G2D AND NOT-MYADM | 0.901408451 | 0.941176471 | 0.864864865 |
| TNFRSF8 AND NOT-SIRPA | 0.965517241 | 1 | 0.933333333 | PLA2G2D AND NOT-IL1RL1 | 0.916666667 | 0.942857143 | 0.891891892 |
| TNFRSF8 AND NOT-CRY2 | 0.933333333 | 0.93333333 | 0.933333333 | PLA2G2D AND NOT-DSEL | 0.929577465 | 0.970588235 | 0.891891892 |
| TNFRSF8 AND NOT-SAMD8 | 0.933333333 | 0.93333333 | 0.933333333 | PLA2G2D AND NOT-LARGE | 0.916666667 | 0.942857143 | 0.891891892 |
| TNFRSF8 AND NOT-VTI1A | 0.933333333 | 0.93333333 | 0.933333333 | PLA2G2D AND NOT-CDHR1 | 0.918918919 | 0.918918919 | 0.918918919 |
| TNFRSF8 AND NOT-MUC15 | 0.933333333 | 0.93333333 | 0.933333333 | PLA2G2D AND NOT-DHRS3 | 0.901408451 | 0.941176471 | 0.864864865 |
| TNFRSF8 AND NOT-FAM76B | 0.933333333 | 0.93333333 | 0.933333333 | PLA2G2D AND NOT-SLC22A6 | 0.918918919 | 0.918918919 | 0.918918919 |
| TNFRSF8 AND NOT-CSF2RA | 0.933333333 | 0.93333333 | 0.933333333 | PLA2G2D AND NOT-NRXN3 | 0.914285714 | 0.96969697 | 0.864864865 |
| TNFRSF8 AND NOT-TMEM86A | 0.933333333 | 0.93333333 | 0.933333333 | PLA2G2D AND NOT-LRRC4B | 0.906666667 | 0.894736842 | 0.918918919 |
| TNFRSF8 AND NOT-CSF3R | 0.965517241 | 1 | 0.933333333 | PLA2G2D AND NOT-OPN4 | 0.918918919 | 0.918918919 | 0.918918919 |
| TNFRSF8 AND NOT-ALG10B | 0.933333333 | 0.93333333 | 0.933333333 | PLA2G2D AND NOT-NTN1 | 0.918918919 | 0.918918919 | 0.918918919 |
| TNFRSF8 AND NOT-BEST3 | 0.933333333 | 0.93333333 | 0.933333333 | PLA2G2D AND NOT-NCR1 | 0.931506849 | 0.944444444 | 0.918918919 |
| TNFRSF8 AND NOT-B3GLCT | 0.933333333 | 0.93333333 | 0.933333333 | PLA2G2D AND NOT-ITM2B | 0.906666667 | 0.894736842 | 0.918918919 |
| TNFRSF8 AND NOT-LRFN5 | 0.933333333 | 0.93333333 | 0.933333333 | PLA2G2D AND NOT-ENTPD2 | 0.918918919 | 0.918918919 | 0.918918919 |
| TNFRSF8 AND NOT-NRG4 | 0.933333333 | 0.93333333 | 0.933333333 | PLA2G2D AND NOT-ENTPD3 | 0.931506849 | 0.944444444 | 0.918918919 |
| TNFRSF8 AND NOT-C16orf92 | 0.933333333 | 0.93333333 | 0.933333333 | PLA2G2D AND NOT-MFAP3L | 0.957746479 | 1 | 0.918918919 |
| TNFRSF8 AND NOT-GSG1L | 0.933333333 | 0.93333333 | 0.933333333 | Adenocarcinoma|Lung Neoplasms (Lung A) | | | |
| TNFRSF8 AND NOT-TMED6 | 0.933333333 | 0.93333333 | 0.933333333 | SFTPD AND NOT-IL3RA | 0.918918919 | 0.894736842 | 0.944444444 |
| TNFRSF8 AND NOT-CD300LF | 0.965517241 | 1 | 0.933333333 | SFTPD AND NOT-CDH5 | 0.941176471 | 1 | 0.888888889 |
| TNFRSF8 AND NOT-SLC47A2 | 0.933333333 | 0.93333333 | 0.933333333 | SFTPC AND NOT-RAMP2 | 0.909090909 | 1 | 0.833333333 |
| TNFRSF8 AND NOT-ODF4 | 0.933333333 | 0.93333333 | 0.933333333 | SFTPD AND NOT-RAMP2 | 0.941176471 | 1 | 0.888888889 |
| TNFRSF8 AND NOT-ADRA1D | 0.933333333 | 0.93333333 | 0.933333333 | SFTPD AND NOT-SIRPB1 | 0.918918919 | 0.894736842 | 0.944444444 |
| TNFRSF8 AND NOT-TMEM199 | 0.933333333 | 0.93333333 | 0.933333333 | SFTPD AND NOT-ABCA8 | 0.941176471 | 1 | 0.888888889 |
| TNFRSF8 AND NOT-VSIG10L | 0.933333333 | 0.93333333 | 0.933333333 | SLC34A2 AND NOT-DLL1 | 0.914285714 | 0.941176471 | 0.888888889 |
| TNFRSF8 AND NOT-C19orf18 | 0.933333333 | 0.93333333 | 0.933333333 | SFTPC AND NOT-LYVE1 | 0.909090909 | 1 | 0.833333333 |
| TNFRSF8 AND NOT-DPY19L3 | 0.933333333 | 0.93333333 | 0.933333333 | SFTPD AND NOT-LYVE1 | 0.971428571 | 1 | 0.944444444 |
| TNFRSF8 AND NOT-ADRA1B | 0.933333333 | 0.93333333 | 0.933333333 | SFTPD AND NOT-PNPLA6 | 0.918918919 | 0.894736842 | 0.944444444 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-FAM187B | 0.933333333 | 0.933333333 | 0.933333333 | SFTPD AND NOT-SLC25A25 | 0.944444444 | 0.944444444 | 0.944444444 |
| TNFRSF8 AND NOT-ATP8B3 | 0.933333333 | 0.933333333 | 0.933333333 | SFTPD AND NOT-CYYR1 | 0.914285714 | 0.941176471 | 0.888888889 |
| TNFRSF8 AND NOT-SYT6 | 0.933333333 | 0.933333333 | 0.933333333 | SFTPD AND NOT-BTNL9 | 0.971428571 | 1 | 0.944444444 |
| TNFRSF8 AND NOT-HFE2 | 0.933333333 | 0.933333333 | 0.933333333 | SFTPC AND NOT-CLEC14A | 0.909090909 | 1 | 0.833333333 |
| TNFRSF8 AND NOT-FAM163A | 0.933333333 | 0.933333333 | 0.933333333 | SFTPD AND NOT-CLEC14A | 0.971428571 | 1 | 0.944444444 |
| TNFRSF8 AND NOT-MFSD4 | 0.933333333 | 0.933333333 | 0.933333333 | SFTPC AND NOT-AGER | 0.909090909 | 1 | 0.833333333 |
| TNFRSF8 AND NOT-PM20D1 | 0.933333333 | 0.933333333 | 0.933333333 | SFTPD AND NOT-AGER | 0.944444444 | 0.944444444 | 0.944444444 |
| TNFRSF8 AND NOT-SLC30A7 | 0.933333333 | 0.933333333 | 0.933333333 | SFTPD AND NOT-HBEGF | 0.944444444 | 0.944444444 | 0.944444444 |
| TNFRSF8 AND NOT-KNCN | 0.933333333 | 0.933333333 | 0.933333333 | SFTPD AND NOT-AGTR1 | 0.918918919 | 0.894736842 | 0.944444444 |
| TNFRSF8 AND NOT-DCST1 | 0.933333333 | 0.933333333 | 0.933333333 | SFTPD AND NOT-S1PR1 | 0.914285714 | 0.941176471 | 0.888888889 |
| TNFRSF8 AND NOT-SHISA4 | 0.933333333 | 0.933333333 | 0.933333333 | SFTPD AND NOT-EDNRB | 0.918918919 | 0.894736842 | 0.944444444 |
| TNFRSF8 AND NOT-SLC9B1 | 0.933333333 | 0.933333333 | 0.933333333 | SFTPD AND NOT-ADCY4 | 0.941176471 | 1 | 0.888888889 |
| TNFRSF8 AND NOT-NFAM1 | 0.965517241 | 1 | 0.933333333 | SFTPD AND NOT-MCEMP1 | 0.914285714 | 0.941176471 | 0.888888889 |
| TNFRSF8 AND NOT-KANSL1L | 0.933333333 | 0.933333333 | 0.933333333 | SFTPD AND NOT-EMP2 | 0.941176471 | 1 | 0.888888889 |
| TNFRSF8 AND NOT-FAM132B | 0.933333333 | 0.933333333 | 0.933333333 | SFTPD AND NOT-ENG | 0.941176471 | 1 | 0.888888889 |
| TNFRSF8 AND NOT-ARL6IP6 | 0.933333333 | 0.933333333 | 0.933333333 | BAX AND NOT-ABCA2 | 0.914285714 | 0.941176471 | 0.888888889 |
| TNFRSF8 AND NOT-SLC38A11 | 0.933333333 | 0.933333333 | 0.933333333 | SFTPD AND NOT-RNF182 | 0.914285714 | 0.941176471 | 0.888888889 |
| TNFRSF8 AND NOT-GPR155 | 0.933333333 | 0.933333333 | 0.933333333 | SFTPD AND NOT-FGFR4 | 0.971428571 | 1 | 0.944444444 |
| TNFRSF8 AND NOT-FAM19A4 | 0.933333333 | 0.933333333 | 0.933333333 | SFTPD AND NOT-ADGRL2 | 0.909090909 | 1 | 0.833333333 |
| TNFRSF8 AND NOT-XXYLT1 | 0.965517241 | 1 | 0.933333333 | SFTPD AND NOT-FUT1 | 0.914285714 | 0.941176471 | 0.888888889 |
| TNFRSF8 AND NOT-CUX1 | 0.965517241 | 1 | 0.933333333 | SFTPD AND NOT-ACKR1 | 0.914285714 | 0.941176471 | 0.888888889 |
| TNFRSF8 AND NOT-IGSF11 | 0.933333333 | 0.933333333 | 0.933333333 | SFTPD AND NOT-ABI3BP | 0.909090909 | 1 | 0.833333333 |
| TNFRSF8 AND NOT-CX3CR1 | 0.928571429 | 1 | 0.866666667 | SFTPD AND NOT-LRRC32 | 0.971428571 | 1 | 0.944444444 |
| TNFRSF8 AND NOT-NFXL1 | 0.933333333 | 0.933333333 | 0.933333333 | SFTPD AND NOT-GPM6A | 0.944444444 | 0.944444444 | 0.944444444 |
| TNFRSF8 AND NOT-PAQR3 | 0.933333333 | 0.933333333 | 0.933333333 | SFTPD AND NOT-IGSF10 | 0.971428571 | 1 | 0.944444444 |
| TNFRSF8 AND NOT-MGAT4D | 0.933333333 | 0.933333333 | 0.933333333 | SFTPD AND NOT-GRIA1 | 0.914285714 | 0.941176471 | 0.888888889 |
| TNFRSF8 AND NOT-CXADR | 0.933333333 | 0.933333333 | 0.933333333 | SFTPD AND NOT-ACACB | 0.909090909 | 1 | 0.833333333 |
| TNFRSF8 AND NOT-THAP6 | 0.933333333 | 0.933333333 | 0.933333333 | SFTPD AND NOT-KCNT2 | 0.918918919 | 0.894736842 | 0.944444444 |
| TNFRSF8 AND NOT-SLC25A48 | 0.933333333 | 0.933333333 | 0.933333333 | SFTPD AND NOT-IL3RA | 0.918918919 | 0.894736842 | 0.944444444 |
| TNFRSF8 AND NOT-MARVELD2 | 0.933333333 | 0.933333333 | 0.933333333 | SFTPD AND NOT-CXCR2 | 0.914285714 | 0.941176471 | 0.888888889 |
| TNFRSF8 AND NOT-CYBB | 0.928571429 | 1 | 0.866666667 | SFTPD AND NOT-PEAR1 | 0.941176471 | 1 | 0.888888889 |
| TNFRSF8 AND NOT-ADRB1 | 0.928571429 | 1 | 0.866666667 | SFTPC AND NOT-KCNK3 | 0.909090909 | 1 | 0.833333333 |
| TNFRSF8 AND NOT-SLC2A12 | 0.933333333 | 0.933333333 | 0.933333333 | SFTPD AND NOT-KCNK3 | 0.914285714 | 0.941176471 | 0.888888889 |
| TNFRSF8 AND NOT-MBOAT1 | 0.965517241 | 1 | 0.933333333 | SFTPD AND NOT-SERTM1 | 0.914285714 | 0.941176471 | 0.888888889 |
| TNFRSF8 AND NOT-RNF217 | 0.933333333 | 0.933333333 | 0.933333333 | SFTPD AND NOT-MME | 0.971428571 | 1 | 0.944444444 |
| TNFRSF8 AND NOT-NKAIN2 | 0.933333333 | 0.933333333 | 0.933333333 | SFTPC AND NOT-MARCH11 | 0.909090909 | 1 | 0.833333333 |
| TNFRSF8 AND NOT-CYP1A1 | 0.933333333 | 0.933333333 | 0.933333333 | SFTPD AND NOT-NOTCH4 | 0.941176471 | 1 | 0.888888889 |
| TNFRSF8 AND NOT-VKORC1L1 | 0.933333333 | 0.933333333 | 0.933333333 | SFTPD AND NOT-CLEC1A | 0.914285714 | 0.941176471 | 0.888888889 |
| TNFRSF8 AND NOT-CYP2A6 | 0.928571429 | 1 | 0.866666667 | SFTPD AND NOT-PCDH12 | 0.909090909 | 1 | 0.833333333 |
| TNFRSF8 AND NOT-ADRB2 | 0.928571429 | 1 | 0.866666667 | SFTPD AND NOT-PECAM1 | 0.971428571 | 1 | 0.944444444 |
| TNFRSF8 AND NOT-CYP3A7 | 0.933333333 | 0.933333333 | 0.933333333 | BAX AND NOT-ABCB1 | 0.918918919 | 0.894736842 | 0.944444444 |
| TNFRSF8 AND NOT-CYP2A13 | 0.933333333 | 0.933333333 | 0.933333333 | SFTPD AND NOT-FXYD6 | 0.909090909 | 1 | 0.833333333 |
| TNFRSF8 AND NOT-CYP2C8 | 0.933333333 | 0.933333333 | 0.933333333 | SFTPD AND NOT-LRRN3 | 0.941176471 | 1 | 0.888888889 |
| TNFRSF8 AND NOT-CYP2E1 | 0.933333333 | 0.933333333 | 0.933333333 | BAX AND NOT-PRPF38B | 0.909090909 | 1 | 0.833333333 |
| TNFRSF8 AND NOT-PEBP4 | 0.933333333 | 0.933333333 | 0.933333333 | SFTPC AND NOT-TMEM74B | 0.909090909 | 1 | 0.833333333 |
| TNFRSF8 AND NOT-TMEM65 | 0.933333333 | 0.933333333 | 0.933333333 | SFTPD AND NOT-TMEM74B | 0.918918919 | 0.894736842 | 0.944444444 |
| TNFRSF8 AND NOT-TMEM74 | 0.933333333 | 0.933333333 | 0.933333333 | SFTPD AND NOT-PRRG1 | 0.941176471 | 1 | 0.888888889 |
| TNFRSF8 AND NOT-CYP4A11 | 0.933333333 | 0.933333333 | 0.933333333 | SFTPD AND NOT-HEG1 | 0.941176471 | 1 | 0.888888889 |
| TNFRSF8 AND NOT-LINGO2 | 0.928571429 | 1 | 0.866666667 | SFTPD AND NOT-SEMA6A | 0.909090909 | 1 | 0.833333333 |
| TNFRSF8 AND NOT-FREM1 | 0.933333333 | 0.933333333 | 0.933333333 | SFTPD AND NOT-PTPRM | 0.944444444 | 0.944444444 | 0.944444444 |
| TNFRSF8 AND NOT-FMR1NB | 0.933333333 | 0.933333333 | 0.933333333 | SFTPD AND NOT-JAM2 | 0.941176471 | 1 | 0.888888889 |
| TNFRSF8 AND NOT-FAAH2 | 0.933333333 | 0.933333333 | 0.933333333 | SFTPD AND NOT-RXFP1 | 0.918918919 | 0.894736842 | 0.944444444 |
| TNFRSF8 AND NOT-ZDHHC15 | 0.933333333 | 0.933333333 | 0.933333333 | SFTPD AND NOT-SELE | 0.909090909 | 1 | 0.833333333 |
| TNFRSF8 AND NOT-CLEC12A | 0.965517241 | 1 | 0.933333333 | SFTPC AND NOT-ECSCR | 0.909090909 | 1 | 0.833333333 |
| TNFRSF8 AND NOT-SLC5A8 | 0.933333333 | 0.933333333 | 0.933333333 | SFTPD AND NOT-ECSCR | 0.971428571 | 1 | 0.944444444 |
| TNFRSF8 AND NOT-GPR180 | 0.933333333 | 0.933333333 | 0.933333333 | SFTPD AND NOT-SGCG | 0.971428571 | 1 | 0.944444444 |
| TNFRSF8 AND NOT-STOML3 | 0.933333333 | 0.933333333 | 0.933333333 | SFTPD AND NOT-TEK | 0.914285714 | 0.941176471 | 0.888888889 |
| TNFRSF8 AND NOT-FITM1 | 0.933333333 | 0.933333333 | 0.933333333 | SFTPD AND NOT-TGFBR3 | 0.971428571 | 1 | 0.944444444 |
| TNFRSF8 AND NOT-TMEM30B | 0.933333333 | 0.933333333 | 0.933333333 | SFTPD AND NOT-THBD | 0.909090909 | 1 | 0.833333333 |
| TNFRSF8 AND NOT-MFSD6L | 0.933333333 | 0.933333333 | 0.933333333 | SFTPD AND NOT-TIE1 | 0.941176471 | 1 | 0.888888889 |
| TNFRSF8 AND NOT-TMEM92 | 0.933333333 | 0.933333333 | 0.933333333 | SFTPD AND NOT-CLDN5 | 0.909090909 | 1 | 0.833333333 |
| TNFRSF8 AND NOT-RHBDL3 | 0.933333333 | 0.933333333 | 0.933333333 | SFTPD AND TMEM258 | 0.944444444 | 0.944444444 | 0.944444444 |
| TNFRSF8 AND NOT-SPPL2C | 0.933333333 | 0.933333333 | 0.933333333 | SFTPD AND NOT-CA4 | 0.944444444 | 0.944444444 | 0.944444444 |
| TNFRSF8 AND NOT-DCC | 0.933333333 | 0.933333333 | 0.933333333 | SFTPD AND NOT-C1orf115 | 0.971428571 | 1 | 0.944444444 |
| TNFRSF8 AND NOT-SYNE4 | 0.933333333 | 0.933333333 | 0.933333333 | SFTPD AND NOT-MYCT1 | 0.941176471 | 1 | 0.888888889 |
| TNFRSF8 AND NOT-TOR1AIP2 | 0.965517241 | 1 | 0.933333333 | SFTPD AND NOT-ADTRP | 0.918918919 | 0.894736842 | 0.944444444 |
| TNFRSF8 AND NOT-DCT | 0.933333333 | 0.933333333 | 0.933333333 | SFTPD AND NOT-AOC3 | 0.941176471 | 1 | 0.888888889 |
| TNFRSF8 AND NOT-PAQR7 | 0.933333333 | 0.933333333 | 0.933333333 | SFTPD AND NOT-IL18R1 | 0.914285714 | 0.941176471 | 0.888888889 |
| TNFRSF8 AND NOT-LRRN4 | 0.933333333 | 0.933333333 | 0.933333333 | SFTPD AND NOT-KL | 0.909090909 | 1 | 0.833333333 |
| TNFRSF8 AND NOT-TMPRSS6 | 0.933333333 | 0.933333333 | 0.933333333 | SFTPD AND NOT-FAM189A2 | 0.909090909 | 1 | 0.833333333 |
| TNFRSF8 AND NOT-ADGRF3 | 0.933333333 | 0.933333333 | 0.933333333 | SFTPD AND NOT-ITM2A | 0.941176471 | 1 | 0.888888889 |
| TNFRSF8 AND NOT-OXER1 | 0.933333333 | 0.933333333 | 0.933333333 | SFTPD AND NOT-CD36 | 0.918918919 | 0.894736842 | 0.944444444 |
| TNFRSF8 AND NOT-SPTSSB | 0.965517241 | 1 | 0.933333333 | SFTPD AND NOT-ACVRL1 | 0.941176471 | 1 | 0.888888889 |
| TNFRSF8 AND NOT-CHST13 | 0.965517241 | 1 | 0.933333333 | TMEM258 AND NOT-TGFBR3 | 0.914285714 | 0.941176471 | 0.888888889 |
| TNFRSF8 AND NOT-ADGRA3 | 0.933333333 | 0.933333333 | 0.933333333 | Oligodendroglioma (Oligodendroglioma) | | | |
| TNFRSF8 AND NOT-SGMS2 | 0.965517241 | 1 | 0.933333333 | NLGN3 AND NOT-FOLR2 | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-GALNTL5 | 0.933333333 | 0.933333333 | 0.933333333 | NLGN3 AND NOT-SLAMF7 | 0.933333333 | 0.933333333 | 0.933333333 |
| TNFRSF8 AND NOT-PKD1L1 | 0.933333333 | 0.933333333 | 0.933333333 | NLGN3 AND NOT-SDC1 | 0.933333333 | 0.933333333 | 0.933333333 |
| TNFRSF8 AND NOT-SLC30A8 | 0.933333333 | 0.933333333 | 0.933333333 | NLGN3 AND NOT-TNFRSF8 | 0.903225806 | 0.875 | 0.933333333 |
| TNFRSF8 AND NOT-KCNV2 | 0.933333333 | 0.933333333 | 0.933333333 | NLGN3 AND NOT-IL11RA | 0.903225806 | 0.875 | 0.933333333 |
| TNFRSF8 AND NOT-CLEC4C | 0.933333333 | 0.933333333 | 0.933333333 | NLGN3 AND NOT-MUC1 | 0.903225806 | 0.875 | 0.933333333 |
| TNFRSF8 AND NOT-HTR3C | 0.933333333 | 0.933333333 | 0.933333333 | NLGN3 AND NOT-KDR | 0.933333333 | 0.933333333 | 0.933333333 |
| TNFRSF8 AND NOT-KCNG3 | 0.933333333 | 0.933333333 | 0.933333333 | NLGN3 AND NOT-IGF1R | 0.903225806 | 0.875 | 0.933333333 |
| TNFRSF8 AND NOT-CLYBL | 0.933333333 | 0.933333333 | 0.933333333 | NLGN3 AND NOT-ALK | 0.903225806 | 0.875 | 0.933333333 |
| TNFRSF8 AND NOT-FAM9C | 0.933333333 | 0.933333333 | 0.933333333 | NLGN3 AND NOT-ERBB3 | 0.903225806 | 0.875 | 0.933333333 |
| TNFRSF8 AND NOT-SPTSSA | 0.965517241 | 1 | 0.933333333 | NLGN3 AND NOT-TNFRSF10B | 0.933333333 | 0.933333333 | 0.933333333 |
| TNFRSF8 AND NOT-ABHD3 | 0.933333333 | 0.933333333 | 0.933333333 | NLGN3 AND NOT-B4GALNT1 | 0.903225806 | 0.875 | 0.933333333 |
| TNFRSF8 AND NOT-DHCR24 | 0.933333333 | 0.933333333 | 0.933333333 | NLGN3 AND NOT-GPA33 | 0.903225806 | 0.875 | 0.933333333 |
| TNFRSF8 AND NOT-DIO1 | 0.933333333 | 0.933333333 | 0.933333333 | NLGN3 AND NOT-MUC13 | 0.903225806 | 0.875 | 0.933333333 |
| TNFRSF8 AND NOT-DIO3 | 0.933333333 | 0.933333333 | 0.933333333 | NLGN3 AND NOT-EPHA3 | 0.903225806 | 0.875 | 0.933333333 |
| TNFRSF8 AND NOT-DNASE1 | 0.933333333 | 0.933333333 | 0.933333333 | NLGN3 AND NOT-MAGEA1 | 0.903225806 | 0.875 | 0.933333333 |
| TNFRSF8 AND NOT-DPP6 | 0.933333333 | 0.933333333 | 0.933333333 | NLGN3 AND NOT-IL3RA | 0.903225806 | 0.875 | 0.933333333 |
| TNFRSF8 AND NOT-DRD1 | 0.933333333 | 0.933333333 | 0.933333333 | NLGN3 AND NOT-ROR1 | 0.903225806 | 0.875 | 0.933333333 |
| TNFRSF8 AND NOT-DRD3 | 0.933333333 | 0.933333333 | 0.933333333 | NLGN3 AND NOT-TNFSF11 | 0.903225806 | 0.875 | 0.933333333 |
| TNFRSF8 AND NOT-DRD4 | 0.933333333 | 0.933333333 | 0.933333333 | NLGN3 AND NOT-NLGN3 | 0.903225806 | 0.875 | 0.933333333 |
| TNFRSF8 AND NOT-DSC3 | 0.933333333 | 0.933333333 | 0.933333333 | NLGN3 AND NOT-MUC17 | 0.903225806 | 0.875 | 0.933333333 |
| TNFRSF8 AND NOT-DSCAM | 0.933333333 | 0.933333333 | 0.933333333 | NLGN3 AND NOT-ITGB3 | 0.903225806 | 0.875 | 0.933333333 |
| TNFRSF8 AND NOT-DTNA | 0.933333333 | 0.933333333 | 0.933333333 | NLGN3 AND NOT-FOLH1 | 0.903225806 | 0.875 | 0.933333333 |
| TNFRSF8 AND NOT-AGTR2 | 0.933333333 | 0.933333333 | 0.933333333 | NLGN3 AND NOT-EPHA2 | 0.933333333 | 0.933333333 | 0.933333333 |
| TNFRSF8 AND NOT-E2F5 | 0.933333333 | 0.933333333 | 0.933333333 | NLGN3 AND NOT-CA9 | 0.903225806 | 0.875 | 0.933333333 |
| TNFRSF8 AND NOT-ECM1 | 0.933333333 | 0.933333333 | 0.933333333 | NLGN3 AND NOT-MS4A1 | 0.903225806 | 0.875 | 0.933333333 |
| TNFRSF8 AND NOT-S1PR1 | 0.928571429 | 1 | 0.866666667 | NLGN3 AND NOT-NLGN3 | 0.903225806 | 0.875 | 0.933333333 |
| TNFRSF8 AND NOT-S1PR3 | 0.933333333 | 0.933333333 | 0.933333333 | NLGN3 AND NOT-TNFRSF10A | 0.903225806 | 0.875 | 0.933333333 |
| TNFRSF8 AND NOT-SCAMP5 | 0.933333333 | 0.933333333 | 0.933333333 | NLGN3 AND NOT-MUC16 | 0.903225806 | 0.875 | 0.933333333 |
| TNFRSF8 AND NOT-EFNA5 | 0.933333333 | 0.933333333 | 0.933333333 | NLGN3 AND NOT-MLANA | 0.903225806 | 0.875 | 0.933333333 |
| TNFRSF8 AND NOT-EFNB3 | 0.965517241 | 1 | 0.933333333 | NLGN3 AND NOT-NLGN3 | 0.903225806 | 0.875 | 0.933333333 |
| TNFRSF8 AND NOT-EGF | 0.933333333 | 0.933333333 | 0.933333333 | NLGN3 AND NOT-CD160 | 0.903225806 | 0.875 | 0.933333333 |
| TNFRSF8 AND NOT-CELSR2 | 0.933333333 | 0.933333333 | 0.933333333 | NLGN3 AND NOT-NAALADL1 | 0.903225806 | 0.875 | 0.933333333 |
| TNFRSF8 AND NOT-MEGF6 | 0.933333333 | 0.933333333 | 0.933333333 | NLGN3 AND NOT-KCNE3 | 0.903225806 | 0.875 | 0.933333333 |
| TNFRSF8 AND NOT-MEGF9 | 0.965517241 | 1 | 0.933333333 | NLGN3 AND NOT-TMEM221 | 0.933333333 | 0.933333333 | 0.933333333 |
| TNFRSF8 AND NOT-PPAPDC1A | 0.933333333 | 0.933333333 | 0.933333333 | NLGN3 AND NOT-LRRC70 | 0.903225806 | 0.875 | 0.933333333 |
| TNFRSF8 AND NOT-MPZL3 | 0.933333333 | 0.933333333 | 0.933333333 | NLGN3 AND NOT-SMIM6 | 0.933333333 | 0.933333333 | 0.933333333 |
| TNFRSF8 AND NOT-PIANP | 0.933333333 | 0.933333333 | 0.933333333 | NLGN3 AND NOT-NEMP2 | 0.903225806 | 0.875 | 0.933333333 |
| TNFRSF8 AND NOT-VSTM4 | 0.933333333 | 0.933333333 | 0.933333333 | NLGN3 AND NOT-ARMCX4 | 0.903225806 | 0.875 | 0.933333333 |
| TNFRSF8 AND NOT-GRAMD2 | 0.933333333 | 0.933333333 | 0.933333333 | NLGN3 AND NOT-100132596? | 0.903225806 | 0.875 | 0.933333333 |
| TNFRSF8 AND NOT-ELANE | 0.933333333 | 0.933333333 | 0.933333333 | NLGN3 AND NOT-BCL2L10 | 0.903225806 | 0.875 | 0.933333333 |
| TNFRSF8 AND NOT-CADM4 | 0.933333333 | 0.933333333 | 0.933333333 | NLGN3 AND NOT-PIGK | 0.933333333 | 0.933333333 | 0.933333333 |
| TNFRSF8 AND NOT-TMEM61 | 0.933333333 | 0.933333333 | 0.933333333 | NLGN3 AND NOT-ERVMER34-1 | 0.903225806 | 0.875 | 0.933333333 |
| TNFRSF8 AND NOT-FAM209A | 0.933333333 | 0.933333333 | 0.933333333 | NLGN3 AND NOT-TMEM239 | 0.903225806 | 0.875 | 0.933333333 |
| TNFRSF8 AND NOT-APLF | 0.933333333 | 0.933333333 | 0.933333333 | NLGN3 AND NOT-CDH4 | 0.903225806 | 0.875 | 0.933333333 |
| TNFRSF8 AND NOT-TMEM17 | 0.933333333 | 0.933333333 | 0.933333333 | NLGN3 AND NOT-NLGN3 | 0.903225806 | 0.875 | 0.933333333 |
| TNFRSF8 AND NOT-GABRR3 | 0.933333333 | 0.933333333 | 0.933333333 | NLGN3 AND NOT-APELA | 0.903225806 | 0.875 | 0.933333333 |
| TNFRSF8 AND NOT-PLD6 | 0.933333333 | 0.933333333 | 0.933333333 | NLGN3 AND NOT-ZMYM6NB | 0.933333333 | 0.933333333 | 0.933333333 |
| TNFRSF8 AND NOT-C17orf74 | 0.933333333 | 0.933333333 | 0.933333333 | NLGN3 AND NOT-MRLN | 0.903225806 | 0.875 | 0.933333333 |
| TNFRSF8 AND NOT-SLC39A11 | 0.933333333 | 0.933333333 | 0.933333333 | NLGN3 AND NOT-SMLR1 | 0.903225806 | 0.875 | 0.933333333 |
| TNFRSF8 AND NOT-TMEM154 | 0.965517241 | 1 | 0.933333333 | NLGN3 AND NOT-MICA | 0.933333333 | 0.933333333 | 0.933333333 |
| TNFRSF8 AND NOT-TAPT1 | 0.933333333 | 0.933333333 | 0.933333333 | NLGN3 AND NOT-SLC17A4 | 0.903225806 | 0.875 | 0.933333333 |
| TNFRSF8 AND NOT-DNAJC18 | 0.933333333 | 0.933333333 | 0.933333333 | NLGN3 AND NOT-NLGN3 | 0.903225806 | 0.875 | 0.933333333 |
| TNFRSF8 AND NOT-GAPT | 0.965517241 | 1 | 0.933333333 | NLGN3 AND NOT-NLGN3 | 0.903225806 | 0.875 | 0.933333333 |
| TNFRSF8 AND NOT-SLC29A1 | 0.933333333 | 0.933333333 | 0.933333333 | NLGN3 AND NOT-ABCC5 | 0.903225806 | 0.875 | 0.933333333 |
| TNFRSF8 AND NOT-HTRA4 | 0.933333333 | 0.933333333 | 0.933333333 | NLGN3 AND NOT-ABCB6 | 0.903225806 | 0.875 | 0.933333333 |
| TNFRSF8 AND NOT-C9orf91 | 0.965517241 | 1 | 0.933333333 | NLGN3 AND NOT-SCAMP3 | 0.933333333 | 0.933333333 | 0.933333333 |
| TNFRSF8 AND NOT-SUSD3 | 0.928571429 | 1 | 0.866666667 | NLGN3 AND NOT-MUC12 | 0.903225806 | 0.875 | 0.933333333 |
| TNFRSF8 AND NOT-ANO5 | 0.933333333 | 0.933333333 | 0.933333333 | NLGN3 AND NOT-NLGN3 | 0.903225806 | 0.875 | 0.933333333 |
| TNFRSF8 AND NOT-EPHA3 | 0.933333333 | 0.933333333 | 0.933333333 | NLGN3 AND NOT-TMEM265 | 0.903225806 | 0.875 | 0.933333333 |
| TNFRSF8 AND NOT-EPHA4 | 0.965517241 | 1 | 0.933333333 | NLGN3 AND NOT-KCNK7 | 0.903225806 | 0.875 | 0.933333333 |
| TNFRSF8 AND NOT-EPHA5 | 0.933333333 | 0.933333333 | 0.933333333 | NLGN3 AND NOT-TSPAN5 | 0.903225806 | 0.875 | 0.933333333 |
| TNFRSF8 AND NOT-EPHA8 | 0.928571429 | 1 | 0.866666667 | NLGN3 AND NOT-NLGN3 | 0.903225806 | 0.875 | 0.933333333 |
| TNFRSF8 AND NOT-EPHB4 | 0.933333333 | 0.933333333 | 0.933333333 | NLGN3 AND NOT-TSPAN2 | 0.903225806 | 0.875 | 0.933333333 |
| TNFRSF8 AND NOT-EPHB6 | 0.933333333 | 0.933333333 | 0.933333333 | NLGN3 AND NOT-TSPAN1 | 0.903225806 | 0.875 | 0.933333333 |
| TNFRSF8 AND NOT-CLN8 | 0.933333333 | 0.933333333 | 0.933333333 | NLGN3 AND NOT-CDH12 | 0.903225806 | 0.875 | 0.933333333 |
| TNFRSF8 AND NOT-LVRN | 0.933333333 | 0.933333333 | 0.933333333 | NLGN3 AND NOT-PREB | 0.933333333 | 0.933333333 | 0.933333333 |
| TNFRSF8 AND NOT-SLC36A1 | 0.965517241 | 1 | 0.933333333 | NLGN3 AND NOT-CLEC3A | 0.903225806 | 0.875 | 0.933333333 |
| TNFRSF8 AND NOT-ERBB2 | 0.965517241 | 1 | 0.933333333 | NLGN3 AND NOT-ADGRG2 | 0.903225806 | 0.875 | 0.933333333 |
| TNFRSF8 AND NOT-ERBB3 | 0.933333333 | 0.933333333 | 0.933333333 | NLGN3 AND NOT-PDZK1IP1 | 0.903225806 | 0.875 | 0.933333333 |
| TNFRSF8 AND NOT-ERBB4 | 0.933333333 | 0.933333333 | 0.933333333 | SLC4A4 AND NOT-PDZK1IP1 | 0.928571429 | 1 | 0.866666667 |
| TNFRSF8 AND NOT-EREG | 0.933333333 | 0.933333333 | 0.933333333 | NLGN3 AND NOT-CDH17 | 0.933333333 | 0.933333333 | 0.933333333 |
| TNFRSF8 AND NOT-ERN1 | 0.965517241 | 1 | 0.933333333 | NLGN3 AND NOT-LPCAT3 | 0.903225806 | 0.875 | 0.933333333 |
| TNFRSF8 AND NOT-ETFDH | 0.933333333 | 0.933333333 | 0.933333333 | NLGN3 AND NOT-CHST4 | 0.903225806 | 0.875 | 0.933333333 |
| TNFRSF8 AND NOT-EVC | 0.933333333 | 0.933333333 | 0.933333333 | NLGN3 AND NOT-CDH18 | 0.903225806 | 0.875 | 0.933333333 |
| TNFRSF8 AND NOT-EXTL3 | 0.965517241 | 1 | 0.933333333 | NLGN3 AND NOT-DHRS9 | 0.903225806 | 0.875 | 0.933333333 |
| TNFRSF8 AND NOT-F10 | 0.933333333 | 0.933333333 | 0.933333333 | NLGN3 AND NOT-TENM1 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-LRRC55 | 0.933333333 | 0.933333333 | 0.933333333 | NLGN3 AND NOT-LHFPL2 | 0.933333333 | 0.933333333 | 0.933333333 |
| TNFRSF8 AND NOT-TMEM26 | 0.933333333 | 0.933333333 | 0.933333333 | NLGN3 AND NOT-NLGN3 | 0.903225806 | 0.875 | 0.933333333 |
| TNFRSF8 AND NOT-FAT2 | 0.933333333 | 0.933333333 | 0.933333333 | NLGN3 AND NOT-ADAM8 | 0.903225806 | 0.875 | 0.933333333 |
| TNFRSF8 AND NOT-C10orf35 | 0.933333333 | 0.933333333 | 0.933333333 | NLGN3 AND NOT-DHRS2 | 0.903225806 | 0.875 | 0.933333333 |
| TNFRSF8 AND NOT-GJD4 | 0.933333333 | 0.933333333 | 0.933333333 | NLGN3 AND NOT-MPZL2 | 0.903225806 | 0.875 | 0.933333333 |
| TNFRSF8 AND NOT-ABCA3 | 0.933333333 | 0.933333333 | 0.933333333 | NLGN3 AND NOT-TRIM13 | 0.903225806 | 0.875 | 0.933333333 |
| TNFRSF8 AND NOT-LRTOMT | 0.933333333 | 0.933333333 | 0.933333333 | NLGN3 AND NOT-ANGPTL7 | 0.903225806 | 0.875 | 0.933333333 |
| TNFRSF8 AND NOT-FBN2 | 0.965517241 | 1 | 0.933333333 | NLGN3 AND NOT-KLRG1 | 0.903225806 | 0.875 | 0.933333333 |
| TNFRSF8 AND NOT-FCAR | 0.933333333 | 0.933333333 | 0.933333333 | NLGN3 AND NOT-GPA33 | 0.903225806 | 0.875 | 0.933333333 |
| TNFRSF8 AND NOT-MS4A2 | 0.928571429 | 1 | 0.866666667 | NLGN3 AND NOT-CD96 | 0.903225806 | 0.875 | 0.933333333 |
| TNFRSF8 AND NOT-FCER2 | 0.933333333 | 0.933333333 | 0.933333333 | NLGN3 AND NOT-STX6 | 0.903225806 | 0.875 | 0.933333333 |
| TNFRSF8 AND NOT-MARCH8 | 0.933333333 | 0.933333333 | 0.933333333 | NLGN3 AND NOT-SLC35B1 | 0.903225806 | 0.875 | 0.933333333 |
| TNFRSF8 AND NOT-LRRN4CL | 0.933333333 | 0.933333333 | 0.933333333 | NLGN3 AND NOT-NLGN3 | 0.903225806 | 0.875 | 0.933333333 |
| TNFRSF8 AND NOT-CES5A | 0.933333333 | 0.933333333 | 0.933333333 | NLGN3 AND NOT-IGSF6 | 0.903225806 | 0.875 | 0.933333333 |
| TNFRSF8 AND NOT-OPN5 | 0.933333333 | 0.933333333 | 0.933333333 | NLGN3 AND NOT-RAMP2 | 0.903225806 | 0.875 | 0.933333333 |
| TNFRSF8 AND NOT-FCGR2B | 0.965517241 | 1 | 0.933333333 | NLGN3 AND NOT-RAMP3 | 0.928571429 | 1 | 0.866666667 |
| TNFRSF8 AND NOT-PI16 | 0.933333333 | 0.933333333 | 0.933333333 | NLGN3 AND NOT-NLGN3 | 0.903225806 | 0.875 | 0.933333333 |
| TNFRSF8 AND NOT-C6orf89 | 0.933333333 | 0.933333333 | 0.933333333 | NLGN3 AND NOT-SIGMAR1 | 0.933333333 | 0.933333333 | 0.933333333 |
| TNFRSF8 AND NOT-FCGR3B | 0.928571429 | 1 | 0.866666667 | NLGN3 AND NOT-BET1 | 0.933333333 | 0.933333333 | 0.933333333 |
| TNFRSF8 AND NOT-RNF182 | 0.933333333 | 0.933333333 | 0.933333333 | NLGN3 AND NOT-LILRB2 | 0.965517241 | 1 | 0.933333333 |
| TNFRSF8 AND NOT-DAGLB | 0.928571429 | 1 | 0.866666667 | NLGN3 AND NOT-MARCH6 | 0.903225806 | 0.875 | 0.933333333 |
| TNFRSF8 AND NOT-ADGRG3 | 0.933333333 | 0.933333333 | 0.933333333 | NLGN3 AND NOT-TCIRG1 | 0.933333333 | 0.933333333 | 0.933333333 |
| TNFRSF8 AND NOT-GPRC6A | 0.933333333 | 0.933333333 | 0.933333333 | NLGN3 AND NOT-NMUR1 | 0.903225806 | 0.875 | 0.933333333 |
| TNFRSF8 AND NOT-ADGRF2 | 0.933333333 | 0.933333333 | 0.933333333 | NLGN3 AND NOT-B3GALT5 | 0.903225806 | 0.875 | 0.933333333 |
| TNFRSF8 AND NOT-UNC5CL | 0.933333333 | 0.933333333 | 0.933333333 | NLGN3 AND NOT-CRISP3 | 0.903225806 | 0.875 | 0.933333333 |
| TNFRSF8 AND NOT-TMEM130 | 0.933333333 | 0.933333333 | 0.933333333 | NLGN3 AND NOT-SIRPB1 | 0.903225806 | 0.875 | 0.933333333 |
| TNFRSF8 AND NOT-SLC29A4 | 0.933333333 | 0.933333333 | 0.933333333 | NLGN3 AND NOT-B3GNT3 | 0.933333333 | 0.933333333 | 0.933333333 |
| TNFRSF8 AND NOT-SEMA3D | 0.933333333 | 0.933333333 | 0.933333333 | NLGN3 AND NOT-CLEC4M | 0.903225806 | 0.875 | 0.933333333 |
| TNFRSF8 AND NOT-FGF4 | 0.933333333 | 0.933333333 | 0.933333333 | NLGN3 AND NOT-TLR6 | 0.903225806 | 0.875 | 0.933333333 |
| TNFRSF8 AND NOT-FGFR3 | 0.933333333 | 0.933333333 | 0.933333333 | NLGN3 AND NOT-NLGN3 | 0.903225806 | 0.875 | 0.933333333 |
| TNFRSF8 AND NOT-FGFR2 | 0.933333333 | 0.933333333 | 0.933333333 | NLGN3 AND NOT-PCGF3 | 0.933333333 | 0.933333333 | 0.933333333 |
| TNFRSF8 AND NOT-FGFR4 | 0.933333333 | 0.933333333 | 0.933333333 | NLGN3 AND NOT-PKDREJ | 0.933333333 | 0.933333333 | 0.933333333 |
| TNFRSF8 AND NOT-ITGA11 | 0.933333333 | 0.933333333 | 0.933333333 | NLGN3 AND NOT-NLGN3 | 0.903225806 | 0.875 | 0.933333333 |
| TNFRSF8 AND NOT-FKBP1A | 0.933333333 | 0.933333333 | 0.933333333 | NLGN3 AND NOT-NLGN3 | 0.903225806 | 0.875 | 0.933333333 |
| TNFRSF8 AND NOT-LMTK2 | 0.965517241 | 1 | 0.933333333 | NLGN3 AND NOT-BTN2A2 | 0.933333333 | 0.933333333 | 0.933333333 |
| TNFRSF8 AND NOT-ZP1 | 0.933333333 | 0.933333333 | 0.933333333 | NLGN3 AND NOT-CEPT1 | 0.933333333 | 0.933333333 | 0.933333333 |
| TNFRSF8 AND NOT-SORCS3 | 0.965517241 | 1 | 0.933333333 | NLGN3 AND NOT-ATP8A1 | 0.903225806 | 0.875 | 0.933333333 |
| TNFRSF8 AND NOT-SV2C | 0.965517241 | 1 | 0.933333333 | NLGN3 AND NOT-NDRG1 | 0.903225806 | 0.875 | 0.933333333 |
| TNFRSF8 AND NOT-FAIM2 | 0.933333333 | 0.933333333 | 0.933333333 | NLGN3 AND NOT-ST3GAL6 | 0.903225806 | 0.875 | 0.933333333 |
| TNFRSF8 AND NOT-TMCC1 | 0.933333333 | 0.933333333 | 0.933333333 | NLGN3 AND NOT-TIMM17A | 0.933333333 | 0.933333333 | 0.933333333 |
| TNFRSF8 AND NOT-PLXND1 | 0.933333333 | 0.933333333 | 0.933333333 | NLGN3 AND NOT-MERTK | 0.933333333 | 0.933333333 | 0.933333333 |
| TNFRSF8 AND NOT-LRCH1 | 0.933333333 | 0.933333333 | 0.933333333 | NLGN3 AND NOT-CLEC10A | 0.933333333 | 0.933333333 | 0.933333333 |
| TNFRSF8 AND NOT-SNX13 | 0.965517241 | 1 | 0.933333333 | NLGN3 AND NOT-SLC9A6 | 0.903225806 | 0.875 | 0.933333333 |
| TNFRSF8 AND NOT-SLC35D1 | 0.933333333 | 0.933333333 | 0.933333333 | NLGN3 AND NOT-NLGN3 | 0.903225806 | 0.875 | 0.933333333 |
| TNFRSF8 AND NOT-ATP11B | 0.933333333 | 0.933333333 | 0.933333333 | NLGN3 AND NOT-VTI1B | 0.903225806 | 0.875 | 0.933333333 |
| TNFRSF8 AND NOT-MLC1 | 0.965517241 | 1 | 0.933333333 | CSPG5 AND CRTAP | 0.909090909 | 0.833333333 | 1 |
| TNFRSF8 AND NOT-NUP210 | 0.933333333 | 0.933333333 | 0.933333333 | NLGN3 AND NOT-CRTAP | 0.933333333 | 0.933333333 | 0.933333333 |
| TNFRSF8 AND NOT-SEL1L3 | 0.933333333 | 0.933333333 | 0.933333333 | NLGN3 AND NOT-NLGN3 | 0.903225806 | 0.875 | 0.933333333 |
| TNFRSF8 AND NOT-FLT3LG | 0.965517241 | 1 | 0.933333333 | NLGN3 AND NOT-DEAF1 | 0.903225806 | 0.875 | 0.933333333 |
| TNFRSF8 AND NOT-KIAA1024 | 0.933333333 | 0.933333333 | 0.933333333 | NLGN3 AND NOT-NLGN3 | 0.903225806 | 0.875 | 0.933333333 |
| TNFRSF8 AND NOT-ACSL6 | 0.965517241 | 1 | 0.933333333 | NLGN3 AND NOT-HTATIP2 | 0.933333333 | 0.933333333 | 0.933333333 |
| TNFRSF8 AND NOT-FMO5 | 0.928571429 | 1 | 0.866666667 | NLGN3 AND NOT-AGPAT2 | 0.933333333 | 0.933333333 | 0.933333333 |
| TNFRSF8 AND NOT-SLC9A8 | 0.933333333 | 0.933333333 | 0.933333333 | NLGN3 AND NOT-SLC19A2 | 0.933333333 | 0.933333333 | 0.933333333 |
| TNFRSF8 AND NOT-DNAJC16 | 0.965517241 | 1 | 0.933333333 | NLGN3 AND NOT-SLC34A2 | 0.903225806 | 0.875 | 0.933333333 |
| TNFRSF8 AND NOT-FAM189A1 | 0.933333333 | 0.933333333 | 0.933333333 | NLGN3 AND NOT-SLCO1B1 | 0.933333333 | 0.933333333 | 0.933333333 |
| TNFRSF8 AND NOT-KCNH4 | 0.933333333 | 0.933333333 | 0.933333333 | NLGN3 AND NOT-ST6GALNAC2 | 0.903225806 | 0.875 | 0.933333333 |
| TNFRSF8 AND NOT-TMED3 | 0.933333333 | 0.933333333 | 0.933333333 | NLGN3 AND NOT-SPINT2 | 0.933333333 | 0.933333333 | 0.933333333 |
| TNFRSF8 AND NOT-ATP1B4 | 0.933333333 | 0.933333333 | 0.933333333 | NLGN3 AND NOT-DMRT2 | 0.903225806 | 0.875 | 0.933333333 |
| TNFRSF8 AND NOT-SLC44A1 | 0.933333333 | 0.933333333 | 0.933333333 | NLGN3 AND NOT-CXCR6 | 0.903225806 | 0.875 | 0.933333333 |
| TNFRSF8 AND NOT-ABCA5 | 0.933333333 | 0.933333333 | 0.933333333 | NLGN3 AND NOT-C6orf10 | 0.903225806 | 0.875 | 0.933333333 |
| TNFRSF8 AND NOT-FOLR1 | 0.933333333 | 0.933333333 | 0.933333333 | NLGN3 AND NOT-CD226 | 0.933333333 | 0.933333333 | 0.933333333 |
| TNFRSF8 AND NOT-LRRC8B | 0.933333333 | 0.933333333 | 0.933333333 | NLGN3 AND NOT-NLGN3 | 0.903225806 | 0.875 | 0.933333333 |
| TNFRSF8 AND NOT-SLC39A14 | 0.933333333 | 0.933333333 | 0.933333333 | CSPG5 AND TMEM115 | 0.909090909 | 0.833333333 | 1 |
| TNFRSF8 AND NOT-NNT | 0.933333333 | 0.933333333 | 0.933333333 | CSPG5 AND TSPAN11 | 0.909090909 | 0.833333333 | 1 |
| TNFRSF8 AND NOT-OR52A1 | 0.933333333 | 0.933333333 | 0.933333333 | CSPG5 AND P2RX4 | 0.909090909 | 0.833333333 | 1 |
| TNFRSF8 AND NOT-SLC16A8 | 0.933333333 | 0.933333333 | 0.933333333 | CSPG5 AND SOAT1 | 0.909090909 | 0.833333333 | 1 |
| TNFRSF8 AND NOT-SEZ6L | 0.928571429 | 1 | 0.866666667 | CSPG5 AND JAGN1 | 0.909090909 | 0.833333333 | 1 |
| TNFRSF8 AND NOT-SYNGR4 | 0.933333333 | 0.933333333 | 0.933333333 | CSPG5 AND GPAA1 | 0.909090909 | 0.833333333 | 1 |
| TNFRSF8 AND NOT-HYAL4 | 0.933333333 | 0.933333333 | 0.933333333 | NLGN3 AND NOT-CLDN16 | 0.903225806 | 0.875 | 0.933333333 |
| TNFRSF8 AND NOT-PIGN | 0.933333333 | 0.933333333 | 0.933333333 | NLGN3 AND NOT-RRH | 0.903225806 | 0.875 | 0.933333333 |
| TNFRSF8 AND NOT-FPR1 | 0.965517241 | 1 | 0.933333333 | NLGN3 AND NOT-CORIN | 0.903225806 | 0.875 | 0.933333333 |
| TNFRSF8 AND NOT-VSIG2 | 0.933333333 | 0.933333333 | 0.933333333 | NLGN3 AND NOT-FAM189B | 0.903225806 | 0.875 | 0.933333333 |
| TNFRSF8 AND NOT-LEMD3 | 0.933333333 | 0.933333333 | 0.933333333 | NLGN3 AND NOT-NRG3 | 0.903225806 | 0.875 | 0.933333333 |
| TNFRSF8 AND NOT-CLEC5A | 0.965517241 | 1 | 0.933333333 | NLGN3 AND NOT-SLC12A7 | 0.933333333 | 0.933333333 | 0.933333333 |
| TNFRSF8 AND NOT-NTSR2 | 0.965517241 | 1 | 0.933333333 | NLGN3 AND NOT-PHTF1 | 0.903225806 | 0.875 | 0.933333333 |
| TNFRSF8 AND NOT-KCNE5 | 0.933333333 | 0.933333333 | 0.933333333 | NLGN3 AND NOT-NLGN3 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-CA14 | 0.933333333 | 0.933333333 | 0.933333333 | NLGN3 AND NOT-ZMYND11 | 0.903225806 | 0.875 | 0.933333333 |
| TNFRSF8 AND NOT-TMEM2 | 0.928571429 | 1 | 0.866666667 | NLGN3 AND NOT-SLC17A3 | 0.903225806 | 0.875 | 0.933333333 |
| TNFRSF8 AND NOT-STX12 | 0.933333333 | 0.933333333 | 0.933333333 | NLGN3 AND NOT-OR5I1 | 0.903225806 | 0.875 | 0.933333333 |
| TNFRSF8 AND NOT-FRRS1L | 0.933333333 | 0.933333333 | 0.933333333 | NLGN3 AND NOT-CYSLTR1 | 0.933333333 | 0.933333333 | 0.933333333 |
| TNFRSF8 AND NOT-FLRT1 | 0.928571429 | 1 | 0.866666667 | NLGN3 AND NOT-CFTR | 0.903225806 | 0.875 | 0.933333333 |
| TNFRSF8 AND NOT-FKBP8 | 0.933333333 | 0.933333333 | 0.933333333 | NLGN3 AND NOT-FAXDC2 | 0.933333333 | 0.933333333 | 0.933333333 |
| TNFRSF8 AND NOT-APOL2 | 0.933333333 | 0.933333333 | 0.933333333 | NLGN3 AND NOT-LILRB1 | 0.903225806 | 0.875 | 0.933333333 |
| TNFRSF8 AND NOT-BCL2L13 | 0.933333333 | 0.933333333 | 0.933333333 | NLGN3 AND NOT-SLC26A1 | 0.903225806 | 0.875 | 0.933333333 |
| TNFRSF8 AND NOT-EML2 | 0.933333333 | 0.933333333 | 0.933333333 | NLGN3 AND NOT-ADAM28 | 0.903225806 | 0.875 | 0.933333333 |
| TNFRSF8 AND NOT-CLDN15 | 0.933333333 | 0.933333333 | 0.933333333 | NLGN3 AND NOT-SLC22A7 | 0.903225806 | 0.875 | 0.933333333 |
| TNFRSF8 AND NOT-MS4A6E | 0.933333333 | 0.933333333 | 0.933333333 | NLGN3 AND NOT-TSPAN9 | 0.903225806 | 0.875 | 0.933333333 |
| TNFRSF8 AND NOT-FUT4 | 0.928571429 | 1 | 0.866666667 | NLGN3 AND NOT-USP19 | 0.903225806 | 0.875 | 0.933333333 |
| TNFRSF8 AND NOT-FUT7 | 0.933333333 | 0.933333333 | 0.933333333 | NLGN3 AND NOT-CD300C | 0.903225806 | 0.875 | 0.933333333 |
| TNFRSF8 AND NOT-FZD2 | 0.933333333 | 0.933333333 | 0.933333333 | NLGN3 AND NOT-NLGN3 | 0.903225806 | 0.875 | 0.933333333 |
| TNFRSF8 AND NOT-CNIH2 | 0.933333333 | 0.933333333 | 0.933333333 | NLGN3 AND NOT-EDDM3A | 0.903225806 | 0.875 | 0.933333333 |
| TNFRSF8 AND NOT-SLC41A1 | 0.933333333 | 0.933333333 | 0.933333333 | NLGN3 AND NOT-CEACAM7 | 0.903225806 | 0.875 | 0.933333333 |
| TNFRSF8 AND NOT-NAALADL2 | 0.933333333 | 0.933333333 | 0.933333333 | NLGN3 AND NOT-NPFFR2 | 0.903225806 | 0.875 | 0.933333333 |
| TNFRSF8 AND NOT-CALHM1 | 0.933333333 | 0.933333333 | 0.933333333 | NLGN3 AND NOT-NLGN3 | 0.903225806 | 0.875 | 0.933333333 |
| TNFRSF8 AND NOT-TMEM86B | 0.933333333 | 0.933333333 | 0.933333333 | NLGN3 AND NOT-LYVE1 | 0.933333333 | 0.933333333 | 0.933333333 |
| TNFRSF8 AND NOT-C19orf26 | 0.933333333 | 0.933333333 | 0.933333333 | NLGN3 AND NOT-OCLM | 0.903225806 | 0.875 | 0.933333333 |
| TNFRSF8 AND NOT-GABBR1 | 0.933333333 | 0.933333333 | 0.933333333 | NLGN3 AND NOT-NLGN3 | 0.903225806 | 0.875 | 0.933333333 |
| TNFRSF8 AND NOT-MYADML2 | 0.933333333 | 0.933333333 | 0.933333333 | NLGN3 AND NOT-CEACAM4 | 0.903225806 | 0.875 | 0.933333333 |
| TNFRSF8 AND NOT-COL24A1 | 0.933333333 | 0.933333333 | 0.933333333 | NLGN3 AND NOT-ADCY2 | 0.903225806 | 0.875 | 0.933333333 |
| TNFRSF8 AND NOT-GABRA4 | 0.933333333 | 0.933333333 | 0.933333333 | NLGN3 AND NOT-BLCAP | 0.933333333 | 0.933333333 | 0.933333333 |
| TNFRSF8 AND NOT-GABRA5 | 0.933333333 | 0.933333333 | 0.933333333 | NLGN3 AND NOT-EDAR | 0.933333333 | 0.933333333 | 0.933333333 |
| TNFRSF8 AND NOT-GABRA6 | 0.933333333 | 0.933333333 | 0.933333333 | NLGN3 AND NOT-BTNL3 | 0.903225806 | 0.875 | 0.933333333 |
| TNFRSF8 AND NOT-TMEM196 | 0.933333333 | 0.933333333 | 0.933333333 | NLGN3 AND NOT-NLGN3 | 0.903225806 | 0.875 | 0.933333333 |
| TNFRSF8 AND NOT-CDRT15L2 | 0.933333333 | 0.933333333 | 0.933333333 | NLGN3 AND NOT-KDELR1 | 0.933333333 | 0.933333333 | 0.933333333 |
| TNFRSF8 AND NOT-STEAP1B | 0.933333333 | 0.933333333 | 0.933333333 | NLGN3 AND NOT-STARD3 | 0.903225806 | 0.875 | 0.933333333 |
| TNFRSF8 AND NOT-GABRB3 | 0.933333333 | 0.933333333 | 0.933333333 | NLGN3 AND NOT-NLGN3 | 0.903225806 | 0.875 | 0.933333333 |
| TNFRSF8 AND NOT-GABRD | 0.933333333 | 0.933333333 | 0.933333333 | NLGN3 AND NOT-ERP29 | 0.933333333 | 0.933333333 | 0.933333333 |
| TNFRSF8 AND NOT-ST6GALNAC3 | 0.933333333 | 0.933333333 | 0.933333333 | NLGN3 AND NOT-TMED10 | 0.933333333 | 0.933333333 | 0.933333333 |
| TNFRSF8 AND NOT-MFSD8 | 0.933333333 | 0.933333333 | 0.933333333 | NLGN3 AND NOT-LILRB5 | 0.933333333 | 0.933333333 | 0.933333333 |
| TNFRSF8 AND NOT-GABRG1 | 0.933333333 | 0.933333333 | 0.933333333 | NLGN3 AND NOT-SLC27A5 | 0.903225806 | 0.875 | 0.933333333 |
| TNFRSF8 AND NOT-GABRG2 | 0.933333333 | 0.933333333 | 0.933333333 | NLGN3 AND NOT-SLC27A4 | 0.903225806 | 0.875 | 0.933333333 |
| TNFRSF8 AND NOT-GABRP | 0.933333333 | 0.933333333 | 0.933333333 | NLGN3 AND NOT-NAT2 | 0.903225806 | 0.875 | 0.933333333 |
| TNFRSF8 AND NOT-GABRR1 | 0.933333333 | 0.933333333 | 0.933333333 | NLGN3 AND NOT-SLC27A3 | 0.903225806 | 0.875 | 0.933333333 |
| TNFRSF8 AND NOT-FRMD3 | 0.965517241 | 1 | 0.933333333 | NLGN3 AND NOT-LILRB4 | 0.903225806 | 0.875 | 0.933333333 |
| TNFRSF8 AND NOT-GABRR2 | 0.933333333 | 0.933333333 | 0.933333333 | NLGN3 AND NOT-GLIPR1 | 0.933333333 | 0.933333333 | 0.933333333 |
| TNFRSF8 AND NOT-UTS2B | 0.933333333 | 0.933333333 | 0.933333333 | NLGN3 AND NOT-KDELR3 | 0.933333333 | 0.933333333 | 0.933333333 |
| TNFRSF8 AND NOT-KIAA1549L | 0.933333333 | 0.933333333 | 0.933333333 | NLGN3 AND NOT-ATF7 | 0.903225806 | 0.875 | 0.933333333 |
| TNFRSF8 AND NOT-SLC24A2 | 0.933333333 | 0.933333333 | 0.933333333 | NLGN3 AND NOT-TDRKH | 0.903225806 | 0.875 | 0.933333333 |
| TNFRSF8 AND NOT-SUN2 | 0.965517241 | 1 | 0.933333333 | NLGN3 AND NOT-LILRB3 | 0.965517241 | 1 | 0.933333333 |
| TNFRSF8 AND NOT-TMEM59L | 0.933333333 | 0.933333333 | 0.933333333 | NLGN3 AND NOT-UPK1A | 0.903225806 | 0.875 | 0.933333333 |
| TNFRSF8 AND NOT-FAM19A5 | 0.933333333 | 0.933333333 | 0.933333333 | NLGN3 AND NOT-ZPBP | 0.903225806 | 0.875 | 0.933333333 |
| TNFRSF8 AND NOT-KLK5 | 0.933333333 | 0.933333333 | 0.933333333 | NLGN3 AND NOT-LECT1 | 0.903225806 | 0.875 | 0.933333333 |
| TNFRSF8 AND NOT-GALC | 0.933333333 | 0.933333333 | 0.933333333 | NLGN3 AND NOT-CYB561D2 | 0.928571429 | 1 | 0.866666667 |
| TNFRSF8 AND NOT-TPSG1 | 0.933333333 | 0.933333333 | 0.933333333 | SORCS3 AND TMEM115 | 0.909090909 | 0.833333333 | 1 |
| TNFRSF8 AND NOT-YIPF3 | 0.933333333 | 0.933333333 | 0.933333333 | NLGN3 AND NOT-TMEM115 | 0.933333333 | 0.933333333 | 0.933333333 |
| TNFRSF8 AND NOT-PARM1 | 0.933333333 | 0.933333333 | 0.933333333 | NLGN3 AND NOT-ADAM30 | 0.903225806 | 0.875 | 0.933333333 |
| TNFRSF8 AND NOT-SUMF2 | 0.933333333 | 0.933333333 | 0.933333333 | NLGN3 AND NOT-ADAM29 | 0.903225806 | 0.875 | 0.933333333 |
| TNFRSF8 AND NOT-GALR1 | 0.933333333 | 0.933333333 | 0.933333333 | NLGN3 AND NOT-CACFD1 | 0.903225806 | 0.875 | 0.933333333 |
| TNFRSF8 AND NOT-GALNT3 | 0.928571429 | 1 | 0.866666667 | NLGN3 AND NOT-NLGN3 | 0.903225806 | 0.875 | 0.933333333 |
| TNFRSF8 AND NOT-LY6G6F | 0.933333333 | 0.933333333 | 0.933333333 | NLGN3 AND NOT-BTN3A1 | 0.933333333 | 0.933333333 | 0.933333333 |
| TNFRSF8 AND NOT-TAS2R39 | 0.933333333 | 0.933333333 | 0.933333333 | NLGN3 AND NOT-BTN2A1 | 0.903225806 | 0.875 | 0.933333333 |
| TNFRSF8 AND NOT-TAS2R40 | 0.933333333 | 0.933333333 | 0.933333333 | NLGN3 AND NOT-PTPRT | 0.903225806 | 0.875 | 0.933333333 |
| TNFRSF8 AND NOT-TAS2R41 | 0.933333333 | 0.933333333 | 0.933333333 | NLGN3 AND NOT-IL1RAPL1 | 0.903225806 | 0.875 | 0.933333333 |
| TNFRSF8 AND NOT-FAM205A | 0.933333333 | 0.933333333 | 0.933333333 | NLGN3 AND NOT-PLA2G16 | 0.933333333 | 0.933333333 | 0.933333333 |
| TNFRSF8 AND NOT-RNF167 | 0.933333333 | 0.933333333 | 0.933333333 | NLGN3 AND NOT-HHLA2 | 0.903225806 | 0.875 | 0.933333333 |
| TNFRSF8 AND NOT-ATRNL1 | 0.933333333 | 0.933333333 | 0.933333333 | NLGN3 AND NOT-ABCB8 | 0.903225806 | 0.875 | 0.933333333 |
| TNFRSF8 AND NOT-GLCE | 0.933333333 | 0.933333333 | 0.933333333 | NLGN3 AND NOT-ADCY5 | 0.903225806 | 0.875 | 0.933333333 |
| TNFRSF8 AND NOT-LRRTM2 | 0.933333333 | 0.933333333 | 0.933333333 | NLGN3 AND NOT-KLK8 | 0.903225806 | 0.875 | 0.933333333 |
| TNFRSF8 AND NOT-CNTNAP2 | 0.965517241 | 1 | 0.933333333 | NLGN3 AND NOT-FZD10 | 0.903225806 | 0.875 | 0.933333333 |
| TNFRSF8 AND NOT-SLITRK5 | 0.933333333 | 0.933333333 | 0.933333333 | NLGN3 AND NOT-GALNT5 | 0.903225806 | 0.875 | 0.933333333 |
| TNFRSF8 AND NOT-CFAP61 | 0.933333333 | 0.933333333 | 0.933333333 | NLGN3 AND NOT-PRAF2 | 0.933333333 | 0.933333333 | 0.933333333 |
| TNFRSF8 AND NOT-HERC4 | 0.933333333 | 0.933333333 | 0.933333333 | NLGN3 AND NOT-SEC63 | 0.903225806 | 0.875 | 0.933333333 |
| TNFRSF8 AND NOT-LRIT1 | 0.933333333 | 0.933333333 | 0.933333333 | NLGN3 AND NOT-NLGN3 | 0.903225806 | 0.875 | 0.933333333 |
| TNFRSF8 AND NOT-PCDHB5 | 0.933333333 | 0.933333333 | 0.933333333 | NLGN3 AND NOT-NLGN3 | 0.903225806 | 0.875 | 0.933333333 |
| TNFRSF8 AND NOT-NPHP4 | 0.933333333 | 0.933333333 | 0.933333333 | NLGN3 AND NOT-GPR45 | 0.933333333 | 0.933333333 | 0.933333333 |
| TNFRSF8 AND NOT-TMEM251 | 0.965517241 | 1 | 0.933333333 | NLGN3 AND NOT-MAN1B1 | 0.903225806 | 0.875 | 0.933333333 |
| TNFRSF8 AND NOT-OR2F1 | 0.933333333 | 0.933333333 | 0.933333333 | NLGN3 AND NOT-SLC6A14 | 0.903225806 | 0.875 | 0.933333333 |
| TNFRSF8 AND NOT-OR2B6 | 0.933333333 | 0.933333333 | 0.933333333 | NLGN3 AND NOT-CMTM7 | 0.965517241 | 1 | 0.933333333 |
| TNFRSF8 AND NOT-OR2L2 | 0.933333333 | 0.933333333 | 0.933333333 | NLGN3 AND NOT-STX1B | 0.903225806 | 0.875 | 0.933333333 |
| TNFRSF8 AND NOT-CLEC4E | 0.965517241 | 1 | 0.933333333 | NLGN3 AND NOT-NLGN3 | 0.903225806 | 0.875 | 0.933333333 |
| TNFRSF8 AND NOT-SLC13A4 | 0.933333333 | 0.933333333 | 0.933333333 | NLGN3 AND NOT-SCN11A | 0.903225806 | 0.875 | 0.933333333 |
| TNFRSF8 AND NOT-IL1RAPL2 | 0.933333333 | 0.933333333 | 0.933333333 | NLGN3 AND NOT-MGAT4B | 0.933333333 | 0.933333333 | 0.933333333 |

FIG. 1 (CONT.)

| Antigen Pair Logic | F1 | Precision | Recall |
|---|---|---|---|
| TNFRSF8 AND NOT-GALNT8 | 0.933333333 | 0.933333333 | 0.933333333 |
| TNFRSF8 AND NOT-OR7A17 | 0.933333333 | 0.933333333 | 0.933333333 |
| TNFRSF8 AND NOT-OR8B8 | 0.933333333 | 0.933333333 | 0.933333333 |
| TNFRSF8 AND NOT-OR10A3 | 0.933333333 | 0.933333333 | 0.933333333 |
| TNFRSF8 AND NOT-GCNT1 | 0.928571429 | 1 | 0.866666667 |
| TNFRSF8 AND NOT-CHIC2 | 0.965517241 | 1 | 0.933333333 |
| TNFRSF8 AND NOT-GCNT2 | 0.928571429 | 1 | 0.866666667 |
| TNFRSF8 AND NOT-TSPAN16 | 0.965517241 | 1 | 0.933333333 |
| TNFRSF8 AND NOT-OR10H3 | 0.928571429 | 1 | 0.866666667 |
| TNFRSF8 AND NOT-AMELX | 0.933333333 | 0.933333333 | 0.933333333 |
| TNFRSF8 AND NOT-GDF9 | 0.933333333 | 0.933333333 | 0.933333333 |
| TNFRSF8 AND NOT-OR7C2 | 0.933333333 | 0.933333333 | 0.933333333 |
| TNFRSF8 AND NOT-OR7C1 | 0.933333333 | 0.933333333 | 0.933333333 |
| TNFRSF8 AND NOT-BEST4 | 0.933333333 | 0.933333333 | 0.933333333 |
| TNFRSF8 AND NOT-HS6ST3 | 0.933333333 | 0.933333333 | 0.933333333 |
| TNFRSF8 AND NOT-GDNF | 0.933333333 | 0.933333333 | 0.933333333 |
| TNFRSF8 AND NOT-ADGRF1 | 0.933333333 | 0.933333333 | 0.933333333 |
| TNFRSF8 AND NOT-OR2H1 | 0.933333333 | 0.933333333 | 0.933333333 |
| TNFRSF8 AND NOT-OR1J2 | 0.933333333 | 0.933333333 | 0.933333333 |
| TNFRSF8 AND NOT-GGCX | 0.933333333 | 0.933333333 | 0.933333333 |
| TNFRSF8 AND NOT-B4GALT1 | 0.965517241 | 1 | 0.933333333 |
| TNFRSF8 AND NOT-GGT7 | 0.933333333 | 0.933333333 | 0.933333333 |
| TNFRSF8 AND NOT-GHRHR | 0.928571429 | 1 | 0.866666667 |
| TNFRSF8 AND NOT-GHSR | 0.933333333 | 0.933333333 | 0.933333333 |
| TNFRSF8 AND NOT-SEC22A | 0.933333333 | 0.933333333 | 0.933333333 |
| TNFRSF8 AND NOT-NOX1 | 0.933333333 | 0.933333333 | 0.933333333 |
| TNFRSF8 AND NOT-SIGLEC7 | 0.928571429 | 1 | 0.866666667 |
| TNFRSF8 AND NOT-PKD2L2 | 0.933333333 | 0.933333333 | 0.933333333 |
| TNFRSF8 AND NOT-NSG1 | 0.933333333 | 0.933333333 | 0.933333333 |
| TNFRSF8 AND NOT-GJB3 | 0.933333333 | 0.933333333 | 0.933333333 |
| TNFRSF8 AND NOT-ST6GALNAC4 | 0.933333333 | 0.933333333 | 0.933333333 |
| TNFRSF8 AND NOT-DKKL1 | 0.933333333 | 0.933333333 | 0.933333333 |
| TNFRSF8 AND NOT-KCNH5 | 0.933333333 | 0.933333333 | 0.933333333 |
| TNFRSF8 AND NOT-NAAA | 0.965517241 | 1 | 0.933333333 |
| TNFRSF8 AND NOT-SLC39A1 | 0.933333333 | 0.933333333 | 0.933333333 |
| TNFRSF8 AND NOT-SIGLEC9 | 0.928571429 | 1 | 0.866666667 |
| TNFRSF8 AND NOT-SIGLEC8 | 0.933333333 | 0.933333333 | 0.933333333 |
| TNFRSF8 AND NOT-GPR82 | 0.965517241 | 1 | 0.933333333 |
| TNFRSF8 AND NOT-HCAR1 | 0.933333333 | 0.933333333 | 0.933333333 |
| TNFRSF8 AND NOT-C5AR2 | 0.933333333 | 0.933333333 | 0.933333333 |
| TNFRSF8 AND NOT-COQ2 | 0.965517241 | 1 | 0.933333333 |
| TNFRSF8 AND NOT-GPR162 | 0.933333333 | 0.933333333 | 0.933333333 |
| TNFRSF8 AND NOT-BMP10 | 0.933333333 | 0.933333333 | 0.933333333 |
| TNFRSF8 AND NOT-PCDH11X | 0.933333333 | 0.933333333 | 0.933333333 |
| TNFRSF8 AND NOT-PCSK1N | 0.933333333 | 0.933333333 | 0.933333333 |
| TNFRSF8 AND NOT-TMEM97 | 0.933333333 | 0.933333333 | 0.933333333 |
| TNFRSF8 AND NOT-TOR1B | 0.933333333 | 0.933333333 | 0.933333333 |
| TNFRSF8 AND NOT-GLP1R | 0.933333333 | 0.933333333 | 0.933333333 |
| TNFRSF8 AND NOT-CECR6 | 0.965517241 | 1 | 0.933333333 |
| TNFRSF8 AND NOT-GNRHR | 0.933333333 | 0.933333333 | 0.933333333 |
| TNFRSF8 AND NOT-WFDC10B | 0.933333333 | 0.933333333 | 0.933333333 |
| TNFRSF8 AND NOT-GP2 | 0.933333333 | 0.933333333 | 0.933333333 |
| TNFRSF8 AND NOT-GP5 | 0.933333333 | 0.933333333 | 0.933333333 |
| TNFRSF8 AND NOT-GPD2 | 0.933333333 | 0.933333333 | 0.933333333 |
| TNFRSF8 AND NOT-GPM6B | 0.933333333 | 0.933333333 | 0.933333333 |
| TNFRSF8 AND NOT-IFNL2 | 0.933333333 | 0.933333333 | 0.933333333 |
| TNFRSF8 AND NOT-CCR10 | 0.933333333 | 0.933333333 | 0.933333333 |
| TNFRSF8 AND NOT-GPR3 | 0.933333333 | 0.933333333 | 0.933333333 |
| TNFRSF8 AND NOT-GPR4 | 0.933333333 | 0.933333333 | 0.933333333 |
| TNFRSF8 AND NOT-XCR1 | 0.933333333 | 0.933333333 | 0.933333333 |
| TNFRSF8 AND NOT-GPR6 | 0.933333333 | 0.933333333 | 0.933333333 |
| TNFRSF8 AND NOT-SLC25A45 | 0.933333333 | 0.933333333 | 0.933333333 |
| TNFRSF8 AND NOT-OR8D2 | 0.933333333 | 0.933333333 | 0.933333333 |
| TNFRSF8 AND NOT-CDH20 | 0.933333333 | 0.933333333 | 0.933333333 |
| TNFRSF8 AND NOT-OR10A4 | 0.933333333 | 0.933333333 | 0.933333333 |
| TNFRSF8 AND NOT-NPBWR2 | 0.933333333 | 0.933333333 | 0.933333333 |
| TNFRSF8 AND NOT-ADGRD1 | 0.965517241 | 1 | 0.933333333 |
| TNFRSF8 AND NOT-GXYLT1 | 0.928571429 | 1 | 0.866666667 |
| TNFRSF8 AND NOT-TMPRSS12 | 0.933333333 | 0.933333333 | 0.933333333 |
| TNFRSF8 AND NOT-ZDHHC22 | 0.933333333 | 0.933333333 | 0.933333333 |
| TNFRSF8 AND NOT-GPR12 | 0.933333333 | 0.933333333 | 0.933333333 |
| TNFRSF8 AND NOT-OR4N4 | 0.933333333 | 0.933333333 | 0.933333333 |
| TNFRSF8 AND NOT-UTS2R | 0.933333333 | 0.933333333 | 0.933333333 |
| TNFRSF8 AND NOT-TMEM235 | 0.933333333 | 0.933333333 | 0.933333333 |
| TNFRSF8 AND NOT-ANG | 0.933333333 | 0.933333333 | 0.933333333 |
| TNFRSF8 AND NOT-FAM171A2 | 0.933333333 | 0.933333333 | 0.933333333 |
| NLGN3 AND NOT-B4GALT7 | 0.933333333 | 0.933333333 | 0.933333333 |
| NLGN3 AND NOT-CHRM1 | 0.903225806 | 0.875 | 0.933333333 |
| NLGN3 AND NOT-CHRM2 | 0.903225806 | 0.875 | 0.933333333 |
| NLGN3 AND NOT-NLGN3 | 0.903225806 | 0.875 | 0.933333333 |
| NLGN3 AND NOT-SLCO2B1 | 0.903225806 | 0.875 | 0.933333333 |
| NLGN3 AND NOT-CD300A | 0.903225806 | 0.875 | 0.933333333 |
| NLGN3 AND NOT-SCAMP4 | 0.903225806 | 0.875 | 0.933333333 |
| NLGN3 AND NOT-GPR182 | 0.903225806 | 0.875 | 0.933333333 |
| NLGN3 AND NOT-CASC4 | 0.933333333 | 0.933333333 | 0.933333333 |
| NLGN3 AND NOT-NLGN3 | 0.903225806 | 0.875 | 0.933333333 |
| NLGN3 AND NOT-SLC46A1 | 0.933333333 | 0.933333333 | 0.933333333 |
| NLGN3 AND NOT-VSIG4 | 0.933333333 | 0.933333333 | 0.933333333 |
| NLGN3 AND NOT-TMEM106A | 0.933333333 | 0.933333333 | 0.933333333 |
| NLGN3 AND NOT-SLC52A3 | 0.928571429 | 1 | 0.866666667 |
| NLGN3 AND NOT-CHRM5 | 0.903225806 | 0.875 | 0.933333333 |
| NLGN3 AND NOT-NLGN3 | 0.903225806 | 0.875 | 0.933333333 |
| NLGN3 AND NOT-RNF13 | 0.928571429 | 1 | 0.866666667 |
| NLGN3 AND NOT-SMIM12 | 0.933333333 | 0.933333333 | 0.933333333 |
| NLGN3 AND NOT-NLGN3 | 0.903225806 | 0.875 | 0.933333333 |
| NLGN3 AND NOT-CHRNA1 | 0.903225806 | 0.875 | 0.933333333 |
| NLGN3 AND NOT-CMTM1 | 0.903225806 | 0.875 | 0.933333333 |
| NLGN3 AND NOT-CHRNA2 | 0.903225806 | 0.875 | 0.933333333 |
| NLGN3 AND NOT-NLGN3 | 0.903225806 | 0.875 | 0.933333333 |
| NLGN3 AND NOT-MFSD3 | 0.903225806 | 0.875 | 0.933333333 |
| NLGN3 AND NOT-SDSL | 0.903225806 | 0.875 | 0.933333333 |
| NLGN3 AND NOT-CHRNA3 | 0.903225806 | 0.875 | 0.933333333 |
| NLGN3 AND NOT-PIK3IP1 | 0.903225806 | 0.875 | 0.933333333 |
| NLGN3 AND NOT-SLC35A4 | 0.933333333 | 0.933333333 | 0.933333333 |
| NLGN3 AND NOT-CHRNA5 | 0.903225806 | 0.875 | 0.933333333 |
| NLGN3 AND NOT-ADCY7 | 0.903225806 | 0.875 | 0.933333333 |
| NLGN3 AND NOT-CHRNB1 | 0.933333333 | 0.933333333 | 0.933333333 |
| NLGN3 AND NOT-CHRNB3 | 0.903225806 | 0.875 | 0.933333333 |
| NLGN3 AND NOT-CHRNB4 | 0.903225806 | 0.875 | 0.933333333 |
| NLGN3 AND NOT-CHRND | 0.903225806 | 0.875 | 0.933333333 |
| NLGN3 AND NOT-SLC22A9 | 0.903225806 | 0.875 | 0.933333333 |
| NLGN3 AND NOT-ERMAP | 0.903225806 | 0.875 | 0.933333333 |
| NLGN3 AND NOT-NLGN3 | 0.903225806 | 0.875 | 0.933333333 |
| NLGN3 AND NOT-CHRNG | 0.903225806 | 0.875 | 0.933333333 |
| NLGN3 AND NOT-PKD1L2 | 0.903225806 | 0.875 | 0.933333333 |
| NLGN3 AND NOT-NLGN3 | 0.903225806 | 0.875 | 0.933333333 |
| NLGN3 AND NOT-CSMD2 | 0.903225806 | 0.875 | 0.933333333 |
| NLGN3 AND NOT-XKR4 | 0.903225806 | 0.875 | 0.933333333 |
| NLGN3 AND NOT-SLC25A25 | 0.933333333 | 0.933333333 | 0.933333333 |
| NLGN3 AND NOT-NLGN3 | 0.903225806 | 0.875 | 0.933333333 |
| NLGN3 AND NOT-SLITRK1 | 0.903225806 | 0.875 | 0.933333333 |
| NLGN3 AND NOT-TMEM200A | 0.933333333 | 0.933333333 | 0.933333333 |
| GRIK3 AND NOT-SORCS1 | 0.903225806 | 0.875 | 0.933333333 |
| NLGN3 AND NOT-SORCS1 | 0.903225806 | 0.875 | 0.933333333 |
| NLGN3 AND NOT-OSBPL8 | 0.933333333 | 0.933333333 | 0.933333333 |
| NLGN3 AND NOT-C1QTNF6 | 0.903225806 | 0.875 | 0.933333333 |
| NLGN3 AND NOT-ADCY8 | 0.903225806 | 0.875 | 0.933333333 |
| NLGN3 AND NOT-SLC26A9 | 0.903225806 | 0.875 | 0.933333333 |
| NLGN3 AND NOT-NLGN3 | 0.903225806 | 0.875 | 0.933333333 |
| NLGN3 AND NOT-OMA1 | 0.933333333 | 0.933333333 | 0.933333333 |
| NLGN3 AND NOT-FCRL1 | 0.903225806 | 0.875 | 0.933333333 |
| NLGN3 AND NOT-FCRL3 | 0.903225806 | 0.875 | 0.933333333 |
| HEPACAM AND NOT-SLC5A11 | 0.933333333 | 0.933333333 | 0.933333333 |
| NLGN3 AND NOT-SLC5A11 | 0.903225806 | 0.875 | 0.933333333 |
| NLGN3 AND NOT-TNFRSF13C | 0.903225806 | 0.875 | 0.933333333 |
| NLGN3 AND NOT-EVI5L | 0.903225806 | 0.875 | 0.933333333 |
| NLGN3 AND NOT-LYSMD3 | 0.933333333 | 0.933333333 | 0.933333333 |
| NLGN3 AND NOT-SLC22A12 | 0.903225806 | 0.875 | 0.933333333 |
| NLGN3 AND NOT-CYYR1 | 0.933333333 | 0.933333333 | 0.933333333 |
| NLGN3 AND NOT-ABHD15 | 0.903225806 | 0.875 | 0.933333333 |
| NLGN3 AND NOT-TLCD1 | 0.903225806 | 0.875 | 0.933333333 |
| NLGN3 AND NOT-PANX3 | 0.903225806 | 0.875 | 0.933333333 |
| NLGN3 AND NOT-GRIN3A | 0.903225806 | 0.875 | 0.933333333 |
| NLGN3 AND NOT-GRIN3B | 0.903225806 | 0.875 | 0.933333333 |
| NLGN3 AND NOT-MRGPRF | 0.965517241 | 1 | 0.933333333 |
| NLGN3 AND NOT-NLGN3 | 0.903225806 | 0.875 | 0.933333333 |
| NLGN3 AND NOT-CATSPER1 | 0.903225806 | 0.875 | 0.933333333 |
| NLGN3 AND NOT-CATSPER2 | 0.903225806 | 0.875 | 0.933333333 |
| NLGN3 AND NOT-MRGPRX2 | 0.903225806 | 0.875 | 0.933333333 |
| NLGN3 AND NOT-MRGPRX4 | 0.903225806 | 0.875 | 0.933333333 |
| NLGN3 AND NOT-SLC16A10 | 0.933333333 | 0.933333333 | 0.933333333 |
| NLGN3 AND NOT-GALNT15 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-PIGW | 0.933333333 | 0.933333333 | 0.933333333 | NLGN3 AND NOT-TMC1 | 0.903225806 | 0.875 | 0.933333333 |
| TNFRSF8 AND NOT-C17orf78 | 0.933333333 | 0.933333333 | 0.933333333 | NLGN3 AND NOT-TMC2 | 0.903225806 | 0.875 | 0.933333333 |
| TNFRSF8 AND NOT-GPR17 | 0.933333333 | 0.933333333 | 0.933333333 | NLGN3 AND NOT-CLCN1 | 0.903225806 | 0.875 | 0.933333333 |
| TNFRSF8 AND NOT-SLC13A5 | 0.933333333 | 0.933333333 | 0.933333333 | NLGN3 AND NOT-CLCN2 | 0.903225806 | 0.875 | 0.933333333 |
| TNFRSF8 AND NOT-SLC26A11 | 0.928571429 | 1 | 0.866666667 | NLGN3 AND NOT-UBE2J2 | 0.903225806 | 0.875 | 0.933333333 |
| TNFRSF8 AND NOT-IZUMO1 | 0.933333333 | 0.933333333 | 0.933333333 | NLGN3 AND NOT-ANTXR2 | 0.933333333 | 0.933333333 | 0.933333333 |
| TNFRSF8 AND NOT-GPR20 | 0.933333333 | 0.933333333 | 0.933333333 | NLGN3 AND NOT-GPR62 | 0.933333333 | 0.933333333 | 0.933333333 |
| TNFRSF8 AND NOT-VSTM1 | 0.965517241 | 1 | 0.933333333 | NLGN3 AND NOT-CLCN5 | 0.903225806 | 0.875 | 0.933333333 |
| TNFRSF8 AND NOT-GPR22 | 0.933333333 | 0.933333333 | 0.933333333 | NLGN3 AND NOT-CLCN6 | 0.903225806 | 0.875 | 0.933333333 |
| TNFRSF8 AND NOT-CYB561D1 | 0.933333333 | 0.933333333 | 0.933333333 | NLGN3 AND NOT-CLCN7 | 0.933333333 | 0.933333333 | 0.933333333 |
| TNFRSF8 AND NOT-EPHA10 | 0.933333333 | 0.933333333 | 0.933333333 | NLGN3 AND NOT-CLCNKB | 0.903225806 | 0.875 | 0.933333333 |
| TNFRSF8 AND NOT-LPAR4 | 0.933333333 | 0.933333333 | 0.933333333 | NLGN3 AND NOT-PDZD8 | 0.903225806 | 0.875 | 0.933333333 |
| TNFRSF8 AND NOT-SLC25A34 | 0.933333333 | 0.933333333 | 0.933333333 | NLGN3 AND NOT-CALHM3 | 0.903225806 | 0.875 | 0.933333333 |
| TNFRSF8 AND NOT-SIRPB2 | 0.965517241 | 1 | 0.933333333 | NLGN3 AND NOT-CLRN3 | 0.903225806 | 0.875 | 0.933333333 |
| TNFRSF8 AND NOT-MCHR1 | 0.933333333 | 0.933333333 | 0.933333333 | NLGN3 AND NOT-CPXM2 | 0.965517241 | 1 | 0.933333333 |
| TNFRSF8 AND NOT-DNAJC5G | 0.933333333 | 0.933333333 | 0.933333333 | NLGN3 AND NOT-OR5P2 | 0.903225806 | 0.875 | 0.933333333 |
| TNFRSF8 AND NOT-SLC9A9 | 0.933333333 | 0.933333333 | 0.933333333 | NLGN3 AND NOT-GYLTL1B | 0.903225806 | 0.875 | 0.933333333 |
| TNFRSF8 AND NOT-GPER1 | 0.933333333 | 0.933333333 | 0.933333333 | NLGN3 AND NOT-NLGN3 | 0.903225806 | 0.875 | 0.933333333 |
| TNFRSF8 AND NOT-GPR31 | 0.933333333 | 0.933333333 | 0.933333333 | NLGN3 AND NOT-TMEM45B | 0.903225806 | 0.875 | 0.933333333 |
| TNFRSF8 AND NOT-CYP4V2 | 0.965517241 | 1 | 0.933333333 | NLGN3 AND NOT-CLN5 | 0.903225806 | 0.875 | 0.933333333 |
| TNFRSF8 AND NOT-GPR32 | 0.933333333 | 0.933333333 | 0.933333333 | NLGN3 AND NOT-AMICA1 | 0.933333333 | 0.933333333 | 0.933333333 |
| TNFRSF8 AND NOT-RELL2 | 0.933333333 | 0.933333333 | 0.933333333 | NLGN3 AND NOT-CLPS | 0.903225806 | 0.875 | 0.933333333 |
| TNFRSF8 AND NOT-DCBLD1 | 0.933333333 | 0.933333333 | 0.933333333 | NLGN3 AND NOT-LRIG3 | 0.903225806 | 0.875 | 0.933333333 |
| TNFRSF8 AND NOT-ATG9B | 0.933333333 | 0.933333333 | 0.933333333 | NLGN3 AND NOT-TEX29 | 0.933333333 | 0.933333333 | 0.933333333 |
| TNFRSF8 AND NOT-GPR35 | 0.933333333 | 0.933333333 | 0.933333333 | NLGN3 AND NOT-NLGN3 | 0.903225806 | 0.875 | 0.933333333 |
| TNFRSF8 AND NOT-LSMEM1 | 0.933333333 | 0.933333333 | 0.933333333 | NLGN3 AND NOT-NLGN3 | 0.903225806 | 0.875 | 0.933333333 |
| TNFRSF8 AND NOT-XKR6 | 0.933333333 | 0.933333333 | 0.933333333 | NLGN3 AND NOT-DEGS2 | 0.903225806 | 0.875 | 0.933333333 |
| TNFRSF8 AND NOT-GPR37 | 0.933333333 | 0.933333333 | 0.933333333 | NLGN3 AND NOT-NLGN3 | 0.903225806 | 0.875 | 0.933333333 |
| TNFRSF8 AND NOT-CRB2 | 0.933333333 | 0.933333333 | 0.933333333 | NLGN3 AND NOT-CCR3 | 0.903225806 | 0.875 | 0.933333333 |
| TNFRSF8 AND NOT-CFAP47 | 0.933333333 | 0.933333333 | 0.933333333 | NLGN3 AND NOT-CCR4 | 0.903225806 | 0.875 | 0.933333333 |
| TNFRSF8 AND NOT-FFAR1 | 0.933333333 | 0.933333333 | 0.933333333 | NLGN3 AND NOT-CCR5 | 0.903225806 | 0.875 | 0.933333333 |
| TNFRSF8 AND NOT-ANK1 | 0.933333333 | 0.933333333 | 0.933333333 | NLGN3 AND NOT-C15orf27 | 0.903225806 | 0.875 | 0.933333333 |
| TNFRSF8 AND NOT-GRIA1 | 0.933333333 | 0.933333333 | 0.933333333 | NLGN3 AND NOT-CCR6 | 0.903225806 | 0.875 | 0.933333333 |
| TNFRSF8 AND NOT-GRIA3 | 0.933333333 | 0.933333333 | 0.933333333 | NLGN3 AND NOT-CCR7 | 0.903225806 | 0.875 | 0.933333333 |
| TNFRSF8 AND NOT-GRIA4 | 0.933333333 | 0.933333333 | 0.933333333 | NLGN3 AND NOT-CCR8 | 0.903225806 | 0.875 | 0.933333333 |
| TNFRSF8 AND NOT-GRID1 | 0.933333333 | 0.933333333 | 0.933333333 | NLGN3 AND NOT-ACKR2 | 0.903225806 | 0.875 | 0.933333333 |
| TNFRSF8 AND NOT-GRID2 | 0.933333333 | 0.933333333 | 0.933333333 | NLGN3 AND NOT-CMTM3 | 0.903225806 | 0.875 | 0.933333333 |
| TNFRSF8 AND NOT-OSTM1 | 0.965517241 | 1 | 0.933333333 | NLGN3 AND NOT-CMKLR1 | 0.933333333 | 0.933333333 | 0.933333333 |
| TNFRSF8 AND NOT-SLC6A16 | 0.933333333 | 0.933333333 | 0.933333333 | NLGN3 AND NOT-LTB4R | 0.903225806 | 0.875 | 0.933333333 |
| TNFRSF8 AND NOT-TMPRSS11E | 0.928571429 | 1 | 0.866666667 | NLGN3 AND NOT-PAQR4 | 0.903225806 | 0.875 | 0.933333333 |
| TNFRSF8 AND NOT-GRIK3 | 0.933333333 | 0.933333333 | 0.933333333 | NLGN3 AND NOT-TMEM219 | 0.933333333 | 0.933333333 | 0.933333333 |
| TNFRSF8 AND NOT-GRIK4 | 0.933333333 | 0.933333333 | 0.933333333 | NLGN3 AND NOT-TMEM170A | 0.903225806 | 0.875 | 0.933333333 |
| TNFRSF8 AND NOT-GRIN1 | 0.933333333 | 0.933333333 | 0.933333333 | NLGN3 AND NOT-ABCC2 | 0.903225806 | 0.875 | 0.933333333 |
| TNFRSF8 AND NOT-GRIN2B | 0.933333333 | 0.933333333 | 0.933333333 | NLGN3 AND NOT-SLC38A10 | 0.933333333 | 0.933333333 | 0.933333333 |
| TNFRSF8 AND NOT-TIMM21 | 0.933333333 | 0.933333333 | 0.933333333 | NLGN3 AND NOT-CD300LB | 0.903225806 | 0.875 | 0.933333333 |
| TNFRSF8 AND NOT-ORMDL2 | 0.933333333 | 0.933333333 | 0.933333333 | NLGN3 AND NOT-B4GALNT2 | 0.903225806 | 0.875 | 0.933333333 |
| TNFRSF8 AND NOT-ANPEP | 0.965517241 | 1 | 0.933333333 | NLGN3 AND NOT-GJD3 | 0.903225806 | 0.875 | 0.933333333 |
| TNFRSF8 AND NOT-GRM1 | 0.933333333 | 0.933333333 | 0.933333333 | NLGN3 AND NOT-SLC5A10 | 0.903225806 | 0.875 | 0.933333333 |
| TNFRSF8 AND NOT-CLEC2D | 0.933333333 | 0.933333333 | 0.933333333 | NLGN3 AND NOT-FAM210A | 0.933333333 | 0.933333333 | 0.933333333 |
| TNFRSF8 AND NOT-GRM2 | 0.928571429 | 1 | 0.866666667 | NLGN3 AND NOT-CLDND2 | 0.903225806 | 0.875 | 0.933333333 |
| TNFRSF8 AND NOT-GRM5 | 0.933333333 | 0.933333333 | 0.933333333 | NLGN3 AND NOT-ZNF816 | 0.903225806 | 0.875 | 0.933333333 |
| TNFRSF8 AND NOT-GRM7 | 0.933333333 | 0.933333333 | 0.933333333 | NLGN3 AND NOT-CNGA1 | 0.903225806 | 0.875 | 0.933333333 |
| TNFRSF8 AND NOT-ZDHHC1 | 0.933333333 | 0.933333333 | 0.933333333 | NLGN3 AND NOT-IZUMO2 | 0.903225806 | 0.875 | 0.933333333 |
| TNFRSF8 AND NOT-ZDHHC8 | 0.933333333 | 0.933333333 | 0.933333333 | NLGN3 AND NOT-NLGN3 | 0.903225806 | 0.875 | 0.933333333 |
| TNFRSF8 AND NOT-GRHL1 | 0.933333333 | 0.933333333 | 0.933333333 | NLGN3 AND NOT-OR1I1 | 0.933333333 | 0.933333333 | 0.933333333 |
| TNFRSF8 AND NOT-ICOS | 0.933333333 | 0.933333333 | 0.933333333 | NLGN3 AND NOT-CYP4F22 | 0.903225806 | 0.875 | 0.933333333 |
| TNFRSF8 AND NOT-GUCY2F | 0.933333333 | 0.933333333 | 0.933333333 | NLGN3 AND NOT-ANKLE1 | 0.903225806 | 0.875 | 0.933333333 |
| TNFRSF8 AND NOT-NPC1L1 | 0.933333333 | 0.933333333 | 0.933333333 | NLGN3 AND NOT-B3GALT6 | 0.903225806 | 0.875 | 0.933333333 |
| TNFRSF8 AND NOT-ST8SIA5 | 0.933333333 | 0.933333333 | 0.933333333 | NLGN3 AND NOT-CNR1 | 0.903225806 | 0.875 | 0.933333333 |
| TNFRSF8 AND NOT-PCDHB1 | 0.933333333 | 0.933333333 | 0.933333333 | NLGN3 AND NOT-SLC44A3 | 0.903225806 | 0.875 | 0.933333333 |
| TNFRSF8 AND NOT-GYPA | 0.933333333 | 0.933333333 | 0.933333333 | NLGN3 AND NOT-CNR2 | 0.903225806 | 0.875 | 0.933333333 |
| TNFRSF8 AND NOT-SLC39A3 | 0.933333333 | 0.933333333 | 0.933333333 | NLGN3 AND NOT-NLGN3 | 0.903225806 | 0.875 | 0.933333333 |
| TNFRSF8 AND NOT-SLC39A2 | 0.933333333 | 0.933333333 | 0.933333333 | NLGN3 AND NOT-TMCO2 | 0.903225806 | 0.875 | 0.933333333 |
| TNFRSF8 AND NOT-PILRA | 0.965517241 | 1 | 0.933333333 | NLGN3 AND NOT-GJB4 | 0.903225806 | 0.875 | 0.933333333 |
| TNFRSF8 AND NOT-GUCY2D | 0.933333333 | 0.933333333 | 0.933333333 | NLGN3 AND NOT-RNF19B | 0.933333333 | 0.933333333 | 0.933333333 |
| TNFRSF8 AND NOT-HAS1 | 0.933333333 | 0.933333333 | 0.933333333 | NLGN3 AND NOT-DCST2 | 0.903225806 | 0.875 | 0.933333333 |
| TNFRSF8 AND NOT-HAS3 | 0.933333333 | 0.933333333 | 0.933333333 | NLGN3 AND NOT-TEDDM1 | 0.903225806 | 0.875 | 0.933333333 |
| TNFRSF8 AND NOT-HCRT | 0.933333333 | 0.933333333 | 0.933333333 | NLGN3 AND NOT-KLHDC7A | 0.903225806 | 0.875 | 0.933333333 |
| TNFRSF8 AND NOT-HCRTR1 | 0.933333333 | 0.933333333 | 0.933333333 | NLGN3 AND NOT-GOLT1A | 0.903225806 | 0.875 | 0.933333333 |
| TNFRSF8 AND NOT-HFE | 0.933333333 | 0.933333333 | 0.933333333 | NLGN3 AND NOT-C1orf162 | 0.933333333 | 0.933333333 | 0.933333333 |
| TNFRSF8 AND NOT-PLA2G2E | 0.933333333 | 0.933333333 | 0.933333333 | NLGN3 AND NOT-FITM2 | 0.903225806 | 0.875 | 0.933333333 |
| TNFRSF8 AND NOT-KCNIP3 | 0.933333333 | 0.933333333 | 0.933333333 | NLGN3 AND NOT-TBC1D20 | 0.903225806 | 0.875 | 0.933333333 |
| TNFRSF8 AND NOT-NRG1 | 0.965517241 | 1 | 0.933333333 | NLGN3 AND NOT-PROKR2 | 0.903225806 | 0.875 | 0.933333333 |
| TNFRSF8 AND NOT-HLA-DOB | 0.933333333 | 0.933333333 | 0.933333333 | NLGN3 AND NOT-CST9L | 0.903225806 | 0.875 | 0.933333333 |
| TNFRSF8 AND NOT-HMGCR | 0.933333333 | 0.933333333 | 0.933333333 | NLGN3 AND NOT-CST9 | 0.903225806 | 0.875 | 0.933333333 |
| TNFRSF8 AND NOT-SLC29A2 | 0.933333333 | 0.933333333 | 0.933333333 | NLGN3 AND NOT-EMID1 | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-HRH2 | 0.933333333 | 0.933333333 | 0.933333333 | NLGN3 AND NOT-TMEM150A | 0.933333333 | 0.933333333 | 0.933333333 |
| TNFRSF8 AND NOT-HSD3B2 | 0.933333333 | 0.933333333 | 0.933333333 | NLGN3 AND NOT-CNTNAP5 | 0.903225806 | 0.875 | 0.933333333 |
| TNFRSF8 AND NOT-HSD17B3 | 0.933333333 | 0.933333333 | 0.933333333 | NLGN3 AND NOT-ACMSD | 0.903225806 | 0.875 | 0.933333333 |
| TNFRSF8 AND NOT-HSD17B2 | 0.933333333 | 0.933333333 | 0.933333333 | NLGN3 AND NOT-COL11A2 | 0.903225806 | 0.875 | 0.933333333 |
| TNFRSF8 AND NOT-ACACB | 0.933333333 | 0.933333333 | 0.933333333 | NLGN3 AND NOT-SPATA3 | 0.903225806 | 0.875 | 0.933333333 |
| TNFRSF8 AND NOT-IGSF3 | 0.933333333 | 0.933333333 | 0.933333333 | NLGN3 AND NOT-LYPD6B | 0.903225806 | 0.875 | 0.933333333 |
| TNFRSF8 AND NOT-DNAJC4 | 0.965517241 | 1 | 0.933333333 | NLGN3 AND NOT-TMEM198 | 0.903225806 | 0.875 | 0.933333333 |
| TNFRSF8 AND NOT-HTR1B | 0.933333333 | 0.933333333 | 0.933333333 | NLGN3 AND NOT-PQLC3 | 0.933333333 | 0.933333333 | 0.933333333 |
| TNFRSF8 AND NOT-HTR1D | 0.933333333 | 0.933333333 | 0.933333333 | NLGN3 AND NOT-TMEM182 | 0.903225806 | 0.875 | 0.933333333 |
| TNFRSF8 AND NOT-HTR2A | 0.933333333 | 0.933333333 | 0.933333333 | NLGN3 AND NOT-COL17A1 | 0.903225806 | 0.875 | 0.933333333 |
| TNFRSF8 AND NOT-HTR3A | 0.933333333 | 0.933333333 | 0.933333333 | NLGN3 AND NOT-KCNH8 | 0.903225806 | 0.875 | 0.933333333 |
| TNFRSF8 AND NOT-HTR5A | 0.933333333 | 0.933333333 | 0.933333333 | NLGN3 AND NOT-DNAJC19 | 0.933333333 | 0.933333333 | 0.933333333 |
| TNFRSF8 AND NOT-HTR6 | 0.933333333 | 0.933333333 | 0.933333333 | NLGN3 AND NOT-FAM3D | 0.903225806 | 0.875 | 0.933333333 |
| TNFRSF8 AND NOT-HTR7 | 0.933333333 | 0.933333333 | 0.933333333 | NLGN3 AND NOT-ZPLD1 | 0.903225806 | 0.875 | 0.933333333 |
| TNFRSF8 AND NOT-FAM151A | 0.933333333 | 0.933333333 | 0.933333333 | NLGN3 AND NOT-CD200R1 | 0.903225806 | 0.875 | 0.933333333 |
| TNFRSF8 AND NOT-CLEC4D | 0.965517241 | 1 | 0.933333333 | NLGN3 AND NOT-ZDHHC19 | 0.933333333 | 0.933333333 | 0.933333333 |
| TNFRSF8 AND NOT-IFNE | 0.933333333 | 0.933333333 | 0.933333333 | NLGN3 AND NOT-DCBLD2 | 0.933333333 | 0.933333333 | 0.933333333 |
| TNFRSF8 AND NOT-ANO9 | 0.933333333 | 0.933333333 | 0.933333333 | NLGN3 AND NOT-LRRC15 | 0.903225806 | 0.875 | 0.933333333 |
| TNFRSF8 AND NOT-ICAM2 | 0.965517241 | 1 | 0.933333333 | NLGN3 AND NOT-TPRA1 | 0.933333333 | 0.933333333 | 0.933333333 |
| TNFRSF8 AND NOT-TMEM225 | 0.933333333 | 0.933333333 | 0.933333333 | NLGN3 AND NOT-SLC31A2 | 0.903225806 | 0.875 | 0.933333333 |
| TNFRSF8 AND NOT-ICAM4 | 0.928571429 | 1 | 0.866666667 | NLGN3 AND NOT-TMEM207 | 0.903225806 | 0.875 | 0.933333333 |
| TNFRSF8 AND NOT-B4GALNT4 | 0.933333333 | 0.933333333 | 0.933333333 | NLGN3 AND NOT-IL17RE | 0.903225806 | 0.875 | 0.933333333 |
| TNFRSF8 AND NOT-FAM19A2 | 0.933333333 | 0.933333333 | 0.933333333 | NLGN3 AND NOT-RTP1 | 0.903225806 | 0.875 | 0.933333333 |
| TNFRSF8 AND NOT-APOB | 0.933333333 | 0.933333333 | 0.933333333 | NLGN3 AND NOT-EVC2 | 0.903225806 | 0.875 | 0.933333333 |
| TNFRSF8 AND NOT-ZNF546 | 0.933333333 | 0.933333333 | 0.933333333 | NLGN3 AND NOT-SLC9B2 | 0.903225806 | 0.875 | 0.933333333 |
| TNFRSF8 AND NOT-CLEC4G | 0.933333333 | 0.933333333 | 0.933333333 | NLGN3 AND NOT-IL31RA | 0.903225806 | 0.875 | 0.933333333 |
| TNFRSF8 AND NOT-C2orf74 | 0.933333333 | 0.933333333 | 0.933333333 | NLGN3 AND NOT-EGFLAM | 0.933333333 | 0.933333333 | 0.933333333 |
| TNFRSF8 AND NOT-LRRC66 | 0.933333333 | 0.933333333 | 0.933333333 | NLGN3 AND NOT-UGT3A1 | 0.903225806 | 0.875 | 0.933333333 |
| TNFRSF8 AND NOT-SLC35D3 | 0.933333333 | 0.933333333 | 0.933333333 | NLGN3 AND NOT-CCDC127 | 0.933333333 | 0.933333333 | 0.933333333 |
| TNFRSF8 AND NOT-TREML1 | 0.933333333 | 0.933333333 | 0.933333333 | NLGN3 AND NOT-TMEM171 | 0.903225806 | 0.875 | 0.933333333 |
| TNFRSF8 AND NOT-ZDHHC21 | 0.933333333 | 0.933333333 | 0.933333333 | NLGN3 AND NOT-TMEM174 | 0.903225806 | 0.875 | 0.933333333 |
| TNFRSF8 AND NOT-VSIG1 | 0.965517241 | 1 | 0.933333333 | NLGN3 AND NOT-PACRG | 0.903225806 | 0.875 | 0.933333333 |
| TNFRSF8 AND NOT-LHFPL1 | 0.933333333 | 0.933333333 | 0.933333333 | NLGN3 AND NOT-NLGN3 | 0.903225806 | 0.875 | 0.933333333 |
| TNFRSF8 AND NOT-MALRD1 | 0.933333333 | 0.933333333 | 0.933333333 | NLGN3 AND NOT-COX11 | 0.903225806 | 0.875 | 0.933333333 |
| TNFRSF8 AND NOT-SLC35F4 | 0.933333333 | 0.933333333 | 0.933333333 | NLGN3 AND NOT-DPCR1 | 0.933333333 | 0.933333333 | 0.933333333 |
| TNFRSF8 AND NOT-GLDN | 0.933333333 | 0.933333333 | 0.933333333 | NLGN3 AND NOT-WBSCR28 | 0.903225806 | 0.875 | 0.933333333 |
| TNFRSF8 AND NOT-IFNAR1 | 0.965517241 | 1 | 0.933333333 | NLGN3 AND NOT-TMEM139 | 0.903225806 | 0.875 | 0.933333333 |
| TNFRSF8 AND NOT-IFNAR2 | 0.933333333 | 0.933333333 | 0.933333333 | NLGN3 AND NOT-OR6B1 | 0.903225806 | 0.875 | 0.933333333 |
| TNFRSF8 AND NOT-IFNB1 | 0.933333333 | 0.933333333 | 0.933333333 | NLGN3 AND NOT-OR2F2 | 0.903225806 | 0.875 | 0.933333333 |
| TNFRSF8 AND NOT-MOGAT3 | 0.933333333 | 0.933333333 | 0.933333333 | NLGN3 AND NOT-CPD | 0.903225806 | 0.875 | 0.933333333 |
| TNFRSF8 AND NOT-LRRTM1 | 0.933333333 | 0.933333333 | 0.933333333 | NLGN3 AND NOT-SVOPL | 0.903225806 | 0.875 | 0.933333333 |
| TNFRSF8 AND NOT-AMIGO2 | 0.928571429 | 1 | 0.866666667 | NLGN3 AND NOT-CLDN4 | 0.903225806 | 0.875 | 0.933333333 |
| TNFRSF8 AND NOT-TMEM255B | 0.933333333 | 0.933333333 | 0.933333333 | NLGN3 AND NOT-CLDN3 | 0.903225806 | 0.875 | 0.933333333 |
| TNFRSF8 AND NOT-SLC6A18 | 0.933333333 | 0.933333333 | 0.933333333 | NLGN3 AND NOT-ADORA2B | 0.903225806 | 0.875 | 0.933333333 |
| TNFRSF8 AND NOT-NIPAL4 | 0.933333333 | 0.933333333 | 0.933333333 | NLGN3 AND NOT-CLDN23 | 0.903225806 | 0.875 | 0.933333333 |
| TNFRSF8 AND NOT-HCN1 | 0.933333333 | 0.933333333 | 0.933333333 | NLGN3 AND NOT-CPT1A | 0.933333333 | 0.933333333 | 0.933333333 |
| TNFRSF8 AND NOT-ZACN | 0.928571429 | 1 | 0.866666667 | NLGN3 AND NOT-NLGN3 | 0.903225806 | 0.875 | 0.933333333 |
| TNFRSF8 AND NOT-SLCO4C1 | 0.965517241 | 1 | 0.933333333 | NLGN3 AND NOT-TMEM71 | 0.903225806 | 0.875 | 0.933333333 |
| TNFRSF8 AND NOT-RGSL1 | 0.933333333 | 0.933333333 | 0.933333333 | NLGN3 AND NOT-SGCZ | 0.903225806 | 0.875 | 0.933333333 |
| TNFRSF8 AND NOT-IGSF1 | 0.933333333 | 0.933333333 | 0.933333333 | NLGN3 AND NOT-CR1 | 0.903225806 | 0.875 | 0.933333333 |
| TNFRSF8 AND NOT-IL3RA | 0.933333333 | 0.933333333 | 0.933333333 | NLGN3 AND NOT-NLGN3 | 0.903225806 | 0.875 | 0.933333333 |
| TNFRSF8 AND NOT-IL5RA | 0.933333333 | 0.933333333 | 0.933333333 | NLGN3 AND NOT-LETM2 | 0.903225806 | 0.875 | 0.933333333 |
| TNFRSF8 AND NOT-IL6ST | 0.933333333 | 0.933333333 | 0.933333333 | NLGN3 AND NOT-HGSNAT | 0.903225806 | 0.875 | 0.933333333 |
| TNFRSF8 AND NOT-CXCL8 | 0.928571429 | 1 | 0.866666667 | NLGN3 AND NOT-RNF183 | 0.903225806 | 0.875 | 0.933333333 |
| TNFRSF8 AND NOT-CXCR1 | 0.965517241 | 1 | 0.933333333 | NLGN3 AND NOT-CR2 | 0.903225806 | 0.875 | 0.933333333 |
| TNFRSF8 AND NOT-IL10RA | 0.965517241 | 1 | 0.933333333 | NLGN3 AND NOT-C9orf57 | 0.903225806 | 0.875 | 0.933333333 |
| TNFRSF8 AND NOT-IL11RA | 0.933333333 | 0.933333333 | 0.933333333 | NLGN3 AND NOT-FAM69B | 0.903225806 | 0.875 | 0.933333333 |
| TNFRSF8 AND NOT-IL12RB1 | 0.933333333 | 0.933333333 | 0.933333333 | NLGN3 AND NOT-SLITRK4 | 0.933333333 | 0.933333333 | 0.933333333 |
| TNFRSF8 AND NOT-IL13 | 0.928571429 | 1 | 0.866666667 | NLGN3 AND NOT-ADGRG4 | 0.903225806 | 0.875 | 0.933333333 |
| TNFRSF8 AND NOT-AQP4 | 0.933333333 | 0.933333333 | 0.933333333 | NLGN3 AND NOT-PTCHD1 | 0.903225806 | 0.875 | 0.933333333 |
| TNFRSF8 AND NOT-AQP5 | 0.933333333 | 0.933333333 | 0.933333333 | NLGN3 AND NOT-CRHR1 | 0.903225806 | 0.875 | 0.933333333 |
| TNFRSF8 AND NOT-INPP4A | 0.933333333 | 0.933333333 | 0.933333333 | NLGN3 AND NOT-AADAC | 0.933333333 | 0.933333333 | 0.933333333 |
| TNFRSF8 AND NOT-AQP6 | 0.933333333 | 0.933333333 | 0.933333333 | NLGN3 AND NOT-MUC17 | 0.903225806 | 0.875 | 0.933333333 |
| TNFRSF8 AND NOT-INSRR | 0.933333333 | 0.933333333 | 0.933333333 | NLGN3 AND NOT-ASB11 | 0.903225806 | 0.875 | 0.933333333 |
| TNFRSF8 AND NOT-AQP7 | 0.933333333 | 0.933333333 | 0.933333333 | NLGN3 AND NOT-CHODL | 0.903225806 | 0.875 | 0.933333333 |
| TNFRSF8 AND NOT-ITGA2B | 0.965517241 | 1 | 0.933333333 | NLGN3 AND NOT-TMEM37 | 0.933333333 | 0.933333333 | 0.933333333 |
| TNFRSF8 AND NOT-ITGA4 | 0.965517241 | 1 | 0.933333333 | NLGN3 AND NOT-NLGN3 | 0.903225806 | 0.875 | 0.933333333 |
| TNFRSF8 AND NOT-ITGA9 | 0.933333333 | 0.933333333 | 0.933333333 | NLGN3 AND NOT-TRPM6 | 0.903225806 | 0.875 | 0.933333333 |
| TNFRSF8 AND NOT-ITGAM | 0.965517241 | 1 | 0.933333333 | NLGN3 AND NOT-WFDC10A | 0.933333333 | 0.933333333 | 0.933333333 |
| TNFRSF8 AND NOT-ITGB2 | 0.928571429 | 1 | 0.866666667 | NLGN3 AND NOT-C20orf173 | 0.903225806 | 0.875 | 0.933333333 |
| TNFRSF8 AND NOT-ABCC6 | 0.933333333 | 0.933333333 | 0.933333333 | NLGN3 AND NOT-CST11 | 0.903225806 | 0.875 | 0.933333333 |
| TNFRSF8 AND NOT-ITGB3 | 0.928571429 | 1 | 0.866666667 | NLGN3 AND NOT-NLGN3 | 0.903225806 | 0.875 | 0.933333333 |
| TNFRSF8 AND NOT-ITGB6 | 0.933333333 | 0.933333333 | 0.933333333 | NLGN3 AND NOT-CRY2 | 0.933333333 | 0.933333333 | 0.933333333 |
| TNFRSF8 AND NOT-ITGB7 | 0.933333333 | 0.933333333 | 0.933333333 | NLGN3 AND NOT-ADORA3 | 0.933333333 | 0.933333333 | 0.933333333 |
| TNFRSF8 AND NOT-ITIH1 | 0.933333333 | 0.933333333 | 0.933333333 | NLGN3 AND NOT-SLC34A3 | 0.903225806 | 0.875 | 0.933333333 |
| TNFRSF8 AND NOT-STT3A | 0.928571429 | 1 | 0.866666667 | NLGN3 AND NOT-VTI1A | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-ITPR2 | 0.933333333 | 0.933333333 | 0.933333333 | NLGN3 AND NOT-SYT9 | 0.903225806 | 0.875 | 0.933333333 |
| TNFRSF8 AND NOT-ITPR3 | 0.933333333 | 0.933333333 | 0.933333333 | NLGN3 AND NOT-CSF1 | 0.903225806 | 0.875 | 0.933333333 |
| TNFRSF8 AND NOT-CD82 | 0.933333333 | 0.933333333 | 0.933333333 | NLGN3 AND NOT-MUC15 | 0.903225806 | 0.875 | 0.933333333 |
| TNFRSF8 AND NOT-KCNA1 | 0.933333333 | 0.933333333 | 0.933333333 | NLGN3 AND NOT-FAM76B | 0.903225806 | 0.875 | 0.933333333 |
| TNFRSF8 AND NOT-KCNA2 | 0.933333333 | 0.933333333 | 0.933333333 | NLGN3 AND NOT-CSF1R | 0.933333333 | 0.933333333 | 0.933333333 |
| TNFRSF8 AND NOT-KCNA3 | 0.928571429 | 1 | 0.866666667 | NLGN3 AND NOT-CSF2RA | 0.903225806 | 0.875 | 0.933333333 |
| TNFRSF8 AND NOT-KCNA4 | 0.933333333 | 0.933333333 | 0.933333333 | NLGN3 AND NOT-LAYN | 0.903225806 | 0.875 | 0.933333333 |
| TNFRSF8 AND NOT-KCNA5 | 0.933333333 | 0.933333333 | 0.933333333 | NLGN3 AND NOT-TMEM86A | 0.903225806 | 0.875 | 0.933333333 |
| TNFRSF8 AND NOT-KCNA6 | 0.933333333 | 0.933333333 | 0.933333333 | NLGN3 AND NOT-CSF3R | 0.933333333 | 0.933333333 | 0.933333333 |
| TNFRSF8 AND NOT-KCNA7 | 0.933333333 | 0.933333333 | 0.933333333 | NLGN3 AND NOT-ALG10B | 0.903225806 | 0.875 | 0.933333333 |
| TNFRSF8 AND NOT-KCNA10 | 0.965517241 | 1 | 0.933333333 | NLGN3 AND NOT-TMEM120B | 0.933333333 | 0.933333333 | 0.933333333 |
| TNFRSF8 AND NOT-KCNC1 | 0.933333333 | 0.933333333 | 0.933333333 | BEST3 AND RPRM | 0.909090909 | 0.833333333 | 1 |
| TNFRSF8 AND NOT-KCNC2 | 0.933333333 | 0.933333333 | 0.933333333 | BEST3 AND NOT-CD36 | 0.967741935 | 0.9375 | 1 |
| TNFRSF8 AND NOT-LRRC37A3 | 0.933333333 | 0.933333333 | 0.933333333 | NLGN3 AND NOT-B3GLCT | 0.903225806 | 0.875 | 0.933333333 |
| TNFRSF8 AND NOT-DRAXIN | 0.933333333 | 0.933333333 | 0.933333333 | NLGN3 AND NOT-SLC38A6 | 0.933333333 | 0.933333333 | 0.933333333 |
| TNFRSF8 AND NOT-FAM73A | 0.933333333 | 0.933333333 | 0.933333333 | NLGN3 AND NOT-C14orf37 | 0.903225806 | 0.875 | 0.933333333 |
| TNFRSF8 AND NOT-KCNC4 | 0.933333333 | 0.933333333 | 0.933333333 | NLGN3 AND NOT-ISM2 | 0.903225806 | 0.875 | 0.933333333 |
| TNFRSF8 AND NOT-MIA3 | 0.933333333 | 0.933333333 | 0.933333333 | NLGN3 AND NOT-LRFN5 | 0.903225806 | 0.875 | 0.933333333 |
| TNFRSF8 AND NOT-C1orf95 | 0.933333333 | 0.933333333 | 0.933333333 | NLGN3 AND NOT-LYSMD4 | 0.903225806 | 0.875 | 0.933333333 |
| TNFRSF8 AND NOT-KCND3 | 0.933333333 | 0.933333333 | 0.933333333 | NLGN3 AND NOT-NRG4 | 0.903225806 | 0.875 | 0.933333333 |
| TNFRSF8 AND NOT-KCNH1 | 0.933333333 | 0.933333333 | 0.933333333 | NLGN3 AND NOT-CMTM4 | 0.903225806 | 0.875 | 0.933333333 |
| TNFRSF8 AND NOT-ENHO | 0.933333333 | 0.933333333 | 0.933333333 | NLGN3 AND NOT-C16orf92 | 0.903225806 | 0.875 | 0.933333333 |
| TNFRSF8 AND NOT-PNPLA7 | 0.933333333 | 0.933333333 | 0.933333333 | NLGN3 AND NOT-GSG1L | 0.933333333 | 0.933333333 | 0.933333333 |
| TNFRSF8 AND NOT-KCNJ1 | 0.933333333 | 0.933333333 | 0.933333333 | NLGN3 AND NOT-SLC22A31 | 0.903225806 | 0.875 | 0.933333333 |
| TNFRSF8 AND NOT-KCNJ5 | 0.933333333 | 0.933333333 | 0.933333333 | NLGN3 AND NOT-TMED6 | 0.903225806 | 0.875 | 0.933333333 |
| TNFRSF8 AND NOT-KCNJ6 | 0.933333333 | 0.933333333 | 0.933333333 | NLGN3 AND NOT-CD300LF | 0.903225806 | 0.875 | 0.933333333 |
| TNFRSF8 AND NOT-SLC27A1 | 0.965517241 | 1 | 0.933333333 | NLGN3 AND NOT-CD300LG | 0.903225806 | 0.875 | 0.933333333 |
| TNFRSF8 AND NOT-KCNJ11 | 0.933333333 | 0.933333333 | 0.933333333 | NLGN3 AND NOT-TMEM199 | 0.903225806 | 0.875 | 0.933333333 |
| TNFRSF8 AND NOT-KCNJ12 | 0.933333333 | 0.933333333 | 0.933333333 | NLGN3 AND NOT-TMC8 | 0.933333333 | 0.933333333 | 0.933333333 |
| TNFRSF8 AND NOT-KCNJ14 | 0.933333333 | 0.933333333 | 0.933333333 | NLGN3 AND NOT-TMEM99 | 0.933333333 | 0.933333333 | 0.933333333 |
| TNFRSF8 AND NOT-KCNJ15 | 0.933333333 | 0.933333333 | 0.933333333 | NLGN3 AND NOT-NLGN3 | 0.903225806 | 0.875 | 0.933333333 |
| TNFRSF8 AND NOT-KCNK2 | 0.933333333 | 0.933333333 | 0.933333333 | NLGN3 AND NOT-VSIG10L | 0.903225806 | 0.875 | 0.933333333 |
| TNFRSF8 AND NOT-KCNMB1 | 0.928571429 | 1 | 0.866666667 | NLGN3 AND NOT-C19orf18 | 0.903225806 | 0.875 | 0.933333333 |
| TNFRSF8 AND NOT-KCNN2 | 0.933333333 | 0.933333333 | 0.933333333 | NLGN3 AND NOT-TMEM190 | 0.903225806 | 0.875 | 0.933333333 |
| TNFRSF8 AND NOT-KCNN3 | 0.933333333 | 0.933333333 | 0.933333333 | NLGN3 AND NOT-TMC4 | 0.903225806 | 0.875 | 0.933333333 |
| TNFRSF8 AND NOT-KCNQ1 | 0.965517241 | 1 | 0.933333333 | SLC4A4 AND NOT-TMC4 | 0.928571429 | 1 | 0.866666667 |
| TNFRSF8 AND NOT-KCNQ2 | 0.933333333 | 0.933333333 | 0.933333333 | NLGN3 AND NOT-NLGN3 | 0.903225806 | 0.875 | 0.933333333 |
| TNFRSF8 AND NOT-KIR2DL3 | 0.933333333 | 0.933333333 | 0.933333333 | NLGN3 AND NOT-ADRA1B | 0.903225806 | 0.875 | 0.933333333 |
| TNFRSF8 AND NOT-KIR2DS4 | 0.933333333 | 0.933333333 | 0.933333333 | NLGN3 AND NOT-ZNRF4 | 0.903225806 | 0.875 | 0.933333333 |
| TNFRSF8 AND NOT-KLRB1 | 0.928571429 | 1 | 0.866666667 | NLGN3 AND NOT-FAM187B | 0.903225806 | 0.875 | 0.933333333 |
| TNFRSF8 AND NOT-KLRC3 | 0.965517241 | 1 | 0.933333333 | NLGN3 AND NOT-ATP8B3 | 0.903225806 | 0.875 | 0.933333333 |
| TNFRSF8 AND NOT-KLRD1 | 0.928571429 | 1 | 0.866666667 | NLGN3 AND NOT-HFE2 | 0.903225806 | 0.875 | 0.933333333 |
| TNFRSF8 AND NOT-KRT5 | 0.933333333 | 0.933333333 | 0.933333333 | NLGN3 AND NOT-FAM163A | 0.903225806 | 0.875 | 0.933333333 |
| TNFRSF8 AND NOT-AMIGO3 | 0.933333333 | 0.933333333 | 0.933333333 | NLGN3 AND NOT-PM20D1 | 0.903225806 | 0.875 | 0.933333333 |
| TNFRSF8 AND NOT-GPR153 | 0.933333333 | 0.933333333 | 0.933333333 | NLGN3 AND NOT-SLC30A7 | 0.933333333 | 0.933333333 | 0.933333333 |
| TNFRSF8 AND NOT-TMEM189 | 0.933333333 | 0.933333333 | 0.933333333 | NLGN3 AND NOT-KNCN | 0.903225806 | 0.875 | 0.933333333 |
| TNFRSF8 AND NOT-SLC22A25 | 0.933333333 | 0.933333333 | 0.933333333 | NLGN3 AND NOT-DCST1 | 0.903225806 | 0.875 | 0.933333333 |
| TNFRSF8 AND NOT-CLEC12B | 0.933333333 | 0.933333333 | 0.933333333 | NLGN3 AND NOT-IL23R | 0.933333333 | 0.933333333 | 0.933333333 |
| TNFRSF8 AND NOT-SHISA2 | 0.933333333 | 0.933333333 | 0.933333333 | NLGN3 AND NOT-CTLA4 | 0.903225806 | 0.875 | 0.933333333 |
| TNFRSF8 AND NOT-GLTPD2 | 0.933333333 | 0.933333333 | 0.933333333 | NLGN3 AND NOT-CLDN19 | 0.903225806 | 0.875 | 0.933333333 |
| TNFRSF8 AND NOT-RPRML | 0.933333333 | 0.933333333 | 0.933333333 | NLGN3 AND NOT-C1orf210 | 0.903225806 | 0.875 | 0.933333333 |
| TNFRSF8 AND NOT-RGS9BP | 0.933333333 | 0.933333333 | 0.933333333 | NLGN3 AND NOT-ADIG | 0.903225806 | 0.875 | 0.933333333 |
| TNFRSF8 AND NOT-FAM132A | 0.933333333 | 0.933333333 | 0.933333333 | NLGN3 AND NOT-CTNS | 0.933333333 | 0.933333333 | 0.933333333 |
| TNFRSF8 AND NOT-FAM69A | 0.933333333 | 0.933333333 | 0.933333333 | NLGN3 AND NOT-SLC9B1 | 0.903225806 | 0.875 | 0.933333333 |
| TNFRSF8 AND NOT-FAM209B | 0.933333333 | 0.933333333 | 0.933333333 | NLGN3 AND NOT-NFAM1 | 0.933333333 | 0.933333333 | 0.933333333 |
| TNFRSF8 AND NOT-C5orf46 | 0.933333333 | 0.933333333 | 0.933333333 | NLGN3 AND NOT-PROM2 | 0.903225806 | 0.875 | 0.933333333 |
| TNFRSF8 AND NOT-IYD | 0.933333333 | 0.933333333 | 0.933333333 | NLGN3 AND NOT-ADRA2A | 0.903225806 | 0.875 | 0.933333333 |
| TNFRSF8 AND NOT-L1CAM | 0.933333333 | 0.933333333 | 0.933333333 | NLGN3 AND NOT-PLB1 | 0.903225806 | 0.875 | 0.933333333 |
| TNFRSF8 AND NOT-USP27X | 0.965517241 | 1 | 0.933333333 | NLGN3 AND NOT-NLGN3 | 0.903225806 | 0.875 | 0.933333333 |
| TNFRSF8 AND NOT-OR5I1 | 0.965517241 | 1 | 0.933333333 | NLGN3 AND NOT-SLC23A3 | 0.903225806 | 0.875 | 0.933333333 |
| TNFRSF8 AND NOT-OR52D1 | 0.933333333 | 0.933333333 | 0.933333333 | NLGN3 AND NOT-GPBAR1 | 0.903225806 | 0.875 | 0.933333333 |
| TNFRSF8 AND NOT-LAMP2 | 0.933333333 | 0.933333333 | 0.933333333 | NLGN3 AND NOT-RMDN2 | 0.933333333 | 0.933333333 | 0.933333333 |
| TNFRSF8 AND NOT-LFNG | 0.965517241 | 1 | 0.933333333 | NLGN3 AND NOT-NLGN3 | 0.903225806 | 0.875 | 0.933333333 |
| TNFRSF8 AND NOT-LIM2 | 0.965517241 | 1 | 0.933333333 | NLGN3 AND NOT-FAM19A4 | 0.965517241 | 1 | 0.933333333 |
| TNFRSF8 AND NOT-C11orf87 | 0.933333333 | 0.933333333 | 0.933333333 | NLGN3 AND NOT-CCDC80 | 0.903225806 | 0.875 | 0.933333333 |
| TNFRSF8 AND NOT-SNX19 | 0.933333333 | 0.933333333 | 0.933333333 | NLGN3 AND NOT-BTLA | 0.903225806 | 0.875 | 0.933333333 |
| TNFRSF8 AND NOT-LNPEP | 0.933333333 | 0.933333333 | 0.933333333 | NLGN3 AND NOT-ADRA2B | 0.903225806 | 0.875 | 0.933333333 |
| TNFRSF8 AND NOT-XKRX | 0.933333333 | 0.933333333 | 0.933333333 | NLGN3 AND NOT-XXYLT1 | 0.903225806 | 0.875 | 0.933333333 |
| TNFRSF8 AND NOT-IFITM10 | 0.933333333 | 0.933333333 | 0.933333333 | NLGN3 AND NOT-CTSZ | 0.933333333 | 0.933333333 | 0.933333333 |
| TNFRSF8 AND NOT-PPAPDC2 | 0.933333333 | 0.933333333 | 0.933333333 | NLGN3 AND NOT-CUX1 | 0.903225806 | 0.875 | 0.933333333 |
| TNFRSF8 AND NOT-LRMP | 0.965517241 | 1 | 0.933333333 | NLGN3 AND NOT-IGSF11 | 0.903225806 | 0.875 | 0.933333333 |
| TNFRSF8 AND NOT-LRP1 | 0.965517241 | 1 | 0.933333333 | NLGN3 AND NOT-NLGN3 | 0.903225806 | 0.875 | 0.933333333 |
| TNFRSF8 AND NOT-LRP3 | 0.965517241 | 1 | 0.933333333 | NLGN3 AND NOT-PAQR3 | 0.903225806 | 0.875 | 0.933333333 |
| TNFRSF8 AND NOT-HAPLN4 | 0.933333333 | 0.933333333 | 0.933333333 | NLGN3 AND NOT-SHISA3 | 0.928571429 | 1 | 0.866666667 |
| TNFRSF8 AND NOT-SPINK6 | 0.928571429 | 1 | 0.866666667 | NLGN3 AND NOT-THAP6 | 0.933333333 | 0.933333333 | 0.933333333 |
| TNFRSF8 AND NOT-LTB | 0.965517241 | 1 | 0.933333333 | NLGN3 AND NOT-C4orf26 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-LTBP3 | 0.933333333 | 0.933333333 | 0.933333333 | NLGN3 AND NOT-KLB | 0.903225806 | 0.875 | 0.933333333 |
| TNFRSF8 AND NOT-ERVFRD-1 | 0.933333333 | 0.933333333 | 0.933333333 | NLGN3 AND NOT-CYB5A | 0.933333333 | 0.933333333 | 0.933333333 |
| TNFRSF8 AND NOT-LTK | 0.933333333 | 0.933333333 | 0.933333333 | NLGN3 AND NOT-SPINK13 | 0.933333333 | 0.933333333 | 0.933333333 |
| TNFRSF8 AND NOT-CD180 | 0.933333333 | 0.933333333 | 0.933333333 | NLGN3 AND NOT-NLGN3 | 0.903225806 | 0.875 | 0.933333333 |
| TNFRSF8 AND NOT-TACSTD2 | 0.933333333 | 0.933333333 | 0.933333333 | NLGN3 AND NOT-TMEM161B | 0.903225806 | 0.875 | 0.933333333 |
| TNFRSF8 AND NOT-M6PR | 0.928571429 | 1 | 0.866666667 | NLGN3 AND NOT-MARVELD2 | 0.903225806 | 0.875 | 0.933333333 |
| TNFRSF8 AND NOT-FAM19A1 | 0.928571429 | 1 | 0.866666667 | NLGN3 AND NOT-BTNL9 | 0.903225806 | 0.875 | 0.933333333 |
| TNFRSF8 AND NOT-SMAD2 | 0.933333333 | 0.933333333 | 0.933333333 | NLGN3 AND NOT-CYBA | 0.933333333 | 0.933333333 | 0.933333333 |
| TNFRSF8 AND NOT-MAG | 0.933333333 | 0.933333333 | 0.933333333 | NLGN3 AND NOT-NLGN3 | 0.903225806 | 0.875 | 0.933333333 |
| TNFRSF8 AND NOT-ARSB | 0.933333333 | 0.933333333 | 0.933333333 | NLGN3 AND NOT-CCDC112 | 0.903225806 | 0.875 | 0.933333333 |
| TNFRSF8 AND NOT-MAN1A1 | 0.933333333 | 0.933333333 | 0.933333333 | NLGN3 AND NOT-RNF145 | 0.933333333 | 0.933333333 | 0.933333333 |
| TNFRSF8 AND NOT-MAN2A2 | 0.965517241 | 1 | 0.933333333 | NLGN3 AND NOT-NLGN3 | 0.903225806 | 0.875 | 0.933333333 |
| TNFRSF8 AND NOT-MAS1 | 0.933333333 | 0.933333333 | 0.933333333 | NLGN3 AND NOT-SLC2A12 | 0.903225806 | 0.875 | 0.933333333 |
| TNFRSF8 AND NOT-LCN10 | 0.933333333 | 0.933333333 | 0.933333333 | NLGN3 AND NOT-MBOAT1 | 0.933333333 | 0.933333333 | 0.933333333 |
| TNFRSF8 AND NOT-ARSD | 0.965517241 | 1 | 0.933333333 | NLGN3 AND NOT-RNF217 | 0.933333333 | 0.933333333 | 0.933333333 |
| TNFRSF8 AND NOT-ARSE | 0.933333333 | 0.933333333 | 0.933333333 | NLGN3 AND NOT-CYP1A1 | 0.903225806 | 0.875 | 0.933333333 |
| TNFRSF8 AND NOT-MC5R | 0.933333333 | 0.933333333 | 0.933333333 | NLGN3 AND NOT-NLGN3 | 0.903225806 | 0.875 | 0.933333333 |
| TNFRSF8 AND NOT-ARSF | 0.933333333 | 0.933333333 | 0.933333333 | NLGN3 AND NOT-CYP1A2 | 0.903225806 | 0.875 | 0.933333333 |
| TNFRSF8 AND NOT-ADAM11 | 0.933333333 | 0.933333333 | 0.933333333 | NLGN3 AND NOT-ABCA13 | 0.933333333 | 0.933333333 | 0.933333333 |
| TNFRSF8 AND NOT-ART3 | 0.933333333 | 0.933333333 | 0.933333333 | NLGN3 AND NOT-VKORC1L1 | 0.903225806 | 0.875 | 0.933333333 |
| TNFRSF8 AND NOT-ART4 | 0.933333333 | 0.933333333 | 0.933333333 | NLGN3 AND NOT-CYP2A6 | 0.903225806 | 0.875 | 0.933333333 |
| TNFRSF8 AND NOT-MGAT1 | 0.928571429 | 1 | 0.866666667 | NLGN3 AND NOT-ADRB2 | 0.903225806 | 0.875 | 0.933333333 |
| TNFRSF8 AND NOT-MGAT3 | 0.933333333 | 0.933333333 | 0.933333333 | NLGN3 AND NOT-TMEM213 | 0.903225806 | 0.875 | 0.933333333 |
| TNFRSF8 AND NOT-CIAGE5 | 0.965517241 | 1 | 0.933333333 | NLGN3 AND ATP6V0E2 | 0.903225806 | 0.875 | 0.933333333 |
| TNFRSF8 AND NOT-MGST2 | 0.965517241 | 1 | 0.933333333 | NLGN3 AND NOT-CYP3A7 | 0.903225806 | 0.875 | 0.933333333 |
| TNFRSF8 AND NOT-MIP | 0.933333333 | 0.933333333 | 0.933333333 | NLGN3 AND NOT-CYP2C8 | 0.933333333 | 0.933333333 | 0.933333333 |
| TNFRSF8 AND NOT-TRPM1 | 0.933333333 | 0.933333333 | 0.933333333 | NLGN3 AND NOT-ADRB3 | 0.903225806 | 0.875 | 0.933333333 |
| TNFRSF8 AND NOT-MMP15 | 0.933333333 | 0.933333333 | 0.933333333 | NLGN3 AND NOT-PEBP4 | 0.933333333 | 0.933333333 | 0.933333333 |
| TNFRSF8 AND NOT-MMP16 | 0.933333333 | 0.933333333 | 0.933333333 | NLGN3 AND NOT-NLGN3 | 0.903225806 | 0.875 | 0.933333333 |
| TNFRSF8 AND NOT-ALDH6A1 | 0.928571429 | 1 | 0.866666667 | NLGN3 AND NOT-NLGN3 | 0.903225806 | 0.875 | 0.933333333 |
| TNFRSF8 AND NOT-ASGR1 | 0.965517241 | 1 | 0.933333333 | NLGN3 AND NOT-CYP3A4 | 0.933333333 | 0.933333333 | 0.933333333 |
| TNFRSF8 AND NOT-MOG | 0.933333333 | 0.933333333 | 0.933333333 | NLGN3 AND NOT-CYP3A5 | 0.933333333 | 0.933333333 | 0.933333333 |
| TNFRSF8 AND NOT-MPL | 0.933333333 | 0.933333333 | 0.933333333 | NLGN3 AND NOT-NLGN3 | 0.903225806 | 0.875 | 0.933333333 |
| TNFRSF8 AND NOT-MXRA7 | 0.933333333 | 0.933333333 | 0.933333333 | NLGN3 AND NOT-CYP4B1 | 0.965517241 | 1 | 0.933333333 |
| TNFRSF8 AND NOT-ACHE | 0.933333333 | 0.933333333 | 0.933333333 | NLGN3 AND NOT-CYP8B1 | 0.903225806 | 0.875 | 0.933333333 |
| TNFRSF8 AND NOT-SMCO3 | 0.933333333 | 0.933333333 | 0.933333333 | NLGN3 AND NOT-FREM1 | 0.903225806 | 0.875 | 0.933333333 |
| TNFRSF8 AND NOT-LRRC52 | 0.933333333 | 0.933333333 | 0.933333333 | NLGN3 AND NOT-PRUNE2 | 0.903225806 | 0.875 | 0.933333333 |
| TNFRSF8 AND NOT-C1orf186 | 0.928571429 | 1 | 0.866666667 | NLGN3 AND NOT-FMR1NB | 0.965517241 | 1 | 0.933333333 |
| TNFRSF8 AND NOT-SHISA8 | 0.933333333 | 0.933333333 | 0.933333333 | NLGN3 AND NOT-FAAH2 | 0.903225806 | 0.875 | 0.933333333 |
| TNFRSF8 AND NOT-SMIM4 | 0.933333333 | 0.933333333 | 0.933333333 | NLGN3 AND NOT-MOSPD2 | 0.903225806 | 0.875 | 0.933333333 |
| TNFRSF8 AND NOT-TMEM151B | 0.933333333 | 0.933333333 | 0.933333333 | NLGN3 AND NOT-AWAT1 | 0.903225806 | 0.875 | 0.933333333 |
| TNFRSF8 AND NOT-OR2B3 | 0.933333333 | 0.933333333 | 0.933333333 | TSPAN7 AND ZDHHC15 | 0.933333333 | 0.933333333 | 0.933333333 |
| TNFRSF8 AND NOT-OR14J1 | 0.933333333 | 0.933333333 | 0.933333333 | NLGN3 AND NOT-CYP19A1 | 0.933333333 | 0.933333333 | 0.933333333 |
| TNFRSF8 AND NOT-OR10C1 | 0.933333333 | 0.933333333 | 0.933333333 | NLGN3 AND NOT-SLC35G1 | 0.903225806 | 0.875 | 0.933333333 |
| TNFRSF8 AND NOT-PTCHD4 | 0.933333333 | 0.933333333 | 0.933333333 | NLGN3 AND NOT-SLC5A12 | 0.903225806 | 0.875 | 0.933333333 |
| TNFRSF8 AND NOT-MSR1 | 0.933333333 | 0.933333333 | 0.933333333 | NLGN3 AND NOT-CCDC67 | 0.903225806 | 0.875 | 0.933333333 |
| TNFRSF8 AND NOT-MTNR1B | 0.933333333 | 0.933333333 | 0.933333333 | NLGN3 AND NOT-TMTC2 | 0.903225806 | 0.875 | 0.933333333 |
| TNFRSF8 AND NOT-MUC3A | 0.933333333 | 0.933333333 | 0.933333333 | NLGN3 AND NOT-CLEC12A | 0.903225806 | 0.875 | 0.933333333 |
| TNFRSF8 AND NOT-MUC4 | 0.933333333 | 0.933333333 | 0.933333333 | NLGN3 AND NOT-TMTC3 | 0.903225806 | 0.875 | 0.933333333 |
| TNFRSF8 AND NOT-NCAM1 | 0.965517241 | 1 | 0.933333333 | NLGN3 AND NOT-DAG1 | 0.903225806 | 0.875 | 0.933333333 |
| TNFRSF8 AND NOT-NDUFC2 | 0.928571429 | 1 | 0.866666667 | NLGN3 AND NOT-SLC5A8 | 0.903225806 | 0.875 | 0.933333333 |
| TNFRSF8 AND NOT-NELL2 | 0.965517241 | 1 | 0.933333333 | NLGN3 AND NOT-GPR180 | 0.903225806 | 0.875 | 0.933333333 |
| TNFRSF8 AND NOT-ATP1A3 | 0.933333333 | 0.933333333 | 0.933333333 | NLGN3 AND NOT-TMEM229B | 0.903225806 | 0.875 | 0.933333333 |
| TNFRSF8 AND NOT-NGFR | 0.933333333 | 0.933333333 | 0.933333333 | NLGN3 AND NOT-SYNE3 | 0.903225806 | 0.875 | 0.933333333 |
| TNFRSF8 AND NOT-ATP1A4 | 0.933333333 | 0.933333333 | 0.933333333 | NLGN3 AND NOT-CLEC14A | 0.903225806 | 0.875 | 0.933333333 |
| TNFRSF8 AND NOT-NMBR | 0.933333333 | 0.933333333 | 0.933333333 | NLGN3 AND NOT-FITM1 | 0.933333333 | 0.933333333 | 0.933333333 |
| TNFRSF8 AND NOT-NOTCH2 | 0.965517241 | 1 | 0.933333333 | NLGN3 AND NOT-TMEM30B | 0.903225806 | 0.875 | 0.933333333 |
| TNFRSF8 AND NOT-NPHS1 | 0.933333333 | 0.933333333 | 0.933333333 | NLGN3 AND NOT-ITPRIPL2 | 0.933333333 | 0.933333333 | 0.933333333 |
| TNFRSF8 AND NOT-NPPA | 0.933333333 | 0.933333333 | 0.933333333 | NLGN3 AND NOT-DBH | 0.903225806 | 0.875 | 0.933333333 |
| TNFRSF8 AND NOT-NPY5R | 0.933333333 | 0.933333333 | 0.933333333 | NLGN3 AND NOT-MFSD6L | 0.903225806 | 0.875 | 0.933333333 |
| TNFRSF8 AND NOT-SLC11A2 | 0.933333333 | 0.933333333 | 0.933333333 | NLGN3 AND NOT-FAM134C | 0.933333333 | 0.933333333 | 0.933333333 |
| TNFRSF8 AND NOT-ATP2A3 | 0.965517241 | 1 | 0.933333333 | NLGN3 AND NOT-TMEM92 | 0.903225806 | 0.875 | 0.933333333 |
| TNFRSF8 AND NOT-NTRK3 | 0.933333333 | 0.933333333 | 0.933333333 | NLGN3 AND NOT-TRPV3 | 0.933333333 | 0.933333333 | 0.933333333 |
| TNFRSF8 AND NOT-ROR2 | 0.933333333 | 0.933333333 | 0.933333333 | NLGN3 AND NOT-SPPL2C | 0.903225806 | 0.875 | 0.933333333 |
| TNFRSF8 AND NOT-NTSR1 | 0.933333333 | 0.933333333 | 0.933333333 | NLGN3 AND NOT-OR7D2 | 0.903225806 | 0.875 | 0.933333333 |
| TNFRSF8 AND NOT-CISD2 | 0.933333333 | 0.933333333 | 0.933333333 | NLGN3 AND NOT-NLGN3 | 0.903225806 | 0.875 | 0.933333333 |
| TNFRSF8 AND NOT-ATP4B | 0.933333333 | 0.933333333 | 0.933333333 | NLGN3 AND NOT-LPPR5 | 0.903225806 | 0.875 | 0.933333333 |
| TNFRSF8 AND NOT-OPRD1 | 0.933333333 | 0.933333333 | 0.933333333 | NLGN3 AND NOT-TOR1AIP2 | 0.933333333 | 0.933333333 | 0.933333333 |
| TNFRSF8 AND NOT-OPRK1 | 0.933333333 | 0.933333333 | 0.933333333 | NLGN3 AND NOT-ACE | 0.903225806 | 0.875 | 0.933333333 |
| TNFRSF8 AND NOT-OPRL1 | 0.933333333 | 0.933333333 | 0.933333333 | NLGN3 AND NOT-IFNLR1 | 0.903225806 | 0.875 | 0.933333333 |
| TNFRSF8 AND NOT-OPRM1 | 0.933333333 | 0.933333333 | 0.933333333 | NLGN3 AND NOT-DCT | 0.903225806 | 0.875 | 0.933333333 |
| TNFRSF8 AND NOT-OR2C1 | 0.933333333 | 0.933333333 | 0.933333333 | NLGN3 AND NOT-PAQR7 | 0.933333333 | 0.933333333 | 0.933333333 |
| TNFRSF8 AND NOT-OR3A1 | 0.933333333 | 0.933333333 | 0.933333333 | NLGN3 AND NOT-LRRN4 | 0.903225806 | 0.875 | 0.933333333 |
| TNFRSF8 AND NOT-P2RX1 | 0.933333333 | 0.933333333 | 0.933333333 | NLGN3 AND NOT-TMPRSS6 | 0.903225806 | 0.875 | 0.933333333 |
| TNFRSF8 AND NOT-P2RX7 | 0.928571429 | 1 | 0.866666667 | NLGN3 AND NOT-ADGRF3 | 0.903225806 | 0.875 | 0.933333333 |
| TNFRSF8 AND NOT-P2RY1 | 0.933333333 | 0.933333333 | 0.933333333 | NLGN3 AND NOT-DDOST | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-P2RY2 | 0.965517241 | 1 | 0.933333333 | NLGN3 AND NOT-CLEC4F | 0.903225806 | 0.875 | 0.933333333 |
| TNFRSF8 AND NOT-P2RY4 | 0.933333333 | 0.933333333 | 0.933333333 | NLGN3 AND NOT-GPR156 | 0.903225806 | 0.875 | 0.933333333 |
| TNFRSF8 AND NOT-P2RY6 | 0.933333333 | 0.933333333 | 0.933333333 | NLGN3 AND NOT-CHST13 | 0.903225806 | 0.875 | 0.933333333 |
| TNFRSF8 AND NOT-CD207 | 0.933333333 | 0.933333333 | 0.933333333 | NLGN3 AND NOT-ADGRA3 | 0.903225806 | 0.875 | 0.933333333 |
| TNFRSF8 AND NOT-DUOX2 | 0.933333333 | 0.933333333 | 0.933333333 | NLGN3 AND NOT-SGMS2 | 0.903225806 | 0.875 | 0.933333333 |
| TNFRSF8 AND NOT-CHST11 | 0.965517241 | 1 | 0.933333333 | SLC4A4 AND NOT-SGMS2 | 0.928571429 | 1 | 0.866666667 |
| TNFRSF8 AND NOT-ATP6V0A4 | 0.933333333 | 0.933333333 | 0.933333333 | NLGN3 AND NOT-GALNTL5 | 0.903225806 | 0.875 | 0.933333333 |
| TNFRSF8 AND NOT-CYHR1 | 0.933333333 | 0.933333333 | 0.933333333 | NLGN3 AND NOT-RNF133 | 0.903225806 | 0.875 | 0.933333333 |
| TNFRSF8 AND NOT-KCNK4 | 0.965517241 | 1 | 0.933333333 | NLGN3 AND NOT-PKD1L1 | 0.903225806 | 0.875 | 0.933333333 |
| TNFRSF8 AND NOT-TAS2R1 | 0.933333333 | 0.933333333 | 0.933333333 | NLGN3 AND NOT-SLC30A8 | 0.903225806 | 0.875 | 0.933333333 |
| TNFRSF8 AND NOT-TAS2R9 | 0.933333333 | 0.933333333 | 0.933333333 | NLGN3 AND NOT-TMEM64 | 0.933333333 | 0.933333333 | 0.933333333 |
| TNFRSF8 AND NOT-TAS2R7 | 0.933333333 | 0.933333333 | 0.933333333 | NLGN3 AND NOT-KCNV2 | 0.903225806 | 0.875 | 0.933333333 |
| TNFRSF8 AND NOT-TAS2R13 | 0.933333333 | 0.933333333 | 0.933333333 | NLGN3 AND NOT-TMEM252 | 0.903225806 | 0.875 | 0.933333333 |
| TNFRSF8 AND NOT-CLEC4A | 0.965517241 | 1 | 0.933333333 | NLGN3 AND NOT-NLGN3 | 0.903225806 | 0.875 | 0.933333333 |
| TNFRSF8 AND NOT-PCDH1 | 0.933333333 | 0.933333333 | 0.933333333 | NLGN3 AND NOT-GIMAP1 | 0.933333333 | 0.933333333 | 0.933333333 |
| TNFRSF8 AND NOT-PCDHGC3 | 0.933333333 | 0.933333333 | 0.933333333 | NLGN3 AND NOT-KCNG3 | 0.903225806 | 0.875 | 0.933333333 |
| TNFRSF8 AND NOT-SLC35B3 | 0.965517241 | 1 | 0.933333333 | NLGN3 AND NOT-CLYBL | 0.933333333 | 0.933333333 | 0.933333333 |
| TNFRSF8 AND NOT-DERL2 | 0.933333333 | 0.933333333 | 0.933333333 | NLGN3 AND NOT-FAM9C | 0.903225806 | 0.875 | 0.933333333 |
| TNFRSF8 AND NOT-PCDH9 | 0.965517241 | 1 | 0.933333333 | NLGN3 AND NOT-SPTSSA | 0.933333333 | 0.933333333 | 0.933333333 |
| TNFRSF8 AND NOT-ST8SIA3 | 0.933333333 | 0.933333333 | 0.933333333 | NLGN3 AND NOT-ABHD3 | 0.903225806 | 0.875 | 0.933333333 |
| TNFRSF8 AND NOT-ATL1 | 0.933333333 | 0.933333333 | 0.933333333 | NLGN3 AND NOT-DHCR24 | 0.933333333 | 0.933333333 | 0.933333333 |
| TNFRSF8 AND NOT-GAL | 0.933333333 | 0.933333333 | 0.933333333 | NLGN3 AND NOT-DIO1 | 0.903225806 | 0.875 | 0.933333333 |
| TNFRSF8 AND NOT-A4GNT | 0.933333333 | 0.933333333 | 0.933333333 | NLGN3 AND NOT-DNASE1 | 0.903225806 | 0.875 | 0.933333333 |
| TNFRSF8 AND NOT-SLC45A2 | 0.933333333 | 0.933333333 | 0.933333333 | NLGN3 AND NOT-AGER | 0.903225806 | 0.875 | 0.933333333 |
| TNFRSF8 AND NOT-CKLF | 0.965517241 | 1 | 0.933333333 | NLGN3 AND NOT-DPAGT1 | 0.933333333 | 0.933333333 | 0.933333333 |
| TNFRSF8 AND NOT-DUSP13 | 0.933333333 | 0.933333333 | 0.933333333 | NLGN3 AND NOT-DPP4 | 0.903225806 | 0.875 | 0.933333333 |
| TNFRSF8 AND NOT-CLDN18 | 0.933333333 | 0.933333333 | 0.933333333 | NLGN3 AND NOT-DPP6 | 0.903225806 | 0.875 | 0.933333333 |
| TNFRSF8 AND NOT-CLEC1B | 0.965517241 | 1 | 0.933333333 | NLGN3 AND NOT-NLGN3 | 0.903225806 | 0.875 | 0.933333333 |
| TNFRSF8 AND NOT-CLEC1A | 0.933333333 | 0.933333333 | 0.933333333 | NLGN3 AND NOT-DRD2 | 0.903225806 | 0.875 | 0.933333333 |
| TNFRSF8 AND NOT-PIPOX | 0.933333333 | 0.933333333 | 0.933333333 | NLGN3 AND NOT-DRD3 | 0.903225806 | 0.875 | 0.933333333 |
| TNFRSF8 AND NOT-TLR7 | 0.965517241 | 1 | 0.933333333 | NLGN3 AND NOT-DRD4 | 0.903225806 | 0.875 | 0.933333333 |
| TNFRSF8 AND NOT-CEND1 | 0.933333333 | 0.933333333 | 0.933333333 | NLGN3 AND NOT-DSC1 | 0.903225806 | 0.875 | 0.933333333 |
| TNFRSF8 AND NOT-RXFP3 | 0.933333333 | 0.933333333 | 0.933333333 | NLGN3 AND NOT-DSC2 | 0.903225806 | 0.875 | 0.933333333 |
| TNFRSF8 AND NOT-SLC15A3 | 0.933333333 | 0.933333333 | 0.933333333 | NLGN3 AND NOT-DSC3 | 0.933333333 | 0.933333333 | 0.933333333 |
| TNFRSF8 AND NOT-REEP2 | 0.965517241 | 1 | 0.933333333 | NOT-MMP16 AND DSCAM | 0.909090909 | 0.833333333 | 1 |
| TNFRSF8 AND NOT-PDCD1 | 0.933333333 | 0.933333333 | 0.933333333 | NLGN3 AND NOT-DSG2 | 0.903225806 | 0.875 | 0.933333333 |
| TNFRSF8 AND NOT-KLRF1 | 0.965517241 | 1 | 0.933333333 | SLC4A4 AND NOT-DSG2 | 0.928571429 | 1 | 0.866666667 |
| TNFRSF8 AND NOT-MBTPS2 | 0.933333333 | 0.933333333 | 0.933333333 | NLGN3 AND NOT-SLC26A2 | 0.933333333 | 0.933333333 | 0.933333333 |
| TNFRSF8 AND NOT-WNT16 | 0.933333333 | 0.933333333 | 0.933333333 | NLGN3 AND NOT-DTNA | 0.903225806 | 0.875 | 0.933333333 |
| TNFRSF8 AND NOT-SCARA3 | 0.933333333 | 0.933333333 | 0.933333333 | NLGN3 AND NOT-AGTR1 | 0.933333333 | 0.933333333 | 0.933333333 |
| TNFRSF8 AND NOT-GULP1 | 0.933333333 | 0.933333333 | 0.933333333 | NLGN3 AND NOT-AGTR2 | 0.903225806 | 0.875 | 0.933333333 |
| TNFRSF8 AND NOT-TMEM138 | 0.933333333 | 0.933333333 | 0.933333333 | NLGN3 AND NOT-NLGN3 | 0.903225806 | 0.875 | 0.933333333 |
| TNFRSF8 AND NOT-PDE6B | 0.933333333 | 0.933333333 | 0.933333333 | NLGN3 AND NOT-GPR183 | 0.933333333 | 0.933333333 | 0.933333333 |
| TNFRSF8 AND NOT-HMP19 | 0.933333333 | 0.933333333 | 0.933333333 | NLGN3 AND NOT-ECE1 | 0.933333333 | 0.933333333 | 0.933333333 |
| TNFRSF8 AND NOT-FKBP7 | 0.933333333 | 0.933333333 | 0.933333333 | NLGN3 AND NOT-EDA | 0.933333333 | 0.933333333 | 0.933333333 |
| TNFRSF8 AND NOT-ENPP1 | 0.933333333 | 0.933333333 | 0.933333333 | NLGN3 AND NOT-NLGN3 | 0.903225806 | 0.875 | 0.933333333 |
| TNFRSF8 AND NOT-ENPP3 | 0.933333333 | 0.933333333 | 0.933333333 | NLGN3 AND NOT-LPAR1 | 0.903225806 | 0.875 | 0.933333333 |
| TNFRSF8 AND NOT-ACSL5 | 0.933333333 | 0.933333333 | 0.933333333 | NLGN3 AND NOT-NLGN3 | 0.903225806 | 0.875 | 0.933333333 |
| TNFRSF8 AND NOT-CD244 | 0.965517241 | 1 | 0.933333333 | NLGN3 AND NOT-EDNRA | 0.903225806 | 0.875 | 0.933333333 |
| TNFRSF8 AND NOT-HIGD1B | 0.933333333 | 0.933333333 | 0.933333333 | NLGN3 AND NOT-NLGN3 | 0.903225806 | 0.875 | 0.933333333 |
| TNFRSF8 AND NOT-TMEM8B | 0.965517241 | 1 | 0.933333333 | NLGN3 AND NOT-PGAM5 | 0.903225806 | 0.875 | 0.933333333 |
| TNFRSF8 AND NOT-ASIC5 | 0.933333333 | 0.933333333 | 0.933333333 | NLGN3 AND NOT-EFNB1 | 0.933333333 | 0.933333333 | 0.933333333 |
| TNFRSF8 AND NOT-TUBA8 | 0.933333333 | 0.933333333 | 0.933333333 | NLGN3 AND NOT-EFNB3 | 0.903225806 | 0.875 | 0.933333333 |
| TNFRSF8 AND NOT-PF4 | 0.965517241 | 1 | 0.933333333 | NLGN3 AND NOT-EGF | 0.903225806 | 0.875 | 0.933333333 |
| TNFRSF8 AND NOT-ABCB1 | 0.928571429 | 1 | 0.866666667 | NLGN3 AND NOT-NLGN3 | 0.903225806 | 0.875 | 0.933333333 |
| TNFRSF8 AND NOT-ABCB4 | 0.933333333 | 0.933333333 | 0.933333333 | NLGN3 AND NOT-MPZL3 | 0.903225806 | 0.875 | 0.933333333 |
| TNFRSF8 AND NOT-PI3 | 0.965517241 | 1 | 0.933333333 | NLGN3 AND NOT-DNAH10 | 0.903225806 | 0.875 | 0.933333333 |
| TNFRSF8 AND NOT-SERPINB13 | 0.933333333 | 0.933333333 | 0.933333333 | NLGN3 AND NOT-PLBD2 | 0.933333333 | 0.933333333 | 0.933333333 |
| TNFRSF8 AND NOT-PIGA | 0.933333333 | 0.933333333 | 0.933333333 | NLGN3 AND NOT-ANO6 | 0.903225806 | 0.875 | 0.933333333 |
| TNFRSF8 AND NOT-PIGR | 0.933333333 | 0.933333333 | 0.933333333 | NLGN3 AND NOT-VSTM4 | 0.933333333 | 0.933333333 | 0.933333333 |
| TNFRSF8 AND NOT-PKHD1 | 0.933333333 | 0.933333333 | 0.933333333 | NLGN3 AND NOT-FAM24B | 0.903225806 | 0.875 | 0.933333333 |
| TNFRSF8 AND NOT-IL17D | 0.933333333 | 0.933333333 | 0.933333333 | NLGN3 AND NOT-ADCY4 | 0.933333333 | 0.933333333 | 0.933333333 |
| TNFRSF8 AND NOT-CHIC1 | 0.933333333 | 0.933333333 | 0.933333333 | NLGN3 AND NOT-EPHA2 | 0.933333333 | 0.933333333 | 0.933333333 |
| TNFRSF8 AND NOT-TM6SF1 | 0.965517241 | 1 | 0.933333333 | NLGN3 AND NOT-LCTL | 0.903225806 | 0.875 | 0.933333333 |
| TNFRSF8 AND NOT-STX18 | 0.933333333 | 0.933333333 | 0.933333333 | NLGN3 AND NOT-ELANE | 0.903225806 | 0.875 | 0.933333333 |
| TNFRSF8 AND NOT-PLIN1 | 0.933333333 | 0.933333333 | 0.933333333 | NLGN3 AND NOT-MCEMP1 | 0.903225806 | 0.875 | 0.933333333 |
| TNFRSF8 AND NOT-FXYD1 | 0.965517241 | 1 | 0.933333333 | NLGN3 AND NOT-NLGN3 | 0.903225806 | 0.875 | 0.933333333 |
| TNFRSF8 AND NOT-FXYD3 | 0.933333333 | 0.933333333 | 0.933333333 | NLGN3 AND NOT-TMEM201 | 0.903225806 | 0.875 | 0.933333333 |
| TNFRSF8 AND NOT-PLP1 | 0.933333333 | 0.933333333 | 0.933333333 | NLGN3 AND NOT-TMEM61 | 0.933333333 | 0.933333333 | 0.933333333 |
| TNFRSF8 AND NOT-ADAM22 | 0.933333333 | 0.933333333 | 0.933333333 | NLGN3 AND NOT-NLGN3 | 0.903225806 | 0.875 | 0.933333333 |
| TNFRSF8 AND NOT-S1PR5 | 0.965517241 | 1 | 0.933333333 | NLGN3 AND NOT-SLC5A9 | 0.903225806 | 0.875 | 0.933333333 |
| TNFRSF8 AND NOT-FXYD7 | 0.933333333 | 0.933333333 | 0.933333333 | NLGN3 AND NOT-FAM209A | 0.903225806 | 0.875 | 0.933333333 |
| TNFRSF8 AND NOT-FXYD6 | 0.933333333 | 0.933333333 | 0.933333333 | NLGN3 AND NOT-KRTCAP3 | 0.903225806 | 0.875 | 0.933333333 |
| TNFRSF8 AND NOT-FXYD4 | 0.933333333 | 0.933333333 | 0.933333333 | NLGN3 AND NOT-SLC51A | 0.933333333 | 0.933333333 | 0.933333333 |
| TNFRSF8 AND NOT-IL20RB | 0.933333333 | 0.933333333 | 0.933333333 | NLGN3 AND NOT-TVP23C | 0.928571429 | 1 | 0.866666667 |
| TNFRSF8 AND NOT-GPR87 | 0.933333333 | 0.933333333 | 0.933333333 | NLGN3 AND NOT-SLC39A11 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-DUOX1 | 0.933333333 | 0.933333333 | 0.933333333 | NLGN3 AND NOT-RDM1 | 0.903225806 | 0.875 | 0.933333333 |
| TNFRSF8 AND NOT-SLCO1C1 | 0.933333333 | 0.933333333 | 0.933333333 | NLGN3 AND NOT-NLGN3 | 0.903225806 | 0.875 | 0.933333333 |
| TNFRSF8 AND NOT-FAM3B | 0.933333333 | 0.933333333 | 0.933333333 | NLGN3 AND NOT-ADGRE1 | 0.903225806 | 0.875 | 0.933333333 |
| TNFRSF8 AND NOT-TLR9 | 0.965517241 | 1 | 0.933333333 | NLGN3 AND NOT-TIGIT | 0.903225806 | 0.875 | 0.933333333 |
| TNFRSF8 AND NOT-KCNK10 | 0.933333333 | 0.933333333 | 0.933333333 | NLGN3 AND NOT-TMEM192 | 0.933333333 | 0.933333333 | 0.933333333 |
| TNFRSF8 AND NOT-TREM2 | 0.933333333 | 0.933333333 | 0.933333333 | NLGN3 AND NOT-TAPT1 | 0.903225806 | 0.875 | 0.933333333 |
| TNFRSF8 AND NOT-TREM1 | 0.965517241 | 1 | 0.933333333 | NLGN3 AND NOT-ENG | 0.933333333 | 0.933333333 | 0.933333333 |
| TNFRSF8 AND NOT-GDAP1 | 0.933333333 | 0.933333333 | 0.933333333 | NLGN3 AND NOT-ENPEP | 0.903225806 | 0.875 | 0.933333333 |
| TNFRSF8 AND NOT-WNT4 | 0.933333333 | 0.933333333 | 0.933333333 | NLGN3 AND NOT-SLC29A1 | 0.933333333 | 0.933333333 | 0.933333333 |
| TNFRSF8 AND NOT-NLGN3 | 0.933333333 | 0.933333333 | 0.933333333 | NLGN3 AND NOT-HTRA4 | 0.903225806 | 0.875 | 0.933333333 |
| TNFRSF8 AND NOT-DNAJC10 | 0.933333333 | 0.933333333 | 0.933333333 | NLGN3 AND NOT-C9orf91 | 0.903225806 | 0.875 | 0.933333333 |
| TNFRSF8 AND NOT-YIPF1 | 0.933333333 | 0.933333333 | 0.933333333 | NLGN3 AND NOT-NRK | 0.965517241 | 1 | 0.933333333 |
| TNFRSF8 AND NOT-FAM105A | 0.933333333 | 0.933333333 | 0.933333333 | NLGN3 AND NOT-VMA21 | 0.903225806 | 0.875 | 0.933333333 |
| TNFRSF8 AND NOT-ZDHHC13 | 0.933333333 | 0.933333333 | 0.933333333 | NLGN3 AND NOT-TMEM31 | 0.903225806 | 0.875 | 0.933333333 |
| TNFRSF8 AND NOT-SDK2 | 0.965517241 | 1 | 0.933333333 | NLGN3 AND NOT-ANO5 | 0.903225806 | 0.875 | 0.933333333 |
| TNFRSF8 AND NOT-UGT1A8 | 0.933333333 | 0.933333333 | 0.933333333 | NLGN3 AND NOT-NLGN3 | 0.903225806 | 0.875 | 0.933333333 |
| TNFRSF8 AND NOT-EQTN | 0.933333333 | 0.933333333 | 0.933333333 | NLGN3 AND NOT-EPHA1 | 0.903225806 | 0.875 | 0.933333333 |
| TNFRSF8 AND NOT-NDFIP2 | 0.933333333 | 0.933333333 | 0.933333333 | NLGN3 AND NOT-CERS3 | 0.903225806 | 0.875 | 0.933333333 |
| TNFRSF8 AND NOT-VSIG10 | 0.933333333 | 0.933333333 | 0.933333333 | NLGN3 AND NOT-EPHA3 | 0.903225806 | 0.875 | 0.933333333 |
| TNFRSF8 AND NOT-LRRN3 | 0.965517241 | 1 | 0.933333333 | NLGN3 AND NOT-EPHA4 | 0.903225806 | 0.875 | 0.933333333 |
| TNFRSF8 AND NOT-CRLS1 | 0.933333333 | 0.933333333 | 0.933333333 | NLGN3 AND NOT-EPHA8 | 0.903225806 | 0.875 | 0.933333333 |
| TNFRSF8 AND NOT-SLC6A20 | 0.933333333 | 0.933333333 | 0.933333333 | NLGN3 AND NOT-SLC44A5 | 0.903225806 | 0.875 | 0.933333333 |
| TNFRSF8 AND NOT-PPBP | 0.965517241 | 1 | 0.933333333 | NLGN3 AND NOT-EPHB4 | 0.933333333 | 0.933333333 | 0.933333333 |
| TNFRSF8 AND NOT-LEPROT | 0.965517241 | 1 | 0.933333333 | NLGN3 AND NOT-EPHB6 | 0.903225806 | 0.875 | 0.933333333 |
| TNFRSF8 AND NOT-DNAJB12 | 0.928571429 | 1 | 0.866666667 | NLGN3 AND NOT-STX2 | 0.933333333 | 0.933333333 | 0.933333333 |
| TNFRSF8 AND NOT-TMEM33 | 0.965517241 | 1 | 0.933333333 | NLGN3 AND NOT-EPO | 0.903225806 | 0.875 | 0.933333333 |
| TNFRSF8 AND NOT-FBXW7 | 0.965517241 | 1 | 0.933333333 | NLGN3 AND NOT-LVRN | 0.903225806 | 0.875 | 0.933333333 |
| TNFRSF8 AND NOT-RNF121 | 0.928571429 | 1 | 0.866666667 | NLGN3 AND NOT-SLC36A1 | 0.903225806 | 0.875 | 0.933333333 |
| TNFRSF8 AND NOT-SLC22A15 | 0.928571429 | 1 | 0.866666667 | NLGN3 AND NOT-ERBB3 | 0.903225806 | 0.875 | 0.933333333 |
| TNFRSF8 AND NOT-NPY4R | 0.928571429 | 1 | 0.866666667 | NLGN3 AND NOT-EREG | 0.903225806 | 0.875 | 0.933333333 |
| TNFRSF8 AND NOT-SMPD3 | 0.965517241 | 1 | 0.933333333 | NLGN3 AND NOT-NLGN3 | 0.903225806 | 0.875 | 0.933333333 |
| TNFRSF8 AND NOT-ACPP | 0.965517241 | 1 | 0.933333333 | NLGN3 AND NOT-ERN1 | 0.933333333 | 0.933333333 | 0.933333333 |
| TNFRSF8 AND NOT-ALG1 | 0.928571429 | 1 | 0.866666667 | NLGN3 AND NOT-ETV6 | 0.933333333 | 0.933333333 | 0.933333333 |
| TNFRSF8 AND NOT-PCDHB12 | 0.928571429 | 1 | 0.866666667 | NLGN3 AND NOT-EVC | 0.903225806 | 0.875 | 0.933333333 |
| TNFRSF8 AND NOT-LRRC8A | 0.928571429 | 1 | 0.866666667 | NLGN3 AND NOT-EXT1 | 0.933333333 | 0.933333333 | 0.933333333 |
| TNFRSF8 AND NOT-UGGT1 | 0.965517241 | 1 | 0.933333333 | NLGN3 AND NOT-F2R | 0.903225806 | 0.875 | 0.933333333 |
| TNFRSF8 AND NOT-LPAR5 | 0.965517241 | 1 | 0.933333333 | NLGN3 AND NOT-F2RL1 | 0.903225806 | 0.875 | 0.933333333 |
| TNFRSF8 AND NOT-RHBG | 0.965517241 | 1 | 0.933333333 | NLGN3 AND NOT-F2RL2 | 0.903225806 | 0.875 | 0.933333333 |
| TNFRSF8 AND NOT-TMEM159 | 0.965517241 | 1 | 0.933333333 | NLGN3 AND NOT-NLGN3 | 0.903225806 | 0.875 | 0.933333333 |
| TNFRSF8 AND NOT-ATP10D | 0.928571429 | 1 | 0.866666667 | NLGN3 AND NOT-F10 | 0.933333333 | 0.933333333 | 0.933333333 |
| TNFRSF8 AND NOT-PTAFR | 0.965517241 | 1 | 0.933333333 | NLGN3 AND NOT-ACSL1 | 0.903225806 | 0.875 | 0.933333333 |
| TNFRSF8 AND NOT-PTGDR | 0.965517241 | 1 | 0.933333333 | NLGN3 AND NOT-NLGN3 | 0.903225806 | 0.875 | 0.933333333 |
| TNFRSF8 AND NOT-PTGER2 | 0.965517241 | 1 | 0.933333333 | NLGN3 AND NOT-LRRC55 | 0.903225806 | 0.875 | 0.933333333 |
| TNFRSF8 AND NOT-PTGS1 | 0.965517241 | 1 | 0.933333333 | NLGN3 AND NOT-NLGN3 | 0.903225806 | 0.875 | 0.933333333 |
| TNFRSF8 AND NOT-TMCC3 | 0.965517241 | 1 | 0.933333333 | NLGN3 AND NOT-UNC5B | 0.903225806 | 0.875 | 0.933333333 |
| TNFRSF8 AND NOT-KIDINS220 | 0.965517241 | 1 | 0.933333333 | NLGN3 AND NOT-FAT2 | 0.903225806 | 0.875 | 0.933333333 |
| TNFRSF8 AND NOT-SLC46A2 | 0.928571429 | 1 | 0.866666667 | NLGN3 AND NOT-TMEM218 | 0.933333333 | 0.933333333 | 0.933333333 |
| TNFRSF8 AND NOT-PTPRC | 0.965517241 | 1 | 0.933333333 | NLGN3 AND NOT-TMEM136 | 0.933333333 | 0.933333333 | 0.933333333 |
| TNFRSF8 AND NOT-PTPRJ | 0.965517241 | 1 | 0.933333333 | NLGN3 AND NOT-MPEG1 | 0.933333333 | 0.933333333 | 0.933333333 |
| TNFRSF8 AND NOT-PTPRO | 0.965517241 | 1 | 0.933333333 | NLGN3 AND NOT-CYB561A3 | 0.933333333 | 0.933333333 | 0.933333333 |
| TNFRSF8 AND NOT-BAX | 0.965517241 | 1 | 0.933333333 | NLGN3 AND NOT-LRTOMT | 0.903225806 | 0.875 | 0.933333333 |
| TNFRSF8 AND NOT-BBS4 | 0.965517241 | 1 | 0.933333333 | NLGN3 AND NOT-FBN2 | 0.933333333 | 0.933333333 | 0.933333333 |
| TNFRSF8 AND NOT-IL22RA1 | 0.928571429 | 1 | 0.866666667 | NLGN3 AND NOT-RNF152 | 0.903225806 | 0.875 | 0.933333333 |
| TNFRSF8 AND NOT-ENPP5 | 0.965517241 | 1 | 0.933333333 | NLGN3 AND NOT-FCAR | 0.903225806 | 0.875 | 0.933333333 |
| TNFRSF8 AND NOT-RARRES3 | 0.965517241 | 1 | 0.933333333 | NLGN3 AND NOT-FCER1A | 0.903225806 | 0.875 | 0.933333333 |
| TNFRSF8 AND NOT-CACNG8 | 0.928571429 | 1 | 0.866666667 | NLGN3 AND NOT-MS4A2 | 0.903225806 | 0.875 | 0.933333333 |
| TNFRSF8 AND NOT-SIGIRR | 0.965517241 | 1 | 0.933333333 | NLGN3 AND NOT-FCER2 | 0.903225806 | 0.875 | 0.933333333 |
| TNFRSF8 AND NOT-HRH4 | 0.965517241 | 1 | 0.933333333 | NLGN3 AND NOT-NLGN3 | 0.903225806 | 0.875 | 0.933333333 |
| TNFRSF8 AND NOT-LGR6 | 0.965517241 | 1 | 0.933333333 | NLGN3 AND NOT-MARCH8 | 0.903225806 | 0.875 | 0.933333333 |
| TNFRSF8 AND NOT-RHO | 0.965517241 | 1 | 0.933333333 | NLGN3 AND NOT-NLGN3 | 0.903225806 | 0.875 | 0.933333333 |
| TNFRSF8 AND NOT-RTN1 | 0.965517241 | 1 | 0.933333333 | NLGN3 AND NOT-NLGN3 | 0.903225806 | 0.875 | 0.933333333 |
| TNFRSF8 AND NOT-TMBIM1 | 0.965517241 | 1 | 0.933333333 | NLGN3 AND NOT-NLGN3 | 0.903225806 | 0.875 | 0.933333333 |
| TNFRSF8 AND NOT-C10orf54 | 0.965517241 | 1 | 0.933333333 | NLGN3 AND NOT-CES5A | 0.903225806 | 0.875 | 0.933333333 |
| TNFRSF8 AND NOT-XYLT1 | 0.965517241 | 1 | 0.933333333 | NLGN3 AND NOT-FAM26D | 0.903225806 | 0.875 | 0.933333333 |
| TNFRSF8 AND NOT-DPEP2 | 0.965517241 | 1 | 0.933333333 | NLGN3 AND NOT-FAM162B | 0.933333333 | 0.933333333 | 0.933333333 |
| TNFRSF8 AND NOT-HERPUD2 | 0.965517241 | 1 | 0.933333333 | NLGN3 AND NOT-OPN5 | 0.903225806 | 0.875 | 0.933333333 |
| TNFRSF8 AND NOT-SFTPC | 0.965517241 | 1 | 0.933333333 | NLGN3 AND NOT-ADGRF4 | 0.903225806 | 0.875 | 0.933333333 |
| TNFRSF8 AND NOT-SUSD1 | 0.928571429 | 1 | 0.866666667 | NLGN3 AND NOT-ADGRF5 | 0.933333333 | 0.933333333 | 0.933333333 |
| TNFRSF8 AND NOT-MARC1 | 0.965517241 | 1 | 0.933333333 | NLGN3 AND NOT-TMEM217 | 0.903225806 | 0.875 | 0.933333333 |
| TNFRSF8 AND NOT-FBXL17 | 0.928571429 | 1 | 0.866666667 | NLGN3 AND NOT-PI16 | 0.903225806 | 0.875 | 0.933333333 |
| TNFRSF8 AND NOT-ST3GAL3 | 0.965517241 | 1 | 0.933333333 | NLGN3 AND NOT-C6orf89 | 0.933333333 | 0.933333333 | 0.933333333 |
| TNFRSF8 AND NOT-MPPE1 | 0.928571429 | 1 | 0.866666667 | NLGN3 AND NOT-LEMD2 | 0.933333333 | 0.933333333 | 0.933333333 |
| TNFRSF8 AND NOT-SLC6A12 | 0.965517241 | 1 | 0.933333333 | NLGN3 AND NOT-NLGN3 | 0.903225806 | 0.875 | 0.933333333 |
| TNFRSF8 AND NOT-SLC8A1 | 0.965517241 | 1 | 0.933333333 | NLGN3 AND NOT-FAM200A | 0.903225806 | 0.875 | 0.933333333 |
| TNFRSF8 AND NOT-SLC11A1 | 0.965517241 | 1 | 0.933333333 | NLGN3 AND NOT-FCGRT | 0.933333333 | 0.933333333 | 0.933333333 |
| TNFRSF8 AND NOT-SLC14A1 | 0.928571429 | 1 | 0.866666667 | NLGN3 AND NOT-NLGN3 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| TNFRSF8 AND NOT-BNIP2 | 0.965517241 | 1 | 0.933333333 | NLGN3 AND NOT-DAGLB | 0.933333333 | 0.933333333 | 0.933333333 |
| TNFRSF8 AND NOT-SPINT1 | 0.928571429 | 1 | 0.866666667 | NLGN3 AND NOT-NLGN3 | 0.903225806 | 0.875 | 0.933333333 |
| TNFRSF8 AND NOT-SPN | 0.928571429 | 1 | 0.866666667 | NLGN3 AND NOT-TMED4 | 0.903225806 | 0.875 | 0.933333333 |
| TNFRSF8 AND NOT-BPI | 0.965517241 | 1 | 0.933333333 | NLGN3 AND NOT-FCN2 | 0.933333333 | 0.933333333 | 0.933333333 |
| TNFRSF8 AND NOT-SSR1 | 0.965517241 | 1 | 0.933333333 | NLGN3 AND NOT-KIAA1324L | 0.903225806 | 0.875 | 0.933333333 |
| TNFRSF8 AND NOT-SSTR4 | 0.965517241 | 1 | 0.933333333 | NLGN3 AND NOT-ADGRG3 | 0.903225806 | 0.875 | 0.933333333 |
| TNFRSF8 AND NOT-STX3 | 0.965517241 | 1 | 0.933333333 | NLGN3 AND NOT-GPRC6A | 0.933333333 | 0.933333333 | 0.933333333 |
| TNFRSF8 AND NOT-BST1 | 0.965517241 | 1 | 0.933333333 | NLGN3 AND NOT-ADGRF2 | 0.903225806 | 0.875 | 0.933333333 |
| TNFRSF8 AND NOT-TGFBR1 | 0.965517241 | 1 | 0.933333333 | NLGN3 AND NOT-TSPO2 | 0.903225806 | 0.875 | 0.933333333 |
| TNFRSF8 AND NOT-TGFBR3 | 0.965517241 | 1 | 0.933333333 | NLGN3 AND NOT-UNC5CL | 0.903225806 | 0.875 | 0.933333333 |
| TNFRSF8 AND NOT-TSPO | 0.928571429 | 1 | 0.866666667 | NLGN3 AND NOT-LHFPL5 | 0.903225806 | 0.875 | 0.933333333 |
| TNFRSF8 AND NOT-TLR1 | 0.928571429 | 1 | 0.866666667 | NLGN3 AND NOT-NLGN3 | 0.903225806 | 0.875 | 0.933333333 |
| TNFRSF8 AND NOT-TLR2 | 0.965517241 | 1 | 0.933333333 | NLGN3 AND NOT-ALDH3A2 | 0.933333333 | 0.933333333 | 0.933333333 |
| TNFRSF8 AND NOT-TLR4 | 0.965517241 | 1 | 0.933333333 | NLGN3 AND NOT-FGF6 | 0.903225806 | 0.875 | 0.933333333 |
| TNFRSF8 AND NOT-TLR5 | 0.965517241 | 1 | 0.933333333 | NLGN3 AND NOT-FGF7 | 0.903225806 | 0.875 | 0.933333333 |
| TNFRSF8 AND NOT-TNFRSF1B | 0.965517241 | 1 | 0.933333333 | NLGN3 AND NOT-FGF10 | 0.903225806 | 0.875 | 0.933333333 |
| TNFRSF8 AND NOT-TRPC4 | 0.928571429 | 1 | 0.866666667 | NLGN3 AND NOT-NLGN3 | 0.903225806 | 0.875 | 0.933333333 |
| TNFRSF8 AND NOT-C5AR1 | 0.965517241 | 1 | 0.933333333 | NLGN3 AND NOT-FGFR3 | 0.903225806 | 0.875 | 0.933333333 |
| TNFRSF8 AND NOT-CCR2 | 0.928571429 | 1 | 0.866666667 | NLGN3 AND NOT-FGFR2 | 0.903225806 | 0.875 | 0.933333333 |
| TNFRSF8 AND NOT-TMEM242 | 0.965517241 | 1 | 0.933333333 | NLGN3 AND NOT-FGFR4 | 0.903225806 | 0.875 | 0.933333333 |
| TNFRSF8 AND NOT-UGT2B17 | 0.928571429 | 1 | 0.866666667 | NLGN3 AND NOT-FGG | 0.933333333 | 0.933333333 | 0.933333333 |
| TNFRSF8 AND NOT-UPK3A | 0.965517241 | 1 | 0.933333333 | NLGN3 AND NOT-ITGA11 | 0.933333333 | 0.933333333 | 0.933333333 |
| TNFRSF8 AND NOT-VIPR1 | 0.965517241 | 1 | 0.933333333 | NLGN3 AND NOT-CLCA4 | 0.903225806 | 0.875 | 0.933333333 |
| TNFRSF8 AND NOT-VIPR2 | 0.965517241 | 1 | 0.933333333 | NLGN3 AND NOT-NLGN3 | 0.903225806 | 0.875 | 0.933333333 |
| TNFRSF8 AND NOT-DAGLA | 0.965517241 | 1 | 0.933333333 | NLGN3 AND NOT-NLGN4Y | 0.903225806 | 0.875 | 0.933333333 |
| TNFRSF8 AND NOT-LDLRAD4 | 0.965517241 | 1 | 0.933333333 | NLGN3 AND NOT-DOLK | 0.933333333 | 0.933333333 | 0.933333333 |
| TNFRSF8 AND NOT-SLC30A1 | 0.965517241 | 1 | 0.933333333 | NLGN3 AND NOT-LMTK2 | 0.903225806 | 0.875 | 0.933333333 |
| TNFRSF8 AND NOT-SLC25A20 | 0.965517241 | 1 | 0.933333333 | NLGN3 AND NOT-CHSY1 | 0.903225806 | 0.875 | 0.933333333 |
| TNFRSF8 AND NOT-ATG9A | 0.965517241 | 1 | 0.933333333 | KCNQ2 AND NOT-ADGRL1 | 0.928571429 | 1 | 0.866666667 |
| TNFRSF8 AND NOT-FKRP | 0.928571429 | 1 | 0.866666667 | NLGN3 AND NOT-NLGN3 | 0.903225806 | 0.875 | 0.933333333 |
| TNFRSF8 AND NOT-GNPTAB | 0.965517241 | 1 | 0.933333333 | NLGN3 AND NOT-SLITRK3 | 0.903225806 | 0.875 | 0.933333333 |
| TNFRSF8 AND NOT-SLC39A7 | 0.965517241 | 1 | 0.933333333 | NRCAM AND NOT-CLSTN1 | 0.928571429 | 1 | 0.866666667 |
| TNFRSF8 AND NOT-LST1 | 0.965517241 | 1 | 0.933333333 | NLGN3 AND NOT-ZP1 | 0.903225806 | 0.875 | 0.933333333 |
| TNFRSF8 AND NOT-RHBDF2 | 0.928571429 | 1 | 0.866666667 | NLGN3 AND NOT-CD93 | 0.933333333 | 0.933333333 | 0.933333333 |
| TNFRSF8 AND NOT-TXNDC15 | 0.928571429 | 1 | 0.866666667 | NLGN3 AND NOT-PLA2R1 | 0.933333333 | 0.933333333 | 0.933333333 |
| TNFRSF8 AND NOT-MCTP1 | 0.965517241 | 1 | 0.933333333 | NLGN3 AND NOT-SCAP | 0.903225806 | 0.875 | 0.933333333 |
| TNFRSF8 AND NOT-CLMN | 0.965517241 | 1 | 0.933333333 | NLGN3 AND NOT-NLGN3 | 0.903225806 | 0.875 | 0.933333333 |
| TNFRSF8 AND NOT-WLS | 0.965517241 | 1 | 0.933333333 | SORCS3 AND TSPAN11 | 0.909090909 | 0.833333333 | 1 |
| TNFRSF8 AND NOT-UXS1 | 0.965517241 | 1 | 0.933333333 | SORCS3 AND P2RX4 | 0.909090909 | 0.833333333 | 1 |
| TNFRSF8 AND NOT-TRAF3IP3 | 0.965517241 | 1 | 0.933333333 | SORCS3 AND OGFOD3 | 0.909090909 | 0.833333333 | 1 |
| TNFRSF8 AND NOT-PRR7 | 0.965517241 | 1 | 0.933333333 | SORCS3 AND GPAA1 | 0.909090909 | 0.833333333 | 1 |
| TNFRSF8 AND NOT-CAMP | 0.965517241 | 1 | 0.933333333 | SORCS3 AND MPZL1 | 0.909090909 | 0.833333333 | 1 |
| TNFRSF8 AND NOT-KLRC4 | 0.965517241 | 1 | 0.933333333 | NLGN3 AND NOT-SV2C | 0.903225806 | 0.875 | 0.933333333 |
| TNFRSF8 AND NOT-STX7 | 0.965517241 | 1 | 0.933333333 | NLGN3 AND NOT-PCNX | 0.933333333 | 0.933333333 | 0.933333333 |
| TNFRSF8 AND NOT-TMEM175 | 0.965517241 | 1 | 0.933333333 | NLGN3 AND NOT-NLGN3 | 0.903225806 | 0.875 | 0.933333333 |
| TNFRSF8 AND NOT-HVCN1 | 0.965517241 | 1 | 0.933333333 | NLGN3 AND NOT-TMCC1 | 0.903225806 | 0.875 | 0.933333333 |
| TNFRSF8 AND NOT-RECK | 0.965517241 | 1 | 0.933333333 | NLGN3 AND NOT-TBC1D2B | 0.933333333 | 0.933333333 | 0.933333333 |
| TNFRSF8 AND NOT-MCHR2 | 0.965517241 | 1 | 0.933333333 | NLGN3 AND NOT-NFASC | 0.903225806 | 0.875 | 0.933333333 |
| TNFRSF8 AND NOT-ATRN | 0.965517241 | 1 | 0.933333333 | NLGN3 AND NOT-ATP10B | 0.903225806 | 0.875 | 0.933333333 |
| TNFRSF8 AND NOT-TPST2 | 0.928571429 | 1 | 0.866666667 | NLGN3 AND NOT-PLXND1 | 0.933333333 | 0.933333333 | 0.933333333 |
| TNFRSF8 AND NOT-ADGRE3 | 0.965517241 | 1 | 0.933333333 | NLGN3 AND NOT-ANKLE2 | 0.903225806 | 0.875 | 0.933333333 |
| TNFRSF8 AND NOT-MS4A14 | 0.965517241 | 1 | 0.933333333 | NLGN3 AND NOT-LRCH1 | 0.933333333 | 0.933333333 | 0.933333333 |
| TNFRSF8 AND NOT-USP30 | 0.928571429 | 1 | 0.866666667 | NLGN3 AND NOT-GRAMD4 | 0.933333333 | 0.933333333 | 0.933333333 |
| TNFRSF8 AND NOT-AGPAT9 | 0.965517241 | 1 | 0.933333333 | NLGN3 AND NOT-MLANA | 0.903225806 | 0.875 | 0.933333333 |
| TNFRSF8 AND NOT-FCRLA | 0.928571429 | 1 | 0.866666667 | NLGN3 AND NOT-NLGN3 | 0.903225806 | 0.875 | 0.933333333 |
| TNFRSF8 AND NOT-SFT2D3 | 0.965517241 | 1 | 0.933333333 | NLGN3 AND NOT-STAB1 | 0.933333333 | 0.933333333 | 0.933333333 |
| TNFRSF8 AND NOT-ADTRP | 0.928571429 | 1 | 0.866666667 | NLGN3 AND NOT-SLC35D1 | 0.933333333 | 0.933333333 | 0.933333333 |
| TNFRSF8 AND NOT-LRCH3 | 0.928571429 | 1 | 0.866666667 | NLGN3 AND NOT-ATP11B | 0.903225806 | 0.875 | 0.933333333 |
| TNFRSF8 AND NOT-MFSD2A | 0.965517241 | 1 | 0.933333333 | NLGN3 AND NOT-NLGN3 | 0.903225806 | 0.875 | 0.933333333 |
| TNFRSF8 AND NOT-FAM73B | 0.928571429 | 1 | 0.866666667 | NLGN3 AND NOT-NUP210 | 0.903225806 | 0.875 | 0.933333333 |
| TNFRSF8 AND NOT-PLXDC2 | 0.928571429 | 1 | 0.866666667 | NLGN3 AND NOT-FLT3 | 0.903225806 | 0.875 | 0.933333333 |
| TNFRSF8 AND NOT-TMEM141 | 0.965517241 | 1 | 0.933333333 | NLGN3 AND NOT-NLGN3 | 0.903225806 | 0.875 | 0.933333333 |
| TNFRSF8 AND NOT-PAQR8 | 0.965517241 | 1 | 0.933333333 | NLGN3 AND NOT-ATP11A | 0.903225806 | 0.875 | 0.933333333 |
| TNFRSF8 AND NOT-DNAJC14 | 0.928571429 | 1 | 0.866666667 | NLGN3 AND NOT-KIAA1024 | 0.933333333 | 0.933333333 | 0.933333333 |
| TNFRSF8 AND NOT-SLC4A4 | 0.965517241 | 1 | 0.933333333 | NLGN3 AND NOT-ADGRL2 | 0.933333333 | 0.933333333 | 0.933333333 |
| TNFRSF8 AND NOT-STX10 | 0.965517241 | 1 | 0.933333333 | NLGN3 AND NOT-FMO3 | 0.933333333 | 0.933333333 | 0.933333333 |
| TNFRSF8 AND NOT-DGAT1 | 0.965517241 | 1 | 0.933333333 | NLGN3 AND NOT-FMO4 | 0.933333333 | 0.933333333 | 0.933333333 |
| TNFRSF8 AND NOT-TNFRSF10C | 0.928571429 | 1 | 0.866666667 | NLGN3 AND NOT-NLGN3 | 0.903225806 | 0.875 | 0.933333333 |
| TNFRSF8 AND NOT-TNFRSF10A | 0.965517241 | 1 | 0.933333333 | NLGN3 AND NOT-ICOSLG | 0.903225806 | 0.875 | 0.933333333 |
| TNFRSF8 AND NOT-VNN2 | 0.965517241 | 1 | 0.933333333 | NLGN3 AND NOT-FMO5 | 0.933333333 | 0.933333333 | 0.933333333 |
| TNFRSF8 AND NOT-MGAM | 0.965517241 | 1 | 0.933333333 | NLGN3 AND NOT-SLC9A8 | 0.933333333 | 0.933333333 | 0.933333333 |
| TNFRSF8 AND NOT-SYS1 | 0.965517241 | 1 | 0.933333333 | NLGN3 AND NOT-NLGN3 | 0.903225806 | 0.875 | 0.933333333 |
| TNFRSF8 AND NOT-TMEM55B | 0.928571429 | 1 | 0.866666667 | NLGN3 AND NOT-DNAJC16 | 0.933333333 | 0.933333333 | 0.933333333 |
| TNFRSF8 AND NOT-CD1C | 0.965517241 | 1 | 0.933333333 | NLGN3 AND NOT-ESYT1 | 0.933333333 | 0.933333333 | 0.933333333 |
| TNFRSF8 AND NOT-CD1D | 0.965517241 | 1 | 0.933333333 | NLGN3 AND NOT-FAM189A1 | 0.903225806 | 0.875 | 0.933333333 |
| TNFRSF8 AND NOT-SYNGR1 | 0.965517241 | 1 | 0.933333333 | NLGN3 AND NOT-ZDHHC17 | 0.903225806 | 0.875 | 0.933333333 |

FIG. 1 (CONT.)

| Antigen Pair Logic | F1 | Precision | Recall |
|---|---|---|---|
| TNFRSF8 AND NOT-MYADM | 0.965517241 | 1 | 0.933333333 |
| TNFRSF8 AND NOT-NXPE3 | 0.965517241 | 1 | 0.933333333 |
| TNFRSF8 AND NOT-CD3G | 0.928571429 | 1 | 0.866666667 |
| TNFRSF8 AND NOT-SLC16A7 | 0.965517241 | 1 | 0.933333333 |
| TNFRSF8 AND NOT-ZMYM6 | 0.965517241 | 1 | 0.933333333 |
| TNFRSF8 AND NOT-CD5 | 0.965517241 | 1 | 0.933333333 |
| TNFRSF8 AND NOT-TMEM129 | 0.965517241 | 1 | 0.933333333 |
| TNFRSF8 AND NOT-TMEM169 | 0.965517241 | 1 | 0.933333333 |
| TNFRSF8 AND NOT-MARCH9 | 0.965517241 | 1 | 0.933333333 |
| TNFRSF8 AND NOT-ORAI3 | 0.965517241 | 1 | 0.933333333 |
| TNFRSF8 AND NOT-PGAP3 | 0.965517241 | 1 | 0.933333333 |
| TNFRSF8 AND NOT-MS4A3 | 0.965517241 | 1 | 0.933333333 |
| TNFRSF8 AND NOT-SFXN5 | 0.965517241 | 1 | 0.933333333 |
| TNFRSF8 AND NOT-SNRNP40 | 0.965517241 | 1 | 0.933333333 |
| TNFRSF8 AND NOT-KCNK6 | 0.965517241 | 1 | 0.933333333 |
| TNFRSF8 AND NOT-ECEL1 | 0.965517241 | 1 | 0.933333333 |
| TNFRSF8 AND NOT-NCR1 | 0.928571429 | 1 | 0.866666667 |
| TNFRSF8 AND NOT-TNFSF8 | 0.928571429 | 1 | 0.866666667 |
| TNFRSF8 AND NOT-CD36 | 0.965517241 | 1 | 0.933333333 |
| TNFRSF8 AND NOT-SPTLC2 | 0.965517241 | 1 | 0.933333333 |
| TNFRSF8 AND NOT-EI24 | 0.965517241 | 1 | 0.933333333 |
| TNFRSF8 AND NOT-CD40LG | 0.965517241 | 1 | 0.933333333 |
| TNFRSF8 AND NOT-TMEM63A | 0.928571429 | 1 | 0.866666667 |
| TNFRSF8 AND NOT-TMCC2 | 0.965517241 | 1 | 0.933333333 |
| TNFRSF8 AND NOT-LPGAT1 | 0.965517241 | 1 | 0.933333333 |
| TNFRSF8 AND NOT-P2RY14 | 0.928571429 | 1 | 0.866666667 |
| TNFRSF8 AND NOT-SLC12A6 | 0.965517241 | 1 | 0.933333333 |
| Leiomyosarcoma (Leiomyosarcoma) | | | |
| NOT-SGPP2 AND VANGL1 | 1 | 1 | 1 |
| NOT-KRTCAP3 AND VANGL1 | 0.923076923 | 0.92307692 | 0.923076923 |
| NOT-SMIM5 AND NEMP1 | 0.916666667 | 1 | 0.846153846 |
| NOT-CRB3 AND ATP2A2 | 0.916666667 | 1 | 0.846153846 |
| NOT-F11R AND VANGL1 | 0.96 | 1 | 0.923076923 |
| NOT-RNF43 AND VANGL1 | 0.96 | 1 | 0.923076923 |
| NOT-SCNN1A AND VANGL1 | 0.96 | 1 | 0.923076923 |
| NOT-SMIM5 AND VANGL1 | 0.923076923 | 0.92307692 | 0.923076923 |
| NOT-ERMP1 AND VANGL1 | 0.962962963 | 0.92857143 | 1 |
| NOT-CRB3 AND VANGL1 | 0.96 | 1 | 0.923076923 |
| Astrocytoma (Astrocytoma) | | | |
| PTPRZ1 AND CLCN5 | 0.911111111 | 0.93181818 | 0.891304348 |
| PTPRZ1 AND ADGRE1 | 0.917647059 | 1 | 0.847826087 |
| PTPRZ1 AND F2R | 0.930232558 | 1 | 0.869565217 |
| PTPRZ1 AND CYB561A3 | 0.901098901 | 0.91111111 | 0.891304348 |
| PTPRZ1 AND IL27 | 0.901098901 | 0.91111111 | 0.891304348 |
| PTPRZ1 AND NOT-GHITM | 0.921348315 | 0.95348837 | 0.891304348 |
| PTPRZ1 AND NOT-PRRT3 | 0.901098901 | 0.91111111 | 0.891304348 |
| PTPRZ1 AND HAS2 | 0.917647059 | 1 | 0.847826087 |
| PTPRZ1 AND LCAT | 0.91954023 | 0.97560976 | 0.869565217 |
| PTPRZ1 AND NOT-EPCAM | 0.901098901 | 0.91111111 | 0.891304348 |
| PTPRZ1 AND NOT-CYB5R2 | 0.909090909 | 0.95238095 | 0.869565217 |
| PTPRZ1 AND NOT-ATP6V0C | 0.911111111 | 0.93181818 | 0.891304348 |
| PTPRZ1 AND ATP13A1 | 0.909090909 | 0.95238095 | 0.869565217 |
| PTPRZ1 AND NOT-LRP11 | 0.901098901 | 0.91111111 | 0.891304348 |
| PTPRZ1 AND NOT-INPP4B | 0.906976744 | 0.975 | 0.847826087 |
| PTPRZ1 AND NOT-C14orf2 | 0.901098901 | 0.91111111 | 0.891304348 |
| Ovarian Neoplasms\|Cystadenocarcinoma, Serous\|Adenocarcinoma, Papillary (Ovarian) | | | |
| SVOPL AND NOT-ARL6IP5 | 0.923076923 | 0.85714286 | 1 |
| NOT-ARL6IP5 AND FAAH2 | 0.916666667 | 0.91666667 | 0.916666667 |
| NOT-ARL6IP5 AND GAL3ST4 | 0.916666667 | 0.91666667 | 0.916666667 |
| SYNE4 AND NOT-FAXDC2 | 0.916666667 | 0.91666667 | 0.916666667 |
| SYNE4 AND NOT-OS9 | 0.916666667 | 0.91666667 | 0.916666667 |
| SVOPL AND NOT-ANTXR2 | 0.923076923 | 0.85714286 | 1 |
| SVOPL AND NOT-COMT | 0.923076923 | 0.85714286 | 1 |
| SVOPL AND NOT-SLC31A2 | 0.96 | 0.92307692 | 1 |
| SVOPL AND NOT-MFSD4 | 0.923076923 | 0.85714286 | 1 |
| SVOPL AND NOT-FMO5 | 0.96 | 0.92307692 | 1 |
| SVOPL AND NOT-TMEM131 | 0.923076923 | 0.85714286 | 1 |
| SVOPL AND NOT-CHIC2 | 0.923076923 | 0.85714286 | 1 |
| SVOPL AND NOT-C4orf3 | 0.923076923 | 0.85714286 | 1 |
| NOT-NDUFA1 AND SVOPL | 0.923076923 | 0.85714286 | 1 |
| SVOPL AND NOT-TAS2R16 | 0.956521739 | 1 | 0.916666667 |
| SVOPL AND NOT-DHRS7 | 0.923076923 | 0.85714286 | 1 |
| SVOPL AND NOT-CYB5R1 | 0.923076923 | 0.85714286 | 1 |
| SVOPL AND NOT-PKD2 | 0.923076923 | 0.85714286 | 1 |
| SVOPL AND NOT-OCIAD1 | 0.923076923 | 0.85714286 | 1 |

| Antigen Pair Logic | F1 | Precision | Recall |
|---|---|---|---|
| NLGN3 AND NOT-KCNH4 | 0.903225806 | 0.875 | 0.933333333 |
| NLGN3 AND NOT-NLGN3 | 0.903225806 | 0.875 | 0.933333333 |
| NLGN3 AND NOT-SLC44A1 | 0.903225806 | 0.875 | 0.933333333 |
| NLGN3 AND NOT-ABCB10 | 0.903225806 | 0.875 | 0.933333333 |
| NLGN3 AND NOT-ABCB9 | 0.903225806 | 0.875 | 0.933333333 |
| NLGN3 AND NOT-ABCA6 | 0.933333333 | 0.933333333 | 0.933333333 |
| NLGN3 AND NOT-ICMT | 0.933333333 | 0.933333333 | 0.933333333 |
| NLGN3 AND NOT-FOLH1 | 0.903225806 | 0.875 | 0.933333333 |
| NLGN3 AND NOT-TRAM1 | 0.933333333 | 0.933333333 | 0.933333333 |
| NLGN3 AND NOT-LEPROTL1 | 0.933333333 | 0.933333333 | 0.933333333 |
| NLGN3 AND NOT-FOLR1 | 0.903225806 | 0.875 | 0.933333333 |
| NLGN3 AND NOT-TNFRSF13B | 0.903225806 | 0.875 | 0.933333333 |
| NLGN3 AND NOT-MACF1 | 0.903225806 | 0.875 | 0.933333333 |
| NLGN3 AND NOT-TMEM131 | 0.903225806 | 0.875 | 0.933333333 |
| NLGN3 AND NOT-LRRC8B | 0.903225806 | 0.875 | 0.933333333 |
| NLGN3 AND NOT-SLC39A14 | 0.903225806 | 0.875 | 0.933333333 |
| NLGN3 AND NOT-NNT | 0.903225806 | 0.875 | 0.933333333 |
| NLGN3 AND NOT-OR52A1 | 0.903225806 | 0.875 | 0.933333333 |
| NLGN3 AND NOT-SLC16A8 | 0.903225806 | 0.875 | 0.933333333 |
| NLGN3 AND NOT-NLGN3 | 0.903225806 | 0.875 | 0.933333333 |
| NLGN3 AND NOT-NLGN3 | 0.903225806 | 0.875 | 0.933333333 |
| NLGN3 AND NOT-SYNGR4 | 0.903225806 | 0.875 | 0.933333333 |
| NLGN3 AND NOT-TSPAN12 | 0.933333333 | 0.933333333 | 0.933333333 |
| NLGN3 AND NOT-TSPAN15 | 0.903225806 | 0.875 | 0.933333333 |
| NLGN3 AND NOT-PIGN | 0.933333333 | 0.933333333 | 0.933333333 |
| NLGN3 AND NOT-CLDN14 | 0.903225806 | 0.875 | 0.933333333 |
| NLGN3 AND NOT-LPAR3 | 0.903225806 | 0.875 | 0.933333333 |
| NLGN3 AND NOT-VSIG2 | 0.903225806 | 0.875 | 0.933333333 |
| NLGN3 AND NOT-FPR2 | 0.928571429 | 1 | 0.866666667 |
| NLGN3 AND NOT-CLEC5A | 0.903225806 | 0.875 | 0.933333333 |
| NLGN3 AND NOT-NLGN3 | 0.903225806 | 0.875 | 0.933333333 |
| NLGN3 AND NOT-PRND | 0.903225806 | 0.875 | 0.933333333 |
| NLGN3 AND NOT-CA14 | 0.903225806 | 0.875 | 0.933333333 |
| NLGN3 AND NOT-RABGAP1 | 0.903225806 | 0.875 | 0.933333333 |
| NLGN3 AND NOT-TMEM2 | 0.903225806 | 0.875 | 0.933333333 |
| NLGN3 AND NOT-TMEFF2 | 0.903225806 | 0.875 | 0.933333333 |
| NLGN3 AND NOT-STX12 | 0.903225806 | 0.875 | 0.933333333 |
| NLGN3 AND NOT-KCNE4 | 0.903225806 | 0.875 | 0.933333333 |
| NLGN3 AND NOT-NLGN3 | 0.903225806 | 0.875 | 0.933333333 |
| NLGN3 AND NOT-TMEM245 | 0.933333333 | 0.933333333 | 0.933333333 |
| NLGN3 AND NOT-NLGN3 | 0.903225806 | 0.875 | 0.933333333 |
| NLGN3 AND NOT-IL17RA | 0.933333333 | 0.933333333 | 0.933333333 |
| NLGN3 AND NOT-FLRT2 | 0.903225806 | 0.875 | 0.933333333 |
| NLGN3 AND NOT-NLGN3 | 0.903225806 | 0.875 | 0.933333333 |
| NLGN3 AND NOT-MTCH1 | 0.903225806 | 0.875 | 0.933333333 |
| NLGN3 AND NOT-LAMP5 | 0.903225806 | 0.875 | 0.933333333 |
| NLGN3 AND NOT-PANX1 | 0.903225806 | 0.875 | 0.933333333 |
| NLGN3 AND NOT-CLDN15 | 0.903225806 | 0.875 | 0.933333333 |
| GRIK3 AND FJX1 | 0.909090909 | 0.833333333 | 1 |
| NLGN3 AND NOT-MS4A6E | 0.903225806 | 0.875 | 0.933333333 |
| NLGN3 AND NOT-SLC17A8 | 0.903225806 | 0.875 | 0.933333333 |
| NLGN3 AND NOT-ADAM2 | 0.933333333 | 0.933333333 | 0.933333333 |
| NLGN3 AND NOT-FUT2 | 0.903225806 | 0.875 | 0.933333333 |
| NLGN3 AND NOT-FUT3 | 0.933333333 | 0.933333333 | 0.933333333 |
| NLGN3 AND NOT-FUT4 | 0.903225806 | 0.875 | 0.933333333 |
| NLGN3 AND NOT-FUT5 | 0.933333333 | 0.933333333 | 0.933333333 |
| NLGN3 AND NOT-TMEM9 | 0.933333333 | 0.933333333 | 0.933333333 |
| NLGN3 AND NOT-FUT6 | 0.903225806 | 0.875 | 0.933333333 |
| NLGN3 AND NOT-FUT7 | 0.903225806 | 0.875 | 0.933333333 |
| NLGN3 AND NOT-HEPACAM2 | 0.903225806 | 0.875 | 0.933333333 |
| NLGN3 AND NOT-TECRL | 0.933333333 | 0.933333333 | 0.933333333 |
| NLGN3 AND NOT-FUT8 | 0.903225806 | 0.875 | 0.933333333 |
| NLGN3 AND NOT-KD5R | 0.903225806 | 0.875 | 0.933333333 |
| NLGN3 AND NOT-ACKR1 | 0.903225806 | 0.875 | 0.933333333 |
| NLGN3 AND NOT-FZD2 | 0.933333333 | 0.933333333 | 0.933333333 |
| NLGN3 AND NOT-IFI6 | 0.903225806 | 0.875 | 0.933333333 |
| NLGN3 AND NOT-ZDHHC20 | 0.903225806 | 0.875 | 0.933333333 |
| NLGN3 AND NOT-G6PC | 0.903225806 | 0.875 | 0.933333333 |
| NLGN3 AND NOT-FAM26E | 0.933333333 | 0.933333333 | 0.933333333 |
| NLGN3 AND NOT-SLC37A4 | 0.933333333 | 0.933333333 | 0.933333333 |
| NLGN3 AND NOT-NLGN3 | 0.903225806 | 0.875 | 0.933333333 |
| NLGN3 AND NOT-TMEM256 | 0.933333333 | 0.933333333 | 0.933333333 |
| NLGN3 AND NOT-ZDHHC23 | 0.903225806 | 0.875 | 0.933333333 |
| NLGN3 AND NOT-GAA | 0.903225806 | 0.875 | 0.933333333 |
| NLGN3 AND NOT-CALHM1 | 0.903225806 | 0.875 | 0.933333333 |

FIG. 1 (CONT.)

| Antigen Pair Logic | F1 | Precision | Recall |
|---|---|---|---|
| SVOPL AND NOT-ZDHHC4 | 0.923076923 | 0.85714286 | 1 |
| SVOPL AND NOT-ZDHHC7 | 0.923076923 | 0.85714286 | 1 |
| SVOPL AND NOT-NDRG2 | 0.923076923 | 0.85714286 | 1 |
| SVOPL AND NOT-TMEM181 | 0.923076923 | 0.85714286 | 1 |
| SVOPL AND NOT-RNASE4 | 0.923076923 | 0.85714286 | 1 |
| SVOPL AND NOT-DNAJC1 | 0.923076923 | 0.85714286 | 1 |
| SVOPL AND NOT-PCDH20 | 0.909090909 | 1 | 0.833333333 |
| SVOPL AND NOT-SLC20A1 | 0.923076923 | 0.85714286 | 1 |
| SVOPL AND NOT-BNIP3L | 0.923076923 | 0.85714286 | 1 |
| SVOPL AND NOT-SPG7 | 0.923076923 | 0.85714286 | 1 |
| SVOPL AND NOT-TSPO | 0.923076923 | 0.85714286 | 1 |
| SVOPL AND NOT-AGPAT9 | 0.923076923 | 0.85714286 | 1 |
| SVOPL AND NOT-SEC11C | 0.923076923 | 0.85714286 | 1 |
| SVOPL AND NOT-CLDN8 | 0.916666667 | 0.91666667 | 0.916666667 |
| SVOPL AND NOT-SMDT1 | 0.923076923 | 0.85714286 | 1 |
| SVOPL AND NOT-TMEM59 | 0.923076923 | 0.85714286 | 1 |
| IL18RAP AND NOT-TMEM71 | 0.909090909 | 1 | 0.833333333 |
| SYNE4 AND NOT-SELM | 0.916666667 | 0.91666667 | 0.916666667 |
| NOT-TMED6 AND OR10H2 | 0.916666667 | 0.91666667 | 0.916666667 |
| NOT-NDRG2 AND FAAH2 | 0.909090909 | 1 | 0.833333333 |
| NOT-TMEM59 AND FAAH2 | 0.916666667 | 0.91666667 | 0.916666667 |
| SYNE4 AND NOT-FAM134C | 0.956521739 | 1 | 0.916666667 |
| SYNE4 AND NOT-TMED3 | 0.916666667 | 0.91666667 | 0.916666667 |
| SYNE4 AND NOT-SUN2 | 0.916666667 | 0.91666667 | 0.916666667 |
| SYNE4 AND NOT-NDUFA1 | 0.916666667 | 0.91666667 | 0.916666667 |
| SYNE4 AND NOT-NDUFB8 | 0.956521739 | 1 | 0.916666667 |
| SYNE4 AND NOT-MAN1C1 | 0.916666667 | 0.91666667 | 0.916666667 |
| SYNE4 AND NOT-C16orf58 | 0.909090909 | 1 | 0.833333333 |
| SYNE4 AND NOT-SPG7 | 0.916666667 | 0.91666667 | 0.916666667 |
| SYNE4 AND NOT-SSR3 | 0.909090909 | 1 | 0.833333333 |
| SYNE4 AND NOT-VKORC1 | 0.909090909 | 1 | 0.833333333 |
| NOT-MAN2A1 AND SFT2D2 | 0.916666667 | 0.91666667 | 0.916666667 |
| NOT-CYB5R1 AND LRRC8E | 0.923076923 | 0.85714286 | 1 |
| NOT-NDRG2 AND DAPL1 | 0.909090909 | 1 | 0.833333333 |
| GAL3ST4 AND NOT-SMPD1 | 0.909090909 | 1 | 0.833333333 |
| NOT-TMEM59 AND GAL3ST4 | 0.909090909 | 1 | 0.833333333 |
| NOT-TMEM59 AND LRRC8E | 0.916666667 | 0.91666667 | 0.916666667 |
| Neuroblastoma (Neuroblastoma) | | | |
| MARCH11 | 0.924855491 | 0.8988764 | 0.952380952 |
| CHRNA3 | 0.927710843 | 0.93902439 | 0.916666667 |
| ST8SIA2 | 0.922155689 | 0.92771084 | 0.916666667 |
| MARCH11 AND SDC1 | 0.905882353 | 0.89534884 | 0.916666667 |
| SLC10A4 AND NOT-SDC1 | 0.922222222 | 0.86458333 | 0.988095238 |
| ST8SIA2 AND NOT-SDC1 | 0.944785276 | 0.97468354 | 0.916666667 |
| VANGL2 AND NOT-SDC1 | 0.918238994 | 0.97333333 | 0.869047619 |
| CHRNA3 AND CHRNA3 | 0.913580247 | 0.94871795 | 0.880952381 |
| DIABLO AND NOT-SDC1 | 0.902439024 | 0.925 | 0.880952381 |
| SLC10A4 AND NOT-WT1 | 0.917127072 | 0.8556701 | 0.988095238 |
| ST8SIA2 AND NOT-WT1 | 0.922155689 | 0.92771084 | 0.916666667 |
| CHRNA3 AND CHRNA3 | 0.913580247 | 0.94871795 | 0.880952381 |
| MARCH11 AND MARCH11 | 0.924855491 | 0.8988764 | 0.952380952 |
| ST8SIA2 AND NOT-FAP | 0.938271605 | 0.97435897 | 0.904761905 |
| CHRNA3 AND CHRNA3 | 0.913580247 | 0.94871795 | 0.880952381 |
| SLC10A4 AND NOT-MAGEA1 | 0.917127072 | 0.8556701 | 0.988095238 |
| ST8SIA2 AND NOT-ST8SIA2 | 0.904458599 | 0.97260274 | 0.845238095 |
| CHRNA3 AND CHRNA3 | 0.913580247 | 0.94871795 | 0.880952381 |
| MARCH11 AND NOT-MET | 0.94047619 | 0.94047619 | 0.94047619 |
| SLC10A4 AND NOT-MET | 0.917127072 | 0.8556701 | 0.988095238 |
| ST8SIA2 AND NOT-MET | 0.938271605 | 0.97435897 | 0.904761905 |
| CHRNA3 AND CHRNA3 | 0.913580247 | 0.94871795 | 0.880952381 |
| MARCH11 AND MARCH11 | 0.924855491 | 0.8988764 | 0.952380952 |
| SLC10A4 AND NOT-CD70 | 0.917127072 | 0.8556701 | 0.988095238 |
| ST8SIA2 AND CD70 | 0.922155689 | 0.92771084 | 0.916666667 |
| CHRNA3 AND CHRNA3 | 0.913580247 | 0.94871795 | 0.880952381 |
| MARCH11 AND CD44 | 0.912280702 | 0.89655172 | 0.928571429 |
| SLC10A4 AND NOT-CD44 | 0.912087912 | 0.84693878 | 0.988095238 |
| ST8SIA2 AND NOT-ST8SIA2 | 0.904458599 | 0.97260274 | 0.845238095 |
| CHRNA3 AND CHRNA3 | 0.913580247 | 0.94871795 | 0.880952381 |
| SLC10A4 AND NOT-MS4A1 | 0.912087912 | 0.84693878 | 0.988095238 |
| ST8SIA2 AND NOT-ST8SIA2 | 0.904458599 | 0.97260274 | 0.845238095 |
| CHRNA3 AND CHRNA3 | 0.913580247 | 0.94871795 | 0.880952381 |
| MARCH11 AND MARCH11 | 0.924855491 | 0.8988764 | 0.952380952 |
| SLC10A4 AND NOT-CD160 | 0.917127072 | 0.8556701 | 0.988095238 |
| ST8SIA2 AND NOT-CD160 | 0.922155689 | 0.92771084 | 0.916666667 |
| CHRNA3 AND CHRNA3 | 0.913580247 | 0.94871795 | 0.880952381 |
| SLC10A4 AND NOT-TNFSF11 | 0.917127072 | 0.8556701 | 0.988095238 |

| Antigen Pair Logic | F1 | Precision | Recall |
|---|---|---|---|
| NLGN3 AND NOT-NLGN3 | 0.903225806 | 0.875 | 0.933333333 |
| NLGN3 AND NOT-C19orf26 | 0.903225806 | 0.875 | 0.933333333 |
| NLGN3 AND NOT-CCDC108 | 0.903225806 | 0.875 | 0.933333333 |
| NLGN3 AND NOT-TMCO4 | 0.933333333 | 0.933333333 | 0.933333333 |
| NLGN3 AND NOT-MCOLN2 | 0.933333333 | 0.933333333 | 0.933333333 |
| NLGN3 AND NOT-RNF144B | 0.903225806 | 0.875 | 0.933333333 |
| NLGN3 AND NOT-GABRA2 | 0.903225806 | 0.875 | 0.933333333 |
| NLGN3 AND NOT-GABRA4 | 0.903225806 | 0.875 | 0.933333333 |
| NLGN3 AND NOT-CNEP1R1 | 0.933333333 | 0.933333333 | 0.933333333 |
| NLGN3 AND NOT-SYT14 | 0.903225806 | 0.875 | 0.933333333 |
| NLGN3 AND NOT-NLGN3 | 0.903225806 | 0.875 | 0.933333333 |
| NLGN3 AND NOT-CDRT15L2 | 0.965517241 | 1 | 0.933333333 |
| NLGN3 AND NOT-STEAP1B | 0.903225806 | 0.875 | 0.933333333 |
| NLGN3 AND NOT-NLGN3 | 0.903225806 | 0.875 | 0.933333333 |
| NLGN3 AND NOT-NLGN3 | 0.903225806 | 0.875 | 0.933333333 |
| NLGN3 AND NOT-ST6GALNAC3 | 0.903225806 | 0.875 | 0.933333333 |
| NLGN3 AND NOT-MFSD8 | 0.933333333 | 0.933333333 | 0.933333333 |
| NLGN3 AND NOT-GABRE | 0.903225806 | 0.875 | 0.933333333 |
| NLGN3 AND NOT-GABRG1 | 0.903225806 | 0.875 | 0.933333333 |
| NLGN3 AND NOT-NLGN3 | 0.903225806 | 0.875 | 0.933333333 |
| NLGN3 AND NOT-GABRP | 0.903225806 | 0.875 | 0.933333333 |
| NLGN3 AND NOT-NPB | 0.903225806 | 0.875 | 0.933333333 |
| NLGN3 AND NOT-NLGN3 | 0.903225806 | 0.875 | 0.933333333 |
| NLGN3 AND NOT-GABRR1 | 0.933333333 | 0.933333333 | 0.933333333 |
| NLGN3 AND NOT-FRMD3 | 0.903225806 | 0.875 | 0.933333333 |
| NLGN3 AND NOT-C1orf101 | 0.903225806 | 0.875 | 0.933333333 |
| NLGN3 AND NOT-GABRR2 | 0.903225806 | 0.875 | 0.933333333 |
| NLGN3 AND NOT-KIAA1549L | 0.903225806 | 0.875 | 0.933333333 |
| NLGN3 AND NOT-SUN2 | 0.933333333 | 0.933333333 | 0.933333333 |
| NLGN3 AND NOT-BRI3 | 0.933333333 | 0.933333333 | 0.933333333 |
| NLGN3 AND NOT-RHBDD3 | 0.903225806 | 0.875 | 0.933333333 |
| NLGN3 AND NOT-KLK5 | 0.903225806 | 0.875 | 0.933333333 |
| NLGN3 AND NOT-BACE2 | 0.903225806 | 0.875 | 0.933333333 |
| NLGN3 AND NOT-B4GALNT1 | 0.903225806 | 0.875 | 0.933333333 |
| NLGN3 AND NOT-NLGN3 | 0.903225806 | 0.875 | 0.933333333 |
| NLGN3 AND NOT-YIPF3 | 0.933333333 | 0.933333333 | 0.933333333 |
| NLGN3 AND NOT-SUMF2 | 0.903225806 | 0.875 | 0.933333333 |
| NLGN3 AND NOT-GALNS | 0.933333333 | 0.933333333 | 0.933333333 |
| NLGN3 AND NOT-ABI3BP | 0.933333333 | 0.933333333 | 0.933333333 |
| NLGN3 AND NOT-RNF19A | 0.903225806 | 0.875 | 0.933333333 |
| NLGN3 AND NOT-GALNT1 | 0.903225806 | 0.875 | 0.933333333 |
| NLGN3 AND NOT-NLGN3 | 0.903225806 | 0.875 | 0.933333333 |
| NLGN3 AND NOT-GALNT3 | 0.903225806 | 0.875 | 0.933333333 |
| NLGN3 AND NOT-SGMS1 | 0.933333333 | 0.933333333 | 0.933333333 |
| NLGN3 AND NOT-WFDC11 | 0.933333333 | 0.933333333 | 0.933333333 |
| NLGN3 AND NOT-ATL3 | 0.933333333 | 0.933333333 | 0.933333333 |
| NLGN3 AND NOT-WFDC9 | 0.903225806 | 0.875 | 0.933333333 |
| NLGN3 AND NOT-MRGPRX1 | 0.903225806 | 0.875 | 0.933333333 |
| NLGN3 AND NOT-TAS2R39 | 0.903225806 | 0.875 | 0.933333333 |
| NLGN3 AND NOT-TAS2R40 | 0.903225806 | 0.875 | 0.933333333 |
| NLGN3 AND NOT-TAS2R41 | 0.903225806 | 0.875 | 0.933333333 |
| NLGN3 AND NOT-TAS2R50 | 0.903225806 | 0.875 | 0.933333333 |
| NLGN3 AND NOT-IL4I1 | 0.903225806 | 0.875 | 0.933333333 |
| NLGN3 AND NOT-FAM205A | 0.903225806 | 0.875 | 0.933333333 |
| NLGN3 AND NOT-NLGN3 | 0.903225806 | 0.875 | 0.933333333 |
| NLGN3 AND NOT-PNKD | 0.933333333 | 0.933333333 | 0.933333333 |
| NLGN3 AND NOT-TMEM87A | 0.903225806 | 0.875 | 0.933333333 |
| NLGN3 AND NOT-C2CD2 | 0.933333333 | 0.933333333 | 0.933333333 |
| NLGN3 AND NOT-TKFC | 0.933333333 | 0.933333333 | 0.933333333 |
| NLGN3 AND NOT-NLGN3 | 0.903225806 | 0.875 | 0.933333333 |
| NLGN3 AND NOT-LRP10 | 0.903225806 | 0.875 | 0.933333333 |
| NLGN3 AND NOT-TMEM98 | 0.965517241 | 1 | 0.933333333 |
| NLGN3 AND NOT-NLGN3 | 0.903225806 | 0.875 | 0.933333333 |
| NLGN3 AND NOT-FDCSP | 0.903225806 | 0.875 | 0.933333333 |
| NLGN3 AND NOT-NLGN3 | 0.903225806 | 0.875 | 0.933333333 |
| NLGN3 AND NOT-CFAP61 | 0.903225806 | 0.875 | 0.933333333 |
| NLGN3 AND NOT-ABHD12 | 0.903225806 | 0.875 | 0.933333333 |
| NLGN3 AND NOT-HERC4 | 0.933333333 | 0.933333333 | 0.933333333 |
| NLGN3 AND NOT-LRIT1 | 0.903225806 | 0.875 | 0.933333333 |
| NLGN3 AND NOT-TCTN3 | 0.933333333 | 0.933333333 | 0.933333333 |
| NLGN3 AND NOT-ABCA12 | 0.903225806 | 0.875 | 0.933333333 |
| NLGN3 AND NOT-GIMAP2 | 0.903225806 | 0.875 | 0.933333333 |
| NLGN3 AND NOT-PCDHB5 | 0.903225806 | 0.875 | 0.933333333 |
| NLGN3 AND NOT-STEAP2 | 0.903225806 | 0.875 | 0.933333333 |
| NLGN3 AND NOT-NPHP4 | 0.903225806 | 0.875 | 0.933333333 |
| NLGN3 AND NOT-OR1A2 | 0.903225806 | 0.875 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| CHRNA3 AND CHRNA3 | 0.913580247 | 0.94871795 | 0.880952381 | NLGN3 AND NOT-OR2F1 | 0.903225806 | 0.875 | 0.933333333 |
| MARCH11 AND MARCH11 | 0.924855491 | 0.8988764 | 0.952380952 | NLGN3 AND NOT-OR1J4 | 0.903225806 | 0.875 | 0.933333333 |
| FAM163A AND NOT-CA9 | 0.911111111 | 0.85416667 | 0.976190476 | NLGN3 AND NOT-B3GAT3 | 0.903225806 | 0.875 | 0.933333333 |
| SLC10A4 AND NOT-CA9 | 0.921348315 | 0.87234043 | 0.976190476 | NLGN3 AND NOT-NLGN3 | 0.903225806 | 0.875 | 0.933333333 |
| ST8SIA2 AND NOT-CA9 | 0.922155689 | 0.92771084 | 0.916666667 | NLGN3 AND NOT-KCNG2 | 0.903225806 | 0.875 | 0.933333333 |
| CHRNA3 AND NOT-CA9 | 0.944099379 | 0.98701299 | 0.904761905 | NLGN3 AND NOT-CLEC4E | 0.903225806 | 0.875 | 0.933333333 |
| SLC10A4 AND NOT-MUC17 | 0.917127072 | 0.8556701 | 0.988095238 | NLGN3 AND NOT-IL1RAPL2 | 0.903225806 | 0.875 | 0.933333333 |
| CHRNA3 AND NOT-MUC17 | 0.924050633 | 0.98648649 | 0.869047619 | NLGN3 AND NOT-CLDN17 | 0.903225806 | 0.875 | 0.933333333 |
| MARCH11 AND MARCH11 | 0.924855491 | 0.8988764 | 0.952380952 | NLGN3 AND NOT-GALNT8 | 0.903225806 | 0.875 | 0.933333333 |
| SLC10A4 AND NOT-FOLR2 | 0.917127072 | 0.8556701 | 0.988095238 | NLGN3 AND NOT-OR7A17 | 0.903225806 | 0.875 | 0.933333333 |
| ST8SIA2 AND FOLR2 | 0.922155689 | 0.92771084 | 0.916666667 | NLGN3 AND NOT-OR5K1 | 0.903225806 | 0.875 | 0.933333333 |
| CHRNA3 AND CHRNA3 | 0.913580247 | 0.94871795 | 0.880952381 | NLGN3 AND NOT-GCGR | 0.903225806 | 0.875 | 0.933333333 |
| MARCH11 AND NOT-FOLH1 | 0.927710843 | 0.93902439 | 0.916666667 | NLGN3 AND NOT-NLGN3 | 0.903225806 | 0.875 | 0.933333333 |
| FAM163A AND NOT-FOLH1 | 0.907103825 | 0.83838384 | 0.988095238 | NLGN3 AND NOT-OR10J1 | 0.903225806 | 0.875 | 0.933333333 |
| SLC10A4 AND NOT-FOLH1 | 0.954022989 | 0.92222222 | 0.988095238 | NLGN3 AND NOT-OR8B8 | 0.903225806 | 0.875 | 0.933333333 |
| CHRNA3 AND NOT-FOLH1 | 0.950617284 | 0.98717949 | 0.916666667 | NLGN3 AND NOT-OR8G1 | 0.903225806 | 0.875 | 0.933333333 |
| MARCH11 AND MARCH11 | 0.924855491 | 0.8988764 | 0.952380952 | NLGN3 AND NOT-OR10A3 | 0.903225806 | 0.875 | 0.933333333 |
| SLC10A4 AND NOT-ST8SIA1 | 0.916201117 | 0.86315789 | 0.976190476 | NLGN3 AND NOT-CNNM4 | 0.903225806 | 0.875 | 0.933333333 |
| CHRNA3 AND CHRNA3 | 0.913580247 | 0.94871795 | 0.880952381 | NLGN3 AND NOT-NLGN3 | 0.903225806 | 0.875 | 0.933333333 |
| SLC10A4 AND NOT-SLAMF7 | 0.917127072 | 0.8556701 | 0.988095238 | NLGN3 AND NOT-MYOF | 0.933333333 | 0.933333333 | 0.933333333 |
| ST8SIA2 AND SLAMF7 | 0.922155689 | 0.92771084 | 0.916666667 | NLGN3 AND NOT-GCNT1 | 0.903225806 | 0.875 | 0.933333333 |
| CHRNA3 AND CHRNA3 | 0.913580247 | 0.94871795 | 0.880952381 | NLGN3 AND NOT-GCNT2 | 0.903225806 | 0.875 | 0.933333333 |
| MARCH11 AND MARCH11 | 0.924855491 | 0.8988764 | 0.952380952 | NLGN3 AND NOT-TSPAN16 | 0.903225806 | 0.875 | 0.933333333 |
| SLC10A4 AND NOT-CD19 | 0.911111111 | 0.85416667 | 0.976190476 | NLGN3 AND NOT-OR12D2 | 0.933333333 | 0.933333333 | 0.933333333 |
| ST8SIA2 AND NOT-ST8SIA2 | 0.904458599 | 0.97260274 | 0.845238095 | NLGN3 AND NOT-OR11A1 | 0.903225806 | 0.875 | 0.933333333 |
| CHRNA3 AND CHRNA3 | 0.913580247 | 0.94871795 | 0.880952381 | NLGN3 AND NOT-OR10H3 | 0.903225806 | 0.875 | 0.933333333 |
| FAM163A AND NOT-NCAM1 | 0.901098901 | 0.83673469 | 0.976190476 | NLGN3 AND NOT-OR10H2 | 0.903225806 | 0.875 | 0.933333333 |
| SLC10A4 AND NOT-NCAM1 | 0.937142857 | 0.9010989 | 0.976190476 | NLGN3 AND NOT-AMELX | 0.903225806 | 0.875 | 0.933333333 |
| CHRNA3 AND NOT-NCAM1 | 0.909090909 | 1 | 0.833333333 | NLGN3 AND NOT-TBL2 | 0.903225806 | 0.875 | 0.933333333 |
| DIABLO AND NCAM1 | 0.925 | 0.97368421 | 0.880952381 | SLC1A2 AND TBL2 | 0.909090909 | 0.833333333 | 1 |
| SLC10A4 AND NOT-MLANA | 0.917127072 | 0.8556701 | 0.988095238 | NLGN3 AND NOT-GDF9 | 0.903225806 | 0.875 | 0.933333333 |
| CHRNA3 AND NOT-MLANA | 0.93081761 | 0.98666667 | 0.880952381 | NLGN3 AND NOT-OR7C2 | 0.933333333 | 0.933333333 | 0.933333333 |
| MARCH11 AND MARCH11 | 0.924855491 | 0.8988764 | 0.952380952 | NLGN3 AND NOT-OR7A5 | 0.903225806 | 0.875 | 0.933333333 |
| SLC10A4 AND NOT-MUC1 | 0.917127072 | 0.8556701 | 0.988095238 | NLGN3 AND NOT-OR7C1 | 0.933333333 | 0.933333333 | 0.933333333 |
| ST8SIA2 AND NOT-MUC1 | 0.929936306 | 1 | 0.869047619 | NLGN3 AND NOT-GDNF | 0.903225806 | 0.875 | 0.933333333 |
| CHRNA3 AND NOT-MUC1 | 0.950617284 | 0.98717949 | 0.916666667 | NLGN3 AND NOT-NLGN3 | 0.903225806 | 0.875 | 0.933333333 |
| SLC10A4 AND NOT-TNFRSF17 | 0.917127072 | 0.8556701 | 0.988095238 | NLGN3 AND NOT-ADGRF1 | 0.903225806 | 0.875 | 0.933333333 |
| CHRNA3 AND CHRNA3 | 0.913580247 | 0.94871795 | 0.880952381 | NLGN3 AND NOT-OR2J2 | 0.903225806 | 0.875 | 0.933333333 |
| SLC10A4 AND NOT-ROR1 | 0.917127072 | 0.8556701 | 0.988095238 | NLGN3 AND NOT-OR2H1 | 0.903225806 | 0.875 | 0.933333333 |
| CHRNA3 AND CHRNA3 | 0.913580247 | 0.94871795 | 0.880952381 | NLGN3 AND NOT-AMFR | 0.903225806 | 0.875 | 0.933333333 |
| SLC10A4 AND NOT-PSCA | 0.917127072 | 0.8556701 | 0.988095238 | NLGN3 AND NOT-B4GALT1 | 0.903225806 | 0.875 | 0.933333333 |
| ST8SIA2 AND NOT-PSCA | 0.944099379 | 0.98701299 | 0.904761905 | NLGN3 AND NOT-NLGN3 | 0.903225806 | 0.875 | 0.933333333 |
| VANGL2 AND NOT-PSCA | 0.9 | 0.94736842 | 0.857142857 | NLGN3 AND NOT-STEAP1 | 0.903225806 | 0.875 | 0.933333333 |
| CHRNA3 AND NOT-PSCA | 0.950617284 | 0.98717949 | 0.916666667 | NLGN3 AND NOT-GGT5 | 0.933333333 | 0.933333333 | 0.933333333 |
| MARCH11 AND NOT-ERBB4 | 0.946745562 | 0.94117647 | 0.952380952 | SLC4A4 AND NOT-GPR160 | 0.928571429 | 1 | 0.866666667 |
| SLC10A4 AND NOT-ERBB4 | 0.927374302 | 0.87368421 | 0.988095238 | NLGN3 AND NOT-AMHR2 | 0.933333333 | 0.933333333 | 0.933333333 |
| ST8SIA2 AND NOT-ERBB4 | 0.931677019 | 0.97402597 | 0.892857143 | NLGN3 AND NOT-CNPPD1 | 0.933333333 | 0.933333333 | 0.933333333 |
| CHRNA3 AND NOT-ERBB4 | 0.9375 | 0.98684211 | 0.892857143 | NLGN3 AND NOT-GJA4 | 0.933333333 | 0.933333333 | 0.933333333 |
| FAM163A AND NOT-MSLN | 0.907103825 | 0.83838384 | 0.988095238 | NLGN3 AND NOT-SIGLEC7 | 0.933333333 | 0.933333333 | 0.933333333 |
| SLC10A4 AND NOT-MSLN | 0.927374302 | 0.87368421 | 0.988095238 | NLGN3 AND NOT-DKKL1 | 0.933333333 | 0.933333333 | 0.933333333 |
| ST8SIA2 AND NOT-MSLN | 0.944785276 | 0.97468354 | 0.916666667 | NLGN3 AND NOT-SLC39A1 | 0.933333333 | 0.933333333 | 0.933333333 |
| CHRNA3 AND NOT-MSLN | 0.944099379 | 0.98701299 | 0.904761905 | NLGN3 AND NOT-SERP1 | 0.933333333 | 0.933333333 | 0.933333333 |
| MARCH11 AND MARCH11 | 0.924855491 | 0.8988764 | 0.952380952 | NLGN3 AND NOT-PGAP2 | 0.933333333 | 0.933333333 | 0.933333333 |
| SLC10A4 AND NOT-ERBB3 | 0.917127072 | 0.8556701 | 0.988095238 | NLGN3 AND NOT-KCNMB4 | 0.933333333 | 0.933333333 | 0.933333333 |
| CHRNA3 AND CHRNA3 | 0.913580247 | 0.94871795 | 0.880952381 | NLGN3 AND NOT-GNS | 0.933333333 | 0.933333333 | 0.933333333 |
| MARCH11 AND MARCH11 | 0.924855491 | 0.8988764 | 0.952380952 | NLGN3 AND NOT-GOLGB1 | 0.933333333 | 0.933333333 | 0.933333333 |
| SLC10A4 AND NOT-CD33 | 0.922222222 | 0.86458333 | 0.988095238 | NLGN3 AND NOT-SLCO4A1 | 0.933333333 | 0.933333333 | 0.933333333 |
| ST8SIA2 AND NOT-CD33 | 0.938271605 | 0.97435897 | 0.904761905 | GPM6A AND DOLPP1 | 0.909090909 | 0.833333333 | 1 |
| CHRNA3 AND CHRNA3 | 0.913580247 | 0.94871795 | 0.880952381 | NLGN3 AND NOT-GPR3 | 0.933333333 | 0.933333333 | 0.933333333 |
| MARCH11 AND MARCH11 | 0.924855491 | 0.8988764 | 0.952380952 | NLGN3 AND NOT-OR8D2 | 0.933333333 | 0.933333333 | 0.933333333 |
| SLC10A4 AND NOT-IGF1R | 0.911111111 | 0.85416667 | 0.976190476 | NLGN3 AND NOT-CD163L1 | 0.933333333 | 0.933333333 | 0.933333333 |
| ST8SIA2 AND NOT-IGF1R | 0.922155689 | 0.92771084 | 0.916666667 | NLGN3 AND NOT-B4GALNT3 | 0.933333333 | 0.933333333 | 0.933333333 |
| CHRNA3 AND CHRNA3 | 0.913580247 | 0.94871795 | 0.880952381 | NLGN3 AND NOT-DPY19L2 | 0.933333333 | 0.933333333 | 0.933333333 |
| ALK AND NOT-KCNJ16 | 0.901960784 | 1 | 0.821428571 | ZDHHC22 AND NOT-CCDC136 | 0.928571429 | 1 | 0.866666667 |
| NOT-MARCH11 AND ALK | 0.937142857 | 0.9010989 | 0.976190476 | NLGN3 AND NOT-ANG | 0.933333333 | 0.933333333 | 0.933333333 |
| NOT-GLCCI1 AND ALK | 0.909090909 | 0.92592593 | 0.892857143 | NLGN3 AND NOT-SLC26A11 | 0.933333333 | 0.933333333 | 0.933333333 |
| NOT-ALK AND PODXL2 | 0.906976744 | 0.88636364 | 0.928571429 | NLGN3 AND NOT-SYPL2 | 0.933333333 | 0.933333333 | 0.933333333 |
| SLC10A4 AND NOT-ALK | 0.906077348 | 0.84536082 | 0.976190476 | NLGN3 AND NOT-SLC25A34 | 0.933333333 | 0.933333333 | 0.933333333 |
| NOT-ALK AND LRRN3 | 0.91954023 | 0.88888889 | 0.952380952 | NLGN3 AND NOT-SIRPB2 | 0.965517241 | 1 | 0.933333333 |
| NOT-ST8SIA2 AND ALK | 0.941176471 | 0.93023256 | 0.952380952 | NLGN3 AND NOT-RNF149 | 0.933333333 | 0.933333333 | 0.933333333 |
| NOT-SLC6A2 AND ALK | 0.917647059 | 0.90697674 | 0.928571429 | NLGN3 AND NOT-IGSF10 | 0.933333333 | 0.933333333 | 0.933333333 |
| ALK AND TMEM258 | 0.901960784 | 1 | 0.821428571 | NLGN3 AND NOT-GPR31 | 0.933333333 | 0.933333333 | 0.933333333 |
| NOT-GDAP1L1 AND ALK | 0.946745562 | 0.94117647 | 0.952380952 | NLGN3 AND NOT-CYP4V2 | 0.933333333 | 0.933333333 | 0.933333333 |
| NOT-PCDHB6 AND ALK | 0.933333333 | 0.95061728 | 0.916666667 | NLGN3 AND NOT-COX18 | 0.933333333 | 0.933333333 | 0.933333333 |
| NOT-ALK AND PTCHD1 | 0.925714286 | 0.89010989 | 0.964285714 | NLGN3 AND NOT-SCARA5 | 0.933333333 | 0.933333333 | 0.933333333 |
| NOT-DBH AND ALK | 0.905027933 | 0.85263158 | 0.964285714 | NLGN3 AND NOT-ATP11C | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| ALK AND NOT-TMC4 | 0.901960784 | 1 | 0.821428571 | NLGN3 AND NOT-YIPF6 | 0.933333333 | 0.933333333 | 0.933333333 |
| CHRNA3 AND CHRNA3 | 0.913580247 | 0.94871795 | 0.880952381 | NLGN3 AND NOT-P2RY8 | 0.933333333 | 0.933333333 | 0.933333333 |
| NOT-PCDHB10 AND ALK | 0.934911243 | 0.92941176 | 0.94047619 | NLGN3 AND NOT-DEXI | 0.933333333 | 0.933333333 | 0.933333333 |
| DIABLO AND ALK | 0.9 | 0.94736842 | 0.857142857 | NLGN3 AND NOT-OSTM1 | 0.933333333 | 0.933333333 | 0.933333333 |
| MARCH11 AND MARCH11 | 0.924855491 | 0.8988764 | 0.952380952 | NLGN3 AND NOT-SLC6A16 | 0.933333333 | 0.933333333 | 0.933333333 |
| SLC10A4 AND NOT-TNFRSF10B | 0.911111111 | 0.85416667 | 0.976190476 | NLGN3 AND NOT-MAGEH1 | 0.933333333 | 0.933333333 | 0.933333333 |
| CHRNA3 AND NOT-TNFRSF10B | 0.903225806 | 0.98591549 | 0.833333333 | GRIK3 AND NOT-KCNS3 | 0.909090909 | 0.833333333 | 1 |
| ST8SIA2 AND NOT-IL13RA2 | 0.922155689 | 0.92771084 | 0.916666667 | GRIK3 AND NOT-SCN4B | 0.9375 | 0.882352941 | 1 |
| CHRNA3 AND CHRNA3 | 0.913580247 | 0.94871795 | 0.880952381 | GRIK3 AND NOT-ELOVL7 | 0.909090909 | 0.833333333 | 1 |
| SLC10A4 AND NOT-KDR | 0.917127072 | 0.8556701 | 0.988095238 | GRIK3 AND NOT-PKDCC | 0.9375 | 0.882352941 | 1 |
| PCSK1N AND CD276 | 0.909090909 | 0.92592593 | 0.892857143 | NLGN3 AND NOT-ANPEP | 0.933333333 | 0.933333333 | 0.933333333 |
| MARCH11 AND MARCH11 | 0.924855491 | 0.8988764 | 0.952380952 | NLGN3 AND NOT-GNL2 | 0.933333333 | 0.933333333 | 0.933333333 |
| ST8SIA3 AND CD276 | 0.928571429 | 0.92857143 | 0.928571429 | NLGN3 AND NOT-ST8SIA5 | 0.933333333 | 0.933333333 | 0.933333333 |
| NOT-EGFR AND CD276 | 0.935672515 | 0.91954023 | 0.952380952 | NLGN3 AND NOT-GUSB | 0.933333333 | 0.933333333 | 0.933333333 |
| SYT11 AND CD276 | 0.904761905 | 0.9047619 | 0.904761905 | NLGN3 AND NOT-ALG6 | 0.933333333 | 0.933333333 | 0.933333333 |
| SVOP AND CD276 | 0.9 | 0.94736842 | 0.857142857 | NLGN3 AND NOT-CERS2 | 0.933333333 | 0.933333333 | 0.933333333 |
| SLC10A4 AND NOT-CD276 | 0.917127072 | 0.8556701 | 0.988095238 | NLGN3 AND NOT-SLC2A8 | 0.933333333 | 0.933333333 | 0.933333333 |
| ST8SIA2 AND NOT-ST8SIA2 | 0.904458599 | 0.97260274 | 0.845238095 | NLGN3 AND NOT-GZMK | 0.965517241 | 1 | 0.933333333 |
| SCN3B AND CD276 | 0.914634146 | 0.9375 | 0.892857143 | NLGN3 AND NOT-HEXB | 0.933333333 | 0.933333333 | 0.933333333 |
| NRSN1 AND CD276 | 0.9 | 0.94736842 | 0.857142857 | NLGN3 AND NOT-HGF | 0.933333333 | 0.933333333 | 0.933333333 |
| HMP19 AND CD276 | 0.906832298 | 0.94805195 | 0.869047619 | NLGN3 AND NOT-HLA-E | 0.933333333 | 0.933333333 | 0.933333333 |
| GPR19 AND CD276 | 0.920245399 | 0.94936709 | 0.892857143 | NLGN3 AND NOT-MR1 | 0.933333333 | 0.933333333 | 0.933333333 |
| RTN1 AND CD276 | 0.944785276 | 0.97468354 | 0.916666667 | NLGN3 AND NOT-HMGCR | 0.933333333 | 0.933333333 | 0.933333333 |
| FAIM2 AND CD276 | 0.901734104 | 0.87640449 | 0.928571429 | NLGN3 AND NOT-HMOX1 | 0.933333333 | 0.933333333 | 0.933333333 |
| LHFPL4 AND CD276 | 0.9 | 0.94736842 | 0.857142857 | NLGN3 AND NOT-VN1R2 | 0.933333333 | 0.933333333 | 0.933333333 |
| CHRNA3 AND CHRNA3 | 0.913580247 | 0.94871795 | 0.880952381 | NLGN3 AND NOT-HSD3B2 | 0.933333333 | 0.933333333 | 0.933333333 |
| NOT-ALPK1 AND CD276 | 0.90797546 | 0.93670886 | 0.880952381 | NLGN3 AND NOT-DNAJC4 | 0.933333333 | 0.933333333 | 0.933333333 |
| MARCH11 AND MARCH11 | 0.924855491 | 0.8988764 | 0.952380952 | NLGN3 AND NOT-HTR2B | 0.933333333 | 0.933333333 | 0.933333333 |
| SLC10A4 AND NOT-IL11RA | 0.917127072 | 0.8556701 | 0.988095238 | NLGN3 AND NOT-HTR4 | 0.933333333 | 0.933333333 | 0.933333333 |
| ST8SIA2 AND NOT-ST8SIA2 | 0.904458599 | 0.97260274 | 0.845238095 | NLGN3 AND NOT-ICAM3 | 0.933333333 | 0.933333333 | 0.933333333 |
| CHRNA3 AND CHRNA3 | 0.913580247 | 0.94871795 | 0.880952381 | NLGN3 AND NOT-TMEM52 | 0.933333333 | 0.933333333 | 0.933333333 |
| SLC10A4 AND NOT-EPHA2 | 0.917127072 | 0.8556701 | 0.988095238 | NLGN3 AND NOT-TSPAN33 | 0.933333333 | 0.933333333 | 0.933333333 |
| ST8SIA2 AND NOT-EPHA2 | 0.944785276 | 0.97468354 | 0.916666667 | NLGN3 AND NOT-SERINC2 | 0.933333333 | 0.933333333 | 0.933333333 |
| VANGL2 AND NOT-EPHA2 | 0.911392405 | 0.97297297 | 0.857142857 | NLGN3 AND NOT-AMIGO2 | 0.933333333 | 0.933333333 | 0.933333333 |
| CHRNA3 AND NOT-EPHA2 | 0.93081761 | 0.98666667 | 0.880952381 | NLGN3 AND NOT-IGF2R | 0.933333333 | 0.933333333 | 0.933333333 |
| SLC10A4 AND NOT-IL3RA | 0.917127072 | 0.8556701 | 0.988095238 | NLGN3 AND NOT-SLCO4C1 | 0.933333333 | 0.933333333 | 0.933333333 |
| ST8SIA2 AND NOT-IL3RA | 0.911392405 | 0.97297297 | 0.857142857 | NLGN3 AND NOT-IL1R1 | 0.933333333 | 0.933333333 | 0.933333333 |
| CHRNA3 AND CHRNA3 | 0.913580247 | 0.94871795 | 0.880952381 | NLGN3 AND NOT-IL4R | 0.933333333 | 0.933333333 | 0.933333333 |
| SLC10A4 AND NOT-GPC3 | 0.917127072 | 0.8556701 | 0.988095238 | NLGN3 AND NOT-IL6R | 0.933333333 | 0.933333333 | 0.933333333 |
| CHRNA3 AND NOT-GPC3 | 0.927710843 | 0.93902439 | 0.916666667 | NLGN3 AND NOT-IL10RA | 0.933333333 | 0.933333333 | 0.933333333 |
| SLC10A4 AND NOT-MUC16 | 0.917127072 | 0.8556701 | 0.988095238 | NLGN3 AND NOT-IL10RB | 0.933333333 | 0.933333333 | 0.933333333 |
| CHRNA3 AND NOT-MUC16 | 0.950617284 | 0.98717949 | 0.916666667 | NLGN3 AND NOT-IL12B | 0.933333333 | 0.933333333 | 0.933333333 |
| MARCH11 AND MARCH11 | 0.924855491 | 0.8988764 | 0.952380952 | NLGN3 AND NOT-IL15RA | 0.933333333 | 0.933333333 | 0.933333333 |
| SLC10A4 AND NOT-EPHA3 | 0.917127072 | 0.8556701 | 0.988095238 | NLGN3 AND NOT-INSR | 0.933333333 | 0.933333333 | 0.933333333 |
| ST8SIA2 AND NOT-EPHA3 | 0.938271605 | 0.97435897 | 0.904761905 | NLGN3 AND NOT-ITGA2 | 0.933333333 | 0.933333333 | 0.933333333 |
| CHRNA3 AND CHRNA3 | 0.913580247 | 0.94871795 | 0.880952381 | NLGN3 AND NOT-ITGA5 | 0.933333333 | 0.933333333 | 0.933333333 |
| PCDHB10 AND NOT-EPHA3 | 0.909090909 | 1 | 0.833333333 | NLGN3 AND NOT-ITGA9 | 0.933333333 | 0.933333333 | 0.933333333 |
| SLC10A4 AND NOT-CD38 | 0.916201117 | 0.86315789 | 0.976190476 | NLGN3 AND NOT-ITGAE | 0.933333333 | 0.933333333 | 0.933333333 |
| ST8SIA2 AND NOT-ST8SIA2 | 0.904458599 | 0.97260274 | 0.845238095 | NLGN3 AND NOT-ITGAM | 0.933333333 | 0.933333333 | 0.933333333 |
| CHRNA3 AND CHRNA3 | 0.913580247 | 0.94871795 | 0.880952381 | GDAP1L1 AND TMEM179B | 0.909090909 | 0.833333333 | 1 |
| MARCH11 AND ERBB2 | 0.912280702 | 0.89655172 | 0.928571429 | NLGN3 AND NOT-KCNA7 | 0.933333333 | 0.933333333 | 0.933333333 |
| SLC10A4 AND NOT-ERBB2 | 0.917127072 | 0.8556701 | 0.988095238 | KCNQ2 AND NOT-KCNB1 | 0.933333333 | 0.933333333 | 0.933333333 |
| ST8SIA2 AND NOT-ERBB2 | 0.922155689 | 0.92771084 | 0.916666667 | NLGN3 AND NOT-PEAR1 | 0.933333333 | 0.933333333 | 0.933333333 |
| VANGL2 AND NOT-ERBB2 | 0.918238994 | 0.97333333 | 0.869047619 | NLGN3 AND NOT-MIA3 | 0.933333333 | 0.933333333 | 0.933333333 |
| CHRNA3 AND CHRNA3 | 0.913580247 | 0.94871795 | 0.880952381 | NLGN3 AND NOT-TMEM110 | 0.933333333 | 0.933333333 | 0.933333333 |
| DIABLO AND NOT-ERBB2 | 0.90797546 | 0.93670886 | 0.880952381 | NLGN3 AND NOT-KCNJ5 | 0.933333333 | 0.933333333 | 0.933333333 |
| SLC10A4 AND NOT-TNFRSF10A | 0.917127072 | 0.8556701 | 0.988095238 | NLGN3 AND NOT-KCNJ8 | 0.933333333 | 0.933333333 | 0.933333333 |
| ST8SIA2 AND NOT-TNFRSF10A | 0.950617284 | 0.98717949 | 0.916666667 | KCNJ10 AND TSPAN11 | 0.909090909 | 0.833333333 | 1 |
| GAL AND NOT-TNFRSF10A | 0.903614458 | 0.91463415 | 0.892857143 | KCNJ10 AND NAT10 | 0.909090909 | 0.833333333 | 1 |
| VANGL2 AND NOT-TNFRSF10A | 0.918238994 | 0.97333333 | 0.869047619 | KCNJ10 AND FAM57A | 0.909090909 | 0.833333333 | 1 |
| CHRNA3 AND NOT-TNFRSF10A | 0.927710843 | 0.93902439 | 0.916666667 | KCNJ10 AND GPAA1 | 0.909090909 | 0.833333333 | 1 |
| DIABLO AND NOT-TNFRSF10A | 0.90797546 | 0.93670886 | 0.880952381 | NLGN3 AND NOT-KCNK2 | 0.933333333 | 0.933333333 | 0.933333333 |
| MARCH11 AND MARCH11 | 0.924855491 | 0.8988764 | 0.952380952 | NLGN3 AND NOT-KCNK3 | 0.933333333 | 0.933333333 | 0.933333333 |
| SLC10A4 AND NOT-L1CAM | 0.917127072 | 0.8556701 | 0.988095238 | NLGN3 AND NOT-KCNQ1 | 0.933333333 | 0.933333333 | 0.933333333 |
| ST8SIA2 AND L1CAM | 0.922155689 | 0.92771084 | 0.916666667 | NLGN3 AND NOT-KDR | 0.933333333 | 0.933333333 | 0.933333333 |
| NOT-GDAP1L1 AND L1CAM | 0.901734104 | 0.87640449 | 0.928571429 | NLGN3 AND NOT-KIR3DL2 | 0.933333333 | 0.933333333 | 0.933333333 |
| CHRNA3 AND CHRNA3 | 0.913580247 | 0.94871795 | 0.880952381 | NLGN3 AND NOT-TMEM189 | 0.933333333 | 0.933333333 | 0.933333333 |
| DIABLO AND L1CAM | 0.925 | 0.97368421 | 0.880952381 | NLGN3 AND NOT-TMEM220 | 0.933333333 | 0.933333333 | 0.933333333 |
| MARCH11 AND MARCH11 | 0.924855491 | 0.8988764 | 0.952380952 | NLGN3 AND NOT-LDLR | 0.933333333 | 0.933333333 | 0.933333333 |
| SLC10A4 AND NOT-CD22 | 0.917127072 | 0.8556701 | 0.988095238 | NLGN3 AND NOT-LHCGR | 0.933333333 | 0.933333333 | 0.933333333 |
| ST8SIA2 AND NOT-ST8SIA2 | 0.904458599 | 0.97260274 | 0.845238095 | NLGN3 AND NOT-FADS3 | 0.933333333 | 0.933333333 | 0.933333333 |
| CHRNA3 AND CHRNA3 | 0.913580247 | 0.94871795 | 0.880952381 | NLGN3 AND NOT-HACD4 | 0.933333333 | 0.933333333 | 0.933333333 |
| MARCH11 AND NOT-B4GALNT1 | 0.901234568 | 0.93589744 | 0.869047619 | NLGN3 AND NOT-IFITM10 | 0.933333333 | 0.933333333 | 0.933333333 |
| SLC10A4 AND NOT-B4GALNT1 | 0.911111111 | 0.85416667 | 0.976190476 | NLGN3 AND NOT-PPAPDC2 | 0.933333333 | 0.933333333 | 0.933333333 |
| ST8SIA2 AND NOT-ST8SIA2 | 0.904458599 | 0.97260274 | 0.845238095 | NLGN3 AND NOT-LRP5 | 0.933333333 | 0.933333333 | 0.933333333 |
| CHRNA3 AND CHRNA3 | 0.913580247 | 0.94871795 | 0.880952381 | NLGN3 AND NOT-LRPAP1 | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| MARCH11 AND MARCH11 | 0.924855491 | 0.8988764 | 0.952380952 | NLGN3 AND NOT-DUOXA2 | 0.965517241 | 1 | 0.933333333 |
| SLC10A4 AND NOT-MUC13 | 0.917127072 | 0.8556701 | 0.988095238 | NLGN3 AND NOT-LY75 | 0.933333333 | 0.933333333 | 0.933333333 |
| ST8SIA2 AND NOT-MUC13 | 0.922155689 | 0.92771084 | 0.916666667 | NLGN3 AND NOT-TACSTD2 | 0.933333333 | 0.933333333 | 0.933333333 |
| CHRNA3 AND NOT-MUC13 | 0.950617284 | 0.98717949 | 0.916666667 | NLGN3 AND NOT-EPCAM | 0.933333333 | 0.933333333 | 0.933333333 |
| SLC10A4 AND NOT-GPA33 | 0.917127072 | 0.8556701 | 0.988095238 | NLGN3 AND NOT-SMAD2 | 0.933333333 | 0.933333333 | 0.933333333 |
| ST8SIA2 AND NOT-GPA33 | 0.95 | 1 | 0.904761905 | NLGN3 AND NOT-MAG | 0.933333333 | 0.933333333 | 0.933333333 |
| CHRNA3 AND NOT-GPA33 | 0.950617284 | 0.98717949 | 0.916666667 | NLGN3 AND NOT-MAN1A1 | 0.933333333 | 0.933333333 | 0.933333333 |
| SLC10A4 AND NOT-AXL | 0.917127072 | 0.8556701 | 0.988095238 | NLGN3 AND NOT-MAN2A1 | 0.933333333 | 0.933333333 | 0.933333333 |
| ST8SIA2 AND NOT-AXL | 0.944785276 | 0.97468354 | 0.916666667 | NLGN3 AND NOT-MARS | 0.933333333 | 0.933333333 | 0.933333333 |
| CHRNA3 AND NOT-AXL | 0.924050633 | 0.98648649 | 0.869047619 | NLGN3 AND NOT-ARSD | 0.933333333 | 0.933333333 | 0.933333333 |
| SLC10A4 AND NOT-ITGB3 | 0.917127072 | 0.8556701 | 0.988095238 | NLGN3 AND NOT-CD46 | 0.933333333 | 0.933333333 | 0.933333333 |
| ST8SIA2 AND NOT-ITGB3 | 0.95 | 1 | 0.904761905 | NLGN3 AND NOT-DNAJB9 | 0.933333333 | 0.933333333 | 0.933333333 |
| CHRNA3 AND NOT-ITGB3 | 0.95 | 1 | 0.904761905 | NLGN3 AND NOT-ART4 | 0.928571429 | 1 | 0.866666667 |
| PCDHB10 AND NOT-ITGB3 | 0.909090909 | 1 | 0.833333333 | NLGN3 AND NOT-MGAT1 | 0.933333333 | 0.933333333 | 0.933333333 |
| SLC10A4 AND NOT-CSPG4 | 0.917127072 | 0.8556701 | 0.988095238 | NLGN3 AND NOT-MGST1 | 0.933333333 | 0.933333333 | 0.933333333 |
| ST8SIA2 AND NOT-CSPG4 | 0.917197452 | 0.98630137 | 0.857142857 | NLGN3 AND NOT-C1orf186 | 0.965517241 | 1 | 0.933333333 |
| CHRNA3 AND CHRNA3 | 0.913580247 | 0.94871795 | 0.880952381 | NLGN3 AND NOT-SHISA8 | 0.933333333 | 0.933333333 | 0.933333333 |
| CHRNA3 AND NOT-SMIM6 | 0.956521739 | 1 | 0.916666667 | NLGN3 AND NOT-SMIM4 | 0.933333333 | 0.933333333 | 0.933333333 |
| FAM163A AND NOT-SMIM6 | 0.970760234 | 0.95402299 | 0.988095238 | NLGN3 AND NOT-TMEM150C | 0.933333333 | 0.933333333 | 0.933333333 |
| SLC10A4 AND NOT-SMIM6 | 0.976470588 | 0.96511628 | 0.988095238 | SLC1A2 AND TSPAN11 | 0.909090909 | 0.833333333 | 1 |
| ST8SIA2 AND NOT-SMIM6 | 0.956521739 | 1 | 0.916666667 | GDAP1L1 AND TSPAN11 | 0.909090909 | 0.833333333 | 1 |
| SLC10A4 AND NOT-NEMP2 | 0.922222222 | 0.86458333 | 0.988095238 | NLGN3 AND NOT-ASPH | 0.933333333 | 0.933333333 | 0.933333333 |
| MARCH11 AND NOT-NEMP2 | 0.946745562 | 0.94117647 | 0.952380952 | NLGN3 AND NDUFB1 | 0.933333333 | 0.933333333 | 0.933333333 |
| CHRNA3 AND NOT-HCN4 | 0.95 | 1 | 0.904761905 | NLGN3 AND NOT-NDUFB8 | 0.933333333 | 0.933333333 | 0.933333333 |
| MARCH11 AND NOT-PET117 | 0.952380952 | 0.95238095 | 0.952380952 | NLGN3 AND NOT-NINJ1 | 0.933333333 | 0.933333333 | 0.933333333 |
| FAM163A AND NOT-APELA | 0.958083832 | 0.96385542 | 0.952380952 | NLGN3 AND NOT-NPR3 | 0.933333333 | 0.933333333 | 0.933333333 |
| ST8SIA2 AND NOT-APELA | 0.950617284 | 0.98717949 | 0.916666667 | NLGN3 AND NOT-ROR2 | 0.933333333 | 0.933333333 | 0.933333333 |
| SLC10A4 AND NOT-TMEM178B | 0.922222222 | 0.86458333 | 0.988095238 | NLGN3 AND NOT-DDR2 | 0.933333333 | 0.933333333 | 0.933333333 |
| MARCH11 AND NOT-TMEM178B | 0.946745562 | 0.94117647 | 0.952380952 | NLGN3 AND NOT-NUCB1 | 0.933333333 | 0.933333333 | 0.933333333 |
| CHRNA3 AND NOT-MICA | 0.950617284 | 0.98717949 | 0.916666667 | NLGN3 AND NOT-GPX8 | 0.933333333 | 0.933333333 | 0.933333333 |
| SLC10A4 AND NOT-MICA | 0.922222222 | 0.86458333 | 0.988095238 | NLGN3 AND NOT-ATP4A | 0.933333333 | 0.933333333 | 0.933333333 |
| CHRNA3 AND NOT-100507547? | 0.943396226 | 1 | 0.892857143 | OMG AND GPAA1 | 0.909090909 | 0.833333333 | 1 |
| SLC10A4 AND NOT-100507547? | 0.927374302 | 0.87368421 | 0.988095238 | NLGN3 AND NOT-OXA1L | 0.933333333 | 0.933333333 | 0.933333333 |
| CHRNA3 AND UBA2 | 0.956521739 | 1 | 0.916666667 | SLC1A2 AND P2RX4 | 0.909090909 | 0.833333333 | 1 |
| SLC10A4 AND UBA2 | 0.922222222 | 0.86458333 | 0.988095238 | GDAP1L1 AND P2RX4 | 0.909090909 | 0.833333333 | 1 |
| ST8SIA2 AND UBA2 | 0.956521739 | 1 | 0.916666667 | LINGO1 AND P2RX4 | 0.909090909 | 0.833333333 | 1 |
| CHRNA3 AND NOT-ABCC9 | 0.950617284 | 0.98717949 | 0.916666667 | NLGN3 AND NOT-CYHR1 | 0.933333333 | 0.933333333 | 0.933333333 |
| SLC10A4 AND NOT-MUC12 | 0.936416185 | 0.91011236 | 0.964285714 | NLGN3 AND NOT-TAS2R1 | 0.933333333 | 0.933333333 | 0.933333333 |
| SLC10A4 AND NOT-UST | 0.970414201 | 0.96470588 | 0.976190476 | NLGN3 AND NOT-F11R | 0.933333333 | 0.933333333 | 0.933333333 |
| ST8SIA2 AND NOT-UST | 0.943396226 | 1 | 0.892857143 | NOT-F11R AND TMEM259 | 0.928571429 | 1 | 0.866666667 |
| ST8SIA2 AND NOT-PDZK1IP1 | 0.943396226 | 1 | 0.892857143 | NLGN3 AND NOT-TMED5 | 0.933333333 | 0.933333333 | 0.933333333 |
| CHRNA3 AND NOT-DHRS9 | 0.950617284 | 0.98717949 | 0.916666667 | NLGN3 AND NOT-SLC35B3 | 0.933333333 | 0.933333333 | 0.933333333 |
| GPR19 AND NOT-DHRS9 | 0.963414634 | 0.9875 | 0.94047619 | NLGN3 AND NOT-SLC35C2 | 0.933333333 | 0.933333333 | 0.933333333 |
| GAL AND NOT-DHRS9 | 0.936708861 | 1 | 0.880952381 | NLGN3 AND NOT-TXNDC12 | 0.933333333 | 0.933333333 | 0.933333333 |
| ST8SIA2 AND NOT-DHRS9 | 0.956521739 | 1 | 0.916666667 | NLGN3 AND NOT-ADIPOR1 | 0.933333333 | 0.933333333 | 0.933333333 |
| FAM163A AND CNIH1 | 0.93258427 | 0.88297872 | 0.988095238 | NLGN3 AND NOT-SCCPDH | 0.933333333 | 0.933333333 | 0.933333333 |
| SLC10A4 AND NOT-TENM1 | 0.927374302 | 0.87368421 | 0.988095238 | NLGN3 AND NOT-TMEM69 | 0.933333333 | 0.933333333 | 0.933333333 |
| CHRNA3 AND NOT-101805491? | 0.950617284 | 0.98717949 | 0.916666667 | NLGN3 AND NOT-NT5C3A | 0.933333333 | 0.933333333 | 0.933333333 |
| CHRNA3 AND NOT-GPA33 | 0.950617284 | 0.98717949 | 0.916666667 | NLGN3 AND NOT-BET1L | 0.933333333 | 0.933333333 | 0.933333333 |
| ST8SIA2 AND NOT-GPA33 | 0.95 | 1 | 0.904761905 | NLGN3 AND NOT-ERGIC2 | 0.933333333 | 0.933333333 | 0.933333333 |
| SLC10A4 AND NOT-MSLN | 0.927374302 | 0.87368421 | 0.988095238 | NLGN3 AND NOT-PCDH12 | 0.933333333 | 0.933333333 | 0.933333333 |
| CHRNA3 AND NOT-PRSS16 | 0.950617284 | 0.98717949 | 0.916666667 | NLGN3 AND NOT-SLC15A3 | 0.933333333 | 0.933333333 | 0.933333333 |
| FAM163A AND NOT-PRSS16 | 0.937853107 | 0.89247312 | 0.988095238 | NLGN3 AND NOT-ZDHHC3 | 0.933333333 | 0.933333333 | 0.933333333 |
| SLC10A4 AND NOT-PRSS16 | 0.927374302 | 0.87368421 | 0.988095238 | NLGN3 AND NOT-MS4A4A | 0.933333333 | 0.933333333 | 0.933333333 |
| MARCH11 AND NOT-PRSS16 | 0.946745562 | 0.94117647 | 0.952380952 | NLGN3 AND NOT-TEX264 | 0.933333333 | 0.933333333 | 0.933333333 |
| SLC10A4 AND NOT-RTN3 | 0.922222222 | 0.86458333 | 0.988095238 | NLGN3 AND NOT-TMEM138 | 0.933333333 | 0.933333333 | 0.933333333 |
| CHRNA3 AND NOT-NMUR1 | 0.950617284 | 0.98717949 | 0.916666667 | NLGN3 AND NOT-MTFP1 | 0.933333333 | 0.933333333 | 0.933333333 |
| CHRNA3 AND NOT-B3GALT5 | 0.950617284 | 0.98717949 | 0.916666667 | NLGN3 AND NOT-NBAS | 0.933333333 | 0.933333333 | 0.933333333 |
| SLC10A4 AND NOT-B3GALT5 | 0.93258427 | 0.88297872 | 0.988095238 | NLGN3 AND NOT-LSR | 0.933333333 | 0.933333333 | 0.933333333 |
| ST8SIA2 AND NOT-B3GALT5 | 0.950617284 | 0.98717949 | 0.916666667 | NLGN3 AND NOT-PDGFRB | 0.933333333 | 0.933333333 | 0.933333333 |
| FAM163A AND NOT-SIRPB1 | 0.942528736 | 0.91111111 | 0.976190476 | NLGN3 AND NOT-SLC25A39 | 0.933333333 | 0.933333333 | 0.933333333 |
| SLC10A4 AND NOT-SIRPB1 | 0.937142857 | 0.9010989 | 0.976190476 | NLGN3 AND NOT-FKBP7 | 0.933333333 | 0.933333333 | 0.933333333 |
| CHRNA3 AND NOT-B3GNT3 | 0.950617284 | 0.98717949 | 0.916666667 | NLGN3 AND NOT-ENPP1 | 0.933333333 | 0.933333333 | 0.933333333 |
| CHRNA3 AND NOT-TLR6 | 0.950617284 | 0.98717949 | 0.916666667 | NLGN3 AND NOT-ENPP3 | 0.933333333 | 0.933333333 | 0.933333333 |
| CHRNA3 AND NOT-PKDREJ | 0.950617284 | 0.98717949 | 0.916666667 | NLGN3 AND NOT-TMEM8B | 0.933333333 | 0.933333333 | 0.933333333 |
| CHRNA3 AND NOT-CDS1 | 0.95 | 1 | 0.904761905 | NLGN3 AND NOT-PECAM1 | 0.933333333 | 0.933333333 | 0.933333333 |
| FAM163A AND NOT-CDS1 | 0.943181818 | 0.90217391 | 0.988095238 | NLGN3 AND NOT-ASIC5 | 0.933333333 | 0.933333333 | 0.933333333 |
| SLC10A4 AND NOT-CDS1 | 0.959537572 | 0.93258427 | 0.988095238 | NLGN3 AND NOT-PEX10 | 0.933333333 | 0.933333333 | 0.933333333 |
| MARCH11 AND NOT-CDS1 | 0.946745562 | 0.94117647 | 0.952380952 | NLGN3 AND NOT-PF4 | 0.928571429 | 1 | 0.866666667 |
| ST8SIA2 AND NOT-CDS1 | 0.95 | 1 | 0.904761905 | SLC4A4 AND NOT-ATP8B1 | 0.928571429 | 1 | 0.866666667 |
| CHRNA3 AND NOT-CDSN | 0.950617284 | 0.98717949 | 0.916666667 | NLGN3 AND NOT-ABCB4 | 0.933333333 | 0.933333333 | 0.933333333 |
| SLC10A4 AND NOT-TIMM17A | 0.922222222 | 0.86458333 | 0.988095238 | NLGN3 AND NOT-PIGA | 0.933333333 | 0.933333333 | 0.933333333 |
| FAM163A AND CLGN | 0.927374302 | 0.87368421 | 0.988095238 | SLC4A4 AND NOT-PIGR | 0.928571429 | 1 | 0.866666667 |
| CHRNA3 AND NOT-CRTAP | 0.950617284 | 0.98717949 | 0.916666667 | NLGN3 AND NOT-ACP1 | 0.933333333 | 0.933333333 | 0.933333333 |
| CHRNA3 AND NOT-SEMA6B | 0.956521739 | 1 | 0.916666667 | NLGN3 AND NOT-TPCN1 | 0.933333333 | 0.933333333 | 0.933333333 |
| CHRNA3 AND NOT-SEMA4D | 0.950617284 | 0.98717949 | 0.916666667 | NLGN3 AND NOT-PLIN1 | 0.933333333 | 0.933333333 | 0.933333333 |

FIG. 1 (CONT.)

| Antigen Pair Logic | F1 | Precision | Recall | Antigen Pair Logic | F1 | Precision | Recall |
| --- | --- | --- | --- | --- | --- | --- | --- |
| CHRNA3 AND NOT-C6orf10 | 0.943396226 | 1 | 0.892857143 | NLGN3 AND NOT-PLN | 0.933333333 | 0.933333333 | 0.933333333 |
| CHRNA3 AND NOT-CD226 | 0.950617284 | 0.98717949 | 0.916666667 | NLGN3 AND NOT-PLP2 | 0.933333333 | 0.933333333 | 0.933333333 |
| SLC10A4 AND NOT-CSPG5 | 0.922222222 | 0.86458333 | 0.988095238 | NLGN3 AND NOT-FXYD5 | 0.933333333 | 0.933333333 | 0.933333333 |
| ST8SIA2 AND NOT-CLDN16 | 0.936708861 | 1 | 0.880952381 | NLGN3 AND NOT-IL20RA | 0.933333333 | 0.933333333 | 0.933333333 |
| SLC10A4 AND NOT-FUT9 | 0.927374302 | 0.87368421 | 0.988095238 | NLGN3 AND NOT-ATP7A | 0.933333333 | 0.933333333 | 0.933333333 |
| CHRNA3 AND NOT-RRH | 0.950617284 | 0.98717949 | 0.916666667 | NLGN3 AND NOT-DUOX1 | 0.933333333 | 0.933333333 | 0.933333333 |
| FAM163A AND NOT-RRH | 0.937853107 | 0.89247312 | 0.988095238 | NLGN3 AND NOT-A4GALT | 0.933333333 | 0.933333333 | 0.933333333 |
| SLC10A4 AND NOT-RRH | 0.948571429 | 0.91208791 | 0.988095238 | NLGN3 AND NOT-WNT4 | 0.933333333 | 0.933333333 | 0.933333333 |
| ST8SIA2 AND NOT-RRH | 0.950617284 | 0.98717949 | 0.916666667 | NLGN3 AND NOT-YIPF1 | 0.933333333 | 0.933333333 | 0.933333333 |
| CHRNA3 AND NOT-CERS1 | 0.950617284 | 0.98717949 | 0.916666667 | NLGN3 AND NOT-POR | 0.933333333 | 0.933333333 | 0.933333333 |
| SLC10A4 AND NOT-CERS1 | 0.922222222 | 0.86458333 | 0.988095238 | NLGN3 AND NOT-TMCO1 | 0.933333333 | 0.933333333 | 0.933333333 |
| ST8SIA2 AND NOT-CERS1 | 0.950617284 | 0.98717949 | 0.916666667 | NLGN3 AND NOT-VSIG10 | 0.933333333 | 0.933333333 | 0.933333333 |
| SLC10A4 AND NOT-NRG3 | 0.922222222 | 0.86458333 | 0.988095238 | NLGN3 AND NOT-P4HTM | 0.933333333 | 0.933333333 | 0.933333333 |
| SLC10A4 AND NOT-ZMYND11 | 0.922222222 | 0.86458333 | 0.988095238 | NLGN3 AND NOT-LEPROT | 0.933333333 | 0.933333333 | 0.933333333 |
| SLC10A4 AND NOT-CYSLTR1 | 0.922222222 | 0.86458333 | 0.988095238 | NLGN3 AND NOT-LY6K | 0.933333333 | 0.933333333 | 0.933333333 |
| CHRNA3 AND NOT-CCR9 | 0.950617284 | 0.98717949 | 0.916666667 | NLGN3 AND NOT-DNAJB12 | 0.933333333 | 0.933333333 | 0.933333333 |
| CHRNA3 AND NOT-GJB6 | 0.95 | 1 | 0.904761905 | NLGN3 AND NOT-TRPM4 | 0.933333333 | 0.933333333 | 0.933333333 |
| NRSN1 AND NOT-GJB6 | 0.95 | 1 | 0.904761905 | NLGN3 AND NOT-CNNM2 | 0.933333333 | 0.933333333 | 0.933333333 |
| SMIM17 AND NOT-GJB6 | 0.95 | 1 | 0.904761905 | NLGN3 AND NOT-PPIC | 0.933333333 | 0.933333333 | 0.933333333 |
| FAM163A AND NOT-GJB6 | 0.970414201 | 0.96470588 | 0.976190476 | NLGN3 AND NOT-CDHR2 | 0.933333333 | 0.933333333 | 0.933333333 |
| SLC10A4 AND NOT-GJB6 | 0.982035928 | 0.98795181 | 0.976190476 | NLGN3 AND NOT-WBP1L | 0.933333333 | 0.933333333 | 0.933333333 |
| GPR19 AND NOT-GJB6 | 0.958083832 | 0.96385542 | 0.952380952 | NLGN3 AND NOT-PAQR5 | 0.965517241 | 1 | 0.933333333 |
| MARCH11 AND NOT-GJB6 | 0.946745562 | 0.94117647 | 0.952380952 | NLGN3 AND NOT-DNAJC25 | 0.933333333 | 0.933333333 | 0.933333333 |
| ST8SIA3 AND NOT-GJB6 | 0.952380952 | 0.95238095 | 0.952380952 | NLGN3 AND NOT-TMEM104 | 0.933333333 | 0.933333333 | 0.933333333 |
| HMP19 AND NOT-GJB6 | 0.956521739 | 1 | 0.916666667 | NLGN3 AND NOT-RETSAT | 0.933333333 | 0.933333333 | 0.933333333 |
| ST8SIA2 AND NOT-GJB6 | 0.956521739 | 1 | 0.916666667 | NLGN3 AND NOT-RNF43 | 0.933333333 | 0.933333333 | 0.933333333 |
| CHRNA3 AND NOT-SLC26A1 | 0.950617284 | 0.98717949 | 0.916666667 | NLGN3 AND NOT-PQLC2 | 0.933333333 | 0.933333333 | 0.933333333 |
| CHRNA3 AND NOT-CD300C | 0.950617284 | 0.98717949 | 0.916666667 | NLGN3 AND NOT-TMEM260 | 0.933333333 | 0.933333333 | 0.933333333 |
| CHRNA3 AND NOT-EDDM3A | 0.950617284 | 0.98717949 | 0.916666667 | NLGN3 AND NOT-TMEM161A | 0.933333333 | 0.933333333 | 0.933333333 |
| CHRNA3 AND NOT-CEACAM7 | 0.950617284 | 0.98717949 | 0.916666667 | NLGN3 AND NOT-PARP16 | 0.933333333 | 0.933333333 | 0.933333333 |
| CHRNA3 AND NOT-LYVE1 | 0.950617284 | 0.98717949 | 0.916666667 | NLGN3 AND NOT-SLC35F6 | 0.933333333 | 0.933333333 | 0.933333333 |
| CHRNA3 AND NOT-OCLM | 0.950617284 | 0.98717949 | 0.916666667 | NLGN3 AND NOT-MARC2 | 0.933333333 | 0.933333333 | 0.933333333 |
| FAM163A AND NOT-OCLM | 0.922222222 | 0.86458333 | 0.988095238 | NLGN3 AND NOT-C19orf24 | 0.933333333 | 0.933333333 | 0.933333333 |
| SLC10A4 AND NOT-OCLM | 0.943181818 | 0.90217391 | 0.988095238 | NLGN3 AND NOT-STX17 | 0.933333333 | 0.933333333 | 0.933333333 |
| CHRNA3 AND NOT-CEACAM4 | 0.95 | 1 | 0.904761905 | NLGN3 AND NOT-TMEM248 | 0.933333333 | 0.933333333 | 0.933333333 |
| CHRNA3 AND NOT-ADCY2 | 0.950617284 | 0.98717949 | 0.916666667 | NLGN3 AND NOT-TMEM45A | 0.933333333 | 0.933333333 | 0.933333333 |
| SLC10A4 AND NOT-ADCY2 | 0.922222222 | 0.86458333 | 0.988095238 | NLGN3 AND NOT-TMEM51 | 0.933333333 | 0.933333333 | 0.933333333 |
| SLC10A4 AND NOT-MAN1A2 | 0.927374302 | 0.87368421 | 0.988095238 | NLGN3 AND NOT-AUP1 | 0.933333333 | 0.933333333 | 0.933333333 |
| CHRNA3 AND NOT-EDAR | 0.950617284 | 0.98717949 | 0.916666667 | NLGN3 AND NOT-ZDHHC4 | 0.933333333 | 0.933333333 | 0.933333333 |
| MARCH11 AND NOT-EDAR | 0.950617284 | 0.98717949 | 0.916666667 | NLGN3 AND NOT-RMDN3 | 0.933333333 | 0.933333333 | 0.933333333 |
| CHRNA3 AND NOT-GPR75 | 0.950617284 | 0.98717949 | 0.916666667 | NLGN3 AND NOT-NAT10 | 0.933333333 | 0.933333333 | 0.933333333 |
| SLC10A4 AND NOT-GPR75 | 0.922222222 | 0.86458333 | 0.988095238 | NLGN3 AND NOT-SLC38A7 | 0.933333333 | 0.933333333 | 0.933333333 |
| ST8SIA2 AND NOT-GPR75 | 0.950617284 | 0.98717949 | 0.916666667 | NLGN3 AND NOT-SLC47A1 | 0.933333333 | 0.933333333 | 0.933333333 |
| MARCH11 AND NOT-AFG3L2 | 0.952380952 | 0.95238095 | 0.952380952 | NLGN3 AND NOT-TYW1 | 0.933333333 | 0.933333333 | 0.933333333 |
| CHRNA3 AND NOT-TMED10 | 0.950617284 | 0.98717949 | 0.916666667 | NLGN3 AND NOT-TMEM39A | 0.933333333 | 0.933333333 | 0.933333333 |
| CHRNA3 AND NOT-SLC38A3 | 0.956521739 | 1 | 0.916666667 | NLGN3 AND NOT-TMEM143 | 0.933333333 | 0.933333333 | 0.933333333 |
| SLC10A4 AND NOT-SLC27A4 | 0.922222222 | 0.86458333 | 0.988095238 | NLGN3 AND NOT-TMEM140 | 0.933333333 | 0.933333333 | 0.933333333 |
| SLC10A4 AND NOT-TMED1 | 0.922222222 | 0.86458333 | 0.988095238 | NLGN3 AND NOT-MCOLN3 | 0.933333333 | 0.933333333 | 0.933333333 |
| CHRNA3 AND NOT-UPK1A | 0.950617284 | 0.98717949 | 0.916666667 | NLGN3 AND NOT-AVPR1A | 0.933333333 | 0.933333333 | 0.933333333 |
| CHRNA3 AND NOT-ADAM30 | 0.950617284 | 0.98717949 | 0.916666667 | NLGN3 AND NOT-DRAM1 | 0.933333333 | 0.933333333 | 0.933333333 |
| SLC10A4 AND NOT-PLA2G16 | 0.937142857 | 0.9010989 | 0.976190476 | NLGN3 AND NOT-SYNJ2BP | 0.933333333 | 0.933333333 | 0.933333333 |
| CHRNA3 AND NOT-HHLA2 | 0.950617284 | 0.98717949 | 0.916666667 | NLGN3 AND NOT-LRRC59 | 0.933333333 | 0.933333333 | 0.933333333 |
| ST8SIA2 AND NOT-HHLA2 | 0.950617284 | 0.98717949 | 0.916666667 | NLGN3 AND NOT-PARL | 0.933333333 | 0.933333333 | 0.933333333 |
| CHRNA3 AND NOT-ADCY5 | 0.956521739 | 1 | 0.916666667 | NLGN3 AND NOT-ETNK1 | 0.933333333 | 0.933333333 | 0.933333333 |
| CHRNA3 AND NOT-GPR45 | 0.950617284 | 0.98717949 | 0.916666667 | NLGN3 AND NOT-SLC39A4 | 0.933333333 | 0.933333333 | 0.933333333 |
| CHRNA3 AND NOT-PTGDR2 | 0.950617284 | 0.98717949 | 0.916666667 | NLGN3 AND NOT-FLVCR2 | 0.933333333 | 0.933333333 | 0.933333333 |
| SLC10A4 AND NOT-PTGDR2 | 0.93258427 | 0.88297872 | 0.988095238 | NLGN3 AND NOT-PIGV | 0.933333333 | 0.933333333 | 0.933333333 |
| CHRNA3 AND NOT-SLC6A14 | 0.950617284 | 0.98717949 | 0.916666667 | NLGN3 AND NOT-TMEM127 | 0.933333333 | 0.933333333 | 0.933333333 |
| ST8SIA2 AND NOT-SLC6A14 | 0.950617284 | 0.98717949 | 0.916666667 | NLGN3 AND NOT-SLC30A6 | 0.933333333 | 0.933333333 | 0.933333333 |
| SLC10A4 AND NOT-CMTM7 | 0.922222222 | 0.86458333 | 0.988095238 | NLGN3 AND NOT-LMBR1L | 0.933333333 | 0.933333333 | 0.933333333 |
| SCN3B AND NRM | 0.947368421 | 0.93103448 | 0.964285714 | NLGN3 AND NOT-HHAT | 0.933333333 | 0.933333333 | 0.933333333 |
| CHRNA3 AND NOT-STX1B | 0.943396226 | 1 | 0.892857143 | NLGN3 AND NOT-NGLY1 | 0.933333333 | 0.933333333 | 0.933333333 |
| FAM163A AND NOT-SCN11A | 0.947368421 | 0.93103448 | 0.964285714 | NLGN3 AND NOT-ERMARD | 0.933333333 | 0.933333333 | 0.933333333 |
| CHRNA3 AND NOT-HOGA1 | 0.950617284 | 0.98717949 | 0.916666667 | NLGN3 AND NOT-ST6GALNAC1 | 0.933333333 | 0.933333333 | 0.933333333 |
| CHRNA3 AND NOT-CYP4F8 | 0.950617284 | 0.98717949 | 0.916666667 | NLGN3 AND NOT-RNF130 | 0.933333333 | 0.933333333 | 0.933333333 |
| CHRNA3 AND NOT-B4GALT7 | 0.950617284 | 0.98717949 | 0.916666667 | NLGN3 AND NOT-GLT8D1 | 0.933333333 | 0.933333333 | 0.933333333 |
| SLC10A4 AND NOT-MGAT4A | 0.927374302 | 0.87368421 | 0.988095238 | NLGN3 AND NOT-EMC3 | 0.933333333 | 0.933333333 | 0.933333333 |
| CHRNA3 AND NOT-CHRM4 | 0.950617284 | 0.98717949 | 0.916666667 | NLGN3 AND NOT-TEX2 | 0.933333333 | 0.933333333 | 0.933333333 |
| FAM163A AND NOT-CHRM5 | 0.942528736 | 0.91111111 | 0.976190476 | NLGN3 AND NOT-GPRC5C | 0.933333333 | 0.933333333 | 0.933333333 |
| SLC10A4 AND NOT-CHRM5 | 0.970414201 | 0.96470588 | 0.976190476 | NLGN3 AND NOT-ACSS2 | 0.933333333 | 0.933333333 | 0.933333333 |
| ST8SIA2 AND NOT-CHRM5 | 0.956521739 | 1 | 0.916666667 | NLGN3 AND NOT-SLC50A1 | 0.933333333 | 0.933333333 | 0.933333333 |
| SLC10A4 AND NOT-RNF13 | 0.970414201 | 0.96470588 | 0.976190476 | NLGN3 AND NOT-ALG1 | 0.933333333 | 0.933333333 | 0.933333333 |
| CHRNA3 AND NOT-CHRNA4 | 0.950617284 | 0.98717949 | 0.916666667 | NLGN3 AND NOT-MOSPD1 | 0.933333333 | 0.933333333 | 0.933333333 |
| CHRNA3 AND NOT-SLC2A13 | 0.936708861 | 1 | 0.880952381 | NLGN3 AND NOT-PRLR | 0.933333333 | 0.933333333 | 0.933333333 |
| CHRNA3 AND NOT-CHRND | 0.950617284 | 0.98717949 | 0.916666667 | NLGN3 AND NOT-SUSD2 | 0.933333333 | 0.933333333 | 0.933333333 |
| CHRNA3 AND NOT-PKD1L2 | 0.950617284 | 0.98717949 | 0.916666667 | NLGN3 AND NOT-MRAP | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| CHRNA3 AND NOT-CSMD3 | 0.950617284 | 0.98717949 | 0.916666667 | NLGN3 AND NOT-GKN1 | 0.933333333 | 0.933333333 | 0.933333333 |
| CHRNA3 AND NOT-ELFN2 | 0.956521739 | 1 | 0.916666667 | NLGN3 AND NOT-TRPV5 | 0.965517241 | 1 | 0.933333333 |
| CHRNA3 AND NOT-SLAMF6 | 0.950617284 | 0.98717949 | 0.916666667 | NLGN3 AND NOT-TMPRSS15 | 0.933333333 | 0.933333333 | 0.933333333 |
| CHRNA3 AND NOT-C1QTNF1 | 0.950617284 | 0.98717949 | 0.916666667 | NLGN3 AND NOT-PSEN2 | 0.933333333 | 0.933333333 | 0.933333333 |
| CHRNA3 AND NOT-SLC26A9 | 0.95 | 1 | 0.904761905 | NLGN3 AND NOT-GPR108 | 0.933333333 | 0.933333333 | 0.933333333 |
| CHRNA3 AND NOT-OMA1 | 0.950617284 | 0.98717949 | 0.916666667 | NLGN3 AND NOT-CHPT1 | 0.933333333 | 0.933333333 | 0.933333333 |
| CHRNA3 AND NOT-SLC5A11 | 0.956521739 | 1 | 0.916666667 | NLGN3 AND NOT-ENTPD7 | 0.933333333 | 0.933333333 | 0.933333333 |
| CHRNA3 AND NOT-EVI5L | 0.950617284 | 0.98717949 | 0.916666667 | NLGN3 AND NOT-PNPLA2 | 0.933333333 | 0.933333333 | 0.933333333 |
| CHRNA3 AND NOT-SLC22A12 | 0.950617284 | 0.98717949 | 0.916666667 | NLGN3 AND NOT-CD248 | 0.933333333 | 0.933333333 | 0.933333333 |
| CHRNA3 AND NOT-ACSM1 | 0.950617284 | 0.98717949 | 0.916666667 | NLGN3 AND NOT-RHBG | 0.928571429 | 1 | 0.866666667 |
| CHRNA3 AND NOT-PANX3 | 0.950617284 | 0.98717949 | 0.916666667 | NLGN3 AND NOT-MAN1C1 | 0.933333333 | 0.933333333 | 0.933333333 |
| CHRNA3 AND NOT-SLC26A8 | 0.950617284 | 0.98717949 | 0.916666667 | NLGN3 AND RTN4 | 0.933333333 | 0.933333333 | 0.933333333 |
| CHRNA3 AND NOT-GRIN3B | 0.950617284 | 0.98717949 | 0.916666667 | NLGN3 AND NOT-TMEM159 | 0.933333333 | 0.933333333 | 0.933333333 |
| CHRNA3 AND NOT-SLC18B1 | 0.950617284 | 0.98717949 | 0.916666667 | NLGN3 AND NOT-DOLPP1 | 0.933333333 | 0.933333333 | 0.933333333 |
| CHRNA3 AND NOT-CATSPER2 | 0.950617284 | 0.98717949 | 0.916666667 | NLGN3 AND NOT-MCOLN1 | 0.933333333 | 0.933333333 | 0.933333333 |
| CHRNA3 AND NOT-MRGPRX2 | 0.950617284 | 0.98717949 | 0.916666667 | NLGN3 AND NOT-ATP10A | 0.933333333 | 0.933333333 | 0.933333333 |
| CHRNA3 AND NOT-MRGPRX3 | 0.950617284 | 0.98717949 | 0.916666667 | NLGN3 AND NOT-ATP10D | 0.933333333 | 0.933333333 | 0.933333333 |
| CHRNA3 AND NOT-ADCYAP1R1 | 0.950617284 | 0.98717949 | 0.916666667 | NLGN3 AND NOT-ADGRG6 | 0.933333333 | 0.933333333 | 0.933333333 |
| CHRNA3 AND NOT-GPR62 | 0.956521739 | 1 | 0.916666667 | NLGN3 AND NOT-ERGIC1 | 0.933333333 | 0.933333333 | 0.933333333 |
| CHRNA3 AND NOT-CLCNKB | 0.950617284 | 0.98717949 | 0.916666667 | NLGN3 AND NOT-SNX14 | 0.933333333 | 0.933333333 | 0.933333333 |
| CHRNA3 AND NOT-OR5P2 | 0.950617284 | 0.98717949 | 0.916666667 | NLGN3 AND NOT-MRS2 | 0.933333333 | 0.933333333 | 0.933333333 |
| CHRNA3 AND NOT-OR5P3 | 0.950617284 | 0.98717949 | 0.916666667 | NLGN3 AND NOT-PTGFRN | 0.933333333 | 0.933333333 | 0.933333333 |
| CHRNA3 AND NOT-TMEM52B | 0.950617284 | 0.98717949 | 0.916666667 | NLGN3 AND NOT-RHBDD2 | 0.933333333 | 0.933333333 | 0.933333333 |
| CHRNA3 AND NOT-ANO4 | 0.950617284 | 0.98717949 | 0.916666667 | NLGN3 AND NOT-GRAMD1B | 0.933333333 | 0.933333333 | 0.933333333 |
| CHRNA3 AND NOT-SLC24A4 | 0.950617284 | 0.98717949 | 0.916666667 | NLGN3 AND NOT-RNF150 | 0.933333333 | 0.933333333 | 0.933333333 |
| CHRNA3 AND NOT-DEGS2 | 0.950617284 | 0.98717949 | 0.916666667 | NLGN3 AND NOT-MTUS1 | 0.928571429 | 1 | 0.866666667 |
| CHRNA3 AND NOT-SLC51B | 0.950617284 | 0.98717949 | 0.916666667 | NLGN3 AND NOT-SEMA6A | 0.933333333 | 0.933333333 | 0.933333333 |
| CHRNA3 AND NOT-CCR3 | 0.950617284 | 0.98717949 | 0.916666667 | NLGN3 AND NOT-PTPN2 | 0.933333333 | 0.933333333 | 0.933333333 |
| CHRNA3 AND NOT-ACKR2 | 0.950617284 | 0.98717949 | 0.916666667 | NLGN3 AND NOT-WDR19 | 0.933333333 | 0.933333333 | 0.933333333 |
| CHRNA3 AND NOT-CD300LB | 0.950617284 | 0.98717949 | 0.916666667 | NLGN3 AND NOT-SLAMF7 | 0.933333333 | 0.933333333 | 0.933333333 |
| CHRNA3 AND NOT-B4GALNT2 | 0.950617284 | 0.98717949 | 0.916666667 | NLGN3 AND NOT-PTPRH | 0.965517241 | 1 | 0.933333333 |
| CHRNA3 AND NOT-SPNS2 | 0.950617284 | 0.98717949 | 0.916666667 | NLGN3 AND NOT-PVR | 0.933333333 | 0.933333333 | 0.933333333 |
| CHRNA3 AND NOT-GJD3 | 0.950617284 | 0.98717949 | 0.916666667 | NLGN3 AND NOT-PVRL2 | 0.933333333 | 0.933333333 | 0.933333333 |
| CHRNA3 AND NOT-CNGA4 | 0.950617284 | 0.98717949 | 0.916666667 | NLGN3 AND NOT-MS4A7 | 0.933333333 | 0.933333333 | 0.933333333 |
| CHRNA3 AND NOT-LRRC25 | 0.95 | 1 | 0.904761905 | NLGN3 AND NOT-FAM3A | 0.933333333 | 0.933333333 | 0.933333333 |
| CHRNA3 AND NOT-CYP4F22 | 0.950617284 | 0.98717949 | 0.916666667 | NLGN3 AND NOT-RNASE1 | 0.933333333 | 0.933333333 | 0.933333333 |
| CHRNA3 AND NOT-GJB4 | 0.950617284 | 0.98717949 | 0.916666667 | NLGN3 AND NOT-RNASE4 | 0.933333333 | 0.933333333 | 0.933333333 |
| CHRNA3 AND NOT-DCST2 | 0.950617284 | 0.98717949 | 0.916666667 | NLGN3 AND NOT-ELOVL5 | 0.933333333 | 0.933333333 | 0.933333333 |
| CHRNA3 AND NOT-TMEM125 | 0.956521739 | 1 | 0.916666667 | NLGN3 AND RPL37A | 0.933333333 | 0.933333333 | 0.933333333 |
| CHRNA3 AND NOT-FITM2 | 0.950617284 | 0.98717949 | 0.916666667 | NLGN3 AND NOT-BCS1L | 0.933333333 | 0.933333333 | 0.933333333 |
| CHRNA3 AND NOT-TMEM150A | 0.950617284 | 0.98717949 | 0.916666667 | NLGN3 AND NOT-RRBP1 | 0.933333333 | 0.933333333 | 0.933333333 |
| CHRNA3 AND NOT-CNTNAP5 | 0.943396226 | 1 | 0.892857143 | NLGN3 AND NOT-SCN4B | 0.933333333 | 0.933333333 | 0.933333333 |
| CHRNA3 AND NOT-SGPP2 | 0.95 | 1 | 0.904761905 | NLGN3 AND NOT-SCN7A | 0.933333333 | 0.933333333 | 0.933333333 |
| CHRNA3 AND NOT-ACVR1C | 0.943396226 | 1 | 0.892857143 | NLGN3 AND NOT-SCNN1A | 0.933333333 | 0.933333333 | 0.933333333 |
| CHRNA3 AND NOT-LYPD6B | 0.95 | 1 | 0.904761905 | NLGN3 AND NOT-CEACAM1 | 0.933333333 | 0.933333333 | 0.933333333 |
| CHRNA3 AND NOT-CD200R1 | 0.950617284 | 0.98717949 | 0.916666667 | NLGN3 AND NOT-SDC1 | 0.933333333 | 0.933333333 | 0.933333333 |
| CHRNA3 AND NOT-TMEM207 | 0.950617284 | 0.98717949 | 0.916666667 | NLGN3 AND NOT-THADA | 0.933333333 | 0.933333333 | 0.933333333 |
| CHRNA3 AND NOT-TMPRSS11B | 0.956521739 | 1 | 0.916666667 | NLGN3 AND NOT-BIK | 0.933333333 | 0.933333333 | 0.933333333 |
| CHRNA3 AND NOT-EVC2 | 0.950617284 | 0.98717949 | 0.916666667 | NLGN3 AND NOT-MANBAL | 0.933333333 | 0.933333333 | 0.933333333 |
| CHRNA3 AND NOT-IL31RA | 0.950617284 | 0.98717949 | 0.916666667 | NLGN3 AND NOT-SELPLG | 0.933333333 | 0.933333333 | 0.933333333 |
| CHRNA3 AND NOT-SLCO6A1 | 0.950617284 | 0.98717949 | 0.916666667 | NLGN3 AND NOT-PERP | 0.928571429 | 1 | 0.866666667 |
| CHRNA3 AND NOT-TMEM171 | 0.950617284 | 0.98717949 | 0.916666667 | NLGN3 AND NOT-POPDC2 | 0.933333333 | 0.933333333 | 0.933333333 |
| CHRNA3 AND NOT-TMEM174 | 0.950617284 | 0.98717949 | 0.916666667 | NLGN3 AND NOT-ELSPBP1 | 0.933333333 | 0.933333333 | 0.933333333 |
| CHRNA3 AND COX7A2 | 0.950617284 | 0.98717949 | 0.916666667 | NLGN3 AND NOT-XYLT2 | 0.933333333 | 0.933333333 | 0.933333333 |
| CHRNA3 AND NOT-TAAR9 | 0.956521739 | 1 | 0.916666667 | NLGN3 AND NOT-DNAJC1 | 0.933333333 | 0.933333333 | 0.933333333 |
| CHRNA3 AND NOT-TAAR1 | 0.943396226 | 1 | 0.892857143 | NLGN3 AND NOT-ATL2 | 0.933333333 | 0.933333333 | 0.933333333 |
| CHRNA3 AND NOT-ADORA1 | 0.943396226 | 1 | 0.892857143 | NLGN3 AND NOT-MS4A6A | 0.933333333 | 0.933333333 | 0.933333333 |
| CHRNA3 AND NOT-RAET1E | 0.950617284 | 0.98717949 | 0.916666667 | NLGN3 AND NOT-SMIM5 | 0.933333333 | 0.933333333 | 0.933333333 |
| CHRNA3 AND NOT-DPCR1 | 0.950617284 | 0.98717949 | 0.916666667 | NLGN3 AND NOT-LMBR1 | 0.933333333 | 0.933333333 | 0.933333333 |
| CHRNA3 AND NOT-WBSCR28 | 0.950617284 | 0.98717949 | 0.916666667 | NLGN3 AND NOT-C1orf233 | 0.933333333 | 0.933333333 | 0.933333333 |
| CHRNA3 AND NOT-TMEM139 | 0.950617284 | 0.98717949 | 0.916666667 | NLGN3 AND NOT-MOSPD3 | 0.933333333 | 0.933333333 | 0.933333333 |
| CHRNA3 AND NOT-OR6B1 | 0.950617284 | 0.98717949 | 0.916666667 | NLGN3 AND NOT-SYNDIG1L | 0.965517241 | 1 | 0.933333333 |
| CHRNA3 AND NOT-OR2F2 | 0.950617284 | 0.98717949 | 0.916666667 | NLGN3 AND NOT-C16orf58 | 0.933333333 | 0.933333333 | 0.933333333 |
| CHRNA3 AND NOT-SSMEM1 | 0.956521739 | 1 | 0.916666667 | NLGN3 AND NOT-FNDC3B | 0.933333333 | 0.933333333 | 0.933333333 |
| CHRNA3 AND NOT-RNF183 | 0.950617284 | 0.98717949 | 0.916666667 | NLGN3 AND NOT-ST3GAL1 | 0.933333333 | 0.933333333 | 0.933333333 |
| CHRNA3 AND NOT-ADGRG4 | 0.950617284 | 0.98717949 | 0.916666667 | NLGN3 AND NOT-FNDC4 | 0.933333333 | 0.933333333 | 0.933333333 |
| CHRNA3 AND NOT-CRHR1 | 0.950617284 | 0.98717949 | 0.916666667 | NLGN3 AND NOT-PORCN | 0.933333333 | 0.933333333 | 0.933333333 |
| CHRNA3 AND NOT-CRHR2 | 0.950617284 | 0.98717949 | 0.916666667 | NLGN3 AND NOT-ST3GAL4 | 0.933333333 | 0.933333333 | 0.933333333 |
| CHRNA3 AND NOT-AADAC | 0.950617284 | 0.98717949 | 0.916666667 | NLGN3 AND NOT-TMEM135 | 0.933333333 | 0.933333333 | 0.933333333 |
| CHRNA3 AND NOT-ASB11 | 0.950617284 | 0.98717949 | 0.916666667 | NLGN3 AND NOT-SLC1A5 | 0.965517241 | 1 | 0.933333333 |
| CHRNA3 AND NOT-ASB5 | 0.950617284 | 0.98717949 | 0.916666667 | NLGN3 AND NOT-SLC4A1 | 0.965517241 | 1 | 0.933333333 |
| CHRNA3 AND NOT-TRPM6 | 0.950617284 | 0.98717949 | 0.916666667 | NLGN3 AND NOT-SLC6A2 | 0.933333333 | 0.933333333 | 0.933333333 |
| CHRNA3 AND NOT-C20orf173 | 0.950617284 | 0.98717949 | 0.916666667 | NLGN3 AND NOT-SLC12A2 | 0.933333333 | 0.933333333 | 0.933333333 |
| CHRNA3 AND NOT-CST11 | 0.950617284 | 0.98717949 | 0.916666667 | NLGN3 AND NOT-SLC16A2 | 0.933333333 | 0.933333333 | 0.933333333 |
| CHRNA3 AND NOT-SIRPA | 0.950617284 | 0.98717949 | 0.916666667 | NLGN3 AND NOT-SLCO2A1 | 0.933333333 | 0.933333333 | 0.933333333 |
| CHRNA3 AND NOT-CRY2 | 0.950617284 | 0.98717949 | 0.916666667 | NLGN3 AND NOT-SLC22A3 | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| CHRNA3 AND NOT-CSF1 | 0.950617284 | 0.98717949 | 0.916666667 | NLGN3 AND NOT-CYP4F12 | 0.965517241 | 1 | 0.933333333 |
| CHRNA3 AND NOT-TMEM86A | 0.950617284 | 0.98717949 | 0.916666667 | NLGN3 AND NOT-SMPD1 | 0.933333333 | 0.933333333 | 0.933333333 |
| CHRNA3 AND NOT-OR10A5 | 0.950617284 | 0.98717949 | 0.916666667 | NLGN3 AND NOT-SMPD2 | 0.933333333 | 0.933333333 | 0.933333333 |
| CHRNA3 AND NOT-ISM2 | 0.950617284 | 0.98717949 | 0.916666667 | NLGN3 AND NOT-SIGLEC1 | 0.933333333 | 0.933333333 | 0.933333333 |
| CHRNA3 AND NOT-TMCO5A | 0.956521739 | 1 | 0.916666667 | NLGN3 AND NOT-SOAT1 | 0.933333333 | 0.933333333 | 0.933333333 |
| CHRNA3 AND NOT-CMTM4 | 0.950617284 | 0.98717949 | 0.916666667 | NLGN3 AND NOT-SPAG4 | 0.933333333 | 0.933333333 | 0.933333333 |
| CHRNA3 AND NOT-GSG1L | 0.943396226 | 1 | 0.892857143 | NLGN3 AND NOT-SPG7 | 0.933333333 | 0.933333333 | 0.933333333 |
| CHRNA3 AND NOT-MGAT5B | 0.950617284 | 0.98717949 | 0.916666667 | NLGN3 AND NOT-SRD5A2 | 0.933333333 | 0.933333333 | 0.933333333 |
| CHRNA3 AND NOT-RBFOX3 | 0.950617284 | 0.98717949 | 0.916666667 | NLGN3 AND NOT-ST14 | 0.933333333 | 0.933333333 | 0.933333333 |
| CHRNA3 AND NOT-SLC47A2 | 0.950617284 | 0.98717949 | 0.916666667 | NLGN3 AND NOT-STX3 | 0.933333333 | 0.933333333 | 0.933333333 |
| CHRNA3 AND NOT-ADRA1D | 0.956521739 | 1 | 0.916666667 | NLGN3 AND NOT-STX4 | 0.933333333 | 0.933333333 | 0.933333333 |
| CHRNA3 AND NOT-C19orf18 | 0.950617284 | 0.98717949 | 0.916666667 | NLGN3 AND NOT-SURF4 | 0.933333333 | 0.933333333 | 0.933333333 |
| CHRNA3 AND NOT-TMEM190 | 0.950617284 | 0.98717949 | 0.916666667 | NLGN3 AND NOT-BST1 | 0.928571429 | 1 | 0.866666667 |
| CHRNA3 AND NOT-TMC4 | 0.956521739 | 1 | 0.916666667 | NLGN3 AND NOT-SYPL1 | 0.933333333 | 0.933333333 | 0.933333333 |
| CHRNA3 AND NOT-ZNRF4 | 0.950617284 | 0.98717949 | 0.916666667 | NLGN3 AND NOT-TCTA | 0.933333333 | 0.933333333 | 0.933333333 |
| CHRNA3 AND NOT-MFSD4 | 0.950617284 | 0.98717949 | 0.916666667 | NLGN3 AND NOT-TGFB3 | 0.933333333 | 0.933333333 | 0.933333333 |
| CHRNA3 AND NOT-DCST1 | 0.950617284 | 0.98717949 | 0.916666667 | NLGN3 AND NOT-TGFBR2 | 0.933333333 | 0.933333333 | 0.933333333 |
| CHRNA3 AND NOT-IL23R | 0.950617284 | 0.98717949 | 0.916666667 | NLGN3 AND NOT-TGFBR3 | 0.933333333 | 0.933333333 | 0.933333333 |
| CHRNA3 AND NOT-CTLA4 | 0.950617284 | 0.98717949 | 0.916666667 | NLGN3 AND NOT-THBD | 0.933333333 | 0.933333333 | 0.933333333 |
| CHRNA3 AND NOT-C1orf210 | 0.950617284 | 0.98717949 | 0.916666667 | NLGN3 AND NOT-TLR2 | 0.933333333 | 0.933333333 | 0.933333333 |
| CHRNA3 AND NOT-ADIG | 0.950617284 | 0.98717949 | 0.916666667 | NLGN3 AND NOT-TLR5 | 0.933333333 | 0.933333333 | 0.933333333 |
| CHRNA3 AND NOT-SLC9B1 | 0.950617284 | 0.98717949 | 0.916666667 | NLGN3 AND NOT-TSPAN8 | 0.933333333 | 0.933333333 | 0.933333333 |
| CHRNA3 AND NOT-PROM2 | 0.950617284 | 0.98717949 | 0.916666667 | NLGN3 AND NOT-TSPAN4 | 0.933333333 | 0.933333333 | 0.933333333 |
| CHRNA3 AND NOT-SLC23A3 | 0.950617284 | 0.98717949 | 0.916666667 | NLGN3 AND NOT-TM7SF2 | 0.933333333 | 0.933333333 | 0.933333333 |
| CHRNA3 AND NOT-RMDN2 | 0.950617284 | 0.98717949 | 0.916666667 | NLGN3 AND NOT-TNFRSF1B | 0.933333333 | 0.933333333 | 0.933333333 |
| CHRNA3 AND NOT-PPM1L | 0.950617284 | 0.98717949 | 0.916666667 | NLGN3 AND NOT-TPTE | 0.933333333 | 0.933333333 | 0.933333333 |
| CHRNA3 AND NOT-ADRA2B | 0.950617284 | 0.98717949 | 0.916666667 | NLGN3 AND NOT-TLCD2 | 0.933333333 | 0.933333333 | 0.933333333 |
| CHRNA3 AND NOT-C4orf26 | 0.950617284 | 0.98717949 | 0.916666667 | NLGN3 AND NOT-GXYLT2 | 0.933333333 | 0.933333333 | 0.933333333 |
| CHRNA3 AND NOT-SLC25A48 | 0.956521739 | 1 | 0.916666667 | NLGN3 AND NOT-C5AR1 | 0.933333333 | 0.933333333 | 0.933333333 |
| CHRNA3 AND NOT-MARVELD2 | 0.950617284 | 0.98717949 | 0.916666667 | NLGN3 AND NOT-UGT2B4 | 0.933333333 | 0.933333333 | 0.933333333 |
| CHRNA3 AND NOT-SLC2A12 | 0.956521739 | 1 | 0.916666667 | NLGN3 AND NOT-VRK2 | 0.933333333 | 0.933333333 | 0.933333333 |
| CHRNA3 AND NOT-NKAIN2 | 0.956521739 | 1 | 0.916666667 | NLGN3 AND NOT-WNT11 | 0.933333333 | 0.933333333 | 0.933333333 |
| CHRNA3 AND NOT-CLEC2L | 0.956521739 | 1 | 0.916666667 | NLGN3 AND NOT-CACNA1D | 0.933333333 | 0.933333333 | 0.933333333 |
| CHRNA3 AND NOT-CYP2A13 | 0.950617284 | 0.98717949 | 0.916666667 | NLGN3 AND NOT-SLC30A1 | 0.933333333 | 0.933333333 | 0.933333333 |
| CHRNA3 AND NOT-PEBP4 | 0.943396226 | 1 | 0.892857143 | NLGN3 AND NOT-BSND | 0.933333333 | 0.933333333 | 0.933333333 |
| CHRNA3 AND NOT-CYP4B1 | 0.950617284 | 0.98717949 | 0.916666667 | NLGN3 AND NOT-MOGS | 0.933333333 | 0.933333333 | 0.933333333 |
| CHRNA3 AND NOT-OR1Q1 | 0.956521739 | 1 | 0.916666667 | NLGN3 AND NOT-IL1R2 | 0.933333333 | 0.933333333 | 0.933333333 |
| CHRNA3 AND NOT-CYP19A1 | 0.95 | 1 | 0.904761905 | NLGN3 AND NOT-CXCR4 | 0.933333333 | 0.933333333 | 0.933333333 |
| CHRNA3 AND NOT-CCDC67 | 0.943396226 | 1 | 0.892857143 | NLGN3 AND NOT-FZD5 | 0.933333333 | 0.933333333 | 0.933333333 |
| CHRNA3 AND NOT-CLECL1 | 0.950617284 | 0.98717949 | 0.916666667 | NLGN3 AND NOT-SEMA3B | 0.933333333 | 0.933333333 | 0.933333333 |
| CHRNA3 AND NOT-SLC5A8 | 0.950617284 | 0.98717949 | 0.916666667 | NLGN3 AND NOT-SLMAP | 0.933333333 | 0.933333333 | 0.933333333 |
| CHRNA3 AND NOT-TMEM229B | 0.95 | 1 | 0.904761905 | NLGN3 AND NOT-SLC25A20 | 0.933333333 | 0.933333333 | 0.933333333 |
| CHRNA3 AND NOT-SYNE3 | 0.950617284 | 0.98717949 | 0.916666667 | NLGN3 AND NOT-TMEM106C | 0.933333333 | 0.933333333 | 0.933333333 |
| CHRNA3 AND NOT-MDGA2 | 0.950617284 | 0.98717949 | 0.916666667 | NLGN3 AND NOT-ALG8 | 0.933333333 | 0.933333333 | 0.933333333 |
| CHRNA3 AND NOT-MFSD6L | 0.950617284 | 0.98717949 | 0.916666667 | NLGN3 AND NOT-ELOVL6 | 0.933333333 | 0.933333333 | 0.933333333 |
| CHRNA3 AND NOT-TRPV3 | 0.950617284 | 0.98717949 | 0.916666667 | NLGN3 AND NOT-TMEM109 | 0.933333333 | 0.933333333 | 0.933333333 |
| CHRNA3 AND NOT-SPPL2C | 0.950617284 | 0.98717949 | 0.916666667 | NLGN3 AND NOT-ALG12 | 0.933333333 | 0.933333333 | 0.933333333 |
| CHRNA3 AND NOT-SYNE4 | 0.95 | 1 | 0.904761905 | NLGN3 AND NOT-TMUB2 | 0.933333333 | 0.933333333 | 0.933333333 |
| CHRNA3 AND NOT-DCT | 0.950617284 | 0.98717949 | 0.916666667 | NLGN3 AND NOT-MBOAT7 | 0.933333333 | 0.933333333 | 0.933333333 |
| CHRNA3 AND NOT-TMPRSS6 | 0.950617284 | 0.98717949 | 0.916666667 | NLGN3 AND NOT-MUL1 | 0.933333333 | 0.933333333 | 0.933333333 |
| CHRNA3 AND NOT-ADGRF3 | 0.950617284 | 0.98717949 | 0.916666667 | NLGN3 AND NOT-OCEL1 | 0.933333333 | 0.933333333 | 0.933333333 |
| CHRNA3 AND NOT-SPTSSB | 0.950617284 | 0.98717949 | 0.916666667 | NLGN3 AND NOT-SRD5A3 | 0.933333333 | 0.933333333 | 0.933333333 |
| CHRNA3 AND NOT-RNF133 | 0.950617284 | 0.98717949 | 0.916666667 | NLGN3 AND NOT-STEAP4 | 0.933333333 | 0.933333333 | 0.933333333 |
| CHRNA3 AND NOT-PKD1L1 | 0.950617284 | 0.98717949 | 0.916666667 | NLGN3 AND NOT-ACBD4 | 0.933333333 | 0.933333333 | 0.933333333 |
| CHRNA3 AND NOT-TMEM252 | 0.950617284 | 0.98717949 | 0.916666667 | NLGN3 AND NOT-ZDHHC11 | 0.933333333 | 0.933333333 | 0.933333333 |
| CHRNA3 AND NOT-CLEC4C | 0.950617284 | 0.98717949 | 0.916666667 | NLGN3 AND NOT-RNF122 | 0.933333333 | 0.933333333 | 0.933333333 |
| CHRNA3 AND NOT-HTR3C | 0.943396226 | 1 | 0.892857143 | NLGN3 AND NOT-THSD4 | 0.933333333 | 0.933333333 | 0.933333333 |
| CHRNA3 AND NOT-CLYBL | 0.950617284 | 0.98717949 | 0.916666667 | NLGN3 AND NOT-CYBRD1 | 0.933333333 | 0.933333333 | 0.933333333 |
| CHRNA3 AND NOT-DIO2 | 0.950617284 | 0.98717949 | 0.916666667 | NLGN3 AND NOT-KIAA0319L | 0.933333333 | 0.933333333 | 0.933333333 |
| CHRNA3 AND NOT-AGER | 0.950617284 | 0.98717949 | 0.916666667 | NLGN3 AND NOT-UBXN8 | 0.933333333 | 0.933333333 | 0.933333333 |
| CHRNA3 AND NOT-DRD1 | 0.950617284 | 0.98717949 | 0.916666667 | NLGN3 AND NOT-ERMP1 | 0.933333333 | 0.933333333 | 0.933333333 |
| CHRNA3 AND NOT-DRD3 | 0.950617284 | 0.98717949 | 0.916666667 | NLGN3 AND NOT-CPED1 | 0.933333333 | 0.933333333 | 0.933333333 |
| CHRNA3 AND NOT-DRD4 | 0.950617284 | 0.98717949 | 0.916666667 | NLGN3 AND NOT-ELOVL7 | 0.933333333 | 0.933333333 | 0.933333333 |
| CHRNA3 AND NOT-DRD5 | 0.950617284 | 0.98717949 | 0.916666667 | NLGN3 AND NOT-SLC8B1 | 0.933333333 | 0.933333333 | 0.933333333 |
| CHRNA3 AND NOT-DSC1 | 0.950617284 | 0.98717949 | 0.916666667 | NLGN3 AND NOT-LRRC8E | 0.933333333 | 0.933333333 | 0.933333333 |
| CHRNA3 AND NOT-DSCAM | 0.950617284 | 0.98717949 | 0.916666667 | NLGN3 AND NOT-CWH43 | 0.933333333 | 0.933333333 | 0.933333333 |
| CHRNA3 AND NOT-EFNB3 | 0.950617284 | 0.98717949 | 0.916666667 | NLGN3 AND NOT-MYCT1 | 0.928571429 | 1 | 0.866666667 |
| CHRNA3 AND NOT-EGF | 0.950617284 | 0.98717949 | 0.916666667 | NLGN3 AND NOT-TMEM134 | 0.933333333 | 0.933333333 | 0.933333333 |
| CHRNA3 AND NOT-MEGF8 | 0.95 | 1 | 0.904761905 | NLGN3 AND NOT-ALPK1 | 0.933333333 | 0.933333333 | 0.933333333 |
| CHRNA3 AND NOT-MEGF9 | 0.956521739 | 1 | 0.916666667 | NLGN3 AND NOT-PAAF1 | 0.933333333 | 0.933333333 | 0.933333333 |
| CHRNA3 AND NOT-EGFR | 0.956521739 | 1 | 0.916666667 | NLGN3 AND NOT-HSD3B7 | 0.933333333 | 0.933333333 | 0.933333333 |
| CHRNA3 AND NOT-GRAMD2 | 0.956521739 | 1 | 0.916666667 | NLGN3 AND NOT-SLC44A4 | 0.933333333 | 0.933333333 | 0.933333333 |
| CHRNA3 AND NOT-TMEM61 | 0.950617284 | 0.98717949 | 0.916666667 | NLGN3 AND NOT-CYB5B | 0.933333333 | 0.933333333 | 0.933333333 |
| CHRNA3 AND NOT-CYP4Z1 | 0.943396226 | 1 | 0.892857143 | NLGN3 AND NOT-SLC2A10 | 0.933333333 | 0.933333333 | 0.933333333 |
| CHRNA3 AND NOT-GABRR3 | 0.956521739 | 1 | 0.916666667 | NLGN3 AND NOT-OR2C3 | 0.933333333 | 0.933333333 | 0.933333333 |
| CHRNA3 AND NOT-TVP23C | 0.950617284 | 0.98717949 | 0.916666667 | NLGN3 AND NOT-PTDSS2 | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| CHRNA3 AND NOT-SPNS3 | 0.950617284 | 0.98717949 | 0.916666667 | NLGN3 AND NOT-SLCO5A1 | 0.933333333 | 0.933333333 | 0.933333333 |
| CHRNA3 AND NOT-ADAM32 | 0.950617284 | 0.98717949 | 0.916666667 | NLGN3 AND NOT-VANGL1 | 0.933333333 | 0.933333333 | 0.933333333 |
| CHRNA3 AND NOT-CT83 | 0.950617284 | 0.98717949 | 0.916666667 | NLGN3 AND NOT-TMEM187 | 0.933333333 | 0.933333333 | 0.933333333 |
| CHRNA3 AND NOT-TMEM31 | 0.950617284 | 0.98717949 | 0.916666667 | NLGN3 AND NOT-SLC10A3 | 0.933333333 | 0.933333333 | 0.933333333 |
| CHRNA3 AND NOT-EPHA1 | 0.950617284 | 0.98717949 | 0.916666667 | NLGN3 AND NOT-DYSF | 0.933333333 | 0.933333333 | 0.933333333 |
| CHRNA3 AND NOT-EPHA4 | 0.956521739 | 1 | 0.916666667 | NLGN3 AND NOT-FZD4 | 0.933333333 | 0.933333333 | 0.933333333 |
| CHRNA3 AND NOT-EPHA8 | 0.936708861 | 1 | 0.880952381 | NLGN3 AND NOT-FZD6 | 0.933333333 | 0.933333333 | 0.933333333 |
| CHRNA3 AND NOT-EPO | 0.950617284 | 0.98717949 | 0.916666667 | NLGN3 AND NOT-APH1B | 0.933333333 | 0.933333333 | 0.933333333 |
| CHRNA3 AND NOT-LVRN | 0.950617284 | 0.98717949 | 0.916666667 | NLGN3 AND NOT-GLT8D2 | 0.933333333 | 0.933333333 | 0.933333333 |
| CHRNA3 AND NOT-ETFDH | 0.950617284 | 0.98717949 | 0.916666667 | NLGN3 AND NOT-PLVAP | 0.933333333 | 0.933333333 | 0.933333333 |
| CHRNA3 AND NOT-EXTL3 | 0.956521739 | 1 | 0.916666667 | NLGN3 AND NOT-TMUB1 | 0.933333333 | 0.933333333 | 0.933333333 |
| CHRNA3 AND NOT-FAAH | 0.956521739 | 1 | 0.916666667 | NLGN3 AND NOT-CRISPLD2 | 0.933333333 | 0.933333333 | 0.933333333 |
| CHRNA3 AND NOT-TMEM26 | 0.95 | 1 | 0.904761905 | NLGN3 AND NOT-TMEM120A | 0.933333333 | 0.933333333 | 0.933333333 |
| CHRNA3 AND NOT-GJD4 | 0.950617284 | 0.98717949 | 0.916666667 | NLGN3 AND NOT-TSPAN10 | 0.965517241 | 1 | 0.933333333 |
| CHRNA3 AND NOT-MS4A15 | 0.950617284 | 0.98717949 | 0.916666667 | NLGN3 AND NOT-SPNS1 | 0.933333333 | 0.933333333 | 0.933333333 |
| CHRNA3 AND NOT-LRTOMT | 0.950617284 | 0.98717949 | 0.916666667 | NLGN3 AND NOT-ITFG3 | 0.933333333 | 0.933333333 | 0.933333333 |
| CHRNA3 AND NOT-FCAR | 0.950617284 | 0.98717949 | 0.916666667 | NLGN3 AND NOT-TMEM222 | 0.933333333 | 0.933333333 | 0.933333333 |
| CHRNA3 AND NOT-MS4A2 | 0.950617284 | 0.98717949 | 0.916666667 | NLGN3 AND NOT-SLC41A2 | 0.933333333 | 0.933333333 | 0.933333333 |
| CHRNA3 AND NOT-FCER2 | 0.950617284 | 0.98717949 | 0.916666667 | NLGN3 AND NOT-MFSD7 | 0.933333333 | 0.933333333 | 0.933333333 |
| CHRNA3 AND NOT-SLC39A12 | 0.936708861 | 1 | 0.880952381 | NLGN3 AND NOT-LRRC8C | 0.933333333 | 0.933333333 | 0.933333333 |
| CHRNA3 AND NOT-OPN5 | 0.950617284 | 0.98717949 | 0.916666667 | NLGN3 AND NOT-RHBDD1 | 0.933333333 | 0.933333333 | 0.933333333 |
| CHRNA3 AND NOT-PI16 | 0.950617284 | 0.98717949 | 0.916666667 | NLGN3 AND NOT-TMEM107 | 0.933333333 | 0.933333333 | 0.933333333 |
| CHRNA3 AND NOT-FCN2 | 0.950617284 | 0.98717949 | 0.916666667 | NLGN3 AND NOT-C2orf40 | 0.933333333 | 0.933333333 | 0.933333333 |
| CHRNA3 AND NOT-GPRC6A | 0.95 | 1 | 0.904761905 | NLGN3 AND NOT-JAGN1 | 0.933333333 | 0.933333333 | 0.933333333 |
| CHRNA3 AND NOT-ADGRF2 | 0.950617284 | 0.98717949 | 0.916666667 | NLGN3 AND NOT-TPST2 | 0.933333333 | 0.933333333 | 0.933333333 |
| CHRNA3 AND NOT-FGFR3 | 0.950617284 | 0.98717949 | 0.916666667 | NLGN3 AND NOT-MS4A14 | 0.933333333 | 0.933333333 | 0.933333333 |
| CHRNA3 AND NOT-FGFR2 | 0.950617284 | 0.98717949 | 0.916666667 | NLGN3 AND NOT-ABHD1 | 0.933333333 | 0.933333333 | 0.933333333 |
| CHRNA3 AND NOT-FGFR4 | 0.950617284 | 0.98717949 | 0.916666667 | NLGN3 AND NOT-PPAPDC3 | 0.933333333 | 0.933333333 | 0.933333333 |
| CHRNA3 AND NOT-LMTK2 | 0.950617284 | 0.98717949 | 0.916666667 | NLGN3 AND NOT-IL17RC | 0.933333333 | 0.933333333 | 0.933333333 |
| CHRNA3 AND NOT-ENPP4 | 0.950617284 | 0.98717949 | 0.916666667 | NLGN3 AND NOT-AIFM2 | 0.933333333 | 0.933333333 | 0.933333333 |
| CHRNA3 AND NOT-SORCS3 | 0.950617284 | 0.98717949 | 0.916666667 | NLGN3 AND NOT-ZDHHC12 | 0.933333333 | 0.933333333 | 0.933333333 |
| CHRNA3 AND NOT-SV2C | 0.950617284 | 0.98717949 | 0.916666667 | NLGN3 AND NOT-SPPL2A | 0.933333333 | 0.933333333 | 0.933333333 |
| CHRNA3 AND NOT-NFASC | 0.936708861 | 1 | 0.880952381 | NLGN3 AND NOT-FAM73B | 0.933333333 | 0.933333333 | 0.933333333 |
| CHRNA3 AND NOT-FLT3 | 0.95 | 1 | 0.904761905 | NLGN3 AND NOT-CIRH1A | 0.933333333 | 0.933333333 | 0.933333333 |
| CHRNA3 AND NOT-FLT4 | 0.950617284 | 0.98717949 | 0.916666667 | NLGN3 AND NOT-TMEM209 | 0.933333333 | 0.933333333 | 0.933333333 |
| CHRNA3 AND NOT-KIAA1024 | 0.950617284 | 0.98717949 | 0.916666667 | NLGN3 AND NOT-FIBCD1 | 0.933333333 | 0.933333333 | 0.933333333 |
| CHRNA3 AND NOT-FMO2 | 0.950617284 | 0.98717949 | 0.916666667 | NLGN3 AND NOT-RELT | 0.933333333 | 0.933333333 | 0.933333333 |
| CHRNA3 AND NOT-FMO4 | 0.943396226 | 1 | 0.892857143 | NLGN3 AND NOT-DISP1 | 0.933333333 | 0.933333333 | 0.933333333 |
| CHRNA3 AND NOT-ACSL6 | 0.950617284 | 0.98717949 | 0.916666667 | NLGN3 AND NOT-SLC43A1 | 0.933333333 | 0.933333333 | 0.933333333 |
| CHRNA3 AND NOT-SLC9A8 | 0.950617284 | 0.98717949 | 0.916666667 | NLGN3 AND NOT-ITGA8 | 0.933333333 | 0.933333333 | 0.933333333 |
| CHRNA3 AND NOT-FAM189A1 | 0.943396226 | 1 | 0.892857143 | NLGN3 AND NOT-APOL1 | 0.933333333 | 0.933333333 | 0.933333333 |
| CHRNA3 AND NOT-CRB1 | 0.950617284 | 0.98717949 | 0.916666667 | NLGN3 AND NOT-LY6D | 0.933333333 | 0.933333333 | 0.933333333 |
| CHRNA3 AND NOT-SLC7A8 | 0.936708861 | 1 | 0.880952381 | NLGN3 AND NOT-PPAP2A | 0.933333333 | 0.933333333 | 0.933333333 |
| CHRNA3 AND NOT-ATP1B4 | 0.950617284 | 0.98717949 | 0.916666667 | NLGN3 AND NOT-UNC5C | 0.933333333 | 0.933333333 | 0.933333333 |
| CHRNA3 AND NOT-SLC44A1 | 0.950617284 | 0.98717949 | 0.916666667 | NLGN3 AND NOT-AOC3 | 0.933333333 | 0.933333333 | 0.933333333 |
| CHRNA3 AND NOT-ABCB9 | 0.950617284 | 0.98717949 | 0.916666667 | NLGN3 AND NOT-KCNK5 | 0.933333333 | 0.933333333 | 0.933333333 |
| CHRNA3 AND NOT-NPTXR | 0.95 | 1 | 0.904761905 | NLGN3 AND NOT-DGAT1 | 0.933333333 | 0.933333333 | 0.933333333 |
| CHRNA3 AND NOT-FOLH1 | 0.950617284 | 0.98717949 | 0.916666667 | NLGN3 AND NOT-B3GALT4 | 0.933333333 | 0.933333333 | 0.933333333 |
| CHRNA3 AND NOT-SYNGR4 | 0.950617284 | 0.98717949 | 0.916666667 | NLGN3 AND NOT-ABCC3 | 0.933333333 | 0.933333333 | 0.933333333 |
| CHRNA3 AND NOT-HYAL4 | 0.95 | 1 | 0.904761905 | NLGN3 AND NOT-TNFRSF25 | 0.933333333 | 0.933333333 | 0.933333333 |
| CHRNA3 AND NOT-FPR2 | 0.950617284 | 0.98717949 | 0.916666667 | NLGN3 AND NOT-TNFSF9 | 0.965517241 | 1 | 0.933333333 |
| CHRNA3 AND NOT-FLRT2 | 0.950617284 | 0.98717949 | 0.916666667 | NLGN3 AND NOT-TNFRSF14 | 0.933333333 | 0.933333333 | 0.933333333 |
| CHRNA3 AND NOT-MS4A6E | 0.950617284 | 0.98717949 | 0.916666667 | NLGN3 AND NOT-TNFRSF10B | 0.933333333 | 0.933333333 | 0.933333333 |
| CHRNA3 AND NOT-IL27 | 0.950617284 | 0.98717949 | 0.916666667 | NLGN3 AND NOT-CREG1 | 0.933333333 | 0.933333333 | 0.933333333 |
| CHRNA3 AND NOT-FUT2 | 0.950617284 | 0.98717949 | 0.916666667 | NLGN3 AND NOT-DPM2 | 0.933333333 | 0.933333333 | 0.933333333 |
| CHRNA3 AND NOT-FUT3 | 0.950617284 | 0.98717949 | 0.916666667 | NLGN3 AND NOT-NRP2 | 0.933333333 | 0.933333333 | 0.933333333 |
| CHRNA3 AND NOT-FUT7 | 0.936708861 | 1 | 0.880952381 | NLGN3 AND NOT-NRP1 | 0.933333333 | 0.933333333 | 0.933333333 |
| CHRNA3 AND NOT-TECRL | 0.956521739 | 1 | 0.916666667 | NLGN3 AND NOT-CD84 | 0.933333333 | 0.933333333 | 0.933333333 |
| CHRNA3 AND NOT-NAALADL2 | 0.950617284 | 0.98717949 | 0.916666667 | NLGN3 AND NOT-ST3GAL5 | 0.933333333 | 0.933333333 | 0.933333333 |
| CHRNA3 AND NOT-ZDHHC23 | 0.950617284 | 0.98717949 | 0.916666667 | NLGN3 AND NOT-SLC5A6 | 0.933333333 | 0.933333333 | 0.933333333 |
| CHRNA3 AND NOT-CALHM1 | 0.950617284 | 0.98717949 | 0.916666667 | NLGN3 AND NOT-SGCE | 0.933333333 | 0.933333333 | 0.933333333 |
| CHRNA3 AND NOT-C19orf26 | 0.950617284 | 0.98717949 | 0.916666667 | NLGN3 AND NOT-CACNA1H | 0.933333333 | 0.933333333 | 0.933333333 |
| CHRNA3 AND NOT-CCDC108 | 0.950617284 | 0.98717949 | 0.916666667 | NLGN3 AND NOT-P4HA2 | 0.933333333 | 0.933333333 | 0.933333333 |
| CHRNA3 AND NOT-MCOLN2 | 0.950617284 | 0.98717949 | 0.916666667 | NLGN3 AND NOT-ABCC10 | 0.933333333 | 0.933333333 | 0.933333333 |
| CHRNA3 AND NOT-MYADML2 | 0.950617284 | 0.98717949 | 0.916666667 | NLGN3 AND NOT-RHOT2 | 0.933333333 | 0.933333333 | 0.933333333 |
| CHRNA3 AND NOT-RNF144B | 0.950617284 | 0.98717949 | 0.916666667 | NLGN3 AND NOT-PHLDB2 | 0.933333333 | 0.933333333 | 0.933333333 |
| CHRNA3 AND NOT-GABRA1 | 0.950617284 | 0.98717949 | 0.916666667 | NLGN3 AND NOT-TSPAN18 | 0.933333333 | 0.933333333 | 0.933333333 |
| CHRNA3 AND NOT-GABRA2 | 0.950617284 | 0.98717949 | 0.916666667 | NLGN3 AND NOT-PKD2L1 | 0.933333333 | 0.933333333 | 0.933333333 |
| CHRNA3 AND NOT-GABRA4 | 0.950617284 | 0.98717949 | 0.916666667 | NLGN3 AND NOT-TMEM41A | 0.933333333 | 0.933333333 | 0.933333333 |
| CHRNA3 AND NOT-GABRB2 | 0.943396226 | 1 | 0.892857143 | NLGN3 AND NOT-GPRC5A | 0.933333333 | 0.933333333 | 0.933333333 |
| CHRNA3 AND NOT-GABRD | 0.95 | 1 | 0.904761905 | NLGN3 AND NOT-SLC7A7 | 0.933333333 | 0.933333333 | 0.933333333 |
| CHRNA3 AND NOT-GABRG3 | 0.950617284 | 0.98717949 | 0.916666667 | NLGN3 AND NOT-CLDN12 | 0.933333333 | 0.933333333 | 0.933333333 |
| CHRNA3 AND NOT-GABRR2 | 0.950617284 | 0.98717949 | 0.916666667 | NLGN3 AND NOT-CLDN8 | 0.933333333 | 0.933333333 | 0.933333333 |
| CHRNA3 AND NOT-SLC24A2 | 0.936708861 | 1 | 0.880952381 | NLGN3 AND NOT-CLDN1 | 0.933333333 | 0.933333333 | 0.933333333 |
| CHRNA3 AND NOT-KLK5 | 0.950617284 | 0.98717949 | 0.916666667 | NLGN3 AND NOT-TMEM55B | 0.933333333 | 0.933333333 | 0.933333333 |
| CHRNA3 AND NOT-TPSG1 | 0.950617284 | 0.98717949 | 0.916666667 | NLGN3 AND NOT-LMF2 | 0.933333333 | 0.933333333 | 0.933333333 |

FIG. 1 (CONT.)

| Antigen Pair Logic | F1 | Precision | Recall | Antigen Pair Logic | F1 | Precision | Recall |
|---|---|---|---|---|---|---|---|
| CHRNA3 AND NOT-METTL7A | 0.950617284 | 0.98717949 | 0.916666667 | NLGN3 AND NOT-AIFM1 | 0.933333333 | 0.933333333 | 0.933333333 |
| CHRNA3 AND NOT-SGMS1 | 0.950617284 | 0.98717949 | 0.916666667 | NLGN3 AND NOT-SYNGR2 | 0.933333333 | 0.933333333 | 0.933333333 |
| CHRNA3 AND NOT-WFDC11 | 0.950617284 | 0.98717949 | 0.916666667 | NLGN3 AND NOT-PKDCC | 0.933333333 | 0.933333333 | 0.933333333 |
| CHRNA3 AND NOT-WFDC9 | 0.950617284 | 0.98717949 | 0.916666667 | NLGN3 AND NOT-RFT1 | 0.933333333 | 0.933333333 | 0.933333333 |
| CHRNA3 AND NOT-TAS2R39 | 0.950617284 | 0.98717949 | 0.916666667 | NLGN3 AND NOT-SLC16A7 | 0.933333333 | 0.933333333 | 0.933333333 |
| CHRNA3 AND NOT-TAS2R40 | 0.950617284 | 0.98717949 | 0.916666667 | NLGN3 AND NOT-SLC33A1 | 0.933333333 | 0.933333333 | 0.933333333 |
| CHRNA3 AND NOT-TAS2R41 | 0.956521739 | 1 | 0.916666667 | NLGN3 AND NOT-CD4 | 0.933333333 | 0.933333333 | 0.933333333 |
| CHRNA3 AND NOT-FAM205A | 0.956521739 | 1 | 0.916666667 | NLGN3 AND NOT-MTDH | 0.933333333 | 0.933333333 | 0.933333333 |
| CHRNA3 AND NOT-PNKD | 0.950617284 | 0.98717949 | 0.916666667 | NLGN3 AND NOT-TMEM88 | 0.933333333 | 0.933333333 | 0.933333333 |
| CHRNA3 AND NOT-LRIG1 | 0.950617284 | 0.98717949 | 0.916666667 | NLGN3 AND NOT-DAPL1 | 0.933333333 | 0.933333333 | 0.933333333 |
| CHRNA3 AND NOT-CYP4X1 | 0.950617284 | 0.98717949 | 0.916666667 | NLGN3 AND NOT-CCPG1 | 0.933333333 | 0.933333333 | 0.933333333 |
| CHRNA3 AND NOT-CFAP61 | 0.950617284 | 0.98717949 | 0.916666667 | NLGN3 AND NOT-DHRS3 | 0.933333333 | 0.933333333 | 0.933333333 |
| CHRNA3 AND NOT-OR1C1 | 0.950617284 | 0.98717949 | 0.916666667 | NLGN3 AND NOT-CD8B | 0.933333333 | 0.933333333 | 0.933333333 |
| CHRNA3 AND NOT-OR2F1 | 0.95 | 1 | 0.904761905 | NLGN3 AND NOT-TAAR2 | 0.933333333 | 0.933333333 | 0.933333333 |
| CHRNA3 AND NOT-OR1J4 | 0.95 | 1 | 0.904761905 | NLGN3 AND NOT-ORAI3 | 0.933333333 | 0.933333333 | 0.933333333 |
| CHRNA3 AND NOT-OR2M4 | 0.950617284 | 0.98717949 | 0.916666667 | NLGN3 AND NOT-GTF3C3 | 0.933333333 | 0.933333333 | 0.933333333 |
| CHRNA3 AND NOT-OR2L2 | 0.950617284 | 0.98717949 | 0.916666667 | NLGN3 AND NOT-CD163 | 0.933333333 | 0.933333333 | 0.933333333 |
| CHRNA3 AND NOT-OR2K2 | 0.936708861 | 1 | 0.880952381 | NLGN3 AND NOT-MMGT1 | 0.933333333 | 0.933333333 | 0.933333333 |
| CHRNA3 AND NOT-SLC13A4 | 0.950617284 | 0.98717949 | 0.916666667 | NLGN3 AND NOT-TAOK2 | 0.933333333 | 0.933333333 | 0.933333333 |
| CHRNA3 AND NOT-IL1RAPL2 | 0.956521739 | 1 | 0.916666667 | NLGN3 AND NOT-ECEL1 | 0.933333333 | 0.933333333 | 0.933333333 |
| CHRNA3 AND NOT-OR7A17 | 0.950617284 | 0.98717949 | 0.916666667 | NLGN3 AND NOT-SIGLEC6 | 0.933333333 | 0.933333333 | 0.933333333 |
| CHRNA3 AND NOT-OR5K1 | 0.950617284 | 0.98717949 | 0.916666667 | NLGN3 AND NOT-CD34 | 0.933333333 | 0.933333333 | 0.933333333 |
| CHRNA3 AND NOT-OR8G1 | 0.950617284 | 0.98717949 | 0.916666667 | NLGN3 AND NOT-STX8 | 0.933333333 | 0.933333333 | 0.933333333 |
| CHRNA3 AND NOT-OR10A3 | 0.950617284 | 0.98717949 | 0.916666667 | NLGN3 AND NOT-CD36 | 0.933333333 | 0.933333333 | 0.933333333 |
| CHRNA3 AND NOT-TSPAN16 | 0.950617284 | 0.98717949 | 0.916666667 | NLGN3 AND NOT-SCARB1 | 0.933333333 | 0.933333333 | 0.933333333 |
| CHRNA3 AND NOT-OR12D2 | 0.950617284 | 0.98717949 | 0.916666667 | NLGN3 AND NOT-ACVRL1 | 0.933333333 | 0.933333333 | 0.933333333 |
| CHRNA3 AND NOT-OR10H3 | 0.956521739 | 1 | 0.916666667 | NLGN3 AND NOT-ADAMTS1 | 0.933333333 | 0.933333333 | 0.933333333 |
| CHRNA3 AND NOT-OR10H2 | 0.950617284 | 0.98717949 | 0.916666667 | NLGN3 AND NOT-SPTLC2 | 0.933333333 | 0.933333333 | 0.933333333 |
| CHRNA3 AND NOT-OR8B2 | 0.950617284 | 0.98717949 | 0.916666667 | NLGN3 AND NOT-MPDU1 | 0.933333333 | 0.933333333 | 0.933333333 |
| CHRNA3 AND NOT-AMELX | 0.950617284 | 0.98717949 | 0.916666667 | NLGN3 AND NOT-C14orf2 | 0.933333333 | 0.933333333 | 0.933333333 |
| CHRNA3 AND NOT-GDF9 | 0.950617284 | 0.98717949 | 0.916666667 | NLGN3 AND NOT-ENTPD6 | 0.933333333 | 0.933333333 | 0.933333333 |
| CHRNA3 AND NOT-BEST4 | 0.950617284 | 0.98717949 | 0.916666667 | NLGN3 AND NOT-ENTPD5 | 0.933333333 | 0.933333333 | 0.933333333 |
| CHRNA3 AND NOT-HS6ST3 | 0.950617284 | 0.98717949 | 0.916666667 | NLGN3 AND NOT-NFE2L3 | 0.933333333 | 0.933333333 | 0.933333333 |
| CHRNA3 AND NOT-OR4D1 | 0.943396226 | 1 | 0.892857143 | NLGN3 AND NOT-ABCG1 | 0.933333333 | 0.933333333 | 0.933333333 |
| CHRNA3 AND NOT-GDNF | 0.950617284 | 0.98717949 | 0.916666667 | NLGN3 AND NOT-KIAA0040 | 0.933333333 | 0.933333333 | 0.933333333 |
| CHRNA3 AND NOT-OR2W1 | 0.950617284 | 0.98717949 | 0.916666667 | NLGN3 AND NOT-EDEM1 | 0.933333333 | 0.933333333 | 0.933333333 |
| CHRNA3 AND NOT-ADGRF1 | 0.950617284 | 0.98717949 | 0.916666667 | NLGN3 AND NOT-CD69 | 0.933333333 | 0.933333333 | 0.933333333 |
| CHRNA3 AND NOT-OR2H1 | 0.950617284 | 0.98717949 | 0.916666667 | NLGN3 AND NOT-CD72 | 0.933333333 | 0.933333333 | 0.933333333 |
| CHRNA3 AND NOT-OR1J2 | 0.936708861 | 1 | 0.880952381 | NLGN3 AND NOT-MLEC | 0.933333333 | 0.933333333 | 0.933333333 |
| CHRNA3 AND NOT-B4GALT1 | 0.950617284 | 0.98717949 | 0.916666667 | NLGN3 AND NOT-ADGRE5 | 0.933333333 | 0.933333333 | 0.933333333 |
| CHRNA3 AND NOT-GHRHR | 0.950617284 | 0.98717949 | 0.916666667 | NLGN3 AND NOT-PIEZO1 | 0.933333333 | 0.933333333 | 0.933333333 |
| CHRNA3 AND NOT-GHSR | 0.950617284 | 0.98717949 | 0.916666667 | NLGN3 AND NOT-RNF144A | 0.933333333 | 0.933333333 | 0.933333333 |
| CHRNA3 AND NOT-GJA3 | 0.950617284 | 0.98717949 | 0.916666667 | NLGN3 AND NOT-HEPH | 0.933333333 | 0.933333333 | 0.933333333 |
| CHRNA3 AND NOT-KCNV1 | 0.950617284 | 0.98717949 | 0.916666667 | NLGN3 AND NOT-TOMM70A | 0.933333333 | 0.933333333 | 0.933333333 |
| CHRNA3 AND NOT-PKD2L2 | 0.950617284 | 0.98717949 | 0.916666667 | NLGN3 AND NOT-FIG4 | 0.933333333 | 0.933333333 | 0.933333333 |
| CHRNA3 AND NOT-GJA8 | 0.950617284 | 0.98717949 | 0.916666667 | NLGN3 AND NOT-GOLGA5 | 0.933333333 | 0.933333333 | 0.933333333 |
| CHRNA3 AND NOT-GJB3 | 0.950617284 | 0.98717949 | 0.916666667 | NLGN3 AND NOT-SLC23A2 | 0.933333333 | 0.933333333 | 0.933333333 |
| CHRNA3 AND NOT-CACNG5 | 0.943396226 | 1 | 0.892857143 | NLGN3 AND NOT-TNFSF15 | 0.933333333 | 0.933333333 | 0.933333333 |
| CHRNA3 AND NOT-GJB5 | 0.950617284 | 0.98717949 | 0.916666667 | NLGN3 AND NOT-CLEC2B | 0.933333333 | 0.933333333 | 0.933333333 |
| CHRNA3 AND NOT-SIGLEC9 | 0.950617284 | 0.98717949 | 0.916666667 | SLC1A2 AND NAT10 | 0.909090909 | 0.833333333 | 1 |
| CHRNA3 AND NOT-SIGLEC8 | 0.950617284 | 0.98717949 | 0.916666667 | SLC1A2 AND DOLPP1 | 0.909090909 | 0.833333333 | 1 |
| CHRNA3 AND NOT-OXGR1 | 0.950617284 | 0.98717949 | 0.916666667 | GDAP1L1 AND DOLPP1 | 0.909090909 | 0.833333333 | 1 |
| CHRNA3 AND NOT-GPR78 | 0.950617284 | 0.98717949 | 0.916666667 | SLC4A4 AND NOT-SCNN1A | 0.928571429 | 1 | 0.866666667 |
| CHRNA3 AND NOT-C5AR2 | 0.950617284 | 0.98717949 | 0.916666667 | GDAP1L1 AND MS4A6A | 0.909090909 | 0.833333333 | 1 |
| CHRNA3 AND NOT-BMP10 | 0.950617284 | 0.98717949 | 0.916666667 | SLC1A2 AND MPPE1 | 0.909090909 | 0.833333333 | 1 |
| CHRNA3 AND NOT-PCDH11X | 0.943396226 | 1 | 0.892857143 | SLC1A2 AND SOAT1 | 0.909090909 | 0.833333333 | 1 |
| CHRNA3 AND NOT-GLP1R | 0.95 | 1 | 0.904761905 | SLC1A2 AND JAGN1 | 0.909090909 | 0.833333333 | 1 |
| CHRNA3 AND NOT-GLRA1 | 0.950617284 | 0.98717949 | 0.916666667 | SLC1A2 AND GPAA1 | 0.909090909 | 0.833333333 | 1 |
| CHRNA3 AND NOT-GNRHR | 0.950617284 | 0.98717949 | 0.916666667 | GDAP1L1 AND SLC22A4 | 0.909090909 | 0.833333333 | 1 |
| | | | | SLC4A4 AND NOT-SPINT1 | 0.928571429 | 1 | 0.866666667 |
| | | | | SLC4A4 AND NOT-TMPRSS2 | 0.928571429 | 1 | 0.866666667 |
| | | | | SLC4A4 AND NOT-P4HA2 | 0.928571429 | 1 | 0.866666667 |

(Continued at top)

FIG. 2

| Antigen | GeneID | Accession No. | SEQ ID NO: | RefSeq Gene Name |
|---|---|---|---|---|
| 100132596? | 100132596 | NR_003254.1 | 7098 | XGY2 Xg pseudogene, Y-linked 2 |
| 100505984? | 100505984 | NR_103775.1 | 7103 | uncharacterized LOC10050598 |
| 100507547? | 100507547 | NR_037169.1 | 7099 | Homo sapiens uncharacterized LOC100507547 (LOC100507547), transcript variant 1, long non-coding RNA |
| 101805491? | 101805491 | NR_103805.1 | 7110 | uncharacterized LOC101805491 |
| 339166? | 339166 | NR_040000 | 7114 | uncharacterized LOC339166 |
| 63914? | 63914 | NR_026784 | 7115 | long intergenic non-protein coding RNA 1590 |
| A4GALT | 53947 | NP_059132 | 4291 | alpha 1,4-galactosyltransferase |
| A4GNT | 51146 | NP_057245 | 4179 | alpha-1,4-N-acetylglucosaminyltransferase |
| AADAC | 13 | NP_001077 | 1067 | arylacetamide deacetylase (esterase) |
| AASDH | 132949 | NP_861522 | 6638 | aminoadipate-semialdehyde dehydrogenase |
| ABCA1 | 19 | NP_005493 | 3298 | ATP-binding cassette, sub-family A (ABC1), member 1 |
| ABCA12 | 26154 | NP_056472 | 4109 | ATP-binding cassette, sub-family A (ABC1), member 12 |
| ABCA12 | 26154 | NP_775099 | 6332 | ATP-binding cassette, sub-family A (ABC1), member 12 |
| ABCA13 | 154664 | NP_689914 | 6102 | ATP-binding cassette, sub-family A (ABC1), member 13 |
| ABCA2 | 20 | NP_001597 | 2417 | ATP-binding cassette, sub-family A (ABC1), member 2 |
| ABCA2 | 20 | NP_997698 | 7034 | ATP-binding cassette, sub-family A (ABC1), member 2 |
| ABCA3 | 21 | NP_001080 | 1098 | ATP-binding cassette, sub-family A (ABC1), member 3 |
| ABCA4 | 24 | NP_000341 | 104 | ATP-binding cassette, sub-family A (ABC1), member 4 |
| ABCA5 | 23461 | NP_061142 | 4483 | ATP-binding cassette, sub-family A (ABC1), member 5 |
| ABCA5 | 23461 | NP_758424 | 6299 | ATP-binding cassette, sub-family A (ABC1), member 5 |
| ABCA6 | 23460 | NP_525023 | 5599 | ATP-binding cassette, sub-family A (ABC1), member 6 |
| ABCA7 | 10347 | NP_061985 | 4567 | ATP-binding cassette, sub-family A (ABC1), member 7 |
| ABCA8 | 10351 | NP_009099 | 3640 | ATP-binding cassette, sub-family A (ABC1), member 8 |
| ABCA9 | 10350 | NP_525022 | 5598 | ATP-binding cassette, sub-family A (ABC1), member 9 |
| ABCB1 | 5243 | NP_000918 | 331 | ATP-binding cassette, sub-family B (MDR/TAP), member 1 |
| ABCB10 | 23456 | NP_036221 | 3701 | ATP-binding cassette, sub-family B (MDR/TAP), member 10 |
| ABCB11 | 8647 | NP_003733 | 2884 | ATP-binding cassette, sub-family B (MDR/TAP), member 11 |
| ABCB4 | 5244 | NP_000434 | 129 | ATP-binding cassette, sub-family B (MDR/TAP), member 4 |
| ABCB4 | 5244 | NP_061337 | 4494 | ATP-binding cassette, sub-family B (MDR/TAP), member 4 |
| ABCB4 | 5244 | NP_061338 | 4495 | ATP-binding cassette, sub-family B (MDR/TAP), member 4 |
| ABCB5 | 340273 | NP_001157413.1 | 7412 | ATP binding cassette subfamily B member 5 |
| ABCB6 | 10058 | NP_005680 | 3344 | ATP-binding cassette, sub-family B (MDR/TAP), member 6 |
| ABCB7 | 22 | NP_004290 | 3010 | ATP-binding cassette, sub-family B (MDR/TAP), member 7 |
| ABCB8 | 11194 | NP_009119 | 3645 | ATP-binding cassette, sub-family B (MDR/TAP), member 8 |
| ABCB9 | 23457 | NP_062570 | 4578 | ATP-binding cassette, sub-family B (MDR/TAP), member 9 |
| ABCB9 | 23457 | NP_062571 | 4579 | ATP-binding cassette, sub-family B (MDR/TAP), member 9 |
| ABCB9 | 23457 | NP_982269 | 6936 | ATP-binding cassette, sub-family B (MDR/TAP), member 9 |
| ABCC1 | 4363 | NP_004987 | 3193 | ATP-binding cassette, sub-family C (CFTR/MRP), member 1 |
| ABCC1 | 4363 | NP_004987.2 | 4589 | ATP-binding cassette, sub-family C (CFTR/MRP), member 1 |
| ABCC1 | 4363 | NP_004987.2 | 4594 | ATP-binding cassette, sub-family C (CFTR/MRP), member 1 |
| ABCC1 | 4363 | NP_004987.2 | 4595 | ATP-binding cassette, sub-family C (CFTR/MRP), member 1 |
| ABCC1 | 4363 | NP_004987.2 | 4596 | ATP-binding cassette, sub-family C (CFTR/MRP), member 1 |
| ABCC10 | 89845 | NP_258261 | 5499 | ATP-binding cassette, sub-family C (CFTR/MRP), member 10 |
| ABCC11 | 85320 | NP_115972 | 5374 | ATP-binding cassette, sub-family C (CFTR/MRP), member 11 |
| ABCC11 | 85320 | NP_149163 | 5453 | ATP-binding cassette, sub-family C (CFTR/MRP), member 11 |
| ABCC11 | 85320 | NP_660187 | 5934 | ATP-binding cassette, sub-family C (CFTR/MRP), member 11 |
| ABCC12 | 94160 | NP_150229 | 5473 | ATP-binding cassette, sub-family C (CFTR/MRP), member 12 |
| ABCC2 | 1244 | NP_000383 | 117 | ATP-binding cassette, sub-family C (CFTR/MRP), member 2 |
| ABCC3 | 8714 | NP_001137542 | 1768 | ATP-binding cassette, sub-family C (CFTR/MRP), member 3 |
| ABCC3 | 8714 | NP_003777 | 2895 | ATP-binding cassette, sub-family C (CFTR/MRP), member 3 |
| ABCC4 | 10257 | NP_001098985 | 1223 | ATP-binding cassette, sub-family C (CFTR/MRP), member 4 |
| ABCC4 | 10257 | NP_005836 | 3382 | ATP-binding cassette, sub-family C (CFTR/MRP), member 4 |
| ABCC5 | 10057 | NP_001018881 | 675 | ATP-binding cassette, sub-family C (CFTR/MRP), member 5 |
| ABCC5 | 10057 | NP_005679 | 3343 | ATP-binding cassette, sub-family C (CFTR/MRP), member 5 |
| ABCC6 | 368 | NP_001072996 | 987 | ATP-binding cassette, sub-family C, member 6 pseudogene 2 |
| ABCC6 | 368 | NP_001162 | 2233 | ATP-binding cassette, sub-family C, member 6 pseudogene 2 |
| ABCC8 | 6833 | NP_000343 | 106 | ATP-binding cassette, sub-family C (CFTR/MRP), member 8 |
| ABCC9 | 10060 | NP_005682 | 3345 | ATP-binding cassette, sub-family C (CFTR/MRP), member 9 |
| ABCC9 | 10060 | NP_064693 | 4624 | ATP-binding cassette, sub-family C (CFTR/MRP), member 9 |
| ABCC9 | 10060 | NP_005682.2 | 4625 | ATP-binding cassette, sub-family C (CFTR/MRP), member 9 |
| ABCD4 | 5826 | NP_005041 | 3202 | ATP-binding cassette, sub-family D (ALD), member 4 |
| ABCG1 | 9619 | NP_004906 | 3166 | ATP-binding cassette, sub-family G (WHITE), member 1 |
| ABCG1 | 9619 | NP_058198 | 4272 | ATP-binding cassette, sub-family G (WHITE), member 1 |
| ABCG1 | 9619 | NP_997057 | 7001 | ATP-binding cassette, sub-family G (WHITE), member 1 |
| ABCG1 | 9619 | NP_997510 | 7029 | ATP-binding cassette, sub-family G (WHITE), member 1 |
| ABCG1 | 9619 | NP_997511 | 7030 | ATP-binding cassette, sub-family G (WHITE), member 1 |
| ABCG1 | 9619 | NP_997512 | 7031 | ATP-binding cassette, sub-family G (WHITE), member 1 |
| ABCG2 | 9429 | NP_004818 | 3142 | ATP-binding cassette, sub-family G (WHITE), member 2 |
| ABCG4 | 64137 | NP_001135977 | 1668 | ATP-binding cassette, sub-family G (WHITE), member 4 |
| ABCG4 | 64137 | NP_071452 | 4893 | ATP-binding cassette, sub-family G (WHITE), member 4 |
| ABCG5 | 64240 | NP_071881.1 | 7296 | ATP binding cassette subfamily G member 5 |
| ABCG8 | 64241 | NP_071882 | 4913 | ATP-binding cassette, sub-family G (WHITE), member 8 |
| ABHD1 | 84696 | NP_115993 | 5378 | abhydrolase domain containing 1 |
| ABHD12 | 26090 | NP_001035937 | 892 | abhydrolase domain containing 12 |
| ABHD12 | 26090 | NP_056415 | 4105 | abhydrolase domain containing 12 |
| ABHD13 | 84945 | NP_116248 | 5418 | abhydrolase domain containing 13 |
| ABHD14A | 25864 | NP_056222 | 4077 | abhydrolase domain containing 14A |
| ABHD15 | 116236 | NP_937790 | 6744 | abhydrolase domain containing 15 |

FIG. 2 (CONT.)

| Antigen | GeneID | Accession No. | SEQ ID NO: | RefSeq Gene Name |
|---|---|---|---|---|
| ABHD16A | 7920 | NP_066983 | 4783 | HLA-B associated transcript 5 |
| ABHD3 | 171586 | NP_612213 | 5730 | abhydrolase domain containing 3 |
| ABHD6 | 57406 | NP_065727 | 4696 | abhydrolase domain containing 6 |
| ABI3BP | 25890 | NP_056244 | 4081 | ABI family, member 3 (NESH) binding protein |
| ABO | 28 | NP_065202 | 4666 | ABO blood group (transferase A, alpha 1-3-N-acetylgalactosaminyltransferase transferase B, alpha 1-3-galactosyltransferase) |
| ACACB | 32 | NP_001084 | 1099 | acetyl-Coenzyme A carboxylase beta |
| ACBD4 | 79777 | NP_001129177.1 | 1556 | acyl-Coenzyme A binding domain containing 4 |
| ACBD4 | 79777 | NP_001129177 | 1557 | acyl-Coenzyme A binding domain containing 4 |
| ACBD4 | 79777 | NP_001129178 | 1558 | acyl-Coenzyme A binding domain containing 4 |
| ACBD4 | 79777 | NP_001129179 | 1559 | acyl-Coenzyme A binding domain containing 4 |
| ACBD4 | 79777 | NP_078998 | 5071 | acyl-Coenzyme A binding domain containing 4 |
| ACBD5 | 91452 | NP_001035938 | 893 | acyl-Coenzyme A binding domain containing 5 |
| ACBD5 | 91452 | NP_663736 | 5971 | acyl-Coenzyme A binding domain containing 5 |
| ACE | 1636 | NP_000780 | 249 | angiotensin I converting enzyme (peptidyl-dipeptidase A) 1 |
| ACE | 1636 | NP_690043 | 6116 | angiotensin I converting enzyme (peptidyl-dipeptidase A) 1 |
| ACE2 | 59272 | NP_068576 | 4831 | angiotensin I converting enzyme (peptidyl-dipeptidase A) 2 |
| ACER1 | 125981 | NP_597999 | 5696 | alkaline ceramidase 1 |
| ACER3 | 55331 | NP_060837 | 4430 | alkaline ceramidase 3 |
| ACHE | 43 | NP_000656 | 189 | acetylcholinesterase (Yt blood group) |
| ACHE | 43 | NP_056646 | 4121 | acetylcholinesterase (Yt blood group) |
| ACKR1 | 2532 | NP_001116423 | 1293 | Duffy blood group, chemokine receptor |
| ACKR1 | 2532 | NP_002027 | 2537 | Duffy blood group, chemokine receptor |
| ACKR2 | 1238 | NP_001287 | 2338 | chemokine binding protein 2 |
| ACKR3 | 57007 | NP_064707 | 4628 | chemokine (C-X-C motif) receptor 7 |
| ACMSD | 130013 | NP_612199 | 5725 | aminocarboxymuconate semialdehyde decarboxylase |
| ACP1 | 52 | NP_001035739 | 876 | acid phosphatase 1, soluble |
| ACP1 | 52 | NP_004291 | 3011 | acid phosphatase 1, soluble |
| ACP1 | 52 | NP_009030 | 3629 | acid phosphatase 1, soluble |
| ACP2 | 53 | NP_001289418.1 | 1468 | acid phosphatase 2, lysosomal |
| ACP2 | 53 | NP_001601 | 2418 | acid phosphatase 2, lysosomal |
| ACPP | 55 | NP_001090 | 1102 | acid phosphatase, prostate |
| ACPP | 55 | NP_001127666 | 1471 | acid phosphatase, prostate |
| ACPT | 93650 | NP_149059 | 5448 | acid phosphatase, testicular |
| ACSBG2 | 81616 | NP_112186 | 5194 | acyl-CoA synthetase bubblegum family member 2 |
| ACSL1 | 2180 | NP_001986 | 2521 | acyl-CoA synthetase long-chain family member 1 |
| ACSL3 | 2181 | NP_004448 | 3054 | acyl-CoA synthetase long-chain family member 3 |
| ACSL3 | 2181 | NP_976251 | 6927 | acyl-CoA synthetase long-chain family member 3 |
| ACSL5 | 51703 | NP_057318 | 4188 | acyl-CoA synthetase long-chain family member 5 |
| ACSL5 | 51703 | NP_976313 | 6928 | acyl-CoA synthetase long-chain family member 5 |
| ACSL5 | 51703 | NP_976314 | 6929 | acyl-CoA synthetase long-chain family member 5 |
| ACSL6 | 23305 | NP_001009185 | 560 | acyl-CoA synthetase long-chain family member 6 |
| ACSL6 | 23305 | NP_056071 | 4052 | acyl-CoA synthetase long-chain family member 6 |
| ACSM1 | 116285 | NP_443188 | 5550 | acyl-CoA synthetase medium-chain family member 1 |
| ACSS1 | 84532 | NP_115890 | 5362 | acyl-CoA synthetase short-chain family member 1 |
| ACSS2 | 55902 | NP_001070020 | 947 | acyl-CoA synthetase short-chain family member 2 |
| ACSS2 | 55902 | NP_061147 | 4484 | acyl-CoA synthetase short-chain family member 2 |
| ACSS3 | 79611 | NP_078836 | 5048 | acyl-CoA synthetase short-chain family member 3 |
| ACVR1 | 90 | NP_001096 | 1206 | activin A receptor, type I |
| ACVR1 | 90 | NP_001104537 | 1246 | activin A receptor, type I |
| ACVR1B | 91 | NP_004293 | 3012 | activin A receptor, type IB |
| ACVR1B | 91 | NP_064732 | 4629 | activin A receptor, type IB |
| ACVR1B | 91 | NP_064733 | 4630 | activin A receptor, type IB |
| ACVR1C | 130399 | NP_001104501 | 1243 | activin A receptor, type IC |
| ACVR1C | 130399 | NP_001104502 | 1244 | activin A receptor, type IC |
| ACVR1C | 130399 | NP_001104503 | 1245 | activin A receptor, type IC |
| ACVR1C | 130399 | NP_660302 | 5944 | activin A receptor, type IC |
| ACVR2A | 92 | NP_001607 | 2419 | activin A receptor, type IIA |
| ACVR2B | 93 | NP_001097 | 1212 | activin A receptor, type IIB |
| ACVRL1 | 94 | NP_000011 | 2 | activin A receptor type II-like 1 |
| ACVRL1 | 94 | NP_001070869 | 965 | activin A receptor type II-like 1 |
| ADAM10 | 102 | NP_001101 | 1233 | ADAM metallopeptidase domain 10 |
| ADAM11 | 4185 | NP_002381 | 2640 | ADAM metallopeptidase domain 11 |
| ADAM12 | 8038 | NP_003465 | 2839 | ADAM metallopeptidase domain 12 |
| ADAM12 | 8038 | NP_067673 | 4815 | ADAM metallopeptidase domain 12 |
| ADAM15 | 8751 | NP_001248393.1 | 7434 | ADAM metallopeptidase domain 15 |
| ADAM17 | 6868 | NP_003174 | 2796 | ADAM metallopeptidase domain 17 |
| ADAM18 | 8749 | NP_055052 | 3893 | ADAM metallopeptidase domain 18 |
| ADAM19 | 8728 | NP_150377.1 | 4970 | ADAM metallopeptidase domain 19 (meltrin beta) |
| ADAM19 | 8728 | NP_150377 | 5478 | ADAM metallopeptidase domain 19 (meltrin beta) |
| ADAM2 | 2515 | NP_001455 | 2381 | ADAM metallopeptidase domain 2 |
| ADAM20 | 8748 | NP_003805 | 2903 | ADAM metallopeptidase domain 20 |
| ADAM21 | 8747 | NP_003804 | 2902 | ADAM metallopeptidase domain 21 pseudogene |
| ADAM22 | 53616 | NP_004185 | 2983 | ADAM metallopeptidase domain 22 |
| ADAM22 | 53616 | NP_057435 | 4207 | ADAM metallopeptidase domain 22 |
| ADAM22 | 53616 | NP_068367 | 4819 | ADAM metallopeptidase domain 22 |
| ADAM22 | 53616 | NP_068368 | 4820 | ADAM metallopeptidase domain 22 |

FIG. 2 (CONT.)

| Antigen | GeneID | Accession No. | SEQ ID NO: | RefSeq Gene Name |
|---|---|---|---|---|
| ADAM22 | 53616 | NP_068369 | 4821 | ADAM metallopeptidase domain 22 |
| ADAM23 | 8745 | NP_003803 | 2901 | ADAM metallopeptidase domain 23 |
| ADAM28 | 10863 | NP_055080 | 3901 | ADAM metallopeptidase domain 28 |
| ADAM28 | 10863 | NP_068547 | 4827 | ADAM metallopeptidase domain 28 |
| ADAM29 | 11086 | NP_001124175 | 1435 | ADAM metallopeptidase domain 29 |
| ADAM29 | 11086 | NP_001124176 | 1436 | ADAM metallopeptidase domain 29 |
| ADAM29 | 11086 | NP_001124177 | 1437 | ADAM metallopeptidase domain 29 |
| ADAM29 | 11086 | NP_055084 | 3903 | ADAM metallopeptidase domain 29 |
| ADAM30 | 11085 | NP_068566 | 4829 | ADAM metallopeptidase domain 30 |
| ADAM32 | 203102 | NP_659441 | 5915 | ADAM metallopeptidase domain 32 |
| ADAM33 | 80332 | NP_079496 | 5135 | ADAM metallopeptidase domain 33 |
| ADAM33 | 80332 | NP_694882 | 6157 | ADAM metallopeptidase domain 33 |
| ADAM7 | 8756 | NP_003808 | 2905 | ADAM metallopeptidase domain 7 |
| ADAM8 | 101 | NP_001100 | 1232 | ADAM metallopeptidase domain 8 |
| ADAM8 | 101 | NP_001157961 | 2084 | ADAM metallopeptidase domain 8 |
| ADAM8 | 101 | NP_001157962 | 2085 | ADAM metallopeptidase domain 8 |
| ADAM9 | 8754 | NP_001005845 | 472 | ADAM metallopeptidase domain 9 (meltrin gamma) |
| ADAM9 | 8754 | NP_003807 | 2904 | ADAM metallopeptidase domain 9 (meltrin gamma) |
| ADAMTS1 | 9510 | NP_008919 | 3607 | ADAM metallopeptidase with thrombospondin type 1 motif, 1 |
| ADAMTS13 | 11093 | NP_620594 | 5829 | ADAM metallopeptidase with thrombospondin type 1 motif, 13 |
| ADAMTS13 | 11093 | NP_620595 | 5830 | ADAM metallopeptidase with thrombospondin type 1 motif, 13 |
| ADAMTS13 | 11093 | NP_620596 | 5831 | ADAM metallopeptidase with thrombospondin type 1 motif, 13 |
| ADCY1 | 107 | NP_066939 | 4777 | adenylate cyclase 1 (brain) |
| ADCY10 | 55811 | NP_001161221 | 2196 | adenylate cyclase 10 (soluble) |
| ADCY10 | 55811 | NP_060887 | 4445 | adenylate cyclase 10 (soluble) |
| ADCY2 | 108 | NP_065433 | 4682 | adenylate cyclase 2 (brain) |
| ADCY3 | 109 | NP_004027 | 2949 | adenylate cyclase 3 |
| ADCY4 | 196883 | NP_640340 | 5849 | adenylate cyclase 4 |
| ADCY5 | 111 | NP_899200 | 6706 | adenylate cyclase 5 |
| ADCY6 | 112 | NP_056085 | 4056 | adenylate cyclase 6 |
| ADCY6 | 112 | NP_056085.1 | 4753 | adenylate cyclase 6 |
| ADCY7 | 113 | NP_001105 | 1247 | adenylate cyclase 7 |
| ADCY8 | 114 | NP_001106 | 1248 | adenylate cyclase 8 (brain) |
| ADCY9 | 115 | NP_001107 | 1260 | adenylate cyclase 9 |
| ADCYAP1R1 | 117 | NP_001109 | 1279 | adenylate cyclase activating polypeptide 1 (pituitary) receptor type I |
| ADGRA1 | 84435 | NP_001077378 | 1081 | G protein-coupled receptor 123 |
| ADGRA2 | 25960 | NP_116166 | 5398 | G protein-coupled receptor 124 |
| ADGRA3 | 166647 | NP_660333 | 5954 | G protein-coupled receptor 125 |
| ADGRB1 | 575 | NP_001693 | 2439 | brain-specific angiogenesis inhibitor 1 |
| ADGRB3 | 577 | NP_001695 | 2440 | brain-specific angiogenesis inhibitor 3 |
| ADGRD1 | 283383 | NP_942122 | 6838 | G protein-coupled receptor 133 |
| ADGRE1 | 2015 | NP_001965 | 2514 | egf-like module containing, mucin-like,Hormone receptor-like 1 |
| ADGRE2 | 30817 | NP_038475 | 3825 | egf-like module containing, mucin-like,Hormone receptor-like 2 |
| ADGRE2 | 30817 | NP_001257981.1 | 6133 | egf-like module containing, mucin-like,Hormone receptor-like 2 |
| ADGRE2 | 30817 | NP_001257981.1 | 6134 | egf-like module containing, mucin-like,Hormone receptor-like 2 |
| ADGRE2 | 30817 | NP_001257981.1 | 6135 | egf-like module containing, mucin-like,Hormone receptor-like 2 |
| ADGRE2 | 30817 | NP_001257981.1 | 6136 | egf-like module containing, mucin-like,Hormone receptor-like 2 |
| ADGRE2 | 30817 | NP_001257981.1 | 6137 | egf-like module containing, mucin-like,Hormone receptor-like 2 |
| ADGRE2 | 30817 | NP_001257981.1 | 6138 | egf-like module containing, mucin-like,Hormone receptor-like 2 |
| ADGRE3 | 84658 | NP_115960 | 5372 | egf-like module containing, mucin-like,Hormone receptor-like 3 |
| ADGRE5 | 976 | NP_001020331 | 698 | CD97 molecule |
| ADGRE5 | 976 | NP_001775 | 2471 | CD97 molecule |
| ADGRE5 | 976 | NP_510966 | 5592 | CD97 molecule |
| ADGRF1 | 266977 | NP_079324 | 5114 | G protein-coupled receptor 110 |
| ADGRF1 | 266977 | NP_722582 | 6242 | G protein-coupled receptor 110 |
| ADGRF2 | 222611 | NP_722581 | 6241 | G protein-coupled receptor 111 |
| ADGRF3 | 165082 | NP_001138640 | 1824 | G protein-coupled receptor 113 |
| ADGRF3 | 165082 | NP_001138641 | 1825 | G protein-coupled receptor 113 |
| ADGRF3 | 165082 | NP_722577 | 6238 | G protein-coupled receptor 113 |
| ADGRF4 | 221393 | NP_722580 | 6240 | G protein-coupled receptor 115 |
| ADGRF5 | 221395 | NP_001091988 | 1131 | G protein-coupled receptor 116 |
| ADGRF5 | 221395 | NP_056049 | 4049 | G protein-coupled receptor 116 |
| ADGRG2 | 10149 | NP_001073327 | 1003 | G protein-coupled receptor 64 |
| ADGRG2 | 10149 | NP_001073328 | 1004 | G protein-coupled receptor 64 |
| ADGRG2 | 10149 | NP_001073329 | 1005 | G protein-coupled receptor 64 |
| ADGRG2 | 10149 | NP_005747 | 3357 | G protein-coupled receptor 64 |
| ADGRG3 | 222487 | NP_740746 | 6263 | G protein-coupled receptor 97 |
| ADGRG4 | 139378 | NP_722576 | 6237 | G protein-coupled receptor 112 |
| ADGRG5 | 221188 | NP_722579 | 6239 | G protein-coupled receptor 114 |
| ADGRG6 | 57211 | NP_001027566 | 745 | G protein-coupled receptor 126 |
| ADGRG6 | 57211 | NP_001027567 | 746 | G protein-coupled receptor 126 |
| ADGRG6 | 57211 | NP_065188 | 4663 | G protein-coupled receptor 126 |
| ADGRG6 | 57211 | NP_940971 | 6818 | G protein-coupled receptor 126 |
| ADGRG7 | 84873 | NP_116176 | 5401 | G protein-coupled receptor 128 |
| ADGRL1 | 22859 | NP_001008701 | 551 | latrophilin 1 |
| ADGRL1 | 22859 | NP_055736 | 4013 | latrophilin 1 |
| ADGRL2 | 23266 | NP_036434 | 3740 | latrophilin 2 |

FIG. 2 (CONT.)

| Antigen | GeneID | Accession No. | SEQ ID NO: | RefSeq Gene Name |
|---|---|---|---|---|
| ADGRL3 | 23284 | NP_056051 | 4050 | latrophilin 3 |
| ADGRL4 | 64123 | NP_071442 | 4890 | EGF, latrophilin and seven transmembrane domain containing 1 |
| ADGRV1 | 84059 | NP_115495 | 5299 | G protein-coupled receptor 98 |
| ADIG | 149685 | NP_001018092 | 668 | adipogenin |
| ADIPOR1 | 51094 | NP_001277482.1 | 1346 | adiponectin receptor 1 |
| ADIPOR1 | 51094 | NP_057083 | 4149 | adiponectin receptor 1 |
| ADIPOR2 | 79602 | NP_078827 | 5045 | adiponectin receptor 2 |
| ADORA1 | 134 | NP_000665 | 190 | adenosine A1 receptor |
| ADORA1 | 134 | NP_001041695 | 931 | adenosine A1 receptor |
| ADORA2B | 136 | NP_000667 | 191 | hypothetical LOC100131909 adenosine A2b receptor |
| ADORA3 | 140 | NP_000668 | 192 | adenosine A3 receptor |
| ADORA3 | 140 | NP_001075445 | 1060 | adenosine A3 receptor |
| ADORA3 | 140 | NP_065734 | 4698 | adenosine A3 receptor |
| ADPRM | 56985 | NP_064618 | 4621 | chromosome 17 open reading frame 48 |
| ADRA1A | 148 | NP_000671 | 195 | adrenergic, alpha-1A-, receptor |
| ADRA1A | 148 | NP_150645 | 5483 | adrenergic, alpha-1A-, receptor |
| ADRA1A | 148 | NP_150646 | 5484 | adrenergic, alpha-1A-, receptor |
| ADRA1A | 148 | NP_150647 | 5485 | adrenergic, alpha-1A-, receptor |
| ADRA1B | 147 | NP_000670 | 194 | adrenergic, alpha-1B-, receptor |
| ADRA1D | 146 | NP_000669 | 193 | adrenergic, alpha-1D-, receptor |
| ADRA2A | 150 | NP_000672 | 196 | adrenergic, alpha-2A-, receptor |
| ADRA2B | 151 | NP_000673 | 197 | adrenergic, alpha-2B-, receptor |
| ADRA2C | 152 | NP_000674 | 198 | adrenergic, alpha-2C-, receptor |
| ADRB1 | 153 | NP_000675 | 199 | adrenergic, beta-1-, receptor |
| ADRB2 | 154 | NP_000015 | 5 | adrenergic, beta-2-, receptor, surface |
| ADRB3 | 155 | NP_000016 | 6 | adrenergic, beta-3-, receptor |
| ADSSL1 | 122622 | NP_689541 | 6034 | adenylosuccinate synthase like 1 |
| ADSSL1 | 122622 | NP_954634 | 6860 | adenylosuccinate synthase like 1 |
| ADTRP | 84830 | NP_001137420 | 1738 | chromosome 6 open reading frame 105 |
| ADTRP | 84830 | NP_116133 | 5396 | chromosome 6 open reading frame 105 |
| AES | 166 | NP_001121 | 1333 | amino-terminal enhancer of split |
| AES | 166 | NP_945320 | 6848 | amino-terminal enhancer of split |
| AES | 166 | NP_945321 | 6849 | amino-terminal enhancer of split |
| AFG3L2 | 10939 | NP_006787 | 3565 | AFG3 ATPase family gene 3-like 2 (yeast) |
| AFP | 174 | NP_001125.1 | 7252 | alpha fetoprotein |
| AGER | 177 | NP_001127 | 1470 | advanced glycosylation end product-specific receptor |
| AGER | 177 | NP_751947 | 6286 | advanced glycosylation end product-specific receptor |
| AGPAT1 | 10554 | NP_006402 | 3485 | 1-acylglycerol-3-phosphate O-acyltransferase 1 (lysophosphatidic acid acyltransferase, alpha) |
| AGPAT1 | 10554 | NP_116130 | 5395 | 1-acylglycerol-3-phosphate O-acyltransferase 1 (lysophosphatidic acid acyltransferase, alpha) |
| AGPAT2 | 10555 | NP_001012745 | 606 | 1-acylglycerol-3-phosphate O-acyltransferase 2 (lysophosphatidic acid acyltransferase, beta) |
| AGPAT2 | 10555 | NP_006403 | 3486 | 1-acylglycerol-3-phosphate O-acyltransferase 2 (lysophosphatidic acid acyltransferase, beta) |
| AGPAT3 | 56894 | NP_001032642 | 777 | 1-acylglycerol-3-phosphate O-acyltransferase 3 |
| AGPAT3 | 56894 | NP_064517 | 4601 | 1-acylglycerol-3-phosphate O-acyltransferase 3 |
| AGPAT4 | 56895 | NP_064518 | 4602 | 1-acylglycerol-3-phosphate O-acyltransferase 4 (lysophosphatidic acid acyltransferase, delta) |
| AGPAT5 | 55326 | NP_060831 | 4429 | 1-acylglycerol-3-phosphate O-acyltransferase 5 (lysophosphatidic acid acyltransferase, epsilon) |
| AGPAT6 | 137964 | NP_848934 | 6564 | 1-acylglycerol-3-phosphate O-acyltransferase 6 (lysophosphatidic acid acyltransferase, zeta) |
| AGPAT9 | 84803 | NP_116106 | 5388 | 1-acylglycerol-3-phosphate O-acyltransferase 9 |
| AGTR1 | 185 | NP_000676 | 200 | angiotensin II receptor, type 1 |
| AGTR1 | 185 | NP_004826 | 3145 | angiotensin II receptor, type 1 |
| AGTR1 | 185 | NP_033611 | 3693 | angiotensin II receptor, type 1 |
| AGTR1 | 185 | NP_114038 | 5240 | angiotensin II receptor, type 1 |
| AGTR1 | 185 | NP_114438 | 5287 | angiotensin II receptor, type 1 |
| AGTR2 | 186 | NP_000677 | 201 | angiotensin II receptor, type 2 |
| AGTRAP | 57085 | NP_001035284 | 857 | angiotensin II receptor-associated protein |
| AGTRAP | 57085 | NP_001035285 | 858 | angiotensin II receptor-associated protein |
| AGTRAP | 57085 | NP_001035286 | 859 | angiotensin II receptor-associated protein |
| AGTRAP | 57085 | NP_001035287 | 860 | angiotensin II receptor-associated protein |
| AGTRAP | 57085 | NP_065083 | 4633 | angiotensin II receptor-associated protein |
| AIFM1 | 9131 | NP_001124318 | 1439 | apoptosis-inducing factor, mitochondrion-associated, 1 |
| AIFM1 | 9131 | NP_001124319 | 1440 | apoptosis-inducing factor, mitochondrion-associated, 1 |
| AIFM1 | 9131 | NP_004199 | 2988 | apoptosis-inducing factor, mitochondrion-associated, 1 |
| AIFM1 | 9131 | NP_056997 | 4133 | apoptosis-inducing factor, mitochondrion-associated, 1 |
| AIFM1 | 9131 | NP_665811 | 5980 | apoptosis-inducing factor, mitochondrion-associated, 1 |
| AIFM1 | 9131 | NP_665812 | 5982 | apoptosis-inducing factor, mitochondrion-associated, 1 |
| AIFM2 | 84883 | NP_116186 | 5403 | apoptosis-inducing factor, mitochondrion-associated, 2 |
| AIG1 | 51390 | NP_057192 | 4170 | androgen-induced 1 |
| AJAP1 | 55966 | NP_001035943 | 894 | adherens junctions associated protein 1 |
| AJAP1 | 55966 | NP_061324 | 4491 | adherens junctions associated protein 1 |
| AKAP1 | 8165 | NP_003479 | 2840 | A kinase (PRKA) anchor protein 1 |
| AKAP6 | 9472 | NP_004265 | 3005 | A kinase (PRKA) anchor protein 6 |
| ALCAM | 214 | NP_001618 | 2420 | hypothetical protein LOC100133690 activated leukocyte cell adhesion molecule |
| ALDH1A1 | 216 | NP_000680.2 | 7313 | aldehyde dehydrogenase 1 family member A1 |
| ALDH3A2 | 224 | NP_000373 | 113 | aldehyde dehydrogenase 3 family, member A2 |
| ALDH3A2 | 224 | NP_001026976 | 734 | aldehyde dehydrogenase 3 family, member A2 |
| ALDH6A1 | 4329 | NP_005580 | 3320 | aldehyde dehydrogenase 6 family, member A1 |
| ALG1 | 56052 | NP_061982 | 4565 | asparagine-linked glycosylation 1, beta-1,4-mannosyltransferaseHomolog (S. cerevisiae) |
| ALG10 | 84920 | NP_116223 | 5415 | asparagine-linked glycosylation 10, alpha-1,2-glucosyltransferaseHomolog (S. pombe) |

FIG. 2 (CONT.)

| Antigen | GeneID | Accession No. | SEQ ID NO: | RefSeq Gene Name |
|---|---|---|---|---|
| ALG10B | 144245 | NP_001013642 | 616 | asparagine-linked glycosylation 10, alpha-1,2-glucosyltransferaseHomolog B (yeast) |
| ALG12 | 79087 | NP_077010 | 5012 | asparagine-linked glycosylation 12, alpha-1,6-mannosyltransferaseHomolog (S. cerevisiae) |
| ALG3 | 10195 | NP_001006942 | 494 | asparagine-linked glycosylation 3, alpha-1,3- mannosyltransferaseHomolog (S. cerevisiae) |
| ALG3 | 10195 | NP_005778 | 3368 | asparagine-linked glycosylation 3, alpha-1,3- mannosyltransferaseHomolog (S. cerevisiae) |
| ALG5 | 29880 | NP_001135836 | 1650 | asparagine-linked glycosylation 5, dolichyl-phosphate beta-glucosyltransferaseHomolog (S. cerevisiae) |
| ALG5 | 29880 | NP_037470 | 3806 | asparagine-linked glycosylation 5, dolichyl-phosphate beta-glucosyltransferaseHomolog (S. cerevisiae) |
| ALG6 | 29929 | NP_037471 | 3807 | asparagine-linked glycosylation 6, alpha-1,3-glucosyltransferaseHomolog (S. cerevisiae) |
| ALG8 | 79053 | NP_001007028 | 500 | asparagine-linked glycosylation 8, alpha-1,3-glucosyltransferaseHomolog (S. cerevisiae) |
| ALG8 | 79053 | NP_076984 | 5003 | asparagine-linked glycosylation 8, alpha-1,3-glucosyltransferaseHomolog (S. cerevisiae) |
| ALG9 | 79796 | NP_001071158 | 976 | asparagine-linked glycosylation 9, alpha-1,2-mannosyltransferaseHomolog (S. cerevisiae) |
| ALG9 | 79796 | NP_001071159 | 977 | asparagine-linked glycosylation 9, alpha-1,2-mannosyltransferaseHomolog (S. cerevisiae) |
| ALG9 | 79796 | NP_001071160 | 978 | asparagine-linked glycosylation 9, alpha-1,2-mannosyltransferaseHomolog (S. cerevisiae) |
| ALG9 | 79796 | NP_079016 | 5074 | asparagine-linked glycosylation 9, alpha-1,2-mannosyltransferaseHomolog (S. cerevisiae) |
| ALK | 238 | NP_004295 | 3013 | anaplastic lymphoma receptor tyrosine kinase |
| ALOX5AP | 241 | NP_001620 | 2421 | arachidonate 5-lipoxygenase-activating protein |
| ALPK1 | 80216 | NP_001095876 | 1205 | alpha-kinase 1 |
| ALPK1 | 80216 | NP_079420 | 5125 | alpha-kinase 1 |
| AMELX | 265 | NP_001133 | 1622 | amelogenin (amelogenesis imperfecta 1, X-linked) |
| AMELX | 265 | NP_872621 | 6673 | amelogenin (amelogenesis imperfecta 1, X-linked) |
| AMELX | 265 | NP_872622 | 6674 | amelogenin (amelogenesis imperfecta 1, X-linked) |
| AMFR | 267 | NP_001135 | 1623 | autocrine motility factor receptor |
| AMHR2 | 269 | NP_001158162 | 2094 | anti-MullerianHormone receptor, type II |
| AMHR2 | 269 | NP_001158163 | 2095 | anti-MullerianHormone receptor, type II |
| AMHR2 | 269 | NP_065434 | 4683 | anti-MullerianHormone receptor, type II |
| AMICA1 | 120425 | NP_001091996 | 1136 | adhesion molecule, interacts with CXADR antigen 1 |
| AMICA1 | 120425 | NP_694938 | 6158 | adhesion molecule, interacts with CXADR antigen 1 |
| AMIGO2 | 347902 | NP_001137140 | 1710 | adhesion molecule with Ig-like domain 2 |
| AMIGO2 | 347902 | NP_862830 | 6640 | adhesion molecule with Ig-like domain 2 |
| AMIGO3 | 386724 | NP_942015 | 6836 | adhesion molecule with Ig-like domain 3 |
| AMN | 81693 | NP_112205 | 5199 | amnionlessHomolog (mouse) |
| ANG | 283 | NP_001091046 | 1103 | angiogenin, ribonuclease, RNase A family, 5 |
| ANG | 283 | NP_001136 | 1669 | angiogenin, ribonuclease, RNase A family, 5 |
| ANGPTL1 | 9068 | NP_004664 | 3100 | angiopoietin-like 1 |
| ANGPTL7 | 10218 | NP_066969 | 4781 | angiopoietin-like 7 |
| ANK1 | 286 | NP_000028 | 7 | ankyrin 1, erythrocytic |
| ANK1 | 286 | NP_001135917 | 1659 | ankyrin 1, erythrocytic |
| ANK1 | 286 | NP_001135918 | 1660 | ankyrin 1, erythrocytic |
| ANK1 | 286 | NP_065208 | 4671 | ankyrin 1, erythrocytic |
| ANK1 | 286 | NP_065209 | 4672 | ankyrin 1, erythrocytic |
| ANK1 | 286 | NP_065210 | 4673 | ankyrin 1, erythrocytic |
| ANK1 | 286 | NP_065211 | 4674 | ankyrin 1, erythrocytic |
| ANK1 | 286 | NP_065213 | 4675 | ankyrin 1, erythrocytic |
| ANKH | 56172 | NP_473368 | 5568 | ankylosis, progressiveHomolog (mouse) |
| ANKLE1 | 126549 | NP_689576 | 6043 | ankyrin repeat and LEM domain containing 1 |
| ANKLE2 | 23141 | NP_055929 | 4034 | ankyrin repeat and LEM domain containing 2 |
| ANKRD29 | 147463 | NP_775776 | 6348 | ankyrin repeat domain 29 |
| ANKRD46 | 157567 | NP_940683 | 6791 | ankyrin repeat domain 46 |
| ANO1 | 55107 | NP_060513 | 4383 | anoctamin 1, calcium activated chloride channel |
| ANO10 | 55129 | NP_060545 | 4388 | anoctamin 10 |
| ANO2 | 57101 | NP_005682.2 | 4637 | anoctamin 2 |
| ANO3 | 63982 | NP_001300655.1 | 7457 | anoctamin 3 |
| ANO4 | 121601 | NP_849148 | 6566 | anoctamin 4 |
| ANO5 | 203859 | NP_001136121 | 1683 | anoctamin 5 |
| ANO5 | 203859 | NP_998764 | 7040 | anoctamin 5 |
| ANO6 | 196527 | NP_001020527 | 708 | anoctamin 6 |
| ANO6 | 196527 | NP_001136150 | 1684 | anoctamin 6 |
| ANO6 | 196527 | NP_001136151 | 1685 | anoctamin 6 |
| ANO6 | 196527 | NP_001136152 | 1686 | anoctamin 6 |
| ANO7 | 50636 | NP_001001666 | 372 | anoctamin 7 |
| ANO7 | 50636 | NP_001001891 | 378 | anoctamin 7 |
| ANO8 | 57719 | NP_066010.1 | 7338 | anoctamin 8 |
| ANO9 | 338440 | NP_001012302 | 591 | anoctamin 9 |
| ANPEP | 290 | NP_001141 | 1936 | alanyl (membrane) aminopeptidase |
| ANTXR1 | 84168 | NP_060623 | 4399 | anthrax toxin receptor 1 |
| ANTXR1 | 84168 | NP_115584 | 5307 | anthrax toxin receptor 1 |
| ANTXR1 | 84168 | NP_444262 | 5557 | anthrax toxin receptor 1 |
| ANTXR2 | 118429 | NP_001139266 | 1876 | anthrax toxin receptor 2 |
| ANTXR2 | 118429 | NP_477520 | 5582 | anthrax toxin receptor 2 |
| ANXA1 | 301 | NP_000691.1 | 7253 | annexin A1 |
| AOC2 | 314 | NP_001149.2 | 7344 | amine oxidase, copper containing 2 |
| AOC3 | 8639 | NP_003725 | 2877 | amine oxidase, copper containing 3 (vascular adhesion protein 1) |
| APCDD1 | 147495 | NP_694545 | 6146 | adenomatosis polyposis coli down-regulated 1 |
| APELA | 100506013 | NP_001284479 | 7104 | apelin receptor early endogenous ligand |
| APH1A | 51107 | NP_001071096 | 974 | anterior pharynx defective 1Homolog A (C. elegans) |
| APH1A | 51107 | NP_057106 | 4153 | anterior pharynx defective 1Homolog A (C. elegans) |
| APH1B | 83464 | NP_001139118 | 1872 | anterior pharynx defective 1Homolog B (C. elegans) |
| APH1B | 83464 | NP_112591 | 5218 | anterior pharynx defective 1Homolog B (C. elegans) |

FIG. 2 (CONT.)

| Antigen | GeneID | Accession No. | SEQ ID NO: | RefSeq Gene Name |
|---|---|---|---|---|
| APLF | 200558 | NP_775816 | 6356 | aprataxin and PNKP like factor |
| APLN | 8862 | NP_059109 | 4283 | apelin |
| APLNR | 187 | NP_005152 | 3221 | apelin receptor |
| APLP1 | 333 | NP_001019978 | 686 | amyloid beta (A4) precursor-like protein 1 |
| APLP1 | 333 | NP_005157 | 3222 | amyloid beta (A4) precursor-like protein 1 |
| APLP2 | 334 | NP_001135748 | 1631 | amyloid beta (A4) precursor-like protein 2 |
| APLP2 | 334 | NP_001135749 | 1632 | amyloid beta (A4) precursor-like protein 2 |
| APLP2 | 334 | NP_001135750 | 1633 | amyloid beta (A4) precursor-like protein 2 |
| APLP2 | 334 | NP_001633 | 2422 | amyloid beta (A4) precursor-like protein 2 |
| APMAP | 57136 | NP_065392 | 4679 | chromosome 20 open reading frame 3 |
| APOB | 338 | NP_000375 | 114 | apolipoprotein B (including Ag(x) antigen) |
| APOC1 | 341 | NP_001636 | 2423 | apolipoprotein C-I |
| APOL1 | 8542 | NP_001130012 | 1610 | apolipoprotein L, 1 |
| APOL1 | 8542 | NP_001130013 | 1611 | apolipoprotein L, 1 |
| APOL1 | 8542 | NP_003652 | 2865 | apolipoprotein L, 1 |
| APOL1 | 8542 | NP_663318 | 5962 | apolipoprotein L, 1 |
| APOL2 | 23780 | NP_112092 | 5184 | apolipoprotein L, 2 |
| APOL2 | 23780 | NP_663612 | 5963 | apolipoprotein L, 2 |
| APOL4 | 80832 | NP_085146 | 5153 | apolipoprotein L, 4 |
| APOL4 | 80832 | NP_663693 | 5970 | apolipoprotein L, 4 |
| APOLD1 | 81575 | NP_001123887 | 1423 | apolipoprotein L domain containing 1 |
| APOLD1 | 81575 | NP_110444 | 5181 | apolipoprotein L domain containing 1 |
| APOO | 79135 | NP_077027 | 5014 | apolipoprotein O |
| APP | 351 | NP_000475.1 | 7254 | amyloid beta precursor protein |
| AQP1 | 358 | NP_932766 | 6740 | aquaporin 1 (Colton blood group) |
| AQP10 | 89872 | NP_536354.2 | 7316 | aquaporin 10 |
| AQP11 | 282679 | NP_766627 | 6326 | aquaporin 11 |
| AQP2 | 359 | NP_000477 | 137 | aquaporin 2 (collecting duct) |
| AQP3 | 360 | NP_004916 | 3168 | aquaporin 3 (Gill blood group) |
| AQP4 | 361 | NP_001641 | 2424 | aquaporin 4 |
| AQP4 | 361 | NP_004019 | 2948 | aquaporin 4 |
| AQP5 | 362 | NP_001642 | 2425 | aquaporin 5 |
| AQP6 | 363 | NP_001643 | 2426 | aquaporin 6, kidney specific |
| AQP7 | 364 | NP_001161 | 2180 | aquaporin 7 |
| AQP8 | 343 | NP_001160 | 2172 | aquaporin 8 |
| AQP9 | 366 | NP_066190.2 | 7378 | aquaporin 9 |
| AREL1 | 9870 | NP_001034568 | 794 | KIAA0317 |
| ARHGAP1 | 392 | NP_004299 | 3014 | Rho GTPase activating protein 1 |
| ARHGAP36 | 158763 | NP_659404 | 5908 | hypothetical protein FLJ30058 |
| ARL10 | 285598 | NP_775935 | 6377 | ADP-ribosylation factor-like 10 |
| ARL6IP1 | 23204 | NP_055976 | 4041 | ADP-ribosylation factor-like 6 interacting protein 1 |
| ARL6IP5 | 10550 | NP_006398 | 3483 | ADP-ribosylation-like factor 6 interacting protein 5 |
| ARL6IP6 | 151188 | NP_689735 | 6074 | ADP-ribosylation-like factor 6 interacting protein 6 |
| ARMC10 | 83787 | NP_001154481 | 1996 | armadillo repeat containing 10 |
| ARMC10 | 83787 | NP_001154482 | 1997 | armadillo repeat containing 10 |
| ARMC10 | 83787 | NP_001154483 | 1998 | armadillo repeat containing 10 |
| ARMC10 | 83787 | NP_001154484 | 1999 | armadillo repeat containing 10 |
| ARMC10 | 83787 | NP_001154485 | 2000 | armadillo repeat containing 10 |
| ARMC10 | 83787 | NP_114111 | 5266 | armadillo repeat containing 10 |
| ARMCX1 | 51309 | NP_057692 | 4261 | armadillo repeat containing, X-linked 1 |
| ARMCX2 | 9823 | NP_055597 | 3988 | armadillo repeat containing, X-linked 2 |
| ARMCX2 | 9823 | NP_808818 | 6507 | armadillo repeat containing, X-linked 2 |
| ARMCX3 | 51566 | NP_057691 | 4260 | armadillo repeat containing, X-linked 3 |
| ARMCX3 | 51566 | NP_808816 | 6505 | armadillo repeat containing, X-linked 3 |
| ARMCX3 | 51566 | NP_808817 | 6506 | armadillo repeat containing, X-linked 3 |
| ARMCX4 | 100131755 | XP_001713936 | 7051 | similar to HCG1792883 |
| ARMCX4 | 100131755 | XP_001717051 | 7056 | similar to HCG1792883 |
| ARMCX4 | 100131755 | XP_001717934 | 7057 | similar to HCG1792883 |
| ARMCX4 | 100131755 | XP_002346361 | 7082 | similar to HCG1792883 |
| ARSB | 411 | NP_000037 | 8 | arylsulfatase B |
| ARSB | 411 | NP_942002 | 6826 | arylsulfatase B |
| ARSD | 414 | NP_001660 | 2427 | arylsulfatase D |
| ARSD | 414 | NP_033667 | 3695 | arylsulfatase D |
| ARSE | 415 | NP_000038 | 9 | arylsulfatase E (chondrodysplasia punctata 1) |
| ARSF | 416 | NP_004033 | 2950 | arylsulfatase F |
| ARSK | 153642 | NP_937793 | 6747 | arylsulfatase family, member K |
| ART3 | 419 | NP_001123488 | 1409 | ADP-ribosyltransferase 3 |
| ART3 | 419 | NP_001123489 | 1410 | ADP-ribosyltransferase 3 |
| ART3 | 419 | NP_001170 | 2309 | ADP-ribosyltransferase 3 |
| ART4 | 420 | NP_066549 | 4762 | ADP-ribosyltransferase 4 (Dombrock blood group) |
| ASB11 | 140456 | NP_001012428 | 595 | ankyrin repeat and SOCS box-containing 11 |
| ASB11 | 140456 | NP_543149 | 5642 | ankyrin repeat and SOCS box-containing 11 |
| ASB5 | 140458 | NP_543150 | 5643 | ankyrin repeat and SOCS box-containing 5 |
| ASGR1 | 432 | NP_001662 | 2428 | asialoglycoprotein receptor 1 |
| ASIC5 | 51802 | NP_059115 | 4286 | amiloride-sensitive cation channel 5, intestinal |
| ASPH | 444 | NP_001158222 | 2105 | aspartate beta-hydroxylase |
| ASPH | 444 | NP_001158223 | 2106 | aspartate beta-hydroxylase |

FIG. 2 (CONT.)

| Antigen | GeneID | Accession No. | SEQ ID NO: | RefSeq Gene Name |
|---|---|---|---|---|
| ASPH | 444 | NP_001158224 | 2107 | aspartate beta-hydroxylase |
| ASPH | 444 | NP_001158225 | 2108 | aspartate beta-hydroxylase |
| ASPH | 444 | NP_001158226 | 2109 | aspartate beta-hydroxylase |
| ASPH | 444 | NP_001158227 | 2110 | aspartate beta-hydroxylase |
| ASPH | 444 | NP_001158228 | 2111 | aspartate beta-hydroxylase |
| ASPH | 444 | NP_004309 | 3015 | aspartate beta-hydroxylase |
| ASPH | 444 | NP_064549 | 4609 | aspartate beta-hydroxylase |
| ASPH | 444 | NP_115855 | 5356 | aspartate beta-hydroxylase |
| ASPH | 444 | NP_115856 | 5357 | aspartate beta-hydroxylase |
| ASPH | 444 | NP_115857 | 5358 | aspartate beta-hydroxylase |
| ASTN1 | 460 | NP_004310 | 3016 | astrotactin 1 |
| ASTN1 | 460 | NP_996991 | 6999 | astrotactin 1 |
| ASTN2 | 23245 | NP_054729 | 3853 | astrotactin 2 |
| ASTN2 | 23245 | NP_937829 | 6753 | astrotactin 2 |
| ASTN2 | 23245 | NP_937830 | 6754 | astrotactin 2 |
| ASTN2 | 23245 | NP_937831 | 6755 | astrotactin 2 |
| ATCAY | 85300 | NP_149053 | 5447 | ataxia, cerebellar, Cayman type |
| ATF7 | 11016 | NP_001123532.1 | 1413 | activating transcription factor 7 |
| ATF7 | 11016 | NP_001123532 | 1414 | activating transcription factor 7 |
| ATF7 | 11016 | NP_006847 | 3583 | activating transcription factor 7 |
| ATG9A | 79065 | NP_001070666 | 955 | ATG9 autophagy related 9Homolog A (S. cerevisiae) |
| ATG9A | 79065 | NP_076990 | 5007 | ATG9 autophagy related 9Homolog A (S. cerevisiae) |
| ATG9B | 285973 | NP_001303985.1 | 6379 | ATG9 autophagy related 9Homolog B (S. cerevisiae) |
| ATL1 | 51062 | NP_001121185 | 1357 | atlastin GTPase 1 |
| ATL1 | 51062 | NP_056999 | 4134 | atlastin GTPase 1 |
| ATL1 | 51062 | NP_853629 | 6612 | atlastin GTPase 1 |
| ATL2 | 64225 | NP_001129145 | 1548 | atlastin GTPase 2 |
| ATL2 | 64225 | NP_071769 | 4909 | atlastin GTPase 2 |
| ATL3 | 25923 | NP_056274 | 4087 | atlastin GTPase 3 |
| ATP10A | 57194 | NP_077816 | 5034 | ATPase, class V, type 10A |
| ATP10B | 23120 | NP_079429 | 5126 | ATPase, class V, type 10B |
| ATP10D | 57205 | NP_065186 | 4662 | ATPase, class V, type 10D |
| ATP11A | 23250 | NP_056020 | 4045 | ATPase, class VI, type 11A |
| ATP11A | 23250 | NP_115565 | 5306 | ATPase, class VI, type 11A |
| ATP11B | 23200 | NP_055431 | 3964 | ATPase, class VI, type 11B |
| ATP11C | 286410 | NP_001010986 | 584 | ATPase, class VI, type 11C |
| ATP11C | 286410 | NP_775965 | 6382 | ATPase, class VI, type 11C |
| ATP12A | 479 | NP_001667 | 2429 | ATPase, H+/K+ transporting, nongastric, alpha polypeptide |
| ATP13A1 | 57130 | NP_065143 | 4652 | ATPase type 13A1 |
| ATP13A2 | 23400 | NP_001135445.1 | 7400 | ATPase 13A2 |
| ATP13A3 | 79572 | NP_078800 | 5040 | ATPase type 13A3 |
| ATP13A4 | 84239 | NP_115655 | 5318 | ATPase type 13A4 |
| ATP13A5 | 344905 | NP_940907 | 6805 | ATPase type 13A5 |
| ATP1A1 | 476 | NP_000692 | 202 | ATPase, Na+/K+ transporting, alpha 1 polypeptide |
| ATP1A1 | 476 | NP_001001586 | 371 | ATPase, Na+/K+ transporting, alpha 1 polypeptide |
| ATP1A1 | 476 | NP_001153705 | 1983 | ATPase, Na+/K+ transporting, alpha 1 polypeptide |
| ATP1A1 | 476 | NP_001153706 | 1984 | ATPase, Na+/K+ transporting, alpha 1 polypeptide |
| ATP1A2 | 477 | NP_000693 | 203 | ATPase, Na+/K+ transporting, alpha 2 (+) polypeptide |
| ATP1A3 | 478 | NP_689509 | 6027 | ATPase, Na+/K+ transporting, alpha 3 polypeptide |
| ATP1A4 | 480 | NP_001001734 | 376 | ATPase, Na+/K+ transporting, alpha 4 polypeptide |
| ATP1A4 | 480 | NP_653300 | 5893 | ATPase, Na+/K+ transporting, alpha 4 polypeptide |
| ATP1B1 | 481 | NP_001668.1 | 7255 | ATPase Na+/K+ transporting subunit beta 1 |
| ATP1B2 | 482 | NP_001669 | 2430 | ATPase, Na+/K+ transporting, beta 2 polypeptide |
| ATP1B3 | 483 | NP_001670 | 2431 | ATPase, Na+/K+ transporting, beta 3 polypeptide |
| ATP1B4 | 23439 | NP_001135919 | 1661 | ATPase, (Na+)/K+ transporting, beta 4 polypeptide |
| ATP1B4 | 23439 | NP_036201 | 3697 | ATPase, (Na+)/K+ transporting, beta 4 polypeptide |
| ATP2A1 | 487 | NP_004311 | 3017 | ATPase, Ca++ transporting, cardiac muscle, fast twitch 1 |
| ATP2A1 | 487 | NP_775293 | 6339 | ATPase, Ca++ transporting, cardiac muscle, fast twitch 1 |
| ATP2A2 | 488 | NP_001672.1 | 1561 | ATPase, Ca++ transporting, cardiac muscle, slow twitch 2 |
| ATP2A2 | 488 | NP_001672 | 2432 | ATPase, Ca++ transporting, cardiac muscle, slow twitch 2 |
| ATP2A2 | 488 | NP_733765 | 6245 | ATPase, Ca++ transporting, cardiac muscle, slow twitch 2 |
| ATP2A3 | 489 | NP_005164 | 3223 | ATPase, Ca++ transporting, ubiquitous |
| ATP2A3 | 489 | NP_777613 | 6417 | ATPase, Ca++ transporting, ubiquitous |
| ATP2A3 | 489 | NP_777614 | 6418 | ATPase, Ca++ transporting, ubiquitous |
| ATP2A3 | 489 | NP_777615 | 6419 | ATPase, Ca++ transporting, ubiquitous |
| ATP2A3 | 489 | NP_777616 | 6420 | ATPase, Ca++ transporting, ubiquitous |
| ATP2A3 | 489 | NP_777617 | 6421 | ATPase, Ca++ transporting, ubiquitous |
| ATP2A3 | 489 | NP_777618 | 6422 | ATPase, Ca++ transporting, ubiquitous |
| ATP2B1 | 490 | NP_001001323 | 351 | ATPase, Ca++ transporting, plasma membrane 1 |
| ATP2B1 | 490 | NP_001673 | 2433 | ATPase, Ca++ transporting, plasma membrane 1 |
| ATP2B2 | 491 | NP_001001331 | 353 | ATPase, Ca++ transporting, plasma membrane 2 |
| ATP2B2 | 491 | NP_001674 | 2434 | ATPase, Ca++ transporting, plasma membrane 2 |
| ATP2B3 | 492 | NP_001001344 | 354 | ATPase, Ca++ transporting, plasma membrane 3 |
| ATP2B3 | 492 | NP_068768 | 4852 | ATPase, Ca++ transporting, plasma membrane 3 |
| ATP2C1 | 27032 | NP_001001485 | 363 | ATPase, Ca++ transporting, type 2C, member 1 |
| ATP2C1 | 27032 | NP_001001486 | 364 | ATPase, Ca++ transporting, type 2C, member 1 |
| ATP2C1 | 27032 | NP_001001487 | 365 | ATPase, Ca++ transporting, type 2C, member 1 |

FIG. 2 (CONT.)

| Antigen | GeneID | Accession No. | SEQ ID NO: | RefSeq Gene Name |
|---|---|---|---|---|
| ATP2C1 | 27032 | NP_055197 | 3926 | ATPase, Ca++ transporting, type 2C, member 1 |
| ATP2C2 | 9914 | NP_055676 | 4001 | ATPase, Ca++ transporting, type 2C, member 2 |
| ATP4A | 495 | NP_000695 | 204 | ATPase,H+/K+ exchanging, alpha polypeptide |
| ATP4B | 496 | NP_000696 | 205 | ATPase,H+/K+ exchanging, beta polypeptide |
| ATP5F1 | 515 | NP_001679 | 2435 | ATP synthase,H+ transporting, mitochondrial F0 complex, subunit B1 |
| ATP5G3 | 518 | NP_001002258 | 392 | ATP synthase,H+ transporting, mitochondrial F0 complex, subunit C3 (subunit 9) |
| ATP5G3 | 518 | NP_001680 | 2436 | ATP synthase,H+ transporting, mitochondrial F0 complex, subunit C3 (subunit 9) |
| ATP5J2 | 9551 | NP_001003713 | 420 | ATP synthase,H+ transporting, mitochondrial F0 complex, subunit F2 |
| ATP5J2 | 9551 | NP_001003714 | 421 | ATP synthase,H+ transporting, mitochondrial F0 complex, subunit F2 |
| ATP5J2 | 9551 | NP_001034267 | 788 | ATP synthase,H+ transporting, mitochondrial F0 complex, subunit F2 |
| ATP5J2 | 9551 | NP_004880 | 3162 | ATP synthase,H+ transporting, mitochondrial F0 complex, subunit F2 |
| ATP6AP1 | 537 | NP_001174 | 2310 | ATPase,H+ transporting, lysosomal accessory protein 1 |
| ATP6AP1L | 92270 | NP_001017971 | 655 | ATPase,H+ transporting, lysosomal accessory protein 1-like |
| ATP6AP2 | 10159 | NP_005756 | 3360 | ATPase,H+ transporting, lysosomal accessory protein 2 |
| ATP6V0A1 | 535 | NP_001123492.1 | 7393 | ATPase H+ transporting V0 subunit a1 |
| ATP6V0A2 | 23545 | NP_036595 | 3782 | ATPase,H+ transporting, lysosomal V0 subunit a2 |
| ATP6V0A4 | 50617 | NP_065683 | 4686 | ATPase,H+ transporting, lysosomal V0 subunit a4 |
| ATP6V0A4 | 50617 | NP_570855 | 5669 | ATPase,H+ transporting, lysosomal V0 subunit a4 |
| ATP6V0A4 | 50617 | NP_570856 | 5670 | ATPase,H+ transporting, lysosomal V0 subunit a4 |
| ATP6V0B | 533 | NP_001034546 | 793 | ATPase,H+ transporting, lysosomal 21kDa, V0 subunit b |
| ATP6V0B | 533 | NP_004038 | 2951 | ATPase,H+ transporting, lysosomal 21kDa, V0 subunit b |
| ATP6V0C | 527 | NP_001685 | 2437 | ATPase,H+ transporting, lysosomal 16kDa, V0 subunit c |
| ATP6V0E1 | 8992 | NP_003936 | 2928 | ATPase,H+ transporting, lysosomal 9kDa, V0 subunit e1 |
| ATP6V0E2 | 155066 | NP_001094062 | 1189 | ATPase,H+ transporting V0 subunit e2 |
| ATP6V0E2 | 155066 | NP_660265 | 5936 | ATPase,H+ transporting V0 subunit e2 |
| ATP7A | 538 | NP_000043 | 10 | ATPase, Cu++ transporting, alpha polypeptide |
| ATP7B | 540 | NP_000044 | 11 | ATPase, Cu++ transporting, beta polypeptide |
| ATP7B | 540 | NP_001005918 | 477 | ATPase, Cu++ transporting, beta polypeptide |
| ATP8A1 | 10396 | NP_001098999 | 1224 | ATPase, aminophospholipid transporter (APLT), class I, type 8A, member 1 |
| ATP8A1 | 10396 | NP_006086 | 3433 | ATPase, aminophospholipid transporter (APLT), class I, type 8A, member 1 |
| ATP8A2 | 51761 | NP_057613 | 4237 | ATPase, aminophospholipid transporter-like, class I, type 8A, member 2 |
| ATP8B1 | 5205 | NP_005594 | 3323 | ATPase, class I, type 8B, member 1 |
| ATP8B2 | 57198 | NP_001005855.1 | 7339 | ATPase phospholipid transporting 8B2 |
| ATP8B3 | 148229 | NP_620168 | 5801 | ATPase, class I, type 8B, member 3 |
| ATP8B4 | 79895 | NP_079113 | 5090 | ATPase, class I, type 8B, member 4 |
| ATP9A | 10079 | NP_006036 | 3420 | ATPase, class II, type 9A |
| ATP9B | 374868 | NP_940933 | 6809 | ATPase, class II, type 9B |
| ATRAID | 51374 | NP_001164266 | 2256 | chromosome 2 open reading frame 28 |
| ATRAID | 51374 | NP_057169 | 4166 | chromosome 2 open reading frame 28 |
| ATRAID | 51374 | NP_542159 | 5608 | chromosome 2 open reading frame 28 |
| ATRN | 8455 | NP_647537 | 5855 | attractin |
| ATRN | 8455 | NP_647538 | 5856 | attractin |
| ATRNL1 | 26033 | NP_997186 | 7004 | attractin-like 1 |
| AUP1 | 550 | NP_853553 | 6611 | ancient ubiquitous protein 1 |
| AVPR1A | 552 | NP_000697 | 206 | arginine vasopressin receptor 1A |
| AVPR1B | 553 | NP_000698 | 207 | arginine vasopressin receptor 1B |
| AVPR2 | 554 | NP_000045 | 12 | arginine vasopressin receptor 2 |
| AVPR2 | 554 | NP_001139623 | 1907 | arginine vasopressin receptor 2 |
| AWAT1 | 158833 | NP_001013597 | 615 | acyl-CoA wax alcohol acyltransferase 1 |
| AXL | 558 | NP_001690 | 2438 | AXL receptor tyrosine kinase |
| AXL | 558 | NP_068713 | 4847 | AXL receptor tyrosine kinase |
| B3GALNT1 | 8706 | NP_001033717 | 784 | beta-1,3-N-acetylgalactosaminyltransferase 1 (globoside blood group) |
| B3GALNT1 | 8706 | NP_003772 | 2892 | beta-1,3-N-acetylgalactosaminyltransferase 1 (globoside blood group) |
| B3GALNT1 | 8706 | NP_149357 | 5455 | beta-1,3-N-acetylgalactosaminyltransferase 1 (globoside blood group) |
| B3GALNT1 | 8706 | NP_149358 | 5456 | beta-1,3-N-acetylgalactosaminyltransferase 1 (globoside blood group) |
| B3GALNT1 | 8706 | NP_149359 | 5457 | beta-1,3-N-acetylgalactosaminyltransferase 1 (globoside blood group) |
| B3GALT1 | 8708 | NP_066191 | 4751 | UDP-Gal:betaGlcNAc beta 1,3-galactosyltransferase, polypeptide 1 |
| B3GALT2 | 8707 | NP_003774 | 2894 | UDP-Gal:betaGlcNAc beta 1,3-galactosyltransferase, polypeptide 2 |
| B3GALT4 | 8705 | NP_003773 | 2893 | UDP-Gal:betaGlcNAc beta 1,3-galactosyltransferase, polypeptide 4 |
| B3GALT5 | 10317 | NP_006048 | 3424 | UDP-Gal:betaGlcNAc beta 1,3-galactosyltransferase, polypeptide 5 |
| B3GALT5 | 10317 | NP_149360 | 5458 | UDP-Gal:betaGlcNAc beta 1,3-galactosyltransferase, polypeptide 5 |
| B3GALT5 | 10317 | NP_149361 | 5459 | UDP-Gal:betaGlcNAc beta 1,3-galactosyltransferase, polypeptide 5 |
| B3GALT5 | 10317 | NP_149362 | 5460 | UDP-Gal:betaGlcNAc beta 1,3-galactosyltransferase, polypeptide 5 |
| B3GALT5 | 10317 | NP_149363 | 5461 | UDP-Gal:betaGlcNAc beta 1,3-galactosyltransferase, polypeptide 5 |
| B3GALT6 | 126792 | NP_542172 | 5610 | UDP-Gal:betaGal beta 1,3-galactosyltransferase polypeptide 6 |
| B3GAT1 | 27087 | NP_061114 | 4475 | beta-1,3-glucuronyltransferase 1 (glucuronosyltransferase P) |
| B3GAT1 | 27087 | NP_473366 | 5567 | beta-1,3-glucuronyltransferase 1 (glucuronosyltransferase P) |
| B3GAT2 | 135152 | NP_542780 | 5625 | beta-1,3-glucuronyltransferase 2 (glucuronosyltransferase S) |
| B3GAT3 | 26229 | NP_036332 | 3720 | beta-1,3-glucuronyltransferase 3 (glucuronosyltransferase I) |
| B3GLCT | 145173 | NP_919299 | 6718 | beta 1,3-galactosyltransferase-like |
| B3GNT2 | 10678 | NP_001306004.1 | 3518 | UDP-GlcNAc:betaGal beta 1,3-N-acetylglucosaminyltransferase 1 |
| B3GNT2 | 10678 | NP_006867 | 3588 | UDP-GlcNAc:betaGal beta 1,3-N-acetylglucosaminyltransferase 1 |
| B3GNT3 | 10331 | NP_055071 | 3898 | UDP-GlcNAc:betaGal beta 1,3-N-acetylglucosaminyltransferase 3 |
| B3GNT5 | 84002 | NP_114436 | 5286 | UDP-GlcNAc:betaGal beta 1,3-N-acetylglucosaminyltransferase 5 |
| B3GNT6 | 192134 | NP_619651 | 5773 | UDP-GlcNAc:betaGal beta 1,3-N-acetylglucosaminyltransferase 6 (core 3 synthase) |
| B4GALNT1 | 2583 | NP_001469 | 2385 | beta-1,4-N-acetyl-galactosaminyl transferase 1 |
| B4GALNT2 | 124872 | NP_001152859 | 1939 | beta-1,4-N-acetyl-galactosaminyl transferase 2 |

FIG. 2 (CONT.)

| Antigen | GeneID | Accession No. | SEQ ID NO: | RefSeq Gene Name |
|---|---|---|---|---|
| B4GALNT2 | 124872 | NP_001152860 | 1940 | beta-1,4-N-acetyl-galactosaminyl transferase 2 |
| B4GALNT2 | 124872 | NP_703147 | 6193 | beta-1,4-N-acetyl-galactosaminyl transferase 2 |
| B4GALNT3 | 283358 | NP_775864 | 6361 | beta-1,4-N-acetyl-galactosaminyl transferase 3 |
| B4GALNT4 | 338707 | NP_848632 | 6551 | beta-1,4-N-acetyl-galactosaminyl transferase 4 |
| B4GALT1 | 2683 | NP_001488 | 2390 | UDP-Gal:betaGlcNAc beta 1,4- galactosyltransferase, polypeptide 1 |
| B4GALT3 | 8703 | NP_003770 | 2891 | UDP-Gal:betaGlcNAc beta 1,4- galactosyltransferase, polypeptide 3 |
| B4GALT4 | 8702 | NP_003769 | 2890 | UDP-Gal:betaGlcNAc beta 1,4- galactosyltransferase, polypeptide 4 |
| B4GALT4 | 8702 | NP_997708 | 7035 | UDP-Gal:betaGlcNAc beta 1,4- galactosyltransferase, polypeptide 4 |
| B4GALT5 | 9334 | NP_004767 | 3122 | UDP-Gal:betaGlcNAc beta 1,4- galactosyltransferase, polypeptide 5 |
| B4GALT6 | 9331 | NP_004766 | 3121 | UDP-Gal:betaGlcNAc beta 1,4- galactosyltransferase, polypeptide 6 |
| B4GALT7 | 11285 | NP_009186 | 3661 | xylosylprotein beta 1,4-galactosyltransferase, polypeptide 7 (galactosyltransferase I) |
| B4GAT1 | 11041 | NP_006867.1 | 3517 | UDP-GlcNAc:betaGal beta-1,3-N-acetylglucosaminyltransferase 1 |
| B4GAT1 | 11041 | NP_006867.1 | 3587 | UDP-GlcNAc:betaGal beta-1,3-N-acetylglucosaminyltransferase 1 |
| BACE1 | 23621 | NP_036236 | 3704 | beta-site APP-cleaving enzyme 1 |
| BACE1 | 23621 | NP_620427 | 5811 | beta-site APP-cleaving enzyme 1 |
| BACE1 | 23621 | NP_620428 | 5812 | beta-site APP-cleaving enzyme 1 |
| BACE1 | 23621 | NP_620429 | 5813 | beta-site APP-cleaving enzyme 1 |
| BACE2 | 25825 | NP_036237 | 3705 | beta-site APP-cleaving enzyme 2 |
| BACE2 | 25825 | NP_620476 | 5814 | beta-site APP-cleaving enzyme 2 |
| BACE2 | 25825 | NP_620477 | 5815 | beta-site APP-cleaving enzyme 2 |
| BAGE | 574 | NP_001178.1 | 7269 | B melanoma antigen |
| BAMBI | 25805 | NP_036474 | 3751 | hypothetical LOC729590 BMP and activin membrane-bound inhibitorHomolog (Xenopus laevis) |
| BANP | 54971 | NP_060339 | 4361 | BTG3 associated nuclear protein |
| BANP | 54971 | NP_524576 | 5597 | BTG3 associated nuclear protein |
| BAX | 581 | NP_004315 | 3018 | BCL2-associated X protein |
| BAX | 581 | NP_620116 | 5786 | BCL2-associated X protein |
| BAX | 581 | NP_620118 | 5787 | BCL2-associated X protein |
| BAX | 581 | NP_620119 | 5788 | BCL2-associated X protein |
| BAX | 581 | NP_620120 | 5789 | BCL2-associated X protein |
| BBS4 | 585 | NP_149017 | 5439 | Bardet-Biedl syndrome 4 |
| BCAM | 4059 | NP_001013275 | 611 | basal cell adhesion molecule (Lutheran blood group) |
| BCAM | 4059 | NP_005572 | 3317 | basal cell adhesion molecule (Lutheran blood group) |
| BCAN | 63827 | NP_068767.3 | 7332 | brevican |
| BCAP29 | 55973 | NP_001008405 | 534 | B-cell receptor-associated protein 29 |
| BCAP29 | 55973 | NP_001008406 | 535 | B-cell receptor-associated protein 29 |
| BCAP29 | 55973 | NP_001008407 | 536 | B-cell receptor-associated protein 29 |
| BCAP29 | 55973 | NP_061332 | 4492 | B-cell receptor-associated protein 29 |
| BCAP31 | 10134 | NP_001132913 | 1616 | B-cell receptor-associated protein 31 |
| BCAP31 | 10134 | NP_001132929 | 1619 | B-cell receptor-associated protein 31 |
| BCAP31 | 10134 | NP_005736 | 3355 | B-cell receptor-associated protein 31 |
| BCHE | 590 | NP_000046 | 13 | butyrylcholinesterase |
| BCL2 | 596 | NP_000624 | 182 | B-cell CLL/lymphoma 2 |
| BCL2 | 596 | NP_000648 | 188 | B-cell CLL/lymphoma 2 |
| BCL2L1 | 598 | NP_001182 | 2311 | BCL2-like 1 |
| BCL2L1 | 598 | NP_612815 | 5763 | BCL2-like 1 |
| BCL2L10 | 10017 | NP_065129 | 4645 | BCL2-like 10 (apoptosis facilitator) |
| BCL2L13 | 23786 | NP_056182 | 4069 | BCL2-like 13 (apoptosis facilitator) |
| BCL2L2 | 599 | NP_004041 | 2952 | BCL2-like 2 |
| BCS1L | 617 | NP_001073335 | 1008 | BCS1-like (yeast) |
| BCS1L | 617 | NP_004319 | 3019 | BCS1-like (yeast) |
| BDKRB1 | 623 | NP_000701 | 208 | bradykinin receptor B1 |
| BDKRB2 | 624 | NP_000614 | 177 | bradykinin receptor B2 |
| BDNF | 627 | NP_001137277 | 1717 | brain-derived neurotrophic factor |
| BDNF | 627 | NP_001137278 | 1718 | brain-derived neurotrophic factor |
| BDNF | 627 | NP_001137279 | 1719 | brain-derived neurotrophic factor |
| BDNF | 627 | NP_001137280 | 1720 | brain-derived neurotrophic factor |
| BDNF | 627 | NP_001137281 | 1721 | brain-derived neurotrophic factor |
| BDNF | 627 | NP_001137282 | 1722 | brain-derived neurotrophic factor |
| BDNF | 627 | NP_001137283 | 1723 | brain-derived neurotrophic factor |
| BDNF | 627 | NP_001137284 | 1724 | brain-derived neurotrophic factor |
| BDNF | 627 | NP_001137285 | 1725 | brain-derived neurotrophic factor |
| BDNF | 627 | NP_001137286 | 1726 | brain-derived neurotrophic factor |
| BDNF | 627 | NP_001137277.1 | 1727 | brain-derived neurotrophic factor |
| BDNF | 627 | NP_001137288 | 1728 | brain-derived neurotrophic factor |
| BDNF | 627 | NP_001700 | 2442 | brain-derived neurotrophic factor |
| BDNF | 627 | NP_733927 | 6251 | brain-derived neurotrophic factor |
| BDNF | 627 | NP_733928 | 6252 | brain-derived neurotrophic factor |
| BDNF | 627 | NP_733929 | 6253 | brain-derived neurotrophic factor |
| BDNF | 627 | NP_733930 | 6254 | brain-derived neurotrophic factor |
| BDNF | 627 | NP_733931 | 6255 | brain-derived neurotrophic factor |
| BEST1 | 7439 | NP_001132915 | 1617 | bestrophin 1 |
| BEST1 | 7439 | NP_004174 | 2982 | bestrophin 1 |
| BEST2 | 54831 | NP_060152 | 4323 | bestrophin 2 |
| BEST3 | 144453 | NP_116124 | 5392 | bestrophin 3 |
| BEST3 | 144453 | NP_689652 | 6059 | bestrophin 3 |
| BEST4 | 266675 | NP_695006 | 6171 | bestrophin 4 |
| BET1 | 10282 | NP_001304668.1 | 2028 | hypothetical protein LOC100128542 blocked early in transport 1Homolog (S. cerevisiae) |

FIG. 2 (CONT.)

| Antigen | GeneID | Accession No. | SEQ ID NO: | RefSeq Gene Name |
|---|---|---|---|---|
| BET1 | 10282 | NP_005859 | 3391 | hypothetical protein LOC100128542 blocked early in transport 1Homolog (S. cerevisiae) |
| BET1L | 51272 | NP_001092257 | 1145 | blocked early in transport 1Homolog (S. cerevisiae)-like |
| BET1L | 51272 | NP_057610 | 4236 | blocked early in transport 1Homolog (S. cerevisiae)-like |
| BFAR | 51283 | NP_057645 | 4243 | bifunctional apoptosis regulator |
| BIK | 638 | NP_001188 | 2313 | BCL2-interacting killer (apoptosis-inducing) |
| BIRC5 | 332 | NP_001012270.1 | 7342 | baculoviral IAP repeat containing 5 |
| BLCAP | 10904 | NP_001161292 | 2198 | bladder cancer associated protein |
| BLCAP | 10904 | NP_001161293 | 2199 | bladder cancer associated protein |
| BLCAP | 10904 | NP_001161294 | 2200 | bladder cancer associated protein |
| BLCAP | 10904 | NP_001161295 | 2201 | bladder cancer associated protein |
| BLCAP | 10904 | NP_006689 | 3549 | bladder cancer associated protein |
| BMP10 | 27302 | NP_055297 | 3945 | bone morphogenetic protein 10 |
| BMP2 | 650 | NP_001191 | 2314 | bone morphogenetic protein 2 |
| BMPR1A | 657 | NP_004320 | 3020 | bone morphogenetic protein receptor, type IA |
| BMPR1B | 658 | NP_001194 | 2315 | bone morphogenetic protein receptor, type IB |
| BMPR2 | 659 | NP_001195 | 2316 | bone morphogenetic protein receptor, type II (serine/threonine kinase) |
| BMX | 660 | NP_001712 | 2444 | BMX non-receptor tyrosine kinase |
| BMX | 660 | NP_975010 | 6920 | BMX non-receptor tyrosine kinase |
| BNIP1 | 662 | NP_001196 | 2317 | BCL2/adenovirus E1B 19kDa interacting protein 1 |
| BNIP1 | 662 | NP_053581 | 3842 | BCL2/adenovirus E1B 19kDa interacting protein 1 |
| BNIP1 | 662 | NP_053582 | 3843 | BCL2/adenovirus E1B 19kDa interacting protein 1 |
| BNIP1 | 662 | NP_053583 | 3844 | BCL2/adenovirus E1B 19kDa interacting protein 1 |
| BNIP2 | 663 | NP_004321 | 3021 | BCL2/adenovirus E1B 19kDa interacting protein 2 |
| BNIP3 | 664 | NP_004043 | 2953 | BCL2/adenovirus E1B 19kDa interacting protein 3 |
| BNIP3L | 665 | NP_004322 | 3022 | BCL2/adenovirus E1B 19kDa interacting protein 3-like |
| BOC | 91653 | NP_150279 | 5474 | BocHomolog (mouse) |
| BPI | 671 | NP_001716 | 2446 | bactericidal/permeability-increasing protein |
| BPIFB1 | 92747 | NP_149974 | 5465 | chromosome 20 open reading frame 114 |
| BPIFB2 | 80341 | NP_079503 | 5136 | bactericidal/permeability-increasing protein-like 1 |
| BRCA1 | 672 | NP_009225 | 3672 | breast cancer 1, early onset |
| BRCA1 | 672 | NP_009226 | 3673 | breast cancer 1, early onset |
| BRCA1 | 672 | NP_009227 | 3674 | breast cancer 1, early onset |
| BRCA1 | 672 | NP_009228 | 3675 | breast cancer 1, early onset |
| BRCA1 | 672 | NP_009229 | 3676 | breast cancer 1, early onset |
| BRCA1 | 672 | NP_009230 | 3677 | breast cancer 1, early onset |
| BRCA1 | 672 | NP_009231 | 3678 | breast cancer 1, early onset |
| BRCA1 | 672 | NP_009233 | 3679 | breast cancer 1, early onset |
| BRCA1 | 672 | NP_009234 | 3680 | breast cancer 1, early onset |
| BRCA1 | 672 | NP_009235 | 3681 | breast cancer 1, early onset |
| BRCA1 | 672 | NP_009236 | 3682 | breast cancer 1, early onset |
| BRI3 | 25798 | NP_001152963 | 1944 | brain protein I3 brain protein I3 pseudogene 1 |
| BRI3 | 25798 | NP_056194 | 4072 | brain protein I3 brain protein I3 pseudogene 1 |
| BRICD5 | 283870 | NP_872369 | 6661 | chromosome 16 open reading frame 79 |
| BRINP2 | 57795 | NP_066988 | 4785 | family with sequence similarity 5, member B |
| BRS3 | 680 | NP_001718 | 2447 | bombesin-like receptor 3 |
| BSG | 682 | NP_001719 | 2448 | basigin (Ok blood group) |
| BSG | 682 | NP_940991 | 6821 | basigin (Ok blood group) |
| BSG | 682 | NP_940993 | 6822 | basigin (Ok blood group) |
| BSND | 7809 | NP_476517 | 5579 | Bartter syndrome, infantile, with sensorineural deafness (Barttin) |
| BST1 | 683 | NP_004325 | 3023 | bone marrow stromal cell antigen 1 |
| BST2 | 684 | NP_004326 | 3024 | NPC-A-7, bone marrow stromal cell antigen 2 |
| BTC | 685 | NP_001720 | 2449 | betacellulin |
| BTLA | 151888 | NP_001078826 | 1090 | B and T lymphocyte associated |
| BTLA | 151888 | NP_861445 | 6632 | B and T lymphocyte associated |
| BTN1A1 | 696 | NP_001723 | 2450 | butyrophilin, subfamily 1, member A1 |
| BTN2A1 | 11120 | NP_008980 | 3621 | butyrophilin, subfamily 2, member A1 |
| BTN2A1 | 11120 | NP_510961 | 5591 | butyrophilin, subfamily 2, member A1 |
| BTN2A2 | 10385 | NP_008926 | 3609 | butyrophilin, subfamily 2, member A2 |
| BTN2A2 | 10385 | NP_853509 | 6607 | butyrophilin, subfamily 2, member A2 |
| BTN3A1 | 11119 | NP_001138480 | 1804 | butyrophilin, subfamily 3, member A1 |
| BTN3A1 | 11119 | NP_001138481 | 1805 | butyrophilin, subfamily 3, member A1 |
| BTN3A1 | 11119 | NP_008979 | 3620 | butyrophilin, subfamily 3, member A1 |
| BTN3A1 | 11119 | NP_919423 | 6725 | butyrophilin, subfamily 3, member A1 |
| BTN3A2 | 11118 | NP_008978 | 3619 | butyrophilin, subfamily 3, member A2 |
| BTN3A3 | 10384 | NP_008925 | 3608 | butyrophilin, subfamily 3, member A3 |
| BTN3A3 | 10384 | NP_932078 | 6736 | butyrophilin, subfamily 3, member A3 |
| BTNL2 | 56244 | NP_062548 | 4575 | butyrophilin-like 2 (MHC class II associated) |
| BTNL3 | 10917 | NP_932079 | 6737 | butyrophilin-like 3 |
| BTNL8 | 79908 | NP_001035552 | 874 | butyrophilin-like 8 |
| BTNL8 | 79908 | NP_001153179 | 1952 | butyrophilin-like 8 |
| BTNL8 | 79908 | NP_001153180 | 1953 | butyrophilin-like 8 |
| BTNL8 | 79908 | NP_001153181 | 1954 | butyrophilin-like 8 |
| BTNL8 | 79908 | NP_001153182 | 1955 | butyrophilin-like 8 |
| BTNL8 | 79908 | NP_079126 | 5093 | butyrophilin-like 8 |
| BTNL9 | 153579 | NP_689760 | 6079 | butyrophilin-like 9 |
| BVES | 11149 | NP_009004 | 3627 | blood vessel epicardial substance |
| BVES | 11149 | NP_671488 | 5990 | blood vessel epicardial substance |

FIG. 2 (CONT.)

| Antigen | GeneID | Accession No. | SEQ ID NO: | RefSeq Gene Name |
|---|---|---|---|---|
| C10orf35 | 219738 | NP_660349 | 5959 | chromosome 10 open reading frame 35 |
| C10orf54 | 64115 | NP_071436 | 4888 | chromosome 10 open reading frame 54 |
| C10orf99 | 387695 | NP_997256 | 7018 | chromosome 10 open reading frame 99 |
| C11orf24 | 53838 | NP_071733 | 4898 | chromosome 11 open reading frame 24 |
| C11orf87 | 399947 | NP_997528 | 7032 | chromosome 11 open reading frame 87 |
| C12orf49 | 79794 | NP_079014 | 5073 | chromosome 12 open reading frame 49 |
| C12orf73 | 728568 | NP_001129042 | 1540 | chromosome 12 open reading frame 73 |
| C14orf1 | 11161 | NP_009107 | 3644 | chromosome 14 open reading frame 1 |
| C14orf180 | 400258 | NP_001008404 | 533 | chromosome 14 open reading frame 180 |
| C14orf2 | 9556 | NP_001120865 | 1324 | chromosome 14 open reading frame 2 |
| C14orf2 | 9556 | NP_004885 | 3163 | chromosome 14 open reading frame 2 |
| C14orf37 | 145407 | NP_001001872 | 377 | chromosome 14 open reading frame 37 |
| C15orf27 | 123591 | NP_689548 | 6035 | chromosome 15 open reading frame 27 |
| C15orf48 | 84419 | NP_115789 | 5352 | chromosome 15 open reading frame 48 |
| C15orf48 | 84419 | NP_922946 | 6733 | chromosome 15 open reading frame 48 |
| C16orf54 | 283897 | NP_787096 | 6466 | chromosome 16 open reading frame 54 |
| C16orf58 | 64755 | NP_073581 | 4941 | chromosome 16 open reading frame 58 |
| C16orf91 | 283951 | NP_001258980.1 | 574 | chromosome 16 open reading frame 91 |
| C16orf92 | 146378 | NP_001103129 | 1234 | chromosome 16 open reading frame 92 |
| C16orf92 | 146378 | NP_001103130 | 1235 | chromosome 16 open reading frame 92 |
| C17orf62 | 79415 | NP_001028218 | 752 | chromosome 17 open reading frame 62 |
| C17orf62 | 79415 | NP_001093877 | 1186 | chromosome 17 open reading frame 62 |
| C17orf62 | 79415 | NP_001093878 | 1187 | chromosome 17 open reading frame 62 |
| C17orf74 | 201243 | NP_783861 | 6456 | chromosome 17 open reading frame 74 |
| C17orf78 | 284099 | NP_775896 | 6365 | chromosome 17 open reading frame 78 |
| C19orf12 | 83636 | NP_001026896 | 729 | chromosome 19 open reading frame 12 |
| C19orf12 | 83636 | NP_113636 | 5226 | chromosome 19 open reading frame 12 |
| C19orf18 | 147685 | NP_689687 | 6066 | chromosome 19 open reading frame 18 |
| C19orf24 | 55009 | NP_060384 | 4369 | chromosome 19 open reading frame 24 |
| C19orf26 | 255057 | NP_689982 | 6113 | chromosome 19 open reading frame 26 |
| C1GALT1 | 56913 | NP_064541 | 4606 | core 1 synthase, glycoprotein-N-acetylgalactosamine 3-beta-galactosyltransferase, 1 |
| C1GALT1C1 | 29071 | NP_001011551 | 588 | C1GALT1-specific chaperone 1 |
| C1GALT1C1 | 29071 | NP_689905 | 6100 | C1GALT1-specific chaperone 1 |
| C1orf101 | 257044 | NP_001124429 | 1450 | chromosome 1 open reading frame 101 |
| C1orf101 | 257044 | NP_776168 | 6388 | chromosome 1 open reading frame 101 |
| C1orf115 | 79762 | NP_078985 | 5068 | chromosome 1 open reading frame 115 |
| C1orf159 | 54991 | NP_060361 | 4364 | chromosome 1 open reading frame 159 |
| C1orf162 | 128346 | NP_777556 | 6405 | chromosome 1 open reading frame 162 |
| C1orf186 | 440712 | NP_001007545 | 523 | chromosome 1 open reading frame 186 |
| C1orf210 | 149466 | NP_001158301 | 2116 | chromosome 1 open reading frame 210 |
| C1orf210 | 149466 | NP_872323 | 6648 | chromosome 1 open reading frame 210 |
| C1orf233 | 643988 | NP_001229588 | 7101 | C1orf233 chromosome 1 open reading frame 233, fibronectin type-III domain-containing transmembrane protein C1orf233 precurso |
| C1orf234 | 729059 | NP_001229450 | 7116 | chromosome 1 open reading frame 234 |
| C1orf27 | 54953 | NP_001157717 | 2070 | chromosome 1 open reading frame 27 |
| C1orf27 | 54953 | NP_001157718 | 2071 | chromosome 1 open reading frame 27 |
| C1orf27 | 54953 | NP_060317 | 4355 | chromosome 1 open reading frame 27 |
| C1orf43 | 25912 | NP_001092086 | 1140 | chromosome 1 open reading frame 43 |
| C1orf43 | 25912 | NP_056264 | 4085 | chromosome 1 open reading frame 43 |
| C1orf43 | 25912 | NP_620077 | 5785 | chromosome 1 open reading frame 43 |
| C1orf95 | 375057 | NP_001003665 | 410 | chromosome 1 open reading frame 95 |
| C1QB | 713 | NP_000482 | 138 | complement component 1, q subcomponent, B chain |
| C1QTNF1 | 114897 | NP_112230 | 5208 | C1q and tumor necrosis factor related protein 1 |
| C1QTNF1 | 114897 | NP_940995 | 6823 | C1q and tumor necrosis factor related protein 1 |
| C1QTNF1 | 114897 | NP_940996 | 6824 | C1q and tumor necrosis factor related protein 1 |
| C1QTNF6 | 114904 | NP_114116 | 5267 | C1q and tumor necrosis factor related protein 6 |
| C1QTNF6 | 114904 | NP_872292 | 6644 | C1q and tumor necrosis factor related protein 6 |
| C20orf173 | 140873 | NP_001138822 | 1854 | chromosome 20 open reading frame 173 |
| C2CD2 | 25966 | NP_056315 | 4092 | C2 calcium-dependent domain containing 2 |
| C2CD2 | 25966 | NP_950251 | 6853 | C2 calcium-dependent domain containing 2 |
| C2CD2L | 9854 | NP_055622 | 3992 | C2CD2-like |
| C2CD5 | 9847 | NP_055617 | 3991 | KIAA0528 |
| C2orf40 | 84417 | NP_115787 | 5351 | chromosome 2 open reading frame 40 |
| C2orf74 | 339804 | NP_001137431 | 1741 | chromosome 2 open reading frame 74 |
| C2orf74 | 339804 | NP_001137432 | 1742 | chromosome 2 open reading frame 74 |
| C2orf82 | 389084 | NP_996778 | 6976 | chromosome 2 open reading frame 82 |
| C2orf83 | 56918 | NP_001155955 | 2029 | chromosome 2 open reading frame 83 |
| C2orf83 | 56918 | NP_064546 | 4608 | chromosome 2 open reading frame 83 |
| C3AR1 | 719 | NP_004045 | 2954 | complement component 3a receptor 1 |
| C3orf18 | 51161 | NP_001165211 | 2280 | chromosome 3 open reading frame 18 |
| C3orf18 | 51161 | NP_001165212 | 2281 | chromosome 3 open reading frame 18 |
| C3orf18 | 51161 | NP_001165214 | 2282 | chromosome 3 open reading frame 18 |
| C3orf18 | 51161 | NP_057294 | 4184 | chromosome 3 open reading frame 18 |
| C3orf52 | 79669 | NP_001165218 | 2283 | chromosome 3 open reading frame 52 |
| C3orf52 | 79669 | NP_078892 | 5056 | chromosome 3 open reading frame 52 |
| C3orf80 | 401097 | NP_001161686 | 2210 | Similar to LOC166075 |
| C4orf26 | 152816 | NP_848592 | 6544 | chromosome 4 open reading frame 26 |

FIG. 2 (CONT.)

| Antigen | GeneID | Accession No. | SEQ ID NO: | RefSeq Gene Name |
|---|---|---|---|---|
| C4orf3 | 401152 | NP_001001701 | 374 | chromosome 4 open reading frame 3 |
| C4orf3 | 401152 | NP_001163801 | 2239 | chromosome 4 open reading frame 3 |
| C4orf32 | 132720 | NP_689613 | 6051 | chromosome 4 open reading frame 32 |
| C5AR1 | 728 | NP_001727 | 2451 | complement component 5a receptor 1 |
| C5AR2 | 27202 | NP_060955 | 4461 | G protein-coupled receptor 77 |
| C5orf15 | 56951 | NP_064584 | 4616 | chromosome 5 open reading frame 15 |
| C5orf28 | 64417 | NP_071928 | 4924 | chromosome 5 open reading frame 28 |
| C5orf46 | 389336 | NP_996849 | 6994 | chromosome 5 open reading frame 46 |
| C6orf10 | 10665 | NP_006772 | 3561 | chromosome 6 open reading frame 10 |
| C6orf136 | 221545 | NP_001103408 | 1237 | chromosome 6 open reading frame 136 |
| C6orf136 | 221545 | NP_001154848 | 2006 | chromosome 6 open reading frame 136 |
| C6orf136 | 221545 | NP_659466 | 5920 | chromosome 6 open reading frame 136 |
| C6orf25 | 80739 | NP_079536 | 5143 | chromosome 6 open reading frame 25 |
| C6orf25 | 80739 | NP_612116 | 5713 | chromosome 6 open reading frame 25 |
| C6orf25 | 80739 | NP_612117 | 5714 | chromosome 6 open reading frame 25 |
| C6orf25 | 80739 | NP_612118 | 5715 | chromosome 6 open reading frame 25 |
| C6orf25 | 80739 | NP_612119 | 5716 | chromosome 6 open reading frame 25 |
| C6orf25 | 80739 | NP_612121 | 5717 | chromosome 6 open reading frame 25 |
| C6orf89 | 221477 | NP_689947 | 6107 | chromosome 6 open reading frame 89 |
| C8B | 732 | NP_000057 | 14 | complement component 8, beta polypeptide |
| C9orf57 | 138240 | NP_001122090 | 1375 | chromosome 9 open reading frame 57 |
| C9orf69 | 90120 | NP_690046 | 6117 | chromosome 9 open reading frame 69 |
| C9orf89 | 84270 | NP_115686 | 5322 | chromosome 9 open reading frame 89 |
| C9orf91 | 203197 | NP_694590 | 6153 | chromosome 9 open reading frame 91 |
| CA12 | 771 | NP_001209 | 2319 | carbonic anhydrase XII |
| CA12 | 771 | NP_996808 | 6982 | carbonic anhydrase XII |
| CA14 | 23632 | NP_036245 | 3708 | carbonic anhydrase XIV |
| CA4 | 762 | NP_000708 | 210 | carbonic anhydrase IV |
| CA9 | 768 | NP_001207 | 2318 | carbonic anhydrase IX |
| CABP7 | 164633 | NP_872333 | 6651 | calcium binding protein 7 |
| CACFD1 | 11094 | NP_001129247 | 1566 | chromosome 9 open reading frame 7 |
| CACFD1 | 11094 | NP_060056 | 4310 | chromosome 9 open reading frame 7 |
| CACHD1 | 57685 | NP_065976 | 4741 | cache domain containing 1 |
| CACNA1A | 773 | NP_001120693 | 1313 | calcium channel, voltage-dependent, P/Q type, alpha 1A subunit |
| CACNA1A | 773 | NP_001120694 | 1314 | calcium channel, voltage-dependent, P/Q type, alpha 1A subunit |
| CACNA1B | 774 | NP_000709 | 211 | calcium channel, voltage-dependent, N type, alpha 1B subunit |
| CACNA1C | 775 | NP_000710 | 212 | hypothetical protein LOC100131098 calcium channel, voltage-dependent, L type, alpha 1C subunit |
| CACNA1C | 775 | NP_001123299 | 1384 | hypothetical protein LOC100131098 calcium channel, voltage-dependent, L type, alpha 1C subunit |
| CACNA1C | 775 | NP_001123301 | 1385 | hypothetical protein LOC100131098 calcium channel, voltage-dependent, L type, alpha 1C subunit |
| CACNA1C | 775 | NP_001123302 | 1386 | hypothetical protein LOC100131098 calcium channel, voltage-dependent, L type, alpha 1C subunit |
| CACNA1C | 775 | NP_001123303 | 1387 | hypothetical protein LOC100131098 calcium channel, voltage-dependent, L type, alpha 1C subunit |
| CACNA1C | 775 | NP_001123304 | 1388 | hypothetical protein LOC100131098 calcium channel, voltage-dependent, L type, alpha 1C subunit |
| CACNA1C | 775 | NP_001123305 | 1389 | hypothetical protein LOC100131098 calcium channel, voltage-dependent, L type, alpha 1C subunit |
| CACNA1C | 775 | NP_001123306 | 1390 | hypothetical protein LOC100131098 calcium channel, voltage-dependent, L type, alpha 1C subunit |
| CACNA1C | 775 | NP_001123307 | 1391 | hypothetical protein LOC100131098 calcium channel, voltage-dependent, L type, alpha 1C subunit |
| CACNA1C | 775 | NP_001123308 | 1392 | hypothetical protein LOC100131098 calcium channel, voltage-dependent, L type, alpha 1C subunit |
| CACNA1C | 775 | NP_001123309 | 1393 | hypothetical protein LOC100131098 calcium channel, voltage-dependent, L type, alpha 1C subunit |
| CACNA1C | 775 | NP_001123310 | 1394 | hypothetical protein LOC100131098 calcium channel, voltage-dependent, L type, alpha 1C subunit |
| CACNA1C | 775 | NP_001123311 | 1395 | hypothetical protein LOC100131098 calcium channel, voltage-dependent, L type, alpha 1C subunit |
| CACNA1C | 775 | NP_001123312 | 1396 | hypothetical protein LOC100131098 calcium channel, voltage-dependent, L type, alpha 1C subunit |
| CACNA1C | 775 | NP_001123313 | 1397 | hypothetical protein LOC100131098 calcium channel, voltage-dependent, L type, alpha 1C subunit |
| CACNA1C | 775 | NP_001123314 | 1398 | hypothetical protein LOC100131098 calcium channel, voltage-dependent, L type, alpha 1C subunit |
| CACNA1C | 775 | NP_001123315 | 1399 | hypothetical protein LOC100131098 calcium channel, voltage-dependent, L type, alpha 1C subunit |
| CACNA1C | 775 | NP_001123316 | 1400 | hypothetical protein LOC100131098 calcium channel, voltage-dependent, L type, alpha 1C subunit |
| CACNA1C | 775 | NP_001123318 | 1401 | hypothetical protein LOC100131098 calcium channel, voltage-dependent, L type, alpha 1C subunit |
| CACNA1C | 775 | NP_001161095 | 2189 | hypothetical protein LOC100131098 calcium channel, voltage-dependent, L type, alpha 1C subunit |
| CACNA1C | 775 | NP_001161096 | 2190 | hypothetical protein LOC100131098 calcium channel, voltage-dependent, L type, alpha 1C subunit |
| CACNA1C | 775 | NP_001161097 | 2191 | hypothetical protein LOC100131098 calcium channel, voltage-dependent, L type, alpha 1C subunit |
| CACNA1C | 775 | NP_955630 | 6886 | hypothetical protein LOC100131098 calcium channel, voltage-dependent, L type, alpha 1C subunit |
| CACNA1D | 776 | NP_000711 | 213 | calcium channel, voltage-dependent, L type, alpha 1D subunit |
| CACNA1D | 776 | NP_001122311 | 1377 | calcium channel, voltage-dependent, L type, alpha 1D subunit |
| CACNA1D | 776 | NP_001122312 | 1378 | calcium channel, voltage-dependent, L type, alpha 1D subunit |
| CACNA1E | 777 | NP_000712 | 214 | calcium channel, voltage-dependent, R type, alpha 1E subunit |
| CACNA1F | 778 | NP_005174 | 3224 | calcium channel, voltage-dependent, L type, alpha 1F subunit |
| CACNA1G | 8913 | NP_061496 | 4496 | calcium channel, voltage-dependent, T type, alpha 1G subunit |
| CACNA1G | 8913 | NP_938190 | 6774 | calcium channel, voltage-dependent, T type, alpha 1G subunit |
| CACNA1G | 8913 | NP_938191 | 6775 | calcium channel, voltage-dependent, T type, alpha 1G subunit |
| CACNA1G | 8913 | NP_938192 | 6776 | calcium channel, voltage-dependent, T type, alpha 1G subunit |
| CACNA1G | 8913 | NP_938193 | 6777 | calcium channel, voltage-dependent, T type, alpha 1G subunit |
| CACNA1G | 8913 | NP_938194 | 6778 | calcium channel, voltage-dependent, T type, alpha 1G subunit |
| CACNA1G | 8913 | NP_938196 | 6779 | calcium channel, voltage-dependent, T type, alpha 1G subunit |
| CACNA1G | 8913 | NP_938197 | 6780 | calcium channel, voltage-dependent, T type, alpha 1G subunit |
| CACNA1G | 8913 | NP_938198 | 6781 | calcium channel, voltage-dependent, T type, alpha 1G subunit |
| CACNA1G | 8913 | NP_938199 | 6782 | calcium channel, voltage-dependent, T type, alpha 1G subunit |
| CACNA1G | 8913 | NP_938200 | 6783 | calcium channel, voltage-dependent, T type, alpha 1G subunit |
| CACNA1G | 8913 | NP_938201 | 6784 | calcium channel, voltage-dependent, T type, alpha 1G subunit |
| CACNA1G | 8913 | NP_938202 | 6785 | calcium channel, voltage-dependent, T type, alpha 1G subunit |

FIG. 2 (CONT.)

| Antigen | GeneID | Accession No. | SEQ ID NO: | RefSeq Gene Name |
|---|---|---|---|---|
| CACNA1G | 8913 | NP_938406 | 6788 | calcium channel, voltage-dependent, T type, alpha 1G subunit |
| CACNA1G | 8913 | NP_938407 | 6789 | calcium channel, voltage-dependent, T type, alpha 1G subunit |
| CACNA1H | 8912 | NP_001005407 | 458 | calcium channel, voltage-dependent, T type, alpha 1H subunit |
| CACNA1H | 8912 | NP_066921 | 4770 | calcium channel, voltage-dependent, T type, alpha 1H subunit |
| CACNA1I | 8911 | NP_001003406 | 408 | calcium channel, voltage-dependent, T type, alpha 1I subunit |
| CACNA1I | 8911 | NP_066919 | 4768 | calcium channel, voltage-dependent, T type, alpha 1I subunit |
| CACNA1S | 779 | NP_000060 | 15 | calcium channel, voltage-dependent, L type, alpha 1S subunit |
| CACNG1 | 786 | NP_000718 | 215 | calcium channel, voltage-dependent, gamma subunit 1 |
| CACNG2 | 10369 | NP_006069 | 3430 | calcium channel, voltage-dependent, gamma subunit 2 |
| CACNG3 | 10368 | NP_006530 | 3510 | calcium channel, voltage-dependent, gamma subunit 3 |
| CACNG4 | 27092 | NP_055220 | 3934 | calcium channel, voltage-dependent, gamma subunit 4 |
| CACNG5 | 27091 | NP_665810.1 | 3933 | calcium channel, voltage-dependent, gamma subunit 5 |
| CACNG5 | 27091 | NP_665810 | 5978 | calcium channel, voltage-dependent, gamma subunit 5 |
| CACNG6 | 59285 | NP_114103 | 5265 | calcium channel, voltage-dependent, gamma subunit 6 |
| CACNG6 | 59285 | NP_665813 | 5983 | calcium channel, voltage-dependent, gamma subunit 6 |
| CACNG6 | 59285 | NP_665814 | 5984 | calcium channel, voltage-dependent, gamma subunit 6 |
| CACNG7 | 59284 | NP_114102 | 5264 | calcium channel, voltage-dependent, gamma subunit 7 |
| CACNG8 | 59283 | NP_114101 | 5263 | calcium channel, voltage-dependent, gamma subunit 8 |
| CADM1 | 23705 | NP_001091987 | 1130 | cell adhesion molecule 1 |
| CADM1 | 23705 | NP_055148 | 3916 | cell adhesion molecule 1 |
| CADM2 | 253559 | NP_001161146 | 2194 | cell adhesion molecule 2 |
| CADM2 | 253559 | NP_001161147 | 2195 | cell adhesion molecule 2 |
| CADM2 | 253559 | NP_694854 | 6154 | cell adhesion molecule 2 |
| CADM3 | 57863 | NP_001120645 | 1307 | cell adhesion molecule 3 |
| CADM3 | 57863 | NP_067012 | 4790 | cell adhesion molecule 3 |
| CADM4 | 199731 | NP_660339 | 5956 | cell adhesion molecule 4 |
| CALCR | 799 | NP_001158209 | 2103 | calcitonin receptor |
| CALCR | 799 | NP_001158210 | 2104 | calcitonin receptor |
| CALCR | 799 | NP_001733 | 2452 | calcitonin receptor |
| CALCRL | 10203 | NP_005786 | 3370 | calcitonin receptor-like |
| CALHM1 | 255022 | NP_001001412 | 359 | calciumHomeostasis modulator 1 |
| CALHM2 | 51063 | NP_057000.2 | 7314 | calcium homeostasis modulator 2 |
| CALHM3 | 119395 | NP_001123214 | 1382 | calciumHomeostasis modulator 3 |
| CALN1 | 83698 | NP_001017440 | 645 | calneuron 1 |
| CALN1 | 83698 | NP_113656 | 5230 | calneuron 1 |
| CALY | 50632 | NP_056537 | 4119 | calcyon neuron-specific vesicular protein |
| CAMKMT | 79823 | NP_079042 | 5079 | chromosome 2 open reading frame 34 |
| CAMP | 820 | NP_004336 | 3027 | cathelicidin antimicrobial peptide |
| CANT1 | 124583 | NP_001153244 | 1960 | calcium activated nucleotidase 1 |
| CANT1 | 124583 | NP_001153245 | 1961 | calcium activated nucleotidase 1 |
| CANT1 | 124583 | NP_620148 | 5797 | calcium activated nucleotidase 1 |
| CANX | 821 | NP_001019820 | 683 | calnexin |
| CANX | 821 | NP_001737 | 2453 | calnexin |
| CAPZA2 | 830 | NP_006127 | 3441 | capping protein (actin filament) muscle Z-line, alpha 2 |
| CARKD | 55739 | NP_060680 | 4403 | carbohydrate kinase domain containing |
| CASC4 | 113201 | NP_612432 | 5747 | cancer susceptibility candidate 4 |
| CASC4 | 113201 | NP_816929 | 6511 | cancer susceptibility candidate 4 |
| CASD1 | 64921 | NP_075051 | 4958 | CAS1 domain containing 1 |
| CASR | 846 | NP_000379 | 116 | calcium-sensing receptor |
| CATSPER1 | 117144 | NP_444282 | 5560 | cation channel, sperm associated 1 |
| CATSPER2 | 117155 | NP_473361 | 5564 | cation channel, sperm associated 2 |
| CATSPER2 | 117155 | NP_742093 | 6273 | cation channel, sperm associated 2 |
| CATSPER2 | 117155 | NP_742095 | 6274 | cation channel, sperm associated 2 |
| CATSPER3 | 347732 | NP_821138 | 6514 | cation channel, sperm associated 3 |
| CATSPERB | 79820 | NP_079040 | 5078 | cation channel, sperm-associated, beta |
| CATSPERD | 257062 | NP_689997.3 | 7356 | cation channel sperm associated auxiliary subunit delta |
| CATSPERG | 57828 | NP_067008 | 4789 | chromosome 19 open reading frame 15 |
| CAV1 | 857 | NP_001744 | 2454 | caveolin 1, caveolae protein, 22kDa |
| CAV2 | 858 | NP_001224 | 2320 | caveolin 2 |
| CAV2 | 858 | NP_937855 | 6759 | caveolin 2 |
| CAV3 | 859 | NP_001225 | 2321 | caveolin 3 |
| CAV3 | 859 | NP_203123 | 5489 | caveolin 3 |
| CBX3 | 11335 | NP_009207.2 | 7304 | chromobox 3 |
| CCDC107 | 203260 | NP_777583 | 6411 | coiled-coil domain containing 107 |
| CCDC108 | 255101 | NP_689602 | 6048 | coiled-coil domain containing 108 |
| CCDC108 | 255101 | NP_919278 | 6716 | coiled-coil domain containing 108 |
| CCDC109B | 55013 | NP_060388 | 4370 | coiled-coil domain containing 109B |
| CCDC112 | 153733 | NP_001035530 | 868 | coiled-coil domain containing 112 |
| CCDC112 | 153733 | NP_689762 | 6080 | coiled-coil domain containing 112 |
| CCDC126 | 90693 | NP_620126 | 5792 | coiled-coil domain containing 126 |
| CCDC127 | 133957 | NP_660308 | 5946 | coiled-coil domain containing 127 |
| CCDC134 | 79879 | NP_079097 | 5088 | coiled-coil domain containing 134 |
| CCDC136 | 64753 | NP_073579 | 4940 | coiled-coil domain containing 136 |
| CCDC141 | 285025 | NP_775919 | 6371 | coiled-coil domain containing 141 |
| CCDC167 | 154467 | NP_612502 | 5757 | chromosome 6 open reading frame 129 |
| CCDC168 | 643677 | NP_001139669 | 1913 | hypothetical protein LOC643677 |
| CCDC51 | 79714 | NP_078937 | 5065 | coiled-coil domain containing 51 |

FIG. 2 (CONT.)

| Antigen | GeneID | Accession No. | SEQ ID NO: | RefSeq Gene Name |
|---|---|---|---|---|
| CCDC67 | 159989 | NP_857596 | 6618 | coiled-coil domain containing 67 |
| CCDC80 | 151887 | NP_955805 | 6889 | coiled-coil domain containing 80 |
| CCDC80 | 151887 | NP_955806 | 6890 | coiled-coil domain containing 80 |
| CCKAR | 886 | NP_000721 | 216 | cholecystokinin A receptor |
| CCKBR | 887 | NP_795344 | 6481 | cholecystokinin B receptor |
| CCL11 | 6356 | NP_002977 | 2744 | chemokine (C-C motif) ligand 11 |
| CCL22 | 6367 | NP_002981 | 2745 | chemokine (C-C motif) ligand 22 |
| CCL4 | 6351 | NP_001001435 | 360 | chemokine (C-C motif) ligand 4 |
| CCL4 | 6351 | NP_002975 | 2743 | chemokine (C-C motif) ligand 4 |
| CCL4 | 6351 | NP_996890 | 6996 | chemokine (C-C motif) ligand 4 |
| CCPG1 | 9236 | NP_004739 | 3115 | cell cycle progression 1 |
| CCPG1 | 9236 | NP_065790 | 4713 | cell cycle progression 1 |
| CCR1 | 1230 | NP_001286 | 2337 | chemokine (C-C motif) receptor 1 |
| CCR10 | 2826 | NP_057686 | 4258 | chemokine (C-C motif) receptor 10 |
| CCR2 | 729230 | NP_001116513 | 1295 | chemokine (C-C motif) receptor 2 |
| CCR2 | 729230 | NP_001116868 | 1297 | chemokine (C-C motif) receptor 2 |
| CCR3 | 1232 | NP_001158152 | 2093 | chemokine (C-C motif) receptor 3 |
| CCR3 | 1232 | NP_001828 | 2484 | chemokine (C-C motif) receptor 3 |
| CCR3 | 1232 | NP_847898 | 6537 | chemokine (C-C motif) receptor 3 |
| CCR3 | 1232 | NP_847899 | 6538 | chemokine (C-C motif) receptor 3 |
| CCR4 | 1233 | NP_005499 | 3301 | chemokine (C-C motif) receptor 4 |
| CCR5 | 1234 | NP_000570 | 167 | chemokine (C-C motif) receptor 5 |
| CCR5 | 1234 | NP_001093638 | 1184 | chemokine (C-C motif) receptor 5 |
| CCR6 | 1235 | NP_001034666 | 801 | cyclin L2 chemokine (C-C motif) receptor 6 |
| CCR6 | 1235 | NP_004358.2 | 1777 | cyclin L2 chemokine (C-C motif) receptor 6 |
| CCR6 | 1235 | NP_004358.2 | 1778 | cyclin L2 chemokine (C-C motif) receptor 6 |
| CCR6 | 1235 | NP_004358 | 3034 | cyclin L2 chemokine (C-C motif) receptor 6 |
| CCR6 | 1235 | NP_112199 | 5198 | cyclin L2 chemokine (C-C motif) receptor 6 |
| CCR6 | 1235 | NP_113597 | 5221 | cyclin L2 chemokine (C-C motif) receptor 6 |
| CCR7 | 1236 | NP_001829 | 2485 | chemokine (C-C motif) receptor 7 |
| CCR8 | 1237 | NP_005192 | 3228 | chemokine (C-C motif) receptor 8 |
| CCR9 | 10803 | NP_006632 | 3535 | chemokine (C-C motif) receptor 9 |
| CCR9 | 10803 | NP_112477 | 5210 | chemokine (C-C motif) receptor 9 |
| CCRL2 | 9034 | NP_001124382 | 1446 | chemokine (C-C motif) receptor-like 2 |
| CCRL2 | 9034 | NP_003956 | 2933 | chemokine (C-C motif) receptor-like 2 |
| CD101 | 9398 | NP_004249 | 3001 | immunoglobulin superfamily, member 2 |
| CD151 | 977 | NP_001034579 | 796 | CD151 molecule (Raph blood group) |
| CD151 | 977 | NP_004348 | 3029 | CD151 molecule (Raph blood group) |
| CD151 | 977 | NP_620598 | 5832 | CD151 molecule (Raph blood group) |
| CD151 | 977 | NP_620599 | 5833 | CD151 molecule (Raph blood group) |
| CD160 | 11126 | NP_008984 | 3624 | CD160 molecule |
| CD163 | 9332 | NP_004235 | 2996 | CD163 molecule |
| CD163 | 9332 | NP_981961 | 6934 | CD163 molecule |
| CD163L1 | 283316 | NP_777601 | 6416 | CD163 molecule-like 1 |
| CD164 | 8763 | NP_001135873 | 1655 | CD164 molecule, sialomucin |
| CD164 | 8763 | NP_001135874 | 1656 | CD164 molecule, sialomucin |
| CD164 | 8763 | NP_001135875 | 1657 | CD164 molecule, sialomucin |
| CD164 | 8763 | NP_001135876 | 1658 | CD164 molecule, sialomucin |
| CD164 | 8763 | NP_006007 | 3414 | CD164 molecule, sialomucin |
| CD180 | 4064 | NP_005573 | 3318 | CD180 molecule |
| CD19 | 930 | NP_001761 | 2460 | CD19 molecule |
| CD1A | 909 | NP_001754 | 2455 | CD1a molecule |
| CD1B | 910 | NP_001755 | 2456 | CD1b molecule |
| CD1C | 911 | NP_001756 | 2457 | CD1c molecule |
| CD1D | 912 | NP_001757 | 2458 | CD1d molecule |
| CD1E | 913 | NP_001036048 | 906 | CD1e molecule |
| CD1E | 913 | NP_001036049 | 907 | CD1e molecule |
| CD1E | 913 | NP_001036050 | 908 | CD1e molecule |
| CD1E | 913 | NP_001036051 | 909 | CD1e molecule |
| CD1E | 913 | NP_001036052 | 910 | CD1e molecule |
| CD1E | 913 | NP_112155 | 5187 | CD1e molecule |
| CD2 | 914 | NP_001758 | 2459 | CD2 molecule |
| CD200 | 4345 | NP_001004196 | 428 | CD200 molecule |
| CD200 | 4345 | NP_005935 | 3404 | CD200 molecule |
| CD200R1 | 131450 | NP_620161 | 5800 | CD200 receptor 1 |
| CD200R1 | 131450 | NP_620385 | 5806 | CD200 receptor 1 |
| CD200R1 | 131450 | NP_620386 | 5807 | CD200 receptor 1 |
| CD200R1 | 131450 | NP_740750 | 6264 | CD200 receptor 1 |
| CD207 | 50489 | NP_056532 | 4117 | CD207 molecule, langerin |
| CD22 | 933 | NP_001762 | 2461 | CD22 molecule |
| CD226 | 10666 | NP_006557 | 3513 | CD226 molecule |
| CD24 | 100133941 | NP_001278666.1 | 7446 | CD24 molecule |
| CD244 | 51744 | NP_001160135 | 2175 | CD244 molecule, natural killer cell receptor 2B4 |
| CD244 | 51744 | NP_001160136 | 2176 | CD244 molecule, natural killer cell receptor 2B4 |
| CD244 | 51744 | NP_057466 | 4215 | CD244 molecule, natural killer cell receptor 2B4 |
| CD247 | 919 | NP_000725.1 | 7270 | CD247 molecule |
| CD248 | 57124 | NP_065137 | 4649 | CD248 molecule, endosialin |

FIG. 2 (CONT.)

| Antigen | GeneID | Accession No. | SEQ ID NO: | RefSeq Gene Name |
|---|---|---|---|---|
| CD27 | 939 | NP_001233 | 2322 | CD27 molecule |
| CD274 | 29126 | NP_054862 | 3872 | CD274 molecule |
| CD276 | 80381 | NP_001019907 | 685 | CD276 molecule |
| CD276 | 80381 | NP_079516 | 5140 | CD276 molecule |
| CD28 | 940 | NP_006130 | 3444 | CD28 molecule |
| CD300A | 11314 | NP_009192 | 3663 | CD300a molecule |
| CD300C | 10871 | NP_006669 | 3543 | CD300c molecule |
| CD300LB | 124599 | NP_777552 | 6404 | CD300 molecule-like family member b |
| CD300LF | 146722 | NP_620587 | 5827 | CD300 molecule-like family member f |
| CD300LG | 146894 | NP_001161794 | 2217 | CD300 molecule-like family member g |
| CD300LG | 146894 | NP_001161795 | 2218 | CD300 molecule-like family member g |
| CD300LG | 146894 | NP_001161796 | 2219 | CD300 molecule-like family member g |
| CD300LG | 146894 | NP_660316 | 5948 | CD300 molecule-like family member g |
| CD320 | 51293 | NP_001159367 | 2127 | CD320 molecule |
| CD320 | 51293 | NP_057663 | 4249 | CD320 molecule |
| CD33 | 945 | NP_001076087 | 1062 | CD33 molecule |
| CD33 | 945 | NP_001763 | 2462 | CD33 molecule |
| CD34 | 947 | NP_001020280 | 697 | CD34 molecule |
| CD34 | 947 | NP_001764 | 2463 | CD34 molecule |
| CD36 | 948 | NP_000063 | 16 | CD36 molecule (thrombospondin receptor) |
| CD36 | 948 | NP_001001547 | 367 | CD36 molecule (thrombospondin receptor) |
| CD36 | 948 | NP_001001548 | 368 | CD36 molecule (thrombospondin receptor) |
| CD36 | 948 | NP_001120915 | 1327 | CD36 molecule (thrombospondin receptor) |
| CD36 | 948 | NP_001120916 | 1328 | CD36 molecule (thrombospondin receptor) |
| CD37 | 951 | NP_001035120 | 823 | CD37 molecule |
| CD37 | 951 | NP_001765 | 2464 | CD37 molecule |
| CD38 | 952 | NP_001766 | 2465 | CD38 molecule |
| CD3D | 915 | NP_000723 | 217 | CD3d molecule, delta (CD3-TCR complex) |
| CD3D | 915 | NP_001035741 | 877 | CD3d molecule, delta (CD3-TCR complex) |
| CD3G | 917 | NP_000064 | 17 | CD3g molecule, gamma (CD3-TCR complex) |
| CD4 | 920 | NP_000607 | 174 | CD4 molecule |
| CD40 | 958 | NP_001241.1 | 7267 | CD40 molecule |
| CD40LG | 959 | NP_000065 | 18 | CD40 ligand |
| CD44 | 960 | NP_000601 | 172 | CD44 molecule (Indian blood group) |
| CD44 | 960 | NP_001001389 | 355 | CD44 molecule (Indian blood group) |
| CD44 | 960 | NP_001001390 | 356 | CD44 molecule (Indian blood group) |
| CD44 | 960 | NP_001001391 | 357 | CD44 molecule (Indian blood group) |
| CD44 | 960 | NP_001001392 | 358 | CD44 molecule (Indian blood group) |
| CD46 | 4179 | NP_002380 | 2639 | CD46 molecule, complement regulatory protein |
| CD46 | 4179 | NP_722548 | 6234 | CD46 molecule, complement regulatory protein |
| CD46 | 4179 | NP_758860 | 6309 | CD46 molecule, complement regulatory protein |
| CD46 | 4179 | NP_758861 | 6310 | CD46 molecule, complement regulatory protein |
| CD46 | 4179 | NP_758862 | 6311 | CD46 molecule, complement regulatory protein |
| CD46 | 4179 | NP_758863 | 6312 | CD46 molecule, complement regulatory protein |
| CD46 | 4179 | NP_758864 | 6313 | CD46 molecule, complement regulatory protein |
| CD46 | 4179 | NP_758865 | 6314 | CD46 molecule, complement regulatory protein |
| CD46 | 4179 | NP_758866 | 6315 | CD46 molecule, complement regulatory protein |
| CD46 | 4179 | NP_758867 | 6316 | CD46 molecule, complement regulatory protein |
| CD46 | 4179 | NP_758868 | 6317 | CD46 molecule, complement regulatory protein |
| CD46 | 4179 | NP_758869 | 6318 | CD46 molecule, complement regulatory protein |
| CD46 | 4179 | NP_758870 | 6319 | CD46 molecule, complement regulatory protein |
| CD46 | 4179 | NP_758871 | 6320 | CD46 molecule, complement regulatory protein |
| CD47 | 961 | NP_001768.1 | 693 | CD47 molecule |
| CD47 | 961 | NP_001768 | 2467 | CD47 molecule |
| CD47 | 961 | NP_942088 | 6837 | CD47 molecule |
| CD48 | 962 | NP_001769.2 | 7315 | CD48 molecule |
| CD5 | 921 | NP_055022 | 3881 | CD5 molecule |
| CD52 | 1043 | NP_001794 | 2478 | CD52 molecule |
| CD53 | 963 | NP_000551 | 161 | CD53 molecule |
| CD53 | 963 | NP_001035122 | 824 | CD53 molecule |
| CD58 | 965 | NP_001138294.1 | 7405 | CD58 molecule |
| CD63 | 967 | NP_001244318.1 | 825 | CD63 molecule |
| CD63 | 967 | NP_001771 | 2468 | CD63 molecule |
| CD68 | 968 | NP_001035148 | 826 | CD68 molecule |
| CD68 | 968 | NP_001242 | 2330 | CD68 molecule |
| CD69 | 969 | NP_001772 | 2469 | CD69 molecule |
| CD7 | 924 | NP_006128 | 3442 | CD7 molecule |
| CD70 | 970 | NP_001243 | 2331 | CD70 molecule |
| CD72 | 971 | NP_001773 | 2470 | CD72 molecule |
| CD74 | 972 | NP_001020329.1 | 7351 | CD74 molecule |
| CD79A | 973 | NP_001774.1 | 7257 | CD79a molecule |
| CD79B | 974 | NP_000617 | 178 | CD79b molecule, immunoglobulin-associated beta |
| CD79B | 974 | NP_001035022 | 817 | CD79b molecule, immunoglobulin-associated beta |
| CD79B | 974 | NP_067613 | 4808 | CD79b molecule, immunoglobulin-associated beta |
| CD80 | 941 | NP_005182 | 3225 | CD80 molecule |
| CD81 | 975 | NP_004347 | 3028 | CD81 molecule |
| CD82 | 3732 | NP_001020015 | 687 | CD82 molecule |

FIG. 2 (CONT.)

| Antigen | GeneID | Accession No. | SEQ ID NO: | RefSeq Gene Name |
|---|---|---|---|---|
| CD82 | 3732 | NP_002222 | 2587 | CD82 molecule |
| CD83 | 9308 | NP_001035370 | 865 | CD83 molecule |
| CD83 | 9308 | NP_004224 | 2995 | CD83 molecule |
| CD84 | 8832 | NP_003865 | 2924 | CD84 molecule |
| CD86 | 942 | NP_008820 | 3589 | CD86 molecule |
| CD86 | 942 | NP_787058 | 6463 | CD86 molecule |
| CD8A | 925 | NP_001139345.1 | 7408 | CD8a molecule |
| CD8B | 926 | NP_004922 | 3169 | CD8b molecule |
| CD8B | 926 | NP_742097 | 6275 | CD8b molecule |
| CD8B | 926 | NP_742099 | 6276 | CD8b molecule |
| CD8B | 926 | NP_742100 | 6277 | CD8b molecule |
| CD8B | 926 | NP_757362 | 6295 | CD8b molecule |
| CD9 | 928 | NP_001317241.1 | 7464 | CD9 molecule |
| CD93 | 22918 | NP_036204 | 3698 | CD93 molecule |
| CD96 | 10225 | NP_005807 | 3375 | CD96 molecule |
| CD96 | 10225 | NP_937839 | 6757 | CD96 molecule |
| CD99 | 4267 | NP_001116370 | 1292 | CD99 molecule |
| CD99 | 4267 | NP_002405 | 2647 | CD99 molecule |
| CD99L2 | 83692 | NP_113650 | 5228 | CD99 molecule-like 2 |
| CD99L2 | 83692 | NP_604394 | 5710 | CD99 molecule-like 2 |
| CD99L2 | 83692 | NP_604395 | 5711 | CD99 molecule-like 2 |
| CDC14B | 8555 | NP_001070649 | 952 | CDC14 cell division cycle 14Homolog B (S. cerevisiae) |
| CDC14B | 8555 | NP_003662 | 2867 | CDC14 cell division cycle 14Homolog B (S. cerevisiae) |
| CDC14B | 8555 | NP_201588 | 5488 | CDC14 cell division cycle 14Homolog B (S. cerevisiae) |
| CDCA7L | 55536 | NP_001120842 | 1319 | cell division cycle associated 7-like |
| CDCA7L | 55536 | NP_001120843 | 1320 | cell division cycle associated 7-like |
| CDCA7L | 55536 | NP_061189 | 4488 | cell division cycle associated 7-like |
| CDCP1 | 64866 | NP_073753 | 4954 | CUB domain containing protein 1 |
| CDCP1 | 64866 | NP_835488 | 6529 | CUB domain containing protein 1 |
| CDH1 | 999 | NP_004351 | 3030 | cadherin 1, type 1, E-cadherin (epithelial) |
| CDH10 | 1008 | NP_006718 | 3552 | cadherin 10, type 2 (T2-cadherin) |
| CDH11 | 1009 | NP_001788 | 2477 | cadherin 11, type 2, OB-cadherin (osteoblast) |
| CDH12 | 1010 | NP_004052 | 2955 | cadherin 12, type 2 (N-cadherin 2) |
| CDH15 | 1013 | NP_004924 | 3171 | cadherin 15, type 1, M-cadherin (myotubule) |
| CDH16 | 1014 | NP_004053 | 2956 | cadherin 16, KSP-cadherin |
| CDH17 | 1015 | NP_001138135 | 1770 | cadherin 17, LI cadherin (liver-intestine) |
| CDH17 | 1015 | NP_004054 | 2957 | cadherin 17, LI cadherin (liver-intestine) |
| CDH18 | 1016 | NP_001161139 | 2192 | cadherin 18, type 2 |
| CDH18 | 1016 | NP_004925 | 3172 | cadherin 18, type 2 |
| CDH19 | 28513 | NP_066976 | 4782 | cadherin 19, type 2 |
| CDH2 | 1000 | NP_001783 | 2472 | cadherin 2, type 1, N-cadherin (neuronal) |
| CDH20 | 28316 | NP_114097 | 5261 | cadherin 20, type 2 |
| CDH22 | 64405 | NP_067071 | 4803 | cadherin-like 22 |
| CDH23 | 64072 | NP_001165401 | 2291 | cadherin-like 23 |
| CDH23 | 64072 | NP_001165402 | 2292 | cadherin-like 23 |
| CDH23 | 64072 | NP_001165403 | 2293 | cadherin-like 23 |
| CDH23 | 64072 | NP_001165404 | 2294 | cadherin-like 23 |
| CDH23 | 64072 | NP_001165405 | 2295 | cadherin-like 23 |
| CDH23 | 64072 | NP_001165406 | 2296 | cadherin-like 23 |
| CDH23 | 64072 | NP_001165407 | 2297 | cadherin-like 23 |
| CDH23 | 64072 | NP_071407 | 4877 | cadherin-like 23 |
| CDH23 | 64072 | NP_443068 | 5515 | cadherin-like 23 |
| CDH24 | 64403 | NP_071923 | 4922 | cadherin-like 24 |
| CDH24 | 64403 | NP_659422 | 5913 | cadherin-like 24 |
| CDH26 | 60437 | NP_068582 | 4835 | cadherin-like 26 |
| CDH26 | 60437 | NP_817089 | 6512 | cadherin-like 26 |
| CDH3 | 1001 | NP_001784 | 2473 | cadherin 3, type 1, P-cadherin (placental) |
| CDH4 | 1002 | NP_001785 | 2474 | cadherin 4, type 1, R-cadherin (retinal) |
| CDH5 | 1003 | NP_001786 | 2475 | cadherin 5, type 2 (vascular endothelium) |
| CDH6 | 1004 | NP_004923 | 3170 | cadherin 6, type 2, K-cadherin (fetal kidney) |
| CDH7 | 1005 | NP_004352 | 3031 | cadherin 7, type 2 |
| CDH7 | 1005 | NP_387450 | 5510 | cadherin 7, type 2 |
| CDH8 | 1006 | NP_001787 | 2476 | cadherin 8, type 2 |
| CDH9 | 1007 | NP_057363 | 4198 | cadherin 9, type 2 (T1-cadherin) |
| CDHR1 | 92211 | NP_001165442 | 2305 | protocadherin 21 |
| CDHR1 | 92211 | NP_149091 | 5449 | protocadherin 21 |
| CDHR2 | 54825 | NP_001165447 | 2306 | protocadherin 24 |
| CDHR2 | 54825 | NP_060145 | 4321 | protocadherin 24 |
| CDHR3 | 222256 | NP_001288090.1 | 7449 | cadherin related family member 3 |
| CDHR5 | 53841 | NP_001165439 | 2304 | mucin-like protocadherin |
| CDHR5 | 53841 | NP_068743 | 4849 | mucin-like protocadherin |
| CDHR5 | 53841 | NP_112554 | 5212 | mucin-like protocadherin |
| CDIPT | 10423 | NP_006310 | 3465 | CDP-diacylglycerol--inositol 3-phosphatidyltransferase (phosphatidylinositol synthase) |
| CDKAL1 | 54901 | NP_060244 | 4341 | CDK5 regulatory subunit associated protein 1-like 1 |
| CDKN3 | 1033 | NP_001124323 | 1441 | cyclin-dependent kinase inhibitor 3 |
| CDKN3 | 1033 | NP_005183 | 3226 | cyclin-dependent kinase inhibitor 3 |
| CDON | 50937 | NP_058648 | 4281 | CdonHomolog (mouse) |

FIG. 2 (CONT.)

| Antigen | GeneID | Accession No. | SEQ ID NO: | RefSeq Gene Name |
|---|---|---|---|---|
| CDRT15L2 | 256223 | XP_001725473 | 7073 | CMT1A duplicated region transcript 15-like 1 CMT1A duplicated region transcript 15-like 2 |
| CDRT15L2 | 256223 | XP_001725838 | 7075 | CMT1A duplicated region transcript 15-like 1 CMT1A duplicated region transcript 15-like 2 |
| CDRT15L2 | 256223 | XP_170840 | 7086 | CMT1A duplicated region transcript 15-like 1 CMT1A duplicated region transcript 15-like 2 |
| CDRT15L2 | 256223 | XP_937402 | 7091 | CMT1A duplicated region transcript 15-like 1 CMT1A duplicated region transcript 15-like 2 |
| CDS1 | 1040 | NP_001254 | 2332 | CDP-diacylglycerol synthase (phosphatidate cytidylyltransferase) 1 |
| CDS2 | 8760 | NP_003809 | 2906 | CDP-diacylglycerol synthase (phosphatidate cytidylyltransferase) 2 |
| CDSN | 1041 | NP_001255 | 2333 | corneodesmosin |
| CDYL | 9425 | NP_001137442 | 1747 | chromodomain protein, Y-like |
| CDYL | 9425 | NP_001137443 | 1748 | chromodomain protein, Y-like |
| CDYL | 9425 | NP_004815 | 3140 | chromodomain protein, Y-like |
| CEACAM1 | 634 | NP_001020083 | 690 | carcinoembryonic antigen-related cell adhesion molecule 1 (biliary glycoprotein) |
| CEACAM1 | 634 | NP_001703 | 2443 | carcinoembryonic antigen-related cell adhesion molecule 1 (biliary glycoprotein) |
| CEACAM19 | 56971 | NP_001121365 | 1358 | carcinoembryonic antigen-related cell adhesion molecule 19 |
| CEACAM19 | 56971 | NP_064604 | 4619 | carcinoembryonic antigen-related cell adhesion molecule 19 |
| CEACAM21 | 90273 | NP_001091976 | 1128 | carcinoembryonic antigen-related cell adhesion molecule 21 |
| CEACAM21 | 90273 | NP_291021 | 5506 | carcinoembryonic antigen-related cell adhesion molecule 21 |
| CEACAM3 | 1084 | NP_001806 | 2479 | carcinoembryonic antigen-related cell adhesion molecule 3 |
| CEACAM4 | 1089 | NP_001808 | 2480 | carcinoembryonic antigen-related cell adhesion molecule 4 |
| CEACAM5 | 1048 | NP_001278413.1 | 7444 | carcinoembryonic antigen related cell adhesion molecule 5 |
| CEACAM6 | 4680 | NP_002474.4 | 7445 | carcinoembryonic antigen related cell adhesion molecule 6 |
| CEACAM7 | 1087 | NP_008821 | 3590 | carcinoembryonic antigen-related cell adhesion molecule 7 |
| CECR1 | 51816 | NP_001269154.1 | 4288 | cat eye syndrome chromosome region, candidate 1 |
| CECR1 | 51816 | NP_803124 | 6490 | cat eye syndrome chromosome region, candidate 1 |
| CECR6 | 27439 | NP_001156551 | 2041 | cat eye syndrome chromosome region, candidate 6 |
| CECR6 | 27439 | NP_114096 | 5260 | cat eye syndrome chromosome region, candidate 6 |
| CELF4 | 56853 | NP_001020258 | 694 | bruno-like 4, RNA binding protein (Drosophila) |
| CELF4 | 56853 | NP_001020259 | 695 | bruno-like 4, RNA binding protein (Drosophila) |
| CELF4 | 56853 | NP_001020260 | 696 | bruno-like 4, RNA binding protein (Drosophila) |
| CELF4 | 56853 | NP_064565 | 4612 | bruno-like 4, RNA binding protein (Drosophila) |
| CELSR1 | 9620 | NP_055061 | 3895 | cadherin, EGF LAG seven-pass G-type receptor 1 (flamingoHomolog, Drosophila) |
| CELSR2 | 1952 | NP_001399 | 2365 | cadherin, EGF LAG seven-pass G-type receptor 2 (flamingoHomolog, Drosophila) |
| CELSR3 | 1951 | NP_001398.2 | 870 | solute carrier family 26, member 6 cadherin, EGF LAG seven-pass G-type receptor 3 (flamingoHomolog, Drosophila) |
| CELSR3 | 1951 | NP_001398 | 2364 | solute carrier family 26, member 6 cadherin, EGF LAG seven-pass G-type receptor 3 (flamingoHomolog, Drosophila) |
| CELSR3 | 1951 | NP_075062 | 4963 | solute carrier family 26, member 6 cadherin, EGF LAG seven-pass G-type receptor 3 (flamingoHomolog, Drosophila) |
| CELSR3 | 1951 | NP_001398.2 | 5704 | solute carrier family 26, member 6 cadherin, EGF LAG seven-pass G-type receptor 3 (flamingoHomolog, Drosophila) |
| CELSR3 | 1951 | NP_001398.2 | 5709 | solute carrier family 26, member 6 cadherin, EGF LAG seven-pass G-type receptor 3 (flamingoHomolog, Drosophila) |
| CEND1 | 51286 | NP_057648 | 4245 | cell cycle exit and neuronal differentiation 1 |
| CEP95 | 90799 | NP_612372 | 5734 | coiled-coil domain containing 45 |
| CEPT1 | 10390 | NP_001007795 | 526 | choline/ethanolamine phosphotransferase 1 |
| CEPT1 | 10390 | NP_006081 | 3432 | choline/ethanolamine phosphotransferase 1 |
| CERS1 | 10715 | NP_001483 | 2389 | growth differentiation factor 1 LAG1Homolog, ceramide synthase 1 |
| CERS1 | 10715 | NP_067090 | 4805 | growth differentiation factor 1 LAG1Homolog, ceramide synthase 1 |
| CERS1 | 10715 | NP_937850 | 6758 | growth differentiation factor 1 LAG1Homolog, ceramide synthase 1 |
| CERS2 | 29956 | NP_071358 | 4872 | LAG1Homolog, ceramide synthase 2 |
| CERS2 | 29956 | NP_859530 | 6629 | LAG1Homolog, ceramide synthase 2 |
| CERS3 | 204219 | NP_849164 | 6571 | LAG1Homolog, ceramide synthase 3 |
| CERS4 | 79603 | NP_078828 | 5046 | LAG1Homolog, ceramide synthase 4 |
| CERS5 | 91012 | NP_671723 | 5995 | LAG1Homolog, ceramide synthase 5 |
| CERS6 | 253782 | NP_982288 | 6939 | LAG1Homolog, ceramide synthase 6 |
| CES5A | 221223 | NP_001137157 | 1711 | carboxylesterase 7 |
| CES5A | 221223 | NP_659461 | 5919 | carboxylesterase 7 |
| CFAP47 | 286464 | NP_001291477.1 | 6383 | chromosome X open reading frame 59 |
| CFAP61 | 26074 | NP_001161288 | 2197 | chromosome 20 open reading frame 26 |
| CFAP61 | 26074 | NP_056400 | 4104 | chromosome 20 open reading frame 26 |
| CFTR | 1080 | NP_000483 | 139 | cystic fibrosis transmembrane conductance regulator (ATP-binding cassette sub-family C, member 7) |
| CGA | 1081 | NP_000726 | 218 | glycoproteinHormones, alpha polypeptide |
| CGRRF1 | 10668 | NP_006559 | 3514 | cell growth regulator with ring finger domain 1 |
| CHI3L2 | 1117 | NP_001020368 | 699 | chitinase 3-like 2 |
| CHI3L2 | 1117 | NP_001020370 | 700 | chitinase 3-like 2 |
| CHI3L2 | 1117 | NP_003991 | 2944 | chitinase 3-like 2 |
| CHIC1 | 53344 | NP_001034929 | 813 | cysteine-richHydrophobic domain 1 |
| CHIC2 | 26511 | NP_036242 | 3707 | cysteine-richHydrophobic domain 2 |
| CHIT1 | 1118 | NP_003456 | 2835 | chitinase 1 (chitotriosidase) |
| CHL1 | 10752 | NP_006605 | 3528 | cell adhesion molecule withHomology to L1CAM (closeHomolog of L1) |
| CHODL | 140578 | NP_079220 | 5106 | chondrolectin |
| CHPT1 | 56994 | NP_064629 | 4622 | choline phosphotransferase 1 |
| CHRM1 | 1128 | NP_000729 | 219 | cholinergic receptor, muscarinic 1 |
| CHRM2 | 1129 | NP_000730 | 220 | cholinergic receptor, muscarinic 2 |
| CHRM2 | 1129 | NP_001006627 | 483 | cholinergic receptor, muscarinic 2 |
| CHRM2 | 1129 | NP_001006628 | 484 | cholinergic receptor, muscarinic 2 |
| CHRM2 | 1129 | NP_001006629 | 485 | cholinergic receptor, muscarinic 2 |
| CHRM2 | 1129 | NP_001006630 | 486 | cholinergic receptor, muscarinic 2 |

FIG. 2 (CONT.)

| Antigen | GeneID | Accession No. | SEQ ID NO: | RefSeq Gene Name |
|---|---|---|---|---|
| CHRM2 | 1129 | NP_001006631 | 487 | cholinergic receptor, muscarinic 2 |
| CHRM2 | 1129 | NP_001006632 | 488 | cholinergic receptor, muscarinic 2 |
| CHRM2 | 1129 | NP_001006633 | 489 | cholinergic receptor, muscarinic 2 |
| CHRM3 | 1131 | NP_000731 | 221 | cholinergic receptor, muscarinic 3 |
| CHRM4 | 1132 | NP_000732 | 222 | cholinergic receptor, muscarinic 4 |
| CHRM5 | 1133 | NP_036257 | 3709 | cholinergic receptor, muscarinic 5 |
| CHRNA1 | 1134 | NP_000070 | 19 | cholinergic receptor, nicotinic, alpha 1 (muscle) |
| CHRNA1 | 1134 | NP_001034612 | 798 | cholinergic receptor, nicotinic, alpha 1 (muscle) |
| CHRNA10 | 57053 | NP_065135 | 4647 | cholinergic receptor, nicotinic, alpha 10 |
| CHRNA2 | 1135 | NP_000733 | 223 | cholinergic receptor, nicotinic, alpha 2 (neuronal) |
| CHRNA3 | 1136 | NP_000734 | 224 | cholinergic receptor, nicotinic, alpha 3 |
| CHRNA3 | 1136 | NP_001160166 | 2177 | cholinergic receptor, nicotinic, alpha 3 |
| CHRNA4 | 1137 | NP_000735 | 225 | cholinergic receptor, nicotinic, alpha 4 |
| CHRNA5 | 1138 | NP_000736 | 226 | cholinergic receptor, nicotinic, alpha 5 |
| CHRNA6 | 8973 | NP_001186208.1 | 7425 | cholinergic receptor nicotinic alpha 6 subunit |
| CHRNA9 | 55584 | NP_060051 | 4308 | cholinergic receptor, nicotinic, alpha 9 |
| CHRNB1 | 1140 | NP_000738 | 227 | cholinergic receptor, nicotinic, beta 1 (muscle) |
| CHRNB2 | 1141 | NP_000739 | 228 | cholinergic receptor, nicotinic, beta 2 (neuronal) |
| CHRNB3 | 1142 | NP_000740 | 229 | cholinergic receptor, nicotinic, beta 3 |
| CHRNB4 | 1143 | NP_000741 | 230 | cholinergic receptor, nicotinic, beta 4 |
| CHRND | 1144 | NP_000742 | 231 | cholinergic receptor, nicotinic, delta |
| CHRNE | 1145 | NP_000071 | 20 | cholinergic receptor, nicotinic, epsilon |
| CHRNG | 1146 | NP_005190 | 3227 | cholinergic receptor, nicotinic, gamma |
| CHST1 | 8534 | NP_003645 | 2864 | carbohydrate (keratan sulfate Gal-6) sulfotransferase 1 |
| CHST10 | 9486 | NP_004845 | 3148 | carbohydrate sulfotransferase 10 |
| CHST11 | 50515 | NP_060883 | 4443 | carbohydrate (chondroitin 4) sulfotransferase 11 |
| CHST12 | 55501 | NP_061111 | 4473 | carbohydrate (chondroitin 4) sulfotransferase 12 |
| CHST13 | 166012 | NP_690849 | 6128 | carbohydrate (chondroitin 4) sulfotransferase 13 |
| CHST15 | 51363 | NP_056976 | 4129 | carbohydrate (N-acetylgalactosamine 4-sulfate 6-O) sulfotransferase 15 |
| CHST3 | 9469 | NP_004264 | 3004 | carbohydrate (chondroitin 6) sulfotransferase 3 |
| CHST4 | 10164 | NP_001159867 | 2166 | carbohydrate (N-acetylglucosamine 6-O) sulfotransferase 4 |
| CHST4 | 10164 | NP_005760 | 3363 | carbohydrate (N-acetylglucosamine 6-O) sulfotransferase 4 |
| CHST8 | 64377 | NP_001121367 | 1359 | carbohydrate (N-acetylgalactosamine 4-0) sulfotransferase 8 |
| CHST8 | 64377 | NP_001121368 | 1360 | carbohydrate (N-acetylgalactosamine 4-0) sulfotransferase 8 |
| CHST8 | 64377 | NP_071912 | 4921 | carbohydrate (N-acetylgalactosamine 4-0) sulfotransferase 8 |
| CHST9 | 83539 | NP_113610 | 5222 | carbohydrate (N-acetylgalactosamine 4-0) sulfotransferase 9 |
| CHSY1 | 22856 | NP_055733 | 4012 | chondroitin sulfate synthase 1 |
| CHSY3 | 337876 | NP_787052 | 6461 | chondroitin sulfate synthase 3 |
| CIRH1A | 84916 | NP_116219 | 5412 | cirrhosis, autosomal recessive 1A (cirhin) |
| CISD2 | 493856 | NP_001008389 | 530 | CDGSH iron sulfur domain 2 |
| CKAP4 | 10970 | NP_006816 | 3573 | cytoskeleton-associated protein 4 |
| CKLF | 51192 | NP_001035228 | 841 | chemokine-like factor |
| CKLF | 51192 | NP_057410 | 4204 | chemokine-like factor |
| CKLF | 51192 | NP_058647 | 4280 | chemokine-like factor |
| CKLF | 51192 | NP_857591 | 6614 | chemokine-like factor |
| CKLF | 51192 | NP_857592 | 6615 | chemokine-like factor |
| CLCA2 | 9635 | NP_006527 | 3509 | chloride channel accessory 2 |
| CLCA4 | 22802 | NP_036260 | 3710 | chloride channel accessory 4 |
| CLCC1 | 23155 | NP_001041675 | 930 | chloride channel CLIC-like 1 |
| CLCC1 | 23155 | NP_055942 | 4037 | chloride channel CLIC-like 1 |
| CLCN1 | 1180 | NP_000074 | 21 | chloride channel 1, skeletal muscle |
| CLCN2 | 1181 | NP_001164558 | 2264 | chloride channel 2 |
| CLCN2 | 1181 | NP_001164559 | 2265 | chloride channel 2 |
| CLCN2 | 1181 | NP_001164560 | 2266 | chloride channel 2 |
| CLCN2 | 1181 | NP_004357 | 3033 | chloride channel 2 |
| CLCN3 | 1182 | NP_001820 | 2481 | chloride channel 3 |
| CLCN3 | 1182 | NP_776297 | 6399 | chloride channel 3 |
| CLCN4 | 1183 | NP_001821 | 2482 | chloride channel 4 |
| CLCN5 | 1184 | NP_000075 | 22 | chloride channel 5 |
| CLCN5 | 1184 | NP_001121370 | 1361 | chloride channel 5 |
| CLCN5 | 1184 | NP_001121371 | 1362 | chloride channel 5 |
| CLCN6 | 1185 | NP_001277 | 2334 | chloride channel 6 |
| CLCN6 | 1185 | NP_001243888.1 | 4824 | chloride channel 6 |
| CLCN6 | 1185 | NP_001243888.1 | 4825 | chloride channel 6 |
| CLCN6 | 1185 | NP_001243888.1 | 4826 | chloride channel 6 |
| CLCN7 | 1186 | NP_001107803 | 1272 | chloride channel 7 |
| CLCN7 | 1186 | NP_001278 | 2335 | chloride channel 7 |
| CLCNKB | 1188 | NP_000076 | 23 | chloride channel Kb |
| CLCNKB | 1188 | NP_001159417 | 2131 | chloride channel Kb |
| CLDN1 | 9076 | NP_066924 | 4771 | claudin 1 |
| CLDN10 | 9071 | NP_001153572 | 1975 | claudin 10 |
| CLDN10 | 9071 | NP_008915 | 3606 | claudin 10 |
| CLDN10 | 9071 | NP_878268 | 6689 | claudin 10 |
| CLDN11 | 5010 | NP_005593 | 3322 | claudin 11 |
| CLDN12 | 9069 | NP_036261 | 3711 | claudin 12 |
| CLDN14 | 23562 | NP_001139549 | 1902 | claudin 14 |
| CLDN14 | 23562 | NP_001139550 | 1903 | claudin 14 |

FIG. 2 (CONT.)

| Antigen | GeneID | Accession No. | SEQ ID NO: | RefSeq Gene Name |
|---|---|---|---|---|
| CLDN14 | 23562 | NP_001139551 | 1904 | claudin 14 |
| CLDN14 | 23562 | NP_036262 | 3712 | claudin 14 |
| CLDN14 | 23562 | NP_652763 | 5857 | claudin 14 |
| CLDN15 | 24146 | NP_055158 | 3920 | claudin 15 |
| CLDN16 | 10686 | NP_006571 | 3520 | claudin 16 |
| CLDN17 | 26285 | NP_036263 | 3713 | claudin 17 |
| CLDN18 | 51208 | NP_001002026 | 387 | claudin 18 |
| CLDN18 | 51208 | NP_057453 | 4213 | claudin 18 |
| CLDN19 | 149461 | NP_001116867 | 1296 | claudin 19 |
| CLDN19 | 149461 | NP_683763 | 6010 | claudin 19 |
| CLDN2 | 9075 | NP_001164563 | 2267 | claudin 2 |
| CLDN2 | 9075 | NP_001164566 | 2268 | claudin 2 |
| CLDN2 | 9075 | NP_065117 | 4642 | claudin 2 |
| CLDN20 | 49861 | NP_001001346.1 | 7334 | claudin 20 |
| CLDN22 | 53842 | NP_001104789.1 | 7381 | claudin 22 |
| CLDN23 | 137075 | NP_919260 | 6713 | claudin 23 |
| CLDN24 | 100132463 | NP_001172078.1 | 7422 | claudin 24 |
| CLDN3 | 1365 | NP_001297 | 2343 | claudin 3 |
| CLDN4 | 1364 | NP_001296 | 2342 | claudin 4 |
| CLDN5 | 7122 | NP_001124333 | 1443 | claudin 5 |
| CLDN5 | 7122 | NP_003268 | 2815 | claudin 5 |
| CLDN6 | 9074 | NP_067018 | 4792 | claudin 6 |
| CLDN7 | 1366 | NP_001298 | 2344 | claudin 7 |
| CLDN8 | 9073 | NP_955360 | 6874 | claudin 8 |
| CLDN9 | 9080 | NP_066192 | 4752 | claudin 9 |
| CLDND1 | 56650 | NP_001035271 | 854 | claudin domain containing 1 |
| CLDND1 | 56650 | NP_001035272 | 855 | claudin domain containing 1 |
| CLDND1 | 56650 | NP_001035273 | 856 | claudin domain containing 1 |
| CLDND1 | 56650 | NP_001035289 | 861 | claudin domain containing 1 |
| CLDND1 | 56650 | NP_001035290 | 862 | claudin domain containing 1 |
| CLDND1 | 56650 | NP_063948 | 4593 | claudin domain containing 1 |
| CLDND2 | 125875 | NP_689566 | 6040 | claudin domain containing 2 |
| CLEC10A | 10462 | NP_006335 | 3472 | C-type lectin domain family 10, member A |
| CLEC10A | 10462 | NP_878910 | 6690 | C-type lectin domain family 10, member A |
| CLEC12A | 160364 | NP_001123470 | 1406 | C-type lectin domain family 12, member A C-type lectin domain family 12, member B |
| CLEC12A | 160364 | NP_612210 | 5728 | C-type lectin domain family 12, member A C-type lectin domain family 12, member B |
| CLEC12A | 160364 | NP_963917 | 6914 | C-type lectin domain family 12, member A C-type lectin domain family 12, member B |
| CLEC12A | 160364 | NP_001193939.1 | 6958 | C-type lectin domain family 12, member A C-type lectin domain family 12, member B |
| CLEC12B | 387837 | NP_001123470 | 1407 | C-type lectin domain family 12, member A |
| CLEC12B | 387837 | NP_001123470.1 | 5729 | C-type lectin domain family 12, member A |
| CLEC12B | 387837 | NP_001123470.1 | 6915 | C-type lectin domain family 12, member A |
| CLEC12B | 387837 | NP_995324 | 6959 | C-type lectin domain family 12, member A |
| CLEC14A | 161198 | NP_778230 | 6440 | C-type lectin domain family 14, member A |
| CLEC1A | 51267 | NP_057595 | 4232 | C-type lectin domain family 1, member A |
| CLEC1B | 51266 | NP_001092901 | 1159 | C-type lectin domain family 1, member B |
| CLEC1B | 51266 | NP_057593 | 4231 | C-type lectin domain family 1, member B |
| CLEC2B | 9976 | NP_005118 | 3217 | C-type lectin domain family 2, member B |
| CLEC2D | 29121 | NP_001004419 | 433 | C-type lectin domain family 2, member D |
| CLEC2D | 29121 | NP_037401 | 3791 | C-type lectin domain family 2, member D |
| CLEC2L | 154790 | NP_001073980 | 1035 | C-type lectin domain family 2, member L |
| CLEC3A | 10143 | NP_005743 | 3356 | C-type lectin domain family 3, member A |
| CLEC4A | 50856 | NP_057268 | 4182 | C-type lectin domain family 4, member A |
| CLEC4A | 50856 | NP_919429 | 6727 | C-type lectin domain family 4, member A |
| CLEC4A | 50856 | NP_919430 | 6728 | C-type lectin domain family 4, member A |
| CLEC4A | 50856 | NP_919432 | 6729 | C-type lectin domain family 4, member A |
| CLEC4C | 170482 | NP_569708 | 5657 | C-type lectin domain family 4, member C |
| CLEC4C | 170482 | NP_987099 | 6948 | C-type lectin domain family 4, member C |
| CLEC4D | 338339 | NP_525126 | 5600 | C-type lectin domain family 4, member D |
| CLEC4E | 26253 | NP_055173 | 3922 | C-type lectin domain family 4, member E |
| CLEC4F | 165530 | NP_775806 | 6353 | C-type lectin domain family 4, member F |
| CLEC4G | 339390 | NP_940894 | 6801 | C-type lectin domain family 4, member G |
| CLEC4M | 10332 | NP_001138376 | 1784 | C-type lectin domain family 4, member M |
| CLEC4M | 10332 | NP_001138377 | 1785 | C-type lectin domain family 4, member M |
| CLEC4M | 10332 | NP_001138378 | 1786 | C-type lectin domain family 4, member M |
| CLEC4M | 10332 | NP_001138379 | 1787 | C-type lectin domain family 4, member M |
| CLEC4M | 10332 | NP_001138380 | 1788 | C-type lectin domain family 4, member M |
| CLEC4M | 10332 | NP_001138381 | 1789 | C-type lectin domain family 4, member M |
| CLEC4M | 10332 | NP_001138382 | 1790 | C-type lectin domain family 4, member M |
| CLEC4M | 10332 | NP_001138383 | 1791 | C-type lectin domain family 4, member M |
| CLEC4M | 10332 | NP_055072 | 3899 | C-type lectin domain family 4, member M |
| CLEC5A | 23601 | NP_037384 | 3790 | C-type lectin domain family 5, member A |
| CLEC7A | 64581 | NP_072092.2 | 7301 | C-type lectin domain containing 7A |
| CLECL1 | 160365 | NP_742001 | 6267 | C-type lectin-like 1 |
| CLGN | 1047 | NP_001124147 | 1433 | calmegin |
| CLGN | 1047 | NP_004353 | 3032 | calmegin |
| CLMN | 79789 | NP_079010 | 5072 | calmin (calponin-like, transmembrane) |
| CLMP | 79827 | NP_079045.1 | 7299 | CXADR like membrane protein |

FIG. 2 (CONT.)

| Antigen | GeneID | Accession No. | SEQ ID NO: | RefSeq Gene Name |
|---|---|---|---|---|
| CLN3 | 1201 | NP_000077 | 24 | ceroid-lipofuscinosis, neuronal 3 |
| CLN3 | 1201 | NP_001035897 | 886 | ceroid-lipofuscinosis, neuronal 3 |
| CLN5 | 1203 | NP_006484 | 3497 | ceroid-lipofuscinosis, neuronal 5 |
| CLN8 | 2055 | NP_061764 | 4532 | ceroid-lipofuscinosis, neuronal 8 (epilepsy, progressive with mental retardation) |
| CLPS | 1208 | NP_001823 | 2483 | colipase, pancreatic |
| CLPTM1 | 1209 | NP_001285 | 2336 | cleft lip and palate associated transmembrane protein 1 |
| CLPTM1L | 81037 | NP_110409 | 5171 | CLPTM1-like |
| CLRN1 | 7401 | NP_443721 | 5554 | clarin 1 |
| CLRN1 | 7401 | NP_777367 | 6402 | clarin 1 |
| CLRN3 | 119467 | NP_689524 | 6029 | clarin 3 |
| CLSTN1 | 22883 | NP_001009566 | 562 | calsyntenin 1 |
| CLSTN1 | 22883 | NP_055759 | 4018 | calsyntenin 1 |
| CLSTN2 | 64084 | NP_071414 | 4879 | calsyntenin 2 |
| CLSTN3 | 9746 | NP_055533 | 3977 | calsyntenin 3 |
| CLYBL | 171425 | NP_996531 | 6965 | citrate lyase beta like |
| CMKLR1 | 1240 | NP_001135815 | 1643 | chemokine-like receptor 1 |
| CMKLR1 | 1240 | NP_001135816 | 1644 | chemokine-like receptor 1 |
| CMKLR1 | 1240 | NP_001135817 | 1645 | chemokine-like receptor 1 |
| CMKLR1 | 1240 | NP_004063 | 2958 | chemokine-like receptor 1 |
| CMTM1 | 113540 | NP_443725 | 5555 | CKLF-like MARVEL transmembrane domain containing 1 |
| CMTM1 | 113540 | NP_851785 | 6582 | CKLF-like MARVEL transmembrane domain containing 1 |
| CMTM1 | 113540 | NP_851786 | 6583 | CKLF-like MARVEL transmembrane domain containing 1 |
| CMTM1 | 113540 | NP_851787 | 6584 | CKLF-like MARVEL transmembrane domain containing 1 |
| CMTM1 | 113540 | NP_851788 | 6585 | CKLF-like MARVEL transmembrane domain containing 1 |
| CMTM1 | 113540 | NP_851789 | 6586 | CKLF-like MARVEL transmembrane domain containing 1 |
| CMTM1 | 113540 | NP_851800 | 6587 | CKLF-like MARVEL transmembrane domain containing 1 |
| CMTM1 | 113540 | NP_851813 | 6588 | CKLF-like MARVEL transmembrane domain containing 1 |
| CMTM2 | 146225 | NP_653274 | 5887 | CKLF-like MARVEL transmembrane domain containing 2 |
| CMTM3 | 123920 | NP_653202.1 | 933 | CKLF-like MARVEL transmembrane domain containing 3 |
| CMTM3 | 123920 | NP_653202 | 5873 | CKLF-like MARVEL transmembrane domain containing 3 |
| CMTM3 | 123920 | NP_853531 | 6609 | CKLF-like MARVEL transmembrane domain containing 3 |
| CMTM3 | 123920 | NP_853532 | 6610 | CKLF-like MARVEL transmembrane domain containing 3 |
| CMTM4 | 146223 | NP_848933 | 6563 | CKLF-like MARVEL transmembrane domain containing 4 |
| CMTM4 | 146223 | NP_852662 | 6606 | CKLF-like MARVEL transmembrane domain containing 4 |
| CMTM5 | 116173 | NP_001032365 | 772 | CKLF-like MARVEL transmembrane domain containing 5 |
| CMTM5 | 116173 | NP_612469 | 5755 | CKLF-like MARVEL transmembrane domain containing 5 |
| CMTM6 | 54918 | NP_060271 | 4346 | CKLF-like MARVEL transmembrane domain containing 6 |
| CMTM7 | 112616 | NP_612419 | 5745 | CKLF-like MARVEL transmembrane domain containing 7 |
| CMTM7 | 112616 | NP_852137 | 6599 | CKLF-like MARVEL transmembrane domain containing 7 |
| CMTM8 | 152189 | NP_849199 | 6576 | CKLF-like MARVEL transmembrane domain containing 8 |
| CNEP1R1 | 255919 | NP_694993 | 6168 | transmembrane protein 188 |
| CNGA1 | 1259 | NP_000078 | 25 | cyclic nucleotide gated channel alpha 1 |
| CNGA1 | 1259 | NP_001136036 | 1674 | cyclic nucleotide gated channel alpha 1 |
| CNGA3 | 1261 | NP_001073347 | 1010 | cyclic nucleotide gated channel alpha 3 |
| CNGA3 | 1261 | NP_001289 | 2339 | cyclic nucleotide gated channel alpha 3 |
| CNGA4 | 1262 | NP_001032406 | 775 | cyclic nucleotide gated channel alpha 4 |
| CNGB3 | 54714 | NP_061971.3 | 7366 | cyclic nucleotide gated channel beta 3 |
| CNIH1 | 10175 | NP_005767 | 3365 | cornichonHomolog (Drosophila) |
| CNIH2 | 254263 | NP_872359 | 6658 | cornichonHomolog 2 (Drosophila) |
| CNIH3 | 149111 | NP_689708 | 6071 | cornichonHomolog 3 (Drosophila) |
| CNIH4 | 29097 | NP_054903 | 3877 | cornichonHomolog 4 (Drosophila) |
| CNNM2 | 54805 | NP_060119 | 4317 | cyclin M2 |
| CNNM2 | 54805 | NP_951058 | 6854 | cyclin M2 |
| CNNM2 | 54805 | NP_951059 | 6855 | cyclin M2 |
| CNNM3 | 26505 | NP_060093 | 4313 | cyclin M3 |
| CNNM3 | 26505 | NP_951060 | 6856 | cyclin M3 |
| CNNM4 | 26504 | NP_064569 | 4614 | cyclin M4 |
| CNOT1 | 23019 | NP_057368 | 4199 | CCR4-NOT transcription complex, subunit 1 |
| CNOT1 | 23019 | NP_996882 | 6995 | CCR4-NOT transcription complex, subunit 1 |
| CNPPD1 | 27013 | NP_056495 | 4113 | chromosome 2 open reading frame 24 |
| CNR1 | 1268 | NP_001153698 | 1982 | cannabinoid receptor 1 (brain) |
| CNR1 | 1268 | NP_001153730 | 1985 | cannabinoid receptor 1 (brain) |
| CNR1 | 1268 | NP_001153731 | 1986 | cannabinoid receptor 1 (brain) |
| CNR1 | 1268 | NP_001153698.1 | 1987 | cannabinoid receptor 1 (brain) |
| CNR1 | 1268 | NP_057167 | 4165 | cannabinoid receptor 1 (brain) |
| CNR1 | 1268 | NP_149421 | 5464 | cannabinoid receptor 1 (brain) |
| CNR2 | 1269 | NP_001832 | 2486 | cannabinoid receptor 2 (macrophage) |
| CNST | 163882 | NP_001132931 | 1620 | chromosome 1 open reading frame 71 |
| CNST | 163882 | NP_689822 | 6088 | chromosome 1 open reading frame 71 |
| CNTN1 | 1272 | NP_001834 | 2487 | contactin 1 |
| CNTN1 | 1272 | NP_778203 | 6435 | contactin 1 |
| CNTNAP1 | 8506 | NP_003623 | 2857 | contactin associated protein 1 |
| CNTNAP2 | 26047 | NP_054860 | 3871 | contactin associated protein-like 2 |
| CNTNAP4 | 85445 | NP_207837 | 5492 | contactin associated protein-like 4 |
| CNTNAP4 | 85445 | NP_620481 | 5816 | contactin associated protein-like 4 |
| CNTNAP5 | 129684 | NP_570129 | 5663 | contactin associated protein-like 5 |
| COA1 | 55744 | NP_060694 | 4404 | chromosome 7 open reading frame 44 |

FIG. 2 (CONT.)

| Antigen | GeneID | Accession No. | SEQ ID NO: | RefSeq Gene Name |
|---|---|---|---|---|
| COA3 | 28958 | NP_001035521 | 867 | coiled-coil domain containing 56 |
| COL11A2 | 1302 | NP_001157243 | 2057 | collagen, type XI, alpha 2 |
| COL11A2 | 1302 | NP_542410 | 5617 | collagen, type XI, alpha 2 |
| COL11A2 | 1302 | NP_542411 | 5618 | collagen, type XI, alpha 2 |
| COL11A2 | 1302 | NP_542412 | 5619 | collagen, type XI, alpha 2 |
| COL14A1 | 7373 | NP_066933 | 4773 | collagen, type XIV, alpha 1 |
| COL17A1 | 1308 | NP_000485 | 140 | collagen, type XVII, alpha 1 |
| COL24A1 | 255631 | NP_690850 | 6129 | collagen, type XXIV, alpha 1 |
| COL25A1 | 84570 | NP_115907 | 5365 | collagen, type XXV, alpha 1 |
| COL25A1 | 84570 | NP_942014 | 6835 | collagen, type XXV, alpha 1 |
| COL26A1 | 136227 | NP_597714 | 5694 | EMI domain containing 2 |
| COL4A2 | 1284 | NP_001837 | 2488 | collagen, type IV, alpha 2 |
| COLEC11 | 78989 | NP_076932 | 4996 | collectin sub-family member 11 |
| COLEC11 | 78989 | NP_954705 | 6868 | collectin sub-family member 11 |
| COLEC12 | 81035 | NP_569057 | 5650 | collectin sub-family member 12 |
| COLQ | 8292 | NP_005668.2 | 7306 | collagen like tail subunit of asymmetric acetylcholinesterase |
| COMT | 1312 | NP_000745 | 232 | catechol-O-methyltransferase |
| COMT | 1312 | NP_001128633 | 1531 | catechol-O-methyltransferase |
| COMT | 1312 | NP_001128634 | 1532 | catechol-O-methyltransferase |
| COMT | 1312 | NP_009294 | 3683 | catechol-O-methyltransferase |
| COMTD1 | 118881 | NP_653190 | 5871 | catechol-O-methyltransferase domain containing 1 |
| COQ2 | 27235 | NP_056512 | 4115 | coenzyme Q2Homolog, prenyltransferase (yeast) |
| COQ7 | 10229 | NP_057222 | 4175 | coenzyme Q7Homolog, ubiquinone (yeast) |
| CORIN | 10699 | NP_006578 | 3523 | corin, serine peptidase |
| COX10 | 1352 | NP_001294 | 2340 | COX10Homolog, cytochrome c oxidase assembly protein,Heme A: farnesyltransferase (yeast) |
| COX11 | 1353 | NP_001156333 | 2033 | COX11Homolog, cytochrome c oxidase assembly protein (yeast) |
| COX11 | 1353 | NP_001156334 | 2034 | COX11Homolog, cytochrome c oxidase assembly protein (yeast) |
| COX11 | 1353 | NP_004366 | 3035 | COX11Homolog, cytochrome c oxidase assembly protein (yeast) |
| COX14 | 84987 | NP_116290 | 5422 | chromosome 12 open reading frame 62 |
| COX15 | 1355 | NP_004367 | 3036 | COX15Homolog, cytochrome c oxidase assembly protein (yeast) |
| COX15 | 1355 | NP_510870 | 5589 | COX15Homolog, cytochrome c oxidase assembly protein (yeast) |
| COX18 | 285521 | NP_776188 | 6390 | COX18 cytochrome c oxidase assemblyHomolog (S. cerevisiae) |
| COX4I1 | 1327 | NP_001852 | 2491 | cytochrome c oxidase subunit IV isoform 1 |
| COX4I2 | 84701 | NP_115998 | 5379 | cytochrome c oxidase subunit IV isoform 2 (lung) |
| COX7A1 | 1346 | NP_001855 | 2492 | cytochrome c oxidase subunit VIIa polypeptide 1 (muscle) |
| COX7A2 | 1347 | NP_001856 | 2493 | cytochrome c oxidase subunit VIIa polypeptide 2 (liver) |
| COX7A2L | 9167 | NP_004709 | 3109 | cytochrome c oxidase subunit VIIa polypeptide 2 like |
| COX8A | 1351 | NP_004065 | 2959 | cytochrome c oxidase subunit 8A (ubiquitous) |
| COX8C | 341947 | NP_892016 | 6697 | cytochrome c oxidase subunit 8C |
| CPD | 1362 | NP_001295 | 2341 | carboxypeptidase D |
| CPED1 | 79974 | NP_001099003 | 1225 | chromosome 7 open reading frame 58 |
| CPED1 | 79974 | NP_079189 | 5102 | chromosome 7 open reading frame 58 |
| CPT1A | 1374 | NP_001027017 | 738 | carnitine palmitoyltransferase 1A (liver) |
| CPT1A | 1374 | NP_001867 | 2494 | carnitine palmitoyltransferase 1A (liver) |
| CPT1C | 126129 | NP_001129524 | 1596 | carnitine palmitoyltransferase 1C |
| CPT1C | 126129 | NP_689572 | 6042 | carnitine palmitoyltransferase 1C |
| CPXM2 | 119587 | NP_937791 | 6745 | carboxypeptidase X (M14 family), member 2 |
| CR1 | 1378 | NP_000564 | 165 | complement component (3b/4b) receptor 1 (Knops blood group) |
| CR1 | 1378 | NP_000642 | 186 | complement component (3b/4b) receptor 1 (Knops blood group) |
| CR2 | 1380 | NP_001006659 | 493 | complement component (3d/Epstein Barr virus) receptor 2 |
| CR2 | 1380 | NP_001868 | 2495 | complement component (3d/Epstein Barr virus) receptor 2 |
| CRB1 | 23418 | NP_957705 | 6891 | crumbsHomolog 1 (Drosophila) |
| CRB2 | 286204 | NP_775960 | 6381 | crumbsHomolog 2 (Drosophila) |
| CRB3 | 92359 | NP_631900 | 5838 | crumbsHomolog 3 (Drosophila) |
| CRB3 | 92359 | NP_777377 | 6403 | crumbsHomolog 3 (Drosophila) |
| CREG1 | 8804 | NP_003842 | 2914 | cellular repressor of E1A-stimulated genes 1 |
| CRELD1 | 78987 | NP_001026887 | 727 | cysteine-rich with EGF-like domains 1 |
| CRELD1 | 78987 | NP_001070883 | 966 | cysteine-rich with EGF-like domains 1 |
| CRELD1 | 78987 | NP_056328 | 4094 | cysteine-rich with EGF-like domains 1 |
| CRHR1 | 1394 | NP_001138618 | 1818 | corticotropin releasingHormone receptor 1 |
| CRHR1 | 1394 | NP_001138619 | 1819 | corticotropin releasingHormone receptor 1 |
| CRHR1 | 1394 | NP_001138620 | 1820 | corticotropin releasingHormone receptor 1 |
| CRHR1 | 1394 | NP_004373 | 3037 | corticotropin releasingHormone receptor 1 |
| CRHR2 | 1395 | NP_001874 | 2496 | corticotropin releasingHormone receptor 2 |
| CRIM1 | 51232 | NP_057525 | 4218 | cysteine rich transmembrane BMP regulator 1 (chordin-like) |
| CRISP3 | 10321 | NP_006052 | 3425 | cysteine-rich secretory protein 3 |
| CRISPLD2 | 83716 | NP_113664 | 5231 | cysteine-rich secretory protein LCCL domain containing 2 |
| CRLS1 | 54675 | NP_001120930 | 1330 | cardiolipin synthase 1 |
| CRLS1 | 54675 | NP_061968 | 4564 | cardiolipin synthase 1 |
| CRTAM | 56253 | NP_001291711.1 | 7453 | cytotoxic and regulatory T-cell molecule |
| CRTAP | 10491 | NP_006362 | 3477 | cartilage associated protein |
| CRY2 | 1408 | NP_001120929 | 1329 | cryptochrome 2 (photolyase-like) |
| CRY2 | 1408 | NP_066940 | 4778 | cryptochrome 2 (photolyase-like) |
| CRYGC | 1420 | NP_066269 | 4754 | crystallin, gamma C |
| CSF1 | 1435 | NP_000748 | 233 | colony stimulating factor 1 (macrophage) |
| CSF1 | 1435 | NP_757349 | 6292 | colony stimulating factor 1 (macrophage) |
| CSF1 | 1435 | NP_757350 | 6293 | colony stimulating factor 1 (macrophage) |

FIG. 2 (CONT.)

| Antigen | GeneID | Accession No. | SEQ ID NO: | RefSeq Gene Name |
|---|---|---|---|---|
| CSF1 | 1435 | NP_757351 | 6294 | colony stimulating factor 1 (macrophage) |
| CSF1R | 1436 | NP_005202 | 3229 | colony stimulating factor 1 receptor |
| CSF2RA | 1438 | NP_001155001 | 2017 | colony stimulating factor 2 receptor, alpha, low-affinity (granulocyte-macrophage) |
| CSF2RA | 1438 | NP_001155002 | 2018 | colony stimulating factor 2 receptor, alpha, low-affinity (granulocyte-macrophage) |
| CSF2RA | 1438 | NP_001155003 | 2019 | colony stimulating factor 2 receptor, alpha, low-affinity (granulocyte-macrophage) |
| CSF2RA | 1438 | NP_001155004 | 2020 | colony stimulating factor 2 receptor, alpha, low-affinity (granulocyte-macrophage) |
| CSF2RA | 1438 | NP_006131 | 3445 | colony stimulating factor 2 receptor, alpha, low-affinity (granulocyte-macrophage) |
| CSF2RA | 1438 | NP_758448 | 6302 | colony stimulating factor 2 receptor, alpha, low-affinity (granulocyte-macrophage) |
| CSF2RA | 1438 | NP_758449 | 6303 | colony stimulating factor 2 receptor, alpha, low-affinity (granulocyte-macrophage) |
| CSF2RA | 1438 | NP_758450 | 6304 | colony stimulating factor 2 receptor, alpha, low-affinity (granulocyte-macrophage) |
| CSF2RA | 1438 | NP_758452 | 6305 | colony stimulating factor 2 receptor, alpha, low-affinity (granulocyte-macrophage) |
| CSF2RB | 1439 | NP_000386.1 | 7275 | colony stimulating factor 2 receptor beta common subunit |
| CSF3 | 1440 | NP_000750 | 234 | colony stimulating factor 3 (granulocyte) |
| CSF3 | 1440 | NP_757373 | 6296 | colony stimulating factor 3 (granulocyte) |
| CSF3 | 1440 | NP_757374 | 6297 | colony stimulating factor 3 (granulocyte) |
| CSF3R | 1441 | NP_000751 | 235 | colony stimulating factor 3 receptor (granulocyte) |
| CSF3R | 1441 | NP_724780 | 6243 | colony stimulating factor 3 receptor (granulocyte) |
| CSF3R | 1441 | NP_724781 | 6244 | colony stimulating factor 3 receptor (granulocyte) |
| CSF3R | 1441 | NP_758519 | 6306 | colony stimulating factor 3 receptor (granulocyte) |
| CSGALNACT1 | 55790 | NP_001123990 | 1431 | chondroitin sulfate N-acetylgalactosaminyltransferase 1 |
| CSGALNACT1 | 55790 | NP_060841 | 4432 | chondroitin sulfate N-acetylgalactosaminyltransferase 1 |
| CSGALNACT2 | 55454 | NP_061060 | 4469 | chondroitin sulfate N-acetylgalactosaminyltransferase 2 novel protein similar to chondroitin sulfate GalNAcT-2 (GALNACT-2) |
| CSH1 | 1442 | NP_001308 | 2345 | chorionic somatomammotropinHormone 1 (placental lactogen) |
| CSH1 | 1442 | NP_066271 | 4755 | chorionic somatomammotropinHormone 1 (placental lactogen) |
| CSH1 | 1442 | NP_001308.1 | 4934 | chorionic somatomammotropinHormone 1 (placental lactogen) |
| CSH1 | 1442 | NP_001308.1 | 4935 | chorionic somatomammotropinHormone 1 (placental lactogen) |
| CSMD1 | 64478 | NP_150094 | 5472 | CUB and Sushi multiple domains 1 |
| CSMD2 | 114784 | NP_443128 | 5530 | CUB and Sushi multiple domains 2 |
| CSMD3 | 114788 | NP_443132 | 5532 | CUB and Sushi multiple domains 3 |
| CSMD3 | 114788 | NP_937756 | 6741 | CUB and Sushi multiple domains 3 |
| CSMD3 | 114788 | NP_937757 | 6742 | CUB and Sushi multiple domains 3 |
| CSPG4 | 1464 | NP_001888 | 2497 | chondroitin sulfate proteoglycan 4 |
| CSPG5 | 10675 | NP_006565 | 3516 | chondroitin sulfate proteoglycan 5 (neuroglycan C) |
| CST11 | 140880 | NP_543020 | 5636 | cystatin 11 |
| CST11 | 140880 | NP_570612 | 5665 | cystatin 11 |
| CST3 | 1471 | NP_000090 | 26 | cystatin C |
| CST9 | 128822 | NP_001008693 | 549 | cystatin 9 (testatin) |
| CST9L | 128821 | NP_542177 | 5611 | cystatin 9-like |
| CT83 | 203413 | NP_001017978 | 658 | chromosome X open reading frame 61 |
| CTAG1A | 246100 | NP_640343.1 | 7312 | cancer/testis antigen 1 |
| CTAG1B | 1485 | NP_001318.1 | 7258 | cancer/testis antigen 1B |
| CTAG2 | 30848 | NP_066274.2 | 7442 | cancer/testis antigen 2 |
| CTAGE1 | 64693 | NP_758441 | 6300 | cutaneous T-cell lymphoma-associated antigen 1 |
| CTAGE5 | 4253 | NP_001139131 | 1873 | CTAGE family, member 5 pseudogene, CTAGE family, member 4 |
| CTAGE5 | 4253 | NP_005921 | 3402 | CTAGE family, member 5 pseudogene, CTAGE family, member 4 |
| CTAGE5 | 4253 | NP_940897 | 6802 | CTAGE family, member 5 pseudogene, CTAGE family, member 4 |
| CTAGE5 | 4253 | NP_976229 | 6924 | CTAGE family, member 5 pseudogene, CTAGE family, member 4 |
| CTAGE5 | 4253 | NP_976230 | 6925 | CTAGE family, member 5 pseudogene, CTAGE family, member 4 |
| CTAGE5 | 4253 | NP_976231 | 6926 | CTAGE family, member 5 pseudogene, CTAGE family, member 4 |
| CTDNEP1 | 23399 | NP_001137247 | 1713 | dullardHomolog (Xenopus laevis) |
| CTDNEP1 | 23399 | NP_056158 | 4064 | dullardHomolog (Xenopus laevis) |
| CTLA4 | 1493 | NP_001032720 | 779 | cytotoxic T-lymphocyte-associated protein 4 |
| CTLA4 | 1493 | NP_005205 | 3230 | cytotoxic T-lymphocyte-associated protein 4 |
| CTNS | 1497 | NP_001026851 | 722 | cystinosis, nephropathic |
| CTNS | 1497 | NP_004928 | 3173 | cystinosis, nephropathic |
| CTRB2 | 440387 | NP_001020371 | 701 | chymotrypsinogen B2 |
| CTSA | 5476 | NP_000299 | 87 | cathepsin A |
| CTSA | 5476 | NP_001121167 | 1348 | cathepsin A |
| CTSA | 5476 | NP_001161066 | 2186 | cathepsin A |
| CTSZ | 1522 | NP_001327 | 2346 | cathepsin Z |
| CTXN1 | 404217 | NP_996664 | 6973 | cortexin 1 |
| CTXN3 | 613212 | NP_001041717 | 934 | cortexin 3 |
| CTXN3 | 613212 | NP_001120857 | 1322 | cortexin 3 |
| CUTA | 51596 | NP_001014433 | 621 | cutA divalent cation toleranceHomolog (E. coli) |
| CUTA | 51596 | NP_001014837 | 625 | cutA divalent cation toleranceHomolog (E. coli) |
| CUTA | 51596 | NP_001014838 | 626 | cutA divalent cation toleranceHomolog (E. coli) |
| CUTA | 51596 | NP_001014840 | 627 | cutA divalent cation toleranceHomolog (E. coli) |
| CUTA | 51596 | NP_057005 | 4135 | cutA divalent cation toleranceHomolog (E. coli) |
| CUX1 | 1523 | NP_001904 | 2498 | cut-likeHomeobox 1 |
| CUX1 | 1523 | NP_852477 | 6603 | cut-likeHomeobox 1 |
| CUX1 | 1523 | NP_853530 | 6608 | cut-likeHomeobox 1 |
| CWH43 | 80157 | NP_079363 | 5119 | hypothetical protein FLJ21511 |
| CX3CL1 | 6376 | NP_002987 | 2746 | chemokine (C-X3-C motif) ligand 1 |
| CX3CR1 | 1524 | NP_001164642 | 2272 | chemokine (C-X3-C motif) receptor 1 |
| CX3CR1 | 1524 | NP_001164643 | 2273 | chemokine (C-X3-C motif) receptor 1 |
| CX3CR1 | 1524 | NP_001164645 | 2274 | chemokine (C-X3-C motif) receptor 1 |

FIG. 2 (CONT.)

| Antigen | GeneID | Accession No. | SEQ ID NO: | RefSeq Gene Name |
|---|---|---|---|---|
| CX3CR1 | 1524 | NP_001328 | 2347 | chemokine (C-X3-C motif) receptor 1 |
| CXADR | 1525 | NP_001329 | 2348 | coxsackie virus and adenovirus receptor pseudogene 2 coxsackie virus and adenovirus receptor |
| CXCL10 | 3627 | NP_001556.2 | 7375 | C-X-C motif chemokine ligand 10 |
| CXCL14 | 9547 | NP_004878 | 3161 | chemokine (C-X-C motif) ligand 14 |
| CXCL16 | 58191 | NP_001094282 | 1193 | chemokine (C-X-C motif) ligand 16 |
| CXCL16 | 58191 | NP_071342 | 4870 | chemokine (C-X-C motif) ligand 16 |
| CXCL8 | 3576 | NP_000575 | 168 | interleukin 8 |
| CXCL9 | 4283 | NP_002407 | 2648 | chemokine (C-X-C motif) ligand 9 |
| CXCR1 | 3577 | NP_000625 | 183 | interleukin 8 receptor, alpha |
| CXCR2 | 3579 | NP_001161770 | 2215 | interleukin 8 receptor, beta |
| CXCR2 | 3579 | NP_001548 | 2412 | interleukin 8 receptor, beta |
| CXCR3 | 2833 | NP_001136269 | 1703 | chemokine (C-X-C motif) receptor 3 |
| CXCR3 | 2833 | NP_001495 | 2393 | chemokine (C-X-C motif) receptor 3 |
| CXCR4 | 7852 | NP_001008540 | 547 | chemokine (C-X-C motif) receptor 4 |
| CXCR4 | 7852 | NP_003458 | 2836 | chemokine (C-X-C motif) receptor 4 |
| CXCR5 | 643 | NP_001707.1 | 7256 | C-X-C motif chemokine receptor 5 |
| CXCR6 | 10663 | NP_006555 | 3512 | chemokine (C-X-C motif) receptor 6 |
| CYB561 | 1534 | NP_001017916 | 646 | cytochrome b-561 |
| CYB561 | 1534 | NP_001017917 | 647 | cytochrome b-561 |
| CYB561 | 1534 | NP_001906 | 2500 | cytochrome b-561 |
| CYB561A3 | 220002 | NP_001154924 | 2012 | cytochrome b, ascorbate dependent 3 |
| CYB561A3 | 220002 | NP_001154926 | 2013 | cytochrome b, ascorbate dependent 3 |
| CYB561A3 | 220002 | NP_705839 | 6201 | cytochrome b, ascorbate dependent 3 |
| CYB561D1 | 284613 | NP_001127872 | 1482 | cytochrome b-561 domain containing 1 |
| CYB561D1 | 284613 | NP_001127874 | 1483 | cytochrome b-561 domain containing 1 |
| CYB561D1 | 284613 | NP_001127875 | 1484 | cytochrome b-561 domain containing 1 |
| CYB561D1 | 284613 | NP_001127876 | 1485 | cytochrome b-561 domain containing 1 |
| CYB561D1 | 284613 | NP_872386 | 6664 | cytochrome b-561 domain containing 1 |
| CYB561D2 | 11068 | NP_008953 | 3616 | cytochrome b-561 domain containing 2 |
| CYB5A | 1528 | NP_001905 | 2499 | cytochrome b5 type A (microsomal) |
| CYB5A | 1528 | NP_683725 | 6008 | cytochrome b5 type A (microsomal) |
| CYB5B | 80777 | NP_085056 | 5150 | cytochrome b5 type B (outer mitochondrial membrane) |
| CYB5D2 | 124936 | NP_653212 | 5874 | cytochrome b5 domain containing 2 |
| CYB5R1 | 51706 | NP_057327 | 4192 | cytochrome b5 reductase 1 |
| CYB5R2 | 51700 | NP_057313 | 4186 | cytochrome b5 reductase 2 |
| CYBA | 1535 | NP_000092 | 27 | cytochrome b-245, alpha polypeptide |
| CYBB | 1536 | NP_000388 | 118 | cytochrome b-245, beta polypeptide |
| CYBRD1 | 79901 | NP_001120855 | 1321 | cytochrome b reductase 1 |
| CYBRD1 | 79901 | NP_079119 | 5091 | cytochrome b reductase 1 |
| CYHR1 | 50626 | NP_001123360 | 1403 | cysteine/histidine-rich 1 |
| CYHR1 | 50626 | NP_116076 | 5387 | cysteine/histidine-rich 1 |
| CYHR1 | 50626 | NP_612505 | 5758 | cysteine/histidine-rich 1 |
| CYP19A1 | 1588 | NP_000094 | 28 | cytochrome P450, family 19, subfamily A, polypeptide 1 |
| CYP19A1 | 1588 | NP_112503 | 5211 | cytochrome P450, family 19, subfamily A, polypeptide 1 |
| CYP1A1 | 1543 | NP_000490 | 141 | cytochrome P450, family 1, subfamily A, polypeptide 1 |
| CYP1A2 | 1544 | NP_000752 | 236 | cytochrome P450, family 1, subfamily A, polypeptide 2 |
| CYP1B1 | 1545 | NP_000095 | 29 | cytochrome P450, family 1, subfamily B, polypeptide 1 |
| CYP20A1 | 57404 | NP_803882 | 6496 | cytochrome P450, family 20, subfamily A, polypeptide 1 |
| CYP26B1 | 56603 | NP_063938 | 4590 | cytochrome P450, family 26, subfamily B, polypeptide 1 |
| CYP2A13 | 1553 | NP_000757 | 240 | cytochrome P450, family 2, subfamily A, polypeptide 13 |
| CYP2A6 | 1548 | NP_000753 | 237 | cytochrome P450, family 2, subfamily A, polypeptide 6 |
| CYP2A7 | 1549 | NP_000755 | 238 | cytochrome P450, family 2, subfamily A, polypeptide 7 |
| CYP2A7 | 1549 | NP_085079 | 5151 | cytochrome P450, family 2, subfamily A, polypeptide 7 |
| CYP2C8 | 1558 | NP_000761 | 241 | cytochrome P450, family 2, subfamily C, polypeptide 8 |
| CYP2E1 | 1571 | NP_000764 | 242 | cytochrome P450, family 2, subfamily E, polypeptide 1 |
| CYP2J2 | 1573 | NP_000766 | 243 | cytochrome P450, family 2, subfamily J, polypeptide 2 |
| CYP2R1 | 120227 | NP_078790 | 5038 | cytochrome P450, family 2, subfamily R, polypeptide 1 |
| CYP2S1 | 29785 | NP_085125 | 5152 | cytochrome P450, family 2, subfamily S, polypeptide 1 |
| CYP2U1 | 113612 | NP_898898 | 6702 | cytochrome P450, family 2, subfamily U, polypeptide 1 |
| CYP39A1 | 51302 | NP_057677 | 4254 | cytochrome P450, family 39, subfamily A, polypeptide 1 |
| CYP3A4 | 1576 | NP_059488 | 4296 | cytochrome P450, family 3, subfamily A, polypeptide 4 |
| CYP3A43 | 64816 | NP_073731 | 4948 | cytochrome P450, family 3, subfamily A, polypeptide 43 |
| CYP3A43 | 64816 | NP_476436 | 5575 | cytochrome P450, family 3, subfamily A, polypeptide 43 |
| CYP3A43 | 64816 | NP_476437 | 5576 | cytochrome P450, family 3, subfamily A, polypeptide 43 |
| CYP3A5 | 1577 | NP_000768 | 244 | cytochrome P450, family 3, subfamily A, polypeptide 5 |
| CYP3A7 | 1551 | NP_000756 | 239 | cytochrome P450, family 3, subfamily A, polypeptide 7 |
| CYP4A11 | 1579 | NP_000769 | 245 | cytochrome P450, family 4, subfamily A, polypeptide 11 |
| CYP4B1 | 1580 | NP_000770 | 246 | cytochrome P450, family 4, subfamily B, polypeptide 1 |
| CYP4B1 | 1580 | NP_001093242 | 1172 | cytochrome P450, family 4, subfamily B, polypeptide 1 |
| CYP4F12 | 66002 | NP_076433 | 4987 | similar to cytochrome P450, family 4, subfamily F, polypeptide 12 |
| CYP4F2 | 8529 | NP_001073 | 988 | cytochrome P450, family 4, subfamily F, polypeptide 2 |
| CYP4F22 | 126410 | NP_775754 | 6344 | cytochrome P450, family 4, subfamily F, polypeptide 22 |
| CYP4F8 | 11283 | NP_009184 | 3660 | cytochrome P450, family 4, subfamily F, polypeptide 8 |
| CYP4V2 | 285440 | NP_997235 | 7015 | cytochrome P450, family 4, subfamily V, polypeptide 2 |
| CYP4X1 | 260293 | NP_828847 | 6516 | cytochrome P450, family 4, subfamily X, polypeptide 1 |
| CYP4Z1 | 199974 | NP_835235 | 6519 | cytochrome P450, family 4, subfamily Z, polypeptide 1 |
| CYP51A1 | 1595 | NP_000777 | 247 | cytochrome P450, family 51, subfamily A, polypeptide 1 |

FIG. 2 (CONT.)

| Antigen | GeneID | Accession No. | SEQ ID NO: | RefSeq Gene Name |
|---|---|---|---|---|
| CYP51A1 | 1595 | NP_001139624 | 1908 | cytochrome P450, family 51, subfamily A, polypeptide 1 |
| CYP7B1 | 9420 | NP_004811 | 3137 | cytochrome P450, family 7, subfamily B, polypeptide 1 |
| CYP8B1 | 1582 | NP_004382 | 3038 | cytochrome P450, family 8, subfamily B, polypeptide 1 |
| CYSLTR1 | 10800 | NP_006630 | 3534 | cysteinyl leukotriene receptor 1 |
| CYSLTR2 | 57105 | NP_065110 | 4639 | cysteinyl leukotriene receptor 2 |
| CYYR1 | 116159 | NP_443186 | 5549 | cysteine/tyrosine-rich 1 |
| DAD1 | 1603 | NP_001335 | 2349 | defender against cell death 1 |
| DAG1 | 1605 | NP_001159400 | 2128 | dystroglycan 1 (dystrophin-associated glycoprotein 1) |
| DAG1 | 1605 | NP_004384 | 3039 | dystroglycan 1 (dystrophin-associated glycoprotein 1) |
| DAGLA | 747 | NP_006124 | 3439 | diacylglycerol lipase, alpha |
| DAGLB | 221955 | NP_001136408 | 1708 | diacylglycerol lipase, beta |
| DAGLB | 221955 | NP_631918 | 5846 | diacylglycerol lipase, beta |
| DAPL1 | 92196 | NP_001017920 | 648 | death associated protein-like 1 |
| DBH | 1621 | NP_000778 | 248 | dopamine beta-hydroxylase (dopamine beta-monooxygenase) |
| DBI | 1622 | NP_001073331 | 1006 | diazepam binding inhibitor (GABA receptor modulator, acyl-Coenzyme A binding protein) |
| DBI | 1622 | NP_001073332 | 1007 | diazepam binding inhibitor (GABA receptor modulator, acyl-Coenzyme A binding protein) |
| DBI | 1622 | NP_065438 | 4684 | diazepam binding inhibitor (GABA receptor modulator, acyl-Coenzyme A binding protein) |
| DCBLD1 | 285761 | NP_775945 | 6378 | discoidin, CUB and LCCL domain containing 1 |
| DCBLD2 | 131566 | NP_563615 | 5648 | discoidin, CUB and LCCL domain containing 2 |
| DCC | 1630 | NP_005206 | 3231 | deleted in colorectal carcinoma |
| DCHS1 | 8642 | NP_003728 | 2881 | dachsous 1 (Drosophila) |
| DCHS2 | 54798 | NP_001136024 | 1672 | dachsous 2 (Drosophila) |
| DCHS2 | 54798 | NP_001136025 | 1673 | dachsous 2 (Drosophila) |
| DCHS2 | 54798 | NP_060109 | 4316 | dachsous 2 (Drosophila) |
| DCST1 | 149095 | NP_001137159 | 1712 | DC-STAMP domain containing 1 |
| DCST1 | 149095 | NP_689707 | 6070 | DC-STAMP domain containing 1 |
| DCST2 | 127579 | NP_653223 | 5876 | DC-STAMP domain containing 2 |
| DCSTAMP | 81501 | NP_001244246.1 | 7433 | dendrocyte expressed seven transmembrane protein |
| DCT | 1638 | NP_001123361 | 1404 | dopachrome tautomerase (dopachrome delta-isomerase, tyrosine-related protein 2) |
| DCT | 1638 | NP_001913 | 2501 | dopachrome tautomerase (dopachrome delta-isomerase, tyrosine-related protein 2) |
| DCUN1D5 | 84259 | NP_115675 | 5321 | DCN1, defective in cullin neddylation 1, domain containing 5 (S. cerevisiae) |
| DDB1 | 1642 | NP_001914 | 2502 | damage-specific DNA binding protein 1, 127kDa |
| DDB2 | 1643 | NP_000098 | 30 | damage-specific DNA binding protein 2, 48kDa |
| DDC | 1644 | NP_000781 | 250 | dopa decarboxylase (aromatic L-amino acid decarboxylase) |
| DDC | 1644 | NP_001076440 | 1065 | dopa decarboxylase (aromatic L-amino acid decarboxylase) |
| DDOST | 1650 | NP_005207 | 3232 | dolichyl-diphosphooligosaccharide-protein glycosyltransferase |
| DDR1 | 780 | NP_001945 | 2509 | discoidin domain receptor tyrosine kinase 1 |
| DDR1 | 780 | NP_054699 | 3849 | discoidin domain receptor tyrosine kinase 1 |
| DDR1 | 780 | NP_054700 | 3850 | discoidin domain receptor tyrosine kinase 1 |
| DDR2 | 4921 | NP_001014796 | 623 | discoidin domain receptor tyrosine kinase 2 |
| DDR2 | 4921 | NP_006173 | 3452 | discoidin domain receptor tyrosine kinase 2 |
| DDX3X | 1654 | NP_001180345.1 | 7424 | DEAD-box helicase 3, X-linked |
| DDX59 | 83479 | NP_001026895 | 728 | DEAD (Asp-Glu-Ala-Asp) box polypeptide 59 |
| DEAF1 | 10522 | NP_066288 | 4758 | deformed epidermal autoregulatory factor 1 (Drosophila) |
| DEFB126 | 81623 | NP_112193 | 5197 | defensin, beta 126 |
| DEGS1 | 8560 | NP_003667 | 2868 | degenerative spermatocyteHomolog 1, lipid desaturase (Drosophila) |
| DEGS1 | 8560 | NP_001308470.1 | 5905 | degenerative spermatocyteHomolog 1, lipid desaturase (Drosophila) |
| DEGS2 | 123099 | NP_996801 | 6980 | degenerative spermatocyteHomolog 2, lipid desaturase (Drosophila) |
| DENND1B | 163486 | NP_001182144.1 | 1702 | DENN/MADD domain containing 1B |
| DENND1B | 163486 | NP_659414 | 5911 | DENN/MADD domain containing 1B |
| DENND5A | 23258 | NP_056028 | 4047 | DENN/MADD domain containing 5A |
| DENND5B | 160518 | NP_659410 | 5910 | DENN/MADD domain containing 5B |
| DERL1 | 79139 | NP_001128143 | 1502 | Der1-like domain family, member 1 |
| DERL1 | 79139 | NP_077271 | 5016 | Der1-like domain family, member 1 |
| DERL2 | 51009 | NP_057125 | 4158 | Der1-like domain family, member 2 |
| DEXI | 28955 | NP_054734 | 3854 | dexamethasone-induced transcript |
| DGAT1 | 8694 | NP_036211 | 3699 | diacylglycerol O-acyltransferaseHomolog 1 (mouse) |
| DGAT2 | 84649 | NP_115953 | 5371 | diacylglycerol O-acyltransferaseHomolog 2 (mouse) |
| DGCR2 | 9993 | NP_005128 | 3219 | DiGeorge syndrome critical region gene 2 |
| DGKE | 8526 | NP_003638 | 2863 | diacylglycerol kinase, epsilon 64kDa |
| DHCR24 | 1718 | NP_055577 | 3985 | 24-dehydrocholesterol reductase |
| DHCR7 | 1717 | NP_001157289 | 2058 | 7-dehydrocholesterol reductase |
| DHCR7 | 1717 | NP_001351 | 2350 | 7-dehydrocholesterol reductase |
| DHODH | 1723 | NP_001352 | 2351 | dihydroorotate dehydrogenase |
| DHRS11 | 79154 | NP_077284 | 5021 | dehydrogenase/reductase (SDR family) member 11 |
| DHRS13 | 147015 | NP_653284 | 5891 | dehydrogenase/reductase (SDR family) member 13 |
| DHRS2 | 10202 | NP_005785 | 3369 | dehydrogenase/reductase (SDR family) member 2 |
| DHRS2 | 10202 | NP_878912 | 6691 | dehydrogenase/reductase (SDR family) member 2 |
| DHRS3 | 9249 | NP_004744 | 3117 | dehydrogenase/reductase (SDR family) member 3 |
| DHRS7 | 51635 | NP_057113 | 4155 | dehydrogenase/reductase (SDR family) member 7 |
| DHRS7B | 25979 | NP_056325 | 4093 | dehydrogenase/reductase (SDR family) member 7B |
| DHRS7C | 201140 | NP_001099041 | 1229 | dehydrogenase/reductase (SDR family) member 7C |
| DHRS9 | 10170 | NP_001135742 | 1628 | dehydrogenase/reductase (SDR family) member 9 |
| DHRS9 | 10170 | NP_001135743 | 1629 | dehydrogenase/reductase (SDR family) member 9 |
| DHRS9 | 10170 | NP_001135742.1 | 3364 | dehydrogenase/reductase (SDR family) member 9 |
| DHRS9 | 10170 | NP_954674 | 6865 | dehydrogenase/reductase (SDR family) member 9 |
| DIABLO | 56616 | NP_063940 | 4591 | diabloHomolog (Drosophila) |

FIG. 2 (CONT.)

| Antigen | GeneID | Accession No. | SEQ ID NO: | RefSeq Gene Name |
|---|---|---|---|---|
| DIABLO | 56616 | NP_001265231.1 | 5805 | diabloHomolog (Drosophila) |
| DIO1 | 1733 | NP_000783 | 251 | deiodinase, iodothyronine, type I |
| DIO1 | 1733 | NP_001034804 | 810 | deiodinase, iodothyronine, type I |
| DIO1 | 1733 | NP_001034805 | 811 | deiodinase, iodothyronine, type I |
| DIO1 | 1733 | NP_998758 | 7039 | deiodinase, iodothyronine, type I |
| DIO2 | 1734 | NP_000784 | 252 | deiodinase, iodothyronine, type II |
| DIO2 | 1734 | NP_001007024 | 497 | deiodinase, iodothyronine, type II |
| DIO2 | 1734 | NP_054644 | 3848 | deiodinase, iodothyronine, type II |
| DIO3 | 1735 | NP_001353 | 2352 | deiodinase, iodothyronine, type III |
| DIP2C | 22982 | NP_055789 | 4020 | DIP2 disco-interacting protein 2Homolog C (Drosophila) |
| DISP1 | 84976 | NP_116279 | 5420 | dispatchedHomolog 1 (Drosophila) |
| DISP2 | 85455 | NP_277045.1 | 7320 | dispatched RND transporter family member 2 |
| DKK1 | 22943 | NP_036374.1 | 7282 | dickkopf WNT signaling pathway inhibitor 1 |
| DKKL1 | 27120 | NP_055234 | 3935 | dickkopf-like 1 (soggy) |
| DLK2 | 65989 | NP_076421 | 4986 | delta-like 2Homolog (Drosophila) |
| DLK2 | 65989 | NP_996262 | 6964 | delta-like 2Homolog (Drosophila) |
| DLL1 | 28514 | NP_005609 | 3326 | delta-like 1 (Drosophila) |
| DLL3 | 10683 | NP_058637 | 4275 | delta-like 3 (Drosophila) |
| DLL3 | 10683 | NP_982353 | 6946 | delta-like 3 (Drosophila) |
| DLL4 | 54567 | NP_061947 | 4556 | delta-like 4 (Drosophila) |
| DMRT2 | 10655 | NP_001124337 | 1445 | doublesex and mab-3 related transcription factor 2 |
| DMRT2 | 10655 | NP_006548 | 3511 | doublesex and mab-3 related transcription factor 2 |
| DMRT2 | 10655 | NP_870987 | 6641 | doublesex and mab-3 related transcription factor 2 |
| DNAH10 | 196385 | NP_997320 | 7021 | dynein, axonemal, Heavy chain 10 |
| DNAJB11 | 51726 | NP_057390 | 4200 | DnaJ (Hsp40)Homolog, subfamily B, member 11 |
| DNAJB12 | 54788 | NP_001002762 | 403 | DnaJ (Hsp40)Homolog, subfamily B, member 12 |
| DNAJB12 | 54788 | NP_060096 | 4314 | DnaJ (Hsp40)Homolog, subfamily B, member 12 |
| DNAJB8 | 165721 | NP_699161.1 | 7318 | DnaJ heat shock protein family (Hsp40) member B8 |
| DNAJB9 | 4189 | NP_036460 | 3747 | DnaJ (Hsp40)Homolog, subfamily B, member 9 |
| DNAJC1 | 64215 | NP_071760 | 4905 | DnaJ (Hsp40)Homolog, subfamily C, member 1 |
| DNAJC10 | 54431 | NP_061854 | 4545 | DnaJ (Hsp40)Homolog, subfamily C, member 10 |
| DNAJC14 | 85406 | NP_115740 | 5334 | DnaJ (Hsp40)Homolog, subfamily C, member 14 |
| DNAJC15 | 29103 | NP_037370 | 3788 | DnaJ (Hsp40)Homolog, subfamily C, member 15 |
| DNAJC16 | 23341 | NP_056106 | 4058 | DnaJ (Hsp40)Homolog, subfamily C, member 16 |
| DNAJC18 | 202052 | NP_689899 | 6098 | DnaJ (Hsp40)Homolog, subfamily C, member 18 |
| DNAJC19 | 131118 | NP_660304 | 5945 | similar to translocase of the inner mitochondrial membrane 14, DnaJ (Hsp40)Homolog, subfamily C, member 19 |
| DNAJC22 | 79962 | NP_079178 | 5100 | DnaJ (Hsp40)Homolog, subfamily C, member 22 |
| DNAJC25 | 548645 | NP_001015882 | 636 | DnaJ (Hsp40)Homolog, subfamily C, member 25, guanine nucleotide binding protein (G protein), gamma 10 |
| DNAJC25 | 548645 | NP_001017998 | 660 | DnaJ (Hsp40)Homolog, subfamily C, member 25, guanine nucleotide binding protein (G protein), gamma 10 |
| DNAJC25 | 548645 | NP_004116 | 2971 | DnaJ (Hsp40)Homolog, subfamily C, member 25, guanine nucleotide binding protein (G protein), gamma 10 |
| DNAJC30 | 84277 | NP_115693 | 5325 | DnaJ (Hsp40)Homolog, subfamily C, member 30 |
| DNAJC4 | 3338 | NP_005519 | 3308 | DnaJ (Hsp40)Homolog, subfamily C, member 4 |
| DNAJC5 | 80331 | NP_079495 | 5134 | DnaJ (Hsp40)Homolog, subfamily C, member 5 |
| DNAJC5G | 285126 | NP_775921 | 6372 | DnaJ (Hsp40)Homolog, subfamily C, member 5 gamma |
| DNASE1 | 1773 | NP_005214 | 3233 | deoxyribonuclease I |
| DNASE2B | 58511 | NP_067056 | 4799 | deoxyribonuclease II beta |
| DNASE2B | 58511 | NP_490649 | 5588 | deoxyribonuclease II beta |
| DNER | 92737 | NP_620711.3 | 7365 | delta/notch like EGF repeat containing |
| DOLK | 22845 | NP_055723 | 4010 | dolichol kinase |
| DOLPP1 | 57171 | NP_001129389 | 1575 | dolichyl pyrophosphate phosphatase 1 |
| DOLPP1 | 57171 | NP_065171 | 4659 | dolichyl pyrophosphate phosphatase 1 |
| DPAGT1 | 1798 | NP_001373 | 2353 | dolichyl-phosphate (UDP-N-acetylglucosamine) N-acetylglucosaminephosphotransferase 1 (GlcNAc-1-P transferase) |
| DPCR1 | 135656 | NP_543146 | 5641 | diffuse panbronchiolitis critical region 1 |
| DPEP1 | 1800 | NP_001121613.1 | 7391 | dipeptidase 1 (renal) |
| DPEP2 | 64174 | NP_071750 | 4901 | dipeptidase 2 |
| DPM2 | 8818 | NP_003854 | 2920 | dolichyl-phosphate mannosyltransferase polypeptide 2, regulatory subunit |
| DPP10 | 57628 | NP_001004360 | 432 | dipeptidyl-peptidase 10 |
| DPP10 | 57628 | NP_065919 | 4736 | dipeptidyl-peptidase 10 |
| DPP4 | 1803 | NP_001926 | 2503 | dipeptidyl-peptidase 4 |
| DPP6 | 1804 | NP_001034439 | 789 | dipeptidyl-peptidase 6 |
| DPP6 | 1804 | NP_001927 | 2504 | dipeptidyl-peptidase 6 |
| DPP6 | 1804 | NP_570629 | 5666 | dipeptidyl-peptidase 6 |
| DPP7 | 29952 | NP_037511 | 3814 | dipeptidyl-peptidase 7 |
| DPP8 | 54878 | NP_060213 | 4333 | dipeptidyl-peptidase 8 |
| DPP8 | 54878 | NP_569118 | 5654 | dipeptidyl-peptidase 8 |
| DPP8 | 54878 | NP_932064 | 6734 | dipeptidyl-peptidase 8 |
| DPP8 | 54878 | NP_932065 | 6735 | dipeptidyl-peptidase 8 |
| DPY19L1 | 23333 | NP_056098 | 4057 | dpy-19-like 1 (C. elegans) |
| DPY19L2 | 283417 | NP_776173 | 6389 | dpy-19-like 2 (C. elegans) |
| DPY19L3 | 147991 | NP_997208 | 7008 | dpy-19-like 3 (C. elegans) |
| DPY19L4 | 286148 | NP_861452 | 6635 | dpy-19-like 4 (C. elegans) |
| DRAM1 | 55332 | NP_060840 | 4431 | DNA-damage regulated autophagy modulator 1 |
| DRAM2 | 128338 | NP_848549 | 6542 | DNA-damage regulated autophagy modulator 2 |
| DRAXIN | 374946 | NP_940947 | 6812 | chromosome 1 open reading frame 187 |
| DRD1 | 1812 | NP_000785 | 253 | dopamine receptor D1 |
| DRD2 | 1813 | NP_000786 | 254 | dopamine receptor D2 |

FIG. 2 (CONT.)

| Antigen | GeneID | Accession No. | SEQ ID NO: | RefSeq Gene Name |
|---|---|---|---|---|
| DRD2 | 1813 | NP_057658 | 4248 | dopamine receptor D2 |
| DRD3 | 1814 | NP_000787 | 255 | dopamine receptor D3 |
| DRD3 | 1814 | NP_387512 | 5511 | dopamine receptor D3 |
| DRD4 | 1815 | NP_000788 | 256 | dopamine receptor D4 |
| DRD5 | 1816 | NP_000789 | 257 | dopamine receptor D5 |
| DSC1 | 1823 | NP_004939 | 3174 | desmocollin 1 |
| DSC1 | 1823 | NP_077739 | 5028 | desmocollin 1 |
| DSC2 | 1824 | NP_004940 | 3175 | desmocollin 2 |
| DSC2 | 1824 | NP_077740 | 5029 | desmocollin 2 |
| DSC3 | 1825 | NP_001932 | 2505 | desmocollin 3 |
| DSC3 | 1825 | NP_077741 | 5030 | desmocollin 3 |
| DSCAM | 1826 | NP_001380 | 2354 | Down syndrome cell adhesion molecule |
| DSCAML1 | 57453 | NP_065744 | 4701 | Down syndrome cell adhesion molecule like 1 |
| DSE | 29940 | NP_001074445 | 1043 | dermatan sulfate epimerase |
| DSE | 29940 | NP_037484 | 3810 | dermatan sulfate epimerase |
| DSEL | 92126 | NP_115536 | 5303 | dermatan sulfate epimerase-like |
| DSG2 | 1829 | NP_001934 | 2506 | desmoglein 2 |
| DST | 667 | NP_001138241 | 1772 | dystonin |
| DST | 667 | NP_001138242 | 1773 | dystonin |
| DST | 667 | NP_001138243 | 1774 | dystonin |
| DST | 667 | NP_001714 | 2445 | dystonin |
| DST | 667 | NP_056363 | 4099 | dystonin |
| DST | 667 | NP_001138241.1 | 4643 | dystonin |
| DST | 667 | NP_899236 | 6707 | dystonin |
| DTD1 | 92675 | NP_036340 | 3722 | histidyl-tRNA synthetase 2, mitochondrial (putative) D-tyrosyl-tRNA deacylase 1Homolog (S. cerevisiae) |
| DTD1 | 92675 | NP_543010 | 5634 | histidyl-tRNA synthetase 2, mitochondrial (putative) D-tyrosyl-tRNA deacylase 1Homolog (S. cerevisiae) |
| DTNA | 1837 | NP_001121647 | 1365 | dystrobrevin, alpha |
| DTNA | 1837 | NP_001381 | 2355 | dystrobrevin, alpha |
| DTNA | 1837 | NP_001382 | 2356 | dystrobrevin, alpha |
| DTNA | 1837 | NP_001383 | 2357 | dystrobrevin, alpha |
| DTNA | 1837 | NP_116757 | 5432 | dystrobrevin, alpha |
| DTNA | 1837 | NP_116760 | 5433 | dystrobrevin, alpha |
| DTNA | 1837 | NP_116761 | 5434 | dystrobrevin, alpha |
| DTNA | 1837 | NP_116762 | 5435 | dystrobrevin, alpha |
| DTNA | 1837 | NP_116763 | 5436 | dystrobrevin, alpha |
| DUOX1 | 53905 | NP_059130 | 4289 | dual oxidase 1 |
| DUOX1 | 53905 | NP_787954 | 6472 | dual oxidase 1 |
| DUOX2 | 50506 | NP_054799 | 3868 | dual oxidase 2 |
| DUOXA1 | 90527 | NP_653166 | 5862 | dual oxidase maturation factor 1 |
| DUOXA2 | 405753 | NP_997464 | 7025 | dual oxidase maturation factor 2 |
| DUSP13 | 51207 | NP_001007272 | 513 | dual specificity phosphatase 13 |
| DUSP13 | 51207 | NP_001007273 | 514 | dual specificity phosphatase 13 |
| DUSP13 | 51207 | NP_001007274 | 515 | dual specificity phosphatase 13 |
| DUSP13 | 51207 | NP_057448 | 4212 | dual specificity phosphatase 13 |
| DYSF | 8291 | NP_001123927 | 1425 | dysferlin, limb girdle muscular dystrophy 2B (autosomal recessive) |
| DYSF | 8291 | NP_001124448 | 1453 | dysferlin, limb girdle muscular dystrophy 2B (autosomal recessive) |
| DYSF | 8291 | NP_001124449 | 1454 | dysferlin, limb girdle muscular dystrophy 2B (autosomal recessive) |
| DYSF | 8291 | NP_001124450 | 1455 | dysferlin, limb girdle muscular dystrophy 2B (autosomal recessive) |
| DYSF | 8291 | NP_001124451 | 1456 | dysferlin, limb girdle muscular dystrophy 2B (autosomal recessive) |
| DYSF | 8291 | NP_001124452 | 1457 | dysferlin, limb girdle muscular dystrophy 2B (autosomal recessive) |
| DYSF | 8291 | NP_001124453 | 1458 | dysferlin, limb girdle muscular dystrophy 2B (autosomal recessive) |
| DYSF | 8291 | NP_001124454 | 1459 | dysferlin, limb girdle muscular dystrophy 2B (autosomal recessive) |
| DYSF | 8291 | NP_001124455 | 1460 | dysferlin, limb girdle muscular dystrophy 2B (autosomal recessive) |
| DYSF | 8291 | NP_001124456 | 1461 | dysferlin, limb girdle muscular dystrophy 2B (autosomal recessive) |
| DYSF | 8291 | NP_001124457 | 1462 | dysferlin, limb girdle muscular dystrophy 2B (autosomal recessive) |
| DYSF | 8291 | NP_001124458 | 1463 | dysferlin, limb girdle muscular dystrophy 2B (autosomal recessive) |
| DYSF | 8291 | NP_001124459 | 1464 | dysferlin, limb girdle muscular dystrophy 2B (autosomal recessive) |
| DYSF | 8291 | NP_003485 | 2842 | dysferlin, limb girdle muscular dystrophy 2B (autosomal recessive) |
| E2F5 | 1875 | NP_001077057 | 1068 | E2F transcription factor 5, p130-binding |
| E2F5 | 1875 | NP_001077058 | 1069 | E2F transcription factor 5, p130-binding |
| E2F5 | 1875 | NP_001942 | 2508 | E2F transcription factor 5, p130-binding |
| EBP | 10682 | NP_006570 | 3519 | emopamil binding protein (sterol isomerase) |
| ECE1 | 1889 | NP_001106818 | 1254 | endothelin converting enzyme 1 |
| ECE1 | 1889 | NP_001106819 | 1255 | endothelin converting enzyme 1 |
| ECE1 | 1889 | NP_001106820 | 1256 | endothelin converting enzyme 1 |
| ECE1 | 1889 | NP_001388 | 2358 | endothelin converting enzyme 1 |
| ECE2 | 9718 | NP_001032401 | 774 | endothelin converting enzyme 2 |
| ECE2 | 9718 | NP_001093590 | 1180 | endothelin converting enzyme 2 |
| ECE2 | 9718 | NP_001093591 | 1181 | endothelin converting enzyme 2 |
| ECE2 | 9718 | NP_055508 | 3974 | endothelin converting enzyme 2 |
| ECE2 | 9718 | NP_115707 | 5329 | endothelin converting enzyme 2 |
| ECEL1 | 9427 | NP_004817 | 3141 | endothelin converting enzyme-like 1 |
| ECHDC1 | 55862 | NP_001002030 | 388 | enoyl Coenzyme AHydratase domain containing 1 |
| ECHDC1 | 55862 | NP_001099014 | 1227 | enoyl Coenzyme AHydratase domain containing 1 |
| ECHDC1 | 55862 | NP_001099015 | 1228 | enoyl Coenzyme AHydratase domain containing 1 |
| ECHDC1 | 55862 | NP_001132982 | 1621 | enoyl Coenzyme AHydratase domain containing 1 |
| ECHDC1 | 55862 | NP_060949 | 4458 | enoyl Coenzyme AHydratase domain containing 1 |

FIG. 2 (CONT.)

| Antigen | GeneID | Accession No. | SEQ ID NO: | RefSeq Gene Name |
|---|---|---|---|---|
| ECM1 | 1893 | NP_004416 | 3040 | extracellular matrix protein 1 |
| ECM1 | 1893 | NP_073155 | 4936 | extracellular matrix protein 1 |
| ECSCR | 641700 | NP_001071161 | 979 | endothelial cell-specific chemotaxis regulator |
| EDA | 1896 | NP_001005609 | 464 | ectodysplasin A |
| EDA | 1896 | NP_001005610 | 465 | ectodysplasin A |
| EDA | 1896 | NP_001005611 | 466 | ectodysplasin A |
| EDA | 1896 | NP_001005612 | 467 | ectodysplasin A |
| EDA | 1896 | NP_001005615 | 468 | ectodysplasin A |
| EDA | 1896 | NP_001390 | 2359 | ectodysplasin A |
| EDA2R | 60401 | NP_068555 | 4828 | ectodysplasin A2 receptor |
| EDAR | 10913 | NP_071731 | 4897 | ectodysplasin A receptor |
| EDDM3A | 10876 | NP_006674 | 3545 | family with sequence similarity 12, member A |
| EDDM3B | 64184 | NP_071755 | 4903 | family with sequence similarity 12, member B (epididymal) |
| EDEM1 | 9695 | NP_055489 | 3972 | ER degradation enhancer, mannosidase alpha-like 1 |
| EDNRA | 1909 | NP_001159527 | 2141 | endothelin receptor type A |
| EDNRA | 1909 | NP_001948 | 2510 | endothelin receptor type A |
| EDNRB | 1910 | NP_000106 | 33 | endothelin receptor type B |
| EDNRB | 1910 | NP_001116131 | 1285 | endothelin receptor type B |
| EDNRB | 1910 | NP_003982 | 2941 | endothelin receptor type B |
| EEF1E1 | 9521 | NP_001129122 | 1544 | eukaryotic translation elongation factor 1 epsilon 1 |
| EEF1E1 | 9521 | NP_004271 | 3007 | eukaryotic translation elongation factor 1 epsilon 1 |
| EFCAB14 | 9813 | NP_055589 | 3987 | KIAA0494 |
| EFNA5 | 1946 | NP_001953 | 2511 | ephrin-A5 |
| EFNB1 | 1947 | NP_004420 | 3041 | ephrin-B1 |
| EFNB2 | 1948 | NP_004084 | 2961 | ephrin-B2 |
| EFNB3 | 1949 | NP_001397 | 2362 | ephrin-B3 |
| EGF | 1950 | NP_001954 | 2512 | epidermal growth factor (beta-urogastrone) |
| EGFLAM | 133584 | NP_689616 | 6053 | EGF-like, fibronectin type III and laminin G domains |
| EGFLAM | 133584 | NP_877950 | 6683 | EGF-like, fibronectin type III and laminin G domains |
| EGFLAM | 133584 | NP_877951 | 6684 | EGF-like, fibronectin type III and laminin G domains |
| EGFLAM | 133584 | NP_877953 | 6685 | EGF-like, fibronectin type III and laminin G domains |
| EGFR | 1956 | NP_005219 | 3235 | epidermal growth factor receptor (erythroblastic leukemia viral (v-erb-b) oncogeneHomolog, avian) |
| EGFR | 1956 | NP_958439 | 6896 | epidermal growth factor receptor (erythroblastic leukemia viral (v-erb-b) oncogeneHomolog, avian) |
| EGFR | 1956 | NP_958440 | 6897 | epidermal growth factor receptor (erythroblastic leukemia viral (v-erb-b) oncogeneHomolog, avian) |
| EGFR | 1956 | NP_958441 | 6898 | epidermal growth factor receptor (erythroblastic leukemia viral (v-erb-b) oncogeneHomolog, avian) |
| EI24 | 9538 | NP_001007278 | 516 | etoposide induced 2.4 mRNA |
| EI24 | 9538 | NP_004870 | 3157 | etoposide induced 2.4 mRNA |
| EIF2AK3 | 9451 | NP_004827 | 3146 | eukaryotic translation initiation factor 2-alpha kinase 3 |
| ELANE | 1991 | NP_001963 | 2513 | elastase, neutrophil expressed |
| ELFN2 | 114794 | NP_443138 | 5534 | extracellular leucine-rich repeat and fibronectin type III domain containing 2 |
| ELN | 2006 | NP_000492 | 142 | elastin |
| ELN | 2006 | NP_001075221 | 1056 | elastin |
| ELN | 2006 | NP_001075222 | 1057 | elastin |
| ELN | 2006 | NP_001075223 | 1058 | elastin |
| ELN | 2006 | NP_001075224 | 1059 | elastin |
| ELOVL1 | 64834 | NP_073732 | 4949 | elongation of very long chain fatty acids (FEN1/Elo2, SUR4/Elo3, yeast)-like 1 |
| ELOVL2 | 54898 | NP_060240 | 4340 | elongation of very long chain fatty acids (FEN1/Elo2, SUR4/Elo3, yeast)-like 2 |
| ELOVL3 | 83401 | NP_689523 | 6028 | elongation of very long chain fatty acids (FEN1/Elo2, SUR4/Elo3, yeast)-like 3 |
| ELOVL4 | 6785 | NP_073563 | 4937 | elongation of very long chain fatty acids (FEN1/Elo2, SUR4/Elo3, yeast)-like 4 |
| ELOVL5 | 60481 | NP_068586 | 4836 | ELOVL family member 5, elongation of long chain fatty acids (FEN1/Elo2, SUR4/Elo3-like, yeast) |
| ELOVL6 | 79071 | NP_001124193 | 1438 | ELOVL family member 6, elongation of long chain fatty acids (FEN1/Elo2, SUR4/Elo3-like, yeast) |
| ELOVL6 | 79071 | NP_076995 | 5008 | ELOVL family member 6, elongation of long chain fatty acids (FEN1/Elo2, SUR4/Elo3-like, yeast) |
| ELOVL7 | 79993 | NP_001098028 | 1216 | ELOVL family member 7, elongation of long chain fatty acids (yeast) |
| ELOVL7 | 79993 | NP_079206 | 5104 | ELOVL family member 7, elongation of long chain fatty acids (yeast) |
| ELSPBP1 | 64100 | NP_071425 | 4883 | epididymal sperm binding protein 1 |
| EMB | 133418 | NP_940851 | 6796 | embiginHomolog (mouse) |
| EMC3 | 55831 | NP_060917 | 4453 | transmembrane protein 111 |
| EMC4 | 51234 | NP_057538 | 4220 | transmembrane protein 85 |
| EMC6 | 83460 | NP_001014764 | 622 | transmembrane protein 93 |
| EMC6 | 83460 | NP_112588 | 5217 | transmembrane protein 93 |
| EMC7 | 56851 | NP_064539 | 4604 | chromosome 15 open reading frame 24 |
| EMCN | 51705 | NP_001153166 | 1951 | endomucin |
| EMCN | 51705 | NP_057326 | 4191 | endomucin |
| EMID1 | 129080 | NP_597712 | 5693 | EMI domain containing 1 |
| EML2 | 24139 | NP_036287 | 3715 | echinoderm microtubule associated protein like 2 |
| EMP1 | 2012 | NP_001414 | 2368 | epithelial membrane protein 1 |
| EMP2 | 2013 | NP_001415 | 2369 | epithelial membrane protein 2 |
| EMP3 | 2014 | NP_001416 | 2370 | epithelial membrane protein 3 |
| ENDOD1 | 23052 | NP_055851 | 4027 | endonuclease domain containing 1 |
| ENG | 2022 | NP_000109 | 35 | endoglin |
| ENG | 2022 | NP_001108225 | 1278 | endoglin |
| ENHO | 375704 | NP_940975 | 6819 | energyHomeostasis associated |
| ENPEP | 2028 | NP_001968 | 2515 | glutamyl aminopeptidase (aminopeptidase A) |
| ENPP1 | 5167 | NP_006199 | 3456 | ectonucleotide pyrophosphatase/phosphodiesterase 1 |
| ENPP2 | 5168 | NP_001035181 | 827 | ectonucleotide pyrophosphatase/phosphodiesterase 2 |
| ENPP2 | 5168 | NP_001124335 | 1444 | ectonucleotide pyrophosphatase/phosphodiesterase 2 |
| ENPP2 | 5168 | NP_006200 | 3457 | ectonucleotide pyrophosphatase/phosphodiesterase 2 |

FIG. 2 (CONT.)

| Antigen | GeneID | Accession No. | SEQ ID NO: | RefSeq Gene Name |
|---|---|---|---|---|
| ENPP3 | 5169 | NP_005012 | 3199 | ectonucleotide pyrophosphatase/phosphodiesterase 3 |
| ENPP4 | 22875 | NP_055751 | 4017 | ectonucleotide pyrophosphatase/phosphodiesterase 4 (putative function) |
| ENPP5 | 59084 | NP_067547 | 4807 | ectonucleotide pyrophosphatase/phosphodiesterase 5 (putative function) |
| ENTPD1 | 953 | NP_001091645 | 1115 | ectonucleoside triphosphate diphosphohydrolase 1 |
| ENTPD1 | 953 | NP_001157650 | 2062 | ectonucleoside triphosphate diphosphohydrolase 1 |
| ENTPD1 | 953 | NP_001157651 | 2063 | ectonucleoside triphosphate diphosphohydrolase 1 |
| ENTPD1 | 953 | NP_001157653 | 2064 | ectonucleoside triphosphate diphosphohydrolase 1 |
| ENTPD1 | 953 | NP_001157654 | 2065 | ectonucleoside triphosphate diphosphohydrolase 1 |
| ENTPD1 | 953 | NP_001157655 | 2066 | ectonucleoside triphosphate diphosphohydrolase 1 |
| ENTPD1 | 953 | NP_001767 | 2466 | ectonucleoside triphosphate diphosphohydrolase 1 |
| ENTPD2 | 954 | NP_001237 | 2326 | ectonucleoside triphosphate diphosphohydrolase 2 |
| ENTPD2 | 954 | NP_982293 | 6940 | ectonucleoside triphosphate diphosphohydrolase 2 |
| ENTPD3 | 956 | NP_001239 | 2328 | ectonucleoside triphosphate diphosphohydrolase 3 |
| ENTPD4 | 9583 | NP_001122402 | 1381 | ectonucleoside triphosphate diphosphohydrolase 4 |
| ENTPD4 | 9583 | NP_004892 | 3164 | ectonucleoside triphosphate diphosphohydrolase 4 |
| ENTPD5 | 957 | NP_001240 | 2329 | ectonucleoside triphosphate diphosphohydrolase 5 |
| ENTPD6 | 955 | NP_001107561 | 1265 | ectonucleoside triphosphate diphosphohydrolase 6 (putative function) |
| ENTPD6 | 955 | NP_001238 | 2327 | ectonucleoside triphosphate diphosphohydrolase 6 (putative function) |
| ENTPD7 | 57089 | NP_065087 | 4634 | ectonucleoside triphosphate diphosphohydrolase 7 |
| EOGT | 285203 | NP_775925 | 6374 | chromosome 3 open reading frame 64 |
| EPCAM | 4072 | NP_002345 | 2632 | epithelial cell adhesion molecule |
| EPDR1 | 54749 | NP_060019 | 4304 | ependymin related protein 1 (zebrafish) |
| EPHA1 | 2041 | NP_005223 | 3236 | EPH receptor A1 |
| EPHA10 | 284656 | NP_001092909 | 1160 | EPH receptor A10 |
| EPHA10 | 284656 | NP_775912 | 6369 | EPH receptor A10 |
| EPHA2 | 1969 | NP_004422 | 3042 | EPH receptor A2 |
| EPHA3 | 2042 | NP_005224 | 3237 | EPH receptor A3 |
| EPHA3 | 2042 | NP_872585 | 6669 | EPH receptor A3 |
| EPHA4 | 2043 | NP_004429 | 3043 | EPH receptor A4 |
| EPHA5 | 2044 | NP_004430 | 3044 | EPH receptor A5 |
| EPHA5 | 2044 | NP_872272 | 6643 | EPH receptor A5 |
| EPHA6 | 285220 | NP_001073917 | 1023 | EPH receptor A6 |
| EPHA6 | 285220 | NP_775926 | 6375 | EPH receptor A6 |
| EPHA7 | 2045 | NP_004431 | 3045 | EPH receptor A7 |
| EPHA8 | 2046 | NP_001006944 | 495 | EPH receptor A8 |
| EPHA8 | 2046 | NP_065387 | 4678 | EPH receptor A8 |
| EPHB1 | 2047 | NP_004432 | 3046 | EPH receptor B1 |
| EPHB2 | 2048 | NP_004433 | 3047 | EPH receptor B2 |
| EPHB2 | 2048 | NP_059145 | 4294 | EPH receptor B2 |
| EPHB3 | 2049 | NP_004434 | 3048 | EPH receptor B3 |
| EPHB4 | 2050 | NP_004435 | 3049 | EPH receptor B4 |
| EPHB6 | 2051 | NP_004436 | 3050 | EPH receptor B6 |
| EPHX3 | 79852 | NP_001136358 | 1707 | epoxideHydrolase 3 |
| EPHX3 | 79852 | NP_079070 | 5084 | epoxideHydrolase 3 |
| EPHX4 | 253152 | NP_775838 | 6359 | epoxideHydrolase 4 |
| EPO | 2056 | NP_000790 | 258 | erythropoietin |
| EPOR | 2057 | NP_000112 | 36 | erythropoietin receptor |
| EPSTI1 | 94240 | NP_001002264 | 395 | epithelial stromal interaction 1 (breast) |
| EPSTI1 | 94240 | NP_150280 | 5475 | epithelial stromal interaction 1 (breast) |
| EPT1 | 85465 | NP_277040 | 5503 | selenoprotein I |
| EQTN | 54586 | NP_001155057 | 2021 | chromosome 9 open reading frame 11 |
| EQTN | 54586 | NP_065692 | 4687 | chromosome 9 open reading frame 11 |
| ERBB2 | 2064 | NP_001005862 | 474 | v-erb-b2 erythroblastic leukemia viral oncogeneHomolog 2, neuro/glioblastoma derived oncogeneHomolog (avian) |
| ERBB2 | 2064 | NP_004439 | 3051 | v-erb-b2 erythroblastic leukemia viral oncogeneHomolog 2, neuro/glioblastoma derived oncogeneHomolog (avian) |
| ERBB3 | 2065 | NP_001005915 | 476 | v-erb-b2 erythroblastic leukemia viral oncogeneHomolog 3 (avian) |
| ERBB3 | 2065 | NP_001973 | 2517 | v-erb-b2 erythroblastic leukemia viral oncogeneHomolog 3 (avian) |
| ERBB4 | 2066 | NP_001036064 | 914 | v-erb-a erythroblastic leukemia viral oncogeneHomolog 4 (avian) |
| ERBB4 | 2066 | NP_005226 | 3238 | v-erb-a erythroblastic leukemia viral oncogeneHomolog 4 (avian) |
| EREG | 2069 | NP_001423 | 2371 | epiregulin |
| ERF | 2077 | NP_006485 | 3498 | Ets2 repressor factor |
| ERGIC1 | 57222 | NP_001026881 | 725 | endoplasmic reticulum-golgi intermediate compartment (ERGIC) 1 |
| ERGIC2 | 51290 | NP_057654 | 4247 | ERGIC and golgi 2 |
| ERGIC3 | 51614 | NP_057050 | 4144 | ERGIC and golgi 3 |
| ERGIC3 | 51614 | NP_938408 | 6790 | ERGIC and golgi 3 |
| ERLIN1 | 10613 | NP_001094096 | 1192 | ER lipid raft associated 1 |
| ERLIN1 | 10613 | NP_006450 | 3494 | ER lipid raft associated 1 |
| ERMAP | 114625 | NP_001017922 | 649 | erythroblast membrane-associated protein (Scianna blood group) |
| ERMAP | 114625 | NP_061008 | 4465 | erythroblast membrane-associated protein (Scianna blood group) |
| ERMARD | 55780 | NP_060811 | 4424 | chromosome 6 open reading frame 70 |
| ERMP1 | 79956 | NP_079172 | 5098 | endoplasmic reticulum metallopeptidase 1 |
| ERN1 | 2081 | NP_001424 | 2372 | endoplasmic reticulum to nucleus signaling 1 |
| ERP29 | 10961 | NP_001029197 | 758 | endoplasmic reticulum protein 29 |
| ERP29 | 10961 | NP_006808 | 3572 | endoplasmic reticulum protein 29 |
| ERVFRD1 | 405754 | NP_997465.1 | 7333 | syncytin-2 preproprotein |
| ERVFRD-1 | 405754 | NP_997465 | 7026 | HERV-FRD provirus ancestral Env polyprotein |

FIG. 2 (CONT.)

| Antigen | GeneID | Accession No. | SEQ ID NO: | RefSeq Gene Name |
|---|---|---|---|---|
| ERVMER34-1 | 100288413 | XP_002342492 | 7076 | similar to Uncharacterized protein LP9056 |
| ERVMER34-1 | 100288413 | XP_002345794 | 7081 | similar to Uncharacterized protein LP9056 |
| ERVMER34-1 | 100288413 | XP_002346661 | 7083 | similar to Uncharacterized protein LP9056 |
| ERVW-1 | 30816 | NP_001124397 | 1449 | endogenous retroviral family W, env(C7), member 1 |
| ERVW-1 | 30816 | NP_055405 | 3963 | endogenous retroviral family W, env(C7), member 1 |
| ESAM | 90952 | NP_620411.2 | 7372 | endothelial cell adhesion molecule |
| ESYT1 | 23344 | NP_056107 | 4059 | family with sequence similarity 62 (C2 domain containing), member A |
| ESYT2 | 57488 | NP_065779 | 4709 | family with sequence similarity 62 (C2 domain containing), member B |
| ESYT3 | 83850 | NP_114119 | 5269 | family with sequence similarity 62 (C2 domain containing), member C |
| ETFDH | 2110 | NP_004444 | 3052 | electron-transferring-flavoprotein dehydrogenase |
| ETNK1 | 55500 | NP_001034570 | 795 | ethanolamine kinase 1 |
| ETNK1 | 55500 | NP_061108 | 4472 | ethanolamine kinase 1 |
| ETV6 | 2120 | NP_001978 | 2518 | ets variant 6 |
| EVA1A | 84141 | NP_001128504 | 1512 | family with sequence similarity 176, member A |
| EVA1A | 84141 | NP_115557 | 5305 | family with sequence similarity 176, member A |
| EVA1B | 55194 | NP_060636 | 4400 | family with sequence similarity 176, member B |
| EVA1C | 59271 | NP_478067 | 5585 | chromosome 21 open reading frame 63 |
| EVC | 2121 | NP_714928 | 6220 | Ellis van Creveld syndrome |
| EVC2 | 132884 | NP_001159608 | 2153 | Ellis van Creveld syndrome 2 |
| EVC2 | 132884 | NP_667338 | 5988 | Ellis van Creveld syndrome 2 |
| EVI2A | 2123 | NP_001003927 | 426 | ecotropic viral integration site 2A |
| EVI2A | 2123 | NP_055025 | 3882 | ecotropic viral integration site 2A |
| EVI2B | 2124 | NP_006486 | 3499 | ecotropic viral integration site 2B |
| EVI5L | 115704 | NP_001153416 | 1963 | ecotropic viral integration site 5-like |
| EVI5L | 115704 | NP_660288 | 5939 | ecotropic viral integration site 5-like |
| EXOG | 9941 | NP_001138936 | 1865 | endo/exonuclease (5'-3'), endonuclease G-like |
| EXOG | 9941 | NP_005098 | 3212 | endo/exonuclease (5'-3'), endonuclease G-like |
| EXT1 | 2131 | NP_000118 | 37 | exostoses (multiple) 1 |
| EXTL1 | 2134 | NP_004446 | 3053 | exostoses (multiple)-like 1 |
| EXTL2 | 2135 | NP_001028197 | 749 | exostoses (multiple)-like 2 |
| EXTL2 | 2135 | NP_001430 | 2373 | exostoses (multiple)-like 2 |
| EXTL3 | 2137 | NP_001431 | 2374 | exostoses (multiple)-like 3 |
| F10 | 2159 | NP_000495 | 143 | coagulation factor X |
| F11R | 50848 | NP_058642 | 4278 | F11 receptor |
| F2R | 2149 | NP_001983 | 2519 | coagulation factor II (thrombin) receptor |
| F2RL1 | 2150 | NP_005233 | 3239 | coagulation factor II (thrombin) receptor-like 1 |
| F2RL2 | 2151 | NP_004092 | 2963 | coagulation factor II (thrombin) receptor-like 2 |
| F3 | 2152 | NP_001984 | 2520 | coagulation factor III (thromboplastin, tissue factor) |
| FA2H | 79152 | NP_077282 | 5019 | fatty acid 2-hydroxylase |
| FAAH | 2166 | NP_001432 | 2375 | fatty acid amideHydrolase |
| FAAH2 | 158584 | NP_777572 | 6408 | fatty acid amideHydrolase 2 |
| FADS2 | 9415 | NP_001268430.1 | 7439 | fatty acid desaturase 2 |
| FADS3 | 3995 | NP_068373 | 4822 | fatty acid desaturase 3 |
| FAIM2 | 23017 | NP_036438 | 3741 | Fas apoptotic inhibitory molecule 2 |
| FAM105A | 54491 | NP_061891 | 4548 | family with sequence similarity 105, member A |
| FAM132A | 388581 | NP_001014980 | 629 | family with sequence similarity 132, member A |
| FAM132B | 151176 | XP_001130886 | 7050 | family with sequence similarity 132, member B |
| FAM132B | 151176 | XP_001714437 | 7052 | family with sequence similarity 132, member B |
| FAM134A | 79137 | NP_077269 | 5015 | family with sequence similarity 134, member A |
| FAM134B | 54463 | NP_001030022 | 762 | family with sequence similarity 134, member B |
| FAM134B | 54463 | NP_061873 | 4547 | family with sequence similarity 134, member B |
| FAM134C | 162427 | NP_835227 | 6517 | family with sequence similarity 134, member C |
| FAM151A | 338094 | NP_788954 | 6475 | family with sequence similarity 151, member A |
| FAM159A | 348378 | NP_001036158 | 916 | family with sequence similarity 159, member A |
| FAM162A | 26355 | NP_055182 | 3923 | family with sequence similarity 162, member A |
| FAM162B | 221303 | NP_001078949 | 1095 | family with sequence similarity 162, member B |
| FAM163A | 148753 | NP_775780 | 6349 | family with sequence similarity 163, member A |
| FAM171A1 | 221061 | NP_001010924 | 578 | family with sequence similarity 171, member A1 |
| FAM171A2 | 284069 | NP_940877 | 6798 | family with sequence similarity 171, member A2 |
| FAM171B | 165215 | NP_803237 | 6494 | family with sequence similarity 171, member B |
| FAM173B | 134145 | NP_954584 | 6858 | family with sequence similarity 173, member B |
| FAM174A | 345757 | NP_940909 | 6806 | family with sequence similarity 174, member A |
| FAM174B | 400451 | NP_997329 | 7022 | family with sequence similarity 174, member B |
| FAM187B | 148109 | NP_689694 | 6067 | family with sequence similarity 187, member B |
| FAM189A1 | 23359 | NP_056122 | 4060 | KIAA0574 protein |
| FAM189A2 | 9413 | NP_001121080 | 1334 | chromosome 9 open reading frame 61 |
| FAM189A2 | 9413 | NP_004807 | 3136 | chromosome 9 open reading frame 61 |
| FAM189B | 10712 | NP_006580 | 3524 | chromosome 1 open reading frame 2 |
| FAM189B | 10712 | NP_937995 | 6763 | chromosome 1 open reading frame 2 |
| FAM198A | 729085 | NP_001123380 | 1405 | chromosome 3 open reading frame 41Hypothetical protein LOC729085 |
| FAM198B | 51313 | NP_001026870 | 724 | chromosome 4 open reading frame 18 |
| FAM198B | 51313 | NP_001121896 | 1372 | chromosome 4 open reading frame 18 |
| FAM198B | 51313 | NP_057697 | 4263 | chromosome 4 open reading frame 18 |
| FAM19A1 | 407738 | NP_998774 | 7041 | family with sequence similarity 19 (chemokine (C-C motif)-like), member A1 |
| FAM19A2 | 338811 | NP_848634 | 6552 | family with sequence similarity 19 (chemokine (C-C motif)-like), member A2 |
| FAM19A4 | 151647 | NP_001005527 | 462 | family with sequence similarity 19 (chemokine (C-C motif)-like), member A4 |
| FAM19A4 | 151647 | NP_872328 | 6649 | family with sequence similarity 19 (chemokine (C-C motif)-like), member A4 |

FIG. 2 (CONT.)

| Antigen | GeneID | Accession No. | SEQ ID NO: | RefSeq Gene Name |
|---|---|---|---|---|
| FAM19A5 | 25817 | NP_001076436 | 1064 | family with sequence similarity 19 (chemokine (C-C motif)-like), member A5 |
| FAM19A5 | 25817 | NP_056196 | 4073 | family with sequence similarity 19 (chemokine (C-C motif)-like), member A5 |
| FAM200A | 221786 | NP_659802 | 5927 | chromosome 7 open reading frame 38 |
| FAM205A | 259308 | NP_001135389 | 1624 | hypothetical protein LOC259308 chromosome 9 open reading frame 144 |
| FAM209A | 200232 | NP_001012989 | 608 | chromosome 20 open reading frame 106 |
| FAM209B | 388799 | NP_001013668 | 617 | chromosome 20 open reading frame 107 |
| FAM20A | 54757 | NP_060035 | 4306 | family with sequence similarity 20, member A |
| FAM20B | 9917 | NP_055679 | 4002 | family with sequence similarity 20, member B |
| FAM20C | 56975 | NP_064608 | 4620 | family with sequence similarity 20, member C |
| FAM210A | 125228 | NP_001092271 | 1146 | chromosome 18 open reading frame 19 |
| FAM210A | 125228 | NP_689565 | 6039 | chromosome 18 open reading frame 19 |
| FAM210B | 116151 | NP_543011 | 5635 | chromosome 20 open reading frame 108 |
| FAM213A | 84293 | NP_079401 | 5123 | chromosome 10 open reading frame 58 |
| FAM213A | 84293 | NP_115709 | 5331 | chromosome 10 open reading frame 58 |
| FAM24A | 118670 | NP_001025059 | 711 | family with sequence similarity 24, member A |
| FAM24B | 196792 | NP_689857 | 6092 | family with sequence similarity 24, member B |
| FAM26D | 221301 | NP_694581 | 6152 | family with sequence similarity 26, member D |
| FAM26E | 254228 | NP_714922 | 6219 | family with sequence similarity 26, member E |
| FAM26F | 441168 | NP_001010919 | 577 | family with sequence similarity 26, member F |
| FAM3A | 60343 | NP_001164603 | 2269 | family with sequence similarity 3, member A |
| FAM3A | 60343 | NP_001164604 | 2270 | family with sequence similarity 3, member A |
| FAM3A | 60343 | NP_001164605 | 2271 | family with sequence similarity 3, member A |
| FAM3A | 60343 | NP_068578 | 4833 | family with sequence similarity 3, member A |
| FAM3B | 54097 | NP_478066 | 5584 | family with sequence similarity 3, member B |
| FAM3B | 54097 | NP_996847 | 6993 | family with sequence similarity 3, member B |
| FAM3D | 131177 | NP_620160 | 5799 | family with sequence similarity 3, member D |
| FAM57A | 79850 | NP_079068 | 5083 | family with sequence similarity 57, member A |
| FAM57B | 83723 | NP_113666 | 5232 | family with sequence similarity 57, member B |
| FAM69A | 388650 | NP_001006606 | 478 | family with sequence similarity 69, member A |
| FAM69B | 138311 | NP_689634 | 6058 | family with sequence similarity 69, member B |
| FAM69C | 125704 | NP_001037834 | 920 | chromosome 18 open reading frame 51 |
| FAM73A | 374986 | NP_940951 | 6813 | family with sequence similarity 73, member A |
| FAM73B | 84895 | NP_116198 | 5407 | family with sequence similarity 73, member B |
| FAM76B | 143684 | NP_653265 | 5886 | family with sequence similarity 76, member B |
| FAM8A1 | 51439 | NP_057339 | 4195 | family with sequence similarity 8, member A1 |
| FAM9C | 171484 | NP_777561 | 6406 | family with sequence similarity 9, member C |
| FANCM | 57697 | NP_065988 | 4743 | Fanconi anemia, complementation group M |
| FAP | 2191 | NP_004451 | 3055 | fibroblast activation protein, alpha |
| FAR1 | 84188 | NP_115604 | 5309 | fatty acyl CoA reductase 1 |
| FAR2 | 55711 | NP_060569 | 4391 | fatty acyl CoA reductase 2 |
| FASLG | 356 | NP_000630 | 184 | Fas ligand (TNF superfamily, member 6) |
| FAT1 | 2195 | NP_005236 | 3240 | FAT tumor suppressorHomolog 1 (Drosophila) |
| FAT2 | 2196 | NP_001438 | 2376 | FAT tumor suppressorHomolog 2 (Drosophila) |
| FAT3 | 120114 | NP_001008781 | 553 | FAT tumor suppressorHomolog 3 (Drosophila) |
| FAT4 | 79633 | NP_078858 | 5052 | FAT tumor suppressorHomolog 4 (Drosophila) |
| FAXDC2 | 10826 | NP_115761.2 | 4206 | chromosome 5 open reading frame 4 |
| FAXDC2 | 10826 | NP_115761 | 5337 | chromosome 5 open reading frame 4 |
| FBN2 | 2201 | NP_001990 | 2522 | fibrillin 2 |
| FBXL17 | 64839 | NP_001156787 | 2051 | F-box and leucine-rich repeat protein 17 |
| FBXL17 | 64839 | NP_001156787.2 | 4951 | F-box and leucine-rich repeat protein 17 |
| FBXW7 | 55294 | NP_001013433 | 612 | F-box and WD repeat domain containing 7 |
| FBXW7 | 55294 | NP_060785 | 4419 | F-box and WD repeat domain containing 7 |
| FBXW7 | 55294 | NP_361014 | 5509 | F-box and WD repeat domain containing 7 |
| FCAMR | 83953 | NP_001116451.1 | 7388 | Fc fragment of IgA and IgM receptor |
| FCAR | 2204 | NP_001991 | 2523 | Fc fragment of IgA, receptor for |
| FCAR | 2204 | NP_579803 | 5679 | Fc fragment of IgA, receptor for |
| FCAR | 2204 | NP_579805 | 5680 | Fc fragment of IgA, receptor for |
| FCAR | 2204 | NP_579806 | 5681 | Fc fragment of IgA, receptor for |
| FCAR | 2204 | NP_579807 | 5682 | Fc fragment of IgA, receptor for |
| FCAR | 2204 | NP_579808 | 5683 | Fc fragment of IgA, receptor for |
| FCAR | 2204 | NP_579811 | 5684 | Fc fragment of IgA, receptor for |
| FCAR | 2204 | NP_579812 | 5685 | Fc fragment of IgA, receptor for |
| FCAR | 2204 | NP_579813 | 5686 | Fc fragment of IgA, receptor for |
| FCER1A | 2205 | NP_001992 | 2524 | Fc fragment of IgE,High affinity I, receptor for alpha polypeptide |
| FCER1G | 2207 | NP_004097 | 2964 | Fc fragment of IgE,High affinity I, receptor for gamma polypeptide |
| FCER2 | 2208 | NP_001993 | 2525 | Fc fragment of IgE, low affinity II, receptor for (CD23) |
| FCGR2B | 2213 | NP_001002273 | 398 | Fc fragment of IgG, low affinity IIb, receptor (CD32) Fc fragment of IgG, low affinity IIc, receptor for (CD32) |
| FCGR2B | 2213 | NP_001002274 | 399 | Fc fragment of IgG, low affinity IIb, receptor (CD32) Fc fragment of IgG, low affinity IIc, receptor for (CD32) |
| FCGR2B | 2213 | NP_001002275 | 400 | Fc fragment of IgG, low affinity IIb, receptor (CD32) Fc fragment of IgG, low affinity IIc, receptor for (CD32) |
| FCGR2B | 2213 | NP_003992 | 2945 | Fc fragment of IgG, low affinity IIb, receptor (CD32) Fc fragment of IgG, low affinity IIc, receptor for (CD32) |
| FCGR2B | 2213 | NP_963857 | 6909 | Fc fragment of IgG, low affinity IIb, receptor (CD32) Fc fragment of IgG, low affinity IIc, receptor for (CD32) |
| FCGR3B | 2215 | NP_000561 | 164 | Fc fragment of IgG, low affinity IIIb, receptor (CD16b) |
| FCGRT | 2217 | NP_001129491 | 1589 | Fc fragment of IgG, receptor, transporter, alpha |
| FCGRT | 2217 | NP_004098 | 2965 | Fc fragment of IgG, receptor, transporter, alpha |
| FCMR | 9214 | NP_001135945 | 1666 | Fas apoptotic inhibitory molecule 3 |
| FCMR | 9214 | NP_001135945 | 1667 | Fas apoptotic inhibitory molecule 3 |
| FCMR | 9214 | NP_005440 | 3287 | Fas apoptotic inhibitory molecule 3 |

FIG. 2 (CONT.)

| Antigen | GeneID | Accession No. | SEQ ID NO: | RefSeq Gene Name |
|---|---|---|---|---|
| FCN2 | 2220 | NP_004099 | 2966 | ficolin (collagen/fibrinogen domain containing lectin) 2 (hucolin) |
| FCN2 | 2220 | NP_056652 | 4122 | ficolin (collagen/fibrinogen domain containing lectin) 2 (hucolin) |
| FCRL1 | 115350 | NP_001152869 | 1941 | Fc receptor-like 1 |
| FCRL1 | 115350 | NP_001152870 | 1942 | Fc receptor-like 1 |
| FCRL1 | 115350 | NP_443170 | 5544 | Fc receptor-like 1 |
| FCRL2 | 79368 | NP_110391 | 5166 | Fc receptor-like 2 |
| FCRL3 | 115352 | NP_443171 | 5545 | Fc receptor-like 3 |
| FCRL4 | 83417 | NP_112572 | 5214 | Fc receptor-like 4 |
| FCRL5 | 83416 | NP_112571 | 5213 | Fc receptor-like 5 |
| FCRLA | 84824 | NP_116127 | 5393 | Fc receptor-like A |
| FDCSP | 260436 | NP_694542 | 6144 | chromosome 4 open reading frame 7 |
| FDPS | 2224 | NP_001129293 | 1570 | farnesyl diphosphate synthase (farnesyl pyrophosphate synthetase, dimethylallyltranstransferase, geranyltranstransferase) |
| FDPS | 2224 | NP_001129294 | 1571 | farnesyl diphosphate synthase (farnesyl pyrophosphate synthetase, dimethylallyltranstransferase, geranyltranstransferase) |
| FDPS | 2224 | NP_001995 | 2526 | farnesyl diphosphate synthase (farnesyl pyrophosphate synthetase, dimethylallyltranstransferase, geranyltranstransferase) |
| FER1L5 | 90342 | NP_001280012.1 | 964 | fer-1-like 5 (C. elegans) |
| FER1L5 | 90342 | NP_001280012.1 | 1257 | fer-1-like 5 (C. elegans) |
| FFAR1 | 2864 | NP_005294 | 3269 | free fatty acid receptor 1 |
| FFAR2 | 2867 | NP_005297 | 3270 | free fatty acid receptor 2 |
| FFAR4 | 338557 | NP_859529 | 6628 | G protein-coupled receptor 120 |
| FGF10 | 2255 | NP_004456 | 3056 | fibroblast growth factor 10 |
| FGF19 | 9965 | NP_005108 | 3215 | fibroblast growth factor 19 |
| FGF4 | 2249 | NP_001998 | 2527 | fibroblast growth factor 4 |
| FGF6 | 2251 | NP_066276 | 4756 | fibroblast growth factor 6 |
| FGF7 | 2252 | NP_002000 | 2528 | hypothetical LOC100132771 fibroblast growth factor 7 (keratinocyte growth factor) |
| FGFR1 | 2260 | NP_056934 | 4124 | fibroblast growth factor receptor 1 |
| FGFR1 | 2260 | NP_075593 | 4973 | fibroblast growth factor receptor 1 |
| FGFR1 | 2260 | NP_075594 | 4974 | fibroblast growth factor receptor 1 |
| FGFR1 | 2260 | NP_001167534.1 | 4975 | fibroblast growth factor receptor 1 |
| FGFR1 | 2260 | NP_001167534.1 | 4976 | fibroblast growth factor receptor 1 |
| FGFR1 | 2260 | NP_075598 | 4977 | fibroblast growth factor receptor 1 |
| FGFR1 | 2260 | NP_075599 | 4978 | fibroblast growth factor receptor 1 |
| FGFR2 | 2263 | NP_000132 | 39 | fibroblast growth factor receptor 2 |
| FGFR2 | 2263 | NP_001138385 | 1792 | fibroblast growth factor receptor 2 |
| FGFR2 | 2263 | NP_001138386 | 1793 | fibroblast growth factor receptor 2 |
| FGFR2 | 2263 | NP_001138387 | 1794 | fibroblast growth factor receptor 2 |
| FGFR2 | 2263 | NP_001138388 | 1795 | fibroblast growth factor receptor 2 |
| FGFR2 | 2263 | NP_001138389 | 1796 | fibroblast growth factor receptor 2 |
| FGFR2 | 2263 | NP_001138390 | 1797 | fibroblast growth factor receptor 2 |
| FGFR2 | 2263 | NP_001138391 | 1798 | fibroblast growth factor receptor 2 |
| FGFR2 | 2263 | NP_075259 | 4967 | fibroblast growth factor receptor 2 |
| FGFR3 | 2261 | NP_000133 | 40 | fibroblast growth factor receptor 3 |
| FGFR3 | 2261 | NP_001156685 | 2048 | fibroblast growth factor receptor 3 |
| FGFR3 | 2261 | NP_075254 | 4966 | fibroblast growth factor receptor 3 |
| FGFR4 | 2264 | NP_002002 | 2529 | fibroblast growth factor receptor 4 |
| FGFR4 | 2264 | NP_075252 | 4965 | fibroblast growth factor receptor 4 |
| FGFR4 | 2264 | NP_998812 | 7045 | fibroblast growth factor receptor 4 |
| FGFRL1 | 53834 | NP_001004356 | 430 | fibroblast growth factor receptor-like 1 |
| FGFRL1 | 53834 | NP_001004358 | 431 | fibroblast growth factor receptor-like 1 |
| FGFRL1 | 53834 | NP_068742 | 4848 | fibroblast growth factor receptor-like 1 |
| FGG | 2266 | NP_000500 | 144 | fibrinogen gamma chain |
| FGG | 2266 | NP_068656 | 4838 | fibrinogen gamma chain |
| FIBCD1 | 84929 | NP_001138578 | 1810 | fibrinogen C domain containing 1 |
| FIBCD1 | 84929 | NP_116232 | 5417 | fibrinogen C domain containing 1 |
| FICD | 11153 | NP_009007 | 3628 | FIC domain containing |
| FIG4 | 9896 | NP_055660 | 3997 | FIG4Homolog (S. cerevisiae) |
| FIS1 | 51024 | NP_057152 | 4160 | fission 1 (mitochondrial outer membrane)Homolog (S. cerevisiae) |
| FITM1 | 161247 | NP_981947 | 6932 | fat storage-inducing transmembrane protein 1 |
| FITM2 | 128486 | NP_001073941 | 1028 | fat storage-inducing transmembrane protein 2 |
| FJX1 | 24147 | NP_055159 | 3921 | four jointed box 1 (Drosophila) |
| FKBP11 | 51303 | NP_001137253 | 1715 | FK506 binding protein 11, 19 kDa |
| FKBP11 | 51303 | NP_001137254 | 1716 | FK506 binding protein 11, 19 kDa |
| FKBP11 | 51303 | NP_057678 | 4255 | FK506 binding protein 11, 19 kDa |
| FKBP1A | 2280 | NP_000792 | 259 | FK506 binding protein 1A, 12kDa |
| FKBP1A | 2280 | NP_463460 | 5563 | FK506 binding protein 1A, 12kDa |
| FKBP7 | 51661 | NP_001128684 | 1538 | FK506 binding protein 7 |
| FKBP7 | 51661 | NP_851939 | 6594 | FK506 binding protein 7 |
| FKBP8 | 23770 | NP_036313 | 3716 | FK506 binding protein 8, 38kDa |
| FKRP | 79147 | NP_001034974 | 815 | fukutin related protein |
| FKRP | 79147 | NP_077277 | 5018 | fukutin related protein |
| FKTN | 2218 | NP_001073270 | 993 | fukutin |
| FKTN | 2218 | NP_006722 | 3553 | fukutin |
| FLOT2 | 2319 | NP_004466.2 | 7359 | flotillin 2 |
| FLRT1 | 23769 | NP_037412 | 3795 | fibronectin leucine rich transmembrane protein 1 |
| FLRT2 | 23768 | NP_037363 | 3787 | fibronectin leucine rich transmembrane protein 2 |

FIG. 2 (CONT.)

| Antigen | GeneID | Accession No. | SEQ ID NO: | RefSeq Gene Name |
|---|---|---|---|---|
| FLRT3 | 23767 | NP_037413 | 3796 | fibronectin leucine rich transmembrane protein 3 |
| FLRT3 | 23767 | NP_938205 | 6787 | fibronectin leucine rich transmembrane protein 3 |
| FLT3 | 2322 | NP_004110 | 2967 | fms-related tyrosine kinase 3 |
| FLT3LG | 2323 | NP_001450 | 2377 | fms-related tyrosine kinase 3 ligand |
| FLT4 | 2324 | NP_002011 | 2530 | fms-related tyrosine kinase 4 |
| FLT4 | 2324 | NP_891555 | 6692 | fms-related tyrosine kinase 4 |
| FLVCR1 | 28982 | NP_054772 | 3864 | feline leukemia virus subgroup C cellular receptor 1 |
| FLVCR2 | 55640 | NP_060261 | 4344 | feline leukemia virus subgroup C cellular receptor family, member 2 |
| FMNL1 | 752 | NP_005883 | 3395 | formin-like 1 |
| FMO2 | 2327 | NP_001451 | 2378 | flavin containing monooxygenase 2 (non-functional) |
| FMO3 | 2328 | NP_001002294 | 402 | flavin containing monooxygenase 3 |
| FMO3 | 2328 | NP_008825 | 3591 | flavin containing monooxygenase 3 |
| FMO4 | 2329 | NP_002013 | 2531 | flavin containing monooxygenase 4 |
| FMO5 | 2330 | NP_001138301 | 1775 | flavin containing monooxygenase 5 |
| FMO5 | 2330 | NP_001138302 | 1776 | flavin containing monooxygenase 5 |
| FMO5 | 2330 | NP_001452 | 2379 | flavin containing monooxygenase 5 |
| FMR1NB | 158521 | NP_689791 | 6083 | fragile X mental retardation 1 neighbor |
| FNDC3A | 22862 | NP_001073141 | 991 | fibronectin type III domain containing 3A |
| FNDC3A | 22862 | NP_055738 | 4014 | fibronectin type III domain containing 3A |
| FNDC3B | 64778 | NP_001128567 | 1520 | fibronectin type III domain containing 3B |
| FNDC3B | 64778 | NP_073600 | 4944 | fibronectin type III domain containing 3B |
| FNDC4 | 64838 | NP_073734 | 4950 | fibronectin type III domain containing 4 |
| FNDC5 | 252995 | NP_001165411 | 2298 | fibronectin type III domain containing 5 |
| FNDC5 | 252995 | NP_001165412 | 2299 | fibronectin type III domain containing 5 |
| FNDC5 | 252995 | NP_715637 | 6224 | fibronectin type III domain containing 5 |
| FOLH1 | 2346 | NP_001014986 | 631 | folateHydrolase (prostate-specific membrane antigen) 1 |
| FOLH1 | 2346 | NP_004467 | 3057 | folateHydrolase (prostate-specific membrane antigen) 1 |
| FOLR1 | 2348 | NP_000793 | 260 | folate receptor 1 (adult) |
| FOLR1 | 2348 | NP_057936 | 4267 | folate receptor 1 (adult) |
| FOLR1 | 2348 | NP_057937 | 4268 | folate receptor 1 (adult) |
| FOLR1 | 2348 | NP_057941 | 4269 | folate receptor 1 (adult) |
| FOLR1 | 2348 | NP_057941 | 4270 | folate receptor 1 (adult) |
| FOLR1 | 2348 | NP_057941 | 4271 | folate receptor 1 (adult) |
| FOLR2 | 2350 | NP_000794 | 261 | folate receptor 2 (fetal) |
| FOLR2 | 2350 | NP_001107006 | 1261 | folate receptor 2 (fetal) |
| FOLR2 | 2350 | NP_001107007 | 1262 | folate receptor 2 (fetal) |
| FOLR2 | 2350 | NP_001107008 | 1263 | folate receptor 2 (fetal) |
| FPR1 | 2357 | NP_002020 | 2532 | formyl peptide receptor 1 |
| FPR2 | 2358 | NP_001005738 | 469 | formyl peptide receptor 2 |
| FPR2 | 2358 | NP_001453 | 2380 | formyl peptide receptor 2 |
| FPR3 | 2359 | NP_002021 | 2533 | formyl peptide receptor 3 |
| FRAS1 | 80144 | NP_001159605 | 2152 | Fraser syndrome 1 |
| FRAS1 | 80144 | NP_079350 | 5116 | Fraser syndrome 1 |
| FREM1 | 158326 | NP_659403 | 5907 | FRAS1 related extracellular matrix 1 |
| FREM2 | 341640 | NP_997244 | 7016 | FRAS1 related extracellular matrix protein 2 |
| FRMD3 | 257019 | NP_777598 | 6414 | FERM domain containing 3 |
| FRMD5 | 84978 | NP_116281 | 5421 | FERM domain containing 5 |
| FRRS1L | 23732 | NP_055149 | 3917 | chromosome 9 open reading frame 4 |
| FSHR | 2492 | NP_000136 | 41 | follicle stimulatingHormone receptor |
| FSHR | 2492 | NP_852111 | 6598 | follicle stimulatingHormone receptor |
| FTHL17 | 53940 | NP_114100 | 5262 | ferritin,Heavy polypeptide-like 17 |
| FURIN | 5045 | NP_002560 | 2685 | furin (paired basic amino acid cleaving enzyme) |
| FUT1 | 2523 | NP_000139 | 42 | fucosyltransferase 1 (galactoside 2-alpha-L-fucosyltransferase,H blood group) |
| FUT10 | 84750 | NP_116053 | 5386 | fucosyltransferase 10 (alpha (1,3) fucosyltransferase) |
| FUT2 | 2524 | NP_000502 | 145 | fucosyltransferase 2 (secretor status included) |
| FUT2 | 2524 | NP_001091107 | 1110 | fucosyltransferase 2 (secretor status included) |
| FUT3 | 2525 | NP_000140 | 43 | fucosyltransferase 3 (galactoside 3(4)-L-fucosyltransferase, Lewis blood group) |
| FUT3 | 2525 | NP_001091108 | 1111 | fucosyltransferase 3 (galactoside 3(4)-L-fucosyltransferase, Lewis blood group) |
| FUT3 | 2525 | NP_001091109 | 1112 | fucosyltransferase 3 (galactoside 3(4)-L-fucosyltransferase, Lewis blood group) |
| FUT3 | 2525 | NP_001091110 | 1113 | fucosyltransferase 3 (galactoside 3(4)-L-fucosyltransferase, Lewis blood group) |
| FUT4 | 2526 | NP_002024 | 2534 | fucosyltransferase 4 (alpha (1,3) fucosyltransferase, myeloid-specific) |
| FUT5 | 2527 | NP_002025 | 2535 | fucosyltransferase 5 (alpha (1,3) fucosyltransferase) |
| FUT6 | 2528 | NP_000141 | 44 | fucosyltransferase 6 (alpha (1,3) fucosyltransferase) |
| FUT6 | 2528 | NP_001035791 | 881 | fucosyltransferase 6 (alpha (1,3) fucosyltransferase) |
| FUT7 | 2529 | NP_004470 | 3058 | fucosyltransferase 7 (alpha (1,3) fucosyltransferase) |
| FUT8 | 2530 | NP_004471 | 3059 | fucosyltransferase 8 (alpha (1,6) fucosyltransferase) |
| FUT8 | 2530 | NP_835367 | 6521 | fucosyltransferase 8 (alpha (1,6) fucosyltransferase) |
| FUT8 | 2530 | NP_835368 | 6522 | fucosyltransferase 8 (alpha (1,6) fucosyltransferase) |
| FUT8 | 2530 | NP_835369 | 6523 | fucosyltransferase 8 (alpha (1,6) fucosyltransferase) |
| FUT8 | 2530 | NP_835370 | 6524 | fucosyltransferase 8 (alpha (1,6) fucosyltransferase) |
| FUT9 | 10690 | NP_006572 | 3521 | fucosyltransferase 9 (alpha (1,3) fucosyltransferase) |
| FXR1 | 8087 | NP_001013456 | 613 | fragile X mental retardation, autosomalHomolog 1 |
| FXR1 | 8087 | NP_001013457 | 614 | fragile X mental retardation, autosomalHomolog 1 |
| FXR1 | 8087 | NP_005078 | 3210 | fragile X mental retardation, autosomalHomolog 1 |
| FXYD1 | 5348 | NP_005022 | 3200 | FXYD domain containing ion transport regulator 1 |
| FXYD1 | 5348 | NP_068702 | 4839 | FXYD domain containing ion transport regulator 1 |
| FXYD3 | 5349 | NP_001129479 | 1583 | FXYD domain containing ion transport regulator 3 |

FIG. 2 (CONT.)

| Antigen | GeneID | Accession No. | SEQ ID NO: | RefSeq Gene Name |
|---|---|---|---|---|
| FXYD3 | 5349 | NP_001129480 | 1584 | FXYD domain containing ion transport regulator 3 |
| FXYD3 | 5349 | NP_001129481 | 1585 | FXYD domain containing ion transport regulator 3 |
| FXYD3 | 5349 | NP_001129482 | 1586 | FXYD domain containing ion transport regulator 3 |
| FXYD3 | 5349 | NP_001129483 | 1587 | FXYD domain containing ion transport regulator 3 |
| FXYD3 | 5349 | NP_001129484 | 1588 | FXYD domain containing ion transport regulator 3 |
| FXYD3 | 5349 | NP_005962 | 3408 | FXYD domain containing ion transport regulator 3 |
| FXYD3 | 5349 | NP_068710 | 4844 | FXYD domain containing ion transport regulator 3 |
| FXYD4 | 53828 | NP_775183 | 6336 | FXYD domain containing ion transport regulator 4 |
| FXYD5 | 53827 | NP_001158077 | 2086 | FXYD domain containing ion transport regulator 5 |
| FXYD5 | 53827 | NP_054883 | 3874 | FXYD domain containing ion transport regulator 5 |
| FXYD5 | 53827 | NP_659003 | 5904 | FXYD domain containing ion transport regulator 5 |
| FXYD6 | 53826 | NP_001158303 | 2117 | FXYD domain containing ion transport regulator 6 |
| FXYD6 | 53826 | NP_001158304 | 2118 | FXYD domain containing ion transport regulator 6 |
| FXYD6 | 53826 | NP_001158308 | 2119 | FXYD domain containing ion transport regulator 6 |
| FXYD6 | 53826 | NP_001158309 | 2120 | FXYD domain containing ion transport regulator 6 |
| FXYD6 | 53826 | NP_071286 | 4863 | FXYD domain containing ion transport regulator 6 |
| FXYD7 | 53822 | NP_071289 | 4864 | FXYD domain containing ion transport regulator 7 |
| FZD1 | 8321 | NP_003496.1 | 7259 | frizzled class receptor 1 |
| FZD10 | 11211 | NP_009128 | 3647 | frizzledHomolog 10 (Drosophila) |
| FZD2 | 2535 | NP_001457 | 2382 | frizzledHomolog 2 (Drosophila) |
| FZD3 | 7976 | NP_059108 | 4282 | frizzledHomolog 3 (Drosophila) |
| FZD4 | 8322 | NP_036325 | 3717 | frizzledHomolog 4 (Drosophila) |
| FZD5 | 7855 | NP_003459 | 2837 | frizzledHomolog 5 (Drosophila) |
| FZD6 | 8323 | NP_001158087 | 2087 | frizzledHomolog 6 (Drosophila) |
| FZD6 | 8323 | NP_001158088 | 2088 | frizzledHomolog 6 (Drosophila) |
| FZD6 | 8323 | NP_003497 | 2844 | frizzledHomolog 6 (Drosophila) |
| FZD7 | 8324 | NP_003498 | 2845 | frizzledHomolog 7 (Drosophila) |
| FZD8 | 8325 | NP_114072 | 5252 | frizzledHomolog 8 (Drosophila) |
| FZD9 | 8326 | NP_003499 | 2846 | frizzledHomolog 9 (Drosophila) |
| G6PC | 2538 | NP_000142 | 45 | glucose-6-phosphatase, catalytic subunit |
| G6PC2 | 57818 | NP_001075155 | 1055 | glucose-6-phosphatase, catalytic, 2 |
| G6PC2 | 57818 | NP_066999 | 4787 | glucose-6-phosphatase, catalytic, 2 |
| G6PC3 | 92579 | NP_612396 | 5739 | glucose 6 phosphatase, catalytic, 3 |
| GAA | 2548 | NP_000143 | 46 | glucosidase, alpha acid |
| GAA | 2548 | NP_001073271 | 994 | glucosidase, alpha acid |
| GAA | 2548 | NP_001073272 | 995 | glucosidase, alpha acid |
| GABBR1 | 2550 | NP_001461 | 2384 | gamma-aminobutyric acid (GABA) B receptor, 1 |
| GABBR1 | 2550 | NP_068703 | 4840 | gamma-aminobutyric acid (GABA) B receptor, 1 |
| GABBR1 | 2550 | NP_068704 | 4841 | gamma-aminobutyric acid (GABA) B receptor, 1 |
| GABBR1 | 2550 | NP_001305982.1 | 4842 | gamma-aminobutyric acid (GABA) B receptor, 1 |
| GABBR2 | 9568 | NP_005449 | 3288 | gamma-aminobutyric acid (GABA) B receptor, 2 |
| GABRA1 | 2554 | NP_000797 | 262 | gamma-aminobutyric acid (GABA) A receptor, alpha 1 |
| GABRA1 | 2554 | NP_001121115 | 1335 | gamma-aminobutyric acid (GABA) A receptor, alpha 1 |
| GABRA1 | 2554 | NP_001121116 | 1336 | gamma-aminobutyric acid (GABA) A receptor, alpha 1 |
| GABRA1 | 2554 | NP_001121117 | 1337 | gamma-aminobutyric acid (GABA) A receptor, alpha 1 |
| GABRA1 | 2554 | NP_000797.2 | 1338 | gamma-aminobutyric acid (GABA) A receptor, alpha 1 |
| GABRA1 | 2554 | NP_000797.2 | 1339 | gamma-aminobutyric acid (GABA) A receptor, alpha 1 |
| GABRA1 | 2554 | NP_001121120 | 1340 | gamma-aminobutyric acid (GABA) A receptor, alpha 1 |
| GABRA2 | 2555 | NP_000798 | 263 | gamma-aminobutyric acid (GABA) A receptor, alpha 2 |
| GABRA2 | 2555 | NP_001107647 | 1269 | gamma-aminobutyric acid (GABA) A receptor, alpha 2 |
| GABRA3 | 2556 | NP_000799 | 264 | gamma-aminobutyric acid (GABA) A receptor, alpha 3 |
| GABRA4 | 2557 | NP_000800 | 265 | gamma-aminobutyric acid (GABA) A receptor, alpha 4 |
| GABRA5 | 2558 | NP_000801 | 266 | gamma-aminobutyric acid (GABA) A receptor, alpha 5 |
| GABRA5 | 2558 | NP_001158509 | 2125 | gamma-aminobutyric acid (GABA) A receptor, alpha 5 |
| GABRA6 | 2559 | NP_000802 | 267 | gamma-aminobutyric acid (GABA) A receptor, alpha 6 |
| GABRB1 | 2560 | NP_000803 | 268 | gamma-aminobutyric acid (GABA) A receptor, beta 1 |
| GABRB2 | 2561 | NP_000804 | 269 | gamma-aminobutyric acid (GABA) A receptor, beta 2 |
| GABRB2 | 2561 | NP_068711 | 4845 | gamma-aminobutyric acid (GABA) A receptor, beta 2 |
| GABRB3 | 2562 | NP_000805 | 270 | gamma-aminobutyric acid (GABA) A receptor, beta 3 |
| GABRB3 | 2562 | NP_068712 | 4846 | gamma-aminobutyric acid (GABA) A receptor, beta 3 |
| GABRD | 2563 | NP_000806 | 271 | gamma-aminobutyric acid (GABA) A receptor, delta |
| GABRE | 2564 | NP_004952 | 3178 | gamma-aminobutyric acid (GABA) A receptor, epsilon |
| GABRG1 | 2565 | NP_775807 | 6354 | gamma-aminobutyric acid (GABA) A receptor, gamma 1 |
| GABRG2 | 2566 | NP_000807 | 272 | gamma-aminobutyric acid (GABA) A receptor, gamma 2 |
| GABRG2 | 2566 | NP_944493 | 6842 | gamma-aminobutyric acid (GABA) A receptor, gamma 2 |
| GABRG2 | 2566 | NP_944494 | 6843 | gamma-aminobutyric acid (GABA) A receptor, gamma 2 |
| GABRG3 | 2567 | NP_150092 | 5471 | gamma-aminobutyric acid (GABA) A receptor, gamma 3 |
| GABRP | 2568 | NP_055026 | 3883 | gamma-aminobutyric acid (GABA) A receptor, pi |
| GABRQ | 55879 | NP_061028 | 4468 | gamma-aminobutyric acid (GABA) receptor, theta |
| GABRR1 | 2569 | NP_002033 | 2539 | gamma-aminobutyric acid (GABA) receptor, rho 1 |
| GABRR2 | 2570 | NP_002034 | 2540 | gamma-aminobutyric acid (GABA) receptor, rho 2 |
| GABRR3 | 200959 | NP_001099050 | 1231 | gamma-aminobutyric acid (GABA) receptor, rho 3 |
| GAGE1 | 2543 | NP_001035753.1 | 7360 | G antigen 1 |
| GAL | 51083 | NP_057057 | 4145 | galanin prepropeptide |
| GAL3ST1 | 9514 | NP_001305032.1 | 7460 | galactose-3-O-sulfotransferase 1 |
| GAL3ST2 | 64090 | NP_071417 | 4880 | galactose-3-O-sulfotransferase 2 |
| GAL3ST4 | 79690 | NP_078913 | 5061 | galactose-3-O-sulfotransferase 4 |

FIG. 2 (CONT.)

| Antigen | GeneID | Accession No. | SEQ ID NO: | RefSeq Gene Name |
|---|---|---|---|---|
| GALC | 2581 | NP_000144 | 47 | galactosylceramidase |
| GALC | 2581 | NP_000144.2 | 776 | galactosylceramidase |
| GALNS | 2588 | NP_000503 | 146 | galactosamine (N-acetyl)-6-sulfate sulfatase |
| GALNT1 | 2589 | NP_065207 | 4670 | UDP-N-acetyl-alpha-D-galactosamine:polypeptide N-acetylgalactosaminyltransferase 13 (GalNAc-T13) |
| GALNT1 | 2589 | NP_443149 | 5539 | UDP-N-acetyl-alpha-D-galactosamine:polypeptide N-acetylgalactosaminyltransferase 13 (GalNAc-T13) |
| GALNT10 | 55568 | NP_938080.1 | 4303 | UDP-N-acetyl-alpha-D-galactosamine:polypeptide N-acetylgalactosaminyltransferase 10 (GalNAc-T10) |
| GALNT10 | 55568 | NP_938080 | 6767 | UDP-N-acetyl-alpha-D-galactosamine:polypeptide N-acetylgalactosaminyltransferase 10 (GalNAc-T10) |
| GALNT11 | 63917 | NP_071370 | 4875 | UDP-N-acetyl-alpha-D-galactosamine:polypeptide N-acetylgalactosaminyltransferase 11 (GalNAc-T11) |
| GALNT12 | 79695 | NP_078918 | 5063 | UDP-N-acetyl-alpha-D-galactosamine:polypeptide N-acetylgalactosaminyltransferase 12 (GalNAc-T12) |
| GALNT13 | 114805 | NP_001288556.1 | 4669 | UDP-N-acetyl-alpha-D-galactosamine:polypeptide N-acetylgalactosaminyltransferase 13 (GalNAc-T13) |
| GALNT13 | 114805 | NP_065207.2 | 5538 | UDP-N-acetyl-alpha-D-galactosamine:polypeptide N-acetylgalactosaminyltransferase 13 (GalNAc-T13) |
| GALNT14 | 79623 | NP_078848 | 5050 | UDP-N-acetyl-alpha-D-galactosamine:polypeptide N-acetylgalactosaminyltransferase 14 (GalNAc-T14) |
| GALNT15 | 117248 | NP_473451 | 5574 | UDP-N-acetyl-alpha-D-galactosamine:polypeptide N-acetylgalactosaminyltransferase-like 2 |
| GALNT16 | 57452 | NP_001161840 | 2226 | UDP-N-acetyl-alpha-D-galactosamine:polypeptide N-acetylgalactosaminyltransferase-like 1 |
| GALNT16 | 57452 | NP_065743 | 4700 | UDP-N-acetyl-alpha-D-galactosamine:polypeptide N-acetylgalactosaminyltransferase-like 1 |
| GALNT18 | 374378 | NP_940918 | 6807 | UDP-N-acetyl-alpha-D-galactosamine:polypeptide N-acetylgalactosaminyltransferase-like 4 |
| GALNT2 | 2590 | NP_004472 | 3060 | UDP-N-acetyl-alpha-D-galactosamine:polypeptide N-acetylgalactosaminyltransferase 2 (GalNAc-T2) |
| GALNT3 | 2591 | NP_004473 | 3061 | UDP-N-acetyl-alpha-D-galactosamine:polypeptide N-acetylgalactosaminyltransferase 3 (GalNAc-T3) |
| GALNT5 | 11227 | NP_055383 | 3957 | UDP-N-acetyl-alpha-D-galactosamine:polypeptide N-acetylgalactosaminyltransferase 5 (GalNAc-T5) |
| GALNT6 | 11226 | NP_009141 | 3648 | UDP-N-acetyl-alpha-D-galactosamine:polypeptide N-acetylgalactosaminyltransferase 6 (GalNAc-T6) |
| GALNT7 | 51809 | NP_059119 | 4287 | UDP-N-acetyl-alpha-D-galactosamine:polypeptide N-acetylgalactosaminyltransferase 7 (GalNAc-T7) |
| GALNT8 | 26290 | NP_059113 | 4285 | UDP-N-acetyl-alpha-D-galactosamine:polypeptide N-acetylgalactosaminyltransferase 8 (GalNAc-T8) |
| GALNT9 | 50614 | NP_001116108 | 1284 | UDP-N-acetyl-alpha-D-galactosamine:polypeptide N-acetylgalactosaminyltransferase 9 (GalNAc-T9) |
| GALNT9 | 50614 | NP_068580 | 4834 | UDP-N-acetyl-alpha-D-galactosamine:polypeptide N-acetylgalactosaminyltransferase 9 (GalNAc-T9) |
| GALNTL5 | 168391 | NP_660335 | 5955 | UDP-N-acetyl-alpha-D-galactosamine:polypeptide N-acetylgalactosaminyltransferase-like 5 |
| GALR1 | 2587 | NP_001471 | 2386 | galanin receptor 1 |
| GALR2 | 8811 | NP_003848 | 2919 | galanin receptor 2 |
| GALR3 | 8484 | NP_003605 | 2854 | galanin receptor 3 |
| GANAB | 23193 | NP_938148 | 6770 | glucosidase, alpha neutral AB |
| GANAB | 23193 | NP_938149 | 6771 | glucosidase, alpha neutral AB |
| GAPT | 202309 | NP_689900 | 6099 | GRB2-binding adaptor protein, transmembrane |
| GBGT1 | 26301 | NP_068836 | 4861 | globoside alpha-1,3-N-acetylgalactosaminyltransferase 1 |
| GCG | 2641 | NP_002045 | 2541 | glucagon |
| GCGR | 2642 | NP_000151 | 48 | glucagon receptor |
| GCLC | 2729 | NP_001489 | 2391 | glutamate-cysteine ligase, catalytic subunit |
| GCNT1 | 2650 | NP_001091102 | 1106 | glucosaminyl (N-acetyl) transferase 1, core 2 (beta-1,6-N-acetylglucosaminyltransferase) |
| GCNT1 | 2650 | NP_001091103 | 1107 | glucosaminyl (N-acetyl) transferase 1, core 2 (beta-1,6-N-acetylglucosaminyltransferase) |
| GCNT1 | 2650 | NP_001091104 | 1108 | glucosaminyl (N-acetyl) transferase 1, core 2 (beta-1,6-N-acetylglucosaminyltransferase) |
| GCNT1 | 2650 | NP_001091105 | 1109 | glucosaminyl (N-acetyl) transferase 1, core 2 (beta-1,6-N-acetylglucosaminyltransferase) |
| GCNT1 | 2650 | NP_001481 | 2387 | glucosaminyl (N-acetyl) transferase 1, core 2 (beta-1,6-N-acetylglucosaminyltransferase) |
| GCNT2 | 2651 | NP_001482 | 2388 | glucosaminyl (N-acetyl) transferase 2, I-branching enzyme (I blood group) |
| GCNT2 | 2651 | NP_663624 | 5965 | glucosaminyl (N-acetyl) transferase 2, I-branching enzyme (I blood group) |
| GCNT2 | 2651 | NP_663630 | 5968 | glucosaminyl (N-acetyl) transferase 2, I-branching enzyme (I blood group) |
| GCNT3 | 9245 | NP_004742 | 3116 | glucosaminyl (N-acetyl) transferase 3, mucin type |
| GCNT4 | 51301 | NP_057675 | 4253 | glucosaminyl (N-acetyl) transferase 4, core 2 (beta-1,6-N-acetylglucosaminyltransferase) |
| GDAP1 | 54332 | NP_001035808 | 884 | ganglioside-induced differentiation-associated protein 1 |
| GDAP1 | 54332 | NP_061845 | 4541 | ganglioside-induced differentiation-associated protein 1 |
| GDAP1L1 | 78997 | NP_076939 | 4998 | ganglioside-induced differentiation-associated protein 1-like 1 |
| GDE1 | 51573 | NP_057725 | 4265 | glycerophosphodiester phosphodiesterase 1 |
| GDF9 | 2661 | NP_005251 | 3241 | growth differentiation factor 9 |
| GDNF | 2668 | NP_000505 | 147 | glial cell derived neurotrophic factor |
| GDNF | 2668 | NP_954701 | 6866 | glial cell derived neurotrophic factor |
| GDNF | 2668 | NP_954704 | 6867 | glial cell derived neurotrophic factor |
| GDPD1 | 284161 | NP_001159465 | 2139 | glycerophosphodiester phosphodiesterase domain containing 1 |
| GDPD1 | 284161 | NP_001159466 | 2140 | glycerophosphodiester phosphodiesterase domain containing 1 |
| GDPD1 | 284161 | NP_872375 | 6662 | glycerophosphodiester phosphodiesterase domain containing 1 |
| GDPD2 | 54857 | NP_001164662 | 2275 | glycerophosphodiester phosphodiesterase domain containing 2 |
| GDPD2 | 54857 | NP_001164663 | 2276 | glycerophosphodiester phosphodiesterase domain containing 2 |
| GDPD2 | 54857 | NP_001164664 | 2277 | glycerophosphodiester phosphodiesterase domain containing 2 |
| GDPD2 | 54857 | NP_060181 | 4327 | glycerophosphodiester phosphodiesterase domain containing 2 |
| GDPD3 | 79153 | NP_077283 | 5020 | glycerophosphodiester phosphodiesterase domain containing 3 |
| GDPD5 | 81544 | NP_110419 | 5177 | glycerophosphodiester phosphodiesterase domain containing 5 |
| GGCX | 2677 | NP_000812 | 273 | gamma-glutamyl carboxylase |
| GGCX | 2677 | NP_001135741 | 1627 | gamma-glutamyl carboxylase |
| GGT5 | 2687 | NP_001093251 | 1173 | gamma-glutamyltransferase 5 |
| GGT5 | 2687 | NP_001093252 | 1174 | gamma-glutamyltransferase 5 |
| GGT5 | 2687 | NP_004112 | 2968 | gamma-glutamyltransferase 5 |
| GGT7 | 2686 | NP_821158 | 6515 | gamma-glutamyltransferase 7 |
| GGTLC1 | 92086 | NP_842563 | 6534 | gamma-glutamyltransferase light chain 1 |
| GGTLC1 | 92086 | NP_842564 | 6535 | gamma-glutamyltransferase light chain 1 |
| GHITM | 27069 | NP_055209 | 3930 | growthHormone inducible transmembrane protein |
| GHR | 2690 | NP_000154 | 49 | growthHormone receptor |
| GHRHR | 2692 | NP_000814 | 274 | growthHormone releasingHormone receptor |
| GHRHR | 2692 | NP_000814.2 | 564 | growthHormone releasingHormone receptor |
| GHRL | 51738 | NP_001128413 | 1508 | ghrelin/obestatin prepropeptide |
| GHRL | 51738 | NP_001128416 | 1509 | ghrelin/obestatin prepropeptide |
| GHRL | 51738 | NP_001128417 | 1510 | ghrelin/obestatin prepropeptide |

FIG. 2 (CONT.)

| Antigen | GeneID | Accession No. | SEQ ID NO: | RefSeq Gene Name |
|---|---|---|---|---|
| GHRL | 51738 | NP_001128418 | 1511 | ghrelin/obestatin prepropeptide |
| GHRL | 51738 | NP_057446 | 4210 | ghrelin/obestatin prepropeptide |
| GHSR | 2693 | NP_004113 | 2969 | growthHormone secretagogue receptor |
| GHSR | 2693 | NP_940799 | 6794 | growthHormone secretagogue receptor |
| GIMAP1 | 170575 | NP_570115 | 5659 | GTPase, IMAP family member 1 |
| GIMAP2 | 26157 | NP_056475 | 4110 | GTPase, IMAP family member 2 |
| GINM1 | 116254 | NP_620140 | 5793 | chromosome 6 open reading frame 72 |
| GIPR | 2696 | NP_000155 | 50 | gastric inhibitory polypeptide receptor |
| GJA1 | 2697 | NP_000156 | 51 | gap junction protein, alpha 1, 43kDa |
| GJA10 | 84694 | NP_115991 | 5377 | gap junction protein, alpha 10, 62kDa |
| GJA3 | 2700 | NP_068773 | 4854 | gap junction protein, alpha 3, 46kDa |
| GJA4 | 2701 | NP_002051 | 2542 | gap junction protein, alpha 4, 37kDa |
| GJA5 | 2702 | NP_005257 | 3242 | gap junction protein, alpha 5, 40kDa |
| GJA5 | 2702 | NP_859054 | 6622 | gap junction protein, alpha 5, 40kDa |
| GJA8 | 2703 | NP_005258 | 3243 | gap junction protein, alpha 8, 50kDa |
| GJB1 | 2705 | NP_000157 | 52 | gap junction protein, beta 1, 32kDa |
| GJB1 | 2705 | NP_001091111 | 1114 | gap junction protein, beta 1, 32kDa |
| GJB2 | 2706 | NP_003995 | 2946 | gap junction protein, beta 2, 26kDa |
| GJB3 | 2707 | NP_001005752 | 470 | gap junction protein, beta 3, 31kDa |
| GJB3 | 2707 | NP_076872 | 4992 | gap junction protein, beta 3, 31kDa |
| GJB4 | 127534 | NP_694944 | 6159 | gap junction protein, beta 4, 30.3kDa |
| GJB5 | 2709 | NP_005259 | 3244 | gap junction protein, beta 5, 31.1kDa |
| GJB6 | 10804 | NP_001103689 | 1238 | gap junction protein, beta 6, 30kDa |
| GJB6 | 10804 | NP_001103690 | 1239 | gap junction protein, beta 6, 30kDa |
| GJB6 | 10804 | NP_001103691 | 1240 | gap junction protein, beta 6, 30kDa |
| GJB6 | 10804 | NP_006774 | 3563 | gap junction protein, beta 6, 30kDa |
| GJC1 | 10052 | NP_001073852 | 1017 | gap junction protein, gamma 1, 45kDa |
| GJC1 | 10052 | NP_005488 | 3295 | gap junction protein, gamma 1, 45kDa |
| GJC2 | 57165 | NP_065168 | 4658 | gap junction protein, gamma 2, 47kDa |
| GJD2 | 57369 | NP_065711 | 4693 | gap junction protein, delta 2, 36kDa |
| GJD3 | 125111 | NP_689343 | 6018 | gap junction protein, delta 3, 31.9kDa |
| GJD4 | 219770 | NP_699199 | 6185 | gap junction protein, delta 4, 40.1kDa |
| GKN1 | 56287 | NP_062563 | 4576 | gastrokine 1 |
| GLB1L2 | 89944 | NP_612351 | 5732 | galactosidase, beta 1-like 2 |
| GLCCI1 | 113263 | NP_612435 | 5748 | glucocorticoid induced transcript 1 |
| GLCE | 26035 | NP_056369 | 4101 | glucuronic acid epimerase |
| GLDN | 342035 | NP_861454 | 6636 | gliomedin |
| GLG1 | 2734 | NP_001139138 | 1874 | golgi apparatus protein 1 |
| GLG1 | 2734 | NP_001139139 | 1875 | golgi apparatus protein 1 |
| GLG1 | 2734 | NP_036333 | 3721 | golgi apparatus protein 1 |
| GLIPR1 | 11010 | NP_006842 | 3580 | GLI pathogenesis-related 1 |
| GLMP | 112770 | NP_653181 | 5866 | chromosome 1 open reading frame 85 |
| GLP1R | 2740 | NP_002053 | 2543 | glucagon-like peptide 1 receptor |
| GLP2R | 9340 | NP_004237 | 2997 | glucagon-like peptide 2 receptor |
| GLRA1 | 2741 | NP_000162 | 53 | glycine receptor, alpha 1 |
| GLRA1 | 2741 | NP_001139512 | 1899 | glycine receptor, alpha 1 |
| GLRA2 | 2742 | NP_001112357 | 1281 | glycine receptor, alpha 2 |
| GLRA2 | 2742 | NP_001112358 | 1282 | glycine receptor, alpha 2 |
| GLRA2 | 2742 | NP_001165413 | 2300 | glycine receptor, alpha 2 |
| GLRA2 | 2742 | NP_002054 | 2544 | glycine receptor, alpha 2 |
| GLRA3 | 8001 | NP_001036008 | 904 | glycine receptor, alpha 3 |
| GLRA3 | 8001 | NP_006520 | 3508 | glycine receptor, alpha 3 |
| GLRB | 2743 | NP_000815 | 275 | glycine receptor, beta |
| GLRB | 2743 | NP_001159532 | 2143 | glycine receptor, beta |
| GLRB | 2743 | NP_001159533 | 2144 | glycine receptor, beta |
| GLT8D1 | 55830 | NP_001010983 | 583 | glycosyltransferase 8 domain containing 1 |
| GLT8D1 | 55830 | NP_060916 | 4452 | glycosyltransferase 8 domain containing 1 |
| GLT8D1 | 55830 | NP_690909 | 6139 | glycosyltransferase 8 domain containing 1 |
| GLT8D2 | 83468 | NP_112592 | 5219 | glycosyltransferase 8 domain containing 2 |
| GLTPD2 | 388323 | NP_001014985 | 630 | glycolipid transfer protein domain containing 2 |
| GMFB | 2764 | NP_004115 | 2970 | glia maturation factor, beta |
| GNB2 | 2783 | NP_005264 | 3245 | guanine nucleotide binding protein (G protein), beta polypeptide 2 |
| GNL2 | 29889 | NP_037417 | 3797 | guanine nucleotide binding protein-like 2 (nucleolar) |
| GNPTAB | 79158 | NP_077288 | 5023 | N-acetylglucosamine-1-phosphate transferase, alpha and beta subunits |
| GNRHR | 2798 | NP_000397 | 119 | gonadotropin-releasingHormone receptor |
| GNRHR | 2798 | NP_001012781 | 607 | gonadotropin-releasingHormone receptor |
| GNS | 2799 | NP_002067 | 2545 | glucosamine (N-acetyl)-6-sulfatase |
| GOLGA5 | 9950 | NP_005104 | 3213 | golgi autoantigen, golgin subfamily a, 5 |
| GOLGB1 | 2804 | NP_004478 | 3063 | golgin B1, golgi integral membrane protein |
| GOLIM4 | 27333 | NP_055313 | 3947 | golgi integral membrane protein 4 |
| GOLM1 | 51280 | NP_057632 | 4241 | golgi membrane protein 1 |
| GOLM1 | 51280 | NP_808800 | 6502 | golgi membrane protein 1 |
| GOLT1A | 127845 | NP_940849 | 6795 | golgi transport 1Homolog A (S. cerevisiae) |
| GOLT1B | 51026 | NP_057156 | 4161 | golgi transport 1Homolog B (S. cerevisiae) |
| GOSR1 | 9527 | NP_001007025 | 498 | golgi SNAP receptor complex member 1 |
| GOSR1 | 9527 | NP_001007026 | 499 | golgi SNAP receptor complex member 1 |
| GOSR1 | 9527 | NP_004862 | 3155 | golgi SNAP receptor complex member 1 |

FIG. 2 (CONT.)

| Antigen | GeneID | Accession No. | SEQ ID NO: | RefSeq Gene Name |
|---|---|---|---|---|
| GOSR2 | 9570 | NP_001012529 | 598 | golgi SNAP receptor complex member 2 |
| GOSR2 | 9570 | NP_004278 | 3008 | golgi SNAP receptor complex member 2 |
| GOSR2 | 9570 | NP_473363 | 5566 | golgi SNAP receptor complex member 2 |
| GP1BA | 2811 | NP_000164 | 54 | glycoprotein Ib (platelet), alpha polypeptide |
| GP2 | 2813 | NP_001007241 | 509 | glycoprotein 2 (zymogen granule membrane) |
| GP2 | 2813 | NP_001007242 | 510 | glycoprotein 2 (zymogen granule membrane) |
| GP2 | 2813 | NP_001007243 | 511 | glycoprotein 2 (zymogen granule membrane) |
| GP2 | 2813 | NP_001493 | 2392 | glycoprotein 2 (zymogen granule membrane) |
| GP5 | 2814 | NP_004479 | 3064 | glycoprotein V (platelet) |
| GP6 | 51206 | NP_001077368 | 1080 | glycoprotein VI (platelet) |
| GP6 | 51206 | NP_057447 | 4211 | glycoprotein VI (platelet) |
| GP9 | 2815 | NP_000165 | 55 | glycoprotein IX (platelet) |
| GPA33 | 10223 | NP_005805 | 3374 | glycoprotein A33 (transmembrane) |
| GPAA1 | 8733 | NP_003792 | 2897 | glycosylphosphatidylinositol anchor attachment protein 1Homolog (yeast) |
| GPATCH2L | 55668 | NP_060396 | 4372 | chromosome 14 open reading frame 118 |
| GPATCH2L | 55668 | NP_060442 | 4376 | chromosome 14 open reading frame 118 |
| GPBAR1 | 151306 | NP_001070659 | 953 | G protein-coupled bile acid receptor 1 |
| GPBAR1 | 151306 | NP_001070662 | 954 | G protein-coupled bile acid receptor 1 |
| GPBAR1 | 151306 | NP_733800 | 6248 | G protein-coupled bile acid receptor 1 |
| GPC3 | 2719 | NP_001158089 | 2089 | glypican 3 |
| GPC3 | 2719 | NP_001158090 | 2090 | glypican 3 |
| GPC3 | 2719 | NP_001158091 | 2091 | glypican 3 |
| GPC3 | 2719 | NP_004475 | 3062 | glypican 3 |
| GPD2 | 2820 | NP_000399 | 120 | glycerol-3-phosphate dehydrogenase 2 (mitochondrial) |
| GPD2 | 2820 | NP_001076581 | 1066 | glycerol-3-phosphate dehydrogenase 2 (mitochondrial) |
| GPER1 | 2852 | NP_001035055 | 819 | G protein-coupled estrogen receptor 1 |
| GPER1 | 2852 | NP_001091671 | 1118 | G protein-coupled estrogen receptor 1 |
| GPER1 | 2852 | NP_001496 | 2394 | G protein-coupled estrogen receptor 1 |
| GPHB5 | 122876 | NP_660154 | 5932 | glycoproteinHormone beta 5 |
| GPM6A | 2823 | NP_005268 | 3246 | glycoprotein M6A |
| GPM6A | 2823 | NP_963885 | 6912 | glycoprotein M6A |
| GPM6A | 2823 | NP_963886 | 6913 | glycoprotein M6A |
| GPM6B | 2824 | NP_001001994 | 382 | glycoprotein M6B |
| GPM6B | 2824 | NP_001001995 | 383 | glycoprotein M6B |
| GPM6B | 2824 | NP_001001996 | 384 | glycoprotein M6B |
| GPM6B | 2824 | NP_005269 | 3247 | glycoprotein M6B |
| GPNMB | 10457 | NP_001005340 | 454 | glycoprotein (transmembrane) nmb |
| GPNMB | 10457 | NP_002501 | 2664 | glycoprotein (transmembrane) nmb |
| GPR1 | 2825 | NP_001091669 | 1116 | G protein-coupled receptor 1 |
| GPR1 | 2825 | NP_005270 | 3248 | G protein-coupled receptor 1 |
| GPR101 | 83550 | NP_473362 | 5565 | G protein-coupled receptor 101 |
| GPR107 | 57720 | NP_001130029 | 1612 | G protein-coupled receptor 107 |
| GPR107 | 57720 | NP_001130030 | 1613 | G protein-coupled receptor 107 |
| GPR107 | 57720 | NP_066011 | 4747 | G protein-coupled receptor 107 |
| GPR108 | 56927 | NP_001073921 | 1024 | G protein-coupled receptor 108 |
| GPR108 | 56927 | NP_001073921.1 | 4611 | G protein-coupled receptor 108 |
| GPR12 | 2835 | NP_005279 | 3255 | G protein-coupled receptor 12 |
| GPR135 | 64582 | NP_072093 | 4932 | G protein-coupled receptor 135 |
| GPR137 | 56834 | NP_001164197 | 2252 | G protein-coupled receptor 137 |
| GPR137 | 56834 | NP_001164351 | 2258 | G protein-coupled receptor 137 |
| GPR137 | 56834 | NP_001164352 | 2259 | G protein-coupled receptor 137 |
| GPR137 | 56834 | NP_064540 | 4605 | G protein-coupled receptor 137 |
| GPR137B | 7107 | NP_003263 | 2812 | G protein-coupled receptor 137B |
| GPR137C | 283554 | NP_001093122 | 1164 | G protein-coupled receptor 137C |
| GPR143 | 4935 | NP_000264 | 79 | G protein-coupled receptor 143 |
| GPR146 | 115330 | NP_612454 | 5754 | G protein-coupled receptor 146 |
| GPR15 | 2838 | NP_005281 | 3256 | G protein-coupled receptor 15 |
| GPR153 | 387509 | NP_997253 | 7017 | G protein-coupled receptor 153 |
| GPR155 | 151556 | NP_001028217 | 751 | G protein-coupled receptor 155 |
| GPR155 | 151556 | NP_689742 | 6076 | G protein-coupled receptor 155 |
| GPR156 | 165829 | NP_001161743 | 2213 | G protein-coupled receptor 156 |
| GPR156 | 165829 | NP_694547 | 6147 | G protein-coupled receptor 156 |
| GPR158 | 57512 | NP_065803 | 4716 | G protein-coupled receptor 158 |
| GPR160 | 26996 | NP_055188 | 3924 | G protein-coupled receptor 160 |
| GPR161 | 23432 | NP_722561 | 6236 | G protein-coupled receptor 161 |
| GPR162 | 27239 | NP_055264 | 3942 | G protein-coupled receptor 162 |
| GPR162 | 27239 | NP_062832 | 4586 | G protein-coupled receptor 162 |
| GPR17 | 2840 | NP_001154887 | 2008 | G protein-coupled receptor 17 |
| GPR17 | 2840 | NP_001154888 | 2009 | G protein-coupled receptor 17 |
| GPR17 | 2840 | NP_001154889 | 2010 | G protein-coupled receptor 17 |
| GPR17 | 2840 | NP_005282 | 3257 | G protein-coupled receptor 17 |
| GPR171 | 29909 | NP_037440 | 3800 | G protein-coupled receptor 171 |
| GPR173 | 54328 | NP_061842 | 4538 | G protein-coupled receptor 173 |
| GPR174 | 84636 | NP_115942.1 | 7302 | G protein-coupled receptor 174 |
| GPR176 | 11245 | NP_009154 | 3654 | G protein-coupled receptor 176 |
| GPR179 | 440435 | NP_001004334.3 | 7447 | G protein-coupled receptor 179 |
| GPR18 | 2841 | NP_001091670 | 1117 | G protein-coupled receptor 18 |

FIG. 2 (CONT.)

| Antigen | GeneID | Accession No. | SEQ ID NO: | RefSeq Gene Name |
|---|---|---|---|---|
| GPR18 | 2841 | NP_005283 | 3258 | G protein-coupled receptor 18 |
| GPR180 | 160897 | NP_851320 | 6577 | G protein-coupled receptor 180 |
| GPR182 | 11318 | NP_009195 | 3664 | G protein-coupled receptor 182 |
| GPR183 | 1880 | NP_004942 | 3176 | G protein-coupled receptor 183 |
| GPR19 | 2842 | NP_006134 | 3446 | G protein-coupled receptor 19 |
| GPR20 | 2843 | NP_005284 | 3259 | G protein-coupled receptor 20 |
| GPR21 | 2844 | NP_005285 | 3260 | G protein-coupled receptor 21 |
| GPR22 | 2845 | NP_005286 | 3261 | G protein-coupled receptor 22 |
| GPR25 | 2848 | NP_005289 | 3264 | G protein-coupled receptor 25 |
| GPR26 | 2849 | NP_703143 | 6190 | G protein-coupled receptor 26 |
| GPR27 | 2850 | NP_061844 | 4540 | G protein-coupled receptor 27 |
| GPR3 | 2827 | NP_005272 | 3249 | G protein-coupled receptor 3 |
| GPR31 | 2853 | NP_005290 | 3265 | G protein-coupled receptor 31 |
| GPR32 | 2854 | NP_001497 | 2395 | G protein-coupled receptor 32 |
| GPR34 | 2857 | NP_001091048 | 1104 | G protein-coupled receptor 34 |
| GPR34 | 2857 | NP_005291 | 3266 | G protein-coupled receptor 34 |
| GPR35 | 2859 | NP_005292 | 3267 | G protein-coupled receptor 35 |
| GPR37 | 2861 | NP_005293 | 3268 | G protein-coupled receptor 37 (endothelin receptor type B-like) |
| GPR37L1 | 9283 | NP_004758 | 3118 | G protein-coupled receptor 37 like 1 |
| GPR39 | 2863 | NP_001499 | 2397 | G protein-coupled receptor 39 |
| GPR4 | 2828 | NP_005273 | 3250 | G protein-coupled receptor 4 |
| GPR45 | 11250 | NP_009158 | 3655 | G protein-coupled receptor 45 |
| GPR50 | 9248 | NP_004215 | 2993 | G protein-coupled receptor 50 |
| GPR52 | 9293 | NP_005675 | 3342 | G protein-coupled receptor 52 |
| GPR55 | 9290 | NP_005674 | 3341 | G protein-coupled receptor 55 |
| GPR6 | 2830 | NP_005275 | 3252 | G protein-coupled receptor 6 |
| GPR61 | 83873 | NP_114142 | 5271 | G protein-coupled receptor 61 |
| GPR62 | 118442 | NP_543141 | 5639 | G protein-coupled receptor 62 |
| GPR63 | 81491 | NP_001137429 | 1739 | G protein-coupled receptor 63 |
| GPR63 | 81491 | NP_110411 | 5173 | G protein-coupled receptor 63 |
| GPR65 | 8477 | NP_003599.2 | 7328 | G protein-coupled receptor 65 |
| GPR68 | 8111 | NP_001171147.1 | 7420 | G protein-coupled receptor 68 |
| GPR75 | 10936 | NP_006785 | 3564 | G protein-coupled receptor 75 |
| GPR78 | 27201 | NP_543009 | 5633 | G protein-coupled receptor 78 |
| GPR82 | 27197 | NP_543007 | 5631 | G protein-coupled receptor 82 |
| GPR83 | 10888 | NP_057624 | 4239 | G protein-coupled receptor 83 |
| GPR84 | 53831 | NP_065103 | 4635 | G protein-coupled receptor 84 |
| GPR85 | 54329 | NP_001139737 | 1920 | G protein-coupled receptor 85 |
| GPR85 | 54329 | NP_001139738 | 1921 | G protein-coupled receptor 85 |
| GPR85 | 54329 | NP_001139739 | 1922 | G protein-coupled receptor 85 |
| GPR85 | 54329 | NP_061843 | 4539 | G protein-coupled receptor 85 |
| GPR87 | 53836 | NP_076404 | 4979 | G protein-coupled receptor 87 |
| GPR88 | 54112 | NP_071332 | 4868 | G protein-coupled receptor 88 |
| GPRC5A | 9052 | NP_003970 | 2937 | G protein-coupled receptor, family C, group 5, member A |
| GPRC5B | 51704 | NP_057319 | 4189 | G protein-coupled receptor, family C, group 5, member B |
| GPRC5C | 55890 | NP_061123 | 4478 | G protein-coupled receptor, family C, group 5, member C |
| GPRC5C | 55890 | NP_071319 | 4865 | G protein-coupled receptor, family C, group 5, member C |
| GPRC5D | 55507 | NP_061124 | 4479 | G protein-coupled receptor, family C, group 5, member D |
| GPRC6A | 222545 | NP_683766 | 6012 | G protein-coupled receptor, family C, group 6, member A |
| GPX7 | 2882 | NP_056511 | 4114 | glutathione peroxidase 7 |
| GPX8 | 493869 | NP_001008398 | 532 | glutathione peroxidase 8 (putative) |
| GRAMD1B | 57476 | NP_065767 | 4707 | GRAM domain containing 1B |
| GRAMD1C | 54762 | NP_001165576 | 2307 | GRAM domain containing 1C |
| GRAMD1C | 54762 | NP_060047 | 4307 | GRAM domain containing 1C |
| GRAMD2 | 196996 | NP_001012660 | 599 | GRAM domain containing 2 |
| GRAMD3 | 65983 | NP_001139791 | 1927 | GRAM domain containing 3 |
| GRAMD3 | 65983 | NP_001139792 | 1928 | GRAM domain containing 3 |
| GRAMD3 | 65983 | NP_001139793 | 1929 | GRAM domain containing 3 |
| GRAMD3 | 65983 | NP_001139794 | 1930 | GRAM domain containing 3 |
| GRAMD3 | 65983 | NP_076416 | 4985 | GRAM domain containing 3 |
| GRAMD4 | 23151 | NP_001015881 | 635 | TSC22 domain family, member 3 GRAM domain containing 4 |
| GRAMD4 | 23151 | NP_004080 | 2960 | TSC22 domain family, member 3 GRAM domain containing 4 |
| GRAMD4 | 23151 | NP_055939 | 4036 | TSC22 domain family, member 3 GRAM domain containing 4 |
| GRAMD4 | 23151 | NP_932174 | 6738 | TSC22 domain family, member 3 GRAM domain containing 4 |
| GREM1 | 26585 | NP_037504 | 3812 | gremlin 1, cysteine knot superfamily, Homolog (Xenopus laevis) |
| GRHL1 | 29841 | NP_937825.2 | 3954 | grainyhead-like 1 (Drosophila) |
| GRHL1 | 29841 | NP_937825 | 6752 | grainyhead-like 1 (Drosophila) |
| GRIA1 | 2890 | NP_000818 | 277 | glutamate receptor, ionotropic, AMPA 1 |
| GRIA1 | 2890 | NP_001107655 | 1270 | glutamate receptor, ionotropic, AMPA 1 |
| GRIA2 | 2891 | NP_000817 | 276 | glutamate receptor, ionotropic, AMPA 2 |
| GRIA2 | 2891 | NP_001077088 | 1078 | glutamate receptor, ionotropic, AMPA 2 |
| GRIA2 | 2891 | NP_001077089 | 1079 | glutamate receptor, ionotropic, AMPA 2 |
| GRIA3 | 2892 | NP_000819 | 278 | glutamate receptor, ionotrophic, AMPA 3 |
| GRIA3 | 2892 | NP_015564 | 3686 | glutamate receptor, ionotrophic, AMPA 3 |
| GRIA4 | 2893 | NP_000820 | 279 | glutamate receptor, ionotrophic, AMPA 4 |
| GRIA4 | 2893 | NP_001070711 | 958 | glutamate receptor, ionotrophic, AMPA 4 |
| GRIA4 | 2893 | NP_001070712 | 959 | glutamate receptor, ionotrophic, AMPA 4 |

FIG. 2 (CONT.)

| Antigen | GeneID | Accession No. | SEQ ID NO: | RefSeq Gene Name |
|---|---|---|---|---|
| GRIA4 | 2893 | NP_001106283 | 1253 | glutamate receptor, ionotrophic, AMPA 4 |
| GRID1 | 2894 | NP_060021 | 4305 | glutamate receptor, ionotropic, delta 1 |
| GRID2 | 2895 | NP_001501 | 2398 | glutamate receptor, ionotropic, delta 2 |
| GRIK1 | 2897 | NP_000821 | 280 | glutamate receptor, ionotropic, kainate 1 |
| GRIK1 | 2897 | NP_783300 | 6445 | glutamate receptor, ionotropic, kainate 1 |
| GRIK2 | 2898 | NP_001159719 | 2155 | glutamate receptor, ionotropic, kainate 2 |
| GRIK2 | 2898 | NP_068775 | 4855 | glutamate receptor, ionotropic, kainate 2 |
| GRIK2 | 2898 | NP_786944 | 6460 | glutamate receptor, ionotropic, kainate 2 |
| GRIK3 | 2899 | NP_000822 | 281 | glutamate receptor, ionotropic, kainate 3 |
| GRIK4 | 2900 | NP_055434 | 3965 | glutamate receptor, ionotropic, kainate 4 |
| GRIK5 | 2901 | NP_002079 | 2546 | glutamate receptor, ionotropic, kainate 5 |
| GRIN1 | 2902 | NP_000823 | 282 | glutamate receptor, ionotropic, N-methyl D-aspartate 1 |
| GRIN1 | 2902 | NP_015566 | 3687 | glutamate receptor, ionotropic, N-methyl D-aspartate 1 |
| GRIN1 | 2902 | NP_067544 | 4806 | glutamate receptor, ionotropic, N-methyl D-aspartate 1 |
| GRIN2A | 2903 | NP_000824 | 283 | glutamate receptor, ionotropic, N-methyl D-aspartate 2A |
| GRIN2A | 2903 | NP_001127879 | 1486 | glutamate receptor, ionotropic, N-methyl D-aspartate 2A |
| GRIN2A | 2903 | NP_001127880 | 1487 | glutamate receptor, ionotropic, N-methyl D-aspartate 2A |
| GRIN2B | 2904 | NP_000825 | 284 | glutamate receptor, ionotropic, N-methyl D-aspartate 2B |
| GRIN2C | 2905 | NP_000826 | 285 | glutamate receptor, ionotropic, N-methyl D-aspartate 2C |
| GRIN2D | 2906 | NP_000827 | 286 | glutamate receptor, ionotropic, N-methyl D-aspartate 2D |
| GRIN3A | 116443 | NP_597702 | 5691 | glutamate receptor, ionotropic, N-methyl-D-aspartate 3A |
| GRIN3B | 116444 | NP_619635 | 5769 | glutamate receptor, ionotropic, N-methyl-D-aspartate 3B |
| GRINA | 2907 | NP_000828 | 287 | glutamate receptor, ionotropic, N-methyl D-aspartate-associated protein 1 (glutamate binding) |
| GRINA | 2907 | NP_001009184 | 559 | glutamate receptor, ionotropic, N-methyl D-aspartate-associated protein 1 (glutamate binding) |
| GRM1 | 2911 | NP_000829 | 288 | glutamate receptor, metabotropic 1 |
| GRM1 | 2911 | NP_001264993.1 | 1271 | glutamate receptor, metabotropic 1 |
| GRM2 | 2912 | NP_000830 | 289 | glutamate receptor, metabotropic 2 |
| GRM2 | 2912 | NP_001123535 | 1415 | glutamate receptor, metabotropic 2 |
| GRM3 | 2913 | NP_000831 | 290 | glutamate receptor, metabotropic 3 |
| GRM4 | 2914 | NP_000832 | 291 | glutamate receptor, metabotropic 4 |
| GRM5 | 2915 | NP_000833 | 292 | glutamate receptor, metabotropic 5 |
| GRM5 | 2915 | NP_001137303 | 1731 | glutamate receptor, metabotropic 5 |
| GRM6 | 2916 | NP_000834 | 293 | glutamate receptor, metabotropic 6 |
| GRM7 | 2917 | NP_000835 | 294 | glutamate receptor, metabotropic 7 |
| GRM7 | 2917 | NP_870989 | 6642 | glutamate receptor, metabotropic 7 |
| GRM8 | 2918 | NP_000836.2 | 7390 | glutamate metabotropic receptor 8 |
| GRPR | 2925 | NP_005305 | 3271 | gastrin-releasing peptide receptor |
| GSG1 | 83445 | NP_001074023 | 1038 | germ cell associated 1 |
| GSG1 | 83445 | NP_001074024 | 1039 | germ cell associated 1 |
| GSG1 | 83445 | NP_112579 | 5215 | germ cell associated 1 |
| GSG1 | 83445 | NP_722545 | 6233 | germ cell associated 1 |
| GSG1L | 146395 | NP_001103233 | 1236 | GSG1-like |
| GSG1L | 146395 | NP_653276 | 5888 | GSG1-like |
| GTF3C3 | 9330 | NP_036218 | 3700 | general transcription factor IIIC, polypeptide 3, 102kDa |
| GUCA2A | 2980 | NP_291031 | 5507 | guanylate cyclase activator 2A (guanylin) |
| GUCA2B | 2981 | NP_009033 | 3630 | guanylate cyclase activator 2B (uroguanylin) |
| GUCY2C | 2984 | NP_004954 | 3179 | guanylate cyclase 2C (heat stable enterotoxin receptor) |
| GUCY2D | 3000 | NP_000171 | 56 | guanylate cyclase 2D, membrane (retina-specific) |
| GUCY2F | 2986 | NP_001513 | 2399 | guanylate cyclase 2F, retinal |
| GULP1 | 51454 | NP_057399 | 4201 | GULP, engulfment adaptor PTB domain containing 1 |
| GUSB | 2990 | NP_000172 | 57 | glucuronidase, beta |
| GXYLT1 | 283464 | NP_001093120 | 1163 | glycosyltransferase 8 domain containing 3 |
| GXYLT1 | 283464 | NP_775872 | 6363 | glycosyltransferase 8 domain containing 3 |
| GXYLT2 | 727936 | NP_001073862 | 1018 | glycosyltransferase 8 domain containing 4 |
| GYLTL1B | 120071 | NP_689525 | 6030 | glycosyltransferase-like 1B |
| GYPA | 2993 | NP_002090 | 2547 | glycophorin A (MNS blood group) |
| GYPB | 2994 | NP_001291311.1 | 7452 | glycophorin B (MNS blood group) |
| GYPC | 2995 | NP_001243513.1 | 7432 | glycophorin C (Gerbich blood group) |
| GYPE | 2996 | NP_002091 | 2548 | glycophorin E glycophorin B (MNS blood group) |
| GYPE | 2996 | NP_002093 | 2549 | glycophorin E glycophorin B (MNS blood group) |
| GYPE | 2996 | NP_941391 | 6825 | glycophorin E glycophorin B (MNS blood group) |
| GZMK | 3003 | NP_002095 | 2550 | granzyme K (granzyme 3 tryptase II) |
| HACD1 | 9200 | NP_055056 | 3894 | protein tyrosine phosphatase-like (proline instead of catalytic arginine), member A |
| HACD4 | 401494 | NP_001010915 | 576 | protein tyrosine phosphatase-like A domain containing 2 |
| HADH | 3033 | NP_005318 | 3272 | hydroxyacyl-Coenzyme A dehydrogenase |
| HAMP | 57817 | NP_066998 | 4786 | hepcidin antimicrobial peptide |
| HAPLN4 | 404037 | NP_075378 | 4968 | hyaluronan and proteoglycan link protein 4 |
| HAS1 | 3036 | NP_001514 | 2400 | hyaluronan synthase 1 |
| HAS2 | 3037 | NP_005319 | 3273 | hyaluronan synthase 2 |
| HAS3 | 3038 | NP_005320 | 3274 | hyaluronan synthase 3 |
| HAS3 | 3038 | NP_619515 | 5764 | hyaluronan synthase 3 |
| HAVCR1 | 26762 | NP_001166864.1 | 7417 | hepatitis A virus cellular receptor 1 |
| HAVCR2 | 84868 | NP_116171.3 | 7336 | hepatitis A virus cellular receptor 2 |
| HBD | 3045 | NP_000510 | 148 | hemoglobin, delta |
| HBEGF | 1839 | NP_001936 | 2507 | heparin-binding EGF-like growth factor |
| HBS1L | 10767 | NP_001138630 | 1823 | HBS1-like (S. cerevisiae) |
| HBS1L | 10767 | NP_001138679 | 1827 | HBS1-like (S. cerevisiae) |

FIG. 2 (CONT.)

| Antigen | GeneID | Accession No. | SEQ ID NO: | RefSeq Gene Name |
|---|---|---|---|---|
| HBS1L | 10767 | NP_006611 | 3529 | HBS1-like (S. cerevisiae) |
| HCAR1 | 27198 | NP_115943 | 5369 | G protein-coupled receptor 81 |
| HCN1 | 348980 | NP_066550 | 4763 | hyperpolarization activated cyclic nucleotide-gated potassium channel 1 |
| HCN2 | 610 | NP_001185.3 | 7377 | hyperpolarization activated cyclic nucleotide gated potassium channel 2 |
| HCN3 | 57657 | NP_065948 | 4738 | hyperpolarization activated cyclic nucleotide-gated potassium channel 3 |
| HCN4 | 10021 | NP_005468 | 3292 | hyperpolarization activated cyclic nucleotide-gated potassium channel 4 |
| HCRT | 3060 | NP_001515 | 2401 | hypocretin (orexin) neuropeptide precursor |
| HCRTR1 | 3061 | NP_001516 | 2402 | hypocretin (orexin) receptor 1 |
| HCRTR2 | 3062 | NP_001517 | 2403 | hypocretin (orexin) receptor 2 |
| HCST | 10870 | NP_001007470 | 518 | hematopoietic cell signal transducer |
| HCST | 10870 | NP_055081 | 3902 | hematopoietic cell signal transducer |
| HDAC2 | 3066 | NP_001518 | 2404 | histone deacetylase 2 |
| HEG1 | 57493 | NP_065784 | 4710 | HEGHomolog 1 (zebrafish) |
| HELZ | 9931 | NP_055692 | 4005 | helicase with zinc finger |
| HEPACAM | 220296 | NP_001032647 | 778 | hepatocyte cell adhesion moleculeHEPACAM opposite strand 1 |
| HEPACAM | 220296 | NP_689935 | 6105 | hepatocyte cell adhesion moleculeHEPACAM opposite strand 1 |
| HEPACAM2 | 253012 | NP_001034461 | 790 | HEPACAM family member 2 |
| HEPACAM2 | 253012 | NP_937794 | 6748 | HEPACAM family member 2 |
| HEPH | 9843 | NP_001124332 | 1442 | hephaestin |
| HEPH | 9843 | NP_055614 | 3989 | hephaestin |
| HEPH | 9843 | NP_620074 | 5784 | hephaestin |
| HERC4 | 26091 | NP_056416 | 4106 | hect domain and RLD 4 |
| HERC4 | 26091 | NP_071362 | 4874 | hect domain and RLD 4 |
| HERPUD1 | 9709 | NP_001010989 | 585 | homocysteine-inducible, endoplasmic reticulum stress-inducible, ubiquitin-like domain member 1 |
| HERPUD1 | 9709 | NP_001010989.1 | 586 | homocysteine-inducible, endoplasmic reticulum stress-inducible, ubiquitin-like domain member 1 |
| HERPUD1 | 9709 | NP_055500 | 3973 | homocysteine-inducible, endoplasmic reticulum stress-inducible, ubiquitin-like domain member 1 |
| HERPUD2 | 64224 | NP_071768 | 4908 | HERPUD family member 2 |
| HEXB | 3074 | NP_000512 | 149 | hexosaminidase B (beta polypeptide) |
| HFE | 3077 | NP_000401 | 121 | hemochromatosis |
| HFE | 3077 | NP_620572 | 5817 | hemochromatosis |
| HFE | 3077 | NP_620573 | 5818 | hemochromatosis |
| HFE | 3077 | NP_620575 | 5819 | hemochromatosis |
| HFE | 3077 | NP_620576 | 5820 | hemochromatosis |
| HFE | 3077 | NP_620577 | 5821 | hemochromatosis |
| HFE | 3077 | NP_620578 | 5822 | hemochromatosis |
| HFE | 3077 | NP_620579 | 5823 | hemochromatosis |
| HFE | 3077 | NP_620580 | 5824 | hemochromatosis |
| HFE2 | 148738 | NP_660320 | 5950 | hemochromatosis type 2 (juvenile) |
| HFE2 | 148738 | NP_973733 | 6919 | hemochromatosis type 2 (juvenile) |
| HFE2 | 148738 | NP_998817 | 7047 | hemochromatosis type 2 (juvenile) |
| HFE2 | 148738 | NP_998818 | 7048 | hemochromatosis type 2 (juvenile) |
| HGF | 3082 | NP_000592 | 171 | hepatocyte growth factor (hepapoietin A scatter factor) |
| HGF | 3082 | NP_001010931 | 579 | hepatocyte growth factor (hepapoietin A scatter factor) |
| HGF | 3082 | NP_001010932 | 580 | hepatocyte growth factor (hepapoietin A scatter factor) |
| HGF | 3082 | NP_001010933 | 581 | hepatocyte growth factor (hepapoietin A scatter factor) |
| HGF | 3082 | NP_001010934 | 582 | hepatocyte growth factor (hepapoietin A scatter factor) |
| HGFAC | 3083 | NP_001519 | 2405 | HGF activator |
| HGSNAT | 138050 | NP_689632 | 6057 | heparan-alpha-glucosaminide N-acetyltransferase |
| HHAT | 55733 | NP_001116306 | 1286 | hedgehog acyltransferase |
| HHAT | 55733 | NP_001164035 | 2245 | hedgehog acyltransferase |
| HHAT | 55733 | NP_001164051 | 2246 | hedgehog acyltransferase |
| HHAT | 55733 | NP_001164058 | 2248 | hedgehog acyltransferase |
| HHAT | 55733 | NP_001164059 | 2249 | hedgehog acyltransferase |
| HHAT | 55733 | NP_060664 | 4401 | hedgehog acyltransferase |
| HHATL | 57467 | NP_065758 | 4705 | hedgehog acyltransferase-like |
| HHIP | 64399 | NP_071920.1 | 7311 | hedgehog interacting protein |
| HHIPL2 | 79802 | NP_079022 | 5076 | HHIP-like 2 |
| HHLA2 | 11148 | NP_009003 | 3626 | HERV-H LTR-associating 2 |
| HIATL1 | 84641 | NP_115947 | 5370 | hippocampus abundant transcript-like 1 |
| HIGD1A | 25994 | NP_001093138 | 1168 | similar toHIG1 domain family, member 1A |
| HIGD1A | 25994 | NP_001093139 | 1169 | similar toHIG1 domain family, member 1A |
| HIGD1A | 25994 | NP_054775 | 3865 | similar toHIG1 domain family, member 1A |
| HIGD1B | 51751 | NP_057522 | 4217 | HIG1Hypoxia inducible domain family, member 1B |
| HIGD2A | 192286 | NP_620175 | 5802 | HIG1Hypoxia inducible domain family, member 2A |
| HILPDA | 29923 | NP_001092256 | 1144 | chromosome 7 open reading frame 68 |
| HILPDA | 29923 | NP_037464 | 3803 | chromosome 7 open reading frame 68 |
| HLA-A | 3105 | NP_002107.3 | 7319 | major histocompatibility complex, class I, A |
| HLA-B | 3106 | NP_005505.2 | 2552 | majorHistocompatibility complex, class I, C |
| HLA-B | 3106 | NP_005505 | 3305 | majorHistocompatibility complex, class I, C |
| HLA-C | 3107 | NP_002108 | 2551 | majorHistocompatibility complex, class I, C |
| HLA-C | 3107 | NP_001229971.1 | 3304 | majorHistocompatibility complex, class I, C |
| HLA-DMA | 3108 | NP_006111 | 3437 | majorHistocompatibility complex, class II, DM alpha |
| HLA-DMB | 3109 | NP_002109 | 2553 | majorHistocompatibility complex, class II, DM beta |
| HLA-DOA | 3111 | NP_002110 | 2554 | majorHistocompatibility complex, class II, DO alpha |
| HLA-DOB | 3112 | NP_002111 | 2555 | majorHistocompatibility complex, class II, DO beta |
| HLA-DQB2 | 3120 | NP_001185787 | 7118 | major histocompatibility complex, class II, DQ beta 2 |
| HLA-DRA | 3122 | NP_061984 | 4566 | majorHistocompatibility complex, class II, DR alpha |

FIG. 2 (CONT.)

| Antigen | GeneID | Accession No. | SEQ ID NO: | RefSeq Gene Name |
|---|---|---|---|---|
| HLA-DRB1 | 3123 | NP_002115 | 2556 | majorHistocompatibility complex, class II, DR beta 4 |
| HLA-DRB1 | 3123 | NP_068818 | 4859 | majorHistocompatibility complex, class II, DR beta 4 |
| HLA-E | 3133 | NP_005507 | 3306 | majorHistocompatibility complex, class I, E |
| HLA-F | 3134 | NP_001091948 | 1123 | majorHistocompatibility complex, class I, F |
| HLA-F | 3134 | NP_001091949 | 1124 | majorHistocompatibility complex, class I, F |
| HLA-F | 3134 | NP_061823 | 4535 | majorHistocompatibility complex, class I, F |
| HLA-G | 3135 | NP_002118 | 2557 | majorHistocompatibility complex, class I, G |
| HM13 | 81502 | NP_110416 | 5174 | histocompatibility (minor) 13 |
| HM13 | 81502 | NP_848695 | 6558 | histocompatibility (minor) 13 |
| HM13 | 81502 | NP_848696 | 6559 | histocompatibility (minor) 13 |
| HM13 | 81502 | NP_848697 | 6560 | histocompatibility (minor) 13 |
| HMGCR | 3156 | NP_000850 | 295 | 3-hydroxy-3-methylglutaryl-Coenzyme A reductase |
| HMGCR | 3156 | NP_001124468 | 1466 | 3-hydroxy-3-methylglutaryl-Coenzyme A reductase |
| HMOX1 | 3162 | NP_002124 | 2558 | heme oxygenase (decycling) 1 |
| HMOX2 | 3163 | NP_001120676 | 1310 | heme oxygenase (decycling) 2 |
| HMOX2 | 3163 | NP_001120677 | 1311 | heme oxygenase (decycling) 2 |
| HMOX2 | 3163 | NP_001120678 | 1312 | heme oxygenase (decycling) 2 |
| HMOX2 | 3163 | NP_002125 | 2559 | heme oxygenase (decycling) 2 |
| HMP19 | 51617 | NP_057064 | 4146 | HMP19 protein |
| HOGA1 | 112817 | NP_001128142 | 1501 | N-acetylneuraminate pyruvate lyase 2 (putative) |
| HOGA1 | 112817 | NP_612422 | 5746 | N-acetylneuraminate pyruvate lyase 2 (putative) |
| HPN | 3249 | NP_002142 | 2560 | hepsin |
| HPN | 3249 | NP_892028 | 6699 | hepsin |
| HRASLS2 | 54979 | NP_060348 | 4363 | HRAS-like suppressor 2 |
| HRCT1 | 646962 | NP_001034881 | 812 | histidine rich carboxyl terminus 1 |
| HRH1 | 3269 | NP_000852 | 296 | histamine receptorH1 |
| HRH1 | 3269 | NP_001091681 | 1119 | histamine receptorH1 |
| HRH1 | 3269 | NP_001091682 | 1120 | histamine receptorH1 |
| HRH1 | 3269 | NP_001091683 | 1121 | histamine receptorH1 |
| HRH2 | 3274 | NP_001124527 | 1467 | histamine receptorH2 |
| HRH2 | 3274 | NP_071640 | 4895 | histamine receptorH2 |
| HRH3 | 11255 | NP_009163 | 3657 | histamine receptorH3 |
| HRH4 | 59340 | NP_001137300 | 1730 | histamine receptorH4 |
| HRH4 | 59340 | NP_001153638 | 1977 | histamine receptorH4 |
| HRH4 | 59340 | NP_067637 | 4810 | histamine receptorH4 |
| HS3ST2 | 9956 | NP_006034 | 3419 | heparan sulfate (glucosamine) 3-O-sulfotransferase 2 |
| HS3ST3B1 | 9953 | NP_006032 | 3418 | heparan sulfate (glucosamine) 3-O-sulfotransferase 3B1 |
| HS3ST5 | 222537 | NP_705840 | 6202 | heparan sulfate (glucosamine) 3-O-sulfotransferase 5 |
| HS6ST3 | 266722 | NP_703157 | 6194 | heparan sulfate 6-O-sulfotransferase 3 |
| HSD11B1 | 3290 | NP_005516 | 3307 | hydroxysteroid (11-beta) dehydrogenase 1 |
| HSD11B1 | 3290 | NP_861420 | 6630 | hydroxysteroid (11-beta) dehydrogenase 1 |
| HSD17B12 | 51144 | NP_057226 | 4176 | hydroxysteroid (17-beta) dehydrogenase 12 |
| HSD17B2 | 3294 | NP_002144 | 2561 | hydroxysteroid (17-beta) dehydrogenase 2 |
| HSD17B3 | 3293 | NP_000188 | 59 | hydroxysteroid (17-beta) dehydrogenase 3 |
| HSD3B2 | 3284 | NP_000189 | 60 | hydroxy-delta-5-steroid dehydrogenase, 3 beta- and steroid delta-isomerase 2 |
| HSD3B2 | 3284 | NP_001159592 | 2151 | hydroxy-delta-5-steroid dehydrogenase, 3 beta- and steroid delta-isomerase 2 |
| HSD3B7 | 80270 | NP_001129193 | 1560 | hydroxy-delta-5-steroid dehydrogenase, 3 beta- and steroid delta-isomerase 7 |
| HSD3B7 | 80270 | NP_001136249 | 1699 | hydroxy-delta-5-steroid dehydrogenase, 3 beta- and steroid delta-isomerase 7 |
| HSD3B7 | 80270 | NP_001136250 | 1700 | hydroxy-delta-5-steroid dehydrogenase, 3 beta- and steroid delta-isomerase 7 |
| HSD3B7 | 80270 | NP_060538 | 4387 | hydroxy-delta-5-steroid dehydrogenase, 3 beta- and steroid delta-isomerase 7 |
| HSD3B7 | 80270 | NP_079469 | 5132 | hydroxy-delta-5-steroid dehydrogenase, 3 beta- and steroid delta-isomerase 7 |
| HSPA13 | 6782 | NP_008879 | 3601 | heat shock protein 70kDa family, member 13 |
| HSPA5 | 3309 | NP_005338.1 | 7305 | heat shock protein family A (Hsp70) member 5 |
| HTATIP2 | 10553 | NP_001091990 | 1132 | HIV-1 Tat interactive protein 2, 30kDa |
| HTATIP2 | 10553 | NP_001091991 | 1133 | HIV-1 Tat interactive protein 2, 30kDa |
| HTATIP2 | 10553 | NP_001091992 | 1134 | HIV-1 Tat interactive protein 2, 30kDa |
| HTATIP2 | 10553 | NP_001091993 | 1135 | HIV-1 Tat interactive protein 2, 30kDa |
| HTATIP2 | 10553 | NP_006401 | 3484 | HIV-1 Tat interactive protein 2, 30kDa |
| HTR1A | 3350 | NP_000515 | 150 | 5-hydroxytryptamine (serotonin) receptor 1A |
| HTR1B | 3351 | NP_000854 | 297 | 5-hydroxytryptamine (serotonin) receptor 1B |
| HTR1D | 3352 | NP_000855 | 298 | 5-hydroxytryptamine (serotonin) receptor 1D |
| HTR1E | 3354 | NP_000856.1 | 7260 | 5-hydroxytryptamine receptor 1E |
| HTR1F | 3355 | NP_000857 | 299 | 5-hydroxytryptamine (serotonin) receptor 1F |
| HTR2A | 3356 | NP_000612 | 176 | 5-hydroxytryptamine (serotonin) receptor 2A |
| HTR2A | 3356 | NP_001159419 | 2132 | 5-hydroxytryptamine (serotonin) receptor 2A |
| HTR2B | 3357 | NP_000858 | 300 | 5-hydroxytryptamine (serotonin) receptor 2B |
| HTR2C | 3358 | NP_000859 | 301 | 5-hydroxytryptamine (serotonin) receptor 2C |
| HTR3A | 3359 | NP_000860 | 302 | 5-hydroxytryptamine (serotonin) receptor 3A |
| HTR3A | 3359 | NP_001155244 | 2027 | 5-hydroxytryptamine (serotonin) receptor 3A |
| HTR3A | 3359 | NP_998786 | 7044 | 5-hydroxytryptamine (serotonin) receptor 3A |
| HTR3B | 9177 | NP_006019 | 3417 | 5-hydroxytryptamine (serotonin) receptor 3B |
| HTR3C | 170572 | NP_570126 | 5662 | 5-hydroxytryptamine (serotonin) receptor 3, family member C |
| HTR4 | 3360 | NP_000861 | 303 | 5-hydroxytryptamine (serotonin) receptor 4 |
| HTR4 | 3360 | NP_001035259 | 848 | 5-hydroxytryptamine (serotonin) receptor 4 |
| HTR4 | 3360 | NP_000861.1 | 849 | 5-hydroxytryptamine (serotonin) receptor 4 |
| HTR4 | 3360 | NP_001035262 | 850 | 5-hydroxytryptamine (serotonin) receptor 4 |
| HTR4 | 3360 | NP_001035263 | 851 | 5-hydroxytryptamine (serotonin) receptor 4 |

FIG. 2 (CONT.)

| Antigen | GeneID | Accession No. | SEQ ID NO: | RefSeq Gene Name |
|---|---|---|---|---|
| HTR4 | 3360 | NP_001035264 | 852 | 5-hydroxytryptamine (serotonin) receptor 4 |
| HTR4 | 3360 | NP_955525 | 6885 | 5-hydroxytryptamine (serotonin) receptor 4 |
| HTR5A | 3361 | NP_076917 | 4993 | 5-hydroxytryptamine (serotonin) receptor 5A |
| HTR6 | 3362 | NP_000862 | 304 | 5-hydroxytryptamine (serotonin) receptor 6 |
| HTR7 | 3363 | NP_000863 | 305 | 5-hydroxytryptamine (serotonin) receptor 7 (adenylate cyclase-coupled) |
| HTR7 | 3363 | NP_062873 | 4587 | 5-hydroxytryptamine (serotonin) receptor 7 (adenylate cyclase-coupled) |
| HTR7 | 3363 | NP_062874 | 4588 | 5-hydroxytryptamine (serotonin) receptor 7 (adenylate cyclase-coupled) |
| HTRA2 | 27429 | NP_037379 | 3789 | HtrA serine peptidase 2 |
| HTRA2 | 27429 | NP_659540 | 5926 | HtrA serine peptidase 2 |
| HTRA4 | 203100 | NP_710159 | 6215 | HtrA serine peptidase 4 |
| HVCN1 | 84329 | NP_001035196 | 836 | hydrogen voltage-gated channel 1 |
| HVCN1 | 84329 | NP_115745 | 5335 | hydrogen voltage-gated channel 1 |
| HYAL4 | 23553 | NP_036401 | 3733 | hyaluronoglucosaminidase 4 |
| HYOU1 | 10525 | NP_001124463 | 1465 | hypoxia up-regulated 1 |
| HYOU1 | 10525 | NP_006380 | 3479 | hypoxia up-regulated 1 |
| ICA1 | 3382 | NP_001129492 | 1590 | islet cell autoantigen 1, 69kDa |
| ICA1 | 3382 | NP_004959 | 3180 | islet cell autoantigen 1, 69kDa |
| ICA1 | 3382 | NP_071682 | 4896 | islet cell autoantigen 1, 69kDa |
| ICAM1 | 3383 | NP_000192.2 | 7382 | intercellular adhesion molecule 1 |
| ICAM2 | 3384 | NP_000864 | 306 | intercellular adhesion molecule 2 |
| ICAM2 | 3384 | NP_001093256 | 1175 | intercellular adhesion molecule 2 |
| ICAM2 | 3384 | NP_001093257 | 1176 | intercellular adhesion molecule 2 |
| ICAM2 | 3384 | NP_001093258 | 1177 | intercellular adhesion molecule 2 |
| ICAM2 | 3384 | NP_001093259 | 1178 | intercellular adhesion molecule 2 |
| ICAM3 | 3385 | NP_002153 | 2563 | intercellular adhesion molecule 3 |
| ICAM4 | 3386 | NP_001034221 | 787 | intercellular adhesion molecule 4 (Landsteiner-Wiener blood group) |
| ICAM4 | 3386 | NP_001535 | 2410 | intercellular adhesion molecule 4 (Landsteiner-Wiener blood group) |
| ICAM4 | 3386 | NP_071772 | 4911 | intercellular adhesion molecule 4 (Landsteiner-Wiener blood group) |
| ICAM5 | 7087 | NP_003250 | 2804 | intercellular adhesion molecule 5, telencephalin |
| ICMT | 23463 | NP_036537 | 3769 | isoprenylcysteine carboxyl methyltransferase |
| ICOS | 29851 | NP_036224 | 3703 | inducible T-cell co-stimulator |
| ICOSLG | 23308 | NP_056074 | 4054 | inducible T-cell co-stimulator ligand |
| IER3IP1 | 51124 | NP_057181 | 4168 | immediate early response 3 interacting protein 1 |
| IFI27 | 3429 | NP_001123552 | 1417 | interferon, alpha-inducible protein 27 |
| IFI27 | 3429 | NP_005523 | 3309 | interferon, alpha-inducible protein 27 |
| IFI27L1 | 122509 | NP_660292 | 5940 | interferon, alpha-inducible protein 27-like 1 |
| IFI27L1 | 122509 | NP_996832 | 6991 | interferon, alpha-inducible protein 27-like 1 |
| IFI6 | 2537 | NP_002029 | 2538 | interferon, alpha-inducible protein 6 |
| IFI6 | 2537 | NP_075010 | 4956 | interferon, alpha-inducible protein 6 |
| IFI6 | 2537 | NP_075011 | 4957 | interferon, alpha-inducible protein 6 |
| IFITM1 | 8519 | NP_003632 | 2861 | interferon induced transmembrane protein 1 (9-27) |
| IFITM10 | 402778 | NP_001164291 | 2257 | similar to RIKEN cDNA 6330512M04 gene (mouse) |
| IFITM2 | 10581 | NP_006426 | 3491 | interferon induced transmembrane protein 2 (1-8D) |
| IFNAR1 | 3454 | NP_000620 | 180 | interferon (alpha, beta and omega) receptor 1 |
| IFNAR2 | 3455 | NP_000865 | 307 | interferon (alpha, beta and omega) receptor 2 |
| IFNAR2 | 3455 | NP_997467 | 7027 | interferon (alpha, beta and omega) receptor 2 |
| IFNAR2 | 3455 | NP_997468 | 7028 | interferon (alpha, beta and omega) receptor 2 |
| IFNB1 | 3456 | NP_002167 | 2564 | interferon, beta 1, fibroblast |
| IFNE | 338376 | NP_795372 | 6487 | interferon, epsilon |
| IFNGR1 | 3459 | NP_000407.1 | 7273 | interferon gamma receptor 1 |
| IFNGR2 | 3460 | NP_005525 | 3310 | interferon gamma receptor 2 (interferon gamma transducer 1) |
| IFNL1 | 282618 | NP_742152 | 6284 | interleukin 29 (interferon, lambda 1) |
| IFNL2 | 282616 | NP_742150 | 6283 | interleukin 28A (interferon, lambda 2) |
| IFNLR1 | 163702 | NP_734464 | 6260 | interleukin 28 receptor, alpha (interferon, lambda receptor) |
| IFNLR1 | 163702 | NP_775087 | 6328 | interleukin 28 receptor, alpha (interferon, lambda receptor) |
| IFNLR1 | 163702 | NP_775088 | 6329 | interleukin 28 receptor, alpha (interferon, lambda receptor) |
| IGB1 | 3688 | NP_002202.2 | 7309 | integrin beta-1 isoform 1A precursor |
| IGDCC3 | 9543 | NP_004875 | 3159 | immunoglobulin superfamily, DCC subclass, member 3 |
| IGDCC4 | 57722 | NP_066013 | 4748 | immunoglobulin superfamily, DCC subclass, member 4 |
| IGF1R | 3480 | NP_000866 | 308 | insulin-like growth factor 1 receptor |
| IGF2R | 3482 | NP_000867 | 309 | insulin-like growth factor 2 receptor |
| IGFL1 | 374918 | NP_940943 | 6811 | IGF-like family member 1 |
| IGFLR1 | 79713 | NP_001332933.1 | 7465 | IGF like family receptor 1 |
| IGK | 50802 | N/A | N/A | immunoglobulin kappa locus |
| IGSF1 | 3547 | NP_001164432 | 2260 | immunoglobulin superfamily, member 1 |
| IGSF1 | 3547 | NP_001164433 | 2261 | immunoglobulin superfamily, member 1 |
| IGSF1 | 3547 | NP_001164434 | 2262 | immunoglobulin superfamily, member 1 |
| IGSF1 | 3547 | NP_001546 | 2411 | immunoglobulin superfamily, member 1 |
| IGSF1 | 3547 | NP_991402 | 6949 | immunoglobulin superfamily, member 1 |
| IGSF10 | 285313 | NP_849144 | 6565 | immunoglobulin superfamily, member 10 |
| IGSF11 | 152404 | NP_001015887 | 637 | immunoglobulin superfamily, member 11 |
| IGSF11 | 152404 | NP_689751 | 6078 | immunoglobulin superfamily, member 11 |
| IGSF3 | 3321 | NP_001007238 | 508 | immunoglobulin superfamily, member 3 |
| IGSF3 | 3321 | NP_001533 | 2408 | immunoglobulin superfamily, member 3 |
| IGSF6 | 10261 | NP_005840 | 3384 | immunoglobulin superfamily, member 6 |
| IGSF8 | 93185 | NP_443100 | 5521 | immunoglobulin superfamily, member 8 |
| IGSF9 | 57549 | NP_001128522.1 | 7396 | immunoglobulin superfamily member 9 |

FIG. 2 (CONT.)

| Antigen | GeneID | Accession No. | SEQ ID NO: | RefSeq Gene Name |
|---|---|---|---|---|
| IHH | 3549 | NP_002172 | 2565 | IndianHedgehogHomolog (Drosophila) |
| IL10RA | 3587 | NP_001549 | 2413 | interleukin 10 receptor, alpha |
| IL10RB | 3588 | NP_000619 | 179 | interleukin 10 receptor, beta |
| IL11RA | 3590 | NP_001136256 | 1701 | interleukin 11 receptor, alpha |
| IL11RA | 3590 | NP_001136256.1 | 3066 | interleukin 11 receptor, alpha |
| IL11RA | 3590 | NP_001136256.1 | 5993 | interleukin 11 receptor, alpha |
| IL12B | 3593 | NP_002178 | 2570 | interleukin 12B (natural killer cell stimulatory factor 2, cytotoxic lymphocyte maturation factor 2, p40) |
| IL12RB1 | 3594 | NP_005526 | 3311 | interleukin 12 receptor, beta 1 |
| IL12RB1 | 3594 | NP_714912 | 6216 | interleukin 12 receptor, beta 1 |
| IL12RB2 | 3595 | NP_001550 | 2414 | interleukin 12 receptor, beta 2 |
| IL13 | 3596 | NP_002179 | 2571 | interleukin 13 |
| IL13RA1 | 3597 | NP_001551 | 2415 | interleukin 13 receptor, alpha 1 |
| IL13RA2 | 3598 | NP_000631 | 185 | interleukin 13 receptor, alpha 2 |
| IL15RA | 3601 | NP_002180 | 2572 | interleukin 15 receptor, alpha |
| IL15RA | 3601 | NP_751950 | 6288 | interleukin 15 receptor, alpha |
| IL17D | 53342 | NP_612141 | 5718 | interleukin 17D |
| IL17RA | 23765 | NP_055154 | 3918 | interleukin 17 receptor A |
| IL17RB | 55540 | NP_061195 | 4489 | interleukin 17 receptor B |
| IL17RC | 84818 | NP_116121 | 5391 | interleukin 17 receptor C |
| IL17RC | 84818 | NP_703190 | 6195 | interleukin 17 receptor C |
| IL17RC | 84818 | NP_703191 | 6196 | interleukin 17 receptor C |
| IL17RE | 132014 | NP_705613 | 6197 | interleukin 17 receptor E |
| IL17RE | 132014 | NP_705614 | 6198 | interleukin 17 receptor E |
| IL17RE | 132014 | NP_705616 | 6199 | interleukin 17 receptor E |
| IL18R1 | 8809 | NP_003846 | 2917 | interleukin 18 receptor 1 |
| IL18RAP | 8807 | NP_003844 | 2915 | interleukin 18 receptor accessory protein |
| IL1R1 | 3554 | NP_000868 | 310 | interleukin 1 receptor, type I |
| IL1R2 | 7850 | NP_004624 | 3093 | interleukin 1 receptor, type II |
| IL1R2 | 7850 | NP_001248348.1 | 6340 | interleukin 1 receptor, type II |
| IL1RAP | 3556 | NP_001161400 | 2204 | interleukin 1 receptor accessory protein |
| IL1RAP | 3556 | NP_001161401 | 2205 | interleukin 1 receptor accessory protein |
| IL1RAP | 3556 | NP_001161402 | 2206 | interleukin 1 receptor accessory protein |
| IL1RAP | 3556 | NP_001161403 | 2207 | interleukin 1 receptor accessory protein |
| IL1RAP | 3556 | NP_002173 | 2566 | interleukin 1 receptor accessory protein |
| IL1RAP | 3556 | NP_608273 | 5712 | interleukin 1 receptor accessory protein |
| IL1RAPL1 | 11141 | NP_055086 | 3905 | interleukin 1 receptor accessory protein-like 1 |
| IL1RAPL2 | 26280 | NP_059112 | 4284 | interleukin 1 receptor accessory protein-like 2 |
| IL1RL1 | 9173 | NP_003847 | 2918 | interleukin 1 receptor-like 1 |
| IL1RL1 | 9173 | NP_057316 | 4187 | interleukin 1 receptor-like 1 |
| IL1RL2 | 8808 | NP_003845 | 2916 | interleukin 1 receptor-like 2 |
| IL20RA | 53832 | NP_055247 | 3936 | interleukin 20 receptor, alpha |
| IL20RB | 53833 | NP_653318 | 5898 | interleukin 20 receptor beta |
| IL21R | 50615 | NP_068570 | 4830 | interleukin 21 receptor |
| IL21R | 50615 | NP_851564 | 6580 | interleukin 21 receptor |
| IL21R | 50615 | NP_851565 | 6581 | interleukin 21 receptor |
| IL22 | 50616 | NP_065386 | 4677 | interleukin 22 |
| IL22RA1 | 58985 | NP_067081 | 4804 | interleukin 22 receptor, alpha 1 |
| IL23R | 149233 | NP_653302 | 5894 | interleukin 23 receptor |
| IL25 | 64806 | NP_073626 | 4947 | interleukin 25 |
| IL25 | 64806 | NP_758525 | 6307 | interleukin 25 |
| IL27 | 246778 | NP_663634 | 5969 | interleukin 27 |
| IL27RA | 9466 | NP_004834.1 | 7276 | interleukin 27 receptor subunit alpha |
| IL2RA | 3559 | NP_000408.1 | 7271 | interleukin 2 receptor subunit alpha |
| IL2RB | 3560 | NP_000869.1 | 7261 | interleukin 2 receptor subunit beta |
| IL2RG | 3561 | NP_000197.1 | 7274 | interleukin 2 receptor subunit gamma |
| IL31RA | 133396 | NP_620586 | 5826 | interleukin 31 receptor A |
| IL3RA | 3563 | NP_002174 | 2567 | interleukin 3 receptor, alpha (low affinity) |
| IL4I1 | 259307 | NP_690863 | 6130 | interleukin 4 induced 1 |
| IL4I1 | 259307 | NP_758962 | 6323 | interleukin 4 induced 1 |
| IL4R | 3566 | NP_000409 | 122 | interleukin 4 receptor |
| IL4R | 3566 | NP_001008699 | 550 | interleukin 4 receptor |
| IL5RA | 3568 | NP_000555 | 162 | interleukin 5 receptor, alpha |
| IL5RA | 3568 | NP_783851 | 6450 | interleukin 5 receptor, alpha |
| IL5RA | 3568 | NP_783852 | 6451 | interleukin 5 receptor, alpha |
| IL5RA | 3568 | NP_783853 | 6452 | interleukin 5 receptor, alpha |
| IL5RA | 3568 | NP_783854 | 6453 | interleukin 5 receptor, alpha |
| IL5RA | 3568 | NP_783855 | 6454 | interleukin 5 receptor, alpha |
| IL6R | 3570 | NP_000556 | 163 | interleukin 6 receptor |
| IL6R | 3570 | NP_852004 | 6596 | interleukin 6 receptor |
| IL6ST | 3572 | NP_002175 | 2568 | interleukin 6 signal transducer (gp130, oncostatin M receptor) |
| IL6ST | 3572 | NP_786943 | 6459 | interleukin 6 signal transducer (gp130, oncostatin M receptor) |
| IL7R | 3575 | NP_002176 | 2569 | interleukin 7 receptor |
| ILDR1 | 286676 | NP_787120 | 6471 | immunoglobulin-like domain containing receptor 1 |
| ILDR2 | 387597 | NP_955383 | 6880 | immunoglobulin-like domain containing receptor 2 |
| ILVBL | 10994 | NP_006835 | 3578 | ilvB (bacterial acetolactate synthase)-like |
| IMPAD1 | 54928 | NP_060283 | 4347 | inositol monophosphatase domain containing 1 |
| IMPG2 | 50939 | NP_057331 | 4193 | interphotoreceptor matrix proteoglycan 2 |

FIG. 2 (CONT.)

| Antigen | GeneID | Accession No. | SEQ ID NO: | RefSeq Gene Name |
|---|---|---|---|---|
| INAFM1 | 255783 | NP_848606 | 6547 | hypothetical protein LOC255783 |
| INPP4A | 3631 | NP_001127696 | 1472 | inositol polyphosphate-4-phosphatase, type I, 107kDa |
| INPP4A | 3631 | NP_001127697 | 1473 | inositol polyphosphate-4-phosphatase, type I, 107kDa |
| INPP4A | 3631 | NP_001557 | 2416 | inositol polyphosphate-4-phosphatase, type I, 107kDa |
| INPP4A | 3631 | NP_004018 | 2947 | inositol polyphosphate-4-phosphatase, type I, 107kDa |
| INPP4B | 8821 | NP_001095139 | 1204 | inositol polyphosphate-4-phosphatase, type II, 105kDa |
| INPP4B | 8821 | NP_003857 | 2921 | inositol polyphosphate-4-phosphatase, type II, 105kDa |
| INSIG1 | 3638 | NP_005533 | 3312 | insulin induced gene 1 |
| INSIG1 | 3638 | NP_938150 | 6772 | insulin induced gene 1 |
| INSIG1 | 3638 | NP_938151 | 6773 | insulin induced gene 1 |
| INSIG2 | 51141 | NP_057217 | 4174 | insulin induced gene 2 |
| INSL3 | 3640 | NP_005534 | 3313 | insulin-like 3 (Leydig cell) |
| INSR | 3643 | NP_000199 | 61 | insulin receptor |
| INSR | 3643 | NP_001073285 | 997 | insulin receptor |
| INSRR | 3645 | NP_055030 | 3884 | insulin receptor-related receptor |
| ISLR2 | 57611 | NP_001123608 | 1418 | immunoglobulin superfamily containing leucine-rich repeat 2 |
| ISLR2 | 57611 | NP_001123609 | 1419 | immunoglobulin superfamily containing leucine-rich repeat 2 |
| ISLR2 | 57611 | NP_001123610 | 1420 | immunoglobulin superfamily containing leucine-rich repeat 2 |
| ISLR2 | 57611 | NP_065902 | 4731 | immunoglobulin superfamily containing leucine-rich repeat 2 |
| ISM2 | 145501 | NP_872315 | 6647 | isthmin 2Homolog (zebrafish) |
| ISM2 | 145501 | NP_954993 | 6873 | isthmin 2Homolog (zebrafish) |
| ITFG1 | 81533 | NP_110417 | 5175 | integrin alpha FG-GAP repeat containing 1 |
| ITFG3 | 83986 | NP_114428 | 5284 | integrin alpha FG-GAP repeat containing 3 |
| ITGA10 | 8515 | NP_003628 | 2859 | integrin, alpha 10 |
| ITGA11 | 22801 | NP_001004439 | 435 | integrin, alpha 11 |
| ITGA2 | 3673 | NP_002194 | 2573 | integrin, alpha 2 (CD49B, alpha 2 subunit of VLA-2 receptor) |
| ITGA2B | 3674 | NP_000410 | 123 | integrin, alpha 2b (platelet glycoprotein IIb of IIb/IIIa complex, antigen CD41) |
| ITGA3 | 3675 | NP_002195 | 2574 | integrin, alpha 3 (antigen CD49C, alpha 3 subunit of VLA-3 receptor) |
| ITGA3 | 3675 | NP_002195.1 | 3297 | integrin, alpha 3 (antigen CD49C, alpha 3 subunit of VLA-3 receptor) |
| ITGA4 | 3676 | NP_000876 | 311 | integrin, alpha 4 (antigen CD49D, alpha 4 subunit of VLA-4 receptor) |
| ITGA5 | 3678 | NP_002196 | 2575 | integrin, alpha 5 (fibronectin receptor, alpha polypeptide) |
| ITGA6 | 3655 | NP_000201 | 62 | integrin, alpha 6 |
| ITGA6 | 3655 | NP_001073286 | 998 | integrin, alpha 6 |
| ITGA7 | 3679 | NP_001138468 | 1800 | integrin, alpha 7 |
| ITGA7 | 3679 | NP_001138469 | 1801 | integrin, alpha 7 |
| ITGA7 | 3679 | NP_002197 | 2576 | integrin, alpha 7 |
| ITGA8 | 8516 | NP_003629 | 2860 | integrin, alpha 8 |
| ITGA9 | 3680 | NP_002198 | 2577 | integrin, alpha 9 |
| ITGAD | 3681 | NP_005344 | 3275 | integrin, alpha D |
| ITGAE | 3682 | NP_002199 | 2578 | integrin, alpha E (antigen CD103,Human mucosal lymphocyte antigen 1 alpha polypeptide) |
| ITGAL | 3683 | NP_001107852.1 | 7383 | integrin subunit alpha L |
| ITGAM | 3684 | NP_000623 | 181 | integrin, alpha M (complement component 3 receptor 3 subunit) |
| ITGAM | 3684 | NP_001139280 | 1877 | integrin, alpha M (complement component 3 receptor 3 subunit) |
| ITGAV | 3685 | NP_001138471 | 1802 | integrin, alpha V (vitronectin receptor, alpha polypeptide, antigen CD51) |
| ITGAV | 3685 | NP_001138472 | 1803 | integrin, alpha V (vitronectin receptor, alpha polypeptide, antigen CD51) |
| ITGAV | 3685 | NP_002201 | 2579 | integrin, alpha V (vitronectin receptor, alpha polypeptide, antigen CD51) |
| ITGAX | 3687 | NP_000878 | 312 | integrin, alpha X (complement component 3 receptor 4 subunit) |
| ITGB1 | 3688 | NP_596867.1 | 7310 | integrin subunit beta 1 |
| ITGB2 | 3689 | NP_000202 | 63 | integrin, beta 2 (complement component 3 receptor 3 and 4 subunit) |
| ITGB2 | 3689 | NP_001120963 | 1331 | integrin, beta 2 (complement component 3 receptor 3 and 4 subunit) |
| ITGB3 | 3690 | NP_000203 | 64 | integrin, beta 3 (platelet glycoprotein IIIa, antigen CD61) |
| ITGB5 | 3693 | NP_002204 | 2580 | integrin, beta 5 |
| ITGB6 | 3694 | NP_000879 | 313 | integrin, beta 6 |
| ITGB7 | 3695 | NP_000880 | 314 | integrin, beta 7 |
| ITGB8 | 3696 | NP_002205 | 2581 | integrin, beta 8 |
| ITIH1 | 3697 | NP_001159906 | 2168 | inter-alpha (globulin) inhibitorH1 |
| ITIH1 | 3697 | NP_001159907 | 2169 | inter-alpha (globulin) inhibitorH1 |
| ITIH1 | 3697 | NP_001159908 | 2170 | inter-alpha (globulin) inhibitorH1 |
| ITIH1 | 3697 | NP_002206 | 2582 | inter-alpha (globulin) inhibitorH1 |
| ITM2A | 9452 | NP_001165052 | 2278 | integral membrane protein 2A |
| ITM2A | 9452 | NP_004858 | 3153 | integral membrane protein 2A |
| ITM2B | 9445 | NP_068839 | 4862 | integral membrane protein 2B |
| ITM2C | 81618 | NP_001012532.1 | 7343 | integral membrane protein 2C |
| ITPR1 | 3708 | NP_001093422 | 1179 | inositol 1,4,5-triphosphate receptor, type 1 |
| ITPR1 | 3708 | NP_001161744 | 2214 | inositol 1,4,5-triphosphate receptor, type 1 |
| ITPR1 | 3708 | NP_002213 | 2583 | inositol 1,4,5-triphosphate receptor, type 1 |
| ITPR2 | 3709 | NP_002214 | 2584 | inositol 1,4,5-triphosphate receptor, type 2 |
| ITPR3 | 3710 | NP_002215 | 2585 | inositol 1,4,5-triphosphate receptor, type 3 |
| ITPRIPL1 | 150771 | NP_001008949 | 558 | inositol 1,4,5-triphosphate receptor interacting protein-like 1 |
| ITPRIPL1 | 150771 | NP_001156995 | 2054 | inositol 1,4,5-triphosphate receptor interacting protein-like 1 |
| ITPRIPL1 | 150771 | NP_001156996 | 2055 | inositol 1,4,5-triphosphate receptor interacting protein-like 1 |
| ITPRIPL1 | 150771 | NP_848590 | 6543 | inositol 1,4,5-triphosphate receptor interacting protein-like 1 |
| ITPRIPL2 | 162073 | NP_001030013 | 761 | inositol 1,4,5-triphosphate receptor interacting protein-like 2 |
| ITSN1 | 6453 | NP_001001132 | 350 | intersectin 1 (SH3 domain protein) |
| ITSN1 | 6453 | NP_003015 | 2756 | intersectin 1 (SH3 domain protein) |
| IYD | 389434 | NP_001158166 | 2098 | iodotyrosine deiodinase |
| IYD | 389434 | NP_001158167 | 2099 | iodotyrosine deiodinase |

FIG. 2 (CONT.)

| Antigen | GeneID | Accession No. | SEQ ID NO: | RefSeq Gene Name |
|---|---|---|---|---|
| IYD | 389434 | NP_981932 | 6930 | iodotyrosine deiodinase |
| IZUMO1 | 284359 | NP_872381 | 6663 | izumo sperm-egg fusion 1 |
| IZUMO2 | 126123 | NP_689571 | 6041 | chromosome 19 open reading frame 41 |
| JAG1 | 182 | NP_000205 | 65 | jagged 1 (Alagille syndrome) |
| JAG2 | 3714 | NP_002217 | 2586 | jagged 2 |
| JAG2 | 3714 | NP_660142 | 5928 | jagged 2 |
| JAGN1 | 84522 | NP_115881 | 5360 | jagunalHomolog 1 (Drosophila) |
| JAM2 | 58494 | NP_067042 | 4796 | junctional adhesion molecule 2 |
| JAM3 | 83700 | NP_001192258.1 | 7430 | junctional adhesion molecule 3 |
| JPH1 | 56704 | NP_065698 | 4689 | junctophilin 1 |
| JPH2 | 57158 | NP_065166 | 4657 | junctophilin 2 |
| JPH2 | 57158 | NP_787109 | 6469 | junctophilin 2 |
| JPH3 | 57338 | NP_065706 | 4690 | junctophilin 3 |
| JTB | 10899 | NP_006685 | 3548 | jumping translocation breakpoint |
| KANSL1L | 151050 | NP_689732 | 6073 | chromosome 2 open reading frame 67 |
| KCNA1 | 3736 | NP_000208 | 66 | potassium voltage-gated channel, shaker-related subfamily, member 1 (episodic ataxia with myokymia) |
| KCNA10 | 3744 | NP_005540 | 3314 | potassium voltage-gated channel, shaker-related subfamily, member 10 |
| KCNA2 | 3737 | NP_004965 | 3181 | potassium voltage-gated channel, shaker-related subfamily, member 2 |
| KCNA3 | 3738 | NP_002223 | 2588 | potassium voltage-gated channel, shaker-related subfamily, member 3 |
| KCNA4 | 3739 | NP_002224 | 2589 | potassium voltage-gated channel, shaker-related subfamily, member 4 |
| KCNA5 | 3741 | NP_002225 | 2590 | potassium voltage-gated channel, shaker-related subfamily, member 5 |
| KCNA6 | 3742 | NP_002226 | 2591 | potassium voltage-gated channel, shaker-related subfamily, member 6 |
| KCNA7 | 3743 | NP_114092 | 5259 | potassium voltage-gated channel, shaker-related subfamily, member 7 |
| KCNB1 | 3745 | NP_004966 | 3182 | potassium voltage-gated channel, Shab-related subfamily, member 1 |
| KCNB2 | 9312 | NP_004761 | 3119 | potassium voltage-gated channel, Shab-related subfamily, member 2 |
| KCNC1 | 3746 | NP_001106212 | 1249 | potassium voltage-gated channel, Shaw-related subfamily, member 1 |
| KCNC1 | 3746 | NP_004967 | 3183 | potassium voltage-gated channel, Shaw-related subfamily, member 1 |
| KCNC2 | 3747 | NP_631874 | 5836 | potassium voltage-gated channel, Shaw-related subfamily, member 2 |
| KCNC2 | 3747 | NP_631875 | 5837 | potassium voltage-gated channel, Shaw-related subfamily, member 2 |
| KCNC2 | 3747 | NP_715624 | 6223 | potassium voltage-gated channel, Shaw-related subfamily, member 2 |
| KCNC3 | 3748 | NP_004968 | 3184 | potassium voltage-gated channel, Shaw-related subfamily, member 3 |
| KCNC4 | 3749 | NP_001034663 | 800 | potassium voltage-gated channel, Shaw-related subfamily, member 4 |
| KCNC4 | 3749 | NP_004969 | 3185 | potassium voltage-gated channel, Shaw-related subfamily, member 4 |
| KCNC4 | 3749 | NP_001034663.1 | 6225 | potassium voltage-gated channel, Shaw-related subfamily, member 4 |
| KCND1 | 3750 | NP_004970 | 3186 | potassium voltage-gated channel, Shal-related subfamily, member 1 |
| KCND2 | 3751 | NP_036413.1 | 7288 | potassium voltage-gated channel subfamily D member 2 |
| KCND3 | 3752 | NP_004971 | 3187 | potassium voltage-gated channel, Shal-related subfamily, member 3 |
| KCND3 | 3752 | NP_751948 | 6287 | potassium voltage-gated channel, Shal-related subfamily, member 3 |
| KCNE1 | 3753 | NP_000210 | 68 | potassium voltage-gated channel, Isk-related family, member 1 |
| KCNE1 | 3753 | NP_001121140 | 1342 | potassium voltage-gated channel, Isk-related family, member 1 |
| KCNE1 | 3753 | NP_001121141 | 1343 | potassium voltage-gated channel, Isk-related family, member 1 |
| KCNE1 | 3753 | NP_001121142 | 1344 | potassium voltage-gated channel, Isk-related family, member 1 |
| KCNE2 | 9992 | NP_751951 | 6289 | potassium voltage-gated channel, Isk-related family, member 2 |
| KCNE3 | 10008 | NP_005463 | 3291 | potassium voltage-gated channel, Isk-related family, member 3 |
| KCNE4 | 23704 | NP_542402 | 5616 | potassium voltage-gated channel, Isk-related family, member 4 |
| KCNE5 | 23630 | NP_036414 | 3734 | KCNE1-like |
| KCNF1 | 3754 | NP_002227 | 2592 | potassium voltage-gated channel, subfamily F, member 1 |
| KCNG1 | 3755 | NP_002228 | 2593 | potassium voltage-gated channel, subfamily G, member 1 |
| KCNG2 | 26251 | NP_036415 | 3735 | potassium voltage-gated channel, subfamily G, member 2 |
| KCNG3 | 170850 | NP_579875 | 5687 | potassium voltage-gated channel, subfamily G, member 3 |
| KCNG3 | 170850 | NP_758847 | 6308 | potassium voltage-gated channel, subfamily G, member 3 |
| KCNH1 | 3756 | NP_002229 | 2594 | potassium voltage-gated channel, subfamilyH (eag-related), member 1 |
| KCNH1 | 3756 | NP_758872 | 6321 | potassium voltage-gated channel, subfamilyH (eag-related), member 1 |
| KCNH2 | 3757 | NP_000229 | 75 | potassium voltage-gated channel, subfamilyH (eag-related), member 2 |
| KCNH2 | 3757 | NP_742053 | 6271 | potassium voltage-gated channel, subfamilyH (eag-related), member 2 |
| KCNH2 | 3757 | NP_742054 | 6272 | potassium voltage-gated channel, subfamilyH (eag-related), member 2 |
| KCNH3 | 23416 | NP_036416 | 3736 | potassium voltage-gated channel, subfamilyH (eag-related), member 3 |
| KCNH4 | 23415 | NP_036417 | 3737 | potassium voltage-gated channel, subfamilyH (eag-related), member 4 |
| KCNH5 | 27133 | NP_647479 | 5853 | potassium voltage-gated channel, subfamilyH (eag-related), member 5 |
| KCNH5 | 27133 | NP_758963 | 6324 | potassium voltage-gated channel, subfamilyH (eag-related), member 5 |
| KCNH5 | 27133 | NP_758964 | 6325 | potassium voltage-gated channel, subfamilyH (eag-related), member 5 |
| KCNH6 | 81033 | NP_110406 | 5170 | potassium voltage-gated channel, subfamilyH (eag-related), member 6 |
| KCNH6 | 81033 | NP_775115 | 6335 | potassium voltage-gated channel, subfamilyH (eag-related), member 6 |
| KCNH7 | 90134 | NP_150375 | 5477 | potassium voltage-gated channel, subfamilyH (eag-related), member 7 |
| KCNH7 | 90134 | NP_775185 | 6337 | potassium voltage-gated channel, subfamilyH (eag-related), member 7 |
| KCNH8 | 131096 | NP_653234 | 5880 | potassium voltage-gated channel, subfamilyH (eag-related), member 8 |
| KCNIP3 | 30818 | NP_001030086 | 763 | Kv channel interacting protein 3, calsenilin |
| KCNIP3 | 30818 | NP_038462 | 3821 | Kv channel interacting protein 3, calsenilin |
| KCNJ1 | 3758 | NP_000211 | 69 | potassium inwardly-rectifying channel, subfamily J, member 1 |
| KCNJ1 | 3758 | NP_722448 | 6226 | potassium inwardly-rectifying channel, subfamily J, member 1 |
| KCNJ1 | 3758 | NP_722449 | 6227 | potassium inwardly-rectifying channel, subfamily J, member 1 |
| KCNJ1 | 3758 | NP_722450 | 6228 | potassium inwardly-rectifying channel, subfamily J, member 1 |
| KCNJ1 | 3758 | NP_722451 | 6229 | potassium inwardly-rectifying channel, subfamily J, member 1 |
| KCNJ10 | 3766 | NP_002232 | 2597 | potassium inwardly-rectifying channel, subfamily J, member 10 |
| KCNJ11 | 3767 | NP_000516 | 151 | potassium inwardly-rectifying channel, subfamily J, member 11 |
| KCNJ11 | 3767 | NP_001159762 | 2157 | potassium inwardly-rectifying channel, subfamily J, member 11 |
| KCNJ12 | 3768 | NP_066292 | 4759 | similar toHkir2.2x |

FIG. 2 (CONT.)

| Antigen | GeneID | Accession No. | SEQ ID NO: | RefSeq Gene Name |
|---|---|---|---|---|
| KCNJ13 | 3769 | NP_002233 | 2598 | potassium inwardly-rectifying channel, subfamily J, member 13 |
| KCNJ14 | 3770 | NP_037480 | 3809 | potassium inwardly-rectifying channel, subfamily J, member 14 |
| KCNJ14 | 3770 | NP_037480.1 | 6249 | potassium inwardly-rectifying channel, subfamily J, member 14 |
| KCNJ15 | 3772 | NP_002234 | 2599 | potassium inwardly-rectifying channel, subfamily J, member 15 |
| KCNJ15 | 3772 | NP_733932 | 6256 | potassium inwardly-rectifying channel, subfamily J, member 15 |
| KCNJ15 | 3772 | NP_733933 | 6257 | potassium inwardly-rectifying channel, subfamily J, member 15 |
| KCNJ16 | 3773 | NP_061128 | 4481 | potassium inwardly-rectifying channel, subfamily J, member 16 |
| KCNJ16 | 3773 | NP_733937 | 6258 | potassium inwardly-rectifying channel, subfamily J, member 16 |
| KCNJ16 | 3773 | NP_733938 | 6259 | potassium inwardly-rectifying channel, subfamily J, member 16 |
| KCNJ2 | 3759 | NP_000882 | 316 | potassium inwardly-rectifying channel, subfamily J, member 2 |
| KCNJ3 | 3760 | NP_002230 | 2595 | potassium inwardly-rectifying channel, subfamily J, member 3 |
| KCNJ4 | 3761 | NP_004972 | 3188 | potassium inwardly-rectifying channel, subfamily J, member 4 |
| KCNJ4 | 3761 | NP_690607 | 6124 | potassium inwardly-rectifying channel, subfamily J, member 4 |
| KCNJ5 | 3762 | NP_000881 | 315 | potassium inwardly-rectifying channel, subfamily J, member 5 |
| KCNJ6 | 3763 | NP_002231 | 2596 | potassium inwardly-rectifying channel, subfamily J, member 6 |
| KCNJ8 | 3764 | NP_004973 | 3189 | potassium inwardly-rectifying channel, subfamily J, member 8 |
| KCNJ9 | 3765 | NP_004974 | 3190 | potassium inwardly-rectifying channel, subfamily J, member 9 |
| KCNK1 | 3775 | NP_002236 | 2600 | potassium channel, subfamily K, member 1 |
| KCNK10 | 54207 | NP_066984 | 4784 | potassium channel, subfamily K, member 10 |
| KCNK10 | 54207 | NP_612190 | 5723 | potassium channel, subfamily K, member 10 |
| KCNK10 | 54207 | NP_612191 | 5724 | potassium channel, subfamily K, member 10 |
| KCNK12 | 56660 | NP_071338.1 | 7295 | potassium two pore domain channel subfamily K member 12 |
| KCNK13 | 56659 | NP_071337 | 4869 | potassium channel, subfamily K, member 13 |
| KCNK15 | 60598 | NP_071753 | 4902 | potassium channel, subfamily K, member 15 |
| KCNK16 | 83795 | NP_001128577 | 1522 | potassium channel, subfamily K, member 16 |
| KCNK16 | 83795 | NP_001128578 | 1523 | potassium channel, subfamily K, member 16 |
| KCNK16 | 83795 | NP_001128579 | 1524 | potassium channel, subfamily K, member 16 |
| KCNK16 | 83795 | NP_115491 | 5298 | potassium channel, subfamily K, member 16 |
| KCNK17 | 89822 | NP_001128583.1 | 7397 | potassium two pore domain channel subfamily K member 17 |
| KCNK2 | 3776 | NP_001017424 | 643 | potassium channel, subfamily K, member 2 |
| KCNK2 | 3776 | NP_001017425 | 644 | potassium channel, subfamily K, member 2 |
| KCNK2 | 3776 | NP_055032 | 3885 | potassium channel, subfamily K, member 2 |
| KCNK3 | 3777 | NP_002237 | 2601 | potassium channel, subfamily K, member 3 |
| KCNK4 | 50801 | NP_201567 | 5486 | potassium channel, subfamily K, member 4 |
| KCNK5 | 8645 | NP_003731 | 2883 | potassium channel, subfamily K, member 5 |
| KCNK6 | 9424 | NP_004814 | 3139 | potassium channel, subfamily K, member 6 |
| KCNK7 | 10089 | NP_005705 | 3349 | potassium channel, subfamily K, member 7 |
| KCNK7 | 10089 | NP_203133 | 5490 | potassium channel, subfamily K, member 7 |
| KCNK7 | 10089 | NP_203134 | 5491 | potassium channel, subfamily K, member 7 |
| KCNK7 | 10089 | NP_258416 | 5500 | potassium channel, subfamily K, member 7 |
| KCNK9 | 51305 | NP_001269463.1 | 4257 | potassium channel, subfamily K, member 9 |
| KCNMA1 | 3778 | NP_001014797 | 624 | potassium large conductance calcium-activated channel, subfamily M, alpha member 1 |
| KCNMA1 | 3778 | NP_001154824 | 2002 | potassium large conductance calcium-activated channel, subfamily M, alpha member 1 |
| KCNMA1 | 3778 | NP_001154825 | 2003 | potassium large conductance calcium-activated channel, subfamily M, alpha member 1 |
| KCNMA1 | 3778 | NP_002238 | 2602 | potassium large conductance calcium-activated channel, subfamily M, alpha member 1 |
| KCNMB1 | 3779 | NP_004128 | 2972 | potassium large conductance calcium-activated channel, subfamily M, beta member 1 |
| KCNMB2 | 10242 | NP_005823 | 3379 | potassium large conductance calcium-activated channel, subfamily M, beta member 2 |
| KCNMB2 | 10242 | NP_852006 | 6597 | potassium large conductance calcium-activated channel, subfamily M, beta member 2 |
| KCNMB4 | 27345 | NP_055320 | 3949 | potassium large conductance calcium-activated channel, subfamily M, beta member 4 |
| KCNN2 | 3781 | NP_067627 | 4809 | potassium intermediate/small conductance calcium-activated channel, subfamily N, member 2 |
| KCNN2 | 3781 | NP_740721 | 6262 | potassium intermediate/small conductance calcium-activated channel, subfamily N, member 2 |
| KCNN3 | 3782 | NP_002240 | 2603 | potassium intermediate/small conductance calcium-activated channel, subfamily N, member 3 |
| KCNN3 | 3782 | NP_740752 | 6265 | potassium intermediate/small conductance calcium-activated channel, subfamily N, member 3 |
| KCNN4 | 3783 | NP_002241 | 2604 | potassium intermediate/small conductance calcium-activated channel, subfamily N, member 4 |
| KCNQ1 | 3784 | NP_000209 | 67 | potassium voltage-gated channel, KQT-like subfamily, member 1 |
| KCNQ1 | 3784 | NP_861463 | 6637 | potassium voltage-gated channel, KQT-like subfamily, member 1 |
| KCNQ2 | 3785 | NP_004509 | 3067 | potassium voltage-gated channel, KQT-like subfamily, member 2 |
| KCNQ2 | 3785 | NP_742104 | 6278 | potassium voltage-gated channel, KQT-like subfamily, member 2 |
| KCNQ2 | 3785 | NP_742105 | 6279 | potassium voltage-gated channel, KQT-like subfamily, member 2 |
| KCNQ2 | 3785 | NP_742106 | 6280 | potassium voltage-gated channel, KQT-like subfamily, member 2 |
| KCNQ2 | 3785 | NP_742107 | 6281 | potassium voltage-gated channel, KQT-like subfamily, member 2 |
| KCNQ3 | 3786 | NP_004510 | 3068 | potassium voltage-gated channel, KQT-like subfamily, member 3 |
| KCNQ4 | 9132 | NP_004691 | 3104 | potassium voltage-gated channel, KQT-like subfamily, member 4 |
| KCNQ4 | 9132 | NP_751895 | 6285 | potassium voltage-gated channel, KQT-like subfamily, member 4 |
| KCNQ5 | 56479 | NP_001153602.1 | 7409 | potassium voltage-gated channel subfamily Q member 5 |
| KCNS1 | 3787 | NP_002242 | 2605 | potassium voltage-gated channel, delayed-rectifier, subfamily S, member 1 |
| KCNS2 | 3788 | NP_065748 | 4702 | potassium voltage-gated channel, delayed-rectifier, subfamily S, member 2 |
| KCNS3 | 3790 | NP_002243 | 2606 | potassium voltage-gated channel, delayed-rectifier, subfamily S, member 3 |
| KCNT1 | 57582 | NP_001258932.1 | 7435 | potassium sodium-activated channel subfamily T member 1 |
| KCNT2 | 343450 | NP_940905 | 6803 | potassium channel, subfamily T, member 2 |
| KCNU1 | 157855 | NP_001027006 | 737 | potassium channel, subfamily U, member 1 |
| KCNV1 | 27012 | NP_055194 | 3925 | potassium channel, subfamily V, member 1 |
| KCNV2 | 169522 | NP_598004 | 5698 | potassium channel, subfamily V, member 2 |
| KCTD8 | 386617 | NP_938167.1 | 7331 | potassium channel tetramerization domain containing 8 |
| KDELR1 | 10945 | NP_006792 | 3566 | KDEL (Lys-Asp-Glu-Leu) endoplasmic reticulum protein retention receptor 1 |
| KDELR2 | 11014 | NP_001094073 | 1191 | KDEL (Lys-Asp-Glu-Leu) endoplasmic reticulum protein retention receptor 2 |
| KDELR2 | 11014 | NP_006845 | 3581 | KDEL (Lys-Asp-Glu-Leu) endoplasmic reticulum protein retention receptor 2 |

FIG. 2 (CONT.)

| Antigen | GeneID | Accession No. | SEQ ID NO: | RefSeq Gene Name |
|---|---|---|---|---|
| KDELR3 | 11015 | NP_006846 | 3582 | KDEL (Lys-Asp-Glu-Leu) endoplasmic reticulum protein retention receptor 3 |
| KDELR3 | 11015 | NP_057839 | 4266 | KDEL (Lys-Asp-Glu-Leu) endoplasmic reticulum protein retention receptor 3 |
| KDR | 3791 | NP_002244 | 2607 | kinase insert domain receptor (a type III receptor tyrosine kinase) |
| KDSR | 2531 | NP_002026 | 2536 | 3-ketodihydrosphingosine reductase |
| KEL | 3792 | NP_000411 | 124 | Kell blood group, metallo-endopeptidase |
| KIAA0040 | 9674 | NP_001156365 | 2035 | KIAA0040 |
| KIAA0040 | 9674 | NP_001156366 | 2036 | KIAA0040 |
| KIAA0040 | 9674 | NP_001156367 | 2037 | KIAA0040 |
| KIAA0040 | 9674 | NP_055471 | 3971 | KIAA0040 |
| KIAA0319 | 9856 | NP_001161846 | 2227 | KIAA0319 |
| KIAA0319 | 9856 | NP_001161847 | 2228 | KIAA0319 |
| KIAA0319 | 9856 | NP_001161848 | 2229 | KIAA0319 |
| KIAA0319 | 9856 | NP_001161849 | 2230 | KIAA0319 |
| KIAA0319 | 9856 | NP_055624 | 3993 | KIAA0319 |
| KIAA0319L | 79932 | NP_079150 | 5094 | KIAA0319-like |
| KIAA0319L | 79932 | NP_079150.3 | 6676 | KIAA0319-like |
| KIAA0754 | 643314 | NP_055853.1 | 7374 | KIAA0754 |
| KIAA1024 | 23251 | NP_056021 | 4046 | KIAA1024 |
| KIAA1109 | 84162 | NP_056127 | 4061 | KIAA1109 |
| KIAA1161 | 57462 | NP_065753 | 4704 | KIAA1161 |
| KIAA1324 | 57535 | NP_065826 | 4719 | KIAA1324 |
| KIAA1324L | 222223 | NP_001136221 | 1687 | KIAA1324-like |
| KIAA1324L | 222223 | NP_689961 | 6110 | KIAA1324-like |
| KIAA1467 | 57613 | NP_065904 | 4732 | KIAA1467 |
| KIAA1549 | 57670 | NP_001158137 | 2092 | KIAA1549 |
| KIAA1549 | 57670 | NP_065961 | 4739 | KIAA1549 |
| KIAA1549L | 25758 | NP_036326 | 3718 | chromosome 11 open reading frame 41 |
| KIAA1644 | 85352 | NP_001092764 | 1155 | KIAA1644 |
| KIAA1715 | 80856 | NP_085153 | 5154 | KIAA1715 |
| KIAA1919 | 91749 | NP_699200 | 6186 | KIAA1919 |
| KIDINS220 | 57498 | NP_065789 | 4712 | kinase D-interacting substrate, 220kDa |
| KIR2DL1 | 3802 | NP_055033.2 | 634 | killer cell immunoglobulin-like receptor, two domains, long cytoplasmic tail, 2 |
| KIR2DL1 | 3802 | NP_055033 | 3886 | killer cell immunoglobulin-like receptor, two domains, long cytoplasmic tail, 2 |
| KIR2DL1 | 3802 | NP_055034 | 3887 | killer cell immunoglobulin-like receptor, two domains, long cytoplasmic tail, 2 |
| KIR2DL3 | 3804 | NP_056952.2 | 3952 | killer cell immunoglobulin-like receptor, two domains, long cytoplasmic tail, 3 |
| KIR2DL3 | 3804 | NP_056952 | 4126 | killer cell immunoglobulin-like receptor, two domains, long cytoplasmic tail, 3 |
| KIR2DL4 | 3805 | NP_001074239 | 1040 | killer cell immunoglobulin-like receptor, two domains, long cytoplasmic tail, 4 |
| KIR2DL4 | 3805 | NP_001074241 | 1041 | killer cell immunoglobulin-like receptor, two domains, long cytoplasmic tail, 4 |
| KIR2DL4 | 3805 | NP_002246 | 2608 | killer cell immunoglobulin-like receptor, two domains, long cytoplasmic tail, 4 |
| KIR2DS4 | 3809 | NP_036444 | 3742 | killer cell immunoglobulin-like receptor, two domains, short cytoplasmic tail, 2 |
| KIR2DS4 | 3809 | NP_036446 | 3743 | killer cell immunoglobulin-like receptor, two domains, short cytoplasmic tail, 2 |
| KIR3DL2 | 3812 | NP_006728 | 3554 | killer cell immunoglobulin-like receptor, three domains, long cytoplasmic tail, 2 |
| KIRREL | 55243 | NP_060710 | 4406 | kin of IRRE like (Drosophila) |
| KIRREL2 | 84063 | NP_001316459.1 | 7463 | kin of IRRE like 2 (Drosophila) |
| KIRREL3 | 84623 | NP_001155179 | 2022 | kin of IRRE like 3 (Drosophila) |
| KIRREL3 | 84623 | NP_115920 | 5367 | kin of IRRE like 3 (Drosophila) |
| KISS1R | 84634 | NP_115940.2 | 7349 | KISS1 receptor |
| KIT | 3815 | NP_000213 | 70 | similar to Mast/stem cell growth factor receptor precursor (SCFR) (Proto-oncogene tyrosine-protein kinase Kit) (c-kit) (CD117 antigen) |
| KIT | 3815 | NP_001087241 | 1101 | similar to Mast/stem cell growth factor receptor precursor (SCFR) (Proto-oncogene tyrosine-protein kinase Kit) (c-kit) (CD117 antigen) |
| KITLG | 4254 | NP_000890 | 318 | KIT ligand |
| KITLG | 4254 | NP_003985 | 2942 | KIT ligand |
| KL | 9365 | NP_004786 | 3128 | klotho |
| KLB | 152831 | NP_783864 | 6457 | klotho beta |
| KLHDC10 | 23008 | NP_055812 | 4024 | kelch domain containing 10 |
| KLHDC7A | 127707 | NP_689588 | 6045 | kelch domain containing 7A |
| KLHL2 | 11275 | NP_001154993 | 2015 | kelch-like 2, Mayven (Drosophila) |
| KLHL2 | 11275 | NP_001154994 | 2016 | kelch-like 2, Mayven (Drosophila) |
| KLHL2 | 11275 | NP_009177 | 3659 | kelch-like 2, Mayven (Drosophila) |
| KLHL31 | 401265 | NP_001003760 | 423 | kelch-like 31 (Drosophila) |
| KLHL5 | 51088 | NP_001007076 | 505 | kelch-like 5 (Drosophila) |
| KLHL5 | 51088 | NP_001165125 | 2279 | kelch-like 5 (Drosophila) |
| KLHL5 | 51088 | NP_057074 | 4147 | kelch-like 5 (Drosophila) |
| KLHL5 | 51088 | NP_950240 | 6852 | kelch-like 5 (Drosophila) |
| KLK4 | 9622 | NP_004908 | 3167 | kallikrein-related peptidase 4 |
| KLK5 | 25818 | NP_001070959 | 971 | kallikrein-related peptidase 5 |
| KLK5 | 25818 | NP_001070960 | 972 | kallikrein-related peptidase 5 |
| KLK5 | 25818 | NP_036559 | 3773 | kallikrein-related peptidase 5 |
| KLK8 | 11202 | NP_009127 | 3646 | kallikrein-related peptidase 8 |
| KLK8 | 11202 | NP_653088 | 5858 | kallikrein-related peptidase 8 |
| KLK8 | 11202 | NP_653089 | 5859 | kallikrein-related peptidase 8 |
| KLK8 | 11202 | NP_653090 | 5860 | kallikrein-related peptidase 8 |
| KLRB1 | 3820 | NP_002249 | 2609 | killer cell lectin-like receptor subfamily B, member 1 |
| KLRC3 | 3823 | NP_002252 | 2610 | killer cell lectin-like receptor subfamily C, member 3 |
| KLRC3 | 3823 | NP_031359 | 3689 | killer cell lectin-like receptor subfamily C, member 3 |
| KLRC4 | 8302 | NP_038459 | 3820 | killer cell lectin-like receptor subfamily C, member 4 |

FIG. 2 (CONT.)

| Antigen | GeneID | Accession No. | SEQ ID NO: | RefSeq Gene Name |
|---|---|---|---|---|
| KLRD1 | 3824 | NP_001107868 | 1273 | killer cell lectin-like receptor subfamily D, member 1 |
| KLRD1 | 3824 | NP_002253 | 2611 | killer cell lectin-like receptor subfamily D, member 1 |
| KLRD1 | 3824 | NP_031360 | 3690 | killer cell lectin-like receptor subfamily D, member 1 |
| KLRF1 | 51348 | NP_057607 | 4235 | killer cell lectin-like receptor subfamily F, member 1 |
| KLRG1 | 10219 | NP_005801 | 3373 | killer cell lectin-like receptor subfamily G, member 1 |
| KMO | 8564 | NP_003670 | 2869 | kynurenine 3-monooxygenase (kynurenine 3-hydroxylase) |
| KMT2E | 55904 | NP_061152 | 4485 | myeloid/lymphoid or mixed-lineage leukemia 5 (trithoraxHomolog, Drosophila) |
| KMT2E | 55904 | NP_891847 | 6693 | myeloid/lymphoid or mixed-lineage leukemia 5 (trithoraxHomolog, Drosophila) |
| KNCN | 148930 | NP_001091080 | 1105 | kinocilin |
| KREMEN1 | 83999 | NP_001034659 | 799 | kringle containing transmembrane protein 1 |
| KREMEN1 | 83999 | NP_114434 | 5285 | kringle containing transmembrane protein 1 |
| KREMEN2 | 79412 | NP_078783 | 5036 | kringle containing transmembrane protein 2 |
| KREMEN2 | 79412 | NP_757384 | 6298 | kringle containing transmembrane protein 2 |
| KRT5 | 3852 | NP_000415 | 125 | keratin 5 |
| KRTAP19-3 | 337970 | NP_853640 | 6613 | keratin associated protein 19-3 |
| KRTCAP2 | 200185 | NP_776251 | 6395 | keratinocyte associated protein 2 |
| KRTCAP3 | 200634 | NP_001161836 | 2225 | keratinocyte associated protein 3 |
| KRTCAP3 | 200634 | NP_776252 | 6396 | keratinocyte associated protein 3 |
| L1CAM | 3897 | NP_000416 | 126 | L1 cell adhesion molecule |
| L1CAM | 3897 | NP_001137435 | 1743 | L1 cell adhesion molecule |
| L1CAM | 3897 | NP_076493 | 4990 | L1 cell adhesion molecule |
| L3MBTL2 | 83746 | NP_113676 | 5235 | l(3)mbt-like 2 (Drosophila) |
| LAG3 | 3902 | NP_002277.4 | 7384 | lymphocyte activating 3 |
| LAIR1 | 3903 | NP_002278 | 2612 | leukocyte-associated immunoglobulin-like receptor 1 |
| LAIR1 | 3903 | NP_068352 | 4818 | leukocyte-associated immunoglobulin-like receptor 1 |
| LAMP1 | 3916 | NP_005552 | 3315 | lysosomal-associated membrane protein 1 |
| LAMP2 | 3920 | NP_001116078 | 1283 | lysosomal-associated membrane protein 2 |
| LAMP2 | 3920 | NP_002285 | 2613 | lysosomal-associated membrane protein 2 |
| LAMP2 | 3920 | NP_054701 | 3851 | lysosomal-associated membrane protein 2 |
| LAMP3 | 27074 | NP_055213 | 3931 | lysosomal-associated membrane protein 3 |
| LAMP5 | 24141 | NP_036393 | 3729 | chromosome 20 open reading frame 103 |
| LAPTM4A | 9741 | NP_055528 | 3976 | lysosomal protein transmembrane 4 alpha |
| LAPTM4B | 55353 | NP_060877 | 4441 | lysosomal protein transmembrane 4 beta |
| LAPTM5 | 7805 | NP_006753 | 3558 | lysosomal multispanning membrane protein 5 |
| LARGE | 9215 | NP_004728 | 3113 | like-glycosyltransferase |
| LARGE | 9215 | NP_598397 | 5701 | like-glycosyltransferase |
| LAT | 27040 | NP_001014987.1 | 7347 | linker for activation of T-cells |
| LAX1 | 54900 | NP_001129662.1 | 7398 | lymphocyte transmembrane adaptor 1 |
| LAYN | 143903 | NP_849156 | 6568 | layilin |
| LBR | 3930 | NP_002287 | 2614 | lamin B receptor |
| LBR | 3930 | NP_919424 | 6726 | lamin B receptor |
| LCAT | 3931 | NP_000220 | 71 | lecithin-cholesterol acyltransferase |
| LCLAT1 | 253558 | NP_001002257 | 391 | lysocardiolipin acyltransferase 1 |
| LCLAT1 | 253558 | NP_872357 | 6657 | lysocardiolipin acyltransferase 1 |
| LCN10 | 414332 | NP_001001712 | 375 | lipocalin 10 |
| LCT | 3938 | NP_002290 | 2615 | lactase |
| LCTL | 197021 | NP_997221 | 7009 | lactase-like |
| LDLR | 3949 | NP_000518 | 152 | low density lipoprotein receptor |
| LDLRAD3 | 143458 | NP_001291192.1 | 7451 | low density lipoprotein receptor class A domain containing 3 |
| LDLRAD4 | 753 | NP_001003674 | 411 | chromosome 18 open reading frame 1 |
| LDLRAD4 | 753 | NP_001003675 | 412 | chromosome 18 open reading frame 1 |
| LDLRAD4 | 753 | NP_001003674.1 | 3025 | chromosome 18 open reading frame 1 |
| LDLRAD4 | 753 | NP_852146 | 6600 | chromosome 18 open reading frame 1 |
| LDLRAD4 | 753 | NP_852147 | 6601 | chromosome 18 open reading frame 1 |
| LDLRAD4 | 753 | NP_852148 | 6602 | chromosome 18 open reading frame 1 |
| LECT1 | 11061 | NP_001011705 | 590 | leukocyte cell derived chemotaxin 1 |
| LECT1 | 11061 | NP_008946 | 3615 | leukocyte cell derived chemotaxin 1 |
| LEMD1 | 93273 | NP_001001552 | 369 | LEM domain containing 1 |
| LEMD2 | 221496 | NP_001137416 | 1737 | LEM domain containing 2 |
| LEMD2 | 221496 | NP_851853 | 6593 | LEM domain containing 2 |
| LEMD3 | 23592 | NP_001161086 | 2188 | LEM domain containing 3 |
| LEMD3 | 23592 | NP_055134 | 3913 | LEM domain containing 3 |
| LEPR | 3953 | NP_001003679 | 413 | leptin receptor |
| LEPR | 3953 | NP_001003680 | 414 | leptin receptor |
| LEPR | 3953 | NP_002294 | 2616 | leptin receptor |
| LEPROT | 54741 | NP_059996 | 4301 | leptin receptor overlapping transcript |
| LEPROTL1 | 23484 | NP_001121680 | 1367 | leptin receptor overlapping transcript-like 1 |
| LEPROTL1 | 23484 | NP_056159 | 4065 | leptin receptor overlapping transcript-like 1 |
| LETM1 | 3954 | NP_036450 | 3744 | leucine zipper-EF-hand containing transmembrane protein 1 |
| LETM2 | 137994 | NP_653253 | 5884 | leucine zipper-EF-hand containing transmembrane protein 2 |
| LETMD1 | 25875 | NP_001230618.1 | 684 | LETM1 domain containing 1 |
| LETMD1 | 25875 | NP_056231 | 4079 | LETM1 domain containing 1 |
| LFNG | 3955 | NP_001035257 | 846 | LFNG O-fucosylpeptide 3-beta-N-acetylglucosaminyltransferase |
| LFNG | 3955 | NP_001035258 | 847 | LFNG O-fucosylpeptide 3-beta-N-acetylglucosaminyltransferase |
| LFNG | 3955 | NP_001159827 | 2163 | LFNG O-fucosylpeptide 3-beta-N-acetylglucosaminyltransferase |
| LFNG | 3955 | NP_002295 | 2617 | LFNG O-fucosylpeptide 3-beta-N-acetylglucosaminyltransferase |
| LGR4 | 55366 | NP_060960 | 4462 | leucine-rich repeat-containing G protein-coupled receptor 4 |

FIG. 2 (CONT.)

| Antigen | GeneID | Accession No. | SEQ ID NO: | RefSeq Gene Name |
|---|---|---|---|---|
| LGR5 | 8549 | NP_003658 | 2866 | leucine-rich repeat-containing G protein-coupled receptor 5 |
| LGR6 | 59352 | NP_001017403 | 641 | leucine-rich repeat-containing G protein-coupled receptor 6 |
| LGR6 | 59352 | NP_001017404 | 642 | leucine-rich repeat-containing G protein-coupled receptor 6 |
| LGR6 | 59352 | NP_067649 | 4813 | leucine-rich repeat-containing G protein-coupled receptor 6 |
| LHCGR | 3973 | NP_000224 | 74 | luteinizingHormone/choriogonadotropin receptor |
| LHFP | 10186 | NP_005771 | 3367 | lipomaHMGIC fusion partner |
| LHFPL1 | 340596 | NP_835469 | 6527 | lipomaHMGIC fusion partner-like 1 |
| LHFPL2 | 10184 | NP_005770 | 3366 | lipomaHMGIC fusion partner-like 2 |
| LHFPL3 | 375612 | NP_945351 | 6850 | lipomaHMGIC fusion partner-like 3 |
| LHFPL4 | 375323 | NP_940962 | 6815 | lipomaHMGIC fusion partner-like 4 |
| LHFPL5 | 222662 | NP_872354 | 6656 | lipomaHMGIC fusion partner-like 5 |
| LIFR | 3977 | NP_001121143 | 1345 | leukemia inhibitory factor receptor alpha |
| LIFR | 3977 | NP_002301 | 2618 | leukemia inhibitory factor receptor alpha |
| LILRB1 | 10859 | NP_001075106 | 1050 | leukocyte immunoglobulin-like receptor, subfamily B (with TM and ITIM domains), member 1 |
| LILRB1 | 10859 | NP_001075107 | 1051 | leukocyte immunoglobulin-like receptor, subfamily B (with TM and ITIM domains), member 1 |
| LILRB1 | 10859 | NP_001075108 | 1052 | leukocyte immunoglobulin-like receptor, subfamily B (with TM and ITIM domains), member 1 |
| LILRB1 | 10859 | NP_006660 | 3537 | leukocyte immunoglobulin-like receptor, subfamily B (with TM and ITIM domains), member 1 |
| LILRB2 | 10288 | NP_001074447 | 1044 | leukocyte immunoglobulin-like receptor, subfamily B (with TM and ITIM domains), member 2 |
| LILRB2 | 10288 | NP_005865 | 3392 | leukocyte immunoglobulin-like receptor, subfamily B (with TM and ITIM domains), member 2 |
| LILRB3 | 11025 | NP_001074919 | 1048 | leukocyte immunoglobulin-like receptor, subfamily B (with TM and ITIM domains), member 3 |
| LILRB3 | 11025 | NP_006855 | 3586 | leukocyte immunoglobulin-like receptor, subfamily B (with TM and ITIM domains), member 3 |
| LILRB4 | 11006 | NP_001265355.2 | 1045 | leukocyte immunoglobulin-like receptor, subfamily B (with TM and ITIM domains), member 4 |
| LILRB4 | 11006 | NP_001265355.2 | 3579 | leukocyte immunoglobulin-like receptor, subfamily B (with TM and ITIM domains), member 4 |
| LILRB5 | 10990 | NP_001074911 | 1046 | leukocyte immunoglobulin-like receptor, subfamily B (with TM and ITIM domains), member 5 |
| LILRB5 | 10990 | NP_001074912 | 1047 | leukocyte immunoglobulin-like receptor, subfamily B (with TM and ITIM domains), member 5 |
| LILRB5 | 10990 | NP_006831 | 3576 | leukocyte immunoglobulin-like receptor, subfamily B (with TM and ITIM domains), member 5 |
| LIM2 | 3982 | NP_001155220 | 2026 | lens intrinsic membrane protein 2, 19kDa |
| LIM2 | 3982 | NP_085915 | 5156 | lens intrinsic membrane protein 2, 19kDa |
| LINGO1 | 84894 | NP_116197 | 5406 | leucine rich repeat and Ig domain containing 1 |
| LINGO2 | 158038 | NP_689783 | 6082 | leucine rich repeat and Ig domain containing 2 |
| LINGO3 | 645191 | NP_001094861 | 1202 | leucine rich repeat and Ig domain containing 3 |
| LITAF | 9516 | NP_001129944.1 | 7399 | lipopolysaccharide induced TNF factor |
| LMAN2 | 10960 | NP_006807 | 3571 | lectin, mannose-binding 2 |
| LMAN2L | 81562 | NP_001135764 | 1635 | lectin, mannose-binding 2-like |
| LMAN2L | 81562 | NP_110432 | 5180 | lectin, mannose-binding 2-like |
| LMBR1 | 64327 | NP_071903 | 4920 | limb region 1Homolog (mouse) |
| LMBR1L | 55716 | NP_060583 | 4395 | limb region 1Homolog (mouse)-like |
| LMBRD1 | 55788 | NP_060838.3 | 7414 | LMBR1 domain containing 1 |
| LMBRD2 | 92255 | NP_001007528 | 521 | LMBR1 domain containing 2 |
| LMF1 | 64788 | NP_073610 | 4945 | lipase maturation factor 1 |
| LMF2 | 91289 | NP_149977 | 5468 | lipase maturation factor 2 |
| LMLN | 89782 | NP_001129521 | 1594 | leishmanolysin-like (metallopeptidase M8 family) |
| LMLN | 89782 | NP_149018 | 5440 | leishmanolysin-like (metallopeptidase M8 family) |
| LMO7 | 4008 | NP_005349 | 3276 | LIM domain 7 |
| LMO7 | 4008 | NP_056667 | 4123 | LIM domain 7 |
| LMTK2 | 22853 | NP_055731 | 4011 | lemur tyrosine kinase 2 |
| LMTK3 | 114783 | NP_001073903 | 1022 | lemur tyrosine kinase 3 |
| LNPEP | 4012 | NP_005566 | 3316 | leucyl/cystinyl aminopeptidase |
| LNPEP | 4012 | NP_787116 | 6470 | leucyl/cystinyl aminopeptidase |
| LPAR1 | 1902 | NP_001392 | 2361 | lysophosphatidic acid receptor 1 |
| LPAR1 | 1902 | NP_476500 | 5577 | lysophosphatidic acid receptor 1 |
| LPAR2 | 9170 | NP_004711.2 | 7283 | lysophosphatidic acid receptor 2 |
| LPAR3 | 23566 | NP_036284 | 3714 | lysophosphatidic acid receptor 3 |
| LPAR4 | 2846 | NP_005287 | 3262 | lysophosphatidic acid receptor 4 |
| LPAR5 | 57121 | NP_001136433 | 1709 | lysophosphatidic acid receptor 5 |
| LPAR5 | 57121 | NP_065133 | 4646 | lysophosphatidic acid receptor 5 |
| LPAR6 | 10161 | NP_001155969 | 2030 | purinergic receptor P2Y, G-protein coupled, 5 |
| LPAR6 | 10161 | NP_001155970 | 2031 | purinergic receptor P2Y, G-protein coupled, 5 |
| LPAR6 | 10161 | NP_005758 | 3361 | purinergic receptor P2Y, G-protein coupled, 5 |
| LPCAT1 | 79888 | NP_079106 | 5089 | lysophosphatidylcholine acyltransferase 1 |
| LPCAT2 | 54947 | NP_060309 | 4354 | lysophosphatidylcholine acyltransferase 2 |
| LPCAT3 | 10162 | NP_005759 | 3362 | lysophosphatidylcholine acyltransferase 3 |
| LPCAT4 | 254531 | NP_705841 | 6203 | lysophosphatidylcholine acyltransferase 4 |
| LPGAT1 | 9926 | NP_055688 | 4003 | lysophosphatidylglycerol acyltransferase 1 |
| LPPR1 | 54886 | NP_060223 | 4336 | plasticity related gene 3 |
| LPPR1 | 54886 | NP_997182 | 7003 | plasticity related gene 3 |
| LPPR2 | 64748 | NP_001164106 | 2250 | lipid phosphate phosphatase-related protein type 2 |
| LPPR2 | 64748 | NP_073574 | 4939 | lipid phosphate phosphatase-related protein type 2 |
| LPPR3 | 79948 | NP_079164 | 5096 | plasticity-related gene 2 |
| LPPR4 | 9890 | NP_001159724 | 2156 | plasticity related gene 1 |
| LPPR4 | 9890 | NP_055654 | 3996 | plasticity related gene 1 |
| LPPR5 | 163404 | NP_001010861 | 570 | phosphatidic acid phosphatase type 2 |
| LPPR5 | 163404 | NP_001032394 | 773 | phosphatidic acid phosphatase type 2 |
| LRCH1 | 23143 | NP_001157683 | 2067 | leucine-rich repeats and calponinHomology (CH) domain containing 1 |
| LRCH1 | 23143 | NP_001157685 | 2068 | leucine-rich repeats and calponinHomology (CH) domain containing 1 |
| LRCH1 | 23143 | NP_055931 | 4035 | leucine-rich repeats and calponinHomology (CH) domain containing 1 |
| LRCH3 | 84859 | NP_116162 | 5397 | leucine-rich repeats and calponinHomology (CH) domain containing 3 |

FIG. 2 (CONT.)

| Antigen | GeneID | Accession No. | SEQ ID NO: | RefSeq Gene Name |
|---|---|---|---|---|
| LRFN1 | 57622 | NP_065913 | 4735 | leucine rich repeat and fibronectin type III domain containing 1 |
| LRFN2 | 57497 | NP_065788 | 4711 | leucine rich repeat and fibronectin type III domain containing 2 |
| LRFN3 | 79414 | NP_078785 | 5037 | leucine rich repeat and fibronectin type III domain containing 3 |
| LRFN4 | 78999 | NP_076941 | 4999 | leucine rich repeat and fibronectin type III domain containing 4 |
| LRFN5 | 145581 | NP_689660 | 6060 | leucine rich repeat and fibronectin type III domain containing 5 |
| LRIG1 | 26018 | NP_056356 | 4097 | leucine rich repeats and immunoglobulin-like domains 1 |
| LRIG2 | 9860 | NP_001299615.1 | 7456 | leucine rich repeats and immunoglobulin like domains 2 |
| LRIG3 | 121227 | NP_001129523 | 1595 | leucine-rich repeats and immunoglobulin-like domains 3 |
| LRIG3 | 121227 | NP_700356 | 6188 | leucine-rich repeats and immunoglobulin-like domains 3 |
| LRIT1 | 26103 | NP_056428 | 4107 | leucine-rich repeat, immunoglobulin-like and transmembrane domains 1 |
| LRMP | 4033 | NP_006143 | 3447 | lymphoid-restricted membrane protein |
| LRP1 | 4035 | NP_002323 | 2619 | low density lipoprotein-related protein 1 (alpha-2-macroglobulin receptor) |
| LRP10 | 26020 | NP_054764 | 3862 | low density lipoprotein receptor-related protein 10 |
| LRP11 | 84918 | NP_116221 | 5414 | low density lipoprotein receptor-related protein 11 |
| LRP12 | 29967 | NP_001129175 | 1555 | low density lipoprotein-related protein 12 |
| LRP12 | 29967 | NP_038465 | 3822 | low density lipoprotein-related protein 12 |
| LRP1B | 53353 | NP_061027 | 4467 | low density lipoprotein-related protein 1B (deleted in tumors) |
| LRP2 | 4036 | NP_004516 | 3069 | low density lipoprotein-related protein 2 |
| LRP3 | 4037 | NP_002324 | 2620 | low density lipoprotein receptor-related protein 3 |
| LRP4 | 4038 | NP_002325 | 2621 | low density lipoprotein receptor-related protein 4 |
| LRP5 | 4041 | NP_002326 | 2622 | low density lipoprotein receptor-related protein 5 |
| LRP8 | 7804 | NP_001018064 | 664 | low density lipoprotein receptor-related protein 8, apolipoprotein e receptor |
| LRP8 | 7804 | NP_004622 | 3092 | low density lipoprotein receptor-related protein 8, apolipoprotein e receptor |
| LRP8 | 7804 | NP_059992 | 4300 | low density lipoprotein receptor-related protein 8, apolipoprotein e receptor |
| LRP8 | 7804 | NP_150643 | 5482 | low density lipoprotein receptor-related protein 8, apolipoprotein e receptor |
| LRPAP1 | 4043 | NP_002328 | 2623 | low density lipoprotein receptor-related protein associated protein 1 |
| LRRC15 | 131578 | NP_001128529 | 1517 | leucine rich repeat containing 15 |
| LRRC15 | 131578 | NP_570843 | 5668 | leucine rich repeat containing 15 |
| LRRC19 | 64922 | NP_075052 | 4959 | leucine rich repeat containing 19 |
| LRRC25 | 126364 | NP_660299 | 5943 | leucine rich repeat containing 25 |
| LRRC3 | 81543 | NP_112153 | 5186 | leucine rich repeat containing 3 |
| LRRC32 | 2615 | NP_001122394 | 1379 | leucine rich repeat containing 32 |
| LRRC32 | 2615 | NP_005503 | 3303 | leucine rich repeat containing 32 |
| LRRC37A3 | 374819 | NP_955372 | 6878 | leucine rich repeat containing 37, member A3 |
| LRRC37B | 114659 | NP_443120 | 5528 | similar to HCG1991475 leucine rich repeat containing 37B |
| LRRC3B | 116135 | NP_443185 | 5548 | leucine rich repeat containing 3B |
| LRRC4 | 64101 | NP_071426 | 4884 | leucine rich repeat containing 4 |
| LRRC4B | 94030 | NP_001073926 | 1026 | leucine rich repeat containing 4B |
| LRRC4C | 57689 | NP_065980 | 4742 | leucine rich repeat containing 4C |
| LRRC52 | 440699 | NP_001005214 | 449 | leucine rich repeat containing 52 |
| LRRC55 | 219527 | NP_001005210 | 448 | leucine rich repeat containing 55 |
| LRRC59 | 55379 | NP_060979 | 4463 | leucine rich repeat containing 59 |
| LRRC66 | 339977 | NP_001019782 | 679 | leucine rich repeat containing 66 |
| LRRC70 | 100130733 | NP_852607 | 6604 | leucine rich repeat containing 70 |
| LRRC8A | 56262 | NP_001120716 | 1315 | leucine rich repeat containing 8 family, member A |
| LRRC8A | 56262 | NP_001120717 | 1316 | leucine rich repeat containing 8 family, member A |
| LRRC8A | 56262 | NP_062540 | 4572 | leucine rich repeat containing 8 family, member A |
| LRRC8B | 23507 | NP_001127948 | 1497 | leucine rich repeat containing 8 family, member B |
| LRRC8B | 23507 | NP_056165 | 4067 | leucine rich repeat containing 8 family, member B |
| LRRC8C | 84230 | NP_115646 | 5315 | leucine rich repeat containing 8 family, member C |
| LRRC8D | 55144 | NP_001127951 | 1499 | leucine rich repeat containing 8 family, member D |
| LRRC8D | 55144 | NP_060573 | 4392 | leucine rich repeat containing 8 family, member D |
| LRRC8E | 80131 | NP_079337 | 5115 | leucine rich repeat containing 8 family, member E |
| LRRN1 | 57633 | NP_065924 | 4737 | leucine rich repeat neuronal 1 |
| LRRN2 | 10446 | NP_006329 | 3470 | leucine rich repeat neuronal 2 |
| LRRN2 | 10446 | NP_963924 | 6916 | leucine rich repeat neuronal 2 |
| LRRN3 | 54674 | NP_001093128 | 1165 | leucine rich repeat neuronal 3 |
| LRRN3 | 54674 | NP_001093130 | 1166 | leucine rich repeat neuronal 3 |
| LRRN3 | 54674 | NP_060804 | 4423 | leucine rich repeat neuronal 3 |
| LRRN4 | 164312 | NP_689824 | 6089 | leucine rich repeat neuronal 4 |
| LRRN4CL | 221091 | NP_981967 | 6935 | LRRN4 C-terminal like |
| LRRTM1 | 347730 | NP_849161 | 6570 | leucine rich repeat transmembrane neuronal 1 |
| LRRTM2 | 26045 | NP_056379 | 4102 | leucine rich repeat transmembrane neuronal 2 |
| LRRTM3 | 347731 | NP_821079.3 | 7362 | leucine rich repeat transmembrane neuronal 3 |
| LRRTM4 | 80059 | NP_001128217 | 1505 | leucine rich repeat transmembrane neuronal 4 |
| LRRTM4 | 80059 | NP_079269 | 5113 | leucine rich repeat transmembrane neuronal 4 |
| LRTM1 | 57408 | NP_065729 | 4697 | leucine-rich repeats and transmembrane domains 1 |
| LRTM2 | 654429 | NP_001034118 | 786 | leucine-rich repeats and transmembrane domains 2 |
| LRTM2 | 654429 | NP_001157397 | 2060 | leucine-rich repeats and transmembrane domains 2 |
| LRTM2 | 654429 | NP_001157398 | 2061 | leucine-rich repeats and transmembrane domains 2 |
| LRTOMT | 220074 | NP_001138779 | 1849 | leucine rich transmembrane and 0-methyltransferase domain containing |
| LRTOMT | 220074 | NP_001138780 | 1850 | leucine rich transmembrane and 0-methyltransferase domain containing |
| LRTOMT | 220074 | NP_001138781 | 1851 | leucine rich transmembrane and 0-methyltransferase domain containing |
| LRTOMT | 220074 | NP_001138782 | 1852 | leucine rich transmembrane and 0-methyltransferase domain containing |
| LRTOMT | 220074 | NP_660352 | 5960 | leucine rich transmembrane and 0-methyltransferase domain containing |
| LSAMP | 4045 | NP_002329 | 2624 | limbic system-associated membrane protein |
| LSMEM1 | 286006 | NP_001127940 | 1496 | chromosome 7 open reading frame 53 |

FIG. 2 (CONT.)

| Antigen | GeneID | Accession No. | SEQ ID NO: | RefSeq Gene Name |
|---|---|---|---|---|
| LSMEM1 | 286006 | NP_872403 | 6665 | chromosome 7 open reading frame 53 |
| LSMEM2 | 132228 | NP_694947 | 6160 | chromosome 3 open reading frame 45 |
| LSR | 51599 | NP_057009 | 4137 | lipolysis stimulated lipoprotein receptor |
| LSR | 51599 | NP_991403 | 6950 | lipolysis stimulated lipoprotein receptor |
| LSR | 51599 | NP_991404 | 6951 | lipolysis stimulated lipoprotein receptor |
| LST1 | 7940 | NP_001160010 | 2173 | leukocyte specific transcript 1 |
| LST1 | 7940 | NP_009092 | 3637 | leukocyte specific transcript 1 |
| LST1 | 7940 | NP_995309 | 6952 | leukocyte specific transcript 1 |
| LST1 | 7940 | NP_995310 | 6953 | leukocyte specific transcript 1 |
| LST1 | 7940 | NP_995311 | 6954 | leukocyte specific transcript 1 |
| LST1 | 7940 | NP_995312 | 6955 | leukocyte specific transcript 1 |
| LTA | 4049 | NP_000586 | 170 | lymphotoxin alpha (TNF superfamily, member 1) |
| LTA | 4049 | NP_001153212 | 1958 | lymphotoxin alpha (TNF superfamily, member 1) |
| LTB | 4050 | NP_002332 | 2625 | lymphotoxin beta (TNF superfamily, member 3) |
| LTB | 4050 | NP_033666 | 3694 | lymphotoxin beta (TNF superfamily, member 3) |
| LTB4R | 1241 | NP_001137391 | 1736 | leukotriene B4 receptor |
| LTB4R | 1241 | NP_858043 | 6619 | leukotriene B4 receptor |
| LTB4R2 | 56413 | NP_001158164 | 2096 | leukotriene B4 receptor 2 |
| LTB4R2 | 56413 | NP_001158164.1 | 2097 | leukotriene B4 receptor 2 |
| LTB4R2 | 56413 | NP_062813 | 4580 | leukotriene B4 receptor 2 |
| LTBP3 | 4054 | NP_001123616 | 1421 | latent transforming growth factor beta binding protein 3 |
| LTBP3 | 4054 | NP_001157738 | 2072 | latent transforming growth factor beta binding protein 3 |
| LTBP3 | 4054 | NP_066548 | 4761 | latent transforming growth factor beta binding protein 3 |
| LTBR | 4055 | NP_002333 | 2626 | lymphotoxin beta receptor (TNFR superfamily, member 3) |
| LTC4S | 4056 | NP_665874 | 5985 | leukotriene C4 synthase |
| LTF | 4057 | NP_002334 | 2627 | lactotransferrin |
| LTK | 4058 | NP_001129157 | 1552 | leukocyte receptor tyrosine kinase |
| LTK | 4058 | NP_002335 | 2628 | leukocyte receptor tyrosine kinase |
| LTK | 4058 | NP_996844 | 6992 | leukocyte receptor tyrosine kinase |
| LVRN | 206338 | NP_776161 | 6386 | laeverin |
| LY6D | 8581 | NP_003686 | 2870 | lymphocyte antigen 6 complex, locus D |
| LY6G5C | 80741 | NP_079538 | 5145 | lymphocyte antigen 6 complex, locus G5C |
| LY6G6C | 80740 | NP_079537 | 5144 | lymphocyte antigen 6 complex, locus G6C |
| LY6G6D | 58530 | NP_067069.2 | 417 | lymphocyte antigen 6 complex, locus G6F |
| LY6G6D | 58530 | NP_067069 | 4802 | lymphocyte antigen 6 complex, locus G6F |
| LY6G6F | 259215 | NP_001003693 | 416 | lymphocyte antigen 6 complex, locus G6F |
| LY6G6F | 259215 | NP_001003693.1 | 4801 | lymphocyte antigen 6 complex, locus G6F |
| LY6K | 54742 | NP_001153826 | 1992 | lymphocyte antigen 6 complex, locus K |
| LY6K | 54742 | NP_001153827 | 1993 | lymphocyte antigen 6 complex, locus K |
| LY6K | 54742 | NP_059997 | 4302 | lymphocyte antigen 6 complex, locus K |
| LY75 | 4065 | NP_002340 | 2630 | CD302 molecule lymphocyte antigen 75 |
| LY75 | 4065 | NP_055695 | 4007 | CD302 molecule lymphocyte antigen 75 |
| LY9 | 4063 | NP_001028839 | 755 | lymphocyte antigen 9 |
| LY9 | 4063 | NP_002339 | 2629 | lymphocyte antigen 9 |
| LYPD1 | 116372 | NP_001070895 | 970 | LY6/PLAUR domain containing 1 |
| LYPD1 | 116372 | NP_653187 | 5869 | LY6/PLAUR domain containing 1 |
| LYPD6B | 130576 | NP_808879 | 6509 | LY6/PLAUR domain containing 6B |
| LYPLA1 | 10434 | NP_006321 | 3468 | lysophospholipase I |
| LYSMD3 | 116068 | NP_938014 | 6764 | LysM, putative peptidoglycan-binding, domain containing 3 |
| LYSMD4 | 145748 | NP_689662 | 6061 | LysM, putative peptidoglycan-binding, domain containing 4 |
| LYVE1 | 10894 | NP_006682 | 3547 | lymphatic vessel endothelialHyaluronan receptor 1 |
| M6PR | 4074 | NP_002346 | 2633 | mannose-6-phosphate receptor (cation dependent) |
| MACF1 | 23499 | NP_036222 | 3702 | microtubule-actin crosslinking factor 1 |
| MACF1 | 23499 | NP_036222.3 | 5441 | microtubule-actin crosslinking factor 1 |
| MADCAM1 | 8174 | NP_570116 | 5660 | mucosal vascular addressin cell adhesion molecule 1 |
| MADCAM1 | 8174 | NP_570118 | 5661 | mucosal vascular addressin cell adhesion molecule 1 |
| MAG | 4099 | NP_002352 | 2634 | myelin associated glycoprotein |
| MAG | 4099 | NP_542167 | 5609 | myelin associated glycoprotein |
| MAGEA1 | 4100 | NP_004979 | 3191 | melanoma antigen family A, 1 (directs expression of antigen MZ2-E) |
| MAGEA11 | 4110 | NP_001011544.1 | 7346 | MAGE family member A11 |
| MAGEA3 | 4102 | NP_005353.1 | 7279 | MAGE family member A3 |
| MAGEA4 | 4103 | NP_001011548.1 | 7341 | MAGE family member A4 |
| MAGEH1 | 28986 | NP_054780 | 3867 | melanoma antigen familyH, 1 |
| MAL | 4118 | NP_002362 | 2635 | mal, T-cell differentiation protein |
| MAL | 4118 | NP_071883 | 4914 | mal, T-cell differentiation protein |
| MAL | 4118 | NP_071884 | 4915 | mal, T-cell differentiation protein |
| MAL | 4118 | NP_071885 | 4916 | mal, T-cell differentiation protein |
| MAL2 | 114569 | NP_443118 | 5527 | mal, T-cell differentiation protein 2 |
| MALRD1 | 340895 | XP_001716895 | 7055 | chromosome 10 open reading frame 112 |
| MALRD1 | 340895 | XP_295865 | 7087 | chromosome 10 open reading frame 112 |
| MALRD1 | 340895 | XP_944452 | 7093 | chromosome 10 open reading frame 112 |
| MAMDC4 | 158056 | NP_996803 | 6981 | MAM domain containing 4 |
| MAN1A1 | 4121 | NP_005898 | 3397 | mannosidase, alpha, class 1A, member 1 |
| MAN1A2 | 10905 | NP_006690 | 3550 | mannosidase, alpha, class 1A, member 2 |
| MAN1B1 | 11253 | NP_057303 | 4185 | mannosidase, alpha, class 1B, member 1 |
| MAN1C1 | 57134 | NP_065112 | 4641 | mannosidase, alpha, class 1C, member 1 |
| MAN2A1 | 4124 | NP_002363 | 2636 | mannosidase, alpha, class 2A, member 1 |

FIG. 2 (CONT.)

| Antigen | GeneID | Accession No. | SEQ ID NO: | RefSeq Gene Name |
|---|---|---|---|---|
| MAN2A2 | 4122 | NP_006113 | 3438 | mannosidase, alpha, class 2A, member 2 |
| MANBAL | 63905 | NP_001003897 | 425 | mannosidase, beta A, lysosomal-like similar to mannosidase, beta A, lysosomal-like |
| MANBAL | 63905 | NP_071360 | 4873 | mannosidase, beta A, lysosomal-like similar to mannosidase, beta A, lysosomal-like |
| MANEA | 79694 | NP_078917 | 5062 | mannosidase, endo-alpha |
| MANEAL | 149175 | NP_001026910 | 732 | mannosidase, endo-alpha-like |
| MANEAL | 149175 | NP_001106954 | 1258 | mannosidase, endo-alpha-like |
| MANEAL | 149175 | NP_689709 | 6072 | mannosidase, endo-alpha-like |
| MANSC1 | 54682 | NP_060520 | 4384 | MANSC domain containing 1 |
| MAOB | 4129 | NP_000889 | 317 | monoamine oxidase B |
| MARC1 | 64757 | NP_073583 | 4942 | MOCO sulphurase C-terminal domain containing 1 |
| MARCH11 | 441061 | NP_001096032 | 1209 | membrane-associated ring finger (C3HC4) 11 |
| MARCH2 | 54996 | NP_060368 | 4366 | MOCO sulphurase C-terminal domain containing 2 |
| MARCH4 | 57574 | NP_065865 | 4726 | membrane-associated ring finger (C3HC4) 4 |
| MARCH5 | 54708 | NP_060294 | 4350 | membrane-associated ring finger (C3HC4) 5 |
| MARCH6 | 10299 | NP_005876 | 3393 | membrane-associated ring finger (C3HC4) 6 |
| MARCH6 | 115123 | NP_848545 | 6541 | membrane-associated ring finger (C3HC4) 3 |
| MARCH8 | 220972 | NP_001002265 | 396 | membrane-associated ring finger (C3HC4) 8 |
| MARCH8 | 220972 | NP_001002266 | 397 | membrane-associated ring finger (C3HC4) 8 |
| MARCH8 | 220972 | NP_659458 | 5918 | membrane-associated ring finger (C3HC4) 8 |
| MARCH9 | 92979 | NP_612405 | 5743 | membrane-associated ring finger (C3HC4) 9 |
| MARCO | 8685 | NP_006761 | 3560 | macrophage receptor with collagenous structure |
| MARS | 4141 | NP_004981 | 3192 | methionyl-tRNA synthetase |
| MARVELD1 | 83742 | NP_113672 | 5234 | hypothetical LOC100270710 MARVEL domain containing 1 |
| MARVELD2 | 153562 | NP_001033692 | 783 | MARVEL domain containing 2 |
| MARVELD2 | 153562 | NP_001033692.2 | 5900 | MARVEL domain containing 2 |
| MARVELD3 | 91862 | NP_001017967 | 653 | MARVEL domain containing 3 |
| MARVELD3 | 91862 | NP_443090 | 5518 | MARVEL domain containing 3 |
| MAS1 | 4142 | NP_002368 | 2637 | MAS1 oncogene |
| MAS1L | 116511 | NP_443199 | 5553 | MAS1 oncogene-like |
| MAVS | 57506 | NP_065797 | 4714 | mitochondrial antiviral signaling protein |
| MBOAT1 | 154141 | NP_001073949 | 1030 | membrane bound O-acyltransferase domain containing 1 |
| MBOAT2 | 129642 | NP_620154 | 5798 | membrane bound O-acyltransferase domain containing 2 |
| MBOAT7 | 79143 | NP_001139528 | 1900 | membrane bound O-acyltransferase domain containing 7 |
| MBOAT7 | 79143 | NP_001139554 | 1905 | membrane bound O-acyltransferase domain containing 7 |
| MBOAT7 | 79143 | NP_001139555 | 1906 | membrane bound O-acyltransferase domain containing 7 |
| MBOAT7 | 79143 | NP_077274 | 5017 | membrane bound O-acyltransferase domain containing 7 |
| MBTPS2 | 51360 | NP_056968 | 4128 | membrane-bound transcription factor peptidase, site 2 |
| MC1R | 4157 | NP_002377 | 2638 | tubulin, beta 3 melanocortin 1 receptor (alpha melanocyte stimulatingHormone receptor) |
| MC1R | 4157 | NP_006077 | 3431 | tubulin, beta 3 melanocortin 1 receptor (alpha melanocyte stimulatingHormone receptor) |
| MC2R | 4158 | NP_000520 | 153 | melanocortin 2 receptor (adrenocorticotropicHormone) |
| MC3R | 4159 | NP_063941.3 | 7386 | melanocortin 3 receptor |
| MC4R | 4160 | NP_005903 | 3398 | melanocortin 4 receptor |
| MC5R | 4161 | NP_005904 | 3399 | melanocortin 5 receptor |
| MCAM | 4162 | NP_006491 | 3500 | melanoma cell adhesion molecule |
| MCEMP1 | 199675 | NP_777578 | 6409 | chromosome 19 open reading frame 59 |
| MCHR1 | 2847 | NP_005288 | 3263 | melanin-concentratingHormone receptor 1 |
| MCHR2 | 84539 | NP_001035269 | 853 | melanin-concentratingHormone receptor 2 |
| MCHR2 | 84539 | NP_115892 | 5363 | melanin-concentratingHormone receptor 2 |
| MCL1 | 4170 | NP_068779 | 4856 | myeloid cell leukemia sequence 1 (BCL2-related) |
| MCL1 | 4170 | NP_877495 | 6681 | myeloid cell leukemia sequence 1 (BCL2-related) |
| MCOLN1 | 57192 | NP_065394 | 4681 | mucolipin 1 |
| MCOLN2 | 255231 | NP_694991 | 6167 | mucolipin 2 |
| MCOLN3 | 55283 | NP_060768 | 4417 | mucolipin 3 |
| MCTP1 | 79772 | NP_001002796 | 404 | multiple C2 domains, transmembrane 1 |
| MCTP1 | 79772 | NP_078993 | 5070 | multiple C2 domains, transmembrane 1 |
| MCTP2 | 55784 | NP_001153115 | 1949 | multiple C2 domains, transmembrane 2 |
| MCTP2 | 55784 | NP_001153116 | 1950 | multiple C2 domains, transmembrane 2 |
| MCTP2 | 55784 | NP_060819 | 4427 | multiple C2 domains, transmembrane 2 |
| MCU | 90550 | NP_612366 | 5733 | coiled-coil domain containing 109A |
| MCUR1 | 63933 | NP_001026883 | 726 | coiled-coil domain containing 90A |
| MDGA2 | 161357 | NP_001106970 | 1259 | MAM domain containing glycosylphosphatidylinositol anchor 2 |
| MDGA2 | 161357 | NP_878250 | 6687 | MAM domain containing glycosylphosphatidylinositol anchor 2 |
| MDM1 | 56890 | NP_059136 | 4292 | Mdm1 nuclear proteinHomolog (mouse) |
| MDM1 | 56890 | NP_064513 | 4600 | Mdm1 nuclear proteinHomolog (mouse) |
| MEGF10 | 84466 | NP_115822 | 5355 | multiple EGF-like-domains 10 |
| MEGF11 | 84465 | NP_115821 | 5354 | multiple EGF-like-domains 11 |
| MEGF6 | 1953 | NP_001400 | 2366 | multiple EGF-like-domains 6 |
| MEGF8 | 1954 | NP_001401 | 2367 | multiple EGF-like-domains 8 |
| MEGF9 | 1955 | NP_001073966 | 1031 | multiple EGF-like-domains 9 |
| MEP1A | 4224 | NP_005579 | 3319 | meprin A, alpha (PABA peptideHydrolase) |
| MEP1B | 4225 | NP_005916 | 3400 | meprin A, beta |
| MERTK | 10461 | NP_006334 | 3471 | c-mer proto-oncogene tyrosine kinase |
| MET | 4233 | NP_000236 | 76 | met proto-oncogene (hepatocyte growth factor receptor) |
| MET | 4233 | NP_001120972 | 1332 | met proto-oncogene (hepatocyte growth factor receptor) |
| METTL21A | 151194 | NP_001120867 | 1325 | family with sequence similarity 119, member A |
| METTL21A | 151194 | NP_660323 | 5951 | family with sequence similarity 119, member A |
| METTL7A | 25840 | NP_054752 | 3858 | methyltransferase like 7A |

FIG. 2 (CONT.)

| Antigen | GeneID | Accession No. | SEQ ID NO: | RefSeq Gene Name |
|---|---|---|---|---|
| METTL7B | 196410 | NP_689850 | 6091 | methyltransferase like 7B |
| MFAP3 | 4238 | NP_001128509 | 1514 | microfibrillar-associated protein 3 |
| MFAP3 | 4238 | NP_005918 | 3401 | microfibrillar-associated protein 3 |
| MFAP3L | 9848 | NP_001009554 | 561 | microfibrillar-associated protein 3-like |
| MFAP3L | 9848 | NP_067679 | 4816 | microfibrillar-associated protein 3-like |
| MFF | 56947 | NP_064579 | 4615 | mitochondrial fission factor |
| MFN2 | 9927 | NP_001121132 | 1341 | mitofusin 2 |
| MFN2 | 9927 | NP_055689 | 4004 | mitofusin 2 |
| MFSD1 | 64747 | NP_001161375 | 2203 | major facilitator superfamily domain containing 1 |
| MFSD1 | 64747 | NP_073573 | 4938 | major facilitator superfamily domain containing 1 |
| MFSD10 | 10227 | NP_001111 | 1280 | major facilitator superfamily domain containing 10 |
| MFSD10 | 10227 | NP_001139541 | 1901 | major facilitator superfamily domain containing 10 |
| MFSD11 | 79157 | NP_077287 | 5022 | major facilitator superfamily domain containing 11 |
| MFSD12 | 126321 | NP_001274458.1 | 915 | chromosome 19 open reading frame 28 |
| MFSD12 | 126321 | NP_001274458.1 | 4823 | chromosome 19 open reading frame 28 |
| MFSD12 | 126321 | NP_778148 | 6434 | chromosome 19 open reading frame 28 |
| MFSD2A | 84879 | NP_001129965 | 1606 | major facilitator superfamily domain containing 2 |
| MFSD2A | 84879 | NP_116182 | 5402 | major facilitator superfamily domain containing 2 |
| MFSD3 | 113655 | NP_612440 | 5750 | major facilitator superfamily domain containing 3 |
| MFSD4 | 148808 | NP_857595 | 6617 | major facilitator superfamily domain containing 4 |
| MFSD5 | 84975 | NP_001164261.1 | 7415 | major facilitator superfamily domain containing 5 |
| MFSD6 | 54842 | NP_060164 | 4324 | major facilitator superfamily domain containing 6 |
| MFSD6L | 162387 | NP_689812 | 6087 | major facilitator superfamily domain containing 6-like |
| MFSD7 | 84179 | NP_115595 | 5308 | major facilitator superfamily domain containing 7 |
| MFSD8 | 256471 | NP_689991 | 6115 | major facilitator superfamily domain containing 8 |
| MFSD9 | 84804 | NP_116107 | 5389 | major facilitator superfamily domain containing 9 |
| MGAM | 8972 | NP_004659 | 3099 | maltase-glucoamylase (alpha-glucosidase) |
| MGAM2 | 93432 | NP_001280555 | 7117 | maltase-glucoamylase 2 (putative) |
| MGARP | 84709 | NP_116012 | 5380 | chromosome 4 open reading frame 49 |
| MGAT1 | 4245 | NP_001108089 | 1274 | mannosyl (alpha-1,3-)-glycoprotein beta-1,2-N-acetylglucosaminyltransferase |
| MGAT1 | 4245 | NP_001108090 | 1275 | mannosyl (alpha-1,3-)-glycoprotein beta-1,2-N-acetylglucosaminyltransferase |
| MGAT1 | 4245 | NP_001108091 | 1276 | mannosyl (alpha-1,3-)-glycoprotein beta-1,2-N-acetylglucosaminyltransferase |
| MGAT1 | 4245 | NP_001108092 | 1277 | mannosyl (alpha-1,3-)-glycoprotein beta-1,2-N-acetylglucosaminyltransferase |
| MGAT1 | 4245 | NP_002397 | 2642 | mannosyl (alpha-1,3-)-glycoprotein beta-1,2-N-acetylglucosaminyltransferase |
| MGAT2 | 4247 | NP_002399 | 2643 | mannosyl (alpha-1,6-)-glycoprotein beta-1,2-N-acetylglucosaminyltransferase |
| MGAT3 | 4248 | NP_001091740 | 1122 | mannosyl (beta-1,4-)-glycoprotein beta-1,4-N-acetylglucosaminyltransferase |
| MGAT3 | 4248 | NP_002400 | 2644 | mannosyl (beta-1,4-)-glycoprotein beta-1,4-N-acetylglucosaminyltransferase |
| MGAT4A | 11320 | NP_001153626 | 1976 | mannosyl (alpha-1,3-)-glycoprotein beta-1,4-N-acetylglucosaminyltransferase, isozyme A |
| MGAT4A | 11320 | NP_036346 | 3723 | mannosyl (alpha-1,3-)-glycoprotein beta-1,4-N-acetylglucosaminyltransferase, isozyme A |
| MGAT4B | 11282 | NP_055090 | 3906 | mannosyl (alpha-1,3-)-glycoprotein beta-1,4-N-acetylglucosaminyltransferase, isozyme B |
| MGAT4B | 11282 | NP_463459 | 5562 | mannosyl (alpha-1,3-)-glycoprotein beta-1,4-N-acetylglucosaminyltransferase, isozyme B |
| MGAT4D | 152586 | XP_001720251 | 7068 | similar to RIKEN cDNA 4933434I20 |
| MGAT4D | 152586 | XP_001720300 | 7069 | similar to RIKEN cDNA 4933434I20 |
| MGAT4D | 152586 | XP_001725525 | 7074 | similar to RIKEN cDNA 4933434I20 |
| MGAT5 | 4249 | NP_002401 | 2645 | mannosyl (alpha-1,6-)-glycoprotein beta-1,6-N-acetyl-glucosaminyltransferase |
| MGAT5B | 146664 | NP_653278 | 5890 | mannosyl (alpha-1,6-)-glycoprotein beta-1,6-N-acetyl-glucosaminyltransferase, isozyme B |
| MGAT5B | 146664 | NP_945193 | 6847 | mannosyl (alpha-1,6-)-glycoprotein beta-1,6-N-acetyl-glucosaminyltransferase, isozyme B |
| MGP | 4256 | NP_000891 | 319 | matrix Gla protein |
| MGST1 | 4257 | NP_064696 | 4626 | microsomal glutathione S-transferase 1 |
| MGST1 | 4257 | NP_665707 | 5975 | microsomal glutathione S-transferase 1 |
| MGST1 | 4257 | NP_665734 | 5976 | microsomal glutathione S-transferase 1 |
| MGST1 | 4257 | NP_665735 | 5977 | microsomal glutathione S-transferase 1 |
| MGST2 | 4258 | NP_002404 | 2646 | microsomal glutathione S-transferase 2 |
| MIA3 | 375056 | NP_940953 | 6814 | melanoma inhibitory activity family, member 3 |
| MICA | 100507436 | NP_000238 | 7109 | MHC class I polypeptide-related sequence A isoform 1 |
| MICU3 | 286097 | NP_859074 | 6625 | EF-hand domain family, member A2 |
| MID1 | 4281 | NP_000372 | 112 | midline 1 (Opitz/BBB syndrome) |
| MID1 | 4281 | NP_001092094 | 1142 | midline 1 (Opitz/BBB syndrome) |
| MID1 | 4281 | NP_150632 | 5481 | midline 1 (Opitz/BBB syndrome) |
| MIEF2 | 125170 | NP_001138372 | 1782 | Smith-Magenis syndrome chromosome region, candidate 7 |
| MIEF2 | 125170 | NP_631901 | 5839 | Smith-Magenis syndrome chromosome region, candidate 7 |
| MIEF2 | 125170 | NP_683684 | 6003 | Smith-Magenis syndrome chromosome region, candidate 7 |
| MILR1 | 284021 | NP_001078892 | 1093 | chromosome 17 open reading frame 60 |
| MINOS1 | 440574 | NP_001027535 | 743 | chromosome 1 open reading frame 151 |
| MIP | 4284 | NP_036196 | 3696 | major intrinsic protein of lens fiber |
| MLANA | 2315 | NP_005502 | 3302 | melan-A |
| MLC1 | 23209 | NP_055981 | 4042 | megalencephalic leukoencephalopathy with subcortical cysts 1 |
| MLC1 | 23209 | NP_631941 | 5847 | megalencephalic leukoencephalopathy with subcortical cysts 1 |
| MLEC | 9761 | NP_055545 | 3978 | malectin |
| MLF2 | 8079 | NP_005430 | 3285 | myeloid leukemia factor 2 |
| MLLT10 | 8028 | NP_001182555 | 563 | myeloid/lymphoid or mixed-lineage leukemia (trithoraxHomolog, Drosophila) |
| MLLT10 | 8028 | NP_004632 | 3095 | myeloid/lymphoid or mixed-lineage leukemia (trithoraxHomolog, Drosophila) |
| MLN | 4295 | NP_001035198 | 837 | motilin |
| MLN | 4295 | NP_002409 | 2649 | motilin |
| MLNR | 2862 | NP_001498 | 2396 | motilin receptor |
| MMD | 23531 | NP_036461 | 3748 | monocyte to macrophage differentiation-associated |
| MMD2 | 221938 | NP_001094070 | 1190 | monocyte to macrophage differentiation-associated 2 |

FIG. 2 (CONT.)

| Antigen | GeneID | Accession No. | SEQ ID NO: | RefSeq Gene Name |
|---|---|---|---|---|
| MMD2 | 221938 | NP_940685 | 6792 | monocyte to macrophage differentiation-associated 2 |
| MME | 4311 | NP_000893 | 320 | membrane metallo-endopeptidase |
| MME | 4311 | NP_009218 | 3669 | membrane metallo-endopeptidase |
| MME | 4311 | NP_009219 | 3670 | membrane metallo-endopeptidase |
| MME | 4311 | NP_009220 | 3671 | membrane metallo-endopeptidase |
| MMEL1 | 79258 | NP_258428 | 5501 | membrane metallo-endopeptidase-like 1 |
| MMGT1 | 93380 | NP_775741 | 6342 | membrane magnesium transporter 1 |
| MMP14 | 4323 | NP_004986.1 | 7277 | matrix metallopeptidase 14 |
| MMP15 | 4324 | NP_002419 | 2651 | matrix metallopeptidase 15 (membrane-inserted) |
| MMP16 | 4325 | NP_005932 | 3403 | matrix metallopeptidase 16 (membrane-inserted) |
| MMP16 | 4325 | NP_005932.2 | 4929 | matrix metallopeptidase 16 (membrane-inserted) |
| MMP20 | 9313 | NP_004762 | 3120 | matrix metallopeptidase 20 |
| MMP24 | 10893 | NP_006681 | 3546 | matrix metallopeptidase 24 (membrane-inserted) |
| MOG | 4340 | NP_001008229 | 528 | myelin oligodendrocyte glycoprotein |
| MOG | 4340 | NP_001008230 | 529 | myelin oligodendrocyte glycoprotein |
| MOG | 4340 | NP_001163888 | 2240 | myelin oligodendrocyte glycoprotein |
| MOG | 4340 | NP_001008229.1 | 2241 | myelin oligodendrocyte glycoprotein |
| MOG | 4340 | NP_002424 | 2652 | myelin oligodendrocyte glycoprotein |
| MOG | 4340 | NP_996532 | 6966 | myelin oligodendrocyte glycoprotein |
| MOG | 4340 | NP_996533 | 6967 | myelin oligodendrocyte glycoprotein |
| MOG | 4340 | NP_996534 | 6968 | myelin oligodendrocyte glycoprotein |
| MOG | 4340 | NP_996535 | 6969 | myelin oligodendrocyte glycoprotein |
| MOG | 4340 | NP_996536 | 6970 | myelin oligodendrocyte glycoprotein |
| MOG | 4340 | NP_996537 | 6971 | myelin oligodendrocyte glycoprotein |
| MOGAT1 | 116255 | NP_477513 | 5580 | monoacylglycerol O-acyltransferase 1 |
| MOGAT3 | 346606 | NP_835470 | 6528 | monoacylglycerol O-acyltransferase 3 |
| MOGS | 7841 | NP_001139630 | 1909 | mannosyl-oligosaccharide glucosidase |
| MOGS | 7841 | NP_006293 | 3463 | mannosyl-oligosaccharide glucosidase |
| MOK | 5891 | NP_001258940.1 | 7436 | MOK protein kinase |
| MOS | 4342 | NP_005363 | 3277 | v-mos Moloney murine sarcoma viral oncogeneHomolog |
| MOSPD1 | 56180 | NP_062456 | 4571 | motile sperm domain containing 1 |
| MOSPD2 | 158747 | NP_689794 | 6084 | motile sperm domain containing 2 |
| MOSPD3 | 64598 | NP_001035186 | 828 | motile sperm domain containing 3 |
| MOSPD3 | 64598 | NP_001035187 | 829 | motile sperm domain containing 3 |
| MOSPD3 | 64598 | NP_001035188 | 830 | motile sperm domain containing 3 |
| MOSPD3 | 64598 | NP_076438 | 4989 | motile sperm domain containing 3 |
| MPC1 | 51660 | NP_057182 | 4169 | brain protein 44-like |
| MPDU1 | 9526 | NP_004861 | 3154 | mannose-P-dolichol utilization defect 1 |
| MPEG1 | 219972 | NP_001034485 | 792 | macrophage expressed 1 |
| MPG | 4350 | NP_001015052 | 632 | N-methylpurine-DNA glycosylase |
| MPG | 4350 | NP_001015054 | 633 | N-methylpurine-DNA glycosylase |
| MPG | 4350 | NP_002425 | 2653 | N-methylpurine-DNA glycosylase |
| MPL | 4352 | NP_005364 | 3278 | myeloproliferative leukemia virus oncogene |
| MPPE1 | 65258 | NP_075563 | 4972 | metallophosphoesterase 1 |
| MPZ | 4359 | NP_000521 | 154 | myelin protein zero |
| MPZL1 | 9019 | NP_001139663 | 1912 | myelin protein zero-like 1 |
| MPZL1 | 9019 | NP_003944 | 2929 | myelin protein zero-like 1 |
| MPZL1 | 9019 | NP_078845 | 5049 | myelin protein zero-like 1 |
| MPZL2 | 10205 | NP_005788 | 3371 | myelin protein zero-like 2 |
| MPZL2 | 10205 | NP_658911 | 5902 | myelin protein zero-like 2 |
| MPZL3 | 196264 | NP_938016 | 6765 | myelin protein zero-like 3 |
| MR1 | 3140 | NP_001522 | 2406 | majorHistocompatibility complex, class I-related |
| MRAP | 56246 | NP_848932 | 6562 | melanocortin 2 receptor accessory protein |
| MRAP | 56246 | NP_996781 | 6977 | melanocortin 2 receptor accessory protein |
| MRAP2 | 112609 | NP_612418 | 5744 | melanocortin 2 receptor accessory protein 2 |
| MRGPRF | 116535 | NP_001091985 | 1129 | MAS-related GPR, member F |
| MRGPRF | 116535 | NP_659452 | 5917 | MAS-related GPR, member F |
| MRGPRX1 | 259249 | NP_671732 | 5999 | MAS-related GPR, member X1 |
| MRGPRX2 | 117194 | NP_473371 | 5570 | MAS-related GPR, member X2 |
| MRGPRX3 | 117195 | NP_473372 | 5571 | MAS-related GPR, member X3 |
| MRGPRX4 | 117196 | NP_473373 | 5572 | MAS-related GPR, member X4 |
| MRLN | 100507027 | NP_001291660 | 7105 | myoregulin |
| MRS2 | 57380 | NP_065713 | 4694 | MRS2 magnesiumHomeostasis factorHomolog (S. cerevisiae) |
| MRVI1 | 10335 | NP_001092049 | 1139 | murine retrovirus integration site 1Homolog |
| MRVI1 | 10335 | NP_001093633 | 1182 | murine retrovirus integration site 1Homolog |
| MRVI1 | 10335 | NP_001093637 | 1183 | murine retrovirus integration site 1Homolog |
| MRVI1 | 10335 | NP_569056 | 5649 | murine retrovirus integration site 1Homolog |
| MS4A1 | 931 | NP_068769 | 4853 | membrane-spanning 4-domains, subfamily A, member 1 |
| MS4A1 | 931 | NP_690605 | 6123 | membrane-spanning 4-domains, subfamily A, member 1 |
| MS4A12 | 54860 | NP_001157942 | 2082 | membrane-spanning 4-domains, subfamily A, member 12 |
| MS4A12 | 54860 | NP_060186 | 4328 | membrane-spanning 4-domains, subfamily A, member 12 |
| MS4A14 | 84689 | NP_001073160 | 992 | membrane-spanning 4-domains, subfamily A, member 14 |
| MS4A14 | 84689 | NP_115986 | 5376 | membrane-spanning 4-domains, subfamily A, member 14 |
| MS4A15 | 219995 | NP_001092305 | 1153 | membrane-spanning 4-domains, subfamily A, member 15 |
| MS4A15 | 219995 | NP_689930 | 6104 | membrane-spanning 4-domains, subfamily A, member 15 |
| MS4A2 | 2206 | NP_000130 | 38 | membrane-spanning 4-domains, subfamily A, member 2 (Fc fragment of IgE,High affinity I, receptor for beta polypeptide) |

FIG. 2 (CONT.)

| Antigen | GeneID | Accession No. | SEQ ID NO: | RefSeq Gene Name |
|---|---|---|---|---|
| MS4A2 | 2206 | NP_000130.1 | 1637 | membrane-spanning 4-domains, subfamily A, member 2 (Fc fragment of IgE,High affinity I, receptor for beta polypeptide) |
| MS4A3 | 932 | NP_001026836 | 721 | membrane-spanning 4-domains, subfamily A, member 3 (hematopoietic cell-specific) |
| MS4A3 | 932 | NP_001026979 | 735 | membrane-spanning 4-domains, subfamily A, member 3 (hematopoietic cell-specific) |
| MS4A3 | 932 | NP_006129 | 3443 | membrane-spanning 4-domains, subfamily A, member 3 (hematopoietic cell-specific) |
| MS4A4A | 51338 | NP_076926 | 4994 | membrane-spanning 4-domains, subfamily A, member 4 |
| MS4A4A | 51338 | NP_683876 | 6017 | membrane-spanning 4-domains, subfamily A, member 4 |
| MS4A5 | 64232 | NP_076434 | 4988 | membrane-spanning 4-domains, subfamily A, member 5 |
| MS4A6A | 64231 | NP_071744 | 4900 | membrane-spanning 4-domains, subfamily A, member 6A |
| MS4A6A | 64231 | NP_690590 | 6120 | membrane-spanning 4-domains, subfamily A, member 6A |
| MS4A6A | 64231 | NP_690591 | 6121 | membrane-spanning 4-domains, subfamily A, member 6A |
| MS4A6E | 245802 | NP_640342 | 5850 | membrane-spanning 4-domains, subfamily A, member 6E |
| MS4A7 | 58475 | NP_067024 | 4794 | membrane-spanning 4-domains, subfamily A, member 7 |
| MS4A7 | 58475 | NP_996821 | 6983 | membrane-spanning 4-domains, subfamily A, member 7 |
| MS4A7 | 58475 | NP_996822 | 6984 | membrane-spanning 4-domains, subfamily A, member 7 |
| MS4A7 | 58475 | NP_996823 | 6985 | membrane-spanning 4-domains, subfamily A, member 7 |
| MS4A8 | 83661 | NP_113645 | 5227 | membrane-spanning 4-domains, subfamily A, member 8B |
| MSLN | 10232 | NP_005814 | 3377 | mesothelin |
| MSLN | 10232 | NP_037536 | 3819 | mesothelin |
| MSMB | 4477 | NP_002434 | 2654 | microseminoprotein, beta- |
| MSMB | 4477 | NP_619540 | 5768 | microseminoprotein, beta- |
| MSMO1 | 6307 | NP_001017369.1 | 7348 | methylsterol monooxygenase 1 |
| MSR1 | 4481 | NP_002436 | 2655 | macrophage scavenger receptor 1 |
| MSR1 | 4481 | NP_619729 | 5774 | macrophage scavenger receptor 1 |
| MSR1 | 4481 | NP_619730 | 5775 | macrophage scavenger receptor 1 |
| MST1R | 4486 | NP_002438 | 2656 | macrophage stimulating 1 receptor (c-met-related tyrosine kinase) |
| MTCH1 | 23787 | NP_055156 | 3919 | mitochondrial carrierHomolog 1 (C. elegans) |
| MTDH | 92140 | NP_848927 | 6561 | metadherin |
| MTFP1 | 51537 | NP_001003704 | 418 | mitochondrial protein 18 kDa |
| MTFP1 | 51537 | NP_057582 | 4229 | mitochondrial protein 18 kDa |
| MTHFD1 | 4522 | NP_005947 | 3405 | methylenetetrahydrofolate dehydrogenase (NADP+ dependent) 1, methenyltetrahydrofolate cyclohydrolase, formyltetrahydrofolate synthetase |
| MTNR1A | 4543 | NP_005949 | 3406 | melatonin receptor 1A |
| MTNR1B | 4544 | NP_005950 | 3407 | melatonin receptor 1B |
| MTUS1 | 57509 | NP_001001924 | 379 | mitochondrial tumor suppressor 1 |
| MTUS1 | 57509 | NP_001001925 | 380 | mitochondrial tumor suppressor 1 |
| MTUS1 | 57509 | NP_001001931 | 381 | mitochondrial tumor suppressor 1 |
| MTUS1 | 57509 | NP_001159865 | 2165 | mitochondrial tumor suppressor 1 |
| MTUS1 | 57509 | NP_065800 | 4715 | mitochondrial tumor suppressor 1 |
| MUC1 | 4582 | NP_001018016 | 661 | mucin 1, cell surface associated |
| MUC1 | 4582 | NP_001018017 | 662 | mucin 1, cell surface associated |
| MUC1 | 4582 | NP_001037855 | 922 | mucin 1, cell surface associated |
| MUC1 | 4582 | NP_001037856 | 923 | mucin 1, cell surface associated |
| MUC1 | 4582 | NP_001037857 | 924 | mucin 1, cell surface associated |
| MUC1 | 4582 | NP_001037858 | 925 | mucin 1, cell surface associated |
| MUC1 | 4582 | NP_002447 | 2657 | mucin 1, cell surface associated |
| MUC12 | 10071 | NP_001157934 | 2080 | mucin 12, cell surface associated similar to mucin 11 |
| MUC13 | 56667 | NP_149038 | 5442 | mucin 13, cell surface associated |
| MUC15 | 143662 | NP_001128563 | 1518 | mucin 15, cell surface associated |
| MUC15 | 143662 | NP_001128564 | 1519 | mucin 15, cell surface associated |
| MUC15 | 143662 | NP_663625 | 5966 | mucin 15, cell surface associated |
| MUC16 | 94025 | NP_078966 | 5067 | mucin 16, cell surface associated |
| MUC17 | 140453 | NP_001035194 | 835 | mucin 17, cell surface associated |
| MUC3A | 4584 | XP_001125753 | 7049 | mucin 3B, cell surface associated |
| MUC3A | 4584 | XP_001718007 | 7058 | mucin 3B, cell surface associated |
| MUC3A | 4584 | XP_001719378 | 7065 | mucin 3B, cell surface associated |
| MUC3A | 4584 | XP_001719551 | 7066 | mucin 3B, cell surface associated |
| MUC3A | 4584 | XP_001721642 | 7070 | mucin 3B, cell surface associated |
| MUC3A | 4584 | XP_001725406 | 7072 | mucin 3B, cell surface associated |
| MUC4 | 4585 | NP_004523 | 3070 | mucin 4, cell surface associated |
| MUC4 | 4585 | NP_060876 | 4440 | mucin 4, cell surface associated |
| MUC4 | 4585 | NP_612154 | 5722 | mucin 4, cell surface associated |
| MUL1 | 79594 | NP_078820 | 5044 | mitochondrial E3 ubiquitin ligase 1 |
| MUSK | 4593 | NP_001159752.1 | 7413 | muscle associated receptor tyrosine kinase |
| MXRA7 | 439921 | NP_001008528 | 544 | matrix-remodelling associated 7 |
| MXRA7 | 439921 | NP_001008529 | 545 | matrix-remodelling associated 7 |
| MXRA7 | 439921 | NP_940932 | 6808 | matrix-remodelling associated 7 |
| MYADM | 91663 | NP_001018654 | 671 | myeloid-associated differentiation marker |
| MYADM | 91663 | NP_001018655 | 672 | myeloid-associated differentiation marker |
| MYADM | 91663 | NP_001018656 | 673 | myeloid-associated differentiation marker |
| MYADM | 91663 | NP_001018657 | 674 | myeloid-associated differentiation marker |
| MYADM | 91663 | NP_612382 | 5736 | myeloid-associated differentiation marker |
| MYADML2 | 255275 | NP_001138585 | 1815 | myeloid-associated differentiation marker-like 2 |
| MYCT1 | 80177 | NP_079383 | 5120 | myc target 1 |
| MYOF | 26509 | NP_038479 | 3826 | myoferlin |
| MYOF | 26509 | NP_579899 | 5688 | myoferlin |
| MYRF | 745 | NP_001120864 | 1323 | chromosome 11 open reading frame 9 |

FIG. 2 (CONT.)

| Antigen | GeneID | Accession No. | SEQ ID NO: | RefSeq Gene Name |
|---|---|---|---|---|
| MYRF | 745 | NP_037411 | 3794 | chromosome 11 open reading frame 9 |
| MYRFL | 196446 | XP_001716702 | 7054 | chromosome 12 open reading frame 28 |
| MYRFL | 196446 | XP_001718110 | 7059 | chromosome 12 open reading frame 28 |
| MYRFL | 196446 | XP_001718960 | 7063 | chromosome 12 open reading frame 28 |
| N4BP2L2 | 10443 | NP_055702 | 4008 | NEDD4 binding protein 2-like 2 |
| N4BP2L2 | 10443 | NP_149102 | 5451 | NEDD4 binding protein 2-like 2 |
| NAAA | 27163 | NP_001035861 | 885 | N-acylethanolamine acid amidase |
| NAAA | 27163 | NP_055250 | 3937 | N-acylethanolamine acid amidase |
| NAALAD2 | 10003 | NP_005458 | 3289 | N-acetylated alpha-linked acidic dipeptidase 2 |
| NAALADL1 | 10004 | NP_005459 | 3290 | N-acetylated alpha-linked acidic dipeptidase-like 1 |
| NAALADL2 | 254827 | NP_996898 | 6997 | N-acetylated alpha-linked acidic dipeptidase-like 2 |
| NALCN | 259232 | NP_443099 | 5520 | sodium leak channel, non-selective |
| NAT10 | 55226 | NP_001137502 | 1759 | N-acetyltransferase 10 (GCN5-related) |
| NAT10 | 55226 | NP_078938 | 5066 | N-acetyltransferase 10 (GCN5-related) |
| NAT14 | 57106 | NP_065111 | 4640 | N-acetyltransferase 14 (GCN5-related, putative) |
| NAT2 | 10 | NP_000006 | 1 | N-acetyltransferase 2 (arylamine N-acetyltransferase) |
| NAT8 | 9027 | NP_003951 | 2930 | N-acetyltransferase 8 (GCN5-related, putative) |
| NAT8 | 9027 | NP_057431 | 4205 | N-acetyltransferase 8 (GCN5-related, putative) |
| NAT8L | 339983 | NP_848652 | 6555 | N-acetyltransferase 8-like (GCN5-related, putative) |
| NBAS | 51594 | NP_056993 | 4131 | neuroblastoma amplified sequence |
| NCAM1 | 4684 | NP_000606 | 173 | neural cell adhesion molecule 1 |
| NCAM1 | 4684 | NP_001070150 | 949 | neural cell adhesion molecule 1 |
| NCAM1 | 4684 | NP_851996 | 6595 | neural cell adhesion molecule 1 |
| NCAM2 | 4685 | NP_004531.2 | 7327 | neural cell adhesion molecule 2 |
| NCEH1 | 57552 | NP_001139748 | 1924 | arylacetamide deacetylase-like 1 |
| NCEH1 | 57552 | NP_001139749 | 1925 | arylacetamide deacetylase-like 1 |
| NCEH1 | 57552 | NP_001139750 | 1926 | arylacetamide deacetylase-like 1 |
| NCEH1 | 57552 | NP_065843 | 4724 | arylacetamide deacetylase-like 1 |
| NCR1 | 9437 | NP_001138929 | 1860 | natural cytotoxicity triggering receptor 1 |
| NCR1 | 9437 | NP_001138930 | 1861 | natural cytotoxicity triggering receptor 1 |
| NCR1 | 9437 | NP_004820 | 3144 | natural cytotoxicity triggering receptor 1 |
| NCR2 | 9436 | NP_004819 | 3143 | natural cytotoxicity triggering receptor 2 |
| NCR3 | 259197 | NP_001138938 | 1866 | natural cytotoxicity triggering receptor 3 |
| NCR3 | 259197 | NP_001138939 | 1867 | natural cytotoxicity triggering receptor 3 |
| NCR3 | 259197 | NP_667341 | 5989 | natural cytotoxicity triggering receptor 3 |
| NCR3LG1 | 374383 | NP_001189368.1 | 7428 | natural killer cell cytotoxicity receptor 3 ligand 1 |
| NCSTN | 23385 | NP_056146 | 4062 | nicastrin |
| NDC1 | 55706 | NP_001162023 | 2234 | transmembrane protein 48 |
| NDC1 | 55706 | NP_060557 | 4389 | transmembrane protein 48 |
| NDFIP2 | 54602 | NP_001154879 | 2007 | Nedd4 family interacting protein 2 |
| NDFIP2 | 54602 | NP_061953 | 4561 | Nedd4 family interacting protein 2 |
| NDRG1 | 10397 | NP_001128714 | 1539 | N-myc downstream regulated 1 |
| NDRG1 | 10397 | NP_006087 | 3434 | N-myc downstream regulated 1 |
| NDRG2 | 57447 | NP_057334 | 4194 | NDRG family member 2 |
| NDRG2 | 57447 | NP_963293 | 6902 | NDRG family member 2 |
| NDRG2 | 57447 | NP_963294 | 6903 | NDRG family member 2 |
| NDRG2 | 57447 | NP_963831 | 6904 | NDRG family member 2 |
| NDRG2 | 57447 | NP_963832 | 6905 | NDRG family member 2 |
| NDRG2 | 57447 | NP_963833 | 6906 | NDRG family member 2 |
| NDRG2 | 57447 | NP_963834 | 6907 | NDRG family member 2 |
| NDRG2 | 57447 | NP_963835 | 6908 | NDRG family member 2 |
| NDRG4 | 65009 | NP_001123959 | 1430 | NDRG family member 4 |
| NDRG4 | 65009 | NP_065198 | 4664 | NDRG family member 4 |
| NDRG4 | 65009 | NP_075061 | 4961 | NDRG family member 4 |
| NDST1 | 3340 | NP_001534 | 2409 | N-deacetylase/N-sulfotransferase (heparan glucosaminyl) 1 |
| NDST2 | 8509 | NP_003626 | 2858 | N-deacetylase/N-sulfotransferase (heparan glucosaminyl) 2 |
| NDST3 | 9348 | NP_004775 | 3126 | N-deacetylase/N-sulfotransferase (heparan glucosaminyl) 3 |
| NDST4 | 64579 | NP_072091 | 4931 | N-deacetylase/N-sulfotransferase (heparan glucosaminyl) 4 |
| NDUFA1 | 4694 | NP_004532 | 3071 | NADH dehydrogenase (ubiquinone) 1 alpha subcomplex, 1, 7.5kDa |
| NDUFA11 | 126328 | NP_783313 | 6446 | NADH dehydrogenase (ubiquinone) 1 alpha subcomplex, 11, 14.7kDa |
| NDUFA13 | 51079 | NP_057049 | 4143 | NADH dehydrogenase (ubiquinone) 1 alpha subcomplex, 13 |
| NDUFA3 | 4696 | NP_004533 | 3072 | NADH dehydrogenase (ubiquinone) 1 alpha subcomplex, 3, 9kDa |
| NDUFA4 | 4697 | NP_002480 | 2658 | NADH dehydrogenase (ubiquinone) 1 alpha subcomplex, 4, 9kDa |
| NDUFA4L2 | 56901 | NP_064527 | 4603 | NADH dehydrogenase (ubiquinone) 1 alpha subcomplex, 4-like 2 |
| NDUFB1 | 4707 | NP_004536 | 3073 | NADH dehydrogenase (ubiquinone) 1 beta subcomplex, 1, 7kDa |
| NDUFB11 | 54539 | NP_001129470 | 1582 | NADH dehydrogenase (ubiquinone) 1 beta subcomplex, 11, 17.3kDa |
| NDUFB11 | 54539 | NP_061929 | 4553 | NADH dehydrogenase (ubiquinone) 1 beta subcomplex, 11, 17.3kDa |
| NDUFB3 | 4709 | NP_002482 | 2659 | NADH dehydrogenase (ubiquinone) 1 beta subcomplex, 3, 12kDa |
| NDUFB5 | 4711 | NP_002483 | 2660 | NADH dehydrogenase (ubiquinone) 1 beta subcomplex, 5, 16kDa |
| NDUFB6 | 4712 | NP_002484 | 2661 | NADH dehydrogenase (ubiquinone) 1 beta subcomplex, 6, 17kDa |
| NDUFB6 | 4712 | NP_877416 | 6679 | NADH dehydrogenase (ubiquinone) 1 beta subcomplex, 6, 17kDa |
| NDUFB8 | 4714 | NP_004995 | 3194 | NADH dehydrogenase (ubiquinone) 1 beta subcomplex, 8, 19kDa |
| NDUFC2 | 4718 | NP_004540 | 3074 | NADH dehydrogenase (ubiquinone) 1, subcomplex unknown, 2, 14.5kDa |
| NELL2 | 4753 | NP_001138579 | 1811 | NEL-like 2 (chicken) |
| NELL2 | 4753 | NP_001138580 | 1812 | NEL-like 2 (chicken) |
| NELL2 | 4753 | NP_001138581 | 1813 | NEL-like 2 (chicken) |
| NELL2 | 4753 | NP_001138582 | 1814 | NEL-like 2 (chicken) |

FIG. 2 (CONT.)

| Antigen | GeneID | Accession No. | SEQ ID NO: | RefSeq Gene Name |
|---|---|---|---|---|
| NELL2 | 4753 | NP_006150 | 3448 | NEL-like 2 (chicken) |
| NEMP1 | 23306 | NP_001124435 | 1451 | transmembrane protein 194A |
| NEMP1 | 23306 | NP_056072 | 4053 | transmembrane protein 194A |
| NEMP2 | 100131211 | NP_001136117 | 1681 | transmembrane protein 194B |
| NEO1 | 4756 | NP_002490 | 2662 | neogeninHomolog 1 (chicken) |
| NETO1 | 81832 | NP_001188394.1 | 7427 | neuropilin and tolloid like 1 |
| NETO2 | 81831 | NP_060562 | 4390 | neuropilin (NRP) and tolloid (TLL)-like 2 |
| NFAM1 | 150372 | NP_666017 | 5986 | NFAT activating protein with ITAM motif 1 |
| NFASC | 23114 | NP_001005388 | 456 | neurofascinHomolog (chicken) |
| NFASC | 23114 | NP_001005389 | 457 | neurofascinHomolog (chicken) |
| NFASC | 23114 | NP_001153803 | 1989 | neurofascinHomolog (chicken) |
| NFASC | 23114 | NP_001153804 | 1990 | neurofascinHomolog (chicken) |
| NFASC | 23114 | NP_001153805 | 1991 | neurofascinHomolog (chicken) |
| NFASC | 23114 | NP_055905 | 4031 | neurofascinHomolog (chicken) |
| NFE2L3 | 9603 | NP_004280 | 3009 | nuclear factor (erythroid-derived 2)-like 3 |
| NFXL1 | 152518 | NP_694540 | 6142 | nuclear transcription factor, X-box binding-like 1 |
| NGFR | 4804 | NP_002498 | 2663 | nerve growth factor receptor (TNFR superfamily, member 16) |
| NGLY1 | 55768 | NP_001138765 | 1845 | N-glycanase 1 |
| NGLY1 | 55768 | NP_001138766 | 1846 | N-glycanase 1 |
| NGLY1 | 55768 | NP_001138767 | 1847 | N-glycanase 1 |
| NGLY1 | 55768 | NP_060767 | 4416 | N-glycanase 1 |
| NINJ1 | 4814 | NP_004139 | 2973 | ninjurin 1 |
| NINJ2 | 4815 | NP_057617 | 4238 | ninjurin 2 |
| NIPA1 | 123606 | NP_001135747 | 1630 | non imprinted in Prader-Willi/Angelman syndrome 1 |
| NIPA1 | 123606 | NP_653200 | 5872 | non imprinted in Prader-Willi/Angelman syndrome 1 |
| NIPA2 | 81614 | NP_001008860 | 555 | non imprinted in Prader-Willi/Angelman syndrome 2 |
| NIPA2 | 81614 | NP_001008892 | 556 | non imprinted in Prader-Willi/Angelman syndrome 2 |
| NIPA2 | 81614 | NP_001008894 | 557 | non imprinted in Prader-Willi/Angelman syndrome 2 |
| NIPA2 | 81614 | NP_112184 | 5192 | non imprinted in Prader-Willi/Angelman syndrome 2 |
| NIPAL2 | 79815 | NP_079035 | 5077 | NIPA-like domain containing 2 |
| NIPAL3 | 57185 | NP_065181 | 4661 | NIPA-like domain containing 3 |
| NIPAL4 | 348938 | NP_001092757 | 1154 | NIPA-like domain containing 4 |
| NIPAL4 | 348938 | NP_001165763 | 2308 | NIPA-like domain containing 4 |
| NKAIN1 | 79570 | NP_078798 | 5039 | Na+/K+ transporting ATPase interacting 1 |
| NKAIN2 | 154215 | NP_001035304 | 864 | Na+/K+ transporting ATPase interacting 2 |
| NKAIN4 | 128414 | NP_690603 | 6122 | Na+/K+ transporting ATPase interacting 4 |
| NKG7 | 4818 | NP_005592 | 3321 | natural killer cell group 7 sequence |
| NKPD1 | 284353 | NP_940880.3 | 1469 | NTPase, KAP family P-loop domain containing 1 |
| NKPD1 | 284353 | NP_940880 | 6799 | NTPase, KAP family P-loop domain containing 1 |
| NLGN1 | 22871 | NP_055747 | 4016 | neuroligin 1 |
| NLGN2 | 57555 | NP_065846.1 | 7325 | neuroligin 2 |
| NLGN3 | 54413 | NP_001160132 | 2174 | neuroligin 3 |
| NLGN3 | 54413 | NP_061850 | 4543 | neuroligin 3 |
| NLGN3 | 54413 | NP_851820 | 6589 | neuroligin 3 |
| NLGN4X | 57502 | NP_001269074.1 | 7441 | neuroligin 4, X-linked |
| NLGN4Y | 22829 | NP_001157710 | 2069 | neuroligin 4, Y-linked |
| NLGN4Y | 22829 | NP_055708 | 4009 | neuroligin 4, Y-linked |
| NMB | 4828 | NP_066563 | 4764 | neuromedin B |
| NMB | 4828 | NP_995580 | 6961 | neuromedin B |
| NMBR | 4829 | NP_002502 | 2665 | neuromedin B receptor |
| NMU | 10874 | NP_006672 | 3544 | neuromedin U |
| NMUR1 | 10316 | NP_006047 | 3423 | neuromedin U receptor 1 |
| NMUR2 | 56923 | NP_064552 | 4610 | neuromedin U receptor 2 |
| NNAT | 4826 | NP_005377 | 3279 | neuronatin |
| NNAT | 4826 | NP_859017 | 6620 | neuronatin |
| NNT | 23530 | NP_036475 | 3752 | nicotinamide nucleotide transhydrogenase |
| NNT | 23530 | NP_892022 | 6698 | nicotinamide nucleotide transhydrogenase |
| NOTCH2 | 4853 | NP_077719 | 5027 | NotchHomolog 2 (Drosophila) |
| NOTCH4 | 4855 | NP_004548 | 3075 | NotchHomolog 4 (Drosophila) |
| NOX1 | 27035 | NP_008983 | 3623 | NADPH oxidase 1 |
| NOX1 | 27035 | NP_039249 | 3833 | NADPH oxidase 1 |
| NOX3 | 50508 | NP_056533.1 | 7294 | NADPH oxidase 3 |
| NOX4 | 50507 | NP_001137308.1 | 7404 | NADPH oxidase 4 |
| NOX5 | 79400 | NP_078781 | 5035 | NADPH oxidase, EF-hand calcium binding domain 5 |
| NPB | 256933 | NP_683694 | 6004 | neuropeptide B |
| NPBWR1 | 2831 | NP_005276 | 3253 | neuropeptides B/W receptor 1 |
| NPBWR2 | 2832 | NP_005277 | 3254 | neuropeptides B/W receptor 2 |
| NPC1 | 4864 | NP_000262 | 78 | Niemann-Pick disease, type C1 |
| NPC1L1 | 29881 | NP_001095118 | 1203 | NPC1 (Niemann-Pick disease, type C1, gene)-like 1 |
| NPC1L1 | 29881 | NP_037521 | 3817 | NPC1 (Niemann-Pick disease, type C1, gene)-like 1 |
| NPDC1 | 56654 | NP_056207 | 4075 | neural proliferation, differentiation and control, 1 |
| NPFFR1 | 64106 | NP_071429 | 4886 | neuropeptide FF receptor 1 |
| NPFFR2 | 10886 | NP_001138228 | 1771 | neuropeptide FF receptor 2 |
| NPFFR2 | 10886 | NP_004876 | 3160 | neuropeptide FF receptor 2 |
| NPFFR2 | 10886 | NP_444264 | 5558 | neuropeptide FF receptor 2 |
| NPHP4 | 261734 | NP_055917 | 4032 | nephronophthisis 4 |
| NPHS1 | 4868 | NP_004637 | 3096 | nephrosis 1, congenital, Finnish type (nephrin) |

FIG. 2 (CONT.)

| Antigen | GeneID | Accession No. | SEQ ID NO: | RefSeq Gene Name |
|---|---|---|---|---|
| NPHS2 | 7827 | NP_055440 | 3966 | nephrosis 2, idiopathic, steroid-resistant (podocin) |
| NPPA | 4878 | NP_006163 | 3449 | natriuretic peptide precursor A |
| NPR3 | 4883 | NP_000899 | 322 | natriuretic peptide receptor C/guanylate cyclase C (atrionatriuretic peptide receptor C) |
| NPTN | 27020 | NP_001154835 | 2004 | neuroplastin |
| NPTN | 27020 | NP_001154836 | 2005 | neuroplastin |
| NPTN | 27020 | NP_036560 | 3774 | neuroplastin |
| NPTN | 27020 | NP_059429 | 4295 | neuroplastin |
| NPTXR | 23467 | NP_055108 | 3907 | neuronal pentraxin receptor |
| NPY | 4852 | NP_000896 | 321 | neuropeptide Y |
| NPY1R | 4886 | NP_000900 | 323 | neuropeptide Y receptor Y1 |
| NPY2R | 4887 | NP_000901.1 | 7262 | neuropeptide Y receptor Y2 |
| NPY4R | 5540 | NP_005963 | 3409 | pancreatic polypeptide receptor 1 |
| NPY5R | 4889 | NP_006165 | 3450 | neuropeptide Y receptor Y5 |
| NRCAM | 4897 | NP_001032209 | 768 | neuronal cell adhesion molecule |
| NRCAM | 4897 | NP_001032209.1 | 769 | neuronal cell adhesion molecule |
| NRCAM | 4897 | NP_005001 | 3195 | neuronal cell adhesion molecule |
| NRG1 | 3084 | NP_001153467 | 1964 | neuregulin 1 |
| NRG1 | 3084 | NP_001153468 | 1965 | neuregulin 1 |
| NRG1 | 3084 | NP_001153471 | 1966 | neuregulin 1 |
| NRG1 | 3084 | NP_001153473 | 1967 | neuregulin 1 |
| NRG1 | 3084 | NP_001153474 | 1968 | neuregulin 1 |
| NRG1 | 3084 | NP_001153476 | 1969 | neuregulin 1 |
| NRG1 | 3084 | NP_001153477 | 1970 | neuregulin 1 |
| NRG1 | 3084 | NP_001153479 | 1971 | neuregulin 1 |
| NRG1 | 3084 | NP_001153480 | 1972 | neuregulin 1 |
| NRG1 | 3084 | NP_004486 | 3065 | neuregulin 1 |
| NRG1 | 3084 | NP_039250 | 3834 | neuregulin 1 |
| NRG1 | 3084 | NP_039251 | 3835 | neuregulin 1 |
| NRG1 | 3084 | NP_039252 | 3836 | neuregulin 1 |
| NRG1 | 3084 | NP_039253 | 3837 | neuregulin 1 |
| NRG1 | 3084 | NP_039254 | 3838 | neuregulin 1 |
| NRG1 | 3084 | NP_001153467.1 | 3839 | neuregulin 1 |
| NRG1 | 3084 | NP_039256 | 3840 | neuregulin 1 |
| NRG1 | 3084 | NP_039258 | 3841 | neuregulin 1 |
| NRG2 | 9542 | NP_004874 | 3158 | neuregulin 2 |
| NRG2 | 9542 | NP_053584 | 3845 | neuregulin 2 |
| NRG2 | 9542 | NP_053585 | 3846 | neuregulin 2 |
| NRG2 | 9542 | NP_053586 | 3847 | neuregulin 2 |
| NRG3 | 10718 | NP_001010848 | 569 | neuregulin 3 |
| NRG3 | 10718 | NP_001159444 | 2135 | neuregulin 3 |
| NRG3 | 10718 | NP_001159445 | 2136 | neuregulin 3 |
| NRG4 | 145957 | NP_612640 | 5761 | neuregulin 4 |
| NRK | 203447 | NP_940867 | 6797 | Nik related kinase |
| NRM | 11270 | NP_009174 | 3658 | nurim (nuclear envelope membrane protein) |
| NRP1 | 8829 | NP_001019799 | 680 | neuropilin 1 |
| NRP1 | 8829 | NP_001019800 | 681 | neuropilin 1 |
| NRP1 | 8829 | NP_003864 | 2923 | neuropilin 1 |
| NRP2 | 8828 | NP_003863 | 2922 | neuropilin 2 |
| NRP2 | 8828 | NP_061004 | 4464 | neuropilin 2 |
| NRP2 | 8828 | NP_957716 | 6892 | neuropilin 2 |
| NRP2 | 8828 | NP_957718 | 6893 | neuropilin 2 |
| NRP2 | 8828 | NP_957719 | 6894 | neuropilin 2 |
| NRP2 | 8828 | NP_958436 | 6895 | neuropilin 2 |
| NRROS | 375387 | NP_940967 | 6817 | leucine rich repeat containing 33 |
| NRSN1 | 140767 | NP_542454 | 5624 | neurensin 1 |
| NRSN2 | 80023 | NP_079234 | 5108 | neurensin 2 |
| NRXN1 | 9378 | NP_001129131 | 1545 | neurexin 1 |
| NRXN1 | 9378 | NP_004792 | 3131 | neurexin 1 |
| NRXN1 | 9378 | NP_620072 | 5783 | neurexin 1 |
| NRXN2 | 9379 | NP_055895 | 4030 | neurexin 2 |
| NRXN2 | 9379 | NP_620060 | 5781 | neurexin 2 |
| NRXN2 | 9379 | NP_620063 | 5782 | neurexin 2 |
| NRXN3 | 9369 | NP_001098720 | 1222 | neurexin 3 |
| NRXN3 | 9369 | NP_004787 | 3129 | neurexin 3 |
| NRXN3 | 9369 | NP_620426 | 5810 | neurexin 3 |
| NSDHL | 50814 | NP_001123237 | 1383 | NAD(P) dependent steroid dehydrogenase-like |
| NSDHL | 50814 | NP_057006 | 4136 | NAD(P) dependent steroid dehydrogenase-like |
| NSG1 | 27065 | NP_001035190 | 832 | DNA segment on chromosome 4 (unique) 234 expressed sequence |
| NSG1 | 27065 | NP_055207 | 3929 | DNA segment on chromosome 4 (unique) 234 expressed sequence |
| NT5C3A | 51251 | NP_001002009 | 385 | 5'-nucleotidase, cytosolic III |
| NT5C3A | 51251 | NP_001002010 | 386 | 5'-nucleotidase, cytosolic III |
| NT5C3A | 51251 | NP_001159590 | 2150 | 5'-nucleotidase, cytosolic III |
| NT5C3A | 51251 | NP_057573 | 4227 | 5'-nucleotidase, cytosolic III |
| NT5E | 4907 | NP_002517 | 2666 | 5'-nucleotidase, ecto (CD73) |
| NTF3 | 4908 | NP_001096124 | 1211 | neurotrophin 3 |
| NTF3 | 4908 | NP_002518 | 2667 | neurotrophin 3 |
| NTM | 50863 | NP_001041674 | 929 | neurotrimin |

FIG. 2 (CONT.)

| Antigen | GeneID | Accession No. | SEQ ID NO: | RefSeq Gene Name |
|---|---|---|---|---|
| NTM | 50863 | NP_001137530 | 1766 | neurotrimin |
| NTM | 50863 | NP_001137531 | 1767 | neurotrimin |
| NTM | 50863 | NP_057606 | 4234 | neurotrimin |
| NTN1 | 9423 | NP_004813 | 3138 | netrin 1 |
| NTN4 | 59277 | NP_067052 | 4798 | netrin 4 |
| NTRK1 | 4914 | NP_001007793 | 525 | neurotrophic tyrosine kinase, receptor, type 1 |
| NTRK1 | 4914 | NP_001012331 | 592 | neurotrophic tyrosine kinase, receptor, type 1 |
| NTRK1 | 4914 | NP_002520 | 2668 | neurotrophic tyrosine kinase, receptor, type 1 |
| NTRK2 | 4915 | NP_001007098 | 506 | neurotrophic tyrosine kinase, receptor, type 2 |
| NTRK2 | 4915 | NP_001018074 | 665 | neurotrophic tyrosine kinase, receptor, type 2 |
| NTRK2 | 4915 | NP_001018075 | 666 | neurotrophic tyrosine kinase, receptor, type 2 |
| NTRK2 | 4915 | NP_001018076 | 667 | neurotrophic tyrosine kinase, receptor, type 2 |
| NTRK2 | 4915 | NP_006171 | 3451 | neurotrophic tyrosine kinase, receptor, type 2 |
| NTRK3 | 4916 | NP_001007157 | 507 | neurotrophic tyrosine kinase, receptor, type 3 |
| NTRK3 | 4916 | NP_001012338 | 593 | neurotrophic tyrosine kinase, receptor, type 3 |
| NTRK3 | 4916 | NP_002521 | 2669 | neurotrophic tyrosine kinase, receptor, type 3 |
| NTSR1 | 4923 | NP_002522 | 2670 | neurotensin receptor 1 (high affinity) |
| NTSR2 | 23620 | NP_036476 | 3753 | neurotensin receptor 2 |
| NUCB1 | 4924 | NP_006175 | 3453 | nucleobindin 1 |
| NUCB2 | 4925 | NP_005004.1 | 7278 | nucleobindin 2 |
| NUDC | 10726 | NP_006591 | 3526 | nuclear distribution gene C Homolog (A. nidulans) |
| NUP210 | 23225 | NP_079199 | 5103 | nucleoporin 210kDa |
| NUP210L | 91181 | NP_001152956 | 1943 | nucleoporin 210kDa-like |
| NUP210L | 91181 | NP_997191 | 7005 | nucleoporin 210kDa-like |
| NUP50 | 10762 | NP_009103 | 3643 | nucleoporin 50kDa |
| NUP50 | 10762 | NP_705931 | 6208 | nucleoporin 50kDa |
| NXPE1 | 120400 | NP_689528 | 6032 | family with sequence similarity 55, member A |
| NXPE3 | 91775 | NP_001127928 | 1495 | family with sequence similarity 55, member C |
| NXPE3 | 91775 | NP_659474 | 5922 | family with sequence similarity 55, member C |
| NXPE4 | 54827 | NP_001071107 | 975 | family with sequence similarity 55, member D |
| NXPE4 | 54827 | NP_060148 | 4322 | family with sequence similarity 55, member D |
| NYX | 60506 | NP_072089 | 4930 | nyctalopin |
| OAS1 | 4938 | NP_001027581.1 | 7354 | 2'-5'-oligoadenylate synthetase 1 |
| OCA2 | 4948 | NP_000266 | 80 | oculocutaneous albinism II |
| OCEL1 | 79629 | NP_078854 | 5051 | occludin/ELL domain containing 1 |
| OCIAD1 | 54940 | NP_001073308 | 999 | OCIA domain containing 1 |
| OCIAD1 | 54940 | NP_001073309 | 1000 | OCIA domain containing 1 |
| OCIAD1 | 54940 | NP_001073310 | 1001 | OCIA domain containing 1 |
| OCIAD1 | 54940 | NP_001073311 | 1002 | OCIA domain containing 1 |
| OCIAD1 | 54940 | NP_001161726 | 2212 | OCIA domain containing 1 |
| OCIAD1 | 54940 | NP_060300 | 4351 | OCIA domain containing 1 |
| OCLM | 10896 | NP_071770 | 4910 | oculomedin |
| ODF4 | 146852 | NP_694552 | 6148 | outer dense fiber of sperm tails 4 |
| OGFOD3 | 79701 | NP_078924 | 5064 | chromosome 17 open reading frame 101 |
| OGFOD3 | 79701 | NP_787098 | 6467 | chromosome 17 open reading frame 101 |
| OLFML2B | 25903 | NP_056256 | 4083 | olfactomedin-like 2B |
| OLR1 | 4973 | NP_002534 | 2671 | oxidized low density lipoprotein (lectin-like) receptor 1 |
| OMA1 | 115209 | NP_660286 | 5938 | OMA1 Homolog, zinc metallopeptidase (S. cerevisiae) |
| OMG | 4974 | NP_002535 | 2672 | oligodendrocyte myelin glycoprotein |
| OPALIN | 93377 | NP_001035191 | 833 | oligodendrocytic myelin paranodal and inner loop protein |
| OPALIN | 93377 | NP_001035192 | 834 | oligodendrocytic myelin paranodal and inner loop protein |
| OPALIN | 93377 | NP_149984 | 5469 | oligodendrocytic myelin paranodal and inner loop protein |
| OPCML | 4978 | NP_001012393 | 594 | opioid binding protein/cell adhesion molecule-like |
| OPCML | 4978 | NP_002536 | 2673 | opioid binding protein/cell adhesion molecule-like |
| OPN1SW | 611 | NP_001699 | 2441 | opsin 1 (cone pigments), short-wave-sensitive |
| OPN3 | 23596 | NP_055137 | 3914 | opsin 3 |
| OPN4 | 94233 | NP_001025186 | 713 | opsin 4 |
| OPN4 | 94233 | NP_150598 | 5480 | opsin 4 |
| OPN5 | 221391 | NP_859528.1 | 714 | opsin 5 |
| OPN5 | 221391 | NP_859528 | 6627 | opsin 5 |
| OPRD1 | 4985 | NP_000902 | 324 | opioid receptor, delta 1 |
| OPRK1 | 4986 | NP_000903 | 325 | opioid receptor, kappa 1 |
| OPRL1 | 4987 | NP_000904 | 326 | opiate receptor-like 1 |
| OPRL1 | 4987 | NP_872588 | 6670 | opiate receptor-like 1 |
| OPRM1 | 4988 | NP_000905 | 327 | opioid receptor, mu 1 |
| OPRM1 | 4988 | NP_001008503 | 541 | opioid receptor, mu 1 |
| OPRM1 | 4988 | NP_001008504 | 542 | opioid receptor, mu 1 |
| OPRM1 | 4988 | NP_001008505 | 543 | opioid receptor, mu 1 |
| OPRM1 | 4988 | NP_001138751 | 1833 | opioid receptor, mu 1 |
| OPRM1 | 4988 | NP_001138752 | 1834 | opioid receptor, mu 1 |
| OPRM1 | 4988 | NP_001138753 | 1835 | opioid receptor, mu 1 |
| OPRM1 | 4988 | NP_001138754 | 1836 | opioid receptor, mu 1 |
| OPRM1 | 4988 | NP_001138755 | 1837 | opioid receptor, mu 1 |
| OPRM1 | 4988 | NP_001138756 | 1838 | opioid receptor, mu 1 |
| OPRM1 | 4988 | NP_001138757 | 1839 | opioid receptor, mu 1 |
| OPRM1 | 4988 | NP_001138758 | 1840 | opioid receptor, mu 1 |
| OPRM1 | 4988 | NP_001138759 | 1841 | opioid receptor, mu 1 |

FIG. 2 (CONT.)

| Antigen | GeneID | Accession No. | SEQ ID NO: | RefSeq Gene Name |
|---|---|---|---|---|
| OR10A3 | 26496 | NP_001003745 | 422 | olfactory receptor, family 10, subfamily A, member 3 |
| OR10A4 | 283297 | NP_997069 | 7002 | olfactory receptor, family 10, subfamily A, member 4 |
| OR10A5 | 144124 | NP_835462 | 6525 | olfactory receptor, family 10, subfamily A, member 5 |
| OR10C1 | 442194 | NP_039229 | 3832 | olfactory receptor, family 10, subfamily C, member 1 |
| OR10H1 | 26539 | NP_039228 | 3831 | olfactory receptor, family 10, subfamilyH, member 1 |
| OR10H2 | 26538 | NP_039227 | 3830 | olfactory receptor, family 10, subfamilyH, member 2 |
| OR10H3 | 26532 | NP_039226 | 3829 | olfactory receptor, family 10, subfamilyH, member 3 |
| OR10J1 | 26476 | NP_036483 | 3754 | olfactory receptor, family 10, subfamily J, member 1 |
| OR11A1 | 26531 | NP_039225 | 3828 | olfactory receptor, family 11, subfamily A, member 1 |
| OR12D2 | 26529 | NP_039224 | 3827 | olfactory receptor, family 12, subfamily D, member 2 |
| OR12D3 | 81797 | NP_112221.1 | 5182 | olfactory receptor, family 12, subfamily D, member 3 |
| OR12D3 | 81797 | NP_112221 | 5204 | olfactory receptor, family 12, subfamily D, member 3 |
| OR14J1 | 442191 | NP_112208 | 5200 | olfactory receptor, family 14, subfamily J, member 1 |
| OR1A1 | 8383 | NP_055380 | 3956 | olfactory receptor, family 1, subfamily A, member 1 |
| OR1A2 | 26189 | NP_036484 | 3755 | olfactory receptor, family 1, subfamily A, member 2 |
| OR1C1 | 26188 | NP_036485 | 3756 | olfactory receptor, family 1, subfamily C, member 1 |
| OR1D2 | 4991 | NP_002539 | 2674 | olfactory receptor, family 1, subfamily D, member 2 |
| OR1F1 | 4992 | NP_036492 | 3757 | olfactory receptor, family 1, subfamily F, member 1 |
| OR1G1 | 8390 | NP_003546 | 2847 | olfactory receptor, family 1, subfamily G, member 1 |
| OR1I1 | 126370 | NP_001004713 | 439 | olfactory receptor, family 1, subfamily I, member 1 |
| OR1J2 | 26740 | NP_473448 | 5573 | olfactory receptor, family 1, subfamily J, member 2 |
| OR1J4 | 26219 | NP_001004452 | 436 | olfactory receptor, family 1, subfamily J, member 4 |
| OR1Q1 | 158131 | NP_036496 | 3758 | olfactory receptor, family 1, subfamily Q, member 1 |
| OR2B2 | 81697 | NP_149046 | 5446 | olfactory receptor, family 2, subfamily B, member 2 |
| OR2B3 | 442184 | NP_001005226 | 450 | olfactory receptor, family 2, subfamily B, member 3 |
| OR2B6 | 26212 | NP_036499 | 3759 | olfactory receptor, family 2, subfamily B, member 6 |
| OR2C1 | 4993 | NP_036500 | 3760 | olfactory receptor, family 2, subfamily C, member 1 |
| OR2C3 | 81472 | NP_932340 | 6739 | olfactory receptor, family 2, subfamily C, member 3 |
| OR2F1 | 26211 | NP_036501 | 3761 | olfactory receptor, family 2, subfamily F, member 1 |
| OR2F2 | 135948 | NP_001004685 | 437 | olfactory receptor, family 2, subfamily F, member 2 |
| OR2H1 | 26716 | NP_112145 | 5185 | olfactory receptor, family 2, subfamilyH, member 1 |
| OR2H2 | 7932 | NP_009091 | 3636 | olfactory receptor, family 2, subfamilyH, member 2 |
| OR2J2 | 26707 | NP_112167 | 5190 | olfactory receptor, family 2, subfamily J, member 2 |
| OR2K2 | 26248 | NP_995581 | 6962 | olfactory receptor, family 2, subfamily K, member 2 |
| OR2L13 | 284521 | NP_787107 | 6468 | olfactory receptor, family 2, subfamily L, member 13 |
| OR2L2 | 26246 | NP_001004686 | 438 | olfactory receptor, family 2, subfamily L, member 2 |
| OR2M4 | 26245 | NP_059974 | 4297 | olfactory receptor, family 2, subfamily M, member 4 |
| OR2S2 | 56656 | NP_063950.2 | 7385 | olfactory receptor family 2 subfamily S member 2 (gene/pseudogene) |
| OR2W1 | 26692 | NP_112165 | 5189 | olfactory receptor, family 2, subfamily W, member 1 |
| OR3A1 | 4994 | NP_002541 | 2675 | olfactory receptor, family 3, subfamily A, member 1 |
| OR3A2 | 4995 | NP_002542 | 2676 | olfactory receptor, family 3, subfamily A, member 2 |
| OR3A3 | 8392 | NP_036505 | 3762 | olfactory receptor, family 3, subfamily A, member 3 |
| OR4D1 | 26689 | NP_036506 | 3763 | olfactory receptor, family 4, subfamily D, member 1 |
| OR4N4 | 283694 | NP_001005241 | 451 | olfactory receptor, family 4, subfamily N, member 4 |
| OR51B2 | 79345 | NP_149420 | 5463 | olfactory receptor, family 51, subfamily B, member 2 |
| OR51B4 | 79339 | NP_149419 | 5462 | olfactory receptor, family 51, subfamily B, member 4 |
| OR51B5 | 282763 | NP_001005567 | 463 | olfactory receptor, family 51, subfamily B, member 5 |
| OR51B6 | 390058 | NP_001004750 | 441 | olfactory receptor, family 51, subfamily B, member 6 |
| OR51E1 | 143503 | NP_689643.2 | 7395 | olfactory receptor family 51 subfamily E member 1 |
| OR51E2 | 81285 | NP_110401 | 5168 | olfactory receptor, family 51, subfamily E, member 2 |
| OR51I1 | 390063 | NP_001005288 | 453 | olfactory receptor, family 51, subfamily I, member 1 |
| OR51I2 | 390064 | NP_001004754 | 442 | olfactory receptor, family 51, subfamily I, member 2 |
| OR51M1 | 390059 | NP_001004756 | 443 | olfactory receptor, family 51, subfamily M, member 1 |
| OR52A1 | 23538 | NP_036507 | 3764 | olfactory receptor, family 52, subfamily A, member 1 |
| OR52D1 | 390066 | NP_001005163 | 444 | olfactory receptor, family 52, subfamily D, member 1 |
| OR5I1 | 10798 | NP_006628 | 3533 | olfactory receptor, family 5, subfamily I, member 1 |
| OR5J2 | 282775 | NP_001005492 | 460 | olfactory receptor, family 5, subfamily J, member 2 |
| OR5K1 | 26339 | NP_001004736 | 440 | olfactory receptor, family 5, subfamily K, member 1 |
| OR5L2 | 26338 | NP_001004739.1 | 7337 | olfactory receptor family 5 subfamily L member 2 |
| OR5P2 | 120065 | NP_703145 | 6191 | olfactory receptor, family 5, subfamily P, member 2 |
| OR5P3 | 120066 | NP_703146 | 6192 | olfactory receptor, family 5, subfamily P, member 3 |
| OR5V1 | 81696 | NP_110503 | 5183 | olfactory receptor, family 12, subfamily D, member 3 |
| OR5V1 | 81696 | NP_110503.3 | 5205 | olfactory receptor, family 12, subfamily D, member 3 |
| OR6A2 | 8590 | NP_003687.2 | 7329 | olfactory receptor family 6 subfamily A member 2 |
| OR6B1 | 135946 | NP_001005281 | 452 | olfactory receptor, family 6, subfamily B, member 1 |
| OR7A10 | 390892 | NP_001005190 | 445 | olfactory receptor, family 7, subfamily A, member 10 |
| OR7A17 | 26333 | NP_112163 | 5188 | olfactory receptor, family 7, subfamily A, member 17 |
| OR7A5 | 26659 | NP_059976 | 4298 | olfactory receptor, family 7, subfamily A, member 5 |
| OR7C1 | 26664 | NP_945182 | 6846 | olfactory receptor, family 7, subfamily C, member 1 |
| OR7C2 | 26658 | NP_036509 | 3765 | olfactory receptor, family 7, subfamily C, member 2 |
| OR7D2 | 162998 | NP_787079 | 6465 | olfactory receptor, family 7, subfamily D, member 2 |
| OR8B2 | 26595 | NP_001005468 | 459 | olfactory receptor, family 8, subfamily B, member 2 |
| OR8B8 | 26493 | NP_036510 | 3766 | olfactory receptor, family 8, subfamily B, member 8 |
| OR8D1 | 283159 | NP_001002917 | 406 | olfactory receptor, family 8, subfamily D, member 1 |
| OR8D2 | 283160 | NP_001002918 | 407 | olfactory receptor, family 8, subfamily D, member 2 |
| OR8G1 | 26494 | NP_001002905 | 405 | olfactory receptor, family 8, subfamily G, member 5, olfactory receptor, family 8, subfamily G, member 1 |
| OR8G1 | 26494 | NP_001005198 | 446 | olfactory receptor, family 8, subfamily G, member 5, olfactory receptor, family 8, subfamily G, member 1 |

FIG. 2 (CONT.)

| Antigen | GeneID | Accession No. | SEQ ID NO: | RefSeq Gene Name |
|---|---|---|---|---|
| ORAI1 | 84876 | NP_116179.2 | 7330 | ORAI calcium release-activated calcium modulator 1 |
| ORAI2 | 80228 | NP_001119812 | 1306 | ORAI calcium release-activated calcium modulator 2 |
| ORAI2 | 80228 | NP_116220 | 5413 | ORAI calcium release-activated calcium modulator 2 |
| ORAI3 | 93129 | NP_689501 | 6026 | ORAI calcium release-activated calcium modulator 3 |
| ORMDL1 | 94101 | NP_001121622 | 1363 | ORM1-like 1 (S. cerevisiae) |
| ORMDL1 | 94101 | NP_057551 | 4224 | ORM1-like 1 (S. cerevisiae) |
| ORMDL2 | 29095 | NP_054901 | 3876 | ORM1-like 2 (S. cerevisiae) |
| ORMDL3 | 94103 | NP_644809 | 5851 | ORM1-like 3 (S. cerevisiae) |
| OS9 | 10956 | NP_001017956 | 650 | osteosarcoma amplified 9, endoplasmic reticulum associated protein |
| OS9 | 10956 | NP_001017957 | 651 | osteosarcoma amplified 9, endoplasmic reticulum associated protein |
| OS9 | 10956 | NP_001017958 | 652 | osteosarcoma amplified 9, endoplasmic reticulum associated protein |
| OS9 | 10956 | NP_006803 | 3569 | osteosarcoma amplified 9, endoplasmic reticulum associated protein |
| OSBPL8 | 114882 | NP_001003712 | 419 | oxysterol binding protein-like 8 |
| OSBPL8 | 114882 | NP_065892 | 4730 | oxysterol binding protein-like 8 |
| OSMR | 9180 | NP_001161827 | 2220 | oncostatin M receptor |
| OSMR | 9180 | NP_003990 | 2943 | oncostatin M receptor |
| OST4 | 100128731 | NP_001128165 | 1503 | dolichyl-diphosphooligosaccharide--protein glycosyltransferase subunit 4 |
| OSTC | 58505 | NP_067050 | 4797 | oligosaccharyltransferase complex subunit |
| OSTM1 | 28962 | NP_054747 | 3857 | osteopetrosis associated transmembrane protein 1 |
| OTOF | 9381 | NP_004793 | 3132 | otoferlin |
| OTOF | 9381 | NP_919224 | 6710 | otoferlin |
| OTOF | 9381 | NP_919303 | 6719 | otoferlin |
| OTOF | 9381 | NP_919304 | 6720 | otoferlin |
| OTOR | 56914 | NP_064542 | 4607 | otoraplin |
| OXA1L | 5018 | NP_005006 | 3197 | oxidase (cytochrome c) assembly 1-like |
| OXER1 | 165140 | NP_683765 | 6011 | oxoeicosanoid (OXE) receptor 1 |
| OXGR1 | 27199 | NP_543008 | 5632 | oxoglutarate (alpha-ketoglutarate) receptor 1 |
| OXTR | 5021 | NP_000907.2 | 7326 | oxytocin receptor |
| P2RX1 | 5023 | NP_002549 | 2678 | purinergic receptor P2X, ligand-gated ion channel, 1 |
| P2RX2 | 22953 | NP_036358 | 3724 | purinergic receptor P2X, ligand-gated ion channel, 2 |
| P2RX2 | 22953 | NP_057402 | 4202 | purinergic receptor P2X, ligand-gated ion channel, 2 |
| P2RX2 | 22953 | NP_733782 | 6246 | purinergic receptor P2X, ligand-gated ion channel, 2 |
| P2RX2 | 22953 | NP_733783 | 6247 | purinergic receptor P2X, ligand-gated ion channel, 2 |
| P2RX2 | 22953 | NP_777361 | 6400 | purinergic receptor P2X, ligand-gated ion channel, 2 |
| P2RX2 | 22953 | NP_777362 | 6401 | purinergic receptor P2X, ligand-gated ion channel, 2 |
| P2RX3 | 5024 | NP_002550.2 | 7323 | purinergic receptor P2X 3 |
| P2RX4 | 5025 | NP_002551 | 2679 | purinergic receptor P2X, ligand-gated ion channel, 4 |
| P2RX5 | 5026 | NP_002552 | 2680 | purinergic receptor P2X, ligand-gated ion channel, 5 |
| P2RX5 | 5026 | NP_778255 | 6441 | purinergic receptor P2X, ligand-gated ion channel, 5 |
| P2RX5 | 5026 | NP_778256 | 6442 | purinergic receptor P2X, ligand-gated ion channel, 5 |
| P2RX6 | 9127 | NP_001153026 | 1945 | purinergic receptor P2X, ligand-gated ion channel, 6 |
| P2RX6 | 9127 | NP_005437 | 3286 | purinergic receptor P2X, ligand-gated ion channel, 6 |
| P2RX7 | 5027 | NP_002553 | 2681 | purinergic receptor P2X, ligand-gated ion channel, 7 |
| P2RY1 | 5028 | NP_002554 | 2682 | purinergic receptor P2Y, G-protein coupled, 1 |
| P2RY10 | 27334 | NP_055314 | 3948 | purinergic receptor P2Y, G-protein coupled, 10 |
| P2RY10 | 27334 | NP_938147 | 6769 | purinergic receptor P2Y, G-protein coupled, 10 |
| P2RY12 | 64805 | NP_073625 | 4946 | purinergic receptor P2Y, G-protein coupled, 12 |
| P2RY12 | 64805 | NP_795345 | 6482 | purinergic receptor P2Y, G-protein coupled, 12 |
| P2RY13 | 53829 | NP_795713.2 | 7394 | purinergic receptor P2Y13 |
| P2RY14 | 9934 | NP_001074924 | 1049 | purinergic receptor P2Y, G-protein coupled, 14 |
| P2RY14 | 9934 | NP_055694 | 4006 | purinergic receptor P2Y, G-protein coupled, 14 |
| P2RY2 | 5029 | NP_002555 | 2683 | purinergic receptor P2Y, G-protein coupled, 2 |
| P2RY2 | 5029 | NP_788085 | 6473 | purinergic receptor P2Y, G-protein coupled, 2 |
| P2RY2 | 5029 | NP_788086 | 6474 | purinergic receptor P2Y, G-protein coupled, 2 |
| P2RY4 | 5030 | NP_002556 | 2684 | pyrimidinergic receptor P2Y, G-protein coupled, 4 |
| P2RY6 | 5031 | NP_001264133.1 | 2974 | pyrimidinergic receptor P2Y, G-protein coupled, 6 |
| P2RY6 | 5031 | NP_789766 | 6477 | pyrimidinergic receptor P2Y, G-protein coupled, 6 |
| P2RY6 | 5031 | NP_789767 | 6478 | pyrimidinergic receptor P2Y, G-protein coupled, 6 |
| P2RY6 | 5031 | NP_789768 | 6479 | pyrimidinergic receptor P2Y, G-protein coupled, 6 |
| P2RY8 | 286530 | NP_835230 | 6518 | purinergic receptor P2Y, G-protein coupled, 8 |
| P4HA2 | 8974 | NP_001017973 | 656 | prolyl 4-hydroxylase, alpha polypeptide II |
| P4HA2 | 8974 | NP_001017974 | 657 | prolyl 4-hydroxylase, alpha polypeptide II |
| P4HA2 | 8974 | NP_001136070 | 1675 | prolyl 4-hydroxylase, alpha polypeptide II |
| P4HA2 | 8974 | NP_001136071 | 1676 | prolyl 4-hydroxylase, alpha polypeptide II |
| P4HA2 | 8974 | NP_004190 | 2985 | prolyl 4-hydroxylase, alpha polypeptide II |
| P4HTM | 54681 | NP_808807 | 6503 | prolyl 4-hydroxylase, transmembrane (endoplasmic reticulum) |
| P4HTM | 54681 | NP_808808 | 6504 | prolyl 4-hydroxylase, transmembrane (endoplasmic reticulum) |
| PAAF1 | 80227 | NP_079431 | 5128 | proteasomal ATPase-associated factor 1 |
| PACRG | 135138 | NP_001073847 | 1015 | PARK2 co-regulated |
| PACRG | 135138 | NP_001073848 | 1016 | PARK2 co-regulated |
| PACRG | 135138 | NP_689623 | 6055 | PARK2 co-regulated |
| PAG1 | 55824 | NP_060910 | 4450 | phosphoprotein associated with glycosphingolipid microdomains 1 |
| PAM | 5066 | NP_000910 | 328 | peptidylglycine alpha-amidating monooxygenase |
| PAM | 5066 | NP_620121 | 5790 | peptidylglycine alpha-amidating monooxygenase |
| PAM | 5066 | NP_620176 | 5803 | peptidylglycine alpha-amidating monooxygenase |
| PAM | 5066 | NP_620177 | 5804 | peptidylglycine alpha-amidating monooxygenase |
| PANX1 | 24145 | NP_056183 | 4070 | pannexin 1 |

FIG. 2 (CONT.)

| Antigen | GeneID | Accession No. | SEQ ID NO: | RefSeq Gene Name |
|---|---|---|---|---|
| PANX2 | 56666 | NP_001153772 | 1988 | pannexin 2 |
| PANX2 | 56666 | NP_443071 | 5517 | pannexin 2 |
| PANX3 | 116337 | NP_443191 | 5551 | pannexin 3 |
| PAQR3 | 152559 | NP_001035292 | 863 | progestin and adipoQ receptor family member III |
| PAQR4 | 124222 | NP_689554 | 6036 | progestin and adipoQ receptor family member IV |
| PAQR5 | 54852 | NP_001098024 | 1215 | progestin and adipoQ receptor family member V |
| PAQR5 | 54852 | NP_060175 | 4326 | progestin and adipoQ receptor family member V |
| PAQR6 | 79957 | NP_079173 | 5099 | progestin and adipoQ receptor family member VI |
| PAQR6 | 79957 | NP_940798 | 6793 | progestin and adipoQ receptor family member VI |
| PAQR7 | 164091 | NP_848509 | 6539 | progestin and adipoQ receptor family member VII |
| PAQR8 | 85315 | NP_588608 | 5689 | progestin and adipoQ receptor family member VIII |
| PAQR9 | 344838 | NP_940906 | 6804 | progestin and adipoQ receptor family member IX |
| PARL | 55486 | NP_001032728 | 780 | presenilin associated, rhomboid-like |
| PARL | 55486 | NP_061092 | 4471 | presenilin associated, rhomboid-like |
| PARM1 | 25849 | NP_056208 | 4076 | DKFZP564O0823 protein |
| PARP16 | 54956 | NP_060321 | 4357 | poly (ADP-ribose) polymerase family, member 16 |
| PCDH1 | 5097 | NP_002578 | 2686 | protocadherin 1 |
| PCDH1 | 5097 | NP_115796 | 5353 | protocadherin 1 |
| PCDH10 | 57575 | NP_065866 | 4727 | protocadherin 10 |
| PCDH10 | 57575 | NP_116586 | 5428 | protocadherin 10 |
| PCDH11X | 27328 | NP_001161832 | 2221 | protocadherin 11 X-linked |
| PCDH11X | 27328 | NP_001161833 | 2222 | protocadherin 11 X-linked |
| PCDH11X | 27328 | NP_001161834 | 2223 | protocadherin 11 X-linked |
| PCDH11X | 27328 | NP_001161835 | 2224 | protocadherin 11 X-linked |
| PCDH11X | 27328 | NP_001161832.1 | 3953 | protocadherin 11 X-linked |
| PCDH11X | 27328 | NP_116750.1 | 5429 | protocadherin 11 X-linked |
| PCDH11X | 27328 | NP_116750 | 5430 | protocadherin 11 X-linked |
| PCDH11X | 27328 | NP_116751 | 5431 | protocadherin 11 X-linked |
| PCDH11Y | 83259 | NP_001265548.1 | 7437 | protocadherin 11 Y-linked |
| PCDH12 | 51294 | NP_057664 | 4250 | protocadherin 12 |
| PCDH15 | 65217 | NP_001136235 | 1688 | protocadherin 15 |
| PCDH15 | 65217 | NP_001136236 | 1689 | protocadherin 15 |
| PCDH15 | 65217 | NP_001136237 | 1690 | protocadherin 15 |
| PCDH15 | 65217 | NP_001136238 | 1691 | protocadherin 15 |
| PCDH15 | 65217 | NP_001136239 | 1692 | protocadherin 15 |
| PCDH15 | 65217 | NP_001136240 | 1693 | protocadherin 15 |
| PCDH15 | 65217 | NP_001136241 | 1694 | protocadherin 15 |
| PCDH15 | 65217 | NP_001136242 | 1695 | protocadherin 15 |
| PCDH15 | 65217 | NP_001136243 | 1696 | protocadherin 15 |
| PCDH15 | 65217 | NP_001136244 | 1697 | protocadherin 15 |
| PCDH15 | 65217 | NP_001136245 | 1698 | protocadherin 15 |
| PCDH15 | 65217 | NP_149045 | 5445 | protocadherin 15 |
| PCDH17 | 27253 | NP_001035519 | 866 | protocadherin 17 |
| PCDH18 | 54510 | NP_061908 | 4552 | protocadherin 18 |
| PCDH19 | 57526 | NP_001098713 | 1218 | protocadherin 19 |
| PCDH19 | 57526 | NP_065817 | 4718 | protocadherin 19 |
| PCDH20 | 64881 | NP_073754 | 4955 | protocadherin 20 |
| PCDH7 | 5099 | NP_002580.2 | 7303 | protocadherin 7 |
| PCDH8 | 5100 | NP_002581 | 2690 | protocadherin 8 |
| PCDH8 | 5100 | NP_116567 | 5427 | protocadherin 8 |
| PCDH9 | 5101 | NP_065136 | 4648 | protocadherin 9 |
| PCDH9 | 5101 | NP_982354 | 6947 | protocadherin 9 |
| PCDHA10 | 56139 | NP_061724.1 | 4497 | protocadherin alpha 13, protocadherin alpha 10, protocadherin alpha subfamily C, 1, C, 2 |
| PCDHA10 | 56139 | NP_061724.1 | 4500 | protocadherin alpha 13, protocadherin alpha 10, protocadherin alpha subfamily C, 1, C, 2 |
| PCDHA10 | 56139 | NP_061724.1 | 4503 | protocadherin alpha 13, protocadherin alpha 10, protocadherin alpha subfamily C, 1, C, 2 |
| PCDHA10 | 56139 | NP_061727.1 | 4506 | protocadherin alpha 13, protocadherin alpha 10, protocadherin alpha subfamily C, 1, C, 2 |
| PCDHA10 | 56139 | NP_114065 | 5243 | protocadherin alpha 13, protocadherin alpha 10, protocadherin alpha subfamily C, 1, C, 2 |
| PCDHA10 | 56139 | NP_114065.1 | 5246 | protocadherin alpha 13, protocadherin alpha 10, protocadherin alpha subfamily C, 1, C, 2 |
| PCDHA10 | 56139 | NP_114071 | 5249 | protocadherin alpha 13, protocadherin alpha 10, protocadherin alpha subfamily C, 1, C, 2 |
| PCDHA10 | 56139 | NP_114088 | 5253 | protocadherin alpha 13, protocadherin alpha 10, protocadherin alpha subfamily C, 1, C, 2 |
| PCDHA10 | 56139 | NP_114089 | 5256 | protocadherin alpha 13, protocadherin alpha 10, protocadherin alpha subfamily C, 1, C, 2 |
| PCDHA2 | 56146 | NP_061728 | 4509 | protocadherin alpha 2 |
| PCDHA2 | 56146 | NP_113683 | 5236 | protocadherin alpha 2 |
| PCDHA5 | 56143 | NP_061731 | 4510 | protocadherin alpha 5 |
| PCDHA5 | 56143 | NP_113689 | 5237 | protocadherin alpha 5 |
| PCDHA6 | 56142 | NP_061732 | 4511 | protocadherin alpha 8 protocadherin alpha 6 |
| PCDHA6 | 56142 | NP_061734 | 4512 | protocadherin alpha 8 protocadherin alpha 6 |
| PCDHA6 | 56142 | NP_114036 | 5238 | protocadherin alpha 8 protocadherin alpha 6 |
| PCDHA6 | 56142 | NP_114037 | 5239 | protocadherin alpha 8 protocadherin alpha 6 |
| PCDHA6 | 56142 | NP_114062 | 5241 | protocadherin alpha 8 protocadherin alpha 6 |
| PCDHA9 | 9752 | NP_054724 | 3852 | protocadherin alpha 9 |
| PCDHA9 | 9752 | NP_114063 | 5242 | protocadherin alpha 9 |
| PCDHAC1 | 56135 | NP_061721 | 4499 | protocadherin alpha 13, protocadherin alpha 10, protocadherin alpha subfamily C, 1, C, 2 |
| PCDHAC1 | 56135 | NP_061722.1 | 4502 | protocadherin alpha 13, protocadherin alpha 10, protocadherin alpha subfamily C, 1, C, 2 |
| PCDHAC1 | 56135 | NP_061721.2 | 4505 | protocadherin alpha 13, protocadherin alpha 10, protocadherin alpha subfamily C, 1, C, 2 |
| PCDHAC1 | 56135 | NP_061721.2 | 4508 | protocadherin alpha 13, protocadherin alpha 10, protocadherin alpha subfamily C, 1, C, 2 |
| PCDHAC1 | 56135 | NP_061721.2 | 5245 | protocadherin alpha 13, protocadherin alpha 10, protocadherin alpha subfamily C, 1, C, 2 |

FIG. 2 (CONT.)

| Antigen | GeneID | Accession No. | SEQ ID NO: | RefSeq Gene Name |
|---|---|---|---|---|
| PCDHAC1 | 56135 | NP_061721.2 | 5248 | protocadherin alpha 13, protocadherin alpha 10, protocadherin alpha subfamily C, 1, C, 2 |
| PCDHAC1 | 56135 | NP_114088.2 | 5251 | protocadherin alpha 13, protocadherin alpha 10, protocadherin alpha subfamily C, 1, C, 2 |
| PCDHAC1 | 56135 | NP_114088 | 5255 | protocadherin alpha 13, protocadherin alpha 10, protocadherin alpha subfamily C, 1, C, 2 |
| PCDHAC1 | 56135 | NP_114089 | 5258 | protocadherin alpha 13, protocadherin alpha 10, protocadherin alpha subfamily C, 1, C, 2 |
| PCDHAC2 | 56134 | NP_061722.1 | 4498 | protocadherin alpha 13, protocadherin alpha 10, protocadherin alpha subfamily C, 1, C, 2 |
| PCDHAC2 | 56134 | NP_061722.1 | 4501 | protocadherin alpha 13, protocadherin alpha 10, protocadherin alpha subfamily C, 1, C, 2 |
| PCDHAC2 | 56134 | NP_061722.1 | 4504 | protocadherin alpha 13, protocadherin alpha 10, protocadherin alpha subfamily C, 1, C, 2 |
| PCDHAC2 | 56134 | NP_061724.1 | 4507 | protocadherin alpha 13, protocadherin alpha 10, protocadherin alpha subfamily C, 1, C, 2 |
| PCDHAC2 | 56134 | NP_061722.1 | 5244 | protocadherin alpha 13, protocadherin alpha 10, protocadherin alpha subfamily C, 1, C, 2 |
| PCDHAC2 | 56134 | NP_114089.1 | 5247 | protocadherin alpha 13, protocadherin alpha 10, protocadherin alpha subfamily C, 1, C, 2 |
| PCDHAC2 | 56134 | NP_061722.1 | 5250 | protocadherin alpha 13, protocadherin alpha 10, protocadherin alpha subfamily C, 1, C, 2 |
| PCDHAC2 | 56134 | NP_114088 | 5254 | protocadherin alpha 13, protocadherin alpha 10, protocadherin alpha subfamily C, 1, C, 2 |
| PCDHAC2 | 56134 | NP_114089 | 5257 | protocadherin alpha 13, protocadherin alpha 10, protocadherin alpha subfamily C, 1, C, 2 |
| PCDHB1 | 29930 | NP_037472 | 3808 | protocadherin beta 1 |
| PCDHB10 | 56126 | NP_061753 | 4526 | protocadherin beta 10 protocadherin beta 12 |
| PCDHB10 | 56126 | NP_061753.1 | 4570 | protocadherin beta 10 protocadherin beta 11 |
| PCDHB11 | 56125 | NP_061754.1 | 4527 | protocadherin beta 11 |
| PCDHB12 | 56124 | NP_061755 | 4528 | protocadherin beta 12 |
| PCDHB13 | 56123 | NP_061756.1 | 7292 | protocadherin beta 13 |
| PCDHB14 | 56122 | NP_061757 | 4529 | protocadherin beta 14 |
| PCDHB16 | 57717 | NP_066008 | 4746 | protocadherin beta 16 |
| PCDHB2 | 56133 | NP_061759.1 | 7286 | protocadherin beta 2 |
| PCDHB4 | 56131 | NP_061761.1 | 7287 | protocadherin beta 4 |
| PCDHB5 | 26167 | NP_056484 | 4111 | protocadherin beta 5 |
| PCDHB6 | 56130 | NP_061762 | 4530 | protocadherin beta 6 |
| PCDHB7 | 56129 | NP_061763 | 4531 | protocadherin beta 7 |
| PCDHB8 | 56128 | NP_061993.3 | 7450 | protocadherin beta 8 |
| PCDHB9 | 56127 | NP_061753 | 4525 | protocadherin beta 10 protocadherin beta 10 |
| PCDHB9 | 56127 | NP_061992 | 4569 | protocadherin beta 10 protocadherin beta 9 |
| PCDHGA1 | 56114 | NP_061735 | 4513 | protocadherin gamma subfamily A, 1 |
| PCDHGA1 | 56114 | NP_114382 | 5276 | protocadherin gamma subfamily A, 1 |
| PCDHGA10 | 56106 | NP_061736 | 4514 | protocadherin gamma subfamily A, 10 |
| PCDHGA10 | 56106 | NP_114479 | 5289 | protocadherin gamma subfamily A, 10 |
| PCDHGA11 | 56105 | NP_061737 | 4515 | protocadherin gamma subfamily A, 11 |
| PCDHGA11 | 56105 | NP_114480 | 5290 | protocadherin gamma subfamily A, 11 |
| PCDHGA11 | 56105 | NP_114481 | 5291 | protocadherin gamma subfamily A, 11 |
| PCDHGA9 | 56107 | NP_061744 | 4516 | protocadherin gamma subfamily A, 9 |
| PCDHGA9 | 56107 | NP_114478 | 5288 | protocadherin gamma subfamily A, 9 |
| PCDHGB5 | 56101 | NP_061748 | 4517 | protocadherin gamma subfamily B, 5 |
| PCDHGB5 | 56101 | NP_115270 | 5295 | protocadherin gamma subfamily B, 5 |
| PCDHGB6 | 56100 | NP_061749 | 4518 | protocadherin gamma subfamily B, 6 |
| PCDHGB6 | 56100 | NP_115271 | 5296 | protocadherin gamma subfamily B, 6 |
| PCDHGB7 | 56099 | NP_061750.1 | 7293 | protocadherin gamma subfamily B, 7 |
| PCDHGC3 | 5098 | NP_002579 | 2687 | protocadherin gamma subfamily C, 3, C, 5, C, 4, A, 12 |
| PCDHGC3 | 5098 | NP_002579.2 | 2878 | protocadherin gamma subfamily C, 3, C, 5, C, 4, A, 12 |
| PCDHGC3 | 5098 | NP_002579.2 | 4519 | protocadherin gamma subfamily C, 3, C, 5, C, 4, A, 12 |
| PCDHGC3 | 5098 | NP_061752 | 4522 | protocadherin gamma subfamily C, 3, C, 5, C, 4, A, 12 |
| PCDHGC3 | 5098 | NP_002579.2 | 5292 | protocadherin gamma subfamily C, 3, C, 5, C, 4, A, 12 |
| PCDHGC3 | 5098 | NP_002579.2 | 5338 | protocadherin gamma subfamily C, 3, C, 5, C, 4, A, 12 |
| PCDHGC3 | 5098 | NP_002579.2 | 5341 | protocadherin gamma subfamily C, 3, C, 5, C, 4, A, 12 |
| PCDHGC3 | 5098 | NP_115782 | 5345 | protocadherin gamma subfamily C, 3, C, 5, C, 4, A, 12 |
| PCDHGC3 | 5098 | NP_115783 | 5348 | protocadherin gamma subfamily C, 3, C, 5, C, 4, A, 12 |
| PCDHGC4 | 56098 | NP_061751.1 | 2688 | protocadherin gamma subfamily C, 3, C, 5, C, 4, A, 12 |
| PCDHGC4 | 56098 | NP_061751.1 | 2879 | protocadherin gamma subfamily C, 3, C, 5, C, 4, A, 12 |
| PCDHGC4 | 56098 | NP_061751.1 | 4520 | protocadherin gamma subfamily C, 3, C, 5, C, 4, A, 12 |
| PCDHGC4 | 56098 | NP_061752 | 4523 | protocadherin gamma subfamily C, 3, C, 5, C, 4, A, 12 |
| PCDHGC4 | 56098 | NP_061751.1 | 5293 | protocadherin gamma subfamily C, 3, C, 5, C, 4, A, 12 |
| PCDHGC4 | 56098 | NP_061751.1 | 5339 | protocadherin gamma subfamily C, 3, C, 5, C, 4, A, 12 |
| PCDHGC4 | 56098 | NP_061751.1 | 5342 | protocadherin gamma subfamily C, 3, C, 5, C, 4, A, 12 |
| PCDHGC4 | 56098 | NP_115782 | 5346 | protocadherin gamma subfamily C, 3, C, 5, C, 4, A, 12 |
| PCDHGC4 | 56098 | NP_115783 | 5349 | protocadherin gamma subfamily C, 3, C, 5, C, 4, A, 12 |
| PCDHGC5 | 56097 | NP_061752.1 | 2689 | protocadherin gamma subfamily C, 3, C, 5, C, 4, A, 12 |
| PCDHGC5 | 56097 | NP_061752.1 | 2880 | protocadherin gamma subfamily C, 3, C, 5, C, 4, A, 12 |
| PCDHGC5 | 56097 | NP_061751 | 4521 | protocadherin gamma subfamily C, 3, C, 5, C, 4, A, 12 |
| PCDHGC5 | 56097 | NP_061752 | 4524 | protocadherin gamma subfamily C, 3, C, 5, C, 4, A, 12 |
| PCDHGC5 | 56097 | NP_115783.1 | 5294 | protocadherin gamma subfamily C, 3, C, 5, C, 4, A, 12 |
| PCDHGC5 | 56097 | NP_061752.1 | 5340 | protocadherin gamma subfamily C, 3, C, 5, C, 4, A, 12 |
| PCDHGC5 | 56097 | NP_061752.1 | 5343 | protocadherin gamma subfamily C, 3, C, 5, C, 4, A, 12 |
| PCDHGC5 | 56097 | NP_115782 | 5347 | protocadherin gamma subfamily C, 3, C, 5, C, 4, A, 12 |
| PCDHGC5 | 56097 | NP_115783 | 5350 | protocadherin gamma subfamily C, 3, C, 5, C, 4, A, 12 |
| PCGF3 | 10336 | NP_006306 | 3464 | polycomb group ring finger 3 |
| PCLO | 27445 | NP_055325 | 3951 | piccolo (presynaptic cytomatrix protein) |
| PCLO | 27445 | NP_149015 | 5438 | piccolo (presynaptic cytomatrix protein) |
| PCNX | 22990 | NP_055797 | 4023 | pecanexHomolog (Drosophila) |
| PCNXL2 | 80003 | NP_055616 | 3990 | pecanex-like 2 (Drosophila) |
| PCNXL4 | 64430 | NP_071940 | 4928 | chromosome 14 open reading frame 135 |
| PCSK1N | 27344 | NP_037403 | 3792 | proprotein convertase subtilisin/kexin type 1 inhibitor |

FIG. 2 (CONT.)

| Antigen | GeneID | Accession No. | SEQ ID NO: | RefSeq Gene Name |
|---|---|---|---|---|
| PCSK5 | 5125 | NP_006191 | 3454 | proprotein convertase subtilisin/kexin type 5 |
| PCSK7 | 9159 | NP_004707 | 3108 | proprotein convertase subtilisin/kexin type 7 pseudogene |
| PCYT1A | 5130 | NP_001299602.1 | 7455 | phosphate cytidylyltransferase 1, choline, alpha |
| PDCD1 | 5133 | NP_005009 | 3198 | programmed cell death 1 |
| PDCD1LG2 | 80380 | NP_079515 | 5139 | programmed cell death 1 ligand 2 |
| PDE3A | 5139 | NP_000912 | 329 | phosphodiesterase 3A, cGMP-inhibited |
| PDE3B | 5140 | NP_000913 | 330 | phosphodiesterase 3B, cGMP-inhibited |
| PDE6B | 5158 | NP_000274 | 81 | phosphodiesterase 6B, cGMP-specific, rod, beta |
| PDE6B | 5158 | NP_001138763 | 1843 | phosphodiesterase 6B, cGMP-specific, rod, beta |
| PDE6B | 5158 | NP_001138764 | 1844 | phosphodiesterase 6B, cGMP-specific, rod, beta |
| PDGFRA | 5156 | NP_006197 | 3455 | platelet-derived growth factor receptor, alpha polypeptide |
| PDGFRB | 5159 | NP_002600 | 2691 | platelet-derived growth factor receptor, beta polypeptide |
| PDIA4 | 9601 | NP_004902 | 3165 | protein disulfide isomerase family A, member 4 |
| PDPN | 10630 | NP_001006625 | 481 | podoplanin |
| PDPN | 10630 | NP_001006626 | 482 | podoplanin |
| PDPN | 10630 | NP_006465 | 3496 | podoplanin |
| PDPN | 10630 | NP_938203 | 6786 | podoplanin |
| PDZD8 | 118987 | NP_776152 | 6384 | PDZ domain containing 8 |
| PDZK1IP1 | 10158 | NP_005755 | 3359 | PDZK1 interacting protein 1 |
| PEAR1 | 375033 | NP_001073940 | 1027 | platelet endothelial aggregation receptor 1 |
| PEBP4 | 157310 | NP_659399 | 5906 | phosphatidylethanolamine-binding protein 4 |
| PECAM1 | 5175 | NP_000433 | 128 | platelet/endothelial cell adhesion molecule |
| PEMT | 10400 | NP_009100 | 3641 | phosphatidylethanolamine N-methyltransferase |
| PEMT | 10400 | NP_680477 | 6001 | phosphatidylethanolamine N-methyltransferase |
| PEMT | 10400 | NP_680478 | 6002 | phosphatidylethanolamine N-methyltransferase |
| PERP | 64065 | NP_071404 | 4876 | PERP, TP53 apoptosis effector |
| PET117 | 100303755 | NP_001158283 | 7102 | protein PET117 homolog, mitochondrial precursor |
| PEX10 | 5192 | NP_002608 | 2692 | peroxisomal biogenesis factor 10 |
| PEX10 | 5192 | NP_722540 | 6232 | peroxisomal biogenesis factor 10 |
| PEX11A | 8800 | NP_003838 | 2913 | peroxisomal biogenesis factor 11 alpha |
| PEX11B | 8799 | NP_003837 | 2912 | peroxisomal biogenesis factor 11 beta |
| PEX11G | 92960 | NP_542393 | 5613 | peroxisomal biogenesis factor 11 gamma |
| PEX2 | 5828 | NP_000309 | 91 | peroxisomal membrane protein 3, 35kDa |
| PEX2 | 5828 | NP_001073336 | 1009 | peroxisomal membrane protein 3, 35kDa |
| PF4 | 5196 | NP_002610 | 2693 | platelet factor 4 |
| PFKP | 5214 | NP_002618 | 2694 | phosphofructokinase, platelet |
| PFN2 | 5217 | NP_002619 | 2695 | profilin 2 |
| PFN2 | 5217 | NP_444252 | 5556 | profilin 2 |
| PGAM5 | 192111 | NP_001164014 | 2242 | phosphoglycerate mutase family member 5 |
| PGAM5 | 192111 | NP_001164015 | 2243 | phosphoglycerate mutase family member 5 |
| PGAM5 | 192111 | NP_612642 | 5762 | phosphoglycerate mutase family member 5 |
| PGAP1 | 80055 | NP_079265 | 5112 | post-GPI attachment to proteins 1 |
| PGAP2 | 27315 | NP_001138910 | 1858 | post-GPI attachment to proteins 2 |
| PGAP2 | 27315 | NP_001138910 | 1859 | post-GPI attachment to proteins 2 |
| PGAP2 | 27315 | NP_055304 | 3946 | post-GPI attachment to proteins 2 |
| PGAP3 | 93210 | NP_219487 | 5495 | post-GPI attachment to proteins 3 |
| PGRMC1 | 10857 | NP_006658 | 3536 | progesterone receptor membrane component 1 |
| PGRMC2 | 10424 | NP_006311 | 3466 | progesterone receptor membrane component 2 |
| PHEX | 5251 | NP_000435 | 130 | phosphate regulating endopeptidaseHomolog, X-linked |
| PHLDB2 | 90102 | NP_001127909 | 1490 | pleckstrinHomology-like domain, family B, member 2,  phosphatidylinositol-specific phospholipase C, X domain containing 2 |
| PHLDB2 | 90102 | NP_001127910 | 1491 | pleckstrinHomology-like domain, family B, member 2,  phosphatidylinositol-specific phospholipase C, X domain containing 2 |
| PHLDB2 | 90102 | NP_001127911 | 1492 | pleckstrinHomology-like domain, family B, member 2,  phosphatidylinositol-specific phospholipase C, X domain containing 2 |
| PHLDB2 | 90102 | NP_001127909.1 | 1498 | pleckstrinHomology-like domain, family B, member 2,  phosphatidylinositol-specific phospholipase C, X domain containing 2 |
| PHLDB2 | 90102 | NP_665696 | 5974 | pleckstrinHomology-like domain, family B, member 2,  phosphatidylinositol-specific phospholipase C, X domain containing 2 |
| PHLDB2 | 90102 | NP_695000 | 6170 | pleckstrinHomology-like domain, family B, member 2,  phosphatidylinositol-specific phospholipase C, X domain containing 2 |
| PHTF1 | 10745 | NP_006599 | 3527 | putativeHomeodomain transcription factor 1 |
| PI16 | 221476 | NP_699201 | 6187 | peptidase inhibitor 16 |
| PI3 | 5266 | NP_002629 | 2697 | peptidase inhibitor 3, skin-derived |
| PIANP | 196500 | NP_710152 | 6214 | chromosome 12 open reading frame 53 |
| PICK1 | 9463 | NP_001034672 | 802 | protein interacting with PRKCA 1 |
| PICK1 | 9463 | NP_001034673 | 803 | protein interacting with PRKCA 1 |
| PICK1 | 9463 | NP_036539 | 3770 | protein interacting with PRKCA 1 |
| PIEZO1 | 9780 | NP_001136336 | 1706 | family with sequence similarity 38, member A |
| PIGA | 5277 | NP_002632 | 2698 | phosphatidylinositol glycan anchor biosynthesis, class A |
| PIGA | 5277 | NP_065206 | 4668 | phosphatidylinositol glycan anchor biosynthesis, class A |
| PIGB | 9488 | NP_004846 | 3149 | phosphatidylinositol glycan anchor biosynthesis, class B |
| PIGC | 5279 | NP_002633 | 2699 | phosphatidylinositol glycan anchor biosynthesis, class C |
| PIGC | 5279 | NP_714969 | 6222 | phosphatidylinositol glycan anchor biosynthesis, class C |
| PIGF | 5281 | NP_002634 | 2700 | phosphatidylinositol glycan anchor biosynthesis, class F |
| PIGF | 5281 | NP_775097 | 6331 | phosphatidylinositol glycan anchor biosynthesis, class F |
| PIGG | 54872 | NP_001120650 | 1308 | phosphatidylinositol glycan anchor biosynthesis, class G |

FIG. 2 (CONT.)

| Antigen | GeneID | Accession No. | SEQ ID NO: | RefSeq Gene Name |
|---|---|---|---|---|
| PIGG | 54872 | NP_060203 | 4330 | phosphatidylinositol glycan anchor biosynthesis, class G |
| PIGH | 5283 | NP_004560 | 3077 | phosphatidylinositol glycan anchor biosynthesis, classH |
| PIGK | 10026 | NP_005473 | 3293 | phosphatidylinositol glycan anchor biosynthesis, class K |
| PIGL | 9487 | NP_004269 | 3006 | phosphatidylinositol glycan anchor biosynthesis, class L |
| PIGM | 93183 | NP_660150 | 5929 | phosphatidylinositol glycan anchor biosynthesis, class M |
| PIGN | 23556 | NP_036459 | 3746 | phosphatidylinositol glycan anchor biosynthesis, class N |
| PIGN | 23556 | NP_789744 | 6476 | phosphatidylinositol glycan anchor biosynthesis, class N |
| PIGO | 84720 | NP_116023 | 5382 | phosphatidylinositol glycan anchor biosynthesis, class O |
| PIGO | 84720 | NP_690577 | 6119 | phosphatidylinositol glycan anchor biosynthesis, class O |
| PIGP | 51227 | NP_710148 | 6212 | phosphatidylinositol glycan anchor biosynthesis, class P |
| PIGP | 51227 | NP_710149 | 6213 | phosphatidylinositol glycan anchor biosynthesis, class P |
| PIGQ | 9091 | NP_004195 | 2986 | phosphatidylinositol glycan anchor biosynthesis, class Q |
| PIGQ | 9091 | NP_683721 | 6007 | phosphatidylinositol glycan anchor biosynthesis, class Q |
| PIGR | 5284 | NP_002635 | 2701 | polymeric immunoglobulin receptor |
| PIGS | 94005 | NP_149975 | 5466 | phosphatidylinositol glycan anchor biosynthesis, class S |
| PIGT | 51604 | NP_057021 | 4139 | phosphatidylinositol glycan anchor biosynthesis, class T |
| PIGU | 128869 | NP_536724 | 5604 | phosphatidylinositol glycan anchor biosynthesis, class U |
| PIGV | 55650 | NP_060307 | 4353 | phosphatidylinositol glycan anchor biosynthesis, class V |
| PIGW | 284098 | NP_848612 | 6548 | phosphatidylinositol glycan anchor biosynthesis, class W |
| PIGX | 54965 | NP_001159776 | 2159 | phosphatidylinositol glycan anchor biosynthesis, class X |
| PIGX | 54965 | NP_060331 | 4359 | phosphatidylinositol glycan anchor biosynthesis, class X |
| PIGZ | 80235 | NP_079439 | 5129 | phosphatidylinositol glycan anchor biosynthesis, class Z |
| PIK3IP1 | 113791 | NP_001129383 | 1574 | phosphoinositide-3-kinase interacting protein 1 |
| PIK3IP1 | 113791 | NP_443112 | 5524 | phosphoinositide-3-kinase interacting protein 1 |
| PILRA | 29992 | NP_038467 | 3823 | paired immunoglobin-like type 2 receptor alpha |
| PILRA | 29992 | NP_840056 | 6531 | paired immunoglobin-like type 2 receptor alpha |
| PILRA | 29992 | NP_840057 | 6532 | paired immunoglobin-like type 2 receptor alpha |
| PIPOX | 51268 | NP_057602 | 4233 | pipecolic acid oxidase |
| PIRT | 644139 | NP_001094857 | 1201 | phosphoinositide-interacting regulator of transient receptor potential channels |
| PKD1 | 5587 | NP_002733.2 | 7364 | protein kinase D1 |
| PKD1L1 | 168507 | NP_612152 | 5720 | polycystic kidney disease 1 like 1 |
| PKD1L2 | 114780 | NP_001070248 | 950 | polycystic kidney disease 1-like 2 |
| PKD1L2 | 114780 | NP_443124 | 5529 | polycystic kidney disease 1-like 2 |
| PKD2 | 5311 | NP_000288 | 83 | polycystic kidney disease 2 (autosomal dominant) |
| PKD2L1 | 9033 | NP_057196 | 4171 | polycystic kidney disease 2-like 1 |
| PKD2L2 | 27039 | NP_055201 | 3928 | polycystic kidney disease 2-like 2 |
| PKDCC | 91461 | NP_612379 | 5735 | protein kinase-like protein SgK493 |
| PKDREJ | 10343 | NP_006062 | 3428 | polycystic kidney disease (polycystin) and REJHomolog (sperm receptor for egg jellyHomolog, sea urchin) |
| PKHD1 | 5314 | NP_062565 | 4577 | polycystic kidney andHepatic disease 1 (autosomal recessive) |
| PKHD1 | 5314 | NP_619639 | 5771 | polycystic kidney andHepatic disease 1 (autosomal recessive) |
| PKHD1 | 5314 | NP_733842 | 6250 | polycystic kidney andHepatic disease 1 (autosomal recessive) |
| PKN2 | 5586 | NP_006247 | 3458 | protein kinase N2 |
| PLA2G10 | 8399 | NP_003552 | 2848 | phospholipase A2, group X |
| PLA2G16 | 11145 | NP_001121675 | 1366 | phospholipase A2, group XVI |
| PLA2G16 | 11145 | NP_009000 | 3625 | phospholipase A2, group XVI |
| PLA2G2A | 5320 | NP_000291 | 84 | phospholipase A2, group IIA (platelets, synovial fluid) |
| PLA2G2A | 5320 | NP_001155199 | 2023 | phospholipase A2, group IIA (platelets, synovial fluid) |
| PLA2G2A | 5320 | NP_001155200 | 2024 | phospholipase A2, group IIA (platelets, synovial fluid) |
| PLA2G2A | 5320 | NP_001155201 | 2025 | phospholipase A2, group IIA (platelets, synovial fluid) |
| PLA2G2D | 26279 | NP_036532 | 3768 | phospholipase A2, group IID |
| PLA2G2E | 30814 | NP_055404 | 3962 | phospholipase A2, group IIE |
| PLA2R1 | 22925 | NP_001007268 | 512 | phospholipase A2 receptor 1, 180kDa |
| PLA2R1 | 22925 | NP_031392 | 3692 | phospholipase A2 receptor 1, 180kDa |
| PLB1 | 151056 | NP_001164056 | 2247 | phospholipase B1 |
| PLB1 | 151056 | NP_694566 | 6150 | phospholipase B1 |
| PLBD2 | 196463 | NP_001153199 | 1957 | phospholipase B domain containing 2 |
| PLBD2 | 196463 | NP_775813 | 6355 | phospholipase B domain containing 2 |
| PLD3 | 23646 | NP_001026866 | 723 | phospholipase D family, member 3 |
| PLD3 | 23646 | NP_036400 | 3732 | phospholipase D family, member 3 |
| PLD4 | 122618 | NP_620145 | 5796 | phospholipase D family, member 4 |
| PLD5 | 200150 | NP_689879 | 6093 | phospholipase D family, member 5 |
| PLD6 | 201164 | NP_849158 | 6569 | phospholipase D family, member 6 |
| PLGRKT | 55848 | NP_060935 | 4455 | chromosome 9 open reading frame 46 |
| PLIN1 | 5346 | NP_001138783 | 1853 | perilipin |
| PLIN1 | 5346 | NP_002657 | 2702 | perilipin |
| PLLP | 51090 | NP_057077 | 4148 | plasma membrane proteolipid (plasmolipin) |
| PLN | 5350 | NP_002658 | 2703 | phospholamban |
| PLOD2 | 5352 | NP_000926 | 332 | procollagen-lysine, 2-oxoglutarate 5-dioxygenase 2 |
| PLOD2 | 5352 | NP_891988 | 6696 | procollagen-lysine, 2-oxoglutarate 5-dioxygenase 2 |
| PLP1 | 5354 | NP_000524 | 155 | proteolipid protein 1 |
| PLP1 | 5354 | NP_001122306 | 1376 | proteolipid protein 1 |
| PLP1 | 5354 | NP_955772 | 6888 | proteolipid protein 1 |
| PLP2 | 5355 | NP_002659 | 2704 | proteolipid protein 2 (colonic epithelium-enriched) |
| PLVAP | 83483 | NP_112600 | 5220 | plasmalemma vesicle associated protein |
| PLXDC1 | 57125 | NP_065138 | 4650 | plexin domain containing 1 |
| PLXDC2 | 84898 | NP_116201 | 5408 | plexin domain containing 2 |
| PLXNA1 | 5361 | NP_115618 | 5313 | plexin A1 |

FIG. 2 (CONT.)

| Antigen | GeneID | Accession No. | SEQ ID NO: | RefSeq Gene Name |
|---|---|---|---|---|
| PLXNA2 | 5362 | NP_079455 | 5130 | plexin A2 |
| PLXNA4 | 91584 | NP_001099013 | 1226 | plexin A4 |
| PLXNA4 | 91584 | NP_065962 | 4740 | plexin A4 |
| PLXNA4 | 91584 | NP_861440 | 6631 | plexin A4 |
| PLXNC1 | 10154 | NP_005752 | 3358 | plexin C1 |
| PLXND1 | 23129 | NP_055918 | 4033 | plexin D1 |
| PM20D1 | 148811 | NP_689704 | 6069 | peptidase M20 domain containing 1 |
| PMEL | 6490 | NP_008859 | 3597 | silverHomolog (mouse) |
| PMEPA1 | 56937 | NP_064567 | 4613 | prostate transmembrane protein, androgen induced 1 |
| PMEPA1 | 56937 | NP_954638 | 6861 | prostate transmembrane protein, androgen induced 1 |
| PMEPA1 | 56937 | NP_954639 | 6862 | prostate transmembrane protein, androgen induced 1 |
| PMEPA1 | 56937 | NP_954640 | 6863 | prostate transmembrane protein, androgen induced 1 |
| PMP22 | 5376 | NP_000295 | 85 | peripheral myelin protein 22 |
| PMP22 | 5376 | NP_696996 | 6176 | peripheral myelin protein 22 |
| PMP22 | 5376 | NP_696997 | 6177 | peripheral myelin protein 22 |
| PNKD | 25953 | NP_001070867 | 963 | paroxysmal nonkinesigenic dyskinesia |
| PNKD | 25953 | NP_056303 | 4090 | paroxysmal nonkinesigenic dyskinesia |
| PNKD | 25953 | NP_072094 | 4933 | paroxysmal nonkinesigenic dyskinesia |
| PNPLA2 | 57104 | NP_065109 | 4638 | patatin-like phospholipase domain containing 2 |
| PNPLA4 | 8228 | NP_001135861 | 1651 | patatin-like phospholipase domain containing 4 |
| PNPLA4 | 8228 | NP_004641 | 3097 | patatin-like phospholipase domain containing 4 |
| PNPLA6 | 10908 | NP_001159583 | 2146 | patatin-like phospholipase domain containing 6 |
| PNPLA6 | 10908 | NP_001159584 | 2147 | patatin-like phospholipase domain containing 6 |
| PNPLA6 | 10908 | NP_001159585 | 2148 | patatin-like phospholipase domain containing 6 |
| PNPLA6 | 10908 | NP_001159586 | 2149 | patatin-like phospholipase domain containing 6 |
| PNPLA6 | 10908 | NP_006693 | 3551 | patatin-like phospholipase domain containing 6 |
| PNPLA7 | 375775 | NP_001092007 | 1137 | patatin-like phospholipase domain containing 7 |
| PNPLA7 | 375775 | NP_689499 | 6025 | patatin-like phospholipase domain containing 7 |
| PODXL | 5420 | NP_001018121 | 669 | podocalyxin-like |
| PODXL | 5420 | NP_005388 | 3280 | podocalyxin-like |
| PODXL2 | 50512 | NP_056535 | 4118 | podocalyxin-like 2 |
| POLG2 | 11232 | NP_009146 | 3651 | polymerase (DNA directed), gamma 2, accessory subunit |
| POMGNT1 | 55624 | NP_060209 | 4331 | protein O-linked mannose beta1,2-N-acetylglucosaminyltransferase |
| POMK | 84197 | NP_115613 | 5312 | protein kinase-like protein SgK196 |
| POMT1 | 10585 | NP_001070833 | 961 | protein-O-mannosyltransferase 1 |
| POMT1 | 10585 | NP_001070834 | 962 | protein-O-mannosyltransferase 1 |
| POMT1 | 10585 | NP_001129585 | 1599 | protein-O-mannosyltransferase 1 |
| POMT1 | 10585 | NP_001129586 | 1600 | protein-O-mannosyltransferase 1 |
| POMT1 | 10585 | NP_009102 | 3642 | protein-O-mannosyltransferase 1 |
| PON2 | 5445 | NP_000296 | 86 | paraoxonase 2 |
| PON2 | 5445 | NP_001018171 | 670 | paraoxonase 2 |
| PON3 | 5446 | NP_000931 | 333 | paraoxonase 3 |
| POPDC2 | 64091 | NP_071418 | 4881 | popeye domain containing 2 |
| POPDC3 | 64208 | NP_071756 | 4904 | popeye domain containing 3 |
| POR | 5447 | NP_000932 | 334 | P450 (cytochrome) oxidoreductase |
| PORCN | 64840 | NP_073736 | 4952 | porcupineHomolog (Drosophila) |
| PORCN | 64840 | NP_982299 | 6942 | porcupineHomolog (Drosophila) |
| PORCN | 64840 | NP_982300 | 6943 | porcupineHomolog (Drosophila) |
| PORCN | 64840 | NP_982301 | 6944 | porcupineHomolog (Drosophila) |
| PORCN | 64840 | NP_982302 | 6945 | porcupineHomolog (Drosophila) |
| PPAP2A | 8611 | NP_003702 | 2873 | phosphatidic acid phosphatase type 2A |
| PPAP2A | 8611 | NP_795714 | 6488 | phosphatidic acid phosphatase type 2A |
| PPAP2B | 8613 | NP_003704 | 2875 | phosphatidic acid phosphatase type 2B |
| PPAP2B | 8613 | NP_003704.3 | 6491 | phosphatidic acid phosphatase type 2B |
| PPAP2C | 8612 | NP_003703 | 2874 | phosphatidic acid phosphatase type 2C |
| PPAP2C | 8612 | NP_803545 | 6495 | phosphatidic acid phosphatase type 2C |
| PPAP2C | 8612 | NP_808211 | 6500 | phosphatidic acid phosphatase type 2C |
| PPAPDC1A | 196051 | NP_001025230 | 715 | phosphatidic acid phosphatase type 2 domain containing 1A |
| PPAPDC1B | 84513 | NP_001096029 | 1207 | phosphatidic acid phosphatase type 2 domain containing 1B |
| PPAPDC1B | 84513 | NP_001096030 | 1208 | phosphatidic acid phosphatase type 2 domain containing 1B |
| PPAPDC1B | 84513 | NP_115872 | 5359 | phosphatidic acid phosphatase type 2 domain containing 1B |
| PPAPDC2 | 403313 | NP_982278 | 6938 | phosphatidic acid phosphatase type 2 domain containing 2 |
| PPAPDC3 | 84814 | NP_116117 | 5390 | phosphatidic acid phosphatase type 2 domain containing 3 |
| PPBP | 5473 | NP_002695 | 2705 | pro-platelet basic protein (chemokine (C-X-C motif) ligand 7) |
| PPIB | 5479 | NP_000933 | 335 | peptidylprolyl isomerase B (cyclophilin B) |
| PPIC | 5480 | NP_000934 | 336 | peptidylprolyl isomerase C (cyclophilin C) |
| PPM1L | 151742 | NP_640338 | 5848 | protein phosphatase 1 (formerly 2C)-like |
| PPP1R3A | 5506 | NP_002702 | 2706 | protein phosphatase 1, regulatory (inhibitor) subunit 3A |
| PPP1R3F | 89801 | NP_149992 | 5470 | protein phosphatase 1, regulatory (inhibitor) subunit 3F |
| PPT2 | 9374 | NP_005146 | 3220 | palmitoyl-protein thioesterase 2 |
| PPT2 | 9374 | NP_619731 | 5776 | palmitoyl-protein thioesterase 2 |
| PQLC1 | 80148 | NP_001139815 | 1933 | PQ loop repeat containing 1 |
| PQLC1 | 80148 | NP_001139817 | 1934 | PQ loop repeat containing 1 |
| PQLC1 | 80148 | NP_079354 | 5118 | PQ loop repeat containing 1 |
| PQLC2 | 54896 | NP_001035214 | 838 | PQ loop repeat containing 2 |
| PQLC2 | 54896 | NP_001035215 | 839 | PQ loop repeat containing 2 |
| PQLC2 | 54896 | NP_060235 | 4338 | PQ loop repeat containing 2 |

FIG. 2 (CONT.)

| Antigen | GeneID | Accession No. | SEQ ID NO: | RefSeq Gene Name |
|---|---|---|---|---|
| PQLC3 | 130814 | NP_689604 | 6050 | PQ loop repeat containing 3 |
| PRAC2 | 360205 | NP_001269204 | 7111 | prostate cancer susceptibility candidate 2 |
| PRADC1 | 84279 | NP_115695 | 5326 | chromosome 2 open reading frame 7 |
| PRAF2 | 11230 | NP_009144 | 3649 | PRA1 domain family, member 2 |
| PRCP | 5547 | NP_005031 | 3201 | prolylcarboxypeptidase (angiotensinase C) |
| PRCP | 5547 | NP_955450 | 6883 | prolylcarboxypeptidase (angiotensinase C) |
| PRDX4 | 10549 | NP_006397 | 3482 | peroxiredoxin 4 |
| PREB | 10113 | NP_037520 | 3816 | prolactin regulatory element binding |
| PRIMA1 | 145270 | NP_821092 | 6513 | proline rich membrane anchor 1 |
| PRLH | 51052 | NP_056977 | 4130 | prolactin releasingHormone |
| PRLHR | 2834 | NP_004239 | 2998 | prolactin releasingHormone receptor |
| PRLR | 5618 | NP_000940 | 337 | prolactin receptor |
| PRND | 23627 | NP_036541 | 3771 | prion protein 2 (dublet) |
| PRNP | 5621 | NP_000302 | 88 | prion protein |
| PRNP | 5621 | NP_001073590 | 1011 | prion protein |
| PRNP | 5621 | NP_001073591 | 1012 | prion protein |
| PRNP | 5621 | NP_001073592 | 1013 | prion protein |
| PRNP | 5621 | NP_898902 | 6703 | prion protein |
| PROCR | 10544 | NP_006395 | 3480 | protein C receptor, endothelial (EPCR) |
| PROKR2 | 128674 | NP_658986 | 5903 | prokineticin receptor 2 |
| PROM1 | 8842 | NP_001139319 | 1878 | prominin 1 |
| PROM1 | 8842 | NP_001139320 | 1879 | prominin 1 |
| PROM1 | 8842 | NP_001139321 | 1880 | prominin 1 |
| PROM1 | 8842 | NP_001139322 | 1881 | prominin 1 |
| PROM1 | 8842 | NP_001139323 | 1882 | prominin 1 |
| PROM1 | 8842 | NP_001139324 | 1883 | prominin 1 |
| PROM1 | 8842 | NP_006008 | 3415 | prominin 1 |
| PROM2 | 150696 | NP_001159449 | 2137 | prominin 2 |
| PROM2 | 150696 | NP_001159450 | 2138 | prominin 2 |
| PROM2 | 150696 | NP_653308 | 5895 | prominin 2 |
| PROS1 | 5627 | NP_000304 | 89 | protein S (alpha) |
| PRPF38B | 55119 | NP_060531 | 4386 | PRP38 pre-mRNA processing factor 38 (yeast) domain containing B |
| PRPH2 | 5961 | NP_000313 | 92 | peripherin 2 (retinal degeneration, slow) |
| PRR4 | 11272 | NP_001092008.2 | 7429 | proline rich 4 (lacrimal) |
| PRR7 | 80758 | NP_085044 | 5147 | proline rich 7 (synaptic) |
| PRRG1 | 5638 | NP_000941 | 338 | proline rich Gla (G-carboxyglutamic acid) 1 |
| PRRG1 | 5638 | NP_001135867 | 1654 | proline rich Gla (G-carboxyglutamic acid) 1 |
| PRRG2 | 5639 | NP_000942 | 339 | proline rich Gla (G-carboxyglutamic acid) 2 |
| PRRG3 | 79057 | NP_076987 | 5006 | proline rich Gla (G-carboxyglutamic acid) 3 (transmembrane) |
| PRRG4 | 79056 | NP_076986 | 5005 | proline rich Gla (G-carboxyglutamic acid) 4 (transmembrane) |
| PRRT1 | 80863 | NP_085154 | 5155 | proline-rich transmembrane protein 1 |
| PRRT2 | 112476 | NP_660282 | 5937 | proline-rich transmembrane protein 2 |
| PRRT3 | 285368 | NP_997234 | 7014 | proline-rich transmembrane protein 3 |
| PRSS16 | 10279 | NP_005856 | 3389 | protease, serine, 16 (thymus) |
| PRUNE2 | 158471 | NP_056040 | 4048 | pruneHomolog 2 (Drosophila) |
| PSCA | 8000 | NP_005663 | 3340 | prostate stem cell antigen |
| PSEN1 | 5663 | NP_000012 | 3 | presenilin 1 |
| PSEN1 | 5663 | NP_015557 | 3685 | presenilin 1 |
| PSEN2 | 5664 | NP_000438 | 131 | presenilin 2 (Alzheimer disease 4) |
| PSEN2 | 5664 | NP_036618 | 3786 | presenilin 2 (Alzheimer disease 4) |
| PSENEN | 55851 | NP_001268461.1 | 7440 | presenilin enhancer gamma-secretase subunit |
| PSMB7 | 5695 | NP_002790 | 2708 | proteasome (prosome, macropain) subunit, beta type, 7 |
| PTAFR | 5724 | NP_000943 | 340 | platelet-activating factor receptor |
| PTAFR | 5724 | NP_001158193 | 2100 | platelet-activating factor receptor |
| PTAFR | 5724 | NP_001158194 | 2101 | platelet-activating factor receptor |
| PTAFR | 5724 | NP_001158195 | 2102 | platelet-activating factor receptor |
| PTCH1 | 5727 | NP_000255 | 77 | patchedHomolog 1 (Drosophila) |
| PTCH1 | 5727 | NP_001077071 | 1071 | patchedHomolog 1 (Drosophila) |
| PTCH1 | 5727 | NP_001077072 | 1072 | patchedHomolog 1 (Drosophila) |
| PTCH1 | 5727 | NP_001077073 | 1073 | patchedHomolog 1 (Drosophila) |
| PTCH1 | 5727 | NP_001077074 | 1074 | patchedHomolog 1 (Drosophila) |
| PTCH1 | 5727 | NP_001077075 | 1075 | patchedHomolog 1 (Drosophila) |
| PTCH1 | 5727 | NP_001077076 | 1076 | patchedHomolog 1 (Drosophila) |
| PTCH2 | 8643 | NP_001159764 | 2158 | patchedHomolog 2 (Drosophila) |
| PTCH2 | 8643 | NP_003729 | 2882 | patchedHomolog 2 (Drosophila) |
| PTCHD1 | 139411 | NP_775766 | 6347 | patched domain containing 1 |
| PTCHD2 | 57540 | NP_065831 | 4721 | patched domain containing 2 |
| PTCHD4 | 442213 | NP_001013754 | 619 | chromosome 6 open reading frame 138 |
| PTCRA | 171558 | NP_612153 | 5721 | pre T-cell antigen receptor alpha |
| PTDSS1 | 9791 | NP_055569 | 3983 | phosphatidylserine synthase 1 |
| PTDSS2 | 81490 | NP_110410 | 5172 | phosphatidylserine synthase 2 |
| PTGDR | 5729 | NP_000944 | 341 | prostaglandin D2 receptor (DP) |
| PTGDR2 | 11251 | NP_004769 | 3123 | G protein-coupled receptor 44 |
| PTGER1 | 5731 | NP_000946 | 342 | prostaglandin E receptor 1 (subtype EP1), 42kDa |
| PTGER2 | 5732 | NP_000947 | 343 | prostaglandin E receptor 2 (subtype EP2), 53kDa |
| PTGER3 | 5733 | NP_000948 | 344 | prostaglandin E receptor 3 (subtype EP3) |
| PTGER3 | 5733 | NP_001119516 | 1300 | prostaglandin E receptor 3 (subtype EP3) |

FIG. 2 (CONT.)

| Antigen | GeneID | Accession No. | SEQ ID NO: | RefSeq Gene Name |
|---|---|---|---|---|
| PTGER3 | 5733 | NP_942005 | 6827 | prostaglandin E receptor 3 (subtype EP3) |
| PTGER3 | 5733 | NP_942006 | 6828 | prostaglandin E receptor 3 (subtype EP3) |
| PTGER3 | 5733 | NP_942007 | 6829 | prostaglandin E receptor 3 (subtype EP3) |
| PTGER3 | 5733 | NP_942008 | 6830 | prostaglandin E receptor 3 (subtype EP3) |
| PTGER3 | 5733 | NP_942009 | 6831 | prostaglandin E receptor 3 (subtype EP3) |
| PTGER3 | 5733 | NP_942010 | 6832 | prostaglandin E receptor 3 (subtype EP3) |
| PTGER3 | 5733 | NP_942011 | 6833 | prostaglandin E receptor 3 (subtype EP3) |
| PTGER3 | 5733 | NP_942012 | 6834 | prostaglandin E receptor 3 (subtype EP3) |
| PTGER4 | 5734 | NP_000949 | 345 | prostaglandin E receptor 4 (subtype EP4) |
| PTGFR | 5737 | NP_000950 | 346 | prostaglandin F receptor (FP) |
| PTGFR | 5737 | NP_001034674 | 804 | prostaglandin F receptor (FP) |
| PTGFRN | 5738 | NP_065173 | 4660 | prostaglandin F2 receptor negative regulator |
| PTGIR | 5739 | NP_000951.1 | 7263 | prostaglandin I2 (prostacyclin) receptor (IP) |
| PTGIS | 5740 | NP_000952 | 347 | prostaglandin I2 (prostacyclin) synthase |
| PTGS1 | 5742 | NP_000953 | 348 | prostaglandin-endoperoxide synthase 1 (prostaglandin G/H synthase and cyclooxygenase) |
| PTGS1 | 5742 | NP_542158 | 5607 | prostaglandin-endoperoxide synthase 1 (prostaglandin G/H synthase and cyclooxygenase) |
| PTH1R | 5745 | NP_000307 | 90 | parathyroidHormone 1 receptor |
| PTH2 | 113091 | NP_848544 | 6540 | parathyroidHormone 2 |
| PTK7 | 5754 | NP_002812 | 2709 | PTK7 protein tyrosine kinase 7 |
| PTK7 | 5754 | NP_690619 | 6125 | PTK7 protein tyrosine kinase 7 |
| PTK7 | 5754 | NP_690620 | 6126 | PTK7 protein tyrosine kinase 7 |
| PTK7 | 5754 | NP_690621 | 6127 | PTK7 protein tyrosine kinase 7 |
| PTN | 5764 | NP_002816 | 2710 | pleiotrophin |
| PTPN1 | 5770 | NP_002818 | 2712 | protein tyrosine phosphatase, non-receptor type 1 |
| PTPN2 | 5771 | NP_002819 | 2713 | protein tyrosine phosphatase, non-receptor type 2 |
| PTPN2 | 5771 | NP_536347 | 5601 | protein tyrosine phosphatase, non-receptor type 2 |
| PTPN2 | 5771 | NP_536348 | 5602 | protein tyrosine phosphatase, non-receptor type 2 |
| PTPN5 | 84867 | NP_001035059 | 820 | protein tyrosine phosphatase, non-receptor type 5 (striatum-enriched) |
| PTPN5 | 84867 | NP_008837 | 3592 | protein tyrosine phosphatase, non-receptor type 5 (striatum-enriched) |
| PTPN5 | 84867 | NP_116170 | 5400 | protein tyrosine phosphatase, non-receptor type 5 (striatum-enriched) |
| PTPRA | 5786 | NP_002827 | 2714 | protein tyrosine phosphatase, receptor type, A |
| PTPRA | 5786 | NP_543030 | 5637 | protein tyrosine phosphatase, receptor type, A |
| PTPRA | 5786 | NP_543031 | 5638 | protein tyrosine phosphatase, receptor type, A |
| PTPRC | 5788 | NP_002829 | 2715 | protein tyrosine phosphatase, receptor type, C |
| PTPRC | 5788 | NP_563578 | 5645 | protein tyrosine phosphatase, receptor type, C |
| PTPRC | 5788 | NP_563579 | 5646 | protein tyrosine phosphatase, receptor type, C |
| PTPRC | 5788 | NP_563580 | 5647 | protein tyrosine phosphatase, receptor type, C |
| PTPRCAP | 5790 | NP_005599 | 3324 | protein tyrosine phosphatase, receptor type, C-associated protein |
| PTPRD | 5789 | NP_001035802 | 883 | protein tyrosine phosphatase, receptor type, D |
| PTPRD | 5789 | NP_001164496 | 2263 | protein tyrosine phosphatase, receptor type, D |
| PTPRD | 5789 | NP_002830 | 2716 | protein tyrosine phosphatase, receptor type, D |
| PTPRD | 5789 | NP_569075 | 5651 | protein tyrosine phosphatase, receptor type, D |
| PTPRD | 5789 | NP_569076 | 5652 | protein tyrosine phosphatase, receptor type, D |
| PTPRD | 5789 | NP_569077 | 5653 | protein tyrosine phosphatase, receptor type, D |
| PTPRE | 5791 | NP_006495 | 3501 | protein tyrosine phosphatase, receptor type, E |
| PTPRE | 5791 | NP_569119 | 5655 | protein tyrosine phosphatase, receptor type, E |
| PTPRF | 5792 | NP_002831 | 2717 | protein tyrosine phosphatase, receptor type, F |
| PTPRF | 5792 | NP_569707 | 5656 | protein tyrosine phosphatase, receptor type, F |
| PTPRG | 5793 | NP_002832 | 2718 | protein tyrosine phosphatase, receptor type, G |
| PTPRH | 5794 | NP_001154912 | 2011 | protein tyrosine phosphatase, receptor type,H |
| PTPRH | 5794 | NP_002833 | 2719 | protein tyrosine phosphatase, receptor type,H |
| PTPRJ | 5795 | NP_001091973 | 1127 | protein tyrosine phosphatase, receptor type, J |
| PTPRJ | 5795 | NP_002834 | 2720 | protein tyrosine phosphatase, receptor type, J |
| PTPRK | 5796 | NP_001129120 | 1543 | protein tyrosine phosphatase, receptor type, K |
| PTPRK | 5796 | NP_002835 | 2721 | protein tyrosine phosphatase, receptor type, K |
| PTPRM | 5797 | NP_001098714 | 1219 | protein tyrosine phosphatase, receptor type, M |
| PTPRM | 5797 | NP_002836 | 2722 | protein tyrosine phosphatase, receptor type, M |
| PTPRN | 5798 | NP_001186692.1 | 7426 | protein tyrosine phosphatase, receptor type N |
| PTPRO | 5800 | NP_002839 | 2723 | protein tyrosine phosphatase, receptor type, O |
| PTPRO | 5800 | NP_109592 | 5157 | protein tyrosine phosphatase, receptor type, O |
| PTPRO | 5800 | NP_109593 | 5158 | protein tyrosine phosphatase, receptor type, O |
| PTPRO | 5800 | NP_109594 | 5159 | protein tyrosine phosphatase, receptor type, O |
| PTPRO | 5800 | NP_109595 | 5160 | protein tyrosine phosphatase, receptor type, O |
| PTPRO | 5800 | NP_109596 | 5161 | protein tyrosine phosphatase, receptor type, O |
| PTPRR | 5801 | NP_002840 | 2724 | protein tyrosine phosphatase, receptor type, R |
| PTPRR | 5801 | NP_570897 | 5671 | protein tyrosine phosphatase, receptor type, R |
| PTPRS | 5802 | NP_002841 | 2725 | protein tyrosine phosphatase, receptor type, S |
| PTPRS | 5802 | NP_570923 | 5673 | protein tyrosine phosphatase, receptor type, S |
| PTPRS | 5802 | NP_570924 | 5674 | protein tyrosine phosphatase, receptor type, S |
| PTPRS | 5802 | NP_570925 | 5675 | protein tyrosine phosphatase, receptor type, S |
| PTPRT | 11122 | NP_008981 | 3622 | protein tyrosine phosphatase, receptor type, T |
| PTPRT | 11122 | NP_573400 | 5676 | protein tyrosine phosphatase, receptor type, T |
| PTPRU | 10076 | NP_005695 | 3348 | protein tyrosine phosphatase, receptor type, U |
| PTPRU | 10076 | NP_573438 | 5677 | protein tyrosine phosphatase, receptor type, U |
| PTPRU | 10076 | NP_573439 | 5678 | protein tyrosine phosphatase, receptor type, U |
| PTPRZ1 | 5803 | NP_002842 | 2726 | protein tyrosine phosphatase, receptor-type, Z polypeptide 1 |
| PTRH2 | 51651 | NP_057161 | 4162 | peptidyl-tRNAHydrolase 2 |

FIG. 2 (CONT.)

| Antigen | GeneID | Accession No. | SEQ ID NO: | RefSeq Gene Name |
|---|---|---|---|---|
| PTTG1IP | 754 | NP_004330 | 3026 | pituitary tumor-transforming 1 interacting protein |
| PVR | 5817 | NP_001129240 | 1562 | poliovirus receptor |
| PVR | 5817 | NP_001129241 | 1563 | poliovirus receptor |
| PVR | 5817 | NP_001129242 | 1564 | poliovirus receptor |
| PVR | 5817 | NP_006496 | 3502 | poliovirus receptor |
| PVRIG | 79037 | NP_076975 | 5002 | poliovirus receptor related immunoglobulin domain containing |
| PVRL1 | 5818 | NP_002846 | 2727 | poliovirus receptor-related 1 (herpesvirus entry mediator C) |
| PVRL1 | 5818 | NP_976030 | 6921 | poliovirus receptor-related 1 (herpesvirus entry mediator C) |
| PVRL1 | 5818 | NP_976031 | 6922 | poliovirus receptor-related 1 (herpesvirus entry mediator C) |
| PVRL2 | 5819 | NP_001036189 | 918 | poliovirus receptor-related 2 (herpesvirus entry mediator B) |
| PVRL2 | 5819 | NP_002847 | 2728 | poliovirus receptor-related 2 (herpesvirus entry mediator B) |
| PVRL3 | 25945 | NP_056295 | 4088 | poliovirus receptor-related 3 |
| PVRL4 | 81607 | NP_112178 | 5191 | poliovirus receptor-related 4 |
| PXDN | 7837 | NP_036425 | 3739 | peroxidasinHomolog (Drosophila) |
| PXYLP1 | 92370 | NP_001032249 | 770 | acid phosphatase-like 2 |
| PXYLP1 | 92370 | NP_689495 | 6024 | acid phosphatase-like 2 |
| PYY | 5697 | NP_004151 | 2975 | peptide YY |
| QPCTL | 54814 | NP_001156849 | 2052 | glutaminyl-peptide cyclotransferase-like |
| QPCTL | 54814 | NP_060129 | 4318 | glutaminyl-peptide cyclotransferase-like |
| QRFPR | 84109 | NP_937822 | 6751 | pyroglutamylated RFamide peptide receptor |
| QSOX1 | 5768 | NP_001004128 | 427 | quiescin Q6 sulfhydryl oxidase 1 |
| QSOX1 | 5768 | NP_002817 | 2711 | quiescin Q6 sulfhydryl oxidase 1 |
| QSOX2 | 169714 | NP_859052 | 6621 | quiescin Q6 sulfhydryl oxidase 2 |
| RABAC1 | 10567 | NP_006414 | 3489 | Rab acceptor 1 (prenylated) |
| RABGAP1 | 23637 | NP_036329 | 3719 | RAB GTPase activating protein 1 |
| RAD51B | 5890 | NP_002868 | 2729 | RAD51-like 1 (S. cerevisiae) |
| RAD51B | 5890 | NP_598193 | 5699 | RAD51-like 1 (S. cerevisiae) |
| RAD51B | 5890 | NP_598194 | 5700 | RAD51-like 1 (S. cerevisiae) |
| RAET1E | 135250 | NP_631904 | 5840 | retinoic acid early transcript 1E |
| RAET1G | 353091 | NP_001001788.2 | 7369 | retinoic acid early transcript 1G |
| RAET1L | 154064 | NP_570970.2 | 7368 | retinoic acid early transcript 1L |
| RAMP1 | 10267 | NP_005846 | 3386 | receptor (G protein-coupled) activity modifying protein 1 |
| RAMP2 | 10266 | NP_005845 | 3385 | receptor (G protein-coupled) activity modifying protein 2 |
| RAMP3 | 10268 | NP_005847 | 3387 | receptor (G protein-coupled) activity modifying protein 3 |
| RARRES3 | 5920 | NP_004576 | 3078 | retinoic acid receptor responder (tazarotene induced) 3 |
| RBFOX3 | 146713 | NP_001076044 | 1061 | hexaribonucleotide binding protein 3 |
| RBM3 | 5935 | NP_006734 | 3555 | RNA binding motif (RNP1, RRM) protein 3 |
| RDH10 | 157506 | NP_742034 | 6270 | retinol dehydrogenase 10 (all-trans) |
| RDH11 | 51109 | NP_057110 | 4154 | retinol dehydrogenase 11 (all-trans/9-cis/11-cis) |
| RDM1 | 201299 | NP_001030008 | 760 | RAD52 motif 1 |
| RDM1 | 201299 | NP_001156592 | 2042 | RAD52 motif 1 |
| RDM1 | 201299 | NP_001156593 | 2043 | RAD52 motif 1 |
| RDM1 | 201299 | NP_001156594 | 2044 | RAD52 motif 1 |
| RDM1 | 201299 | NP_001156596 | 2045 | RAD52 motif 1 |
| RDM1 | 201299 | NP_001156597 | 2046 | RAD52 motif 1 |
| RDM1 | 201299 | NP_001156602 | 2047 | RAD52 motif 1 |
| RDM1 | 201299 | NP_663629 | 5967 | RAD52 motif 1 |
| RECK | 8434 | NP_066934 | 4774 | reversion-inducing-cysteine-rich protein with kazal motifs |
| REEP2 | 51308 | NP_057690 | 4259 | receptor accessory protein 2 |
| REEP3 | 221035 | NP_001001330 | 352 | receptor accessory protein 3 |
| REEP4 | 80346 | NP_079508 | 5138 | receptor accessory protein 4 |
| REEP5 | 7905 | NP_005660 | 3338 | receptor accessory protein 5 |
| REEP6 | 92840 | NP_612402 | 5742 | receptor accessory protein 6 |
| RELL1 | 768211 | NP_001078868 | 1091 | RELT-like 1 |
| RELL1 | 768211 | NP_001078869 | 1092 | RELT-like 1 |
| RELL2 | 285613 | NP_001123501 | 1411 | RELT-like 2 |
| RELL2 | 285613 | NP_776189 | 6391 | RELT-like 2 |
| RELT | 84957 | NP_116260 | 5419 | RELT tumor necrosis factor receptor |
| RELT | 84957 | NP_689408 | 6019 | RELT tumor necrosis factor receptor |
| RER1 | 11079 | NP_008964 | 3618 | RER1 retention in endoplasmic reticulum 1Homolog (S. cerevisiae) |
| RET | 5979 | NP_065681 | 4685 | ret proto-oncogene |
| RET | 5979 | NP_066124 | 4750 | ret proto-oncogene |
| RETSAT | 54884 | NP_060220 | 4335 | retinol saturase (all-trans-retinol 13,14-reductase) |
| RFT1 | 91869 | NP_443091 | 5519 | RFT1Homolog (S. cerevisiae) |
| RGR | 5995 | NP_001012738 | 604 | retinal G protein coupled receptor |
| RGR | 5995 | NP_001012740 | 605 | retinal G protein coupled receptor |
| RGR | 5995 | NP_002912 | 2730 | retinal G protein coupled receptor |
| RGS9BP | 388531 | NP_997274 | 7020 | regulator of G protein signaling 9 binding protein |
| RGSL1 | 353299 | NP_001131141 | 1615 | regulator of G-protein signaling like 1 |
| RHAG | 6005 | NP_000315 | 93 | Rh-associated glycoprotein |
| RHBDD1 | 84236 | NP_001161080 | 2187 | rhomboid domain containing 1 |
| RHBDD1 | 84236 | NP_115652 | 5317 | rhomboid domain containing 1 |
| RHBDD2 | 57414 | NP_001035546 | 872 | rhomboid domain containing 2 |
| RHBDD2 | 57414 | NP_001035547 | 873 | rhomboid domain containing 2 |
| RHBDD3 | 25807 | NP_036397 | 3731 | rhomboid domain containing 3 |
| RHBDF1 | 64285 | NP_071895 | 4919 | rhomboid 5Homolog 1 (Drosophila) |
| RHBDF2 | 79651 | NP_001005498 | 461 | rhomboid 5Homolog 2 (Drosophila) |

FIG. 2 (CONT.)

| Antigen | GeneID | Accession No. | SEQ ID NO: | RefSeq Gene Name |
|---|---|---|---|---|
| RHBDF2 | 79651 | NP_078875 | 5054 | rhomboid 5Homolog 2 (Drosophila) |
| RHBDL1 | 9028 | NP_001265649.1 | 2931 | rhomboid, veinlet-like 1 (Drosophila) |
| RHBDL2 | 54933 | NP_060291 | 4349 | rhomboid, veinlet-like 2 (Drosophila) |
| RHBDL3 | 162494 | NP_612201 | 5727 | rhomboid, veinlet-like 3 (Drosophila) |
| RHBG | 57127 | NP_065140 | 4651 | Rh family, B glycoprotein (gene/pseudogene) |
| RHCE | 6006 | NP_065231 | 4676 | Rh blood group, CcEe antigens |
| RHCE | 6006 | NP_619522 | 5765 | Rh blood group, CcEe antigens |
| RHCE | 6006 | NP_619523 | 5766 | Rh blood group, CcEe antigens |
| RHCE | 6006 | NP_619524 | 5767 | Rh blood group, CcEe antigens |
| RHCG | 51458 | NP_057405 | 4203 | Rh family, C glycoprotein |
| RHD | 6007 | NP_001121163 | 1347 | Rh blood group, D antigen |
| RHD | 6007 | NP_057208 | 4173 | Rh blood group, D antigen |
| RHO | 6010 | NP_000530 | 156 | rhodopsin |
| RHOT1 | 55288 | NP_001028738.1 | 7355 | ras homolog family member T1 |
| RHOT2 | 89941 | NP_620124 | 5791 | rasHomolog gene family, member T2 |
| RIC3 | 79608 | NP_001128581 | 1525 | resistance to inhibitors of cholinesterase 3Homolog (C. elegans) |
| RIC3 | 79608 | NP_078833 | 5047 | resistance to inhibitors of cholinesterase 3Homolog (C. elegans) |
| RMDN2 | 151393 | NP_001164262 | 2253 | family with sequence similarity 82, member A1 |
| RMDN2 | 151393 | NP_001164263 | 2254 | family with sequence similarity 82, member A1 |
| RMDN2 | 151393 | NP_001164264 | 2255 | family with sequence similarity 82, member A1 |
| RMDN2 | 151393 | NP_653314 | 5897 | family with sequence similarity 82, member A1 |
| RMDN3 | 55177 | NP_060615 | 4398 | family with sequence similarity 82, member A2 |
| RNASE1 | 6035 | NP_002924 | 2731 | ribonuclease, RNase A family, 1 (pancreatic) |
| RNASE1 | 6035 | NP_937875 | 6760 | ribonuclease, RNase A family, 1 (pancreatic) |
| RNASE1 | 6035 | NP_937877 | 6761 | ribonuclease, RNase A family, 1 (pancreatic) |
| RNASE1 | 6035 | NP_937878 | 6762 | ribonuclease, RNase A family, 1 (pancreatic) |
| RNASE4 | 6038 | NP_002928 | 2732 | ribonuclease, RNase A family, 4 |
| RNASE4 | 6038 | NP_919412 | 6722 | ribonuclease, RNase A family, 4 |
| RNASE6 | 6039 | NP_005606 | 3325 | ribonuclease, RNase A family, k6 |
| RNASE7 | 84659 | NP_115961 | 5373 | ribonuclease, RNase A family, 7 |
| RNF103 | 7844 | NP_001005753 | 471 | vacuolar protein sorting 24Homolog (S. cerevisiae) ring finger protein 103 |
| RNF103 | 7844 | NP_005658 | 3337 | vacuolar protein sorting 24Homolog (S. cerevisiae) ring finger protein 103 |
| RNF103 | 7844 | NP_057163 | 4164 | vacuolar protein sorting 24Homolog (S. cerevisiae) ring finger protein 103 |
| RNF112 | 7732 | NP_009079 | 3634 | ring finger protein 112 |
| RNF121 | 55298 | NP_060790 | 4420 | ring finger protein 121 |
| RNF122 | 79845 | NP_079063 | 5082 | ring finger protein 122 |
| RNF128 | 79589 | NP_078815 | 5043 | ring finger protein 128 |
| RNF128 | 79589 | NP_919445 | 6732 | ring finger protein 128 |
| RNF13 | 11342 | NP_009213 | 3668 | ring finger protein 13 |
| RNF13 | 11342 | NP_899237 | 6708 | ring finger protein 13 |
| RNF130 | 55819 | NP_060904 | 4449 | ring finger protein 130 |
| RNF133 | 168433 | NP_631914 | 5844 | ring finger protein 133 |
| RNF139 | 11236 | NP_009149 | 3652 | ring finger protein 139 |
| RNF144A | 9781 | NP_055561 | 3981 | ring finger protein 144A |
| RNF144B | 255488 | NP_877434 | 6680 | ring finger protein 144B |
| RNF145 | 153830 | NP_653327 | 5901 | ring finger protein 145 |
| RNF149 | 284996 | NP_775918 | 6370 | ring finger protein 149 |
| RNF150 | 57484 | NP_065775 | 4708 | ring finger protein 150 |
| RNF152 | 220441 | NP_775828 | 6357 | ring finger protein 152 |
| RNF167 | 26001 | NP_056343 | 4095 | ring finger protein 167 |
| RNF170 | 81790 | NP_001153695 | 1979 | ring finger protein 170 |
| RNF170 | 81790 | NP_001153696 | 1980 | ring finger protein 170 |
| RNF170 | 81790 | NP_001153697 | 1981 | ring finger protein 170 |
| RNF170 | 81790 | NP_112216 | 5201 | ring finger protein 170 |
| RNF175 | 285533 | NP_775933 | 6376 | ring finger protein 175 |
| RNF180 | 285671 | NP_001107033 | 1264 | ring finger protein 180 |
| RNF180 | 285671 | NP_848627 | 6550 | ring finger protein 180 |
| RNF182 | 221687 | NP_001158504 | 2122 | ring finger protein 182 |
| RNF182 | 221687 | NP_001158505 | 2123 | ring finger protein 182 |
| RNF182 | 221687 | NP_001158506 | 2124 | ring finger protein 182 |
| RNF182 | 221687 | NP_689950 | 6108 | ring finger protein 182 |
| RNF183 | 138065 | NP_659488 | 5924 | ring finger protein 183 |
| RNF186 | 54546 | NP_061935 | 4555 | ring finger protein 186 |
| RNF19A | 25897 | NP_056250 | 4082 | ring finger protein 19A |
| RNF19A | 25897 | NP_904355 | 6709 | ring finger protein 19A |
| RNF19B | 127544 | NP_001120833 | 1318 | ring finger protein 19B |
| RNF19B | 127544 | NP_699172 | 6178 | ring finger protein 19B |
| RNF217 | 154214 | NP_689766 | 6081 | ring finger protein 217 |
| RNF24 | 11237 | NP_001127809 | 1475 | ring finger protein 24 |
| RNF24 | 11237 | NP_001127810 | 1476 | ring finger protein 24 |
| RNF24 | 11237 | NP_009150 | 3653 | ring finger protein 24 |
| RNF26 | 79102 | NP_114404 | 5278 | ring finger protein 26 |
| RNF43 | 54894 | NP_060233 | 4337 | ring finger protein 43 |
| ROBO2 | 6092 | NP_001122401 | 1380 | roundabout, axon guidance receptor,Homolog 2 (Drosophila) |
| ROBO2 | 6092 | NP_002933 | 2733 | roundabout, axon guidance receptor,Homolog 2 (Drosophila) |
| ROBO3 | 64221 | NP_071765 | 4907 | roundabout, axon guidance receptor,Homolog 3 (Drosophila) |
| ROM1 | 6094 | NP_000318 | 94 | retinal outer segment membrane protein 1 |

FIG. 2 (CONT.)

| Antigen | GeneID | Accession No. | SEQ ID NO: | RefSeq Gene Name |
|---|---|---|---|---|
| ROMO1 | 140823 | NP_542786 | 5626 | reactive oxygen species modulator 1 |
| ROR1 | 4919 | NP_001077061 | 1070 | receptor tyrosine kinase-like orphan receptor 1 |
| ROR1 | 4919 | NP_005003 | 3196 | receptor tyrosine kinase-like orphan receptor 1 |
| ROR2 | 4920 | NP_004551 | 3076 | receptor tyrosine kinase-like orphan receptor 2 |
| ROS1 | 6098 | NP_002935 | 2734 | c-ros oncogene 1, receptor tyrosine kinase |
| RPL37A | 6168 | NP_000989 | 349 | ribosomal protein L37a |
| RPN1 | 6184 | NP_002941 | 2735 | ribophorin I |
| RPN2 | 6185 | NP_001129243 | 1565 | ribophorin II |
| RPN2 | 6185 | NP_002942 | 2736 | ribophorin II |
| RPRM | 56475 | NP_062819 | 4583 | reprimo, TP53 dependent G2 arrest mediator candidate |
| RPRML | 388394 | NP_981945 | 6931 | reprimo-like |
| RPS23 | 6228 | NP_001016 | 638 | ribosomal protein S23 |
| RRBP1 | 6238 | NP_001036041 | 905 | ribosome binding protein 1Homolog 180kDa (dog) |
| RRBP1 | 6238 | NP_004578 | 3079 | ribosome binding protein 1Homolog 180kDa (dog) |
| RRH | 10692 | NP_006574 | 3522 | retinal pigment epithelium-derived rhodopsinHomolog |
| RRM2B | 50484 | NP_056528 | 4116 | ribonucleotide reductase M2 B (TP53 inducible) |
| RTN1 | 6252 | NP_066959 | 4779 | reticulon 1 |
| RTN1 | 6252 | NP_996734 | 6974 | reticulon 1 |
| RTN1 | 6252 | NP_996739 | 6975 | reticulon 1 |
| RTN2 | 6253 | NP_005610 | 3327 | reticulon 2 |
| RTN2 | 6253 | NP_996783 | 6978 | reticulon 2 |
| RTN2 | 6253 | NP_996784 | 6979 | reticulon 2 |
| RTN3 | 10313 | NP_006045 | 3422 | reticulon 3 |
| RTN3 | 10313 | NP_958831 | 6899 | reticulon 3 |
| RTN3 | 10313 | NP_958832 | 6900 | reticulon 3 |
| RTN3 | 10313 | NP_958833 | 6901 | reticulon 3 |
| RTN4 | 57142 | NP_008939 | 3613 | reticulon 4 |
| RTN4 | 57142 | NP_065393 | 4680 | reticulon 4 |
| RTN4 | 57142 | NP_722550 | 6235 | reticulon 4 |
| RTN4 | 57142 | NP_997403 | 7023 | reticulon 4 |
| RTN4 | 57142 | NP_997404 | 7024 | reticulon 4 |
| RTP1 | 132112 | NP_714919 | 6218 | receptor (chemosensory) transporter protein 1 |
| RTP3 | 83597 | NP_113628 | 5224 | receptor (chemosensory) transporter protein 3 |
| RXFP1 | 59350 | NP_067647 | 4812 | relaxin/insulin-like family peptide receptor 1 |
| RXFP2 | 122042 | NP_001159530 | 2142 | relaxin/insulin-like family peptide receptor 2 |
| RXFP2 | 122042 | NP_570718 | 5667 | relaxin/insulin-like family peptide receptor 2 |
| RXFP3 | 51289 | NP_057652 | 4246 | relaxin/insulin-like family peptide receptor 3 |
| RYK | 6259 | NP_001005861 | 473 | RYK receptor-like tyrosine kinase |
| RYK | 6259 | NP_002949 | 2737 | RYK receptor-like tyrosine kinase |
| RYR1 | 6261 | NP_000531 | 157 | ryanodine receptor 1 (skeletal) |
| RYR1 | 6261 | NP_001036188 | 917 | ryanodine receptor 1 (skeletal) |
| RYR2 | 6262 | NP_001026 | 718 | ryanodine receptor 2 (cardiac) |
| RYR3 | 6263 | NP_001027 | 736 | ryanodine receptor 3 |
| S100A10 | 6281 | NP_002957.1 | 7264 | S100 calcium binding protein A10 |
| S1PR1 | 1901 | NP_001391 | 2360 | sphingosine-1-phosphate receptor 1 |
| S1PR2 | 9294 | NP_004221 | 2994 | sphingosine-1-phosphate receptor 2 |
| S1PR3 | 1903 | NP_005217 | 3234 | sphingosine-1-phosphate receptor 3 |
| S1PR4 | 8698 | NP_003766 | 2889 | sphingosine-1-phosphate receptor 4 |
| S1PR5 | 53637 | NP_001159687 | 2154 | sphingosine-1-phosphate receptor 5 |
| S1PR5 | 53637 | NP_110387 | 5164 | sphingosine-1-phosphate receptor 5 |
| SACM1L | 22908 | NP_054735 | 3855 | SAC1 suppressor of actin mutations 1-like (yeast) |
| SAMD5 | 389432 | NP_001025231 | 716 | sterile alpha motif domain containing 5 |
| SAMD8 | 142891 | NP_653261 | 5885 | sterile alpha motif domain containing 8 |
| SAYSD1 | 55776 | NP_060792 | 4421 | chromosome 6 open reading frame 64 |
| SC5D | 6309 | NP_001020127 | 692 | sterol-C5-desaturase (ERG3 delta-5-desaturaseHomolog, S. cerevisiae)-like |
| SC5D | 6309 | NP_008849 | 3593 | sterol-C5-desaturase (ERG3 delta-5-desaturaseHomolog, S. cerevisiae)-like |
| SCAMP1 | 9522 | NP_004857 | 3152 | secretory carrier membrane protein 1 |
| SCAMP2 | 10066 | NP_005688 | 3346 | secretory carrier membrane protein 2 |
| SCAMP3 | 10067 | NP_005689 | 3347 | secretory carrier membrane protein 3 |
| SCAMP3 | 10067 | NP_443069 | 5516 | secretory carrier membrane protein 3 |
| SCAMP4 | 113178 | NP_524558 | 5596 | secretory carrier membrane protein 4 |
| SCAMP5 | 192683 | NP_620417 | 5809 | secretory carrier membrane protein 5 |
| SCAP | 22937 | NP_036367 | 3725 | SREBF chaperone |
| SCARA3 | 51435 | NP_057324 | 4190 | scavenger receptor class A, member 3 |
| SCARA3 | 51435 | NP_878185 | 6686 | scavenger receptor class A, member 3 |
| SCARA5 | 286133 | NP_776194 | 6392 | scavenger receptor class A, member 5 (putative) |
| SCARB1 | 949 | NP_001076428 | 1063 | scavenger receptor class B, member 1 |
| SCARB1 | 949 | NP_005496 | 3299 | scavenger receptor class B, member 1 |
| SCARB2 | 950 | NP_005497 | 3300 | scavenger receptor class B, member 2 |
| SCCPDH | 51097 | NP_057086 | 4150 | saccharopine dehydrogenase (putative) |
| SCD | 6319 | NP_005054 | 3203 | stearoyl-CoA desaturase (delta-9-desaturase) |
| SCG2 | 7857 | NP_003460 | 2838 | secretogranin II (chromogranin C) |
| SCIMP | 388325 | NP_996986 | 6998 | chromosome 17 open reading frame 87 |
| SCN10A | 6336 | NP_006505 | 3503 | sodium channel, voltage-gated, type X, alpha subunit |
| SCN11A | 11280 | NP_054858 | 3870 | sodium channel, voltage-gated, type XI, alpha subunit |
| SCN1A | 6323 | NP_001159435 | 2133 | sodium channel, voltage-gated, type I, alpha subunit |
| SCN1A | 6323 | NP_001159436 | 2134 | sodium channel, voltage-gated, type I, alpha subunit |

FIG. 2 (CONT.)

| Antigen | GeneID | Accession No. | SEQ ID NO: | RefSeq Gene Name |
|---|---|---|---|---|
| SCN1A | 6323 | NP_008851 | 3594 | sodium channel, voltage-gated, type I, alpha subunit |
| SCN1B | 6324 | NP_001028 | 748 | sodium channel, voltage-gated, type I, beta |
| SCN1B | 6324 | NP_950238 | 6851 | sodium channel, voltage-gated, type I, beta |
| SCN2A | 6326 | NP_001035232 | 842 | sodium channel, voltage-gated, type II, alpha subunit |
| SCN2A | 6326 | NP_001035233 | 843 | sodium channel, voltage-gated, type II, alpha subunit |
| SCN2A | 6326 | NP_066287 | 4757 | sodium channel, voltage-gated, type II, alpha subunit |
| SCN2B | 6327 | NP_004579 | 3080 | sodium channel, voltage-gated, type II, beta |
| SCN3A | 6328 | NP_001075145 | 1053 | sodium channel, voltage-gated, type III, alpha subunit |
| SCN3A | 6328 | NP_001075146 | 1054 | sodium channel, voltage-gated, type III, alpha subunit |
| SCN3A | 6328 | NP_008853 | 3595 | sodium channel, voltage-gated, type III, alpha subunit |
| SCN3B | 55800 | NP_001035241 | 844 | sodium channel, voltage-gated, type III, beta |
| SCN3B | 55800 | NP_060870 | 4439 | sodium channel, voltage-gated, type III, beta |
| SCN4A | 6329 | NP_000325 | 95 | sodium channel, voltage-gated, type IV, alpha subunit |
| SCN4B | 6330 | NP_001135820 | 1646 | sodium channel, voltage-gated, type IV, beta |
| SCN4B | 6330 | NP_001135821 | 1647 | sodium channel, voltage-gated, type IV, beta |
| SCN4B | 6330 | NP_777594 | 6413 | sodium channel, voltage-gated, type IV, beta |
| SCN5A | 6331 | NP_000326.2 | 7324 | sodium voltage-gated channel alpha subunit 5 |
| SCN7A | 6332 | NP_002967 | 2739 | sodium channel, voltage-gated, type VII, alpha |
| SCN8A | 6334 | NP_055006 | 3879 | sodium channel, voltage gated, type VIII, alpha subunit |
| SCN9A | 6335 | NP_002968 | 2740 | sodium channel, voltage-gated, type IX, alpha subunit |
| SCNN1A | 6337 | NP_001029 | 756 | sodium channel, nonvoltage-gated 1 alpha |
| SCNN1A | 6337 | NP_001153047 | 1946 | sodium channel, nonvoltage-gated 1 alpha |
| SCNN1A | 6337 | NP_001153048 | 1947 | sodium channel, nonvoltage-gated 1 alpha |
| SCNN1B | 6338 | NP_000327 | 96 | sodium channel, nonvoltage-gated 1, beta |
| SCNN1D | 6339 | NP_001123885 | 1422 | sodium channel, nonvoltage-gated 1, delta |
| SCNN1D | 6339 | NP_001123885.2 | 2741 | sodium channel, nonvoltage-gated 1, delta |
| SCNN1G | 6340 | NP_001030 | 759 | sodium channel, nonvoltage-gated 1, gamma |
| SCRG1 | 11341 | NP_009212 | 3667 | stimulator of chondrogenesis 1 |
| SCTR | 6344 | NP_002971 | 2742 | secretin receptor |
| SCUBE2 | 57758 | NP_001164161 | 2251 | signal peptide, CUB domain, EGF-like 2 |
| SCUBE2 | 57758 | NP_066025 | 4749 | signal peptide, CUB domain, EGF-like 2 |
| SDC1 | 6382 | NP_001006947 | 496 | syndecan 1 |
| SDC1 | 6382 | NP_002988 | 2747 | syndecan 1 |
| SDC2 | 6383 | NP_002989 | 2748 | syndecan 2 |
| SDC3 | 9672 | NP_055469 | 3969 | syndecan 3 |
| SDC4 | 6385 | NP_002990 | 2749 | syndecan 4 |
| SDCBP | 6386 | NP_001007068 | 501 | syndecan binding protein (syntenin) |
| SDCBP | 6386 | NP_001007069 | 502 | syndecan binding protein (syntenin) |
| SDCBP | 6386 | NP_001007070 | 503 | syndecan binding protein (syntenin) |
| SDCBP | 6386 | NP_001007071 | 504 | syndecan binding protein (syntenin) |
| SDCBP | 6386 | NP_005616 | 3328 | syndecan binding protein (syntenin) |
| SDF2L1 | 23753 | NP_071327 | 4867 | stromal cell-derived factor 2-like 1 |
| SDF4 | 51150 | NP_057260.2 | 7307 | stromal cell derived factor 4 |
| SDHC | 6391 | NP_001030588 | 764 | succinate dehydrogenase complex, subunit C, integral membrane protein, 15kDa |
| SDHC | 6391 | NP_001030589 | 765 | succinate dehydrogenase complex, subunit C, integral membrane protein, 15kDa |
| SDHC | 6391 | NP_001030590 | 766 | succinate dehydrogenase complex, subunit C, integral membrane protein, 15kDa |
| SDHC | 6391 | NP_002992 | 2750 | succinate dehydrogenase complex, subunit C, integral membrane protein, 15kDa |
| SDK1 | 221935 | NP_001073121 | 989 | sidekickHomolog 1, cell adhesion molecule (chicken)Hypothetical LOC730351 |
| SDK1 | 221935 | NP_689957 | 6109 | sidekickHomolog 1, cell adhesion molecule (chicken)Hypothetical LOC730351 |
| SDK2 | 54549 | NP_001138424 | 1799 | sidekickHomolog 2 (chicken) |
| SDR42E1 | 93517 | NP_660151 | 5930 | short chain dehydrogenase/reductase family 42E, member 1 |
| SDSL | 113675 | NP_612441 | 5751 | serine dehydratase-like |
| SEC11A | 23478 | NP_055115 | 3909 | SEC11Homolog A (S. cerevisiae) |
| SEC11C | 90701 | NP_150596 | 5479 | SEC11Homolog C (S. cerevisiae) |
| SEC22A | 26984 | NP_036562 | 3775 | SEC22 vesicle trafficking proteinHomolog A (S. cerevisiae) |
| SEC61A1 | 29927 | NP_037468 | 3804 | Sec61 alpha 1 subunit (S. cerevisiae) |
| SEC61A2 | 55176 | NP_001136099 | 1679 | Sec61 alpha 2 subunit (S. cerevisiae) |
| SEC61A2 | 55176 | NP_001136100 | 1680 | Sec61 alpha 2 subunit (S. cerevisiae) |
| SEC61A2 | 55176 | NP_060614 | 4397 | Sec61 alpha 2 subunit (S. cerevisiae) |
| SEC61G | 23480 | NP_001012474 | 596 | Sec61 gamma subunit |
| SEC61G | 23480 | NP_055117 | 3910 | Sec61 gamma subunit |
| SEC62 | 7095 | NP_003253 | 2805 | SEC62Homolog (S. cerevisiae) |
| SEC63 | 11231 | NP_009145 | 3650 | SEC63Homolog (S. cerevisiae) |
| SECTM1 | 6398 | NP_002995.1 | 7265 | secreted and transmembrane 1 |
| SEL1L | 6400 | NP_005056 | 3204 | sel-1 suppressor of lin-12-like (C. elegans) |
| SEL1L3 | 23231 | NP_056002 | 4043 | KIAA0746 protein |
| SELE | 6401 | NP_000441 | 132 | selectin E |
| SELK | 58515 | NP_067060 | 4800 | selenoprotein K |
| SELL | 6402 | NP_000646 | 187 | selectin L |
| SELM | 140606 | NP_536355 | 5603 | selenoprotein M |
| SELP | 6403 | NP_002996 | 2751 | selectin P (granule membrane protein 140kDa, antigen CD62) |
| SELPLG | 6404 | NP_002997 | 2752 | selectin P ligand |
| SELT | 51714 | NP_057359 | 4197 | selenoprotein T |
| SEMA3B | 7869 | NP_001005914 | 475 | sema domain, immunoglobulin domain (Ig), short basic domain, secreted, (semaphorin) 3B |
| SEMA3B | 7869 | NP_004627 | 3094 | sema domain, immunoglobulin domain (Ig), short basic domain, secreted, (semaphorin) 3B |
| SEMA3D | 223117 | NP_689967 | 6111 | sema domain, immunoglobulin domain (Ig), short basic domain, secreted, (semaphorin) 3D |

FIG. 2 (CONT.)

| Antigen | GeneID | Accession No. | SEQ ID NO: | RefSeq Gene Name |
|---|---|---|---|---|
| SEMA4A | 64218 | NP_071762 | 4906 | sema domain, immunoglobulin domain (Ig), transmembrane domain (TM) and short cytoplasmic domain, (semaphorin) 4A |
| SEMA4B | 10509 | NP_064595 | 4618 | sema domain, immunoglobulin domain (Ig), transmembrane domain (TM) and short cytoplasmic domain, (semaphorin) 4B |
| SEMA4B | 10509 | NP_945119 | 6844 | sema domain, immunoglobulin domain (Ig), transmembrane domain (TM) and short cytoplasmic domain, (semaphorin) 4B |
| SEMA4C | 54910 | NP_060259 | 4343 | sema domain, immunoglobulin domain (Ig), transmembrane domain (TM) and short cytoplasmic domain, (semaphorin) 4C |
| SEMA4D | 10507 | NP_001135759 | 1634 | sema domain, immunoglobulin domain (Ig), transmembrane domain (TM) and short cytoplasmic domain, (semaphorin) 4D |
| SEMA4D | 10507 | NP_006369 | 3478 | sema domain, immunoglobulin domain (Ig), transmembrane domain (TM) and short cytoplasmic domain, (semaphorin) 4D |
| SEMA4F | 10505 | NP_004254 | 3003 | sema domain, immunoglobulin domain (Ig), transmembrane domain (TM) and short cytoplasmic domain, (semaphorin) 4F |
| SEMA4G | 57715 | NP_060363 | 4365 | sema domain, immunoglobulin domain (Ig), transmembrane domain (TM) and short cytoplasmic domain, (semaphorin) 4G |
| SEMA5A | 9037 | NP_003957 | 2934 | sema domain, seven thrombospondin repeats (type 1 and type 1-like), transmembrane domain (TM) and short cytoplasmic domain, (semaphorin) 5A |
| SEMA5B | 54437 | NP_001026872.2 | 7357 | semaphorin 5B |
| SEMA6A | 57556 | NP_065847 | 4725 | sema domain, transmembrane domain (TM), and cytoplasmic domain, (semaphorin) 6A |
| SEMA6B | 10501 | NP_115484 | 5297 | sema domain, transmembrane domain (TM), and cytoplasmic domain, (semaphorin) 6B |
| SEMA6D | 80031 | NP_065909 | 4733 | sema domain, transmembrane domain (TM), and cytoplasmic domain, (semaphorin) 6D |
| SEMA6D | 80031 | NP_079242 | 5110 | sema domain, transmembrane domain (TM), and cytoplasmic domain, (semaphorin) 6D |
| SEMA6D | 80031 | NP_705869 | 6204 | sema domain, transmembrane domain (TM), and cytoplasmic domain, (semaphorin) 6D |
| SEMA6D | 80031 | NP_705870 | 6205 | sema domain, transmembrane domain (TM), and cytoplasmic domain, (semaphorin) 6D |
| SEMA6D | 80031 | NP_705871 | 6206 | sema domain, transmembrane domain (TM), and cytoplasmic domain, (semaphorin) 6D |
| SEMA6D | 80031 | NP_705872 | 6207 | sema domain, transmembrane domain (TM), and cytoplasmic domain, (semaphorin) 6D |
| SEPP1 | 6414 | NP_001078955 | 1096 | selenoprotein P, plasma, 1 |
| SEPP1 | 6414 | NP_001087195 | 1100 | selenoprotein P, plasma, 1 |
| SEPP1 | 6414 | NP_005401 | 3281 | selenoprotein P, plasma, 1 |
| SERINC1 | 57515 | NP_065806 | 4717 | serine incorporator 1 |
| SERINC2 | 347735 | NP_849196 | 6575 | serine incorporator 2 |
| SERINC3 | 10955 | NP_006802 | 3568 | serine incorporator 3 |
| SERINC3 | 10955 | NP_945179 | 6845 | serine incorporator 3 |
| SERINC5 | 256987 | NP_840060 | 6533 | serine incorporator 5 |
| SERP1 | 27230 | NP_055260 | 3941 | stress-associated endoplasmic reticulum protein 1 |
| SERP2 | 387923 | NP_001010897 | 575 | stress-associated endoplasmic reticulum protein family member 2 |
| SERPINA1 | 5265 | NP_000286 | 82 | serpin peptidase inhibitor, clade A (alpha-1 antiproteinase, antitrypsin), member 1 |
| SERPINA1 | 5265 | NP_001002235 | 389 | serpin peptidase inhibitor, clade A (alpha-1 antiproteinase, antitrypsin), member 1 |
| SERPINA1 | 5265 | NP_001002236 | 390 | serpin peptidase inhibitor, clade A (alpha-1 antiproteinase, antitrypsin), member 1 |
| SERPINA1 | 5265 | NP_001121172 | 1349 | serpin peptidase inhibitor, clade A (alpha-1 antiproteinase, antitrypsin), member 1 |
| SERPINA1 | 5265 | NP_001121173 | 1350 | serpin peptidase inhibitor, clade A (alpha-1 antiproteinase, antitrypsin), member 1 |
| SERPINA1 | 5265 | NP_001121174 | 1351 | serpin peptidase inhibitor, clade A (alpha-1 antiproteinase, antitrypsin), member 1 |
| SERPINA1 | 5265 | NP_001121175 | 1352 | serpin peptidase inhibitor, clade A (alpha-1 antiproteinase, antitrypsin), member 1 |
| SERPINA1 | 5265 | NP_001121176 | 1353 | serpin peptidase inhibitor, clade A (alpha-1 antiproteinase, antitrypsin), member 1 |
| SERPINA1 | 5265 | NP_001121177 | 1354 | serpin peptidase inhibitor, clade A (alpha-1 antiproteinase, antitrypsin), member 1 |
| SERPINA1 | 5265 | NP_001121178 | 1355 | serpin peptidase inhibitor, clade A (alpha-1 antiproteinase, antitrypsin), member 1 |
| SERPINA1 | 5265 | NP_001121179 | 1356 | serpin peptidase inhibitor, clade A (alpha-1 antiproteinase, antitrypsin), member 1 |
| SERPINA9 | 327657 | NP_001035983 | 901 | serpin peptidase inhibitor, clade A (alpha-1 antiproteinase, antitrypsin), member 9 |
| SERPINA9 | 327657 | NP_783866 | 6458 | serpin peptidase inhibitor, clade A (alpha-1 antiproteinase, antitrypsin), member 9 |
| SERPINB13 | 5275 | NP_036529 | 3767 | serpin peptidase inhibitor, clade B (ovalbumin), member 13 |
| SERTM1 | 400120 | NP_982276 | 6937 | chromosome 13 open reading frame 36 |
| SEZ6 | 124925 | NP_001092105 | 1143 | seizure related 6Homolog (mouse) |
| SEZ6 | 124925 | NP_849191 | 6574 | seizure related 6Homolog (mouse) |
| SEZ6L | 23544 | NP_066938 | 4776 | seizure related 6Homolog (mouse)-like |
| SEZ6L2 | 26470 | NP_001107571 | 1266 | seizure related 6Homolog (mouse)-like 2 |
| SEZ6L2 | 26470 | NP_001107572 | 1267 | seizure related 6Homolog (mouse)-like 2 |
| SEZ6L2 | 26470 | NP_036542 | 3772 | seizure related 6Homolog (mouse)-like 2 |
| SEZ6L2 | 26470 | NP_963869 | 6911 | seizure related 6Homolog (mouse)-like 2 |
| SFRP1 | 6422 | NP_003003 | 2753 | secreted frizzled-related protein 1 |
| SFT2D1 | 113402 | NP_660152 | 5931 | SFT2 domain containing 1 |
| SFT2D2 | 375035 | NP_955376 | 6879 | SFT2 domain containing 2 |
| SFT2D3 | 84826 | NP_116129 | 5394 | SFT2 domain containing 3 |
| SFTPC | 6440 | NP_003009 | 2754 | surfactant protein C |
| SFTPD | 6441 | NP_003010 | 2755 | surfactant protein D |
| SFXN1 | 94081 | NP_073591 | 4943 | sideroflexin 1 |
| SFXN2 | 118980 | NP_849189 | 6572 | sideroflexin 2 |
| SFXN3 | 81855 | NP_112233 | 5209 | sideroflexin 3 |
| SFXN4 | 119559 | NP_998814 | 7046 | sideroflexin 4 |
| SFXN5 | 94097 | NP_653180 | 5865 | sideroflexin 5 |
| SGCA | 6442 | NP_000014 | 4 | sarcoglycan, alpha (50kDa dystrophin-associated glycoprotein) |
| SGCA | 6442 | NP_001129169 | 1554 | sarcoglycan, alpha (50kDa dystrophin-associated glycoprotein) |
| SGCB | 6443 | NP_000223 | 73 | sarcoglycan, beta (43kDa dystrophin-associated glycoprotein) |
| SGCD | 6444 | NP_000328 | 97 | sarcoglycan, delta (35kDa dystrophin-associated glycoprotein) |
| SGCD | 6444 | NP_001121681 | 1368 | sarcoglycan, delta (35kDa dystrophin-associated glycoprotein) |
| SGCD | 6444 | NP_758447 | 6301 | sarcoglycan, delta (35kDa dystrophin-associated glycoprotein) |
| SGCE | 8910 | NP_001092870 | 1156 | sarcoglycan, epsilon |

FIG. 2 (CONT.)

| Antigen | GeneID | Accession No. | SEQ ID NO: | RefSeq Gene Name |
|---|---|---|---|---|
| SGCE | 8910 | NP_001092871 | 1157 | sarcoglycan, epsilon |
| SGCE | 8910 | NP_003910 | 2927 | sarcoglycan, epsilon |
| SGCG | 6445 | NP_000222 | 72 | sarcoglycan, gamma (35kDa dystrophin-associated glycoprotein) |
| SGCZ | 137868 | NP_631906 | 5841 | sarcoglycan zeta |
| SGMS1 | 259230 | NP_671512 | 5991 | sphingomyelin synthase 1 |
| SGMS2 | 166929 | NP_001129729 | 1604 | sphingomyelin synthase 2 |
| SGMS2 | 166929 | NP_001129730 | 1605 | sphingomyelin synthase 2 |
| SGMS2 | 166929 | NP_689834 | 6090 | sphingomyelin synthase 2 |
| SGPL1 | 8879 | NP_003892 | 2926 | sphingosine-1-phosphate lyase 1 |
| SGPP1 | 81537 | NP_110418 | 5176 | sphingosine-1-phosphate phosphatase 1 |
| SGPP2 | 130367 | NP_689599 | 6046 | sphingosine-1-phosphate phosphotase 2 |
| SHH | 6469 | NP_000184 | 58 | sonicHedgehogHomolog (Drosophila) |
| SHISA2 | 387914 | NP_001007539 | 522 | shisaHomolog 2 (Xenopus laevis) |
| SHISA3 | 152573 | NP_001073974 | 1032 | shisaHomolog 3 (Xenopus laevis) |
| SHISA4 | 149345 | NP_937792 | 6746 | shisaHomolog 4 (Xenopus laevis) |
| SHISA5 | 51246 | NP_057563 | 4225 | shisaHomolog 5 (Xenopus laevis) |
| SHISA6 | 388336 | NP_997269 | 7019 | FLJ45455 protein |
| SHISA7 | 729956 | NP_001138648.1 | 7406 | shisa family member 7 |
| SHISA8 | 440829 | XP_496530 | 7089 | transmembrane protein 46-like |
| SHISA8 | 440829 | XP_945572 | 7094 | transmembrane protein 46-like |
| SHISA9 | 729993 | NP_001138676.2 | 7418 | shisa family member 9 |
| SI | 6476 | NP_001032 | 767 | sucrase-isomaltase (alpha-glucosidase) |
| SIDT1 | 54847 | NP_060169 | 4325 | SID1 transmembrane family, member 1 |
| SIDT2 | 51092 | NP_001035545 | 871 | SID1 transmembrane family, member 2 |
| SIGIRR | 59307 | NP_001128525 | 1515 | single immunoglobulin and toll-interleukin 1 receptor (TIR) domain |
| SIGIRR | 59307 | NP_001128526 | 1516 | single immunoglobulin and toll-interleukin 1 receptor (TIR) domain |
| SIGIRR | 59307 | NP_068577 | 4832 | single immunoglobulin and toll-interleukin 1 receptor (TIR) domain |
| SIGLEC1 | 6614 | NP_075556 | 4971 | sialic acid binding Ig-like lectin 1, sialoadhesin |
| SIGLEC10 | 89790 | NP_001164627.1 | 7416 | sialic acid binding Ig like lectin 10 |
| SIGLEC11 | 114132 | NP_001128635 | 1533 | sialic acid binding Ig-like lectin 11 |
| SIGLEC11 | 114132 | NP_443116 | 5525 | sialic acid binding Ig-like lectin 11 |
| SIGLEC6 | 946 | NP_001236 | 2325 | sialic acid binding Ig-like lectin 6 |
| SIGLEC6 | 946 | NP_942142 | 6839 | sialic acid binding Ig-like lectin 6 |
| SIGLEC6 | 946 | NP_942143 | 6840 | sialic acid binding Ig-like lectin 6 |
| SIGLEC7 | 27036 | NP_055200 | 3927 | sialic acid binding Ig-like lectin 7 |
| SIGLEC7 | 27036 | NP_057627 | 4240 | sialic acid binding Ig-like lectin 7 |
| SIGLEC8 | 27181 | NP_055257 | 3940 | sialic acid binding Ig-like lectin 8 |
| SIGLEC9 | 27180 | NP_055256 | 3939 | sialic acid binding Ig-like lectin 9 |
| SIGLECL1 | 284369 | NP_775906 | 6368 | hypothetical protein FLJ40235 |
| SIGMAR1 | 10280 | NP_005857 | 3390 | sigma non-opioid intracellular receptor 1 |
| SIGMAR1 | 10280 | NP_671513 | 5992 | sigma non-opioid intracellular receptor 1 |
| SIRPA | 140885 | NP_001035111 | 821 | signal-regulatory protein alpha |
| SIRPA | 140885 | NP_001035112 | 822 | signal-regulatory protein alpha |
| SIRPA | 140885 | NP_542970 | 5629 | signal-regulatory protein alpha |
| SIRPB1 | 10326 | NP_001077379 | 1082 | signal-regulatory protein beta 1 |
| SIRPB1 | 10326 | NP_001129316 | 1573 | signal-regulatory protein beta 1 |
| SIRPB1 | 10326 | NP_006056 | 3426 | signal-regulatory protein beta 1 |
| SIRPB2 | 284759 | NP_001116434 | 1294 | signal-regulatory protein beta 2 |
| SIRPB2 | 284759 | NP_001128308 | 1507 | signal-regulatory protein beta 2 |
| SIRPG | 55423 | NP_001034597 | 797 | signal-regulatory protein gamma |
| SIRPG | 55423 | NP_061026 | 4466 | signal-regulatory protein gamma |
| SIRPG | 55423 | NP_543006 | 5630 | signal-regulatory protein gamma |
| SIT1 | 27240 | NP_055265 | 3943 | signaling threshold regulating transmembrane adaptor 1 |
| SLAMF1 | 6504 | NP_003028 | 2759 | signaling lymphocytic activation molecule family member 1 |
| SLAMF6 | 114836 | NP_443163 | 5541 | SLAM family member 6 |
| SLAMF7 | 57823 | NP_067004 | 4788 | SLAM family member 7 |
| SLAMF8 | 56833 | NP_064510 | 4599 | SLAM family member 8 |
| SLAMF9 | 89886 | NP_001139644 | 1910 | SLAM family member 9 |
| SLAMF9 | 89886 | NP_001139645 | 1911 | SLAM family member 9 |
| SLAMF9 | 89886 | NP_254273 | 5498 | SLAM family member 9 |
| SLC10A1 | 6554 | NP_003040 | 2770 | solute carrier family 10 (sodium/bile acid cotransporter family), member 1 |
| SLC10A2 | 6555 | NP_000443 | 133 | solute carrier family 10 (sodium/bile acid cotransporter family), member 2 |
| SLC10A3 | 8273 | NP_001135863 | 1652 | solute carrier family 10 (sodium/bile acid cotransporter family), member 3 |
| SLC10A3 | 8273 | NP_001135864 | 1653 | solute carrier family 10 (sodium/bile acid cotransporter family), member 3 |
| SLC10A3 | 8273 | NP_062822 | 4584 | solute carrier family 10 (sodium/bile acid cotransporter family), member 3 |
| SLC10A4 | 201780 | NP_689892 | 6095 | solute carrier family 10 (sodium/bile acid cotransporter family), member 4 |
| SLC10A7 | 84068 | NP_001025169 | 712 | solute carrier family 10 (sodium/bile acid cotransporter family), member 7 |
| SLC10A7 | 84068 | NP_115504 | 5301 | solute carrier family 10 (sodium/bile acid cotransporter family), member 7 |
| SLC11A1 | 6556 | NP_000569 | 166 | solute carrier family 11 (proton-coupled divalent metal ion transporters), member 1 |
| SLC11A2 | 4891 | NP_000608 | 175 | solute carrier family 11 (proton-coupled divalent metal ion transporters), member 2 |
| SLC12A1 | 6557 | NP_000329 | 98 | solute carrier family 12 (sodium/potassium/chloride transporters), member 1 |
| SLC12A2 | 6558 | NP_001037 | 919 | solute carrier family 12 (sodium/potassium/chloride transporters), member 2 |
| SLC12A3 | 6559 | NP_000330 | 99 | solute carrier family 12 (sodium/chloride transporters), member 3 |
| SLC12A3 | 6559 | NP_001119579 | 1303 | solute carrier family 12 (sodium/chloride transporters), member 3 |
| SLC12A3 | 6559 | NP_001119580 | 1304 | solute carrier family 12 (sodium/chloride transporters), member 3 |
| SLC12A4 | 6560 | NP_001139433 | 1888 | solute carrier family 12 (potassium/chloride transporters), member 4 |
| SLC12A4 | 6560 | NP_001139434 | 1889 | solute carrier family 12 (potassium/chloride transporters), member 4 |

FIG. 2 (CONT.)

| Antigen | GeneID | Accession No. | SEQ ID NO: | RefSeq Gene Name |
|---|---|---|---|---|
| SLC12A4 | 6560 | NP_001139435 | 1890 | solute carrier family 12 (potassium/chloride transporters), member 4 |
| SLC12A4 | 6560 | NP_001139436 | 1891 | solute carrier family 12 (potassium/chloride transporters), member 4 |
| SLC12A4 | 6560 | NP_005063 | 3207 | solute carrier family 12 (potassium/chloride transporters), member 4 |
| SLC12A5 | 57468 | NP_001128243 | 1506 | solute carrier family 12 (potassium-chloride transporter), member 5 |
| SLC12A5 | 57468 | NP_065759 | 4706 | solute carrier family 12 (potassium-chloride transporter), member 5 |
| SLC12A6 | 9990 | NP_001035959 | 896 | solute carrier family 12 (potassium/chloride transporters), member 6 |
| SLC12A6 | 9990 | NP_001035960 | 897 | solute carrier family 12 (potassium/chloride transporters), member 6 |
| SLC12A6 | 9990 | NP_001035961 | 898 | solute carrier family 12 (potassium/chloride transporters), member 6 |
| SLC12A6 | 9990 | NP_001035962 | 899 | solute carrier family 12 (potassium/chloride transporters), member 6 |
| SLC12A6 | 9990 | NP_005126 | 3218 | solute carrier family 12 (potassium/chloride transporters), member 6 |
| SLC12A6 | 9990 | NP_598408 | 5702 | solute carrier family 12 (potassium/chloride transporters), member 6 |
| SLC12A7 | 10723 | NP_006589 | 3525 | solute carrier family 12 (potassium/chloride transporters), member 7 |
| SLC12A8 | 84561 | NP_078904 | 5058 | solute carrier family 12 (potassium/chloride transporters), member 8 |
| SLC12A9 | 56996 | NP_064631 | 4623 | solute carrier family 12 (potassium/chloride transporters), member 9 |
| SLC13A1 | 6561 | NP_071889 | 4918 | solute carrier family 13 (sodium/sulfate symporters), member 1 |
| SLC13A2 | 9058 | NP_001139447 | 1892 | solute carrier family 13 (sodium-dependent dicarboxylate transporter), member 2 |
| SLC13A2 | 9058 | NP_001139447.1 | 1893 | solute carrier family 13 (sodium-dependent dicarboxylate transporter), member 2 |
| SLC13A2 | 9058 | NP_003975 | 2940 | solute carrier family 13 (sodium-dependent dicarboxylate transporter), member 2 |
| SLC13A3 | 64849 | NP_001011554 | 589 | solute carrier family 13 (sodium-dependent dicarboxylate transporter), member 3 |
| SLC13A3 | 64849 | NP_073740 | 4953 | solute carrier family 13 (sodium-dependent dicarboxylate transporter), member 3 |
| SLC13A4 | 26266 | NP_036582 | 3778 | solute carrier family 13 (sodium/sulfate symporters), member 4 |
| SLC13A5 | 284111 | NP_001137310 | 1732 | solute carrier family 13 (sodium-dependent citrate transporter), member 5 |
| SLC13A5 | 284111 | NP_808218 | 6501 | solute carrier family 13 (sodium-dependent citrate transporter), member 5 |
| SLC14A1 | 6563 | NP_001122060 | 1374 | solute carrier family 14 (urea transporter), member 1 (Kidd blood group) |
| SLC14A1 | 6563 | NP_001139508 | 1897 | solute carrier family 14 (urea transporter), member 1 (Kidd blood group) |
| SLC14A1 | 6563 | NP_001139509 | 1898 | solute carrier family 14 (urea transporter), member 1 (Kidd blood group) |
| SLC14A1 | 6563 | NP_056949 | 4125 | solute carrier family 14 (urea transporter), member 1 (Kidd blood group) |
| SLC14A2 | 8170 | NP_009094 | 3638 | solute carrier family 14 (urea transporter), member 2 |
| SLC15A1 | 6564 | NP_005064 | 3208 | solute carrier family 15 (oligopeptide transporter), member 1 |
| SLC15A2 | 6565 | NP_001139470 | 1894 | solute carrier family 15 (H+/peptide transporter), member 2 |
| SLC15A2 | 6565 | NP_066568 | 4765 | solute carrier family 15 (H+/peptide transporter), member 2 |
| SLC15A3 | 51296 | NP_057666 | 4251 | solute carrier family 15, member 3 |
| SLC15A4 | 121260 | NP_663623 | 5964 | solute carrier family 15, member 4 |
| SLC16A1 | 6566 | NP_001159968 | 2171 | solute carrier family 16, member 1 (monocarboxylic acid transporter 1) |
| SLC16A1 | 6566 | NP_003042 | 2771 | solute carrier family 16, member 1 (monocarboxylic acid transporter 1) |
| SLC16A10 | 117247 | NP_061063 | 4470 | solute carrier family 16, member 10 (aromatic amino acid transporter) |
| SLC16A11 | 162515 | NP_699188 | 6183 | solute carrier family 16, member 11 (monocarboxylic acid transporter 11) |
| SLC16A14 | 151473 | NP_689740 | 6075 | solute carrier family 16, member 14 (monocarboxylic acid transporter 14) |
| SLC16A2 | 6567 | NP_006508 | 3505 | solute carrier family 16, member 2 (monocarboxylic acid transporter 8) |
| SLC16A3 | 9123 | NP_001035887.1 | 7361 | solute carrier family 16 member 3 |
| SLC16A4 | 9122 | NP_004687 | 3103 | solute carrier family 16, member 4 (monocarboxylic acid transporter 5) |
| SLC16A5 | 9121 | NP_004686 | 3102 | similar to MCT solute carrier family 16, member 5 (monocarboxylic acid transporter 6) |
| SLC16A6 | 9120 | NP_004685 | 3101 | solute carrier family 16, member 6 (monocarboxylic acid transporter 7) |
| SLC16A7 | 9194 | NP_004722 | 3110 | solute carrier family 16, member 7 (monocarboxylic acid transporter 2) |
| SLC16A8 | 23539 | NP_037488 | 3811 | solute carrier family 16, member 8 (monocarboxylic acid transporter 3) |
| SLC16A9 | 220963 | NP_919274 | 6715 | solute carrier family 16, member 9 (monocarboxylic acid transporter 9) |
| SLC17A1 | 6568 | NP_005065.2 | 7376 | solute carrier family 17 member 1 |
| SLC17A2 | 10246 | NP_005826 | 3381 | solute carrier family 17 (sodium phosphate), member 2 |
| SLC17A3 | 10786 | NP_001091956 | 1126 | solute carrier family 17 (sodium phosphate), member 3 |
| SLC17A3 | 10786 | NP_006623 | 3531 | solute carrier family 17 (sodium phosphate), member 3 |
| SLC17A4 | 10050 | NP_005486 | 3294 | solute carrier family 17 (sodium phosphate), member 4 |
| SLC17A5 | 26503 | NP_036566 | 3776 | solute carrier family 17 (anion/sugar transporter), member 5 |
| SLC17A7 | 57030 | NP_064705 | 4627 | solute carrier family 17 (sodium-dependent inorganic phosphate cotransporter), member 7 |
| SLC17A8 | 246213 | NP_001138760 | 1842 | solute carrier family 17 (sodium-dependent inorganic phosphate cotransporter), member 8 |
| SLC17A8 | 246213 | NP_647480 | 5854 | solute carrier family 17 (sodium-dependent inorganic phosphate cotransporter), member 8 |
| SLC18A1 | 6570 | NP_001129163 | 1553 | solute carrier family 18 (vesicular monoamine), member 1 |
| SLC18A1 | 6570 | NP_001135796 | 1641 | solute carrier family 18 (vesicular monoamine), member 1 |
| SLC18A1 | 6570 | NP_001135797 | 1642 | solute carrier family 18 (vesicular monoamine), member 1 |
| SLC18A1 | 6570 | NP_003044 | 2773 | solute carrier family 18 (vesicular monoamine), member 1 |
| SLC18A2 | 6571 | NP_003045 | 2774 | solute carrier family 18 (vesicular monoamine), member 2 |
| SLC18A3 | 6572 | NP_003046 | 2775 | solute carrier family 18 (vesicular acetylcholine), member 3 |
| SLC18B1 | 116843 | NP_439896 | 5513 | chromosome 6 open reading frame 192 |
| SLC19A1 | 6573 | NP_919231 | 6711 | solute carrier family 19 (folate transporter), member 1 |
| SLC19A2 | 10560 | NP_008927 | 3610 | solute carrier family 19 (thiamine transporter), member 2 |
| SLC19A3 | 80704 | NP_079519.1 | 7300 | solute carrier family 19 member 3 |
| SLC1A1 | 6505 | NP_004161 | 2976 | solute carrier family 1 (neuronal/epithelialHigh affinity glutamate transporter, system Xag), member 1 |
| SLC1A2 | 6506 | NP_004162 | 2977 | solute carrier family 1 (glialHigh affinity glutamate transporter), member 2 |
| SLC1A3 | 6507 | NP_001160167 | 2178 | solute carrier family 1 (glialHigh affinity glutamate transporter), member 3 |
| SLC1A3 | 6507 | NP_001160168 | 2179 | solute carrier family 1 (glialHigh affinity glutamate transporter), member 3 |
| SLC1A3 | 6507 | NP_004163 | 2978 | solute carrier family 1 (glialHigh affinity glutamate transporter), member 3 |
| SLC1A4 | 6509 | NP_001180422.1 | 1541 | solute carrier family 1 (glutamate/neutral amino acid transporter), member 4 |
| SLC1A4 | 6509 | NP_003029 | 2760 | solute carrier family 1 (glutamate/neutral amino acid transporter), member 4 |
| SLC1A5 | 6510 | NP_001138616 | 1816 | solute carrier family 1 (neutral amino acid transporter), member 5 |
| SLC1A5 | 6510 | NP_001138617 | 1817 | solute carrier family 1 (neutral amino acid transporter), member 5 |
| SLC1A5 | 6510 | NP_005619 | 3329 | solute carrier family 1 (neutral amino acid transporter), member 5 |
| SLC1A6 | 6511 | NP_005062 | 3206 | solute carrier family 1 (high affinity aspartate/glutamate transporter), member 6 |
| SLC1A7 | 6512 | NP_006662 | 3539 | solute carrier family 1 (glutamate transporter), member 7 |

FIG. 2 (CONT.)

| Antigen | GeneID | Accession No. | SEQ ID NO: | RefSeq Gene Name |
|---|---|---|---|---|
| SLC20A1 | 6574 | NP_005406 | 3282 | solute carrier family 20 (phosphate transporter), member 1 |
| SLC20A2 | 6575 | NP_006740 | 3556 | solute carrier family 20 (phosphate transporter), member 2 |
| SLC22A1 | 6580 | NP_003048 | 2776 | solute carrier family 22 (organic cation transporter), member 1 |
| SLC22A1 | 6580 | NP_694857 | 6155 | solute carrier family 22 (organic cation transporter), member 1 |
| SLC22A11 | 55867 | NP_060954 | 4460 | solute carrier family 22 (organic anion/urate transporter), member 11 |
| SLC22A12 | 116085 | NP_653186 | 5868 | solute carrier family 22 (organic anion/urate transporter), member 12 |
| SLC22A12 | 116085 | NP_700357 | 6189 | solute carrier family 22 (organic anion/urate transporter), member 12 |
| SLC22A13 | 9390 | NP_004247 | 3000 | solute carrier family 22 (organic anion transporter), member 13 |
| SLC22A14 | 9389 | NP_004794 | 3133 | solute carrier family 22, member 14 |
| SLC22A15 | 55356 | NP_060890 | 4446 | solute carrier family 22, member 15 |
| SLC22A16 | 85413 | NP_149116 | 5452 | solute carrier family 22 (organic cation/carnitine transporter), member 16 |
| SLC22A17 | 51310 | NP_057693 | 4262 | solute carrier family 22, member 17 |
| SLC22A17 | 51310 | NP_065105 | 4636 | solute carrier family 22, member 17 |
| SLC22A18 | 5002 | NP_002546 | 2677 | solute carrier family 22, member 18 |
| SLC22A18 | 5002 | NP_899056 | 6704 | solute carrier family 22, member 18 |
| SLC22A2 | 6582 | NP_003049 | 2777 | solute carrier family 22 (organic cation transporter), member 2 |
| SLC22A23 | 63027 | NP_056297 | 4089 | solute carrier family 22, member 23 |
| SLC22A23 | 63027 | NP_068764 | 4850 | solute carrier family 22, member 23 |
| SLC22A24 | 283238 | NP_001129978 | 1609 | solute carrier family 22, member 24 |
| SLC22A25 | 387601 | NP_955384 | 6881 | solute carrier family 22, member 25 |
| SLC22A3 | 6581 | NP_068812 | 4857 | solute carrier family 22 (extraneuronal monoamine transporter), member 3 |
| SLC22A31 | 146429 | XP_001714620 | 7053 | Putative solute carrier family 22 member ENSG00000182157 |
| SLC22A31 | 146429 | XP_370997 | 7088 | Putative solute carrier family 22 member ENSG00000182157 |
| SLC22A31 | 146429 | XP_951429 | 7097 | Putative solute carrier family 22 member ENSG00000182157 |
| SLC22A4 | 6583 | NP_003050 | 2778 | solute carrier family 22 (organic cation/ergothioneine transporter), member 4 |
| SLC22A5 | 6584 | NP_003051 | 2779 | solute carrier family 22 (organic cation/carnitine transporter), member 5 |
| SLC22A6 | 9356 | NP_004781 | 3127 | solute carrier family 22 (organic anion transporter), member 6 |
| SLC22A6 | 9356 | NP_695008 | 6172 | solute carrier family 22 (organic anion transporter), member 6 |
| SLC22A6 | 9356 | NP_695009 | 6173 | solute carrier family 22 (organic anion transporter), member 6 |
| SLC22A6 | 9356 | NP_695010 | 6174 | solute carrier family 22 (organic anion transporter), member 6 |
| SLC22A7 | 10864 | NP_006663 | 3540 | solute carrier family 22 (organic anion transporter), member 7 |
| SLC22A7 | 10864 | NP_696961 | 6175 | solute carrier family 22 (organic anion transporter), member 7 |
| SLC22A8 | 9376 | NP_004245 | 2999 | solute carrier family 22 (organic anion transporter), member 8 |
| SLC22A9 | 114571 | NP_543142 | 5640 | solute carrier family 22 (organic anion transporter), member 9 |
| SLC23A1 | 9963 | NP_005838 | 3383 | solute carrier family 23 (nucleobase transporters), member 1 |
| SLC23A1 | 9963 | NP_689898 | 6097 | solute carrier family 23 (nucleobase transporters), member 1 |
| SLC23A2 | 9962 | NP_005107 | 3214 | solute carrier family 23 (nucleobase transporters), member 2 |
| SLC23A2 | 9962 | NP_976072 | 6923 | solute carrier family 23 (nucleobase transporters), member 2 |
| SLC23A3 | 151295 | NP_001138361 | 1780 | solute carrier family 23 (nucleobase transporters), member 3 |
| SLC23A3 | 151295 | NP_001138362 | 1781 | solute carrier family 23 (nucleobase transporters), member 3 |
| SLC23A3 | 151295 | NP_653313 | 5896 | solute carrier family 23 (nucleobase transporters), member 3 |
| SLC24A1 | 9187 | NP_001287960.1 | 7448 | solute carrier family 24 member 1 |
| SLC24A2 | 25769 | NP_065077 | 4632 | solute carrier family 24 (sodium/potassium/calcium exchanger), member 2 |
| SLC24A3 | 57419 | NP_065740 | 4699 | solute carrier family 24 (sodium/potassium/calcium exchanger), member 3 |
| SLC24A4 | 123041 | NP_705932 | 6209 | solute carrier family 24 (sodium/potassium/calcium exchanger), member 4 |
| SLC24A4 | 123041 | NP_705933 | 6210 | solute carrier family 24 (sodium/potassium/calcium exchanger), member 4 |
| SLC24A4 | 123041 | NP_705934 | 6211 | solute carrier family 24 (sodium/potassium/calcium exchanger), member 4 |
| SLC25A17 | 10478 | NP_006349 | 3474 | solute carrier family 25 (mitochondrial carrier peroxisomal membrane protein, 34kDa), member 17 |
| SLC25A18 | 83733 | NP_113669 | 5233 | solute carrier family 25 (mitochondrial carrier), member 18 |
| SLC25A2 | 83884 | NP_114153 | 5274 | solute carrier family 25 (mitochondrial carrier ornithine transporter) member 2 |
| SLC25A20 | 788 | NP_000378 | 115 | solute carrier family 25 (carnitine/acylcarnitine translocase), member 20 |
| SLC25A23 | 79085 | NP_077008 | 5010 | solute carrier family 25 (mitochondrial carrier phosphate carrier), member 23 |
| SLC25A25 | 114789 | NP_001006642 | 490 | solute carrier family 25 (mitochondrial carrier phosphate carrier), member 25 |
| SLC25A25 | 114789 | NP_001006643 | 491 | solute carrier family 25 (mitochondrial carrier phosphate carrier), member 25 |
| SLC25A25 | 114789 | NP_001006644 | 492 | solute carrier family 25 (mitochondrial carrier phosphate carrier), member 25 |
| SLC25A25 | 114789 | NP_443133 | 5533 | solute carrier family 25 (mitochondrial carrier phosphate carrier), member 25 |
| SLC25A26 | 115286 | NP_001158268 | 2113 | solute carrier family 25, member 26 |
| SLC25A26 | 115286 | NP_775742 | 6343 | solute carrier family 25, member 26 |
| SLC25A3 | 5250 | NP_002626 | 2696 | solute carrier family 25 (mitochondrial carrier phosphate carrier), member 3 |
| SLC25A3 | 5250 | NP_005879 | 3394 | solute carrier family 25 (mitochondrial carrier phosphate carrier), member 3 |
| SLC25A3 | 5250 | NP_998776 | 7042 | solute carrier family 25 (mitochondrial carrier phosphate carrier), member 3 |
| SLC25A31 | 83447 | NP_112581 | 5216 | solute carrier family 25 (mitochondrial carrier adenine nucleotide translocator), member 31 |
| SLC25A33 | 84275 | NP_115691 | 5324 | solute carrier family 25, member 33 |
| SLC25A34 | 284723 | NP_997231 | 7013 | solute carrier family 25, member 34 |
| SLC25A39 | 51629 | NP_001137252 | 1714 | solute carrier family 25, member 39 |
| SLC25A39 | 51629 | NP_057100 | 4151 | solute carrier family 25, member 39 |
| SLC25A4 | 291 | NP_001142 | 1937 | solute carrier family 25 (mitochondrial carrier adenine nucleotide translocator), member 5 |
| SLC25A43 | 203427 | NP_660348 | 5958 | solute carrier family 25, member 43 |
| SLC25A44 | 9673 | NP_001273113.1 | 1547 | solute carrier family 25, member 44 |
| SLC25A44 | 9673 | NP_055470 | 3970 | solute carrier family 25, member 44 |
| SLC25A45 | 283130 | NP_001070709 | 957 | solute carrier family 25, member 45 |
| SLC25A45 | 283130 | NP_872362 | 6659 | solute carrier family 25, member 45 |
| SLC25A48 | 153328 | NP_660325 | 5952 | mitochondrial carrier protein-like |
| SLC25A5 | 292 | NP_001143 | 1938 | solute carrier family 25 (mitochondrial carrier adenine nucleotide translocator), member 5 |
| SLC26A1 | 10861 | NP_071325 | 4866 | solute carrier family 26 (sulfate transporter), member 1 |
| SLC26A1 | 10861 | NP_602297 | 5707 | solute carrier family 26 (sulfate transporter), member 1 |
| SLC26A1 | 10861 | NP_998778 | 7043 | solute carrier family 26 (sulfate transporter), member 1 |

FIG. 2 (CONT.)

| Antigen | GeneID | Accession No. | SEQ ID NO: | RefSeq Gene Name |
|---|---|---|---|---|
| SLC26A10 | 65012 | NP_597996.2 | 7350 | solute carrier family 26 member 10 |
| SLC26A11 | 284129 | NP_001159819 | 2160 | solute carrier family 26, member 11 |
| SLC26A11 | 284129 | NP_001159820 | 2161 | solute carrier family 26, member 11 |
| SLC26A11 | 284129 | NP_001159821 | 2162 | solute carrier family 26, member 11 |
| SLC26A11 | 284129 | NP_775897 | 6366 | solute carrier family 26, member 11 |
| SLC26A2 | 1836 | NP_000103 | 32 | solute carrier family 26 (sulfate transporter), member 2 |
| SLC26A3 | 1811 | NP_000102 | 31 | solute carrier family 26, member 3 |
| SLC26A4 | 5172 | NP_000432 | 127 | solute carrier family 26, member 4 |
| SLC26A6 | 65010 | NP_001035544 | 869 | solute carrier family 26, member 6 cadherin, EGF LAG seven-pass G-type receptor 3 (flamingoHomolog, Drosophila) |
| SLC26A6 | 65010 | NP_001035544.1 | 2363 | solute carrier family 26, member 6 cadherin, EGF LAG seven-pass G-type receptor 3 (flamingoHomolog, Drosophila) |
| SLC26A6 | 65010 | NP_001035544.1 | 4962 | solute carrier family 26, member 6 cadherin, EGF LAG seven-pass G-type receptor 3 (flamingoHomolog, Drosophila) |
| SLC26A6 | 65010 | NP_599025 | 5703 | solute carrier family 26, member 6 cadherin, EGF LAG seven-pass G-type receptor 3 (flamingoHomolog, Drosophila) |
| SLC26A6 | 65010 | NP_602298 | 5708 | solute carrier family 26, member 6 cadherin, EGF LAG seven-pass G-type receptor 3 (flamingoHomolog, Drosophila) |
| SLC26A7 | 115111 | NP_439897 | 5514 | solute carrier family 26, member 7 |
| SLC26A7 | 115111 | NP_599028 | 5705 | solute carrier family 26, member 7 |
| SLC26A8 | 116369 | NP_443193 | 5552 | solute carrier family 26, member 8 |
| SLC26A8 | 116369 | NP_619732 | 5777 | solute carrier family 26, member 8 |
| SLC26A9 | 115019 | NP_443166.1 | 1677 | solute carrier family 26, member 9 |
| SLC26A9 | 115019 | NP_443166 | 5543 | solute carrier family 26, member 9 |
| SLC26A9 | 115019 | NP_599152 | 5706 | solute carrier family 26, member 9 |
| SLC27A1 | 376497 | NP_940982 | 6820 | solute carrier family 27 (fatty acid transporter), member 1 |
| SLC27A2 | 11001 | NP_001153101 | 1948 | solute carrier family 27 (fatty acid transporter), member 2 |
| SLC27A2 | 11001 | NP_003636 | 2862 | solute carrier family 27 (fatty acid transporter), member 2 |
| SLC27A3 | 11000 | NP_077306 | 5025 | solute carrier family 27 (fatty acid transporter), member 3 |
| SLC27A4 | 10999 | NP_005085 | 3211 | solute carrier family 27 (fatty acid transporter), member 4 |
| SLC27A5 | 10998 | NP_036386 | 3728 | solute carrier family 27 (fatty acid transporter), member 5 |
| SLC28A1 | 9154 | NP_004204 | 2992 | solute carrier family 28 (sodium-coupled nucleoside transporter), member 1 |
| SLC28A1 | 9154 | NP_964014 | 6918 | solute carrier family 28 (sodium-coupled nucleoside transporter), member 1 |
| SLC28A2 | 9153 | NP_004203 | 2991 | solute carrier family 28 (sodium-coupled nucleoside transporter), member 2 |
| SLC28A3 | 64078 | NP_071410 | 4878 | solute carrier family 28 (sodium-coupled nucleoside transporter), member 3 |
| SLC29A1 | 2030 | NP_001071643.1 | 980 | solute carrier family 29 (nucleoside transporters), member 1 |
| SLC29A1 | 2030 | NP_001071643 | 981 | solute carrier family 29 (nucleoside transporters), member 1 |
| SLC29A1 | 2030 | NP_001071643.1 | 982 | solute carrier family 29 (nucleoside transporters), member 1 |
| SLC29A1 | 2030 | NP_001071645 | 983 | solute carrier family 29 (nucleoside transporters), member 1 |
| SLC29A1 | 2030 | NP_001071643.1 | 3177 | solute carrier family 29 (nucleoside transporters), member 1 |
| SLC29A2 | 3177 | NP_001523 | 2407 | solute carrier family 29 (nucleoside transporters), member 2 |
| SLC29A3 | 55315 | NP_001138722 | 1830 | solute carrier family 29 (nucleoside transporters), member 3 |
| SLC29A3 | 55315 | NP_060814 | 4426 | solute carrier family 29 (nucleoside transporters), member 3 |
| SLC29A4 | 222962 | NP_001035751 | 878 | solute carrier family 29 (nucleoside transporters), member 4 |
| SLC29A4 | 222962 | NP_694979 | 6165 | solute carrier family 29 (nucleoside transporters), member 4 |
| SLC2A1 | 6513 | NP_006507 | 3504 | solute carrier family 2 (facilitated glucose transporter), member 1 |
| SLC2A10 | 81031 | NP_110404 | 5169 | solute carrier family 2 (facilitated glucose transporter), member 10 |
| SLC2A12 | 154091 | NP_660159 | 5933 | solute carrier family 2 (facilitated glucose transporter), member 12 |
| SLC2A13 | 114134 | NP_443117 | 5526 | solute carrier family 2 (facilitated glucose transporter), member 13 |
| SLC2A2 | 6514 | NP_000331.1 | 7272 | solute carrier family 2 member 2 |
| SLC2A3 | 6515 | NP_008862 | 3598 | solute carrier family 2 (facilitated glucose transporter), member 3 |
| SLC2A4 | 6517 | NP_001033 | 781 | solute carrier family 2 (facilitated glucose transporter), member 4 |
| SLC2A5 | 6518 | NP_001129057 | 1542 | solute carrier family 2 (facilitated glucose/fructose transporter), member 5 |
| SLC2A5 | 6518 | NP_003030 | 2761 | solute carrier family 2 (facilitated glucose/fructose transporter), member 5 |
| SLC2A6 | 11182 | NP_001138571 | 1809 | solute carrier family 2 (facilitated glucose transporter), member 6 |
| SLC2A6 | 11182 | NP_060055 | 4309 | solute carrier family 2 (facilitated glucose transporter), member 6 |
| SLC2A8 | 29988 | NP_055395 | 3960 | solute carrier family 2 (facilitated glucose transporter), member 8 |
| SLC2A9 | 56606 | NP_001001290.1 | 7335 | solute carrier family 2 member 9 |
| SLC30A1 | 7779 | NP_067017 | 4791 | solute carrier family 30 (zinc transporter), member 1 |
| SLC30A10 | 55532 | NP_061183 | 4487 | solute carrier family 30, member 10 |
| SLC30A2 | 7780 | NP_001004434 | 434 | solute carrier family 30 (zinc transporter), member 2 |
| SLC30A2 | 7780 | NP_115902 | 5364 | solute carrier family 30 (zinc transporter), member 2 |
| SLC30A3 | 7781 | NP_003450 | 2834 | solute carrier family 30 (zinc transporter), member 3 |
| SLC30A4 | 7782 | NP_037441 | 3801 | solute carrier family 30 (zinc transporter), member 4 |
| SLC30A5 | 64924 | NP_075053 | 4960 | solute carrier family 30 (zinc transporter), member 5 |
| SLC30A5 | 64924 | NP_076960 | 5000 | solute carrier family 30 (zinc transporter), member 5 |
| SLC30A6 | 55676 | NP_060434 | 4375 | solute carrier family 30 (zinc transporter), member 6 |
| SLC30A7 | 148867 | NP_001138356 | 1779 | solute carrier family 30 (zinc transporter), member 7 |
| SLC30A7 | 148867 | NP_598003 | 5697 | solute carrier family 30 (zinc transporter), member 7 |
| SLC30A8 | 169026 | NP_776250 | 6394 | solute carrier family 30 (zinc transporter), member 8 |
| SLC30A9 | 10463 | NP_006336 | 3473 | solute carrier family 30 (zinc transporter), member 9 |
| SLC31A1 | 1317 | NP_001850 | 2489 | solute carrier family 31 (copper transporters), member 1 |
| SLC31A2 | 1318 | NP_001851 | 2490 | solute carrier family 31 (copper transporters), member 2 |
| SLC32A1 | 140679 | NP_542119 | 5606 | solute carrier family 32 (GABA vesicular transporter), member 1 |
| SLC33A1 | 9197 | NP_004724 | 3111 | solute carrier family 33 (acetyl-CoA transporter), member 1 |
| SLC34A1 | 6569 | NP_001161051 | 2184 | solute carrier family 34 (sodium phosphate), member 1 |
| SLC34A1 | 6569 | NP_003043 | 2772 | solute carrier family 34 (sodium phosphate), member 1 |

FIG. 2 (CONT.)

| Antigen | GeneID | Accession No. | SEQ ID NO: | RefSeq Gene Name |
|---|---|---|---|---|
| SLC34A2 | 10568 | NP_006415 | 3490 | solute carrier family 34 (sodium phosphate), member 2 |
| SLC34A3 | 142680 | NP_543153 | 5644 | solute carrier family 34 (sodium phosphate), member 3 |
| SLC35A1 | 10559 | NP_001161870 | 2231 | solute carrier family 35 (CMP-sialic acid transporter), member A1 |
| SLC35A1 | 10559 | NP_006407 | 3488 | solute carrier family 35 (CMP-sialic acid transporter), member A1 |
| SLC35A2 | 7355 | NP_001027460 | 742 | solute carrier family 35 (UDP-galactose transporter), member A2 |
| SLC35A2 | 7355 | NP_001035963 | 900 | solute carrier family 35 (UDP-galactose transporter), member A2 |
| SLC35A2 | 7355 | NP_005651 | 3336 | solute carrier family 35 (UDP-galactose transporter), member A2 |
| SLC35A3 | 23443 | NP_036375 | 3726 | solute carrier family 35 (UDP-N-acetylglucosamine (UDP-GlcNAc) transporter), member A3 |
| SLC35A4 | 113829 | NP_542401 | 5615 | solute carrier family 35, member A4 |
| SLC35A5 | 55032 | NP_060415 | 4374 | solute carrier family 35, member A5 |
| SLC35B1 | 10237 | NP_005818 | 3378 | solute carrier family 35, member B1 |
| SLC35B2 | 347734 | NP_835361 | 6520 | solute carrier family 35, member B2 |
| SLC35B3 | 51000 | NP_001136013 | 1670 | solute carrier family 35, member B3 |
| SLC35B3 | 51000 | NP_001136013 | 1671 | solute carrier family 35, member B3 |
| SLC35B3 | 51000 | NP_057032 | 4141 | solute carrier family 35, member B3 |
| SLC35B4 | 84912 | NP_116215 | 5411 | solute carrier family 35, member B4 |
| SLC35C1 | 55343 | NP_001138737 | 1831 | solute carrier family 35, member C1 |
| SLC35C1 | 55343 | NP_001138738 | 1832 | solute carrier family 35, member C1 |
| SLC35C1 | 55343 | NP_060859 | 4437 | solute carrier family 35, member C1 |
| SLC35C2 | 51006 | NP_057029 | 4140 | solute carrier family 35, member C2 |
| SLC35C2 | 51006 | NP_775096 | 6330 | solute carrier family 35, member C2 |
| SLC35C2 | 51006 | NP_775271 | 6338 | solute carrier family 35, member C2 |
| SLC35D1 | 23169 | NP_055954 | 4040 | solute carrier family 35 (UDP-glucuronic acid/UDP-N-acetylgalactosamine dual transporter), member D1 |
| SLC35D2 | 11046 | NP_008932 | 3612 | solute carrier family 35, member D2 |
| SLC35D3 | 340146 | NP_001008783 | 554 | solute carrier family 35, member D3 |
| SLC35E1 | 79939 | NP_079157 | 5095 | solute carrier family 35, member E1 |
| SLC35E2 | 9906 | NP_001104251 | 1242 | solute carrier family 35, member E2 |
| SLC35E2 | 9906 | NP_878258 | 6688 | solute carrier family 35, member E2 |
| SLC35E3 | 55508 | NP_061126 | 4480 | solute carrier family 35, member E3 |
| SLC35E4 | 339665 | NP_001001479 | 361 | solute carrier family 35, member E4 |
| SLC35F1 | 222553 | NP_001025029 | 710 | solute carrier family 35, member F1 |
| SLC35F2 | 54733 | NP_059985 | 4299 | solute carrier family 35, member F2 |
| SLC35F4 | 341880 | NP_001193849.1 | 1025 | solute carrier family 35, member F4 |
| SLC35F5 | 80255 | NP_079457 | 5131 | solute carrier family 35, member F5 |
| SLC35F6 | 54978 | NP_060347 | 4362 | chromosome 2 open reading frame 18 |
| SLC35G1 | 159371 | NP_001128130 | 1500 | transmembrane protein 20 |
| SLC35G1 | 159371 | NP_694958 | 6162 | transmembrane protein 20 |
| SLC35G3 | 146861 | NP_001096084 | 1210 | acyl-malonyl condensing enzyme 1-like 3, 1, 2, enzyme 1 |
| SLC35G3 | 146861 | NP_473369 | 5569 | acyl-malonyl condensing enzyme 1-like 3, 1, 2, enzyme 1 |
| SLC35G3 | 146861 | NP_689675 | 6063 | acyl-malonyl condensing enzyme 1-like 3, 1, 2, enzyme 1 |
| SLC36A1 | 206358 | NP_510968 | 5593 | solute carrier family 36 (proton/amino acid symporter), member 1 |
| SLC36A4 | 120103 | NP_689526 | 6031 | solute carrier family 36 (proton/amino acid symporter), member 4 |
| SLC37A1 | 54020 | NP_061837 | 4536 | solute carrier family 37 (glycerol-3-phosphate transporter), member 1 |
| SLC37A3 | 84255 | NP_115671 | 5320 | solute carrier family 37 (glycerol-3-phosphate transporter), member 3 |
| SLC37A3 | 84255 | NP_996996 | 7000 | solute carrier family 37 (glycerol-3-phosphate transporter), member 3 |
| SLC37A4 | 2542 | NP_001157749 | 2073 | solute carrier family 37 (glucose-6-phosphate transporter), member 4 |
| SLC37A4 | 2542 | NP_001157750 | 2074 | solute carrier family 37 (glucose-6-phosphate transporter), member 4 |
| SLC37A4 | 2542 | NP_001157751 | 2075 | solute carrier family 37 (glucose-6-phosphate transporter), member 4 |
| SLC37A4 | 2542 | NP_001157752 | 2076 | solute carrier family 37 (glucose-6-phosphate transporter), member 4 |
| SLC37A4 | 2542 | NP_001458 | 2383 | solute carrier family 37 (glucose-6-phosphate transporter), member 4 |
| SLC38A1 | 81539 | NP_001070952.1 | 7367 | solute carrier family 38 member 1 |
| SLC38A10 | 124565 | NP_001033073 | 782 | solute carrier family 38, member 10 |
| SLC38A10 | 124565 | NP_612637 | 5760 | solute carrier family 38, member 10 |
| SLC38A11 | 151258 | NP_775783 | 6350 | solute carrier family 38, member 11 |
| SLC38A2 | 54407 | NP_061849 | 4542 | solute carrier family 38, member 2 |
| SLC38A3 | 10991 | NP_006832 | 3577 | solute carrier family 38, member 3 |
| SLC38A4 | 55089 | NP_001137296.1 | 7402 | solute carrier family 38 member 4 |
| SLC38A5 | 92745 | NP_277053 | 5504 | solute carrier family 38, member 5 |
| SLC38A6 | 145389 | NP_722518 | 6230 | solute carrier family 38, member 6 |
| SLC38A7 | 55238 | NP_060701 | 4405 | solute carrier family 38, member 7 |
| SLC38A9 | 153129 | NP_775785 | 6351 | solute carrier family 38, member 9 |
| SLC39A1 | 27173 | NP_055252 | 3938 | solute carrier family 39 (zinc transporter), member 1 |
| SLC39A10 | 57181 | NP_001120729.1 | 7389 | solute carrier family 39 member 10 |
| SLC39A11 | 201266 | NP_001153242 | 1959 | solute carrier family 39 (metal ion transporter), member 11 |
| SLC39A11 | 201266 | NP_631916 | 5845 | solute carrier family 39 (metal ion transporter), member 11 |
| SLC39A12 | 221074 | NP_001138667 | 1826 | solute carrier family 39 (zinc transporter), member 12 |
| SLC39A12 | 221074 | NP_689938 | 6106 | solute carrier family 39 (zinc transporter), member 12 |
| SLC39A13 | 91252 | NP_001121697 | 1370 | solute carrier family 39 (zinc transporter), member 13 |
| SLC39A13 | 91252 | NP_689477 | 6022 | solute carrier family 39 (zinc transporter), member 13 |
| SLC39A14 | 23516 | NP_001121903 | 1373 | solute carrier family 39 (zinc transporter), member 14 |
| SLC39A14 | 23516 | NP_001128625 | 1529 | solute carrier family 39 (zinc transporter), member 14 |
| SLC39A14 | 23516 | NP_001128626 | 1530 | solute carrier family 39 (zinc transporter), member 14 |
| SLC39A14 | 23516 | NP_056174 | 4068 | solute carrier family 39 (zinc transporter), member 14 |
| SLC39A2 | 29986 | NP_055394 | 3959 | solute carrier family 39 (zinc transporter), member 2 |
| SLC39A3 | 29985 | NP_653165 | 5861 | solute carrier family 39 (zinc transporter), member 3 |
| SLC39A3 | 29985 | NP_998733 | 7037 | solute carrier family 39 (zinc transporter), member 3 |
| SLC39A4 | 55630 | NP_060237 | 4339 | solute carrier family 39 (zinc transporter), member 4 |

FIG. 2 (CONT.)

| Antigen | GeneID | Accession No. | SEQ ID NO: | RefSeq Gene Name |
|---|---|---|---|---|
| SLC39A4 | 55630 | NP_570901 | 5672 | solute carrier family 39 (zinc transporter), member 4 |
| SLC39A5 | 283375 | NP_001128667 | 1537 | solute carrier family 39 (metal ion transporter), member 5 |
| SLC39A5 | 283375 | NP_775867 | 6362 | solute carrier family 39 (metal ion transporter), member 5 |
| SLC39A6 | 25800 | NP_001092876 | 1158 | solute carrier family 39 (zinc transporter), member 6 |
| SLC39A6 | 25800 | NP_036451 | 3745 | solute carrier family 39 (zinc transporter), member 6 |
| SLC39A7 | 7922 | NP_001070984 | 973 | solute carrier family 39 (zinc transporter), member 7 |
| SLC39A7 | 7922 | NP_008910 | 3605 | solute carrier family 39 (zinc transporter), member 7 |
| SLC39A8 | 64116 | NP_001128618 | 1526 | solute carrier family 39 (zinc transporter), member 8 |
| SLC39A8 | 64116 | NP_001128619 | 1527 | solute carrier family 39 (zinc transporter), member 8 |
| SLC39A8 | 64116 | NP_001128620 | 1528 | solute carrier family 39 (zinc transporter), member 8 |
| SLC39A8 | 64116 | NP_071437 | 4889 | solute carrier family 39 (zinc transporter), member 8 |
| SLC39A9 | 55334 | NP_060845 | 4435 | solute carrier family 39 (zinc transporter), member 9 |
| SLC3A1 | 6519 | NP_000332 | 100 | solute carrier family 3 (cystine, dibasic and neutral amino acid transporters, activator of cystine, dibasic and neutral amino acid transport), member 1 |
| SLC3A2 | 6520 | NP_001012680.1 | 600 | solute carrier family 3 (activators of dibasic and neutral amino acid transport), member 2 |
| SLC3A2 | 6520 | NP_001012680 | 601 | solute carrier family 3 (activators of dibasic and neutral amino acid transport), member 2 |
| SLC3A2 | 6520 | NP_001012680.1 | 602 | solute carrier family 3 (activators of dibasic and neutral amino acid transport), member 2 |
| SLC3A2 | 6520 | NP_001012682 | 603 | solute carrier family 3 (activators of dibasic and neutral amino acid transport), member 2 |
| SLC3A2 | 6520 | NP_001013269 | 610 | solute carrier family 3 (activators of dibasic and neutral amino acid transport), member 2 |
| SLC3A2 | 6520 | NP_002385 | 2641 | solute carrier family 3 (activators of dibasic and neutral amino acid transport), member 2 |
| SLC40A1 | 30061 | NP_055400 | 3961 | solute carrier family 40 (iron-regulated transporter), member 1 |
| SLC41A1 | 254428 | NP_776253 | 6397 | solute carrier family 41, member 1 |
| SLC41A2 | 84102 | NP_115524 | 5302 | solute carrier family 41, member 2 |
| SLC41A3 | 54946 | NP_001008485 | 537 | solute carrier family 41, member 3 |
| SLC41A3 | 54946 | NP_001008486 | 538 | solute carrier family 41, member 3 |
| SLC41A3 | 54946 | NP_001008487 | 539 | solute carrier family 41, member 3 |
| SLC41A3 | 54946 | NP_001157947 | 2083 | solute carrier family 41, member 3 |
| SLC41A3 | 54946 | NP_060306 | 4352 | solute carrier family 41, member 3 |
| SLC43A1 | 8501 | NP_003618 | 2856 | solute carrier family 43, member 1 |
| SLC43A2 | 124935 | NP_689559 | 6037 | solute carrier family 43, member 2 |
| SLC43A3 | 29015 | NP_054815 | 3869 | solute carrier family 43, member 3 |
| SLC43A3 | 29015 | NP_060081 | 4312 | solute carrier family 43, member 3 |
| SLC43A3 | 29015 | NP_955361 | 6875 | solute carrier family 43, member 3 |
| SLC44A1 | 23446 | NP_536856 | 5605 | solute carrier family 44, member 1 |
| SLC44A2 | 57153 | NP_001138528 | 1807 | solute carrier family 44, member 2 |
| SLC44A2 | 57153 | NP_065161 | 4655 | solute carrier family 44, member 2 |
| SLC44A3 | 126969 | NP_001107578 | 1268 | solute carrier family 44, member 3 |
| SLC44A3 | 126969 | NP_689582 | 6044 | solute carrier family 44, member 3 |
| SLC44A4 | 80736 | NP_079533 | 5142 | solute carrier family 44, member 4 |
| SLC44A5 | 204962 | NP_001123530 | 1412 | solute carrier family 44, member 5 |
| SLC44A5 | 204962 | NP_689910 | 6101 | solute carrier family 44, member 5 |
| SLC45A1 | 50651 | NP_001073866 | 1019 | solute carrier family 45, member 1 |
| SLC45A2 | 51151 | NP_001012527 | 597 | solute carrier family 45, member 2 |
| SLC45A2 | 51151 | NP_057264 | 4181 | solute carrier family 45, member 2 |
| SLC45A3 | 85414 | NP_149093 | 5450 | solute carrier family 45, member 3 |
| SLC45A4 | 57210 | NP_001073900 | 1021 | solute carrier family 45, member 4 |
| SLC46A1 | 113235 | NP_542400 | 5614 | solute carrier family 46 (folate transporter), member 1 |
| SLC46A2 | 57864 | NP_149040 | 5444 | solute carrier family 46, member 2 |
| SLC46A3 | 283537 | NP_001129391 | 1576 | solute carrier family 46, member 3 |
| SLC46A3 | 283537 | NP_861450 | 6634 | solute carrier family 46, member 3 |
| SLC47A1 | 55244 | NP_060712 | 4407 | solute carrier family 47, member 1 |
| SLC47A2 | 146802 | NP_001093116 | 1162 | solute carrier family 47, member 2 |
| SLC47A2 | 146802 | NP_690872 | 6131 | solute carrier family 47, member 2 |
| SLC4A1 | 6521 | NP_000333 | 101 | solute carrier family 4, anion exchanger, member 1 (erythrocyte membrane protein band 3, Diego blood group) |
| SLC4A10 | 57282 | NP_001171486.1 | 7421 | solute carrier family 4 member 10 |
| SLC4A11 | 83959 | NP_114423 | 5282 | solute carrier family 4, sodium borate transporter, member 11 |
| SLC4A2 | 6522 | NP_003031 | 2762 | solute carrier family 4, anion exchanger, member 2 (erythrocyte membrane protein band 3-like 1) |
| SLC4A3 | 6508 | NP_005061 | 3205 | solute carrier family 4, anion exchanger, member 3 |
| SLC4A3 | 6508 | NP_963868 | 6910 | solute carrier family 4, anion exchanger, member 3 |
| SLC4A4 | 8671 | NP_001091954 | 1125 | solute carrier family 4, sodium bicarbonate cotransporter, member 4 |
| SLC4A4 | 8671 | NP_001128214 | 1504 | solute carrier family 4, sodium bicarbonate cotransporter, member 4 |
| SLC4A4 | 8671 | NP_003750 | 2885 | solute carrier family 4, sodium bicarbonate cotransporter, member 4 |
| SLC4A5 | 57835 | NP_067019 | 4793 | solute carrier family 4, sodium bicarbonate cotransporter, member 5 |
| SLC4A5 | 57835 | NP_597812 | 5695 | solute carrier family 4, sodium bicarbonate cotransporter, member 5 |
| SLC4A7 | 9497 | NP_003606 | 2855 | solute carrier family 4, sodium bicarbonate cotransporter, member 7 |
| SLC4A8 | 9498 | NP_001035049 | 818 | solute carrier family 4, sodium bicarbonate cotransporter, member 8 |
| SLC4A8 | 9498 | NP_001035049.1 | 3150 | solute carrier family 4, sodium bicarbonate cotransporter, member 8 |
| SLC4A9 | 83697 | NP_113655 | 5229 | solute carrier family 4, sodium bicarbonate cotransporter, member 9 |
| SLC50A1 | 55974 | NP_001116309 | 1288 | recombination activating gene 1 activating protein 1 |
| SLC50A1 | 55974 | NP_001116311 | 1289 | recombination activating gene 1 activating protein 1 |
| SLC50A1 | 55974 | NP_061333 | 4493 | recombination activating gene 1 activating protein 1 |
| SLC51A | 200931 | NP_689885 | 6094 | organic solute transporter alpha |
| SLC51B | 123264 | NP_849190 | 6573 | organic solute transporter beta |
| SLC52A1 | 55065 | NP_001098047 | 1217 | G protein-coupled receptor 172B |
| SLC52A1 | 55065 | NP_060456 | 4378 | G protein-coupled receptor 172B |
| SLC52A2 | 79581 | NP_078807 | 5042 | G protein-coupled receptor 172A |
| SLC52A3 | 113278 | NP_212134 | 5494 | chromosome 20 open reading frame 54 |

FIG. 2 (CONT.)

| Antigen | GeneID | Accession No. | SEQ ID NO: | RefSeq Gene Name |
|---|---|---|---|---|
| SLC5A1 | 6523 | NP_000334 | 102 | solute carrier family 5 (sodium/glucose cotransporter), member 1 |
| SLC5A10 | 125206 | NP_001035915 | 888 | solute carrier family 5 (sodium/glucose cotransporter), member 10 |
| SLC5A10 | 125206 | NP_689564 | 6038 | solute carrier family 5 (sodium/glucose cotransporter), member 10 |
| SLC5A11 | 115584 | NP_443176 | 5546 | solute carrier family 5 (sodium/glucose cotransporter), member 11 |
| SLC5A12 | 159963 | NP_848593 | 6545 | solute carrier family 5 (sodium/glucose cotransporter), member 12 |
| SLC5A2 | 6524 | NP_003032 | 2763 | solute carrier family 5 (sodium/glucose cotransporter), member 2 |
| SLC5A3 | 6526 | NP_008864 | 3599 | solute carrier family 5 (sodium/myo-inositol cotransporter), member 3 |
| SLC5A4 | 6527 | NP_055042 | 3889 | solute carrier family 5 (low affinity glucose cotransporter), member 4 |
| SLC5A5 | 6528 | NP_000444 | 134 | solute carrier family 5 (sodium iodide symporter), member 5 |
| SLC5A6 | 8884 | NP_066918 | 4767 | solute carrier family 5 (sodium-dependent vitamin transporter), member 6 |
| SLC5A7 | 60482 | NP_068587 | 4837 | solute carrier family 5 (choline transporter), member 7 |
| SLC5A8 | 160728 | NP_666018 | 5987 | solute carrier family 5 (iodide transporter), member 8 |
| SLC5A9 | 200010 | NP_001011547 | 587 | solute carrier family 5 (sodium/glucose cotransporter), member 9 |
| SLC5A9 | 200010 | NP_001128653 | 1536 | solute carrier family 5 (sodium/glucose cotransporter), member 9 |
| SLC6A1 | 6529 | NP_003033 | 2764 | solute carrier family 6 (neurotransmitter transporter, GABA), member 1 |
| SLC6A11 | 6538 | NP_055044 | 3890 | solute carrier family 6 (neurotransmitter transporter, GABA), member 11 |
| SLC6A12 | 6539 | NP_001116319 | 1290 | solute carrier family 6 (neurotransmitter transporter, betaine/GABA), member 12 |
| SLC6A12 | 6539 | NP_001116320 | 1291 | solute carrier family 6 (neurotransmitter transporter, betaine/GABA), member 12 |
| SLC6A12 | 6539 | NP_003035 | 2766 | solute carrier family 6 (neurotransmitter transporter, betaine/GABA), member 12 |
| SLC6A13 | 6540 | NP_057699 | 4264 | solute carrier family 6 (neurotransmitter transporter, GABA), member 13 |
| SLC6A14 | 11254 | NP_009162 | 3656 | solute carrier family 6 (amino acid transporter), member 14 |
| SLC6A15 | 55117 | NP_001139807 | 1932 | solute carrier family 6 (neutral amino acid transporter), member 15 |
| SLC6A15 | 55117 | NP_060527 | 4385 | solute carrier family 6 (neutral amino acid transporter), member 15 |
| SLC6A15 | 55117 | NP_877499 | 6682 | solute carrier family 6 (neutral amino acid transporter), member 15 |
| SLC6A16 | 28968 | NP_054756 | 3859 | solute carrier family 6, member 16 |
| SLC6A18 | 348932 | NP_872438 | 6668 | solute carrier family 6, member 18 |
| SLC6A19 | 340024 | NP_001003841 | 424 | solute carrier family 6 (neutral amino acid transporter), member 19 |
| SLC6A2 | 6530 | NP_001034 | 785 | solute carrier family 6 (neurotransmitter transporter, noradrenalin), member 2 |
| SLC6A20 | 54716 | NP_064593 | 4617 | solute carrier family 6 (proline IMINO transporter), member 20 |
| SLC6A20 | 54716 | NP_071800 | 4912 | solute carrier family 6 (proline IMINO transporter), member 20 |
| SLC6A3 | 6531 | NP_001035 | 816 | solute carrier family 6 (neurotransmitter transporter, dopamine), member 3 |
| SLC6A4 | 6532 | NP_001036 | 902 | solute carrier family 6 (neurotransmitter transporter, serotonin), member 4 |
| SLC6A5 | 9152 | NP_004202 | 2990 | solute carrier family 6 (neurotransmitter transporter, glycine), member 5 |
| SLC6A6 | 6533 | NP_001127839 | 1477 | solute carrier family 6 (neurotransmitter transporter, taurine), member 6 |
| SLC6A6 | 6533 | NP_001127840 | 1478 | solute carrier family 6 (neurotransmitter transporter, taurine), member 6 |
| SLC6A6 | 6533 | NP_003034 | 2765 | solute carrier family 6 (neurotransmitter transporter, taurine), member 6 |
| SLC6A7 | 6534 | NP_055043.2 | 7370 | solute carrier family 6 member 7 |
| SLC6A8 | 6535 | NP_001136277 | 1704 | solute carrier family 6 (neurotransmitter transporter, creatine), member 8 |
| SLC6A8 | 6535 | NP_001136278 | 1705 | solute carrier family 6 (neurotransmitter transporter, creatine), member 8 |
| SLC6A8 | 6535 | NP_005620 | 3330 | solute carrier family 6 (neurotransmitter transporter, creatine), member 8 |
| SLC6A9 | 6536 | NP_001020016 | 688 | solute carrier family 6 (neurotransmitter transporter, glycine), member 9 |
| SLC6A9 | 6536 | NP_008865 | 3600 | solute carrier family 6 (neurotransmitter transporter, glycine), member 9 |
| SLC6A9 | 6536 | NP_964012 | 6917 | solute carrier family 6 (neurotransmitter transporter, glycine), member 9 |
| SLC7A1 | 6541 | NP_003036 | 2767 | solute carrier family 7 (cationic amino acid transporter, y+ system), member 1 |
| SLC7A10 | 56301 | NP_062823 | 4585 | solute carrier family 7, (neutral amino acid transporter, y+ system) member 10 |
| SLC7A11 | 23657 | NP_055146 | 3915 | solute carrier family 7, (cationic amino acid transporter, y+ system) member 11 |
| SLC7A13 | 157724 | NP_620172.2 | 7353 | solute carrier family 7 member 13 |
| SLC7A14 | 57709 | NP_066000 | 4744 | solute carrier family 7 (cationic amino acid transporter, y+ system), member 14 |
| SLC7A2 | 6542 | NP_001008539 | 546 | solute carrier family 7 (cationic amino acid transporter, y+ system), member 2 |
| SLC7A2 | 6542 | NP_001158243 | 2112 | solute carrier family 7 (cationic amino acid transporter, y+ system), member 2 |
| SLC7A2 | 6542 | NP_003037 | 2768 | solute carrier family 7 (cationic amino acid transporter, y+ system), member 2 |
| SLC7A4 | 6545 | NP_004164 | 2979 | solute carrier family 7 (cationic amino acid transporter, y+ system), member 4 |
| SLC7A5 | 8140 | NP_003477.4 | 7352 | solute carrier family 7 member 5 |
| SLC7A6 | 9057 | NP_001070253 | 951 | solute carrier family 7 (cationic amino acid transporter, y+ system), member 6 |
| SLC7A6 | 9057 | NP_003974 | 2939 | solute carrier family 7 (cationic amino acid transporter, y+ system), member 6 |
| SLC7A7 | 9056 | NP_001119577 | 1301 | solute carrier family 7 (cationic amino acid transporter, y+ system), member 7 |
| SLC7A7 | 9056 | NP_001119578 | 1302 | solute carrier family 7 (cationic amino acid transporter, y+ system), member 7 |
| SLC7A7 | 9056 | NP_003973 | 2938 | solute carrier family 7 (cationic amino acid transporter, y+ system), member 7 |
| SLC7A8 | 23428 | NP_036376 | 3727 | solute carrier family 7 (cationic amino acid transporter, y+ system), member 8 |
| SLC7A8 | 23428 | NP_877392 | 6678 | solute carrier family 7 (cationic amino acid transporter, y+ system), member 8 |
| SLC7A9 | 11136 | NP_001119807 | 1305 | solute carrier family 7 (cationic amino acid transporter, y+ system), member 9 |
| SLC7A9 | 11136 | NP_055085 | 3904 | solute carrier family 7 (cationic amino acid transporter, y+ system), member 9 |
| SLC8A1 | 6546 | NP_001106271 | 1250 | solute carrier family 8 (sodium/calcium exchanger), member 1 |
| SLC8A1 | 6546 | NP_001106272 | 1251 | solute carrier family 8 (sodium/calcium exchanger), member 1 |
| SLC8A1 | 6546 | NP_001106273 | 1252 | solute carrier family 8 (sodium/calcium exchanger), member 1 |
| SLC8A1 | 6546 | NP_066920 | 4769 | solute carrier family 8 (sodium/calcium exchanger), member 1 |
| SLC8A2 | 6543 | NP_055878 | 4028 | solute carrier family 8 (sodium/calcium exchanger), member 2 |
| SLC8A3 | 6547 | NP_001123889 | 1424 | solute carrier family 8 (sodium/calcium exchanger), member 3 |
| SLC8A3 | 6547 | NP_150287 | 5476 | solute carrier family 8 (sodium/calcium exchanger), member 3 |
| SLC8A3 | 6547 | NP_489479 | 5587 | solute carrier family 8 (sodium/calcium exchanger), member 3 |
| SLC8A3 | 6547 | NP_891977 | 6694 | solute carrier family 8 (sodium/calcium exchanger), member 3 |
| SLC8A3 | 6547 | NP_891981 | 6695 | solute carrier family 8 (sodium/calcium exchanger), member 3 |
| SLC8A3 | 6547 | NP_892114 | 6700 | solute carrier family 8 (sodium/calcium exchanger), member 3 |
| SLC8B1 | 80024 | NP_079235 | 5109 | solute carrier family 24 (sodium/potassium/calcium exchanger), member 6 |
| SLC9A1 | 6548 | NP_003038.2 | 7322 | solute carrier family 9 member A1 |
| SLC9A2 | 6549 | NP_003039 | 2769 | solute carrier family 9 (sodium/hydrogen exchanger), member 2 |
| SLC9A3 | 6550 | NP_004165 | 2980 | solute carrier family 9 (sodium/hydrogen exchanger), member 3 |

FIG. 2 (CONT.)

| Antigen | GeneID | Accession No. | SEQ ID NO: | RefSeq Gene Name |
|---|---|---|---|---|
| SLC9A5 | 6553 | NP_004585 | 3081 | solute carrier family 9 (sodium/hydrogen exchanger), member 5 |
| SLC9A6 | 10479 | NP_001036002 | 903 | solute carrier family 9 (sodium/hydrogen exchanger), member 6 |
| SLC9A6 | 10479 | NP_006350 | 3475 | solute carrier family 9 (sodium/hydrogen exchanger), member 6 |
| SLC9A7 | 84679 | NP_115980 | 5375 | solute carrier family 9 (sodium/hydrogen exchanger), member 7 |
| SLC9A8 | 23315 | NP_056081 | 4055 | solute carrier family 9 (sodium/hydrogen exchanger), member 8 |
| SLC9A9 | 285195 | NP_775924 | 6373 | solute carrier family 9 (sodium/hydrogen exchanger), member 9 |
| SLC9B1 | 150159 | NP_001094344 | 1196 | similar to CG10806-like, similar to Na+/H+ exchanger domain containing 1 |
| SLC9B1 | 150159 | NP_631912 | 5843 | similar to CG10806-like, similar to Na+/H+ exchanger domain containing 1 |
| SLC9B2 | 133308 | NP_849155 | 6567 | Na+/H+ exchanger domain containing 2 |
| SLC9C2 | 284525 | NP_848622.2 | 7407 | solute carrier family 9 member C2 (putative) |
| SLCO1A2 | 6579 | NP_066580.1 | 7290 | solute carrier organic anion transporter family member 1A2 |
| SLCO1B1 | 10599 | NP_006437 | 3492 | solute carrier organic anion transporter family, member 1B1 |
| SLCO1B3 | 28234 | NP_062818 | 4582 | solute carrier organic anion transporter family, member 1B3 |
| SLCO1C1 | 53919 | NP_001139416 | 1885 | solute carrier organic anion transporter family, member 1C1 |
| SLCO1C1 | 53919 | NP_001139417 | 1886 | solute carrier organic anion transporter family, member 1C1 |
| SLCO1C1 | 53919 | NP_001139418 | 1887 | solute carrier organic anion transporter family, member 1C1 |
| SLCO1C1 | 53919 | NP_059131 | 4290 | solute carrier organic anion transporter family, member 1C1 |
| SLCO2A1 | 6578 | NP_005621 | 3331 | solute carrier organic anion transporter family, member 2A1 |
| SLCO2B1 | 11309 | NP_001138683 | 1828 | solute carrier organic anion transporter family, member 2B1 |
| SLCO2B1 | 11309 | NP_001138684 | 1829 | solute carrier organic anion transporter family, member 2B1 |
| SLCO2B1 | 11309 | NP_009187 | 3662 | solute carrier organic anion transporter family, member 2B1 |
| SLCO3A1 | 28232 | NP_001138516 | 1806 | solute carrier organic anion transporter family, member 3A1 |
| SLCO3A1 | 28232 | NP_037404 | 3793 | solute carrier organic anion transporter family, member 3A1 |
| SLCO4A1 | 28231 | NP_057438 | 4209 | solute carrier organic anion transporter family, member 4A1 |
| SLCO4C1 | 353189 | NP_851322 | 6579 | solute carrier organic anion transporter family, member 4C1 |
| SLCO5A1 | 81796 | NP_001139480 | 1895 | solute carrier organic anion transporter family, member 5A1 |
| SLCO5A1 | 81796 | NP_001139481 | 1896 | solute carrier organic anion transporter family, member 5A1 |
| SLCO5A1 | 81796 | NP_112220 | 5203 | solute carrier organic anion transporter family, member 5A1 |
| SLCO6A1 | 133482 | NP_775759 | 6345 | solute carrier organic anion transporter family, member 6A1 |
| SLITRK1 | 114798 | NP_443142 | 5536 | SLIT and NTRK-like family, member 1 |
| SLITRK2 | 84631 | NP_001137475 | 1750 | similar to CXorf2 protein SLIT and NTRK-like family, member 2 |
| SLITRK2 | 84631 | NP_001137476 | 1751 | similar to CXorf2 protein SLIT and NTRK-like family, member 2 |
| SLITRK2 | 84631 | NP_001137477 | 1752 | similar to CXorf2 protein SLIT and NTRK-like family, member 2 |
| SLITRK2 | 84631 | NP_001137478 | 1753 | similar to CXorf2 protein SLIT and NTRK-like family, member 2 |
| SLITRK2 | 84631 | NP_001137479 | 1754 | similar to CXorf2 protein SLIT and NTRK-like family, member 2 |
| SLITRK2 | 84631 | NP_001137480 | 1755 | similar to CXorf2 protein SLIT and NTRK-like family, member 2 |
| SLITRK2 | 84631 | NP_001137481 | 1756 | similar to CXorf2 protein SLIT and NTRK-like family, member 2 |
| SLITRK2 | 84631 | NP_001137482 | 1757 | similar to CXorf2 protein SLIT and NTRK-like family, member 2 |
| SLITRK2 | 84631 | NP_115928 | 5368 | similar to CXorf2 protein SLIT and NTRK-like family, member 2 |
| SLITRK3 | 22865 | NP_055741 | 4015 | SLIT and NTRK-like family, member 3 |
| SLITRK4 | 139065 | NP_775101 | 6333 | SLIT and NTRK-like family, member 4 |
| SLITRK5 | 26050 | NP_056382 | 4103 | SLIT and NTRK-like family, member 5 |
| SLITRK6 | 84189 | NP_115605 | 5310 | SLIT and NTRK-like family, member 6 |
| SLMAP | 7871 | NP_009090 | 3635 | sarcolemma associated protein |
| SLN | 6588 | NP_003054 | 2780 | sarcolipin |
| SMAD2 | 4087 | NP_001003652 | 409 | SMAD family member 2 |
| SMAD2 | 4087 | NP_001129409 | 1577 | SMAD family member 2 |
| SMAD2 | 4087 | NP_005892 | 3396 | SMAD family member 2 |
| SMAGP | 57228 | NP_001026798 | 719 | small trans-membrane and glycosylated protein |
| SMAGP | 57228 | NP_001029045 | 757 | small trans-membrane and glycosylated protein |
| SMCO3 | 440087 | NP_001013720 | 618 | chromosome 12 open reading frame 69 |
| SMDT1 | 91689 | NP_201575 | 5487 | chromosome 22 open reading frame 32 |
| SMIM1 | 388588 | NP_001157196 | 2056 | hypothetical LOC388588 |
| SMIM10 | 644538 | NP_001156910 | 2053 | hypothetical protein LOC644538 |
| SMIM11 | 54065 | NP_478062 | 5583 | family with sequence similarity 165, member B |
| SMIM12 | 113444 | NP_001158296 | 2114 | chromosome 1 open reading frame 212 |
| SMIM12 | 113444 | NP_001158297 | 2115 | chromosome 1 open reading frame 212 |
| SMIM12 | 113444 | NP_612437 | 5749 | chromosome 1 open reading frame 212 |
| SMIM14 | 201895 | NP_777581 | 6410 | chromosome 4 open reading frame 34 |
| SMIM15 | 643155 | NP_001041714 | 932 | chromosome 5 open reading frame 43 |
| SMIM17 | 147670 | XP_001718525 | 7060 | hypothetical protein LOC147670 |
| SMIM17 | 147670 | XP_001718558 | 7061 | hypothetical protein LOC147670 |
| SMIM17 | 147670 | XP_001719239 | 7064 | hypothetical protein LOC147670 |
| SMIM19 | 114926 | NP_001129146 | 1549 | chromosome 8 open reading frame 40 |
| SMIM19 | 114926 | NP_001129147 | 1550 | chromosome 8 open reading frame 40 |
| SMIM19 | 114926 | NP_001129148 | 1551 | chromosome 8 open reading frame 40 |
| SMIM19 | 114926 | NP_612445 | 5752 | chromosome 8 open reading frame 40 |
| SMIM2 | 79024 | XP_935153 | 7090 | hypothetical protein MGC5590 |
| SMIM2 | 79024 | XP_946545 | 7095 | hypothetical protein MGC5590 |
| SMIM20 | 389203 | NP_001138904 | 1857 | hypothetical protein LOC389203 |
| SMIM22 | 440335 | XP_001722243 | 7071 | hypothetical protein LOC440335 |
| SMIM22 | 440335 | XP_002343454 | 7077 | hypothetical protein LOC440335 |
| SMIM22 | 440335 | XP_002343455 | 7078 | hypothetical protein LOC440335 |
| SMIM22 | 440335 | XP_002344988 | 7079 | hypothetical protein LOC440335 |
| SMIM22 | 440335 | XP_002344989 | 7080 | hypothetical protein LOC440335 |
| SMIM22 | 440335 | XP_002347626 | 7084 | hypothetical protein LOC440335 |
| SMIM22 | 440335 | XP_002347627 | 7085 | hypothetical protein LOC440335 |

FIG. 2 (CONT.)

| Antigen | GeneID | Accession No. | SEQ ID NO: | RefSeq Gene Name |
|---|---|---|---|---|
| SMIM22 | 440335 | XP_940484 | 7092 | hypothetical protein LOC440335 |
| SMIM22 | 440335 | XP_950835 | 7096 | hypothetical protein LOC440335 |
| SMIM24 | 284422 | NP_001129975 | 1607 | similar toHSPC323 |
| SMIM3 | 85027 | NP_116565 | 5426 | MSTP150 |
| SMIM4 | 440957 | NP_001118239 | 1299 | similar to CG32736-PA |
| SMIM5 | 643008 | NP_001156467 | 2039 | PP12104 |
| SMIM6 | 100130933 | NP_001156469 | 2040 | hypothetical LOC100130933 |
| SMIM7 | 79086 | NP_077009 | 5011 | chromosome 19 open reading frame 42 |
| SMIM8 | 57150 | NP_001035958 | 895 | chromosome 6 open reading frame 162 |
| SMIM8 | 57150 | NP_065158 | 4654 | chromosome 6 open reading frame 162 |
| SMLR1 | 100507203 | NP_001182526.1 | 7107 | small leucine-rich protein 1 |
| SMO | 6608 | NP_005622 | 3332 | smoothenedHomolog (Drosophila) |
| SMOC2 | 64094 | NP_001159884 | 2167 | SPARC related modular calcium binding 2 |
| SMOC2 | 64094 | NP_071421 | 4882 | SPARC related modular calcium binding 2 |
| SMPD1 | 6609 | NP_000534 | 158 | sphingomyelin phosphodiesterase 1, acid lysosomal |
| SMPD1 | 6609 | NP_001007594 | 524 | sphingomyelin phosphodiesterase 1, acid lysosomal |
| SMPD2 | 6610 | NP_003071 | 2781 | sphingomyelin phosphodiesterase 2, neutral membrane (neutral sphingomyelinase) |
| SMPD3 | 55512 | NP_061137 | 4482 | sphingomyelin phosphodiesterase 3, neutral membrane (neutral sphingomyelinase II) |
| SNAP23 | 8773 | NP_003816.2 | 7308 | synaptosome associated protein 23 |
| SNN | 8303 | NP_003489 | 2843 | stannin |
| SNRNP40 | 9410 | NP_004805 | 3135 | small nuclear ribonucleoprotein 40kDa (U5) |
| SNX13 | 23161 | NP_055947 | 4038 | sorting nexin 13 |
| SNX14 | 57231 | NP_065201 | 4665 | sorting nexin 14 |
| SNX14 | 57231 | NP_722523 | 6231 | sorting nexin 14 |
| SNX19 | 399979 | NP_055573 | 3984 | sorting nexin 19 |
| SOAT1 | 6646 | NP_003092 | 2782 | sterol O-acyltransferase 1 |
| SOAT2 | 8435 | NP_003569 | 2851 | sterol O-acyltransferase 2 |
| SORCS1 | 114815 | NP_001013049 | 609 | sortilin-related VPS10 domain containing receptor 1 |
| SORCS1 | 114815 | NP_443150 | 5540 | sortilin-related VPS10 domain containing receptor 1 |
| SORCS2 | 57537 | NP_065828 | 4720 | sortilin-related VPS10 domain containing receptor 2 |
| SORCS3 | 22986 | NP_055793 | 4021 | sortilin-related VPS10 domain containing receptor 3 |
| SORL1 | 6653 | NP_003096 | 2783 | sortilin-related receptor, L(DLR class) A repeats-containing |
| SORT1 | 6272 | NP_002950 | 2738 | sortilin 1 |
| SOX1 | 6656 | NP_005977 | 3411 | SRY (sex determining region Y)-box 1 |
| SP4 | 6671 | NP_003103 | 2784 | Sp4 transcription factor |
| SPACA1 | 81833 | NP_112222 | 5206 | sperm acrosome associated 1 |
| SPAG4 | 6676 | NP_003107 | 2785 | sperm associated antigen 4 |
| SPAG9 | 9043 | NP_001124000 | 1432 | sperm associated antigen 9 |
| SPAG9 | 9043 | NP_003962 | 2936 | sperm associated antigen 9 |
| SPAM1 | 6677 | NP_003108 | 2786 | sperm adhesion molecule 1 (PH-20Hyaluronidase, zona pellucida binding) |
| SPAM1 | 6677 | NP_694859 | 6156 | sperm adhesion molecule 1 (PH-20Hyaluronidase, zona pellucida binding) |
| SPAST | 6683 | NP_055761 | 4019 | spastin |
| SPAST | 6683 | NP_955468 | 6884 | spastin |
| SPATA3 | 130560 | NP_620712 | 5834 | spermatogenesis associated 3 |
| SPATA31D1 | 389763 | NP_001001670 | 373 | FAM75-like protein FLJ46321 |
| SPATA9 | 83890 | NP_114158 | 5275 | spermatogenesis associated 9 |
| SPCS1 | 28972 | NP_054760 | 3860 | signal peptidase complex subunit 1Homolog (S. cerevisiae) |
| SPCS2 | 9789 | NP_055567 | 3982 | signal peptidase complex subunit 2Homolog (S. cerevisiae) signal peptidase complex subunit 2Homolog pseudogene |
| SPEM1 | 374768 | NP_955371 | 6877 | spermatid maturation 1 |
| SPG7 | 6687 | NP_003110 | 2787 | spastic paraplegia 7 (pure and complicated autosomal recessive) |
| SPG7 | 6687 | NP_955399 | 6882 | spastic paraplegia 7 (pure and complicated autosomal recessive) |
| SPI1 | 6688 | NP_001074016 | 1037 | spleen focus forming virus (SFFV) proviral integration oncogene spi1 |
| SPI1 | 6688 | NP_003111 | 2788 | spleen focus forming virus (SFFV) proviral integration oncogene spi1 |
| SPINK13 | 153218 | NP_001035218 | 840 | serine PI Kazal type 5-like 3 |
| SPINK2 | 6691 | NP_066937 | 4775 | serine peptidase inhibitor, Kazal type 2 (acrosin-trypsin inhibitor) |
| SPINK6 | 404203 | NP_995313 | 6956 | serine peptidase inhibitor, Kazal type 6 |
| SPINT1 | 6692 | NP_001027539 | 744 | serine peptidase inhibitor, Kunitz type 1 |
| SPINT1 | 6692 | NP_003701 | 2872 | serine peptidase inhibitor, Kunitz type 1 |
| SPINT1 | 6692 | NP_857593 | 6616 | serine peptidase inhibitor, Kunitz type 1 |
| SPINT2 | 10653 | NP_001159575 | 2145 | serine peptidase inhibitor, Kunitz type, 2 |
| SPINT2 | 10653 | NP_066925 | 4772 | serine peptidase inhibitor, Kunitz type, 2 |
| SPN | 6693 | NP_001025459 | 717 | sialophorin |
| SPN | 6693 | NP_003114 | 2789 | sialophorin |
| SPNS1 | 83985 | NP_001135920 | 1662 | spinsterHomolog 1 (Drosophila) |
| SPNS1 | 83985 | NP_001135921 | 1663 | spinsterHomolog 1 (Drosophila) |
| SPNS1 | 83985 | NP_001135922 | 1664 | spinsterHomolog 1 (Drosophila) |
| SPNS1 | 83985 | NP_001135923 | 1665 | spinsterHomolog 1 (Drosophila) |
| SPNS1 | 83985 | NP_114427 | 5283 | spinsterHomolog 1 (Drosophila) |
| SPNS2 | 124976 | NP_001118230 | 1298 | spinsterHomolog 2 (Drosophila) |
| SPNS3 | 201305 | NP_872344 | 6653 | spinsterHomolog 3 (Drosophila) |
| SPOCK3 | 50859 | NP_001035249 | 845 | sparc/osteonectin, cwcv and kazal-like domains proteoglycan (testican) 3 |
| SPOCK3 | 50859 | NP_058646 | 4279 | sparc/osteonectin, cwcv and kazal-like domains proteoglycan (testican) 3 |
| SPON2 | 10417 | NP_001121797.1 | 7392 | spondin 2 |
| SPPL2A | 84888 | NP_116191 | 5405 | signal peptide peptidase-like 2A |
| SPPL2B | 56928 | NP_001070706 | 956 | signal peptide peptidase-like 2B |
| SPPL2B | 56928 | NP_694533 | 6141 | signal peptide peptidase-like 2B |

FIG. 2 (CONT.)

| Antigen | GeneID | Accession No. | SEQ ID NO: | RefSeq Gene Name |
|---|---|---|---|---|
| SPPL2C | 162540 | NP_787078 | 6464 | intramembrane protease 5 |
| SPPL3 | 121665 | NP_620584 | 5825 | signal peptide peptidase 3 |
| SPTLC1 | 10558 | NP_006406 | 3487 | serine palmitoyltransferase, long chain base subunit 1 |
| SPTLC1 | 10558 | NP_847894 | 6536 | serine palmitoyltransferase, long chain base subunit 1 |
| SPTLC2 | 9517 | NP_004854 | 3151 | serine palmitoyltransferase, long chain base subunit 2 |
| SPTLC3 | 55304 | NP_060797 | 4422 | serine palmitoyltransferase, long chain base subunit 3 |
| SPTSSA | 171546 | NP_612145 | 5719 | chromosome 14 open reading frame 147 |
| SPTSSB | 165679 | NP_001035189 | 831 | chromosome 3 open reading frame 57 |
| SPX | 80763 | NP_085049 | 5149 | chromosome 12 open reading frame 39 |
| SQLE | 6713 | NP_003120 | 2790 | squalene epoxidase |
| SRD5A1 | 6715 | NP_001038 | 926 | steroid-5-alpha-reductase, alpha polypeptide 1 (3-oxo-5 alpha-steroid delta 4-dehydrogenase alpha 1) |
| SRD5A2 | 6716 | NP_000339 | 103 | steroid-5-alpha-reductase, alpha polypeptide 2 (3-oxo-5 alpha-steroid delta 4-dehydrogenase alpha 2) |
| SRD5A3 | 79644 | NP_078868 | 5053 | steroid 5 alpha-reductase 3 |
| SRPRB | 58477 | NP_067026 | 4795 | signal recognition particle receptor, B subunit |
| SRR | 63826 | NP_068766 | 4851 | serine racemase |
| SSBP4 | 170463 | NP_001009998 | 568 | single stranded DNA binding protein 4 |
| SSBP4 | 170463 | NP_116016 | 5381 | single stranded DNA binding protein 4 |
| SSMEM1 | 136263 | NP_660311 | 5947 | chromosome 7 open reading frame 45 |
| SSPN | 8082 | NP_001129295 | 1572 | sarcospan (Kras oncogene-associated gene) |
| SSPN | 8082 | NP_005077 | 3209 | sarcospan (Kras oncogene-associated gene) |
| SSR1 | 6745 | NP_003135 | 2791 | signal sequence receptor, alpha |
| SSR2 | 6746 | NP_003136 | 2792 | signal sequence receptor, beta (translocon-associated protein beta) |
| SSR3 | 6747 | NP_009038 | 3631 | signal sequence receptor, gamma (translocon-associated protein gamma) |
| SST | 6750 | NP_001039.1 | 7266 | somatostatin |
| SSTR1 | 6751 | NP_001040 | 927 | somatostatin receptor 1 |
| SSTR2 | 6752 | NP_001041 | 928 | somatostatin receptor 2 |
| SSTR3 | 6753 | NP_001042 | 935 | somatostatin receptor 3 |
| SSTR4 | 6754 | NP_001043 | 936 | somatostatin receptor 4 |
| SSTR5 | 6755 | NP_001044 | 937 | somatostatin receptor 5 |
| SSX1 | 6756 | NP_001265620.1 | 7438 | SSX family member 1 |
| ST14 | 6768 | NP_068813 | 4858 | suppression of tumorigenicity 14 (colon carcinoma) |
| ST3GAL1 | 6482 | NP_003024 | 2757 | ST3 beta-galactoside alpha-2,3-sialyltransferase 1 |
| ST3GAL1 | 6482 | NP_775479 | 6341 | ST3 beta-galactoside alpha-2,3-sialyltransferase 1 |
| ST3GAL2 | 6483 | NP_008858 | 3596 | ST3 beta-galactoside alpha-2,3-sialyltransferase 2 |
| ST3GAL3 | 6487 | NP_006270 | 3460 | ST3 beta-galactoside alpha-2,3-sialyltransferase 3 |
| ST3GAL3 | 6487 | NP_777623 | 6424 | ST3 beta-galactoside alpha-2,3-sialyltransferase 3 |
| ST3GAL3 | 6487 | NP_777624 | 6425 | ST3 beta-galactoside alpha-2,3-sialyltransferase 3 |
| ST3GAL3 | 6487 | NP_777625 | 6426 | ST3 beta-galactoside alpha-2,3-sialyltransferase 3 |
| ST3GAL3 | 6487 | NP_777626 | 6427 | ST3 beta-galactoside alpha-2,3-sialyltransferase 3 |
| ST3GAL3 | 6487 | NP_777627 | 6428 | ST3 beta-galactoside alpha-2,3-sialyltransferase 3 |
| ST3GAL3 | 6487 | NP_777628 | 6429 | ST3 beta-galactoside alpha-2,3-sialyltransferase 3 |
| ST3GAL3 | 6487 | NP_777629 | 6430 | ST3 beta-galactoside alpha-2,3-sialyltransferase 3 |
| ST3GAL3 | 6487 | NP_777630 | 6431 | ST3 beta-galactoside alpha-2,3-sialyltransferase 3 |
| ST3GAL3 | 6487 | NP_777631 | 6432 | ST3 beta-galactoside alpha-2,3-sialyltransferase 3 |
| ST3GAL4 | 6484 | NP_006269 | 3459 | ST3 beta-galactoside alpha-2,3-sialyltransferase 4 |
| ST3GAL5 | 8869 | NP_001035902 | 887 | ST3 beta-galactoside alpha-2,3-sialyltransferase 5 |
| ST3GAL5 | 8869 | NP_003887 | 2925 | ST3 beta-galactoside alpha-2,3-sialyltransferase 5 |
| ST3GAL6 | 10402 | NP_006091 | 3435 | ST3 beta-galactoside alpha-2,3-sialyltransferase 6 |
| ST6GAL2 | 84620 | NP_001135823 | 1648 | ST6 beta-galactosamide alpha-2,6-sialyltranferase 2 |
| ST6GAL2 | 84620 | NP_001135824 | 1649 | ST6 beta-galactosamide alpha-2,6-sialyltransferase 2 |
| ST6GAL2 | 84620 | NP_115917 | 5366 | ST6 beta-galactosamide alpha-2,6-sialyltranferase 2 |
| ST6GALNAC1 | 55808 | NP_060884 | 4444 | ST6 (alpha-N-acetyl-neuraminyl-2,3-beta-galactosyl-1,3)-N-acetylgalactosaminide alpha-2,6-sialyltransferase 1 |
| ST6GALNAC2 | 10610 | NP_006447 | 3493 | ST6 (alpha-N-acetyl-neuraminyl-2,3-beta-galactosyl-1,3)-N-acetylgalactosaminide alpha-2,6-sialyltransferase 2 |
| ST6GALNAC3 | 256435 | NP_001153483 | 1973 | ST6 (alpha-N-acetyl-neuraminyl-2,3-beta-galactosyl-1,3)-N-acetylgalactosaminide alpha-2,6-sialyltransferase 3 |
| ST6GALNAC3 | 256435 | NP_694541 | 6143 | ST6 (alpha-N-acetyl-neuraminyl-2,3-beta-galactosyl-1,3)-N-acetylgalactosaminide alpha-2,6-sialyltransferase 3 |
| ST6GALNAC4 | 27090 | NP_778204 | 6436 | ST6 (alpha-N-acetyl-neuraminyl-2,3-beta-galactosyl-1,3)-N-acetylgalactosaminide alpha-2,6-sialyltransferase 4 |
| ST6GALNAC4 | 27090 | NP_778205 | 6437 | ST6 (alpha-N-acetyl-neuraminyl-2,3-beta-galactosyl-1,3)-N-acetylgalactosaminide alpha-2,6-sialyltransferase 4 |
| ST6GALNAC5 | 81849 | NP_112227 | 5207 | ST6 (alpha-N-acetyl-neuraminyl-2,3-beta-galactosyl-1,3)-N-acetylgalactosaminide alpha-2,6-sialyltransferase 5 |
| ST6GALNAC6 | 30815 | NP_038471 | 3824 | ST6 (alpha-N-acetyl-neuraminyl-2,3-beta-galactosyl-1,3)-N-acetylgalactosaminide alpha-2,6-sialyltransferase 6 |
| ST7 | 7982 | NP_060882 | 4442 | suppression of tumorigenicity 7 |
| ST7 | 7982 | NP_068708 | 4843 | suppression of tumorigenicity 7 |
| ST7L | 54879 | NP_060214 | 4334 | suppression of tumorigenicity 7 like |
| ST7L | 54879 | NP_620055 | 5778 | suppression of tumorigenicity 7 like |
| ST7L | 54879 | NP_620056 | 5779 | suppression of tumorigenicity 7 like |
| ST7L | 54879 | NP_620057 | 5780 | suppression of tumorigenicity 7 like |
| ST8SIA1 | 6489 | NP_003025 | 2758 | ST8 alpha-N-acetyl-neuraminide alpha-2,8-sialyltransferase 1 |
| ST8SIA2 | 8128 | NP_006002 | 3413 | ST8 alpha-N-acetyl-neuraminide alpha-2,8-sialyltransferase 2 |
| ST8SIA3 | 51046 | NP_056963 | 4127 | ST8 alpha-N-acetyl-neuraminide alpha-2,8-sialyltransferase 3 |
| ST8SIA5 | 29906 | NP_037437 | 3799 | ST8 alpha-N-acetyl-neuraminide alpha-2,8-sialyltransferase 5 |
| STAB1 | 23166 | NP_055951 | 4039 | stabilin 1 |
| STAB2 | 55576 | NP_060034.9 | 7345 | stabilin 2 |
| STARD3 | 10948 | NP_001159409 | 2129 | StAR-related lipid transfer (START) domain containing 3 |
| STARD3 | 10948 | NP_001159410 | 2130 | StAR-related lipid transfer (START) domain containing 3 |
| STARD3 | 10948 | NP_006795 | 3567 | StAR-related lipid transfer (START) domain containing 3 |
| STARD3NL | 83930 | NP_114405 | 5279 | STARD3 N-terminal like |
| STEAP1 | 26872 | NP_036581 | 3777 | six transmembrane epithelial antigen of the prostate 1 |
| STEAP1B | 256227 | NP_001157932 | 2079 | similar to Six transmembrane epithelial antigen of prostate |

FIG. 2 (CONT.)

| Antigen | GeneID | Accession No. | SEQ ID NO: | RefSeq Gene Name |
|---|---|---|---|---|
| STEAP1B | 256227 | NP_997225 | 7012 | similar to Six transmembrane epithelial antigen of prostate |
| STEAP2 | 261729 | NP_001035755 | 879 | six transmembrane epithelial antigen of the prostate 2 |
| STEAP2 | 261729 | NP_001035756 | 880 | six transmembrane epithelial antigen of the prostate 2 |
| STEAP2 | 261729 | NP_694544 | 6145 | six transmembrane epithelial antigen of the prostate 2 |
| STEAP3 | 55240 | NP_001008410.1 | 7340 | STEAP3 metalloreductase |
| STEAP4 | 79689 | NP_078912 | 5060 | STEAP family member 4 |
| STIM1 | 6786 | NP_003147 | 2793 | stromal interaction molecule 1 |
| STIM2 | 57620 | NP_001162588 | 2236 | stromal interaction molecule 2 |
| STIM2 | 57620 | NP_001162589 | 2237 | stromal interaction molecule 2 |
| STIM2 | 57620 | NP_065911 | 4734 | stromal interaction molecule 2 |
| STOM | 2040 | NP_004090 | 2962 | stomatin |
| STOM | 2040 | NP_937837 | 6756 | stomatin |
| STOML1 | 9399 | NP_004800 | 3134 | stomatin (EPB72)-like 1 |
| STOML3 | 161003 | NP_001137505 | 1760 | stomatin (EPB72)-like 3 |
| STOML3 | 161003 | NP_660329 | 5953 | stomatin (EPB72)-like 3 |
| STRA6 | 64220 | NP_001136089.1 | 7401 | stimulated by retinoic acid 6 |
| STS | 412 | NP_000342 | 105 | steroid sulfatase (microsomal), isozyme S |
| STT3A | 3703 | NP_689926 | 6103 | STT3, subunit of the oligosaccharyltransferase complex,Homolog A (S. cerevisiae) |
| STX10 | 8677 | NP_003756 | 2888 | syntaxin 10 |
| STX12 | 23673 | NP_803173 | 6492 | syntaxin 12 |
| STX17 | 55014 | NP_060389 | 4371 | syntaxin 17 |
| STX18 | 53407 | NP_058626 | 4274 | syntaxin 18 |
| STX1B | 112755 | NP_443106 | 5523 | syntaxin 1B |
| STX2 | 2054 | NP_001971 | 2516 | syntaxin 2 |
| STX2 | 2054 | NP_919337 | 6721 | syntaxin 2 |
| STX3 | 6809 | NP_004168 | 2981 | syntaxin 3 |
| STX4 | 6810 | NP_004595 | 3082 | syntaxin 4 |
| STX6 | 10228 | NP_005810 | 3376 | syntaxin 6 |
| STX7 | 8417 | NP_003560 | 2849 | syntaxin 7 |
| STX8 | 9482 | NP_004844 | 3147 | syntaxin 8 |
| STXBP2 | 6813 | NP_001120868 | 1326 | syntaxin binding protein 2 |
| STXBP2 | 6813 | NP_008880 | 3602 | syntaxin binding protein 2 |
| STYK1 | 55359 | NP_060893 | 4447 | serine/threonine/tyrosine kinase 1 |
| SUCNR1 | 56670 | NP_149039 | 5443 | succinate receptor 1 |
| SULF2 | 55959 | NP_001155313.1 | 7411 | sulfatase 2 |
| SUMF2 | 25870 | NP_001035934 | 890 | sulfatase modifying factor 2 |
| SUMF2 | 25870 | NP_001035935 | 891 | sulfatase modifying factor 2 |
| SUMF2 | 25870 | NP_001123541 | 1416 | sulfatase modifying factor 2 |
| SUMF2 | 25870 | NP_001139805 | 1931 | sulfatase modifying factor 2 |
| SUMF2 | 25870 | NP_056226 | 4078 | sulfatase modifying factor 2 |
| SUN1 | 23353 | NP_001124437 | 1452 | unc-84Homolog A (C. elegans) |
| SUN1 | 23353 | NP_001165415 | 2301 | unc-84Homolog A (C. elegans) |
| SUN1 | 23353 | NP_001165416 | 2302 | unc-84Homolog A (C. elegans) |
| SUN1 | 23353 | NP_001165417 | 2303 | unc-84Homolog A (C. elegans) |
| SUN1 | 23353 | NP_079430 | 5127 | unc-84Homolog A (C. elegans) |
| SUN2 | 25777 | NP_056189 | 4071 | unc-84Homolog B (C. elegans) |
| SURF4 | 6836 | NP_149351 | 5454 | surfeit 4 |
| SUSD1 | 64420 | NP_071931 | 4926 | sushi domain containing 1 |
| SUSD2 | 56241 | NP_062547 | 4574 | sushi domain containing 2 |
| SUSD3 | 203328 | NP_659443 | 5916 | sushi domain containing 3 |
| SUSD4 | 55061 | NP_001032252 | 771 | sushi domain containing 4 |
| SUSD4 | 55061 | NP_060452 | 4377 | sushi domain containing 4 |
| SUSD5 | 26032 | NP_056366 | 4100 | sushi domain containing 5 |
| SUSD6 | 9766 | NP_055549 | 3979 | KIAA0247 |
| SV2A | 9900 | NP_055664 | 3999 | synaptic vesicle glycoprotein 2A |
| SV2B | 9899 | NP_001161052 | 2185 | synaptic vesicle glycoprotein 2BHypothetical protein LOC100128403 |
| SV2B | 9899 | NP_055663 | 3998 | synaptic vesicle glycoprotein 2BHypothetical protein LOC100128403 |
| SV2C | 22987 | NP_055794 | 4022 | synaptic vesicle glycoprotein 2C |
| SVOP | 55530 | NP_061181 | 4486 | SV2 related proteinHomolog (rat) |
| SVOPL | 136306 | NP_001132928 | 1618 | SVOP-like |
| SVOPL | 136306 | NP_777619 | 6423 | SVOP-like |
| SYNDIG1 | 79953 | NP_079169 | 5097 | chromosome 20 open reading frame 39 |
| SYNDIG1L | 646658 | NP_001099049 | 1230 | transmembrane protein 90A |
| SYNE3 | 161176 | NP_689805 | 6086 | chromosome 14 open reading frame 49 |
| SYNE4 | 163183 | NP_001034965 | 814 | chromosome 19 open reading frame 46 |
| SYNGR1 | 9145 | NP_004702 | 3107 | synaptogyrin 1 |
| SYNGR1 | 9145 | NP_663783 | 5972 | synaptogyrin 1 |
| SYNGR1 | 9145 | NP_663791 | 5973 | synaptogyrin 1 |
| SYNGR2 | 9144 | NP_004701 | 3106 | synaptogyrin 2 |
| SYNGR3 | 9143 | NP_004200 | 2989 | synaptogyrin 3 |
| SYNGR4 | 23546 | NP_036583 | 3779 | synaptogyrin 4 |
| SYNJ2BP | 55333 | NP_060843 | 4433 | synaptojanin 2 binding protein |
| SYNPR | 132204 | NP_001123475 | 1408 | synaptoporin |
| SYNPR | 132204 | NP_653243 | 5882 | synaptoporin |
| SYP | 6855 | NP_003170 | 2794 | synaptophysin |
| SYPL1 | 6856 | NP_006745 | 3557 | synaptophysin-like 1 |
| SYPL1 | 6856 | NP_874384 | 6677 | synaptophysin-like 1 |

FIG. 2 (CONT.)

| Antigen | GeneID | Accession No. | SEQ ID NO: | RefSeq Gene Name |
|---|---|---|---|---|
| SYPL2 | 284612 | NP_001035799 | 882 | synaptophysin-like 2 |
| SYS1 | 90196 | NP_291020 | 5505 | SYS1 Golgi-localized integral membrane proteinHomolog (S. cerevisiae) |
| SYT1 | 6857 | NP_001129277 | 1567 | synaptotagmin I |
| SYT1 | 6857 | NP_001129278 | 1568 | synaptotagmin I |
| SYT1 | 6857 | NP_005630 | 3334 | synaptotagmin I |
| SYT11 | 23208 | NP_689493 | 6023 | synaptotagmin XI |
| SYT12 | 91683 | NP_808878 | 6508 | synaptotagmin XII |
| SYT13 | 57586 | NP_065877 | 4729 | synaptotagmin XIII |
| SYT14 | 255928 | NP_001139733 | 1917 | synaptotagmin XIV |
| SYT14 | 255928 | NP_001139734 | 1918 | synaptotagmin XIV |
| SYT14 | 255928 | NP_001139736 | 1919 | synaptotagmin XIV |
| SYT14 | 255928 | NP_694994 | 6169 | synaptotagmin XIV |
| SYT15 | 83849 | NP_114118 | 5268 | synaptotagmin XV |
| SYT15 | 83849 | NP_852660 | 6605 | synaptotagmin XV |
| SYT2 | 127833 | NP_001129976 | 1608 | synaptotagmin II |
| SYT2 | 127833 | NP_796376 | 6489 | synaptotagmin II |
| SYT3 | 84258 | NP_001153800.1 | 7410 | synaptotagmin 3 |
| SYT4 | 6860 | NP_065834 | 4722 | synaptotagmin IV |
| SYT5 | 6861 | NP_003171 | 2795 | synaptotagmin V |
| SYT6 | 148281 | NP_995320 | 6957 | synaptotagmin VI |
| SYT7 | 9066 | NP_001238994.1 | 7431 | synaptotagmin 7 |
| SYT8 | 90019 | NP_612634.3 | 7358 | synaptotagmin 8 |
| SYT9 | 143425 | NP_783860 | 6455 | synaptotagmin IX |
| TAAR1 | 134864 | NP_612200 | 5726 | trace amine associated receptor 1 |
| TAAR2 | 9287 | NP_001028252 | 753 | trace amine associated receptor 2 |
| TAAR2 | 9287 | NP_055441 | 3967 | trace amine associated receptor 2 |
| TAAR5 | 9038 | NP_003958 | 2935 | trace amine associated receptor 5 |
| TAAR8 | 83551 | NP_444508 | 5561 | trace amine associated receptor 8 |
| TAAR9 | 134860 | NP_778227 | 6439 | trace amine associated receptor 9 |
| TACR1 | 6869 | NP_001049 | 939 | tachykinin receptor 1 |
| TACR1 | 6869 | NP_056542 | 4120 | tachykinin receptor 1 |
| TACR2 | 6865 | NP_001048 | 938 | tachykinin receptor 2 |
| TACR3 | 6870 | NP_001050 | 940 | tachykinin receptor 3 |
| TACSTD2 | 4070 | NP_002344 | 2631 | tumor-associated calcium signal transducer 2 |
| TAOK2 | 9344 | NP_004774 | 3125 | TAO kinase 2 |
| TAOK2 | 9344 | NP_057235 | 4178 | TAO kinase 2 |
| TAPBP | 6892 | NP_003181 | 2797 | TAP binding protein (tapasin) |
| TAPBP | 6892 | NP_757345 | 6290 | TAP binding protein (tapasin) |
| TAPBP | 6892 | NP_757346 | 6291 | TAP binding protein (tapasin) |
| TAPBPL | 55080 | NP_060479 | 4381 | TAP binding protein-like |
| TAPT1 | 202018 | NP_699196 | 6184 | transmembrane anterior posterior transformation 1 |
| TAS1R1 | 80835 | NP_619642 | 5772 | taste receptor, type 1, member 1 |
| TAS1R1 | 80835 | NP_803883 | 6497 | taste receptor, type 1, member 1 |
| TAS1R1 | 80835 | NP_803884 | 6498 | taste receptor, type 1, member 1 |
| TAS1R1 | 80835 | NP_803885 | 6499 | taste receptor, type 1, member 1 |
| TAS1R2 | 80834 | NP_689418 | 6020 | taste receptor, type 1, member 2 |
| TAS2R1 | 50834 | NP_062545 | 4573 | taste receptor, type 2, member 1 |
| TAS2R10 | 50839 | NP_076410.1 | 7297 | taste 2 receptor member 10 |
| TAS2R13 | 50838 | NP_076409 | 4983 | taste receptor, type 2, member 13 |
| TAS2R14 | 50840 | NP_076411 | 4984 | taste receptor, type 2, member 14 |
| TAS2R16 | 50833 | NP_058641 | 4277 | taste receptor, type 2, member 16 |
| TAS2R3 | 50831 | NP_058639 | 4276 | taste receptor, type 2, member 3 |
| TAS2R38 | 5726 | NP_789787 | 6480 | taste receptor, type 2, member 38 |
| TAS2R39 | 259285 | NP_795362 | 6483 | taste receptor, type 2, member 39 |
| TAS2R4 | 50832 | NP_058640.1 | 7285 | taste 2 receptor member 4 |
| TAS2R40 | 259286 | NP_795363 | 6484 | taste receptor, type 2, member 40 |
| TAS2R41 | 259287 | NP_795364 | 6485 | taste receptor, type 2, member 41 |
| TAS2R5 | 54429 | NP_061853 | 4544 | taste receptor, type 2, member 5 |
| TAS2R50 | 259296 | NP_795371 | 6486 | taste receptor, type 2, member 50 |
| TAS2R7 | 50837 | NP_076408 | 4982 | taste receptor, type 2, member 7 |
| TAS2R8 | 50836 | NP_076407 | 4981 | taste receptor, type 2, member 8 |
| TAS2R9 | 50835 | NP_076406 | 4980 | taste receptor, type 2, member 9 |
| TAZ | 6901 | NP_000107 | 34 | tafazzin |
| TAZ | 6901 | NP_851828 | 6590 | tafazzin |
| TAZ | 6901 | NP_851829 | 6591 | tafazzin |
| TAZ | 6901 | NP_851830 | 6592 | tafazzin |
| TBC1D20 | 128637 | NP_653229 | 5878 | TBC1 domain family, member 20 |
| TBC1D2B | 23102 | NP_055894 | 4029 | TBC1 domain family, member 2B |
| TBC1D2B | 23102 | NP_653173 | 5864 | TBC1 domain family, member 2B |
| TBC1D7 | 51256 | NP_001137436 | 1744 | TBC1 domain family, member 7 |
| TBC1D7 | 51256 | NP_001137437 | 1745 | TBC1 domain family, member 7 |
| TBC1D7 | 51256 | NP_001137438 | 1746 | TBC1 domain family, member 7 |
| TBC1D7 | 51256 | NP_057579 | 4228 | TBC1 domain family, member 7 |
| TBL2 | 26608 | NP_036585 | 3781 | transducin (beta)-like 2 |
| TCIRG1 | 10312 | NP_006010 | 3416 | T-cell, immune regulator 1, ATPase,H+ transporting, lysosomal V0 subunit A3 |
| TCIRG1 | 10312 | NP_006044 | 3421 | T-cell, immune regulator 1, ATPase,H+ transporting, lysosomal V0 subunit A3 |
| TCTA | 6988 | NP_071503 | 4894 | T-cell leukemia translocation altered gene |

FIG. 2 (CONT.)

| Antigen | GeneID | Accession No. | SEQ ID NO: | RefSeq Gene Name |
|---|---|---|---|---|
| TCTN3 | 26123 | NP_001137445 | 1749 | tectonic family member 3 |
| TCTN3 | 26123 | NP_056446 | 4108 | tectonic family member 3 |
| TDGF1 | 6997 | NP_001167607.1 | 7419 | teratocarcinoma-derived growth factor 1 |
| TDGF1P3 | 6998 | AAA61135.1 | 7466 | teratocarcinoma-derived growth factor 3 |
| TDRKH | 11022 | NP_001077432 | 1086 | tudor and KH domain containing |
| TDRKH | 11022 | NP_001077433 | 1087 | tudor and KH domain containing |
| TDRKH | 11022 | NP_001077434 | 1088 | tudor and KH domain containing |
| TDRKH | 11022 | NP_006853 | 3585 | tudor and KH domain containing |
| TECRL | 253017 | NP_001010874 | 573 | steroid 5 alpha-reductase 2-like 2 |
| TEDDM1 | 127670 | NP_741997 | 6266 | transmembrane epididymal protein 1 |
| TEK | 7010 | NP_000450 | 135 | TEK tyrosine kinase, endothelial |
| TENM1 | 10178 | NP_001156750 | 2049 | odz, odd Oz/ten-mHomolog 1(Drosophila) |
| TENM1 | 10178 | NP_001156751 | 2050 | odz, odd Oz/ten-mHomolog 1(Drosophila) |
| TENM1 | 10178 | NP_055068 | 3896 | odz, odd Oz/ten-mHomolog 1(Drosophila) |
| TENM2 | 57451 | NP_001073897.2 | 7373 | teneurin transmembrane protein 2 |
| TENM3 | 55714 | NP_001073946 | 1029 | odz, odd Oz/ten-mHomolog 3 (Drosophila) |
| TENM4 | 26011 | NP_001092286 | 1147 | odz, odd Oz/ten-mHomolog 4 (Drosophila) |
| TEX2 | 55852 | NP_060939 | 4456 | testis expressed 2 |
| TEX261 | 113419 | NP_653183 | 5867 | testis expressed 261 |
| TEX264 | 51368 | NP_001123356 | 1402 | testis expressed 264 |
| TEX264 | 51368 | NP_057010 | 4138 | testis expressed 264 |
| TEX29 | 121793 | NP_689537 | 6033 | chromosome 13 open reading frame 16 |
| TEX38 | 374973 | NP_001138946 | 1868 | chromosome 1 open reading frame 223 |
| TFR2 | 7036 | NP_003218 | 2799 | transferrin receptor 2 |
| TGFA | 7039 | NP_001093161 | 1170 | transforming growth factor, alpha |
| TGFA | 7039 | NP_003227 | 2800 | transforming growth factor, alpha |
| TGFB3 | 7043 | NP_003230 | 2801 | transforming growth factor, beta 3 |
| TGFBI | 7045 | NP_000349 | 107 | transforming growth factor, beta-induced, 68kDa |
| TGFBR1 | 7046 | NP_001124388 | 1447 | transforming growth factor, beta receptor 1 |
| TGFBR1 | 7046 | NP_004603 | 3083 | transforming growth factor, beta receptor 1 |
| TGFBR2 | 7048 | NP_001020018 | 689 | transforming growth factor, beta receptor II (70/80kDa) |
| TGFBR2 | 7048 | NP_003233 | 2802 | transforming growth factor, beta receptor II (70/80kDa) |
| TGFBR3 | 7049 | NP_003234 | 2803 | transforming growth factor, beta receptor III |
| TGOLN2 | 10618 | NP_006455 | 3495 | trans-golgi network protein 2 |
| THADA | 63892 | NP_001077422 | 1085 | thyroid adenoma associated |
| THADA | 63892 | NP_071348 | 4871 | thyroid adenoma associated |
| THAP6 | 152815 | NP_653322 | 5899 | THAP domain containing 6 |
| THBD | 7056 | NP_000352 | 108 | thrombomodulin |
| THSD4 | 79875 | NP_079093 | 5086 | thrombospondin, type I, domain containing 4 |
| THSD7A | 221981 | NP_056019 | 4044 | thrombospondin, type I, domain containing 7A |
| THSD7B | 80731 | NP_001303278.1 | 1020 | thrombospondin, type I, domain containing 7B |
| THY1 | 7070 | NP_001298089.1 | 7454 | Thy-1 cell surface antigen |
| TIE1 | 7075 | NP_005415 | 3283 | tyrosine kinase with immunoglobulin-like and EGF-like domains 1 |
| TIGIT | 201633 | NP_776160 | 6385 | T cell immunoreceptor with Ig and ITIM domains |
| TIMD4 | 91937 | NP_001140198 | 1935 | T-cell immunoglobulin and mucin domain containing 4 |
| TIMD4 | 91937 | NP_612388 | 5737 | T-cell immunoglobulin and mucin domain containing 4 |
| TIMM17A | 10440 | NP_006326 | 3469 | translocase of inner mitochondrial membrane 17Homolog A (yeast) |
| TIMM17B | 10245 | NP_001161419 | 2208 | translocase of inner mitochondrial membrane 17Homolog B (yeast) |
| TIMM17B | 10245 | NP_005825 | 3380 | translocase of inner mitochondrial membrane 17Homolog B (yeast) |
| TIMM21 | 29090 | NP_054896 | 3875 | chromosome 18 open reading frame 55 |
| TIMM22 | 29928 | NP_037469 | 3805 | translocase of inner mitochondrial membrane 22Homolog (yeast) |
| TIMM23 | 100287932 | NP_006318 | 3467 | similar to translocase of inner mitochondrial membrane 23 (yeast)Homolog |
| TIMM50 | 92609 | NP_001001563 | 370 | translocase of inner mitochondrial membrane 50Homolog (S. cerevisiae) |
| TIMMDC1 | 51300 | NP_057673 | 4252 | chromosome 3 open reading frame 1 |
| TKFC | 26007 | NP_056348 | 4096 | dihydroxyacetone kinase 2Homolog (S. cerevisiae) |
| TLCD1 | 116238 | NP_001153879 | 1995 | TLC domain containing 1 |
| TLCD1 | 116238 | NP_612472 | 5756 | TLC domain containing 1 |
| TLCD2 | 727910 | NP_001157879 | 2077 | TLC domain containing 2 |
| TLR1 | 7096 | NP_003254 | 2806 | toll-like receptor 1 |
| TLR10 | 81793 | NP_001017388 | 639 | toll-like receptor 10 |
| TLR10 | 81793 | NP_112218 | 5202 | toll-like receptor 10 |
| TLR2 | 7097 | NP_003255 | 2807 | toll-like receptor 2 |
| TLR3 | 7098 | NP_003256 | 2808 | toll-like receptor 3 |
| TLR4 | 7099 | NP_612564 | 5759 | toll-like receptor 4 |
| TLR5 | 7100 | NP_003259 | 2809 | toll-like receptor 5 |
| TLR6 | 10333 | NP_006059 | 3427 | toll-like receptor 6 |
| TLR7 | 51284 | NP_057646 | 4244 | toll-like receptor 7 |
| TLR9 | 54106 | NP_059138 | 4293 | toll-like receptor 9 |
| TM2D1 | 83941 | NP_114416 | 5281 | TM2 domain containing 1 |
| TM2D2 | 83877 | NP_001019551 | 676 | TM2 domain containing 2 |
| TM2D2 | 83877 | NP_001019552 | 677 | TM2 domain containing 2 |
| TM2D2 | 83877 | NP_114146 | 5272 | TM2 domain containing 2 |
| TM2D2 | 83877 | NP_510882 | 5590 | TM2 domain containing 2 |
| TM4SF1 | 4071 | NP_055035 | 3888 | transmembrane 4 L six family member 1 |
| TM4SF18 | 116441 | NP_620141 | 5794 | transmembrane 4 L six family member 18 |
| TM4SF20 | 79853 | NP_079071 | 5085 | transmembrane 4 L six family member 20 |
| TM4SF4 | 7104 | NP_004608 | 3086 | transmembrane 4 L six family member 4 |

FIG. 2 (CONT.)

| Antigen | GeneID | Accession No. | SEQ ID NO: | RefSeq Gene Name |
|---|---|---|---|---|
| TM4SF5 | 9032 | NP_003954 | 2932 | transmembrane 4 L six family member 5 |
| TM6SF1 | 53346 | NP_001138375 | 1783 | transmembrane 6 superfamily member 1 |
| TM6SF1 | 53346 | NP_075379 | 4969 | transmembrane 6 superfamily member 1 |
| TM6SF2 | 53345 | NP_001001524 | 366 | transmembrane 6 superfamily member 2 |
| TM7SF2 | 7108 | NP_003264 | 2813 | transmembrane 7 superfamily member 2 |
| TM7SF3 | 51768 | NP_057635 | 4242 | transmembrane 7 superfamily member 3 |
| TM9SF1 | 10548 | NP_001014842 | 628 | transmembrane 9 superfamily member 1 |
| TM9SF1 | 10548 | NP_006396 | 3481 | transmembrane 9 superfamily member 1 |
| TM9SF2 | 9375 | NP_004791 | 3130 | transmembrane 9 superfamily member 2 |
| TM9SF3 | 56889 | NP_064508 | 4598 | transmembrane 9 superfamily member 3 |
| TM9SF4 | 9777 | NP_055557 | 3980 | transmembrane 9 superfamily protein member 4 |
| TMBIM1 | 64114 | NP_071435 | 4887 | transmembrane BAX inhibitor motif containing 1 |
| TMBIM4 | 51643 | NP_057140 | 4159 | transmembrane BAX inhibitor motif containing 4 |
| TMBIM6 | 7009 | NP_001092046 | 1138 | transmembrane BAX inhibitor motif containing 6 |
| TMBIM6 | 7009 | NP_003208 | 2798 | transmembrane BAX inhibitor motif containing 6 |
| TMC1 | 117531 | NP_619636 | 5770 | transmembrane channel-like 1 |
| TMC2 | 117532 | NP_542789 | 5627 | transmembrane channel-like 2 |
| TMC4 | 147798 | NP_001138775 | 1848 | transmembrane channel-like 4 |
| TMC4 | 147798 | NP_653287 | 5892 | transmembrane channel-like 4 |
| TMC5 | 79838 | NP_001098718 | 1220 | transmembrane channel-like 5 |
| TMC5 | 79838 | NP_001098719 | 1221 | transmembrane channel-like 5 |
| TMC5 | 79838 | NP_079056 | 5080 | transmembrane channel-like 5 |
| TMC6 | 11322 | NP_001120670 | 1309 | transmembrane channel-like 6 |
| TMC6 | 11322 | NP_009198 | 3665 | transmembrane channel-like 6 |
| TMC7 | 79905 | NP_001153836 | 1994 | transmembrane channel-like 7 |
| TMC7 | 79905 | NP_079123 | 5092 | transmembrane channel-like 7 |
| TMC8 | 147138 | NP_689681 | 6065 | transmembrane channel-like 8 |
| TMCC1 | 23023 | NP_001017395 | 640 | transmembrane and coiled-coil domain family 1 |
| TMCC1 | 23023 | NP_001121696 | 1369 | transmembrane and coiled-coil domain family 1 |
| TMCC1 | 23023 | NP_001017395.2 | 4025 | transmembrane and coiled-coil domain family 1 |
| TMCC2 | 9911 | NP_055673 | 4000 | transmembrane and coiled-coil domain family 2 |
| TMCC3 | 57458 | NP_065749 | 4703 | transmembrane and coiled-coil domain family 3 |
| TMCO1 | 54499 | NP_061899 | 4550 | transmembrane and coiled-coil domains 1 |
| TMCO2 | 127391 | NP_001008740 | 552 | transmembrane and coiled-coil domains 2 |
| TMCO3 | 55002 | NP_060375 | 4368 | transmembrane and coiled-coil domains 3 |
| TMCO4 | 255104 | NP_859070 | 6624 | transmembrane and coiled-coil domains 4 |
| TMCO5A | 145942 | NP_689666 | 6062 | transmembrane and coiled-coil domains 5A |
| TMED1 | 11018 | NP_006849 | 3584 | transmembrane emp24 protein transport domain containing 1 |
| TMED10 | 10972 | NP_006818 | 3574 | transmembrane emp24-like trafficking protein 10 (yeast) |
| TMED2 | 10959 | NP_006806 | 3570 | transmembrane emp24 domain trafficking protein 2 |
| TMED3 | 23423 | NP_031390 | 3691 | transmembrane emp24 protein transport domain containing 3 |
| TMED4 | 222068 | NP_872353 | 6655 | transmembrane emp24 protein transport domain containing 4 |
| TMED5 | 50999 | NP_001161302 | 2202 | transmembrane emp24 protein transport domain containing 5 |
| TMED5 | 50999 | NP_057124 | 4157 | transmembrane emp24 protein transport domain containing 5 |
| TMED6 | 146456 | NP_653277 | 5889 | transmembrane emp24 protein transport domain containing 6 |
| TMED7 | 51014 | NP_001157941 | 2081 | transmembrane emp24 protein transport domain containing 7 toll-like receptor adaptor molecule 2 |
| TMED7 | 51014 | NP_067681 | 4817 | transmembrane emp24 protein transport domain containing 7 toll-like receptor adaptor molecule 2 |
| TMED7 | 51014 | NP_861974 | 6639 | transmembrane emp24 protein transport domain containing 7 toll-like receptor adaptor molecule 2 |
| TMEFF2 | 23671 | NP_057276 | 4183 | transmembrane protein with EGF-like and two follistatin-like domains 2 |
| TMEM100 | 55273 | NP_001093110 | 1161 | transmembrane protein 100 |
| TMEM100 | 55273 | NP_060756 | 4414 | transmembrane protein 100 |
| TMEM101 | 84336 | NP_115752 | 5336 | transmembrane protein 101 |
| TMEM104 | 54868 | NP_060198 | 4329 | transmembrane protein 104 |
| TMEM105 | 284186 | NP_848615 | 6549 | transmembrane protein 105 |
| TMEM106A | 113277 | NP_659478 | 5923 | hypothetical LOC728772 transmembrane protein 106A |
| TMEM106B | 54664 | NP_001127704 | 1474 | transmembrane protein 106B |
| TMEM106B | 54664 | NP_060844 | 4434 | transmembrane protein 106B |
| TMEM106C | 79022 | NP_001137313 | 1733 | transmembrane protein 106C |
| TMEM106C | 79022 | NP_001137314 | 1734 | transmembrane protein 106C |
| TMEM106C | 79022 | NP_001137315 | 1735 | transmembrane protein 106C |
| TMEM106C | 79022 | NP_076961 | 5001 | transmembrane protein 106C |
| TMEM107 | 84314 | NP_115730 | 5333 | transmembrane protein 107 |
| TMEM107 | 84314 | NP_898888 | 6701 | transmembrane protein 107 |
| TMEM109 | 79073 | NP_076997 | 5009 | transmembrane protein 109 |
| TMEM110 | 375346 | NP_940965 | 6816 | transmembrane protein 110 musculoskeletal, embryonic nuclear protein 1 |
| TMEM110 | 375346 | NP_995325 | 6960 | transmembrane protein 110 musculoskeletal, embryonic nuclear protein 1 |
| TMEM115 | 11070 | NP_008955 | 3617 | transmembrane protein 115 |
| TMEM116 | 89894 | NP_612350 | 5731 | transmembrane protein 116 |
| TMEM117 | 84216 | NP_115632 | 5314 | transmembrane protein 117 |
| TMEM119 | 338773 | NP_859075 | 6626 | transmembrane protein 119 |
| TMEM120A | 83862 | NP_114131 | 5270 | transmembrane protein 120A |
| TMEM120B | 144404 | NP_001074294 | 1042 | transmembrane protein 120B |
| TMEM121 | 80757 | NP_079544 | 5146 | transmembrane protein 121 |
| TMEM123 | 114908 | NP_443164 | 5542 | transmembrane protein 123 |
| TMEM125 | 128218 | NP_653227 | 5877 | transmembrane protein 125 |
| TMEM126A | 84233 | NP_115649 | 5316 | transmembrane protein 126A |
| TMEM126B | 55863 | NP_060950 | 4459 | transmembrane protein 126B |

FIG. 2 (CONT.)

| Antigen | GeneID | Accession No. | SEQ ID NO: | RefSeq Gene Name |
|---|---|---|---|---|
| TMEM127 | 55654 | NP_060319 | 4356 | transmembrane protein 127 |
| TMEM128 | 85013 | NP_116316 | 5423 | transmembrane protein 128 |
| TMEM129 | 92305 | NP_001120738 | 1317 | transmembrane protein 129 |
| TMEM129 | 92305 | NP_612394 | 5738 | transmembrane protein 129 |
| TMEM130 | 222865 | NP_001127922 | 1493 | transmembrane protein 130 |
| TMEM130 | 222865 | NP_001127923 | 1494 | transmembrane protein 130 |
| TMEM130 | 222865 | NP_690877 | 6132 | transmembrane protein 130 |
| TMEM131 | 23505 | NP_056163 | 4066 | transmembrane protein 131 |
| TMEM132B | 114795 | NP_443139 | 5535 | transmembrane protein 132BHypothetical LOC121296 |
| TMEM132C | 92293 | NP_001129575 | 1598 | transmembrane protein 132C |
| TMEM132D | 121256 | NP_597705 | 5692 | transmembrane protein 132D |
| TMEM132E | 124842 | NP_001291367.1 | 7006 | transmembrane protein 132E |
| TMEM133 | 83935 | NP_114410 | 5280 | transmembrane protein 133 |
| TMEM134 | 80194 | NP_001072118 | 984 | transmembrane protein 134 |
| TMEM134 | 80194 | NP_001072119 | 985 | transmembrane protein 134 |
| TMEM134 | 80194 | NP_001072118.1 | 5121 | transmembrane protein 134 |
| TMEM135 | 65084 | NP_001162195 | 2235 | transmembrane protein 135 |
| TMEM135 | 65084 | NP_075069 | 4964 | transmembrane protein 135 |
| TMEM136 | 219902 | NP_777586 | 6412 | transmembrane protein 136 |
| TMEM138 | 51524 | NP_057548 | 4223 | transmembrane protein 138 |
| TMEM139 | 135932 | NP_699176 | 6180 | transmembrane protein 139 |
| TMEM140 | 55281 | NP_060765 | 4415 | transmembrane protein 140 |
| TMEM141 | 85014 | NP_001034463 | 791 | KIAA1984 transmembrane protein 141 |
| TMEM141 | 85014 | NP_116317 | 5424 | KIAA1984 transmembrane protein 141 |
| TMEM143 | 55260 | NP_060743 | 4412 | transmembrane protein 143 |
| TMEM144 | 55314 | NP_060812 | 4425 | transmembrane protein 144 |
| TMEM145 | 284339 | NP_775904 | 6367 | transmembrane protein 145 |
| TMEM147 | 10430 | NP_116024 | 5383 | transmembrane protein 147 |
| TMEM14A | 28978 | NP_054770 | 3863 | transmembrane protein 14A |
| TMEM14C | 51522 | NP_001158730 | 2126 | transmembrane protein 14C |
| TMEM14C | 51522 | NP_057546 | 4222 | transmembrane protein 14C |
| TMEM150A | 129303 | NP_001026908 | 731 | transmembrane protein 150A |
| TMEM150A | 129303 | NP_001026908.1 | 6179 | transmembrane protein 150A |
| TMEM150B | 284417 | NP_001078957 | 1097 | transmembrane protein 150B |
| TMEM150C | 441027 | NP_001073975 | 1033 | hypothetical LOC441027 |
| TMEM151B | 441151 | NP_001131032 | 1614 | transmembrane protein 151B |
| TMEM154 | 201799 | NP_689893 | 6096 | transmembrane protein 154 |
| TMEM156 | 80008 | NP_079219 | 5105 | transmembrane protein 156 |
| TMEM158 | 25907 | NP_056259 | 4084 | transmembrane protein 158 |
| TMEM159 | 57146 | NP_065155 | 4653 | transmembrane protein 159 |
| TMEM160 | 54958 | NP_060324 | 4358 | transmembrane protein 160 |
| TMEM161A | 54929 | NP_060284 | 4348 | transmembrane protein 161A |
| TMEM161B | 153396 | NP_699185 | 6182 | transmembrane protein 161B |
| TMEM163 | 81615 | NP_112185 | 5193 | transmembrane protein 163 |
| TMEM165 | 55858 | NP_060945 | 4457 | transmembrane protein 165 |
| TMEM167A | 153339 | NP_777569 | 6407 | similar to transmembrane protein 167A |
| TMEM168 | 64418 | NP_071929 | 4925 | transmembrane protein 168 |
| TMEM169 | 92691 | NP_001135782 | 1638 | transmembrane protein 169 |
| TMEM169 | 92691 | NP_001135783 | 1639 | transmembrane protein 169 |
| TMEM169 | 92691 | NP_001135784 | 1640 | transmembrane protein 169 |
| TMEM169 | 92691 | NP_612399 | 5740 | transmembrane protein 169 |
| TMEM17 | 200728 | NP_938017 | 6766 | transmembrane protein 17 |
| TMEM170A | 124491 | NP_660297 | 5942 | transmembrane protein 170A |
| TMEM170B | 100113407 | NP_001094299 | 1195 | transmembrane protein 170B |
| TMEM171 | 134285 | NP_001154814 | 2001 | transmembrane protein 171 |
| TMEM171 | 134285 | NP_775761 | 6346 | transmembrane protein 171 |
| TMEM174 | 134288 | NP_694949 | 6161 | transmembrane protein 174 |
| TMEM175 | 84286 | NP_115702 | 5328 | transmembrane protein 175 |
| TMEM176B | 28959 | NP_001094781 | 1197 | transmembrane protein 176B |
| TMEM176B | 28959 | NP_001094782 | 1198 | transmembrane protein 176B |
| TMEM176B | 28959 | NP_001094781.1 | 1199 | transmembrane protein 176B |
| TMEM176B | 28959 | NP_001094784 | 1200 | transmembrane protein 176B |
| TMEM176B | 28959 | NP_054739 | 3856 | transmembrane protein 176B |
| TMEM178A | 130733 | NP_001161431 | 2209 | transmembrane protein 178 |
| TMEM178A | 130733 | NP_689603 | 6049 | transmembrane protein 178 |
| TMEM178B | 100507421 | XP_011514007 | 7108 | transmembrane protein 178B |
| TMEM179B | 374395 | NP_955369 | 6876 | transmembrane protein 179B |
| TMEM18 | 129787 | NP_690047 | 6118 | transmembrane protein 18 |
| TMEM181 | 57583 | NP_065874 | 4728 | transmembrane protein 181 |
| TMEM182 | 130827 | NP_653233 | 5879 | transmembrane protein 182 |
| TMEM183A | 92703 | NP_001073277 | 996 | transmembrane protein 183A transmembrane protein 183B |
| TMEM183A | 92703 | NP_612400 | 5741 | transmembrane protein 183A transmembrane protein 183B |
| TMEM184B | 25829 | NP_036396 | 3730 | transmembrane protein 184B |
| TMEM185B | 79134 | NP_077026 | 7100 | transmembrane protein 185B |
| TMEM186 | 25880 | NP_056236 | 4080 | transmembrane protein 186 |
| TMEM187 | 8269 | NP_003483 | 2841 | transmembrane protein 187 |
| TMEM189 | 387521 | NP_001027459 | 741 | ubiquitin-conjugating enzyme E2 variant 1 |

FIG. 2 (CONT.)

| Antigen | GeneID | Accession No. | SEQ ID NO: | RefSeq Gene Name |
|---|---|---|---|---|
| TMEM189 | 387521 | NP_001155977 | 2032 | ubiquitin-conjugating enzyme E2 variant 1 |
| TMEM189 | 387521 | NP_001155977.1 | 2824 | ubiquitin-conjugating enzyme E2 variant 1 |
| TMEM189 | 387521 | NP_068823 | 4860 | ubiquitin-conjugating enzyme E2 variant 1 |
| TMEM189 | 387521 | NP_071887 | 4917 | ubiquitin-conjugating enzyme E2 variant 1 |
| TMEM189 | 387521 | NP_954580 | 6857 | ubiquitin-conjugating enzyme E2 variant 1 |
| TMEM189 | 387521 | NP_954595 | 6859 | ubiquitin-conjugating enzyme E2 variant 1 |
| TMEM189 | 387521 | NP_954673 | 6864 | ubiquitin-conjugating enzyme E2 variant 1 |
| TMEM19 | 55266 | NP_060749 | 4413 | transmembrane protein 19 |
| TMEM190 | 147744 | NP_631911 | 5842 | transmembrane protein 190 |
| TMEM192 | 201931 | NP_001093859 | 1185 | transmembrane protein 192 |
| TMEM196 | 256130 | NP_689987 | 6114 | transmembrane protein 196 |
| TMEM198 | 130612 | NP_001005209 | 447 | transmembrane protein 198 |
| TMEM199 | 147007 | NP_689677 | 6064 | transmembrane protein 199 |
| TMEM2 | 23670 | NP_001129292 | 1569 | transmembrane protein 2 |
| TMEM2 | 23670 | NP_037522 | 3818 | transmembrane protein 2 |
| TMEM200A | 114801 | NP_443145 | 5537 | transmembrane protein 200A |
| TMEM200B | 399474 | NP_001003682 | 415 | transmembrane protein 200B |
| TMEM200B | 399474 | NP_001165339 | 2289 | transmembrane protein 200B |
| TMEM200C | 645369 | NP_001073678 | 1014 | two transmembrane domain family member A |
| TMEM201 | 199953 | NP_001010866 | 571 | transmembrane protein 201 |
| TMEM201 | 199953 | NP_001124396 | 1448 | transmembrane protein 201 |
| TMEM203 | 94107 | NP_444273 | 5559 | transmembrane protein 203 |
| TMEM204 | 79652 | NP_078876 | 5055 | transmembrane protein 204 |
| TMEM205 | 374882 | NP_001138888 | 1855 | transmembrane protein 205 |
| TMEM205 | 374882 | NP_212133 | 5493 | transmembrane protein 205 |
| TMEM205 | 374882 | NP_940938 | 6810 | transmembrane protein 205 |
| TMEM206 | 55248 | NP_060722 | 4409 | transmembrane protein 206 |
| TMEM207 | 131920 | NP_997199 | 7007 | transmembrane protein 207 |
| TMEM208 | 29100 | NP_054906 | 3878 | transmembrane protein 208 |
| TMEM209 | 84928 | NP_116231 | 5416 | transmembrane protein 209 |
| TMEM212 | 389177 | NP_001157908 | 2078 | hypothetical LOC389177 |
| TMEM213 | 155006 | NP_001078898 | 1094 | transmembrane protein 213 |
| TMEM216 | 51259 | NP_057583 | 4230 | transmembrane protein 216 |
| TMEM217 | 221468 | NP_001156372 | 2038 | transmembrane protein 217 |
| TMEM217 | 221468 | NP_660359 | 5961 | transmembrane protein 217 |
| TMEM218 | 219854 | NP_001074015 | 1036 | transmembrane protein 218 |
| TMEM219 | 124446 | NP_001077082 | 1077 | transmembrane protein 219 |
| TMEM219 | 124446 | NP_919256 | 6712 | transmembrane protein 219 |
| TMEM220 | 388335 | NP_001004313 | 429 | transmembrane protein 220 |
| TMEM221 | 100130519 | XP_001718804 | 7062 | transmembrane protein 221 |
| TMEM221 | 100130519 | XP_001719748 | 7067 | transmembrane protein 221 |
| TMEM222 | 84065 | NP_115501 | 5300 | transmembrane protein 222 |
| TMEM225 | 338661 | NP_001013765 | 620 | transmembrane protein 225 |
| TMEM229B | 161145 | NP_872332 | 6650 | chromosome 14 open reading frame 83 |
| TMEM230 | 29058 | NP_001009923 | 565 | hypothetical LOC642975 chromosome 20 open reading frame 30 |
| TMEM230 | 29058 | NP_001009924 | 566 | hypothetical LOC642975 chromosome 20 open reading frame 30 |
| TMEM230 | 29058 | NP_001009925 | 567 | hypothetical LOC642975 chromosome 20 open reading frame 30 |
| TMEM230 | 29058 | NP_054864 | 3873 | hypothetical LOC642975 chromosome 20 open reading frame 30 |
| TMEM231 | 79583 | NP_001070884 | 967 | hypothetical protein FLJ22167 |
| TMEM231 | 79583 | NP_001070886 | 968 | hypothetical protein FLJ22167 |
| TMEM231 | 79583 | NP_001070884.2 | 969 | hypothetical protein FLJ22167 |
| TMEM234 | 56063 | NP_061991 | 4568 | chromosome 1 open reading frame 91 |
| TMEM235 | 283999 | NP_001191139.1 | 1869 | hypothetical protein LOC283999 |
| TMEM237 | 65062 | NP_001037850 | 921 | amyotrophic lateral sclerosis 2 (juvenile) chromosome region, candidate 4 |
| TMEM237 | 65062 | NP_689601 | 6047 | amyotrophic lateral sclerosis 2 (juvenile) chromosome region, candidate 4 |
| TMEM239 | 100288797 | NP_001161142 | 2193 | hypothetical protein LOC100288797 |
| TMEM242 | 729515 | NP_001138890 | 1856 | chromosome 6 open reading frame 35HCG1820764 tetratricopeptide repeat domain 28 |
| TMEM242 | 729515 | NP_060922 | 4454 | chromosome 6 open reading frame 35HCG1820764 tetratricopeptide repeat domain 28 |
| TMEM243 | 79161 | NP_077291 | 5024 | chromosome 7 open reading frame 23 |
| TMEM245 | 23731 | NP_114401.2 | 1171 | chromosome 9 open reading frame 5 |
| TMEM245 | 23731 | NP_114401 | 5277 | chromosome 9 open reading frame 5 |
| TMEM246 | 84302 | NP_115718 | 5332 | chromosome 9 open reading frame 125 |
| TMEM248 | 55069 | NP_060464 | 4379 | chromosome 7 open reading frame 42 |
| TMEM25 | 84866 | NP_001137506 | 1761 | transmembrane protein 25 |
| TMEM25 | 84866 | NP_001137507 | 1762 | transmembrane protein 25 |
| TMEM25 | 84866 | NP_001137508 | 1763 | transmembrane protein 25 |
| TMEM25 | 84866 | NP_001137509 | 1764 | transmembrane protein 25 |
| TMEM25 | 84866 | NP_001137510 | 1765 | transmembrane protein 25 |
| TMEM25 | 84866 | NP_116169 | 5399 | transmembrane protein 25 |
| TMEM251 | 26175 | NP_001092091 | 1141 | chromosome 14 open reading frame 109 |
| TMEM251 | 26175 | NP_056491 | 4112 | chromosome 14 open reading frame 109 |
| TMEM252 | 169693 | NP_694969 | 6164 | chromosome 9 open reading frame 71 |
| TMEM254 | 80195 | NP_079401 | 5122 | chromosome 10 open reading frame 58 chromosome 10 open reading frame 57 |
| TMEM254 | 80195 | NP_001257296.1 | 5330 | chromosome 10 open reading frame 58 chromosome 10 open reading frame 57 |
| TMEM255A | 55026 | NP_001098014 | 1213 | family with sequence similarity 70, member A |
| TMEM255A | 55026 | NP_001098015 | 1214 | family with sequence similarity 70, member A |
| TMEM255A | 55026 | NP_060408 | 4373 | family with sequence similarity 70, member A |

FIG. 2 (CONT.)

| Antigen | GeneID | Accession No. | SEQ ID NO: | RefSeq Gene Name |
|---|---|---|---|---|
| TMEM255B | 348013 | NP_872420 | 6667 | family with sequence similarity 70, member B |
| TMEM256 | 254863 | NP_689979 | 6112 | chromosome 17 open reading frame 61 |
| TMEM257 | 9142 | NP_004700 | 3105 | chromosome X open reading frame 1 |
| TMEM258 | 746 | NP_055021 | 3880 | chromosome 11 open reading frame 10 |
| TMEM259 | 91304 | NP_001028198 | 750 | chromosome 19 open reading frame 6 |
| TMEM259 | 91304 | NP_219488 | 5496 | chromosome 19 open reading frame 6 |
| TMEM26 | 219623 | NP_848600 | 6546 | transmembrane protein 26 |
| TMEM260 | 54916 | NP_060269 | 4345 | chromosome 14 open reading frame 101 |
| TMEM261 | 90871 | NP_219500 | 5497 | chromosome 9 open reading frame 123 |
| TMEM263 | 90488 | NP_689474 | 6021 | chromosome 12 open reading frame 23 |
| TMEM265 | 100862671 | NP_001243758 | 7113 | transmembrane protein 265 |
| TMEM27 | 57393 | NP_065716 | 4695 | transmembrane protein 27 |
| TMEM30A | 55754 | NP_001137430 | 1740 | transmembrane protein 30A |
| TMEM30A | 55754 | NP_060717 | 4408 | transmembrane protein 30A |
| TMEM30B | 161291 | NP_001017970 | 654 | transmembrane protein 30B |
| TMEM31 | 203562 | NP_872347 | 6654 | transmembrane protein 31 |
| TMEM33 | 55161 | NP_060596 | 4396 | transmembrane protein 33 |
| TMEM35 | 59353 | NP_067650 | 4814 | transmembrane protein 35 |
| TMEM37 | 140738 | NP_899063 | 6705 | transmembrane protein 37 |
| TMEM38B | 55151 | NP_060582 | 4394 | transmembrane protein 38B |
| TMEM39A | 55254 | NP_060736 | 4411 | transmembrane protein 39A |
| TMEM40 | 55287 | NP_060776 | 4418 | transmembrane protein 40 |
| TMEM41A | 90407 | NP_542383 | 5612 | transmembrane protein 41A |
| TMEM41B | 440026 | NP_001158502 | 2121 | transmembrane protein 41B |
| TMEM41B | 440026 | NP_055827 | 4026 | transmembrane protein 41B |
| TMEM42 | 131616 | NP_653239 | 5881 | transmembrane protein 42 |
| TMEM43 | 79188 | NP_077310 | 5026 | transmembrane protein 43 |
| TMEM45A | 55076 | NP_060474 | 4380 | transmembrane protein 45A |
| TMEM45B | 120224 | NP_620143 | 5795 | transmembrane protein 45B |
| TMEM47 | 83604 | NP_113630 | 5225 | transmembrane protein 47 |
| TMEM5 | 10329 | NP_055069 | 3897 | transmembrane protein 5 |
| TMEM50A | 23585 | NP_055128 | 3912 | transmembrane protein 50A |
| TMEM50B | 757 | NP_006125 | 3440 | transmembrane protein 50B |
| TMEM51 | 55092 | NP_001129688 | 1601 | transmembrane protein 51 |
| TMEM51 | 55092 | NP_001129689 | 1602 | transmembrane protein 51 |
| TMEM51 | 55092 | NP_001129690 | 1603 | transmembrane protein 51 |
| TMEM51 | 55092 | NP_060492 | 4382 | transmembrane protein 51 |
| TMEM52 | 339456 | NP_848640 | 6554 | transmembrane protein 52 |
| TMEM52B | 120939 | NP_694567 | 6151 | chromosome 12 open reading frame 59 |
| TMEM54 | 113452 | NP_277039 | 5502 | transmembrane protein 54 |
| TMEM55B | 90809 | NP_001094284 | 1194 | transmembrane protein 55B |
| TMEM55B | 90809 | NP_653169 | 5863 | transmembrane protein 55B |
| TMEM56 | 148534 | NP_689700 | 6068 | transmembrane protein 56 |
| TMEM57 | 55219 | NP_060672 | 4402 | transmembrane protein 57 |
| TMEM59 | 9528 | NP_004863 | 3156 | transmembrane protein 59 |
| TMEM59L | 25789 | NP_036241 | 3706 | transmembrane protein 59-like |
| TMEM60 | 85025 | NP_116325 | 5425 | transmembrane protein 60 |
| TMEM61 | 199964 | NP_872338 | 6652 | transmembrane protein 61 |
| TMEM62 | 80021 | NP_079232 | 5107 | transmembrane protein 62 |
| TMEM63A | 9725 | NP_055513 | 3975 | transmembrane protein 63A |
| TMEM63B | 55362 | NP_060896 | 4448 | transmembrane protein 63B |
| TMEM63C | 57156 | NP_065164 | 4656 | transmembrane protein 63C |
| TMEM64 | 169200 | NP_001008495 | 540 | transmembrane protein 64 |
| TMEM64 | 169200 | NP_001139745 | 1923 | transmembrane protein 64 |
| TMEM65 | 157378 | NP_919267 | 6714 | transmembrane protein 65 |
| TMEM67 | 91147 | NP_001135773 | 1636 | transmembrane protein 67 |
| TMEM67 | 91147 | NP_714915 | 6217 | transmembrane protein 67 |
| TMEM68 | 137695 | NP_689630 | 6056 | transmembrane protein 68 |
| TMEM69 | 51249 | NP_057570 | 4226 | transmembrane protein 69 |
| TMEM70 | 54968 | NP_001035703 | 875 | transmembrane protein 70 |
| TMEM70 | 54968 | NP_060336 | 4360 | transmembrane protein 70 |
| TMEM71 | 137835 | NP_001138625 | 1822 | transmembrane protein 71 |
| TMEM71 | 137835 | NP_653250 | 5883 | transmembrane protein 71 |
| TMEM74 | 157753 | NP_694560 | 6149 | transmembrane protein 74 |
| TMEM74B | 55321 | NP_060824 | 4428 | chromosome 20 open reading frame 46 |
| TMEM79 | 84283 | NP_115699 | 5327 | transmembrane protein 79 |
| TMEM80 | 283232 | NP_001035928 | 889 | transmembrane protein 80 |
| TMEM80 | 283232 | NP_777600 | 6415 | transmembrane protein 80 |
| TMEM86A | 144110 | NP_699178 | 6181 | transmembrane protein 86A |
| TMEM86B | 255043 | NP_776165 | 6387 | transmembrane protein 86B |
| TMEM87A | 25963 | NP_001103973 | 1241 | transmembrane protein 87A |
| TMEM87A | 25963 | NP_056312 | 4091 | transmembrane protein 87A |
| TMEM87B | 84910 | NP_116213 | 5410 | transmembrane protein 87B |
| TMEM88 | 92162 | NP_981956 | 6933 | transmembrane protein 88 |
| TMEM8A | 58986 | NP_067082.2 | 7380 | transmembrane protein 8A |
| TMEM8B | 51754 | NP_001036054 | 911 | transmembrane protein 8B |
| TMEM8B | 51754 | NP_001036055 | 912 | transmembrane protein 8B |

FIG. 2 (CONT.)

| Antigen | GeneID | Accession No. | SEQ ID NO: | RefSeq Gene Name |
|---|---|---|---|---|
| TMEM8B | 51754 | NP_057530 | 4219 | transmembrane protein 8B |
| TMEM9 | 252839 | NP_057540 | 4221 | transmembrane protein 9 |
| TMEM91 | 641649 | NP_001036060 | 913 | transmembrane protein 91 |
| TMEM91 | 641649 | NP_001092291 | 1148 | transmembrane protein 91 |
| TMEM91 | 641649 | NP_001092292 | 1149 | transmembrane protein 91 |
| TMEM91 | 641649 | NP_001092293 | 1150 | transmembrane protein 91 |
| TMEM91 | 641649 | NP_001092294 | 1151 | transmembrane protein 91 |
| TMEM91 | 641649 | NP_001092295 | 1152 | transmembrane protein 91 |
| TMEM92 | 162461 | NP_001161687 | 2211 | transmembrane protein 92 |
| TMEM92 | 162461 | NP_694961 | 6163 | transmembrane protein 92 |
| TMEM95 | 339168 | NP_937797 | 6750 | transmembrane protein 95 |
| TMEM97 | 27346 | NP_055388 | 3958 | transmembrane protein 97 |
| TMEM98 | 26022 | NP_001028676 | 754 | similar to transmembrane protein 98 |
| TMEM98 | 26022 | NP_056359 | 4098 | similar to transmembrane protein 98 |
| TMEM99 | 147184 | NP_660317 | 5949 | transmembrane protein 99 |
| TMEM9B | 56674 | NP_065695 | 4688 | TMEM9 domain family, member B |
| TMIE | 259236 | NP_671729 | 5996 | transmembrane inner ear |
| TMIGD2 | 126259 | NP_001162597 | 2238 | transmembrane and immunoglobulin domain containing 2 |
| TMIGD2 | 126259 | NP_653216 | 5875 | transmembrane and immunoglobulin domain containing 2 |
| TMPO | 7112 | NP_001027454 | 739 | thymopoietin |
| TMPO | 7112 | NP_001027455 | 740 | thymopoietin |
| TMPO | 7112 | NP_003267 | 2814 | thymopoietin |
| TMPRSS11B | 132724 | NP_872308 | 6645 | transmembrane protease, serine 11B |
| TMPRSS11D | 9407 | NP_004253 | 3002 | transmembrane protease, serine 11D |
| TMPRSS11E | 28983 | NP_054777.2 | 1167 | transmembrane protease, serine 11E |
| TMPRSS11E | 28983 | NP_054777 | 3866 | transmembrane protease, serine 11E |
| TMPRSS12 | 283471 | NP_872365 | 6660 | transmembrane protease, serine 12 |
| TMPRSS13 | 84000 | NP_001070731 | 960 | transmembrane protease, serine 13 |
| TMPRSS15 | 5651 | NP_002763 | 2707 | protease, serine, 7 (enterokinase) |
| TMPRSS2 | 7113 | NP_001128571 | 1521 | transmembrane protease, serine 2 |
| TMPRSS2 | 7113 | NP_005647 | 3335 | transmembrane protease, serine 2 |
| TMPRSS3 | 64699 | NP_076927 | 4995 | transmembrane protease, serine 3 |
| TMPRSS3 | 64699 | NP_115781 | 5344 | transmembrane protease, serine 3 |
| TMPRSS4 | 56649 | NP_001077416 | 1084 | transmembrane protease, serine 4 |
| TMPRSS4 | 56649 | NP_063947 | 4592 | transmembrane protease, serine 4 |
| TMPRSS5 | 80975 | NP_110397 | 5167 | transmembrane protease, serine 5 |
| TMPRSS6 | 164656 | NP_705837 | 6200 | transmembrane protease, serine 6 |
| TMTC1 | 83857 | NP_787057 | 6462 | transmembrane and tetratricopeptide repeat containing 1 |
| TMTC2 | 160335 | NP_689801 | 6085 | transmembrane and tetratricopeptide repeat containing 2 |
| TMTC3 | 160418 | NP_861448 | 6633 | transmembrane and tetratricopeptide repeat containing 3 |
| TMTC4 | 84899 | NP_001073137 | 990 | transmembrane and tetratricopeptide repeat containing 4 |
| TMTC4 | 84899 | NP_116202 | 5409 | transmembrane and tetratricopeptide repeat containing 4 |
| TMUB1 | 83590 | NP_001129516 | 1593 | transmembrane and ubiquitin-like domain containing 1 |
| TMUB1 | 83590 | NP_113622 | 5223 | transmembrane and ubiquitin-like domain containing 1 |
| TMUB2 | 79089 | NP_001070142 | 948 | transmembrane and ubiquitin-like domain containing 2 |
| TMUB2 | 79089 | NP_077012 | 5013 | transmembrane and ubiquitin-like domain containing 2 |
| TMUB2 | 79089 | NP_803190 | 6493 | transmembrane and ubiquitin-like domain containing 2 |
| TMX1 | 81542 | NP_110382 | 5163 | thioredoxin-related transmembrane protein 1 |
| TMX2 | 51075 | NP_001137484 | 1758 | thioredoxin-related transmembrane protein 2 |
| TMX2 | 51075 | NP_057043 | 4142 | thioredoxin-related transmembrane protein 2 |
| TMX3 | 54495 | NP_061895 | 4549 | thioredoxin-related transmembrane protein 3 |
| TNC | 3371 | NP_002151 | 2562 | tenascin C |
| TNF | 7124 | NP_000585 | 169 | tumor necrosis factor (TNF superfamily, member 2) |
| TNFRSF10A | 8797 | NP_003835 | 2911 | tumor necrosis factor receptor superfamily, member 10a |
| TNFRSF10B | 8795 | NP_003833 | 2910 | tumor necrosis factor receptor superfamily, member 10b |
| TNFRSF10B | 8795 | NP_671716 | 5994 | tumor necrosis factor receptor superfamily, member 10b |
| TNFRSF10C | 8794 | NP_003832 | 2909 | tumor necrosis factor receptor superfamily, member 10c, decoy without an intracellular domain |
| TNFRSF10D | 8793 | NP_003831.2 | 7317 | TNF receptor superfamily member 10d |
| TNFRSF11A | 8792 | NP_003830 | 2908 | tumor necrosis factor receptor superfamily, member 11a, NFKB activator |
| TNFRSF12A | 51330 | NP_057723.1 | 7284 | TNF receptor superfamily member 12A |
| TNFRSF13B | 23495 | NP_036584 | 3780 | tumor necrosis factor receptor superfamily, member 13B |
| TNFRSF13C | 115650 | NP_443177 | 5547 | tumor necrosis factor receptor superfamily, member 13C |
| TNFRSF14 | 8764 | NP_003811 | 2907 | tumor necrosis factor receptor superfamily, member 14 (herpesvirus entry mediator) |
| TNFRSF17 | 608 | NP_001183 | 2312 | tumor necrosis factor receptor superfamily, member 17 |
| TNFRSF18 | 8784 | NP_004186 | 2984 | tumor necrosis factor receptor superfamily, member 18 |
| TNFRSF18 | 8784 | NP_683699 | 6005 | tumor necrosis factor receptor superfamily, member 18 |
| TNFRSF18 | 8784 | NP_683700 | 6006 | tumor necrosis factor receptor superfamily, member 18 |
| TNFRSF19 | 55504 | NP_061117 | 4477 | tumor necrosis factor receptor superfamily, member 19 |
| TNFRSF19 | 55504 | NP_683760 | 6009 | tumor necrosis factor receptor superfamily, member 19 |
| TNFRSF1A | 7132 | NP_001056 | 941 | tumor necrosis factor receptor superfamily, member 1A |
| TNFRSF1B | 7133 | NP_001057 | 942 | tumor necrosis factor receptor superfamily, member 1B |
| TNFRSF21 | 27242 | NP_055267 | 3944 | tumor necrosis factor receptor superfamily, member 21 |
| TNFRSF25 | 8718 | NP_001034753 | 806 | tumor necrosis factor receptor superfamily, member 25 |
| TNFRSF25 | 8718 | NP_003781 | 2896 | tumor necrosis factor receptor superfamily, member 25 |
| TNFRSF25 | 8718 | NP_683866 | 6013 | tumor necrosis factor receptor superfamily, member 25 |
| TNFRSF25 | 8718 | NP_683867 | 6014 | tumor necrosis factor receptor superfamily, member 25 |
| TNFRSF25 | 8718 | NP_683868 | 6015 | tumor necrosis factor receptor superfamily, member 25 |

FIG. 2 (CONT.)

| Antigen | GeneID | Accession No. | SEQ ID NO: | RefSeq Gene Name |
|---|---|---|---|---|
| TNFRSF25 | 8718 | NP_683871 | 6016 | tumor necrosis factor receptor superfamily, member 25 |
| TNFRSF4 | 7293 | NP_003318 | 2822 | tumor necrosis factor receptor superfamily, member 4 |
| TNFRSF8 | 943 | NP_001234 | 2323 | tumor necrosis factor receptor superfamily, member 8 |
| TNFRSF8 | 943 | NP_001234.3 | 6140 | tumor necrosis factor receptor superfamily, member 8 |
| TNFRSF9 | 3604 | NP_001552.2 | 7280 | TNF receptor superfamily member 9 |
| TNFSF10 | 8743 | NP_003801 | 2899 | tumor necrosis factor (ligand) superfamily, member 10 |
| TNFSF11 | 8600 | NP_003692 | 2871 | tumor necrosis factor (ligand) superfamily, member 11 |
| TNFSF11 | 8600 | NP_143026 | 5437 | tumor necrosis factor (ligand) superfamily, member 11 |
| TNFSF12 | 407977 | NP_003800.1 | 7268 | TNFSF12-TNFSF13 readthrough |
| TNFSF13B | 10673 | NP_001139117 | 1871 | tumor necrosis factor (ligand) superfamily, member 13b |
| TNFSF13B | 10673 | NP_006564 | 3515 | tumor necrosis factor (ligand) superfamily, member 13b |
| TNFSF14 | 8740 | NP_003798 | 2898 | tumor necrosis factor (ligand) superfamily, member 14 |
| TNFSF14 | 8740 | NP_742011 | 6269 | tumor necrosis factor (ligand) superfamily, member 14 |
| TNFSF15 | 9966 | NP_005109 | 3216 | tumor necrosis factor (ligand) superfamily, member 15 |
| TNFSF18 | 8995 | NP_005083.2 | 7379 | TNF superfamily member 18 |
| TNFSF4 | 7292 | NP_003317 | 2821 | tumor necrosis factor (ligand) superfamily, member 4 |
| TNFSF8 | 944 | NP_001235 | 2324 | tumor necrosis factor (ligand) superfamily, member 8 |
| TNFSF9 | 8744 | NP_003802 | 2900 | tumor necrosis factor (ligand) superfamily, member 9 |
| TNMD | 64102 | NP_071427 | 4885 | tenomodulin |
| TOMM20 | 9804 | NP_055580 | 3986 | similar to translocase of outer mitochondrial membrane 20Homolog |
| TOMM7 | 54543 | NP_061932 | 4554 | translocase of outer mitochondrial membrane 7Homolog (yeast) |
| TOMM70A | 9868 | NP_055635 | 3995 | translocase of outer mitochondrial membrane 70Homolog A (S. cerevisiae) |
| TOR1AIP2 | 163590 | NP_071742 | 4899 | torsin A interacting protein 2 |
| TOR1AIP2 | 163590 | NP_659471 | 5921 | torsin A interacting protein 2 |
| TOR1B | 27348 | NP_055321 | 3950 | torsin family 1, member B (torsin B) |
| TOR2A | 27433 | NP_001078816 | 1089 | torsin family 2, member A |
| TOR2A | 27433 | NP_001127902 | 1488 | torsin family 2, member A |
| TOR2A | 27433 | NP_001127903 | 1489 | torsin family 2, member A |
| TOR2A | 27433 | NP_569726 | 5658 | torsin family 2, member A |
| TP53I13 | 90313 | NP_612358.3 | 7363 | tumor protein p53 inducible protein 13 |
| TPBG | 7162 | NP_001159864 | 2164 | trophoblast glycoprotein |
| TPBG | 7162 | NP_006661 | 3538 | trophoblast glycoprotein |
| TPBGL | 100507050 | NP_001182457 | 7106 | trophoblast glycoprotein-like |
| TPCN1 | 53373 | NP_001137291 | 1729 | two pore segment channel 1 |
| TPCN1 | 53373 | NP_060371 | 4367 | two pore segment channel 1 |
| TPCN2 | 219931 | NP_620714 | 5835 | two pore segment channel 2 |
| TPM1 | 7168 | NP_000357.3 | 7321 | tropomyosin 1 (alpha) |
| TPO | 7173 | NP_000538 | 159 | thyroid peroxidase |
| TPO | 7173 | NP_783650 | 6447 | thyroid peroxidase |
| TPO | 7173 | NP_783652 | 6448 | thyroid peroxidase |
| TPO | 7173 | NP_783653 | 6449 | thyroid peroxidase |
| TPRA1 | 131601 | NP_001129525 | 1597 | G protein-coupled receptor 175 |
| TPRA1 | 131601 | NP_001136118 | 1682 | G protein-coupled receptor 175 |
| TPRA1 | 131601 | NP_001129525.1 | 4214 | G protein-coupled receptor 175 |
| TPSG1 | 25823 | NP_036599 | 3784 | tryptase gamma 1 |
| TPST1 | 8460 | NP_003587 | 2853 | tyrosylprotein sulfotransferase 1 |
| TPST2 | 8459 | NP_001008566 | 548 | tyrosylprotein sulfotransferase 2 |
| TPST2 | 8459 | NP_003586 | 2852 | tyrosylprotein sulfotransferase 2 |
| TPTE | 7179 | NP_954868 | 6870 | transmembrane phosphatase with tensinHomology |
| TPTE | 7179 | NP_954869 | 6871 | transmembrane phosphatase with tensinHomology |
| TPTE | 7179 | NP_954870 | 6872 | transmembrane phosphatase with tensinHomology |
| TRAF3IP3 | 80342 | NP_079504 | 5137 | TRAF3 interacting protein 3 |
| TRAM1 | 23471 | NP_055109 | 3908 | translocation associated membrane protein 1 |
| TRAM1L1 | 133022 | NP_689615 | 6052 | translocation associated membrane protein 1-like 1 |
| TRAM2 | 9697 | NP_036420 | 3738 | translocation associated membrane protein 2 |
| TRAT1 | 50852 | NP_057472 | 4216 | T cell receptor associated transmembrane adaptor 1 |
| TRDN | 10345 | NP_006064 | 3429 | triadin |
| TREM1 | 54210 | NP_061113 | 4474 | triggering receptor expressed on myeloid cells 1 |
| TREM2 | 54209 | NP_061838 | 4537 | triggering receptor expressed on myeloid cells 2 |
| TREML1 | 340205 | NP_835468 | 6526 | triggering receptor expressed on myeloid cells-like 1 |
| TREML2 | 79865 | NP_079083.2 | 7387 | triggering receptor expressed on myeloid cells like 2 |
| TRHDE | 29953 | NP_037513 | 3815 | thyrotropin-releasingHormone degrading enzyme |
| TRHR | 7201 | NP_003292 | 2816 | thyrotropin-releasingHormone receptor |
| TRIL | 9865 | NP_055632 | 3994 | KIAA0644 gene product |
| TRIM13 | 10206 | NP_001007279 | 517 | tripartite motif-containing 13 |
| TRIM13 | 10206 | NP_005789 | 3372 | tripartite motif-containing 13 |
| TRIM13 | 10206 | NP_434698 | 5512 | tripartite motif-containing 13 |
| TRIM13 | 10206 | NP_775876 | 6364 | tripartite motif-containing 13 |
| TRIM13 | 10206 | NP_955751 | 6887 | tripartite motif-containing 13 |
| TRIM13 | 10206 | NP_998755 | 7038 | tripartite motif-containing 13 |
| TRIM59 | 286827 | NP_775107 | 6334 | tripartite motif-containing 59 |
| TRIQK | 286144 | NP_001165266 | 2284 | chromosome 8 open reading frame 83 |
| TRIQK | 286144 | NP_001165267 | 2285 | chromosome 8 open reading frame 83 |
| TRIQK | 286144 | NP_001165268 | 2286 | chromosome 8 open reading frame 83 |
| TRIQK | 286144 | NP_001165269 | 2287 | chromosome 8 open reading frame 83 |
| TRIQK | 286144 | NP_001165270 | 2288 | chromosome 8 open reading frame 83 |
| TRPA1 | 8989 | NP_015628 | 3688 | transient receptor potential cation channel, subfamily A, member 1 |

FIG. 2 (CONT.)

| Antigen | GeneID | Accession No. | SEQ ID NO: | RefSeq Gene Name |
|---|---|---|---|---|
| TRPC1 | 7220 | NP_003295 | 2817 | transient receptor potential cation channel, subfamily C, member 1 |
| TRPC3 | 7222 | NP_001124170 | 1434 | transient receptor potential cation channel, subfamily C, member 3 |
| TRPC3 | 7222 | NP_003296 | 2818 | transient receptor potential cation channel, subfamily C, member 3 |
| TRPC4 | 7223 | NP_001129427 | 1578 | transient receptor potential cation channel, subfamily C, member 4 |
| TRPC4 | 7223 | NP_001129428 | 1579 | transient receptor potential cation channel, subfamily C, member 4 |
| TRPC4 | 7223 | NP_001129429 | 1580 | transient receptor potential cation channel, subfamily C, member 4 |
| TRPC4 | 7223 | NP_001129430 | 1581 | transient receptor potential cation channel, subfamily C, member 4 |
| TRPC4 | 7223 | NP_003297 | 2819 | transient receptor potential cation channel, subfamily C, member 4 |
| TRPC4 | 7223 | NP_057263 | 4180 | transient receptor potential cation channel, subfamily C, member 4 |
| TRPC5 | 7224 | NP_036603 | 3785 | transient receptor potential cation channel, subfamily C, member 5 |
| TRPC6 | 7225 | NP_004612 | 3087 | transient receptor potential cation channel, subfamily C, member 6 |
| TRPC7 | 57113 | NP_001161048 | 2182 | transient receptor potential cation channel, subfamily C, member 7 |
| TRPC7 | 57113 | NP_001161049 | 2183 | transient receptor potential cation channel, subfamily C, member 7 |
| TRPC7 | 57113 | NP_065122 | 4644 | transient receptor potential cation channel, subfamily C, member 7 |
| TRPM1 | 4308 | NP_002411 | 2650 | transient receptor potential cation channel, subfamily M, member 1 |
| TRPM2 | 7226 | NP_003298 | 2820 | transient receptor potential cation channel, subfamily M, member 2 |
| TRPM3 | 80036 | NP_001007471 | 519 | transient receptor potential cation channel, subfamily M, member 3 |
| TRPM3 | 80036 | NP_001007472 | 520 | transient receptor potential cation channel, subfamily M, member 3 |
| TRPM3 | 80036 | NP_066003 | 4745 | transient receptor potential cation channel, subfamily M, member 3 |
| TRPM3 | 80036 | NP_079247 | 5111 | transient receptor potential cation channel, subfamily M, member 3 |
| TRPM3 | 80036 | NP_996827 | 6986 | transient receptor potential cation channel, subfamily M, member 3 |
| TRPM3 | 80036 | NP_996828 | 6987 | transient receptor potential cation channel, subfamily M, member 3 |
| TRPM3 | 80036 | NP_996829 | 6988 | transient receptor potential cation channel, subfamily M, member 3 |
| TRPM3 | 80036 | NP_996830 | 6989 | transient receptor potential cation channel, subfamily M, member 3 |
| TRPM3 | 80036 | NP_996831 | 6990 | transient receptor potential cation channel, subfamily M, member 3 |
| TRPM4 | 54795 | NP_060106 | 4315 | transient receptor potential cation channel, subfamily M, member 4 |
| TRPM5 | 29850 | NP_055370 | 3955 | transient receptor potential cation channel, subfamily M, member 5 |
| TRPM6 | 140803 | NP_060132 | 4319 | transient receptor potential cation channel, subfamily M, member 6 |
| TRPM7 | 54822 | NP_060142 | 4320 | transient receptor potential cation channel, subfamily M, member 7 |
| TRPM8 | 79054 | NP_076985 | 5004 | transient receptor potential cation channel, subfamily M, member 8 |
| TRPV1 | 7442 | NP_061197 | 4490 | transient receptor potential cation channel, subfamily V, member 1 |
| TRPV1 | 7442 | NP_542435 | 5621 | transient receptor potential cation channel, subfamily V, member 1 |
| TRPV1 | 7442 | NP_542436 | 5622 | transient receptor potential cation channel, subfamily V, member 1 |
| TRPV1 | 7442 | NP_542437 | 5623 | transient receptor potential cation channel, subfamily V, member 1 |
| TRPV2 | 51393 | NP_057197 | 4172 | transient receptor potential cation channel, subfamily V, member 2 |
| TRPV3 | 162514 | NP_659505 | 5925 | transient receptor potential cation channel, subfamily V, member 3 |
| TRPV4 | 59341 | NP_067638 | 4811 | transient receptor potential cation channel, subfamily V, member 4 |
| TRPV4 | 59341 | NP_671737 | 6000 | transient receptor potential cation channel, subfamily V, member 4 |
| TRPV5 | 56302 | NP_062815 | 4581 | transient receptor potential cation channel, subfamily V, member 5 |
| TRPV6 | 55503 | NP_061116 | 4476 | transient receptor potential cation channel, subfamily V, member 6 |
| TSHR | 7253 | NP_000360 | 109 | thyroid stimulatingHormone receptor |
| TSHR | 7253 | NP_001018046 | 663 | thyroid stimulatingHormone receptor |
| TSHR | 7253 | NP_001136098 | 1678 | thyroid stimulatingHormone receptor |
| TSNARE1 | 203062 | NP_659440 | 5914 | t-SNARE domain containing 1 |
| TSPAN1 | 10103 | NP_005718 | 3354 | tetraspanin 1 |
| TSPAN10 | 83882 | NP_114151 | 5273 | tetraspanin 10 |
| TSPAN11 | 441631 | NP_001073978 | 1034 | tetraspanin 11 |
| TSPAN12 | 23554 | NP_036470 | 3749 | tetraspanin 12 |
| TSPAN13 | 27075 | NP_055214 | 3932 | tetraspanin 13 |
| TSPAN14 | 81619 | NP_001121781 | 1371 | tetraspanin 14 |
| TSPAN14 | 81619 | NP_112189 | 5195 | tetraspanin 14 |
| TSPAN15 | 23555 | NP_036471 | 3750 | tetraspanin 15 |
| TSPAN16 | 26526 | NP_036598 | 3783 | tetraspanin 16 |
| TSPAN17 | 26262 | NP_001006617.2 | 7423 | tetraspanin 17 |
| TSPAN18 | 90139 | NP_570139.3 | 730 | tetraspanin 18 |
| TSPAN18 | 90139 | NP_570139 | 5664 | tetraspanin 18 |
| TSPAN2 | 10100 | NP_005716 | 3353 | tetraspanin 2 |
| TSPAN3 | 10099 | NP_001161884 | 2232 | tetraspanin 3 |
| TSPAN3 | 10099 | NP_005715 | 3352 | tetraspanin 3 |
| TSPAN3 | 10099 | NP_944492 | 6841 | tetraspanin 3 |
| TSPAN31 | 6302 | NP_005972 | 3410 | tetraspanin 31 |
| TSPAN32 | 10077 | NP_620591 | 5828 | tetraspanin 32 |
| TSPAN33 | 340348 | NP_848657 | 6556 | tetraspanin 33 |
| TSPAN4 | 7106 | NP_001020405 | 702 | tetraspanin 4 |
| TSPAN4 | 7106 | NP_001020406 | 703 | tetraspanin 4 |
| TSPAN4 | 7106 | NP_001020407 | 704 | tetraspanin 4 |
| TSPAN4 | 7106 | NP_001020408 | 705 | tetraspanin 4 |
| TSPAN4 | 7106 | NP_001020409 | 706 | tetraspanin 4 |
| TSPAN4 | 7106 | NP_001020410 | 707 | tetraspanin 4 |
| TSPAN4 | 7106 | NP_003262 | 2811 | tetraspanin 4 |
| TSPAN5 | 10098 | NP_005714 | 3351 | tetraspanin 5 |
| TSPAN6 | 7105 | NP_003261 | 2810 | tetraspanin 6 |
| TSPAN7 | 7102 | NP_004606 | 3084 | tetraspanin 7 |
| TSPAN8 | 7103 | NP_004607 | 3085 | tetraspanin 8 |
| TSPAN9 | 10867 | NP_001161792 | 2216 | tetraspanin 9 |
| TSPAN9 | 10867 | NP_006666 | 3541 | tetraspanin 9 |
| TSPO | 706 | NP_000705 | 209 | translocator protein (18kDa) |

FIG. 2 (CONT.)

| Antigen | GeneID | Accession No. | SEQ ID NO: | RefSeq Gene Name |
|---|---|---|---|---|
| TSPO | 706 | NP_000705.2 | 3684 | translocator protein (18kDa) |
| TSPO2 | 222642 | NP_001010873 | 572 | benzodiazapine receptor (peripheral)-like 1 |
| TSPO2 | 222642 | NP_001153198 | 1956 | benzodiazapine receptor (peripheral)-like 1 |
| TTC13 | 79573 | NP_001116307 | 1287 | tetratricopeptide repeat domain 13 |
| TTC13 | 79573 | NP_078801 | 5041 | tetratricopeptide repeat domain 13 |
| TTYH1 | 57348 | NP_001005367 | 455 | tweetyHomolog 1 (Drosophila) |
| TTYH1 | 57348 | NP_065710 | 4692 | tweetyHomolog 1 (Drosophila) |
| TTYH2 | 94015 | NP_116035 | 5384 | tweetyHomolog 2 (Drosophila) |
| TTYH2 | 94015 | NP_443101 | 5522 | tweetyHomolog 2 (Drosophila) |
| TTYH3 | 80727 | NP_079526 | 5141 | tweetyHomolog 3 (Drosophila) |
| TUBA8 | 51807 | NP_061816 | 4533 | tubulin, alpha 8 |
| TUBD1 | 51174 | NP_057345 | 4196 | tubulin, delta 1 |
| TUSC3 | 7991 | NP_006756 | 3559 | tumor suppressor candidate 3 |
| TUSC3 | 7991 | NP_839952 | 6530 | tumor suppressor candidate 3 |
| TUSC5 | 286753 | NP_758955 | 6322 | tumor suppressor candidate 5 |
| TVP23A | 780776 | NP_001072980 | 986 | family with sequence similarity 18, member A |
| TVP23C | 201158 | NP_001128508 | 1513 | family with sequence similarity 18, member B2 family with sequence similarity 18, member B |
| TVP23C | 201158 | NP_057162 | 4163 | family with sequence similarity 18, member B2 family with sequence similarity 18, member B |
| TVP23C | 201158 | NP_660344 | 5957 | family with sequence similarity 18, member B2 family with sequence similarity 18, member B |
| TXNDC12 | 51060 | NP_056997.1 | 2987 | thioredoxin domain containing 12 (endoplasmic reticulum) |
| TXNDC12 | 51060 | NP_056997.1 | 4132 | thioredoxin domain containing 12 (endoplasmic reticulum) |
| TXNDC12 | 51060 | NP_056997.1 | 5979 | thioredoxin domain containing 12 (endoplasmic reticulum) |
| TXNDC12 | 51060 | NP_056997.1 | 5981 | thioredoxin domain containing 12 (endoplasmic reticulum) |
| TXNDC15 | 79770 | NP_078991 | 5069 | thioredoxin domain containing 15 |
| TXNDC16 | 57544 | NP_001153519 | 1974 | thioredoxin domain containing 16 |
| TXNDC16 | 57544 | NP_065835 | 4723 | thioredoxin domain containing 16 |
| TYR | 7299 | NP_000363 | 110 | tyrosinase-like (pseudogene) |
| TYRO3 | 7301 | NP_006284 | 3461 | TYRO3 protein tyrosine kinase |
| TYROBP | 7305 | NP_003323 | 2823 | TYRO protein tyrosine kinase binding protein |
| TYROBP | 7305 | NP_937758 | 6743 | TYRO protein tyrosine kinase binding protein |
| TYRP1 | 7306 | NP_000541 | 160 | tyrosinase-related protein 1 |
| TYW1 | 55253 | NP_060734 | 4410 | tRNA-yW synthesizing protein 1Homolog (S. cerevisiae) |
| UBA2 | 10054 | NP_005490 | 3296 | ubiquitin-like modifier activating enzyme 2 |
| UBA5 | 79876 | NP_079094 | 5087 | ubiquitin-like modifier activating enzyme 5 |
| UBA5 | 79876 | NP_938143 | 6768 | ubiquitin-like modifier activating enzyme 5 |
| UBAC2 | 337867 | NP_001137544 | 1769 | UBA domain containing 2 |
| UBAC2 | 337867 | NP_808882 | 6510 | UBA domain containing 2 |
| UBE2J1 | 51465 | NP_057105 | 4152 | ubiquitin-conjugating enzyme E2, J1 (UBC6Homolog, yeast) |
| UBE2J2 | 118424 | NP_477515 | 5581 | ubiquitin-conjugating enzyme E2, J2 (UBC6Homolog, yeast) |
| UBE2J2 | 118424 | NP_919296 | 6717 | ubiquitin-conjugating enzyme E2, J2 (UBC6Homolog, yeast) |
| UBE2J2 | 118424 | NP_919439 | 6730 | ubiquitin-conjugating enzyme E2, J2 (UBC6Homolog, yeast) |
| UBE2J2 | 118424 | NP_919440 | 6731 | ubiquitin-conjugating enzyme E2, J2 (UBC6Homolog, yeast) |
| UBIAD1 | 29914 | NP_037451 | 3802 | UbiA prenyltransferase domain containing 1 |
| UBXN8 | 7993 | NP_005662 | 3339 | UBX domain protein 8 |
| UCN2 | 90226 | NP_149976 | 5467 | urocortin 2 |
| UGGT1 | 56886 | NP_064505.1 | 709 | UDP-glucose ceramide glucosyltransferase-like 1 |
| UGGT1 | 56886 | NP_064505 | 4597 | UDP-glucose ceramide glucosyltransferase-like 1 |
| UGT1A8 | 54576 | NP_000454 | 136 | UDP glucuronosyltransferase 1 family, polypeptide A3 |
| UGT1A8 | 54576 | NP_001063 | 943 | UDP glucuronosyltransferase 1 family, polypeptide A3 |
| UGT1A8 | 54576 | NP_009051 | 3632 | UDP glucuronosyltransferase 1 family, polypeptide A3 |
| UGT1A8 | 54576 | NP_061948 | 4557 | UDP glucuronosyltransferase 1 family, polypeptide A3 |
| UGT1A8 | 54576 | NP_061949 | 4558 | UDP glucuronosyltransferase 1 family, polypeptide A3 |
| UGT1A8 | 54576 | NP_061950 | 4559 | UDP glucuronosyltransferase 1 family, polypeptide A3 |
| UGT1A8 | 54576 | NP_061951 | 4560 | UDP glucuronosyltransferase 1 family, polypeptide A1, A3, A4, A5, A6, A7, A8, A9, A10 |
| UGT1A8 | 54576 | NP_061966 | 4563 | UDP glucuronosyltransferase 1 family, polypeptide A3 |
| UGT1A8 | 54576 | NP_066307 | 4760 | UDP glucuronosyltransferase 1 family, polypeptide A3 |
| UGT1A8 | 54576 | NP_995584 | 6963 | UDP glucuronosyltransferase 1 family, polypeptide A3 |
| UGT2A3 | 79799 | NP_079019 | 5075 | UDP glucuronosyltransferase 2 family, polypeptide A3 |
| UGT2B15 | 7366 | NP_001067 | 944 | UDP glucuronosyltransferase 2 family, polypeptide B15 |
| UGT2B17 | 7367 | NP_001068 | 945 | UDP glucuronosyltransferase 2 family, polypeptide B17 |
| UGT2B4 | 7363 | NP_066962 | 4780 | UDP glucuronosyltransferase 2 family, polypeptide B4 |
| UGT3A1 | 133688 | NP_001165344 | 2290 | UDP glycosyltransferase 3 family, polypeptide A1 |
| UGT3A1 | 133688 | NP_689617 | 6054 | UDP glycosyltransferase 3 family, polypeptide A1 |
| UGT8 | 7368 | NP_001121646 | 1364 | UDP glycosyltransferase 8 |
| UGT8 | 7368 | NP_003351 | 2825 | UDP glycosyltransferase 8 |
| ULBP1 | 80329 | NP_001304018.1 | 7458 | UL16 binding protein 1 |
| ULBP2 | 80328 | NP_079493 | 5133 | UL16 binding protein 2 |
| ULBP3 | 79465 | NP_078794.1 | 7298 | UL16 binding protein 3 |
| UMOD | 7369 | NP_001008390 | 531 | uromodulin |
| UMOD | 7369 | NP_003352 | 2826 | uromodulin |
| UMODL1 | 89766 | NP_001004416.2 | 7371 | uromodulin like 1 |
| UNC50 | 25972 | NP_054763 | 3861 | unc-50Homolog (C. elegans) |
| UNC5A | 90249 | NP_588610 | 5690 | unc-5Homolog A (C. elegans) |
| UNC5B | 219699 | NP_734465 | 6261 | unc-5Homolog B (C. elegans) |
| UNC5C | 8633 | NP_003719 | 2876 | unc-5Homolog C (C. elegans) |
| UNC5CL | 222643 | NP_775832 | 6358 | unc-5Homolog C (C. elegans)-like |
| UNC5D | 137970 | NP_001309747.1 | 7461 | unc-5 netrin receptor D |

FIG. 2 (CONT.)

| Antigen | GeneID | Accession No. | SEQ ID NO: | RefSeq Gene Name |
|---|---|---|---|---|
| UNC93B1 | 81622 | NP_112192 | 5196 | unc-93Homolog B1 (C. elegans), unc-93Homolog B6 (C. elegans), unc-93Homolog B3 pseudogene (C. elegans), similar to unc-93Homolog B1 (C. elegans) |
| UPK1A | 11045 | NP_008931 | 3611 | uroplakin 1A |
| UPK1B | 7348 | NP_008883 | 3603 | uroplakin 1B |
| UPK2 | 7379 | NP_006751.1 | 7281 | uroplakin 2 |
| UPK3A | 7380 | NP_001161046 | 2181 | uroplakin 3A |
| UPK3A | 7380 | NP_008884 | 3604 | uroplakin 3A |
| UPK3B | 80761 | NP_085047 | 5148 | uroplakin 3B |
| UPK3B | 80761 | NP_872625 | 6675 | uroplakin 3B |
| UQCR11 | 10975 | NP_006821 | 3575 | ubiquinol-cytochrome c reductase, 6.4kDa subunit |
| USH2A | 7399 | NP_009054.5 | 7403 | usherin |
| USP19 | 10869 | NP_006668 | 3542 | ubiquitin specific peptidase 19 |
| USP27X | 389856 | NP_001138545 | 1808 | ubiquitin specific peptidase 27, X-linked |
| USP30 | 84749 | NP_116052 | 5385 | ubiquitin specific peptidase 30 |
| USP48 | 84196 | NP_001027902 | 747 | ubiquitin specific peptidase 48 |
| USP48 | 84196 | NP_115612 | 5311 | ubiquitin specific peptidase 48 |
| UST | 10090 | NP_005706 | 3350 | uronyl-2-sulfotransferase |
| UTS2B | 257313 | NP_937795 | 6749 | urotensin 2 domain containing |
| UTS2R | 2837 | NP_061822 | 4534 | urotensin 2 receptor |
| UTY | 7404 | NP_009056 | 3633 | ubiquitously transcribed tetratricopeptide repeat gene, Y-linked |
| UTY | 7404 | NP_872600 | 6671 | ubiquitously transcribed tetratricopeptide repeat gene, Y-linked |
| UTY | 7404 | NP_872601 | 6672 | ubiquitously transcribed tetratricopeptide repeat gene, Y-linked |
| UXS1 | 80146 | NP_079352 | 5117 | UDP-glucuronate decarboxylase 1 |
| VAMP1 | 6843 | NP_055046 | 3891 | vesicle-associated membrane protein 1 (synaptobrevin 1) |
| VAMP1 | 6843 | NP_058439 | 4273 | vesicle-associated membrane protein 1 (synaptobrevin 1) |
| VAMP1 | 6843 | NP_954740 | 6869 | vesicle-associated membrane protein 1 (synaptobrevin 1) |
| VAMP2 | 6844 | NP_055047 | 3892 | vesicle-associated membrane protein 2 (synaptobrevin 2) |
| VAMP3 | 9341 | NP_004772 | 3124 | vesicle-associated membrane protein 3 (cellubrevin) |
| VAMP4 | 8674 | NP_003753 | 2887 | vesicle-associated membrane protein 4 |
| VAMP5 | 10791 | NP_006625 | 3532 | vesicle-associated membrane protein 5 (myobrevin) |
| VAMP7 | 6845 | NP_001138621 | 1821 | vesicle-associated membrane protein 7 |
| VAMP7 | 6845 | NP_005629 | 3333 | vesicle-associated membrane protein 7 |
| VAMP8 | 8673 | NP_003752 | 2886 | vesicle-associated membrane protein 8 (endobrevin) |
| VANGL1 | 81839 | NP_620409 | 5808 | vang-like 1 (van gogh, Drosophila) |
| VANGL2 | 57216 | NP_065068 | 4631 | vang-like 2 (van gogh, Drosophila) |
| VAPA | 9218 | NP_003565 | 2850 | VAMP (vesicle-associated membrane protein)-associated protein A, 33kDa |
| VAPA | 9218 | NP_919415 | 6723 | VAMP (vesicle-associated membrane protein)-associated protein A, 33kDa |
| VAPB | 9217 | NP_004729 | 3114 | VAMP (vesicle-associated membrane protein)-associated protein B and C |
| VASN | 114990 | NP_612449 | 5753 | vasorin |
| VCAM1 | 7412 | NP_001069 | 946 | vascular cell adhesion molecule 1 |
| VCAM1 | 7412 | NP_542413 | 5620 | vascular cell adhesion molecule 1 |
| VEZT | 55591 | NP_060069 | 4311 | vezatin, adherens junctions transmembrane protein |
| VIMP | 55829 | NP_060915 | 4451 | selenoprotein S |
| VIMP | 55829 | NP_982298 | 6941 | selenoprotein S |
| VIP | 7432 | NP_003372 | 2827 | vasoactive intestinal peptide |
| VIP | 7432 | NP_919416 | 6724 | vasoactive intestinal peptide |
| VIPR1 | 7433 | NP_004615 | 3088 | vasoactive intestinal peptide receptor 1 |
| VIPR2 | 7434 | NP_003373 | 2828 | vasoactive intestinal peptide receptor 2 |
| VKORC1 | 79001 | NP_076869 | 4991 | vitamin K epoxide reductase complex, subunit 1 |
| VKORC1 | 79001 | NP_996560 | 6972 | vitamin K epoxide reductase complex, subunit 1 |
| VKORC1L1 | 154807 | NP_775788 | 6352 | vitamin K epoxide reductase complex, subunit 1-like 1 |
| VMA21 | 203547 | NP_001017980 | 659 | VMA21 vacuolarH+-ATPaseHomolog (S. cerevisiae) |
| VMP1 | 81671 | NP_001316323.1 | 7462 | vacuole membrane protein 1 |
| VN1R1 | 57191 | NP_065684.1 | 7289 | vomeronasal 1 receptor 1 |
| VN1R2 | 317701 | NP_776255 | 6398 | vomeronasal 1 receptor 2 |
| VNN2 | 8875 | NP_004656 | 3098 | vanin 2 |
| VNN2 | 8875 | NP_511043 | 5594 | vanin 2 |
| VNN3 | 55350 | NP_001278631.1 | 678 | vanin 3 |
| VNN3 | 55350 | NP_001278631.1 | 4438 | vanin 3 |
| VNN3 | 55350 | NP_001278631.1 | 5595 | vanin 3 |
| VRK1 | 7443 | NP_003375 | 2829 | vaccinia related kinase 1 |
| VRK2 | 7444 | NP_001123952 | 1426 | vaccinia related kinase 2 |
| VRK2 | 7444 | NP_001123953 | 1427 | vaccinia related kinase 2 |
| VRK2 | 7444 | NP_001123954 | 1428 | vaccinia related kinase 2 |
| VRK2 | 7444 | NP_001123955 | 1429 | vaccinia related kinase 2 |
| VRK2 | 7444 | NP_001123952.1 | 1591 | vaccinia related kinase 2 |
| VRK2 | 7444 | NP_006287 | 3462 | vaccinia related kinase 2 |
| VSIG1 | 340547 | NP_001164024 | 2244 | V-set and immunoglobulin domain containing 1 |
| VSIG1 | 340547 | NP_872413 | 6666 | V-set and immunoglobulin domain containing 1 |
| VSIG10 | 54621 | NP_061959 | 4562 | hypothetical protein FLJ20674 |
| VSIG10L | 147645 | NP_001157394 | 2059 | hypothetical protein LOC147645 |
| VSIG2 | 23584 | NP_055127 | 3911 | V-set and immunoglobulin domain containing 2 |
| VSIG4 | 11326 | NP_001093901 | 1188 | V-set and immunoglobulin domain containing 4 |
| VSIG4 | 11326 | NP_009199 | 3666 | V-set and immunoglobulin domain containing 4 |
| VSTM1 | 284415 | NP_940883 | 6800 | V-set and transmembrane domain containing 1 |
| VSTM2A | 222008 | NP_001304772.1 | 7459 | V-set and transmembrane domain containing 2A |
| VSTM4 | 196740 | NP_001026916 | 733 | chromosome 10 open reading frame 72 |

FIG. 2 (CONT.)

| Antigen | GeneID | Accession No. | SEQ ID NO: | RefSeq Gene Name |
|---|---|---|---|---|
| VSTM4 | 196740 | NP_659421 | 5912 | chromosome 10 open reading frame 72 |
| VTCN1 | 79679 | NP_078902 | 5057 | V-set domain containing T cell activation inhibitor 1 |
| VTI1A | 143187 | NP_660207 | 5935 | vesicle transport through interaction with t-SNAREsHomolog 1A (yeast) |
| VTI1B | 10490 | NP_006361 | 3476 | vesicle transport through interaction with t-SNAREsHomolog 1B (yeast) |
| VWA9 | 81556 | NP_001129515 | 1592 | chromosome 15 open reading frame 44 |
| VWA9 | 81556 | NP_001129515.1 | 5179 | chromosome 15 open reading frame 44 |
| WBP1L | 54838 | NP_001077382 | 1083 | chromosome 10 open reading frame 26 |
| WBP1L | 54838 | NP_060257 | 4342 | chromosome 10 open reading frame 26 |
| WBSCR17 | 64409 | NP_071924 | 4923 | Williams-Beuren syndrome chromosome region 17 |
| WBSCR28 | 135886 | NP_872310 | 6646 | Williams-Beuren syndrome chromosome region 28 |
| WDR19 | 57728 | NP_079408 | 5124 | WD repeat domain 19 |
| WDR33 | 55339 | NP_001006623 | 479 | WD repeat domain 33 |
| WDR33 | 55339 | NP_001006624 | 480 | WD repeat domain 33 |
| WDR33 | 55339 | NP_060853 | 4436 | WD repeat domain 33 |
| WDR83OS | 51398 | NP_057229 | 4177 | chromosome 19 open reading frame 56 |
| WFDC10A | 140832 | NP_542791 | 5628 | WAP four-disulfide core domain 10A |
| WFDC10B | 280664 | NP_742003 | 6268 | WAP four-disulfide core domain 10B |
| WFDC10B | 280664 | NP_742143 | 6282 | WAP four-disulfide core domain 10B |
| WFDC11 | 259239 | NP_671730 | 5997 | WAP four-disulfide core domain 11 |
| WFDC2 | 10406 | NP_006094 | 3436 | WAP four-disulfide core domain 2 |
| WFDC9 | 259240 | NP_671731 | 5998 | WAP four-disulfide core domain 9 |
| WFIKKN2 | 124857 | NP_783165 | 6444 | WAP, follistatin/kazal, immunoglobulin, kunitz and netrin domain containing 2 |
| WFS1 | 7466 | NP_001139325 | 1884 | Wolfram syndrome 1 (wolframin) |
| WFS1 | 7466 | NP_005996 | 3412 | Wolfram syndrome 1 (wolframin) |
| WLS | 79971 | NP_001002292 | 401 | G protein-coupled receptor 177 |
| WLS | 79971 | NP_079187 | 5101 | G protein-coupled receptor 177 |
| WNT1 | 7471 | NP_005421 | 3284 | wingless-type MMTV integration site family, member 1 |
| WNT11 | 7481 | NP_004617 | 3090 | wingless-type MMTV integration site family, member 11 |
| WNT16 | 51384 | NP_057171 | 4167 | wingless-type MMTV integration site family, member 16 |
| WNT16 | 51384 | NP_476509 | 5578 | wingless-type MMTV integration site family, member 16 |
| WNT3 | 7473 | NP_110380 | 5162 | wingless-type MMTV integration site family, member 3 |
| WNT4 | 54361 | NP_110388 | 5165 | wingless-type MMTV integration site family, member 4 |
| WNT5A | 7474 | NP_003383 | 2831 | wingless-type MMTV integration site family, member 5A |
| WNT6 | 7475 | NP_006513 | 3506 | wingless-type MMTV integration site family, member 6 |
| WNT7A | 7476 | NP_004616 | 3089 | wingless-type MMTV integration site family, member 7A |
| WNT7B | 7477 | NP_478679 | 5586 | wingless-type MMTV integration site family, member 7B |
| WNT9B | 7484 | NP_003387 | 2832 | wingless-type MMTV integration site family, member 9B |
| WRB | 7485 | NP_001139690 | 1914 | tryptophan rich basic protein |
| WRB | 7485 | NP_004618 | 3091 | tryptophan rich basic protein |
| WSCD1 | 23302 | NP_056068 | 4051 | WSC domain containing 1 |
| WSCD2 | 9671 | NP_055468 | 3968 | WSC domain containing 2 |
| WT1 | 7490 | NP_000369 | 111 | Wilms tumor 1 |
| WT1 | 7490 | NP_077742 | 5031 | Wilms tumor 1 |
| WT1 | 7490 | NP_077743 | 5032 | Wilms tumor 1 |
| WT1 | 7490 | NP_077744 | 5033 | Wilms tumor 1 |
| XCR1 | 2829 | NP_001019815 | 682 | chemokine (C motif) receptor 1 |
| XCR1 | 2829 | NP_005274 | 3251 | chemokine (C motif) receptor 1 |
| XG | 7499 | NP_001135391 | 1625 | Xg blood group |
| XG | 7499 | NP_001135392 | 1626 | Xg blood group |
| XG | 7499 | NP_780778 | 6443 | Xg blood group |
| XK | 7504 | NP_066569 | 4766 | X-linked Kx blood group (McLeod syndrome) |
| XKR4 | 114786 | NP_443130 | 5531 | XK, Kell blood group complex subunit-related family, member 4 |
| XKR6 | 286046 | NP_775954 | 6380 | XK, Kell blood group complex subunit-related family, member 6 |
| XKRX | 402415 | NP_997724 | 7036 | XK, Kell blood group complex subunit-related, X-linked |
| XPR1 | 9213 | NP_001129141 | 1546 | xenotropic and polytropic retrovirus receptor |
| XPR1 | 9213 | NP_004727 | 3112 | xenotropic and polytropic retrovirus receptor |
| XXYLT1 | 152002 | NP_689744 | 6077 | chromosome 3 open reading frame 21 |
| XYLT1 | 64131 | NP_071449 | 4891 | xylosyltransferase I |
| XYLT2 | 64132 | NP_071450 | 4892 | xylosyltransferase II |
| YIF1A | 10897 | NP_065203 | 4667 | Yip1 interacting factorHomolog A (S. cerevisiae) |
| YIF1B | 90522 | NP_001034760 | 807 | Yip1 interacting factorHomolog B (S. cerevisiae) |
| YIF1B | 90522 | NP_001034761 | 808 | Yip1 interacting factorHomolog B (S. cerevisiae) |
| YIF1B | 90522 | NP_001034762 | 809 | Yip1 interacting factorHomolog B (S. cerevisiae) |
| YIF1B | 90522 | NP_001138933 | 1862 | Yip1 interacting factorHomolog B (S. cerevisiae) |
| YIF1B | 90522 | NP_001138934 | 1863 | Yip1 interacting factorHomolog B (S. cerevisiae) |
| YIF1B | 90522 | NP_001138935 | 1864 | Yip1 interacting factorHomolog B (S. cerevisiae) |
| YIF1B | 90522 | NP_001034760.1 | 5508 | Yip1 interacting factorHomolog B (S. cerevisiae) |
| YIPF1 | 54432 | NP_061855 | 4546 | Yip1 domain family, member 1 |
| YIPF2 | 78992 | NP_076934 | 4997 | Yip1 domain family, member 2 |
| YIPF3 | 25844 | NP_056203 | 4074 | Yip1 domain family, member 3 |
| YIPF4 | 84272 | NP_115688 | 5323 | Yip1 domain family, member 4 |
| YIPF5 | 81555 | NP_001020118 | 691 | Yip1 domain family, member 5 |
| YIPF5 | 81555 | NP_110426 | 5178 | Yip1 domain family, member 5 |
| YIPF6 | 286451 | NP_776195 | 6393 | Yip1 domain family, member 6 |
| YME1L1 | 10730 | NP_055078 | 3900 | YME1-like 1 (S. cerevisiae) |
| YME1L1 | 10730 | NP_647473 | 5852 | YME1-like 1 (S. cerevisiae) |
| ZACN | 353174 | NP_851321 | 6578 | zinc activated ligand-gated ion channel |

FIG. 2 (CONT.)

| Antigen | GeneID | Accession No. | SEQ ID NO: | RefSeq Gene Name |
|---|---|---|---|---|
| ZAN | 7455 | NP_003377 | 2830 | zonadhesin |
| ZAN | 7455 | NP_775082 | 6327 | zonadhesin |
| ZDHHC1 | 29800 | NP_037436 | 3798 | zinc finger, DHHC-type containing 1 |
| ZDHHC11 | 79844 | NP_079062 | 5081 | zinc finger, DHHC-type containing 11 |
| ZDHHC12 | 84885 | NP_116188 | 5404 | zinc finger, DHHC-type containing 12 |
| ZDHHC13 | 54503 | NP_001001483 | 362 | zinc finger, DHHC-type containing 13 |
| ZDHHC13 | 54503 | NP_061901 | 4551 | zinc finger, DHHC-type containing 13 |
| ZDHHC14 | 79683 | NP_078906 | 5059 | zinc finger, DHHC-type containing 14 |
| ZDHHC14 | 79683 | NP_714968 | 6221 | zinc finger, DHHC-type containing 14 |
| ZDHHC15 | 158866 | NP_001139728 | 1915 | zinc finger, DHHC-type containing 15 |
| ZDHHC15 | 158866 | NP_001139729 | 1916 | zinc finger, DHHC-type containing 15 |
| ZDHHC15 | 158866 | NP_659406 | 5909 | zinc finger, DHHC-type containing 15 |
| ZDHHC17 | 23390 | NP_056151 | 4063 | zinc finger, DHHC-type containing 17 |
| ZDHHC18 | 84243 | NP_115659 | 5319 | zinc finger, DHHC-type containing 18 |
| ZDHHC19 | 131540 | NP_001034706 | 805 | zinc finger, DHHC-type containing 19 |
| ZDHHC2 | 51201 | NP_057437 | 4208 | zinc finger, DHHC-type containing 2 |
| ZDHHC20 | 253832 | NP_694983 | 6166 | zinc finger, DHHC-type containing 20 |
| ZDHHC21 | 340481 | NP_848661 | 6557 | zinc finger, DHHC-type containing 21 |
| ZDHHC22 | 283576 | NP_777636 | 6433 | zinc finger, DHHC-type containing 22 |
| ZDHHC23 | 254887 | NP_775841 | 6360 | zinc finger, DHHC-type containing 23 |
| ZDHHC24 | 254359 | NP_997223 | 7010 | zinc finger, DHHC-type containing 24 |
| ZDHHC3 | 51304 | NP_001128651 | 1534 | zinc finger, DHHC-type containing 3 |
| ZDHHC3 | 51304 | NP_001128651.1 | 1535 | zinc finger, DHHC-type containing 3 |
| ZDHHC3 | 51304 | NP_057682 | 4256 | zinc finger, DHHC-type containing 3 |
| ZDHHC4 | 55146 | NP_001127859 | 1479 | zinc finger, DHHC-type containing 4 |
| ZDHHC4 | 55146 | NP_001127860 | 1480 | zinc finger, DHHC-type containing 4 |
| ZDHHC4 | 55146 | NP_001127861 | 1481 | zinc finger, DHHC-type containing 4 |
| ZDHHC4 | 55146 | NP_060576 | 4393 | zinc finger, DHHC-type containing 4 |
| ZDHHC5 | 25921 | NP_056272 | 4086 | zinc finger, DHHC-type containing 5 |
| ZDHHC6 | 64429 | NP_071939 | 4927 | zinc finger, DHHC-type containing 6 |
| ZDHHC7 | 55625 | NP_001139020 | 1870 | zinc finger, DHHC-type containing 7 |
| ZDHHC7 | 55625 | NP_060210 | 4332 | zinc finger, DHHC-type containing 7 |
| ZDHHC8 | 29801 | NP_037505 | 3813 | zinc finger, DHHC-type containing 8 |
| ZDHHC9 | 51114 | NP_001008223 | 527 | zinc finger, DHHC-type containing 9 |
| ZDHHC9 | 51114 | NP_057116 | 4156 | zinc finger, DHHC-type containing 9 |
| ZFPL1 | 7542 | NP_006773 | 3562 | zinc finger protein-like 1 |
| ZFYVE27 | 118813 | NP_001002261 | 393 | zinc finger, FYVE domain containing 27 |
| ZFYVE27 | 118813 | NP_001002262 | 394 | zinc finger, FYVE domain containing 27 |
| ZFYVE27 | 118813 | NP_653189 | 5870 | zinc finger, FYVE domain containing 27 |
| ZG16B | 124220 | NP_660295 | 5941 | zymogen granule protein 16Homolog B (rat) |
| ZMPSTE24 | 10269 | NP_005848 | 3388 | zinc metallopeptidase (STE24Homolog, S. cerevisiae) |
| ZMYM6 | 9204 | NP_009098 | 3639 | hypothetical LOC100130633 zinc finger, MYM-type 6 |
| ZMYM6NB | 100506144 | NP_001182085 | 7112 | ZMYM6 neighbor |
| ZMYND11 | 10771 | NP_001189393.1 | 2014 | zinc finger, MYND domain containing 11 |
| ZMYND11 | 10771 | NP_006615 | 3530 | zinc finger, MYND domain containing 11 |
| ZMYND11 | 10771 | NP_997644 | 7033 | zinc finger, MYND domain containing 11 |
| ZNF138 | 7697 | NP_001153655 | 1978 | zinc finger protein 138 |
| ZNF138 | 7697 | NP_006515 | 3507 | zinc finger protein 138 |
| ZNF304 | 57343 | NP_065708 | 4691 | zinc finger protein 304 |
| ZNF546 | 339327 | NP_848639 | 6553 | zinc finger protein 546 |
| ZNF559 | 84527 | NP_115886 | 5361 | zinc finger protein 559 |
| ZNF7 | 7553 | NP_003407 | 2833 | zinc finger protein 7 |
| ZNF816 | 125893 | NP_001026835 | 720 | zinc finger protein 816A |
| ZNRF3 | 84133 | NP_115549 | 5304 | zinc and ring finger 3 |
| ZNRF4 | 148066 | NP_859061 | 6623 | zinc and ring finger 4 |
| ZP1 | 22917 | NP_997224 | 7011 | zona pellucida glycoprotein 1 (sperm receptor) |
| ZP2 | 7783 | NP_001277033.1 | 7443 | zona pellucida glycoprotein 2 |
| ZP4 | 57829 | NP_067009.1 | 7291 | zona pellucida glycoprotein 4 |
| ZPBP | 11055 | NP_001153350 | 1962 | zona pellucida binding protein |
| ZPBP | 11055 | NP_008940 | 3614 | zona pellucida binding protein |
| ZPLD1 | 131368 | NP_778226 | 6438 | zona pellucida-like domain containing 1 |

FIG. 4

| Antigen | Gene Symbol | Entrez GeneID | Exemplary Cancers | Accession No. | SEQ ID NOs: |
|---|---|---|---|---|---|
| ALK | ALK | 238 | Hallmark, large cell lymphomas, neuroblastoma, and non small cell lung cancer | NP_004295 | 7119 |
| Axl | AXL | 558 | Lung cancer | NP_068713, NP_001690 | 7120, 7121 |
| B7H3 | CD276 | 80381 | Sarcoma, glioma | NP_079516, NP_001019907 | 7122, 7123 |
| B7H6 | NCR3LG1 | 374383 | leukemia, lymphoma and gastrointestinal stromal tumors | NP_001189368 | 7124 |
| BCMA | TNFRSF17 | 608 | multiple myeloma | NP_001183 | 7125 |
| CAIX | CA9 | 768 | Kidney | NP_001207 | 7126 |
| CD123 | IL3RA | 3563 | Myeloid | NP_002174 | 7127 |
| CD138 | SDC1 | 6382 | multiple myeloma | NP_002988, NP_001006947 | 7128, 7129 |
| CD160 | CD160 | 11126 | Leukemia | NP_008984 | 7130 |
| CD171 | L1CAM | 3897 | Neuroblastoma | NP_076493, NP_000416, NP_001137435 | 7131, 7132, 7133 |
| CD19 | CD19 | 930 | B-cell | NP_001761 | 7134 |
| CD20 | MS4A1 | 931 | B-cell | NP_690605, NP_068769 | 7135, 7136 |
| CD22 | CD22 | 933 | B-cell | NP_001762 | 7137 |
| CD30 | TNFRSF8 | 943 | B-cell | NP_694421, NP_001234 | 7138, 7139 |
| CD33 | CD33 | 945 | Myeloid | NP_001076087, NP_001763 | 7140, 7141 |
| CD38 | CD38 | 952 | multiple myeloma | NP_001766 | 7142 |
| CD44 v6/v7 | CD44 | 960 | Cervical | NP_001001389, NP_001001392, NP_001001391, NP_001001390, NP_000601 | 7143, 7144, 7145, 7146, 7147 |
| CD70 | CD70 | 970 | B-cell/T-cell | NP_001243 | 7148 |
| CS1 | SLAMF7 | 57823 | multiple myeloma | NP_067004 | 7149 |
| EGP2 (EGP40) | EPCAM | 4072 | Colon, Carcinomas, breast, lung | NP_002345 | 7150 |
| EphA2 | EPHA2 | 1969 | Glioma, lung | NP_004422 | 7151 |
| EphA3 | EPHA3 | 2042 | Lung, kidney, melanoma, glioma, hematological malignancies | NP_872585, NP_005224 | 7152, 7153 |
| ErbB3 | ERBB3 | 2065 | Breast, ovarian | NP_001005915, NP_001973 | 7154, 7155 |
| ErbB4 | ERBB4 | 2066 | Breast, ovarian | NP_001036064, NP_005226 | 7156, 7157 |
| FAP | FAP | 2191 | Cancer associated fibroblasts | NP_004451 | 7158 |
| Folate receptor alpha | FOLR1 | 2348 | Ovarian | NP_057937, NP_057941, NP_057943, NP_057942, NP_000793, NP_057936 | 7159, 7160, 7161, 7162, 7163, 7164 |
| Folate receptor beta | FOLR2 | 2350 | Acute Myeloid Leukemia | NP_000794, NP_001107007, NP_001107006, NP_001107008 | 7165, 7166, 7167, 7168 |
| GD2 | B4GALNT1 | 2583 | Neuroblastoma, sarcoma, melanoma | NP_001469 | 7169 |
| GD3 | ST8SIA1 | 6489 | Melanoma, lung cancer | NP_003025 | 7170 |
| gpA33 | GPA33 | 10223 | Colorectal carcinoma | NP_005805 | 7171 |
| GPC3 | GPC3 | 2719 | Hepatocellular Carcinoma | NP_004475, NP_001158089, NP_001158090, NP_001158091 | 7172, 7173, 7174, 7175 |
| Her2 (NEU) | ERBB2 | 2064 | Breast, lung, prostate, glioma | NP_001005862, NP_004439, NP_001005915, NP_001973, NP_001036064, NP_005226 | 7176, 7177, 7178, 7179, 7180, 7181 |

FIG. 4 (CONT.)

| Antigen | Gene Symbol | Entrez GeneID | Exemplary Cancers | Accession No. | SEQ ID NOs: |
|---|---|---|---|---|---|
| HLA-A2/NY-ESO-1 | CTAG1B | 1485 | Sarcoma, melanoma | NP_640343, NP_001318 | 7182, 7183 |
| HMW-MAA | CSPG4 | 1464 | Melanoma | NP_001888 | 7184 |
| IGF1R | IGF1R | 3480 | Lung, breast, head and neck, prostate, thyroid, glioma | NP_000866 | 7185 |
| IL11Ra | IL11RA | 3590 | Osteosarcoma | NP_671518, NP_004503, NP_001136256 | 7186, 7187, 7188 |
| IL13Ra2 | IL13RA2 | 3598 | Glioma | NP_000631 | 7189 |
| Kappa | IGK | 50802 | B-cell, multiple myeloma | NG_000834, NG_000833 | 7190, 7191 |
| MAGE-A1 | MAGEA1 | 4100 | Melanoma | NP_004979 | 7192 |
| MART-1 | MLANA | 2315 | Melanoma | NP_005502 | 7193 |
| Mesothelin | MSLN | 10232 | Mesothelioma, breast, pancreas | NP_005814, NP_037536 | 7194, 7195 |
| Met | MET | 4233 | Lung cancer | NP_001120972, NP_000236 | 7196, 7197 |
| MUC13 | MUC13 | 56667 | Adenocarcinoma | NP_149038 | 7198 |
| MUC17 | MUC17 | 140453 | Adenocarcinoma | NP_001035194 | 7199 |
| Mucin-1 | MUC1 | 4582 | Ovarian, breast, prostate | NP_002447, NP_001018017, NP_001018016, NP_001037857, NP_001037858, NP_001037855, NP_001037856 | 7200, 7201, 7202, 7203, 7204, 7205, 7206 |
| Mucin-16 | MUC16 | 94025 | Adenocarcinoma | NP_078966, XP_002345182 | 7207, 7208 |
| NCAM | NCAM1 | 4684 | Neuroblastoma, colorectal | NP_000606, NP_851996, NP_001070150 | 7209, 7210, 7211 |
| PSCA | PSCA | 8000 | Prostate, pancreatic | NP_005663 | 7212 |
| PSMA | FOLH1 | 2346 | Prostate | NP_004467, NP_001014986 | 7213, 7214 |
| RANKL | TNFSF11 | 8600 | Prostate cancer and bone metastases | NP_003692, NP_143026 | 7215, 7216 |
| ROR1 | ROR1 | 4919 | B-cell | NP_001077061, NP_005003 | 7217, 7218 |
| TRAIL-R1 | TNFRSF10A | 8797 | Solid tumors (colon, lung, pancreas) and hematological malignancies | NP_003835 | 7219 |
| TRAIL-R2 | TNFRSF10B | 8795 | Solid tumors (colon, lung, pancreas) and hematological malignancies | NP_671716, NP_003833 | 7220, 7221 |
| VEGFR-2 | KDR | 3791 | Tumor vasculature | NP_002244 | 7222 |
| WT1 | WT1 | 7490 | Leukemia, solid tumors (e.g., lung cancer) | NP_077743, NP_077742, NP_000369, NP_077744 | 7223, 7224, 7225, 7226 |
| α5β1 | ITGB1 | 3688 | Tumor vasculature | NP_391989, NP_391988, NP_391987, NP_389647, NP_002202, NP_596867 | 7227, 7228, 7229, 7230, 7231, 7232 |
| α5β3 | ITGB3 | 3690 | Tumor vasculature | NP_000203 | 7233 |
| NKG2D ligands | KLRK1 | 22914 | Myeloid, Ovarian, Sarcoma | NP_031386 | 7234 |
| Lewis Y (CD174) | FUT3 | 2525 | Breast/ovarian/pancreatic, multiple myeloma | NP_001091109, NP_001091108, NP_000140, NP_001091110 | 7235, 7236, 7237, 7238, |
| CEA | CEACAM5 | 1048 | Epithelial tumors (breast, colon, lung) | NP_004354 | 7239 |

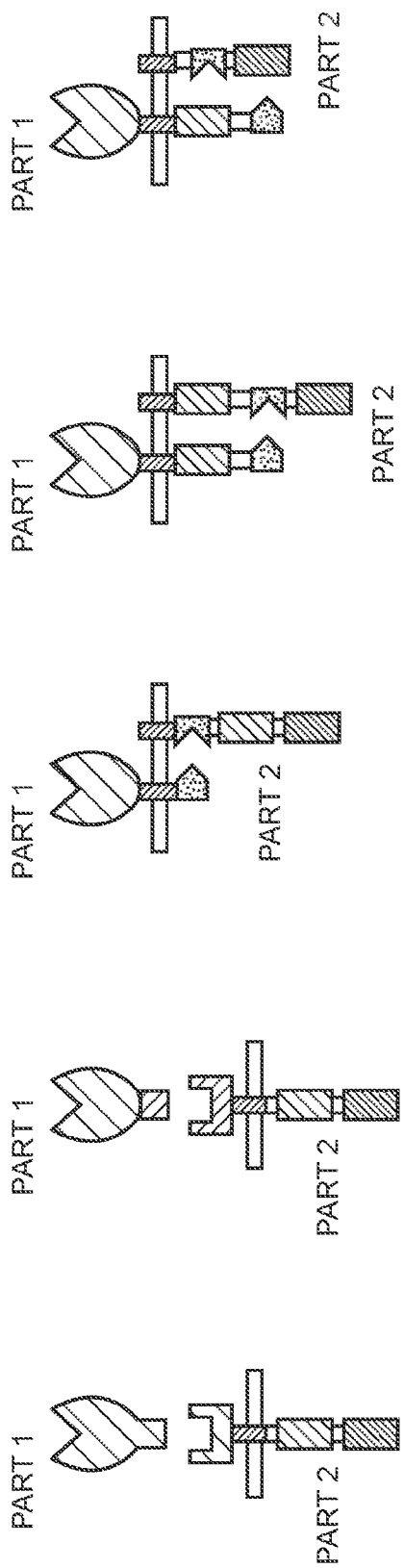

FIG. 9

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ADAM12 AND EPCAM | Breast | 0.868687 | 0.955556 | 0.796296 | FOLH1 AND FAM57A | Prostate | 0.857143 | 1 | 0.75 |
| NOX4 AND EPCAM | Breast | 0.757282 | 0.795918 | 0.722222 | FOLH1 AND CDH3 | Prostate | 0.8 | 0.666667 | 1 |
| SLC5A6 AND EPCAM | Breast | 0.75 | 0.970588 | 0.611111 | FOLH1 AND DHRS3 | Prostate | 1 | 1 | 1 |
| EPCAM AND CALHM2 | Breast | 0.821053 | 0.95122 | 0.722222 | FOLH1 AND CD69 | Prostate | 0.888889 | 0.8 | 1 |
| PLXND1 AND EPCAM | Breast | 0.786517 | 1 | 0.648148 | FOLH1 AND CTNS | Prostate | 0.75 | 0.75 | 0.75 |
| TGFB3 AND EPCAM | Breast | 0.741573 | 0.942857 | 0.611111 | FOLH1 AND STYK1 | Prostate | 0.888889 | 0.8 | 1 |
| PMEPA1 AND EPCAM | Breast | 0.733333 | 0.916667 | 0.611111 | DDR2 AND B4GALNT1 | Sarcoma | 0.648649 | 0.6 | 0.705882 |
| SEMA4C AND EPCAM | Breast | 0.791209 | 0.972973 | 0.666667 | CDH11 AND EPCAM | Breast | 0.712644 | 0.939394 | 0.574074 |
| ADAM12 AND ERBB2 | Breast | 0.714286 | 1 | 0.555556 | PPAPDC1A AND EPCAM | Breast | 0.711111 | 0.888889 | 0.592593 |
| EPCAM AND APLNR | Breast | 0.772277 | 0.829787 | 0.722222 | EPCAM AND BST2 | Breast | 0.817204 | 0.974359 | 0.703704 |
| PRLR AND EPCAM | Breast | 0.707071 | 0.777778 | 0.648148 | ENPP1 AND EPCAM | Breast | 0.672566 | 0.644068 | 0.703704 |
| EPCAM AND NTM | Breast | 0.705882 | 0.75 | 0.666667 | EPCAM AND LAMP5 | Breast | 0.666667 | 0.794872 | 0.574074 |
| UNC5B AND EPCAM | Breast | 0.719101 | 0.914286 | 0.592593 | EPCAM AND SLC38A1 | Breast | 0.647619 | 0.666667 | 0.62963 |
| EPCAM AND CELSR2 | Breast | 0.699029 | 0.734694 | 0.666667 | EPCAM AND IL17RA | Breast | 0.666667 | 0.733333 | 0.611111 |
| SLC4A2 AND EPCAM | Breast | 0.698795 | 1 | 0.537037 | EPCAM AND LRRC8E | Breast | 0.712871 | 0.765957 | 0.666667 |
| MFSD10 AND EPCAM | Breast | 0.727273 | 0.941176 | 0.592593 | EPCAM AND TGFBI | Breast | 0.672 | 0.591549 | 0.777778 |
| FZD2 AND EPCAM | Breast | 0.681818 | 0.882353 | 0.555556 | EPCAM AND SEMA4D | Breast | 0.638655 | 0.584615 | 0.703704 |
| EPCAM AND TNFSF4 | Breast | 0.828283 | 0.911111 | 0.759259 | EPCAM AND DYSF | Breast | 0.618557 | 0.697674 | 0.555556 |
| F2RL2 AND EPCAM | Breast | 0.682927 | 1 | 0.518519 | EPCAM AND LAPTM5 | Breast | 0.696629 | 0.885714 | 0.574074 |
| EPCAM AND SLC1A3 | Breast | 0.792453 | 0.807692 | 0.777778 | EPCAM AND TTYH2 | Breast | 0.605042 | 0.553846 | 0.666667 |
| EPCAM AND LRRC32 | Breast | 0.72549 | 0.770833 | 0.685185 | PPAPDC1A AND ERBB2 | Breast | 0.60241 | 0.862069 | 0.462963 |
| EPCAM AND FGFR1 | Breast | 0.666667 | 0.708333 | 0.62963 | EPCAM AND TNFRSF12A | Breast | 0.639175 | 0.72093 | 0.574074 |
| EPCAM AND FZD7 | Breast | 0.666667 | 0.794872 | 0.574074 | EPCAM AND GPR137B | Breast | 0.688172 | 0.820513 | 0.592593 |
| EPCAM AND CD84 | Breast | 0.674699 | 0.965517 | 0.518519 | EPCAM AND VANGL1 | Breast | 0.632479 | 0.587302 | 0.685185 |
| EPCAM AND SLC39A10 | Breast | 0.754717 | 0.769231 | 0.740741 | EPCAM AND LAT | Breast | 0.672414 | 0.629032 | 0.722222 |
| CXCL9 AND EPCAM | Breast | 0.817204 | 0.974359 | 0.703704 | EPCAM AND SLC6A6 | Breast | 0.643478 | 0.606557 | 0.685185 |
| EPCAM AND GJA1 | Breast | 0.75 | 0.724138 | 0.777778 | EPCAM AND FLVCR1 | Breast | 0.650407 | 0.57971 | 0.740741 |
| EPCAM AND S1PR3 | Breast | 0.660377 | 0.673077 | 0.648148 | EPCAM AND IFI6 | Breast | 0.638655 | 0.584615 | 0.703704 |
| EPCAM AND SLC3A2 | Breast | 0.747664 | 0.754717 | 0.740741 | EPCAM AND CD163 | Breast | 0.792453 | 0.807692 | 0.777778 |
| SLC52A2 AND EPCAM | Breast | 0.659794 | 0.744186 | 0.592593 | SLC2A2 AND MSLN | Liver | 0.857143 | 0.75 | 1 |
| EPCAM AND SLC10A3 | Breast | 0.6875 | 0.785714 | 0.611111 | SLC2A2 AND TNFRSF10A | Liver | 0.727273 | 0.8 | 0.666667 |
| EPCAM AND TPCN2 | Breast | 0.707965 | 0.677966 | 0.740741 | SLCO1B1 AND MSLN | Liver | 0.75 | 0.6 | 1 |
| EPCAM AND PCDHB10 | Breast | 0.652632 | 0.756098 | 0.574074 | SLC17A2 AND MSLN | Liver | 0.666667 | 0.555556 | 0.833333 |
| EPCAM AND APOLD1 | Breast | 0.65625 | 0.567568 | 0.777778 | ABCG8 AND MSLN | Liver | 0.8 | 1 | 0.666667 |
| EPCAM AND SLC9A7 | Breast | 0.651163 | 0.56 | 0.777778 | SLC13A5 AND MSLN | Liver | 0.666667 | 0.5 | 1 |
| EPCAM AND JAG2 | Breast | 0.752475 | 0.808511 | 0.703704 | SLCO1B1 AND TNFRSF10A | Liver | 0.615385 | 0.571429 | 0.666667 |
| EPCAM AND CXCR4 | Breast | 0.649123 | 0.616667 | 0.685185 | SLC17A2 AND TNFRSF10A | Liver | 0.615385 | 0.571429 | 0.666667 |
| EPCAM AND ITGAM | Breast | 0.848485 | 0.933333 | 0.777778 | ABCG8 AND TNFRSF10A | Liver | 0.666667 | 1 | 0.5 |
| EPCAM AND LPAR2 | Breast | 0.673684 | 0.780488 | 0.592593 | SLC10A1 AND MSLN | Liver | 0.666667 | 0.555556 | 0.833333 |
| EPCAM AND ESYT1 | Breast | 0.658537 | 0.964286 | 0.5 | SLC43A1 AND TNFRSF10A | Liver | 0.8 | 1 | 0.666667 |
| EPCAM AND STX6 | Breast | 0.772277 | 0.829787 | 0.722222 | ABCG5 AND MSLN | Liver | 0.75 | 0.6 | 1 |
| EPCAM AND TSPAN5 | Breast | 0.719298 | 0.683333 | 0.759259 | SLC30A8 AND CD19 | Pancreas | 0.705882 | 1 | 0.545455 |
| EPCAM AND PMP22 | Breast | 0.780952 | 0.803922 | 0.759259 | PPAPDC1A AND MUC1 | Pancreas | 0.666667 | 0.857143 | 0.545455 |
| EPCAM AND CD81 | Breast | 0.727273 | 0.714286 | 0.740741 | KCND2 AND MUC1 | Pancreas | 0.736842 | 0.875 | 0.636364 |
| EPCAM AND ITSN1 | Breast | 0.719298 | 0.683333 | 0.759259 | PPAPDC1A AND ERBB2 | Pancreas | 0.666667 | 0.857143 | 0.545455 |
| EPCAM AND GJA5 | Breast | 0.711864 | 0.65625 | 0.777778 | PPAPDC1A AND MSLN | Pancreas | 0.705882 | 1 | 0.545455 |
| BAMBI AND EPCAM | Breast | 0.641975 | 0.962963 | 0.481481 | CLDN10 AND MSLN | Pancreas | 0.631579 | 0.75 | 0.545455 |
| EPCAM AND TMEM119 | Breast | 0.651163 | 0.56 | 0.777778 | TNFRSF10B AND MUC1 | Pancreas | 0.631579 | 0.75 | 0.545455 |
| EPCAM AND PCDHB16 | Breast | 0.650794 | 0.569444 | 0.759259 | MUC1 AND SYT11 | Pancreas | 0.615385 | 0.533333 | 0.727273 |
| EPCAM AND PTPRS | Breast | 0.666667 | 0.761905 | 0.592593 | CD163 AND MUC1 | Pancreas | 0.666667 | 0.857143 | 0.545455 |
| EPCAM AND ADAM8 | Breast | 0.638298 | 0.75 | 0.555556 | MSLN AND TGFBI | Pancreas | 0.6 | 0.666667 | 0.545455 |
| EPCAM AND SLC16A6 | Breast | 0.772277 | 0.829787 | 0.722222 | IFI6 AND MUC1 | Colon | 1 | 1 | 1 |
| FGG AND MSLN | Liver | 0.8 | 0.666667 | 1 | IFI6 AND ERBB2 | Colon | 0.909091 | 0.833333 | 1 |
| HPN AND TNFRSF10A | Liver | 0.666667 | 0.666667 | 0.666667 | SYT11 AND ERBB2 | Glioma | 0.964539 | 0.944444 | 0.985507 |
| ASGR1 AND MSLN | Liver | 0.75 | 0.6 | 1 | SYT11 AND MUC1 | Glioma | 0.94964 | 0.942857 | 0.956522 |
| FGG AND TNFRSF10A | Liver | 0.666667 | 0.666667 | 0.666667 | SYT11 AND EPHA2 | Glioma | 0.957143 | 0.943662 | 0.971014 |
| GJB1 AND MSLN | Liver | 0.8 | 1 | 0.666667 | GPR19 AND ERBB2 | Glioma | 0.816327 | 0.769231 | 0.869565 |
| ABCC6 AND MSLN | Liver | 0.75 | 0.6 | 1 | LYPD1 AND MUC1 | Glioma | 0.876923 | 0.934426 | 0.826087 |
| SLC27A5 AND MSLN | Liver | 0.75 | 0.6 | 1 | GPR19 AND EPHA2 | Glioma | 0.802817 | 0.780822 | 0.826087 |
| F10 AND TNFRSF10A | Liver | 0.8 | 1 | 0.666667 | GPR19 AND MUC1 | Glioma | 0.805556 | 0.773333 | 0.84058 |
| ABCB4 AND MSLN | Liver | 1 | 1 | 1 | CSMD2 AND ERBB2 | Glioma | 0.691176 | 0.701493 | 0.681159 |
| ABCB4 AND TNFRSF10A | Liver | 0.8 | 1 | 0.666667 | BEST3 AND MUC1 | Glioma | 0.682171 | 0.733333 | 0.637681 |
| SLC27A5 AND TNFRSF10A | Liver | 0.615385 | 0.571429 | 0.666667 | CSMD2 AND EPHA2 | Glioma | 0.666667 | 0.681818 | 0.652174 |
| ABCB11 AND MSLN | Liver | 0.727273 | 0.8 | 0.666667 | SLCO1C1 AND ERBB2 | Glioma | 0.653333 | 0.604938 | 0.710145 |
| ABCC2 AND MSLN | Liver | 1 | 1 | 1 | DSCAM AND ERBB2 | Glioma | 0.640777 | 0.970588 | 0.478261 |
| ABCC2 AND TNFRSF10A | Liver | 0.8 | 1 | 0.666667 | ASTN1 AND ERBB2 | Glioma | 0.629834 | 0.508929 | 0.826087 |
| F10 AND MSLN | Liver | 1 | 1 | 1 | SLCO1C1 AND MUC1 | Glioma | 0.613333 | 0.567901 | 0.666667 |
| APOB AND MSLN | Liver | 0.833333 | 0.833333 | 0.833333 | CDH10 AND ERBB2 | Glioma | 0.604396 | 0.486726 | 0.797101 |
| KLB AND MSLN | Liver | 0.666667 | 0.666667 | 0.666667 | FXYD6 AND ERBB2 | Glioma | 0.601156 | 0.5 | 0.753623 |
| APOB AND TNFRSF10A | Liver | 0.6 | 0.75 | 0.5 | CD163 AND ERBB2 | Glioma | 0.666667 | 0.759259 | 0.594203 |
| KLB AND TNFRSF10A | Liver | 0.6 | 0.75 | 0.5 | SLC22A16 AND CD33 | AML | 0.89505 | 0.889764 | 0.900398 |
| SLC4A2 AND MSLN | Liver | 0.666667 | 1 | 0.5 | CD33 AND ADAM29 | AML | 0.819085 | 0.81746 | 0.820717 |
| ABCC6 AND MUC1 | Liver | 0.666667 | 0.555556 | 0.833333 | CD33 AND SLC22A14 | AML | 0.834846 | 0.766667 | 0.916335 |
| GJB1 AND MUC1 | Liver | 0.666667 | 1 | 0.5 | CD33 AND SLC43A1 | AML | 0.8 | 0.945652 | 0.693227 |
| TM4SF5 AND MSLN | Liver | 0.8 | 1 | 0.666667 | CD33 AND GJD2 | AML | 0.791252 | 0.789683 | 0.792829 |
| TM4SF5 AND TNFRSF10A | Liver | 0.6 | 0.75 | 0.5 | CD33 AND SLCO1B3 | AML | 0.812834 | 0.735484 | 0.908367 |
| F10 AND MUC1 | Liver | 0.909091 | 1 | 0.833333 | CD33 AND P2RX4 | AML | 0.775862 | 0.683891 | 0.896414 |

FIG. 9 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SDC2 AND MSLN | Liver | 0.6 | 0.75 | 0.5 | CD33 AND KCND2 | AML | 0.720764 | 0.89881 | 0.601594 |
| SLC12A7 AND MSLN | Liver | 0.833333 | 0.833333 | 0.833333 | CD33 AND OTOF | AML | 0.715294 | 0.873563 | 0.605578 |
| KLB AND MUC1 | Liver | 0.666667 | 0.666667 | 0.666667 | CD33 AND SLC39A8 | AML | 0.710145 | 0.90184 | 0.585657 |
| EVA1A AND TNFRSF10A | Liver | 0.666667 | 1 | 0.5 | CD33 AND CSPG5 | AML | 0.709251 | 0.793103 | 0.641434 |
| NOX4 AND MSLN | Pancreas | 0.705882 | 1 | 0.545455 | MLC1 AND CD33 | AML | 0.700405 | 0.711934 | 0.689243 |
| TNFSF4 AND MUC1 | Pancreas | 0.777778 | 1 | 0.636364 | CD33 AND SLC5A10 | AML | 0.693446 | 0.738739 | 0.653386 |
| MMP14 AND MUC1 | Pancreas | 0.705882 | 1 | 0.545455 | CD33 AND STAB1 | AML | 0.67803 | 0.646209 | 0.713147 |
| VSIG1 AND MSLN | Pancreas | 0.625 | 1 | 0.454545 | CD33 AND KCNJ9 | AML | 0.664962 | 0.928571 | 0.517928 |
| TNFSF4 AND MSLN | Pancreas | 0.631579 | 0.75 | 0.545455 | SLC22A16 AND IL3RA | AML | 0.610966 | 0.886364 | 0.466135 |
| ADAM12 AND MUC1 | Pancreas | 0.705882 | 1 | 0.545455 | CD33 AND SLC2A1 | AML | 0.608696 | 0.85 | 0.474104 |
| TNFSF13B AND MUC1 | Pancreas | 0.625 | 1 | 0.454545 | CD33 AND SPAM1 | AML | 0.604396 | 0.973451 | 0.438247 |
| MMP14 AND CD19 | Pancreas | 0.7 | 0.777778 | 0.636364 | MS4A1 AND KCNJ10 | B-Cell Diffuse | 0.69697 | 0.793103 | 0.621622 |
| OSMR AND MUC1 | Pancreas | 0.777778 | 1 | 0.636364 | MS4A1 AND CDH11 | B-Cell Diffuse | 0.686567 | 0.766667 | 0.621622 |
| RNF144A AND MSLN | Pancreas | 0.631579 | 0.75 | 0.545455 | CD19 AND KCNJ10 | B-Cell Diffuse | 0.656716 | 0.733333 | 0.594595 |
| ABCC8 AND MUC1 | Pancreas | 0.705882 | 1 | 0.545455 | MS4A1 AND EFNB2 | B-Cell Diffuse | 0.656716 | 0.733333 | 0.594595 |
| ABCC8 AND ERBB2 | Pancreas | 0.705882 | 1 | 0.545455 | MS4A1 AND FAT1 | B-Cell Diffuse | 0.647059 | 0.709677 | 0.594595 |
| MUC1 AND CD84 | Pancreas | 0.625 | 1 | 0.454545 | MS4A1 AND PLVAP | B-Cell Diffuse | 0.65625 | 0.777778 | 0.567568 |
| TNFSF4 AND ERBB2 | Pancreas | 0.636364 | 0.636364 | 0.636364 | CD19 AND CSPG5 | B-Cell Diffuse | 0.628571 | 0.666667 | 0.594595 |
| SLC4A7 AND MUC1 | Pancreas | 0.705882 | 1 | 0.545455 | CD19 AND CDH11 | B-Cell Diffuse | 0.628571 | 0.666667 | 0.594595 |
| IFITM2 AND MSLN | Pancreas | 0.631579 | 0.75 | 0.545455 | MS4A1 AND AOC3 | B-Cell Diffuse | 0.626866 | 0.7 | 0.567568 |
| MMP14 AND MSLN | Pancreas | 0.705882 | 1 | 0.545455 | MS4A1 AND PROCR | B-Cell Diffuse | 0.606061 | 0.689655 | 0.540541 |
| TREM2 AND MUC1 | Pancreas | 0.625 | 1 | 0.454545 | CD19 AND ADCY10 | Mantle-Cell Lymphoma | 0.914286 | 1 | 0.842105 |
| ABCC8 AND CD19 | Pancreas | 0.705882 | 1 | 0.545455 | CD19 AND JPH3 | Mantle-Cell Lymphoma | 0.914286 | 1 | 0.842105 |
| NALCN AND MUC1 | Pancreas | 0.631579 | 0.75 | 0.545455 | CD19 AND SLC22A18 | Mantle-Cell Lymphoma | 0.914286 | 1 | 0.842105 |
| ABCC8 AND MSLN | Pancreas | 0.705882 | 1 | 0.545455 | CD19 AND SCN8A | Mantle-Cell Lymphoma | 0.914286 | 1 | 0.842105 |
| FLRT2 AND ERBB2 | Pancreas | 0.631579 | 0.75 | 0.545455 | CD19 AND HCN2 | Mantle-Cell Lymphoma | 0.914286 | 1 | 0.842105 |
| PTPN2 AND MUC1 | Pancreas | 0.8 | 0.888889 | 0.727273 | CD19 AND PCDHAC2 | Mantle-Cell Lymphoma | 0.914286 | 1 | 0.842105 |
| SLC2A3 AND MUC1 | Pancreas | 0.631579 | 0.75 | 0.545455 | CD19 AND KCNA1 | Mantle-Cell Lymphoma | 0.914286 | 1 | 0.842105 |
| SLC12A2 AND MUC1 | Colon | 0.75 | 1 | 0.6 | CD19 AND SLC22A16 | Mantle-Cell Lymphoma | 0.914286 | 1 | 0.842105 |
| GDE1 AND MSLN | Colon | 0.75 | 1 | 0.6 | CD19 AND MC2R | Mantle-Cell Lymphoma | 0.914286 | 1 | 0.842105 |
| SPINT1 AND MSLN | Colon | 0.75 | 1 | 0.6 | CD19 AND LCT | Mantle-Cell Lymphoma | 0.914286 | 1 | 0.842105 |
| PMEPA1 AND MSLN | Colon | 0.6 | 0.6 | 0.6 | CD19 AND CLDN17 | Mantle-Cell Lymphoma | 0.914286 | 1 | 0.842105 |
| PMEPA1 AND MUC1 | Colon | 0.888889 | 1 | 0.8 | CD19 AND DCC | Mantle-Cell Lymphoma | 0.914286 | 1 | 0.842105 |
| TNFSF15 AND MUC1 | Colon | 0.6 | 0.6 | 0.6 | CD19 AND CLDN20 | Mantle-Cell Lymphoma | 0.914286 | 1 | 0.842105 |
| PMEPA1 AND ERBB2 | Colon | 0.666667 | 0.571429 | 0.8 | CD19 AND CATSPERD | Mantle-Cell Lymphoma | 0.914286 | 1 | 0.842105 |
| SLC39A10 AND MUC1 | Colon | 0.888889 | 1 | 0.8 | CD19 AND PTGIR | Mantle-Cell Lymphoma | 0.914286 | 1 | 0.842105 |
| SMAGP AND MSLN | Colon | 0.75 | 1 | 0.6 | CD19 AND ADAM20 | Mantle-Cell Lymphoma | 0.914286 | 1 | 0.842105 |
| NRCAM AND MUC1 | Glioma | 0.909091 | 0.952381 | 0.869565 | CD19 AND CNTNAP4 | Mantle-Cell Lymphoma | 0.914286 | 1 | 0.842105 |
| NRCAM AND ERBB2 | Glioma | 0.917293 | 0.953125 | 0.884058 | CD19 AND MPL | Mantle-Cell Lymphoma | 0.914286 | 1 | 0.842105 |
| NLGN1 AND ERBB2 | Glioma | 0.938462 | 1 | 0.884058 | CD19 AND MRGPRX2 | Mantle-Cell Lymphoma | 0.914286 | 1 | 0.842105 |
| SGCB AND MUC1 | Glioma | 0.859259 | 0.878788 | 0.84058 | CD19 AND GHSR | Mantle-Cell Lymphoma | 0.914286 | 1 | 0.842105 |
| SCN3A AND ERBB2 | Glioma | 0.789116 | 0.74359 | 0.84058 | CD19 AND KCNC1 | Mantle-Cell Lymphoma | 0.914286 | 1 | 0.842105 |
| SCN3A AND EPHA2 | Glioma | 0.808511 | 0.791667 | 0.826087 | CD19 AND CCKBR | Mantle-Cell Lymphoma | 0.914286 | 1 | 0.842105 |
| SCN3A AND MUC1 | Glioma | 0.820896 | 0.846154 | 0.797101 | CD19 AND TMEM235 | Mantle-Cell Lymphoma | 0.914286 | 1 | 0.842105 |
| GRIK3 AND ERBB2 | Glioma | 0.754967 | 0.695122 | 0.826087 | CD19 AND HTR3C | Mantle-Cell Lymphoma | 0.914286 | 1 | 0.842105 |
| EPHB1 AND ERBB2 | Glioma | 0.75 | 0.882353 | 0.652174 | CD19 AND PRND | Mantle-Cell Lymphoma | 0.914286 | 1 | 0.842105 |
| FZD3 AND ERBB2 | Glioma | 0.736842 | 0.674699 | 0.811594 | CD19 AND NTSR2 | Mantle-Cell Lymphoma | 0.914286 | 1 | 0.842105 |
| NLGN4X AND ERBB2 | Glioma | 0.73494 | 0.628866 | 0.884058 | CD19 AND TAS1R1 | Mantle-Cell Lymphoma | 0.914286 | 1 | 0.842105 |
| CPT1C AND ERBB2 | Glioma | 0.722892 | 0.618557 | 0.869565 | CD19 AND GPR156 | Mantle-Cell Lymphoma | 0.914286 | 1 | 0.842105 |
| CPT1C AND EPHA2 | Glioma | 0.714286 | 0.606061 | 0.869565 | CD19 AND SLC30A8 | Mantle-Cell Lymphoma | 0.914286 | 1 | 0.842105 |
| CPT1C AND MUC1 | Glioma | 0.693642 | 0.576923 | 0.869565 | CD19 AND GNRHR | Mantle-Cell Lymphoma | 0.914286 | 1 | 0.842105 |
| GPR34 AND MUC1 | Glioma | 0.787402 | 0.862069 | 0.724638 | CD19 AND DTNA | Mantle-Cell Lymphoma | 0.914286 | 1 | 0.842105 |
| SLC39A10 AND ERBB2 | Glioma | 0.688889 | 0.558559 | 0.898551 | CD19 AND CDH22 | Mantle-Cell Lymphoma | 0.914286 | 1 | 0.842105 |
| RAMP1 AND MUC1 | Glioma | 0.683544 | 0.606742 | 0.782609 | CD19 AND OR3A2 | Mantle-Cell Lymphoma | 0.914286 | 1 | 0.842105 |
| NCAM2 AND ERBB2 | Glioma | 0.675159 | 0.602273 | 0.768116 | CD19 AND CACNG1 | Mantle-Cell Lymphoma | 0.914286 | 1 | 0.842105 |
| CNR1 AND ERBB2 | Glioma | 0.697368 | 0.638554 | 0.768116 | CD19 AND SLC22A12 | Mantle-Cell Lymphoma | 0.914286 | 1 | 0.842105 |
| NCAM2 AND EPHA2 | Glioma | 0.666667 | 0.588889 | 0.768116 | CD19 AND OR52D1 | Mantle-Cell Lymphoma | 0.914286 | 1 | 0.842105 |
| SLC39A10 AND EPHA2 | Glioma | 0.666667 | 0.552381 | 0.84058 | CD19 AND OR7C1 | Mantle-Cell Lymphoma | 0.914286 | 1 | 0.842105 |
| CD33 AND SLC2A5 | AML | 0.855319 | 0.917808 | 0.800797 | CD19 AND GPR50 | Mantle-Cell Lymphoma | 0.914286 | 1 | 0.842105 |
| P2RX1 AND CD33 | AML | 0.839858 | 0.758842 | 0.940239 | CD19 AND FGF6 | Mantle-Cell Lymphoma | 0.914286 | 1 | 0.842105 |
| MR1 AND MUC1 | Lung Adenocarcinoma | 0.60177 | 0.790698 | 0.485714 | CD19 AND GPR158 | Mantle-Cell Lymphoma | 0.914286 | 1 | 0.842105 |
| CXCL9 AND CD19 | B-Cell Diffuse | 0.774194 | 0.96 | 0.648649 | CD19 AND DRD5 | Mantle-Cell Lymphoma | 0.914286 | 1 | 0.842105 |
| CXCL9 AND MS4A1 | B-Cell Diffuse | 0.754098 | 0.958333 | 0.621622 | CD19 AND OR10J1 | Mantle-Cell Lymphoma | 0.914286 | 1 | 0.842105 |
| CXCL9 AND CD22 | B-Cell Diffuse | 0.754098 | 0.958333 | 0.621622 | CD19 AND USH2A | Mantle-Cell Lymphoma | 0.914286 | 1 | 0.842105 |
| MS4A1 AND MCOLN2 | B-Cell Diffuse | 0.709677 | 0.88 | 0.594595 | CD19 AND MUC17 | Mantle-Cell Lymphoma | 0.914286 | 1 | 0.842105 |
| MS4A1 AND GJA1 | B-Cell Diffuse | 0.705882 | 0.774194 | 0.648649 | CD19 AND KCNV2 | Mantle-Cell Lymphoma | 0.898551 | 1 | 0.815789 |
| MS4A1 AND TNFRSF9 | B-Cell Diffuse | 0.705882 | 0.774194 | 0.648649 | CD19 AND EPHA10 | Mantle-Cell Lymphoma | 0.898551 | 1 | 0.815789 |
| MS4A1 AND SLCO2B1 | B-Cell Diffuse | 0.705882 | 0.774194 | 0.648649 | CD19 AND CALN1 | Mantle-Cell Lymphoma | 0.898551 | 1 | 0.815789 |
| CD19 AND SLC2A5 | B-Cell Diffuse | 0.698413 | 0.846154 | 0.594595 | CD19 AND SLC4A5 | Mantle-Cell Lymphoma | 0.898551 | 1 | 0.815789 |
| MS4A1 AND SLC1A3 | B-Cell Diffuse | 0.69697 | 0.793103 | 0.621622 | CD19 AND CLDN15 | Mantle-Cell Lymphoma | 0.898551 | 1 | 0.815789 |
| MS4A1 AND PPAP2B | B-Cell Diffuse | 0.695652 | 0.75 | 0.648649 | CD19 AND TRPC7 | Mantle-Cell Lymphoma | 0.898551 | 1 | 0.815789 |
| MS4A1 AND AQP7 | B-Cell Diffuse | 0.69697 | 0.793103 | 0.621622 | CD19 AND CDH18 | Mantle-Cell Lymphoma | 0.898551 | 1 | 0.815789 |
| CXCL10 AND CD22 | B-Cell Diffuse | 0.6875 | 0.814815 | 0.594595 | CD19 AND CRB1 | Mantle-Cell Lymphoma | 0.898551 | 1 | 0.815789 |
| MS4A1 AND PDGFRA | B-Cell Diffuse | 0.686567 | 0.766667 | 0.621622 | CD19 AND HTR6 | Mantle-Cell Lymphoma | 0.898551 | 1 | 0.815789 |
| MS4A1 AND DDR2 | B-Cell Diffuse | 0.686567 | 0.766667 | 0.621622 | CD19 AND CACNG2 | Mantle-Cell Lymphoma | 0.898551 | 1 | 0.815789 |
| MS4A1 AND ANTXR1 | B-Cell Diffuse | 0.686567 | 0.766667 | 0.621622 | CD19 AND STAB1 | Mantle-Cell Lymphoma | 0.898551 | 1 | 0.815789 |
| MS4A1 AND OSMR | B-Cell Diffuse | 0.686567 | 0.766667 | 0.621622 | CD19 AND SLC22A2 | Mantle-Cell Lymphoma | 0.898551 | 1 | 0.815789 |

FIG. 9 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| MS4A1 AND TMEM119 | B-Cell Diffuse | 0.686567 | 0.766667 | 0.621622 | CD19 AND SLC39A2 | Mantle-Cell Lymphoma | 0.898551 | 1 | 0.815789 |
| MS4A1 AND CDH5 | B-Cell Diffuse | 0.686567 | 0.766667 | 0.621622 | CD19 AND CEACAM7 | Mantle-Cell Lymphoma | 0.898551 | 1 | 0.815789 |
| MCOLN2 AND CD22 | B-Cell Diffuse | 0.760563 | 0.794118 | 0.72973 | CD19 AND TSHR | Mantle-Cell Lymphoma | 0.898551 | 1 | 0.815789 |
| MS4A1 AND SLC2A5 | B-Cell Diffuse | 0.685714 | 0.727273 | 0.648649 | CD19 AND SLC22A11 | Mantle-Cell Lymphoma | 0.898551 | 1 | 0.815789 |
| CD80 AND CD22 | B-Cell Diffuse | 0.712329 | 0.722222 | 0.702703 | CD19 AND PCDHGC4 | Mantle-Cell Lymphoma | 0.898551 | 1 | 0.815789 |
| CD19 AND MCOLN2 | B-Cell Diffuse | 0.677419 | 0.84 | 0.567568 | CD19 AND GRIN2B | Mantle-Cell Lymphoma | 0.898551 | 1 | 0.815789 |
| CD19 AND BRCA1 | B-Cell Diffuse | 0.676923 | 0.785714 | 0.594595 | CD19 AND TRPM3 | Mantle-Cell Lymphoma | 0.898551 | 1 | 0.815789 |
| MS4A1 AND KCNMA1 | B-Cell Diffuse | 0.676471 | 0.741935 | 0.621622 | CD19 AND ADAM7 | Mantle-Cell Lymphoma | 0.898551 | 1 | 0.815789 |
| MS4A1 AND GJA4 | B-Cell Diffuse | 0.676923 | 0.785714 | 0.594595 | CD19 AND MRAP | Mantle-Cell Lymphoma | 0.898551 | 1 | 0.815789 |
| MS4A1 AND MCAM | B-Cell Diffuse | 0.666667 | 0.71875 | 0.621622 | CD19 AND GRIN1 | Mantle-Cell Lymphoma | 0.898551 | 1 | 0.815789 |
| CD19 AND ATP2A1 | B-Cell Diffuse | 0.666667 | 0.758621 | 0.594595 | CD19 AND GABRB2 | Mantle-Cell Lymphoma | 0.898551 | 1 | 0.815789 |
| MS4A1 AND UNC5B | B-Cell Diffuse | 0.666667 | 0.71875 | 0.621622 | CD19 AND SLC17A1 | Mantle-Cell Lymphoma | 0.914286 | 1 | 0.842105 |
| CD22 AND SLC2A5 | B-Cell Diffuse | 0.698795 | 0.630435 | 0.783784 | CD19 AND PPAPDC1A | Mantle-Cell Lymphoma | 0.914286 | 1 | 0.842105 |
| MS4A1 AND TM4SF1 | B-Cell Diffuse | 0.666667 | 0.758621 | 0.594595 | CD19 AND KCNJ9 | Mantle-Cell Lymphoma | 0.914286 | 1 | 0.842105 |
| MS4A1 AND TSPAN7 | B-Cell Diffuse | 0.666667 | 0.758621 | 0.594595 | CD19 AND CNGA4 | Mantle-Cell Lymphoma | 0.914286 | 1 | 0.842105 |
| MS4A1 AND CSF1 | B-Cell Diffuse | 0.666667 | 0.758621 | 0.594595 | CD19 AND OPALIN | Mantle-Cell Lymphoma | 0.914286 | 1 | 0.842105 |
| MS4A1 AND TMEM47 | B-Cell Diffuse | 0.666667 | 0.758621 | 0.594595 | CD19 AND GRM6 | Mantle-Cell Lymphoma | 0.914286 | 1 | 0.842105 |
| MS4A1 AND AQP1 | B-Cell Diffuse | 0.666667 | 0.758621 | 0.594595 | CD19 AND P2RX3 | Mantle-Cell Lymphoma | 0.914286 | 1 | 0.842105 |
| MS4A1 AND PMP22 | B-Cell Diffuse | 0.657534 | 0.666667 | 0.648649 | CD19 AND BEST2 | Mantle-Cell Lymphoma | 0.914286 | 1 | 0.842105 |
| MS4A1 AND ENPP2 | B-Cell Diffuse | 0.657534 | 0.666667 | 0.648649 | CD19 AND DISP2 | Mantle-Cell Lymphoma | 0.914286 | 1 | 0.842105 |
| MS4A1 AND SDC2 | B-Cell Diffuse | 0.657143 | 0.69697 | 0.621622 | CD19 AND ZACN | Mantle-Cell Lymphoma | 0.914286 | 1 | 0.842105 |
| MS4A1 AND CAV1 | B-Cell Diffuse | 0.657143 | 0.69697 | 0.621622 | CD19 AND GPR12 | Mantle-Cell Lymphoma | 0.914286 | 1 | 0.842105 |
| MS4A1 AND FZD4 | B-Cell Diffuse | 0.666667 | 0.758621 | 0.594595 | CD19 AND CABP7 | Mantle-Cell Lymphoma | 0.914286 | 1 | 0.842105 |
| MS4A1 AND ECSCR | B-Cell Diffuse | 0.647887 | 0.676471 | 0.621622 | CD19 AND SLC17A3 | Mantle-Cell Lymphoma | 0.898551 | 1 | 0.815789 |
| MS4A1 AND SLC25A4 | B-Cell Diffuse | 0.647059 | 0.709677 | 0.594595 | CD19 AND CRB2 | Mantle-Cell Lymphoma | 0.914286 | 1 | 0.842105 |
| CD19 AND TNFRSF9 | B-Cell Diffuse | 0.647059 | 0.709677 | 0.594595 | CD19 AND AJAP1 | Mantle-Cell Lymphoma | 0.914286 | 1 | 0.842105 |
| MS4A1 AND CMKLR1 | B-Cell Diffuse | 0.647059 | 0.709677 | 0.594595 | CD19 AND ZP4 | Mantle-Cell Lymphoma | 0.914286 | 1 | 0.842105 |
| MS4A1 AND CD80 | B-Cell Diffuse | 0.646154 | 0.75 | 0.567568 | CD19 AND OR5P3 | Mantle-Cell Lymphoma | 0.914286 | 1 | 0.842105 |
| CD19 AND SLC1A3 | B-Cell Diffuse | 0.646154 | 0.75 | 0.567568 | CD19 AND KCNK10 | Mantle-Cell Lymphoma | 0.914286 | 1 | 0.842105 |
| CD19 AND NDRG4 | Mantle-Cell Lymphoma | 0.914286 | 1 | 0.842105 | CD19 AND EPHA8 | Mantle-Cell Lymphoma | 0.914286 | 1 | 0.842105 |
| CD19 AND DPP4 | Mantle-Cell Lymphoma | 0.914286 | 1 | 0.842105 | CD19 AND HCN1 | Mantle-Cell Lymphoma | 0.914286 | 1 | 0.842105 |
| CD19 AND SLC13A3 | Mantle-Cell Lymphoma | 0.914286 | 1 | 0.842105 | CD19 AND ATP6V0A4 | Mantle-Cell Lymphoma | 0.914286 | 1 | 0.842105 |
| CD19 AND P2RY2 | Mantle-Cell Lymphoma | 0.914286 | 1 | 0.842105 | CD19 AND SLC1A6 | Mantle-Cell Lymphoma | 0.914286 | 1 | 0.842105 |
| CD19 AND KCNH5 | Mantle-Cell Lymphoma | 0.914286 | 1 | 0.842105 | CD19 AND CHRNA1 | Mantle-Cell Lymphoma | 0.914286 | 1 | 0.842105 |
| CD19 AND LPAR3 | Mantle-Cell Lymphoma | 0.914286 | 1 | 0.842105 | CD19 AND SLC22A14 | Mantle-Cell Lymphoma | 0.914286 | 1 | 0.842105 |
| CD19 AND SLC7A2 | Mantle-Cell Lymphoma | 0.914286 | 1 | 0.842105 | MLANA AND GPR137B | Melanoma | 1 | 1 | 1 |
| CD19 AND MARVELD2 | Mantle-Cell Lymphoma | 0.914286 | 1 | 0.842105 | GPR19 AND B4GALNT1 | Neuroblastoma | 0.624 | 0.46988 | 0.928571 |
| CD19 AND LY6D | Mantle-Cell Lymphoma | 0.914286 | 1 | 0.842105 | FLVCR1 AND B4GALNT1 | Neuroblastoma | 0.643836 | 0.758065 | 0.559524 |
| CD19 AND NOX4 | Mantle-Cell Lymphoma | 0.914286 | 1 | 0.842105 | B4GALNT1 AND ATP7A | Neuroblastoma | 0.675159 | 0.726027 | 0.630952 |
| CD19 AND TRHDE | Mantle-Cell Lymphoma | 0.914286 | 1 | 0.842105 | FOLH1 AND STEAP4 | Prostate | 0.857143 | 1 | 0.75 |
| CD19 AND MRGPRX4 | Mantle-Cell Lymphoma | 0.914286 | 1 | 0.842105 | FOLH1 AND ANTXR2 | Prostate | 0.727273 | 0.571429 | 1 |
| CD19 AND STRA6 | Mantle-Cell Lymphoma | 0.914286 | 1 | 0.842105 | FOLH1 AND PTGIS | Prostate | 0.8 | 0.666667 | 1 |
| CD19 AND APOB | Mantle-Cell Lymphoma | 0.914286 | 1 | 0.842105 | FOLH1 AND SLC43A1 | Prostate | 1 | 1 | 1 |
| CD19 AND PCDHB11 | Mantle-Cell Lymphoma | 0.914286 | 1 | 0.842105 | FOLH1 AND GGTLC1 | Prostate | 1 | 1 | 1 |
| CD19 AND GDE1 | Mantle-Cell Lymphoma | 0.914286 | 1 | 0.842105 | UPK3A AND FOLH1 | Prostate | 0.666667 | 0.6 | 0.75 |
| CD19 AND PDE6B | Mantle-Cell Lymphoma | 0.914286 | 1 | 0.842105 | FOLH1 AND GHR | Prostate | 0.857143 | 1 | 0.75 |
| CD19 AND CLECL1 | Mantle-Cell Lymphoma | 0.914286 | 1 | 0.842105 | FOLH1 AND ATP7A | Prostate | 0.888889 | 0.8 | 1 |
| CD19 AND LRRC32 | Mantle-Cell Lymphoma | 0.914286 | 1 | 0.842105 | FOLH1 AND GUCY2D | Prostate | 0.666667 | 0.6 | 0.75 |
| CD19 AND TMEM30B | Mantle-Cell Lymphoma | 0.914286 | 1 | 0.842105 | FOLH1 AND ATP8B2 | Prostate | 0.666667 | 0.5 | 1 |
| CD19 AND ITGA2 | Mantle-Cell Lymphoma | 0.914286 | 1 | 0.842105 | FOLH1 AND FAT1 | Prostate | 0.857143 | 1 | 0.75 |
| CD19 AND RHBDL1 | Mantle-Cell Lymphoma | 0.914286 | 1 | 0.842105 | FOLH1 AND GABRG3 | Prostate | 0.666667 | 0.6 | 0.75 |
| CD19 AND IL5RA | Mantle-Cell Lymphoma | 0.914286 | 1 | 0.842105 | FOLH1 AND ATP8B1 | Prostate | 0.615385 | 0.444444 | 1 |
| CD19 AND DCHS2 | Mantle-Cell Lymphoma | 0.914286 | 1 | 0.842105 | FOLH1 AND EMP3 | Prostate | 0.727273 | 0.571429 | 1 |
| CD19 AND ADAM22 | Mantle-Cell Lymphoma | 0.914286 | 1 | 0.842105 | FOLH1 AND FLVCR1 | Prostate | 0.727273 | 0.571429 | 1 |
| CD19 AND CORIN | Mantle-Cell Lymphoma | 0.914286 | 1 | 0.842105 | FOLH1 AND VANGL1 | Prostate | 0.727273 | 0.571429 | 1 |
| CD19 AND TMEM150B | Mantle-Cell Lymphoma | 0.914286 | 1 | 0.842105 | FOLH1 AND MRGPRF | Prostate | 0.6 | 0.5 | 0.75 |
| CD19 AND KNCN | Mantle-Cell Lymphoma | 0.914286 | 1 | 0.842105 | FOLH1 AND SEMA4B | Prostate | 0.727273 | 0.571429 | 1 |
| CD19 AND TAS2R39 | Mantle-Cell Lymphoma | 0.914286 | 1 | 0.842105 | FOLH1 AND PPAPDC1B | Prostate | 0.615385 | 0.444444 | 1 |
| CD19 AND ANO1 | Mantle-Cell Lymphoma | 0.914286 | 1 | 0.842105 | FOLH1 AND CD93 | Prostate | 0.857143 | 1 | 0.75 |
| CD19 AND CXADR | Mantle-Cell Lymphoma | 0.914286 | 1 | 0.842105 | FOLH1 AND SLC1A5 | Prostate | 0.615385 | 0.444444 | 1 |
| CD19 AND CCR8 | Mantle-Cell Lymphoma | 0.914286 | 1 | 0.842105 | FOLH1 AND PAQR7 | Prostate | 0.857143 | 1 | 0.75 |
| CD19 AND CHRM3 | Mantle-Cell Lymphoma | 0.914286 | 1 | 0.842105 | FOLH1 AND ENPP1 | Prostate | 0.857143 | 1 | 0.75 |
| CD19 AND FRAS1 | Mantle-Cell Lymphoma | 0.914286 | 1 | 0.842105 | FOLH1 AND SLC22A5 | Prostate | 0.857143 | 1 | 0.75 |
| CD19 AND EVA1A | Mantle-Cell Lymphoma | 0.914286 | 1 | 0.842105 | FOLH1 AND ZACN | Prostate | 0.666667 | 1 | 0.5 |
| CD19 AND CDH19 | Mantle-Cell Lymphoma | 0.914286 | 1 | 0.842105 | FOLH1 AND TTYH3 | Prostate | 0.666667 | 1 | 0.5 |
| CD19 AND NPBWR2 | Mantle-Cell Lymphoma | 0.914286 | 1 | 0.842105 | FOLH1 AND CD44 | Prostate | 0.615385 | 0.444444 | 1 |
| CD19 AND OR1G1 | Mantle-Cell Lymphoma | 0.914286 | 1 | 0.842105 | FOLH1 AND MPL | Prostate | 0.8 | 0.666667 | 1 |
| CD19 AND PROKR2 | Mantle-Cell Lymphoma | 0.914286 | 1 | 0.842105 | FOLH1 AND CD163 | Prostate | 1 | 1 | 1 |
| CD19 AND SLC24A4 | Mantle-Cell Lymphoma | 0.914286 | 1 | 0.842105 | FOLH1 AND F2R | Prostate | 0.888889 | 0.8 | 1 |
| CD19 AND OR51B5 | Mantle-Cell Lymphoma | 0.914286 | 1 | 0.842105 | FOLH1 AND AOC3 | Prostate | 0.727273 | 0.571429 | 1 |
| CD19 AND FCRL4 | Mantle-Cell Lymphoma | 0.914286 | 1 | 0.842105 | FOLH1 AND PHLDB2 | Prostate | 0.615385 | 0.444444 | 1 |
| CD19 AND PCDHB12 | Mantle-Cell Lymphoma | 0.914286 | 1 | 0.842105 | FOLH1 AND ANPEP | Prostate | 0.727273 | 0.571429 | 1 |
| CD19 AND VN1R1 | Mantle-Cell Lymphoma | 0.914286 | 1 | 0.842105 | FOLH1 AND DGKE | Prostate | 0.857143 | 1 | 0.75 |
| CD19 AND SLC24A3 | Mantle-Cell Lymphoma | 0.914286 | 1 | 0.842105 | FOLH1 AND KCNK6 | Prostate | 0.615385 | 0.444444 | 1 |
| CD19 AND ADORA2B | Mantle-Cell Lymphoma | 0.914286 | 1 | 0.842105 | FOLH1 AND BTN3A1 | Prostate | 0.8 | 0.666667 | 1 |
| CD19 AND OXGR1 | Mantle-Cell Lymphoma | 0.914286 | 1 | 0.842105 | FOLH1 AND PTGER4 | Prostate | 0.857143 | 1 | 0.75 |
| CD19 AND AOC2 | Mantle-Cell Lymphoma | 0.914286 | 1 | 0.842105 | FAP AND EPCAM | Breast | 0.875 | 1 | 0.777778 |

FIG. 9 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CD19 AND PCDH10 | Mantle-Cell Lymphoma | 0.914286 | 1 | 0.842105 | TPBG AND EPCAM | Breast | 0.712644 | 0.939394 | 0.574074 |
| CD19 AND SLC26A7 | Mantle-Cell Lymphoma | 0.914286 | 1 | 0.842105 | EPCAM AND SLC7A5 | Breast | 0.744681 | 0.875 | 0.648148 |
| CD19 AND HTR1B | Mantle-Cell Lymphoma | 0.914286 | 1 | 0.842105 | FAP AND MSLN | Breast | 0.762887 | 0.860465 | 0.685185 |
| CD19 AND OR51E1 | Mantle-Cell Lymphoma | 0.914286 | 1 | 0.842105 | FAP AND ERBB2 | Breast | 0.682927 | 1 | 0.518519 |
| CD19 AND HTR2A | Mantle-Cell Lymphoma | 0.914286 | 1 | 0.842105 | EPCAM AND KDR | Breast | 0.66129 | 0.585714 | 0.759259 |
| CD19 AND IL1RL1 | Mantle-Cell Lymphoma | 0.914286 | 1 | 0.842105 | EPCAM AND SDC1 | Breast | 0.764045 | 0.971429 | 0.62963 |
| CD19 AND OR7A5 | Mantle-Cell Lymphoma | 0.914286 | 1 | 0.842105 | EPCAM AND AXL | Breast | 0.701754 | 0.666667 | 0.740741 |
| CD19 AND CHRM5 | Mantle-Cell Lymphoma | 0.914286 | 1 | 0.842105 | EPCAM AND GPNMB | Breast | 0.8 | 0.823529 | 0.777778 |
| CD19 AND PKHD1 | Mantle-Cell Lymphoma | 0.914286 | 1 | 0.842105 | EPCAM AND TNC | Breast | 0.632479 | 0.587302 | 0.685185 |
| CD19 AND AQP4 | Mantle-Cell Lymphoma | 0.914286 | 1 | 0.842105 | TPBG AND MSLN | Breast | 0.606061 | 0.666667 | 0.555556 |
| CD19 AND EPHB1 | Mantle-Cell Lymphoma | 0.914286 | 1 | 0.842105 | EPCAM AND PCYT1A | Breast | 0.740741 | 0.740741 | 0.740741 |
| CD19 AND EFNB3 | Mantle-Cell Lymphoma | 0.914286 | 1 | 0.842105 | EPCAM AND ITGAV | Breast | 0.65625 | 0.567568 | 0.777778 |
| CD19 AND TIE1 | Mantle-Cell Lymphoma | 0.914286 | 1 | 0.842105 | EPCAM AND CBX3 | Breast | 0.722689 | 0.661538 | 0.796296 |
| CD19 AND SI | Mantle-Cell Lymphoma | 0.914286 | 1 | 0.842105 | FAP AND MUC1 | Pancreas | 0.777778 | 1 | 0.636364 |
| CD19 AND KCNK1 | Mantle-Cell Lymphoma | 0.914286 | 1 | 0.842105 | FAP AND CD19 | Pancreas | 0.705882 | 1 | 0.545455 |
| CD19 AND AGTR1 | Mantle-Cell Lymphoma | 0.914286 | 1 | 0.842105 | FAP AND MSLN | Pancreas | 0.705882 | 1 | 0.545455 |
| CD19 AND P2RX2 | Mantle-Cell Lymphoma | 0.914286 | 1 | 0.842105 | CLDN2 AND MSLN | Pancreas | 0.615385 | 0.533333 | 0.727273 |
| CD19 AND OR51M1 | Mantle-Cell Lymphoma | 0.914286 | 1 | 0.842105 | FAP AND ERBB2 | Pancreas | 0.705882 | 1 | 0.545455 |
| CD19 AND UPK1B | Mantle-Cell Lymphoma | 0.914286 | 1 | 0.842105 | VCAM1 AND MUC1 | Pancreas | 0.666667 | 0.7 | 0.636364 |
| CD19 AND SFRP1 | Mantle-Cell Lymphoma | 0.914286 | 1 | 0.842105 | TNFSF11 AND MUC1 | Pancreas | 0.608696 | 0.583333 | 0.636364 |
| CD19 AND SLC5A9 | Mantle-Cell Lymphoma | 0.914286 | 1 | 0.842105 | VCAM1 AND ERBB2 | Pancreas | 0.692308 | 0.6 | 0.818182 |
| CD19 AND ATP4A | Mantle-Cell Lymphoma | 0.914286 | 1 | 0.842105 | MUC1 AND ITGAV | Pancreas | 0.727273 | 0.727273 | 0.727273 |
| CD19 AND ABCC8 | Mantle-Cell Lymphoma | 0.914286 | 1 | 0.842105 | PTK7 AND MSLN | Pancreas | 0.625 | 1 | 0.454545 |
| CD19 AND MAS1 | Mantle-Cell Lymphoma | 0.914286 | 1 | 0.842105 | STEAP2 AND MUC1 | Pancreas | 0.642857 | 0.529412 | 0.818182 |
| CD19 AND CDH6 | Mantle-Cell Lymphoma | 0.914286 | 1 | 0.842105 | CBX3 AND MUC1 | Colon | 0.666667 | 0.571429 | 0.8 |
| CD19 AND KCNG3 | Mantle-Cell Lymphoma | 0.914286 | 1 | 0.842105 | CBX3 AND ERBB2 | Colon | 0.666667 | 0.571429 | 0.8 |
| CD19 AND EMCN | Mantle-Cell Lymphoma | 0.914286 | 1 | 0.842105 | BIRC5 AND MUC1 | Colon | 0.666667 | 0.5 | 1 |
| CD19 AND LRP4 | Mantle-Cell Lymphoma | 0.914286 | 1 | 0.842105 | ITGAV AND MUC1 | Colon | 0.909091 | 0.833333 | 1 |
| CD19 AND OPN5 | Mantle-Cell Lymphoma | 0.914286 | 1 | 0.842105 | CD33 AND CD70 | AML | 0.872659 | 0.823322 | 0.928287 |
| CD19 AND KIR2DL4 | Mantle-Cell Lymphoma | 0.914286 | 1 | 0.842105 | CD33 AND SLC7A5 | AML | 0.857678 | 0.809187 | 0.912351 |
| CD19 AND KCNE1 | Mantle-Cell Lymphoma | 0.914286 | 1 | 0.842105 | CD33 AND PROM1 | AML | 0.757576 | 0.829384 | 0.697211 |
| CD19 AND EDNRA | Mantle-Cell Lymphoma | 0.914286 | 1 | 0.842105 | CD33 AND CD38 | AML | 0.756661 | 0.682692 | 0.848606 |
| CD19 AND TSPAN1 | Mantle-Cell Lymphoma | 0.914286 | 1 | 0.842105 | CD33 AND TPBG | AML | 0.64486 | 0.779661 | 0.549801 |
| CD19 AND SLC8A1 | Mantle-Cell Lymphoma | 0.914286 | 1 | 0.842105 | CD33 AND CD34 | AML | 0.631068 | 0.807453 | 0.517928 |
| CD19 AND EPHA1 | Mantle-Cell Lymphoma | 0.914286 | 1 | 0.842105 | CD22 AND GPNMB | B-Cell Diffuse | 0.8125 | 0.962963 | 0.702703 |
| CD19 AND FLRT3 | Mantle-Cell Lymphoma | 0.914286 | 1 | 0.842105 | MS4A1 AND GPNMB | B-Cell Diffuse | 0.716418 | 0.8 | 0.648649 |
| CD19 AND ERVFRD-1 | Mantle-Cell Lymphoma | 0.914286 | 1 | 0.842105 | MS4A1 AND VCAM1 | B-Cell Diffuse | 0.705882 | 0.774194 | 0.648649 |
| CD19 AND KIR2DL3 | Mantle-Cell Lymphoma | 0.914286 | 1 | 0.842105 | CD19 AND GPNMB | B-Cell Diffuse | 0.689655 | 0.952381 | 0.540541 |
| CD19 AND SLC16A1 | Mantle-Cell Lymphoma | 0.914286 | 1 | 0.842105 | MS4A1 AND SLC7A5 | B-Cell Diffuse | 0.686567 | 0.766667 | 0.621622 |
| CD19 AND NOX3 | Mantle-Cell Lymphoma | 0.914286 | 1 | 0.842105 | MS4A1 AND TPBG | B-Cell Diffuse | 0.676471 | 0.741935 | 0.621622 |
| CD19 AND SLC26A10 | Mantle-Cell Lymphoma | 0.914286 | 1 | 0.842105 | MS4A1 AND EDNRB | B-Cell Diffuse | 0.657143 | 0.69697 | 0.621622 |
| CD19 AND OR1J4 | Mantle-Cell Lymphoma | 0.914286 | 1 | 0.842105 | CD22 AND VCAM1 | B-Cell Diffuse | 0.637363 | 0.537037 | 0.783784 |
| CD19 AND SLC12A4 | Mantle-Cell Lymphoma | 0.914286 | 1 | 0.842105 | CD19 AND VCAM1 | B-Cell Diffuse | 0.628571 | 0.666667 | 0.594595 |
| CD19 AND MFSD2A | Mantle-Cell Lymphoma | 0.914286 | 1 | 0.842105 | MS4A1 AND CLDN12 | B-Cell Diffuse | 0.621622 | 0.621622 | 0.621622 |
| MLANA AND KCNK15 | Melanoma | 1 | 1 | 1 | CD19 AND TPBG | B-Cell Diffuse | 0.619718 | 0.647059 | 0.594595 |
| MLANA AND SLC20A1 | Melanoma | 0.952381 | 1 | 0.909091 | CD19 AND IL2RA | B-Cell Diffuse | 0.60274 | 0.611111 | 0.594595 |
| SLC6A2 AND B4GALNT1 | Neuroblastoma | 0.810127 | 0.864865 | 0.761905 | CD19 AND STEAP2 | Mantle-Cell Lymphoma | 0.914286 | 1 | 0.842105 |
| SCN9A AND B4GALNT1 | Neuroblastoma | 0.766467 | 0.771084 | 0.761905 | CD19 AND ERBB2 | Mantle-Cell Lymphoma | 0.914286 | 1 | 0.842105 |
| THSD7A AND B4GALNT1 | Neuroblastoma | 0.695187 | 0.631068 | 0.77381 | CD19 AND SDC1 | Mantle-Cell Lymphoma | 0.914286 | 1 | 0.842105 |
| SLC29A4 AND B4GALNT1 | Neuroblastoma | 0.69281 | 0.768116 | 0.630952 | CD19 AND ERBB3 | Mantle-Cell Lymphoma | 0.914286 | 1 | 0.842105 |
| TUSC3 AND B4GALNT1 | Neuroblastoma | 0.69281 | 0.768116 | 0.630952 | CD19 AND SSTR1 | Mantle-Cell Lymphoma | 0.914286 | 1 | 0.842105 |
| XPR1 AND B4GALNT1 | Neuroblastoma | 0.6625 | 0.697368 | 0.630952 | CD19 AND CD34 | Mantle-Cell Lymphoma | 0.914286 | 1 | 0.842105 |
| CADM1 AND B4GALNT1 | Neuroblastoma | 0.641791 | 0.86 | 0.511905 | CD19 AND MUC16 | Mantle-Cell Lymphoma | 0.914286 | 1 | 0.842105 |
| HTRA2 AND B4GALNT1 | Neuroblastoma | 0.626866 | 0.84 | 0.5 | CD19 AND CLDN2 | Mantle-Cell Lymphoma | 0.898551 | 1 | 0.815789 |
| SLC26A11 AND B4GALNT1 | Neuroblastoma | 0.609375 | 0.886364 | 0.464286 | CD19 AND NCAM1 | Mantle-Cell Lymphoma | 0.898551 | 1 | 0.815789 |
| B4GALNT1 AND PEMT | Neuroblastoma | 0.666667 | 0.824561 | 0.559524 | CD19 AND ITGB6 | Mantle-Cell Lymphoma | 0.898551 | 1 | 0.815789 |
| B4GALNT1 AND YIPF3 | Neuroblastoma | 0.657895 | 0.735294 | 0.595238 | CD19 AND EDNRB | Mantle-Cell Lymphoma | 0.898551 | 1 | 0.815789 |
| B4GALNT1 AND SLC38A2 | Neuroblastoma | 0.679739 | 0.753623 | 0.619048 | CD19 AND GUCY2C | Mantle-Cell Lymphoma | 0.898551 | 1 | 0.815789 |
| LDLRAD3 AND B4GALNT1 | Neuroblastoma | 0.630872 | 0.723077 | 0.559524 | CD19 AND ENPP3 | Mantle-Cell Lymphoma | 0.898551 | 1 | 0.815789 |
| B4GALNT1 AND VIMP | Neuroblastoma | 0.601504 | 0.816327 | 0.47619 | CD19 AND LGR5 | Mantle-Cell Lymphoma | 0.898551 | 1 | 0.815789 |
| B4GALNT1 AND JTB | Neuroblastoma | 0.607595 | 0.648649 | 0.571429 | CD19 AND ERBB4 | Mantle-Cell Lymphoma | 0.898551 | 1 | 0.815789 |
| DCHS1 AND B4GALNT1 | Neuroblastoma | 0.714286 | 0.892857 | 0.595238 | CD19 AND B4GALNT1 | Mantle-Cell Lymphoma | 0.914286 | 1 | 0.842105 |
| FOLH1 AND CACNA1D | Prostate | 0.857143 | 1 | 0.75 | CD19 AND FOLH1 | Mantle-Cell Lymphoma | 0.914286 | 1 | 0.842105 |
| FOLH1 AND BCAM | Prostate | 0.727273 | 0.571429 | 1 | CD19 AND TNFRSF8 | Mantle-Cell Lymphoma | 0.898551 | 1 | 0.815789 |
| OR51E1 AND FOLH1 | Prostate | 0.857143 | 1 | 0.75 | CD19 AND SLC39A6 | Mantle-Cell Lymphoma | 0.882353 | 1 | 0.789474 |
| FOLH1 AND ADRB2 | Prostate | 1 | 1 | 1 | CD19 AND TNFRSF10A | Mantle-Cell Lymphoma | 0.914286 | 1 | 0.842105 |
| TSPAN1 AND FOLH1 | Prostate | 0.666667 | 1 | 0.5 | CD19 AND PMEL | Mantle-Cell Lymphoma | 0.914286 | 1 | 0.842105 |
| FOLH1 AND PCDHB14 | Prostate | 0.75 | 0.75 | 0.75 | CD19 AND FOLR1 | Mantle-Cell Lymphoma | 0.882353 | 1 | 0.789474 |
| FOLH1 AND VIPR1 | Prostate | 0.857143 | 1 | 0.75 | CD19 AND CLDN12 | Mantle-Cell Lymphoma | 0.865672 | 1 | 0.763158 |
| FOLH1 AND SERINC5 | Prostate | 0.666667 | 1 | 0.5 | CD19 AND ABCB5 | Mantle-Cell Lymphoma | 0.865672 | 1 | 0.763158 |
| FOLH1 AND GOLM1 | Prostate | 1 | 1 | 1 | CD19 AND ITGB3 | Mantle-Cell Lymphoma | 0.865672 | 1 | 0.763158 |
| FOLH1 AND EDNRA | Prostate | 0.727273 | 0.571429 | 1 | CD19 AND CD52 | Mantle-Cell Lymphoma | 0.898551 | 1 | 0.815789 |
| FOLH1 AND SELE | Prostate | 0.666667 | 0.5 | 1 | CD19 AND IL11RA | Mantle-Cell Lymphoma | 0.898551 | 1 | 0.815789 |
| FOLH1 AND HPN | Prostate | 1 | 1 | 1 | CD19 AND SSTR5 | Mantle-Cell Lymphoma | 0.830769 | 1 | 0.710526 |
| FOLH1 AND CD320 | Prostate | 0.727273 | 0.571429 | 1 | CD19 AND CLDN18 | Mantle-Cell Lymphoma | 0.830769 | 1 | 0.710526 |
| FOLH1 AND COLEC12 | Prostate | 0.8 | 0.666667 | 1 | CD19 AND RNF43 | Mantle-Cell Lymphoma | 0.8125 | 1 | 0.684211 |
| FOLH1 AND ATP2C1 | Prostate | 0.666667 | 0.6 | 0.75 | CD19 AND CA9 | Mantle-Cell Lymphoma | 0.793651 | 1 | 0.657895 |

FIG. 9 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ABCC4 AND FOLH1 | Prostate | 0.857143 | 1 | 0.75 | CD19 AND SLC7A5 | Mantle-Cell Lymphoma | 0.793651 | 1 | 0.657895 |
| FOLH1 AND CDH26 | Prostate | 0.727273 | 0.571429 | 1 | CD19 AND ROR1 | Mantle-Cell Lymphoma | 0.793651 | 1 | 0.657895 |
| FOLH1 AND CD99 | Prostate | 0.666667 | 0.6 | 0.75 | CD19 AND CSPG4 | Mantle-Cell Lymphoma | 0.793651 | 1 | 0.657895 |
| FOLH1 AND SLC2A10 | Prostate | 0.666667 | 1 | 0.5 | CD19 AND IL2RA | Mantle-Cell Lymphoma | 0.793651 | 1 | 0.657895 |
| FOLH1 AND EPHA7 | Prostate | 0.666667 | 0.5 | 1 | CD19 AND EPCAM | Mantle-Cell Lymphoma | 0.774194 | 1 | 0.631579 |
| FOLH1 AND AGTRAP | Prostate | 0.727273 | 0.571429 | 1 | FCRL2 AND CD19 | Mantle-Cell Lymphoma | 0.754098 | 1 | 0.605263 |
| FOLH1 AND IL1R1 | Prostate | 0.888889 | 0.8 | 1 | CD19 AND CLDN9 | Mantle-Cell Lymphoma | 0.754098 | 1 | 0.605263 |
| FOLH1 AND ITGA5 | Prostate | 0.888889 | 0.8 | 1 | CD19 AND SLC34A2 | Mantle-Cell Lymphoma | 0.733333 | 1 | 0.578947 |
| FOLH1 AND SDK1 | Prostate | 0.727273 | 0.571429 | 1 | CD19 AND VTCN1 | Mantle-Cell Lymphoma | 0.733333 | 1 | 0.578947 |
| FOLH1 AND POPDC2 | Prostate | 0.888889 | 0.8 | 1 | CD19 AND GPA33 | Mantle-Cell Lymphoma | 0.711864 | 1 | 0.552632 |
| FOLH1 AND BBS4 | Prostate | 0.727273 | 0.571429 | 1 | CD19 AND MUC4 | Mantle-Cell Lymphoma | 0.711864 | 1 | 0.552632 |
| FOLH1 AND PPAP2A | Prostate | 0.6 | 0.5 | 0.75 | CD19 AND STEAP1 | Mantle-Cell Lymphoma | 0.689655 | 1 | 0.526316 |
| FOLH1 AND KCNMB1 | Prostate | 0.666667 | 0.5 | 1 | CD19 AND CLDN23 | Mantle-Cell Lymphoma | 0.666667 | 1 | 0.5 |
| FOLH1 AND SLC26A4 | Prostate | 0.857143 | 1 | 0.75 | CD19 AND CLDN7 | Mantle-Cell Lymphoma | 0.642857 | 1 | 0.473684 |
| NDRG1 AND FOLH1 | Prostate | 0.666667 | 1 | 0.5 | CD19 AND IL3RA | Mantle-Cell Lymphoma | 0.642857 | 1 | 0.473684 |
| FOLH1 AND KIAA0319L | Prostate | 0.75 | 0.75 | 0.75 | CD19 AND PROM1 | Mantle-Cell Lymphoma | 0.618182 | 1 | 0.447368 |
| FOLH1 AND TNFSF4 | Prostate | 0.6 | 0.5 | 0.75 | CD19 AND L1CAM | Mantle-Cell Lymphoma | 0.618182 | 1 | 0.447368 |
| SLC2A12 AND FOLH1 | Prostate | 0.857143 | 1 | 0.75 | MLANA AND TRPM4 | Melanoma | 0.952381 | 1 | 0.909091 |
| FOLH1 AND ANKH | Prostate | 0.6 | 0.5 | 0.75 | MLANA AND IL11RA | Melanoma | 1 | 1 | 1 |
| FOLH1 AND OSMR | Prostate | 0.857143 | 1 | 0.75 | MLANA AND L1CAM | Melanoma | 0.952381 | 1 | 0.909091 |
| FOLH1 AND TLCD1 | Prostate | 1 | 1 | 1 | EDNRB AND PMEL | Melanoma | 0.9 | 1 | 0.818182 |
| FOLH1 AND TUSC3 | Prostate | 0.727273 | 0.571429 | 1 | EDNRB AND MLANA | Melanoma | 0.9 | 1 | 0.818182 |
| FOLH1 AND SLC10A3 | Prostate | 0.857143 | 1 | 0.75 | PMEL AND CD22 | Melanoma | 0.9 | 1 | 0.818182 |
| FOLH1 AND SLC26A6 | Prostate | 0.75 | 0.75 | 0.75 | MLANA AND MET | Melanoma | 0.842105 | 1 | 0.727273 |
| FOLH1 AND FZD4 | Prostate | 1 | 1 | 1 | MLANA AND IL13RA1 | Melanoma | 0.842105 | 1 | 0.727273 |
| FOLH1 AND SLC7A2 | Prostate | 0.888889 | 0.8 | 1 | PMEL AND ITGAV | Melanoma | 0.842105 | 1 | 0.727273 |
| FOLH1 AND FREM2 | Prostate | 0.888889 | 0.8 | 1 | CBX3 AND B4GALNT1 | Neuroblastoma | 0.625954 | 0.87234 | 0.488095 |
| FOLH1 AND MARVELD1 | Prostate | 0.8 | 0.666667 | 1 | B4GALNT1 AND CD276 | Neuroblastoma | 0.629371 | 0.762712 | 0.535714 |
| FOLH1 AND VMP1 | Prostate | 1 | 1 | 1 | STEAP2 AND FOLH1 | Prostate | 0.727273 | 0.571429 | 1 |
| FOLH1 AND NPR3 | Prostate | 0.75 | 0.75 | 0.75 | STEAP1 AND FOLH1 | Prostate | 0.75 | 0.75 | 0.75 |
| FOLH1 AND FZD10 | Prostate | 0.727273 | 0.571429 | 1 | FOLH1 AND EPHA3 | Prostate | 0.8 | 0.666667 | 1 |
| FOLH1 AND FUT1 | Prostate | 0.75 | 0.75 | 0.75 | FOLH1 AND GPNMB | Prostate | 0.666667 | 1 | 0.5 |
| FOLH1 AND GPR183 | Prostate | 0.666667 | 1 | 0.5 | FOLH1 AND FLOT2 | Prostate | 0.666667 | 0.5 | 1 |
| FOLH1 AND C5AR1 | Prostate | 0.75 | 0.75 | 0.75 | FOLH1 AND ROR1 | Prostate | 0.888889 | 0.8 | 1 |
| FOLH1 AND KCNG3 | Prostate | 0.666667 | 1 | 0.5 | FOLH1 AND TNC | Prostate | 0.888889 | 0.8 | 1 |
| FOLH1 AND TSPAN2 | Prostate | 0.727273 | 0.571429 | 1 | FOLH1 AND EPCAM | Prostate | 0.857143 | 1 | 0.75 |
| FOLH1 AND CYB5R1 | Prostate | 0.8 | 0.666667 | 1 | FOLH1 AND CLDN8 | Prostate | 0.8 | 0.666667 | 1 |
| FOLH1 AND KCNS3 | Prostate | 0.888889 | 0.8 | 1 | FOLH1 AND TPBG | Prostate | 0.6 | 0.5 | 0.75 |
| FOLH1 AND TPM1 | Prostate | 1 | 1 | 1 | FOLH1 AND CLDN12 | Prostate | 0.666667 | 1 | 0.5 |
| FOLH1 AND TMPRSS2 | Prostate | 0.727273 | 0.571429 | 1 | FOLH1 AND HSPA5 | Prostate | 0.666667 | 1 | 0.5 |
| FOLH1 AND ITGB5 | Prostate | 0.857143 | 1 | 0.75 | FOLH1 AND CD38 | Prostate | 0.727273 | 0.571429 | 1 |
| FOLH1 AND CATSPER2 | Prostate | 0.857143 | 1 | 0.75 | FOLH1 AND IL20RA | Prostate | 0.8 | 0.666667 | 1 |
| FOLH1 AND TRPV1 | Prostate | 0.857143 | 1 | 0.75 | FOLH1 AND DKK1 | Prostate | 0.727273 | 0.571429 | 1 |
| FOLH1 AND NOX4 | Prostate | 1 | 1 | 1 | FOLH1 AND PTK7 | Prostate | 0.615385 | 0.444444 | 1 |
| FOLH1 AND MYADM | Prostate | 0.857143 | 1 | 0.75 | FOLH1 AND MOK | Prostate | 0.666667 | 1 | 0.5 |
| FOLH1 AND OPN1SW | Prostate | 0.857143 | 1 | 0.75 | FOLH1 AND ERBB2 | Prostate | 0.615385 | 0.444444 | 1 |
| FOLH1 AND VANGL2 | Prostate | 0.666667 | 0.6 | 0.75 | FOLH1 AND CBX3 | Prostate | 0.857143 | 1 | 0.75 |
| FOLH1 AND LMAN2 | Prostate | 0.857143 | 1 | 0.75 | FOLH1 AND MUC1 | Prostate | 0.888889 | 0.8 | 1 |
| FOLH1 AND EPHB4 | Prostate | 0.8 | 0.666667 | 1 | FOLH1 AND CD52 | Prostate | 0.75 | 0.75 | 0.75 |
| | | | | | FOLH1 AND ABCA5 | Prostate | 0.666667 | 1 | 0.5 |

FIG. 10

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| EPCAM AND NOT-SLC4A4 | Breast | 0.84848 | 0.9333 | 0.7778 | EPCAM AND NOT-SLC13A2 | Breast | 0.6179 | 0.5507 | 0.7037 |
| ADAM12 AND NOT-MET | Breast | 0.77358 | 0.7885 | 0.7593 | EPCAM AND NOT-CLDN16 | Breast | 0.6074 | 0.5062 | 0.7593 |
| EPCAM AND NOT-VSIG2 | Breast | 0.71795 | 0.6667 | 0.7778 | EPCAM AND NOT-PCDHA6 | Breast | 0.688 | 0.6056 | 0.7963 |
| EPCAM AND NOT-MRAP2 | Breast | 0.71429 | 0.7955 | 0.6481 | EPCAM AND NOT-C8B | Breast | 0.6056 | 0.4886 | 0.7963 |
| EPCAM AND NOT-F3 | Breast | 0.71074 | 0.6418 | 0.7963 | ENPP1 AND NOT-ROR1 | Breast | 0.6066 | 0.5441 | 0.6852 |
| NOX4 AND NOT-ROR1 | Breast | 0.73171 | 0.6522 | 0.8333 | EPCAM AND NOT-SLC6A13 | Breast | 0.6167 | 0.5606 | 0.6852 |
| NOX4 AND NOT-TYR | Breast | 0.69173 | 0.5823 | 0.8519 | EPCAM AND NOT-KCNK10 | Breast | 0.6176 | 0.5122 | 0.7778 |
| EPCAM AND NOT-ABHD6 | Breast | 0.68908 | 0.6308 | 0.7593 | EPCAM AND NOT-CHRNA9 | Breast | 0.6061 | 0.5128 | 0.7407 |
| PMEPA1 AND NOT-ROR1 | Breast | 0.68627 | 0.7292 | 0.6481 | EPCAM AND NOT-SLC22A18 | Breast | 0.6 | 0.4884 | 0.7778 |
| EPCAM AND NOT-SCNN1B | Breast | 0.68333 | 0.6212 | 0.7593 | EPCAM AND NOT-HTR6 | Breast | 0.6043 | 0.4941 | 0.7778 |
| SLC52A2 AND NOT-TYR | Breast | 0.74725 | 0.9189 | 0.6296 | EPCAM AND NOT-SLCO1C1 | Breast | 0.6116 | 0.5522 | 0.6852 |
| EPCAM AND NOT-SLC16A9 | Breast | 0.68627 | 0.7292 | 0.6481 | EPCAM AND NOT-GABRA2 | Breast | 0.6074 | 0.5062 | 0.7593 |
| EPCAM AND NOT-CLCA4 | Breast | 0.67742 | 0.6 | 0.7778 | EPCAM AND NOT-SYT4 | Breast | 0.7167 | 0.6515 | 0.7963 |
| F2RL2 AND NOT-TYR | Breast | 0.67442 | 0.9063 | 0.537 | EPCAM AND NOT-ANPEP | Breast | 0.6232 | 0.5119 | 0.7963 |
| PRLR AND NOT-MET | Breast | 0.67327 | 0.7234 | 0.6296 | EPCAM AND NOT-HCN4 | Breast | 0.6043 | 0.4941 | 0.7778 |
| EPCAM AND NOT-TSPAN8 | Breast | 0.67308 | 0.7 | 0.6481 | TNFRSF12A AND NOT-ROR1 | Breast | 0.6271 | 0.5781 | 0.6852 |
| PRLR AND NOT-TYR | Breast | 0.67308 | 0.7 | 0.6481 | EPCAM AND NOT-SLC28A1 | Breast | 0.6232 | 0.5119 | 0.7963 |
| EPCAM AND NOT-KCNQ1 | Breast | 0.71186 | 0.6563 | 0.7778 | EPCAM AND NOT-OR1Q1 | Breast | 0.6087 | 0.5 | 0.7778 |
| EPCAM AND NOT-KCNE3 | Breast | 0.672 | 0.5915 | 0.7778 | EPCAM AND NOT-TAS2R1 | Breast | 0.6232 | 0.5119 | 0.7963 |
| F2RL2 AND NOT-ROR1 | Breast | 0.67442 | 0.9063 | 0.537 | EPCAM AND NOT-ADAM20 | Breast | 0.6299 | 0.5479 | 0.7407 |
| EPCAM AND NOT-CA4 | Breast | 0.76364 | 0.75 | 0.7778 | ALCAM AND NOT-MUC1 | Liver | 0.7143 | 0.625 | 0.8333 |
| EPCAM AND NOT-ATP10B | Breast | 0.68421 | 0.65 | 0.7222 | SLC30A10 AND NOT-MUC1 | Liver | 0.6667 | 1 | 0.5 |
| EPCAM AND NOT-PVRL3 | Breast | 0.66667 | 0.6491 | 0.6852 | ABCG8 AND NOT-MUC1 | Liver | 0.8 | 1 | 0.6667 |
| EPCAM AND NOT-BEST4 | Breast | 0.66142 | 0.5753 | 0.7778 | CLDN15 AND NOT-MUC1 | Liver | 0.8333 | 0.8333 | 0.8333 |
| EPCAM AND NOT-PIGR | Breast | 0.66116 | 0.597 | 0.7407 | SLC22A18 AND NOT-MUC1 | Liver | 1 | 1 | 1 |
| EPCAM AND NOT-BMP2 | Breast | 0.66116 | 0.597 | 0.7407 | SLC43A1 AND NOT-MUC1 | Liver | 1 | 1 | 1 |
| EPCAM AND NOT-CYP4F12 | Breast | 0.71186 | 0.6563 | 0.7778 | ALCAM AND NOT-MSLN | Liver | 0.7143 | 0.625 | 0.8333 |
| EPCAM AND NOT-TRHDE | Breast | 0.66071 | 0.6379 | 0.6852 | DIO1 AND NOT-MUC1 | Liver | 0.6 | 0.4286 | 1 |
| PMEPA1 AND NOT-TYR | Breast | 0.66055 | 0.6545 | 0.6667 | ABCG5 AND NOT-MUC1 | Liver | 0.75 | 0.6 | 1 |
| EPCAM AND NOT-UPK1B | Breast | 0.66129 | 0.5857 | 0.7593 | CLDN15 AND NOT-TNFRSF10A | Liver | 0.6667 | 0.5556 | 0.8333 |
| SLC4A2 AND NOT-TYR | Breast | 0.65217 | 0.7895 | 0.5556 | ENPP1 AND NOT-MUC1 | Liver | 0.6154 | 0.5714 | 0.6667 |
| EPCAM AND NOT-SMPD3 | Breast | 0.65152 | 0.5513 | 0.7963 | IFI6 AND NOT-GPC3 | Colon | 0.8333 | 0.7143 | 1 |
| EPCAM AND NOT-DUOX2 | Breast | 0.7 | 0.6364 | 0.7778 | MUC1 AND NOT-AGTR2 | Colon | 0.75 | 1 | 0.6 |
| EPCAM AND NOT-IL22RA1 | Breast | 0.64662 | 0.5443 | 0.7963 | PROCR AND NOT-GPC3 | Colon | 0.75 | 1 | 0.6 |
| EPCAM AND NOT-IL1R2 | Breast | 0.64407 | 0.5938 | 0.7037 | MUC1 AND NOT-EPHA10 | Colon | 0.75 | 1 | 0.6 |
| EPCAM AND NOT-SLC23A1 | Breast | 0.64407 | 0.5938 | 0.7037 | MUC1 AND NOT-KIRREL3 | Colon | 0.75 | 1 | 0.6 |
| EPCAM AND NOT-TSPAN7 | Breast | 0.66071 | 0.6379 | 0.6852 | MUC1 AND NOT-GUCY2D | Colon | 0.75 | 1 | 0.6 |
| EPCAM AND NOT-ADORA2B | Breast | 0.64122 | 0.5455 | 0.7778 | MUC1 AND NOT-ATP1B4 | Colon | 0.75 | 1 | 0.6 |
| EPCAM AND NOT-TMPRSS2 | Breast | 0.64078 | 0.6735 | 0.6111 | MUC1 AND NOT-ROS1 | Colon | 0.75 | 1 | 0.6 |
| MFSD10 AND NOT-MET | Breast | 0.64078 | 0.6735 | 0.6111 | MUC1 AND NOT-GABRA4 | Colon | 0.75 | 1 | 0.6 |
| EPCAM AND NOT-SLC17A4 | Breast | 0.65625 | 0.5676 | 0.7778 | ERBB2 AND NOT-OPCML | Colon | 0.75 | 1 | 0.6 |
| EPCAM AND NOT-GJB1 | Breast | 0.64078 | 0.6735 | 0.6111 | ERBB2 AND NOT-GALR2 | Colon | 0.75 | 1 | 0.6 |
| EPCAM AND NOT-SLC3A1 | Breast | 0.64348 | 0.6066 | 0.6852 | MUC1 AND NOT-JPH3 | Colon | 0.75 | 1 | 0.6 |
| SLC4A2 AND NOT-ROR1 | Breast | 0.63736 | 0.7838 | 0.537 | ERBB2 AND NOT-GPR78 | Colon | 0.75 | 1 | 0.6 |
| EPCAM AND NOT-TSPAN1 | Breast | 0.63704 | 0.5309 | 0.7963 | ERBB2 AND NOT-MPL | Colon | 0.75 | 1 | 0.6 |
| SLC5A6 AND NOT-TYR | Breast | 0.63636 | 0.625 | 0.6481 | ERBB2 AND NOT-ADCY8 | Colon | 0.75 | 1 | 0.6 |
| EPCAM AND NOT-RHBDL2 | Breast | 0.65649 | 0.5584 | 0.7963 | ERBB2 AND NOT-CLDN16 | Colon | 0.75 | 1 | 0.6 |
| EPCAM AND NOT-SLC5A1 | Breast | 0.65487 | 0.6271 | 0.6852 | MUC1 AND NOT-GRM1 | Colon | 0.75 | 1 | 0.6 |
| FGFR4 AND NOT-MUC1 | Liver | 0.8 | 1 | 0.6667 | MUC1 AND NOT-HTR5A | Colon | 0.75 | 1 | 0.6 |
| FGFR4 AND NOT-MSLN | Liver | 0.8 | 1 | 0.6667 | MUC1 AND NOT-SV2C | Colon | 0.75 | 1 | 0.6 |
| FGFR4 AND NOT-TNFRSF10A | Liver | 0.8 | 1 | 0.6667 | MUC1 AND NOT-KCNA10 | Colon | 0.75 | 1 | 0.6 |
| SLC4A2 AND NOT-MUC1 | Liver | 0.8 | 1 | 0.6667 | MUC1 AND NOT-PTPRT | Colon | 0.75 | 1 | 0.6 |
| LRP5 AND NOT-MUC1 | Liver | 0.83333 | 0.8333 | 0.8333 | ERBB2 AND NOT-HTR1D | Colon | 0.75 | 1 | 0.6 |
| CLPTM1 AND NOT-MUC1 | Liver | 0.90909 | 1 | 0.8333 | MUC1 AND NOT-LYPD1 | Colon | 0.75 | 1 | 0.6 |
| SEMA4G AND NOT-MUC1 | Liver | 0.625 | 0.5 | 0.8333 | ERBB2 AND NOT-OPRM1 | Colon | 0.75 | 1 | 0.6 |
| TMPRSS6 AND NOT-MUC1 | Liver | 0.66667 | 1 | 0.5 | MUC1 AND NOT-DCSTAMP | Colon | 0.6 | 0.6 | 0.6 |
| TMPRSS6 AND NOT-MSLN | Liver | 0.66667 | 1 | 0.5 | MUC1 AND NOT-NPHS1 | Colon | 0.6667 | 0.75 | 0.6 |
| ITPR2 AND NOT-MUC1 | Liver | 0.83333 | 0.8333 | 0.8333 | MUC1 AND NOT-ADAM30 | Colon | 0.6667 | 0.75 | 0.6 |
| ABCB11 AND NOT-MUC1 | Liver | 0.8 | 1 | 0.6667 | MUC1 AND NOT-NMBR | Colon | 0.75 | 1 | 0.6 |
| ABCC2 AND NOT-MUC1 | Liver | 1 | 1 | 1 | MUC1 AND NOT-SCN8A | Colon | 0.75 | 1 | 0.6 |
| TMPRSS6 AND NOT-TNFRSF10A | Liver | 0.66667 | 1 | 0.5 | MUC1 AND NOT-SLC30A8 | Colon | 0.75 | 1 | 0.6 |
| APOB AND NOT-MUC1 | Liver | 0.83333 | 0.8333 | 0.8333 | MUC1 AND NOT-OPRM1 | Colon | 0.75 | 1 | 0.6 |
| SLC4A2 AND NOT-TNFRSF10A | Liver | 0.8 | 1 | 0.6667 | MUC1 AND NOT-CLRN1 | Colon | 0.75 | 1 | 0.6 |
| SLC5A9 AND NOT-MUC1 | Liver | 0.72727 | 0.8 | 0.6667 | ERBB2 AND NOT-CRB2 | Colon | 0.75 | 1 | 0.6 |
| RHBG AND NOT-MUC1 | Liver | 0.66667 | 1 | 0.5 | MUC1 AND NOT-GABRD | Colon | 0.75 | 1 | 0.6 |
| LSR AND NOT-MUC1 | Liver | 0.90909 | 1 | 0.8333 | ERBB2 AND NOT-ABCG5 | Colon | 0.75 | 1 | 0.6 |
| SMO AND NOT-MUC1 | Liver | 0.66667 | 1 | 0.5 | LYPD1 AND NOT-EPHA2 | Glioma | 0.8769 | 0.9344 | 0.8261 |
| TM4SF5 AND NOT-MUC1 | Liver | 0.8 | 1 | 0.6667 | CDH11 AND NOT-EPHA2 | Glioma | 0.7287 | 0.7833 | 0.6812 |
| CLPTM1 AND NOT-TNFRSF10A | Liver | 0.90909 | 1 | 0.8333 | CDH11 AND NOT-MUC1 | Glioma | 0.7361 | 0.7067 | 0.7681 |
| TSPAN6 AND NOT-MUC1 | Liver | 0.90909 | 1 | 0.8333 | CSMD2 AND NOT-MUC1 | Glioma | 0.6765 | 0.6866 | 0.6667 |
| LRP5 AND NOT-TNFRSF10A | Liver | 0.83333 | 0.8333 | 0.8333 | CDH11 AND NOT-ERBB2 | Glioma | 0.7143 | 0.7042 | 0.7246 |
| SLC16A11 AND NOT-MSLN | Liver | 0.66667 | 1 | 0.5 | OXTR AND NOT-MUC1 | Glioma | 0.6475 | 0.6429 | 0.6522 |
| SLC16A11 AND NOT-MUC1 | Liver | 0.66667 | 1 | 0.5 | OXTR AND NOT-EPHA2 | Glioma | 0.6232 | 0.6232 | 0.6232 |
| TMUB1 AND NOT-TNFRSF10A | Liver | 0.8 | 1 | 0.6667 | F2R AND NOT-EPHA2 | Glioma | 0.6196 | 0.4957 | 0.8261 |
| SLC16A11 AND NOT-TNFRSF10A | Liver | 0.66667 | 1 | 0.5 | OXTR AND NOT-ERBB2 | Glioma | 0.662 | 0.6438 | 0.6812 |
| RHBG AND NOT-MSLN | Liver | 0.66667 | 1 | 0.5 | NPFFR1 AND NOT-EPHA2 | Glioma | 0.6923 | 0.6207 | 0.7826 |
| ITPR2 AND NOT-TNFRSF10A | Liver | 0.8 | 1 | 0.6667 | NPFFR1 AND NOT-MUC1 | Glioma | 0.6512 | 0.5437 | 0.8116 |

FIG. 10 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CDHR5 AND NOT-MUC1 | Liver | 0.92308 | 0.8571 | 1 | CD163 AND NOT-EPHA2 | Glioma | 0.6667 | 0.8444 | 0.5507 |
| CACFD1 AND NOT-MUC1 | Liver | 0.72727 | 0.8 | 0.6667 | NPFFR1 AND NOT-ERBB2 | Glioma | 0.7186 | 0.6122 | 0.8696 |
| FZD5 AND NOT-MUC1 | Liver | 0.90909 | 1 | 0.8333 | CD163 AND NOT-MUC1 | Glioma | 0.6667 | 0.7593 | 0.5942 |
| ABCC3 AND NOT-MUC1 | Liver | 0.76923 | 0.7143 | 0.8333 | CD33 AND NOT-TGFBI | AML | 0.8977 | 0.943 | 0.8566 |
| RHBG AND NOT-TNFRSF10A | Liver | 0.66667 | 1 | 0.5 | CD33 AND NOT-S1PR1 | AML | 0.894 | 0.9348 | 0.8566 |
| CLPTM1 AND NOT-MSLN | Liver | 0.90909 | 1 | 0.8333 | CD33 AND NOT-STEAP4 | AML | 0.9023 | 0.8851 | 0.9203 |
| PMEPA1 AND NOT-GPC3 | Colon | 0.88889 | 1 | 0.8 | CD33 AND NOT-BTN3A1 | AML | 0.9398 | 0.9474 | 0.9323 |
| SLC12A2 AND NOT-GPC3 | Colon | 0.75 | 1 | 0.6 | CD33 AND NOT-BTN3A3 | AML | 0.9388 | 0.9623 | 0.9163 |
| SLC12A2 AND NOT-ERBB2 | Colon | 0.75 | 1 | 0.6 | CD33 AND NOT-IFNAR2 | AML | 0.9053 | 0.9598 | 0.8566 |
| LY6G6D AND NOT-GPC3 | Colon | 0.75 | 1 | 0.6 | CD33 AND NOT-LAT | AML | 0.8986 | 0.8968 | 0.9004 |
| MMP14 AND NOT-GPC3 | Colon | 0.75 | 1 | 0.6 | CD33 AND NOT-PIK3IP1 | AML | 0.8718 | 0.8633 | 0.8805 |
| CRB3 AND NOT-MUC1 | Colon | 0.66667 | 0.75 | 0.6 | CD33 AND NOT-SEMA4D | AML | 0.8814 | 0.8357 | 0.9323 |
| TNFSF15 AND NOT-GPC3 | Colon | 0.75 | 1 | 0.6 | CD33 AND NOT-ATP7A | AML | 0.8716 | 0.8517 | 0.8924 |
| EPHB4 AND NOT-GPC3 | Colon | 0.8 | 0.8 | 0.8 | CD33 AND NOT-FLVCR1 | AML | 0.8305 | 0.7956 | 0.8685 |
| SLC2A8 AND NOT-GPC3 | Colon | 0.75 | 1 | 0.6 | CD33 AND NOT-MSMO1 | AML | 0.8187 | 0.8375 | 0.8008 |
| LY6G6D AND NOT-ERBB2 | Colon | 0.75 | 1 | 0.6 | CD33 AND NOT-KCNK6 | AML | 0.8139 | 0.7222 | 0.9323 |
| KCNN4 AND NOT-GPC3 | Colon | 0.72727 | 0.6667 | 0.8 | CD33 AND NOT-SEMA4B | AML | 0.8112 | 0.7227 | 0.9243 |
| SIGMAR1 AND NOT-GPC3 | Colon | 0.8 | 0.8 | 0.8 | CD33 AND NOT-SYT11 | AML | 0.8512 | 0.8071 | 0.9004 |
| MUC1 AND NOT-CLCA2 | Colon | 0.75 | 1 | 0.6 | CD33 AND NOT-FMNL1 | AML | 0.8427 | 0.7715 | 0.9283 |
| LY6G6D AND NOT-MUC1 | Colon | 0.75 | 1 | 0.6 | CD33 AND NOT-CD74 | AML | 0.8286 | 0.7508 | 0.9243 |
| MUC1 AND NOT-S1PR2 | Colon | 0.75 | 1 | 0.6 | CD33 AND NOT-SELP | AML | 0.8101 | 0.7887 | 0.8327 |
| SLC5A6 AND NOT-GPC3 | Colon | 0.6 | 0.6 | 0.6 | CD33 AND NOT-SLC22A5 | AML | 0.8423 | 0.7655 | 0.9363 |
| MUC1 AND NOT-CTLA4 | Colon | 0.75 | 1 | 0.6 | CD33 AND NOT-AGER | AML | 0.802 | 0.7015 | 0.9363 |
| ERBB2 AND NOT-PLA2R1 | Colon | 0.75 | 1 | 0.6 | CD33 AND NOT-PPAPDC1B | AML | 0.8124 | 0.8419 | 0.7849 |
| SLC39A4 AND NOT-ERBB2 | Colon | 0.6 | 0.6 | 0.6 | CD33 AND NOT-ATP8B1 | AML | 0.7932 | 0.6903 | 0.9323 |
| ERBB2 AND NOT-P2RY1 | Colon | 0.75 | 1 | 0.6 | CD33 AND NOT-AOC3 | AML | 0.7932 | 0.6903 | 0.9323 |
| MUC1 AND NOT-ITGAL | Colon | 0.75 | 1 | 0.6 | CD33 AND NOT-SLC31A1 | AML | 0.789 | 0.6928 | 0.9163 |
| MUC1 AND NOT-CLECL1 | Colon | 0.75 | 1 | 0.6 | CD33 AND NOT-SLC38A1 | AML | 0.7978 | 0.7294 | 0.8805 |
| ERBB2 AND NOT-GABRE | Colon | 0.66667 | 0.75 | 0.6 | CD33 AND NOT-CDH11 | AML | 0.786 | 0.6772 | 0.9363 |
| MUC1 AND NOT-TNFRSF10C | Colon | 0.75 | 1 | 0.6 | CD33 AND NOT-SCARA5 | AML | 0.7833 | 0.6734 | 0.9363 |
| VANGL2 AND NOT-ERBB2 | Glioblastoma | 0.61538 | 0.8889 | 0.4706 | CD33 AND NOT-MRGPRF | AML | 0.782 | 0.6714 | 0.9363 |
| AQP4 AND NOT-ERBB2 | Glioblastoma | 0.60465 | 0.5 | 0.7647 | CD33 AND NOT-LRIG3 | AML | 0.7807 | 0.6695 | 0.9363 |
| JAM2 AND NOT-ERBB2 | Glioblastoma | 0.77419 | 0.8571 | 0.7059 | CD33 AND NOT-SLC50A1 | AML | 0.7795 | 0.6826 | 0.9084 |
| HRH1 AND NOT-ERBB2 | Glioblastoma | 0.66667 | 0.9 | 0.5294 | CD33 AND NOT-PLVAP | AML | 0.7794 | 0.6676 | 0.9363 |
| OR51B6 AND NOT-CD19 | Glioblastoma | 0.78049 | 0.6667 | 0.9412 | CD33 AND NOT-GHR | AML | 0.7785 | 0.6725 | 0.9243 |
| PON2 AND NOT-ERBB2 | Glioblastoma | 0.68085 | 0.5333 | 0.9412 | CD33 AND NOT-SLC6A6 | AML | 0.7781 | 0.6657 | 0.9363 |
| PTPRZ1 AND NOT-ERBB2 | Glioma | 0.9781 | 0.9853 | 0.971 | CD33 AND NOT-CD163 | AML | 0.7824 | 0.9337 | 0.6733 |
| PTPRZ1 AND NOT-MUC1 | Glioma | 0.98551 | 0.9855 | 0.9855 | CD33 AND NOT-IL17RA | AML | 0.7736 | 0.6716 | 0.9124 |
| NRCAM AND NOT-EPHA2 | Glioma | 0.91729 | 0.9531 | 0.8841 | CD33 AND NOT-PAQR8 | AML | 0.8674 | 0.9196 | 0.8207 |
| PTPRZ1 AND NOT-EPHA2 | Glioma | 0.97059 | 0.9851 | 0.9565 | CD33 AND NOT-FXYD6 | AML | 0.7679 | 0.6609 | 0.9163 |
| PCDHB10 AND NOT-MUC1 | Glioma | 0.896 | 1 | 0.8116 | CD33 AND NOT-TNFRSF10B | AML | 0.7642 | 0.6456 | 0.9363 |
| PCDHB10 AND NOT-EPHA2 | Glioma | 0.90476 | 1 | 0.8261 | CD33 AND NOT-SLC9A1 | AML | 0.7642 | 0.6456 | 0.9363 |
| PCDHB10 AND NOT-ERBB2 | Glioma | 0.896 | 1 | 0.8116 | CD33 AND NOT-ZACN | AML | 0.763 | 0.6438 | 0.9363 |
| PON2 AND NOT-MUC1 | Glioma | 0.96241 | 1 | 0.9275 | CD33 AND NOT-ESAM | AML | 0.763 | 0.6438 | 0.9363 |
| GOLM1 AND NOT-MUC1 | Glioma | 0.93333 | 0.9545 | 0.913 | CD33 AND NOT-CXCL16 | AML | 0.7585 | 0.81 | 0.7131 |
| JAM2 AND NOT-EPHA2 | Glioma | 0.84034 | 1 | 0.7246 | CD33 AND NOT-PROCR | AML | 0.7556 | 0.6617 | 0.8805 |
| SRR AND NOT-ERBB2 | Glioma | 0.79195 | 0.7375 | 0.8551 | CD33 AND NOT-IL15RA | AML | 0.7402 | 0.645 | 0.8685 |
| JAM2 AND NOT-MUC1 | Glioma | 0.90476 | 1 | 0.8261 | CD33 AND NOT-SLC16A5 | AML | 0.733 | 0.6522 | 0.8367 |
| SGCB AND NOT-EPHA2 | Glioma | 0.85507 | 0.8551 | 0.8551 | CD33 AND NOT-ZDHHC2 | AML | 0.7183 | 0.7154 | 0.7211 |
| TREM2 AND NOT-MUC1 | Glioma | 0.90625 | 0.9831 | 0.8406 | CD33 AND NOT-ANPEP | AML | 0.7027 | 0.6414 | 0.7769 |
| SRR AND NOT-MUC1 | Glioma | 0.77551 | 0.7308 | 0.8261 | CD33 AND NOT-SORL1 | AML | 0.6992 | 0.6858 | 0.7131 |
| PON2 AND NOT-EPHA2 | Glioma | 0.84034 | 1 | 0.7246 | CD33 AND NOT-BST2 | AML | 0.6974 | 0.7756 | 0.6335 |
| JAM2 AND NOT-ERBB2 | Glioma | 0.92188 | 1 | 0.8551 | CD33 AND NOT-THBD | AML | 0.6966 | 0.7512 | 0.6494 |
| SRR AND NOT-EPHA2 | Glioma | 0.76712 | 0.7273 | 0.8116 | CD33 AND NOT-SLC22A18 | AML | 0.6201 | 0.686 | 0.5657 |
| GOLM1 AND NOT-EPHA2 | Glioma | 0.8125 | 0.8814 | 0.7536 | CD33 AND NOT-IFI6 | AML | 0.6054 | 0.636 | 0.5777 |
| AQP4 AND NOT-MUC1 | Glioma | 0.79688 | 0.8644 | 0.7391 | CD19 AND NOT-CD93 | B-Cell Diffuse | 0.6875 | 0.8148 | 0.5946 |
| XPR1 AND NOT-ERBB2 | Glioma | 0.75641 | 0.6782 | 0.8551 | CD19 AND NOT-CCR9 | B-Cell Diffuse | 0.6667 | 0.8077 | 0.5676 |
| XPR1 AND NOT-EPHA2 | Glioma | 0.75472 | 0.6667 | 0.8696 | CD19 AND NOT-ACSL6 | B-Cell Diffuse | 0.6563 | 0.7778 | 0.5676 |
| XPR1 AND NOT-MUC1 | Glioma | 0.75 | 0.6593 | 0.8696 | CD19 AND NOT-GPR22 | B-Cell Diffuse | 0.6471 | 0.7097 | 0.5946 |
| PON2 AND NOT-ERBB2 | Glioma | 0.90476 | 1 | 0.8261 | CD19 AND NOT-ATP8B2 | B-Cell Diffuse | 0.6462 | 0.75 | 0.5676 |
| LDLRAD3 AND NOT-ERBB2 | Glioma | 0.74214 | 0.6556 | 0.8551 | CD19 AND NOT-CNTNAP2 | B-Cell Diffuse | 0.6452 | 0.8 | 0.5405 |
| AQP4 AND NOT-EPHA2 | Glioma | 0.7874 | 0.8621 | 0.7246 | MS4A1 AND NOT-CCR9 | B-Cell Diffuse | 0.6389 | 0.6571 | 0.6216 |
| LRP4 AND NOT-ERBB2 | Glioma | 0.73394 | 1 | 0.5797 | CD19 AND NOT-DRD5 | B-Cell Diffuse | 0.6349 | 0.7692 | 0.5405 |
| ROM1 AND NOT-ERBB2 | Glioma | 0.73171 | 0.6316 | 0.8696 | CD19 AND NOT-BTN3A1 | B-Cell Diffuse | 0.6207 | 0.8571 | 0.4865 |
| ATP2A2 AND NOT-EPHA2 | Glioma | 0.76106 | 0.9773 | 0.6232 | CD19 AND NOT-ATP8A2 | B-Cell Diffuse | 0.6154 | 0.7143 | 0.5405 |
| LDLRAD3 AND NOT-EPHA2 | Glioma | 0.72848 | 0.6707 | 0.7971 | MS4A1 AND NOT-PAQR8 | B-Cell Diffuse | 0.6133 | 0.6053 | 0.6216 |
| FAM57A AND NOT-EPHA2 | Glioma | 0.816 | 0.9107 | 0.7391 | MS4A1 AND NOT-CNTNAP2 | B-Cell Diffuse | 0.6111 | 0.6286 | 0.5946 |
| PTPRG AND NOT-EPHA2 | Glioma | 0.74783 | 0.9348 | 0.6232 | CD19 AND NOT-BTN3A3 | B-Cell Diffuse | 0.6102 | 0.8182 | 0.4865 |
| SLC16A2 AND NOT-EPHA2 | Glioma | 0.72593 | 0.7424 | 0.7101 | CD19 AND NOT-SLC16A5 | B-Cell Diffuse | 0.6102 | 0.8182 | 0.4865 |
| ROM1 AND NOT-EPHA2 | Glioma | 0.72483 | 0.675 | 0.7826 | MS4A1 AND NOT-DSC1 | B-Cell Diffuse | 0.6061 | 0.6897 | 0.5405 |
| PCDH17 AND NOT-EPHA2 | Glioma | 0.72393 | 0.6277 | 0.8551 | CD19 AND NOT-CD1A | B-Cell Diffuse | 0.6032 | 0.7308 | 0.5135 |
| FZD3 AND NOT-MUC1 | Glioma | 0.72258 | 0.6512 | 0.8116 | CD19 AND NOT-PPAPDC1B | B-Cell Diffuse | 0.6 | 0.7826 | 0.4865 |
| PCDH17 AND NOT-MUC1 | Glioma | 0.72189 | 0.61 | 0.8841 | CD19 AND NOT-MPL | B-Cell Diffuse | 0.6 | 0.7826 | 0.4865 |
| TSPAN6 AND NOT-EPHA2 | Glioma | 0.78261 | 0.9783 | 0.6522 | CD19 AND NOT-SEMA4B | Mantle-Cell Lymphoma | 0.9143 | 1 | 0.8421 |
| SLC16A2 AND NOT-MUC1 | Glioma | 0.78378 | 0.7342 | 0.8406 | CD19 AND NOT-KCNC2 | Mantle-Cell Lymphoma | 0.8986 | 1 | 0.8158 |
| TREM2 AND NOT-EPHA2 | Glioma | 0.84298 | 0.9808 | 0.7391 | CD19 AND NOT-CD1A | Mantle-Cell Lymphoma | 0.9143 | 1 | 0.8421 |
| FZD3 AND NOT-EPHA2 | Glioma | 0.71429 | 0.6471 | 0.7971 | CD19 AND NOT-SYT6 | Mantle-Cell Lymphoma | 0.8986 | 1 | 0.8158 |

FIG. 10 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| MERTK AND NOT-EPHA2 | Glioma | 0.77586 | 0.9574 | 0.6522 | CD19 AND NOT-GPR78 | Mantle-Cell Lymphoma | 0.8986 | 1 | 0.8158 |
| TENM4 AND NOT-EPHA2 | Glioma | 0.79389 | 0.8387 | 0.7536 | CD19 AND NOT-CD82 | Mantle-Cell Lymphoma | 0.8986 | 1 | 0.8158 |
| SLC16A2 AND NOT-ERBB2 | Glioma | 0.79195 | 0.7375 | 0.8551 | CD19 AND NOT-SLC32A1 | Mantle-Cell Lymphoma | 0.9143 | 1 | 0.8421 |
| TENM4 AND NOT-ERBB2 | Glioma | 0.80303 | 0.8413 | 0.7681 | CD19 AND NOT-CACNG4 | Mantle-Cell Lymphoma | 0.9143 | 1 | 0.8421 |
| LRP4 AND NOT-MUC1 | Glioma | 0.71028 | 1 | 0.5507 | CD19 AND NOT-SORL1 | Mantle-Cell Lymphoma | 0.8986 | 1 | 0.8158 |
| MERTK AND NOT-MUC1 | Glioma | 0.79389 | 0.8387 | 0.7536 | MLANA AND NOT-NOX1 | Melanoma | 1 | 1 | 1 |
| PTPRG AND NOT-MUC1 | Glioma | 0.704 | 0.7857 | 0.6377 | MLANA AND NOT-ATP13A5 | Melanoma | 1 | 1 | 1 |
| TENM4 AND NOT-MUC1 | Glioma | 0.78462 | 0.8361 | 0.7391 | MLANA AND NOT-NPFFR1 | Melanoma | 1 | 1 | 1 |
| ABHD12 AND NOT-ERBB2 | Glioma | 0.77193 | 0.9778 | 0.6377 | MLANA AND NOT-NMUR2 | Melanoma | 1 | 1 | 1 |
| ABHD12 AND NOT-EPHA2 | Glioma | 0.75 | 0.9767 | 0.6087 | MLANA AND NOT-GHR | Melanoma | 1 | 1 | 1 |
| ABHD12 AND NOT-MUC1 | Glioma | 0.72727 | 0.9756 | 0.5797 | MLANA AND NOT-SCARA5 | Melanoma | 1 | 1 | 1 |
| GOLM1 AND NOT-ERBB2 | Glioma | 0.90226 | 0.9375 | 0.8696 | MLANA AND NOT-OR10J1 | Melanoma | 1 | 1 | 1 |
| TMEM231 AND NOT-ERBB2 | Glioma | 0.69737 | 0.6386 | 0.7681 | MLANA AND NOT-CDH20 | Melanoma | 1 | 1 | 1 |
| LDLRAD3 AND NOT-MUC1 | Glioma | 0.69281 | 0.631 | 0.7681 | MLANA AND NOT-HTR1E | Melanoma | 1 | 1 | 1 |
| MERTK AND NOT-ERBB2 | Glioma | 0.79389 | 0.8387 | 0.7536 | MLANA AND NOT-TMEM235 | Melanoma | 1 | 1 | 1 |
| TMEM231 AND NOT-MUC1 | Glioma | 0.68966 | 0.6579 | 0.7246 | MLANA AND NOT-CCKBR | Melanoma | 1 | 1 | 1 |
| TSPAN6 AND NOT-MUC1 | Glioma | 0.83453 | 0.8286 | 0.8406 | MLANA AND NOT-NKAIN2 | Melanoma | 0.9524 | 1 | 0.9091 |
| ADORA3 AND NOT-EPHA2 | Glioma | 0.73438 | 0.7966 | 0.6812 | MLANA AND NOT-KCND2 | Melanoma | 0.9524 | 1 | 0.9091 |
| DISP1 AND NOT-EPHA2 | Glioma | 0.68657 | 0.7077 | 0.6667 | MLANA AND NOT-BEST3 | Melanoma | 0.9524 | 1 | 0.9091 |
| SEMA5A AND NOT-ERBB2 | Glioma | 0.68571 | 1 | 0.5217 | MLANA AND NOT-RGSL1 | Melanoma | 1 | 1 | 1 |
| GPR34 AND NOT-EPHA2 | Glioma | 0.8 | 0.8929 | 0.7246 | MLANA AND NOT-KCNF1 | Melanoma | 1 | 1 | 1 |
| SLC6A9 AND NOT-ERBB2 | Glioma | 0.72368 | 0.6627 | 0.7971 | MLANA AND NOT-EPHA10 | Melanoma | 1 | 1 | 1 |
| GPR161 AND NOT-EPHA2 | Glioma | 0.68056 | 0.6533 | 0.7101 | MLANA AND NOT-GPR26 | Melanoma | 1 | 1 | 1 |
| SLC6A9 AND NOT-EPHA2 | Glioma | 0.68027 | 0.641 | 0.7246 | MLANA AND NOT-KCNA10 | Melanoma | 1 | 1 | 1 |
| ROM1 AND NOT-MUC1 | Glioma | 0.67901 | 0.5914 | 0.7971 | MLANA AND NOT-CRB2 | Melanoma | 1 | 1 | 1 |
| ATP2A2 AND NOT-ERBB2 | Glioma | 0.77165 | 0.8448 | 0.7101 | MLANA AND NOT-HTR6 | Melanoma | 1 | 1 | 1 |
| PTPRG AND NOT-ERBB2 | Glioma | 0.736 | 0.8214 | 0.6667 | MLANA AND NOT-GRIK4 | Melanoma | 1 | 1 | 1 |
| TMEM100 AND NOT-EPHA2 | Glioma | 0.70866 | 0.7759 | 0.6522 | MLANA AND NOT-GRIN1 | Melanoma | 1 | 1 | 1 |
| TMEM231 AND NOT-EPHA2 | Glioma | 0.67606 | 0.6575 | 0.6957 | MLANA AND NOT-GRIN2B | Melanoma | 1 | 1 | 1 |
| SLC3A2 AND NOT-EPHA2 | Glioma | 0.73684 | 0.9333 | 0.6087 | MLANA AND NOT-PCDHB1 | Melanoma | 1 | 1 | 1 |
| SEMA5A AND NOT-MUC1 | Glioma | 0.67308 | 1 | 0.5072 | MLANA AND NOT-SLC6A18 | Melanoma | 1 | 1 | 1 |
| LRP4 AND NOT-EPHA2 | Glioma | 0.67308 | 1 | 0.5072 | MLANA AND NOT-HTR5A | Melanoma | 1 | 1 | 1 |
| VANGL2 AND NOT-ERBB2 | Glioma | 0.67257 | 0.8636 | 0.5507 | MLANA AND NOT-HTR1D | Melanoma | 1 | 1 | 1 |
| GPR161 AND NOT-ERBB2 | Glioma | 0.70833 | 0.68 | 0.7391 | MLANA AND NOT-HCN4 | Melanoma | 1 | 1 | 1 |
| WDR19 AND NOT-EPHA2 | Glioma | 0.78571 | 0.7746 | 0.7971 | MLANA AND NOT-GPR78 | Melanoma | 1 | 1 | 1 |
| TMEM100 AND NOT-MUC1 | Glioma | 0.71318 | 0.7667 | 0.6667 | MLANA AND NOT-CACNG4 | Melanoma | 1 | 1 | 1 |
| PODXL AND NOT-MUC1 | Glioma | 0.74074 | 0.7576 | 0.7246 | MLANA AND NOT-SEZ6 | Melanoma | 1 | 1 | 1 |
| CD33 AND NOT-IL4R | AML | 0.88655 | 0.9378 | 0.8406 | MLANA AND NOT-CNGA4 | Melanoma | 1 | 1 | 1 |
| CD33 AND NOT-AMIGO2 | AML | 0.92585 | 0.9315 | 0.9203 | MLANA AND NOT-SLC32A1 | Melanoma | 1 | 1 | 1 |
| CD33 AND NOT-NPC1 | AML | 0.90722 | 0.9402 | 0.8765 | MLANA AND NOT-CLDN19 | Melanoma | 1 | 1 | 1 |
| CD33 AND NOT-GPR171 | AML | 0.92901 | 0.9463 | 0.9124 | MLANA AND NOT-CYP4A11 | Melanoma | 1 | 1 | 1 |
| CD33 AND NOT-ADTRP | AML | 0.91977 | 0.9038 | 0.9363 | MLANA AND NOT-OR1Q1 | Melanoma | 1 | 1 | 1 |
| CD33 AND NOT-STX7 | AML | 0.94715 | 0.9668 | 0.9283 | MLANA AND NOT-SLC5A8 | Melanoma | 1 | 1 | 1 |
| CD33 AND NOT-ST3GAL5 | AML | 0.91383 | 0.9194 | 0.9084 | MLANA AND NOT-LRRN4 | Melanoma | 1 | 1 | 1 |
| CD33 AND NOT-IL7R | AML | 0.92857 | 0.9249 | 0.9323 | MLANA AND NOT-GPR156 | Melanoma | 1 | 1 | 1 |
| CD33 AND NOT-SLC41A1 | AML | 0.87398 | 0.8921 | 0.8566 | MLANA AND NOT-FGF6 | Melanoma | 1 | 1 | 1 |
| CD33 AND NOT-DPP4 | AML | 0.92771 | 0.9352 | 0.9203 | MLANA AND NOT-KCNH4 | Melanoma | 1 | 1 | 1 |
| CD33 AND NOT-IFITM1 | AML | 0.87794 | 0.9491 | 0.8167 | MLANA AND NOT-FSHR | Melanoma | 1 | 1 | 1 |
| CD33 AND NOT-SLC44A2 | AML | 0.90873 | 0.9051 | 0.9124 | MLANA AND NOT-CALHM1 | Melanoma | 1 | 1 | 1 |
| CD33 AND NOT-CRTAM | AML | 0.89613 | 0.9167 | 0.8765 | MLANA AND NOT-OR1C1 | Melanoma | 1 | 1 | 1 |
| CD33 AND NOT-C6orf89 | AML | 0.8632 | 0.8358 | 0.8924 | MLANA AND NOT-OR2L2 | Melanoma | 1 | 1 | 1 |
| CD33 AND NOT-BTN3A2 | AML | 0.93443 | 0.962 | 0.9084 | MLANA AND NOT-TSPAN16 | Melanoma | 1 | 1 | 1 |
| CD33 AND NOT-KLRB1 | AML | 0.88085 | 0.9452 | 0.8247 | MLANA AND NOT-GHSR | Melanoma | 1 | 1 | 1 |
| CD33 AND NOT-GPR18 | AML | 0.88247 | 0.9145 | 0.8526 | MLANA AND NOT-AMHR2 | Melanoma | 1 | 1 | 1 |
| CD33 AND NOT-MAL | AML | 0.89655 | 0.9132 | 0.8805 | MLANA AND NOT-KCNJ9 | Melanoma | 1 | 1 | 1 |
| CD33 AND NOT-VIPR1 | AML | 0.86312 | 0.8255 | 0.9044 | MLANA AND NOT-KCNH1 | Melanoma | 1 | 1 | 1 |
| CD33 AND NOT-LTB | AML | 0.88136 | 0.9412 | 0.8287 | MLANA AND NOT-OR52D1 | Melanoma | 1 | 1 | 1 |
| CD33 AND NOT-CD2 | AML | 0.924 | 0.9277 | 0.9203 | MLANA AND NOT-KCNQ2 | Melanoma | 1 | 1 | 1 |
| CD33 AND NOT-RER1 | AML | 0.85657 | 0.8689 | 0.8446 | MLANA AND NOT-CALN1 | Melanoma | 1 | 1 | 1 |
| CD33 AND NOT-EPHA4 | AML | 0.90909 | 0.8835 | 0.9363 | MLANA AND NOT-SLC1A6 | Melanoma | 1 | 1 | 1 |
| CD33 AND NOT-IFNAR1 | AML | 0.90945 | 0.8988 | 0.9203 | MLANA AND NOT-SLC10A1 | Melanoma | 1 | 1 | 1 |
| CD33 AND NOT-PLXDC1 | AML | 0.89524 | 0.8577 | 0.9363 | MLANA AND NOT-SLC10A2 | Melanoma | 1 | 1 | 1 |
| CD33 AND NOT-PTGDR | AML | 0.92857 | 0.9249 | 0.9323 | MLANA AND NOT-SLC34A1 | Melanoma | 0.9524 | 1 | 0.9091 |
| CD33 AND NOT-KLRF1 | AML | 0.91235 | 0.9124 | 0.9124 | MLANA AND NOT-SLC22A5 | Melanoma | 1 | 1 | 1 |
| CD33 AND NOT-HMOX2 | AML | 0.88168 | 0.8462 | 0.9203 | MLANA AND NOT-UPK3A | Melanoma | 1 | 1 | 1 |
| CD33 AND NOT-TNFSF10 | AML | 0.88492 | 0.8814 | 0.8884 | MLANA AND NOT-CACNA1S | Melanoma | 1 | 1 | 1 |
| CD33 AND NOT-SLC46A2 | AML | 0.88588 | 0.8609 | 0.9124 | MLANA AND NOT-PCDH11Y | Melanoma | 0.9524 | 1 | 0.9091 |
| CD33 AND NOT-IL2RB | AML | 0.91235 | 0.9124 | 0.9124 | MLANA AND NOT-GJA10 | Melanoma | 1 | 1 | 1 |
| CD33 AND NOT-CD274 | AML | 0.8785 | 0.8275 | 0.9363 | MLANA AND NOT-GPR135 | Melanoma | 1 | 1 | 1 |
| CD33 AND NOT-MFAP3L | AML | 0.90485 | 0.8826 | 0.9283 | MLANA AND NOT-CASR | Melanoma | 1 | 1 | 1 |
| CD33 AND NOT-TRPC1 | AML | 0.85926 | 0.8028 | 0.9243 | MLANA AND NOT-CCKAR | Melanoma | 1 | 1 | 1 |
| CD33 AND NOT-BMPR2 | AML | 0.8486 | 0.7993 | 0.9044 | MLANA AND NOT-SLC28A1 | Melanoma | 1 | 1 | 1 |
| CD33 AND NOT-SLC16A6 | AML | 0.84889 | 0.9598 | 0.761 | MLANA AND NOT-GPR50 | Melanoma | 1 | 1 | 1 |
| CD33 AND NOT-VAPA | AML | 0.85775 | 0.9182 | 0.8048 | MLANA AND NOT-SLC22A6 | Melanoma | 1 | 1 | 1 |
| CD33 AND NOT-SIRPG | AML | 0.91406 | 0.8966 | 0.9323 | MLANA AND NOT-OTOF | Melanoma | 1 | 1 | 1 |
| CD33 AND NOT-CD28 | AML | 0.92615 | 0.928 | 0.9243 | MLANA AND NOT-SLC22A13 | Melanoma | 1 | 1 | 1 |
| CD33 AND NOT-SLC17A5 | AML | 0.85246 | 0.7852 | 0.9323 | MLANA AND NOT-IGDCC3 | Melanoma | 1 | 1 | 1 |

FIG. 10 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CD33 AND NOT-P2RY10 | AML | 0.92247 | 0.9206 | 0.9243 | MLANA AND NOT-GABBR2 | Melanoma | 1 | 1 | 1 |
| CD33 AND NOT-PROS1 | AML | 0.8743 | 0.8262 | 0.9283 | MLANA AND NOT-SLC1A2 | Melanoma | 0.9524 | 1 | 0.9091 |
| CD33 AND NOT-ABHD6 | AML | 0.87199 | 0.816 | 0.9363 | MLANA AND NOT-ABCG8 | Melanoma | 1 | 1 | 1 |
| CD33 AND NOT-CD247 | AML | 0.91235 | 0.9124 | 0.9124 | MLANA AND NOT-CALHM3 | Melanoma | 1 | 1 | 1 |
| CD33 AND NOT-LAMP3 | AML | 0.86876 | 0.8103 | 0.9363 | MLANA AND NOT-RXFP3 | Melanoma | 1 | 1 | 1 |
| CD33 AND NOT-FPR1 | AML | 0.84979 | 0.9209 | 0.7888 | MLANA AND NOT-MC2R | Melanoma | 1 | 1 | 1 |
| CD33 AND NOT-CD8A | AML | 0.91235 | 0.9124 | 0.9124 | MLANA AND NOT-MIP | Melanoma | 1 | 1 | 1 |
| CD33 AND NOT-ICOS | AML | 0.904 | 0.9076 | 0.9004 | MLANA AND NOT-MPL | Melanoma | 0.9524 | 1 | 0.9091 |
| CD33 AND NOT-TNFRSF1A | AML | 0.84381 | 0.8595 | 0.8287 | MLANA AND NOT-OR3A1 | Melanoma | 1 | 1 | 1 |
| CD33 AND NOT-CD27 | AML | 0.91732 | 0.9066 | 0.9283 | MLANA AND NOT-P2RX3 | Melanoma | 1 | 1 | 1 |
| CD33 AND NOT-PMEPA1 | AML | 0.85714 | 0.7932 | 0.9323 | MLANA AND NOT-P2RY4 | Melanoma | 0.9524 | 1 | 0.9091 |
| CD33 AND NOT-AQP3 | AML | 0.86076 | 0.9148 | 0.8127 | MLANA AND NOT-CALY | Melanoma | 1 | 1 | 1 |
| CD33 AND NOT-KLRD1 | AML | 0.92338 | 0.9109 | 0.9363 | MLANA AND NOT-KCNK4 | Melanoma | 1 | 1 | 1 |
| CD33 AND NOT-CD8B | AML | 0.917 | 0.9098 | 0.9243 | MLANA AND NOT-PCDH8 | Melanoma | 1 | 1 | 1 |
| CD33 AND NOT-TSPAN18 | AML | 0.84229 | 0.7655 | 0.9363 | MLANA AND NOT-ATP8B1 | Melanoma | 1 | 1 | 1 |
| CD33 AND NOT-SIT1 | AML | 0.92673 | 0.9213 | 0.9323 | MLANA AND NOT-CACNG6 | Melanoma | 1 | 1 | 1 |
| CD33 AND NOT-ATP10D | AML | 0.87726 | 0.8862 | 0.8685 | MLANA AND NOT-BEST2 | Melanoma | 1 | 1 | 1 |
| CD33 AND NOT-SLC22A3 | AML | 0.84381 | 0.768 | 0.9363 | MLANA AND NOT-PCDHGC4 | Melanoma | 1 | 1 | 1 |
| CD33 AND NOT-TIGIT | AML | 0.89313 | 0.8571 | 0.9323 | MLANA AND NOT-PCDHAC2 | Melanoma | 0.9524 | 1 | 0.9091 |
| CD33 AND NOT-CCR6 | AML | 0.90173 | 0.8731 | 0.9323 | MLANA AND NOT-KCNK12 | Melanoma | 1 | 1 | 1 |
| CD33 AND NOT-BTLA | AML | 0.91945 | 0.907 | 0.9323 | MLANA AND NOT-GJD2 | Melanoma | 1 | 1 | 1 |
| CD33 AND NOT-LY9 | AML | 0.91262 | 0.8902 | 0.9363 | MLANA AND NOT-LRFN2 | Melanoma | 1 | 1 | 1 |
| CD33 AND NOT-NKG7 | AML | 0.88485 | 0.8975 | 0.8725 | MLANA AND NOT-SLC4A5 | Melanoma | 1 | 1 | 1 |
| CD33 AND NOT-PAG1 | AML | 0.91383 | 0.9194 | 0.9083 | MLANA AND NOT-CACNG8 | Melanoma | 1 | 1 | 1 |
| CD33 AND NOT-PTCH1 | AML | 0.89922 | 0.8755 | 0.9243 | MLANA AND NOT-CACNG7 | Melanoma | 1 | 1 | 1 |
| CD33 AND NOT-GLG1 | AML | 0.83951 | 0.8681 | 0.8127 | MLANA AND NOT-LRIG3 | Melanoma | 1 | 1 | 1 |
| CD33 AND NOT-DRAM2 | AML | 0.84567 | 0.9009 | 0.7968 | MLANA AND NOT-UMOD | Melanoma | 1 | 1 | 1 |
| CD33 AND NOT-TSPAN14 | AML | 0.83817 | 0.8745 | 0.8048 | GPR85 AND NOT-B4GALNT1 | Neuroblastoma | 0.7805 | 0.8 | 0.7619 |
| CD33 AND NOT-SLC38A6 | AML | 0.85421 | 0.8814 | 0.8287 | CACNA1B AND NOT-B4GALNT1 | Neuroblastoma | 0.7624 | 0.7113 | 0.8214 |
| CD33 AND NOT-FCRL3 | AML | 0.91765 | 0.9035 | 0.9323 | SLC6A15 AND NOT-B4GALNT1 | Neuroblastoma | 0.6961 | 0.6495 | 0.75 |
| CD33 AND NOT-KCNJ2 | AML | 0.89024 | 0.9087 | 0.8725 | KCNQ2 AND NOT-B4GALNT1 | Neuroblastoma | 0.6736 | 0.5963 | 0.7738 |
| CD33 AND NOT-IL6ST | AML | 0.83594 | 0.8199 | 0.8526 | B4GALNT1 AND NOT-NKAIN2 | Neuroblastoma | 0.6383 | 0.7895 | 0.5357 |
| CD33 AND NOT-TMX3 | AML | 0.88224 | 0.884 | 0.8805 | B4GALNT1 AND NOT-KCNA1 | Neuroblastoma | 0.6667 | 0.6923 | 0.6429 |
| CD33 AND NOT-PTPRCAP | AML | 0.84556 | 0.8202 | 0.8725 | B4GALNT1 AND NOT-GRM3 | Neuroblastoma | 0.6386 | 0.6463 | 0.631 |
| CD33 AND NOT-CD40LG | AML | 0.91228 | 0.8931 | 0.9323 | B4GALNT1 AND NOT-KCNA2 | Neuroblastoma | 0.6232 | 0.7963 | 0.5119 |
| CD33 AND NOT-VSIG1 | AML | 0.84079 | 0.763 | 0.9363 | B4GALNT1 AND NOT-CSMD3 | Neuroblastoma | 0.7101 | 0.9074 | 0.5833 |
| CD33 AND NOT-HVCN1 | AML | 0.89571 | 0.9202 | 0.8725 | B4GALNT1 AND NOT-GABRB2 | Neuroblastoma | 0.6369 | 0.6849 | 0.5952 |
| CD33 AND NOT-LGR6 | AML | 0.83696 | 0.7674 | 0.9203 | B4GALNT1 AND NOT-SLCO1C1 | Neuroblastoma | 0.6933 | 0.7879 | 0.619 |
| CD33 AND NOT-CD3G | AML | 0.92 | 0.9237 | 0.9163 | B4GALNT1 AND NOT-MLC1 | Neuroblastoma | 0.6391 | 0.6353 | 0.6429 |
| CD33 AND NOT-CLEC2D | AML | 0.92126 | 0.9105 | 0.9323 | B4GALNT1 AND NOT-DPP10 | Neuroblastoma | 0.6027 | 0.7097 | 0.5238 |
| CD33 AND NOT-FCGR2B | AML | 0.90683 | 0.944 | 0.8725 | B4GALNT1 AND NOT-KCNJ10 | Neuroblastoma | 0.6026 | 0.6528 | 0.5595 |
| CD33 AND NOT-TGFBR2 | AML | 0.84229 | 0.7655 | 0.9363 | EPHA10 AND NOT-ERBB2 | Ovarian | 0.6207 | 0.5294 | 0.75 |
| CD33 AND NOT-SLC16A10 | AML | 0.85662 | 0.7952 | 0.9283 | FOLH1 AND NOT-NTSR2 | Prostate | 0.6667 | 1 | 0.5 |
| CD33 AND NOT-TMEM204 | AML | 0.83186 | 0.7484 | 0.9363 | FOLH1 AND NOT-GRIN2C | Prostate | 0.8889 | 0.8 | 1 |
| CD33 AND NOT-ITPR3 | AML | 0.83186 | 0.7484 | 0.9363 | FOLH1 AND NOT-SLC6A13 | Prostate | 0.6667 | 1 | 0.5 |
| CD33 AND NOT-CD5 | AML | 0.90874 | 0.8864 | 0.9323 | FOLH1 AND NOT-SLC22A8 | Prostate | 0.6667 | 1 | 0.5 |
| CD33 AND NOT-BBS4 | AML | 0.83107 | 0.8106 | 0.8526 | FOLH1 AND NOT-C8B | Prostate | 0.8571 | 1 | 0.75 |
| CD33 AND NOT-FLT3LG | AML | 0.89101 | 0.8566 | 0.9283 | FOLH1 AND NOT-MEGF11 | Prostate | 0.6667 | 0.6 | 0.75 |
| CD33 AND NOT-ABCG1 | AML | 0.85214 | 0.8327 | 0.8725 | FOLH1 AND NOT-SLC13A5 | Prostate | 0.6667 | 0.6 | 0.75 |
| CD19 AND NOT-SCNN1D | B-Cell Diffuse | 0.72131 | 0.9167 | 0.5946 | FOLH1 AND NOT-PAQR8 | Prostate | 0.6154 | 0.4444 | 1 |
| CD19 AND NOT-CXCR2 | B-Cell Diffuse | 0.70968 | 0.88 | 0.5946 | FOLH1 AND NOT-SLC4A8 | Prostate | 0.8889 | 0.8 | 1 |
| CD19 AND NOT-ABCA2 | B-Cell Diffuse | 0.70968 | 0.88 | 0.5946 | FOLH1 AND NOT-SLC30A10 | Prostate | 0.8 | 0.6667 | 1 |
| CD19 AND NOT-CD244 | B-Cell Diffuse | 0.69841 | 0.8462 | 0.5946 | FOLH1 AND NOT-SLC1A2 | Prostate | 0.6667 | 0.6 | 0.75 |
| CD19 AND NOT-SLC46A2 | B-Cell Diffuse | 0.69841 | 0.8462 | 0.5946 | FOLH1 AND NOT-ATP13A5 | Prostate | 0.8571 | 1 | 0.75 |
| CD19 AND NOT-SLC24A1 | B-Cell Diffuse | 0.69841 | 0.8462 | 0.5946 | FOLH1 AND NOT-CD82 | Prostate | 0.8571 | 1 | 0.75 |
| CD19 AND NOT-S1PR5 | B-Cell Diffuse | 0.69841 | 0.8462 | 0.5946 | FOLH1 AND NOT-NRG3 | Prostate | 0.6667 | 0.6 | 0.75 |
| CD19 AND NOT-STX3 | B-Cell Diffuse | 0.69841 | 0.8462 | 0.5946 | FOLH1 AND NOT-CHRNA2 | Prostate | 0.6667 | 1 | 0.5 |
| CD19 AND NOT-FCER1A | B-Cell Diffuse | 0.68852 | 0.875 | 0.5676 | FOLH1 AND NOT-GRIN2A | Prostate | 0.6667 | 1 | 0.5 |
| CD19 AND NOT-BST1 | B-Cell Diffuse | 0.6875 | 0.8148 | 0.5946 | FOLH1 AND NOT-CLDN17 | Prostate | 0.6667 | 0.6 | 0.75 |
| CD19 AND NOT-TLR5 | B-Cell Diffuse | 0.6875 | 0.8148 | 0.5946 | FOLH1 AND NOT-SLCO1A2 | Prostate | 0.8571 | 1 | 0.75 |
| CD19 AND NOT-NAALAD2 | B-Cell Diffuse | 0.6875 | 0.8148 | 0.5946 | FOLH1 AND NOT-KIRREL3 | Prostate | 0.8571 | 1 | 0.75 |
| CD19 AND NOT-ITGA6 | B-Cell Diffuse | 0.6875 | 0.8148 | 0.5946 | FOLH1 AND NOT-SLC6A12 | Prostate | 0.75 | 0.75 | 0.75 |
| CD19 AND NOT-ASGR1 | B-Cell Diffuse | 0.67742 | 0.84 | 0.5676 | FOLH1 AND NOT-FMNL1 | Prostate | 0.75 | 0.75 | 0.75 |
| CD19 AND NOT-BTN2A1 | B-Cell Diffuse | 0.67742 | 0.84 | 0.5676 | FOLH1 AND NOT-OPALIN | Prostate | 0.8571 | 1 | 0.75 |
| CD19 AND NOT-ADAM23 | B-Cell Diffuse | 0.67742 | 0.84 | 0.5676 | FOLH1 AND NOT-SLC39A2 | Prostate | 0.8571 | 1 | 0.75 |
| CD19 AND NOT-SCIMP | B-Cell Diffuse | 0.67742 | 0.84 | 0.5676 | FOLH1 AND NOT-CNTNAP4 | Prostate | 0.8571 | 1 | 0.75 |
| CD19 AND NOT-TMIGD2 | B-Cell Diffuse | 0.67742 | 0.84 | 0.5676 | FOLH1 AND NOT-LCT | Prostate | 0.6667 | 0.6 | 0.75 |
| CD19 AND NOT-ANO8 | B-Cell Diffuse | 0.67742 | 0.84 | 0.5676 | FOLH1 AND NOT-OR1Q1 | Prostate | 0.8571 | 1 | 0.75 |
| CD19 AND NOT-MFAP3L | B-Cell Diffuse | 0.67692 | 0.7857 | 0.5946 | FOLH1 AND NOT-GJA10 | Prostate | 0.6 | 0.5 | 0.75 |
| CD19 AND NOT-GP9 | B-Cell Diffuse | 0.67692 | 0.7857 | 0.5946 | FOLH1 AND NOT-KCNJ10 | Prostate | 0.6667 | 1 | 0.5 |
| CD19 AND NOT-GPBAR1 | B-Cell Diffuse | 0.67692 | 0.7857 | 0.5946 | FOLH1 AND NOT-PIRT | Prostate | 0.6 | 0.5 | 0.75 |
| MS4A1 AND NOT-TSPAN32 | B-Cell Diffuse | 0.67647 | 0.7419 | 0.6216 | FOLH1 AND NOT-TTYH2 | Prostate | 0.6154 | 0.4444 | 1 |
| MS4A1 AND NOT-CD244 | B-Cell Diffuse | 0.66667 | 0.6857 | 0.6486 | FOLH1 AND NOT-KCNC1 | Prostate | 0.6 | 0.5 | 0.75 |
| MS4A1 AND NOT-SLC46A2 | B-Cell Diffuse | 0.66667 | 0.6857 | 0.6486 | FOLH1 AND NOT-SLC12A5 | Prostate | 0.6667 | 0.6 | 0.75 |
| MS4A1 AND NOT-ABCA2 | B-Cell Diffuse | 0.66667 | 0.6857 | 0.6486 | FOLH1 AND NOT-VN1R2 | Prostate | 0.8571 | 1 | 0.75 |
| CD19 AND NOT-CD300LB | B-Cell Diffuse | 0.66667 | 0.7586 | 0.5946 | FOLH1 AND NOT-MC2R | Prostate | 0.75 | 0.75 | 0.75 |
| CD19 AND NOT-CX3CR1 | B-Cell Diffuse | 0.66667 | 0.7586 | 0.5946 | FOLH1 AND NOT-MAG | Prostate | 0.6667 | 0.6 | 0.75 |

FIG. 10 (Cont.)

| Antigen Pair Logic | Cancer (short name) | F1 | Precision | Recall |
|---|---|---|---|---|
| MS4A1 AND NOT-RNF144A | B-Cell Diffuse | 0.66667 | 0.6857 | 0.6486 |
| CD19 AND NOT-SLC18A2 | B-Cell Diffuse | 0.66667 | 0.7586 | 0.5946 |
| MS4A1 AND NOT-BST1 | B-Cell Diffuse | 0.66667 | 0.6857 | 0.6486 |
| MS4A1 AND NOT-CXCR2 | B-Cell Diffuse | 0.66667 | 0.6857 | 0.6486 |
| CD19 AND NOT-TSPAN32 | B-Cell Diffuse | 0.66667 | 0.8077 | 0.5676 |
| CD19 AND NOT-C19orf26 | B-Cell Diffuse | 0.66667 | 0.8077 | 0.5676 |
| CD19 AND NOT-CCR3 | B-Cell Diffuse | 0.66667 | 0.8696 | 0.5405 |
| MS4A1 AND NOT-MFAP3L | B-Cell Diffuse | 0.65753 | 0.6667 | 0.6486 |
| MS4A1 AND NOT-ITGA6 | B-Cell Diffuse | 0.65753 | 0.6667 | 0.6486 |
| MS4A1 AND NOT-SIRPB1 | B-Cell Diffuse | 0.65753 | 0.6667 | 0.6486 |
| CD19 AND NOT-CLEC1B | B-Cell Diffuse | 0.65672 | 0.7333 | 0.5946 |
| CD19 AND NOT-SIRPB1 | B-Cell Diffuse | 0.65672 | 0.7333 | 0.5946 |
| CD19 AND NOT-SLC24A4 | B-Cell Diffuse | 0.65672 | 0.7333 | 0.5946 |
| CD19 AND NOT-PTGDR2 | B-Cell Diffuse | 0.65574 | 0.8333 | 0.5405 |
| CD19 AND NOT-MGAM | B-Cell Diffuse | 0.65574 | 0.8333 | 0.5405 |
| CD19 AND NOT-EPOR | B-Cell Diffuse | 0.65574 | 0.8333 | 0.5405 |
| CD19 AND NOT-IL1RAP | B-Cell Diffuse | 0.65574 | 0.8333 | 0.5405 |
| CD19 AND NOT-VIPR1 | B-Cell Diffuse | 0.65574 | 0.8333 | 0.5405 |
| CD19 AND NOT-RNF144A | B-Cell Diffuse | 0.65517 | 0.9048 | 0.5135 |
| MS4A1 AND NOT-S1PR5 | B-Cell Diffuse | 0.64865 | 0.6486 | 0.6486 |
| MS4A1 AND NOT-CX3CR1 | B-Cell Diffuse | 0.64865 | 0.6486 | 0.6486 |
| MS4A1 AND NOT-ASGR1 | B-Cell Diffuse | 0.64789 | 0.6765 | 0.6216 |
| MS4A1 AND NOT-CLEC1B | B-Cell Diffuse | 0.64789 | 0.6765 | 0.6216 |
| MS4A1 AND NOT-TMIGD2 | B-Cell Diffuse | 0.64789 | 0.6765 | 0.6216 |
| MS4A1 AND NOT-FCER1A | B-Cell Diffuse | 0.64789 | 0.6765 | 0.6216 |
| CD19 AND NOT-VSIG2 | B-Cell Diffuse | 0.64706 | 0.7097 | 0.5946 |
| CD19 AND NOT-LGR6 | B-Cell Diffuse | 0.64706 | 0.7097 | 0.5946 |
| CD19 AND NOT-AQP8 | Mantle-Cell Lymphoma | 0.91429 | 1 | 0.8421 |
| CD19 AND NOT-GPM6B | Mantle-Cell Lymphoma | 0.91429 | 1 | 0.8421 |
| CD19 AND NOT-TRPV2 | Mantle-Cell Lymphoma | 0.91429 | 1 | 0.8421 |
| CD19 AND NOT-MS4A2 | Mantle-Cell Lymphoma | 0.91429 | 1 | 0.8421 |
| CD19 AND NOT-FCER2 | Mantle-Cell Lymphoma | 0.91429 | 1 | 0.8421 |
| CD19 AND NOT-SLC52A3 | Mantle-Cell Lymphoma | 0.91429 | 1 | 0.8421 |
| CD19 AND NOT-LRRTM2 | Mantle-Cell Lymphoma | 0.91429 | 1 | 0.8421 |
| CD19 AND NOT-CYP4F12 | Mantle-Cell Lymphoma | 0.91429 | 1 | 0.8421 |
| MLANA AND NOT-RET | Melanoma | 1 | 1 | 1 |
| MLANA AND NOT-FAT4 | Melanoma | 1 | 1 | 1 |
| MLANA AND NOT-FRRS1L | Melanoma | 1 | 1 | 1 |
| MLANA AND NOT-PCDH18 | Melanoma | 1 | 1 | 1 |
| MLANA AND NOT-CADM2 | Melanoma | 1 | 1 | 1 |
| MLANA AND NOT-ABCC9 | Melanoma | 1 | 1 | 1 |
| MLANA AND NOT-FXYD4 | Melanoma | 1 | 1 | 1 |
| MLANA AND NOT-KCNK3 | Melanoma | 1 | 1 | 1 |
| MLANA AND NOT-SGMS1 | Melanoma | 1 | 1 | 1 |
| MLANA AND NOT-XG | Melanoma | 1 | 1 | 1 |
| MLANA AND NOT-CFTR | Melanoma | 1 | 1 | 1 |
| MLANA AND NOT-KCNB1 | Melanoma | 1 | 1 | 1 |
| MLANA AND NOT-ZP2 | Melanoma | 1 | 1 | 1 |
| MLANA AND NOT-PCDH19 | Melanoma | 1 | 1 | 1 |
| MLANA AND NOT-LY6G6D | Melanoma | 1 | 1 | 1 |
| MLANA AND NOT-GPRC5C | Melanoma | 1 | 1 | 1 |
| MLANA AND NOT-OR1J2 | Melanoma | 1 | 1 | 1 |
| MLANA AND NOT-AQP10 | Melanoma | 1 | 1 | 1 |
| MLANA AND NOT-GPR101 | Melanoma | 1 | 1 | 1 |
| MLANA AND NOT-CHRM2 | Melanoma | 1 | 1 | 1 |
| MLANA AND NOT-SGCG | Melanoma | 1 | 1 | 1 |
| MLANA AND NOT-NPR3 | Melanoma | 1 | 1 | 1 |
| MLANA AND NOT-BMP2 | Melanoma | 1 | 1 | 1 |
| MLANA AND NOT-TMEM100 | Melanoma | 1 | 1 | 1 |
| MLANA AND NOT-NPY5R | Melanoma | 1 | 1 | 1 |
| MLANA AND NOT-AGTR1 | Melanoma | 1 | 1 | 1 |
| MLANA AND NOT-IL31RA | Melanoma | 1 | 1 | 1 |
| MLANA AND NOT-HRH2 | Melanoma | 1 | 1 | 1 |
| MLANA AND NOT-ADCYAP1R1 | Melanoma | 1 | 1 | 1 |
| MLANA AND NOT-FAT3 | Melanoma | 1 | 1 | 1 |
| MLANA AND NOT-NTRK3 | Melanoma | 1 | 1 | 1 |
| MLANA AND NOT-FZD8 | Melanoma | 0.95238 | 1 | 0.9091 |
| MLANA AND NOT-SYT8 | Melanoma | 0.95238 | 1 | 0.9091 |
| MLANA AND NOT-GPRC5D | Melanoma | 0.95238 | 1 | 0.9091 |
| MLANA AND NOT-SGCA | Melanoma | 0.95238 | 1 | 0.9091 |
| MLANA AND NOT-OR51M1 | Melanoma | 0.95238 | 1 | 0.9091 |
| MLANA AND NOT-SLC6A20 | Melanoma | 1 | 1 | 1 |
| MLANA AND NOT-NPY1R | Melanoma | 1 | 1 | 1 |
| MLANA AND NOT-NTRK1 | Melanoma | 1 | 1 | 1 |
| MLANA AND NOT-CCR4 | Melanoma | 1 | 1 | 1 |
| MLANA AND NOT-ATP4A | Melanoma | 1 | 1 | 1 |
| MLANA AND NOT-GDPD2 | Melanoma | 1 | 1 | 1 |

| Antigen Pair Logic | Cancer (short name) | F1 | Precision | Recall |
|---|---|---|---|---|
| FOLH1 AND NOT-GPR19 | Prostate | 0.75 | 0.75 | 0.75 |
| FOLH1 AND NOT-SLCO1C1 | Prostate | 0.8571 | 1 | 0.75 |
| FOLH1 AND NOT-TRPC3 | Prostate | 0.6667 | 1 | 0.5 |
| FOLH1 AND NOT-MOG | Prostate | 0.8571 | 1 | 0.75 |
| FOLH1 AND NOT-NKAIN2 | Prostate | 0.6667 | 0.5 | 1 |
| PTGIS AND NOT-B4GALNT1 | Sarcoma | 0.7143 | 0.9091 | 0.5882 |
| NOT-CLDN10 AND MUC1 | Colon | 0.6667 | 0.75 | 0.6 |
| NOT-CLDN10 AND ERBB2 | Colon | 0.6 | 0.6 | 0.6 |
| NOT-PORCN AND ERBB2 | Colon | 0.6667 | 0.75 | 0.6 |
| NOT-CNIH2 AND ERBB2 | Colon | 0.75 | 1 | 0.6 |
| NOT-GPR158 AND ERBB2 | Colon | 0.75 | 1 | 0.6 |
| NOT-AGTR2 AND ERBB2 | Colon | 0.75 | 1 | 0.6 |
| NOT-KCNA7 AND MUC1 | Colon | 0.75 | 1 | 0.6 |
| NOT-KCNJ10 AND MUC1 | Colon | 0.75 | 1 | 0.6 |
| NOT-CNIH2 AND MUC1 | Colon | 0.75 | 1 | 0.6 |
| NOT-KCNJ10 AND ERBB2 | Colon | 0.75 | 1 | 0.6 |
| NOT-CACNG8 AND ERBB2 | Colon | 0.75 | 1 | 0.6 |
| NOT-MEGF10 AND ERBB2 | Colon | 0.6667 | 0.5714 | 0.8 |
| NOT-EPHA10 AND ERBB2 | Colon | 0.75 | 1 | 0.6 |
| NOT-SCN2A AND ERBB2 | Colon | 0.6667 | 0.75 | 0.6 |
| NOT-CACNG8 AND MUC1 | Colon | 0.75 | 1 | 0.6 |
| NOT-NPHS1 AND ERBB2 | Colon | 0.6667 | 0.75 | 0.6 |
| NOT-GRM7 AND MUC1 | Colon | 0.6667 | 0.75 | 0.6 |
| NOT-KCNA7 AND ERBB2 | Colon | 0.75 | 1 | 0.6 |
| NOT-ATP8A2 AND MUC1 | Colon | 0.75 | 1 | 0.6 |
| NOT-ADAM30 AND ERBB2 | Colon | 0.6667 | 0.75 | 0.6 |
| NOT-MEGF10 AND MUC1 | Colon | 0.6667 | 0.5714 | 0.8 |
| NOT-KIRREL3 AND ERBB2 | Colon | 0.75 | 1 | 0.6 |
| NOT-ATP8A2 AND ERBB2 | Colon | 0.75 | 1 | 0.6 |
| NOT-SYT6 AND ERBB2 | Colon | 0.75 | 1 | 0.6 |
| NOT-GALR1 AND ERBB2 | Colon | 0.6667 | 0.75 | 0.6 |
| NOT-PORCN AND MUC1 | Colon | 0.6667 | 0.75 | 0.6 |
| NOT-GABRA2 AND MUC1 | Colon | 0.8889 | 1 | 0.8 |
| NOT-CD1A AND MUC1 | Glioma | 0.7191 | 0.5872 | 0.9275 |
| NOT-CD1A AND ERBB2 | Glioma | 0.6802 | 0.5234 | 0.971 |
| NOT-PHLDB2 AND CD33 | AML | 0.9391 | 0.9264 | 0.9522 |
| NOT-GPR137B AND CD33 | AML | 0.8584 | 0.9302 | 0.7968 |
| NOT-PHLDB2 AND IL3RA | AML | 0.6649 | 0.9552 | 0.51 |
| FAP AND NOT-ROR1 | Breast | 0.8515 | 0.9149 | 0.7963 |
| FAP AND NOT-TYR | Breast | 0.8381 | 0.8627 | 0.8148 |
| EPCAM AND NOT-ALDH1A1 | Breast | 0.7209 | 0.9688 | 0.5741 |
| EPCAM AND NOT-MUC13 | Breast | 0.7304 | 0.6885 | 0.7778 |
| VTCN1 AND NOT-TYR | Breast | 0.6905 | 0.9667 | 0.537 |
| VTCN1 AND NOT-MET | Breast | 0.6905 | 0.9667 | 0.537 |
| EPCAM AND NOT-MUC4 | Breast | 0.6829 | 0.6087 | 0.7778 |
| EPCAM AND NOT-SSTR1 | Breast | 0.6565 | 0.5584 | 0.7963 |
| EPCAM AND NOT-GPA33 | Breast | 0.6829 | 0.6087 | 0.7778 |
| EPCAM AND NOT-ENPP3 | Breast | 0.6496 | 0.6032 | 0.7037 |
| EPCAM AND NOT-HHLA2 | Breast | 0.6412 | 0.5455 | 0.7778 |
| EPCAM AND NOT-GUCY2C | Breast | 0.6615 | 0.5658 | 0.7963 |
| EPCAM AND NOT-SST | Breast | 0.7167 | 0.6515 | 0.7963 |
| TPBG AND NOT-TYR | Breast | 0.62 | 0.6739 | 0.5741 |
| EPCAM AND NOT-CLDN8 | Breast | 0.6116 | 0.5522 | 0.6852 |
| EPCAM AND NOT-FOLR1 | Breast | 0.6187 | 0.5059 | 0.7963 |
| FAP AND NOT-MET | Breast | 0.6047 | 0.8125 | 0.4815 |
| TPBG AND NOT-ROR1 | Breast | 0.6042 | 0.6905 | 0.537 |
| EPCAM AND NOT-CLDN7 | Breast | 0.6107 | 0.5195 | 0.7407 |
| EPCAM AND NOT-LGR5 | Breast | 0.6457 | 0.5616 | 0.7593 |
| EPCAM AND NOT-CLDN2 | Breast | 0.6563 | 0.5676 | 0.7778 |
| AXL AND NOT-ROR1 | Breast | 0.6207 | 0.5806 | 0.6667 |
| EPCAM AND NOT-CLDN4 | Breast | 0.6087 | 0.5 | 0.7778 |
| EPCAM AND NOT-TNFRSF13C | Breast | 0.6056 | 0.4886 | 0.7963 |
| GPNMB AND NOT-ROR1 | Breast | 0.6154 | 0.5263 | 0.7407 |
| EPCAM AND NOT-EGFR | Breast | 0.6067 | 0.7714 | 0.5 |
| EPCAM AND NOT-PROM1 | Breast | 0.6538 | 0.68 | 0.6296 |
| CLDN2 AND NOT-MUC1 | Liver | 0.625 | 0.5 | 0.8333 |
| CLDN12 AND NOT-MUC1 | Liver | 1 | 1 | 1 |
| DPEP1 AND NOT-GPC3 | Colon | 1 | 1 | 1 |
| EPHB2 AND NOT-MUC1 | Colon | 0.75 | 1 | 0.6 |
| RNF43 AND NOT-ERBB2 | Colon | 0.75 | 1 | 0.6 |
| RNF43 AND NOT-GPC3 | Colon | 0.75 | 1 | 0.6 |
| RNF43 AND NOT-MUC1 | Colon | 0.75 | 1 | 0.6 |
| EPHB2 AND NOT-GPC3 | Colon | 0.7273 | 0.6667 | 0.8 |
| EPHB2 AND NOT-ERBB2 | Colon | 0.8 | 0.8 | 0.8 |
| CLDN2 AND NOT-GPC3 | Colon | 0.75 | 1 | 0.6 |
| BIRC5 AND NOT-GPC3 | Colon | 0.625 | 0.4545 | 1 |
| MET AND NOT-GPC3 | Colon | 0.75 | 1 | 0.6 |

FIG. 10 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| MLANA AND NOT-SLC51B | Melanoma | 0.95238 | 1 | 0.9091 | BIRC5 AND NOT-ERBB2 | Colon | 0.625 | 0.4545 | 1 |
| MLANA AND NOT-DCHS2 | Melanoma | 1 | 1 | 1 | MUC1 AND NOT-CLDN18 | Colon | 0.75 | 1 | 0.6 |
| MLANA AND NOT-OPRD1 | Melanoma | 1 | 1 | 1 | MUC1 AND NOT-GAGE1 | Colon | 0.75 | 1 | 0.6 |
| MLANA AND NOT-TAS2R8 | Melanoma | 1 | 1 | 1 | ITGAV AND NOT-EPHA2 | Glioma | 0.8722 | 0.9063 | 0.8406 |
| MLANA AND NOT-PDGFRB | Melanoma | 0.95238 | 1 | 0.9091 | SLC39A6 AND NOT-EPHA2 | Glioma | 0.7656 | 0.8305 | 0.7101 |
| MLANA AND NOT-OPRL1 | Melanoma | 1 | 1 | 1 | SLC39A6 AND NOT-ERBB2 | Glioma | 0.7612 | 0.7846 | 0.7391 |
| MLANA AND NOT-DLL4 | Melanoma | 1 | 1 | 1 | ITGAV AND NOT-ERBB2 | Glioma | 0.9209 | 0.9143 | 0.9275 |
| MLANA AND NOT-TAS2R5 | Melanoma | 1 | 1 | 1 | ITGAV AND NOT-MUC1 | Glioma | 0.8489 | 0.8429 | 0.8551 |
| MLANA AND NOT-CDHR5 | Melanoma | 1 | 1 | 1 | EDNRB AND NOT-MUC1 | Glioma | 0.662 | 0.6438 | 0.6812 |
| MLANA AND NOT-OR1F1 | Melanoma | 1 | 1 | 1 | EDNRB AND NOT-ERBB2 | Glioma | 0.6963 | 0.7121 | 0.6812 |
| MLANA AND NOT-P2RX1 | Melanoma | 1 | 1 | 1 | EDNRB AND NOT-EPHA2 | Glioma | 0.6271 | 0.7551 | 0.5362 |
| MLANA AND NOT-S1PR5 | Melanoma | 1 | 1 | 1 | CLDN12 AND NOT-EPHA2 | Glioma | 0.6168 | 0.8684 | 0.4783 |
| MLANA AND NOT-DUOX2 | Melanoma | 1 | 1 | 1 | CLDN12 AND NOT-MUC1 | Glioma | 0.7193 | 0.9111 | 0.5942 |
| MLANA AND NOT-PKD1 | Melanoma | 1 | 1 | 1 | SLC39A6 AND NOT-MUC1 | Glioma | 0.7647 | 0.7761 | 0.7536 |
| MLANA AND NOT-TAS2R3 | Melanoma | 1 | 1 | 1 | CLDN12 AND NOT-ERBB2 | Glioma | 0.7304 | 0.913 | 0.6087 |
| MLANA AND NOT-RHBDL2 | Melanoma | 0.95238 | 1 | 0.9091 | CD276 AND NOT-ERBB2 | Glioma | 0.6824 | 0.5743 | 0.8406 |
| MLANA AND NOT-TAS2R9 | Melanoma | 1 | 1 | 1 | CD276 AND NOT-MUC1 | Glioma | 0.6237 | 0.4957 | 0.8406 |
| MLANA AND NOT-CLCNKB | Melanoma | 1 | 1 | 1 | CD33 AND NOT-CD79B | AML | 0.8583 | 0.8856 | 0.8327 |
| MLANA AND NOT-NAALAD2 | Melanoma | 1 | 1 | 1 | CD33 AND NOT-IL11RA | AML | 0.8565 | 0.8957 | 0.8207 |
| MLANA AND NOT-PCDHGA11 | Melanoma | 1 | 1 | 1 | CD33 AND NOT-SLAMF7 | AML | 0.9206 | 0.917 | 0.9243 |
| MLANA AND NOT-SLC38A4 | Melanoma | 1 | 1 | 1 | CD33 AND NOT-FCRL1 | AML | 0.903 | 0.8976 | 0.9084 |
| MLANA AND NOT-ECSCR | Melanoma | 0.95238 | 1 | 0.9091 | CD33 AND NOT-MS4A1 | AML | 0.9134 | 0.9027 | 0.9243 |
| MLANA AND NOT-SCN3A | Melanoma | 0.95238 | 1 | 0.9091 | CD33 AND NOT-FCRL5 | AML | 0.9116 | 0.8992 | 0.9243 |
| MLANA AND NOT-SCN4A | Melanoma | 1 | 1 | 1 | CD33 AND NOT-CD22 | AML | 0.8944 | 0.863 | 0.9283 |
| MLANA AND NOT-SCN4B | Melanoma | 0.95238 | 1 | 0.9091 | CD33 AND NOT-TNFRSF17 | AML | 0.9109 | 0.9055 | 0.9163 |
| MLANA AND NOT-SCNN1A | Melanoma | 1 | 1 | 1 | CD33 AND NOT-CD72 | AML | 0.8906 | 0.8593 | 0.9243 |
| MLANA AND NOT-GPR182 | Melanoma | 1 | 1 | 1 | CD33 AND NOT-CLDN23 | AML | 0.8357 | 0.7573 | 0.9323 |
| MLANA AND NOT-SCTR | Melanoma | 1 | 1 | 1 | CD33 AND NOT-CD79A | AML | 0.8657 | 0.814 | 0.9243 |
| MLANA AND NOT-CDH23 | Melanoma | 1 | 1 | 1 | CD33 AND NOT-CD19 | AML | 0.8929 | 0.8893 | 0.8964 |
| MLANA AND NOT-SLC1A7 | Melanoma | 1 | 1 | 1 | CD33 AND NOT-P2RX5 | AML | 0.7974 | 0.8578 | 0.745 |
| MLANA AND NOT-OPN1SW | Melanoma | 1 | 1 | 1 | CD33 AND NOT-STEAP2 | AML | 0.786 | 0.6772 | 0.9363 |
| MLANA AND NOT-SLC2A4 | Melanoma | 1 | 1 | 1 | CD33 AND NOT-KDR | AML | 0.782 | 0.6714 | 0.9363 |
| MLANA AND NOT-SLC5A5 | Melanoma | 1 | 1 | 1 | CD33 AND NOT-ROR1 | AML | 0.7807 | 0.6695 | 0.9363 |
| MLANA AND NOT-SLC6A2 | Melanoma | 1 | 1 | 1 | CD33 AND NOT-AXL | AML | 0.78 | 0.6705 | 0.9323 |
| MLANA AND NOT-SLC6A3 | Melanoma | 1 | 1 | 1 | CD33 AND NOT-STEAP1 | AML | 0.7798 | 0.6744 | 0.9243 |
| MLANA AND NOT-GPR45 | Melanoma | 1 | 1 | 1 | CD33 AND NOT-CLDN5 | AML | 0.7769 | 0.6638 | 0.9363 |
| MLANA AND NOT-SLC6A9 | Melanoma | 1 | 1 | 1 | CD33 AND NOT-CLDN11 | AML | 0.7756 | 0.662 | 0.9363 |
| MLANA AND NOT-SLC9A2 | Melanoma | 1 | 1 | 1 | CD33 AND NOT-EDNRB | AML | 0.7752 | 0.6696 | 0.9203 |
| MLANA AND NOT-SCN2B | Melanoma | 1 | 1 | 1 | CD33 AND NOT-TNFRSF10A | AML | 0.7655 | 0.6474 | 0.9363 |
| MLANA AND NOT-HRH4 | Melanoma | 1 | 1 | 1 | CD33 AND NOT-ERBB2 | AML | 0.763 | 0.6438 | 0.9363 |
| MLANA AND NOT-ANO1 | Melanoma | 1 | 1 | 1 | CD33 AND NOT-CD276 | AML | 0.7629 | 0.6534 | 0.9163 |
| MLANA AND NOT-PCDHA10 | Melanoma | 1 | 1 | 1 | CD33 AND NOT-ENG | AML | 0.7492 | 0.6519 | 0.8805 |
| MLANA AND NOT-AVPR1A | Melanoma | 1 | 1 | 1 | CD33 AND NOT-VCAM1 | AML | 0.7483 | 0.6596 | 0.8645 |
| MLANA AND NOT-AVPR2 | Melanoma | 1 | 1 | 1 | CD33 AND NOT-MUC1 | AML | 0.73 | 0.6275 | 0.8725 |
| MLANA AND NOT-GABRQ | Melanoma | 1 | 1 | 1 | CD33 AND NOT-IL13RA1 | AML | 0.6559 | 0.6667 | 0.6454 |
| MLANA AND NOT-PCDHGC5 | Melanoma | 1 | 1 | 1 | CD33 AND NOT-CD52 | AML | 0.6166 | 0.8815 | 0.4741 |
| CELSR3 AND NOT-B4GALNT1 | Neuroblastoma | 0.75258 | 0.6636 | 0.869 | SLC34A2 AND NOT-ERBB2 | Lung Adenocarcinoma | 0.625 | 0.5556 | 0.7143 |
| SCN3A AND NOT-B4GALNT1 | Neuroblastoma | 0.71958 | 0.6476 | 0.8095 | CD19 AND NOT-CD33 | B-Cell Diffuse | 0.6667 | 0.8077 | 0.5676 |
| CPT1C AND NOT-B4GALNT1 | Neuroblastoma | 0.71006 | 0.7059 | 0.7143 | MS4A1 AND NOT-ITGB3 | B-Cell Diffuse | 0.6575 | 0.6667 | 0.6486 |
| FZD3 AND NOT-B4GALNT1 | Neuroblastoma | 0.67879 | 0.6914 | 0.6667 | CD19 AND NOT-NCAM1 | B-Cell Diffuse | 0.6452 | 0.8 | 0.5405 |
| GABRB3 AND NOT-B4GALNT1 | Neuroblastoma | 0.65031 | 0.6709 | 0.631 | CD19 AND NOT-ITGB3 | B-Cell Diffuse | 0.6207 | 0.8571 | 0.4865 |
| B4GALNT1 AND NOT-SCN1B | Neuroblastoma | 0.65734 | 0.7966 | 0.5595 | MS4A1 AND NOT-NCAM1 | B-Cell Diffuse | 0.6111 | 0.6286 | 0.5946 |
| KCNQ5 AND NOT-B4GALNT1 | Neuroblastoma | 0.64286 | 0.6429 | 0.6429 | CD19 AND NOT-SSTR2 | Mantle-Cell Lymphoma | 0.9143 | 1 | 0.8421 |
| EPHA5 AND NOT-B4GALNT1 | Neuroblastoma | 0.62069 | 0.7377 | 0.5357 | CD19 AND NOT-TNFRSF17 | Mantle-Cell Lymphoma | 0.8986 | 1 | 0.8158 |
| B4GALNT1 AND NOT-AQP4 | Neuroblastoma | 0.62162 | 0.7188 | 0.5476 | CD19 AND NOT-IL13RA1 | Mantle-Cell Lymphoma | 0.8986 | 1 | 0.8158 |
| B4GALNT1 AND NOT-ART3 | Neuroblastoma | 0.60645 | 0.662 | 0.5595 | CD19 AND NOT-CLDN8 | Mantle-Cell Lymphoma | 0.9143 | 1 | 0.8421 |
| SCN3B AND NOT-B4GALNT1 | Neuroblastoma | 0.60377 | 0.5 | 0.7619 | CD19 AND NOT-TRPM4 | Mantle-Cell Lymphoma | 0.8986 | 1 | 0.8158 |
| B4GALNT1 AND NOT-STYK1 | Neuroblastoma | 0.63226 | 0.6901 | 0.5833 | CD19 AND NOT-SSTR3 | Mantle-Cell Lymphoma | 0.9143 | 1 | 0.8421 |
| B4GALNT1 AND NOT-SLC15A2 | Neuroblastoma | 0.67925 | 0.72 | 0.6429 | CD19 AND NOT-MST1R | Mantle-Cell Lymphoma | 0.8657 | 1 | 0.7632 |
| B4GALNT1 AND NOT-SLC17A7 | Neuroblastoma | 0.64151 | 0.68 | 0.6071 | CD19 AND NOT-SLAMF7 | Mantle-Cell Lymphoma | 0.8986 | 1 | 0.8158 |
| B4GALNT1 AND NOT-GJB6 | Neuroblastoma | 0.67516 | 0.726 | 0.631 | CD19 AND NOT-CD180 | Mantle-Cell Lymphoma | 0.9143 | 1 | 0.8421 |
| B4GALNT1 AND NOT-SLC4A4 | Neuroblastoma | 0.71533 | 0.9245 | 0.5833 | CD19 AND NOT-CLDN6 | Mantle-Cell Lymphoma | 0.8485 | 1 | 0.7368 |
| B4GALNT1 AND NOT-SLC24A4 | Neuroblastoma | 0.60227 | 0.5761 | 0.631 | CD19 AND NOT-CD72 | Mantle-Cell Lymphoma | 0.6897 | 1 | 0.5263 |
| B4GALNT1 AND NOT-ADRB1 | Neuroblastoma | 0.62069 | 0.6 | 0.6429 | CD19 AND NOT-FCRL1 | Mantle-Cell Lymphoma | 0.6667 | 1 | 0.5 |
| B4GALNT1 AND NOT-KCNS1 | Neuroblastoma | 0.60526 | 0.6765 | 0.5476 | MLANA AND NOT-EPCAM | Melanoma | 1 | 1 | 1 |
| B4GALNT1 AND NOT-CACNA1A | Neuroblastoma | 0.61905 | 0.619 | 0.619 | MLANA AND NOT-SSTR1 | Melanoma | 1 | 1 | 1 |
| KCNK15 AND NOT-ERBB2 | Ovarian | 0.8 | 0.6667 | 1 | MLANA AND NOT-LGR5 | Melanoma | 1 | 1 | 1 |
| FOLH1 AND NOT-ACVR1C | Prostate | 0.72727 | 0.5714 | 1 | MLANA AND NOT-CD34 | Melanoma | 0.9524 | 1 | 0.9091 |
| FOLH1 AND NOT-TMEM63B | Prostate | 0.66667 | 1 | 0.5 | MLANA AND NOT-GPA33 | Melanoma | 0.9524 | 1 | 0.9091 |
| FOLH1 AND NOT-PLB1 | Prostate | 0.66667 | 1 | 0.5 | MLANA AND NOT-EGFR | Melanoma | 1 | 1 | 1 |
| FOLH1 AND NOT-CYSLTR2 | Prostate | 0.66667 | 1 | 0.5 | MLANA AND NOT-ENPP3 | Melanoma | 0.9524 | 1 | 0.9091 |
| FOLH1 AND NOT-ATP1B1 | Prostate | 0.85714 | 1 | 0.75 | MLANA AND NOT-SSTR3 | Melanoma | 1 | 1 | 1 |
| FOLH1 AND NOT-UGT8 | Prostate | 0.75 | 0.75 | 0.75 | MLANA AND NOT-SSTR5 | Melanoma | 1 | 1 | 1 |
| FOLH1 AND NOT-APLNR | Prostate | 0.66667 | 0.6 | 0.75 | MLANA AND NOT-CLDN5 | Melanoma | 0.9524 | 1 | 0.9091 |
| FOLH1 AND NOT-PCDHB12 | Prostate | 0.66667 | 1 | 0.5 | MLANA AND NOT-VTCN1 | Melanoma | 1 | 1 | 1 |
| FOLH1 AND NOT-CSF1 | Prostate | 0.66667 | 1 | 0.5 | MLANA AND NOT-ULBP1 | Melanoma | 1 | 1 | 1 |
| FOLH1 AND NOT-ITM2A | Prostate | 0.66667 | 1 | 0.5 | MLANA AND NOT-ERBB2 | Melanoma | 1 | 1 | 1 |

FIG. 10 (Cont.)

| Antigen Pair Logic | Cancer (short name) | F1 | Precision | Recall |
|---|---|---|---|---|
| FOLH1 AND NOT-ATP10B | Prostate | 0.85714 | 1 | 0.75 |
| FOLH1 AND NOT-MAL | Prostate | 0.66667 | 1 | 0.5 |
| FOLH1 AND NOT-GRIK5 | Prostate | 0.85714 | 1 | 0.75 |
| FOLH1 AND NOT-SLC34A3 | Prostate | 0.66667 | 1 | 0.5 |
| FOLH1 AND NOT-SLC5A5 | Prostate | 0.66667 | 1 | 0.5 |
| FOLH1 AND NOT-GAL3ST1 | Prostate | 0.75 | 0.75 | 0.75 |
| FOLH1 AND NOT-CDH19 | Prostate | 0.85714 | 1 | 0.75 |
| FOLH1 AND NOT-STX1B | Prostate | 0.8 | 0.6667 | 1 |
| FOLH1 AND NOT-GPRC5B | Prostate | 0.66667 | 0.6 | 0.75 |
| FOLH1 AND NOT-ATP6AP2 | Prostate | 0.66667 | 1 | 0.5 |
| FOLH1 AND NOT-SLC4A1 | Prostate | 0.85714 | 1 | 0.75 |
| FOLH1 AND NOT-OR10H3 | Prostate | 0.66667 | 1 | 0.5 |
| FOLH1 AND NOT-OR51B2 | Prostate | 0.88889 | 0.8 | 1 |
| FOLH1 AND NOT-OR7A10 | Prostate | 0.66667 | 0.6 | 0.75 |
| FGFR1 AND NOT-B4GALNT1 | Sarcoma | 0.66667 | 0.9 | 0.5294 |
| MMP14 AND NOT-B4GALNT1 | Sarcoma | 0.74074 | 1 | 0.5882 |
| FLRT2 AND NOT-B4GALNT1 | Sarcoma | 0.73333 | 0.8462 | 0.6471 |
| VASN AND NOT-B4GALNT1 | Sarcoma | 0.69231 | 1 | 0.5294 |
| BFAR AND NOT-B4GALNT1 | Sarcoma | 0.73333 | 0.8462 | 0.6471 |
| PCDHB14 AND NOT-B4GALNT1 | Sarcoma | 0.75862 | 0.9167 | 0.6471 |
| NOT-KIAA0754 AND MSLN | Colon | 0.66667 | 0.75 | 0.6 |
| NOT-CLEC2D AND MSLN | Colon | 0.66667 | 0.75 | 0.6 |
| NOT-S1PR2 AND ERBB2 | Colon | 0.75 | 1 | 0.6 |
| NOT-PLXNA4 AND ERBB2 | Colon | 0.75 | 1 | 0.6 |
| NOT-CD200R1 AND ERBB2 | Colon | 0.75 | 1 | 0.6 |
| NOT-CDH26 AND ERBB2 | Colon | 0.75 | 1 | 0.6 |
| NOT-SLC6A2 AND ERBB2 | Colon | 0.75 | 1 | 0.6 |
| NOT-ZP2 AND MSLN | Colon | 0.66667 | 0.75 | 0.6 |
| NOT-NAALAD2 AND MSLN | Colon | 0.66667 | 0.75 | 0.6 |
| NOT-TACR1 AND ERBB2 | Colon | 0.75 | 1 | 0.6 |
| NOT-SCN4B AND ERBB2 | Colon | 0.75 | 1 | 0.6 |
| NOT-PTPRS AND ERBB2 | Colon | 0.75 | 1 | 0.6 |
| NOT-GRID1 AND MUC1 | Colon | 0.75 | 1 | 0.6 |
| NOT-DIO3 AND ERBB2 | Colon | 0.75 | 1 | 0.6 |
| NOT-KCNH8 AND ERBB2 | Colon | 0.75 | 1 | 0.6 |
| NOT-PCDH9 AND MSLN | Colon | 0.66667 | 0.75 | 0.6 |
| NOT-GPR37 AND ERBB2 | Colon | 0.6 | 0.6 | 0.6 |
| NOT-GPC3 AND EFNB1 | Colon | 0.6 | 0.6 | 0.6 |
| NOT-GPC3 AND ANTXR1 | Colon | 0.75 | 1 | 0.6 |
| NOT-C1orf210 AND MUC1 | Glioma | 0.82051 | 0.7356 | 0.9275 |
| NOT-WLS AND CD33 | AML | 0.91585 | 0.9 | 0.9323 |
| NOT-HEG1 AND CD33 | AML | 0.90083 | 0.9356 | 0.8685 |
| NOT-TGFBR3 AND CD33 | AML | 0.89669 | 0.9313 | 0.8645 |
| NOT-PTPRK AND CD33 | AML | 0.88645 | 0.8203 | 0.9641 |
| NOT-ACVR2A AND CD33 | AML | 0.88469 | 0.8417 | 0.9323 |
| NOT-PERP AND CD33 | AML | 0.86176 | 0.7843 | 0.9562 |
| NOT-ATP9A AND CD33 | AML | 0.88258 | 0.8412 | 0.9283 |
| NOT-PODXL AND CD33 | AML | 0.84283 | 0.7439 | 0.9721 |
| NOT-BMPR1A AND CD33 | AML | 0.83871 | 0.7622 | 0.9323 |
| NOT-CLCA4 AND MUC1 | Lung Adenocarcinoma | 0.60748 | 0.4514 | 0.9286 |
| NOT-LRP4 AND B4GALNT1 | Neuroblastoma | 0.77019 | 0.8052 | 0.7381 |
| NOT-SLC2A12 AND B4GALNT1 | Neuroblastoma | 0.73684 | 0.7241 | 0.75 |
| NOT-SDC4 AND B4GALNT1 | Neuroblastoma | 0.66272 | 0.6588 | 0.6667 |
| NOT-KCNK1 AND B4GALNT1 | Neuroblastoma | 0.62687 | 0.84 | 0.5 |
| EPCAM AND NOT-CDH17 | Breast | 0.70588 | 0.75 | 0.6667 |
| EPCAM AND NOT-PTPRR | Breast | 0.71795 | 0.6667 | 0.7778 |
| EPCAM AND NOT-SCARA5 | Breast | 0.62712 | 0.5781 | 0.6852 |
| EPCAM AND NOT-SLC30A10 | Breast | 0.63636 | 0.5385 | 0.7778 |
| EPCAM AND NOT-GRM7 | Breast | 0.62774 | 0.5181 | 0.7963 |
| EPCAM AND NOT-FUT3 | Breast | 0.69091 | 0.6786 | 0.7037 |
| ENPP1 AND NOT-TYR | Breast | 0.65079 | 0.5694 | 0.7593 |
| EPCAM AND NOT-ABHD3 | Breast | 0.64179 | 0.5375 | 0.7963 |
| EPCAM AND NOT-DPP10 | Breast | 0.61069 | 0.5195 | 0.7407 |
| LRRC8E AND NOT-TYR | Breast | 0.68333 | 0.6212 | 0.7593 |
| EPCAM AND NOT-MUC12 | Breast | 0.65152 | 0.5513 | 0.7963 |
| EPCAM AND NOT-BEST2 | Breast | 0.64179 | 0.5375 | 0.7963 |
| EPCAM AND NOT-NOX1 | Breast | 0.65152 | 0.5513 | 0.7963 |
| EPCAM AND NOT-TMPRSS11E | Breast | 0.61538 | 0.5263 | 0.7407 |

| Antigen Pair Logic | Cancer (short name) | F1 | Precision | Recall |
|---|---|---|---|---|
| MLANA AND NOT-CLDN1 | Melanoma | 1 | 1 | 1 |
| MLANA AND NOT-TNFRSF13C | Melanoma | 1 | 1 | 1 |
| MLANA AND NOT-SLC34A2 | Melanoma | 1 | 1 | 1 |
| MLANA AND NOT-CLDN8 | Melanoma | 1 | 1 | 1 |
| PMEL AND NOT-EPCAM | Melanoma | 0.9524 | 1 | 0.9091 |
| PMEL AND NOT-ENPP3 | Melanoma | 0.9524 | 1 | 0.9091 |
| PMEL AND NOT-SSTR1 | Melanoma | 0.9524 | 1 | 0.9091 |
| PMEL AND NOT-VTCN1 | Melanoma | 0.9524 | 1 | 0.9091 |
| PMEL AND NOT-LGR5 | Melanoma | 0.9524 | 1 | 0.9091 |
| PMEL AND NOT-CLDN1 | Melanoma | 0.9524 | 1 | 0.9091 |
| PMEL AND NOT-ERBB2 | Melanoma | 0.9524 | 1 | 0.9091 |
| PMEL AND NOT-CD34 | Melanoma | 0.9524 | 1 | 0.9091 |
| PMEL AND NOT-CLDN7 | Melanoma | 0.9524 | 1 | 0.9091 |
| MLANA AND NOT-SSTR4 | Melanoma | 1 | 1 | 1 |
| MLANA AND NOT-ENG | Melanoma | 1 | 1 | 1 |
| MLANA AND NOT-RAET1E | Melanoma | 0.9524 | 1 | 0.9091 |
| MLANA AND NOT-MST1R | Melanoma | 1 | 1 | 1 |
| MLANA AND NOT-CLDN9 | Melanoma | 1 | 1 | 1 |
| MLANA AND NOT-CLDN2 | Melanoma | 1 | 1 | 1 |
| MLANA AND NOT-CLDN6 | Melanoma | 1 | 1 | 1 |
| MLANA AND NOT-GUCY2C | Melanoma | 0.9524 | 1 | 0.9091 |
| MLANA AND NOT-FOLR1 | Melanoma | 1 | 1 | 1 |
| MLANA AND NOT-CLDN7 | Melanoma | 1 | 1 | 1 |
| MLANA AND NOT-IL20RA | Melanoma | 0.9524 | 1 | 0.9091 |
| PMEL AND NOT-SLC34A2 | Melanoma | 0.9524 | 1 | 0.9091 |
| PMEL AND NOT-CLDN23 | Melanoma | 0.9524 | 1 | 0.9091 |
| PMEL AND NOT-CLDN8 | Melanoma | 0.9524 | 1 | 0.9091 |
| MLANA AND NOT-MUC13 | Melanoma | 1 | 1 | 1 |
| MLANA AND NOT-STEAP2 | Melanoma | 0.9524 | 1 | 0.9091 |
| MLANA AND NOT-CLDN11 | Melanoma | 0.9 | 1 | 0.8182 |
| MLANA AND NOT-CLDN18 | Melanoma | 0.9 | 1 | 0.8182 |
| MLANA AND NOT-AXL | Melanoma | 0.9 | 1 | 0.8182 |
| EDNRB AND NOT-KDR | Melanoma | 0.8421 | 1 | 0.7273 |
| ABCB5 AND NOT-B4GALNT1 | Melanoma | 0.7059 | 1 | 0.5455 |
| ABCB5 AND NOT-KDR | Melanoma | 0.625 | 1 | 0.4545 |
| CLDN12 AND NOT-B4GALNT1 | Melanoma | 0.625 | 1 | 0.4545 |
| RNF43 AND NOT-B4GALNT1 | Melanoma | 0.625 | 1 | 0.4545 |
| L1CAM AND NOT-B4GALNT1 | Neuroblastoma | 0.6364 | 0.5147 | 0.8333 |
| B4GALNT1 AND NOT-ERBB4 | Neuroblastoma | 0.6043 | 0.7636 | 0.5 |
| MUC16 AND NOT-ERBB2 | Ovarian | 0.6957 | 0.7273 | 0.6667 |
| FOLH1 AND NOT-FCRL5 | Prostate | 0.6667 | 1 | 0.5 |
| FOLH1 AND NOT-TNFRSF13C | Prostate | 0.6667 | 1 | 0.5 |
| FOLH1 AND NOT-ERBB3 | Prostate | 0.6 | 0.5 | 0.75 |
| FOLH1 AND NOT-LGR5 | Prostate | 0.8889 | 0.8 | 1 |
| FOLH1 AND NOT-GPA33 | Prostate | 0.6 | 0.5 | 0.75 |
| FOLH1 AND NOT-ALK | Prostate | 0.6667 | 1 | 0.5 |
| FOLH1 AND NOT-NCAM1 | Prostate | 0.6154 | 0.4444 | 1 |
| NOT-ERBB4 AND MUC1 | Colon | 0.6 | 0.6 | 0.6 |
| NOT-ITGB3 AND ERBB2 | Colon | 0.6667 | 0.75 | 0.6 |
| NOT-ERBB4 AND ERBB2 | Colon | 0.6 | 0.6 | 0.6 |
| NOT-GPC3 AND CD276 | Colon | 0.75 | 1 | 0.6 |
| NOT-GPC3 AND IL20RA | Colon | 0.6667 | 0.5 | 1 |
| NOT-GAGE1 AND MSLN | Colon | 0.6667 | 0.75 | 0.6 |
| NOT-GPC3 AND PTK7 | Colon | 0.9091 | 0.8333 | 1 |
| NOT-EPHA2 AND CD276 | Glioma | 0.6824 | 0.5743 | 0.8406 |
| NOT-SLAMF7 AND MUC1 | Glioma | 0.6256 | 0.4648 | 0.9565 |
| NOT-MUC1 AND PROM1 | Glioma | 0.6065 | 0.5465 | 0.6812 |
| NOT-RAET1E AND MUC1 | Glioma | 0.6738 | 0.5339 | 0.913 |
| NOT-GPA33 AND MUC1 | Glioma | 0.6979 | 0.5447 | 0.971 |
| NOT-ITGAV AND CD33 | AML | 0.8119 | 0.7622 | 0.8685 |
| NOT-GPNMB AND CD33 | AML | 0.7606 | 0.6627 | 0.8924 |
| NOT-CLDN12 AND CD33 | AML | 0.7427 | 0.6281 | 0.9084 |
| NOT-SLC34A2 AND KDR | Melanoma | 1 | 1 | 1 |
| NOT-VTCN1 AND KDR | Melanoma | 0.9 | 1 | 0.8182 |
| NOT-CLDN7 AND KDR | Melanoma | 0.8696 | 0.8333 | 0.9091 |
| NOT-TNFRSF13C AND KDR | Melanoma | 0.8421 | 1 | 0.7273 |
| NOT-CA9 AND KDR | Melanoma | 0.7778 | 1 | 0.6364 |
| NOT-FCRL5 AND KDR | Melanoma | 0.625 | 1 | 0.4545 |

FIG. 11

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| PTPRZ1 AND ITGB8 | Astrocytoma | 0.904762 | 1 | 0.826087 | STEAP2 AND STEAP4 | Prostate | 0.857143 | 1 | 0.75 |
| PTPRZ1 AND ITM2B | Astrocytoma | 0.876404 | 0.906977 | 0.847826 | STEAP1 AND CDH10 | Prostate | 0.857143 | 1 | 0.75 |
| PTPRZ1 AND MPZL1 | Astrocytoma | 0.904762 | 1 | 0.826087 | STEAP2 AND ADAM2 | Prostate | 0.857143 | 1 | 0.75 |
| PTPRZ1 AND SLC44A2 | Astrocytoma | 0.857143 | 0.866667 | 0.847826 | STEAP2 AND ATP8A2 | Prostate | 0.75 | 0.75 | 0.75 |
| PTPRZ1 AND CSF1R | Astrocytoma | 0.847826 | 0.847826 | 0.847826 | STEAP2 AND CSPG5 | Prostate | 0.857143 | 1 | 0.75 |
| PLP1 AND F2RL1 | Astrocytoma | 0.843373 | 0.945946 | 0.76087 | STEAP2 AND FLVCR1 | Prostate | 0.8 | 0.666667 | 1 |
| PTPRZ1 AND ABCA1 | Astrocytoma | 0.835443 | 1 | 0.717391 | STEAP1 AND GABRG3 | Prostate | 0.75 | 0.75 | 0.75 |
| PTPRZ1 AND NRCAM | Astrocytoma | 0.833333 | 0.8 | 0.869565 | STEAP1 AND PCDH15 | Prostate | 0.75 | 0.75 | 0.75 |
| PTPRZ1 AND ATP8B4 | Astrocytoma | 0.829268 | 0.944444 | 0.73913 | STEAP1 AND TMEFF2 | Prostate | 0.75 | 0.75 | 0.75 |
| PTPRZ1 AND CLCN5 | Astrocytoma | 0.828283 | 0.773585 | 0.891304 | STEAP1 AND PCDH8 | Prostate | 0.75 | 0.75 | 0.75 |
| PTPRZ1 AND BMP2 | Astrocytoma | 0.827586 | 0.878049 | 0.782609 | STEAP1 AND TTYH3 | Prostate | 0.75 | 0.75 | 0.75 |
| PTPRZ1 AND VANGL2 | Astrocytoma | 0.826087 | 0.826087 | 0.826087 | STEAP1 AND NKAIN1 | Prostate | 0.857143 | 1 | 0.75 |
| PLP1 AND ABCA1 | Astrocytoma | 0.825 | 0.970588 | 0.717391 | STEAP2 AND IL15RA | Prostate | 0.727273 | 0.571429 | 1 |
| PTPRZ1 AND CD320 | Astrocytoma | 0.822222 | 0.840909 | 0.804348 | STEAP2 AND UMODL1 | Prostate | 0.727273 | 0.571429 | 1 |
| PTPRZ1 AND CSF2RB | Astrocytoma | 0.820513 | 1 | 0.695652 | STEAP2 AND NMBR | Prostate | 0.727273 | 0.571429 | 1 |
| PTPRZ1 AND ADAM28 | Astrocytoma | 0.820513 | 1 | 0.695652 | STEAP2 AND PCDHB1 | Prostate | 0.727273 | 0.571429 | 1 |
| PTPRZ1 AND ANTXR1 | Astrocytoma | 0.819277 | 0.918919 | 0.73913 | STEAP2 AND GRM6 | Prostate | 0.727273 | 0.571429 | 1 |
| PTPRZ1 AND ADAM17 | Astrocytoma | 0.818182 | 0.857143 | 0.782609 | STEAP2 AND GRM5 | Prostate | 0.727273 | 0.571429 | 1 |
| PTPRZ1 AND DDR2 | Astrocytoma | 0.817204 | 0.808511 | 0.826087 | STEAP2 AND TAS1R1 | Prostate | 0.727273 | 0.571429 | 1 |
| PTPRZ1 AND LRRC8D | Astrocytoma | 0.816327 | 0.769231 | 0.869565 | STEAP2 AND CHRNB4 | Prostate | 0.727273 | 0.571429 | 1 |
| PTPRZ1 AND DLL1 | Astrocytoma | 0.818182 | 0.857143 | 0.782609 | STEAP2 AND ATP6V0A4 | Prostate | 0.727273 | 0.571429 | 1 |
| PTPRZ1 AND AGTRAP | Astrocytoma | 0.814815 | 0.942857 | 0.717391 | STEAP2 AND SLC13A2 | Prostate | 0.727273 | 0.571429 | 1 |
| PTPRZ1 AND CD68 | Astrocytoma | 0.814815 | 0.942857 | 0.717391 | STEAP2 AND ZACN | Prostate | 0.727273 | 0.571429 | 1 |
| NRCAM AND TSPAN11 | Astrocytoma | 0.813953 | 0.875 | 0.76087 | STEAP2 AND CHRNG | Prostate | 0.727273 | 0.571429 | 1 |
| PTPRZ1 AND MACF1 | Astrocytoma | 0.813187 | 0.822222 | 0.804348 | STEAP2 AND KCNA7 | Prostate | 0.727273 | 0.571429 | 1 |
| PTPRZ1 AND BMPR1A | Astrocytoma | 0.811881 | 0.745455 | 0.891304 | STEAP2 AND ATP13A5 | Prostate | 0.727273 | 0.571429 | 1 |
| AQP4 AND VANGL2 | Astrocytoma | 0.808989 | 0.837209 | 0.782609 | STEAP2 AND GLRA3 | Prostate | 0.727273 | 0.571429 | 1 |
| PTPRZ1 AND BVES | Astrocytoma | 0.808989 | 0.837209 | 0.782609 | STEAP2 AND AGTR2 | Prostate | 0.727273 | 0.571429 | 1 |
| PLP1 AND MPZL1 | Astrocytoma | 0.804878 | 0.916667 | 0.717391 | STEAP2 AND KCNQ2 | Prostate | 0.727273 | 0.571429 | 1 |
| NRCAM AND F2RL1 | Astrocytoma | 0.804348 | 0.804348 | 0.804348 | STEAP2 AND HTR5A | Prostate | 0.727273 | 0.571429 | 1 |
| PTPRZ1 AND PCDHB2 | Astrocytoma | 0.804124 | 0.764706 | 0.847826 | STEAP2 AND DSC1 | Prostate | 0.727273 | 0.571429 | 1 |
| SLC1A3 AND VANGL2 | Astrocytoma | 0.804124 | 0.764706 | 0.847826 | STEAP2 AND HTR1F | Prostate | 0.727273 | 0.571429 | 1 |
| FAIM2 AND VANGL2 | Astrocytoma | 0.8 | 0.818182 | 0.782609 | STEAP2 AND ACSL6 | Prostate | 0.727273 | 0.571429 | 1 |
| PTPRZ1 AND SLCO2B1 | Astrocytoma | 0.8 | 0.941176 | 0.695652 | STEAP2 AND TTYH3 | Prostate | 0.727273 | 0.571429 | 1 |
| NRCAM AND HAS2 | Astrocytoma | 0.8 | 0.871795 | 0.73913 | STEAP2 AND SLC9B1 | Prostate | 0.727273 | 0.571429 | 1 |
| FAIM2 AND F2RL1 | Astrocytoma | 0.8 | 0.871795 | 0.73913 | STEAP2 AND OR8B2 | Prostate | 0.727273 | 0.571429 | 1 |
| AQP4 AND TSPAN11 | Astrocytoma | 0.8 | 0.871795 | 0.73913 | STEAP2 AND ADAM21 | Prostate | 0.727273 | 0.571429 | 1 |
| PTPRZ1 AND TSPAN11 | Astrocytoma | 0.8 | 0.871795 | 0.73913 | STEAP2 AND GPR78 | Prostate | 0.727273 | 0.571429 | 1 |
| NRCAM AND VANGL2 | Astrocytoma | 0.8 | 0.871795 | 0.73913 | STEAP2 AND GHSR | Prostate | 0.727273 | 0.571429 | 1 |
| PTPRZ1 AND CACNA1F | Astrocytoma | 0.795918 | 0.75 | 0.847826 | STEAP2 AND GHRHR | Prostate | 0.727273 | 0.571429 | 1 |
| APLP1 AND VANGL2 | Astrocytoma | 0.795918 | 0.75 | 0.847826 | STEAP2 AND PCDHA9 | Prostate | 0.727273 | 0.571429 | 1 |
| PTPRZ1 AND MERTK | Astrocytoma | 0.795699 | 0.787234 | 0.804348 | STEAP2 AND CCR9 | Prostate | 0.727273 | 0.571429 | 1 |
| NRCAM AND BMPR1A | Astrocytoma | 0.795455 | 0.833333 | 0.76087 | STEAP2 AND KCNK16 | Prostate | 0.727273 | 0.571429 | 1 |
| PTPRZ1 AND TSPAN12 | Astrocytoma | 0.795455 | 0.833333 | 0.76087 | STEAP2 AND PRND | Prostate | 0.727273 | 0.571429 | 1 |
| PTPRZ1 AND IL12RB1 | Astrocytoma | 0.795455 | 0.833333 | 0.76087 | STEAP2 AND KIRREL2 | Prostate | 0.727273 | 0.571429 | 1 |
| PTPRZ1 AND ATP13A4 | Astrocytoma | 0.794872 | 0.96875 | 0.673913 | STEAP2 AND CD74 | Prostate | 0.727273 | 0.571429 | 1 |
| ADAM22 AND SLC3A2 | Astrocytoma | 0.791209 | 0.8 | 0.782609 | STEAP2 AND CD44 | Prostate | 0.727273 | 0.571429 | 1 |
| PTPRZ1 AND CSF1 | Astrocytoma | 0.791209 | 0.8 | 0.782609 | STEAP2 AND MEGF11 | Prostate | 0.727273 | 0.571429 | 1 |
| NRCAM AND TSPAN12 | Astrocytoma | 0.790698 | 0.85 | 0.73913 | STEAP2 AND TMPRSS11D | Prostate | 0.727273 | 0.571429 | 1 |
| PTPRZ1 AND ADAM9 | Astrocytoma | 0.790698 | 0.85 | 0.73913 | STEAP2 AND CNTNAP2 | Prostate | 0.727273 | 0.571429 | 1 |
| PTPRZ1 AND FCGRT | Astrocytoma | 0.789474 | 1 | 0.652174 | STEAP2 AND GNRHR | Prostate | 0.727273 | 0.571429 | 1 |
| PTPRZ1 AND CLEC4A | Astrocytoma | 0.789474 | 1 | 0.652174 | STEAP2 AND EPHA10 | Prostate | 0.727273 | 0.571429 | 1 |
| GPM6B AND F2RL1 | Astrocytoma | 0.789474 | 1 | 0.652174 | FAP AND TGFBI | Sarcoma | 0.785714 | 1 | 0.647059 |
| PTPRZ1 AND PANX1 | Astrocytoma | 0.788462 | 0.706897 | 0.891304 | FAP AND LAPTM5 | Sarcoma | 0.827586 | 1 | 0.705882 |
| PTPRZ1 AND C5AR1 | Astrocytoma | 0.787234 | 0.770833 | 0.804348 | FAP AND CD163 | Sarcoma | 0.827586 | 1 | 0.705882 |
| PLP1 AND VANGL2 | Astrocytoma | 0.786517 | 0.813953 | 0.76087 | TGFBI AND ULBP2 | Sarcoma | 0.692308 | 1 | 0.529412 |
| NRCAM AND ABCC4 | Astrocytoma | 0.785714 | 0.868421 | 0.717391 | FAP AND SLC1A5 | Sarcoma | 0.692308 | 1 | 0.529412 |
| CADM2 AND F2RL1 | Astrocytoma | 0.785714 | 0.868421 | 0.717391 | FAP AND SLC31A1 | Sarcoma | 0.785714 | 1 | 0.647059 |
| GPM6B AND HAS2 | Astrocytoma | 0.78481 | 0.939394 | 0.673913 | CDH17 AND SPON2 | Stomach | 0.896552 | 0.886364 | 0.906977 |
| PTPRZ1 AND SLC1A3 | Astrocytoma | 0.784314 | 0.714286 | 0.869565 | CDH17 AND THY1 | Stomach | 0.767677 | 0.678571 | 0.883721 |
| PTPRZ1 AND ATP13A1 | Astrocytoma | 0.784314 | 0.714286 | 0.869565 | CDH17 AND CLDN1 | Stomach | 0.921348 | 0.891304 | 0.953488 |
| PTPRZ1 AND KCNJ8 | Astrocytoma | 0.784314 | 0.714286 | 0.869565 | CLDN18 AND FAT1 | Stomach | 0.864198 | 0.921053 | 0.813953 |
| ADAM22 AND VANGL2 | Astrocytoma | 0.808989 | 0.837209 | 0.782609 | CLDN18 AND CDH17 | Stomach | 0.897436 | 1 | 0.813953 |
| PTPRZ1 AND ATP6AP2 | Astrocytoma | 0.783505 | 0.745098 | 0.826087 | CLDN18 AND SLC2A1 | Stomach | 0.847059 | 0.857143 | 0.837209 |
| PCDH17 AND TSPAN11 | Astrocytoma | 0.782609 | 0.782609 | 0.782609 | CLDN18 AND TTYH3 | Stomach | 0.843373 | 0.875 | 0.813953 |
| PTPRZ1 AND HTRA2 | Astrocytoma | 0.782609 | 0.782609 | 0.782609 | CLDN18 AND PCDHA6 | Stomach | 0.747253 | 0.708333 | 0.790698 |
| PTPRZ1 AND CCR5 | Astrocytoma | 0.789474 | 1 | 0.652174 | CLDN18 AND ATP4B | Stomach | 0.769231 | 0.729167 | 0.813953 |
| PLP1 AND TSPAN12 | Astrocytoma | 0.781609 | 0.829268 | 0.73913 | CDH17 AND PSCA | Stomach | 0.739726 | 0.9 | 0.627907 |
| PTPRZ1 AND P2RY1 | Astrocytoma | 0.780952 | 0.694915 | 0.891304 | CLDN18 AND ABCG5 | Stomach | 0.786517 | 0.76087 | 0.813953 |
| PTPRZ1 AND CLEC1A | Astrocytoma | 0.780952 | 0.694915 | 0.891304 | CLDN18 AND VANGL1 | Stomach | 0.875 | 0.945946 | 0.813953 |
| PTPRZ1 AND TPCN2 | Astrocytoma | 0.780952 | 0.694915 | 0.891304 | MUC13 AND BST2 | Stomach | 0.837838 | 1 | 0.72093 |
| PTPRZ1 AND TMEM119 | Astrocytoma | 0.779221 | 0.967742 | 0.652174 | CLDN18 AND F2R | Stomach | 0.86747 | 0.9 | 0.837209 |
| PTPRZ1 AND SRR | Astrocytoma | 0.778947 | 0.755102 | 0.804348 | CLDN18 AND RXFP3 | Stomach | 0.738095 | 0.756098 | 0.72093 |
| ADAM22 AND TSPAN12 | Astrocytoma | 0.777778 | 0.795455 | 0.76087 | CLDN18 AND FLVCR1 | Stomach | 0.809524 | 0.829268 | 0.790698 |
| PLP1 AND SNAP23 | Astrocytoma | 0.777778 | 0.795455 | 0.76087 | CLDN18 AND LRIG3 | Stomach | 0.860759 | 0.944444 | 0.790698 |
| ADAM12 AND PMEPA1 | Breast | 0.857143 | 0.882353 | 0.833333 | CLDN18 AND ABHD3 | Stomach | 0.864198 | 0.921053 | 0.813953 |
| ADAM12 AND JAG2 | Breast | 0.854167 | 0.97619 | 0.759259 | CLDN18 AND ATP8B1 | Stomach | 0.837838 | 1 | 0.72093 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ADAM12 AND CELSR2 | Breast | 0.851485 | 0.914894 | 0.796296 | CLDN18 AND KCNC2 | Stomach | 0.767442 | 0.767442 | 0.767442 |
| ADAM12 AND TSPAN17 | Breast | 0.851064 | 1 | 0.740741 | CDH17 AND FAP | Stomach | 0.837209 | 0.837209 | 0.837209 |
| ADAM12 AND CNNM4 | Breast | 0.851064 | 1 | 0.740741 | CLDN18 AND KCNK12 | Stomach | 0.759494 | 0.833333 | 0.697674 |
| ADAM12 AND SLC9A7 | Breast | 0.851485 | 0.914894 | 0.796296 | CLDN18 AND ENPP1 | Stomach | 0.755556 | 0.723404 | 0.790698 |
| ADAM12 AND CX3CL1 | Breast | 0.849057 | 0.865385 | 0.833333 | CLDN18 AND LHFPL5 | Stomach | 0.765957 | 0.705882 | 0.837209 |
| ADAM12 AND CD9 | Breast | 0.848485 | 0.933333 | 0.777778 | MUC13 AND ESAM | Stomach | 0.851064 | 0.784314 | 0.930233 |
| ADAM12 AND UNC5B | Breast | 0.842105 | 0.97561 | 0.740741 | MUC13 AND F2R | Stomach | 0.857143 | 0.763636 | 0.976744 |
| ADAM12 AND CELSR1 | Breast | 0.841121 | 0.849057 | 0.833333 | CLDN18 AND GJB4 | Stomach | 0.704545 | 0.688889 | 0.72093 |
| ADAM12 AND SLC12A7 | Breast | 0.83871 | 1 | 0.722222 | CLDN18 AND PPAPDC1B | Stomach | 0.847059 | 0.857143 | 0.837209 |
| ADAM12 AND KIAA1324 | Breast | 0.834951 | 0.877551 | 0.796296 | MST1R AND BST2 | Stomach | 0.837838 | 1 | 0.72093 |
| ADAM12 AND GJB2 | Breast | 0.834951 | 0.877551 | 0.796296 | CDH17 AND SLC7A5 | Stomach | 0.72549 | 0.627119 | 0.860465 |
| ADAM12 AND CXADR | Breast | 0.826923 | 0.86 | 0.796296 | CLDN18 AND GRIK4 | Stomach | 0.781609 | 0.772727 | 0.790698 |
| ADAM12 AND SLC27A1 | Breast | 0.824742 | 0.930233 | 0.740741 | CLDN18 AND CDH20 | Stomach | 0.765432 | 0.815789 | 0.72093 |
| ADAM12 AND ACVR1B | Breast | 0.823529 | 0.875 | 0.777778 | CLDN18 AND MLNR | Stomach | 0.771084 | 0.8 | 0.744186 |
| ADAM12 AND ST14 | Breast | 0.821053 | 0.95122 | 0.722222 | CLDN18 AND PCDHAC2 | Stomach | 0.795455 | 0.777778 | 0.813953 |
| ADAM12 AND PROM2 | Breast | 0.821053 | 0.95122 | 0.722222 | CLDN18 AND CACNA1B | Stomach | 0.758621 | 0.75 | 0.767442 |
| ADAM12 AND CCR5 | Breast | 0.818182 | 0.803571 | 0.833333 | CLDN18 AND LRRC55 | Stomach | 0.782609 | 0.734694 | 0.837209 |
| ADAM12 AND ABCA3 | Breast | 0.817204 | 0.974359 | 0.703704 | CLDN18 AND LCT | Stomach | 0.765957 | 0.705882 | 0.837209 |
| ADAM12 AND LSR | Breast | 0.817204 | 0.974359 | 0.703704 | CLDN18 AND CACNG6 | Stomach | 0.765957 | 0.705882 | 0.837209 |
| ADAM12 AND LAX1 | Breast | 0.807339 | 0.8 | 0.814815 | CLDN18 AND PAQR8 | Stomach | 0.837838 | 1 | 0.72093 |
| ADAM12 AND ITGA11 | Breast | 0.804348 | 0.973684 | 0.685185 | CLDN18 AND LRFN2 | Stomach | 0.8 | 0.809524 | 0.790698 |
| ADAM12 AND PLXDC1 | Breast | 0.804124 | 0.906977 | 0.722222 | CLDN18 AND DIO1 | Stomach | 0.705882 | 0.714286 | 0.697674 |
| ADAM12 AND ITGAX | Breast | 0.8 | 0.926829 | 0.703704 | CLDN18 AND GALR2 | Stomach | 0.790123 | 0.842105 | 0.744186 |
| ADAM12 AND IL17RB | Breast | 0.8 | 0.869565 | 0.740741 | CLDN18 AND OPRM1 | Stomach | 0.777778 | 0.744681 | 0.813953 |
| FGG AND SLC26A6 | Liver | 0.923077 | 0.857143 | 1 | CLDN18 AND KCNH1 | Stomach | 0.755556 | 0.723404 | 0.790698 |
| FGG AND LRRC8D | Liver | 0.909091 | 1 | 0.833333 | CLDN18 AND ABCA12 | Stomach | 0.777778 | 0.744681 | 0.813953 |
| FGG AND SLC38A6 | Liver | 0.909091 | 1 | 0.833333 | CLDN18 AND OR52D1 | Stomach | 0.764045 | 0.73913 | 0.790698 |
| FGG AND HM13 | Liver | 1 | 1 | 1 | CLDN18 AND GPR135 | Stomach | 0.808989 | 0.782609 | 0.837209 |
| FGG AND SLC39A1 | Liver | 0.909091 | 1 | 0.833333 | CLDN18 AND CALHM1 | Stomach | 0.752688 | 0.7 | 0.813953 |
| FGG AND NCSTN | Liver | 1 | 1 | 1 | CLDN18 AND FSHR | Stomach | 0.725275 | 0.6875 | 0.767442 |
| FGG AND C6orf89 | Liver | 1 | 1 | 1 | CEACAM5 AND BST2 | Stomach | 0.771429 | 1 | 0.627907 |
| FGG AND LRP11 | Liver | 1 | 1 | 1 | CLDN18 AND GJA3 | Stomach | 0.771084 | 0.8 | 0.744186 |
| FGG AND ATP2A2 | Liver | 0.909091 | 1 | 0.833333 | CLDN18 AND GPR158 | Stomach | 0.755556 | 0.723404 | 0.790698 |
| FGG AND ADCY6 | Liver | 0.909091 | 1 | 0.833333 | ATP8B1 AND THY1 | Stomach | 0.871795 | 0.971429 | 0.790698 |
| FGG AND FGFRL1 | Liver | 1 | 1 | 1 | CLDN18 AND SLC22A11 | Stomach | 0.712644 | 0.704545 | 0.72093 |
| FGG AND CELSR3 | Liver | 0.857143 | 0.75 | 1 | CLDN18 AND P2RY4 | Stomach | 0.765957 | 0.705882 | 0.837209 |
| FGG AND ANO10 | Liver | 0.909091 | 1 | 0.833333 | CLDN18 AND ABCG4 | Stomach | 0.853659 | 0.897436 | 0.813953 |
| FGG AND NIPA1 | Liver | 0.909091 | 1 | 0.833333 | CLDN18 AND UMOD | Stomach | 0.719101 | 0.695652 | 0.744186 |
| FGG AND SLC17A5 | Liver | 0.909091 | 1 | 0.833333 | CLDN18 AND CEACAM7 | Stomach | 0.813953 | 0.813953 | 0.813953 |
| HPN AND SLC26A6 | Liver | 1 | 1 | 1 | MUC17 AND CLDN1 | Stomach | 0.853333 | 1 | 0.744186 |
| TFR2 AND SLC26A6 | Liver | 0.833333 | 0.833333 | 0.833333 | MUC13 AND IFI6 | Stomach | 0.729412 | 0.738095 | 0.72093 |
| FGG AND TSPAN17 | Liver | 0.909091 | 1 | 0.833333 | CLDN18 AND CACNG8 | Stomach | 0.818182 | 0.8 | 0.837209 |
| FGG AND CLN3 | Liver | 0.909091 | 1 | 0.833333 | CLDN18 AND CLRN1 | Stomach | 0.76087 | 0.714286 | 0.813953 |
| FGG AND NOX4 | Liver | 0.923077 | 0.857143 | 1 | CLDN18 AND CACNG2 | Stomach | 0.75 | 0.733333 | 0.767442 |
| FGG AND SLC26A11 | Liver | 0.909091 | 1 | 0.833333 | CLDN18 AND NPHS1 | Stomach | 0.791209 | 0.75 | 0.837209 |
| FGG AND NPBWR2 | Liver | 0.909091 | 1 | 0.833333 | CLDN18 AND GRIN2B | Stomach | 0.755556 | 0.723404 | 0.790698 |
| FGG AND ABCB8 | Liver | 0.857143 | 0.75 | 1 | CLDN18 AND GABBR2 | Stomach | 0.711111 | 0.680851 | 0.744186 |
| FGG AND PANX2 | Liver | 1 | 1 | 1 | CLDN18 AND SLC17A1 | Stomach | 0.769231 | 0.729167 | 0.813953 |
| FGG AND PIGU | Liver | 0.8 | 1 | 0.666667 | CLDN18 AND CALY | Stomach | 0.823529 | 0.833333 | 0.813953 |
| FGG AND PHEX | Liver | 1 | 1 | 1 | CLDN18 AND SEZ6 | Stomach | 0.769231 | 0.729167 | 0.813953 |
| FGG AND TMEM8B | Liver | 0.8 | 1 | 0.666667 | PTPRZ1 AND CD33 | Astrocytoma | 0.829787 | 0.8125 | 0.847826 |
| FGG AND PDCD1 | Liver | 0.909091 | 1 | 0.833333 | PTPRZ1 AND VCAM1 | Astrocytoma | 0.811881 | 0.745455 | 0.891304 |
| FGG AND MRAP2 | Liver | 0.8 | 0.666667 | 1 | PTPRZ1 AND CD38 | Astrocytoma | 0.764706 | 0.696429 | 0.847826 |
| FGG AND YIPF3 | Liver | 0.909091 | 1 | 0.833333 | PTPRZ1 AND CD79A | Astrocytoma | 0.761905 | 0.677966 | 0.869565 |
| FGG AND SPPL3 | Liver | 0.8 | 1 | 0.666667 | NCAM1 AND VANGL2 | Astrocytoma | 0.758621 | 0.804878 | 0.717391 |
| FGG AND CNNM3 | Liver | 0.8 | 0.666667 | 1 | PTPRZ1 AND EDNRB | Astrocytoma | 0.758621 | 0.804878 | 0.717391 |
| FGG AND OPRD1 | Liver | 1 | 1 | 1 | ADCYAP1R1 AND CD33 | Astrocytoma | 0.758621 | 0.804878 | 0.717391 |
| FGG AND ADORA2B | Liver | 0.909091 | 1 | 0.833333 | NRCAM AND CD33 | Astrocytoma | 0.755102 | 0.711538 | 0.804348 |
| FGG AND IGF2R | Liver | 0.909091 | 1 | 0.833333 | PTPRZ1 AND MS4A1 | Astrocytoma | 0.75 | 0.672414 | 0.847826 |
| FGG AND ATP9B | Liver | 0.8 | 1 | 0.666667 | PTPRZ1 AND NCAM1 | Astrocytoma | 0.745455 | 0.640625 | 0.891304 |
| ASGR1 AND SMO | Liver | 0.8 | 1 | 0.666667 | PTPRZ1 AND BMPR1B | Astrocytoma | 0.733945 | 0.634921 | 0.869565 |
| FGG AND MMP14 | Liver | 1 | 1 | 1 | PTPRZ1 AND L1CAM | Astrocytoma | 0.733945 | 0.634921 | 0.869565 |
| FGG AND SLC5A5 | Liver | 0.909091 | 1 | 0.833333 | PTPRZ1 AND P2RX5 | Astrocytoma | 0.728972 | 0.639344 | 0.847826 |
| FGG AND SLC2A5 | Liver | 0.909091 | 1 | 0.833333 | PTPRZ1 AND ITGB3 | Astrocytoma | 0.725275 | 0.733333 | 0.717391 |
| FGG AND SMO | Liver | 0.8 | 1 | 0.666667 | PTPRZ1 AND TNFRSF10A | Astrocytoma | 0.717391 | 0.717391 | 0.717391 |
| FGG AND STIM1 | Liver | 0.909091 | 1 | 0.833333 | PTPRZ1 AND GUCY2C | Astrocytoma | 0.717391 | 0.717391 | 0.717391 |
| FGG AND STX4 | Liver | 0.8 | 1 | 0.666667 | NRCAM AND MUC1 | Astrocytoma | 0.716981 | 0.633333 | 0.826087 |
| FGG AND TMEM67 | Liver | 0.8 | 0.666667 | 1 | PTPRZ1 AND FCRL5 | Astrocytoma | 0.715789 | 0.693878 | 0.73913 |
| SLC27A5 AND SLC26A6 | Liver | 0.923077 | 0.857143 | 1 | PTPRZ1 AND FAP | Astrocytoma | 0.712644 | 0.756098 | 0.673913 |
| FGG AND PLXNC1 | Liver | 0.8 | 1 | 0.666667 | PTPRZ1 AND CLDN18 | Astrocytoma | 0.709677 | 0.702128 | 0.717391 |
| FGG AND MFSD5 | Liver | 0.8 | 1 | 0.666667 | PTPRZ1 AND FCRL2 | Astrocytoma | 0.709677 | 0.702128 | 0.717391 |
| FGG AND DAGLB | Liver | 0.8 | 1 | 0.666667 | PTPRZ1 AND CLDN2 | Astrocytoma | 0.709677 | 0.702128 | 0.717391 |
| FGG AND TMPRSS5 | Liver | 0.8 | 0.666667 | 1 | NCAM1 AND ABCA1 | Astrocytoma | 0.708861 | 0.848485 | 0.608696 |
| FGG AND KCNG3 | Liver | 0.8 | 0.666667 | 1 | NCAM1 AND TSPAN11 | Astrocytoma | 0.708333 | 0.68 | 0.73913 |
| FGG AND SLC4A11 | Liver | 0.833333 | 0.833333 | 0.833333 | PTPRZ1 AND TNFRSF13C | Astrocytoma | 0.705882 | 0.769231 | 0.652174 |
| FGG AND CRHR1 | Liver | 0.8 | 1 | 0.666667 | PTPRZ1 AND CD276 | Astrocytoma | 0.704545 | 0.738095 | 0.673913 |
| SLC39A14 AND OLR1 | Pancreas | 0.736842 | 0.875 | 0.636364 | PTPRZ1 AND IL2RA | Astrocytoma | 0.703297 | 0.711111 | 0.695652 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| KCNE4 AND NTM | Pancreas | 0.7 | 0.777778 | 0.636364 | PTPRZ1 AND CD79B | Astrocytoma | 0.703297 | 0.711111 | 0.695652 |
| KCNE4 AND SYT13 | Pancreas | 0.695652 | 0.666667 | 0.727273 | PTPRZ1 AND PTK7 | Astrocytoma | 0.703297 | 0.711111 | 0.695652 |
| NOX4 AND TM4SF1 | Pancreas | 0.777778 | 1 | 0.636364 | PTPRZ1 AND TNFRSF17 | Astrocytoma | 0.702128 | 0.6875 | 0.717391 |
| NOX4 AND ADAM28 | Pancreas | 0.705882 | 1 | 0.545455 | NCAM1 AND SLC3A2 | Astrocytoma | 0.702128 | 0.6875 | 0.717391 |
| NOX4 AND LITAF | Pancreas | 0.705882 | 1 | 0.545455 | MMP16 AND ITGAV | Astrocytoma | 0.701299 | 0.870968 | 0.586957 |
| TNFSF4 AND SYT13 | Pancreas | 0.736842 | 0.875 | 0.636364 | ADCYAP1R1 AND CLDN1 | Astrocytoma | 0.701031 | 0.666667 | 0.73913 |
| KCNE4 AND MARCH1 | Pancreas | 0.666667 | 0.615385 | 0.727273 | NRCAM AND CD38 | Astrocytoma | 0.698113 | 0.616667 | 0.804348 |
| KCNE4 AND IGSF6 | Pancreas | 0.666667 | 0.615385 | 0.727273 | PTPRZ1 AND SSTR1 | Astrocytoma | 0.698113 | 0.616667 | 0.804348 |
| KCNE4 AND FAM26F | Pancreas | 0.666667 | 0.615385 | 0.727273 | PTPRZ1 AND CD37 | Astrocytoma | 0.695652 | 0.695652 | 0.695652 |
| KCNE4 AND TACSTD2 | Pancreas | 0.666667 | 0.7 | 0.636364 | PTPRZ1 AND CA9 | Astrocytoma | 0.694737 | 0.673469 | 0.717391 |
| KCNE4 AND TSPAN8 | Pancreas | 0.736842 | 0.875 | 0.636364 | NCAM1 AND ATP13A4 | Astrocytoma | 0.692308 | 0.84375 | 0.586957 |
| TREM2 AND TNFSF4 | Pancreas | 0.705882 | 1 | 0.545455 | BMPR1B AND TLR4 | Astrocytoma | 0.691358 | 0.8 | 0.608696 |
| SYT13 AND ATP10D | Pancreas | 0.727273 | 0.727273 | 0.727273 | MMP16 AND SLC39A6 | Astrocytoma | 0.690476 | 0.763158 | 0.630435 |
| SYT13 AND LRRC32 | Pancreas | 0.72 | 0.642857 | 0.818182 | NRCAM AND FAP | Astrocytoma | 0.690476 | 0.763158 | 0.630435 |
| KCNE4 AND SLC41A2 | Pancreas | 0.666667 | 0.857143 | 0.545455 | PTPRZ1 AND SLC7A5 | Astrocytoma | 0.688172 | 0.680851 | 0.695652 |
| KCNE4 AND GPRC5A | Pancreas | 0.666667 | 0.857143 | 0.545455 | NCAM1 AND BMPR1A | Astrocytoma | 0.688172 | 0.680851 | 0.695652 |
| NOX4 AND CXCR4 | Pancreas | 0.666667 | 0.857143 | 0.545455 | NCAM1 AND SLC16A2 | Astrocytoma | 0.688172 | 0.680851 | 0.695652 |
| KCNE4 AND SLC7A7 | Pancreas | 0.666667 | 0.615385 | 0.727273 | PTPRZ1 AND SSTR4 | Astrocytoma | 0.688172 | 0.680851 | 0.695652 |
| KCNE4 AND CD48 | Pancreas | 0.666667 | 0.615385 | 0.727273 | PTPRZ1 AND ULBP1 | Astrocytoma | 0.6875 | 0.66 | 0.717391 |
| KCNE4 AND SLC44A3 | Pancreas | 0.695652 | 0.666667 | 0.727273 | PTPRZ1 AND FCRL1 | Astrocytoma | 0.6875 | 0.66 | 0.717391 |
| KCNE4 AND LSR | Pancreas | 0.666667 | 0.857143 | 0.545455 | PTPRZ1 AND CD19 | Astrocytoma | 0.685714 | 0.610169 | 0.782609 |
| TNFSF13B AND SYT13 | Pancreas | 0.842105 | 1 | 0.727273 | CALCRL AND BMPR1B | Astrocytoma | 0.682927 | 0.777778 | 0.608696 |
| TNFSF4 AND DSG2 | Pancreas | 0.736842 | 0.875 | 0.636364 | MMP16 AND EDNRB | Astrocytoma | 0.682927 | 0.777778 | 0.608696 |
| VSIG1 AND GJA1 | Pancreas | 0.666667 | 0.857143 | 0.545455 | NCAM1 AND SRR | Astrocytoma | 0.680851 | 0.666667 | 0.695652 |
| NOX4 AND SLC38A5 | Pancreas | 0.695652 | 0.666667 | 0.727273 | PTPRZ1 AND TNFSF11 | Astrocytoma | 0.680412 | 0.647059 | 0.717391 |
| OSMR AND SYT13 | Pancreas | 0.666667 | 0.7 | 0.636364 | PTPRZ1 AND GPA33 | Astrocytoma | 0.680412 | 0.647059 | 0.717391 |
| KCNE4 AND ABCC8 | Pancreas | 0.736842 | 0.875 | 0.636364 | PTPRZ1 AND ABCB5 | Astrocytoma | 0.680412 | 0.647059 | 0.717391 |
| GP2 AND TLR2 | Pancreas | 0.777778 | 1 | 0.636364 | PTPRZ1 AND MUC4 | Astrocytoma | 0.680412 | 0.647059 | 0.717391 |
| NTM AND DSG2 | Pancreas | 0.705882 | 1 | 0.545455 | PTPRZ1 AND CR2 | Astrocytoma | 0.68 | 0.62963 | 0.73913 |
| NOX4 AND GPRC5A | Pancreas | 0.705882 | 1 | 0.545455 | NRCAM AND RAET1E | Astrocytoma | 0.678899 | 0.587302 | 0.804348 |
| NOX4 AND PTPRH | Pancreas | 0.736842 | 0.875 | 0.636364 | KCNN3 AND CLDN1 | Astrocytoma | 0.690476 | 0.763158 | 0.630435 |
| TREM2 AND ADAM28 | Pancreas | 0.666667 | 0.857143 | 0.545455 | KCNN3 AND CD33 | Astrocytoma | 0.691358 | 0.8 | 0.608696 |
| KCNE4 AND ADAM12 | Pancreas | 0.666667 | 0.615385 | 0.727273 | ADCYAP1R1 AND FAP | Astrocytoma | 0.674699 | 0.756757 | 0.608696 |
| TM4SF1 AND SYT13 | Pancreas | 0.736842 | 0.875 | 0.636364 | PTPRZ1 AND CD180 | Astrocytoma | 0.674699 | 0.756757 | 0.608696 |
| KCNE4 AND GABRP | Pancreas | 0.695652 | 0.666667 | 0.727273 | ADAM12 AND SDC1 | Breast | 0.875 | 1 | 0.777778 |
| OLR1 AND ITGA11 | Pancreas | 0.736842 | 0.875 | 0.636364 | ADAM12 AND MUC1 | Breast | 0.857143 | 0.954545 | 0.777778 |
| SYT13 AND TSPAN4 | Pancreas | 0.761905 | 0.8 | 0.727273 | ADAM12 AND CLDN7 | Breast | 0.833333 | 0.952381 | 0.740741 |
| TNFSF13B AND PPAP2C | Pancreas | 0.705882 | 1 | 0.545455 | FAP AND CD300LF | Breast | 0.8 | 0.926829 | 0.703704 |
| SYT13 AND PKD2 | Pancreas | 0.64 | 0.571429 | 0.727273 | FAP AND CXCR4 | Breast | 0.826087 | 1 | 0.703704 |
| KCNE4 AND TLR2 | Pancreas | 0.64 | 0.571429 | 0.727273 | FAP AND SLC16A3 | Breast | 0.821053 | 0.95122 | 0.722222 |
| KCNE4 AND GPR65 | Pancreas | 0.64 | 0.571429 | 0.727273 | FAP AND IL17RB | Breast | 0.821053 | 0.95122 | 0.722222 |
| GP2 AND OLR1 | Pancreas | 0.777778 | 1 | 0.636364 | FAP AND SLC5A2 | Breast | 0.863158 | 1 | 0.759259 |
| GP2 AND EDNRA | Pancreas | 0.8 | 0.888889 | 0.727273 | FAP AND CNNM4 | Breast | 0.813187 | 1 | 0.685185 |
| GP2 AND ITGB2 | Pancreas | 0.705882 | 1 | 0.545455 | FAP AND KIAA1324 | Breast | 0.786517 | 1 | 0.648148 |
| KCNE4 AND ITGA4 | Pancreas | 0.666667 | 0.615385 | 0.727273 | FAP AND OR51B2 | Breast | 0.783505 | 0.883721 | 0.703704 |
| GP2 AND NTM | Pancreas | 0.777778 | 1 | 0.636364 | FAP AND UNC5B | Breast | 0.772727 | 1 | 0.62963 |
| SYT13 AND GLIPR1 | Pancreas | 0.952381 | 1 | 0.909091 | FAP AND MFSD10 | Breast | 0.758621 | 1 | 0.611111 |
| KCNE4 AND SLC39A14 | Pancreas | 0.636364 | 0.636364 | 0.636364 | ADAM12 AND ERBB3 | Breast | 0.758621 | 1 | 0.611111 |
| NOX4 AND CD300LF | Pancreas | 0.636364 | 0.636364 | 0.636364 | SLC5A6 AND FAP | Breast | 0.758621 | 1 | 0.611111 |
| KCNE4 AND ATP1A1 | Pancreas | 0.636364 | 0.636364 | 0.636364 | FAP AND CACFD1 | Breast | 0.886598 | 1 | 0.796296 |
| KCNE4 AND PTPN2 | Pancreas | 0.666667 | 0.615385 | 0.727273 | FAP AND VMP1 | Breast | 0.795699 | 0.948718 | 0.685185 |
| GP2 AND LRRC32 | Pancreas | 0.705882 | 1 | 0.545455 | FAP AND LPAR2 | Breast | 0.758621 | 1 | 0.611111 |
| NOX4 AND VSIG1 | Pancreas | 0.7 | 0.777778 | 0.636364 | FAP AND ADAM8 | Breast | 0.782609 | 0.947368 | 0.666667 |
| KCNE4 AND TMEM30B | Pancreas | 0.64 | 0.571429 | 0.727273 | FGG AND ERBB3 | Liver | 0.833333 | 0.833333 | 0.833333 |
| TNFSF13B AND GJB1 | Pancreas | 0.705882 | 1 | 0.545455 | FGG AND EPHB2 | Liver | 1 | 1 | 1 |
| PDGFRB AND LITAF | Pancreas | 0.705882 | 1 | 0.545455 | FGG AND CD34 | Liver | 0.8 | 1 | 0.666667 |
| SYT13 AND CXCR4 | Pancreas | 0.842105 | 1 | 0.727273 | ASGR1 AND CD34 | Liver | 0.909091 | 1 | 0.833333 |
| TM4SF1 AND ITGA11 | Pancreas | 0.631579 | 0.75 | 0.545455 | ASGR1 AND ERBB3 | Liver | 0.769231 | 0.714286 | 0.833333 |
| NOX4 AND TREM1 | Pancreas | 0.64 | 0.571429 | 0.727273 | FGG AND IL3RA | Liver | 0.769231 | 0.714286 | 0.833333 |
| NOX4 AND TNFRSF21 | Pancreas | 0.631579 | 0.75 | 0.545455 | FGG AND LGR5 | Liver | 0.833333 | 0.833333 | 0.833333 |
| KCNE4 AND SLC1A1 | Pancreas | 0.727273 | 0.727273 | 0.727273 | ASGR1 AND EPHB2 | Liver | 0.909091 | 1 | 0.833333 |
| TNFSF4 AND GPRC5A | Pancreas | 0.705882 | 1 | 0.545455 | HPN AND ERBB3 | Liver | 0.833333 | 0.833333 | 0.833333 |
| GP2 AND AMIGO2 | Pancreas | 0.842105 | 1 | 0.727273 | HPN AND CD34 | Liver | 0.909091 | 1 | 0.833333 |
| GP2 AND ITGAM | Pancreas | 0.842105 | 1 | 0.727273 | FGG AND VTCN1 | Liver | 0.8 | 1 | 0.666667 |
| TNFSF13B AND DUOX2 | Pancreas | 0.666667 | 0.857143 | 0.545455 | ABCC6 AND CD34 | Liver | 0.8 | 1 | 0.666667 |
| SYT13 AND FXYD5 | Pancreas | 0.842105 | 1 | 0.727273 | HPN AND EPHB2 | Liver | 1 | 1 | 1 |
| OLR1 AND DUOX2 | Pancreas | 0.705882 | 1 | 0.545455 | TFR2 AND EPHB2 | Liver | 0.909091 | 1 | 0.833333 |
| GP2 AND MSR1 | Pancreas | 0.8 | 0.888889 | 0.727273 | ASGR1 AND LGR5 | Liver | 0.769231 | 0.714286 | 0.833333 |
| GJB1 AND CALHM2 | Pancreas | 0.705882 | 1 | 0.545455 | ABCB4 AND CD34 | Liver | 0.8 | 1 | 0.666667 |
| GP2 AND CLEC5A | Pancreas | 0.8 | 0.888889 | 0.727273 | SLC27A5 AND EPHB2 | Liver | 0.909091 | 1 | 0.833333 |
| GP2 AND ADAM12 | Pancreas | 0.736842 | 0.875 | 0.636364 | HPN AND IL3RA | Liver | 0.833333 | 0.833333 | 0.833333 |
| NOX4 AND SLCO2B1 | Pancreas | 0.7 | 0.777778 | 0.636364 | HPN AND LGR5 | Liver | 0.833333 | 0.833333 | 0.833333 |
| NOX4 AND PTPN2 | Pancreas | 0.761905 | 0.8 | 0.727273 | SLC27A5 AND ERBB3 | Liver | 0.769231 | 0.714286 | 0.833333 |
| OLR1 AND SLC15A1 | Pancreas | 0.705882 | 1 | 0.545455 | SLC27A5 AND CD34 | Liver | 0.8 | 1 | 0.666667 |
| SYT13 AND CALCRL | Pancreas | 0.64 | 0.571429 | 0.727273 | FGG AND SSTR5 | Liver | 0.727273 | 0.8 | 0.666667 |
| TREM2 AND SLC28A3 | Pancreas | 0.666667 | 0.857143 | 0.545455 | FGG AND SSTR3 | Liver | 0.769231 | 0.714286 | 0.833333 |
| SYT13 AND ITGAM | Pancreas | 0.846154 | 0.733333 | 1 | HPN AND ULBP1 | Liver | 0.769231 | 0.714286 | 0.833333 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NOX4 AND OLR1 | Pancreas | 0.625 | 1 | 0.454545 | HPN AND VTCN1 | Liver | 0.8 | 1 | 0.666667 |
| CLEC5A AND SYT13 | Pancreas | 0.625 | 1 | 0.454545 | ABCB4 AND ERBB3 | Liver | 0.909091 | 1 | 0.833333 |
| TREM2 AND DSG2 | Pancreas | 0.625 | 1 | 0.454545 | FGG AND CLDN9 | Liver | 0.857143 | 0.75 | 1 |
| TM4SF1 AND NALCN | Pancreas | 0.625 | 1 | 0.454545 | FGG AND ULBP1 | Liver | 0.714286 | 0.625 | 0.833333 |
| CLEC5A AND GJB1 | Pancreas | 0.625 | 1 | 0.454545 | SLC27A5 AND LGR5 | Liver | 0.769231 | 0.714286 | 0.833333 |
| NOX4 AND TREM2 | Pancreas | 0.625 | 1 | 0.454545 | AQP9 AND ERBB3 | Liver | 0.769231 | 0.714286 | 0.833333 |
| TREM2 AND GJB2 | Pancreas | 0.625 | 1 | 0.454545 | FGG AND ABCB5 | Liver | 0.714286 | 0.625 | 0.833333 |
| NOX4 AND SLC16A3 | Pancreas | 0.625 | 1 | 0.454545 | SLC27A5 AND IL3RA | Liver | 0.714286 | 0.625 | 0.833333 |
| SYT13 AND TYROBP | Pancreas | 0.625 | 1 | 0.454545 | FGG AND ITGB6 | Liver | 0.8 | 0.666667 | 1 |
| KCNE4 AND GJB1 | Pancreas | 0.625 | 1 | 0.454545 | FGG AND GPA33 | Liver | 0.8 | 0.666667 | 1 |
| NOX4 AND HLA-C | Pancreas | 0.625 | 1 | 0.454545 | FGG AND ULBP2 | Liver | 0.8 | 0.666667 | 1 |
| KCNE4 AND TREM2 | Pancreas | 0.625 | 1 | 0.454545 | ASGR1 AND VTCN1 | Liver | 0.8 | 1 | 0.666667 |
| GP2 AND CALHM2 | Pancreas | 0.666667 | 0.615385 | 0.727273 | KCNE4 AND CLDN7 | Pancreas | 0.727273 | 0.727273 | 0.727273 |
| TNFSF13B AND RAMP1 | Pancreas | 0.777778 | 1 | 0.636364 | KCNE4 AND STEAP1 | Pancreas | 0.736842 | 0.875 | 0.636364 |
| CLEC5A AND TNFRSF21 | Pancreas | 0.625 | 1 | 0.454545 | FAP AND CXCR4 | Pancreas | 0.777778 | 1 | 0.636364 |
| GP2 AND CD53 | Pancreas | 0.777778 | 1 | 0.636364 | FAP AND DSG2 | Pancreas | 0.777778 | 1 | 0.636364 |
| TNFSF13B AND DSG2 | Pancreas | 0.705882 | 1 | 0.545455 | FAP AND SYT13 | Pancreas | 0.842105 | 1 | 0.727273 |
| NOX4 AND SYT13 | Pancreas | 0.62069 | 0.5 | 0.818182 | TNFSF4 AND EPCAM | Pancreas | 0.777778 | 1 | 0.636364 |
| NOX4 AND SLAMF6 | Pancreas | 0.62069 | 0.5 | 0.818182 | STEAP1 AND CXCR4 | Pancreas | 0.777778 | 1 | 0.636364 |
| CDH6 AND ATRAID | Renal | 0.857143 | 1 | 0.75 | FAP AND TNFRSF21 | Pancreas | 0.777778 | 1 | 0.636364 |
| SLC3A1 AND SIRPA | Renal | 0.857143 | 1 | 0.75 | FAP AND TSPAN1 | Pancreas | 0.705882 | 1 | 0.545455 |
| SLC3A1 AND TSPAN4 | Renal | 0.857143 | 1 | 0.75 | FAP AND ADAM28 | Pancreas | 0.705882 | 1 | 0.545455 |
| CDH6 AND HLA-C | Renal | 0.857143 | 1 | 0.75 | TNFSF11 AND TM4SF1 | Pancreas | 0.666667 | 0.857143 | 0.545455 |
| CDH6 AND JTB | Renal | 0.857143 | 1 | 0.75 | FAP AND CD53 | Pancreas | 0.777778 | 1 | 0.636364 |
| CDH6 AND S100A10 | Renal | 0.857143 | 1 | 0.75 | GP2 AND GPNMB | Pancreas | 0.777778 | 1 | 0.636364 |
| CDH6 AND HLA-B | Renal | 0.857143 | 1 | 0.75 | FAP AND ILDR1 | Pancreas | 0.777778 | 1 | 0.636364 |
| HEPH AND SLC39A10 | Colon | 1 | 1 | 1 | EPHA3 AND TM4SF1 | Pancreas | 0.705882 | 1 | 0.545455 |
| MEP1A AND AMIGO2 | Colon | 0.909091 | 0.833333 | 1 | FAP AND TM4SF1 | Pancreas | 0.842105 | 1 | 0.727273 |
| ATP10B AND AMIGO2 | Colon | 0.909091 | 0.833333 | 1 | NOX4 AND ITGB6 | Pancreas | 0.705882 | 1 | 0.545455 |
| GPR160 AND EVA1A | Colon | 0.888889 | 1 | 0.8 | FAP AND FXYD3 | Pancreas | 0.705882 | 1 | 0.545455 |
| GPR160 AND EDNRA | Colon | 0.888889 | 1 | 0.8 | FAP AND ATP1B1 | Pancreas | 0.777778 | 1 | 0.636364 |
| GPR160 AND PCDH17 | Colon | 0.888889 | 1 | 0.8 | FAP AND PTPN2 | Pancreas | 0.777778 | 1 | 0.636364 |
| GPR160 AND LDLRAD3 | Colon | 0.888889 | 1 | 0.8 | FAP AND TSPAN13 | Pancreas | 0.777778 | 1 | 0.636364 |
| GPR160 AND CDH3 | Colon | 0.888889 | 1 | 0.8 | FAP AND UGT8 | Pancreas | 0.777778 | 1 | 0.636364 |
| HEPH AND EVA1A | Colon | 0.888889 | 1 | 0.8 | ADAM12 AND ITGB6 | Pancreas | 0.705882 | 1 | 0.545455 |
| GPR160 AND GJA4 | Colon | 0.888889 | 1 | 0.8 | FAP AND CD300LF | Pancreas | 0.777778 | 1 | 0.636364 |
| PMEPA1 AND LY75 | Colon | 0.888889 | 1 | 0.8 | FAP AND NPC1L1 | Pancreas | 0.842105 | 1 | 0.727273 |
| HEPH AND IL1RAP | Colon | 0.888889 | 1 | 0.8 | FAP AND SLC44A3 | Pancreas | 0.842105 | 1 | 0.727273 |
| PMEPA1 AND GPR160 | Colon | 0.888889 | 1 | 0.8 | CLDN2 AND OLR1 | Pancreas | 0.8 | 0.888889 | 0.727273 |
| PMEPA1 AND PON2 | Colon | 0.888889 | 1 | 0.8 | FAP AND LSR | Pancreas | 0.777778 | 1 | 0.636364 |
| GPR160 AND PODXL | Colon | 0.888889 | 1 | 0.8 | FAP AND SLC6A14 | Pancreas | 0.705882 | 1 | 0.545455 |
| GPR160 AND TACSTD2 | Colon | 0.888889 | 1 | 0.8 | KCNE4 AND STEAP2 | Pancreas | 0.636364 | 0.636364 | 0.636364 |
| MEP1A AND SLC39A10 | Colon | 1 | 1 | 1 | KCNE4 AND CLDN2 | Pancreas | 0.636364 | 0.636364 | 0.636364 |
| HEPH AND TACSTD2 | Colon | 1 | 1 | 1 | FAP AND IL2RG | Pancreas | 0.842105 | 1 | 0.727273 |
| PMEPA1 AND HEPH | Colon | 0.888889 | 1 | 0.8 | FAP AND GPRC5A | Pancreas | 0.777778 | 1 | 0.636364 |
| PMEPA1 AND IFITM1 | Colon | 0.888889 | 1 | 0.8 | NOX4 AND FCRL5 | Pancreas | 0.692308 | 0.6 | 0.818182 |
| GPR160 AND PDPN | Colon | 0.888889 | 1 | 0.8 | FAP AND TNFSF13B | Pancreas | 0.777778 | 1 | 0.636364 |
| PMEPA1 AND SPINT1 | Colon | 0.888889 | 1 | 0.8 | FAP AND F11R | Pancreas | 0.777778 | 1 | 0.636364 |
| ATP10B AND SLC39A10 | Colon | 1 | 1 | 1 | FAP AND CD80 | Pancreas | 0.777778 | 1 | 0.636364 |
| GPR160 AND EDAR | Colon | 0.888889 | 1 | 0.8 | FAP AND OR1A2 | Pancreas | 0.842105 | 1 | 0.727273 |
| HEPH AND EDAR | Colon | 0.888889 | 1 | 0.8 | FAP AND ST14 | Pancreas | 0.777778 | 1 | 0.636364 |
| PMEPA1 AND ATP1B1 | Colon | 0.888889 | 1 | 0.8 | FAP AND CRB3 | Pancreas | 0.777778 | 1 | 0.636364 |
| SLC5A1 AND CD81 | Colon | 0.888889 | 1 | 0.8 | FAP AND TACSTD2 | Pancreas | 0.842105 | 1 | 0.727273 |
| PMEPA1 AND ATP6AP2 | Colon | 0.888889 | 1 | 0.8 | FAP AND GPR160 | Pancreas | 0.777778 | 1 | 0.636364 |
| PMEPA1 AND GPRC5A | Colon | 0.888889 | 1 | 0.8 | FAP AND CDH1 | Pancreas | 0.777778 | 1 | 0.636364 |
| PPAP2C AND IFITM1 | Colon | 0.888889 | 1 | 0.8 | FAP AND DSC2 | Pancreas | 0.705882 | 1 | 0.545455 |
| PMEPA1 AND IFNGR2 | Colon | 0.888889 | 1 | 0.8 | FAP AND C1orf210 | Pancreas | 0.777778 | 1 | 0.636364 |
| AMIGO2 AND PSENEN | Colon | 0.888889 | 1 | 0.8 | TNFSF4 AND CLDN7 | Pancreas | 0.736842 | 0.875 | 0.636364 |
| IHH AND SLC39A10 | Colon | 0.888889 | 1 | 0.8 | KCNE4 AND ITGB6 | Pancreas | 0.625 | 1 | 0.454545 |
| IYD AND SLC39A10 | Colon | 0.909091 | 0.833333 | 1 | FAP AND LITAF | Pancreas | 0.625 | 1 | 0.454545 |
| HEPH AND APCDD1 | Colon | 0.8 | 0.8 | 0.8 | KCNE4 AND EPCAM | Pancreas | 0.625 | 1 | 0.454545 |
| LSR AND AMIGO2 | Colon | 0.8 | 0.8 | 0.8 | FAP AND VNN2 | Pancreas | 0.842105 | 1 | 0.727273 |
| AMIGO2 AND IYD | Colon | 0.8 | 0.8 | 0.8 | FAP AND TAS2R16 | Pancreas | 0.777778 | 1 | 0.636364 |
| AMIGO2 AND TM4SF5 | Colon | 0.8 | 0.8 | 0.8 | FAP AND FPR1 | Pancreas | 0.842105 | 1 | 0.727273 |
| GPM6B AND BMP2 | Ependymoma | 1 | 1 | 1 | FAP AND PCDHGA10 | Pancreas | 0.842105 | 1 | 0.727273 |
| GPM6B AND WLS | Ependymoma | 1 | 1 | 1 | FAP AND SPINT1 | Pancreas | 0.842105 | 1 | 0.727273 |
| SLC52A2 AND TMEM123 | Esophagus | 0.782609 | 1 | 0.642857 | FAP AND IL1R2 | Pancreas | 0.842105 | 1 | 0.727273 |
| PTPRZ1 AND OR1A1 | Glioblastoma | 0.909091 | 0.9375 | 0.882353 | FAP AND TREM2 | Pancreas | 0.777778 | 1 | 0.636364 |
| PTPRZ1 AND SIGLEC10 | Glioblastoma | 0.866667 | 1 | 0.764706 | CDH6 AND TNFRSF13C | Renal | 0.857143 | 1 | 0.75 |
| PTPRZ1 AND ADAM12 | Glioblastoma | 0.866667 | 1 | 0.764706 | CDH6 AND SLAMF7 | Renal | 0.857143 | 1 | 0.75 |
| PTPRZ1 AND SLC4A2 | Glioblastoma | 0.9375 | 1 | 0.882353 | CDH6 AND ABCB5 | Renal | 0.857143 | 1 | 0.75 |
| PTPRZ1 AND SIRPG | Glioblastoma | 0.9375 | 1 | 0.882353 | SLC3A1 AND CD276 | Renal | 0.818182 | 0.9 | 0.75 |
| NRCAM AND SLC4A2 | Glioblastoma | 0.875 | 0.933333 | 0.823529 | CDH6 AND CD70 | Renal | 0.857143 | 1 | 0.75 |
| PTPRZ1 AND CD84 | Glioblastoma | 0.866667 | 1 | 0.764706 | CDH6 AND CXCR5 | Renal | 0.857143 | 1 | 0.75 |
| PTPRZ1 AND ABCA1 | Glioblastoma | 0.875 | 0.933333 | 0.823529 | CDH6 AND ENPP3 | Renal | 0.8 | 1 | 0.666667 |
| NRCAM AND BRCA1 | Glioblastoma | 0.903226 | 1 | 0.823529 | CDH6 AND CD52 | Renal | 0.857143 | 1 | 0.75 |
| PTPRZ1 AND KCNK15 | Glioblastoma | 0.903226 | 1 | 0.823529 | CDH6 AND ERBB3 | Renal | 0.8 | 1 | 0.666667 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NRCAM AND CYBA | Glioblastoma | 0.9375 | 1 | 0.882353 | CDH6 AND FOLR1 | Renal | 0.857143 | 1 | 0.75 |
| PTPRZ1 AND SLC2A5 | Glioblastoma | 0.866667 | 1 | 0.764706 | SLC3A1 AND MET | Renal | 0.8 | 1 | 0.666667 |
| PTPRZ1 AND NRCAM | Glioblastoma | 0.909091 | 0.9375 | 0.882353 | CDH6 AND ULBP1 | Renal | 0.857143 | 1 | 0.75 |
| PTPRZ1 AND ATP12A | Glioblastoma | 0.866667 | 1 | 0.764706 | CDH6 AND CD37 | Renal | 0.857143 | 1 | 0.75 |
| NRCAM AND KCNK15 | Glioblastoma | 0.857143 | 0.833333 | 0.882353 | CDH6 AND CD19 | Renal | 0.857143 | 1 | 0.75 |
| PTPRZ1 AND GPR65 | Glioblastoma | 0.83871 | 0.928571 | 0.764706 | CDH6 AND VCAM1 | Renal | 0.8 | 1 | 0.666667 |
| PTPRZ1 AND CDH6 | Glioblastoma | 0.866667 | 1 | 0.764706 | CDH6 AND EPCAM | Renal | 0.8 | 1 | 0.666667 |
| PTPRZ1 AND MR1 | Glioblastoma | 0.866667 | 1 | 0.764706 | CDH6 AND SLC34A2 | Renal | 0.857143 | 1 | 0.75 |
| NRCAM AND SLC22A4 | Glioblastoma | 0.882353 | 0.882353 | 0.882353 | CDH6 AND MET | Renal | 0.857143 | 1 | 0.75 |
| PTPRZ1 AND MMP16 | Glioblastoma | 0.875 | 0.933333 | 0.823529 | CDH6 AND GPNMB | Renal | 0.857143 | 1 | 0.75 |
| PTPRZ1 AND CLEC4A | Glioblastoma | 0.9375 | 1 | 0.882353 | VCAM1 AND SYT13 | Renal | 0.857143 | 1 | 0.75 |
| PTPRZ1 AND CD99 | Glioblastoma | 0.9375 | 1 | 0.882353 | SLC3A1 AND VCAM1 | Renal | 0.761905 | 0.888889 | 0.666667 |
| PTPRZ1 AND FCGRT | Glioblastoma | 0.866667 | 1 | 0.764706 | KCNJ16 AND VCAM1 | Renal | 0.761905 | 0.888889 | 0.666667 |
| NRCAM AND VANGL2 | Glioblastoma | 0.875 | 0.933333 | 0.823529 | VCAM1 AND OR10H3 | Renal | 0.761905 | 0.888889 | 0.666667 |
| NRCAM AND PCDH18 | Glioblastoma | 0.866667 | 1 | 0.764706 | DPEP1 AND CD81 | Colon | 1 | 1 | 1 |
| PTPRZ1 AND GJC1 | Glioblastoma | 0.827586 | 1 | 0.705882 | DPEP1 AND IFITM1 | Colon | 1 | 1 | 1 |
| PTPRZ1 AND ATP13A1 | Glioblastoma | 0.827586 | 1 | 0.705882 | DPEP1 AND AMIGO2 | Colon | 1 | 1 | 1 |
| PTPRZ1 AND DDR2 | Glioblastoma | 0.827586 | 1 | 0.705882 | HEPH AND CLDN1 | Colon | 1 | 1 | 1 |
| PTPRZ1 AND C5AR1 | Glioblastoma | 0.827586 | 1 | 0.705882 | GUCY2C AND AMIGO2 | Colon | 0.909091 | 0.833333 | 1 |
| PTPRZ1 AND ABCC3 | Glioblastoma | 0.827586 | 1 | 0.705882 | MUC13 AND AMIGO2 | Colon | 0.909091 | 0.833333 | 1 |
| NRCAM AND CD99 | Glioblastoma | 0.827586 | 1 | 0.705882 | DPEP1 AND TMEM123 | Colon | 1 | 1 | 1 |
| NRCAM AND PSENEN | Glioblastoma | 0.827586 | 1 | 0.705882 | CEACAM5 AND SLC39A10 | Colon | 1 | 1 | 1 |
| PTPRZ1 AND ITGB8 | Glioblastoma | 0.827586 | 1 | 0.705882 | CLDN2 AND AMIGO2 | Colon | 0.888889 | 1 | 0.8 |
| NRCAM AND AGTRAP | Glioblastoma | 0.827586 | 1 | 0.705882 | CLDN2 AND ARL6IP5 | Colon | 0.888889 | 1 | 0.8 |
| NRCAM AND EMP1 | Glioblastoma | 0.827586 | 1 | 0.705882 | GPR160 AND FAP | Colon | 0.888889 | 1 | 0.8 |
| PTPRZ1 AND CD163L1 | Glioblastoma | 0.827586 | 1 | 0.705882 | PMEPA1 AND CEACAM6 | Colon | 0.888889 | 1 | 0.8 |
| PTPRZ1 AND TMPRSS5 | Glioblastoma | 0.827586 | 1 | 0.705882 | DPEP1 AND SMAGP | Colon | 0.888889 | 1 | 0.8 |
| PTPRZ1 AND TLR7 | Glioblastoma | 0.827586 | 1 | 0.705882 | HEPH AND SLC7A5 | Colon | 0.888889 | 1 | 0.8 |
| PTPRZ1 AND F2RL2 | Glioblastoma | 0.827586 | 1 | 0.705882 | GPR160 AND THY1 | Colon | 0.888889 | 1 | 0.8 |
| PTPRZ1 AND CXCR4 | Glioblastoma | 0.827586 | 1 | 0.705882 | GPR160 AND SLC7A5 | Colon | 0.888889 | 1 | 0.8 |
| NRCAM AND ADAM12 | Glioblastoma | 0.827586 | 1 | 0.705882 | GPR160 AND CLDN1 | Colon | 0.888889 | 1 | 0.8 |
| NRCAM AND CTNS | Glioblastoma | 0.9375 | 1 | 0.882353 | DPEP1 AND SERINC5 | Colon | 0.888889 | 1 | 0.8 |
| NRCAM AND SLC11A1 | Glioblastoma | 0.827586 | 1 | 0.705882 | GUCY2C AND SLC39A10 | Colon | 1 | 1 | 1 |
| NRCAM AND BTN3A2 | Glioblastoma | 0.866667 | 1 | 0.764706 | GPA33 AND AMIGO2 | Colon | 0.909091 | 0.833333 | 1 |
| NRCAM AND BMPR1A | Glioblastoma | 0.827586 | 1 | 0.705882 | MUC13 AND SLC39A10 | Colon | 1 | 1 | 1 |
| PTPRZ1 AND OR51B6 | Glioblastoma | 0.903226 | 1 | 0.823529 | HEPH AND THY1 | Colon | 1 | 1 | 1 |
| NLGN4X AND BRCA1 | Glioblastoma | 0.83871 | 0.928571 | 0.764706 | PRNP AND ABCB5 | Ependymoma | 1 | 1 | 1 |
| PTPRZ1 AND F2RL1 | Glioblastoma | 0.866667 | 1 | 0.764706 | SSTR1 AND CD81 | Ependymoma | 1 | 1 | 1 |
| PTPRZ1 AND SORT1 | Glioblastoma | 0.903226 | 1 | 0.823529 | GPM6B AND CD38 | Ependymoma | 1 | 1 | 1 |
| NRCAM AND LMAN2 | Glioblastoma | 0.83871 | 0.928571 | 0.764706 | PRNP AND ERBB2 | Ependymoma | 1 | 1 | 1 |
| PTPRZ1 AND TLR3 | Glioblastoma | 0.827586 | 1 | 0.705882 | PRNP AND CLDN2 | Ependymoma | 1 | 1 | 1 |
| PTPRZ1 AND SLC6A8 | Glioblastoma | 0.827586 | 1 | 0.705882 | PRNP AND VTCN1 | Ependymoma | 1 | 1 | 1 |
| PTPRZ1 AND ITGB2 | Glioblastoma | 0.866667 | 1 | 0.764706 | PRNP AND RNF43 | Ependymoma | 1 | 1 | 1 |
| PTPRZ1 AND ENTPD1 | Glioblastoma | 0.903226 | 1 | 0.823529 | BCAP31 AND EPCAM | Esophagus | 0.692308 | 0.75 | 0.642857 |
| PTPRZ1 AND EDNRA | Glioblastoma | 0.827586 | 1 | 0.705882 | TM4SF5 AND MOK | Esophagus | 0.727273 | 1 | 0.571429 |
| PTPRZ1 AND SLC16A4 | Glioblastoma | 0.866667 | 1 | 0.764706 | GPRC5A AND MOK | Esophagus | 0.666667 | 1 | 0.5 |
| NRCAM AND OR51B6 | Glioblastoma | 0.903226 | 1 | 0.823529 | SLC52A2 AND ITGAV | Esophagus | 0.782609 | 1 | 0.642857 |
| PTPRZ1 AND TNFRSF19 | Glioblastoma | 0.866667 | 1 | 0.764706 | CBX3 AND CDCP1 | Esophagus | 0.64 | 0.727273 | 0.571429 |
| NRCAM AND ANO6 | Glioblastoma | 0.827586 | 1 | 0.705882 | CBX3 AND TACSTD2 | Esophagus | 0.727273 | 1 | 0.571429 |
| NRCAM AND FAM57A | Glioblastoma | 0.827586 | 1 | 0.705882 | CBX3 AND PPAP2C | Esophagus | 0.666667 | 0.8 | 0.571429 |
| PTPRZ1 AND HRH1 | Glioblastoma | 0.827586 | 1 | 0.705882 | CBX3 AND CXADR | Esophagus | 0.64 | 0.727273 | 0.571429 |
| GPM6A AND SLC7A7 | Glioblastoma | 0.882353 | 0.882353 | 0.882353 | CBX3 AND SLC39A4 | Esophagus | 0.666667 | 0.8 | 0.571429 |
| NRCAM AND SIGLEC10 | Glioblastoma | 0.83871 | 0.928571 | 0.764706 | CBX3 AND IL22RA1 | Esophagus | 0.666667 | 0.8 | 0.571429 |
| NRCAM AND SLC16A4 | Glioblastoma | 0.827586 | 1 | 0.705882 | BCAP31 AND MUC13 | Esophagus | 0.64 | 0.727273 | 0.571429 |
| NRCAM AND CXCR4 | Glioblastoma | 0.827586 | 1 | 0.705882 | EPCAM AND RHBDF2 | Esophagus | 0.666667 | 1 | 0.5 |
| GPM6B AND TSPAN6 | Glioma | 0.962406 | 1 | 0.927536 | CBX3 AND EDNRA | Esophagus | 0.666667 | 0.8 | 0.571429 |
| GPM6A AND TSPAN6 | Glioma | 0.970588 | 0.985075 | 0.956522 | CBX3 AND GPRC5A | Esophagus | 0.64 | 0.727273 | 0.571429 |
| GPM6B AND PLGRKT | Glioma | 0.970149 | 1 | 0.942029 | SLC52A2 AND CLDN1 | Esophagus | 0.782609 | 1 | 0.642857 |
| GPM6B AND ABCA1 | Glioma | 0.94964 | 0.942857 | 0.956522 | PTPRH AND MOK | Esophagus | 0.636364 | 0.875 | 0.5 |
| PTPRZ1 AND JAM2 | Glioma | 0.985294 | 1 | 0.971014 | SLC52A2 AND ULBP2 | Esophagus | 0.6 | 1 | 0.428571 |
| GPM6A AND SLC40A1 | Glioma | 0.970588 | 0.985075 | 0.956522 | PTPRZ1 AND CD33 | Glioblastoma | 0.866667 | 1 | 0.764706 |
| PTPRZ1 AND NRCAM | Glioma | 0.946565 | 1 | 0.898551 | PTPRZ1 AND CD180 | Glioblastoma | 0.866667 | 1 | 0.764706 |
| GPM6A AND HLA-B | Glioma | 0.94964 | 0.942857 | 0.956522 | PTPRZ1 AND VCAM1 | Glioblastoma | 0.9375 | 1 | 0.882353 |
| GPM6B AND ATP13A1 | Glioma | 0.954545 | 1 | 0.913043 | PTPRZ1 AND CD70 | Glioblastoma | 0.909091 | 0.9375 | 0.882353 |
| GPM6A AND ABCA1 | Glioma | 0.963504 | 0.970588 | 0.956522 | PTPRZ1 AND SDC1 | Glioblastoma | 0.827586 | 1 | 0.705882 |
| GPM6B AND ATRAID | Glioma | 0.978102 | 0.985294 | 0.971014 | PTPRZ1 AND IL13RA1 | Glioblastoma | 0.903226 | 1 | 0.823529 |
| GPM6A AND PLGRKT | Glioma | 0.970149 | 1 | 0.942029 | PTPRZ1 AND ENG | Glioblastoma | 0.785714 | 1 | 0.647059 |
| GPM6B AND JTB | Glioma | 0.962406 | 1 | 0.927536 | PTPRZ1 AND NCAM1 | Glioblastoma | 0.909091 | 0.9375 | 0.882353 |
| GPM6A AND JTB | Glioma | 0.962406 | 1 | 0.927536 | NRCAM AND VCAM1 | Glioblastoma | 0.909091 | 0.9375 | 0.882353 |
| PTPRZ1 AND HLA-B | Glioma | 0.992701 | 1 | 0.985507 | BMPR1B AND SIGLEC10 | Glioblastoma | 0.777778 | 0.736842 | 0.823529 |
| PTPRZ1 AND BFAR | Glioma | 0.992701 | 1 | 0.985507 | PTPRZ1 AND SLC39A6 | Glioblastoma | 0.9375 | 1 | 0.882353 |
| PTPRZ1 AND XPR1 | Glioma | 0.970149 | 1 | 0.942029 | PTPRZ1 AND BMPR1B | Glioblastoma | 0.909091 | 0.9375 | 0.882353 |
| GPM6A AND ATRAID | Glioma | 0.985294 | 1 | 0.971014 | AQP4 AND EGFR | Glioblastoma | 0.758621 | 0.916667 | 0.647059 |
| PTPRZ1 AND ABCA1 | Glioma | 0.985294 | 1 | 0.971014 | NRCAM AND AXL | Glioblastoma | 0.882353 | 0.882353 | 0.882353 |
| PTPRZ1 AND SLC40A1 | Glioma | 0.977778 | 1 | 0.956522 | PTPRZ1 AND KDR | Glioblastoma | 0.866667 | 1 | 0.764706 |
| PTPRZ1 AND TSPAN6 | Glioma | 0.962406 | 1 | 0.927536 | NRCAM AND IL13RA1 | Glioblastoma | 0.789474 | 0.714286 | 0.882353 |
| GPM6B AND XPR1 | Glioma | 0.970149 | 1 | 0.942029 | NRCAM AND CD180 | Glioblastoma | 0.756757 | 0.7 | 0.823529 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| PTPRZ1 AND CD46 | Glioma | 0.962406 | 1 | 0.927536 | PTPRZ1 AND AXL | Glioblastoma | 0.875 | 0.933333 | 0.823529 |
| PTPRZ1 AND PRCP | Glioma | 0.977778 | 1 | 0.956522 | NCAM1 AND SLC3A2 | Glioblastoma | 0.83871 | 0.928571 | 0.764706 |
| PTPRZ1 AND SGCB | Glioma | 0.985294 | 1 | 0.971014 | PTPRZ1 AND SLC7A5 | Glioblastoma | 0.758621 | 0.916667 | 0.647059 |
| NRCAM AND SLC3A2 | Glioma | 0.938462 | 1 | 0.884058 | NCAM1 AND TSPAN6 | Glioblastoma | 0.758621 | 0.916667 | 0.647059 |
| GPM6B AND JAM2 | Glioma | 0.964029 | 0.957143 | 0.971014 | NRCAM AND MUC1 | Glioblastoma | 0.740741 | 1 | 0.588235 |
| PTPRZ1 AND HLA-G | Glioma | 0.992701 | 1 | 0.985507 | NRCAM AND KDR | Glioblastoma | 0.736842 | 0.666667 | 0.823529 |
| PTPRZ1 AND ADAM9 | Glioma | 0.962406 | 1 | 0.927536 | NRCAM AND ENG | Glioblastoma | 0.714286 | 0.909091 | 0.588235 |
| GPM6B AND DIABLO | Glioma | 0.992701 | 1 | 0.985507 | PTPRZ1 AND P2RX5 | Glioblastoma | 0.714286 | 0.909091 | 0.588235 |
| PTPRZ1 AND PLGRKT | Glioma | 0.970149 | 1 | 0.942029 | NCAM1 AND WNT5A | Glioblastoma | 0.714286 | 0.909091 | 0.588235 |
| NRCAM AND HLA-G | Glioma | 0.938462 | 1 | 0.884058 | NRCAM AND EDNRB | Glioblastoma | 0.714286 | 0.6 | 0.882353 |
| PTPRZ1 AND TNFRSF21 | Glioma | 0.977778 | 1 | 0.956522 | AQP4 AND CD33 | Glioblastoma | 0.733333 | 0.846154 | 0.647059 |
| GPM6B AND BFAR | Glioma | 0.951049 | 0.918919 | 0.985507 | BMPR1B AND ADAM12 | Glioblastoma | 0.742857 | 0.722222 | 0.764706 |
| PTPRZ1 AND CALCRL | Glioma | 0.962406 | 1 | 0.927536 | FZD3 AND VCAM1 | Glioblastoma | 0.727273 | 0.75 | 0.705882 |
| NRCAM AND IL10RB | Glioma | 0.938462 | 1 | 0.884058 | AQP4 AND CD180 | Glioblastoma | 0.709677 | 0.785714 | 0.647059 |
| NRCAM AND HLA-C | Glioma | 0.930233 | 1 | 0.869565 | BMPR1B AND SLC3A2 | Glioblastoma | 0.777778 | 0.736842 | 0.823529 |
| NRCAM AND CD81 | Glioma | 0.930233 | 1 | 0.869565 | NRCAM AND ITGAV | Glioblastoma | 0.866667 | 1 | 0.764706 |
| VMP1 AND SGCD | Leiomyosarcoma | 0.727273 | 0.888889 | 0.615385 | PTPRZ1 AND CSPG4 | Glioblastoma | 0.692308 | 1 | 0.529412 |
| DDR2 AND BRCA1 | Leiomyosarcoma | 0.666667 | 0.875 | 0.538462 | PTPRZ1 AND MUC1 | Glioblastoma | 0.692308 | 1 | 0.529412 |
| ADAM12 AND HTR2A | Liposarcoma | 0.765432 | 0.688889 | 0.861111 | PTPRZ1 AND CA9 | Glioblastoma | 0.692308 | 1 | 0.529412 |
| ADAM12 AND CACNA1C | Liposarcoma | 0.738095 | 0.645833 | 0.861111 | NCAM1 AND SRR | Glioblastoma | 0.6875 | 0.733333 | 0.647059 |
| ADAM12 AND STOML3 | Liposarcoma | 0.729412 | 0.632653 | 0.861111 | BMPR1B AND ABCA1 | Glioblastoma | 0.684211 | 0.619048 | 0.764706 |
| ADAM12 AND SLC38A5 | Liposarcoma | 0.729412 | 0.632653 | 0.861111 | BMPR1B AND SLC11A1 | Glioblastoma | 0.785714 | 1 | 0.647059 |
| ADAM12 AND EMP1 | Liposarcoma | 0.765432 | 0.688889 | 0.861111 | NRCAM AND GPNMB | Glioblastoma | 0.866667 | 1 | 0.764706 |
| ADAM12 AND GABRR1 | Liposarcoma | 0.731707 | 0.652174 | 0.833333 | NCAM1 AND VANGL2 | Glioblastoma | 0.666667 | 0.9 | 0.529412 |
| ADAM12 AND TNFRSF9 | Liposarcoma | 0.738095 | 0.645833 | 0.861111 | NLGN4X AND MUC1 | Glioblastoma | 0.666667 | 0.9 | 0.529412 |
| CNTNAP1 AND SLC2A10 | Liposarcoma | 0.779221 | 0.731707 | 0.833333 | NRCAM AND CSPG4 | Glioblastoma | 0.666667 | 0.769231 | 0.588235 |
| ADAM12 AND OR2B2 | Liposarcoma | 0.72093 | 0.62 | 0.861111 | GPM6B AND GPNMB | Glioblastoma | 0.666667 | 0.631579 | 0.705882 |
| ADAM12 AND GP5 | Liposarcoma | 0.740741 | 0.666667 | 0.833333 | NCAM1 AND FAM57A | Glioblastoma | 0.666667 | 0.9 | 0.529412 |
| ADAM12 AND CORIN | Liposarcoma | 0.72093 | 0.62 | 0.861111 | SLC7A5 AND SLC11A1 | Glioblastoma | 0.666667 | 0.9 | 0.529412 |
| ADAM12 AND SGCD | Liposarcoma | 0.729412 | 0.632653 | 0.861111 | CSPG4 AND PON2 | Glioblastoma | 0.692308 | 1 | 0.529412 |
| ADAM12 AND GJB6 | Liposarcoma | 0.716049 | 0.644444 | 0.805556 | NLGN4X AND ITGAV | Glioblastoma | 0.666667 | 0.769231 | 0.588235 |
| ADAM12 AND MC3R | Liposarcoma | 0.731707 | 0.652174 | 0.833333 | NCAM1 AND IGDCC4 | Glioblastoma | 0.733333 | 0.846154 | 0.647059 |
| ADAM12 AND PCDHB4 | Liposarcoma | 0.712644 | 0.607843 | 0.861111 | PTPRZ1 AND ITGAV | Glioblastoma | 0.866667 | 1 | 0.764706 |
| ADAM12 AND S100A10 | Liposarcoma | 0.712644 | 0.607843 | 0.861111 | BMPR1B AND HAVCR2 | Glioblastoma | 0.764706 | 0.764706 | 0.764706 |
| ADAM12 AND PCDHGC3 | Liposarcoma | 0.712644 | 0.607843 | 0.861111 | FZD3 AND AXL | Glioblastoma | 0.666667 | 0.6875 | 0.647059 |
| ADAM12 AND LAX1 | Liposarcoma | 0.712644 | 0.607843 | 0.861111 | NRCAM AND CD33 | Glioblastoma | 0.651163 | 0.538462 | 0.823529 |
| ADAM12 AND CLEC5A | Liposarcoma | 0.712644 | 0.607843 | 0.861111 | BMPR1B AND IGDCC4 | Glioblastoma | 0.651163 | 0.538462 | 0.823529 |
| ADAM12 AND TRPA1 | Liposarcoma | 0.712644 | 0.607843 | 0.861111 | NRCAM AND SLC39A6 | Glioblastoma | 0.651163 | 0.538462 | 0.823529 |
| ADAM12 AND MSR1 | Liposarcoma | 0.775 | 0.704545 | 0.861111 | BMPR1B AND CD86 | Glioblastoma | 0.709677 | 0.785714 | 0.647059 |
| ADAM12 AND OR10A3 | Liposarcoma | 0.731707 | 0.652174 | 0.833333 | GPM6B AND VCAM1 | Glioblastoma | 0.65 | 0.565217 | 0.764706 |
| ADAM12 AND UGT8 | Liposarcoma | 0.714286 | 0.625 | 0.833333 | AQP4 AND PROM1 | Glioblastoma | 0.648649 | 0.6 | 0.705882 |
| ADAM12 AND CHRM1 | Liposarcoma | 0.746988 | 0.659574 | 0.861111 | AQP4 AND SLC7A5 | Glioblastoma | 0.648649 | 0.6 | 0.705882 |
| ADAM12 AND PCDHGC5 | Liposarcoma | 0.746988 | 0.659574 | 0.861111 | NCAM1 AND JAM2 | Glioblastoma | 0.758621 | 0.916667 | 0.647059 |
| ADAM12 AND CRTAM | Liposarcoma | 0.705882 | 0.612245 | 0.833333 | BMPR1B AND MERTK | Glioblastoma | 0.65 | 0.565217 | 0.764706 |
| ADAM12 AND SLC5A12 | Liposarcoma | 0.746988 | 0.659574 | 0.861111 | FZD3 AND CD33 | Glioblastoma | 0.645161 | 0.714286 | 0.588235 |
| ADAM12 AND PDCD1LG2 | Liposarcoma | 0.729412 | 0.632653 | 0.861111 | GRIA3 AND MUC1 | Glioblastoma | 0.642857 | 0.818182 | 0.529412 |
| ADAM12 AND TAS1R2 | Liposarcoma | 0.729412 | 0.632653 | 0.861111 | BMPR1B AND CD300A | Glioblastoma | 0.666667 | 0.631579 | 0.705882 |
| ADAM12 AND FRRS1L | Liposarcoma | 0.729412 | 0.632653 | 0.861111 | PTPRZ1 AND EPHA3 | Glioblastoma | 0.64 | 1 | 0.470588 |
| ADAM12 AND SLC4A9 | Liposarcoma | 0.705882 | 0.612245 | 0.833333 | PTPRZ1 AND EGFR | Glioblastoma | 0.64 | 1 | 0.470588 |
| ADAM12 AND EMCN | Liposarcoma | 0.738095 | 0.645833 | 0.861111 | PTPRZ1 AND STEAP1 | Glioblastoma | 0.64 | 1 | 0.470588 |
| ADAM12 AND HRH4 | Liposarcoma | 0.707317 | 0.630435 | 0.805556 | GPM6A AND ITGAV | Glioma | 0.94964 | 0.942857 | 0.956522 |
| ADAM12 AND TAAR1 | Liposarcoma | 0.729412 | 0.632653 | 0.861111 | GPM6B AND ITGAV | Glioma | 0.93617 | 0.916667 | 0.956522 |
| ADAM12 AND KCNG3 | Liposarcoma | 0.731707 | 0.652174 | 0.833333 | PTPRZ1 AND ITGAV | Glioma | 0.985294 | 1 | 0.971014 |
| ADAM12 AND TAS2R14 | Liposarcoma | 0.704545 | 0.596154 | 0.861111 | NRCAM AND CD276 | Glioma | 0.931298 | 0.983871 | 0.884058 |
| ADAM12 AND KISS1R | Liposarcoma | 0.704545 | 0.596154 | 0.861111 | NLGN1 AND ITGAV | Glioma | 0.930233 | 1 | 0.869565 |
| ADAM12 AND MTDH | Liposarcoma | 0.704545 | 0.596154 | 0.861111 | NRCAM AND ITGAV | Glioma | 0.921875 | 1 | 0.855072 |
| ADAM12 AND GPR84 | Liposarcoma | 0.705882 | 0.612245 | 0.833333 | PTPRZ1 AND SLC39A6 | Glioma | 0.970149 | 1 | 0.942029 |
| ADAM12 AND PILRA | Liposarcoma | 0.712644 | 0.607843 | 0.861111 | NRCAM AND ABCB5 | Glioma | 0.917293 | 0.953125 | 0.884058 |
| CNTNAP1 AND TYROBP | Liposarcoma | 0.732394 | 0.742857 | 0.722222 | NRCAM AND SLC34A2 | Glioma | 0.917293 | 0.953125 | 0.884058 |
| ADAM12 AND VSIG1 | Liposarcoma | 0.704545 | 0.596154 | 0.861111 | NRCAM AND VTCN1 | Glioma | 0.917293 | 0.953125 | 0.884058 |
| ADAM12 AND FPR3 | Liposarcoma | 0.75 | 0.681818 | 0.833333 | NRCAM AND GUCY2C | Glioma | 0.917293 | 0.953125 | 0.884058 |
| ADAM12 AND CATSPER1 | Liposarcoma | 0.729412 | 0.632653 | 0.861111 | NRCAM AND FCRL5 | Glioma | 0.917293 | 0.953125 | 0.884058 |
| ADAM12 AND PCDH7 | Liposarcoma | 0.739726 | 0.72973 | 0.75 | PTPRZ1 AND NCAM1 | Glioma | 0.985507 | 0.985507 | 0.985507 |
| ADAM12 AND PCDHB10 | Liposarcoma | 0.696629 | 0.584906 | 0.861111 | NRCAM AND SLAMF7 | Glioma | 0.917293 | 0.953125 | 0.884058 |
| ADAM12 AND C5AR1 | Liposarcoma | 0.696629 | 0.584906 | 0.861111 | NRCAM AND SSTR4 | Glioma | 0.917293 | 0.953125 | 0.884058 |
| ADAM12 AND KCNH8 | Liposarcoma | 0.698795 | 0.617021 | 0.805556 | NRCAM AND CLDN7 | Glioma | 0.917293 | 0.953125 | 0.884058 |
| ADAM12 AND TAS2R8 | Liposarcoma | 0.75 | 0.681818 | 0.833333 | NRCAM AND CD180 | Glioma | 0.917293 | 0.953125 | 0.884058 |
| ADAM12 AND VMP1 | Liposarcoma | 0.692308 | 0.642857 | 0.75 | NRCAM AND SSTR3 | Glioma | 0.917293 | 0.953125 | 0.884058 |
| ADAM12 AND OR5P2 | Liposarcoma | 0.691358 | 0.622222 | 0.777778 | NRCAM AND ENG | Glioma | 0.917293 | 0.953125 | 0.884058 |
| ADAM12 AND CHIC2 | Liposarcoma | 0.688889 | 0.574074 | 0.861111 | NRCAM AND MUC4 | Glioma | 0.917293 | 0.953125 | 0.884058 |
| ADAM12 AND GRIA2 | Liposarcoma | 0.75 | 0.681818 | 0.833333 | NRCAM AND MUC13 | Glioma | 0.917293 | 0.953125 | 0.884058 |
| ADAM12 AND IFITM2 | Liposarcoma | 0.704545 | 0.596154 | 0.861111 | PTPRZ1 AND CD276 | Glioma | 0.985294 | 1 | 0.971014 |
| ADAM12 AND SLC23A1 | Liposarcoma | 0.729412 | 0.632653 | 0.861111 | NRCAM AND GPA33 | Glioma | 0.917293 | 0.953125 | 0.884058 |
| ADAM12 AND CNTNAP1 | Liposarcoma | 0.732394 | 0.742857 | 0.722222 | NRCAM AND CLDN23 | Glioma | 0.917293 | 0.953125 | 0.884058 |
| CNTNAP1 AND IFNGR2 | Liposarcoma | 0.698413 | 0.814815 | 0.611111 | APLP1 AND ITGAV | Glioma | 0.920863 | 0.914286 | 0.927536 |
| ADAM12 AND GYPE | Liposarcoma | 0.682353 | 0.591837 | 0.805556 | NLGN4X AND ITGAV | Glioma | 0.923077 | 0.983607 | 0.869565 |
| ADAM12 AND SLC6A14 | Liposarcoma | 0.682353 | 0.591837 | 0.805556 | NRCAM AND RAET1E | Glioma | 0.917293 | 0.953125 | 0.884058 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ADAM12 AND BTN3A2 | Liposarcoma | 0.681818 | 0.576923 | 0.833333 | NRCAM AND CD52 | Glioma | 0.917293 | 0.953125 | 0.884058 |
| PON2 AND TACSTD2 | Lung Adenocarcinoma | 0.637168 | 0.837209 | 0.514286 | NRCAM AND TNFRSF17 | Glioma | 0.917293 | 0.953125 | 0.884058 |
| OSMR AND TLCD1 | Lung Adenocarcinoma | 0.618182 | 0.85 | 0.485714 | NRCAM AND ULBP2 | Glioma | 0.917293 | 0.953125 | 0.884058 |
| PON2 AND CDH3 | Lung Adenocarcinoma | 0.654545 | 0.9 | 0.514286 | NRCAM AND TNFRSF13C | Glioma | 0.917293 | 0.953125 | 0.884058 |
| VMP1 AND NTM | Lung Adenocarcinoma | 0.616667 | 0.74 | 0.528571 | NRCAM AND CD34 | Glioma | 0.917293 | 0.953125 | 0.884058 |
| OSMR AND GOLM1 | Lung Adenocarcinoma | 0.615385 | 0.765957 | 0.514286 | NRCAM AND MS4A1 | Glioma | 0.917293 | 0.953125 | 0.884058 |
| OSMR AND XPR1 | Lung Adenocarcinoma | 0.612613 | 0.829268 | 0.485714 | NRCAM AND ROR1 | Glioma | 0.917293 | 0.953125 | 0.884058 |
| VMP1 AND WNT3 | Lung Adenocarcinoma | 0.633333 | 0.76 | 0.542857 | NRCAM AND PTK7 | Glioma | 0.909091 | 0.952381 | 0.869565 |
| PSENEN AND GJA1 | Lung Adenocarcinoma | 0.608696 | 0.777778 | 0.5 | NRCAM AND CA9 | Glioma | 0.909091 | 0.952381 | 0.869565 |
| VMP1 AND FGG | Lung Adenocarcinoma | 0.607143 | 0.809524 | 0.485714 | NRCAM AND TNFSF11 | Glioma | 0.909091 | 0.952381 | 0.869565 |
| OSMR AND ATP1B1 | Lung Adenocarcinoma | 0.626087 | 0.8 | 0.514286 | NRCAM AND FCRL1 | Glioma | 0.909091 | 0.952381 | 0.869565 |
| TREM1 AND PON2 | Lung Adenocarcinoma | 0.62963 | 0.894737 | 0.485714 | NRCAM AND IL2RA | Glioma | 0.909091 | 0.952381 | 0.869565 |
| OSMR AND C1orf210 | Lung Adenocarcinoma | 0.6 | 0.72 | 0.514286 | NRCAM AND CD19 | Glioma | 0.909091 | 0.952381 | 0.869565 |
| OSMR AND BCAP31 | Lung Adenocarcinoma | 0.6 | 0.72 | 0.514286 | TNFSF4 AND GPNMB | Leiomyosarcoma | 0.631579 | 1 | 0.461538 |
| OSMR AND SLC39A11 | Lung Adenocarcinoma | 0.610169 | 0.75 | 0.514286 | FGFR1 AND ULBP2 | Leiomyosarcoma | 0.727273 | 0.888889 | 0.615385 |
| PON2 AND AGTRAP | Lung Adenocarcinoma | 0.612613 | 0.829268 | 0.485714 | FLT3 AND CD37 | AML | 0.935818 | 0.974138 | 0.900398 |
| OLR1 AND PON2 | Lung Adenocarcinoma | 0.608696 | 0.777778 | 0.5 | ATP8B4 AND CD70 | AML | 0.884532 | 0.975962 | 0.808765 |
| PON2 AND LAMP3 | Lung Adenocarcinoma | 0.630631 | 0.853659 | 0.5 | ADAM12 AND FOLH1 | Liposarcoma | 0.765432 | 0.688889 | 0.861111 |
| TREM1 AND KCNK5 | Lung Adenocarcinoma | 0.6 | 0.825 | 0.471429 | ADAM12 AND IL2RA | Liposarcoma | 0.756098 | 0.673913 | 0.861111 |
| PON2 AND KCNJ15 | Lung Adenocarcinoma | 0.605505 | 0.846154 | 0.471429 | ADAM12 AND ULBP2 | Liposarcoma | 0.681319 | 0.563636 | 0.861111 |
| PTPRCAP AND SLC2A5 | B-Cell Diffuse | 0.782609 | 0.84375 | 0.72973 | OSMR AND EPCAM | Lung Adenocarcinoma | 0.666667 | 0.947368 | 0.514286 |
| CD48 AND SLC2A5 | B-Cell Diffuse | 0.757576 | 0.862069 | 0.675676 | EPCAM AND SLC39A10 | Lung Adenocarcinoma | 0.629921 | 0.701754 | 0.571429 |
| CXCL9 AND GPR18 | B-Cell Diffuse | 0.732394 | 0.764706 | 0.702703 | VMP1 AND FAP | Lung Adenocarcinoma | 0.628099 | 0.745098 | 0.542857 |
| PTPRCAP AND KCNMA1 | B-Cell Diffuse | 0.732394 | 0.764706 | 0.702703 | CXCR4 AND SDC1 | Lung Adenocarcinoma | 0.615385 | 0.765957 | 0.514286 |
| CXCL9 AND ITGAE | B-Cell Diffuse | 0.732394 | 0.764706 | 0.702703 | VMP1 AND SLC34A2 | Lung Adenocarcinoma | 0.661017 | 0.8125 | 0.557143 |
| IL2RB AND CDH5 | Anaplastic Lymphoma | 0.740741 | 0.833333 | 0.666667 | SLC34A2 AND NTM | Lung Adenocarcinoma | 0.611111 | 0.594595 | 0.628571 |
| IL2RB AND GJA1 | Anaplastic Lymphoma | 0.692308 | 0.818182 | 0.6 | OLR1 AND SDC1 | Lung Adenocarcinoma | 0.610169 | 0.75 | 0.514286 |
| IL2RB AND OSMR | Anaplastic Lymphoma | 0.692308 | 0.818182 | 0.6 | CLEC7A AND EPCAM | Lung Adenocarcinoma | 0.608696 | 0.777778 | 0.5 |
| IL2RB AND RAMP3 | Anaplastic Lymphoma | 0.64 | 0.8 | 0.533333 | TSPAN4 AND CLDN7 | Lung Adenocarcinoma | 0.645161 | 0.740741 | 0.571429 |
| IL2RB AND ECSCR | Anaplastic Lymphoma | 0.615385 | 0.727273 | 0.533333 | PON2 AND FOLR1 | Lung Adenocarcinoma | 0.614035 | 0.795455 | 0.5 |
| CXCL9 AND IL2RB | Anaplastic Lymphoma | 0.615385 | 0.727273 | 0.533333 | SLC34A2 AND SLC2A5 | Lung Adenocarcinoma | 0.608 | 0.690909 | 0.542857 |
| IL2RB AND GJA4 | Anaplastic Lymphoma | 0.740741 | 0.833333 | 0.666667 | CLEC5A AND EPCAM | Lung Adenocarcinoma | 0.605505 | 0.846154 | 0.471429 |
| CD2 AND CDH5 | Anaplastic Lymphoma | 0.615385 | 0.727273 | 0.533333 | VMP1 AND SDC1 | Lung Adenocarcinoma | 0.654545 | 0.9 | 0.514286 |
| CXCL9 AND IL2RB | T-Cell, Peripheral | 0.8 | 0.814815 | 0.785714 | SLC34A2 AND PON2 | Lung Adenocarcinoma | 0.603774 | 0.888889 | 0.457143 |
| CXCL9 AND SIRPG | T-Cell, Peripheral | 0.816327 | 0.952381 | 0.714286 | TREM1 AND SDC1 | Lung Adenocarcinoma | 0.603448 | 0.76087 | 0.5 |
| CXCL9 AND CD3G | T-Cell, Peripheral | 0.763636 | 0.777778 | 0.75 | SLC34A2 AND SLC41A2 | Lung Adenocarcinoma | 0.603175 | 0.678571 | 0.542857 |
| CXCL9 AND TRPV5 | T-Cell, Peripheral | 0.75 | 0.9 | 0.642857 | EPCAM AND VAMP5 | Lung Adenocarcinoma | 0.603175 | 0.678571 | 0.542857 |
| CXCL9 AND KIAA0754 | T-Cell, Peripheral | 0.769231 | 0.833333 | 0.714286 | FAP AND GPRC5A | Lung Adenocarcinoma | 0.6 | 0.825 | 0.471429 |
| CXCL9 AND PTPRC | T-Cell, Peripheral | 0.75 | 0.75 | 0.75 | PON2 AND PTK7 | Lung Adenocarcinoma | 0.62069 | 0.782609 | 0.514286 |
| PTPRM AND C11orf24 | Melanoma | 0.9 | 1 | 0.818182 | SLC34A2 AND WNT3 | Lung Adenocarcinoma | 0.650794 | 0.732143 | 0.585714 |
| C11orf24 AND BCAP31 | Melanoma | 0.9 | 1 | 0.818182 | EPCAM AND PLXND1 | Lung Adenocarcinoma | 0.606061 | 0.645161 | 0.571429 |
| C11orf24 AND PRCP | Melanoma | 0.9 | 1 | 0.818182 | SLC34A2 AND CDH5 | Lung Adenocarcinoma | 0.606061 | 0.526316 | 0.714286 |
| C11orf24 AND NPC1 | Melanoma | 0.9 | 1 | 0.818182 | FAP AND PON2 | Lung Adenocarcinoma | 0.616822 | 0.891892 | 0.471429 |
| TNFSF9 AND VMP1 | Melanoma | 0.952381 | 1 | 0.909091 | MAGEA11 AND SLC7A13 | Lung Carcinoma | 0.606061 | 0.857143 | 0.46875 |
| MC1R AND VMP1 | Melanoma | 0.9 | 1 | 0.818182 | CXCL9 AND CD79B | B-Cell Diffuse | 0.793651 | 0.961538 | 0.675676 |
| MC1R AND STOM | Melanoma | 0.9 | 1 | 0.818182 | CXCL9 AND FCRL5 | B-Cell Diffuse | 0.761905 | 0.923077 | 0.648649 |
| TNFSF9 AND STOM | Melanoma | 0.952381 | 1 | 0.909091 | CXCL9 AND CXCR5 | B-Cell Diffuse | 0.754098 | 0.958333 | 0.621622 |
| PTPRZ1 AND GPR52 | Oligodendroglioma | 0.888889 | 1 | 0.8 | CXCL9 AND P2RX5 | B-Cell Diffuse | 0.753623 | 0.8125 | 0.702703 |
| GRIA2 AND CALCRL | Oligodendroglioma | 0.888889 | 1 | 0.8 | MCOLN2 AND CD180 | B-Cell Diffuse | 0.764706 | 0.83871 | 0.702703 |
| PCDHGC3 AND GPM6B | Oligodendroglioma | 0.888889 | 1 | 0.8 | FCRL3 AND GPNMB | B-Cell Diffuse | 0.736842 | 0.717949 | 0.756757 |
| GPM6A AND CALCRL | Oligodendroglioma | 0.888889 | 1 | 0.8 | CXCL9 AND CR2 | B-Cell Diffuse | 0.754098 | 0.958333 | 0.621622 |
| GRIA2 AND VANGL2 | Oligodendroglioma | 0.888889 | 1 | 0.8 | CD79B AND RAMP3 | B-Cell Diffuse | 0.746269 | 0.833333 | 0.675676 |
| PTPRZ1 AND ADAM22 | Oligodendroglioma | 0.888889 | 1 | 0.8 | PTPRCAP AND GPNMB | B-Cell Diffuse | 0.735294 | 0.806452 | 0.675676 |
| NRCAM AND TSPAN11 | Oligodendroglioma | 0.928571 | 1 | 0.866667 | CXCL9 AND CD72 | B-Cell Diffuse | 0.733333 | 0.956522 | 0.594595 |
| REEP2 AND CALCRL | Oligodendroglioma | 0.888889 | 1 | 0.8 | CD79B AND PPAP2B | B-Cell Diffuse | 0.727273 | 0.827586 | 0.648649 |
| GPM6B AND BMP2 | Oligodendroglioma | 0.857143 | 0.923077 | 0.8 | CD79B AND ENPP2 | B-Cell Diffuse | 0.727273 | 0.827586 | 0.648649 |
| PTPRZ1 AND CLEC1A | Oligodendroglioma | 0.888889 | 1 | 0.8 | CD79B AND TNFRSF9 | B-Cell Diffuse | 0.727273 | 0.827586 | 0.648649 |
| PTPRZ1 AND ANTXR1 | Oligodendroglioma | 0.888889 | 1 | 0.8 | CD79B AND SLCO2B1 | B-Cell Diffuse | 0.727273 | 0.827586 | 0.648649 |
| GPRC5B AND TSPAN11 | Oligodendroglioma | 0.848485 | 0.777778 | 0.933333 | MCOLN2 AND GPNMB | B-Cell Diffuse | 0.764706 | 0.83871 | 0.702703 |
| SCAMP5 AND VANGL2 | Oligodendroglioma | 0.888889 | 1 | 0.8 | CD79B AND CDH5 | B-Cell Diffuse | 0.727273 | 0.827586 | 0.648649 |
| PCDHGC3 AND PTPRZ1 | Oligodendroglioma | 0.846154 | 1 | 0.733333 | CD79A AND BRCA1 | B-Cell Diffuse | 0.727273 | 0.827586 | 0.648649 |
| PTPRZ1 AND TMPRSS5 | Oligodendroglioma | 0.846154 | 1 | 0.733333 | CD79B AND TMEM119 | B-Cell Diffuse | 0.727273 | 0.827586 | 0.648649 |
| PTPRZ1 AND OR51B2 | Oligodendroglioma | 0.846154 | 1 | 0.733333 | CD79B AND ECSCR | B-Cell Diffuse | 0.716418 | 0.8 | 0.648649 |
| PTPRZ1 AND TREM1 | Oligodendroglioma | 0.846154 | 1 | 0.733333 | CD40 AND GPNMB | B-Cell Diffuse | 0.716418 | 0.8 | 0.648649 |
| PTPRZ1 AND VIPR2 | Oligodendroglioma | 0.846154 | 1 | 0.733333 | TNFRSF9 AND GPNMB | B-Cell Diffuse | 0.714286 | 0.757576 | 0.675676 |
| NLGN1 AND VANGL2 | Oligodendroglioma | 0.846154 | 1 | 0.733333 | CD40 AND VCAM1 | B-Cell Diffuse | 0.712329 | 0.722222 | 0.702703 |
| PCDHGC3 AND PON2 | Oligodendroglioma | 0.846154 | 1 | 0.733333 | CLECL1 AND GPNMB | B-Cell Diffuse | 0.711864 | 0.954545 | 0.567568 |
| PTPRZ1 AND FCRL3 | Oligodendroglioma | 0.846154 | 1 | 0.733333 | CD79B AND MRGPRX4 | B-Cell Diffuse | 0.724638 | 0.78125 | 0.675676 |
| PTPRZ1 AND TNFSF18 | Oligodendroglioma | 0.846154 | 1 | 0.733333 | CD79A AND SLC2A5 | B-Cell Diffuse | 0.738462 | 0.857143 | 0.648649 |
| PTPRZ1 AND DLL1 | Oligodendroglioma | 0.846154 | 1 | 0.733333 | MCOLN2 AND P2RX5 | B-Cell Diffuse | 0.716418 | 0.8 | 0.648649 |
| PTPRZ1 AND CALCRL | Oligodendroglioma | 0.846154 | 1 | 0.733333 | CD79B AND OSMR | B-Cell Diffuse | 0.707692 | 0.821429 | 0.621622 |
| PTPRZ1 AND CHRNA5 | Oligodendroglioma | 0.846154 | 1 | 0.733333 | CD79B AND DDR2 | B-Cell Diffuse | 0.707692 | 0.821429 | 0.621622 |
| PTPRZ1 AND CD300LF | Oligodendroglioma | 0.846154 | 1 | 0.733333 | CD79B AND GJA1 | B-Cell Diffuse | 0.707692 | 0.821429 | 0.621622 |
| REEP2 AND VANGL2 | Oligodendroglioma | 0.846154 | 1 | 0.733333 | CD79B AND AQP1 | B-Cell Diffuse | 0.707692 | 0.821429 | 0.621622 |
| GRIA2 AND ANTXR1 | Oligodendroglioma | 0.928571 | 1 | 0.866667 | CD79B AND MCAM | B-Cell Diffuse | 0.705882 | 0.774194 | 0.648649 |
| PCDHGC3 AND TSPAN7 | Oligodendroglioma | 0.888889 | 1 | 0.8 | CD79A AND SLC1A3 | B-Cell Diffuse | 0.705882 | 0.774194 | 0.648649 |
| KCNK15 AND PCDH19 | Ovarian | 0.869565 | 0.909091 | 0.833333 | P2RX5 AND ENPP2 | B-Cell Diffuse | 0.704225 | 0.735294 | 0.675676 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| KCNK15 AND SLC26A7 | Ovarian | 0.857143 | 1 | 0.75 | CD180 AND SLC2A5 | B-Cell Diffuse | 0.75 | 0.771429 | 0.72973 |
| KCNK15 AND TACR2 | Ovarian | 0.909091 | 1 | 0.833333 | MS4A1 AND CELSR1 | Mantle-Cell Lymphoma | 0.962025 | 0.926829 | 1 |
| ADAM12 AND CD99 | Sarcoma | 0.785714 | 1 | 0.647059 | MS4A1 AND ST14 | Mantle-Cell Lymphoma | 0.944444 | 1 | 0.894737 |
| DDR2 AND SLC20A1 | Sarcoma | 0.8 | 0.923077 | 0.705882 | MS4A1 AND CLECL1 | Mantle-Cell Lymphoma | 0.894118 | 0.808511 | 1 |
| ADAM12 AND VMP1 | Sarcoma | 0.866667 | 1 | 0.764706 | P2RX5 AND PKD2L1 | Mantle-Cell Lymphoma | 0.933333 | 0.945946 | 0.921053 |
| OSMR AND TNFSF4 | Sarcoma | 0.827586 | 1 | 0.705882 | P2RX5 AND STRA6 | Mantle-Cell Lymphoma | 0.935065 | 0.923077 | 0.947368 |
| ADAM12 AND HLA-B | Sarcoma | 0.969697 | 1 | 0.941176 | P2RX5 AND CELSR1 | Mantle-Cell Lymphoma | 0.909091 | 0.897436 | 0.921053 |
| OSMR AND ITGA11 | Sarcoma | 0.827586 | 1 | 0.705882 | MS4A1 AND KCNN4 | Mantle-Cell Lymphoma | 0.974359 | 0.95 | 1 |
| OSMR AND PDGFRB | Sarcoma | 0.875 | 0.933333 | 0.823529 | P2RX5 AND MRGPRX4 | Mantle-Cell Lymphoma | 0.894737 | 0.894737 | 0.894737 |
| TSPAN8 AND FXYD5 | Stomach | 0.860759 | 0.944444 | 0.790698 | P2RX5 AND SLC13A3 | Mantle-Cell Lymphoma | 0.909091 | 0.897436 | 0.921053 |
| GOLM1 AND FXYD5 | Stomach | 0.8 | 0.765957 | 0.837209 | P2RX5 AND TSPAN1 | Mantle-Cell Lymphoma | 0.876712 | 0.914286 | 0.842105 |
| LSR AND FXYD5 | Stomach | 0.915663 | 0.95 | 0.883721 | CD52 AND KCNN4 | Mantle-Cell Lymphoma | 0.888889 | 0.837209 | 0.947368 |
| VSIG1 AND PTPRK | Stomach | 0.735294 | 1 | 0.581395 | P2RX5 AND OR2S2 | Mantle-Cell Lymphoma | 0.911392 | 0.878049 | 0.947368 |
| VSIG1 AND GPRC5A | Stomach | 0.735294 | 1 | 0.581395 | P2RX5 AND IL17RC | Mantle-Cell Lymphoma | 0.891892 | 0.916667 | 0.868421 |
| VSIG1 AND PMEPA1 | Stomach | 0.724638 | 0.961538 | 0.581395 | P2RX5 AND ADAM15 | Mantle-Cell Lymphoma | 0.868421 | 0.868421 | 0.868421 |
| VSIG1 AND LRP11 | Stomach | 0.724638 | 0.961538 | 0.581395 | CD52 AND ST14 | Mantle-Cell Lymphoma | 0.882353 | 1 | 0.789474 |
| VSIG1 AND CD151 | Stomach | 0.724638 | 0.961538 | 0.581395 | P2RX5 AND ST14 | Mantle-Cell Lymphoma | 0.865672 | 1 | 0.763158 |
| GJB1 AND FXYD5 | Stomach | 0.95122 | 1 | 0.906977 | P2RX5 AND LRRC32 | Mantle-Cell Lymphoma | 0.9 | 0.857143 | 0.947368 |
| PTPRH AND FXYD5 | Stomach | 0.879121 | 0.833333 | 0.930233 | P2RX5 AND P2RX2 | Mantle-Cell Lymphoma | 0.923077 | 0.9 | 0.947368 |
| TSPAN8 AND MCAM | Stomach | 0.785714 | 0.804878 | 0.767442 | P2RX5 AND SLC22A24 | Mantle-Cell Lymphoma | 0.935065 | 0.923077 | 0.947368 |
| TM4SF5 AND FXYD5 | Stomach | 0.941176 | 0.952381 | 0.930233 | P2RX5 AND PTH1R | Mantle-Cell Lymphoma | 0.911392 | 0.878049 | 0.947368 |
| B3GNT3 AND FXYD5 | Stomach | 0.97619 | 1 | 0.953488 | P2RX5 AND TIE1 | Mantle-Cell Lymphoma | 0.911392 | 0.878049 | 0.947368 |
| VSIG1 AND PON2 | Stomach | 0.716418 | 1 | 0.55814 | P2RX5 AND KCNE2 | Mantle-Cell Lymphoma | 0.894737 | 0.894737 | 0.894737 |
| VSIG1 AND PDPN | Stomach | 0.716418 | 1 | 0.55814 | P2RX5 AND SLC34A3 | Mantle-Cell Lymphoma | 0.933333 | 0.945946 | 0.921053 |
| VSIG1 AND MYOF | Stomach | 0.716418 | 1 | 0.55814 | P2RX5 AND KCNK1 | Mantle-Cell Lymphoma | 0.911392 | 0.878049 | 0.947368 |
| VSIG1 AND EMP1 | Stomach | 0.714286 | 0.925926 | 0.581395 | P2RX5 AND EDNRA | Mantle-Cell Lymphoma | 0.86747 | 0.8 | 0.947368 |
| SYT13 AND FXYD5 | Stomach | 0.953488 | 0.953488 | 0.953488 | P2RX5 AND HEPH | Mantle-Cell Lymphoma | 0.861111 | 0.911765 | 0.815789 |
| VSIG1 AND TSPAN3 | Stomach | 0.735294 | 1 | 0.581395 | P2RX5 AND UPK2 | Mantle-Cell Lymphoma | 0.897436 | 0.875 | 0.921053 |
| VSIG1 AND PERP | Stomach | 0.714286 | 0.925926 | 0.581395 | P2RX5 AND OR51B4 | Mantle-Cell Lymphoma | 0.86747 | 0.8 | 0.947368 |
| VSIG1 AND ITGA2 | Stomach | 0.716418 | 1 | 0.55814 | MS4A1 AND LRRC32 | Mantle-Cell Lymphoma | 0.853933 | 0.745098 | 1 |
| VSIG1 AND LTBR | Stomach | 0.735294 | 1 | 0.581395 | P2RX5 AND FUT1 | Mantle-Cell Lymphoma | 0.853333 | 0.864865 | 0.842105 |
| VSIG1 AND ATP1A1 | Stomach | 0.716418 | 1 | 0.55814 | P2RX5 AND FXYD3 | Mantle-Cell Lymphoma | 0.911392 | 0.878049 | 0.947368 |
| VSIG1 AND GJB2 | Stomach | 0.724638 | 0.961538 | 0.581395 | P2RX5 AND CLSTN2 | Mantle-Cell Lymphoma | 0.886076 | 0.853659 | 0.921053 |
| VSIG1 AND ST14 | Stomach | 0.705882 | 0.96 | 0.55814 | P2RX5 AND TMEM150B | Mantle-Cell Lymphoma | 0.911392 | 0.878049 | 0.947368 |
| VSIG1 AND CLSTN1 | Stomach | 0.705882 | 0.96 | 0.55814 | P2RX5 AND ABCC8 | Mantle-Cell Lymphoma | 0.911392 | 0.878049 | 0.947368 |
| VSIG1 AND PLXNA1 | Stomach | 0.704225 | 0.892857 | 0.581395 | P2RX5 AND PROKR2 | Mantle-Cell Lymphoma | 0.935065 | 0.923077 | 0.947368 |
| VSIG1 AND PPAP2C | Stomach | 0.704225 | 0.892857 | 0.581395 | P2RX5 AND DCHS2 | Mantle-Cell Lymphoma | 0.888889 | 0.837209 | 0.947368 |
| VSIG1 AND LGR4 | Stomach | 0.724638 | 0.961538 | 0.581395 | P2RX5 AND AGTR1 | Mantle-Cell Lymphoma | 0.878049 | 0.818182 | 0.947368 |
| VSIG1 AND EMP2 | Stomach | 0.714286 | 0.925926 | 0.581395 | P2RX5 AND OR51M1 | Mantle-Cell Lymphoma | 0.9 | 0.857143 | 0.947368 |
| TM4SF5 AND CDH3 | Stomach | 0.795181 | 0.825 | 0.767442 | P2RX5 AND PAQR5 | Mantle-Cell Lymphoma | 0.891892 | 0.916667 | 0.868421 |
| VSIG1 AND LSR | Stomach | 0.704225 | 0.892857 | 0.581395 | P2RX5 AND PCDHB12 | Mantle-Cell Lymphoma | 0.923077 | 0.9 | 0.947368 |
| IYD AND FXYD5 | Stomach | 0.860759 | 0.944444 | 0.790698 | P2RX5 AND FCRL4 | Mantle-Cell Lymphoma | 0.878049 | 0.818182 | 0.947368 |
| TSPAN8 AND EDNRA | Stomach | 0.842105 | 0.969697 | 0.744186 | P2RX5 AND FAIM2 | Mantle-Cell Lymphoma | 0.90411 | 0.942857 | 0.868421 |
| VSIG1 AND FZD6 | Stomach | 0.716418 | 1 | 0.55814 | P2RX5 AND HRH1 | Mantle-Cell Lymphoma | 0.853333 | 0.864865 | 0.842105 |
| VSIG1 AND WNT5A | Stomach | 0.69697 | 1 | 0.534884 | CXCL9 AND CR2 | T-Cell, Peripheral | 0.784314 | 0.869565 | 0.714286 |
| VSIG1 AND TM4SF1 | Stomach | 0.69697 | 1 | 0.534884 | CXCL9 AND MS4A1 | T-Cell, Peripheral | 0.740741 | 0.769231 | 0.714286 |
| VSIG1 AND GJA1 | Stomach | 0.69697 | 1 | 0.534884 | CXCL9 AND P2RX5 | T-Cell, Peripheral | 0.740741 | 0.769231 | 0.714286 |
| VSIG1 AND DSG2 | Stomach | 0.704225 | 0.892857 | 0.581395 | CXCL9 AND CD22 | T-Cell, Peripheral | 0.692308 | 0.75 | 0.642857 |
| VSIG1 AND LDLR | Stomach | 0.714286 | 0.925926 | 0.581395 | CXCL9 AND ULBP2 | T-Cell, Peripheral | 0.72 | 0.818182 | 0.642857 |
| VSIG1 AND PTPRF | Stomach | 0.704225 | 0.892857 | 0.581395 | CXCL9 AND IL2RA | T-Cell, Peripheral | 0.679245 | 0.72 | 0.642857 |
| VSIG1 AND SLCO2B1 | Stomach | 0.695652 | 0.923077 | 0.55814 | CXCL9 AND CD38 | T-Cell, Peripheral | 0.641509 | 0.68 | 0.607143 |
| VSIG1 AND CD9 | Stomach | 0.695652 | 0.923077 | 0.55814 | CXCL9 AND CD79A | T-Cell, Peripheral | 0.62963 | 0.653846 | 0.607143 |
| VSIG1 AND DAG1 | Stomach | 0.695652 | 0.923077 | 0.55814 | TNFSF11 AND IL2RB | T-Cell, Peripheral | 0.619048 | 0.928571 | 0.464286 |
| VSIG1 AND OSMR | Stomach | 0.694444 | 0.862069 | 0.581395 | GPR174 AND GPNMB | T-Cell, Peripheral | 0.638889 | 0.522727 | 0.821429 |
| VSIG1 AND TNFRSF21 | Stomach | 0.694444 | 0.862069 | 0.581395 | BTLA AND TPBG | T-Cell, Peripheral | 0.615385 | 0.666667 | 0.571429 |
| VSIG1 AND EPHB4 | Stomach | 0.694444 | 0.862069 | 0.581395 | TNFSF11 AND CLEC2D | T-Cell, Peripheral | 0.622222 | 0.823529 | 0.5 |
| PTPRH AND TACSTD2 | Stomach | 0.831461 | 0.804348 | 0.860465 | TNFRSF9 AND TPBG | T-Cell, Peripheral | 0.625 | 0.75 | 0.535714 |
| VSIG1 AND ABHD12 | Stomach | 0.716418 | 1 | 0.55814 | TNFSF11 AND GPR174 | T-Cell, Peripheral | 0.622222 | 0.823529 | 0.5 |
| VSIG1 AND AKAP1 | Stomach | 0.694444 | 0.862069 | 0.581395 | ITGAL AND GPNMB | T-Cell, Peripheral | 0.631579 | 0.5 | 0.857143 |
| VSIG1 AND PRRG1 | Stomach | 0.694444 | 0.862069 | 0.581395 | TNFSF11 AND CD28 | T-Cell, Peripheral | 0.608696 | 0.777778 | 0.5 |
| KCNE3 AND DIO2 | Stomach | 0.787234 | 0.72549 | 0.860465 | EDNRB AND IL6R | Melanoma | 0.9 | 1 | 0.818182 |
| TSPAN8 AND PDGFRB | Stomach | 0.842105 | 0.969697 | 0.744186 | EDNRB AND IL1RAP | Melanoma | 0.9 | 1 | 0.818182 |
| LSR AND TNFSF15 | Stomach | 0.840909 | 0.822222 | 0.860465 | EDNRB AND ABCC5 | Melanoma | 0.9 | 1 | 0.818182 |
| VSIG1 AND SPINT1 | Stomach | 0.735294 | 1 | 0.581395 | EDNRB AND JAG2 | Melanoma | 0.9 | 1 | 0.818182 |
| VSIG1 AND SDF4 | Stomach | 0.695652 | 0.923077 | 0.55814 | EDNRB AND CLCN5 | Melanoma | 0.9 | 1 | 0.818182 |
| VSIG1 AND TNFRSF11A | Stomach | 0.735294 | 1 | 0.581395 | EDNRB AND JTB | Melanoma | 0.9 | 1 | 0.818182 |
| VSIG1 AND S100A10 | Stomach | 0.714286 | 0.925926 | 0.581395 | EDNRB AND GPR37 | Melanoma | 0.9 | 1 | 0.818182 |
| VSIG1 AND ATP2A2 | Stomach | 0.714286 | 0.925926 | 0.581395 | EDNRB AND DLL1 | Melanoma | 0.9 | 1 | 0.818182 |
| TSPAN1 AND FXYD5 | Stomach | 0.934783 | 0.877551 | 1 | EDNRB AND SLC2A8 | Melanoma | 0.9 | 1 | 0.818182 |
| TM4SF5 AND PDPN | Stomach | 0.808511 | 0.745098 | 0.883721 | SLC10A4 AND CD276 | Neuroblastoma | 0.953488 | 0.931818 | 0.97619 |
| VSIG1 AND SGCB | Stomach | 0.716418 | 1 | 0.55814 | SLC10A4 AND PTK7 | Neuroblastoma | 0.947977 | 0.921348 | 0.97619 |
| TSPAN8 AND PDPN | Stomach | 0.780488 | 0.820513 | 0.744186 | SLC10A4 AND L1CAM | Neuroblastoma | 0.943182 | 0.902174 | 0.988095 |
| VSIG1 AND B3GNT3 | Stomach | 0.694444 | 0.862069 | 0.581395 | SLC10A4 AND CLDN12 | Neuroblastoma | 0.935673 | 0.91954 | 0.952381 |
| VSIG1 AND FAM57A | Stomach | 0.704225 | 0.892857 | 0.581395 | CHRNA3 AND THY1 | Neuroblastoma | 0.909091 | 0.925926 | 0.892857 |
| VSIG1 AND NRP1 | Stomach | 0.686567 | 0.958333 | 0.534884 | SLC10A4 AND CBX3 | Neuroblastoma | 0.907975 | 0.936709 | 0.880952 |
| VSIG1 AND CAV2 | Stomach | 0.685714 | 0.888889 | 0.55814 | GRIA2 AND EGFR | Oligodendroglioma | 0.903226 | 0.875 | 0.933333 |
| VSIG1 AND AQP1 | Stomach | 0.685714 | 0.888889 | 0.55814 | GPRC5B AND EGFR | Oligodendroglioma | 0.896552 | 0.928571 | 0.866667 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| VSIG1 AND CLPTM1 | Stomach | 0.685714 | 0.888889 | 0.55814 | PTPRZ1 AND EGFR | Oligodendroglioma | 0.846154 | 1 | 0.733333 |
| VSIG1 AND MFSD10 | Stomach | 0.685714 | 0.888889 | 0.55814 | PTPRZ1 AND CD38 | Oligodendroglioma | 0.888889 | 1 | 0.8 |
| VSIG1 AND SLC4A2 | Stomach | 0.714286 | 0.925926 | 0.581395 | GPM6A AND EGFR | Oligodendroglioma | 0.933333 | 0.933333 | 0.933333 |
| VSIG1 AND SLC39A10 | Stomach | 0.684932 | 0.833333 | 0.581395 | NRXN2 AND EGFR | Oligodendroglioma | 0.827586 | 0.857143 | 0.8 |
| VSIG1 AND HEPH | Stomach | 0.684932 | 0.833333 | 0.581395 | NRCAM AND EGFR | Oligodendroglioma | 0.888889 | 1 | 0.8 |
| VSIG1 AND ANO1 | Stomach | 0.684932 | 0.833333 | 0.581395 | LSAMP AND EGFR | Oligodendroglioma | 0.827586 | 0.857143 | 0.8 |
| VSIG1 AND SLC12A7 | Stomach | 0.714286 | 0.925926 | 0.581395 | PTPRZ1 AND CD180 | Oligodendroglioma | 0.846154 | 1 | 0.733333 |
| VSIG1 AND KCNK1 | Stomach | 0.684932 | 0.833333 | 0.581395 | AQP4 AND EGFR | Oligodendroglioma | 0.814815 | 0.916667 | 0.733333 |
| VSIG1 AND CALCRL | Stomach | 0.684932 | 0.833333 | 0.581395 | APLP1 AND EGFR | Oligodendroglioma | 0.814815 | 0.916667 | 0.733333 |
| VSIG1 AND APOLD1 | Stomach | 0.684932 | 0.833333 | 0.581395 | NCAM2 AND EGFR | Oligodendroglioma | 0.888889 | 1 | 0.8 |
| VSIG1 AND JAG1 | Stomach | 0.684932 | 0.833333 | 0.581395 | SLC1A3 AND EGFR | Oligodendroglioma | 0.814815 | 0.916667 | 0.733333 |
| VSIG1 AND BMPR1A | Stomach | 0.694444 | 0.862069 | 0.581395 | PTPRZ1 AND CA9 | Oligodendroglioma | 0.8 | 1 | 0.666667 |
| LSR AND PDPN | Stomach | 0.86747 | 0.9 | 0.837209 | PTPRZ1 AND CD33 | Oligodendroglioma | 0.8 | 1 | 0.666667 |
| TSPAN8 AND DIO2 | Stomach | 0.717949 | 0.8 | 0.651163 | SLC6A1 AND EGFR | Oligodendroglioma | 0.814815 | 0.916667 | 0.733333 |
| VSIG1 AND BCAP31 | Stomach | 0.714286 | 0.925926 | 0.581395 | NLGN1 AND EGFR | Oligodendroglioma | 0.8 | 1 | 0.666667 |
| VSIG1 AND VIMP | Stomach | 0.735294 | 1 | 0.581395 | SLC22A17 AND EGFR | Oligodendroglioma | 0.928571 | 1 | 0.866667 |
| VSIG1 AND CDCP1 | Stomach | 0.694444 | 0.862069 | 0.581395 | PTPRZ1 AND CLDN1 | Oligodendroglioma | 0.857143 | 0.923077 | 0.8 |
| FXYD6 AND BEST3 | Astrocytoma | 0.831461 | 0.860465 | 0.804348 | ADAM22 AND EGFR | Oligodendroglioma | 0.8 | 0.8 | 0.8 |
| CRB1 AND F2R | Astrocytoma | 0.795699 | 0.787234 | 0.804348 | PTPRZ1 AND CR2 | Oligodendroglioma | 0.8 | 1 | 0.666667 |
| KCNJ10 AND F2R | Astrocytoma | 0.774194 | 0.765957 | 0.782609 | PTPRZ1 AND CSPG4 | Oligodendroglioma | 0.8 | 1 | 0.666667 |
| NKAIN4 AND GPR137B | Astrocytoma | 0.772727 | 0.809524 | 0.73913 | MUC16 AND SLC1A3 | Ovarian | 0.736842 | 1 | 0.583333 |
| NKAIN4 AND F2R | Astrocytoma | 0.764045 | 0.790698 | 0.73913 | KCNK15 AND VTCN1 | Ovarian | 0.736842 | 1 | 0.583333 |
| MLC1 AND F2R | Astrocytoma | 0.76087 | 0.76087 | 0.76087 | MUC16 AND SLC16A10 | Ovarian | 0.761905 | 0.888889 | 0.666667 |
| SLCO1C1 AND F2R | Astrocytoma | 0.758621 | 0.804878 | 0.717391 | MUC16 AND ADORA3 | Ovarian | 0.727273 | 0.8 | 0.666667 |
| NKAIN4 AND LAPTM5 | Astrocytoma | 0.756098 | 0.861111 | 0.673913 | MUC16 AND NRCAM | Ovarian | 0.736842 | 1 | 0.583333 |
| GABBR2 AND F2R | Astrocytoma | 0.782609 | 0.782609 | 0.782609 | MUC16 AND PCDH19 | Ovarian | 0.666667 | 1 | 0.5 |
| CRB1 AND BEST3 | Astrocytoma | 0.752941 | 0.820513 | 0.695652 | KCNK15 AND SDC1 | Ovarian | 0.666667 | 0.6 | 0.75 |
| NKAIN4 AND CD44 | Astrocytoma | 0.752941 | 0.820513 | 0.695652 | MUC16 AND CDH2 | Ovarian | 0.7 | 0.875 | 0.583333 |
| MLC1 AND BEST3 | Astrocytoma | 0.741573 | 0.767442 | 0.717391 | MUC16 AND SUSD3 | Ovarian | 0.761905 | 0.888889 | 0.666667 |
| GABBR2 AND BEST3 | Astrocytoma | 0.738095 | 0.815789 | 0.673913 | OR51E2 AND EPCAM | Prostate | 0.857143 | 1 | 0.75 |
| NKAIN4 AND SORL1 | Astrocytoma | 0.736842 | 0.933333 | 0.608696 | ATP2C1 AND EPCAM | Prostate | 0.857143 | 1 | 0.75 |
| TTYH2 AND BEST3 | Astrocytoma | 0.735632 | 0.780488 | 0.695652 | ANO7 AND EPCAM | Prostate | 0.857143 | 1 | 0.75 |
| CRB1 AND SEMA4B | Astrocytoma | 0.734694 | 0.692308 | 0.782609 | FAP AND JTB | Sarcoma | 0.785714 | 1 | 0.647059 |
| MLC1 AND SEMA4B | Astrocytoma | 0.729167 | 0.7 | 0.76087 | MUC13 AND FXYD5 | Stomach | 0.965517 | 0.954545 | 0.976744 |
| KCNJ10 AND BEST3 | Astrocytoma | 0.722892 | 0.810811 | 0.652174 | CLDN18 AND ST14 | Stomach | 0.886076 | 0.972222 | 0.813953 |
| SLC1A2 AND F2R | Astrocytoma | 0.716981 | 0.633333 | 0.826087 | MUC13 AND MCAM | Stomach | 0.901099 | 0.854167 | 0.953488 |
| SLCO1C1 AND BEST3 | Astrocytoma | 0.708861 | 0.848485 | 0.608696 | TSPAN8 AND THY1 | Stomach | 0.815789 | 0.939394 | 0.72093 |
| NKAIN4 AND CXCL16 | Astrocytoma | 0.708861 | 0.848485 | 0.608696 | CLDN18 AND GJB2 | Stomach | 0.9 | 0.972973 | 0.837209 |
| SLCO1C1 AND LAPTM5 | Astrocytoma | 0.707317 | 0.805556 | 0.630435 | TSPAN1 AND THY1 | Stomach | 0.8 | 0.701754 | 0.930233 |
| SLC39A12 AND F2R | Astrocytoma | 0.705882 | 0.769231 | 0.652174 | MUC13 AND CDH5 | Stomach | 0.91954 | 0.909091 | 0.930233 |
| MOG AND F2R | Astrocytoma | 0.704545 | 0.738095 | 0.673913 | CLDN18 AND BRCA1 | Stomach | 0.871795 | 0.971429 | 0.790698 |
| PPAPDC1A AND VANGL1 | Breast | 0.744681 | 0.875 | 0.648148 | CLDN18 AND B3GNT3 | Stomach | 0.847059 | 0.857143 | 0.837209 |
| PPAPDC1A AND LRRC8E | Breast | 0.76087 | 0.921053 | 0.648148 | CLDN18 AND F2RL2 | Stomach | 0.85 | 0.918919 | 0.790698 |
| PPAPDC1A AND ATP8B1 | Breast | 0.77551 | 0.863636 | 0.703704 | MUC13 AND PDPN | Stomach | 0.898876 | 0.869565 | 0.930233 |
| PPAPDC1A AND VAMP8 | Breast | 0.767677 | 0.844444 | 0.703704 | CLDN18 AND LGR4 | Stomach | 0.878049 | 0.923077 | 0.837209 |
| PPAPDC1A AND TGFBI | Breast | 0.765957 | 0.9 | 0.666667 | CLDN18 AND TM4SF5 | Stomach | 0.875 | 0.945946 | 0.813953 |
| PPAPDC1A AND TNFRSF12A | Breast | 0.715789 | 0.829268 | 0.62963 | CEACAM5 AND FXYD5 | Stomach | 0.883117 | 1 | 0.790698 |
| PPAPDC1A AND AOC3 | Breast | 0.714286 | 0.795455 | 0.648148 | CLDN18 AND PPAP2C | Stomach | 0.888889 | 0.947368 | 0.837209 |
| BST2 AND VANGL1 | Breast | 0.712644 | 0.939394 | 0.574074 | MUC13 AND LDLRAD3 | Stomach | 0.866667 | 0.829787 | 0.906977 |
| BST2 AND LRRC8E | Breast | 0.727273 | 0.941176 | 0.592593 | MUC13 AND EDNRA | Stomach | 0.963855 | 1 | 0.930233 |
| PPAPDC1A AND SLC22A18 | Breast | 0.709677 | 0.846154 | 0.611111 | MUC13 AND PDGFRB | Stomach | 0.941176 | 0.952381 | 0.930233 |
| PPAPDC1A AND F2R | Breast | 0.709677 | 0.846154 | 0.611111 | CLDN18 AND TNFRSF11A | Stomach | 0.911392 | 1 | 0.837209 |
| PPAPDC1A AND PPAPDC1B | Breast | 0.762887 | 0.860465 | 0.685185 | CLDN18 AND SLC16A1 | Stomach | 0.837209 | 0.837209 | 0.837209 |
| PPAPDC1A AND PHLDB2 | Breast | 0.74 | 0.804348 | 0.685185 | CLDN18 AND F2RL1 | Stomach | 0.911392 | 1 | 0.837209 |
| PPAPDC1A AND BST2 | Breast | 0.772727 | 1 | 0.62963 | MUC13 AND APOLD1 | Stomach | 0.875 | 0.792453 | 0.976744 |
| PPAPDC1A AND ANTXR2 | Breast | 0.76 | 0.826087 | 0.703704 | CLDN18 AND GOLM1 | Stomach | 0.843373 | 0.875 | 0.813953 |
| PPAPDC1A AND BTN3A1 | Breast | 0.696629 | 0.885714 | 0.574074 | CLDN18 AND TSPAN8 | Stomach | 0.835443 | 0.916667 | 0.767442 |
| ENPP1 AND LRRC8E | Breast | 0.72381 | 0.745098 | 0.703704 | MUC13 AND CALCRL | Stomach | 0.880952 | 0.902439 | 0.860465 |
| PPAPDC1A AND PTGER4 | Breast | 0.711538 | 0.74 | 0.685185 | CLDN18 AND SEMA4G | Stomach | 0.808989 | 0.782609 | 0.837209 |
| PPAPDC1A AND CXCL16 | Breast | 0.707071 | 0.777778 | 0.648148 | CLDN18 AND ABCC3 | Stomach | 0.86747 | 0.9 | 0.837209 |
| PPAPDC1A AND CD163 | Breast | 0.770833 | 0.880952 | 0.685185 | CLDN18 AND SLC7A1 | Stomach | 0.888889 | 0.947368 | 0.837209 |
| PPAPDC1A AND ATP7A | Breast | 0.678899 | 0.672727 | 0.685185 | CLDN18 AND ATP10B | Stomach | 0.772727 | 0.755556 | 0.790698 |
| PPAPDC1A AND SLC31A1 | Breast | 0.778947 | 0.902439 | 0.685185 | VSIG1 AND CLDN1 | Stomach | 0.735294 | 1 | 0.581395 |
| PPAPDC1A AND CD58 | Breast | 0.723404 | 0.85 | 0.62963 | CLDN18 AND SYT13 | Stomach | 0.839506 | 0.894737 | 0.790698 |
| PPAPDC1A AND TNFRSF10B | Breast | 0.666667 | 0.708333 | 0.62963 | CLDN18 AND SLC39A14 | Stomach | 0.837209 | 0.837209 | 0.837209 |
| CDH11 AND VANGL1 | Breast | 0.697674 | 0.9375 | 0.555556 | B3GNT3 AND THY1 | Stomach | 0.952381 | 0.97561 | 0.930233 |
| PPAPDC1A AND BTN3A3 | Breast | 0.658824 | 0.903226 | 0.518519 | CLDN18 AND SLC12A2 | Stomach | 0.839506 | 0.894737 | 0.790698 |
| PPAPDC1A AND PROCR | Breast | 0.695652 | 0.842105 | 0.592593 | PTPRH AND THY1 | Stomach | 0.83871 | 0.78 | 0.906977 |
| PPAPDC1A AND SLC38A1 | Breast | 0.652174 | 0.789474 | 0.555556 | CLDN18 AND DIO2 | Stomach | 0.775 | 0.837838 | 0.72093 |
| PPAPDC1A AND IFNAR2 | Breast | 0.650602 | 0.931034 | 0.5 | CLDN18 AND CDH3 | Stomach | 0.853333 | 1 | 0.744186 |
| TNFRSF12A AND VANGL1 | Breast | 0.679612 | 0.714286 | 0.648148 | EPCAM AND DIO2 | Stomach | 0.747475 | 0.660714 | 0.860465 |
| PPAPDC1A AND CDH11 | Breast | 0.65 | 1 | 0.481481 | MUC13 AND IFITM2 | Stomach | 0.911111 | 0.87234 | 0.953488 |
| CDH11 AND LRRC8E | Breast | 0.65 | 1 | 0.481481 | CEACAM5 AND MCAM | Stomach | 0.777778 | 0.744681 | 0.813953 |
| TNFRSF12A AND LRRC8E | Breast | 0.747253 | 0.918919 | 0.62963 | VSIG1 AND ERBB2 | Stomach | 0.724638 | 0.961538 | 0.581395 |
| ENPP1 AND LAPTM5 | Breast | 0.704545 | 0.911765 | 0.574074 | NCAM1 AND SLC39A6 | Astrocytoma | 0.606742 | 0.627907 | 0.586957 |
| CDH11 AND FLVCR1 | Breast | 0.714286 | 1 | 0.555556 | NCAM1 AND EDNRB | Astrocytoma | 0.606061 | 0.566038 | 0.652174 |
| ENPP1 AND SLC38A1 | Breast | 0.647059 | 0.6875 | 0.611111 | FAP AND CLDN4 | Breast | 0.791209 | 0.972973 | 0.666667 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC2A2 AND ALCAM | Liver | 1 | 1 | 1 | FAP AND SDC1 | Breast | 0.875 | 1 | 0.777778 |
| SLC2A2 AND DTNA | Liver | 0.909091 | 1 | 0.833333 | FAP AND WT1 | Breast | 0.808081 | 0.888889 | 0.740741 |
| SLC2A2 AND GPR158 | Liver | 0.909091 | 1 | 0.833333 | FAP AND MS4A1 | Breast | 0.744681 | 0.875 | 0.648148 |
| SLC2A2 AND FGF6 | Liver | 0.833333 | 0.833333 | 0.833333 | FAP AND SLC7A5 | Breast | 0.868687 | 0.955556 | 0.796296 |
| SLC13A5 AND PLVAP | Liver | 0.8 | 1 | 0.666667 | FAP AND FOLH1 | Breast | 0.828283 | 0.911111 | 0.759259 |
| SLCO1B1 AND FGF6 | Liver | 0.833333 | 0.833333 | 0.833333 | FAP AND CLDN7 | Breast | 0.698795 | 1 | 0.537037 |
| SLCO1B1 AND PLVAP | Liver | 0.8 | 1 | 0.666667 | FAP AND BIRC5 | Breast | 0.82 | 0.891304 | 0.759259 |
| SLC2A2 AND NPFFR1 | Liver | 0.8 | 1 | 0.666667 | FAP AND SSTR4 | Breast | 0.744681 | 0.875 | 0.648148 |
| SLC2A2 AND GABRG3 | Liver | 0.8 | 1 | 0.666667 | FAP AND RNF43 | Breast | 0.857143 | 0.954545 | 0.777778 |
| SLC2A2 AND PCDHB1 | Liver | 0.857143 | 0.75 | 1 | FAP AND CD22 | Breast | 0.757895 | 0.878049 | 0.666667 |
| SLCO1B1 AND SMPD2 | Liver | 1 | 1 | 1 | TPBG AND FAP | Breast | 0.705882 | 0.967742 | 0.555556 |
| SLC2A2 AND SLC22A11 | Liver | 0.909091 | 1 | 0.833333 | FAP AND CXCR5 | Breast | 0.755102 | 0.840909 | 0.685185 |
| SLC2A2 AND ZACN | Liver | 0.909091 | 1 | 0.833333 | VTCN1 AND VCAM1 | Breast | 0.690476 | 0.966667 | 0.537037 |
| SLC2A2 AND SEZ6 | Liver | 0.857143 | 0.75 | 1 | FAP AND BCAN | Breast | 0.723404 | 0.85 | 0.62963 |
| SLCO1B1 AND ZACN | Liver | 0.909091 | 1 | 0.833333 | VTCN1 AND KDR | Breast | 0.690476 | 0.966667 | 0.537037 |
| SLCO1B1 AND SLC22A12 | Liver | 0.769231 | 0.714286 | 0.833333 | FAP AND MUC13 | Breast | 0.795918 | 0.886364 | 0.722222 |
| SLC2A2 AND MRGPRX2 | Liver | 0.769231 | 0.714286 | 0.833333 | VTCN1 AND GPNMB | Breast | 0.690476 | 0.966667 | 0.537037 |
| SLC2A2 AND KCNJ6 | Liver | 0.909091 | 1 | 0.833333 | VTCN1 AND THY1 | Breast | 0.682927 | 1 | 0.518519 |
| SLC2A2 AND SLC22A12 | Liver | 0.769231 | 0.714286 | 0.833333 | VTCN1 AND SLC7A5 | Breast | 0.682927 | 1 | 0.518519 |
| SLC2A2 AND CNTNAP4 | Liver | 0.769231 | 0.714286 | 0.833333 | FAP AND CD70 | Breast | 0.816327 | 0.909091 | 0.740741 |
| SLCO1B1 AND NPFFR1 | Liver | 0.8 | 1 | 0.666667 | FAP AND MUC4 | Breast | 0.681319 | 0.837838 | 0.574074 |
| SLC2A2 AND SLC12A9 | Liver | 0.8 | 1 | 0.666667 | FAP AND SLAMF7 | Breast | 0.782609 | 0.947368 | 0.666667 |
| SLC2A2 AND SLC30A8 | Liver | 0.769231 | 0.714286 | 0.833333 | VTCN1 AND CD34 | Breast | 0.674699 | 0.965517 | 0.518519 |
| ABCG5 AND ALCAM | Liver | 1 | 1 | 1 | FAP AND DNAJB8 | Breast | 0.674157 | 0.857143 | 0.555556 |
| SLC17A2 AND SLC22A12 | Liver | 0.769231 | 0.714286 | 0.833333 | TPBG AND CLDN4 | Breast | 0.674157 | 0.857143 | 0.555556 |
| SLC2A2 AND GRM3 | Liver | 0.769231 | 0.714286 | 0.833333 | CLDN2 AND CD276 | Liver | 0.909091 | 1 | 0.833333 |
| SLCO1B1 AND ALCAM | Liver | 1 | 1 | 1 | CLDN2 AND CD70 | Liver | 0.769231 | 0.714286 | 0.833333 |
| SLCO1B1 AND KCNJ6 | Liver | 0.909091 | 1 | 0.833333 | CLDN2 AND SDC1 | Liver | 0.8 | 1 | 0.666667 |
| SLC17A2 AND SMPD2 | Liver | 0.909091 | 1 | 0.833333 | CLDN2 AND CLDN1 | Liver | 0.8 | 1 | 0.666667 |
| SLCO1B1 AND DTNA | Liver | 0.909091 | 1 | 0.833333 | CLDN2 AND IL11RA | Liver | 0.615385 | 0.571429 | 0.666667 |
| SLC2A2 AND SMPD2 | Liver | 1 | 1 | 1 | FAP AND EPCAM | Pancreas | 0.777778 | 1 | 0.636364 |
| SLC2A2 AND HTR1E | Liver | 0.769231 | 0.714286 | 0.833333 | FAP AND CLDN7 | Pancreas | 0.842105 | 1 | 0.727273 |
| SLC2A2 AND SLC8A3 | Liver | 0.8 | 1 | 0.666667 | FAP AND ITGB6 | Pancreas | 0.777778 | 1 | 0.636364 |
| SLC2A2 AND MAG | Liver | 0.833333 | 0.833333 | 0.833333 | FAP AND PROM1 | Pancreas | 0.777778 | 1 | 0.636364 |
| SLC2A2 AND UPK3A | Liver | 0.8 | 1 | 0.666667 | FAP AND MUC13 | Pancreas | 0.705882 | 1 | 0.545455 |
| SLC2A2 AND GRM1 | Liver | 0.857143 | 0.75 | 1 | FAP AND ERBB3 | Pancreas | 0.842105 | 1 | 0.727273 |
| SLCO1B1 AND GABRG3 | Liver | 0.8 | 1 | 0.666667 | FAP AND CLDN18 | Pancreas | 0.625 | 1 | 0.454545 |
| SLC2A2 AND KCNK16 | Liver | 0.833333 | 0.833333 | 0.833333 | FAP AND CD79A | Pancreas | 0.705882 | 1 | 0.545455 |
| SLC43A1 AND ALCAM | Liver | 0.909091 | 1 | 0.833333 | FAP AND CD52 | Pancreas | 0.777778 | 1 | 0.636364 |
| SLCO1B1 AND SLC22A5 | Liver | 0.833333 | 0.833333 | 0.833333 | FAP AND FCRL5 | Pancreas | 0.842105 | 1 | 0.727273 |
| SLC2A2 AND ROS1 | Liver | 0.857143 | 0.75 | 1 | FAP AND CD37 | Pancreas | 0.705882 | 1 | 0.545455 |
| SLC2A2 AND CACNA1E | Liver | 0.769231 | 0.714286 | 0.833333 | FAP AND MST1R | Pancreas | 0.705882 | 1 | 0.545455 |
| SLC2A2 AND GABRA5 | Liver | 0.857143 | 0.75 | 1 | FAP AND VCAM1 | Pancreas | 0.777778 | 1 | 0.636364 |
| SLC2A2 AND PVRL1 | Liver | 0.857143 | 0.75 | 1 | FAP AND CLDN23 | Pancreas | 0.777778 | 1 | 0.636364 |
| SLC2A2 AND SLC43A1 | Liver | 0.909091 | 1 | 0.833333 | FAP AND SLAMF7 | Pancreas | 0.705882 | 1 | 0.545455 |
| SLC2A2 AND CLSTN3 | Liver | 0.909091 | 1 | 0.833333 | FAP AND STEAP1 | Pancreas | 0.777778 | 1 | 0.636364 |
| SLCO1B1 AND GPR158 | Liver | 0.75 | 0.6 | 1 | FAP AND TNFSF11 | Pancreas | 0.842105 | 1 | 0.727273 |
| SLCO1B1 AND SEZ6 | Liver | 0.75 | 0.6 | 1 | FAP AND TNFRSF17 | Pancreas | 0.842105 | 1 | 0.727273 |
| SLCO1B1 AND PCDHB1 | Liver | 0.75 | 0.6 | 1 | FAP AND SDC1 | Pancreas | 0.705882 | 1 | 0.545455 |
| SLCO1B1 AND MUC12 | Liver | 0.833333 | 0.833333 | 0.833333 | FAP AND IGF1R | Pancreas | 0.842105 | 1 | 0.727273 |
| SLCO1B1 AND SLC30A8 | Liver | 0.75 | 0.6 | 1 | FAP AND TNFRSF10A | Pancreas | 0.777778 | 1 | 0.636364 |
| SLCO1B1 AND KCNK16 | Liver | 0.833333 | 0.833333 | 0.833333 | FAP AND FOLH1 | Pancreas | 0.842105 | 1 | 0.727273 |
| ABCG5 AND DTNA | Liver | 0.909091 | 1 | 0.833333 | CLDN2 AND GPNMB | Pancreas | 0.842105 | 1 | 0.727273 |
| SLC17A2 AND ZACN | Liver | 0.8 | 1 | 0.666667 | FAP AND SLC7A5 | Pancreas | 0.842105 | 1 | 0.727273 |
| SLCO1B3 AND ALCAM | Liver | 0.8 | 1 | 0.666667 | FAP AND MUC4 | Pancreas | 0.777778 | 1 | 0.636364 |
| SLCO1B1 AND PVRL1 | Liver | 0.857143 | 0.75 | 1 | EPHA3 AND MUC13 | Pancreas | 0.631579 | 0.75 | 0.545455 |
| SLC2A2 AND OPCML | Liver | 0.857143 | 0.75 | 1 | FAP AND CD72 | Pancreas | 0.777778 | 1 | 0.636364 |
| SLCO1B1 AND SLC12A9 | Liver | 0.857143 | 0.75 | 1 | FAP AND CD38 | Pancreas | 0.777778 | 1 | 0.636364 |
| SLCO1B1 AND RGSL1 | Liver | 0.769231 | 0.714286 | 0.833333 | FAP AND FOLR1 | Pancreas | 0.777778 | 1 | 0.636364 |
| SLCO1B1 AND SLC6A11 | Liver | 0.8 | 1 | 0.666667 | FAP AND ULBP1 | Pancreas | 0.777778 | 1 | 0.636364 |
| SLCO1B1 AND MMP24 | Liver | 0.833333 | 0.833333 | 0.833333 | FAP AND STEAP2 | Pancreas | 0.777778 | 1 | 0.636364 |
| SLC2A2 AND TSHR | Liver | 0.769231 | 0.714286 | 0.833333 | FAP AND CLDN2 | Pancreas | 0.842105 | 1 | 0.727273 |
| ABCG8 AND ALCAM | Liver | 0.8 | 1 | 0.666667 | FAP AND IL2RA | Pancreas | 0.705882 | 1 | 0.545455 |
| SLC17A2 AND NPFFR1 | Liver | 0.8 | 1 | 0.666667 | FAP AND BMPR1B | Pancreas | 0.777778 | 1 | 0.636364 |
| SLCO1B1 AND SLC22A11 | Liver | 0.833333 | 0.833333 | 0.833333 | FAP AND EPHB2 | Pancreas | 0.842105 | 1 | 0.727273 |
| SLC2A2 AND NKAIN4 | Liver | 0.8 | 1 | 0.666667 | EPHA3 AND CLDN1 | Pancreas | 0.625 | 1 | 0.454545 |
| SLCO1B1 AND CALN1 | Liver | 0.8 | 0.666667 | 1 | EPHA3 AND CLDN2 | Pancreas | 0.705882 | 1 | 0.545455 |
| SLCO1B1 AND DRD5 | Liver | 0.75 | 0.6 | 1 | FAP AND RNF43 | Pancreas | 0.777778 | 1 | 0.636364 |
| SLCO1B1 AND OPCML | Liver | 0.75 | 0.6 | 1 | EPHA3 AND CD70 | Pancreas | 0.631579 | 0.75 | 0.545455 |
| SLC2A2 AND ACSL6 | Liver | 1 | 1 | 1 | EPHA3 AND PROM1 | Pancreas | 0.625 | 1 | 0.454545 |
| SLCO1B1 AND NKAIN4 | Liver | 0.8 | 1 | 0.666667 | FAP AND VTCN1 | Pancreas | 0.777778 | 1 | 0.636364 |
| SLC17A2 AND ALCAM | Liver | 0.909091 | 1 | 0.833333 | EPHA3 AND CD52 | Pancreas | 0.736842 | 0.875 | 0.636364 |
| SLC17A2 AND DTNA | Liver | 0.909091 | 1 | 0.833333 | TNFSF11 AND CLDN18 | Pancreas | 0.625 | 1 | 0.454545 |
| SLCO1B1 AND MAG | Liver | 0.769231 | 0.714286 | 0.833333 | EPHA3 AND IL13RA1 | Pancreas | 0.705882 | 1 | 0.545455 |
| C8B AND SMPD2 | Liver | 0.8 | 1 | 0.666667 | EPHA3 AND TNFSF11 | Pancreas | 0.666667 | 0.857143 | 0.545455 |
| SLCO1B1 AND TRPM3 | Liver | 0.833333 | 0.833333 | 0.833333 | FAP AND IL13RA1 | Pancreas | 0.842105 | 1 | 0.727273 |
| SLCO1B1 AND SCN2A | Liver | 0.769231 | 0.714286 | 0.833333 | FAP AND TRPM4 | Pancreas | 0.705882 | 1 | 0.545455 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC2A2 AND PCDHAC2 | Liver | 0.833333 | 0.833333 | 0.833333 | FAP AND MS4A1 | Pancreas | 0.705882 | 1 | 0.545455 |
| SLC2A2 AND CACNG1 | Liver | 0.769231 | 0.714286 | 0.833333 | FAP AND EGFR | Pancreas | 0.842105 | 1 | 0.727273 |
| SLC17A2 AND KCNJ6 | Liver | 0.8 | 1 | 0.666667 | FAP AND MET | Pancreas | 0.705882 | 1 | 0.545455 |
| SLCO1B1 AND GRM1 | Liver | 0.8 | 0.666667 | 1 | CLDN2 AND FCRL5 | Pancreas | 0.666667 | 0.5625 | 0.818182 |
| SLC2A2 AND LRRN4 | Liver | 0.8 | 1 | 0.666667 | FAP AND GUCY2C | Pancreas | 0.842105 | 1 | 0.727273 |
| SLC13A5 AND ZACN | Liver | 0.833333 | 0.833333 | 0.833333 | EPHA3 AND STEAP1 | Pancreas | 0.666667 | 0.857143 | 0.545455 |
| SLC2A2 AND CRB2 | Liver | 0.769231 | 0.714286 | 0.833333 | FAP AND FCRL2 | Pancreas | 0.842105 | 1 | 0.727273 |
| SLC2A2 AND OR7C1 | Liver | 0.769231 | 0.714286 | 0.833333 | EPHA3 AND STEAP2 | Pancreas | 0.6 | 0.666667 | 0.545455 |
| SLC2A2 AND GABRA3 | Liver | 0.909091 | 1 | 0.833333 | FAP AND FCRL1 | Pancreas | 0.842105 | 1 | 0.727273 |
| SLC2A2 AND MMP24 | Liver | 0.833333 | 0.833333 | 0.833333 | FAP AND CLDN12 | Pancreas | 0.777778 | 1 | 0.636364 |
| SLCO1B1 AND UPK3A | Liver | 0.727273 | 0.8 | 0.666667 | EPHA3 AND EPHB2 | Pancreas | 0.7 | 0.777778 | 0.636364 |
| SLCO1B1 AND MLANA | Liver | 0.727273 | 0.8 | 0.666667 | FAP AND SSTR5 | Pancreas | 0.705882 | 1 | 0.545455 |
| SLC2A2 AND KCNA7 | Liver | 0.727273 | 0.8 | 0.666667 | FAP AND SLC34A2 | Pancreas | 0.777778 | 1 | 0.636364 |
| SLC17A2 AND FGF6 | Liver | 0.727273 | 0.8 | 0.666667 | FAP AND CLDN1 | Pancreas | 0.777778 | 1 | 0.636364 |
| SLC2A2 AND HCN1 | Liver | 0.727273 | 0.8 | 0.666667 | FAP AND MUC16 | Pancreas | 0.842105 | 1 | 0.727273 |
| SLCO1B1 AND GABRA5 | Liver | 0.857143 | 0.75 | 1 | FAP AND LGR5 | Pancreas | 0.842105 | 1 | 0.727273 |
| SLC2A2 AND OR8D1 | Liver | 0.769231 | 0.714286 | 0.833333 | FAP AND CD72 | Pancreas | 0.666667 | 0.7 | 0.636364 |
| SLCO1B1 AND LRRN4 | Liver | 0.8 | 1 | 0.666667 | EPHA3 AND IL2RA | Pancreas | 0.608696 | 0.583333 | 0.636364 |
| SLCO1B1 AND GPR61 | Liver | 0.909091 | 1 | 0.833333 | FAP AND GPA33 | Pancreas | 0.842105 | 1 | 0.727273 |
| SLC2A2 AND DPP10 | Liver | 0.727273 | 0.8 | 0.666667 | CLDN2 AND VCAM1 | Renal | 0.761905 | 0.888889 | 0.666667 |
| SLC2A2 AND MLANA | Liver | 0.727273 | 0.8 | 0.666667 | VCAM1 AND ERBB3 | Renal | 0.736842 | 1 | 0.583333 |
| SLC30A8 AND HLA-DRB1 | Pancreas | 0.777778 | 1 | 0.636364 | CLDN2 AND GPNMB | Renal | 0.695652 | 0.727273 | 0.666667 |
| CLDN10 AND BST2 | Pancreas | 0.625 | 1 | 0.454545 | CLDN2 AND CD276 | Renal | 0.695652 | 0.727273 | 0.666667 |
| SLC30A8 AND BST2 | Pancreas | 0.777778 | 1 | 0.636364 | CLDN2 AND AXL | Renal | 0.761905 | 0.888889 | 0.666667 |
| PPAPDC1A AND CD58 | Pancreas | 0.705882 | 1 | 0.545455 | VCAM1 AND EPCAM | Renal | 0.666667 | 1 | 0.5 |
| SLC30A8 AND LAPTM5 | Pancreas | 0.777778 | 1 | 0.636364 | VCAM1 AND FOLR1 | Renal | 0.857143 | 1 | 0.75 |
| SLC2A2 AND HLA-DRB1 | Renal | 0.7 | 0.875 | 0.583333 | VCAM1 AND ERBB2 | Renal | 0.666667 | 1 | 0.5 |
| SLC17A1 AND IFNAR2 | Renal | 0.666667 | 1 | 0.5 | VCAM1 AND MUC1 | Renal | 0.666667 | 1 | 0.5 |
| SLC6A13 AND HLA-DRB1 | Renal | 0.631579 | 0.857143 | 0.5 | VCAM1 AND CLDN12 | Renal | 0.8 | 1 | 0.666667 |
| SLC22A2 AND VAMP8 | Renal | 0.631579 | 0.857143 | 0.5 | VCAM1 AND ABCB5 | Renal | 0.666667 | 0.6 | 0.75 |
| SLC13A1 AND EMP3 | Renal | 0.6 | 0.75 | 0.5 | VCAM1 AND SDC1 | Renal | 0.8 | 1 | 0.666667 |
| SLC17A1 AND HLA-DRB1 | Renal | 0.631579 | 0.857143 | 0.5 | VCAM1 AND CLDN1 | Renal | 0.857143 | 1 | 0.75 |
| SLC17A1 AND CXCL16 | Renal | 0.666667 | 1 | 0.5 | VCAM1 AND EGFR | Renal | 0.736842 | 1 | 0.583333 |
| NOX1 AND TGFBI | Colon | 0.909091 | 0.833333 | 1 | DPEP1 AND ITGAV | Colon | 0.909091 | 0.833333 | 1 |
| FUT3 AND TGFBI | Colon | 0.909091 | 0.833333 | 1 | DPEP1 AND CEACAM5 | Colon | 1 | 1 | 1 |
| IFI6 AND NOX1 | Colon | 1 | 1 | 1 | GPA33 AND CLDN1 | Colon | 1 | 1 | 1 |
| IFI6 AND FUT3 | Colon | 1 | 1 | 1 | CEACAM5 AND THY1 | Colon | 0.888889 | 1 | 0.8 |
| CDH17 AND TGFBI | Colon | 0.909091 | 0.833333 | 1 | DPEP1 AND CBX3 | Colon | 0.888889 | 1 | 0.8 |
| IFI6 AND FAT1 | Colon | 0.888889 | 1 | 0.8 | DPEP1 AND BIRC5 | Colon | 1 | 1 | 1 |
| IFI6 AND CDH17 | Colon | 0.888889 | 1 | 0.8 | GUCY2C AND CLDN1 | Colon | 1 | 1 | 1 |
| IFI6 AND CEACAM7 | Colon | 1 | 1 | 1 | MUC13 AND THY1 | Colon | 1 | 1 | 1 |
| IFI6 AND MUC12 | Colon | 1 | 1 | 1 | MUC13 AND CLDN1 | Colon | 1 | 1 | 1 |
| MUC12 AND TGFBI | Colon | 0.909091 | 0.833333 | 1 | GUCY2C AND THY1 | Colon | 1 | 1 | 1 |
| IFI6 AND EBP | Colon | 0.909091 | 0.833333 | 1 | GPA33 AND THY1 | Colon | 1 | 1 | 1 |
| IFI6 AND SLC22A18 | Colon | 0.75 | 1 | 0.6 | EPHB2 AND ITGAV | Colon | 0.888889 | 1 | 0.8 |
| IFI6 AND SLC50A1 | Colon | 0.727273 | 0.666667 | 0.8 | DPEP1 AND SLC7A5 | Colon | 0.909091 | 0.833333 | 1 |
| IFI6 AND LRIG3 | Colon | 0.8 | 0.8 | 0.8 | CLDN3 AND THY1 | Colon | 1 | 1 | 1 |
| IFI6 AND VANGL1 | Colon | 0.909091 | 0.833333 | 1 | MUC13 AND SLC7A5 | Colon | 1 | 1 | 1 |
| CDH17 AND PPAPDC1A | Colon | 0.75 | 1 | 0.6 | GUCY2C AND SLC7A5 | Colon | 1 | 1 | 1 |
| CDH17 AND BST2 | Colon | 0.75 | 1 | 0.6 | GPA33 AND SLC7A5 | Colon | 1 | 1 | 1 |
| IFI6 AND ATP8B1 | Colon | 0.888889 | 1 | 0.8 | CEACAM6 AND THY1 | Colon | 0.888889 | 1 | 0.8 |
| CDH17 AND CDH11 | Colon | 0.75 | 1 | 0.6 | DPEP1 AND STEAP1 | Colon | 0.888889 | 1 | 0.8 |
| SLC22A18 AND TGFBI | Colon | 0.666667 | 0.75 | 0.6 | CLDN7 AND THY1 | Colon | 1 | 1 | 1 |
| CLDN15 AND TGFBI | Colon | 0.666667 | 0.75 | 0.6 | CLDN3 AND SLC7A5 | Colon | 1 | 1 | 1 |
| IFI6 AND CLDN15 | Colon | 0.75 | 1 | 0.6 | CLDN3 AND ITGAV | Colon | 0.909091 | 0.833333 | 1 |
| IFI6 AND PAQR8 | Colon | 0.8 | 0.8 | 0.8 | CLDN2 AND ITGAV | Colon | 0.8 | 0.8 | 0.8 |
| IFI6 AND EFNB2 | Colon | 0.888889 | 1 | 0.8 | CEACAM5 AND FAP | Colon | 0.888889 | 1 | 0.8 |
| IFI6 AND PPAPDC1A | Colon | 0.888889 | 1 | 0.8 | CLDN2 AND CEACAM6 | Colon | 0.888889 | 1 | 0.8 |
| IFI6 AND SLC1A5 | Colon | 0.888889 | 1 | 0.8 | GUCY2C AND ITGAV | Colon | 1 | 1 | 1 |
| SLC22A18 AND CDH11 | Colon | 0.75 | 1 | 0.6 | EPHB2 AND THY1 | Colon | 0.888889 | 1 | 0.8 |
| CEACAM7 AND TGFBI | Colon | 0.909091 | 0.833333 | 1 | MUC13 AND FAP | Colon | 0.888889 | 1 | 0.8 |
| IFI6 AND FLVCR1 | Colon | 0.833333 | 0.714286 | 1 | CEACAM6 AND FAP | Colon | 0.888889 | 1 | 0.8 |
| GRIN2A AND TGFBI | Ependymoma | 1 | 1 | 1 | CLDN2 AND BIRC5 | Colon | 0.888889 | 1 | 0.8 |
| CXCL16 AND CDH17 | Esophagus | 0.666667 | 0.692308 | 0.642857 | GUCY2C AND FAP | Colon | 0.888889 | 1 | 0.8 |
| CXCL16 AND FUT3 | Esophagus | 0.782609 | 1 | 0.642857 | EPHB2 AND CLDN1 | Colon | 0.888889 | 1 | 0.8 |
| SLCO1B3 AND VANGL1 | Esophagus | 0.636364 | 0.875 | 0.5 | DPEP1 AND EPHB2 | Colon | 0.888889 | 1 | 0.8 |
| CXCL16 AND MUC17 | Esophagus | 0.782609 | 1 | 0.642857 | GPA33 AND FAP | Colon | 0.888889 | 1 | 0.8 |
| SLCO1B3 AND SLC6A6 | Esophagus | 0.636364 | 0.875 | 0.5 | EPHB2 AND FAP | Colon | 0.888889 | 1 | 0.8 |
| SLCO1B3 AND LRIG3 | Esophagus | 0.636364 | 0.875 | 0.5 | CLDN2 AND LGR5 | Colon | 0.888889 | 1 | 0.8 |
| GPR158 AND F2R | Glioblastoma | 0.83871 | 0.928571 | 0.764706 | RNF43 AND CEACAM5 | Colon | 0.75 | 1 | 0.6 |
| LYPD1 AND LAPTM5 | Glioblastoma | 0.903226 | 1 | 0.823529 | RNF43 AND CEACAM6 | Colon | 0.75 | 1 | 0.6 |
| LYPD1 AND ADAM29 | Glioblastoma | 0.777778 | 0.736842 | 0.823529 | DPEP1 AND IL20RA | Colon | 0.888889 | 1 | 0.8 |
| LYPD1 AND HLA-DRB1 | Glioblastoma | 0.777778 | 0.736842 | 0.823529 | CLDN7 AND ITGAV | Colon | 1 | 1 | 1 |
| CRB1 AND CD58 | Glioblastoma | 0.758621 | 0.916667 | 0.647059 | GPA33 AND ITGAV | Colon | 1 | 1 | 1 |
| LYPD1 AND SPAM1 | Glioblastoma | 0.742857 | 0.722222 | 0.764706 | MUC13 AND ITGAV | Colon | 1 | 1 | 1 |
| LYPD1 AND F2R | Glioblastoma | 0.740741 | 1 | 0.588235 | DPEP1 AND LGR5 | Colon | 0.888889 | 1 | 0.8 |
| MLC1 AND BTN3A3 | Glioblastoma | 0.736842 | 0.666667 | 0.823529 | CLDN7 AND FAP | Colon | 0.888889 | 1 | 0.8 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLCO1C1 AND LAPTM5 | Glioblastoma | 0.823529 | 0.823529 | 0.823529 | CLDN2 AND FAP | Colon | 0.888889 | 1 | 0.8 |
| SLCO1C1 AND TNFRSF12A | Glioblastoma | 0.733333 | 0.846154 | 0.647059 | CLDN3 AND FAP | Colon | 0.888889 | 1 | 0.8 |
| SLCO1C1 AND ANTXR2 | Glioblastoma | 0.727273 | 0.75 | 0.705882 | CLDN2 AND IL20RA | Colon | 0.888889 | 1 | 0.8 |
| LYPD1 AND ANTXR2 | Glioblastoma | 0.740741 | 1 | 0.588235 | CLDN2 AND EPHB2 | Colon | 0.888889 | 1 | 0.8 |
| CDH10 AND STAB1 | Glioblastoma | 0.758621 | 0.916667 | 0.647059 | EPCAM AND SLC7A5 | Esophagus | 0.8125 | 0.722222 | 0.928571 |
| LYPD1 AND CD44 | Glioblastoma | 0.758621 | 0.916667 | 0.647059 | EPCAM AND ITGAV | Esophagus | 0.692308 | 0.75 | 0.642857 |
| LYPD1 AND CD163 | Glioblastoma | 0.903226 | 1 | 0.823529 | CBX3 AND EPCAM | Esophagus | 0.666667 | 0.8 | 0.571429 |
| CDH10 AND LAPTM5 | Glioblastoma | 0.810811 | 0.75 | 0.882353 | EPCAM AND SDC1 | Esophagus | 0.88 | 1 | 0.785714 |
| MLC1 AND BST2 | Glioblastoma | 0.736842 | 0.666667 | 0.823529 | CBX3 AND MUC1 | Esophagus | 0.608696 | 0.777778 | 0.5 |
| LYPD1 AND CD93 | Glioblastoma | 0.785714 | 1 | 0.647059 | CBX3 AND ERBB3 | Esophagus | 0.666667 | 0.8 | 0.571429 |
| LYPD1 AND TGFBI | Glioblastoma | 0.8 | 0.923077 | 0.705882 | CBX3 AND CLDN7 | Esophagus | 0.666667 | 0.8 | 0.571429 |
| LYPD1 AND TNFRSF12A | Glioblastoma | 0.714286 | 0.909091 | 0.588235 | CBX3 AND RNF43 | Esophagus | 0.608696 | 0.777778 | 0.5 |
| CDH10 AND ANTXR2 | Glioblastoma | 0.785714 | 1 | 0.647059 | CBX3 AND CLDN1 | Esophagus | 0.666667 | 1 | 0.5 |
| SLCO1C1 AND CD93 | Glioblastoma | 0.727273 | 0.75 | 0.705882 | MUC13 AND SLC7A5 | Esophagus | 0.923077 | 1 | 0.857143 |
| ASTN1 AND EMP3 | Glioblastoma | 0.709677 | 0.785714 | 0.647059 | CBX3 AND EGFR | Esophagus | 0.64 | 0.727273 | 0.571429 |
| MLC1 AND TNFRSF12A | Glioblastoma | 0.709677 | 0.785714 | 0.647059 | CBX3 AND ITGB6 | Esophagus | 0.666667 | 0.8 | 0.571429 |
| CRB1 AND LAPTM5 | Glioblastoma | 0.709677 | 0.785714 | 0.647059 | MUC13 AND THY1 | Esophagus | 0.857143 | 0.857143 | 0.857143 |
| LYPD1 AND CXCL16 | Glioblastoma | 0.827586 | 1 | 0.705882 | CBX3 AND CLDN4 | Esophagus | 0.666667 | 0.8 | 0.571429 |
| SLCO1C1 AND CD58 | Glioblastoma | 0.787879 | 0.8125 | 0.764706 | CBX3 AND CLDN12 | Esophagus | 0.64 | 0.727273 | 0.571429 |
| LYPD1 AND CDH11 | Glioblastoma | 0.83871 | 0.928571 | 0.764706 | CBX3 AND KDR | Esophagus | 0.615385 | 0.666667 | 0.571429 |
| LYPD1 AND VAMP8 | Glioblastoma | 0.777778 | 0.736842 | 0.823529 | CBX3 AND IL20RA | Esophagus | 0.666667 | 0.8 | 0.571429 |
| SYT11 AND TNFRSF12A | Glioblastoma | 0.705882 | 0.705882 | 0.705882 | EPHB2 AND CLDN1 | Esophagus | 0.923077 | 1 | 0.857143 |
| SLCO1C1 AND CDH11 | Glioblastoma | 0.714286 | 0.6 | 0.882353 | CBX3 AND MUC13 | Esophagus | 0.608696 | 0.777778 | 0.5 |
| LYPD1 AND OR1C1 | Glioblastoma | 0.702703 | 0.65 | 0.764706 | BIRC5 AND EPCAM | Esophagus | 0.782609 | 1 | 0.642857 |
| LYPD1 AND SLCO1B3 | Glioblastoma | 0.736842 | 0.666667 | 0.823529 | EPHB2 AND SLC7A5 | Esophagus | 0.8 | 0.75 | 0.857143 |
| GPR158 AND SLC39A8 | Glioblastoma | 0.733333 | 0.846154 | 0.647059 | ITGAV AND CLDN3 | Esophagus | 0.608696 | 0.777778 | 0.5 |
| PCDH8 AND LAPTM5 | Glioblastoma | 0.8125 | 0.866667 | 0.764706 | CEACAM5 AND THY1 | Esophagus | 0.896552 | 0.866667 | 0.928571 |
| LYPD1 AND BST2 | Glioblastoma | 0.875 | 0.933333 | 0.823529 | CBX3 AND CLDN3 | Esophagus | 0.666667 | 0.8 | 0.571429 |
| LYPD1 AND DTNA | Glioblastoma | 0.7 | 0.608696 | 0.823529 | BMPR1B AND ITGAV | Glioblastoma | 0.702703 | 0.65 | 0.764706 |
| LYPD1 AND KCNJ10 | Glioblastoma | 0.7 | 0.608696 | 0.823529 | NCAM1 AND SLC39A6 | Glioma | 0.829268 | 0.944444 | 0.73913 |
| ASTN1 AND CD58 | Glioblastoma | 0.733333 | 0.846154 | 0.647059 | NCAM1 AND ITGAV | Glioma | 0.784314 | 0.714286 | 0.869565 |
| LYPD1 AND SYT11 | Glioblastoma | 0.7 | 0.608696 | 0.823529 | ITGAV AND BMPR1B | Glioma | 0.859259 | 0.878788 | 0.84058 |
| CDH10 AND EMP3 | Glioblastoma | 0.785714 | 1 | 0.647059 | ITGAV AND SLC7A5 | Glioma | 0.925373 | 0.953846 | 0.898551 |
| LYPD1 AND CD58 | Glioblastoma | 0.692308 | 1 | 0.529412 | NCAM1 AND IL13RA1 | Glioma | 0.753623 | 0.753623 | 0.753623 |
| LYPD1 AND EMP3 | Glioblastoma | 0.692308 | 1 | 0.529412 | ITGAV AND ULBP1 | Glioma | 0.859259 | 0.878788 | 0.84058 |
| GPR158 AND CD163 | Glioblastoma | 0.764706 | 0.764706 | 0.764706 | ITGAV AND SLC39A6 | Glioma | 0.868852 | 1 | 0.768116 |
| CRB1 AND BTN3A1 | Glioblastoma | 0.689655 | 0.833333 | 0.588235 | NCAM1 AND EDNRB | Glioma | 0.716418 | 0.738462 | 0.695652 |
| CDH10 AND TNFRSF12A | Glioblastoma | 0.689655 | 0.833333 | 0.588235 | ITGAV AND ERBB4 | Glioma | 0.817518 | 0.823529 | 0.811594 |
| LYPD1 AND STAB1 | Glioblastoma | 0.689655 | 0.833333 | 0.588235 | NCAM1 AND CD276 | Glioma | 0.71345 | 0.598039 | 0.884058 |
| SLC1A2 AND BST2 | Glioblastoma | 0.689655 | 0.833333 | 0.588235 | ITGAV AND EDNRB | Glioma | 0.8 | 0.941176 | 0.695652 |
| OMG AND F2R | Glioblastoma | 0.6875 | 0.733333 | 0.647059 | NCAM1 AND PROM1 | Glioma | 0.717557 | 0.758065 | 0.681159 |
| SLCO1C1 AND STAB1 | Glioblastoma | 0.6875 | 0.733333 | 0.647059 | NCAM1 AND CLDN12 | Glioma | 0.702703 | 0.928571 | 0.565217 |
| ASTN1 AND ANTXR2 | Glioblastoma | 0.6875 | 0.733333 | 0.647059 | ITGAV AND CD19 | Glioma | 0.834532 | 0.828571 | 0.84058 |
| LYPD1 AND BTN3A3 | Glioblastoma | 0.689655 | 0.833333 | 0.588235 | ITGAV AND GUCY2C | Glioma | 0.884058 | 0.884058 | 0.884058 |
| GPR158 AND CD93 | Glioblastoma | 0.684211 | 0.619048 | 0.764706 | ITGAV AND CLDN12 | Glioma | 0.809917 | 0.942308 | 0.710145 |
| LYPD1 AND SLCO1C1 | Glioblastoma | 0.682927 | 0.583333 | 0.823529 | ITGAV AND CR2 | Glioma | 0.884058 | 0.884058 | 0.884058 |
| LYPD1 AND CDH10 | Glioblastoma | 0.682927 | 0.583333 | 0.823529 | ITGAV AND MSLN | Glioma | 0.916667 | 0.88 | 0.956522 |
| SLCO1C1 AND SLC39A8 | Glioblastoma | 0.733333 | 0.846154 | 0.647059 | ITGAV AND SSTR4 | Glioma | 0.884058 | 0.884058 | 0.884058 |
| SLCO1C1 AND CD163 | Glioblastoma | 0.774194 | 0.857143 | 0.705882 | ITGAV AND L1CAM | Glioma | 0.907801 | 0.888889 | 0.927536 |
| CDH10 AND VAMP8 | Glioblastoma | 0.714286 | 0.6 | 0.882353 | ITGAV AND FCRL5 | Glioma | 0.833333 | 0.873016 | 0.797101 |
| ASTN1 AND CD93 | Glioblastoma | 0.666667 | 0.6875 | 0.647059 | ITGAV AND FCRL1 | Glioma | 0.9 | 0.887324 | 0.913043 |
| CRB1 AND BST2 | Glioblastoma | 0.666667 | 0.6875 | 0.647059 | CD37 AND SLC7A5 | AML | 0.818505 | 0.73955 | 0.916335 |
| SLCO1C1 AND VAMP8 | Glioblastoma | 0.666667 | 0.535714 | 0.882353 | CD38 AND SLC7A5 | AML | 0.776291 | 0.746324 | 0.808765 |
| GABBR2 AND LAPTM5 | Glioblastoma | 0.666667 | 0.590909 | 0.764706 | CD37 AND MUC1 | AML | 0.725173 | 0.862637 | 0.625498 |
| SLC1A2 AND LAPTM5 | Glioblastoma | 0.666667 | 0.769231 | 0.588235 | P2RX5 AND SLC7A5 | AML | 0.683465 | 0.565104 | 0.864542 |
| CRB1 AND SLC31A1 | Glioblastoma | 0.666667 | 0.9 | 0.529412 | CD38 AND CD70 | AML | 0.666667 | 0.664032 | 0.669323 |
| CRB1 AND CXCL16 | Glioblastoma | 0.666667 | 0.769231 | 0.588235 | P2RX5 AND CD70 | AML | 0.649266 | 0.549724 | 0.792829 |
| CDH10 AND CDH11 | Glioblastoma | 0.848485 | 0.875 | 0.823529 | SLC7A5 AND CD70 | AML | 0.648464 | 0.567164 | 0.756972 |
| MLC1 AND SLC31A1 | Glioblastoma | 0.666667 | 0.631579 | 0.705882 | SLC7A5 AND CD52 | AML | 0.755556 | 0.627968 | 0.948207 |
| SLCO1C1 AND TGFBI | Glioblastoma | 0.666667 | 0.590909 | 0.764706 | CD38 AND PROM1 | AML | 0.64466 | 0.628788 | 0.661355 |
| CRB1 AND F2R | Glioblastoma | 0.666667 | 0.9 | 0.529412 | CD276 AND EPHB2 | Liposarcoma | 0.779221 | 0.731707 | 0.833333 |
| LYPD1 AND TTYH2 | Glioblastoma | 0.666667 | 0.590909 | 0.764706 | EPHB2 AND GPNMB | Liposarcoma | 0.716049 | 0.644444 | 0.805556 |
| MLC1 AND F2R | Glioblastoma | 0.666667 | 0.631579 | 0.705882 | CD276 AND FOLH1 | Liposarcoma | 0.712329 | 0.702703 | 0.722222 |
| LYPD1 AND KCNA2 | Glioblastoma | 0.666667 | 0.590909 | 0.764706 | EPHB2 AND ENG | Liposarcoma | 0.704545 | 0.596154 | 0.861111 |
| SLC1A2 AND CD163 | Glioblastoma | 0.666667 | 0.769231 | 0.588235 | EPHB2 AND PTK7 | Liposarcoma | 0.736842 | 0.7 | 0.777778 |
| CRB1 AND CDH11 | Glioblastoma | 0.666667 | 0.6875 | 0.647059 | CD276 AND B4GALNT1 | Liposarcoma | 0.622951 | 0.76 | 0.527778 |
| LYPD1 AND DSCAM | Glioblastoma | 0.666667 | 0.56 | 0.823529 | EPHB2 AND FOLH1 | Liposarcoma | 0.638298 | 0.517241 | 0.833333 |
| SYT11 AND F2R | Glioma | 0.992701 | 1 | 0.985507 | CD276 AND MS4A1 | Liposarcoma | 0.652174 | 0.535714 | 0.833333 |
| GPR158 AND F2R | Glioma | 0.977778 | 1 | 0.956522 | SLC34A2 AND SLC7A5 | Lung Adenocarcinoma | 0.666667 | 0.636364 | 0.7 |
| SYT11 AND BTN3A3 | Glioma | 0.933333 | 0.954545 | 0.913043 | SLC34A2 AND FCRL5 | Lung Adenocarcinoma | 0.639344 | 0.75 | 0.557143 |
| SYT11 AND HLA-DRB1 | Glioma | 0.934307 | 0.941176 | 0.927536 | EPCAM AND SLC7A5 | Lung Adenocarcinoma | 0.632479 | 0.787234 | 0.528571 |
| SYT11 AND LAPTM5 | Glioma | 0.971429 | 0.957746 | 0.985507 | FAP AND EPCAM | Lung Adenocarcinoma | 0.625 | 0.833333 | 0.5 |
| SYT11 AND VAMP8 | Glioma | 0.948905 | 0.955882 | 0.942029 | FAP AND CEACAM6 | Lung Adenocarcinoma | 0.634615 | 0.970588 | 0.471429 |
| SYT11 AND STAB1 | Glioma | 0.964539 | 0.944444 | 0.985507 | SLC34A2 AND FOLR2 | Lung Adenocarcinoma | 0.621118 | 0.549451 | 0.714286 |
| SYT11 AND CD74 | Glioma | 0.957143 | 0.943662 | 0.971014 | SLC34A2 AND BIRC5 | Lung Adenocarcinoma | 0.616667 | 0.74 | 0.528571 |
| OMG AND F2R | Glioma | 0.9 | 0.887324 | 0.913043 | FAP AND CLDN7 | Lung Adenocarcinoma | 0.614035 | 0.795455 | 0.5 |
| SYT11 AND CLDN15 | Glioma | 0.978417 | 0.971429 | 0.985507 | SLC34A2 AND VCAM1 | Lung Adenocarcinoma | 0.606061 | 0.526316 | 0.714286 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SYT11 AND GPR50 | Glioma | 0.956522 | 0.956522 | 0.956522 | SLC34A2 AND SDC1 | Lung Adenocarcinoma | 0.603448 | 0.76087 | 0.5 |
| SYT11 AND BTN3A1 | Glioma | 0.933333 | 0.954545 | 0.913043 | SLC34A2 AND FAP | Lung Adenocarcinoma | 0.6 | 0.72 | 0.514286 |
| SYT11 AND CD163 | Glioma | 0.924242 | 0.968254 | 0.884058 | CEACAM6 AND SLC7A5 | Lung Adenocarcinoma | 0.603774 | 0.888889 | 0.457143 |
| SYT11 AND TGFBI | Glioma | 0.94964 | 0.942857 | 0.956522 | SLC34A2 AND HLA-DOB | Lung Adenocarcinoma | 0.632258 | 0.576471 | 0.7 |
| SYT11 AND ADAM7 | Glioma | 0.957143 | 0.943662 | 0.971014 | EPCAM AND PTK7 | Lung Adenocarcinoma | 0.605505 | 0.846154 | 0.471429 |
| SYT11 AND FSHR | Glioma | 0.94964 | 0.942857 | 0.956522 | MAGEA11 AND ULBP2 | Lung Carcinoma | 0.606061 | 0.857143 | 0.46875 |
| SYT11 AND CD36 | Glioma | 0.942029 | 0.942029 | 0.942029 | CXCR5 AND GPNMB | B-Cell Diffuse | 0.776119 | 0.866667 | 0.702703 |
| SYT11 AND ATP6V0A4 | Glioma | 0.948905 | 0.955882 | 0.942029 | CD180 AND GPNMB | B-Cell Diffuse | 0.746269 | 0.833333 | 0.675676 |
| SYT11 AND CD93 | Glioma | 0.957143 | 0.943662 | 0.971014 | CD79B AND GPNMB | B-Cell Diffuse | 0.738462 | 0.857143 | 0.648649 |
| SYT11 AND SV2C | Glioma | 0.94964 | 0.942857 | 0.956522 | CD79A AND GPNMB | B-Cell Diffuse | 0.733333 | 0.956522 | 0.594595 |
| SYT11 AND MIP | Glioma | 0.964029 | 0.957143 | 0.971014 | CD79B AND IL2RA | B-Cell Diffuse | 0.714286 | 0.757576 | 0.675676 |
| SYT11 AND SLC22A13 | Glioma | 0.971429 | 0.957746 | 0.985507 | CD72 AND GPNMB | B-Cell Diffuse | 0.711864 | 0.954545 | 0.567568 |
| SYT11 AND ICAM1 | Glioma | 0.934307 | 0.941176 | 0.927536 | P2RX5 AND GPNMB | B-Cell Diffuse | 0.711864 | 0.954545 | 0.567568 |
| SYT11 AND GYPC | Glioma | 0.964539 | 0.944444 | 0.985507 | CD79B AND VCAM1 | B-Cell Diffuse | 0.707692 | 0.821429 | 0.621622 |
| SYT11 AND FGF6 | Glioma | 0.971429 | 0.957746 | 0.985507 | FCRL2 AND GPNMB | B-Cell Diffuse | 0.689655 | 0.952381 | 0.540541 |
| SYT11 AND GABRG3 | Glioma | 0.971429 | 0.957746 | 0.985507 | P2RX5 AND VCAM1 | B-Cell Diffuse | 0.676056 | 0.705882 | 0.648649 |
| SYT11 AND BEST2 | Glioma | 0.971429 | 0.957746 | 0.985507 | CD72 AND VCAM1 | B-Cell Diffuse | 0.666667 | 0.71875 | 0.621622 |
| SYT11 AND SLC12A9 | Glioma | 0.971429 | 0.957746 | 0.985507 | CD79B AND TPBG | B-Cell Diffuse | 0.685714 | 0.727273 | 0.648649 |
| SYT11 AND OR2L2 | Glioma | 0.964029 | 0.957143 | 0.971014 | CD180 AND VCAM1 | B-Cell Diffuse | 0.658537 | 0.6 | 0.72973 |
| SYT11 AND TSHR | Glioma | 0.957143 | 0.943662 | 0.971014 | FCRL5 AND VCAM1 | B-Cell Diffuse | 0.738462 | 0.857143 | 0.648649 |
| SYT11 AND ADAM20 | Glioma | 0.94964 | 0.942857 | 0.956522 | CD79B AND CD276 | B-Cell Diffuse | 0.6875 | 0.814815 | 0.594595 |
| SYT11 AND P2RX4 | Glioma | 0.970588 | 0.985075 | 0.956522 | FCRL5 AND GPNMB | B-Cell Diffuse | 0.745763 | 1 | 0.594595 |
| SYT11 AND OR4N4 | Glioma | 0.957143 | 0.943662 | 0.971014 | CXCR5 AND VCAM1 | B-Cell Diffuse | 0.642857 | 0.574468 | 0.72973 |
| SYT11 AND LRRN4 | Glioma | 0.971429 | 0.957746 | 0.985507 | CR2 AND GPNMB | B-Cell Diffuse | 0.642857 | 0.947368 | 0.486486 |
| SYT11 AND SELP | Glioma | 0.957143 | 0.943662 | 0.971014 | CD79A AND VCAM1 | B-Cell Diffuse | 0.64 | 0.631579 | 0.648649 |
| SYT11 AND ZP4 | Glioma | 0.964539 | 0.944444 | 0.985507 | CD72 AND EDNRB | B-Cell Diffuse | 0.637681 | 0.6875 | 0.594595 |
| SYT11 AND GHSR | Glioma | 0.957143 | 0.943662 | 0.971014 | CD37 AND GPNMB | B-Cell Diffuse | 0.705882 | 0.774194 | 0.648649 |
| SYT11 AND KCNA10 | Glioma | 0.964029 | 0.957143 | 0.971014 | IL2RA AND GPNMB | B-Cell Diffuse | 0.632911 | 0.595238 | 0.675676 |
| SYT11 AND SLC22A12 | Glioma | 0.948905 | 0.955882 | 0.942029 | FCRL1 AND GPNMB | B-Cell Diffuse | 0.631579 | 0.9 | 0.486486 |
| SYT11 AND GJA3 | Glioma | 0.964539 | 0.944444 | 0.985507 | CD72 AND TPBG | B-Cell Diffuse | 0.630137 | 0.638889 | 0.621622 |
| SYT11 AND MLANA | Glioma | 0.942029 | 0.942029 | 0.942029 | CD79A AND EDNRB | B-Cell Diffuse | 0.628571 | 0.666667 | 0.594595 |
| GPR19 AND F2R | Glioma | 0.921875 | 1 | 0.855072 | CD79B AND EDNRB | B-Cell Diffuse | 0.623377 | 0.6 | 0.648649 |
| SYT11 AND CCR9 | Glioma | 0.957143 | 0.943662 | 0.971014 | CD180 AND EDNRB | B-Cell Diffuse | 0.613333 | 0.605263 | 0.621622 |
| SYT11 AND TRPC7 | Glioma | 0.94964 | 0.942857 | 0.956522 | P2RX5 AND EDNRB | B-Cell Diffuse | 0.608696 | 0.65625 | 0.567568 |
| SYT11 AND PROCR | Glioma | 0.956522 | 0.956522 | 0.956522 | FCRL5 AND IL2RA | B-Cell Diffuse | 0.698413 | 0.846154 | 0.594595 |
| SYT11 AND ESAM | Glioma | 0.964029 | 0.957143 | 0.971014 | CD72 AND IL2RA | B-Cell Diffuse | 0.605263 | 0.589744 | 0.621622 |
| SYT11 AND ROS1 | Glioma | 0.964029 | 0.957143 | 0.971014 | FCRL5 AND TPBG | B-Cell Diffuse | 0.676923 | 0.785714 | 0.594595 |
| SYT11 AND KCNU1 | Glioma | 0.964539 | 0.944444 | 0.985507 | P2RX5 AND IL2RA | B-Cell Diffuse | 0.60274 | 0.611111 | 0.594595 |
| SYT11 AND CATSPERD | Glioma | 0.957143 | 0.943662 | 0.971014 | FCRL5 AND CD34 | B-Cell Diffuse | 0.644068 | 0.863636 | 0.513514 |
| SYT11 AND TNFRSF10B | Glioma | 0.956522 | 0.956522 | 0.956522 | CD37 AND VCAM1 | B-Cell Diffuse | 0.611765 | 0.541667 | 0.702703 |
| SYT11 AND MRGPRX2 | Glioma | 0.942029 | 0.942029 | 0.942029 | CD79A AND SLC7A5 | B-Cell Diffuse | 0.666667 | 0.807692 | 0.567568 |
| SYT11 AND GALR1 | Glioma | 0.934307 | 0.941176 | 0.927536 | CD79A AND IL2RA | B-Cell Diffuse | 0.625 | 0.740741 | 0.540541 |
| SYT11 AND CHRNA9 | Glioma | 0.942029 | 0.942029 | 0.942029 | CD79B AND KDR | B-Cell Diffuse | 0.6875 | 0.814815 | 0.594595 |
| SYT11 AND CDH11 | Glioma | 0.924242 | 0.968254 | 0.884058 | P2RX5 AND SLC7A5 | B-Cell Diffuse | 0.612903 | 0.76 | 0.513514 |
| SYT11 AND STEAP4 | Glioma | 0.957143 | 0.943662 | 0.971014 | IL2RA AND SLC7A5 | Anaplastic Lymphoma | 0.642857 | 0.692308 | 0.6 |
| SLC22A16 AND EMP3 | AML | 0.909449 | 0.898833 | 0.920319 | IL2RA AND VCAM1 | Anaplastic Lymphoma | 0.62069 | 0.642857 | 0.6 |
| SLC22A16 AND CD44 | AML | 0.929006 | 0.946281 | 0.912351 | IL2RA AND TPBG | Anaplastic Lymphoma | 0.692308 | 0.818182 | 0.6 |
| SLC22A16 AND FMNL1 | AML | 0.895706 | 0.920168 | 0.87251 | IL2RA AND CLDN5 | Anaplastic Lymphoma | 0.692308 | 0.818182 | 0.6 |
| SLC22A16 AND SLC39A8 | AML | 0.882227 | 0.953704 | 0.820717 | CD79B AND GUCY2C | Mantle-Cell Lymphoma | 0.835821 | 0.965517 | 0.736842 |
| SLC22A16 AND MLC1 | AML | 0.865424 | 0.900862 | 0.832669 | P2RX5 AND GUCY2C | Mantle-Cell Lymphoma | 0.828571 | 0.90625 | 0.763158 |
| SLC22A16 AND SLC43A1 | AML | 0.834061 | 0.922705 | 0.760956 | P2RX5 AND FOLR1 | Mantle-Cell Lymphoma | 0.857143 | 0.846154 | 0.868421 |
| SLC22A16 AND SEMA4D | AML | 0.828452 | 0.872247 | 0.788845 | CD79B AND CD34 | Mantle-Cell Lymphoma | 0.823529 | 0.933333 | 0.736842 |
| SLC22A16 AND TTYH2 | AML | 0.811839 | 0.864865 | 0.76449 | P2RX5 AND CA9 | Mantle-Cell Lymphoma | 0.80597 | 0.931034 | 0.710526 |
| SLC22A16 AND STAB1 | AML | 0.778523 | 0.887755 | 0.693227 | P2RX5 AND FOLH1 | Mantle-Cell Lymphoma | 0.8 | 0.875 | 0.736842 |
| TTYH3 AND PTGIS | Liposarcoma | 0.636364 | 0.7 | 0.583333 | MS4A1 AND PMEL | Mantle-Cell Lymphoma | 0.791667 | 0.655172 | 1 |
| TTYH3 AND SLC6A7 | Liposarcoma | 0.626866 | 0.677419 | 0.583333 | P2RX5 AND CD70 | Mantle-Cell Lymphoma | 0.914286 | 1 | 0.842105 |
| TTYH3 AND ATP8B2 | Liposarcoma | 0.621622 | 0.605263 | 0.638889 | MS4A1 AND ERBB3 | Mantle-Cell Lymphoma | 0.783505 | 0.644068 | 1 |
| CD163 AND SLC6A7 | Liposarcoma | 0.658228 | 0.604651 | 0.722222 | P2RX5 AND ROR1 | Mantle-Cell Lymphoma | 0.782609 | 0.870968 | 0.710526 |
| TTYH3 AND PHLDB2 | Liposarcoma | 0.605263 | 0.575 | 0.638889 | MS4A1 AND CD70 | Mantle-Cell Lymphoma | 0.898551 | 1 | 0.815789 |
| TTYH3 AND CDH11 | Liposarcoma | 0.605263 | 0.575 | 0.638889 | CD79B AND FAP | Mantle-Cell Lymphoma | 0.78125 | 0.961538 | 0.657895 |
| TTYH3 AND TNFRSF12A | Liposarcoma | 0.630137 | 0.621622 | 0.638889 | MS4A1 AND ROR1 | Mantle-Cell Lymphoma | 0.779221 | 0.769231 | 0.789474 |
| STAB1 AND SLC6A7 | Liposarcoma | 0.666667 | 0.641026 | 0.694444 | MS4A1 AND ERBB2 | Mantle-Cell Lymphoma | 0.778947 | 0.649123 | 0.973684 |
| STAB1 AND EMP3 | Liposarcoma | 0.648649 | 0.631579 | 0.666667 | MS4A1 AND CD52 | Mantle-Cell Lymphoma | 0.778947 | 0.649123 | 0.973684 |
| STAB1 AND TGFBI | Liposarcoma | 0.648649 | 0.631579 | 0.666667 | P2RX5 AND CSPG4 | Mantle-Cell Lymphoma | 0.776119 | 0.896552 | 0.684211 |
| STAB1 AND IFNAR2 | Liposarcoma | 0.6 | 0.545455 | 0.666667 | MS4A1 AND TNFRSF10A | Mantle-Cell Lymphoma | 0.77551 | 0.633333 | 1 |
| STAB1 AND LRIG3 | Liposarcoma | 0.657895 | 0.625 | 0.694444 | P2RX5 AND ERBB3 | Mantle-Cell Lymphoma | 0.774194 | 0.654545 | 0.947368 |
| EMP3 AND VANGL1 | Liposarcoma | 0.666667 | 0.568627 | 0.805556 | MS4A1 AND LGR5 | Mantle-Cell Lymphoma | 0.774194 | 0.654545 | 0.947368 |
| STAB1 AND FAT1 | Liposarcoma | 0.724638 | 0.757576 | 0.694444 | MS4A1 AND ERBB4 | Mantle-Cell Lymphoma | 0.774194 | 0.654545 | 0.947368 |
| STAB1 AND CD93 | Liposarcoma | 0.675676 | 0.657895 | 0.694444 | P2RX5 AND SLC34A2 | Mantle-Cell Lymphoma | 0.769231 | 0.925926 | 0.657895 |
| CD163 AND VANGL1 | Liposarcoma | 0.717949 | 0.666667 | 0.777778 | MS4A1 AND MUC16 | Mantle-Cell Lymphoma | 0.767677 | 0.622951 | 1 |
| CD163 AND FAT1 | Liposarcoma | 0.701299 | 0.658537 | 0.75 | CD79B AND MUC16 | Mantle-Cell Lymphoma | 0.767123 | 0.8 | 0.736842 |
| STAB1 AND GPR137B | Liposarcoma | 0.621622 | 0.605263 | 0.638889 | MS4A1 AND CLDN2 | Mantle-Cell Lymphoma | 0.765957 | 0.642857 | 0.947368 |
| STAB1 AND GPR158 | Liposarcoma | 0.623377 | 0.585366 | 0.666667 | CD72 AND CD70 | Mantle-Cell Lymphoma | 0.818182 | 0.964286 | 0.710526 |
| STAB1 AND ABHD3 | Liposarcoma | 0.617284 | 0.555556 | 0.694444 | MS4A1 AND TNFRSF13C | Mantle-Cell Lymphoma | 0.894118 | 0.808511 | 1 |
| STAB1 AND CDH20 | Liposarcoma | 0.625 | 0.568182 | 0.694444 | CD79B AND CLDN2 | Mantle-Cell Lymphoma | 0.760563 | 0.818182 | 0.710526 |
| KCNJ10 AND HLA-DRB1 | B-Cell Diffuse | 0.75 | 0.771429 | 0.72973 | MS4A1 AND SDC1 | Mantle-Cell Lymphoma | 0.76 | 0.612903 | 1 |
| KCNJ10 AND LAPTM5 | B-Cell Diffuse | 0.724638 | 0.78125 | 0.675676 | CD70 AND CD52 | Mantle-Cell Lymphoma | 0.882353 | 1 | 0.789474 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| KCNJ10 AND VAMP8 | B-Cell Diffuse | 0.622951 | 0.791667 | 0.513514 | MS4A1 AND SLC7A5 | Mantle-Cell Lymphoma | 0.756098 | 0.704545 | 0.815789 |
| GPR19 AND IL15RA | Anaplastic Lymphoma | 0.606061 | 0.555556 | 0.666667 | EDNRB AND IL11RA | Melanoma | 0.9 | 1 | 0.818182 |
| GPR137B AND SLC6A15 | Melanoma | 0.9 | 1 | 0.818182 | EDNRB AND CSPG4 | Melanoma | 0.9 | 1 | 0.818182 |
| GPR19 AND TGFBI | Melanoma | 0.9 | 1 | 0.818182 | EDNRB AND VCAM1 | Melanoma | 0.9 | 1 | 0.818182 |
| GPR137B AND GPR19 | Melanoma | 1 | 1 | 1 | EDNRB AND GPNMB | Melanoma | 0.9 | 1 | 0.818182 |
| GPR137B AND GPR158 | Melanoma | 0.842105 | 1 | 0.727273 | EDNRB AND L1CAM | Melanoma | 0.9 | 1 | 0.818182 |
| FAT1 AND GPR19 | Melanoma | 0.842105 | 1 | 0.727273 | EDNRB AND AXL | Melanoma | 0.842105 | 1 | 0.727273 |
| PAQR7 AND GPR19 | Melanoma | 0.9 | 1 | 0.818182 | EDNRB AND TRPM4 | Melanoma | 0.842105 | 1 | 0.727273 |
| SLC22A5 AND GPR19 | Melanoma | 0.842105 | 1 | 0.727273 | EDNRB AND STEAP1 | Melanoma | 0.842105 | 1 | 0.727273 |
| GPR19 AND SLC50A1 | Melanoma | 0.9 | 1 | 0.818182 | EDNRB AND CD34 | Melanoma | 0.842105 | 1 | 0.727273 |
| GPR137B AND IFI6 | Melanoma | 0.818182 | 0.818182 | 0.818182 | EDNRB AND SLC7A5 | Melanoma | 0.842105 | 1 | 0.727273 |
| GPR19 AND ATP7A | Melanoma | 0.857143 | 0.9 | 0.818182 | EDNRB AND CLDN12 | Melanoma | 0.842105 | 1 | 0.727273 |
| GPR19 AND THBD | Melanoma | 0.9 | 1 | 0.818182 | EDNRB AND FAP | Melanoma | 0.842105 | 1 | 0.727273 |
| GPR137B AND TTYH2 | Melanoma | 0.785714 | 0.647059 | 1 | EDNRB AND IGF1R | Melanoma | 0.842105 | 1 | 0.727273 |
| GPR137B AND GPR85 | Melanoma | 0.857143 | 0.9 | 0.818182 | EDNRB AND ERBB2 | Melanoma | 0.842105 | 1 | 0.727273 |
| FAT1 AND IFI6 | Melanoma | 0.777778 | 1 | 0.636364 | EDNRB AND CD70 | Melanoma | 0.842105 | 1 | 0.727273 |
| GPR137B AND SLC23A2 | Melanoma | 0.777778 | 1 | 0.636364 | EDNRB AND CLDN23 | Melanoma | 0.777778 | 1 | 0.636364 |
| GPR19 AND ATP7A | Neuroblastoma | 0.895349 | 0.875 | 0.916667 | CLDN12 AND GPNMB | Melanoma | 0.777778 | 1 | 0.636364 |
| CACNA1B AND ATP7A | Neuroblastoma | 0.882353 | 0.872093 | 0.892857 | ALK AND GPNMB | Neuroblastoma | 0.825806 | 0.901408 | 0.761905 |
| TRPM8 AND SLCO1A2 | Prostate | 0.727273 | 0.571429 | 1 | ALK AND FOLR1 | Neuroblastoma | 0.8125 | 0.855263 | 0.77381 |
| UPK3A AND ATP8B1 | Prostate | 0.666667 | 0.6 | 0.75 | L1CAM AND CDH3 | Neuroblastoma | 0.8 | 1 | 0.666667 |
| GGTLC1 AND CDH10 | Prostate | 0.8 | 0.666667 | 1 | ALK AND GPC3 | Neuroblastoma | 0.797468 | 0.851351 | 0.75 |
| ADAM2 AND GHR | Prostate | 0.666667 | 1 | 0.5 | ALK AND CD52 | Neuroblastoma | 0.794872 | 0.861111 | 0.738095 |
| UPK3A AND SLC43A1 | Prostate | 0.857143 | 1 | 0.75 | ALK AND ERBB3 | Neuroblastoma | 0.792453 | 0.84 | 0.75 |
| UPK3A AND ADAM2 | Prostate | 0.666667 | 1 | 0.5 | L1CAM AND GPNMB | Neuroblastoma | 0.790698 | 0.772727 | 0.809524 |
| UPK3A AND CNTNAP2 | Prostate | 0.666667 | 0.6 | 0.75 | ALK AND OAS1 | Neuroblastoma | 0.782051 | 0.847222 | 0.72619 |
| UPK3A AND SLC2A2 | Prostate | 0.666667 | 0.6 | 0.75 | ALK AND CD34 | Neuroblastoma | 0.781457 | 0.880597 | 0.702381 |
| UPK3A AND GRIA4 | Prostate | 0.666667 | 0.6 | 0.75 | ALK AND MST1R | Neuroblastoma | 0.77707 | 0.835616 | 0.72619 |
| UPK3A AND SELP | Prostate | 0.666667 | 0.6 | 0.75 | L1CAM AND CD276 | Neuroblastoma | 0.814815 | 0.846154 | 0.785714 |
| UPK3A AND STEAP4 | Prostate | 0.666667 | 1 | 0.5 | ALK AND CLDN3 | Neuroblastoma | 0.771242 | 0.855072 | 0.702381 |
| UPK3A AND GABRG3 | Prostate | 0.666667 | 0.6 | 0.75 | ALK AND MSLN | Neuroblastoma | 0.763158 | 0.852941 | 0.690476 |
| ADAM2 AND ATP8B1 | Prostate | 0.857143 | 1 | 0.75 | ALK AND ALDH1A1 | Neuroblastoma | 0.76129 | 0.830986 | 0.702381 |
| UPK3A AND GPR158 | Prostate | 0.666667 | 0.6 | 0.75 | ALK AND MUC4 | Neuroblastoma | 0.76129 | 0.830986 | 0.702381 |
| STAB1 AND SLC6A7 | Sarcoma | 0.689655 | 0.833333 | 0.588235 | ALK AND CD72 | Neuroblastoma | 0.754967 | 0.850746 | 0.678571 |
| STAB1 AND EMP3 | Sarcoma | 0.727273 | 0.75 | 0.705882 | ALK AND FOLH1 | Neuroblastoma | 0.753247 | 0.828571 | 0.690476 |
| STAB1 AND TGFBI | Sarcoma | 0.645161 | 0.714286 | 0.588235 | ALK AND FCRL2 | Neuroblastoma | 0.75 | 0.838235 | 0.678571 |
| CDH17 AND BST2 | Stomach | 0.829268 | 0.871795 | 0.790698 | ALK AND IL3RA | Neuroblastoma | 0.728477 | 0.820896 | 0.654762 |
| CDH17 AND SLC6A6 | Stomach | 0.816327 | 0.727273 | 0.930233 | ALK AND EDNRB | Neuroblastoma | 0.724832 | 0.830769 | 0.642857 |
| ATP8B1 AND CDH11 | Stomach | 0.871795 | 0.971429 | 0.790698 | ALK AND ULBP1 | Neuroblastoma | 0.721088 | 0.84127 | 0.630952 |
| ATP8B1 AND CD93 | Stomach | 0.871795 | 0.971429 | 0.790698 | ALK AND CXCR5 | Neuroblastoma | 0.72 | 0.818182 | 0.642857 |
| ATP8B1 AND F2R | Stomach | 0.91358 | 0.973684 | 0.860465 | ALK AND ABCB5 | Neuroblastoma | 0.72 | 0.818182 | 0.642857 |
| MUC17 AND ESAM | Stomach | 0.826667 | 0.96875 | 0.72093 | L1CAM AND BMPR1B | Neuroblastoma | 0.712329 | 0.83871 | 0.619048 |
| MUC17 AND IFI6 | Stomach | 0.753623 | 1 | 0.604651 | ALK AND TNFRSF17 | Neuroblastoma | 0.711409 | 0.815385 | 0.630952 |
| CDH17 AND IFI6 | Stomach | 0.621359 | 0.533333 | 0.744186 | NCAM1 AND EGFR | Oligodendroglioma | 0.666667 | 0.541667 | 0.866667 |
| MUC17 AND THBD | Stomach | 0.826667 | 0.96875 | 0.72093 | SLC7A5 AND MUC13 | Oligodendroglioma | 0.72 | 0.9 | 0.6 |
| ATP8B1 AND PLVAP | Stomach | 0.860465 | 0.860465 | 0.860465 | SLC7A5 AND MSLN | Oligodendroglioma | 0.692308 | 0.818182 | 0.6 |
| MUC17 AND CD163 | Stomach | 0.815789 | 0.939394 | 0.72093 | SLC7A5 AND CLDN9 | Oligodendroglioma | 0.689655 | 0.714286 | 0.666667 |
| CDH17 AND CDH11 | Stomach | 0.810127 | 0.888889 | 0.744186 | ABCB5 AND BMPR1B | Oligodendroglioma | 0.714286 | 0.769231 | 0.666667 |
| MUC17 AND SYT11 | Stomach | 0.842105 | 0.969697 | 0.744186 | ABCB5 AND SLC7A5 | Oligodendroglioma | 0.647059 | 0.578947 | 0.733333 |
| MUC17 AND EMP3 | Stomach | 0.815789 | 0.939394 | 0.72093 | SLC7A5 AND GPA33 | Oligodendroglioma | 0.6 | 0.6 | 0.6 |
| ATP8B1 AND TGFBI | Stomach | 0.839506 | 0.894737 | 0.790698 | NCAM1 AND EDNRB | Oligodendroglioma | 0.615385 | 0.727273 | 0.533333 |
| MUC17 AND F2R | Stomach | 0.853333 | 1 | 0.744186 | SSTR2 AND BMPR1B | Oligodendroglioma | 0.695652 | 1 | 0.533333 |
| MUC17 AND STEAP4 | Stomach | 0.842105 | 0.969697 | 0.744186 | SSTR3 AND SLC7A5 | Oligodendroglioma | 0.642857 | 0.692308 | 0.6 |
| MUC17 AND CD44 | Stomach | 0.842105 | 0.969697 | 0.744186 | SLC7A5 AND CLDN18 | Oligodendroglioma | 0.625 | 0.588235 | 0.666667 |
| MUC17 AND SLC1A5 | Stomach | 0.831169 | 0.941176 | 0.744186 | SLC7A5 AND ITGB3 | Oligodendroglioma | 0.606061 | 0.555556 | 0.666667 |
| MUC17 AND EPHA2 | Stomach | 0.831169 | 0.941176 | 0.744186 | CLDN11 AND GPA33 | Oligodendroglioma | 0.714286 | 0.769231 | 0.666667 |
| MUC17 AND SEMA4D | Stomach | 0.842105 | 0.969697 | 0.744186 | SSTR2 AND EDNRB | Oligodendroglioma | 0.615385 | 0.727273 | 0.533333 |
| MUC17 AND GYPC | Stomach | 0.815789 | 0.939394 | 0.72093 | ABCB5 AND SLC39A6 | Oligodendroglioma | 0.666667 | 0.611111 | 0.733333 |
| MUC17 AND BST2 | Stomach | 0.771429 | 1 | 0.627907 | MUC16 AND NCAM1 | Ovarian | 0.666667 | 0.777778 | 0.583333 |
| MUC17 AND PROCR | Stomach | 0.826667 | 0.96875 | 0.72093 | STEAP2 AND EPCAM | Prostate | 0.857143 | 1 | 0.75 |
| MUC17 AND PLVAP | Stomach | 0.831169 | 0.941176 | 0.744186 | STEAP1 AND EPCAM | Prostate | 0.857143 | 1 | 0.75 |
| MUC17 AND S1PR1 | Stomach | 0.826667 | 0.96875 | 0.72093 | STEAP2 AND CLDN8 | Prostate | 1 | 1 | 1 |
| MUC17 AND CLSTN3 | Stomach | 0.842105 | 0.969697 | 0.744186 | STEAP2 AND EPHA3 | Prostate | 0.8 | 0.666667 | 1 |
| MUC17 AND VANGL1 | Stomach | 0.831169 | 0.941176 | 0.744186 | STEAP2 AND MUC1 | Prostate | 1 | 1 | 1 |
| MUC17 AND PHLDB2 | Stomach | 0.826667 | 0.96875 | 0.72093 | STEAP2 AND VCAM1 | Prostate | 1 | 1 | 1 |
| MUC17 AND STAB1 | Stomach | 0.831169 | 0.941176 | 0.744186 | STEAP2 AND CBX3 | Prostate | 0.857143 | 1 | 0.75 |
| MUC17 AND NRG3 | Stomach | 0.842105 | 0.969697 | 0.744186 | STEAP1 AND P2RX5 | Prostate | 0.75 | 0.75 | 0.75 |
| MUC17 AND ATP8B2 | Stomach | 0.8 | 0.9375 | 0.697674 | STEAP2 AND IL13RA1 | Prostate | 0.888889 | 0.8 | 1 |
| ATP8B1 AND STAB1 | Stomach | 0.847059 | 0.857143 | 0.837209 | STEAP1 AND MUC1 | Prostate | 0.857143 | 1 | 0.75 |
| MUC17 AND TTYH2 | Stomach | 0.842105 | 0.969697 | 0.744186 | STEAP2 AND IL20RA | Prostate | 0.857143 | 1 | 0.75 |
| ATP8B1 AND ESAM | Stomach | 0.888889 | 0.947368 | 0.837209 | STEAP2 AND IL2RA | Prostate | 0.727273 | 0.571429 | 1 |
| ATP8B1 AND BST2 | Stomach | 0.837838 | 1 | 0.72093 | STEAP2 AND BIRC5 | Prostate | 0.727273 | 0.571429 | 1 |
| ATP8B1 AND MRGPRF | Stomach | 0.819277 | 0.85 | 0.790698 | STEAP2 AND ABCB5 | Prostate | 0.727273 | 0.571429 | 1 |
| NKAIN4 AND ITGAV | Astrocytoma | 0.746988 | 0.837838 | 0.673913 | STEAP2 AND STEAP1 | Prostate | 0.727273 | 0.571429 | 1 |
| BEST3 AND SLC39A6 | Astrocytoma | 0.708861 | 0.848485 | 0.608696 | STEAP2 AND HLA-DOB | Prostate | 0.727273 | 0.571429 | 1 |
| CRB1 AND SLC39A6 | Astrocytoma | 0.708333 | 0.68 | 0.73913 | STEAP2 AND FAP | Prostate | 0.727273 | 0.571429 | 1 |
| CRB1 AND EDNRB | Astrocytoma | 0.704762 | 0.627119 | 0.804348 | STEAP2 AND LGR5 | Prostate | 0.727273 | 0.571429 | 1 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NCAM1 AND BEST3 | Astrocytoma | 0.694737 | 0.673469 | 0.717391 | STEAP2 AND TNFRSF10A | Prostate | 0.727273 | 0.571429 | 1 |
| BEST3 AND EDNRB | Astrocytoma | 0.692308 | 0.84375 | 0.586957 | STEAP2 AND CLDN3 | Prostate | 0.727273 | 0.571429 | 1 |
| NCAM1 AND LAPTM5 | Astrocytoma | 0.690476 | 0.763158 | 0.630435 | STEAP2 AND CLDN2 | Prostate | 0.727273 | 0.571429 | 1 |
| SLCO1C1 AND EDNRB | Astrocytoma | 0.680412 | 0.647059 | 0.717391 | STEAP2 AND MS4A1 | Prostate | 0.727273 | 0.571429 | 1 |
| NCAM1 AND F2R | Astrocytoma | 0.680412 | 0.647059 | 0.717391 | STEAP2 AND MUC16 | Prostate | 0.727273 | 0.571429 | 1 |
| BEST3 AND BMPR1B | Astrocytoma | 0.666667 | 0.8125 | 0.565217 | STEAP2 AND CD33 | Prostate | 0.727273 | 0.571429 | 1 |
| CRB1 AND NCAM1 | Astrocytoma | 0.659091 | 0.690476 | 0.630435 | STEAP2 AND CLDN23 | Prostate | 0.727273 | 0.571429 | 1 |
| BEST3 AND MUC1 | Astrocytoma | 0.658824 | 0.717949 | 0.608696 | STEAP2 AND CD37 | Prostate | 0.727273 | 0.571429 | 1 |
| BEST3 AND FOLH1 | Astrocytoma | 0.651163 | 0.7 | 0.608696 | STEAP2 AND SST | Prostate | 0.727273 | 0.571429 | 1 |
| KCNJ10 AND CD276 | Astrocytoma | 0.650602 | 0.72973 | 0.586957 | STEAP2 AND MOK | Prostate | 0.727273 | 0.571429 | 1 |
| NKAIN4 AND AXL | Astrocytoma | 0.649351 | 0.806452 | 0.543478 | STEAP2 AND SSTR1 | Prostate | 0.727273 | 0.571429 | 1 |
| BEST3 AND VCAM1 | Astrocytoma | 0.649351 | 0.806452 | 0.543478 | STEAP2 AND P2RX5 | Prostate | 0.727273 | 0.571429 | 1 |
| NCAM1 AND SEMA4B | Astrocytoma | 0.647619 | 0.576271 | 0.73913 | STEAP2 AND WT1 | Prostate | 0.727273 | 0.571429 | 1 |
| BMPR1B AND F2R | Astrocytoma | 0.647619 | 0.576271 | 0.73913 | STEAP2 AND CD160 | Prostate | 0.727273 | 0.571429 | 1 |
| MLC1 AND CD276 | Astrocytoma | 0.641975 | 0.742857 | 0.565217 | STEAP1 AND EPHA3 | Prostate | 0.857143 | 1 | 0.75 |
| SLC1A2 AND EDNRB | Astrocytoma | 0.637931 | 0.528571 | 0.804348 | STEAP1 AND CD72 | Prostate | 0.75 | 0.75 | 0.75 |
| ASTN1 AND EDNRB | Astrocytoma | 0.635294 | 0.692308 | 0.586957 | STEAP2 AND TNFRSF13C | Prostate | 0.727273 | 0.571429 | 1 |
| FXYD6 AND EDNRB | Astrocytoma | 0.630631 | 0.538462 | 0.76087 | STEAP1 AND IGF1R | Prostate | 0.75 | 0.75 | 0.75 |
| CSPG5 AND EDNRB | Astrocytoma | 0.626506 | 0.702703 | 0.565217 | STEAP1 AND SLC39A6 | Prostate | 0.75 | 0.75 | 0.75 |
| BEST3 AND L1CAM | Astrocytoma | 0.626506 | 0.702703 | 0.565217 | STEAP1 AND CLDN4 | Prostate | 0.75 | 0.75 | 0.75 |
| GABBR2 AND SLC39A6 | Astrocytoma | 0.622642 | 0.55 | 0.717391 | STEAP1 AND ERBB2 | Prostate | 0.75 | 0.75 | 0.75 |
| BEST3 AND ERBB4 | Astrocytoma | 0.621622 | 0.821429 | 0.5 | STEAP1 AND IL20RA | Prostate | 0.857143 | 1 | 0.75 |
| CRB1 AND SLC7A5 | Astrocytoma | 0.62069 | 0.658537 | 0.586957 | STEAP1 AND BMPR1B | Prostate | 0.75 | 0.75 | 0.75 |
| SLCO1C1 AND SLC39A6 | Astrocytoma | 0.619048 | 0.684211 | 0.565217 | STEAP1 AND CLDN8 | Prostate | 0.857143 | 1 | 0.75 |
| BEST3 AND CD79A | Astrocytoma | 0.617284 | 0.714286 | 0.543478 | STEAP1 AND CLDN3 | Prostate | 0.75 | 0.75 | 0.75 |
| CRB1 AND SDC1 | Astrocytoma | 0.617021 | 0.604167 | 0.630435 | STEAP2 AND MSLN | Prostate | 0.727273 | 0.571429 | 1 |
| SYT6 AND SLC39A6 | Astrocytoma | 0.613636 | 0.642857 | 0.586957 | STEAP2 AND DNAJB8 | Prostate | 0.727273 | 0.571429 | 1 |
| CRB1 AND CLDN9 | Astrocytoma | 0.612245 | 0.576923 | 0.652174 | STEAP1 AND PTK7 | Prostate | 0.75 | 0.75 | 0.75 |
| CRB1 AND PTK7 | Astrocytoma | 0.609756 | 0.694444 | 0.543478 | STEAP1 AND SSTR1 | Prostate | 0.75 | 0.75 | 0.75 |
| CRB1 AND TNFRSF10A | Astrocytoma | 0.607843 | 0.553571 | 0.673913 | STEAP1 AND ENPP3 | Prostate | 0.666667 | 1 | 0.5 |
| SLC1A2 AND CD180 | Astrocytoma | 0.606742 | 0.627907 | 0.586957 | STEAP2 AND ENPP3 | Prostate | 0.666667 | 1 | 0.5 |
| SLC1A2 AND PTK7 | Astrocytoma | 0.606742 | 0.627907 | 0.586957 | STEAP1 AND PROM1 | Prostate | 0.666667 | 1 | 0.5 |
| KCNJ10 AND CD180 | Astrocytoma | 0.60241 | 0.675676 | 0.543478 | STEAP1 AND CLDN7 | Prostate | 0.75 | 0.75 | 0.75 |
| CRB1 AND IL3RA | Astrocytoma | 0.601942 | 0.54386 | 0.673913 | ABCA5 AND EPCAM | Prostate | 0.666667 | 1 | 0.5 |
| ADCY8 AND EDNRB | Astrocytoma | 0.613861 | 0.563636 | 0.673913 | STEAP1 AND ROR1 | Prostate | 0.666667 | 1 | 0.5 |
| FAP AND PPAPDC1A | Breast | 0.845361 | 0.953488 | 0.759259 | STEAP1 AND CLDN18 | Prostate | 0.666667 | 0.6 | 0.75 |
| FAP AND SORL1 | Breast | 0.75 | 0.970588 | 0.611111 | STEAP1 AND NCAM1 | Prostate | 0.666667 | 0.6 | 0.75 |
| PPAPDC1A AND CLDN4 | Breast | 0.73913 | 0.894737 | 0.62963 | STEAP1 AND CLDN11 | Prostate | 0.666667 | 0.6 | 0.75 |
| PPAPDC1A AND CLDN7 | Breast | 0.73913 | 0.894737 | 0.62963 | STEAP1 AND ULBP1 | Prostate | 0.666667 | 0.6 | 0.75 |
| PPAPDC1A AND SPON2 | Breast | 0.741573 | 0.942857 | 0.611111 | STEAP1 AND ULBP2 | Prostate | 0.666667 | 0.6 | 0.75 |
| PPAPDC1A AND MUC1 | Breast | 0.765957 | 0.9 | 0.666667 | STEAP1 AND PSCA | Prostate | 0.666667 | 0.6 | 0.75 |
| PPAPDC1A AND SDC1 | Breast | 0.744681 | 0.875 | 0.648148 | STEAP1 AND ULBP3 | Prostate | 0.666667 | 0.6 | 0.75 |
| FAP AND FLVCR1 | Breast | 0.875 | 1 | 0.777778 | STEAP1 AND SSTR2 | Prostate | 0.666667 | 0.6 | 0.75 |
| FAP AND TNFRSF12A | Breast | 0.795918 | 0.886364 | 0.722222 | STEAP1 AND SST | Prostate | 0.666667 | 0.6 | 0.75 |
| FAP AND PPAPDC1B | Breast | 0.829787 | 0.975 | 0.722222 | STEAP1 AND FCRL2 | Prostate | 0.666667 | 0.6 | 0.75 |
| FAP AND VANGL1 | Breast | 0.808511 | 0.95 | 0.703704 | STEAP1 AND CR2 | Prostate | 0.666667 | 0.6 | 0.75 |
| FAP AND BST2 | Breast | 0.83871 | 1 | 0.722222 | STEAP1 AND TNFRSF10A | Prostate | 0.666667 | 0.6 | 0.75 |
| FAP AND LRRC8E | Breast | 0.795699 | 0.948718 | 0.685185 | STEAP1 AND MST1R | Prostate | 0.666667 | 0.6 | 0.75 |
| PPAPDC1A AND GPNMB | Breast | 0.747253 | 0.918919 | 0.62963 | STEAP1 AND IL3RA | Prostate | 0.666667 | 0.6 | 0.75 |
| PPAPDC1A AND ITGB6 | Breast | 0.742268 | 0.837209 | 0.666667 | STEAP1 AND DLL3 | Prostate | 0.666667 | 0.6 | 0.75 |
| FAP AND SLCO1B1 | Breast | 0.762887 | 0.860465 | 0.685185 | FAP AND ULBP2 | Sarcoma | 0.740741 | 1 | 0.588235 |
| FAP AND CXCL16 | Breast | 0.857143 | 0.954545 | 0.777778 | FAP AND SLC7A5 | Sarcoma | 0.692308 | 1 | 0.529412 |
| FAP AND IFNAR2 | Breast | 0.741573 | 0.942857 | 0.611111 | FAP AND FOLH1 | Sarcoma | 0.740741 | 1 | 0.588235 |
| TPBG AND BST2 | Breast | 0.712644 | 0.939394 | 0.574074 | FAP AND CD276 | Sarcoma | 0.827586 | 1 | 0.705882 |
| FAP AND CACNG6 | Breast | 0.803922 | 0.854167 | 0.759259 | FAP AND IL13RA1 | Sarcoma | 0.692308 | 1 | 0.529412 |
| FAP AND SLC10A1 | Breast | 0.838095 | 0.862745 | 0.814815 | FAP AND EGFR | Sarcoma | 0.827586 | 1 | 0.705882 |
| FAP AND SEMA4D | Breast | 0.833333 | 0.952381 | 0.740741 | FAP AND TPBG | Sarcoma | 0.740741 | 1 | 0.588235 |
| FAP AND OXTR | Breast | 0.703297 | 0.864865 | 0.592593 | FAP AND ABCB5 | Sarcoma | 0.827586 | 1 | 0.705882 |
| FAP AND ADAM29 | Breast | 0.838095 | 0.862745 | 0.814815 | FAP AND ULBP1 | Sarcoma | 0.866667 | 1 | 0.764706 |
| FAP AND CALHM1 | Breast | 0.75 | 0.857143 | 0.666667 | FAP AND FCRL5 | Sarcoma | 0.827586 | 1 | 0.705882 |
| PPAPDC1A AND IL13RA1 | Breast | 0.731183 | 0.871795 | 0.62963 | MUC13 AND THY1 | Stomach | 0.939759 | 0.975 | 0.906977 |
| FAP AND GABRG2 | Breast | 0.717391 | 0.868421 | 0.611111 | EPCAM AND THY1 | Stomach | 0.816327 | 0.727273 | 0.930233 |
| PPAPDC1A AND AXL | Breast | 0.704545 | 0.911765 | 0.574074 | CEACAM5 AND THY1 | Stomach | 0.857143 | 0.970588 | 0.767442 |
| FAP AND KCND2 | Breast | 0.871287 | 0.93617 | 0.814815 | CLDN18 AND MUC13 | Stomach | 0.878049 | 0.923077 | 0.837209 |
| PPAPDC1A AND STEAP1 | Breast | 0.770833 | 0.880952 | 0.685185 | MUC13 AND SPON2 | Stomach | 0.963855 | 1 | 0.930233 |
| TPBG AND SLC38A1 | Breast | 0.698795 | 1 | 0.537037 | CLDN18 AND BIRC5 | Stomach | 0.777778 | 0.744681 | 0.813953 |
| FAP AND GUCY2D | Breast | 0.77551 | 0.863636 | 0.703704 | CLDN18 AND STEAP1 | Stomach | 0.897436 | 1 | 0.813953 |
| PPAPDC1A AND ANXA1 | Breast | 0.712871 | 0.765957 | 0.666667 | CLDN18 AND EPHB2 | Stomach | 0.857143 | 0.970588 | 0.767442 |
| TPBG AND ENPP1 | Breast | 0.696629 | 0.885714 | 0.574074 | CLDN18 AND THY1 | Stomach | 0.871795 | 0.971429 | 0.790698 |
| FAP AND LPPR3 | Breast | 0.715789 | 0.829268 | 0.62963 | MUC13 AND FAP | Stomach | 0.860465 | 0.860465 | 0.860465 |
| SLC2A2 AND CD34 | Liver | 0.8 | 1 | 0.666667 | CLDN18 AND EPCAM | Stomach | 0.888889 | 0.947368 | 0.837209 |
| SLCO1B1 AND CD34 | Liver | 0.8 | 1 | 0.666667 | CLDN18 AND MST1R | Stomach | 0.810127 | 0.888889 | 0.744186 |
| SLC43A1 AND ERBB3 | Liver | 0.909091 | 1 | 0.833333 | CLDN18 AND CEACAM5 | Stomach | 0.805556 | 1 | 0.674419 |
| SLCO1B1 AND EPHB2 | Liver | 1 | 1 | 1 | EPCAM AND SLC7A5 | Stomach | 0.917647 | 0.928571 | 0.906977 |
| SLC2A2 AND ABCB5 | Liver | 0.769231 | 0.714286 | 0.833333 | CLDN18 AND PROM1 | Stomach | 0.746988 | 0.775 | 0.72093 |
| SLC2A2 AND ERBB3 | Liver | 0.769231 | 0.714286 | 0.833333 | MUC13 AND SLC7A5 | Stomach | 0.938272 | 1 | 0.883721 |
| SLC2A2 AND IL3RA | Liver | 0.769231 | 0.714286 | 0.833333 | CLDN18 AND SST | Stomach | 0.764045 | 0.73913 | 0.790698 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLCO1B1 AND LGR5 | Liver | 0.769231 | 0.714286 | 0.833333 | CLDN18 AND GUCY2C | Stomach | 0.73913 | 0.693878 | 0.790698 |
| SLCO1B1 AND ERBB3 | Liver | 0.769231 | 0.714286 | 0.833333 | EPCAM AND FAP | Stomach | 0.817204 | 0.76 | 0.883721 |
| SLC2A2 AND LGR5 | Liver | 0.769231 | 0.714286 | 0.833333 | CLDN18 AND SPON2 | Stomach | 0.795455 | 0.777778 | 0.813953 |
| SLC2A2 AND ULBP1 | Liver | 0.769231 | 0.714286 | 0.833333 | CLDN18 AND PSCA | Stomach | 0.682927 | 0.717949 | 0.651163 |
| SLC13A5 AND ERBB3 | Liver | 0.769231 | 0.714286 | 0.833333 | CLDN18 AND ERBB3 | Stomach | 0.888889 | 0.947368 | 0.837209 |
| SLC17A2 AND EPHB2 | Liver | 0.909091 | 1 | 0.833333 | CLDN18 AND CBX3 | Stomach | 0.853333 | 1 | 0.744186 |
| SLC17A2 AND LGR5 | Liver | 0.769231 | 0.714286 | 0.833333 | CLDN18 AND SSTR4 | Stomach | 0.725275 | 0.6875 | 0.767442 |
| SLC2A2 AND SSTR5 | Liver | 0.8 | 1 | 0.666667 | CLDN18 AND MAGEA1 | Stomach | 0.808989 | 0.782609 | 0.837209 |
| SLCO1B1 AND ITGB6 | Liver | 0.75 | 0.6 | 1 | CLDN18 AND FCRL5 | Stomach | 0.8 | 0.765957 | 0.837209 |
| SLCO1B1 AND VTCN1 | Liver | 0.8 | 1 | 0.666667 | CLDN18 AND AFP | Stomach | 0.765957 | 0.705882 | 0.837209 |
| SLC2A2 AND EPHB2 | Liver | 1 | 1 | 1 | MUC13 AND CLDN1 | Stomach | 0.965517 | 0.954545 | 0.976744 |
| SLCO1B1 AND SSTR5 | Liver | 0.727273 | 0.8 | 0.666667 | CA9 AND EPCAM | Stomach | 0.712329 | 0.866667 | 0.604651 |
| SLC2A2 AND ULBP2 | Liver | 0.857143 | 0.75 | 1 | CEACAM5 AND SPON2 | Stomach | 0.839506 | 0.894737 | 0.790698 |
| SLC13A5 AND CD34 | Liver | 0.727273 | 0.8 | 0.666667 | CLDN18 AND GAGE1 | Stomach | 0.774194 | 0.72 | 0.837209 |
| SLC6A12 AND ERBB3 | Liver | 0.769231 | 0.714286 | 0.833333 | CLDN18 AND SSTR2 | Stomach | 0.765957 | 0.705882 | 0.837209 |
| SLC13A5 AND EPHB2 | Liver | 0.769231 | 0.714286 | 0.833333 | CLDN18 AND DLL3 | Stomach | 0.795455 | 0.777778 | 0.813953 |
| SLCO1B1 AND IL3RA | Liver | 0.714286 | 0.625 | 0.833333 | CEACAM5 AND FAP | Stomach | 0.837838 | 1 | 0.72093 |
| SLC2A2 AND VTCN1 | Liver | 0.8 | 1 | 0.666667 | CLDN18 AND ULBP1 | Stomach | 0.765957 | 0.705882 | 0.837209 |
| SLCO1B1 AND ULBP2 | Liver | 0.75 | 0.6 | 1 | CLDN18 AND TNFSF11 | Stomach | 0.786517 | 0.76087 | 0.813953 |
| SLCO1B1 AND SSTR3 | Liver | 0.714286 | 0.625 | 0.833333 | CLDN18 AND NCAM1 | Stomach | 0.75 | 0.733333 | 0.767442 |
| SLC17A2 AND VTCN1 | Liver | 0.8 | 1 | 0.666667 | MUC13 AND CD34 | Stomach | 0.845361 | 0.759259 | 0.953488 |
| SLC2A2 AND CD22 | Liver | 0.8 | 1 | 0.666667 | CLDN18 AND MAGEA11 | Stomach | 0.747253 | 0.708333 | 0.790698 |
| SLC17A2 AND SSTR5 | Liver | 0.727273 | 0.8 | 0.666667 | CLDN18 AND ABCB5 | Stomach | 0.765957 | 0.705882 | 0.837209 |
| SLC10A1 AND EPHB2 | Liver | 0.8 | 1 | 0.666667 | CLDN18 AND MUC16 | Stomach | 0.73913 | 0.693878 | 0.790698 |
| SLC2A2 AND L1CAM | Liver | 0.857143 | 0.75 | 1 | CLDN18 AND DNAJB8 | Stomach | 0.808989 | 0.782609 | 0.837209 |
| SLCO1B1 AND CLDN9 | Liver | 0.8 | 0.666667 | 1 | CLDN18 AND MUC4 | Stomach | 0.774194 | 0.72 | 0.837209 |
| SLCO1B1 AND GPA33 | Liver | 0.75 | 0.6 | 1 | CLDN18 AND SSX1 | Stomach | 0.75 | 0.733333 | 0.767442 |
| SLCO1B1 AND GUCY2C | Liver | 0.75 | 0.6 | 1 | CLDN18 AND CA9 | Stomach | 0.674699 | 0.7 | 0.651163 |
| SLC2A2 AND CLDN9 | Liver | 0.8 | 1 | 0.666667 | CLDN18 AND SSTR5 | Stomach | 0.808989 | 0.782609 | 0.837209 |
| SLC2A2 AND ROR1 | Liver | 0.8 | 1 | 0.666667 | CLDN18 AND RNF43 | Stomach | 0.837209 | 0.837209 | 0.837209 |
| SLC10A1 AND IL3RA | Liver | 0.714286 | 0.625 | 0.833333 | CLDN18 AND L1CAM | Stomach | 0.777778 | 0.744681 | 0.813953 |
| SLC17A2 AND SSTR3 | Liver | 0.714286 | 0.625 | 0.833333 | EPCAM AND SPON2 | Stomach | 0.931818 | 0.911111 | 0.953488 |
| SLCO1B1 AND L1CAM | Liver | 0.75 | 0.6 | 1 | CLDN18 AND CD19 | Stomach | 0.765957 | 0.705882 | 0.837209 |
| SLCO1B1 AND MUC4 | Liver | 0.75 | 0.6 | 1 | CLDN7 AND THY1 | Stomach | 0.926829 | 0.974359 | 0.883721 |
| SLC2A2 AND ITGB6 | Liver | 0.857143 | 0.75 | 1 | CLDN18 AND IL2RA | Stomach | 0.781609 | 0.772727 | 0.790698 |
| SLCO1B1 AND ULBP1 | Liver | 0.666667 | 0.555556 | 0.833333 | CLDN18 AND TRPM4 | Stomach | 0.888889 | 0.947368 | 0.837209 |
| SLC17A2 AND ULBP2 | Liver | 0.666667 | 0.555556 | 0.833333 | CLDN18 AND CLDN1 | Stomach | 0.9 | 0.972973 | 0.837209 |
| SLC2A2 AND TNFRSF8 | Liver | 0.8 | 1 | 0.666667 | CLDN18 AND WT1 | Stomach | 0.765957 | 0.705882 | 0.837209 |
| SLCO1B1 AND ABCB5 | Liver | 0.666667 | 0.555556 | 0.833333 | CLDN18 AND SSTR3 | Stomach | 0.791209 | 0.75 | 0.837209 |
| SLC17A2 AND ITGB6 | Liver | 0.666667 | 0.555556 | 0.833333 | CLDN18 AND BCAN | Stomach | 0.808989 | 0.782609 | 0.837209 |
| SLCO1B1 AND TNFRSF8 | Liver | 0.8 | 1 | 0.666667 | CLDN18 AND ERBB2 | Stomach | 0.888889 | 0.947368 | 0.837209 |
| SLC17A2 AND CLDN9 | Liver | 0.714286 | 0.625 | 0.833333 | CLDN18 AND PMEL | Stomach | 0.765957 | 0.705882 | 0.837209 |
| SLC17A2 AND CD34 | Liver | 0.666667 | 1 | 0.5 | CLDN18 AND OAS1 | Stomach | 0.735294 | 1 | 0.581395 |
| SLC30A10 AND CLDN1 | Liver | 0.666667 | 1 | 0.5 | CLDN18 AND SLC39A6 | Stomach | 0.86747 | 0.9 | 0.837209 |
| SLCO1B1 AND CD22 | Liver | 0.8 | 1 | 0.666667 | PTPRZ1 AND F2R | Astrocytoma | 0.866667 | 0.886364 | 0.847826 |
| SLCO1B1 AND MST1R | Liver | 0.666667 | 1 | 0.5 | PTPRZ1 AND BEST3 | Astrocytoma | 0.857143 | 0.866667 | 0.847826 |
| SLCO1B1 AND PTK7 | Liver | 0.666667 | 1 | 0.5 | FAIM2 AND F2R | Astrocytoma | 0.840909 | 0.880952 | 0.804348 |
| SLC2A2 AND IL2RA | Liver | 0.666667 | 0.666667 | 0.666667 | PLP1 AND F2R | Astrocytoma | 0.831461 | 0.860465 | 0.804348 |
| SLC2A2 AND PTK7 | Liver | 0.666667 | 1 | 0.5 | CRB1 AND ABCA1 | Astrocytoma | 0.822222 | 0.840909 | 0.804348 |
| SLC2A2 AND CSPG4 | Liver | 0.666667 | 0.666667 | 0.666667 | NRCAM AND F2R | Astrocytoma | 0.813953 | 0.875 | 0.76087 |
| ABCG8 AND RAET1E | Liver | 0.666667 | 1 | 0.5 | NKAIN4 AND PTPRZ1 | Astrocytoma | 0.809524 | 0.894737 | 0.73913 |
| ALCAM AND SDC1 | Liver | 0.909091 | 1 | 0.833333 | MLC1 AND HAS2 | Astrocytoma | 0.804598 | 0.853659 | 0.76087 |
| SLC17A2 AND ERBB3 | Liver | 0.666667 | 0.666667 | 0.666667 | PTPRZ1 AND CD82 | Astrocytoma | 0.804348 | 0.804348 | 0.804348 |
| SLC2A2 AND CLDN6 | Liver | 0.833333 | 0.833333 | 0.833333 | SLC1A2 AND VANGL2 | Astrocytoma | 0.804124 | 0.764706 | 0.847826 |
| C8B AND EPHB2 | Liver | 0.666667 | 1 | 0.5 | KCNJ10 AND TSPAN11 | Astrocytoma | 0.8 | 0.818182 | 0.782609 |
| ABCG5 AND CD34 | Liver | 0.666667 | 1 | 0.5 | KCNJ10 AND VANGL2 | Astrocytoma | 0.8 | 0.818182 | 0.782609 |
| ABCG8 AND CD70 | Liver | 0.8 | 1 | 0.666667 | PTPRZ1 AND FXYD6 | Astrocytoma | 0.8 | 0.740741 | 0.869565 |
| SLC10A1 AND LGR5 | Liver | 0.666667 | 0.666667 | 0.666667 | GABBR2 AND VANGL2 | Astrocytoma | 0.795699 | 0.787234 | 0.804348 |
| SLC2A2 AND MUC4 | Liver | 0.857143 | 0.75 | 1 | PTPRZ1 AND GALR1 | Astrocytoma | 0.795699 | 0.787234 | 0.804348 |
| SLC17A2 AND GPA33 | Liver | 0.666667 | 0.555556 | 0.833333 | PTPRZ1 AND STAB1 | Astrocytoma | 0.791667 | 0.76 | 0.826087 |
| SLC2A2 AND CR2 | Liver | 0.666667 | 0.666667 | 0.666667 | PTPRZ1 AND SYT6 | Astrocytoma | 0.791667 | 0.76 | 0.826087 |
| SLC10A1 AND CD34 | Liver | 0.666667 | 1 | 0.5 | CRB1 AND ITGB8 | Astrocytoma | 0.791209 | 0.8 | 0.782609 |
| SLC2A2 AND SSTR4 | Liver | 0.666667 | 0.666667 | 0.666667 | SLCO1C1 AND ABCA1 | Astrocytoma | 0.790698 | 0.85 | 0.73913 |
| SLC17A2 AND GUCY2C | Liver | 0.666667 | 0.555556 | 0.833333 | GPM6B AND BEST3 | Astrocytoma | 0.790123 | 0.914286 | 0.695652 |
| FAP AND CD82 | Pancreas | 0.842105 | 1 | 0.727273 | ADAM22 AND F2R | Astrocytoma | 0.786517 | 0.813953 | 0.76087 |
| CLDN2 AND LAMP5 | Pancreas | 0.736842 | 0.875 | 0.636364 | NRCAM AND SEMA4B | Astrocytoma | 0.786517 | 0.813953 | 0.76087 |
| FAP AND HLA-DRB1 | Pancreas | 0.777778 | 1 | 0.636364 | MLC1 AND ABCA1 | Astrocytoma | 0.785714 | 0.868421 | 0.717391 |
| FAP AND LAPTM5 | Pancreas | 0.705882 | 1 | 0.545455 | PLP1 AND BEST3 | Astrocytoma | 0.78481 | 0.939394 | 0.673913 |
| FAP AND CD74 | Pancreas | 0.777778 | 1 | 0.636364 | NKAIN4 AND ABCA1 | Astrocytoma | 0.781609 | 0.829268 | 0.73913 |
| FAP AND LRRC52 | Pancreas | 0.777778 | 1 | 0.636364 | PTPRZ1 AND SLC10A1 | Astrocytoma | 0.78 | 0.722222 | 0.847826 |
| FAP AND P2RX4 | Pancreas | 0.777778 | 1 | 0.636364 | CRB1 AND VANGL2 | Astrocytoma | 0.778947 | 0.755102 | 0.804348 |
| FAP AND TNFRSF10B | Pancreas | 0.842105 | 1 | 0.727273 | MLC1 AND BMPR1A | Astrocytoma | 0.777778 | 0.795455 | 0.76087 |
| FAP AND CCR9 | Pancreas | 0.842105 | 1 | 0.727273 | CRB1 AND DLL1 | Astrocytoma | 0.777778 | 0.795455 | 0.76087 |
| FAP AND SORL1 | Pancreas | 0.842105 | 1 | 0.727273 | CRB1 AND CALCRL | Astrocytoma | 0.776471 | 0.846154 | 0.717391 |
| FAP AND CXCL16 | Pancreas | 0.842105 | 1 | 0.727273 | NKAIN4 AND SNAP23 | Astrocytoma | 0.776471 | 0.846154 | 0.717391 |
| FAP AND SEMA4D | Pancreas | 0.842105 | 1 | 0.727273 | CRB1 AND ITM2B | Astrocytoma | 0.776471 | 0.846154 | 0.717391 |
| FAP AND UMODL1 | Pancreas | 0.842105 | 1 | 0.727273 | TTYH2 AND VANGL2 | Astrocytoma | 0.774194 | 0.765957 | 0.782609 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| EPHA3 AND CLDN10 | Pancreas | 0.625 | 1 | 0.454545 | PTPRZ1 AND CD44 | Astrocytoma | 0.773333 | 1 | 0.630435 |
| FAP AND GRM4 | Pancreas | 0.625 | 1 | 0.454545 | NRCAM AND BEST3 | Astrocytoma | 0.772727 | 0.809524 | 0.73913 |
| FAP AND NMBR | Pancreas | 0.842105 | 1 | 0.727273 | SLCO1C1 AND CALCRL | Astrocytoma | 0.771084 | 0.864865 | 0.695652 |
| FAP AND CRB1 | Pancreas | 0.842105 | 1 | 0.727273 | PCDH10 AND BEST3 | Astrocytoma | 0.771084 | 0.864865 | 0.695652 |
| FAP AND EFNB2 | Pancreas | 0.777778 | 1 | 0.636364 | CRB1 AND ABCC4 | Astrocytoma | 0.771084 | 0.864865 | 0.695652 |
| FAP AND ICAM1 | Pancreas | 0.842105 | 1 | 0.727273 | SLCO1C1 AND F2RL1 | Astrocytoma | 0.771084 | 0.864865 | 0.695652 |
| FAP AND CCKAR | Pancreas | 0.705882 | 1 | 0.545455 | NKAIN4 AND WLS | Astrocytoma | 0.771084 | 0.864865 | 0.695652 |
| EPHA3 AND CD58 | Pancreas | 0.736842 | 0.875 | 0.636364 | MLC1 AND VANGL2 | Astrocytoma | 0.769231 | 0.777778 | 0.76087 |
| FAP AND KCNU1 | Pancreas | 0.842105 | 1 | 0.727273 | GPM6A AND F2R | Astrocytoma | 0.769231 | 0.777778 | 0.76087 |
| FAP AND SLC6A18 | Pancreas | 0.777778 | 1 | 0.636364 | ADCYAP1R1 AND BEST3 | Astrocytoma | 0.767442 | 0.825 | 0.717391 |
| FAP AND PPAPDC1A | Pancreas | 0.777778 | 1 | 0.636364 | PTPRZ1 AND CLDN17 | Astrocytoma | 0.766355 | 0.672131 | 0.891304 |
| FAP AND OTOF | Pancreas | 0.842105 | 1 | 0.727273 | NKAIN4 AND SLC25A3 | Astrocytoma | 0.765432 | 0.885714 | 0.673913 |
| FAP AND KCNV2 | Pancreas | 0.842105 | 1 | 0.727273 | ADAM12 AND PPAPDC1A | Breast | 0.830189 | 0.846154 | 0.814815 |
| FAP AND SLC2A2 | Pancreas | 0.842105 | 1 | 0.727273 | ADAM12 AND SORL1 | Breast | 0.815534 | 0.857143 | 0.777778 |
| FAP AND MEGF11 | Pancreas | 0.842105 | 1 | 0.727273 | ADAM12 AND LAMP5 | Breast | 0.807339 | 0.8 | 0.814815 |
| FAP AND DPP10 | Pancreas | 0.705882 | 1 | 0.545455 | ADAM12 AND LRRC8E | Breast | 0.787879 | 0.866667 | 0.722222 |
| SLC30A8 AND CD52 | Pancreas | 0.777778 | 1 | 0.636364 | ADAM12 AND VANGL1 | Breast | 0.783505 | 0.883721 | 0.703704 |
| CLDN2 AND KCND2 | Pancreas | 0.8 | 0.888889 | 0.727273 | BST2 AND PPAP2C | Breast | 0.777778 | 0.972222 | 0.648148 |
| EPHA3 AND LAMP5 | Pancreas | 0.777778 | 1 | 0.636364 | ADAM12 AND MEGF10 | Breast | 0.77551 | 0.863636 | 0.703704 |
| EPHA3 AND PTGIR | Pancreas | 0.736842 | 0.875 | 0.636364 | ADAM12 AND UNC5A | Breast | 0.770833 | 0.880952 | 0.685185 |
| FAP AND KCNK12 | Pancreas | 0.705882 | 1 | 0.545455 | SLC5A6 AND KCNA4 | Breast | 0.777778 | 0.972222 | 0.648148 |
| FAP AND CDH18 | Pancreas | 0.842105 | 1 | 0.727273 | PRLR AND FLVCR1 | Breast | 0.76087 | 0.921053 | 0.648148 |
| FAP AND CD163 | Pancreas | 0.777778 | 1 | 0.636364 | ADAM12 AND NKAIN1 | Breast | 0.757895 | 0.878049 | 0.666667 |
| FAP AND CATSPERD | Pancreas | 0.842105 | 1 | 0.727273 | SLC5A6 AND ADAM29 | Breast | 0.777778 | 0.972222 | 0.648148 |
| FAP AND SLC17A1 | Pancreas | 0.842105 | 1 | 0.727273 | SLC5A6 AND SLC10A1 | Breast | 0.777778 | 0.972222 | 0.648148 |
| FAP AND GGTLC1 | Pancreas | 0.625 | 1 | 0.454545 | SLC5A6 AND SLC22A14 | Breast | 0.777778 | 0.972222 | 0.648148 |
| FAP AND OPRK1 | Pancreas | 0.705882 | 1 | 0.545455 | SLC5A6 AND GLRA2 | Breast | 0.777778 | 0.972222 | 0.648148 |
| FAP AND IFNAR2 | Pancreas | 0.705882 | 1 | 0.545455 | PPAPDC1A AND MFSD10 | Breast | 0.744186 | 1 | 0.592593 |
| FAP AND PPAPDC1B | Pancreas | 0.705882 | 1 | 0.545455 | BST2 AND PROM2 | Breast | 0.782609 | 0.947368 | 0.666667 |
| FAP AND PCDHA6 | Pancreas | 0.777778 | 1 | 0.636364 | PPAPDC1A AND FXYD3 | Breast | 0.787234 | 0.925 | 0.685185 |
| FAP AND EBP | Pancreas | 0.625 | 1 | 0.454545 | PPAPDC1A AND F11R | Breast | 0.744681 | 0.875 | 0.648148 |
| FAP AND CD58 | Pancreas | 0.842105 | 1 | 0.727273 | PPAPDC1A AND PROM2 | Breast | 0.755102 | 0.840909 | 0.685185 |
| FAP AND SLC17A3 | Pancreas | 0.842105 | 1 | 0.727273 | PPAPDC1A AND SLC52A2 | Breast | 0.786517 | 1 | 0.648148 |
| FAP AND KCNJ6 | Pancreas | 0.842105 | 1 | 0.727273 | CELSR2 AND BST2 | Breast | 0.736842 | 0.853659 | 0.648148 |
| FAP AND SLC26A8 | Pancreas | 0.842105 | 1 | 0.727273 | SLC5A6 AND SCN10A | Breast | 0.777778 | 0.972222 | 0.648148 |
| FAP AND NPFFR1 | Pancreas | 0.777778 | 1 | 0.636364 | SLC5A6 AND MIP | Breast | 0.735632 | 0.969697 | 0.592593 |
| CLDN18 AND KCND2 | Pancreas | 0.631579 | 0.75 | 0.545455 | ADAM12 AND CNIH2 | Breast | 0.734694 | 0.818182 | 0.666667 |
| SLC30A8 AND GPNMB | Pancreas | 0.777778 | 1 | 0.636364 | PPAPDC1A AND LSR | Breast | 0.733333 | 0.916667 | 0.611111 |
| FAP AND GPR22 | Pancreas | 0.777778 | 1 | 0.636364 | PRLR AND CXCL16 | Breast | 0.73913 | 0.894737 | 0.62963 |
| FAP AND SPAM1 | Pancreas | 0.705882 | 1 | 0.545455 | SLC5A6 AND SLC10A2 | Breast | 0.764045 | 0.971429 | 0.62963 |
| FAP AND FCAMR | Pancreas | 0.842105 | 1 | 0.727273 | SLC5A6 AND KCND2 | Breast | 0.777778 | 0.972222 | 0.648148 |
| FAP AND OR52D1 | Pancreas | 0.777778 | 1 | 0.636364 | PPAPDC1A AND PLP2 | Breast | 0.744186 | 1 | 0.592593 |
| FAP AND DIO1 | Pancreas | 0.842105 | 1 | 0.727273 | PPAPDC1A AND CDH1 | Breast | 0.744681 | 0.875 | 0.648148 |
| EPHA3 AND PTGER4 | Pancreas | 0.777778 | 1 | 0.636364 | PPAPDC1A AND CALHM2 | Breast | 0.741573 | 0.942857 | 0.611111 |
| FAP AND OR2L2 | Pancreas | 0.842105 | 1 | 0.727273 | PPAPDC1A AND EDNRA | Breast | 0.782609 | 0.947368 | 0.666667 |
| FAP AND AJAP1 | Pancreas | 0.705882 | 1 | 0.545455 | PRLR AND IL17RA | Breast | 0.731183 | 0.871795 | 0.62963 |
| EPHA3 AND HLA-DRB1 | Pancreas | 0.777778 | 1 | 0.636364 | PPAPDC1A AND TCIRG1 | Breast | 0.755556 | 0.944444 | 0.62963 |
| FAP AND CLDN10 | Pancreas | 0.705882 | 1 | 0.545455 | SLC5A6 AND OR1C1 | Breast | 0.735632 | 0.969697 | 0.592593 |
| FAP AND USH2A | Pancreas | 0.777778 | 1 | 0.636364 | SLC5A6 AND PPAPDC1A | Breast | 0.729412 | 1 | 0.574074 |
| FAP AND ZP4 | Pancreas | 0.842105 | 1 | 0.727273 | SLC5A6 AND LRRC8E | Breast | 0.729412 | 1 | 0.574074 |
| FAP AND OPRM1 | Pancreas | 0.842105 | 1 | 0.727273 | PPAPDC1A AND TNFSF10 | Breast | 0.730769 | 0.76 | 0.703704 |
| FAP AND SLC12A5 | Pancreas | 0.842105 | 1 | 0.727273 | SLC5A6 AND CLDN19 | Breast | 0.735632 | 0.969697 | 0.592593 |
| FAP AND TNFRSF12A | Pancreas | 0.842105 | 1 | 0.727273 | SLC5A6 AND GPR19 | Breast | 0.755556 | 0.944444 | 0.62963 |
| FAP AND GPR83 | Pancreas | 0.842105 | 1 | 0.727273 | PPAPDC1A AND SECTM1 | Breast | 0.747253 | 0.918919 | 0.62963 |
| FAP AND CHRNA1 | Pancreas | 0.842105 | 1 | 0.727273 | PPAPDC1A AND NOX4 | Breast | 0.76 | 0.826087 | 0.703704 |
| VCAM1 AND GGTLC1 | Renal | 0.8 | 1 | 0.666667 | PPAPDC1A AND PLXND1 | Breast | 0.744186 | 1 | 0.592593 |
| VCAM1 AND FAT1 | Renal | 0.8 | 1 | 0.666667 | MFSD10 AND CDH11 | Breast | 0.735632 | 0.969697 | 0.592593 |
| VCAM1 AND SLC22A5 | Renal | 0.736842 | 1 | 0.583333 | SLC2A2 AND FGFRL1 | Liver | 1 | 1 | 1 |
| VCAM1 AND SLC22A18 | Renal | 0.8 | 1 | 0.666667 | FGG AND FGF6 | Liver | 0.909091 | 1 | 0.833333 |
| CLDN2 AND GYPC | Renal | 0.727273 | 0.8 | 0.666667 | SLCO1B1 AND SLC26A6 | Liver | 0.923077 | 0.857143 | 1 |
| CLDN2 AND EMP3 | Renal | 0.727273 | 0.8 | 0.666667 | SLC2A2 AND CELSR3 | Liver | 0.857143 | 0.75 | 1 |
| VCAM1 AND CLDN10 | Renal | 0.8 | 1 | 0.666667 | SLC2A2 AND CNNM3 | Liver | 0.857143 | 0.75 | 1 |
| CLDN2 AND SLC38A1 | Renal | 0.736842 | 1 | 0.583333 | FGG AND SLC22A5 | Liver | 0.833333 | 0.833333 | 0.833333 |
| SLC2A2 AND VCAM1 | Renal | 0.7 | 0.875 | 0.583333 | SLC2A2 AND TREML2 | Liver | 0.909091 | 1 | 0.833333 |
| CLDN2 AND LAPTM5 | Renal | 0.8 | 1 | 0.666667 | SLC2A2 AND SLC38A6 | Liver | 0.909091 | 1 | 0.833333 |
| SLC17A1 AND VCAM1 | Renal | 0.666667 | 1 | 0.5 | SLC2A2 AND PANX2 | Liver | 1 | 1 | 1 |
| VCAM1 AND SLC6A12 | Renal | 0.666667 | 1 | 0.5 | SLC2A2 AND SLC26A6 | Liver | 1 | 1 | 1 |
| VCAM1 AND SLC22A11 | Renal | 0.666667 | 1 | 0.5 | SLC17A2 AND SLC26A6 | Liver | 0.833333 | 0.833333 | 0.833333 |
| CLDN2 AND P2RX4 | Renal | 0.727273 | 0.8 | 0.666667 | SLC2A2 AND ANO8 | Liver | 0.833333 | 0.833333 | 0.833333 |
| CLDN2 AND GPR137B | Renal | 0.64 | 0.615385 | 0.666667 | SLC2A2 AND ABCB8 | Liver | 0.909091 | 1 | 0.833333 |
| SLC13A1 AND VCAM1 | Renal | 0.631579 | 0.857143 | 0.5 | FGG AND ALCAM | Liver | 1 | 1 | 1 |
| SLC6A13 AND VCAM1 | Renal | 0.631579 | 0.857143 | 0.5 | FGG AND KCNJ6 | Liver | 0.909091 | 1 | 0.833333 |
| VCAM1 AND TNFRSF12A | Renal | 0.666667 | 1 | 0.5 | ABCG5 AND FGFRL1 | Liver | 1 | 1 | 1 |
| CLDN2 AND VANGL1 | Renal | 0.636364 | 0.7 | 0.583333 | SLCO1B1 AND HM13 | Liver | 1 | 1 | 1 |
| VCAM1 AND ABCA12 | Renal | 0.666667 | 0.6 | 0.75 | SLC2A2 AND BCAM | Liver | 0.909091 | 1 | 0.833333 |
| VCAM1 AND TRPM3 | Renal | 0.631579 | 0.857143 | 0.5 | SLC2A2 AND TP53I13 | Liver | 1 | 1 | 1 |
| CLDN2 AND CD58 | Renal | 0.695652 | 0.727273 | 0.666667 | SLC2A2 AND NPBWR2 | Liver | 0.909091 | 1 | 0.833333 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| VCAM1 AND SLC38A1 | Renal | 0.615385 | 0.571429 | 0.666667 | SLC2A2 AND TMEM67 | Liver | 0.857143 | 0.75 | 1 |
| CLDN2 AND ABCG4 | Renal | 0.615385 | 0.571429 | 0.666667 | SLCO1B1 AND ANO10 | Liver | 0.909091 | 1 | 0.833333 |
| CLDN2 AND CD44 | Renal | 0.666667 | 0.666667 | 0.666667 | ABCG5 AND SLC38A6 | Liver | 0.909091 | 1 | 0.833333 |
| CLDN2 AND HLA-DRB1 | Renal | 0.761905 | 0.888889 | 0.666667 | HPN AND PLVAP | Liver | 0.8 | 1 | 0.666667 |
| VCAM1 AND EPHA8 | Renal | 0.615385 | 0.571429 | 0.666667 | FGG AND MLANA | Liver | 0.8 | 1 | 0.666667 |
| CLDN2 AND ICAM1 | Renal | 0.666667 | 1 | 0.5 | SLCO1B1 AND CELSR3 | Liver | 0.8 | 0.666667 | 1 |
| VCAM1 AND CALHM3 | Renal | 0.666667 | 0.6 | 0.75 | SLC2A2 AND SLC5A5 | Liver | 0.909091 | 1 | 0.833333 |
| VCAM1 AND LRRN4 | Renal | 0.666667 | 0.6 | 0.75 | FGG AND GPR158 | Liver | 0.8 | 0.666667 | 1 |
| SLC13A1 AND CD276 | Renal | 0.6 | 0.75 | 0.5 | ABCG5 AND SMO | Liver | 0.8 | 1 | 0.666667 |
| SLC13A1 AND AXL | Renal | 0.6 | 0.75 | 0.5 | ASGR1 AND PLVAP | Liver | 0.8 | 1 | 0.666667 |
| VCAM1 AND SLC2A1 | Renal | 0.636364 | 0.7 | 0.583333 | SLCO1B1 AND C6orf89 | Liver | 1 | 1 | 1 |
| VCAM1 AND TNFRSF10B | Renal | 0.615385 | 0.571429 | 0.666667 | SLC2A2 AND DAGLB | Liver | 0.8 | 1 | 0.666667 |
| DPEP1 AND TGFBI | Colon | 1 | 1 | 1 | SLC2A2 AND SMO | Liver | 0.8 | 1 | 0.666667 |
| IFI6 AND CEACAM5 | Colon | 1 | 1 | 1 | SLC2A2 AND HM13 | Liver | 1 | 1 | 1 |
| CDH17 AND CLDN1 | Colon | 1 | 1 | 1 | FGG AND SLC50A1 | Liver | 1 | 1 | 1 |
| IFI6 AND GUCY2C | Colon | 1 | 1 | 1 | SLC2A2 AND SLC4A11 | Liver | 0.8 | 1 | 0.666667 |
| GPA33 AND TGFBI | Colon | 0.909091 | 0.833333 | 1 | SLCO1B1 AND SMO | Liver | 0.8 | 1 | 0.666667 |
| CLDN7 AND TGFBI | Colon | 0.909091 | 0.833333 | 1 | FGG AND PLVAP | Liver | 0.8 | 1 | 0.666667 |
| IFI6 AND GPA33 | Colon | 1 | 1 | 1 | FGG AND NPFFR1 | Liver | 0.8 | 1 | 0.666667 |
| CDH17 AND THY1 | Colon | 1 | 1 | 1 | SLC2A2 AND PTCHD1 | Liver | 0.833333 | 0.833333 | 0.833333 |
| MUC13 AND TGFBI | Colon | 0.909091 | 0.833333 | 1 | SLC2A2 AND PLXNC1 | Liver | 0.8 | 1 | 0.666667 |
| IFI6 AND MUC13 | Colon | 1 | 1 | 1 | SLCO1B1 AND SLC4A11 | Liver | 0.833333 | 0.833333 | 0.833333 |
| CEACAM5 AND TGFBI | Colon | 0.909091 | 0.833333 | 1 | SLCO1B1 AND CD200 | Liver | 0.923077 | 0.857143 | 1 |
| GUCY2C AND TGFBI | Colon | 0.909091 | 0.833333 | 1 | SLC2A2 AND KCNN3 | Liver | 0.909091 | 1 | 0.833333 |
| DPEP1 AND IFI6 | Colon | 1 | 1 | 1 | SLC2A2 AND CRHR1 | Liver | 0.8 | 1 | 0.666667 |
| CLDN3 AND TGFBI | Colon | 0.909091 | 0.833333 | 1 | SLC2A2 AND ATP2A2 | Liver | 0.909091 | 1 | 0.833333 |
| CDH17 AND SLC7A5 | Colon | 1 | 1 | 1 | SLC2A2 AND NOTCH4 | Liver | 1 | 1 | 1 |
| IFI6 AND EPHB2 | Colon | 0.909091 | 0.833333 | 1 | FGG AND PCDHB1 | Liver | 0.8 | 0.666667 | 1 |
| CLDN2 AND TGFBI | Colon | 0.888889 | 1 | 0.8 | SLCO1B1 AND DAGLB | Liver | 0.8 | 1 | 0.666667 |
| NOX1 AND CLDN1 | Colon | 1 | 1 | 1 | SLC2A2 AND SLC12A7 | Liver | 0.909091 | 1 | 0.833333 |
| IFI6 AND STEAP1 | Colon | 1 | 1 | 1 | SLCO1B1 AND TLCD1 | Liver | 1 | 1 | 1 |
| DPEP1 AND NOX1 | Colon | 1 | 1 | 1 | SLC17A2 AND HM13 | Liver | 0.909091 | 1 | 0.833333 |
| NOX1 AND THY1 | Colon | 1 | 1 | 1 | SLCO1B1 AND FGFRL1 | Liver | 1 | 1 | 1 |
| IFI6 AND CLDN3 | Colon | 1 | 1 | 1 | ABCB4 AND PLVAP | Liver | 0.8 | 1 | 0.666667 |
| CDH17 AND FAP | Colon | 0.888889 | 1 | 0.8 | SLC2A2 AND IGSF8 | Liver | 1 | 1 | 1 |
| CXCL16 AND MUC13 | Esophagus | 0.782609 | 1 | 0.642857 | SLC2A2 AND SLC39A1 | Liver | 0.909091 | 1 | 0.833333 |
| CDH17 AND CLDN1 | Esophagus | 0.928571 | 0.928571 | 0.928571 | FGG AND DTNA | Liver | 0.909091 | 1 | 0.833333 |
| SLCO1B3 AND EPCAM | Esophagus | 0.636364 | 0.875 | 0.5 | SLC2A2 AND TSPAN5 | Liver | 0.833333 | 0.833333 | 0.833333 |
| CXCL16 AND CEACAM5 | Esophagus | 0.782609 | 1 | 0.642857 | SLC2A2 AND QSOX2 | Liver | 0.909091 | 1 | 0.833333 |
| CDH17 AND MOK | Esophagus | 0.666667 | 1 | 0.5 | FGG AND SLC22A12 | Liver | 0.833333 | 0.833333 | 0.833333 |
| MUC17 AND CLDN1 | Esophagus | 0.88 | 1 | 0.785714 | SLC13A5 AND SMO | Liver | 0.8 | 1 | 0.666667 |
| SLCO1B3 AND SLC7A5 | Esophagus | 0.6 | 1 | 0.428571 | SLCO1B1 AND C6orf89 | Liver | 1 | 1 | 1 |
| MUC13 AND BST2 | Esophagus | 0.6 | 1 | 0.428571 | SLC2A2 AND SLC26A11 | Liver | 0.909091 | 1 | 0.833333 |
| SLCO1B3 AND BIRC5 | Esophagus | 0.636364 | 0.875 | 0.5 | SLCO1B1 AND SLC7A11 | Liver | 1 | 1 | 1 |
| CBX3 AND SLC2A1 | Esophagus | 0.695652 | 0.888889 | 0.571429 | SLCO1B1 AND NIPA1 | Liver | 0.909091 | 1 | 0.833333 |
| CDH17 AND SPON2 | Esophagus | 0.685714 | 0.571429 | 0.857143 | SLC2A2 AND MMP14 | Liver | 0.923077 | 0.857143 | 1 |
| SLCO1B3 AND MUC1 | Esophagus | 0.636364 | 0.875 | 0.5 | SLC2A2 AND TIE1 | Liver | 0.857143 | 0.75 | 1 |
| SLCO1B3 AND IL20RA | Esophagus | 0.636364 | 0.875 | 0.5 | SLCO1B1 AND SLC38A6 | Liver | 0.909091 | 1 | 0.833333 |
| CXCL16 AND GUCY2C | Esophagus | 0.727273 | 1 | 0.571429 | SLCO1B1 AND SLC39A1 | Liver | 0.909091 | 1 | 0.833333 |
| CBX3 AND EFNB2 | Esophagus | 0.695652 | 0.888889 | 0.571429 | SLCO1B1 AND NPBWR2 | Liver | 0.909091 | 1 | 0.833333 |
| CXCL16 AND EPCAM | Esophagus | 0.782609 | 1 | 0.642857 | ABCG5 AND CELSR3 | Liver | 0.923077 | 0.857143 | 1 |
| LYPD1 AND CD33 | Glioblastoma | 0.764706 | 0.764706 | 0.764706 | ABCC6 AND PLVAP | Liver | 0.8 | 1 | 0.666667 |
| MLC1 AND IL13RA1 | Glioblastoma | 0.717949 | 0.636364 | 0.823529 | SLCO1B1 AND NCSTN | Liver | 1 | 1 | 1 |
| LYPD1 AND CD180 | Glioblastoma | 0.702703 | 0.65 | 0.764706 | SLC2A2 AND SLC16A11 | Liver | 0.833333 | 0.833333 | 0.833333 |
| LYPD1 AND AXL | Glioblastoma | 0.848485 | 0.875 | 0.823529 | SLCO1B1 AND TP53I13 | Liver | 0.923077 | 0.857143 | 1 |
| LYPD1 AND SLC7A5 | Glioblastoma | 0.7 | 0.608696 | 0.823529 | ASGR1 AND FGF6 | Liver | 0.833333 | 0.833333 | 0.833333 |
| LYPD1 AND CD70 | Glioblastoma | 0.7 | 0.608696 | 0.823529 | SLCO1B1 AND TREML2 | Liver | 0.909091 | 1 | 0.833333 |
| LYPD1 AND CLDN5 | Glioblastoma | 0.7 | 0.608696 | 0.823529 | SLC27A5 AND PLVAP | Liver | 0.8 | 1 | 0.666667 |
| MLC1 AND VCAM1 | Glioblastoma | 0.742857 | 0.722222 | 0.764706 | SLCO1B1 AND PANX2 | Liver | 1 | 1 | 1 |
| CRB1 AND ITGAV | Glioblastoma | 0.692308 | 1 | 0.529412 | SLCO1B1 AND LRRC8D | Liver | 0.909091 | 1 | 0.833333 |
| LYPD1 AND CSPG4 | Glioblastoma | 0.692308 | 1 | 0.529412 | SLCO1B1 AND ABCB8 | Liver | 0.857143 | 0.75 | 1 |
| LYPD1 AND IL13RA1 | Glioblastoma | 0.823529 | 0.823529 | 0.823529 | SLC17A2 AND ANO10 | Liver | 0.8 | 1 | 0.666667 |
| LYPD1 AND SLC39A6 | Glioblastoma | 0.684211 | 0.619048 | 0.764706 | TNFRSF12A AND ADAM28 | Pancreas | 0.777778 | 1 | 0.636364 |
| MLC1 AND GPNMB | Glioblastoma | 0.709677 | 0.785714 | 0.647059 | KCNE4 AND IFNAR2 | Pancreas | 0.666667 | 0.615385 | 0.727273 |
| LYPD1 AND BMPR1B | Glioblastoma | 0.717949 | 0.636364 | 0.823529 | SYT13 AND EMP3 | Pancreas | 0.8 | 0.888889 | 0.727273 |
| LYPD1 AND NCAM1 | Glioblastoma | 0.666667 | 0.590909 | 0.764706 | NOX4 AND TNFRSF10B | Pancreas | 0.666667 | 0.7 | 0.636364 |
| LYPD1 AND MUC1 | Glioblastoma | 0.666667 | 0.9 | 0.529412 | PTGIS AND GJB1 | Pancreas | 0.666667 | 0.615385 | 0.727273 |
| SYT11 AND GPNMB | Glioblastoma | 0.666667 | 0.56 | 0.823529 | NOX4 AND TNFRSF12A | Pancreas | 0.636364 | 0.636364 | 0.636364 |
| SYT11 AND ITGAV | Glioblastoma | 0.717949 | 0.636364 | 0.823529 | KCNE4 AND TNFRSF12A | Pancreas | 0.636364 | 0.636364 | 0.636364 |
| SLC1A2 AND IL13RA1 | Glioblastoma | 0.692308 | 1 | 0.529412 | TNFRSF12A AND TNFSF4 | Pancreas | 0.705882 | 1 | 0.545455 |
| MLC1 AND EGFR | Glioblastoma | 0.647059 | 0.647059 | 0.647059 | NOX4 AND UMODL1 | Pancreas | 0.72 | 0.642857 | 0.818182 |
| SYT11 AND MUC1 | Glioblastoma | 0.642857 | 0.818182 | 0.529412 | SYT13 AND BST2 | Pancreas | 0.842105 | 1 | 0.727273 |
| CDH10 AND MUC1 | Glioblastoma | 0.642857 | 0.818182 | 0.529412 | SYT13 AND PTGIS | Pancreas | 0.628571 | 0.458333 | 1 |
| MLC1 AND ITGAV | Glioblastoma | 0.666667 | 0.769231 | 0.588235 | NOX4 AND LAPTM5 | Pancreas | 0.625 | 1 | 0.454545 |
| LYPD1 AND ITGAV | Glioblastoma | 0.740741 | 1 | 0.588235 | NOX4 AND CD58 | Pancreas | 0.705882 | 1 | 0.545455 |
| LYPD1 AND PROM1 | Glioblastoma | 0.631579 | 0.571429 | 0.705882 | CLDN10 AND CXCR4 | Pancreas | 0.705882 | 1 | 0.545455 |
| GPR158 AND ITGAV | Glioblastoma | 0.666667 | 0.56 | 0.823529 | GP2 AND PTGIS | Pancreas | 0.8 | 0.888889 | 0.727273 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NCAM1 AND PPAPDC1B | Glioblastoma | 0.645161 | 0.714286 | 0.588235 | GP2 AND CDH11 | Pancreas | 0.777778 | 1 | 0.636364 |
| SLCO1C1 AND IL13RA1 | Glioblastoma | 0.625 | 0.483871 | 0.882353 | SLC30A8 AND VMP1 | Pancreas | 0.705882 | 1 | 0.545455 |
| BEST3 AND BMPR1B | Glioblastoma | 0.625 | 0.666667 | 0.588235 | GP2 AND BST2 | Pancreas | 0.705882 | 1 | 0.545455 |
| SLCO1C1 AND MUC1 | Glioblastoma | 0.62069 | 0.75 | 0.529412 | NOX4 AND PCDHA6 | Pancreas | 0.64 | 0.571429 | 0.727273 |
| CRB1 AND VCAM1 | Glioblastoma | 0.611111 | 0.578947 | 0.647059 | GP2 AND F2R | Pancreas | 0.842105 | 1 | 0.727273 |
| SCN1A AND ITGAV | Glioblastoma | 0.666667 | 0.769231 | 0.588235 | GP2 AND LAMP5 | Pancreas | 0.705882 | 1 | 0.545455 |
| GPR19 AND ITGAV | Glioblastoma | 0.62069 | 0.75 | 0.529412 | NOX4 AND CD82 | Pancreas | 0.608696 | 0.583333 | 0.636364 |
| SLCO1C1 AND GPNMB | Glioblastoma | 0.684211 | 0.619048 | 0.764706 | KCNE4 AND LAPTM5 | Pancreas | 0.608696 | 0.583333 | 0.636364 |
| GPR158 AND GPNMB | Glioblastoma | 0.603774 | 0.444444 | 0.941176 | NOX4 AND NMBR | Pancreas | 0.72 | 0.642857 | 0.818182 |
| LYPD1 AND VCAM1 | Glioblastoma | 0.827586 | 1 | 0.705882 | GP2 AND CD163 | Pancreas | 0.842105 | 1 | 0.727273 |
| SLCO1C1 AND ITGAV | Glioblastoma | 0.742857 | 0.722222 | 0.764706 | KCNE4 AND HLA-DRB1 | Pancreas | 0.608696 | 0.583333 | 0.636364 |
| ASTN1 AND ITGAV | Glioblastoma | 0.666667 | 0.9 | 0.529412 | KCNE4 AND CD74 | Pancreas | 0.608696 | 0.583333 | 0.636364 |
| BMPR1B AND CD163 | Glioblastoma | 0.827586 | 1 | 0.705882 | SLC30A8 AND TM4SF1 | Pancreas | 0.705882 | 1 | 0.545455 |
| NCAM1 AND IFNAR2 | Glioblastoma | 0.666667 | 0.6875 | 0.647059 | GJB1 AND EMP3 | Pancreas | 0.666667 | 0.857143 | 0.545455 |
| SLCO1C1 AND CLDN12 | Glioblastoma | 0.615385 | 0.457143 | 0.941176 | TM4SF1 AND KCND2 | Pancreas | 0.666667 | 0.857143 | 0.545455 |
| PPAPDC1A AND ITGAV | Glioblastoma | 0.631579 | 0.571429 | 0.705882 | NOX4 AND KCNU1 | Pancreas | 0.6 | 0.473684 | 0.818182 |
| NCAM1 AND SLC31A1 | Glioblastoma | 0.689655 | 0.833333 | 0.588235 | NOX4 AND OTOF | Pancreas | 0.6 | 0.473684 | 0.818182 |
| SYT11 AND ITGAV | Glioma | 0.977778 | 1 | 0.956522 | GP2 AND CD93 | Pancreas | 0.777778 | 1 | 0.636364 |
| GPR158 AND ITGAV | Glioma | 0.948905 | 0.955882 | 0.942029 | TM4SF1 AND CACNG4 | Pancreas | 0.631579 | 0.75 | 0.545455 |
| KCNJ10 AND ITGAV | Glioma | 0.906475 | 0.9 | 0.913043 | GP2 AND LAPTM5 | Pancreas | 0.705882 | 1 | 0.545455 |
| SYT11 AND CLDN8 | Glioma | 0.957143 | 0.943662 | 0.971014 | OLR1 AND CEACAM7 | Pancreas | 0.705882 | 1 | 0.545455 |
| GPR19 AND ITGAV | Glioma | 0.913386 | 1 | 0.84058 | GP2 AND PPAPDC1A | Pancreas | 0.615385 | 0.533333 | 0.727273 |
| SYT11 AND FCRL5 | Glioma | 0.971429 | 0.957746 | 0.985507 | SLC30A8 AND PTPRK | Pancreas | 0.625 | 1 | 0.454545 |
| SYT11 AND CD276 | Glioma | 0.964029 | 0.957143 | 0.971014 | SLC30A8 AND CD9 | Pancreas | 0.777778 | 1 | 0.636364 |
| SYT11 AND ENG | Glioma | 0.964539 | 0.944444 | 0.985507 | GP2 AND HLA-DRB1 | Pancreas | 0.625 | 1 | 0.454545 |
| SYT11 AND GUCY2C | Glioma | 0.957143 | 0.943662 | 0.971014 | GP2 AND SLC6A6 | Pancreas | 0.636364 | 0.636364 | 0.636364 |
| SYT11 AND CLDN23 | Glioma | 0.964029 | 0.957143 | 0.971014 | NOX4 AND PTGIR | Pancreas | 0.736842 | 0.875 | 0.636364 |
| SYT11 AND EDNRB | Glioma | 0.942029 | 0.942029 | 0.942029 | GP2 AND PTGIR | Pancreas | 0.666667 | 0.857143 | 0.545455 |
| SYT11 AND FCRL1 | Glioma | 0.934307 | 0.941176 | 0.927536 | PTGIS AND TNFRSF21 | Pancreas | 0.666667 | 0.7 | 0.636364 |
| SYT11 AND CD37 | Glioma | 0.964539 | 0.944444 | 0.985507 | NOX4 AND LAMP5 | Pancreas | 0.8 | 0.888889 | 0.727273 |
| SYT11 AND ABCB5 | Glioma | 0.957143 | 0.943662 | 0.971014 | CLDN10 AND TNFSF13B | Pancreas | 0.625 | 1 | 0.454545 |
| SYT11 AND ITGB6 | Glioma | 0.957143 | 0.943662 | 0.971014 | CLDN10 AND SLAMF6 | Pancreas | 0.6 | 0.666667 | 0.545455 |
| SYT11 AND TNFRSF17 | Glioma | 0.957143 | 0.943662 | 0.971014 | GP2 AND PROCR | Pancreas | 0.625 | 1 | 0.454545 |
| SYT11 AND CD180 | Glioma | 0.964539 | 0.944444 | 0.985507 | TREM2 AND LAMP5 | Pancreas | 0.631579 | 0.75 | 0.545455 |
| SYT11 AND TNFSF11 | Glioma | 0.956522 | 0.956522 | 0.956522 | TNFRSF12A AND VSIG1 | Pancreas | 0.631579 | 0.75 | 0.545455 |
| SYT11 AND PTK7 | Glioma | 0.94964 | 0.942857 | 0.956522 | SLC30A8 AND S100A10 | Pancreas | 0.777778 | 1 | 0.636364 |
| SYT11 AND SDC1 | Glioma | 0.942029 | 0.942029 | 0.942029 | CDH6 AND GYPC | Renal | 0.857143 | 1 | 0.75 |
| SYT11 AND ULBP1 | Glioma | 0.948905 | 0.955882 | 0.942029 | CDH6 AND NOX1 | Renal | 0.857143 | 1 | 0.75 |
| SYT11 AND VTCN1 | Glioma | 0.94964 | 0.942857 | 0.956522 | CDH6 AND P2RX4 | Renal | 0.857143 | 1 | 0.75 |
| SYT11 AND SSTR4 | Glioma | 0.94964 | 0.942857 | 0.956522 | CDH6 AND IL13 | Renal | 0.857143 | 1 | 0.75 |
| ASTN1 AND ITGAV | Glioma | 0.888889 | 0.982456 | 0.811594 | CDH6 AND CLDN15 | Renal | 0.857143 | 1 | 0.75 |
| SYT11 AND IL2RA | Glioma | 0.964539 | 0.944444 | 0.985507 | CDH6 AND HLA-DRB1 | Renal | 0.857143 | 1 | 0.75 |
| SYT11 AND CD72 | Glioma | 0.957143 | 0.943662 | 0.971014 | CDH6 AND ABCA12 | Renal | 0.857143 | 1 | 0.75 |
| SYT11 AND CLDN2 | Glioma | 0.94964 | 0.942857 | 0.956522 | CDH6 AND C8B | Renal | 0.857143 | 1 | 0.75 |
| SYT11 AND SLC34A2 | Glioma | 0.942029 | 0.942029 | 0.942029 | CDH6 AND SLC22A14 | Renal | 0.857143 | 1 | 0.75 |
| SYT11 AND MUC4 | Glioma | 0.964539 | 0.944444 | 0.985507 | JPH1 AND TGFBI | Colon | 1 | 1 | 1 |
| SYT11 AND SSTR3 | Glioma | 0.964539 | 0.944444 | 0.985507 | IFI6 AND HEPH | Colon | 1 | 1 | 1 |
| SYT11 AND CD52 | Glioma | 0.964029 | 0.957143 | 0.971014 | CDH17 AND SLC39A10 | Colon | 1 | 1 | 1 |
| CDH10 AND ITGAV | Glioma | 0.878049 | 1 | 0.782609 | NOX1 AND AMIGO2 | Colon | 0.909091 | 0.833333 | 1 |
| SYT11 AND SLC39A6 | Glioma | 0.956522 | 0.956522 | 0.956522 | IFI6 AND SLC39A4 | Colon | 1 | 1 | 1 |
| SYT11 AND KDR | Glioma | 0.964539 | 0.944444 | 0.985507 | IFI6 AND GPR160 | Colon | 0.909091 | 0.833333 | 1 |
| SYT11 AND CR2 | Glioma | 0.94964 | 0.942857 | 0.956522 | IFI6 AND MEP1A | Colon | 1 | 1 | 1 |
| SYT11 AND MS4A1 | Glioma | 0.957143 | 0.943662 | 0.971014 | IFI6 AND IHH | Colon | 1 | 1 | 1 |
| SYT11 AND MSLN | Glioma | 0.964539 | 0.944444 | 0.985507 | CDH17 AND AMIGO2 | Colon | 0.909091 | 0.833333 | 1 |
| SYT11 AND CD33 | Glioma | 0.964539 | 0.944444 | 0.985507 | ATP10B AND TGFBI | Colon | 0.909091 | 0.833333 | 1 |
| SYT11 AND CLDN18 | Glioma | 0.918519 | 0.939394 | 0.898551 | MEP1A AND TGFBI | Colon | 0.909091 | 0.833333 | 1 |
| SYT11 AND AXL | Glioma | 0.957143 | 0.943662 | 0.971014 | IFI6 AND CFTR | Colon | 1 | 1 | 1 |
| SYT11 AND IL3RA | Glioma | 0.957143 | 0.943662 | 0.971014 | IFI6 AND SLC26A3 | Colon | 1 | 1 | 1 |
| SYT11 AND CD34 | Glioma | 0.964539 | 0.944444 | 0.985507 | HEPH AND TGFBI | Colon | 0.909091 | 0.833333 | 1 |
| SYT11 AND ROR1 | Glioma | 0.964539 | 0.944444 | 0.985507 | IFI6 AND ATP10B | Colon | 1 | 1 | 1 |
| SYT11 AND FCRL2 | Glioma | 0.957143 | 0.943662 | 0.971014 | IFI6 AND SLC5A1 | Colon | 1 | 1 | 1 |
| SYT11 AND MUC16 | Glioma | 0.964539 | 0.944444 | 0.985507 | IFI6 AND CEACAM1 | Colon | 0.909091 | 0.833333 | 1 |
| SYT11 AND RNF43 | Glioma | 0.957143 | 0.943662 | 0.971014 | IYD AND TGFBI | Colon | 0.909091 | 0.833333 | 1 |
| SYT11 AND GPA33 | Glioma | 0.957143 | 0.943662 | 0.971014 | TM4SF5 AND TGFBI | Colon | 0.909091 | 0.833333 | 1 |
| SYT11 AND RAET1E | Glioma | 0.964539 | 0.944444 | 0.985507 | NOX1 AND SLC39A10 | Colon | 1 | 1 | 1 |
| SYT11 AND CA9 | Glioma | 0.957143 | 0.943662 | 0.971014 | IFI6 AND ATP1A1 | Colon | 0.888889 | 1 | 0.8 |
| SYT11 AND TNFRSF10A | Glioma | 0.94964 | 0.942857 | 0.956522 | IFI6 AND SLC35G1 | Colon | 1 | 1 | 1 |
| SYT11 AND MST1R | Glioma | 0.948905 | 0.955882 | 0.942029 | IFI6 AND IYD | Colon | 0.909091 | 0.833333 | 1 |
| SYT11 AND SSTR5 | Glioma | 0.94964 | 0.942857 | 0.956522 | SLC26A3 AND TGFBI | Colon | 0.909091 | 0.833333 | 1 |
| SYT11 AND PMEL | Glioma | 0.964539 | 0.944444 | 0.985507 | IFI6 AND TM4SF5 | Colon | 1 | 1 | 1 |
| SYT11 AND SLAMF7 | Glioma | 0.964539 | 0.944444 | 0.985507 | NOX1 AND TACSTD2 | Colon | 1 | 1 | 1 |
| SYT11 AND CXCR5 | Glioma | 0.957143 | 0.943662 | 0.971014 | IFI6 AND JPH1 | Colon | 1 | 1 | 1 |
| OMG AND ITGAV | Glioma | 0.867133 | 0.837838 | 0.898551 | FUT3 AND SLC39A10 | Colon | 1 | 1 | 1 |
| SYT11 AND TNFRSF13C | Glioma | 0.964539 | 0.944444 | 0.985507 | IFI6 AND XK | Colon | 0.909091 | 0.833333 | 1 |
| SYT11 AND CD38 | Glioma | 0.964539 | 0.944444 | 0.985507 | IFI6 AND TSPAN8 | Colon | 1 | 1 | 1 |
| SYT11 AND IL20RA | Glioma | 0.94964 | 0.942857 | 0.956522 | IFI6 AND ST14 | Colon | 1 | 1 | 1 |
| SYT11 AND CLDN9 | Glioma | 0.957143 | 0.943662 | 0.971014 | IFI6 AND PTPRH | Colon | 0.833333 | 0.714286 | 1 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SYT11 AND CD79A | Glioma | 0.964539 | 0.944444 | 0.985507 | CDH17 AND GJA4 | Colon | 0.888889 | 1 | 0.8 |
| SCN1A AND ITGAV | Glioma | 0.90625 | 0.983051 | 0.84058 | CDH17 AND PODXL | Colon | 0.888889 | 1 | 0.8 |
| SYT11 AND LGR5 | Glioma | 0.942029 | 0.942029 | 0.942029 | CDH17 AND TMED1 | Colon | 0.888889 | 1 | 0.8 |
| ITGAV AND SLC4A8 | Glioma | 0.882353 | 0.895522 | 0.869565 | CDH17 AND IL1RAP | Colon | 0.888889 | 1 | 0.8 |
| SYT11 AND VCAM1 | Glioma | 0.957143 | 0.943662 | 0.971014 | CDH17 AND LDLRAD3 | Colon | 0.888889 | 1 | 0.8 |
| SYT11 AND FOLR1 | Glioma | 0.964539 | 0.944444 | 0.985507 | IFI6 AND DUOX2 | Colon | 0.909091 | 0.833333 | 1 |
| SYT11 AND MUC13 | Glioma | 0.964539 | 0.944444 | 0.985507 | CDH17 AND CDH3 | Colon | 1 | 1 | 1 |
| SYT11 AND CLDN1 | Glioma | 0.964539 | 0.944444 | 0.985507 | IFI6 AND TNFRSF11A | Colon | 1 | 1 | 1 |
| SYT11 AND CD70 | Glioma | 0.956522 | 0.956522 | 0.956522 | IFI6 AND GPR35 | Colon | 1 | 1 | 1 |
| SYT11 AND EGFR | Glioma | 0.875 | 0.949153 | 0.811594 | IFI6 AND SI | Colon | 0.888889 | 1 | 0.8 |
| SYT11 AND CD79B | Glioma | 0.918519 | 0.939394 | 0.898551 | CXCL16 AND TM4SF5 | Esophagus | 0.782609 | 1 | 0.642857 |
| ITGAV AND SORL1 | Glioma | 0.916031 | 0.967742 | 0.869565 | CXCL16 AND SYT13 | Esophagus | 0.727273 | 1 | 0.571429 |
| SYT11 AND ENPP3 | Glioma | 0.926471 | 0.940299 | 0.913043 | CXCL16 AND B3GNT3 | Esophagus | 0.727273 | 1 | 0.571429 |
| GPR158 AND SLC39A6 | Glioma | 0.852941 | 0.865672 | 0.84058 | CXCL16 AND PTPRH | Esophagus | 0.6 | 0.5625 | 0.642857 |
| GPR19 AND EDNRB | Glioma | 0.878788 | 0.920635 | 0.84058 | PTPRZ1 AND SPAM1 | Glioblastoma | 0.903226 | 1 | 0.823529 |
| SYT11 AND CSPG4 | Glioma | 0.850394 | 0.931034 | 0.782609 | GPM6B AND F2R | Glioblastoma | 0.866667 | 1 | 0.764706 |
| LYPD1 AND ITGAV | Glioma | 0.904762 | 1 | 0.826087 | PTPRZ1 AND ADAM29 | Glioblastoma | 0.903226 | 1 | 0.823529 |
| NCAM1 AND LAPTM5 | Glioma | 0.873016 | 0.964912 | 0.797101 | PTPRZ1 AND STAB1 | Glioblastoma | 0.903226 | 1 | 0.823529 |
| SCN2A AND ITGAV | Glioma | 0.883721 | 0.95 | 0.826087 | PTPRZ1 AND F2R | Glioblastoma | 0.866667 | 1 | 0.764706 |
| ITGAV AND CNIH2 | Glioma | 0.880597 | 0.907692 | 0.855072 | NLGN4X AND LAPTM5 | Glioblastoma | 0.903226 | 1 | 0.823529 |
| MLC1 AND ITGAV | Glioma | 0.83871 | 0.945455 | 0.753623 | PTPRZ1 AND ANTXR2 | Glioblastoma | 0.903226 | 1 | 0.823529 |
| GPR19 AND SLC39A6 | Glioma | 0.836066 | 0.962264 | 0.73913 | PTPRZ1 AND LAPTM5 | Glioblastoma | 0.9375 | 1 | 0.882353 |
| FXYD6 AND ITGAV | Glioma | 0.840336 | 1 | 0.724638 | NRCAM AND TGFBI | Glioblastoma | 0.83871 | 0.928571 | 0.764706 |
| SLC22A16 AND CD37 | AML | 0.924949 | 0.942149 | 0.908367 | PTPRZ1 AND CXCL16 | Glioblastoma | 0.866667 | 1 | 0.764706 |
| SLC22A16 AND SLC7A5 | AML | 0.901734 | 0.873134 | 0.932271 | GPM6A AND F2R | Glioblastoma | 0.827586 | 1 | 0.705882 |
| SLC22A16 AND P2RX5 | AML | 0.874751 | 0.873016 | 0.876494 | GPM6A AND EMP3 | Glioblastoma | 0.827586 | 1 | 0.705882 |
| SLC22A16 AND ENG | AML | 0.859504 | 0.892704 | 0.828685 | NRCAM AND F2R | Glioblastoma | 0.827586 | 1 | 0.705882 |
| SLC22A16 AND IL11RA | AML | 0.824268 | 0.867841 | 0.784861 | PTPRZ1 AND BEST3 | Glioblastoma | 0.827586 | 1 | 0.705882 |
| CD37 AND SLC43A1 | AML | 0.772182 | 0.96988 | 0.641434 | NRCAM AND TNFRSF12A | Glioblastoma | 0.827586 | 1 | 0.705882 |
| TTYH3 AND CD276 | Liposarcoma | 0.638889 | 0.638889 | 0.638889 | PTPRZ1 AND TNFRSF12A | Glioblastoma | 0.827586 | 1 | 0.705882 |
| TTYH3 AND GPNMB | Liposarcoma | 0.637681 | 0.666667 | 0.611111 | PTPRZ1 AND PIRT | Glioblastoma | 0.866667 | 1 | 0.764706 |
| TTYH3 AND PTK7 | Liposarcoma | 0.608696 | 0.636364 | 0.583333 | PTPRZ1 AND IL17RA | Glioblastoma | 0.827586 | 1 | 0.705882 |
| ROR1 AND ESAM | Liposarcoma | 0.6 | 0.75 | 0.5 | MLC1 AND OR51B6 | Glioblastoma | 0.909091 | 0.9375 | 0.882353 |
| ROR1 AND PLVAP | Liposarcoma | 0.6 | 0.75 | 0.5 | PTPRZ1 AND LYPD1 | Glioblastoma | 0.875 | 0.933333 | 0.823529 |
| EPHB2 AND GYPC | Liposarcoma | 0.746988 | 0.659574 | 0.861111 | NRCAM AND LAPTM5 | Glioblastoma | 0.9375 | 1 | 0.882353 |
| EPHB2 AND CD93 | Liposarcoma | 0.697674 | 0.6 | 0.833333 | AQP4 AND SPAM1 | Glioblastoma | 0.827586 | 1 | 0.705882 |
| EMP3 AND FOLH1 | Liposarcoma | 0.722222 | 0.722222 | 0.722222 | NLGN1 AND LAPTM5 | Glioblastoma | 0.827586 | 1 | 0.705882 |
| STAB1 AND GPNMB | Liposarcoma | 0.705882 | 0.75 | 0.666667 | MLC1 AND FAM57A | Glioblastoma | 0.827586 | 1 | 0.705882 |
| EMP3 AND EPHB2 | Liposarcoma | 0.72 | 0.692308 | 0.75 | MLC1 AND BMPR1A | Glioblastoma | 0.8125 | 0.866667 | 0.764706 |
| CD163 AND EPHB2 | Liposarcoma | 0.694444 | 0.694444 | 0.694444 | PTPRZ1 AND TGFBI | Glioblastoma | 0.827586 | 1 | 0.705882 |
| ATP8B2 AND EPHB2 | Liposarcoma | 0.676923 | 0.758621 | 0.611111 | NRCAM AND HLA-DRB1 | Glioblastoma | 0.833333 | 0.789474 | 0.882353 |
| EPHB2 AND PHLDB2 | Liposarcoma | 0.641975 | 0.577778 | 0.722222 | SYT11 AND ADAM12 | Glioblastoma | 0.823529 | 0.823529 | 0.823529 |
| CD163 AND CD276 | Liposarcoma | 0.717949 | 0.666667 | 0.777778 | MLC1 AND SLC2A10 | Glioblastoma | 0.866667 | 1 | 0.764706 |
| STAB1 AND TPBG | Liposarcoma | 0.603175 | 0.703704 | 0.527778 | NRCAM AND CDH11 | Glioblastoma | 0.903226 | 1 | 0.823529 |
| SLC6A7 AND EPHB2 | Liposarcoma | 0.675325 | 0.634146 | 0.722222 | PTPRZ1 AND HLA-DRB1 | Glioblastoma | 0.903226 | 1 | 0.823529 |
| EPHB2 AND TGFBI | Liposarcoma | 0.657143 | 0.676471 | 0.638889 | PTPRZ1 AND CD93 | Glioblastoma | 0.827586 | 1 | 0.705882 |
| SLC34A2 AND SLC50A1 | Lung Adenocarcinoma | 0.612613 | 0.829268 | 0.485714 | NRCAM AND CXCL16 | Glioblastoma | 0.903226 | 1 | 0.823529 |
| EPCAM AND CD93 | Lung Adenocarcinoma | 0.601504 | 0.634921 | 0.571429 | GPM6A AND CD93 | Glioblastoma | 0.8 | 0.923077 | 0.705882 |
| SLC34A2 AND S1PR1 | Lung Adenocarcinoma | 0.614458 | 0.53125 | 0.728571 | GPM6A AND ANTXR2 | Glioblastoma | 0.8 | 0.923077 | 0.705882 |
| EPCAM AND CD163 | Lung Adenocarcinoma | 0.608 | 0.690909 | 0.542857 | SYT11 AND PCDH12 | Glioblastoma | 0.8 | 0.923077 | 0.705882 |
| SLC34A2 AND ESAM | Lung Adenocarcinoma | 0.608696 | 0.538462 | 0.7 | AQP4 AND ADAM29 | Glioblastoma | 0.8 | 0.923077 | 0.705882 |
| CD163 AND CLDN7 | Lung Adenocarcinoma | 0.62069 | 0.782609 | 0.514286 | MLC1 AND TNFRSF19 | Glioblastoma | 0.8 | 0.923077 | 0.705882 |
| SLC34A2 AND DYSF | Lung Adenocarcinoma | 0.604938 | 0.532609 | 0.7 | GPR158 AND ABCA1 | Glioblastoma | 0.8 | 0.777778 | 0.823529 |
| KCNJ10 AND GPNMB | B-Cell Diffuse | 0.739726 | 0.75 | 0.72973 | PTPRZ1 AND LRIG3 | Glioblastoma | 0.827586 | 1 | 0.705882 |
| CD79B AND KCNJ10 | B-Cell Diffuse | 0.727273 | 0.827586 | 0.648649 | NRCAM AND CD93 | Glioblastoma | 0.827586 | 1 | 0.705882 |
| CD180 AND KCNJ10 | B-Cell Diffuse | 0.722222 | 0.742857 | 0.702703 | NRCAM AND BTN3A3 | Glioblastoma | 0.833333 | 0.789474 | 0.882353 |
| CD79B AND SLC22A8 | B-Cell Diffuse | 0.716418 | 0.8 | 0.648649 | PTPRZ1 AND NKAIN4 | Glioblastoma | 0.8 | 0.923077 | 0.705882 |
| CD79B AND CDH11 | B-Cell Diffuse | 0.707692 | 0.821429 | 0.621622 | NRCAM AND VAMP8 | Glioblastoma | 0.882353 | 0.882353 | 0.882353 |
| CD79B AND GJD2 | B-Cell Diffuse | 0.707692 | 0.821429 | 0.621622 | PTPRZ1 AND SLC5A10 | Glioblastoma | 0.866667 | 1 | 0.764706 |
| KCNJ10 AND CD52 | B-Cell Diffuse | 0.702703 | 0.702703 | 0.702703 | GPM6B AND F2R | Glioma | 0.992701 | 1 | 0.985507 |
| CD79B AND SLC22A14 | B-Cell Diffuse | 0.695652 | 0.75 | 0.648649 | GPM6A AND F2R | Glioma | 0.992701 | 1 | 0.985507 |
| KCNJ10 AND CD37 | B-Cell Diffuse | 0.684932 | 0.694444 | 0.675676 | PTPRZ1 AND F2R | Glioma | 0.985294 | 1 | 0.971014 |
| CD79A AND KCNJ10 | B-Cell Diffuse | 0.685714 | 0.727273 | 0.648649 | SYT11 AND HLA-B | Glioma | 0.956522 | 0.956522 | 0.956522 |
| CD79B AND FAT1 | B-Cell Diffuse | 0.676471 | 0.741935 | 0.621622 | SYT11 AND SLC40A1 | Glioma | 0.956522 | 0.956522 | 0.956522 |
| CD72 AND KCNJ10 | B-Cell Diffuse | 0.676471 | 0.741935 | 0.621622 | NRCAM AND F2R | Glioma | 0.938462 | 1 | 0.884058 |
| CD79B AND CSPG5 | B-Cell Diffuse | 0.666667 | 0.71875 | 0.621622 | SYT11 AND TSPAN6 | Glioma | 0.970149 | 1 | 0.942029 |
| KCNJ10 AND CD38 | B-Cell Diffuse | 0.666667 | 0.657895 | 0.675676 | SYT11 AND ABCA1 | Glioma | 0.970588 | 0.985075 | 0.956522 |
| CD79A AND CDH11 | B-Cell Diffuse | 0.657534 | 0.666667 | 0.648649 | SYT11 AND PLGRKT | Glioma | 0.970149 | 1 | 0.942029 |
| CD79B AND AOC3 | B-Cell Diffuse | 0.6875 | 0.814815 | 0.594595 | SYT11 AND JAM2 | Glioma | 0.985294 | 1 | 0.971014 |
| FCRL5 AND CSPG5 | B-Cell Diffuse | 0.686567 | 0.766667 | 0.621622 | PTPRZ1 AND LAPTM5 | Glioma | 0.985507 | 0.985507 | 0.985507 |
| KCNJ10 AND TNFRSF17 | B-Cell Diffuse | 0.658228 | 0.619048 | 0.702703 | SYT11 AND JTB | Glioma | 0.962406 | 1 | 0.927536 |
| CD72 AND CDH11 | B-Cell Diffuse | 0.637681 | 0.6875 | 0.594595 | SYT11 AND ATRAID | Glioma | 0.985294 | 1 | 0.971014 |
| CD180 AND CDH11 | B-Cell Diffuse | 0.675 | 0.627907 | 0.72973 | SYT11 AND HLA-C | Glioma | 0.957143 | 0.943662 | 0.971014 |
| FCRL5 AND SLC22A8 | B-Cell Diffuse | 0.688525 | 0.875 | 0.567568 | SYT11 AND HLA-G | Glioma | 0.964539 | 0.944444 | 0.985507 |
| CD72 AND AOC3 | B-Cell Diffuse | 0.626866 | 0.7 | 0.567568 | PTPRZ1 AND SYT1 | Glioma | 0.985294 | 1 | 0.971014 |
| CD79B AND PLVAP | B-Cell Diffuse | 0.666667 | 0.807692 | 0.567568 | GPM6A AND BTN3A3 | Glioma | 0.970149 | 1 | 0.942029 |
| CD79B AND PROCR | B-Cell Diffuse | 0.622951 | 0.791667 | 0.513514 | PTPRZ1 AND BTN3A3 | Glioma | 0.962406 | 1 | 0.927536 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| KCNJ10 AND SLAMF7 | B-Cell Diffuse | 0.622222 | 0.528302 | 0.756757 | DDR2 AND ATP8B2 | Leiomyosarcoma | 0.761905 | 1 | 0.615385 |
| CD79B AND HTR1E | B-Cell Diffuse | 0.666667 | 0.807692 | 0.567568 | FLT3 AND EMP3 | AML | 0.944559 | 0.974576 | 0.916335 |
| FCRL5 AND SLC22A14 | B-Cell Diffuse | 0.625 | 0.740741 | 0.540541 | SLC22A16 AND HCST | AML | 0.939759 | 0.947368 | 0.932271 |
| CD72 AND FAT1 | B-Cell Diffuse | 0.619718 | 0.647059 | 0.594595 | SLC22A16 AND P2RX1 | AML | 0.937374 | 0.95082 | 0.924303 |
| P2RX5 AND CDH11 | B-Cell Diffuse | 0.637681 | 0.6875 | 0.594595 | SLC22A16 AND P2RY8 | AML | 0.928571 | 0.924901 | 0.932271 |
| P2RX5 AND KCNJ10 | B-Cell Diffuse | 0.666667 | 0.71875 | 0.621622 | CNTNAP1 AND CD163 | Liposarcoma | 0.8 | 0.823529 | 0.777778 |
| FCRL5 AND KCNJ10 | B-Cell Diffuse | 0.709677 | 0.88 | 0.594595 | ADAM12 AND KCNU1 | Liposarcoma | 0.740741 | 0.666667 | 0.833333 |
| FCRL5 AND SLCO1B3 | B-Cell Diffuse | 0.619048 | 0.553191 | 0.702703 | ADAM12 AND EMP3 | Liposarcoma | 0.727273 | 0.682927 | 0.777778 |
| FCRL5 AND GJD2 | B-Cell Diffuse | 0.62069 | 0.857143 | 0.486486 | ADAM12 AND SLC6A7 | Liposarcoma | 0.725 | 0.659091 | 0.805556 |
| FCRL5 AND GLRA2 | B-Cell Diffuse | 0.644068 | 0.863636 | 0.513514 | ADAM12 AND MDGA2 | Liposarcoma | 0.75 | 0.681818 | 0.833333 |
| P2RX5 AND SLC22A2 | Mantle-Cell Lymphoma | 0.897436 | 0.875 | 0.921053 | ADAM12 AND OR2C3 | Liposarcoma | 0.746988 | 0.659574 | 0.861111 |
| P2RX5 AND HCN2 | Mantle-Cell Lymphoma | 0.911392 | 0.878049 | 0.947368 | ADAM12 AND OR52D1 | Liposarcoma | 0.72093 | 0.62 | 0.861111 |
| P2RX5 AND ADCY10 | Mantle-Cell Lymphoma | 0.888889 | 0.837209 | 0.947368 | ADAM12 AND CSMD2 | Liposarcoma | 0.746988 | 0.659574 | 0.861111 |
| P2RX5 AND PVRL1 | Mantle-Cell Lymphoma | 0.891892 | 0.916667 | 0.868421 | ADAM12 AND SV2C | Liposarcoma | 0.738095 | 0.645833 | 0.861111 |
| P2RX5 AND NTSR2 | Mantle-Cell Lymphoma | 0.878049 | 0.818182 | 0.947368 | ADAM12 AND HLA-DRB1 | Liposarcoma | 0.707317 | 0.630435 | 0.805556 |
| P2RX5 AND GHSR | Mantle-Cell Lymphoma | 0.906667 | 0.918919 | 0.894737 | ADAM12 AND DRD1 | Liposarcoma | 0.765432 | 0.688889 | 0.861111 |
| P2RX5 AND SLC30A8 | Mantle-Cell Lymphoma | 0.911392 | 0.878049 | 0.947368 | ADAM12 AND LCT | Liposarcoma | 0.729412 | 0.632653 | 0.861111 |
| P2RX5 AND PCDHGC4 | Mantle-Cell Lymphoma | 0.861111 | 0.911765 | 0.815789 | ADAM12 AND TRHR | Liposarcoma | 0.738095 | 0.645833 | 0.861111 |
| P2RX5 AND NKAIN4 | Mantle-Cell Lymphoma | 0.88 | 0.891892 | 0.868421 | ADAM12 AND KCNV2 | Liposarcoma | 0.756098 | 0.673913 | 0.861111 |
| P2RX5 AND CDH22 | Mantle-Cell Lymphoma | 0.9 | 0.857143 | 0.947368 | ADAM12 AND ADAM7 | Liposarcoma | 0.759494 | 0.697674 | 0.833333 |
| P2RX5 AND GRIN2B | Mantle-Cell Lymphoma | 0.853659 | 0.795455 | 0.921053 | ADAM12 AND GABRA3 | Liposarcoma | 0.746988 | 0.659574 | 0.861111 |
| P2RX5 AND MC2R | Mantle-Cell Lymphoma | 0.86747 | 0.8 | 0.947368 | ADAM12 AND OR8B2 | Liposarcoma | 0.705882 | 0.612245 | 0.833333 |
| P2RX5 AND CACNG1 | Mantle-Cell Lymphoma | 0.875 | 0.833333 | 0.921053 | ADAM12 AND OR3A1 | Liposarcoma | 0.714286 | 0.625 | 0.833333 |
| P2RX5 AND ADAM7 | Mantle-Cell Lymphoma | 0.85 | 0.809524 | 0.894737 | ADAM12 AND GRIN2B | Liposarcoma | 0.698795 | 0.617021 | 0.805556 |
| CD79B AND HTR5A | Mantle-Cell Lymphoma | 0.848485 | 1 | 0.736842 | ADAM12 AND GPR85 | Liposarcoma | 0.696629 | 0.584906 | 0.861111 |
| CD79B AND HCN2 | Mantle-Cell Lymphoma | 0.848485 | 1 | 0.736842 | ADAM12 AND CACNG4 | Liposarcoma | 0.696629 | 0.584906 | 0.861111 |
| P2RX5 AND GPR6 | Mantle-Cell Lymphoma | 0.876712 | 0.914286 | 0.842105 | ADAM12 AND NMBR | Liposarcoma | 0.734177 | 0.674419 | 0.805556 |
| P2RX5 AND CYP4A11 | Mantle-Cell Lymphoma | 0.842105 | 0.842105 | 0.842105 | ADAM12 AND TRPM8 | Liposarcoma | 0.738095 | 0.645833 | 0.861111 |
| P2RX5 AND GJD2 | Mantle-Cell Lymphoma | 0.933333 | 0.945946 | 0.921053 | ADAM12 AND PCDHA9 | Liposarcoma | 0.738095 | 0.645833 | 0.861111 |
| P2RX5 AND HTR5A | Mantle-Cell Lymphoma | 0.897436 | 0.875 | 0.921053 | ADAM12 AND GLRA3 | Liposarcoma | 0.717949 | 0.666667 | 0.777778 |
| P2RX5 AND DISP2 | Mantle-Cell Lymphoma | 0.86747 | 0.8 | 0.947368 | ADAM12 AND GRM4 | Liposarcoma | 0.691358 | 0.622222 | 0.777778 |
| CD79B AND ADCY10 | Mantle-Cell Lymphoma | 0.835821 | 0.965517 | 0.736842 | ADAM12 AND GYPC | Liposarcoma | 0.688889 | 0.574074 | 0.861111 |
| CD79B AND SLC30A8 | Mantle-Cell Lymphoma | 0.835821 | 0.965517 | 0.736842 | ADAM12 AND LRRTM4 | Liposarcoma | 0.684211 | 0.65 | 0.722222 |
| CD79B AND AMHR2 | Mantle-Cell Lymphoma | 0.835821 | 0.965517 | 0.736842 | ADAM12 AND FCAMR | Liposarcoma | 0.756098 | 0.673913 | 0.861111 |
| CD79B AND EPHA8 | Mantle-Cell Lymphoma | 0.835821 | 0.965517 | 0.736842 | ADAM12 AND P2RY4 | Liposarcoma | 0.681818 | 0.576923 | 0.833333 |
| P2RX5 AND HTR1D | Mantle-Cell Lymphoma | 0.835443 | 0.804878 | 0.868421 | ADAM12 AND MLANA | Liposarcoma | 0.722892 | 0.638298 | 0.833333 |
| MS4A1 AND NTSR2 | Mantle-Cell Lymphoma | 0.835165 | 0.716981 | 1 | ADAM12 AND SLCO6A1 | Liposarcoma | 0.729412 | 0.632653 | 0.861111 |
| MS4A1 AND SLC22A9 | Mantle-Cell Lymphoma | 0.835165 | 0.716981 | 1 | ADAM12 AND ACSL6 | Liposarcoma | 0.674699 | 0.595745 | 0.777778 |
| P2RX5 AND AMHR2 | Mantle-Cell Lymphoma | 0.9 | 0.857143 | 0.947368 | ADAM12 AND ATP8B2 | Liposarcoma | 0.722222 | 0.722222 | 0.722222 |
| P2RX5 AND PIRT | Mantle-Cell Lymphoma | 0.833333 | 0.882353 | 0.789474 | ADAM12 AND GPR83 | Liposarcoma | 0.740741 | 0.666667 | 0.833333 |
| P2RX5 AND EPHA8 | Mantle-Cell Lymphoma | 0.923077 | 0.9 | 0.947368 | TTYH3 AND LRP1 | Liposarcoma | 0.686567 | 0.741935 | 0.638889 |
| P2RX5 AND SLC22A14 | Mantle-Cell Lymphoma | 0.911392 | 0.878049 | 0.947368 | GJC1 AND LAPTM5 | Liposarcoma | 0.666667 | 0.6 | 0.75 |
| CD79B AND GJD2 | Mantle-Cell Lymphoma | 0.830769 | 1 | 0.710526 | ADAM12 AND GABRG2 | Liposarcoma | 0.659341 | 0.545455 | 0.833333 |
| CD79B AND GHSR | Mantle-Cell Lymphoma | 0.830769 | 1 | 0.710526 | ADAM12 AND BEST3 | Liposarcoma | 0.753247 | 0.707317 | 0.805556 |
| CD79B AND FSHR | Mantle-Cell Lymphoma | 0.830769 | 1 | 0.710526 | ADAM12 AND ADAM21 | Liposarcoma | 0.658537 | 0.586957 | 0.75 |
| P2RX5 AND CNTNAP4 | Mantle-Cell Lymphoma | 0.829268 | 0.772727 | 0.894737 | ADAM12 AND CD74 | Liposarcoma | 0.658537 | 0.586957 | 0.75 |
| P2RX5 AND ROS1 | Mantle-Cell Lymphoma | 0.828571 | 0.90625 | 0.763158 | TTYH3 AND PKD2 | Liposarcoma | 0.657143 | 0.676471 | 0.638889 |
| P2RX5 AND OR2L2 | Mantle-Cell Lymphoma | 0.853659 | 0.795455 | 0.921053 | CNTNAP1 AND LAPTM5 | Liposarcoma | 0.777778 | 0.777778 | 0.777778 |
| P2RX5 AND GPR12 | Mantle-Cell Lymphoma | 0.876712 | 0.914286 | 0.842105 | TTYH3 AND COLEC12 | Liposarcoma | 0.647887 | 0.657143 | 0.638889 |
| P2RX5 AND JPH3 | Mantle-Cell Lymphoma | 0.827586 | 0.734694 | 0.947368 | TTYH3 AND PDGFRB | Liposarcoma | 0.647059 | 0.6875 | 0.611111 |
| MS4A1 AND HTR5A | Mantle-Cell Lymphoma | 0.826087 | 0.703704 | 1 | ADAM12 AND CATSPERD | Liposarcoma | 0.64 | 0.615385 | 0.666667 |
| MS4A1 AND ADCY10 | Mantle-Cell Lymphoma | 0.826087 | 0.703704 | 1 | TTYH3 AND DCHS1 | Liposarcoma | 0.638889 | 0.638889 | 0.638889 |
| P2RX5 AND GABRB2 | Mantle-Cell Lymphoma | 0.825 | 0.785714 | 0.868421 | TTYH3 AND FAT4 | Liposarcoma | 0.637681 | 0.666667 | 0.611111 |
| P2RX5 AND SCN1A | Mantle-Cell Lymphoma | 0.825 | 0.785714 | 0.868421 | CD163 AND PCDH7 | Liposarcoma | 0.658228 | 0.604651 | 0.722222 |
| P2RX5 AND SLC2A1 | Mantle-Cell Lymphoma | 0.846154 | 0.825 | 0.868421 | ADAM12 AND LAPTM5 | Liposarcoma | 0.634146 | 0.565217 | 0.722222 |
| P2RX5 AND OR2C3 | Mantle-Cell Lymphoma | 0.829268 | 0.772727 | 0.894737 | EMP3 AND SLC2A10 | Liposarcoma | 0.75 | 0.75 | 0.75 |
| CD79B AND OR10J1 | Mantle-Cell Lymphoma | 0.823529 | 0.933333 | 0.736842 | GPR34 AND SLC6A7 | Liposarcoma | 0.630137 | 0.621622 | 0.638889 |
| CD79B AND MC2R | Mantle-Cell Lymphoma | 0.823529 | 0.933333 | 0.736842 | TTYH3 AND PCDH12 | Liposarcoma | 0.630137 | 0.621622 | 0.638889 |
| CD79B AND CLDN20 | Mantle-Cell Lymphoma | 0.823529 | 0.933333 | 0.736842 | TTYH3 AND MMP14 | Liposarcoma | 0.647887 | 0.657143 | 0.638889 |
| CD79B AND SLC22A14 | Mantle-Cell Lymphoma | 0.823529 | 0.933333 | 0.736842 | ADAM12 AND MUC12 | Liposarcoma | 0.717949 | 0.666667 | 0.777778 |
| P2RX5 AND LCT | Mantle-Cell Lymphoma | 0.823529 | 0.744681 | 0.921053 | TTYH3 AND SGCD | Liposarcoma | 0.625 | 0.714286 | 0.555556 |
| P2RX5 AND CHRNB2 | Mantle-Cell Lymphoma | 0.878049 | 0.818182 | 0.947368 | ADAM12 AND GPR22 | Liposarcoma | 0.623656 | 0.508772 | 0.805556 |
| P2RX5 AND GPRC6A | Mantle-Cell Lymphoma | 0.820513 | 0.8 | 0.842105 | ATP8B2 AND SLC2A10 | Liposarcoma | 0.717949 | 0.666667 | 0.777778 |
| P2RX5 AND KCNA7 | Mantle-Cell Lymphoma | 0.857143 | 0.846154 | 0.868421 | TTYH3 AND PLXDC1 | Liposarcoma | 0.622951 | 0.76 | 0.527778 |
| P2RX5 AND GRM5 | Mantle-Cell Lymphoma | 0.842105 | 0.842105 | 0.842105 | TTYH3 AND EMP1 | Liposarcoma | 0.621622 | 0.605263 | 0.638889 |
| P2RX5 AND OR10J1 | Mantle-Cell Lymphoma | 0.819277 | 0.755556 | 0.894737 | TTYH3 AND CNTNAP1 | Liposarcoma | 0.621622 | 0.605263 | 0.638889 |
| P2RX5 AND TRPM3 | Mantle-Cell Lymphoma | 0.819277 | 0.755556 | 0.894737 | TTYH3 AND VASN | Liposarcoma | 0.621622 | 0.605263 | 0.638889 |
| P2RX5 AND CEACAM7 | Mantle-Cell Lymphoma | 0.819277 | 0.755556 | 0.894737 | ADAM12 AND SLC17A1 | Liposarcoma | 0.621622 | 0.605263 | 0.638889 |
| P2RX5 AND SLC1A6 | Mantle-Cell Lymphoma | 0.819277 | 0.755556 | 0.894737 | TTYH3 AND PLXNA1 | Liposarcoma | 0.621622 | 0.605263 | 0.638889 |
| P2RX5 AND LRFN2 | Mantle-Cell Lymphoma | 0.84507 | 0.909091 | 0.789474 | TTYH3 AND SLC2A10 | Liposarcoma | 0.619718 | 0.628571 | 0.611111 |
| P2RX5 AND SLC22A9 | Mantle-Cell Lymphoma | 0.878049 | 0.818182 | 0.947368 | OLR1 AND SLC50A1 | Lung Adenocarcinoma | 0.655172 | 0.826087 | 0.542857 |
| CD79B AND NKAIN4 | Mantle-Cell Lymphoma | 0.818182 | 0.964286 | 0.710526 | OSMR AND SLC50A1 | Lung Adenocarcinoma | 0.625 | 0.833333 | 0.5 |
| CD79B AND CDH22 | Mantle-Cell Lymphoma | 0.818182 | 0.964286 | 0.710526 | BST2 AND TLCD1 | Lung Adenocarcinoma | 0.619469 | 0.813953 | 0.5 |
| CD79B AND SLC1A6 | Mantle-Cell Lymphoma | 0.818182 | 0.964286 | 0.710526 | PON2 AND CD44 | Lung Adenocarcinoma | 0.62069 | 0.782609 | 0.514286 |
| P2RX5 AND TMEM235 | Mantle-Cell Lymphoma | 0.818182 | 0.72 | 0.947368 | PON2 AND IFNAR2 | Lung Adenocarcinoma | 0.641509 | 0.944444 | 0.485714 |
| MS4A1 AND CLDN20 | Mantle-Cell Lymphoma | 0.817204 | 0.690909 | 1 | SLC50A1 AND FZD6 | Lung Adenocarcinoma | 0.62069 | 0.782609 | 0.514286 |
| P2RX5 AND FSHR | Mantle-Cell Lymphoma | 0.906667 | 0.918919 | 0.894737 | KCNJ10 AND CD53 | B-Cell Diffuse | 0.759494 | 0.714286 | 0.810811 |

FIG. 11 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CD79B AND GPR6 | Mantle-Cell Lymphoma | 0.8125 | 1 | 0.684211 | PTPRCAP AND KCNJ10 | B-Cell Diffuse | 0.722222 | 0.742857 | 0.702703 |
| CD79B AND ADAM7 | Mantle-Cell Lymphoma | 0.8125 | 1 | 0.684211 | CD48 AND KCNJ10 | B-Cell Diffuse | 0.724638 | 0.78125 | 0.675676 |
| CD79B AND LRFN2 | Mantle-Cell Lymphoma | 0.8125 | 1 | 0.684211 | IL2RB AND FAT1 | Anaplastic Lymphoma | 0.64 | 0.8 | 0.533333 |
| CD79B AND SLCO1A2 | Mantle-Cell Lymphoma | 0.8125 | 1 | 0.684211 | CXCL9 AND GPR19 | T-Cell, Peripheral | 0.75 | 0.75 | 0.75 |
| CD79B AND GPR12 | Mantle-Cell Lymphoma | 0.8125 | 1 | 0.684211 | CXCL9 AND KCNJ10 | T-Cell, Peripheral | 0.769231 | 0.833333 | 0.714286 |
| CD79B AND CLDN15 | Mantle-Cell Lymphoma | 0.811594 | 0.903226 | 0.736842 | CXCL9 AND SEMA4D | T-Cell, Peripheral | 0.784314 | 0.869565 | 0.714286 |
| CD79B AND GPR50 | Mantle-Cell Lymphoma | 0.811594 | 0.903226 | 0.736842 | CXCL9 AND TTYH2 | T-Cell, Peripheral | 0.714286 | 0.714286 | 0.714286 |
| CD79B AND HRH3 | Mantle-Cell Lymphoma | 0.811594 | 0.903226 | 0.736842 | CXCL9 AND SLC38A1 | T-Cell, Peripheral | 0.652174 | 0.833333 | 0.535714 |
| EDNRB AND GPR19 | Melanoma | 0.9 | 1 | 0.818182 | BCAP31 AND TTYH2 | Melanoma | 0.952381 | 1 | 0.909091 |
| EDNRB AND LRIG3 | Melanoma | 0.9 | 1 | 0.818182 | GPR137B AND KCNN2 | Melanoma | 0.9 | 1 | 0.818182 |
| EDNRB AND ZACN | Melanoma | 0.9 | 1 | 0.818182 | PLP2 AND SLC6A15 | Melanoma | 0.9 | 1 | 0.818182 |
| EDNRB AND FAT1 | Melanoma | 0.9 | 1 | 0.818182 | BCAP31 AND EMP3 | Melanoma | 0.952381 | 1 | 0.909091 |
| EDNRB AND EFNB2 | Melanoma | 0.9 | 1 | 0.818182 | TNFSF9 AND GPR137B | Melanoma | 0.952381 | 1 | 0.909091 |
| EDNRB AND GHR | Melanoma | 0.9 | 1 | 0.818182 | C11orf24 AND GPR137B | Melanoma | 0.9 | 1 | 0.818182 |
| EDNRB AND SLC22A18 | Melanoma | 0.9 | 1 | 0.818182 | NKAIN4 AND PTPRZ1 | Oligodendroglioma | 0.888889 | 1 | 0.8 |
| NKAIN1 AND CBX3 | Neuroblastoma | 0.866242 | 0.931507 | 0.809524 | KCNK15 AND CSPG5 | Ovarian | 0.8 | 1 | 0.666667 |
| NKAIN1 AND ALK | Neuroblastoma | 0.867925 | 0.92 | 0.821429 | KCNK15 AND EPHA10 | Ovarian | 0.785714 | 0.6875 | 0.916667 |
| GPR19 AND PTK7 | Neuroblastoma | 0.854054 | 0.782178 | 0.940476 | KCNK15 AND SLC2A1 | Ovarian | 0.758621 | 0.647059 | 0.916667 |
| GPR19 AND GPNMB | Neuroblastoma | 0.842105 | 0.827586 | 0.857143 | KCNK15 AND NMUR2 | Ovarian | 0.75 | 0.75 | 0.75 |
| ALK AND CD163 | Neuroblastoma | 0.840764 | 0.90411 | 0.785714 | ADAM12 AND EMP3 | Sarcoma | 1 | 1 | 1 |
| KCNQ2 AND CBX3 | Neuroblastoma | 0.839506 | 0.871795 | 0.809524 | CD99 AND PCDHA9 | Sarcoma | 0.740741 | 1 | 0.588235 |
| CACNA1B AND CD276 | Neuroblastoma | 0.836957 | 0.77 | 0.916667 | ADAM12 AND SLC6A7 | Sarcoma | 0.8125 | 0.866667 | 0.764706 |
| SYT11 AND ALK | Neuroblastoma | 0.840764 | 0.90411 | 0.785714 | ADAM12 AND KCNU1 | Sarcoma | 0.75 | 0.652174 | 0.882353 |
| SLC1A2 AND EGFR | Oligodendroglioma | 0.933333 | 0.933333 | 0.933333 | CDH17 AND FXYD5 | Stomach | 0.911111 | 0.87234 | 0.953488 |
| CSPG5 AND EGFR | Oligodendroglioma | 0.888889 | 1 | 0.8 | CDH17 AND CDH3 | Stomach | 0.8 | 0.765957 | 0.837209 |
| OMG AND EGFR | Oligodendroglioma | 0.857143 | 0.923077 | 0.8 | CDH17 AND TACSTD2 | Stomach | 0.911392 | 1 | 0.837209 |
| KCNJ10 AND EGFR | Oligodendroglioma | 0.933333 | 0.933333 | 0.933333 | CDH17 AND EDNRA | Stomach | 0.876404 | 0.847826 | 0.906977 |
| MLC1 AND EGFR | Oligodendroglioma | 0.896552 | 0.928571 | 0.866667 | CDH17 AND PDPN | Stomach | 0.83871 | 0.78 | 0.906977 |
| DTNA AND EGFR | Oligodendroglioma | 0.888889 | 1 | 0.8 | CDH17 AND MCAM | Stomach | 0.727273 | 0.597015 | 0.930233 |
| ASTN1 AND EGFR | Oligodendroglioma | 0.888889 | 1 | 0.8 | CDH17 AND CDH5 | Stomach | 0.829787 | 0.764706 | 0.906977 |
| CDH10 AND EGFR | Oligodendroglioma | 0.857143 | 0.923077 | 0.8 | CDH17 AND IFITM2 | Stomach | 0.824742 | 0.740741 | 0.930233 |
| GPR19 AND EGFR | Oligodendroglioma | 0.903226 | 0.875 | 0.933333 | VSIG1 AND TNFRSF12A | Stomach | 0.714286 | 0.925926 | 0.581395 |
| UNC5A AND EGFR | Oligodendroglioma | 0.846154 | 1 | 0.733333 | VSIG1 AND VANGL1 | Stomach | 0.714286 | 0.925926 | 0.581395 |
| GPR158 AND EGFR | Oligodendroglioma | 0.8 | 0.8 | 0.8 | CDH17 AND APOLD1 | Stomach | 0.780952 | 0.66129 | 0.953488 |
| OPCML AND EGFR | Oligodendroglioma | 0.8 | 0.8 | 0.8 | VSIG1 AND FAT1 | Stomach | 0.705882 | 0.96 | 0.55814 |
| SEZ6 AND EGFR | Oligodendroglioma | 0.928571 | 1 | 0.866667 | VSIG1 AND PROCR | Stomach | 0.704225 | 0.892857 | 0.581395 |
| FXYD6 AND EGFR | Oligodendroglioma | 0.928571 | 1 | 0.866667 | CDH17 AND OSMR | Stomach | 0.866667 | 0.829787 | 0.906977 |
| CSPG5 AND EDNRB | Oligodendroglioma | 0.8 | 0.8 | 0.8 | CDH17 AND C5AR1 | Stomach | 0.822222 | 0.787234 | 0.860465 |
| ASTN1 AND CSPG4 | Oligodendroglioma | 0.8 | 0.7 | 0.933333 | VSIG1 AND CDH11 | Stomach | 0.695652 | 0.923077 | 0.55814 |
| BEST3 AND BMPR1B | Oligodendroglioma | 0.866667 | 0.866667 | 0.866667 | CDH17 AND PDGFRB | Stomach | 0.853933 | 0.826087 | 0.883721 |
| CSPG5 AND MUC13 | Oligodendroglioma | 0.888889 | 1 | 0.8 | CDH17 AND LDLRAD3 | Stomach | 0.690265 | 0.557143 | 0.906977 |
| BEST3 AND SLC7A5 | Oligodendroglioma | 0.777778 | 0.666667 | 0.933333 | VSIG1 AND EFNB2 | Stomach | 0.684932 | 0.833333 | 0.581395 |
| MLC1 AND CD38 | Oligodendroglioma | 0.774194 | 0.75 | 0.8 | CDH17 AND ANO1 | Stomach | 0.894118 | 0.904762 | 0.883721 |
| KCNC1 AND EGFR | Oligodendroglioma | 0.774194 | 0.75 | 0.8 | CDH17 AND GJA4 | Stomach | 0.716981 | 0.603175 | 0.883721 |
| CSPG5 AND FOLR1 | Oligodendroglioma | 0.774194 | 0.75 | 0.8 | CDH17 AND CALCRL | Stomach | 0.823529 | 0.833333 | 0.813953 |
| MLC1 AND MUC1 | Oligodendroglioma | 0.785714 | 0.846154 | 0.733333 | CDH17 AND PODXL | Stomach | 0.847059 | 0.857143 | 0.837209 |
| CSPG5 AND CLDN18 | Oligodendroglioma | 0.827586 | 0.857143 | 0.8 | CDH17 AND SLC2A3 | Stomach | 0.690909 | 0.567164 | 0.883721 |
| CSPG5 AND VTCN1 | Oligodendroglioma | 0.846154 | 1 | 0.733333 | VSIG1 AND EPHA2 | Stomach | 0.676923 | 1 | 0.511628 |
| LRRTM4 AND EGFR | Oligodendroglioma | 0.764706 | 0.684211 | 0.866667 | CDH17 AND FCGR3B | Stomach | 0.771084 | 0.8 | 0.744186 |
| GABBR2 AND EGFR | Oligodendroglioma | 0.764706 | 0.684211 | 0.866667 | CDH17 AND CD81 | Stomach | 0.718447 | 0.616667 | 0.860465 |
| CSPG5 AND MUC1 | Oligodendroglioma | 0.764706 | 0.684211 | 0.866667 | VSIG1 AND LRIG3 | Stomach | 0.675676 | 0.806452 | 0.581395 |
| DTNA AND MUC13 | Oligodendroglioma | 0.764706 | 0.684211 | 0.866667 | CDH17 AND CXCL9 | Stomach | 0.707317 | 0.74359 | 0.674419 |
| BEST3 AND SLC39A6 | Oligodendroglioma | 0.823529 | 0.736842 | 0.933333 | CDH17 AND SLC41A1 | Stomach | 0.727273 | 0.597015 | 0.930233 |
| MLC1 AND VTCN1 | Oligodendroglioma | 0.8 | 1 | 0.666667 | TSPAN8 AND BST2 | Stomach | 0.724638 | 0.961538 | 0.581395 |
| SLC1A2 AND VTCN1 | Oligodendroglioma | 0.814815 | 0.916667 | 0.733333 | ATP8B1 AND FXYD5 | Stomach | 0.91358 | 0.973684 | 0.860465 |
| SLC1A2 AND PTK7 | Oligodendroglioma | 0.8 | 1 | 0.666667 | VSIG1 AND F2R | Stomach | 0.714286 | 0.925926 | 0.581395 |
| CSPG5 AND GUCY2C | Oligodendroglioma | 0.758621 | 0.785714 | 0.733333 | VSIG1 AND CDH17 | Stomach | 0.735294 | 1 | 0.581395 |
| DTNA AND MUC1 | Oligodendroglioma | 0.769231 | 0.909091 | 0.666667 | CDH17 AND ABCC1 | Stomach | 0.880952 | 0.902439 | 0.860465 |
| KCNJ10 AND CD276 | Oligodendroglioma | 0.8125 | 0.764706 | 0.866667 | CDH17 AND PLXDC1 | Stomach | 0.813187 | 0.770833 | 0.860465 |
| SLCO1C1 AND EGFR | Oligodendroglioma | 0.827586 | 0.857143 | 0.8 | CDH17 AND SLC29A1 | Stomach | 0.772277 | 0.672414 | 0.906977 |
| CSPG5 AND CA9 | Oligodendroglioma | 0.756757 | 0.636364 | 0.933333 | CDH17 AND RHBDF2 | Stomach | 0.752688 | 0.7 | 0.813953 |
| MUC16 AND SYT11 | Ovarian | 0.736842 | 1 | 0.583333 | VSIG1 AND TTYH3 | Stomach | 0.666667 | 0.827586 | 0.55814 |
| EPHA10 AND VTCN1 | Ovarian | 0.666667 | 1 | 0.5 | VSIG1 AND SLC1A5 | Stomach | 0.675676 | 0.806452 | 0.581395 |
| MUC16 AND CSPG5 | Ovarian | 0.666667 | 1 | 0.5 | CDH17 AND DIO2 | Stomach | 0.66 | 0.578947 | 0.767442 |
| MUC16 AND PPAPDC1A | Ovarian | 0.666667 | 0.777778 | 0.583333 | CDH17 AND F2RL2 | Stomach | 0.9 | 0.972973 | 0.837209 |
| MUC16 AND LAMP5 | Ovarian | 0.631579 | 0.857143 | 0.5 | MUC17 AND CDH3 | Stomach | 0.788732 | 1 | 0.651163 |
| MUC16 AND GPRC6A | Ovarian | 0.631579 | 0.857143 | 0.5 | ATP8B1 AND CXCR4 | Stomach | 0.826667 | 0.96875 | 0.72093 |
| MUC16 AND KCNU1 | Ovarian | 0.608696 | 0.636364 | 0.583333 | VSIG1 AND CD82 | Stomach | 0.657895 | 0.757576 | 0.581395 |
| TRPM8 AND EPCAM | Prostate | 0.857143 | 1 | 0.75 | VSIG1 AND BST2 | Stomach | 0.675676 | 0.806452 | 0.581395 |
| STEAP2 AND SLC43A1 | Prostate | 1 | 1 | 1 | | | | | |

FIG. 12

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| VANGL2 AND NOT-TACSTD2 | Astrocytoma | 0.8387 | 0.8298 | 0.8478 | FGFR4 AND NOT-IL3RA | Liver | 0.8 | 1 | 0.6667 |
| VANGL2 AND NOT-AQP3 | Astrocytoma | 0.8298 | 0.8125 | 0.8478 | LRP5 AND NOT-TPBG | Liver | 0.8333 | 0.8333 | 0.8333 |
| VANGL2 AND NOT-FXYD3 | Astrocytoma | 0.8298 | 0.8125 | 0.8478 | FGFR4 AND NOT-CD52 | Liver | 0.8 | 1 | 0.6667 |
| VANGL2 AND NOT-PERP | Astrocytoma | 0.8298 | 0.8125 | 0.8478 | FGFR4 AND NOT-IL20RA | Liver | 0.8 | 1 | 0.6667 |
| VANGL2 AND NOT-F11R | Astrocytoma | 0.8261 | 0.8261 | 0.8261 | FGFR4 AND NOT-FOLR1 | Liver | 0.8 | 1 | 0.6667 |
| VANGL2 AND NOT-KRT5 | Astrocytoma | 0.8211 | 0.7959 | 0.8478 | FGFR4 AND NOT-CD33 | Liver | 0.8 | 1 | 0.6667 |
| VANGL2 AND NOT-DUOX1 | Astrocytoma | 0.8211 | 0.7959 | 0.8478 | FGFR4 AND NOT-CD37 | Liver | 0.8 | 1 | 0.6667 |
| VANGL2 AND NOT-SMAGP | Astrocytoma | 0.8125 | 0.78 | 0.8478 | SLC4A2 AND NOT-PTK7 | Liver | 0.8 | 1 | 0.6667 |
| PTPRZ1 AND NOT-SLC2A12 | Astrocytoma | 0.8119 | 0.7455 | 0.8913 | FGFR4 AND NOT-PMEL | Liver | 0.8 | 1 | 0.6667 |
| NRCAM AND NOT-TENM2 | Astrocytoma | 0.8046 | 0.8537 | 0.7609 | FGFR4 AND NOT-TNFRSF17 | Liver | 0.8 | 1 | 0.6667 |
| PTPRZ1 AND NOT-MTUS1 | Astrocytoma | 0.8041 | 0.7647 | 0.8478 | FGFR4 AND NOT-MS4A1 | Liver | 0.8 | 1 | 0.6667 |
| PTPRZ1 AND NOT-ABCC5 | Astrocytoma | 0.8039 | 0.7321 | 0.8913 | FGFR4 AND NOT-CD22 | Liver | 0.8 | 1 | 0.6667 |
| PTPRZ1 AND NOT-LRP11 | Astrocytoma | 0.8039 | 0.7321 | 0.8913 | FGFR4 AND NOT-ERBB2 | Liver | 0.8 | 1 | 0.6667 |
| VANGL2 AND NOT-CDH1 | Astrocytoma | 0.8 | 0.8182 | 0.7826 | FGFR4 AND NOT-MUC16 | Liver | 0.8 | 1 | 0.6667 |
| PTPRZ1 AND NOT-FZD7 | Astrocytoma | 0.7921 | 0.7273 | 0.8696 | FGFR4 AND NOT-SSTR2 | Liver | 0.8 | 1 | 0.6667 |
| PTPRZ1 AND NOT-CNST | Astrocytoma | 0.7921 | 0.7273 | 0.8696 | FGFR4 AND NOT-GUCY2C | Liver | 0.8 | 1 | 0.6667 |
| PTPRZ1 AND NOT-SACM1L | Astrocytoma | 0.7885 | 0.7069 | 0.8913 | FGFR4 AND NOT-EPHB2 | Liver | 0.8 | 1 | 0.6667 |
| VANGL2 AND NOT-TMEM30B | Astrocytoma | 0.7879 | 0.7358 | 0.8478 | FGFR4 AND NOT-CD70 | Liver | 0.8 | 1 | 0.6667 |
| VANGL2 AND NOT-DSG2 | Astrocytoma | 0.7872 | 0.7708 | 0.8043 | FGFR4 AND NOT-CD79A | Liver | 0.8 | 1 | 0.6667 |
| VANGL2 AND NOT-ST14 | Astrocytoma | 0.7865 | 0.814 | 0.7609 | FGFR4 AND NOT-FCRL5 | Liver | 0.8 | 1 | 0.6667 |
| VANGL2 AND NOT-PLP2 | Astrocytoma | 0.7835 | 0.7451 | 0.8261 | FGFR4 AND NOT-ERBB4 | Liver | 0.8 | 1 | 0.6667 |
| PTPRZ1 AND NOT-FZD10 | Astrocytoma | 0.781 | 0.6949 | 0.8913 | FGFR4 AND NOT-CR2 | Liver | 0.8 | 1 | 0.6667 |
| PTPRZ1 AND NOT-FAM73B | Astrocytoma | 0.781 | 0.6949 | 0.8913 | FGFR4 AND NOT-FCRL2 | Liver | 0.8 | 1 | 0.6667 |
| PTPRZ1 AND NOT-PLXNA2 | Astrocytoma | 0.7789 | 0.7551 | 0.8043 | FGFR4 AND NOT-CD79B | Liver | 0.8 | 1 | 0.6667 |
| PTPRZ1 AND NOT-ANO3 | Astrocytoma | 0.7789 | 0.7551 | 0.8043 | FGFR4 AND NOT-CLDN8 | Liver | 0.8 | 1 | 0.6667 |
| ADAM12 AND NOT-GPBAR1 | Breast | 0.8654 | 0.9 | 0.8333 | FGFR4 AND NOT-L1CAM | Liver | 0.8 | 1 | 0.6667 |
| ADAM12 AND NOT-TRPC6 | Breast | 0.8627 | 0.9167 | 0.8148 | FGFR4 AND NOT-PTK7 | Liver | 0.8 | 1 | 0.6667 |
| ADAM12 AND NOT-F10 | Breast | 0.8462 | 0.88 | 0.8148 | FGFR4 AND NOT-PROM1 | Liver | 0.8 | 1 | 0.6667 |
| ADAM12 AND NOT-GLDN | Breast | 0.8462 | 0.88 | 0.8148 | FGFR4 AND NOT-MUC13 | Liver | 0.8 | 1 | 0.6667 |
| ADAM12 AND NOT-TNFRSF10D | Breast | 0.8462 | 0.88 | 0.8148 | FGFR4 AND NOT-SLC7A5 | Liver | 0.8 | 1 | 0.6667 |
| ADAM12 AND NOT-AVPR1A | Breast | 0.8462 | 0.88 | 0.8148 | FGFR4 AND NOT-TRPM4 | Liver | 0.8 | 1 | 0.6667 |
| ADAM12 AND NOT-JAM3 | Breast | 0.8411 | 0.8491 | 0.8333 | FGFR4 AND NOT-CD180 | Liver | 0.8 | 1 | 0.6667 |
| ADAM12 AND NOT-NAALAD2 | Breast | 0.8333 | 0.8333 | 0.8333 | FGFR4 AND NOT-CLDN23 | Liver | 0.8 | 1 | 0.6667 |
| ADAM12 AND NOT-SLC16A7 | Breast | 0.8302 | 0.8462 | 0.8148 | FGFR4 AND NOT-MUC4 | Liver | 0.8 | 1 | 0.6667 |
| ADAM12 AND NOT-CXCR2 | Breast | 0.8283 | 0.9111 | 0.7599 | FGFR4 AND NOT-MST1R | Liver | 0.8 | 1 | 0.6667 |
| ADAM12 AND NOT-F3 | Breast | 0.8257 | 0.8182 | 0.8333 | FGFR4 AND NOT-CD19 | Liver | 0.8 | 1 | 0.6667 |
| ADAM12 AND NOT-FCGR3B | Breast | 0.8247 | 0.9302 | 0.7407 | SLC4A2 AND NOT-CLDN11 | Liver | 0.8 | 1 | 0.6667 |
| ADAM12 AND NOT-GPR87 | Breast | 0.8235 | 0.875 | 0.7778 | SLC4A2 AND NOT-IGF1R | Liver | 0.8 | 1 | 0.6667 |
| ADAM12 AND NOT-SLC22A3 | Breast | 0.8224 | 0.8302 | 0.8148 | APOB AND NOT-PROM1 | Liver | 0.7273 | 0.8 | 0.6667 |
| ADAM12 AND NOT-KLB | Breast | 0.8182 | 0.8036 | 0.8333 | SLC4A2 AND NOT-ITGB6 | Liver | 0.8 | 1 | 0.6667 |
| ADAM12 AND NOT-OLR1 | Breast | 0.8182 | 0.8036 | 0.8333 | ITPR2 AND NOT-CLDN8 | Liver | 0.8333 | 0.8333 | 0.8333 |
| ADAM12 AND NOT-C14orf180 | Breast | 0.8182 | 0.8036 | 0.8333 | SLC4A2 AND NOT-CSPG4 | Liver | 0.8 | 1 | 0.6667 |
| ADAM12 AND NOT-PLXNA4 | Breast | 0.8182 | 0.8036 | 0.8333 | SLC4A2 AND NOT-PROM1 | Liver | 0.8 | 1 | 0.6667 |
| ADAM12 AND NOT-PPAP2A | Breast | 0.8182 | 0.8036 | 0.8333 | FGFR4 AND NOT-TNFSF11 | Liver | 0.8 | 1 | 0.6667 |
| ADAM12 AND NOT-SLC4A4 | Breast | 0.8182 | 0.8036 | 0.8333 | FGFR4 AND NOT-FAP | Liver | 0.8 | 1 | 0.6667 |
| ADAM12 AND NOT-APOB | Breast | 0.8182 | 0.8036 | 0.8333 | FAP AND NOT-PTPRS | Pancreas | 0.8421 | 1 | 0.7273 |
| ADAM12 AND NOT-SCN3A | Breast | 0.8182 | 0.8036 | 0.8333 | FAP AND NOT-SDC2 | Pancreas | 0.7059 | 1 | 0.5455 |
| ADAM12 AND NOT-ENPEP | Breast | 0.8182 | 0.8036 | 0.8333 | FAP AND NOT-KCNMA1 | Pancreas | 0.7778 | 1 | 0.6364 |
| ADAM12 AND NOT-SGCB | Breast | 0.8182 | 0.8036 | 0.8333 | FAP AND NOT-TGFBR3 | Pancreas | 0.7778 | 1 | 0.6364 |
| ADAM12 AND NOT-DPP4 | Breast | 0.8182 | 0.8036 | 0.8333 | FAP AND NOT-LIFR | Pancreas | 0.7778 | 1 | 0.6364 |
| ADAM12 AND NOT-SCN9A | Breast | 0.8182 | 0.8036 | 0.8333 | FAP AND NOT-GJC1 | Pancreas | 0.8421 | 1 | 0.7273 |
| ADAM12 AND NOT-ATP8B4 | Breast | 0.8182 | 0.8036 | 0.8333 | FAP AND NOT-PCDH19 | Pancreas | 0.8421 | 1 | 0.7273 |
| ADAM12 AND NOT-ABCC9 | Breast | 0.8182 | 0.8036 | 0.8333 | FAP AND NOT-CALHM2 | Pancreas | 0.7778 | 1 | 0.6364 |
| ADAM12 AND NOT-SIGLEC6 | Breast | 0.8182 | 0.8036 | 0.8333 | FAP AND NOT-PTGER3 | Pancreas | 0.7778 | 1 | 0.6364 |
| ADAM12 AND NOT-CD300LG | Breast | 0.8182 | 0.8036 | 0.8333 | FAP AND NOT-ESYT1 | Pancreas | 0.7778 | 1 | 0.6364 |
| ADAM12 AND NOT-ERVFRD-1 | Breast | 0.8182 | 0.8036 | 0.8333 | FAP AND NOT-ITGA7 | Pancreas | 0.7778 | 1 | 0.6364 |
| ADAM12 AND NOT-SLC52A1 | Breast | 0.8182 | 0.8036 | 0.8333 | FAP AND NOT-SGMS1 | Pancreas | 0.7059 | 1 | 0.5455 |
| ADAM12 AND NOT-SMAGP | Breast | 0.8182 | 0.8036 | 0.8333 | FAP AND NOT-CAV1 | Pancreas | 0.7778 | 1 | 0.6364 |
| ADAM12 AND NOT-CDH6 | Breast | 0.8182 | 0.8036 | 0.8333 | FAP AND NOT-SLC47A1 | Pancreas | 0.8421 | 1 | 0.7273 |
| ADAM12 AND NOT-CDH5 | Breast | 0.8182 | 0.8036 | 0.8333 | FAP AND NOT-NRXN3 | Pancreas | 0.7778 | 1 | 0.6364 |
| ADAM12 AND NOT-CAV2 | Breast | 0.8182 | 0.8036 | 0.8333 | FAP AND NOT-BVES | Pancreas | 0.7778 | 1 | 0.6364 |
| ADAM12 AND NOT-MCAM | Breast | 0.8182 | 0.8036 | 0.8333 | FAP AND NOT-REEP2 | Pancreas | 0.7059 | 1 | 0.5455 |
| ADAM12 AND NOT-ITM2A | Breast | 0.8155 | 0.8571 | 0.7778 | FAP AND NOT-SLC2A12 | Pancreas | 0.7778 | 1 | 0.6364 |
| ADAM12 AND NOT-MME | Breast | 0.8155 | 0.8571 | 0.7778 | FAP AND NOT-PTH1R | Pancreas | 0.7778 | 1 | 0.6364 |
| ADAM12 AND NOT-FCGR2B | Breast | 0.8148 | 0.8148 | 0.8148 | FAP AND NOT-ADCY4 | Pancreas | 0.8421 | 1 | 0.7273 |
| ADAM12 AND NOT-C15orf27 | Breast | 0.8148 | 0.8148 | 0.8148 | FAP AND NOT-ECSCR | Pancreas | 0.8421 | 1 | 0.7273 |
| ADAM12 AND NOT-PAG1 | Breast | 0.8148 | 0.8148 | 0.8148 | FAP AND NOT-RECK | Pancreas | 0.7059 | 1 | 0.5455 |
| ADAM12 AND NOT-ACPP | Breast | 0.8148 | 0.8148 | 0.8148 | FAP AND NOT-PRLR | Pancreas | 0.8421 | 1 | 0.7273 |
| ADAM12 AND NOT-KL | Breast | 0.8148 | 0.8148 | 0.8148 | FAP AND NOT-EMCN | Pancreas | 0.8421 | 1 | 0.7273 |
| ADAM12 AND NOT-ADCYAP1R1 | Breast | 0.8148 | 0.8148 | 0.8148 | FAP AND NOT-ADRA2C | Pancreas | 0.8421 | 1 | 0.7273 |
| ADAM12 AND NOT-PVRL3 | Breast | 0.8148 | 0.8148 | 0.8148 | FAP AND NOT-PEAR1 | Pancreas | 0.7778 | 1 | 0.6364 |
| ADAM12 AND NOT-SLC13A4 | Breast | 0.8148 | 0.8148 | 0.8148 | FAP AND NOT-JAM2 | Pancreas | 0.7778 | 1 | 0.6364 |
| ADAM12 AND NOT-KIRREL | Breast | 0.8119 | 0.8723 | 0.7593 | FAP AND NOT-AVPR1A | Pancreas | 0.7778 | 1 | 0.6364 |
| ADAM12 AND NOT-IL1R1 | Breast | 0.8119 | 0.8723 | 0.7593 | FAP AND NOT-ABCG2 | Pancreas | 0.7059 | 1 | 0.5455 |
| ADAM12 AND NOT-PCDH18 | Breast | 0.8113 | 0.8269 | 0.7963 | FAP AND NOT-SCN4B | Pancreas | 0.7059 | 1 | 0.5455 |
| ADAM12 AND NOT-P2RY1 | Breast | 0.8113 | 0.8269 | 0.7963 | FAP AND NOT-PTGFR | Pancreas | 0.8421 | 1 | 0.7273 |
| ADAM12 AND NOT-PTH1R | Breast | 0.8113 | 0.8269 | 0.7963 | FAP AND NOT-ST6GALNAC6 | Pancreas | 0.7778 | 1 | 0.6364 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ADAM12 AND NOT-TRHDE | Breast | 0.8077 | 0.84 | 0.7778 | FAP AND NOT-TSPAN7 | Pancreas | 0.7778 | 1 | 0.6364 |
| ADAM12 AND NOT-GPR146 | Breast | 0.8073 | 0.8 | 0.8148 | FAP AND NOT-SLC16A1 | Pancreas | 0.7059 | 1 | 0.5455 |
| ADAM12 AND NOT-LYVE1 | Breast | 0.8073 | 0.8 | 0.8148 | FAP AND NOT-GPR161 | Pancreas | 0.625 | 1 | 0.4545 |
| ADAM12 AND NOT-TUSC3 | Breast | 0.8073 | 0.8 | 0.8148 | FAP AND NOT-FGFR1 | Pancreas | 0.625 | 1 | 0.4545 |
| ADAM12 AND NOT-ADRB1 | Breast | 0.8073 | 0.8 | 0.8148 | FAP AND NOT-FZD7 | Pancreas | 0.625 | 1 | 0.4545 |
| ADAM12 AND NOT-GJA5 | Breast | 0.8073 | 0.8 | 0.8148 | FAP AND NOT-NDRG4 | Pancreas | 0.8421 | 1 | 0.7273 |
| ADAM12 AND NOT-CAV1 | Breast | 0.8073 | 0.8 | 0.8148 | FAP AND NOT-KCNB1 | Pancreas | 0.8421 | 1 | 0.7273 |
| ADAM12 AND NOT-THSD7A | Breast | 0.8073 | 0.8 | 0.8148 | FAP AND NOT-PRIMA1 | Pancreas | 0.7778 | 1 | 0.6364 |
| GPRC5A AND NOT-BMP2 | Breast | 0.8235 | 0.875 | 0.7778 | FAP AND NOT-TRPC1 | Pancreas | 0.7059 | 1 | 0.5455 |
| ADAM12 AND NOT-NT5E | Breast | 0.8037 | 0.8113 | 0.7963 | FAP AND NOT-FZD4 | Pancreas | 0.7778 | 1 | 0.6364 |
| ADAM12 AND NOT-ENPP2 | Breast | 0.8037 | 0.8113 | 0.7963 | FAP AND NOT-TMEM25 | Pancreas | 0.625 | 1 | 0.4545 |
| ADAM12 AND NOT-IL1RAP | Breast | 0.8037 | 0.8113 | 0.7963 | FAP AND NOT-TMEM231 | Pancreas | 0.7059 | 1 | 0.5455 |
| ADAM12 AND NOT-SLC31A2 | Breast | 0.8 | 0.8235 | 0.7778 | CDH6 AND NOT-ERBB4 | Renal | 0.8571 | 1 | 0.75 |
| ADAM12 AND NOT-BMP2 | Breast | 0.8 | 0.8696 | 0.7407 | CDH6 AND NOT-BMPR1B | Renal | 0.8571 | 1 | 0.75 |
| ADAM12 AND NOT-HTR2B | Breast | 0.7963 | 0.7963 | 0.7963 | CDH6 AND NOT-CLDN11 | Renal | 0.8571 | 1 | 0.75 |
| ADAM12 AND NOT-C10orf54 | Breast | 0.7963 | 0.7963 | 0.7963 | CDH6 AND NOT-IL11RA | Renal | 0.8571 | 1 | 0.75 |
| ADAM12 AND NOT-CHL1 | Breast | 0.7963 | 0.7963 | 0.7963 | CDH6 AND NOT-FAP | Renal | 0.8571 | 1 | 0.75 |
| ADAM12 AND NOT-TLR4 | Breast | 0.7963 | 0.7963 | 0.7963 | CDH6 AND NOT-MUC16 | Renal | 0.8571 | 1 | 0.75 |
| ADAM12 AND NOT-SGCG | Breast | 0.7963 | 0.7963 | 0.7963 | CDH6 AND NOT-IL13RA1 | Renal | 0.8571 | 1 | 0.75 |
| ADAM12 AND NOT-SLC7A6 | Breast | 0.7963 | 0.7963 | 0.7963 | CDH6 AND NOT-CLDN8 | Renal | 0.8571 | 1 | 0.75 |
| ADAM12 AND NOT-SLC28A2 | Breast | 0.7963 | 0.7963 | 0.7963 | CDH6 AND NOT-SLC7A5 | Renal | 0.8571 | 1 | 0.75 |
| ADAM12 AND NOT-LEPR | Breast | 0.7961 | 0.8367 | 0.7593 | CDH6 AND NOT-LGR5 | Renal | 0.8571 | 1 | 0.75 |
| SLC27A5 AND NOT-CLEC1B | Liver | 0.9091 | 1 | 0.8333 | CDH6 AND NOT-CLDN6 | Renal | 0.8571 | 1 | 0.75 |
| FGG AND NOT-CLEC1B | Liver | 0.9091 | 1 | 0.8333 | CDH6 AND NOT-SSTR2 | Renal | 0.8571 | 1 | 0.75 |
| HPN AND NOT-CLEC1B | Liver | 0.9091 | 1 | 0.8333 | CDH6 AND NOT-CSPG4 | Renal | 0.8571 | 1 | 0.75 |
| FGG AND NOT-MARCO | Liver | 0.8571 | 0.75 | 1 | CDH6 AND NOT-FCRL1 | Renal | 0.8571 | 1 | 0.75 |
| HPN AND NOT-MARCO | Liver | 0.8571 | 0.75 | 1 | CDH6 AND NOT-CD276 | Renal | 0.8571 | 1 | 0.75 |
| ABCC6 AND NOT-CLEC1B | Liver | 0.8333 | 0.8333 | 0.8333 | CDH6 AND NOT-IL2RA | Renal | 0.8571 | 1 | 0.75 |
| APOB AND NOT-CDHR2 | Liver | 0.8333 | 0.8333 | 0.8333 | CDH6 AND NOT-CR2 | Renal | 0.8571 | 1 | 0.75 |
| HPN AND NOT-KCNN2 | Liver | 1 | 1 | 1 | CDH6 AND NOT-ULBP2 | Renal | 0.8571 | 1 | 0.75 |
| ABCB4 AND NOT-CLEC1B | Liver | 0.9091 | 1 | 0.8333 | CDH6 AND NOT-P2RX5 | Renal | 0.8571 | 1 | 0.75 |
| SLC27A5 AND NOT-GPR182 | Liver | 0.8 | 1 | 0.6667 | CDH6 AND NOT-PMEL | Renal | 0.8571 | 1 | 0.75 |
| ABCC6 AND NOT-CLEC4G | Liver | 0.8 | 1 | 0.6667 | CDH6 AND NOT-SSTR1 | Renal | 0.8571 | 1 | 0.75 |
| SCARB1 AND NOT-LYVE1 | Liver | 0.8 | 1 | 0.6667 | CDH6 AND NOT-CLDN12 | Renal | 0.8571 | 1 | 0.75 |
| SLC4A2 AND NOT-ATP1B3 | Liver | 0.8 | 1 | 0.6667 | CDH6 AND NOT-MUC1 | Renal | 0.8571 | 1 | 0.75 |
| SLC4A2 AND NOT-PMP22 | Liver | 0.8 | 1 | 0.6667 | CDH6 AND NOT-FOLH1 | Renal | 0.8571 | 1 | 0.75 |
| GJB1 AND NOT-CLEC1B | Liver | 0.8 | 1 | 0.6667 | CDH6 AND NOT-FCRL2 | Renal | 0.8571 | 1 | 0.75 |
| HPN AND NOT-CLEC4G | Liver | 0.8 | 1 | 0.6667 | CDH6 AND NOT-RNF43 | Renal | 0.8571 | 1 | 0.75 |
| SLC27A5 AND NOT-CLEC4G | Liver | 0.8 | 1 | 0.6667 | CDH6 AND NOT-CD72 | Renal | 0.8571 | 1 | 0.75 |
| SLC4A2 AND NOT-KCNN4 | Liver | 0.8 | 1 | 0.6667 | CDH6 AND NOT-MUC13 | Renal | 0.8 | 1 | 0.6667 |
| SLC4A2 AND NOT-JAM2 | Liver | 0.8 | 1 | 0.6667 | KCNJ16 AND NOT-ERBB4 | Renal | 0.8 | 1 | 0.6667 |
| FGG AND NOT-CLEC4G | Liver | 0.8 | 1 | 0.6667 | CDH6 AND NOT-AXL | Renal | 0.8 | 1 | 0.6667 |
| FGG AND NOT-CLEC4M | Liver | 0.8 | 1 | 0.6667 | CDH6 AND NOT-TNFRSF17 | Renal | 0.8 | 1 | 0.6667 |
| SLC4A2 AND NOT-SLC24A3 | Liver | 0.8 | 1 | 0.6667 | CDH6 AND NOT-TRPM4 | Renal | 0.8571 | 1 | 0.75 |
| ABCC6 AND NOT-CLEC4M | Liver | 0.8 | 1 | 0.6667 | CDH6 AND NOT-PTK7 | Renal | 0.8571 | 1 | 0.75 |
| ABCC6 AND NOT-VIPR1 | Liver | 0.8 | 1 | 0.6667 | CDH6 AND NOT-GPA33 | Renal | 0.8571 | 1 | 0.75 |
| SLC4A2 AND NOT-JAM3 | Liver | 0.8 | 1 | 0.6667 | CDH6 AND NOT-IL20RA | Renal | 0.8571 | 1 | 0.75 |
| HPN AND NOT-CLEC4M | Liver | 0.8 | 1 | 0.6667 | CDH6 AND NOT-CLDN18 | Renal | 0.8571 | 1 | 0.75 |
| ABCC6 AND NOT-MARCO | Liver | 0.8 | 0.6667 | 1 | CDH6 AND NOT-ENG | Renal | 0.8571 | 1 | 0.75 |
| SLC27A5 AND NOT-PTH1R | Liver | 0.8 | 1 | 0.6667 | CDH6 AND NOT-ROR1 | Renal | 0.8 | 1 | 0.6667 |
| SLC27A5 AND NOT-CLEC4M | Liver | 0.8 | 1 | 0.6667 | CDH6 AND NOT-EPHB2 | Renal | 0.8 | 1 | 0.6667 |
| SLC4A2 AND NOT-SLC44A2 | Liver | 0.8 | 1 | 0.6667 | CDH6 AND NOT-ERBB2 | Renal | 0.8571 | 1 | 0.75 |
| SLC4A2 AND NOT-CLSTN1 | Liver | 0.8 | 1 | 0.6667 | CDH6 AND NOT-EGFR | Renal | 0.8571 | 1 | 0.75 |
| SLC4A2 AND NOT-MARVELD1 | Liver | 0.8 | 1 | 0.6667 | CDH6 AND NOT-SLC39A6 | Renal | 0.8 | 1 | 0.6667 |
| GJB1 AND NOT-CLEC4G | Liver | 0.8 | 1 | 0.6667 | CDH6 AND NOT-STEAP2 | Renal | 0.8571 | 1 | 0.75 |
| SMO AND NOT-GPM6B | Liver | 0.8 | 1 | 0.6667 | CDH6 AND NOT-STEAP1 | Renal | 0.8571 | 1 | 0.75 |
| SLC27A5 AND NOT-MARCO | Liver | 0.8 | 0.6667 | 1 | CDH6 AND NOT-GUCY2C | Renal | 0.8571 | 1 | 0.75 |
| ASGR1 AND NOT-CLEC1B | Liver | 0.8 | 1 | 0.6667 | CDH6 AND NOT-IGF1R | Renal | 0.8571 | 1 | 0.75 |
| SLC4A2 AND NOT-CD320 | Liver | 0.8 | 1 | 0.6667 | CDH6 AND NOT-CLDN23 | Renal | 0.8 | 1 | 0.6667 |
| FGG AND NOT-GPR182 | Liver | 0.8 | 1 | 0.6667 | CDH6 AND NOT-SSTR3 | Renal | 0.8571 | 1 | 0.75 |
| SLC4A2 AND NOT-PDPN | Liver | 0.8 | 1 | 0.6667 | CDH6 AND NOT-ITGB6 | Renal | 0.8 | 1 | 0.6667 |
| HPN AND NOT-GPR182 | Liver | 0.8 | 1 | 0.6667 | CDH6 AND NOT-CD180 | Renal | 0.8571 | 1 | 0.75 |
| GJB1 AND NOT-CLEC4M | Liver | 0.8 | 1 | 0.6667 | CDH6 AND NOT-RAET1E | Renal | 0.8571 | 1 | 0.75 |
| GJB1 AND NOT-MARCO | Liver | 0.8 | 1 | 0.6667 | CDH6 AND NOT-MUC4 | Renal | 0.8571 | 1 | 0.75 |
| HPN AND NOT-PTH1R | Liver | 0.8 | 1 | 0.6667 | CDH6 AND NOT-EPHA3 | Renal | 0.8571 | 1 | 0.75 |
| SLC4A2 AND NOT-TGFB3 | Liver | 0.8 | 1 | 0.6667 | CDH6 AND NOT-IL3RA | Renal | 0.8571 | 1 | 0.75 |
| SMO AND NOT-PLA2R1 | Liver | 0.8 | 1 | 0.6667 | CDH6 AND NOT-SSTR4 | Renal | 0.8571 | 1 | 0.75 |
| SLC4A2 AND NOT-FZD7 | Liver | 0.8 | 1 | 0.6667 | CDH6 AND NOT-CD22 | Renal | 0.8571 | 1 | 0.75 |
| TFR2 AND NOT-CLEC1B | Liver | 0.8 | 1 | 0.6667 | CDH6 AND NOT-CLDN9 | Renal | 0.8 | 1 | 0.6667 |
| HPN AND NOT-STAB2 | Liver | 0.8 | 1 | 0.6667 | CDH6 AND NOT-TNFRSF8 | Renal | 0.8571 | 1 | 0.75 |
| KCNE4 AND NOT-TSPAN18 | Pancreas | 0.64 | 0.5714 | 0.7273 | CDH6 AND NOT-CLDN1 | Renal | 0.8571 | 1 | 0.75 |
| NOX4 AND NOT-PTH1R | Pancreas | 0.6316 | 0.75 | 0.5455 | CDH6 AND NOT-TNFRSF10A | Renal | 0.8 | 1 | 0.6667 |
| TREM2 AND NOT-FXYD1 | Pancreas | 0.625 | 1 | 0.4545 | CDH6 AND NOT-TNFSF11 | Renal | 0.8 | 1 | 0.6667 |
| CDH6 AND NOT-CNTN1 | Renal | 0.8571 | 1 | 0.75 | CDH6 AND NOT-FCRL5 | Renal | 0.8571 | 1 | 0.75 |
| CDH6 AND NOT-COL25A1 | Renal | 0.8571 | 1 | 0.75 | CDH6 AND NOT-CD38 | Renal | 0.8 | 1 | 0.6667 |
| CDH6 AND NOT-FAM26E | Renal | 0.8571 | 1 | 0.75 | CDH6 AND NOT-MS4A1 | Renal | 0.8 | 1 | 0.6667 |
| CDH6 AND NOT-TRPM7 | Renal | 0.8571 | 1 | 0.75 | CDH6 AND NOT-CD79A | Renal | 0.8 | 1 | 0.6667 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CDH6 AND NOT-SCN7A | Renal | 0.8571 | 1 | 0.75 | CDH6 AND NOT-CD79B | Renal | 0.8571 | 1 | 0.75 |
| CDH16 AND NOT-SCNN1B | Renal | 0.8571 | 1 | 0.75 | CDH6 AND NOT-CLDN5 | Renal | 0.8571 | 1 | 0.75 |
| CDH6 AND NOT-DST | Renal | 0.8571 | 1 | 0.75 | CDH6 AND NOT-VTCN1 | Renal | 0.8571 | 1 | 0.75 |
| CDH6 AND NOT-ANTXR1 | Renal | 0.8571 | 1 | 0.75 | CDH6 AND NOT-SSTR5 | Renal | 0.8 | 1 | 0.6667 |
| CDH6 AND NOT-USP48 | Renal | 0.8571 | 1 | 0.75 | CDH6 AND NOT-TPBG | Renal | 0.8 | 1 | 0.6667 |
| CDH6 AND NOT-KCNE1 | Renal | 0.8571 | 1 | 0.75 | CDH6 AND NOT-SDC1 | Renal | 0.8 | 1 | 0.6667 |
| CDH6 AND NOT-KIRREL | Renal | 0.8571 | 1 | 0.75 | CDH6 AND NOT-MST1R | Renal | 0.8571 | 1 | 0.75 |
| CDH6 AND NOT-BMPR2 | Renal | 0.8571 | 1 | 0.75 | SLC3A1 AND NOT-LGR5 | Renal | 0.7826 | 0.8182 | 0.75 |
| CDH6 AND NOT-MRAP2 | Renal | 0.8571 | 1 | 0.75 | CDH16 AND NOT-LGR5 | Renal | 0.7826 | 0.8182 | 0.75 |
| CDH6 AND NOT-ZDHHC20 | Renal | 0.8571 | 1 | 0.75 | CDH16 AND NOT-CLDN8 | Renal | 0.7619 | 0.8889 | 0.6667 |
| CDH6 AND NOT-BMPR1A | Renal | 0.8571 | 1 | 0.75 | DPEP1 AND NOT-SLC16A7 | Colon | 1 | 1 | 1 |
| CDH6 AND NOT-SLC20A2 | Renal | 0.8571 | 1 | 0.75 | DPEP1 AND NOT-GP2 | Colon | 1 | 1 | 1 |
| CDH6 AND NOT-BVES | Renal | 0.8571 | 1 | 0.75 | DPEP1 AND NOT-ZP2 | Colon | 1 | 1 | 1 |
| CDH6 AND NOT-ADAM23 | Renal | 0.8571 | 1 | 0.75 | DPEP1 AND NOT-SLC22A7 | Colon | 1 | 1 | 1 |
| CDH6 AND NOT-SLC2A12 | Renal | 0.8571 | 1 | 0.75 | DPEP1 AND NOT-P2RX6 | Colon | 1 | 1 | 1 |
| CDH6 AND NOT-GPR39 | Renal | 0.8571 | 1 | 0.75 | MUC13 AND NOT-FLVCR2 | Colon | 0.9091 | 0.8333 | 1 |
| CDH6 AND NOT-NRP2 | Renal | 0.8571 | 1 | 0.75 | GUCY2C AND NOT-FLVCR2 | Colon | 0.9091 | 0.8333 | 1 |
| CDH6 AND NOT-SLC12A2 | Renal | 0.8571 | 1 | 0.75 | DPEP1 AND NOT-KCNJ13 | Colon | 1 | 1 | 1 |
| CDH6 AND NOT-ST3GAL5 | Renal | 0.8571 | 1 | 0.75 | DPEP1 AND NOT-RTP1 | Colon | 1 | 1 | 1 |
| CDH6 AND NOT-ATP11C | Renal | 0.8571 | 1 | 0.75 | DPEP1 AND NOT-OR2C1 | Colon | 1 | 1 | 1 |
| CDH6 AND NOT-PLA2R1 | Renal | 0.8571 | 1 | 0.75 | DPEP1 AND NOT-SLC5A12 | Colon | 1 | 1 | 1 |
| CDH6 AND NOT-GPR173 | Renal | 0.8571 | 1 | 0.75 | DPEP1 AND NOT-OR10H1 | Colon | 1 | 1 | 1 |
| CDH6 AND NOT-SLC8A1 | Renal | 0.8571 | 1 | 0.75 | DPEP1 AND NOT-GRM2 | Colon | 0.9091 | 0.8333 | 1 |
| CDH6 AND NOT-PDGFRA | Renal | 0.8571 | 1 | 0.75 | GPA33 AND NOT-FLVCR2 | Colon | 0.9091 | 0.8333 | 1 |
| CDH6 AND NOT-FAT3 | Renal | 0.8571 | 1 | 0.75 | CLDN7 AND NOT-SLC22A23 | Colon | 0.9091 | 0.8333 | 1 |
| CDH6 AND NOT-PCDH9 | Renal | 0.8571 | 1 | 0.75 | DPEP1 AND NOT-NTRK3 | Colon | 1 | 1 | 1 |
| CDH6 AND NOT-BACE1 | Renal | 0.8571 | 1 | 0.75 | EPHB2 AND NOT-VSIG2 | Colon | 0.8889 | 1 | 0.8 |
| CDH6 AND NOT-OXGR1 | Renal | 0.8571 | 1 | 0.75 | EPHB2 AND NOT-CNNM4 | Colon | 0.8889 | 1 | 0.8 |
| CDH6 AND NOT-CRIM1 | Renal | 0.8571 | 1 | 0.75 | CLDN2 AND NOT-SLC16A7 | Colon | 0.8889 | 1 | 0.8 |
| CDH6 AND NOT-FLRT2 | Renal | 0.8571 | 1 | 0.75 | CLDN2 AND NOT-SLC19A3 | Colon | 0.8889 | 1 | 0.8 |
| CDH6 AND NOT-TRPV1 | Renal | 0.8571 | 1 | 0.75 | GPA33 AND NOT-SEMA4G | Colon | 0.8889 | 1 | 0.8 |
| CDH6 AND NOT-TGFBR1 | Renal | 0.8571 | 1 | 0.75 | EPHB2 AND NOT-FLVCR2 | Colon | 0.8889 | 1 | 0.8 |
| CDH6 AND NOT-RELL1 | Renal | 0.8571 | 1 | 0.75 | CLDN2 AND NOT-P2RX6 | Colon | 0.8889 | 1 | 0.8 |
| CDH6 AND NOT-CLCN3 | Renal | 0.8571 | 1 | 0.75 | EPHB2 AND NOT-NEO1 | Colon | 0.8889 | 1 | 0.8 |
| CDH6 AND NOT-ATP11B | Renal | 0.8571 | 1 | 0.75 | EPHB2 AND NOT-ATP2A3 | Colon | 0.8889 | 1 | 0.8 |
| CDH6 AND NOT-SLMAP | Renal | 0.8571 | 1 | 0.75 | CLDN2 AND NOT-ABCC2 | Colon | 0.8889 | 1 | 0.8 |
| CDH6 AND NOT-ATP13A3 | Renal | 0.8571 | 1 | 0.75 | EPHB2 AND NOT-SLC4A4 | Colon | 0.8889 | 1 | 0.8 |
| CDH6 AND NOT-GPM6B | Renal | 0.8571 | 1 | 0.75 | EPHB2 AND NOT-F2RL1 | Colon | 0.8889 | 1 | 0.8 |
| CDH6 AND NOT-CYBRD1 | Renal | 0.8571 | 1 | 0.75 | DPEP1 AND NOT-OR10A5 | Colon | 0.8889 | 1 | 0.8 |
| CDH6 AND NOT-WLS | Renal | 0.8571 | 1 | 0.75 | CLDN2 AND NOT-ADRA1B | Colon | 0.8889 | 1 | 0.8 |
| CDH6 AND NOT-SYT1 | Renal | 0.8571 | 1 | 0.75 | DPEP1 AND NOT-CYSLTR2 | Colon | 0.8889 | 1 | 0.8 |
| CDH6 AND NOT-ADAM22 | Renal | 0.8571 | 1 | 0.75 | DPEP1 AND NOT-CACNA1I | Colon | 0.8889 | 1 | 0.8 |
| CDH6 AND NOT-COLEC12 | Renal | 0.8571 | 1 | 0.75 | GUCY2C AND NOT-SEMA4G | Colon | 0.8889 | 1 | 0.8 |
| CDH6 AND NOT-GPR63 | Renal | 0.8571 | 1 | 0.75 | DPEP1 AND NOT-CYP4F2 | Colon | 0.8889 | 1 | 0.8 |
| CDH6 AND NOT-TPM1 | Renal | 0.8571 | 1 | 0.75 | PMEPA1 AND NOT-IL11RA | Colon | 0.8889 | 1 | 0.8 |
| CDH6 AND NOT-TMEM65 | Renal | 0.8571 | 1 | 0.75 | EPHB2 AND NOT-ADCY6 | Colon | 0.8889 | 1 | 0.8 |
| CDH6 AND NOT-IL6ST | Renal | 0.8571 | 1 | 0.75 | DPEP1 AND NOT-SPN | Colon | 0.8889 | 1 | 0.8 |
| CDH6 AND NOT-SLC12A6 | Renal | 0.8571 | 1 | 0.75 | MUC13 AND NOT-SEMA4G | Colon | 0.8889 | 1 | 0.8 |
| CDH6 AND NOT-ACVR2A | Renal | 0.8571 | 1 | 0.75 | EPHB2 AND NOT-AMN | Colon | 0.8889 | 1 | 0.8 |
| CDH6 AND NOT-LRPAP1 | Renal | 0.8571 | 1 | 0.75 | DPEP1 AND NOT-C1orf101 | Colon | 0.8889 | 1 | 0.8 |
| CDH6 AND NOT-SLC9A6 | Renal | 0.8571 | 1 | 0.75 | EPHB2 AND NOT-SEMA4G | Colon | 0.8889 | 1 | 0.8 |
| CDH6 AND NOT-ZDHHC21 | Renal | 0.8571 | 1 | 0.75 | EPHB2 AND NOT-SCNN1B | Colon | 0.8889 | 1 | 0.8 |
| CDH6 AND NOT-PTPRA | Renal | 0.8571 | 1 | 0.75 | EPHB2 AND NOT-UGT8 | Colon | 0.8889 | 1 | 0.8 |
| CDH6 AND NOT-LSAMP | Renal | 0.8571 | 1 | 0.75 | EPHB2 AND NOT-PSEN1 | Colon | 0.8889 | 1 | 0.8 |
| SLC3A1 AND NOT-TMEM30B | Renal | 0.8571 | 1 | 0.75 | EPHB2 AND NOT-PTPRD | Colon | 0.8889 | 1 | 0.8 |
| CDH6 AND NOT-DIO2 | Renal | 0.8571 | 1 | 0.75 | EPHB2 AND NOT-TMPRSS2 | Colon | 0.8889 | 1 | 0.8 |
| CDH6 AND NOT-PTPRJ | Renal | 0.8571 | 1 | 0.75 | EPHB2 AND NOT-SLC22A23 | Colon | 0.8889 | 1 | 0.8 |
| CDH6 AND NOT-CD47 | Renal | 0.8571 | 1 | 0.75 | EPHB2 AND NOT-CA12 | Colon | 0.8889 | 1 | 0.8 |
| CDH6 AND NOT-DPP6 | Renal | 0.8571 | 1 | 0.75 | EPHB2 AND NOT-SEMA6A | Colon | 0.8889 | 1 | 0.8 |
| CDH6 AND NOT-LRRTM2 | Renal | 0.8571 | 1 | 0.75 | EPHB2 AND NOT-PTGDR | Colon | 0.8889 | 1 | 0.8 |
| CDH6 AND NOT-RET | Renal | 0.8571 | 1 | 0.75 | GUCY2C AND NOT-SLC22A23 | Colon | 0.9091 | 0.8333 | 1 |
| CDH6 AND NOT-TSPAN2 | Renal | 0.8571 | 1 | 0.75 | DPEP1 AND NOT-KCNG3 | Colon | 1 | 1 | 1 |
| CDH6 AND NOT-HHIP | Renal | 0.8571 | 1 | 0.75 | DPEP1 AND NOT-CNGB3 | Colon | 1 | 1 | 1 |
| CDH6 AND NOT-SLC4A3 | Renal | 0.8571 | 1 | 0.75 | DPEP1 AND NOT-GRPR | Colon | 1 | 1 | 1 |
| CDH6 AND NOT-PRPH2 | Renal | 0.8571 | 1 | 0.75 | DPEP1 AND NOT-ESYT3 | Colon | 1 | 1 | 1 |
| CDH6 AND NOT-ROM1 | Renal | 0.8571 | 1 | 0.75 | DPEP1 AND NOT-ATP1B2 | Colon | 1 | 1 | 1 |
| CDH6 AND NOT-SLC36A1 | Renal | 0.8571 | 1 | 0.75 | DPEP1 AND NOT-LPAR3 | Colon | 0.9091 | 0.8333 | 1 |
| CDH6 AND NOT-SLC7A10 | Renal | 0.8571 | 1 | 0.75 | DPEP1 AND NOT-KCNJ1 | Colon | 1 | 1 | 1 |
| CDH6 AND NOT-SLC7A1 | Renal | 0.8571 | 1 | 0.75 | DPEP1 AND NOT-UNC5D | Colon | 1 | 1 | 1 |
| CDH6 AND NOT-SLC6A9 | Renal | 0.8571 | 1 | 0.75 | DPEP1 AND NOT-SLC4A4 | Colon | 1 | 1 | 1 |
| CDH6 AND NOT-GRIK2 | Renal | 0.8571 | 1 | 0.75 | DPEP1 AND NOT-GDPD2 | Colon | 0.9091 | 0.8333 | 1 |
| CDH6 AND NOT-SLC7A6 | Renal | 0.8571 | 1 | 0.75 | DPEP1 AND NOT-KCNJ5 | Colon | 1 | 1 | 1 |
| CDH6 AND NOT-SLC25A4 | Renal | 0.8571 | 1 | 0.75 | FZD3 AND NOT-B4GALNT1 | Ependymoma | 1 | 1 | 1 |
| CDH6 AND NOT-M6PR | Renal | 0.8571 | 1 | 0.75 | SLC1A3 AND NOT-CD33 | Ependymoma | 1 | 1 | 1 |
| CDH6 AND NOT-SLC5A3 | Renal | 0.8571 | 1 | 0.75 | FZD3 AND NOT-P2RX5 | Ependymoma | 1 | 1 | 1 |
| CDH6 AND NOT-PLXNA4 | Renal | 0.8571 | 1 | 0.75 | SLC1A3 AND NOT-CD37 | Ependymoma | 1 | 1 | 1 |
| CDH6 AND NOT-CORIN | Renal | 0.8571 | 1 | 0.75 | SLC1A3 AND NOT-IL13RA1 | Ependymoma | 1 | 1 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CDH6 AND NOT-SORT1 | Renal | 0.8571 | 1 | 0.75 | SLC1A3 AND NOT-CXCR5 | Ependymoma | 1 | 1 | 1 |
| CDH6 AND NOT-ACVR1B | Renal | 0.8571 | 1 | 0.75 | SLC1A3 AND NOT-MS4A1 | Ependymoma | 1 | 1 | 1 |
| CDH6 AND NOT-CNST | Renal | 0.8571 | 1 | 0.75 | SLC1A3 AND NOT-FCRL2 | Ependymoma | 1 | 1 | 1 |
| CDH6 AND NOT-TMEM150C | Renal | 0.8571 | 1 | 0.75 | SLC1A3 AND NOT-TNFRSF17 | Ependymoma | 1 | 1 | 1 |
| CDH6 AND NOT-HEPH | Renal | 0.8571 | 1 | 0.75 | SLC1A3 AND NOT-FCRL5 | Ependymoma | 1 | 1 | 1 |
| CDH6 AND NOT-REEP2 | Renal | 0.8571 | 1 | 0.75 | SLC7A11 AND NOT-IL13RA1 | Ependymoma | 1 | 1 | 1 |
| CDH6 AND NOT-OPN1SW | Renal | 0.8571 | 1 | 0.75 | KCNA6 AND NOT-FOLH1 | Ependymoma | 1 | 1 | 1 |
| CDH6 AND NOT-ROBO2 | Renal | 0.8571 | 1 | 0.75 | WDR19 AND NOT-IL13RA1 | Ependymoma | 1 | 1 | 1 |
| CDH6 AND NOT-GRIA1 | Renal | 0.8571 | 1 | 0.75 | SSTR1 AND NOT-INSR | Ependymoma | 1 | 1 | 1 |
| CDH6 AND NOT-LRP8 | Renal | 0.8571 | 1 | 0.75 | SSTR1 AND NOT-XK | Ependymoma | 1 | 1 | 1 |
| CDH6 AND NOT-APLP1 | Renal | 0.8571 | 1 | 0.75 | KCNA6 AND NOT-EPCAM | Ependymoma | 1 | 1 | 1 |
| CDH6 AND NOT-ATP13A2 | Renal | 0.8571 | 1 | 0.75 | ROR2 AND NOT-STEAP1 | Ependymoma | 1 | 1 | 1 |
| ATP10B AND NOT-FLVCR2 | Colon | 0.9091 | 0.8333 | 1 | KCNA6 AND NOT-P2RX5 | Ependymoma | 1 | 1 | 1 |
| HEPH AND NOT-FLVCR2 | Colon | 0.9091 | 0.8333 | 1 | KCNA6 AND NOT-B4GALNT1 | Ependymoma | 1 | 1 | 1 |
| MEP1A AND NOT-FLVCR2 | Colon | 0.9091 | 0.8333 | 1 | SSTR1 AND NOT-KCNS3 | Ependymoma | 1 | 1 | 1 |
| PMEPA1 AND NOT-GABRE | Colon | 0.8889 | 1 | 0.8 | FZD3 AND NOT-L1CAM | Ependymoma | 1 | 1 | 1 |
| FGFR4 AND NOT-LIFR | Colon | 0.8889 | 1 | 0.8 | SSTR1 AND NOT-ATRN | Ependymoma | 1 | 1 | 1 |
| PMEPA1 AND NOT-FZD4 | Colon | 0.8889 | 1 | 0.8 | TSPAN11 AND NOT-MET | Ependymoma | 1 | 1 | 1 |
| PMEPA1 AND NOT-ANO3 | Colon | 0.8889 | 1 | 0.8 | PCDHB10 AND NOT-MET | Ependymoma | 1 | 1 | 1 |
| PMEPA1 AND NOT-LIFR | Colon | 0.8889 | 1 | 0.8 | KCNA6 AND NOT-CLDN1 | Ependymoma | 1 | 1 | 1 |
| PMEPA1 AND NOT-PCDH9 | Colon | 0.8889 | 1 | 0.8 | KCNA6 AND NOT-STEAP2 | Ependymoma | 1 | 1 | 1 |
| PMEPA1 AND NOT-ITGA7 | Colon | 0.8889 | 1 | 0.8 | SSTR1 AND NOT-EMB | Ependymoma | 1 | 1 | 1 |
| PMEPA1 AND NOT-MPZ | Colon | 0.8889 | 1 | 0.8 | ZNRF3 AND NOT-CD34 | Ependymoma | 1 | 1 | 1 |
| PMEPA1 AND NOT-ADRB2 | Colon | 0.8889 | 1 | 0.8 | SSTR1 AND NOT-SLC31A2 | Ependymoma | 1 | 1 | 1 |
| CD320 AND NOT-LPAR1 | Colon | 0.8889 | 1 | 0.8 | SSTR1 AND NOT-GJB2 | Ependymoma | 1 | 1 | 1 |
| CD320 AND NOT-EFNA5 | Colon | 0.8889 | 1 | 0.8 | ROR2 AND NOT-ENG | Ependymoma | 1 | 1 | 1 |
| PMEPA1 AND NOT-ATP8B4 | Colon | 0.8889 | 1 | 0.8 | SSTR1 AND NOT-MRAP2 | Ependymoma | 1 | 1 | 1 |
| PMEPA1 AND NOT-SLC9A9 | Colon | 0.8889 | 1 | 0.8 | DLL1 AND NOT-STEAP1 | Ependymoma | 1 | 1 | 1 |
| MEP1A AND NOT-SEMA4G | Colon | 0.8889 | 1 | 0.8 | KCNA6 AND NOT-EPHA3 | Ependymoma | 1 | 1 | 1 |
| CYBA AND NOT-LRMP | Colon | 1 | 1 | 1 | SSTR1 AND NOT-SLC17A5 | Ependymoma | 1 | 1 | 1 |
| PMEPA1 AND NOT-ADCY6 | Colon | 0.8889 | 1 | 0.8 | DLL1 AND NOT-IL2RA | Ependymoma | 1 | 1 | 1 |
| PMEPA1 AND NOT-NAALAD2 | Colon | 0.8889 | 1 | 0.8 | SSTR1 AND NOT-CD47 | Ependymoma | 1 | 1 | 1 |
| CD320 AND NOT-BEST4 | Colon | 0.8889 | 1 | 0.8 | DLL1 AND NOT-MET | Ependymoma | 1 | 1 | 1 |
| PMEPA1 AND NOT-AGTR1 | Colon | 0.8889 | 1 | 0.8 | KCNA6 AND NOT-EPHB2 | Ependymoma | 1 | 1 | 1 |
| PPAP2C AND NOT-ABHD6 | Colon | 0.8889 | 1 | 0.8 | DLL1 AND NOT-TRPM4 | Ependymoma | 1 | 1 | 1 |
| PMEPA1 AND NOT-KL | Colon | 0.8889 | 1 | 0.8 | DLL1 AND NOT-SDC1 | Ependymoma | 1 | 1 | 1 |
| PSENEN AND NOT-LRMP | Colon | 0.8889 | 1 | 0.8 | SSTR1 AND NOT-SLC4A7 | Ependymoma | 1 | 1 | 1 |
| PMEPA1 AND NOT-CDON | Colon | 0.8889 | 1 | 0.8 | SSTR1 AND NOT-MTDH | Ependymoma | 1 | 1 | 1 |
| PMEPA1 AND NOT-SLC16A2 | Colon | 0.8889 | 1 | 0.8 | DLL1 AND NOT-CD52 | Ependymoma | 1 | 1 | 1 |
| SIGMAR1 AND NOT-SLC6A16 | Colon | 0.8889 | 1 | 0.8 | SSTR1 AND NOT-MYADM | Ependymoma | 1 | 1 | 1 |
| PMEPA1 AND NOT-SFRP1 | Colon | 0.8889 | 1 | 0.8 | KCNA6 AND NOT-ERBB4 | Ependymoma | 1 | 1 | 1 |
| PMEPA1 AND NOT-SLC41A1 | Colon | 0.8889 | 1 | 0.8 | DLL1 AND NOT-TNFRSF10A | Ependymoma | 1 | 1 | 1 |
| PMEPA1 AND NOT-CX3CL1 | Colon | 0.8889 | 1 | 0.8 | SSTR1 AND NOT-STX3 | Ependymoma | 1 | 1 | 1 |
| PMEPA1 AND NOT-ATP1A2 | Colon | 0.8889 | 1 | 0.8 | KCNA6 AND NOT-CLDN12 | Ependymoma | 1 | 1 | 1 |
| ATP10B AND NOT-SLC22A23 | Colon | 0.9091 | 0.8333 | 1 | ZNRF3 AND NOT-AXL | Ependymoma | 1 | 1 | 1 |
| PMEPA1 AND NOT-VSTM4 | Colon | 0.8889 | 1 | 0.8 | ROR2 AND NOT-CD276 | Ependymoma | 1 | 1 | 1 |
| HEPH AND NOT-SLC22A23 | Colon | 0.9091 | 0.8333 | 1 | SSTR1 AND NOT-STYK1 | Ependymoma | 1 | 1 | 1 |
| PMEPA1 AND NOT-PEAR1 | Colon | 0.8889 | 1 | 0.8 | SSTR1 AND NOT-ANO10 | Ependymoma | 1 | 1 | 1 |
| PMEPA1 AND NOT-ADCY5 | Colon | 0.8889 | 1 | 0.8 | ROR2 AND NOT-CD34 | Ependymoma | 1 | 1 | 1 |
| PMEPA1 AND NOT-NTRK3 | Colon | 0.8889 | 1 | 0.8 | SSTR1 AND NOT-KIAA1324 | Ependymoma | 1 | 1 | 1 |
| PMEPA1 AND NOT-ACSL1 | Colon | 0.8889 | 1 | 0.8 | SSTR1 AND NOT-SMPD3 | Ependymoma | 1 | 1 | 1 |
| PMEPA1 AND NOT-SLC46A1 | Colon | 0.8889 | 1 | 0.8 | SSTR1 AND NOT-NTN4 | Ependymoma | 1 | 1 | 1 |
| LSR AND NOT-FLVCR2 | Colon | 0.8889 | 1 | 0.8 | SSTR1 AND NOT-TMEM127 | Ependymoma | 1 | 1 | 1 |
| PPAP2C AND NOT-SLC22A23 | Colon | 0.8889 | 1 | 0.8 | SLC39A4 AND NOT-ENPP3 | Esophagus | 0.7273 | 1 | 0.5714 |
| SIGMAR1 AND NOT-KIAA0754 | Colon | 0.8889 | 1 | 0.8 | SLC52A2 AND NOT-ENPP3 | Esophagus | 0.7273 | 1 | 0.5714 |
| PMEPA1 AND NOT-GPM6B | Colon | 0.8889 | 1 | 0.8 | PTPRH AND NOT-ENPP3 | Esophagus | 0.7273 | 1 | 0.5714 |
| EPHB4 AND NOT-SLC9A9 | Colon | 0.8333 | 0.7143 | 1 | SLC52A2 AND NOT-ABCA5 | Esophagus | 0.8 | 0.9091 | 0.7143 |
| HEPH AND NOT-ABHD6 | Colon | 1 | 1 | 1 | SLC52A2 AND NOT-IL3RA | Esophagus | 0.6667 | 1 | 0.5 |
| SLC26A3 AND NOT-FLVCR2 | Colon | 0.9091 | 0.8333 | 1 | SLC52A2 AND NOT-TRPM4 | Esophagus | 0.7826 | 1 | 0.6429 |
| HEPH AND NOT-ANO7 | Colon | 0.8 | 0.8 | 0.8 | MOK AND NOT-WDR19 | Esophagus | 0.6667 | 0.8 | 0.5714 |
| LSR AND NOT-ATP6V0A1 | Colon | 0.8 | 0.8 | 0.8 | SLC52A2 AND NOT-FOLR2 | Esophagus | 0.6667 | 1 | 0.5 |
| PMEPA1 AND NOT-OR2C1 | Colon | 0.8889 | 1 | 0.8 | MUC13 AND NOT-PIGR | Esophagus | 0.7273 | 1 | 0.5714 |
| LSR AND NOT-ABHD6 | Colon | 0.8889 | 1 | 0.8 | SLC52A2 AND NOT-CLDN8 | Esophagus | 0.7826 | 1 | 0.6429 |
| FZD3 AND NOT-KCNJ2 | Ependymoma | 1 | 1 | 1 | TM4SF5 AND NOT-ENPP3 | Esophagus | 0.7273 | 1 | 0.5714 |
| FZD3 AND NOT-KCNJ4 | Ependymoma | 1 | 1 | 1 | SLC52A2 AND NOT-TYR | Esophagus | 0.7826 | 1 | 0.6429 |
| SLC1A3 AND NOT-HTRA2 | Ependymoma | 1 | 1 | 1 | SLC52A2 AND NOT-TNFRSF8 | Esophagus | 0.7826 | 1 | 0.6429 |
| CDH2 AND NOT-ADCY9 | Ependymoma | 1 | 1 | 1 | SLC52A2 AND NOT-IL11RA | Esophagus | 0.8333 | 1 | 0.7143 |
| FZD3 AND NOT-KCNK1 | Ependymoma | 1 | 1 | 1 | SLC52A2 AND NOT-FCRL1 | Esophagus | 0.7826 | 1 | 0.6429 |
| FZD3 AND NOT-KCNMA1 | Ependymoma | 1 | 1 | 1 | SLC52A2 AND NOT-CD160 | Esophagus | 0.8333 | 1 | 0.7143 |
| FZD3 AND NOT-KCNQ3 | Ependymoma | 1 | 1 | 1 | SLC52A2 AND NOT-HHLA2 | Esophagus | 0.6 | 1 | 0.4286 |
| TMEM231 AND NOT-KCNJ2 | Ependymoma | 1 | 1 | 1 | SLC52A2 AND NOT-CD72 | Esophagus | 0.6 | 1 | 0.4286 |
| SLC1A3 AND NOT-TNFRSF1A | Ependymoma | 1 | 1 | 1 | SLC52A2 AND NOT-CLEC14A | Esophagus | 0.6 | 1 | 0.4286 |
| SLC1A3 AND NOT-TGFBR2 | Ependymoma | 1 | 1 | 1 | MUC13 AND NOT-SCNN1B | Esophagus | 0.6 | 1 | 0.4286 |
| FZD3 AND NOT-CDH12 | Ependymoma | 1 | 1 | 1 | SLC52A2 AND NOT-SST | Esophagus | 0.6 | 1 | 0.4286 |
| SLC1A3 AND NOT-LRMP | Ependymoma | 1 | 1 | 1 | SLC52A2 AND NOT-GPA33 | Esophagus | 0.7826 | 1 | 0.6429 |
| SLC1A3 AND NOT-LTB | Ependymoma | 1 | 1 | 1 | SLC52A2 AND NOT-RAET1E | Esophagus | 0.7826 | 1 | 0.6429 |
| FZD3 AND NOT-SCN2B | Ependymoma | 1 | 1 | 1 | SLC52A2 AND NOT-PMEL | Esophagus | 0.6667 | 1 | 0.5 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC16A2 AND NOT-LTBR | Ependymoma | 1 | 1 | 1 | SLC52A2 AND NOT-NCAM1 | Esophagus | 0.6667 | 1 | 0.5 |
| SLC1A3 AND NOT-LY9 | Ependymoma | 1 | 1 | 1 | SLC52A2 AND NOT-SSTR5 | Esophagus | 0.6 | 1 | 0.4286 |
| SLC7A11 AND NOT-SLC12A6 | Ependymoma | 1 | 1 | 1 | EPCAM AND NOT-SLC4A4 | Esophagus | 0.64 | 0.7273 | 0.5714 |
| FZD3 AND NOT-RYR2 | Ependymoma | 1 | 1 | 1 | SLC6A20 AND NOT-CD160 | Esophagus | 0.6957 | 0.8889 | 0.5714 |
| SLC1A3 AND NOT-LY75 | Ependymoma | 1 | 1 | 1 | SLC52A2 AND NOT-EPHA3 | Esophagus | 0.6 | 1 | 0.4286 |
| SLC1A3 AND NOT-KLRB1 | Ependymoma | 1 | 1 | 1 | SLC52A2 AND NOT-CD79B | Esophagus | 0.7826 | 1 | 0.6429 |
| SLC1A3 AND NOT-LAMP2 | Ependymoma | 1 | 1 | 1 | SLC52A2 AND NOT-ULBP3 | Esophagus | 0.6667 | 1 | 0.5 |
| SLC7A11 AND NOT-USP48 | Ependymoma | 1 | 1 | 1 | SLC52A2 AND NOT-CD79A | Esophagus | 0.7273 | 1 | 0.5714 |
| SLC1A3 AND NOT-P2RY10 | Ependymoma | 1 | 1 | 1 | MARVELD2 AND NOT-ENPP3 | Esophagus | 0.6087 | 0.7778 | 0.5 |
| SLC1A3 AND NOT-SELPLG | Ependymoma | 1 | 1 | 1 | SLC52A2 AND NOT-TNFRSF17 | Esophagus | 0.7826 | 1 | 0.6429 |
| SLC16A2 AND NOT-LEPR | Ependymoma | 1 | 1 | 1 | SLC52A2 AND NOT-SSTR3 | Esophagus | 0.6 | 1 | 0.4286 |
| SLC1A3 AND NOT-CD2 | Ependymoma | 1 | 1 | 1 | MUC13 AND NOT-SLC4A4 | Esophagus | 0.6957 | 0.8889 | 0.5714 |
| SLC52A2 AND NOT-SMPD1 | Esophagus | 0.7826 | 1 | 0.6429 | SLC52A2 AND NOT-CD180 | Esophagus | 0.7826 | 1 | 0.6429 |
| SLC52A2 AND NOT-SCNN1B | Esophagus | 0.7826 | 1 | 0.6429 | SLC52A2 AND NOT-SEMA5B | Esophagus | 0.7826 | 1 | 0.6429 |
| SLC52A2 AND NOT-KLB | Esophagus | 0.8333 | 1 | 0.7143 | SLC6A20 AND NOT-ENPP3 | Esophagus | 0.6667 | 1 | 0.5 |
| SLC52A2 AND NOT-CDHR1 | Esophagus | 0.8333 | 1 | 0.7143 | TM4SF20 AND NOT-ENPP3 | Esophagus | 0.6667 | 1 | 0.5 |
| SLC52A2 AND NOT-ST6GALNAC6 | Esophagus | 0.8333 | 1 | 0.7143 | SLC52A2 AND NOT-ITGB3 | Esophagus | 0.7826 | 1 | 0.6429 |
| SLC52A2 AND NOT-VIPR1 | Esophagus | 0.8333 | 1 | 0.7143 | SLC52A2 AND NOT-BCAN | Esophagus | 0.8333 | 1 | 0.7143 |
| GJB3 AND NOT-CDHR1 | Esophagus | 0.6897 | 0.6667 | 0.7143 | SLC52A2 AND NOT-CXCR5 | Esophagus | 0.7826 | 1 | 0.6429 |
| BCAP31 AND NOT-ST6GALNAC6 | Esophagus | 0.7273 | 1 | 0.5714 | SLC52A2 AND NOT-DLL3 | Esophagus | 0.7826 | 1 | 0.6429 |
| SLC52A2 AND NOT-CLEC10A | Esophagus | 0.7826 | 1 | 0.6429 | SLC52A2 AND NOT-ABCB5 | Esophagus | 0.6667 | 1 | 0.5 |
| SLC52A2 AND NOT-SLCO2A1 | Esophagus | 0.75 | 0.9 | 0.6429 | SLC52A2 AND NOT-CD33 | Esophagus | 0.8333 | 1 | 0.7143 |
| SLC52A2 AND NOT-AMICA1 | Esophagus | 0.7826 | 1 | 0.6429 | SLC52A2 AND NOT-ERBB2 | Esophagus | 0.6 | 1 | 0.4286 |
| SLC52A2 AND NOT-PTGDR | Esophagus | 0.8333 | 1 | 0.7143 | CBX3 AND NOT-ADCY7 | Esophagus | 0.6667 | 0.8 | 0.5714 |
| SLC52A2 AND NOT-ABCA8 | Esophagus | 0.7826 | 1 | 0.6429 | SLC52A2 AND NOT-CLDN23 | Esophagus | 0.6957 | 0.8889 | 0.5714 |
| SLC52A2 AND NOT-GDPD2 | Esophagus | 0.7273 | 1 | 0.5714 | CBX3 AND NOT-CD69 | Esophagus | 0.64 | 0.7273 | 0.5714 |
| SLC52A2 AND NOT-ABHD6 | Esophagus | 0.7826 | 1 | 0.6429 | SLC52A2 AND NOT-P2RX5 | Esophagus | 0.7273 | 1 | 0.5714 |
| GPRC5A AND NOT-ST6GALNAC6 | Esophagus | 0.7826 | 1 | 0.6429 | SLC52A2 AND NOT-DNAJB8 | Esophagus | 0.8333 | 1 | 0.7143 |
| SLC52A2 AND NOT-LRMP | Esophagus | 0.7273 | 1 | 0.5714 | TM4SF20 AND NOT-SST | Esophagus | 0.6667 | 1 | 0.5 |
| FZD5 AND NOT-PTPRD | Esophagus | 0.7273 | 1 | 0.5714 | BCAP31 AND NOT-IL11RA | Esophagus | 0.7273 | 1 | 0.5714 |
| SLC39A4 AND NOT-SCNN1B | Esophagus | 0.6667 | 1 | 0.5 | SLC52A2 AND NOT-CLDN9 | Esophagus | 0.7826 | 1 | 0.6429 |
| SLC52A2 AND NOT-PTPRD | Esophagus | 0.8333 | 1 | 0.7143 | ST14 AND NOT-ENPP3 | Esophagus | 0.6667 | 1 | 0.5 |
| SLC52A2 AND NOT-ABCB1 | Esophagus | 0.6667 | 1 | 0.5 | PTPRZ1 AND NOT-EPCAM | Glioblastoma | 0.875 | 0.9333 | 0.8235 |
| SLC52A2 AND NOT-NEO1 | Esophagus | 0.6667 | 1 | 0.5 | PTPRZ1 AND NOT-RNF43 | Glioblastoma | 0.9091 | 0.9375 | 0.8824 |
| SLC52A2 AND NOT-ADTRP | Esophagus | 0.6667 | 1 | 0.5 | PTPRZ1 AND NOT-CLDN8 | Glioblastoma | 0.9091 | 0.9375 | 0.8824 |
| SLC52A2 AND NOT-RNF144A | Esophagus | 0.6667 | 1 | 0.5 | PTPRZ1 AND NOT-LGR5 | Glioblastoma | 0.875 | 0.9333 | 0.8235 |
| SLC52A2 AND NOT-ATP6V0A1 | Esophagus | 0.6667 | 1 | 0.5 | PTPRZ1 AND NOT-TPBG | Glioblastoma | 0.875 | 0.9333 | 0.8235 |
| SLC52A2 AND NOT-CDH19 | Esophagus | 0.6667 | 1 | 0.5 | PTPRZ1 AND NOT-SSTR1 | Glioblastoma | 0.9091 | 0.9375 | 0.8824 |
| SLC52A2 AND NOT-ITGB7 | Esophagus | 0.8333 | 1 | 0.7143 | PTPRZ1 AND NOT-TRPM4 | Glioblastoma | 0.9091 | 0.9375 | 0.8824 |
| SLC52A2 AND NOT-POPDC2 | Esophagus | 0.7273 | 1 | 0.5714 | PTPRZ1 AND NOT-MST1R | Glioblastoma | 0.9091 | 0.9375 | 0.8824 |
| SLC52A2 AND NOT-CA12 | Esophagus | 0.8333 | 1 | 0.7143 | PTPRZ1 AND NOT-CD52 | Glioblastoma | 0.9091 | 0.9375 | 0.8824 |
| SLC52A2 AND NOT-TMEM100 | Esophagus | 0.7826 | 1 | 0.6429 | PTPRZ1 AND NOT-IL20RA | Glioblastoma | 0.9091 | 0.9375 | 0.8824 |
| SLC52A2 AND NOT-SLC26A6 | Esophagus | 0.8333 | 1 | 0.7143 | PTPRZ1 AND NOT-GPNMB | Glioblastoma | 0.8 | 0.9231 | 0.7059 |
| SLC52A2 AND NOT-NPY1R | Esophagus | 0.7826 | 1 | 0.6429 | PTPRZ1 AND NOT-IL11RA | Glioblastoma | 0.8 | 0.9231 | 0.7059 |
| SLC52A2 AND NOT-TNFRSF25 | Esophagus | 0.8333 | 1 | 0.7143 | PTPRZ1 AND NOT-PROM1 | Glioblastoma | 0.9091 | 0.9375 | 0.8824 |
| SLC52A2 AND NOT-SCNN1G | Esophagus | 0.7826 | 1 | 0.6429 | NRCAM AND NOT-B4GALNT1 | Glioblastoma | 0.7317 | 0.625 | 0.8824 |
| SLC52A2 AND NOT-GPR173 | Esophagus | 0.7826 | 1 | 0.6429 | PTPRZ1 AND NOT-STEAP2 | Glioblastoma | 0.7407 | 1 | 0.5882 |
| SLC52A2 AND NOT-SCN3A | Esophagus | 0.7826 | 1 | 0.6429 | AQP4 AND NOT-ERBB3 | Glioblastoma | 0.6897 | 0.8333 | 0.5882 |
| SLC52A2 AND NOT-NCAM2 | Esophagus | 0.6667 | 1 | 0.5 | NLGN4X AND NOT-L1CAM | Glioblastoma | 0.6875 | 0.7333 | 0.6471 |
| SLC52A2 AND NOT-UNC5D | Esophagus | 0.7826 | 1 | 0.6429 | PTPRZ1 AND NOT-L1CAM | Glioblastoma | 0.8276 | 1 | 0.7059 |
| SLC52A2 AND NOT-NLGN1 | Esophagus | 0.7826 | 1 | 0.6429 | PTPRZ1 AND NOT-MET | Glioblastoma | 0.8 | 0.9231 | 0.7059 |
| SLC52A2 AND NOT-MPZ | Esophagus | 0.6667 | 1 | 0.5 | JAM2 AND NOT-CD34 | Glioblastoma | 0.8276 | 1 | 0.7059 |
| SLC52A2 AND NOT-MCOLN1 | Esophagus | 0.7826 | 1 | 0.6429 | NRCAM AND NOT-L1CAM | Glioblastoma | 0.7586 | 0.9167 | 0.6471 |
| SLC52A2 AND NOT-GABRA6 | Esophagus | 0.6667 | 1 | 0.5 | PON2 AND NOT-SDC1 | Glioblastoma | 0.7111 | 0.5714 | 0.9412 |
| SLC52A2 AND NOT-FLT3 | Esophagus | 0.7273 | 1 | 0.5714 | JAM2 AND NOT-EPCAM | Glioblastoma | 0.8 | 0.9231 | 0.7059 |
| SLC52A2 AND NOT-CD101 | Esophagus | 0.7826 | 1 | 0.6429 | JAM2 AND NOT-CLDN1 | Glioblastoma | 0.7586 | 0.9167 | 0.6471 |
| SLC52A2 AND NOT-IL6R | Esophagus | 0.7273 | 1 | 0.5714 | PTPRZ1 AND NOT-ERBB3 | Glioblastoma | 0.7857 | 1 | 0.6471 |
| SLC52A2 AND NOT-CD163L1 | Esophagus | 0.7273 | 1 | 0.5714 | ITGB8 AND NOT-ERBB3 | Glioblastoma | 0.64 | 1 | 0.4706 |
| SLC52A2 AND NOT-RHOT2 | Esophagus | 0.7692 | 0.8333 | 0.7143 | PTPRZ1 AND NOT-ERBB4 | Glioblastoma | 0.64 | 1 | 0.4706 |
| SLC52A2 AND NOT-SEMA6D | Esophagus | 0.7826 | 1 | 0.6429 | PTPRZ1 AND NOT-EPCAM | Glioma | 0.9855 | 0.9855 | 0.9855 |
| SLC52A2 AND NOT-MCOLN2 | Esophagus | 0.7273 | 1 | 0.5714 | PTPRZ1 AND NOT-RAET1E | Glioma | 0.9853 | 1 | 0.971 |
| GPRC5A AND NOT-SCNN1G | Esophagus | 0.6897 | 0.6667 | 0.7143 | PTPRZ1 AND NOT-CLDN8 | Glioma | 0.9781 | 0.9853 | 0.971 |
| SLC52A2 AND NOT-SLC26A10 | Esophagus | 0.7826 | 1 | 0.6429 | PTPRZ1 AND NOT-RNF43 | Glioma | 0.9313 | 0.9839 | 0.8841 |
| SLC52A2 AND NOT-KCND1 | Esophagus | 0.7826 | 1 | 0.6429 | PTPRZ1 AND NOT-MST1R | Glioma | 0.9855 | 0.9855 | 0.9855 |
| SLC52A2 AND NOT-AQP8 | Esophagus | 0.7826 | 1 | 0.6429 | PTPRZ1 AND NOT-PMEL | Glioma | 0.9706 | 0.9851 | 0.9565 |
| SLC52A2 AND NOT-SLC9A5 | Esophagus | 0.8333 | 1 | 0.7143 | PTPRZ1 AND NOT-ITGB6 | Glioma | 0.9855 | 0.9855 | 0.9855 |
| SLC52A2 AND NOT-PKD1 | Esophagus | 0.8333 | 1 | 0.7143 | PTPRZ1 AND NOT-CLDN6 | Glioma | 0.9781 | 0.9853 | 0.971 |
| SLC52A2 AND NOT-SLC6A16 | Esophagus | 0.7273 | 1 | 0.5714 | NRCAM AND NOT-EPCAM | Glioma | 0.9242 | 0.9683 | 0.8841 |
| SLC52A2 AND NOT-EPHB3 | Esophagus | 0.6667 | 1 | 0.5 | PTPRZ1 AND NOT-GPA33 | Glioma | 0.9855 | 0.9855 | 0.9855 |
| SLC52A2 AND NOT-PLXNA4 | Esophagus | 0.8333 | 1 | 0.7143 | GOLM1 AND NOT-EPCAM | Glioma | 0.9624 | 1 | 0.9275 |
| SLC52A2 AND NOT-PTGDR2 | Esophagus | 0.8333 | 1 | 0.7143 | NLGN1 AND NOT-EPCAM | Glioma | 0.9385 | 1 | 0.8841 |
| SLC52A2 AND NOT-COL25A1 | Esophagus | 0.6667 | 1 | 0.5 | PTPRZ1 AND NOT-SLAMF7 | Glioma | 0.9853 | 1 | 0.971 |
| SLC52A2 AND NOT-EVC | Esophagus | 0.6667 | 1 | 0.5 | PTPRZ1 AND NOT-CLDN1 | Glioma | 0.9781 | 0.9853 | 0.971 |
| SLC52A2 AND NOT-ABCB8 | Esophagus | 0.7826 | 1 | 0.6429 | NRCAM AND NOT-CLDN11 | Glioma | 0.9173 | 0.9531 | 0.8841 |
| SLC52A2 AND NOT-GPR174 | Esophagus | 0.6667 | 1 | 0.5 | NRCAM AND NOT-CD22 | Glioma | 0.9173 | 0.9531 | 0.8841 |
| SLC52A2 AND NOT-PARM1 | Esophagus | 0.8333 | 1 | 0.7143 | PTPRZ1 AND NOT-CLDN9 | Glioma | 0.9781 | 0.9853 | 0.971 |
| SLC52A2 AND NOT-MC1R | Esophagus | 0.7273 | 1 | 0.5714 | PTPRZ1 AND NOT-STEAP2 | Glioma | 0.9855 | 0.9855 | 0.9855 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC52A2 AND NOT-CLEC2D | Esophagus | 0.8333 | 1 | 0.7143 | PTPRZ1 AND NOT-CLDN23 | Glioma | 0.9855 | 0.9855 | 0.9855 |
| SLC52A2 AND NOT-C1QTNF1 | Esophagus | 0.7273 | 1 | 0.5714 | PTPRZ1 AND NOT-SSTR3 | Glioma | 0.9855 | 0.9855 | 0.9855 |
| SLC52A2 AND NOT-FLT3LG | Esophagus | 0.7273 | 1 | 0.5714 | PTPRZ1 AND NOT-CXCR5 | Glioma | 0.9624 | 1 | 0.9275 |
| SLC52A2 AND NOT-CDH24 | Esophagus | 0.7826 | 1 | 0.6429 | PTPRZ1 AND NOT-CLDN18 | Glioma | 0.9781 | 0.9853 | 0.971 |
| SLC52A2 AND NOT-SLAMF1 | Esophagus | 0.8333 | 1 | 0.7143 | PTPRZ1 AND NOT-IL3RA | Glioma | 0.9855 | 0.9855 | 0.9855 |
| SLC52A2 AND NOT-CHRNA3 | Esophagus | 0.6667 | 1 | 0.5 | PTPRZ1 AND NOT-TNFRSF10A | Glioma | 0.963 | 0.9848 | 0.942 |
| SLC52A2 AND NOT-ZFYVE27 | Esophagus | 0.7273 | 1 | 0.5714 | PTPRZ1 AND NOT-SSTR5 | Glioma | 0.9855 | 0.9855 | 0.9855 |
| SLC52A2 AND NOT-TMEM119 | Esophagus | 0.6667 | 1 | 0.5 | PTPRZ1 AND NOT-SDC1 | Glioma | 0.9855 | 0.9855 | 0.9855 |
| SLC52A2 AND NOT-KIT | Esophagus | 0.7826 | 1 | 0.6429 | NRCAM AND NOT-STEAP2 | Glioma | 0.9173 | 0.9531 | 0.8841 |
| SLC39A4 AND NOT-ABHD6 | Esophagus | 0.72 | 0.8182 | 0.6429 | NRCAM AND NOT-ENPP3 | Glioma | 0.9173 | 0.9531 | 0.8841 |
| GPRC5A AND NOT-SEMA6D | Esophagus | 0.7826 | 1 | 0.6429 | PTPRZ1 AND NOT-ENPP3 | Glioma | 0.9855 | 0.9855 | 0.9855 |
| SLC52A2 AND NOT-CMKLR1 | Esophagus | 0.7826 | 1 | 0.6429 | PTPRZ1 AND NOT-MUC4 | Glioma | 0.9855 | 0.9855 | 0.9855 |
| SLC52A2 AND NOT-TRPC5 | Esophagus | 0.7273 | 1 | 0.5714 | PTPRZ1 AND NOT-VTCN1 | Glioma | 0.9855 | 0.9855 | 0.9855 |
| SLC52A2 AND NOT-COLQ | Esophagus | 0.8333 | 1 | 0.7143 | PTPRZ1 AND NOT-MSLN | Glioma | 0.9706 | 0.9851 | 0.9565 |
| SLC52A2 AND NOT-JAG1 | Esophagus | 0.6364 | 0.875 | 0.5 | PTPRZ1 AND NOT-CLDN7 | Glioma | 0.963 | 0.9848 | 0.942 |
| SLC52A2 AND NOT-ZP1 | Esophagus | 0.7826 | 1 | 0.6429 | NRCAM AND NOT-CR2 | Glioma | 0.9173 | 0.9531 | 0.8841 |
| SLC52A2 AND NOT-SLC46A2 | Esophagus | 0.8333 | 1 | 0.7143 | NRCAM AND NOT-CLDN8 | Glioma | 0.9173 | 0.9531 | 0.8841 |
| SLC52A2 AND NOT-SLC13A4 | Esophagus | 0.8333 | 1 | 0.7143 | NRCAM AND NOT-ITGB6 | Glioma | 0.9173 | 0.9531 | 0.8841 |
| SLC52A2 AND NOT-SCNN1D | Esophagus | 0.7826 | 1 | 0.6429 | PTPRZ1 AND NOT-CD79B | Glioma | 0.9706 | 0.9851 | 0.9565 |
| SLC52A2 AND NOT-CHRM1 | Esophagus | 0.7826 | 1 | 0.6429 | PTPRZ1 AND NOT-GUCY2C | Glioma | 0.9855 | 0.9855 | 0.9855 |
| SLC52A2 AND NOT-LPAR5 | Esophagus | 0.8 | 0.9091 | 0.7143 | PTPRZ1 AND NOT-TNFRSF8 | Glioma | 0.9781 | 0.9853 | 0.971 |
| SLC52A2 AND NOT-SLC44A1 | Esophagus | 0.6667 | 0.8 | 0.5714 | NLGN1 AND NOT-CLDN6 | Glioma | 0.9302 | 1 | 0.8696 |
| SLC52A2 AND NOT-GRIA3 | Esophagus | 0.8333 | 1 | 0.7143 | NLGN1 AND NOT-GPA33 | Glioma | 0.9385 | 1 | 0.8841 |
| SLC52A2 AND NOT-KCNK7 | Esophagus | 0.6667 | 1 | 0.5 | PTPRZ1 AND NOT-TNFRSF17 | Glioma | 0.9781 | 0.9853 | 0.971 |
| SLC52A2 AND NOT-IFITM10 | Esophagus | 0.7826 | 1 | 0.6429 | PTPRZ1 AND NOT-FCRL5 | Glioma | 0.963 | 0.9848 | 0.942 |
| SLC52A2 AND NOT-CD1E | Esophagus | 0.8333 | 1 | 0.7143 | PTPRZ1 AND NOT-CR2 | Glioma | 0.9781 | 0.9853 | 0.971 |
| SLC52A2 AND NOT-CACNA1G | Esophagus | 0.6667 | 1 | 0.5 | NRCAM AND NOT-CLDN1 | Glioma | 0.9173 | 0.9531 | 0.8841 |
| SLC52A2 AND NOT-CLEC12B | Esophagus | 0.7826 | 1 | 0.6429 | NRCAM AND NOT-CLDN18 | Glioma | 0.9173 | 0.9531 | 0.8841 |
| SLC52A2 AND NOT-NRSN2 | Esophagus | 0.6667 | 1 | 0.5 | NRCAM AND NOT-CLDN9 | Glioma | 0.9173 | 0.9531 | 0.8841 |
| SLC52A2 AND NOT-ABCG2 | Esophagus | 0.6667 | 1 | 0.5 | NRCAM AND NOT-CXCR5 | Glioma | 0.9173 | 0.9531 | 0.8841 |
| SLC52A2 AND NOT-SLC6A2 | Esophagus | 0.7826 | 1 | 0.6429 | NRCAM AND NOT-CLDN6 | Glioma | 0.9173 | 0.9531 | 0.8841 |
| SLC52A2 AND NOT-TACR1 | Esophagus | 0.7826 | 1 | 0.6429 | NRCAM AND NOT-PMEL | Glioma | 0.9173 | 0.9531 | 0.8841 |
| SLC52A2 AND NOT-CD300LG | Esophagus | 0.8333 | 1 | 0.7143 | NRCAM AND NOT-BMPR1B | Glioma | 0.9173 | 0.9531 | 0.8841 |
| SLC52A2 AND NOT-JPH2 | Esophagus | 0.7273 | 1 | 0.5714 | NRCAM AND NOT-FCRL2 | Glioma | 0.9173 | 0.9531 | 0.8841 |
| PTPRZ1 AND NOT-LRP11 | Glioblastoma | 0.875 | 0.9333 | 0.8235 | NRCAM AND NOT-MST1R | Glioma | 0.9173 | 0.9531 | 0.8841 |
| PTPRZ1 AND NOT-SLC2A12 | Glioblastoma | 0.9091 | 0.9375 | 0.8824 | NRCAM AND NOT-CLDN2 | Glioma | 0.9173 | 0.9531 | 0.8841 |
| PTPRZ1 AND NOT-MTUS1 | Glioblastoma | 0.8667 | 1 | 0.7647 | NRCAM AND NOT-SSTR1 | Glioma | 0.9091 | 0.9524 | 0.8696 |
| PTPRZ1 AND NOT-STX8 | Glioblastoma | 0.875 | 0.9333 | 0.8235 | NRCAM AND NOT-ERBB4 | Glioma | 0.9091 | 0.9524 | 0.8696 |
| PTPRZ1 AND NOT-CNST | Glioblastoma | 0.875 | 0.9333 | 0.8235 | NRCAM AND NOT-FOLH1 | Glioma | 0.9091 | 0.9524 | 0.8696 |
| PTPRZ1 AND NOT-LRFN5 | Glioblastoma | 0.875 | 0.9333 | 0.8235 | PTPRZ1 AND NOT-MUC13 | Glioma | 0.9781 | 0.9853 | 0.971 |
| PTPRZ1 AND NOT-VIPR1 | Glioblastoma | 0.9091 | 0.9375 | 0.8824 | PTPRZ1 AND NOT-FCRL2 | Glioma | 0.9778 | 1 | 0.9565 |
| PTPRZ1 AND NOT-NRXN3 | Glioblastoma | 0.875 | 0.9333 | 0.8235 | NRCAM AND NOT-NCAM1 | Glioma | 0.9091 | 0.9524 | 0.8696 |
| PTPRZ1 AND NOT-SYT1 | Glioblastoma | 0.875 | 0.9333 | 0.8235 | ROR2 AND NOT-IL20RA | Leiomyosarcoma | 0.7619 | 1 | 0.6154 |
| PTPRZ1 AND NOT-MEP1A | Glioblastoma | 0.8387 | 0.9286 | 0.7647 | FGFR1 AND NOT-CLDN11 | Leiomyosarcoma | 0.7826 | 0.9 | 0.6923 |
| PTPRZ1 AND NOT-ATP1A1 | Glioblastoma | 0.8387 | 0.9286 | 0.7647 | DDR2 AND NOT-EPCAM | Leiomyosarcoma | 0.8 | 0.8333 | 0.7692 |
| NRCAM AND NOT-LRFN5 | Glioblastoma | 0.8387 | 0.9286 | 0.7647 | FAP AND NOT-SGMS1 | Leiomyosarcoma | 0.7 | 1 | 0.5385 |
| PTPRZ1 AND NOT-KIT | Glioblastoma | 0.8387 | 0.9286 | 0.7647 | FGFR1 AND NOT-EPCAM | Leiomyosarcoma | 0.8182 | 1 | 0.6923 |
| PTPRZ1 AND NOT-EFNA5 | Glioblastoma | 0.8387 | 0.9286 | 0.7647 | FGFR1 AND NOT-IL20RA | Leiomyosarcoma | 0.7619 | 1 | 0.6154 |
| PTPRZ1 AND NOT-NPTN | Glioblastoma | 0.8387 | 0.9286 | 0.7647 | ROR2 AND NOT-RNF43 | Leiomyosarcoma | 0.7619 | 1 | 0.6154 |
| PTPRZ1 AND NOT-ENTPD3 | Glioblastoma | 0.8387 | 0.9286 | 0.7647 | FGFR1 AND NOT-TRPM4 | Leiomyosarcoma | 0.7826 | 0.9 | 0.6923 |
| NRCAM AND NOT-NRXN3 | Glioblastoma | 0.8485 | 0.875 | 0.8235 | FGFR1 AND NOT-ENPP3 | Leiomyosarcoma | 0.8182 | 1 | 0.6923 |
| PTPRZ1 AND NOT-PARM1 | Glioblastoma | 0.875 | 0.9333 | 0.8235 | DDR2 AND NOT-EDNRB | Leiomyosarcoma | 0.6667 | 0.7273 | 0.6154 |
| PTPRZ1 AND NOT-CDH12 | Glioblastoma | 0.875 | 0.9333 | 0.8235 | ROR2 AND NOT-CLDN8 | Leiomyosarcoma | 0.6923 | 0.6923 | 0.6923 |
| PTPRZ1 AND NOT-ACVR2A | Glioblastoma | 0.8387 | 0.9286 | 0.7647 | FGFR1 AND NOT-CLDN7 | Leiomyosarcoma | 0.7619 | 1 | 0.6154 |
| PTPRZ1 AND NOT-KL | Glioblastoma | 0.8387 | 0.9286 | 0.7647 | CD276 AND NOT-LSR | Leiomyosarcoma | 0.75 | 0.8182 | 0.6923 |
| PTPRZ1 AND NOT-ANKH | Glioblastoma | 0.875 | 0.9333 | 0.8235 | OSMR AND NOT-ITGB6 | Leiomyosarcoma | 0.7273 | 0.8889 | 0.6154 |
| PTPRZ1 AND NOT-ATP2C1 | Glioblastoma | 0.875 | 0.9333 | 0.8235 | FGFR1 AND NOT-RNF43 | Leiomyosarcoma | 0.8182 | 1 | 0.6923 |
| PTPRZ1 AND NOT-GJB6 | Glioblastoma | 0.8276 | 1 | 0.7059 | FGFR1 AND NOT-ERBB3 | Leiomyosarcoma | 0.7826 | 0.9 | 0.6923 |
| PTPRZ1 AND NOT-FLRT2 | Glioblastoma | 0.8276 | 1 | 0.7059 | TGFB3 AND NOT-ERBB3 | Leiomyosarcoma | 0.6667 | 0.875 | 0.5385 |
| PTPRZ1 AND NOT-RNF144A | Glioblastoma | 0.8387 | 0.9286 | 0.7647 | OSMR AND NOT-ERBB3 | Leiomyosarcoma | 0.7 | 1 | 0.5385 |
| PTPRZ1 AND NOT-SLC6A1 | Glioblastoma | 0.9032 | 1 | 0.8235 | FGFR1 AND NOT-SLC39A6 | Leiomyosarcoma | 0.6667 | 0.875 | 0.5385 |
| PTPRZ1 AND NOT-TRHDE | Glioblastoma | 0.875 | 0.9333 | 0.8235 | GPR161 AND NOT-ERBB3 | Leiomyosarcoma | 0.8182 | 1 | 0.6923 |
| PTPRZ1 AND NOT-SYT13 | Glioblastoma | 0.875 | 0.9333 | 0.8235 | CD276 AND NOT-CRB3 | Leiomyosarcoma | 0.7273 | 0.8889 | 0.6154 |
| PTPRZ1 AND NOT-EPHB6 | Glioblastoma | 0.875 | 0.9333 | 0.8235 | FGFR1 AND NOT-STEAP1 | Leiomyosarcoma | 0.7826 | 0.9 | 0.6923 |
| PTPRZ1 AND NOT-SV2B | Glioblastoma | 0.875 | 0.9333 | 0.8235 | FGFR1 AND NOT-PMEL | Leiomyosarcoma | 0.7826 | 0.9 | 0.6923 |
| PTPRZ1 AND NOT-VAPA | Glioblastoma | 0.875 | 0.9333 | 0.8235 | FGFR1 AND NOT-SDC1 | Leiomyosarcoma | 0.7273 | 0.8889 | 0.6154 |
| NRCAM AND NOT-SYT1 | Glioblastoma | 0.8667 | 1 | 0.7647 | FGFR1 AND NOT-LGR5 | Leiomyosarcoma | 0.7273 | 0.8889 | 0.6154 |
| PTPRZ1 AND NOT-ANO10 | Glioblastoma | 0.9091 | 0.9375 | 0.8824 | FGFR1 AND NOT-CD34 | Leiomyosarcoma | 0.7826 | 0.9 | 0.6923 |
| NRCAM AND NOT-SLC2A13 | Glioblastoma | 0.9091 | 0.9375 | 0.8824 | FGFR1 AND NOT-CLDN2 | Leiomyosarcoma | 0.8182 | 1 | 0.6923 |
| PTPRZ1 AND NOT-EFNA5 | Glioma | 0.9781 | 0.9853 | 0.971 | FGFR1 AND NOT-CLDN8 | Leiomyosarcoma | 0.7826 | 0.9 | 0.6923 |
| PTPRZ1 AND NOT-CD3G | Glioma | 0.9778 | 1 | 0.9565 | FGFR1 AND NOT-RAET1E | Leiomyosarcoma | 0.8182 | 1 | 0.6923 |
| PTPRZ1 AND NOT-KIAA1324 | Glioma | 0.963 | 0.9848 | 0.942 | FGFR1 AND NOT-CLDN1 | Leiomyosarcoma | 0.7826 | 0.9 | 0.6923 |
| PTPRZ1 AND NOT-FAT2 | Glioma | 0.9855 | 0.9855 | 0.9855 | FGFR1 AND NOT-GUCY2C | Leiomyosarcoma | 0.7619 | 1 | 0.6154 |
| PTPRZ1 AND NOT-C1orf210 | Glioma | 0.9927 | 1 | 0.9855 | ROR2 AND NOT-ENPP3 | Leiomyosarcoma | 0.7 | 1 | 0.5385 |
| PTPRZ1 AND NOT-LRP11 | Glioma | 0.9855 | 0.9855 | 0.9855 | FGFR1 AND NOT-SLC7A5 | Leiomyosarcoma | 0.7273 | 0.8889 | 0.6154 |
| PTPRZ1 AND NOT-FUT1 | Glioma | 0.9855 | 0.9855 | 0.9855 | FGFR1 AND NOT-MUC4 | Leiomyosarcoma | 0.7619 | 1 | 0.6154 |
| PTPRZ1 AND NOT-DSC3 | Glioma | 0.9853 | 1 | 0.971 | DDR2 AND NOT-IL20RA | Leiomyosarcoma | 0.6364 | 0.7778 | 0.5385 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| PTPRZ1 AND NOT-SYT2 | Glioma | 0.9855 | 0.9855 | 0.9855 | AXL AND NOT-GPRC5C | Leiomyosarcoma | 0.6364 | 0.7778 | 0.5385 |
| PTPRZ1 AND NOT-ADRA2C | Glioma | 0.9552 | 0.9846 | 0.9275 | FGFR1 AND NOT-MST1R | Leiomyosarcoma | 0.8182 | 1 | 0.6923 |
| PTPRZ1 AND NOT-SLC26A9 | Glioma | 0.9781 | 0.9853 | 0.971 | FGFR1 AND NOT-ERBB2 | Leiomyosarcoma | 0.7619 | 1 | 0.6154 |
| PTPRZ1 AND NOT-CLCA2 | Glioma | 0.9855 | 0.9855 | 0.9855 | OSMR AND NOT-CLDN1 | Leiomyosarcoma | 0.6364 | 0.7778 | 0.5385 |
| PTPRZ1 AND NOT-GPR68 | Glioma | 0.9855 | 0.9855 | 0.9855 | FGFR1 AND NOT-VTCN1 | Leiomyosarcoma | 0.8182 | 1 | 0.6923 |
| PTPRZ1 AND NOT-SLC5A1 | Glioma | 0.9927 | 1 | 0.9855 | FGFR1 AND NOT-CLDN5 | Leiomyosarcoma | 0.7826 | 0.9 | 0.6923 |
| PTPRZ1 AND NOT-PTGER3 | Glioma | 0.9853 | 1 | 0.971 | FGFR1 AND NOT-CLDN23 | Leiomyosarcoma | 0.7273 | 0.8889 | 0.6154 |
| PTPRZ1 AND NOT-ACVR1B | Glioma | 0.9781 | 0.9853 | 0.971 | FGFR1 AND NOT-ITGB6 | Leiomyosarcoma | 0.8182 | 1 | 0.6923 |
| PTPRZ1 AND NOT-GRM2 | Glioma | 0.9855 | 0.9855 | 0.9855 | FGFR1 AND NOT-CD79B | Leiomyosarcoma | 0.8182 | 1 | 0.6923 |
| PTPRZ1 AND NOT-TNFRSF9 | Glioma | 0.9853 | 1 | 0.971 | FAP AND NOT-NLGN4X | Leiomyosarcoma | 0.6316 | 1 | 0.4615 |
| PTPRZ1 AND NOT-SLC46A2 | Glioma | 0.9781 | 0.9853 | 0.971 | AXL AND NOT-SLCO4A1 | Leiomyosarcoma | 0.7 | 1 | 0.5385 |
| PTPRZ1 AND NOT-KRT5 | Glioma | 0.9706 | 0.9851 | 0.9565 | FGFR1 AND NOT-SSTR3 | Leiomyosarcoma | 0.8182 | 1 | 0.6923 |
| PTPRZ1 AND NOT-SLC28A3 | Glioma | 0.9855 | 0.9855 | 0.9855 | FGFR1 AND NOT-SSTR5 | Leiomyosarcoma | 0.8182 | 1 | 0.6923 |
| PTPRZ1 AND NOT-KCNB2 | Glioma | 0.9855 | 0.9855 | 0.9855 | FGFR1 AND NOT-SLC34A2 | Leiomyosarcoma | 0.8182 | 1 | 0.6923 |
| PTPRZ1 AND NOT-EDAR | Glioma | 0.963 | 0.9848 | 0.942 | FGFR1 AND NOT-MET | Leiomyosarcoma | 0.7826 | 0.9 | 0.6923 |
| PTPRZ1 AND NOT-C15orf27 | Glioma | 0.9853 | 1 | 0.971 | OSMR AND NOT-FOLR1 | Leiomyosarcoma | 0.6316 | 1 | 0.4615 |
| PTPRZ1 AND NOT-SLC18A2 | Glioma | 0.9853 | 1 | 0.971 | ROR2 AND NOT-ERBB3 | Leiomyosarcoma | 0.7619 | 1 | 0.6154 |
| PTPRZ1 AND NOT-SCNN1A | Glioma | 0.9781 | 0.9853 | 0.971 | FGFR1 AND NOT-EDNRB | Leiomyosarcoma | 0.7 | 1 | 0.5385 |
| PTPRZ1 AND NOT-HAS1 | Glioma | 0.9552 | 0.9846 | 0.9275 | GPR176 AND NOT-EPCAM | Leiomyosarcoma | 0.6364 | 0.7778 | 0.5385 |
| PTPRZ1 AND NOT-ATP2A3 | Glioma | 0.9706 | 0.9851 | 0.9565 | DCHS1 AND NOT-ERBB3 | Leiomyosarcoma | 0.7 | 1 | 0.5385 |
| PTPRZ1 AND NOT-ESYT3 | Glioma | 0.9855 | 0.9855 | 0.9855 | OSMR AND NOT-RNF43 | Leiomyosarcoma | 0.6667 | 0.875 | 0.5385 |
| PTPRZ1 AND NOT-PVRL4 | Glioma | 0.9927 | 1 | 0.9855 | DCHS1 AND NOT-IL20RA | Leiomyosarcoma | 0.6667 | 0.875 | 0.5385 |
| PTPRZ1 AND NOT-GJB5 | Glioma | 0.9855 | 0.9855 | 0.9855 | FGFR1 AND NOT-CLDN6 | Leiomyosarcoma | 0.8182 | 1 | 0.6923 |
| PTPRZ1 AND NOT-SYT8 | Glioma | 0.9855 | 0.9855 | 0.9855 | FGFR1 AND NOT-FCRL1 | Leiomyosarcoma | 0.7619 | 1 | 0.6154 |
| PTPRZ1 AND NOT-RHBDL2 | Glioma | 0.9701 | 1 | 0.942 | FGFR1 AND NOT-P2RX5 | Leiomyosarcoma | 0.8182 | 1 | 0.6923 |
| PTPRZ1 AND NOT-MS4A2 | Glioma | 0.9927 | 1 | 0.9855 | ROR2 AND NOT-ERBB4 | Leiomyosarcoma | 0.8182 | 1 | 0.6923 |
| PTPRZ1 AND NOT-COL17A1 | Glioma | 0.9855 | 0.9855 | 0.9855 | FGFR1 AND NOT-TNFRSF13C | Leiomyosarcoma | 0.7 | 1 | 0.5385 |
| PTPRZ1 AND NOT-CD5 | Glioma | 0.9853 | 1 | 0.971 | FGFR1 AND NOT-CLDN18 | Leiomyosarcoma | 0.7619 | 1 | 0.6154 |
| PTPRZ1 AND NOT-S1PR5 | Glioma | 0.9781 | 0.9853 | 0.971 | FGFR1 AND NOT-CD22 | Leiomyosarcoma | 0.8182 | 1 | 0.6923 |
| PTPRZ1 AND NOT-MUC15 | Glioma | 0.9781 | 0.9853 | 0.971 | CD276 AND NOT-FXYD3 | Leiomyosarcoma | 0.7273 | 0.8889 | 0.6154 |
| PTPRZ1 AND NOT-CD1E | Glioma | 0.9855 | 0.9855 | 0.9855 | FAP AND NOT-BCAM | Leiomyosarcoma | 0.8182 | 1 | 0.6923 |
| PTPRZ1 AND NOT-CFTR | Glioma | 0.9855 | 0.9855 | 0.9855 | FGFR1 AND NOT-L1CAM | Leiomyosarcoma | 0.8182 | 1 | 0.6923 |
| PTPRZ1 AND NOT-LPAR3 | Glioma | 0.9474 | 0.9844 | 0.913 | AXL AND NOT-SCN7A | Leiomyosarcoma | 0.6364 | 0.7778 | 0.5385 |
| PTPRZ1 AND NOT-DUOXA1 | Glioma | 0.9701 | 1 | 0.942 | FGFR1 AND NOT-TNFRSF17 | Leiomyosarcoma | 0.7826 | 0.9 | 0.6923 |
| PTPRZ1 AND NOT-FLT3 | Glioma | 0.9853 | 1 | 0.971 | FGFR1 AND NOT-ENG | Leiomyosarcoma | 0.7826 | 0.9 | 0.6923 |
| PTPRZ1 AND NOT-CORIN | Glioma | 0.9781 | 0.9853 | 0.971 | FAP AND NOT-FCER1A | Leiomyosarcoma | 0.7 | 1 | 0.5385 |
| PTPRZ1 AND NOT-KIT | Glioma | 0.963 | 0.9848 | 0.942 | FGFR1 AND NOT-IL3RA | Leiomyosarcoma | 0.7826 | 0.9 | 0.6923 |
| PTPRZ1 AND NOT-MARVELD2 | Glioma | 0.9855 | 0.9855 | 0.9855 | FGFR1 AND NOT-CD180 | Leiomyosarcoma | 0.7826 | 0.9 | 0.6923 |
| NRCAM AND NOT-FRRS1L | Glioma | 0.9385 | 1 | 0.8841 | FGFR1 AND NOT-FCRL5 | Leiomyosarcoma | 0.7826 | 0.9 | 0.6923 |
| PTPRZ1 AND NOT-UPK1A | Glioma | 0.9781 | 0.9853 | 0.971 | FGFR1 AND NOT-ULBP1 | Leiomyosarcoma | 0.8182 | 1 | 0.6923 |
| PTPRZ1 AND NOT-VIPR1 | Glioma | 0.9781 | 0.9853 | 0.971 | FGFR1 AND NOT-FOLR1 | Leiomyosarcoma | 0.7826 | 0.9 | 0.6923 |
| PTPRZ1 AND NOT-PRPH2 | Glioma | 0.9781 | 0.9853 | 0.971 | FGFR1 AND NOT-FCRL2 | Leiomyosarcoma | 0.8182 | 1 | 0.6923 |
| PTPRZ1 AND NOT-GJB6 | Glioma | 0.9853 | 1 | 0.971 | FGFR1 AND NOT-MUC1 | Leiomyosarcoma | 0.7826 | 0.9 | 0.6923 |
| PTPRZ1 AND NOT-LY6K | Glioma | 0.9706 | 0.9851 | 0.9565 | FGFR1 AND NOT-CR2 | Leiomyosarcoma | 0.7826 | 0.9 | 0.6923 |
| PTPRZ1 AND NOT-SYT1 | Glioma | 0.9855 | 0.9855 | 0.9855 | FAP AND NOT-LIFR | Leiomyosarcoma | 0.7 | 1 | 0.5385 |
| PTPRZ1 AND NOT-SIGLEC6 | Glioma | 0.9927 | 1 | 0.9855 | FGFR1 AND NOT-TNFRSF8 | Leiomyosarcoma | 0.8182 | 1 | 0.6923 |
| PTPRZ1 AND NOT-GPR143 | Glioma | 0.9781 | 0.9853 | 0.971 | FGFR1 AND NOT-PROM1 | Leiomyosarcoma | 0.7826 | 0.9 | 0.6923 |
| NRCAM AND NOT-KCNB1 | Glioma | 0.9313 | 0.9839 | 0.8841 | FGFR1 AND NOT-MS4A1 | Leiomyosarcoma | 0.7826 | 0.9 | 0.6923 |
| PTPRZ1 AND NOT-GPR87 | Glioma | 0.9855 | 0.9855 | 0.9855 | FLT3 AND NOT-EDNRB | AML | 0.9545 | 0.9914 | 0.9203 |
| PTPRZ1 AND NOT-KCNJ12 | Glioma | 0.9781 | 0.9853 | 0.971 | FLT3 AND NOT-SLAMF7 | AML | 0.9545 | 0.9914 | 0.9203 |
| PTPRZ1 AND NOT-CD40LG | Glioma | 0.9781 | 0.9853 | 0.971 | FLT3 AND NOT-FCRL1 | AML | 0.9506 | 0.983 | 0.9203 |
| PTPRZ1 AND NOT-SLITRK6 | Glioma | 0.9706 | 0.9851 | 0.9565 | FLT3 AND NOT-CD72 | AML | 0.9506 | 0.983 | 0.9203 |
| PTPRZ1 AND NOT-ANO9 | Glioma | 0.9781 | 0.9853 | 0.971 | FLT3 AND NOT-AXL | AML | 0.9482 | 0.9871 | 0.9124 |
| PTPRZ1 AND NOT-LY6D | Glioma | 0.9855 | 0.9855 | 0.9855 | FLT3 AND NOT-CLDN5 | AML | 0.9467 | 0.9747 | 0.9203 |
| DDR2 AND NOT-PEAR1 | Leiomyosarcoma | 0.8182 | 1 | 0.6923 | FLT3 AND NOT-CLDN12 | AML | 0.9465 | 0.9787 | 0.9163 |
| DDR2 AND NOT-F11R | Leiomyosarcoma | 0.7692 | 0.7692 | 0.7692 | FLT3 AND NOT-RNF43 | AML | 0.9448 | 0.9706 | 0.9203 |
| DDR2 AND NOT-TM7SF2 | Leiomyosarcoma | 0.8696 | 1 | 0.7692 | FLT3 AND NOT-MST1R | AML | 0.9429 | 0.9665 | 0.9203 |
| FGFR1 AND NOT-SGMS1 | Leiomyosarcoma | 0.7826 | 0.9 | 0.6923 | FLT3 AND NOT-TNFRSF10A | AML | 0.9429 | 0.9665 | 0.9203 |
| VMP1 AND NOT-F11R | Leiomyosarcoma | 0.8333 | 0.9091 | 0.7692 | FLT3 AND NOT-VTCN1 | AML | 0.9429 | 0.9665 | 0.9203 |
| DDR2 AND NOT-CHL1 | Leiomyosarcoma | 0.7273 | 0.8889 | 0.6154 | FLT3 AND NOT-IL11RA | AML | 0.9429 | 0.9665 | 0.9203 |
| DDR2 AND NOT-EMCN | Leiomyosarcoma | 0.8333 | 0.9091 | 0.7692 | FLT3 AND NOT-CD79B | AML | 0.9397 | 0.9826 | 0.9004 |
| ROR2 AND NOT-TMEM88 | Leiomyosarcoma | 0.7826 | 0.9 | 0.6923 | FLT3 AND NOT-TPBG | AML | 0.9385 | 0.9662 | 0.9124 |
| FGFR1 AND NOT-TCTN3 | Leiomyosarcoma | 0.7826 | 0.9 | 0.6923 | FLT3 AND NOT-MUC1 | AML | 0.9385 | 0.9662 | 0.9124 |
| DDR2 AND NOT-LIFR | Leiomyosarcoma | 0.6957 | 0.8 | 0.6154 | FLT3 AND NOT-GPNMB | AML | 0.9328 | 0.9867 | 0.8845 |
| SLC4A7 AND NOT-SLC12A6 | Leiomyosarcoma | 0.6957 | 0.8 | 0.6154 | FLT3 AND NOT-ITGAV | AML | 0.9325 | 0.991 | 0.8805 |
| DDR2 AND NOT-TSPAN8 | Leiomyosarcoma | 0.7273 | 0.8889 | 0.6154 | FLT3 AND NOT-VCAM1 | AML | 0.9056 | 0.9814 | 0.8406 |
| DDR2 AND NOT-ADRA2A | Leiomyosarcoma | 0.8182 | 1 | 0.6923 | CD37 AND NOT-HEG1 | AML | 0.9041 | 0.8885 | 0.9203 |
| FGFR1 AND NOT-ADRA2A | Leiomyosarcoma | 0.7826 | 0.9 | 0.6923 | CD37 AND NOT-GPR171 | AML | 0.8919 | 0.8798 | 0.9044 |
| FGFR1 AND NOT-RHBDL2 | Leiomyosarcoma | 0.8182 | 1 | 0.6923 | CD37 AND NOT-IL7R | AML | 0.8893 | 0.8535 | 0.9283 |
| FGFR1 AND NOT-XG | Leiomyosarcoma | 0.7826 | 0.9 | 0.6923 | CD37 AND NOT-AMIGO2 | AML | 0.8872 | 0.8529 | 0.9243 |
| FGFR1 AND NOT-TSPAN31 | Leiomyosarcoma | 0.7619 | 1 | 0.6154 | P2RX1 AND NOT-IL11RA | AML | 0.8971 | 0.875 | 0.9203 |
| FGFR1 AND NOT-TMPRSS6 | Leiomyosarcoma | 0.7619 | 1 | 0.6154 | CD37 AND NOT-CD27 | AML | 0.8867 | 0.8697 | 0.9044 |
| FGFR1 AND NOT-TM7SF2 | Leiomyosarcoma | 0.8182 | 1 | 0.6923 | CD37 AND NOT-BTN3A2 | AML | 0.8845 | 0.8692 | 0.9004 |
| FGFR1 AND NOT-VAMP3 | Leiomyosarcoma | 0.7826 | 0.9 | 0.6923 | CD37 AND NOT-CD2 | AML | 0.8842 | 0.8577 | 0.9124 |
| FGFR1 AND NOT-EREG | Leiomyosarcoma | 0.8182 | 1 | 0.6923 | CD37 AND NOT-P2RY10 | AML | 0.8975 | 0.8722 | 0.9243 |
| FGFR1 AND NOT-PRR7 | Leiomyosarcoma | 0.8182 | 1 | 0.6923 | CD37 AND NOT-SIT1 | AML | 0.8885 | 0.8453 | 0.9363 |
| FGFR1 AND NOT-MFSD5 | Leiomyosarcoma | 0.7826 | 0.9 | 0.6923 | CD37 AND NOT-GPR18 | AML | 0.8736 | 0.8413 | 0.9084 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| DDR2 AND NOT-F3 | Leiomyosarcoma | 0.7273 | 0.8889 | 0.6154 | CD37 AND NOT-SLC44A2 | AML | 0.8729 | 0.8333 | 0.9163 |
| FGFR1 AND NOT-ERMAP | Leiomyosarcoma | 0.7273 | 0.8889 | 0.6154 | CD37 AND NOT-ADTRP | AML | 0.872 | 0.816 | 0.9363 |
| FGFR1 AND NOT-GCGR | Leiomyosarcoma | 0.7619 | 1 | 0.6154 | TSPAN32 AND NOT-FCRL5 | AML | 0.9108 | 0.8537 | 0.9761 |
| ROR2 AND NOT-ABCA8 | Leiomyosarcoma | 0.75 | 0.8182 | 0.6923 | TSPAN32 AND NOT-CR2 | AML | 0.8982 | 0.8261 | 0.9841 |
| ROR2 AND NOT-DLL1 | Leiomyosarcoma | 0.7826 | 0.9 | 0.6923 | CD37 AND NOT-IL2RB | AML | 0.8716 | 0.8517 | 0.8924 |
| FGFR1 AND NOT-ACVR1B | Leiomyosarcoma | 0.8182 | 1 | 0.6923 | TSPAN32 AND NOT-MS4A1 | AML | 0.9057 | 0.8448 | 0.9761 |
| FGFR1 AND NOT-PAQR5 | Leiomyosarcoma | 0.8182 | 1 | 0.6923 | FLT3 AND NOT-SLC7A5 | AML | 0.8709 | 0.966 | 0.7928 |
| FGFR1 AND NOT-SCNN1B | Leiomyosarcoma | 0.8182 | 1 | 0.6923 | TSPAN32 AND NOT-FCRL1 | AML | 0.8909 | 0.8194 | 0.9761 |
| FGFR1 AND NOT-F11R | Leiomyosarcoma | 0.7826 | 0.9 | 0.6923 | CD37 AND NOT-CCR6 | AML | 0.8688 | 0.8103 | 0.9363 |
| FGFR1 AND NOT-PLA2R1 | Leiomyosarcoma | 0.7273 | 0.8889 | 0.6154 | CD37 AND NOT-FCRL3 | AML | 0.8688 | 0.8103 | 0.9363 |
| FGFR1 AND NOT-FXYD3 | Leiomyosarcoma | 0.7619 | 1 | 0.6154 | CSF3R AND NOT-SLAMF7 | AML | 0.9006 | 0.8817 | 0.9203 |
| FGFR1 AND NOT-TACR1 | Leiomyosarcoma | 0.8182 | 1 | 0.6923 | ATP8B4 AND NOT-CLDN23 | AML | 0.8675 | 0.9355 | 0.8088 |
| FGFR1 AND NOT-CDH19 | Leiomyosarcoma | 0.8182 | 1 | 0.6923 | CD37 AND NOT-DPP4 | AML | 0.8673 | 0.8169 | 0.9243 |
| ROR2 AND NOT-MPZ | Leiomyosarcoma | 0.7826 | 0.9 | 0.6923 | TSPAN32 AND NOT-SLAMF7 | AML | 0.9017 | 0.8438 | 0.9681 |
| OSMR AND NOT-F11R | Leiomyosarcoma | 0.7273 | 0.8889 | 0.6154 | CD37 AND NOT-BTLA | AML | 0.8667 | 0.8097 | 0.9323 |
| FGFR1 AND NOT-SMAGP | Leiomyosarcoma | 0.7826 | 0.9 | 0.6923 | CD37 AND NOT-CLEC2D | AML | 0.8818 | 0.8333 | 0.9363 |
| FGFR1 AND NOT-KCNK7 | Leiomyosarcoma | 0.8182 | 1 | 0.6923 | CSF3R AND NOT-MS4A1 | AML | 0.9049 | 0.8826 | 0.9283 |
| FGFR1 AND NOT-LEPR | Leiomyosarcoma | 0.7826 | 0.9 | 0.6923 | TSPAN32 AND NOT-CD22 | AML | 0.8978 | 0.8283 | 0.9801 |
| FGFR1 AND NOT-CD300LB | Leiomyosarcoma | 0.7619 | 1 | 0.6154 | TSPAN32 AND NOT-FCRL2 | AML | 0.8837 | 0.8019 | 0.9841 |
| FGFR1 AND NOT-LIM2 | Leiomyosarcoma | 0.8182 | 1 | 0.6923 | CD37 AND NOT-TIGIT | AML | 0.864 | 0.802 | 0.9363 |
| DDR2 AND NOT-ABCA8 | Leiomyosarcoma | 0.7273 | 0.8889 | 0.6154 | CD37 AND NOT-IFITM1 | AML | 0.8638 | 0.9269 | 0.8088 |
| CNTNAP1 AND NOT-NLGN4X | Leiomyosarcoma | 0.6957 | 0.8 | 0.6154 | CSF3R AND NOT-FCRL1 | AML | 0.8927 | 0.8598 | 0.9283 |
| DDR2 AND NOT-PLP1 | Leiomyosarcoma | 0.7 | 1 | 0.5385 | CD37 AND NOT-SIRPG | AML | 0.8635 | 0.8041 | 0.9323 |
| FGFR1 AND NOT-AGTR1 | Leiomyosarcoma | 0.7273 | 0.8889 | 0.6154 | CD37 AND NOT-CD247 | AML | 0.8632 | 0.8358 | 0.8924 |
| FGFR1 AND NOT-SLC12A2 | Leiomyosarcoma | 0.6667 | 0.875 | 0.5385 | CD37 AND NOT-ST3GAL5 | AML | 0.862 | 0.8201 | 0.9084 |
| FGFR1 AND NOT-SLC15A1 | Leiomyosarcoma | 0.8182 | 1 | 0.6923 | TSPAN32 AND NOT-IL11RA | AML | 0.8665 | 0.8007 | 0.9442 |
| FGFR1 AND NOT-ICOSLG | Leiomyosarcoma | 0.7619 | 1 | 0.6154 | CD37 AND NOT-LTB | AML | 0.8613 | 0.9111 | 0.8167 |
| FGFR1 AND NOT-ATP10B | Leiomyosarcoma | 0.7619 | 1 | 0.6154 | CD37 AND NOT-PLXDC1 | AML | 0.8613 | 0.7946 | 0.9402 |
| FGFR1 AND NOT-P2RY2 | Leiomyosarcoma | 0.8182 | 1 | 0.6923 | CD37 AND NOT-LY9 | AML | 0.8613 | 0.7946 | 0.9402 |
| FGFR1 AND NOT-MTUS1 | Leiomyosarcoma | 0.8182 | 1 | 0.6923 | CD37 AND NOT-PTGDR | AML | 0.8608 | 0.7966 | 0.9363 |
| DDR2 AND NOT-TSPAN7 | Leiomyosarcoma | 0.6667 | 0.875 | 0.5385 | CD37 AND NOT-CD28 | AML | 0.8812 | 0.8487 | 0.9163 |
| FGFR1 AND NOT-LPAR3 | Leiomyosarcoma | 0.8182 | 1 | 0.6923 | CD37 AND NOT-CD40LG | AML | 0.8736 | 0.8188 | 0.9363 |
| FGFR1 AND NOT-ASIC5 | Leiomyosarcoma | 0.7619 | 1 | 0.6154 | P2RX1 AND NOT-CD79B | AML | 0.8663 | 0.868 | 0.8645 |
| FGFR1 AND NOT-CNGA1 | Leiomyosarcoma | 0.7 | 1 | 0.5385 | GYPB AND NOT-EDNRB | AML | 0.859 | 0.9429 | 0.7888 |
| FGFR1 AND NOT-STAB2 | Leiomyosarcoma | 0.7619 | 1 | 0.6154 | CSF3R AND NOT-FCRL5 | AML | 0.9017 | 0.8731 | 0.9323 |
| FGFR1 AND NOT-CD300LG | Leiomyosarcoma | 0.8182 | 1 | 0.6923 | CSF3R AND NOT-CD22 | AML | 0.8851 | 0.8393 | 0.9363 |
| FGFR1 AND NOT-COL17A1 | Leiomyosarcoma | 0.8182 | 1 | 0.6923 | CD37 AND NOT-KLRD1 | AML | 0.8773 | 0.8223 | 0.9402 |
| ROR2 AND NOT-ABCB1 | Leiomyosarcoma | 0.7826 | 0.9 | 0.6923 | CD37 AND NOT-CD8B | AML | 0.8683 | 0.8125 | 0.9323 |
| FGFR1 AND NOT-CXCR1 | Leiomyosarcoma | 0.8182 | 1 | 0.6923 | CD37 AND NOT-CCR7 | AML | 0.8577 | 0.8 | 0.9243 |
| FGFR1 AND NOT-ACPP | Leiomyosarcoma | 0.7619 | 1 | 0.6154 | P2RY8 AND NOT-FCRL5 | AML | 0.9139 | 0.8622 | 0.9721 |
| FGFR1 AND NOT-NLGN3 | Leiomyosarcoma | 0.8182 | 1 | 0.6923 | ATP8B4 AND NOT-CLDN12 | AML | 0.8571 | 0.9384 | 0.7888 |
| FGFR1 AND NOT-KCNK15 | Leiomyosarcoma | 0.7619 | 1 | 0.6154 | TSPAN32 AND NOT-TNFRSF17 | AML | 0.8881 | 0.8231 | 0.9641 |
| FGFR1 AND NOT-SLC44A1 | Leiomyosarcoma | 0.6667 | 0.875 | 0.5385 | CD37 AND NOT-ICOS | AML | 0.8555 | 0.8284 | 0.8845 |
| FGFR1 AND NOT-PROM2 | Leiomyosarcoma | 0.7619 | 1 | 0.6154 | CD37 AND NOT-TLR10 | AML | 0.8608 | 0.7966 | 0.9363 |
| FGFR1 AND NOT-ABHD6 | Leiomyosarcoma | 0.7826 | 0.9 | 0.6923 | P2RY8 AND NOT-MS4A1 | AML | 0.9208 | 0.8746 | 0.9721 |
| PCDH18 AND NOT-ADRA2A | Leiomyosarcoma | 0.6667 | 0.7273 | 0.6154 | CD37 AND NOT-EPHA4 | AML | 0.8545 | 0.786 | 0.9363 |
| ROR2 AND NOT-CRB3 | Leiomyosarcoma | 0.7619 | 1 | 0.6154 | CD37 AND NOT-STX7 | AML | 0.8544 | 0.8333 | 0.8765 |
| FGFR1 AND NOT-IL18R1 | Leiomyosarcoma | 0.8182 | 1 | 0.6923 | CSF3R AND NOT-CD79B | AML | 0.8543 | 0.8683 | 0.8406 |
| FGFR1 AND NOT-IL1RL2 | Leiomyosarcoma | 0.7619 | 1 | 0.6154 | P2RX1 AND NOT-CLDN5 | AML | 0.8541 | 0.7642 | 0.9681 |
| FGFR1 AND NOT-ATP13A4 | Leiomyosarcoma | 0.7619 | 1 | 0.6154 | P2RY8 AND NOT-SLAMF7 | AML | 0.8864 | 0.8203 | 0.9641 |
| FGFR1 AND NOT-LYPD6B | Leiomyosarcoma | 0.8182 | 1 | 0.6923 | P2RY8 AND NOT-CD79B | AML | 0.8533 | 0.8277 | 0.8805 |
| FGFR1 AND NOT-GJB3 | Leiomyosarcoma | 0.8182 | 1 | 0.6923 | CD37 AND NOT-CD8A | AML | 0.8577 | 0.829 | 0.8884 |
| FGFR1 AND NOT-FAM57A | Leiomyosarcoma | 0.6667 | 0.875 | 0.5385 | CD37 AND NOT-KLRF1 | AML | 0.8529 | 0.8007 | 0.9124 |
| FGFR1 AND NOT-YIPF4 | Leiomyosarcoma | 0.7619 | 1 | 0.6154 | CD37 AND NOT-IFNAR1 | AML | 0.8528 | 0.8199 | 0.8884 |
| FGFR1 AND NOT-DIO3 | Leiomyosarcoma | 0.8182 | 1 | 0.6923 | TSPAN32 AND NOT-CD79A | AML | 0.8522 | 0.7562 | 0.9761 |
| FGFR1 AND NOT-MMP15 | Leiomyosarcoma | 0.7619 | 1 | 0.6154 | CD276 AND NOT-CXADR | Liposarcoma | 0.8049 | 0.7174 | 0.9167 |
| FGFR1 AND NOT-KCNJ1 | Leiomyosarcoma | 0.7619 | 1 | 0.6154 | ADAM12 AND NOT-ITGB6 | Liposarcoma | 0.7294 | 0.6327 | 0.8611 |
| FGFR1 AND NOT-UTS2R | Leiomyosarcoma | 0.7826 | 0.9 | 0.6923 | ADAM12 AND NOT-CLDN7 | Liposarcoma | 0.7273 | 0.6829 | 0.7778 |
| FGFR1 AND NOT-GJD4 | Leiomyosarcoma | 0.8182 | 1 | 0.6923 | ADAM12 AND NOT-PROM1 | Liposarcoma | 0.7273 | 0.6829 | 0.7778 |
| FGFR1 AND NOT-CRB3 | Leiomyosarcoma | 0.8182 | 1 | 0.6923 | CD276 AND NOT-ATP2C2 | Liposarcoma | 0.6933 | 0.6667 | 0.7222 |
| FGFR1 AND NOT-TMPRSS5 | Leiomyosarcoma | 0.7619 | 1 | 0.6154 | EPHB2 AND NOT-SEMA4G | Liposarcoma | 0.7647 | 0.8125 | 0.7222 |
| FGFR1 AND NOT-ATP12A | Leiomyosarcoma | 0.7619 | 1 | 0.6154 | EPHB2 AND NOT-STYK1 | Liposarcoma | 0.7077 | 0.7931 | 0.6389 |
| ROR2 AND NOT-SCN7A | Leiomyosarcoma | 0.7826 | 0.9 | 0.6923 | EPHB2 AND NOT-CLCA4 | Liposarcoma | 0.7467 | 0.7179 | 0.7778 |
| FGFR1 AND NOT-NPR3 | Leiomyosarcoma | 0.7619 | 1 | 0.6154 | ADAM12 AND NOT-SDC1 | Liposarcoma | 0.6739 | 0.5536 | 0.8611 |
| FGFR1 AND NOT-BST1 | Leiomyosarcoma | 0.6667 | 0.875 | 0.5385 | EPHB2 AND NOT-IL17RB | Liposarcoma | 0.7353 | 0.7813 | 0.6944 |
| FGFR1 AND NOT-SYP | Leiomyosarcoma | 0.8182 | 1 | 0.6923 | ADAM12 AND NOT-EGFR | Liposarcoma | 0.7671 | 0.7568 | 0.7778 |
| FGFR1 AND NOT-AQP5 | Leiomyosarcoma | 0.7619 | 1 | 0.6154 | CD276 AND NOT-LY6D | Liposarcoma | 0.6923 | 0.6429 | 0.75 |
| FGFR1 AND NOT-CLEC10A | Leiomyosarcoma | 0.7826 | 0.9 | 0.6923 | CD276 AND NOT-FGFR2 | Liposarcoma | 0.7568 | 0.7368 | 0.7778 |
| FGFR1 AND NOT-LY6D | Leiomyosarcoma | 0.8182 | 1 | 0.6923 | ADAM12 AND NOT-ERBB2 | Liposarcoma | 0.6593 | 0.5455 | 0.8333 |
| FGFR1 AND NOT-MPZ | Leiomyosarcoma | 0.8182 | 1 | 0.6923 | ADAM12 AND NOT-SLC7A5 | Liposarcoma | 0.6588 | 0.5714 | 0.7778 |
| FGFR1 AND NOT-C19orf26 | Leiomyosarcoma | 0.7 | 1 | 0.5385 | ADAM12 AND NOT-CLDN23 | Liposarcoma | 0.6588 | 0.5714 | 0.7778 |
| FGFR1 AND NOT-FUT1 | Leiomyosarcoma | 0.7619 | 1 | 0.6154 | FAT4 AND NOT-EPCAM | Liposarcoma | 0.8 | 0.8235 | 0.7778 |
| FGFR1 AND NOT-AQP3 | Leiomyosarcoma | 0.8182 | 1 | 0.6923 | FAT4 AND NOT-CLDN1 | Liposarcoma | 0.6765 | 0.7188 | 0.6389 |
| FGFR1 AND NOT-OR1I1 | Leiomyosarcoma | 0.7619 | 1 | 0.6154 | EPHB2 AND NOT-ABCC3 | Liposarcoma | 0.6944 | 0.6944 | 0.6944 |
| FLT3 AND NOT-HEPH | AML | 0.9545 | 0.9914 | 0.9203 | ADAM12 AND NOT-SLC34A2 | Liposarcoma | 0.65 | 0.5909 | 0.7222 |
| FLT3 AND NOT-ENPP2 | AML | 0.9545 | 0.9914 | 0.9203 | ROR1 AND NOT-TSPAN2 | Liposarcoma | 0.6545 | 0.9474 | 0.5 |
| FLT3 AND NOT-LPAR1 | AML | 0.9545 | 0.9914 | 0.9203 | CD276 AND NOT-TSPAN7 | Liposarcoma | 0.6486 | 0.6316 | 0.6667 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FLT3 AND NOT-PODXL | AML | 0.9545 | 0.9914 | 0.9203 | ADAM12 AND NOT-LGR5 | Liposarcoma | 0.6458 | 0.5167 | 0.8611 |
| FLT3 AND NOT-KCNMA1 | AML | 0.9545 | 0.9914 | 0.9203 | ADAM12 AND NOT-ENG | Liposarcoma | 0.6444 | 0.537 | 0.8056 |
| FLT3 AND NOT-ABHD6 | AML | 0.9545 | 0.9914 | 0.9203 | ROR1 AND NOT-ATP13A3 | Liposarcoma | 0.6429 | 0.9 | 0.5 |
| FLT3 AND NOT-CD28 | AML | 0.9545 | 0.9914 | 0.9203 | ROR1 AND NOT-ITGA3 | Liposarcoma | 0.6429 | 0.9 | 0.5 |
| FLT3 AND NOT-PTPRM | AML | 0.9526 | 0.9872 | 0.9203 | FAT4 AND NOT-ERBB4 | Liposarcoma | 0.6984 | 0.8148 | 0.6111 |
| FLT3 AND NOT-HEG1 | AML | 0.9526 | 0.9872 | 0.9203 | CD276 AND NOT-EPHA1 | Liposarcoma | 0.6829 | 0.6087 | 0.7778 |
| FLT3 AND NOT-PTPRZ1 | AML | 0.9526 | 0.9872 | 0.9203 | CD276 AND NOT-SLC12A2 | Liposarcoma | 0.7027 | 0.6842 | 0.7222 |
| FLT3 AND NOT-SIT1 | AML | 0.9526 | 0.9872 | 0.9203 | EPHB2 AND NOT-MARVELD2 | Liposarcoma | 0.6364 | 0.7 | 0.5833 |
| FLT3 AND NOT-LY9 | AML | 0.9526 | 0.9872 | 0.9203 | EPHB2 AND NOT-ANO9 | Liposarcoma | 0.6364 | 0.7 | 0.5833 |
| FLT3 AND NOT-SLC9A9 | AML | 0.9526 | 0.9872 | 0.9203 | EPHB2 AND NOT-ACE2 | Liposarcoma | 0.6364 | 0.7 | 0.5833 |
| FLT3 AND NOT-LAMP3 | AML | 0.9526 | 0.9872 | 0.9203 | EPHB2 AND NOT-ABCB1 | Liposarcoma | 0.6571 | 0.6765 | 0.6389 |
| FLT3 AND NOT-TIGIT | AML | 0.9524 | 0.9914 | 0.9163 | ROR1 AND NOT-CYP4F2 | Liposarcoma | 0.6316 | 0.8571 | 0.5 |
| FLT3 AND NOT-GOLM1 | AML | 0.9524 | 0.9914 | 0.9163 | ROR1 AND NOT-TSPAN5 | Liposarcoma | 0.6316 | 0.8571 | 0.5 |
| FLT3 AND NOT-ABCC5 | AML | 0.9524 | 0.9914 | 0.9163 | ROR1 AND NOT-SLC2A12 | Liposarcoma | 0.6316 | 0.8571 | 0.5 |
| FLT3 AND NOT-BMPR2 | AML | 0.9524 | 0.9914 | 0.9163 | ROR1 AND NOT-BACE1 | Liposarcoma | 0.6316 | 0.8571 | 0.5 |
| FLT3 AND NOT-PMEPA1 | AML | 0.9524 | 0.9914 | 0.9163 | ROR1 AND NOT-LRP2 | Liposarcoma | 0.6316 | 0.8571 | 0.5 |
| FLT3 AND NOT-P2RY12 | AML | 0.9522 | 0.9957 | 0.9124 | ROR1 AND NOT-CD274 | Liposarcoma | 0.6316 | 0.8571 | 0.5 |
| FLT3 AND NOT-SLC16A4 | AML | 0.9506 | 0.983 | 0.9203 | ROR1 AND NOT-SLC4A7 | Liposarcoma | 0.6429 | 0.9 | 0.5 |
| FLT3 AND NOT-CRIM1 | AML | 0.9506 | 0.983 | 0.9203 | ROR1 AND NOT-ANO10 | Liposarcoma | 0.6316 | 0.8571 | 0.5 |
| FLT3 AND NOT-PDGFRB | AML | 0.9506 | 0.983 | 0.9203 | ROR1 AND NOT-SLC12A1 | Liposarcoma | 0.6316 | 0.8571 | 0.5 |
| FLT3 AND NOT-CD247 | AML | 0.9506 | 0.983 | 0.9203 | ROR1 AND NOT-SLC7A1 | Liposarcoma | 0.6316 | 0.8571 | 0.5 |
| FLT3 AND NOT-TSPAN9 | AML | 0.9506 | 0.983 | 0.9203 | ROR1 AND NOT-KCNMA1 | Liposarcoma | 0.6316 | 0.8571 | 0.5 |
| FLT3 AND NOT-KLRF1 | AML | 0.9506 | 0.983 | 0.9203 | ROR1 AND NOT-AGPAT3 | Liposarcoma | 0.6316 | 0.8571 | 0.5 |
| FLT3 AND NOT-SLC17A5 | AML | 0.9506 | 0.983 | 0.9203 | CD276 AND NOT-KCNK5 | Liposarcoma | 0.6301 | 0.6216 | 0.6389 |
| FLT3 AND NOT-TSPAN6 | AML | 0.9506 | 0.983 | 0.9203 | CD276 AND NOT-ANO9 | Liposarcoma | 0.6301 | 0.6216 | 0.6389 |
| FLT3 AND NOT-ST6GALNAC6 | AML | 0.9506 | 0.983 | 0.9203 | ROR1 AND NOT-OR51B6 | Liposarcoma | 0.6296 | 0.9444 | 0.4722 |
| FLT3 AND NOT-ST3GAL5 | AML | 0.9506 | 0.983 | 0.9203 | EPHB2 AND NOT-SYT13 | Liposarcoma | 0.7222 | 0.7222 | 0.7222 |
| FLT3 AND NOT-P2RY6 | AML | 0.9506 | 0.983 | 0.9203 | EPHB2 AND NOT-TSPAN7 | Liposarcoma | 0.6557 | 0.8 | 0.5556 |
| FLT3 AND NOT-CD274 | AML | 0.9506 | 0.983 | 0.9203 | CD276 AND NOT-CD9 | Liposarcoma | 0.7952 | 0.7021 | 0.9167 |
| FLT3 AND NOT-CAV1 | AML | 0.9506 | 0.983 | 0.9203 | MSR1 AND NOT-CLDN1 | Liposarcoma | 0.6429 | 0.5625 | 0.75 |
| FLT3 AND NOT-FPR3 | AML | 0.9506 | 0.983 | 0.9203 | SLC2A10 AND NOT-MET | Liposarcoma | 0.625 | 0.7143 | 0.5556 |
| FLT3 AND NOT-AMIGO2 | AML | 0.9506 | 0.983 | 0.9203 | ADAM12 AND NOT-CLDN1 | Liposarcoma | 0.625 | 0.7143 | 0.5556 |
| FLT3 AND NOT-ITGA2 | AML | 0.9506 | 0.983 | 0.9203 | EPHB2 AND NOT-IL22RA1 | Liposarcoma | 0.6905 | 0.6042 | 0.8056 |
| FLT3 AND NOT-ITGB5 | AML | 0.9506 | 0.983 | 0.9203 | CD276 AND NOT-TACSTD2 | Liposarcoma | 0.623 | 0.76 | 0.5278 |
| FLT3 AND NOT-ITPR3 | AML | 0.9506 | 0.983 | 0.9203 | CD276 AND NOT-SEMA4G | Liposarcoma | 0.6761 | 0.6857 | 0.6667 |
| FLT3 AND NOT-FAM73A | AML | 0.9506 | 0.983 | 0.9203 | CD276 AND NOT-SLC44A3 | Liposarcoma | 0.7123 | 0.7027 | 0.7222 |
| FLT3 AND NOT-FAT4 | AML | 0.9506 | 0.983 | 0.9203 | ROR1 AND NOT-GPM6A | Liposarcoma | 0.6207 | 0.8182 | 0.5 |
| FLT3 AND NOT-KLRD1 | AML | 0.9506 | 0.983 | 0.9203 | ROR1 AND NOT-CDH2 | Liposarcoma | 0.6207 | 0.8182 | 0.5 |
| FLT3 AND NOT-TMEM150C | AML | 0.9506 | 0.983 | 0.9203 | ROR1 AND NOT-SPINT1 | Liposarcoma | 0.6207 | 0.8182 | 0.5 |
| FLT3 AND NOT-JAM3 | AML | 0.9506 | 0.983 | 0.9203 | ROR1 AND NOT-DCBLD2 | Liposarcoma | 0.6207 | 0.8182 | 0.5 |
| FLT3 AND NOT-M6PR | AML | 0.9506 | 0.983 | 0.9203 | ROR1 AND NOT-LRP12 | Liposarcoma | 0.6207 | 0.8182 | 0.5 |
| FLT3 AND NOT-ZDHHC5 | AML | 0.9506 | 0.983 | 0.9203 | ROR1 AND NOT-NDRG4 | Liposarcoma | 0.6207 | 0.8182 | 0.5 |
| FLT3 AND NOT-CD320 | AML | 0.9506 | 0.983 | 0.9203 | ROR1 AND NOT-GYPE | Liposarcoma | 0.6207 | 0.8182 | 0.5 |
| FLT3 AND NOT-TM4SF1 | AML | 0.9506 | 0.983 | 0.9203 | ROR1 AND NOT-SLC44A5 | Liposarcoma | 0.6207 | 0.8182 | 0.5 |
| FLT3 AND NOT-EMCN | AML | 0.9506 | 0.983 | 0.9203 | ROR1 AND NOT-SORT1 | Liposarcoma | 0.6207 | 0.8182 | 0.5 |
| FLT3 AND NOT-AGTR1 | AML | 0.9506 | 0.983 | 0.9203 | ROR1 AND NOT-TM7SF3 | Liposarcoma | 0.6207 | 0.8182 | 0.5 |
| FLT3 AND NOT-CHIC1 | AML | 0.9506 | 0.983 | 0.9203 | ROR1 AND NOT-TGOLN2 | Liposarcoma | 0.6182 | 0.8947 | 0.4722 |
| FLT3 AND NOT-TEK | AML | 0.9506 | 0.983 | 0.9203 | SLC34A2 AND NOT-FXYD1 | Lung Adenocarcinoma | 0.7619 | 0.8571 | 0.6857 |
| FLT3 AND NOT-PROS1 | AML | 0.9506 | 0.983 | 0.9203 | SLC34A2 AND NOT-DUOX1 | Lung Adenocarcinoma | 0.7176 | 0.7705 | 0.6714 |
| FLT3 AND NOT-MFAP3L | AML | 0.9506 | 0.983 | 0.9203 | SLC34A2 AND NOT-ST6GALNAC6 | Lung Adenocarcinoma | 0.6861 | 0.7015 | 0.6714 |
| FLT3 AND NOT-SLC44A2 | AML | 0.9506 | 0.983 | 0.9203 | SLC34A2 AND NOT-DUOXA1 | Lung Adenocarcinoma | 0.6765 | 0.697 | 0.6571 |
| FLT3 AND NOT-DAG1 | AML | 0.9506 | 0.983 | 0.9203 | SLC34A2 AND NOT-PTGFR | Lung Adenocarcinoma | 0.6761 | 0.6667 | 0.6857 |
| FLT3 AND NOT-WLS | AML | 0.9504 | 0.9871 | 0.9163 | SLC34A2 AND NOT-SLC13A4 | Lung Adenocarcinoma | 0.6757 | 0.641 | 0.7143 |
| FLT3 AND NOT-IL7R | AML | 0.9504 | 0.9871 | 0.9163 | SLC34A2 AND NOT-MGAM | Lung Adenocarcinoma | 0.6718 | 0.7213 | 0.6286 |
| FLT3 AND NOT-BTLA | AML | 0.9504 | 0.9871 | 0.9163 | SLC34A2 AND NOT-SLC6A16 | Lung Adenocarcinoma | 0.6716 | 0.7031 | 0.6429 |
| FLT3 AND NOT-APOLD1 | AML | 0.9502 | 0.9913 | 0.9124 | SLC34A2 AND NOT-ADCY9 | Lung Adenocarcinoma | 0.6667 | 0.7288 | 0.6143 |
| FLT3 AND NOT-PPAP2B | AML | 0.9502 | 0.9913 | 0.9124 | SLC34A2 AND NOT-VSIG2 | Lung Adenocarcinoma | 0.6571 | 0.6571 | 0.6571 |
| FLT3 AND NOT-TRPC1 | AML | 0.9502 | 0.9913 | 0.9124 | SLC34A2 AND NOT-STX2 | Lung Adenocarcinoma | 0.6512 | 0.7119 | 0.6 |
| FLT3 AND NOT-ACVR2A | AML | 0.95 | 0.9956 | 0.9084 | SLC34A2 AND NOT-CLCA4 | Lung Adenocarcinoma | 0.6536 | 0.6024 | 0.7143 |
| FLT3 AND NOT-MR1 | AML | 0.9487 | 0.9788 | 0.9203 | SLC34A2 AND NOT-SLC52A1 | Lung Adenocarcinoma | 0.6452 | 0.5882 | 0.7143 |
| FLT3 AND NOT-RNF144A | AML | 0.9487 | 0.9788 | 0.9203 | SLC34A2 AND NOT-TRPV4 | Lung Adenocarcinoma | 0.6447 | 0.5976 | 0.7 |
| FLT3 AND NOT-PKD2L1 | AML | 0.9487 | 0.9788 | 0.9203 | SLC34A2 AND NOT-KCNMB2 | Lung Adenocarcinoma | 0.6415 | 0.573 | 0.7286 |
| FLT3 AND NOT-ADRA2A | AML | 0.9487 | 0.9788 | 0.9203 | SLC34A2 AND NOT-VAPA | Lung Adenocarcinoma | 0.6504 | 0.7547 | 0.5714 |
| FLT3 AND NOT-ITSN1 | AML | 0.9487 | 0.9788 | 0.9203 | SLC34A2 AND NOT-ATP7B | Lung Adenocarcinoma | 0.637 | 0.6615 | 0.6143 |
| FLT3 AND NOT-APH1B | AML | 0.9487 | 0.9788 | 0.9203 | SLC34A2 AND NOT-SLC51B | Lung Adenocarcinoma | 0.6364 | 0.6774 | 0.6 |
| FLT3 AND NOT-INSR | AML | 0.9487 | 0.9788 | 0.9203 | SLC34A2 AND NOT-SLC13A3 | Lung Adenocarcinoma | 0.6358 | 0.5926 | 0.6857 |
| FLT3 AND NOT-ABCG1 | AML | 0.9487 | 0.9788 | 0.9203 | SLC34A2 AND NOT-ADCY2 | Lung Adenocarcinoma | 0.6335 | 0.5604 | 0.7286 |
| FLT3 AND NOT-IGF2R | AML | 0.9487 | 0.9788 | 0.9203 | SLC34A2 AND NOT-CNNM2 | Lung Adenocarcinoma | 0.6329 | 0.5682 | 0.7143 |
| FLT3 AND NOT-SLC25A4 | AML | 0.9487 | 0.9788 | 0.9203 | SLC34A2 AND NOT-SLC23A1 | Lung Adenocarcinoma | 0.6323 | 0.5765 | 0.7 |
| FLT3 AND NOT-CNGA1 | AML | 0.9487 | 0.9788 | 0.9203 | SLC34A2 AND NOT-DSCAML1 | Lung Adenocarcinoma | 0.6323 | 0.5765 | 0.7 |
| FLT3 AND NOT-SLC16A10 | AML | 0.9485 | 0.9829 | 0.9163 | SLC34A2 AND NOT-SLC9C2 | Lung Adenocarcinoma | 0.6296 | 0.5543 | 0.7286 |
| FLT3 AND NOT-IL6ST | AML | 0.9485 | 0.9829 | 0.9163 | SLC34A2 AND NOT-CLCA2 | Lung Adenocarcinoma | 0.6289 | 0.5618 | 0.7143 |
| FLT3 AND NOT-CDH5 | AML | 0.9485 | 0.9829 | 0.9163 | SLC34A2 AND NOT-KCNE1 | Lung Adenocarcinoma | 0.6282 | 0.5698 | 0.7 |
| FLT3 AND NOT-IFNAR1 | AML | 0.9485 | 0.9829 | 0.9163 | SLC34A2 AND NOT-STOML3 | Lung Adenocarcinoma | 0.6258 | 0.5484 | 0.7286 |
| FLT3 AND NOT-KL | AML | 0.9485 | 0.9829 | 0.9163 | SLC34A2 AND NOT-CELSR1 | Lung Adenocarcinoma | 0.625 | 0.5556 | 0.7143 |
| FLT3 AND NOT-SLC2A8 | AML | 0.9485 | 0.9829 | 0.9163 | SLC34A2 AND NOT-GABRP | Lung Adenocarcinoma | 0.625 | 0.6081 | 0.6429 |
| FLT3 AND NOT-CD40 | AML | 0.9485 | 0.9829 | 0.9163 | SLC34A2 AND NOT-LPAR3 | Lung Adenocarcinoma | 0.6242 | 0.5632 | 0.7 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FLT3 AND NOT-DST | AML | 0.9485 | 0.9829 | 0.9163 | SLC34A2 AND NOT-WDR19 | Lung Adenocarcinoma | 0.6242 | 0.5632 | 0.7 |
| FLT3 AND NOT-ENPP4 | AML | 0.9485 | 0.9829 | 0.9163 | SLC34A2 AND NOT-TGFBR3 | Lung Adenocarcinoma | 0.6214 | 0.9697 | 0.4571 |
| FLT3 AND NOT-TMEM231 | AML | 0.9526 | 0.9872 | 0.9203 | SLC34A2 AND NOT-C1orf101 | Lung Adenocarcinoma | 0.6296 | 0.5543 | 0.7286 |
| FLT3 AND NOT-CLEC4A | AML | 0.9482 | 0.9871 | 0.9124 | SLC34A2 AND NOT-SLC51A | Lung Adenocarcinoma | 0.6203 | 0.5568 | 0.7 |
| FLT3 AND NOT-STX7 | AML | 0.9482 | 0.9871 | 0.9124 | SLC34A2 AND NOT-KRT5 | Lung Adenocarcinoma | 0.6187 | 0.6232 | 0.6143 |
| FLT3 AND NOT-TGFBR3 | AML | 0.9482 | 0.9871 | 0.9124 | SLC34A2 AND NOT-SLC27A1 | Lung Adenocarcinoma | 0.6164 | 0.5921 | 0.6429 |
| FLT3 AND NOT-HMOX2 | AML | 0.9482 | 0.9871 | 0.9124 | SLC34A2 AND NOT-LRRC4 | Lung Adenocarcinoma | 0.6258 | 0.5484 | 0.7286 |
| FLT3 AND NOT-SIRPG | AML | 0.9482 | 0.9871 | 0.9124 | SLC34A2 AND NOT-BBS4 | Lung Adenocarcinoma | 0.6242 | 0.5632 | 0.7 |
| FLT3 AND NOT-GPR171 | AML | 0.9482 | 0.9871 | 0.9124 | SLC34A2 AND NOT-EFNB3 | Lung Adenocarcinoma | 0.6456 | 0.5795 | 0.7286 |
| FLT3 AND NOT-CD27 | AML | 0.948 | 0.9913 | 0.9084 | SLC34A2 AND NOT-DLL1 | Lung Adenocarcinoma | 0.6111 | 0.8684 | 0.4714 |
| FLT3 AND NOT-PSEN2 | AML | 0.9467 | 0.9747 | 0.9203 | SLC34A2 AND NOT-UPK1B | Lung Adenocarcinoma | 0.6111 | 0.5946 | 0.6286 |
| FLT3 AND NOT-JAM2 | AML | 0.9467 | 0.9747 | 0.9203 | SLC34A2 AND NOT-VNN3 | Lung Adenocarcinoma | 0.6111 | 0.5946 | 0.6286 |
| FLT3 AND NOT-FZD7 | AML | 0.9467 | 0.9747 | 0.9203 | SLC34A2 AND NOT-CDH12 | Lung Adenocarcinoma | 0.6104 | 0.5595 | 0.6714 |
| FLT3 AND NOT-SEZ6L2 | AML | 0.9467 | 0.9747 | 0.9203 | SLC34A2 AND NOT-SGMS2 | Lung Adenocarcinoma | 0.6099 | 0.6056 | 0.6143 |
| FLT3 AND NOT-MACF1 | AML | 0.9467 | 0.9747 | 0.9203 | SLC34A2 AND NOT-TSPAN1 | Lung Adenocarcinoma | 0.6087 | 0.5385 | 0.7 |
| FLT3 AND NOT-SLC22A17 | AML | 0.9467 | 0.9747 | 0.9203 | SLC34A2 AND NOT-CDHR3 | Lung Adenocarcinoma | 0.6065 | 0.5529 | 0.6714 |
| FLT3 AND NOT-CDIPT | AML | 0.9467 | 0.9747 | 0.9203 | SLC34A2 AND NOT-NRG4 | Lung Adenocarcinoma | 0.6486 | 0.6154 | 0.6857 |
| FLT3 AND NOT-ZNRF3 | AML | 0.9467 | 0.9747 | 0.9203 | SLC34A2 AND NOT-GJB5 | Lung Adenocarcinoma | 0.6053 | 0.561 | 0.6571 |
| FLT3 AND NOT-GPR176 | AML | 0.9467 | 0.9747 | 0.9203 | SLC34A2 AND NOT-BEST4 | Lung Adenocarcinoma | 0.604 | 0.5696 | 0.6429 |
| SLC2A10 AND NOT-PERP | Liposarcoma | 0.9143 | 0.9412 | 0.8889 | SLC34A2 AND NOT-DSC3 | Lung Adenocarcinoma | 0.6906 | 0.6957 | 0.6857 |
| ADAM12 AND NOT-ITGA6 | Liposarcoma | 0.7949 | 0.7381 | 0.8611 | SLC34A2 AND NOT-APCDD1 | Lung Adenocarcinoma | 0.6483 | 0.6267 | 0.6714 |
| ADAM12 AND NOT-TACSTD2 | Liposarcoma | 0.8378 | 0.8158 | 0.8611 | SLC34A2 AND NOT-PRRT2 | Lung Adenocarcinoma | 0.6581 | 0.6 | 0.7286 |
| CNTNAP1 AND NOT-DPP6 | Liposarcoma | 0.7647 | 0.8125 | 0.7222 | FAP AND NOT-BOC | Lung Adenocarcinoma | 0.6 | 0.825 | 0.4714 |
| MSR1 AND NOT-CXADR | Liposarcoma | 0.7826 | 0.8182 | 0.75 | SLC34A2 AND NOT-SLC4A3 | Lung Adenocarcinoma | 0.6316 | 0.6667 | 0.6 |
| ADAM12 AND NOT-CDH3 | Liposarcoma | 0.7397 | 0.7297 | 0.75 | SLC34A2 AND NOT-CDH26 | Lung Adenocarcinoma | 0.6 | 0.5333 | 0.6857 |
| ADAM12 AND NOT-DSC2 | Liposarcoma | 0.7368 | 0.7 | 0.7778 | OSMR AND NOT-EDNRB | Lung Adenocarcinoma | 0.6 | 0.72 | 0.5143 |
| ADAM12 AND NOT-MUC15 | Liposarcoma | 0.7368 | 0.7 | 0.7778 | SLC34A2 AND NOT-PIGR | Lung Adenocarcinoma | 0.6222 | 0.6462 | 0.6 |
| ADAM12 AND NOT-PERP | Liposarcoma | 0.8169 | 0.8286 | 0.8056 | MAGEA11 AND NOT-JAM3 | Lung Carcinoma | 0.6237 | 1 | 0.4531 |
| ADAM12 AND NOT-OLR1 | Liposarcoma | 0.75 | 0.6818 | 0.8333 | MAGEA11 AND NOT-TRPV6 | Lung Carcinoma | 0.6316 | 0.9677 | 0.4688 |
| ADAM12 AND NOT-LRP2 | Liposarcoma | 0.7229 | 0.6383 | 0.8333 | MAGEA11 AND NOT-PRLR | Lung Carcinoma | 0.625 | 0.9375 | 0.4688 |
| ADAM12 AND NOT-ATP7B | Liposarcoma | 0.7229 | 0.6383 | 0.8333 | MAGEA11 AND NOT-TMEM88 | Lung Carcinoma | 0.6383 | 1 | 0.4688 |
| ADAM12 AND NOT-DSC3 | Liposarcoma | 0.72 | 0.6923 | 0.75 | MAGEA11 AND NOT-GLDN | Lung Carcinoma | 0.6237 | 1 | 0.4531 |
| CNTNAP1 AND NOT-NTRK3 | Liposarcoma | 0.7188 | 0.8214 | 0.6389 | MAGEA11 AND NOT-SLC7A6 | Lung Carcinoma | 0.6383 | 1 | 0.4688 |
| ADAM12 AND NOT-MAL | Liposarcoma | 0.725 | 0.6591 | 0.8056 | MAGEA11 AND NOT-LIFR | Lung Carcinoma | 0.625 | 0.9375 | 0.4688 |
| ADAM12 AND NOT-PCDH10 | Liposarcoma | 0.7381 | 0.6458 | 0.8611 | MAGEA11 AND NOT-APLNR | Lung Carcinoma | 0.6316 | 0.9677 | 0.4688 |
| CNTNAP1 AND NOT-GRIA2 | Liposarcoma | 0.7879 | 0.8667 | 0.7222 | MAGEA11 AND NOT-KCNK5 | Lung Carcinoma | 0.6383 | 1 | 0.4688 |
| ADAM12 AND NOT-MFSD2A | Liposarcoma | 0.7059 | 0.6122 | 0.8333 | MAGEA11 AND NOT-CLEC1A | Lung Carcinoma | 0.6316 | 0.9677 | 0.4688 |
| ADAM12 AND NOT-DAG1 | Liposarcoma | 0.7013 | 0.6585 | 0.75 | MAGEA11 AND NOT-SLC19A3 | Lung Carcinoma | 0.625 | 0.9375 | 0.4688 |
| CNTNAP1 AND NOT-GRIK2 | Liposarcoma | 0.7188 | 0.8214 | 0.6389 | MAGEA11 AND NOT-CADM3 | Lung Carcinoma | 0.6316 | 0.9677 | 0.4688 |
| ADAM12 AND NOT-STXBP2 | Liposarcoma | 0.6977 | 0.6 | 0.8333 | MAGEA11 AND NOT-FURIN | Lung Carcinoma | 0.6316 | 0.9677 | 0.4688 |
| ADAM12 AND NOT-DPP4 | Liposarcoma | 0.6977 | 0.6 | 0.8333 | MAGEA11 AND NOT-KIAA1919 | Lung Carcinoma | 0.6316 | 0.9677 | 0.4688 |
| ADAM12 AND NOT-IL6ST | Liposarcoma | 0.6933 | 0.6667 | 0.7222 | MAGEA11 AND NOT-SLC7A2 | Lung Carcinoma | 0.6186 | 0.9091 | 0.4688 |
| ADAM12 AND NOT-P2RY14 | Liposarcoma | 0.6933 | 0.6667 | 0.7222 | MAGEA11 AND NOT-SYT12 | Lung Carcinoma | 0.617 | 0.9667 | 0.4531 |
| ADAM12 AND NOT-SEMA6D | Liposarcoma | 0.6905 | 0.6042 | 0.8056 | MAGEA11 AND NOT-EPOR | Lung Carcinoma | 0.6122 | 0.8824 | 0.4688 |
| ADAM12 AND NOT-CSF2RB | Liposarcoma | 0.6857 | 0.7059 | 0.6667 | MAGEA11 AND NOT-SLC13A3 | Lung Carcinoma | 0.6122 | 0.8824 | 0.4688 |
| ADAM12 AND NOT-ATP12A | Liposarcoma | 0.6829 | 0.6087 | 0.7778 | MAGEA11 AND NOT-FLT4 | Lung Carcinoma | 0.6105 | 0.9355 | 0.4531 |
| ADAM12 AND NOT-CXADR | Liposarcoma | 0.6824 | 0.5918 | 0.8056 | MAGEA11 AND NOT-PCDH12 | Lung Carcinoma | 0.6105 | 0.9355 | 0.4531 |
| PON2 AND NOT-ABCB1 | Lung Adenocarcinoma | 0.6355 | 0.9189 | 0.4857 | MAGEA11 AND NOT-C1QTNF1 | Lung Carcinoma | 0.6105 | 0.9355 | 0.4531 |
| OSMR AND NOT-LYVE1 | Lung Adenocarcinoma | 0.625 | 0.8333 | 0.5 | MAGEA11 AND NOT-VAMP2 | Lung Carcinoma | 0.6087 | 1 | 0.4375 |
| OSMR AND NOT-JAM3 | Lung Adenocarcinoma | 0.6182 | 0.85 | 0.4857 | MAGEA11 AND NOT-SLC26A6 | Lung Carcinoma | 0.6087 | 1 | 0.4375 |
| OSMR AND NOT-SEMA6A | Lung Adenocarcinoma | 0.6071 | 0.8095 | 0.4857 | MAGEA11 AND NOT-ZFYVE27 | Lung Carcinoma | 0.6237 | 1 | 0.4531 |
| OSMR AND NOT-NGFR | Lung Adenocarcinoma | 0.6034 | 0.7609 | 0.5 | MAGEA11 AND NOT-SLC30A2 | Lung Carcinoma | 0.6122 | 0.8824 | 0.4688 |
| OSMR AND NOT-TGFBR3 | Lung Adenocarcinoma | 0.6019 | 0.9394 | 0.4429 | MAGEA11 AND NOT-SIGLEC6 | Lung Carcinoma | 0.6186 | 0.9091 | 0.4688 |
| SEMA4F AND NOT-GPM6A | Lung Carcinoma | 0.6197 | 0.5641 | 0.6875 | MAGEA11 AND NOT-ADCY6 | Lung Carcinoma | 0.6042 | 0.9063 | 0.4531 |
| CHRNA5 AND NOT-GRIK2 | Lung Carcinoma | 0.608 | 0.623 | 0.5938 | MAGEA11 AND NOT-SPPL3 | Lung Carcinoma | 0.6022 | 0.9655 | 0.4375 |
| ADAM12 AND NOT-MPZ | Lung Carcinoma | 0.6259 | 0.5542 | 0.7188 | MAGEA11 AND NOT-PTH1R | Lung Carcinoma | 0.6022 | 0.9655 | 0.4375 |
| SEMA4F AND NOT-ATP1B2 | Lung Carcinoma | 0.6056 | 0.5513 | 0.6719 | MAGEA11 AND NOT-CRIM1 | Lung Carcinoma | 0.6022 | 0.9655 | 0.4375 |
| ADAM12 AND NOT-CD300LG | Lung Carcinoma | 0.6138 | 0.464 | 0.9063 | MAGEA11 AND NOT-KCNK3 | Lung Carcinoma | 0.6122 | 0.8824 | 0.4688 |
| CXCL9 AND NOT-FCER1A | B-Cell Diffuse | 0.7937 | 0.9615 | 0.6757 | MAGEA11 AND NOT-LRP2 | Lung Carcinoma | 0.6122 | 0.8824 | 0.4688 |
| CXCL9 AND NOT-SLC16A10 | B-Cell Diffuse | 0.8 | 0.9286 | 0.7027 | MAGEA11 AND NOT-TREML2 | Lung Carcinoma | 0.6122 | 0.8824 | 0.4688 |
| CXCL9 AND NOT-EREG | B-Cell Diffuse | 0.7813 | 0.9259 | 0.6757 | MAGEA11 AND NOT-CSF3R | Lung Carcinoma | 0.6122 | 0.8824 | 0.4688 |
| CXCL9 AND NOT-KCNJ15 | B-Cell Diffuse | 0.7813 | 0.9259 | 0.6757 | MAGEA11 AND NOT-STRA6 | Lung Carcinoma | 0.6122 | 0.8824 | 0.4688 |
| CXCL9 AND NOT-CLEC5A | B-Cell Diffuse | 0.7742 | 0.96 | 0.6486 | MAGEA11 AND NOT-TMEM150A | Lung Carcinoma | 0.617 | 0.9667 | 0.4531 |
| CXCL9 AND NOT-TLR3 | B-Cell Diffuse | 0.7692 | 0.8929 | 0.6757 | MAGEA11 AND NOT-KCNN4 | Lung Carcinoma | 0.6237 | 1 | 0.4531 |
| CXCL9 AND NOT-GPR35 | B-Cell Diffuse | 0.7692 | 0.8929 | 0.6757 | MAGEA11 AND NOT-TMEM150C | Lung Carcinoma | 0.617 | 0.9667 | 0.4531 |
| CXCL9 AND NOT-SERINC5 | B-Cell Diffuse | 0.7692 | 0.8929 | 0.6757 | MAGEA11 AND NOT-SYT7 | Lung Carcinoma | 0.6122 | 0.8824 | 0.4688 |
| CXCL9 AND NOT-S1PR5 | B-Cell Diffuse | 0.7647 | 0.8387 | 0.7027 | MAGEA11 AND NOT-BCAM | Lung Carcinoma | 0.6042 | 0.9063 | 0.4531 |
| CD80 AND NOT-FCER1A | B-Cell Diffuse | 0.7692 | 0.8929 | 0.6757 | MAGEA11 AND NOT-ADCY4 | Lung Carcinoma | 0.6087 | 1 | 0.4375 |
| CXCL9 AND NOT-PLB1 | B-Cell Diffuse | 0.7619 | 0.9231 | 0.6486 | CD180 AND NOT-CXCR2 | B-Cell Diffuse | 0.7647 | 0.8387 | 0.7027 |
| CXCL9 AND NOT-GJB2 | B-Cell Diffuse | 0.7619 | 0.9231 | 0.6486 | CD180 AND NOT-FCER1A | B-Cell Diffuse | 0.7429 | 0.7879 | 0.7027 |
| MCOLN2 AND NOT-GPR35 | B-Cell Diffuse | 0.7619 | 0.9231 | 0.6486 | CXCL9 AND NOT-CLDN1 | B-Cell Diffuse | 0.7429 | 0.7879 | 0.7027 |
| CXCL9 AND NOT-SGMS2 | B-Cell Diffuse | 0.7576 | 0.8621 | 0.6757 | MCOLN2 AND NOT-ERBB3 | B-Cell Diffuse | 0.7429 | 0.7879 | 0.7027 |
| CXCL9 AND NOT-ITGB5 | B-Cell Diffuse | 0.7576 | 0.8621 | 0.6757 | CXCL9 AND NOT-CLDN11 | B-Cell Diffuse | 0.7353 | 0.8065 | 0.6757 |
| CXCL9 AND NOT-ITM2B | B-Cell Diffuse | 0.7536 | 0.8125 | 0.7027 | CXCL9 AND NOT-RAET1E | B-Cell Diffuse | 0.7324 | 0.7647 | 0.7027 |
| CXCL9 AND NOT-GJB6 | B-Cell Diffuse | 0.7536 | 0.8125 | 0.7027 | CD79A AND NOT-TSPAN32 | B-Cell Diffuse | 0.7302 | 0.8846 | 0.6216 |
| MCOLN2 AND NOT-MRAP2 | B-Cell Diffuse | 0.7536 | 0.8125 | 0.7027 | CXCR5 AND NOT-TSPAN32 | B-Cell Diffuse | 0.7397 | 0.75 | 0.7297 |
| CD80 AND NOT-S1PR5 | B-Cell Diffuse | 0.7536 | 0.8125 | 0.7027 | VCAM1 AND NOT-SLC16A2 | B-Cell Diffuse | 0.7273 | 0.8276 | 0.6486 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CXCL9 AND NOT-EMCN | B-Cell Diffuse | 0.7536 | 0.8125 | 0.7027 | CXCL9 AND NOT-AXL | B-Cell Diffuse | 0.7246 | 0.7813 | 0.6757 |
| CXCL9 AND NOT-STX3 | B-Cell Diffuse | 0.75 | 0.8889 | 0.6486 | CXCL9 AND NOT-IL11RA | B-Cell Diffuse | 0.7246 | 0.7813 | 0.6757 |
| TNFRSF9 AND NOT-BEST1 | B-Cell Diffuse | 0.75 | 0.8889 | 0.6486 | CXCL9 AND NOT-BMPR1B | B-Cell Diffuse | 0.7222 | 0.7429 | 0.7027 |
| CXCL9 AND NOT-SLC22A4 | B-Cell Diffuse | 0.75 | 0.8889 | 0.6486 | CXCL9 AND NOT-ERBB4 | B-Cell Diffuse | 0.7222 | 0.7429 | 0.7027 |
| CXCL9 AND NOT-LGR6 | B-Cell Diffuse | 0.75 | 0.8889 | 0.6486 | MCOLN2 AND NOT-GPA33 | B-Cell Diffuse | 0.7222 | 0.7429 | 0.7027 |
| MCOLN2 AND NOT-SLC4A4 | B-Cell Diffuse | 0.75 | 0.7714 | 0.7297 | CXCL9 AND NOT-PROM1 | B-Cell Diffuse | 0.7222 | 0.7429 | 0.7027 |
| MCOLN2 AND NOT-ANO5 | B-Cell Diffuse | 0.75 | 0.7714 | 0.7297 | MCOLN2 AND NOT-MUC1 | B-Cell Diffuse | 0.7164 | 0.8 | 0.6486 |
| MCOLN2 AND NOT-SYT13 | B-Cell Diffuse | 0.75 | 0.7714 | 0.7297 | CD180 AND NOT-CLEC1B | B-Cell Diffuse | 0.7429 | 0.7879 | 0.7027 |
| CXCL9 AND NOT-BEST1 | B-Cell Diffuse | 0.7463 | 0.8333 | 0.6757 | CD79B AND NOT-RNF144A | B-Cell Diffuse | 0.7143 | 0.7576 | 0.6757 |
| CXCL9 AND NOT-RHOT1 | B-Cell Diffuse | 0.7463 | 0.8333 | 0.6757 | CXCL9 AND NOT-ULBP2 | B-Cell Diffuse | 0.7143 | 0.7576 | 0.6757 |
| CXCL9 AND NOT-CAV2 | B-Cell Diffuse | 0.7463 | 0.8333 | 0.6757 | CXCL9 AND NOT-ERBB3 | B-Cell Diffuse | 0.7143 | 0.7576 | 0.6757 |
| CD80 AND NOT-CXCR2 | B-Cell Diffuse | 0.7463 | 0.8333 | 0.6757 | CD79B AND NOT-SLC46A2 | B-Cell Diffuse | 0.7143 | 0.7576 | 0.6757 |
| CXCL9 AND NOT-ADCY9 | B-Cell Diffuse | 0.7463 | 0.8333 | 0.6757 | CD79B AND NOT-ASGR1 | B-Cell Diffuse | 0.7143 | 0.7576 | 0.6757 |
| TNFRSF9 AND NOT-CD300LB | B-Cell Diffuse | 0.7463 | 0.8333 | 0.6757 | CXCL9 AND NOT-RNF43 | B-Cell Diffuse | 0.7143 | 0.7576 | 0.6757 |
| CXCL9 AND NOT-PCDHB16 | B-Cell Diffuse | 0.7463 | 0.8333 | 0.6757 | CXCL9 AND NOT-CD34 | B-Cell Diffuse | 0.7143 | 0.7576 | 0.6757 |
| CXCL9 AND NOT-PROS1 | B-Cell Diffuse | 0.7463 | 0.8333 | 0.6757 | CD79B AND NOT-CD244 | B-Cell Diffuse | 0.7143 | 0.7576 | 0.6757 |
| MCOLN2 AND NOT-LGR6 | B-Cell Diffuse | 0.7463 | 0.8333 | 0.6757 | CD79B AND NOT-SLC18A2 | B-Cell Diffuse | 0.7143 | 0.7576 | 0.6757 |
| FAM26F AND NOT-FCER1A | B-Cell Diffuse | 0.8052 | 0.775 | 0.8378 | CD79B AND NOT-SLC24A1 | B-Cell Diffuse | 0.7143 | 0.7576 | 0.6757 |
| MCOLN2 AND NOT-FCER1A | B-Cell Diffuse | 0.7463 | 0.8333 | 0.6757 | CD79B AND NOT-CXCR2 | B-Cell Diffuse | 0.7143 | 0.7576 | 0.6757 |
| CXCL9 AND NOT-TNFRSF19 | B-Cell Diffuse | 0.7429 | 0.7879 | 0.7027 | CD79B AND NOT-AMICA1 | B-Cell Diffuse | 0.7143 | 0.7576 | 0.6757 |
| CXCL9 AND NOT-KCNJ5 | B-Cell Diffuse | 0.7429 | 0.7879 | 0.7027 | CXCL9 AND NOT-IL20RA | B-Cell Diffuse | 0.7123 | 0.7222 | 0.7027 |
| CXCL9 AND NOT-GLDN | B-Cell Diffuse | 0.7429 | 0.7879 | 0.7027 | CXCL9 AND NOT-CLDN18 | B-Cell Diffuse | 0.7123 | 0.7222 | 0.7027 |
| CXCL9 AND NOT-MFAP3L | B-Cell Diffuse | 0.7429 | 0.7879 | 0.7027 | MCOLN2 AND NOT-PROM1 | B-Cell Diffuse | 0.7123 | 0.7222 | 0.7027 |
| CXCL9 AND NOT-NTRK1 | B-Cell Diffuse | 0.7429 | 0.7879 | 0.7027 | CXCL9 AND NOT-MUC13 | B-Cell Diffuse | 0.7123 | 0.7222 | 0.7027 |
| CXCL9 AND NOT-CD300LG | B-Cell Diffuse | 0.7429 | 0.7879 | 0.7027 | CD80 AND NOT-CLDN1 | B-Cell Diffuse | 0.7123 | 0.7222 | 0.7027 |
| CXCL9 AND NOT-SLC28A3 | B-Cell Diffuse | 0.7429 | 0.7879 | 0.7027 | CXCL9 AND NOT-MSLN | B-Cell Diffuse | 0.7123 | 0.7222 | 0.7027 |
| CXCL9 AND NOT-BDKRB1 | B-Cell Diffuse | 0.7429 | 0.7879 | 0.7027 | CD80 AND NOT-BMPR1B | B-Cell Diffuse | 0.7123 | 0.7222 | 0.7027 |
| CXCL9 AND NOT-NEO1 | B-Cell Diffuse | 0.7429 | 0.7879 | 0.7027 | MCOLN2 AND NOT-MUC4 | B-Cell Diffuse | 0.7123 | 0.7222 | 0.7027 |
| CXCL9 AND NOT-DUOX1 | B-Cell Diffuse | 0.7429 | 0.7879 | 0.7027 | MCOLN2 AND NOT-ITGB6 | B-Cell Diffuse | 0.7123 | 0.7222 | 0.7027 |
| CXCL9 AND NOT-PTPRZ1 | B-Cell Diffuse | 0.7429 | 0.7879 | 0.7027 | MCOLN2 AND NOT-MUC13 | B-Cell Diffuse | 0.7105 | 0.6923 | 0.7297 |
| CXCL9 AND NOT-GDPD2 | B-Cell Diffuse | 0.7429 | 0.7879 | 0.7027 | CD79B AND NOT-ITSN1 | B-Cell Diffuse | 0.7143 | 0.7576 | 0.6757 |
| CXCL9 AND NOT-SORT1 | B-Cell Diffuse | 0.7419 | 0.92 | 0.6216 | CD79A AND NOT-FCER1A | B-Cell Diffuse | 0.7188 | 0.8519 | 0.6216 |
| CXCL9 AND NOT-FCGRT | B-Cell Diffuse | 0.7419 | 0.92 | 0.6216 | CD40 AND NOT-SDC1 | B-Cell Diffuse | 0.7143 | 0.7576 | 0.6757 |
| CXCL9 AND NOT-NRP1 | B-Cell Diffuse | 0.7419 | 0.92 | 0.6216 | CD40 AND NOT-EDNRB | B-Cell Diffuse | 0.7246 | 0.7813 | 0.6757 |
| CXCL9 AND NOT-SDC2 | B-Cell Diffuse | 0.7419 | 0.92 | 0.6216 | CD40 AND NOT-AXL | B-Cell Diffuse | 0.7059 | 0.7742 | 0.6486 |
| CXCL9 AND NOT-EMP1 | B-Cell Diffuse | 0.7419 | 0.92 | 0.6216 | CD79A AND NOT-CXCR2 | B-Cell Diffuse | 0.7059 | 0.7742 | 0.6486 |
| MCOLN2 AND NOT-SEMA4G | B-Cell Diffuse | 0.7397 | 0.75 | 0.7297 | CXCL9 AND NOT-CSPG4 | B-Cell Diffuse | 0.7059 | 0.7742 | 0.6486 |
| MCOLN2 AND NOT-PCDH19 | B-Cell Diffuse | 0.7397 | 0.75 | 0.7297 | CD79B AND NOT-KLRD1 | B-Cell Diffuse | 0.7042 | 0.7353 | 0.6757 |
| MCOLN2 AND NOT-CA4 | B-Cell Diffuse | 0.7397 | 0.75 | 0.7297 | CD79B AND NOT-INSR | B-Cell Diffuse | 0.7042 | 0.7353 | 0.6757 |
| MCOLN2 AND NOT-IHH | B-Cell Diffuse | 0.7397 | 0.75 | 0.7297 | CXCL9 AND NOT-ITGB6 | B-Cell Diffuse | 0.7042 | 0.7353 | 0.6757 |
| MCOLN2 AND NOT-SLC51B | B-Cell Diffuse | 0.7385 | 0.8571 | 0.6486 | CXCL9 AND NOT-EDNRB | B-Cell Diffuse | 0.7042 | 0.7353 | 0.6757 |
| CXCL9 AND NOT-ATP10A | B-Cell Diffuse | 0.7385 | 0.8571 | 0.6486 | CD79B AND NOT-FCER1A | B-Cell Diffuse | 0.7042 | 0.7353 | 0.6757 |
| CD80 AND NOT-SLC16A10 | B-Cell Diffuse | 0.7647 | 0.8387 | 0.7027 | CD79B AND NOT-TLR5 | B-Cell Diffuse | 0.7042 | 0.7353 | 0.6757 |
| CD80 AND NOT-GPR35 | B-Cell Diffuse | 0.7619 | 0.9231 | 0.6486 | CD79B AND NOT-CX3CR1 | B-Cell Diffuse | 0.7042 | 0.7353 | 0.6757 |
| CD80 AND NOT-HAS1 | B-Cell Diffuse | 0.7353 | 0.8065 | 0.6757 | CXCL9 AND NOT-GPA33 | B-Cell Diffuse | 0.7042 | 0.7353 | 0.6757 |
| CXCL9 AND NOT-FZD10 | B-Cell Diffuse | 0.7353 | 0.8065 | 0.6757 | CXCL9 AND NOT-FOLH1 | B-Cell Diffuse | 0.7042 | 0.7353 | 0.6757 |
| CXCL9 AND NOT-SLC24A3 | B-Cell Diffuse | 0.7353 | 0.8065 | 0.6757 | CXCL9 AND NOT-EGFR | B-Cell Diffuse | 0.7042 | 0.7353 | 0.6757 |
| MCOLN2 AND NOT-SLC26A3 | B-Cell Diffuse | 0.7353 | 0.8065 | 0.6757 | CD79B AND NOT-PKN2 | B-Cell Diffuse | 0.7042 | 0.7353 | 0.6757 |
| CXCL9 AND NOT-RECK | B-Cell Diffuse | 0.7353 | 0.8065 | 0.6757 | CD79B AND NOT-ABCA2 | B-Cell Diffuse | 0.7042 | 0.7353 | 0.6757 |
| CXCL9 AND NOT-WLS | B-Cell Diffuse | 0.7353 | 0.8065 | 0.6757 | CXCL9 AND NOT-SDC1 | B-Cell Diffuse | 0.7042 | 0.7353 | 0.6757 |
| CXCL9 AND NOT-EMP2 | B-Cell Diffuse | 0.7353 | 0.8065 | 0.6757 | CD79B AND NOT-MFAP3L | B-Cell Diffuse | 0.7042 | 0.7353 | 0.6757 |
| CXCL9 AND NOT-LDLRAD3 | B-Cell Diffuse | 0.7353 | 0.8065 | 0.6757 | CD79B AND NOT-CLEC12A | B-Cell Diffuse | 0.7042 | 0.7353 | 0.6757 |
| CXCL9 AND NOT-CADM3 | B-Cell Diffuse | 0.7353 | 0.8065 | 0.6757 | MCOLN2 AND NOT-ERBB2 | B-Cell Diffuse | 0.7042 | 0.7353 | 0.6757 |
| CXCL9 AND NOT-SLC18A2 | B-Cell Diffuse | 0.7353 | 0.8065 | 0.6757 | CXCL9 AND NOT-CLDN23 | Anaplastic Lymphoma | 0.6667 | 0.8889 | 0.5333 |
| CXCL9 AND NOT-BMP2 | B-Cell Diffuse | 0.7353 | 0.8065 | 0.6757 | IL2RA AND NOT-GAL3ST1 | Anaplastic Lymphoma | 0.6667 | 0.75 | 0.6 |
| CXCL9 AND NOT-SLC1A7 | B-Cell Diffuse | 0.7353 | 0.8065 | 0.6757 | IL2RA AND NOT-GPM6A | Anaplastic Lymphoma | 0.6667 | 0.75 | 0.6 |
| CD80 AND NOT-ITM2B | B-Cell Diffuse | 0.7536 | 0.8125 | 0.7027 | IL2RA AND NOT-KCNH7 | Anaplastic Lymphoma | 0.6667 | 0.75 | 0.6 |
| CLECL1 AND NOT-SLC18A2 | B-Cell Diffuse | 0.7333 | 0.9565 | 0.5946 | IL2RA AND NOT-KCNH5 | Anaplastic Lymphoma | 0.6667 | 0.75 | 0.6 |
| CLECL1 AND NOT-ABCA2 | B-Cell Diffuse | 0.7333 | 0.9565 | 0.5946 | IL2RA AND NOT-SCNN1D | Anaplastic Lymphoma | 0.6667 | 0.75 | 0.6 |
| CLECL1 AND NOT-ITM2B | B-Cell Diffuse | 0.7333 | 0.9565 | 0.5946 | IL2RA AND NOT-GPR75 | Anaplastic Lymphoma | 0.6667 | 0.75 | 0.6 |
| CXCL9 AND NOT-SLCO3A1 | B-Cell Diffuse | 0.7333 | 0.9565 | 0.5946 | IL2RA AND NOT-PKHD1 | Anaplastic Lymphoma | 0.6667 | 0.75 | 0.6 |
| CXCL9 AND NOT-KCNJ13 | B-Cell Diffuse | 0.7324 | 0.7647 | 0.7027 | IL2RA AND NOT-IL1RAPL1 | Anaplastic Lymphoma | 0.6667 | 0.75 | 0.6 |
| CXCL9 AND NOT-ANO5 | B-Cell Diffuse | 0.7324 | 0.7647 | 0.7027 | IL2RA AND NOT-SLC28A2 | Anaplastic Lymphoma | 0.6667 | 0.75 | 0.6 |
| CXCL9 AND NOT-DSC3 | B-Cell Diffuse | 0.7324 | 0.7647 | 0.7027 | IL2RA AND NOT-SGCD | Anaplastic Lymphoma | 0.6667 | 0.75 | 0.6 |
| CXCL9 AND NOT-SGCA | B-Cell Diffuse | 0.7324 | 0.7647 | 0.7027 | IL2RA AND NOT-FAT3 | Anaplastic Lymphoma | 0.6429 | 0.6923 | 0.6 |
| CXCL9 AND NOT-HCN3 | B-Cell Diffuse | 0.7324 | 0.7647 | 0.7027 | IL2RA AND NOT-SLC29A2 | Anaplastic Lymphoma | 0.6667 | 0.75 | 0.6 |
| CXCL9 AND NOT-CLCA2 | B-Cell Diffuse | 0.7324 | 0.7647 | 0.7027 | IL2RA AND NOT-FGFR3 | Anaplastic Lymphoma | 0.6667 | 0.75 | 0.6 |
| CXCL9 AND NOT-AGTR1 | B-Cell Diffuse | 0.7324 | 0.7647 | 0.7027 | IL2RA AND NOT-SLC43A2 | Anaplastic Lymphoma | 0.6957 | 1 | 0.5333 |
| CXCL9 AND NOT-ABCA8 | B-Cell Diffuse | 0.7324 | 0.7647 | 0.7027 | IL2RA AND NOT-KCNJ16 | Anaplastic Lymphoma | 0.6667 | 0.75 | 0.6 |
| CXCL9 AND NOT-SLC2A12 | B-Cell Diffuse | 0.7324 | 0.7647 | 0.7027 | IL2RA AND NOT-KCNJ12 | Anaplastic Lymphoma | 0.6667 | 0.75 | 0.6 |
| CXCL9 AND NOT-CDHR1 | B-Cell Diffuse | 0.7324 | 0.7647 | 0.7027 | IL2RA AND NOT-SHH | Anaplastic Lymphoma | 0.6667 | 0.75 | 0.6 |
| CXCL9 AND NOT-IL1RL1 | B-Cell Diffuse | 0.7324 | 0.7647 | 0.7027 | IL2RA AND NOT-GPR20 | Anaplastic Lymphoma | 0.6667 | 0.75 | 0.6 |
| CXCL9 AND NOT-GJD4 | B-Cell Diffuse | 0.7324 | 0.7647 | 0.7027 | IL2RA AND NOT-TAAR2 | Anaplastic Lymphoma | 0.6429 | 0.6923 | 0.6 |
| CXCL9 AND NOT-SLC15A1 | B-Cell Diffuse | 0.7324 | 0.7647 | 0.7027 | IL2RA AND NOT-FNDC5 | Anaplastic Lymphoma | 0.6667 | 0.75 | 0.6 |
| CXCL9 AND NOT-SLC4A9 | B-Cell Diffuse | 0.7324 | 0.7647 | 0.7027 | IL2RA AND NOT-VSIG2 | Anaplastic Lymphoma | 0.6667 | 0.75 | 0.6 |
| CXCL9 AND NOT-DPP6 | B-Cell Diffuse | 0.7324 | 0.7647 | 0.7027 | IL2RA AND NOT-TRPC4 | Anaplastic Lymphoma | 0.6667 | 0.75 | 0.6 |
| CXCL9 AND NOT-FCER1A | Anaplastic Lymphoma | 0.6667 | 0.8889 | 0.5333 | IL2RA AND NOT-OR5J2 | Anaplastic Lymphoma | 0.6429 | 0.6923 | 0.6 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CXCL9 AND NOT-SORT1 | Anaplastic Lymphoma | 0.6923 | 0.8182 | 0.6 | IL2RA AND NOT-CDH6 | Anaplastic Lymphoma | 0.6667 | 0.75 | 0.6 |
| CXCL9 AND NOT-SLC44A1 | Anaplastic Lymphoma | 0.75 | 1 | 0.6 | IL2RA AND NOT-OR51I1 | Anaplastic Lymphoma | 0.6667 | 0.75 | 0.6 |
| CXCL9 AND NOT-STX3 | Anaplastic Lymphoma | 0.6667 | 0.75 | 0.6 | IL2RA AND NOT-DPP6 | Anaplastic Lymphoma | 0.6667 | 0.75 | 0.6 |
| CXCL9 AND NOT-TLR3 | Anaplastic Lymphoma | 0.6429 | 0.6923 | 0.6 | IL2RA AND NOT-SIGLEC6 | Anaplastic Lymphoma | 0.6667 | 0.75 | 0.6 |
| CXCL9 AND NOT-CD9 | Anaplastic Lymphoma | 0.64 | 0.8 | 0.5333 | IL2RA AND NOT-SLC30A3 | Anaplastic Lymphoma | 0.72 | 0.9 | 0.6 |
| CXCL9 AND NOT-SDC2 | Anaplastic Lymphoma | 0.64 | 0.8 | 0.5333 | IL2RA AND NOT-GRID1 | Anaplastic Lymphoma | 0.6667 | 0.75 | 0.6 |
| CXCL9 AND NOT-EFNA5 | Anaplastic Lymphoma | 0.6923 | 0.8182 | 0.6 | IL2RA AND NOT-KCNB2 | Anaplastic Lymphoma | 0.6667 | 0.75 | 0.6 |
| CXCL9 AND NOT-F3 | Anaplastic Lymphoma | 0.6207 | 0.6429 | 0.6 | IL2RA AND NOT-ERVFRD-1 | Anaplastic Lymphoma | 0.6667 | 0.75 | 0.6 |
| CXCL9 AND NOT-SLC17A5 | Anaplastic Lymphoma | 0.6207 | 0.6429 | 0.6 | IL2RA AND NOT-SLC4A3 | Anaplastic Lymphoma | 0.6923 | 0.8182 | 0.6 |
| CXCL9 AND NOT-KCNJ15 | Anaplastic Lymphoma | 0.6364 | 1 | 0.4667 | IL2RA AND NOT-CHRNE | Anaplastic Lymphoma | 0.6667 | 0.75 | 0.6 |
| CXCL9 AND NOT-TM9SF2 | Anaplastic Lymphoma | 0.6154 | 0.7273 | 0.5333 | IL2RA AND NOT-GPR173 | Anaplastic Lymphoma | 0.6667 | 0.75 | 0.6 |
| CXCL9 AND NOT-SERINC5 | Anaplastic Lymphoma | 0.6207 | 0.6429 | 0.6 | IL2RA AND NOT-SLC9A3 | Anaplastic Lymphoma | 0.6667 | 0.75 | 0.6 |
| CXCL9 AND NOT-ADRB2 | Anaplastic Lymphoma | 0.6087 | 0.875 | 0.4667 | IL2RA AND NOT-DRD3 | Anaplastic Lymphoma | 0.6667 | 0.75 | 0.6 |
| CXCL9 AND NOT-FFAR2 | Anaplastic Lymphoma | 0.64 | 0.8 | 0.5333 | IL2RA AND NOT-ABCB8 | Anaplastic Lymphoma | 0.6667 | 0.75 | 0.6 |
| IL2RB AND NOT-TSPAN32 | Anaplastic Lymphoma | 0.6061 | 0.5556 | 0.6667 | IL2RA AND NOT-GABRB3 | Anaplastic Lymphoma | 0.6667 | 0.75 | 0.6 |
| CXCL9 AND NOT-ADCY9 | Anaplastic Lymphoma | 0.6 | 0.6 | 0.6 | IL2RA AND NOT-KCNJ4 | Anaplastic Lymphoma | 0.6667 | 0.75 | 0.6 |
| CXCL9 AND NOT-CRIM1 | Anaplastic Lymphoma | 0.6 | 0.6 | 0.6 | IL2RA AND NOT-ADRA2B | Anaplastic Lymphoma | 0.6667 | 0.75 | 0.6 |
| CXCL9 AND NOT-SLC18A2 | Anaplastic Lymphoma | 0.6 | 0.6 | 0.6 | IL2RA AND NOT-OR8D2 | Anaplastic Lymphoma | 0.6667 | 0.75 | 0.6 |
| CXCL9 AND NOT-SLC34A3 | Anaplastic Lymphoma | 0.6 | 0.6 | 0.6 | IL2RA AND NOT-OR51E2 | Anaplastic Lymphoma | 0.6667 | 0.75 | 0.6 |
| CXCL9 AND NOT-BST1 | Anaplastic Lymphoma | 0.6087 | 0.875 | 0.4667 | IL2RA AND NOT-OR1G1 | Anaplastic Lymphoma | 0.6667 | 0.75 | 0.6 |
| CXCL9 AND NOT-JAG1 | Anaplastic Lymphoma | 0.6087 | 0.875 | 0.4667 | IL2RA AND NOT-SLC6A9 | Anaplastic Lymphoma | 0.6154 | 0.7273 | 0.5333 |
| CXCL9 AND NOT-B4GALT1 | Anaplastic Lymphoma | 0.6957 | 1 | 0.5333 | IL2RA AND NOT-PCDHB13 | Anaplastic Lymphoma | 0.6154 | 0.7273 | 0.5333 |
| CXCL9 AND NOT-TMEM127 | Anaplastic Lymphoma | 0.6667 | 0.8889 | 0.5333 | IL2RA AND NOT-OR2M4 | Anaplastic Lymphoma | 0.6154 | 0.7273 | 0.5333 |
| CXCL9 AND NOT-SLC43A2 | Anaplastic Lymphoma | 0.6087 | 0.875 | 0.4667 | IL2RA AND NOT-TMEM8B | Anaplastic Lymphoma | 0.6154 | 0.7273 | 0.5333 |
| LAG3 AND NOT-TMEM8B | Anaplastic Lymphoma | 0.6061 | 0.5556 | 0.6667 | IL2RA AND NOT-RHD | Anaplastic Lymphoma | 0.6154 | 0.7273 | 0.5333 |
| CXCL9 AND NOT-VNN3 | Anaplastic Lymphoma | 0.6207 | 0.6429 | 0.6 | IL2RA AND NOT-RRH | Anaplastic Lymphoma | 0.6154 | 0.7273 | 0.5333 |
| CXCL9 AND NOT-IL22RA1 | Anaplastic Lymphoma | 0.64 | 0.8 | 0.5333 | IL2RA AND NOT-SLC15A1 | Anaplastic Lymphoma | 0.6154 | 0.7273 | 0.5333 |
| CXCL9 AND NOT-HCN3 | Anaplastic Lymphoma | 0.6 | 0.6 | 0.6 | IL2RA AND NOT-KCNC3 | Anaplastic Lymphoma | 0.6667 | 0.75 | 0.6 |
| CXCL9 AND NOT-CKAP4 | Anaplastic Lymphoma | 0.6667 | 0.75 | 0.6 | IL2RA AND NOT-OR10H3 | Anaplastic Lymphoma | 0.6154 | 0.7273 | 0.5333 |
| CXCL9 AND NOT-ANO6 | Anaplastic Lymphoma | 0.6087 | 0.875 | 0.4667 | IL2RA AND NOT-OR10H1 | Anaplastic Lymphoma | 0.6154 | 0.7273 | 0.5333 |
| CXCL9 AND NOT-STX1B | Anaplastic Lymphoma | 0.6667 | 0.8889 | 0.5333 | IL2RA AND NOT-KCNH2 | Anaplastic Lymphoma | 0.6154 | 0.7273 | 0.5333 |
| CXCL9 AND NOT-EPHA4 | Anaplastic Lymphoma | 0.6429 | 0.6923 | 0.6 | IL2RA AND NOT-PTCHD1 | Anaplastic Lymphoma | 0.6154 | 0.7273 | 0.5333 |
| CLECL1 AND NOT-SLC46A2 | Mantle-Cell Lymphoma | 0.9737 | 0.9737 | 0.9737 | IL2RA AND NOT-SLC26A10 | Anaplastic Lymphoma | 0.6154 | 0.7273 | 0.5333 |
| CLECL1 AND NOT-PTGDR2 | Mantle-Cell Lymphoma | 0.9744 | 0.95 | 1 | IL2RA AND NOT-ACE2 | Anaplastic Lymphoma | 0.6154 | 0.7273 | 0.5333 |
| CLECL1 AND NOT-ASGR1 | Mantle-Cell Lymphoma | 0.9737 | 0.9737 | 0.9737 | IL2RA AND NOT-CHRNA10 | Anaplastic Lymphoma | 0.6154 | 0.7273 | 0.5333 |
| CLECL1 AND NOT-FPR2 | Mantle-Cell Lymphoma | 0.961 | 0.9487 | 0.9737 | IL2RA AND NOT-ENTPD2 | Anaplastic Lymphoma | 0.6154 | 0.7273 | 0.5333 |
| CLECL1 AND NOT-SLC16A10 | Mantle-Cell Lymphoma | 0.9737 | 0.9737 | 0.9737 | IL2RA AND NOT-TAS2R41 | Anaplastic Lymphoma | 0.6667 | 0.75 | 0.6 |
| CLECL1 AND NOT-S1PR5 | Mantle-Cell Lymphoma | 0.9737 | 0.9737 | 0.9737 | IL2RA AND NOT-KIRREL | Anaplastic Lymphoma | 0.6154 | 0.7273 | 0.5333 |
| CLECL1 AND NOT-ACPP | Mantle-Cell Lymphoma | 0.9744 | 0.95 | 1 | IL2RA AND NOT-KCNG3 | Anaplastic Lymphoma | 0.6667 | 0.75 | 0.6 |
| CLECL1 AND NOT-ADAM9 | Mantle-Cell Lymphoma | 0.9487 | 0.925 | 0.9737 | IL2RA AND NOT-FFAR1 | Anaplastic Lymphoma | 0.6154 | 0.7273 | 0.5333 |
| CLECL1 AND NOT-INSR | Mantle-Cell Lymphoma | 0.9474 | 0.9474 | 0.9474 | IL2RA AND NOT-IZUMO1 | Anaplastic Lymphoma | 0.72 | 0.9 | 0.6 |
| CLECL1 AND NOT-GP9 | Mantle-Cell Lymphoma | 0.962 | 0.9268 | 1 | IL2RA AND NOT-FLRT1 | Anaplastic Lymphoma | 0.6154 | 0.7273 | 0.5333 |
| CLECL1 AND NOT-SLC51A | Mantle-Cell Lymphoma | 0.961 | 0.9487 | 0.9737 | IL2RA AND NOT-CHRM5 | Anaplastic Lymphoma | 0.6667 | 0.75 | 0.6 |
| CLECL1 AND NOT-MS4A2 | Mantle-Cell Lymphoma | 0.95 | 0.9048 | 1 | IL2RA AND NOT-OR7C2 | Anaplastic Lymphoma | 0.6667 | 0.75 | 0.6 |
| CLECL1 AND NOT-DHRS3 | Mantle-Cell Lymphoma | 0.961 | 0.9487 | 0.9737 | IL2RA AND NOT-OPRL1 | Anaplastic Lymphoma | 0.6667 | 0.75 | 0.6 |
| CLECL1 AND NOT-ATRN | Mantle-Cell Lymphoma | 0.9744 | 0.95 | 1 | IL2RA AND NOT-KCNQ4 | Anaplastic Lymphoma | 0.6667 | 0.75 | 0.6 |
| CLECL1 AND NOT-ITGA5 | Mantle-Cell Lymphoma | 0.987 | 0.9744 | 1 | IL2RA AND NOT-ASGR1 | Anaplastic Lymphoma | 0.6667 | 0.8889 | 0.5333 |
| CLECL1 AND NOT-TMEM204 | Mantle-Cell Lymphoma | 0.9487 | 0.925 | 0.9737 | IL2RA AND NOT-NRXN1 | Anaplastic Lymphoma | 0.6154 | 0.7273 | 0.5333 |
| CLECL1 AND NOT-SLC2A12 | Mantle-Cell Lymphoma | 1 | 1 | 1 | IL2RA AND NOT-SGCA | Anaplastic Lymphoma | 0.6667 | 0.75 | 0.6 |
| CLECL1 AND NOT-CPD | Mantle-Cell Lymphoma | 0.9737 | 0.9737 | 0.9737 | IL2RA AND NOT-PTGDR2 | Anaplastic Lymphoma | 0.6667 | 0.75 | 0.6 |
| CLECL1 AND NOT-MFAP3L | Mantle-Cell Lymphoma | 0.9487 | 0.925 | 0.9737 | IL2RA AND NOT-GP9 | Anaplastic Lymphoma | 0.6667 | 0.75 | 0.6 |
| CLECL1 AND NOT-FCER1A | Mantle-Cell Lymphoma | 0.96 | 0.973 | 0.9474 | IL2RA AND NOT-KCNJ14 | Anaplastic Lymphoma | 0.6667 | 0.75 | 0.6 |
| CLECL1 AND NOT-HM13 | Mantle-Cell Lymphoma | 0.9744 | 0.95 | 1 | IL2RA AND NOT-TAS2R16 | Anaplastic Lymphoma | 0.6667 | 0.75 | 0.6 |
| CLECL1 AND NOT-VSIG2 | Mantle-Cell Lymphoma | 0.9383 | 0.8837 | 1 | IL2RA AND NOT-SGCZ | Anaplastic Lymphoma | 0.6667 | 0.75 | 0.6 |
| CLECL1 AND NOT-CCR3 | Mantle-Cell Lymphoma | 0.9744 | 0.95 | 1 | IL2RA AND NOT-TAS2R13 | Anaplastic Lymphoma | 0.6667 | 0.75 | 0.6 |
| CLECL1 AND NOT-SLC18A2 | Mantle-Cell Lymphoma | 0.987 | 0.9744 | 1 | IL2RA AND NOT-SLC6A16 | Anaplastic Lymphoma | 0.6667 | 0.75 | 0.6 |
| CLECL1 AND NOT-VIPR1 | Mantle-Cell Lymphoma | 0.9351 | 0.9231 | 0.9474 | IL2RA AND NOT-CCR3 | Anaplastic Lymphoma | 0.72 | 0.9 | 0.6 |
| CLECL1 AND NOT-SLC24A4 | Mantle-Cell Lymphoma | 0.9383 | 0.8837 | 1 | IL2RA AND NOT-TAS2R39 | Anaplastic Lymphoma | 0.6429 | 0.6923 | 0.6 |
| CLECL1 AND NOT-PTGER2 | Mantle-Cell Lymphoma | 0.9737 | 0.9737 | 0.9737 | IL2RA AND NOT-FGFRL1 | Anaplastic Lymphoma | 0.6667 | 0.75 | 0.6 |
| CLECL1 AND NOT-ANKH | Mantle-Cell Lymphoma | 0.9315 | 0.9714 | 0.8947 | IL2RA AND NOT-CDHR5 | Anaplastic Lymphoma | 0.6667 | 0.75 | 0.6 |
| CLECL1 AND NOT-GOLM1 | Mantle-Cell Lymphoma | 0.961 | 0.9487 | 0.9737 | IL2RA AND NOT-WNT4 | Anaplastic Lymphoma | 0.6667 | 0.75 | 0.6 |
| CLECL1 AND NOT-ACVR1B | Mantle-Cell Lymphoma | 0.961 | 0.9487 | 0.9737 | IL2RA AND NOT-TAS2R50 | Anaplastic Lymphoma | 0.6429 | 0.6923 | 0.6 |
| CLECL1 AND NOT-CLEC1B | Mantle-Cell Lymphoma | 0.95 | 0.9048 | 1 | IL2RA AND NOT-KCNK7 | Anaplastic Lymphoma | 0.6667 | 0.75 | 0.6 |
| CLECL1 AND NOT-ATP8B4 | Mantle-Cell Lymphoma | 0.9744 | 0.95 | 1 | IL2RA AND NOT-BTN1A1 | Anaplastic Lymphoma | 0.6667 | 0.75 | 0.6 |
| CLECL1 AND NOT-ADAM23 | Mantle-Cell Lymphoma | 0.962 | 0.9268 | 1 | IL2RA AND NOT-KCNN | Anaplastic Lymphoma | 0.6667 | 0.75 | 0.6 |
| CLECL1 AND NOT-CLEC7A | Mantle-Cell Lymphoma | 0.9296 | 1 | 0.8684 | IL2RA AND NOT-FCGR2B | Anaplastic Lymphoma | 0.75 | 1 | 0.6 |
| CLECL1 AND NOT-XK | Mantle-Cell Lymphoma | 0.9474 | 0.9474 | 0.9474 | IL2RA AND NOT-LRRTM1 | Anaplastic Lymphoma | 0.6667 | 0.75 | 0.6 |
| CLECL1 AND NOT-ASPH | Mantle-Cell Lymphoma | 0.961 | 0.9487 | 0.9737 | IL2RA AND NOT-ABCC2 | Anaplastic Lymphoma | 0.6667 | 0.75 | 0.6 |
| CLECL1 AND NOT-CD101 | Mantle-Cell Lymphoma | 0.9744 | 0.95 | 1 | IL2RA AND NOT-AQP4 | Anaplastic Lymphoma | 0.6429 | 0.6923 | 0.6 |
| CLECL1 AND NOT-AQP11 | Mantle-Cell Lymphoma | 0.961 | 0.9487 | 0.9737 | IL2RA AND NOT-ITGA9 | Anaplastic Lymphoma | 0.6667 | 0.75 | 0.6 |
| CLECL1 AND NOT-TNFSF14 | Mantle-Cell Lymphoma | 0.9268 | 0.8636 | 1 | IL2RA AND NOT-KCNA5 | Anaplastic Lymphoma | 0.6667 | 0.75 | 0.6 |
| CLECL1 AND NOT-CLEC5A | Mantle-Cell Lymphoma | 0.9268 | 0.8636 | 1 | IL2RA AND NOT-SLC13A4 | Anaplastic Lymphoma | 0.6667 | 0.75 | 0.6 |
| CLECL1 AND NOT-SIGLEC9 | Mantle-Cell Lymphoma | 0.9268 | 0.8636 | 1 | IL2RA AND NOT-CDH15 | Anaplastic Lymphoma | 0.6667 | 0.75 | 0.6 |
| CLECL1 AND NOT-SLC22A4 | Mantle-Cell Lymphoma | 0.987 | 0.9744 | 1 | IL2RA AND NOT-RHBDL2 | Anaplastic Lymphoma | 0.6667 | 0.75 | 0.6 |
| CLECL1 AND NOT-KLRD1 | Mantle-Cell Lymphoma | 0.9737 | 0.9737 | 0.9737 | IL2RA AND NOT-MAS1 | Anaplastic Lymphoma | 0.6667 | 0.75 | 0.6 |
| CLECL1 AND NOT-TGFBR3 | Mantle-Cell Lymphoma | 0.9268 | 0.8636 | 1 | CLECL1 AND NOT-ITGB3 | Mantle-Cell Lymphoma | 0.987 | 0.9744 | 1 |
| CLECL1 AND NOT-TNFSF10 | Mantle-Cell Lymphoma | 0.9744 | 0.95 | 1 | CLECL1 AND NOT-NCAM1 | Mantle-Cell Lymphoma | 0.9744 | 0.95 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CLECL1 AND NOT-TRAT1 | Mantle-Cell Lymphoma | 1 | 1 | 1 | CLECL1 AND NOT-TNFRSF8 | Mantle-Cell Lymphoma | 0.9367 | 0.9024 | 0.9737 |
| CLECL1 AND NOT-CACNA1I | Mantle-Cell Lymphoma | 0.925 | 0.881 | 0.9737 | MS4A1 AND NOT-ICAM4 | Mantle-Cell Lymphoma | 0.9167 | 0.9706 | 0.8684 |
| CLECL1 AND NOT-CD300C | Mantle-Cell Lymphoma | 0.925 | 0.881 | 0.9737 | MS4A1 AND NOT-KCNG2 | Mantle-Cell Lymphoma | 0.9383 | 0.8837 | 1 |
| CLECL1 AND NOT-SLCO3A1 | Mantle-Cell Lymphoma | 0.987 | 0.9744 | 1 | MS4A1 AND NOT-CDHR3 | Mantle-Cell Lymphoma | 0.9041 | 0.9429 | 0.8684 |
| CLECL1 AND NOT-KCNE3 | Mantle-Cell Lymphoma | 0.9744 | 0.95 | 1 | CD52 AND NOT-FPR2 | Mantle-Cell Lymphoma | 0.8974 | 0.875 | 0.9211 |
| CLECL1 AND NOT-CLEC12B | Mantle-Cell Lymphoma | 0.9383 | 0.8837 | 1 | MS4A1 AND NOT-LRRTM2 | Mantle-Cell Lymphoma | 0.881 | 0.8043 | 0.9737 |
| CLECL1 AND NOT-NRG1 | Mantle-Cell Lymphoma | 0.9367 | 0.9024 | 0.9737 | P2RX5 AND NOT-MS4A2 | Mantle-Cell Lymphoma | 0.878 | 0.8182 | 0.9474 |
| CLECL1 AND NOT-HAS3 | Mantle-Cell Lymphoma | 0.95 | 0.9048 | 1 | MS4A1 AND NOT-GPM6B | Mantle-Cell Lymphoma | 0.9136 | 0.8605 | 0.9737 |
| CLECL1 AND NOT-SGMS2 | Mantle-Cell Lymphoma | 0.9474 | 0.9474 | 0.9474 | CLECL1 AND NOT-CD33 | Mantle-Cell Lymphoma | 0.962 | 0.9268 | 1 |
| CLECL1 AND NOT-HS3ST3B1 | Mantle-Cell Lymphoma | 0.9333 | 0.9459 | 0.9211 | MS4A1 AND NOT-CYBB | Mantle-Cell Lymphoma | 0.8736 | 0.7755 | 1 |
| CLECL1 AND NOT-BPI | Mantle-Cell Lymphoma | 0.9189 | 0.9444 | 0.8947 | MS4A1 AND NOT-M6PR | Mantle-Cell Lymphoma | 0.8736 | 0.7755 | 1 |
| CLECL1 AND NOT-TNFSF12 | Mantle-Cell Lymphoma | 0.9487 | 0.925 | 0.9737 | CD52 AND NOT-PTGER2 | Mantle-Cell Lymphoma | 0.9211 | 0.9211 | 0.9211 |
| CLECL1 AND NOT-IL6R | Mantle-Cell Lymphoma | 0.962 | 0.9268 | 1 | P2RX5 AND NOT-SLAMF6 | Mantle-Cell Lymphoma | 0.8718 | 0.85 | 0.8947 |
| CLECL1 AND NOT-IL18RAP | Mantle-Cell Lymphoma | 0.987 | 0.9744 | 1 | P2RX5 AND NOT-SCN3A | Mantle-Cell Lymphoma | 0.8718 | 0.85 | 0.8947 |
| CLECL1 AND NOT-CD244 | Mantle-Cell Lymphoma | 0.9744 | 0.95 | 1 | QSOX2 AND NOT-TNFRSF8 | Mantle-Cell Lymphoma | 0.9474 | 0.9474 | 0.9474 |
| CLECL1 AND NOT-AMICA1 | Mantle-Cell Lymphoma | 0.9744 | 0.95 | 1 | MS4A1 AND NOT-FPR2 | Mantle-Cell Lymphoma | 0.8706 | 0.7872 | 0.9737 |
| CLECL1 AND NOT-TENM1 | Mantle-Cell Lymphoma | 0.987 | 0.9744 | 1 | CD52 AND NOT-ITGA5 | Mantle-Cell Lymphoma | 0.96 | 0.973 | 0.9474 |
| CLECL1 AND NOT-SPN | Mantle-Cell Lymphoma | 0.9744 | 0.95 | 1 | P2RX5 AND NOT-FPR2 | Mantle-Cell Lymphoma | 0.875 | 0.8333 | 0.9211 |
| CLECL1 AND NOT-SULF2 | Mantle-Cell Lymphoma | 0.95 | 0.9048 | 1 | KCNN4 AND NOT-MET | Mantle-Cell Lymphoma | 0.9024 | 0.8409 | 0.9737 |
| CLECL1 AND NOT-KLRB1 | Mantle-Cell Lymphoma | 0.9589 | 1 | 0.9211 | MS4A1 AND NOT-PTGDR2 | Mantle-Cell Lymphoma | 0.8736 | 0.7755 | 1 |
| CLECL1 AND NOT-GPR68 | Mantle-Cell Lymphoma | 0.9268 | 0.8636 | 1 | MS4A1 AND NOT-KCNG2 | Mantle-Cell Lymphoma | 0.9459 | 0.9722 | 0.9211 |
| CLECL1 AND NOT-SLC44A1 | Mantle-Cell Lymphoma | 0.9744 | 0.95 | 1 | IL10RA AND NOT-CD33 | Mantle-Cell Lymphoma | 0.8837 | 0.7917 | 1 |
| CLECL1 AND NOT-SECTM1 | Mantle-Cell Lymphoma | 0.95 | 0.9048 | 1 | P2RX5 AND NOT-CYBB | Mantle-Cell Lymphoma | 0.9 | 0.8571 | 0.9474 |
| CLECL1 AND NOT-TLR5 | Mantle-Cell Lymphoma | 0.9744 | 0.95 | 1 | CD52 AND NOT-SLC46A2 | Mantle-Cell Lymphoma | 0.8642 | 0.814 | 0.9211 |
| CLECL1 AND NOT-GPR143 | Mantle-Cell Lymphoma | 0.9367 | 0.9024 | 0.9737 | CD52 AND NOT-DHRS3 | Mantle-Cell Lymphoma | 0.8642 | 0.814 | 0.9211 |
| CLECL1 AND NOT-FLT3LG | Mantle-Cell Lymphoma | 0.9744 | 0.95 | 1 | MS4A1 AND NOT-MS4A2 | Mantle-Cell Lymphoma | 0.8636 | 0.76 | 1 |
| CLECL1 AND NOT-TSPAN2 | Mantle-Cell Lymphoma | 0.9737 | 0.9737 | 0.9737 | MS4A1 AND NOT-GP9 | Mantle-Cell Lymphoma | 0.8636 | 0.76 | 1 |
| CLECL1 AND NOT-SORT1 | Mantle-Cell Lymphoma | 0.9157 | 0.8444 | 1 | MS4A1 AND NOT-SLC16A10 | Mantle-Cell Lymphoma | 0.8605 | 0.7708 | 0.9737 |
| CLECL1 AND NOT-SLC8A1 | Mantle-Cell Lymphoma | 0.9157 | 0.8444 | 1 | MS4A1 AND NOT-PTPRA | Mantle-Cell Lymphoma | 0.8605 | 0.7708 | 0.9737 |
| CLECL1 AND NOT-SLC19A1 | Mantle-Cell Lymphoma | 0.9744 | 0.95 | 1 | IL10RA AND NOT-ITGB3 | Mantle-Cell Lymphoma | 0.8736 | 0.7755 | 1 |
| CLECL1 AND NOT-EGF | Mantle-Cell Lymphoma | 0.9268 | 0.8636 | 1 | MS4A1 AND NOT-S1PR5 | Mantle-Cell Lymphoma | 0.8605 | 0.7708 | 0.9737 |
| CLECL1 AND NOT-CD226 | Mantle-Cell Lymphoma | 0.987 | 0.9744 | 1 | P2RX5 AND NOT-CLEC4A | Mantle-Cell Lymphoma | 0.8571 | 0.8462 | 0.8684 |
| CLECL1 AND NOT-C10orf54 | Mantle-Cell Lymphoma | 0.961 | 0.9487 | 0.9737 | QSOX2 AND NOT-SSTR5 | Mantle-Cell Lymphoma | 0.9024 | 0.8409 | 0.9737 |
| CLECL1 AND NOT-CD28 | Mantle-Cell Lymphoma | 0.987 | 0.9744 | 1 | MS4A1 AND NOT-CD86 | Mantle-Cell Lymphoma | 0.8571 | 0.7826 | 0.9474 |
| CLECL1 AND NOT-NAALAD2 | Mantle-Cell Lymphoma | 0.962 | 0.9268 | 1 | QSOX2 AND NOT-IL20RA | Mantle-Cell Lymphoma | 0.9024 | 0.8409 | 0.9737 |
| CLECL1 AND NOT-EPHA4 | Mantle-Cell Lymphoma | 0.9315 | 0.9714 | 0.8947 | QSOX2 AND NOT-CLDN2 | Mantle-Cell Lymphoma | 0.9024 | 0.8409 | 0.9737 |
| CLECL1 AND NOT-DNAJC5 | Mantle-Cell Lymphoma | 0.9744 | 0.95 | 1 | MS4A1 AND NOT-SERINC3 | Mantle-Cell Lymphoma | 0.8736 | 0.7755 | 1 |
| CLECL1 AND NOT-HTR2B | Mantle-Cell Lymphoma | 0.962 | 0.9268 | 1 | MS4A1 AND NOT-PSEN1 | Mantle-Cell Lymphoma | 0.8736 | 0.7755 | 1 |
| CLECL1 AND NOT-PTGDR | Mantle-Cell Lymphoma | 0.9744 | 0.95 | 1 | QSOX2 AND NOT-ENG | Mantle-Cell Lymphoma | 0.9024 | 0.8409 | 0.9737 |
| CLECL1 AND NOT-SCIMP | Mantle-Cell Lymphoma | 0.9114 | 0.878 | 0.9474 | CLECL1 AND NOT-MST1R | Mantle-Cell Lymphoma | 0.8539 | 0.7451 | 1 |
| CLECL1 AND NOT-SIGLEC7 | Mantle-Cell Lymphoma | 0.962 | 0.9268 | 1 | MS4A1 AND NOT-HM13 | Mantle-Cell Lymphoma | 0.8539 | 0.7451 | 1 |
| CLECL1 AND NOT-NFAM1 | Mantle-Cell Lymphoma | 0.9744 | 0.95 | 1 | MS4A1 AND NOT-LILRB3 | Mantle-Cell Lymphoma | 0.8539 | 0.7451 | 1 |
| CLECL1 AND NOT-NUCB2 | Mantle-Cell Lymphoma | 0.9737 | 0.9737 | 0.9737 | MS4A1 AND NOT-LNPEP | Mantle-Cell Lymphoma | 0.8539 | 0.7451 | 1 |
| CLECL1 AND NOT-ICAM4 | Mantle-Cell Lymphoma | 0.9091 | 0.8974 | 0.9211 | CD52 AND NOT-AQP9 | Mantle-Cell Lymphoma | 0.8533 | 0.8649 | 0.8421 |
| CLECL1 AND NOT-DPP4 | Mantle-Cell Lymphoma | 0.9744 | 0.95 | 1 | CD52 AND NOT-FCER1G | Mantle-Cell Lymphoma | 0.8861 | 0.8537 | 0.9211 |
| CLECL1 AND NOT-MPZ | Mantle-Cell Lymphoma | 0.9268 | 0.8636 | 1 | CD52 AND NOT-CLEC7A | Mantle-Cell Lymphoma | 0.9067 | 0.9189 | 0.8947 |
| CLECL1 AND NOT-NT5E | Mantle-Cell Lymphoma | 0.9067 | 0.9189 | 0.8947 | CXCL9 AND NOT-CLDN1 | T-Cell, Peripheral | 0.7719 | 0.7586 | 0.7857 |
| CLECL1 AND NOT-P2RY12 | Mantle-Cell Lymphoma | 0.9383 | 0.8837 | 1 | CXCL9 AND NOT-ERBB3 | T-Cell, Peripheral | 0.7586 | 0.7333 | 0.7857 |
| IL10RA AND NOT-AQP9 | Mantle-Cell Lymphoma | 0.9211 | 0.9211 | 0.9211 | CXCL9 AND NOT-CLDN23 | T-Cell, Peripheral | 0.8462 | 0.9167 | 0.7857 |
| CXCL9 AND NOT-CD9 | T-Cell, Peripheral | 0.8462 | 0.9167 | 0.7857 | CXCL9 AND NOT-ROR1 | T-Cell, Peripheral | 0.7586 | 0.7333 | 0.7857 |
| CXCL9 AND NOT-EREG | T-Cell, Peripheral | 0.8235 | 0.913 | 0.75 | CXCL9 AND NOT-SDC1 | T-Cell, Peripheral | 0.7458 | 0.7097 | 0.7857 |
| CXCL9 AND NOT-EMP2 | T-Cell, Peripheral | 0.7857 | 0.7857 | 0.7857 | CXCL9 AND NOT-CLDN7 | T-Cell, Peripheral | 0.7458 | 0.7097 | 0.7857 |
| CXCL9 AND NOT-TLR3 | T-Cell, Peripheral | 0.7925 | 0.84 | 0.75 | CXCL9 AND NOT-CD34 | T-Cell, Peripheral | 0.7458 | 0.7097 | 0.7857 |
| CXCL9 AND NOT-ITGB5 | T-Cell, Peripheral | 0.7843 | 0.8696 | 0.7143 | CXCL9 AND NOT-RNF43 | T-Cell, Peripheral | 0.7368 | 0.7241 | 0.75 |
| CXCL9 AND NOT-ADCY9 | T-Cell, Peripheral | 0.7778 | 0.8077 | 0.75 | CXCL9 AND NOT-CLDN12 | T-Cell, Peripheral | 0.7333 | 0.6875 | 0.7857 |
| CXCL9 AND NOT-CAV2 | T-Cell, Peripheral | 0.7778 | 0.8077 | 0.75 | CXCL9 AND NOT-CLDN8 | T-Cell, Peripheral | 0.7333 | 0.6875 | 0.7857 |
| CXCL9 AND NOT-SGMS2 | T-Cell, Peripheral | 0.7857 | 0.7857 | 0.7857 | CXCL9 AND NOT-CD276 | T-Cell, Peripheral | 0.7241 | 0.7 | 0.75 |
| CXCL9 AND NOT-EPHB4 | T-Cell, Peripheral | 0.7719 | 0.7586 | 0.7857 | CXCL9 AND NOT-MUC1 | T-Cell, Peripheral | 0.7333 | 0.6875 | 0.7857 |
| CXCL9 AND NOT-SLC6A14 | T-Cell, Peripheral | 0.7719 | 0.7586 | 0.7857 | CXCL9 AND NOT-AXL | T-Cell, Peripheral | 0.7273 | 0.7407 | 0.7143 |
| CXCL9 AND NOT-SLC17A5 | T-Cell, Peripheral | 0.8235 | 0.913 | 0.75 | CXCL9 AND NOT-STEAP2 | T-Cell, Peripheral | 0.7778 | 0.8077 | 0.75 |
| CXCL9 AND NOT-PTPRG | T-Cell, Peripheral | 0.8 | 0.8148 | 0.7857 | CXCL9 AND NOT-ENG | T-Cell, Peripheral | 0.7368 | 0.7241 | 0.75 |
| CXCL9 AND NOT-APLP2 | T-Cell, Peripheral | 0.8148 | 0.8462 | 0.7857 | CXCL9 AND NOT-CLDN5 | T-Cell, Peripheral | 0.7333 | 0.6875 | 0.7857 |
| CXCL9 AND NOT-CRIM1 | T-Cell, Peripheral | 0.8148 | 0.8462 | 0.7857 | CXCL9 AND NOT-STEAP1 | T-Cell, Peripheral | 0.7059 | 0.7826 | 0.6429 |
| CXCL9 AND NOT-SLC24A3 | T-Cell, Peripheral | 0.7719 | 0.7586 | 0.7857 | CXCL9 AND NOT-MST1R | T-Cell, Peripheral | 0.7333 | 0.6875 | 0.7857 |
| CXCL9 AND NOT-DSC2 | T-Cell, Peripheral | 0.7636 | 0.7778 | 0.75 | CXCL9 AND NOT-TRPM4 | T-Cell, Peripheral | 0.7037 | 0.7308 | 0.6786 |
| CXCL9 AND NOT-FZD5 | T-Cell, Peripheral | 0.7719 | 0.7586 | 0.7857 | CXCL9 AND NOT-ERBB4 | T-Cell, Peripheral | 0.7018 | 0.6897 | 0.7143 |
| CXCL9 AND NOT-SERINC5 | T-Cell, Peripheral | 0.7778 | 0.8077 | 0.75 | CXCL9 AND NOT-PROM1 | T-Cell, Peripheral | 0.7018 | 0.6897 | 0.7143 |
| CXCL9 AND NOT-SLC44A1 | T-Cell, Peripheral | 0.7778 | 0.8077 | 0.75 | CXCL9 AND NOT-MUC13 | T-Cell, Peripheral | 0.7119 | 0.6774 | 0.75 |
| CXCL9 AND NOT-PMP22 | T-Cell, Peripheral | 0.8 | 0.8148 | 0.7857 | CXCL9 AND NOT-SLC34A2 | T-Cell, Peripheral | 0.6786 | 0.6786 | 0.6786 |
| CXCL9 AND NOT-STEAP3 | T-Cell, Peripheral | 0.7755 | 0.9048 | 0.6786 | CXCL9 AND NOT-EDNRB | T-Cell, Peripheral | 0.6786 | 0.6786 | 0.6786 |
| CXCL9 AND NOT-SDC2 | T-Cell, Peripheral | 0.8462 | 0.9167 | 0.7857 | CXCL9 AND NOT-KDR | T-Cell, Peripheral | 0.7018 | 0.6897 | 0.7143 |
| CXCL9 AND NOT-SLC41A2 | T-Cell, Peripheral | 0.7692 | 0.8333 | 0.7143 | CXCL9 AND NOT-BMPR1B | T-Cell, Peripheral | 0.7018 | 0.6897 | 0.7143 |
| CXCL9 AND NOT-SLC34A3 | T-Cell, Peripheral | 0.7636 | 0.7778 | 0.75 | CXCL9 AND NOT-LGR5 | T-Cell, Peripheral | 0.6667 | 0.6552 | 0.6786 |
| CXCL9 AND NOT-FGFR3 | T-Cell, Peripheral | 0.7586 | 0.7333 | 0.7857 | CXCL9 AND NOT-CLDN11 | T-Cell, Peripheral | 0.6667 | 0.7391 | 0.6071 |
| CXCL9 AND NOT-FXYD3 | T-Cell, Peripheral | 0.7586 | 0.7333 | 0.7857 | CXCL9 AND NOT-TPBG | T-Cell, Peripheral | 0.7857 | 0.7857 | 0.7857 |
| CXCL9 AND NOT-SORT1 | T-Cell, Peripheral | 0.7586 | 0.7333 | 0.7857 | CXCL9 AND NOT-FOLH1 | T-Cell, Peripheral | 0.6545 | 0.6667 | 0.6429 |
| CXCL9 AND NOT-KCNS3 | T-Cell, Peripheral | 0.7586 | 0.7333 | 0.7857 | CXCL9 AND NOT-EGFR | T-Cell, Peripheral | 0.6545 | 0.6667 | 0.6429 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| CXCL9 AND NOT-CACFD1 | T-Cell, Peripheral | 0.7586 | 0.7333 | 0.7857 | CXCL9 AND NOT-IL13RA1 | T-Cell, Peripheral | 0.6522 | 0.8333 | 0.5357 |
| CXCL9 AND NOT-B4GALT1 | T-Cell, Peripheral | 0.8235 | 0.913 | 0.75 | CXCL9 AND NOT-MET | T-Cell, Peripheral | 0.6667 | 1 | 0.5 |
| CXCL9 AND NOT-GJB2 | T-Cell, Peripheral | 0.8163 | 0.9524 | 0.7143 | CXCL9 AND NOT-EPCAM | T-Cell, Peripheral | 0.6415 | 0.68 | 0.6071 |
| CXCL9 AND NOT-BMP2 | T-Cell, Peripheral | 0.75 | 0.75 | 0.75 | CXCL9 AND NOT-ERBB2 | T-Cell, Peripheral | 0.64 | 0.7273 | 0.5714 |
| CXCL9 AND NOT-NTN4 | T-Cell, Peripheral | 0.75 | 0.75 | 0.75 | CXCL9 AND NOT-CD33 | T-Cell, Peripheral | 0.6809 | 0.8421 | 0.5714 |
| CXCL9 AND NOT-MFAP3L | T-Cell, Peripheral | 0.75 | 0.75 | 0.75 | CXCL9 AND NOT-EPHA3 | T-Cell, Peripheral | 0.6275 | 0.6957 | 0.5714 |
| CXCL9 AND NOT-ATP1B1 | T-Cell, Peripheral | 0.75 | 0.75 | 0.75 | TNFSF11 AND NOT-FXYD1 | T-Cell, Peripheral | 0.6222 | 0.8235 | 0.5 |
| CXCL9 AND NOT-KIT | T-Cell, Peripheral | 0.75 | 0.75 | 0.75 | CXCL9 AND NOT-MUC4 | T-Cell, Peripheral | 0.6182 | 0.6296 | 0.6071 |
| CXCL9 AND NOT-SLC2A10 | T-Cell, Peripheral | 0.7778 | 0.8077 | 0.75 | CXCL10 AND NOT-CLDN12 | T-Cell, Peripheral | 0.6154 | 0.5405 | 0.7143 |
| CXCL9 AND NOT-PERP | T-Cell, Peripheral | 0.7586 | 0.7333 | 0.7857 | CXCL10 AND NOT-SDC1 | T-Cell, Peripheral | 0.6154 | 0.5405 | 0.7143 |
| CXCL9 AND NOT-PTPRS | T-Cell, Peripheral | 0.7586 | 0.7333 | 0.7857 | CXCL9 AND NOT-CSPG4 | T-Cell, Peripheral | 0.6154 | 0.6667 | 0.5714 |
| CXCL9 AND NOT-LY6K | T-Cell, Peripheral | 0.7719 | 0.7586 | 0.7857 | CXCL10 AND NOT-CLDN7 | T-Cell, Peripheral | 0.6129 | 0.5588 | 0.6786 |
| CXCL9 AND NOT-SLC6A8 | T-Cell, Peripheral | 0.7458 | 0.7097 | 0.7857 | TNFSF11 AND NOT-NTN4 | T-Cell, Peripheral | 0.6087 | 0.7778 | 0.5 |
| CXCL9 AND NOT-SLC3A1 | T-Cell, Peripheral | 0.7458 | 0.7097 | 0.7857 | TNFSF11 AND NOT-ITGB5 | T-Cell, Peripheral | 0.6087 | 0.7778 | 0.5 |
| CXCL9 AND NOT-TSPAN9 | T-Cell, Peripheral | 0.7458 | 0.7097 | 0.7857 | TNFSF11 AND NOT-SSPN | T-Cell, Peripheral | 0.619 | 0.9286 | 0.4643 |
| CXCL9 AND NOT-KITLG | T-Cell, Peripheral | 0.7458 | 0.7097 | 0.7857 | CXCL10 AND NOT-CLDN23 | T-Cell, Peripheral | 0.6957 | 0.8889 | 0.5714 |
| CXCL9 AND NOT-FAT4 | T-Cell, Peripheral | 0.7458 | 0.7097 | 0.7857 | CXCL10 AND NOT-STEAP2 | T-Cell, Peripheral | 0.6316 | 0.6207 | 0.6429 |
| CXCL9 AND NOT-ATP10B | T-Cell, Peripheral | 0.7458 | 0.7097 | 0.7857 | CXCL9 AND NOT-IGF1R | T-Cell, Peripheral | 0.7368 | 0.7241 | 0.75 |
| CXCL9 AND NOT-CRB3 | T-Cell, Peripheral | 0.7458 | 0.7097 | 0.7857 | TNFSF11 AND NOT-RAMP2 | T-Cell, Peripheral | 0.6087 | 0.7778 | 0.5 |
| CXCL9 AND NOT-BAMBI | T-Cell, Peripheral | 0.7458 | 0.7097 | 0.7857 | CXCL9 AND NOT-ABCB5 | T-Cell, Peripheral | 0.6038 | 0.64 | 0.5714 |
| CXCL9 AND NOT-CYP4F12 | T-Cell, Peripheral | 0.7458 | 0.7097 | 0.7857 | CXCL10 AND NOT-ROR1 | T-Cell, Peripheral | 0.6452 | 0.5882 | 0.7143 |
| CXCL9 AND NOT-KCNK17 | T-Cell, Peripheral | 0.7458 | 0.7097 | 0.7857 | TNFSF11 AND NOT-OR7A10 | T-Cell, Peripheral | 0.6 | 1 | 0.4286 |
| CXCL9 AND NOT-LRP11 | T-Cell, Peripheral | 0.7458 | 0.7097 | 0.7857 | TNFSF11 AND NOT-TMEM47 | T-Cell, Peripheral | 0.6222 | 0.8235 | 0.5 |
| CXCL9 AND NOT-EPHB3 | T-Cell, Peripheral | 0.7458 | 0.7097 | 0.7857 | EDNRB AND NOT-HTR2A | Melanoma | 0.9 | 1 | 0.8182 |
| CXCL9 AND NOT-SPPL3 | T-Cell, Peripheral | 0.7458 | 0.7097 | 0.7857 | EDNRB AND NOT-IL5RA | Melanoma | 0.9 | 1 | 0.8182 |
| CXCL9 AND NOT-TMEM231 | T-Cell, Peripheral | 0.7586 | 0.7333 | 0.7857 | EDNRB AND NOT-IHH | Melanoma | 0.9 | 1 | 0.8182 |
| CXCL9 AND NOT-MCOLN3 | T-Cell, Peripheral | 0.7719 | 0.7586 | 0.7857 | EDNRB AND NOT-AMIGO2 | Melanoma | 0.9 | 1 | 0.8182 |
| CXCL9 AND NOT-ANO6 | T-Cell, Peripheral | 0.7925 | 0.84 | 0.75 | EDNRB AND NOT-IFNGR1 | Melanoma | 0.9 | 1 | 0.8182 |
| CXCL9 AND NOT-PCDHB14 | T-Cell, Peripheral | 0.7586 | 0.7333 | 0.7857 | EDNRB AND NOT-AQP8 | Melanoma | 0.9 | 1 | 0.8182 |
| CXCL9 AND NOT-BACE1 | T-Cell, Peripheral | 0.7407 | 0.7692 | 0.7143 | EDNRB AND NOT-SLC6A19 | Melanoma | 0.9 | 1 | 0.8182 |
| CXCL9 AND NOT-F2RL1 | T-Cell, Peripheral | 0.75 | 0.75 | 0.75 | EDNRB AND NOT-FAT3 | Melanoma | 0.9 | 1 | 0.8182 |
| CXCL9 AND NOT-GLDN | T-Cell, Peripheral | 0.75 | 0.75 | 0.75 | EDNRB AND NOT-ICAM4 | Melanoma | 0.9 | 1 | 0.8182 |
| CXCL9 AND NOT-KCNMB1 | T-Cell, Peripheral | 0.8148 | 0.8462 | 0.7857 | EDNRB AND NOT-ICAM2 | Melanoma | 0.9 | 1 | 0.8182 |
| CXCL9 AND NOT-WNT5A | T-Cell, Peripheral | 0.7857 | 0.7857 | 0.7857 | EDNRB AND NOT-HTR4 | Melanoma | 0.9 | 1 | 0.8182 |
| CXCL9 AND NOT-KRT5 | T-Cell, Peripheral | 0.7586 | 0.7333 | 0.7857 | EDNRB AND NOT-IL7R | Melanoma | 0.9 | 1 | 0.8182 |
| CXCL9 AND NOT-RHBG | T-Cell, Peripheral | 0.7586 | 0.7333 | 0.7857 | EDNRB AND NOT-CXCR1 | Melanoma | 0.9 | 1 | 0.8182 |
| CXCL9 AND NOT-DSC3 | T-Cell, Peripheral | 0.7586 | 0.7333 | 0.7857 | EDNRB AND NOT-AQP1 | Melanoma | 0.9 | 1 | 0.8182 |
| CXCL9 AND NOT-NDRG1 | T-Cell, Peripheral | 0.7719 | 0.7586 | 0.7857 | EDNRB AND NOT-KCNB1 | Melanoma | 0.9 | 1 | 0.8182 |
| CXCL9 AND NOT-SSPN | T-Cell, Peripheral | 0.7636 | 0.7778 | 0.75 | EDNRB AND NOT-ABCC6 | Melanoma | 0.9 | 1 | 0.8182 |
| CXCL9 AND NOT-FZD7 | T-Cell, Peripheral | 0.7368 | 0.7241 | 0.75 | EDNRB AND NOT-AQP9 | Melanoma | 0.9 | 1 | 0.8182 |
| CXCL9 AND NOT-ATP9B | T-Cell, Peripheral | 0.7368 | 0.7241 | 0.75 | EDNRB AND NOT-INSRR | Melanoma | 0.9 | 1 | 0.8182 |
| CXCL9 AND NOT-MARCO | T-Cell, Peripheral | 0.7368 | 0.7241 | 0.75 | EDNRB AND NOT-AQP4 | Melanoma | 0.9 | 1 | 0.8182 |
| CXCL9 AND NOT-HAS3 | T-Cell, Peripheral | 0.7368 | 0.7241 | 0.75 | EDNRB AND NOT-ANK1 | Melanoma | 0.9 | 1 | 0.8182 |
| CXCL9 AND NOT-TSPAN6 | T-Cell, Peripheral | 0.7368 | 0.7241 | 0.75 | EDNRB AND NOT-FFAR2 | Melanoma | 0.9 | 1 | 0.8182 |
| CXCL9 AND NOT-THSD7A | T-Cell, Peripheral | 0.75 | 0.75 | 0.75 | EDNRB AND NOT-GPR31 | Melanoma | 0.9 | 1 | 0.8182 |
| CXCL9 AND NOT-UNC5B | T-Cell, Peripheral | 0.7586 | 0.7333 | 0.7857 | EDNRB AND NOT-GPR21 | Melanoma | 0.9 | 1 | 0.8182 |
| CXCL9 AND NOT-STX3 | T-Cell, Peripheral | 0.7347 | 0.8571 | 0.6429 | EDNRB AND NOT-TMEM150B | Melanoma | 0.9 | 1 | 0.8182 |
| CXCL9 AND NOT-SMO | T-Cell, Peripheral | 0.7333 | 0.6875 | 0.7857 | EDNRB AND NOT-CCR4 | Melanoma | 0.9 | 1 | 0.8182 |
| CXCL9 AND NOT-APCDD1 | T-Cell, Peripheral | 0.7333 | 0.6875 | 0.7857 | EDNRB AND NOT-GPR20 | Melanoma | 0.9 | 1 | 0.8182 |
| CXCL9 AND NOT-PLXNA2 | T-Cell, Peripheral | 0.7333 | 0.6875 | 0.7857 | EDNRB AND NOT-IZUMO1 | Melanoma | 0.9 | 1 | 0.8182 |
| CXCL9 AND NOT-IL20RB | T-Cell, Peripheral | 0.7333 | 0.6875 | 0.7857 | EDNRB AND NOT-GPR15 | Melanoma | 0.9 | 1 | 0.8182 |
| CXCL9 AND NOT-ANO10 | T-Cell, Peripheral | 0.7333 | 0.6875 | 0.7857 | EDNRB AND NOT-UTS2R | Melanoma | 0.9 | 1 | 0.8182 |
| CXCL9 AND NOT-KCNMB4 | T-Cell, Peripheral | 0.7458 | 0.7097 | 0.7857 | EDNRB AND NOT-PRLHR | Melanoma | 0.9 | 1 | 0.8182 |
| CXCL9 AND NOT-PCDHB10 | T-Cell, Peripheral | 0.7333 | 0.6875 | 0.7857 | EDNRB AND NOT-NPBWR2 | Melanoma | 0.9 | 1 | 0.8182 |
| CXCL9 AND NOT-MUC15 | T-Cell, Peripheral | 0.7333 | 0.6875 | 0.7857 | EDNRB AND NOT-OR10A4 | Melanoma | 0.9 | 1 | 0.8182 |
| CXCL9 AND NOT-ST14 | T-Cell, Peripheral | 0.7333 | 0.6875 | 0.7857 | EDNRB AND NOT-GRIA1 | Melanoma | 0.9 | 1 | 0.8182 |
| CXCL9 AND NOT-PTPRF | T-Cell, Peripheral | 0.7333 | 0.6875 | 0.7857 | EDNRB AND NOT-GRIK5 | Melanoma | 0.9 | 1 | 0.8182 |
| CXCL9 AND NOT-ADRB2 | T-Cell, Peripheral | 0.7719 | 0.7586 | 0.7857 | EDNRB AND NOT-HCRTR1 | Melanoma | 0.9 | 1 | 0.8182 |
| CXCL9 AND NOT-CDH1 | T-Cell, Peripheral | 0.7333 | 0.6875 | 0.7857 | EDNRB AND NOT-HRH2 | Melanoma | 0.9 | 1 | 0.8182 |
| CXCL9 AND NOT-CLCN5 | T-Cell, Peripheral | 0.7333 | 0.6875 | 0.7857 | EDNRB AND NOT-RXFP2 | Melanoma | 0.9 | 1 | 0.8182 |
| CXCL9 AND NOT-OR2F1 | T-Cell, Peripheral | 0.7333 | 0.6875 | 0.7857 | EDNRB AND NOT-GYPE | Melanoma | 0.9 | 1 | 0.8182 |
| CXCL9 AND NOT-DSG2 | T-Cell, Peripheral | 0.7333 | 0.6875 | 0.7857 | EDNRB AND NOT-TRHDE | Melanoma | 0.9 | 1 | 0.8182 |
| CXCL9 AND NOT-CELSR1 | T-Cell, Peripheral | 0.7333 | 0.6875 | 0.7857 | EDNRB AND NOT-GYPB | Melanoma | 0.9 | 1 | 0.8182 |
| CXCL9 AND NOT-JAG2 | T-Cell, Peripheral | 0.7333 | 0.6875 | 0.7857 | EDNRB AND NOT-GYPA | Melanoma | 0.9 | 1 | 0.8182 |
| CXCL9 AND NOT-FCGRT | T-Cell, Peripheral | 0.7755 | 0.9048 | 0.6786 | EDNRB AND NOT-LYVE1 | Melanoma | 0.9 | 1 | 0.8182 |
| CXCL9 AND NOT-SLC22A23 | T-Cell, Peripheral | 0.7333 | 0.6875 | 0.7857 | EDNRB AND NOT-GRPR | Melanoma | 0.9 | 1 | 0.8182 |
| VANGL2 AND NOT-CADM2 | Melanoma | 0.9524 | 1 | 0.9091 | EDNRB AND NOT-CD46 | Melanoma | 0.9 | 1 | 0.8182 |
| NPC1 AND NOT-NTRK3 | Melanoma | 0.9091 | 0.9091 | 0.9091 | SLC10A4 AND NOT-SSTR1 | Neuroblastoma | 0.9881 | 0.9881 | 0.9881 |
| VANGL2 AND NOT-TSPAN8 | Melanoma | 0.9 | 1 | 0.8182 | SLC10A4 AND NOT-CLDN11 | Neuroblastoma | 0.988 | 1 | 0.9762 |
| VANGL2 AND NOT-ATP1A2 | Melanoma | 0.9 | 1 | 0.8182 | SLC10A4 AND NOT-TYR | Neuroblastoma | 0.9765 | 0.9651 | 0.9881 |
| C11orf24 AND NOT-CAV3 | Melanoma | 0.9 | 1 | 0.8182 | SLC10A4 AND NOT-EGFR | Neuroblastoma | 0.9762 | 0.9762 | 0.9762 |
| C11orf24 AND NOT-KCNS2 | Melanoma | 0.9 | 1 | 0.8182 | SLC10A4 AND NOT-BCAN | Neuroblastoma | 0.9762 | 0.9762 | 0.9762 |
| C11orf24 AND NOT-TAAR2 | Melanoma | 0.9 | 1 | 0.8182 | SLC10A4 AND NOT-NCAM1 | Neuroblastoma | 0.9762 | 0.9762 | 0.9762 |
| C11orf24 AND NOT-KCNB1 | Melanoma | 0.9 | 1 | 0.8182 | SLC10A4 AND NOT-ITGB3 | Neuroblastoma | 0.9765 | 0.9651 | 0.9881 |
| C11orf24 AND NOT-SLC22A24 | Melanoma | 0.9 | 1 | 0.8182 | SLC10A4 AND NOT-ABCB5 | Neuroblastoma | 0.9708 | 0.954 | 0.9881 |
| C11orf24 AND NOT-TNFSF18 | Melanoma | 0.9 | 1 | 0.8182 | SLC10A4 AND NOT-FOLH1 | Neuroblastoma | 0.9708 | 0.954 | 0.9881 |
| C11orf24 AND NOT-CXCR1 | Melanoma | 0.9 | 1 | 0.8182 | SLC10A4 AND NOT-CLDN18 | Neuroblastoma | 0.9708 | 0.954 | 0.9881 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| C11orf24 AND NOT-OR51B2 | Melanoma | 0.9 | 1 | 0.8182 | SLC10A4 AND NOT-ITGB6 | Neuroblastoma | 0.9701 | 0.9759 | 0.9643 |
| VANGL2 AND NOT-NRXN1 | Melanoma | 0.9 | 1 | 0.8182 | SLC10A4 AND NOT-PCYT1A | Neuroblastoma | 0.9647 | 0.9535 | 0.9762 |
| C11orf24 AND NOT-OR4D1 | Melanoma | 0.9 | 1 | 0.8182 | SLC10A4 AND NOT-CLDN7 | Neuroblastoma | 0.9639 | 0.9756 | 0.9524 |
| C11orf24 AND NOT-GYPB | Melanoma | 0.9 | 1 | 0.8182 | SLC10A4 AND NOT-DNAJB8 | Neuroblastoma | 0.9595 | 0.9326 | 0.9881 |
| C11orf24 AND NOT-CYP4F12 | Melanoma | 0.9 | 1 | 0.8182 | SLC10A4 AND NOT-CLDN4 | Neuroblastoma | 0.9591 | 0.9425 | 0.9762 |
| C11orf24 AND NOT-AQP2 | Melanoma | 0.9 | 1 | 0.8182 | CHRNA3 AND NOT-TYR | Neuroblastoma | 0.9565 | 1 | 0.9167 |
| C11orf24 AND NOT-AMN | Melanoma | 0.9 | 1 | 0.8182 | CHRNA3 AND NOT-EGFR | Neuroblastoma | 0.9565 | 1 | 0.9167 |
| C11orf24 AND NOT-RXFP2 | Melanoma | 0.9 | 1 | 0.8182 | SLC10A4 AND NOT-ULBP3 | Neuroblastoma | 0.954 | 0.9222 | 0.9881 |
| C11orf24 AND NOT-SGMS2 | Melanoma | 0.9 | 1 | 0.8182 | SLC10A4 AND NOT-HHLA2 | Neuroblastoma | 0.9535 | 0.9318 | 0.9762 |
| SDC3 AND NOT-VIPR2 | Melanoma | 0.9 | 1 | 0.8182 | SLC10A4 AND NOT-MSLN | Neuroblastoma | 0.9529 | 0.9419 | 0.9643 |
| MC1R AND NOT-OR1J2 | Melanoma | 0.9 | 1 | 0.8182 | SLC10A4 AND NOT-ERBB3 | Neuroblastoma | 0.9518 | 0.9634 | 0.9405 |
| C11orf24 AND NOT-SLC7A13 | Melanoma | 0.9 | 1 | 0.8182 | CHRNA3 AND NOT-ULBP3 | Neuroblastoma | 0.9506 | 0.9872 | 0.9167 |
| MC1R AND NOT-GPR101 | Melanoma | 0.9 | 1 | 0.8182 | CHRNA3 AND NOT-DNAJB8 | Neuroblastoma | 0.9506 | 0.9872 | 0.9167 |
| C11orf24 AND NOT-NTRK3 | Melanoma | 0.9 | 1 | 0.8182 | CHRNA3 AND NOT-DPEP1 | Neuroblastoma | 0.9506 | 0.9872 | 0.9167 |
| MC1R AND NOT-AQP10 | Melanoma | 0.9 | 1 | 0.8182 | CHRNA3 AND NOT-CLDN1 | Neuroblastoma | 0.9506 | 0.9872 | 0.9167 |
| CELSR2 AND NOT-CADM2 | Melanoma | 0.9524 | 1 | 0.9091 | CHRNA3 AND NOT-HHLA2 | Neuroblastoma | 0.9506 | 0.9872 | 0.9167 |
| CELSR2 AND NOT-ATP1A2 | Melanoma | 0.9524 | 1 | 0.9091 | CHRNA3 AND NOT-CLDN18 | Neuroblastoma | 0.9506 | 0.9872 | 0.9167 |
| VANGL2 AND NOT-NTRK3 | Melanoma | 0.9 | 1 | 0.8182 | CHRNA3 AND NOT-ITGB3 | Neuroblastoma | 0.95 | 1 | 0.9048 |
| TNFSF9 AND NOT-KCNQ3 | Melanoma | 0.9524 | 1 | 0.9091 | CHRNA3 AND NOT-BCAN | Neuroblastoma | 0.95 | 1 | 0.9048 |
| C11orf24 AND NOT-CHRM2 | Melanoma | 0.9 | 1 | 0.8182 | SLC10A4 AND NOT-MST1R | Neuroblastoma | 0.9486 | 0.9121 | 0.9881 |
| C11orf24 AND NOT-PSENEN | Melanoma | 0.9 | 1 | 0.8182 | SLC10A4 AND NOT-ERBB4 | Neuroblastoma | 0.9474 | 0.931 | 0.9643 |
| C11orf24 AND NOT-IL17RC | Melanoma | 0.9 | 1 | 0.8182 | SLC10A4 AND NOT-IL20RA | Neuroblastoma | 0.9455 | 0.963 | 0.9286 |
| C11orf24 AND NOT-SLC2A5 | Melanoma | 0.9 | 1 | 0.8182 | CHRNA3 AND NOT-RNF43 | Neuroblastoma | 0.9441 | 0.987 | 0.9048 |
| C11orf24 AND NOT-DCHS2 | Melanoma | 0.9 | 1 | 0.8182 | CHRNA3 AND NOT-CLDN4 | Neuroblastoma | 0.9441 | 0.987 | 0.9048 |
| C11orf24 AND NOT-CD300C | Melanoma | 0.9 | 1 | 0.8182 | CHRNA3 AND NOT-IL20RA | Neuroblastoma | 0.9441 | 0.987 | 0.9048 |
| TNFSF9 AND NOT-FNDC5 | Melanoma | 0.9524 | 1 | 0.9091 | CHRNA3 AND NOT-SLC34A2 | Neuroblastoma | 0.9441 | 0.987 | 0.9048 |
| C11orf24 AND NOT-CD300LB | Melanoma | 0.9 | 1 | 0.8182 | CHRNA3 AND NOT-CA9 | Neuroblastoma | 0.9441 | 0.987 | 0.9048 |
| SDC3 AND NOT-SYT9 | Melanoma | 0.9 | 1 | 0.8182 | CHRNA3 AND NOT-PCYT1A | Neuroblastoma | 0.9441 | 0.987 | 0.9048 |
| C11orf24 AND NOT-SCN4A | Melanoma | 0.9 | 1 | 0.8182 | CHRNA3 AND NOT-MSLN | Neuroblastoma | 0.9441 | 0.987 | 0.9048 |
| C11orf24 AND NOT-OR2S2 | Melanoma | 0.9 | 1 | 0.8182 | CHRNA3 AND NOT-ITGB6 | Neuroblastoma | 0.9434 | 1 | 0.8929 |
| C11orf24 AND NOT-KCNK1 | Melanoma | 0.9 | 1 | 0.8182 | CHRNA3 AND NOT-ENPP3 | Neuroblastoma | 0.9434 | 1 | 0.8929 |
| C11orf24 AND NOT-STX1B | Melanoma | 0.9 | 1 | 0.8182 | SLC10A4 AND NOT-ENPP3 | Neuroblastoma | 0.9425 | 0.9111 | 0.9762 |
| C11orf24 AND NOT-IHH | Melanoma | 0.9 | 1 | 0.8182 | SLC10A4 AND NOT-RNF43 | Neuroblastoma | 0.9425 | 0.9111 | 0.9762 |
| C11orf24 AND NOT-GDPD2 | Melanoma | 0.9 | 1 | 0.8182 | SLC10A4 AND NOT-TPBG | Neuroblastoma | 0.9405 | 0.9405 | 0.9405 |
| C11orf24 AND NOT-OR2F2 | Melanoma | 0.9 | 1 | 0.8182 | CHRNA3 AND NOT-CXCR5 | Neuroblastoma | 0.9375 | 0.9868 | 0.8929 |
| C11orf24 AND NOT-GCGR | Melanoma | 0.9 | 1 | 0.8182 | SLC10A4 AND NOT-ULBP1 | Neuroblastoma | 0.9364 | 0.9101 | 0.9643 |
| C11orf24 AND NOT-HCRTR1 | Melanoma | 0.9 | 1 | 0.8182 | SLC10A4 AND NOT-EDNRB | Neuroblastoma | 0.9349 | 0.9294 | 0.9405 |
| C11orf24 AND NOT-TAS2R7 | Melanoma | 0.9 | 1 | 0.8182 | SLC10A4 AND NOT-ALDH1A1 | Neuroblastoma | 0.9349 | 0.9294 | 0.9405 |
| C11orf24 AND NOT-SLC1A1 | Melanoma | 0.9 | 1 | 0.8182 | SLC10A4 AND NOT-FOLR1 | Neuroblastoma | 0.9325 | 0.962 | 0.9048 |
| C11orf24 AND NOT-NPC1L1 | Melanoma | 0.9 | 1 | 0.8182 | CHRNA3 AND NOT-ABCB5 | Neuroblastoma | 0.9308 | 0.9867 | 0.881 |
| C11orf24 AND NOT-OXER1 | Melanoma | 0.9 | 1 | 0.8182 | CHRNA3 AND NOT-FOLR1 | Neuroblastoma | 0.9308 | 0.9867 | 0.881 |
| C11orf24 AND NOT-TAAR1 | Melanoma | 0.9 | 1 | 0.8182 | SLC10A4 AND NOT-TNFRSF13C | Neuroblastoma | 0.9294 | 0.9186 | 0.9405 |
| C11orf24 AND NOT-ATP2A1 | Melanoma | 0.9 | 1 | 0.8182 | SLC10A4 AND NOT-CLDN6 | Neuroblastoma | 0.9286 | 0.9286 | 0.9286 |
| C11orf24 AND NOT-OR12D2 | Melanoma | 0.9 | 1 | 0.8182 | SLC10A4 AND NOT-CXCR5 | Neuroblastoma | 0.9259 | 0.9615 | 0.8929 |
| C11orf24 AND NOT-SLC5A5 | Melanoma | 0.9 | 1 | 0.8182 | CHRNA3 AND NOT-EDNRB | Neuroblastoma | 0.9241 | 0.9865 | 0.869 |
| TNFSF9 AND NOT-FRRS1L | Melanoma | 0.9524 | 1 | 0.9091 | CHRNA3 AND NOT-AXL | Neuroblastoma | 0.9241 | 0.9865 | 0.869 |
| C11orf24 AND NOT-CACNG5 | Melanoma | 0.9 | 1 | 0.8182 | CHRNA3 AND NOT-TNFRSF13C | Neuroblastoma | 0.9241 | 0.9865 | 0.869 |
| C11orf24 AND NOT-SLC36A1 | Melanoma | 0.9 | 1 | 0.8182 | VANGL2 AND NOT-EGFR | Neuroblastoma | 0.9241 | 0.9865 | 0.869 |
| C11orf24 AND NOT-CHRNB3 | Melanoma | 0.9 | 1 | 0.8182 | L1CAM AND NOT-GJB6 | Neuroblastoma | 0.9317 | 0.974 | 0.8929 |
| TNFSF9 AND NOT-SYT9 | Melanoma | 0.9091 | 0.9091 | 0.9091 | L1CAM AND NOT-CACNA1A | Neuroblastoma | 0.9193 | 0.961 | 0.881 |
| C11orf24 AND NOT-VIPR2 | Melanoma | 0.9 | 1 | 0.8182 | VANGL2 AND NOT-RNF43 | Neuroblastoma | 0.9125 | 0.9605 | 0.869 |
| C11orf24 AND NOT-GPR101 | Melanoma | 0.9 | 1 | 0.8182 | PCDHB10 AND NOT-SSTR1 | Neuroblastoma | 0.9091 | 1 | 0.8333 |
| C11orf24 AND NOT-AQP10 | Melanoma | 0.9 | 1 | 0.8182 | VANGL2 AND NOT-SDC1 | Oligodendroglioma | 0.8571 | 0.9231 | 0.8 |
| C11orf24 AND NOT-F2RL1 | Melanoma | 0.9 | 1 | 0.8182 | PCDHGC3 AND NOT-IL2RA | Oligodendroglioma | 0.8889 | 1 | 0.8 |
| C11orf24 AND NOT-SLC4A1 | Melanoma | 0.9 | 1 | 0.8182 | PCDHGC3 AND NOT-CD72 | Oligodendroglioma | 0.8571 | 0.9231 | 0.8 |
| C11orf24 AND NOT-ADRA1B | Melanoma | 0.9 | 1 | 0.8182 | VANGL2 AND NOT-IL20RA | Oligodendroglioma | 0.8571 | 0.9231 | 0.8 |
| C11orf24 AND NOT-TM4SF5 | Melanoma | 0.9 | 1 | 0.8182 | NLGN3 AND NOT-EPCAM | Oligodendroglioma | 0.9333 | 0.9333 | 0.9333 |
| C11orf24 AND NOT-GRIK5 | Melanoma | 0.9 | 1 | 0.8182 | PCDHGC3 AND NOT-MET | Oligodendroglioma | 0.8889 | 1 | 0.8 |
| C11orf24 AND NOT-PVRL3 | Melanoma | 0.9 | 1 | 0.8182 | VANGL2 AND NOT-CLDN1 | Oligodendroglioma | 0.8571 | 0.9231 | 0.8 |
| C11orf24 AND NOT-PTPRF | Melanoma | 0.9 | 1 | 0.8182 | PCDHGC3 AND NOT-ABCB5 | Oligodendroglioma | 0.8571 | 0.9231 | 0.8 |
| C11orf24 AND NOT-GRPR | Melanoma | 0.9 | 1 | 0.8182 | PCDHGC3 AND NOT-ERBB2 | Oligodendroglioma | 0.8571 | 0.9231 | 0.8 |
| C11orf24 AND NOT-OR2F1 | Melanoma | 0.9 | 1 | 0.8182 | PCDHGC3 AND NOT-TRPM4 | Oligodendroglioma | 0.8276 | 0.8571 | 0.8 |
| C11orf24 AND NOT-PIANP | Melanoma | 0.9 | 1 | 0.8182 | PCDHGC3 AND NOT-ROR1 | Oligodendroglioma | 0.8276 | 0.8571 | 0.8 |
| C11orf24 AND NOT-SLC5A1 | Melanoma | 0.9 | 1 | 0.8182 | PCDHGC3 AND NOT-KDR | Oligodendroglioma | 0.8276 | 0.8571 | 0.8 |
| C11orf24 AND NOT-PRLHR | Melanoma | 0.9 | 1 | 0.8182 | VANGL2 AND NOT-TRPM4 | Oligodendroglioma | 0.8276 | 0.8571 | 0.8 |
| TNFSF9 AND NOT-SLC7A14 | Melanoma | 0.9524 | 1 | 0.9091 | PCDHGC3 AND NOT-RAET1E | Oligodendroglioma | 0.8276 | 0.8571 | 0.8 |
| C11orf24 AND NOT-TAAR8 | Melanoma | 0.9 | 1 | 0.8182 | NLGN3 AND NOT-RNF43 | Oligodendroglioma | 0.9333 | 0.9333 | 0.9333 |
| C11orf24 AND NOT-GP2 | Melanoma | 0.9 | 1 | 0.8182 | NLGN3 AND NOT-IL13RA1 | Oligodendroglioma | 0.8966 | 0.9286 | 0.8667 |
| C11orf24 AND NOT-SLC14A2 | Melanoma | 0.9 | 1 | 0.8182 | VANGL2 AND NOT-TPBG | Oligodendroglioma | 0.8148 | 0.9167 | 0.7333 |
| C11orf24 AND NOT-CNGB3 | Melanoma | 0.9 | 1 | 0.8182 | VANGL2 AND NOT-EPCAM | Oligodendroglioma | 0.8148 | 0.9167 | 0.7333 |
| C11orf24 AND NOT-OR10A5 | Melanoma | 0.9 | 1 | 0.8182 | NLGN3 AND NOT-CLDN8 | Oligodendroglioma | 0.9333 | 0.9333 | 0.9333 |
| C11orf24 AND NOT-SLC6A20 | Melanoma | 0.9 | 1 | 0.8182 | NLGN3 AND NOT-CLDN12 | Oligodendroglioma | 0.9333 | 0.9333 | 0.9333 |
| C11orf24 AND NOT-MCHR2 | Melanoma | 0.9 | 1 | 0.8182 | NLGN3 AND NOT-CLDN1 | Oligodendroglioma | 0.9333 | 0.9333 | 0.9333 |
| C11orf24 AND NOT-GLP1R | Melanoma | 0.9 | 1 | 0.8182 | NLGN3 AND NOT-IL20RA | Oligodendroglioma | 0.9333 | 0.9333 | 0.9333 |
| SLC10A4 AND NOT-GPR62 | Neuroblastoma | 0.994 | 1 | 0.9881 | NLGN3 AND NOT-CD33 | Oligodendroglioma | 0.8571 | 0.9231 | 0.8 |
| SLC10A4 AND NOT-PAQR6 | Neuroblastoma | 0.994 | 1 | 0.9881 | NLGN3 AND NOT-CD72 | Oligodendroglioma | 0.9333 | 0.9333 | 0.9333 |
| SLC10A4 AND NOT-AQP4 | Neuroblastoma | 0.994 | 1 | 0.9881 | NLGN3 AND NOT-TRPM4 | Oligodendroglioma | 0.9333 | 0.9333 | 0.9333 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC10A4 AND NOT-SLC15A2 | Neuroblastoma | 0.994 | 1 | 0.9881 | NLGN3 AND NOT-SDC1 | Oligodendroglioma | 0.9333 | 0.9333 | 0.9333 |
| SLC10A4 AND NOT-SLC2A12 | Neuroblastoma | 0.994 | 1 | 0.9881 | VANGL2 AND NOT-CLDN8 | Oligodendroglioma | 0.8571 | 0.9231 | 0.8 |
| SLC10A4 AND NOT-SLC7A10 | Neuroblastoma | 0.994 | 1 | 0.9881 | PTPRZ1 AND NOT-EPCAM | Oligodendroglioma | 0.8148 | 0.9167 | 0.7333 |
| SLC10A4 AND NOT-LRP4 | Neuroblastoma | 0.994 | 1 | 0.9881 | NLGN3 AND NOT-RAET1E | Oligodendroglioma | 0.8889 | 1 | 0.8 |
| SLC10A4 AND NOT-SLC24A4 | Neuroblastoma | 0.9881 | 0.9881 | 0.9881 | NLGN3 AND NOT-ENPP3 | Oligodendroglioma | 0.9333 | 0.9333 | 0.9333 |
| SLC10A4 AND NOT-SLC1A3 | Neuroblastoma | 0.9881 | 0.9881 | 0.9881 | NLGN3 AND NOT-CD79A | Oligodendroglioma | 0.8571 | 0.9231 | 0.8 |
| SLC10A4 AND NOT-KCNJ16 | Neuroblastoma | 0.9881 | 0.9881 | 0.9881 | VANGL2 AND NOT-ERBB2 | Oligodendroglioma | 0.8571 | 0.9231 | 0.8 |
| SLC10A4 AND NOT-GPR37 | Neuroblastoma | 0.9881 | 0.9881 | 0.9881 | NLGN3 AND NOT-SLC34A2 | Oligodendroglioma | 0.9333 | 0.9333 | 0.9333 |
| SLC10A4 AND NOT-ADRB1 | Neuroblastoma | 0.988 | 1 | 0.9762 | NLGN3 AND NOT-ULBP2 | Oligodendroglioma | 0.9333 | 0.9333 | 0.9333 |
| SLC10A4 AND NOT-GJB6 | Neuroblastoma | 0.988 | 1 | 0.9762 | NLGN3 AND NOT-CLDN9 | Oligodendroglioma | 0.9333 | 0.9333 | 0.9333 |
| SLC10A4 AND NOT-ABCG2 | Neuroblastoma | 0.988 | 1 | 0.9762 | NLGN3 AND NOT-CD34 | Oligodendroglioma | 0.9333 | 0.9333 | 0.9333 |
| SLC10A4 AND NOT-IGSF11 | Neuroblastoma | 0.988 | 1 | 0.9762 | NLGN3 AND NOT-P2RX5 | Oligodendroglioma | 0.9333 | 0.9333 | 0.9333 |
| SLC10A4 AND NOT-KCNN3 | Neuroblastoma | 0.988 | 1 | 0.9762 | PCDHGC3 AND NOT-CD34 | Oligodendroglioma | 0.8 | 0.8 | 0.8 |
| SLC10A4 AND NOT-CHRM5 | Neuroblastoma | 0.988 | 1 | 0.9762 | VANGL2 AND NOT-RNF43 | Oligodendroglioma | 0.8 | 0.8 | 0.8 |
| SLC10A4 AND NOT-SLC4A4 | Neuroblastoma | 0.9822 | 0.9765 | 0.9881 | GPR173 AND NOT-ERBB2 | Oligodendroglioma | 0.8 | 1 | 0.6667 |
| SLC10A4 AND NOT-TRPM6 | Neuroblastoma | 0.9822 | 0.9765 | 0.9881 | GPR173 AND NOT-ENG | Oligodendroglioma | 0.8 | 1 | 0.6667 |
| SLC10A4 AND NOT-CADM4 | Neuroblastoma | 0.9822 | 0.9765 | 0.9881 | NLGN3 AND NOT-CD52 | Oligodendroglioma | 0.8 | 1 | 0.6667 |
| SLC10A4 AND NOT-AQP8 | Neuroblastoma | 0.9822 | 0.9765 | 0.9881 | GPR173 AND NOT-CLDN1 | Oligodendroglioma | 0.8 | 1 | 0.6667 |
| SLC10A4 AND NOT-GRIA3 | Neuroblastoma | 0.9822 | 0.9765 | 0.9881 | VANGL2 AND NOT-CD52 | Oligodendroglioma | 0.8148 | 0.9167 | 0.7333 |
| SLC10A4 AND NOT-ATP1A2 | Neuroblastoma | 0.9822 | 0.9765 | 0.9881 | PTPRZ1 AND NOT-TPBG | Oligodendroglioma | 0.8148 | 0.9167 | 0.7333 |
| SLC10A4 AND NOT-GJC2 | Neuroblastoma | 0.9822 | 0.9765 | 0.9881 | SLC4A4 AND NOT-EPCAM | Oligodendroglioma | 0.8889 | 1 | 0.8 |
| SLC10A4 AND NOT-GPRC5B | Neuroblastoma | 0.9822 | 0.9765 | 0.9881 | NLGN3 AND NOT-TNFRSF8 | Oligodendroglioma | 0.9333 | 0.9333 | 0.9333 |
| SLC10A4 AND NOT-ATP13A4 | Neuroblastoma | 0.9822 | 0.9765 | 0.9881 | NLGN3 AND NOT-GUCY2C | Oligodendroglioma | 0.9333 | 0.9333 | 0.9333 |
| SLC10A4 AND NOT-SLC22A23 | Neuroblastoma | 0.9822 | 0.9765 | 0.9881 | NLGN3 AND NOT-CD180 | Oligodendroglioma | 0.9333 | 0.9333 | 0.9333 |
| SLC10A4 AND NOT-SLC44A1 | Neuroblastoma | 0.9822 | 0.9765 | 0.9881 | NLGN3 AND NOT-IL3RA | Oligodendroglioma | 0.9333 | 0.9333 | 0.9333 |
| SLC10A4 AND NOT-PRRG1 | Neuroblastoma | 0.9822 | 0.9765 | 0.9881 | NLGN3 AND NOT-STEAP1 | Oligodendroglioma | 0.9333 | 0.9333 | 0.9333 |
| SLC10A4 AND NOT-RHBDL2 | Neuroblastoma | 0.9822 | 0.9765 | 0.9881 | NLGN3 AND NOT-ENG | Oligodendroglioma | 0.9333 | 0.9333 | 0.9333 |
| SLC10A4 AND NOT-TGFA | Neuroblastoma | 0.9822 | 0.9765 | 0.9881 | NLGN3 AND NOT-STEAP2 | Oligodendroglioma | 0.9333 | 0.9333 | 0.9333 |
| SLC10A4 AND NOT-SLC2A13 | Neuroblastoma | 0.982 | 0.988 | 0.9762 | NLGN3 AND NOT-ITGB6 | Oligodendroglioma | 0.9333 | 0.9333 | 0.9333 |
| SLC10A4 AND NOT-MFAP3L | Neuroblastoma | 0.982 | 0.988 | 0.9762 | NLGN3 AND NOT-ABCB5 | Oligodendroglioma | 0.9333 | 0.9333 | 0.9333 |
| SLC10A4 AND NOT-CACNA1A | Neuroblastoma | 0.982 | 0.988 | 0.9762 | NLGN3 AND NOT-FCRL1 | Oligodendroglioma | 0.9333 | 0.9333 | 0.9333 |
| SLC10A4 AND NOT-GLDN | Neuroblastoma | 0.982 | 0.988 | 0.9762 | NLGN3 AND NOT-SSTR4 | Oligodendroglioma | 0.9333 | 0.9333 | 0.9333 |
| SLC10A4 AND NOT-UGT8 | Neuroblastoma | 0.982 | 0.988 | 0.9762 | NLGN3 AND NOT-CD79B | Oligodendroglioma | 0.9333 | 0.9333 | 0.9333 |
| SLC10A4 AND NOT-STYK1 | Neuroblastoma | 0.9818 | 1 | 0.9643 | NLGN3 AND NOT-SSTR5 | Oligodendroglioma | 0.9333 | 0.9333 | 0.9333 |
| SLC10A4 AND NOT-PCDHAC1 | Neuroblastoma | 0.9822 | 0.9765 | 0.9881 | NLGN3 AND NOT-SSTR3 | Oligodendroglioma | 0.9333 | 0.9333 | 0.9333 |
| SLC10A4 AND NOT-OPN5 | Neuroblastoma | 0.9822 | 0.9765 | 0.9881 | NLGN3 AND NOT-TNFRSF17 | Oligodendroglioma | 0.9333 | 0.9333 | 0.9333 |
| SLC10A4 AND NOT-CATSPERG | Neuroblastoma | 0.9822 | 0.9765 | 0.9881 | NLGN3 AND NOT-VTCN1 | Oligodendroglioma | 0.9333 | 0.9333 | 0.9333 |
| SLC10A4 AND NOT-ACE2 | Neuroblastoma | 0.9822 | 0.9765 | 0.9881 | NLGN3 AND NOT-FCRL5 | Oligodendroglioma | 0.9333 | 0.9333 | 0.9333 |
| SLC10A4 AND NOT-ESYT3 | Neuroblastoma | 0.988 | 1 | 0.9762 | NLGN3 AND NOT-AXL | Oligodendroglioma | 0.8966 | 0.9286 | 0.8667 |
| SLC10A4 AND NOT-CDH26 | Neuroblastoma | 0.9765 | 0.9651 | 0.9881 | NLGN3 AND NOT-PMEL | Oligodendroglioma | 0.9333 | 0.9333 | 0.9333 |
| SLC10A4 AND NOT-SLC13A3 | Neuroblastoma | 0.9765 | 0.9651 | 0.9881 | NLGN3 AND NOT-TNFRSF10A | Oligodendroglioma | 0.9333 | 0.9333 | 0.9333 |
| SLC10A4 AND NOT-SLC6A1 | Neuroblastoma | 0.9765 | 0.9651 | 0.9881 | NLGN3 AND NOT-MSLN | Oligodendroglioma | 0.8966 | 0.9286 | 0.8667 |
| SLC10A4 AND NOT-NINJ2 | Neuroblastoma | 0.9765 | 0.9651 | 0.9881 | NLGN3 AND NOT-MUC1 | Oligodendroglioma | 0.9333 | 0.9333 | 0.9333 |
| SLC10A4 AND NOT-CLCA2 | Neuroblastoma | 0.9765 | 0.9651 | 0.9881 | NLGN3 AND NOT-CLDN6 | Oligodendroglioma | 0.9333 | 0.9333 | 0.9333 |
| SLC10A4 AND NOT-RRH | Neuroblastoma | 0.9765 | 0.9651 | 0.9881 | NLGN3 AND NOT-TNFRSF13C | Oligodendroglioma | 0.9333 | 0.9333 | 0.9333 |
| SLC10A4 AND NOT-GAL3ST1 | Neuroblastoma | 0.9765 | 0.9651 | 0.9881 | NLGN3 AND NOT-SSTR1 | Oligodendroglioma | 0.9333 | 0.9333 | 0.9333 |
| SLC10A4 AND NOT-AGPAT3 | Neuroblastoma | 0.9765 | 0.9651 | 0.9881 | NLGN3 AND NOT-TNFSF11 | Oligodendroglioma | 0.9333 | 0.9333 | 0.9333 |
| SLC10A4 AND NOT-CRHR2 | Neuroblastoma | 0.9765 | 0.9651 | 0.9881 | NLGN3 AND NOT-MUC13 | Oligodendroglioma | 0.9333 | 0.9333 | 0.9333 |
| SLC10A4 AND NOT-CD99L2 | Neuroblastoma | 0.9765 | 0.9651 | 0.9881 | NLGN3 AND NOT-CR2 | Oligodendroglioma | 0.9333 | 0.9333 | 0.9333 |
| SLC10A4 AND NOT-S1PR5 | Neuroblastoma | 0.9765 | 0.9651 | 0.9881 | NLGN3 AND NOT-FOLH1 | Oligodendroglioma | 0.9333 | 0.9333 | 0.9333 |
| SLC10A4 AND NOT-FGFR2 | Neuroblastoma | 0.9765 | 0.9651 | 0.9881 | NLGN3 AND NOT-CLDN2 | Oligodendroglioma | 0.9333 | 0.9333 | 0.9333 |
| SLC10A4 AND NOT-LRP2 | Neuroblastoma | 0.9765 | 0.9651 | 0.9881 | NLGN3 AND NOT-ITGB3 | Oligodendroglioma | 0.9333 | 0.9333 | 0.9333 |
| SLC10A4 AND NOT-NTRK2 | Neuroblastoma | 0.9765 | 0.9651 | 0.9881 | NLGN3 AND NOT-CLDN18 | Oligodendroglioma | 0.9333 | 0.9333 | 0.9333 |
| SLC10A4 AND NOT-SLC6A4 | Neuroblastoma | 0.9762 | 0.9762 | 0.9762 | KCNK15 AND NOT-TPBG | Ovarian | 0.8571 | 0.75 | 1 |
| SLC10A4 AND NOT-UPK1B | Neuroblastoma | 0.9762 | 0.9762 | 0.9762 | KCNK15 AND NOT-EDNRB | Ovarian | 0.8696 | 0.9091 | 0.8333 |
| SLC10A4 AND NOT-SLC6A20 | Neuroblastoma | 0.9762 | 0.9762 | 0.9762 | KCNK15 AND NOT-AXL | Ovarian | 0.8889 | 0.8 | 1 |
| SLC10A4 AND NOT-DIO2 | Neuroblastoma | 0.9762 | 0.9762 | 0.9762 | KCNK15 AND NOT-IL3RA | Ovarian | 0.9167 | 0.9167 | 0.9167 |
| SLC10A4 AND NOT-SLC26A9 | Neuroblastoma | 0.9762 | 0.9762 | 0.9762 | KCNK15 AND NOT-CD52 | Ovarian | 0.8276 | 0.7059 | 1 |
| SLC10A4 AND NOT-TREML1 | Neuroblastoma | 0.9762 | 0.9762 | 0.9762 | KCNK15 AND NOT-GPNMB | Ovarian | 0.96 | 0.9231 | 1 |
| SLC10A4 AND NOT-SLC5A1 | Neuroblastoma | 0.9762 | 0.9762 | 0.9762 | KCNK15 AND NOT-VCAM1 | Ovarian | 0.8 | 0.6667 | 1 |
| SLC10A4 AND NOT-GABRA6 | Neuroblastoma | 0.9762 | 0.9762 | 0.9762 | KCNK15 AND NOT-CLDN23 | Ovarian | 0.8 | 0.6667 | 1 |
| PCDHGC3 AND NOT-DSG2 | Oligodendroglioma | 0.8889 | 1 | 0.8 | MUC16 AND NOT-MTUS1 | Ovarian | 0.8 | 1 | 0.6667 |
| PCDHGC3 AND NOT-IL1R1 | Oligodendroglioma | 0.8889 | 1 | 0.8 | KCNK15 AND NOT-ENG | Ovarian | 0.8 | 0.6667 | 1 |
| PCDHGC3 AND NOT-IL1RL2 | Oligodendroglioma | 0.8889 | 1 | 0.8 | MUC16 AND NOT-CD99 | Ovarian | 0.8 | 1 | 0.6667 |
| PCDHGC3 AND NOT-GABRE | Oligodendroglioma | 0.8889 | 1 | 0.8 | MUC16 AND NOT-PKD2 | Ovarian | 0.8 | 1 | 0.6667 |
| PCDHGC3 AND NOT-CORIN | Oligodendroglioma | 0.8889 | 1 | 0.8 | KCNK15 AND NOT-IL20RA | Ovarian | 0.7742 | 0.6316 | 1 |
| PCDHGC3 AND NOT-DUOX2 | Oligodendroglioma | 0.8889 | 1 | 0.8 | KCNK15 AND NOT-FAP | Ovarian | 0.7742 | 0.6316 | 1 |
| PCDHGC3 AND NOT-DSC2 | Oligodendroglioma | 0.8889 | 1 | 0.8 | KCNK15 AND NOT-CLDN8 | Ovarian | 0.7742 | 0.6316 | 1 |
| PCDHGC3 AND NOT-SGMS2 | Oligodendroglioma | 0.8889 | 1 | 0.8 | KCNK15 AND NOT-PROM1 | Ovarian | 0.7742 | 0.6316 | 1 |
| VANGL2 AND NOT-SLITRK6 | Oligodendroglioma | 0.8571 | 0.9231 | 0.8 | KCNK15 AND NOT-ROR1 | Ovarian | 0.7742 | 0.6316 | 1 |
| PCDHGC3 AND NOT-CLMP | Oligodendroglioma | 0.8571 | 0.9231 | 0.8 | KCNK15 AND NOT-TRPM4 | Ovarian | 0.7742 | 0.6316 | 1 |
| PCDHGC3 AND NOT-ITGA11 | Oligodendroglioma | 0.8571 | 0.9231 | 0.8 | KCNK15 AND NOT-KDR | Ovarian | 0.7742 | 0.6316 | 1 |
| PCDHGC3 AND NOT-TRPM7 | Oligodendroglioma | 0.8889 | 1 | 0.8 | KCNK15 AND NOT-CLDN1 | Ovarian | 0.7742 | 0.6316 | 1 |
| VANGL2 AND NOT-FXYD3 | Oligodendroglioma | 0.8571 | 0.9231 | 0.8 | KCNK15 AND NOT-CD70 | Ovarian | 0.7742 | 0.6316 | 1 |
| PCDHGC3 AND NOT-ICAM3 | Oligodendroglioma | 0.8571 | 0.9231 | 0.8 | KCNK15 AND NOT-MET | Ovarian | 0.7742 | 0.6316 | 1 |
| VANGL2 AND NOT-KRT5 | Oligodendroglioma | 0.8571 | 0.9231 | 0.8 | KCNK15 AND NOT-ULBP2 | Ovarian | 0.7742 | 0.6316 | 1 |
| VANGL2 AND NOT-PERP | Oligodendroglioma | 0.8571 | 0.9231 | 0.8 | KCNK15 AND NOT-SLC39A6 | Ovarian | 0.7742 | 0.6316 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| PCDHGC3 AND NOT-OR51M1 | Oligodendroglioma | 0.8571 | 0.9231 | 0.8 | KCNK15 AND NOT-SSTR5 | Ovarian | 0.7692 | 0.7143 | 0.8333 |
| VANGL2 AND NOT-DSG2 | Oligodendroglioma | 0.8571 | 0.9231 | 0.8 | MUC16 AND NOT-TMEM59 | Ovarian | 0.7619 | 0.8889 | 0.6667 |
| PCDHGC3 AND NOT-SGCG | Oligodendroglioma | 0.8889 | 1 | 0.8 | MUC16 AND NOT-BTN3A2 | Ovarian | 0.7619 | 0.8889 | 0.6667 |
| PCDHGC3 AND NOT-SLCO2A1 | Oligodendroglioma | 0.8571 | 0.9231 | 0.8 | MUC16 AND NOT-F3 | Ovarian | 0.7619 | 0.8889 | 0.6667 |
| PCDHGC3 AND NOT-NPR3 | Oligodendroglioma | 0.8889 | 1 | 0.8 | KCNK15 AND NOT-TNFRSF8 | Ovarian | 0.7586 | 0.6471 | 0.9167 |
| PCDHGC3 AND NOT-CD40 | Oligodendroglioma | 0.8571 | 0.9231 | 0.8 | KCNK15 AND NOT-CSPG4 | Ovarian | 0.7407 | 0.6667 | 0.8333 |
| VANGL2 AND NOT-TACSTD2 | Oligodendroglioma | 0.8571 | 0.9231 | 0.8 | KCNK15 AND NOT-CLDN11 | Ovarian | 0.7333 | 0.6111 | 0.9167 |
| PCDHGC3 AND NOT-SPPL2A | Oligodendroglioma | 0.8889 | 1 | 0.8 | MUC16 AND NOT-ATP2C2 | Ovarian | 0.7273 | 0.8 | 0.6667 |
| VANGL2 AND NOT-AQP3 | Oligodendroglioma | 0.8571 | 0.9231 | 0.8 | MUC16 AND NOT-DLL1 | Ovarian | 0.7273 | 0.8 | 0.6667 |
| VANGL2 AND NOT-DUOX1 | Oligodendroglioma | 0.8571 | 0.9231 | 0.8 | MUC16 AND NOT-PIGR | Ovarian | 0.7273 | 0.8 | 0.6667 |
| PCDHGC3 AND NOT-LRRC32 | Oligodendroglioma | 0.8571 | 0.9231 | 0.8 | MUC16 AND NOT-KIAA1324 | Ovarian | 0.7273 | 0.8 | 0.6667 |
| PCDHGC3 AND NOT-AGTR1 | Oligodendroglioma | 0.8571 | 0.9231 | 0.8 | MUC16 AND NOT-GOLM1 | Ovarian | 0.7273 | 0.8 | 0.6667 |
| VANGL2 AND NOT-GPR87 | Oligodendroglioma | 0.8571 | 0.9231 | 0.8 | MUC16 AND NOT-TSPAN8 | Ovarian | 0.7273 | 0.8 | 0.6667 |
| PTPRZ1 AND NOT-MTUS1 | Oligodendroglioma | 0.8889 | 1 | 0.8 | MUC16 AND NOT-STIM2 | Ovarian | 0.7273 | 0.8 | 0.6667 |
| PCDHGC3 AND NOT-GJA5 | Oligodendroglioma | 0.8889 | 1 | 0.8 | MUC16 AND NOT-APCDD1 | Ovarian | 0.7273 | 0.8 | 0.6667 |
| PCDHGC3 AND NOT-LTA | Oligodendroglioma | 0.8571 | 0.9231 | 0.8 | MUC16 AND NOT-AQP3 | Ovarian | 0.7273 | 0.8 | 0.6667 |
| PCDHGC3 AND NOT-JPH2 | Oligodendroglioma | 0.8571 | 0.9231 | 0.8 | MUC16 AND NOT-MACF1 | Ovarian | 0.7273 | 0.8 | 0.6667 |
| PCDHGC3 AND NOT-RTP1 | Oligodendroglioma | 0.8571 | 0.9231 | 0.8 | KCNK15 AND NOT-SSTR4 | Ovarian | 0.7143 | 0.625 | 0.8333 |
| PCDHGC3 AND NOT-DSC3 | Oligodendroglioma | 0.8571 | 0.9231 | 0.8 | MUC16 AND NOT-LPAR6 | Ovarian | 0.7619 | 0.8889 | 0.6667 |
| PCDHGC3 AND NOT-VNN3 | Oligodendroglioma | 0.8889 | 1 | 0.8 | MUC16 AND NOT-ICAM4 | Ovarian | 0.7368 | 1 | 0.5833 |
| PCDHGC3 AND NOT-FUT1 | Oligodendroglioma | 0.8571 | 0.9231 | 0.8 | MUC16 AND NOT-C10orf54 | Ovarian | 0.7619 | 0.8889 | 0.6667 |
| PCDHGC3 AND NOT-ITGA9 | Oligodendroglioma | 0.8889 | 1 | 0.8 | MUC16 AND NOT-BAMBI | Ovarian | 0.7 | 0.875 | 0.5833 |
| PCDHGC3 AND NOT-AQP7 | Oligodendroglioma | 0.8889 | 1 | 0.8 | MUC16 AND NOT-KIT | Ovarian | 0.7 | 0.875 | 0.5833 |
| PCDHGC3 AND NOT-APOB | Oligodendroglioma | 0.8889 | 1 | 0.8 | MUC16 AND NOT-FXYD1 | Ovarian | 0.7 | 0.875 | 0.5833 |
| PCDHGC3 AND NOT-LNPEP | Oligodendroglioma | 0.8571 | 0.9231 | 0.8 | MUC16 AND NOT-KRT5 | Ovarian | 0.7273 | 0.8 | 0.6667 |
| PCDHGC3 AND NOT-KCNQ1 | Oligodendroglioma | 0.8571 | 0.9231 | 0.8 | MUC16 AND NOT-PTPRZ1 | Ovarian | 0.6957 | 0.7273 | 0.6667 |
| PCDHGC3 AND NOT-SLCO5A1 | Oligodendroglioma | 0.8889 | 1 | 0.8 | MUC16 AND NOT-CDHR3 | Ovarian | 0.6957 | 0.7273 | 0.6667 |
| PCDHGC3 AND NOT-P2RY2 | Oligodendroglioma | 0.8889 | 1 | 0.8 | MUC16 AND NOT-COMT | Ovarian | 0.6957 | 0.7273 | 0.6667 |
| PCDHGC3 AND NOT-SGCA | Oligodendroglioma | 0.8889 | 1 | 0.8 | MUC16 AND NOT-ITGA2 | Ovarian | 0.6957 | 0.7273 | 0.6667 |
| PCDHGC3 AND NOT-SCN5A | Oligodendroglioma | 0.8571 | 0.9231 | 0.8 | KCNK15 AND NOT-CXCR5 | Ovarian | 0.6957 | 0.7273 | 0.6667 |
| PCDHGC3 AND NOT-C14orf180 | Oligodendroglioma | 0.8889 | 1 | 0.8 | MUC16 AND NOT-DNAJC1 | Ovarian | 0.6957 | 0.7273 | 0.6667 |
| PCDHGC3 AND NOT-EPHB4 | Oligodendroglioma | 0.8571 | 0.9231 | 0.8 | MUC16 AND NOT-STIM1 | Ovarian | 0.6957 | 0.7273 | 0.6667 |
| PCDHGC3 AND NOT-FGG | Oligodendroglioma | 0.8889 | 1 | 0.8 | MUC16 AND NOT-ACSL1 | Ovarian | 0.6957 | 0.7273 | 0.6667 |
| PCDHGC3 AND NOT-SLC5A1 | Oligodendroglioma | 0.8889 | 1 | 0.8 | MUC16 AND NOT-STOM | Ovarian | 0.6957 | 0.7273 | 0.6667 |
| VANGL2 AND NOT-ST14 | Oligodendroglioma | 0.8571 | 0.9231 | 0.8 | MUC16 AND NOT-LRP11 | Ovarian | 0.6957 | 0.7273 | 0.6667 |
| VANGL2 AND NOT-DSC3 | Oligodendroglioma | 0.8571 | 0.9231 | 0.8 | MUC16 AND NOT-ATP6AP2 | Ovarian | 0.7273 | 0.8 | 0.6667 |
| VANGL2 AND NOT-SCNN1A | Oligodendroglioma | 0.8571 | 0.9231 | 0.8 | KCNK15 AND NOT-IL11RA | Ovarian | 0.7692 | 0.7143 | 0.8333 |
| VANGL2 AND NOT-SPINT1 | Oligodendroglioma | 0.8571 | 0.9231 | 0.8 | MUC16 AND NOT-PCDHGA10 | Ovarian | 0.7 | 0.875 | 0.5833 |
| VANGL2 AND NOT-EMP2 | Oligodendroglioma | 0.8571 | 0.9231 | 0.8 | MUC16 AND NOT-HLA-B | Ovarian | 0.7273 | 0.8 | 0.6667 |
| PCDHGC3 AND NOT-ACVRL1 | Oligodendroglioma | 0.8889 | 1 | 0.8 | MUC16 AND NOT-CLCA2 | Ovarian | 0.6667 | 0.6667 | 0.6667 |
| PCDHGC3 AND NOT-LILRB1 | Oligodendroglioma | 0.8462 | 1 | 0.7333 | MUC16 AND NOT-LRRTM2 | Ovarian | 0.6667 | 1 | 0.5 |
| PCDHGC3 AND NOT-PERP | Oligodendroglioma | 0.8462 | 1 | 0.7333 | MUC16 AND NOT-IL4R | Ovarian | 0.6667 | 0.7778 | 0.5833 |
| PCDHGC3 AND NOT-IL7R | Oligodendroglioma | 0.8462 | 1 | 0.7333 | MUC16 AND NOT-SLC20A1 | Ovarian | 0.6667 | 0.6667 | 0.6667 |
| PCDHGC3 AND NOT-MYADM | Oligodendroglioma | 0.8462 | 1 | 0.7333 | MUC16 AND NOT-AKAP1 | Ovarian | 0.6667 | 0.6667 | 0.6667 |
| PCDHGC3 AND NOT-ITPR3 | Oligodendroglioma | 0.8462 | 1 | 0.7333 | MUC16 AND NOT-ENTPD3 | Ovarian | 0.6667 | 0.6667 | 0.6667 |
| PCDHGC3 AND NOT-ESYT2 | Oligodendroglioma | 0.8462 | 1 | 0.7333 | MUC16 AND NOT-LITAF | Ovarian | 0.6667 | 0.6667 | 0.6667 |
| PCDHGC3 AND NOT-PDCD1LG2 | Oligodendroglioma | 0.8462 | 1 | 0.7333 | MUC16 AND NOT-SERINC3 | Ovarian | 0.6667 | 0.6667 | 0.6667 |
| PCDHGC3 AND NOT-ADCY9 | Oligodendroglioma | 0.8462 | 1 | 0.7333 | MUC16 AND NOT-SLC41A1 | Ovarian | 0.6667 | 0.6667 | 0.6667 |
| PCDHGC3 AND NOT-IL1R2 | Oligodendroglioma | 0.8462 | 1 | 0.7333 | MUC16 AND NOT-ATP12A | Ovarian | 0.6667 | 0.6667 | 0.6667 |
| PCDHGC3 AND NOT-TRPV3 | Oligodendroglioma | 0.8462 | 1 | 0.7333 | MUC16 AND NOT-ARL6IP5 | Ovarian | 0.6667 | 0.6667 | 0.6667 |
| PTPRZ1 AND NOT-ATP1B1 | Oligodendroglioma | 0.8462 | 1 | 0.7333 | MUC16 AND NOT-LPAR1 | Ovarian | 0.6667 | 1 | 0.5 |
| PCDHGC3 AND NOT-ZDHHC5 | Oligodendroglioma | 0.8462 | 1 | 0.7333 | MUC16 AND NOT-CHIC2 | Ovarian | 0.6667 | 0.6667 | 0.6667 |
| VANGL2 AND NOT-IL1R1 | Oligodendroglioma | 0.8571 | 0.9231 | 0.8 | MUC16 AND NOT-SCN4B | Ovarian | 0.6667 | 0.6667 | 0.6667 |
| VANGL2 AND NOT-SGMS2 | Oligodendroglioma | 0.8571 | 0.9231 | 0.8 | KCNK15 AND NOT-SSTR1 | Ovarian | 0.6667 | 0.6 | 0.75 |
| PCDHGC3 AND NOT-EMP2 | Oligodendroglioma | 0.8462 | 1 | 0.7333 | MUC16 AND NOT-SLC16A7 | Ovarian | 0.8 | 1 | 0.6667 |
| KCNK15 AND NOT-BMP2 | Ovarian | 0.96 | 0.9231 | 1 | MUC16 AND NOT-AQP5 | Ovarian | 0.7273 | 0.8 | 0.6667 |
| KCNK15 AND NOT-SLC31A2 | Ovarian | 0.96 | 0.9231 | 1 | MUC16 AND NOT-CYP4F12 | Ovarian | 0.7273 | 0.8 | 0.6667 |
| KCNK15 AND NOT-CAV1 | Ovarian | 0.96 | 0.9231 | 1 | MUC16 AND NOT-CAV2 | Ovarian | 0.7368 | 1 | 0.5833 |
| KCNK15 AND NOT-TSPAN5 | Ovarian | 0.9231 | 0.8571 | 1 | KCNK15 AND NOT-ULBP1 | Ovarian | 0.6429 | 0.5625 | 0.75 |
| KCNK15 AND NOT-DSC3 | Ovarian | 0.96 | 0.9231 | 1 | MUC16 AND NOT-ASPH | Ovarian | 0.6667 | 0.6667 | 0.6667 |
| KCNK15 AND NOT-SLC16A7 | Ovarian | 1 | 1 | 1 | MUC16 AND NOT-KCNK1 | Ovarian | 0.64 | 0.6154 | 0.6667 |
| KCNK15 AND NOT-AQP9 | Ovarian | 0.9231 | 0.8571 | 1 | MUC16 AND NOT-CYB5R1 | Ovarian | 0.64 | 0.6154 | 0.6667 |
| KCNK15 AND NOT-KCNJ8 | Ovarian | 0.96 | 0.9231 | 1 | MUC16 AND NOT-LRMP | Ovarian | 0.64 | 0.6154 | 0.6667 |
| KCNK15 AND NOT-SFRP1 | Ovarian | 0.96 | 0.9231 | 1 | MUC16 AND NOT-SLC31A2 | Ovarian | 0.64 | 0.6154 | 0.6667 |
| KCNK15 AND NOT-ATP10D | Ovarian | 0.9167 | 0.9167 | 0.9167 | OR51E2 AND NOT-KDR | Prostate | 1 | 1 | 1 |
| KCNK15 AND NOT-MARCO | Ovarian | 0.9167 | 0.9167 | 0.9167 | OR51E2 AND NOT-AXL | Prostate | 0.8889 | 0.8 | 1 |
| KCNK15 AND NOT-PMP22 | Ovarian | 0.96 | 0.9231 | 1 | OR51E2 AND NOT-TNC | Prostate | 0.8889 | 0.8 | 1 |
| KCNK15 AND NOT-PARM1 | Ovarian | 0.88 | 0.8462 | 0.9167 | OR51E2 AND NOT-CSPG4 | Prostate | 0.8889 | 0.8 | 1 |
| KCNK15 AND NOT-ABCA8 | Ovarian | 0.88 | 0.8462 | 0.9167 | OR51E2 AND NOT-ST8SIA1 | Prostate | 0.8889 | 0.8 | 1 |
| KCNK15 AND NOT-FCGR3B | Ovarian | 0.96 | 0.9231 | 1 | OR51E2 AND NOT-TNFRSF17 | Prostate | 0.8889 | 0.8 | 1 |
| KCNK15 AND NOT-STX8 | Ovarian | 0.96 | 0.9231 | 1 | OR51E2 AND NOT-CLDN5 | Prostate | 0.8889 | 0.8 | 1 |
| KCNK15 AND NOT-TNFSF13B | Ovarian | 0.96 | 0.9231 | 1 | OR51E2 AND NOT-ITGB6 | Prostate | 0.8889 | 0.8 | 1 |
| KCNK15 AND NOT-LYVE1 | Ovarian | 0.8889 | 0.8 | 1 | OR51E2 AND NOT-DKK1 | Prostate | 0.8889 | 0.8 | 1 |
| KCNK15 AND NOT-LPAR5 | Ovarian | 0.9231 | 0.8571 | 1 | OR51E2 AND NOT-SLAMF7 | Prostate | 0.8889 | 0.8 | 1 |
| KCNK15 AND NOT-PTGER3 | Ovarian | 0.8889 | 0.8 | 1 | OR51E2 AND NOT-CLDN1 | Prostate | 0.8889 | 0.8 | 1 |
| KCNK15 AND NOT-ABHD6 | Ovarian | 0.8696 | 0.9091 | 0.8333 | OR51E2 AND NOT-MUC16 | Prostate | 0.8889 | 0.8 | 1 |
| KCNK15 AND NOT-AQP1 | Ovarian | 1 | 1 | 1 | OR51E2 AND NOT-CD33 | Prostate | 0.8889 | 0.8 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| KCNK15 AND NOT-HAS1 | Ovarian | 0.8696 | 0.9091 | 0.8333 | OR51E2 AND NOT-CD72 | Prostate | 0.8889 | 0.8 | 1 |
| KCNK15 AND NOT-CXCR2 | Ovarian | 0.8696 | 0.9091 | 0.8333 | OR51E2 AND NOT-CD79B | Prostate | 0.8889 | 0.8 | 1 |
| KCNK15 AND NOT-EMB | Ovarian | 0.8889 | 0.8 | 1 | STEAP2 AND NOT-SLC52A3 | Prostate | 0.8889 | 0.8 | 1 |
| KCNK15 AND NOT-JAM3 | Ovarian | 0.9231 | 0.8571 | 1 | STEAP2 AND NOT-FZD1 | Prostate | 0.8889 | 0.8 | 1 |
| KCNK15 AND NOT-IL22RA1 | Ovarian | 0.9167 | 0.9167 | 0.9167 | OR51E2 AND NOT-CD180 | Prostate | 0.8889 | 0.8 | 1 |
| KCNK15 AND NOT-PTPRZ1 | Ovarian | 0.96 | 0.9231 | 1 | OR51E2 AND NOT-MOK | Prostate | 0.8889 | 0.8 | 1 |
| KCNK15 AND NOT-LRFN5 | Ovarian | 0.8571 | 0.75 | 1 | STEAP2 AND NOT-FADS2 | Prostate | 0.8889 | 0.8 | 1 |
| KCNK15 AND NOT-TNFSF12 | Ovarian | 0.8571 | 1 | 0.75 | OR51E2 AND NOT-LGR5 | Prostate | 0.8889 | 0.8 | 1 |
| KCNK15 AND NOT-PTGDR | Ovarian | 0.8571 | 0.75 | 1 | OR51E2 AND NOT-L1CAM | Prostate | 0.8889 | 0.8 | 1 |
| KCNK15 AND NOT-STIM2 | Ovarian | 0.8571 | 0.75 | 1 | OR51E2 AND NOT-SLC34A2 | Prostate | 0.8889 | 0.8 | 1 |
| KCNK15 AND NOT-ADRA2A | Ovarian | 0.8571 | 0.75 | 1 | OR51E2 AND NOT-MST1R | Prostate | 0.8889 | 0.8 | 1 |
| KCNK15 AND NOT-TMEM150C | Ovarian | 0.8571 | 0.75 | 1 | OR51E2 AND NOT-HLA-DOB | Prostate | 0.8889 | 0.8 | 1 |
| KCNK15 AND NOT-CNIH3 | Ovarian | 0.8571 | 0.75 | 1 | OR51E2 AND NOT-IGF1R | Prostate | 0.8889 | 0.8 | 1 |
| KCNK15 AND NOT-PPAP2A | Ovarian | 0.8571 | 0.75 | 1 | OR51E2 AND NOT-IL11RA | Prostate | 0.8889 | 0.8 | 1 |
| KCNK15 AND NOT-SLC9A9 | Ovarian | 0.8889 | 0.8 | 1 | OR51E2 AND NOT-CLDN11 | Prostate | 0.8889 | 0.8 | 1 |
| KCNK15 AND NOT-DDR2 | Ovarian | 0.9231 | 0.8571 | 1 | OR51E2 AND NOT-FOLR1 | Prostate | 0.8889 | 0.8 | 1 |
| KCNK15 AND NOT-CSF2RB | Ovarian | 0.8696 | 0.9091 | 0.8333 | OR51E2 AND NOT-MUC1 | Prostate | 0.8889 | 0.8 | 1 |
| KCNK15 AND NOT-IL6ST | Ovarian | 0.8889 | 0.8 | 1 | STEAP2 AND NOT-SLC2A5 | Prostate | 1 | 1 | 1 |
| KCNK15 AND NOT-C10orf54 | Ovarian | 1 | 1 | 1 | OR51E2 AND NOT-MUC4 | Prostate | 0.8889 | 0.8 | 1 |
| KCNK15 AND NOT-SDC2 | Ovarian | 0.8571 | 0.75 | 1 | OR51E2 AND NOT-VTCN1 | Prostate | 0.8889 | 0.8 | 1 |
| KCNK15 AND NOT-ITM2A | Ovarian | 0.96 | 0.9231 | 1 | OR51E2 AND NOT-CEACAM6 | Prostate | 0.8889 | 0.8 | 1 |
| KCNK15 AND NOT-CMKLR1 | Ovarian | 0.9091 | 1 | 0.8333 | STEAP2 AND NOT-PRRT2 | Prostate | 0.8571 | 1 | 0.75 |
| KCNK15 AND NOT-SELL | Ovarian | 0.9167 | 0.9167 | 0.9167 | OR51E1 AND NOT-CSPG4 | Prostate | 0.8571 | 1 | 0.75 |
| KCNK15 AND NOT-CLEC10A | Ovarian | 0.8462 | 0.7857 | 0.9167 | STEAP2 AND NOT-SGCD | Prostate | 1 | 1 | 1 |
| KCNK15 AND NOT-SLC51A | Ovarian | 0.8462 | 0.7857 | 0.9167 | OR51E2 AND NOT-PMEL | Prostate | 0.8571 | 1 | 0.75 |
| KCNK15 AND NOT-PDPN | Ovarian | 0.8571 | 0.75 | 1 | STEAP2 AND NOT-PCDH9 | Prostate | 0.8571 | 1 | 0.75 |
| KCNK15 AND NOT-AMICA1 | Ovarian | 0.9167 | 0.9167 | 0.9167 | STEAP2 AND NOT-PTPRF | Prostate | 0.8571 | 1 | 0.75 |
| KCNK15 AND NOT-NAALADL1 | Ovarian | 0.8462 | 0.7857 | 0.9167 | STEAP2 AND NOT-IL6ST | Prostate | 0.8571 | 1 | 0.75 |
| KCNK15 AND NOT-TLR2 | Ovarian | 0.96 | 0.9231 | 1 | STEAP2 AND NOT-KCNK3 | Prostate | 0.8571 | 1 | 0.75 |
| KCNK15 AND NOT-ACSL1 | Ovarian | 0.96 | 0.9231 | 1 | OR51E2 AND NOT-DPEP1 | Prostate | 0.8571 | 1 | 0.75 |
| KCNK15 AND NOT-DST | Ovarian | 0.8889 | 0.8 | 1 | OR51E2 AND NOT-ITGB3 | Prostate | 0.8571 | 1 | 0.75 |
| KCNK15 AND NOT-P2RY14 | Ovarian | 0.9167 | 0.9167 | 0.9167 | OR51E2 AND NOT-B4GALNT1 | Prostate | 0.8571 | 1 | 0.75 |
| KCNK15 AND NOT-EMCN | Ovarian | 0.9231 | 0.8571 | 1 | OR51E1 AND NOT-CLDN5 | Prostate | 0.8571 | 1 | 0.75 |
| KCNK15 AND NOT-LPAR1 | Ovarian | 1 | 1 | 1 | OR51E2 AND NOT-CXCR5 | Prostate | 0.8889 | 0.8 | 1 |
| KCNK15 AND NOT-ITGAM | Ovarian | 0.96 | 0.9231 | 1 | OR51E2 AND NOT-CEACAM5 | Prostate | 0.8889 | 0.8 | 1 |
| KCNK15 AND NOT-C3AR1 | Ovarian | 0.96 | 0.9231 | 1 | OR51E2 AND NOT-SSTR3 | Prostate | 0.8889 | 0.8 | 1 |
| KCNK15 AND NOT-FPR1 | Ovarian | 1 | 1 | 1 | OR51E2 AND NOT-AFP | Prostate | 0.8889 | 0.8 | 1 |
| KCNK15 AND NOT-KIT | Ovarian | 0.96 | 0.9231 | 1 | OR51E2 AND NOT-CA9 | Prostate | 0.8889 | 0.8 | 1 |
| KCNK15 AND NOT-APH1B | Ovarian | 0.9231 | 0.8571 | 1 | OR51E2 AND NOT-SSTR4 | Prostate | 0.8889 | 0.8 | 1 |
| KCNK15 AND NOT-PCDH17 | Ovarian | 0.8333 | 0.8333 | 0.8333 | OR51E2 AND NOT-CR2 | Prostate | 0.8889 | 0.8 | 1 |
| KCNK15 AND NOT-IL7R | Ovarian | 0.96 | 0.9231 | 1 | OR51E2 AND NOT-SSX1 | Prostate | 0.8889 | 0.8 | 1 |
| KCNK15 AND NOT-CCR1 | Ovarian | 0.9167 | 0.9167 | 0.9167 | OR51E2 AND NOT-ROR1 | Prostate | 0.8889 | 0.8 | 1 |
| KCNK15 AND NOT-JAM2 | Ovarian | 0.9091 | 1 | 0.8333 | OR51E2 AND NOT-BCAN | Prostate | 0.8889 | 0.8 | 1 |
| KCNK15 AND NOT-SULF2 | Ovarian | 0.8276 | 0.7059 | 1 | OR51E2 AND NOT-DNAJB8 | Prostate | 0.8889 | 0.8 | 1 |
| KCNK15 AND NOT-RECK | Ovarian | 0.8276 | 0.7059 | 1 | OR51E2 AND NOT-DLL3 | Prostate | 0.8889 | 0.8 | 1 |
| KCNK15 AND NOT-CNST | Ovarian | 0.8276 | 0.7059 | 1 | OR51E2 AND NOT-SSTR2 | Prostate | 0.8889 | 0.8 | 1 |
| KCNK15 AND NOT-COLEC12 | Ovarian | 0.8276 | 0.7059 | 1 | OR51E2 AND NOT-VCAM1 | Prostate | 0.8889 | 0.8 | 1 |
| KCNK15 AND NOT-STX7 | Ovarian | 0.8276 | 0.7059 | 1 | OR51E2 AND NOT-SSTR1 | Prostate | 0.8889 | 0.8 | 1 |
| KCNK15 AND NOT-SEMA5A | Ovarian | 0.8276 | 0.7059 | 1 | OR51E2 AND NOT-SST | Prostate | 0.8889 | 0.8 | 1 |
| KCNK15 AND NOT-SLC41A2 | Ovarian | 0.8276 | 0.7059 | 1 | OR51E2 AND NOT-FCRL2 | Prostate | 0.8889 | 0.8 | 1 |
| KCNK15 AND NOT-BDKRB1 | Ovarian | 0.8276 | 0.7059 | 1 | OR51E2 AND NOT-GAGE1 | Prostate | 0.8889 | 0.8 | 1 |
| KCNK15 AND NOT-STX2 | Ovarian | 0.8276 | 0.7059 | 1 | OR51E2 AND NOT-CLDN4 | Prostate | 0.8889 | 0.8 | 1 |
| KCNK15 AND NOT-NT5E | Ovarian | 0.8276 | 0.7059 | 1 | OR51E2 AND NOT-IL2RA | Prostate | 0.8889 | 0.8 | 1 |
| KCNK15 AND NOT-PROS1 | Ovarian | 0.8276 | 0.7059 | 1 | OR51E2 AND NOT-TNFRSF13C | Prostate | 0.8889 | 0.8 | 1 |
| KCNK15 AND NOT-CAV2 | Ovarian | 0.8276 | 0.7059 | 1 | OR51E2 AND NOT-ABCB5 | Prostate | 0.8889 | 0.8 | 1 |
| KCNK15 AND NOT-HMOX1 | Ovarian | 0.8889 | 0.8 | 1 | OR51E2 AND NOT-WT1 | Prostate | 0.8889 | 0.8 | 1 |
| KCNK15 AND NOT-BDKRB2 | Ovarian | 0.8696 | 0.9091 | 0.8333 | OR51E2 AND NOT-BIRC5 | Prostate | 0.8889 | 0.8 | 1 |
| KCNK15 AND NOT-PDGFRA | Ovarian | 0.96 | 0.9231 | 1 | OR51E2 AND NOT-ULBP3 | Prostate | 0.8889 | 0.8 | 1 |
| KCNK15 AND NOT-HCST | Ovarian | 0.88 | 0.8462 | 0.9167 | OR51E2 AND NOT-CTAG2 | Prostate | 0.8889 | 0.8 | 1 |
| KCNK15 AND NOT-FPR2 | Ovarian | 0.88 | 0.8462 | 0.9167 | OR51E2 AND NOT-SEMA5B | Prostate | 0.8889 | 0.8 | 1 |
| KCNK15 AND NOT-ATP8B4 | Ovarian | 0.8333 | 0.8333 | 0.8333 | OR51E2 AND NOT-GUCY2C | Prostate | 0.8889 | 0.8 | 1 |
| KCNK15 AND NOT-HVCN1 | Ovarian | 0.8276 | 0.7059 | 1 | OR51E2 AND NOT-GPA33 | Prostate | 0.8889 | 0.8 | 1 |
| KCNK15 AND NOT-VAMP5 | Ovarian | 0.8889 | 0.8 | 1 | OR51E2 AND NOT-RAET1E | Prostate | 0.8889 | 0.8 | 1 |
| KCNK15 AND NOT-GPR34 | Ovarian | 0.8276 | 0.7059 | 1 | OR51E2 AND NOT-MSLN | Prostate | 0.8889 | 0.8 | 1 |
| KCNK15 AND NOT-VNN2 | Ovarian | 0.8889 | 0.8 | 1 | OR51E2 AND NOT-THY1 | Prostate | 0.8889 | 0.8 | 1 |
| KCNK15 AND NOT-PTPRO | Ovarian | 0.8571 | 0.75 | 1 | OR51E2 AND NOT-CD52 | Prostate | 0.8889 | 0.8 | 1 |
| KCNK15 AND NOT-LRRTM2 | Ovarian | 0.9565 | 1 | 0.9167 | STEAP2 AND NOT-KL | Prostate | 0.8571 | 1 | 0.75 |
| KCNK15 AND NOT-VSTM4 | Ovarian | 0.88 | 0.8462 | 0.9167 | OR51E2 AND NOT-TYR | Prostate | 0.8889 | 0.8 | 1 |
| KCNK15 AND NOT-C5AR1 | Ovarian | 0.9565 | 1 | 0.9167 | OR51E2 AND NOT-FCRL5 | Prostate | 0.8889 | 0.8 | 1 |
| KCNK15 AND NOT-GLIPR1 | Ovarian | 0.96 | 0.9231 | 1 | OR51E2 AND NOT-CD22 | Prostate | 0.8889 | 0.8 | 1 |
| KCNK15 AND NOT-HEPH | Ovarian | 0.8571 | 1 | 0.75 | STEAP2 AND NOT-ANTXR1 | Prostate | 0.8571 | 1 | 0.75 |
| KCNK15 AND NOT-VAMP7 | Ovarian | 0.8571 | 0.75 | 1 | OR51E2 AND NOT-ULBP2 | Prostate | 0.8889 | 0.8 | 1 |
| KCNK15 AND NOT-ENPP2 | Ovarian | 0.96 | 0.9231 | 1 | STEAP2 AND NOT-IL6R | Prostate | 0.8571 | 1 | 0.75 |
| KCNK15 AND NOT-CD53 | Ovarian | 0.96 | 0.9231 | 1 | OR51E2 AND NOT-CLDN7 | Prostate | 0.8889 | 0.8 | 1 |
| KCNK15 AND NOT-GPR171 | Ovarian | 0.96 | 0.9231 | 1 | OR51E2 AND NOT-CD79A | Prostate | 0.8889 | 0.8 | 1 |
| OR51E2 AND NOT-LSAMP | Prostate | 1 | 1 | 1 | OR51E2 AND NOT-CD70 | Prostate | 0.8889 | 0.8 | 1 |
| OR51E2 AND NOT-SGCD | Prostate | 1 | 1 | 1 | OR51E2 AND NOT-CD37 | Prostate | 0.8889 | 0.8 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| OR51E2 AND NOT-SLC2A5 | Prostate | 1 | 1 | 1 | OR51E2 AND NOT-TNFRSF8 | Prostate | 0.8889 | 0.8 | 1 |
| OR51E2 AND NOT-ACE | Prostate | 1 | 1 | 1 | OR51E2 AND NOT-MS4A1 | Prostate | 0.8889 | 0.8 | 1 |
| OR51E2 AND NOT-SI | Prostate | 1 | 1 | 1 | ADAM12 AND NOT-ERBB3 | Sarcoma | 0.8333 | 0.7895 | 0.8824 |
| OR51E2 AND NOT-DAGLA | Prostate | 1 | 1 | 1 | FAP AND NOT-SLC8A1 | Sarcoma | 0.8276 | 1 | 0.7059 |
| OR51E2 AND NOT-CDH6 | Prostate | 0.8889 | 0.8 | 1 | FAP AND NOT-SLC25A4 | Sarcoma | 0.8276 | 1 | 0.7059 |
| OR51E2 AND NOT-TSPAN11 | Prostate | 0.8889 | 0.8 | 1 | FAP AND NOT-TSPAN12 | Sarcoma | 0.8276 | 1 | 0.7059 |
| OR51E2 AND NOT-STX2 | Prostate | 0.8889 | 0.8 | 1 | FAP AND NOT-ABCB1 | Sarcoma | 0.8667 | 1 | 0.7647 |
| OR51E2 AND NOT-SDC3 | Prostate | 0.8889 | 0.8 | 1 | FAP AND NOT-SCN7A | Sarcoma | 0.8667 | 1 | 0.7647 |
| OR51E2 AND NOT-CD69 | Prostate | 0.8889 | 0.8 | 1 | FAP AND NOT-SCN3A | Sarcoma | 0.8276 | 1 | 0.7059 |
| OR51E2 AND NOT-GPR65 | Prostate | 0.8889 | 0.8 | 1 | FAP AND NOT-SLMAP | Sarcoma | 0.8667 | 1 | 0.7647 |
| OR51E2 AND NOT-SLC5A4 | Prostate | 0.8889 | 0.8 | 1 | FAP AND NOT-SLC4A3 | Sarcoma | 0.8667 | 1 | 0.7647 |
| OR51E2 AND NOT-GPR87 | Prostate | 0.8889 | 0.8 | 1 | FAP AND NOT-NAALAD2 | Sarcoma | 0.8276 | 1 | 0.7059 |
| OR51E2 AND NOT-FAT4 | Prostate | 0.8889 | 0.8 | 1 | FAP AND NOT-PRIMA1 | Sarcoma | 0.8276 | 1 | 0.7059 |
| OR51E2 AND NOT-TMEM67 | Prostate | 0.8889 | 0.8 | 1 | FAP AND NOT-NPY1R | Sarcoma | 0.8276 | 1 | 0.7059 |
| OR51E2 AND NOT-CD1C | Prostate | 0.8889 | 0.8 | 1 | FAP AND NOT-SIGLEC6 | Sarcoma | 0.8667 | 1 | 0.7647 |
| OR51E2 AND NOT-SLC5A3 | Prostate | 0.8889 | 0.8 | 1 | FAP AND NOT-PRLR | Sarcoma | 0.8276 | 1 | 0.7059 |
| OR51E2 AND NOT-MYOF | Prostate | 0.8889 | 0.8 | 1 | FAP AND NOT-MRAP2 | Sarcoma | 0.8276 | 1 | 0.7059 |
| OR51E2 AND NOT-SV2B | Prostate | 0.8889 | 0.8 | 1 | ADAM12 AND NOT-RNF43 | Sarcoma | 0.8421 | 0.7619 | 0.9412 |
| OR51E2 AND NOT-LPAR3 | Prostate | 0.8889 | 0.8 | 1 | FAP AND NOT-SLC2A12 | Sarcoma | 0.7857 | 1 | 0.6471 |
| OR51E2 AND NOT-KCNE4 | Prostate | 0.8889 | 0.8 | 1 | FAP AND NOT-EMCN | Sarcoma | 0.7857 | 1 | 0.6471 |
| OR51E2 AND NOT-CEACAM1 | Prostate | 0.8889 | 0.8 | 1 | FAP AND NOT-BCAM | Sarcoma | 0.7857 | 1 | 0.6471 |
| OR51E2 AND NOT-BMP2 | Prostate | 0.8889 | 0.8 | 1 | FAP AND NOT-PCDH20 | Sarcoma | 0.7857 | 1 | 0.6471 |
| OR51E2 AND NOT-CHL1 | Prostate | 0.8889 | 0.8 | 1 | FAP AND NOT-TSPAN2 | Sarcoma | 0.7857 | 1 | 0.6471 |
| OR51E2 AND NOT-SLC23A1 | Prostate | 0.8889 | 0.8 | 1 | FAP AND NOT-KCNMB1 | Sarcoma | 0.7857 | 1 | 0.6471 |
| OR51E2 AND NOT-TM7SF3 | Prostate | 0.8889 | 0.8 | 1 | FAP AND NOT-PARM1 | Sarcoma | 0.7857 | 1 | 0.6471 |
| OR51E2 AND NOT-DUOXA1 | Prostate | 1 | 1 | 1 | FAP AND NOT-PLA2R1 | Sarcoma | 0.7857 | 1 | 0.6471 |
| OR51E2 AND NOT-CLCA4 | Prostate | 0.8889 | 0.8 | 1 | FAP AND NOT-SLCO2A1 | Sarcoma | 0.7857 | 1 | 0.6471 |
| OR51E2 AND NOT-LEPR | Prostate | 0.8889 | 0.8 | 1 | FAP AND NOT-HTR2B | Sarcoma | 0.7857 | 1 | 0.6471 |
| ANO7 AND NOT-CAV1 | Prostate | 0.8889 | 0.8 | 1 | FAP AND NOT-SLC3A1 | Sarcoma | 0.7857 | 1 | 0.6471 |
| OR51E2 AND NOT-ADCY3 | Prostate | 0.8889 | 0.8 | 1 | FAP AND NOT-GDPD2 | Sarcoma | 0.8667 | 1 | 0.7647 |
| ANO7 AND NOT-ATP1A2 | Prostate | 0.8889 | 0.8 | 1 | FAP AND NOT-CDH3 | Sarcoma | 0.7857 | 1 | 0.6471 |
| OR51E2 AND NOT-ITGB5 | Prostate | 0.8889 | 0.8 | 1 | FAP AND NOT-TSPAN7 | Sarcoma | 0.8667 | 1 | 0.7647 |
| OR51E2 AND NOT-SGCA | Prostate | 0.8889 | 0.8 | 1 | FAP AND NOT-GPM6A | Sarcoma | 0.8276 | 1 | 0.7059 |
| OR51E2 AND NOT-SLC47A1 | Prostate | 0.8889 | 0.8 | 1 | ADAM12 AND NOT-PROM1 | Sarcoma | 0.8095 | 0.68 | 1 |
| OR51E2 AND NOT-PRPH2 | Prostate | 0.8889 | 0.8 | 1 | FAP AND NOT-CLSTN2 | Sarcoma | 0.8276 | 1 | 0.7059 |
| OR51E2 AND NOT-LRFN4 | Prostate | 0.8889 | 0.8 | 1 | OSMR AND NOT-FOLR1 | Sarcoma | 0.8387 | 0.9286 | 0.7647 |
| OR51E2 AND NOT-TRPM6 | Prostate | 0.8889 | 0.8 | 1 | FAP AND NOT-CACNA1D | Sarcoma | 0.8667 | 1 | 0.7647 |
| OR51E2 AND NOT-NKG7 | Prostate | 0.8889 | 0.8 | 1 | FAP AND NOT-KCNQ4 | Sarcoma | 0.8667 | 1 | 0.7647 |
| OR51E2 AND NOT-WDR19 | Prostate | 0.8889 | 0.8 | 1 | FAP AND NOT-KCNC4 | Sarcoma | 0.8276 | 1 | 0.7059 |
| OR51E2 AND NOT-GGT7 | Prostate | 0.8889 | 0.8 | 1 | FAP AND NOT-SLC6A2 | Sarcoma | 0.7857 | 1 | 0.6471 |
| OR51E2 AND NOT-SEMA4F | Prostate | 0.8889 | 0.8 | 1 | FAP AND NOT-SLC8A2 | Sarcoma | 0.8276 | 1 | 0.7059 |
| OR51E2 AND NOT-SLC38A4 | Prostate | 0.8889 | 0.8 | 1 | FAP AND NOT-CD9 | Sarcoma | 0.7857 | 1 | 0.6471 |
| OR51E2 AND NOT-LRRC8A | Prostate | 0.8889 | 0.8 | 1 | FAP AND NOT-ATP7B | Sarcoma | 0.8667 | 1 | 0.7647 |
| OR51E2 AND NOT-PMEPA1 | Prostate | 0.8889 | 0.8 | 1 | FAP AND NOT-P2RX1 | Sarcoma | 0.7857 | 1 | 0.6471 |
| OR51E2 AND NOT-ITGA2 | Prostate | 0.8889 | 0.8 | 1 | FAP AND NOT-TACR1 | Sarcoma | 0.7857 | 1 | 0.6471 |
| OR51E2 AND NOT-ATP1A2 | Prostate | 0.8889 | 0.8 | 1 | FAP AND NOT-PCDHA10 | Sarcoma | 0.8276 | 1 | 0.7059 |
| OR51E2 AND NOT-ADRB1 | Prostate | 0.8889 | 0.8 | 1 | FAP AND NOT-PERP | Sarcoma | 0.7857 | 1 | 0.6471 |
| OR51E2 AND NOT-CELSR2 | Prostate | 0.8889 | 0.8 | 1 | FAP AND NOT-SLC6A16 | Sarcoma | 0.7857 | 1 | 0.6471 |
| OR51E2 AND NOT-ENPP2 | Prostate | 0.8889 | 0.8 | 1 | FAP AND NOT-SGCA | Sarcoma | 0.8276 | 1 | 0.7059 |
| OR51E2 AND NOT-FCGRT | Prostate | 0.8889 | 0.8 | 1 | FAP AND NOT-JPH2 | Sarcoma | 0.8667 | 1 | 0.7647 |
| ANO7 AND NOT-FADS2 | Prostate | 0.8889 | 0.8 | 1 | FAP AND NOT-TACSTD2 | Sarcoma | 0.7857 | 1 | 0.6471 |
| OR51E2 AND NOT-SLC18A2 | Prostate | 0.8889 | 0.8 | 1 | FAP AND NOT-VIPR2 | Sarcoma | 0.7857 | 1 | 0.6471 |
| OR51E2 AND NOT-DNAJC5 | Prostate | 0.8889 | 0.8 | 1 | OSMR AND NOT-ITGB6 | Sarcoma | 0.7586 | 0.9167 | 0.6471 |
| OR51E2 AND NOT-PANX1 | Prostate | 0.8889 | 0.8 | 1 | FAP AND NOT-PTPRS | Sarcoma | 0.7857 | 1 | 0.6471 |
| OR51E2 AND NOT-TENM2 | Prostate | 0.8889 | 0.8 | 1 | FAP AND NOT-PIGR | Sarcoma | 0.8276 | 1 | 0.7059 |
| OR51E2 AND NOT-SLC52A3 | Prostate | 0.8889 | 0.8 | 1 | FAP AND NOT-KCNH2 | Sarcoma | 0.7857 | 1 | 0.6471 |
| OR51E2 AND NOT-SLC8A1 | Prostate | 0.8889 | 0.8 | 1 | FAP AND NOT-ATP1B2 | Sarcoma | 0.7857 | 1 | 0.6471 |
| ANO7 AND NOT-SLC52A3 | Prostate | 0.8889 | 0.8 | 1 | FAP AND NOT-TRPC4 | Sarcoma | 0.8667 | 1 | 0.7647 |
| OR51E2 AND NOT-SHISA6 | Prostate | 0.8889 | 0.8 | 1 | FAP AND NOT-SLC47A1 | Sarcoma | 0.7857 | 1 | 0.6471 |
| ANO7 AND NOT-LSAMP | Prostate | 1 | 1 | 1 | FAP AND NOT-CXADR | Sarcoma | 0.7857 | 1 | 0.6471 |
| OR51E2 AND NOT-SLC16A14 | Prostate | 0.8889 | 0.8 | 1 | FAP AND NOT-GPR162 | Sarcoma | 0.7857 | 1 | 0.6471 |
| OR51E2 AND NOT-STX4 | Prostate | 0.8889 | 0.8 | 1 | ADAM12 AND NOT-ITGB6 | Sarcoma | 0.8235 | 0.8235 | 0.8235 |
| OR51E2 AND NOT-AQP1 | Prostate | 0.8889 | 0.8 | 1 | FAP AND NOT-NTRK3 | Sarcoma | 0.7857 | 1 | 0.6471 |
| OR51E2 AND NOT-SLC24A3 | Prostate | 0.8889 | 0.8 | 1 | FAP AND NOT-GPR37 | Sarcoma | 0.8667 | 1 | 0.7647 |
| OR51E2 AND NOT-SEMA6D | Prostate | 0.8889 | 0.8 | 1 | FAP AND NOT-KCNB1 | Sarcoma | 0.8276 | 1 | 0.7059 |
| OR51E2 AND NOT-DAGLB | Prostate | 0.8889 | 0.8 | 1 | FAP AND NOT-ITM2B | Sarcoma | 0.7857 | 1 | 0.6471 |
| OR51E2 AND NOT-SDC4 | Prostate | 0.8889 | 0.8 | 1 | FAP AND NOT-ZDHHC21 | Sarcoma | 0.8276 | 1 | 0.7059 |
| OR51E2 AND NOT-ADRA2C | Prostate | 0.8889 | 0.8 | 1 | FAP AND NOT-MCHR1 | Sarcoma | 0.8276 | 1 | 0.7059 |
| OR51E2 AND NOT-CAV2 | Prostate | 0.8889 | 0.8 | 1 | FAP AND NOT-RAMP1 | Sarcoma | 0.7857 | 1 | 0.6471 |
| OR51E2 AND NOT-SLC6A16 | Prostate | 0.8889 | 0.8 | 1 | FAP AND NOT-NAALADL1 | Sarcoma | 0.7857 | 1 | 0.6471 |
| OR51E2 AND NOT-CTSZ | Prostate | 0.8889 | 0.8 | 1 | FAP AND NOT-ART4 | Sarcoma | 0.7857 | 1 | 0.6471 |
| OR51E2 AND NOT-EMP2 | Prostate | 0.8889 | 0.8 | 1 | FAP AND NOT-ADCY4 | Sarcoma | 0.8276 | 1 | 0.7059 |
| OR51E2 AND NOT-CYP4F2 | Prostate | 1 | 1 | 1 | FAP AND NOT-ISLR2 | Sarcoma | 0.7857 | 1 | 0.6471 |
| OR51E2 AND NOT-BCAM | Prostate | 0.8889 | 0.8 | 1 | FAP AND NOT-KCNN2 | Sarcoma | 0.7857 | 1 | 0.6471 |
| OR51E2 AND NOT-JPH1 | Prostate | 0.8889 | 0.8 | 1 | FAP AND NOT-DPP6 | Sarcoma | 0.8276 | 1 | 0.7059 |
| OR51E2 AND NOT-ABHD6 | Prostate | 0.8889 | 0.8 | 1 | FAP AND NOT-SLC27A5 | Sarcoma | 0.8276 | 1 | 0.7059 |
| OR51E2 AND NOT-VAMP1 | Prostate | 0.8889 | 0.8 | 1 | OSMR AND NOT-RNF43 | Sarcoma | 0.7586 | 0.9167 | 0.6471 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| OR51E2 AND NOT-ATP10A | Prostate | 0.8889 | 0.8 | 1 | OSMR AND NOT-EDNRB | Sarcoma | 0.875 | 0.9333 | 0.8235 |
| OR51E2 AND NOT-NRSN2 | Prostate | 0.8889 | 0.8 | 1 | FAP AND NOT-NLGN3 | Sarcoma | 0.8276 | 1 | 0.7059 |
| OR51E2 AND NOT-FAM57A | Prostate | 0.8889 | 0.8 | 1 | FAP AND NOT-ABCG2 | Sarcoma | 0.7857 | 1 | 0.6471 |
| OR51E2 AND NOT-TMEM97 | Prostate | 0.8889 | 0.8 | 1 | FAP AND NOT-CD101 | Sarcoma | 0.8667 | 1 | 0.7647 |
| OR51E2 AND NOT-DLL1 | Prostate | 0.8889 | 0.8 | 1 | FAP AND NOT-DIO3 | Sarcoma | 0.7857 | 1 | 0.6471 |
| ADAM12 AND NOT-CDH1 | Sarcoma | 0.8333 | 0.7895 | 0.8824 | FAP AND NOT-ADRA2A | Sarcoma | 0.7857 | 1 | 0.6471 |
| OSMR AND NOT-SCN7A | Sarcoma | 0.9032 | 1 | 0.8235 | FAP AND NOT-MPZ | Sarcoma | 0.7857 | 1 | 0.6471 |
| OSMR AND NOT-F11R | Sarcoma | 0.875 | 0.9333 | 0.8235 | FAP AND NOT-TMEM123 | Sarcoma | 0.8667 | 1 | 0.7647 |
| ADAM12 AND NOT-F11R | Sarcoma | 0.9444 | 0.8947 | 1 | FAP AND NOT-TMEM198 | Sarcoma | 0.7857 | 1 | 0.6471 |
| DDR2 AND NOT-SLC25A4 | Sarcoma | 0.8276 | 1 | 0.7059 | FAP AND NOT-STYK1 | Sarcoma | 0.8276 | 1 | 0.7059 |
| ADAM12 AND NOT-LSR | Sarcoma | 0.8387 | 0.9286 | 0.7647 | FAP AND NOT-AVPR1A | Sarcoma | 0.8276 | 1 | 0.7059 |
| ADAM12 AND NOT-TACSTD2 | Sarcoma | 0.8333 | 0.7895 | 0.8824 | FAP AND NOT-CORIN | Sarcoma | 0.8667 | 1 | 0.7647 |
| SLC2A10 AND NOT-F11R | Sarcoma | 0.8276 | 1 | 0.7059 | FAP AND NOT-SLC26A10 | Sarcoma | 0.7857 | 1 | 0.6471 |
| OSMR AND NOT-CDH1 | Sarcoma | 0.8 | 0.9231 | 0.7059 | ADAM12 AND NOT-EPCAM | Sarcoma | 0.85 | 0.7391 | 1 |
| ADAM12 AND NOT-PARM1 | Sarcoma | 0.8108 | 0.75 | 0.8824 | FAP AND NOT-TMPRSS6 | Sarcoma | 0.7857 | 1 | 0.6471 |
| ADAM12 AND NOT-NAALAD2 | Sarcoma | 0.7805 | 0.6667 | 0.9412 | FAP AND NOT-SYT2 | Sarcoma | 0.8276 | 1 | 0.7059 |
| ADAM12 AND NOT-PERP | Sarcoma | 0.8 | 0.7778 | 0.8235 | FAP AND NOT-SLC6A5 | Sarcoma | 0.7407 | 1 | 0.5882 |
| ADAM12 AND NOT-FXYD3 | Sarcoma | 0.8333 | 0.7895 | 0.8824 | FAP AND NOT-MYADM | Sarcoma | 0.7407 | 1 | 0.5882 |
| OSMR AND NOT-TACSTD2 | Sarcoma | 0.7742 | 0.8571 | 0.7059 | FAP AND NOT-TSPAN8 | Sarcoma | 0.7407 | 1 | 0.5882 |
| ADAM12 AND NOT-SCN7A | Sarcoma | 0.7727 | 0.6296 | 1 | FAP AND NOT-SUSD3 | Sarcoma | 0.7407 | 1 | 0.5882 |
| ADAM12 AND NOT-ATP7B | Sarcoma | 0.8205 | 0.7273 | 0.9412 | FAP AND NOT-CNR1 | Sarcoma | 0.7407 | 1 | 0.5882 |
| DDR2 AND NOT-SCN7A | Sarcoma | 0.8 | 0.9231 | 0.7059 | FAP AND NOT-CELSR2 | Sarcoma | 0.7407 | 1 | 0.5882 |
| ADAM12 AND NOT-CLEC1A | Sarcoma | 0.8205 | 0.7273 | 0.9412 | CLDN18 AND NOT-SCNN1G | Stomach | 0.809 | 0.7826 | 0.8372 |
| OSMR AND NOT-FXYD3 | Sarcoma | 0.8 | 0.9231 | 0.7059 | CLDN18 AND NOT-SCNN1B | Stomach | 0.7912 | 0.75 | 0.8372 |
| DDR2 AND NOT-TSPAN7 | Sarcoma | 0.7586 | 0.9167 | 0.6471 | MUC13 AND NOT-BEST4 | Stomach | 0.8718 | 0.9714 | 0.7907 |
| OSMR AND NOT-BCAM | Sarcoma | 0.7586 | 0.9167 | 0.6471 | CLDN18 AND NOT-ABCA3 | Stomach | 0.7912 | 0.75 | 0.8372 |
| OSMR AND NOT-LSR | Sarcoma | 0.7586 | 0.9167 | 0.6471 | CLDN18 AND NOT-GPM6A | Stomach | 0.7865 | 0.7609 | 0.814 |
| DDR2 AND NOT-NAALAD2 | Sarcoma | 0.7586 | 0.9167 | 0.6471 | CLDN18 AND NOT-MARCO | Stomach | 0.7912 | 0.75 | 0.8372 |
| VMP1 AND NOT-F11R | Sarcoma | 0.875 | 0.9333 | 0.8235 | CLDN18 AND NOT-NPR3 | Stomach | 0.7692 | 0.8571 | 0.6977 |
| OSMR AND NOT-LRP5 | Sarcoma | 0.8276 | 1 | 0.7059 | MUC13 AND NOT-SLC51B | Stomach | 0.8831 | 1 | 0.7907 |
| ADAM12 AND NOT-TM7SF2 | Sarcoma | 0.7778 | 0.7368 | 0.8235 | CLDN18 AND NOT-CD300LG | Stomach | 0.7692 | 0.7292 | 0.814 |
| OSMR AND NOT-ABCB1 | Sarcoma | 0.875 | 0.9333 | 0.8235 | CLDN18 AND NOT-SGCG | Stomach | 0.8235 | 0.8333 | 0.814 |
| OSMR AND NOT-SLC19A3 | Sarcoma | 0.8485 | 0.875 | 0.8235 | CLDN18 AND NOT-ADRB2 | Stomach | 0.7674 | 0.7674 | 0.7674 |
| OSMR AND NOT-MUC15 | Sarcoma | 0.8387 | 0.9286 | 0.7647 | CLDN18 AND NOT-SLC6A4 | Stomach | 0.7674 | 0.7674 | 0.7674 |
| OSMR AND NOT-CRB3 | Sarcoma | 0.875 | 0.9333 | 0.8235 | CLDN18 AND NOT-CADM1 | Stomach | 0.7865 | 0.7609 | 0.814 |
| OSMR AND NOT-TMEM88 | Sarcoma | 0.7586 | 0.9167 | 0.6471 | CLDN18 AND NOT-EVA1A | Stomach | 0.766 | 0.7059 | 0.8372 |
| OSMR AND NOT-SCNN1B | Sarcoma | 0.875 | 0.9333 | 0.8235 | CLDN18 AND NOT-SLCO4C1 | Stomach | 0.766 | 0.7059 | 0.8372 |
| OSMR AND NOT-SPINT1 | Sarcoma | 0.875 | 0.9333 | 0.8235 | CLDN18 AND NOT-ADRB1 | Stomach | 0.7865 | 0.7609 | 0.814 |
| OSMR AND NOT-PCDH1 | Sarcoma | 0.8 | 0.9231 | 0.7059 | CLDN18 AND NOT-DUOX1 | Stomach | 0.7609 | 0.7143 | 0.814 |
| OSMR AND NOT-PARM1 | Sarcoma | 0.8387 | 0.9286 | 0.7647 | MUC13 AND NOT-SLC16A9 | Stomach | 0.9136 | 0.9737 | 0.8605 |
| OSMR AND NOT-CLEC1A | Sarcoma | 0.875 | 0.9333 | 0.8235 | CLDN18 AND NOT-SLC11A1 | Stomach | 0.7778 | 0.7447 | 0.814 |
| ADAM12 AND NOT-NRCAM | Sarcoma | 0.8 | 0.7778 | 0.8235 | CLDN18 AND NOT-ESYT3 | Stomach | 0.7586 | 0.75 | 0.7674 |
| OSMR AND NOT-SEMA6A | Sarcoma | 0.8667 | 1 | 0.7647 | MUC13 AND NOT-SCNN1B | Stomach | 0.9882 | 1 | 0.9767 |
| ADAM12 AND NOT-SPINT1 | Sarcoma | 0.8718 | 0.7727 | 1 | CLDN18 AND NOT-GLDN | Stomach | 0.7529 | 0.7619 | 0.7442 |
| DDR2 AND NOT-PARM1 | Sarcoma | 0.7407 | 1 | 0.5882 | CLDN18 AND NOT-SLC15A2 | Stomach | 0.7527 | 0.7 | 0.814 |
| DDR2 AND NOT-TM7SF2 | Sarcoma | 0.7407 | 1 | 0.5882 | CLDN18 AND NOT-GPM6B | Stomach | 0.7857 | 0.8049 | 0.7674 |
| ADAM12 AND NOT-TSPAN13 | Sarcoma | 0.7907 | 0.6538 | 1 | CLDN18 AND NOT-GJA5 | Stomach | 0.75 | 0.7333 | 0.7674 |
| ADAM12 AND NOT-SLC24A3 | Sarcoma | 0.7857 | 1 | 0.6471 | CLDN18 AND NOT-SUSD2 | Stomach | 0.75 | 0.7333 | 0.7674 |
| OSMR AND NOT-KCNK3 | Sarcoma | 0.8667 | 1 | 0.7647 | CLDN18 AND NOT-KLRF1 | Stomach | 0.7826 | 0.7347 | 0.8372 |
| OSMR AND NOT-PERP | Sarcoma | 0.7586 | 0.9167 | 0.6471 | CLDN18 AND NOT-CAV2 | Stomach | 0.764 | 0.7391 | 0.7907 |
| OSMR AND NOT-TM7SF2 | Sarcoma | 0.7407 | 1 | 0.5882 | CLDN18 AND NOT-AMICA1 | Stomach | 0.7556 | 0.7234 | 0.7907 |
| OSMR AND NOT-ACPP | Sarcoma | 0.875 | 0.9333 | 0.8235 | CLDN18 AND NOT-TREM1 | Stomach | 0.7473 | 0.7083 | 0.7907 |
| OSMR AND NOT-CSF3R | Sarcoma | 0.8125 | 0.8667 | 0.7647 | CLDN18 AND NOT-DUOXA1 | Stomach | 0.747 | 0.775 | 0.7209 |
| ADAM12 AND NOT-TMEM150C | Sarcoma | 0.7368 | 0.6667 | 0.8235 | CLDN18 AND NOT-ICAM4 | Stomach | 0.7714 | 1 | 0.6279 |
| DDR2 AND NOT-ENPP4 | Sarcoma | 0.7586 | 0.9167 | 0.6471 | CLDN18 AND NOT-CLEC12A | Stomach | 0.7692 | 0.7292 | 0.814 |
| OSMR AND NOT-CEACAM1 | Sarcoma | 0.7586 | 0.9167 | 0.6471 | CLDN18 AND NOT-CAV1 | Stomach | 0.7865 | 0.7609 | 0.814 |
| OSMR AND NOT-SLC6A2 | Sarcoma | 0.7857 | 1 | 0.6471 | CLDN18 AND NOT-OLR1 | Stomach | 0.75 | 0.7333 | 0.7674 |
| DDR2 AND NOT-TSPAN8 | Sarcoma | 0.7333 | 0.8462 | 0.6471 | MST1R AND NOT-SCNN1B | Stomach | 0.9318 | 0.9111 | 0.9535 |
| OSMR AND NOT-MGST2 | Sarcoma | 0.7333 | 0.8462 | 0.6471 | CLDN7 AND NOT-SCNN1B | Stomach | 0.9195 | 0.9091 | 0.9302 |
| OSMR AND NOT-SLC25A4 | Sarcoma | 0.7586 | 0.9167 | 0.6471 | CLDN18 AND NOT-SCN7A | Stomach | 0.7619 | 0.7805 | 0.7442 |
| ADAM12 AND NOT-AQP3 | Sarcoma | 0.7333 | 0.8462 | 0.6471 | CLDN18 AND NOT-ST3GAL5 | Stomach | 0.7556 | 0.7234 | 0.7907 |
| OSMR AND NOT-MTUS1 | Sarcoma | 0.7857 | 1 | 0.6471 | CLDN18 AND NOT-COLEC12 | Stomach | 0.7391 | 0.6939 | 0.7907 |
| OSMR AND NOT-TSPAN31 | Sarcoma | 0.7742 | 0.8571 | 0.7059 | CLDN18 AND NOT-TMEM100 | Stomach | 0.7955 | 0.7778 | 0.814 |
| ADAM12 AND NOT-CEACAM1 | Sarcoma | 0.7429 | 0.7222 | 0.7647 | MUC13 AND NOT-TSPAN1 | Stomach | 0.866 | 0.7778 | 0.9767 |
| ADAM12 AND NOT-SLC19A3 | Sarcoma | 0.7317 | 0.625 | 0.8824 | CLDN18 AND NOT-LIFR | Stomach | 0.8182 | 0.8 | 0.8372 |
| ADAM12 AND NOT-SLC6A2 | Sarcoma | 0.8485 | 0.875 | 0.8235 | CLDN18 AND NOT-ECSCR | Stomach | 0.7356 | 0.7273 | 0.7442 |
| ADAM12 AND NOT-SIGLEC6 | Sarcoma | 0.85 | 0.7391 | 1 | CLDN18 AND NOT-KL | Stomach | 0.7356 | 0.7273 | 0.7442 |
| OSMR AND NOT-TSPAN12 | Sarcoma | 0.875 | 0.9333 | 0.8235 | CLDN18 AND NOT-CDH5 | Stomach | 0.7586 | 0.75 | 0.7674 |
| OSMR AND NOT-TMPRSS2 | Sarcoma | 0.8 | 0.9231 | 0.7059 | CLDN18 AND NOT-EMCN | Stomach | 0.7333 | 0.7021 | 0.7674 |
| ADAM12 AND NOT-CDH3 | Sarcoma | 0.8108 | 0.75 | 0.8824 | CLDN18 AND NOT-SIRPB1 | Stomach | 0.7333 | 0.7021 | 0.7674 |
| OSMR AND NOT-FZD5 | Sarcoma | 0.8125 | 0.8667 | 0.7647 | CLDN18 AND NOT-RAMP3 | Stomach | 0.7356 | 0.7273 | 0.7442 |
| OSMR AND NOT-HAS3 | Sarcoma | 0.8387 | 0.9286 | 0.7647 | CEACAM5 AND NOT-SCNN1B | Stomach | 0.878 | 0.9231 | 0.8372 |
| ADAM12 AND NOT-CNGA1 | Sarcoma | 0.7273 | 0.75 | 0.7059 | CLDN18 AND NOT-LYVE1 | Stomach | 0.7674 | 0.7674 | 0.7674 |
| OSMR AND NOT-LRP2 | Sarcoma | 0.8387 | 0.9286 | 0.7647 | CLDN18 AND NOT-CSF3R | Stomach | 0.7391 | 0.6939 | 0.7907 |
| OSMR AND NOT-TMEM150C | Sarcoma | 0.7586 | 0.9167 | 0.6471 | CLDN18 AND NOT-CA4 | Stomach | 0.7273 | 0.8235 | 0.6512 |
| ADAM12 AND NOT-ADRA2C | Sarcoma | 0.7273 | 0.75 | 0.7059 | CLDN18 AND NOT-MSR1 | Stomach | 0.7273 | 0.7111 | 0.7442 |
| OSMR AND NOT-PIGR | Sarcoma | 0.8667 | 1 | 0.7647 | CLDN18 AND NOT-CD300LF | Stomach | 0.7416 | 0.7174 | 0.7674 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ADAM12 AND NOT-PROM2 | Sarcoma | 0.8649 | 0.8 | 0.9412 | CLDN18 AND NOT-TYROBP | Stomach | 0.7692 | 0.7292 | 0.814 |
| ADAM12 AND NOT-NPY1R | Sarcoma | 0.7222 | 0.6842 | 0.7647 | CLDN18 AND NOT-CLEC1A | Stomach | 0.7436 | 0.8286 | 0.6744 |
| OSMR AND NOT-KCNK5 | Sarcoma | 0.7586 | 0.9167 | 0.6471 | CLDN18 AND NOT-NINJ2 | Stomach | 0.7253 | 0.6875 | 0.7674 |
| OSMR AND NOT-F3 | Sarcoma | 0.8 | 0.9231 | 0.7059 | CLDN18 AND NOT-GRIA1 | Stomach | 0.7778 | 0.9655 | 0.6512 |
| MMP14 AND NOT-BCAM | Sarcoma | 0.7407 | 1 | 0.5882 | NOT-SDC1 AND ATP13A4 | Astrocytoma | 0.7654 | 0.8857 | 0.6739 |
| MMP14 AND NOT-LSR | Sarcoma | 0.7407 | 1 | 0.5882 | NOT-TPBG AND PTPRF | Liver | 0.8333 | 0.8333 | 0.8333 |
| MMP14 AND NOT-SIGLEC6 | Sarcoma | 0.7407 | 1 | 0.5882 | NOT-SLC7A2 AND CLDN1 | Colon | 0.9091 | 0.8333 | 1 |
| SLC2A10 AND NOT-PIGR | Sarcoma | 0.8276 | 1 | 0.7059 | NOT-SLC33A1 AND SLC39A6 | Ependymoma | 1 | 1 | 1 |
| OSMR AND NOT-SLCO4A1 | Sarcoma | 0.8387 | 0.9286 | 0.7647 | NOT-LTBR AND ERBB2 | Ependymoma | 1 | 1 | 1 |
| ADAM12 AND NOT-SLC44A5 | Sarcoma | 0.7273 | 0.5926 | 0.9412 | NOT-IL11RA AND EPHB4 | Esophagus | 0.6 | 0.5625 | 0.6429 |
| OSMR AND NOT-TSPAN8 | Sarcoma | 0.7857 | 1 | 0.6471 | NOT-GYPE AND CLDN18 | Esophagus | 0.6 | 1 | 0.4286 |
| OSMR AND NOT-SLC6A4 | Sarcoma | 0.8387 | 0.9286 | 0.7647 | NOT-IL11RA AND F2RL2 | Esophagus | 0.6667 | 0.5789 | 0.7857 |
| GPRC5A AND NOT-SCNN1B | Stomach | 0.9535 | 0.9535 | 0.9535 | NOT-IL11RA AND OSMR | Esophagus | 0.6087 | 0.7778 | 0.5 |
| ST14 AND NOT-SCNN1B | Stomach | 0.9111 | 0.8723 | 0.9535 | NOT-COL25A1 AND CLDN18 | Esophagus | 0.6 | 1 | 0.4286 |
| GPRC5A AND NOT-SCNN1G | Stomach | 0.7342 | 0.8056 | 0.6744 | NOT-ENPP3 AND TSPAN1 | Esophagus | 0.6364 | 0.875 | 0.5 |
| TSPAN1 AND NOT-SCNN1B | Stomach | 0.75 | 0.6087 | 0.9767 | NOT-SDC1 AND FAM57A | Glioblastoma | 0.7143 | 0.9091 | 0.5882 |
| LSR AND NOT-SCNN1B | Stomach | 0.9383 | 1 | 0.8837 | NOT-ERBB3 AND ATP2A2 | Leiomyosarcoma | 0.8696 | 1 | 0.7692 |
| LSR AND NOT-ABHD6 | Stomach | 0.7536 | 1 | 0.6047 | NOT-AQP3 AND CD276 | Leiomyosarcoma | 0.6923 | 0.6923 | 0.6923 |
| SLC39A4 AND NOT-CLCA4 | Stomach | 0.8235 | 0.8333 | 0.814 | NOT-ERBB3 AND EVC2 | Leiomyosarcoma | 0.7273 | 0.8889 | 0.6154 |
| LSR AND NOT-SLC16A9 | Stomach | 0.9136 | 0.9737 | 0.8605 | NOT-ERBB3 AND PCDH7 | Leiomyosarcoma | 0.6429 | 0.6 | 0.6923 |
| B3GNT3 AND NOT-SCNN1B | Stomach | 0.8958 | 0.8113 | 1 | NOT-AQP3 AND SDC1 | Leiomyosarcoma | 0.64 | 0.6667 | 0.6154 |
| LSR AND NOT-CLCA4 | Stomach | 0.8378 | 1 | 0.7209 | NOT-LSR AND SDC1 | Leiomyosarcoma | 0.8462 | 0.8462 | 0.8462 |
| LSR AND NOT-BEST4 | Stomach | 0.9268 | 0.9744 | 0.8837 | NOT-ERBB3 AND PKD1 | Leiomyosarcoma | 0.8696 | 1 | 0.7692 |
| VSIG1 AND NOT-GP1BA | Stomach | 0.6866 | 0.9583 | 0.5349 | NOT-CRB3 AND AXL | Leiomyosarcoma | 0.6957 | 0.8 | 0.6154 |
| SMAGP AND NOT-SCNN1B | Stomach | 0.9767 | 0.9767 | 0.9767 | NOT-ERBB3 AND PCDHB7 | Leiomyosarcoma | 0.7619 | 1 | 0.6154 |
| LSR AND NOT-ST6GALNAC6 | Stomach | 0.8571 | 0.9706 | 0.7674 | NOT-EPCAM AND FAM57A | Leiomyosarcoma | 0.6667 | 0.875 | 0.5385 |
| B3GNT3 AND NOT-CLCA4 | Stomach | 0.7353 | 1 | 0.5814 | NOT-ERBB3 AND HEPH | Leiomyosarcoma | 0.6957 | 0.8 | 0.6154 |
| NOT-LIFR AND PODXL | Colon | 0.8889 | 1 | 0.8 | NOT-ERBB3 AND PCDHGC3 | Leiomyosarcoma | 0.6667 | 0.7273 | 0.6154 |
| NOT-LIFR AND TMEM47 | Colon | 0.8889 | 1 | 0.8 | NOT-PTPRK AND SLC7A5 | AML | 0.8925 | 0.8111 | 0.992 |
| NOT-SLC16A7 AND EDAR | Colon | 0.8889 | 1 | 0.8 | NOT-WLS AND CD37 | AML | 0.8778 | 0.8201 | 0.9442 |
| NOT-LIFR AND EVA1A | Colon | 0.8889 | 1 | 0.8 | NOT-PTPRK AND CD70 | AML | 0.8737 | 0.7806 | 0.992 |
| NOT-MUC15 AND CDH3 | Colon | 0.9091 | 0.8333 | 1 | NOT-TGFBR3 AND CD37 | AML | 0.8722 | 0.8884 | 0.8566 |
| NOT-LIFR AND PCDH18 | Colon | 0.8889 | 1 | 0.8 | NOT-HEG1 AND SLC7A5 | AML | 0.8745 | 0.861 | 0.8884 |
| NOT-LIFR AND EPHB4 | Colon | 0.8333 | 0.7143 | 1 | NOT-WLS AND CD70 | AML | 0.8689 | 0.7908 | 0.9641 |
| NOT-SLC16A7 AND TMEM97 | Colon | 1 | 1 | 1 | NOT-CADM1 AND SLC7A5 | AML | 0.8801 | 0.8304 | 0.9363 |
| NOT-LIFR AND PDGFRB | Colon | 0.8333 | 0.7143 | 1 | NOT-HEG1 AND CD70 | AML | 0.8862 | 0.888 | 0.8845 |
| NOT-SLC7A2 AND CDH3 | Colon | 0.8333 | 0.7143 | 1 | NOT-PODXL AND SLC7A5 | AML | 0.8592 | 0.7697 | 0.9721 |
| NOT-LIFR AND COLEC12 | Colon | 0.8 | 0.8 | 0.8 | NOT-ATP9A AND SLC7A5 | AML | 0.8664 | 0.7921 | 0.9562 |
| NOT-AQP3 AND SLC10A3 | Leiomyosarcoma | 0.7273 | 0.8889 | 0.6154 | NOT-PTPRK AND CD37 | AML | 0.8566 | 0.7632 | 0.9761 |
| NOT-CXADR AND DCBLD2 | Liposarcoma | 0.7143 | 0.7353 | 0.6944 | NOT-SGCE AND SLC7A5 | AML | 0.8557 | 0.7593 | 0.9801 |
| NOT-PERP AND FAM57A | Liposarcoma | 0.7813 | 0.8929 | 0.6944 | NOT-WLS AND SLC7A5 | AML | 0.8531 | 0.7675 | 0.9602 |
| NOT-CXADR AND SMO | Liposarcoma | 0.6885 | 0.84 | 0.5833 | NOT-CXADR AND EPHB2 | Liposarcoma | 0.7647 | 0.8125 | 0.7222 |
| NOT-NTRK2 AND NTM | Lung Adenocarcinoma | 0.7287 | 0.7966 | 0.6714 | NOT-FGFR2 AND PTK7 | Liposarcoma | 0.6575 | 0.6486 | 0.6667 |
| NOT-CLCA4 AND PVRL4 | Lung Adenocarcinoma | 0.6512 | 0.7119 | 0.6 | NOT-XK AND EPHB2 | Liposarcoma | 0.6494 | 0.6098 | 0.6944 |
| NOT-PLP1 AND NTM | Lung Adenocarcinoma | 0.7397 | 0.7105 | 0.7714 | NOT-SORT1 AND GPNMB | B-Cell Diffuse | 0.7742 | 0.96 | 0.6486 |
| NOT-NTRK2 AND SDC3 | Lung Adenocarcinoma | 0.6202 | 0.678 | 0.5714 | NOT-MTUS1 AND GPNMB | B-Cell Diffuse | 0.7105 | 0.6923 | 0.7297 |
| NOT-CLCA4 AND TLCD1 | Lung Adenocarcinoma | 0.6195 | 0.814 | 0.5 | NOT-JAG1 AND GPNMB | B-Cell Diffuse | 0.7097 | 0.88 | 0.5946 |
| NOT-ABHD6 AND MARVELD2 | Lung Adenocarcinoma | 0.6069 | 0.5867 | 0.6286 | NOT-ITGB6 AND ST14 | Mantle-Cell Lymphoma | 0.9143 | 1 | 0.8421 |
| NOT-TENM2 AND PVRL4 | Lung Adenocarcinoma | 0.6015 | 0.6349 | 0.5714 | NOT-TPBG AND ST14 | Mantle-Cell Lymphoma | 0.9315 | 0.9714 | 0.8947 |
| NOT-DLL1 AND MARVELD2 | Lung Adenocarcinoma | 0.6104 | 0.5595 | 0.6714 | NOT-ERBB3 AND ST14 | Mantle-Cell Lymphoma | 0.9014 | 0.9697 | 0.8421 |
| NOT-SLC5A1 AND SLC6A14 | Lung Adenocarcinoma | 0.631 | 0.5408 | 0.7571 | NOT-STEAP2 AND ST14 | Mantle-Cell Lymphoma | 0.8657 | 1 | 0.7632 |
| NOT-ADCY4 AND NOX4 | Lung Carcinoma | 0.6102 | 0.4779 | 0.8438 | NOT-IL20RA AND ST14 | Mantle-Cell Lymphoma | 0.9315 | 0.9714 | 0.8947 |
| NOT-ADCY4 AND ADAM12 | Lung Carcinoma | 0.6974 | 0.6023 | 0.8281 | NOT-ITGB6 AND CELSR1 | Mantle-Cell Lymphoma | 0.8706 | 0.7872 | 0.9737 |
| NOT-ABCA8 AND CDH5 | Anaplastic Lymphoma | 0.6667 | 0.6667 | 0.6667 | NOT-STEAP2 AND CELSR1 | Mantle-Cell Lymphoma | 0.8608 | 0.8293 | 0.8947 |
| NOT-FCER1A AND CXCL10 | Anaplastic Lymphoma | 0.72 | 0.9 | 0.6 | NOT-TPBG AND CELSR1 | Mantle-Cell Lymphoma | 0.8539 | 0.7451 | 1 |
| NOT-FCER1A AND LILRB2 | Anaplastic Lymphoma | 0.6 | 0.6 | 0.6 | NOT-MST1R AND ST14 | Mantle-Cell Lymphoma | 0.8529 | 0.9667 | 0.7632 |
| NOT-ASPH AND ST14 | Mantle-Cell Lymphoma | 0.9444 | 1 | 0.8947 | NOT-CD9 AND VCAM1 | T-Cell, Peripheral | 0.6939 | 0.8095 | 0.6071 |
| NOT-ASPH AND CELSR1 | Mantle-Cell Lymphoma | 0.9867 | 1 | 0.9737 | NOT-ITGB5 AND GPNMB | T-Cell, Peripheral | 0.6792 | 0.72 | 0.6429 |
| NOT-SLC2A12 AND CELSR1 | Mantle-Cell Lymphoma | 1 | 1 | 1 | NOT-APCDD1 AND GPNMB | T-Cell, Peripheral | 0.6579 | 0.5208 | 0.8929 |
| NOT-DHRS3 AND ST14 | Mantle-Cell Lymphoma | 0.9167 | 0.9706 | 0.8684 | NOT-NTN4 AND GPNMB | T-Cell, Peripheral | 0.6575 | 0.5333 | 0.8571 |
| NOT-MTUS1 AND ST14 | Mantle-Cell Lymphoma | 0.9444 | 1 | 0.8947 | NOT-TMEM59 AND RNF43 | Ovarian | 0.7273 | 0.8 | 0.6667 |
| NOT-GPM6B AND CELSR1 | Mantle-Cell Lymphoma | 0.9487 | 0.925 | 0.9737 | NOT-SLC16A7 AND IL2RA | Ovarian | 0.7368 | 1 | 0.5833 |
| NOT-TMEM150B AND SLC16A4 | Melanoma | 0.9524 | 1 | 0.9091 | NOT-MTUS1 AND RNF43 | Ovarian | 0.6957 | 0.7273 | 0.6667 |
| NOT-TM4SF5 AND ADAM12 | Melanoma | 0.9524 | 1 | 0.9091 | NOT-EPCAM AND FAM57A | Sarcoma | 0.8 | 0.7778 | 0.8235 |
| NOT-TM4SF5 AND SGCD | Melanoma | 0.9524 | 1 | 0.9091 | NOT-RNF43 AND FAM57A | Sarcoma | 0.7586 | 0.9167 | 0.6471 |
| NOT-CDH1 AND FAM57A | Sarcoma | 0.8667 | 1 | 0.7647 | FAP AND NOT-FOLR2 | Breast | 0.7879 | 0.8667 | 0.7222 |
| NOT-CDH1 AND SLC2A10 | Sarcoma | 0.7857 | 1 | 0.6471 | FAP AND NOT-IL11RA | Breast | 0.8317 | 0.8936 | 0.7778 |
| NOT-LSR AND SLC2A10 | Sarcoma | 0.7857 | 1 | 0.6471 | FAP AND NOT-ALDH1A1 | Breast | 0.8163 | 0.9091 | 0.7407 |
| NOT-F11R AND MPZL1 | Sarcoma | 0.8125 | 0.8667 | 0.7647 | FAP AND NOT-PMEL | Breast | 0.8381 | 0.8627 | 0.8148 |
| NOT-F11R AND FAM57A | Sarcoma | 0.8 | 0.9231 | 0.7059 | FAP AND NOT-CLDN1 | Breast | 0.8515 | 0.9149 | 0.7963 |
| NKAIN4 AND NOT-CNTNAP2 | Astrocytoma | 0.825 | 0.9706 | 0.7174 | FAP AND NOT-EGFR | Breast | 0.8269 | 0.86 | 0.7963 |
| NKAIN4 AND NOT-CDH8 | Astrocytoma | 0.8148 | 0.9429 | 0.7174 | FAP AND NOT-LGR5 | Breast | 0.8269 | 0.86 | 0.7963 |
| NKAIN4 AND NOT-HTR2C | Astrocytoma | 0.8101 | 0.9697 | 0.6957 | FAP AND NOT-EDNRB | Breast | 0.7556 | 0.9444 | 0.6296 |
| NKAIN4 AND NOT-KIAA0319 | Astrocytoma | 0.8049 | 0.9167 | 0.7174 | FAP AND NOT-ABCA5 | Breast | 0.8155 | 0.8571 | 0.7778 |
| NKAIN4 AND NOT-SCN2A | Astrocytoma | 0.7952 | 0.8919 | 0.7174 | FAP AND NOT-CD34 | Breast | 0.8381 | 0.8627 | 0.8148 |
| NKAIN4 AND NOT-KCNJ6 | Astrocytoma | 0.7895 | 1 | 0.6522 | FAP AND NOT-TNC | Breast | 0.7579 | 0.878 | 0.6667 |
| NKAIN4 AND NOT-SCN8A | Astrocytoma | 0.7895 | 1 | 0.6522 | FAP AND NOT-NCAM1 | Breast | 0.8776 | 0.9773 | 0.7963 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NKAIN4 AND NOT-GRM1 | Astrocytoma | 0.7895 | 1 | 0.6522 | MUC1 AND NOT-ALDH1A1 | Breast | 0.7347 | 0.8182 | 0.6667 |
| NKAIN4 AND NOT-LRFN2 | Astrocytoma | 0.7895 | 1 | 0.6522 | FAP AND NOT-CD160 | Breast | 0.7579 | 0.878 | 0.6667 |
| CRB1 AND NOT-GRM3 | Astrocytoma | 0.7857 | 0.8684 | 0.7174 | FAP AND NOT-RAET1E | Breast | 0.7755 | 0.8636 | 0.7037 |
| NKAIN4 AND NOT-SLC13A5 | Astrocytoma | 0.7805 | 0.8889 | 0.6957 | FAP AND NOT-CLDN11 | Breast | 0.8269 | 0.86 | 0.7963 |
| NKAIN4 AND NOT-GRM3 | Astrocytoma | 0.7792 | 0.9677 | 0.6522 | FAP AND NOT-CLDN8 | Breast | 0.7158 | 0.8293 | 0.6296 |
| NKAIN4 AND NOT-KIRREL3 | Astrocytoma | 0.7792 | 0.9677 | 0.6522 | CLDN7 AND NOT-ALDH1A1 | Breast | 0.7143 | 0.6897 | 0.7407 |
| NKAIN4 AND NOT-GPR26 | Astrocytoma | 0.7792 | 0.9677 | 0.6522 | FAP AND NOT-SSTR1 | Breast | 0.8381 | 0.8627 | 0.8148 |
| NKAIN4 AND NOT-CACNA1E | Astrocytoma | 0.7792 | 0.9677 | 0.6522 | FAP AND NOT-PCYT1A | Breast | 0.8269 | 0.86 | 0.7963 |
| NKAIN4 AND NOT-CDH22 | Astrocytoma | 0.7733 | 1 | 0.6304 | FAP AND NOT-GPC3 | Breast | 0.78 | 0.8478 | 0.7222 |
| NKAIN4 AND NOT-CACNA1B | Astrocytoma | 0.7733 | 1 | 0.6304 | FAP AND NOT-GUCY2C | Breast | 0.8544 | 0.898 | 0.8148 |
| NKAIN4 AND NOT-GPR6 | Astrocytoma | 0.7654 | 0.8857 | 0.6739 | FAP AND NOT-GAGE1 | Breast | 0.8317 | 0.8936 | 0.7778 |
| NKAIN4 AND NOT-CNIH2 | Astrocytoma | 0.7654 | 0.8857 | 0.6739 | FAP AND NOT-CLDN2 | Breast | 0.8269 | 0.86 | 0.7963 |
| NKAIN4 AND NOT-KCNV1 | Astrocytoma | 0.7654 | 0.8857 | 0.6739 | FAP AND NOT-CLDN12 | Breast | 0.7158 | 0.8293 | 0.6296 |
| NKAIN4 AND NOT-CCKBR | Astrocytoma | 0.7654 | 0.8857 | 0.6739 | FAP AND NOT-DDX3X | Breast | 0.8381 | 0.8627 | 0.8148 |
| NKAIN4 AND NOT-FXYD7 | Astrocytoma | 0.7654 | 0.8857 | 0.6739 | FAP AND NOT-CSPG4 | Breast | 0.75 | 0.8571 | 0.6667 |
| NKAIN4 AND NOT-CDH9 | Astrocytoma | 0.7654 | 0.8857 | 0.6739 | FAP AND NOT-CLDN18 | Breast | 0.8381 | 0.8627 | 0.8148 |
| NKAIN4 AND NOT-PTPRR | Astrocytoma | 0.7632 | 0.9667 | 0.6304 | FAP AND NOT-IL20RA | Breast | 0.7158 | 0.8293 | 0.6296 |
| NKAIN4 AND NOT-GPR22 | Astrocytoma | 0.7595 | 0.9091 | 0.6522 | FAP AND NOT-EPHA3 | Breast | 0.6977 | 0.9375 | 0.5556 |
| NKAIN4 AND NOT-DGKE | Astrocytoma | 0.7595 | 0.9091 | 0.6522 | FAP AND NOT-CD33 | Breast | 0.7579 | 0.878 | 0.6667 |
| NKAIN4 AND NOT-CDH18 | Astrocytoma | 0.75 | 0.8824 | 0.6522 | FAP AND NOT-VCAM1 | Breast | 0.7423 | 0.8372 | 0.6667 |
| NKAIN4 AND NOT-GRIN2A | Astrocytoma | 0.75 | 0.8824 | 0.6522 | FAP AND NOT-KDR | Breast | 0.7755 | 0.8636 | 0.7037 |
| NKAIN4 AND NOT-CHRND | Astrocytoma | 0.75 | 0.8824 | 0.6522 | FAP AND NOT-TNFRSF8 | Breast | 0.8081 | 0.8889 | 0.7407 |
| CRB1 AND NOT-KCNC1 | Astrocytoma | 0.7447 | 0.7292 | 0.7609 | FAP AND NOT-MAGEA11 | Breast | 0.8381 | 0.8627 | 0.8148 |
| NKAIN4 AND NOT-GABRA1 | Astrocytoma | 0.7436 | 0.9063 | 0.6304 | FAP AND NOT-CLDN23 | Breast | 0.8381 | 0.8627 | 0.8148 |
| SLCO1C1 AND NOT-GRM3 | Astrocytoma | 0.7407 | 0.8571 | 0.6522 | FAP AND NOT-SSTR5 | Breast | 0.8462 | 0.88 | 0.8148 |
| NKAIN4 AND NOT-HCN1 | Astrocytoma | 0.7397 | 1 | 0.587 | FAP AND NOT-SST | Breast | 0.8544 | 0.898 | 0.8148 |
| NKAIN4 AND NOT-SLC6A15 | Astrocytoma | 0.7397 | 1 | 0.587 | FAP AND NOT-STEAP2 | Breast | 0.8269 | 0.86 | 0.7963 |
| NKAIN4 AND NOT-KCNA4 | Astrocytoma | 0.7342 | 0.8788 | 0.6304 | VTCN1 AND NOT-MUC13 | Breast | 0.6905 | 0.9667 | 0.537 |
| NKAIN4 AND NOT-CACNG8 | Astrocytoma | 0.7342 | 0.8788 | 0.6304 | VTCN1 AND NOT-MUC4 | Breast | 0.6905 | 0.9667 | 0.537 |
| NKAIN4 AND NOT-JPH3 | Astrocytoma | 0.7342 | 0.8788 | 0.6304 | VTCN1 AND NOT-MOK | Breast | 0.6905 | 0.9667 | 0.537 |
| NKAIN4 AND NOT-KCNJ9 | Astrocytoma | 0.7342 | 0.8788 | 0.6304 | VTCN1 AND NOT-CLDN23 | Breast | 0.6905 | 0.9667 | 0.537 |
| NKAIN4 AND NOT-DRD1 | Astrocytoma | 0.7342 | 0.8788 | 0.6304 | VTCN1 AND NOT-PMEL | Breast | 0.6905 | 0.9667 | 0.537 |
| CRB1 AND NOT-SCN8A | Astrocytoma | 0.7317 | 0.8333 | 0.6522 | VTCN1 AND NOT-HHLA2 | Breast | 0.6905 | 0.9667 | 0.537 |
| CRB1 AND NOT-GABRA2 | Astrocytoma | 0.7317 | 0.8333 | 0.6522 | VTCN1 AND NOT-SSTR1 | Breast | 0.6905 | 0.9667 | 0.537 |
| NKAIN4 AND NOT-CLSTN3 | Astrocytoma | 0.7273 | 0.9032 | 0.6087 | VTCN1 AND NOT-IL11RA | Breast | 0.6905 | 0.9667 | 0.537 |
| SLCO1C1 AND NOT-GABRA2 | Astrocytoma | 0.7273 | 0.7619 | 0.6957 | VTCN1 AND NOT-MAGEA11 | Breast | 0.6905 | 0.9667 | 0.537 |
| CRB1 AND NOT-KIAA0319 | Astrocytoma | 0.7229 | 0.8108 | 0.6522 | FAP AND NOT-IL3RA | Breast | 0.8544 | 0.898 | 0.8148 |
| NKAIN4 AND NOT-EPHA8 | Astrocytoma | 0.7222 | 1 | 0.5652 | FAP AND NOT-ITGB3 | Breast | 0.8571 | 0.9545 | 0.7778 |
| NKAIN4 AND NOT-GPR83 | Astrocytoma | 0.7222 | 1 | 0.5652 | VTCN1 AND NOT-MUC16 | Breast | 0.6905 | 0.9667 | 0.537 |
| NKAIN4 AND NOT-ABCG4 | Astrocytoma | 0.72 | 0.931 | 0.587 | VTCN1 AND NOT-TNC | Breast | 0.6905 | 0.9667 | 0.537 |
| NKAIN4 AND NOT-NKAIN2 | Astrocytoma | 0.72 | 0.931 | 0.587 | VTCN1 AND NOT-GPA33 | Breast | 0.6905 | 0.9667 | 0.537 |
| NKAIN4 AND NOT-CACNG3 | Astrocytoma | 0.7179 | 0.875 | 0.6087 | VTCN1 AND NOT-GUCY2C | Breast | 0.6905 | 0.9667 | 0.537 |
| NKAIN4 AND NOT-GABRA5 | Astrocytoma | 0.7179 | 0.875 | 0.6087 | VTCN1 AND NOT-CLDN9 | Breast | 0.6905 | 0.9667 | 0.537 |
| NKAIN4 AND NOT-GABRA4 | Astrocytoma | 0.7179 | 0.875 | 0.6087 | FAP AND NOT-MOK | Breast | 0.8039 | 0.8542 | 0.7593 |
| NKAIN4 AND NOT-GABRB2 | Astrocytoma | 0.7179 | 0.875 | 0.6087 | FAP AND NOT-SSX1 | Breast | 0.8 | 0.8696 | 0.7407 |
| CRB1 AND NOT-CDH8 | Astrocytoma | 0.7111 | 0.7273 | 0.6957 | TPBG AND NOT-NCAM1 | Breast | 0.6813 | 0.8378 | 0.5741 |
| NKAIN4 AND NOT-OPRK1 | Astrocytoma | 0.7105 | 0.9 | 0.587 | FAP AND NOT-CD52 | Breast | 0.7677 | 0.8444 | 0.7037 |
| BEST3 AND NOT-AOC3 | Astrocytoma | 0.7089 | 0.8485 | 0.6087 | FAP AND NOT-CLEC14A | Breast | 0.8283 | 0.9111 | 0.7593 |
| CRB1 AND NOT-SYT4 | Astrocytoma | 0.7073 | 0.8056 | 0.6304 | VTCN1 AND NOT-EDNRB | Breast | 0.6747 | 0.9655 | 0.5185 |
| CRB1 AND NOT-GPR83 | Astrocytoma | 0.7073 | 0.8056 | 0.6304 | VTCN1 AND NOT-GAGE1 | Breast | 0.6747 | 0.9655 | 0.5185 |
| CRB1 AND NOT-DGKE | Astrocytoma | 0.7059 | 0.7692 | 0.6522 | VTCN1 AND NOT-HSPA5 | Breast | 0.6747 | 0.9655 | 0.5185 |
| CRB1 AND NOT-ATP8A2 | Astrocytoma | 0.7059 | 0.7692 | 0.6522 | VTCN1 AND NOT-SLC34A2 | Breast | 0.6905 | 0.9667 | 0.537 |
| PPAPDC1A AND NOT-TMEFF2 | Breast | 0.7755 | 0.8636 | 0.7037 | VTCN1 AND NOT-NCAM1 | Breast | 0.6905 | 0.9667 | 0.537 |
| PPAPDC1A AND NOT-GRM3 | Breast | 0.7677 | 0.8444 | 0.7037 | TPBG AND NOT-ALK | Breast | 0.6739 | 0.8158 | 0.5741 |
| PPAPDC1A AND NOT-TRPM3 | Breast | 0.76 | 0.8261 | 0.7037 | VTCN1 AND NOT-CLDN1 | Breast | 0.6747 | 0.9655 | 0.5185 |
| PPAPDC1A AND NOT-GABRG1 | Breast | 0.76 | 0.8261 | 0.7037 | CLDN12 AND NOT-EPCAM | Liver | 0.8 | 1 | 0.6667 |
| PPAPDC1A AND NOT-ASTN1 | Breast | 0.76 | 0.8261 | 0.7037 | CLDN12 AND NOT-TPBG | Liver | 0.9091 | 1 | 0.8333 |
| PPAPDC1A AND NOT-OMG | Breast | 0.7917 | 0.9048 | 0.7037 | SDC1 AND NOT-TPBG | Liver | 0.8 | 0.6667 | 1 |
| PPAPDC1A AND NOT-KCNJ10 | Breast | 0.8132 | 1 | 0.6852 | CLDN1 AND NOT-TPBG | Liver | 0.8 | 1 | 0.6667 |
| PPAPDC1A AND NOT-CALN1 | Breast | 0.7451 | 0.7917 | 0.7037 | CLDN1 AND NOT-IL20RA | Liver | 0.8 | 1 | 0.6667 |
| PPAPDC1A AND NOT-GABRB1 | Breast | 0.7551 | 0.8409 | 0.6852 | CLDN12 AND NOT-IL20RA | Liver | 0.9231 | 0.8571 | 1 |
| PPAPDC1A AND NOT-TMEM235 | Breast | 0.7677 | 0.8444 | 0.7037 | CLDN12 AND NOT-ITGB6 | Liver | 1 | 1 | 1 |
| PPAPDC1A AND NOT-MLC1 | Breast | 0.7677 | 0.8444 | 0.7037 | CLDN2 AND NOT-FOLR1 | Liver | 0.625 | 0.5 | 0.8333 |
| PPAPDC1A AND NOT-CNTNAP4 | Breast | 0.7755 | 0.8636 | 0.7037 | CLDN1 AND NOT-PROM1 | Liver | 0.9091 | 1 | 0.8333 |
| PPAPDC1A AND NOT-SLC24A2 | Breast | 0.7451 | 0.7917 | 0.7037 | CLDN12 AND NOT-MST1R | Liver | 1 | 1 | 1 |
| PPAPDC1A AND NOT-OPALIN | Breast | 0.7677 | 0.8444 | 0.7037 | CLDN12 AND NOT-CLDN8 | Liver | 0.9231 | 0.8571 | 1 |
| PPAPDC1A AND NOT-NTSR2 | Breast | 0.7525 | 0.8085 | 0.7037 | CLDN12 AND NOT-ENPP3 | Liver | 0.6667 | 1 | 0.5 |
| PPAPDC1A AND NOT-DTNA | Breast | 0.7308 | 0.76 | 0.7037 | ERBB3 AND NOT-FOLR1 | Liver | 0.7692 | 0.7143 | 0.8333 |
| PPAPDC1A AND NOT-ANO4 | Breast | 0.7238 | 0.7451 | 0.7037 | FAP AND NOT-CSPG4 | Pancreas | 0.8421 | 1 | 0.7273 |
| PPAPDC1A AND NOT-MOG | Breast | 0.76 | 0.8261 | 0.7037 | FAP AND NOT-RAET1E | Pancreas | 0.7059 | 1 | 0.5455 |
| LRRC8E AND NOT-CLDN10 | Breast | 0.729 | 0.7358 | 0.7222 | FAP AND NOT-IL11RA | Pancreas | 0.7778 | 1 | 0.6364 |
| PPAPDC1A AND NOT-ACSL6 | Breast | 0.7525 | 0.8085 | 0.7037 | FAP AND NOT-NCAM1 | Pancreas | 0.8421 | 1 | 0.7273 |
| PPAPDC1A AND NOT-OPCML | Breast | 0.717 | 0.7308 | 0.7037 | FAP AND NOT-CLDN8 | Pancreas | 0.8421 | 1 | 0.7273 |
| PPAPDC1A AND NOT-FXYD7 | Breast | 0.7238 | 0.7451 | 0.7037 | MUC13 AND NOT-ENPP3 | Pancreas | 0.6154 | 0.5333 | 0.7273 |
| PPAPDC1A AND NOT-SLC1A2 | Breast | 0.7347 | 0.8182 | 0.6667 | FAP AND NOT-KDR | Pancreas | 0.625 | 1 | 0.4545 |
| PPAPDC1A AND NOT-MAG | Breast | 0.76 | 0.8261 | 0.7037 | EPHA3 AND NOT-CLDN8 | Pancreas | 0.6667 | 0.8571 | 0.5455 |
| PPAPDC1A AND NOT-ATP2B2 | Breast | 0.7115 | 0.74 | 0.6852 | CLDN2 AND NOT-ENPP3 | Pancreas | 0.6316 | 0.75 | 0.5455 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| PPAPDC1A AND NOT-NKAIN2 | Breast | 0.7097 | 0.8462 | 0.6111 | FAP AND NOT-AXL | Pancreas | 0.7778 | 1 | 0.6364 |
| PPAPDC1A AND NOT-SLC5A11 | Breast | 0.7527 | 0.8974 | 0.6481 | FAP AND NOT-CD34 | Pancreas | 0.7059 | 1 | 0.5455 |
| PPAPDC1A AND NOT-SLC6A12 | Breast | 0.717 | 0.7308 | 0.7037 | FAP AND NOT-PMEL | Pancreas | 0.8421 | 1 | 0.7273 |
| PPAPDC1A AND NOT-SLCO1A2 | Breast | 0.76 | 0.8261 | 0.7037 | EPHA3 AND NOT-CSPG4 | Pancreas | 0.6 | 0.6667 | 0.5455 |
| PPAPDC1A AND NOT-NKAIN4 | Breast | 0.7379 | 0.7755 | 0.7037 | FAP AND NOT-ROR1 | Pancreas | 0.625 | 1 | 0.4545 |
| PPAPDC1A AND NOT-SLC12A5 | Breast | 0.7037 | 0.7037 | 0.7037 | FAP AND NOT-EDNRB | Pancreas | 0.7059 | 1 | 0.5455 |
| PPAPDC1A AND NOT-NFASC | Breast | 0.7379 | 0.7755 | 0.7037 | FAP AND NOT-CLDN6 | Pancreas | 0.8421 | 1 | 0.7273 |
| PPAPDC1A AND NOT-CSPG5 | Breast | 0.701 | 0.7907 | 0.6296 | FAP AND NOT-ENPP3 | Pancreas | 0.7778 | 1 | 0.6364 |
| PPAPDC1A AND NOT-SCN2A | Breast | 0.7048 | 0.7255 | 0.6852 | FAP AND NOT-ITGB3 | Pancreas | 0.7778 | 1 | 0.6364 |
| PPAPDC1A AND NOT-KCNK10 | Breast | 0.6981 | 0.7115 | 0.6852 | FAP AND NOT-TNFRSF8 | Pancreas | 0.8421 | 1 | 0.7273 |
| PPAPDC1A AND NOT-GABRA2 | Breast | 0.6981 | 0.7115 | 0.6852 | FAP AND NOT-CLDN11 | Pancreas | 0.8421 | 1 | 0.7273 |
| PPAPDC1A AND NOT-CSMD3 | Breast | 0.6972 | 0.6909 | 0.7037 | VCAM1 AND NOT-CLDN11 | Renal | 0.8 | 1 | 0.6667 |
| PPAPDC1A AND NOT-SCN1A | Breast | 0.6972 | 0.6909 | 0.7037 | VCAM1 AND NOT-IL11RA | Renal | 0.7368 | 1 | 0.5833 |
| PPAPDC1A AND NOT-GABRG2 | Breast | 0.6972 | 0.6909 | 0.7037 | CLDN2 AND NOT-LGR5 | Renal | 0.7619 | 0.8889 | 0.6667 |
| PPAPDC1A AND NOT-CALY | Breast | 0.6972 | 0.6909 | 0.7037 | CLDN2 AND NOT-IL11RA | Renal | 0.6667 | 0.7778 | 0.5833 |
| PPAPDC1A AND NOT-SYT4 | Breast | 0.6916 | 0.6981 | 0.6852 | CLDN2 AND NOT-SSTR4 | Renal | 0.6667 | 1 | 0.5 |
| PPAPDC1A AND NOT-GRIN2C | Breast | 0.6909 | 0.6786 | 0.7037 | VCAM1 AND NOT-BMPR1B | Renal | 0.6667 | 1 | 0.5 |
| PPAPDC1A AND NOT-CLDN10 | Breast | 0.6857 | 0.7059 | 0.6667 | VCAM1 AND NOT-LGR5 | Renal | 0.8 | 1 | 0.6667 |
| PPAPDC1A AND NOT-SLC39A12 | Breast | 0.6847 | 0.6667 | 0.7037 | CLDN2 AND NOT-B4GALNT1 | Renal | 0.6667 | 1 | 0.5 |
| PPAPDC1A AND NOT-OR1Q1 | Breast | 0.7835 | 0.8837 | 0.7037 | VCAM1 AND NOT-FAP | Renal | 0.6667 | 0.6 | 0.75 |
| PPAPDC1A AND NOT-HCN2 | Breast | 0.7451 | 0.7917 | 0.7037 | CLDN2 AND NOT-CD19 | Renal | 0.6087 | 0.6364 | 0.5833 |
| PPAPDC1A AND NOT-ATP8A1 | Breast | 0.68 | 0.7391 | 0.6296 | CLDN2 AND NOT-FCRL1 | Renal | 0.8 | 1 | 0.6667 |
| PPAPDC1A AND NOT-DPP10 | Breast | 0.6792 | 0.6923 | 0.6667 | DPEP1 AND NOT-AFP | Colon | 1 | 1 | 1 |
| ENPP1 AND NOT-CLDN10 | Breast | 0.6789 | 0.6727 | 0.6852 | EPHB2 AND NOT-MUC4 | Colon | 0.8889 | 1 | 0.8 |
| PPAPDC1A AND NOT-TTYH2 | Breast | 0.7021 | 0.825 | 0.6111 | GUCY2C AND NOT-GPA33 | Colon | 0.8889 | 1 | 0.8 |
| PPAPDC1A AND NOT-KCNA2 | Breast | 0.6739 | 0.8158 | 0.5741 | DPEP1 AND NOT-SSTR4 | Colon | 0.8889 | 1 | 0.8 |
| LRRC8E AND NOT-SLC39A2 | Breast | 0.7407 | 0.7407 | 0.7407 | DPEP1 AND NOT-MAGEA1 | Colon | 1 | 1 | 1 |
| PPAPDC1A AND NOT-CDH18 | Breast | 0.6727 | 0.6607 | 0.6852 | DPEP1 AND NOT-MAGEA11 | Colon | 1 | 1 | 1 |
| PPAPDC1A AND NOT-GRIN2A | Breast | 0.6726 | 0.6441 | 0.7037 | DPEP1 AND NOT-CLDN18 | Colon | 1 | 1 | 1 |
| PPAPDC1A AND NOT-PIRT | Breast | 0.6726 | 0.6441 | 0.7037 | MUC13 AND NOT-GPA33 | Colon | 0.8889 | 1 | 0.8 |
| PPAPDC1A AND NOT-ADCY8 | Breast | 0.6726 | 0.6441 | 0.7037 | DPEP1 AND NOT-FCRL1 | Colon | 0.8889 | 1 | 0.8 |
| PPAPDC1A AND NOT-GRIA4 | Breast | 0.6667 | 0.6333 | 0.7037 | DPEP1 AND NOT-CLDN9 | Colon | 0.9091 | 0.8333 | 1 |
| PPAPDC1A AND NOT-SLCO1C1 | Breast | 0.6667 | 0.6491 | 0.6852 | EPHB2 AND NOT-SST | Colon | 0.8889 | 1 | 0.8 |
| LRRC8E AND NOT-TMPRSS11E | Breast | 0.7879 | 0.8667 | 0.7222 | EPHB2 AND NOT-CLDN3 | Colon | 0.8 | 0.8 | 0.8 |
| PPAPDC1A AND NOT-SEMA4D | Breast | 0.6609 | 0.623 | 0.7037 | DPEP1 AND NOT-MAGEA4 | Colon | 1 | 1 | 1 |
| PPAPDC1A AND NOT-DISP2 | Breast | 0.6604 | 0.6731 | 0.6481 | DPEP1 AND NOT-TNFRSF13C | Colon | 1 | 1 | 1 |
| PPAPDC1A AND NOT-CACNA1B | Breast | 0.6496 | 0.6032 | 0.7037 | DPEP1 AND NOT-ITGB3 | Colon | 0.8889 | 1 | 0.8 |
| ENPP1 AND NOT-MUC17 | Breast | 0.6613 | 0.5857 | 0.7593 | EPHB2 AND NOT-CLDN23 | Colon | 0.8889 | 1 | 0.8 |
| PPAPDC1A AND NOT-GPR85 | Breast | 0.6441 | 0.5938 | 0.7037 | EPHB2 AND NOT-IGF1R | Colon | 0.8889 | 1 | 0.8 |
| CLDN15 AND NOT-SLC16A5 | Liver | 0.8333 | 0.8333 | 0.8333 | BIRC5 AND NOT-IL11RA | Colon | 1 | 1 | 1 |
| SLCO1B1 AND NOT-C8B | Liver | 0.75 | 0.6 | 1 | CLDN2 AND NOT-AFP | Colon | 0.8889 | 1 | 0.8 |
| SLC30A8 AND NOT-NPHS1 | Pancreas | 0.7778 | 1 | 0.6364 | EPHB2 AND NOT-TNFRSF13C | Colon | 0.8889 | 1 | 0.8 |
| SLC30A8 AND NOT-SLC6A11 | Pancreas | 0.7778 | 1 | 0.6364 | GUCY2C AND NOT-SSTR1 | Colon | 0.8889 | 1 | 0.8 |
| SLC30A8 AND NOT-DPP10 | Pancreas | 0.7778 | 1 | 0.6364 | RNF43 AND NOT-FLOT2 | Colon | 0.75 | 1 | 0.6 |
| SLC30A8 AND NOT-ENPP1 | Pancreas | 0.7059 | 1 | 0.5455 | GUCY2C AND NOT-HHLA2 | Colon | 0.75 | 1 | 0.6 |
| SLC30A8 AND NOT-HCN1 | Pancreas | 0.7778 | 1 | 0.6364 | RNF43 AND NOT-ERBB4 | Colon | 0.75 | 1 | 0.6 |
| SLC30A8 AND NOT-KCNK16 | Pancreas | 0.7778 | 1 | 0.6364 | RNF43 AND NOT-CSPG4 | Colon | 0.75 | 1 | 0.6 |
| SLC30A8 AND NOT-CNIH2 | Pancreas | 0.7778 | 1 | 0.6364 | RNF43 AND NOT-EGFR | Colon | 0.75 | 1 | 0.6 |
| SLC30A8 AND NOT-SLC1A2 | Pancreas | 0.7778 | 1 | 0.6364 | DPEP1 AND NOT-CXCR5 | Colon | 0.75 | 1 | 0.6 |
| SLC30A8 AND NOT-GPR50 | Pancreas | 0.7778 | 1 | 0.6364 | EPHB2 AND NOT-TRPM4 | Colon | 0.75 | 1 | 0.6 |
| SLC30A8 AND NOT-CHRNB2 | Pancreas | 0.7778 | 1 | 0.6364 | RNF43 AND NOT-CD160 | Colon | 0.75 | 1 | 0.6 |
| SLC30A8 AND NOT-SLC5A2 | Pancreas | 0.7778 | 1 | 0.6364 | RNF43 AND NOT-CLDN11 | Colon | 0.75 | 1 | 0.6 |
| SLC30A8 AND NOT-SLC28A1 | Pancreas | 0.7778 | 1 | 0.6364 | CLDN2 AND NOT-TYR | Colon | 0.75 | 1 | 0.6 |
| SLC30A8 AND NOT-DTNA | Pancreas | 0.7778 | 1 | 0.6364 | RNF43 AND NOT-PCYT1A | Colon | 0.75 | 1 | 0.6 |
| SLC30A8 AND NOT-FSHR | Pancreas | 0.7778 | 1 | 0.6364 | RNF43 AND NOT-MOK | Colon | 0.75 | 1 | 0.6 |
| SLC30A8 AND NOT-SLC39A8 | Pancreas | 0.7778 | 1 | 0.6364 | RNF43 AND NOT-ST8SIA1 | Colon | 0.75 | 1 | 0.6 |
| SLC30A8 AND NOT-SHISA9 | Pancreas | 0.7778 | 1 | 0.6364 | RNF43 AND NOT-IL11RA | Colon | 0.75 | 1 | 0.6 |
| SLC30A8 AND NOT-CDH9 | Pancreas | 0.7059 | 1 | 0.5455 | CLDN2 AND NOT-SSTR4 | Colon | 0.75 | 1 | 0.6 |
| SLC30A8 AND NOT-FAM26D | Pancreas | 0.7778 | 1 | 0.6364 | RNF43 AND NOT-TNC | Colon | 0.75 | 1 | 0.6 |
| SLC30A8 AND NOT-CCKAR | Pancreas | 0.7059 | 1 | 0.5455 | RNF43 AND NOT-CD34 | Colon | 0.75 | 1 | 0.6 |
| SLC30A8 AND NOT-PPAPDC1B | Pancreas | 0.7778 | 1 | 0.6364 | EPHB2 AND NOT-GPA33 | Colon | 0.75 | 1 | 0.6 |
| SLC30A8 AND NOT-LRRC55 | Pancreas | 0.7778 | 1 | 0.6364 | DPEP1 AND NOT-ULBP1 | Colon | 0.8889 | 1 | 0.8 |
| SLC30A8 AND NOT-CCKBR | Pancreas | 0.7778 | 1 | 0.6364 | DPEP1 AND NOT-TYR | Colon | 0.8889 | 1 | 0.8 |
| SLC30A8 AND NOT-LCT | Pancreas | 0.7778 | 1 | 0.6364 | DPEP1 AND NOT-PMEL | Colon | 0.75 | 1 | 0.6 |
| SLC30A8 AND NOT-KIRREL2 | Pancreas | 0.7778 | 1 | 0.6364 | BIRC5 AND NOT-CD79B | Colon | 0.8333 | 0.7143 | 1 |
| SLC30A8 AND NOT-KCNF1 | Pancreas | 0.7059 | 1 | 0.5455 | DPEP1 AND NOT-B4GALNT1 | Colon | 0.8889 | 1 | 0.8 |
| SLC30A8 AND NOT-GPR22 | Pancreas | 0.7778 | 1 | 0.6364 | EPHB2 AND NOT-MST1R | Colon | 0.8 | 0.8 | 0.8 |
| SLC30A8 AND NOT-CYP4A11 | Pancreas | 0.7778 | 1 | 0.6364 | RNF43 AND NOT-NCAM1 | Colon | 0.75 | 1 | 0.6 |
| SLC30A8 AND NOT-KCNK10 | Pancreas | 0.7778 | 1 | 0.6364 | RNF43 AND NOT-TRPM4 | Colon | 0.75 | 1 | 0.6 |
| SLC30A8 AND NOT-TMPRSS11E | Pancreas | 0.7778 | 1 | 0.6364 | SSTR1 AND NOT-EPCAM | Ependymoma | 1 | 1 | 1 |
| SLC30A8 AND NOT-ATP8A2 | Pancreas | 0.7778 | 1 | 0.6364 | SSTR1 AND NOT-CLDN12 | Ependymoma | 1 | 1 | 1 |
| SLC30A8 AND NOT-LRRC8E | Pancreas | 0.7778 | 1 | 0.6364 | MUC13 AND NOT-ENPP3 | Esophagus | 0.6667 | 1 | 0.5 |
| SLC30A8 AND NOT-SLC2A2 | Pancreas | 0.7778 | 1 | 0.6364 | EPCAM AND NOT-ENPP3 | Esophagus | 0.6667 | 1 | 0.5 |
| SLC30A8 AND NOT-PAQR7 | Pancreas | 0.7778 | 1 | 0.6364 | MST1R AND NOT-ENPP3 | Esophagus | 0.6 | 1 | 0.4286 |
| SLC30A8 AND NOT-SLC17A2 | Pancreas | 0.7778 | 1 | 0.6364 | EPHB2 AND NOT-ENPP3 | Esophagus | 0.7647 | 1 | 0.9286 |
| SLC30A8 AND NOT-P2RX3 | Pancreas | 0.7778 | 1 | 0.6364 | CBX3 AND NOT-CD19 | Esophagus | 0.64 | 0.7273 | 0.5714 |
| SLC30A8 AND NOT-MRAP | Pancreas | 0.7778 | 1 | 0.6364 | CBX3 AND NOT-IL11RA | Esophagus | 0.6667 | 1 | 0.5 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC30A8 AND NOT-IL13 | Pancreas | 0.7778 | 1 | 0.6364 | EPHB2 AND NOT-ABCA5 | Esophagus | 0.6875 | 0.6111 | 0.7857 |
| SLC30A8 AND NOT-SLC17A3 | Pancreas | 0.7778 | 1 | 0.6364 | CLDN18 AND NOT-FOLR1 | Esophagus | 0.6 | 0.5625 | 0.6429 |
| SLC30A8 AND NOT-HTR3C | Pancreas | 0.7778 | 1 | 0.6364 | EPHB2 AND NOT-GPA33 | Esophagus | 0.7059 | 0.6 | 0.8571 |
| SLC30A8 AND NOT-SLC6A12 | Pancreas | 0.7059 | 1 | 0.5455 | MUC13 AND NOT-ABCA5 | Esophagus | 0.6897 | 0.6667 | 0.7143 |
| SLC30A8 AND NOT-SLC43A1 | Pancreas | 0.7778 | 1 | 0.6364 | BIRC5 AND NOT-CD33 | Esophagus | 0.6923 | 0.75 | 0.6429 |
| SLC30A8 AND NOT-TMPRSS11D | Pancreas | 0.7778 | 1 | 0.6364 | BIRC5 AND NOT-CD160 | Esophagus | 0.6923 | 0.75 | 0.6429 |
| SLC30A8 AND NOT-CSPG5 | Pancreas | 0.7778 | 1 | 0.6364 | BIRC5 AND NOT-SLC39A6 | Esophagus | 0.6 | 1 | 0.4286 |
| SLC30A8 AND NOT-GRIK1 | Pancreas | 0.7778 | 1 | 0.6364 | ITGAV AND NOT-RNF43 | Glioma | 0.9037 | 0.9242 | 0.8841 |
| SLC30A8 AND NOT-ADAM2 | Pancreas | 0.7059 | 1 | 0.5455 | ITGAV AND NOT-CLDN1 | Glioma | 0.8936 | 0.875 | 0.913 |
| SLC30A8 AND NOT-GABRG1 | Pancreas | 0.7778 | 1 | 0.6364 | ITGAV AND NOT-EPCAM | Glioma | 0.8966 | 0.8553 | 0.942 |
| SLC30A8 AND NOT-FCAMR | Pancreas | 0.7778 | 1 | 0.6364 | ITGAV AND NOT-TRPM4 | Glioma | 0.8837 | 0.95 | 0.8261 |
| SLC30A8 AND NOT-NTSR2 | Pancreas | 0.7778 | 1 | 0.6364 | ITGAV AND NOT-SLAMF7 | Glioma | 0.9489 | 0.9559 | 0.942 |
| SLC30A8 AND NOT-SLC22A12 | Pancreas | 0.7778 | 1 | 0.6364 | ITGAV AND NOT-TPBG | Glioma | 0.8321 | 0.8382 | 0.8261 |
| SLC30A8 AND NOT-GPR83 | Pancreas | 0.7778 | 1 | 0.6364 | SLC39A6 AND NOT-CLDN1 | Glioma | 0.7941 | 0.806 | 0.7826 |
| SLC30A8 AND NOT-SLC12A3 | Pancreas | 0.7778 | 1 | 0.6364 | ITGAV AND NOT-CLDN8 | Glioma | 0.9429 | 0.9296 | 0.9565 |
| SLC30A8 AND NOT-IGDCC3 | Pancreas | 0.7778 | 1 | 0.6364 | ITGAV AND NOT-ITGB6 | Glioma | 0.942 | 0.942 | 0.942 |
| SLC30A8 AND NOT-KREMEN2 | Pancreas | 0.7778 | 1 | 0.6364 | SLC39A6 AND NOT-RNF43 | Glioma | 0.7786 | 0.8226 | 0.7391 |
| SLC30A8 AND NOT-SLC34A1 | Pancreas | 0.7778 | 1 | 0.6364 | ITGAV AND NOT-RAET1E | Glioma | 0.942 | 0.942 | 0.942 |
| SLC30A8 AND NOT-DRD5 | Pancreas | 0.7778 | 1 | 0.6364 | EDNRB AND NOT-EPCAM | Glioma | 0.7704 | 0.7879 | 0.7536 |
| SLC30A8 AND NOT-MIP | Pancreas | 0.7778 | 1 | 0.6364 | ITGAV AND NOT-CLDN23 | Glioma | 0.8889 | 0.9091 | 0.8696 |
| SLC30A8 AND NOT-SLC22A2 | Pancreas | 0.7778 | 1 | 0.6364 | ITGAV AND NOT-GPNMB | Glioma | 0.8148 | 0.8333 | 0.7971 |
| SLC30A8 AND NOT-SMPD2 | Pancreas | 0.7059 | 1 | 0.5455 | ITGAV AND NOT-CLDN7 | Glioma | 0.942 | 0.942 | 0.942 |
| SLC30A8 AND NOT-PCDH11X | Pancreas | 0.7778 | 1 | 0.6364 | ITGAV AND NOT-IL20RA | Glioma | 0.8702 | 0.9194 | 0.8261 |
| SLC30A8 AND NOT-CHRNB4 | Pancreas | 0.7778 | 1 | 0.6364 | ITGAV AND NOT-CD34 | Glioma | 0.8769 | 0.9344 | 0.8261 |
| SLC30A8 AND NOT-KCNQ2 | Pancreas | 0.7778 | 1 | 0.6364 | ITGAV AND NOT-SDC1 | Glioma | 0.8966 | 0.8553 | 0.942 |
| SLC30A8 AND NOT-OR4N4 | Pancreas | 0.7778 | 1 | 0.6364 | SLC39A6 AND NOT-TRPM4 | Glioma | 0.75 | 0.8136 | 0.6957 |
| SLC30A8 AND NOT-PTGER4 | Pancreas | 0.7778 | 1 | 0.6364 | SLC39A6 AND NOT-ITGB6 | Glioma | 0.8209 | 0.8462 | 0.7971 |
| SLC30A8 AND NOT-ATP13A5 | Pancreas | 0.7778 | 1 | 0.6364 | NCAM1 AND NOT-RAET1E | Glioma | 0.7453 | 0.6522 | 0.8696 |
| SLC30A8 AND NOT-ADAM20 | Pancreas | 0.7778 | 1 | 0.6364 | ITGAV AND NOT-TNFRSF10A | Glioma | 0.9209 | 0.9143 | 0.9275 |
| SLC30A8 AND NOT-ATP6V0A4 | Pancreas | 0.7778 | 1 | 0.6364 | SLC39A6 AND NOT-SDC1 | Glioma | 0.7424 | 0.7778 | 0.7101 |
| SLC30A8 AND NOT-MMP24 | Pancreas | 0.7059 | 1 | 0.5455 | ITGAV AND NOT-ROR1 | Glioma | 0.9091 | 0.9524 | 0.8696 |
| SLC30A8 AND NOT-TAS2R1 | Pancreas | 0.7778 | 1 | 0.6364 | ITGAV AND NOT-PMEL | Glioma | 0.9362 | 0.9167 | 0.9565 |
| SLC30A8 AND NOT-CNTNAP2 | Pancreas | 0.7778 | 1 | 0.6364 | SLC39A6 AND NOT-IL20RA | Glioma | 0.7385 | 0.7869 | 0.6957 |
| SLC30A8 AND NOT-AQP6 | Pancreas | 0.7059 | 1 | 0.5455 | ITGAV AND NOT-CD52 | Glioma | 0.791 | 0.8154 | 0.7681 |
| SLC30A8 AND NOT-CNGA4 | Pancreas | 0.7778 | 1 | 0.6364 | ITGAV AND NOT-VTCN1 | Glioma | 0.9037 | 0.9242 | 0.8841 |
| SLC30A8 AND NOT-KIAA0319 | Pancreas | 0.7778 | 1 | 0.6364 | SLC39A6 AND NOT-CLDN8 | Glioma | 0.8116 | 0.8116 | 0.8116 |
| SLC30A8 AND NOT-GRM1 | Pancreas | 0.7778 | 1 | 0.6364 | ITGAV AND NOT-IL3RA | Glioma | 0.8971 | 0.9104 | 0.8841 |
| SLC30A8 AND NOT-KCNA4 | Pancreas | 0.7778 | 1 | 0.6364 | ITGAV AND NOT-CD79A | Glioma | 0.8438 | 0.9153 | 0.7826 |
| SLC30A8 AND NOT-SLC22A13 | Pancreas | 0.7778 | 1 | 0.6364 | ITGAV AND NOT-ENPP3 | Glioma | 0.9265 | 0.9403 | 0.913 |
| PPAPDC1A AND NOT-CSPG5 | Pancreas | 0.6 | 0.6667 | 0.5455 | SLC39A6 AND NOT-RAET1E | Glioma | 0.8346 | 0.9138 | 0.7681 |
| SLC30A8 AND NOT-SLC22A6 | Pancreas | 0.7778 | 1 | 0.6364 | SLC39A6 AND NOT-CLDN7 | Glioma | 0.8209 | 0.8462 | 0.7971 |
| SLC30A8 AND NOT-SLC5A10 | Pancreas | 0.7778 | 1 | 0.6364 | EDNRB AND NOT-ITGB6 | Glioma | 0.7761 | 0.8 | 0.7536 |
| SLC30A8 AND NOT-PORCN | Pancreas | 0.7778 | 1 | 0.6364 | EDNRB AND NOT-RNF43 | Glioma | 0.7231 | 0.7705 | 0.6812 |
| SLC30A8 AND NOT-FGF6 | Pancreas | 0.7778 | 1 | 0.6364 | NCAM1 AND NOT-GPA33 | Glioma | 0.7229 | 0.6186 | 0.8696 |
| SLC30A8 AND NOT-GRM3 | Pancreas | 0.7778 | 1 | 0.6364 | ITGAV AND NOT-MST1R | Glioma | 0.9343 | 0.9412 | 0.9275 |
| SLC30A8 AND NOT-ATP4B | Pancreas | 0.7778 | 1 | 0.6364 | EDNRB AND NOT-CLDN1 | Glioma | 0.7805 | 0.8889 | 0.6957 |
| SLC30A8 AND NOT-SLC22A11 | Pancreas | 0.7778 | 1 | 0.6364 | EDNRB AND NOT-SLAMF7 | Glioma | 0.8254 | 0.9123 | 0.7536 |
| SLC30A8 AND NOT-TRPM3 | Pancreas | 0.7778 | 1 | 0.6364 | EDNRB AND NOT-CLDN7 | Glioma | 0.7934 | 0.9231 | 0.6957 |
| SLC30A8 AND NOT-SLC22A14 | Pancreas | 0.7778 | 1 | 0.6364 | ITGAV AND NOT-MUC13 | Glioma | 0.8855 | 0.9355 | 0.8406 |
| SLC30A8 AND NOT-GUCY2D | Pancreas | 0.7778 | 1 | 0.6364 | EDNRB AND NOT-CLDN23 | Glioma | 0.7133 | 0.6892 | 0.7391 |
| SLC30A8 AND NOT-HRH3 | Pancreas | 0.7778 | 1 | 0.6364 | ITGAV AND NOT-CD79B | Glioma | 0.8788 | 0.9206 | 0.8406 |
| SLC30A8 AND NOT-NMBR | Pancreas | 0.7778 | 1 | 0.6364 | ITGAV AND NOT-FAP | Glioma | 0.768 | 0.8571 | 0.6957 |
| SLC30A8 AND NOT-GJA3 | Pancreas | 0.7059 | 1 | 0.5455 | ITGAV AND NOT-MET | Glioma | 0.708 | 0.9091 | 0.5797 |
| SLC30A8 AND NOT-CHRNA1 | Pancreas | 0.7778 | 1 | 0.6364 | SLC39A6 AND NOT-CLDN23 | Glioma | 0.7778 | 0.8596 | 0.7101 |
| SLC30A8 AND NOT-HTR1D | Pancreas | 0.7778 | 1 | 0.6364 | ITGAV AND NOT-ITGB3 | Glioma | 0.8254 | 0.9123 | 0.7536 |
| SLC30A8 AND NOT-CSMD3 | Pancreas | 0.625 | 1 | 0.4545 | SLC39A6 AND NOT-TPBG | Glioma | 0.704 | 0.7857 | 0.6377 |
| SLC30A8 AND NOT-KCNU1 | Pancreas | 0.7778 | 1 | 0.6364 | EDNRB AND NOT-TRPM4 | Glioma | 0.7023 | 0.7419 | 0.6667 |
| SLC30A8 AND NOT-SLC5A11 | Pancreas | 0.7778 | 1 | 0.6364 | SLC39A6 AND NOT-SLAMF7 | Glioma | 0.8661 | 0.9483 | 0.7971 |
| SLC30A8 AND NOT-TRPC7 | Pancreas | 0.7778 | 1 | 0.6364 | SLC7A5 AND NOT-CLDN1 | Glioma | 0.7 | 0.6154 | 0.8116 |
| SLC22A2 AND NOT-SLC16A5 | Renal | 0.7368 | 1 | 0.5833 | SLC39A6 AND NOT-CD52 | Glioma | 0.7 | 0.8235 | 0.6087 |
| SLC22A2 AND NOT-ATP6V0A4 | Renal | 0.7368 | 1 | 0.5833 | ITGAV AND NOT-PTK7 | Glioma | 0.8429 | 0.831 | 0.8551 |
| SLC22A2 AND NOT-UMOD | Renal | 0.7368 | 1 | 0.5833 | SLC39A6 AND NOT-TNFRSF10A | Glioma | 0.813 | 0.9259 | 0.7246 |
| GGTLC1 AND NOT-SLC16A5 | Renal | 0.75 | 0.75 | 0.75 | ITGAV AND NOT-SLC34A2 | Glioma | 0.913 | 0.913 | 0.913 |
| TNFRSF12A AND NOT-SCARA5 | Renal | 0.75 | 0.75 | 0.75 | ITGAV AND NOT-AXL | Glioma | 0.8 | 0.8182 | 0.7826 |
| SLC13A1 AND NOT-SLC5A11 | Renal | 0.6667 | 1 | 0.5 | ITGAV AND NOT-MS4A1 | Glioma | 0.9275 | 0.9275 | 0.9275 |
| SLC13A1 AND NOT-SLC16A5 | Renal | 0.6667 | 1 | 0.5 | EDNRB AND NOT-TNFRSF10A | Glioma | 0.7634 | 0.8065 | 0.7246 |
| SLC22A2 AND NOT-CASR | Renal | 0.6667 | 0.7778 | 0.5833 | ITGAV AND NOT-LGR5 | Glioma | 0.8671 | 0.8378 | 0.8986 |
| SLC13A1 AND NOT-SLC13A2 | Renal | 0.6667 | 1 | 0.5 | ITGAV AND NOT-CLDN6 | Glioma | 0.942 | 0.942 | 0.942 |
| SLC22A2 AND NOT-DIO1 | Renal | 0.6667 | 0.7778 | 0.5833 | ITGAV AND NOT-ABCB5 | Glioma | 0.9104 | 0.9385 | 0.8841 |
| SLC17A1 AND NOT-DIO1 | Renal | 0.6667 | 1 | 0.5 | ITGAV AND NOT-TNFRSF8 | Glioma | 0.913 | 0.913 | 0.913 |
| SLC6A13 AND NOT-CLDN19 | Renal | 0.6667 | 1 | 0.5 | ITGAV AND NOT-IL11RA | Glioma | 0.8777 | 0.8714 | 0.8841 |
| SLC22A2 AND NOT-SLC12A3 | Renal | 0.6667 | 0.7778 | 0.5833 | EDNRB AND NOT-CLDN8 | Glioma | 0.7259 | 0.7424 | 0.7101 |
| SLC22A2 AND NOT-SLC13A2 | Renal | 0.6667 | 0.7778 | 0.5833 | ITGAV AND NOT-TNFRSF17 | Glioma | 0.9286 | 0.9155 | 0.942 |
| SLC6A13 AND NOT-SYT6 | Renal | 0.6667 | 1 | 0.5 | EDNRB AND NOT-IL20RA | Glioma | 0.7097 | 0.8 | 0.6377 |
| SLC22A2 AND NOT-SLC22A8 | Renal | 0.6667 | 0.7778 | 0.5833 | ITGAV AND NOT-IL3RA | Glioma | 0.7619 | 0.8421 | 0.6957 |
| SLC22A2 AND NOT-SYT6 | Renal | 0.6667 | 1 | 0.5 | ITGAV AND NOT-GPA33 | Glioma | 0.9275 | 0.9275 | 0.9275 |
| SLC22A2 AND NOT-SLC5A11 | Renal | 0.6667 | 0.7778 | 0.5833 | CD276 AND NOT-RNF43 | Leiomyosarcoma | 0.7826 | 0.9 | 0.6923 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC22A2 AND NOT-GABRB1 | Renal | 0.6667 | 1 | 0.5 | CD276 AND NOT-IL20RA | Leiomyosarcoma | 0.6364 | 0.7778 | 0.5385 |
| SLC6A13 AND NOT-GPRC6A | Renal | 0.6667 | 1 | 0.5 | CD276 AND NOT-EPCAM | Leiomyosarcoma | 0.75 | 0.8182 | 0.6923 |
| SLC22A2 AND NOT-GHRHR | Renal | 0.6667 | 0.7778 | 0.5833 | FAP AND NOT-CLDN1 | Leiomyosarcoma | 0.6316 | 1 | 0.4615 |
| SLC22A2 AND NOT-NPHS2 | Renal | 0.6667 | 0.7778 | 0.5833 | FAP AND NOT-ERBB3 | Leiomyosarcoma | 0.7619 | 1 | 0.6154 |
| SLC22A2 AND NOT-OPALIN | Renal | 0.6364 | 0.7 | 0.5833 | FAP AND NOT-RNF43 | Leiomyosarcoma | 0.7619 | 1 | 0.6154 |
| SLC22A2 AND NOT-SCN1A | Renal | 0.6364 | 0.7 | 0.5833 | FAP AND NOT-CLDN6 | Leiomyosarcoma | 0.8182 | 1 | 0.6923 |
| SLC22A2 AND NOT-SLC22A25 | Renal | 0.6364 | 0.7 | 0.5833 | FAP AND NOT-IL20RA | Leiomyosarcoma | 0.6316 | 1 | 0.4615 |
| SLC22A2 AND NOT-CD207 | Renal | 0.6364 | 0.7 | 0.5833 | FAP AND NOT-CD79A | Leiomyosarcoma | 0.8182 | 1 | 0.6923 |
| SLC22A2 AND NOT-PTPRT | Renal | 0.6364 | 0.7 | 0.5833 | FAP AND NOT-EDNRB | Leiomyosarcoma | 0.7619 | 1 | 0.6154 |
| SLC6A13 AND NOT-AQP6 | Renal | 0.6316 | 0.8571 | 0.5 | FAP AND NOT-IL3RA | Leiomyosarcoma | 0.8182 | 1 | 0.6923 |
| SLC6A13 AND NOT-SLC5A11 | Renal | 0.6316 | 0.8571 | 0.5 | CD276 AND NOT-CLDN8 | Leiomyosarcoma | 0.75 | 0.8182 | 0.6923 |
| SLC6A13 AND NOT-ATP6V0A4 | Renal | 0.6316 | 0.8571 | 0.5 | FAP AND NOT-CLDN8 | Leiomyosarcoma | 0.7619 | 1 | 0.6154 |
| SLC6A13 AND NOT-SLC22A8 | Renal | 0.6316 | 0.8571 | 0.5 | FAP AND NOT-CLDN11 | Leiomyosarcoma | 0.7619 | 1 | 0.6154 |
| SLC6A13 AND NOT-KCNJ10 | Renal | 0.6316 | 0.8571 | 0.5 | FAP AND NOT-FCRL2 | Leiomyosarcoma | 0.8182 | 1 | 0.6923 |
| SLC6A13 AND NOT-SLC16A5 | Renal | 0.6316 | 0.8571 | 0.5 | FAP AND NOT-KDR | Leiomyosarcoma | 0.7619 | 1 | 0.6154 |
| SLC6A13 AND NOT-NPHS2 | Renal | 0.6316 | 0.8571 | 0.5 | CD37 AND NOT-SLAMF7 | AML | 0.8783 | 0.84 | 0.9203 |
| SLC6A13 AND NOT-SLC13A2 | Renal | 0.6316 | 0.8571 | 0.5 | CD37 AND NOT-MS4A1 | AML | 0.8743 | 0.8262 | 0.9283 |
| SLC6A13 AND NOT-SLC12A3 | Renal | 0.6316 | 0.8571 | 0.5 | CD37 AND NOT-FCRL5 | AML | 0.8731 | 0.8211 | 0.9323 |
| MMP24 AND NOT-LAMP5 | Renal | 0.6316 | 0.8571 | 0.5 | CD37 AND NOT-CR2 | AML | 0.864 | 0.802 | 0.9363 |
| SLC22A2 AND NOT-KCNK10 | Renal | 0.6087 | 0.6364 | 0.5833 | CD37 AND NOT-TNFRSF17 | AML | 0.8614 | 0.8127 | 0.9163 |
| SLC22A2 AND NOT-OR2L2 | Renal | 0.6087 | 0.6364 | 0.5833 | CD37 AND NOT-FCRL1 | AML | 0.8519 | 0.7872 | 0.9283 |
| SLC22A2 AND NOT-TRHR | Renal | 0.6087 | 0.6364 | 0.5833 | CD37 AND NOT-CD22 | AML | 0.8499 | 0.7781 | 0.9363 |
| SLC22A2 AND NOT-CHRND | Renal | 0.6087 | 0.6364 | 0.5833 | CD37 AND NOT-FCRL2 | AML | 0.8484 | 0.7756 | 0.9363 |
| TNFRSF12A AND NOT-STEAP4 | Renal | 0.8182 | 0.9 | 0.75 | CD37 AND NOT-CD19 | AML | 0.8593 | 0.8121 | 0.9124 |
| SLC22A2 AND NOT-MRGPRX2 | Renal | 0.6 | 0.75 | 0.5 | CD37 AND NOT-CD72 | AML | 0.8412 | 0.769 | 0.9283 |
| SLC22A2 AND NOT-SLC22A12 | Renal | 0.6 | 0.75 | 0.5 | CD37 AND NOT-CD79A | AML | 0.8271 | 0.7484 | 0.9243 |
| SLC22A2 AND NOT-SLC22A6 | Renal | 0.6 | 0.75 | 0.5 | CD37 AND NOT-CD79B | AML | 0.8124 | 0.7895 | 0.8367 |
| SLC22A2 AND NOT-GPR6 | Renal | 0.6 | 0.75 | 0.5 | CD37 AND NOT-IL11RA | AML | 0.8078 | 0.7879 | 0.8287 |
| FAT1 AND NOT-SLC16A5 | Renal | 0.6 | 0.75 | 0.5 | SLC7A5 AND NOT-CLDN11 | AML | 0.8053 | 0.6873 | 0.9721 |
| SLC22A2 AND NOT-USH2A | Renal | 0.6 | 0.75 | 0.5 | CD37 AND NOT-CXCR5 | AML | 0.7516 | 0.626 | 0.9402 |
| SLC6A13 AND NOT-DIO1 | Renal | 0.6 | 0.75 | 0.5 | CD37 AND NOT-CLDN5 | AML | 0.7433 | 0.6146 | 0.9402 |
| SLC6A13 AND NOT-GHRHR | Renal | 0.6 | 0.75 | 0.5 | CD37 AND NOT-ITGAV | AML | 0.7422 | 0.6313 | 0.9004 |
| SLC17A1 AND NOT-CALHM1 | Renal | 0.6 | 0.75 | 0.5 | CD37 AND NOT-KDR | AML | 0.741 | 0.6114 | 0.9402 |
| SLC6A13 AND NOT-NPHS1 | Renal | 0.6 | 0.75 | 0.5 | CD37 AND NOT-EDNRB | AML | 0.7353 | 0.6105 | 0.9243 |
| SLC17A1 AND NOT-CATSPERD | Renal | 0.6 | 0.75 | 0.5 | CD37 AND NOT-STEAP2 | AML | 0.7352 | 0.6036 | 0.9402 |
| SLC17A1 AND NOT-SLC5A11 | Renal | 0.6667 | 1 | 0.5 | CD37 AND NOT-SDC1 | AML | 0.7352 | 0.6036 | 0.9402 |
| SLC17A1 AND NOT-NPHS2 | Renal | 0.6667 | 1 | 0.5 | CD37 AND NOT-GPNMB | AML | 0.734 | 0.6139 | 0.9124 |
| SLC17A1 AND NOT-SLC12A3 | Renal | 0.6667 | 1 | 0.5 | CD37 AND NOT-AXL | AML | 0.7335 | 0.6047 | 0.9323 |
| SLC17A1 AND NOT-OR4N4 | Renal | 0.6667 | 1 | 0.5 | CD37 AND NOT-STEAP1 | AML | 0.7316 | 0.6036 | 0.9283 |
| SLC17A1 AND NOT-KCNK10 | Renal | 0.6 | 0.75 | 0.5 | CD37 AND NOT-ROR1 | AML | 0.7284 | 0.5945 | 0.9402 |
| NOX1 AND NOT-SLC9A1 | Colon | 1 | 1 | 1 | CD37 AND NOT-CLDN11 | AML | 0.725 | 0.59 | 0.9402 |
| CDH17 AND NOT-SLC9A1 | Colon | 1 | 1 | 1 | CD38 AND NOT-SLAMF7 | AML | 0.771 | 0.7399 | 0.8048 |
| NOX1 AND NOT-SLC30A10 | Colon | 0.8889 | 1 | 0.8 | CD37 AND NOT-CLDN7 | AML | 0.7217 | 0.5856 | 0.9402 |
| CDH17 AND NOT-SLC30A10 | Colon | 0.8889 | 1 | 0.8 | CD37 AND NOT-ERBB3 | AML | 0.7206 | 0.5842 | 0.9402 |
| IFI6 AND NOT-SLC1A2 | Colon | 0.9091 | 0.8333 | 1 | CD37 AND NOT-MET | AML | 0.7205 | 0.5903 | 0.9243 |
| IFI6 AND NOT-GPR26 | Colon | 0.8333 | 0.7143 | 1 | CD37 AND NOT-VCAM1 | AML | 0.7204 | 0.6134 | 0.8725 |
| FAT1 AND NOT-ENPP1 | Colon | 0.8 | 0.8 | 0.8 | CD37 AND NOT-ERBB2 | AML | 0.7195 | 0.5827 | 0.9402 |
| IFI6 AND NOT-STEAP4 | Colon | 0.8333 | 0.7143 | 1 | CD37 AND NOT-SLC34A2 | AML | 0.7173 | 0.5799 | 0.9402 |
| CDH17 AND NOT-EPHA10 | Colon | 0.8333 | 0.7143 | 1 | CD37 AND NOT-IL13RA1 | AML | 0.6968 | 0.5854 | 0.8606 |
| IFI6 AND NOT-MLC1 | Colon | 0.9091 | 0.8333 | 1 | SLC7A5 AND NOT-FOLH1 | AML | 0.7579 | 0.626 | 0.9602 |
| NOX1 AND NOT-CHRND | Colon | 0.7692 | 0.625 | 1 | CD38 AND NOT-CLDN23 | AML | 0.6787 | 0.5787 | 0.8207 |
| FAT1 AND NOT-SLC9A1 | Colon | 0.75 | 1 | 0.6 | CD38 AND NOT-CLDN5 | AML | 0.6732 | 0.5687 | 0.8247 |
| NOX1 AND NOT-BEST2 | Colon | 0.75 | 1 | 0.6 | CD38 AND NOT-ERBB2 | AML | 0.6635 | 0.555 | 0.8247 |
| IFI6 AND NOT-TTYH2 | Colon | 0.8 | 0.8 | 0.8 | P2RX5 AND NOT-SLAMF7 | AML | 0.6616 | 0.5358 | 0.8645 |
| CDH17 AND NOT-CHRND | Colon | 0.7692 | 0.625 | 1 | SLC7A5 AND NOT-BMPR1B | AML | 0.7397 | 0.5985 | 0.9681 |
| IFI6 AND NOT-KCNV2 | Colon | 0.9091 | 0.8333 | 1 | CD38 AND NOT-CLDN7 | AML | 0.6551 | 0.5433 | 0.8247 |
| IFI6 AND NOT-S1PR1 | Colon | 0.7273 | 0.6667 | 0.8 | CD38 AND NOT-CLDN8 | AML | 0.6551 | 0.5433 | 0.8247 |
| IFI6 AND NOT-CLDN10 | Colon | 0.75 | 1 | 0.6 | CD38 AND NOT-RNF43 | AML | 0.653 | 0.5405 | 0.8247 |
| IFI6 AND NOT-SLC23A2 | Colon | 0.75 | 1 | 0.6 | CD38 AND NOT-CD19 | AML | 0.7034 | 0.6201 | 0.8127 |
| FAT1 AND NOT-SLC16A5 | Colon | 0.8 | 0.8 | 0.8 | CD38 AND NOT-EGFR | AML | 0.6509 | 0.5377 | 0.8247 |
| IFI6 AND NOT-CD36 | Colon | 0.8333 | 0.7143 | 1 | CD38 AND NOT-ITGB6 | AML | 0.6479 | 0.5335 | 0.8247 |
| NOX1 AND NOT-EPHA10 | Colon | 0.7143 | 0.5556 | 1 | CD38 AND NOT-EPCAM | AML | 0.6455 | 0.537 | 0.8088 |
| IFI6 AND NOT-GYPC | Colon | 0.7273 | 0.6667 | 0.8 | CD38 AND NOT-CLDN1 | AML | 0.6419 | 0.5254 | 0.8247 |
| NOX1 AND NOT-GABRB2 | Colon | 1 | 1 | 1 | CD38 AND NOT-IL20RA | AML | 0.6409 | 0.5241 | 0.8247 |
| CDH17 AND NOT-GABRB2 | Colon | 0.9091 | 0.8333 | 1 | SLC7A5 AND NOT-EGFR | AML | 0.6404 | 0.4775 | 0.9721 |
| CDH17 AND NOT-DISP2 | Colon | 1 | 1 | 1 | CD38 AND NOT-TRPM4 | AML | 0.6403 | 0.5316 | 0.8048 |
| NOX1 AND NOT-SLC16A5 | Colon | 0.8889 | 1 | 0.8 | SLC7A5 AND NOT-CLDN23 | AML | 0.6402 | 0.4792 | 0.9641 |
| CDH17 AND NOT-SLC16A5 | Colon | 0.8889 | 1 | 0.8 | CD276 AND NOT-CLDN1 | Liposarcoma | 0.7429 | 0.7647 | 0.7222 |
| FAT1 AND NOT-SLC22A5 | Colon | 0.8 | 0.8 | 0.8 | ROR1 AND NOT-MET | Liposarcoma | 0.6545 | 0.9474 | 0.5 |
| IFI6 AND NOT-OXTR | Colon | 0.8889 | 1 | 0.8 | ROR1 AND NOT-SLC7A5 | Liposarcoma | 0.6316 | 0.8571 | 0.5 |
| IFI6 AND NOT-SLC6A15 | Colon | 0.7273 | 0.6667 | 0.8 | EPHB2 AND NOT-MUC13 | Liposarcoma | 0.6757 | 0.6579 | 0.6944 |
| IFI6 AND NOT-PAQR7 | Colon | 0.9091 | 0.8333 | 1 | ROR1 AND NOT-EPCAM | Liposarcoma | 0.6207 | 0.8182 | 0.5 |
| NOX1 AND NOT-DISP2 | Colon | 1 | 1 | 1 | ROR1 AND NOT-SLC34A2 | Liposarcoma | 0.6182 | 0.8947 | 0.4722 |
| IFI6 AND NOT-CHRND | Colon | 0.8333 | 0.7143 | 1 | ROR1 AND NOT-CD52 | Liposarcoma | 0.6 | 0.75 | 0.5 |
| NOX1 AND NOT-ATP8A1 | Colon | 0.8889 | 1 | 0.8 | EPHB2 AND NOT-GPA33 | Liposarcoma | 0.6301 | 0.6216 | 0.6389 |
| IFI6 AND NOT-SLCO6A1 | Colon | 0.9091 | 0.8333 | 1 | EPHB2 AND NOT-CLDN7 | Liposarcoma | 0.6667 | 0.5686 | 0.8056 |
| FAT1 AND NOT-MMP24 | Colon | 0.6667 | 0.5714 | 0.8 | CD276 AND NOT-PROM1 | Liposarcoma | 0.7778 | 0.7778 | 0.7778 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NOX1 AND NOT-CDH10 | Colon | 0.6667 | 0.5 | 1 | CD276 AND NOT-ERBB2 | Liposarcoma | 0.6471 | 0.6875 | 0.6111 |
| IFI6 AND NOT-GPR85 | Colon | 0.75 | 1 | 0.6 | EPHB2 AND NOT-TRPM4 | Liposarcoma | 0.6024 | 0.5319 | 0.6944 |
| NOX1 AND NOT-CLDN10 | Colon | 0.6667 | 0.75 | 0.6 | CD276 AND NOT-EGFR | Liposarcoma | 0.8533 | 0.8205 | 0.8889 |
| MUC12 AND NOT-CLDN10 | Colon | 0.6667 | 0.75 | 0.6 | CD276 AND NOT-SDC1 | Liposarcoma | 0.6757 | 0.6579 | 0.6944 |
| MUC12 AND NOT-EPHA10 | Colon | 0.6667 | 0.75 | 0.6 | CD276 AND NOT-MET | Liposarcoma | 0.6667 | 0.7778 | 0.5833 |
| CDH17 AND NOT-CLDN10 | Colon | 0.6667 | 0.75 | 0.6 | CD276 AND NOT-IGF1R | Liposarcoma | 0.8312 | 0.7805 | 0.8889 |
| FUT3 AND NOT-CLDN10 | Colon | 0.6667 | 0.75 | 0.6 | CD276 AND NOT-SLC34A2 | Liposarcoma | 0.7674 | 0.66 | 0.9167 |
| IFI6 AND NOT-MOG | Colon | 0.8333 | 0.7143 | 1 | CD276 AND NOT-SLC7A5 | Liposarcoma | 0.6133 | 0.5897 | 0.6389 |
| IFI6 AND NOT-MDGA2 | Colon | 0.9091 | 0.8333 | 1 | SLC34A2 AND NOT-ERBB4 | Lung Adenocarcinoma | 0.6179 | 0.717 | 0.5429 |
| IFI6 AND NOT-TSHR | Colon | 0.8333 | 0.7143 | 1 | SLC34A2 AND NOT-BMPR1B | Lung Adenocarcinoma | 0.6125 | 0.5444 | 0.7 |
| IFI6 AND NOT-OPRK1 | Colon | 0.8333 | 0.7143 | 1 | SLC34A2 AND NOT-CLDN8 | Lung Adenocarcinoma | 0.6316 | 0.5854 | 0.6857 |
| IFI6 AND NOT-GRIN2C | Colon | 0.7692 | 0.625 | 1 | SLC34A2 AND NOT-ABCA5 | Lung Adenocarcinoma | 0.6093 | 0.5679 | 0.6571 |
| CDH17 AND NOT-ATP8A1 | Colon | 0.8889 | 1 | 0.8 | SLC34A2 AND NOT-MUC16 | Lung Adenocarcinoma | 0.6 | 0.5333 | 0.6857 |
| FAT1 AND NOT-GABRA2 | Colon | 0.75 | 1 | 0.6 | SLC34A2 AND NOT-PSCA | Lung Adenocarcinoma | 0.6093 | 0.5679 | 0.6571 |
| IFI6 AND NOT-LRRTM4 | Colon | 0.75 | 1 | 0.6 | SLC34A2 AND NOT-SSTR4 | Lung Adenocarcinoma | 0.6667 | 0.6145 | 0.7286 |
| IFI6 AND NOT-GABRA5 | Colon | 0.8333 | 0.7143 | 1 | SLC34A2 AND NOT-GPA33 | Lung Adenocarcinoma | 0.6508 | 0.7321 | 0.5857 |
| NOX1 AND NOT-PCDHA6 | Colon | 1 | 1 | 1 | CD79A AND NOT-ITGB3 | B-Cell Diffuse | 0.6957 | 0.75 | 0.6486 |
| IFI6 AND NOT-SLC9B1 | Colon | 0.9091 | 0.8333 | 1 | CD79B AND NOT-ITGB3 | B-Cell Diffuse | 0.6944 | 0.7143 | 0.6757 |
| CDH17 AND NOT-KIRREL3 | Colon | 0.75 | 1 | 0.6 | CD79B AND NOT-CD33 | B-Cell Diffuse | 0.6765 | 0.7419 | 0.6216 |
| IFI6 AND NOT-DYSF | Colon | 0.7273 | 0.6667 | 0.8 | CXCR5 AND NOT-GPA33 | B-Cell Diffuse | 0.6667 | 0.6579 | 0.6757 |
| NOX1 AND NOT-KIRREL3 | Colon | 0.75 | 1 | 0.6 | IL2RA AND NOT-GPA33 | B-Cell Diffuse | 0.6984 | 0.8462 | 0.5946 |
| FAT1 AND NOT-SLC13A2 | Colon | 0.8 | 0.8 | 0.8 | CD79A AND NOT-CD33 | B-Cell Diffuse | 0.6571 | 0.697 | 0.6216 |
| FAT1 AND NOT-ANPEP | Colon | 0.75 | 1 | 0.6 | CD180 AND NOT-CD33 | B-Cell Diffuse | 0.6479 | 0.6765 | 0.6216 |
| IFI6 AND NOT-DSC1 | Colon | 0.9091 | 0.8333 | 1 | P2RX5 AND NOT-ITGB3 | B-Cell Diffuse | 0.6829 | 0.6222 | 0.7568 |
| CDH17 AND NOT-ABHD3 | Colon | 0.8889 | 1 | 0.8 | IL2RA AND NOT-NCAM1 | B-Cell Diffuse | 0.6667 | 0.6857 | 0.6486 |
| CDH17 AND NOT-CD1B | Colon | 0.625 | 0.4545 | 1 | FCRL5 AND NOT-NCAM1 | B-Cell Diffuse | 0.6575 | 0.6667 | 0.6486 |
| IFI6 AND NOT-PIRT | Colon | 0.8333 | 0.7143 | 1 | IL2RA AND NOT-ITGB3 | B-Cell Diffuse | 0.6774 | 0.84 | 0.5676 |
| NOX1 AND NOT-CD1B | Colon | 0.625 | 0.4545 | 1 | FCRL5 AND NOT-ITGB3 | B-Cell Diffuse | 0.6933 | 0.6842 | 0.7027 |
| FUT3 AND NOT-CHRND | Colon | 0.625 | 0.4545 | 1 | VCAM1 AND NOT-CLDN1 | B-Cell Diffuse | 0.6329 | 0.5952 | 0.6757 |
| GRIN2A AND NOT-ATP2B2 | Ependymoma | 1 | 1 | 1 | CD79B AND NOT-NCAM1 | B-Cell Diffuse | 0.6301 | 0.6389 | 0.6216 |
| GRIN2A AND NOT-ANO4 | Ependymoma | 1 | 1 | 1 | P2RX5 AND NOT-CD33 | B-Cell Diffuse | 0.6585 | 0.6 | 0.7297 |
| GRIN2A AND NOT-SYT4 | Ependymoma | 1 | 1 | 1 | CD180 AND NOT-ITGB3 | B-Cell Diffuse | 0.6269 | 0.7 | 0.5676 |
| GRIN2A AND NOT-NKAIN2 | Ependymoma | 1 | 1 | 1 | CD79A AND NOT-GPA33 | B-Cell Diffuse | 0.623 | 0.7917 | 0.5135 |
| GRIN2A AND NOT-GRM5 | Ependymoma | 1 | 1 | 1 | CD72 AND NOT-CD33 | B-Cell Diffuse | 0.6176 | 0.6774 | 0.5676 |
| GRIN2A AND NOT-SCN2A | Ependymoma | 1 | 1 | 1 | CD79B AND NOT-GPA33 | B-Cell Diffuse | 0.6176 | 0.6774 | 0.5676 |
| GRIN2A AND NOT-SCN1A | Ependymoma | 1 | 1 | 1 | CXCR5 AND NOT-ITGB3 | B-Cell Diffuse | 0.6897 | 0.6 | 0.8108 |
| GRIN2A AND NOT-PTPRR | Ependymoma | 1 | 1 | 1 | VCAM1 AND NOT-SDC1 | B-Cell Diffuse | 0.6098 | 0.5556 | 0.6757 |
| GRIN2A AND NOT-GABRA1 | Ependymoma | 1 | 1 | 1 | VCAM1 AND NOT-CLDN11 | B-Cell Diffuse | 0.6667 | 0.6579 | 0.6757 |
| GRIN2A AND NOT-GABRA2 | Ependymoma | 1 | 1 | 1 | CD72 AND NOT-NCAM1 | B-Cell Diffuse | 0.6027 | 0.6111 | 0.5946 |
| GRIN2A AND NOT-GABRA4 | Ependymoma | 1 | 1 | 1 | IL2RA AND NOT-IL20RA | B-Cell Diffuse | 0.6582 | 0.619 | 0.7027 |
| GRIN2A AND NOT-GABRB2 | Ependymoma | 1 | 1 | 1 | IL2RA AND NOT-MSLN | B-Cell Diffuse | 0.6667 | 0.6136 | 0.7297 |
| GRIN2A AND NOT-SLC12A5 | Ependymoma | 1 | 1 | 1 | IL2RA AND NOT-CLDN9 | Anaplastic Lymphoma | 0.6923 | 0.8182 | 0.6 |
| GRIN2A AND NOT-SLC24A2 | Ependymoma | 1 | 1 | 1 | IL2RA AND NOT-ERBB3 | Anaplastic Lymphoma | 0.6667 | 0.75 | 0.6 |
| GRIN2A AND NOT-CNTNAP2 | Ependymoma | 1 | 1 | 1 | IL2RA AND NOT-ITGB3 | Anaplastic Lymphoma | 0.6667 | 0.8889 | 0.5333 |
| GRIN2A AND NOT-JPH3 | Ependymoma | 1 | 1 | 1 | IL2RA AND NOT-CLDN2 | Anaplastic Lymphoma | 0.6923 | 0.8182 | 0.6 |
| GRIN2A AND NOT-ATP8A2 | Ependymoma | 1 | 1 | 1 | IL2RA AND NOT-CLDN6 | Anaplastic Lymphoma | 0.6154 | 0.7273 | 0.5333 |
| GRIN2A AND NOT-PCDH8 | Ependymoma | 1 | 1 | 1 | IL2RA AND NOT-GUCY2C | Anaplastic Lymphoma | 0.6154 | 0.7273 | 0.5333 |
| GRIN2A AND NOT-TMEM235 | Ependymoma | 1 | 1 | 1 | IL2RA AND NOT-ULBP1 | Anaplastic Lymphoma | 0.6154 | 0.7273 | 0.5333 |
| GRIN2A AND NOT-KCNC1 | Ependymoma | 1 | 1 | 1 | IL2RA AND NOT-SSTR1 | Anaplastic Lymphoma | 0.6667 | 0.75 | 0.6 |
| GRIN2A AND NOT-GRM7 | Ependymoma | 1 | 1 | 1 | IL2RA AND NOT-CLDN18 | Anaplastic Lymphoma | 0.6667 | 0.75 | 0.6 |
| GRIN2A AND NOT-SLC32A1 | Ependymoma | 1 | 1 | 1 | IL2RA AND NOT-IL20RA | Anaplastic Lymphoma | 0.6154 | 0.7273 | 0.5333 |
| GRIN2A AND NOT-SCN8A | Ependymoma | 1 | 1 | 1 | IL2RA AND NOT-CSPG4 | Anaplastic Lymphoma | 0.6154 | 0.7273 | 0.5333 |
| GRIN2A AND NOT-GRM3 | Ependymoma | 1 | 1 | 1 | IL2RA AND NOT-LGR5 | Anaplastic Lymphoma | 0.6429 | 0.6923 | 0.6 |
| GRIN2A AND NOT-CSMD2 | Ependymoma | 1 | 1 | 1 | IL2RA AND NOT-MUC4 | Anaplastic Lymphoma | 0.6667 | 0.75 | 0.6 |
| GRIN2A AND NOT-CACNG3 | Ependymoma | 1 | 1 | 1 | IL2RA AND NOT-SSTR3 | Anaplastic Lymphoma | 0.6667 | 0.75 | 0.6 |
| GRIN2A AND NOT-UNC5A | Ependymoma | 1 | 1 | 1 | IL2RA AND NOT-TNFRSF13C | Anaplastic Lymphoma | 0.6154 | 0.7273 | 0.5333 |
| GRIN2A AND NOT-CDH18 | Ependymoma | 1 | 1 | 1 | IL2RA AND NOT-MSLN | Anaplastic Lymphoma | 0.6667 | 0.75 | 0.6 |
| GRIN2A AND NOT-KCNV1 | Ependymoma | 1 | 1 | 1 | IL2RA AND NOT-CLDN23 | Anaplastic Lymphoma | 0.6957 | 1 | 0.5333 |
| GRIN2A AND NOT-OPCML | Ependymoma | 1 | 1 | 1 | IL2RA AND NOT-GPA33 | Anaplastic Lymphoma | 0.6667 | 0.75 | 0.6 |
| GRIN2A AND NOT-KCNJ6 | Ependymoma | 0.6667 | 0.5 | 1 | IL2RA AND NOT-BMPR1B | Anaplastic Lymphoma | 0.6667 | 0.75 | 0.6 |
| GRIN2A AND NOT-CACNG8 | Ependymoma | 0.6667 | 0.5 | 1 | IL2RA AND NOT-SLC34A2 | Anaplastic Lymphoma | 0.6429 | 0.6923 | 0.6 |
| GRIN2A AND NOT-HCN1 | Ependymoma | 0.6667 | 0.5 | 1 | IL2RA AND NOT-SSTR5 | Anaplastic Lymphoma | 0.6667 | 0.75 | 0.6 |
| GRIN2A AND NOT-OPALIN | Ependymoma | 1 | 1 | 1 | IL2RA AND NOT-MUC16 | Anaplastic Lymphoma | 0.6154 | 0.7273 | 0.5333 |
| MEGF10 AND NOT-NKAIN2 | Ependymoma | 1 | 1 | 1 | IL2RA AND NOT-ITGB6 | Anaplastic Lymphoma | 0.6667 | 0.75 | 0.6 |
| GRIN2A AND NOT-CNTNAP4 | Ependymoma | 1 | 1 | 1 | IL2RA AND NOT-PMEL | Anaplastic Lymphoma | 0.6667 | 0.75 | 0.6 |
| GRIN2A AND NOT-GABRG2 | Ependymoma | 1 | 1 | 1 | IL2RA AND NOT-IL13RA1 | Anaplastic Lymphoma | 0.6154 | 0.7273 | 0.5333 |
| MEGF10 AND NOT-SEMA4D | Ependymoma | 1 | 1 | 1 | IL2RA AND NOT-ERBB2 | Anaplastic Lymphoma | 0.6667 | 0.75 | 0.6 |
| TNFRSF10B AND NOT-KCNK6 | Ependymoma | 1 | 1 | 1 | IL2RA AND NOT-CXCR5 | Anaplastic Lymphoma | 0.6429 | 0.6923 | 0.6 |
| GRIN2A AND NOT-ASTN1 | Ependymoma | 1 | 1 | 1 | IL2RA AND NOT-TNFRSF10A | Anaplastic Lymphoma | 0.6667 | 0.75 | 0.6 |
| TNFRSF10B AND NOT-IFNAR2 | Ependymoma | 1 | 1 | 1 | IL2RA AND NOT-FCRL1 | Anaplastic Lymphoma | 0.6429 | 0.6923 | 0.6 |
| GRIN2A AND NOT-GPR158 | Ependymoma | 1 | 1 | 1 | IL2RA AND NOT-CD22 | Anaplastic Lymphoma | 0.6429 | 0.6923 | 0.6 |
| TNFRSF10B AND NOT-SLC50A1 | Ependymoma | 0.6667 | 0.5 | 1 | IL2RA AND NOT-CA9 | Anaplastic Lymphoma | 0.6429 | 0.6923 | 0.6 |
| TNFRSF10B AND NOT-CD58 | Ependymoma | 1 | 1 | 1 | IL2RA AND NOT-SSTR4 | Anaplastic Lymphoma | 0.6429 | 0.6923 | 0.6 |
| GRIN2A AND NOT-CDH10 | Ependymoma | 1 | 1 | 1 | IL2RA AND NOT-NCAM1 | Anaplastic Lymphoma | 0.6667 | 0.75 | 0.6 |
| SLCO1B3 AND NOT-SLC1A2 | Esophagus | 0.6667 | 1 | 0.5 | IL2RA AND NOT-ABCB5 | Anaplastic Lymphoma | 0.6667 | 0.75 | 0.6 |
| SLCO1B3 AND NOT-ABCG8 | Esophagus | 0.6667 | 1 | 0.5 | IL2RA AND NOT-VTCN1 | Anaplastic Lymphoma | 0.6429 | 0.6923 | 0.6 |
| SLCO1B3 AND NOT-SLC23A2 | Esophagus | 0.6 | 1 | 0.4286 | IL2RA AND NOT-EGFR | Anaplastic Lymphoma | 0.6667 | 0.75 | 0.6 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLCO1B3 AND NOT-ATP2B2 | Esophagus | 0.6 | 1 | 0.4286 | IL2RA AND NOT-CD180 | Anaplastic Lymphoma | 0.6429 | 0.6923 | 0.6 |
| SLCO1B3 AND NOT-DIO1 | Esophagus | 0.6667 | 1 | 0.5 | IL2RA AND NOT-EDNRB | Anaplastic Lymphoma | 0.6429 | 0.6923 | 0.6 |
| SLCO1B3 AND NOT-SLC30A10 | Esophagus | 0.6667 | 1 | 0.5 | IL2RA AND NOT-EPHB2 | Anaplastic Lymphoma | 0.6207 | 0.6429 | 0.6 |
| SLCO1B3 AND NOT-SLC22A9 | Esophagus | 0.6 | 1 | 0.4286 | IL2RA AND NOT-ENPP3 | Anaplastic Lymphoma | 0.6923 | 0.8182 | 0.6 |
| SLCO1B3 AND NOT-SLC17A2 | Esophagus | 0.6667 | 1 | 0.5 | IL2RA AND NOT-CLDN1 | Anaplastic Lymphoma | 0.6207 | 0.6429 | 0.6 |
| SLCO1B3 AND NOT-SLC10A1 | Esophagus | 0.6667 | 1 | 0.5 | IL2RA AND NOT-CD19 | Anaplastic Lymphoma | 0.6207 | 0.6429 | 0.6 |
| SLCO1B3 AND NOT-TRPM8 | Esophagus | 0.6364 | 0.875 | 0.5 | IL2RA AND NOT-MET | Anaplastic Lymphoma | 0.6667 | 0.75 | 0.6 |
| MUC17 AND NOT-FXYD7 | Esophagus | 0.6364 | 0.875 | 0.5 | IL2RA AND NOT-EPHA3 | Anaplastic Lymphoma | 0.6207 | 0.6429 | 0.6 |
| SLCO1B3 AND NOT-SLC28A1 | Esophagus | 0.6 | 1 | 0.4286 | IL2RA AND NOT-MUC1 | Anaplastic Lymphoma | 0.6207 | 0.6429 | 0.6 |
| SLCO1B3 AND NOT-CYP4A11 | Esophagus | 0.6667 | 1 | 0.5 | IL2RA AND NOT-IL11RA | Anaplastic Lymphoma | 0.6429 | 0.6923 | 0.6 |
| SLCO1B3 AND NOT-GHR | Esophagus | 0.6364 | 0.875 | 0.5 | IL2RA AND NOT-ROR1 | Anaplastic Lymphoma | 0.6667 | 0.75 | 0.6 |
| MUC17 AND NOT-ABHD3 | Esophagus | 0.6364 | 0.875 | 0.5 | IL2RA AND NOT-CLDN8 | Anaplastic Lymphoma | 0.6667 | 0.75 | 0.6 |
| MUC17 AND NOT-SLC30A10 | Esophagus | 0.88 | 1 | 0.7857 | IL2RA AND NOT-L1CAM | Anaplastic Lymphoma | 0.6207 | 0.6429 | 0.6 |
| MUC17 AND NOT-SLC22A5 | Esophagus | 0.7273 | 1 | 0.5714 | TNFRSF8 AND NOT-ULBP1 | Anaplastic Lymphoma | 0.7586 | 0.7857 | 0.7333 |
| MUC17 AND NOT-ABCG8 | Esophagus | 0.75 | 0.9 | 0.6429 | IL2RA AND NOT-RAET1E | Anaplastic Lymphoma | 0.6087 | 0.875 | 0.4667 |
| SLCO1B3 AND NOT-SLC13A5 | Esophagus | 0.6667 | 1 | 0.5 | TNFRSF8 AND NOT-SSTR4 | Anaplastic Lymphoma | 0.875 | 0.8235 | 0.9333 |
| MUC17 AND NOT-SLC5A11 | Esophagus | 0.6957 | 0.8889 | 0.5714 | TNFRSF8 AND NOT-CLDN9 | Anaplastic Lymphoma | 0.8 | 0.8 | 0.8 |
| MUC17 AND NOT-CD36 | Esophagus | 0.7273 | 1 | 0.5714 | TNFRSF8 AND NOT-TNFRSF13C | Anaplastic Lymphoma | 0.8387 | 0.8125 | 0.8667 |
| LYPD1 AND NOT-CNTNAP2 | Glioblastoma | 0.8 | 0.7778 | 0.8235 | TNFRSF8 AND NOT-CLDN6 | Anaplastic Lymphoma | 0.875 | 0.8235 | 0.9333 |
| LYPD1 AND NOT-GRM5 | Glioblastoma | 0.7368 | 0.6667 | 0.8235 | TNFRSF8 AND NOT-RAET1E | Anaplastic Lymphoma | 0.8 | 0.8 | 0.8 |
| LYPD1 AND NOT-KIAA0319 | Glioblastoma | 0.7742 | 0.8571 | 0.7059 | TNFRSF8 AND NOT-ERBB3 | Anaplastic Lymphoma | 0.875 | 0.8235 | 0.9333 |
| LYPD1 AND NOT-CDH8 | Glioblastoma | 0.75 | 0.8 | 0.7059 | TNFRSF8 AND NOT-SLC34A2 | Anaplastic Lymphoma | 0.8387 | 0.8125 | 0.8667 |
| LYPD1 AND NOT-ATP8A2 | Glioblastoma | 0.7273 | 0.75 | 0.7059 | TNFRSF8 AND NOT-GUCY2C | Anaplastic Lymphoma | 0.8387 | 0.8125 | 0.8667 |
| LYPD1 AND NOT-GABRG1 | Glioblastoma | 0.8125 | 0.8667 | 0.7647 | TNFRSF8 AND NOT-IGF1R | Anaplastic Lymphoma | 0.8387 | 0.8125 | 0.8667 |
| LYPD1 AND NOT-GRM3 | Glioblastoma | 0.7273 | 0.75 | 0.7059 | TNFRSF8 AND NOT-CD33 | Anaplastic Lymphoma | 0.8889 | 1 | 0.8 |
| LYPD1 AND NOT-NKAIN2 | Glioblastoma | 0.7059 | 0.7059 | 0.7059 | TNFRSF8 AND NOT-SSTR1 | Anaplastic Lymphoma | 0.875 | 0.8235 | 0.9333 |
| LYPD1 AND NOT-SYT4 | Glioblastoma | 0.7568 | 0.7 | 0.8235 | TNFRSF8 AND NOT-CD180 | Anaplastic Lymphoma | 0.9655 | 1 | 0.9333 |
| LYPD1 AND NOT-SLC6A15 | Glioblastoma | 0.7027 | 0.65 | 0.7647 | TNFRSF8 AND NOT-ITGB3 | Anaplastic Lymphoma | 0.9286 | 1 | 0.8667 |
| LYPD1 AND NOT-CACNA1B | Glioblastoma | 0.7027 | 0.65 | 0.7647 | TNFRSF8 AND NOT-ERBB2 | Anaplastic Lymphoma | 0.875 | 0.8235 | 0.9333 |
| LYPD1 AND NOT-DGKE | Glioblastoma | 0.7027 | 0.65 | 0.7647 | TNFRSF8 AND NOT-ENPP3 | Anaplastic Lymphoma | 0.9655 | 1 | 0.9333 |
| LYPD1 AND NOT-CALN1 | Glioblastoma | 0.6875 | 0.7333 | 0.6471 | TNFRSF8 AND NOT-IL13RA1 | Anaplastic Lymphoma | 0.8387 | 0.8125 | 0.8667 |
| LYPD1 AND NOT-ATP2B2 | Glioblastoma | 0.6857 | 0.6667 | 0.7059 | TNFRSF8 AND NOT-TNFRSF10A | Anaplastic Lymphoma | 0.875 | 0.8235 | 0.9333 |
| LYPD1 AND NOT-SCN2A | Glioblastoma | 0.6857 | 0.6667 | 0.7059 | TNFRSF8 AND NOT-CD79B | Anaplastic Lymphoma | 0.9333 | 0.9333 | 0.9333 |
| LYPD1 AND NOT-SCN8A | Glioblastoma | 0.6857 | 0.6667 | 0.7059 | TNFRSF8 AND NOT-SLAMF7 | Anaplastic Lymphoma | 0.7857 | 0.8462 | 0.7333 |
| LYPD1 AND NOT-TRPM3 | Glioblastoma | 0.7179 | 0.6364 | 0.8235 | MS4A1 AND NOT-SSTR2 | Mantle-Cell Lymphoma | 0.8941 | 0.8085 | 1 |
| LYPD1 AND NOT-AJAP1 | Glioblastoma | 0.6842 | 0.619 | 0.7647 | MS4A1 AND NOT-TNFRSF8 | Mantle-Cell Lymphoma | 0.8506 | 0.7551 | 0.9737 |
| LYPD1 AND NOT-PPAPDC1B | Glioblastoma | 0.6829 | 0.5833 | 0.8235 | MS4A1 AND NOT-CLDN8 | Mantle-Cell Lymphoma | 0.8315 | 0.7255 | 0.9737 |
| LYPD1 AND NOT-GABRA2 | Glioblastoma | 0.6667 | 0.5909 | 0.7647 | CD52 AND NOT-CD33 | Mantle-Cell Lymphoma | 0.8675 | 0.8 | 0.9474 |
| LYPD1 AND NOT-ANO4 | Glioblastoma | 0.6667 | 0.6875 | 0.6471 | MS4A1 AND NOT-MST1R | Mantle-Cell Lymphoma | 0.814 | 0.7292 | 0.9211 |
| LYPD1 AND NOT-SLC6A6 | Glioblastoma | 0.6667 | 0.56 | 0.8235 | MS4A1 AND NOT-SLAMF7 | Mantle-Cell Lymphoma | 0.809 | 0.7059 | 0.9474 |
| LYPD1 AND NOT-PPAPDC1A | Glioblastoma | 0.6667 | 0.56 | 0.8235 | CD52 AND NOT-NCAM1 | Mantle-Cell Lymphoma | 0.8537 | 0.7955 | 0.9211 |
| LYPD1 AND NOT-NFASC | Glioblastoma | 0.6667 | 0.56 | 0.8235 | CXCR5 AND NOT-TNFRSF8 | Mantle-Cell Lymphoma | 0.7937 | 1 | 0.6579 |
| LYPD1 AND NOT-ATP8B1 | Glioblastoma | 0.6667 | 0.56 | 0.8235 | CXCR5 AND NOT-ITGB3 | Mantle-Cell Lymphoma | 0.7937 | 1 | 0.6579 |
| SYT11 AND NOT-SLC6A15 | Glioma | 0.9481 | 0.9697 | 0.9275 | CXCR5 AND NOT-NCAM1 | Mantle-Cell Lymphoma | 0.7937 | 1 | 0.6579 |
| SYT11 AND NOT-CDH8 | Glioma | 0.9645 | 0.9444 | 0.9855 | CXCR5 AND NOT-ITGB6 | Mantle-Cell Lymphoma | 0.7937 | 1 | 0.6579 |
| SYT11 AND NOT-DGKE | Glioma | 0.9781 | 0.9853 | 0.971 | CXCR5 AND NOT-MUC4 | Mantle-Cell Lymphoma | 0.7937 | 1 | 0.6579 |
| SYT11 AND NOT-SCN8A | Glioma | 0.964 | 0.9571 | 0.971 | MS4A1 AND NOT-TRPM4 | Mantle-Cell Lymphoma | 0.7912 | 0.6792 | 0.9474 |
| SYT11 AND NOT-ATP8A2 | Glioma | 0.9853 | 1 | 0.971 | MS4A1 AND NOT-CLDN6 | Mantle-Cell Lymphoma | 0.7901 | 0.7442 | 0.8421 |
| SYT11 AND NOT-SLC32A1 | Glioma | 0.9496 | 0.9429 | 0.9565 | P2RX5 AND NOT-TNFRSF17 | Mantle-Cell Lymphoma | 0.7865 | 0.6863 | 0.9211 |
| SYT11 AND NOT-GRM1 | Glioma | 0.9496 | 0.9429 | 0.9565 | TNFRSF13C AND NOT-TNFRSF8 | Mantle-Cell Lymphoma | 0.8132 | 0.6981 | 0.9737 |
| SYT11 AND NOT-KIAA0319 | Glioma | 0.9559 | 0.9701 | 0.942 | CXCR5 AND NOT-CLDN2 | Mantle-Cell Lymphoma | 0.7813 | 0.9615 | 0.6579 |
| SYT11 AND NOT-ABCG4 | Glioma | 0.9781 | 0.9853 | 0.971 | CXCR5 AND NOT-ULBP1 | Mantle-Cell Lymphoma | 0.7813 | 0.9615 | 0.6579 |
| SYT11 AND NOT-KCNA2 | Glioma | 0.9714 | 0.9577 | 0.9855 | CXCR5 AND NOT-SSTR5 | Mantle-Cell Lymphoma | 0.7813 | 0.9615 | 0.6579 |
| SYT11 AND NOT-CACNA1B | Glioma | 0.971 | 0.971 | 0.971 | CD70 AND NOT-ITGB3 | Mantle-Cell Lymphoma | 0.8986 | 1 | 0.8158 |
| SYT11 AND NOT-NKAIN2 | Glioma | 0.9853 | 1 | 0.971 | CD70 AND NOT-ITGB6 | Mantle-Cell Lymphoma | 0.8986 | 1 | 0.8158 |
| SYT11 AND NOT-GPR26 | Glioma | 0.9571 | 0.9437 | 0.971 | CD70 AND NOT-ENG | Mantle-Cell Lymphoma | 0.8986 | 1 | 0.8158 |
| SYT11 AND NOT-HCN1 | Glioma | 0.9781 | 0.9853 | 0.971 | CD70 AND NOT-SLC39A6 | Mantle-Cell Lymphoma | 0.8986 | 1 | 0.8158 |
| SYT11 AND NOT-KCNA1 | Glioma | 0.9853 | 1 | 0.971 | CD70 AND NOT-IL13RA1 | Mantle-Cell Lymphoma | 0.8986 | 1 | 0.8158 |
| SYT11 AND NOT-CACNA1E | Glioma | 0.9496 | 0.9429 | 0.9565 | CD79B AND NOT-TNFRSF8 | Mantle-Cell Lymphoma | 0.7778 | 0.8235 | 0.7368 |
| SYT11 AND NOT-ATP2B2 | Glioma | 0.9571 | 0.9437 | 0.971 | CD70 AND NOT-BMPR1B | Mantle-Cell Lymphoma | 0.8986 | 1 | 0.8158 |
| SYT11 AND NOT-KCNJ6 | Glioma | 0.9571 | 0.9437 | 0.971 | CD70 AND NOT-IL20RA | Mantle-Cell Lymphoma | 0.8986 | 1 | 0.8158 |
| SYT11 AND NOT-CNTNAP2 | Glioma | 0.971 | 0.971 | 0.971 | CD72 AND NOT-ITGB3 | Mantle-Cell Lymphoma | 0.7733 | 0.7838 | 0.7632 |
| SYT11 AND NOT-GRM3 | Glioma | 0.9645 | 0.9444 | 0.9855 | TNFRSF13C AND NOT-CLDN2 | Mantle-Cell Lymphoma | 0.8352 | 0.717 | 1 |
| SYT11 AND NOT-SLC12A5 | Glioma | 0.942 | 0.942 | 0.942 | CD70 AND NOT-NCAM1 | Mantle-Cell Lymphoma | 0.8986 | 1 | 0.8158 |
| SYT11 AND NOT-KIRREL3 | Glioma | 0.9571 | 0.9437 | 0.971 | CD70 AND NOT-CSPG4 | Mantle-Cell Lymphoma | 0.8824 | 1 | 0.7895 |
| SYT11 AND NOT-CACNG3 | Glioma | 0.9481 | 0.9697 | 0.9275 | MS4A1 AND NOT-MET | Mantle-Cell Lymphoma | 0.7692 | 0.75 | 0.7895 |
| SYT11 AND NOT-GPR83 | Glioma | 0.9853 | 1 | 0.971 | TNFRSF13C AND NOT-ITGB3 | Mantle-Cell Lymphoma | 0.8444 | 0.7308 | 1 |
| SYT11 AND NOT-GPR22 | Glioma | 0.9645 | 0.9444 | 0.9855 | CD70 AND NOT-IGF1R | Mantle-Cell Lymphoma | 0.8986 | 1 | 0.8158 |
| SYT11 AND NOT-KCNK9 | Glioma | 0.964 | 0.9571 | 0.971 | TNFRSF13C AND NOT-SSTR5 | Mantle-Cell Lymphoma | 0.8172 | 0.6909 | 1 |
| SYT11 AND NOT-HTR1E | Glioma | 0.9714 | 0.9577 | 0.9855 | CD70 AND NOT-EPHA3 | Mantle-Cell Lymphoma | 0.8986 | 1 | 0.8158 |
| SYT11 AND NOT-GRIN1 | Glioma | 0.9565 | 0.9565 | 0.9565 | CD70 AND NOT-SSTR1 | Mantle-Cell Lymphoma | 0.8986 | 1 | 0.8158 |
| SYT11 AND NOT-GABRA1 | Glioma | 0.9496 | 0.9429 | 0.9565 | FCRL1 AND NOT-TNFRSF8 | Mantle-Cell Lymphoma | 0.7647 | 0.8667 | 0.6842 |
| SYT11 AND NOT-GABRG1 | Glioma | 0.9265 | 0.9403 | 0.913 | TNFRSF13C AND NOT-SSTR1 | Mantle-Cell Lymphoma | 0.8261 | 0.7037 | 1 |
| SYT11 AND NOT-CCKBR | Glioma | 0.9645 | 0.9444 | 0.9855 | TNFRSF13C AND NOT-ITGB6 | Mantle-Cell Lymphoma | 0.8222 | 0.7115 | 0.9737 |
| SYT11 AND NOT-CALY | Glioma | 0.9701 | 1 | 0.942 | CD52 AND NOT-TNFRSF8 | Mantle-Cell Lymphoma | 0.7609 | 0.6481 | 0.9211 |
| SYT11 AND NOT-SYT4 | Glioma | 0.9481 | 0.9697 | 0.9275 | CD79B AND NOT-TNFRSF17 | Mantle-Cell Lymphoma | 0.7606 | 0.8182 | 0.7105 |
| SYT11 AND NOT-KCNJ9 | Glioma | 0.964 | 0.9571 | 0.971 | CD70 AND NOT-KDR | Mantle-Cell Lymphoma | 0.8986 | 1 | 0.8158 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SYT11 AND NOT-SLC26A8 | Glioma | 0.9714 | 0.9577 | 0.9855 | CD70 AND NOT-EDNRB | Mantle-Cell Lymphoma | 0.8986 | 1 | 0.8158 |
| SYT11 AND NOT-GPR6 | Glioma | 0.9489 | 0.9559 | 0.942 | CD70 AND NOT-SDC1 | Mantle-Cell Lymphoma | 0.8986 | 1 | 0.8158 |
| SYT11 AND NOT-OPRK1 | Glioma | 0.9624 | 1 | 0.9275 | CD70 AND NOT-EGFR | Mantle-Cell Lymphoma | 0.8986 | 1 | 0.8158 |
| SYT11 AND NOT-KCNC1 | Glioma | 0.9645 | 0.9444 | 0.9855 | CD70 AND NOT-CD34 | Mantle-Cell Lymphoma | 0.8986 | 1 | 0.8158 |
| SYT11 AND NOT-UNC5A | Glioma | 0.9496 | 0.9429 | 0.9565 | CD70 AND NOT-TPBG | Mantle-Cell Lymphoma | 0.8986 | 1 | 0.8158 |
| SYT11 AND NOT-GABRA4 | Glioma | 0.9496 | 0.9429 | 0.9565 | CD70 AND NOT-AXL | Mantle-Cell Lymphoma | 0.8986 | 1 | 0.8158 |
| SYT11 AND NOT-GABRA2 | Glioma | 0.942 | 0.942 | 0.942 | CD70 AND NOT-IL11RA | Mantle-Cell Lymphoma | 0.8824 | 1 | 0.7895 |
| SYT11 AND NOT-AJAP1 | Glioma | 0.9008 | 0.9516 | 0.8551 | CD70 AND NOT-PTK7 | Mantle-Cell Lymphoma | 0.8986 | 1 | 0.8158 |
| SYT11 AND NOT-KCNV1 | Glioma | 0.9645 | 0.9444 | 0.9855 | CD70 AND NOT-CLDN1 | Mantle-Cell Lymphoma | 0.8986 | 1 | 0.8158 |
| SYT11 AND NOT-GABRB2 | Glioma | 0.9185 | 0.9394 | 0.8986 | CD70 AND NOT-ITGAV | Mantle-Cell Lymphoma | 0.8857 | 0.9688 | 0.8158 |
| ATP8B2 AND NOT-SELP | Leiomyosarcoma | 0.75 | 0.8182 | 0.6923 | CD70 AND NOT-MET | Mantle-Cell Lymphoma | 0.8986 | 1 | 0.8158 |
| ATP8B2 AND NOT-SLC6A6 | Leiomyosarcoma | 0.7 | 1 | 0.5385 | CD70 AND NOT-ERBB2 | Mantle-Cell Lymphoma | 0.8986 | 1 | 0.8158 |
| ATP8B2 AND NOT-CD1A | Leiomyosarcoma | 0.6923 | 0.6923 | 0.6923 | CD70 AND NOT-CD276 | Mantle-Cell Lymphoma | 0.8986 | 1 | 0.8158 |
| ATP8B2 AND NOT-SEMA4D | Leiomyosarcoma | 0.8333 | 0.9091 | 0.7692 | CD70 AND NOT-CLDN11 | Mantle-Cell Lymphoma | 0.8986 | 1 | 0.8158 |
| ATP8B2 AND NOT-DGKE | Leiomyosarcoma | 0.7619 | 1 | 0.6154 | CD70 AND NOT-FAP | Mantle-Cell Lymphoma | 0.8986 | 1 | 0.8158 |
| ATP8B2 AND NOT-SLC12A9 | Leiomyosarcoma | 0.8333 | 0.9091 | 0.7692 | CD70 AND NOT-STEAP2 | Mantle-Cell Lymphoma | 0.8657 | 1 | 0.7632 |
| ATP8B2 AND NOT-MPL | Leiomyosarcoma | 0.6667 | 0.7273 | 0.6154 | CD70 AND NOT-STEAP1 | Mantle-Cell Lymphoma | 0.8657 | 1 | 0.7632 |
| EMP3 AND NOT-SORL1 | Leiomyosarcoma | 0.6667 | 0.7273 | 0.6154 | FCRL1 AND NOT-ITGB3 | Mantle-Cell Lymphoma | 0.7826 | 0.871 | 0.7105 |
| ATP8B2 AND NOT-CD44 | Leiomyosarcoma | 0.6667 | 0.875 | 0.5385 | CXCR5 AND NOT-CSPG4 | Mantle-Cell Lymphoma | 0.7576 | 0.8929 | 0.6579 |
| ATP8B2 AND NOT-KCNK6 | Leiomyosarcoma | 0.6 | 0.8571 | 0.4615 | CD70 AND NOT-MUC4 | Mantle-Cell Lymphoma | 0.8824 | 1 | 0.7895 |
| ATP8B2 AND NOT-MLC1 | Leiomyosarcoma | 0.7407 | 0.7143 | 0.7692 | CD70 AND NOT-LGR5 | Mantle-Cell Lymphoma | 0.8657 | 1 | 0.7632 |
| ATP8B2 AND NOT-SORL1 | Leiomyosarcoma | 0.7619 | 1 | 0.6154 | CD70 AND NOT-SSTR5 | Mantle-Cell Lymphoma | 0.8824 | 1 | 0.7895 |
| ATP8B2 AND NOT-LAT | Leiomyosarcoma | 0.6 | 0.8571 | 0.4615 | CD70 AND NOT-ERBB3 | Mantle-Cell Lymphoma | 0.8986 | 1 | 0.8158 |
| ATP8B2 AND NOT-BTN3A1 | Leiomyosarcoma | 0.6667 | 0.875 | 0.5385 | CD52 AND NOT-ITGB3 | Mantle-Cell Lymphoma | 0.9114 | 0.878 | 0.9474 |
| EMP3 AND NOT-SELP | Leiomyosarcoma | 0.8333 | 0.9091 | 0.7692 | TNFRSF13C AND NOT-NCAM1 | Mantle-Cell Lymphoma | 0.8736 | 0.7755 | 1 |
| SLC22A16 AND NOT-EFNB2 | AML | 0.9299 | 0.9355 | 0.9243 | EDNRB AND NOT-ITGB6 | Melanoma | 0.9 | 1 | 0.8182 |
| SLC22A16 AND NOT-STEAP4 | AML | 0.9256 | 0.935 | 0.9163 | EDNRB AND NOT-CLDN18 | Melanoma | 0.9 | 1 | 0.8182 |
| SLC22A16 AND NOT-EPHA2 | AML | 0.9231 | 0.9141 | 0.9323 | EDNRB AND NOT-TNFRSF13C | Melanoma | 0.9 | 1 | 0.8182 |
| SLC22A16 AND NOT-FAT1 | AML | 0.9215 | 0.9309 | 0.9124 | EDNRB AND NOT-CLDN6 | Melanoma | 0.9 | 1 | 0.8182 |
| SLC22A16 AND NOT-ATP8B1 | AML | 0.9209 | 0.9137 | 0.9283 | EDNRB AND NOT-MSLN | Melanoma | 0.9 | 1 | 0.8182 |
| SLC22A16 AND NOT-LRIG3 | AML | 0.9176 | 0.9035 | 0.9323 | EDNRB AND NOT-CLDN5 | Melanoma | 0.9 | 1 | 0.8182 |
| SLC22A16 AND NOT-DIO1 | AML | 0.9052 | 0.8797 | 0.9323 | EDNRB AND NOT-GUCY2C | Melanoma | 0.9 | 1 | 0.8182 |
| SLC22A16 AND NOT-SLC4A8 | AML | 0.9035 | 0.8764 | 0.9323 | EDNRB AND NOT-SSTR1 | Melanoma | 0.9 | 1 | 0.8182 |
| SLC22A16 AND NOT-PHLDB2 | AML | 0.9409 | 0.9625 | 0.9203 | EDNRB AND NOT-CLDN7 | Melanoma | 0.9 | 1 | 0.8182 |
| SLC22A16 AND NOT-CATSPERD | AML | 0.9017 | 0.8731 | 0.9323 | EDNRB AND NOT-FOLR1 | Melanoma | 0.9 | 1 | 0.8182 |
| SLC22A16 AND NOT-SLC22A5 | AML | 0.9299 | 0.9355 | 0.9243 | EDNRB AND NOT-GPA33 | Melanoma | 0.9 | 1 | 0.8182 |
| SLC22A16 AND NOT-KIAA0319 | AML | 0.9 | 0.8699 | 0.9323 | EDNRB AND NOT-EPCAM | Melanoma | 0.9 | 1 | 0.8182 |
| SLC22A16 AND NOT-CACNG6 | AML | 0.9 | 0.8699 | 0.9323 | EDNRB AND NOT-SLC34A2 | Melanoma | 0.9 | 1 | 0.8182 |
| SLC22A16 AND NOT-LRRC8E | AML | 0.8983 | 0.8667 | 0.9323 | EDNRB AND NOT-ENG | Melanoma | 0.9 | 1 | 0.8182 |
| SLC22A16 AND NOT-OXTR | AML | 0.8983 | 0.8667 | 0.9323 | CLDN12 AND NOT-ULBP1 | Melanoma | 0.7778 | 1 | 0.6364 |
| SLC22A16 AND NOT-GRM7 | AML | 0.8983 | 0.8667 | 0.9323 | CLDN12 AND NOT-VTCN1 | Melanoma | 0.7778 | 1 | 0.6364 |
| SLC22A16 AND NOT-SLC31A1 | AML | 0.8975 | 0.8722 | 0.9243 | CLDN12 AND NOT-SSTR1 | Melanoma | 0.7778 | 1 | 0.6364 |
| SLC22A16 AND NOT-CNGA4 | AML | 0.8966 | 0.8635 | 0.9323 | CLDN12 AND NOT-FOLH1 | Melanoma | 0.7778 | 1 | 0.6364 |
| SLC22A16 AND NOT-ATP6V0A4 | AML | 0.8966 | 0.8635 | 0.9323 | CLDN12 AND NOT-SSTR3 | Melanoma | 0.7778 | 1 | 0.6364 |
| SLC22A16 AND NOT-PTPRT | AML | 0.8966 | 0.8635 | 0.9323 | CLDN12 AND NOT-SSTR4 | Melanoma | 0.7778 | 1 | 0.6364 |
| SLC22A16 AND NOT-SMPD2 | AML | 0.8953 | 0.8717 | 0.9203 | CLDN12 AND NOT-SSTR5 | Melanoma | 0.7778 | 1 | 0.6364 |
| SLC22A16 AND NOT-GPR137B | AML | 0.8941 | 0.9548 | 0.8406 | CLDN12 AND NOT-CLDN7 | Melanoma | 0.7778 | 1 | 0.6364 |
| SLC22A16 AND NOT-PPAPDC1B | AML | 0.8854 | 0.8784 | 0.8924 | CLDN12 AND NOT-EPCAM | Melanoma | 0.7778 | 1 | 0.6364 |
| SLC22A16 AND NOT-SLC16A5 | AML | 0.8789 | 0.8621 | 0.8964 | CLDN12 AND NOT-ERBB4 | Melanoma | 0.7778 | 1 | 0.6364 |
| SLC22A16 AND NOT-FLVCR1 | AML | 0.8624 | 0.8898 | 0.8367 | CLDN12 AND NOT-ERBB2 | Melanoma | 0.7778 | 1 | 0.6364 |
| SLC22A16 AND NOT-CLDN10 | AML | 0.8571 | 0.8538 | 0.8606 | CLDN12 AND NOT-MUC16 | Melanoma | 0.7778 | 1 | 0.6364 |
| SLC22A16 AND NOT-MSMO1 | AML | 0.8439 | 0.8969 | 0.7968 | CLDN12 AND NOT-SLC34A2 | Melanoma | 0.7778 | 1 | 0.6364 |
| FMNL1 AND NOT-BTN3A1 | AML | 0.8352 | 0.788 | 0.8884 | CLDN12 AND NOT-CLDN9 | Melanoma | 0.7778 | 1 | 0.6364 |
| FMNL1 AND NOT-BTN3A3 | AML | 0.8318 | 0.7914 | 0.8765 | CLDN12 AND NOT-CLDN1 | Melanoma | 0.7778 | 1 | 0.6364 |
| EMP3 AND NOT-S1PR1 | AML | 0.8247 | 0.8247 | 0.8247 | CLDN12 AND NOT-CLDN2 | Melanoma | 0.7778 | 1 | 0.6364 |
| FMNL1 AND NOT-S1PR1 | AML | 0.818 | 0.8038 | 0.8327 | CLDN12 AND NOT-CLDN6 | Melanoma | 0.7778 | 1 | 0.6364 |
| FMNL1 AND NOT-LAT | AML | 0.8272 | 0.8068 | 0.8486 | CLDN12 AND NOT-CLDN8 | Melanoma | 0.7778 | 1 | 0.6364 |
| CD44 AND NOT-KCNK6 | AML | 0.8624 | 0.7993 | 0.9363 | CLDN12 AND NOT-IL20RA | Melanoma | 0.7778 | 1 | 0.6364 |
| FMNL1 AND NOT-STEAP4 | AML | 0.8007 | 0.7399 | 0.8725 | CLDN12 AND NOT-ENPP3 | Melanoma | 0.7778 | 1 | 0.6364 |
| FMNL1 AND NOT-KCNK6 | AML | 0.7985 | 0.7571 | 0.8446 | CLDN12 AND NOT-MUC4 | Melanoma | 0.7778 | 1 | 0.6364 |
| FMNL1 AND NOT-IFNAR2 | AML | 0.7954 | 0.7715 | 0.8207 | CLDN12 AND NOT-STEAP1 | Melanoma | 0.7778 | 1 | 0.6364 |
| FMNL1 AND NOT-SEMA4D | AML | 0.7851 | 0.7083 | 0.8805 | CLDN12 AND NOT-LGR5 | Melanoma | 0.7778 | 1 | 0.6364 |
| TTYH3 AND NOT-SLC38A1 | Liposarcoma | 0.6364 | 0.7 | 0.5833 | CLDN12 AND NOT-EPHA3 | Melanoma | 0.7778 | 1 | 0.6364 |
| STAB1 AND NOT-NFASC | Liposarcoma | 0.7302 | 0.8519 | 0.6389 | CLDN12 AND NOT-CLDN23 | Melanoma | 0.7778 | 1 | 0.6364 |
| STAB1 AND NOT-ATP13A5 | Liposarcoma | 0.6129 | 0.7308 | 0.5278 | CLDN12 AND NOT-GUCY2C | Melanoma | 0.7778 | 1 | 0.6364 |
| STAB1 AND NOT-CD1A | Liposarcoma | 0.6765 | 0.7188 | 0.6389 | CLDN12 AND NOT-MUC13 | Melanoma | 0.7778 | 1 | 0.6364 |
| STAB1 AND NOT-ATP8A1 | Liposarcoma | 0.6333 | 0.7917 | 0.5278 | CLDN12 AND NOT-GPA33 | Melanoma | 0.7778 | 1 | 0.6364 |
| STAB1 AND NOT-SEMA4D | Liposarcoma | 0.6667 | 0.9048 | 0.5278 | ALK AND NOT-CLDN11 | Neuroblastoma | 0.8625 | 0.9079 | 0.8214 |
| STAB1 AND NOT-ADAM29 | Liposarcoma | 0.6849 | 0.6757 | 0.6944 | ALK AND NOT-ROR1 | Neuroblastoma | 0.8625 | 0.9079 | 0.8214 |
| STAB1 AND NOT-DPP10 | Liposarcoma | 0.6494 | 0.6098 | 0.6944 | ALK AND NOT-SLC34A2 | Neuroblastoma | 0.8535 | 0.9178 | 0.7976 |
| STAB1 AND NOT-ASTN1 | Liposarcoma | 0.6494 | 0.6098 | 0.6944 | ALK AND NOT-MOK | Neuroblastoma | 0.8625 | 0.9079 | 0.8214 |
| STAB1 AND NOT-SLC23A2 | Liposarcoma | 0.6575 | 0.6486 | 0.6667 | ALK AND NOT-AXL | Neuroblastoma | 0.8625 | 0.9079 | 0.8214 |
| STAB1 AND NOT-HTR1E | Liposarcoma | 0.6269 | 0.6774 | 0.5833 | ALK AND NOT-CSPG4 | Neuroblastoma | 0.8625 | 0.9079 | 0.8214 |
| STAB1 AND NOT-CACNG1 | Liposarcoma | 0.6027 | 0.5946 | 0.6111 | ALK AND NOT-TNC | Neuroblastoma | 0.8535 | 0.9178 | 0.7976 |
| STAB1 AND NOT-MSMO1 | Liposarcoma | 0.641 | 0.5952 | 0.6944 | ALK AND NOT-EPHB2 | Neuroblastoma | 0.8553 | 0.9067 | 0.8095 |
| STAB1 AND NOT-CALHM1 | Liposarcoma | 0.6567 | 0.7097 | 0.6111 | ALK AND NOT-SLC7A5 | Neuroblastoma | 0.8481 | 0.9054 | 0.7976 |
| STAB1 AND NOT-SEMA4B | Liposarcoma | 0.6102 | 0.7826 | 0.5 | ALK AND NOT-TPBG | Neuroblastoma | 0.8466 | 0.8734 | 0.8214 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| STAB1 AND NOT-GABRB2 | Liposarcoma | 0.6567 | 0.7097 | 0.6111 | ALK AND NOT-FAP | Neuroblastoma | 0.8364 | 0.8519 | 0.8214 |
| KCNJ10 AND NOT-NFASC | B-Cell Diffuse | 0.7826 | 0.8438 | 0.7297 | L1CAM AND NOT-BCAN | Neuroblastoma | 0.8222 | 0.7708 | 0.881 |
| KCNJ10 AND NOT-OPCML | B-Cell Diffuse | 0.7532 | 0.725 | 0.7838 | L1CAM AND NOT-SSTR1 | Neuroblastoma | 0.8 | 0.7327 | 0.881 |
| KCNJ10 AND NOT-CDH10 | B-Cell Diffuse | 0.7324 | 0.7647 | 0.7027 | L1CAM AND NOT-CLDN11 | Neuroblastoma | 0.7957 | 0.7255 | 0.881 |
| KCNJ10 AND NOT-DTNA | B-Cell Diffuse | 0.7297 | 0.7297 | 0.7297 | L1CAM AND NOT-ITGB3 | Neuroblastoma | 0.759 | 0.6667 | 0.881 |
| KCNJ10 AND NOT-ASTN1 | B-Cell Diffuse | 0.7632 | 0.7436 | 0.7838 | L1CAM AND NOT-CLDN18 | Neuroblastoma | 0.7513 | 0.6549 | 0.881 |
| KCNJ10 AND NOT-SLCO1C1 | B-Cell Diffuse | 0.7059 | 0.625 | 0.8108 | L1CAM AND NOT-FOLH1 | Neuroblastoma | 0.7419 | 0.6765 | 0.8214 |
| KCNJ10 AND NOT-FXYD7 | B-Cell Diffuse | 0.7013 | 0.675 | 0.7297 | BMPR1B AND NOT-RNF43 | Neuroblastoma | 0.7413 | 0.8983 | 0.631 |
| KCNJ10 AND NOT-OMG | B-Cell Diffuse | 0.7013 | 0.675 | 0.7297 | L1CAM AND NOT-EGFR | Neuroblastoma | 0.7389 | 0.6303 | 0.8929 |
| KCNJ10 AND NOT-ATP2B2 | B-Cell Diffuse | 0.6897 | 0.6 | 0.8108 | BMPR1B AND NOT-ENPP3 | Neuroblastoma | 0.7361 | 0.8833 | 0.631 |
| KCNJ10 AND NOT-KIRREL3 | B-Cell Diffuse | 0.6897 | 0.6 | 0.8108 | BMPR1B AND NOT-CLDN4 | Neuroblastoma | 0.7361 | 0.8833 | 0.631 |
| KCNJ10 AND NOT-CSMD3 | B-Cell Diffuse | 0.6977 | 0.6122 | 0.8108 | BMPR1B AND NOT-CEACAM5 | Neuroblastoma | 0.7347 | 0.8571 | 0.6429 |
| KCNJ10 AND NOT-KCNA2 | B-Cell Diffuse | 0.6824 | 0.6042 | 0.7838 | BMPR1B AND NOT-ITGB6 | Neuroblastoma | 0.7338 | 0.9273 | 0.6071 |
| KCNJ10 AND NOT-GRM3 | B-Cell Diffuse | 0.6824 | 0.6042 | 0.7838 | L1CAM AND NOT-TYR | Neuroblastoma | 0.7317 | 0.6198 | 0.8929 |
| KCNJ10 AND NOT-DISP2 | B-Cell Diffuse | 0.7324 | 0.7647 | 0.7027 | BMPR1B AND NOT-ERBB2 | Neuroblastoma | 0.731 | 0.8689 | 0.631 |
| KCNJ10 AND NOT-SYT4 | B-Cell Diffuse | 0.6667 | 0.566 | 0.8108 | BMPR1B AND NOT-CLDN8 | Neuroblastoma | 0.7297 | 0.8438 | 0.6429 |
| KCNJ10 AND NOT-MEGF10 | B-Cell Diffuse | 0.6667 | 0.6136 | 0.7297 | BMPR1B AND NOT-RAET1E | Neuroblastoma | 0.7297 | 0.8438 | 0.6429 |
| KCNJ10 AND NOT-TRPM3 | B-Cell Diffuse | 0.6667 | 0.5957 | 0.7568 | BMPR1B AND NOT-CLDN3 | Neuroblastoma | 0.7297 | 0.8438 | 0.6429 |
| KCNJ10 AND NOT-GPR158 | B-Cell Diffuse | 0.6512 | 0.5714 | 0.7568 | BMPR1B AND NOT-CLDN7 | Neuroblastoma | 0.7273 | 0.8814 | 0.619 |
| KCNJ10 AND NOT-SLC30A10 | B-Cell Diffuse | 0.6452 | 0.5357 | 0.8108 | BMPR1B AND NOT-PSCA | Neuroblastoma | 0.7248 | 0.8308 | 0.6429 |
| KCNJ10 AND NOT-SLC24A2 | B-Cell Diffuse | 0.6383 | 0.5263 | 0.8108 | L1CAM AND NOT-ITGB6 | Neuroblastoma | 0.7192 | 0.6134 | 0.869 |
| KCNJ10 AND NOT-KCNK10 | B-Cell Diffuse | 0.6353 | 0.5625 | 0.7297 | BMPR1B AND NOT-HHLA2 | Neuroblastoma | 0.7152 | 0.806 | 0.6429 |
| KCNJ10 AND NOT-CNTNAP2 | B-Cell Diffuse | 0.6301 | 0.6389 | 0.6216 | BMPR1B AND NOT-CLDN1 | Neuroblastoma | 0.7143 | 0.8929 | 0.5952 |
| KCNJ10 AND NOT-CACNG3 | B-Cell Diffuse | 0.6279 | 0.551 | 0.7297 | BMPR1B AND NOT-FOLR1 | Neuroblastoma | 0.7123 | 0.8387 | 0.619 |
| KCNJ10 AND NOT-ANO4 | B-Cell Diffuse | 0.6279 | 0.551 | 0.7297 | EDNRB AND NOT-SDC1 | Oligodendroglioma | 0.6154 | 0.7273 | 0.5333 |
| KCNJ10 AND NOT-NRG3 | B-Cell Diffuse | 0.6105 | 0.5 | 0.7838 | CSPG4 AND NOT-TPBG | Oligodendroglioma | 0.6667 | 0.8889 | 0.5333 |
| KCNJ10 AND NOT-GABRG1 | B-Cell Diffuse | 0.6024 | 0.5435 | 0.6757 | EDNRB AND NOT-TPBG | Oligodendroglioma | 0.6667 | 0.8889 | 0.5333 |
| GPR19 AND NOT-GABRB2 | Anaplastic Lymphoma | 0.6 | 0.6 | 0.6 | EDNRB AND NOT-ENG | Oligodendroglioma | 0.64 | 0.8 | 0.5333 |
| LAPTM5 AND NOT-ANPEP | Mantle-Cell Lymphoma | 0.7789 | 0.6491 | 0.9737 | EDNRB AND NOT-KDR | Oligodendroglioma | 0.6087 | 0.875 | 0.4667 |
| LAPTM5 AND NOT-CD93 | Mantle-Cell Lymphoma | 0.7677 | 0.623 | 1 | EDNRB AND NOT-CLDN1 | Oligodendroglioma | 0.64 | 0.8 | 0.5333 |
| LAPTM5 AND NOT-SLC31A1 | Mantle-Cell Lymphoma | 0.7037 | 0.5429 | 1 | EDNRB AND NOT-ERBB2 | Oligodendroglioma | 0.6154 | 0.7273 | 0.5333 |
| LAPTM5 AND NOT-STEAP4 | Mantle-Cell Lymphoma | 0.7835 | 0.6441 | 1 | MUC13 AND NOT-TRPM4 | Oligodendroglioma | 0.6 | 0.6 | 0.6 |
| LAPTM5 AND NOT-CXCL16 | Mantle-Cell Lymphoma | 0.6966 | 0.6078 | 0.8158 | MUC16 AND NOT-PROM1 | Ovarian | 0.7273 | 0.8 | 0.6667 |
| LAPTM5 AND NOT-DYSF | Mantle-Cell Lymphoma | 0.6972 | 0.5352 | 1 | MUC16 AND NOT-SDC1 | Ovarian | 0.6957 | 0.7273 | 0.6667 |
| LAPTM5 AND NOT-CD163 | Mantle-Cell Lymphoma | 0.6786 | 0.5135 | 1 | MUC16 AND NOT-MUC4 | Ovarian | 0.6667 | 0.6667 | 0.6667 |
| SLC38A1 AND NOT-MLC1 | Mantle-Cell Lymphoma | 0.6761 | 0.7273 | 0.6316 | MUC16 AND NOT-TPBG | Ovarian | 0.6667 | 0.7778 | 0.5833 |
| LAPTM5 AND NOT-CD36 | Mantle-Cell Lymphoma | 0.6607 | 0.5 | 0.9737 | MUC16 AND NOT-PTK7 | Ovarian | 0.6667 | 0.6667 | 0.6667 |
| SLC38A1 AND NOT-SLC31A1 | Mantle-Cell Lymphoma | 0.6588 | 0.5957 | 0.7368 | MUC16 AND NOT-CLDN8 | Ovarian | 0.6364 | 0.7 | 0.5833 |
| CLDN15 AND NOT-CD36 | Mantle-Cell Lymphoma | 0.65 | 0.619 | 0.6842 | MUC16 AND NOT-CD52 | Ovarian | 0.6154 | 0.5714 | 0.6667 |
| CLDN15 AND NOT-SLC16A5 | Mantle-Cell Lymphoma | 0.6462 | 0.7778 | 0.5526 | MUC16 AND NOT-MUC13 | Ovarian | 0.6154 | 0.5714 | 0.6667 |
| SLC38A1 AND NOT-CD93 | Mantle-Cell Lymphoma | 0.6437 | 0.5714 | 0.7368 | STEAP2 AND NOT-B4GALNT1 | Prostate | 0.8571 | 1 | 0.75 |
| CLDN15 AND NOT-PROCR | Mantle-Cell Lymphoma | 0.6506 | 0.6 | 0.7105 | STEAP2 AND NOT-NCAM1 | Prostate | 0.8889 | 0.8 | 1 |
| SLC38A1 AND NOT-MPL | Mantle-Cell Lymphoma | 0.6588 | 0.5957 | 0.7368 | STEAP2 AND NOT-EDNRB | Prostate | 0.75 | 0.75 | 0.75 |
| SLC38A1 AND NOT-KCNC2 | Mantle-Cell Lymphoma | 0.7105 | 0.7105 | 0.7105 | STEAP2 AND NOT-IL3RA | Prostate | 0.8571 | 1 | 0.75 |
| CLDN15 AND NOT-SLC22A18 | Mantle-Cell Lymphoma | 0.6506 | 0.6 | 0.7105 | STEAP2 AND NOT-DPEP1 | Prostate | 0.8571 | 1 | 0.75 |
| SLC38A1 AND NOT-SLC22A13 | Mantle-Cell Lymphoma | 0.6301 | 0.6571 | 0.6053 | STEAP2 AND NOT-KDR | Prostate | 0.8 | 0.6667 | 1 |
| SLC38A1 AND NOT-CALHM3 | Mantle-Cell Lymphoma | 0.7013 | 0.6923 | 0.7105 | STEAP2 AND NOT-IL11RA | Prostate | 0.7273 | 0.5714 | 1 |
| SLC38A1 AND NOT-GRIN1 | Mantle-Cell Lymphoma | 0.6667 | 0.6279 | 0.7105 | STEAP2 AND NOT-TNC | Prostate | 0.7273 | 0.5714 | 1 |
| SLC38A1 AND NOT-CALY | Mantle-Cell Lymphoma | 0.7027 | 0.7222 | 0.6842 | STEAP2 AND NOT-IGF1R | Prostate | 0.7273 | 0.5714 | 1 |
| SLC38A1 AND NOT-CD36 | Mantle-Cell Lymphoma | 0.6207 | 0.551 | 0.7105 | STEAP2 AND NOT-DKK1 | Prostate | 0.7273 | 0.5714 | 1 |
| SLC38A1 AND NOT-ANPEP | Mantle-Cell Lymphoma | 0.6207 | 0.551 | 0.7105 | STEAP2 AND NOT-CSPG4 | Prostate | 0.7273 | 0.5714 | 1 |
| SLC38A1 AND NOT-DYSF | Mantle-Cell Lymphoma | 0.7 | 0.6667 | 0.7368 | STEAP2 AND NOT-HSPA5 | Prostate | 0.7273 | 0.5714 | 1 |
| LAPTM5 AND NOT-TGFBI | Mantle-Cell Lymphoma | 0.6154 | 0.4848 | 0.8421 | STEAP2 AND NOT-AXL | Prostate | 0.7273 | 0.5714 | 1 |
| SLC38A1 AND NOT-KCNK4 | Mantle-Cell Lymphoma | 0.6571 | 0.7188 | 0.6053 | STEAP2 AND NOT-VTCN1 | Prostate | 0.7273 | 0.5714 | 1 |
| BTN3A1 AND NOT-DYSF | Mantle-Cell Lymphoma | 0.7294 | 0.6596 | 0.8158 | STEAP2 AND NOT-L1CAM | Prostate | 0.7273 | 0.5714 | 1 |
| SLC38A1 AND NOT-SYT6 | Mantle-Cell Lymphoma | 0.7164 | 0.8276 | 0.6316 | STEAP2 AND NOT-PSCA | Prostate | 1 | 1 | 1 |
| SLC38A1 AND NOT-STEAP4 | Mantle-Cell Lymphoma | 0.6437 | 0.5714 | 0.7368 | STEAP1 AND NOT-CD33 | Prostate | 0.75 | 0.75 | 0.75 |
| CLDN15 AND NOT-CXCL16 | Mantle-Cell Lymphoma | 0.6053 | 0.6053 | 0.6053 | STEAP1 AND NOT-VCAM1 | Prostate | 0.75 | 0.75 | 0.75 |
| SLC38A1 AND NOT-GRIK1 | Mantle-Cell Lymphoma | 0.6027 | 0.6286 | 0.5789 | STEAP1 AND NOT-FOLR2 | Prostate | 0.75 | 0.75 | 0.75 |
| BTN3A1 AND NOT-MLC1 | Mantle-Cell Lymphoma | 0.6022 | 0.5091 | 0.7368 | STEAP1 AND NOT-AXL | Prostate | 0.75 | 0.75 | 0.75 |
| SLC38A1 AND NOT-AJAP1 | Mantle-Cell Lymphoma | 0.6761 | 0.7273 | 0.6316 | CLDN12 AND NOT-PROM1 | Prostate | 0.6667 | 1 | 0.5 |
| SLC38A1 AND NOT-PTGER4 | Mantle-Cell Lymphoma | 0.6265 | 0.5778 | 0.6842 | STEAP2 AND NOT-CLDN5 | Prostate | 0.6667 | 1 | 0.5 |
| SLC38A1 AND NOT-CD163 | Mantle-Cell Lymphoma | 0.6292 | 0.549 | 0.7368 | STEAP1 AND NOT-FCRL5 | Prostate | 0.6667 | 1 | 0.5 |
| SLC38A1 AND NOT-GPR78 | Mantle-Cell Lymphoma | 0.6265 | 0.5778 | 0.6842 | STEAP1 AND NOT-SLC39A6 | Prostate | 0.6667 | 1 | 0.5 |
| CLDN15 AND NOT-BEST2 | Mantle-Cell Lymphoma | 0.642 | 0.6047 | 0.6842 | STEAP1 AND NOT-B4GALNT1 | Prostate | 0.6667 | 1 | 0.5 |
| SLC38A1 AND NOT-ATP6V0A4 | Mantle-Cell Lymphoma | 0.6341 | 0.5909 | 0.6842 | STEAP1 AND NOT-CSPG4 | Prostate | 0.6667 | 0.6 | 0.75 |
| SLC38A1 AND NOT-LPPR3 | Mantle-Cell Lymphoma | 0.6316 | 0.6316 | 0.6316 | STEAP1 AND NOT-ST8SIA1 | Prostate | 0.6667 | 0.6 | 0.75 |
| SLC38A1 AND NOT-CHRNA4 | Mantle-Cell Lymphoma | 0.6849 | 0.7143 | 0.6579 | STEAP1 AND NOT-DKK1 | Prostate | 0.6667 | 0.6 | 0.75 |
| CLDN15 AND NOT-CD93 | Mantle-Cell Lymphoma | 0.6585 | 0.6136 | 0.7105 | STEAP1 AND NOT-CLDN1 | Prostate | 0.6667 | 0.6 | 0.75 |
| SLC38A1 AND NOT-SLC28A1 | Mantle-Cell Lymphoma | 0.6842 | 0.6842 | 0.6842 | STEAP2 AND NOT-ALDH1A1 | Prostate | 0.6667 | 0.6 | 0.75 |
| LAPTM5 AND NOT-SORL1 | Mantle-Cell Lymphoma | 0.7551 | 0.6167 | 0.9737 | STEAP1 AND NOT-CLDN5 | Prostate | 0.6667 | 0.6 | 0.75 |
| SLC38A1 AND NOT-GALR2 | Mantle-Cell Lymphoma | 0.6585 | 0.6136 | 0.7105 | STEAP2 AND NOT-CD38 | Prostate | 0.6667 | 0.6 | 0.75 |
| SLC38A1 AND NOT-SLC39A2 | Mantle-Cell Lymphoma | 0.6506 | 0.6 | 0.7105 | FAP AND NOT-CLDN8 | Sarcoma | 0.8276 | 1 | 0.7059 |
| SLC38A1 AND NOT-SLC5A8 | Mantle-Cell Lymphoma | 0.6316 | 0.6316 | 0.6316 | FAP AND NOT-CLDN6 | Sarcoma | 0.8667 | 1 | 0.7647 |
| SLC38A1 AND NOT-OR3A2 | Mantle-Cell Lymphoma | 0.6154 | 0.6 | 0.6316 | FAP AND NOT-IL20RA | Sarcoma | 0.8667 | 1 | 0.7647 |
| SLC38A1 AND NOT-OXTR | Mantle-Cell Lymphoma | 0.6486 | 0.6667 | 0.6316 | FAP AND NOT-SSTR1 | Sarcoma | 0.7857 | 1 | 0.6471 |
| SLC38A1 AND NOT-KCNA4 | Mantle-Cell Lymphoma | 0.619 | 0.5652 | 0.6842 | FAP AND NOT-RNF43 | Sarcoma | 0.7407 | 1 | 0.5882 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SLC38A1 AND NOT-SLC22A6 | Mantle-Cell Lymphoma | 0.6857 | 0.75 | 0.6316 | FAP AND NOT-ERBB3 | Sarcoma | 0.7407 | 1 | 0.5882 |
| SLC38A1 AND NOT-OPCML | Mantle-Cell Lymphoma | 0.6024 | 0.5556 | 0.6579 | FAP AND NOT-CD22 | Sarcoma | 0.7857 | 1 | 0.6471 |
| FAT1 AND NOT-ATP8B1 | Melanoma | 0.8421 | 1 | 0.7273 | FAP AND NOT-MSLN | Sarcoma | 0.7857 | 1 | 0.6471 |
| FAT1 AND NOT-NOX1 | Melanoma | 0.8421 | 1 | 0.7273 | FAP AND NOT-PMEL | Sarcoma | 0.8276 | 1 | 0.7059 |
| GPR19 AND NOT-GABRB2 | Melanoma | 0.9 | 1 | 0.8182 | FAP AND NOT-EPCAM | Sarcoma | 0.8667 | 1 | 0.7647 |
| FAT1 AND NOT-OR1C1 | Melanoma | 0.8421 | 1 | 0.7273 | FAP AND NOT-PROM1 | Sarcoma | 0.8667 | 1 | 0.7647 |
| FAT1 AND NOT-SLC17A3 | Melanoma | 0.8421 | 1 | 0.7273 | FAP AND NOT-MST1R | Sarcoma | 0.7857 | 1 | 0.6471 |
| GPR137B AND NOT-CD36 | Melanoma | 0.8 | 0.8889 | 0.7273 | FAP AND NOT-ENPP3 | Sarcoma | 0.7407 | 1 | 0.5882 |
| FAT1 AND NOT-GPR6 | Melanoma | 0.8421 | 1 | 0.7273 | FAP AND NOT-CR2 | Sarcoma | 0.7857 | 1 | 0.6471 |
| GPR19 AND NOT-CDH18 | Melanoma | 0.9524 | 1 | 0.9091 | FAP AND NOT-ERBB4 | Sarcoma | 0.8276 | 1 | 0.7059 |
| FAT1 AND NOT-BEST3 | Melanoma | 0.8421 | 1 | 0.7273 | FAP AND NOT-CLDN11 | Sarcoma | 0.7407 | 1 | 0.5882 |
| FAT1 AND NOT-LCT | Melanoma | 0.7778 | 1 | 0.6364 | FAP AND NOT-ITGB6 | Sarcoma | 0.7407 | 1 | 0.5882 |
| GPR19 AND NOT-GABRB1 | Melanoma | 0.7778 | 1 | 0.6364 | FAP AND NOT-MUC4 | Sarcoma | 0.6923 | 1 | 0.5294 |
| FAT1 AND NOT-PCDHGC4 | Melanoma | 0.8421 | 1 | 0.7273 | FAP AND NOT-FCRL2 | Sarcoma | 0.6923 | 1 | 0.5294 |
| FAT1 AND NOT-AOC3 | Melanoma | 0.8421 | 1 | 0.7273 | FAP AND NOT-RAET1E | Sarcoma | 0.8276 | 1 | 0.7059 |
| FAT1 AND NOT-TMEM235 | Melanoma | 0.7778 | 1 | 0.6364 | FAP AND NOT-SSTR2 | Sarcoma | 0.7857 | 1 | 0.6471 |
| CACNA1B AND NOT-KCNA2 | Neuroblastoma | 0.9434 | 1 | 0.8929 | FAP AND NOT-TNFRSF8 | Sarcoma | 0.6923 | 1 | 0.5294 |
| CACNA1B AND NOT-KCNA1 | Neuroblastoma | 0.939 | 0.9625 | 0.9167 | FAP AND NOT-NCAM1 | Sarcoma | 0.8667 | 1 | 0.7647 |
| CACNA1B AND NOT-GABRB2 | Neuroblastoma | 0.939 | 0.9625 | 0.9167 | ROR1 AND NOT-CLDN6 | Sarcoma | 0.8667 | 1 | 0.7647 |
| CACNA1B AND NOT-ATP2B2 | Neuroblastoma | 0.9383 | 0.9744 | 0.9048 | FAP AND NOT-MUC1 | Sarcoma | 0.7857 | 1 | 0.6471 |
| KCNQ2 AND NOT-KCNA1 | Neuroblastoma | 0.9333 | 0.9506 | 0.9167 | FAP AND NOT-CLDN2 | Sarcoma | 0.8276 | 1 | 0.7059 |
| KCNQ2 AND NOT-SLC12A5 | Neuroblastoma | 0.9317 | 0.974 | 0.8929 | FAP AND NOT-SSTR5 | Sarcoma | 0.8667 | 1 | 0.7647 |
| CACNA1B AND NOT-GRM3 | Neuroblastoma | 0.9317 | 0.974 | 0.8929 | ROR1 AND NOT-ERBB3 | Sarcoma | 0.7857 | 1 | 0.6471 |
| KCNQ2 AND NOT-GRM3 | Neuroblastoma | 0.9317 | 0.974 | 0.8929 | FAP AND NOT-EDNRB | Sarcoma | 0.7407 | 1 | 0.5882 |
| KCNQ2 AND NOT-KCNA2 | Neuroblastoma | 0.9299 | 1 | 0.869 | FAP AND NOT-CXCR5 | Sarcoma | 0.8667 | 1 | 0.7647 |
| KCNQ2 AND NOT-GABRB2 | Neuroblastoma | 0.9277 | 0.939 | 0.9167 | FAP AND NOT-SLC34A2 | Sarcoma | 0.8667 | 1 | 0.7647 |
| CACNA1B AND NOT-OMG | Neuroblastoma | 0.925 | 0.9737 | 0.881 | FAP AND NOT-MUC13 | Sarcoma | 0.6923 | 1 | 0.5294 |
| KCNQ2 AND NOT-ATP2B2 | Neuroblastoma | 0.9222 | 0.9277 | 0.9167 | FAP AND NOT-VTCN1 | Sarcoma | 0.8276 | 1 | 0.7059 |
| KCNQ2 AND NOT-MLC1 | Neuroblastoma | 0.9222 | 0.9277 | 0.9167 | FAP AND NOT-CLDN18 | Sarcoma | 0.6923 | 1 | 0.5294 |
| CACNA1B AND NOT-OPCML | Neuroblastoma | 0.9202 | 0.9494 | 0.8929 | FAP AND NOT-MUC16 | Sarcoma | 0.8667 | 1 | 0.7647 |
| KCNQ2 AND NOT-CSMD3 | Neuroblastoma | 0.9182 | 0.9733 | 0.869 | FAP AND NOT-TNFRSF17 | Sarcoma | 0.6923 | 1 | 0.5294 |
| NKAIN1 AND NOT-SLC13A5 | Neuroblastoma | 0.9193 | 0.961 | 0.881 | FAP AND NOT-KDR | Sarcoma | 0.8276 | 1 | 0.7059 |
| NKAIN1 AND NOT-TRPC3 | Neuroblastoma | 0.9172 | 0.9863 | 0.8571 | ROR1 AND NOT-MSLN | Sarcoma | 0.8276 | 1 | 0.7059 |
| CACNA1B AND NOT-GABRA1 | Neuroblastoma | 0.9157 | 0.9268 | 0.9048 | ROR1 AND NOT-EPCAM | Sarcoma | 0.8387 | 0.9286 | 0.7647 |
| GPR19 AND NOT-GRM3 | Neuroblastoma | 0.9143 | 0.8791 | 0.9524 | FAP AND NOT-GUCY2C | Sarcoma | 0.8667 | 1 | 0.7647 |
| NKAIN1 AND NOT-GRM3 | Neuroblastoma | 0.9114 | 0.973 | 0.8571 | ROR1 AND NOT-IL20RA | Sarcoma | 0.8387 | 0.9286 | 0.7647 |
| NKAIN1 AND NOT-GABRB2 | Neuroblastoma | 0.9103 | 0.9861 | 0.8452 | FAP AND NOT-GPA33 | Sarcoma | 0.8276 | 1 | 0.7059 |
| KCNQ2 AND NOT-OMG | Neuroblastoma | 0.9091 | 1 | 0.8333 | FAP AND NOT-FOLR1 | Sarcoma | 0.8276 | 1 | 0.7059 |
| SCN2A AND NOT-GRM3 | Neuroblastoma | 0.9068 | 0.9481 | 0.869 | ROR1 AND NOT-CLDN1 | Sarcoma | 0.7143 | 0.9091 | 0.5882 |
| SLC6A15 AND NOT-KCNA1 | Neuroblastoma | 0.9045 | 0.9726 | 0.8452 | FAP AND NOT-CLDN23 | Sarcoma | 0.8667 | 1 | 0.7647 |
| CACNA1B AND NOT-GABBR2 | Neuroblastoma | 0.9036 | 0.9146 | 0.8929 | ROR1 AND NOT-RNF43 | Sarcoma | 0.8276 | 1 | 0.7059 |
| KCNQ2 AND NOT-SCN1A | Neuroblastoma | 0.9024 | 0.925 | 0.881 | ROR1 AND NOT-CLDN8 | Sarcoma | 0.8667 | 1 | 0.7647 |
| CACNA1B AND NOT-MLC1 | Neuroblastoma | 0.9006 | 0.8851 | 0.9167 | FAP AND NOT-TNFRSF13C | Sarcoma | 0.7407 | 1 | 0.5882 |
| CACNA1B AND NOT-GRIN2A | Neuroblastoma | 0.9006 | 0.8851 | 0.9167 | EPHB2 AND NOT-RNF43 | Sarcoma | 0.64 | 1 | 0.4706 |
| KCNQ2 AND NOT-OPALIN | Neuroblastoma | 0.9006 | 0.8851 | 0.9167 | EPHB2 AND NOT-PROM1 | Sarcoma | 0.64 | 1 | 0.4706 |
| NKAIN1 AND NOT-CACNG8 | Neuroblastoma | 0.9 | 0.9474 | 0.8571 | FAP AND NOT-CLDN1 | Sarcoma | 0.64 | 1 | 0.4706 |
| SCN2A AND NOT-CSMD3 | Neuroblastoma | 0.9 | 0.9474 | 0.8571 | EPHB2 AND NOT-GUCY2C | Sarcoma | 0.64 | 1 | 0.4706 |
| GPR19 AND NOT-GABRB2 | Neuroblastoma | 0.9 | 0.9474 | 0.8571 | EPHB2 AND NOT-EPCAM | Sarcoma | 0.64 | 1 | 0.4706 |
| CACNA1B AND NOT-SLC12A5 | Neuroblastoma | 0.8994 | 0.8941 | 0.9048 | ROR1 AND NOT-SLC7A5 | Sarcoma | 0.8387 | 0.9286 | 0.7647 |
| KCNQ2 AND NOT-SLCO1C1 | Neuroblastoma | 0.8982 | 0.9036 | 0.8929 | ROR1 AND NOT-ENPP3 | Sarcoma | 0.64 | 1 | 0.4706 |
| NKAIN1 AND NOT-MLC1 | Neuroblastoma | 0.9202 | 0.9494 | 0.8929 | EPHB2 AND NOT-GPA33 | Sarcoma | 0.64 | 1 | 0.4706 |
| KCNQ2 AND NOT-NKAIN2 | Neuroblastoma | 0.8961 | 0.9857 | 0.8214 | ROR1 AND NOT-MST1R | Sarcoma | 0.8276 | 1 | 0.7059 |
| NKAIN1 AND NOT-NKAIN2 | Neuroblastoma | 0.8961 | 0.9857 | 0.8214 | EPHB2 AND NOT-ITGB6 | Sarcoma | 0.64 | 1 | 0.4706 |
| NKAIN1 AND NOT-MOG | Neuroblastoma | 0.8929 | 0.8929 | 0.8929 | FAP AND NOT-MS4A1 | Sarcoma | 0.7857 | 1 | 0.6471 |
| NKAIN1 AND NOT-SLC9B1 | Neuroblastoma | 0.8982 | 0.9036 | 0.8929 | FAP AND NOT-CLDN7 | Sarcoma | 0.8667 | 1 | 0.7647 |
| SLC6A15 AND NOT-KCNA2 | Neuroblastoma | 0.8903 | 0.9718 | 0.8214 | FAP AND NOT-CLDN12 | Sarcoma | 0.8667 | 1 | 0.7647 |
| CACNA1B AND NOT-GABRD | Neuroblastoma | 0.8889 | 0.8736 | 0.9048 | ROR1 AND NOT-FCRL2 | Sarcoma | 0.8667 | 1 | 0.7647 |
| NKAIN1 AND NOT-GABRD | Neuroblastoma | 0.8929 | 0.8929 | 0.8929 | ROR1 AND NOT-ERBB4 | Sarcoma | 0.8276 | 1 | 0.7059 |
| NKAIN1 AND NOT-ATP2B2 | Neuroblastoma | 0.9146 | 0.9375 | 0.8929 | ROR1 AND NOT-CR2 | Sarcoma | 0.8667 | 1 | 0.7647 |
| NKAIN1 AND NOT-GRM1 | Neuroblastoma | 0.8929 | 0.8929 | 0.8929 | EPHB2 AND NOT-MUC13 | Sarcoma | 0.64 | 1 | 0.4706 |
| ASTN1 AND NOT-NKAIN2 | Neuroblastoma | 0.8931 | 0.9467 | 0.8452 | FAP AND NOT-SDC1 | Sarcoma | 0.8276 | 1 | 0.7059 |
| SCN2A AND NOT-KCNA1 | Neuroblastoma | 0.8862 | 0.8916 | 0.881 | ROR1 AND NOT-SSTR1 | Sarcoma | 0.8276 | 1 | 0.7059 |
| SCN2A AND NOT-MLC1 | Neuroblastoma | 0.8862 | 0.8916 | 0.881 | EPHB2 AND NOT-MUC4 | Sarcoma | 0.64 | 1 | 0.4706 |
| NKAIN1 AND NOT-OPCML | Neuroblastoma | 0.8862 | 0.8916 | 0.881 | ROR1 AND NOT-SSTR4 | Sarcoma | 0.8276 | 1 | 0.7059 |
| NKAIN1 AND NOT-OPRK1 | Neuroblastoma | 0.8848 | 0.9012 | 0.869 | CD276 AND NOT-RNF43 | Sarcoma | 0.6923 | 1 | 0.5294 |
| NKAIN1 AND NOT-GRIN2C | Neuroblastoma | 0.8846 | 0.9583 | 0.8214 | ROR1 AND NOT-GUCY2C | Sarcoma | 0.8667 | 1 | 0.7647 |
| NKAIN1 AND NOT-SLC1A6 | Neuroblastoma | 0.8846 | 0.9583 | 0.8214 | FAP AND NOT-FCRL1 | Sarcoma | 0.8276 | 1 | 0.7059 |
| NKAIN1 AND NOT-HTR5A | Neuroblastoma | 0.8876 | 0.8824 | 0.8929 | ROR1 AND NOT-SDC1 | Sarcoma | 0.8387 | 0.9286 | 0.7647 |
| KCNQ2 AND NOT-GABRD | Neuroblastoma | 0.8837 | 0.8636 | 0.9048 | ROR1 AND NOT-ENPP3 | Sarcoma | 0.7407 | 1 | 0.5882 |
| SLC6A15 AND NOT-CSMD3 | Neuroblastoma | 0.8831 | 0.9714 | 0.8095 | EPHB2 AND NOT-CLDN23 | Sarcoma | 0.64 | 1 | 0.4706 |
| NKAIN1 AND NOT-SCN1A | Neuroblastoma | 0.8824 | 0.8721 | 0.8929 | ROR1 AND NOT-SSTR5 | Sarcoma | 0.8667 | 1 | 0.7647 |
| NKAIN1 AND NOT-GGTLC1 | Neuroblastoma | 0.8824 | 0.8721 | 0.8929 | ROR1 AND NOT-ITGB6 | Sarcoma | 0.7857 | 1 | 0.6471 |
| NKAIN1 AND NOT-ACSL6 | Neuroblastoma | 0.8824 | 0.8721 | 0.8929 | EPHB2 AND NOT-SSTR1 | Sarcoma | 0.64 | 1 | 0.4706 |
| NKAIN1 AND NOT-CALHM1 | Neuroblastoma | 0.882 | 0.9221 | 0.8452 | ROR1 AND NOT-PMEL | Sarcoma | 0.8276 | 1 | 0.7059 |
| GPR85 AND NOT-GABRB2 | Neuroblastoma | 0.8816 | 0.9853 | 0.7976 | ROR1 AND NOT-MS4A1 | Sarcoma | 0.8667 | 1 | 0.7647 |
| NKAIN1 AND NOT-OR1Q1 | Neuroblastoma | 0.881 | 0.881 | 0.881 | ROR1 AND NOT-CLDN11 | Sarcoma | 0.7143 | 0.9091 | 0.5882 |
| NKAIN1 AND NOT-NPHS1 | Neuroblastoma | 0.881 | 0.881 | 0.881 | ROR1 AND NOT-CXCR5 | Sarcoma | 0.8667 | 1 | 0.7647 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NKAIN1 AND NOT-SLCO1C1 | Neuroblastoma | 0.8916 | 0.9024 | 0.881 | ROR1 AND NOT-IL3RA | Sarcoma | 0.8276 | 1 | 0.7059 |
| CACNA1B AND NOT-SLCO1C1 | Neuroblastoma | 0.8786 | 0.8539 | 0.9048 | ROR1 AND NOT-CLDN12 | Sarcoma | 0.8387 | 0.9286 | 0.7647 |
| JPH3 AND NOT-CSMD3 | Neuroblastoma | 0.8861 | 0.9459 | 0.8333 | ROR1 AND NOT-CLDN23 | Sarcoma | 0.8387 | 0.9286 | 0.7647 |
| SCN2A AND NOT-KCNA2 | Neuroblastoma | 0.878 | 0.9 | 0.8571 | ROR1 AND NOT-TNFRSF10A | Sarcoma | 0.8276 | 1 | 0.7059 |
| NKAIN1 AND NOT-KCNA2 | Neuroblastoma | 0.8774 | 0.9577 | 0.8095 | ROR1 AND NOT-GPA33 | Sarcoma | 0.6923 | 1 | 0.5294 |
| GPR85 AND NOT-KCNA1 | Neuroblastoma | 0.8774 | 0.9577 | 0.8095 | TPBG AND NOT-EPCAM | Sarcoma | 0.6154 | 0.8889 | 0.4706 |
| NKAIN1 AND NOT-ROS1 | Neuroblastoma | 0.8772 | 0.8621 | 0.8929 | MUC13 AND NOT-ENPP3 | Stomach | 0.9512 | 1 | 0.907 |
| NKAIN1 AND NOT-GPRC6A | Neuroblastoma | 0.8772 | 0.8621 | 0.8929 | MUC13 AND NOT-CLDN8 | Stomach | 0.9524 | 0.9756 | 0.9302 |
| KCNQ2 AND NOT-OPCML | Neuroblastoma | 0.8772 | 0.8621 | 0.8929 | CLDN18 AND NOT-SLC34A2 | Stomach | 0.7912 | 0.75 | 0.8372 |
| NKAIN1 AND NOT-GUCY2F | Neuroblastoma | 0.8772 | 0.8621 | 0.8929 | MUC13 AND NOT-HHLA2 | Stomach | 0.7714 | 1 | 0.6279 |
| NKAIN1 AND NOT-ADAM7 | Neuroblastoma | 0.8929 | 0.8929 | 0.8929 | CLDN18 AND NOT-CLDN5 | Stomach | 0.7778 | 0.7447 | 0.814 |
| NKAIN1 AND NOT-CSMD3 | Neuroblastoma | 0.8758 | 0.971 | 0.7976 | CLDN18 AND NOT-CD52 | Stomach | 0.7556 | 0.7234 | 0.7907 |
| NKAIN1 AND NOT-BEST3 | Neuroblastoma | 0.8757 | 0.8706 | 0.881 | MST1R AND NOT-CLDN8 | Stomach | 0.8989 | 0.8696 | 0.9302 |
| NKAIN1 AND NOT-SLC22A11 | Neuroblastoma | 0.8757 | 0.8706 | 0.881 | CLDN18 AND NOT-FOLR1 | Stomach | 0.7356 | 0.7273 | 0.7442 |
| NKAIN1 AND NOT-GSG1L | Neuroblastoma | 0.8757 | 0.8706 | 0.881 | CLDN18 AND NOT-CD33 | Stomach | 0.766 | 0.7059 | 0.8372 |
| NKAIN1 AND NOT-KCNA7 | Neuroblastoma | 0.8757 | 0.8706 | 0.881 | EPHB2 AND NOT-ENPP3 | Stomach | 0.7255 | 0.6271 | 0.8605 |
| NKAIN1 AND NOT-SLC5A11 | Neuroblastoma | 0.8743 | 0.8795 | 0.869 | CLDN18 AND NOT-GPC3 | Stomach | 0.7416 | 0.7174 | 0.7674 |
| NKAIN1 AND NOT-KCNJ9 | Neuroblastoma | 0.8743 | 0.8795 | 0.869 | CLDN18 AND NOT-CLEC14A | Stomach | 0.7 | 0.7568 | 0.6512 |
| SCN2A AND NOT-NKAIN2 | Neuroblastoma | 0.8742 | 0.9851 | 0.7857 | CLDN18 AND NOT-ERBB4 | Stomach | 0.6923 | 0.7714 | 0.6279 |
| CACNA1B AND NOT-CSMD3 | Neuroblastoma | 0.8736 | 0.8444 | 0.9048 | CEACAM5 AND NOT-CLDN8 | Stomach | 0.8 | 0.8095 | 0.7907 |
| SLC6A15 AND NOT-GABBR2 | Neuroblastoma | 0.8734 | 0.9324 | 0.8214 | MUC13 AND NOT-CLDN3 | Stomach | 0.7174 | 0.6735 | 0.7674 |
| SYT11 AND NOT-MLC1 | Neuroblastoma | 0.8729 | 0.8144 | 0.9405 | MUC13 AND NOT-MUC4 | Stomach | 0.7778 | 0.7447 | 0.814 |
| NKAIN1 AND NOT-UPK3A | Neuroblastoma | 0.8721 | 0.8523 | 0.8929 | CLDN18 AND NOT-IL11RA | Stomach | 0.6829 | 0.7179 | 0.6512 |
| NKAIN1 AND NOT-TRPM1 | Neuroblastoma | 0.8721 | 0.8523 | 0.8929 | CLDN18 AND NOT-CD34 | Stomach | 0.6824 | 0.6905 | 0.6744 |
| NKAIN1 AND NOT-KCNA10 | Neuroblastoma | 0.8721 | 0.8523 | 0.8929 | MUC13 AND NOT-ABCA5 | Stomach | 0.68 | 0.5965 | 0.7907 |
| NKAIN1 AND NOT-TAS1R1 | Neuroblastoma | 0.8721 | 0.8523 | 0.8929 | MUC13 AND NOT-GPA33 | Stomach | 0.9512 | 1 | 0.907 |
| SCN2A AND NOT-OPCML | Neuroblastoma | 0.8718 | 0.9444 | 0.8095 | EPCAM AND NOT-CLDN8 | Stomach | 0.7857 | 0.8049 | 0.7674 |
| GPR85 AND NOT-ATP2B2 | Neuroblastoma | 0.8718 | 0.9444 | 0.8095 | CLDN18 AND NOT-CD37 | Stomach | 0.6667 | 0.6591 | 0.6744 |
| NKAIN1 AND NOT-TSPAN16 | Neuroblastoma | 0.8712 | 0.8987 | 0.8452 | CLDN18 AND NOT-EDNRB | Stomach | 0.6667 | 0.6591 | 0.6744 |
| SLC6A15 AND NOT-MLC1 | Neuroblastoma | 0.8712 | 0.8987 | 0.8452 | CLDN18 AND NOT-IL3RA | Stomach | 0.6667 | 0.6591 | 0.6744 |
| UNC5A AND NOT-GRM3 | Neuroblastoma | 0.8712 | 0.8987 | 0.8452 | CEACAM5 AND NOT-ENPP3 | Stomach | 0.8046 | 0.7955 | 0.814 |
| SLC6A15 AND NOT-GABRB2 | Neuroblastoma | 0.8712 | 0.8987 | 0.8452 | EPCAM AND NOT-ENPP3 | Stomach | 0.8155 | 0.7 | 0.9767 |
| SLC6A15 AND NOT-GRM3 | Neuroblastoma | 0.8712 | 0.8987 | 0.8452 | MUC13 AND NOT-GUCY2C | Stomach | 0.7416 | 0.7174 | 0.7674 |
| SYT11 AND NOT-NKAIN2 | Neuroblastoma | 0.8706 | 0.8605 | 0.881 | CLDN18 AND NOT-CD160 | Stomach | 0.7294 | 0.7381 | 0.7209 |
| NKAIN1 AND NOT-MIP | Neuroblastoma | 0.8706 | 0.8605 | 0.881 | CLDN18 AND NOT-ENG | Stomach | 0.6506 | 0.675 | 0.6279 |
| SCN2A AND NOT-OMG | Neuroblastoma | 0.8701 | 0.9571 | 0.7976 | CLDN18 AND NOT-KDR | Stomach | 0.7865 | 0.7609 | 0.814 |
| KCNQ2 AND NOT-GABRA2 | Neuroblastoma | 0.869 | 0.869 | 0.869 | MUC13 AND NOT-CLDN7 | Stomach | 0.6835 | 0.75 | 0.6279 |
| NKAIN4 AND NOT-CDH20 | Oligodendroglioma | 0.8889 | 1 | 0.8 | MST1R AND NOT-ABCA5 | Stomach | 0.6602 | 0.5667 | 0.7907 |
| NKAIN4 AND NOT-KCNJ9 | Oligodendroglioma | 0.8889 | 1 | 0.8 | CLDN7 AND NOT-CLDN8 | Stomach | 0.8478 | 0.7959 | 0.907 |
| NKAIN4 AND NOT-IL13 | Oligodendroglioma | 0.8889 | 1 | 0.8 | CLDN18 AND NOT-GPNMB | Stomach | 0.6966 | 0.6739 | 0.7209 |
| NKAIN4 AND NOT-AQP6 | Oligodendroglioma | 0.8889 | 1 | 0.8 | CLDN18 AND NOT-ALK | Stomach | 0.8312 | 0.9412 | 0.7442 |
| NKAIN4 AND NOT-KCNA1 | Oligodendroglioma | 0.8889 | 1 | 0.8 | MST1R AND NOT-ENPP3 | Stomach | 0.8966 | 0.8864 | 0.907 |
| NKAIN4 AND NOT-KCNC2 | Oligodendroglioma | 0.8889 | 1 | 0.8 | CLDN18 AND NOT-AXL | Stomach | 0.6966 | 0.6739 | 0.7209 |
| NKAIN4 AND NOT-KCNJ6 | Oligodendroglioma | 0.8889 | 1 | 0.8 | PROM1 AND NOT-ENPP3 | Stomach | 0.7111 | 0.6809 | 0.7442 |
| NKAIN4 AND NOT-SLC6A18 | Oligodendroglioma | 0.8889 | 1 | 0.8 | MUC13 AND NOT-CD160 | Stomach | 0.8409 | 0.8222 | 0.8605 |
| NKAIN4 AND NOT-OR52D1 | Oligodendroglioma | 0.8889 | 1 | 0.8 | NOT-TPBG AND CLDN7 | Liver | 0.7143 | 0.625 | 0.8333 |
| NKAIN4 AND NOT-MIP | Oligodendroglioma | 0.8889 | 1 | 0.8 | NOT-IL20RA AND RNF43 | Liver | 0.6667 | 1 | 0.5 |
| NKAIN4 AND NOT-TRPM1 | Oligodendroglioma | 0.8889 | 1 | 0.8 | NOT-TPBG AND RNF43 | Liver | 0.6667 | 1 | 0.5 |
| NKAIN4 AND NOT-CLDN20 | Oligodendroglioma | 0.8889 | 1 | 0.8 | NOT-TPBG AND MUC13 | Liver | 0.6 | 0.75 | 0.5 |
| NKAIN4 AND NOT-OPRK1 | Oligodendroglioma | 0.8889 | 1 | 0.8 | NOT-ITGB6 AND MUC13 | Liver | 0.6667 | 1 | 0.5 |
| NKAIN4 AND NOT-HTR5A | Oligodendroglioma | 0.8889 | 1 | 0.8 | NOT-IL11RA AND AXL | Renal | 0.8 | 1 | 0.6667 |
| NKAIN4 AND NOT-GRM4 | Oligodendroglioma | 0.8889 | 1 | 0.8 | NOT-CLDN11 AND AXL | Renal | 0.7273 | 0.8 | 0.6667 |
| NKAIN4 AND NOT-GRIA4 | Oligodendroglioma | 0.8889 | 1 | 0.8 | NOT-ENPP3 AND CLDN3 | Esophagus | 0.6 | 1 | 0.4286 |
| NKAIN4 AND NOT-GRIK1 | Oligodendroglioma | 0.8889 | 1 | 0.8 | NOT-ENPP3 AND CLDN2 | Esophagus | 0.6 | 1 | 0.4286 |
| NKAIN4 AND NOT-GRIN2B | Oligodendroglioma | 0.8889 | 1 | 0.8 | NOT-ENPP3 AND CEACAM5 | Esophagus | 0.6667 | 0.8 | 0.5714 |
| NKAIN4 AND NOT-GRM1 | Oligodendroglioma | 0.8889 | 1 | 0.8 | NOT-EPCAM AND SLC39A6 | Glioma | 0.8254 | 0.9123 | 0.7536 |
| NKAIN4 AND NOT-GRM3 | Oligodendroglioma | 0.8889 | 1 | 0.8 | NOT-EPCAM AND CLDN12 | Glioma | 0.7848 | 0.6966 | 0.8986 |
| NKAIN4 AND NOT-PCDHB1 | Oligodendroglioma | 0.8889 | 1 | 0.8 | NOT-RNF43 AND CLDN12 | Glioma | 0.7967 | 0.9074 | 0.7101 |
| NKAIN4 AND NOT-HTR2C | Oligodendroglioma | 0.8889 | 1 | 0.8 | NOT-TRPM4 AND CD276 | Glioma | 0.7333 | 0.679 | 0.7971 |
| NKAIN4 AND NOT-SLC39A2 | Oligodendroglioma | 0.8889 | 1 | 0.8 | NOT-EPCAM AND CD276 | Glioma | 0.7799 | 0.6889 | 0.8986 |
| NKAIN4 AND NOT-OPRM1 | Oligodendroglioma | 0.8889 | 1 | 0.8 | NOT-TRPM4 AND CLDN12 | Glioma | 0.7639 | 0.7333 | 0.7971 |
| NKAIN4 AND NOT-OR3A1 | Oligodendroglioma | 0.8889 | 1 | 0.8 | NOT-SLAMF7 AND EPHB2 | Glioma | 0.6971 | 0.5755 | 0.8841 |
| NKAIN4 AND NOT-SLC22A18 | Oligodendroglioma | 0.8889 | 1 | 0.8 | NOT-RNF43 AND CD276 | Glioma | 0.7643 | 0.6818 | 0.8696 |
| NKAIN4 AND NOT-GJD2 | Oligodendroglioma | 0.8889 | 1 | 0.8 | NOT-ITGB6 AND PROM1 | Glioma | 0.7353 | 0.7463 | 0.7246 |
| NKAIN4 AND NOT-PTGIR | Oligodendroglioma | 0.8889 | 1 | 0.8 | NOT-ERBB3 AND PTK7 | Leiomyosarcoma | 0.6667 | 0.7273 | 0.6154 |
| NKAIN4 AND NOT-PTPRR | Oligodendroglioma | 0.8889 | 1 | 0.8 | NOT-ERBB3 AND CD276 | Leiomyosarcoma | 0.7826 | 0.9 | 0.6923 |
| NKAIN4 AND NOT-CACNG8 | Oligodendroglioma | 0.8889 | 1 | 0.8 | NOT-RNF43 AND AXL | Leiomyosarcoma | 0.6667 | 0.7273 | 0.6154 |
| NKAIN4 AND NOT-CACNG7 | Oligodendroglioma | 0.8889 | 1 | 0.8 | NOT-EPCAM AND AXL | Leiomyosarcoma | 0.64 | 0.6667 | 0.6154 |
| NKAIN4 AND NOT-OXTR | Oligodendroglioma | 0.8889 | 1 | 0.8 | NOT-ERBB3 AND TPBG | Leiomyosarcoma | 0.75 | 0.8182 | 0.6923 |
| NKAIN4 AND NOT-PORCN | Oligodendroglioma | 0.8889 | 1 | 0.8 | NOT-ERBB3 AND AXL | Leiomyosarcoma | 0.6667 | 0.875 | 0.5385 |
| NKAIN4 AND NOT-SLC1A6 | Oligodendroglioma | 0.8889 | 1 | 0.8 | NOT-ERBB3 AND GPNMB | Leiomyosarcoma | 0.6207 | 0.5625 | 0.6923 |
| NKAIN4 AND NOT-PCDH15 | Oligodendroglioma | 0.8889 | 1 | 0.8 | NOT-EPCAM AND TPBG | Leiomyosarcoma | 0.6667 | 0.7273 | 0.6154 |
| NKAIN4 AND NOT-NMUR2 | Oligodendroglioma | 0.8889 | 1 | 0.8 | NOT-ITGAV AND CD70 | AML | 0.7957 | 0.7285 | 0.8765 |
| NKAIN4 AND NOT-ADCY10 | Oligodendroglioma | 0.8889 | 1 | 0.8 | NOT-ITGAV AND SLC7A5 | AML | 0.792 | 0.7252 | 0.8725 |
| NKAIN4 AND NOT-P2RX3 | Oligodendroglioma | 0.8889 | 1 | 0.8 | NOT-EDNRB AND SLC7A5 | AML | 0.7709 | 0.6387 | 0.9721 |
| NKAIN4 AND NOT-P2RY4 | Oligodendroglioma | 0.8889 | 1 | 0.8 | NOT-CLDN12 AND CD37 | AML | 0.7708 | 0.6716 | 0.9044 |
| NKAIN4 AND NOT-SLC22A9 | Oligodendroglioma | 0.8889 | 1 | 0.8 | NOT-ITGAV AND SLC39A6 | AML | 0.769 | 0.6899 | 0.8685 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NKAIN4 AND NOT-CALY | Oligodendroglioma | 0.8889 | 1 | 0.8 | NOT-CLDN5 AND SLC7A5 | AML | 0.7519 | 0.6131 | 0.9721 |
| NKAIN4 AND NOT-RXFP3 | Oligodendroglioma | 0.8889 | 1 | 0.8 | NOT-ITGAV AND ENG | AML | 0.7406 | 0.7362 | 0.745 |
| NKAIN4 AND NOT-KCNK9 | Oligodendroglioma | 0.8889 | 1 | 0.8 | NOT-CLDN12 AND SLC7A5 | AML | 0.7255 | 0.615 | 0.8845 |
| NKAIN4 AND NOT-ATP8A2 | Oligodendroglioma | 0.8889 | 1 | 0.8 | NOT-EDNRB AND ENG | AML | 0.7244 | 0.6508 | 0.8167 |
| NKAIN4 AND NOT-FXYD7 | Oligodendroglioma | 0.8889 | 1 | 0.8 | NOT-EDNRB AND MUC1 | AML | 0.7185 | 0.76 | 0.6813 |
| NKAIN4 AND NOT-KCNK10 | Oligodendroglioma | 0.8889 | 1 | 0.8 | NOT-CLDN12 AND CD70 | AML | 0.7161 | 0.5927 | 0.9044 |
| NKAIN4 AND NOT-GPR85 | Oligodendroglioma | 0.8889 | 1 | 0.8 | NOT-ERBB3 AND MUC1 | AML | 0.7152 | 0.7731 | 0.6653 |
| NKAIN4 AND NOT-BEST2 | Oligodendroglioma | 0.8889 | 1 | 0.8 | NOT-ITGAV AND PROM1 | AML | 0.7149 | 0.7671 | 0.6693 |
| NKAIN4 AND NOT-SLC6A15 | Oligodendroglioma | 0.8889 | 1 | 0.8 | NOT-STEAP2 AND MUC1 | AML | 0.7134 | 0.7636 | 0.6693 |
| NKAIN4 AND NOT-SLC30A10 | Oligodendroglioma | 0.8889 | 1 | 0.8 | NOT-ITGAV AND CD38 | AML | 0.7122 | 0.6492 | 0.7888 |
| NKAIN4 AND NOT-GPR22 | Oligodendroglioma | 0.8889 | 1 | 0.8 | NOT-AXL AND CD70 | AML | 0.6892 | 0.5982 | 0.8127 |
| NKAIN4 AND NOT-DIO1 | Oligodendroglioma | 0.8889 | 1 | 0.8 | NOT-CLDN5 AND CD70 | AML | 0.6838 | 0.5988 | 0.7968 |
| NKAIN4 AND NOT-LRRN4 | Oligodendroglioma | 0.8889 | 1 | 0.8 | NOT-ITGAV AND MUC1 | AML | 0.6818 | 0.7937 | 0.5976 |
| NKAIN4 AND NOT-KCNV2 | Oligodendroglioma | 0.8889 | 1 | 0.8 | NOT-AXL AND SLC7A5 | AML | 0.6731 | 0.5148 | 0.9721 |
| NKAIN4 AND NOT-HTR3C | Oligodendroglioma | 0.8889 | 1 | 0.8 | NOT-AXL AND CD38 | AML | 0.6711 | 0.5734 | 0.8088 |
| NKAIN4 AND NOT-LRRC55 | Oligodendroglioma | 0.8889 | 1 | 0.8 | NOT-AXL AND MUC1 | AML | 0.6667 | 0.6849 | 0.6494 |
| NKAIN4 AND NOT-DSC1 | Oligodendroglioma | 0.8889 | 1 | 0.8 | NOT-GPNMB AND SLC7A5 | AML | 0.6627 | 0.5271 | 0.8924 |
| NKAIN4 AND NOT-DSCAM | Oligodendroglioma | 0.8889 | 1 | 0.8 | NOT-GPNMB AND MUC1 | AML | 0.6611 | 0.7009 | 0.6255 |
| NKAIN4 AND NOT-DTNA | Oligodendroglioma | 0.8889 | 1 | 0.8 | NOT-ITGAV AND CD79A | AML | 0.6581 | 0.6109 | 0.7131 |
| NKAIN4 AND NOT-EFNB2 | Oligodendroglioma | 0.8889 | 1 | 0.8 | NOT-CLDN12 AND MUC1 | AML | 0.651 | 0.7037 | 0.6056 |
| NKAIN4 AND NOT-EPHA2 | Oligodendroglioma | 0.8889 | 1 | 0.8 | NOT-KDR AND ENG | AML | 0.6471 | 0.5291 | 0.8327 |
| NKAIN4 AND NOT-EMP3 | Oligodendroglioma | 0.8889 | 1 | 0.8 | NOT-AXL AND ENG | AML | 0.6467 | 0.5352 | 0.8167 |
| NKAIN4 AND NOT-PAQR7 | Oligodendroglioma | 0.8889 | 1 | 0.8 | NOT-GPNMB AND ENG | AML | 0.6388 | 0.5504 | 0.761 |
| EPHA10 AND NOT-EMP3 | Ovarian | 0.7273 | 0.8 | 0.6667 | NOT-EGFR AND VCAM1 | B-Cell Diffuse | 0.6765 | 0.7419 | 0.6216 |
| EPHA10 AND NOT-GABRA2 | Ovarian | 0.72 | 0.6923 | 0.75 | NOT-EGFR AND GPNMB | B-Cell Diffuse | 0.6761 | 0.7059 | 0.6486 |
| EPHA10 AND NOT-ADAM2 | Ovarian | 0.7 | 0.875 | 0.5833 | NOT-STEAP2 AND GPNMB | B-Cell Diffuse | 0.6118 | 0.5417 | 0.7027 |
| EPHA10 AND NOT-MRGPRF | Ovarian | 0.6957 | 0.7273 | 0.6667 | NOT-TRPM4 AND ROR1 | Mantle-Cell Lymphoma | 0.8182 | 0.9643 | 0.7105 |
| EPHA10 AND NOT-GGTLC1 | Ovarian | 0.6957 | 0.7273 | 0.6667 | NOT-SLC34A2 AND ENG | Melanoma | 1 | 1 | 1 |
| EPHA10 AND NOT-ANO4 | Ovarian | 0.6957 | 0.7273 | 0.6667 | NOT-VTCN1 AND ENG | Melanoma | 0.9 | 1 | 0.8182 |
| EPHA10 AND NOT-MTNR1B | Ovarian | 0.6957 | 0.7273 | 0.6667 | NOT-SLC34A2 AND FAP | Melanoma | 0.9 | 1 | 0.8182 |
| EPHA10 AND NOT-SCARA5 | Ovarian | 0.6923 | 0.6429 | 0.75 | NOT-SLC34A2 AND GPNMB | Melanoma | 1 | 1 | 1 |
| EPHA10 AND NOT-CDH9 | Ovarian | 0.6923 | 0.6429 | 0.75 | NOT-VTCN1 AND GPNMB | Melanoma | 0.9 | 1 | 0.8182 |
| EPHA10 AND NOT-CD36 | Ovarian | 0.72 | 0.6923 | 0.75 | NOT-VTCN1 AND FAP | Melanoma | 0.8421 | 1 | 0.7273 |
| EPHA10 AND NOT-XCR1 | Ovarian | 0.6957 | 0.7273 | 0.6667 | NOT-VTCN1 AND ERBB2 | Melanoma | 0.8421 | 1 | 0.7273 |
| EPHA10 AND NOT-SLC22A13 | Ovarian | 0.7 | 0.875 | 0.5833 | NOT-CLDN7 AND ERBB2 | Melanoma | 0.9524 | 1 | 0.9091 |
| EPHA10 AND NOT-TAS2R1 | Ovarian | 0.75 | 0.75 | 0.75 | NOT-VTCN1 AND STEAP1 | Melanoma | 0.8421 | 1 | 0.7273 |
| CSPG5 AND NOT-PAQR8 | Ovarian | 0.8 | 1 | 0.6667 | NOT-CLDN7 AND TRPM4 | Melanoma | 0.9524 | 1 | 0.9091 |
| EPHA10 AND NOT-CHRNB4 | Ovarian | 0.6667 | 0.6667 | 0.6667 | NOT-VTCN1 AND CD276 | Melanoma | 0.8421 | 1 | 0.7273 |
| EPHA10 AND NOT-MLNR | Ovarian | 0.6667 | 0.6667 | 0.6667 | NOT-CLDN7 AND PTK7 | Melanoma | 0.9524 | 1 | 0.9091 |
| EPHA10 AND NOT-KCNA4 | Ovarian | 0.6667 | 0.6667 | 0.6667 | NOT-SLC34A2 AND STEAP1 | Melanoma | 0.9524 | 1 | 0.9091 |
| EPHA10 AND NOT-GSG1L | Ovarian | 0.6667 | 0.6667 | 0.6667 | NOT-CLDN7 AND STEAP1 | Melanoma | 0.9524 | 1 | 0.9091 |
| EPHA10 AND NOT-PCDH15 | Ovarian | 0.6667 | 0.6667 | 0.6667 | NOT-SLC34A2 AND ERBB2 | Melanoma | 0.9524 | 1 | 0.9091 |
| EPHA10 AND NOT-SLC1A6 | Ovarian | 0.6667 | 0.6667 | 0.6667 | NOT-VTCN1 AND VCAM1 | Melanoma | 0.9 | 1 | 0.8182 |
| EPHA10 AND NOT-CNIH2 | Ovarian | 0.6667 | 0.6667 | 0.6667 | NOT-CLDN7 AND SDC1 | Melanoma | 0.9524 | 1 | 0.9091 |
| EPHA10 AND NOT-PCDHA6 | Ovarian | 0.6667 | 0.6667 | 0.6667 | NOT-SLC34A2 AND PTK7 | Melanoma | 0.9091 | 0.9091 | 0.9091 |
| EPHA10 AND NOT-ATP1B4 | Ovarian | 0.6667 | 0.6667 | 0.6667 | NOT-CLDN7 AND GPNMB | Melanoma | 1 | 1 | 1 |
| EPHA10 AND NOT-NMBR | Ovarian | 0.6667 | 0.6667 | 0.6667 | NOT-SLC34A2 AND CD276 | Melanoma | 0.9524 | 1 | 0.9091 |
| EPHA10 AND NOT-LRFN2 | Ovarian | 0.6667 | 0.6667 | 0.6667 | NOT-CLDN7 AND CD276 | Melanoma | 0.9 | 1 | 0.8182 |
| EPHA10 AND NOT-GABRD | Ovarian | 0.6667 | 0.6667 | 0.6667 | NOT-SLC34A2 AND ERBB3 | Melanoma | 0.7778 | 1 | 0.6364 |
| EPHA10 AND NOT-BEST3 | Ovarian | 0.6667 | 0.6667 | 0.6667 | NOT-CLDN7 AND ERBB3 | Melanoma | 0.7778 | 1 | 0.6364 |
| EPHA10 AND NOT-KCNK6 | Ovarian | 0.6667 | 0.6667 | 0.6667 | NOT-VTCN1 AND ERBB3 | Melanoma | 0.9 | 1 | 0.8182 |
| EPHA10 AND NOT-SLC6A18 | Ovarian | 0.6667 | 0.6 | 0.75 | NOT-CLDN7 AND ENG | Melanoma | 1 | 1 | 1 |
| EPHA10 AND NOT-AOC3 | Ovarian | 0.6667 | 0.6 | 0.75 | NOT-VTCN1 AND SDC1 | Melanoma | 0.9 | 1 | 0.8182 |
| EPHA10 AND NOT-MLC1 | Ovarian | 0.8 | 1 | 0.6667 | NOT-SLC34A2 AND VCAM1 | Melanoma | 1 | 1 | 1 |
| EPHA10 AND NOT-OR4N4 | Ovarian | 0.6667 | 0.6667 | 0.6667 | NOT-EGFR AND PTK7 | Neuroblastoma | 0.9294 | 0.9186 | 0.9405 |
| EPHA10 AND NOT-SLC23A2 | Ovarian | 0.6667 | 0.6667 | 0.6667 | NOT-EGFR AND CD276 | Neuroblastoma | 0.904 | 0.8602 | 0.9524 |
| EPHA10 AND NOT-ABCA12 | Ovarian | 0.7 | 0.875 | 0.5833 | NOT-EGFR AND BMPR1B | Neuroblastoma | 0.878 | 0.9 | 0.8571 |
| EPHA10 AND NOT-HCN1 | Ovarian | 0.6667 | 0.6667 | 0.6667 | NOT-TRPM4 AND CD276 | Neuroblastoma | 0.7771 | 0.7473 | 0.8095 |
| EPHA10 AND NOT-ABCG4 | Ovarian | 0.7368 | 1 | 0.5833 | NOT-EGFR AND CLDN12 | Neuroblastoma | 0.7418 | 0.6124 | 0.9405 |
| EPHA10 AND NOT-USH2A | Ovarian | 0.6667 | 0.6667 | 0.6667 | NOT-EGFR AND GPNMB | Neuroblastoma | 0.7317 | 0.6198 | 0.8929 |
| EPHA10 AND NOT-NOX1 | Ovarian | 0.6429 | 0.5625 | 0.75 | NOT-CLDN7 AND PTK7 | Neuroblastoma | 0.73 | 0.6293 | 0.869 |
| EPHA10 AND NOT-UMODL1 | Ovarian | 0.64 | 0.6154 | 0.6667 | NOT-ERBB2 AND PTK7 | Neuroblastoma | 0.7263 | 0.6842 | 0.7738 |
| EPHA10 AND NOT-ASTN1 | Ovarian | 0.64 | 0.6154 | 0.6667 | NOT-IL20RA AND CD276 | Neuroblastoma | 0.7255 | 0.6167 | 0.881 |
| EPHA10 AND NOT-OR2L2 | Ovarian | 0.64 | 0.6154 | 0.6667 | NOT-PCYT1A AND CD276 | Neuroblastoma | 0.7882 | 0.7791 | 0.7976 |
| EPHA10 AND NOT-SLC9B1 | Ovarian | 0.64 | 0.6154 | 0.6667 | NOT-RNF43 AND PTK7 | Neuroblastoma | 0.7192 | 0.6134 | 0.869 |
| EPHA10 AND NOT-ADAM20 | Ovarian | 0.64 | 0.6154 | 0.6667 | NOT-ERBB3 AND GPNMB | Sarcoma | 0.625 | 0.6667 | 0.5882 |
| EPHA10 AND NOT-LRRN4 | Ovarian | 0.64 | 0.6154 | 0.6667 | NOT-IL20RA AND GPNMB | Sarcoma | 0.6154 | 0.5455 | 0.7059 |
| EPHA10 AND NOT-GABRG1 | Ovarian | 0.6667 | 0.6667 | 0.6667 | PTPRZ1 AND NOT-GRM3 | Astrocytoma | 0.881 | 0.9737 | 0.8043 |
| EPHA10 AND NOT-OR3A1 | Ovarian | 0.64 | 0.6154 | 0.6667 | PTPRZ1 AND NOT-GABRA2 | Astrocytoma | 0.8817 | 0.8723 | 0.8913 |
| EPHA10 AND NOT-ATP6V0A4 | Ovarian | 0.64 | 0.6154 | 0.6667 | PTPRZ1 AND NOT-KCNJ6 | Astrocytoma | 0.8276 | 0.878 | 0.7826 |
| EPHA10 AND NOT-LPPR3 | Ovarian | 0.64 | 0.6154 | 0.6667 | NRCAM AND NOT-CDH18 | Astrocytoma | 0.8235 | 0.8974 | 0.7609 |
| EPHA10 AND NOT-GABRG3 | Ovarian | 0.64 | 0.6154 | 0.6667 | PTPRZ1 AND NOT-KIAA0319 | Astrocytoma | 0.8235 | 0.8974 | 0.7609 |
| EPHA10 AND NOT-TRPM1 | Ovarian | 0.64 | 0.6154 | 0.6667 | NKAIN4 AND NOT-CDH7 | Astrocytoma | 0.8205 | 1 | 0.6957 |
| EPHA10 AND NOT-SLC5A11 | Ovarian | 0.64 | 0.6154 | 0.6667 | PTPRZ1 AND NOT-GPR83 | Astrocytoma | 0.8095 | 0.8947 | 0.7391 |
| EPHA10 AND NOT-ERVW-1 | Ovarian | 0.64 | 0.6154 | 0.6667 | NKAIN4 AND NOT-TMEM130 | Astrocytoma | 0.8095 | 0.8947 | 0.7391 |
| EPHA10 AND NOT-KCNJ10 | Ovarian | 0.64 | 0.6154 | 0.6667 | NKAIN4 AND NOT-DIO2 | Astrocytoma | 0.8095 | 0.8947 | 0.7391 |
| EPHA10 AND NOT-GRID2 | Ovarian | 0.64 | 0.6154 | 0.6667 | NKAIN4 AND NOT-ADRA2C | Astrocytoma | 0.8052 | 1 | 0.6739 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| EPHA10 AND NOT-SLC17A2 | Ovarian | 0.6364 | 0.7 | 0.5833 | PTPRZ1 AND NOT-CDH18 | Astrocytoma | 0.8043 | 0.8043 | 0.8043 |
| EPHA10 AND NOT-GALR1 | Ovarian | 0.6364 | 0.7 | 0.5833 | PTPRZ1 AND NOT-DGKE | Astrocytoma | 0.8043 | 0.8043 | 0.8043 |
| EPHA10 AND NOT-CALY | Ovarian | 0.6364 | 0.7 | 0.5833 | PTPRZ1 AND NOT-CDH8 | Astrocytoma | 0.7957 | 0.7872 | 0.8043 |
| EPHA10 AND NOT-KCNQ2 | Ovarian | 0.64 | 0.6154 | 0.6667 | VANGL2 AND NOT-STEAP4 | Astrocytoma | 0.8041 | 0.7647 | 0.8478 |
| EPHA10 AND NOT-SLC22A25 | Ovarian | 0.6957 | 0.7273 | 0.6667 | NKAIN4 AND NOT-KCNJ12 | Astrocytoma | 0.7952 | 0.8919 | 0.7174 |
| EPHA10 AND NOT-ADCY8 | Ovarian | 0.6667 | 0.6667 | 0.6667 | NKAIN4 AND NOT-SLC22A24 | Astrocytoma | 0.7952 | 0.8919 | 0.7174 |
| EPHA10 AND NOT-CD58 | Ovarian | 0.6207 | 0.5294 | 0.75 | NKAIN4 AND NOT-PLXNA2 | Astrocytoma | 0.7901 | 0.9143 | 0.6957 |
| EPHA10 AND NOT-TTYH3 | Ovarian | 0.6207 | 0.5294 | 0.75 | NKAIN4 AND NOT-CDH12 | Astrocytoma | 0.7901 | 0.9143 | 0.6957 |
| EPHA10 AND NOT-ANTXR2 | Ovarian | 0.6207 | 0.5294 | 0.75 | PTPRZ1 AND NOT-GABRA1 | Astrocytoma | 0.7857 | 0.8684 | 0.7174 |
| EPHA10 AND NOT-CD74 | Ovarian | 0.6207 | 0.5294 | 0.75 | NRCAM AND NOT-CDH8 | Astrocytoma | 0.7857 | 0.8684 | 0.7174 |
| EPHA10 AND NOT-GYPC | Ovarian | 0.6207 | 0.5294 | 0.75 | NRCAM AND NOT-GABRA1 | Astrocytoma | 0.7848 | 0.9394 | 0.6739 |
| EPHA10 AND NOT-IL17RA | Ovarian | 0.6207 | 0.5294 | 0.75 | PTPRZ1 AND NOT-DYSF | Astrocytoma | 0.781 | 0.6949 | 0.8913 |
| EPHA10 AND NOT-F2R | Ovarian | 0.72 | 0.6923 | 0.75 | NKAIN4 AND NOT-KCNH3 | Astrocytoma | 0.7805 | 0.8889 | 0.6957 |
| EPHA10 AND NOT-GNRHR | Ovarian | 0.6667 | 0.6667 | 0.6667 | NKAIN4 AND NOT-CHRM3 | Astrocytoma | 0.7805 | 0.8889 | 0.6957 |
| EPHA10 AND NOT-CRB2 | Ovarian | 0.6667 | 0.6667 | 0.6667 | NKAIN4 AND NOT-JAG2 | Astrocytoma | 0.7805 | 0.8889 | 0.6957 |
| EPHA10 AND NOT-GLRA3 | Ovarian | 0.72 | 0.6923 | 0.75 | NKAIN4 AND NOT-CACNA1A | Astrocytoma | 0.7805 | 0.8889 | 0.6957 |
| EPHA10 AND NOT-ZDHHC2 | Ovarian | 0.6667 | 0.7778 | 0.5833 | NKAIN4 AND NOT-LRRC8B | Astrocytoma | 0.7805 | 0.8889 | 0.6957 |
| EPHA10 AND NOT-GHSR | Ovarian | 0.6154 | 0.5714 | 0.6667 | NKAIN4 AND NOT-SEMA4F | Astrocytoma | 0.7805 | 0.8889 | 0.6957 |
| EPHA10 AND NOT-KCNA10 | Ovarian | 0.6154 | 0.5714 | 0.6667 | VANGL2 AND NOT-LRIG3 | Astrocytoma | 0.7879 | 0.7358 | 0.8478 |
| EPHA10 AND NOT-KCNF1 | Ovarian | 0.6154 | 0.5714 | 0.6667 | NKAIN4 AND NOT-NPY1R | Astrocytoma | 0.7792 | 0.9677 | 0.6522 |
| EPHA10 AND NOT-NFASC | Ovarian | 0.6154 | 0.5714 | 0.6667 | NKAIN4 AND NOT-EPHA7 | Astrocytoma | 0.7733 | 1 | 0.6304 |
| EPHA10 AND NOT-GRIN1 | Ovarian | 0.6154 | 0.5714 | 0.6667 | NRCAM AND NOT-DGKE | Astrocytoma | 0.7727 | 0.8095 | 0.7391 |
| EPHA10 AND NOT-MUC17 | Ovarian | 0.6154 | 0.5714 | 0.6667 | NKAIN4 AND NOT-ANO3 | Astrocytoma | 0.7654 | 0.8857 | 0.6739 |
| EPHA10 AND NOT-CLCN1 | Ovarian | 0.6154 | 0.5714 | 0.6667 | NKAIN4 AND NOT-DNAJC5 | Astrocytoma | 0.7654 | 0.8857 | 0.6739 |
| EPHA10 AND NOT-PTPRR | Ovarian | 0.6154 | 0.5714 | 0.6667 | NKAIN4 AND NOT-VIPR1 | Astrocytoma | 0.7654 | 0.8857 | 0.6739 |
| EPHA10 AND NOT-ATP8B2 | Ovarian | 0.6154 | 0.5714 | 0.6667 | NKAIN4 AND NOT-EFNB3 | Astrocytoma | 0.7654 | 0.8857 | 0.6739 |
| EPHA10 AND NOT-NTSR2 | Ovarian | 0.6154 | 0.5714 | 0.6667 | NKAIN4 AND NOT-ADCY1 | Astrocytoma | 0.7654 | 0.8857 | 0.6739 |
| EPHA10 AND NOT-HTR1D | Ovarian | 0.6154 | 0.5714 | 0.6667 | PTPRZ1 AND NOT-SLC12A5 | Astrocytoma | 0.7654 | 0.8857 | 0.6739 |
| EPHA10 AND NOT-HCN2 | Ovarian | 0.6154 | 0.5714 | 0.6667 | NKAIN4 AND NOT-GABRB3 | Astrocytoma | 0.7654 | 0.8857 | 0.6739 |
| EPHA10 AND NOT-KCNK12 | Ovarian | 0.6154 | 0.5714 | 0.6667 | VANGL2 AND NOT-EPHA2 | Astrocytoma | 0.7647 | 0.6964 | 0.8478 |
| EPHA10 AND NOT-KCNK10 | Ovarian | 0.6154 | 0.5714 | 0.6667 | ADAM12 AND NOT-PROCR | Breast | 0.8411 | 0.8491 | 0.8333 |
| EPHA10 AND NOT-GRIK4 | Ovarian | 0.6154 | 0.5714 | 0.6667 | ADAM12 AND NOT-SCARA5 | Breast | 0.8381 | 0.8627 | 0.8148 |
| EPHA10 AND NOT-SLC12A9 | Ovarian | 0.6154 | 0.5714 | 0.6667 | ADAM12 AND NOT-SLC2A1 | Breast | 0.8257 | 0.8182 | 0.8333 |
| EPHA10 AND NOT-SYT4 | Ovarian | 0.6154 | 0.5714 | 0.6667 | ADAM12 AND NOT-SLC22A11 | Breast | 0.8182 | 0.8036 | 0.8333 |
| EPHA10 AND NOT-MEGF11 | Ovarian | 0.6154 | 0.5714 | 0.6667 | ADAM12 AND NOT-AOC3 | Breast | 0.8182 | 0.8036 | 0.8333 |
| KCNU1 AND NOT-ADAM2 | Ovarian | 0.8571 | 1 | 0.75 | ADAM12 AND NOT-MRGPRF | Breast | 0.8073 | 0.8 | 0.8148 |
| TRPM8 AND NOT-SLC16A5 | Prostate | 0.8571 | 1 | 0.75 | ADAM12 AND NOT-ERVW-1 | Breast | 0.8073 | 0.8 | 0.8148 |
| TRPM8 AND NOT-SLC39A2 | Prostate | 1 | 1 | 1 | ADAM12 AND NOT-ANTXR2 | Breast | 0.8037 | 0.8113 | 0.7963 |
| GHR AND NOT-CD36 | Prostate | 0.8571 | 1 | 0.75 | ADAM12 AND NOT-MRAP | Breast | 0.7963 | 0.7963 | 0.7963 |
| TRPM8 AND NOT-SLC4A8 | Prostate | 0.8889 | 0.8 | 1 | ADAM12 AND NOT-THBD | Breast | 0.7921 | 0.8511 | 0.7407 |
| TRPM8 AND NOT-NRG3 | Prostate | 0.8571 | 1 | 0.75 | ADAM12 AND NOT-S1PR1 | Breast | 0.7885 | 0.82 | 0.7593 |
| TRPM8 AND NOT-SYT4 | Prostate | 0.8 | 0.6667 | 1 | ADAM12 AND NOT-PHLDB2 | Breast | 0.785 | 0.7925 | 0.7778 |
| TRPM8 AND NOT-GRIN2C | Prostate | 0.8889 | 0.8 | 1 | SLC5A6 AND NOT-PAQR7 | Breast | 0.7778 | 0.9722 | 0.6481 |
| TRPM8 AND NOT-FMNL1 | Prostate | 1 | 1 | 1 | PPAPDC1A AND NOT-DPP6 | Breast | 0.7917 | 0.9048 | 0.7037 |
| TRPM8 AND NOT-SLC9A1 | Prostate | 0.75 | 0.75 | 0.75 | PPAPDC1A AND NOT-SLC4A4 | Breast | 0.8085 | 0.95 | 0.7037 |
| TRPM8 AND NOT-CALN1 | Prostate | 0.75 | 0.75 | 0.75 | PPAPDC1A AND NOT-LRRTM2 | Breast | 0.7835 | 0.8837 | 0.7037 |
| TRPM8 AND NOT-SLC17A2 | Prostate | 0.75 | 0.75 | 0.75 | PPAPDC1A AND NOT-PCDH9 | Breast | 0.7917 | 0.9048 | 0.7037 |
| TRPM8 AND NOT-SLC22A18 | Prostate | 0.7273 | 0.5714 | 1 | PPAPDC1A AND NOT-ADCYAP1R1 | Breast | 0.7677 | 0.8444 | 0.7037 |
| TRPM8 AND NOT-GUCY2D | Prostate | 0.7273 | 0.5714 | 1 | LRRC8E AND NOT-GJB5 | Breast | 0.7477 | 0.7547 | 0.7407 |
| TRPM8 AND NOT-CD36 | Prostate | 0.7273 | 0.5714 | 1 | PPAPDC1A AND NOT-CADM2 | Breast | 0.7755 | 0.8636 | 0.7037 |
| TRPM8 AND NOT-TTYH2 | Prostate | 0.7273 | 0.5714 | 1 | LRRC8E AND NOT-DNER | Breast | 0.78 | 0.8478 | 0.7222 |
| TRPM8 AND NOT-PTGER4 | Prostate | 0.7273 | 0.5714 | 1 | VANGL1 AND NOT-CLCA4 | Breast | 0.7451 | 0.7917 | 0.7037 |
| TRPM8 AND NOT-CHRNA2 | Prostate | 0.7273 | 0.5714 | 1 | PPAPDC1A AND NOT-IGSF11 | Breast | 0.7451 | 0.7917 | 0.7037 |
| TRPM8 AND NOT-PIK3IP1 | Prostate | 0.7273 | 0.5714 | 1 | PRLR AND NOT-XCR1 | Breast | 0.7447 | 0.875 | 0.6481 |
| TRPM8 AND NOT-PAQR8 | Prostate | 0.7273 | 0.5714 | 1 | PPAPDC1A AND NOT-ATP1A2 | Breast | 0.7423 | 0.8372 | 0.6667 |
| TRPM8 AND NOT-LAT | Prostate | 0.7273 | 0.5714 | 1 | PPAPDC1A AND NOT-FLRT1 | Breast | 0.7826 | 0.9474 | 0.6667 |
| TRPM8 AND NOT-DYSF | Prostate | 0.7273 | 0.5714 | 1 | PPAPDC1A AND NOT-PLP1 | Breast | 0.7551 | 0.8409 | 0.6852 |
| TRPM8 AND NOT-CDH10 | Prostate | 0.7273 | 0.5714 | 1 | PPAPDC1A AND NOT-ATP1B2 | Breast | 0.7835 | 0.8837 | 0.7037 |
| TRPM8 AND NOT-NFASC | Prostate | 0.7273 | 0.5714 | 1 | PPAPDC1A AND NOT-MAL | Breast | 0.7447 | 0.875 | 0.6481 |
| TRPM8 AND NOT-GYPC | Prostate | 0.7273 | 0.5714 | 1 | SLC5A6 AND NOT-SLC9B1 | Breast | 0.7778 | 0.9722 | 0.6481 |
| TRPM8 AND NOT-PAQR7 | Prostate | 0.7273 | 0.5714 | 1 | PPAPDC1A AND NOT-DNER | Breast | 0.76 | 0.8261 | 0.7037 |
| TRPM8 AND NOT-STAB1 | Prostate | 0.7273 | 0.5714 | 1 | PPAPDC1A AND NOT-SLC6A1 | Breast | 0.7379 | 0.7755 | 0.7037 |
| TRPM8 AND NOT-EMP3 | Prostate | 0.7273 | 0.5714 | 1 | SLC5A6 AND NOT-MPL | Breast | 0.7527 | 0.8974 | 0.6481 |
| TRPM8 AND NOT-SEMA4D | Prostate | 0.7273 | 0.5714 | 1 | PRLR AND NOT-CACNG3 | Breast | 0.7368 | 0.8537 | 0.6481 |
| TRPM8 AND NOT-EPHA2 | Prostate | 0.7273 | 0.5714 | 1 | PRLR AND NOT-NPHS1 | Breast | 0.7368 | 0.8537 | 0.6481 |
| TRPM8 AND NOT-IL17RA | Prostate | 0.7273 | 0.5714 | 1 | PRLR AND NOT-SLC22A6 | Breast | 0.7368 | 0.8537 | 0.6481 |
| TRPM8 AND NOT-AGER | Prostate | 0.7273 | 0.5714 | 1 | LRRC8E AND NOT-CLCA4 | Breast | 0.7358 | 0.75 | 0.7222 |
| TRPM8 AND NOT-BST2 | Prostate | 0.7273 | 0.5714 | 1 | SLC5A6 AND NOT-GPR22 | Breast | 0.7447 | 0.875 | 0.6481 |
| TRPM8 AND NOT-GABRA1 | Prostate | 0.7273 | 0.5714 | 1 | PPAPDC1A AND NOT-GPM6B | Breast | 0.7551 | 0.8409 | 0.6852 |
| TRPM8 AND NOT-TNFRSF12A | Prostate | 0.7273 | 0.5714 | 1 | PPAPDC1A AND NOT-GPM6A | Breast | 0.7333 | 0.9167 | 0.6111 |
| TRPM8 AND NOT-SLC5A2 | Prostate | 0.7273 | 0.5714 | 1 | PRLR AND NOT-CDH18 | Breast | 0.7447 | 0.875 | 0.6481 |
| UPK3A AND NOT-SCARA5 | Prostate | 0.75 | 0.75 | 0.75 | SLC5A6 AND NOT-EMP3 | Breast | 0.7609 | 0.9211 | 0.6481 |
| ADAM2 AND NOT-MC2R | Prostate | 0.8571 | 1 | 0.75 | PPAPDC1A AND NOT-SLC7A14 | Breast | 0.7525 | 0.8085 | 0.7037 |
| UPK3A AND NOT-CACNG6 | Prostate | 0.75 | 0.75 | 0.75 | PPAPDC1A AND NOT-AQP4 | Breast | 0.7708 | 0.881 | 0.6852 |
| UPK3A AND NOT-NTSR2 | Prostate | 0.75 | 0.75 | 0.75 | SLC5A6 AND NOT-DGKE | Breast | 0.764 | 0.9714 | 0.6296 |
| TRPM8 AND NOT-GALR1 | Prostate | 0.6667 | 1 | 0.5 | SLC5A6 AND NOT-SEMA4D | Breast | 0.7778 | 0.9722 | 0.6481 |
| TRPM8 AND NOT-SLC23A2 | Prostate | 0.6667 | 1 | 0.5 | PPAPDC1A AND NOT-KCNH8 | Breast | 0.7308 | 0.76 | 0.7037 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| TRPM8 AND NOT-CLSTN3 | Prostate | 0.6667 | 1 | 0.5 | PRLR AND NOT-SLC22A11 | Breast | 0.7292 | 0.8333 | 0.6481 |
| UPK3A AND NOT-CACNG1 | Prostate | 0.6667 | 1 | 0.5 | PRLR AND NOT-C8B | Breast | 0.7292 | 0.8333 | 0.6481 |
| TRPM8 AND NOT-MEGF10 | Prostate | 0.6667 | 1 | 0.5 | PRLR AND NOT-TRPM3 | Breast | 0.7292 | 0.8333 | 0.6481 |
| UPK3A AND NOT-HTR5A | Prostate | 0.6667 | 1 | 0.5 | PRLR AND NOT-MTNR1B | Breast | 0.7292 | 0.8333 | 0.6481 |
| TRPM8 AND NOT-TRPC3 | Prostate | 0.6667 | 1 | 0.5 | PPAPDC1A AND NOT-NRXN1 | Breast | 0.7273 | 0.8 | 0.6667 |
| STEAP4 AND NOT-CD58 | Prostate | 0.6667 | 1 | 0.5 | PPAPDC1A AND NOT-GRIK2 | Breast | 0.7273 | 0.8 | 0.6667 |
| TRPM8 AND NOT-OPRK1 | Prostate | 0.6667 | 1 | 0.5 | PPAPDC1A AND NOT-ATP10B | Breast | 0.7629 | 0.8605 | 0.6852 |
| TRPM8 AND NOT-SEZ6 | Prostate | 0.6667 | 1 | 0.5 | PPAPDC1A AND NOT-NTRK3 | Breast | 0.7255 | 0.7708 | 0.6852 |
| UPK3A AND NOT-VN1R2 | Prostate | 0.6667 | 1 | 0.5 | SLCO1B1 AND NOT-CLEC1B | Liver | 0.9091 | 1 | 0.8333 |
| UPK3A AND NOT-KCNA7 | Prostate | 0.6667 | 1 | 0.5 | SLCO1B1 AND NOT-KCNN2 | Liver | 1 | 1 | 1 |
| UPK3A AND NOT-ATP1B4 | Prostate | 0.6667 | 0.6 | 0.75 | SLCO1B1 AND NOT-MARCO | Liver | 0.8 | 0.6667 | 1 |
| TRPM8 AND NOT-PLVAP | Prostate | 0.6667 | 0.6 | 0.75 | SLC17A2 AND NOT-CLEC1B | Liver | 0.8 | 1 | 0.6667 |
| TRPM8 AND NOT-CALHM3 | Prostate | 0.6667 | 0.6 | 0.75 | SLC43A1 AND NOT-NPY1R | Liver | 0.8 | 1 | 0.6667 |
| UPK3A AND NOT-GYPC | Prostate | 0.6667 | 0.6 | 0.75 | SLCO1B1 AND NOT-STAB2 | Liver | 0.8 | 1 | 0.6667 |
| UPK3A AND NOT-DYSF | Prostate | 0.6667 | 0.6 | 0.75 | SLCO1B1 AND NOT-GPR182 | Liver | 0.8 | 1 | 0.6667 |
| UPK3A AND NOT-BEST3 | Prostate | 0.6667 | 0.6 | 0.75 | SLCO1B1 AND NOT-CLEC4G | Liver | 0.8 | 1 | 0.6667 |
| UPK3A AND NOT-CACNA1S | Prostate | 0.6667 | 0.6 | 0.75 | SLCO1B1 AND NOT-PTH1R | Liver | 0.8 | 1 | 0.6667 |
| UPK3A AND NOT-CD36 | Prostate | 0.6667 | 0.6 | 0.75 | SLC10A1 AND NOT-CLEC4G | Liver | 0.8 | 1 | 0.6667 |
| TRPM8 AND NOT-DTNA | Prostate | 0.6667 | 0.6 | 0.75 | SLCO1B1 AND NOT-CLEC4M | Liver | 0.8 | 1 | 0.6667 |
| UPK3A AND NOT-TTYH2 | Prostate | 0.6667 | 0.6 | 0.75 | SLC4A2 AND NOT-SLC9A1 | Liver | 0.8 | 1 | 0.6667 |
| UPK3A AND NOT-CHRNA1 | Prostate | 0.6667 | 0.6 | 0.75 | ABCG8 AND NOT-CDHR2 | Liver | 0.8 | 1 | 0.6667 |
| ADAM2 AND NOT-OR1Q1 | Prostate | 0.8571 | 1 | 0.75 | SLC10A1 AND NOT-CLEC1B | Liver | 0.8 | 1 | 0.6667 |
| ADAM2 AND NOT-MRGPRX2 | Prostate | 0.6667 | 0.6 | 0.75 | SLC4A2 AND NOT-THBD | Liver | 0.8 | 1 | 0.6667 |
| ADAM2 AND NOT-DRD1 | Prostate | 0.6667 | 1 | 0.5 | SLC2A2 AND NOT-CLEC1B | Liver | 0.9091 | 1 | 0.8333 |
| ADAM2 AND NOT-CACNG1 | Prostate | 0.8571 | 1 | 0.75 | SLC4A2 AND NOT-PAQR7 | Liver | 0.8 | 1 | 0.6667 |
| ADAM2 AND NOT-LRRC52 | Prostate | 0.8571 | 1 | 0.75 | SLC17A2 AND NOT-KCNN2 | Liver | 0.9091 | 1 | 0.8333 |
| ADAM2 AND NOT-SLC22A9 | Prostate | 0.8571 | 1 | 0.75 | SLC30A8 AND NOT-FUT1 | Pancreas | 0.7778 | 1 | 0.6364 |
| ADAM2 AND NOT-KCNA4 | Prostate | 0.8571 | 1 | 0.75 | SLC30A8 AND NOT-ANO5 | Pancreas | 0.7059 | 1 | 0.5455 |
| ADAM2 AND NOT-CD82 | Prostate | 0.8571 | 1 | 0.75 | SLC30A8 AND NOT-LAG3 | Pancreas | 0.7778 | 1 | 0.6364 |
| ADAM2 AND NOT-CLDN19 | Prostate | 0.8571 | 1 | 0.75 | SLC30A8 AND NOT-LIFR | Pancreas | 0.625 | 1 | 0.4545 |
| ADAM2 AND NOT-OMG | Prostate | 0.8571 | 1 | 0.75 | SLC30A8 AND NOT-PRLR | Pancreas | 0.7778 | 1 | 0.6364 |
| TRPM8 AND NOT-CD82 | Prostate | 0.6667 | 1 | 0.5 | SLC30A8 AND NOT-CHRM3 | Pancreas | 0.7778 | 1 | 0.6364 |
| ADAM2 AND NOT-CACNG6 | Prostate | 0.6667 | 1 | 0.5 | SLC30A8 AND NOT-OR1J4 | Pancreas | 0.7778 | 1 | 0.6364 |
| ADAM2 AND NOT-SLC22A14 | Prostate | 0.6667 | 1 | 0.5 | SLC30A8 AND NOT-TRHDE | Pancreas | 0.7778 | 1 | 0.6364 |
| ADAM2 AND NOT-FMNL1 | Prostate | 0.6667 | 1 | 0.5 | NOX4 AND NOT-PAQR7 | Pancreas | 0.6087 | 0.5833 | 0.6364 |
| ADAM2 AND NOT-CD1A | Prostate | 0.6667 | 0.6 | 0.75 | SLC30A8 AND NOT-NRCAM | Pancreas | 0.7778 | 1 | 0.6364 |
| ADAM2 AND NOT-RGR | Prostate | 0.6667 | 1 | 0.5 | SLC30A8 AND NOT-OR3A3 | Pancreas | 0.7059 | 1 | 0.5455 |
| UPK3A AND NOT-CLDN17 | Prostate | 0.6667 | 1 | 0.5 | SLC30A8 AND NOT-SIGLEC11 | Pancreas | 0.7778 | 1 | 0.6364 |
| UPK3A AND NOT-MC2R | Prostate | 0.6667 | 1 | 0.5 | SLC30A8 AND NOT-CLCNKB | Pancreas | 0.7059 | 1 | 0.5455 |
| UPK3A AND NOT-MEGF11 | Prostate | 0.6667 | 1 | 0.5 | SLC30A8 AND NOT-LPAR3 | Pancreas | 0.7778 | 1 | 0.6364 |
| UPK3A AND NOT-PTGER4 | Prostate | 0.6667 | 0.6 | 0.75 | SLC30A8 AND NOT-KCNJ13 | Pancreas | 0.7059 | 1 | 0.5455 |
| GGTLC1 AND NOT-DYSF | Prostate | 0.8571 | 1 | 0.75 | SLC30A8 AND NOT-AQP11 | Pancreas | 0.7778 | 1 | 0.6364 |
| ADAM2 AND NOT-PORCN | Prostate | 0.6667 | 0.6 | 0.75 | SLC30A8 AND NOT-STX1B | Pancreas | 0.7778 | 1 | 0.6364 |
| ADAM2 AND NOT-FUT3 | Prostate | 0.6667 | 0.6 | 0.75 | SLC30A8 AND NOT-SLC38A4 | Pancreas | 0.625 | 1 | 0.4545 |
| STAB1 AND NOT-NFASC | Sarcoma | 0.7586 | 0.9167 | 0.6471 | SLC30A8 AND NOT-KCNJ5 | Pancreas | 0.7059 | 1 | 0.5455 |
| STAB1 AND NOT-ATP13A5 | Sarcoma | 0.7097 | 0.7857 | 0.6471 | SLC30A8 AND NOT-TMEM8A | Pancreas | 0.7778 | 1 | 0.6364 |
| STAB1 AND NOT-CDH17 | Sarcoma | 0.7333 | 0.8462 | 0.6471 | SLC30A8 AND NOT-NRG4 | Pancreas | 0.7778 | 1 | 0.6364 |
| STAB1 AND NOT-CD1A | Sarcoma | 0.7333 | 0.8462 | 0.6471 | SLC30A8 AND NOT-SLC22A7 | Pancreas | 0.7778 | 1 | 0.6364 |
| STAB1 AND NOT-CLDN19 | Sarcoma | 0.7407 | 1 | 0.5882 | SLC30A8 AND NOT-CD300C | Pancreas | 0.7778 | 1 | 0.6364 |
| STAB1 AND NOT-NRG3 | Sarcoma | 0.7407 | 1 | 0.5882 | SLC30A8 AND NOT-SLC16A10 | Pancreas | 0.7778 | 1 | 0.6364 |
| STAB1 AND NOT-CLDN10 | Sarcoma | 0.6875 | 0.7333 | 0.6471 | SLC30A8 AND NOT-JPH1 | Pancreas | 0.7778 | 1 | 0.6364 |
| STAB1 AND NOT-ABCG8 | Sarcoma | 0.6875 | 0.7333 | 0.6471 | SLC30A8 AND NOT-INSR | Pancreas | 0.7059 | 1 | 0.5455 |
| STAB1 AND NOT-ATP8A2 | Sarcoma | 0.7273 | 0.75 | 0.7059 | SLC30A8 AND NOT-EPOR | Pancreas | 0.7778 | 1 | 0.6364 |
| STAB1 AND NOT-ATP8A1 | Sarcoma | 0.7407 | 1 | 0.5882 | SLC30A8 AND NOT-SLC23A1 | Pancreas | 0.7778 | 1 | 0.6364 |
| STAB1 AND NOT-KCNJ10 | Sarcoma | 0.7857 | 1 | 0.6471 | SLC30A8 AND NOT-KLB | Pancreas | 0.7778 | 1 | 0.6364 |
| STAB1 AND NOT-HRH3 | Sarcoma | 0.7097 | 0.7857 | 0.6471 | SLC30A8 AND NOT-SLC26A6 | Pancreas | 0.7059 | 1 | 0.5455 |
| STAB1 AND NOT-FXYD6 | Sarcoma | 0.6923 | 1 | 0.5294 | SLC30A8 AND NOT-CNGB3 | Pancreas | 0.7778 | 1 | 0.6364 |
| STAB1 AND NOT-GGTLC1 | Sarcoma | 0.7333 | 0.8462 | 0.6471 | SLC30A8 AND NOT-RYR2 | Pancreas | 0.7778 | 1 | 0.6364 |
| STAB1 AND NOT-HTR1D | Sarcoma | 0.7059 | 0.7059 | 0.7059 | SLC30A8 AND NOT-CHRNA3 | Pancreas | 0.7778 | 1 | 0.6364 |
| STAB1 AND NOT-GUCY2F | Sarcoma | 0.6875 | 0.7333 | 0.6471 | SLC30A8 AND NOT-ABCB8 | Pancreas | 0.7059 | 1 | 0.5455 |
| STAB1 AND NOT-SEMA4D | Sarcoma | 0.8276 | 1 | 0.7059 | SLC30A8 AND NOT-PRPH2 | Pancreas | 0.7059 | 1 | 0.5455 |
| STAB1 AND NOT-KCNQ2 | Sarcoma | 0.6667 | 0.9 | 0.5294 | SLC30A8 AND NOT-SDK1 | Pancreas | 0.7778 | 1 | 0.6364 |
| STAB1 AND NOT-SLC22A6 | Sarcoma | 0.6667 | 0.7692 | 0.5882 | SLC30A8 AND NOT-PLB1 | Pancreas | 0.625 | 1 | 0.4545 |
| STAB1 AND NOT-ADAM30 | Sarcoma | 0.6667 | 0.6875 | 0.6471 | SLC30A8 AND NOT-NUCB2 | Pancreas | 0.7778 | 1 | 0.6364 |
| STAB1 AND NOT-OR1Q1 | Sarcoma | 0.6667 | 0.9 | 0.5294 | SLC30A8 AND NOT-KCNN2 | Pancreas | 0.7778 | 1 | 0.6364 |
| STAB1 AND NOT-XCR1 | Sarcoma | 0.6667 | 0.7692 | 0.5882 | SLC30A8 AND NOT-CA4 | Pancreas | 0.7059 | 1 | 0.5455 |
| STAB1 AND NOT-WNT7A | Sarcoma | 0.6667 | 0.9 | 0.5294 | SLC30A8 AND NOT-AQP10 | Pancreas | 0.7778 | 1 | 0.6364 |
| STAB1 AND NOT-PVRL1 | Sarcoma | 0.6857 | 0.6667 | 0.7059 | SLC30A8 AND NOT-ADRB1 | Pancreas | 0.7059 | 1 | 0.5455 |
| STAB1 AND NOT-LHFPL5 | Sarcoma | 0.6667 | 0.6875 | 0.6471 | SLC30A8 AND NOT-FGF10 | Pancreas | 0.625 | 1 | 0.4545 |
| STAB1 AND NOT-TSPAN16 | Sarcoma | 0.7742 | 0.8571 | 0.7059 | CDH6 AND NOT-SLC9B1 | Renal | 0.8571 | 1 | 0.75 |
| STAB1 AND NOT-CDH9 | Sarcoma | 0.6667 | 0.6316 | 0.7059 | CDH6 AND NOT-PPAPDC1A | Renal | 0.8571 | 1 | 0.75 |
| STAB1 AND NOT-GRM3 | Sarcoma | 0.7586 | 0.9167 | 0.6471 | CDH6 AND NOT-PHLDB2 | Renal | 0.8571 | 1 | 0.75 |
| STAB1 AND NOT-SLC1A2 | Sarcoma | 0.6667 | 0.7692 | 0.5882 | CDH6 AND NOT-KCNJ10 | Renal | 0.8571 | 1 | 0.75 |
| STAB1 AND NOT-GALR1 | Sarcoma | 0.6897 | 0.8333 | 0.5882 | CDH6 AND NOT-CDH11 | Renal | 0.8571 | 1 | 0.75 |
| STAB1 AND NOT-SLC13A5 | Sarcoma | 0.7586 | 0.9167 | 0.6471 | CDH6 AND NOT-OXTR | Renal | 0.8571 | 1 | 0.75 |
| STAB1 AND NOT-SLC28A1 | Sarcoma | 0.7097 | 0.7857 | 0.6471 | CDH6 AND NOT-SCN2A | Renal | 0.8571 | 1 | 0.75 |
| STAB1 AND NOT-HTR1E | Sarcoma | 0.7097 | 0.7857 | 0.6471 | CDH6 AND NOT-SYT11 | Renal | 0.8571 | 1 | 0.75 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| STAB1 AND NOT-MC2R | Sarcoma | 0.7586 | 0.9167 | 0.6471 | CDH6 AND NOT-MSMO1 | Renal | 0.8571 | 1 | 0.75 |
| STAB1 AND NOT-TAS2R1 | Sarcoma | 0.7143 | 0.9091 | 0.5882 | CDH6 AND NOT-CCKAR | Renal | 0.8571 | 1 | 0.75 |
| STAB1 AND NOT-IGDCC3 | Sarcoma | 0.6897 | 0.8333 | 0.5882 | CDH6 AND NOT-ZDHHC2 | Renal | 0.8571 | 1 | 0.75 |
| STAB1 AND NOT-CACNG3 | Sarcoma | 0.6667 | 0.9 | 0.5294 | CDH6 AND NOT-KCNK10 | Renal | 0.8571 | 1 | 0.75 |
| STAB1 AND NOT-SLC6A13 | Sarcoma | 0.6667 | 0.6875 | 0.6471 | CDH6 AND NOT-PAQR7 | Renal | 0.8571 | 1 | 0.75 |
| STAB1 AND NOT-ACSL6 | Sarcoma | 0.7742 | 0.8571 | 0.7059 | CDH6 AND NOT-DSCAM | Renal | 0.8571 | 1 | 0.75 |
| STAB1 AND NOT-PCDHB1 | Sarcoma | 0.6875 | 0.7333 | 0.6471 | CDH6 AND NOT-GPR22 | Renal | 0.8571 | 1 | 0.75 |
| STAB1 AND NOT-HTR3C | Sarcoma | 0.6897 | 0.8333 | 0.5882 | CDH6 AND NOT-CLDN16 | Renal | 0.8571 | 1 | 0.75 |
| STAB1 AND NOT-SMPD2 | Sarcoma | 0.6667 | 0.7692 | 0.5882 | CDH6 AND NOT-MEGF10 | Renal | 0.8571 | 1 | 0.75 |
| STAB1 AND NOT-SEZ6 | Sarcoma | 0.6667 | 0.9 | 0.5294 | CDH6 AND NOT-CSPG5 | Renal | 0.8571 | 1 | 0.75 |
| STAB1 AND NOT-MTNR1B | Sarcoma | 0.7333 | 0.8462 | 0.6471 | CDH6 AND NOT-NKAIN2 | Renal | 0.8571 | 1 | 0.75 |
| STAB1 AND NOT-C8B | Sarcoma | 0.7407 | 1 | 0.5882 | CDH6 AND NOT-ZACN | Renal | 0.8571 | 1 | 0.75 |
| STAB1 AND NOT-SLC5A11 | Sarcoma | 0.6471 | 0.6471 | 0.6471 | CDH6 AND NOT-HCN1 | Renal | 0.8571 | 1 | 0.75 |
| STAB1 AND NOT-GRM5 | Sarcoma | 0.6471 | 0.6471 | 0.6471 | CDH6 AND NOT-CHRNB4 | Renal | 0.8571 | 1 | 0.75 |
| STAB1 AND NOT-RGSL1 | Sarcoma | 0.6471 | 0.6471 | 0.6471 | CDH6 AND NOT-DRD5 | Renal | 0.8571 | 1 | 0.75 |
| STAB1 AND NOT-FGF6 | Sarcoma | 0.6471 | 0.6471 | 0.6471 | CDH6 AND NOT-CDH10 | Renal | 0.8571 | 1 | 0.75 |
| STAB1 AND NOT-RGR | Sarcoma | 0.6471 | 0.6471 | 0.6471 | CDH6 AND NOT-CDH8 | Renal | 0.8571 | 1 | 0.75 |
| STAB1 AND NOT-CACNG6 | Sarcoma | 0.6471 | 0.6471 | 0.6471 | CDH6 AND NOT-SLC12A5 | Renal | 0.8571 | 1 | 0.75 |
| STAB1 AND NOT-DSCAM | Sarcoma | 0.6471 | 0.6471 | 0.6471 | CDH6 AND NOT-PAQR8 | Renal | 0.8571 | 1 | 0.75 |
| STAB1 AND NOT-OTOF | Sarcoma | 0.6667 | 0.7692 | 0.5882 | CDH6 AND NOT-MLC1 | Renal | 0.8571 | 1 | 0.75 |
| STAB1 AND NOT-AMHR2 | Sarcoma | 0.6471 | 0.6471 | 0.6471 | CDH6 AND NOT-ANTXR2 | Renal | 0.8571 | 1 | 0.75 |
| STAB1 AND NOT-CACNG4 | Sarcoma | 0.6471 | 0.6471 | 0.6471 | CDH6 AND NOT-GNRHR | Renal | 0.8571 | 1 | 0.75 |
| STAB1 AND NOT-OR8D1 | Sarcoma | 0.6897 | 0.8333 | 0.5882 | CDH6 AND NOT-ENPP1 | Renal | 0.8571 | 1 | 0.75 |
| SLC6A7 AND NOT-CLDN10 | Sarcoma | 0.6667 | 0.7692 | 0.5882 | CDH6 AND NOT-GABRA2 | Renal | 0.8571 | 1 | 0.75 |
| STAB1 AND NOT-MAG | Sarcoma | 0.6452 | 0.7143 | 0.5882 | CDH6 AND NOT-GABRA3 | Renal | 0.8571 | 1 | 0.75 |
| STAB1 AND NOT-KREMEN2 | Sarcoma | 0.6452 | 0.7143 | 0.5882 | CDH6 AND NOT-AQP6 | Renal | 0.8571 | 1 | 0.75 |
| STAB1 AND NOT-UPK3A | Sarcoma | 0.6452 | 0.7143 | 0.5882 | CDH6 AND NOT-CDH20 | Renal | 0.8571 | 1 | 0.75 |
| STAB1 AND NOT-SYT4 | Sarcoma | 0.6452 | 0.7143 | 0.5882 | CDH6 AND NOT-GABRA5 | Renal | 0.8571 | 1 | 0.75 |
| STAB1 AND NOT-BEST3 | Sarcoma | 0.6429 | 0.8182 | 0.5294 | CDH6 AND NOT-CNTNAP2 | Renal | 0.8571 | 1 | 0.75 |
| STAB1 AND NOT-ATP2B2 | Sarcoma | 0.6429 | 0.8182 | 0.5294 | CDH6 AND NOT-KIAA0319 | Renal | 0.8571 | 1 | 0.75 |
| STAB1 AND NOT-ZDHHC2 | Sarcoma | 0.6471 | 0.6471 | 0.6471 | CDH6 AND NOT-GPR26 | Renal | 0.8571 | 1 | 0.75 |
| STAB1 AND NOT-CABP7 | Sarcoma | 0.6486 | 0.6 | 0.7059 | CDH6 AND NOT-SLC4A8 | Renal | 0.8571 | 1 | 0.75 |
| STAB1 AND NOT-EPHA8 | Sarcoma | 0.7857 | 1 | 0.6471 | CDH6 AND NOT-FLVCR1 | Renal | 0.8571 | 1 | 0.75 |
| STAB1 AND NOT-NPHS1 | Sarcoma | 0.6857 | 0.6667 | 0.7059 | CDH6 AND NOT-CASR | Renal | 0.8571 | 1 | 0.75 |
| STAB1 AND NOT-CLRN1 | Sarcoma | 0.6897 | 0.8333 | 0.5882 | CDH6 AND NOT-NPHS2 | Renal | 0.8571 | 1 | 0.75 |
| TTYH3 AND NOT-GPR37L1 | Sarcoma | 0.64 | 1 | 0.4706 | CDH6 AND NOT-NPHS1 | Renal | 0.8571 | 1 | 0.75 |
| TTYH3 AND NOT-NRG3 | Sarcoma | 0.64 | 1 | 0.4706 | CDH6 AND NOT-CLDN20 | Renal | 0.8571 | 1 | 0.75 |
| TTYH3 AND NOT-SLC22A13 | Sarcoma | 0.64 | 1 | 0.4706 | CDH6 AND NOT-SLC6A7 | Renal | 0.8571 | 1 | 0.75 |
| TTYH3 AND NOT-TTYH2 | Sarcoma | 0.64 | 1 | 0.4706 | CDH6 AND NOT-SLC6A6 | Renal | 0.8571 | 1 | 0.75 |
| TTYH3 AND NOT-UMOD | Sarcoma | 0.64 | 1 | 0.4706 | CDH6 AND NOT-SLC30A1 | Renal | 0.8571 | 1 | 0.75 |
| TTYH3 AND NOT-GPR12 | Sarcoma | 0.64 | 1 | 0.4706 | CDH6 AND NOT-ATP8A1 | Renal | 0.8571 | 1 | 0.75 |
| TTYH3 AND NOT-CD207 | Sarcoma | 0.64 | 1 | 0.4706 | CDH6 AND NOT-CD207 | Renal | 0.8571 | 1 | 0.75 |
| TTYH3 AND NOT-CACNG7 | Sarcoma | 0.64 | 1 | 0.4706 | CDH6 AND NOT-SLC12A3 | Renal | 0.8571 | 1 | 0.75 |
| TTYH3 AND NOT-GABRD | Sarcoma | 0.64 | 1 | 0.4706 | CDH6 AND NOT-SCN1A | Renal | 0.8571 | 1 | 0.75 |
| TTYH3 AND NOT-SLC12A3 | Sarcoma | 0.64 | 1 | 0.4706 | CDH6 AND NOT-CACNG8 | Renal | 0.8571 | 1 | 0.75 |
| TTYH3 AND NOT-EPHA8 | Sarcoma | 0.64 | 1 | 0.4706 | CDH6 AND NOT-ZP4 | Renal | 0.8571 | 1 | 0.75 |
| TTYH3 AND NOT-GABRG1 | Sarcoma | 0.64 | 1 | 0.4706 | CDH6 AND NOT-DCSTAMP | Renal | 0.8571 | 1 | 0.75 |
| TTYH3 AND NOT-CALY | Sarcoma | 0.64 | 1 | 0.4706 | CDH6 AND NOT-SLC32A1 | Renal | 0.8571 | 1 | 0.75 |
| STAB1 AND NOT-SLC22A9 | Sarcoma | 0.64 | 1 | 0.4706 | CDH6 AND NOT-SLC30A10 | Renal | 0.8571 | 1 | 0.75 |
| TTYH3 AND NOT-PCDHGC4 | Sarcoma | 0.64 | 1 | 0.4706 | CDH6 AND NOT-ASTN1 | Renal | 0.8571 | 1 | 0.75 |
| TTYH3 AND NOT-PCDHAC2 | Sarcoma | 0.64 | 1 | 0.4706 | CDH6 AND NOT-DTNA | Renal | 0.8571 | 1 | 0.75 |
| TTYH3 AND NOT-LRRC55 | Sarcoma | 0.64 | 1 | 0.4706 | CDH6 AND NOT-DISP2 | Renal | 0.8571 | 1 | 0.75 |
| TTYH3 AND NOT-RGR | Sarcoma | 0.64 | 1 | 0.4706 | CDH6 AND NOT-GPR83 | Renal | 0.8571 | 1 | 0.75 |
| TTYH3 AND NOT-SLC22A11 | Sarcoma | 0.64 | 1 | 0.4706 | CDH6 AND NOT-MTNR1B | Renal | 0.8571 | 1 | 0.75 |
| TTYH3 AND NOT-CCKBR | Sarcoma | 0.64 | 1 | 0.4706 | CDH6 AND NOT-AOC3 | Renal | 0.8571 | 1 | 0.75 |
| TTYH3 AND NOT-CACNG3 | Sarcoma | 0.64 | 1 | 0.4706 | CDH6 AND NOT-SCN10A | Renal | 0.8571 | 1 | 0.75 |
| TTYH3 AND NOT-CD1B | Sarcoma | 0.64 | 1 | 0.4706 | CDH6 AND NOT-PCDHAC2 | Renal | 0.8571 | 1 | 0.75 |
| TTYH3 AND NOT-MC2R | Sarcoma | 0.64 | 1 | 0.4706 | CDH6 AND NOT-KCNJ9 | Renal | 0.8571 | 1 | 0.75 |
| TTYH3 AND NOT-KCNK10 | Sarcoma | 0.64 | 1 | 0.4706 | CDH6 AND NOT-CD1B | Renal | 0.8571 | 1 | 0.75 |
| TTYH3 AND NOT-HCN4 | Sarcoma | 0.64 | 1 | 0.4706 | CDH6 AND NOT-CACNG7 | Renal | 0.8571 | 1 | 0.75 |
| TTYH3 AND NOT-OR1Q1 | Sarcoma | 0.64 | 1 | 0.4706 | CDH6 AND NOT-GPR37L1 | Renal | 0.8571 | 1 | 0.75 |
| TTYH3 AND NOT-GRM3 | Sarcoma | 0.64 | 1 | 0.4706 | CDH6 AND NOT-GRM1 | Renal | 0.8571 | 1 | 0.75 |
| TTYH3 AND NOT-ATP8A1 | Sarcoma | 0.64 | 1 | 0.4706 | CDH6 AND NOT-OPALIN | Renal | 0.8571 | 1 | 0.75 |
| TTYH3 AND NOT-OR3A1 | Sarcoma | 0.64 | 1 | 0.4706 | CDH6 AND NOT-KCNK6 | Renal | 0.8571 | 1 | 0.75 |
| CDH17 AND NOT-SLC30A10 | Stomach | 0.7664 | 0.6406 | 0.9535 | CDH6 AND NOT-TRHR | Renal | 0.8571 | 1 | 0.75 |
| MUC17 AND NOT-SLC30A10 | Stomach | 0.8533 | 1 | 0.7442 | CDH6 AND NOT-OR52D1 | Renal | 0.8571 | 1 | 0.75 |
| CDH17 AND NOT-BEST2 | Stomach | 0.6724 | 0.5342 | 0.907 | CDH6 AND NOT-OR1C1 | Renal | 0.8571 | 1 | 0.75 |
| MUC17 AND NOT-SLC13A2 | Stomach | 0.697 | 1 | 0.5349 | CDH6 AND NOT-GHRHR | Renal | 0.8571 | 1 | 0.75 |
| MUC17 AND NOT-SLC22A5 | Stomach | 0.8378 | 1 | 0.7209 | CDH6 AND NOT-OPCML | Renal | 0.8571 | 1 | 0.75 |
| MUC17 AND NOT-SLC5A11 | Stomach | 0.7945 | 0.9667 | 0.6744 | CDH6 AND NOT-SLC10A1 | Renal | 0.8571 | 1 | 0.75 |
| MUC17 AND NOT-PTPRR | Stomach | 0.7945 | 0.9667 | 0.6744 | CDH6 AND NOT-HTR5A | Renal | 0.8571 | 1 | 0.75 |
| CDH17 AND NOT-SLC22A5 | Stomach | 0.65 | 0.5065 | 0.907 | CDH6 AND NOT-EBP | Renal | 0.8571 | 1 | 0.75 |
| MUC17 AND NOT-ABCG8 | Stomach | 0.8312 | 0.9412 | 0.7442 | CDH6 AND NOT-SLC5A11 | Renal | 0.8571 | 1 | 0.75 |
| MUC17 AND NOT-SLC31A1 | Stomach | 0.7671 | 0.9333 | 0.6512 | CDH6 AND NOT-ANO4 | Renal | 0.8571 | 1 | 0.75 |
| MUC17 AND NOT-ABCG5 | Stomach | 0.7324 | 0.9286 | 0.6047 | CDH6 AND NOT-CNGA4 | Renal | 0.8571 | 1 | 0.75 |
| MUC17 AND NOT-FLVCR1 | Stomach | 0.6364 | 0.913 | 0.4884 | CDH6 AND NOT-CLDN14 | Renal | 0.8571 | 1 | 0.75 |
| CDH17 AND NOT-NOX1 | Stomach | 0.6341 | 0.4875 | 0.907 | CDH6 AND NOT-MUC17 | Renal | 0.8571 | 1 | 0.75 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| MUC17 AND NOT-P2RX4 | Stomach | 0.7945 | 0.9667 | 0.6744 | CDH6 AND NOT-DIO1 | Renal | 0.8571 | 1 | 0.75 |
| MUC17 AND NOT-GABRA2 | Stomach | 0.6957 | 0.9231 | 0.5581 | CDH6 AND NOT-KCNA2 | Renal | 0.8571 | 1 | 0.75 |
| CDH17 AND NOT-MUC12 | Stomach | 0.6271 | 0.4933 | 0.8605 | CDH6 AND NOT-UNC5A | Renal | 0.8571 | 1 | 0.75 |
| MUC17 AND NOT-BEST2 | Stomach | 0.8219 | 1 | 0.6977 | CDH6 AND NOT-SLC22A8 | Renal | 0.8571 | 1 | 0.75 |
| MUC17 AND NOT-LCT | Stomach | 0.8158 | 0.9394 | 0.7209 | CDH6 AND NOT-BTN3A1 | Renal | 0.8571 | 1 | 0.75 |
| MUC17 AND NOT-CCR9 | Stomach | 0.8158 | 0.9394 | 0.7209 | CDH6 AND NOT-SLC22A16 | Renal | 0.8571 | 1 | 0.75 |
| MUC17 AND NOT-FUT3 | Stomach | 0.697 | 1 | 0.5349 | NOX1 AND NOT-BEST4 | Colon | 1 | 1 | 1 |
| MUC17 AND NOT-CD36 | Stomach | 0.8 | 0.9375 | 0.6977 | NOX1 AND NOT-FLVCR2 | Colon | 0.9091 | 0.8333 | 1 |
| MUC17 AND NOT-GPR22 | Stomach | 0.8312 | 0.9412 | 0.7442 | NOX1 AND NOT-SLC22A23 | Colon | 0.9091 | 0.8333 | 1 |
| MUC17 AND NOT-KCNK10 | Stomach | 0.7324 | 0.9286 | 0.6047 | NOX1 AND NOT-TSPAN7 | Colon | 1 | 1 | 1 |
| MUC17 AND NOT-EBP | Stomach | 0.7429 | 0.963 | 0.6047 | CDH17 AND NOT-FLVCR2 | Colon | 0.9091 | 0.8333 | 1 |
| MUC17 AND NOT-CACNG4 | Stomach | 0.7324 | 0.9286 | 0.6047 | B3GNT3 AND NOT-SLC9A1 | Colon | 0.8889 | 1 | 0.8 |
| MUC17 AND NOT-ENPP1 | Stomach | 0.8 | 0.9375 | 0.6977 | PMEPA1 AND NOT-STEAP4 | Colon | 0.8889 | 1 | 0.8 |
| MUC17 AND NOT-SLC22A18 | Stomach | 0.6129 | 1 | 0.4419 | FAT1 AND NOT-LPAR1 | Colon | 0.8889 | 1 | 0.8 |
| MUC17 AND NOT-NKAIN1 | Stomach | 0.6154 | 0.9091 | 0.4651 | NOX1 AND NOT-SEMA4G | Colon | 0.8889 | 1 | 0.8 |
| MUC17 AND NOT-NOX1 | Stomach | 0.8219 | 1 | 0.6977 | CDH17 AND NOT-SEMA4G | Colon | 0.8889 | 1 | 0.8 |
| MUC17 AND NOT-PTPRT | Stomach | 0.75 | 0.931 | 0.6279 | CD320 AND NOT-SLC9A1 | Colon | 0.8889 | 1 | 0.8 |
| MUC17 AND NOT-MUC12 | Stomach | 0.8056 | 1 | 0.6744 | HEPH AND NOT-SLC9A1 | Colon | 1 | 1 | 1 |
| MUC17 AND NOT-SLC17A2 | Stomach | 0.7246 | 0.9615 | 0.5814 | IFI6 AND NOT-NAALAD2 | Colon | 0.9091 | 0.8333 | 1 |
| MUC17 AND NOT-KIAA0319 | Stomach | 0.7143 | 0.9259 | 0.5814 | PMEPA1 AND NOT-GHR | Colon | 0.8889 | 1 | 0.8 |
| MUC17 AND NOT-PCDHA9 | Stomach | 0.8158 | 0.9394 | 0.7209 | NOX1 AND NOT-SEMA6D | Colon | 0.8889 | 1 | 0.8 |
| MUC17 AND NOT-PAQR7 | Stomach | 0.6957 | 0.9231 | 0.5581 | NOX1 AND NOT-CA12 | Colon | 0.9091 | 0.8333 | 1 |
| MUC17 AND NOT-PVRL1 | Stomach | 0.6567 | 0.9167 | 0.5116 | PSENEN AND NOT-SLC16A5 | Colon | 0.8889 | 1 | 0.8 |
| MUC17 AND NOT-IL17RA | Stomach | 0.8312 | 0.9412 | 0.7442 | IFI6 AND NOT-SCN11A | Colon | 0.8889 | 1 | 0.8 |
| MUC17 AND NOT-AGER | Stomach | 0.6567 | 0.9167 | 0.5116 | MEP1A AND NOT-SLC9A1 | Colon | 1 | 1 | 1 |
| MUC17 AND NOT-SLC39A8 | Stomach | 0.7429 | 0.963 | 0.6047 | NOX1 AND NOT-IL1R2 | Colon | 0.8333 | 0.7143 | 1 |
| MUC17 AND NOT-AMHR2 | Stomach | 0.7778 | 0.9655 | 0.6512 | NOX1 AND NOT-PTGDR | Colon | 1 | 1 | 1 |
| MUC17 AND NOT-KCNV1 | Stomach | 0.8 | 0.9375 | 0.6977 | PMEPA1 AND NOT-SPAM1 | Colon | 0.8889 | 1 | 0.8 |
| MUC17 AND NOT-ADAM2 | Stomach | 0.6667 | 0.9565 | 0.5116 | NOX1 AND NOT-SLC4A4 | Colon | 0.8889 | 1 | 0.8 |
| MUC17 AND NOT-CD58 | Stomach | 0.6129 | 1 | 0.4419 | MEP1A AND NOT-SLC30A10 | Colon | 0.8889 | 1 | 0.8 |
| MUC17 AND NOT-KCNK16 | Stomach | 0.6032 | 0.95 | 0.4419 | CDH17 AND NOT-SLC4A4 | Colon | 0.8889 | 1 | 0.8 |
| MUC17 AND NOT-SLCO1B1 | Stomach | 0.6032 | 0.95 | 0.4419 | IFI6 AND NOT-ATP8B4 | Colon | 0.8333 | 0.7143 | 1 |
| MUC17 AND NOT-RGR | Stomach | 0.8312 | 0.9412 | 0.7442 | IFI6 AND NOT-CLEC12A | Colon | 1 | 1 | 1 |
| MUC17 AND NOT-EFNB2 | Stomach | 0.7838 | 0.9355 | 0.6744 | NOX1 AND NOT-PAQR5 | Colon | 1 | 1 | 1 |
| MUC17 AND NOT-ANTXR2 | Stomach | 0.6957 | 0.9231 | 0.5581 | CDH17 AND NOT-SLC22A23 | Colon | 0.9091 | 0.8333 | 1 |
| MUC17 AND NOT-CEACAM7 | Stomach | 0.8421 | 0.9697 | 0.7442 | IFI6 AND NOT-CD274 | Colon | 0.8333 | 0.7143 | 1 |
| MUC17 AND NOT-SLC9A1 | Stomach | 0.7838 | 0.9355 | 0.6744 | FZD3 AND NOT-SLC24A2 | Ependymoma | 1 | 1 | 1 |
| MUC17 AND NOT-CHRNA1 | Stomach | 0.8312 | 0.9412 | 0.7442 | FZD3 AND NOT-ABCG4 | Ependymoma | 1 | 1 | 1 |
| MUC17 AND NOT-KCNJ9 | Stomach | 0.6462 | 0.9545 | 0.4884 | FZD3 AND NOT-GABRB2 | Ependymoma | 1 | 1 | 1 |
| MUC17 AND NOT-GALR1 | Stomach | 0.7143 | 0.9259 | 0.5814 | SLC1A3 AND NOT-LAPTM5 | Ependymoma | 1 | 1 | 1 |
| MUC17 AND NOT-CDH9 | Stomach | 0.7945 | 0.9667 | 0.6744 | SLC1A3 AND NOT-SLC31A1 | Ependymoma | 1 | 1 | 1 |
| MUC17 AND NOT-NPFFR1 | Stomach | 0.8158 | 0.9394 | 0.7209 | FZD3 AND NOT-CDH8 | Ependymoma | 1 | 1 | 1 |
| MUC17 AND NOT-CLDN10 | Stomach | 0.8158 | 0.9394 | 0.7209 | FZD3 AND NOT-CACNA1B | Ependymoma | 1 | 1 | 1 |
| MUC17 AND NOT-SCN8A | Stomach | 0.6154 | 0.9091 | 0.4651 | FZD3 AND NOT-CACNA1E | Ependymoma | 1 | 1 | 1 |
| MUC17 AND NOT-GRM7 | Stomach | 0.6765 | 0.92 | 0.5349 | NRG3 AND NOT-SLC2A3 | Ependymoma | 1 | 1 | 1 |
| MUC17 AND NOT-EPHA10 | Stomach | 0.8267 | 0.9688 | 0.7209 | SLC1A3 AND NOT-PHLDB2 | Ependymoma | 1 | 1 | 1 |
| MUC17 AND NOT-SORL1 | Stomach | 0.6765 | 0.92 | 0.5349 | FZD3 AND NOT-NETO1 | Ependymoma | 1 | 1 | 1 |
| IL15RA AND NOT-CD36 | Stomach | 0.6522 | 0.6122 | 0.6977 | FZD3 AND NOT-SCN8A | Ependymoma | 1 | 1 | 1 |
| NOT-CLDN10 AND CDH11 | Colon | 0.75 | 1 | 0.6 | FZD3 AND NOT-DGKE | Ependymoma | 1 | 1 | 1 |
| NOT-ATP2B2 AND HCN1 | Colon | 0.75 | 1 | 0.6 | MEGF10 AND NOT-KCNJ2 | Ependymoma | 1 | 1 | 1 |
| NOT-CLDN10 AND EPHA2 | Colon | 0.6667 | 0.75 | 0.6 | FZD3 AND NOT-SCN2A | Ependymoma | 1 | 1 | 1 |
| NOT-MEGF10 AND HCN1 | Colon | 0.75 | 1 | 0.6 | FZD3 AND NOT-SYT4 | Ependymoma | 1 | 1 | 1 |
| NOT-CLDN10 AND SLC2A1 | Colon | 0.6667 | 0.75 | 0.6 | SLC1A3 AND NOT-SLC30A1 | Ependymoma | 1 | 1 | 1 |
| NOT-SLC6A6 AND LRFN2 | Ependymoma | 1 | 1 | 1 | SLC1A3 AND NOT-PROCR | Ependymoma | 1 | 1 | 1 |
| NOT-SLC6A6 AND UMODL1 | Ependymoma | 0.6667 | 0.5 | 1 | FZD3 AND NOT-GRM5 | Ependymoma | 1 | 1 | 1 |
| NOT-SLC6A6 AND SLC4A5 | Ependymoma | 0.6667 | 0.5 | 1 | FZD3 AND NOT-GRM3 | Ependymoma | 1 | 1 | 1 |
| NOT-SLC6A6 AND ATP8A1 | Ependymoma | 0.6667 | 0.5 | 1 | SLC7A11 AND NOT-SLC6A6 | Ependymoma | 1 | 1 | 1 |
| NOT-BTN3A1 AND TNFRSF10B | Ependymoma | 0.6667 | 0.5 | 1 | FZD3 AND NOT-KCNA1 | Ependymoma | 1 | 1 | 1 |
| NOT-SLC6A6 AND CLDN16 | Ependymoma | 0.6667 | 0.5 | 1 | FZD3 AND NOT-SLC6A6 | Ependymoma | 1 | 1 | 1 |
| NOT-CD36 AND IL15RA | Esophagus | 0.6667 | 0.625 | 0.7143 | SLC1A3 AND NOT-CD36 | Ependymoma | 1 | 1 | 1 |
| NOT-ATP8A1 AND SLC6A18 | Leiomyosarcoma | 0.6957 | 0.8 | 0.6154 | SLC1A3 AND NOT-IL15RA | Ependymoma | 1 | 1 | 1 |
| NOT-SLC16A5 AND VANGL1 | Leiomyosarcoma | 0.7619 | 1 | 0.6154 | FZD3 AND NOT-ATP2B2 | Ependymoma | 1 | 1 | 1 |
| NOT-ATP8A1 AND ATP8B2 | Leiomyosarcoma | 0.7826 | 0.9 | 0.6923 | ZDHHC17 AND NOT-SLC6A6 | Ependymoma | 1 | 1 | 1 |
| NOT-ATP8A1 AND EMP3 | Leiomyosarcoma | 0.6957 | 0.8 | 0.6154 | FZD3 AND NOT-GABRA1 | Ependymoma | 1 | 1 | 1 |
| NOT-ATP8A1 AND SYT11 | Leiomyosarcoma | 0.64 | 0.6667 | 0.6154 | FZD3 AND NOT-GABRA2 | Ependymoma | 1 | 1 | 1 |
| NOT-ATP8A1 AND CHRND | Leiomyosarcoma | 0.6207 | 0.5625 | 0.6923 | SLC16A2 AND NOT-PHLDB2 | Ependymoma | 1 | 1 | 1 |
| NOT-ATP8A1 AND PTGIR | Leiomyosarcoma | 0.6957 | 0.8 | 0.6154 | FZD3 AND NOT-OPRK1 | Ependymoma | 1 | 1 | 1 |
| NOT-ATP8A1 AND CHRNA2 | Leiomyosarcoma | 0.6452 | 0.5556 | 0.7692 | SLC1A3 AND NOT-STAB1 | Ependymoma | 1 | 1 | 1 |
| NOT-ATP8A1 AND FLVCR1 | Leiomyosarcoma | 0.6316 | 1 | 0.4615 | FZD3 AND NOT-UNC5A | Ependymoma | 1 | 1 | 1 |
| NOT-ATP8A1 AND GABRA3 | Leiomyosarcoma | 0.75 | 0.8182 | 0.6923 | FZD3 AND NOT-ATP8A2 | Ependymoma | 1 | 1 | 1 |
| NOT-ATP8A1 AND NPFFR1 | Leiomyosarcoma | 0.8696 | 1 | 0.7692 | FZD3 AND NOT-CACNG8 | Ependymoma | 1 | 1 | 1 |
| NOT-ATP8A1 AND GABRA5 | Leiomyosarcoma | 0.6429 | 0.6 | 0.6923 | SLC1A3 AND NOT-DYSF | Ependymoma | 1 | 1 | 1 |
| NOT-ATP8A1 AND GYPC | Leiomyosarcoma | 0.7619 | 1 | 0.6154 | SLC1A3 AND NOT-CXCL16 | Ependymoma | 1 | 1 | 1 |
| NOT-ATP8A1 AND IL13 | Leiomyosarcoma | 0.6957 | 0.8 | 0.6154 | FZD3 AND NOT-SLC32A1 | Ependymoma | 1 | 1 | 1 |
| NOT-ATP8A1 AND SLC6A7 | Leiomyosarcoma | 0.6364 | 0.7778 | 0.5385 | FZD3 AND NOT-PTPRR | Ependymoma | 1 | 1 | 1 |
| NOT-CLDN10 AND SLC6A7 | Leiomyosarcoma | 0.6316 | 1 | 0.4615 | FZD3 AND NOT-SLC12A5 | Ependymoma | 1 | 1 | 1 |
| NOT-ATP8A1 AND CLDN15 | Leiomyosarcoma | 0.6 | 0.8571 | 0.4615 | SLC1A3 AND NOT-SLC38A1 | Ependymoma | 1 | 1 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NOT-ATP8A1 AND GPR135 | Leiomyosarcoma | 0.6667 | 0.5882 | 0.7692 | PTPRA AND NOT-SLC6A6 | Ependymoma | 1 | 1 | 1 |
| NOT-SMPD2 AND VANGL1 | Leiomyosarcoma | 0.8696 | 1 | 0.7692 | SLC52A2 AND NOT-DPP10 | Esophagus | 0.7273 | 1 | 0.5714 |
| NOT-ATP8A1 AND CHRNB4 | Leiomyosarcoma | 0.7143 | 0.6667 | 0.7692 | SLC52A2 AND NOT-SCARA5 | Esophagus | 0.7273 | 1 | 0.5714 |
| NOT-ATP8A1 AND CCKAR | Leiomyosarcoma | 0.7273 | 0.8889 | 0.6154 | CDH17 AND NOT-SEMA6D | Esophagus | 0.7692 | 0.8333 | 0.7143 |
| NOT-ATP8A1 AND TTYH3 | Leiomyosarcoma | 0.7826 | 0.9 | 0.6923 | SLC52A2 AND NOT-STAB1 | Esophagus | 0.7273 | 1 | 0.5714 |
| NOT-ATP8A1 AND JPH3 | Leiomyosarcoma | 0.6429 | 0.6 | 0.6923 | SLC52A2 AND NOT-SLC13A1 | Esophagus | 0.6667 | 1 | 0.5 |
| NOT-ATP8A1 AND BTN3A3 | Leiomyosarcoma | 0.7619 | 1 | 0.6154 | SLC52A2 AND NOT-SLC22A5 | Esophagus | 0.6667 | 1 | 0.5 |
| NOT-ATP8A1 AND MDGA2 | Leiomyosarcoma | 0.6667 | 0.5882 | 0.7692 | CXCL16 AND NOT-ADCY7 | Esophagus | 0.7273 | 1 | 0.5714 |
| NOT-ATP8A1 AND MIP | Leiomyosarcoma | 0.72 | 0.75 | 0.6923 | SLC52A2 AND NOT-TMEFF2 | Esophagus | 0.6667 | 1 | 0.5 |
| NOT-ATP8A1 AND MPL | Leiomyosarcoma | 0.6957 | 0.8 | 0.6154 | SLC52A2 AND NOT-HCN1 | Esophagus | 0.6667 | 1 | 0.5 |
| NOT-ATP8A1 AND GABRG3 | Leiomyosarcoma | 0.6207 | 0.5625 | 0.6923 | CXCL16 AND NOT-ADRB2 | Esophagus | 0.64 | 0.7273 | 0.5714 |
| NOT-ATP8A1 AND SLC26A8 | Leiomyosarcoma | 0.6207 | 0.5625 | 0.6923 | SLC52A2 AND NOT-CD36 | Esophagus | 0.7273 | 1 | 0.5714 |
| NOT-ATP8A1 AND TNFRSF12A | Leiomyosarcoma | 0.6667 | 0.7273 | 0.6154 | CXCL16 AND NOT-TLR1 | Esophagus | 0.72 | 0.8182 | 0.6429 |
| NOT-ATP8A1 AND OPRM1 | Leiomyosarcoma | 0.6061 | 0.5 | 0.7692 | SLC52A2 AND NOT-MDGA2 | Esophagus | 0.6667 | 1 | 0.5 |
| NOT-ATP8A1 AND AGER | Leiomyosarcoma | 0.6957 | 0.8 | 0.6154 | SLC52A2 AND NOT-TAS2R10 | Esophagus | 0.7826 | 1 | 0.6429 |
| NOT-CLDN10 AND FAM26D | Leiomyosarcoma | 0.6957 | 0.8 | 0.6154 | SLC52A2 AND NOT-NFASC | Esophagus | 0.7826 | 1 | 0.6429 |
| NOT-ATP8A1 AND BEST3 | Leiomyosarcoma | 0.6061 | 0.5 | 0.7692 | SLC52A2 AND NOT-TAS1R1 | Esophagus | 0.7273 | 1 | 0.5714 |
| NOT-ATP8A1 AND PPAPDC1A | Leiomyosarcoma | 0.6316 | 1 | 0.4615 | SLC52A2 AND NOT-MLANA | Esophagus | 0.7273 | 1 | 0.5714 |
| NOT-ATP8A1 AND ATP7A | Leiomyosarcoma | 0.7 | 1 | 0.5385 | SLC52A2 AND NOT-ATP8A2 | Esophagus | 0.8333 | 1 | 0.7143 |
| NOT-ATP8A1 AND FAM26D | Leiomyosarcoma | 0.6087 | 0.7 | 0.5385 | SLC52A2 AND NOT-BEST2 | Esophagus | 0.7273 | 1 | 0.5714 |
| NOT-PHLDB2 AND EMP3 | AML | 0.9377 | 0.9163 | 0.9602 | SLC52A2 AND NOT-MMP24 | Esophagus | 0.8333 | 1 | 0.7143 |
| NOT-PHLDB2 AND CD44 | AML | 0.9367 | 0.9037 | 0.9721 | SLC52A2 AND NOT-DSC1 | Esophagus | 0.8333 | 1 | 0.7143 |
| NOT-PHLDB2 AND SLC39A8 | AML | 0.9275 | 0.9655 | 0.8924 | SLC52A2 AND NOT-FMNL1 | Esophagus | 0.7826 | 1 | 0.6429 |
| NOT-STEAP4 AND EMP3 | AML | 0.8919 | 0.8652 | 0.9203 | SLC52A2 AND NOT-AGER | Esophagus | 0.6667 | 1 | 0.5 |
| NOT-STEAP4 AND CD44 | AML | 0.9126 | 0.8902 | 0.9363 | CXCL16 AND NOT-PILRA | Esophagus | 0.6667 | 1 | 0.5 |
| NOT-PHLDB2 AND CD36 | AML | 0.8784 | 0.8649 | 0.8924 | SLC52A2 AND NOT-CATSPER3 | Esophagus | 0.7826 | 1 | 0.6429 |
| NOT-PHLDB2 AND GYPC | AML | 0.8773 | 0.802 | 0.9681 | SLC52A2 AND NOT-SLC1A2 | Esophagus | 0.8333 | 1 | 0.7143 |
| NOT-PHLDB2 AND LAPTM5 | AML | 0.9118 | 0.8464 | 0.988 | SLC52A2 AND NOT-SCN1A | Esophagus | 0.6667 | 1 | 0.5 |
| NOT-PHLDB2 AND P2RX4 | AML | 0.9295 | 0.8905 | 0.9721 | SLC52A2 AND NOT-TSHR | Esophagus | 0.6667 | 1 | 0.5 |
| NOT-GPR137B AND SLC39A8 | AML | 0.8518 | 0.8947 | 0.8127 | SLC52A2 AND NOT-PCDH15 | Esophagus | 0.7826 | 1 | 0.6429 |
| NOT-ATP8B1 AND SLC39A8 | AML | 0.8515 | 0.8465 | 0.8566 | SLC52A2 AND NOT-ATP13A5 | Esophagus | 0.7826 | 1 | 0.6429 |
| NOT-GPR137B AND P2RX4 | AML | 0.8499 | 0.9054 | 0.8008 | SLC52A2 AND NOT-GRIA4 | Esophagus | 0.6667 | 1 | 0.5 |
| NOT-PHLDB2 AND ANPEP | AML | 0.8505 | 0.7763 | 0.9402 | SLC52A2 AND NOT-HTR1F | Esophagus | 0.7273 | 1 | 0.5714 |
| NOT-GPR137B AND SLC30A1 | AML | 0.849 | 0.8703 | 0.8287 | SLC52A2 AND NOT-DTNA | Esophagus | 0.7273 | 1 | 0.5714 |
| NOT-PHLDB2 AND SLCO1B3 | AML | 0.8909 | 0.831 | 0.9602 | SLC52A2 AND NOT-ABHD3 | Esophagus | 0.7273 | 1 | 0.5714 |
| NOT-PHLDB2 AND SLC43A1 | AML | 0.8455 | 0.9163 | 0.7849 | SLC52A2 AND NOT-SLC30A10 | Esophagus | 0.8333 | 1 | 0.7143 |
| NOT-PHLDB2 AND SLC30A1 | AML | 0.8671 | 0.7726 | 0.988 | CXCL16 AND NOT-FCER1A | Esophagus | 0.6154 | 0.6667 | 0.5714 |
| NOT-PHLDB2 AND FMNL1 | AML | 0.8436 | 0.7759 | 0.9243 | SLC52A2 AND NOT-UMOD | Esophagus | 0.6667 | 1 | 0.5 |
| NOT-PHLDB2 AND VAMP8 | AML | 0.9168 | 0.8552 | 0.988 | SLC52A2 AND NOT-TSPAN16 | Esophagus | 0.7826 | 1 | 0.6429 |
| NOT-LRIG3 AND SLC39A8 | AML | 0.8436 | 0.8386 | 0.8486 | SLC52A2 AND NOT-ATP8B2 | Esophagus | 0.8333 | 1 | 0.7143 |
| NOT-GPR137B AND CD44 | AML | 0.8412 | 0.8718 | 0.8127 | SLC52A2 AND NOT-EPHA10 | Esophagus | 0.8333 | 1 | 0.7143 |
| NOT-GPR137B AND LAPTM5 | AML | 0.8404 | 0.8525 | 0.8287 | SLC52A2 AND NOT-GABRA5 | Esophagus | 0.7273 | 1 | 0.5714 |
| NOT-FAT1 AND SLC39A8 | AML | 0.8306 | 0.8408 | 0.8207 | SLC52A2 AND NOT-OPALIN | Esophagus | 0.6667 | 1 | 0.5 |
| NOT-GPR137B AND EMP3 | AML | 0.8204 | 0.841 | 0.8008 | SLC52A2 AND NOT-FXYD7 | Esophagus | 0.7273 | 1 | 0.5714 |
| NOT-PHLDB2 AND SLC16A5 | AML | 0.813 | 0.8947 | 0.745 | SLC52A2 AND NOT-GABRA3 | Esophagus | 0.7273 | 1 | 0.5714 |
| NOT-GPR137B AND FMNL1 | AML | 0.8126 | 0.8616 | 0.7689 | SLC52A2 AND NOT-CNGA4 | Esophagus | 0.7826 | 1 | 0.6429 |
| NOT-LRIG3 AND SLC43A1 | AML | 0.81 | 0.8509 | 0.7729 | SLC52A2 AND NOT-GUCY2D | Esophagus | 0.8333 | 1 | 0.7143 |
| NOT-PHLDB2 AND IL15RA | AML | 0.8097 | 0.9104 | 0.7291 | SLC52A2 AND NOT-KCNV1 | Esophagus | 0.6667 | 1 | 0.5 |
| NOT-GHR AND SLC43A1 | AML | 0.8077 | 0.871 | 0.753 | SLC52A2 AND NOT-OR3A1 | Esophagus | 0.6667 | 1 | 0.5 |
| NOT-AOC3 AND SLC43A1 | AML | 0.8075 | 0.8502 | 0.7689 | SLC52A2 AND NOT-NTSR2 | Esophagus | 0.6 | 1 | 0.4286 |
| NOT-ATP8B1 AND SLC43A1 | AML | 0.8075 | 0.8502 | 0.7689 | SLC52A2 AND NOT-CSMD3 | Esophagus | 0.6 | 1 | 0.4286 |
| NOT-STEAP4 AND SLC43A1 | AML | 0.7922 | 0.8673 | 0.7291 | CDH17 AND NOT-CA4 | Esophagus | 0.6 | 1 | 0.4286 |
| NOT-PHLDB2 AND SLC5A2 | AML | 0.7919 | 0.7363 | 0.8566 | SLC52A2 AND NOT-CHRNA9 | Esophagus | 0.6667 | 1 | 0.5 |
| NOT-SEMA4B AND P2RX4 | AML | 0.7919 | 0.6882 | 0.9323 | SLC52A2 AND NOT-GABRD | Esophagus | 0.6 | 1 | 0.4286 |
| NOT-ATP8B1 AND P2RX4 | AML | 0.7907 | 0.6781 | 0.9482 | SLC52A2 AND NOT-CSMD2 | Esophagus | 0.6 | 1 | 0.4286 |
| NOT-PHLDB2 AND STAB1 | AML | 0.7905 | 0.8632 | 0.7291 | SLC52A2 AND NOT-GABRA4 | Esophagus | 0.6 | 1 | 0.4286 |
| NOT-CDH11 AND SLC43A1 | AML | 0.7902 | 0.8083 | 0.7729 | SLC52A2 AND NOT-DRD5 | Esophagus | 0.6 | 1 | 0.4286 |
| NOT-PHLDB2 AND BST2 | AML | 0.7902 | 0.7518 | 0.8327 | SLC52A2 AND NOT-CHRNA1 | Esophagus | 0.6 | 1 | 0.4286 |
| NOT-ATP8B1 AND VAMP8 | AML | 0.7899 | 0.6545 | 0.996 | SLC52A2 AND NOT-AGTR2 | Esophagus | 0.6 | 1 | 0.4286 |
| NOT-SCARA5 AND SLC43A1 | AML | 0.7884 | 0.8225 | 0.757 | SLC52A2 AND NOT-GABRG1 | Esophagus | 0.6 | 1 | 0.4286 |
| NOT-ATP8B1 AND SLC30A1 | AML | 0.7862 | 0.6494 | 0.996 | SLC52A2 AND NOT-OR2L13 | Esophagus | 0.6 | 1 | 0.4286 |
| NOT-ATP8B1 AND CD44 | AML | 0.7847 | 0.6543 | 0.9801 | SLC52A2 AND NOT-OR8B2 | Esophagus | 0.7273 | 1 | 0.5714 |
| NOT-TGFBI AND EMP3 | AML | 0.7826 | 0.8612 | 0.7171 | SLC52A2 AND NOT-CACNG3 | Esophagus | 0.6667 | 1 | 0.5 |
| NOT-AOC3 AND CD44 | AML | 0.7783 | 0.6489 | 0.9721 | SLC52A2 AND NOT-TRPM3 | Esophagus | 0.6 | 1 | 0.4286 |
| NOT-SORL1 AND IFNAR2 | Liposarcoma | 0.6129 | 0.7308 | 0.5278 | SLC52A2 AND NOT-FAM26D | Esophagus | 0.7273 | 1 | 0.5714 |
| NOT-SORL1 AND PTGER4 | Liposarcoma | 0.6087 | 0.6364 | 0.5833 | SLC52A2 AND NOT-NOX1 | Esophagus | 0.7273 | 1 | 0.5714 |
| NOT-ANPEP AND CLDN15 | B-Cell Diffuse | 0.6 | 0.5581 | 0.6486 | SLC52A2 AND NOT-GPR12 | Esophagus | 0.6667 | 1 | 0.5 |
| NOT-VANGL1 AND CLDN15 | Mantle-Cell Lymphoma | 0.775 | 0.7381 | 0.8158 | SLC52A2 AND NOT-CNTNAP4 | Esophagus | 0.6 | 1 | 0.4286 |
| NOT-SLC31A1 AND CLDN15 | Mantle-Cell Lymphoma | 0.7692 | 0.75 | 0.7895 | SLC52A2 AND NOT-SLC26A8 | Esophagus | 0.6 | 1 | 0.4286 |
| NOT-ANPEP AND HLA-DRB1 | Mantle-Cell Lymphoma | 0.8471 | 0.766 | 0.9474 | SLC52A2 AND NOT-CEACAM7 | Esophagus | 0.7273 | 1 | 0.5714 |
| NOT-VANGL1 AND SLC38A1 | Mantle-Cell Lymphoma | 0.7416 | 0.6471 | 0.8684 | SLC52A2 AND NOT-CALN1 | Esophagus | 0.6667 | 1 | 0.5 |
| NOT-STEAP4 AND EMP3 | Mantle-Cell Lymphoma | 0.7333 | 0.6346 | 0.8684 | SLC52A2 AND NOT-SLC23A2 | Esophagus | 0.7273 | 1 | 0.5714 |
| NOT-VANGL1 AND HLA-DRB1 | Mantle-Cell Lymphoma | 0.7048 | 0.5522 | 0.9737 | SLC52A2 AND NOT-HTR6 | Esophagus | 0.7273 | 1 | 0.5714 |
| NOT-ANPEP AND CLDN15 | Mantle-Cell Lymphoma | 0.7027 | 0.7222 | 0.6842 | SLC52A2 AND NOT-UMODL1 | Esophagus | 0.7273 | 1 | 0.5714 |
| NOT-VANGL1 AND SLC50A1 | Mantle-Cell Lymphoma | 0.7021 | 0.5893 | 0.8684 | SLC52A2 AND NOT-CACNG | Esophagus | 0.6667 | 1 | 0.5 |
| NOT-STEAP4 AND CD44 | Mantle-Cell Lymphoma | 0.72 | 0.5806 | 0.9474 | SLC52A2 AND NOT-SLC4A5 | Esophagus | 0.6 | 1 | 0.4286 |
| NOT-SLC31A1 AND HLA-DRB1 | Mantle-Cell Lymphoma | 0.6981 | 0.5441 | 0.9737 | SLC52A2 AND NOT-CNIH2 | Esophagus | 0.8333 | 1 | 0.7143 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NOT-CXCL16 AND HLA-DRB1 | Mantle-Cell Lymphoma | 0.6835 | 0.6585 | 0.7105 | SLC52A2 AND NOT-ZP4 | Esophagus | 0.8333 | 1 | 0.7143 |
| NOT-CXCL16 AND BTN3A1 | Mantle-Cell Lymphoma | 0.6857 | 0.75 | 0.6316 | SLC52A2 AND NOT-GRM3 | Esophagus | 0.6667 | 1 | 0.5 |
| NOT-CD93 AND BTN3A1 | Mantle-Cell Lymphoma | 0.7561 | 0.7045 | 0.8158 | SLC52A2 AND NOT-NRG3 | Esophagus | 0.8333 | 1 | 0.7143 |
| NOT-ANPEP AND BTN3A1 | Mantle-Cell Lymphoma | 0.7561 | 0.7045 | 0.8158 | SLC52A2 AND NOT-MEGF10 | Esophagus | 0.7826 | 1 | 0.6429 |
| NOT-VANGL1 AND SEMA4B | Mantle-Cell Lymphoma | 0.6517 | 0.5686 | 0.7632 | SLC52A2 AND NOT-TRPM1 | Esophagus | 0.7826 | 1 | 0.6429 |
| NOT-STEAP4 AND BTN3A1 | Mantle-Cell Lymphoma | 0.8158 | 0.8158 | 0.8158 | TM4SF5 AND NOT-SLC30A10 | Esophagus | 0.7778 | 0.6364 | 1 |
| NOT-VANGL1 AND LAPTM5 | Mantle-Cell Lymphoma | 0.6441 | 0.475 | 1 | SLC52A2 AND NOT-GRIN2A | Esophagus | 0.7826 | 1 | 0.6429 |
| NOT-CD36 AND BTN3A1 | Mantle-Cell Lymphoma | 0.7126 | 0.6327 | 0.8158 | SLC52A2 AND NOT-CD207 | Esophagus | 0.6667 | 1 | 0.5 |
| NOT-CHRNG AND SLC38A1 | Mantle-Cell Lymphoma | 0.6377 | 0.7097 | 0.5789 | SLC52A2 AND NOT-DRD1 | Esophagus | 0.6667 | 1 | 0.5 |
| NOT-ANPEP AND SLC50A1 | Mantle-Cell Lymphoma | 0.6279 | 0.5625 | 0.7105 | SLC52A2 AND NOT-SLC1A6 | Esophagus | 0.8333 | 1 | 0.7143 |
| NOT-VANGL1 AND BTN3A1 | Mantle-Cell Lymphoma | 0.6239 | 0.4789 | 0.8947 | SLC52A2 AND NOT-CHRNB4 | Esophagus | 0.7273 | 1 | 0.5714 |
| NOT-VANGL1 AND CD44 | Mantle-Cell Lymphoma | 0.6154 | 0.4557 | 0.9474 | SLC52A2 AND NOT-GHR | Esophagus | 0.7273 | 1 | 0.5714 |
| NOT-ANPEP AND IFNAR2 | Mantle-Cell Lymphoma | 0.6596 | 0.5536 | 0.8158 | SLC52A2 AND NOT-CD1A | Esophagus | 0.7826 | 1 | 0.6429 |
| NOT-STEAP4 AND GYPC | Mantle-Cell Lymphoma | 0.6076 | 0.5854 | 0.6316 | SLC52A2 AND NOT-SELP | Esophagus | 0.6667 | 1 | 0.5 |
| NOT-ANPEP AND SEMA4B | Mantle-Cell Lymphoma | 0.6067 | 0.5294 | 0.7105 | SLC52A2 AND NOT-SLC2A2 | Esophagus | 0.6 | 1 | 0.4286 |
| NOT-STEAP4 AND HLA-DRB1 | Mantle-Cell Lymphoma | 0.7957 | 0.6727 | 0.9737 | NRCAM AND NOT-CNTNAP2 | Glioblastoma | 0.875 | 0.9333 | 0.8235 |
| NOT-CD93 AND EMP3 | Mantle-Cell Lymphoma | 0.6022 | 0.5091 | 0.7368 | PTPRZ1 AND NOT-CLDN10 | Glioblastoma | 0.8667 | 1 | 0.7647 |
| NOT-VANGL1 AND IFNAR2 | Mantle-Cell Lymphoma | 0.6018 | 0.4533 | 0.8947 | PTPRZ1 AND NOT-KIAA0319 | Glioblastoma | 0.875 | 0.9333 | 0.8235 |
| NOT-VANGL1 AND EMP3 | Mantle-Cell Lymphoma | 0.6 | 0.4583 | 0.8684 | PTPRZ1 AND NOT-GRM3 | Glioblastoma | 0.9032 | 1 | 0.8235 |
| NOT-ANPEP AND CD44 | Mantle-Cell Lymphoma | 0.6034 | 0.4487 | 0.9211 | PTPRZ1 AND NOT-GABRA2 | Glioblastoma | 0.8667 | 1 | 0.7647 |
| NOT-CD36 AND HLA-DRB1 | Mantle-Cell Lymphoma | 0.7826 | 0.6667 | 0.9474 | PTPRZ1 AND NOT-SLC6A15 | Glioblastoma | 0.875 | 0.9333 | 0.8235 |
| NOT-CHRNA2 AND ICAM1 | Melanoma | 0.9 | 1 | 0.8182 | NRCAM AND NOT-GRM5 | Glioblastoma | 0.875 | 0.9333 | 0.8235 |
| NOT-NMUR2 AND ICAM1 | Melanoma | 0.9 | 1 | 0.8182 | PTPRZ1 AND NOT-CDH22 | Glioblastoma | 0.9091 | 0.9375 | 0.8824 |
| NOT-CLDN19 AND ICAM1 | Melanoma | 0.9 | 1 | 0.8182 | PTPRZ1 AND NOT-SLC1A6 | Glioblastoma | 0.9091 | 0.9375 | 0.8824 |
| NOT-GLRA2 AND ICAM1 | Melanoma | 0.9 | 1 | 0.8182 | PTPRZ1 AND NOT-ATP8A2 | Glioblastoma | 0.875 | 0.9333 | 0.8235 |
| NOT-SLC22A9 AND FAT1 | Melanoma | 0.8421 | 1 | 0.7273 | PTPRZ1 AND NOT-CACNA1B | Glioblastoma | 0.875 | 0.9333 | 0.8235 |
| NOT-CHRNA2 AND DCSTAMP | Melanoma | 0.8421 | 1 | 0.7273 | PTPRZ1 AND NOT-KCNJ6 | Glioblastoma | 0.9091 | 0.9375 | 0.8824 |
| NOT-ADAM29 AND FAT1 | Melanoma | 0.9524 | 1 | 0.9091 | PTPRZ1 AND NOT-SCN8A | Glioblastoma | 0.875 | 0.9333 | 0.8235 |
| NOT-SLC10A2 AND ICAM1 | Melanoma | 0.8571 | 0.9 | 0.8182 | PTPRZ1 AND NOT-GPR85 | Glioblastoma | 0.8387 | 0.9286 | 0.7647 |
| NOT-CHRNA2 AND IFI6 | Melanoma | 0.8571 | 0.9 | 0.8182 | PTPRZ1 AND NOT-GABRG1 | Glioblastoma | 0.9032 | 1 | 0.8235 |
| NOT-CHRNA2 AND FAT1 | Melanoma | 1 | 1 | 1 | NRCAM AND NOT-SCN8A | Glioblastoma | 0.8485 | 0.875 | 0.8235 |
| NOT-ADAM29 AND VANGL1 | Melanoma | 0.9091 | 0.9091 | 0.9091 | PTPRZ1 AND NOT-SCN2A | Glioblastoma | 0.9032 | 1 | 0.8235 |
| NOT-C8B AND ICAM1 | Melanoma | 0.9 | 1 | 0.8182 | NRCAM AND NOT-KIAA0319 | Glioblastoma | 0.8387 | 0.9286 | 0.7647 |
| NOT-SLC6A13 AND ICAM1 | Melanoma | 0.8421 | 1 | 0.7273 | PTPRZ1 AND NOT-GPR83 | Glioblastoma | 0.9091 | 0.9375 | 0.8824 |
| NOT-CACNG6 AND ICAM1 | Melanoma | 0.9 | 1 | 0.8182 | PTPRZ1 AND NOT-SLC32A1 | Glioblastoma | 0.8387 | 0.9286 | 0.7647 |
| NOT-CLDN19 AND IFI6 | Melanoma | 0.8182 | 0.8182 | 0.8182 | PTPRZ1 AND NOT-KCNA1 | Glioblastoma | 0.875 | 0.9333 | 0.8235 |
| NOT-SLC22A8 AND ICAM1 | Melanoma | 0.8182 | 0.8182 | 0.8182 | PTPRZ1 AND NOT-HCN1 | Glioblastoma | 0.875 | 0.9333 | 0.8235 |
| NOT-CHRNA2 AND GPR19 | Melanoma | 1 | 1 | 1 | PTPRZ1 AND NOT-CNTNAP2 | Glioblastoma | 0.875 | 0.9333 | 0.8235 |
| NOT-ADAM29 AND SLC23A2 | Melanoma | 0.8421 | 1 | 0.7273 | PTPRZ1 AND NOT-CDH18 | Glioblastoma | 0.875 | 0.9333 | 0.8235 |
| NOT-ADAM29 AND LRIG3 | Melanoma | 1 | 1 | 1 | PTPRZ1 AND NOT-CALN1 | Glioblastoma | 0.8387 | 0.9286 | 0.7647 |
| NOT-NMUR2 AND FAT1 | Melanoma | 1 | 1 | 1 | PTPRZ1 AND NOT-CDH8 | Glioblastoma | 0.875 | 0.9333 | 0.8235 |
| NOT-NPFFR1 AND GPR19 | Melanoma | 0.9524 | 1 | 0.9091 | PTPRZ1 AND NOT-GABRA1 | Glioblastoma | 0.8387 | 0.9286 | 0.7647 |
| NOT-SCN10A AND ICAM1 | Melanoma | 0.8421 | 1 | 0.7273 | NRCAM AND NOT-ATP2B2 | Glioblastoma | 0.9091 | 0.9375 | 0.8824 |
| NOT-SLC8A3 AND VANGL1 | Melanoma | 0.8421 | 1 | 0.7273 | PTPRZ1 AND NOT-SLC12A5 | Glioblastoma | 0.875 | 0.9333 | 0.8235 |
| NOT-ADAM29 AND PLVAP | Melanoma | 1 | 1 | 1 | PTPRZ1 AND NOT-PTPRR | Glioblastoma | 0.9091 | 0.9375 | 0.8824 |
| NOT-SLC22A9 AND LRIG3 | Melanoma | 0.8421 | 1 | 0.7273 | PTPRZ1 AND NOT-GPR26 | Glioblastoma | 0.875 | 0.9333 | 0.8235 |
| NOT-CHRNA2 AND CDH11 | Melanoma | 0.9524 | 1 | 0.9091 | PTPRZ1 AND NOT-GRM5 | Glioblastoma | 0.875 | 0.9333 | 0.8235 |
| NOT-CHRNA2 AND TNFRSF12A | Melanoma | 0.9524 | 1 | 0.9091 | PTPRZ1 AND NOT-ATP2B2 | Glioblastoma | 0.875 | 0.9333 | 0.8235 |
| NOT-NMUR2 AND DCSTAMP | Melanoma | 0.8421 | 1 | 0.7273 | PTPRZ1 AND NOT-KCNC1 | Glioblastoma | 0.9091 | 0.9375 | 0.8824 |
| NOT-TMEM235 AND VANGL1 | Melanoma | 0.8571 | 0.9 | 0.8182 | PTPRZ1 AND NOT-DGKE | Glioblastoma | 0.9091 | 0.9375 | 0.8824 |
| NOT-SLC10A2 AND TTYH2 | Melanoma | 0.8 | 0.7143 | 0.9091 | PTPRZ1 AND NOT-CDH10 | Glioblastoma | 0.8387 | 0.9286 | 0.7647 |
| NOT-NMUR2 AND TTYH2 | Melanoma | 0.8 | 0.7143 | 0.9091 | PTPRZ1 AND NOT-GRM7 | Glioblastoma | 0.9091 | 0.9375 | 0.8824 |
| NOT-ADAM29 AND TTYH2 | Melanoma | 0.8 | 0.7143 | 0.9091 | PTPRZ1 AND NOT-GPR22 | Glioblastoma | 0.875 | 0.9333 | 0.8235 |
| NOT-CLDN19 AND TTYH2 | Melanoma | 0.8 | 0.7143 | 0.9091 | NRCAM AND NOT-SCN2A | Glioblastoma | 0.8387 | 0.9286 | 0.7647 |
| NOT-CLDN19 AND VANGL1 | Melanoma | 0.9524 | 1 | 0.9091 | PTPRZ1 AND NOT-SYT4 | Glioblastoma | 0.875 | 0.9333 | 0.8235 |
| NOT-CACNG6 AND TTYH2 | Melanoma | 0.8 | 0.7143 | 0.9091 | PTPRZ1 AND NOT-OPCML | Glioblastoma | 0.8 | 0.9231 | 0.7059 |
| NOT-NMUR2 AND IFI6 | Melanoma | 0.8182 | 0.8182 | 0.8182 | PTPRZ1 AND NOT-NRG3 | Glioblastoma | 0.8 | 0.9231 | 0.7059 |
| NOT-CHRNA2 AND LRIG3 | Melanoma | 1 | 1 | 1 | PTPRZ1 AND NOT-GRM1 | Glioblastoma | 0.8 | 0.9231 | 0.7059 |
| NOT-CLDN19 AND FAT1 | Melanoma | 0.9524 | 1 | 0.9091 | PTPRZ1 AND NOT-CACNA1E | Glioblastoma | 0.9032 | 1 | 0.8235 |
| NOT-CHRNA2 AND ENPP1 | Melanoma | 0.8696 | 0.8333 | 0.9091 | PTPRZ1 AND NOT-ANO4 | Glioblastoma | 0.8667 | 1 | 0.7647 |
| NOT-NMUR2 AND EPHA2 | Melanoma | 0.8571 | 0.9 | 0.8182 | PTPRZ1 AND NOT-GABRA4 | Glioblastoma | 0.875 | 0.9333 | 0.8235 |
| NOT-HTR1E AND VANGL1 | Melanoma | 0.9091 | 0.9091 | 0.9091 | PTPRZ1 AND NOT-GHR | Glioblastoma | 0.8 | 0.9231 | 0.7059 |
| NOT-CLDN19 AND GPR19 | Melanoma | 1 | 1 | 1 | NRCAM AND NOT-GABRA4 | Glioblastoma | 0.8235 | 0.8235 | 0.8235 |
| NOT-CHRNA2 AND GJA3 | Melanoma | 0.9 | 1 | 0.8182 | PTPRZ1 AND NOT-DPP10 | Glioblastoma | 0.8387 | 0.9286 | 0.7647 |
| NOT-CLDN19 AND TNFRSF12A | Melanoma | 0.9524 | 1 | 0.9091 | PTPRZ1 AND NOT-PIK3IP1 | Glioblastoma | 0.9091 | 0.9375 | 0.8824 |
| NOT-CDH10 AND GPR158 | Melanoma | 0.8421 | 1 | 0.7273 | PTPRZ1 AND NOT-CLSTN3 | Glioblastoma | 0.9091 | 0.9375 | 0.8824 |
| NOT-CHRNA2 AND PLVAP | Melanoma | 1 | 1 | 1 | PTPRZ1 AND NOT-CCKBR | Glioblastoma | 0.9091 | 0.9375 | 0.8824 |
| NOT-ADAM29 AND ENPP1 | Melanoma | 0.9524 | 1 | 0.9091 | PTPRZ1 AND NOT-OR2L13 | Glioblastoma | 0.875 | 0.9333 | 0.8235 |
| NOT-C8B AND TTYH2 | Melanoma | 0.8182 | 0.8182 | 0.8182 | PTPRZ1 AND NOT-SLC6A12 | Glioblastoma | 0.875 | 0.9333 | 0.8235 |
| NOT-SLC17A2 AND VANGL1 | Melanoma | 0.8571 | 0.9 | 0.8182 | PTPRZ1 AND NOT-PTPRT | Glioblastoma | 0.875 | 0.9333 | 0.8235 |
| NOT-NTSR2 AND GPR19 | Melanoma | 1 | 1 | 1 | PTPRZ1 AND NOT-SLC16A5 | Glioma | 0.9855 | 0.9855 | 0.9855 |
| NOT-TMEM235 AND ICAM1 | Melanoma | 0.8421 | 1 | 0.7273 | PTPRZ1 AND NOT-SLC6A15 | Glioma | 0.9781 | 0.9853 | 0.971 |
| NOT-SLC22A8 AND IFI6 | Melanoma | 0.8182 | 0.8182 | 0.8182 | NRCAM AND NOT-KCNA2 | Glioma | 0.9385 | 1 | 0.8841 |
| NOT-SLC10A2 AND IFI6 | Melanoma | 0.8182 | 0.8182 | 0.8182 | NRCAM AND NOT-KCNJ9 | Glioma | 0.9385 | 1 | 0.8841 |
| NOT-GLRA2 AND IFI6 | Melanoma | 0.8182 | 0.8182 | 0.8182 | PTPRZ1 AND NOT-NKAIN2 | Glioma | 0.9855 | 0.9855 | 0.9855 |
| NOT-CACNG6 AND IFI6 | Melanoma | 0.8182 | 0.8182 | 0.8182 | PTPRZ1 AND NOT-ABCG4 | Glioma | 0.9781 | 0.9853 | 0.971 |
| NOT-CLDN19 AND LRIG3 | Melanoma | 1 | 1 | 1 | PTPRZ1 AND NOT-TMPRSS11D | Glioma | 0.9781 | 0.9853 | 0.971 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NOT-NMUR2 AND LRIG3 | Melanoma | 1 | 1 | 1 | PTPRZ1 AND NOT-KIAA0319 | Glioma | 0.9855 | 0.9855 | 0.9855 |
| NOT-NOX1 AND VANGL1 | Melanoma | 0.9 | 1 | 0.8182 | PTPRZ1 AND NOT-CD1A | Glioma | 0.9927 | 1 | 0.9855 |
| NOT-AMHR2 AND ICAM1 | Melanoma | 0.8182 | 0.8182 | 0.8182 | PTPRZ1 AND NOT-HCN1 | Glioma | 0.9781 | 0.9853 | 0.971 |
| NOT-ADAM29 AND GJA3 | Melanoma | 0.9 | 1 | 0.8182 | PTPRZ1 AND NOT-ATP8A2 | Glioma | 0.9855 | 0.9855 | 0.9855 |
| NOT-NMUR2 AND CDH11 | Melanoma | 0.9524 | 1 | 0.9091 | PTPRZ1 AND NOT-SCN8A | Glioma | 0.9781 | 0.9853 | 0.971 |
| NOT-CLDN19 AND PLVAP | Melanoma | 0.9524 | 1 | 0.9091 | PTPRZ1 AND NOT-SMPD2 | Glioma | 0.9706 | 0.9851 | 0.9565 |
| NOT-SLC6A13 AND VANGL1 | Melanoma | 0.9 | 1 | 0.8182 | PTPRZ1 AND NOT-TMPRSS11E | Glioma | 0.9855 | 0.9855 | 0.9855 |
| NOT-CHRNA2 AND SLC23A2 | Melanoma | 0.7778 | 1 | 0.6364 | NRCAM AND NOT-HTR1E | Glioma | 0.9385 | 1 | 0.8841 |
| NOT-CLDN19 AND SLC22A18 | Melanoma | 0.7778 | 1 | 0.6364 | NRCAM AND NOT-CDH8 | Glioma | 0.9313 | 0.9839 | 0.8841 |
| NOT-GJD2 AND ICAM1 | Melanoma | 0.9 | 1 | 0.8182 | NLGN1 AND NOT-CACNA1B | Glioma | 0.9385 | 1 | 0.8841 |
| NOT-NMUR2 AND SLC23A2 | Melanoma | 0.7778 | 1 | 0.6364 | NLGN1 AND NOT-GPR83 | Glioma | 0.9385 | 1 | 0.8841 |
| NOT-ADAM29 AND LRRC8E | Melanoma | 0.9524 | 1 | 0.9091 | PTPRZ1 AND NOT-GPR6 | Glioma | 0.9706 | 0.9851 | 0.9565 |
| NOT-CALHM1 AND SLC22A18 | Melanoma | 0.8182 | 0.8182 | 0.8182 | PTPRZ1 AND NOT-CDH8 | Glioma | 0.9855 | 0.9855 | 0.9855 |
| NOT-HTR1E AND SLC23A2 | Melanoma | 0.7778 | 1 | 0.6364 | PTPRZ1 AND NOT-DGKE | Glioma | 0.9855 | 0.9855 | 0.9855 |
| NOT-ANO4 AND DCC | Ovarian | 0.7826 | 0.8182 | 0.75 | NLGN1 AND NOT-HCN1 | Glioma | 0.9302 | 1 | 0.8696 |
| NOT-EMP3 AND GPRC6A | Ovarian | 0.7619 | 0.8889 | 0.6667 | NRCAM AND NOT-SCN8A | Glioma | 0.9302 | 1 | 0.8696 |
| NOT-KCNK12 AND GPRC6A | Ovarian | 0.7 | 0.875 | 0.5833 | NLGN1 AND NOT-SCN8A | Glioma | 0.9302 | 1 | 0.8696 |
| NOT-GRID2 AND SLC4A5 | Ovarian | 0.64 | 0.6154 | 0.6667 | PTPRZ1 AND NOT-CACNA1B | Glioma | 0.9855 | 0.9855 | 0.9855 |
| NOT-KCNK12 AND DCC | Ovarian | 0.6364 | 0.7 | 0.5833 | PTPRZ1 AND NOT-HTR5A | Glioma | 0.9781 | 0.9853 | 0.971 |
| NOT-EMP3 AND NMUR2 | Ovarian | 0.8 | 1 | 0.6667 | NRCAM AND NOT-HCN1 | Glioma | 0.9313 | 0.9839 | 0.8841 |
| NOT-KCNK12 AND KCNV1 | Ovarian | 0.6364 | 0.7 | 0.5833 | NLGN1 AND NOT-GPR6 | Glioma | 0.9385 | 1 | 0.8841 |
| NOT-KCNK12 AND LRRC8E | Ovarian | 0.6667 | 0.7778 | 0.5833 | NRCAM AND NOT-ATP2B2 | Glioma | 0.9313 | 0.9839 | 0.8841 |
| NOT-EMP3 AND LRRC8E | Ovarian | 0.8 | 1 | 0.6667 | NLGN1 AND NOT-GABRA2 | Glioma | 0.9385 | 1 | 0.8841 |
| NOT-MTNR1B AND KCNU1 | Ovarian | 0.7619 | 0.8889 | 0.6667 | PTPRZ1 AND NOT-GRM3 | Glioma | 0.9927 | 1 | 0.9855 |
| NKAIN4 AND NOT-P2RX5 | Astrocytoma | 0.7952 | 0.8919 | 0.7174 | NLGN1 AND NOT-KCNA1 | Glioma | 0.9302 | 1 | 0.8696 |
| NKAIN4 AND NOT-L1CAM | Astrocytoma | 0.75 | 0.8824 | 0.6522 | PTPRZ1 AND NOT-SLC32A1 | Glioma | 0.9706 | 0.9851 | 0.9565 |
| NKAIN4 AND NOT-SLC34A2 | Astrocytoma | 0.6667 | 0.8621 | 0.5435 | PTPRZ1 AND NOT-SLC26A8 | Glioma | 0.9855 | 0.9855 | 0.9855 |
| CRB1 AND NOT-B4GALNT1 | Astrocytoma | 0.6606 | 0.5714 | 0.7826 | PTPRZ1 AND NOT-CD207 | Glioma | 0.9855 | 0.9855 | 0.9855 |
| EDNRB AND NOT-AOC3 | Astrocytoma | 0.6538 | 0.5862 | 0.7391 | PTPRZ1 AND NOT-GABRA2 | Glioma | 0.9855 | 0.9855 | 0.9855 |
| EDNRB AND NOT-PHLDB2 | Astrocytoma | 0.6531 | 0.6154 | 0.6957 | NRCAM AND NOT-GABRB2 | Glioma | 0.9385 | 1 | 0.8841 |
| CRB1 AND NOT-L1CAM | Astrocytoma | 0.6316 | 0.8 | 0.5217 | SYT11 AND NOT-SYT2 | Glioma | 0.9853 | 1 | 0.971 |
| CRB1 AND NOT-EPCAM | Astrocytoma | 0.623 | 0.5 | 0.8261 | PTPRZ1 AND NOT-GRM1 | Glioma | 0.9706 | 0.9851 | 0.9565 |
| EDNRB AND NOT-CD36 | Astrocytoma | 0.6168 | 0.541 | 0.7174 | PTPRZ1 AND NOT-KCNK9 | Glioma | 0.9781 | 0.9853 | 0.971 |
| NKAIN4 AND NOT-ITGB3 | Astrocytoma | 0.6111 | 0.8462 | 0.4783 | NLGN1 AND NOT-KIAA0319 | Glioma | 0.9385 | 1 | 0.8841 |
| BEST3 AND NOT-CD34 | Astrocytoma | 0.6098 | 0.6944 | 0.5435 | PTPRZ1 AND NOT-SLC13A2 | Glioma | 0.9855 | 0.9855 | 0.9855 |
| CSPG5 AND NOT-P2RX5 | Astrocytoma | 0.6047 | 0.65 | 0.5652 | PTPRZ1 AND NOT-GPR83 | Glioma | 0.9781 | 0.9853 | 0.971 |
| CSPG5 AND NOT-EPCAM | Astrocytoma | 0.6 | 0.6136 | 0.587 | PTPRZ1 AND NOT-GGTLC1 | Glioma | 0.9927 | 1 | 0.9855 |
| FAP AND NOT-SCARA5 | Breast | 0.8431 | 0.8958 | 0.7963 | PTPRZ1 AND NOT-NPHS1 | Glioma | 0.963 | 0.9848 | 0.942 |
| FAP AND NOT-EMP3 | Breast | 0.835 | 0.8776 | 0.7963 | PTPRZ1 AND NOT-KCNA7 | Glioma | 0.9781 | 0.9853 | 0.971 |
| FAP AND NOT-MRGPRF | Breast | 0.84 | 0.913 | 0.7778 | PTPRZ1 AND NOT-MTNR1B | Glioma | 0.9778 | 1 | 0.9565 |
| FAP AND NOT-CLDN10 | Breast | 0.8081 | 0.8889 | 0.7407 | PTPRZ1 AND NOT-ABCA12 | Glioma | 0.9781 | 0.9853 | 0.971 |
| FAP AND NOT-MLANA | Breast | 0.8462 | 0.88 | 0.8148 | NRCAM AND NOT-CNTNAP2 | Glioma | 0.9302 | 1 | 0.8696 |
| FAP AND NOT-SLC39A2 | Breast | 0.8462 | 0.88 | 0.8148 | NLGN1 AND NOT-KCNK9 | Glioma | 0.9302 | 1 | 0.8696 |
| FAP AND NOT-LRIG3 | Breast | 0.8155 | 0.8571 | 0.7778 | PTPRZ1 AND NOT-EPHA10 | Glioma | 0.9855 | 0.9855 | 0.9855 |
| FAP AND NOT-DSC1 | Breast | 0.8627 | 0.9167 | 0.8148 | NRCAM AND NOT-KCNV1 | Glioma | 0.9242 | 0.9683 | 0.8841 |
| FAP AND NOT-CD207 | Breast | 0.8381 | 0.8627 | 0.8148 | NRCAM AND NOT-NKAIN2 | Glioma | 0.9242 | 0.9683 | 0.8841 |
| FAP AND NOT-CD1A | Breast | 0.8269 | 0.86 | 0.7963 | NRCAM AND NOT-KCNA1 | Glioma | 0.9242 | 0.9683 | 0.8841 |
| FAP AND NOT-EPHA2 | Breast | 0.7551 | 0.8409 | 0.6852 | NRCAM AND NOT-CCKBR | Glioma | 0.9242 | 0.9683 | 0.8841 |
| PPAPDC1A AND NOT-NCAM1 | Breast | 0.7551 | 0.8409 | 0.6852 | NRCAM AND NOT-SLC24A2 | Glioma | 0.9242 | 0.9683 | 0.8841 |
| FAP AND NOT-TMPRSS11E | Breast | 0.82 | 0.8913 | 0.7593 | PTPRZ1 AND NOT-PVRL1 | Glioma | 0.9781 | 0.9853 | 0.971 |
| FAP AND NOT-ANTXR2 | Breast | 0.7416 | 0.9429 | 0.6111 | PTPRZ1 AND NOT-HCN4 | Glioma | 0.9855 | 0.9855 | 0.9855 |
| FAP AND NOT-SLC1A6 | Breast | 0.8119 | 0.8723 | 0.7593 | NLGN1 AND NOT-SLC32A1 | Glioma | 0.9302 | 1 | 0.8696 |
| FAP AND NOT-AOC3 | Breast | 0.8431 | 0.8958 | 0.7963 | NRCAM AND NOT-TMEM235 | Glioma | 0.9242 | 0.9683 | 0.8841 |
| FAP AND NOT-PHLDB2 | Breast | 0.7391 | 0.8947 | 0.6296 | NLGN1 AND NOT-DGKE | Glioma | 0.9385 | 1 | 0.8841 |
| FAP AND NOT-MSMO1 | Breast | 0.7292 | 0.8333 | 0.6481 | PTPRZ1 AND NOT-MRAP | Glioma | 0.9855 | 0.9855 | 0.9855 |
| FAP AND NOT-CDH22 | Breast | 0.8155 | 0.8571 | 0.7778 | PTPRZ1 AND NOT-ATP8A2 | Glioma | 0.9302 | 1 | 0.8696 |
| ENPP1 AND NOT-ALDH1A1 | Breast | 0.7551 | 0.8409 | 0.6852 | PTPRZ1 AND NOT-SLC22A9 | Glioma | 0.9778 | 1 | 0.9565 |
| FAP AND NOT-FXYD6 | Breast | 0.7917 | 0.9048 | 0.7037 | NLGN1 AND NOT-GPR26 | Glioma | 0.9385 | 1 | 0.8841 |
| FAP AND NOT-PTGIS | Breast | 0.8283 | 0.9111 | 0.7593 | PTPRZ1 AND NOT-KCNJ6 | Glioma | 0.9855 | 0.9855 | 0.9855 |
| FAP AND NOT-ADCY8 | Breast | 0.8462 | 0.88 | 0.8148 | NRCAM AND NOT-CACNA1E | Glioma | 0.9231 | 0.9836 | 0.8696 |
| FAP AND NOT-SELP | Breast | 0.7742 | 0.9231 | 0.6667 | NRCAM AND NOT-GPR26 | Glioma | 0.9231 | 0.9836 | 0.8696 |
| FAP AND NOT-SLC2A1 | Breast | 0.8235 | 0.875 | 0.7778 | NLGN1 AND NOT-GRM1 | Glioma | 0.9385 | 1 | 0.8841 |
| FAP AND NOT-TRPM1 | Breast | 0.8381 | 0.8627 | 0.8148 | PTPRZ1 AND NOT-KCNA1 | Glioma | 0.9781 | 0.9853 | 0.971 |
| FAP AND NOT-ERVW-1 | Breast | 0.8269 | 0.86 | 0.7963 | NRCAM AND NOT-CACNG8 | Glioma | 0.9242 | 0.9683 | 0.8841 |
| FAP AND NOT-PVRL1 | Breast | 0.8381 | 0.8627 | 0.8148 | NRCAM AND NOT-CLSTN3 | Glioma | 0.9313 | 0.9839 | 0.8841 |
| FAP AND NOT-MRAP | Breast | 0.8039 | 0.8542 | 0.7593 | NRCAM AND NOT-CACNG3 | Glioma | 0.9385 | 1 | 0.8841 |
| FAP AND NOT-SLC23A2 | Breast | 0.8039 | 0.8542 | 0.7593 | NRCAM AND NOT-CACNA1B | Glioma | 0.9385 | 1 | 0.8841 |
| FAP AND NOT-GRIK4 | Breast | 0.8544 | 0.898 | 0.8148 | NRCAM AND NOT-GRM1 | Glioma | 0.9313 | 0.9839 | 0.8841 |
| FAP AND NOT-CD44 | Breast | 0.8381 | 0.8627 | 0.8148 | PTPRZ1 AND NOT-OR8D1 | Glioma | 0.9855 | 0.9855 | 0.9855 |
| FAP AND NOT-GABRA4 | Breast | 0.8462 | 0.88 | 0.8148 | PTPRZ1 AND NOT-HTR1E | Glioma | 0.9855 | 0.9855 | 0.9855 |
| FAP AND NOT-TSPAN16 | Breast | 0.8431 | 0.8958 | 0.7963 | PTPRZ1 AND NOT-CACNA1S | Glioma | 0.9781 | 0.9853 | 0.971 |
| FAP AND NOT-AGTR2 | Breast | 0.8627 | 0.9167 | 0.8148 | PTPRZ1 AND NOT-FGF6 | Glioma | 0.9855 | 0.9855 | 0.9855 |
| FAP AND NOT-GJA3 | Breast | 0.8713 | 0.9362 | 0.8148 | PTPRZ1 AND NOT-GUCY2F | Glioma | 0.9855 | 0.9855 | 0.9855 |
| FAP AND NOT-DRD5 | Breast | 0.835 | 0.8776 | 0.7963 | PTPRZ1 AND NOT-LRRC8E | Glioma | 0.9706 | 0.9851 | 0.9565 |
| FAP AND NOT-PROCR | Breast | 0.7045 | 0.9118 | 0.5741 | PTPRZ1 AND NOT-CLSTN3 | Glioma | 0.9855 | 0.9855 | 0.9855 |
| FAP AND NOT-SLC6A11 | Breast | 0.8381 | 0.8627 | 0.8148 | ATP8B2 AND NOT-FCER1A | Leiomyosarcoma | 0.7826 | 0.9 | 0.6923 |
| FAP AND NOT-CHRNG | Breast | 0.835 | 0.8776 | 0.7963 | ATP8B2 AND NOT-ABCB1 | Leiomyosarcoma | 0.8333 | 0.9091 | 0.7692 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FAP AND NOT-CHRNB4 | Breast | 0.8544 | 0.898 | 0.8148 | ATP8B2 AND NOT-IL27RA | Leiomyosarcoma | 0.8333 | 0.9091 | 0.7692 |
| FAP AND NOT-SLC9B1 | Breast | 0.8381 | 0.8627 | 0.8148 | ATP8B2 AND NOT-MAL | Leiomyosarcoma | 0.8333 | 0.9091 | 0.7692 |
| FAP AND NOT-MMP24 | Breast | 0.8269 | 0.86 | 0.7963 | FGFR1 AND NOT-SLC6A11 | Leiomyosarcoma | 0.7619 | 1 | 0.6154 |
| FAP AND NOT-ESAM | Breast | 0.8381 | 0.8627 | 0.8148 | ATP8B2 AND NOT-AQP3 | Leiomyosarcoma | 0.8333 | 0.9091 | 0.7692 |
| FAP AND NOT-ABCA12 | Breast | 0.7921 | 0.8511 | 0.7407 | ATP8B2 AND NOT-CD1C | Leiomyosarcoma | 0.7826 | 0.9 | 0.6923 |
| FAP AND NOT-ATP6V0A4 | Breast | 0.7677 | 0.8444 | 0.7037 | FGFR1 AND NOT-SLC5A2 | Leiomyosarcoma | 0.8182 | 1 | 0.6923 |
| FAP AND NOT-SLC30A1 | Breast | 0.7447 | 0.875 | 0.6481 | DDR2 AND NOT-ATP8A1 | Leiomyosarcoma | 0.7619 | 1 | 0.6154 |
| FAP AND NOT-GRIN2A | Breast | 0.8269 | 0.86 | 0.7963 | FGFR1 AND NOT-SLC30A1 | Leiomyosarcoma | 0.7826 | 0.9 | 0.6923 |
| FAP AND NOT-PTPRR | Breast | 0.8544 | 0.898 | 0.8148 | FGFR1 AND NOT-KIAA0319 | Leiomyosarcoma | 0.8182 | 1 | 0.6923 |
| FAP AND NOT-MUC17 | Breast | 0.8381 | 0.8627 | 0.8148 | FGFR1 AND NOT-CD44 | Leiomyosarcoma | 0.7273 | 0.8889 | 0.6154 |
| FAP AND NOT-SLC22A11 | Breast | 0.8269 | 0.86 | 0.7963 | ATP8B2 AND NOT-CCR6 | Leiomyosarcoma | 0.8696 | 1 | 0.7692 |
| FAP AND NOT-OR7C1 | Breast | 0.8269 | 0.86 | 0.7963 | FGFR1 AND NOT-CD207 | Leiomyosarcoma | 0.7619 | 1 | 0.6154 |
| FAP AND NOT-GPR22 | Breast | 0.8627 | 0.9167 | 0.8148 | FGFR1 AND NOT-OR10J1 | Leiomyosarcoma | 0.8182 | 1 | 0.6923 |
| FAP AND NOT-GYPC | Breast | 0.8544 | 0.898 | 0.8148 | FGFR1 AND NOT-DSCAM | Leiomyosarcoma | 0.8182 | 1 | 0.6923 |
| FAP AND NOT-CLDN16 | Breast | 0.8155 | 0.8571 | 0.7778 | FGFR1 AND NOT-FGF6 | Leiomyosarcoma | 0.8182 | 1 | 0.6923 |
| FAP AND NOT-TSHR | Breast | 0.8269 | 0.86 | 0.7963 | FGFR1 AND NOT-RGSL1 | Leiomyosarcoma | 0.8182 | 1 | 0.6923 |
| FAP AND NOT-CCKAR | Breast | 0.8381 | 0.8627 | 0.8148 | TGFB3 AND NOT-CLDN10 | Leiomyosarcoma | 0.6667 | 0.875 | 0.5385 |
| FAP AND NOT-MPL | Breast | 0.8381 | 0.8627 | 0.8148 | ROR2 AND NOT-CLDN10 | Leiomyosarcoma | 0.8182 | 1 | 0.6923 |
| FAP AND NOT-HCN1 | Breast | 0.8381 | 0.8627 | 0.8148 | FGFR1 AND NOT-CLDN10 | Leiomyosarcoma | 0.8182 | 1 | 0.6923 |
| PPAPDC1A AND NOT-BCAN | Breast | 0.6972 | 0.6909 | 0.7037 | FGFR1 AND NOT-HCN2 | Leiomyosarcoma | 0.8182 | 1 | 0.6923 |
| FAP AND NOT-CALN1 | Breast | 0.8381 | 0.8627 | 0.8148 | ATP8B2 AND NOT-PTGDR2 | Leiomyosarcoma | 0.6667 | 0.6429 | 0.6923 |
| FAP AND NOT-PCDHAC2 | Breast | 0.8544 | 0.898 | 0.8148 | GPR161 AND NOT-CLDN10 | Leiomyosarcoma | 0.8182 | 1 | 0.6923 |
| FAP AND NOT-NRG3 | Breast | 0.7755 | 0.8636 | 0.7037 | ATP8B2 AND NOT-MFAP3L | Leiomyosarcoma | 0.6667 | 0.7273 | 0.6154 |
| FAP AND NOT-GALR2 | Breast | 0.8381 | 0.8627 | 0.8148 | ATP8B2 AND NOT-P2RY14 | Leiomyosarcoma | 0.6667 | 0.875 | 0.5385 |
| ABCG8 AND NOT-FOLH1 | Liver | 0.8 | 1 | 0.6667 | ATP8B2 AND NOT-SLC18A2 | Leiomyosarcoma | 0.7692 | 0.7692 | 0.7692 |
| FAT1 AND NOT-TPBG | Liver | 0.8 | 1 | 0.6667 | FGFR1 AND NOT-FSHR | Leiomyosarcoma | 0.8182 | 1 | 0.6923 |
| ALCAM AND NOT-TPBG | Liver | 0.7692 | 0.7143 | 0.8333 | FGFR1 AND NOT-GPR12 | Leiomyosarcoma | 0.8182 | 1 | 0.6923 |
| CLDN15 AND NOT-TPBG | Liver | 0.9091 | 1 | 0.8333 | FGFR1 AND NOT-CHRNA4 | Leiomyosarcoma | 0.8182 | 1 | 0.6923 |
| ALCAM AND NOT-IGF1R | Liver | 0.9091 | 1 | 0.8333 | FGFR1 AND NOT-ATP6V0A4 | Leiomyosarcoma | 0.8182 | 1 | 0.6923 |
| ALCAM AND NOT-ERBB4 | Liver | 0.9091 | 1 | 0.8333 | ROR2 AND NOT-GGTLC1 | Leiomyosarcoma | 0.7619 | 1 | 0.6154 |
| ABCG8 AND NOT-TPBG | Liver | 0.8 | 1 | 0.6667 | ATP8B2 AND NOT-IL12RB1 | Leiomyosarcoma | 0.7 | 1 | 0.5385 |
| ABCG8 AND NOT-GPA33 | Liver | 0.8 | 1 | 0.6667 | FGFR1 AND NOT-DSC1 | Leiomyosarcoma | 0.7619 | 1 | 0.6154 |
| ABCG8 AND NOT-ENPP3 | Liver | 0.8 | 1 | 0.6667 | FGFR1 AND NOT-GPR37L1 | Leiomyosarcoma | 0.8182 | 1 | 0.6923 |
| ALCAM AND NOT-IL20RA | Liver | 0.7143 | 0.625 | 0.8333 | FGFR1 AND NOT-SLC34A1 | Leiomyosarcoma | 0.8182 | 1 | 0.6923 |
| ABCG8 AND NOT-MUC13 | Liver | 0.8 | 1 | 0.6667 | FGFR1 AND NOT-LRIG3 | Leiomyosarcoma | 0.6667 | 0.875 | 0.5385 |
| ABCG8 AND NOT-GUCY2C | Liver | 0.8 | 1 | 0.6667 | ATP8B2 AND NOT-CD101 | Leiomyosarcoma | 0.7826 | 0.9 | 0.6923 |
| ABCG8 AND NOT-CLDN7 | Liver | 0.8 | 1 | 0.6667 | EMP3 AND NOT-P2RY14 | Leiomyosarcoma | 0.6667 | 0.7273 | 0.6154 |
| ABCG8 AND NOT-MST1R | Liver | 0.8 | 1 | 0.6667 | FGFR1 AND NOT-ATP13A5 | Leiomyosarcoma | 0.7619 | 1 | 0.6154 |
| ABCG8 AND NOT-SLC34A2 | Liver | 0.8 | 1 | 0.6667 | FGFR1 AND NOT-GPR6 | Leiomyosarcoma | 0.8182 | 1 | 0.6923 |
| ALCAM AND NOT-FOLR1 | Liver | 0.7143 | 0.625 | 0.8333 | FGFR1 AND NOT-HTR1D | Leiomyosarcoma | 0.7619 | 1 | 0.6154 |
| SLC30A10 AND NOT-CLDN7 | Liver | 0.6667 | 1 | 0.5 | FGFR1 AND NOT-CLDN19 | Leiomyosarcoma | 0.8182 | 1 | 0.6923 |
| ABCG8 AND NOT-PROM1 | Liver | 0.6667 | 1 | 0.5 | FGFR1 AND NOT-PROCR | Leiomyosarcoma | 0.7826 | 0.9 | 0.6923 |
| SLC30A10 AND NOT-GUCY2C | Liver | 0.6667 | 1 | 0.5 | FGFR1 AND NOT-SLC23A2 | Leiomyosarcoma | 0.6667 | 0.875 | 0.5385 |
| SLC30A10 AND NOT-IL20RA | Liver | 0.6667 | 1 | 0.5 | FGFR1 AND NOT-TMPRSS11E | Leiomyosarcoma | 0.7619 | 1 | 0.6154 |
| ABCG8 AND NOT-FOLR1 | Liver | 0.8 | 1 | 0.6667 | FGFR1 AND NOT-KCNK4 | Leiomyosarcoma | 0.8182 | 1 | 0.6923 |
| SLC30A10 AND NOT-MUC4 | Liver | 0.6667 | 1 | 0.5 | ATP8B2 AND NOT-IL18R1 | Leiomyosarcoma | 0.6667 | 0.875 | 0.5385 |
| SLC30A10 AND NOT-MUC13 | Liver | 0.6667 | 1 | 0.5 | FGFR1 AND NOT-HRH3 | Leiomyosarcoma | 0.8182 | 1 | 0.6923 |
| SLC30A10 AND NOT-ITGB6 | Liver | 0.6667 | 1 | 0.5 | FGFR1 AND NOT-MLANA | Leiomyosarcoma | 0.7826 | 0.9 | 0.6923 |
| SLC30A10 AND NOT-TRPM4 | Liver | 0.6667 | 1 | 0.5 | FGFR1 AND NOT-CD1A | Leiomyosarcoma | 0.7826 | 0.9 | 0.6923 |
| ABCG8 AND NOT-ITGB6 | Liver | 0.8 | 1 | 0.6667 | FGFR1 AND NOT-CACNG6 | Leiomyosarcoma | 0.8182 | 1 | 0.6923 |
| SLC30A10 AND NOT-MST1R | Liver | 0.6667 | 1 | 0.5 | FGFR1 AND NOT-CACNG7 | Leiomyosarcoma | 0.8182 | 1 | 0.6923 |
| SLC30A10 AND NOT-GPA33 | Liver | 0.6667 | 1 | 0.5 | ATP8B2 AND NOT-ATP2A3 | Leiomyosarcoma | 0.7826 | 0.9 | 0.6923 |
| SLC30A10 AND NOT-PROM1 | Liver | 0.6667 | 1 | 0.5 | FGFR1 AND NOT-HCN4 | Leiomyosarcoma | 0.7619 | 1 | 0.6154 |
| FAP AND NOT-PAQR7 | Pancreas | 0.8421 | 1 | 0.7273 | FGFR1 AND NOT-KCNH4 | Leiomyosarcoma | 0.7619 | 1 | 0.6154 |
| FAP AND NOT-MEGF10 | Pancreas | 0.7059 | 1 | 0.5455 | FGFR1 AND NOT-ABCA12 | Leiomyosarcoma | 0.7826 | 0.9 | 0.6923 |
| FAP AND NOT-ENPP1 | Pancreas | 0.8421 | 1 | 0.7273 | FGFR1 AND NOT-SLC13A2 | Leiomyosarcoma | 0.8182 | 1 | 0.6923 |
| FAP AND NOT-MRGPRF | Pancreas | 0.7778 | 1 | 0.6364 | FGFR1 AND NOT-PVRL1 | Leiomyosarcoma | 0.8182 | 1 | 0.6923 |
| FAP AND NOT-AOC3 | Pancreas | 0.8421 | 1 | 0.7273 | FGFR1 AND NOT-CDH22 | Leiomyosarcoma | 0.8182 | 1 | 0.6923 |
| FAP AND NOT-DGKE | Pancreas | 0.8421 | 1 | 0.7273 | ROR2 AND NOT-NKAIN1 | Leiomyosarcoma | 0.7619 | 1 | 0.6154 |
| FAP AND NOT-FXYD6 | Pancreas | 0.7778 | 1 | 0.6364 | FGFR1 AND NOT-SELP | Leiomyosarcoma | 0.7826 | 0.9 | 0.6923 |
| FAP AND NOT-SLC22A14 | Pancreas | 0.7778 | 1 | 0.6364 | ROR2 AND NOT-SELP | Leiomyosarcoma | 0.75 | 0.8182 | 0.6923 |
| FAP AND NOT-CDH9 | Pancreas | 0.8421 | 1 | 0.7273 | FGFR1 AND NOT-LRRC8E | Leiomyosarcoma | 0.7273 | 0.8889 | 0.6154 |
| SLC30A8 AND NOT-CD70 | Pancreas | 0.7778 | 1 | 0.6364 | FGFR1 AND NOT-CHRNG | Leiomyosarcoma | 0.8182 | 1 | 0.6923 |
| FAP AND NOT-NFASC | Pancreas | 0.7778 | 1 | 0.6364 | FGFR1 AND NOT-CD1B | Leiomyosarcoma | 0.7 | 1 | 0.5385 |
| FAP AND NOT-EMP3 | Pancreas | 0.7778 | 1 | 0.6364 | TGFBI AND NOT-F11R | Leiomyosarcoma | 0.75 | 0.8182 | 0.6923 |
| FAP AND NOT-AGTR2 | Pancreas | 0.8421 | 1 | 0.7273 | FGFR1 AND NOT-SMPD2 | Leiomyosarcoma | 0.8182 | 1 | 0.6923 |
| FAP AND NOT-ATP8B2 | Pancreas | 0.8421 | 1 | 0.7273 | FGFR1 AND NOT-KREMEN2 | Leiomyosarcoma | 0.8182 | 1 | 0.6923 |
| FAP AND NOT-ATP13A5 | Pancreas | 0.625 | 1 | 0.4545 | FGFR1 AND NOT-NPBWR1 | Leiomyosarcoma | 0.7 | 1 | 0.5385 |
| SLC30A8 AND NOT-ERBB4 | Pancreas | 0.7778 | 1 | 0.6364 | DDR2 AND NOT-STEAP4 | Leiomyosarcoma | 0.8182 | 1 | 0.6923 |
| SLC30A8 AND NOT-SSTR2 | Pancreas | 0.7778 | 1 | 0.6364 | PCDH18 AND NOT-SELP | Leiomyosarcoma | 0.7273 | 0.8889 | 0.6154 |
| FAP AND NOT-SELP | Pancreas | 0.7778 | 1 | 0.6364 | FGFR1 AND NOT-MAG | Leiomyosarcoma | 0.8182 | 1 | 0.6923 |
| SLC30A8 AND NOT-L1CAM | Pancreas | 0.7778 | 1 | 0.6364 | FGFR1 AND NOT-AQP6 | Leiomyosarcoma | 0.8182 | 1 | 0.6923 |
| SLC30A8 AND NOT-CLDN8 | Pancreas | 0.7778 | 1 | 0.6364 | FGFR1 AND NOT-SLC22A11 | Leiomyosarcoma | 0.8182 | 1 | 0.6923 |
| FAP AND NOT-GRM7 | Pancreas | 0.8421 | 1 | 0.7273 | FGFR1 AND NOT-NPHS2 | Leiomyosarcoma | 0.7 | 1 | 0.5385 |
| SLC30A8 AND NOT-SSTR4 | Pancreas | 0.7778 | 1 | 0.6364 | FGFR1 AND NOT-ABCG5 | Leiomyosarcoma | 0.8182 | 1 | 0.6923 |
| FAP AND NOT-CACNG1 | Pancreas | 0.625 | 1 | 0.4545 | FGFR1 AND NOT-CEACAM7 | Leiomyosarcoma | 0.8182 | 1 | 0.6923 |
| FAP AND NOT-SLC22A16 | Pancreas | 0.8421 | 1 | 0.7273 | FGFR1 AND NOT-ADAM29 | Leiomyosarcoma | 0.8182 | 1 | 0.6923 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FAP AND NOT-ESAM | Pancreas | 0.8421 | 1 | 0.7273 | FGFR1 AND NOT-CLDN16 | Leiomyosarcoma | 0.7619 | 1 | 0.6154 |
| SLC22A2 AND NOT-CLDN8 | Renal | 0.7368 | 1 | 0.5833 | FGFR1 AND NOT-MRGPRF | Leiomyosarcoma | 0.7273 | 0.8889 | 0.6154 |
| SLC22A2 AND NOT-L1CAM | Renal | 0.7 | 0.875 | 0.5833 | FGFR1 AND NOT-PIK3IP1 | Leiomyosarcoma | 0.7273 | 0.8889 | 0.6154 |
| CLDN2 AND NOT-MUC17 | Renal | 0.6957 | 0.7273 | 0.6667 | FGFR1 AND NOT-GABRA2 | Leiomyosarcoma | 0.7619 | 1 | 0.6154 |
| VCAM1 AND NOT-SCARA5 | Renal | 0.8571 | 1 | 0.75 | FGFR1 AND NOT-MLNR | Leiomyosarcoma | 0.7826 | 0.9 | 0.6923 |
| TNFRSF12A AND NOT-IL11RA | Renal | 0.8 | 1 | 0.6667 | FGFR1 AND NOT-MLC1 | Leiomyosarcoma | 0.8182 | 1 | 0.6923 |
| VCAM1 AND NOT-MRGPRF | Renal | 0.8571 | 1 | 0.75 | FGFR1 AND NOT-SLC22A18 | Leiomyosarcoma | 0.7826 | 0.9 | 0.6923 |
| SLC22A2 AND NOT-LGR5 | Renal | 0.6667 | 0.7778 | 0.5833 | FGFR1 AND NOT-WNT7A | Leiomyosarcoma | 0.8182 | 1 | 0.6923 |
| CLDN2 AND NOT-SLC13A5 | Renal | 0.6667 | 0.7778 | 0.5833 | FGFR1 AND NOT-OR3A1 | Leiomyosarcoma | 0.7 | 1 | 0.5385 |
| CLDN2 AND NOT-SLC22A25 | Renal | 0.6667 | 0.7778 | 0.5833 | FGFR1 AND NOT-SLC13A5 | Leiomyosarcoma | 0.8182 | 1 | 0.6923 |
| CLDN2 AND NOT-ENPP1 | Renal | 0.6667 | 0.7778 | 0.5833 | FGFR1 AND NOT-SLC39A2 | Leiomyosarcoma | 0.8182 | 1 | 0.6923 |
| CLDN2 AND NOT-DIO1 | Renal | 0.6957 | 0.7273 | 0.6667 | FLT3 AND NOT-BTN3A1 | AML | 0.9526 | 0.9872 | 0.9203 |
| GGTLC1 AND NOT-CLDN11 | Renal | 0.6667 | 0.7778 | 0.5833 | FLT3 AND NOT-S1PR1 | AML | 0.9524 | 0.9914 | 0.9163 |
| CLDN2 AND NOT-SLCO1A2 | Renal | 0.7273 | 0.8 | 0.6667 | FLT3 AND NOT-ATP8B1 | AML | 0.9506 | 0.983 | 0.9203 |
| CLDN2 AND NOT-DISP2 | Renal | 0.7273 | 0.8 | 0.6667 | FLT3 AND NOT-GHR | AML | 0.9506 | 0.983 | 0.9203 |
| CLDN2 AND NOT-SLC16A5 | Renal | 0.6667 | 0.6667 | 0.6667 | FLT3 AND NOT-BTN3A3 | AML | 0.9504 | 0.9871 | 0.9163 |
| VCAM1 AND NOT-SLC43A1 | Renal | 0.7368 | 1 | 0.5833 | FLT3 AND NOT-IFNAR2 | AML | 0.9485 | 0.9829 | 0.9163 |
| CLDN2 AND NOT-TMPRSS11E | Renal | 0.7 | 0.875 | 0.5833 | FLT3 AND NOT-PHLDB2 | AML | 0.9482 | 0.9871 | 0.9124 |
| VCAM1 AND NOT-SLC16A5 | Renal | 0.7368 | 1 | 0.5833 | FLT3 AND NOT-EFNB2 | AML | 0.948 | 0.9913 | 0.9084 |
| SLC22A2 AND NOT-SSTR4 | Renal | 0.6364 | 0.7 | 0.5833 | FLT3 AND NOT-CSPG5 | AML | 0.9467 | 0.9747 | 0.9203 |
| CLDN2 AND NOT-CALHM1 | Renal | 0.6364 | 0.7 | 0.5833 | FLT3 AND NOT-GPR19 | AML | 0.9467 | 0.9747 | 0.9203 |
| VCAM1 AND NOT-KCNK6 | Renal | 0.8571 | 1 | 0.75 | FLT3 AND NOT-GRM5 | AML | 0.9467 | 0.9747 | 0.9203 |
| SLC6A13 AND NOT-CLDN8 | Renal | 0.6316 | 0.8571 | 0.5 | FLT3 AND NOT-SLC31A1 | AML | 0.9465 | 0.9787 | 0.9163 |
| SLC17A1 AND NOT-CLDN11 | Renal | 0.6316 | 0.8571 | 0.5 | FLT3 AND NOT-SLC22A5 | AML | 0.9448 | 0.9706 | 0.9203 |
| SLC6A13 AND NOT-L1CAM | Renal | 0.6316 | 0.8571 | 0.5 | FLT3 AND NOT-KCNK6 | AML | 0.9448 | 0.9706 | 0.9203 |
| VCAM1 AND NOT-FMNL1 | Renal | 0.7368 | 1 | 0.5833 | FLT3 AND NOT-SLC8A3 | AML | 0.9448 | 0.9706 | 0.9203 |
| GGTLC1 AND NOT-IL11RA | Renal | 0.6207 | 0.5294 | 0.75 | FLT3 AND NOT-SEMA4D | AML | 0.9448 | 0.9706 | 0.9203 |
| CLDN2 AND NOT-LRRC52 | Renal | 0.8 | 1 | 0.6667 | FLT3 AND NOT-NKAIN2 | AML | 0.9446 | 0.9746 | 0.9163 |
| CLDN2 AND NOT-GHRHR | Renal | 0.7368 | 1 | 0.5833 | FLT3 AND NOT-PROCR | AML | 0.9441 | 0.9828 | 0.9084 |
| CLDN2 AND NOT-CCR9 | Renal | 0.6154 | 0.5714 | 0.6667 | FLT3 AND NOT-FXYD6 | AML | 0.9436 | 0.9912 | 0.9004 |
| CLDN2 AND NOT-SLC5A11 | Renal | 0.6154 | 0.5714 | 0.6667 | FLT3 AND NOT-CD93 | AML | 0.9429 | 0.9665 | 0.9203 |
| CLDN2 AND NOT-KCNJ10 | Renal | 0.6154 | 0.5714 | 0.6667 | FLT3 AND NOT-SLC9A1 | AML | 0.9429 | 0.9665 | 0.9203 |
| CLDN2 AND NOT-PTPRT | Renal | 0.6667 | 0.7778 | 0.5833 | FLT3 AND NOT-GPR37L1 | AML | 0.9429 | 0.9665 | 0.9203 |
| CLDN2 AND NOT-GABRA4 | Renal | 0.6667 | 1 | 0.5 | FLT3 AND NOT-KCNV1 | AML | 0.9429 | 0.9665 | 0.9203 |
| CLDN2 AND NOT-GABRA2 | Renal | 0.6087 | 0.6364 | 0.5833 | FLT3 AND NOT-ZACN | AML | 0.9429 | 0.9665 | 0.9203 |
| CLDN2 AND NOT-GJB4 | Renal | 0.6364 | 0.7 | 0.5833 | FLT3 AND NOT-SLC5A2 | AML | 0.9429 | 0.9665 | 0.9203 |
| VCAM1 AND NOT-PTGER4 | Renal | 0.8 | 1 | 0.6667 | FLT3 AND NOT-PAQR7 | AML | 0.9429 | 0.9665 | 0.9203 |
| CLDN2 AND NOT-LAMP5 | Renal | 0.6667 | 0.6667 | 0.6667 | FLT3 AND NOT-ADAM29 | AML | 0.9429 | 0.9665 | 0.9203 |
| SLC17A1 AND NOT-LGR5 | Renal | 0.6 | 0.75 | 0.5 | FLT3 AND NOT-CALN1 | AML | 0.9424 | 0.9745 | 0.9124 |
| CLDN2 AND NOT-USH2A | Renal | 0.6 | 0.75 | 0.5 | SLC22A16 AND NOT-PERP | AML | 0.9412 | 0.9587 | 0.9243 |
| VCAM1 AND NOT-SLC6A7 | Renal | 0.7368 | 1 | 0.5833 | FLT3 AND NOT-SLC43A1 | AML | 0.9407 | 0.9664 | 0.9163 |
| SLC6A13 AND NOT-LGR5 | Renal | 0.6 | 0.75 | 0.5 | FLT3 AND NOT-SELP | AML | 0.9407 | 0.9664 | 0.9163 |
| SLC13A1 AND NOT-CR2 | Renal | 0.6 | 0.75 | 0.5 | FLT3 AND NOT-SMPD2 | AML | 0.9407 | 0.9664 | 0.9163 |
| SLC6A13 AND NOT-CR2 | Renal | 0.6 | 0.75 | 0.5 | FLT3 AND NOT-SLC2A1 | AML | 0.9407 | 0.9664 | 0.9163 |
| CLDN2 AND NOT-CNTNAP2 | Renal | 0.6 | 0.75 | 0.5 | FLT3 AND NOT-SLC38A1 | AML | 0.9407 | 0.9664 | 0.9163 |
| SLC13A1 AND NOT-LGR5 | Renal | 0.6 | 0.75 | 0.5 | FLT3 AND NOT-IL15RA | AML | 0.9405 | 0.9703 | 0.9124 |
| CLDN2 AND NOT-OPALIN | Renal | 0.6364 | 0.7 | 0.5833 | FLT3 AND NOT-LAT | AML | 0.9402 | 0.9744 | 0.9084 |
| VCAM1 AND NOT-LAMP5 | Renal | 0.8 | 1 | 0.6667 | FLT3 AND NOT-PAQR8 | AML | 0.9402 | 0.9744 | 0.9084 |
| TNFRSF12A AND NOT-CLDN11 | Renal | 0.6087 | 0.6364 | 0.5833 | SLC22A16 AND NOT-PROS1 | AML | 0.9416 | 0.9512 | 0.9323 |
| CLDN2 AND NOT-CSMD3 | Renal | 0.6667 | 1 | 0.5 | SLC22A16 AND NOT-PODXL | AML | 0.9398 | 0.9474 | 0.9323 |
| CLDN2 AND NOT-KCNK10 | Renal | 0.6154 | 0.5714 | 0.6667 | FLT3 AND NOT-SLC16A5 | AML | 0.9363 | 0.9661 | 0.9084 |
| CLDN2 AND NOT-SLC12A3 | Renal | 0.6087 | 0.6364 | 0.5833 | SLC22A16 AND NOT-TMEM47 | AML | 0.936 | 0.9398 | 0.9323 |
| CLDN2 AND NOT-TRPC3 | Renal | 0.6364 | 0.7 | 0.5833 | FLT3 AND NOT-SYT11 | AML | 0.9347 | 0.9911 | 0.8845 |
| DPEP1 AND NOT-IL13 | Colon | 1 | 1 | 1 | SLC22A16 AND NOT-TUSC3 | AML | 0.9341 | 0.936 | 0.9323 |
| DPEP1 AND NOT-SLC28A1 | Colon | 1 | 1 | 1 | SLC22A16 AND NOT-TRPC1 | AML | 0.9352 | 0.9506 | 0.9203 |
| DPEP1 AND NOT-SLC13A1 | Colon | 1 | 1 | 1 | FLT3 AND NOT-ZDHHC2 | AML | 0.932 | 0.9658 | 0.9004 |
| DPEP1 AND NOT-CD1B | Colon | 1 | 1 | 1 | P2RX1 AND NOT-PHLDB2 | AML | 0.9377 | 0.9163 | 0.9602 |
| DPEP1 AND NOT-GPR26 | Colon | 1 | 1 | 1 | FLT3 AND NOT-FLVCR1 | AML | 0.9314 | 0.9739 | 0.8924 |
| DPEP1 AND NOT-EPHA8 | Colon | 1 | 1 | 1 | SLC22A16 AND NOT-ANTXR1 | AML | 0.9304 | 0.9286 | 0.9323 |
| DPEP1 AND NOT-ANPEP | Colon | 1 | 1 | 1 | SLC22A16 AND NOT-NTN4 | AML | 0.9304 | 0.9286 | 0.9323 |
| DPEP1 AND NOT-SPAM1 | Colon | 1 | 1 | 1 | SLC22A16 AND NOT-SLC7A2 | AML | 0.9301 | 0.932 | 0.9283 |
| DPEP1 AND NOT-ENPP1 | Colon | 1 | 1 | 1 | SLC22A16 AND NOT-LIFR | AML | 0.9301 | 0.932 | 0.9283 |
| DPEP1 AND NOT-OXTR | Colon | 1 | 1 | 1 | SLC22A16 AND NOT-LAMP3 | AML | 0.9286 | 0.9249 | 0.9323 |
| DPEP1 AND NOT-HTR3C | Colon | 1 | 1 | 1 | SLC22A16 AND NOT-EMP2 | AML | 0.9286 | 0.9249 | 0.9323 |
| GUCY2C AND NOT-SLC9A1 | Colon | 1 | 1 | 1 | SLC22A16 AND NOT-LPAR1 | AML | 0.9339 | 0.9395 | 0.9283 |
| DPEP1 AND NOT-KCNV2 | Colon | 1 | 1 | 1 | CSF3R AND NOT-PHLDB2 | AML | 0.9283 | 0.9283 | 0.9283 |
| CLDN2 AND NOT-SLC28A1 | Colon | 0.8889 | 1 | 0.8 | SLC22A16 AND NOT-MTUS1 | AML | 0.9283 | 0.9283 | 0.9283 |
| DPEP1 AND NOT-FXYD7 | Colon | 0.8889 | 1 | 0.8 | SLC22A16 AND NOT-ATP9A | AML | 0.9393 | 0.9547 | 0.9243 |
| DPEP1 AND NOT-CALHM1 | Colon | 0.8889 | 1 | 0.8 | SLC22A16 AND NOT-OSMR | AML | 0.9304 | 0.9286 | 0.9323 |
| NOX1 AND NOT-GPA33 | Colon | 0.8889 | 1 | 0.8 | SLC22A16 AND NOT-ENPP5 | AML | 0.9264 | 0.9246 | 0.9283 |
| EPHB2 AND NOT-EPHA10 | Colon | 0.8889 | 1 | 0.8 | SLC22A16 AND NOT-SEMA5A | AML | 0.9264 | 0.9246 | 0.9283 |
| CLDN2 AND NOT-SLC13A1 | Colon | 0.8889 | 1 | 0.8 | SLC22A16 AND NOT-TSPAN6 | AML | 0.9264 | 0.9246 | 0.9283 |
| EPHB2 AND NOT-SLC39A8 | Colon | 0.8889 | 1 | 0.8 | SLC22A16 AND NOT-TMEM150C | AML | 0.9249 | 0.9176 | 0.9323 |
| EPHB2 AND NOT-SLC9A1 | Colon | 0.8889 | 1 | 0.8 | SLC22A16 AND NOT-SLC25A4 | AML | 0.9249 | 0.9176 | 0.9323 |
| DPEP1 AND NOT-PCDH11Y | Colon | 0.8889 | 1 | 0.8 | SLC22A16 AND NOT-BMPR1A | AML | 0.932 | 0.9357 | 0.9283 |
| CLDN2 AND NOT-SLC2A2 | Colon | 0.8889 | 1 | 0.8 | SLC22A16 AND NOT-SSPN | AML | 0.9246 | 0.9458 | 0.9044 |
| DPEP1 AND NOT-OR1C1 | Colon | 1 | 1 | 1 | SLC22A16 AND NOT-ACVR2A | AML | 0.924 | 0.9277 | 0.9203 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| DPEP1 AND NOT-DSC1 | Colon | 1 | 1 | 1 | SLC22A16 AND NOT-SGCB | AML | 0.924 | 0.9277 | 0.9203 |
| DPEP1 AND NOT-CHRND | Colon | 1 | 1 | 1 | SLC22A16 AND NOT-DAG1 | AML | 0.9339 | 0.9395 | 0.9283 |
| DPEP1 AND NOT-CSMD3 | Colon | 1 | 1 | 1 | SLC22A16 AND NOT-WNT5A | AML | 0.9231 | 0.9141 | 0.9323 |
| DPEP1 AND NOT-FGF6 | Colon | 0.8889 | 1 | 0.8 | SLC22A16 AND NOT-SLC2A12 | AML | 0.9286 | 0.9249 | 0.9323 |
| DPEP1 AND NOT-LRRC52 | Colon | 1 | 1 | 1 | SLC22A16 AND NOT-SGCE | AML | 0.9317 | 0.9393 | 0.9243 |
| DPEP1 AND NOT-OR1Q1 | Colon | 1 | 1 | 1 | SLC22A16 AND NOT-ITGB5 | AML | 0.9215 | 0.9309 | 0.9124 |
| CLDN2 AND NOT-KCNV2 | Colon | 0.8889 | 1 | 0.8 | SLC22A16 AND NOT-PTPRM | AML | 0.9209 | 0.9137 | 0.9283 |
| DPEP1 AND NOT-KCNK10 | Colon | 1 | 1 | 1 | SLC22A16 AND NOT-DCBLD2 | AML | 0.9286 | 0.9249 | 0.9323 |
| CLDN2 AND NOT-ENPP1 | Colon | 0.8889 | 1 | 0.8 | SLC22A16 AND NOT-KITLG | AML | 0.9203 | 0.9203 | 0.9203 |
| GPA33 AND NOT-SLC9A1 | Colon | 1 | 1 | 1 | SLC22A16 AND NOT-ABHD6 | AML | 0.9194 | 0.907 | 0.9323 |
| NOX1 AND NOT-MUC4 | Colon | 0.8889 | 1 | 0.8 | SLC22A16 AND NOT-AMIGO2 | AML | 0.9182 | 0.92 | 0.9163 |
| DPEP1 AND NOT-GPR22 | Colon | 1 | 1 | 1 | ADAM12 AND NOT-SLC2A1 | Liposarcoma | 0.7407 | 0.6667 | 0.8333 |
| DPEP1 AND NOT-ABCG8 | Colon | 0.8889 | 1 | 0.8 | ADAM12 AND NOT-SELP | Liposarcoma | 0.7059 | 0.6122 | 0.8333 |
| DPEP1 AND NOT-ABCA12 | Colon | 0.8889 | 1 | 0.8 | ADAM12 AND NOT-ERVW-1 | Liposarcoma | 0.7381 | 0.6458 | 0.8611 |
| DPEP1 AND NOT-SLC10A2 | Colon | 1 | 1 | 1 | ADAM12 AND NOT-SLC1A2 | Liposarcoma | 0.6667 | 0.5439 | 0.8611 |
| DPEP1 AND NOT-SLC22A8 | Colon | 0.8889 | 1 | 0.8 | ADAM12 AND NOT-MSMO1 | Liposarcoma | 0.6444 | 0.537 | 0.8056 |
| DPEP1 AND NOT-CDH8 | Colon | 1 | 1 | 1 | FAT4 AND NOT-NFASC | Liposarcoma | 0.6667 | 0.9048 | 0.5278 |
| MUC13 AND NOT-SLC9A1 | Colon | 1 | 1 | 1 | SLC2A10 AND NOT-SORL1 | Liposarcoma | 0.6364 | 0.7 | 0.5833 |
| DPEP1 AND NOT-SLC5A11 | Colon | 0.8889 | 1 | 0.8 | ADAM12 AND NOT-ADAM29 | Liposarcoma | 0.6316 | 0.5085 | 0.8333 |
| DPEP1 AND NOT-KCNF1 | Colon | 0.8889 | 1 | 0.8 | CNTNAP1 AND NOT-NFASC | Liposarcoma | 0.6316 | 0.8571 | 0.5 |
| DPEP1 AND NOT-TRPC7 | Colon | 1 | 1 | 1 | FAT4 AND NOT-SORL1 | Liposarcoma | 0.6774 | 0.8077 | 0.5833 |
| DPEP1 AND NOT-UMOD | Colon | 1 | 1 | 1 | EMP3 AND NOT-CXCR2 | Liposarcoma | 0.6286 | 0.6471 | 0.6111 |
| DPEP1 AND NOT-SLC39A12 | Colon | 1 | 1 | 1 | TTYH3 AND NOT-CD46 | Liposarcoma | 0.6197 | 0.6286 | 0.6111 |
| DPEP1 AND NOT-GJB4 | Colon | 1 | 1 | 1 | TTYH3 AND NOT-KCNA3 | Liposarcoma | 0.6197 | 0.6286 | 0.6111 |
| DPEP1 AND NOT-SLCO6A1 | Colon | 1 | 1 | 1 | CNTNAP1 AND NOT-OMG | Liposarcoma | 0.6567 | 0.7097 | 0.6111 |
| DPEP1 AND NOT-TMPRSS11B | Colon | 1 | 1 | 1 | SLC50A1 AND NOT-ABCB1 | Lung Adenocarcinoma | 0.6491 | 0.8409 | 0.5286 |
| DPEP1 AND NOT-OTOF | Colon | 1 | 1 | 1 | SLC50A1 AND NOT-VIPR1 | Lung Adenocarcinoma | 0.6207 | 0.7826 | 0.5143 |
| DPEP1 AND NOT-CLDN20 | Colon | 0.8333 | 0.7143 | 1 | OSMR AND NOT-GHR | Lung Adenocarcinoma | 0.6154 | 0.9412 | 0.4571 |
| DPEP1 AND NOT-SLC1A6 | Colon | 1 | 1 | 1 | SLC50A1 AND NOT-ZFYVE27 | Lung Adenocarcinoma | 0.6116 | 0.7255 | 0.5286 |
| DPEP1 AND NOT-PIRT | Colon | 1 | 1 | 1 | PON2 AND NOT-SLC30A10 | Lung Adenocarcinoma | 0.614 | 0.7955 | 0.5 |
| DPEP1 AND NOT-OR2C3 | Colon | 0.9091 | 0.8333 | 1 | ADAM12 AND NOT-ENPP1 | Lung Carcinoma | 0.6265 | 0.5098 | 0.8125 |
| EPHB2 AND NOT-CHRND | Colon | 0.8889 | 1 | 0.8 | KCNJ10 AND NOT-MFAP3L | B-Cell Diffuse | 0.8451 | 0.8824 | 0.8108 |
| CLDN2 AND NOT-GPR26 | Colon | 0.8889 | 1 | 0.8 | KCNJ10 AND NOT-SLC4A4 | B-Cell Diffuse | 0.8056 | 0.8286 | 0.7838 |
| CLDN2 AND NOT-SPAM1 | Colon | 0.8889 | 1 | 0.8 | KCNJ10 AND NOT-ATP1B2 | B-Cell Diffuse | 0.8108 | 0.8108 | 0.8108 |
| CLDN2 AND NOT-GRM4 | Colon | 0.8889 | 1 | 0.8 | KCNJ10 AND NOT-LRP4 | B-Cell Diffuse | 0.8286 | 0.8788 | 0.7838 |
| GUCY2C AND NOT-SLC30A10 | Colon | 0.8889 | 1 | 0.8 | CXCL9 AND NOT-PROCR | B-Cell Diffuse | 0.7869 | 1 | 0.6486 |
| DPEP1 AND NOT-SLCO1C1 | Colon | 0.8889 | 1 | 0.8 | KCNJ10 AND NOT-NTRK2 | B-Cell Diffuse | 0.7895 | 0.7692 | 0.8108 |
| DPEP1 AND NOT-CALHM3 | Colon | 0.8889 | 1 | 0.8 | KCNJ10 AND NOT-PLP1 | B-Cell Diffuse | 0.8 | 0.7895 | 0.8108 |
| GRIN2A AND NOT-STEAP2 | Ependymoma | 1 | 1 | 1 | KCNJ10 AND NOT-NDRG4 | B-Cell Diffuse | 0.7692 | 0.8929 | 0.6757 |
| SSTR1 AND NOT-EBP | Ependymoma | 1 | 1 | 1 | KCNJ10 AND NOT-SEMA6D | B-Cell Diffuse | 0.7671 | 0.7778 | 0.7568 |
| SSTR1 AND NOT-SLC6A6 | Ependymoma | 1 | 1 | 1 | CXCL9 AND NOT-GJA3 | B-Cell Diffuse | 0.7647 | 0.8387 | 0.7027 |
| GRIN2A AND NOT-FOLH1 | Ependymoma | 1 | 1 | 1 | KCNJ10 AND NOT-SLC6A8 | B-Cell Diffuse | 0.7761 | 0.8667 | 0.7027 |
| GRIN2A AND NOT-ERBB4 | Ependymoma | 1 | 1 | 1 | KCNJ10 AND NOT-DPP6 | B-Cell Diffuse | 0.8333 | 0.8571 | 0.8108 |
| CRB2 AND NOT-EPCAM | Ependymoma | 0.6667 | 0.5 | 1 | CXCL9 AND NOT-PCDH11Y | B-Cell Diffuse | 0.7576 | 0.8621 | 0.6757 |
| GRIN2A AND NOT-B4GALNT1 | Ependymoma | 0.6667 | 0.5 | 1 | KCNJ10 AND NOT-TYRO3 | B-Cell Diffuse | 0.7536 | 0.8125 | 0.7027 |
| SSTR1 AND NOT-PTPRR | Ependymoma | 1 | 1 | 1 | CXCL9 AND NOT-SLC22A16 | B-Cell Diffuse | 0.7536 | 0.8125 | 0.7027 |
| SSTR1 AND NOT-SLC31A1 | Ependymoma | 1 | 1 | 1 | KCNJ10 AND NOT-PTPRD | B-Cell Diffuse | 0.75 | 0.7714 | 0.7297 |
| TNFRSF10B AND NOT-TNFRSF10A | Ependymoma | 0.6667 | 0.5 | 1 | KCNJ10 AND NOT-CNTN1 | B-Cell Diffuse | 0.75 | 0.7714 | 0.7297 |
| CDH17 AND NOT-ENPP3 | Esophagus | 0.625 | 0.5556 | 0.7143 | KCNJ10 AND NOT-ADCYAP1R1 | B-Cell Diffuse | 0.75 | 0.7714 | 0.7297 |
| CBX3 AND NOT-CD36 | Esophagus | 0.64 | 0.7273 | 0.5714 | MCOLN2 AND NOT-SLC30A10 | B-Cell Diffuse | 0.7826 | 0.8438 | 0.7297 |
| SLCO1B3 AND NOT-IL11RA | Esophagus | 0.6 | 1 | 0.4286 | KCNJ10 AND NOT-FGFR3 | B-Cell Diffuse | 0.7436 | 0.7073 | 0.7838 |
| MUC17 AND NOT-HHLA2 | Esophagus | 0.6 | 1 | 0.4286 | CXCL9 AND NOT-TMPRSS11E | B-Cell Diffuse | 0.7429 | 0.7879 | 0.7027 |
| SLCO1B3 AND NOT-AFP | Esophagus | 0.6 | 1 | 0.4286 | CD80 AND NOT-GJA3 | B-Cell Diffuse | 0.7429 | 0.7879 | 0.7027 |
| CBX3 AND NOT-ATP8B2 | Esophagus | 0.6957 | 0.8889 | 0.5714 | KCNJ10 AND NOT-PCDH19 | B-Cell Diffuse | 0.7407 | 0.6818 | 0.8108 |
| MUC17 AND NOT-ENPP3 | Esophagus | 0.6667 | 1 | 0.5 | KCNJ10 AND NOT-NEO1 | B-Cell Diffuse | 0.7397 | 0.75 | 0.7297 |
| EPHB2 AND NOT-BEST2 | Esophagus | 0.64 | 0.7273 | 0.5714 | TNFRSF9 AND NOT-PCDH11Y | B-Cell Diffuse | 0.7419 | 0.92 | 0.6216 |
| EPHB2 AND NOT-SLC22A5 | Esophagus | 0.625 | 0.5556 | 0.7143 | KCNJ10 AND NOT-BACE1 | B-Cell Diffuse | 0.7353 | 0.8065 | 0.6757 |
| CXCL16 AND NOT-CD33 | Esophagus | 0.64 | 0.7273 | 0.5714 | CXCL9 AND NOT-SLC39A2 | B-Cell Diffuse | 0.7324 | 0.7647 | 0.7027 |
| MUC17 AND NOT-CD160 | Esophagus | 0.7826 | 1 | 0.6429 | CXCL9 AND NOT-CLDN10 | B-Cell Diffuse | 0.7324 | 0.7647 | 0.7027 |
| LYPD1 AND NOT-TPBG | Glioblastoma | 0.6842 | 0.619 | 0.7647 | CXCL9 AND NOT-DSC1 | B-Cell Diffuse | 0.7324 | 0.7647 | 0.7027 |
| LYPD1 AND NOT-FOLH1 | Glioblastoma | 0.6667 | 0.6316 | 0.7059 | CXCL9 AND NOT-AMHR2 | B-Cell Diffuse | 0.7324 | 0.7647 | 0.7027 |
| LYPD1 AND NOT-EPCAM | Glioblastoma | 0.6667 | 0.7692 | 0.5882 | CXCL9 AND NOT-GHR | B-Cell Diffuse | 0.7273 | 0.8276 | 0.6486 |
| LYPD1 AND NOT-STEAP2 | Glioblastoma | 0.6667 | 0.5909 | 0.7647 | CXCL9 AND NOT-STEAP4 | B-Cell Diffuse | 0.7273 | 0.8276 | 0.6486 |
| LYPD1 AND NOT-CLDN11 | Glioblastoma | 0.6667 | 0.56 | 0.8235 | CD80 AND NOT-KCNC2 | B-Cell Diffuse | 0.7246 | 0.7813 | 0.6757 |
| LYPD1 AND NOT-RNF43 | Glioblastoma | 0.6667 | 0.56 | 0.8235 | KCNJ10 AND NOT-TSPAN7 | B-Cell Diffuse | 0.7246 | 0.7813 | 0.6757 |
| LYPD1 AND NOT-IL20RA | Glioblastoma | 0.6667 | 0.56 | 0.8235 | CXCL9 AND NOT-C8B | B-Cell Diffuse | 0.7246 | 0.7813 | 0.6757 |
| LYPD1 AND NOT-TRPM4 | Glioblastoma | 0.6667 | 0.56 | 0.8235 | CXCL9 AND NOT-GPR37L1 | B-Cell Diffuse | 0.7222 | 0.7429 | 0.7027 |
| LYPD1 AND NOT-CD22 | Glioblastoma | 0.6667 | 0.56 | 0.8235 | CXCL9 AND NOT-EPHA8 | B-Cell Diffuse | 0.7222 | 0.7429 | 0.7027 |
| LYPD1 AND NOT-P2RX5 | Glioblastoma | 0.6061 | 0.625 | 0.5882 | CXCL9 AND NOT-CACNA1S | B-Cell Diffuse | 0.7222 | 0.7429 | 0.7027 |
| LYPD1 AND NOT-ERBB3 | Glioblastoma | 0.6667 | 0.7692 | 0.5882 | CXCL9 AND NOT-NMUR2 | B-Cell Diffuse | 0.7222 | 0.7429 | 0.7027 |
| SYT11 AND NOT-EPCAM | Glioma | 0.9714 | 0.9577 | 0.9855 | CXCL9 AND NOT-VN1R2 | B-Cell Diffuse | 0.7222 | 0.7429 | 0.7027 |
| SYT11 AND NOT-P2RX5 | Glioma | 0.9571 | 0.9437 | 0.971 | CXCL9 AND NOT-GPR26 | B-Cell Diffuse | 0.7222 | 0.7429 | 0.7027 |
| SYT11 AND NOT-B4GALNT1 | Glioma | 0.9496 | 0.9429 | 0.9565 | CXCL9 AND NOT-GABRA2 | B-Cell Diffuse | 0.7222 | 0.7429 | 0.7027 |
| SYT11 AND NOT-CLDN6 | Glioma | 0.964 | 0.9571 | 0.971 | CXCL9 AND NOT-KCNF1 | B-Cell Diffuse | 0.7222 | 0.7429 | 0.7027 |
| SYT11 AND NOT-STEAP2 | Glioma | 0.9645 | 0.9444 | 0.9855 | CXCL9 AND NOT-CASR | B-Cell Diffuse | 0.7222 | 0.7429 | 0.7027 |
| SYT11 AND NOT-CD22 | Glioma | 0.964 | 0.9571 | 0.971 | CXCL9 AND NOT-SLC10A1 | B-Cell Diffuse | 0.7222 | 0.7429 | 0.7027 |
| SYT11 AND NOT-CLDN11 | Glioma | 0.9496 | 0.9429 | 0.9565 | CXCL9 AND NOT-MLANA | B-Cell Diffuse | 0.7222 | 0.7429 | 0.7027 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| SYT11 AND NOT-CLDN7 | Glioma | 0.964 | 0.9571 | 0.971 | CXCL9 AND NOT-KIRREL3 | B-Cell Diffuse | 0.7222 | 0.7429 | 0.7027 |
| SYT11 AND NOT-FOLH1 | Glioma | 0.9496 | 0.9429 | 0.9565 | CXCL9 AND NOT-CD207 | B-Cell Diffuse | 0.7222 | 0.7429 | 0.7027 |
| SYT11 AND NOT-ITGB3 | Glioma | 0.9481 | 0.9697 | 0.9275 | CXCL9 AND NOT-ADAM29 | B-Cell Diffuse | 0.7222 | 0.7429 | 0.7027 |
| LYPD1 AND NOT-EPCAM | Glioma | 0.9048 | 1 | 0.8261 | CD80 AND NOT-CACNG1 | B-Cell Diffuse | 0.7222 | 0.7429 | 0.7027 |
| ITGAV AND NOT-ATP8B1 | Glioma | 0.9197 | 0.9265 | 0.913 | CXCL9 AND NOT-HTR6 | B-Cell Diffuse | 0.7222 | 0.7429 | 0.7027 |
| ITGAV AND NOT-SLC16A5 | Glioma | 0.9343 | 0.9412 | 0.9275 | CXCL9 AND NOT-CABP7 | B-Cell Diffuse | 0.7222 | 0.7429 | 0.7027 |
| ITGAV AND NOT-STEAP4 | Glioma | 0.9323 | 0.9688 | 0.8986 | CXCL9 AND NOT-ANPEP | B-Cell Diffuse | 0.7213 | 0.9167 | 0.5946 |
| SYT11 AND NOT-ULBP2 | Glioma | 0.8504 | 0.931 | 0.7826 | MCOLN2 AND NOT-NOX1 | B-Cell Diffuse | 0.72 | 0.7105 | 0.7297 |
| SLC39A6 AND NOT-ATP8B1 | Glioma | 0.8462 | 0.9016 | 0.7971 | CXCL9 AND NOT-STAB1 | B-Cell Diffuse | 0.7188 | 0.8519 | 0.6216 |
| ATP8B2 AND NOT-CD79B | Leiomyosarcoma | 0.8333 | 0.9091 | 0.7692 | CXCL9 AND NOT-SLC6A12 | B-Cell Diffuse | 0.7164 | 0.8 | 0.6486 |
| ATP8B2 AND NOT-TNFRSF10A | Leiomyosarcoma | 0.7826 | 0.9 | 0.6923 | CD80 AND NOT-FXYD7 | B-Cell Diffuse | 0.7164 | 0.8 | 0.6486 |
| FAP AND NOT-CLDN10 | Leiomyosarcoma | 0.8182 | 1 | 0.6923 | CXCL9 AND NOT-FAT1 | B-Cell Diffuse | 0.7164 | 0.8 | 0.6486 |
| CD276 AND NOT-SLC16A5 | Leiomyosarcoma | 0.6 | 0.8571 | 0.4615 | KCNJ10 AND NOT-ATP1A2 | B-Cell Diffuse | 0.716 | 0.6591 | 0.7838 |
| FAP AND NOT-SELP | Leiomyosarcoma | 0.7619 | 1 | 0.6154 | CD40 AND NOT-CCR9 | B-Cell Diffuse | 0.7879 | 0.8966 | 0.7027 |
| CD276 AND NOT-SMPD2 | Leiomyosarcoma | 0.6957 | 0.8 | 0.6154 | KCNJ10 AND NOT-GLDN | B-Cell Diffuse | 0.7143 | 0.7576 | 0.6757 |
| FAP AND NOT-PAQR7 | Leiomyosarcoma | 0.6316 | 1 | 0.4615 | CXCL9 AND NOT-LRRC8E | B-Cell Diffuse | 0.7143 | 0.7576 | 0.6757 |
| ATP8B2 AND NOT-CD79A | Leiomyosarcoma | 0.8333 | 0.9091 | 0.7692 | CXCL9 AND NOT-CD1A | B-Cell Diffuse | 0.7143 | 0.7576 | 0.6757 |
| FAP AND NOT-GRIN1 | Leiomyosarcoma | 0.8182 | 1 | 0.6923 | CXCL9 AND NOT-GRIN2B | B-Cell Diffuse | 0.7143 | 0.7576 | 0.6757 |
| SLC22A16 AND NOT-STEAP2 | AML | 0.9231 | 0.9141 | 0.9323 | CD40 AND NOT-LRRN4 | B-Cell Diffuse | 0.7143 | 0.7576 | 0.6757 |
| SLC22A16 AND NOT-MET | AML | 0.9225 | 0.9206 | 0.9243 | CXCL9 AND NOT-SLC17A1 | B-Cell Diffuse | 0.7123 | 0.7222 | 0.7027 |
| SLC22A16 AND NOT-BMPR1B | AML | 0.9191 | 0.9102 | 0.9283 | CXCL9 AND NOT-CYP4A11 | B-Cell Diffuse | 0.7123 | 0.7222 | 0.7027 |
| SLC22A16 AND NOT-ERBB3 | AML | 0.9141 | 0.8966 | 0.9323 | CXCL9 AND NOT-SLC22A25 | B-Cell Diffuse | 0.7123 | 0.7222 | 0.7027 |
| SLC22A16 AND NOT-ERBB2 | AML | 0.9141 | 0.8966 | 0.9323 | CXCL9 AND NOT-SLC6A13 | B-Cell Diffuse | 0.7123 | 0.7222 | 0.7027 |
| SLC22A16 AND NOT-GPNMB | AML | 0.9136 | 0.9447 | 0.8845 | CXCL9 AND NOT-CLRN1 | B-Cell Diffuse | 0.7123 | 0.7222 | 0.7027 |
| SLC22A16 AND NOT-STEAP1 | AML | 0.913 | 0.9059 | 0.9203 | CXCL9 AND NOT-ATP6V0A4 | B-Cell Diffuse | 0.7123 | 0.7222 | 0.7027 |
| SLC22A16 AND NOT-CLDN23 | AML | 0.9155 | 0.9031 | 0.9283 | CXCL9 AND NOT-ATP2B2 | B-Cell Diffuse | 0.7123 | 0.7222 | 0.7027 |
| SLC22A16 AND NOT-CLDN12 | AML | 0.9128 | 0.9298 | 0.8964 | CXCL9 AND NOT-KCNH4 | B-Cell Diffuse | 0.7123 | 0.7222 | 0.7027 |
| SLC22A16 AND NOT-CLDN1 | AML | 0.9105 | 0.8897 | 0.9323 | CXCL9 AND NOT-SLC1A6 | B-Cell Diffuse | 0.7123 | 0.7222 | 0.7027 |
| SLC22A16 AND NOT-RNF43 | AML | 0.9105 | 0.8897 | 0.9323 | CD80 AND NOT-SLC6A13 | B-Cell Diffuse | 0.7123 | 0.7222 | 0.7027 |
| SLC22A16 AND NOT-ERBB4 | AML | 0.9231 | 0.9141 | 0.9323 | CXCL9 AND NOT-SLC13A5 | B-Cell Diffuse | 0.7123 | 0.7222 | 0.7027 |
| SLC22A16 AND NOT-SLC34A2 | AML | 0.9066 | 0.8859 | 0.9283 | CD80 AND NOT-HTR6 | B-Cell Diffuse | 0.7123 | 0.7222 | 0.7027 |
| SLC22A16 AND NOT-ITGAV | AML | 0.9057 | 0.9325 | 0.8805 | CXCL9 AND NOT-IGDCC3 | B-Cell Diffuse | 0.7123 | 0.7222 | 0.7027 |
| CD37 AND NOT-PHLDB2 | AML | 0.9049 | 0.8826 | 0.9283 | CXCL9 AND NOT-SLC22A8 | B-Cell Diffuse | 0.7123 | 0.7222 | 0.7027 |
| SLC22A16 AND NOT-ENPP3 | AML | 0.9035 | 0.8764 | 0.9323 | CXCL9 AND NOT-DIO1 | B-Cell Diffuse | 0.7123 | 0.7222 | 0.7027 |
| SLC22A16 AND NOT-MUC16 | AML | 0.9035 | 0.8764 | 0.9323 | CXCL9 AND NOT-OR1C1 | B-Cell Diffuse | 0.7123 | 0.7222 | 0.7027 |
| SLC22A16 AND NOT-IL20RA | AML | 0.9017 | 0.8731 | 0.9323 | CXCL9 AND NOT-NOX1 | B-Cell Diffuse | 0.7123 | 0.7222 | 0.7027 |
| SLC22A16 AND NOT-VTCN1 | AML | 0.9017 | 0.8731 | 0.9323 | CXCL9 AND NOT-CSMD3 | B-Cell Diffuse | 0.7123 | 0.7222 | 0.7027 |
| SLC22A16 AND NOT-CLDN8 | AML | 0.9 | 0.8699 | 0.9323 | CXCL9 AND NOT-DRD5 | B-Cell Diffuse | 0.7123 | 0.7222 | 0.7027 |
| SLC22A16 AND NOT-SDC1 | AML | 0.9 | 0.8699 | 0.9323 | CXCL9 AND NOT-MSMO1 | B-Cell Diffuse | 0.7123 | 0.7222 | 0.7027 |
| SLC22A16 AND NOT-MUC13 | AML | 0.9052 | 0.8797 | 0.9323 | CXCL9 AND NOT-BEST2 | B-Cell Diffuse | 0.7123 | 0.7222 | 0.7027 |
| SLC22A16 AND NOT-AXL | AML | 0.9256 | 0.935 | 0.9163 | CXCL9 AND NOT-PIRT | B-Cell Diffuse | 0.7123 | 0.7222 | 0.7027 |
| SLC22A16 AND NOT-FOLH1 | AML | 0.8971 | 0.875 | 0.9203 | CXCL9 AND NOT-ABCG4 | B-Cell Diffuse | 0.7123 | 0.7222 | 0.7027 |
| SLC22A16 AND NOT-FOLR1 | AML | 0.8966 | 0.8635 | 0.9323 | CXCL9 AND NOT-SLCO1B3 | Anaplastic Lymphoma | 0.6207 | 0.6429 | 0.6 |
| SLC22A16 AND NOT-MUC4 | AML | 0.8966 | 0.8635 | 0.9323 | CXCL9 AND NOT-MMP24 | Anaplastic Lymphoma | 0.6207 | 0.6429 | 0.6 |
| SLC22A16 AND NOT-CLDN7 | AML | 0.8966 | 0.8635 | 0.9323 | CXCL9 AND NOT-EPHA8 | Anaplastic Lymphoma | 0.6 | 0.6 | 0.6 |
| SLC22A16 AND NOT-EPCAM | AML | 0.8923 | 0.8625 | 0.9243 | CXCL9 AND NOT-MRAP | Anaplastic Lymphoma | 0.6923 | 0.8182 | 0.6 |
| CD37 AND NOT-BTN3A3 | AML | 0.8919 | 0.8652 | 0.9203 | CXCL9 AND NOT-DISP2 | Anaplastic Lymphoma | 0.6207 | 0.6429 | 0.6 |
| CD37 AND NOT-BTN3A1 | AML | 0.8835 | 0.8363 | 0.9363 | CXCL9 AND NOT-GABRB2 | Anaplastic Lymphoma | 0.6429 | 0.6923 | 0.6 |
| SLC22A16 AND NOT-MUC1 | AML | 0.8811 | 0.8626 | 0.9004 | CXCL9 AND NOT-ERVW-1 | Anaplastic Lymphoma | 0.6 | 0.6 | 0.6 |
| CD37 AND NOT-S1PR1 | AML | 0.8672 | 0.8506 | 0.8845 | CXCL9 AND NOT-MEGF11 | Anaplastic Lymphoma | 0.6207 | 0.6429 | 0.6 |
| CD37 AND NOT-LAT | AML | 0.8582 | 0.7979 | 0.9283 | CXCL9 AND NOT-KCNJ6 | Anaplastic Lymphoma | 0.6 | 0.6 | 0.6 |
| CD37 AND NOT-GPR137B | AML | 0.8537 | 0.8714 | 0.8367 | CXCL9 AND NOT-ATP7A | Anaplastic Lymphoma | 0.6 | 0.6 | 0.6 |
| SLC22A16 AND NOT-TPBG | AML | 0.8525 | 0.8776 | 0.8287 | CXCL9 AND NOT-CHRNG | Anaplastic Lymphoma | 0.6207 | 0.6429 | 0.6 |
| CD37 AND NOT-STEAP4 | AML | 0.8514 | 0.7891 | 0.9243 | LAG3 AND NOT-GABRB2 | Anaplastic Lymphoma | 0.6061 | 0.5556 | 0.6667 |
| CD37 AND NOT-IFNAR2 | AML | 0.8417 | 0.8165 | 0.8685 | CXCL9 AND NOT-CSMD3 | Anaplastic Lymphoma | 0.6429 | 0.6923 | 0.6 |
| CD37 AND NOT-TGFBI | AML | 0.835 | 0.8144 | 0.8566 | CXCL9 AND NOT-DCSTAMP | Anaplastic Lymphoma | 0.6429 | 0.6923 | 0.6 |
| CD37 AND NOT-SEMA4D | AML | 0.8269 | 0.7429 | 0.9323 | CLECL1 AND NOT-CHRNG | Mantle-Cell Lymphoma | 0.9444 | 1 | 0.8947 |
| FMNL1 AND NOT-FCRL5 | AML | 0.8209 | 0.7719 | 0.8765 | CLECL1 AND NOT-MPL | Mantle-Cell Lymphoma | 0.962 | 0.9268 | 1 |
| FMNL1 AND NOT-MS4A1 | AML | 0.8349 | 0.7971 | 0.8765 | CLECL1 AND NOT-TSPAN16 | Mantle-Cell Lymphoma | 0.9474 | 0.9474 | 0.9474 |
| SLC22A16 AND NOT-PROM1 | AML | 0.8148 | 0.8426 | 0.7888 | CLECL1 AND NOT-CD36 | Mantle-Cell Lymphoma | 0.961 | 0.9487 | 0.9737 |
| FMNL1 AND NOT-SLAMF7 | AML | 0.8103 | 0.7534 | 0.8765 | CLECL1 AND NOT-PAQR7 | Mantle-Cell Lymphoma | 0.9351 | 0.9231 | 0.9474 |
| FMNL1 AND NOT-TNFRSF17 | AML | 0.8081 | 0.7526 | 0.8725 | CLECL1 AND NOT-MLC1 | Mantle-Cell Lymphoma | 0.9315 | 0.9714 | 0.8947 |
| FMNL1 AND NOT-FCRL1 | AML | 0.8073 | 0.7483 | 0.8765 | CLECL1 AND NOT-TAS1R1 | Mantle-Cell Lymphoma | 0.9474 | 0.9474 | 0.9474 |
| FMNL1 AND NOT-CD22 | AML | 0.8102 | 0.7475 | 0.8845 | CLECL1 AND NOT-ANPEP | Mantle-Cell Lymphoma | 0.9737 | 0.9737 | 0.9737 |
| FMNL1 AND NOT-CR2 | AML | 0.8147 | 0.7551 | 0.8845 | CLECL1 AND NOT-ACSL6 | Mantle-Cell Lymphoma | 0.987 | 0.9744 | 1 |
| CD37 AND NOT-PIK3IP1 | AML | 0.8056 | 0.8024 | 0.8088 | CLECL1 AND NOT-SLC9B1 | Mantle-Cell Lymphoma | 0.9383 | 0.8837 | 1 |
| FMNL1 AND NOT-CD72 | AML | 0.7971 | 0.7309 | 0.8765 | CLECL1 AND NOT-SLC6A6 | Mantle-Cell Lymphoma | 0.9315 | 0.9714 | 0.8947 |
| P2RX4 AND NOT-CLDN23 | AML | 0.7893 | 0.6801 | 0.9402 | CLECL1 AND NOT-STEAP4 | Mantle-Cell Lymphoma | 0.9744 | 0.95 | 1 |
| CD44 AND NOT-IL11RA | AML | 0.7821 | 0.7343 | 0.8367 | CLECL1 AND NOT-MUC17 | Mantle-Cell Lymphoma | 0.9383 | 0.8837 | 1 |
| FMNL1 AND NOT-CD79A | AML | 0.7807 | 0.7065 | 0.8725 | CLECL1 AND NOT-KCNK6 | Mantle-Cell Lymphoma | 0.9744 | 0.95 | 1 |
| EMP3 AND NOT-IL11RA | AML | 0.7797 | 0.7393 | 0.8247 | CLECL1 AND NOT-CD93 | Mantle-Cell Lymphoma | 0.9744 | 0.95 | 1 |
| FMNL1 AND NOT-IL11RA | AML | 0.7794 | 0.7235 | 0.8446 | CLECL1 AND NOT-CD163 | Mantle-Cell Lymphoma | 0.9744 | 0.95 | 1 |
| FMNL1 AND NOT-CD19 | AML | 0.8152 | 0.781 | 0.8526 | CLECL1 AND NOT-GALR2 | Mantle-Cell Lymphoma | 0.9048 | 0.8261 | 1 |
| CD37 AND NOT-MSMO1 | AML | 0.7678 | 0.7244 | 0.8167 | CLECL1 AND NOT-PTGER4 | Mantle-Cell Lymphoma | 0.9048 | 0.8261 | 1 |
| FMNL1 AND NOT-CD79B | AML | 0.7674 | 0.7472 | 0.7888 | CLECL1 AND NOT-CHRNB4 | Mantle-Cell Lymphoma | 0.9091 | 0.8974 | 0.9211 |
| CD276 AND NOT-CD1A | Liposarcoma | 0.6914 | 0.6222 | 0.7778 | CLECL1 AND NOT-VANGL1 | Mantle-Cell Lymphoma | 0.9048 | 0.8261 | 1 |
| CD276 AND NOT-SEMA4B | Liposarcoma | 0.6667 | 0.8333 | 0.5556 | CLECL1 AND NOT-GUCY2F | Mantle-Cell Lymphoma | 0.9024 | 0.8409 | 0.9737 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| ROR1 AND NOT-ALCAM | Liposarcoma | 0.6429 | 0.9 | 0.5 | CLECL1 AND NOT-MMP24 | Mantle-Cell Lymphoma | 0.8941 | 0.8085 | 1 |
| ROR1 AND NOT-SLC10A1 | Liposarcoma | 0.6316 | 0.8571 | 0.5 | IL10RA AND NOT-ANPEP | Mantle-Cell Lymphoma | 0.9048 | 0.8261 | 1 |
| ROR1 AND NOT-ADAM29 | Liposarcoma | 0.6316 | 0.8571 | 0.5 | IL10RA AND NOT-CD36 | Mantle-Cell Lymphoma | 0.9136 | 0.8605 | 0.9737 |
| ROR1 AND NOT-NFASC | Liposarcoma | 0.6316 | 0.8571 | 0.5 | CLECL1 AND NOT-SLC12A9 | Mantle-Cell Lymphoma | 0.8889 | 0.9412 | 0.8421 |
| ROR1 AND NOT-SCN10A | Liposarcoma | 0.6316 | 0.8571 | 0.5 | CLECL1 AND NOT-DRD5 | Mantle-Cell Lymphoma | 0.8889 | 0.9412 | 0.8421 |
| ROR1 AND NOT-SLC38A1 | Liposarcoma | 0.6207 | 0.8182 | 0.5 | CLECL1 AND NOT-SLC16A5 | Mantle-Cell Lymphoma | 0.8861 | 0.8537 | 0.9211 |
| ROR1 AND NOT-SORL1 | Liposarcoma | 0.6207 | 0.8182 | 0.5 | CLECL1 AND NOT-DYSF | Mantle-Cell Lymphoma | 0.95 | 0.9048 | 1 |
| ROR1 AND NOT-SLC2A1 | Liposarcoma | 0.6207 | 0.8182 | 0.5 | CLECL1 AND NOT-CXCL16 | Mantle-Cell Lymphoma | 0.8857 | 0.9688 | 0.8158 |
| CD276 AND NOT-SLC1A6 | Liposarcoma | 0.6176 | 0.6563 | 0.5833 | CLECL1 AND NOT-LAMP5 | Mantle-Cell Lymphoma | 0.9091 | 0.8974 | 0.9211 |
| EPHB2 AND NOT-SLC30A10 | Liposarcoma | 0.8108 | 0.7895 | 0.8333 | CLECL1 AND NOT-CALHM3 | Mantle-Cell Lymphoma | 0.881 | 0.8043 | 0.9737 |
| ROR1 AND NOT-PIK3IP1 | Liposarcoma | 0.6102 | 0.7826 | 0.5 | CLECL1 AND NOT-CNTNAP2 | Mantle-Cell Lymphoma | 0.88 | 0.8919 | 0.8684 |
| ROR1 AND NOT-ANO4 | Liposarcoma | 0.6102 | 0.7826 | 0.5 | QSOX2 AND NOT-KCNC2 | Mantle-Cell Lymphoma | 0.8889 | 0.8372 | 0.9474 |
| ROR1 AND NOT-EFNB2 | Liposarcoma | 0.6102 | 0.7826 | 0.5 | QSOX2 AND NOT-SLC5A11 | Mantle-Cell Lymphoma | 0.8831 | 0.8718 | 0.8947 |
| ROR1 AND NOT-SLC16A5 | Liposarcoma | 0.6071 | 0.85 | 0.4722 | IL10RA AND NOT-CD93 | Mantle-Cell Lymphoma | 0.8941 | 0.8085 | 1 |
| ROR1 AND NOT-CD1B | Liposarcoma | 0.6071 | 0.85 | 0.4722 | IL10RA AND NOT-CD163 | Mantle-Cell Lymphoma | 0.9383 | 0.8837 | 1 |
| EPHB2 AND NOT-SLC22A18 | Liposarcoma | 0.6429 | 0.5625 | 0.75 | QSOX2 AND NOT-MEGF11 | Mantle-Cell Lymphoma | 0.9024 | 0.8409 | 0.9737 |
| STAB1 AND NOT-EPCAM | Liposarcoma | 0.6757 | 0.6579 | 0.6944 | QSOX2 AND NOT-CHRNG | Mantle-Cell Lymphoma | 0.9333 | 0.9459 | 0.9211 |
| CD276 AND NOT-MSMO1 | Liposarcoma | 0.75 | 0.6346 | 0.9167 | QSOX2 AND NOT-GPR78 | Mantle-Cell Lymphoma | 0.9 | 0.8571 | 0.9474 |
| STAB1 AND NOT-CLDN1 | Liposarcoma | 0.6133 | 0.5897 | 0.6389 | CLECL1 AND NOT-SLC4A8 | Mantle-Cell Lymphoma | 0.8837 | 0.7917 | 1 |
| STAB1 AND NOT-SSTR2 | Liposarcoma | 0.6557 | 0.8 | 0.5556 | KCNN4 AND NOT-ANPEP | Mantle-Cell Lymphoma | 0.9114 | 0.878 | 0.9474 |
| CD276 AND NOT-SLC22A18 | Liposarcoma | 0.6567 | 0.7097 | 0.6111 | CLECL1 AND NOT-THBD | Mantle-Cell Lymphoma | 0.9383 | 0.8837 | 1 |
| CD276 AND NOT-DSC1 | Liposarcoma | 0.7105 | 0.675 | 0.75 | CELSR1 AND NOT-LRRC8E | Mantle-Cell Lymphoma | 0.9231 | 0.9 | 0.9474 |
| CD276 AND NOT-CD207 | Liposarcoma | 0.6197 | 0.6286 | 0.6111 | CLECL1 AND NOT-ABHD3 | Mantle-Cell Lymphoma | 0.9157 | 0.8444 | 1 |
| SLC34A2 AND NOT-SLC16A5 | Lung Adenocarcinoma | 0.6716 | 0.7031 | 0.6429 | KCNN4 AND NOT-SLC31A1 | Mantle-Cell Lymphoma | 0.925 | 0.881 | 0.9737 |
| SLC34A2 AND NOT-CATSPERD | Lung Adenocarcinoma | 0.6483 | 0.6267 | 0.6714 | QSOX2 AND NOT-SLC39A2 | Mantle-Cell Lymphoma | 0.8889 | 0.8372 | 0.9474 |
| SLC34A2 AND NOT-LPPR3 | Lung Adenocarcinoma | 0.6456 | 0.5795 | 0.7286 | QSOX2 AND NOT-GABRD | Mantle-Cell Lymphoma | 0.8889 | 0.8372 | 0.9474 |
| SLC34A2 AND NOT-GRM7 | Lung Adenocarcinoma | 0.6456 | 0.5795 | 0.7286 | QSOX2 AND NOT-SCN8A | Mantle-Cell Lymphoma | 0.8947 | 0.8947 | 0.8947 |
| SLC34A2 AND NOT-CNGA4 | Lung Adenocarcinoma | 0.6323 | 0.5765 | 0.7 | QSOX2 AND NOT-ZACN | Mantle-Cell Lymphoma | 0.9189 | 0.9444 | 0.8947 |
| SLC34A2 AND NOT-CNIH2 | Lung Adenocarcinoma | 0.6115 | 0.5517 | 0.6857 | QSOX2 AND NOT-OR3A2 | Mantle-Cell Lymphoma | 0.875 | 0.8333 | 0.9211 |
| SLC34A2 AND NOT-NFASC | Lung Adenocarcinoma | 0.6071 | 0.8095 | 0.4857 | QSOX2 AND NOT-CRB2 | Mantle-Cell Lymphoma | 0.8889 | 0.8372 | 0.9474 |
| SLC34A2 AND NOT-CRB1 | Lung Adenocarcinoma | 0.6323 | 0.5765 | 0.7 | QSOX2 AND NOT-ANPEP | Mantle-Cell Lymphoma | 0.961 | 0.9487 | 0.9737 |
| SLC34A2 AND NOT-GALR1 | Lung Adenocarcinoma | 0.6111 | 0.5946 | 0.6286 | QSOX2 AND NOT-KCNK4 | Mantle-Cell Lymphoma | 0.9024 | 0.8409 | 0.9737 |
| SLC34A2 AND NOT-MSMO1 | Lung Adenocarcinoma | 0.6438 | 0.6184 | 0.6714 | QSOX2 AND NOT-ATP6V0A4 | Mantle-Cell Lymphoma | 0.8889 | 0.8372 | 0.9474 |
| MAGEA11 AND NOT-ENPP1 | Lung Carcinoma | 0.6316 | 0.9677 | 0.4688 | QSOX2 AND NOT-CALY | Mantle-Cell Lymphoma | 0.8974 | 0.875 | 0.9211 |
| MAGEA11 AND NOT-SLC16A5 | Lung Carcinoma | 0.6237 | 1 | 0.4531 | QSOX2 AND NOT-DRD5 | Mantle-Cell Lymphoma | 0.8857 | 0.9688 | 0.8158 |
| MAGEA11 AND NOT-SLC22A5 | Lung Carcinoma | 0.6383 | 1 | 0.4688 | CLECL1 AND NOT-GPR78 | Mantle-Cell Lymphoma | 0.8605 | 0.7708 | 0.9737 |
| MAGEA11 AND NOT-PAQR7 | Lung Carcinoma | 0.6383 | 1 | 0.4688 | CLECL1 AND NOT-STAB1 | Mantle-Cell Lymphoma | 0.8837 | 0.7917 | 1 |
| MAGEA11 AND NOT-ESAM | Lung Carcinoma | 0.6237 | 1 | 0.4531 | QSOX2 AND NOT-SLC28A1 | Mantle-Cell Lymphoma | 0.9024 | 0.8409 | 0.9737 |
| MAGEA11 AND NOT-SLC23A2 | Lung Carcinoma | 0.617 | 0.9667 | 0.4531 | QSOX2 AND NOT-SLC5A8 | Mantle-Cell Lymphoma | 0.875 | 0.8333 | 0.9211 |
| MAGEA11 AND NOT-SLC22A11 | Lung Carcinoma | 0.6122 | 0.8824 | 0.4688 | QSOX2 AND NOT-MRGPRX2 | Mantle-Cell Lymphoma | 0.8608 | 0.8293 | 0.8947 |
| MAGEA11 AND NOT-MRAP | Lung Carcinoma | 0.6237 | 1 | 0.4531 | QSOX2 AND NOT-LPPR3 | Mantle-Cell Lymphoma | 0.8889 | 0.8372 | 0.9474 |
| MAGEA11 AND NOT-AQP6 | Lung Carcinoma | 0.625 | 0.9375 | 0.4688 | QSOX2 AND NOT-TSPAN16 | Mantle-Cell Lymphoma | 0.9333 | 0.9459 | 0.9211 |
| KCNJ10 AND NOT-BMPR1B | B-Cell Diffuse | 0.8 | 0.7895 | 0.8108 | QSOX2 AND NOT-SYT6 | Mantle-Cell Lymphoma | 0.8889 | 0.8372 | 0.9474 |
| KCNJ10 AND NOT-NCAM1 | B-Cell Diffuse | 0.7368 | 0.7179 | 0.7568 | QSOX2 AND NOT-GABRA4 | Mantle-Cell Lymphoma | 0.9024 | 0.8409 | 0.9737 |
| KCNJ10 AND NOT-CLDN11 | B-Cell Diffuse | 0.7273 | 0.7 | 0.7568 | CLECL1 AND NOT-TGFBI | Mantle-Cell Lymphoma | 0.8889 | 0.9412 | 0.8421 |
| KCNJ10 AND NOT-FOLH1 | B-Cell Diffuse | 0.7123 | 0.7222 | 0.7027 | QSOX2 AND NOT-SLC22A6 | Mantle-Cell Lymphoma | 0.8889 | 0.8372 | 0.9474 |
| CD180 AND NOT-CD36 | B-Cell Diffuse | 0.6875 | 0.8148 | 0.5946 | QSOX2 AND NOT-CLCN1 | Mantle-Cell Lymphoma | 0.875 | 0.8333 | 0.9211 |
| CD79B AND NOT-ACSL6 | B-Cell Diffuse | 0.6857 | 0.7273 | 0.6486 | QSOX2 AND NOT-GALR2 | Mantle-Cell Lymphoma | 0.9367 | 0.9024 | 0.9737 |
| CD79B AND NOT-SLC30A1 | B-Cell Diffuse | 0.6849 | 0.6944 | 0.6757 | QSOX2 AND NOT-SEZ6 | Mantle-Cell Lymphoma | 0.9024 | 0.8409 | 0.9737 |
| CD79B AND NOT-DRD5 | B-Cell Diffuse | 0.6667 | 0.7188 | 0.6216 | QSOX2 AND NOT-MAG | Mantle-Cell Lymphoma | 0.9024 | 0.8409 | 0.9737 |
| CD180 AND NOT-ACSL6 | B-Cell Diffuse | 0.6667 | 0.6341 | 0.7027 | QSOX2 AND NOT-OR52D1 | Mantle-Cell Lymphoma | 0.875 | 0.8333 | 0.9211 |
| KCNJ10 AND NOT-ERBB4 | B-Cell Diffuse | 0.6667 | 0.6857 | 0.6486 | QSOX2 AND NOT-CD207 | Mantle-Cell Lymphoma | 0.9024 | 0.8409 | 0.9737 |
| CD79B AND NOT-ATP8B2 | B-Cell Diffuse | 0.6667 | 0.6857 | 0.6486 | QSOX2 AND NOT-SLC6A6 | Mantle-Cell Lymphoma | 0.9189 | 0.9444 | 0.8947 |
| FCRL5 AND NOT-PPAPDC1B | B-Cell Diffuse | 0.6667 | 0.7188 | 0.6216 | QSOX2 AND NOT-MMP24 | Mantle-Cell Lymphoma | 0.9367 | 0.9024 | 0.9737 |
| CD79B AND NOT-CD93 | B-Cell Diffuse | 0.6667 | 0.6579 | 0.6757 | QSOX2 AND NOT-SLC6A11 | Mantle-Cell Lymphoma | 0.8608 | 0.8293 | 0.8947 |
| CD180 AND NOT-MLC1 | B-Cell Diffuse | 0.6579 | 0.641 | 0.6757 | QSOX2 AND NOT-BEST2 | Mantle-Cell Lymphoma | 0.8889 | 0.8372 | 0.9474 |
| CD72 AND NOT-ACSL6 | B-Cell Diffuse | 0.6571 | 0.697 | 0.6216 | QSOX2 AND NOT-GUCY2D | Mantle-Cell Lymphoma | 0.9 | 0.8571 | 0.9474 |
| CD72 AND NOT-MLC1 | B-Cell Diffuse | 0.6571 | 0.697 | 0.6216 | QSOX2 AND NOT-PVRL1 | Mantle-Cell Lymphoma | 0.9024 | 0.8409 | 0.9737 |
| CD79B AND NOT-CD36 | B-Cell Diffuse | 0.6567 | 0.7333 | 0.5946 | CLECL1 AND NOT-FMNL1 | Mantle-Cell Lymphoma | 0.8837 | 0.7917 | 1 |
| CD72 AND NOT-CD36 | B-Cell Diffuse | 0.6479 | 0.6765 | 0.6216 | CLECL1 AND NOT-ATP8B2 | Mantle-Cell Lymphoma | 0.9157 | 0.8444 | 1 |
| P2RX5 AND NOT-ATP8B2 | B-Cell Diffuse | 0.6506 | 0.587 | 0.7297 | CLECL1 AND NOT-TTYH2 | Mantle-Cell Lymphoma | 0.9268 | 0.8636 | 1 |
| P2RX5 AND NOT-CD93 | B-Cell Diffuse | 0.642 | 0.5909 | 0.7027 | QSOX2 AND NOT-OPCML | Mantle-Cell Lymphoma | 0.875 | 0.8333 | 0.9211 |
| CD79B AND NOT-LAT | B-Cell Diffuse | 0.6389 | 0.6571 | 0.6216 | QSOX2 AND NOT-MLC1 | Mantle-Cell Lymphoma | 0.9315 | 0.9714 | 0.8947 |
| CD72 AND NOT-ATP8B2 | B-Cell Diffuse | 0.6389 | 0.6571 | 0.6216 | QSOX2 AND NOT-GRM3 | Mantle-Cell Lymphoma | 0.9367 | 0.9024 | 0.9737 |
| CD79A AND NOT-MLC1 | B-Cell Diffuse | 0.6389 | 0.6571 | 0.6216 | QSOX2 AND NOT-CALN1 | Mantle-Cell Lymphoma | 0.875 | 0.8333 | 0.9211 |
| CD72 AND NOT-CD93 | B-Cell Diffuse | 0.6389 | 0.6571 | 0.6216 | QSOX2 AND NOT-TSHR | Mantle-Cell Lymphoma | 0.9024 | 0.8409 | 0.9737 |
| CD180 AND NOT-CD93 | B-Cell Diffuse | 0.6389 | 0.6571 | 0.6216 | QSOX2 AND NOT-SLC1A6 | Mantle-Cell Lymphoma | 0.8608 | 0.8293 | 0.8947 |
| FCRL5 AND NOT-ATP8B2 | B-Cell Diffuse | 0.6849 | 0.6944 | 0.6757 | QSOX2 AND NOT-GJB4 | Mantle-Cell Lymphoma | 0.8889 | 0.8372 | 0.9474 |
| P2RX5 AND NOT-ACSL6 | B-Cell Diffuse | 0.6582 | 0.619 | 0.7027 | QSOX2 AND NOT-CLDN16 | Mantle-Cell Lymphoma | 0.9024 | 0.8409 | 0.9737 |
| P2RX5 AND NOT-CD36 | B-Cell Diffuse | 0.641 | 0.6098 | 0.6757 | CLECL1 AND NOT-GRM3 | Mantle-Cell Lymphoma | 0.8539 | 0.7451 | 1 |
| CD79A AND NOT-ACSL6 | B-Cell Diffuse | 0.6364 | 0.7241 | 0.5676 | CLECL1 AND NOT-GGTLC1 | Mantle-Cell Lymphoma | 0.8533 | 0.8649 | 0.8421 |
| CD79B AND NOT-BTN3A1 | B-Cell Diffuse | 0.6364 | 0.7241 | 0.5676 | CLECL1 AND NOT-SLC39A8 | Mantle-Cell Lymphoma | 0.8837 | 0.7917 | 1 |
| FCRL5 AND NOT-S1PR1 | B-Cell Diffuse | 0.6377 | 0.6875 | 0.5946 | CXCL9 AND NOT-SLC30A1 | T-Cell, Peripheral | 0.7917 | 0.95 | 0.6786 |
| FCRL5 AND NOT-MPL | B-Cell Diffuse | 0.6753 | 0.65 | 0.7027 | CXCL9 AND NOT-ATP8B1 | T-Cell, Peripheral | 0.7586 | 0.7333 | 0.7857 |
| FCRL5 AND NOT-CD93 | B-Cell Diffuse | 0.6842 | 0.6667 | 0.7027 | CXCL9 AND NOT-FAT1 | T-Cell, Peripheral | 0.7458 | 0.7097 | 0.7857 |
| FCRL5 AND NOT-CNTNAP2 | B-Cell Diffuse | 0.6316 | 0.6154 | 0.6486 | CXCL9 AND NOT-SLC22A18 | T-Cell, Peripheral | 0.7458 | 0.7097 | 0.7857 |
| P2RX5 AND NOT-MLC1 | B-Cell Diffuse | 0.6585 | 0.6 | 0.7297 | CXCL9 AND NOT-IFI6 | T-Cell, Peripheral | 0.8 | 0.9091 | 0.7143 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| IL2RA AND NOT-FXYD7 | B-Cell Diffuse | 0.6452 | 0.8 | 0.5405 | CXCL9 AND NOT-SEMA4B | T-Cell, Peripheral | 0.7458 | 0.7097 | 0.7857 |
| FCRL5 AND NOT-MLC1 | B-Cell Diffuse | 0.6757 | 0.6757 | 0.6757 | CXCL9 AND NOT-PVRL1 | T-Cell, Peripheral | 0.7333 | 0.6875 | 0.7857 |
| CD79B AND NOT-MPL | B-Cell Diffuse | 0.6269 | 0.7 | 0.5676 | CXCL9 AND NOT-CXCL16 | T-Cell, Peripheral | 0.75 | 0.9 | 0.6429 |
| CD79B AND NOT-BTN3A3 | B-Cell Diffuse | 0.6269 | 0.7 | 0.5676 | CXCL9 AND NOT-PTGIS | T-Cell, Peripheral | 0.7333 | 0.6875 | 0.7857 |
| CD79A AND NOT-CD36 | B-Cell Diffuse | 0.6269 | 0.7 | 0.5676 | CXCL9 AND NOT-DSC1 | T-Cell, Peripheral | 0.7586 | 0.7333 | 0.7857 |
| CD79B AND NOT-ANPEP | B-Cell Diffuse | 0.6269 | 0.7 | 0.5676 | CXCL9 AND NOT-SLC2A1 | T-Cell, Peripheral | 0.7458 | 0.7097 | 0.7857 |
| CD180 AND NOT-ATP8B2 | B-Cell Diffuse | 0.6269 | 0.7 | 0.5676 | CXCL9 AND NOT-SLC16A5 | T-Cell, Peripheral | 0.7273 | 0.7407 | 0.7143 |
| FCRL5 AND NOT-CCR9 | B-Cell Diffuse | 0.625 | 0.5814 | 0.6757 | CXCL9 AND NOT-ABCG4 | T-Cell, Peripheral | 0.7333 | 0.6875 | 0.7857 |
| FCRL5 AND NOT-DRD5 | B-Cell Diffuse | 0.6486 | 0.6486 | 0.6486 | CXCL9 AND NOT-SMPD2 | T-Cell, Peripheral | 0.7458 | 0.7097 | 0.7857 |
| FCRL5 AND NOT-GPR22 | B-Cell Diffuse | 0.6842 | 0.6667 | 0.7027 | CXCL9 AND NOT-GHR | T-Cell, Peripheral | 0.717 | 0.76 | 0.6786 |
| P2RX5 AND NOT-DGKE | B-Cell Diffuse | 0.6216 | 0.6216 | 0.6216 | CXCL9 AND NOT-THBD | T-Cell, Peripheral | 0.7586 | 0.7333 | 0.7857 |
| CD79A AND NOT-PAQR8 | B-Cell Diffuse | 0.6216 | 0.6216 | 0.6216 | CXCL9 AND NOT-FXYD6 | T-Cell, Peripheral | 0.7458 | 0.7097 | 0.7857 |
| CD180 AND NOT-S1PR1 | B-Cell Diffuse | 0.6197 | 0.6471 | 0.5946 | CXCL9 AND NOT-PHLDB2 | T-Cell, Peripheral | 0.7458 | 0.7097 | 0.7857 |
| CD72 AND NOT-CNTNAP2 | B-Cell Diffuse | 0.6197 | 0.6471 | 0.5946 | CXCL9 AND NOT-CD207 | T-Cell, Peripheral | 0.7143 | 0.7143 | 0.7143 |
| IL2RA AND NOT-SLC6A6 | B-Cell Diffuse | 0.6364 | 0.7241 | 0.5676 | CXCL9 AND NOT-EPHA2 | T-Cell, Peripheral | 0.7143 | 0.7143 | 0.7143 |
| FCRL5 AND NOT-ACSL6 | B-Cell Diffuse | 0.6757 | 0.6757 | 0.6757 | CXCL9 AND NOT-ZACN | T-Cell, Peripheral | 0.7143 | 0.7143 | 0.7143 |
| FCRL5 AND NOT-PAQR7 | B-Cell Diffuse | 0.6575 | 0.6667 | 0.6486 | CXCL9 AND NOT-SCARA5 | T-Cell, Peripheral | 0.7368 | 0.7241 | 0.75 |
| CD72 AND NOT-MPL | B-Cell Diffuse | 0.6176 | 0.6774 | 0.5676 | CXCL9 AND NOT-LRIG3 | T-Cell, Peripheral | 0.7119 | 0.6774 | 0.75 |
| CD79B AND NOT-SLC16A5 | B-Cell Diffuse | 0.6154 | 0.7143 | 0.5405 | CXCL9 AND NOT-PAQR7 | T-Cell, Peripheral | 0.7119 | 0.6774 | 0.75 |
| CD79B AND NOT-ANTXR2 | B-Cell Diffuse | 0.6154 | 0.7143 | 0.5405 | CXCL9 AND NOT-MSMO1 | T-Cell, Peripheral | 0.7119 | 0.6774 | 0.75 |
| FCRL5 AND NOT-ANPEP | B-Cell Diffuse | 0.6154 | 0.5854 | 0.6486 | CXCL9 AND NOT-SLC6A18 | T-Cell, Peripheral | 0.7333 | 0.6875 | 0.7857 |
| P2RX5 AND NOT-PAQR8 | B-Cell Diffuse | 0.6136 | 0.5294 | 0.7297 | CXCL9 AND NOT-SLC22A16 | T-Cell, Peripheral | 0.7857 | 0.7857 | 0.7857 |
| FCRL5 AND NOT-ATP8A2 | B-Cell Diffuse | 0.6133 | 0.6053 | 0.6216 | CXCL9 AND NOT-KCNA7 | T-Cell, Peripheral | 0.7119 | 0.6774 | 0.75 |
| GPNMB AND NOT-MRGPRF | B-Cell Diffuse | 0.6133 | 0.6053 | 0.6216 | CXCL9 AND NOT-SLC39A8 | T-Cell, Peripheral | 0.7308 | 0.7917 | 0.6786 |
| FCRL5 AND NOT-CHRNB4 | B-Cell Diffuse | 0.6118 | 0.5417 | 0.7027 | CXCL9 AND NOT-STEAP4 | T-Cell, Peripheral | 0.7059 | 0.7826 | 0.6429 |
| FCRL5 AND NOT-SLC9B1 | B-Cell Diffuse | 0.6111 | 0.6286 | 0.5946 | CXCL9 AND NOT-ANPEP | T-Cell, Peripheral | 0.8235 | 0.913 | 0.75 |
| IL2RA AND NOT-CCR9 | B-Cell Diffuse | 0.6389 | 0.6571 | 0.6216 | CXCL9 AND NOT-CHRNA9 | T-Cell, Peripheral | 0.7119 | 0.6774 | 0.75 |
| CD79A AND NOT-CD93 | B-Cell Diffuse | 0.6087 | 0.6563 | 0.5676 | CXCL9 AND NOT-CHRNA1 | T-Cell, Peripheral | 0.7119 | 0.6774 | 0.75 |
| IL2RA AND NOT-TRPM3 | Anaplastic Lymphoma | 0.6667 | 0.75 | 0.6 | CXCL9 AND NOT-CHRNB2 | T-Cell, Peripheral | 0.7018 | 0.6897 | 0.7143 |
| IL2RA AND NOT-MRGPRX2 | Anaplastic Lymphoma | 0.6667 | 0.75 | 0.6 | CXCL9 AND NOT-SLC5A2 | T-Cell, Peripheral | 0.7018 | 0.6897 | 0.7143 |
| IL2RA AND NOT-ZP4 | Anaplastic Lymphoma | 0.6667 | 0.75 | 0.6 | CXCL9 AND NOT-SLC17A2 | T-Cell, Peripheral | 0.7333 | 0.6875 | 0.7857 |
| IL2RA AND NOT-CACNA1S | Anaplastic Lymphoma | 0.6667 | 0.75 | 0.6 | CXCL9 AND NOT-LHFPL5 | T-Cell, Peripheral | 0.7119 | 0.6774 | 0.75 |
| IL2RA AND NOT-FXYD7 | Anaplastic Lymphoma | 0.6667 | 0.75 | 0.6 | CXCL9 AND NOT-SLC17A1 | T-Cell, Peripheral | 0.7119 | 0.6774 | 0.75 |
| IL2RA AND NOT-LRRN4 | Anaplastic Lymphoma | 0.6667 | 0.75 | 0.6 | CXCL9 AND NOT-ABCG8 | T-Cell, Peripheral | 0.7333 | 0.6875 | 0.7857 |
| IL2RA AND NOT-KCNA10 | Anaplastic Lymphoma | 0.6667 | 0.75 | 0.6 | CXCL9 AND NOT-SLC2A2 | T-Cell, Peripheral | 0.7333 | 0.6875 | 0.7857 |
| IL2RA AND NOT-AGTR2 | Anaplastic Lymphoma | 0.6667 | 0.75 | 0.6 | CXCL9 AND NOT-ATP2B2 | T-Cell, Peripheral | 0.7333 | 0.6875 | 0.7857 |
| IL2RA AND NOT-MEGF11 | Anaplastic Lymphoma | 0.72 | 0.9 | 0.6 | CXCL9 AND NOT-PTPRT | T-Cell, Peripheral | 0.7333 | 0.6875 | 0.7857 |
| IL2RA AND NOT-OR5P3 | Anaplastic Lymphoma | 0.6923 | 0.8182 | 0.6 | CXCL9 AND NOT-TAS2R1 | T-Cell, Peripheral | 0.7018 | 0.6897 | 0.7143 |
| IL2RA AND NOT-MOG | Anaplastic Lymphoma | 0.6923 | 0.8182 | 0.6 | CXCL9 AND NOT-SLC43A1 | T-Cell, Peripheral | 0.7333 | 0.6875 | 0.7857 |
| IL2RA AND NOT-CNTNAP4 | Anaplastic Lymphoma | 0.6667 | 0.75 | 0.6 | CXCL9 AND NOT-ALCAM | T-Cell, Peripheral | 0.7719 | 0.7586 | 0.7857 |
| IL2RA AND NOT-KCNK10 | Anaplastic Lymphoma | 0.6667 | 0.75 | 0.6 | CXCL9 AND NOT-SLC13A2 | T-Cell, Peripheral | 0.7333 | 0.6875 | 0.7857 |
| IL2RA AND NOT-KIAA0319 | Anaplastic Lymphoma | 0.6667 | 0.75 | 0.6 | CXCL9 AND NOT-GABBR2 | T-Cell, Peripheral | 0.7333 | 0.6875 | 0.7857 |
| IL2RA AND NOT-KCNH4 | Anaplastic Lymphoma | 0.6667 | 0.75 | 0.6 | CXCL9 AND NOT-KREMEN2 | T-Cell, Peripheral | 0.6909 | 0.7037 | 0.6786 |
| IL2RA AND NOT-SLCO1B3 | Anaplastic Lymphoma | 0.6364 | 1 | 0.4667 | CXCL9 AND NOT-DYSF | T-Cell, Peripheral | 0.6909 | 0.7037 | 0.6786 |
| IL2RA AND NOT-CNTNAP2 | Anaplastic Lymphoma | 0.6667 | 0.75 | 0.6 | CXCL9 AND NOT-PROCR | T-Cell, Peripheral | 0.7826 | 1 | 0.6429 |
| IL2RA AND NOT-SLC6A15 | Anaplastic Lymphoma | 0.6667 | 0.75 | 0.6 | CXCL9 AND NOT-LRRC55 | T-Cell, Peripheral | 0.6897 | 0.6667 | 0.7143 |
| IL2RA AND NOT-MUC17 | Anaplastic Lymphoma | 0.6667 | 0.75 | 0.6 | CXCL9 AND NOT-TTYH3 | T-Cell, Peripheral | 0.6897 | 0.6667 | 0.7143 |
| IL2RA AND NOT-CNGA4 | Anaplastic Lymphoma | 0.6667 | 0.75 | 0.6 | CXCL9 AND NOT-DSCAM | T-Cell, Peripheral | 0.6897 | 0.6667 | 0.7143 |
| IL2RA AND NOT-CALY | Anaplastic Lymphoma | 0.6667 | 0.75 | 0.6 | CXCL9 AND NOT-CEACAM7 | T-Cell, Peripheral | 0.6897 | 0.6667 | 0.7143 |
| IL2RA AND NOT-OR52D1 | Anaplastic Lymphoma | 0.6667 | 0.75 | 0.6 | CXCL9 AND NOT-SLC9A1 | T-Cell, Peripheral | 0.6897 | 0.6667 | 0.7143 |
| IL2RA AND NOT-TSPAN16 | Anaplastic Lymphoma | 0.6154 | 0.7273 | 0.5333 | CXCL9 AND NOT-GGTLC1 | T-Cell, Peripheral | 0.7018 | 0.6897 | 0.7143 |
| IL2RA AND NOT-SLC9B1 | Anaplastic Lymphoma | 0.6154 | 0.7273 | 0.5333 | CXCL9 AND NOT-UNC5A | T-Cell, Peripheral | 0.7333 | 0.6875 | 0.7857 |
| IL2RA AND NOT-SLC22A13 | Anaplastic Lymphoma | 0.6667 | 0.75 | 0.6 | CXCL9 AND NOT-EBP | T-Cell, Peripheral | 0.7333 | 0.6875 | 0.7857 |
| IL2RA AND NOT-GRM3 | Anaplastic Lymphoma | 0.6154 | 0.7273 | 0.5333 | CXCL9 AND NOT-CD1B | T-Cell, Peripheral | 0.6897 | 0.6667 | 0.7143 |
| IL2RA AND NOT-SLC5A11 | Anaplastic Lymphoma | 0.6154 | 0.7273 | 0.5333 | CXCL9 AND NOT-SLC12A5 | T-Cell, Peripheral | 0.7333 | 0.6875 | 0.7857 |
| IL2RA AND NOT-GABRB2 | Anaplastic Lymphoma | 0.6154 | 0.7273 | 0.5333 | CXCL9 AND NOT-CHRND | T-Cell, Peripheral | 0.7333 | 0.6875 | 0.7857 |
| IL2RA AND NOT-DRD5 | Anaplastic Lymphoma | 0.6154 | 0.7273 | 0.5333 | CXCL9 AND NOT-SLC6A6 | T-Cell, Peripheral | 0.6809 | 0.8421 | 0.5714 |
| IL2RA AND NOT-CDH18 | Anaplastic Lymphoma | 0.6154 | 0.7273 | 0.5333 | CXCL9 AND NOT-CD74 | T-Cell, Peripheral | 0.6786 | 0.6786 | 0.6786 |
| IL2RA AND NOT-CALHM1 | Anaplastic Lymphoma | 0.6429 | 0.6923 | 0.6 | CXCL9 AND NOT-IL13 | T-Cell, Peripheral | 0.6786 | 0.6786 | 0.6786 |
| IL2RA AND NOT-MMP24 | Anaplastic Lymphoma | 0.72 | 0.9 | 0.6 | CXCL9 AND NOT-KCNJ6 | T-Cell, Peripheral | 0.6786 | 0.6786 | 0.6786 |
| IL2RA AND NOT-ASTN1 | Anaplastic Lymphoma | 0.6154 | 0.7273 | 0.5333 | CXCL9 AND NOT-CD36 | T-Cell, Peripheral | 0.6667 | 0.8824 | 0.5357 |
| IL2RA AND NOT-MTNR1B | Anaplastic Lymphoma | 0.6154 | 0.7273 | 0.5333 | CXCL9 AND NOT-SLCO1A2 | T-Cell, Peripheral | 0.6667 | 0.6552 | 0.6786 |
| IL2RA AND NOT-SV2C | Anaplastic Lymphoma | 0.6154 | 0.7273 | 0.5333 | CXCL9 AND NOT-MUC12 | T-Cell, Peripheral | 0.6667 | 0.6552 | 0.6786 |
| IL2RA AND NOT-TRPM1 | Anaplastic Lymphoma | 0.6154 | 0.7273 | 0.5333 | CXCL9 AND NOT-SLC6A12 | T-Cell, Peripheral | 0.6667 | 0.7391 | 0.6071 |
| IL2RA AND NOT-EPHA8 | Anaplastic Lymphoma | 0.6154 | 0.7273 | 0.5333 | CXCL9 AND NOT-MEGF10 | T-Cell, Peripheral | 0.6667 | 0.6552 | 0.6786 |
| IL2RA AND NOT-RXFP3 | Anaplastic Lymphoma | 0.6667 | 0.75 | 0.6 | CXCL9 AND NOT-CD1A | T-Cell, Peripheral | 0.6667 | 0.6923 | 0.6429 |
| IL2RA AND NOT-ADAM30 | Anaplastic Lymphoma | 0.6667 | 0.75 | 0.6 | CXCL9 AND NOT-SLC10A1 | T-Cell, Peripheral | 0.6667 | 0.6552 | 0.6786 |
| IL2RA AND NOT-KCNA4 | Anaplastic Lymphoma | 0.6154 | 0.7273 | 0.5333 | CXCL9 AND NOT-TGFBI | T-Cell, Peripheral | 0.8235 | 0.913 | 0.75 |
| IL2RA AND NOT-DSC1 | Anaplastic Lymphoma | 0.6154 | 0.7273 | 0.5333 | CXCL9 AND NOT-RGR | T-Cell, Peripheral | 0.6667 | 0.6552 | 0.6786 |
| IL2RA AND NOT-LCT | Anaplastic Lymphoma | 0.6154 | 0.7273 | 0.5333 | CXCL9 AND NOT-VANGL1 | T-Cell, Peripheral | 0.7333 | 0.6875 | 0.7857 |
| IL2RA AND NOT-GABRA2 | Anaplastic Lymphoma | 0.6429 | 0.6923 | 0.6 | CXCL9 AND NOT-GJA3 | T-Cell, Peripheral | 0.6923 | 0.75 | 0.6429 |
| IL2RA AND NOT-GRIA4 | Anaplastic Lymphoma | 0.6154 | 0.7273 | 0.5333 | CXCL9 AND NOT-RGSL1 | T-Cell, Peripheral | 0.6545 | 0.6667 | 0.6429 |
| IL2RA AND NOT-KCNA1 | Anaplastic Lymphoma | 0.6667 | 0.75 | 0.6 | CXCL9 AND NOT-OR2C3 | T-Cell, Peripheral | 0.6545 | 0.6667 | 0.6429 |
| IL2RA AND NOT-LPPR3 | Anaplastic Lymphoma | 0.6667 | 0.75 | 0.6 | CXCL9 AND NOT-TNFRSF10B | T-Cell, Peripheral | 0.6545 | 0.6667 | 0.6429 |
| IL2RA AND NOT-SLC12A3 | Anaplastic Lymphoma | 0.6667 | 0.75 | 0.6 | CXCL9 AND NOT-SLC23A2 | T-Cell, Peripheral | 0.6531 | 0.7619 | 0.5714 |
| IL2RA AND NOT-SEZ6 | Anaplastic Lymphoma | 0.6667 | 0.75 | 0.6 | CXCL9 AND NOT-SLCO1B3 | T-Cell, Peripheral | 0.6512 | 0.9333 | 0.5 |
| IL2RA AND NOT-CCKAR | Anaplastic Lymphoma | 0.6667 | 0.75 | 0.6 | CXCL10 AND NOT-ATP8B1 | T-Cell, Peripheral | 0.6441 | 0.6129 | 0.6786 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| IL2RA AND NOT-OR3A2 | Anaplastic Lymphoma | 0.6667 | 0.75 | 0.6 | CXCL9 AND NOT-PIRT | T-Cell, Peripheral | 0.6429 | 0.6429 | 0.6429 |
| IL2RA AND NOT-TRPC7 | Anaplastic Lymphoma | 0.6667 | 0.75 | 0.6 | CXCL9 AND NOT-SCN10A | T-Cell, Peripheral | 0.6429 | 0.6429 | 0.6429 |
| IL2RA AND NOT-LYPD1 | Anaplastic Lymphoma | 0.6154 | 0.7273 | 0.5333 | CXCL9 AND NOT-NPHS2 | T-Cell, Peripheral | 0.6429 | 0.6429 | 0.6429 |
| IL2RA AND NOT-GABRD | Anaplastic Lymphoma | 0.6667 | 0.75 | 0.6 | CXCL9 AND NOT-SLC39A12 | T-Cell, Peripheral | 0.6429 | 0.6429 | 0.6429 |
| IL2RA AND NOT-MPL | Anaplastic Lymphoma | 0.6667 | 0.75 | 0.6 | CXCL9 AND NOT-KCNJ9 | T-Cell, Peripheral | 0.6429 | 0.6429 | 0.6429 |
| IL2RA AND NOT-GUCY2F | Anaplastic Lymphoma | 0.6667 | 0.75 | 0.6 | CXCL9 AND NOT-TNFRSF12A | T-Cell, Peripheral | 0.7241 | 0.7 | 0.75 |
| IL2RA AND NOT-SLC39A12 | Anaplastic Lymphoma | 0.6667 | 0.75 | 0.6 | CXCL9 AND NOT-MRGPRF | T-Cell, Peripheral | 0.7273 | 0.7407 | 0.7143 |
| IL2RA AND NOT-OR2L2 | Anaplastic Lymphoma | 0.6667 | 0.75 | 0.6 | C11orf24 AND NOT-ANPEP | Melanoma | 0.9 | 1 | 0.8182 |
| IL2RA AND NOT-SLC22A16 | Anaplastic Lymphoma | 0.6923 | 0.8182 | 0.6 | C11orf24 AND NOT-LHFPL5 | Melanoma | 0.9 | 1 | 0.8182 |
| IL2RA AND NOT-GABRA4 | Anaplastic Lymphoma | 0.6667 | 0.75 | 0.6 | C11orf24 AND NOT-SLC10A1 | Melanoma | 0.9 | 1 | 0.8182 |
| IL2RA AND NOT-PCDHB1 | Anaplastic Lymphoma | 0.6667 | 0.75 | 0.6 | C11orf24 AND NOT-OR10J1 | Melanoma | 0.9 | 1 | 0.8182 |
| IL2RA AND NOT-CACNG2 | Anaplastic Lymphoma | 0.6667 | 0.75 | 0.6 | C11orf24 AND NOT-NMUR2 | Melanoma | 0.9 | 1 | 0.8182 |
| IL2RA AND NOT-SLC28A1 | Anaplastic Lymphoma | 0.6667 | 0.75 | 0.6 | C11orf24 AND NOT-NPFFR1 | Melanoma | 0.9 | 1 | 0.8182 |
| IL2RA AND NOT-HTR6 | Anaplastic Lymphoma | 0.6667 | 0.75 | 0.6 | TNFSF9 AND NOT-TMEM235 | Melanoma | 0.9524 | 1 | 0.9091 |
| IL2RA AND NOT-MAG | Anaplastic Lymphoma | 0.6667 | 0.75 | 0.6 | C11orf24 AND NOT-TMEM235 | Melanoma | 0.9 | 1 | 0.8182 |
| IL2RA AND NOT-ADAM7 | Anaplastic Lymphoma | 0.6667 | 0.75 | 0.6 | SLC5A6 AND NOT-ATP13A5 | Melanoma | 0.9524 | 1 | 0.9091 |
| IL2RA AND NOT-P2RY4 | Anaplastic Lymphoma | 0.6667 | 0.75 | 0.6 | TNFSF9 AND NOT-CDH20 | Melanoma | 0.9524 | 1 | 0.9091 |
| IL2RA AND NOT-GALR2 | Anaplastic Lymphoma | 0.6667 | 0.75 | 0.6 | C11orf24 AND NOT-OR1Q1 | Melanoma | 0.9 | 1 | 0.8182 |
| IL2RA AND NOT-SCN1A | Anaplastic Lymphoma | 0.6429 | 0.6923 | 0.6 | MC1R AND NOT-OR5P3 | Melanoma | 0.9 | 1 | 0.8182 |
| IL2RA AND NOT-KCNC1 | Anaplastic Lymphoma | 0.6667 | 0.75 | 0.6 | MC1R AND NOT-NPFFR1 | Melanoma | 0.9 | 1 | 0.8182 |
| IL2RA AND NOT-GABRA5 | Anaplastic Lymphoma | 0.6667 | 0.75 | 0.6 | MC1R AND NOT-KCNJ6 | Melanoma | 0.9 | 1 | 0.8182 |
| IL2RA AND NOT-OR4N4 | Anaplastic Lymphoma | 0.6667 | 0.75 | 0.6 | MC1R AND NOT-TMEM235 | Melanoma | 0.9 | 1 | 0.8182 |
| IL2RA AND NOT-KCNQ2 | Anaplastic Lymphoma | 0.6667 | 0.75 | 0.6 | C11orf24 AND NOT-ATP13A5 | Melanoma | 0.9 | 1 | 0.8182 |
| IL2RA AND NOT-GPR83 | Anaplastic Lymphoma | 0.6667 | 0.75 | 0.6 | MC1R AND NOT-OR10J1 | Melanoma | 0.9 | 1 | 0.8182 |
| IL2RA AND NOT-GNRHR | Anaplastic Lymphoma | 0.6429 | 0.6923 | 0.6 | MC1R AND NOT-NMUR2 | Melanoma | 0.9 | 1 | 0.8182 |
| IL2RA AND NOT-HCN1 | Anaplastic Lymphoma | 0.6667 | 0.75 | 0.6 | C11orf24 AND NOT-NOX1 | Melanoma | 0.9 | 1 | 0.8182 |
| IL2RA AND NOT-PCDHGC4 | Anaplastic Lymphoma | 0.6667 | 0.75 | 0.6 | C11orf24 AND NOT-OR3A1 | Melanoma | 0.9 | 1 | 0.8182 |
| IL2RA AND NOT-DCC | Anaplastic Lymphoma | 0.6667 | 0.75 | 0.6 | C11orf24 AND NOT-HCN4 | Melanoma | 0.9 | 1 | 0.8182 |
| IL2RA AND NOT-LRRTM4 | Anaplastic Lymphoma | 0.6154 | 0.7273 | 0.5333 | C11orf24 AND NOT-CACNG4 | Melanoma | 0.9 | 1 | 0.8182 |
| IL2RA AND NOT-GRM1 | Anaplastic Lymphoma | 0.6667 | 0.75 | 0.6 | C11orf24 AND NOT-OR1C1 | Melanoma | 0.9 | 1 | 0.8182 |
| IL2RA AND NOT-OR1Q1 | Anaplastic Lymphoma | 0.6667 | 0.75 | 0.6 | C11orf24 AND NOT-CD82 | Melanoma | 0.9 | 1 | 0.8182 |
| IL2RA AND NOT-GLRA3 | Anaplastic Lymphoma | 0.6429 | 0.6923 | 0.6 | C11orf24 AND NOT-SLC22A8 | Melanoma | 0.9 | 1 | 0.8182 |
| IL2RA AND NOT-CACNA1E | Anaplastic Lymphoma | 0.6667 | 0.75 | 0.6 | C11orf24 AND NOT-FSHR | Melanoma | 0.9 | 1 | 0.8182 |
| IL2RA AND NOT-SLC13A5 | Anaplastic Lymphoma | 0.6667 | 0.75 | 0.6 | C11orf24 AND NOT-CCR9 | Melanoma | 0.9 | 1 | 0.8182 |
| IL2RA AND NOT-P2RX3 | Anaplastic Lymphoma | 0.6923 | 0.8182 | 0.6 | C11orf24 AND NOT-AMHR2 | Melanoma | 0.9 | 1 | 0.8182 |
| IL2RA AND NOT-GPR6 | Anaplastic Lymphoma | 0.6667 | 0.75 | 0.6 | C11orf24 AND NOT-CLDN19 | Melanoma | 0.9 | 1 | 0.8182 |
| IL2RA AND NOT-CALN1 | Anaplastic Lymphoma | 0.6667 | 0.75 | 0.6 | TNFSF9 AND NOT-KCNJ6 | Melanoma | 0.9524 | 1 | 0.9091 |
| IL2RA AND NOT-CACNG7 | Anaplastic Lymphoma | 0.6154 | 0.7273 | 0.5333 | C11orf24 AND NOT-MC2R | Melanoma | 0.9 | 1 | 0.8182 |
| IL2RA AND NOT-CD207 | Anaplastic Lymphoma | 0.6667 | 0.75 | 0.6 | C11orf24 AND NOT-CHRNA2 | Melanoma | 0.9 | 1 | 0.8182 |
| IL2RA AND NOT-AJAP1 | Anaplastic Lymphoma | 0.6667 | 0.75 | 0.6 | C11orf24 AND NOT-RGSL1 | Melanoma | 0.9 | 1 | 0.8182 |
| IL2RA AND NOT-SLC1A6 | Anaplastic Lymphoma | 0.6667 | 0.75 | 0.6 | TNFSF9 AND NOT-KCNQ2 | Melanoma | 0.9524 | 1 | 0.9091 |
| IL2RA AND NOT-GRM7 | Anaplastic Lymphoma | 0.6154 | 0.7273 | 0.5333 | C11orf24 AND NOT-GJD2 | Melanoma | 0.9 | 1 | 0.8182 |
| IL2RA AND NOT-ANO4 | Anaplastic Lymphoma | 0.6667 | 0.75 | 0.6 | C11orf24 AND NOT-C8B | Melanoma | 0.9 | 1 | 0.8182 |
| IL2RA AND NOT-GRIK4 | Anaplastic Lymphoma | 0.6667 | 0.75 | 0.6 | C11orf24 AND NOT-BEST2 | Melanoma | 0.9 | 1 | 0.8182 |
| IL2RA AND NOT-UMODL1 | Anaplastic Lymphoma | 0.6429 | 0.6923 | 0.6 | C11orf24 AND NOT-ABCG8 | Melanoma | 0.9 | 1 | 0.8182 |
| IL2RA AND NOT-GPR12 | Anaplastic Lymphoma | 0.6429 | 0.6923 | 0.6 | C11orf24 AND NOT-SLC2A2 | Melanoma | 0.9 | 1 | 0.8182 |
| IL2RA AND NOT-HCN2 | Anaplastic Lymphoma | 0.6667 | 0.75 | 0.6 | C11orf24 AND NOT-SLC6A13 | Melanoma | 0.9 | 1 | 0.8182 |
| IL2RA AND NOT-CASR | Anaplastic Lymphoma | 0.6667 | 0.75 | 0.6 | C11orf24 AND NOT-SCN10A | Melanoma | 0.9 | 1 | 0.8182 |
| IL2RA AND NOT-KREMEN2 | Anaplastic Lymphoma | 0.6667 | 0.75 | 0.6 | C11orf24 AND NOT-SLC22A9 | Melanoma | 0.9 | 1 | 0.8182 |
| IL2RA AND NOT-OPRM1 | Anaplastic Lymphoma | 0.6667 | 0.75 | 0.6 | C11orf24 AND NOT-CALHM1 | Melanoma | 0.9 | 1 | 0.8182 |
| IL2RA AND NOT-DTNA | Anaplastic Lymphoma | 0.6667 | 0.75 | 0.6 | C11orf24 AND NOT-LRFN2 | Melanoma | 0.9 | 1 | 0.8182 |
| MS4A1 AND NOT-SORL1 | Mantle-Cell Lymphoma | 0.9136 | 0.8605 | 0.9737 | C11orf24 AND NOT-SLC6A18 | Melanoma | 0.9 | 1 | 0.8182 |
| CD52 AND NOT-CD36 | Mantle-Cell Lymphoma | 0.8642 | 0.814 | 0.9211 | C11orf24 AND NOT-HTR1E | Melanoma | 0.9 | 1 | 0.8182 |
| CD52 AND NOT-ANPEP | Mantle-Cell Lymphoma | 0.8642 | 0.814 | 0.9211 | C11orf24 AND NOT-GLRA2 | Melanoma | 0.9 | 1 | 0.8182 |
| CD52 AND NOT-CD93 | Mantle-Cell Lymphoma | 0.8889 | 0.8372 | 0.9474 | C11orf24 AND NOT-CACNG6 | Melanoma | 0.9 | 1 | 0.8182 |
| MS4A1 AND NOT-CALHM3 | Mantle-Cell Lymphoma | 0.8506 | 0.7551 | 0.9737 | C11orf24 AND NOT-SLC10A2 | Melanoma | 0.9 | 1 | 0.8182 |
| MS4A1 AND NOT-MLC1 | Mantle-Cell Lymphoma | 0.85 | 0.8095 | 0.8947 | C11orf24 AND NOT-SLC13A1 | Melanoma | 0.9 | 1 | 0.8182 |
| MS4A1 AND NOT-PTGER4 | Mantle-Cell Lymphoma | 0.8444 | 0.7308 | 1 | C11orf24 AND NOT-PCDHGC4 | Melanoma | 0.9 | 1 | 0.8182 |
| MS4A1 AND NOT-CCR9 | Mantle-Cell Lymphoma | 0.8434 | 0.7778 | 0.9211 | C11orf24 AND NOT-OTOF | Melanoma | 0.9 | 1 | 0.8182 |
| P2RX5 AND NOT-CHRNG | Mantle-Cell Lymphoma | 0.8421 | 0.8421 | 0.8421 | C11orf24 AND NOT-HRH3 | Melanoma | 0.9 | 1 | 0.8182 |
| P2RX5 AND NOT-MLC1 | Mantle-Cell Lymphoma | 0.8421 | 0.8421 | 0.8421 | TNFSF9 AND NOT-NMUR2 | Melanoma | 0.9524 | 1 | 0.9091 |
| CD52 AND NOT-MLC1 | Mantle-Cell Lymphoma | 0.8649 | 0.8889 | 0.8421 | C11orf24 AND NOT-ADAM29 | Melanoma | 0.9 | 1 | 0.8182 |
| CD52 AND NOT-CD163 | Mantle-Cell Lymphoma | 0.8675 | 0.8 | 0.9474 | TNFSF9 AND NOT-SYT4 | Melanoma | 0.9524 | 1 | 0.9091 |
| MS4A1 AND NOT-XCR1 | Mantle-Cell Lymphoma | 0.8352 | 0.717 | 1 | C11orf24 AND NOT-KCNJ6 | Melanoma | 0.9 | 1 | 0.8182 |
| MS4A1 AND NOT-KCNA4 | Mantle-Cell Lymphoma | 0.8315 | 0.7255 | 0.9737 | C11orf24 AND NOT-GRIN2B | Melanoma | 0.9 | 1 | 0.8182 |
| MS4A1 AND NOT-DRD5 | Mantle-Cell Lymphoma | 0.8312 | 0.8205 | 0.8421 | MC1R AND NOT-PCDHB1 | Melanoma | 0.9 | 1 | 0.8182 |
| MS4A1 AND NOT-ADAM2 | Mantle-Cell Lymphoma | 0.8312 | 0.8205 | 0.8421 | C11orf24 AND NOT-PCDH11Y | Melanoma | 0.9 | 1 | 0.8182 |
| P2RX5 AND NOT-CD163 | Mantle-Cell Lymphoma | 0.9 | 0.8571 | 0.9474 | MC1R AND NOT-CHRNA2 | Melanoma | 0.9 | 1 | 0.8182 |
| MS4A1 AND NOT-CACNG4 | Mantle-Cell Lymphoma | 0.8261 | 0.7037 | 1 | MC1R AND NOT-SLC6A13 | Melanoma | 0.9 | 1 | 0.8182 |
| P2RX5 AND NOT-SLC12A9 | Mantle-Cell Lymphoma | 0.8267 | 0.8378 | 0.8158 | MC1R AND NOT-KCNQ2 | Melanoma | 0.9 | 1 | 0.8182 |
| MS4A1 AND NOT-TSPAN16 | Mantle-Cell Lymphoma | 0.8182 | 0.72 | 0.9474 | MC1R AND NOT-SLC34A1 | Melanoma | 0.9 | 1 | 0.8182 |
| MS4A1 AND NOT-CLDN10 | Mantle-Cell Lymphoma | 0.8172 | 0.6909 | 1 | MC1R AND NOT-OTOF | Melanoma | 0.9 | 1 | 0.8182 |
| MS4A1 AND NOT-ADCY8 | Mantle-Cell Lymphoma | 0.8172 | 0.6909 | 1 | MC1R AND NOT-PCDH11X | Melanoma | 0.9 | 1 | 0.8182 |
| MS4A1 AND NOT-KCNK12 | Mantle-Cell Lymphoma | 0.814 | 0.7292 | 0.9211 | MC1R AND NOT-OR1C1 | Melanoma | 0.9 | 1 | 0.8182 |
| MS4A1 AND NOT-GALR1 | Mantle-Cell Lymphoma | 0.8132 | 0.6981 | 0.9737 | MC1R AND NOT-IL13 | Melanoma | 0.9 | 1 | 0.8182 |
| CD79B AND NOT-SORL1 | Mantle-Cell Lymphoma | 0.8116 | 0.9032 | 0.7368 | MC1R AND NOT-CALHM1 | Melanoma | 0.9 | 1 | 0.8182 |
| TNFSF11 AND NOT-STAB1 | T-Cell, Peripheral | 0.6047 | 0.8667 | 0.4643 | MC1R AND NOT-GRIN2B | Melanoma | 0.9 | 1 | 0.8182 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| EDNRB AND NOT-VN1R2 | Melanoma | 0.9 | 1 | 0.8182 | MC1R AND NOT-FSHR | Melanoma | 0.9 | 1 | 0.8182 |
| EDNRB AND NOT-ERVW-1 | Melanoma | 0.9 | 1 | 0.8182 | MC1R AND NOT-SLC17A2 | Melanoma | 0.9 | 1 | 0.8182 |
| EDNRB AND NOT-PCDHB1 | Melanoma | 0.9 | 1 | 0.8182 | MC1R AND NOT-PCDHGC4 | Melanoma | 0.9 | 1 | 0.8182 |
| EDNRB AND NOT-GRM8 | Melanoma | 0.9 | 1 | 0.8182 | MC1R AND NOT-CDH20 | Melanoma | 0.9 | 1 | 0.8182 |
| EDNRB AND NOT-GRM6 | Melanoma | 0.9 | 1 | 0.8182 | MC1R AND NOT-VN1R2 | Melanoma | 0.9 | 1 | 0.8182 |
| EDNRB AND NOT-GRM4 | Melanoma | 0.9 | 1 | 0.8182 | MC1R AND NOT-MIP | Melanoma | 0.9 | 1 | 0.8182 |
| EDNRB AND NOT-GRM3 | Melanoma | 0.9 | 1 | 0.8182 | MC1R AND NOT-MC2R | Melanoma | 0.9 | 1 | 0.8182 |
| EDNRB AND NOT-GRIN2B | Melanoma | 0.9 | 1 | 0.8182 | MC1R AND NOT-HTR5A | Melanoma | 0.9 | 1 | 0.8182 |
| EDNRB AND NOT-GRID2 | Melanoma | 0.9 | 1 | 0.8182 | MC1R AND NOT-OR1Q1 | Melanoma | 0.9 | 1 | 0.8182 |
| EDNRB AND NOT-MLNR | Melanoma | 0.9 | 1 | 0.8182 | MC1R AND NOT-AOC3 | Melanoma | 0.9 | 1 | 0.8182 |
| EDNRB AND NOT-GPR26 | Melanoma | 0.9 | 1 | 0.8182 | MC1R AND NOT-GPRC6A | Melanoma | 0.9 | 1 | 0.8182 |
| EDNRB AND NOT-TMEM235 | Melanoma | 0.9 | 1 | 0.8182 | MC1R AND NOT-DSCAM | Melanoma | 0.9 | 1 | 0.8182 |
| EDNRB AND NOT-CDH20 | Melanoma | 0.9 | 1 | 0.8182 | C11orf24 AND NOT-TAS2R1 | Melanoma | 0.9 | 1 | 0.8182 |
| EDNRB AND NOT-HTR1E | Melanoma | 0.9 | 1 | 0.8182 | MC1R AND NOT-GJD2 | Melanoma | 0.9 | 1 | 0.8182 |
| EDNRB AND NOT-HTR5A | Melanoma | 0.9 | 1 | 0.8182 | SLC10A4 AND NOT-KCNJ10 | Neuroblastoma | 0.994 | 1 | 0.9881 |
| EDNRB AND NOT-SLCO1B3 | Melanoma | 0.9 | 1 | 0.8182 | SLC10A4 AND NOT-NKAIN2 | Neuroblastoma | 0.994 | 1 | 0.9881 |
| EDNRB AND NOT-ATP13A5 | Melanoma | 0.9 | 1 | 0.8182 | SLC10A4 AND NOT-OPALIN | Neuroblastoma | 0.9881 | 0.9881 | 0.9881 |
| EDNRB AND NOT-MIP | Melanoma | 0.9 | 1 | 0.8182 | SLC10A4 AND NOT-TMEM235 | Neuroblastoma | 0.9881 | 0.9881 | 0.9881 |
| EDNRB AND NOT-MC2R | Melanoma | 0.9 | 1 | 0.8182 | SLC10A4 AND NOT-OMG | Neuroblastoma | 0.988 | 1 | 0.9762 |
| EDNRB AND NOT-CDH17 | Melanoma | 0.9 | 1 | 0.8182 | SLC10A4 AND NOT-KCNA1 | Neuroblastoma | 0.9822 | 0.9765 | 0.9881 |
| EDNRB AND NOT-SLC22A25 | Melanoma | 0.9 | 1 | 0.8182 | SLC10A4 AND NOT-MAG | Neuroblastoma | 0.9822 | 0.9765 | 0.9881 |
| EDNRB AND NOT-KCNJ6 | Melanoma | 0.9 | 1 | 0.8182 | SLC10A4 AND NOT-MOG | Neuroblastoma | 0.9822 | 0.9765 | 0.9881 |
| EDNRB AND NOT-KCNH1 | Melanoma | 0.9 | 1 | 0.8182 | SLC10A4 AND NOT-SLC5A11 | Neuroblastoma | 0.9822 | 0.9765 | 0.9881 |
| EDNRB AND NOT-KCND2 | Melanoma | 0.9 | 1 | 0.8182 | SLC10A4 AND NOT-HCN2 | Neuroblastoma | 0.9822 | 0.9765 | 0.9881 |
| EDNRB AND NOT-KCNA4 | Melanoma | 0.9 | 1 | 0.8182 | SLC10A4 AND NOT-GABRB2 | Neuroblastoma | 0.9822 | 0.9765 | 0.9881 |
| EDNRB AND NOT-KCNA1 | Melanoma | 0.9 | 1 | 0.8182 | SLC10A4 AND NOT-SLC24A2 | Neuroblastoma | 0.9822 | 0.9765 | 0.9881 |
| EDNRB AND NOT-CD82 | Melanoma | 0.9 | 1 | 0.8182 | SLC10A4 AND NOT-OR1Q1 | Neuroblastoma | 0.9822 | 0.9765 | 0.9881 |
| EDNRB AND NOT-GPR6 | Melanoma | 0.9 | 1 | 0.8182 | SLC10A4 AND NOT-MLC1 | Neuroblastoma | 0.9822 | 0.9765 | 0.9881 |
| EDNRB AND NOT-GLRA2 | Melanoma | 0.9 | 1 | 0.8182 | SLC10A4 AND NOT-TTYH2 | Neuroblastoma | 0.9822 | 0.9765 | 0.9881 |
| EDNRB AND NOT-OR3A1 | Melanoma | 0.9 | 1 | 0.8182 | SLC10A4 AND NOT-KCNA2 | Neuroblastoma | 0.9818 | 1 | 0.9643 |
| EDNRB AND NOT-SV2C | Melanoma | 0.9 | 1 | 0.8182 | SLC10A4 AND NOT-HTR1F | Neuroblastoma | 0.994 | 1 | 0.9881 |
| EDNRB AND NOT-LHFPL5 | Melanoma | 0.9 | 1 | 0.8182 | SLC10A4 AND NOT-TRPC3 | Neuroblastoma | 0.982 | 0.988 | 0.9762 |
| EDNRB AND NOT-GPRC6A | Melanoma | 0.9 | 1 | 0.8182 | SLC10A4 AND NOT-SLC13A1 | Neuroblastoma | 0.9822 | 0.9765 | 0.9881 |
| EDNRB AND NOT-SLC39A12 | Melanoma | 0.9 | 1 | 0.8182 | SLC10A4 AND NOT-SLC9B1 | Neuroblastoma | 0.9765 | 0.9651 | 0.9881 |
| EDNRB AND NOT-EPHA8 | Melanoma | 0.9 | 1 | 0.8182 | SLC10A4 AND NOT-GNRHR | Neuroblastoma | 0.9765 | 0.9651 | 0.9881 |
| EDNRB AND NOT-CHRNB2 | Melanoma | 0.9 | 1 | 0.8182 | SLC10A4 AND NOT-ADAM7 | Neuroblastoma | 0.9765 | 0.9651 | 0.9881 |
| EDNRB AND NOT-AGTR2 | Melanoma | 0.9 | 1 | 0.8182 | SLC10A4 AND NOT-MRGPRX2 | Neuroblastoma | 0.9765 | 0.9651 | 0.9881 |
| EDNRB AND NOT-CHRNA4 | Melanoma | 0.9 | 1 | 0.8182 | SLC10A4 AND NOT-XCR1 | Neuroblastoma | 0.9765 | 0.9651 | 0.9881 |
| EDNRB AND NOT-SLC17A2 | Melanoma | 0.9 | 1 | 0.8182 | SLC10A4 AND NOT-GABRA1 | Neuroblastoma | 0.9762 | 0.9762 | 0.9762 |
| EDNRB AND NOT-PIK3IP1 | Melanoma | 0.9 | 1 | 0.8182 | SLC10A4 AND NOT-GPRC6A | Neuroblastoma | 0.9762 | 0.9762 | 0.9762 |
| EDNRB AND NOT-DSCAM | Melanoma | 0.9 | 1 | 0.8182 | SLC10A4 AND NOT-KCNU1 | Neuroblastoma | 0.9762 | 0.9762 | 0.9762 |
| EDNRB AND NOT-AGER | Melanoma | 0.9 | 1 | 0.8182 | SLC10A4 AND NOT-GRIN2B | Neuroblastoma | 0.9881 | 0.9881 | 0.9881 |
| EDNRB AND NOT-NTSR2 | Melanoma | 0.9 | 1 | 0.8182 | SLC10A4 AND NOT-OR5P3 | Neuroblastoma | 0.9822 | 0.9765 | 0.9881 |
| EDNRB AND NOT-PCDH11X | Melanoma | 0.9 | 1 | 0.8182 | SLC10A4 AND NOT-TMPRSS11B | Neuroblastoma | 0.9822 | 0.9765 | 0.9881 |
| EDNRB AND NOT-ADAM2 | Melanoma | 0.9 | 1 | 0.8182 | SLC10A4 AND NOT-GRM6 | Neuroblastoma | 0.9822 | 0.9765 | 0.9881 |
| EDNRB AND NOT-CACNG4 | Melanoma | 0.9 | 1 | 0.8182 | SLC10A4 AND NOT-OR8B2 | Neuroblastoma | 0.9765 | 0.9651 | 0.9881 |
| EDNRB AND NOT-NOX1 | Melanoma | 0.9 | 1 | 0.8182 | SLC10A4 AND NOT-LCT | Neuroblastoma | 0.9765 | 0.9651 | 0.9881 |
| EDNRB AND NOT-AMHR2 | Melanoma | 0.9 | 1 | 0.8182 | SLC10A4 AND NOT-GLRA3 | Neuroblastoma | 0.994 | 1 | 0.9881 |
| EDNRB AND NOT-GHSR | Melanoma | 0.9 | 1 | 0.8182 | SLC10A4 AND NOT-CACNG6 | Neuroblastoma | 0.9762 | 0.9762 | 0.9762 |
| EDNRB AND NOT-OR10J1 | Melanoma | 0.9 | 1 | 0.8182 | SLC10A4 AND NOT-ADAM30 | Neuroblastoma | 0.9708 | 0.954 | 0.9881 |
| EDNRB AND NOT-OR2L2 | Melanoma | 0.9 | 1 | 0.8182 | SLC10A4 AND NOT-ACSL6 | Neuroblastoma | 0.9708 | 0.954 | 0.9881 |
| EDNRB AND NOT-OR1C1 | Melanoma | 0.9 | 1 | 0.8182 | SLC10A4 AND NOT-SLCO1A2 | Neuroblastoma | 0.9708 | 0.954 | 0.9881 |
| EDNRB AND NOT-CATSPERD | Melanoma | 0.9 | 1 | 0.8182 | SLC10A4 AND NOT-GPR156 | Neuroblastoma | 0.9708 | 0.954 | 0.9881 |
| EDNRB AND NOT-GABRB2 | Melanoma | 0.9 | 1 | 0.8182 | SLC10A4 AND NOT-LRRC8E | Neuroblastoma | 0.9708 | 0.954 | 0.9881 |
| EDNRB AND NOT-SLC22A9 | Melanoma | 0.9 | 1 | 0.8182 | SLC10A4 AND NOT-GRM1 | Neuroblastoma | 0.9708 | 0.954 | 0.9881 |
| EDNRB AND NOT-CALHM1 | Melanoma | 0.9 | 1 | 0.8182 | SLC10A4 AND NOT-PCDHB1 | Neuroblastoma | 0.9708 | 0.954 | 0.9881 |
| NKAIN1 AND NOT-EGFR | Neuroblastoma | 0.908 | 0.9367 | 0.881 | SLC10A4 AND NOT-SLC22A6 | Neuroblastoma | 0.9708 | 0.954 | 0.9881 |
| NKAIN1 AND NOT-SSTR1 | Neuroblastoma | 0.8929 | 0.8929 | 0.8929 | SLC10A4 AND NOT-CALHM1 | Neuroblastoma | 0.9708 | 0.954 | 0.9881 |
| NKAIN1 AND NOT-BCAN | Neuroblastoma | 0.8929 | 0.8929 | 0.8929 | SLC10A4 AND NOT-SCN10A | Neuroblastoma | 0.9708 | 0.954 | 0.9881 |
| NKAIN1 AND NOT-GAGE1 | Neuroblastoma | 0.8862 | 0.8916 | 0.881 | SLC10A4 AND NOT-SCN1A | Neuroblastoma | 0.9708 | 0.954 | 0.9881 |
| L1CAM AND NOT-NKAIN2 | Neuroblastoma | 0.8846 | 0.9583 | 0.8214 | SLC10A4 AND NOT-GRM3 | Neuroblastoma | 0.9708 | 0.954 | 0.9881 |
| L1CAM AND NOT-GRM3 | Neuroblastoma | 0.8848 | 0.9012 | 0.869 | SLC10A4 AND NOT-CD82 | Neuroblastoma | 0.9704 | 0.9647 | 0.9762 |
| NKAIN1 AND NOT-GPA33 | Neuroblastoma | 0.881 | 0.881 | 0.881 | SLC10A4 AND NOT-GRID2 | Neuroblastoma | 0.9704 | 0.9647 | 0.9762 |
| L1CAM AND NOT-KCNA1 | Neuroblastoma | 0.9375 | 0.9868 | 0.8929 | SLC10A4 AND NOT-SLC22A16 | Neuroblastoma | 0.9704 | 0.9647 | 0.9762 |
| NKAIN1 AND NOT-DPEP1 | Neuroblastoma | 0.8721 | 0.8523 | 0.8929 | SLC10A4 AND NOT-CD207 | Neuroblastoma | 0.9704 | 0.9647 | 0.9762 |
| NKAIN1 AND NOT-WT1 | Neuroblastoma | 0.8712 | 0.8987 | 0.8452 | SLC10A4 AND NOT-GABBR2 | Neuroblastoma | 0.9701 | 0.9759 | 0.9643 |
| NKAIN1 AND NOT-RNF43 | Neuroblastoma | 0.8706 | 0.8605 | 0.881 | SLC10A4 AND NOT-PCDH11X | Neuroblastoma | 0.9701 | 0.9759 | 0.9643 |
| L1CAM AND NOT-SLCO1C1 | Neuroblastoma | 0.9182 | 0.9733 | 0.869 | SLC10A4 AND NOT-CLDN16 | Neuroblastoma | 0.9701 | 0.9759 | 0.9643 |
| NKAIN1 AND NOT-ULBP3 | Neuroblastoma | 0.8671 | 0.8427 | 0.8929 | SLC10A4 AND NOT-HTR3C | Neuroblastoma | 0.9701 | 0.9759 | 0.9643 |
| L1CAM AND NOT-TRPC3 | Neuroblastoma | 0.8671 | 0.8427 | 0.8929 | SLC10A4 AND NOT-GSG1L | Neuroblastoma | 0.9697 | 0.9877 | 0.9524 |
| NKAIN1 AND NOT-TNFRSF10A | Neuroblastoma | 0.8671 | 0.8427 | 0.8929 | SLC10A4 AND NOT-CSMD3 | Neuroblastoma | 0.9693 | 1 | 0.9405 |
| NKAIN1 AND NOT-HHLA2 | Neuroblastoma | 0.8655 | 0.8506 | 0.881 | SLC10A4 AND NOT-HTR5A | Neuroblastoma | 0.9765 | 0.9651 | 0.9881 |
| NKAIN1 AND NOT-CLDN2 | Neuroblastoma | 0.8655 | 0.8506 | 0.881 | SLC10A4 AND NOT-SLC22A11 | Neuroblastoma | 0.9762 | 0.9762 | 0.9762 |
| NKAIN1 AND NOT-TYR | Neuroblastoma | 0.8639 | 0.8588 | 0.869 | SLC10A4 AND NOT-MEGF10 | Neuroblastoma | 0.9651 | 0.9432 | 0.9881 |
| L1CAM AND NOT-CSMD3 | Neuroblastoma | 0.882 | 0.9221 | 0.8452 | SLC10A4 AND NOT-DTNA | Neuroblastoma | 0.9651 | 0.9432 | 0.9881 |
| L1CAM AND NOT-MLC1 | Neuroblastoma | 0.8621 | 0.8333 | 0.8929 | SLC10A4 AND NOT-CACNG8 | Neuroblastoma | 0.9651 | 0.9432 | 0.9881 |
| NKAIN1 AND NOT-CLDN18 | Neuroblastoma | 0.8621 | 0.8333 | 0.8929 | SLC10A4 AND NOT-ROS1 | Neuroblastoma | 0.9651 | 0.9432 | 0.9881 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NKAIN1 AND NOT-ITGB3 | Neuroblastoma | 0.8605 | 0.8409 | 0.881 | SLC10A4 AND NOT-SLC39A12 | Neuroblastoma | 0.9651 | 0.9432 | 0.9881 |
| NKAIN1 AND NOT-CLDN7 | Neuroblastoma | 0.8588 | 0.8488 | 0.869 | SLC10A4 AND NOT-SLC28A1 | Neuroblastoma | 0.9651 | 0.9432 | 0.9881 |
| NKAIN1 AND NOT-DNAJB8 | Neuroblastoma | 0.8555 | 0.8315 | 0.881 | SLC10A4 AND NOT-HTR6 | Neuroblastoma | 0.9651 | 0.9432 | 0.9881 |
| L1CAM AND NOT-KCNA2 | Neuroblastoma | 0.8553 | 0.9559 | 0.7738 | SLC10A4 AND NOT-TRPM3 | Neuroblastoma | 0.9765 | 0.9651 | 0.9881 |
| NKAIN1 AND NOT-SSTR5 | Neuroblastoma | 0.8538 | 0.8391 | 0.869 | SLC10A4 AND NOT-CNGA4 | Neuroblastoma | 0.9651 | 0.9432 | 0.9881 |
| NKAIN1 AND NOT-MUC13 | Neuroblastoma | 0.8506 | 0.8222 | 0.881 | SLC10A4 AND NOT-ATP2B2 | Neuroblastoma | 0.9647 | 0.9535 | 0.9762 |
| NKAIN1 AND NOT-CLDN11 | Neuroblastoma | 0.85 | 0.8947 | 0.8095 | SLC10A4 AND NOT-GJA10 | Neuroblastoma | 0.9647 | 0.9535 | 0.9762 |
| ALK AND NOT-PAQR7 | Neuroblastoma | 0.8553 | 0.9067 | 0.8095 | SLC10A4 AND NOT-SLC12A5 | Neuroblastoma | 0.9647 | 0.9535 | 0.9762 |
| ALK AND NOT-SLC2A1 | Neuroblastoma | 0.8625 | 0.9079 | 0.8214 | SLC10A4 AND NOT-CLRN1 | Neuroblastoma | 0.9643 | 0.9643 | 0.9643 |
| ALK AND NOT-CHRND | Neuroblastoma | 0.8679 | 0.92 | 0.8214 | SLC10A4 AND NOT-HCN4 | Neuroblastoma | 0.9643 | 0.9643 | 0.9643 |
| ALK AND NOT-CLDN17 | Neuroblastoma | 0.8662 | 0.9315 | 0.8095 | SLC10A4 AND NOT-GRIN2C | Neuroblastoma | 0.9639 | 0.9756 | 0.9524 |
| ALK AND NOT-DCSTAMP | Neuroblastoma | 0.859 | 0.9306 | 0.7976 | SLC10A4 AND NOT-SLC6A12 | Neuroblastoma | 0.9639 | 0.9756 | 0.9524 |
| ALK AND NOT-OPCML | Neuroblastoma | 0.879 | 0.9452 | 0.8214 | SLC10A4 AND NOT-MC2R | Neuroblastoma | 0.9639 | 0.9756 | 0.9524 |
| ALK AND NOT-LRRC8E | Neuroblastoma | 0.8734 | 0.9324 | 0.8214 | SLC10A4 AND NOT-OPRK1 | Neuroblastoma | 0.9634 | 0.9875 | 0.9405 |
| ALK AND NOT-GABBR2 | Neuroblastoma | 0.8701 | 0.9571 | 0.7976 | SLC10A4 AND NOT-KCNJ6 | Neuroblastoma | 0.963 | 1 | 0.9286 |
| ALK AND NOT-MLC1 | Neuroblastoma | 0.8846 | 0.9583 | 0.8214 | SLC10A4 AND NOT-SLC12A3 | Neuroblastoma | 0.9595 | 0.9326 | 0.9881 |
| ALK AND NOT-SLC6A13 | Neuroblastoma | 0.8774 | 0.9577 | 0.8095 | SLC10A4 AND NOT-SEMA4D | Neuroblastoma | 0.9595 | 0.9326 | 0.9881 |
| ALK AND NOT-GPR137B | Neuroblastoma | 0.8608 | 0.9189 | 0.8095 | SLC10A4 AND NOT-OR2L2 | Neuroblastoma | 0.9595 | 0.9326 | 0.9881 |
| ALK AND NOT-ADAM29 | Neuroblastoma | 0.879 | 0.9452 | 0.8214 | SLC10A4 AND NOT-CLDN17 | Neuroblastoma | 0.9591 | 0.9425 | 0.9762 |
| ALK AND NOT-DYSF | Neuroblastoma | 0.8625 | 0.9079 | 0.8214 | NKAIN4 AND NOT-AQP11 | Oligodendroglioma | 0.8889 | 1 | 0.8 |
| ALK AND NOT-OR1C1 | Neuroblastoma | 0.8625 | 0.9079 | 0.8214 | NKAIN4 AND NOT-ACE2 | Oligodendroglioma | 0.8889 | 1 | 0.8 |
| ALK AND NOT-GPR37L1 | Neuroblastoma | 0.8625 | 0.9079 | 0.8214 | NKAIN4 AND NOT-TRPV4 | Oligodendroglioma | 0.8889 | 1 | 0.8 |
| ALK AND NOT-TNFRSF12A | Neuroblastoma | 0.8553 | 0.9067 | 0.8095 | NKAIN4 AND NOT-RXFP1 | Oligodendroglioma | 0.8889 | 1 | 0.8 |
| ALK AND NOT-ATP13A5 | Neuroblastoma | 0.8625 | 0.9079 | 0.8214 | NKAIN4 AND NOT-PRPH2 | Oligodendroglioma | 0.8889 | 1 | 0.8 |
| ALK AND NOT-VN1R2 | Neuroblastoma | 0.8684 | 0.9706 | 0.7857 | NKAIN4 AND NOT-RHAG | Oligodendroglioma | 0.8889 | 1 | 0.8 |
| ALK AND NOT-LYPD1 | Neuroblastoma | 0.8625 | 0.9079 | 0.8214 | NKAIN4 AND NOT-EDA2R | Oligodendroglioma | 0.8889 | 1 | 0.8 |
| ALK AND NOT-FAT1 | Neuroblastoma | 0.8519 | 0.8846 | 0.8214 | NKAIN4 AND NOT-CDH26 | Oligodendroglioma | 0.8889 | 1 | 0.8 |
| ALK AND NOT-ZDHHC2 | Neuroblastoma | 0.8553 | 0.9067 | 0.8095 | NKAIN4 AND NOT-SLC5A7 | Oligodendroglioma | 0.8889 | 1 | 0.8 |
| ALK AND NOT-SCN10A | Neuroblastoma | 0.8679 | 0.92 | 0.8214 | NKAIN4 AND NOT-ROBO2 | Oligodendroglioma | 0.8889 | 1 | 0.8 |
| ALK AND NOT-PHLDB2 | Neuroblastoma | 0.8625 | 0.9079 | 0.8214 | NKAIN4 AND NOT-CEACAM1 | Oligodendroglioma | 0.8889 | 1 | 0.8 |
| ALK AND NOT-PCDH11X | Neuroblastoma | 0.8734 | 0.9324 | 0.8214 | NKAIN4 AND NOT-OPN1SW | Oligodendroglioma | 0.8889 | 1 | 0.8 |
| ALK AND NOT-OXTR | Neuroblastoma | 0.8625 | 0.9079 | 0.8214 | NKAIN4 AND NOT-RYR1 | Oligodendroglioma | 0.8889 | 1 | 0.8 |
| ALK AND NOT-EMP3 | Neuroblastoma | 0.8625 | 0.9079 | 0.8214 | NKAIN4 AND NOT-SORT1 | Oligodendroglioma | 0.8889 | 1 | 0.8 |
| L1CAM AND NOT-GABRB2 | Neuroblastoma | 0.8488 | 0.8295 | 0.869 | NKAIN4 AND NOT-SLC22A23 | Oligodendroglioma | 0.8889 | 1 | 0.8 |
| NKAIN1 AND NOT-MUC1 | Neuroblastoma | 0.8488 | 0.8295 | 0.869 | NKAIN4 AND NOT-SCN5A | Oligodendroglioma | 0.8889 | 1 | 0.8 |
| ALK AND NOT-PPAPDC1B | Neuroblastoma | 0.8481 | 0.9054 | 0.7976 | NKAIN4 AND NOT-ABCD4 | Oligodendroglioma | 0.8889 | 1 | 0.8 |
| NKAIN1 AND NOT-RAET1E | Neuroblastoma | 0.8475 | 0.8065 | 0.8929 | NKAIN4 AND NOT-PTPRS | Oligodendroglioma | 0.8889 | 1 | 0.8 |
| L1CAM AND NOT-SLC39A12 | Neuroblastoma | 0.8475 | 0.8065 | 0.8929 | NKAIN4 AND NOT-NLGN2 | Oligodendroglioma | 0.8889 | 1 | 0.8 |
| L1CAM AND NOT-OMG | Neuroblastoma | 0.8462 | 0.9167 | 0.7857 | NKAIN4 AND NOT-PCDH10 | Oligodendroglioma | 0.8889 | 1 | 0.8 |
| NKAIN1 AND NOT-IL20RA | Neuroblastoma | 0.8452 | 0.8452 | 0.8452 | NKAIN4 AND NOT-KCNT1 | Oligodendroglioma | 0.8889 | 1 | 0.8 |
| NKAIN1 AND NOT-FCRL2 | Neuroblastoma | 0.8503 | 0.8554 | 0.8452 | NKAIN4 AND NOT-ISLR2 | Oligodendroglioma | 0.8889 | 1 | 0.8 |
| NKAIN1 AND NOT-PSCA | Neuroblastoma | 0.8427 | 0.7979 | 0.8929 | NKAIN4 AND NOT-STIM2 | Oligodendroglioma | 0.8889 | 1 | 0.8 |
| L1CAM AND NOT-MOG | Neuroblastoma | 0.8427 | 0.7979 | 0.8929 | NKAIN4 AND NOT-HCN3 | Oligodendroglioma | 0.8889 | 1 | 0.8 |
| NKAIN1 AND NOT-CLDN6 | Neuroblastoma | 0.8421 | 0.8276 | 0.8571 | NKAIN4 AND NOT-SLC7A14 | Oligodendroglioma | 0.8889 | 1 | 0.8 |
| FLVCR1 AND NOT-PCYT1A | Neuroblastoma | 0.8395 | 0.8718 | 0.8095 | NKAIN4 AND NOT-PTPN2 | Oligodendroglioma | 0.8889 | 1 | 0.8 |
| NKAIN1 AND NOT-TRPM4 | Neuroblastoma | 0.8395 | 0.8718 | 0.8095 | NKAIN4 AND NOT-WDR19 | Oligodendroglioma | 0.8889 | 1 | 0.8 |
| NKAIN1 AND NOT-ITGB6 | Neuroblastoma | 0.838 | 0.7895 | 0.8929 | NKAIN4 AND NOT-CADM3 | Oligodendroglioma | 0.8889 | 1 | 0.8 |
| NKAIN4 AND NOT-GUCY2C | Oligodendroglioma | 0.8889 | 1 | 0.8 | NKAIN4 AND NOT-PTPRC | Oligodendroglioma | 0.8889 | 1 | 0.8 |
| NKAIN4 AND NOT-SSTR5 | Oligodendroglioma | 0.8889 | 1 | 0.8 | NKAIN4 AND NOT-PTPRM | Oligodendroglioma | 0.8889 | 1 | 0.8 |
| NKAIN4 AND NOT-ROR1 | Oligodendroglioma | 0.8889 | 1 | 0.8 | NKAIN4 AND NOT-PTPRN | Oligodendroglioma | 0.8889 | 1 | 0.8 |
| NKAIN4 AND NOT-P2RX5 | Oligodendroglioma | 0.8889 | 1 | 0.8 | NKAIN4 AND NOT-PTPRO | Oligodendroglioma | 0.8889 | 1 | 0.8 |
| NKAIN4 AND NOT-RNF43 | Oligodendroglioma | 0.8889 | 1 | 0.8 | NKAIN4 AND NOT-CX3CL1 | Oligodendroglioma | 0.8889 | 1 | 0.8 |
| NKAIN4 AND NOT-PTK7 | Oligodendroglioma | 0.8889 | 1 | 0.8 | NKAIN4 AND NOT-PCDH19 | Oligodendroglioma | 0.8889 | 1 | 0.8 |
| NKAIN4 AND NOT-SLAMF7 | Oligodendroglioma | 0.8889 | 1 | 0.8 | NKAIN4 AND NOT-SLC16A2 | Oligodendroglioma | 0.8889 | 1 | 0.8 |
| NKAIN4 AND NOT-SDC1 | Oligodendroglioma | 0.8889 | 1 | 0.8 | NKAIN4 AND NOT-SLC9A5 | Oligodendroglioma | 0.8889 | 1 | 0.8 |
| NKAIN4 AND NOT-SSTR1 | Oligodendroglioma | 0.8889 | 1 | 0.8 | NKAIN4 AND NOT-SLC12A1 | Oligodendroglioma | 0.8889 | 1 | 0.8 |
| NKAIN4 AND NOT-SSTR2 | Oligodendroglioma | 0.8889 | 1 | 0.8 | NKAIN4 AND NOT-SLC12A4 | Oligodendroglioma | 0.8889 | 1 | 0.8 |
| NKAIN4 AND NOT-CD79A | Oligodendroglioma | 0.8889 | 1 | 0.8 | NKAIN4 AND NOT-SLC15A2 | Oligodendroglioma | 0.8889 | 1 | 0.8 |
| NKAIN4 AND NOT-MUC16 | Oligodendroglioma | 0.8889 | 1 | 0.8 | NKAIN4 AND NOT-SLC16A1 | Oligodendroglioma | 0.8889 | 1 | 0.8 |
| NKAIN4 AND NOT-CD19 | Oligodendroglioma | 0.8889 | 1 | 0.8 | NKAIN4 AND NOT-SLC18A3 | Oligodendroglioma | 0.8889 | 1 | 0.8 |
| NKAIN4 AND NOT-CLDN6 | Oligodendroglioma | 0.8889 | 1 | 0.8 | NKAIN4 AND NOT-SRR | Oligodendroglioma | 0.8889 | 1 | 0.8 |
| NKAIN4 AND NOT-SSTR4 | Oligodendroglioma | 0.8889 | 1 | 0.8 | NKAIN4 AND NOT-SLCO2A1 | Oligodendroglioma | 0.8889 | 1 | 0.8 |
| NKAIN4 AND NOT-PROM1 | Oligodendroglioma | 0.8889 | 1 | 0.8 | NKAIN4 AND NOT-SLC22A3 | Oligodendroglioma | 0.8889 | 1 | 0.8 |
| NKAIN4 AND NOT-VTCN1 | Oligodendroglioma | 0.8889 | 1 | 0.8 | NKAIN4 AND NOT-CYP4F12 | Oligodendroglioma | 0.8889 | 1 | 0.8 |
| NKAIN4 AND NOT-MSLN | Oligodendroglioma | 0.8889 | 1 | 0.8 | NKAIN4 AND NOT-SMPD1 | Oligodendroglioma | 0.8889 | 1 | 0.8 |
| NKAIN4 AND NOT-MET | Oligodendroglioma | 0.8889 | 1 | 0.8 | NKAIN4 AND NOT-SIGLEC1 | Oligodendroglioma | 0.8889 | 1 | 0.8 |
| NKAIN4 AND NOT-FOLR1 | Oligodendroglioma | 0.8889 | 1 | 0.8 | NKAIN4 AND NOT-DST | Oligodendroglioma | 0.8889 | 1 | 0.8 |
| NKAIN4 AND NOT-SLC34A2 | Oligodendroglioma | 0.8889 | 1 | 0.8 | NKAIN4 AND NOT-SPINT1 | Oligodendroglioma | 0.8889 | 1 | 0.8 |
| NKAIN4 AND NOT-CD52 | Oligodendroglioma | 0.8889 | 1 | 0.8 | NKAIN4 AND NOT-BPI | Oligodendroglioma | 0.8889 | 1 | 0.8 |
| NKAIN4 AND NOT-RAET1E | Oligodendroglioma | 0.8889 | 1 | 0.8 | NKAIN4 AND NOT-BRCA1 | Oligodendroglioma | 0.8889 | 1 | 0.8 |
| NKAIN4 AND NOT-CLDN7 | Oligodendroglioma | 0.8889 | 1 | 0.8 | NKAIN4 AND NOT-SLC5A3 | Oligodendroglioma | 0.8889 | 1 | 0.8 |
| NKAIN4 AND NOT-CR2 | Oligodendroglioma | 0.8889 | 1 | 0.8 | NKAIN4 AND NOT-SLC4A2 | Oligodendroglioma | 0.8889 | 1 | 0.8 |
| NKAIN4 AND NOT-ENG | Oligodendroglioma | 0.8889 | 1 | 0.8 | NKAIN4 AND NOT-SDC2 | Oligodendroglioma | 0.8889 | 1 | 0.8 |
| NKAIN4 AND NOT-EPHB2 | Oligodendroglioma | 0.8889 | 1 | 0.8 | NKAIN4 AND NOT-ANO3 | Oligodendroglioma | 0.8889 | 1 | 0.8 |
| NKAIN4 AND NOT-ERBB2 | Oligodendroglioma | 0.8889 | 1 | 0.8 | NKAIN4 AND NOT-SELE | Oligodendroglioma | 0.8889 | 1 | 0.8 |
| NKAIN4 AND NOT-TPBG | Oligodendroglioma | 0.8889 | 1 | 0.8 | NKAIN4 AND NOT-CDH23 | Oligodendroglioma | 0.8889 | 1 | 0.8 |
| NKAIN4 AND NOT-SLC39A6 | Oligodendroglioma | 0.8889 | 1 | 0.8 | NKAIN4 AND NOT-C10orf54 | Oligodendroglioma | 0.8889 | 1 | 0.8 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NKAIN4 AND NOT-EPCAM | Oligodendroglioma | 0.8889 | 1 | 0.8 | NKAIN4 AND NOT-DNAJC1 | Oligodendroglioma | 0.8889 | 1 | 0.8 |
| NKAIN4 AND NOT-CD180 | Oligodendroglioma | 0.8889 | 1 | 0.8 | NKAIN4 AND NOT-SFRP1 | Oligodendroglioma | 0.8889 | 1 | 0.8 |
| NKAIN4 AND NOT-IL2RA | Oligodendroglioma | 0.8889 | 1 | 0.8 | NKAIN4 AND NOT-SGCG | Oligodendroglioma | 0.8889 | 1 | 0.8 |
| NKAIN4 AND NOT-IGF1R | Oligodendroglioma | 0.8889 | 1 | 0.8 | NKAIN4 AND NOT-CLEC7A | Oligodendroglioma | 0.8889 | 1 | 0.8 |
| NKAIN4 AND NOT-STEAP2 | Oligodendroglioma | 0.8889 | 1 | 0.8 | NKAIN4 AND NOT-SHH | Oligodendroglioma | 0.8889 | 1 | 0.8 |
| NKAIN4 AND NOT-B4GALNT1 | Oligodendroglioma | 0.8889 | 1 | 0.8 | NKAIN4 AND NOT-SLC26A6 | Oligodendroglioma | 0.8889 | 1 | 0.8 |
| NKAIN4 AND NOT-EPHA3 | Oligodendroglioma | 0.8889 | 1 | 0.8 | NKAIN4 AND NOT-SLC1A1 | Oligodendroglioma | 0.8889 | 1 | 0.8 |
| NKAIN4 AND NOT-FAP | Oligodendroglioma | 0.8462 | 1 | 0.7333 | NKAIN4 AND NOT-SLC4A3 | Oligodendroglioma | 0.8889 | 1 | 0.8 |
| NKAIN4 AND NOT-CD38 | Oligodendroglioma | 0.8462 | 1 | 0.7333 | NKAIN4 AND NOT-SLC1A4 | Oligodendroglioma | 0.8889 | 1 | 0.8 |
| NKAIN4 AND NOT-ERBB4 | Oligodendroglioma | 0.8462 | 1 | 0.7333 | KCNK15 AND NOT-THBD | Ovarian | 1 | 1 | 1 |
| KCNQ2 AND NOT-B4GALNT1 | Oligodendroglioma | 0.8387 | 0.8125 | 0.8667 | KCNK15 AND NOT-GHR | Ovarian | 0.9231 | 0.8571 | 1 |
| MUC16 AND NOT-STEAP4 | Ovarian | 0.8 | 1 | 0.6667 | KCNK15 AND NOT-PROCR | Ovarian | 0.96 | 0.9231 | 1 |
| MUC16 AND NOT-CD74 | Ovarian | 0.7619 | 0.8889 | 0.6667 | KCNK15 AND NOT-KCNK6 | Ovarian | 1 | 1 | 1 |
| MUC16 AND NOT-ANTXR2 | Ovarian | 0.7273 | 0.8 | 0.6667 | KCNK15 AND NOT-ANTXR2 | Ovarian | 1 | 1 | 1 |
| EPHA10 AND NOT-P2RX5 | Ovarian | 0.7273 | 0.8 | 0.6667 | KCNK15 AND NOT-PTGER4 | Ovarian | 0.8889 | 0.8 | 1 |
| EPHA10 AND NOT-CLDN5 | Ovarian | 0.7826 | 0.8182 | 0.75 | KCNK15 AND NOT-GYPC | Ovarian | 0.9231 | 0.8571 | 1 |
| MUC16 AND NOT-CD44 | Ovarian | 0.8 | 1 | 0.6667 | KCNK15 AND NOT-GPR137B | Ovarian | 0.9231 | 0.8571 | 1 |
| MUC16 AND NOT-PCDH15 | Ovarian | 0.7 | 0.875 | 0.5833 | KCNK15 AND NOT-PHLDB2 | Ovarian | 0.8571 | 0.75 | 1 |
| MUC16 AND NOT-PPAPDC1B | Ovarian | 0.6957 | 0.7273 | 0.6667 | KCNK15 AND NOT-TTYH2 | Ovarian | 0.9167 | 0.9167 | 0.9167 |
| MUC16 AND NOT-MRGPRF | Ovarian | 0.6667 | 1 | 0.5 | KCNK15 AND NOT-KCNA4 | Ovarian | 0.9167 | 0.9167 | 0.9167 |
| EPHA10 AND NOT-ENG | Ovarian | 0.6667 | 0.6667 | 0.6667 | KCNK15 AND NOT-CD163 | Ovarian | 0.96 | 0.9231 | 1 |
| MUC16 AND NOT-ALCAM | Ovarian | 0.6667 | 0.6667 | 0.6667 | KCNK15 AND NOT-ADAM2 | Ovarian | 0.9091 | 1 | 0.8333 |
| MUC16 AND NOT-ADAM2 | Ovarian | 0.6667 | 1 | 0.5 | KCNK15 AND NOT-PTGIS | Ovarian | 0.8571 | 0.75 | 1 |
| EPHA10 AND NOT-AXL | Ovarian | 0.6429 | 0.5625 | 0.75 | KCNK15 AND NOT-EMP3 | Ovarian | 0.9091 | 1 | 0.8333 |
| EPHA10 AND NOT-SSTR1 | Ovarian | 0.64 | 0.6154 | 0.6667 | KCNK15 AND NOT-DTNA | Ovarian | 0.8571 | 0.75 | 1 |
| EPHA10 AND NOT-FCRL2 | Ovarian | 0.64 | 0.6154 | 0.6667 | KCNK15 AND NOT-SLC39A8 | Ovarian | 0.8696 | 0.9091 | 0.8333 |
| EPHA10 AND NOT-CXCR5 | Ovarian | 0.6364 | 0.7 | 0.5833 | KCNK15 AND NOT-SCARA5 | Ovarian | 1 | 1 | 1 |
| MUC16 AND NOT-USH2A | Ovarian | 0.6316 | 0.8571 | 0.5 | KCNK15 AND NOT-CD44 | Ovarian | 0.96 | 0.9231 | 1 |
| EPHA10 AND NOT-RAET1E | Ovarian | 0.6429 | 0.5625 | 0.75 | KCNK15 AND NOT-MTNR1B | Ovarian | 0.8571 | 1 | 0.75 |
| EPHA10 AND NOT-PTK7 | Ovarian | 0.6667 | 0.6 | 0.75 | KCNK15 AND NOT-IL17RA | Ovarian | 0.9231 | 0.8571 | 1 |
| MUC16 AND NOT-LRIG3 | Ovarian | 0.6154 | 0.5714 | 0.6667 | KCNK15 AND NOT-ATP8B2 | Ovarian | 0.9231 | 0.8571 | 1 |
| EPHA10 AND NOT-CLDN8 | Ovarian | 0.6154 | 0.5714 | 0.6667 | KCNK15 AND NOT-BTN3A1 | Ovarian | 0.8571 | 0.75 | 1 |
| MUC16 AND NOT-CDH9 | Ovarian | 0.6154 | 0.5714 | 0.6667 | KCNK15 AND NOT-LAT | Ovarian | 0.9231 | 0.8571 | 1 |
| EPHA10 AND NOT-CSPG4 | Ovarian | 0.6154 | 0.5714 | 0.6667 | KCNK15 AND NOT-MLNR | Ovarian | 0.8182 | 0.9 | 0.75 |
| EPHA10 AND NOT-ULBP1 | Ovarian | 0.6087 | 0.6364 | 0.5833 | KCNK15 AND NOT-KCNK12 | Ovarian | 0.8182 | 0.9 | 0.75 |
| MUC16 AND NOT-CLDN10 | Ovarian | 0.6087 | 0.6364 | 0.5833 | KCNK15 AND NOT-PCDHA6 | Ovarian | 0.8182 | 0.9 | 0.75 |
| MUC16 AND NOT-SLC6A6 | Ovarian | 0.6087 | 0.6364 | 0.5833 | KCNK15 AND NOT-GRID2 | Ovarian | 0.8182 | 0.9 | 0.75 |
| MUC16 AND NOT-ANPEP | Ovarian | 0.6316 | 0.8571 | 0.5 | KCNK15 AND NOT-ATP1B4 | Ovarian | 0.8696 | 0.9091 | 0.8333 |
| MUC16 AND NOT-GYPC | Ovarian | 0.7273 | 0.8 | 0.6667 | KCNK15 AND NOT-PLVAP | Ovarian | 0.8571 | 0.75 | 1 |
| EPHA10 AND NOT-CD276 | Ovarian | 0.6207 | 0.5294 | 0.75 | KCNK15 AND NOT-AOC3 | Ovarian | 0.8571 | 0.75 | 1 |
| EPHA10 AND NOT-CD19 | Ovarian | 0.6923 | 0.6429 | 0.75 | KCNK15 AND NOT-CD93 | Ovarian | 0.96 | 0.9231 | 1 |
| MUC16 AND NOT-TAS2R1 | Ovarian | 0.6 | 0.75 | 0.5 | KCNK15 AND NOT-SELP | Ovarian | 1 | 1 | 1 |
| EPHA10 AND NOT-SSTR2 | Ovarian | 0.6923 | 0.6429 | 0.75 | KCNK15 AND NOT-CDH11 | Ovarian | 0.8276 | 0.7059 | 1 |
| ERBB4 AND NOT-ANO4 | Ovarian | 0.6087 | 0.6364 | 0.5833 | KCNK15 AND NOT-PCDH11Y | Ovarian | 0.8333 | 0.8333 | 0.8333 |
| EPHA10 AND NOT-CD34 | Ovarian | 0.6207 | 0.5294 | 0.75 | KCNK15 AND NOT-STAB1 | Ovarian | 0.8 | 0.6667 | 1 |
| KCNU1 AND NOT-CXCR5 | Ovarian | 0.7273 | 0.8 | 0.6667 | KCNK15 AND NOT-SLC23A2 | Ovarian | 0.8 | 0.6667 | 1 |
| STEAP2 AND NOT-SLC16A5 | Prostate | 0.8571 | 1 | 0.75 | KCNK15 AND NOT-MRGPRF | Ovarian | 0.8 | 0.6667 | 1 |
| STEAP2 AND NOT-SLC39A2 | Prostate | 1 | 1 | 1 | KCNK15 AND NOT-S1PR1 | Ovarian | 0.8 | 0.6667 | 1 |
| TRPM8 AND NOT-B4GALNT1 | Prostate | 0.8571 | 1 | 0.75 | KCNK15 AND NOT-PCDH15 | Ovarian | 0.8 | 0.6667 | 1 |
| STEAP2 AND NOT-SLC4A8 | Prostate | 0.8889 | 0.8 | 1 | KCNK15 AND NOT-PIK3IP1 | Ovarian | 0.8 | 0.6667 | 1 |
| TRPM8 AND NOT-NCAM1 | Prostate | 0.8889 | 0.8 | 1 | KCNK15 AND NOT-ESAM | Ovarian | 0.8 | 0.6667 | 1 |
| STEAP2 AND NOT-NRG3 | Prostate | 0.8571 | 1 | 0.75 | KCNK15 AND NOT-ASTN1 | Ovarian | 0.8 | 0.6667 | 1 |
| STEAP2 AND NOT-SYT4 | Prostate | 0.8 | 0.6667 | 1 | KCNK15 AND NOT-ABCA12 | Ovarian | 0.9167 | 0.9167 | 0.9167 |
| TRPM8 AND NOT-LGR5 | Prostate | 0.8889 | 0.8 | 1 | KCNK15 AND NOT-IL15RA | Ovarian | 0.9231 | 0.8571 | 1 |
| TRPM8 AND NOT-IL3RA | Prostate | 0.8571 | 1 | 0.75 | KCNK15 AND NOT-CD74 | Ovarian | 0.8 | 0.6667 | 1 |
| STEAP2 AND NOT-GRIN2C | Prostate | 0.8889 | 0.8 | 1 | KCNK15 AND NOT-CACNG4 | Ovarian | 0.7857 | 0.6875 | 0.9167 |
| TRPM8 AND NOT-DPEP1 | Prostate | 0.8571 | 1 | 0.75 | KCNK15 AND NOT-NMBR | Ovarian | 0.7857 | 0.6875 | 0.9167 |
| STEAP1 AND NOT-SLC22A18 | Prostate | 0.8571 | 1 | 0.75 | KCNK15 AND NOT-LPPR3 | Ovarian | 0.7826 | 0.8182 | 0.75 |
| TRPM8 AND NOT-FOLR1 | Prostate | 0.8571 | 1 | 0.75 | EPHA10 AND NOT-ITM2A | Ovarian | 0.8571 | 1 | 0.75 |
| TRPM8 AND NOT-KDR | Prostate | 0.8 | 0.6667 | 1 | KCNK15 AND NOT-FXYD6 | Ovarian | 0.8571 | 0.75 | 1 |
| TRPM8 AND NOT-PSCA | Prostate | 1 | 1 | 1 | KCNK15 AND NOT-CD58 | Ovarian | 0.7742 | 0.6316 | 1 |
| STEAP1 AND NOT-DYSF | Prostate | 0.75 | 0.75 | 0.75 | KCNK15 AND NOT-SLC9A1 | Ovarian | 0.7742 | 0.6316 | 1 |
| STEAP2 AND NOT-SLC17A2 | Prostate | 0.75 | 0.75 | 0.75 | KCNK15 AND NOT-ATP8A1 | Ovarian | 0.7742 | 0.6316 | 1 |
| STEAP1 AND NOT-CD36 | Prostate | 0.75 | 0.75 | 0.75 | KCNK15 AND NOT-TMEM235 | Ovarian | 0.7742 | 0.6316 | 1 |
| STEAP2 AND NOT-SLC9A1 | Prostate | 0.75 | 0.75 | 0.75 | KCNK15 AND NOT-SYT4 | Ovarian | 0.7742 | 0.6316 | 1 |
| STEAP1 AND NOT-PTGER4 | Prostate | 0.75 | 0.75 | 0.75 | KCNK15 AND NOT-FAT1 | Ovarian | 0.7742 | 0.6316 | 1 |
| STEAP2 AND NOT-CALN1 | Prostate | 0.75 | 0.75 | 0.75 | KCNK15 AND NOT-MEGF11 | Ovarian | 0.7742 | 0.6316 | 1 |
| TRPM8 AND NOT-EDNRB | Prostate | 0.75 | 0.75 | 0.75 | KCNK15 AND NOT-LRRN4 | Ovarian | 0.7742 | 0.6316 | 1 |
| STEAP2 AND NOT-MLC1 | Prostate | 0.75 | 0.75 | 0.75 | KCNK15 AND NOT-PPAPDC1A | Ovarian | 0.7742 | 0.6316 | 1 |
| TRPM8 AND NOT-MUC16 | Prostate | 0.75 | 0.75 | 0.75 | KCNK15 AND NOT-MMP24 | Ovarian | 0.7742 | 0.6316 | 1 |
| STEAP2 AND NOT-FMNL1 | Prostate | 1 | 1 | 1 | KCNK15 AND NOT-ATP7A | Ovarian | 0.7742 | 0.6316 | 1 |
| STEAP2 AND NOT-GRIN2A | Prostate | 0.8571 | 1 | 0.75 | KCNK15 AND NOT-BTN3A3 | Ovarian | 0.7742 | 0.6316 | 1 |
| STEAP1 AND NOT-IL17RA | Prostate | 0.75 | 0.75 | 0.75 | KCNK15 AND NOT-SLC43A1 | Ovarian | 0.7742 | 0.6316 | 1 |
| GGTLC1 AND NOT-FOLR1 | Prostate | 0.8571 | 1 | 0.75 | KCNK15 AND NOT-PAQR7 | Ovarian | 0.7742 | 0.6316 | 1 |
| STEAP2 AND NOT-GYPC | Prostate | 0.7273 | 0.5714 | 1 | KCNK15 AND NOT-MSMO1 | Ovarian | 0.7742 | 0.6316 | 1 |
| STEAP2 AND NOT-SLC22A18 | Prostate | 0.7273 | 0.5714 | 1 | KCNK15 AND NOT-CNTNAP4 | Ovarian | 0.7742 | 0.6316 | 1 |
| STEAP2 AND NOT-ASTN1 | Prostate | 0.7273 | 0.5714 | 1 | KCNK15 AND NOT-SLC16A5 | Ovarian | 0.7742 | 0.6316 | 1 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| STEAP2 AND NOT-EPHA2 | Prostate | 0.7273 | 0.5714 | 1 | KCNK15 AND NOT-CLDN15 | Ovarian | 0.7742 | 0.6316 | 1 |
| STEAP2 AND NOT-CLDN10 | Prostate | 0.7273 | 0.5714 | 1 | KCNK15 AND NOT-GABRG1 | Ovarian | 0.7742 | 0.6316 | 1 |
| STEAP2 AND NOT-CSMD3 | Prostate | 0.7273 | 0.5714 | 1 | KCNK15 AND NOT-SMPD2 | Ovarian | 0.7742 | 0.6316 | 1 |
| TRPM8 AND NOT-SDC1 | Prostate | 0.7273 | 0.5714 | 1 | KCNK15 AND NOT-ATP8A2 | Ovarian | 0.7742 | 0.6316 | 1 |
| TRPM8 AND NOT-TNFRSF17 | Prostate | 0.7273 | 0.5714 | 1 | KCNK15 AND NOT-DPP10 | Ovarian | 0.7742 | 0.6316 | 1 |
| TRPM8 AND NOT-L1CAM | Prostate | 0.7273 | 0.5714 | 1 | KCNK15 AND NOT-GABRB2 | Ovarian | 0.7742 | 0.6316 | 1 |
| STEAP2 AND NOT-GUCY2D | Prostate | 0.7273 | 0.5714 | 1 | KCNK15 AND NOT-NKAIN2 | Ovarian | 0.7742 | 0.6316 | 1 |
| STEAP2 AND NOT-PAQR8 | Prostate | 0.7273 | 0.5714 | 1 | KCNK15 AND NOT-GABRA2 | Ovarian | 0.7742 | 0.6316 | 1 |
| TRPM8 AND NOT-CD72 | Prostate | 0.7273 | 0.5714 | 1 | KCNK15 AND NOT-ALCAM | Ovarian | 0.7742 | 0.6316 | 1 |
| STEAP2 AND NOT-LAT | Prostate | 0.7273 | 0.5714 | 1 | KCNK15 AND NOT-LRRC8E | Ovarian | 0.7742 | 0.6316 | 1 |
| STEAP2 AND NOT-PAQR7 | Prostate | 0.7273 | 0.5714 | 1 | KCNK15 AND NOT-NPHS2 | Ovarian | 0.7742 | 0.6316 | 1 |
| STEAP2 AND NOT-DCC | Prostate | 0.7273 | 0.5714 | 1 | KCNK15 AND NOT-OR10J1 | Ovarian | 0.7742 | 0.6316 | 1 |
| STEAP2 AND NOT-TTYH2 | Prostate | 0.7273 | 0.5714 | 1 | KCNK15 AND NOT-CD36 | Ovarian | 0.7742 | 0.6316 | 1 |
| STEAP2 AND NOT-CD36 | Prostate | 0.7273 | 0.5714 | 1 | KCNK15 AND NOT-SLC22A18 | Ovarian | 0.8333 | 0.8333 | 0.8333 |
| STEAP2 AND NOT-SEMA4D | Prostate | 0.7273 | 0.5714 | 1 | KCNK15 AND NOT-ERVW-1 | Ovarian | 0.7692 | 0.7143 | 0.8333 |
| FAP AND NOT-NFASC | Sarcoma | 0.8667 | 1 | 0.7647 | KCNK15 AND NOT-TRPM1 | Ovarian | 0.7692 | 0.7143 | 0.8333 |
| FAP AND NOT-AOC3 | Sarcoma | 0.8276 | 1 | 0.7059 | KCNK15 AND NOT-LRFN2 | Ovarian | 0.7692 | 0.7143 | 0.8333 |
| FAP AND NOT-CLDN10 | Sarcoma | 0.8276 | 1 | 0.7059 | CSPG5 AND NOT-TSPAN5 | Ovarian | 0.8 | 1 | 0.6667 |
| FAP AND NOT-PAQR7 | Sarcoma | 0.8276 | 1 | 0.7059 | CSPG5 AND NOT-SLC6A1 | Ovarian | 0.7619 | 0.8889 | 0.6667 |
| FAP AND NOT-ATP13A5 | Sarcoma | 0.8276 | 1 | 0.7059 | KCNK15 AND NOT-XCR1 | Ovarian | 0.7586 | 0.6471 | 0.9167 |
| FAP AND NOT-NRG3 | Sarcoma | 0.8667 | 1 | 0.7647 | KCNK15 AND NOT-CLSTN3 | Ovarian | 0.7586 | 0.6471 | 0.9167 |
| FAP AND NOT-NKAIN1 | Sarcoma | 0.7857 | 1 | 0.6471 | KCNK15 AND NOT-TAS1R1 | Ovarian | 0.7586 | 0.6471 | 0.9167 |
| FAP AND NOT-GPR6 | Sarcoma | 0.7857 | 1 | 0.6471 | KCNK15 AND NOT-USH2A | Ovarian | 0.7586 | 0.6471 | 0.9167 |
| FAP AND NOT-SELP | Sarcoma | 0.7407 | 1 | 0.5882 | KCNK15 AND NOT-PAQR8 | Ovarian | 0.8696 | 0.9091 | 0.8333 |
| FAP AND NOT-KCNA2 | Sarcoma | 0.7407 | 1 | 0.5882 | KCNK15 AND NOT-NFASC | Ovarian | 0.75 | 0.75 | 0.75 |
| FAP AND NOT-GRIN1 | Sarcoma | 0.7407 | 1 | 0.5882 | KCNK15 AND NOT-ANO4 | Ovarian | 0.75 | 0.75 | 0.75 |
| FAP AND NOT-DGKE | Sarcoma | 0.7857 | 1 | 0.6471 | KCNK15 AND NOT-GGTLC1 | Ovarian | 0.75 | 0.75 | 0.75 |
| FAP AND NOT-SLC1A6 | Sarcoma | 0.8276 | 1 | 0.7059 | EPHA10 AND NOT-STIM1 | Ovarian | 0.8571 | 1 | 0.75 |
| FAP AND NOT-SLC16A5 | Sarcoma | 0.7407 | 1 | 0.5882 | TRPM8 AND NOT-SLC2A5 | Prostate | 1 | 1 | 1 |
| FAP AND NOT-AGTR2 | Sarcoma | 0.8667 | 1 | 0.7647 | OR51E2 AND NOT-IL17RA | Prostate | 0.8889 | 0.8 | 1 |
| FAP AND NOT-GUCY2F | Sarcoma | 0.8276 | 1 | 0.7059 | OR51E2 AND NOT-EMP3 | Prostate | 0.8889 | 0.8 | 1 |
| FAP AND NOT-GGTLC1 | Sarcoma | 0.7857 | 1 | 0.6471 | OR51E2 AND NOT-CD36 | Prostate | 0.8889 | 0.8 | 1 |
| FAP AND NOT-RXFP3 | Sarcoma | 0.7857 | 1 | 0.6471 | TRPM8 AND NOT-FADS2 | Prostate | 0.8889 | 0.8 | 1 |
| FAP AND NOT-CD1A | Sarcoma | 0.7407 | 1 | 0.5882 | OR51E2 AND NOT-CHRNA2 | Prostate | 0.8889 | 0.8 | 1 |
| FAP AND NOT-KCNK6 | Sarcoma | 0.7857 | 1 | 0.6471 | OR51E2 AND NOT-SLC16A5 | Prostate | 0.8889 | 0.8 | 1 |
| FAP AND NOT-AQP6 | Sarcoma | 0.7407 | 1 | 0.5882 | OR51E2 AND NOT-GABRA1 | Prostate | 0.8889 | 0.8 | 1 |
| FAP AND NOT-LHFPL5 | Sarcoma | 0.8667 | 1 | 0.7647 | OR51E2 AND NOT-SEMA4D | Prostate | 0.8889 | 0.8 | 1 |
| FAP AND NOT-SLC22A9 | Sarcoma | 0.7407 | 1 | 0.5882 | OR51E2 AND NOT-GUCY2D | Prostate | 0.8889 | 0.8 | 1 |
| FAP AND NOT-LPPR3 | Sarcoma | 0.8667 | 1 | 0.7647 | OR51E2 AND NOT-SLC22A18 | Prostate | 0.8889 | 0.8 | 1 |
| FAP AND NOT-MMP24 | Sarcoma | 0.7407 | 1 | 0.5882 | OR51E2 AND NOT-SYT4 | Prostate | 0.8889 | 0.8 | 1 |
| FAP AND NOT-MTNR1B | Sarcoma | 0.8667 | 1 | 0.7647 | OR51E2 AND NOT-SLC5A2 | Prostate | 0.8889 | 0.8 | 1 |
| FAP AND NOT-CACNG4 | Sarcoma | 0.8276 | 1 | 0.7059 | OR51E2 AND NOT-PTGER4 | Prostate | 0.8889 | 0.8 | 1 |
| FAP AND NOT-MRGPRF | Sarcoma | 0.7857 | 1 | 0.6471 | OR51E2 AND NOT-TNFRSF10B | Prostate | 0.8889 | 0.8 | 1 |
| STAB1 AND NOT-CLDN6 | Sarcoma | 0.7273 | 0.75 | 0.7059 | OR51E2 AND NOT-CDH10 | Prostate | 0.8889 | 0.8 | 1 |
| FAP AND NOT-XCR1 | Sarcoma | 0.8276 | 1 | 0.7059 | OR51E2 AND NOT-GYPC | Prostate | 0.8889 | 0.8 | 1 |
| FAP AND NOT-GPR135 | Sarcoma | 0.7407 | 1 | 0.5882 | OR51E2 AND NOT-SHISA9 | Prostate | 0.8889 | 0.8 | 1 |
| FAP AND NOT-ADAM30 | Sarcoma | 0.8276 | 1 | 0.7059 | TRPM8 AND NOT-FZD1 | Prostate | 0.8889 | 0.8 | 1 |
| FAP AND NOT-GALR1 | Sarcoma | 0.7857 | 1 | 0.6471 | OR51E2 AND NOT-STAB1 | Prostate | 0.8889 | 0.8 | 1 |
| FAP AND NOT-OR8D1 | Sarcoma | 0.8667 | 1 | 0.7647 | OR51E2 AND NOT-EPHA2 | Prostate | 0.8889 | 0.8 | 1 |
| FAP AND NOT-CLDN19 | Sarcoma | 0.7857 | 1 | 0.6471 | TRPM8 AND NOT-SGCD | Prostate | 1 | 1 | 1 |
| FAP AND NOT-CDH9 | Sarcoma | 0.8667 | 1 | 0.7647 | OR51E2 AND NOT-DYSF | Prostate | 0.8889 | 0.8 | 1 |
| FAP AND NOT-ABCG8 | Sarcoma | 0.8276 | 1 | 0.7059 | TRPM8 AND NOT-SLC52A3 | Prostate | 0.8889 | 0.8 | 1 |
| FAP AND NOT-OR3A1 | Sarcoma | 0.8667 | 1 | 0.7647 | OR51E2 AND NOT-PAQR8 | Prostate | 0.8889 | 0.8 | 1 |
| FAP AND NOT-KIRREL2 | Sarcoma | 0.7857 | 1 | 0.6471 | OR51E2 AND NOT-NFASC | Prostate | 0.8889 | 0.8 | 1 |
| FAP AND NOT-KCNQ2 | Sarcoma | 0.7407 | 1 | 0.5882 | OR51E2 AND NOT-BEST3 | Prostate | 0.8889 | 0.8 | 1 |
| FAP AND NOT-ATP2B2 | Sarcoma | 0.7407 | 1 | 0.5882 | OR51E2 AND NOT-CD207 | Prostate | 0.8889 | 0.8 | 1 |
| FAP AND NOT-SLC17A2 | Sarcoma | 0.7857 | 1 | 0.6471 | OR51E2 AND NOT-CNTNAP2 | Prostate | 0.8889 | 0.8 | 1 |
| FAP AND NOT-KCNJ10 | Sarcoma | 0.7857 | 1 | 0.6471 | OR51E2 AND NOT-SLC4A8 | Prostate | 0.8889 | 0.8 | 1 |
| FAP AND NOT-TSPAN16 | Sarcoma | 0.8667 | 1 | 0.7647 | OR51E2 AND NOT-LAT | Prostate | 0.8889 | 0.8 | 1 |
| FAP AND NOT-SLC6A11 | Sarcoma | 0.8276 | 1 | 0.7059 | OR51E2 AND NOT-TNFRSF12A | Prostate | 0.8889 | 0.8 | 1 |
| FAP AND NOT-SLC5A11 | Sarcoma | 0.8276 | 1 | 0.7059 | OR51E2 AND NOT-NOX1 | Prostate | 0.8889 | 0.8 | 1 |
| FAP AND NOT-KCNA7 | Sarcoma | 0.7407 | 1 | 0.5882 | OR51E2 AND NOT-CLDN10 | Prostate | 0.8889 | 0.8 | 1 |
| FAP AND NOT-CLCN1 | Sarcoma | 0.7407 | 1 | 0.5882 | OR51E2 AND NOT-KCNJ10 | Prostate | 0.8889 | 0.8 | 1 |
| FAP AND NOT-CATSPER3 | Sarcoma | 0.7407 | 1 | 0.5882 | OR51E2 AND NOT-BTN3A1 | Prostate | 0.8889 | 0.8 | 1 |
| FAP AND NOT-VN1R2 | Sarcoma | 0.7407 | 1 | 0.5882 | OR51E2 AND NOT-SLC6A6 | Prostate | 0.8889 | 0.8 | 1 |
| FAP AND NOT-CDH17 | Sarcoma | 0.8276 | 1 | 0.7059 | OR51E2 AND NOT-FMNL1 | Prostate | 1 | 1 | 1 |
| FAP AND NOT-KREMEN2 | Sarcoma | 0.7857 | 1 | 0.6471 | TRPM8 AND NOT-LSAMP | Prostate | 1 | 1 | 1 |
| FAP AND NOT-SLC22A6 | Sarcoma | 0.7857 | 1 | 0.6471 | OR51E2 AND NOT-SLC39A2 | Prostate | 1 | 1 | 1 |
| FAP AND NOT-GRM3 | Sarcoma | 0.7407 | 1 | 0.5882 | OR51E2 AND NOT-SCN8A | Prostate | 0.8889 | 0.8 | 1 |
| FAP AND NOT-UMOD | Sarcoma | 0.7857 | 1 | 0.6471 | OR51E2 AND NOT-PCDH8 | Prostate | 0.8889 | 0.8 | 1 |
| FAP AND NOT-HRH3 | Sarcoma | 0.7407 | 1 | 0.5882 | OR51E2 AND NOT-BST2 | Prostate | 0.8889 | 0.8 | 1 |
| FAP AND NOT-RGSL1 | Sarcoma | 0.8667 | 1 | 0.7647 | OR51E2 AND NOT-TTYH2 | Prostate | 0.8889 | 0.8 | 1 |
| FAP AND NOT-PVRL1 | Sarcoma | 0.8667 | 1 | 0.7647 | OR51E2 AND NOT-CEACAM7 | Prostate | 0.8889 | 0.8 | 1 |
| FAP AND NOT-IGDCC3 | Sarcoma | 0.8276 | 1 | 0.7059 | OR51E2 AND NOT-PIK3IP1 | Prostate | 0.8889 | 0.8 | 1 |
| FAP AND NOT-CD207 | Sarcoma | 0.8276 | 1 | 0.7059 | TRPM8 AND NOT-IL6ST | Prostate | 0.8571 | 1 | 0.75 |
| FAP AND NOT-MLC1 | Sarcoma | 0.8667 | 1 | 0.7647 | TRPM8 AND NOT-ANTXR1 | Prostate | 0.8571 | 1 | 0.75 |
| FAP AND NOT-OR5P3 | Sarcoma | 0.7857 | 1 | 0.6471 | TRPM8 AND NOT-IL6R | Prostate | 0.8571 | 1 | 0.75 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FAP AND NOT-GRM7 | Sarcoma | 0.6923 | 1 | 0.5294 | OR51E1 AND NOT-CD36 | Prostate | 0.8571 | 1 | 0.75 |
| FAP AND NOT-SEZ6 | Sarcoma | 0.6923 | 1 | 0.5294 | OR51E2 AND NOT-UPK3A | Prostate | 0.8889 | 0.8 | 1 |
| FAP AND NOT-UPK3A | Sarcoma | 0.6923 | 1 | 0.5294 | OR51E2 AND NOT-CSPG5 | Prostate | 0.8889 | 0.8 | 1 |
| FAP AND NOT-KCNK4 | Sarcoma | 0.6923 | 1 | 0.5294 | OR51E2 AND NOT-UMOD | Prostate | 0.8571 | 1 | 0.75 |
| FAP AND NOT-HCN4 | Sarcoma | 0.6923 | 1 | 0.5294 | TRPM8 AND NOT-TGOLN2 | Prostate | 0.8571 | 1 | 0.75 |
| FAP AND NOT-FXYD6 | Sarcoma | 0.6923 | 1 | 0.5294 | OR51E2 AND NOT-GRIN2A | Prostate | 0.8571 | 1 | 0.75 |
| FAP AND NOT-LAMP5 | Sarcoma | 0.6923 | 1 | 0.5294 | TRPM8 AND NOT-KL | Prostate | 0.8571 | 1 | 0.75 |
| FAP AND NOT-CACNG6 | Sarcoma | 0.8276 | 1 | 0.7059 | TRPM8 AND NOT-PCDH9 | Prostate | 0.8571 | 1 | 0.75 |
| FAP AND NOT-KCNA10 | Sarcoma | 0.6923 | 1 | 0.5294 | OR51E2 AND NOT-NRG3 | Prostate | 0.8571 | 1 | 0.75 |
| FAP AND NOT-GABBR2 | Sarcoma | 0.6923 | 1 | 0.5294 | OR51E1 AND NOT-DYSF | Prostate | 0.8571 | 1 | 0.75 |
| FAP AND NOT-GRM5 | Sarcoma | 0.8276 | 1 | 0.7059 | OR51E2 AND NOT-OR2C3 | Prostate | 0.8571 | 1 | 0.75 |
| FAP AND NOT-GRM1 | Sarcoma | 0.6923 | 1 | 0.5294 | TRPM8 AND NOT-KCNK3 | Prostate | 0.8571 | 1 | 0.75 |
| FAP AND NOT-PCDHB1 | Sarcoma | 0.8276 | 1 | 0.7059 | TRPM8 AND NOT-PTPRF | Prostate | 0.8571 | 1 | 0.75 |
| FAP AND NOT-NPHS1 | Sarcoma | 0.8276 | 1 | 0.7059 | TRPM8 AND NOT-PRRT2 | Prostate | 0.8571 | 1 | 0.75 |
| FAP AND NOT-CACNG7 | Sarcoma | 0.7857 | 1 | 0.6471 | UPK3A AND NOT-SGCD | Prostate | 0.8571 | 1 | 0.75 |
| FAP AND NOT-KCNV1 | Sarcoma | 0.6923 | 1 | 0.5294 | OR51E1 AND NOT-IL17RA | Prostate | 0.8571 | 1 | 0.75 |
| FAP AND NOT-KCNK16 | Sarcoma | 0.7407 | 1 | 0.5882 | OR51E2 AND NOT-GRM1 | Prostate | 0.8889 | 0.8 | 1 |
| FAP AND NOT-ADAM2 | Sarcoma | 0.8276 | 1 | 0.7059 | OR51E2 AND NOT-HTR1E | Prostate | 0.8889 | 0.8 | 1 |
| FAP AND NOT-EPHA8 | Sarcoma | 0.8276 | 1 | 0.7059 | OR51E2 AND NOT-HTR1D | Prostate | 0.8889 | 0.8 | 1 |
| FAP AND NOT-ATP6V0A4 | Sarcoma | 0.8276 | 1 | 0.7059 | OR51E2 AND NOT-VN1R2 | Prostate | 0.8889 | 0.8 | 1 |
| FAP AND NOT-SLC4A5 | Sarcoma | 0.8276 | 1 | 0.7059 | OR51E2 AND NOT-CLDN16 | Prostate | 0.8889 | 0.8 | 1 |
| FAP AND NOT-SLC23A2 | Sarcoma | 0.7857 | 1 | 0.6471 | OR51E2 AND NOT-MDGA2 | Prostate | 0.8889 | 0.8 | 1 |
| FAP AND NOT-KCNH1 | Sarcoma | 0.7857 | 1 | 0.6471 | OR51E2 AND NOT-SLC5A8 | Prostate | 0.8889 | 0.8 | 1 |
| FAP AND NOT-TMPRSS11E | Sarcoma | 0.7857 | 1 | 0.6471 | OR51E2 AND NOT-GRM3 | Prostate | 0.8889 | 0.8 | 1 |
| FAP AND NOT-GPR37L1 | Sarcoma | 0.8276 | 1 | 0.7059 | OR51E2 AND NOT-OR1Q1 | Prostate | 0.8889 | 0.8 | 1 |
| FAP AND NOT-PCDH11Y | Sarcoma | 0.6923 | 1 | 0.5294 | OR51E2 AND NOT-GRM5 | Prostate | 0.8889 | 0.8 | 1 |
| FAP AND NOT-BEST2 | Sarcoma | 0.7407 | 1 | 0.5882 | OR51E2 AND NOT-GRM4 | Prostate | 0.8889 | 0.8 | 1 |
| FAP AND NOT-SLC34A1 | Sarcoma | 0.8276 | 1 | 0.7059 | OR51E2 AND NOT-PCDHB1 | Prostate | 0.8889 | 0.8 | 1 |
| FAP AND NOT-KIAA0319 | Sarcoma | 0.8276 | 1 | 0.7059 | OR51E2 AND NOT-GRM6 | Prostate | 0.8889 | 0.8 | 1 |
| CLDN18 AND NOT-AGER | Stomach | 0.75 | 0.7333 | 0.7674 | OR51E2 AND NOT-CHRND | Prostate | 0.8889 | 0.8 | 1 |
| CLDN18 AND NOT-EMP3 | Stomach | 0.7609 | 0.7143 | 0.814 | OR51E2 AND NOT-GRM7 | Prostate | 0.8889 | 0.8 | 1 |
| CLDN18 AND NOT-ROS1 | Stomach | 0.7416 | 0.7174 | 0.7674 | OR51E2 AND NOT-ERVW-1 | Prostate | 0.8889 | 0.8 | 1 |
| CLDN18 AND NOT-THBD | Stomach | 0.7356 | 0.7273 | 0.7442 | OR51E2 AND NOT-CYP4A11 | Prostate | 0.8889 | 0.8 | 1 |
| CLDN18 AND NOT-CD36 | Stomach | 0.7294 | 0.7381 | 0.7209 | OR51E2 AND NOT-KCNU1 | Prostate | 0.8889 | 0.8 | 1 |
| CLDN18 AND NOT-ICAM1 | Stomach | 0.75 | 0.7333 | 0.7674 | OR51E2 AND NOT-GRM8 | Prostate | 0.8889 | 0.8 | 1 |
| MUC13 AND NOT-SLC22A5 | Stomach | 0.8889 | 0.9474 | 0.8372 | OR51E2 AND NOT-GUCY2F | Prostate | 0.8889 | 0.8 | 1 |
| CLDN18 AND NOT-S1PR1 | Stomach | 0.7692 | 0.7292 | 0.814 | OR51E2 AND NOT-CDH8 | Prostate | 0.8889 | 0.8 | 1 |
| CLDN18 AND NOT-AOC3 | Stomach | 0.7711 | 0.8 | 0.7442 | OR51E2 AND NOT-CHRNB4 | Prostate | 0.8889 | 0.8 | 1 |
| CLDN18 AND NOT-FXYD6 | Stomach | 0.7143 | 0.7317 | 0.6977 | OR51E2 AND NOT-HTR2C | Prostate | 0.8889 | 0.8 | 1 |
| CDH17 AND NOT-CLDN8 | Stomach | 0.6964 | 0.5652 | 0.907 | OR51E2 AND NOT-KCND2 | Prostate | 0.8889 | 0.8 | 1 |
| CLDN18 AND NOT-LAPTM5 | Stomach | 0.7391 | 0.6939 | 0.7907 | OR51E2 AND NOT-HTR5A | Prostate | 0.8889 | 0.8 | 1 |
| CLDN18 AND NOT-ESAM | Stomach | 0.6905 | 0.7073 | 0.6744 | OR51E2 AND NOT-KCNC1 | Prostate | 0.8889 | 0.8 | 1 |
| CLDN18 AND NOT-SELP | Stomach | 0.7253 | 0.6875 | 0.7674 | OR51E2 AND NOT-SLC10A2 | Prostate | 0.8889 | 0.8 | 1 |
| CLDN18 AND NOT-GYPC | Stomach | 0.6966 | 0.6739 | 0.7209 | OR51E2 AND NOT-SLC10A1 | Prostate | 0.8889 | 0.8 | 1 |
| MUC17 AND NOT-ENPP3 | Stomach | 0.8378 | 1 | 0.7209 | OR51E2 AND NOT-KCNH1 | Prostate | 0.8889 | 0.8 | 1 |
| CLDN18 AND NOT-SLC17A3 | Stomach | 0.6829 | 0.7179 | 0.6512 | OR51E2 AND NOT-KCNJ6 | Prostate | 0.8889 | 0.8 | 1 |
| CLDN18 AND NOT-STEAP4 | Stomach | 0.6744 | 0.6744 | 0.6744 | OR51E2 AND NOT-KCNJ9 | Prostate | 0.8889 | 0.8 | 1 |
| CLDN18 AND NOT-CD163 | Stomach | 0.766 | 0.7059 | 0.8372 | OR51E2 AND NOT-GLRA3 | Prostate | 0.8889 | 0.8 | 1 |
| CLDN18 AND NOT-DYSF | Stomach | 0.7527 | 0.7 | 0.814 | OR51E2 AND NOT-TRPM3 | Prostate | 0.8889 | 0.8 | 1 |
| CDH17 AND NOT-ENPP3 | Stomach | 0.6726 | 0.5429 | 0.8837 | OR51E2 AND NOT-SLC8A3 | Prostate | 0.8889 | 0.8 | 1 |
| MUC17 AND NOT-CD160 | Stomach | 0.7714 | 1 | 0.6279 | OR51E2 AND NOT-KCNQ2 | Prostate | 0.8889 | 0.8 | 1 |
| MUC13 AND NOT-BEST2 | Stomach | 0.9762 | 1 | 0.9535 | TGFBI AND NOT-F11R | Sarcoma | 0.9375 | 1 | 0.8824 |
| CLDN18 AND NOT-SLC39A8 | Stomach | 0.6667 | 0.6591 | 0.6744 | TGFBI AND NOT-AQP3 | Sarcoma | 0.7857 | 1 | 0.6471 |
| MUC13 AND NOT-SORL1 | Stomach | 0.675 | 0.7297 | 0.6279 | CNTNAP1 AND NOT-NFASC | Sarcoma | 0.7879 | 0.8125 | 0.7647 |
| MUC13 AND NOT-SLC30A10 | Stomach | 0.9438 | 0.913 | 0.9767 | DDR2 AND NOT-AOC3 | Sarcoma | 0.7586 | 0.9167 | 0.6471 |
| MUC17 AND NOT-GUCY2C | Stomach | 0.7164 | 1 | 0.5581 | ATP8B2 AND NOT-ABCB1 | Sarcoma | 0.8 | 0.9231 | 0.7059 |
| MUC13 AND NOT-SLC22A18 | Stomach | 0.7436 | 0.8286 | 0.6744 | OSMR AND NOT-STEAP4 | Sarcoma | 0.8 | 0.9231 | 0.7059 |
| CLDN18 AND NOT-CD93 | Stomach | 0.6585 | 0.6923 | 0.6279 | OSMR AND NOT-NFASC | Sarcoma | 0.8276 | 1 | 0.7059 |
| MUC17 AND NOT-ABCA5 | Stomach | 0.7143 | 0.9259 | 0.5814 | ADAM12 AND NOT-SELP | Sarcoma | 0.7333 | 0.8462 | 0.6471 |
| CLDN18 AND NOT-CATSPERD | Stomach | 0.766 | 0.7059 | 0.8372 | ADAM12 AND NOT-NFASC | Sarcoma | 0.7692 | 0.6818 | 0.8824 |
| NOT-ATP8B1 AND ERBB2 | Ependymoma | 0.6667 | 0.5 | 1 | DDR2 AND NOT-KCNA2 | Sarcoma | 0.7407 | 1 | 0.5882 |
| NOT-PHLDB2 AND ROR1 | Ependymoma | 1 | 1 | 1 | OSMR AND NOT-AOC3 | Sarcoma | 0.8485 | 0.875 | 0.8235 |
| NOT-SLC6A6 AND SLC39A6 | Ependymoma | 0.6667 | 0.5 | 1 | OSMR AND NOT-SLC16A5 | Sarcoma | 0.8 | 0.9231 | 0.7059 |
| NOT-SLC6A6 AND SSTR3 | Ependymoma | 0.6667 | 0.5 | 1 | STAB1 AND NOT-GDPD2 | Sarcoma | 0.7742 | 0.8571 | 0.7059 |
| NOT-SLC6A6 AND SSTR5 | Ependymoma | 1 | 1 | 1 | ADAM12 AND NOT-SLC16A5 | Sarcoma | 0.7222 | 0.6842 | 0.7647 |
| NOT-CD36 AND CLDN18 | Esophagus | 0.6 | 1 | 0.4286 | STAB1 AND NOT-ABCB1 | Sarcoma | 0.7742 | 0.8571 | 0.7059 |
| NOT-IL11RA AND PROCR | Esophagus | 0.7333 | 0.6875 | 0.7857 | ADAM12 AND NOT-PAQR7 | Sarcoma | 0.7805 | 0.6667 | 0.9412 |
| NOT-IL11RA AND IL15RA | Esophagus | 0.75 | 0.9 | 0.6429 | DDR2 AND NOT-MRAP | Sarcoma | 0.8276 | 1 | 0.7059 |
| NOT-CD52 AND LAPTM5 | Glioblastoma | 0.7429 | 0.7222 | 0.7647 | STAB1 AND NOT-BPI | Sarcoma | 0.8276 | 1 | 0.7059 |
| NOT-STEAP4 AND ITGAV | Glioblastoma | 0.619 | 0.52 | 0.7647 | OSMR AND NOT-SELP | Sarcoma | 0.7143 | 0.9091 | 0.5882 |
| NOT-RNF43 AND VANGL1 | Leiomyosarcoma | 0.8889 | 0.8571 | 0.9231 | STAB1 AND NOT-CLEC1B | Sarcoma | 0.7407 | 1 | 0.5882 |
| NOT-EPCAM AND VANGL1 | Leiomyosarcoma | 0.8966 | 0.8125 | 1 | OSMR AND NOT-CLDN10 | Sarcoma | 0.7143 | 0.9091 | 0.5882 |
| NOT-ERBB3 AND FAT1 | Leiomyosarcoma | 0.7826 | 0.9 | 0.6923 | STAB1 AND NOT-ART4 | Sarcoma | 0.8276 | 1 | 0.7059 |
| NOT-ERBB3 AND CDH11 | Leiomyosarcoma | 0.6957 | 0.8 | 0.6154 | STAB1 AND NOT-KCNA3 | Sarcoma | 0.8276 | 1 | 0.7059 |
| NOT-ERBB3 AND VANGL1 | Leiomyosarcoma | 0.8462 | 0.8462 | 0.8462 | MMP14 AND NOT-PAQR7 | Sarcoma | 0.7407 | 1 | 0.5882 |
| NOT-IL20RA AND VANGL1 | Leiomyosarcoma | 0.64 | 0.6667 | 0.6154 | MMP14 AND NOT-CLDN19 | Sarcoma | 0.7407 | 1 | 0.5882 |
| NOT-CLDN10 AND CD276 | Leiomyosarcoma | 0.8 | 0.8333 | 0.7692 | ADAM12 AND NOT-CLDN10 | Sarcoma | 0.8125 | 0.8667 | 0.7647 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| NOT-ERBB3 AND LRIG3 | Leiomyosarcoma | 0.7619 | 1 | 0.6154 | STAB1 AND NOT-TSPAN7 | Sarcoma | 0.7857 | 1 | 0.6471 |
| NOT-ERBB3 AND FCAMR | Leiomyosarcoma | 0.6154 | 0.6154 | 0.6154 | STAB1 AND NOT-NPY1R | Sarcoma | 0.8276 | 1 | 0.7059 |
| NOT-ERBB3 AND PRND | Leiomyosarcoma | 0.7143 | 0.6667 | 0.7692 | STAB1 AND NOT-LSR | Sarcoma | 0.7857 | 1 | 0.6471 |
| NOT-ERBB3 AND MOG | Leiomyosarcoma | 0.6061 | 0.5 | 0.7692 | STAB1 AND NOT-NAALAD2 | Sarcoma | 0.7097 | 0.7857 | 0.6471 |
| NOT-CLDN10 AND AXL | Leiomyosarcoma | 0.6957 | 0.8 | 0.6154 | OSMR AND NOT-GGTLC1 | Sarcoma | 0.8387 | 0.9286 | 0.7647 |
| NOT-ERBB3 AND SLC39A8 | AML | 0.834 | 0.809 | 0.8606 | STAB1 AND NOT-KCNC4 | Sarcoma | 0.7742 | 0.8571 | 0.7059 |
| NOT-STEAP1 AND SLC39A8 | AML | 0.8208 | 0.7948 | 0.8486 | STAB1 AND NOT-ICAM4 | Sarcoma | 0.7333 | 0.8462 | 0.6471 |
| NOT-MET AND SLC39A8 | AML | 0.8131 | 0.7873 | 0.8406 | STAB1 AND NOT-SLC6A2 | Sarcoma | 0.7407 | 1 | 0.5882 |
| NOT-ITGAV AND P2RX4 | AML | 0.8127 | 0.7668 | 0.8645 | TGFBI AND NOT-SPINT1 | Sarcoma | 0.9091 | 0.9375 | 0.8824 |
| NOT-CLDN12 AND P2RX4 | AML | 0.8112 | 0.7641 | 0.8645 | STAB1 AND NOT-PCDHA10 | Sarcoma | 0.7742 | 0.8571 | 0.7059 |
| NOT-EDNRB AND SLC43A1 | AML | 0.8085 | 0.8676 | 0.757 | MMP14 AND NOT-ERVW-1 | Sarcoma | 0.7407 | 1 | 0.5882 |
| NOT-KDR AND SLC43A1 | AML | 0.8075 | 0.8502 | 0.7689 | MMP14 AND NOT-SLC22A11 | Sarcoma | 0.7407 | 1 | 0.5882 |
| NOT-ITGAV AND SLC39A8 | AML | 0.8043 | 0.863 | 0.753 | STAB1 AND NOT-SCN7A | Sarcoma | 0.7059 | 0.7059 | 0.7059 |
| NOT-GPR137B AND SLC7A5 | AML | 0.8031 | 0.7863 | 0.8207 | STAB1 AND NOT-ATP7B | Sarcoma | 0.7059 | 0.7059 | 0.7059 |
| NOT-ITGAV AND CD44 | AML | 0.8015 | 0.744 | 0.8685 | STAB1 AND NOT-MFSD3 | Sarcoma | 0.7097 | 0.7857 | 0.6471 |
| NOT-ITGAV AND PTGER4 | AML | 0.8015 | 0.7383 | 0.8765 | ITGA11 AND NOT-NFASC | Sarcoma | 0.8276 | 1 | 0.7059 |
| NOT-CLDN12 AND SLC39A8 | AML | 0.7958 | 0.8341 | 0.761 | ADAM12 AND NOT-MRAP | Sarcoma | 0.7907 | 0.6538 | 1 |
| NOT-ITGAV AND EMP3 | AML | 0.7928 | 0.7237 | 0.8765 | MMP14 AND NOT-SLC2A1 | Sarcoma | 0.7407 | 1 | 0.5882 |
| NOT-ITGAV AND SLC30A1 | AML | 0.7893 | 0.7152 | 0.8805 | FLRT2 AND NOT-NFASC | Sarcoma | 0.7407 | 1 | 0.5882 |
| NOT-AXL AND SLC39A8 | AML | 0.7885 | 0.8818 | 0.7131 | OSMR AND NOT-RGR | Sarcoma | 0.8387 | 0.9286 | 0.7647 |
| NOT-CLDN12 AND SLC30A1 | AML | 0.7883 | 0.6939 | 0.9124 | STAB1 AND NOT-BCAM | Sarcoma | 0.7586 | 0.9167 | 0.6471 |
| NOT-GPNMB AND SLC43A1 | AML | 0.7867 | 0.8894 | 0.7052 | STAB1 AND NOT-TSPAN32 | Sarcoma | 0.8276 | 1 | 0.7059 |
| NOT-AXL AND SLC43A1 | AML | 0.7804 | 0.8394 | 0.7291 | STAB1 AND NOT-CACNA1D | Sarcoma | 0.7742 | 0.8571 | 0.7059 |
| NOT-ITGAV AND FMNL1 | AML | 0.7794 | 0.7042 | 0.8725 | STAB1 AND NOT-KCNH6 | Sarcoma | 0.7407 | 1 | 0.5882 |
| NOT-EDNRB AND P2RX4 | AML | 0.7745 | 0.6565 | 0.9442 | STAB1 AND NOT-LTA | Sarcoma | 0.75 | 0.8 | 0.7059 |
| NOT-ITGAV AND SLCO1B3 | AML | 0.774 | 0.7086 | 0.8526 | STAB1 AND NOT-SYP | Sarcoma | 0.7407 | 1 | 0.5882 |
| NOT-EDNRB AND SLC39A8 | AML | 0.772 | 0.8906 | 0.6813 | FGFR1 AND NOT-KCNC2 | Sarcoma | 0.6923 | 1 | 0.5294 |
| NOT-CDH11 AND SLC7A5 | AML | 0.7709 | 0.6387 | 0.9721 | FGFR1 AND NOT-NPBWR1 | Sarcoma | 0.6923 | 1 | 0.5294 |
| NOT-ITGAV AND VAMP8 | AML | 0.77 | 0.6842 | 0.8805 | FGFR1 AND NOT-TMEM235 | Sarcoma | 0.6923 | 1 | 0.5294 |
| NOT-AXL AND SLC30A1 | AML | 0.77 | 0.634 | 0.9801 | FGFR1 AND NOT-KIAA0319 | Sarcoma | 0.6923 | 1 | 0.5294 |
| NOT-ITGAV AND ZDHHC2 | AML | 0.769 | 0.703 | 0.8486 | FGFR1 AND NOT-SLC4A8 | Sarcoma | 0.6923 | 1 | 0.5294 |
| NOT-ITGAV AND SLC43A1 | AML | 0.7682 | 0.8326 | 0.7131 | FGFR1 AND NOT-CHRNB4 | Sarcoma | 0.6923 | 1 | 0.5294 |
| NOT-EPCAM AND VANGL1 | Liposarcoma | 0.6296 | 0.9444 | 0.4722 | FGFR1 AND NOT-GPR22 | Sarcoma | 0.6923 | 1 | 0.5294 |
| NOT-SORL1 AND EPHB2 | Liposarcoma | 0.6452 | 0.7692 | 0.5556 | FGFR1 AND NOT-EPHA10 | Sarcoma | 0.6923 | 1 | 0.5294 |
| NOT-FAT1 AND GPNMB | B-Cell Diffuse | 0.6757 | 0.7407 | 0.6216 | FGFR1 AND NOT-GPR26 | Sarcoma | 0.6923 | 1 | 0.5294 |
| NOT-ATP8B1 AND GPNMB | B-Cell Diffuse | 0.6667 | 0.7188 | 0.6216 | FGFR1 AND NOT-TMPRSS11E | Sarcoma | 0.6923 | 1 | 0.5294 |
| NOT-LRIG3 AND GPNMB | B-Cell Diffuse | 0.64 | 0.6316 | 0.6486 | FGFR1 AND NOT-CLRN1 | Sarcoma | 0.6923 | 1 | 0.5294 |
| NOT-EMP3 AND IL2RA | Ovarian | 0.6667 | 1 | 0.5 | FGFR1 AND NOT-GRM3 | Sarcoma | 0.6923 | 1 | 0.5294 |
| NOT-KCNK12 AND CLDN9 | Ovarian | 0.6 | 0.75 | 0.5 | FGFR1 AND NOT-CDH20 | Sarcoma | 0.6923 | 1 | 0.5294 |
| NOT-GRID2 AND RNF43 | Ovarian | 0.6667 | 1 | 0.5 | FGFR1 AND NOT-PCDHB1 | Sarcoma | 0.6923 | 1 | 0.5294 |
| NOT-EMP3 AND RNF43 | Ovarian | 0.7368 | 1 | 0.5833 | FGFR1 AND NOT-ERVW-1 | Sarcoma | 0.6923 | 1 | 0.5294 |
| NOT-RNF43 AND VANGL1 | Sarcoma | 0.7742 | 0.8571 | 0.7059 | FGFR1 AND NOT-VN1R2 | Sarcoma | 0.6923 | 1 | 0.5294 |
| NOT-EPCAM AND VANGL1 | Sarcoma | 0.7895 | 0.7143 | 0.8824 | FGFR1 AND NOT-HTR1D | Sarcoma | 0.6923 | 1 | 0.5294 |
| NOT-IL20RA AND VANGL1 | Sarcoma | 0.7059 | 0.7059 | 0.7059 | FGFR1 AND NOT-HTR5A | Sarcoma | 0.6923 | 1 | 0.5294 |
| VANGL2 AND NOT-SDC1 | Astrocytoma | 0.8298 | 0.8125 | 0.8478 | FGFR1 AND NOT-ATP13A5 | Sarcoma | 0.6923 | 1 | 0.5294 |
| VANGL2 AND NOT-TPBG | Astrocytoma | 0.809 | 0.8372 | 0.7826 | FGFR1 AND NOT-CATSPER3 | Sarcoma | 0.6923 | 1 | 0.5294 |
| PTPRZ1 AND NOT-STEAP2 | Astrocytoma | 0.8039 | 0.7321 | 0.8913 | FGFR1 AND NOT-HCN1 | Sarcoma | 0.6923 | 1 | 0.5294 |
| PTPRZ1 AND NOT-RNF43 | Astrocytoma | 0.7921 | 0.7273 | 0.8696 | FGFR1 AND NOT-RGSL1 | Sarcoma | 0.6923 | 1 | 0.5294 |
| VANGL2 AND NOT-EPCAM | Astrocytoma | 0.8211 | 0.7959 | 0.8478 | FGFR1 AND NOT-IL13 | Sarcoma | 0.6923 | 1 | 0.5294 |
| PTPRZ1 AND NOT-SDC1 | Astrocytoma | 0.7736 | 0.6833 | 0.8913 | FGFR1 AND NOT-SHISA9 | Sarcoma | 0.6923 | 1 | 0.5294 |
| VANGL2 AND NOT-CLDN1 | Astrocytoma | 0.7723 | 0.7091 | 0.8478 | FGFR1 AND NOT-OR8D1 | Sarcoma | 0.6923 | 1 | 0.5294 |
| VANGL2 AND NOT-TRPM4 | Astrocytoma | 0.78 | 0.7222 | 0.8478 | FGFR1 AND NOT-XCR1 | Sarcoma | 0.6923 | 1 | 0.5294 |
| PTPRZ1 AND NOT-EPCAM | Astrocytoma | 0.7593 | 0.6613 | 0.8913 | FGFR1 AND NOT-KCNK16 | Sarcoma | 0.6923 | 1 | 0.5294 |
| PTPRZ1 AND NOT-LGR5 | Astrocytoma | 0.7547 | 0.6667 | 0.8696 | FGFR1 AND NOT-GLRA3 | Sarcoma | 0.6923 | 1 | 0.5294 |
| MMP16 AND NOT-EPCAM | Astrocytoma | 0.7532 | 0.9355 | 0.6304 | FGFR1 AND NOT-DSCAM | Sarcoma | 0.6923 | 1 | 0.5294 |
| PTPRZ1 AND NOT-TPBG | Astrocytoma | 0.7525 | 0.6909 | 0.8261 | STAB1 AND NOT-CNGA1 | Sarcoma | 0.6923 | 1 | 0.5294 |
| VANGL2 AND NOT-ERBB2 | Astrocytoma | 0.7473 | 0.7556 | 0.7391 | FGFR1 AND NOT-ACSL6 | Sarcoma | 0.6923 | 1 | 0.5294 |
| PTPRZ1 AND NOT-CLDN1 | Astrocytoma | 0.7455 | 0.6406 | 0.8913 | FGFR1 AND NOT-CEACAM7 | Sarcoma | 0.6923 | 1 | 0.5294 |
| PTPRZ1 AND NOT-PMEL | Astrocytoma | 0.7455 | 0.6406 | 0.8913 | FGFR1 AND NOT-CHRNA2 | Sarcoma | 0.6923 | 1 | 0.5294 |
| PTPRZ1 AND NOT-TRPM4 | Astrocytoma | 0.7455 | 0.6406 | 0.8913 | FGFR1 AND NOT-LPPR3 | Sarcoma | 0.6923 | 1 | 0.5294 |
| PTPRZ1 AND NOT-STEAP1 | Astrocytoma | 0.7455 | 0.6406 | 0.8913 | FGFR1 AND NOT-NKAIN1 | Sarcoma | 0.6923 | 1 | 0.5294 |
| PTPRZ1 AND NOT-CD52 | Astrocytoma | 0.7455 | 0.6406 | 0.8913 | FGFR1 AND NOT-NTSR2 | Sarcoma | 0.6923 | 1 | 0.5294 |
| PTPRZ1 AND NOT-CLDN23 | Astrocytoma | 0.7455 | 0.6406 | 0.8913 | FGFR1 AND NOT-CACNG2 | Sarcoma | 0.6923 | 1 | 0.5294 |
| MMP16 AND NOT-B4GALNT1 | Astrocytoma | 0.7368 | 0.9333 | 0.6087 | FGFR1 AND NOT-GABRA4 | Sarcoma | 0.6923 | 1 | 0.5294 |
| MMP16 AND NOT-SDC1 | Astrocytoma | 0.7342 | 0.8788 | 0.6304 | FGFR1 AND NOT-SLC17A2 | Sarcoma | 0.6923 | 1 | 0.5294 |
| PTPRZ1 AND NOT-SLC39A6 | Astrocytoma | 0.7339 | 0.6349 | 0.8696 | FGFR1 AND NOT-GABRD | Sarcoma | 0.6923 | 1 | 0.5294 |
| PTPRZ1 AND NOT-ERBB2 | Astrocytoma | 0.7222 | 0.629 | 0.8478 | CDH17 AND NOT-AQP8 | Stomach | 0.8533 | 1 | 0.7442 |
| PTPRZ1 AND NOT-CD34 | Astrocytoma | 0.7222 | 0.629 | 0.8478 | CDH17 AND NOT-CLCA4 | Stomach | 0.7473 | 0.7083 | 0.7907 |
| PTPRZ1 AND NOT-IL11RA | Astrocytoma | 0.7222 | 0.629 | 0.8478 | CDH17 AND NOT-TSPAN7 | Stomach | 0.7467 | 0.875 | 0.6512 |
| PTPRZ1 AND NOT-ERBB3 | Astrocytoma | 0.7222 | 0.629 | 0.8478 | TM4SF5 AND NOT-SLC30A10 | Stomach | 0.8247 | 0.7407 | 0.9302 |
| MMP16 AND NOT-TPBG | Astrocytoma | 0.7179 | 0.875 | 0.6087 | CDH17 AND NOT-CDHR1 | Stomach | 0.6972 | 0.5758 | 0.8837 |
| MMP16 AND NOT-MET | Astrocytoma | 0.716 | 0.8286 | 0.6304 | CDH17 AND NOT-PTGDR | Stomach | 0.6909 | 0.5672 | 0.8837 |
| MMP16 AND NOT-IGF1R | Astrocytoma | 0.716 | 0.8286 | 0.6304 | CDH17 AND NOT-PARM1 | Stomach | 0.6891 | 0.5395 | 0.9535 |
| MMP16 AND NOT-FAP | Astrocytoma | 0.716 | 0.8286 | 0.6304 | CDH17 AND NOT-PTPRD | Stomach | 0.6835 | 0.75 | 0.6279 |
| TSPAN11 AND NOT-CLDN1 | Astrocytoma | 0.6923 | 0.8438 | 0.587 | CDH17 AND NOT-SLC26A3 | Stomach | 0.6833 | 0.5325 | 0.9535 |
| VANGL2 AND NOT-RNF43 | Astrocytoma | 0.6923 | 0.8438 | 0.587 | CDH17 AND NOT-SCNN1B | Stomach | 0.6833 | 0.5325 | 0.9535 |
| VANGL2 AND NOT-CD34 | Astrocytoma | 0.7789 | 0.7551 | 0.8043 | MUC17 AND NOT-MEP1A | Stomach | 0.7353 | 1 | 0.5814 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FAP AND NOT-CAV1 | Breast | 0.8687 | 0.9556 | 0.7963 | CDH17 AND NOT-CNGA1 | Stomach | 0.8718 | 0.9714 | 0.7907 |
| FAP AND NOT-SLC22A3 | Breast | 0.8333 | 0.9524 | 0.7407 | CDH17 AND NOT-TRPM6 | Stomach | 0.6783 | 0.5417 | 0.907 |
| ADAM12 AND NOT-EGFR | Breast | 0.8302 | 0.8462 | 0.8148 | MUC17 AND NOT-TRPM6 | Stomach | 0.8378 | 1 | 0.7209 |
| FAP AND NOT-LYVE1 | Breast | 0.8687 | 0.9556 | 0.7963 | MUC17 AND NOT-TPSG1 | Stomach | 0.8378 | 1 | 0.7209 |
| FAP AND NOT-ITM2A | Breast | 0.8421 | 0.9756 | 0.7407 | MUC17 AND NOT-PTPRD | Stomach | 0.8108 | 0.9677 | 0.6977 |
| ADAM12 AND NOT-GPC3 | Breast | 0.8073 | 0.8 | 0.8148 | MUC17 AND NOT-ABCG2 | Stomach | 0.6769 | 1 | 0.5116 |
| FAP AND NOT-CAV2 | Breast | 0.8283 | 0.9111 | 0.7593 | MUC17 AND NOT-SLC51B | Stomach | 0.7887 | 1 | 0.6512 |
| FAP AND NOT-PVRL3 | Breast | 0.8041 | 0.907 | 0.7222 | MUC17 AND NOT-GDPD2 | Stomach | 0.7945 | 0.9667 | 0.6744 |
| FAP AND NOT-SLC9A9 | Breast | 0.8081 | 0.8889 | 0.7407 | MUC17 AND NOT-SLC2A13 | Stomach | 0.6765 | 0.92 | 0.5349 |
| FAP AND NOT-SLC16A7 | Breast | 0.8298 | 0.975 | 0.7222 | MUC17 AND NOT-SLC26A2 | Stomach | 0.8378 | 1 | 0.7209 |
| FAP AND NOT-PPAP2A | Breast | 0.8544 | 0.898 | 0.8148 | MUC17 AND NOT-CLCA4 | Stomach | 0.8378 | 1 | 0.7209 |
| FAP AND NOT-F10 | Breast | 0.86 | 0.9348 | 0.7963 | FUT3 AND NOT-CLCA4 | Stomach | 0.6866 | 0.9583 | 0.5349 |
| FAP AND NOT-BMP2 | Breast | 0.7959 | 0.8864 | 0.7222 | CDH17 AND NOT-SLC26A2 | Stomach | 0.6723 | 0.5263 | 0.9302 |
| FAP AND NOT-GLDN | Breast | 0.8317 | 0.8936 | 0.7778 | MUC17 AND NOT-CDHR5 | Stomach | 0.7246 | 0.9615 | 0.5814 |
| FAP AND NOT-EMCN | Breast | 0.8713 | 0.9362 | 0.8148 | MUC17 AND NOT-SLC26A3 | Stomach | 0.8378 | 1 | 0.7209 |
| FAP AND NOT-FXYD1 | Breast | 0.88 | 0.9565 | 0.8148 | MUC17 AND NOT-ACE | Stomach | 0.7324 | 0.9286 | 0.6047 |
| FAP AND NOT-CXCR2 | Breast | 0.7959 | 0.8864 | 0.7222 | MUC17 AND NOT-ANO10 | Stomach | 0.8267 | 0.9688 | 0.7209 |
| FAP AND NOT-ACPP | Breast | 0.8431 | 0.8958 | 0.7963 | VSIG1 AND NOT-PCDHA9 | Stomach | 0.6849 | 0.8333 | 0.5814 |
| FAP AND NOT-PTGFR | Breast | 0.8367 | 0.9318 | 0.7593 | MUC17 AND NOT-SEMA6A | Stomach | 0.7143 | 0.9259 | 0.5814 |
| FAP AND NOT-NT5E | Breast | 0.8041 | 0.907 | 0.7222 | MUC17 AND NOT-SLC39A5 | Stomach | 0.7606 | 0.9643 | 0.6279 |
| FAP AND NOT-PLP1 | Breast | 0.7826 | 0.9474 | 0.6667 | MUC17 AND NOT-VIPR1 | Stomach | 0.7536 | 1 | 0.6047 |
| ADAM12 AND NOT-EDNRB | Breast | 0.781 | 0.8039 | 0.7593 | MUC17 AND NOT-SLC6A19 | Stomach | 0.8 | 0.9375 | 0.6977 |
| FAP AND NOT-AVPR1A | Breast | 0.835 | 0.8776 | 0.7963 | MUC17 AND NOT-SLC23A1 | Stomach | 0.75 | 0.931 | 0.6279 |
| FAP AND NOT-IL1R2 | Breast | 0.7835 | 0.8837 | 0.7037 | MUC17 AND NOT-MEP1B | Stomach | 0.7838 | 0.9355 | 0.6744 |
| FAP AND NOT-STX8 | Breast | 0.8544 | 0.898 | 0.8148 | MUC17 AND NOT-SLC36A1 | Stomach | 0.8267 | 0.9688 | 0.7209 |
| FAP AND NOT-PLA2R1 | Breast | 0.82 | 0.8913 | 0.7593 | MUC17 AND NOT-NAALADL1 | Stomach | 0.7778 | 0.9655 | 0.6512 |
| FAP AND NOT-KL | Breast | 0.82 | 0.8913 | 0.7593 | VSIG1 AND NOT-KCNV1 | Stomach | 0.6757 | 0.8065 | 0.5814 |
| FAP AND NOT-GPR87 | Breast | 0.8235 | 0.875 | 0.7778 | MUC17 AND NOT-SLC1A1 | Stomach | 0.7838 | 0.9355 | 0.6744 |
| FAP AND NOT-KCNT2 | Breast | 0.8081 | 0.8889 | 0.7407 | MUC17 AND NOT-SECTM1 | Stomach | 0.7838 | 0.9355 | 0.6744 |
| FAP AND NOT-ABCA8 | Breast | 0.8081 | 0.8889 | 0.7407 | MUC17 AND NOT-CDHR2 | Stomach | 0.8421 | 0.9697 | 0.7442 |
| FAP AND NOT-SCN3A | Breast | 0.8317 | 0.8936 | 0.7778 | MUC17 AND NOT-ABHD6 | Stomach | 0.8219 | 1 | 0.6977 |
| FAP AND NOT-IL1RAP | Breast | 0.8 | 0.8696 | 0.7407 | MUC17 AND NOT-CYP4F12 | Stomach | 0.7246 | 0.9615 | 0.5814 |
| FAP AND NOT-ABHD6 | Breast | 0.82 | 0.8913 | 0.7593 | FUT3 AND NOT-SCNN1B | Stomach | 0.8081 | 0.7143 | 0.9302 |
| FAP AND NOT-SLC31A2 | Breast | 0.8119 | 0.8723 | 0.7593 | MUC17 AND NOT-FLVCR2 | Stomach | 0.8158 | 0.9394 | 0.7209 |
| FAP AND NOT-NAALAD2 | Breast | 0.8544 | 0.898 | 0.8148 | MUC17 AND NOT-BST1 | Stomach | 0.7429 | 0.963 | 0.6047 |
| FAP AND NOT-IL22RA1 | Breast | 0.8544 | 0.898 | 0.8148 | MUC17 AND NOT-P2RY2 | Stomach | 0.7164 | 1 | 0.5581 |
| FAP AND NOT-CHL1 | Breast | 0.78 | 0.8478 | 0.7222 | MUC17 AND NOT-SLC51A | Stomach | 0.8312 | 0.9412 | 0.7442 |
| FAP AND NOT-MPZ | Breast | 0.88 | 0.9565 | 0.8148 | MUC17 AND NOT-PTPRH | Stomach | 0.8158 | 0.9394 | 0.7209 |
| FAP AND NOT-IL20RB | Breast | 0.8269 | 0.86 | 0.7963 | MUC17 AND NOT-ABCB1 | Stomach | 0.8056 | 1 | 0.6744 |
| FAP AND NOT-SLMAP | Breast | 0.7692 | 0.9459 | 0.6481 | EPHA2 AND NOT-SCNN1B | Stomach | 0.68 | 0.5965 | 0.7907 |
| FAP AND NOT-CLCA4 | Breast | 0.835 | 0.8776 | 0.7963 | VSIG1 AND NOT-CALHM1 | Stomach | 0.6667 | 0.7813 | 0.5814 |
| FAP AND NOT-FZD10 | Breast | 0.835 | 0.8776 | 0.7963 | VSIG1 AND NOT-CLDN19 | Stomach | 0.6579 | 0.7576 | 0.5814 |
| FAP AND NOT-GJB6 | Breast | 0.8462 | 0.88 | 0.8148 | CXCL16 AND NOT-ADRB2 | Stomach | 0.6571 | 0.8519 | 0.5349 |
| FAP AND NOT-DPP4 | Breast | 0.835 | 0.8776 | 0.7963 | NOT-LIFR AND CDH11 | Colon | 0.9091 | 0.8333 | 1 |
| FAP AND NOT-COL17A1 | Breast | 0.8381 | 0.8627 | 0.8148 | NOT-ADRB2 AND TGFBI | Colon | 0.8889 | 1 | 0.8 |
| FAP AND NOT-SLC46A2 | Breast | 0.8462 | 0.88 | 0.8148 | NOT-PCDH9 AND PPAPDC1A | Colon | 0.8889 | 1 | 0.8 |
| FAP AND NOT-CDHR1 | Breast | 0.8544 | 0.898 | 0.8148 | NOT-NFASC AND SYT1 | Esophagus | 0.6087 | 0.7778 | 0.5 |
| FAP AND NOT-LRFN5 | Breast | 0.8431 | 0.8958 | 0.7963 | NOT-VAPA AND VANGL1 | Esophagus | 0.6 | 1 | 0.4286 |
| FAP AND NOT-TSPAN7 | Breast | 0.766 | 0.9 | 0.6667 | NOT-SCNN1B AND FUT3 | Esophagus | 0.6 | 1 | 0.4286 |
| FAP AND NOT-LIFR | Breast | 0.766 | 0.9 | 0.6667 | NOT-CSMD3 AND SEZ6L2 | Esophagus | 0.6 | 1 | 0.4286 |
| FAP AND NOT-SGCG | Breast | 0.8317 | 0.8936 | 0.7778 | NOT-ATP8A1 AND TRPC1 | Leiomyosarcoma | 0.7407 | 0.7143 | 0.7692 |
| FAP AND NOT-MRAP2 | Breast | 0.7742 | 0.9231 | 0.6667 | NOT-F11R AND VANGL1 | Leiomyosarcoma | 0.7879 | 0.65 | 1 |
| FAP AND NOT-ATP10B | Breast | 0.835 | 0.8776 | 0.7963 | NOT-CLDN10 AND CNTNAP1 | Leiomyosarcoma | 0.6667 | 0.6429 | 0.6923 |
| FAP AND NOT-GJB5 | Breast | 0.8269 | 0.86 | 0.7963 | NOT-ATP8A1 AND BVES | Leiomyosarcoma | 0.7407 | 0.7143 | 0.7692 |
| FAP AND NOT-ATP1A2 | Breast | 0.8085 | 0.95 | 0.7037 | NOT-ATP8A1 AND CNTNAP1 | Leiomyosarcoma | 0.6667 | 0.6429 | 0.6923 |
| FAP AND NOT-APCDD1 | Breast | 0.8381 | 0.8627 | 0.8148 | NOT-ATP8A1 AND CHIC1 | Leiomyosarcoma | 0.7273 | 0.8889 | 0.6154 |
| FAP AND NOT-JAM3 | Breast | 0.8317 | 0.8936 | 0.7778 | NOT-ATP8A1 AND STX2 | Leiomyosarcoma | 0.7619 | 1 | 0.6154 |
| FAP AND NOT-PERP | Breast | 0.8269 | 0.86 | 0.7963 | NOT-CLDN10 AND GRIN2D | Leiomyosarcoma | 0.7273 | 0.8889 | 0.6154 |
| FAP AND NOT-DSC3 | Breast | 0.835 | 0.8776 | 0.7963 | NOT-ATP8A1 AND TPM1 | Leiomyosarcoma | 0.6667 | 0.6429 | 0.6923 |
| ADAM12 AND NOT-FOLR2 | Breast | 0.7619 | 0.7843 | 0.7407 | NOT-WLS AND SLC22A16 | AML | 0.9537 | 0.9634 | 0.9442 |
| FAP AND NOT-SGCA | Breast | 0.8889 | 0.9778 | 0.8148 | NOT-PTPRK AND SLC22A16 | AML | 0.9435 | 0.9551 | 0.9323 |
| FAP AND NOT-SLC8A1 | Breast | 0.8387 | 1 | 0.7222 | NOT-PHLDB2 AND HCST | AML | 0.9448 | 0.9051 | 0.988 |
| FAP AND NOT-LRP4 | Breast | 0.7579 | 0.878 | 0.6667 | NOT-PHLDB2 AND TAAR5 | AML | 0.9409 | 0.93 | 0.9522 |
| FAP AND NOT-P2RY1 | Breast | 0.8317 | 0.8936 | 0.7778 | NOT-PHLDB2 AND CLEC12A | AML | 0.9318 | 0.9122 | 0.9522 |
| FAP AND NOT-KCNK7 | Breast | 0.8381 | 0.8627 | 0.8148 | NOT-PHLDB2 AND PIEZO1 | AML | 0.9261 | 0.9049 | 0.9482 |
| FAP AND NOT-PRIMA1 | Breast | 0.8163 | 0.9091 | 0.7407 | NOT-PHLDB2 AND CXCR4 | AML | 0.9254 | 0.8702 | 0.988 |
| FAP AND NOT-EREG | Breast | 0.7879 | 0.8667 | 0.7222 | NOT-CXADR AND VANGL1 | Liposarcoma | 0.72 | 0.6923 | 0.75 |
| FAP AND NOT-P2RX1 | Breast | 0.7921 | 0.8511 | 0.7407 | NOT-CD1A AND SMO | Liposarcoma | 0.6774 | 0.8077 | 0.5833 |
| FAP AND NOT-DPP6 | Breast | 0.88 | 0.9565 | 0.8148 | NOT-XK AND SLC6A7 | Liposarcoma | 0.6667 | 0.619 | 0.7222 |
| FAP AND NOT-ABCC9 | Breast | 0.8627 | 0.9167 | 0.8148 | NOT-SCNN1A AND VANGL1 | Liposarcoma | 0.6316 | 0.6 | 0.6667 |
| FAP AND NOT-PCDH20 | Breast | 0.7917 | 0.9048 | 0.7037 | NOT-ADCY4 AND SLC2A1 | Lung Carcinoma | 0.6471 | 0.6111 | 0.6875 |
| FAP AND NOT-SCN9A | Breast | 0.8462 | 0.88 | 0.8148 | NOT-GPM6A AND GPR19 | Anaplastic Lymphoma | 0.625 | 0.5882 | 0.6667 |
| FAP AND NOT-DUOXA1 | Breast | 0.8462 | 0.88 | 0.8148 | NOT-CD9 AND IL15RA | Anaplastic Lymphoma | 0.6667 | 0.6111 | 0.7333 |
| FAP AND NOT-FAM57A | Breast | 0.7551 | 0.8409 | 0.6852 | NOT-LRIG3 AND ST14 | Mantle-Cell Lymphoma | 0.9315 | 0.9714 | 0.8947 |
| FAP AND NOT-RECK | Breast | 0.7551 | 0.8409 | 0.6852 | NOT-FAT1 AND ST14 | Mantle-Cell Lymphoma | 0.9296 | 1 | 0.8684 |
| FAP AND NOT-GJB3 | Breast | 0.8381 | 0.8627 | 0.8148 | NOT-LRIG3 AND CELSR1 | Mantle-Cell Lymphoma | 0.8736 | 0.7755 | 1 |
| FAP AND NOT-ACVR2A | Breast | 0.8269 | 0.86 | 0.7963 | NOT-FAT1 AND CELSR1 | Mantle-Cell Lymphoma | 0.8889 | 0.8372 | 0.9474 |

FIG. 12 (Cont.)

| Antigen Pair Logic | Cancer (short name) | F1 | Precision | Recall | Antigen Pair Logic | Cancer (short name) | F1 | Precision | Recall |
|---|---|---|---|---|---|---|---|---|---|
| FAP AND NOT-TMEM47 | Breast | 0.8571 | 0.9545 | 0.7778 | NOT-VANGL1 AND ST14 | Mantle-Cell Lymphoma | 0.9444 | 1 | 0.8947 |
| FAP AND NOT-LY6D | Breast | 0.8381 | 0.8627 | 0.8148 | NOT-VANGL1 AND CELSR1 | Mantle-Cell Lymphoma | 0.987 | 0.9744 | 1 |
| SLC4A2 AND NOT-TPBG | Liver | 0.8 | 1 | 0.6667 | NOT-EPHA2 AND CELSR1 | Mantle-Cell Lymphoma | 0.8636 | 0.76 | 1 |
| SMO AND NOT-PTK7 | Liver | 0.8 | 1 | 0.6667 | NOT-CHRNA2 AND SGCD | Melanoma | 0.9524 | 1 | 0.9091 |
| SMO AND NOT-IGF1R | Liver | 0.8 | 1 | 0.6667 | NOT-NMUR2 AND SGCD | Melanoma | 0.9524 | 1 | 0.9091 |
| FGFR4 AND NOT-EDNRB | Liver | 0.8 | 1 | 0.6667 | NOT-CLDN19 AND SGCD | Melanoma | 0.9524 | 1 | 0.9091 |
| FGFR4 AND NOT-ITGB6 | Liver | 0.8 | 1 | 0.6667 | NOT-OR51B2 AND GPR19 | Melanoma | 0.9524 | 1 | 0.9091 |
| FGFR4 AND NOT-AXL | Liver | 0.8 | 1 | 0.6667 | NOT-CHRNA2 AND NRP2 | Melanoma | 0.9 | 1 | 0.8182 |
| FGFR4 AND NOT-CLDN7 | Liver | 0.8 | 1 | 0.6667 | NOT-NMUR2 AND NRP2 | Melanoma | 0.9 | 1 | 0.8182 |
| FGFR4 AND NOT-TPBG | Liver | 0.8 | 1 | 0.6667 | NOT-CHRNA2 AND SDC3 | Melanoma | 0.9 | 1 | 0.8182 |
| SLC4A2 AND NOT-AXL | Liver | 0.8 | 1 | 0.6667 | NOT-SCN10A AND ADAM12 | Melanoma | 0.9 | 1 | 0.8182 |
| SLC4A2 AND NOT-FOLR1 | Liver | 0.8 | 1 | 0.6667 | NOT-TMEM150B AND ICAM1 | Melanoma | 0.9 | 1 | 0.8182 |
| FGFR4 AND NOT-ENG | Liver | 0.8 | 1 | 0.6667 | NOT-TM4SF5 AND GPR19 | Melanoma | 0.9524 | 1 | 0.9091 |
| FGFR4 AND NOT-SLC34A2 | Liver | 0.8 | 1 | 0.6667 | NOT-F11R AND SLC31A1 | Sarcoma | 0.8571 | 0.8333 | 0.8824 |
| FGFR4 AND NOT-GPA33 | Liver | 0.8 | 1 | 0.6667 | NOT-F11R AND VANGL1 | Sarcoma | 0.7317 | 0.625 | 0.8824 |
| FGFR4 AND NOT-CLDN5 | Liver | 0.8 | 1 | 0.6667 | NOT-SCNN1A AND VANGL1 | Sarcoma | 0.8276 | 1 | 0.7059 |
| FGFR4 AND NOT-CLDN18 | Liver | 0.8 | 1 | 0.6667 | NOT-F11R AND ATP7A | Sarcoma | 0.6923 | 1 | 0.5294 |
| FGFR4 AND NOT-ROR1 | Liver | 0.8 | 1 | 0.6667 | | | | | |

FIG. 13

| Antigen Pair Logic | Cancer (short name) | F1 | Precision | Recall |
|---|---|---|---|---|
| EPCAM AND ROR1 | Breast | 0.441379 | 0.351648 | 0.592593 |
| EPCAM AND ERBB2 | Breast | 0.358491 | 0.365385 | 0.351852 |
| CD33 AND IL3RA | AML | 0.552567 | 0.71519 | 0.450199 |
| EPCAM AND NOT-MET | Breast | 0.573913 | 0.540984 | 0.611111 |
| EPCAM AND NOT-MSLN | Breast | 0.587413 | 0.47191 | 0.777778 |
| EPCAM AND NOT-TYR | Breast | 0.577181 | 0.452632 | 0.796296 |
| ERBB2 AND NOT-ROR1 | Breast | 0.392157 | 0.416667 | 0.37037 |
| ERBB2 AND NOT-TYR | Breast | 0.38835 | 0.408163 | 0.37037 |
| ERBB2 AND NOT-MET | Breast | 0.305556 | 0.611111 | 0.203704 |
| MSLN AND NOT-ROR1 | Breast | 0.093137 | 0.053672 | 0.351852 |
| MSLN AND NOT-TYR | Breast | 0.091127 | 0.052342 | 0.351852 |
| MSLN AND NOT-MET | Breast | 0.063158 | 0.03681 | 0.222222 |
| MSLN AND NOT-ERBB2 | Pancreas | 0.146341 | 0.1 | 0.272727 |
| MSLN AND NOT-ERBB2 | Lung Adenocarcinoma | 0.354167 | 0.653846 | 0.242857 |
| MUC1 AND NOT-ERBB2 | Lung Adenocarcinoma | 0.385787 | 0.299213 | 0.542857 |
| CD19 AND NOT-CD22 | B-Cell Diffuse | 0.192308 | 0.333333 | 0.135135 |
| MS4A1 AND NOT-CD22 | B-Cell Diffuse | 0.151515 | 0.172414 | 0.135135 |
| MLANA AND NOT-KDR | Melanoma | 0.9 | 1 | 0.818182 |
| NOT-TYR AND ROR1 | Breast | 0.183486 | 0.10989 | 0.555556 |
| NOT-MET AND ROR1 | Breast | 0.123656 | 0.072327 | 0.425926 |
| NOT-MET AND TYR | Breast | 0.11588 | 0.065534 | 0.5 |
| NOT-GPC3 AND MSLN | Colon | 0.352941 | 0.25 | 0.6 |
| NOT-GPC3 AND MUC1 | Colon | 0.47619 | 0.3125 | 1 |
| NOT-GPC3 AND ERBB2 | Colon | 0.454545 | 0.294118 | 1 |
| NOT-EPHA2 AND ERBB2 | Glioma | 0.295918 | 0.179567 | 0.84058 |
| NOT-EPHA2 AND MUC1 | Glioma | 0.281481 | 0.169643 | 0.826087 |
| NOT-ROR1 AND MUC1 | Lung Carcinoma | 0.248996 | 0.167568 | 0.484375 |
| NOT-ROR1 AND TNFRSF10A | Lung Carcinoma | 0.042553 | 0.027523 | 0.09375 |

FIG. 14

| Antigen Pair Logic | Cancer (short name) | F1 | Precision | Recall |
|---|---|---|---|---|
| CD33 | AML | 0.762987 | 0.643836 | 0.936255 |
| CD19 | Mantle-Cell Lymphoma | 0.914286 | 1 | 0.842105 |
| PMEL | Melanoma | 0.952381 | 1 | 0.909091 |
| MLANA | Melanoma | 1 | 1 | 1 |
| VTCN1 | Breast | 0.690476 | 0.966667 | 0.537037 |
| FAP | Breast | 0.838095 | 0.862745 | 0.814815 |
| TPBG | Breast | 0.62 | 0.673913 | 0.574074 |
| CLDN12 | Liver | 0.631579 | 0.461538 | 1 |
| FAP | Pancreas | 0.842105 | 1 | 0.727273 |
| VCAM1 | Renal | 0.666667 | 0.6 | 0.75 |
| RNF43 | Colon | 0.75 | 1 | 0.6 |
| BIRC5 | Colon | 0.625 | 0.454545 | 1 |
| EPHB2 | Colon | 0.615385 | 0.5 | 0.8 |
| SSTR1 | Ependymoma | 1 | 1 | 1 |
| BIRC5 | Esophagus | 0.692308 | 0.75 | 0.642857 |
| ITGAV | Glioma | 0.897959 | 0.846154 | 0.956522 |
| EDNRB | Glioma | 0.707483 | 0.666667 | 0.753623 |
| SLC39A6 | Glioma | 0.777778 | 0.746667 | 0.811594 |
| CLDN12 | Glioma | 0.651852 | 0.666667 | 0.637681 |
| FAP | Leiomyosarcoma | 0.818182 | 1 | 0.692308 |
| CD37 | AML | 0.71407 | 0.57561 | 0.940239 |
| CD38 | AML | 0.62069 | 0.497596 | 0.824701 |
| CD276 | Liposarcoma | 0.648148 | 0.486111 | 0.972222 |
| SLC34A2 | Lung Adenocarcinoma | 0.607143 | 0.520408 | 0.728571 |
| MAGEA4 | Lung Carcinoma | 0.605505 | 0.733333 | 0.515625 |
| IL2RA | Anaplastic Lymphoma | 0.62069 | 0.642857 | 0.6 |
| TNFRSF8 | Anaplastic Lymphoma | 0.875 | 0.823529 | 0.933333 |
| FCRL2 | Mantle-Cell Lymphoma | 0.730159 | 0.92 | 0.605263 |
| MS4A1 | Mantle-Cell Lymphoma | 0.71028 | 0.550725 | 1 |
| CD70 | Mantle-Cell Lymphoma | 0.885714 | 0.96875 | 0.815789 |
| CXCR5 | Mantle-Cell Lymphoma | 0.675676 | 0.694444 | 0.657895 |
| CD79B | Mantle-Cell Lymphoma | 0.666667 | 0.608696 | 0.736842 |
| TNFRSF13C | Mantle-Cell Lymphoma | 0.77551 | 0.633333 | 1 |
| FCRL1 | Mantle-Cell Lymphoma | 0.606742 | 0.529412 | 0.710526 |
| EDNRB | Melanoma | 0.9 | 1 | 0.818182 |
| CLDN12 | Melanoma | 0.777778 | 1 | 0.636364 |
| SLC7A5 | Melanoma | 0.705882 | 1 | 0.545455 |
| ABCB5 | Melanoma | 0.705882 | 1 | 0.545455 |
| RNF43 | Melanoma | 0.777778 | 1 | 0.636364 |
| BMPR1B | Neuroblastoma | 0.666667 | 0.692308 | 0.642857 |
| STEAP2 | Prostate | 0.727273 | 0.571429 | 1 |
| STEAP1 | Prostate | 0.666667 | 0.6 | 0.75 |
| CLDN12 | Prostate | 0.666667 | 1 | 0.5 |
| BMPR1B | Prostate | 0.666667 | 1 | 0.5 |
| FAP | Sarcoma | 0.866667 | 1 | 0.764706 |
| ROR1 | Sarcoma | 0.83871 | 0.928571 | 0.764706 |
| CD276 | Sarcoma | 0.740741 | 1 | 0.588235 |
| CLDN18 | Stomach | 0.765957 | 0.705882 | 0.837209 |
| MUC13 | Stomach | 0.705882 | 0.552632 | 0.976744 |
| MUC1 | Stomach | 0.666667 | 0.956522 | 0.511628 |
| CLDN2 | Stomach | 0.621359 | 0.533333 | 0.744186 |
| EPCAM | Stomach | 0.609929 | 0.438776 | 1 |
| MST1R | Stomach | 0.688525 | 0.531646 | 0.976744 |
| NOT-ITGAV | AML | 0.690625 | 0.568123 | 0.880478 |
| NOT-EDNRB | AML | 0.664865 | 0.503067 | 0.98008 |
| NOT-STEAP2 | AML | 0.620519 | 0.449821 | 1 |
| NOT-ERBB3 | AML | 0.607748 | 0.436522 | 1 |
| NOT-FCRL5 | Melanoma | 0.625 | 1 | 0.454545 |
| NKAIN4 | Astrocytoma | 0.764045 | 0.790698 | 0.73913 |
| BEST3 | Astrocytoma | 0.608696 | 0.608696 | 0.608696 |
| ABCG8 | Liver | 0.8 | 1 | 0.666667 |
| SLCO1B1 | Liver | 0.75 | 0.6 | 1 |
| SLC17A2 | Liver | 0.666667 | 0.555556 | 0.833333 |
| SLC2A2 | Liver | 0.857143 | 0.75 | 1 |
| SLC10A1 | Liver | 0.666667 | 0.555556 | 0.833333 |
| SLC30A8 | Pancreas | 0.777778 | 1 | 0.636364 |
| MUC17 | Pancreas | 0.666667 | 0.857143 | 0.545455 |
| IFI6 | Colon | 0.666667 | 0.5 | 1 |
| MUC17 | Esophagus | 0.785714 | 0.785714 | 0.785714 |
| SLC1A5 | Esophagus | 0.64 | 0.727273 | 0.571429 |
| LYPD1 | Glioblastoma | 0.666667 | 0.56 | 0.823529 |
| SYT11 | Glioma | 0.964539 | 0.944444 | 0.985507 |
| CRB1 | Glioma | 0.813559 | 0.979592 | 0.695652 |
| LYPD1 | Glioma | 0.876923 | 0.934426 | 0.826087 |
| DTNA | Glioma | 0.711864 | 0.857143 | 0.608696 |
| GPR19 | Glioma | 0.816327 | 0.769231 | 0.869565 |
| MEGF11 | Glioma | 0.682927 | 0.777778 | 0.608696 |
| PRLR | Breast | 0.654206 | 0.660377 | 0.648148 |
| SLC4A2 | Breast | 0.652174 | 0.789474 | 0.555556 |
| F2RL2 | Breast | 0.674419 | 0.90625 | 0.537037 |
| SLC5A6 | Breast | 0.636364 | 0.625 | 0.648148 |
| PMEPA1 | Breast | 0.66055 | 0.654545 | 0.666667 |
| MFSD10 | Breast | 0.640777 | 0.673469 | 0.611111 |
| NOX4 | Breast | 0.643357 | 0.516854 | 0.851852 |
| SLC52A2 | Breast | 0.673267 | 0.723404 | 0.62963 |
| KCNK15 | Breast | 0.629213 | 0.8 | 0.518519 |
| FGFR4 | Liver | 0.8 | 1 | 0.666667 |
| ABCC2 | Liver | 1 | 1 | 1 |
| ABCB11 | Liver | 0.666667 | 0.666667 | 0.666667 |
| TMPRSS6 | Liver | 0.666667 | 1 | 0.5 |
| APOB | Liver | 0.833333 | 0.833333 | 0.833333 |
| HPN | Liver | 0.857143 | 0.75 | 1 |
| FGG | Liver | 0.8 | 0.666667 | 1 |
| ABCC6 | Liver | 0.75 | 0.6 | 1 |
| TFR2 | Liver | 0.666667 | 0.555556 | 0.833333 |
| ABCC8 | Pancreas | 0.777778 | 1 | 0.636364 |
| CDH6 | Renal | 0.857143 | 1 | 0.75 |
| LRP2 | Renal | 0.636364 | 0.7 | 0.583333 |
| SLC3A1 | Renal | 0.72 | 0.692308 | 0.75 |
| SLC12A2 | Colon | 0.75 | 1 | 0.6 |
| LY6G6D | Colon | 0.75 | 1 | 0.6 |
| PMEPA1 | Colon | 0.666667 | 0.571429 | 0.8 |
| KCNA6 | Ependymoma | 1 | 1 | 1 |
| DLL1 | Ependymoma | 0.666667 | 0.5 | 1 |
| SLC7A11 | Ependymoma | 1 | 1 | 1 |
| PRNP | Ependymoma | 1 | 1 | 1 |
| SLC52A2 | Esophagus | 0.769231 | 0.833333 | 0.714286 |
| SLC6A20 | Esophagus | 0.62069 | 0.6 | 0.642857 |
| TM4SF20 | Esophagus | 0.666667 | 0.692308 | 0.642857 |
| PTPRZ1 | Glioblastoma | 0.909091 | 0.9375 | 0.882353 |
| AQP4 | Glioblastoma | 0.604651 | 0.5 | 0.764706 |
| HRH1 | Glioblastoma | 0.666667 | 0.9 | 0.529412 |
| PTPRZ1 | Glioma | 0.985507 | 0.985507 | 0.985507 |
| NRCAM | Glioma | 0.917293 | 0.953125 | 0.884058 |
| NLGN1 | Glioma | 0.938462 | 1 | 0.884058 |
| PCDHB10 | Glioma | 0.904762 | 1 | 0.826087 |
| SGCB | Glioma | 0.855072 | 0.855072 | 0.855072 |
| GRIK3 | Glioma | 0.754967 | 0.695122 | 0.826087 |
| XPR1 | Glioma | 0.75 | 0.659341 | 0.869565 |
| NLGN4X | Glioma | 0.730539 | 0.622449 | 0.884058 |
| FZD3 | Glioma | 0.722581 | 0.651163 | 0.811594 |
| SLC1A3 | Glioma | 0.72 | 0.666667 | 0.782609 |
| FGFR1 | Leiomyosarcoma | 0.782609 | 0.9 | 0.692308 |
| ROR2 | Leiomyosarcoma | 0.692308 | 0.692308 | 0.692308 |
| ITGA11 | Leiomyosarcoma | 0.64 | 0.666667 | 0.615385 |
| OSMR | Leiomyosarcoma | 0.695652 | 0.8 | 0.615385 |
| FLT3 | AML | 0.942857 | 0.966527 | 0.920319 |
| P2RX1 | AML | 0.823729 | 0.716814 | 0.968127 |
| ATP8B4 | AML | 0.796875 | 0.781609 | 0.812749 |
| CSF3R | AML | 0.778878 | 0.664789 | 0.940239 |
| HCST | AML | 0.767802 | 0.627848 | 0.988048 |
| ADAM12 | Liposarcoma | 0.62 | 0.484375 | 0.861111 |
| TSPAN31 | Liposarcoma | 0.618182 | 0.894737 | 0.472222 |
| IGDCC4 | Liposarcoma | 0.631579 | 0.857143 | 0.5 |
| MMP14 | Liposarcoma | 0.686567 | 0.741935 | 0.638889 |
| CXCL9 | B-Cell Diffuse | 0.712329 | 0.722222 | 0.702703 |
| CD40 | B-Cell Diffuse | 0.675325 | 0.65 | 0.702703 |
| CD80 | B-Cell Diffuse | 0.611765 | 0.541667 | 0.702703 |
| CXCL10 | B-Cell Diffuse | 0.60274 | 0.611111 | 0.594595 |
| CLECL1 | Mantle-Cell Lymphoma | 0.767677 | 0.622951 | 1 |
| QSOX2 | Mantle-Cell Lymphoma | 0.891566 | 0.822222 | 0.973684 |
| TNFRSF13B | Mantle-Cell Lymphoma | 0.78481 | 0.756098 | 0.815789 |
| CD83 | Mantle-Cell Lymphoma | 0.648649 | 0.493151 | 0.947368 |
| CXCL9 | T-Cell, Peripheral | 0.733333 | 0.6875 | 0.785714 |
| GPR143 | Melanoma | 0.842105 | 1 | 0.727273 |
| STEAP1B | Melanoma | 0.842105 | 1 | 0.727273 |
| HTRA2 | Melanoma | 0.777778 | 1 | 0.636364 |
| MC1R | Melanoma | 0.9 | 1 | 0.818182 |
| MARVELD1 | Melanoma | 0.952381 | 1 | 0.909091 |
| C11orf24 | Melanoma | 0.9 | 1 | 0.818182 |
| PTPRM | Melanoma | 0.842105 | 1 | 0.727273 |
| TNFSF9 | Melanoma | 0.909091 | 0.909091 | 0.909091 |
| SLC4A2 | Melanoma | 0.777778 | 1 | 0.636364 |
| IL12RB2 | Melanoma | 0.9 | 1 | 0.818182 |

FIG. 14 (Cont.)

| Antigen Pair Logic | Cancer (short name) | F1 | Precision | Recall |
|---|---|---|---|---|
| CSMD2 | Glioma | 0.686131 | 0.691176 | 0.681159 |
| DSCAM | Glioma | 0.640777 | 0.970588 | 0.478261 |
| BEST3 | Glioma | 0.671642 | 0.692308 | 0.652174 |
| SLCO1C1 | Glioma | 0.624204 | 0.556818 | 0.710145 |
| SLC22A16 | AML | 0.896552 | 0.863469 | 0.932271 |
| FMNL1 | AML | 0.676783 | 0.546569 | 0.888446 |
| SLC39A8 | AML | 0.648871 | 0.669492 | 0.629482 |
| LAPTM5 | AML | 0.692414 | 0.529536 | 1 |
| EMP3 | AML | 0.667598 | 0.513978 | 0.952191 |
| SLC43A1 | AML | 0.695833 | 0.729258 | 0.665339 |
| STAB1 | Liposarcoma | 0.617284 | 0.555556 | 0.694444 |
| TRPM1 | Melanoma | 0.705882 | 1 | 0.545455 |
| SLC6A15 | Melanoma | 0.705882 | 1 | 0.545455 |
| OR7C1 | Melanoma | 0.636364 | 0.636364 | 0.636364 |
| FAT1 | Melanoma | 0.8 | 0.888889 | 0.727273 |
| LYPD1 | Melanoma | 0.705882 | 1 | 0.545455 |
| IFI6 | Melanoma | 0.75 | 0.692308 | 0.818182 |
| NKAIN1 | Neuroblastoma | 0.797872 | 0.721154 | 0.892857 |
| GRM8 | Neuroblastoma | 0.637037 | 0.843137 | 0.511905 |
| PIRT | Neuroblastoma | 0.632258 | 0.690141 | 0.583333 |
| CHRNB4 | Neuroblastoma | 0.628205 | 0.680556 | 0.583333 |
| GPR19 | Neuroblastoma | 0.610687 | 0.449438 | 0.952381 |
| GPR85 | Neuroblastoma | 0.609865 | 0.489209 | 0.809524 |
| NKAIN4 | Oligodendroglioma | 0.888889 | 1 | 0.8 |
| CRB1 | Oligodendroglioma | 0.75 | 1 | 0.6 |
| KCNQ2 | Oligodendroglioma | 0.736842 | 0.608696 | 0.933333 |
| MDGA2 | Oligodendroglioma | 0.685714 | 0.6 | 0.8 |
| DSCAM | Oligodendroglioma | 0.75 | 1 | 0.6 |
| LYPD1 | Oligodendroglioma | 0.733333 | 0.733333 | 0.733333 |
| GPR37L1 | Oligodendroglioma | 0.608696 | 0.875 | 0.466667 |
| DTNA | Oligodendroglioma | 0.702703 | 0.590909 | 0.866667 |
| TRPM8 | Prostate | 0.727273 | 0.571429 | 1 |
| UPK3A | Prostate | 0.666667 | 0.6 | 0.75 |
| TMEFF2 | Prostate | 0.857143 | 1 | 0.75 |
| STAB1 | Sarcoma | 0.6 | 0.521739 | 0.705882 |
| PTGIS | Sarcoma | 0.714286 | 0.909091 | 0.588235 |
| MUC17 | Stomach | 0.831169 | 0.941176 | 0.744186 |
| ATP8B1 | Stomach | 0.831461 | 0.804348 | 0.860465 |
| NOT-PHLDB2 | AML | 0.698592 | 0.540305 | 0.988048 |
| NOT-FAT1 | AML | 0.693642 | 0.544218 | 0.956175 |
| NOT-EFNB2 | AML | 0.673051 | 0.5125 | 0.98008 |
| NOT-GPR137B | AML | 0.672052 | 0.565217 | 0.828685 |
| PTPRZ1 | Astrocytoma | 0.745455 | 0.640625 | 0.891304 |
| PTPRZ1 | Astrocytoma | 0.745455 | 0.640625 | 0.891304 |
| MMP16 | Astrocytoma | 0.674419 | 0.725 | 0.630435 |
| ADCYAP1R1 | Astrocytoma | 0.62963 | 0.548387 | 0.73913 |
| NRCAM | Astrocytoma | 0.617886 | 0.493506 | 0.826087 |
| KCNN3 | Astrocytoma | 0.682353 | 0.74359 | 0.630435 |
| ADAM12 | Breast | 0.818182 | 0.803571 | 0.833333 |
| SLC10A4 | Neuroblastoma | 0.922222 | 0.864583 | 0.988095 |
| CHRNA3 | Neuroblastoma | 0.922156 | 0.927711 | 0.916667 |
| DIABLO | Neuroblastoma | 0.881988 | 0.922078 | 0.845238 |
| ACVR2B | Neuroblastoma | 0.831169 | 0.914286 | 0.761905 |
| PCDHB10 | Neuroblastoma | 0.820809 | 0.797753 | 0.845238 |
| SLC6A2 | Neuroblastoma | 0.814815 | 0.846154 | 0.785714 |
| PCDHB6 | Neuroblastoma | 0.797297 | 0.921875 | 0.702381 |
| SCN9A | Neuroblastoma | 0.776471 | 0.767442 | 0.785714 |
| GPR173 | Neuroblastoma | 0.745763 | 0.709677 | 0.785714 |
| PODXL2 | Neuroblastoma | 0.708995 | 0.638095 | 0.797619 |
| NLGN3 | Oligodendroglioma | 0.933333 | 0.933333 | 0.933333 |
| GPR173 | Oligodendroglioma | 0.769231 | 0.909091 | 0.666667 |
| GRIK3 | Oligodendroglioma | 0.681818 | 0.517241 | 1 |
| ADCYAP1R1 | Oligodendroglioma | 0.846154 | 1 | 0.733333 |
| MMP16 | Oligodendroglioma | 0.888889 | 1 | 0.8 |
| PTPRZ1 | Oligodendroglioma | 0.857143 | 0.923077 | 0.8 |
| NRCAM | Oligodendroglioma | 0.702703 | 0.590909 | 0.866667 |
| GRIK2 | Oligodendroglioma | 0.666667 | 0.571429 | 0.8 |
| KCNN3 | Oligodendroglioma | 0.64 | 0.8 | 0.533333 |
| EPHB1 | Oligodendroglioma | 0.666667 | 0.666667 | 0.666667 |
| KCNK15 | Ovarian | 0.774194 | 0.631579 | 1 |
| OR51E2 | Prostate | 0.888889 | 0.8 | 1 |
| ANO7 | Prostate | 0.8 | 0.666667 | 1 |
| ACPP | Prostate | 0.857143 | 1 | 0.75 |
| OR51E1 | Prostate | 0.857143 | 1 | 0.75 |
| TSPAN1 | Prostate | 0.666667 | 1 | 0.5 |
| ABCC4 | Prostate | 0.75 | 0.75 | 0.75 |
| SLC2A12 | Prostate | 0.857143 | 1 | 0.75 |
| PMEPA1 | Prostate | 0.6 | 0.5 | 0.75 |
| NDRG1 | Prostate | 0.666667 | 1 | 0.5 |
| FGFR1 | Sarcoma | 0.666667 | 0.9 | 0.529412 |
| MMP14 | Sarcoma | 0.740741 | 1 | 0.588235 |
| OSMR | Sarcoma | 0.848485 | 0.875 | 0.823529 |
| ADAM12 | Sarcoma | 0.755556 | 0.607143 | 1 |
| VASN | Sarcoma | 0.692308 | 1 | 0.529412 |
| FLRT2 | Sarcoma | 0.733333 | 0.846154 | 0.647059 |
| BFAR | Sarcoma | 0.733333 | 0.846154 | 0.647059 |
| ITGA11 | Sarcoma | 0.787879 | 0.8125 | 0.764706 |
| HRH1 | Sarcoma | 0.615385 | 0.888889 | 0.470588 |
| VSIG1 | Stomach | 0.617284 | 0.657895 | 0.581395 |
| LSR | Stomach | 0.690909 | 0.567164 | 0.883721 |
| TM4SF20 | Stomach | 0.611111 | 0.507692 | 0.767442 |
| B3GNT3 | Stomach | 0.661538 | 0.494253 | 1 |
| SI | Stomach | 0.6 | 0.467532 | 0.837209 |
| NOT-PTPRK | AML | 0.805778 | 0.674731 | 1 |
| NOT-HEG1 | AML | 0.797853 | 0.724026 | 0.888446 |
| NOT-WLS | AML | 0.782609 | 0.656757 | 0.968127 |
| NOT-CADM1 | AML | 0.766506 | 0.643243 | 0.948207 |
| NOT-PTPRM | AML | 0.782753 | 0.670455 | 0.940239 |

FIG. 15

| Antigen Pair Logic | F1 | Precision | Recall | Antigen Pair Logic | F1 | Precision | Recall |
|---|---|---|---|---|---|---|---|
| Astrocytoma | | | | (Cont.) | | | |
| PTPRZ1 AND NOT-SDC1 AND F2R | 0.91954 | 0.97561 | 0.869565 | SELL AND NOT-HLA-DOB AND NOT-KDR | 0.917603 | 0.865724 | 0.976096 |
| PTPRZ1 AND NOT-EPCAM AND F2R | 0.911111 | 0.931818 | 0.891304 | NOT-PTPRK AND CD70 AND NOT-ABCA5 | 0.899804 | 0.887597 | 0.912351 |
| PTPRZ1 AND CLDN17 AND TNC | 0.891304 | 0.891304 | 0.891304 | NOT-PODXL AND CD37 AND NOT-FCRL1 | 0.899628 | 0.843206 | 0.964143 |
| PTPRZ1 AND NOT-SDC1 AND NOT-GABRA2 | 0.891304 | 0.891304 | 0.891304 | NOT-EDNRB AND ITGB2 AND NOT-MS4A1 | 0.911488 | 0.864286 | 0.964143 |
| PCDH10 AND F2R AND NOT-SDC1 | 0.886364 | 0.928571 | 0.847826 | NOT-EDNRB AND SLC7A5 AND NOT-MAL | 0.899431 | 0.858696 | 0.944223 |
| PTPRZ1 AND NOT-SDC1 AND ANTXR2 | 0.886364 | 0.928571 | 0.847826 | P2RY8 AND NOT-PCYT1A AND NOT-FCRL2 | 0.919325 | 0.868794 | 0.976096 |
| CELSR2 AND NOT-SDC1 AND F2R | 0.883721 | 0.95 | 0.826087 | NOT-PTPRK AND CD70 AND NOT-ALDH1A1 | 0.899225 | 0.875472 | 0.924303 |
| PTPRZ1 AND NOT-STEAP1 AND NOT-GABRA2 | 0.88172 | 0.87234 | 0.891304 | SELL AND NOT-HLA-DOB AND NOT-AXL | 0.911488 | 0.864286 | 0.964143 |
| PTPRZ1 AND GABRB2 AND TNC | 0.88172 | 0.87234 | 0.891304 | P2RY8 AND NOT-IL11RA AND NOT-CR2 | 0.898833 | 0.878327 | 0.920319 |
| PTPRZ1 AND NOT-CLDN23 AND NOT-GABRA2 | 0.88172 | 0.87234 | 0.891304 | NOT-EDNRB AND ITGB2 AND NOT-FCRL5 | 0.898711 | 0.835616 | 0.972112 |
| PTPRZ1 AND NOT-CD52 AND NOT-GABRA2 | 0.88172 | 0.87234 | 0.891304 | P2RY8 AND NOT-CD22 AND NOT-CLDN8 | 0.897436 | 0.830508 | 0.976096 |
| PTPRZ1 AND NCAM1 AND NOT-GRM3 | 0.880952 | 0.973684 | 0.804348 | SELL AND NOT-HLA-DOB AND NOT-STEAP1 | 0.906367 | 0.855124 | 0.964143 |
| PTPRZ1 AND NOT-SDC1 AND NOT-GRM3 | 0.880952 | 0.973684 | 0.804348 | NOT-PODXL AND CD37 AND NOT-CD22 | 0.896679 | 0.835052 | 0.968127 |
| PTPRZ1 AND NOT-PMEL AND NOT-GRM3 | 0.880952 | 0.973684 | 0.804348 | P2RY8 AND NOT-CD22 AND NOT-AXL | 0.896679 | 0.835052 | 0.968127 |
| PTPRZ1 AND NOT-EPCAM AND NOT-GRM3 | 0.880952 | 0.973684 | 0.804348 | P2RY8 AND NOT-ALDH1A1 AND NOT-CR2 | 0.901575 | 0.891051 | 0.912351 |
| PTPRZ1 AND NOT-TRPM4 AND NOT-GRM3 | 0.880952 | 0.973684 | 0.804348 | CXCR4 AND NOT-MS4A1 AND NOT-CLDN11 | 0.897579 | 0.842657 | 0.960159 |
| PTPRZ1 AND NOT-STEAP1 AND NOT-GRM3 | 0.880952 | 0.973684 | 0.804348 | NOT-PTPRK AND CD37 AND NOT-CD22 | 0.895028 | 0.832192 | 0.968127 |
| PTPRZ1 AND NOT-CLDN23 AND NOT-GRM3 | 0.880952 | 0.973684 | 0.804348 | NOT-SGCB AND NOT-HLA-DOB AND CD70 | 0.907063 | 0.850174 | 0.972112 |
| PTPRZ1 AND NOT-EPCAM AND NOT-GRM3 | 0.880952 | 0.973684 | 0.804348 | P2RY8 AND NOT-FCRL1 AND NOT-AXL | 0.89464 | 0.834483 | 0.964143 |
| PTPRZ1 AND NOT-CLDN1 AND NOT-GRM3 | 0.880952 | 0.973684 | 0.804348 | P2RY8 AND NOT-FCRL1 AND NOT-AXL | 0.89464 | 0.834483 | 0.964143 |
| PTPRZ1 AND NOT-TRPM4 AND F2R | 0.879121 | 0.888889 | 0.869565 | NOT-WLS AND CD70 AND NOT-ABCA5 | 0.894212 | 0.896 | 0.89243 |
| PTPRZ1 AND NOT-CLDN1 AND F2R | 0.879121 | 0.888889 | 0.869565 | P2RY8 AND NOT-ITGAV AND NOT-CR2 | 0.893939 | 0.851986 | 0.940239 |
| PTPRZ1 AND NCAM1 AND F2R | 0.879121 | 0.888889 | 0.869565 | SELL AND NOT-AXL AND NOT-CD160 | 0.893855 | 0.839161 | 0.956175 |
| PTPRZ1 AND FXYD6 AND NOT-STEAP2 | 0.869565 | 0.869565 | 0.869565 | NOT-EDNRB AND FXYD5 AND NOT-HLA-DOB | 0.902752 | 0.836735 | 0.98008 |
| PTPRZ1 AND F2R AND NOT-CD52 | 0.866667 | 0.886364 | 0.847826 | P2RY8 AND NOT-FCRL1 AND NOT-EDNRB | 0.893458 | 0.841549 | 0.952191 |
| PTPRZ1 AND F2R AND NOT-STEAP1 | 0.866667 | 0.886364 | 0.847826 | P2RY8 AND NOT-FCRL1 AND NOT-EDNRB | 0.893458 | 0.841549 | 0.952191 |
| PTPRZ1 AND BEST3 AND NOT-SDC1 | 0.866667 | 0.886364 | 0.847826 | P2RY8 AND NOT-CD22 AND NOT-CLDN5 | 0.897436 | 0.830508 | 0.976096 |
| PTPRZ1 AND F2R AND NOT-PMEL | 0.866667 | 0.886364 | 0.847826 | NOT-WLS AND CD70 AND NOT-HLA-DOB | 0.892989 | 0.831615 | 0.964143 |
| PTPRZ1 AND F2R AND NOT-CLDN23 | 0.866667 | 0.886364 | 0.847826 | SELL AND NOT-AXL AND NOT-MS4A1 | 0.901887 | 0.856631 | 0.952191 |
| PTPRZ1 AND SLCO1C1 AND CD33 | 0.863636 | 0.904762 | 0.826087 | P2RY8 AND NOT-CD22 AND NOT-EDNRB | 0.892193 | 0.836237 | 0.956175 |
| PTPRZ1 AND GPR85 AND CD33 | 0.860465 | 0.925 | 0.804348 | NOT-EDNRB AND SLC7A5 AND NOT-EPHA4 | 0.892139 | 0.824324 | 0.972112 |
| PTPRZ1 AND CRB1 AND CD33 | 0.860465 | 0.925 | 0.804348 | NOT-EDNRB AND SLC7A5 AND NOT-EPHA4 | 0.892139 | 0.824324 | 0.972112 |
| COMPLEX-TNC/PTPRZ1/PCDH15 | 0.863158 | 0.836735 | 0.891304 | CXCR4 AND NOT-SLAMF7 AND NOT-CLDN11 | 0.901887 | 0.856631 | 0.952191 |
| PCDH10 AND F2R AND NOT-EPCAM | 0.857143 | 0.866667 | 0.847826 | NOT-PODXL AND CD33 AND NOT-CD160 | 0.94902 | 0.934363 | 0.964143 |
| PTPRZ1 AND NOT-TPBG AND NOT-GABRA2 | 0.853933 | 0.883721 | 0.826087 | NOT-PODXL AND CD33 AND NOT-MS4A1 | 0.941406 | 0.923372 | 0.960159 |
| PTPRZ1 AND NOT-AOC3 AND FOLR2 | 0.851064 | 0.833333 | 0.869565 | NOT-PTPRK AND CD33 AND NOT-SLAMF7 | 0.945098 | 0.930502 | 0.960159 |
| PTPRZ1 AND NOT-MRGPRF AND FOLR2 | 0.851064 | 0.833333 | 0.869565 | NOT-PODXL AND CD33 AND NOT-FCRL5 | 0.935927 | 0.912879 | 0.960159 |
| PTPRZ1 AND SLC4A8 AND FOLR2 | 0.851064 | 0.833333 | 0.869565 | NOT-PODXL AND CD33 AND NOT-HLA-DOB | 0.933078 | 0.897059 | 0.972112 |
| PTPRZ1 AND NOT-SLC43A1 AND FOLR2 | 0.851064 | 0.833333 | 0.869565 | NOT-PODXL AND CD33 AND NOT-SLAMF7 | 0.934109 | 0.909434 | 0.960159 |
| PTPRZ1 AND NOT-STEAP1 AND ANTXR2 | 0.847826 | 0.847826 | 0.847826 | NOT-PTPRK AND CD33 AND NOT-MS4A1 | 0.940945 | 0.929961 | 0.952191 |
| PTPRZ1 AND NCAM1 AND ANTXR2 | 0.847826 | 0.847826 | 0.847826 | NOT-PTPRK AND NOT-HLA-DOB AND CD33 | 0.930769 | 0.899628 | 0.964143 |
| PTPRZ1 AND NOT-CD52 AND ANTXR2 | 0.847826 | 0.847826 | 0.847826 | NOT-PTPRK AND CD33 AND NOT-FCRL1 | 0.930693 | 0.925197 | 0.936255 |
| PTPRZ1 AND NOT-CLDN23 AND ANTXR2 | 0.847826 | 0.847826 | 0.847826 | NOT-PODXL AND CD33 AND NOT-FCRL1 | 0.930502 | 0.902622 | 0.960159 |
| PTPRZ1 AND NOT-CLDN1 AND ANTXR2 | 0.847826 | 0.847826 | 0.847826 | NOT-PODXL AND CD33 AND NOT-CD22 | 0.92543 | 0.889706 | 0.964143 |
| PTPRZ1 AND NOT-TRPM4 AND ANTXR2 | 0.847826 | 0.847826 | 0.847826 | NOT-PTPRK AND CD33 AND NOT-FCRL5 | 0.934109 | 0.909434 | 0.960159 |
| PTPRZ1 AND NOT-SDC1 AND NOT-SCN2A | 0.845361 | 0.803922 | 0.891304 | NOT-PTPRK AND CD33 AND NOT-CD22 | 0.921305 | 0.888889 | 0.956175 |
| PTPRZ1 AND NCAM1 AND NOT-ATP8A2 | 0.844444 | 0.863636 | 0.826087 | NOT-PODXL AND CD33 AND NOT-CR2 | 0.920455 | 0.877256 | 0.968127 |
| PTPRZ1 AND NOT-CLDN23 AND NOT-GPR83 | 0.844444 | 0.863636 | 0.826087 | NOT-PTPRK AND CD33 AND NOT-SPON2 | 0.939806 | 0.916667 | 0.964143 |
| PTPRZ1 AND NOT-STEAP1 AND NOT-GPR83 | 0.844444 | 0.863636 | 0.826087 | NOT-PTPRK AND CD33 AND NOT-ALDH1A1 | 0.912779 | 0.929752 | 0.896414 |
| PTPRZ1 AND NOT-CLDN23 AND NOT-ATP8A2 | 0.844444 | 0.863636 | 0.826087 | NOT-PODXL AND CD33 AND NOT-SPON2 | 0.91215 | 0.859155 | 0.972112 |
| PTPRZ1 AND NOT-STEAP1 AND NOT-ATP8A2 | 0.844444 | 0.863636 | 0.826087 | NOT-PTPRK AND CD33 AND NOT-OAS1 | 0.936 | 0.939759 | 0.932271 |
| PTPRZ1 AND NOT-TRPM4 AND NOT-ATP8A2 | 0.844444 | 0.863636 | 0.826087 | NOT-PTPRK AND CD33 AND NOT-IL11RA | 0.910891 | 0.905512 | 0.916335 |
| PTPRZ1 AND NOT-CD52 AND NOT-GPR83 | 0.844444 | 0.863636 | 0.826087 | NOT-PTPRK AND CD33 AND NOT-CD79A | 0.908745 | 0.869091 | 0.952191 |
| PTPRZ1 AND NOT-CLDN1 AND NOT-GPR83 | 0.844444 | 0.863636 | 0.826087 | NOT-PTPRK AND CD33 AND NOT-PCYT1A | 0.907721 | 0.860714 | 0.960159 |
| PTPRZ1 AND NOT-CLDN1 AND NOT-ATP8A2 | 0.844444 | 0.863636 | 0.826087 | NOT-PODXL AND CD33 AND NOT-OAS1 | 0.917647 | 0.903475 | 0.932271 |
| PTPRZ1 AND NOT-TRPM4 AND NOT-GPR83 | 0.844444 | 0.863636 | 0.826087 | NOT-PODXL AND CD33 AND NOT-IL11RA | 0.907336 | 0.88015 | 0.936255 |
| PTPRZ1 AND NOT-SDC1 AND NOT-GPR83 | 0.844444 | 0.863636 | 0.826087 | NOT-PODXL AND CD33 AND NOT-ALDH1A1 | 0.905812 | 0.91129 | 0.900398 |
| PTPRZ1 AND NOT-SDC1 AND NOT-ATP8A2 | 0.844444 | 0.863636 | 0.826087 | NOT-PODXL AND CD33 AND NOT-CD79A | 0.902622 | 0.85159 | 0.960159 |
| PTPRZ1 AND NCAM1 AND NOT-GPR83 | 0.844444 | 0.863636 | 0.826087 | NOT-PTPRK AND CD33 AND NOT-CD72 | 0.926357 | 0.901887 | 0.952191 |
| PTPRZ1 AND NOT-SDC1 AND NOT-CDH18 | 0.840909 | 0.880952 | 0.804348 | NOT-PTPRK AND CD33 AND NOT-CXCR5 | 0.899628 | 0.843206 | 0.964143 |
| PTPRZ1 AND NOT-MSMO1 AND FOLR2 | 0.851064 | 0.833333 | 0.869565 | NOT-PODXL AND CD33 AND NOT-ABCA5 | 0.895582 | 0.902834 | 0.888446 |
| PTPRZ1 AND NOT-RNF43 AND NOT-DYSF | 0.833333 | 0.8 | 0.869565 | NOT-PTPRK AND NOT-CD79B AND CD33 | 0.893878 | 0.916318 | 0.87251 |
| PTPRZ1 AND CD82 AND VCAM1 | 0.831461 | 0.860465 | 0.804348 | COMPLEX-ALDH1A1/SLC4A1/CD33 | 0.893617 | 0.868421 | 0.920319 |
| COMPLEX-PTGER4/PTPRZ1/CD33 | 0.829787 | 0.8125 | 0.847826 | NOT-PODXL AND CD33 AND NOT-CD79B | 0.892057 | 0.9125 | 0.87251 |
| PTPRZ1 AND CD33 AND NOT-KCNK6 | 0.829787 | 0.8125 | 0.847826 | CD33 AND NOT-EPHA4 AND NOT-EDNRB | 0.911243 | 0.902344 | 0.920319 |
| PTPRZ1 AND CD33 AND NOT-AOC3 | 0.829787 | 0.8125 | 0.847826 | NOT-PTPRK AND CD33 AND NOT-CD19 | 0.918812 | 0.913386 | 0.924303 |
| PTPRZ1 AND CD33 AND OR2L13 | 0.829787 | 0.8125 | 0.847826 | CD33 AND NOT-EPHA4 AND NOT-ITGB6 | 0.909091 | 0.883459 | 0.936255 |
| PTPRZ1 AND CD33 AND NOT-CD36 | 0.829787 | 0.8125 | 0.847826 | CD33 AND NOT-HLA-DOB AND SLC4A1 | 0.925 | 0.969432 | 0.884462 |
| PTPRZ1 AND CD33 AND SLC4A8 | 0.829787 | 0.8125 | 0.847826 | CD33 AND NOT-TLR1 AND NOT-ERBB2 | 0.882474 | 0.91453 | 0.85259 |
| PTPRZ1 AND CD33 AND NOT-DYSF | 0.829787 | 0.8125 | 0.847826 | CD33 AND NOT-CD79B AND SLC4A1 | 0.874459 | 0.957346 | 0.804781 |
| PTPRZ1 AND CD33 AND NOT-CLDN10 | 0.829787 | 0.8125 | 0.847826 | CD33 AND NOT-SLAMF7 AND SLC4A1 | 0.92562 | 0.961373 | 0.89243 |
| PTPRZ1 AND CD33 AND NOT-MRGPRF | 0.829787 | 0.8125 | 0.847826 | NOT-PTPRK AND CD33 AND NOT-IL13RA1 | 0.867188 | 0.850575 | 0.884462 |
| PTPRZ1 AND CD33 AND NOT-SLC43A1 | 0.829787 | 0.8125 | 0.847826 | COMPLEX-SPON2/SLC4A1/CD33 | 0.867031 | 0.798658 | 0.948207 |
| SLC1A2 AND SLC3A2 AND NOT-SDC1 | 0.833333 | 0.8 | 0.869565 | CD33 AND NOT-ACVR1C AND NOT-CLDN23 | 0.899614 | 0.872659 | 0.928287 |
| PTPRZ1 AND CLDN17 AND NOT-STEAP2 | 0.828283 | 0.773585 | 0.891304 | CD33 AND NOT-ABHD6 AND NOT-CLDN5 | 0.876866 | 0.824561 | 0.936255 |
| PTPRZ1 AND CLDN17 AND NOT-STEAP2 | 0.828283 | 0.773585 | 0.891304 | CD33 AND NOT-CD22 AND SLC4A1 | 0.914761 | 0.956522 | 0.876494 |

FIG. 15 (cont.)

| Antigen Pair Logic | F1 | Precision | Recall |
|---|---|---|---|
| PTPRZ1 AND NOT-CLDN1 AND NOT-KCNJ6 | 0.827586 | 0.878049 | 0.782609 |
| PTPRZ1 AND NOT-EPCAM AND NOT-KCNJ6 | 0.827586 | 0.878049 | 0.782609 |
| PTPRZ1 AND NOT-PMEL AND NOT-KCNJ6 | 0.827586 | 0.878049 | 0.782609 |
| PTPRZ1 AND NCAM1 AND NOT-KCNJ6 | 0.827586 | 0.878049 | 0.782609 |
| PTPRZ1 AND NOT-CLDN23 AND NOT-KCNJ6 | 0.827586 | 0.878049 | 0.782609 |
| PTPRZ1 AND NOT-STEAP1 AND NOT-KCNJ6 | 0.827586 | 0.878049 | 0.782609 |
| PTPRZ1 AND NOT-KCNJ6 AND NOT-CD52 | 0.827586 | 0.878049 | 0.782609 |
| PTPRZ1 AND NOT-TRPM4 AND NOT-KCNJ6 | 0.827586 | 0.878049 | 0.782609 |
| PTPRZ1 AND NOT-SDC1 AND NOT-KCNJ6 | 0.827586 | 0.878049 | 0.782609 |
| PTPRZ1 AND NOT-SDC1 AND STAB1 | 0.826087 | 0.826087 | 0.826087 |
| PTPRZ1 AND SYT6 AND NOT-SDC1 | 0.826087 | 0.826087 | 0.826087 |
| VANGL2 AND NOT-EPCAM AND GABRG2 | 0.826087 | 0.826087 | 0.826087 |
| PTPRZ1 AND NOT-SDC1 AND NOT-GPR22 | 0.823529 | 0.897436 | 0.76087 |
| PTPRZ1 AND NOT-SDC1 AND NOT-SYT4 | 0.823529 | 0.897436 | 0.76087 |
| VANGL2 AND NOT-EPCAM AND P2RX4 | 0.864198 | 1 | 0.76087 |
| SLC1A2 AND F2RL1 AND NOT-CLDN1 | 0.827586 | 0.878049 | 0.782609 |
| PTPRZ1 AND SEMA5B AND NOT-CNTNAP2 | 0.819277 | 0.918919 | 0.73913 |
| PTPRZ1 AND NOT-SDC1 AND VANGL1 | 0.819277 | 0.918919 | 0.73913 |
| VANGL2 AND NOT-TPBG AND NOT-CNTNAP2 | 0.818182 | 0.857143 | 0.782609 |
| PTPRZ1 AND NOT-CLDN23 AND SEMA4B | 0.817204 | 0.808511 | 0.826087 |
| PTPRZ1 AND NOT-SDC1 AND SEMA4B | 0.817204 | 0.808511 | 0.826087 |
| PTPRZ1 AND NOT-TRPM4 AND SEMA4B | 0.817204 | 0.808511 | 0.826087 |
| PTPRZ1 AND NCAM1 AND SEMA4B | 0.817204 | 0.808511 | 0.826087 |
| PTPRZ1 AND NOT-CLDN1 AND SEMA4B | 0.817204 | 0.808511 | 0.826087 |
| SLC1A2 AND F2R AND NOT-SDC1 | 0.835165 | 0.844444 | 0.826087 |
| SLC1A2 AND F2R AND NOT-CLDN1 | 0.835165 | 0.844444 | 0.826087 |
| PTPRZ1 AND NOT-SDK1 AND HAS2 | 0.917647 | 1 | 0.847826 |
| PTPRZ1 AND NOT-FZD10 AND HAS2 | 0.917647 | 1 | 0.847826 |
| PTPRZ1 AND NOT-ZDHHC5 AND HAS2 | 0.906977 | 0.975 | 0.847826 |
| PTPRZ1 AND NOT-SMAGP AND HAS2 | 0.906977 | 0.975 | 0.847826 |
| PTPRZ1 AND NOT-GPR87 AND HAS2 | 0.906977 | 0.975 | 0.847826 |
| PTPRZ1 AND SLC8A2 AND HAS2 | 0.906977 | 0.975 | 0.847826 |
| PTPRZ1 AND GPM6B AND HAS2 | 0.906977 | 0.975 | 0.847826 |
| PTPRZ1 AND NOT-DUOX1 AND HAS2 | 0.906977 | 0.975 | 0.847826 |
| PTPRZ1 AND SEMA6D AND HAS2 | 0.906977 | 0.975 | 0.847826 |
| PTPRZ1 AND SCAMP5 AND HAS2 | 0.906977 | 0.975 | 0.847826 |
| PTPRZ1 AND NOT-F11R AND HAS2 | 0.906977 | 0.975 | 0.847826 |
| PTPRZ1 AND NOT-ST14 AND HAS2 | 0.906977 | 0.975 | 0.847826 |
| PTPRZ1 AND NOT-SLC46A2 AND HAS2 | 0.906977 | 0.975 | 0.847826 |
| PTPRZ1 AND NOT-BTC AND HAS2 | 0.906977 | 0.975 | 0.847826 |
| PTPRZ1 AND NOT-ACPP AND HAS2 | 0.906977 | 0.975 | 0.847826 |
| PTPRZ1 AND NOT-PERP AND HAS2 | 0.906977 | 0.975 | 0.847826 |
| PTPRZ1 AND NOT-COL17A1 AND HAS2 | 0.906977 | 0.975 | 0.847826 |
| PTPRZ1 AND NOT-RECK AND HAS2 | 0.906977 | 0.975 | 0.847826 |
| PTPRZ1 AND NOT-AQP3 AND HAS2 | 0.906977 | 0.975 | 0.847826 |
| PTPRZ1 AND NOT-SPINT1 AND HAS2 | 0.906977 | 0.975 | 0.847826 |
| PTPRZ1 AND NOT-SLC6A14 AND HAS2 | 0.906977 | 0.975 | 0.847826 |
| PTPRZ1 AND SYNDIG1 AND HAS2 | 0.906977 | 0.975 | 0.847826 |
| PTPRZ1 AND NOT-LRP11 AND HAS2 | 0.906977 | 0.975 | 0.847826 |
| PTPRZ1 AND NOT-IL22RA1 AND HAS2 | 0.906977 | 0.975 | 0.847826 |
| PTPRZ1 AND GPR173 AND HAS2 | 0.906977 | 0.975 | 0.847826 |
| PTPRZ1 AND NOT-ATP2C2 AND HAS2 | 0.906977 | 0.975 | 0.847826 |
| PTPRZ1 AND ADAM22 AND HAS2 | 0.906977 | 0.975 | 0.847826 |
| PTPRZ1 AND NOT-SLC15A1 AND HAS2 | 0.906977 | 0.975 | 0.847826 |
| PTPRZ1 AND NOT-ACVRL1 AND HAS2 | 0.906977 | 0.975 | 0.847826 |
| PTPRZ1 AND LRRTM2 AND HAS2 | 0.906977 | 0.975 | 0.847826 |
| PTPRZ1 AND NOT-MYOF AND HAS2 | 0.906977 | 0.975 | 0.847826 |
| PTPRZ1 AND SLC4A4 AND HAS2 | 0.906977 | 0.975 | 0.847826 |
| PTPRZ1 AND NOT-F11R AND MPZL1 | 0.904762 | 1 | 0.826087 |
| PTPRZ1 AND NOT-SLC35G1 AND MPZL1 | 0.904762 | 1 | 0.826087 |
| PTPRZ1 AND NOT-SLC6A14 AND MPZL1 | 0.904762 | 1 | 0.826087 |
| PTPRZ1 AND NOT-ATP2C2 AND MPZL1 | 0.904762 | 1 | 0.826087 |
| PTPRZ1 AND NOT-FZD10 AND MPZL1 | 0.904762 | 1 | 0.826087 |
| PTPRZ1 AND NOT-SPPL3 AND MPZL1 | 0.904762 | 1 | 0.826087 |
| PTPRZ1 AND ADAM22 AND MPZL1 | 0.904762 | 1 | 0.826087 |
| PTPRZ1 AND CLSTN2 AND MPZL1 | 0.904762 | 1 | 0.826087 |
| PTPRZ1 AND NOT-SDK1 AND MPZL1 | 0.904762 | 1 | 0.826087 |
| PTPRZ1 AND NOT-RECK AND MPZL1 | 0.904762 | 1 | 0.826087 |
| PTPRZ1 AND NOT-SLCO4C1 AND MPZL1 | 0.904762 | 1 | 0.826087 |
| PTPRZ1 AND NOT-ST14 AND MPZL1 | 0.904762 | 1 | 0.826087 |
| PTPRZ1 AND NOT-ACPP AND MPZL1 | 0.904762 | 1 | 0.826087 |
| PTPRZ1 AND LRRTM2 AND MPZL1 | 0.904762 | 1 | 0.826087 |
| PTPRZ1 AND NOT-TNFSF10 AND MPZL1 | 0.904762 | 1 | 0.826087 |
| PTPRZ1 AND NOT-ANO1 AND MPZL1 | 0.904762 | 1 | 0.826087 |
| PTPRZ1 AND NOT-IL1R2 AND MPZL1 | 0.904762 | 1 | 0.826087 |
| PTPRZ1 AND NOT-ATP10D AND MPZL1 | 0.904762 | 1 | 0.826087 |
| PTPRZ1 AND NOT-ZDHHC5 AND MPZL1 | 0.904762 | 1 | 0.826087 |

| Antigen Pair Logic | F1 | Precision | Recall |
|---|---|---|---|
| CD33 AND NOT-ABHD6 AND NOT-EDNRB | 0.871698 | 0.827957 | 0.920319 |
| CD33 AND NOT-LPAR1 AND CD70 | 0.880455 | 0.84058 | 0.924303 |
| CD33 AND NOT-CD79A AND SLC4A1 | 0.908714 | 0.948052 | 0.87251 |
| CD33 AND NOT-TNFRSF17 AND SLC4A1 | 0.915612 | 0.973094 | 0.864542 |
| COMPLEX-IL11RA/SLC4A1/CD33 | 0.853229 | 0.838462 | 0.868526 |
| CD33 AND NOT-CD72 AND SLC4A1 | 0.91858 | 0.964912 | 0.876494 |
| CD33 AND NOT-ABHD6 AND CD70 | 0.889313 | 0.85348 | 0.928287 |
| COMPLEX-PCYT1A/SLC4A1/CD33 | 0.851211 | 0.752294 | 0.98008 |
| CD33 AND NOT-ACVR1C AND NOT-CLDN11 | 0.847826 | 0.777409 | 0.932271 |
| CD33 AND NOT-DAG1 AND CD70 | 0.87218 | 0.825623 | 0.924303 |
| COMPLEX-ST8SIA1/SLC4A1/CD33 | 0.84375 | 0.747692 | 0.968127 |
| CD33 AND NOT-CD19 AND SLC4A1 | 0.906445 | 0.947826 | 0.868526 |
| CD33 AND NOT-EDNRB AND NOT-KIAA1324 | 0.836364 | 0.769231 | 0.916335 |
| COMPLEX-OAS1/SLC4A1/CD33 | 0.88632 | 0.858209 | 0.916335 |
| CD33 AND NOT-ACVR1C AND NOT-ERBB2 | 0.83274 | 0.752412 | 0.932271 |
| COMPLEX-ITPR3/CLDN5/CD33 | 0.831858 | 0.748408 | 0.936255 |
| CD33 AND NOT-SLC25A4 AND SLC7A5 | 0.857678 | 0.809187 | 0.912351 |
| NOT-ABCA5 AND CD33 AND SLC4A1 | 0.825054 | 0.900943 | 0.760956 |
| COMPLEX-SLC4A1/SLC7A5/CD33 | 0.85461 | 0.769968 | 0.960159 |
| NOT-PTPRK AND CD33 AND NOT-P2RX5 | 0.816415 | 0.891509 | 0.752988 |
| NOT-PODXL AND BIRC5 AND CD33 | 0.814655 | 0.887324 | 0.752988 |
| NOT-PODXL AND CD33 AND PROM1 | 0.8125 | 0.923858 | 0.7251 |
| CD33 AND NOT-P2RX5 AND SLC4A1 | 0.808314 | 0.961538 | 0.697211 |
| CD33 AND NOT-ENPP5 AND NOT-EDNRB | 0.801394 | 0.712074 | 0.916335 |
| NOT-PHLDB2 AND SLC7A5 AND ANXA1 | 0.953668 | 0.925094 | 0.984064 |
| NOT-PHLDB2 AND NOT-ERBB3 AND DDX3X | 0.939163 | 0.898182 | 0.984064 |
| NOT-PHLDB2 AND SLC7A5 AND DDX3X | 0.936416 | 0.906716 | 0.968127 |
| NOT-PHLDB2 AND SLC7A5 AND CD52 | 0.930502 | 0.902622 | 0.960159 |
| SLC22A16 AND SLC7A5 AND NOT-EDNRB | 0.923695 | 0.931174 | 0.916335 |
| NOT-PHLDB2 AND DDX3X AND NOT-BMPR1B | 0.923664 | 0.886447 | 0.964143 |
| NOT-PHLDB2 AND DDX3X AND NOT-FOLH1 | 0.923372 | 0.889299 | 0.960159 |
| NOT-PHLDB2 AND DDX3X AND NOT-SDC1 | 0.916667 | 0.873646 | 0.964143 |
| NOT-PHLDB2 AND DDX3X AND NOT-CLDN7 | 0.916667 | 0.873646 | 0.964143 |
| NOT-PHLDB2 AND DDX3X AND NOT-ERBB2 | 0.916667 | 0.873646 | 0.964143 |
| NOT-AXL AND EMP3 AND NOT-CD160 | 0.915254 | 0.867857 | 0.968127 |
| NOT-PHLDB2 AND DDX3X AND NOT-CLDN8 | 0.914934 | 0.870504 | 0.964143 |
| NOT-PHLDB2 AND DDX3X AND NOT-RNF43 | 0.914934 | 0.870504 | 0.964143 |
| NOT-PHLDB2 AND DDX3X AND NOT-EPCAM | 0.914611 | 0.873188 | 0.960159 |
| NOT-PHLDB2 AND DDX3X AND NOT-VTCN1 | 0.913208 | 0.867384 | 0.964143 |
| NOT-AXL AND EMP3 AND NOT-SLAMF7 | 0.911488 | 0.864286 | 0.964143 |
| NOT-PHLDB2 AND DDX3X AND NOT-STEAP1 | 0.910476 | 0.872263 | 0.952191 |
| NOT-PHLDB2 AND DDX3X AND NOT-MET | 0.908387 | 0.871795 | 0.948207 |
| NOT-AXL AND EMP3 AND NOT-FCRL5 | 0.908068 | 0.858156 | 0.964143 |
| NOT-AXL AND EMP3 AND NOT-HLA-DOB | 0.907407 | 0.847751 | 0.976096 |
| NOT-PHLDB2 AND DDX3X AND NOT-MUC1 | 0.902111 | 0.87037 | 0.936255 |
| NOT-EDNRB AND EMP3 AND NOT-CD160 | 0.895238 | 0.857664 | 0.936255 |
| NOT-EDNRB AND EMP3 AND NOT-SLAMF7 | 0.893536 | 0.854545 | 0.936255 |
| NOT-ERBB2 AND CD44 AND NOT-SLAMF7 | 0.892989 | 0.831615 | 0.964143 |
| NOT-AXL AND EMP3 AND NOT-TNFRSF17 | 0.892193 | 0.836237 | 0.956175 |
| NOT-AXL AND EMP3 AND NOT-CD22 | 0.892139 | 0.824324 | 0.972112 |
| NOT-KDR AND EMP3 AND NOT-HLA-DOB | 0.891304 | 0.817276 | 0.98008 |
| NOT-EDNRB AND EMP3 AND NOT-MS4A1 | 0.886792 | 0.842294 | 0.936255 |
| NOT-ALDH1A1 AND SLC30A1 AND NOT-EGFR | 0.885496 | 0.849817 | 0.924303 |
| NOT-PHLDB2 AND SLC7A5 AND NOT-ERBB4 | 0.883721 | 0.801948 | 0.984064 |
| NOT-PHLDB2 AND SLC7A5 AND NOT-ERBB4 | 0.883721 | 0.801948 | 0.984064 |
| NOT-AXL AND EMP3 AND NOT-CD72 | 0.883636 | 0.812709 | 0.968127 |
| NOT-ERBB2 AND CD44 AND NOT-HLA-DOB | 0.882143 | 0.799353 | 0.984064 |
| NOT-ALDH1A1 AND SLC30A1 AND NOT-ERBB2 | 0.878788 | 0.837545 | 0.924303 |
| NOT-EDNRB AND SLC7A5 AND NOT-STEAP4 | 0.878505 | 0.827465 | 0.936255 |
| NOT-EDNRB AND EMP3 AND NOT-HLA-DOB | 0.878229 | 0.817869 | 0.948207 |
| NOT-EDNRB AND EMP3 AND NOT-FCRL5 | 0.877778 | 0.820069 | 0.944223 |
| NOT-EDNRB AND SLC7A5 AND NOT-S1PR1 | 0.875676 | 0.799342 | 0.968127 |
| NOT-EDNRB AND SLC7A5 AND NOT-SYT11 | 0.875 | 0.812287 | 0.948207 |
| NOT-PHLDB2 AND ENG AND NOT-FOLH1 | 0.873706 | 0.909483 | 0.840637 |
| NOT-EDNRB AND EMP3 AND NOT-TNFRSF17 | 0.870544 | 0.822695 | 0.924303 |
| NOT-PHLDB2 AND ENG AND NOT-ERBB3 | 0.870103 | 0.901709 | 0.840637 |
| NOT-ALDH1A1 AND SLC30A1 AND NOT-SLC39A6 | 0.870544 | 0.822695 | 0.924303 |
| NOT-ALDH1A1 AND EMP3 AND NOT-AXL | 0.868526 | 0.868526 | 0.868526 |
| NOT-ALDH1A1 AND CD44 AND NOT-ERBB2 | 0.867925 | 0.824373 | 0.916335 |
| NOT-ALDH1A1 AND EMP3 AND NOT-KDR | 0.865613 | 0.858824 | 0.87251 |
| NOT-EDNRB AND EMP3 AND NOT-CD22 | 0.864964 | 0.79798 | 0.944223 |
| LAPTM5 AND NOT-ERBB2 AND NOT-HLA-DOB | 0.890071 | 0.801917 | 1 |
| NOT-AXL AND EMP3 AND NOT-OAS1 | 0.863551 | 0.81338 | 0.920319 |
| NOT-EDNRB AND SLC7A5 AND SLCO1B3 | 0.860254 | 0.79 | 0.944223 |
| NOT-ERBB2 AND CD44 AND NOT-CD19 | 0.857143 | 0.784768 | 0.944223 |
| NOT-PHLDB2 AND NOT-CEACAM5 AND NOT-ERBB4 | 0.853701 | 0.751515 | 0.988048 |
| NOT-ALDH1A1 AND CD44 AND NOT-CLDN8 | 0.856611 | 0.804196 | 0.916335 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND SEMA6D AND MPZL1 | 0.904762 | 1 | 0.826087 | NOT-ITGAV AND SLC39A6 AND NOT-BTN3A1 | 0.851563 | 0.835249 | 0.868526 |
| PTPRZ1 AND SYNDIG1 AND MPZL1 | 0.904762 | 1 | 0.826087 | NOT-STEAP1 AND EMP3 AND NOT-HLA-DOB | 0.851064 | 0.766773 | 0.956175 |
| PTPRZ1 AND NOT-SLC16A10 AND MPZL1 | 0.904762 | 1 | 0.826087 | NOT-STEAP1 AND EMP3 AND NOT-SLAMF7 | 0.849462 | 0.771987 | 0.944223 |
| PTPRZ1 AND NOT-IL22RA1 AND MPZL1 | 0.904762 | 1 | 0.826087 | NOT-PHLDB2 AND SLC7A5 AND NOT-STEAP2 | 0.847341 | 0.743976 | 0.984064 |
| PTPRZ1 AND NOT-LY6K AND MPZL1 | 0.904762 | 1 | 0.826087 | NOT-PHLDB2 AND SLC7A5 AND NOT-STEAP2 | 0.847341 | 0.743976 | 0.984064 |
| PTPRZ1 AND NOT-ACP1 AND MPZL1 | 0.904762 | 1 | 0.826087 | LAPTM5 AND NOT-ERBB2 AND NOT-SLAMF7 | 0.875445 | 0.790997 | 0.98008 |
| PTPRZ1 AND NOT-IL2RB AND MPZL1 | 0.904762 | 1 | 0.826087 | NOT-ERBB2 AND EMP3 AND NOT-HLA-DOB | 0.845754 | 0.748466 | 0.972112 |
| PTPRZ1 AND NOT-SLC46A2 AND MPZL1 | 0.904762 | 1 | 0.826087 | NOT-ALDH1A1 AND VAMP8 AND NOT-EGFR | 0.845173 | 0.778523 | 0.924303 |
| PTPRZ1 AND NOT-GPR87 AND MPZL1 | 0.904762 | 1 | 0.826087 | NOT-PHLDB2 AND NOT-ERBB3 AND MUC1 | 0.844538 | 0.893333 | 0.800797 |
| PTPRZ1 AND NOT-MYOF AND MPZL1 | 0.904762 | 1 | 0.826087 | NOT-PHLDB2 AND NOT-ERBB3 AND MUC1 | 0.844538 | 0.893333 | 0.800797 |
| PTPRZ1 AND NOT-SPINT1 AND MPZL1 | 0.904762 | 1 | 0.826087 | NOT-ERBB2 AND CD44 AND NOT-OAS1 | 0.844203 | 0.774086 | 0.928287 |
| PTPRZ1 AND GPM6B AND MPZL1 | 0.904762 | 1 | 0.826087 | CD37 AND NOT-PHLDB2 AND MUC1 | 0.843956 | 0.941176 | 0.76494 |
| PTPRZ1 AND NOT-ITPR3 AND MPZL1 | 0.904762 | 1 | 0.826087 | NOT-PHLDB2 AND CD70 AND NOT-FOLH1 | 0.843478 | 0.92823 | 0.772908 |
| PTPRZ1 AND NOT-LRP11 AND MPZL1 | 0.904762 | 1 | 0.826087 | NOT-ERBB2 AND CD44 AND NOT-IL11RA | 0.843066 | 0.777778 | 0.920319 |
| PTPRZ1 AND NOT-SMAGP AND MPZL1 | 0.904762 | 1 | 0.826087 | NOT-ABCA5 AND SLC30A1 AND NOT-ERBB2 | 0.842324 | 0.878788 | 0.808765 |
| PTPRZ1 AND NOT-PERP AND MPZL1 | 0.904762 | 1 | 0.826087 | NOT-ERBB2 AND EMP3 AND SLC7A5 | 0.840426 | 0.757188 | 0.944223 |
| PTPRZ1 AND NOT-APCDD1 AND MPZL1 | 0.904762 | 1 | 0.826087 | NOT-ERBB2 AND EMP3 AND NOT-SLAMF7 | 0.839721 | 0.74613 | 0.960159 |
| PTPRZ1 AND SLC4A4 AND MPZL1 | 0.904762 | 1 | 0.826087 | NOT-EDNRB AND EMP3 AND NOT-CD79A | 0.839286 | 0.760518 | 0.936255 |
| PTPRZ1 AND NOT-SLMAP AND MPZL1 | 0.904762 | 1 | 0.826087 | NOT-ABCA5 AND EMP3 AND NOT-AXL | 0.837607 | 0.903226 | 0.780876 |
| PTPRZ1 AND NOT-ACVRL1 AND MPZL1 | 0.904762 | 1 | 0.826087 | NOT-ATP8B1 AND SLC7A5 AND NOT-EDNRB | 0.836555 | 0.748428 | 0.948207 |
| PTPRZ1 AND NOT-SLC15A1 AND MPZL1 | 0.904762 | 1 | 0.826087 | NOT-ATP8B1 AND SLC7A5 AND NOT-EDNRB | 0.836555 | 0.748428 | 0.948207 |
| PTPRZ1 AND NOT-AQP9 AND MPZL1 | 0.904762 | 1 | 0.826087 | NOT-PHLDB2 AND NOT-FOLH1 AND MUC1 | 0.836134 | 0.884444 | 0.792829 |
| PTPRZ1 AND GPR173 AND MPZL1 | 0.904762 | 1 | 0.826087 | NOT-PHLDB2 AND NOT-FOLH1 AND MUC1 | 0.836134 | 0.884444 | 0.792829 |
| PTPRZ1 AND NOT-F2RL1 AND MPZL1 | 0.904762 | 1 | 0.826087 | NOT-ERBB2 AND CD44 AND SLC7A5 | 0.834783 | 0.740741 | 0.956175 |
| PTPRZ1 AND SLC8A2 AND MPZL1 | 0.904762 | 1 | 0.826087 | LAPTM5 AND NOT-CLDN7 AND NOT-HLA-DOB | 0.896429 | 0.812298 | 1 |
| PTPRZ1 AND NOT-SACM1L AND MPZL1 | 0.904762 | 1 | 0.826087 | NOT-EDNRB AND SLC7A5 AND NOT-TGFBI | 0.834559 | 0.774744 | 0.904382 |
| PTPRZ1 AND NOT-SLC12A7 AND MPZL1 | 0.904762 | 1 | 0.826087 | NOT-ERBB2 AND EMP3 AND NOT-SPON2 | 0.831889 | 0.736196 | 0.956175 |
| PTPRZ1 AND MPZL1 AND NOT-GDE1 | 0.904762 | 1 | 0.826087 | CD44 AND NOT-SPON2 AND NOT-CLDN8 | 0.831793 | 0.775862 | 0.896414 |
| PTPRZ1 AND NOT-KCNK5 AND MPZL1 | 0.904762 | 1 | 0.826087 | NOT-EDNRB AND SLC43A1 AND SLC7A5 | 0.829694 | 0.917874 | 0.756972 |
| PTPRZ1 AND NOT-BTC AND MPZL1 | 0.904762 | 1 | 0.826087 | LAPTM5 AND SLC7A5 AND NOT-CLDN5 | 0.835616 | 0.732733 | 0.972112 |
| PTPRZ1 AND NOT-DUOX1 AND MPZL1 | 0.904762 | 1 | 0.826087 | LAPTM5 AND SLC7A5 AND NOT-CLDN11 | 0.845754 | 0.748466 | 0.972112 |
| PTPRZ1 AND OR51B6 AND MPZL1 | 0.904762 | 1 | 0.826087 | NOT-EDNRB AND SLC7A5 AND P2RX4 | 0.828571 | 0.750809 | 0.924303 |
| PTPRZ1 AND NOT-CDH1 AND MPZL1 | 0.904762 | 1 | 0.826087 | NOT-ERBB2 AND SLC7A5 AND VAMP8 | 0.828523 | 0.721893 | 0.972112 |
| PTPRZ1 AND NRCAM AND F2RL1 | 0.904762 | 1 | 0.826087 | NOT-PHLDB2 AND SLC7A5 AND CD70 | 0.828179 | 0.728097 | 0.960159 |
| PTPRZ1 AND NOT-TMEM30B AND MPZL1 | 0.904762 | 1 | 0.826087 | NOT-ABCA5 AND CD44 AND NOT-FAP | 0.828157 | 0.862069 | 0.796813 |
| PTPRZ1 AND NOT-AQP3 AND MPZL1 | 0.904762 | 1 | 0.826087 | NOT-EDNRB AND CD44 AND SLC7A5 | 0.827709 | 0.746795 | 0.928287 |
| PTPRZ1 AND NOT-P2RY14 AND MPZL1 | 0.904762 | 1 | 0.826087 | LAPTM5 AND SLC7A5 AND NOT-ROR1 | 0.835616 | 0.732733 | 0.972112 |
| PTPRZ1 AND NOT-TMEM30B AND HAS2 | 0.898876 | 0.930233 | 0.869565 | NOT-GPR137B AND SLC7A5 AND NOT-EDNRB | 0.825911 | 0.839506 | 0.812749 |
| PTPRZ1 AND NRCAM AND CLCN5 | 0.898876 | 0.930233 | 0.869565 | LAPTM5 AND NOT-ERBB2 AND SLC7A5 | 0.844291 | 0.746177 | 0.972112 |
| PTPRZ1 AND ITM2B AND NOT-SACM1L | 0.896552 | 0.95122 | 0.847826 | NOT-ERBB2 AND CD44 AND NOT-PCYT1A | 0.825503 | 0.713043 | 0.98008 |
| PTPRZ1 AND NOT-LRP11 AND ITM2B | 0.896552 | 0.95122 | 0.847826 | NOT-ABCA5 AND CD44 AND NOT-ERBB2 | 0.824742 | 0.854701 | 0.796813 |
| PTPRZ1 AND NRCAM AND TPCN2 | 0.888889 | 0.909091 | 0.869565 | CD44 AND NOT-CLDN8 AND NOT-SLAMF7 | 0.869565 | 0.797342 | 0.956175 |
| PTPRZ1 AND NOT-FZD10 AND F2RL1 | 0.888889 | 0.909091 | 0.869565 | NOT-EDNRB AND SLC7A5 AND SLC30A1 | 0.824324 | 0.715543 | 0.972112 |
| PTPRZ1 AND NRCAM AND NOT-LRP11 | 0.888889 | 0.909091 | 0.869565 | NOT-STEAP1 AND EMP3 AND SLC7A5 | 0.821869 | 0.737342 | 0.928287 |
| PTPRZ1 AND NOT-FZD10 AND F2RL1 | 0.888889 | 0.909091 | 0.869565 | NOT-PHLDB2 AND ENG AND NOT-ERBB4 | 0.821012 | 0.802281 | 0.840637 |
| PTPRZ1 AND ITM2B AND NOT-RECK | 0.886364 | 0.928571 | 0.847826 | NOT-ABCA5 AND EMP3 AND NOT-KDR | 0.820833 | 0.860262 | 0.784861 |
| PTPRZ1 AND ITM2B AND NOT-COL17A1 | 0.886364 | 0.928571 | 0.847826 | CD44 AND NOT-CLDN8 AND NOT-HLA-DOB | 0.862676 | 0.772871 | 0.976096 |
| PTPRZ1 AND GPR85 AND HAS2 | 0.906977 | 0.975 | 0.847826 | NOT-PHLDB2 AND CD33 AND SLC7A5 | 0.961771 | 0.971545 | 0.952191 |
| PTPRZ1 AND F2R AND NOT-FZD10 | 0.906977 | 0.975 | 0.847826 | NOT-PHLDB2 AND CD33 AND NOT-STEAP2 | 0.942801 | 0.933594 | 0.952191 |
| PTPRZ1 AND NOT-CD36 AND HAS2 | 0.906977 | 0.975 | 0.847826 | NOT-PHLDB2 AND CD33 AND NOT-CLDN8 | 0.940945 | 0.929961 | 0.952191 |
| PTPRZ1 AND CRB1 AND HAS2 | 0.906977 | 0.975 | 0.847826 | NOT-PHLDB2 AND CD33 AND NOT-RNF43 | 0.939096 | 0.926357 | 0.952191 |
| PTPRZ1 AND SLCO1C1 AND HAS2 | 0.906977 | 0.975 | 0.847826 | COMPLEX-VTCN1/PHLDB2/CD33 | 0.939096 | 0.926357 | 0.952191 |
| PTPRZ1 AND NOT-KCNK6 AND HAS2 | 0.906977 | 0.975 | 0.847826 | NOT-PHLDB2 AND CD33 AND MUC1 | 0.871111 | 0.984925 | 0.780876 |
| PTPRZ1 AND NOT-LRIG3 AND HAS2 | 0.906977 | 0.975 | 0.847826 | CD33 AND NOT-GHR AND SLC7A5 | 0.85283 | 0.810036 | 0.900398 |
| PTPRZ1 AND MOG AND HAS2 | 0.906977 | 0.975 | 0.847826 | NOT-EDNRB AND SLC7A5 AND NOT-HLA-DOB | 0.872987 | 0.792208 | 0.972112 |
| PTPRZ1 AND SLCO1A2 AND HAS2 | 0.906977 | 0.975 | 0.847826 | NOT-ABCA5 AND SLC7A5 AND NOT-EDNRB | 0.824268 | 0.867841 | 0.784861 |
| PTPRZ1 AND CLDN17 AND HAS2 | 0.906977 | 0.975 | 0.847826 | NOT-EDNRB AND SLC7A5 AND DDX3X | 0.813675 | 0.712575 | 0.948207 |
| PTPRZ1 AND ATP2B2 AND HAS2 | 0.906977 | 0.975 | 0.847826 | NOT-EDNRB AND SLC7A5 AND NOT-CEACAM5 | 0.806612 | 0.689266 | 0.972112 |
| PTPRZ1 AND KCNJ10 AND HAS2 | 0.906977 | 0.975 | 0.847826 | CD33 AND NOT-EDNRB AND SLC7A5 | 0.850662 | 0.809353 | 0.896414 |
| PTPRZ1 AND SLC4A8 AND HAS2 | 0.906977 | 0.975 | 0.847826 | Liposarcoma | | | |
| PTPRZ1 AND NOT-ATP8B1 AND HAS2 | 0.906977 | 0.975 | 0.847826 | ADAM12 AND NOT-ITGA6 AND SLC6A18 | 0.865672 | 0.935484 | 0.805556 |
| PTPRZ1 AND SLC1A2 AND HAS2 | 0.906977 | 0.975 | 0.847826 | CNTNAP1 AND CD68 AND NOT-GPR22 | 0.833333 | 0.833333 | 0.833333 |
| PTPRZ1 AND GABRB2 AND MPZL1 | 0.904762 | 1 | 0.826087 | NOT-CXADR AND LIFR AND TNFRSF10B | 0.80597 | 0.870968 | 0.75 |
| PTPRZ1 AND NOT-SLC43A1 AND MPZL1 | 0.904762 | 1 | 0.826087 | NOT-CXADR AND MCAM AND TNFRSF10B | 0.84375 | 0.964286 | 0.75 |
| PTPRZ1 AND KCNA2 AND MPZL1 | 0.904762 | 1 | 0.826087 | SLC2A10 AND PROCR AND NOT-ITGA6 | 0.860759 | 0.790698 | 0.944444 |
| PTPRZ1 AND GABBR2 AND MPZL1 | 0.904762 | 1 | 0.826087 | ADAM12 AND KCNV2 AND S100A10 | 0.837838 | 0.815789 | 0.861111 |
| PTPRZ1 AND MPZL1 AND NOT-MRGPRF | 0.904762 | 1 | 0.826087 | ADAM12 AND FCAMR AND NOT-CLCA2 | 0.805195 | 0.756098 | 0.861111 |
| PTPRZ1 AND NOT-CD36 AND MPZL1 | 0.904762 | 1 | 0.826087 | PLXND1 AND NOT-MUC15 AND GABRA1 | 0.842105 | 0.8 | 0.888889 |
| PTPRZ1 AND CRB1 AND MPZL1 | 0.904762 | 1 | 0.826087 | CNTNAP1 AND NOT-GPR22 AND CHIC2 | 0.84507 | 0.857143 | 0.833333 |
| PTPRZ1 AND SLCO1C1 AND MPZL1 | 0.904762 | 1 | 0.826087 | ADAM12 AND NOT-ITGA6 AND KL | 0.828571 | 0.852941 | 0.805556 |
| PTPRZ1 AND GPR85 AND MPZL1 | 0.904762 | 1 | 0.826087 | ADAM12 AND NOT-LRP2 AND CHIC2 | 0.810811 | 0.789474 | 0.833333 |
| PTPRZ1 AND NOT-EPHA2 AND MPZL1 | 0.904762 | 1 | 0.826087 | ADAM12 AND NOT-ITGA6 AND SIRPA | 0.861111 | 0.861111 | 0.861111 |
| PTPRZ1 AND NOT-KCNK6 AND MPZL1 | 0.904762 | 1 | 0.826087 | ADAM12 AND NOT-ITGA6 AND DUOX1 | 0.826667 | 0.794872 | 0.861111 |
| PTPRZ1 AND NOT-LRIG3 AND MPZL1 | 0.904762 | 1 | 0.826087 | ADAM12 AND NOT-ITGA6 AND CD4 | 0.826667 | 0.794872 | 0.861111 |
| PTPRZ1 AND NOT-AOC3 AND MPZL1 | 0.904762 | 1 | 0.826087 | ADAM12 AND NOT-ITGA6 AND CLEC2B | 0.805195 | 0.756098 | 0.861111 |
| PTPRZ1 AND KCNJ10 AND MPZL1 | 0.904762 | 1 | 0.826087 | ADAM12 AND NOT-ITGA6 AND CD68 | 0.837838 | 0.815789 | 0.861111 |
| PTPRZ1 AND CLDN17 AND MPZL1 | 0.904762 | 1 | 0.826087 | ADAM12 AND NOT-ITGA6 AND S100A10 | 0.869565 | 0.909091 | 0.833333 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND SLC4A8 AND MPZL1 | 0.904762 | 1 | 0.826087 | ADAM12 AND NOT-ITGA6 AND EMP1 | 0.873239 | 0.885714 | 0.861111 |
| PTPRZ1 AND SLC1A2 AND MPZL1 | 0.904762 | 1 | 0.826087 | ADAM12 AND NOT-ITGA6 AND CXCR4 | 0.828571 | 0.852941 | 0.805556 |
| PTPRZ1 AND MOG AND MPZL1 | 0.904762 | 1 | 0.826087 | ADAM12 AND NOT-LRP2 AND NCAM2 | 0.8 | 0.769231 | 0.833333 |
| PTPRZ1 AND CSF1R AND NOT-DYSF | 0.896552 | 0.95122 | 0.847826 | SLC2A10 AND EMP1 AND NOT-ITGA6 | 0.871795 | 0.809524 | 0.944444 |
| PTPRZ1 AND F2R AND NOT-SDK1 | 0.896552 | 0.95122 | 0.847826 | ADAM12 AND NOT-ITGA6 AND CLPTM1 | 0.869565 | 0.909091 | 0.833333 |
| PTPRZ1 AND CSF1R AND NOT-DYSF | 0.896552 | 0.95122 | 0.847826 | SLC2A10 AND NOT-IYD AND CD68 | 0.825 | 0.75 | 0.916667 |
| PTPRZ1 AND NOT-FZD10 AND ANTXR2 | 0.896552 | 0.95122 | 0.847826 | SLC2A10 AND GJA1 AND NOT-ITGA6 | 0.849315 | 0.837838 | 0.861111 |
| PTPRZ1 AND CLDN17 AND F2RL1 | 0.894118 | 0.974359 | 0.826087 | ADAM12 AND NOT-ITGA6 AND EDNRB | 0.826667 | 0.794872 | 0.861111 |
| PTPRZ1 AND CLDN17 AND ABCA1 | 0.894118 | 0.974359 | 0.826087 | CD276 AND NOT-ITGA6 AND NOT-ATP12A | 0.873239 | 0.885714 | 0.861111 |
| PTPRZ1 AND NOT-TMEM30B AND NOT-GRM3 | 0.894118 | 0.974359 | 0.826087 | EPHB2 AND NOT-IHH AND CD68 | 0.810811 | 0.789474 | 0.833333 |
| PTPRZ1 AND NOT-LRP11 AND F2R | 0.891304 | 0.891304 | 0.891304 | CD276 AND NOT-ITGA6 AND MMD | 0.933333 | 0.897436 | 0.972222 |
| PTPRZ1 AND NOT-FZD10 AND NOT-GABRA2 | 0.891304 | 0.891304 | 0.891304 | CD276 AND NOT-ITGA6 AND KL | 0.891892 | 0.868421 | 0.916667 |
| PTPRZ1 AND NOT-IL22RA1 AND F2R | 0.888889 | 0.909091 | 0.869565 | CD276 AND NOT-MUC15 AND CLEC2B | 0.873239 | 0.885714 | 0.861111 |
| PTPRZ1 AND NOT-ABCC5 AND NOT-GABRA2 | 0.901099 | 0.911111 | 0.891304 | EPHB2 AND NOT-SLC26A3 AND CD68 | 0.810811 | 0.789474 | 0.833333 |
| PTPRZ1 AND NOT-CDH3 AND NOT-GABRA2 | 0.88172 | 0.87234 | 0.891304 | CD276 AND NOT-ESYT3 AND STOML3 | 0.868421 | 0.825 | 0.916667 |
| PTPRZ1 AND GPR173 AND NOT-GABRA2 | 0.88172 | 0.87234 | 0.891304 | EPHB2 AND NOT-SLC26A3 AND S100A10 | 0.821918 | 0.810811 | 0.833333 |
| PTPRZ1 AND NOT-SLCO4C1 AND NOT-GABRA2 | 0.88172 | 0.87234 | 0.891304 | EPHB2 AND NOT-SLC26A3 AND STOML3 | 0.821918 | 0.810811 | 0.833333 |
| PTPRZ1 AND NOT-AQP9 AND NOT-GABRA2 | 0.88172 | 0.87234 | 0.891304 | EPHB2 AND NOT-SLC26A3 AND WNT1 | 0.805556 | 0.805556 | 0.805556 |
| PTPRZ1 AND NOT-SLC35G1 AND NOT-GABRA2 | 0.88172 | 0.87234 | 0.891304 | CD276 AND NOT-FZD10 AND NOT-PON2 | 0.814815 | 0.733333 | 0.916667 |
| PTPRZ1 AND CLSTN2 AND NOT-GABRA2 | 0.88172 | 0.87234 | 0.891304 | CD276 AND NOT-GJB3 AND NOT-LRP2 | 0.805195 | 0.756098 | 0.861111 |
| PTPRZ1 AND NOT-P2RY14 AND NOT-GABRA2 | 0.88172 | 0.87234 | 0.891304 | CD276 AND NOT-ESYT3 AND CLEC2B | 0.868421 | 0.825 | 0.916667 |
| PTPRZ1 AND NOT-APCDD1 AND NOT-GABRA2 | 0.88172 | 0.87234 | 0.891304 | EPHB2 AND NOT-IYD AND CD68 | 0.815789 | 0.775 | 0.861111 |
| PTPRZ1 AND NOT-F11R AND NOT-GABRA2 | 0.88172 | 0.87234 | 0.891304 | EPHB2 AND NOT-SLC26A3 AND ORSL2 | 0.805556 | 0.805556 | 0.805556 |
| PTPRZ1 AND NOT-CDH1 AND NOT-GABRA2 | 0.88172 | 0.87234 | 0.891304 | EPHB2 AND NOT-SLC26A3 AND TAS1R2 | 0.833333 | 0.833333 | 0.833333 |
| PTPRZ1 AND NOT-IL1R2 AND NOT-GABRA2 | 0.88172 | 0.87234 | 0.891304 | EPHB2 AND NOT-IHH AND NOT-FZD10 | 0.852941 | 0.90625 | 0.805556 |
| PTPRZ1 AND SLC4A4 AND NOT-GABRA2 | 0.88172 | 0.87234 | 0.891304 | EPHB2 AND NOT-IHH AND OR10H2 | 0.810811 | 0.789474 | 0.833333 |
| PTPRZ1 AND NOT-LY6K AND NOT-GABRA2 | 0.88172 | 0.87234 | 0.891304 | EPHB2 AND NOT-SLC26A3 AND CHIC2 | 0.821918 | 0.810811 | 0.833333 |
| PTPRZ1 AND NOT-SLCO4C1 AND NOT-GABRA2 | 0.88172 | 0.87234 | 0.891304 | EPHB2 AND RECK AND NOT-GJB3 | 0.828571 | 0.852941 | 0.805556 |
| PTPRZ1 AND NOT-GRM3 AND NOT-TNFSF10 | 0.880952 | 0.973684 | 0.804348 | CD276 AND NOT-DUOX1 AND CLEC2B | 0.868421 | 0.825 | 0.916667 |
| PTPRZ1 AND SLC8A2 AND NOT-GRM3 | 0.880952 | 0.973684 | 0.804348 | EPHB2 AND SLC41A1 AND NOT-MUC15 | 0.811594 | 0.848485 | 0.777778 |
| PTPRZ1 AND NOT-SLC6A14 AND NOT-GRM3 | 0.880952 | 0.973684 | 0.804348 | EPHB2 AND NOT-SLC26A3 AND RECK | 0.816901 | 0.828571 | 0.805556 |
| PTPRZ1 AND NOT-GRM3 AND NOT-FCER1A | 0.880952 | 0.973684 | 0.804348 | CNTNAP1 AND NOT-ABCA12 AND TNFRSF10B | 0.828571 | 0.852941 | 0.805556 |
| PTPRZ1 AND NOT-F11R AND NOT-GRM3 | 0.880952 | 0.973684 | 0.804348 | CD276 AND NOT-ITGA6 AND NOT-MSMO1 | 0.868421 | 0.825 | 0.916667 |
| PTPRZ1 AND SEMA6D AND NOT-GRM3 | 0.880952 | 0.973684 | 0.804348 | EPHB2 AND NOT-IYD AND NOT-GPR22 | 0.84507 | 0.857143 | 0.833333 |
| PTPRZ1 AND LRRTM2 AND NOT-GRM3 | 0.880952 | 0.973684 | 0.804348 | EPHB2 AND NOT-SLC26A3 AND PCDHA6 | 0.821918 | 0.810811 | 0.833333 |
| PTPRZ1 AND GPM6B AND NOT-GRM3 | 0.880952 | 0.973684 | 0.804348 | EPHB2 AND NOT-IHH AND SLC22A12 | 0.8 | 0.769231 | 0.833333 |
| PTPRZ1 AND NOT-SDK1 AND NOT-GRM3 | 0.880952 | 0.973684 | 0.804348 | EPHB2 AND NOT-IHH AND NPHS2 | 0.8 | 0.769231 | 0.833333 |
| PTPRZ1 AND NOT-BTC AND NOT-GRM3 | 0.880952 | 0.973684 | 0.804348 | EPHB2 AND NOT-SLC26A3 AND CHRNB4 | 0.810811 | 0.789474 | 0.833333 |
| PTPRZ1 AND NOT-IL22RA1 AND NOT-GRM3 | 0.880952 | 0.973684 | 0.804348 | EPHB2 AND NOT-SLC26A3 AND PLVAP | 0.821918 | 0.810811 | 0.833333 |
| PTPRZ1 AND NOT-PERP AND NOT-GRM3 | 0.880952 | 0.973684 | 0.804348 | EPHB2 AND NOT-SLC26A3 AND OR2C3 | 0.833333 | 0.833333 | 0.833333 |
| PTPRZ1 AND NOT-LRP11 AND NOT-GRM3 | 0.880952 | 0.973684 | 0.804348 | EPHB2 AND NOT-SLC30A10 AND STOML3 | 0.84507 | 0.857143 | 0.833333 |
| PTPRZ1 AND NOT-GRM3 AND NOT-LSR | 0.880952 | 0.973684 | 0.804348 | EPHB2 AND NOT-SLC26A3 AND ROS1 | 0.821918 | 0.810811 | 0.833333 |
| PTPRZ1 AND ADAM22 AND NOT-GRM3 | 0.880952 | 0.973684 | 0.804348 | EPHB2 AND NOT-SLC26A3 AND OR52D1 | 0.8 | 0.769231 | 0.833333 |
| PTPRZ1 AND NOT-ZDHHC5 AND NOT-GRM3 | 0.880952 | 0.973684 | 0.804348 | EPHB2 AND SLC41A1 AND NOT-GPR22 | 0.882353 | 0.9375 | 0.833333 |
| PTPRZ1 AND NOT-GRM3 AND NOT-COL17A1 | 0.880952 | 0.973684 | 0.804348 | EPHB2 AND RECK AND NOT-ABCA12 | 0.828571 | 0.852941 | 0.805556 |
| PTPRZ1 AND NOT-GRM3 AND SLC4A4 | 0.880952 | 0.973684 | 0.804348 | CD276 AND NOT-GJB3 AND NOT-SLC34A2 | 0.829268 | 0.73913 | 0.944444 |
| PTPRZ1 AND NOT-GPR87 AND NOT-GRM3 | 0.880952 | 0.973684 | 0.804348 | ATP8B2 AND NOT-GPR22 AND GPR85 | 0.84507 | 0.857143 | 0.833333 |
| PTPRZ1 AND NOT-DUOX1 AND NOT-GRM3 | 0.880952 | 0.973684 | 0.804348 | Lung Adenocarcinoma | | | |
| PTPRZ1 AND NOT-SMAGP AND NOT-GRM3 | 0.880952 | 0.973684 | 0.804348 | NOT-CLCA4 AND SLC6A14 AND NOT-FXYD1 | 0.81761 | 0.730337 | 0.928571 |
| PTPRZ1 AND SCAMP5 AND NOT-GRM3 | 0.880952 | 0.973684 | 0.804348 | Lung Carcinoma | | | |
| PTPRZ1 AND NOT-ATP2C2 AND NOT-GRM3 | 0.880952 | 0.973684 | 0.804348 | NOT-ADCY4 AND GJB2 AND ADAM12 | 0.815385 | 0.80303 | 0.828125 |
| PTPRZ1 AND GPRC5B AND NOT-GRM3 | 0.880952 | 0.973684 | 0.804348 | ADAM12 AND NOT-NRG2 AND IGSF9 | 0.823529 | 0.777778 | 0.875 |
| PTPRZ1 AND NOT-FZD10 AND NOT-GRM3 | 0.880952 | 0.973684 | 0.804348 | Diffuse B-Cell Lymphoma | | | |
| PTPRZ1 AND NOT-SLC15A1 AND NOT-GRM3 | 0.880952 | 0.973684 | 0.804348 | FCRL3 AND NOT-FCER1A AND FPR1 | 0.871795 | 0.829268 | 0.918919 |
| PTPRZ1 AND NOT-GRM3 AND NOT-RECK | 0.880952 | 0.973684 | 0.804348 | FCRL3 AND NOT-FCER1A AND FPR1 | 0.871795 | 0.829268 | 0.918919 |
| PTPRZ1 AND SYNDIG1 AND NOT-GRM3 | 0.880952 | 0.973684 | 0.804348 | FCRL3 AND ENPP2 AND NOT-ITM2B | 0.826667 | 0.815789 | 0.837838 |
| PTPRZ1 AND NOT-ST14 AND NOT-GRM3 | 0.880952 | 0.973684 | 0.804348 | FCRL3 AND ENPP2 AND NOT-ITM2B | 0.826667 | 0.815789 | 0.837838 |
| PTPRZ1 AND NOT-AQP3 AND NOT-GRM3 | 0.880952 | 0.973684 | 0.804348 | FCRL3 AND NOT-FCER1A AND IGSF6 | 0.826667 | 0.815789 | 0.837838 |
| PTPRZ1 AND NOT-GRM3 AND NOT-ACPP | 0.880952 | 0.973684 | 0.804348 | FCRL3 AND SLC1A3 AND NOT-FCER1A | 0.823529 | 0.903226 | 0.756757 |
| PTPRZ1 AND NOT-SMAGP AND NOT-GRM3 | 0.880952 | 0.973684 | 0.804348 | FCRL3 AND NOT-FCER1A AND C3AR1 | 0.84058 | 0.90625 | 0.783784 |
| PTPRZ1 AND NOT-ACVRL1 AND NOT-GRM3 | 0.880952 | 0.973684 | 0.804348 | FCRL3 AND NOT-TSPAN32 AND FPR1 | 0.821918 | 0.833333 | 0.810811 |
| PTPRZ1 AND NOT-GRM3 AND NOT-SLC46A2 | 0.880952 | 0.973684 | 0.804348 | FCRL3 AND GJA1 AND NOT-ITM2B | 0.820513 | 0.780488 | 0.864865 |
| PTPRZ1 AND NOT-SPINT1 AND NOT-GRM3 | 0.880952 | 0.973684 | 0.804348 | FCRL3 AND GJA1 AND NOT-ITM2B | 0.820513 | 0.780488 | 0.864865 |
| PTPRZ1 AND GPR173 AND NOT-GRM3 | 0.880952 | 0.973684 | 0.804348 | MCOLN2 AND CD53 AND GJA1 | 0.818182 | 0.931034 | 0.72973 |
| PTPRZ1 AND NOT-MYOF AND NOT-GRM3 | 0.880952 | 0.973684 | 0.804348 | FCRL3 AND NOT-FCER1A AND VAMP5 | 0.816901 | 0.852941 | 0.783784 |
| PTPRZ1 AND NOT-PTPRM AND NOT-GABRA2 | 0.891304 | 0.891304 | 0.891304 | FCRL3 AND NOT-FCER1A AND CLEC4E | 0.816901 | 0.852941 | 0.783784 |
| PTPRZ1 AND PLXNA4 AND NOT-GABRA2 | 0.88172 | 0.87234 | 0.891304 | FCRL3 AND ENPP2 AND NOT-SFRP1 | 0.815789 | 0.794872 | 0.837838 |
| PTPRZ1 AND NOT-SDC1 AND HAS2 | 0.917647 | 1 | 0.847826 | FCRL3 AND ENPP2 AND NOT-SLC7A9 | 0.815789 | 0.794872 | 0.837838 |
| PTPRZ1 AND NOT-STEAP1 AND HAS2 | 0.906977 | 0.975 | 0.847826 | FAM26F AND NOT-FCER1A AND NOT-ADRA1A | 0.815789 | 0.794872 | 0.837838 |
| PTPRZ1 AND NCAM1 AND HAS2 | 0.906977 | 0.975 | 0.847826 | FCRL3 AND GJA1 AND NOT-NPY5R | 0.815789 | 0.794872 | 0.837838 |
| PTPRZ1 AND NOT-CLDN1 AND HAS2 | 0.906977 | 0.975 | 0.847826 | TNFRSF9 AND GJA1 AND NOT-ENTPD3 | 0.830769 | 0.964286 | 0.72973 |
| PTPRZ1 AND NOT-TRPM4 AND HAS2 | 0.906977 | 0.975 | 0.847826 | FCRL3 AND NOT-FCER1A AND TMEM97 | 0.84058 | 0.90625 | 0.783784 |
| PTPRZ1 AND NOT-CLDN23 AND HAS2 | 0.906977 | 0.975 | 0.847826 | CD53 AND NOT-FCER1A AND FPR1 | 0.814815 | 0.75 | 0.891892 |
| PTPRZ1 AND NOT-PMEL AND HAS2 | 0.906977 | 0.975 | 0.847826 | CD53 AND NOT-FCER1A AND FPR1 | 0.814815 | 0.75 | 0.891892 |
| PTPRZ1 AND NOT-CLDN23 AND MPZL1 | 0.904762 | 1 | 0.826087 | CD53 AND NOT-FCER1A AND CLEC4E | 0.828571 | 0.878788 | 0.783784 |
| PTPRZ1 AND NOT-STEAP1 AND MPZL1 | 0.904762 | 1 | 0.826087 | FCRL3 AND NOT-FCER1A AND TLR2 | 0.820513 | 0.780488 | 0.864865 |
| PTPRZ1 AND NOT-CD52 AND MPZL1 | 0.904762 | 1 | 0.826087 | FCRL3 AND NOT-FCER1A AND TLR2 | 0.820513 | 0.780488 | 0.864865 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NCAM1 AND MPZL1 | 0.904762 | 1 | 0.826087 | FCRL3 AND NOT-IL1RAP AND PLGRKT | 0.8125 | 0.962963 | 0.702703 |
| PTPRZ1 AND NOT-CLDN1 AND MPZL1 | 0.904762 | 1 | 0.826087 | FCRL3 AND NOT-FCER1A AND SIRPA | 0.831169 | 0.8 | 0.864865 |
| PTPRZ1 AND NOT-SDC1 AND MPZL1 | 0.904762 | 1 | 0.826087 | NOT-FCER1A AND IGSF6 AND GPR18 | 0.811594 | 0.875 | 0.756757 |
| PTPRZ1 AND NOT-TRPM4 AND MPZL1 | 0.904762 | 1 | 0.826087 | FCRL3 AND SLC1A3 AND NOT-LGR6 | 0.811594 | 0.875 | 0.756757 |
| PTPRZ1 AND NOT-EPCAM AND MPZL1 | 0.904762 | 1 | 0.826087 | CD53 AND NOT-FCER1A AND SLC1A3 | 0.810811 | 0.810811 | 0.810811 |
| PTPRZ1 AND NOT-RNF43 AND F2RL1 | 0.896552 | 0.95122 | 0.847826 | FAM26F AND NOT-FCER1A AND NOT-SEMA4G | 0.826667 | 0.815789 | 0.837838 |
| PTPRZ1 AND NOT-SDC1 AND ABCA1 | 0.894118 | 0.974359 | 0.826087 | FCRL3 AND ENPP2 AND NOT-NPY5R | 0.810811 | 0.810811 | 0.810811 |
| PTPRZ1 AND CLSTN2 AND TNC | 0.88172 | 0.87234 | 0.891304 | FAM26F AND NOT-FCER1A AND NOT-TM4SF5 | 0.826667 | 0.815789 | 0.837838 |
| PTPRZ1 AND OR51B6 AND TNC | 0.88172 | 0.87234 | 0.891304 | FCRL3 AND GJA1 AND NOT-SFRP1 | 0.810127 | 0.761905 | 0.864865 |
| PTPRZ1 AND NOT-ABCC5 AND TNC | 0.88172 | 0.87234 | 0.891304 | CD53 AND NOT-FCER1A AND TMEM97 | 0.84058 | 0.90625 | 0.783784 |
| PTPRZ1 AND NOT-SLCO4C1 AND TNC | 0.88172 | 0.87234 | 0.891304 | CD53 AND NOT-FCER1A AND FAM26F | 0.815789 | 0.794872 | 0.837838 |
| PTPRZ1 AND NOT-SDC1 AND F2RL1 | 0.879121 | 0.888889 | 0.869565 | GPR18 AND NOT-SLC18A2 AND RAMP3 | 0.815789 | 0.794872 | 0.837838 |
| PTPRZ1 AND NOT-SDC1 AND F2RL1 | 0.879121 | 0.888889 | 0.869565 | FCRL3 AND SLC1A3 AND NOT-S1PR5 | 0.80597 | 0.9 | 0.72973 |
| PTPRZ1 AND ITM2B AND NOT-STEAP1 | 0.876404 | 0.906977 | 0.847826 | CD53 AND NOT-CXCR2 AND FPR1 | 0.80597 | 0.9 | 0.72973 |
| COMPLEX-L1CAM/PTPRZ1/OR6A2 | 0.876404 | 0.906977 | 0.847826 | MCOLN2 AND NOT-GDPD2 AND CYBRD1 | 0.80597 | 0.9 | 0.72973 |
| PTPRZ1 AND ITM2B AND NOT-PMEL | 0.876404 | 0.906977 | 0.847826 | FCRL3 AND KCNMA1 AND NOT-SLC16A2 | 0.80597 | 0.9 | 0.72973 |
| PTPRZ1 AND ITM2B AND NOT-CD52 | 0.876404 | 0.906977 | 0.847826 | FCRL3 AND SLC1A3 AND NOT-CRIM1 | 0.80597 | 0.9 | 0.72973 |
| PTPRZ1 AND NOT-RNF43 AND CLCN5 | 0.873563 | 0.926829 | 0.826087 | CD53 AND NOT-FCER1A AND SIRPA | 0.810127 | 0.761905 | 0.864865 |
| PTPRZ1 AND NOT-FZD10 AND FOLR2 | 0.869565 | 0.869565 | 0.869565 | FCRL3 AND ENPP2 AND NOT-TACSTD2 | 0.805556 | 0.828571 | 0.783784 |
| PTPRZ1 AND DLL3 AND F2RL1 | 0.86747 | 0.972973 | 0.782609 | FAM26F AND NOT-FCER1A AND NOT-CLEC4M | 0.849315 | 0.861111 | 0.837838 |
| PTPRZ1 AND ITM2B AND NOT-CLDN23 | 0.866667 | 0.886364 | 0.847826 | FAM26F AND NOT-FCER1A AND NOT-PTH1R | 0.826667 | 0.815789 | 0.837838 |
| PTPRZ1 AND NCAM1 AND ITM2B | 0.866667 | 0.886364 | 0.847826 | FAM26F AND NOT-FCER1A AND NOT-SLC17A4 | 0.805195 | 0.775 | 0.837838 |
| PTPRZ1 AND CD33 AND PANX1 | 0.866667 | 0.886364 | 0.847826 | FAM26F AND NOT-FCER1A AND NOT-SLC51A | 0.805195 | 0.775 | 0.837838 |
| PTPRZ1 AND NOT-CLDN1 AND ITM2B | 0.866667 | 0.886364 | 0.847826 | FCRL3 AND GJA1 AND NOT-SLC18A2 | 0.805195 | 0.775 | 0.837838 |
| PTPRZ1 AND NOT-TRPM4 AND ITM2B | 0.866667 | 0.886364 | 0.847826 | CD53 AND NOT-CXCR2 AND FPR1 | 0.804878 | 0.733333 | 0.891892 |
| PTPRZ1 AND NOT-EPCAM AND ITM2B | 0.866667 | 0.886364 | 0.847826 | CD53 AND NOT-CXCR2 AND FPR1 | 0.804878 | 0.733333 | 0.891892 |
| PTPRZ1 AND NOT-SDC1 AND VANGL2 | 0.863636 | 0.904762 | 0.826087 | FCRL3 AND NOT-FCER1A AND SULF2 | 0.804878 | 0.733333 | 0.891892 |
| PTPRZ1 AND NOT-SDK1 AND CD33 | 0.863636 | 0.904762 | 0.826087 | NOT-FCER1A AND IGSF6 AND NOT-PTH1R | 0.8 | 0.848485 | 0.756757 |
| PTPRZ1 AND NOT-LGR5 AND CSF1R | 0.863636 | 0.904762 | 0.826087 | FCRL3 AND GJA1 AND NOT-MFAP3L | 0.8 | 0.744186 | 0.864865 |
| PTPRZ1 AND NOT-ACVRL1 AND CD33 | 0.863636 | 0.904762 | 0.826087 | FCRL3 AND NOT-ATP10A AND SLC38A6 | 0.80597 | 0.9 | 0.72973 |
| PTPRZ1 AND NOT-F11R AND CD33 | 0.863636 | 0.904762 | 0.826087 | FCRL3 AND GJA1 AND NOT-MFAP3L | 0.8 | 0.744186 | 0.864865 |
| PTPRZ1 AND NOT-EPCAM AND F2RL1 | 0.863158 | 0.836735 | 0.891304 | NOT-FCER1A AND GPR18 AND SECTM1 | 0.823529 | 0.903226 | 0.756757 |
| PTPRZ1 AND NOT-EPCAM AND F2RL1 | 0.863158 | 0.836735 | 0.891304 | FCRL3 AND ENPP2 AND NOT-SLC18A2 | 0.8 | 0.789474 | 0.810811 |
| PTPRZ1 AND NOT-ABCA5 AND CLCN5 | 0.863158 | 0.836735 | 0.891304 | FAM26F AND NOT-FCER1A AND NOT-CDH16 | 0.8 | 0.789474 | 0.810811 |
| PTPRZ1 AND SYNDIG1 AND CD33 | 0.860465 | 0.925 | 0.804348 | FCRL3 AND GJA1 AND ITGAE | 0.8 | 0.744186 | 0.864865 |
| PTPRZ1 AND ADAM22 AND CD33 | 0.860465 | 0.925 | 0.804348 | FAM26F AND NOT-FCER1A AND NOT-GPR88 | 0.826667 | 0.815789 | 0.837838 |
| PTPRZ1 AND GPM6B AND CD33 | 0.860465 | 0.925 | 0.804348 | FAM26F AND NOT-FCER1A AND NOT-SLC22A7 | 0.805195 | 0.775 | 0.837838 |
| PTPRZ1 AND NOT-ST14 AND CD33 | 0.860465 | 0.925 | 0.804348 | FCRL3 AND NOT-FCER1A AND PKD2L1 | 0.8 | 0.744186 | 0.864865 |
| PTPRZ1 AND NOT-DUOX1 AND CD33 | 0.860465 | 0.925 | 0.804348 | FCRL3 AND NOT-FCER1A AND PLGRKT | 0.816901 | 0.852941 | 0.783784 |
| PTPRZ1 AND LRRTM2 AND CD33 | 0.860465 | 0.925 | 0.804348 | FCRL3 AND SLC1A3 AND NOT-ITM2B | 0.852941 | 0.935484 | 0.783784 |
| PTPRZ1 AND NOT-AQP3 AND CD33 | 0.860465 | 0.925 | 0.804348 | FCRL3 AND TMEM119 AND NOT-KITLG | 0.821918 | 0.833333 | 0.810811 |
| PTPRZ1 AND NOT-ATP2C2 AND CD33 | 0.860465 | 0.925 | 0.804348 | FCRL3 AND NOT-F2RL1 AND TMEM119 | 0.814815 | 0.75 | 0.891892 |
| PTPRZ1 AND NOT-GPR87 AND CD33 | 0.860465 | 0.925 | 0.804348 | FAM26F AND NOT-FCER1A AND NOT-FREM2 | 0.815789 | 0.794872 | 0.837838 |
| PTPRZ1 AND NOT-PERP AND CD33 | 0.860465 | 0.925 | 0.804348 | FAM26F AND NOT-FCER1A AND NOT-SLC22A1 | 0.805195 | 0.775 | 0.837838 |
| PTPRZ1 AND NOT-LRP11 AND SEMA5B | 0.860215 | 0.851064 | 0.869565 | FAM26F AND NOT-FCER1A AND NOT-SLC23A1 | 0.805195 | 0.775 | 0.837838 |
| PTPRZ1 AND NRCAM AND NOT-STEAP2 | 0.860215 | 0.851064 | 0.869565 | FAM26F AND NOT-FCER1A AND NOT-SLC47A1 | 0.805195 | 0.775 | 0.837838 |
| PTPRZ1 AND NOT-ACP1 AND FOLR2 | 0.860215 | 0.851064 | 0.869565 | NOT-FCER1A AND GPR18 AND TLR2 | 0.828571 | 0.878788 | 0.783784 |
| CNTNAP1 AND NOT-EPCAM AND VANGL2 | 0.866667 | 0.886364 | 0.847826 | CD40 AND GJA1 AND NOT-ENTPD3 | 0.825397 | 1 | 0.702703 |
| SLC1A3 AND VANGL2 AND NOT-CLDN1 | 0.866667 | 0.886364 | 0.847826 | FCRL3 AND NOT-FCER1A AND CCR1 | 0.849315 | 0.861111 | 0.837838 |
| VANGL2 AND NOT-FZD10 AND CD33 | 0.860465 | 0.925 | 0.804348 | CD53 AND TMEM119 AND NOT-PROS1 | 0.8 | 0.744186 | 0.864865 |
| PTPRZ1 AND NOT-TRPM4 AND SLC44A2 | 0.857143 | 0.866667 | 0.847826 | KCNJ10 AND CD53 AND NOT-PROS1 | 0.852941 | 0.935484 | 0.783784 |
| PTPRZ1 AND NOT-SDC1 AND TSPAN11 | 0.857143 | 0.866667 | 0.847826 | KCNJ10 AND CD53 AND NOT-FZD4 | 0.84507 | 0.882353 | 0.810811 |
| CNTNAP1 AND NOT-SDC1 AND VANGL2 | 0.857143 | 0.866667 | 0.847826 | FCRL3 AND NOT-FCER1A AND FXYD6 | 0.843373 | 0.76087 | 0.945946 |
| PTPRZ1 AND NCAM1 AND SLC44A2 | 0.857143 | 0.866667 | 0.847826 | KCNJ10 AND CD53 AND NOT-PCDHB16 | 0.852941 | 0.935484 | 0.783784 |
| PCDH10 AND NOT-SDC1 AND F2RL1 | 0.878049 | 1 | 0.782609 | FCRL3 AND NOT-FCER1A AND SLC31A1 | 0.849315 | 0.861111 | 0.837838 |
| SLC1A3 AND VANGL2 AND NOT-CD52 | 0.857143 | 0.866667 | 0.847826 | KCNJ10 AND NOT-PTPRZ1 AND NOT-FZD4 | 0.84058 | 0.90625 | 0.783784 |
| PTPRZ1 AND PANX1 AND NOT-STEAP2 | 0.854167 | 0.82 | 0.891304 | KCNJ10 AND CD53 AND NOT-FRAS1 | 0.833333 | 0.857143 | 0.810811 |
| PTPRZ1 AND NOT-SDC1 AND NOT-TRHDE | 0.854167 | 0.82 | 0.891304 | KCNJ10 AND CD53 AND NOT-TEK | 0.833333 | 0.857143 | 0.810811 |
| PTPRZ1 AND NOT-EPCAM AND HAS2 | 0.854167 | 0.82 | 0.891304 | KCNJ10 AND CD53 AND NOT-PLB1 | 0.852941 | 0.935484 | 0.783784 |
| PTPRZ1 AND NOT-FZD10 AND VCAM1 | 0.854167 | 0.82 | 0.891304 | KCNJ10 AND NOT-SLC16A2 AND ICAM3 | 0.830769 | 0.964286 | 0.72973 |
| PTPRZ1 AND PANX1 AND NOT-STEAP2 | 0.854167 | 0.82 | 0.891304 | KCNJ10 AND NOT-SLC16A2 AND IL10RA | 0.830769 | 0.964286 | 0.72973 |
| PTPRZ1 AND NOT-FZD10 AND HLA-DOB | 0.854167 | 0.82 | 0.891304 | KCNJ10 AND NOT-SLC16A2 AND FCRL3 | 0.830769 | 0.964286 | 0.72973 |
| VANGL2 AND NOT-CLDN1 AND CSF1R | 0.853933 | 0.883721 | 0.826087 | KCNJ10 AND CD53 AND NOT-CXCR2 | 0.84058 | 0.90625 | 0.783784 |
| PTPRZ1 AND NOT-EPCAM AND CALCRL | 0.853659 | 0.972222 | 0.76087 | KCNJ10 AND NOT-PLP1 AND NOT-PROS1 | 0.828571 | 0.878788 | 0.783784 |
| PTPRZ1 AND NOT-SDC1 AND CALCRL | 0.853659 | 0.972222 | 0.76087 | KCNJ10 AND GPR18 AND NOT-TNFRSF19 | 0.828571 | 0.878788 | 0.783784 |
| PTPRZ1 AND SLC4A4 AND FOLR2 | 0.851064 | 0.833333 | 0.869565 | KCNJ10 AND FCRL3 AND NOT-TNFRSF19 | 0.828571 | 0.878788 | 0.783784 |
| PTPRZ1 AND NOT-P2RY14 AND FOLR2 | 0.851064 | 0.833333 | 0.869565 | KCNJ10 AND FCRL3 AND NOT-ENTPD3 | 0.833333 | 0.857143 | 0.810811 |
| SLC1A3 AND VANGL2 AND NOT-STEAP1 | 0.866667 | 0.886364 | 0.847826 | FCRL3 AND NOT-MFAP3L AND FXYD6 | 0.825 | 0.767442 | 0.891892 |
| PTPRZ1 AND NOT-KIT AND VCAM1 | 0.851064 | 0.833333 | 0.869565 | KCNJ10 AND CD53 AND NOT-F2RL1 | 0.852941 | 0.935484 | 0.783784 |
| PTPRZ1 AND NOT-SLC35G1 AND FOLR2 | 0.851064 | 0.833333 | 0.869565 | FCRL3 AND NOT-ITGA6 AND FXYD6 | 0.825 | 0.767442 | 0.891892 |
| PTPRZ1 AND NOT-IL1R2 AND FOLR2 | 0.851064 | 0.833333 | 0.869565 | KCNJ10 AND CD53 AND NOT-ENTPD3 | 0.833333 | 0.857143 | 0.810811 |
| PTPRZ1 AND NOT-LY6K AND FOLR2 | 0.851064 | 0.833333 | 0.869565 | KCNJ10 AND CD53 AND NOT-TSPAN7 | 0.821918 | 0.833333 | 0.810811 |
| PTPRZ1 AND NOT-CDH1 AND FOLR2 | 0.851064 | 0.833333 | 0.869565 | KCNJ10 AND CD53 AND NOT-EMCN | 0.852941 | 0.935484 | 0.783784 |
| PCDH10 AND VANGL2 AND NOT-EPCAM | 0.850575 | 0.902439 | 0.804348 | KCNJ10 AND CD53 AND NOT-DUOX1 | 0.818182 | 0.931034 | 0.72973 |
| PTPRZ1 AND SEMA5B AND F2RL1 | 0.85 | 1 | 0.73913 | KCNJ10 AND CD53 AND NOT-SLC46A2 | 0.818182 | 0.931034 | 0.72973 |
| PTPRZ1 AND NOT-ENTPD6 AND FOLR2 | 0.860215 | 0.851064 | 0.869565 | KCNJ10 AND FCRL3 AND NOT-FZD4 | 0.816901 | 0.852941 | 0.783784 |
| PTPRZ1 AND NOT-SDC1 AND CLCN5 | 0.847826 | 0.847826 | 0.847826 | KCNJ10 AND CD53 AND NOT-CRIM1 | 0.816901 | 0.852941 | 0.783784 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NCAM1 AND CSF1R | 0.847826 | 0.847826 | 0.847826 | KCNJ10 AND NOT-PTPRZ1 AND NOT-SLC3A1 | 0.816901 | 0.852941 | 0.783784 |
| PTPRZ1 AND NOT-SDC1 AND CSF1R | 0.847826 | 0.847826 | 0.847826 | KCNJ10 AND FCRL3 AND NOT-PLB1 | 0.816901 | 0.852941 | 0.783784 |
| PTPRZ1 AND NOT-STEAP1 AND CSF1R | 0.847826 | 0.847826 | 0.847826 | FAM26F AND NOT-FCER1A AND NOT-DIO1 | 0.849315 | 0.861111 | 0.837838 |
| PTPRZ1 AND CD33 AND NOT-FZD10 | 0.847826 | 0.847826 | 0.847826 | CD53 AND NOT-FCER1A AND FXYD6 | 0.814815 | 0.75 | 0.891892 |
| PTPRZ1 AND NOT-SDC1 AND CLCN5 | 0.847826 | 0.847826 | 0.847826 | CD53 AND NOT-FCER1A AND FXYD6 | 0.814815 | 0.75 | 0.891892 |
| PTPRZ1 AND NOT-SDC1 AND CSF1R | 0.847826 | 0.847826 | 0.847826 | FAM26F AND NOT-FCER1A AND NOT-SLC13A5 | 0.821918 | 0.833333 | 0.810811 |
| PTPRZ1 AND NOT-CLDN1 AND CSF1R | 0.847826 | 0.847826 | 0.847826 | KCNJ10 AND CD53 AND NOT-TSPAN6 | 0.816901 | 0.852941 | 0.783784 |
| PTPRZ1 AND NOT-CLDN1 AND CSF1R | 0.847826 | 0.847826 | 0.847826 | KCNJ10 AND CD53 AND NOT-PKD2L1 | 0.828571 | 0.878788 | 0.783784 |
| PTPRZ1 AND CSF1R AND NOT-CD52 | 0.847826 | 0.847826 | 0.847826 | KCNJ10 AND NOT-ROM1 AND FCRL3 | 0.821918 | 0.833333 | 0.810811 |
| PTPRZ1 AND NOT-CLDN23 AND CSF1R | 0.847826 | 0.847826 | 0.847826 | KCNJ10 AND FCRL3 AND NOT-FCER1A | 0.84058 | 0.90625 | 0.783784 |
| PTPRZ1 AND NOT-SDC1 AND ITM2B | 0.847826 | 0.847826 | 0.847826 | KCNJ10 AND CD53 AND NOT-KITLG | 0.8125 | 0.962963 | 0.702703 |
| PTPRZ1 AND CD33 AND CLCN5 | 0.847826 | 0.847826 | 0.847826 | KCNJ10 AND NOT-PTPRZ1 AND NOT-SEMA4G | 0.821918 | 0.833333 | 0.810811 |
| PTPRZ1 AND CLDN17 AND NOT-GABRA2 | 0.891304 | 0.891304 | 0.891304 | KCNJ10 AND CD53 AND NOT-CD300LB | 0.811594 | 0.875 | 0.756757 |
| PTPRZ1 AND SLC4A8 AND NOT-GABRA2 | 0.88172 | 0.87234 | 0.891304 | KCNJ10 AND FCRL3 AND NOT-HCRTR1 | 0.810811 | 0.810811 | 0.810811 |
| PTPRZ1 AND CRB1 AND NOT-GABRA2 | 0.88172 | 0.87234 | 0.891304 | KCNJ10 AND GPR18 AND NOT-HCRTR1 | 0.810811 | 0.810811 | 0.810811 |
| PTPRZ1 AND NOT-AOC3 AND NOT-GABRA2 | 0.88172 | 0.87234 | 0.891304 | FAM26F AND NOT-FCER1A AND NOT-SLC10A1 | 0.849315 | 0.861111 | 0.837838 |
| PTPRZ1 AND GABBR2 AND NOT-GABRA2 | 0.88172 | 0.87234 | 0.891304 | FAM26F AND NOT-FCER1A AND NOT-SLC22A25 | 0.810811 | 0.810811 | 0.810811 |
| PTPRZ1 AND NOT-AOC3 AND NOT-GABRA2 | 0.88172 | 0.87234 | 0.891304 | KCNJ10 AND NOT-PCDH19 AND FCRL3 | 0.810811 | 0.810811 | 0.810811 |
| PTPRZ1 AND NOT-CD36 AND NOT-GABRA2 | 0.88172 | 0.87234 | 0.891304 | KCNJ10 AND CD53 AND NOT-FCER1A | 0.878788 | 1 | 0.783784 |
| PTPRZ1 AND SLCO1C1 AND NOT-GABRA2 | 0.88172 | 0.87234 | 0.891304 | KCNJ10 AND FCRL3 AND NOT-ITGA2B | 0.833333 | 0.857143 | 0.810811 |
| PTPRZ1 AND SLC4A8 AND NOT-GRM3 | 0.880952 | 0.973684 | 0.804348 | KCNJ10 AND NOT-ABCA8 AND GPR18 | 0.84507 | 0.882353 | 0.810811 |
| PTPRZ1 AND NOT-ATP8B1 AND NOT-GRM3 | 0.880952 | 0.973684 | 0.804348 | KCNJ10 AND NOT-NTRK2 AND NOT-FCER1A | 0.84058 | 0.90625 | 0.783784 |
| PTPRZ1 AND SLC1A2 AND NOT-GRM3 | 0.880952 | 0.973684 | 0.804348 | KCNJ10 AND NOT-SLC18A2 AND GPR18 | 0.80597 | 0.9 | 0.72973 |
| PTPRZ1 AND NOT-GRM3 AND NOT-EPHA2 | 0.880952 | 0.973684 | 0.804348 | KCNJ10 AND CD53 AND NOT-TSPAN18 | 0.80597 | 0.9 | 0.72973 |
| PTPRZ1 AND NOT-GRM3 AND NOT-CD36 | 0.880952 | 0.973684 | 0.804348 | KCNJ10 AND CD53 AND NOT-KCNQ1 | 0.80597 | 0.9 | 0.72973 |
| PTPRZ1 AND NOT-KCNK6 AND NOT-GRM3 | 0.880952 | 0.973684 | 0.804348 | KCNJ10 AND CD53 AND NOT-NRP1 | 0.80597 | 0.9 | 0.72973 |
| PTPRZ1 AND NOT-GRM3 AND GABBR2 | 0.880952 | 0.973684 | 0.804348 | KCNJ10 AND ICAM3 AND NOT-PROS1 | 0.805556 | 0.828571 | 0.783784 |
| PTPRZ1 AND NOT-GRM3 AND NOT-AOC3 | 0.880952 | 0.973684 | 0.804348 | KCNJ10 AND NOT-GPR173 AND FCRL3 | 0.805556 | 0.828571 | 0.783784 |
| PTPRZ1 AND KCNJ10 AND NOT-GRM3 | 0.880952 | 0.973684 | 0.804348 | KCNJ10 AND GPR18 AND NOT-LY6D | 0.805556 | 0.828571 | 0.783784 |
| PTPRZ1 AND CRB1 AND NOT-GRM3 | 0.880952 | 0.973684 | 0.804348 | KCNJ10 AND NOT-TENM1 AND FCRL3 | 0.805556 | 0.828571 | 0.783784 |
| PTPRZ1 AND NOT-LRIG3 AND NOT-GRM3 | 0.880952 | 0.973684 | 0.804348 | KCNJ10 AND GPR18 AND NOT-FZD4 | 0.805556 | 0.828571 | 0.783784 |
| PTPRZ1 AND ATP2B2 AND NOT-GRM3 | 0.880952 | 0.973684 | 0.804348 | KCNJ10 AND GPR18 AND NOT-PROS1 | 0.805556 | 0.828571 | 0.783784 |
| PTPRZ1 AND CLDN17 AND NOT-SCN8A | 0.880952 | 0.973684 | 0.804348 | KCNJ10 AND FCRL3 AND NOT-F2RL1 | 0.805556 | 0.828571 | 0.783784 |
| PTPRZ1 AND CNTNAP2 AND NOT-GRM3 | 0.880952 | 0.973684 | 0.804348 | KCNJ10 AND CD53 AND NOT-LEPR | 0.805556 | 0.828571 | 0.783784 |
| PTPRZ1 AND SLCO1A2 AND NOT-GRM3 | 0.880952 | 0.973684 | 0.804348 | KCNJ10 AND CD53 AND NOT-SCN7A | 0.805556 | 0.828571 | 0.783784 |
| PTPRZ1 AND CLDN17 AND NOT-GRM3 | 0.880952 | 0.973684 | 0.804348 | FAM26F AND NOT-FCER1A AND NOT-SLC6A13 | 0.837838 | 0.837838 | 0.837838 |
| PTPRZ1 AND MOG AND NOT-GRM3 | 0.880952 | 0.973684 | 0.804348 | KCNJ10 AND ITGAL AND NOT-PROS1 | 0.8 | 0.848485 | 0.756757 |
| PTPRZ1 AND GPR85 AND NOT-GRM3 | 0.880952 | 0.973684 | 0.804348 | KCNJ10 AND CD53 AND NOT-ITGA6 | 0.8 | 0.848485 | 0.756757 |
| PTPRZ1 AND SLCO1C1 AND NOT-GRM3 | 0.880952 | 0.973684 | 0.804348 | KCNJ10 AND FCRL3 AND NOT-S1PR5 | 0.8 | 0.848485 | 0.756757 |
| PTPRZ1 AND OR2L13 AND NOT-GABRA2 | 0.88172 | 0.87234 | 0.891304 | KCNJ10 AND NOT-PLP1 AND NOT-FCER1A | 0.878788 | 1 | 0.783784 |
| PTPRZ1 AND NOT-ATP6V0A4 AND NOT-GABRA2 | 0.88172 | 0.87234 | 0.891304 | KCNJ10 AND NOT-PTPRZ1 AND NOT-TM4SF5 | 0.8 | 0.789474 | 0.810811 |
| PTPRZ1 AND ATP2B2 AND F2R | 0.879121 | 0.888889 | 0.869565 | KCNJ10 AND FCRL3 AND NOT-AVPR2 | 0.8 | 0.789474 | 0.810811 |
| PTPRZ1 AND SLC1A2 AND F2R | 0.879121 | 0.888889 | 0.869565 | KCNJ10 AND CD53 AND NOT-GDPD2 | 0.869565 | 0.9375 | 0.810811 |
| PTPRZ1 AND KCNJ10 AND F2R | 0.879121 | 0.888889 | 0.869565 | FAM26F AND NOT-FCER1A AND NOT-SLC17A2 | 0.805195 | 0.775 | 0.837838 |
| PTPRZ1 AND CLDN17 AND F2R | 0.879121 | 0.888889 | 0.869565 | KCNJ10 AND HLA-A AND NOT-PROS1 | 0.828571 | 0.878788 | 0.783784 |
| PTPRZ1 AND MOG AND F2R | 0.879121 | 0.888889 | 0.869565 | KCNJ10 AND CD53 AND NOT-ACVR2A | 0.823529 | 0.903226 | 0.756757 |
| PTPRZ1 AND GPR85 AND F2R | 0.879121 | 0.888889 | 0.869565 | FAM26F AND NOT-FCER1A AND NOT-ABCG5 | 0.805195 | 0.775 | 0.837838 |
| PTPRZ1 AND NOT-LRIG3 AND F2R | 0.879121 | 0.888889 | 0.869565 | FCRL3 AND NOT-CLEC1B AND FXYD6 | 0.853659 | 0.777778 | 0.945946 |
| PTPRZ1 AND CRB1 AND F2R | 0.879121 | 0.888889 | 0.869565 | KCNJ10 AND NOT-PLP1 AND GPR18 | 0.821918 | 0.833333 | 0.810811 |
| PTPRZ1 AND CLDN17 AND NOT-GPR83 | 0.873563 | 0.926829 | 0.826087 | KCNJ10 AND NOT-ENTPD3 AND GPR18 | 0.821918 | 0.833333 | 0.810811 |
| PTPRZ1 AND NOT-MSMO1 AND NOT-GABRA2 | 0.88172 | 0.87234 | 0.891304 | KCNJ10 AND GPR18 AND NOT-CNGA1 | 0.8 | 0.848485 | 0.756757 |
| SLC1A3 AND F2R AND NOT-CD36 | 0.870588 | 0.948718 | 0.804348 | KCNJ10 AND NOT-S1PR5 AND GPR18 | 0.8 | 0.848485 | 0.756757 |
| PTPRZ1 AND F2R AND CNTNAP4 | 0.866667 | 0.886364 | 0.847826 | KCNJ10 AND NOT-ENTPD3 AND ADTRP | 0.8 | 0.789474 | 0.810811 |
| PTPRZ1 AND F2R AND SLCO1A2 | 0.866667 | 0.886364 | 0.847826 | KCNJ10 AND NOT-PCDH19 AND GPR18 | 0.810811 | 0.810811 | 0.810811 |
| PTPRZ1 AND F2R AND SLCO1C1 | 0.866667 | 0.886364 | 0.847826 | CD53 AND NOT-FCER1A AND GPNMB | 0.849315 | 0.861111 | 0.837838 |
| PTPRZ1 AND F2R AND CNTNAP2 | 0.866667 | 0.886364 | 0.847826 | CD53 AND NOT-FCER1A AND GPNMB | 0.849315 | 0.861111 | 0.837838 |
| PTPRZ1 AND F2R AND NOT-KCNK6 | 0.866667 | 0.886364 | 0.847826 | BIRC5 AND FCRL3 AND GJA1 | 0.830769 | 0.964286 | 0.72973 |
| PTPRZ1 AND F2R AND GABBR2 | 0.866667 | 0.886364 | 0.847826 | FCRL3 AND GPNMB AND NOT-FCER1A | 0.830769 | 0.964286 | 0.72973 |
| PTPRZ1 AND F2R AND SLC4A8 | 0.866667 | 0.886364 | 0.847826 | FCRL3 AND GPNMB AND NOT-S1PR5 | 0.830769 | 0.964286 | 0.72973 |
| PTPRZ1 AND F2R AND NOT-CD36 | 0.866667 | 0.886364 | 0.847826 | CXCR5 AND GJA1 AND NOT-ENTPD3 | 0.84058 | 0.90625 | 0.783784 |
| PTPRZ1 AND F2R AND KCNA2 | 0.866667 | 0.886364 | 0.847826 | FCRL3 AND GPNMB AND NOT-ITM2B | 0.823529 | 0.903226 | 0.756757 |
| PTPRZ1 AND F2R AND NOT-AOC3 | 0.866667 | 0.886364 | 0.847826 | FCRL3 AND GPNMB AND NOT-CRIM1 | 0.818182 | 0.931034 | 0.72973 |
| PTPRZ1 AND F2R AND NOT-EPHA2 | 0.866667 | 0.886364 | 0.847826 | BIRC5 AND CD53 AND CD8A | 0.818182 | 0.931034 | 0.72973 |
| PTPRZ1 AND F2R AND NOT-SLC43A1 | 0.866667 | 0.886364 | 0.847826 | FCRL3 AND NOT-CD160 AND FPR1 | 0.816901 | 0.852941 | 0.783784 |
| PTPRZ1 AND F2R AND NOT-MRGPRF | 0.866667 | 0.886364 | 0.847826 | FCRL3 AND GJA1 AND NOT-EGFR | 0.815789 | 0.794872 | 0.837838 |
| PTPRZ1 AND F2R AND NOT-ATP8B1 | 0.866667 | 0.886364 | 0.847826 | FCRL3 AND GJA1 AND NOT-EGFR | 0.815789 | 0.794872 | 0.837838 |
| PTPRZ1 AND CLDN17 AND NOT-SYT4 | 0.860465 | 0.925 | 0.804348 | FCRL3 AND VCAM1 AND NOT-TACSTD2 | 0.815789 | 0.794872 | 0.837838 |
| PTPRZ1 AND BEST3 AND CRB1 | 0.857143 | 0.866667 | 0.847826 | FCRL3 AND GPNMB AND NOT-ATP10A | 0.8125 | 0.962963 | 0.702703 |
| PTPRZ1 AND BEST3 AND NOT-MOG | 0.857143 | 0.866667 | 0.847826 | FCRL3 AND GPNMB AND NOT-GPR35 | 0.8125 | 0.962963 | 0.702703 |
| PTPRZ1 AND CLDN17 AND NOT-KCNJ6 | 0.857143 | 0.947368 | 0.782609 | FCRL3 AND GPNMB AND NOT-LGR6 | 0.8125 | 0.962963 | 0.702703 |
| PTPRZ1 AND BEST3 AND CLDN17 | 0.857143 | 0.866667 | 0.847826 | FCRL3 AND VCAM1 AND NOT-ITM2B | 0.810127 | 0.761905 | 0.864865 |
| SLC1A2 AND F2R AND NOT-AQP3 | 0.853933 | 0.883721 | 0.826087 | FCRL3 AND VCAM1 AND NOT-SFRP1 | 0.810127 | 0.761905 | 0.864865 |
| PTPRZ1 AND CLDN17 AND NOT-GRM1 | 0.853933 | 0.883721 | 0.826087 | FCRL3 AND VCAM1 AND NOT-ITM2B | 0.810127 | 0.761905 | 0.864865 |
| PTPRZ1 AND NOT-GRM3 AND KCNA2 | 0.853659 | 0.972222 | 0.76087 | BIRC5 AND FCRL3 AND FCER1G | 0.80597 | 0.9 | 0.72973 |
| PTPRZ1 AND GPR85 AND ANTXR2 | 0.847826 | 0.847826 | 0.847826 | BIRC5 AND FCRL3 AND TYROBP | 0.80597 | 0.9 | 0.72973 |
| PTPRZ1 AND MOG AND ANTXR2 | 0.847826 | 0.847826 | 0.847826 | BIRC5 AND FCRL3 AND IGSF6 | 0.80597 | 0.9 | 0.72973 |
| PTPRZ1 AND SLC1A2 AND ANTXR2 | 0.847826 | 0.847826 | 0.847826 | FCRL3 AND ENPP2 AND NOT-CLDN1 | 0.805195 | 0.775 | 0.837838 |

FIG. 15 (cont.)

| Antigen Pair Logic | F1 | Precision | Recall |
|---|---|---|---|
| PTPRZ1 AND NOT-CD36 AND ANTXR2 | 0.847826 | 0.847826 | 0.847826 |
| PTPRZ1 AND GABBR2 AND ANTXR2 | 0.847826 | 0.847826 | 0.847826 |
| PTPRZ1 AND KCNA2 AND ANTXR2 | 0.847826 | 0.847826 | 0.847826 |
| PTPRZ1 AND NOT-KCNK6 AND ANTXR2 | 0.847826 | 0.847826 | 0.847826 |
| PTPRZ1 AND KCNJ10 AND ANTXR2 | 0.847826 | 0.847826 | 0.847826 |
| PTPRZ1 AND NOT-AOC3 AND ANTXR2 | 0.847826 | 0.847826 | 0.847826 |
| PTPRZ1 AND SLC4A8 AND ANTXR2 | 0.847826 | 0.847826 | 0.847826 |
| PTPRZ1 AND NOT-LRIG3 AND ANTXR2 | 0.847826 | 0.847826 | 0.847826 |
| PTPRZ1 AND GABRB2 AND ANTXR2 | 0.847826 | 0.847826 | 0.847826 |
| PTPRZ1 AND CR81 AND ANTXR2 | 0.847826 | 0.847826 | 0.847826 |
| PTPRZ1 AND SLCO1C1 AND ANTXR2 | 0.847826 | 0.847826 | 0.847826 |
| PTPRZ1 AND NOT-SLC43A1 AND ANTXR2 | 0.847826 | 0.847826 | 0.847826 |
| PTPRZ1 AND NOT-MRGPRF AND ANTXR2 | 0.847826 | 0.847826 | 0.847826 |
| PTPRZ1 AND CLDN17 AND ANTXR2 | 0.847826 | 0.847826 | 0.847826 |
| PTPRZ1 AND CLDN17 AND NOT-SCN2A | 0.845361 | 0.803922 | 0.891304 |
| PTPRZ1 AND NOT-CD36 AND NOT-GPR83 | 0.844444 | 0.863636 | 0.826087 |
| PTPRZ1 AND NOT-CD36 AND NOT-ATP8A2 | 0.844444 | 0.863636 | 0.826087 |
| PTPRZ1 AND SLC1A2 AND NOT-GPR83 | 0.844444 | 0.863636 | 0.826087 |
| PTPRZ1 AND GABRB2 AND NOT-GPR83 | 0.844444 | 0.863636 | 0.826087 |
| PTPRZ1 AND GPR85 AND NOT-GPR83 | 0.844444 | 0.863636 | 0.826087 |
| PTPRZ1 AND GABBR2 AND NOT-ATP8A2 | 0.844444 | 0.863636 | 0.826087 |
| PTPRZ1 AND CR81 AND NOT-GPR83 | 0.844444 | 0.863636 | 0.826087 |
| PTPRZ1 AND SLC1A2 AND NOT-ATP8A2 | 0.844444 | 0.863636 | 0.826087 |
| PTPRZ1 AND CR81 AND NOT-ATP8A2 | 0.844444 | 0.863636 | 0.826087 |
| PTPRZ1 AND NOT-AOC3 AND NOT-ATP8A2 | 0.844444 | 0.863636 | 0.826087 |
| PTPRZ1 AND SLC4A8 AND NOT-GPR83 | 0.844444 | 0.863636 | 0.826087 |
| PTPRZ1 AND GABBR2 AND NOT-GPR83 | 0.844444 | 0.863636 | 0.826087 |
| PTPRZ1 AND NOT-KCNK6 AND NOT-ATP8A2 | 0.844444 | 0.863636 | 0.826087 |
| PTPRZ1 AND SLC4A8 AND NOT-ATP8A2 | 0.844444 | 0.863636 | 0.826087 |
| PTPRZ1 AND SLCO1C1 AND NOT-GPR83 | 0.844444 | 0.863636 | 0.826087 |
| PTPRZ1 AND NOT-LRIG3 AND NOT-ATP8A2 | 0.844444 | 0.863636 | 0.826087 |
| PTPRZ1 AND SLCO1C1 AND NOT-ATP8A2 | 0.844444 | 0.863636 | 0.826087 |
| PTPRZ1 AND NOT-SDC1 AND TNC | 0.921348 | 0.953488 | 0.891304 |
| PTPRZ1 AND NOT-CLDN23 AND CD33 | 0.863636 | 0.904762 | 0.826087 |
| PTPRZ1 AND NOT-CLDN1 AND CD33 | 0.860465 | 0.925 | 0.804348 |
| PTPRZ1 AND NCAM1 AND CD33 | 0.860465 | 0.925 | 0.804348 |
| PTPRZ1 AND NOT-TRPM4 AND CD33 | 0.860465 | 0.925 | 0.804348 |
| PTPRZ1 AND SEMA5B AND NOT-STEAP2 | 0.844444 | 0.863636 | 0.826087 |
| PTPRZ1 AND CD33 AND NOT-STEAP2 | 0.83871 | 0.829787 | 0.847826 |
| PTPRZ1 AND NOT-SDC1 AND NOT-STEAP2 | 0.836735 | 0.788462 | 0.891304 |
| PTPRZ1 AND NOT-SDC1 AND NOT-STEAP2 | 0.836735 | 0.788462 | 0.891304 |
| PTPRZ1 AND CD33 AND NOT-STEAP1 | 0.829787 | 0.8125 | 0.847826 |
| COMPLEX-L1CAM/PTPRZ1/CD33 | 0.829787 | 0.8125 | 0.847826 |
| PTPRZ1 AND CD33 AND NOT-CD52 | 0.829787 | 0.8125 | 0.847826 |
| COMPLEX-PTPRZ1/VCAM1/CD33 | 0.829787 | 0.8125 | 0.847826 |
| PTPRZ1 AND CD33 AND NOT-PMEL | 0.829787 | 0.8125 | 0.847826 |
| PTPRZ1 AND NOT-SDC1 AND SEMA5B | 0.824742 | 0.784314 | 0.869565 |
| PTPRZ1 AND DLL3 AND NOT-STEAP2 | 0.821053 | 0.795918 | 0.847826 |
| COMPLEX-MET/PTPRZ1/CD33 | 0.821053 | 0.795918 | 0.847826 |
| VANGL2 AND NOT-TPBG AND L1CAM | 0.818182 | 0.857143 | 0.782609 |
| PCDH10 AND TNC AND NOT-SDC1 | 0.816327 | 0.769231 | 0.869565 |
| PTPRZ1 AND NOT-EPCAM AND SEMA5B | 0.808081 | 0.754717 | 0.869565 |
| COMPLEX-FOLR2/MET/PTPRZ1 | 0.808081 | 0.754717 | 0.869565 |
| PTPRZ1 AND NOT-TRPM4 AND NOT-STEAP2 | 0.803922 | 0.732143 | 0.891304 |
| PTPRZ1 AND NOT-SPON2 AND NOT-STEAP2 | 0.803922 | 0.732143 | 0.891304 |
| PTPRZ1 AND NOT-CLDN1 AND NOT-STEAP2 | 0.803922 | 0.732143 | 0.891304 |
| PTPRZ1 AND NOT-CD52 AND SLC39A6 | 0.803922 | 0.732143 | 0.891304 |
| PTPRZ1 AND NOT-CD52 AND NOT-STEAP2 | 0.803922 | 0.732143 | 0.891304 |
| PTPRZ1 AND NCAM1 AND NOT-STEAP2 | 0.803922 | 0.732143 | 0.891304 |
| PTPRZ1 AND BCAN AND NOT-STEAP2 | 0.803922 | 0.732143 | 0.891304 |
| PTPRZ1 AND NOT-CD52 AND NOT-STEAP2 | 0.803922 | 0.732143 | 0.891304 |
| PTPRZ1 AND NCAM1 AND NOT-STEAP2 | 0.803922 | 0.732143 | 0.891304 |
| PTPRZ1 AND NOT-TRPM4 AND NOT-STEAP2 | 0.803922 | 0.732143 | 0.891304 |
| PTPRZ1 AND NOT-CLDN1 AND NOT-STEAP2 | 0.803922 | 0.732143 | 0.891304 |
| COMPLEX-FOLH1/EPCAM/VANGL2 | 0.821053 | 0.795918 | 0.847826 |
| VANGL2 AND NOT-EPCAM AND L1CAM | 0.808989 | 0.837209 | 0.782609 |
| Breast Cancer | | | |
| ADAM12 AND NOT-NAALAD2 AND NOT-GPBAR1 | 0.882353 | 0.9375 | 0.833333 |
| ADAM12 AND NOT-NAALAD2 AND TMEM47 | 0.857143 | 0.882353 | 0.833333 |
| ADAM12 AND NOT-PAG1 AND NOT-IL1RL1 | 0.854369 | 0.897959 | 0.814815 |
| ADAM12 AND NOT-NAALAD2 AND TMPRSS2 | 0.841121 | 0.849057 | 0.833333 |
| ADAM12 AND NOT-GPBAR1 AND LY75 | 0.84 | 0.913043 | 0.777778 |
| GPRC5A AND NOT-ATP10B AND NOT-FPR1 | 0.857143 | 0.882353 | 0.833333 |
| ADAM12 AND NOT-SCN9A AND TMPRSS2 | 0.833333 | 0.833333 | 0.833333 |
| ADAM12 AND NOT-PAG1 AND APCDD1 | 0.830189 | 0.846154 | 0.814815 |
| ADAM12 AND NOT-C15orf27 AND KCNS1 | 0.830189 | 0.846154 | 0.814815 |
| GPRC5A AND NOT-IL22RA1 AND NOT-HHIP | 0.873786 | 0.918367 | 0.833333 |

| Antigen Pair Logic | F1 | Precision | Recall |
|---|---|---|---|
| BIRC5 AND CD53 AND GJA1 | 0.830769 | 0.964286 | 0.72973 |
| BIRC5 AND CD53 AND IGSF6 | 0.80597 | 0.9 | 0.72973 |
| GPR18 AND NOT-SLC18A2 AND GPNMB | 0.8 | 0.789474 | 0.810811 |
| CD53 AND GPNMB AND NOT-PROS1 | 0.8 | 0.744186 | 0.864865 |
| CD53 AND GPNMB AND NOT-PROS1 | 0.8 | 0.744186 | 0.864865 |
| FCRL3 AND TMEM119 AND NOT-EGFR | 0.860759 | 0.809524 | 0.918919 |
| GPR18 AND NOT-S1PR5 AND GPNMB | 0.805195 | 0.775 | 0.837838 |
| BIRC5 AND CD53 AND ADTRP | 0.811594 | 0.875 | 0.756757 |
| CD53 AND GPNMB AND NOT-HAS1 | 0.831169 | 0.8 | 0.864865 |
| FCRL3 AND NOT-NCAM1 AND BRCA1 | 0.8 | 0.789474 | 0.810811 |
| BIRC5 AND CD53 AND FPR1 | 0.80597 | 0.9 | 0.72973 |
| NOT-SLC6A8 AND NOT-SDC1 AND TMEM119 | 0.8 | 0.789474 | 0.810811 |
| FCRL3 AND TMEM119 AND NOT-IL20RA | 0.813953 | 0.714286 | 0.945946 |
| CXCR5 AND PPAP2B AND NOT-ENTPD3 | 0.8 | 0.848485 | 0.756757 |
| KCNJ10 AND CD53 AND NOT-LRIG3 | 0.828571 | 0.878788 | 0.783784 |
| KCNJ10 AND CD53 AND NOT-GJA3 | 0.857143 | 0.909091 | 0.810811 |
| KCNJ10 AND NOT-FXYD7 AND FCRL3 | 0.818182 | 0.931034 | 0.72973 |
| KCNJ10 AND NOT-ASTN1 AND NOT-FCER1A | 0.823529 | 0.903226 | 0.756757 |
| KCNJ10 AND CD53 AND NOT-CD93 | 0.811594 | 0.875 | 0.756757 |
| KCNJ10 AND FCRL3 AND NOT-KCNF1 | 0.810811 | 0.810811 | 0.810811 |
| KCNJ10 AND FCRL3 AND NOT-CABP7 | 0.810811 | 0.810811 | 0.810811 |
| KCNJ10 AND CD53 AND NOT-CCKAR | 0.811594 | 0.875 | 0.756757 |
| KCNJ10 AND CD53 AND NOT-STEAP4 | 0.8 | 0.848485 | 0.756757 |
| KCNJ10 AND CD53 AND NOT-AXL | 0.828571 | 0.878788 | 0.783784 |
| FCRL3 AND CDH11 AND NOT-EGFR | 0.818182 | 0.931034 | 0.72973 |
| KCNJ10 AND NOT-EGFR AND FCRL3 | 0.818182 | 0.931034 | 0.72973 |
| KCNJ10 AND NOT-EGFR AND IL10RA | 0.818182 | 0.931034 | 0.72973 |
| KCNJ10 AND CD53 AND NOT-MSLN | 0.810811 | 0.810811 | 0.810811 |
| KCNJ10 AND NOT-NCAM1 AND FCRL3 | 0.8 | 0.848485 | 0.756757 |
| FCRL3 AND NOT-SLC6A13 AND THY1 | 0.805556 | 0.828571 | 0.783784 |
| KCNJ10 AND NOT-IL20RA AND GPR18 | 0.8 | 0.789474 | 0.810811 |
| BIRC5 AND FCRL3 AND VCAM1 | 0.830769 | 0.964286 | 0.72973 |
| FCRL3 AND THY1 AND NOT-EGFR | 0.811594 | 0.875 | 0.756757 |
| FCRL3 AND VCAM1 AND NOT-EGFR | 0.805195 | 0.775 | 0.837838 |
| FCRL3 AND TNC AND NOT-EGFR | 0.8 | 0.848485 | 0.756757 |
| FCRL3 AND VCAM1 AND NOT-CLDN1 | 0.8 | 0.744186 | 0.864865 |
| Anaplastic Lymphoma | | | |
| NOT-MRAP2 AND NOT-FXYD1 AND RAMP3 | 0.8 | 1 | 0.666667 |
| NOT-MRAP2 AND NOT-FXYD1 AND MCAM | 0.846154 | 1 | 0.733333 |
| GPR18 AND NOT-CA4 AND APLNR | 0.8125 | 0.764706 | 0.866667 |
| NOT-MRAP2 AND NOT-FXYD1 AND OSMR | 0.846154 | 1 | 0.733333 |
| NOT-MRAP2 AND NOT-FXYD1 AND CDH5 | 0.827586 | 0.857143 | 0.8 |
| NOT-MRAP2 AND NOT-FXYD1 AND GJA1 | 0.857143 | 0.923077 | 0.8 |
| NOT-MRAP2 AND NOT-GHR AND APLNR | 0.903226 | 0.875 | 0.933333 |
| NOT-FXYD1 AND CDH5 AND NOT-SLC39A2 | 0.814815 | 0.916667 | 0.733333 |
| NOT-ERBB3 AND NOT-SCN4B AND APLNR | 0.848485 | 0.777778 | 0.933333 |
| NOT-ERBB3 AND NOT-SCN4B AND RAMP3 | 0.848485 | 0.777778 | 0.933333 |
| NOT-MRAP2 AND NOT-FXYD1 AND TNC | 0.8 | 1 | 0.666667 |
| NOT-EGFR AND CDH5 AND NOT-FXYD1 | 0.846154 | 1 | 0.733333 |
| NOT-ERBB3 AND NOT-FXYD1 AND APLNR | 0.965517 | 1 | 0.933333 |
| NOT-ERBB3 AND NOT-FXYD1 AND AQP1 | 0.8125 | 0.764706 | 0.866667 |
| NOT-MRAP2 AND NOT-EGFR AND APLNR | 0.896552 | 0.928571 | 0.866667 |
| NOT-FCER1A AND SECTM1 AND NOT-EGFR | 0.8 | 0.8 | 0.8 |
| NOT-FXYD1 AND THY1 AND NOT-CNTN1 | 0.8125 | 0.764706 | 0.866667 |
| NOT-FXYD1 AND THY1 AND NOT-PRRG1 | 0.83871 | 0.8125 | 0.866667 |
| NOT-FXYD1 AND NOT-ITGB6 AND CDH5 | 0.846154 | 1 | 0.733333 |
| NOT-EGFR AND NOT-FXYD1 AND GJA4 | 0.903226 | 0.875 | 0.933333 |
| COMPLEX-ANO4/ATP8B1/TNFRSF8 | 0.823529 | 0.736842 | 0.933333 |
| NOT-ERBB3 AND NOT-GHR AND APLNR | 0.875 | 0.823529 | 0.933333 |
| NOT-GHR AND NOT-EFNB3 AND THY1 | 0.814815 | 0.916667 | 0.733333 |
| NOT-FXYD1 AND THY1 AND NOT-GHR | 0.8125 | 0.764706 | 0.866667 |
| NOT-EGFR AND THY1 AND P2RY8 | 0.814815 | 0.916667 | 0.733333 |
| NOT-ERBB3 AND NOT-SCN4B AND THY1 | 0.83871 | 0.8125 | 0.866667 |
| NOT-EGFR AND THY1 AND FAM26F | 0.814815 | 0.916667 | 0.733333 |
| NOT-ERBB2 AND NOT-GLRB AND THY1 | 0.827586 | 0.857143 | 0.8 |
| NOT-EGFR AND THY1 AND SLC7A7 | 0.814815 | 0.916667 | 0.733333 |
| NOT-EGFR AND THY1 AND NOT-ATP1A2 | 0.83871 | 0.8125 | 0.866667 |
| NOT-EGFR AND THY1 AND NOT-AQP4 | 0.8125 | 0.764706 | 0.866667 |
| NOT-ERBB2 AND THY1 AND NOT-GLDN | 0.846154 | 1 | 0.733333 |
| NOT-ERBB2 AND THY1 AND NOT-TSPAN7 | 0.8 | 0.8 | 0.8 |
| NOT-ERBB2 AND NOT-GPRC5B AND THY1 | 0.866667 | 0.866667 | 0.866667 |
| NOT-ERBB3 AND NOT-GHR AND THY1 | 0.896552 | 0.928571 | 0.866667 |
| NOT-EGFR AND THY1 AND NOT-CNTNAP4 | 0.8125 | 0.764706 | 0.866667 |
| NOT-ERBB3 AND THY1 AND NOT-EGFR | 0.866667 | 0.866667 | 0.866667 |
| Mantle-Cell Lymphoma | | | |
| CLECL1 AND NOT-IL12RB2 AND LRRC32 | 1 | 1 | 1 |
| CLECL1 AND NOT-IL12RB2 AND NOT-CLEC4A | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| ADAM12 AND NOT-SCN9A AND RHCG | 0.825688 | 0.818182 | 0.833333 | CLECL1 AND NOT-IL12RB2 AND NOT-RECK | 1 | 1 | 1 |
| GPRC5A AND NOT-IL22RA1 AND NOT-AQP4 | 0.862745 | 0.916667 | 0.814815 | CLECL1 AND NOT-IL12RB2 AND NOT-DNAJC5 | 1 | 1 | 1 |
| ADAM12 AND OR51B2 AND NOT-ASGR1 | 0.823529 | 0.875 | 0.777778 | CLECL1 AND NOT-IL12RB2 AND NOT-IL10RB | 0.987013 | 0.974359 | 1 |
| ADAM12 AND NOT-MME AND NOT-IL1RL1 | 0.823529 | 0.875 | 0.777778 | CLECL1 AND NOT-IL12RB2 AND NOT-SLC30A5 | 1 | 1 | 1 |
| ADAM12 AND NOT-TSPAN3 AND NOT-IL1RL1 | 0.823529 | 0.875 | 0.777778 | CLECL1 AND NOT-IL12RB2 AND NOT-CYB3 | 1 | 1 | 1 |
| KCNS3 AND NOT-IL22RA1 AND NOT-AQP4 | 0.851852 | 0.851852 | 0.851852 | CLECL1 AND NOT-IL12RB2 AND NOT-PTGER2 | 1 | 1 | 1 |
| ADAM12 AND NOT-DPP4 AND NOT-DUOXA1 | 0.818182 | 0.803571 | 0.833333 | CLECL1 AND NOT-IL12RB2 AND NOT-PAG1 | 1 | 1 | 1 |
| GPRC5A AND NOT-ATP10B AND NOT-DUOXA1 | 0.873786 | 0.918367 | 0.833333 | CLECL1 AND NOT-IL12RB2 AND NOT-CYB3 | 1 | 1 | 1 |
| ADAM12 AND NOT-DPP4 AND NOT-COL17A1 | 0.818182 | 0.803571 | 0.833333 | CLECL1 AND NOT-KCNH6 AND NOT-PTGER2 | 0.987013 | 0.974359 | 1 |
| GPRC5A AND NOT-IL22RA1 AND NOT-TREM1 | 0.849057 | 0.865385 | 0.833333 | CLECL1 AND NOT-P2RY2 AND STRA6 | 0.974359 | 0.95 | 1 |
| ADAM12 AND NOT-MME AND NOT-PRPH2 | 0.815534 | 0.857143 | 0.777778 | CLECL1 AND NOT-IL12RB2 AND NOT-AQP9 | 0.974359 | 0.95 | 1 |
| ADAM12 AND NOT-MME AND NOT-STAB2 | 0.815534 | 0.857143 | 0.777778 | COMPLEX-CLECL1/FPR2/LNPEP | 0.974359 | 0.95 | 1 |
| ADAM12 AND NOT-PAG1 AND RHCG | 0.814815 | 0.814815 | 0.814815 | CLECL1 AND NOT-P2RY2 AND MRGPRX4 | 0.974359 | 0.95 | 1 |
| ADAM12 AND NOT-DPP4 AND NOT-PAG1 | 0.814815 | 0.814815 | 0.814815 | CLECL1 AND NOT-KCNH6 AND NOT-CYBB | 0.974359 | 0.95 | 1 |
| GPRC5A AND NOT-IL22RA1 AND NOT-FPR1 | 0.865385 | 0.9 | 0.833333 | CLECL1 AND NOT-KCNH6 AND NOT-CLEC4A | 0.974359 | 0.95 | 1 |
| ADAM12 AND NOT-PAG1 AND GPR15 | 0.811321 | 0.826923 | 0.796296 | CLECL1 AND NOT-ABCG2 AND NOT-FCER1A | 0.973684 | 0.973684 | 0.973684 |
| GPRC5A AND NOT-IL22RA1 AND NOT-CA4 | 0.873786 | 0.918367 | 0.833333 | CLECL1 AND NOT-TREM2 AND NOT-FCER1A | 0.973684 | 0.973684 | 0.973684 |
| GPRC5A AND NOT-DUOXA1 AND NOT-MEP1A | 0.857143 | 0.882353 | 0.833333 | CLECL1 AND NOT-ERVFRD-1 AND NOT-FCER1A | 0.973684 | 0.973684 | 0.973684 |
| PROM2 AND NOT-DUOXA1 AND NOT-CA4 | 0.815534 | 0.857143 | 0.777778 | CLECL1 AND NOT-TAS2R16 AND NOT-NKG7 | 0.973684 | 0.973684 | 0.973684 |
| ADAM12 AND NOT-C15orf27 AND TMPRSS2 | 0.808081 | 0.888889 | 0.740741 | CLECL1 AND NOT-SLC46A2 AND SLC25A3 | 0.973684 | 0.973684 | 0.973684 |
| ADAM12 AND NOT-DPP4 AND NOT-UPK1B | 0.807339 | 0.8 | 0.814815 | CLECL1 AND NOT-SLC46A2 AND MRGPRX4 | 0.973684 | 0.973684 | 0.973684 |
| GPRC5A AND NOT-DUOXA1 AND NOT-IHH | 0.857143 | 0.882353 | 0.833333 | CLECL1 AND NOT-TAS2R16 AND NOT-CD28 | 0.973684 | 0.973684 | 0.973684 |
| GPRC5A AND NOT-DUOXA1 AND NOT-TM4SF5 | 0.857143 | 0.882353 | 0.833333 | CLECL1 AND NOT-SLC46A2 AND STRA6 | 0.973684 | 0.973684 | 0.973684 |
| GPRC5A AND NOT-DUOXA1 AND NOT-SLC17A4 | 0.857143 | 0.882353 | 0.833333 | COMPLEX-CLECL1/LNPEP/SLC46A2 | 0.973684 | 0.973684 | 0.973684 |
| GPRC5A AND NOT-DUOXA1 AND NOT-GPR35 | 0.857143 | 0.882353 | 0.833333 | CLECL1 AND NOT-IL12RB2 AND NOT-NPC1 | 0.973684 | 0.973684 | 0.973684 |
| GPRC5A AND NOT-IL22RA1 AND NOT-AQP9 | 0.834951 | 0.877551 | 0.796296 | CLECL1 AND NOT-ATP1A4 AND NOT-FCER1A | 0.973684 | 0.973684 | 0.973684 |
| GPRC5A AND NOT-CYP4F12 AND NOT-DUOXA1 | 0.851485 | 0.914894 | 0.796296 | CLECL1 AND NOT-TAS2R5 AND NOT-CLEC4A | 0.973684 | 0.973684 | 0.973684 |
| GPRC5A AND NOT-DUOXA1 AND NOT-SLC39A5 | 0.857143 | 0.882353 | 0.833333 | CLECL1 AND NOT-TAS2R16 AND NOT-TRAT1 | 0.973684 | 0.973684 | 0.973684 |
| GPRC5A AND NOT-CA4 AND NOT-DUOXA1 | 0.862745 | 0.916667 | 0.814815 | CLECL1 AND NOT-KCNG2 AND NOT-FCER1A | 0.973684 | 0.973684 | 0.973684 |
| GPRC5A AND NOT-IL22RA1 AND NOT-GLDN | 0.808081 | 0.888889 | 0.740741 | CLECL1 AND NOT-SLC46A2 AND NOT-GPR1 | 0.973684 | 0.973684 | 0.973684 |
| KCNS3 AND NOT-CDHR1 AND NOT-AQP4 | 0.87619 | 0.901961 | 0.851852 | CLECL1 AND NOT-IL12RB2 AND NOT-SLAMF6 | 0.972973 | 1 | 0.947368 |
| GPRC5A AND NOT-CA4 AND NOT-IL20RB | 0.834951 | 0.877551 | 0.796296 | CLECL1 AND NOT-IL12RB2 AND ST14 | 0.972973 | 1 | 0.947368 |
| GPRC5A AND NOT-IL22RA1 AND NOT-IL1RL1 | 0.862745 | 0.916667 | 0.814815 | CLECL1 AND NOT-SLC24A4 AND NOT-DEGS1 | 0.972973 | 1 | 0.947368 |
| GPRC5A AND NOT-CA4 AND NOT-DSC3 | 0.82243 | 0.830189 | 0.814815 | CLECL1 AND NOT-IL12RB2 AND NOT-IFNAR1 | 0.972973 | 1 | 0.947368 |
| GPRC5A AND NOT-VSIG2 AND NOT-LY6D | 0.873786 | 0.918367 | 0.833333 | CLECL1 AND NOT-IL12RB2 AND NOT-CLEC12A | 0.972973 | 1 | 0.947368 |
| KCNS3 AND NOT-CA4 AND NOT-IL20RB | 0.803571 | 0.775862 | 0.833333 | CLECL1 AND NOT-IL12RB2 AND NOT-CD86 | 0.972973 | 1 | 0.947368 |
| CDH3 AND NOT-DUOXA1 AND NOT-DPP6 | 0.803279 | 0.720588 | 0.907407 | CLECL1 AND NOT-ABCG2 AND NOT-SLC16A6 | 0.974359 | 0.95 | 1 |
| ADAM12 AND NOT-MME AND NOT-SLC8A3 | 0.84 | 0.913043 | 0.777778 | CLECL1 AND NOT-KCNG2 AND NOT-IL10RB | 0.974359 | 0.95 | 1 |
| JAG2 AND NOT-DUOXA1 AND VAMP8 | 0.824742 | 0.930233 | 0.740741 | CLECL1 AND NOT-TREM2 AND NOT-NKG7 | 0.987013 | 0.974359 | 1 |
| LRRC8E AND NOT-IL22RA1 AND NOT-FNDC5 | 0.82 | 0.891304 | 0.759259 | CLECL1 AND NOT-ABCG2 AND NOT-FURIN | 0.972973 | 1 | 0.947368 |
| ADAM12 AND NOT-C15orf27 AND NOT-GYPC | 0.814815 | 0.814815 | 0.814815 | CLECL1 AND NOT-ATP1A4 AND NOT-CD28 | 0.987013 | 0.974359 | 1 |
| GPRC5A AND NOT-DUOXA1 AND NOT-CDH17 | 0.857143 | 0.882353 | 0.833333 | CLECL1 AND NOT-ATP1A4 AND NOT-CYBB | 0.974359 | 0.95 | 1 |
| LRRC8E AND NOT-DUOXA1 AND NOT-IL1RL1 | 0.808081 | 0.888889 | 0.740741 | CLECL1 AND NOT-ABCG2 AND NOT-CYBB | 0.974359 | 0.95 | 1 |
| JAG2 AND NOT-DUOXA1 AND NOT-GABRG2 | 0.803922 | 0.854167 | 0.759259 | CLECL1 AND NOT-TREM2 AND NOT-PILRA | 0.974359 | 0.95 | 1 |
| GPRC5A AND NOT-DUOXA1 AND NOT-PTPRR | 0.857143 | 0.882353 | 0.833333 | CLECL1 AND NOT-KCNG2 AND NOT-SLC44A1 | 0.974359 | 0.95 | 1 |
| JAG2 AND NOT-IL22RA1 AND VAMP8 | 0.808081 | 0.888889 | 0.740741 | CLECL1 AND NOT-IL12RB2 AND NOT-LDLRAD3 | 1 | 1 | 1 |
| GPRC5A AND NOT-ATP10B AND NOT-GYPC | 0.841121 | 0.849057 | 0.833333 | CLECL1 AND NOT-ATP1A4 AND NOT-CLEC4D | 0.974359 | 0.95 | 1 |
| GPRC5A AND NOT-IL22RA1 AND NOT-GYPC | 0.849057 | 0.865385 | 0.833333 | CLECL1 AND NOT-ABCG2 AND NOT-AMICA1 | 0.974359 | 0.95 | 1 |
| GPRC5A AND NOT-PIGR AND NOT-SLC39A2 | 0.831683 | 0.893617 | 0.777778 | CLECL1 AND NOT-KCNG2 AND NOT-IGSF6 | 0.974359 | 0.95 | 1 |
| SDC1 AND NOT-DUOXA1 AND NOT-TM4SF5 | 0.865385 | 0.9 | 0.833333 | CLECL1 AND NOT-TREM2 AND NOT-SLC44A1 | 0.974359 | 0.95 | 1 |
| GPRC5A AND NOT-ATP10B AND NOT-CD52 | 0.857143 | 0.882353 | 0.833333 | CLECL1 AND NOT-TREM2 AND NOT-FLT3LG | 0.987013 | 0.974359 | 1 |
| SDC1 AND NOT-DUOXA1 AND NOT-SLC39A5 | 0.873786 | 0.918367 | 0.833333 | COMPLEX-CD226/CLECL1/AQP9 | 0.987013 | 0.974359 | 1 |
| SDC1 AND NOT-DUOXA1 AND NOT-SLC17A4 | 0.833333 | 0.833333 | 0.833333 | CLECL1 AND NOT-TREM2 AND NOT-STOM | 0.987013 | 0.974359 | 1 |
| ADAM12 AND NOT-DPP4 AND NOT-GPA33 | 0.833333 | 0.833333 | 0.833333 | CLECL1 AND NOT-TREM2 AND NOT-SLC31A2 | 0.974359 | 0.95 | 1 |
| ADAM12 AND NOT-SCN9A AND SLAMF7 | 0.825688 | 0.818182 | 0.833333 | CLECL1 AND NOT-ABCG2 AND NOT-RECK | 0.974359 | 0.95 | 1 |
| FAP AND NOT-NAALAD2 AND NOT-IL22RA1 | 0.871267 | 0.93617 | 0.814815 | CLECL1 AND NOT-TREM2 AND NOT-RECK | 0.974359 | 0.95 | 1 |
| GPRC5A AND NOT-GPA33 AND NOT-DUOXA1 | 0.865385 | 0.9 | 0.833333 | CLECL1 AND NOT-KCNG2 AND NOT-PILRA | 0.974359 | 0.95 | 1 |
| GPRC5A AND NOT-SSTR1 AND NOT-DUOXA1 | 0.857143 | 0.882353 | 0.833333 | CLECL1 AND NOT-KCNG2 AND NOT-LILRB2 | 0.974359 | 0.95 | 1 |
| FAP AND NOT-NAALAD2 AND NOT-COL17A1 | 0.854369 | 0.897959 | 0.814815 | CLECL1 AND NOT-ATP1A4 AND NOT-KLRD1 | 0.987013 | 0.974359 | 1 |
| SDC1 AND NOT-CYP4F12 AND NOT-DUOXA1 | 0.819048 | 0.843137 | 0.796296 | CLECL1 AND NOT-ATP1A4 AND NOT-LILRB2 | 0.974359 | 0.95 | 1 |
| GPRC5A AND NOT-GUCY2C AND NOT-DUOXA1 | 0.873786 | 0.918367 | 0.833333 | CLECL1 AND NOT-ATP1A4 AND NOT-GPR171 | 0.987013 | 0.974359 | 1 |
| GPRC5A AND NOT-IL22RA1 AND NOT-CD52 | 0.865385 | 0.9 | 0.833333 | CLECL1 AND NOT-SHH AND NOT-CD28 | 0.973684 | 0.973684 | 0.973684 |
| FAP AND NOT-COL17A1 AND NOT-DPP6 | 0.88 | 0.956522 | 0.814815 | CLECL1 AND NOT-TREM2 AND NOT-DNAJC5 | 0.974359 | 0.95 | 1 |
| ADAM12 AND NOT-MME AND NOT-GPA33 | 0.815534 | 0.857143 | 0.777778 | CLECL1 AND NOT-ATP1A4 AND NOT-IGSF6 | 0.974359 | 0.95 | 1 |
| ADAM12 AND NOT-MME AND NOT-CD52 | 0.815534 | 0.857143 | 0.777778 | CLECL1 AND NOT-TREM2 AND NOT-TRAT1 | 0.987013 | 0.974359 | 1 |
| FAP AND NOT-IL22RA1 AND NOT-DPP6 | 0.88 | 0.956522 | 0.814815 | CLECL1 AND NOT-ABCG2 AND NOT-FCER1G | 0.973684 | 0.973684 | 0.973684 |
| COMPLEX-C15orf27/PMEL/ADAM12 | 0.814815 | 0.814815 | 0.814815 | CLECL1 AND NOT-KCNG2 AND NOT-NKG7 | 0.987013 | 0.974359 | 1 |
| FAP AND NOT-NAALAD2 AND NOT-DUOXA1 | 0.862745 | 0.916667 | 0.814815 | CLECL1 AND NOT-TREM2 AND NOT-CD3G | 0.987013 | 0.974359 | 1 |
| FAP AND NOT-APCDD1 AND NOT-SCN9A | 0.838095 | 0.862745 | 0.814815 | CLECL1 AND NOT-ATP1A4 AND NOT-NUCB2 | 0.974359 | 0.95 | 1 |
| FAP AND NOT-NAALAD2 AND NOT-LY6D | 0.854369 | 0.897959 | 0.814815 | CLECL1 AND NOT-KCNG2 AND NOT-CD244 | 0.974359 | 0.95 | 1 |
| FAP AND NOT-NAALAD2 AND NOT-GJB3 | 0.854369 | 0.897959 | 0.814815 | CLECL1 AND NOT-TREM2 AND NOT-CD28 | 0.987013 | 0.974359 | 1 |
| GPRC5A AND NOT-DUOX1 AND NOT-SST | 0.849057 | 0.865385 | 0.833333 | CLECL1 AND NOT-KCNG2 AND NOT-PRCP | 0.974359 | 0.95 | 1 |
| FAP AND NOT-COL17A1 AND NOT-SCN9A | 0.838095 | 0.862745 | 0.814815 | CLECL1 AND NOT-IL12RB2 AND NOT-SLC9A6 | 0.986667 | 1 | 0.973684 |
| CLDN7 AND NOT-AQP3 AND NOT-CA4 | 0.807692 | 0.84 | 0.777778 | CLECL1 AND NOT-LRP12 AND NOT-DNAJC5 | 0.974359 | 0.95 | 1 |
| SDC1 AND NOT-ATP10B AND NOT-DUOXA1 | 0.807339 | 0.8 | 0.814815 | CLECL1 AND NOT-IL12RB2 AND NOT-SIRPB1 | 1 | 1 | 1 |
| FXYD3 AND NOT-DUOX1 AND NOT-SST | 0.836066 | 0.75 | 0.944444 | CLECL1 AND NOT-LRP12 AND NOT-CYBB | 0.974359 | 0.95 | 1 |
| FAP AND NOT-NAALAD2 AND NOT-CHIC2 | 0.854369 | 0.897959 | 0.814815 | CLECL1 AND NOT-IL12RB2 AND NOT-CLEC4E | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| FAP AND NOT-DPP6 AND NOT-DUOXA1 | 0.88 | 0.956522 | 0.814815 | CLECL1 AND NOT-ERVFRD-1 AND NOT-SIRPB1 | 0.974359 | 0.95 | 1 |
| FAP AND NOT-DPP6 AND NOT-LY6D | 0.88 | 0.956522 | 0.814815 | CLECL1 AND NOT-LRP12 AND NOT-CCR6 | 0.974359 | 0.95 | 1 |
| FAP AND NOT-NAALAD2 AND NOT-P2RX1 | 0.854369 | 0.897959 | 0.814815 | CLECL1 AND NOT-ABCG2 AND NOT-SLC39A11 | 0.974359 | 0.95 | 1 |
| FAP AND NOT-DPP6 AND NOT-GJB3 | 0.88 | 0.956522 | 0.814815 | CLECL1 AND NOT-TREM2 AND NOT-ACVR2A | 0.974359 | 0.95 | 1 |
| FAP AND NOT-IL22RA1 AND NOT-KCNMB2 | 0.871287 | 0.93617 | 0.814815 | CLECL1 AND NOT-GALR3 AND NOT-CD28 | 0.973684 | 0.973684 | 0.973684 |
| FAP AND NOT-SLC46A2 AND NOT-KCNMB2 | 0.84 | 0.913043 | 0.777778 | CLECL1 AND NOT-IL12RB2 AND NOT-LILRB2 | 1 | 1 | 1 |
| GPRC5A AND NOT-IL22RA1 AND NOT-SSTR1 | 0.857143 | 0.882353 | 0.833333 | CLECL1 AND NOT-TREM2 AND NOT-CD244 | 0.974359 | 0.95 | 1 |
| FAP AND NOT-IL22RA1 AND KCNS1 | 0.854369 | 0.897959 | 0.814815 | CLECL1 AND NOT-IL12RB2 AND NOT-CPD | 1 | 1 | 1 |
| FAP AND NOT-NAALAD2 AND NOT-TMEM47 | 0.857143 | 0.954545 | 0.777778 | CLECL1 AND NOT-ATP1A4 AND NOT-IL2RB | 0.974359 | 0.95 | 1 |
| GPRC5A AND NOT-DUOXA1 AND NOT-SST | 0.833333 | 0.833333 | 0.833333 | COMPLEX-PTGDR2/CLECL1/LNPEP | 0.974359 | 0.95 | 1 |
| FAP AND NOT-CDHR1 AND NOT-KCNMB2 | 0.848485 | 0.933333 | 0.777778 | CLECL1 AND NOT-IL12RB2 AND NOT-IGSF6 | 1 | 1 | 1 |
| GPRC5A AND NOT-GUCY2C AND NOT-SLC46A2 | 0.818182 | 0.803571 | 0.833333 | CLECL1 AND NOT-TREM2 AND NOT-C5AR1 | 0.974359 | 0.95 | 1 |
| FAP AND NOT-COL17A1 AND NOT-DPP4 | 0.838095 | 0.862745 | 0.814815 | CLECL1 AND NOT-LRP12 AND NOT-RECK | 0.974359 | 0.95 | 1 |
| FAP AND NOT-FXYD1 AND NOT-DUOXA1 | 0.88 | 0.956522 | 0.814815 | CLECL1 AND NOT-ABCG2 AND NOT-CD28 | 0.987013 | 0.974359 | 1 |
| FAP AND NOT-IL22RA1 AND CYP4F12 | 0.831683 | 0.893617 | 0.777778 | CLECL1 AND NOT-TREM2 AND NOT-PTGDR | 0.974359 | 0.95 | 1 |
| FAP AND NOT-IL22RA1 AND NOT-TREM1 | 0.843137 | 0.895833 | 0.796296 | CLECL1 AND NOT-KCNG2 AND NOT-PAG1 | 0.974359 | 0.95 | 1 |
| FAP AND NOT-IL22RA1 AND NOT-PRIMA1 | 0.851485 | 0.914894 | 0.796296 | CLECL1 AND NOT-ATP1A4 AND NOT-SLC24A4 | 0.974359 | 0.95 | 1 |
| FAP AND NOT-COL17A1 AND KCNS1 | 0.838095 | 0.862745 | 0.814815 | CLECL1 AND NOT-ABCG2 AND LRRC32 | 0.987013 | 0.974359 | 1 |
| FAP AND NOT-IL22RA1 AND NOT-FPR1 | 0.854369 | 0.897959 | 0.814815 | CLECL1 AND NOT-KCNG2 AND NOT-PTGDR | 0.974359 | 0.95 | 1 |
| FAP AND NOT-APCDD1 AND NOT-GPBAR1 | 0.843137 | 0.895833 | 0.796296 | CLECL1 AND NOT-TREM2 AND NOT-PAG1 | 0.974359 | 0.95 | 1 |
| FAP AND NOT-APCDD1 AND NOT-PAG1 | 0.815534 | 0.857143 | 0.777778 | CLECL1 AND NOT-ABCG2 AND NOT-CLEC4E | 0.974359 | 0.95 | 1 |
| FAP AND NOT-DUOXA1 AND NOT-KCNMB2 | 0.84 | 0.913043 | 0.777778 | CLECL1 AND NOT-CHRNA4 AND NOT-CLEC4A | 0.986667 | 1 | 0.973684 |
| FAP AND NOT-COL17A1 AND NOT-GPBAR1 | 0.843137 | 0.895833 | 0.796296 | CLECL1 AND NOT-CHRNA4 AND NOT-TRPV2 | 0.974359 | 0.95 | 1 |
| FAP AND NOT-IL22RA1 AND NOT-PAG1 | 0.843137 | 0.895833 | 0.796296 | CLECL1 AND NOT-CHRNA4 AND NOT-TRPV2 | 0.974359 | 0.95 | 1 |
| FAP AND NOT-COL17A1 AND NOT-TREM1 | 0.834951 | 0.877551 | 0.796296 | CLECL1 AND NOT-GUCY2D AND NOT-TRPV2 | 0.973684 | 0.973684 | 0.973684 |
| FAP AND NOT-ATP10B AND LY75 | 0.804348 | 0.973684 | 0.685185 | CLECL1 AND NOT-CRB2 AND NOT-CD28 | 0.973684 | 0.973684 | 0.973684 |
| FAP AND NOT-IL22RA1 AND NOT-GPBAR1 | 0.843137 | 0.895833 | 0.796296 | CLECL1 AND NOT-CRB2 AND NOT-TRAT1 | 0.973684 | 0.973684 | 0.973684 |
| FAP AND NOT-IL20RB AND NOT-PAG1 | 0.803922 | 0.854167 | 0.759259 | CLECL1 AND NOT-SLC46A2 AND NOT-SEMA4D | 0.973684 | 0.973684 | 0.973684 |
| FAP AND NOT-SGCA AND NOT-GJB3 | 0.888889 | 0.977778 | 0.814815 | COMPLEX-CLECL1/MLC1/LNPEP | 0.973684 | 0.973684 | 0.973684 |
| FAP AND NOT-IL22RA1 AND ICAM3 | 0.868687 | 0.955556 | 0.796296 | CLECL1 AND NOT-CRB2 AND NOT-NKG7 | 0.973684 | 0.973684 | 0.973684 |
| FAP AND NOT-CDHR1 AND NOT-ADRB1 | 0.851485 | 0.914894 | 0.796296 | CLECL1 AND NOT-IL12RB2 AND NOT-EBP | 0.972973 | 1 | 0.947368 |
| GPRC5A AND NOT-SSTR1 AND NOT-PTPRZ1 | 0.841121 | 0.849057 | 0.833333 | CLECL1 AND NOT-FCER1A AND NOT-CHRNA4 | 0.972973 | 1 | 0.947368 |
| FAP AND NOT-COL17A1 AND NOT-PAG1 | 0.815534 | 0.857143 | 0.777778 | CLECL1 AND NOT-CHRNA4 AND NOT-IL18RAP | 1 | 1 | 1 |
| GPRC5A AND NOT-SSTR1 AND NOT-IL20RB | 0.830189 | 0.846154 | 0.814815 | CLECL1 AND NOT-CHRNA4 AND NOT-C5AR1 | 1 | 1 | 1 |
| FAP AND NOT-DPP4 AND NOT-DUOXA1 | 0.834951 | 0.877551 | 0.796296 | CLECL1 AND NOT-CHRNA4 AND NOT-SLC22A4 | 0.974359 | 0.95 | 1 |
| FAP AND NOT-NAALAD2 AND NOT-TREM1 | 0.851485 | 0.914894 | 0.796296 | CLECL1 AND NOT-CHRNA4 AND NOT-CD3D | 1 | 1 | 1 |
| FAP AND NOT-IL20RB AND NOT-PDGFRA | 0.82 | 0.891304 | 0.759259 | CLECL1 AND NOT-ERVFRD-1 AND NOT-CD93 | 0.974359 | 0.95 | 1 |
| FAP AND NOT-COL17A1 AND NOT-IL1RL1 | 0.854369 | 0.897959 | 0.814815 | CLECL1 AND NOT-CHRNA4 AND NOT-PTGDR | 1 | 1 | 1 |
| FAP AND NOT-COL17A1 AND NOT-CHRNB3 | 0.815534 | 0.857143 | 0.777778 | CLECL1 AND NOT-CHRNA4 AND NOT-CD28 | 1 | 1 | 1 |
| FAP AND NOT-COL17A1 AND NOT-C15orf27 | 0.826923 | 0.86 | 0.796296 | CLECL1 AND NOT-CHRNA4 AND NOT-NFAM1 | 1 | 1 | 1 |
| FAP AND NOT-SLC46A2 AND ATP12A | 0.82 | 0.891304 | 0.759259 | CLECL1 AND NOT-CHRNA4 AND NOT-PAG1 | 1 | 1 | 1 |
| FAP AND NOT-SGCA AND NOT-GPBAR1 | 0.877551 | 0.977273 | 0.796296 | CLECL1 AND NOT-CHRNA4 AND NOT-CX3CR1 | 0.972973 | 1 | 0.947368 |
| FAP AND NOT-APCDD1 AND NOT-PDGFRA | 0.831683 | 0.893617 | 0.777778 | CLECL1 AND NOT-CHRNA4 AND NOT-LAMP2 | 0.974359 | 0.95 | 1 |
| FAP AND NOT-COL17A1 AND ICAM3 | 0.851485 | 0.914894 | 0.796296 | CLECL1 AND NOT-CHRNA4 AND NOT-ATP8B4 | 1 | 1 | 1 |
| FAP AND NOT-NAALAD2 AND NOT-CR1 | 0.8125 | 0.928571 | 0.722222 | CLECL1 AND NOT-CHRNA4 AND NOT-KLRD1 | 1 | 1 | 1 |
| FAP AND NOT-ATP10B AND NOT-FPR1 | 0.843137 | 0.895833 | 0.796296 | CLECL1 AND NOT-CHRNA4 AND NOT-PRCP | 0.987013 | 0.974359 | 1 |
| FAP AND NOT-IL22RA1 AND GRIK5 | 0.854369 | 0.897959 | 0.814815 | CLECL1 AND NOT-SLC9B1 AND NOT-TRPV2 | 0.974359 | 0.95 | 1 |
| FAP AND NOT-SCN9A AND NOT-GJB3 | 0.846154 | 0.88 | 0.814815 | CLECL1 AND NOT-KCNC2 AND NOT-CD28 | 0.973684 | 0.973684 | 0.973684 |
| FAP AND NOT-SCN9A AND NOT-LY6D | 0.846154 | 0.88 | 0.814815 | CLECL1 AND NOT-CHRNA4 AND NOT-CD244 | 1 | 1 | 1 |
| GPRC5A AND NOT-SSTR1 AND NOT-DSC3 | 0.818182 | 0.803571 | 0.833333 | CLECL1 AND NOT-MAG AND NOT-CYBB | 0.974359 | 0.95 | 1 |
| FAP AND NOT-DUOXA1 AND NOT-PRLHR | 0.831683 | 0.893617 | 0.777778 | CLECL1 AND NOT-CHRNA4 AND NOT-TRAT1 | 1 | 1 | 1 |
| FAP AND NOT-SCN9A AND NOT-DUOXA1 | 0.854369 | 0.897959 | 0.814815 | CLECL1 AND NOT-CHRNA4 AND NOT-NKG7 | 1 | 1 | 1 |
| FAP AND NOT-COL17A1 AND NOT-SNAP23 | 0.838095 | 0.862745 | 0.814815 | CLECL1 AND NOT-CHRNA4 AND NOT-TLR2 | 0.974359 | 0.95 | 1 |
| FAP AND NOT-NAALAD2 AND TMPRSS2 | 0.851485 | 0.914894 | 0.796296 | CLECL1 AND NOT-GUCY2D AND NOT-CYBB | 0.973684 | 0.973684 | 0.973684 |
| FAP AND NOT-ATP10B AND ICAM3 | 0.848485 | 0.933333 | 0.777778 | CLECL1 AND NOT-ATP1B4 AND NOT-CYBB | 0.974359 | 0.95 | 1 |
| FAP AND NOT-DPP6 AND NOT-AQP3 | 0.88 | 0.956522 | 0.814815 | CLECL1 AND NOT-KCNC2 AND NOT-BST1 | 0.973684 | 0.973684 | 0.973684 |
| FAP AND NOT-COL17A1 AND NOT-HHIP | 0.838095 | 0.862745 | 0.814815 | CLECL1 AND NOT-CHRNA4 AND NOT-TRAT1 | 1 | 1 | 1 |
| FAP AND NOT-COL17A1 AND RHCG | 0.846154 | 0.88 | 0.814815 | CLECL1 AND NOT-TREM2 AND NOT-STEAP4 | 0.974359 | 0.95 | 1 |
| FAP AND NOT-PPAP2A AND KCND2 | 0.88 | 0.956522 | 0.814815 | CLECL1 AND NOT-MAG AND NOT-RECK | 0.974359 | 0.95 | 1 |
| FAP AND NOT-IL22RA1 AND NOT-GYPC | 0.871287 | 0.93617 | 0.814815 | CLECL1 AND NOT-MAG AND NOT-DNAJC5 | 0.974359 | 0.95 | 1 |
| FAP AND NOT-IL22RA1 AND SEMA4D | 0.851064 | 1 | 0.740741 | CLECL1 AND NOT-TREM2 AND NOT-CXCL16 | 0.973684 | 0.973684 | 0.973684 |
| FAP AND NOT-COL17A1 AND NOT-GYPC | 0.854369 | 0.897959 | 0.814815 | CLECL1 AND NOT-KCNC2 AND MRGPRX4 | 0.973684 | 0.973684 | 0.973684 |
| FAP AND NOT-CDHR1 AND NOT-GYPC | 0.871287 | 0.93617 | 0.814815 | CLECL1 AND NOT-ABCG2 AND NOT-ZDHHC2 | 0.974359 | 0.95 | 1 |
| FAP AND NOT-IL22RA1 AND VAMP8 | 0.888889 | 0.977778 | 0.814815 | CLECL1 AND NOT-CHRNA4 AND NOT-SPN | 1 | 1 | 1 |
| FAP AND NOT-ATP10B AND NOT-GYPC | 0.851485 | 0.914894 | 0.796296 | CLECL1 AND NOT-CHRNA4 AND NOT-IL7R | 0.987013 | 0.974359 | 1 |
| FAP AND NOT-IL22RA1 AND NOT-PTPRR | 0.871287 | 0.93617 | 0.814815 | CLECL1 AND NOT-CHRNA4 AND NOT-KLRB1 | 1 | 1 | 1 |
| FAP AND NOT-AVPR1A AND KCND2 | 0.86 | 0.934783 | 0.796296 | CLECL1 AND NOT-CHRNA4 AND NOT-NPC1 | 0.973684 | 0.973684 | 0.973684 |
| FAP AND NOT-CDHR1 AND VAMP8 | 0.888889 | 0.977778 | 0.814815 | CLECL1 AND NOT-TNFSF10 AND NOT-GPR61 | 0.974359 | 0.95 | 1 |
| FAP AND NOT-SLC46A2 AND VAMP8 | 0.88 | 0.956522 | 0.814815 | CLECL1 AND NOT-SHH AND NOT-CD93 | 0.973684 | 0.973684 | 0.973684 |
| FAP AND NOT-SLC46A2 AND NOT-PTPRR | 0.862745 | 0.916667 | 0.814815 | CLECL1 AND NOT-CHRNA4 AND NOT-P2RY13 | 1 | 1 | 1 |
| FAP AND NOT-APCDD1 AND NOT-GYPC | 0.854369 | 0.897959 | 0.814815 | CLECL1 AND NOT-CHRNA4 AND NOT-CD86 | 0.972973 | 1 | 0.947368 |
| SDC1 AND NOT-DUOXA1 AND NOT-CDH17 | 0.810811 | 0.789474 | 0.833333 | CLECL1 AND NOT-CHRNA4 AND NOT-ACVR2A | 1 | 1 | 1 |
| FAP AND NOT-GJB3 AND NOT-GYPC | 0.854369 | 0.897959 | 0.814815 | CLECL1 AND NOT-CHRNA4 AND NOT-CD3G | 1 | 1 | 1 |
| FAP AND NOT-LY6D AND NOT-GYPC | 0.854369 | 0.897959 | 0.814815 | CLECL1 AND NOT-KCNH6 AND NOT-CD93 | 0.974359 | 0.95 | 1 |
| FAP AND NOT-DUOXA1 AND NOT-GYPC | 0.862745 | 0.916667 | 0.814815 | CLECL1 AND NOT-IL12RB2 AND NOT-BTN3A3 | 1 | 1 | 1 |
| FAP AND NOT-ESYT3 AND NOT-GYPC | 0.871287 | 0.93617 | 0.814815 | CLECL1 AND NOT-CHRNA4 AND NOT-C10orf54 | 0.973684 | 0.973684 | 0.973684 |
| FAP AND NOT-DUOXA1 AND NOT-PTPRR | 0.862745 | 0.916667 | 0.814815 | CLECL1 AND NOT-IL12RB2 AND NOT-CD36 | 0.986667 | 1 | 0.973684 |

FIG. 15 (cont.)

| Antigen Pair Logic | F1 | Precision | Recall | Antigen Pair Logic | F1 | Precision | Recall |
|---|---|---|---|---|---|---|---|
| FAP AND NOT-DUOXA1 AND VAMP8 | 0.88 | 0.956522 | 0.814815 | CLECL1 AND NOT-CHRNA4 AND NOT-C3AR1 | 1 | 1 | 1 |
| FAP AND NOT-IL22RA1 AND KCND2 | 0.871287 | 0.93617 | 0.814815 | CLECL1 AND NOT-CHRNA4 AND NOT-GOLM1 | 0.974359 | 0.95 | 1 |
| FAP AND NOT-COL17A1 AND NOT-GRM7 | 0.838095 | 0.862745 | 0.814815 | CLECL1 AND NOT-CHRNA4 AND NOT-PTGER2 | 1 | 1 | 1 |
| FAP AND NOT-IL20RB AND KCND2 | 0.86 | 0.934783 | 0.796296 | CLECL1 AND NOT-OR3A2 AND NOT-NKG7 | 0.972973 | 1 | 0.947368 |
| FAP AND OR51B2 AND NOT-GRM7 | 0.808511 | 0.95 | 0.703704 | CLECL1 AND NOT-MAG AND NOT-CYBB | 0.974359 | 0.95 | 1 |
| GPRC5A AND NOT-SSTR1 AND NOT-SLC39A2 | 0.849057 | 0.865385 | 0.833333 | CLECL1 AND NOT-IL12RB2 AND NOT-STEAP4 | 1 | 1 | 1 |
| FAP AND NOT-APCDD1 AND NOT-GRM7 | 0.838095 | 0.862745 | 0.814815 | CLECL1 AND NOT-ERVFRD-1 AND NOT-STEAP4 | 0.974359 | 0.95 | 1 |
| FAP AND NOT-SLC46A2 AND KCND2 | 0.871287 | 0.93617 | 0.814815 | CLECL1 AND NOT-CHRNA4 AND NOT-SELPLG | 1 | 1 | 1 |
| FAP AND NOT-DSC3 AND NOT-GRM7 | 0.86 | 0.934783 | 0.796296 | CLECL1 AND NOT-ERVFRD-1 AND NOT-CXCL16 | 0.973684 | 0.973684 | 0.973684 |
| FAP AND NOT-COL17A1 AND PIRT | 0.823529 | 0.875 | 0.777778 | CLECL1 AND NOT-OR3A2 AND NOT-TRAT1 | 0.972973 | 1 | 0.947368 |
| FAP AND NOT-COL17A1 AND KCND2 | 0.871287 | 0.93617 | 0.814815 | CLECL1 AND NOT-KCNC2 AND NOT-SLC24A4 | 0.973684 | 0.973684 | 0.973684 |
| FAP AND NOT-MLANA AND NOT-PAG1 | 0.834951 | 0.877551 | 0.796296 | CLECL1 AND NOT-KCNH6 AND NOT-CD93 | 0.974359 | 0.95 | 1 |
| FAP AND NOT-SCN9A AND NOT-GYPC | 0.862745 | 0.916667 | 0.814815 | CLECL1 AND NOT-GRID2 AND NOT-CYBB | 0.974359 | 0.95 | 1 |
| FAP AND NOT-P2RX1 AND CACNG1 | 0.808081 | 0.888889 | 0.740741 | CLECL1 AND NOT-KLRD1 AND NOT-GPR61 | 0.973684 | 0.973684 | 0.973684 |
| FAP AND NOT-APCDD1 AND KCND2 | 0.871287 | 0.93617 | 0.814815 | CLECL1 AND NOT-SLC9B1 AND NOT-TRPV2 | 0.974359 | 0.95 | 1 |
| FAP AND NOT-SGCA AND KCND2 | 0.888889 | 0.977778 | 0.814815 | CLECL1 AND NOT-KCNC2 AND NOT-TRAT1 | 0.986667 | 1 | 0.973684 |
| FAP AND NOT-ABCC9 AND KCND2 | 0.888889 | 0.977778 | 0.814815 | CLECL1 AND NOT-ATP1B4 AND NOT-PTGER2 | 0.987013 | 0.974359 | 1 |
| FAP AND NOT-GJB3 AND NOT-GRM7 | 0.838095 | 0.862745 | 0.814815 | CLECL1 AND NOT-KCNH6 AND NOT-CXCL16 | 0.973684 | 0.973684 | 0.973684 |
| FAP AND NOT-DUOXA1 AND CACNG1 | 0.862745 | 0.916667 | 0.814815 | COMPLEX-CLECL1/MLC1/KCNG2 | 0.973684 | 0.973684 | 0.973684 |
| FAP AND NOT-P2RX1 AND KCND2 | 0.824742 | 0.930233 | 0.740741 | CLECL1 AND NOT-KCNC2 AND NOT-CYBB | 0.973684 | 0.973684 | 0.973684 |
| FAP AND NOT-APCDD1 AND CACNG6 | 0.803922 | 0.854167 | 0.759259 | CLECL1 AND NOT-GRID2 AND NOT-PAG1 | 0.974359 | 0.95 | 1 |
| FAP AND NOT-KCNK7 AND KCND2 | 0.871287 | 0.93617 | 0.814815 | CLECL1 AND NOT-KCNG2 AND NOT-STEAP4 | 0.974359 | 0.95 | 1 |
| FAP AND NOT-LY6D AND NOT-GRM7 | 0.838095 | 0.862745 | 0.814815 | CLECL1 AND NOT-KCNG2 AND NOT-CXCL16 | 0.973684 | 0.973684 | 0.973684 |
| FAP AND NOT-DUOXA1 AND PIRT | 0.831683 | 0.893617 | 0.777778 | CLECL1 AND NOT-TREM2 AND NOT-CD93 | 0.974359 | 0.95 | 1 |
| FAP AND NOT-DUOXA1 AND KCND2 | 0.871287 | 0.93617 | 0.814815 | CLECL1 AND NOT-CHRNA4 AND NOT-BST1 | 1 | 1 | 1 |
| FAP AND NOT-S1PR5 AND NOT-PTPRR | 0.848485 | 0.933333 | 0.777778 | CLECL1 AND NOT-CHRNA4 AND NOT-SMPD1 | 0.987013 | 0.974359 | 1 |
| FAP AND NOT-COL17A1 AND SLC30A10 | 0.843137 | 0.895833 | 0.796296 | CLECL1 AND NOT-IL12RB2 AND TMEFF2 | 0.973684 | 0.973684 | 0.973684 |
| FAP AND NOT-AQP3 AND NOT-GYPC | 0.854369 | 0.897959 | 0.814815 | CLECL1 AND NOT-CHRNA4 AND NOT-TNFSF10 | 1 | 1 | 1 |
| FAP AND NOT-GJB3 AND KCND2 | 0.871287 | 0.93617 | 0.814815 | CLECL1 AND NOT-KCNG2 AND NOT-CD93 | 0.974359 | 0.95 | 1 |
| FAP AND NOT-ACVR2A AND CACNG1 | 0.843137 | 0.895833 | 0.796296 | CLECL1 AND NOT-KCNC2 AND NOT-NKG7 | 0.986667 | 1 | 0.973684 |
| FAP AND NOT-DUOXA1 AND NOT-CLDN19 | 0.846154 | 0.88 | 0.814815 | CLECL1 AND NOT-CHRNA4 AND NOT-CYBB | 1 | 1 | 1 |
| LRRC8E AND NOT-AQP3 AND NOT-SST | 0.811881 | 0.87234 | 0.759259 | CLECL1 AND NOT-CHRNA4 AND NOT-KLRF1 | 0.972973 | 1 | 0.947368 |
| FAP AND NOT-GJB3 AND NOT-GABRA4 | 0.846154 | 0.88 | 0.814815 | CLECL1 AND NOT-CHRNA4 AND NOT-IL10RB | 0.987013 | 0.974359 | 1 |
| FAP AND NOT-LY6D AND KCND2 | 0.871287 | 0.93617 | 0.814815 | CLECL1 AND NOT-GALR2 AND NOT-PAG1 | 0.974359 | 0.95 | 1 |
| FAP AND NOT-APCDD1 AND SLC30A10 | 0.843137 | 0.895833 | 0.796296 | CLECL1 AND NOT-CHRNA4 AND NOT-PILRA | 1 | 1 | 1 |
| FAP AND NOT-DUOXA1 AND CACNG6 | 0.811881 | 0.87234 | 0.759259 | CLECL1 AND NOT-MAG AND NOT-PAG1 | 0.974359 | 0.95 | 1 |
| FAP AND NOT-COL17A1 AND SPAM1 | 0.831683 | 0.893617 | 0.777778 | CLECL1 AND NOT-CHRNA4 AND NOT-CLEC7A | 1 | 1 | 1 |
| FAP AND NOT-DUOXA1 AND SLC13A2 | 0.823529 | 0.875 | 0.777778 | CLECL1 AND NOT-KCNC2 AND STRA6 | 0.973684 | 0.973684 | 0.973684 |
| FAP AND NOT-DUOXA1 AND SLC12A5 | 0.84 | 0.913043 | 0.777778 | CLECL1 AND NOT-CHRNA4 AND NOT-SMPD1 | 0.987013 | 0.974359 | 1 |
| FAP AND NOT-SLC46A2 AND SLC30A10 | 0.851485 | 0.914894 | 0.796296 | CLECL1 AND NOT-CHRNA4 AND NOT-BST1 | 1 | 1 | 1 |
| GPRC5A AND NOT-GPA33 AND NOT-SLC39A2 | 0.849057 | 0.865385 | 0.833333 | CLECL1 AND NOT-CHRNA4 AND NOT-TLR5 | 1 | 1 | 1 |
| COMPLEX-COL17A1/FAP/FXYD7 | 0.838095 | 0.862745 | 0.814815 | CLECL1 AND NOT-CHRNA4 AND NOT-TYROBP | 0.986667 | 1 | 0.973684 |
| FAP AND NOT-S1PR5 AND KCND2 | 0.86 | 0.934783 | 0.796296 | CLECL1 AND NOT-CHRNA4 AND NOT-SLAMF6 | 0.972973 | 1 | 0.947368 |
| FAP AND NOT-TENM1 AND KCND2 | 0.871287 | 0.93617 | 0.814815 | CLECL1 AND NOT-GALR2 AND NOT-RECK | 0.974359 | 0.95 | 1 |
| FAP AND NOT-SCN9A AND KCND2 | 0.871287 | 0.93617 | 0.814815 | MS4A1 AND PKD2L1 AND NOT-P2RY2 | 0.986667 | 1 | 0.973684 |
| FAP AND NOT-TNFRSF19 AND KCND2 | 0.871287 | 0.93617 | 0.814815 | MS4A1 AND PKD2L1 AND NOT-PTGDR2 | 0.986667 | 1 | 0.973684 |
| FAP AND NOT-DUOXA1 AND OR1C1 | 0.816327 | 0.909091 | 0.740741 | MS4A1 AND PKD2L1 AND NOT-TGOLN2 | 0.986667 | 1 | 0.973684 |
| FAP AND NOT-CADM3 AND KCND2 | 0.871287 | 0.93617 | 0.814815 | MS4A1 AND GDE1 AND NOT-PTGDR2 | 0.986667 | 1 | 0.973684 |
| FAP AND NOT-DUOXA1 AND SPAM1 | 0.84 | 0.913043 | 0.777778 | MS4A1 AND STRA6 AND NOT-TGOLN2 | 0.974359 | 0.95 | 1 |
| COMPLEX-FAP/SLC5A2/DUOXA1 | 0.846154 | 0.88 | 0.814815 | MS4A1 AND STRA6 AND NOT-P2RY2 | 0.974359 | 0.95 | 1 |
| FAP AND NOT-CAV2 AND NOT-SST | 0.828283 | 0.911111 | 0.759259 | MS4A1 AND STRA6 AND NOT-PTGDR2 | 0.974359 | 0.95 | 1 |
| FAP AND NOT-IL22RA1 AND NOT-NCAM1 | 0.886598 | 1 | 0.796296 | MS4A1 AND STRA6 AND NOT-PTGDR2 | 0.974359 | 0.95 | 1 |
| SDC1 AND NOT-AQP3 AND NOT-SSTR1 | 0.849057 | 0.865385 | 0.833333 | MS4A1 AND STRA6 AND NOT-TGOLN2 | 0.974359 | 0.95 | 1 |
| FAP AND NOT-COL17A1 AND NOT-NCAM1 | 0.868687 | 0.955556 | 0.796296 | MS4A1 AND STRA6 AND NOT-P2RY2 | 0.974359 | 0.95 | 1 |
| FAP AND NOT-CAV2 AND NOT-GPA33 | 0.828283 | 0.911111 | 0.759259 | MS4A1 AND PIGR AND NOT-PSEN1 | 0.973684 | 0.973684 | 0.973684 |
| FAP AND NOT-APCDD1 AND NOT-NCAM1 | 0.868687 | 0.955556 | 0.796296 | MS4A1 AND STRA6 AND NOT-SLC46A2 | 0.973684 | 0.973684 | 0.973684 |
| FAP AND NOT-DUOXA1 AND NOT-NCAM1 | 0.877551 | 0.977273 | 0.796296 | MS4A1 AND MARVELD2 AND NOT-SLC46A2 | 0.973684 | 0.973684 | 0.973684 |
| FAP AND NOT-GJB3 AND NOT-NCAM1 | 0.868687 | 0.955556 | 0.796296 | MS4A1 AND STRA6 AND NOT-IL12RB2 | 0.973684 | 0.973684 | 0.973684 |
| FAP AND NOT-LY6D AND NOT-NCAM1 | 0.868687 | 0.955556 | 0.796296 | MS4A1 AND STRA6 AND NOT-IL12RB2 | 0.973684 | 0.973684 | 0.973684 |
| FAP AND NOT-PMEL AND NOT-GPBAR1 | 0.843137 | 0.895833 | 0.796296 | MS4A1 AND PIGR AND NOT-PTGDR2 | 0.973684 | 0.973684 | 0.973684 |
| FAP AND NOT-NAALAD2 AND NOT-ABCA5 | 0.831683 | 0.893617 | 0.777778 | MS4A1 AND STRA6 AND NOT-FPR2 | 0.973684 | 0.973684 | 0.973684 |
| FAP AND NOT-APCDD1 AND NOT-SSTR1 | 0.838095 | 0.862745 | 0.814815 | MS4A1 AND PKD2L1 AND NOT-IL12RB2 | 0.972973 | 1 | 0.947368 |
| FAP AND NOT-PMEL AND NOT-C15orf27 | 0.826923 | 0.86 | 0.796296 | CLECL1 AND NOT-IL12RB2 AND NOT-CD33 | 0.987013 | 0.974359 | 1 |
| FAP AND NOT-SLC46A2 AND NOT-ABCA5 | 0.823529 | 0.875 | 0.777778 | CLECL1 AND NOT-CLDN2 AND NOT-PTGER2 | 0.987013 | 0.974359 | 1 |
| FAP AND NOT-TNFRSF19 AND NOT-NCAM1 | 0.868687 | 0.955556 | 0.796296 | CLECL1 AND NOT-SLC24A4 AND NOT-DDX3X | 0.974359 | 0.95 | 1 |
| MUC1 AND NOT-SSTR1 AND NOT-AQP3 | 0.803419 | 0.746032 | 0.87037 | CLECL1 AND NOT-DNAJB8 AND NOT-BST1 | 0.974359 | 0.95 | 1 |
| FAP AND NOT-APCDD1 AND NOT-GPA33 | 0.838095 | 0.862745 | 0.814815 | CLECL1 AND NOT-DNAJB8 AND NOT-RECK | 0.974359 | 0.95 | 1 |
| FAP AND NOT-COL17A1 AND CD52 | 0.838095 | 0.862745 | 0.814815 | CLECL1 AND NOT-CLDN2 AND NOT-DNAJC5 | 0.974359 | 0.95 | 1 |
| FAP AND NOT-LY6D AND SLAMF7 | 0.838095 | 0.862745 | 0.814815 | CLECL1 AND NOT-IL12RB2 AND NOT-HSPA5 | 0.972973 | 1 | 0.947368 |
| FAP AND NOT-GJB3 AND SLAMF7 | 0.838095 | 0.862745 | 0.814815 | CLECL1 AND NOT-CLDN2 AND NOT-RECK | 0.974359 | 0.95 | 1 |
| FAP AND NOT-P2RX1 AND NOT-NCAM1 | 0.833333 | 0.952381 | 0.740741 | MS4A1 AND PIGR AND NOT-SERINC3 | 0.973684 | 0.973684 | 0.973684 |
| FAP AND NOT-ATP10B AND CD52 | 0.834951 | 0.877551 | 0.796296 | MS4A1 AND MARVELD2 AND NOT-PTGDR2 | 0.974359 | 0.95 | 1 |
| FAP AND NOT-DSC3 AND NOT-SSTR1 | 0.843137 | 0.895833 | 0.796296 | CLECL1 AND NOT-CLDN2 AND NOT-PAG1 | 0.974359 | 0.95 | 1 |
| FAP AND NOT-DUOXA1 AND NOT-SSTR1 | 0.846154 | 0.88 | 0.814815 | CLECL1 AND NOT-DNAJB8 AND NOT-LILR82 | 0.974359 | 0.95 | 1 |
| FAP AND NOT-PTPRZ1 AND NOT-SSTR1 | 0.838095 | 0.862745 | 0.814815 | COMPLEX-CLECL1/ITGB3/LNPEP | 0.987013 | 0.974359 | 1 |
| FAP AND NOT-DUOXA1 AND NOT-ABCA5 | 0.823529 | 0.875 | 0.777778 | CLECL1 AND NOT-DNAJB8 AND NOT-CD28 | 0.987013 | 0.974359 | 1 |
| MUC1 AND NOT-AQP3 AND NOT-SST | 0.817391 | 0.770492 | 0.87037 | CLECL1 AND NOT-ATP1A4 AND NOT-CD160 | 0.974359 | 0.95 | 1 |

FIG. 15 (cont.)

| Antigen Pair Logic | F1 | Precision | Recall | Antigen Pair Logic | F1 | Precision | Recall |
|---|---|---|---|---|---|---|---|
| FAP AND NOT-DUOXA1 AND CD52 | 0.846154 | 0.88 | 0.814815 | CLECL1 AND NOT-DNAJB8 AND NOT-NKG7 | 0.987013 | 0.974359 | 1 |
| FAP AND NOT-GJB3 AND CD52 | 0.838095 | 0.862745 | 0.814815 | CLECL1 AND NOT-CLDN2 AND NOT-CYBB | 0.974359 | 0.95 | 1 |
| FAP AND NOT-LY6D AND CD52 | 0.838095 | 0.862745 | 0.814815 | CLECL1 AND NOT-DNAJB8 AND NOT-TNFSF10 | 0.974359 | 0.95 | 1 |
| FAP AND NOT-LY6D AND NOT-SSTR1 | 0.846154 | 0.88 | 0.814815 | CLECL1 AND NOT-DNAJB8 AND NOT-CD226 | 0.974359 | 0.95 | 1 |
| FAP AND NOT-CADM3 AND NOT-ABCA5 | 0.831683 | 0.893617 | 0.777778 | CLECL1 AND NOT-KCNG2 AND NOT-CD33 | 0.974359 | 0.95 | 1 |
| FAP AND NOT-EPHB6 AND CD52 | 0.826923 | 0.86 | 0.796296 | CLECL1 AND NOT-CLDN2 AND NOT-CYBB | 0.974359 | 0.95 | 1 |
| FAP AND NOT-ABCA5 AND NOT-IL1RL1 | 0.831683 | 0.893617 | 0.777778 | CLECL1 AND NOT-ERVFRD-1 AND NOT-CD160 | 0.974359 | 0.95 | 1 |
| FAP AND NOT-COL17A1 AND SLAMF7 | 0.8 | 0.926829 | 0.703704 | COMPLEX-CLECL1/KCNG2/ITGB3 | 0.987013 | 0.974359 | 1 |
| FAP AND NOT-TNFRSF19 AND NOT-SSTR1 | 0.854369 | 0.897959 | 0.814815 | CLECL1 AND NOT-SSTR1 AND NOT-DNAJC5 | 0.974359 | 0.95 | 1 |
| FAP AND NOT-ABCA5 AND KCNS1 | 0.815534 | 0.857143 | 0.777778 | CLECL1 AND NOT-KCNH6 AND NOT-CD160 | 0.974359 | 0.95 | 1 |
| FAP AND NOT-ABCA5 AND NOT-CYSLTR2 | 0.815534 | 0.857143 | 0.777778 | MS4A1 AND STRA6 AND NOT-PTPRA | 0.974359 | 0.95 | 1 |
| SDC1 AND NOT-AQP3 AND NOT-GPA33 | 0.849057 | 0.865385 | 0.833333 | CLECL1 AND NOT-IL12RB2 AND NOT-ALDH1A1 | 0.974359 | 0.95 | 1 |
| FAP AND NOT-AQP3 AND NOT-SSTR1 | 0.846154 | 0.88 | 0.814815 | CLECL1 AND NOT-DNAJB8 AND NOT-TRAT1 | 0.987013 | 0.974359 | 1 |
| FAP AND NOT-AQP3 AND CD52 | 0.838095 | 0.862745 | 0.814815 | CLECL1 AND NOT-DNAJB8 AND NOT-SELPLG | 0.974359 | 0.95 | 1 |
| FAP AND NOT-FNDC5 AND NOT-DDX3X | 0.871287 | 0.93617 | 0.814815 | CLECL1 AND NOT-IL12RB2 AND NOT-CD160 | 1 | 1 | 1 |
| MUC1 AND NOT-MUC4 AND NOT-DPP6 | 0.814159 | 0.779661 | 0.851852 | COMPLEX-CLECL1/IFNGR1/ITGB3 | 0.974359 | 0.95 | 1 |
| FAP AND NOT-CHIC2 AND NOT-GPA33 | 0.84 | 0.913043 | 0.777778 | CLECL1 AND NOT-CLDN2 AND NOT-RECK | 0.974359 | 0.95 | 1 |
| SDC1 AND NOT-AQP3 AND NOT-SST | 0.833333 | 0.833333 | 0.833333 | CLECL1 AND NOT-DNAJB8 AND NOT-SLC24A4 | 0.974359 | 0.95 | 1 |
| FAP AND MEP1A AND NOT-GPA33 | 0.851485 | 0.914894 | 0.796296 | COMPLEX-ADAM8/CLECL1/ITGB3 | 0.974359 | 0.95 | 1 |
| PPAPDC1A AND NOT-OMG AND NOT-IL22RA1 | 0.808511 | 0.95 | 0.703704 | CLECL1 AND NOT-DNAJB8 AND NOT-CYBB | 0.974359 | 0.95 | 1 |
| FAP AND NOT-PMEL AND KCND2 | 0.871287 | 0.93617 | 0.814815 | CLECL1 AND NOT-ALDH1A1 AND NOT-TGFBR1 | 0.974359 | 0.95 | 1 |
| FAP AND NOT-ABCA5 AND NOT-GYPC | 0.831683 | 0.893617 | 0.777778 | MS4A1 AND MARVELD2 AND NOT-PTGDR2 | 0.974359 | 0.95 | 1 |
| COMPLEX-FAP/SLC30A10/PMEL | 0.838095 | 0.862745 | 0.814815 | CLECL1 AND NOT-SSTR1 AND NOT-PAG1 | 0.974359 | 0.95 | 1 |
| FAP AND NOT-CDH22 AND CD52 | 0.815534 | 0.857143 | 0.777778 | CLECL1 AND NOT-ABCG2 AND NOT-HSPA5 | 0.973684 | 0.973684 | 0.973684 |
| COMPLEX-FAP/ABCA5/GABRG2 | 0.815534 | 0.857143 | 0.777778 | CLECL1 AND NOT-TREM2 AND NOT-CD160 | 0.974359 | 0.95 | 1 |
| FAP AND NOT-GUCY2C AND KCND2 | 0.88 | 0.956522 | 0.814815 | CLECL1 AND NOT-KCNG2 AND NOT-CD160 | 0.974359 | 0.95 | 1 |
| FAP AND NOT-SSTR1 AND KCND2 | 0.871287 | 0.93617 | 0.814815 | MS4A1 AND MARVELD2 AND NOT-TGOLN2 | 0.974359 | 0.95 | 1 |
| FAP AND NOT-DDX3X AND GLRA2 | 0.838095 | 0.862745 | 0.814815 | MS4A1 AND PIGR AND NOT-M6PR | 0.973684 | 0.973684 | 0.973684 |
| FAP AND KCND2 AND NOT-CLDN18 | 0.871287 | 0.93617 | 0.814815 | CLECL1 AND NOT-ITGB3 AND NOT-TRPV2 | 1 | 1 | 1 |
| FAP AND KCND2 AND NOT-SST | 0.871287 | 0.93617 | 0.814815 | CLECL1 AND NOT-ITGB3 AND TSPAN15 | 0.987013 | 0.974359 | 1 |
| FAP AND SLC10A1 AND NOT-CLDN18 | 0.838095 | 0.862745 | 0.814815 | CLECL1 AND NOT-ITGB3 AND SLC25A3 | 0.987013 | 0.974359 | 1 |
| FAP AND KCND2 AND NOT-GPA33 | 0.868687 | 0.955556 | 0.796296 | CLECL1 AND NOT-ITGB3 AND MRGPRX4 | 1 | 1 | 1 |
| FAP AND GLRA2 AND NOT-TNFRSF13C | 0.838095 | 0.862745 | 0.814815 | MS4A1 AND MARVELD2 AND NOT-FPR2 | 0.973684 | 0.973684 | 0.973684 |
| COMPLEX-FAP/ZACN/CEACAM6 | 0.838095 | 0.862745 | 0.814815 | MS4A1 AND STRA6 AND NOT-ACPP | 0.974359 | 0.95 | 1 |
| FAP AND NOT-SLC39A2 AND NOT-GYPC | 0.862745 | 0.916667 | 0.814815 | CLECL1 AND NOT-ITGB3 AND PPAP2A | 0.973684 | 0.973684 | 0.973684 |
| FAP AND NOT-MLANA AND NOT-PTPRR | 0.862745 | 0.916667 | 0.814815 | CLECL1 AND NOT-PSCA AND NOT-TRPV2 | 0.974359 | 0.95 | 1 |
| FAP AND NOT-SLC39A2 AND KCND2 | 0.871287 | 0.93617 | 0.814815 | CLECL1 AND NOT-ITGB3 AND STRA6 | 1 | 1 | 1 |
| FAP AND NOT-CDH22 AND KCND2 | 0.848485 | 0.933333 | 0.777778 | CLECL1 AND NOT-ITGB3 AND NOT-IL12RB2 | 0.987013 | 0.974359 | 1 |
| FAP AND NOT-CDH22 AND GLRA2 | 0.815534 | 0.857143 | 0.777778 | CLECL1 AND NOT-ITGB3 AND NOT-GPR1 | 0.987013 | 0.974359 | 1 |
| FAP AND ADAM29 AND NOT-PIK3IP1 | 0.838095 | 0.862745 | 0.814815 | MS4A1 AND STRA6 AND NOT-FAM26E | 0.973684 | 0.973684 | 0.973684 |
| FAP AND NOT-GABRA4 AND KCND2 | 0.871287 | 0.93617 | 0.814815 | CLECL1 AND NOT-ITGB3 AND NOT-KCNH6 | 0.987013 | 0.974359 | 1 |
| FAP AND NOT-GYPC AND NOT-KCNA1 | 0.851485 | 0.914894 | 0.796296 | CLECL1 AND NOT-ITGB3 AND PPAP2A | 0.973684 | 0.973684 | 0.973684 |
| FAP AND NOT-PIK3IP1 AND GLRA2 | 0.838095 | 0.862745 | 0.814815 | CLECL1 AND NOT-ITGB3 AND NOT-ERVFRD-1 | 0.973684 | 0.973684 | 0.973684 |
| FAP AND SLC10A1 AND NOT-SLC13A5 | 0.838095 | 0.862745 | 0.814815 | CLECL1 AND NOT-ITGB3 AND HTR7 | 0.973684 | 0.973684 | 0.973684 |
| FAP AND NOT-GPR22 AND NOT-PIK3IP1 | 0.862745 | 0.916667 | 0.814815 | MS4A1 AND MARVELD2 AND NOT-P2RY2 | 0.962025 | 0.926829 | 1 |
| FAP AND NOT-HCN1 AND NOT-PIK3IP1 | 0.838095 | 0.862745 | 0.814815 | MS4A1 AND NOT-MS4A2 AND MARVELD2 | 0.962025 | 0.926829 | 1 |
| FAP AND KCND2 AND NOT-TMEFF2 | 0.871287 | 0.93617 | 0.814815 | CLECL1 AND NOT-ATP1A4 AND NOT-CD33 | 0.962025 | 0.926829 | 1 |
| FAP AND KCND2 AND NOT-CALN1 | 0.871287 | 0.93617 | 0.814815 | CLECL1 AND NOT-IL12RB2 AND TNFRSF13C | 0.962025 | 0.926829 | 1 |
| FAP AND KCND2 AND NOT-SLC13A5 | 0.871287 | 0.93617 | 0.814815 | CLECL1 AND NOT-DNAJB8 AND NOT-CD300LF | 0.962025 | 0.926829 | 1 |
| FAP AND KCND2 AND NOT-HCN1 | 0.871287 | 0.93617 | 0.814815 | MS4A1 AND MRGPRX4 AND NOT-P2RY2 | 0.962025 | 0.926829 | 1 |
| FAP AND KCND2 AND NOT-OPCML | 0.871287 | 0.93617 | 0.814815 | MS4A1 AND STRA6 AND NOT-KCNG2 | 0.962025 | 0.926829 | 1 |
| FAP AND KCND2 AND NOT-MPL | 0.871287 | 0.93617 | 0.814815 | CLECL1 AND NOT-DNAJB8 AND NOT-MGST2 | 0.962025 | 0.926829 | 1 |
| FAP AND NOT-CLDN16 AND GLRA2 | 0.815534 | 0.857143 | 0.777778 | CLECL1 AND NOT-MST1R AND NOT-DNAJC5 | 0.962025 | 0.926829 | 1 |
| FAP AND KCND2 AND NOT-BEST2 | 0.871287 | 0.93617 | 0.814815 | CLECL1 AND NOT-CLDN2 AND NOT-IL10RB | 0.962025 | 0.926829 | 1 |
| FAP AND KCND2 AND CACNG3 | 0.8 | 0.926829 | 0.703704 | MS4A1 AND MRGPRX4 AND NOT-P2RY2 | 0.962025 | 0.926829 | 1 |
| FAP AND KCND2 AND JPH3 | 0.8 | 0.926829 | 0.703704 | CLECL1 AND NOT-KCNG2 AND NOT-ALDH1A1 | 0.962025 | 0.926829 | 1 |
| FAP AND KCND2 AND NOT-CACNA1E | 0.871287 | 0.93617 | 0.814815 | CLECL1 AND NOT-ERVFRD-1 AND NOT-CD33 | 0.962025 | 0.926829 | 1 |
| FAP AND NOT-PIK3IP1 AND NOT-FXYD7 | 0.846154 | 0.88 | 0.814815 | MS4A1 AND MARVELD2 AND NOT-P2RY2 | 0.962025 | 0.926829 | 1 |
| FAP AND KCND2 AND NOT-HTR1E | 0.868687 | 0.955556 | 0.796296 | CLECL1 AND NOT-MST1R AND NOT-TRPV2 | 0.962025 | 0.926829 | 1 |
| FAP AND KCND2 AND NOT-FSHR | 0.888889 | 0.977778 | 0.814815 | MS4A1 AND STRA6 AND NOT-MS4A2 | 0.962025 | 0.926829 | 1 |
| FAP AND KCND2 AND NOT-GLRA2 | 0.871287 | 0.93617 | 0.814815 | CLECL1 AND NOT-ABCG2 AND NOT-CD33 | 0.962025 | 0.926829 | 1 |
| FAP AND KCND2 AND NOT-AGER | 0.871287 | 0.93617 | 0.814815 | CLECL1 AND NOT-KCNH6 AND NOT-CD33 | 0.962025 | 0.926829 | 1 |
| FAP AND GLRA2 AND SLC13A2 | 0.815534 | 0.857143 | 0.777778 | CLECL1 AND NOT-MST1R AND NOT-TRPV2 | 0.962025 | 0.926829 | 1 |
| FAP AND GLRA2 AND NOT-AMHR2 | 0.826923 | 0.86 | 0.796296 | CLECL1 AND NOT-DNAJB8 AND NOT-SMPD1 | 0.962025 | 0.926829 | 1 |
| FAP AND GLRA2 AND NOT-BEST2 | 0.838095 | 0.862745 | 0.814815 | CLECL1 AND NOT-DNAJB8 AND NOT-LRRC8D | 0.962025 | 0.926829 | 1 |
| FAP AND GLRA2 AND NOT-HTR1E | 0.834951 | 0.877551 | 0.796296 | CLECL1 AND NOT-DLL3 AND NOT-TRPV2 | 0.962025 | 0.926829 | 1 |
| FAP AND GLRA2 AND NOT-FSHR | 0.854369 | 0.897959 | 0.814815 | CLECL1 AND NOT-TREM2 AND NOT-CD33 | 0.962025 | 0.926829 | 1 |
| COMPLEX-FAP/SLC24A2/KCND2 | 0.871287 | 0.93617 | 0.814815 | CLECL1 AND NOT-CHRNA4 AND NOT-STEAP4 | 1 | 1 | 1 |
| COMPLEX-FAP/SLC24A2/GLRA2 | 0.838095 | 0.862745 | 0.814815 | CLECL1 AND NOT-CHRNA4 AND NOT-CD93 | 1 | 1 | 1 |
| COMPLEX-FAP/GLRA2/KIRREL3 | 0.838095 | 0.862745 | 0.814815 | CLECL1 AND NOT-CHRNA4 AND NOT-CXCL16 | 0.986667 | 1 | 0.973684 |
| COMPLEX-AGER/FAP/GLRA2 | 0.838095 | 0.862745 | 0.814815 | CLECL1 AND NOT-CHRNA4 AND NOT-CD36 | 0.986667 | 1 | 0.973684 |
| PPAPDC1A AND CD52 AND NOT-OR1Q1 | 0.808511 | 0.95 | 0.703704 | CLECL1 AND NOT-CHRNA4 AND NOT-CD93 | 1 | 1 | 1 |
| EPCAM AND NOT-VSIG2 AND NOT-DPP6 | 0.815534 | 0.857143 | 0.777778 | CLECL1 AND NOT-CHRNA4 AND NOT-CD163 | 0.987013 | 0.974359 | 1 |
| EPCAM AND NOT-CA4 AND NOT-AQP3 | 0.807692 | 0.84 | 0.777778 | CLECL1 AND NOT-KCNC2 AND NOT-CD93 | 0.973684 | 0.973684 | 0.973684 |
| EPCAM AND NOT-ATP10B AND ICAM3 | 0.826087 | 1 | 0.703704 | CLECL1 AND NOT-GPR78 AND NOT-CD93 | 0.986667 | 1 | 0.973684 |
| FAP AND NOT-TYR AND NOT-PAG1 | 0.826923 | 0.86 | 0.796296 | CLECL1 AND NOT-MEGF11 AND NOT-CD93 | 0.974359 | 0.95 | 1 |
| FAP AND NOT-TYR AND NOT-PDGFRA | 0.831683 | 0.893617 | 0.777778 | CLECL1 AND NOT-KCNK4 AND NOT-CD93 | 0.987013 | 0.974359 | 1 |

FIG. 15 (cont.)

| Antigen Pair Logic | F1 | Precision | Recall | Antigen Pair Logic | F1 | Precision | Recall |
|---|---|---|---|---|---|---|---|
| EPCAM AND NOT-MUC4 AND NOT-DPP6 | 0.807692 | 0.84 | 0.777778 | CLECL1 AND NOT-GPR78 AND NOT-PAQR8 | 0.986667 | 1 | 0.973684 |
| GPRC5A AND NOT-GPA33 AND NOT-TYR | 0.810811 | 0.789474 | 0.833333 | CLECL1 AND NOT-MEGF11 AND NOT-PAQR8 | 0.962025 | 0.926829 | 1 |
| FAP AND NOT-CLDN1 AND NOT-ABCA5 | 0.828283 | 0.911111 | 0.759259 | CLECL1 AND NOT-GRID2 AND NOT-STEAP4 | 0.974359 | 0.95 | 1 |
| FAP AND NOT-ABCA5 AND NOT-SSTR1 | 0.815534 | 0.857143 | 0.777778 | CLECL1 AND NOT-MAG AND NOT-CD93 | 0.974359 | 0.95 | 1 |
| EPCAM AND NOT-BEST2 AND KCND2 | 0.803922 | 0.854167 | 0.759259 | CLECL1 AND NOT-MAG AND NOT-PAQR8 | 0.962025 | 0.926829 | 1 |
| EPCAM AND NOT-NOX1 AND KCND2 | 0.803922 | 0.854167 | 0.759259 | CLECL1 AND NOT-GALR2 AND NOT-STEAP4 | 0.974359 | 0.95 | 1 |
| EPCAM AND NOT-GRM7 AND KCND2 | 0.824742 | 0.930233 | 0.740741 | CLECL1 AND NOT-ATP1B4 AND NOT-CXCL16 | 0.973684 | 0.973684 | 0.973684 |
| LRRC8E AND NOT-TYR AND KCND2 | 0.813187 | 1 | 0.685185 | CLECL1 AND NOT-GUCY2D AND NOT-CD93 | 0.973684 | 0.973684 | 0.973684 |
| TGFBI AND NOT-TYR AND KCND2 | 0.815534 | 0.857143 | 0.777778 | CLECL1 AND NOT-CHRNA4 AND NOT-EBP | 0.972973 | 1 | 0.947368 |
| BST2 AND KCND2 AND NOT-TYR | 0.804124 | 0.906977 | 0.722222 | CLECL1 AND NOT-GALR2 AND NOT-DYSF | 0.962025 | 0.926829 | 1 |
| ATP8B1 AND NOT-TYR AND KCND2 | 0.824742 | 0.930233 | 0.740741 | CLECL1 AND NOT-GALR2 AND NOT-CD93 | 0.974359 | 0.95 | 1 |
| FAP AND NOT-TYR AND KCND2 | 0.871287 | 0.93617 | 0.814815 | CLECL1 AND NOT-ATP1B4 AND NOT-CD93 | 0.974359 | 0.95 | 1 |
| FAP AND NOT-TYR AND SLC30A10 | 0.843137 | 0.895833 | 0.796296 | CLECL1 AND NOT-GALR2 AND NOT-CD163 | 0.962025 | 0.926829 | 1 |
| EPCAM AND NOT-SST AND KCND2 | 0.803738 | 0.811321 | 0.796296 | CLECL1 AND NOT-CHRNA4 AND NOT-PAQR7 | 0.986667 | 1 | 0.973684 |
| SDC1 AND NOT-TYR AND KCND2 | 0.857143 | 0.954545 | 0.777778 | CLECL1 AND NOT-ATP1B4 AND NOT-PAQR8 | 0.974359 | 0.95 | 1 |
| MUC1 AND NOT-TYR AND KCND2 | 0.851064 | 1 | 0.740741 | CLECL1 AND NOT-GRID2 AND NOT-CXCL16 | 0.973684 | 0.973684 | 0.973684 |
| CLDN4 AND NOT-TYR AND KCND2 | 0.826087 | 1 | 0.703704 | CLECL1 AND NOT-GRID2 AND NOT-CD163 | 0.962025 | 0.926829 | 1 |
| Liver Cancer | | | | CLECL1 AND NOT-GALR2 AND NOT-DYSF | 0.962025 | 0.926829 | 1 |
| ABCG5 AND NOT-MUC17 AND HM13 | 1 | 1 | 1 | CLECL1 AND NOT-GALR2 AND NOT-CD93 | 0.974359 | 0.95 | 1 |
| ABCG5 AND NOT-MUC17 AND HM13 | 1 | 1 | 1 | CLECL1 AND NOT-MAG AND NOT-PAQR8 | 0.962025 | 0.926829 | 1 |
| SLCO1B1 AND NOT-MARCO AND AGER | 1 | 1 | 1 | CLECL1 AND NOT-MAG AND NOT-STEAP4 | 0.974359 | 0.95 | 1 |
| SLCO1B1 AND NOT-MARCO AND SLC5A2 | 1 | 1 | 1 | CLECL1 AND NOT-MAG AND NOT-CXCL16 | 0.973684 | 0.973684 | 0.973684 |
| SLCO1B1 AND NOT-MARCO AND DSCAM | 1 | 1 | 1 | CLECL1 AND NOT-GPR37L1 AND NOT-ZDHHC2 | 0.987013 | 0.974359 | 1 |
| SLCO1B1 AND NOT-MARCO AND CSPG5 | 1 | 1 | 1 | CLECL1 AND NOT-GALR2 AND NOT-CXCL16 | 0.973684 | 0.973684 | 0.973684 |
| SLCO1B1 AND NOT-MARCO AND NPFFR1 | 1 | 1 | 1 | CLECL1 AND NOT-GUCY2D AND NOT-PAQR8 | 0.973684 | 0.973684 | 0.973684 |
| SLCO1B1 AND NOT-MARCO AND ZACN | 1 | 1 | 1 | CLECL1 AND NOT-GALR2 AND NOT-PAQR8 | 0.974359 | 0.95 | 1 |
| SLCO1B1 AND NOT-MARCO AND FLVCR1 | 1 | 1 | 1 | CLECL1 AND NOT-GRID2 AND NOT-CD93 | 0.974359 | 0.95 | 1 |
| SLCO1B1 AND NOT-MARCO AND FAT1 | 1 | 1 | 1 | CLECL1 AND NOT-GALR2 AND NOT-PAQR8 | 0.974359 | 0.95 | 1 |
| SLCO1B1 AND NOT-MARCO AND ALCAM | 1 | 1 | 1 | CLECL1 AND NOT-MAG AND NOT-CD93 | 0.974359 | 0.95 | 1 |
| SLCO1B1 AND NOT-MARCO AND MIP | 1 | 1 | 1 | CLECL1 AND NOT-ATP1B4 AND NOT-CD36 | 0.961039 | 0.948718 | 0.973684 |
| SLCO1B1 AND NOT-MARCO AND PTGIR | 1 | 1 | 1 | CLECL1 AND NOT-MAG AND NOT-CD36 | 0.961039 | 0.948718 | 0.973684 |
| ABCG5 AND FGFRL1 AND NOT-SCARA5 | 1 | 1 | 1 | CLECL1 AND NOT-LPPR3 AND NOT-CD93 | 0.961039 | 0.948718 | 0.973684 |
| ABCG5 AND HM13 AND NOT-CDH17 | 1 | 1 | 1 | CLECL1 AND NOT-CD36 AND NOT-GPR61 | 0.961039 | 0.948718 | 0.973684 |
| ABCG5 AND HM13 AND NOT-SLC13A2 | 1 | 1 | 1 | CLECL1 AND NOT-GRID2 AND NOT-CD36 | 0.961039 | 0.948718 | 0.973684 |
| ABCG5 AND HM13 AND NOT-SLC16A5 | 1 | 1 | 1 | CLECL1 AND NOT-CRB2 AND NOT-CD93 | 0.961039 | 0.948718 | 0.973684 |
| ABCG5 AND FLVCR1 AND NOT-MEP1B | 1 | 1 | 1 | CLECL1 AND NOT-CALHM3 AND NOT-FMNL1 | 0.961039 | 0.948718 | 0.973684 |
| ABCG5 AND HM13 AND NOT-SLC16A5 | 1 | 1 | 1 | CLECL1 AND NOT-GALR2 AND NOT-CD36 | 0.961039 | 0.948718 | 0.973684 |
| ABCG5 AND HM13 AND NOT-CDH17 | 1 | 1 | 1 | CLECL1 AND NOT-CHRNA4 AND NOT-ACSL6 | 1 | 1 | 1 |
| ABCG5 AND FLVCR1 AND NOT-MEP1B | 1 | 1 | 1 | CLECL1 AND NOT-CD207 AND NOT-CD93 | 0.974359 | 0.95 | 1 |
| ABCG5 AND HM13 AND NOT-PTPRR | 1 | 1 | 1 | CLECL1 AND NOT-GGTLC1 AND NOT-CD93 | 0.961039 | 0.948718 | 0.973684 |
| ABCG5 AND HM13 AND NOT-SLC13A2 | 1 | 1 | 1 | CLECL1 AND NOT-CHRNA4 AND NOT-PAQR8 | 0.987013 | 0.974359 | 1 |
| ABCG5 AND HM13 AND NOT-FUT3 | 1 | 1 | 1 | CLECL1 AND NOT-TRPM3 AND NOT-CD93 | 0.961039 | 0.948718 | 0.973684 |
| ABCG5 AND HM13 AND NOT-PTPRR | 1 | 1 | 1 | CLECL1 AND NOT-CHRNA4 AND NOT-PAQR8 | 0.987013 | 0.974359 | 1 |
| ABCG5 AND FGFRL1 AND NOT-SLC31A1 | 1 | 1 | 1 | CLECL1 AND NOT-SLC22A6 AND NOT-CD93 | 0.961039 | 0.948718 | 0.973684 |
| SLC43A1 AND RGR AND NOT-CLEC4G | 1 | 1 | 1 | CLECL1 AND NOT-SLC22A13 AND NOT-CD93 | 0.961039 | 0.948718 | 0.973684 |
| SLC43A1 AND FLVCR1 AND NOT-LRRC8B | 1 | 1 | 1 | CLECL1 AND NOT-GABRD AND NOT-CD93 | 0.986667 | 1 | 0.973684 |
| SLCO1B1 AND NOT-MARCO AND CD58 | 1 | 1 | 1 | CLECL1 AND NOT-GABRA4 AND NOT-CD93 | 0.974359 | 0.95 | 1 |
| SLCO1B1 AND NOT-MARCO AND DYSF | 1 | 1 | 1 | CLECL1 AND NOT-CD207 AND NOT-PAQR8 | 0.962025 | 0.926829 | 1 |
| ABCG5 AND FGFRL1 AND NOT-GPR83 | 1 | 1 | 1 | CLECL1 AND NOT-GABRD AND NOT-PAQR8 | 0.973684 | 0.973684 | 0.973684 |
| ABCG5 AND FGFRL1 AND NOT-MUC17 | 1 | 1 | 1 | CLECL1 AND NOT-GRM4 AND NOT-CD93 | 0.974359 | 0.95 | 1 |
| ABCG5 AND FGFRL1 AND NOT-MUC17 | 1 | 1 | 1 | CLECL1 AND NOT-CLDN16 AND NOT-CD93 | 1 | 1 | 1 |
| SLC43A1 AND NOT-GPR22 AND SLC26A6 | 1 | 1 | 1 | CLECL1 AND NOT-AJAP1 AND NOT-CD93 | 0.973684 | 0.973684 | 0.973684 |
| SLCO1B1 AND NOT-MARCO AND P2RX4 | 1 | 1 | 1 | CLECL1 AND NOT-CLDN16 AND NOT-PAQR8 | 0.987013 | 0.974359 | 1 |
| SLC43A1 AND RGR AND NOT-MARCO | 1 | 1 | 1 | CLECL1 AND NOT-AJAP1 AND NOT-PAQR8 | 0.961039 | 0.948718 | 0.973684 |
| SLCO1B1 AND SLC7A11 AND NOT-MUC17 | 1 | 1 | 1 | CLECL1 AND NOT-CALY AND NOT-PAQR8 | 0.96 | 0.972973 | 0.947368 |
| ABCG5 AND FGFRL1 AND NOT-IL15RA | 1 | 1 | 1 | CLECL1 AND NOT-OR3A2 AND NOT-PAQR8 | 0.96 | 0.972973 | 0.947368 |
| SLCO1B1 AND HM13 AND NOT-OR2C3 | 1 | 1 | 1 | COMPLEX-SLC9B1/CLECL1/MLC1 | 0.96 | 0.972973 | 0.947368 |
| ABCG5 AND NOT-MARCO AND DYSF | 1 | 1 | 1 | CLECL1 AND NOT-CALY AND NOT-CD93 | 0.96 | 0.972973 | 0.947368 |
| SLCO1B1 AND HM13 AND NOT-TRHR | 1 | 1 | 1 | CLECL1 AND NOT-SLC5A8 AND NOT-CD93 | 0.96 | 0.972973 | 0.947368 |
| SLCO1B1 AND HM13 AND NOT-GABRA5 | 1 | 1 | 1 | CLECL1 AND NOT-OR3A2 AND NOT-CD93 | 0.96 | 0.972973 | 0.947368 |
| SLCO1B1 AND NOT-MARCO AND CHRNB2 | 1 | 1 | 1 | CLECL1 AND NOT-CHRNA4 AND NOT-IFNAR2 | 0.958904 | 1 | 0.921053 |
| SLCO1B1 AND HM13 AND NOT-SLC31A1 | 1 | 1 | 1 | CLECL1 AND NOT-GALR2 AND NOT-PAQR7 | 0.961039 | 0.948718 | 0.973684 |
| SLCO1B1 AND HM13 AND NOT-MUC17 | 1 | 1 | 1 | CLECL1 AND NOT-GPR61 AND NOT-CD93 | 0.974359 | 0.95 | 1 |
| SLCO1B1 AND SLC7A11 AND NOT-MUC17 | 1 | 1 | 1 | CLECL1 AND NOT-CD36 AND NOT-HTR2C | 0.961039 | 0.948718 | 0.973684 |
| SLCO1B1 AND HM13 AND NOT-MUC17 | 1 | 1 | 1 | CLECL1 AND NOT-CD36 AND NOT-GPR37L1 | 0.961039 | 0.948718 | 0.973684 |
| SLCO1B1 AND HM13 AND NOT-SLC17A2 | 1 | 1 | 1 | CLECL1 AND NOT-CD36 AND NOT-GABRB1 | 0.961039 | 0.948718 | 0.973684 |
| SLCO1B1 AND SLC7A11 AND NOT-SLC17A2 | 1 | 1 | 1 | CLECL1 AND NOT-CD36 AND NOT-SLC9B1 | 0.961039 | 0.948718 | 0.973684 |
| SLC43A1 AND RGR AND NOT-MARCO | 1 | 1 | 1 | CLECL1 AND NOT-GALR2 AND OR1Q1 | 0.962025 | 0.926829 | 1 |
| SLCO1B1 AND NOT-MARCO AND SLC30A1 | 1 | 1 | 1 | CLECL1 AND NOT-CHRNA4 AND NOT-BTN3A3 | 1 | 1 | 1 |
| COMPLEX-P2RY4/SLC2A2/SLC4A2 | 1 | 1 | 1 | CLECL1 AND NOT-MAG AND NOT-PAQR7 | 0.961039 | 0.948718 | 0.973684 |
| SLC2A2 AND SLC26A6 AND C8B | 1 | 1 | 1 | CLECL1 AND NOT-CD36 AND NOT-SLC13A1 | 0.961039 | 0.948718 | 0.973684 |
| SLC2A2 AND SLC26A6 AND SLC6A12 | 1 | 1 | 1 | CLECL1 AND NOT-SLC9B1 AND NOT-SLC31A1 | 0.974359 | 0.95 | 1 |
| SLC2A2 AND SLC26A6 AND NOT-PAQR8 | 1 | 1 | 1 | CLECL1 AND NOT-CALHM3 AND NOT-CD93 | 0.973684 | 0.973684 | 0.973684 |
| SLCO1B1 AND NOT-MARCO AND CALY | 1 | 1 | 1 | CLECL1 AND NOT-CD36 AND NOT-KCNK16 | 0.961039 | 0.948718 | 0.973684 |
| SLC2A2 AND SLC26A6 AND DYSF | 1 | 1 | 1 | CLECL1 AND NOT-CD36 AND NOT-NPHS2 | 0.961039 | 0.948718 | 0.973684 |
| SLCO1B1 AND NOT-MARCO AND TNFRSF12A | 1 | 1 | 1 | CLECL1 AND NOT-CD36 AND NOT-GABRG2 | 0.961039 | 0.948718 | 0.973684 |
| SLC2A2 AND SLC26A6 AND S1PR1 | 1 | 1 | 1 | CLECL1 AND NOT-CD36 AND NOT-GABRG1 | 0.961039 | 0.948718 | 0.973684 |

FIG. 15 (cont.)

| Antigen Pair Logic | F1 | Precision | Recall | Antigen Pair Logic | F1 | Precision | Recall |
|---|---|---|---|---|---|---|---|
| SLCO1B1 AND TLCD1 AND NOT-SLC17A2 | 1 | 1 | 1 | CLECL1 AND NOT-CD36 AND NOT-OR8B2 | 0.961039 | 0.948718 | 0.973684 |
| SLCO1B1 AND NOT-KCNN2 AND CLDN15 | 1 | 1 | 1 | CLECL1 AND NOT-CHRNA4 AND NOT-SLC12A9 | 0.986667 | 1 | 0.973684 |
| SLCO1B1 AND NOT-KCNN2 AND SEZ6 | 1 | 1 | 1 | CLECL1 AND NOT-CHRNA4 AND TMEFF2 | 0.973684 | 0.973684 | 0.973684 |
| SLC2A2 AND SLC26A6 AND NOT-SLC13A2 | 1 | 1 | 1 | CLECL1 AND NOT-CD36 AND NOT-LRRC52 | 0.973684 | 0.973684 | 0.973684 |
| SLC2A2 AND SLC26A6 AND ENPP1 | 1 | 1 | 1 | CLECL1 AND NOT-CD36 AND NOT-GABRA5 | 0.961039 | 0.948718 | 0.973684 |
| SLC2A2 AND SLC26A6 AND PHLDB2 | 1 | 1 | 1 | CLECL1 AND NOT-CD36 AND NOT-ATP13A5 | 0.961039 | 0.948718 | 0.973684 |
| SLC2A2 AND SLC26A6 AND SLC13A5 | 1 | 1 | 1 | CLECL1 AND NOT-CD36 AND NOT-GABRA3 | 0.961039 | 0.948718 | 0.973684 |
| SLC2A2 AND SLC26A6 AND NOT-FUT3 | 1 | 1 | 1 | CLECL1 AND NOT-CD36 AND NOT-GRM6 | 0.961039 | 0.948718 | 0.973684 |
| SLC2A2 AND SLC26A6 AND DIO1 | 1 | 1 | 1 | CLECL1 AND NOT-CD36 AND NOT-SLC39A12 | 0.961039 | 0.948718 | 0.973684 |
| SLC2A2 AND SLC26A6 AND SLC23A2 | 1 | 1 | 1 | CLECL1 AND NOT-CD36 AND LAPTM5 | 0.961039 | 0.948718 | 0.973684 |
| SLCO1B1 AND SMPD2 AND NOT-IL2RG | 1 | 1 | 1 | CLECL1 AND NOT-GRID2 AND NOT-PAQR7 | 0.961039 | 0.948718 | 0.973684 |
| SLCO1B1 AND SMPD2 AND NOT-FCGR3B | 1 | 1 | 1 | CLECL1 AND NOT-CD36 AND NOT-GABRA2 | 0.961039 | 0.948718 | 0.973684 |
| ABCG5 AND FGFRL1 AND NOT-EPHA2 | 1 | 1 | 1 | MS4A1 AND SLC22A18 AND NOT-SLC46A2 | 0.973684 | 0.973684 | 0.973684 |
| SLC2A2 AND SLC26A6 AND NOT-CD58 | 1 | 1 | 1 | CLECL1 AND NOT-CHRNA4 AND NOT-CD33 | 0.987013 | 0.974359 | 1 |
| SLC2A2 AND SLC26A6 AND SLC43A1 | 1 | 1 | 1 | MS4A1 AND SLC22A18 AND NOT-PTGDR2 | 0.974359 | 0.95 | 1 |
| SLC2A2 AND SLC26A6 AND NOT-ATP8A1 | 1 | 1 | 1 | CLECL1 AND NOT-CHRNA4 AND NOT-ALDH1A1 | 0.974359 | 0.95 | 1 |
| SLC2A2 AND SLC26A6 AND NOT-MUC12 | 1 | 1 | 1 | CLECL1 AND NOT-CHRNA4 AND NOT-CD160 | 1 | 1 | 1 |
| SLC2A2 AND SLC26A6 AND NOT-MUC17 | 1 | 1 | 1 | CLECL1 AND NOT-DNAJB8 AND NOT-CD93 | 0.974359 | 0.95 | 1 |
| SLCO1B1 AND SMPD2 AND NOT-NGFR | 1 | 1 | 1 | MS4A1 AND SLC22A18 AND NOT-PTGDR2 | 0.974359 | 0.95 | 1 |
| SLC2A2 AND SLC26A6 AND NOT-SLC16A5 | 1 | 1 | 1 | MS4A1 AND SLC22A18 AND NOT-FPR2 | 0.973684 | 0.973684 | 0.973684 |
| SLCO1B1 AND NOT-KCNN2 AND PCDHB1 | 1 | 1 | 1 | CLECL1 AND NOT-ITGB3 AND SEMA4D | 0.987013 | 0.974359 | 1 |
| SLCO1B1 AND FGFRL1 AND NOT-SCARA5 | 1 | 1 | 1 | MS4A1 AND HCN2 AND NOT-P2RY2 | 0.962025 | 0.926829 | 1 |
| SLC2A2 AND SLC26A6 AND NOT-CD82 | 1 | 1 | 1 | MS4A1 AND MARVELD2 AND NOT-ANPEP | 0.962025 | 0.926829 | 1 |
| SLC2A2 AND SLC26A6 AND SLC22A9 | 1 | 1 | 1 | CLECL1 AND NOT-DNAJB8 AND NOT-PAQR8 | 0.962025 | 0.926829 | 1 |
| SLC2A2 AND SLC26A6 AND SLC17A3 | 1 | 1 | 1 | MS4A1 AND STRA6 AND NOT-ANPEP | 0.962025 | 0.926829 | 1 |
| SLCO1B1 AND NOT-KCNN2 AND SLCO1A2 | 1 | 1 | 1 | MS4A1 AND ADCY10 AND NOT-SLC46A2 | 0.986667 | 1 | 0.973684 |
| SLCO1B1 AND NOT-MARCO AND ABCG4 | 1 | 1 | 1 | CLECL1 AND NOT-MAG AND NOT-CD160 | 0.974359 | 0.95 | 1 |
| SLCO1B1 AND HM13 AND NOT-CD163 | 1 | 1 | 1 | CLECL1 AND NOT-GRID2 AND NOT-CD33 | 0.962025 | 0.926829 | 1 |
| SLC2A2 AND SLC26A6 AND NOT-SLC5A11 | 1 | 1 | 1 | CLECL1 AND NOT-CLDN2 AND NOT-CD93 | 0.974359 | 0.95 | 1 |
| SLC2A2 AND SLC26A6 AND CLDN14 | 1 | 1 | 1 | CLECL1 AND NOT-CLDN2 AND NOT-STEAP4 | 0.974359 | 0.95 | 1 |
| SLCO1B1 AND SMPD2 AND NOT-CXCR2 | 1 | 1 | 1 | CLECL1 AND NOT-ATP1B4 AND NOT-CD160 | 0.974359 | 0.95 | 1 |
| SLCO1B1 AND SMPD2 AND NOT-GPR171 | 1 | 1 | 1 | CLECL1 AND NOT-CLDN2 AND NOT-CXCL16 | 0.973684 | 0.973684 | 0.973684 |
| SLCO1B1 AND SMPD2 AND NOT-LYVE1 | 1 | 1 | 1 | CLECL1 AND NOT-GALR2 AND NOT-CD33 | 0.974359 | 0.95 | 1 |
| SLCO1B1 AND TLCD1 AND NOT-SLC17A2 | 1 | 1 | 1 | CLECL1 AND NOT-CHRNA4 AND TNFRSF13C | 0.962025 | 0.926829 | 1 |
| SLCO1B1 AND NOT-MARCO AND HTR5A | 1 | 1 | 1 | CLECL1 AND NOT-CLDN2 AND NOT-CD93 | 0.974359 | 0.95 | 1 |
| SLC2A2 AND SLC26A6 AND NOT-CDH17 | 1 | 1 | 1 | CLECL1 AND NOT-CHRNA4 AND NOT-HSPA5 | 0.972973 | 1 | 0.947368 |
| SLC2A2 AND SLC26A6 AND NOT-MUC17 | 1 | 1 | 1 | CLECL1 AND NOT-GRID2 AND NOT-CD160 | 0.974359 | 0.95 | 1 |
| SLC2A2 AND SLC26A6 AND NOT-LCT | 1 | 1 | 1 | MS4A1 AND ADCY10 AND NOT-P2RY2 | 0.987013 | 0.974359 | 1 |
| SLC2A2 AND SLC26A6 AND NOT-SLC9A1 | 1 | 1 | 1 | CLECL1 AND NOT-ATP1B4 AND NOT-CD33 | 0.962025 | 0.926829 | 1 |
| SLC2A2 AND SLC26A6 AND NOT-SLC10A2 | 1 | 1 | 1 | CLECL1 AND NOT-MAG AND NOT-CD33 | 0.962025 | 0.926829 | 1 |
| SLC2A2 AND SLC26A6 AND NOT-PTPRR | 1 | 1 | 1 | CLECL1 AND NOT-GALR2 AND NOT-CD160 | 0.974359 | 0.95 | 1 |
| SLCO1B1 AND HM13 AND NOT-KCNN2 | 1 | 1 | 1 | CLECL1 AND NOT-CLDN2 AND NOT-PAQR8 | 0.962025 | 0.926829 | 1 |
| SLCO1B1 AND NOT-MARCO AND DST | 1 | 1 | 1 | CLECL1 AND NOT-GALR2 AND NOT-ALDH1A1 | 0.962025 | 0.926829 | 1 |
| SLCO1B1 AND NOT-MARCO AND PVRL2 | 1 | 1 | 1 | CLECL1 AND NOT-CLDN2 AND NOT-CD36 | 0.961039 | 0.948718 | 0.973684 |
| SLCO1B1 AND NOT-MARCO AND DAGLB | 1 | 1 | 1 | MS4A1 AND SLC22A18 AND NOT-ASGR1 | 0.961039 | 0.948718 | 0.973684 |
| SLCO1B1 AND NOT-MARCO AND NCSTN | 1 | 1 | 1 | MS4A1 AND STRA6 AND NOT-CD36 | 0.961039 | 0.948718 | 0.973684 |
| SLC43A1 AND NOT-ENTPD3 AND SLC26A6 | 1 | 1 | 1 | MS4A1 AND SLC22A18 AND NOT-SLC16A10 | 0.961039 | 0.948718 | 0.973684 |
| ABCG5 AND FGFRL1 AND NOT-MARCO | 1 | 1 | 1 | MS4A1 AND HCN2 AND NOT-IL12RB2 | 0.961039 | 0.948718 | 0.973684 |
| ABCG5 AND FGFRL1 AND NOT-CLEC4M | 1 | 1 | 1 | MS4A1 AND JPH3 AND NOT-P2RY2 | 0.961039 | 0.948718 | 0.973684 |
| SLCO1B1 AND NOT-MARCO AND FAIM2 | 1 | 1 | 1 | MS4A1 AND SLC22A18 AND NOT-PTPRA | 0.961039 | 0.948718 | 0.973684 |
| SLCO1B1 AND NOT-MARCO AND RHOT2 | 1 | 1 | 1 | CLECL1 AND NOT-SST AND NOT-CD93 | 0.974359 | 0.95 | 1 |
| SLC43A1 AND NOT-PARM1 AND SLC26A6 | 1 | 1 | 1 | CLECL1 AND NOT-SSTR5 AND NOT-CD93 | 0.974359 | 0.95 | 1 |
| ABCG5 AND FGFRL1 AND NOT-FNDC4 | 1 | 1 | 1 | MS4A1 AND JPH3 AND NOT-PTGDR2 | 0.961039 | 0.948718 | 0.973684 |
| SLCO1B1 AND NOT-MARCO AND HM13 | 1 | 1 | 1 | MS4A1 AND HCN2 AND NOT-PTGDR2 | 0.974359 | 0.95 | 1 |
| SLCO1B1 AND NOT-MARCO AND ATP9B | 1 | 1 | 1 | MS4A1 AND JPH3 AND NOT-TGOLN2 | 0.961039 | 0.948718 | 0.973684 |
| SLCO1B1 AND NOT-MARCO AND SLC26A11 | 1 | 1 | 1 | MS4A1 AND NOT-MS4A2 AND HRH3 | 0.962025 | 0.926829 | 1 |
| SLC43A1 AND NOT-SLC4A3 AND SLC26A6 | 1 | 1 | 1 | MS4A1 AND NOT-MS4A2 AND ADCY10 | 0.974359 | 0.95 | 1 |
| SLCO1B1 AND NOT-MARCO AND ANO10 | 1 | 1 | 1 | COMPLEX-CLECL1/ITGB3/LRRC52 | 0.987013 | 0.974359 | 1 |
| SLCO1B1 AND NOT-MARCO AND CLPTM1 | 1 | 1 | 1 | CLECL1 AND NOT-SSTR5 AND NOT-PAQR8 | 0.962025 | 0.926829 | 1 |
| SLCO1B1 AND NOT-MARCO AND MERTK | 1 | 1 | 1 | CLECL1 AND NOT-SST AND NOT-PAQR8 | 0.962025 | 0.926829 | 1 |
| SLCO1B1 AND NOT-MARCO AND BSG | 1 | 1 | 1 | COMPLEX-CLECL1/GABRA2/ITGB3 | 0.987013 | 0.974359 | 1 |
| SLCO1B1 AND NOT-MARCO AND HM13 | 1 | 1 | 1 | MS4A1 AND STRA6 AND NOT-SLC28A1 | 0.962025 | 0.926829 | 1 |
| SLCO1B1 AND NOT-MARCO AND SLC10A3 | 1 | 1 | 1 | CLECL1 AND NOT-ALK AND NOT-CD93 | 0.974359 | 0.95 | 1 |
| SLCO1B1 AND NOT-MARCO AND STX6 | 1 | 1 | 1 | COMPLEX-CLECL1/OR8B2/ITGB3 | 0.987013 | 0.974359 | 1 |
| SLCO1B1 AND NOT-MARCO AND ORAI1 | 1 | 1 | 1 | COMPLEX-CLECL1/ITGB3/LAPTM5 | 0.987013 | 0.974359 | 1 |
| SLCO1B1 AND NOT-MARCO AND ADAM15 | 1 | 1 | 1 | MS4A1 AND HCN2 AND NOT-TGOLN2 | 0.962025 | 0.926829 | 1 |
| SLCO1B1 AND NOT-MARCO AND CHRNA6 | 1 | 1 | 1 | COMPLEX-CLECL1/ABHD3/ITGB3 | 0.987013 | 0.974359 | 1 |
| SLCO1B1 AND NOT-MARCO AND RYK | 1 | 1 | 1 | CLECL1 AND NOT-ULBP3 AND NOT-CD93 | 0.961039 | 0.948718 | 0.973684 |
| ABCG5 AND FGFRL1 AND NOT-PRIMA1 | 1 | 1 | 1 | COMPLEX-CLECL1/MPL/MST1R | 0.962025 | 0.926829 | 1 |
| ABCG5 AND FGFRL1 AND NOT-CLEC4G | 1 | 1 | 1 | MS4A1 AND SLC22A18 AND NOT-S1PR5 | 0.961039 | 0.948718 | 0.973684 |
| SLCO1B1 AND NOT-MARCO AND ADIPOR1 | 1 | 1 | 1 | MS4A1 AND STRA6 AND NOT-MPL | 0.974359 | 0.95 | 1 |
| SLCO1B1 AND NOT-MARCO AND ASPH | 1 | 1 | 1 | CLECL1 AND NOT-MAG AND NOT-HSPA5 | 0.96 | 0.972973 | 0.947368 |
| SLCO1B1 AND NOT-MARCO AND CD46 | 1 | 1 | 1 | CLECL1 AND NOT-ITGB3 AND GALR2 | 0.96 | 0.972973 | 0.947368 |
| SLCO1B1 AND NOT-MARCO AND SLC38A6 | 1 | 1 | 1 | MS4A1 AND JPH3 AND NOT-IL12RB2 | 0.96 | 0.972973 | 0.947368 |
| SLCO1B1 AND NOT-MARCO AND CSF1 | 1 | 1 | 1 | CLECL1 AND NOT-GALR2 AND NOT-HSPA5 | 0.96 | 0.972973 | 0.947368 |
| SLCO1B1 AND HM13 AND NOT-ADRA1B | 1 | 1 | 1 | CLECL1 AND NOT-ATP1B4 AND NOT-HSPA5 | 0.96 | 0.972973 | 0.947368 |
| SLCO1B1 AND NOT-MARCO AND OR51M1 | 1 | 1 | 1 | MS4A1 AND STRA6 AND NOT-PTGER4 | 0.974359 | 0.95 | 1 |

FIG. 15 (cont.)

| Antigen Pair Logic | F1 | Precision | Recall |
|---|---|---|---|
| ABCG5 AND FGFRL1 AND NOT-PLP1 | 1 | 1 | 1 |
| SLCO1B1 AND NOT-MARCO AND RHOT2 | 1 | 1 | 1 |
| SLCO1B1 AND NOT-MARCO AND CSF1 | 1 | 1 | 1 |
| SLCO1B1 AND NOT-MARCO AND PTPRA | 1 | 1 | 1 |
| SLCO1B1 AND NOT-MARCO AND ATP13A1 | 1 | 1 | 1 |
| ABCG5 AND NOTCH4 AND NOT-MARCO | 1 | 1 | 1 |
| SLCO1B1 AND NOT-MARCO AND SYNDIG1 | 1 | 1 | 1 |
| SLCO1B1 AND NOT-MARCO AND CLPTM1 | 1 | 1 | 1 |
| ABCG5 AND FGFRL1 AND NOT-PLP1 | 1 | 1 | 1 |
| SLCO1B1 AND NOT-MARCO AND ABHD12 | 1 | 1 | 1 |
| SLCO1B1 AND HM13 AND NOT-KCNN2 | 1 | 1 | 1 |
| SLCO1B1 AND NOT-MARCO AND ATP13A1 | 1 | 1 | 1 |
| ABCG5 AND NOTCH4 AND NOT-MARCO | 1 | 1 | 1 |
| SLC43A1 AND NOT-KIAA1324 AND SLC26A6 | 1 | 1 | 1 |
| SLCO1B1 AND NOT-MARCO AND ITGAX | 1 | 1 | 1 |
| SLCO1B1 AND NOT-MARCO AND SLC41A3 | 1 | 1 | 1 |
| SLCO1B1 AND NOT-MARCO AND CD151 | 1 | 1 | 1 |
| SLCO1B1 AND NOT-MARCO AND ORAI1 | 1 | 1 | 1 |
| SLCO1B1 AND NOT-MARCO AND FAM73A | 1 | 1 | 1 |
| SLCO1B1 AND NOT-MARCO AND OR51M1 | 1 | 1 | 1 |
| ABCG5 AND FGFRL1 AND NOT-CLEC1B | 1 | 1 | 1 |
| SLCO1B1 AND NOT-MARCO AND ABCC1 | 1 | 1 | 1 |
| ABCG5 AND FGFRL1 AND NOT-MARCO | 1 | 1 | 1 |
| ABCG5 AND FGFRL1 AND NOT-PRIMA1 | 1 | 1 | 1 |
| SLCO1B1 AND NOT-MARCO AND ABCC1 | 1 | 1 | 1 |
| ABCG5 AND HM13 AND NOT-SLC5A1 | 1 | 1 | 1 |
| ABCG5 AND HM13 AND NOT-SPINT1 | 1 | 1 | 1 |
| ABCG5 AND HM13 AND NOT-TNFRSF11A | 1 | 1 | 1 |
| ABCG5 AND HM13 AND NOT-ADTRP | 1 | 1 | 1 |
| ABCG5 AND HM13 AND NOT-SLC28A2 | 1 | 1 | 1 |
| ABCG5 AND HM13 AND NOT-SLC6A19 | 1 | 1 | 1 |
| ABCG5 AND HM13 AND NOT-UGT8 | 1 | 1 | 1 |
| ABCG5 AND HM13 AND NOT-ADTRP | 1 | 1 | 1 |
| ABCG5 AND HM13 AND NOT-ATP2C2 | 1 | 1 | 1 |
| ABCG5 AND HM13 AND NOT-SLC5A1 | 1 | 1 | 1 |
| ABCG5 AND HM13 AND NOT-SLC6A20 | 1 | 1 | 1 |
| ABCG5 AND HM13 AND NOT-TNFRSF11A | 1 | 1 | 1 |
| ABCG5 AND HM13 AND NOT-KCNJ3 | 1 | 1 | 1 |
| ABCG5 AND HM13 AND NOT-HEPH | 1 | 1 | 1 |
| ABCG5 AND HM13 AND NOT-GPRC5A | 1 | 1 | 1 |
| ABCG5 AND HM13 AND NOT-TSPAN1 | 1 | 1 | 1 |
| ABCG5 AND HM13 AND NOT-SI | 1 | 1 | 1 |
| ABCG5 AND HM13 AND NOT-SLC26A3 | 1 | 1 | 1 |
| ABCG5 AND HM13 AND NOT-B3GNT3 | 1 | 1 | 1 |
| ABCG5 AND HM13 AND NOT-KCNJ3 | 1 | 1 | 1 |
| ABCG5 AND HM13 AND NOT-GPR160 | 1 | 1 | 1 |
| ABCG5 AND HM13 AND NOT-KIAA1324 | 1 | 1 | 1 |
| ABCG5 AND HM13 AND NOT-GDPD2 | 1 | 1 | 1 |
| ABCG5 AND HM13 AND NOT-HEPH | 1 | 1 | 1 |
| ABCG5 AND HM13 AND NOT-ATP10B | 1 | 1 | 1 |
| ABCG5 AND HM13 AND NOT-SLC28A2 | 1 | 1 | 1 |
| ABCG5 AND HM13 AND NOT-KIAA1324 | 1 | 1 | 1 |
| ABCG5 AND HM13 AND NOT-MGAM | 1 | 1 | 1 |
| ABCG5 AND HM13 AND NOT-ACE | 1 | 1 | 1 |
| ABCG5 AND HM13 AND NOT-SPINT1 | 1 | 1 | 1 |
| ABCG5 AND HM13 AND NOT-TSPAN1 | 1 | 1 | 1 |
| ABCG5 AND HM13 AND NOT-MGAM | 1 | 1 | 1 |
| ABCG5 AND HM13 AND NOT-SLC6A20 | 1 | 1 | 1 |
| ABCG5 AND HM13 AND NOT-SLC6A19 | 1 | 1 | 1 |
| ABCG5 AND HM13 AND NOT-GPR35 | 1 | 1 | 1 |
| ABCG5 AND HM13 AND NOT-KCNQ1 | 1 | 1 | 1 |
| ABCG5 AND HM13 AND NOT-MEP1B | 1 | 1 | 1 |
| ABCG5 AND HM13 AND NOT-ATP10B | 1 | 1 | 1 |
| SLCO1B1 AND NOT-MARCO AND CLDN8 | 1 | 1 | 1 |
| ABCG5 AND HM13 AND NOT-SST | 1 | 1 | 1 |
| ABCG5 AND HM13 AND NOT-DPEP1 | 1 | 1 | 1 |
| ABCG5 AND HM13 AND NOT-GPA33 | 1 | 1 | 1 |
| ABCG5 AND HM13 AND NOT-GUCY2C | 1 | 1 | 1 |
| ABCG5 AND HM13 AND NOT-GPA33 | 1 | 1 | 1 |
| ABCG5 AND HM13 AND NOT-HHLA2 | 1 | 1 | 1 |
| ABCG5 AND HM13 AND NOT-CEACAM5 | 1 | 1 | 1 |
| ABCG5 AND HM13 AND NOT-GUCY2C | 1 | 1 | 1 |
| ABCG5 AND HM13 AND NOT-MST1R | 1 | 1 | 1 |
| ABCG5 AND HM13 AND NOT-MST1R | 1 | 1 | 1 |
| ABCG5 AND HM13 AND NOT-CEACAM6 | 1 | 1 | 1 |
| SLCO1B1 AND HM13 AND NOT-CLDN5 | 1 | 1 | 1 |
| SLC43A1 AND NOT-IL20RA AND SLC26A6 | 1 | 1 | 1 |

| Antigen Pair Logic | F1 | Precision | Recall |
|---|---|---|---|
| MS4A1 AND MARVELD2 AND NOT-PTGER4 | 0.974359 | 0.95 | 1 |
| MS4A1 AND SLC22A18 AND NOT-ACPP | 0.961039 | 0.948718 | 0.973684 |
| MS4A1 AND SLC22A18 AND NOT-PSEN1 | 0.974359 | 0.95 | 1 |
| CLECL1 AND NOT-SSTR1 AND NOT-CXCL16 | 0.973684 | 0.973684 | 0.973684 |
| CLECL1 AND NOT-GPR61 AND NOT-CD160 | 0.974359 | 0.95 | 1 |
| MS4A1 AND NOT-TRPV2 AND ADCY10 | 0.962025 | 0.926829 | 1 |
| MS4A1 AND ADCY10 AND NOT-SLC16A10 | 0.973684 | 0.973684 | 0.973684 |
| MS4A1 AND NOT-TGOLN2 AND ADCY10 | 0.987013 | 0.974359 | 1 |
| MS4A1 AND MARVELD2 AND NOT-CD36 | 0.961039 | 0.948718 | 0.973684 |
| MS4A1 AND SLC22A18 AND NOT-DHRS3 | 0.961039 | 0.948718 | 0.973684 |
| MS4A1 AND ADCY10 AND NOT-PTGDR2 | 0.987013 | 0.974359 | 1 |
| CLECL1 AND NOT-MST1R AND NOT-CD163 | 0.974359 | 0.95 | 1 |
| MS4A1 AND ADCY10 AND NOT-CD300C | 0.973684 | 0.973684 | 0.973684 |
| CLECL1 AND NOT-GPR61 AND NOT-CD33 | 0.962025 | 0.926829 | 1 |
| CLECL1 AND NOT-GALR2 AND TNFRSF13C | 0.974359 | 0.95 | 1 |
| MS4A1 AND SLC22A18 AND NOT-PAG1 | 0.974359 | 0.95 | 1 |
| MS4A1 AND ADCY10 AND NOT-IL12RB2 | 0.987013 | 0.974359 | 1 |
| CLECL1 AND NOT-SSTR1 AND NOT-STEAP4 | 0.974359 | 0.95 | 1 |
| MS4A1 AND SLC22A18 AND NOT-PTGER2 | 0.961039 | 0.948718 | 0.973684 |
| MS4A1 AND SLC22A18 AND NOT-PSEN1 | 0.974359 | 0.95 | 1 |
| CLECL1 AND NOT-MAG AND TNFRSF13C | 0.962025 | 0.926829 | 1 |
| MS4A1 AND NOT-TGOLN2 AND ADCY10 | 0.987013 | 0.974359 | 1 |
| CLECL1 AND NOT-GRID2 AND TNFRSF13C | 0.962025 | 0.926829 | 1 |
| MS4A1 AND ADCY10 AND NOT-HM13 | 0.962025 | 0.926829 | 1 |
| MS4A1 AND ADCY10 AND NOT-ASGR1 | 0.973684 | 0.973684 | 0.973684 |
| CLECL1 AND NOT-SSTR1 AND NOT-CD93 | 0.974359 | 0.95 | 1 |
| MS4A1 AND SLC30A8 AND NOT-IL12RB2 | 0.962025 | 0.926829 | 1 |
| CLECL1 AND NOT-CLDN2 AND NOT-BTN3A3 | 0.974359 | 0.95 | 1 |
| CLECL1 AND NOT-CD36 AND NOT-TPBG | 0.961039 | 0.948718 | 0.973684 |
| MS4A1 AND SLC30A8 AND NOT-SLC46A2 | 0.961039 | 0.948718 | 0.973684 |
| CLECL1 AND NOT-SSTR1 AND NOT-PAQR8 | 0.962025 | 0.926829 | 1 |
| CLECL1 AND NOT-CLDN2 AND NOT-PAQR7 | 0.961039 | 0.948718 | 0.973684 |
| CLECL1 AND NOT-SSTR1 AND NOT-PAQR8 | 0.962025 | 0.926829 | 1 |
| CD19 AND CLECL1 AND NOT-SLC2A5 | 0.914286 | 1 | 0.842105 |
| COMPLEX-CLECL1/SLC22A3/CD19 | 0.914286 | 1 | 0.842105 |
| CD19 AND CLECL1 AND NOT-TAS2R5 | 0.914286 | 1 | 0.842105 |
| CD19 AND CLECL1 AND NOT-CTNS | 0.914286 | 1 | 0.842105 |
| CD19 AND CLECL1 AND NOT-LNPEP | 0.914286 | 1 | 0.842105 |
| COMPLEX-CLECL1/EQTN/CD19 | 0.914286 | 1 | 0.842105 |
| CD19 AND CLECL1 AND NOT-SLC16A3 | 0.914286 | 1 | 0.842105 |
| COMPLEX-CLECL1/SLCO2A1/CD19 | 0.914286 | 1 | 0.842105 |
| CD19 AND CLECL1 AND NOT-TGFBR2 | 0.914286 | 1 | 0.842105 |
| COMPLEX-SLC26A7/CLECL1/CD19 | 0.914286 | 1 | 0.842105 |
| COMPLEX-CLECL1/GPRC5B/CD19 | 0.914286 | 1 | 0.842105 |
| CD19 AND LRRC32 AND PPAP2A | 0.914286 | 1 | 0.842105 |
| CD19 AND CLECL1 AND NOT-TREML2 | 0.914286 | 1 | 0.842105 |
| CD19 AND CLECL1 AND NOT-SLC4A7 | 0.914286 | 1 | 0.842105 |
| CD19 AND PRPH2 AND NOT-SLC2A12 | 0.914286 | 1 | 0.842105 |
| CD19 AND KIR2DL4 AND NOT-SLC2A12 | 0.914286 | 1 | 0.842105 |
| CD19 AND SLC26A6 AND NOT-SLC2A12 | 0.914286 | 1 | 0.842105 |
| CD19 AND OR51M1 AND NOT-SLC2A12 | 0.914286 | 1 | 0.842105 |
| CD19 AND HRH1 AND NOT-SLC2A12 | 0.914286 | 1 | 0.842105 |
| CD19 AND CLECL1 AND NOT-MMP15 | 0.914286 | 1 | 0.842105 |
| CD19 AND CLECL1 AND NOT-ABCG2 | 0.914286 | 1 | 0.842105 |
| COMPLEX-CLECL1/OR7A5/CD19 | 0.914286 | 1 | 0.842105 |
| CD19 AND OR10A4 AND NOT-SLC2A12 | 0.914286 | 1 | 0.842105 |
| CD19 AND CLECL1 AND NOT-TPCN1 | 0.914286 | 1 | 0.842105 |
| CD19 AND STRA6 AND NOT-ADCY2 | 0.914286 | 1 | 0.842105 |
| CD19 AND OR51B4 AND SLC25A3 | 0.914286 | 1 | 0.842105 |
| CD19 AND LRP4 AND LRRC8B | 0.914286 | 1 | 0.842105 |
| CD19 AND EDNRA AND NOT-SLC2A12 | 0.914286 | 1 | 0.842105 |
| CD19 AND BTN1A1 AND SLC25A3 | 0.914286 | 1 | 0.842105 |
| CD19 AND CLECL1 AND NOT-LRP12 | 0.914286 | 1 | 0.842105 |
| CD19 AND SLC5A9 AND NOT-SLC2A12 | 0.914286 | 1 | 0.842105 |
| COMPLEX-CLECL1/SEMA5A/CD19 | 0.914286 | 1 | 0.842105 |
| CD19 AND NOT-TRPV2 AND CLECL1 | 0.914286 | 1 | 0.842105 |
| CD19 AND CLECL1 AND NOT-TGOLN2 | 0.914286 | 1 | 0.842105 |
| CD19 AND CLECL1 AND NOT-ADAM8 | 0.914286 | 1 | 0.842105 |
| COMPLEX-CLECL1/LY6G6D/CD19 | 0.914286 | 1 | 0.842105 |
| CD19 AND CLECL1 AND NOT-IL1RAPL1 | 0.914286 | 1 | 0.842105 |
| CD19 AND CLECL1 AND NOT-KCNH6 | 0.914286 | 1 | 0.842105 |
| COMPLEX-RXFP2/CLECL1/CD19 | 0.914286 | 1 | 0.842105 |
| CD19 AND CLECL1 AND NOT-SMPD1 | 0.914286 | 1 | 0.842105 |
| CD19 AND CLECL1 AND NOT-CYBB | 0.914286 | 1 | 0.842105 |
| CD19 AND NOT-CYP4F12 AND NOT-SLC2A12 | 0.914286 | 1 | 0.842105 |
| CD19 AND SLC22A7 AND NOT-SLC2A12 | 0.914286 | 1 | 0.842105 |
| CD19 AND CLECL1 AND NOT-TCTN3 | 0.914286 | 1 | 0.842105 |

FIG. 15 (cont.)

| Antigen Pair Logic | F1 | Precision | Recall |
|---|---|---|---|
| SLCO1B1 AND HM13 AND NOT-STEAP1 | 1 | 1 | 1 |
| SLCO1B1 AND HM13 AND NOT-MAGEA4 | 1 | 1 | 1 |
| ABCG5 AND FGFRL1 AND NOT-FOLH1 | 1 | 1 | 1 |
| SLCO1B1 AND EPHB2 AND NOT-HMOX1 | 1 | 1 | 1 |
| SLC2A2 AND SLC26A6 AND NOT-CLDN7 | 1 | 1 | 1 |
| SLC2A2 AND SLC26A6 AND NOT-GPA33 | 1 | 1 | 1 |
| SLCO1B1 AND NOT-MARCO AND CD22 | 1 | 1 | 1 |
| SLC2A2 AND SLC26A6 AND CD70 | 1 | 1 | 1 |
| SLC2A2 AND SLC26A6 AND NOT-DPEP1 | 1 | 1 | 1 |
| SLC2A2 AND SLC26A6 AND NOT-CLDN3 | 1 | 1 | 1 |
| SLC2A2 AND SLC26A6 AND NOT-GUCY2C | 1 | 1 | 1 |
| SLC2A2 AND SLC26A6 AND NOT-MUC13 | 1 | 1 | 1 |
| SLC2A2 AND SLC26A6 AND NOT-CLDN23 | 1 | 1 | 1 |
| SLC2A2 AND SLC26A6 AND NOT-PROM1 | 1 | 1 | 1 |
| ABCG5 AND FGFRL1 AND NOT-IL13RA2 | 1 | 1 | 1 |
| SLCO1B1 AND EPHB2 AND NOT-STEAP3 | 1 | 1 | 1 |
| SLCO1B1 AND TLCD1 AND NOT-CLDN5 | 1 | 1 | 1 |
| SLC2A2 AND SLC26A6 AND CLDN1 | 1 | 1 | 1 |
| SLC2A2 AND SLC26A6 AND NOT-CLDN4 | 1 | 1 | 1 |
| SLCO1B1 AND EPHB2 AND NOT-P2RY13 | 1 | 1 | 1 |
| SLC2A2 AND SLC26A6 AND NOT-ENPP3 | 1 | 1 | 1 |
| SLC2A2 AND SLC26A6 AND NOT-MST1R | 1 | 1 | 1 |
| SLC2A2 AND SLC26A6 AND NOT-SST | 1 | 1 | 1 |
| SLCO1B1 AND NOT-MARCO AND SEMA5B | 1 | 1 | 1 |
| SLC2A2 AND SLC26A6 AND KDR | 1 | 1 | 1 |
| SLC2A2 AND SLC26A6 AND NOT-CEACAM5 | 1 | 1 | 1 |
| SLC2A2 AND SLC26A6 AND NOT-CEACAM6 | 1 | 1 | 1 |
| SLC2A2 AND SLC26A6 AND CD70 | 1 | 1 | 1 |
| SLCO1B1 AND NOT-MARCO AND MST1R | 1 | 1 | 1 |
| SLC2A2 AND SLC26A6 AND NOT-CD160 | 1 | 1 | 1 |
| SLC2A2 AND SLC26A6 AND NOT-HHLA2 | 1 | 1 | 1 |
| SLCO1B1 AND TLCD1 AND NOT-STEAP1 | 1 | 1 | 1 |
| ABCG5 AND SLC7A11 AND NOT-CEACAM5 | 1 | 1 | 1 |
| ABCG5 AND HM13 AND NOT-MUC13 | 1 | 1 | 1 |
| ABCG5 AND SLC7A11 AND NOT-CEACAM6 | 1 | 1 | 1 |
| ABCG5 AND FGFRL1 AND NOT-BMPR1B | 1 | 1 | 1 |
| SLC43A1 AND NOT-IL20RA AND NOT-MARCO | 1 | 1 | 1 |
| SLCO1B1 AND HM13 AND NOT-KDR | 1 | 1 | 1 |
| ABCG5 AND FGFRL1 AND NOT-CD19 | 1 | 1 | 1 |
| ABCG5 AND FGFRL1 AND NOT-SSTR3 | 1 | 1 | 1 |
| ABCG5 AND FGFRL1 AND NOT-SSTR4 | 1 | 1 | 1 |
| SLCO1B1 AND HM13 AND NOT-TNFRSF13C | 1 | 1 | 1 |
| SLCO1B1 AND HM13 AND NOT-ANXA1 | 1 | 1 | 1 |
| ABCG5 AND FGFRL1 AND NOT-L1CAM | 1 | 1 | 1 |
| SLCO1B1 AND HM13 AND NOT-WT1 | 1 | 1 | 1 |
| SLCO1B1 AND HM13 AND NOT-ITGB6 | 1 | 1 | 1 |
| SLCO1B1 AND HM13 AND NOT-CTAG2 | 1 | 1 | 1 |
| ABCG5 AND FGFRL1 AND NOT-THY1 | 1 | 1 | 1 |
| ABCG5 AND HM13 AND NOT-ITGB6 | 1 | 1 | 1 |
| ABCG5 AND FGFRL1 AND NOT-MS4A1 | 1 | 1 | 1 |
| SLCO1B1 AND HM13 AND NOT-SLC39A6 | 1 | 1 | 1 |
| SLCO1B1 AND HM13 AND NOT-FLOT2 | 1 | 1 | 1 |
| SLCO1B1 AND HM13 AND NOT-PMEL | 1 | 1 | 1 |
| SLCO1B1 AND HM13 AND NOT-CD160 | 1 | 1 | 1 |
| SLCO1B1 AND HM13 AND NOT-CLDN3 | 1 | 1 | 1 |
| ABCG5 AND FGFRL1 AND NOT-ITGB3 | 1 | 1 | 1 |
| ABCG5 AND FGFRL1 AND NOT-L1CAM | 1 | 1 | 1 |
| SLCO1B1 AND HM13 AND NOT-CXCR5 | 1 | 1 | 1 |
| ABCG5 AND HM13 AND NOT-PROM1 | 1 | 1 | 1 |
| SLCO1B1 AND HM13 AND NOT-THY1 | 1 | 1 | 1 |
| SLCO1B1 AND HM13 AND NOT-VTCN1 | 1 | 1 | 1 |
| ABCG5 AND FGFRL1 AND NOT-TNFRSF8 | 1 | 1 | 1 |
| SLC43A1 AND NOT-MUC1 AND SLC26A6 | 1 | 1 | 1 |
| SLC43A1 AND NOT-MUC1 AND NOT-CLEC4G | 1 | 1 | 1 |
| SLC43A1 AND NOT-MUC1 AND NOT-MARCO | 1 | 1 | 1 |
| SLC43A1 AND NOT-MUC1 AND NOT-MARCO | 1 | 1 | 1 |
| SLC43A1 AND NOT-MUC1 AND HM13 | 1 | 1 | 1 |
| SLCO1B1 AND SLC26A6 AND NOT-MSLN | 0.923077 | 0.857143 | 1 |
| SLCO1B1 AND SLC26A6 AND NOT-MUC1 | 0.923077 | 0.857143 | 1 |
| SLC43A1 AND CELSR3 AND NOT-MUC1 | 1 | 1 | 1 |
| SLC43A1 AND NOT-MUC1 AND CD200 | 1 | 1 | 1 |
| SLC43A1 AND CELSR3 AND NOT-MUC1 | 1 | 1 | 1 |
| SLCO1B1 AND C6orf89 AND NOT-MSLN | 1 | 1 | 1 |
| ABCG5 AND SLC38A6 AND NOT-MSLN | 0.909091 | 1 | 0.833333 |
| SLC43A1 AND NOT-MUC1 AND ANO10 | 0.909091 | 1 | 0.833333 |
| SLC43A1 AND SLC38A6 AND NOT-MUC1 | 0.909091 | 1 | 0.833333 |
| SLCO1B1 AND NOT-MARCO AND GPC3 | 0.909091 | 1 | 0.833333 |

| Antigen Pair Logic | F1 | Precision | Recall |
|---|---|---|---|
| CD19 AND AQP4 AND PPAP2A | 0.914286 | 1 | 0.842105 |
| CD19 AND CLECL1 AND NOT-ATP1A4 | 0.914286 | 1 | 0.842105 |
| CD19 AND CORIN AND SLC38A2 | 0.914286 | 1 | 0.842105 |
| CD19 AND NOT-MS4A2 AND PTH1R | 0.914286 | 1 | 0.842105 |
| CD19 AND NOT-MS4A2 AND CXADR | 0.914286 | 1 | 0.842105 |
| CD19 AND NOT-MS4A2 AND TMEM30B | 0.914286 | 1 | 0.842105 |
| CD19 AND NOT-TRPV2 AND SLC2A6 | 0.914286 | 1 | 0.842105 |
| CD19 AND EFNB3 AND PPAP2A | 0.914286 | 1 | 0.842105 |
| CD19 AND STRA6 AND NOT-FPR3 | 0.914286 | 1 | 0.842105 |
| CD19 AND CLECL1 AND NOT-GPR15 | 0.914286 | 1 | 0.842105 |
| CD19 AND CLECL1 AND NOT-RECK | 0.914286 | 1 | 0.842105 |
| CD19 AND CLECL1 AND NOT-TFR2 | 0.914286 | 1 | 0.842105 |
| CD19 AND NOT-MS4A2 AND USP48 | 0.914286 | 1 | 0.842105 |
| COMPLEX-PPAP2A/CD19/CELSR1 | 0.914286 | 1 | 0.842105 |
| CD19 AND PTH1R AND NOT-HM13 | 0.914286 | 1 | 0.842105 |
| CD19 AND NDRG4 AND NOT-PAG1 | 0.914286 | 1 | 0.842105 |
| CD19 AND CORIN AND PTH1R | 0.914286 | 1 | 0.842105 |
| CD19 AND CLEC4M AND NOT-SLC2A12 | 0.914286 | 1 | 0.842105 |
| CD19 AND NOT-MS4A2 AND SLC7A2 | 0.914286 | 1 | 0.842105 |
| CD19 AND CLECL1 AND NOT-KCNG2 | 0.914286 | 1 | 0.842105 |
| CD19 AND CXADR AND NOT-SLC2A12 | 0.914286 | 1 | 0.842105 |
| COMPLEX-CLECL1/TGFBR3/CD19 | 0.914286 | 1 | 0.842105 |
| CD19 AND CLECL1 AND NOT-TAS2R50 | 0.914286 | 1 | 0.842105 |
| COMPLEX-SLC5A12/CLECL1/CD19 | 0.914286 | 1 | 0.842105 |
| CD19 AND PCDHB12 AND NOT-SLC2A12 | 0.914286 | 1 | 0.842105 |
| CD19 AND EMCN AND NOT-SLC2A12 | 0.914286 | 1 | 0.842105 |
| COMPLEX-CLECL1/NLGN1/CD19 | 0.914286 | 1 | 0.842105 |
| CD19 AND GPBAR1 AND NOT-SLC2A12 | 0.914286 | 1 | 0.842105 |
| CD19 AND CLECL1 AND NOT-GLRB | 0.914286 | 1 | 0.842105 |
| CD19 AND CLECL1 AND NOT-TMC1 | 0.914286 | 1 | 0.842105 |
| COMPLEX-CLECL1/CD19/CD151 | 0.914286 | 1 | 0.842105 |
| CD19 AND CORIN AND NOT-HTR4 | 0.914286 | 1 | 0.842105 |
| CD19 AND NDRG4 AND NOT-CATSPER1 | 0.914286 | 1 | 0.842105 |
| CD19 AND CLECL1 AND NOT-COL25A1 | 0.914286 | 1 | 0.842105 |
| CD19 AND ITPR2 AND NOT-NTRK1 | 0.914286 | 1 | 0.842105 |
| CD19 AND NOT-MS4A2 AND NOT-CYP4F12 | 0.914286 | 1 | 0.842105 |
| CD19 AND CLECL1 AND NOT-TGFBR1 | 0.914286 | 1 | 0.842105 |
| CD19 AND NDRG4 AND NOT-FPR3 | 0.914286 | 1 | 0.842105 |
| COMPLEX-SLC24A4/CLECL1/CD19 | 0.914286 | 1 | 0.842105 |
| COMPLEX-CLECL1/HTR7/CD19 | 0.914286 | 1 | 0.842105 |
| COMPLEX-CLECL1/GPR88/CD19 | 0.914286 | 1 | 0.842105 |
| CD19 AND CORIN AND NOT-ADCY2 | 0.914286 | 1 | 0.842105 |
| CD19 AND SLC6A9 AND NOT-SLC2A12 | 0.914286 | 1 | 0.842105 |
| CD19 AND NOT-TREML2 AND SLC2A6 | 0.914286 | 1 | 0.842105 |
| COMPLEX-CFTR/ITGAE/CD19 | 0.914286 | 1 | 0.842105 |
| CD19 AND HRH1 AND NOT-GLRB | 0.914286 | 1 | 0.842105 |
| CD19 AND PCDH7 AND PPAP2A | 0.898551 | 1 | 0.815789 |
| CD19 AND ADCY2 AND NOT-HM13 | 0.898551 | 1 | 0.815789 |
| CD19 AND PCDH7 AND NOT-HTR4 | 0.898551 | 1 | 0.815789 |
| CD19 AND ADCY2 AND NOT-HTR4 | 0.898551 | 1 | 0.815789 |
| CD19 AND PCDH7 AND NOT-TNFSF14 | 0.898551 | 1 | 0.815789 |
| CD19 AND ABCA8 AND NOT-FLT3LG | 0.898551 | 1 | 0.815789 |
| CD19 AND PCDH7 AND NOT-CD46 | 0.898551 | 1 | 0.815789 |
| COMPLEX-PCDH7/UGT8/CD19 | 0.898551 | 1 | 0.815789 |
| CD19 AND ABCA8 AND ST6GALNAC6 | 0.898551 | 1 | 0.815789 |
| MS4A1 AND NOT-KCNC2 AND ADCY10 | 0.961039 | 0.948718 | 0.973684 |
| MS4A1 AND SLC22A18 AND NOT-CD36 | 0.961039 | 0.948718 | 0.973684 |
| MS4A1 AND SLC22A18 AND NOT-MPL | 0.974359 | 0.95 | 1 |
| MS4A1 AND ADCY10 AND NOT-CHRNA4 | 0.948718 | 0.925 | 0.973684 |
| MS4A1 AND SLC22A18 AND NOT-MLC1 | 0.944444 | 1 | 0.894737 |
| MS4A1 AND ADCY10 AND NOT-MLC1 | 0.944444 | 1 | 0.894737 |
| MS4A1 AND ADCY10 AND NOT-SLC22A6 | 0.961039 | 0.948718 | 0.973684 |
| MS4A1 AND ADCY10 AND NOT-CD36 | 0.973684 | 0.973684 | 0.973684 |
| MS4A1 AND ADCY10 AND NOT-AJAP1 | 0.948718 | 0.925 | 0.973684 |
| MS4A1 AND ADCY10 AND NOT-SLC28A1 | 0.974359 | 0.95 | 1 |
| MS4A1 AND ADCY10 AND NOT-SYT6 | 0.948718 | 0.925 | 0.973684 |
| MS4A1 AND ADCY10 AND NOT-CALY | 0.947368 | 0.947368 | 0.947368 |
| MS4A1 AND SLC22A18 AND NOT-PTGER4 | 0.938272 | 0.883721 | 1 |
| MS4A1 AND ADCY10 AND NOT-MPL | 0.987013 | 0.974359 | 1 |
| MS4A1 AND NOT-KCNC2 AND HRH3 | 0.936709 | 0.902439 | 0.973684 |
| MS4A1 AND HCN2 AND NOT-KCNK4 | 0.936709 | 0.902439 | 0.973684 |
| MS4A1 AND NOT-KCNC2 AND SLC30A8 | 0.936709 | 0.902439 | 0.973684 |
| MS4A1 AND ADCY10 AND NOT-PTGER4 | 0.987013 | 0.974359 | 1 |
| MS4A1 AND PCDHAC2 AND NOT-PTGER4 | 0.95 | 0.904762 | 1 |
| MS4A1 AND SLC30A8 AND NOT-PTGER4 | 0.935065 | 0.923077 | 0.947368 |
| MS4A1 AND JPH3 AND NOT-KCNK4 | 0.935065 | 0.923077 | 0.947368 |
| MS4A1 AND ADCY10 AND NOT-OR3A2 | 0.935065 | 0.923077 | 0.947368 |

FIG. 15 (cont.)

| Antigen Pair Logic | F1 | Precision | Recall | Antigen Pair Logic | F1 | Precision | Recall |
|---|---|---|---|---|---|---|---|
| SLC43A1 AND NOT-MUC1 AND NOT-CLEC1B | 0.909091 | 1 | 0.833333 | MS4A1 AND ADCY10 AND NOT-SLC5A8 | 0.935065 | 0.923077 | 0.947368 |
| SLC43A1 AND NOT-MUC1 AND MRAP2 | 1 | 1 | 1 | MS4A1 AND NOT-SLC5A11 AND ADCY10 | 0.933333 | 0.945946 | 0.921053 |
| SLC43A1 AND NOT-MUC1 AND TMEM67 | 1 | 1 | 1 | MS4A1 AND ADCY10 AND NOT-MAG | 0.95 | 0.904762 | 1 |
| SLC43A1 AND NOT-MUC1 AND TMPRSS5 | 1 | 1 | 1 | MS4A1 AND SLC30A8 AND NOT-SLC22A6 | 0.936709 | 0.902439 | 0.973684 |
| SLCO1B1 AND CD200 AND NOT-MSLN | 0.923077 | 0.857143 | 1 | MS4A1 AND CLDN20 AND NOT-CHRNA4 | 0.936709 | 0.902439 | 0.973684 |
| SLC43A1 AND NOT-MUC1 AND TMPRSS5 | 1 | 1 | 1 | MS4A1 AND PCDHAC2 AND NOT-CD36 | 0.948718 | 0.925 | 0.973684 |
| SLC43A1 AND NOT-MUC1 AND TMEM67 | 1 | 1 | 1 | MS4A1 AND SLC30A8 AND NOT-CD36 | 0.948718 | 0.925 | 0.973684 |
| SLC43A1 AND NOT-MUC1 AND SLC7A11 | 1 | 1 | 1 | MS4A1 AND SLC22A18 AND NOT-CD93 | 0.974359 | 0.95 | 1 |
| SLC2A2 AND NOT-CLEC1B AND MSLN | 0.909091 | 1 | 0.833333 | MS4A1 AND PRND AND NOT-MLC1 | 0.931507 | 0.971429 | 0.894737 |
| SLC2A2 AND NOT-MARCO AND MSLN | 0.923077 | 0.857143 | 1 | MS4A1 AND ADAM20 AND NOT-MLC1 | 0.931507 | 0.971429 | 0.894737 |
| SLC2A2 AND SLC26A6 AND MSLN | 1 | 1 | 1 | MS4A1 AND SLC30A8 AND NOT-MLC1 | 0.931507 | 0.971429 | 0.894737 |
| SLC43A1 AND NOT-MUC1 AND SLC4A11 | 0.909091 | 1 | 0.833333 | MS4A1 AND PCDHAC2 AND NOT-MLC1 | 0.931507 | 0.971429 | 0.894737 |
| SLCO1B1 AND TLCD1 AND NOT-MSLN | 1 | 1 | 1 | MS4A1 AND ADCY10 AND NOT-KCNF1 | 0.962025 | 0.926829 | 1 |
| SLC2A2 AND NOT-MARCO AND MSLN | 0.923077 | 0.857143 | 1 | MS4A1 AND ADCY10 AND NOT-GRM1 | 0.962025 | 0.926829 | 1 |
| SLCO1B1 AND TLCD1 AND NOT-MSLN | 1 | 1 | 1 | MS4A1 AND SLC30A8 AND NOT-SLC28A1 | 0.95 | 0.904762 | 1 |
| SLC2A2 AND SLC26A6 AND MSLN | 1 | 1 | 1 | MS4A1 AND SLC22A18 AND NOT-TGFBI | 0.933333 | 0.945946 | 0.921053 |
| SLC43A1 AND NOT-MUC1 AND MMP14 | 1 | 1 | 1 | MS4A1 AND ADCY10 AND NOT-ATP6V0A4 | 0.948718 | 0.925 | 0.973684 |
| SLC43A1 AND DAGLB AND NOT-MUC1 | 0.909091 | 1 | 0.833333 | MS4A1 AND ADCY10 AND NOT-LPPR3 | 0.948718 | 0.925 | 0.973684 |
| SLC43A1 AND PANX2 AND NOT-MUC1 | 1 | 1 | 1 | MS4A1 AND CCKBR AND NOT-MLC1 | 0.931507 | 0.971429 | 0.894737 |
| SLC43A1 AND NOT-MUC1 AND TREML2 | 0.909091 | 1 | 0.833333 | MS4A1 AND CLDN20 AND NOT-MLC1 | 0.931507 | 0.971429 | 0.894737 |
| SLC43A1 AND TMUB1 AND NOT-MUC1 | 0.909091 | 1 | 0.833333 | MS4A1 AND FGF6 AND NOT-MLC1 | 0.931507 | 0.971429 | 0.894737 |
| SLCO1B1 AND SLC39A1 AND NOT-MSLN | 0.909091 | 1 | 0.833333 | MS4A1 AND GPR156 AND NOT-MLC1 | 0.931507 | 0.971429 | 0.894737 |
| SLC43A1 AND FGFRL1 AND NOT-MUC1 | 1 | 1 | 1 | MS4A1 AND SLC22A18 AND NOT-CD163 | 0.974359 | 0.95 | 1 |
| SLC43A1 AND NOT-MUC1 AND CACNA1I | 0.909091 | 1 | 0.833333 | MS4A1 AND ADCY10 AND NOT-UNC5A | 0.929577 | 1 | 0.868421 |
| SLC43A1 AND CNNM3 AND NOT-MUC1 | 1 | 1 | 1 | MS4A1 AND SLC22A18 AND NOT-KCNK6 | 0.95 | 0.904762 | 1 |
| SLC43A1 AND NOT-MUC1 AND SLC2A5 | 0.909091 | 1 | 0.833333 | MS4A1 AND PRND AND NOT-PTGER4 | 0.935065 | 0.923077 | 0.947368 |
| SLCO1B1 AND LRRC8D AND NOT-MSLN | 0.909091 | 1 | 0.833333 | MS4A1 AND ADCY10 AND NOT-LRFN2 | 0.926829 | 0.863636 | 1 |
| SLC43A1 AND NOT-MUC1 AND NIPA1 | 0.909091 | 1 | 0.833333 | MS4A1 AND SLC30A8 AND NOT-MAG | 0.926829 | 0.863636 | 1 |
| SLC43A1 AND SLC39A1 AND NOT-MUC1 | 0.909091 | 1 | 0.833333 | MS4A1 AND PRND AND NOT-CD36 | 0.961039 | 0.948718 | 0.973684 |
| SLC43A1 AND NOT-MUC1 AND ADORA2B | 0.909091 | 1 | 0.833333 | MS4A1 AND ADCY10 AND NOT-CALHM3 | 0.961039 | 0.948718 | 0.973684 |
| SLCO1B1 AND NCSTN AND NOT-MSLN | 1 | 1 | 1 | MS4A1 AND ADAM20 AND NOT-CD36 | 0.948718 | 0.925 | 0.973684 |
| SLC43A1 AND NOT-MUC1 AND SLC52A2 | 1 | 1 | 1 | MS4A1 AND NOT-CHRNA4 AND HRH3 | 0.925 | 0.880952 | 0.973684 |
| SLCO1B1 AND SLC52A2 AND NOT-MSLN | 1 | 1 | 1 | MS4A1 AND ADCY10 AND NOT-SLC22A13 | 0.925 | 0.880952 | 0.973684 |
| SLC43A1 AND NOT-MUC1 AND ADAM23 | 0.909091 | 1 | 0.833333 | MS4A1 AND SLC30A8 AND NOT-AJAP1 | 0.925 | 0.880952 | 0.973684 |
| SLC43A1 AND ATP2A2 AND NOT-MUC1 | 0.909091 | 1 | 0.833333 | MS4A1 AND ADCY10 AND NOT-GABRD | 0.925 | 0.880952 | 0.973684 |
| SLCO1B1 AND LRP11 AND NOT-MSLN | 1 | 1 | 1 | MS4A1 AND SLC30A8 AND NOT-CHRNA4 | 0.925 | 0.880952 | 0.973684 |
| ABCG5 AND CELSR3 AND NOT-MUC1 | 0.923077 | 0.857143 | 1 | MS4A1 AND ADCY10 AND NOT-GRIA4 | 0.925 | 0.880952 | 0.973684 |
| SLC43A1 AND NOT-MUC1 AND LRP11 | 1 | 1 | 1 | MS4A1 AND SLC30A8 AND NOT-SYT6 | 0.925 | 0.880952 | 0.973684 |
| SLC43A1 AND C6orf89 AND NOT-MUC1 | 1 | 1 | 1 | MS4A1 AND NOT-CHRNA4 AND DCC | 0.925 | 0.880952 | 0.973684 |
| SLC43A1 AND NOT-MUC1 AND ASIC5 | 1 | 1 | 1 | MS4A1 AND PRND AND NOT-SLC28A1 | 0.926829 | 0.863636 | 1 |
| SLCO1B1 AND SLC7A11 AND NOT-MUC1 | 1 | 1 | 1 | MS4A1 AND CLDN20 AND NOT-SYT6 | 0.936709 | 0.902439 | 0.973684 |
| SLC43A1 AND NOT-MUC1 AND ASIC5 | 1 | 1 | 1 | MS4A1 AND SLC30A8 AND NOT-ATP6V0A4 | 0.925 | 0.880952 | 0.973684 |
| SLC2A2 AND MSLN AND SLC5A6 | 1 | 1 | 1 | MS4A1 AND SLC30A8 AND NOT-LPPR3 | 0.925 | 0.880952 | 0.973684 |
| SLC43A1 AND BSND AND NOT-MUC1 | 0.909091 | 1 | 0.833333 | MS4A1 AND ADCY10 AND NOT-GRM3 | 0.926829 | 0.863636 | 1 |
| SLC43A1 AND GABRE AND NOT-MUC1 | 0.909091 | 1 | 0.833333 | MS4A1 AND SLC30A8 AND NOT-CALY | 0.923077 | 0.9 | 0.947368 |
| SLC2A2 AND NOT-CLEC4G AND MSLN | 0.909091 | 1 | 0.833333 | MS4A1 AND PRND AND NOT-CALY | 0.923077 | 0.9 | 0.947368 |
| SLC43A1 AND NOT-MUC1 AND KCNG3 | 1 | 1 | 1 | MS4A1 AND SLC30A8 AND NOT-OR3A2 | 0.923077 | 0.9 | 0.947368 |
| SLC43A1 AND TMEM150A AND NOT-MUC1 | 0.909091 | 1 | 0.833333 | MS4A1 AND KCNA1 AND NOT-MLC1 | 0.931507 | 0.971429 | 0.894737 |
| ABCG5 AND SLC5A5 AND NOT-MUC1 | 0.909091 | 1 | 0.833333 | MS4A1 AND DTNA AND NOT-MLC1 | 0.931507 | 0.971429 | 0.894737 |
| SLC43A1 AND NOT-MUC1 AND KCNG3 | 1 | 1 | 1 | MS4A1 AND DCC AND NOT-MLC1 | 0.931507 | 0.971429 | 0.894737 |
| SLCO1B1 AND ADCY6 AND NOT-TNFRSF10A | 1 | 1 | 1 | MS4A1 AND ADCY10 AND NOT-CACNG7 | 0.935065 | 0.923077 | 0.947368 |
| SLCO1B1 AND NOT-KCNN2 AND MSLN | 1 | 1 | 1 | MS4A1 AND CATSPERD AND NOT-MLC1 | 0.931507 | 0.971429 | 0.894737 |
| ABCG5 AND SLC39A1 AND NOT-MUC1 | 0.909091 | 1 | 0.833333 | MS4A1 AND ADCY10 AND NOT-OXTR | 0.931507 | 0.971429 | 0.894737 |
| SLC43A1 AND ADCY6 AND NOT-MUC1 | 1 | 1 | 1 | MS4A1 AND OR52D1 AND NOT-MLC1 | 0.931507 | 0.971429 | 0.894737 |
| SLCO1B1 AND MMP14 AND NOT-MSLN | 0.923077 | 0.857143 | 1 | MS4A1 AND SLC22A18 AND NOT-VANGL1 | 0.938272 | 0.883721 | 1 |
| SLCO1B1 AND NOT-KCNN2 AND MSLN | 1 | 1 | 1 | MS4A1 AND ADCY10 AND NOT-TRPM1 | 0.926829 | 0.863636 | 1 |
| SLC2A2 AND CD200 AND MSLN | 1 | 1 | 1 | MS4A1 AND FGF6 AND NOT-PTGER4 | 0.95 | 0.904762 | 1 |
| SLC43A1 AND ADCY6 AND NOT-MUC1 | 1 | 1 | 1 | MS4A1 AND TMEFF2 AND NOT-KCNK4 | 0.921053 | 0.921053 | 0.921053 |
| SLC2A2 AND SLC12A7 AND MSLN | 0.909091 | 1 | 0.833333 | MS4A1 AND ADCY10 AND NOT-SCN1A | 0.921053 | 0.921053 | 0.921053 |
| SLCO1B1 AND SLC2A5 AND NOT-MSLN | 0.909091 | 1 | 0.833333 | MS4A1 AND CDH22 AND NOT-KCNK4 | 0.921053 | 0.921053 | 0.921053 |
| SLC43A1 AND PDCD1 AND NOT-MUC1 | 0.909091 | 1 | 0.833333 | MS4A1 AND CCKBR AND NOT-PTGER4 | 0.935065 | 0.923077 | 0.947368 |
| SLC43A1 AND NOT-MUC1 AND TAS2R4 | 0.909091 | 1 | 0.833333 | MS4A1 AND GPR156 AND NOT-PTGER4 | 0.947368 | 0.947368 | 0.947368 |
| ALCAM AND NOT-MUC1 AND SLC40A1 | 0.909091 | 1 | 0.833333 | MS4A1 AND CLDN20 AND NOT-PTGER4 | 0.947368 | 0.947368 | 0.947368 |
| SLC2A2 AND HM13 AND MSLN | 1 | 1 | 1 | MS4A1 AND ADCY10 AND NOT-CASR | 0.935065 | 0.923077 | 0.947368 |
| SLC43A1 AND IGF2R AND NOT-MUC1 | 0.909091 | 1 | 0.833333 | MS4A1 AND ADCY10 AND NOT-CCR9 | 0.945946 | 0.972222 | 0.921053 |
| SLC43A1 AND SLC5A5 AND NOT-MUC1 | 0.909091 | 1 | 0.833333 | MS4A1 AND PCDHAC2 AND NOT-KCNA4 | 0.925 | 0.880952 | 0.973684 |
| ASGR1 AND HM13 AND NOT-CD160 | 1 | 1 | 1 | MS4A1 AND ADCY10 AND NOT-KCNA4 | 0.961039 | 0.948718 | 0.973684 |
| ASGR1 AND HM13 AND NOT-CD33 | 1 | 1 | 1 | MS4A1 AND NOT-KCNC2 AND CCKBR | 0.947368 | 0.947368 | 0.947368 |
| ASGR1 AND FGFRL1 AND NOT-IL13RA2 | 1 | 1 | 1 | MS4A1 AND PVRL1 AND NOT-KCNK4 | 0.918919 | 0.944444 | 0.894737 |
| HPN AND SLC26A6 AND NOT-IL3RA | 1 | 1 | 1 | MS4A1 AND MC2R AND NOT-MLC1 | 0.918919 | 0.944444 | 0.894737 |
| HPN AND SLC26A6 AND NOT-PMEL | 1 | 1 | 1 | MS4A1 AND PCDHAC2 AND NOT-CALHM3 | 0.925 | 0.880952 | 0.973684 |
| HPN AND SLC26A6 AND NOT-PCYT1A | 1 | 1 | 1 | MS4A1 AND SLC30A8 AND NOT-CALHM3 | 0.936709 | 0.902439 | 0.973684 |
| HPN AND SLC26A6 AND NOT-ENPP3 | 1 | 1 | 1 | MS4A1 AND GPR156 AND NOT-SLC22A6 | 0.925 | 0.880952 | 0.973684 |
| FGG AND NOT-MARCO AND MET | 1 | 1 | 1 | MS4A1 AND DCC AND NOT-SYT6 | 0.925 | 0.880952 | 0.973684 |
| HPN AND SLC26A6 AND NOT-TYR | 1 | 1 | 1 | MS4A1 AND GPR156 AND NOT-CALY | 0.923077 | 0.9 | 0.947368 |
| HPN AND SLC26A6 AND NOT-PTK7 | 1 | 1 | 1 | MS4A1 AND NOT-MLC1 AND OR7C1 | 0.931507 | 0.971429 | 0.894737 |
| FGG AND HM13 AND NOT-MAGEA4 | 1 | 1 | 1 | MS4A1 AND CCKBR AND NOT-CALY | 0.923077 | 0.9 | 0.947368 |

FIG. 15 (cont.)

| Antigen Pair Logic | F1 | Precision | Recall | Antigen Pair Logic | F1 | Precision | Recall |
|---|---|---|---|---|---|---|---|
| HPN AND SLC26A6 AND NOT-GUCY2C | 1 | 1 | 1 | MS4A1 AND SLC22A18 AND NOT-ITGB3 | 0.974359 | 0.95 | 1 |
| HPN AND SLC26A6 AND NOT-FOLR1 | 1 | 1 | 1 | MS4A1 AND SLC22A18 AND NOT-TNFRSF8 | 0.961039 | 0.948718 | 0.973684 |
| HPN AND SLC26A6 AND NOT-ERBB4 | 1 | 1 | 1 | MS4A1 AND SLC22A18 AND NOT-NCAM1 | 0.987013 | 0.974359 | 1 |
| HPN AND SLC26A6 AND NOT-CLDN3 | 1 | 1 | 1 | MS4A1 AND ADCY10 AND NOT-ITGB3 | 0.987013 | 0.974359 | 1 |
| HPN AND SLC26A6 AND NOT-RAET1E | 1 | 1 | 1 | MS4A1 AND SLC30A8 AND NOT-ITGB3 | 0.962025 | 0.926829 | 1 |
| HPN AND SLC26A6 AND NOT-CD52 | 1 | 1 | 1 | MS4A1 AND ADCY10 AND NOT-TNFRSF8 | 0.973684 | 0.973684 | 0.973684 |
| HPN AND SLC26A6 AND NOT-SLC34A2 | 1 | 1 | 1 | MS4A1 AND PCDHAC2 AND NOT-ITGB3 | 0.95 | 0.904762 | 1 |
| HPN AND SLC26A6 AND NOT-CLEC14A | 1 | 1 | 1 | MS4A1 AND PRND AND NOT-ITGB3 | 0.962025 | 0.926829 | 1 |
| HPN AND SLC26A6 AND NOT-ERBB3 | 1 | 1 | 1 | MS4A1 AND ADAM20 AND NOT-ITGB3 | 0.95 | 0.904762 | 1 |
| FGG AND NOT-MARCO AND THY1 | 1 | 1 | 1 | MS4A1 AND SLC30A8 AND NOT-TNFRSF8 | 0.948718 | 0.925 | 0.973684 |
| HPN AND SLC26A6 AND NOT-FOLR2 | 1 | 1 | 1 | MS4A1 AND SLC22A18 AND NOT-DDX3X | 0.938272 | 0.883721 | 1 |
| HPN AND SLC26A6 AND NOT-B4GALNT1 | 1 | 1 | 1 | MS4A1 AND PCDHAC2 AND NOT-TNFRSF8 | 0.936709 | 0.902439 | 0.973684 |
| HPN AND SLC26A6 AND NOT-IL11RA | 1 | 1 | 1 | MS4A1 AND PRND AND NOT-CLDN8 | 0.936709 | 0.902439 | 0.973684 |
| HPN AND SLC26A6 AND NOT-ROR1 | 1 | 1 | 1 | MS4A1 AND ADCY10 AND NOT-CLDN8 | 0.986667 | 1 | 0.973684 |
| HPN AND SLC26A6 AND NOT-LGR5 | 1 | 1 | 1 | MS4A1 AND SLC22A18 AND NOT-CD33 | 0.974359 | 0.95 | 1 |
| HPN AND SLC26A6 AND NOT-CLDN11 | 1 | 1 | 1 | MS4A1 AND SLC22A18 AND NOT-CD160 | 0.974359 | 0.95 | 1 |
| HPN AND SLC26A6 AND NOT-MOK | 1 | 1 | 1 | MS4A1 AND FGF6 AND NOT-ITGB3 | 0.95 | 0.904762 | 1 |
| HPN AND SLC26A6 AND NOT-ST8SIA1 | 1 | 1 | 1 | MS4A1 AND ADAM20 AND NOT-TNFRSF8 | 0.936709 | 0.902439 | 0.973684 |
| HPN AND SLC26A6 AND NOT-FCRL2 | 1 | 1 | 1 | MS4A1 AND GPR156 AND NOT-ITGB3 | 0.962025 | 0.926829 | 1 |
| HPN AND SLC26A6 AND NOT-CD19 | 1 | 1 | 1 | MS4A1 AND CLDN20 AND NOT-ITGB3 | 0.974359 | 0.95 | 1 |
| HPN AND SLC26A6 AND NOT-KDR | 1 | 1 | 1 | MS4A1 AND CCKBR AND NOT-ITGB3 | 0.962025 | 0.926829 | 1 |
| HPN AND SLC26A6 AND NOT-CD37 | 1 | 1 | 1 | MS4A1 AND PRND AND NOT-TNFRSF8 | 0.948718 | 0.925 | 0.973684 |
| HPN AND SLC26A6 AND NOT-CD180 | 1 | 1 | 1 | MS4A1 AND SLC22A18 AND NOT-ULBP1 | 0.938272 | 0.883721 | 1 |
| FGG AND NCSTN AND NOT-FOLH1 | 1 | 1 | 1 | MS4A1 AND ADCY10 AND NOT-DNAJB8 | 0.926829 | 0.863636 | 1 |
| HPN AND SLC26A6 AND NOT-FCRL5 | 1 | 1 | 1 | MS4A1 AND NOT-CLDN8 AND DCC | 0.961039 | 0.948718 | 0.973684 |
| HPN AND SLC26A6 AND NOT-ULBP2 | 1 | 1 | 1 | MS4A1 AND NOT-CLDN8 AND MC2R | 0.948718 | 0.925 | 0.973684 |
| FGG AND NOT-MARCO AND TNC | 1 | 1 | 1 | MS4A1 AND NOT-CLDN8 AND NMUR2 | 0.948718 | 0.925 | 0.973684 |
| HPN AND SLC26A6 AND NOT-CA9 | 1 | 1 | 1 | MS4A1 AND NOT-CLDN8 AND CLDN20 | 0.973684 | 0.973684 | 0.973684 |
| HPN AND SLC26A6 AND NOT-MUC4 | 1 | 1 | 1 | MS4A1 AND NOT-CLDN8 AND KCNA1 | 0.936709 | 0.902439 | 0.973684 |
| FGG AND NOT-MARCO AND CD34 | 1 | 1 | 1 | MS4A1 AND NOT-CLDN8 AND GPR156 | 0.948718 | 0.925 | 0.973684 |
| HPN AND SLC26A6 AND NOT-CLDN9 | 1 | 1 | 1 | MS4A1 AND SLC30A8 AND NOT-CLDN8 | 0.961039 | 0.948718 | 0.973684 |
| HPN AND SLC26A6 AND NOT-SEMA5B | 1 | 1 | 1 | MS4A1 AND NOT-CLDN8 AND TMEM235 | 0.936709 | 0.902439 | 0.973684 |
| HPN AND SLC26A6 AND NOT-CD160 | 1 | 1 | 1 | MS4A1 AND NOT-CLDN8 AND CATSPERD | 0.936709 | 0.902439 | 0.973684 |
| HPN AND SLC26A6 AND NOT-CD38 | 1 | 1 | 1 | MS4A1 AND NOT-CLDN8 AND DTNA | 0.948718 | 0.925 | 0.973684 |
| HPN AND SLC26A6 AND NOT-GAGE1 | 1 | 1 | 1 | MS4A1 AND GPR156 AND NOT-TNFRSF8 | 0.948718 | 0.925 | 0.973684 |
| ASGR1 AND HM13 AND NOT-FCRL1 | 1 | 1 | 1 | MS4A1 AND ADCY10 AND NOT-DDX3X | 0.95 | 0.904762 | 1 |
| ASGR1 AND HM13 AND NOT-CD22 | 1 | 1 | 1 | MS4A1 AND CLDN20 AND NOT-TNFRSF8 | 0.961039 | 0.948718 | 0.973684 |
| ASGR1 AND HM13 AND NOT-CD79B | 1 | 1 | 1 | MS4A1 AND CCKBR AND NOT-TNFRSF8 | 0.948718 | 0.925 | 0.973684 |
| ASGR1 AND HM13 AND NOT-CD180 | 1 | 1 | 1 | MS4A1 AND FGF6 AND NOT-TNFRSF8 | 0.936709 | 0.902439 | 0.973684 |
| ASGR1 AND HM13 AND NOT-P2RX5 | 1 | 1 | 1 | MS4A1 AND ADCY10 AND NOT-MUC4 | 0.925 | 0.880952 | 0.973684 |
| ASGR1 AND HM13 AND ALDH1A1 | 1 | 1 | 1 | MS4A1 AND SLC22A18 AND NOT-CLDN8 | 0.925 | 0.880952 | 0.973684 |
| ASGR1 AND HM13 AND NOT-MS4A1 | 1 | 1 | 1 | MS4A1 AND ERBB3 AND NOT-CD36 | 0.925 | 0.880952 | 0.973684 |
| ASGR1 AND HM13 AND NOT-TNFRSF8 | 1 | 1 | 1 | MS4A1 AND ADCY10 AND NOT-SSTR5 | 0.925 | 0.880952 | 0.973684 |
| ASGR1 AND HM13 AND NOT-CD52 | 1 | 1 | 1 | MS4A1 AND NOT-CLDN8 AND CCKBR | 0.925 | 0.880952 | 0.973684 |
| ASGR1 AND HM13 AND NOT-CD37 | 1 | 1 | 1 | MS4A1 AND ADCY10 AND NOT-ULBP3 | 0.925 | 0.880952 | 0.973684 |
| ASGR1 AND HM13 AND NOT-CD72 | 1 | 1 | 1 | MS4A1 AND ADCY10 AND NOT-DPEP1 | 0.923077 | 0.9 | 0.947368 |
| ASGR1 AND HM13 AND NOT-CD79A | 1 | 1 | 1 | MS4A1 AND NOT-SSTR2 AND PCDHAC2 | 0.926829 | 0.863636 | 1 |
| ASGR1 AND HM13 AND NOT-CD19 | 1 | 1 | 1 | MS4A1 AND NOT-SSTR2 AND HRH3 | 0.95 | 0.904762 | 1 |
| FGG AND SLC26A6 AND NOT-GUCY2C | 0.923077 | 0.857143 | 1 | MS4A1 AND ADCY10 AND NOT-CTAG2 | 0.926829 | 0.863636 | 1 |
| FGG AND SPON2 AND NOT-CD79B | 0.909091 | 1 | 0.833333 | MS4A1 AND ADCY10 AND NOT-SSTR2 | 0.962025 | 0.926829 | 1 |
| ASGR1 AND CD34 AND NOT-ITGB6 | 0.909091 | 1 | 0.833333 | MS4A1 AND ERBB3 AND NOT-MLC1 | 0.918919 | 0.944444 | 0.894737 |
| ASGR1 AND CD34 AND NOT-ABCB5 | 0.909091 | 1 | 0.833333 | MS4A1 AND PCDHAC2 AND NOT-DDX3X | 0.926829 | 0.863636 | 1 |
| ASGR1 AND EPHB2 AND NOT-ITGB6 | 0.909091 | 1 | 0.833333 | MS4A1 AND CATSPERD AND NOT-TNFRSF8 | 0.948718 | 0.925 | 0.973684 |
| SLC7A9 AND SEMA5B AND NOT-TPBG | 0.857143 | 0.75 | 1 | MS4A1 AND MC2R AND NOT-TNFRSF8 | 0.936709 | 0.902439 | 0.973684 |
| SLC7A9 AND ERBB3 AND NOT-TPBG | 0.833333 | 0.833333 | 0.833333 | MS4A1 AND KCNA1 AND NOT-TNFRSF8 | 0.948718 | 0.925 | 0.973684 |
| SDC1 AND NOT-FXYD3 AND NOT-IL13RA2 | 0.833333 | 0.833333 | 0.833333 | MS4A1 AND TMEM235 AND NOT-TNFRSF8 | 0.925 | 0.880952 | 0.973684 |
| FGG AND ERBB3 AND NOT-CD79B | 0.833333 | 0.833333 | 0.833333 | MS4A1 AND ADCY10 AND NOT-CD160 | 0.987013 | 0.974359 | 1 |
| ASGR1 AND MAGEA1 AND NOT-ITGB6 | 0.909091 | 1 | 0.833333 | MS4A1 AND DCC AND NOT-TNFRSF8 | 0.948718 | 0.925 | 0.973684 |
| SEMA5B AND SDC1 AND NOT-FXYD3 | 1 | 1 | 1 | MS4A1 AND DTNA AND NOT-TNFRSF8 | 0.948718 | 0.925 | 0.973684 |
| AFP AND HM13 AND NOT-IL20RA | 0.909091 | 1 | 0.833333 | MS4A1 AND SLC30A8 AND NOT-DDX3X | 0.926829 | 0.863636 | 1 |
| ERBB3 AND NOT-IL20RA AND SDC4 | 0.833333 | 0.833333 | 0.833333 | MS4A1 AND NMUR2 AND NOT-TNFRSF8 | 0.936709 | 0.902439 | 0.973684 |
| ERBB3 AND NOT-SCNN1B AND SDC1 | 0.909091 | 1 | 0.833333 | MS4A1 AND NOT-CLDN8 AND OR52D1 | 0.936709 | 0.902439 | 0.973684 |
| SLC7A9 AND NOT-TPBG AND EPHB2 | 0.8 | 0.666667 | 1 | MS4A1 AND PCDHAC2 AND NOT-CLDN8 | 0.925 | 0.880952 | 0.973684 |
| CLDN1 AND NOT-IL20RA AND HM13 | 0.8 | 1 | 0.666667 | MS4A1 AND NOT-CLDN8 AND FGF6 | 0.925 | 0.880952 | 0.973684 |
| SEMA5B AND SDC1 AND NOT-ACPP | 1 | 1 | 1 | MS4A1 AND NOT-CLDN8 AND SLC22A14 | 0.948718 | 0.925 | 0.973684 |
| SEMA5B AND SDC1 AND NOT-SCNN1B | 1 | 1 | 1 | MS4A1 AND NOT-SSTR2 AND FGF6 | 0.926829 | 0.863636 | 1 |
| SEMA5B AND NOT-MAL AND SDC1 | 0.923077 | 0.857143 | 1 | COMPLEX-NMUR2/MS4A1/CD70 | 0.95 | 0.904762 | 1 |
| ERBB3 AND NOT-PLP1 AND EDNRB | 0.833333 | 0.833333 | 0.833333 | MS4A1 AND SDC1 AND NOT-PTGER4 | 0.915663 | 0.844444 | 1 |
| SDC1 AND NOT-SCNN1B AND NOT-IL13RA2 | 0.909091 | 1 | 0.833333 | MS4A1 AND ADCY10 AND NOT-PSCA | 0.915663 | 0.844444 | 1 |
| SLC7A9 AND CD72 AND NOT-TPBG | 0.833333 | 0.833333 | 0.833333 | MS4A1 AND ADCY10 AND NOT-SST | 0.915663 | 0.844444 | 1 |
| SLC7A9 AND SEMA5B AND CD70 | 0.923077 | 0.857143 | 1 | MS4A1 AND SLC22A18 AND NOT-SSTR2 | 0.915663 | 0.844444 | 1 |
| SLC2A8 AND CLDN1 AND NOT-IL20RA | 0.8 | 1 | 0.666667 | MS4A1 AND ERBB3 AND NOT-SLC28A1 | 0.915663 | 0.844444 | 1 |
| SDC1 AND NOT-SCNN1B AND SSTR5 | 0.8 | 1 | 0.666667 | MS4A1 AND ADCY10 AND NOT-ALK | 0.914286 | 1 | 0.842105 |
| FGG AND CD79B AND NOT-CEACAM5 | 0.909091 | 1 | 0.833333 | MS4A1 AND ADAM20 AND NOT-CLDN8 | 0.91358 | 0.860465 | 0.973684 |
| SLC2A8 AND NOT-ITGB6 AND ERBB3 | 0.909091 | 1 | 0.833333 | MS4A1 AND NOT-CLDN8 AND OR7C1 | 0.91358 | 0.860465 | 0.973684 |
| CD70 AND NOT-KIAA1324 AND CLDN3 | 0.833333 | 0.833333 | 0.833333 | MS4A1 AND SLC30A8 AND NOT-MUC4 | 0.91358 | 0.860465 | 0.973684 |
| FGG AND DDX3X AND CD79B | 0.8 | 1 | 0.666667 | MS4A1 AND NOT-SSTR2 AND SLC30A8 | 0.962025 | 0.926829 | 1 |

FIG. 15 (cont.)

| Antigen Pair Logic | F1 | Precision | Recall |
|---|---|---|---|
| SDC1 AND NOT-SCNN1B AND CD34 | 0.8 | 1 | 0.666667 |
| SLC2A8 AND ERBB3 AND NOT-IL20RA | 0.909091 | 1 | 0.833333 |
| AFP AND EPHB2 AND SLC40A1 | 0.909091 | 1 | 0.833333 |
| SLC7A9 AND CD70 AND BIRC5 | 0.8 | 0.666667 | 1 |
| FGG AND CD79B AND ITGAV | 0.8 | 1 | 0.666667 |
| ERBB3 AND NOT-CLDN8 AND SDC4 | 0.909091 | 1 | 0.833333 |
| SLC7A9 AND NOT-TPBG AND DDX3X | 0.8 | 1 | 0.666667 |
| SLC2A8 AND ERBB3 AND NOT-CLDN8 | 0.909091 | 1 | 0.833333 |
| SLC7A9 AND CD276 AND NOT-TPBG | 0.909091 | 1 | 0.833333 |
| AFP AND SLC2A8 AND NOT-IL20RA | 0.909091 | 1 | 0.833333 |
| AFP AND NOT-PRIMA1 AND CD70 | 0.833333 | 0.833333 | 0.833333 |
| AFP AND SLC2A8 AND NOT-ERBB4 | 0.909091 | 1 | 0.833333 |
| SLC2A8 AND NOT-ITGB6 AND CLDN3 | 0.833333 | 0.833333 | 0.833333 |
| SDC1 AND NOT-SCNN1B AND CLEC14A | 0.8 | 1 | 0.666667 |
| SDC1 AND NOT-SCNN1B AND THY1 | 0.8 | 1 | 0.666667 |
| SDC1 AND NOT-SCNN1B AND VTCN1 | 0.8 | 1 | 0.666667 |
| SLC7A9 AND NOT-EPCAM AND CD70 | 0.8 | 1 | 0.666667 |
| SDC1 AND NOT-SCNN1B AND TNFRSF8 | 0.8 | 1 | 0.666667 |
| SLC2A8 AND CLDN1 AND NOT-CLDN8 | 0.8 | 1 | 0.666667 |
| ERBB3 AND NOT-PRIMA1 AND EDNRB | 0.833333 | 0.833333 | 0.833333 |
| ASGR1 AND GPC3 AND ULBP2 | 0.8 | 1 | 0.666667 |
| SLC2A8 AND NOT-MUC1 AND CLDN3 | 0.833333 | 0.833333 | 0.833333 |
| SLC2A8 AND ERBB3 AND NOT-MUC1 | 0.909091 | 1 | 0.833333 |
| SLC2A8 AND CLDN1 AND NOT-MUC1 | 0.8 | 1 | 0.666667 |
| CLDN2 AND SLC2A8 AND NOT-MUC1 | 0.909091 | 1 | 0.833333 |
| SLC2A8 AND NOT-MUC1 AND SDC1 | 1 | 1 | 1 |
| SLC2A8 AND NOT-MUC1 AND CLDN12 | 0.8 | 1 | 0.666667 |
| SLC2A8 AND NOT-MUC1 AND CLDN7 | 0.833333 | 0.833333 | 0.833333 |
| SDC1 AND NOT-ACPP AND MSLN | 0.8 | 0.666667 | 1 |
| SLC2A8 AND NOT-MUC1 AND ERBB2 | 0.8 | 0.666667 | 1 |
| SDC1 AND SLC20A1 AND NOT-MUC1 | 1 | 1 | 1 |
| SLC40A1 AND NOT-MUC1 AND SSTR1 | 0.8 | 1 | 0.666667 |
| SDC1 AND SLC40A1 AND NOT-MUC1 | 0.857143 | 0.75 | 1 |
| CLDN1 AND SLC40A1 AND NOT-MUC1 | 0.8 | 1 | 0.666667 |
| ASGR1 AND SLC26A6 AND ATP1B1 | 1 | 1 | 1 |
| ASGR1 AND TMPRSS5 AND NOT-CLEC4G | 1 | 1 | 1 |
| ASGR1 AND HM13 AND NOT-CYBB | 1 | 1 | 1 |
| ASGR1 AND HM13 AND NOT-EVI2B | 1 | 1 | 1 |
| ASGR1 AND SLC7A11 AND NOT-KCNN2 | 1 | 1 | 1 |
| ASGR1 AND SLC7A11 AND NOT-SLC41A2 | 1 | 1 | 1 |
| ASGR1 AND HM13 AND NOT-IGSF6 | 1 | 1 | 1 |
| ASGR1 AND SLC52A2 AND NOT-CD300A | 1 | 1 | 1 |
| ASGR1 AND SLC52A2 AND NOT-EVI2B | 1 | 1 | 1 |
| SLC7A9 AND SLC26A6 AND NOT-ITGA3 | 1 | 1 | 1 |
| ASGR1 AND HM13 AND NOT-CR1 | 1 | 1 | 1 |
| ASGR1 AND SLC7A11 AND NOT-SLC41A2 | 1 | 1 | 1 |
| FGG AND NOT-MARCO AND SLC39A1 | 1 | 1 | 1 |
| HPN AND NOT-MARCO AND DAGLB | 1 | 1 | 1 |
| HPN AND SLC26A6 AND NOT-NTSR1 | 1 | 1 | 1 |
| HPN AND SLC26A6 AND NOT-NPY2R | 1 | 1 | 1 |
| HPN AND SLC26A6 AND NOT-TREM2 | 1 | 1 | 1 |
| HPN AND SLC26A6 AND NOT-P2RY13 | 1 | 1 | 1 |
| HPN AND SLC26A6 AND NOT-PMP22 | 1 | 1 | 1 |
| HPN AND SLC26A6 AND NOT-TMEM8B | 1 | 1 | 1 |
| HPN AND SLC26A6 AND NOT-SLC22A17 | 1 | 1 | 1 |
| HPN AND SLC26A6 AND NOT-MAL | 1 | 1 | 1 |
| HPN AND SLC26A6 AND NOT-CLEC1A | 1 | 1 | 1 |
| HPN AND SLC26A6 AND NOT-SDF4 | 1 | 1 | 1 |
| HPN AND SLC26A6 AND NOT-CLEC4A | 1 | 1 | 1 |
| HPN AND SLC26A6 AND NOT-LRP5 | 1 | 1 | 1 |
| HPN AND NOT-MARCO AND IFNGR2 | 1 | 1 | 1 |
| HPN AND SLC26A6 AND NOT-SLC7A11 | 1 | 1 | 1 |
| HPN AND SLC26A6 AND NOT-TPSG1 | 1 | 1 | 1 |
| HPN AND SLC26A6 AND NOT-PCDH17 | 1 | 1 | 1 |
| HPN AND SLC26A6 AND NOT-OR5J2 | 1 | 1 | 1 |
| HPN AND SLC26A6 AND NOT-DLL1 | 1 | 1 | 1 |
| HPN AND SLC26A6 AND NOT-GRIA2 | 1 | 1 | 1 |
| HPN AND SLC26A6 AND NOT-GYPA | 1 | 1 | 1 |
| HPN AND SLC26A6 AND NOT-MR1 | 1 | 1 | 1 |
| HPN AND SLC26A6 AND NOT-IL1RAP | 1 | 1 | 1 |
| HPN AND SLC26A6 AND NOT-AQP1 | 1 | 1 | 1 |
| HPN AND SLC26A6 AND NOT-AQP3 | 1 | 1 | 1 |
| HPN AND SLC26A6 AND NOT-KCNJ3 | 1 | 1 | 1 |
| HPN AND SLC26A6 AND NOT-KCNS1 | 1 | 1 | 1 |
| HPN AND SLC26A6 AND NOT-CLEC12B | 1 | 1 | 1 |
| HPN AND SLC26A6 AND NOT-SYT15 | 1 | 1 | 1 |
| HPN AND SLC26A6 AND NOT-TM2D1 | 1 | 1 | 1 |

| Antigen Pair Logic | F1 | Precision | Recall |
|---|---|---|---|
| MS4A1 AND ADCY10 AND NOT-ULBP1 | 1 | 1 | 1 |
| MS4A1 AND ADCY10 AND NOT-MST1R | 0.933333 | 0.945946 | 0.921053 |
| MS4A1 AND ERBB3 AND NOT-CALHM3 | 0.91358 | 0.860465 | 0.973684 |
| MS4A1 AND P2RX3 AND NOT-TNFRSF8 | 0.961039 | 0.948718 | 0.973684 |
| MS4A1 AND NOT-TNFRSF8 AND OR7C1 | 0.936709 | 0.902439 | 0.973684 |
| MS4A1 AND NOT-TNFRSF8 AND ZACN | 0.925 | 0.880952 | 0.973684 |
| MS4A1 AND PRND AND NOT-DDX3X | 0.938272 | 0.883721 | 1 |
| MS4A1 AND NOT-TNFRSF8 AND KCNJ9 | 0.925 | 0.880952 | 0.973684 |
| MS4A1 AND ERBB3 AND NOT-PTGER4 | 0.911392 | 0.878049 | 0.947368 |
| MS4A1 AND ADCY10 AND NOT-SSTR1 | 0.911392 | 0.878049 | 0.947368 |
| MS4A1 AND ADCY10 AND NOT-IGF1R | 0.911392 | 0.878049 | 0.947368 |
| MS4A1 AND NOT-CLDN8 AND GRM6 | 0.936709 | 0.902439 | 0.973684 |
| MS4A1 AND ADCY10 AND NOT-SLC39A6 | 0.926829 | 0.863636 | 1 |
| MS4A1 AND NOT-CLDN8 AND OPALIN | 0.925 | 0.880952 | 0.973684 |
| MS4A1 AND NOT-SSTR2 AND P2RX3 | 0.915663 | 0.844444 | 1 |
| MS4A1 AND PCDHAC2 AND NOT-MST1R | 0.909091 | 0.897436 | 0.921053 |
| MS4A1 AND NOT-SSTR2 AND PRND | 0.926829 | 0.863636 | 1 |
| MS4A1 AND ADCY10 AND NOT-ANXA1 | 0.916667 | 0.970588 | 0.868421 |
| MS4A1 AND SDC1 AND NOT-MLC1 | 0.906667 | 0.918919 | 0.894737 |
| MS4A1 AND NOT-SSTR2 AND ADAM20 | 0.926829 | 0.863636 | 1 |
| MS4A1 AND GPR156 AND NOT-DDX3X | 0.938272 | 0.883721 | 1 |
| MS4A1 AND CCKBR AND NOT-DDX3X | 0.938272 | 0.883721 | 1 |
| MS4A1 AND NOT-TNFRSF8 AND OPALIN | 0.936709 | 0.902439 | 0.973684 |
| COMPLEX-EDNRB/LAPTM5/CD19 | 0.898551 | 1 | 0.815789 |
| CD19 AND PTGIS AND NOT-ITGB3 | 0.830769 | 1 | 0.710526 |
| MS4A1 AND STRA6 AND NOT-ITGB3 | 0.974359 | 0.95 | 1 |
| MS4A1 AND MARVELD2 AND NOT-ITGB3 | 0.974359 | 0.95 | 1 |
| MS4A1 AND STRA6 AND NOT-NCAM1 | 0.987013 | 0.974359 | 1 |
| CLECL1 AND NOT-CLDN2 AND NOT-CD160 | 0.974359 | 0.95 | 1 |
| CLECL1 AND NOT-CLDN2 AND NOT-CD33 | 0.962025 | 0.926829 | 1 |
| MS4A1 AND MRGPRX4 AND NOT-DDX3X | 0.962025 | 0.926829 | 1 |
| MS4A1 AND STRA6 AND NOT-TNFRSF8 | 0.961039 | 0.948718 | 0.973684 |
| COMPLEX-CLECL1/ITGB3/CD34 | 0.987013 | 0.974359 | 1 |
| MS4A1 AND MARVELD2 AND NOT-NCAM1 | 0.987013 | 0.974359 | 1 |
| MS4A1 AND MARVELD2 AND NOT-TNFRSF8 | 0.961039 | 0.948718 | 0.973684 |
| COMPLEX-CLECL1/ITGB3/TPBG | 0.987013 | 0.974359 | 1 |
| COMPLEX-CLECL1/ITGB3/CLDN2 | 0.987013 | 0.974359 | 1 |
| COMPLEX-CLECL1/ITGB3/CA9 | 0.987013 | 0.974359 | 1 |
| CLECL1 AND NOT-CLDN2 AND NOT-HSPA5 | 0.96 | 0.972973 | 0.947368 |
| MS4A1 AND DPP4 AND NOT-ITGB3 | 0.962025 | 0.926829 | 1 |
| CLECL1 AND NOT-SSTR1 AND NOT-CD33 | 0.962025 | 0.926829 | 1 |
| MS4A1 AND SLC12A4 AND NOT-ITGB3 | 0.962025 | 0.926829 | 1 |
| CLECL1 AND NOT-SSTR1 AND NOT-CD160 | 0.974359 | 0.95 | 1 |
| CLECL1 AND NOT-CLDN2 AND TNFRSF13C | 0.962025 | 0.926829 | 1 |
| MS4A1 AND MRGPRX4 AND NOT-NCAM1 | 0.987013 | 0.974359 | 1 |
| MS4A1 AND NDRG4 AND NOT-NCAM1 | 0.974359 | 0.95 | 1 |
| CLECL1 AND NOT-CLDN2 AND NOT-ALDH1A1 | 0.95 | 0.904762 | 1 |
| MS4A1 AND NDRG4 AND NOT-ITGB3 | 0.95 | 0.904762 | 1 |
| MS4A1 AND CLECL1 AND NOT-CLDN2 | 0.95 | 0.904762 | 1 |
| MS4A1 AND MRGPRX4 AND NOT-TNFRSF8 | 0.948718 | 0.925 | 0.973684 |
| CLECL1 AND NOT-MST1R AND NOT-CD160 | 0.974359 | 0.95 | 1 |
| CLECL1 AND NOT-MST1R AND NOT-CD33 | 0.974359 | 0.95 | 1 |
| MS4A1 AND SLC47A2 AND NOT-ITGB3 | 0.962025 | 0.926829 | 1 |
| MS4A1 AND TNFRSF18 AND NOT-ITGB3 | 0.974359 | 0.95 | 1 |
| MS4A1 AND DPP4 AND NOT-TNFRSF8 | 0.948718 | 0.925 | 0.973684 |
| MS4A1 AND SLC12A4 AND NOT-TNFRSF8 | 0.948718 | 0.925 | 0.973684 |
| CLECL1 AND NOT-MST1R AND NOT-HSPA5 | 0.945946 | 0.972222 | 0.921053 |
| CLECL1 AND NOT-SSTR1 AND NOT-HSPA5 | 0.945946 | 0.972222 | 0.921053 |
| CLECL1 AND NOT-ITGB3 AND EDNRB | 0.945946 | 0.972222 | 0.921053 |
| CLECL1 AND NOT-NCAM1 AND EDNRB | 0.945946 | 0.972222 | 0.921053 |
| MS4A1 AND STRA6 AND NOT-PSCA | 0.962025 | 0.926829 | 1 |
| MS4A1 AND ST14 AND ERBB3 | 0.944444 | 1 | 0.894737 |
| MS4A1 AND STRA6 AND NOT-SSTR2 | 0.962025 | 0.926829 | 1 |
| MS4A1 AND RHBDL1 AND NOT-ITGB3 | 0.962025 | 0.926829 | 1 |
| MS4A1 AND SLC5A9 AND NOT-ITGB3 | 0.95 | 0.904762 | 1 |
| MS4A1 AND LRRC32 AND NOT-ITGB3 | 0.95 | 0.904762 | 1 |
| MS4A1 AND TIE1 AND NOT-ITGB3 | 0.962025 | 0.926829 | 1 |
| MS4A1 AND TNFRSF18 AND NOT-TNFRSF8 | 0.961039 | 0.948718 | 0.973684 |
| MS4A1 AND NGFR AND NOT-ITGB3 | 0.95 | 0.904762 | 1 |
| MS4A1 AND STRA6 AND NOT-CD33 | 0.974359 | 0.95 | 1 |
| MS4A1 AND EDNRA AND NOT-ITGB3 | 0.974359 | 0.95 | 1 |
| MS4A1 AND SLC47A2 AND NOT-TNFRSF8 | 0.948718 | 0.925 | 0.973684 |
| MS4A1 AND STRA6 AND NOT-CD160 | 0.974359 | 0.95 | 1 |
| MS4A1 AND ERBB2 AND NOT-PTGDR2 | 0.961039 | 0.948718 | 0.973684 |
| MS4A1 AND MARVELD2 AND NOT-DDX3X | 0.938272 | 0.883721 | 1 |
| MS4A1 AND ERBB3 AND NOT-PTGDR2 | 0.938272 | 0.883721 | 1 |
| MS4A1 AND STRA6 AND NOT-DDX3X | 0.938272 | 0.883721 | 1 |

FIG. 15 (cont.)

| Antigen Pair Logic | F1 | Precision | Recall |
|---|---|---|---|
| HPN AND SLC26A6 AND NOT-SLC41A2 | 1 | 1 | 1 |
| HPN AND SLC26A6 AND NOT-DISP1 | 1 | 1 | 1 |
| HPN AND SLC26A6 AND NOT-DCHS1 | 1 | 1 | 1 |
| HPN AND SLC26A6 AND NOT-SYT8 | 1 | 1 | 1 |
| HPN AND SLC26A6 AND NOT-SLC16A3 | 1 | 1 | 1 |
| ASGR1 AND ADCY6 AND NOT-SIGLEC1 | 1 | 1 | 1 |
| HPN AND SLC26A6 AND NOT-CD101 | 1 | 1 | 1 |
| HPN AND SLC26A6 AND NOT-NCR2 | 1 | 1 | 1 |
| HPN AND NOT-MARCO AND GPC3 | 1 | 1 | 1 |
| FGG AND SLC26A6 AND NOT-MUC1 | 0.923077 | 0.857143 | 1 |
| FGG AND NCSTN AND NOT-MSLN | 1 | 1 | 1 |
| FGG AND NCSTN AND NOT-TNFRSF10A | 1 | 1 | 1 |
| FGG AND NCSTN AND NOT-MUC1 | 1 | 1 | 1 |
| FGG AND FGFRL1 AND NOT-MSLN | 1 | 1 | 1 |
| ASGR1 AND MMP14 AND NOT-MSLN | 0.923077 | 0.857143 | 1 |
| HPN AND NOT-MARCO AND MSLN | 0.857143 | 0.75 | 1 |
| COMPLEX-FGG/MUC1/MARCO | 0.857143 | 0.75 | 1 |
| HPN AND MRAP2 AND NOT-MSLN | 0.857143 | 0.75 | 1 |
| ASGR1 AND SLC26A6 AND GPC3 | 0.909091 | 1 | 0.833333 |
| HPN AND TMPRSS5 AND NOT-MUC1 | 0.857143 | 0.75 | 1 |
| FGG AND NOT-MARCO AND MSLN | 0.857143 | 0.75 | 1 |
| FGG AND SLC7A11 AND NOT-MUC1 | 1 | 1 | 1 |
| HPN AND ASIC5 AND NOT-MSLN | 0.857143 | 0.75 | 1 |
| HPN AND ASIC5 AND NOT-MUC1 | 0.857143 | 0.75 | 1 |
| HPN AND ASIC5 AND NOT-TNFRSF10A | 0.857143 | 0.75 | 1 |
| SLC7A9 AND SLC26A6 AND NOT-MUC1 | 1 | 1 | 1 |
| ASGR1 AND NOT-KCNN2 AND MSLN | 1 | 1 | 1 |
| HPN AND NOT-SLC41A2 AND MSLN | 0.857143 | 0.75 | 1 |
| ASGR1 AND NOT-KCNN2 AND MSLN | 1 | 1 | 1 |
| ASGR1 AND SLC26A6 AND MSLN | 0.923077 | 0.857143 | 1 |
| ASGR1 AND SLC26A6 AND MSLN | 0.923077 | 0.857143 | 1 |
| ASGR1 AND SLC4A11 AND NOT-MSLN | 0.833333 | 0.833333 | 0.833333 |
| FGG AND SLC7A11 AND TNFRSF10A | 1 | 1 | 1 |
| HPN AND SLC5A5 AND NOT-MUC1 | 1 | 1 | 1 |
| FGG AND SLC7A11 AND NOT-MSLN | 1 | 1 | 1 |
| COMPLEX-FGG/GPC3/KCNT1 | 0.909091 | 1 | 0.833333 |
| ASGR1 AND HM13 AND MSLN | 1 | 1 | 1 |
| FGG AND ATP13A1 AND NOT-MSLN | 1 | 1 | 1 |
| COMPLEX-FGG/GPC3/CHRNA10 | 0.909091 | 1 | 0.833333 |
| ASGR1 AND HM13 AND MSLN | 1 | 1 | 1 |
| FGG AND SLC2A8 AND MSLN | 1 | 1 | 1 |
| HPN AND NOT-ASGR1 AND MSLN | 0.857143 | 0.75 | 1 |
| HPN AND NOT-ASGR1 AND MSLN | 0.857143 | 0.75 | 1 |
| APOB AND SLC2A8 AND NOT-MUC1 | 0.909091 | 1 | 0.833333 |
| SEMA4G AND NOT-MUC1 AND SLC2A8 | 0.909091 | 1 | 0.833333 |
| ASGR1 AND NOT-FCGR3B AND MSLN | 0.857143 | 0.75 | 1 |
| ASGR1 AND SLC12A7 AND MSLN | 0.909091 | 1 | 0.833333 |
| ASGR1 AND ATP6V0A1 AND NOT-MUC1 | 1 | 1 | 1 |
| FGG AND VN1R1 AND NOT-MUC1 | 0.857143 | 0.75 | 1 |
| ASGR1 AND SLC52A2 AND NOT-TNFRSF10A | 0.8 | 0.666667 | 1 |
| ASGR1 AND NOT-GPR182 AND MSLN | 0.8 | 1 | 0.666667 |
| ASGR1 AND ATP13A1 AND NOT-TNFRSF10A | 0.8 | 0.666667 | 1 |
| SLC7A9 AND TMEM67 AND NOT-MUC1 | 0.8 | 0.666667 | 1 |
| ASGR1 AND GPC3 AND CD200 | 0.8 | 1 | 0.666667 |
| ASGR1 AND GPC3 AND HM13 | 0.8 | 1 | 0.666667 |
| ASGR1 AND NOT-KCNN2 AND NOT-TNFRSF10A | 0.8 | 0.666667 | 1 |
| FGG AND MRAP2 AND GPC3 | 0.8 | 1 | 0.666667 |
| ASGR1 AND NOT-STAB2 AND MSLN | 0.8 | 1 | 0.666667 |
| ASGR1 AND TNFRSF19 AND NOT-MSLN | 0.8 | 1 | 0.666667 |
| ASGR1 AND GPC3 AND NOT-VSIG2 | 0.8 | 1 | 0.666667 |
| ASGR1 AND NOT-CLEC4M AND MSLN | 0.8 | 1 | 0.666667 |
| FGG AND TNFSF4 AND MSLN | 0.923077 | 0.857143 | 1 |
| FGG AND SLC7A11 AND GPC3 | 0.8 | 1 | 0.666667 |
| ASGR1 AND NOT-CLEC4G AND MSLN | 0.8 | 1 | 0.666667 |
| FGG AND ATP6V0A1 AND TNFRSF10A | 0.8 | 1 | 0.666667 |
| ASGR1 AND HM13 AND NOT-TNFRSF10A | 0.8 | 0.666667 | 1 |
| ASGR1 AND NOT-CLEC1B AND MSLN | 0.8 | 1 | 0.666667 |
| ASGR1 AND GPC3 AND NOT-KCNN2 | 0.8 | 1 | 0.666667 |
| ASGR1 AND VN1R1 AND NOT-TNFRSF10A | 0.8 | 0.666667 | 1 |
| CNNM3 AND MERTK AND NOT-MUC1 | 0.8 | 0.666667 | 1 |
| ASGR1 AND NOT-PTH1R AND MSLN | 0.8 | 1 | 0.666667 |
| FGG AND NOT-MARCO AND GPC3 | 0.8 | 1 | 0.666667 |
| ASGR1 AND GPC3 AND WDR19 | 0.8 | 1 | 0.666667 |
| FGG AND TNFRSF10A AND OR51M1 | 0.8 | 1 | 0.666667 |
| ASGR1 AND GPC3 AND GRPR | 0.8 | 1 | 0.666667 |
| FGG AND ATP13A1 AND TNFRSF10A | 0.8 | 1 | 0.666667 |
| ITPR2 AND NOT-MUC1 AND SLC2A8 | 0.909091 | 1 | 0.833333 |

| Antigen Pair Logic | F1 | Precision | Recall |
|---|---|---|---|
| MS4A1 AND ERBB3 AND NOT-PTGDR2 | 0.938272 | 0.883721 | 1 |
| CLECL1 AND NOT-MST1R AND NOT-DDX3X | 0.938272 | 0.883721 | 1 |
| MS4A1 AND CLECL1 AND NOT-BMPR1B | 0.95 | 0.904762 | 1 |
| MS4A1 AND NOT-KCNG2 AND SDC1 | 0.987013 | 0.974359 | 1 |
| MS4A1 AND NDRG4 AND NOT-TNFRSF8 | 0.936709 | 0.902439 | 0.973684 |
| MS4A1 AND ERBB2 AND NOT-HM13 | 0.936709 | 0.902439 | 0.973684 |
| MS4A1 AND NOT-TGOLN2 AND IL11RA | 0.936709 | 0.902439 | 0.973684 |
| MS4A1 AND MARVELD2 AND NOT-SSTR2 | 0.95 | 0.904762 | 1 |
| MS4A1 AND MRGPRX4 AND NOT-SSTR2 | 0.962025 | 0.926829 | 1 |
| MS4A1 AND NOT-TGOLN2 AND ERBB2 | 0.948718 | 0.925 | 0.973684 |
| MS4A1 AND STRA6 AND NOT-ULBP1 | 0.987013 | 0.974359 | 1 |
| MS4A1 AND STRA6 AND NOT-CLDN8 | 0.973684 | 0.973684 | 0.973684 |
| MS4A1 AND TIE1 AND NOT-CLDN8 | 0.961039 | 0.948718 | 0.973684 |
| MS4A1 AND SLC47A2 AND NOT-CLDN8 | 0.936709 | 0.902439 | 0.973684 |
| MS4A1 AND LRRC32 AND NOT-CLDN8 | 0.961039 | 0.948718 | 0.973684 |
| MS4A1 AND NOT-CLDN8 AND KCNK1 | 0.961039 | 0.948718 | 0.973684 |
| MS4A1 AND MARVELD2 AND NOT-CLDN8 | 0.961039 | 0.948718 | 0.973684 |
| MS4A1 AND ERBB3 AND NOT-GP9 | 0.938272 | 0.883721 | 1 |
| MS4A1 AND KIR2DL4 AND NOT-ITGB3 | 0.95 | 0.904762 | 1 |
| MS4A1 AND NGFR AND NOT-TNFRSF8 | 0.936709 | 0.902439 | 0.973684 |
| MS4A1 AND ERBB3 AND NOT-PTPRA | 0.938272 | 0.883721 | 1 |
| MS4A1 AND MARVELD2 AND NOT-CD160 | 0.974359 | 0.95 | 1 |
| MS4A1 AND RHBDL1 AND NOT-TNFRSF8 | 0.948718 | 0.925 | 0.973684 |
| MS4A1 AND MARVELD2 AND NOT-CD33 | 0.974359 | 0.95 | 1 |
| MS4A1 AND OR51E1 AND NOT-ITGB3 | 0.962025 | 0.926829 | 1 |
| MS4A1 AND LRRC32 AND NOT-TNFRSF8 | 0.936709 | 0.902439 | 0.973684 |
| MS4A1 AND NOT-CYBB AND PCYT1A | 0.944444 | 1 | 0.894737 |
| MS4A1 AND SDC1 AND NOT-PTPRA | 0.936709 | 0.902439 | 0.973684 |
| MS4A1 AND TIE1 AND NOT-TNFRSF8 | 0.948718 | 0.925 | 0.973684 |
| MS4A1 AND ERBB3 AND NOT-GP9 | 0.938272 | 0.883721 | 1 |
| MS4A1 AND AOC2 AND NOT-ITGB3 | 0.95 | 0.904762 | 1 |
| MS4A1 AND ITPR2 AND NOT-ITGB3 | 0.974359 | 0.95 | 1 |
| MS4A1 AND SDC1 AND NOT-PTGDR2 | 0.95 | 0.904762 | 1 |
| MS4A1 AND CLDN2 AND NOT-PTGDR2 | 0.947368 | 0.947368 | 0.947368 |
| MS4A1 AND SDC1 AND NOT-SLC16A10 | 0.936709 | 0.902439 | 0.973684 |
| MS4A1 AND SDC1 AND NOT-PTGDR2 | 0.95 | 0.904762 | 1 |
| MS4A1 AND ERBB3 AND NOT-PAG1 | 0.938272 | 0.883721 | 1 |
| MS4A1 AND EDNRA AND NOT-TNFRSF8 | 0.961039 | 0.948718 | 0.973684 |
| MS4A1 AND KCNK1 AND NOT-ITGB3 | 0.962025 | 0.926829 | 1 |
| CLECL1 AND NOT-CLDN2 AND NOT-ANXA1 | 0.931507 | 0.971429 | 0.894737 |
| MS4A1 AND ERBB2 AND NOT-GP9 | 0.961039 | 0.948718 | 0.973684 |
| MS4A1 AND PPAP2A AND NOT-ITGB3 | 0.947368 | 0.947368 | 0.947368 |
| MS4A1 AND KCNN4 AND ERBB3 | 0.987013 | 0.974359 | 1 |
| MS4A1 AND MUC16 AND NOT-PTGDR2 | 0.938272 | 0.883721 | 1 |
| MS4A1 AND CELSR1 AND ERBB3 | 0.987013 | 0.974359 | 1 |
| MS4A1 AND MARVELD2 AND NOT-ULBP1 | 0.974359 | 0.95 | 1 |
| MS4A1 AND NOT-TGOLN2 AND TNFRSF10A | 0.926829 | 0.863636 | 1 |
| NOT-LRIG3 AND NOT-DYSF AND SEMA4B | 0.883117 | 0.871795 | 0.894737 |
| LAPTM5 AND NOT-SORL1 AND NOT-GHR | 0.813187 | 0.698113 | 0.973684 |
| NOT-LRIG3 AND CLDN15 AND NOT-DYSF | 0.818182 | 0.964286 | 0.710526 |
| LAPTM5 AND NOT-SORL1 AND NOT-EFNB2 | 0.813187 | 0.698113 | 0.973684 |
| LAPTM5 AND NOT-SORL1 AND NOT-PHLDB2 | 0.822222 | 0.711538 | 0.973684 |
| CLDN15 AND NOT-GHR AND NOT-DYSF | 0.80597 | 0.931034 | 0.710526 |
| NOT-SYT6 AND ADCY10 AND NOT-DYSF | 0.864865 | 0.888889 | 0.842105 |
| NOT-SLC39A2 AND NOT-DYSF AND ADCY10 | 0.918919 | 0.944444 | 0.894737 |
| CD19 AND NOT-CD1A AND NOT-PAG1 | 0.914286 | 1 | 0.842105 |
| CD19 AND CLECL1 AND NOT-GALR2 | 0.914286 | 1 | 0.842105 |
| CD19 AND CLECL1 AND NOT-CD82 | 0.914286 | 1 | 0.842105 |
| COMPLEX-CLECL1/LAPTM5/CD19 | 0.914286 | 1 | 0.842105 |
| COMPLEX-MTUS1/HCN2/CD19 | 0.914286 | 1 | 0.842105 |
| CD19 AND CLECL1 AND NOT-IL17RA | 0.914286 | 1 | 0.842105 |
| CD19 AND PTH1R AND NOT-LYPD1 | 0.914286 | 1 | 0.842105 |
| CD19 AND CLECL1 AND NOT-GPR61 | 0.914286 | 1 | 0.842105 |
| CD19 AND ADCY10 AND NOT-ADCY2 | 0.914286 | 1 | 0.842105 |
| CD19 AND CLECL1 AND NOT-GRID2 | 0.914286 | 1 | 0.842105 |
| CD19 AND ADCY10 AND NOT-SLC39A1 | 0.914286 | 1 | 0.842105 |
| CD19 AND ZP4 AND NOT-SLC2A12 | 0.914286 | 1 | 0.842105 |
| CD19 AND NOT-MS4A2 AND DTNA | 0.914286 | 1 | 0.842105 |
| CD19 AND DTNA AND NOT-SLC2A12 | 0.914286 | 1 | 0.842105 |
| CD19 AND CLECL1 AND NOT-SLC9B1 | 0.914286 | 1 | 0.842105 |
| CD19 AND CLECL1 AND NOT-ATP1B4 | 0.914286 | 1 | 0.842105 |
| CD19 AND ADAM20 AND NOT-SLC2A12 | 0.914286 | 1 | 0.842105 |
| COMPLEX-CLECL1/HTR2C/CD19 | 0.914286 | 1 | 0.842105 |
| COMPLEX-CLECL1/LRRC55/CD19 | 0.914286 | 1 | 0.842105 |
| COMPLEX-TRPV2/LAPTM5/CD19 | 0.914286 | 1 | 0.842105 |
| CD19 AND FGF6 AND NOT-SLC2A12 | 0.914286 | 1 | 0.842105 |
| CD19 AND CLECL1 AND NOT-FMNL1 | 0.914286 | 1 | 0.842105 |

FIG. 15 (cont.)

| Antigen Pair Logic | F1 | Precision | Recall | Antigen Pair Logic | F1 | Precision | Recall |
|---|---|---|---|---|---|---|---|
| FGG AND TNFRSF10A AND MFSD10 | 0.8 | 1 | 0.666667 | CD19 AND P2RX3 AND NOT-SLC2A12 | 0.914286 | 1 | 0.842105 |
| ASGR1 AND GPC3 AND NOT-SCN4B | 0.8 | 1 | 0.666667 | CD19 AND CLECL1 AND NOT-MAG | 0.914286 | 1 | 0.842105 |
| FGG AND TNFRSF10A AND SLC44A2 | 0.8 | 1 | 0.666667 | CD19 AND CCKBR AND NOT-SLC2A12 | 0.914286 | 1 | 0.842105 |
| FGG AND TNFRSF10A AND SLC2A8 | 0.8 | 1 | 0.666667 | COMPLEX-SLC6A16/CD19/SLC22A14 | 0.914286 | 1 | 0.842105 |
| ASGR1 AND GPC3 AND NOT-SLC41A2 | 0.8 | 1 | 0.666667 | CD19 AND SLC17A1 AND SLC25A3 | 0.914286 | 1 | 0.842105 |
| ASGR1 AND GPC3 AND ASIC5 | 0.8 | 1 | 0.666667 | COMPLEX-TIE1/LAPTM5/CD19 | 0.914286 | 1 | 0.842105 |
| FGG AND TNFRSF10A AND CLPTM1 | 0.8 | 1 | 0.666667 | CD19 AND NOT-CD1A AND NOT-CATSPER1 | 0.914286 | 1 | 0.842105 |
| SLC7A9 AND HM13 AND NOT-MUC1 | 1 | 1 | 1 | CD19 AND NOT-GPR61 AND SLC2A6 | 0.914286 | 1 | 0.842105 |
| ASGR1 AND KCNJ12 AND NOT-TNFRSF10A | 0.8 | 0.666667 | 1 | CD19 AND NOT-GPR61 AND OR51B2 | 0.914286 | 1 | 0.842105 |
| ASGR1 AND GPC3 AND DIO3 | 0.8 | 1 | 0.666667 | COMPLEX-PCDH7/LAPTM5/CD19 | 0.898551 | 1 | 0.815789 |
| SLC7A9 AND NOTCH4 AND NOT-MUC1 | 0.923077 | 0.857143 | 1 | CD19 AND ADCY2 AND NOT-SLC13A5 | 0.898551 | 1 | 0.815789 |
| ASGR1 AND GPC3 AND SLC7A14 | 0.8 | 1 | 0.666667 | CD19 AND ABCA8 AND NOT-MOG | 0.898551 | 1 | 0.815789 |
| SLC7A9 AND WDR19 AND NOT-MUC1 | 1 | 1 | 1 | CD19 AND ADCY2 AND NOT-CD207 | 0.898551 | 1 | 0.815789 |
| SLC7A9 AND ASIC5 AND NOT-MUC1 | 0.8 | 0.666667 | 1 | CD19 AND ABCA8 AND NOT-GPR61 | 0.898551 | 1 | 0.815789 |
| ASGR1 AND ACVRL1 AND TNFRSF10A | 0.8 | 1 | 0.666667 | COMPLEX-CFTR/LAPTM5/CD19 | 0.898551 | 1 | 0.815789 |
| SLCO1B1 AND SMPD2 AND NOT-CD79A | 1 | 1 | 1 | COMPLEX-IPH1/LAPTM5/CD19 | 0.898551 | 1 | 0.815789 |
| ABCG5 AND FLVCR1 AND NOT-DPEP1 | 1 | 1 | 1 | CD19 AND PCDH7 AND NOT-SLC39A8 | 0.898551 | 1 | 0.815789 |
| ABCG5 AND FLVCR1 AND NOT-CEACAM5 | 1 | 1 | 1 | CD19 AND CLECL1 AND NOT-LRRC52 | 0.898551 | 1 | 0.815789 |
| ABCG5 AND FLVCR1 AND NOT-GPA33 | 1 | 1 | 1 | CD19 AND KCNJ16 AND NOT-LYPD1 | 0.898551 | 1 | 0.815789 |
| ABCG5 AND FLVCR1 AND NOT-SST | 1 | 1 | 1 | CD19 AND SLC22A14 AND SLC25A3 | 0.914286 | 1 | 0.842105 |
| ABCG5 AND FLVCR1 AND NOT-MST1R | 1 | 1 | 1 | COMPLEX-LAPTM5/TREML2/CD19 | 0.914286 | 1 | 0.842105 |
| ABCG5 AND FLVCR1 AND NOT-GUCY2C | 1 | 1 | 1 | CD19 AND NOT-PTGER4 AND NOT-PARM1 | 0.914286 | 1 | 0.842105 |
| ABCG5 AND FLVCR1 AND NOT-HHLA2 | 1 | 1 | 1 | COMPLEX-LAPTM5/SEMA6D/CD19 | 0.882353 | 1 | 0.789474 |
| ABCG5 AND FLVCR1 AND NOT-MST1R | 1 | 1 | 1 | CD19 AND CD207 AND NOT-HTR4 | 0.882353 | 1 | 0.789474 |
| ABCG5 AND FLVCR1 AND NOT-CEACAM6 | 1 | 1 | 1 | COMPLEX-SLC6A16/GPR61/CD19 | 0.914286 | 1 | 0.842105 |
| ABCG5 AND FLVCR1 AND NOT-GUCY2C | 1 | 1 | 1 | CD19 AND PVRL1 AND NOT-HM13 | 0.882353 | 1 | 0.789474 |
| SLC43A1 AND FLVCR1 AND ALDH1A1 | 1 | 1 | 1 | CD19 AND CLECL1 AND NOT-CHRNA4 | 0.882353 | 1 | 0.789474 |
| SLCO1B1 AND SMPD2 AND NOT-CEACAM5 | 1 | 1 | 1 | CD19 AND ABCA8 AND CATSPER3 | 0.882353 | 1 | 0.789474 |
| ABCG5 AND NOT-CEACAM5 AND SMPD2 | 1 | 1 | 1 | CD19 AND SEMA6D AND NOT-PTPRT | 0.882353 | 1 | 0.789474 |
| SLCO1B1 AND SMPD2 AND NOT-SLAMF7 | 1 | 1 | 1 | CD19 AND PVRL1 AND NOT-CDH26 | 0.882353 | 1 | 0.789474 |
| SLCO1B1 AND SMPD2 AND NOT-TNFRSF1A | 1 | 1 | 1 | CD19 AND GJA3 AND ABCA8 | 0.882353 | 1 | 0.789474 |
| SLCO1B1 AND SMPD2 AND NOT-CEACAM6 | 1 | 1 | 1 | CD19 AND KCNK5 AND NOT-GABRA4 | 0.882353 | 1 | 0.789474 |
| ABCG5 AND NOT-CEACAM6 AND SMPD2 | 1 | 1 | 1 | CD19 AND HTR2B AND NOT-LYPD1 | 0.882353 | 1 | 0.789474 |
| SLCO1B1 AND SMPD2 AND NOT-TNFRSF17 | 1 | 1 | 1 | COMPLEX-ECSCR/LAPTM5/CD19 | 0.848485 | 1 | 0.736842 |
| SLCO1B1 AND SMPD2 AND NOT-FCRL5 | 1 | 1 | 1 | CD19 AND LRRC52 AND NOT-SLC2A12 | 0.848485 | 1 | 0.736842 |
| SLCO1B1 AND SMPD2 AND NOT-CD38 | 1 | 1 | 1 | CD19 AND ECSCR AND NOT-CD207 | 0.848485 | 1 | 0.736842 |
| SLCO1B1 AND SMPD2 AND NOT-ENG | 1 | 1 | 1 | COMPLEX-GGT5/LAPTM5/CD19 | 0.848485 | 1 | 0.736842 |
| SLCO1B1 AND SMPD2 AND NOT-PSCA | 1 | 1 | 1 | CD19 AND GGT5 AND NOT-LYPD1 | 0.848485 | 1 | 0.736842 |
| SLCO1B1 AND SMPD2 AND NOT-P2RX5 | 1 | 1 | 1 | CD19 AND PCDH7 AND NOT-SLC2A1 | 0.848485 | 1 | 0.736842 |
| SLCO1B1 AND SMPD2 AND NOT-EDNRB | 1 | 1 | 1 | CD19 AND MLANA AND NOT-CATSPER1 | 0.848485 | 1 | 0.736842 |
| ABCG5 AND SMPD2 AND NOT-PROM1 | 1 | 1 | 1 | COMPLEX-LAPTM5/CD19/CD28 | 0.848485 | 1 | 0.736842 |
| SLC43A1 AND BIRC5 AND NOT-ABCA12 | 1 | 1 | 1 | CD19 AND PTGIS AND NOT-CNGA3 | 0.830769 | 1 | 0.710526 |
| SLCO1B1 AND SMPD2 AND NOT-AXL | 1 | 1 | 1 | CD19 AND SGCG AND NOT-CD207 | 0.830769 | 1 | 0.710526 |
| SLCO1B1 AND SMPD2 AND NOT-SLC34A2 | 1 | 1 | 1 | CD19 AND PTGIS AND NOT-CDH26 | 0.830769 | 1 | 0.710526 |
| SLCO1B1 AND SMPD2 AND NOT-PROM1 | 1 | 1 | 1 | CD19 AND NAALAD2 AND NOT-CD207 | 0.830769 | 1 | 0.710526 |
| ABCG5 AND SPON2 AND NOT-SLC9A1 | 0.909091 | 1 | 0.833333 | CD19 AND SLC6A1 AND NOT-LYPD1 | 0.830769 | 1 | 0.710526 |
| ABCG5 AND SPON2 AND NOT-CRB1 | 0.909091 | 1 | 0.833333 | CD19 AND PTGIS AND NOT-PAG1 | 0.830769 | 1 | 0.710526 |
| ABCG5 AND SPON2 AND NOT-OXTR | 0.909091 | 1 | 0.833333 | CD19 AND PTGIS AND NOT-HM13 | 0.830769 | 1 | 0.710526 |
| ABCG5 AND SPON2 AND NOT-SLC1A5 | 0.909091 | 1 | 0.833333 | CD19 AND PTGIS AND NOT-ADCY2 | 0.830769 | 1 | 0.710526 |
| ABCG5 AND SPON2 AND NOT-GABRD | 0.909091 | 1 | 0.833333 | CD19 AND PTGIS AND NOT-HTR4 | 0.830769 | 1 | 0.710526 |
| ABCG5 AND SPON2 AND NOT-OR3A2 | 0.909091 | 1 | 0.833333 | CD19 AND PTGIS AND NOT-CORIN | 0.830769 | 1 | 0.710526 |
| ABCG5 AND SPON2 AND NOT-RXFP3 | 0.909091 | 1 | 0.833333 | CD19 AND PTGIS AND LRRC8B | 0.830769 | 1 | 0.710526 |
| SLC2A2 AND SPON2 AND LRRC55 | 0.909091 | 1 | 0.833333 | COMPLEX-ROBO2/LAPTM5/CD19 | 0.830769 | 1 | 0.710526 |
| ABCG5 AND SPON2 AND NOT-EMP3 | 0.909091 | 1 | 0.833333 | COMPLEX-EMB/LAPTM5/CD19 | 0.830769 | 1 | 0.710526 |
| SLCO1B1 AND SPON2 AND NOT-CCKAR | 0.909091 | 1 | 0.833333 | CD19 AND NOT-CD1A AND NOT-SLC2A6 | 0.8125 | 1 | 0.684211 |
| ABCG5 AND SPON2 AND NOT-SLC39A2 | 0.909091 | 1 | 0.833333 | COMPLEX-LAPTM5/PPAP2A/CD19 | 0.8125 | 1 | 0.684211 |
| SLCO1B1 AND SPON2 AND NOT-OR1Q1 | 0.909091 | 1 | 0.833333 | CD19 AND CDH19 AND NOT-ITGB3 | 0.914286 | 1 | 0.842105 |
| SLC43A1 AND SPON2 AND NOT-GPR22 | 0.909091 | 1 | 0.833333 | CD19 AND CLECL1 AND NOT-CLDN2 | 0.914286 | 1 | 0.842105 |
| ABCG5 AND SPON2 AND NOT-KCNQ2 | 0.909091 | 1 | 0.833333 | COMPLEX-CLECL1/AXL/CD19 | 0.914286 | 1 | 0.842105 |
| SLC2A2 AND SPON2 AND DRD5 | 0.909091 | 1 | 0.833333 | COMPLEX-CLECL1/CD19/CD34 | 0.914286 | 1 | 0.842105 |
| ABCG5 AND SPON2 AND NOT-UMODL1 | 0.909091 | 1 | 0.833333 | CD19 AND LRP4 AND NOT-ITGB3 | 0.914286 | 1 | 0.842105 |
| ABCG5 AND SPON2 AND NOT-CCKBR | 0.909091 | 1 | 0.833333 | CD19 AND CD34 AND NOT-SLC2A12 | 0.914286 | 1 | 0.842105 |
| ABCG5 AND SPON2 AND NOT-DCC | 0.909091 | 1 | 0.833333 | COMPLEX-CLECL1/TPBG/CD19 | 0.914286 | 1 | 0.842105 |
| SLCO1B1 AND SPON2 AND NOT-RGR | 0.909091 | 1 | 0.833333 | CD19 AND PCDH7 AND NOT-ITGB3 | 0.898551 | 1 | 0.815789 |
| SLC43A1 AND NOT-IL20RA AND FGF6 | 0.909091 | 1 | 0.833333 | CD19 AND EDNRB AND NOT-PVR | 0.898551 | 1 | 0.815789 |
| ABCG5 AND SPON2 AND NOT-AJAP1 | 0.909091 | 1 | 0.833333 | CD19 AND ABCA8 AND NOT-ITGB3 | 0.898551 | 1 | 0.815789 |
| SLCO1B1 AND SPON2 AND NOT-SLC6A7 | 0.909091 | 1 | 0.833333 | CD19 AND ABCA8 AND NOT-SLC39A6 | 0.898551 | 1 | 0.815789 |
| SLCO1B1 AND SPON2 AND NOT-PCDHGC4 | 0.909091 | 1 | 0.833333 | CD19 AND ADCY2 AND NOT-ITGB3 | 0.898551 | 1 | 0.815789 |
| ABCG5 AND SPON2 AND NOT-KCNK10 | 0.909091 | 1 | 0.833333 | CD19 AND EDNRB AND NOT-ADCY2 | 0.898551 | 1 | 0.815789 |
| ABCG5 AND SPON2 AND NOT-GSG1L | 0.909091 | 1 | 0.833333 | CD19 AND CLECL1 AND NOT-SSTR1 | 0.882353 | 1 | 0.789474 |
| ABCG5 AND SPON2 AND NOT-KCNH1 | 0.909091 | 1 | 0.833333 | CD19 AND SEMA6D AND NOT-IL20RA | 0.882353 | 1 | 0.789474 |
| ABCG5 AND SPON2 AND NOT-GRID2 | 0.909091 | 1 | 0.833333 | CD19 AND KCNK5 AND NOT-ITGB3 | 0.882353 | 1 | 0.789474 |
| ABCG5 AND SPON2 AND NOT-NRG3 | 0.909091 | 1 | 0.833333 | CD19 AND CLECL1 AND NOT-MST1R | 0.865672 | 1 | 0.763158 |
| SLCO1B1 AND SPON2 AND NOT-GPR37L1 | 0.909091 | 1 | 0.833333 | CD19 AND GGT5 AND NOT-SLC39A6 | 0.848485 | 1 | 0.736842 |
| SLCO1B1 AND SPON2 AND NOT-SLC12A9 | 0.909091 | 1 | 0.833333 | CD19 AND SEMA6D AND NOT-SLC34A2 | 0.848485 | 1 | 0.736842 |
| ABCG5 AND DTNA AND NOT-CD79A | 0.909091 | 1 | 0.833333 | CD19 AND SLC35G1 AND NOT-ENG | 0.830769 | 1 | 0.710526 |
| ABCG5 AND SPON2 AND NOT-PCDHB1 | 0.909091 | 1 | 0.833333 | CD19 AND NOT-CD1A AND LYPD1 | 0.898551 | 1 | 0.815789 |

FIG. 15 (cont.)

| Antigen Pair Logic | F1 | Precision | Recall | Antigen Pair Logic | F1 | Precision | Recall |
|---|---|---|---|---|---|---|---|
| ABCG5 AND SPON2 AND NOT-SLC12A9 | 0.909091 | 1 | 0.833333 | CD19 AND MEGF10 AND NOT-LYPD1 | 0.865672 | 1 | 0.763158 |
| ABCG5 AND SPON2 AND NOT-LRRC55 | 0.909091 | 1 | 0.833333 | CD19 AND MLANA AND NOT-LYPD1 | 0.848485 | 1 | 0.736842 |
| ABCG5 AND SPON2 AND NOT-OPCML | 0.909091 | 1 | 0.833333 | CD19 AND PTGIS AND NOT-LYPD1 | 0.830769 | 1 | 0.710526 |
| SLCO1B1 AND SPON2 AND NOT-SCN8A | 0.909091 | 1 | 0.833333 | CD19 AND PTGIS AND NOT-GABRA4 | 0.830769 | 1 | 0.710526 |
| ABCG5 AND SPON2 AND NOT-CDH22 | 0.909091 | 1 | 0.833333 | CD19 AND PTGIS AND NOT-GRM3 | 0.830769 | 1 | 0.710526 |
| SLCO1B1 AND SPON2 AND NOT-CACNG7 | 0.909091 | 1 | 0.833333 | CD19 AND PTGIS AND NOT-CD207 | 0.830769 | 1 | 0.710526 |
| ABCG5 AND SPON2 AND NOT-HCN4 | 0.909091 | 1 | 0.833333 | MS4A1 AND ERBB3 AND NOT-ITGB3 | 0.938272 | 0.883721 | 1 |
| SLC2A2 AND SPON2 AND SLCO1A2 | 0.909091 | 1 | 0.833333 | MS4A1 AND SDC1 AND NOT-ITGB3 | 0.938272 | 0.883721 | 1 |
| SLC43A1 AND NOT-IL13RA2 AND SLC17A3 | 0.909091 | 1 | 0.833333 | MS4A1 AND ERBB3 AND NOT-CLDN8 | 0.925 | 0.880952 | 0.973684 |
| SLCO1B1 AND EPHB2 AND NOT-SEMA4B | 0.909091 | 1 | 0.833333 | MS4A1 AND SDC1 AND NOT-TNFRSF8 | 0.925 | 0.880952 | 0.973684 |
| SLCO1B1 AND SPON2 AND NOT-SLC1A6 | 0.909091 | 1 | 0.833333 | MS4A1 AND ERBB3 AND NOT-TNFRSF8 | 0.925 | 0.880952 | 0.973684 |
| SLCO1B1 AND SPON2 AND NOT-LPPR3 | 0.909091 | 1 | 0.833333 | MS4A1 AND SDC1 AND NOT-DDX3X | 0.915663 | 0.844444 | 1 |
| ABCG5 AND FLVCR1 AND NOT-PROM1 | 0.909091 | 1 | 0.833333 | MS4A1 AND NOT-SSTR2 AND SDC1 | 0.904762 | 0.826087 | 1 |
| SLCO1B1 AND SPON2 AND NOT-UMODL1 | 0.909091 | 1 | 0.833333 | MS4A1 AND ERBB3 AND NOT-DDX3X | 0.904762 | 0.826087 | 1 |
| SLCO1B1 AND SPON2 AND NOT-GABRG2 | 0.909091 | 1 | 0.833333 | MS4A1 AND NOT-SSTR2 AND ERBB3 | 0.906667 | 0.918919 | 0.894737 |
| SLCO1B1 AND SPON2 AND NOT-SLC22A6 | 0.909091 | 1 | 0.833333 | MS4A1 AND ERBB3 AND NOT-ULBP1 | 0.95 | 0.904762 | 1 |
| ABCG5 AND SPON2 AND NOT-SMPD2 | 0.909091 | 1 | 0.833333 | MS4A1 AND SDC1 AND NOT-ULBP1 | 0.904762 | 0.826087 | 1 |
| SLC2A2 AND SPON2 AND SEZ6 | 0.909091 | 1 | 0.833333 | MS4A1 AND NOT-CLDN8 AND PMEL | 0.936709 | 0.902439 | 0.973684 |
| ABCG5 AND SPON2 AND NOT-GRIA4 | 0.909091 | 1 | 0.833333 | MS4A1 AND SDC1 AND NOT-ANXA1 | 0.891892 | 0.916667 | 0.868421 |
| SLCO1B1 AND SPON2 AND NOT-SLC1A5 | 0.909091 | 1 | 0.833333 | MS4A1 AND ERBB3 AND NOT-MST1R | 0.886076 | 0.853659 | 0.921053 |
| SLCO1B1 AND SPON2 AND NOT-P2RY4 | 0.909091 | 1 | 0.833333 | MS4A1 AND NOT-SSTR2 AND P2RX5 | 0.880952 | 0.804348 | 0.973684 |
| ABCG5 AND SPON2 AND NOT-OTOF | 0.909091 | 1 | 0.833333 | MS4A1 AND ERBB3 AND NOT-ANXA1 | 0.88 | 0.891892 | 0.868421 |
| ABCG5 AND SPON2 AND NOT-CACNA1E | 0.909091 | 1 | 0.833333 | MS4A1 AND SEMA5B AND NOT-BMPR1B | 0.883721 | 0.791667 | 1 |
| SLCO1B1 AND SPON2 AND NOT-SLC17A2 | 0.909091 | 1 | 0.833333 | MS4A1 AND NOT-CLDN8 AND SDC1 | 0.875 | 0.833333 | 0.921053 |
| ABCG5 AND SPON2 AND NOT-LPPR3 | 0.909091 | 1 | 0.833333 | MS4A1 AND SDC1 AND NOT-MST1R | 0.875 | 0.833333 | 0.921053 |
| SLCO1B1 AND SPON2 AND NOT-HCN4 | 0.909091 | 1 | 0.833333 | MS4A1 AND ERBB3 AND NOT-DNAJB8 | 0.873563 | 0.77551 | 1 |
| ABCG5 AND SPON2 AND NOT-GABRG2 | 0.909091 | 1 | 0.833333 | MS4A1 AND ERBB3 AND NOT-CTAG2 | 0.873563 | 0.77551 | 1 |
| SLCO1B1 AND SPON2 AND NOT-AJAP1 | 0.909091 | 1 | 0.833333 | MS4A1 AND ERBB3 AND NOT-PSCA | 0.873563 | 0.77551 | 1 |
| ABCG5 AND SPON2 AND NOT-SYT6 | 0.909091 | 1 | 0.833333 | MS4A1 AND ERBB3 AND NOT-SLC39A6 | 0.873563 | 0.77551 | 1 |
| SLCO1B1 AND SPON2 AND NOT-CALN1 | 0.909091 | 1 | 0.833333 | MS4A1 AND ERBB3 AND NOT-BMPR1B | 0.904762 | 0.826087 | 1 |
| ABCG5 AND SPON2 AND NOT-ADAM2 | 0.909091 | 1 | 0.833333 | MS4A1 AND SDC1 AND NOT-BMPR1B | 0.904762 | 0.826087 | 1 |
| SLCO1B1 AND SPON2 AND NOT-KCNK10 | 0.909091 | 1 | 0.833333 | MS4A1 AND ERBB2 AND NOT-BMPR1B | 0.902439 | 0.840909 | 0.973684 |
| SLCO1B1 AND SPON2 AND NOT-TTYH3 | 0.909091 | 1 | 0.833333 | MS4A1 AND ERBB3 AND NOT-ULBP3 | 0.870588 | 0.787234 | 0.973684 |
| ABCG5 AND SPON2 AND NOT-KCNK12 | 0.909091 | 1 | 0.833333 | MS4A1 AND ERBB3 AND NOT-SSTR5 | 0.870588 | 0.787234 | 0.973684 |
| SLCO1B1 AND SPON2 AND NOT-SLCO1A2 | 0.909091 | 1 | 0.833333 | MS4A1 AND STEAP2 AND NOT-BMPR1B | 0.868421 | 0.868421 | 0.868421 |
| ABCG5 AND SPON2 AND NOT-PAQR8 | 0.909091 | 1 | 0.833333 | MS4A1 AND ERBB3 AND NOT-DPEP1 | 0.86747 | 0.8 | 0.947368 |
| ABCG5 AND SPON2 AND NOT-ROS1 | 0.909091 | 1 | 0.833333 | MS4A1 AND SDC1 AND NOT-BMPR1B | 0.873563 | 0.77551 | 1 |
| ABCG5 AND SPON2 AND NOT-KCNJ10 | 0.909091 | 1 | 0.833333 | MS4A1 AND SDC1 AND NOT-BMPR1B | 0.873563 | 0.77551 | 1 |
| SLC43A1 AND BIRC5 AND NOT-IL20RA | 1 | 1 | 1 | MS4A1 AND ERBB3 AND NOT-SST | 0.863636 | 0.76 | 1 |
| SLC43A1 AND BIRC5 AND NOT-FOLR1 | 1 | 1 | 1 | MS4A1 AND NOT-MST1R AND PMEL | 0.921053 | 0.921053 | 0.921053 |
| ABCG5 AND SPON2 AND NOT-MUC4 | 0.909091 | 1 | 0.833333 | MS4A1 AND ERBB3 AND NOT-SLAMF7 | 0.88 | 0.891892 | 0.868421 |
| ABCG5 AND SPON2 AND NOT-ITGB6 | 0.909091 | 1 | 0.833333 | MS4A1 AND ERBB3 AND NOT-CLDN6 | 0.873239 | 0.939394 | 0.815789 |
| ABCG5 AND SPON2 AND NOT-L1CAM | 0.909091 | 1 | 0.833333 | MS4A1 AND ERBB3 AND NOT-IGF1R | 0.857143 | 0.782609 | 0.947368 |
| ABCG5 AND SPON2 AND NOT-FCRL2 | 0.909091 | 1 | 0.833333 | MS4A1 AND SLC39A6 AND NOT-BMPR1B | 0.860759 | 0.829268 | 0.894737 |
| SLCO1B1 AND SPON2 AND NOT-ULBP2 | 0.909091 | 1 | 0.833333 | MS4A1 AND SDC1 AND NOT-SLAMF7 | 0.891892 | 0.916667 | 0.868421 |
| ABCG5 AND SPON2 AND NOT-CLDN18 | 0.909091 | 1 | 0.833333 | MS4A1 AND ERBB3 AND NOT-CLDN2 | 0.853933 | 0.745098 | 1 |
| ABCG5 AND SPON2 AND NOT-ULBP2 | 0.909091 | 1 | 0.833333 | MS4A1 AND MAGEA1 AND NOT-BMPR1B | 0.853333 | 0.864865 | 0.842105 |
| SLC43A1 AND SPON2 AND NOT-CSPG4 | 0.909091 | 1 | 0.833333 | MS4A1 AND CLDN3 AND NOT-BMPR1B | 0.880952 | 0.804348 | 0.973684 |
| ABCG5 AND SPON2 AND NOT-GUCY2C | 0.909091 | 1 | 0.833333 | MS4A1 AND SDC1 AND NOT-SSTR5 | 0.850575 | 0.755102 | 0.973684 |
| SLC43A1 AND NOT-IL13RA2 AND NOT-IL20RA | 0.909091 | 1 | 0.833333 | COMPLEX-PMEL/MS4A1/CD70 | 0.85 | 0.809524 | 0.894737 |
| ABCG5 AND SPON2 AND NOT-EPHB2 | 0.909091 | 1 | 0.833333 | MS4A1 AND CLDN4 AND NOT-BMPR1B | 0.846154 | 0.825 | 0.868421 |
| SLCO1B1 AND SPON2 AND NOT-GUCY2C | 0.909091 | 1 | 0.833333 | MS4A1 AND SDC1 AND NOT-CTAG2 | 0.844444 | 0.730769 | 1 |
| ABCG5 AND SPON2 AND NOT-TPBG | 0.909091 | 1 | 0.833333 | MS4A1 AND SDC1 AND NOT-PSCA | 0.844444 | 0.730769 | 1 |
| SLCO1B1 AND EPHB2 AND NOT-FOLR2 | 0.909091 | 1 | 0.833333 | MS4A1 AND SDC1 AND NOT-DNAJB8 | 0.844444 | 0.730769 | 1 |
| SLC2A2 AND SPON2 AND ITGB6 | 0.909091 | 1 | 0.833333 | MS4A1 AND SDC1 AND NOT-SLC39A6 | 0.844444 | 0.730769 | 1 |
| ABCG5 AND SPON2 AND NOT-ENG | 0.909091 | 1 | 0.833333 | MS4A1 AND ERBB3 AND NOT-ITGB6 | 0.840909 | 0.74 | 0.973684 |
| SLCO1B1 AND SPON2 AND NOT-CD72 | 0.909091 | 1 | 0.833333 | MS4A1 AND TYR AND NOT-BMPR1B | 0.839506 | 0.790698 | 0.894737 |
| SLCO1B1 AND SPON2 AND NOT-ITGB6 | 0.909091 | 1 | 0.833333 | CD52 AND NOT-ITGB3 AND NOT-KDR | 0.911392 | 0.878049 | 0.947368 |
| SLCO1B1 AND SPON2 AND NOT-TNFRSF17 | 0.909091 | 1 | 0.833333 | MS4A1 AND CBX3 AND NOT-BMPR1B | 0.911392 | 0.878049 | 0.947368 |
| ABCG5 AND SPON2 AND NOT-MST1R | 0.909091 | 1 | 0.833333 | MS4A1 AND GPC3 AND NOT-BMPR1B | 0.837209 | 0.75 | 0.947368 |
| SLCO1B1 AND SPON2 AND NOT-PMEL | 0.909091 | 1 | 0.833333 | MS4A1 AND SDC1 AND NOT-SST | 0.835165 | 0.716981 | 1 |
| SLC43A1 AND SPON2 AND NOT-IL20RA | 0.909091 | 1 | 0.833333 | MS4A1 AND SDC1 AND NOT-CLDN3 | 0.835165 | 0.716981 | 1 |
| SLCO1B1 AND SPON2 AND NOT-MUC4 | 0.909091 | 1 | 0.833333 | MS4A1 AND ERBB3 AND NOT-BCAN | 0.835165 | 0.716981 | 1 |
| SLCO1B1 AND SPON2 AND NOT-MUC16 | 0.909091 | 1 | 0.833333 | MS4A1 AND SDC1 AND NOT-ULBP3 | 0.833333 | 0.76087 | 0.921053 |
| ABCG5 AND SPON2 AND NOT-CLDN7 | 0.909091 | 1 | 0.833333 | MS4A1 AND SDC1 AND NOT-IGF1R | 0.827586 | 0.734694 | 0.947368 |
| ABCG5 AND SPON2 AND NOT-CD79B | 0.909091 | 1 | 0.833333 | MS4A1 AND LGR5 AND NOT-BMPR1B | 0.827586 | 0.734694 | 0.947368 |
| ABCG5 AND SPON2 AND NOT-TNFRSF13C | 0.909091 | 1 | 0.833333 | COMPLEX-PMEL/BMPR1B/MS4A1 | 0.902439 | 0.840909 | 0.973684 |
| ABCG5 AND SPON2 AND NOT-CD70 | 0.909091 | 1 | 0.833333 | COMPLEX-SEMA5B/MS4A1/CD37 | 0.826087 | 0.703704 | 1 |
| ABCG5 AND SPON2 AND NOT-TNFRSF17 | 0.909091 | 1 | 0.833333 | MS4A1 AND SDC1 AND NOT-CLDN2 | 0.826087 | 0.703704 | 1 |
| ABCG5 AND SPON2 AND NOT-EGFR | 0.909091 | 1 | 0.833333 | COMPLEX-P2RX5/SEMA5B/MS4A1 | 0.826087 | 0.703704 | 1 |
| ABCG5 AND SPON2 AND NOT-IL20RA | 0.909091 | 1 | 0.833333 | MS4A1 AND CD52 AND NOT-BMPR1B | 0.902439 | 0.840909 | 0.973684 |
| ABCG5 AND SPON2 AND NOT-CLDN23 | 0.909091 | 1 | 0.833333 | MS4A1 AND CLDN12 AND NOT-BMPR1B | 0.825 | 0.785714 | 0.868421 |
| ABCG5 AND SPON2 AND NOT-MUC13 | 0.909091 | 1 | 0.833333 | MS4A1 AND ERBB3 AND CD70 | 0.823529 | 0.744681 | 0.921053 |
| ABCG5 AND SPON2 AND NOT-IL2RA | 0.909091 | 1 | 0.833333 | MS4A1 AND ERBB3 AND NOT-SSTR1 | 0.822222 | 0.711538 | 0.973684 |
| ABCG5 AND SPON2 AND NOT-CD19 | 0.909091 | 1 | 0.833333 | MS4A1 AND NOT-DPEP1 AND SDC1 | 0.821918 | 0.857143 | 0.789474 |
| ABCG5 AND SPON2 AND NOT-GPA33 | 0.909091 | 1 | 0.833333 | MS4A1 AND ERBB3 AND NOT-GPA33 | 0.817204 | 0.690909 | 1 |
| ABCG5 AND SPON2 AND NOT-FCRL5 | 0.909091 | 1 | 0.833333 | MS4A1 AND SDC1 AND NOT-CLDN6 | 0.815789 | 0.815789 | 0.815789 |

FIG. 15 (cont.)

| Antigen Pair Logic | F1 | Precision | Recall | Antigen Pair Logic | F1 | Precision | Recall |
|---|---|---|---|---|---|---|---|
| SLCO1B1 AND SPON2 AND NOT-EPHB2 | 0.909091 | 1 | 0.833333 | MS4A1 AND SDC1 AND NOT-ITGB6 | 0.813187 | 0.698113 | 0.973684 |
| ABCG5 AND SPON2 AND NOT-ABCB5 | 0.909091 | 1 | 0.833333 | MS4A1 AND CD52 AND P2RX5 | 0.897436 | 0.875 | 0.921053 |
| SLCO1B1 AND NOT-IL13RA2 AND EPHB2 | 0.909091 | 1 | 0.833333 | MS4A1 AND SLC34A2 AND P2RX5 | 0.8125 | 1 | 0.684211 |
| ABCG5 AND SPON2 AND NOT-CSPG4 | 0.909091 | 1 | 0.833333 | MS4A1 AND HSPA5 AND NOT-BMPR1B | 0.815789 | 0.815789 | 0.815789 |
| SLC43A1 AND NOT-IL13RA2 AND NOT-FOLR1 | 0.909091 | 1 | 0.833333 | MS4A1 AND MOK AND NOT-BMPR1B | 0.810127 | 0.780488 | 0.842105 |
| SLCO1B1 AND SPON2 AND NOT-GPA33 | 0.909091 | 1 | 0.833333 | MS4A1 AND TYR AND NOT-ERBB3 | 0.809524 | 0.73913 | 0.894737 |
| ABCG5 AND SPON2 AND NOT-CA9 | 0.909091 | 1 | 0.833333 | MS4A1 AND SDC1 AND NOT-BCAN | 0.808511 | 0.678571 | 1 |
| ABCG5 AND SPON2 AND NOT-CD79A | 0.909091 | 1 | 0.833333 | MS4A1 AND FOLH1 AND NOT-BMPR1B | 0.805556 | 0.852941 | 0.763158 |
| SLCO1B1 AND SPON2 AND NOT-FCRL2 | 0.909091 | 1 | 0.833333 | COMPLEX-ROR1/PMEL/MS4A1 | 0.804878 | 0.75 | 0.868421 |
| SLC43A1 AND ERBB3 AND NOT-FOLR1 | 0.909091 | 1 | 0.833333 | MS4A1 AND ERBB3 AND HSPA5 | 0.804348 | 0.685185 | 0.973684 |
| ABCG5 AND SEMA5B AND NOT-MST1R | 1 | 1 | 1 | MS4A1 AND ERBB3 AND IL11RA | 0.804348 | 0.685185 | 0.973684 |
| SLC43A1 AND ERBB3 AND NOT-CSPG4 | 0.909091 | 1 | 0.833333 | MS4A1 AND ERBB3 AND CLDN3 | 0.8 | 0.666667 | 1 |
| SLC43A1 AND NOT-IL20RA AND CD34 | 0.909091 | 1 | 0.833333 | MS4A1 AND CD70 AND NOT-BMPR1B | 0.898551 | 1 | 0.815789 |
| SLCO1B1 AND SEMA5B AND NOT-CD72 | 1 | 1 | 1 | Peripheral T-cell lymphoma | | | |
| ABCG5 AND SEMA5B AND NOT-GPA33 | 1 | 1 | 1 | CXCL9 AND NOT-BMPR1A AND NOT-SDC2 | 0.830189 | 0.88 | 0.785714 |
| SLCO1B1 AND EPHB2 AND NOT-MAGEA4 | 1 | 1 | 1 | GPR174 AND CDH5 AND NOT-CXADR | 0.807018 | 0.793103 | 0.821429 |
| SLC43A1 AND NOT-IL13RA2 AND NOT-VTCN1 | 0.909091 | 1 | 0.833333 | CXCL9 AND NOT-CRIM1 AND NOT-CYP4F12 | 0.830189 | 0.88 | 0.785714 |
| SLCO1B1 AND EPHB2 AND NOT-OAS1 | 1 | 1 | 1 | CD96 AND CDH5 AND NOT-EPHB4 | 0.80597 | 0.692308 | 0.964286 |
| SLC43A1 AND ERBB3 AND NOT-MUC16 | 0.909091 | 1 | 0.833333 | CXCL9 AND NOT-APCDD1 AND NOT-GJB2 | 0.862745 | 0.956522 | 0.785714 |
| SLC43A1 AND ERBB3 AND NOT-IL20RA | 0.909091 | 1 | 0.833333 | CXCL9 AND NOT-PMP22 AND NOT-MGST2 | 0.814815 | 0.846154 | 0.785714 |
| SLCO1B1 AND SEMA5B AND NOT-GPA33 | 1 | 1 | 1 | CXCL9 AND NOT-FAM57A AND NOT-SDC2 | 0.846154 | 0.916667 | 0.785714 |
| SLCO1B1 AND SEMA5B AND NOT-ULBP2 | 1 | 1 | 1 | CXCL9 AND NOT-PMP22 AND CD96 | 0.814815 | 0.846154 | 0.785714 |
| SLCO1B1 AND SEMA5B AND NOT-TNFRSF17 | 1 | 1 | 1 | CXCL9 AND NOT-FAM57A AND NOT-AQP9 | 0.830189 | 0.88 | 0.785714 |
| ABCG5 AND SEMA5B AND NOT-GUCY2C | 1 | 1 | 1 | CXCL9 AND NOT-CRIM1 AND NOT-MGST2 | 0.830189 | 0.88 | 0.785714 |
| SLCO1B1 AND EPHB2 AND NOT-EDNRB | 1 | 1 | 1 | P2RY10 AND CDH5 AND NOT-CXADR | 0.806452 | 0.735294 | 0.892857 |
| SLCO1B1 AND EPHB2 AND NOT-AXL | 1 | 1 | 1 | TRAT1 AND CDH5 AND NOT-CXADR | 0.851852 | 0.884615 | 0.821429 |
| SLC2A2 AND SEMA5B AND CD70 | 1 | 1 | 1 | CXCL9 AND NOT-SLC3A1 AND NOT-SLC11A2 | 0.814815 | 0.846154 | 0.785714 |
| SLCO1B1 AND EPHB2 AND NOT-HHLA2 | 1 | 1 | 1 | CXCL9 AND NOT-SDC2 AND NOT-MGST2 | 0.862745 | 0.956522 | 0.785714 |
| SLCO1B1 AND EPHB2 AND NOT-L1CAM | 1 | 1 | 1 | CXCL9 AND NOT-CRIM1 AND NOT-ITGA2 | 0.814815 | 0.846154 | 0.785714 |
| SLCO1B1 AND EPHB2 AND NOT-ERBB3 | 1 | 1 | 1 | CXCL9 AND NOT-CRIM1 AND NOT-SPINT1 | 0.814815 | 0.846154 | 0.785714 |
| SLCO1B1 AND EPHB2 AND NOT-CD180 | 1 | 1 | 1 | CXCL9 AND NOT-CRIM1 AND NOT-SLC22A23 | 0.814815 | 0.846154 | 0.785714 |
| SLCO1B1 AND EPHB2 AND NOT-CD160 | 1 | 1 | 1 | CXCL9 AND NOT-GJB2 AND NOT-TMEM219 | 0.833333 | 1 | 0.714286 |
| SLCO1B1 AND EPHB2 AND NOT-TNFRSF13C | 1 | 1 | 1 | CXCL9 AND NOT-GJB2 AND NOT-TMEM150A | 0.816327 | 0.952381 | 0.714286 |
| SLC43A1 AND NOT-FOLR1 AND EPHB2 | 1 | 1 | 1 | CXCL9 AND NOT-GJB2 AND NOT-CAV1 | 0.833333 | 1 | 0.714286 |
| ABCG5 AND SEMA5B AND NOT-MUC13 | 1 | 1 | 1 | CXCL9 AND NOT-GJB2 AND NOT-CSF3R | 0.833333 | 1 | 0.714286 |
| SLCO1B1 AND EPHB2 AND NOT-GUCY2C | 1 | 1 | 1 | CXCL9 AND NOT-GJB2 AND NOT-TMEM231 | 0.816327 | 0.952381 | 0.714286 |
| SLC43A1 AND NOT-IL13RA2 AND CD72 | 0.909091 | 1 | 0.833333 | CXCL9 AND NOT-GJB2 AND NOT-RAMP2 | 0.816327 | 0.952381 | 0.714286 |
| SLC43A1 AND NOT-FOLR1 AND EPHB2 | 1 | 1 | 1 | CXCL9 AND NOT-GJB2 AND NOT-TUSC3 | 0.833333 | 1 | 0.714286 |
| SLC43A1 AND NOT-IL20RA AND EPHB2 | 1 | 1 | 1 | CXCL9 AND NOT-BMPR1A AND NOT-TNFRSF1A | 0.846154 | 0.916667 | 0.785714 |
| SLCO1B1 AND EPHB2 AND NOT-CLDN9 | 1 | 1 | 1 | CXCL9 AND NOT-CRIM1 AND NOT-PTPRK | 0.814815 | 0.846154 | 0.785714 |
| SLCO1B1 AND EPHB2 AND NOT-TNC | 1 | 1 | 1 | CXCL9 AND NOT-GJB2 AND NOT-PCDH12 | 0.833333 | 1 | 0.714286 |
| SLCO1B1 AND EPHB2 AND NOT-SSTR1 | 1 | 1 | 1 | CXCL9 AND NOT-GJB2 AND NOT-COMT | 0.833333 | 1 | 0.714286 |
| SLCO1B1 AND EPHB2 AND NOT-PMEL | 1 | 1 | 1 | FAM26F AND CDH5 AND NOT-CXADR | 0.814815 | 0.846154 | 0.785714 |
| SLCO1B1 AND EPHB2 AND NOT-BCAN | 1 | 1 | 1 | CXCL9 AND NOT-CRIM1 AND NOT-FAM57A | 0.814815 | 0.846154 | 0.785714 |
| SLCO1B1 AND EPHB2 AND NOT-CLDN18 | 1 | 1 | 1 | CXCL9 AND NOT-APCDD1 AND NOT-AQP9 | 0.830189 | 0.88 | 0.785714 |
| SLCO1B1 AND EPHB2 AND NOT-ANXA1 | 1 | 1 | 1 | CXCL9 AND NOT-SDC2 AND NOT-MS4A2 | 0.88 | 1 | 0.785714 |
| SLCO1B1 AND EPHB2 AND NOT-GUCY2C | 1 | 1 | 1 | CXCL9 AND NOT-APLP2 AND CD96 | 0.846154 | 0.916667 | 0.785714 |
| SLCO1B1 AND EPHB2 AND NOT-ERBB4 | 1 | 1 | 1 | CD96 AND CDH11 AND NOT-KIT | 0.806452 | 0.735294 | 0.892857 |
| SLC43A1 AND BIRC5 AND NOT-MUC1 | 1 | 1 | 1 | CXCL9 AND NOT-FAM57A AND NOT-ANPEP | 0.830189 | 0.88 | 0.785714 |
| SLC43A1 AND NOT-IL13RA2 AND NOT-MUC1 | 0.909091 | 1 | 0.833333 | CXCL9 AND NOT-SDC2 AND NOT-LRIG3 | 0.846154 | 0.916667 | 0.785714 |
| SLC43A1 AND SPON2 AND NOT-MUC1 | 0.909091 | 1 | 0.833333 | CXCL9 AND NOT-CRIM1 AND NOT-LRIG3 | 0.814815 | 0.846154 | 0.785714 |
| SLCO1B1 AND SPON2 AND NOT-MSLN | 0.909091 | 1 | 0.833333 | CXCL9 AND NOT-CRIM1 AND NOT-SEMA4B | 0.814815 | 0.846154 | 0.785714 |
| ABCG5 AND SPON2 AND NOT-MUC1 | 0.909091 | 1 | 0.833333 | CXCL9 AND NOT-SEMA4B AND NOT-ERMAP | 0.814815 | 0.846154 | 0.785714 |
| ABCG5 AND SPON2 AND NOT-MSLN | 0.909091 | 1 | 0.833333 | CXCL9 AND NOT-SEMA4B AND NOT-LMBRD1 | 0.830189 | 0.88 | 0.785714 |
| SLCO1B1 AND SEMA5B AND NOT-MSLN | 1 | 1 | 1 | CD96 AND THY1 AND NOT-EMP2 | 0.830189 | 0.88 | 0.785714 |
| SLC43A1 AND ERBB3 AND NOT-MUC1 | 0.909091 | 1 | 0.833333 | CD96 AND THY1 AND NOT-KIT | 0.807692 | 0.875 | 0.75 |
| SLC43A1 AND NOT-MUC1 AND CD34 | 0.909091 | 1 | 0.833333 | CD96 AND THY1 AND NOT-BMP2 | 0.84 | 0.954545 | 0.75 |
| SLCO1B1 AND EPHB2 AND NOT-MSLN | 1 | 1 | 1 | CXCL9 AND NOT-GJB2 AND NOT-MUC1 | 0.816327 | 0.952381 | 0.714286 |
| SLCO1B1 AND EPHB2 AND NOT-MSLN | 1 | 1 | 1 | CD96 AND THY1 AND NOT-SEMA6A | 0.8 | 0.909091 | 0.714286 |
| SLC43A1 AND NOT-MUC1 AND EPHB2 | 1 | 1 | 1 | CD96 AND LIFR AND NOT-STEAP2 | 0.806452 | 0.735294 | 0.892857 |
| SLCO1B1 AND EPHB2 AND NOT-TNFRSF10A | 1 | 1 | 1 | NOT-EMP2 AND THY1 AND GPR183 | 0.816327 | 0.952381 | 0.714286 |
| SLC43A1 AND NOT-MUC1 AND EPHB2 | 1 | 1 | 1 | CD96 AND THY1 AND NOT-ATP8B1 | 0.830189 | 0.88 | 0.785714 |
| SLC43A1 AND SEMA5B AND NOT-MUC1 | 1 | 1 | 1 | Melanoma | | | |
| SLC43A1 AND NOT-MUC1 AND LGR5 | 0.909091 | 1 | 0.833333 | NOT-CHRNA2 AND LGR4 AND NOT-KCNK5 | 1 | 1 | 1 |
| SLC43A1 AND NOT-MUC1 AND IL3RA | 0.909091 | 1 | 0.833333 | NOT-CHRNA2 AND LGR4 AND NOT-CFTR | 1 | 1 | 1 |
| SLC2A2 AND SEMA5B AND MSLN | 1 | 1 | 1 | NOT-CLDN19 AND TIE1 AND NOT-CADM2 | 1 | 1 | 1 |
| SLC2A2 AND BIRC5 AND MSLN | 0.857143 | 0.75 | 1 | NOT-CHRNA2 AND PCDHB14 AND NOT-CADM2 | 1 | 1 | 1 |
| SLC2A2 AND EPHB2 AND MSLN | 1 | 1 | 1 | GPR137B AND NOT-NPR3 AND TYRO3 | 1 | 1 | 1 |
| SLC43A1 AND NOT-MUC1 AND ULBP1 | 0.909091 | 1 | 0.833333 | NOT-CHRNA2 AND NOT-CADM2 AND TYRO3 | 1 | 1 | 1 |
| SLC2A2 AND NOT-IL13RA2 AND MSLN | 0.833333 | 0.833333 | 0.833333 | NOT-CLDN19 AND LGR4 AND NOT-CADM2 | 1 | 1 | 1 |
| SLC2A2 AND MSLN AND NOT-AXL | 0.857143 | 0.75 | 1 | NOT-CHRNA2 AND ZNRF3 AND NOT-CADM2 | 1 | 1 | 1 |
| SLC43A1 AND NOT-MUC1 AND GPA33 | 1 | 1 | 1 | NOT-CHRNA2 AND ZNRF3 AND NOT-CADM2 | 1 | 1 | 1 |
| SLC43A1 AND NOT-MUC1 AND ITGB6 | 1 | 1 | 1 | NOT-CHRNA2 AND TIE1 AND NOT-KCNK5 | 1 | 1 | 1 |
| SLC43A1 AND NOT-MUC1 AND GPA33 | 1 | 1 | 1 | NOT-CLDN19 AND PCDHB14 AND NOT-CADM2 | 1 | 1 | 1 |
| ABCG5 AND SEMA5B AND NOT-MUC1 | 1 | 1 | 1 | NOT-CHRNA2 AND NOT-CADM2 AND TYRO3 | 1 | 1 | 1 |
| SLC2A2 AND VTCN1 AND MSLN | 0.8 | 1 | 0.666667 | NOT-CHRNA2 AND PCDHB14 AND NOT-CADM2 | 1 | 1 | 1 |
| ABCG5 AND GPC3 AND NOT-MST1R | 0.8 | 1 | 0.666667 | NOT-CHRNA2 AND LGR4 AND NOT-CADM2 | 1 | 1 | 1 |

FIG. 15 (cont.)

| Antigen Pair Logic | F1 | Precision | Recall |
|---|---|---|---|
| ABCG5 AND GPC3 AND NOT-CD19 | 0.8 | 1 | 0.666667 |
| ABCG5 AND GPC3 AND NOT-CA9 | 0.8 | 1 | 0.666667 |
| ABCG5 AND THY1 AND NOT-MUC1 | 0.8 | 1 | 0.666667 |
| ABCG5 AND GPC3 AND EPHB2 | 0.8 | 1 | 0.666667 |
| ABCG5 AND GPC3 AND NOT-L1CAM | 0.8 | 1 | 0.666667 |
| ABCG5 AND GPC3 AND NOT-CLDN23 | 0.8 | 1 | 0.666667 |
| SLC2A2 AND MSLN AND NOT-EDNRB | 0.857143 | 0.75 | 1 |
| SLC43A1 AND NOT-MUC1 AND VTCN1 | 0.8 | 1 | 0.666667 |
| SLC43A1 AND NOT-MUC1 AND THY1 | 0.8 | 1 | 0.666667 |
| SLC43A1 AND NOT-MUC1 AND SSTR5 | 0.8 | 1 | 0.666667 |
| ABCG5 AND GPC3 AND NOT-CLDN7 | 0.8 | 1 | 0.666667 |
| SLC43A1 AND NOT-MUC1 AND CR2 | 0.8 | 1 | 0.666667 |
| ABCG5 AND GPC3 AND NOT-GUCY2C | 0.8 | 1 | 0.666667 |
| ABCG5 AND GPC3 AND NOT-ITGB6 | 0.8 | 1 | 0.666667 |
| ABCG5 AND GPC3 AND NOT-FCRL2 | 0.8 | 1 | 0.666667 |
| SLC43A1 AND NOT-MUC1 AND DLL3 | 0.8 | 1 | 0.666667 |
| SLC2A2 AND GPC3 AND CD70 | 0.8 | 1 | 0.666667 |
| SLCO1B1 AND GPC3 AND ULBP2 | 0.8 | 1 | 0.666667 |
| ABCG5 AND GPC3 AND ULBP2 | 0.8 | 1 | 0.666667 |
| SLC2A2 AND THY1 AND MSLN | 0.8 | 1 | 0.666667 |
| ABCG5 AND GPC3 AND NOT-TPBG | 0.8 | 1 | 0.666667 |
| ABCG5 AND GPC3 AND ABCB5 | 0.8 | 1 | 0.666667 |
| SLC43A1 AND NOT-MUC1 AND MAGEA11 | 0.909091 | 1 | 0.833333 |
| ABCG5 AND GPC3 AND NOT-TNFRSF13C | 0.8 | 1 | 0.666667 |
| ABCG5 AND GPC3 AND NOT-MUC13 | 0.8 | 1 | 0.666667 |
| ABCG5 AND GPC3 AND NOT-TNFRSF17 | 0.8 | 1 | 0.666667 |
| ABCG5 AND GPC3 AND NOT-IL20RA | 0.8 | 1 | 0.666667 |
| SLC2A2 AND MSLN AND FLOT2 | 0.8 | 1 | 0.666667 |
| SLC43A1 AND NOT-MUC1 AND CLDN18 | 0.8 | 1 | 0.666667 |
| ABCG5 AND GPC3 AND NOT-CLDN18 | 0.8 | 1 | 0.666667 |
| ABCG5 AND GPC3 AND NOT-IL2RA | 0.8 | 1 | 0.666667 |
| ABCG5 AND GPC3 AND NOT-CD79A | 0.8 | 1 | 0.666667 |
| SLC2A2 AND MSLN AND CBX3 | 0.8 | 1 | 0.666667 |
| SLCO1B1 AND GPC3 AND NOT-TNFRSF17 | 0.8 | 1 | 0.666667 |
| ABCG5 AND GPC3 AND NOT-EGFR | 0.8 | 1 | 0.666667 |
| ABCG5 AND GPC3 AND NOT-CSPG4 | 0.8 | 1 | 0.666667 |
| SLCO1B1 AND THY1 AND NOT-MSLN | 0.8 | 1 | 0.666667 |
| ABCG5 AND GPC3 AND NOT-CD70 | 0.8 | 1 | 0.666667 |
| ABCG5 AND MAGEA1 AND NOT-MSLN | 0.8 | 1 | 0.666667 |
| SLC43A1 AND NOT-MUC1 AND VTCN1 | 0.8 | 1 | 0.666667 |
| SLC43A1 AND NOT-MUC1 AND CSPG4 | 0.8 | 1 | 0.666667 |
| SLC43A1 AND NOT-IL20RA AND TNFRSF10A | 0.8 | 1 | 0.666667 |
| SLC2A2 AND GPC3 AND ITGB6 | 0.8 | 1 | 0.666667 |
| SLC43A1 AND NOT-MUC1 AND CSPG4 | 0.8 | 1 | 0.666667 |
| ABCG5 AND GPC3 AND NOT-CD79B | 0.8 | 1 | 0.666667 |
| ABCG5 AND GPC3 AND NOT-GPA33 | 0.8 | 1 | 0.666667 |
| ABCG5 AND GPC3 AND NOT-FCRL5 | 0.8 | 1 | 0.666667 |
| ABCG5 AND GPC3 AND NOT-MUC4 | 0.8 | 1 | 0.666667 |
| SLC43A1 AND NOT-MUC1 AND PSCA | 0.8 | 1 | 0.666667 |
| SLC2A2 AND MSLN AND RNF43 | 0.857143 | 0.75 | 1 |
| SLC2A2 AND MSLN AND ITGB6 | 0.857143 | 0.75 | 1 |
| SLC2A2 AND MSLN AND NOT-PROM1 | 0.857143 | 0.75 | 1 |
| SLC43A1 AND NOT-MUC1 AND CLEC14A | 0.8 | 1 | 0.666667 |
| SLC43A1 AND NOT-MUC1 AND GAGE1 | 0.909091 | 1 | 0.833333 |
| SLC2A2 AND CLEC14A AND MSLN | 0.8 | 1 | 0.666667 |
| SLCO1B1 AND GPC3 AND NOT-GPA33 | 0.8 | 1 | 0.666667 |
| SLCO1B1 AND GPC3 AND NOT-MUC4 | 0.8 | 1 | 0.666667 |
| SLCO1B1 AND GPC3 AND NOT-GUCY2C | 0.8 | 1 | 0.666667 |
| SLCO1B1 AND GPC3 AND NOT-MUC16 | 0.8 | 1 | 0.666667 |
| SLCO1B1 AND GPC3 AND NOT-PMEL | 0.8 | 1 | 0.666667 |
| SLCO1B1 AND GPC3 AND NOT-FCRL2 | 0.8 | 1 | 0.666667 |
| SLC2A2 AND MSLN AND NOT-CEACAM6 | 0.857143 | 0.75 | 1 |
| SLC43A1 AND NOT-IL20RA AND MSLN | 1 | 1 | 1 |
| SLC43A1 AND NOT-FOLR1 AND MSLN | 1 | 1 | 1 |
| ABCG5 AND NOT-MUC17 AND FLVCR1 | 1 | 1 | 1 |
| ABCG5 AND NOT-MUC17 AND FLVCR1 | 1 | 1 | 1 |
| SLC43A1 AND NOT-MUC17 AND PCDHB1 | 1 | 1 | 1 |
| SLC43A1 AND NOT-MUC17 AND PCDHB1 | 1 | 1 | 1 |
| ABCG5 AND FLVCR1 AND NOT-CDH17 | 1 | 1 | 1 |
| ABCG5 AND FLVCR1 AND NOT-SLC16A5 | 1 | 1 | 1 |
| ABCG5 AND FLVCR1 AND NOT-CDH17 | 1 | 1 | 1 |
| ABCG5 AND FLVCR1 AND NOT-PTPRR | 1 | 1 | 1 |
| ABCG5 AND FLVCR1 AND NOT-PTPRR | 1 | 1 | 1 |
| ABCG5 AND FLVCR1 AND NOT-SLC13A2 | 1 | 1 | 1 |
| ABCG5 AND FLVCR1 AND NOT-SLC13A2 | 1 | 1 | 1 |
| ABCG5 AND FLVCR1 AND NOT-FUT3 | 1 | 1 | 1 |
| ABCG5 AND FLVCR1 AND NOT-SLC16A5 | 1 | 1 | 1 |

| Antigen Pair Logic | F1 | Precision | Recall |
|---|---|---|---|
| GPR137B AND NOT-NPR3 AND TYRO3 | 1 | 1 | 1 |
| NOT-CHRNA2 AND NOT-CADM2 AND IGDCC4 | 1 | 1 | 1 |
| NOT-CHRNA2 AND PCDHB14 AND NOT-KCNK5 | 1 | 1 | 1 |
| NOT-TM4SF5 AND TTYH2 AND ANO1 | 1 | 1 | 1 |
| NOT-TM4SF5 AND TTYH2 AND KCNK15 | 1 | 1 | 1 |
| NOT-TM4SF5 AND TTYH2 AND SLCO2A1 | 1 | 1 | 1 |
| NOT-TM4SF5 AND TTYH2 AND LGR4 | 1 | 1 | 1 |
| NOT-TM4SF5 AND TTYH2 AND TSPAN11 | 1 | 1 | 1 |
| NOT-TM4SF5 AND TTYH2 AND FZD7 | 1 | 1 | 1 |
| NOT-CHRNA2 AND TIE1 AND NOT-CFTR | 1 | 1 | 1 |
| NOT-CHRNA2 AND TSPAN11 AND NOT-CFTR | 1 | 1 | 1 |
| NOT-CHRNA2 AND PCDHB14 AND NOT-CFTR | 1 | 1 | 1 |
| NOT-CHRNA2 AND TSPAN11 AND NOT-KCNK5 | 1 | 1 | 1 |
| NOT-CHRNA2 AND NOT-CADM2 AND APLNR | 1 | 1 | 1 |
| NOT-CHRNA2 AND NOT-CADM2 AND CNTNAP1 | 1 | 1 | 1 |
| NOT-CHRNA2 AND TIE1 AND NOT-CADM2 | 1 | 1 | 1 |
| GPR137B AND NOT-ATP1A2 AND TYRO3 | 1 | 1 | 1 |
| GPR137B AND NOT-ATP1A2 AND TYRO3 | 1 | 1 | 1 |
| NOT-CLDN19 AND TSPAN11 AND NOT-CADM2 | 1 | 1 | 1 |
| GPR137B AND NOT-CADM2 AND KCNS3 | 1 | 1 | 1 |
| GPR137B AND NOT-CADM2 AND FXYD3 | 1 | 1 | 1 |
| NOT-CHRNA2 AND NOT-ATP1A2 AND TYRO3 | 1 | 1 | 1 |
| GPR137B AND NOT-CADM2 AND TYRO3 | 1 | 1 | 1 |
| NOT-CHRNA2 AND TIE1 AND NOT-CADM2 | 1 | 1 | 1 |
| GPR137B AND NOT-CADM2 AND VANGL2 | 1 | 1 | 1 |
| GPR137B AND NOT-FGFR2 AND TYRO3 | 1 | 1 | 1 |
| NOT-CLDN19 AND ZNRF3 AND NOT-CADM2 | 1 | 1 | 1 |
| GPR137B AND NOT-CADM2 AND FXYD3 | 1 | 1 | 1 |
| GPR137B AND NOT-CADM2 AND PCDH7 | 1 | 1 | 1 |
| NOT-CHRNA2 AND NOT-CADM2 AND ADRA2C | 1 | 1 | 1 |
| NOT-CHRNA2 AND NOT-ATP1A2 AND TYRO3 | 1 | 1 | 1 |
| GPR137B AND NOT-CADM2 AND TYRO3 | 1 | 1 | 1 |
| NOT-CHRNA2 AND NOT-CADM2 AND ADRA2C | 1 | 1 | 1 |
| NOT-CHRNA2 AND FZD7 AND NOT-KCNK5 | 1 | 1 | 1 |
| GPR137B AND NOT-CADM2 AND VANGL2 | 1 | 1 | 1 |
| NOT-CHRNA2 AND NOT-CADM2 AND ANO10 | 1 | 1 | 1 |
| NOT-CHRNA2 AND ZNRF3 AND NOT-KCNK5 | 1 | 1 | 1 |
| GPR137B AND NOT-FGFR2 AND TYRO3 | 1 | 1 | 1 |
| NOT-CHRNA2 AND NOT-CADM2 AND PCDHB16 | 1 | 1 | 1 |
| NOT-CHRNA2 AND TMEM231 AND NOT-CFTR | 1 | 1 | 1 |
| NOT-CHRNA2 AND WLS AND NOT-KCNK5 | 1 | 1 | 1 |
| NOT-GIPR AND GPR161 AND NOT-PCDH8 | 1 | 1 | 1 |
| GPR137B AND NOT-CXADR AND TYRO3 | 1 | 1 | 1 |
| NOT-TM4SF5 AND NOT-CADM2 AND LRIG3 | 1 | 1 | 1 |
| NOT-CHRNA2 AND NOT-CADM2 AND WLS | 1 | 1 | 1 |
| NOT-CLDN19 AND TYRO3 AND NOT-CADM2 | 0.956522 | 0.916667 | 1 |
| NOT-CACNG6 AND NOT-CADM2 AND PCDHB14 | 1 | 1 | 1 |
| NOT-CHRNA2 AND NOT-CADM2 AND WLS | 1 | 1 | 1 |
| NOT-CHRNA2 AND NOT-CADM2 AND LSAMP | 0.956522 | 0.916667 | 1 |
| COMPLEX-CHRNA2/OR7A5/SGCD | 1 | 1 | 1 |
| NOT-CACNG6 AND LGR4 AND NOT-CADM2 | 1 | 1 | 1 |
| NOT-SLC10A2 AND GPR161 AND NOT-ATP1A2 | 1 | 1 | 1 |
| NOT-CHRNA2 AND LGR4 AND NOT-SCNN1G | 1 | 1 | 1 |
| NOT-CHRNA2 AND NOT-CADM2 AND NTM | 1 | 1 | 1 |
| NOT-CHRNA2 AND TMEM231 AND NOT-KCNK5 | 1 | 1 | 1 |
| NOT-GPR21 AND TTYH2 AND ATP1A1 | 1 | 1 | 1 |
| NOT-CHRNA2 AND TMEM231 AND NOT-SCNN1G | 1 | 1 | 1 |
| NOT-TM4SF5 AND TTYH2 AND PCDHB14 | 1 | 1 | 1 |
| NOT-CHRNA2 AND SGCD AND PCDHB14 | 0.952381 | 1 | 0.909091 |
| GPR137B AND NOT-CADM2 AND BCAP31 | 0.952381 | 1 | 0.909091 |
| NOT-CLDN19 AND LGR4 AND NOT-ATP1A2 | 0.952381 | 1 | 0.909091 |
| GPR137B AND NOT-CADM2 AND RAMP2 | 0.952381 | 1 | 0.909091 |
| NOT-CHRNA2 AND SLC16A4 AND TNFRSF19 | 0.952381 | 1 | 0.909091 |
| NOT-CLDN19 AND SGCD AND TNFRSF10D | 0.952381 | 1 | 0.909091 |
| NOT-CHRNA2 AND LGR4 AND NOT-TSPAN8 | 0.952381 | 1 | 0.909091 |
| NOT-CHRNA2 AND SGCD AND PCDHB16 | 0.952381 | 1 | 0.909091 |
| COMPLEX-CD300LB/PSEN2/GPR137B | 0.952381 | 1 | 0.909091 |
| NOT-CLDN19 AND SGCD AND NOT-SLC7A14 | 0.952381 | 1 | 0.909091 |
| NOT-SLC34A3 AND TTYH2 AND ANO1 | 0.952381 | 1 | 0.909091 |
| GPR137B AND NOT-TSPAN8 AND TYRO3 | 0.952381 | 1 | 0.909091 |
| GPR137B AND SLC5A6 AND NOT-NPR3 | 0.952381 | 1 | 0.909091 |
| NOT-CHRNA2 AND SGCD AND APLNR | 0.952381 | 1 | 0.909091 |
| NOT-CHRNA2 AND SLC16A4 AND IGDCC4 | 0.952381 | 1 | 0.909091 |
| NOT-CHRNA2 AND SGCD AND DAGLB | 0.952381 | 1 | 0.909091 |
| NOT-CHRNA2 AND SLC16A4 AND PCDHB16 | 0.952381 | 1 | 0.909091 |
| GPR137B AND NOT-NPR3 AND KCNS3 | 0.952381 | 1 | 0.909091 |
| NOT-CHRNA2 AND SLC16A4 AND LGR4 | 0.952381 | 1 | 0.909091 |

FIG. 15 (cont.)

| Antigen Pair Logic | F1 | Precision | Recall | Antigen Pair Logic | F1 | Precision | Recall |
|---|---|---|---|---|---|---|---|
| SLC43A1 AND FLVCR1 AND NOT-AOC3 | 1 | 1 | 1 | NOT-CLDN19 AND SGCD AND SLC31A2 | 0.952381 | 1 | 0.909091 |
| COMPLEX-PCDHB1/SLC2A2/PLVAP | 0.923077 | 0.857143 | 1 | NOT-CLDN19 AND SGCD AND ZNRF3 | 0.952381 | 1 | 0.909091 |
| SLCO1B1 AND SMPD2 AND NOT-ABCA12 | 1 | 1 | 1 | COMPLEX-CHRNA2/CNIH3/MCOLN1 | 0.952381 | 1 | 0.909091 |
| SLCO1B1 AND SMPD2 AND NOT-STEAP4 | 1 | 1 | 1 | NOT-CHRNA2 AND SGCD AND PMEPA1 | 0.952381 | 1 | 0.909091 |
| SLCO1B1 AND SMPD2 AND NOT-PCDH11Y | 1 | 1 | 1 | NOT-CHRNA2 AND SGCD AND BRCA1 | 0.952381 | 1 | 0.909091 |
| SLCO1B1 AND SMPD2 AND NOT-CD163 | 1 | 1 | 1 | NOT-SLC5A5 AND TTYH2 AND FZD7 | 0.952381 | 1 | 0.909091 |
| SLCO1B1 AND PVRL1 AND NOT-SLC17A2 | 0.923077 | 0.857143 | 1 | NOT-CHRNA2 AND SGCD AND FZD4 | 0.952381 | 1 | 0.909091 |
| SLCO1B1 AND SMPD2 AND NOT-GYPC | 1 | 1 | 1 | NOT-CHRNA2 AND SLC16A4 AND PCDHB14 | 0.952381 | 1 | 0.909091 |
| COMPLEX-P2RY4/SLC2A2/PLVAP | 0.909091 | 1 | 0.833333 | NOT-CHRNA2 AND SGCD AND AKAP1 | 0.952381 | 1 | 0.909091 |
| ABCG5 AND NOT-MUC17 AND KCNJ6 | 0.909091 | 1 | 0.833333 | NOT-CHRNA2 AND TTYH2 AND EMP1 | 1 | 1 | 1 |
| SLCO1B1 AND SMPD2 AND NOT-PPAPDC1A | 0.909091 | 1 | 0.833333 | NOT-CHRNA2 AND TTYH2 AND TIE1 | 1 | 1 | 1 |
| SLCO1B1 AND SMPD2 AND NOT-CLDN10 | 0.909091 | 1 | 0.833333 | GPR137B AND TTYH2 AND NOT-CD300LB | 1 | 1 | 1 |
| SLC2A2 AND PCDHB1 AND GYPC | 0.909091 | 1 | 0.833333 | NOT-CHRNA2 AND TTYH2 AND OSMR | 1 | 1 | 1 |
| SLC43A1 AND FLVCR1 AND NOT-MMP24 | 1 | 1 | 1 | GPR137B AND TTYH2 AND NOT-CCR3 | 1 | 1 | 1 |
| SLC43A1 AND FLVCR1 AND NOT-SLC9B1 | 1 | 1 | 1 | GPR137B AND TTYH2 AND NOT-CD300LB | 1 | 1 | 1 |
| SLC43A1 AND FLVCR1 AND NOT-CD44 | 1 | 1 | 1 | NOT-CHRNA2 AND TTYH2 AND ZNRF3 | 1 | 1 | 1 |
| SLC43A1 AND FLVCR1 AND NOT-DGKE | 1 | 1 | 1 | NOT-CHRNA2 AND TTYH2 AND ANO1 | 1 | 1 | 1 |
| SLC43A1 AND FLVCR1 AND NOT-SLC22A5 | 1 | 1 | 1 | GPR137B AND TTYH2 AND ATP1A1 | 1 | 1 | 1 |
| SLC43A1 AND FLVCR1 AND NOT-KCNK6 | 1 | 1 | 1 | NOT-CHRNA2 AND TTYH2 AND TSPAN11 | 1 | 1 | 1 |
| SLC43A1 AND FLVCR1 AND NOT-MPL | 1 | 1 | 1 | NOT-CHRNA2 AND TTYH2 AND WNT5A | 1 | 1 | 1 |
| SLC43A1 AND FLVCR1 AND NOT-ZACN | 1 | 1 | 1 | NOT-CHRNA2 AND TTYH2 AND CAV2 | 1 | 1 | 1 |
| SLC43A1 AND FLVCR1 AND NOT-GUCY2D | 1 | 1 | 1 | NOT-CHRNA2 AND TTYH2 AND KCNK15 | 1 | 1 | 1 |
| SLC43A1 AND FLVCR1 AND NOT-LAT | 1 | 1 | 1 | NOT-CHRNA2 AND TTYH2 AND FZD7 | 1 | 1 | 1 |
| SLC43A1 AND FLVCR1 AND NOT-PAQR7 | 1 | 1 | 1 | NOT-CHRNA2 AND TTYH2 AND TIE1 | 1 | 1 | 1 |
| SLC43A1 AND FLVCR1 AND NOT-SELP | 0.909091 | 1 | 0.833333 | NOT-CHRNA2 AND TTYH2 AND TMEM231 | 1 | 1 | 1 |
| SLC43A1 AND FLVCR1 AND NOT-GPR22 | 1 | 1 | 1 | GPR137B AND TTYH2 AND NOT-SPN | 1 | 1 | 1 |
| SLC43A1 AND RGR AND NOT-CD163 | 0.909091 | 1 | 0.833333 | GPR137B AND TTYH2 AND NOT-AQP9 | 1 | 1 | 1 |
| SLC43A1 AND FLVCR1 AND NOT-SYT11 | 1 | 1 | 1 | GPR137B AND TTYH2 AND NOT-CD300C | 1 | 1 | 1 |
| SLC43A1 AND FLVCR1 AND NOT-ATP8B2 | 0.909091 | 1 | 0.833333 | NOT-CHRNA2 AND TTYH2 AND FZD7 | 1 | 1 | 1 |
| SLC43A1 AND FLVCR1 AND NOT-LRRC8E | 1 | 1 | 1 | NOT-CHRNA2 AND TTYH2 AND FAM57A | 1 | 1 | 1 |
| SLC43A1 AND FLVCR1 AND NOT-SLC16A5 | 1 | 1 | 1 | NOT-CHRNA2 AND TTYH2 AND OSMR | 1 | 1 | 1 |
| ABCG5 AND FLVCR1 AND NOT-SLC9A1 | 1 | 1 | 1 | NOT-CHRNA2 AND TTYH2 AND SGCD | 1 | 1 | 1 |
| SLC43A1 AND FLVCR1 AND NOT-SLC9A1 | 1 | 1 | 1 | NOT-CHRNA2 AND TTYH2 AND EMP1 | 1 | 1 | 1 |
| SLC43A1 AND FLVCR1 AND NOT-NFASC | 1 | 1 | 1 | NOT-CHRNA2 AND TTYH2 AND GPR161 | 1 | 1 | 1 |
| SLC43A1 AND FLVCR1 AND NOT-SEMA4D | 1 | 1 | 1 | NOT-CHRNA2 AND TTYH2 AND GJB2 | 1 | 1 | 1 |
| SLC43A1 AND FLVCR1 AND NOT-FXYD6 | 1 | 1 | 1 | NOT-CHRNA2 AND TTYH2 AND TMEM231 | 1 | 1 | 1 |
| SLC43A1 AND FLVCR1 AND NOT-GPR22 | 1 | 1 | 1 | NOT-CHRNA2 AND TTYH2 AND TNFRSF19 | 1 | 1 | 1 |
| SLCO1B1 AND SMPD2 AND NOT-KCNH4 | 1 | 1 | 1 | NOT-CHRNA2 AND TTYH2 AND LGR4 | 1 | 1 | 1 |
| SLCO1B1 AND SMPD2 AND NOT-ATP8B2 | 1 | 1 | 1 | NOT-CHRNA2 AND TTYH2 AND TSPAN11 | 1 | 1 | 1 |
| SLCO1B1 AND SMPD2 AND NOT-PORCN | 1 | 1 | 1 | NOT-CHRNA2 AND TTYH2 AND FXYD3 | 1 | 1 | 1 |
| SLCO1B1 AND SMPD2 AND NOT-UPK3A | 0.909091 | 1 | 0.833333 | NOT-CHRNA2 AND TTYH2 AND XG | 1 | 1 | 1 |
| SLCO1B1 AND SMPD2 AND NOT-CD1A | 1 | 1 | 1 | NOT-CHRNA2 AND TTYH2 AND PERP | 1 | 1 | 1 |
| SLCO1B1 AND SMPD2 AND NOT-CD93 | 1 | 1 | 1 | NOT-CHRNA2 AND TTYH2 AND ANO1 | 1 | 1 | 1 |
| SLCO1B1 AND SMPD2 AND NOT-ATP1B4 | 1 | 1 | 1 | NOT-CHRNA2 AND TTYH2 AND KCNK15 | 1 | 1 | 1 |
| SLCO1B1 AND SMPD2 AND NOT-AOC3 | 1 | 1 | 1 | NOT-CHRNA2 AND TTYH2 AND SLCO2A1 | 1 | 1 | 1 |
| SLCO1B1 AND SMPD2 AND NOT-NOX1 | 1 | 1 | 1 | NOT-CHRNA2 AND TTYH2 AND GJA4 | 1 | 1 | 1 |
| SLCO1B1 AND SMPD2 AND NOT-EPHA10 | 1 | 1 | 1 | NOT-CHRNA2 AND TTYH2 AND SCARB1 | 1 | 1 | 1 |
| SLCO1B1 AND SMPD2 AND NOT-ICAM1 | 1 | 1 | 1 | NOT-CHRNA2 AND TTYH2 AND WNT5A | 1 | 1 | 1 |
| SLCO1B1 AND SMPD2 AND NOT-SLC12A9 | 1 | 1 | 1 | NOT-CHRNA2 AND TTYH2 AND CAV1 | 1 | 1 | 1 |
| SLCO1B1 AND SMPD2 AND NOT-OXTR | 1 | 1 | 1 | NOT-CHRNA2 AND TTYH2 AND ZNRF3 | 1 | 1 | 1 |
| SLCO1B1 AND SMPD2 AND NOT-DCC | 1 | 1 | 1 | NOT-CHRNA2 AND TTYH2 AND ITGA3 | 1 | 1 | 1 |
| SLCO1B1 AND SMPD2 AND NOT-CABP7 | 1 | 1 | 1 | NOT-CHRNA2 AND TTYH2 AND GPR153 | 1 | 1 | 1 |
| SLCO1B1 AND SMPD2 AND NOT-SV2C | 1 | 1 | 1 | NOT-CHRNA2 AND TTYH2 AND XG | 1 | 1 | 1 |
| SLCO1B1 AND SMPD2 AND NOT-CLDN15 | 0.909091 | 1 | 0.833333 | NOT-CHRNA2 AND TTYH2 AND PERP | 1 | 1 | 1 |
| SLCO1B1 AND SMPD2 AND NOT-SLC24A2 | 1 | 1 | 1 | NOT-CHRNA2 AND TTYH2 AND GJA4 | 1 | 1 | 1 |
| SLCO1B1 AND SMPD2 AND NOT-CDH20 | 1 | 1 | 1 | NOT-CHRNA2 AND TTYH2 AND VANGL2 | 1 | 1 | 1 |
| SLCO1B1 AND SMPD2 AND NOT-OR4N4 | 1 | 1 | 1 | NOT-CHRNA2 AND TTYH2 AND FZD4 | 1 | 1 | 1 |
| SLCO1B1 AND SMPD2 AND NOT-GPR22 | 1 | 1 | 1 | NOT-CHRNA2 AND TTYH2 AND PCDH18 | 1 | 1 | 1 |
| SLCO1B1 AND SMPD2 AND NOT-GPR26 | 1 | 1 | 1 | NOT-CHRNA2 AND TTYH2 AND EMP2 | 1 | 1 | 1 |
| SLCO1B1 AND SMPD2 AND NOT-GRM7 | 1 | 1 | 1 | NOT-CHRNA2 AND TTYH2 AND ADRA2C | 1 | 1 | 1 |
| SLCO1B1 AND SMPD2 AND NOT-SLC39A2 | 1 | 1 | 1 | NOT-CHRNA2 AND TTYH2 AND PCDHB16 | 1 | 1 | 1 |
| SLCO1B1 AND SMPD2 AND NOT-ATP13A5 | 1 | 1 | 1 | NOT-CHRNA2 AND FAT1 AND NOT-KCNK5 | 1 | 1 | 1 |
| SLCO1B1 AND SMPD2 AND NOT-KCNA4 | 1 | 1 | 1 | NOT-CHRNA2 AND TTYH2 AND ANO10 | 1 | 1 | 1 |
| SLCO1B1 AND SMPD2 AND NOT-LRRC52 | 1 | 1 | 1 | NOT-CHRNA2 AND TTYH2 AND ANTXR1 | 1 | 1 | 1 |
| SLCO1B1 AND SMPD2 AND NOT-OR4N4 | 1 | 1 | 1 | NOT-CHRNA2 AND TTYH2 AND SDC3 | 1 | 1 | 1 |
| SLC43A1 AND NOT-MUC1 AND FGF6 | 0.909091 | 1 | 0.833333 | NOT-CHRNA2 AND TTYH2 AND EMP2 | 1 | 1 | 1 |
| SLC43A1 AND FLVCR1 AND NOT-MUC1 | 1 | 1 | 1 | NOT-CHRNA2 AND TTYH2 AND TSPAN6 | 1 | 1 | 1 |
| SLCO1B1 AND SMPD2 AND NOT-MSLN | 1 | 1 | 1 | NOT-CHRNA2 AND TTYH2 AND ADRA2C | 1 | 1 | 1 |
| SLCO1B1 AND SMPD2 AND NOT-TNFRSF10A | 1 | 1 | 1 | NOT-CHRNA2 AND TTYH2 AND CNTNAP1 | 1 | 1 | 1 |
| SLCO1B1 AND SMPD2 AND NOT-MSLN | 1 | 1 | 1 | NOT-CHRNA2 AND TTYH2 AND TSPAN6 | 1 | 1 | 1 |
| SLC43A1 AND NOT-MUC1 AND KCNJ6 | 0.909091 | 1 | 0.833333 | NOT-CHRNA2 AND FAT1 AND NOT-CADM2 | 1 | 1 | 1 |
| SLC43A1 AND NOT-MUC1 AND SMPD2 | 1 | 1 | 1 | NOT-CHRNA2 AND TTYH2 AND ADCY6 | 1 | 1 | 1 |
| SLCO1B1 AND ZACN AND NOT-MSLN | 0.909091 | 1 | 0.833333 | GPR137B AND TTYH2 AND NOT-SLC46A2 | 1 | 1 | 1 |
| DIO1 AND FLVCR1 AND NOT-MUC1 | 1 | 1 | 1 | NOT-CHRNA2 AND TTYH2 AND PCDHB14 | 1 | 1 | 1 |
| SLC43A1 AND NOT-MUC1 AND SLC22A12 | 0.909091 | 1 | 0.833333 | NOT-CHRNA2 AND TTYH2 AND FZD6 | 1 | 1 | 1 |
| SLCO1B1 AND DTNA AND NOT-MSLN | 0.909091 | 1 | 0.833333 | NOT-CHRNA2 AND OSMR AND NOT-ATP13A5 | 1 | 1 | 1 |
| SLC43A1 AND NOT-MUC1 AND SCN2A | 0.909091 | 1 | 0.833333 | NOT-CHRNA2 AND TSPAN11 AND NOT-ATP13A5 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| ABCG5 AND ALCAM AND NOT-MSLN | 1 | 1 | 1 | NOT-CHRNA2 AND EMP1 AND NOT-ATP13A5 | 1 | 1 | 1 |
| ABCG5 AND ALCAM AND NOT-MUC1 | 1 | 1 | 1 | NOT-CHRNA2 AND TTYH2 AND PCDHB14 | 1 | 1 | 1 |
| SLC43A1 AND NOT-MUC1 AND DTNA | 0.909091 | 1 | 0.833333 | NOT-CHRNA2 AND TIE1 AND NOT-ATP13A5 | 1 | 1 | 1 |
| SLC2A2 AND DTNA AND MSLN | 0.909091 | 1 | 0.833333 | NOT-CHRNA2 AND TTYH2 AND FZD6 | 1 | 1 | 1 |
| SLC43A1 AND NOT-MUC1 AND SLC22A5 | 0.909091 | 1 | 0.833333 | NOT-CHRNA2 AND TTYH2 AND CNIH3 | 1 | 1 | 1 |
| SLC43A1 AND NOT-MUC1 AND PCDHB1 | 1 | 1 | 1 | NOT-TM4SF5 AND TTYH2 AND LRIG3 | 1 | 1 | 1 |
| SLC43A1 AND NOT-MUC1 AND PCDHB1 | 1 | 1 | 1 | NOT-CHRNA2 AND TTYH2 AND MCOLN3 | 1 | 1 | 1 |
| SLC43A1 AND NOT-MUC1 AND GRM3 | 0.909091 | 1 | 0.833333 | GPR137B AND NOT-ATP13A5 AND VANGL2 | 1 | 1 | 1 |
| SLC43A1 AND GPR158 AND NOT-MUC1 | 0.909091 | 1 | 0.833333 | NOT-CHRNA2 AND LGR4 AND NOT-ATP13A5 | 1 | 1 | 1 |
| ABCG5 AND GPR158 AND NOT-MUC1 | 0.909091 | 1 | 0.833333 | GPR137B AND NOT-ATP13A5 AND TSPAN11 | 1 | 1 | 1 |
| SLC43A1 AND NOT-MUC1 AND MRGPRX2 | 0.909091 | 1 | 0.833333 | NOT-CHRNA2 AND CAV1 AND NOT-ATP13A5 | 1 | 1 | 1 |
| ABCG5 AND DTNA AND NOT-MUC1 | 0.909091 | 1 | 0.833333 | NOT-CHRNA2 AND GJA4 AND NOT-ATP13A5 | 1 | 1 | 1 |
| ABCG5 AND DTNA AND NOT-MSLN | 0.909091 | 1 | 0.833333 | NOT-CHRNA2 AND FAT1 AND NOT-CFTR | 1 | 1 | 1 |
| SLC43A1 AND NOT-MUC1 AND PVRL1 | 1 | 1 | 1 | NOT-CHRNA2 AND TTYH2 AND IGDCC4 | 1 | 1 | 1 |
| SLC43A1 AND ZACN AND NOT-MUC1 | 0.909091 | 1 | 0.833333 | NOT-CHRNA2 AND TTYH2 AND PDGFRA | 1 | 1 | 1 |
| SLC43A1 AND NOT-MUC1 AND DRD5 | 1 | 1 | 1 | NOT-CHRNA2 AND TTYH2 AND PDGFRA | 1 | 1 | 1 |
| SLC43A1 AND NOT-MUC1 AND NOT-CD163 | 0.909091 | 1 | 0.833333 | NOT-CHRNA2 AND TTYH2 AND PMP22 | 1 | 1 | 1 |
| ABCG5 AND FGF6 AND NOT-MUC1 | 0.833333 | 0.833333 | 0.833333 | NOT-CHRNA2 AND TTYH2 AND GJA1 | 1 | 1 | 1 |
| SLCO1B1 AND SLC22A11 AND NOT-MSLN | 0.833333 | 0.833333 | 0.833333 | NOT-CHRNA2 AND TTYH2 AND APCDD1 | 1 | 1 | 1 |
| SLCO1B1 AND FGF6 AND NOT-MSLN | 0.833333 | 0.833333 | 0.833333 | NOT-CHRNA2 AND TTYH2 AND FZD3 | 0.956522 | 0.916667 | 1 |
| SLC43A1 AND NOT-MUC1 AND KCNK16 | 0.909091 | 1 | 0.833333 | NOT-CHRNA2 AND TTYH2 AND ADAM12 | 0.956522 | 0.916667 | 1 |
| SLC43A1 AND NOT-MUC1 AND KCNK16 | 0.909091 | 1 | 0.833333 | GPR137B AND TTYH2 AND SLC12A1 | 0.956522 | 0.916667 | 1 |
| DIO1 AND NOT-MUC1 AND ALCAM | 1 | 1 | 1 | NOT-CHRNA2 AND PCDHB14 AND NOT-ATP13A5 | 1 | 1 | 1 |
| SLC2A2 AND KCNJ6 AND MSLN | 0.909091 | 1 | 0.833333 | NOT-CHRNA2 AND SORT1 AND NOT-PCDH8 | 1 | 1 | 1 |
| SLCO1B1 AND SLC12A9 AND NOT-MUC1 | 0.857143 | 0.75 | 1 | NOT-CHRNA2 AND ADRA2C AND NOT-ATP13A5 | 1 | 1 | 1 |
| SLC43A1 AND NOT-MUC1 AND RGSL1 | 0.909091 | 1 | 0.833333 | NOT-CHRNA2 AND TTYH2 AND ITGA2 | 1 | 1 | 1 |
| SLC43A1 AND NOT-MUC1 AND LHFPL5 | 1 | 1 | 1 | NOT-TM4SF5 AND TTYH2 AND S1PR1 | 1 | 1 | 1 |
| SLC2A2 AND TMEFF2 AND MSLN | 0.833333 | 0.833333 | 0.833333 | GPR137B AND NOT-ATP13A5 AND NOT-SLC7A7 | 1 | 1 | 1 |
| SLC43A1 AND NOT-MUC1 AND LHFPL5 | 1 | 1 | 1 | NOT-CHRNA2 AND TTYH2 AND WLS | 0.956522 | 0.916667 | 1 |
| SLC43A1 AND HTR1E AND NOT-MUC1 | 0.909091 | 1 | 0.833333 | NOT-CHRNA2 AND FAT1 AND NOT-SCNN1G | 1 | 1 | 1 |
| SLC2A2 AND SMPD2 AND MSLN | 1 | 1 | 1 | NOT-CHRNA2 AND TTYH2 AND KITLG | 1 | 1 | 1 |
| SLC2A2 AND ZACN AND MSLN | 0.909091 | 1 | 0.833333 | NOT-CHRNA2 AND LGR4 AND NOT-CLDN8 | 1 | 1 | 1 |
| SLC43A1 AND NOT-MUC1 AND MMP24 | 0.909091 | 1 | 0.833333 | NOT-CLDN19 AND GPNMB AND NOT-KCNK5 | 1 | 1 | 1 |
| SLC43A1 AND NOT-MUC1 AND ROS1 | 1 | 1 | 1 | NOT-TM4SF5 AND TTYH2 AND GPNMB | 1 | 1 | 1 |
| SLC43A1 AND NOT-MUC1 AND GABRA5 | 1 | 1 | 1 | NOT-CLDN19 AND GPNMB AND NOT-CFTR | 1 | 1 | 1 |
| SLC43A1 AND NOT-MUC1 AND FUT3 | 0.909091 | 1 | 0.833333 | NOT-CHRNA2 AND SDC1 AND NOT-CFTR | 1 | 1 | 1 |
| SLC43A1 AND NOT-MUC1 AND OR7C1 | 0.909091 | 1 | 0.833333 | NOT-CHRNA2 AND TIE1 AND NOT-CLDN8 | 1 | 1 | 1 |
| SLC2A2 AND SLC22A11 AND MSLN | 0.909091 | 1 | 0.833333 | NOT-CLDN19 AND GPNMB AND NOT-CADM2 | 1 | 1 | 1 |
| SLC43A1 AND NOT-MUC1 AND SLC30A8 | 0.909091 | 1 | 0.833333 | NOT-CHRNA2 AND TMEM231 AND NOT-ERBB2 | 1 | 1 | 1 |
| SLCO1B1 AND SLC50A1 AND NOT-MSLN | 1 | 1 | 1 | GPR137B AND NOT-NPR3 AND ERBB3 | 1 | 1 | 1 |
| SLC2A2 AND GABRA5 AND MSLN | 0.857143 | 0.75 | 1 | GPR137B AND NOT-CLDN8 AND TYRO3 | 1 | 1 | 1 |
| SLC43A1 AND NOT-MUC1 AND CALN1 | 0.909091 | 1 | 0.833333 | NOT-CHRNA2 AND GPNMB AND NOT-KCNK5 | 1 | 1 | 1 |
| SLC2A2 AND MSLN AND GPR61 | 0.909091 | 1 | 0.833333 | NOT-CHRNA2 AND SDC1 AND NOT-KCNK5 | 1 | 1 | 1 |
| SLC2A2 AND MSLN AND NOT-C8B | 0.857143 | 0.75 | 1 | GPR137B AND NOT-CLDN8 AND TYRO3 | 1 | 1 | 1 |
| SLC43A1 AND NOT-MUC1 AND CRB2 | 0.909091 | 1 | 0.833333 | GPR137B AND NOT-CLDN8 AND KCNS3 | 1 | 1 | 1 |
| SLC2A2 AND MSLN AND SLCO1A2 | 0.857143 | 0.75 | 1 | NOT-CHRNA2 AND PCDHB14 AND NOT-CLDN8 | 1 | 1 | 1 |
| SLC2A2 AND MSLN AND NOT-MUC17 | 0.857143 | 0.75 | 1 | NOT-CHRNA2 AND TMEM231 AND NOT-ERBB2 | 1 | 1 | 1 |
| SLC43A1 AND NOT-MUC1 AND OPCML | 1 | 1 | 1 | GPR137B AND NOT-CLDN8 AND ATP1A1 | 1 | 1 | 1 |
| SLC43A1 AND NOT-MUC17 AND MSLN | 1 | 1 | 1 | NOT-TM4SF5 AND TTYH2 AND SDC1 | 0.956522 | 0.916667 | 1 |
| SLC43A1 AND NOT-MUC1 AND SEZ6 | 1 | 1 | 1 | NOT-TM4SF5 AND GPNMB AND NOT-ATP13A5 | 1 | 1 | 1 |
| SLC2A2 AND MSLN AND SLCO1A2 | 0.857143 | 0.75 | 1 | NOT-TM4SF5 AND TTYH2 AND TPBG | 1 | 1 | 1 |
| SLC2A2 AND MSLN AND NOT-MUC17 | 0.857143 | 0.75 | 1 | NOT-SLC5A5 AND TTYH2 AND TPBG | 0.952381 | 1 | 0.909091 |
| ABCG5 AND GPC3 AND NOT-OR1C1 | 0.8 | 1 | 0.666667 | NOT-GIPR AND TTYH2 AND GPNMB | 0.952381 | 1 | 0.909091 |
| ABCG5 AND GPC3 AND NOT-SLC10A2 | 0.8 | 1 | 0.666667 | NOT-CHRNA2 AND NOT-CADM2 AND THY1 | 0.952381 | 1 | 0.909091 |
| ABCG5 AND GPC3 AND NOT-SLC22A6 | 0.8 | 1 | 0.666667 | GPR137B AND NOT-CLDN8 AND APOLD1 | 0.952381 | 1 | 0.909091 |
| ABCG5 AND GPC3 AND NOT-LHFPL5 | 0.8 | 1 | 0.666667 | NOT-CLDN19 AND ENG AND NOT-GLDN | 0.952381 | 1 | 0.909091 |
| ABCG5 AND GPC3 AND FLVCR1 | 0.8 | 1 | 0.666667 | NOT-CHRNA2 AND LGR4 AND NOT-VTCN1 | 0.952381 | 1 | 0.909091 |
| SLCO1B1 AND GPC3 AND SCN8A | 0.8 | 1 | 0.666667 | NOT-SLC5A5 AND TTYH2 AND GPNMB | 0.952381 | 1 | 0.909091 |
| SLC2A2 AND GPC3 AND NOX1 | 0.8 | 1 | 0.666667 | GPR137B AND NOT-CADM2 AND ERBB2 | 0.952381 | 1 | 0.909091 |
| ABCG5 AND GPC3 AND NOT-PCDH11Y | 0.8 | 1 | 0.666667 | NOT-CLDN19 AND GPNMB AND NOT-LYPD6B | 0.952381 | 1 | 0.909091 |
| SLC2A2 AND GPC3 AND DRD5 | 0.8 | 1 | 0.666667 | GPR137B AND SLC5A6 AND NOT-CLDN8 | 0.952381 | 1 | 0.909091 |
| ABCG5 AND GPC3 AND NOT-ATP8A1 | 0.8 | 1 | 0.666667 | ABCG5 AND GPC3 AND NOT-GPR6 | 0.8 | 1 | 0.666667 | NOT-CLDN19 AND GPNMB AND NOT-TSPAN8 | 0.952381 | 1 | 0.909091 |
| SLCO1B1 AND MSLN AND NOT-SLC17A2 | 0.8 | 0.666667 | 1 | GPR137B AND NOT-NTRK3 AND ERBB3 | 0.952381 | 1 | 0.909091 |
| ABCG5 AND GPC3 AND NOT-ADAM21 | 0.8 | 1 | 0.666667 | GPR137B AND NOT-CADM2 AND ERBB2 | 0.952381 | 1 | 0.909091 |
| ABCG5 AND GPC3 AND NOT-SLC9A1 | 0.8 | 1 | 0.666667 | COMPLEX-CHRNA2/MST1R/SGCD | 0.952381 | 1 | 0.909091 |
| ABCG5 AND GPC3 AND NOT-GSG1L | 0.8 | 1 | 0.666667 | GPR137B AND NOT-TSPAN8 AND ERBB3 | 0.952381 | 1 | 0.909091 |
| ABCG5 AND GPC3 AND NOT-KCNK10 | 0.8 | 1 | 0.666667 | NOT-CHRNA2 AND SLC16A4 AND SDC1 | 0.952381 | 1 | 0.909091 |
| ABCG5 AND GPC3 AND PVRL1 | 0.8 | 1 | 0.666667 | NOT-CHRNA2 AND SGCD AND IL11RA | 0.952381 | 1 | 0.909091 |
| ABCG8 AND SLC2A2 AND MSLN | 0.8 | 1 | 0.666667 | COMPLEX-CHRNA2/SGCD/TPBG | 0.952381 | 1 | 0.909091 |
| ABCG5 AND GPC3 AND NOT-CCR9 | 0.8 | 1 | 0.666667 | GPR137B AND NOT-CLDN8 AND IGSF8 | 0.952381 | 1 | 0.909091 |
| SLC2A2 AND MSLN AND CSPG5 | 1 | 1 | 1 | GPR137B AND NOT-NPR3 AND L1CAM | 0.952381 | 1 | 0.909091 |
| DIO1 AND GPC3 AND FLVCR1 | 0.8 | 1 | 0.666667 | NOT-CHRNA2 AND TMEM231 AND NOT-EGFR | 0.952381 | 1 | 0.909091 |
| ABCG5 AND GPC3 AND NOT-CATSPER3 | 0.8 | 1 | 0.666667 | NOT-CHRNA2 AND SDC1 AND NOT-TSPAN8 | 0.952381 | 1 | 0.909091 |
| ABCG5 AND GPC3 AND NOT-CD1A | 0.8 | 1 | 0.666667 | NOT-CHRNA2 AND IGSF8 AND NOT-ERBB2 | 0.952381 | 1 | 0.909091 |
| ABCG5 AND GPC3 AND NOT-AJAP1 | 0.8 | 1 | 0.666667 | NOT-CHRNA2 AND SORT1 AND NOT-ERBB2 | 1 | 1 | 1 |
| ABCG5 AND GPC3 AND NOT-ROS1 | 0.8 | 1 | 0.666667 | NOT-CHRNA2 AND PVRL2 AND NOT-ERBB2 | 0.952381 | 1 | 0.909091 |

FIG. 15 (cont.)

| Antigen Pair Logic | F1 | Precision | Recall | Antigen Pair Logic | F1 | Precision | Recall |
|---|---|---|---|---|---|---|---|
| ABCG5 AND GPC3 AND NOT-SLC39A2 | 0.8 | 1 | 0.666667 | NOT-CHRNA2 AND ITGB5 AND NOT-ERBB2 | 0.952381 | 1 | 0.909091 |
| SLC43A1 AND CNTNAP4 AND NOT-MUC1 | 0.8 | 1 | 0.666667 | NOT-CHRNA2 AND LGR4 AND NOT-ERBB2 | 1 | 1 | 1 |
| SLC43A1 AND MLANA AND NOT-MUC1 | 0.8 | 1 | 0.666667 | GPR137B AND NOT-ERBB2 AND TYRO3 | 1 | 1 | 1 |
| SLCO1B1 AND CALN1 AND NOT-MUC1 | 0.8 | 0.666667 | 1 | NOT-CHRNA2 AND GPNMB AND NOT-CFTR | 1 | 1 | 1 |
| SLC43A1 AND NOT-MUC1 AND NPBWR1 | 0.8 | 1 | 0.666667 | NOT-CHRNA2 AND SORT1 AND NOT-ERBB2 | 1 | 1 | 1 |
| SLC43A1 AND FAT1 AND NOT-MUC1 | 0.8 | 1 | 0.666667 | NOT-CHRNA2 AND LGR4 AND NOT-ERBB2 | 1 | 1 | 1 |
| ABCG5 AND GPC3 AND NOT-MSLN | 0.8 | 1 | 0.666667 | NOT-CLDN19 AND GPNMB AND NOT-ACSL1 | 0.952381 | 1 | 0.909091 |
| SLC43A1 AND NOT-MUC1 AND TNFRSF10A | 0.8 | 1 | 0.666667 | GPR137B AND NOT-CLDN8 AND VANGL2 | 1 | 1 | 1 |
| ABCG5 AND GPC3 AND NOT-MUC1 | 0.8 | 1 | 0.666667 | NOT-CHRNA2 AND ZNRF3 AND NOT-CLDN8 | 1 | 1 | 1 |
| SLC2A2 AND GPC3 AND MSLN | 0.8 | 1 | 0.666667 | GPR137B AND NOT-CLDN8 AND PCDH7 | 1 | 1 | 1 |
| SLCO1B1 AND GPC3 AND NOT-MSLN | 0.8 | 1 | 0.666667 | COMPLEX-CLDN19/SGCD/TPBG | 0.952381 | 1 | 0.909091 |
| ASGR1 AND GPC3 AND NOT-MSLN | 0.8 | 1 | 0.666667 | GPR137B AND NOT-CADM2 AND ERBB3 | 1 | 1 | 1 |
| Pancreatic Cancer | | | | GPR137B AND NOT-ATP1A2 AND ERBB3 | 1 | 1 | 1 |
| KCNE4 AND IFNAR2 AND NOT-TSPAN14 | 0.842105 | 1 | 0.727273 | NOT-CHRNA2 AND NOT-CADM2 AND VCAM1 | 1 | 1 | 1 |
| KCNE4 AND IFNAR2 AND NOT-P2RY8 | 0.842105 | 1 | 0.727273 | NOT-CHRNA2 AND FZD7 AND NOT-CLDN8 | 1 | 1 | 1 |
| SYT13 AND ITGAM AND NOT-GRM8 | 0.869565 | 0.833333 | 0.909091 | NOT-CLDN19 AND GPNMB AND NOT-NPR3 | 1 | 1 | 1 |
| KCNE4 AND IFNAR2 AND NOT-ITGAD | 0.842105 | 1 | 0.727273 | NOT-CHRNA2 AND GPNMB AND NOT-CADM2 | 1 | 1 | 1 |
| KCNE4 AND IFNAR2 AND NOT-TMEM5 | 0.842105 | 1 | 0.727273 | NOT-CHRNA2 AND GPNMB AND NOT-TSPAN8 | 0.952381 | 1 | 0.909091 |
| NOX4 AND NOT-SLC47A1 AND GJB4 | 0.818182 | 0.818182 | 0.818182 | GPR137B AND NOT-CADM2 AND ERBB3 | 1 | 1 | 1 |
| SYT13 AND IFNAR2 AND PCDHB16 | 1 | 1 | 1 | NOT-CLDN19 AND GPNMB AND NOT-SYT8 | 0.952381 | 1 | 0.909091 |
| NTM AND NOT-RTN3 AND IFNAR2 | 0.842105 | 1 | 0.727273 | NOT-CHRNA2 AND VCAM1 AND NOT-TSPAN8 | 0.952381 | 1 | 0.909091 |
| NOX4 AND NOT-SLC47A1 AND GRM8 | 0.857143 | 0.9 | 0.818182 | GPR137B AND NOT-CLDN8 AND FAM57A | 0.952381 | 1 | 0.909091 |
| NOX4 AND NOT-SLC47A1 AND CSMD2 | 0.9 | 1 | 0.818182 | GPR137B AND NOT-CLDN8 AND VANGL2 | 1 | 1 | 1 |
| NALCN AND NOT-LRP4 AND ATP8B1 | 0.857143 | 0.9 | 0.818182 | GPR137B AND NOT-CLDN8 AND NOTCH4 | 0.952381 | 1 | 0.909091 |
| SYT13 AND IFNAR2 AND NOT-RTN3 | 0.956522 | 0.916667 | 1 | NOT-CLDN19 AND LGR4 AND NOT-CLDN8 | 1 | 1 | 1 |
| SYT13 AND IFNAR2 AND NOT-PTPRD | 0.857143 | 0.9 | 0.818182 | NOT-CHRNA2 AND NOT-ATP1A2 AND THY1 | 0.952381 | 1 | 0.909091 |
| SYT13 AND ITGAM AND NOT-GJB4 | 0.869565 | 0.833333 | 0.909091 | GPR137B AND SLC5A6 AND NOT-ERBB2 | 0.952381 | 1 | 0.909091 |
| TNFRSF12A AND PCDH7 AND VNN2 | 0.818182 | 0.818182 | 0.818182 | NOT-CHRNA2 AND TSPAN11 AND NOT-CLDN8 | 1 | 1 | 1 |
| NALCN AND LRIG3 AND NOT-XG | 0.857143 | 0.9 | 0.818182 | NOT-CHRNA2 AND VCAM1 AND NOT-KCNK5 | 1 | 1 | 1 |
| SYT13 AND VNN2 AND NOT-ADAM20 | 0.9 | 1 | 0.818182 | NOT-CHRNA2 AND NOT-CADM2 AND CD34 | 0.952381 | 1 | 0.909091 |
| NTM AND NOT-CELSR2 AND CSMD2 | 0.842105 | 1 | 0.727273 | NOT-CHRNA2 AND NOT-CADM2 AND VCAM1 | 1 | 1 | 1 |
| SLC39A14 AND NOT-LRP4 AND GRM8 | 0.857143 | 0.9 | 0.818182 | NOT-CHRNA2 AND SDC1 AND NOT-SCNN1G | 1 | 1 | 1 |
| NTM AND OTOF AND IFNAR2 | 0.842105 | 1 | 0.727273 | NOT-CACNG6 AND SDC1 AND NOT-TSPAN8 | 0.952381 | 1 | 0.909091 |
| NOX4 AND OTOF AND IFNAR2 | 0.9 | 1 | 0.818182 | GPR137B AND NOT-CLDN8 AND JAG1 | 0.952381 | 1 | 0.909091 |
| GP2 AND IFNAR2 AND NOT-SHISA9 | 0.842105 | 1 | 0.727273 | NOT-CLDN19 AND VCAM1 AND NOT-CADM2 | 1 | 1 | 1 |
| NOX4 AND USH2A AND IFNAR2 | 0.842105 | 1 | 0.727273 | GPR137B AND NOT-NPR3 AND ERBB2 | 0.952381 | 1 | 0.909091 |
| TNFRSF12A AND IFNAR2 AND NOT-RTN3 | 0.9 | 1 | 0.818182 | GPR137B AND NOT-KCNK5 AND ERBB2 | 0.952381 | 1 | 0.909091 |
| TNFRSF12A AND OR7C1 AND FAM26F | 0.9 | 1 | 0.818182 | GPR137B AND NOT-ATP1A2 AND ERBB2 | 0.952381 | 1 | 0.909091 |
| TNFRSF12A AND CACNG2 AND FAM26F | 0.9 | 1 | 0.818182 | GPR137B AND NOT-KCNK5 AND ERBB2 | 0.952381 | 1 | 0.909091 |
| PTGIS AND NOT-XG AND LRIG3 | 0.814815 | 0.6875 | 1 | GPR137B AND NOT-ATP1A2 AND ERBB2 | 0.952381 | 1 | 0.909091 |
| TNFRSF12A AND GJB4 AND FAM26F | 0.9 | 1 | 0.818182 | NOT-CACNG6 AND LGR4 AND NOT-CLDN8 | 1 | 1 | 1 |
| GP2 AND IFNAR2 AND NOT-PCDH8 | 0.842105 | 1 | 0.727273 | GPR137B AND NOT-IL20RA AND TYRO3 | 0.952381 | 1 | 0.909091 |
| NTM AND USH2A AND LRIG3 | 0.842105 | 1 | 0.727273 | NOT-CHRNA2 AND PTPRJ AND GPNMB | 0.952381 | 1 | 0.909091 |
| TNFRSF12A AND GPR1 AND IFNAR2 | 0.9 | 1 | 0.818182 | GPR137B AND NOT-CLDN8 AND SLC19A2 | 0.952381 | 1 | 0.909091 |
| FAP AND NOT-GJC1 AND OTOF | 0.842105 | 1 | 0.727273 | NOT-CLDN19 AND GPNMB AND NOT-NTRK3 | 0.952381 | 1 | 0.909091 |
| FAP AND NOT-GJC1 AND CSMD2 | 0.842105 | 1 | 0.727273 | GPR137B AND NOT-NPR3 AND ERBB2 | 0.952381 | 1 | 0.909091 |
| FAP AND NOT-GJC1 AND GJB4 | 0.842105 | 1 | 0.727273 | NOT-CLDN19 AND GPNMB AND NOT-ATP1A2 | 0.952381 | 1 | 0.909091 |
| FAP AND NOT-GJC1 AND SHISA9 | 0.842105 | 1 | 0.727273 | NOT-CLDN19 AND VCAM1 AND NOT-TSPAN8 | 0.952381 | 1 | 0.909091 |
| FAP AND SLC44A3 AND NOT-SLC6A15 | 0.842105 | 1 | 0.727273 | GPR137B AND NOT-IL20RA AND VANGL2 | 0.952381 | 1 | 0.909091 |
| SST AND ITGAM AND NOT-GJB4 | 0.842105 | 1 | 0.727273 | NOT-CHRNA2 AND BEST1 AND GPNMB | 0.952381 | 1 | 0.909091 |
| FAP AND NOT-SLC47A1 AND GRIN2B | 0.842105 | 1 | 0.727273 | NOT-CHRNA2 AND TMEM231 AND NOT-CLDN8 | 1 | 1 | 1 |
| FAP AND NOT-SLC47A1 AND GJB4 | 0.842105 | 1 | 0.727273 | NOT-CHRNA2 AND LGR4 AND NOT-IL20RA | 0.952381 | 1 | 0.909091 |
| THY1 AND IFNAR2 AND NOT-RTN3 | 0.9 | 1 | 0.818182 | NOT-CHRNA2 AND WLS AND NOT-CLDN8 | 1 | 1 | 1 |
| FAP AND SLC44A3 AND NOT-GRM3 | 0.842105 | 1 | 0.727273 | NOT-CHRNA2 AND SDC1 AND NOT-CADM2 | 0.952381 | 1 | 0.909091 |
| THY1 AND VNN2 AND FCAMR | 0.842105 | 1 | 0.727273 | NOT-CHRNA2 AND SDC1 AND NOT-CADM2 | 0.952381 | 1 | 0.909091 |
| FAP AND NOT-SLC47A1 AND LCT | 0.842105 | 1 | 0.727273 | COMPLEX-LDLRAD3/PMEL/SLC23A1 | 1 | 1 | 1 |
| FAP AND NOT-SLC47A1 AND GRM8 | 0.842105 | 1 | 0.727273 | COMPLEX-MUC12/LDLRAD3/PMEL | 1 | 1 | 1 |
| FAP AND SLC44A3 AND NOT-ADCY10 | 0.842105 | 1 | 0.727273 | COMPLEX-MLANA/CDH20/FREM2 | 1 | 1 | 1 |
| FAP AND SLC44A3 AND NOT-CSMD2 | 0.842105 | 1 | 0.727273 | COMPLEX-MLANA/NOX1/FREM2 | 1 | 1 | 1 |
| SST AND DCBLD2 AND NOT-GRM8 | 0.842105 | 1 | 0.727273 | COMPLEX-ZACN/PMEL/RNF144A | 1 | 1 | 1 |
| FAP AND IL2RG AND NOT-PTPRT | 0.842105 | 1 | 0.727273 | COMPLEX-GJA3/PMEL/RNF144A | 1 | 1 | 1 |
| DCBLD2 AND NOT-RAET1E AND OTOF | 0.842105 | 1 | 0.727273 | COMPLEX-ACSL6/PMEL/RNF144A | 1 | 1 | 1 |
| FAP AND LTB AND NOT-PTPRT | 0.842105 | 1 | 0.727273 | COMPLEX-EFNB2/PMEL/RNF144A | 1 | 1 | 1 |
| FAP AND LTB AND NOT-SLC39A2 | 0.842105 | 1 | 0.727273 | COMPLEX-HTRA2/PMEL/SLC2A1 | 1 | 1 | 1 |
| FAP AND IL2RG AND NOT-SLC6A15 | 0.842105 | 1 | 0.727273 | COMPLEX-SEMA4B/PMEL/RNF144A | 1 | 1 | 1 |
| THY1 AND VNN2 AND DIO1 | 0.842105 | 1 | 0.727273 | COMPLEX-SLC6A15/PMEL/RNF144A | 1 | 1 | 1 |
| THY1 AND VNN2 AND GRM8 | 0.842105 | 1 | 0.727273 | COMPLEX-GPR158/PMEL/RNF144A | 1 | 1 | 1 |
| THY1 AND VNN2 AND GRIN2B | 0.842105 | 1 | 0.727273 | COMPLEX-MLANA/OR10J1/FREM2 | 1 | 1 | 1 |
| THY1 AND VNN2 AND CNTNAP4 | 0.842105 | 1 | 0.727273 | COMPLEX-LDLRAD3/PMEL/CD163 | 1 | 1 | 1 |
| THY1 AND VNN2 AND SLC30A10 | 0.842105 | 1 | 0.727273 | COMPLEX-MLANA/SCARA5/FREM2 | 1 | 1 | 1 |
| FAP AND SLC44A3 AND NOT-IFNAR2 | 0.842105 | 1 | 0.727273 | COMPLEX-ABCA12/HTRA2/PMEL | 1 | 1 | 1 |
| FAP AND SLC44A3 AND NOT-LCT | 0.842105 | 1 | 0.727273 | COMPLEX-MLANA/FREM2/ATP13A5 | 1 | 1 | 1 |
| FAP AND SLC44A3 AND NOT-GLRA3 | 0.842105 | 1 | 0.727273 | COMPLEX-TNFRSF12A/PMEL/RNF144A | 1 | 1 | 1 |
| FAP AND SLC44A3 AND NOT-GPRC6A | 0.842105 | 1 | 0.727273 | COMPLEX-MLANA/FREM2/NPFFR1 | 1 | 1 | 1 |
| FAP AND SLC44A3 AND NOT-SLC22A6 | 0.842105 | 1 | 0.727273 | COMPLEX-MLANA/FREM2/CCKBR | 1 | 1 | 1 |
| FAP AND SLC44A3 AND NOT-VN1R2 | 0.842105 | 1 | 0.727273 | COMPLEX-CDH18/LDLRAD3/PMEL | 1 | 1 | 1 |
| FAP AND SLC44A3 AND NOT-GRM8 | 0.842105 | 1 | 0.727273 | COMPLEX-MLANA/TMEM235/FREM2 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| FAP AND SLC44A3 AND NOT-CDH8 | 0.842105 | 1 | 0.727273 | COMPLEX-ATP8A1/LDLRAD3/PMEL | 1 | 1 | 1 |
| FAP AND VNN2 AND NOT-PTPRT | 0.842105 | 1 | 0.727273 | COMPLEX-CLCN1/LDLRAD3/PMEL | 1 | 1 | 1 |
| FAP AND LTB AND NOT-ADAM20 | 0.842105 | 1 | 0.727273 | COMPLEX-TMPRSS11B/LDLRAD3/PMEL | 1 | 1 | 1 |
| FAP AND VNN2 AND NOT-GRM3 | 0.842105 | 1 | 0.727273 | COMPLEX-LDLRAD3/PMEL/OR2C3 | 1 | 1 | 1 |
| FAP AND IL2RG AND NOT-GRM3 | 0.842105 | 1 | 0.727273 | COMPLEX-LDLRAD3/PMEL/TRPM8 | 1 | 1 | 1 |
| SST AND IFNAR2 AND NOT-PTPRH | 0.842105 | 1 | 0.727273 | COMPLEX-LDLRAD3/PMEL/SYT4 | 1 | 1 | 1 |
| FAP AND LTB AND NOT-DSCAM | 0.842105 | 1 | 0.727273 | COMPLEX-LDLRAD3/PMEL/SLC6A6 | 1 | 1 | 1 |
| FAP AND VNN2 AND NOT-KCNJ9 | 0.842105 | 1 | 0.727273 | COMPLEX-LDLRAD3/PMEL/PCDH15 | 1 | 1 | 1 |
| FAP AND LTB AND NOT-SLC6A15 | 0.842105 | 1 | 0.727273 | COMPLEX-LDLRAD3/PMEL/SLC1A2 | 1 | 1 | 1 |
| FAP AND IL2RG AND NOT-MDGA2 | 0.842105 | 1 | 0.727273 | COMPLEX-LDLRAD3/OR1Q1/PMEL | 1 | 1 | 1 |
| FAP AND LTB AND NOT-KCNA1 | 0.842105 | 1 | 0.727273 | COMPLEX-LDLRAD3/LRRC52/PMEL | 1 | 1 | 1 |
| FAP AND VNN2 AND NOT-KCNA1 | 0.842105 | 1 | 0.727273 | COMPLEX-LDLRAD3/IL13/PMEL | 1 | 1 | 1 |
| FAP AND VNN2 AND NOT-CNGA4 | 0.842105 | 1 | 0.727273 | COMPLEX-LDLRAD3/SLC6A18/PMEL | 1 | 1 | 1 |
| FAP AND VNN2 AND NOT-ADAM20 | 0.842105 | 1 | 0.727273 | COMPLEX-LDLRAD3/NOX1/PMEL | 1 | 1 | 1 |
| FAP AND VNN2 AND NOT-ADCY10 | 0.842105 | 1 | 0.727273 | COMPLEX-LDLRAD3/EMP3/PMEL | 1 | 1 | 1 |
| STEAP1 AND NOT-LRP4 AND GRM8 | 0.833333 | 0.769231 | 0.909091 | COMPLEX-LDLRAD3/DIO1/PMEL | 1 | 1 | 1 |
| THY1 AND VNN2 AND GJB4 | 0.842105 | 1 | 0.727273 | COMPLEX-MLANA/GHR/FREM2 | 1 | 1 | 1 |
| THY1 AND VNN2 AND PTPRT | 0.842105 | 1 | 0.727273 | COMPLEX-LDLRAD3/F2R/PMEL | 1 | 1 | 1 |
| THY1 AND VNN2 AND NOT-ADAM20 | 0.842105 | 1 | 0.727273 | COMPLEX-LDLRAD3/KCNV1/PMEL | 1 | 1 | 1 |
| THY1 AND LRIG3 AND NOT-XG | 0.842105 | 1 | 0.727273 | COMPLEX-SLCO6A1/LDLRAD3/PMEL | 1 | 1 | 1 |
| THY1 AND VNN2 AND GRM3 | 0.842105 | 1 | 0.727273 | COMPLEX-ANTXR2/LDLRAD3/PMEL | 1 | 1 | 1 |
| THY1 AND VNN2 AND KCNA1 | 0.842105 | 1 | 0.727273 | COMPLEX-SLCO1B1/LDLRAD3/PMEL | 1 | 1 | 1 |
| FAP AND SLC44A3 AND NOT-ACSL6 | 0.842105 | 1 | 0.727273 | COMPLEX-LDLRAD3/PMEL/CNTNAP4 | 1 | 1 | 1 |
| NTM AND NOT-MAL AND CLDN1 | 0.842105 | 1 | 0.727273 | COMPLEX-LDLRAD3/PMEL/GJA10 | 1 | 1 | 1 |
| THY1 AND NOT-MAL AND SLC44A3 | 0.857143 | 0.9 | 0.818182 | COMPLEX-LDLRAD3/PMEL/GLRA3 | 1 | 1 | 1 |
| NTM AND NOT-MAL AND ERBB3 | 0.842105 | 1 | 0.727273 | COMPLEX-LDLRAD3/PMEL/STEAP4 | 1 | 1 | 1 |
| NTM AND NOT-MAL AND TNFRSF10A | 0.842105 | 1 | 0.727273 | COMPLEX-LDLRAD3/PMEL/SHISA9 | 1 | 1 | 1 |
| THY1 AND NOT-MAL AND TMEM30B | 0.9 | 1 | 0.818182 | COMPLEX-LDLRAD3/TMPRSS11E/PMEL | 1 | 1 | 1 |
| NOX4 AND NOT-SLC47A1 AND CLDN1 | 0.9 | 1 | 0.818182 | COMPLEX-LDLRAD3/PMEL/CD58 | 1 | 1 | 1 |
| THY1 AND NOT-MAL AND IL2RG | 0.9 | 1 | 0.818182 | COMPLEX-LDLRAD3/PMEL/GGTLC1 | 1 | 1 | 1 |
| FAP AND NOT-GJC1 AND PTPRH | 0.842105 | 1 | 0.727273 | COMPLEX-LDLRAD3/PMEL/ADAM21 | 1 | 1 | 1 |
| NOX4 AND NOT-MAL AND ERBB3 | 0.9 | 1 | 0.818182 | COMPLEX-LDLRAD3/PMEL/GPR137B | 1 | 1 | 1 |
| THY1 AND NOT-MAL AND LY75 | 0.9 | 1 | 0.818182 | COMPLEX-LDLRAD3/CACNG6/PMEL | 1 | 1 | 1 |
| FAP AND LTB AND NOT-LRFN5 | 0.842105 | 1 | 0.727273 | COMPLEX-LDLRAD3/TRPC7/PMEL | 1 | 1 | 1 |
| GPR68 AND NOT-DUOX1 AND CLDN1 | 0.869565 | 0.833333 | 0.909091 | NOT-CHRNA2 AND TTYH2 AND LRIG3 | 1 | 1 | 1 |
| FAP AND NOT-SLC47A1 AND PTPRH | 0.842105 | 1 | 0.727273 | NOT-CHRNA2 AND TTYH2 AND LRIG3 | 1 | 1 | 1 |
| ABCC3 AND CLDN1 AND NOT-SLC47A1 | 0.842105 | 1 | 0.727273 | NOT-CHRNA2 AND TTYH2 AND FAT1 | 1 | 1 | 1 |
| FAP AND SLC44A3 AND NOT-MAL | 0.842105 | 1 | 0.727273 | NOT-CHRNA2 AND TTYH2 AND PLVAP | 1 | 1 | 1 |
| FAP AND SLC44A3 AND NOT-SCN3B | 0.842105 | 1 | 0.727273 | NOT-CHRNA2 AND FAT1 AND NOT-ATP13A5 | 1 | 1 | 1 |
| NOX4 AND NOT-MAL AND TNFRSF10A | 0.842105 | 1 | 0.727273 | NOT-CHRNA2 AND TTYH2 AND PLVAP | 1 | 1 | 1 |
| FAP AND VNN2 AND NOT-LRFN5 | 0.842105 | 1 | 0.727273 | NOT-CHRNA2 AND TTYH2 AND EFNB2 | 1 | 1 | 1 |
| NALCN AND NOT-LRP4 AND SDC1 | 0.857143 | 0.9 | 0.818182 | NOT-CHRNA2 AND TTYH2 AND GHR | 1 | 1 | 1 |
| THY1 AND VNN2 AND SLC44A3 | 0.842105 | 1 | 0.727273 | NOT-CHRNA2 AND TTYH2 AND GHR | 1 | 1 | 1 |
| FAP AND SLC44A3 AND NOT-CELSR1 | 0.842105 | 1 | 0.727273 | NOT-CHRNA2 AND TTYH2 AND NOT-SORL1 | 0.956522 | 0.916667 | 1 |
| FAP AND SLC44A3 AND NOT-CLEC2B | 0.842105 | 1 | 0.727273 | NOT-CHRNA2 AND NOT-CLDN10 AND LRIG3 | 1 | 1 | 1 |
| FAP AND SLC44A3 AND NOT-GPR1 | 0.842105 | 1 | 0.727273 | GPR137B AND TTYH2 AND NOT-MPL | 0.952381 | 1 | 0.909091 |
| FAP AND NOT-SLC47A1 AND SLC44A3 | 0.842105 | 1 | 0.727273 | NOT-CHRNA2 AND TTYH2 AND TNFRSF12A | 0.952381 | 1 | 0.909091 |
| FAP AND SLC44A3 AND NOT-LYPD6B | 0.842105 | 1 | 0.727273 | NOT-CHRNA2 AND TTYH2 AND CDH11 | 0.952381 | 1 | 0.909091 |
| FAP AND SLC44A3 AND NOT-PTPRZ1 | 0.842105 | 1 | 0.727273 | NOT-CLDN19 AND TTYH2 AND LRIG3 | 0.952381 | 1 | 0.909091 |
| THY1 AND SLC44A3 AND NOT-SLC47A1 | 0.857143 | 0.9 | 0.818182 | COMPLEX-CALHM3/SLC6A15/GPR137B | 0.952381 | 1 | 0.909091 |
| THY1 AND VNN2 AND NOT-RTN3 | 0.842105 | 1 | 0.727273 | NOT-CHRNA2 AND TTYH2 AND ENPP1 | 0.952381 | 1 | 0.909091 |
| THY1 AND VNN2 AND PCDH7 | 0.842105 | 1 | 0.727273 | NOT-CHRNA2 AND EMP3 AND FAT1 | 0.952381 | 1 | 0.909091 |
| FAP AND VNN2 AND NOT-CD300LG | 0.842105 | 1 | 0.727273 | NOT-CHRNA2 AND EMP3 AND LRIG3 | 0.952381 | 1 | 0.909091 |
| FAP AND LTB AND NOT-IL1RL2 | 0.842105 | 1 | 0.727273 | NOT-CLDN19 AND FAT1 AND NOT-ATP8B1 | 0.952381 | 1 | 0.909091 |
| FAP AND NOT-SLC47A1 AND SLC5A4 | 0.842105 | 1 | 0.727273 | NOT-CLDN19 AND TTYH2 AND NOT-S1PR1 | 0.952381 | 1 | 0.909091 |
| FAP AND NOT-SLC47A1 AND ABCC9 | 0.842105 | 1 | 0.727273 | GPR137B AND NOT-CLDN10 AND FAT1 | 1 | 1 | 1 |
| FAP AND IGSF6 AND NOT-LRFN5 | 0.842105 | 1 | 0.727273 | NOT-CHRNA2 AND FAT1 AND NOT-CLDN10 | 1 | 1 | 1 |
| FAP AND IL1R2 AND NOT-TSPAN14 | 0.842105 | 1 | 0.727273 | NOT-SLC10A2 AND TTYH2 AND LRIG3 | 0.952381 | 1 | 0.909091 |
| FAP AND IL2RG AND NOT-MAL | 0.842105 | 1 | 0.727273 | NOT-CHRNA2 AND TTYH2 AND ATP6V0A4 | 0.952381 | 1 | 0.909091 |
| FAP AND NOT-SLC47A1 AND GRIK3 | 0.842105 | 1 | 0.727273 | NOT-CHRNA2 AND NOT-ATP13A5 AND LRIG3 | 0.952381 | 1 | 0.909091 |
| FAP AND TMEM30B AND NOT-GPR1 | 0.842105 | 1 | 0.727273 | NOT-CHRNA2 AND TTYH2 AND LRRC8E | 0.952381 | 1 | 0.909091 |
| FAP AND NOT-SLC47A1 AND PAQR9 | 0.842105 | 1 | 0.727273 | NOT-CHRNA2 AND FAT1 AND NOT-CD207 | 0.952381 | 1 | 0.909091 |
| NTM AND NOT-CELSR2 AND EPHB2 | 0.842105 | 1 | 0.727273 | NOT-CHRNA2 AND FAT1 AND NOT-PCDH8 | 1 | 1 | 1 |
| THY1 AND VNN2 AND NOT-GJC1 | 0.842105 | 1 | 0.727273 | NOT-CLDN19 AND LRIG3 AND NOT-CLDN10 | 1 | 1 | 1 |
| FAP AND SLC44A3 AND NOT-KCNA5 | 0.842105 | 1 | 0.727273 | NOT-CLDN19 AND VANGL1 AND NOT-ATP8B1 | 0.952381 | 1 | 0.909091 |
| THY1 AND NOT-MAL AND ERBB3 | 0.818182 | 0.818182 | 0.818182 | NOT-CHRNA2 AND FAT1 AND NOT-SLC1A6 | 1 | 1 | 1 |
| FAP AND ERBB3 AND NOT-MAL | 0.842105 | 1 | 0.727273 | GPR137B AND NOT-LCT AND FAT1 | 0.952381 | 1 | 0.909091 |
| FAP AND NOT-SLC47A1 AND CLDN1 | 0.842105 | 1 | 0.727273 | NOT-CHRNA2 AND NOT-ATP13A5 AND PLVAP | 0.952381 | 1 | 0.909091 |
| FAP AND SLC44A3 AND NOT-NCAM1 | 0.842105 | 1 | 0.727273 | NOT-CHRNA2 AND FAT1 AND NOT-GHR | 1 | 1 | 1 |
| THY1 AND NOT-MAL AND TNFRSF10A | 0.842105 | 1 | 0.727273 | NOT-CHRNA2 AND FAT1 AND NOT-CEACAM7 | 1 | 1 | 1 |
| FAP AND NOT-SLC47A1 AND L1CAM | 0.842105 | 1 | 0.727273 | NOT-CHRNA2 AND FAT1 AND NOT-GHR | 1 | 1 | 1 |
| FAP AND ERBB3 AND NOT-CELSR2 | 0.842105 | 1 | 0.727273 | NOT-CACNG6 AND FAT1 AND NOT-ATP8B1 | 0.952381 | 1 | 0.909091 |
| FAP AND NOT-SLC47A1 AND ABCB5 | 0.842105 | 1 | 0.727273 | NOT-CHRNA2 AND FAT1 AND NOT-AOC3 | 0.952381 | 1 | 0.909091 |
| FAP AND LTB AND NOT-ERBB4 | 0.842105 | 1 | 0.727273 | NOT-CHRNA2 AND FAT1 AND NOT-SLC30A10 | 0.952381 | 1 | 0.909091 |
| FAP AND ERBB3 AND NOT-RTN3 | 0.842105 | 1 | 0.727273 | NOT-CLDN19 AND LRIG3 AND NOT-ATP8B1 | 1 | 1 | 1 |
| FAP AND IL2RG AND NOT-L1CAM | 0.842105 | 1 | 0.727273 | GPR137B AND NOT-P2RY4 AND FAT1 | 0.952381 | 1 | 0.909091 |
| FAP AND IL2RG AND NOT-CLDN1 | 0.842105 | 1 | 0.727273 | GPR137B AND NOT-ATP8B1 AND FAT1 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| THY1 AND NOT-MAL AND SDC1 | 0.9 | 1 | 0.818182 | NOT-CLDN19 AND LRIG3 AND NOT-ATP8B1 | 1 | 1 | 1 |
| FAP AND ERBB3 AND NOT-PTPRZ1 | 0.842105 | 1 | 0.727273 | GPR137B AND NOT-AOC3 AND FAT1 | 0.952381 | 1 | 0.909091 |
| FAP AND ERBB3 AND NOT-LYPD6B | 0.842105 | 1 | 0.727273 | COMPLEX-NPFFR1/GPR137B/SLC23A2 | 0.916667 | 0.846154 | 1 |
| FAP AND LTB AND NOT-IL20RA | 0.842105 | 1 | 0.727273 | NOT-CHRNA2 AND TTYH2 AND VANGL1 | 0.916667 | 0.846154 | 1 |
| THY1 AND VNN2 AND IL20RA | 0.842105 | 1 | 0.727273 | GPR137B AND TTYH2 AND NOT-UPK3A | 0.916667 | 0.846154 | 1 |
| THY1 AND VNN2 AND ERBB3 | 0.842105 | 1 | 0.727273 | NOT-CHRNA2 AND FAT1 AND NOT-ATP8B1 | 1 | 1 | 1 |
| FAP AND SLC44A3 AND NOT-FCRL5 | 0.842105 | 1 | 0.727273 | NOT-CHRNA2 AND FAT1 AND NOT-ATP6V0A4 | 1 | 1 | 1 |
| FAP AND IL2RG AND NOT-ROR1 | 0.842105 | 1 | 0.727273 | NOT-GJD2 AND LRIG3 AND GPR19 | 1 | 1 | 1 |
| FAP AND LTB AND NOT-SDC1 | 0.842105 | 1 | 0.727273 | GPR137B AND NOT-SLC1A6 AND FAT1 | 1 | 1 | 1 |
| FAP AND VNN2 AND NOT-IL20RA | 0.842105 | 1 | 0.727273 | NOT-SLC10A2 AND LRIG3 AND GPR19 | 1 | 1 | 1 |
| FAP AND VNN2 AND NOT-SDC1 | 0.842105 | 1 | 0.727273 | NOT-CHRNA2 AND FAT1 AND NOT-LCT | 0.952381 | 1 | 0.909091 |
| THY1 AND NOT-MAL AND FOLH1 | 0.818182 | 0.818182 | 0.818182 | NOT-CHRNA2 AND TTYH2 AND AOC3 | 0.909091 | 0.909091 | 0.909091 |
| SST AND CLDN1 AND IL2RG | 0.842105 | 1 | 0.727273 | NOT-CHRNA2 AND TTYH2 AND ATP8B1 | 0.909091 | 0.909091 | 0.909091 |
| FAP AND CLEC7A AND NOT-CLDN1 | 0.842105 | 1 | 0.727273 | NOT-CHRNA2 AND TTYH2 AND NOT-SEMA4D | 0.909091 | 0.909091 | 0.909091 |
| SST AND CLEC7A AND NOT-GUCY2C | 0.842105 | 1 | 0.727273 | NOT-CHRNA2 AND FAT1 AND NOT-SHISA9 | 0.952381 | 1 | 0.909091 |
| FAP AND FAM26F AND NOT-ERBB4 | 0.842105 | 1 | 0.727273 | NOT-CHRNA2 AND FAT1 AND NOT-SLC13A2 | 0.952381 | 1 | 0.909091 |
| FAP AND FOLH1 AND NOT-MAL | 0.842105 | 1 | 0.727273 | GPR137B AND NOT-LCT AND PLVAP | 0.952381 | 1 | 0.909091 |
| FAP AND EPHB2 AND NOT-GPR1 | 0.842105 | 1 | 0.727273 | NOT-CHRNA2 AND FAT1 AND NOT-SLC13A2 | 0.952381 | 1 | 0.909091 |
| SST AND CLDN1 AND PTGER2 | 0.842105 | 1 | 0.727273 | NOT-CHRNA2 AND FAT1 AND NOT-PIRT | 1 | 1 | 1 |
| FAP AND FOLH1 AND NOT-RTN3 | 0.842105 | 1 | 0.727273 | GPR137B AND NOT-SLC13A2 AND FAT1 | 0.952381 | 1 | 0.909091 |
| FAP AND PTPRC AND NOT-ABCB5 | 0.842105 | 1 | 0.727273 | NOT-CHRNA2 AND FAT1 AND NOT-TMPRSS11E | 1 | 1 | 1 |
| FAP AND PTPRC AND NOT-IL20RA | 0.842105 | 1 | 0.727273 | GPR137B AND NOT-GHR AND FAT1 | 0.952381 | 1 | 0.909091 |
| STEAP2 AND CLDN1 AND NOT-CELSR1 | 0.869565 | 0.833333 | 0.909091 | NOT-OR10J1 AND LRIG3 AND GPR19 | 1 | 1 | 1 |
| FAP AND IGSF6 AND NOT-SDC1 | 0.842105 | 1 | 0.727273 | NOT-CHRNA2 AND GPR19 AND NOT-KCNJ6 | 1 | 1 | 1 |
| FAP AND ERBB3 AND NOT-PTPRC | 0.842105 | 1 | 0.727273 | GPR137B AND GPR19 AND NOT-NPFFR1 | 1 | 1 | 1 |
| FAP AND ERBB3 AND KCNJ3 | 0.842105 | 1 | 0.727273 | NOT-CHRNA2 AND GPR19 AND NOT-SCN1A | 1 | 1 | 1 |
| SST AND CLEC7A AND CLDN1 | 0.842105 | 1 | 0.727273 | NOT-CHRNA2 AND GPR19 AND NOT-SYT4 | 1 | 1 | 1 |
| SST AND CLDN1 AND FZD10 | 0.842105 | 1 | 0.727273 | NOT-CHRNA2 AND GPR19 AND SLC30A1 | 1 | 1 | 1 |
| FAP AND FCRL5 AND NOT-NRP2 | 0.842105 | 1 | 0.727273 | GPR19 AND LRIG3 AND NOT-OR1Q1 | 0.952381 | 1 | 0.909091 |
| SYT13 AND CLDN1 AND ABCB5 | 0.956522 | 0.916667 | 1 | GPR19 AND LRIG3 AND NOT-KCNK12 | 0.952381 | 1 | 0.909091 |
| THY1 AND NOT-CELSR2 AND EPHB2 | 0.842105 | 1 | 0.727273 | NOT-CHRNA2 AND ZACN AND GPR19 | 1 | 1 | 1 |
| FAP AND IGSF6 AND GUCY2C | 0.842105 | 1 | 0.727273 | NOT-CLDN19 AND GPR19 AND ZACN | 1 | 1 | 1 |
| FAP AND PTPRC AND GUCY2C | 0.842105 | 1 | 0.727273 | NOT-CHRNA2 AND GPR19 AND LRIG3 | 1 | 1 | 1 |
| FAP AND PTPRC AND NOT-CLDN12 | 0.842105 | 1 | 0.727273 | NOT-CHRNA2 AND GPR19 AND SEMA4B | 1 | 1 | 1 |
| FAP AND FAM26F AND NOT-SSTR3 | 0.842105 | 1 | 0.727273 | NOT-CHRNA2 AND GPR19 AND SLC22A18 | 1 | 1 | 1 |
| FAP AND FOLH1 AND NOT-PTPRZ1 | 0.842105 | 1 | 0.727273 | GPR19 AND LRIG3 AND NOT-CYP4A11 | 0.952381 | 1 | 0.909091 |
| SST AND CLDN1 AND CELSR1 | 0.842105 | 1 | 0.727273 | GPR137B AND GPR19 AND NOT-NMUR2 | 1 | 1 | 1 |
| SST AND CLDN1 AND SLC47A1 | 0.842105 | 1 | 0.727273 | NOT-NOX1 AND GPR19 AND LRIG3 | 0.952381 | 1 | 0.909091 |
| FAP AND KLRD1 AND NOT-CLDN1 | 0.842105 | 1 | 0.727273 | GPR137B AND GPR19 AND SLC22A5 | 0.952381 | 1 | 0.909091 |
| SST AND CLDN1 AND SGCD | 0.842105 | 1 | 0.727273 | NOT-CLDN19 AND GPR19 AND LRIG3 | 1 | 1 | 1 |
| SST AND CLDN1 AND GPR68 | 0.842105 | 1 | 0.727273 | NOT-CLDN19 AND LRIG3 AND NOT-PCDH8 | 1 | 1 | 1 |
| NTM AND NOT-MAL AND LY75 | 0.842105 | 1 | 0.727273 | NOT-CLDN19 AND LRIG3 AND NOT-PCDH8 | 1 | 1 | 1 |
| NTM AND NOT-MAL AND IL2RG | 0.842105 | 1 | 0.727273 | NOT-CHRNA2 AND FAT1 AND NOT-P2RY4 | 0.952381 | 1 | 0.909091 |
| NTM AND NOT-MAL AND SLC44A3 | 0.842105 | 1 | 0.727273 | COMPLEX-GPR19/SLC6A18/GPR137B | 0.956522 | 0.916667 | 1 |
| NTM AND NOT-MAL AND CDH1 | 0.842105 | 1 | 0.727273 | COMPLEX-SLC5A8/GPR19/GPR137B | 1 | 1 | 1 |
| KCNE4 AND LY75 AND NOT-MAL | 0.842105 | 1 | 0.727273 | COMPLEX-CALHM3/GPR19/GPR137B | 1 | 1 | 1 |
| KCNE4 AND SLC44A3 AND NOT-MAL | 0.842105 | 1 | 0.727273 | COMPLEX-GPR19/GPR137B/TAS1R1 | 0.916667 | 0.846154 | 1 |
| NTM AND NOT-MAL AND TMEM30B | 0.842105 | 1 | 0.727273 | COMPLEX-SLC6A15/CACNG6/GPR137B | 0.9 | 1 | 0.818182 |
| NOX4 AND NOT-MAL AND SLC44A3 | 0.9 | 1 | 0.818182 | COMPLEX-SLC6A15/GPR137B/LPPR3 | 0.9 | 1 | 0.818182 |
| KCNE4 AND CDH1 AND NOT-MAL | 0.842105 | 1 | 0.727273 | COMPLEX-GRIK4/SLC6A15/GPR137B | 0.9 | 1 | 0.818182 |
| KCNE4 AND IGSF6 AND NOT-TSPAN14 | 0.842105 | 1 | 0.727273 | COMPLEX-NPHS1/SLC6A15/GPR137B | 0.9 | 1 | 0.818182 |
| KCNE4 AND FAM26F AND NOT-TSPAN14 | 0.842105 | 1 | 0.727273 | COMPLEX-SLC6A15/CACNG7/GPR137B | 0.9 | 1 | 0.818182 |
| NTM AND NOT-MAL AND GPR160 | 0.842105 | 1 | 0.727273 | COMPLEX-NPBWR1/SLC6A15/GPR137B | 0.9 | 1 | 0.818182 |
| KCNE4 AND ITGB8 AND NOT-VAMP2 | 0.842105 | 1 | 0.727273 | NOT-CHRNA2 AND TTYH2 AND GPNMB | 1 | 1 | 1 |
| KCNE4 AND LTB AND NOT-FLT3LG | 0.842105 | 1 | 0.727273 | NOT-CLDN19 AND GPNMB AND TTYH2 | 1 | 1 | 1 |
| KCNE4 AND FAM26F AND NOT-ITGAD | 0.842105 | 1 | 0.727273 | NOT-CHRNA2 AND TTYH2 AND CSPG4 | 1 | 1 | 1 |
| KCNE4 AND FAM26F AND NOT-NPY5R | 0.842105 | 1 | 0.727273 | NOT-CHRNA2 AND TTYH2 AND VCAM1 | 1 | 1 | 1 |
| NTM AND NOT-MAL AND OR2F2 | 0.842105 | 1 | 0.727273 | NOT-CHRNA2 AND TTYH2 AND VCAM1 | 1 | 1 | 1 |
| KCNE4 AND IGSF6 AND NOT-FLT3LG | 0.842105 | 1 | 0.727273 | NOT-CHRNA2 AND GPNMB AND NOT-ATP13A5 | 1 | 1 | 1 |
| NOX4 AND NOT-MAL AND TMEM30B | 0.857143 | 0.9 | 0.818182 | NOT-CHRNA2 AND SDC1 AND NOT-ATP13A5 | 1 | 1 | 1 |
| KCNE4 AND IGSF6 AND NOT-ADCY7 | 0.842105 | 1 | 0.727273 | NOT-CHRNA2 AND FAT1 AND NOT-CLDN8 | 1 | 1 | 1 |
| PCDHB16 AND NOT-MAL AND IL2RG | 0.9 | 1 | 0.818182 | NOT-CHRNA2 AND TTYH2 AND STEAP2 | 1 | 1 | 1 |
| KCNE4 AND IGSF6 AND NOT-NPY5R | 0.842105 | 1 | 0.727273 | NOT-CHRNA2 AND TTYH2 AND STEAP2 | 1 | 1 | 1 |
| NOX4 AND NOT-MAL AND LY75 | 0.9 | 1 | 0.818182 | NOT-CHRNA2 AND TTYH2 AND SDC1 | 0.956522 | 0.916667 | 1 |
| NTM AND NOT-MAL AND CHRNB1 | 0.842105 | 1 | 0.727273 | NOT-CHRNA2 AND TTYH2 AND SDC1 | 0.956522 | 0.916667 | 1 |
| NTM AND NOT-RTN3 AND FAM26F | 0.842105 | 1 | 0.727273 | NOT-CHRNA2 AND TTYH2 AND ERBB2 | 0.956522 | 0.916667 | 1 |
| NOX4 AND NOT-SLC47A1 AND SLC44A3 | 0.9 | 1 | 0.818182 | NOT-CHRNA2 AND TTYH2 AND TPBG | 1 | 1 | 1 |
| NOX4 AND NOT-SLC47A1 AND CHRNB1 | 0.857143 | 0.9 | 0.818182 | NOT-CHRNA2 AND TTYH2 AND TPBG | 1 | 1 | 1 |
| NTM AND NOT-RTN3 AND TMEM30B | 0.842105 | 1 | 0.727273 | NOT-CHRNA2 AND VCAM1 AND NOT-ATP13A5 | 1 | 1 | 1 |
| SYT13 AND IGSF6 AND PCDHB16 | 1 | 1 | 1 | NOT-CHRNA2 AND TTYH2 AND CLDN1 | 0.956522 | 0.916667 | 1 |
| NOX4 AND NOT-SLC47A1 AND SLC5A4 | 0.857143 | 0.9 | 0.818182 | NOT-CHRNA2 AND TTYH2 AND ROR1 | 0.956522 | 0.916667 | 1 |
| MUC1 AND NOT-RTN3 AND IFNAR2 | 0.952381 | 1 | 0.909091 | NOT-CHRNA2 AND TTYH2 AND ERBB2 | 0.956522 | 0.916667 | 1 |
| GRM8 AND ITGAM AND MUC1 | 0.842105 | 1 | 0.727273 | GPR137B AND NOT-ATP13A5 AND SDC1 | 0.956522 | 0.916667 | 1 |
| OR5I1 AND GPC3 AND IFNAR2 | 0.857143 | 0.9 | 0.818182 | NOT-CLDN19 AND TTYH2 AND TPBG | 0.952381 | 1 | 0.909091 |
| OTOF AND MUC1 AND CLEC2B | 0.833333 | 0.769231 | 0.909091 | NOT-CHRNA2 AND TTYH2 AND FAP | 0.952381 | 1 | 0.909091 |
| THY1 AND IFNAR2 AND OTOF | 0.9 | 1 | 0.818182 | NOT-CHRNA2 AND TTYH2 AND TNC | 0.952381 | 1 | 0.909091 |
| FAP AND OTOF AND IFNAR2 | 0.842105 | 1 | 0.727273 | NOT-CHRNA2 AND TTYH2 AND ERBB3 | 0.952381 | 1 | 0.909091 |

FIG. 15 (cont.)

| Antigen Pair Logic | F1 | Precision | Recall | Antigen Pair Logic | F1 | Precision | Recall |
|---|---|---|---|---|---|---|---|
| FAP AND CDH18 AND IFNAR2 | 0.842105 | 1 | 0.727273 | GPR137B AND NOT-ATP13A5 AND ERBB2 | 0.952381 | 1 | 0.909091 |
| THY1 AND USH2A AND IFNAR2 | 0.9 | 1 | 0.818182 | NOT-CHRNA2 AND TTYH2 AND CD276 | 0.952381 | 1 | 0.909091 |
| FAP AND CRB1 AND IFNAR2 | 0.842105 | 1 | 0.727273 | NOT-CACNG6 AND TTYH2 AND GPNMB | 0.952381 | 1 | 0.909091 |
| TNFRSF12A AND IFNAR2 AND ABCB5 | 0.9 | 1 | 0.818182 | NOT-CHRNA2 AND TTYH2 AND IL13RA2 | 0.952381 | 1 | 0.909091 |
| CRB1 AND NOT-RAET1E AND LRIG3 | 0.842105 | 1 | 0.727273 | NOT-CHRNA2 AND TTYH2 AND CD34 | 0.952381 | 1 | 0.909091 |
| THY1 AND IFNAR2 AND CNTNAP4 | 0.9 | 1 | 0.818182 | NOT-CHRNA2 AND TTYH2 AND AXL | 0.952381 | 1 | 0.909091 |
| THY1 AND IFNAR2 AND GRM8 | 0.9 | 1 | 0.818182 | NOT-CHRNA2 AND TTYH2 AND L1CAM | 0.952381 | 1 | 0.909091 |
| THY1 AND IFNAR2 AND GRIN2B | 0.9 | 1 | 0.818182 | NOT-CHRNA2 AND TTYH2 AND STEAP1 | 0.952381 | 1 | 0.909091 |
| THY1 AND IFNAR2 AND DCC | 0.9 | 1 | 0.818182 | GPR137B AND NOT-CLDN8 AND FAT1 | 1 | 1 | 1 |
| GRM8 AND NOT-RAET1E AND LRIG3 | 0.842105 | 1 | 0.727273 | NOT-CHRNA2 AND NOT-CLDN10 AND SDC1 | 1 | 1 | 1 |
| GJB4 AND NOT-RAET1E AND CLDN1 | 0.842105 | 1 | 0.727273 | GPR137B AND NOT-CLDN10 AND ERBB3 | 1 | 1 | 1 |
| SST AND IFNAR2 AND NOT-EPHB2 | 0.842105 | 1 | 0.727273 | NOT-CLDN19 AND GPNMB AND NOT-CLDN10 | 1 | 1 | 1 |
| SST AND CLDN1 AND IFNAR2 | 0.842105 | 1 | 0.727273 | NOT-SLC10A2 AND TTYH2 AND GPNMB | 0.952381 | 1 | 0.909091 |
| FAP AND ERBB3 AND NOT-OTOF | 0.842105 | 1 | 0.727273 | NOT-CHRNA2 AND FAT1 AND NOT-VTCN1 | 0.952381 | 1 | 0.909091 |
| SST AND CLDN1 AND NOT-LCT | 0.842105 | 1 | 0.727273 | NOT-CHRNA2 AND LRIG3 AND NOT-EPCAM | 0.952381 | 1 | 0.909091 |
| FAP AND ERBB3 AND NOT-IFNAR2 | 0.842105 | 1 | 0.727273 | GPR137B AND NOT-CLDN10 AND ERBB2 | 0.952381 | 1 | 0.909091 |
| FAP AND ERBB3 AND NOT-LCT | 0.842105 | 1 | 0.727273 | NOT-CHRNA2 AND NOT-CLDN10 AND ERBB2 | 0.952381 | 1 | 0.909091 |
| SST AND CLDN1 AND GRIN2B | 0.842105 | 1 | 0.727273 | NOT-CLDN19 AND LRIG3 AND NOT-EPCAM | 0.952381 | 1 | 0.909091 |
| SST AND CLDN1 AND NOT-GPR158 | 0.842105 | 1 | 0.727273 | NOT-CLDN19 AND TTYH2 AND VCAM1 | 0.952381 | 1 | 0.909091 |
| SST AND CLDN1 AND KCNA1 | 0.842105 | 1 | 0.727273 | NOT-CHRNA2 AND FAT1 AND NOT-ERBB2 | 1 | 1 | 1 |
| SST AND CLDN1 AND ABCG5 | 0.842105 | 1 | 0.727273 | NOT-CHRNA2 AND FAT1 AND NOT-ERBB2 | 1 | 1 | 1 |
| SST AND CLDN1 AND CRB1 | 0.842105 | 1 | 0.727273 | GPR137B AND NOT-CLDN8 AND LRIG3 | 1 | 1 | 1 |
| SST AND CLDN1 AND NOT-GABRB2 | 0.842105 | 1 | 0.727273 | GPR137B AND NOT-AOC3 AND ERBB3 | 0.952381 | 1 | 0.909091 |
| SST AND CLDN1 AND NOT-USH2A | 0.842105 | 1 | 0.727273 | NOT-CLDN19 AND GPNMB AND NOT-SLC30A10 | 0.952381 | 1 | 0.909091 |
| SST AND CLDN1 AND GRM8 | 0.842105 | 1 | 0.727273 | NOT-CLDN19 AND GPNMB AND NOT-PCDH8 | 1 | 1 | 1 |
| SST AND CLDN1 AND CD207 | 0.842105 | 1 | 0.727273 | NOT-CHRNA2 AND FAT1 AND NOT-IL20RA | 0.952381 | 1 | 0.909091 |
| CRB1 AND NOT-RAET1E AND ROR1 | 0.842105 | 1 | 0.727273 | NOT-CLDN19 AND GPNMB AND NOT-ATP8B1 | 1 | 1 | 1 |
| FAP AND EPHB2 AND NOT-THBD | 0.842105 | 1 | 0.727273 | NOT-CHRNA2 AND SDC1 AND NOT-PCDH8 | 1 | 1 | 1 |
| SST AND CLDN1 AND NOT-SCN2A | 0.842105 | 1 | 0.727273 | NOT-CHRNA2 AND ENG AND NOT-GHR | 1 | 1 | 1 |
| SST AND CLDN1 AND NOT-MMP24 | 0.842105 | 1 | 0.727273 | GPR137B AND NOT-IL20RA AND FAT1 | 0.952381 | 1 | 0.909091 |
| SST AND CLDN1 AND NOT-GJB4 | 0.842105 | 1 | 0.727273 | NOT-CLDN19 AND GPNMB AND GPR19 | 1 | 1 | 1 |
| SST AND CLDN1 AND CSMD2 | 0.842105 | 1 | 0.727273 | GPR137B AND NOT-P2RY4 AND ERBB3 | 0.952381 | 1 | 0.909091 |
| GJB4 AND NOT-RAET1E AND SDC1 | 0.842105 | 1 | 0.727273 | NOT-CHRNA2 AND NOT-CLDN10 AND GPNMB | 1 | 1 | 1 |
| THY1 AND IFNAR2 AND NOT-SDC1 | 0.9 | 1 | 0.818182 | NOT-CLDN19 AND ENG AND NOT-GHR | 0.952381 | 1 | 0.909091 |
| THY1 AND IFNAR2 AND ABCB5 | 0.9 | 1 | 0.818182 | NOT-CLDN19 AND GPNMB AND NOT-SLC1A6 | 1 | 1 | 1 |
| FAP AND GPR158 AND NOT-CLDN1 | 0.842105 | 1 | 0.727273 | GPR137B AND NOT-ATP8B1 AND ERBB2 | 0.952381 | 1 | 0.909091 |
| THY1 AND IFNAR2 AND NOT-L1CAM | 0.9 | 1 | 0.818182 | NOT-NOX1 AND GPNMB AND GPR19 | 1 | 1 | 1 |
| MUC1 AND NOT-RTN3 AND CLEC2B | 0.833333 | 0.769231 | 0.909091 | NOT-CHRNA2 AND ENG AND NOT-SLC13A2 | 0.952381 | 1 | 0.909091 |
| MUC1 AND ABCB5 AND IFNAR2 | 0.842105 | 1 | 0.727273 | NOT-CHRNA2 AND NOT-CLDN10 AND VCAM1 | 1 | 1 | 1 |
| EPHB2 AND IFNAR2 AND GPC3 | 0.857143 | 0.9 | 0.818182 | NOT-CLDN19 AND STEAP1 AND NOT-ATP8B1 | 0.952381 | 1 | 0.909091 |
| MUC1 AND CSMD2 AND CLDN1 | 0.833333 | 0.769231 | 0.909091 | NOT-CLDN19 AND ENG AND NOT-ATP8B1 | 1 | 1 | 1 |
| TNFRSF12A AND GJB4 AND IFNAR2 | 0.9 | 1 | 0.818182 | NOT-CHRNA2 AND FAT1 AND NOT-EPCAM | 0.952381 | 1 | 0.909091 |
| TNFRSF12A AND LCT AND IFNAR2 | 0.9 | 1 | 0.818182 | GPR137B AND NOT-LCT AND ERBB3 | 0.952381 | 1 | 0.909091 |
| TNFRSF12A AND OTOF AND IFNAR2 | 0.9 | 1 | 0.818182 | NOT-CLDN19 AND GPNMB AND NOT-TMPRSS11E | 1 | 1 | 1 |
| TNFRSF12A AND GRIN2B AND IFNAR2 | 0.9 | 1 | 0.818182 | GPR137B AND NOT-GHR AND ERBB3 | 0.952381 | 1 | 0.909091 |
| TNFRSF12A AND SLC6A15 AND IFNAR2 | 0.842105 | 1 | 0.727273 | NOT-CHRNA2 AND GPNMB AND NOT-CD207 | 0.952381 | 1 | 0.909091 |
| TNFRSF12A AND FCAMR AND IFNAR2 | 0.9 | 1 | 0.818182 | NOT-CHRNA2 AND SDC1 AND NOT-CD207 | 0.952381 | 1 | 0.909091 |
| TNFRSF12A AND OR7C1 AND IFNAR2 | 0.9 | 1 | 0.818182 | GPR137B AND NOT-CLDN19 AND L1CAM | 0.952381 | 1 | 0.909091 |
| TNFRSF12A AND IFNAR2 AND SLC28A1 | 0.9 | 1 | 0.818182 | NOT-CHRNA2 AND GPNMB AND NOT-PCDH8 | 1 | 1 | 1 |
| TNFRSF12A AND SLC22A6 AND IFNAR2 | 0.9 | 1 | 0.818182 | NOT-CHRNA2 AND PLVAP AND NOT-CLDN8 | 1 | 1 | 1 |
| TNFRSF12A AND SHISA9 AND IFNAR2 | 0.9 | 1 | 0.818182 | NOT-CLDN19 AND ENG AND NOT-NOX1 | 1 | 1 | 1 |
| TNFRSF12A AND CDH18 AND IFNAR2 | 0.842105 | 1 | 0.727273 | NOT-CLDN19 AND GPNMB AND NOT-CD207 | 0.952381 | 1 | 0.909091 |
| TNFRSF12A AND CRB1 AND IFNAR2 | 0.9 | 1 | 0.818182 | GPR137B AND NOT-NOX1 AND L1CAM | 0.952381 | 1 | 0.909091 |
| TNFRSF12A AND IFNAR2 AND CACNA1S | 0.842105 | 1 | 0.727273 | NOT-CHRNA2 AND VCAM1 AND NOT-PCDH8 | 1 | 1 | 1 |
| TNFRSF12A AND CNTNAP4 AND IFNAR2 | 0.9 | 1 | 0.818182 | NOT-CACNG6 AND SDC1 AND NOT-PCDH8 | 1 | 1 | 1 |
| TNFRSF12A AND CHRND AND IFNAR2 | 0.9 | 1 | 0.818182 | GPR137B AND NOT-ATP8B1 AND ERBB3 | 1 | 1 | 1 |
| TNFRSF12A AND GRM8 AND IFNAR2 | 0.9 | 1 | 0.818182 | GPR137B AND NOT-CLDN19 AND CSPG4 | 0.952381 | 1 | 0.909091 |
| TNFRSF12A AND CSMD2 AND IFNAR2 | 0.842105 | 1 | 0.727273 | NOT-CHRNA2 AND ITGAV AND NOT-PCDH8 | 0.916667 | 0.846154 | 1 |
| TNFRSF12A AND IFNAR2 AND SLC30A10 | 0.9 | 1 | 0.818182 | NOT-CHRNA2 AND ERBB2 AND NOT-ATP13A5 | 0.916667 | 0.846154 | 1 |
| TNFRSF12A AND GRM8 AND LRIG3 | 0.818182 | 0.818182 | 0.818182 | NOT-CHRNA2 AND NOT-CLDN10 AND ITGAV | 0.916667 | 0.846154 | 1 |
| TNFRSF12A AND IFNAR2 AND LRIG3 | 0.9 | 1 | 0.818182 | GPR137B AND NOT-SLC1A6 AND ERBB3 | 1 | 1 | 1 |
| TNFRSF12A AND GPR6 AND IFNAR2 | 0.842105 | 1 | 0.727273 | NOT-CLDN19 AND VCAM1 AND NOT-PCDH8 | 1 | 1 | 1 |
| TNFRSF12A AND IFNAR2 AND NOT-LRRN4 | 0.842105 | 1 | 0.727273 | NOT-CHRNA2 AND NOT-CLDN10 AND TPBG | 0.956522 | 0.916667 | 1 |
| TNFRSF12A AND GPR158 AND IFNAR2 | 0.9 | 1 | 0.818182 | GPR137B AND NOT-EPCAM AND FAT1 | 0.952381 | 1 | 0.909091 |
| TNFRSF12A AND IFNAR2 AND SLC39A2 | 0.9 | 1 | 0.818182 | NOT-CACNG6 AND GPNMB AND NOT-CLDN10 | 1 | 1 | 1 |
| TNFRSF12A AND USH2A AND IFNAR2 | 0.9 | 1 | 0.818182 | NOT-CHRNA2 AND LRIG3 AND NOT-VTCN1 | 0.952381 | 1 | 0.909091 |
| TNFRSF12A AND IFNAR2 AND CLDN19 | 0.9 | 1 | 0.818182 | NOT-CLDN19 AND ERBB2 AND NOT-ATP8B1 | 0.952381 | 1 | 0.909091 |
| TNFRSF12A AND IFNAR2 AND CDH8 | 0.9 | 1 | 0.818182 | NOT-CHRNA2 AND SDC1 AND NOT-SLC1A6 | 1 | 1 | 1 |
| TNFRSF12A AND IFNAR2 AND GPRC6A | 0.9 | 1 | 0.818182 | NOT-CHRNA2 AND FAT1 AND NOT-EGFR | 0.952381 | 1 | 0.909091 |
| TNFRSF12A AND IFNAR2 AND GABRG2 | 0.9 | 1 | 0.818182 | NOT-CHRNA2 AND NOT-CLDN10 AND SDC1 | 0.956522 | 0.916667 | 1 |
| TNFRSF12A AND CHRNA1 AND IFNAR2 | 0.842105 | 1 | 0.727273 | NOT-CHRNA2 AND GPNMB AND NOT-SLC1A6 | 1 | 1 | 1 |
| TNFRSF12A AND IFNAR2 AND CD1B | 0.9 | 1 | 0.818182 | NOT-CLDN19 AND GPNMB AND NOT-ATP6V0A4 | 1 | 1 | 1 |
| TNFRSF12A AND CSMD2 AND LRIG3 | 0.857143 | 0.9 | 0.818182 | NOT-CLDN19 AND GPNMB AND NOT-LCT | 0.952381 | 1 | 0.909091 |
| ABCB5 AND NOT-RAET1E AND CLDN1 | 0.842105 | 1 | 0.727273 | NOT-CLDN19 AND GPNMB AND NOT-GRM6 | 1 | 1 | 1 |
| STEAP1 AND ABCB5 AND CLDN1 | 0.833333 | 0.769231 | 0.909091 | NOT-CHRNA2 AND EMP3 AND SDC1 | 0.909091 | 0.909091 | 0.909091 |
| STEAP2 AND ABCB5 AND CLDN1 | 0.869565 | 0.833333 | 0.909091 | NOT-SLC5A5 AND ZNRF3 AND NOT-CADM2 | 1 | 1 | 1 |
| STEAP2 AND CLDN1 AND NOT-SDC1 | 0.869565 | 0.833333 | 0.909091 | NOT-SLC5A5 AND TYRO3 AND NOT-CADM2 | 1 | 1 | 1 |

FIG. 15 (cont.)

| Antigen Pair Logic | F1 | Precision | Recall |
|---|---|---|---|
| EPHB2 AND CLDN1 AND NOT-ABCB5 | 0.818182 | 0.818182 | 0.818182 |
| OTOF AND IFNAR2 AND GPC3 | 0.818182 | 0.818182 | 0.818182 |
| GRIN2B AND GPC3 AND IFNAR2 | 0.9 | 1 | 0.818182 |
| USH2A AND GPC3 AND IFNAR2 | 0.857143 | 0.9 | 0.818182 |
| FCAMR AND GPC3 AND IFNAR2 | 0.818182 | 0.818182 | 0.818182 |
| GRM8 AND GPC3 AND IFNAR2 | 0.818182 | 0.818182 | 0.818182 |
| LCT AND IFNAR2 AND GPC3 | 0.818182 | 0.818182 | 0.818182 |
| CSMD2 AND IFNAR2 AND GPC3 | 0.818182 | 0.818182 | 0.818182 |
| MUC1 AND CNTNAP4 AND IFNAR2 | 0.842105 | 1 | 0.727273 |
| LCT AND MUC1 AND IFNAR2 | 0.869565 | 0.833333 | 0.909091 |
| MUC1 AND GRIN2B AND IFNAR2 | 0.909091 | 0.909091 | 0.909091 |
| MUC1 AND CSMD2 AND IFNAR2 | 0.909091 | 0.909091 | 0.909091 |
| Renal Cancer | | | |
| CDH6 AND NOT-HAS1 AND TYROBP | 0.857143 | 1 | 0.75 |
| CDH6 AND NOT-ACPP AND LITAF | 0.857143 | 1 | 0.75 |
| CDH6 AND NOT-CORIN AND ITGAM | 0.857143 | 1 | 0.75 |
| CDH6 AND CD63 AND GJB6 | 0.857143 | 1 | 0.75 |
| CDH6 AND NOT-SLC24A4 AND OR51M1 | 0.857143 | 1 | 0.75 |
| CDH6 AND NOT-SLC24A4 AND NTRK1 | 0.857143 | 1 | 0.75 |
| CDH6 AND NOT-COLQ AND KCNS1 | 0.857143 | 1 | 0.75 |
| CDH6 AND JTB AND TRAT1 | 0.857143 | 1 | 0.75 |
| CDH6 AND KCNS1 AND NOT-VIPR1 | 0.857143 | 1 | 0.75 |
| CDH6 AND NOT-DPP6 AND DSC2 | 0.857143 | 1 | 0.75 |
| CDH6 AND NOT-HAS1 AND C5AR1 | 0.857143 | 1 | 0.75 |
| CDH6 AND NOT-KCNK2 AND ZDHHC5 | 0.857143 | 1 | 0.75 |
| CDH6 AND ATP1B1 AND CLPTM1 | 0.857143 | 1 | 0.75 |
| CDH6 AND NOT-CORIN AND NTRK1 | 0.857143 | 1 | 0.75 |
| CDH6 AND NOT-NRG4 AND TAAR8 | 0.857143 | 1 | 0.75 |
| COMPLEX-CDH6/ATRAID/TPM1 | 0.857143 | 1 | 0.75 |
| CDH6 AND NOT-NRG4 AND LRRC32 | 0.857143 | 1 | 0.75 |
| CDH6 AND SLC25A5 AND CAV3 | 0.857143 | 1 | 0.75 |
| CDH6 AND NOT-FGFR3 AND NOT-FZD6 | 0.857143 | 1 | 0.75 |
| CDH6 AND NOT-SCNN1B AND GPR82 | 0.857143 | 1 | 0.75 |
| COMPLEX-CDH6/CLCN3/ATRAID | 0.857143 | 1 | 0.75 |
| CDH6 AND NOT-NRG4 AND KCNS1 | 0.857143 | 1 | 0.75 |
| CDH6 AND CD53 AND NOT-KRT5 | 0.857143 | 1 | 0.75 |
| COMPLEX-CDH6/ATRAID/PTPRJ | 0.857143 | 1 | 0.75 |
| COMPLEX-CDH6/ATRAID/DST | 0.857143 | 1 | 0.75 |
| CDH6 AND NOT-PTPRZ1 AND NOT-MARVELD2 | 0.857143 | 1 | 0.75 |
| CDH6 AND NOT-NRG4 AND C5AR1 | 0.857143 | 1 | 0.75 |
| CDH6 AND JTB AND CD3D | 0.857143 | 1 | 0.75 |
| CDH6 AND NOT-AKAP6 AND VIPR1 | 0.857143 | 1 | 0.75 |
| CDH6 AND NOT-TPM1 AND NOT-WNT4 | 0.857143 | 1 | 0.75 |
| CDH6 AND NOT-TM9SF2 AND CD63 | 0.857143 | 1 | 0.75 |
| COMPLEX-CDH6/IL6ST/ATRAID | 0.857143 | 1 | 0.75 |
| CDH6 AND NOT-STX2 AND NOT-PTPRZ1 | 0.857143 | 1 | 0.75 |
| CDH6 AND CD63 AND ZDHHC5 | 0.857143 | 1 | 0.75 |
| CDH6 AND OR51M1 AND NOT-OR2B2 | 0.857143 | 1 | 0.75 |
| CDH6 AND TYROBP AND NOT-WNT4 | 0.857143 | 1 | 0.75 |
| CDH6 AND NOT-NRG4 AND ITGA2 | 0.857143 | 1 | 0.75 |
| CDH6 AND NOT-NRG4 AND DCHS2 | 0.857143 | 1 | 0.75 |
| CDH6 AND NOT-SCNN1B AND GRM2 | 0.857143 | 1 | 0.75 |
| CDH6 AND OR51M1 AND NOT-OR51B4 | 0.857143 | 1 | 0.75 |
| CDH6 AND NOT-RHBDL2 AND LITAF | 0.857143 | 1 | 0.75 |
| CDH6 AND NOT-RHBDL2 AND KCNS1 | 0.857143 | 1 | 0.75 |
| CDH6 AND NOT-SGCG AND PTPRU | 0.857143 | 1 | 0.75 |
| CDH6 AND NOT-ESYT3 AND DCHS2 | 0.857143 | 1 | 0.75 |
| COMPLEX-CDH6/ATRAID/PTPRG | 0.857143 | 1 | 0.75 |
| CDH6 AND NOT-RET AND NOT-SCNN1B | 0.857143 | 1 | 0.75 |
| CDH6 AND NOT-PRRT2 AND CLPTM1 | 0.857143 | 1 | 0.75 |
| COMPLEX-CDH6/LRRC8B/RET | 0.857143 | 1 | 0.75 |
| CDH16 AND NOT-SCNN1B AND OR51M1 | 0.857143 | 1 | 0.75 |
| COMPLEX-CDH6/ATRAID/ETNK1 | 0.857143 | 1 | 0.75 |
| COMPLEX-CDH6/ATRAID/GPRC5A | 0.857143 | 1 | 0.75 |
| CDH6 AND NOT-COLQ AND CLPTM1 | 0.857143 | 1 | 0.75 |
| COMPLEX-CDH6/ATP1B3/ATRAID | 0.857143 | 1 | 0.75 |
| CDH16 AND NOT-SCNN1B AND SLC5A5 | 0.857143 | 1 | 0.75 |
| CDH6 AND SLC25A5 AND OPN5 | 0.857143 | 1 | 0.75 |
| COMPLEX-CDH6/CADM1/ATRAID | 0.857143 | 1 | 0.75 |
| CDH16 AND NOT-RET AND NOT-SCNN1B | 0.857143 | 1 | 0.75 |
| CDH6 AND NOT-DPP6 AND CLPTM1 | 0.857143 | 1 | 0.75 |
| CDH6 AND ATP1B1 AND ADAM15 | 0.857143 | 1 | 0.75 |
| CDH6 AND ATP1B1 AND KLRB1 | 0.857143 | 1 | 0.75 |
| CDH6 AND NOT-TPM1 AND NOT-KCNK2 | 0.857143 | 1 | 0.75 |
| CDH6 AND CD63 AND ADAM15 | 0.857143 | 1 | 0.75 |
| CDH6 AND ATP1B1 AND MEP1A | 0.857143 | 1 | 0.75 |
| CDH6 AND NOT-KCNJ12 AND TYROBP | 0.857143 | 1 | 0.75 |

| Antigen Pair Logic | F1 | Precision | Recall |
|---|---|---|---|
| NOT-SLC5A5 AND LGR4 AND NOT-CADM2 | 1 | 1 | 1 |
| NOT-SLC5A5 AND IGDCC4 AND NOT-CADM2 | 1 | 1 | 1 |
| NOT-SLC5A5 AND PCDHB14 AND NOT-CADM2 | 1 | 1 | 1 |
| NOT-SLC5A5 AND SORT1 AND NOT-CADM2 | 1 | 1 | 1 |
| NOT-GIPR AND SORT1 AND NOT-ATP1A2 | 1 | 1 | 1 |
| NOT-TM4SF5 AND NOT-CADM2 AND TYRO3 | 1 | 1 | 1 |
| NOT-OR2S2 AND NOT-ATP1A2 AND PCDHB14 | 1 | 1 | 1 |
| NOT-SLC5A5 AND FZD7 AND NOT-CADM2 | 1 | 1 | 1 |
| NOT-OR2S2 AND NOT-ATP1A2 AND GPM6B | 1 | 1 | 1 |
| NOT-OR2S2 AND NOT-ATP1A2 AND NLGN1 | 1 | 1 | 1 |
| NOT-SLC5A5 AND TSPAN11 AND NOT-CADM2 | 1 | 1 | 1 |
| NOT-GIPR AND GPR161 AND NOT-ATP1A2 | 1 | 1 | 1 |
| NOT-CD300LB AND PAQR6 AND NOT-CADM2 | 0.956522 | 0.916667 | 1 |
| NOT-SLC34A3 AND PCDHB14 AND NOT-CADM2 | 1 | 1 | 1 |
| NOT-TM4SF5 AND NOT-CADM2 AND ZNRF3 | 1 | 1 | 1 |
| NOT-SLC34A3 AND LGR4 AND NOT-CADM2 | 1 | 1 | 1 |
| NOT-TM4SF5 AND NOT-CADM2 AND APLNR | 1 | 1 | 1 |
| NOT-SLC34A3 AND IGDCC4 AND NOT-CADM2 | 0.956522 | 0.916667 | 1 |
| NOT-CD300LB AND PAQR6 AND NOT-CADM2 | 0.956522 | 0.916667 | 1 |
| NOT-TM4SF5 AND NOT-CADM2 AND TIE1 | 0.956522 | 0.916667 | 1 |
| NOT-TM4SF5 AND NOT-ATP1A2 AND TYRO3 | 1 | 1 | 1 |
| NOT-TM4SF5 AND NOT-CADM2 AND PCDHB14 | 1 | 1 | 1 |
| NOT-TM4SF5 AND NOT-CADM2 AND LGR4 | 1 | 1 | 1 |
| CLCN5 AND NOT-CD300LB AND NOT-CADM2 | 1 | 1 | 1 |
| NOT-SLC5A5 AND FZD7 AND NOT-TSPAN8 | 0.952381 | 1 | 0.909091 |
| NOT-GIPR AND BEST1 AND LGR4 | 0.952381 | 1 | 0.909091 |
| NOT-SLC5A5 AND BEST1 AND LGR4 | 0.952381 | 1 | 0.909091 |
| NOT-SLC5A5 AND ZNRF3 AND NOT-ATP1A2 | 0.952381 | 1 | 0.909091 |
| NOT-TM4SF5 AND NOT-TSPAN8 AND PCDHB14 | 0.952381 | 1 | 0.909091 |
| NOT-TAAR8 AND LGR4 AND NOT-TSPAN8 | 0.952381 | 1 | 0.909091 |
| NOT-SLC5A5 AND LGR4 AND NOT-TSPAN8 | 0.952381 | 1 | 0.909091 |
| NOT-TAAR8 AND SORT1 AND NOT-TSPAN8 | 0.952381 | 1 | 0.909091 |
| NOT-SLC5A5 AND LGR4 AND NOT-ATP1A2 | 0.952381 | 1 | 0.909091 |
| NOT-SLC5A5 AND SORT1 AND NOT-TSPAN8 | 0.952381 | 1 | 0.909091 |
| NOT-SLC5A5 AND TSPAN11 AND NOT-TSPAN8 | 0.952381 | 1 | 0.909091 |
| COMPLEX-ITPR3/GPR143/OR2S2 | 0.952381 | 1 | 0.909091 |
| NOT-OR2S2 AND NOT-ATP1A2 AND PRRG1 | 0.952381 | 1 | 0.909091 |
| NOT-SLC5A5 AND TYRO3 AND NOT-NTRK3 | 0.952381 | 1 | 0.909091 |
| NOT-SLC5A5 AND TYRO3 AND NOT-ATP1A2 | 0.952381 | 1 | 0.909091 |
| NOT-OR2S2 AND NOT-NTRK3 AND TYRO3 | 0.952381 | 1 | 0.909091 |
| NOT-OR2S2 AND NOT-ATP1A2 AND KCNN2 | 0.952381 | 1 | 0.909091 |
| NOT-OR2S2 AND NOT-ATP1A2 AND SLC25A4 | 0.952381 | 1 | 0.909091 |
| NOT-OR2S2 AND NOT-ATP1A2 AND PLP1 | 0.952381 | 1 | 0.909091 |
| NOT-CD300LB AND TGFB3 AND NOT-CADM2 | 0.952381 | 1 | 0.909091 |
| NOT-OR2S2 AND NOT-ATP1A2 AND APOLD1 | 0.952381 | 1 | 0.909091 |
| TRPV1 AND NOT-CADM2 AND NOT-CD300LB | 0.952381 | 1 | 0.909091 |
| NOT-CD300LB AND TSPAN11 AND NOT-TSPAN8 | 0.952381 | 1 | 0.909091 |
| NOT-GIPR AND GPR161 AND NOT-TSPAN8 | 0.952381 | 1 | 0.909091 |
| NOT-SLC5A5 AND TIE1 AND NOT-ATP1A2 | 0.952381 | 1 | 0.909091 |
| NOT-OR51I2 AND TSPAN11 AND NOT-TSPAN8 | 0.952381 | 1 | 0.909091 |
| NOT-SLC34A3 AND PCDHB14 AND NOT-TSPAN8 | 0.952381 | 1 | 0.909091 |
| NOT-SLC5A5 AND PCDHB14 AND NOT-ATP1A2 | 0.952381 | 1 | 0.909091 |
| NOT-CD300LB AND LGR4 AND NOT-CADM2 | 0.952381 | 1 | 0.909091 |
| NOT-TM4SF5 AND NOT-TSPAN8 AND LGR4 | 0.952381 | 1 | 0.909091 |
| NOT-SLC5A5 AND SORT1 AND NOT-ATP1A2 | 0.952381 | 1 | 0.909091 |
| NOT-TAAR8 AND PCDHB14 AND NOT-TSPAN8 | 0.952381 | 1 | 0.909091 |
| NOT-GIPR AND LGR4 AND NOT-TSPAN8 | 0.952381 | 1 | 0.909091 |
| NOT-SLC5A5 AND PCDHB14 AND NOT-TSPAN8 | 0.952381 | 1 | 0.909091 |
| NOT-CD300LB AND ATP9B AND NOT-CADM2 | 0.952381 | 1 | 0.909091 |
| PTPRS AND NOT-CADM2 AND NOT-CD300LB | 0.952381 | 1 | 0.909091 |
| NOT-CD300LB AND TGFBR1 AND NOT-CADM2 | 0.952381 | 1 | 0.909091 |
| NOT-SLC34A3 AND LGR4 AND NOT-TSPAN8 | 0.952381 | 1 | 0.909091 |
| NOT-SLC5A5 AND NOT-ATP1A2 AND NTN4 | 0.956522 | 0.916667 | 1 |
| NOT-SLC5A5 AND APCDD1 AND NOT-ATP1A2 | 0.956522 | 0.916667 | 1 |
| NOT-OR2S2 AND TSPAN11 AND NOT-TSPAN8 | 0.952381 | 1 | 0.909091 |
| NOT-OR2S2 AND NOT-ATP1A2 AND VANGL2 | 1 | 1 | 1 |
| NOT-SLC5A5 AND FZD4 AND NOT-ATP1A2 | 1 | 1 | 1 |
| NOT-SLC5A5 AND ZNRF3 AND NOT-TSPAN8 | 0.952381 | 1 | 0.909091 |
| NOT-SLC5A5 AND PDGFRA AND NOT-ATP1A2 | 1 | 1 | 1 |
| NOT-SLC5A5 AND TIE1 AND NOT-TSPAN8 | 0.952381 | 1 | 0.909091 |
| NOT-TAAR8 AND TSPAN11 AND NOT-FNDC5 | 1 | 1 | 1 |
| NOT-SLC5A5 AND PERP AND NOT-ATP1A2 | 1 | 1 | 1 |
| NOT-SLC5A5 AND WNT5A AND NOT-TSPAN8 | 0.952381 | 1 | 0.909091 |
| NOT-CD300LB AND FAM57A AND NOT-CADM2 | 0.952381 | 1 | 0.909091 |
| NOT-OR2S2 AND NOT-CADM2 AND PCDHB14 | 1 | 1 | 1 |
| NOT-SLC5A5 AND OSMR AND NOT-CADM2 | 1 | 1 | 1 |
| NOT-CD300LB AND PTGDR2 AND NOT-TSPAN8 | 0.952381 | 1 | 0.909091 |

FIG. 15 (cont.)

| Antigen Pair Logic | F1 | Precision | Recall |
|---|---|---|---|
| CDH6 AND OR51M1 AND NOT-SLC6A14 | 0.857143 | 1 | 0.75 |
| CDH6 AND CD63 AND PRLHR | 0.857143 | 1 | 0.75 |
| CDH6 AND NOT-AKAP6 AND NOT-ATP1B3 | 0.857143 | 1 | 0.75 |
| COMPLEX-CDH6/LRRC8B/ATRAID | 0.857143 | 1 | 0.75 |
| COMPLEX-CDH6/HAS1/PTPRJ | 0.857143 | 1 | 0.75 |
| CDH6 AND CCR5 AND NOT-SLC6A14 | 0.857143 | 1 | 0.75 |
| CDH6 AND NOT-KCNK2 AND ITGAM | 0.857143 | 1 | 0.75 |
| CDH6 AND NOT-COLQ AND NOT-FZD6 | 0.857143 | 1 | 0.75 |
| CDH6 AND CD63 AND SLC27A1 | 0.857143 | 1 | 0.75 |
| CDH6 AND NOT-NPY2R AND CLPTM1 | 0.857143 | 1 | 0.75 |
| CDH6 AND C5AR1 AND ATP1B1 | 0.857143 | 1 | 0.75 |
| CDH6 AND NOT-PTPRZ1 AND NOT-PSEN1 | 0.857143 | 1 | 0.75 |
| CDH6 AND NOT-MEGF10 AND LRRC32 | 0.857143 | 1 | 0.75 |
| CDH6 AND NOT-AKAP6 AND CATSPER3 | 0.857143 | 1 | 0.75 |
| CDH6 AND SLC25A5 AND OR8D1 | 0.857143 | 1 | 0.75 |
| CDH6 AND NOT-HAS1 AND CHRNA2 | 0.857143 | 1 | 0.75 |
| CDH6 AND NOT-TAS2R14 AND CALHM3 | 0.857143 | 1 | 0.75 |
| KCNJ16 AND ATRAID AND NOT-CLDN16 | 0.857143 | 1 | 0.75 |
| CDH6 AND NOT-HTR5A AND KCNS1 | 0.857143 | 1 | 0.75 |
| CDH6 AND NOT-ESYT3 AND CATSPER3 | 0.857143 | 1 | 0.75 |
| CDH6 AND NOT-SLC4A8 AND CLPTM1 | 0.857143 | 1 | 0.75 |
| CDH6 AND NOT-ADCYAP1R1 AND CATSPER3 | 0.857143 | 1 | 0.75 |
| CDH6 AND NOT-MEGF10 AND TMEM8A | 0.857143 | 1 | 0.75 |
| CDH6 AND NOT-MEGF10 AND HRH1 | 0.857143 | 1 | 0.75 |
| CDH6 AND NOT-MEGF10 AND C5AR1 | 0.857143 | 1 | 0.75 |
| CDH6 AND ATP1B1 AND SLC12A9 | 0.857143 | 1 | 0.75 |
| CDH6 AND NOT-P2RX3 AND C5AR1 | 0.857143 | 1 | 0.75 |
| CDH6 AND NOT-PTPRZ1 AND HLA-DRB1 | 0.857143 | 1 | 0.75 |
| CDH6 AND NOT-KCNQ5 AND ABCA12 | 0.857143 | 1 | 0.75 |
| CDH6 AND NOT-FLVCR1 AND ATP1B1 | 0.857143 | 1 | 0.75 |
| COMPLEX-CDH6/GRIN2A/ATRAID | 0.857143 | 1 | 0.75 |
| CDH6 AND NOT-SHH AND ABCA12 | 0.857143 | 1 | 0.75 |
| CDH6 AND NOT-NRG4 AND ROS1 | 0.857143 | 1 | 0.75 |
| CDH6 AND NOT-SLCO1A2 AND NOT-ATP1B3 | 0.857143 | 1 | 0.75 |
| CDH6 AND NOT-SLC9B1 AND C5AR1 | 0.857143 | 1 | 0.75 |
| CDH6 AND NOT-XG AND CATSPER3 | 0.857143 | 1 | 0.75 |
| CDH6 AND CD63 AND CATSPER3 | 0.857143 | 1 | 0.75 |
| CDH6 AND OR51M1 AND NOT-DSC1 | 0.857143 | 1 | 0.75 |
| CDH6 AND NOT-CD207 AND DSC2 | 0.857143 | 1 | 0.75 |
| CDH6 AND NOT-MEGF10 AND NOT-MCOLN2 | 0.857143 | 1 | 0.75 |
| CDH6 AND NOT-HAS1 AND ABCA12 | 0.857143 | 1 | 0.75 |
| CDH6 AND NOT-HAS1 AND CALHM3 | 0.857143 | 1 | 0.75 |
| CDH6 AND NOT-SGCG AND CATSPER3 | 0.857143 | 1 | 0.75 |
| CDH6 AND ATP1B1 AND BEST3 | 0.857143 | 1 | 0.75 |
| CDH6 AND ABCA12 AND NOT-RHBDL2 | 0.857143 | 1 | 0.75 |
| CDH6 AND NOT-MEGF10 AND SLC5A5 | 0.857143 | 1 | 0.75 |
| CDH6 AND NOT-SHH AND CALHM3 | 0.857143 | 1 | 0.75 |
| CDH6 AND NOT-NRG4 AND C8B | 0.857143 | 1 | 0.75 |
| CDH6 AND NOT-OXTR AND NOT-COLQ | 0.857143 | 1 | 0.75 |
| CDH6 AND NOT-TAS2R14 AND NOX1 | 0.857143 | 1 | 0.75 |
| CDH6 AND ATP1B1 AND PCDHA6 | 0.857143 | 1 | 0.75 |
| CDH6 AND NOT-KIAA0319 AND VIPR1 | 0.857143 | 1 | 0.75 |
| CDH6 AND ATP1B1 AND SELP | 0.857143 | 1 | 0.75 |
| CDH6 AND NOT-CD207 AND TAAR8 | 0.857143 | 1 | 0.75 |
| CDH6 AND ABCA12 AND NOT-HRH4 | 0.857143 | 1 | 0.75 |
| CDH6 AND NOT-ADCYAP1R1 AND ABCA12 | 0.857143 | 1 | 0.75 |
| CDH6 AND NOT-DPP6 AND ABCA12 | 0.857143 | 1 | 0.75 |
| CDH6 AND NOT-COLQ AND CALHM3 | 0.857143 | 1 | 0.75 |
| CDH6 AND NOT-SLC4A8 AND C5AR1 | 0.857143 | 1 | 0.75 |
| CDH6 AND NOT-MEGF10 AND ZDHHC5 | 0.857143 | 1 | 0.75 |
| CDH6 AND NOT-COLQ AND ABCA12 | 0.857143 | 1 | 0.75 |
| COMPLEX-CDH6/NFASC/ATRAID | 0.857143 | 1 | 0.75 |
| CDH6 AND ATP1B1 AND CALHM1 | 0.857143 | 1 | 0.75 |
| CDH6 AND NOT-MEGF10 AND TMIGD2 | 0.857143 | 1 | 0.75 |
| CDH6 AND NOT-HTR5A AND OR51M1 | 0.857143 | 1 | 0.75 |
| CDH6 AND VIPR1 AND NOT-OR8D1 | 0.857143 | 1 | 0.75 |
| CDH6 AND NOT-CORIN AND SLC12A9 | 0.857143 | 1 | 0.75 |
| CDH6 AND NOX1 AND NOT-NPY2R | 0.857143 | 1 | 0.75 |
| CDH6 AND NOT-MLC1 AND VIPR1 | 0.857143 | 1 | 0.75 |
| CDH6 AND NOT-SLC20A2 AND ABCA12 | 0.857143 | 1 | 0.75 |
| CDH6 AND NOT-MEGF10 AND CLPTM1 | 0.857143 | 1 | 0.75 |
| CDH6 AND NOT-NRG4 AND ABCA12 | 0.857143 | 1 | 0.75 |
| CDH6 AND NOT-MEGF10 AND TYROBP | 0.857143 | 1 | 0.75 |
| CDH6 AND C8B AND CD63 | 0.857143 | 1 | 0.75 |
| CDH6 AND NOT-NRG4 AND CATSPER3 | 0.857143 | 1 | 0.75 |
| CDH6 AND NOT-CORIN AND HLA-DRB1 | 0.857143 | 1 | 0.75 |
| CDH6 AND NOT-SYT8 AND CATSPER3 | 0.857143 | 1 | 0.75 |

| Antigen Pair Logic | F1 | Precision | Recall |
|---|---|---|---|
| NOT-CD300LB AND B4GALT1 AND NOT-CADM2 | 0.952381 | 1 | 0.909091 |
| NOT-SLC5A5 AND NOT-CADM2 AND GJA1 | 1 | 1 | 1 |
| NOT-CD300LB AND CYP51A1 AND NOT-CADM2 | 0.952381 | 1 | 0.909091 |
| NOT-SLC5A5 AND NOT-ATP1A2 AND GJA1 | 0.956522 | 0.916667 | 1 |
| NOT-OR2S2 AND NOT-ATP1A2 AND SORT1 | 1 | 1 | 1 |
| NOT-SLC5A5 AND IGDCC4 AND NOT-ATP1A2 | 1 | 1 | 1 |
| NOT-CD300LB AND PTGDR2 AND NOT-CADM2 | 1 | 1 | 1 |
| NOT-SLC5A5 AND ANO1 AND NOT-TSPAN8 | 0.952381 | 1 | 0.909091 |
| NOT-OR2S2 AND TSPAN11 AND NOT-CADM2 | 1 | 1 | 1 |
| NOT-OR2S2 AND NOT-CADM2 AND IGDCC4 | 1 | 1 | 1 |
| NOT-SLC5A5 AND TIE1 AND NOT-CADM2 | 1 | 1 | 1 |
| NOT-CD300LB AND TGFBR1 AND NOT-ATP1A2 | 0.952381 | 1 | 0.909091 |
| NOT-CD300LB AND PTGDR2 AND NOT-CADM2 | 1 | 1 | 1 |
| NOT-SLC5A5 AND IGDCC4 AND NOT-TSPAN8 | 0.952381 | 1 | 0.909091 |
| NOT-TM4SF5 AND NOT-CADM2 AND ANO1 | 1 | 1 | 1 |
| NOT-TM4SF5 AND NOT-TSPAN8 AND ZNRF3 | 0.952381 | 1 | 0.909091 |
| NOT-GPR21 AND PCDHB14 AND NOT-TSPAN8 | 0.952381 | 1 | 0.909091 |
| NOT-TAAR8 AND TSPAN11 AND NOT-ATP1A2 | 1 | 1 | 1 |
| NOT-TM4SF5 AND NOT-TSPAN8 AND FZD7 | 0.952381 | 1 | 0.909091 |
| NOT-SLC34A3 AND TSPAN11 AND NOT-CADM2 | 0.952381 | 1 | 0.909091 |
| NOT-GPR21 AND TSPAN11 AND NOT-NTRK3 | 0.952381 | 1 | 0.909091 |
| NOT-SLC5A5 AND GPNMB AND NOT-KCNK5 | 1 | 1 | 1 |
| NOT-SLC5A5 AND GPNMB AND NOT-CFTR | 1 | 1 | 1 |
| NOT-SLC5A5 AND GPNMB AND NOT-CADM2 | 1 | 1 | 1 |
| NOT-TM4SF5 AND GPNMB AND NOT-KCNK5 | 1 | 1 | 1 |
| NOT-SLC5A5 AND GPNMB AND NOT-TSPAN8 | 0.952381 | 1 | 0.909091 |
| NOT-SLC5A5 AND GPNMB AND NOT-SYT8 | 0.952381 | 1 | 0.909091 |
| NOT-SLC34A3 AND LGR4 AND NOT-CLDN8 | 1 | 1 | 1 |
| NOT-CD300LB AND GPNMB AND NOT-TSPAN8 | 0.952381 | 1 | 0.909091 |
| NOT-TM4SF5 AND GPNMB AND NOT-CFTR | 1 | 1 | 1 |
| NOT-OR2S2 AND GPNMB AND NOT-KCNK5 | 1 | 1 | 1 |
| NOT-SLC5A5 AND LGR4 AND NOT-CLDN8 | 1 | 1 | 1 |
| NOT-OR2S2 AND TSPAN11 AND NOT-CLDN8 | 1 | 1 | 1 |
| NOT-TM4SF5 AND NOT-CADM2 AND SDC1 | 1 | 1 | 1 |
| NOT-CD300LB AND PCYT1A AND NOT-CADM2 | 0.952381 | 1 | 0.909091 |
| NOT-OR2S2 AND NOT-NTRK3 AND SDC1 | 0.952381 | 1 | 0.909091 |
| NOT-TAAR8 AND GPNMB AND NOT-TSPAN8 | 0.952381 | 1 | 0.909091 |
| NOT-TM4SF5 AND NOT-CADM2 AND GPNMB | 1 | 1 | 1 |
| NOT-SLC5A5 AND GPNMB AND NOT-ATP1A2 | 0.952381 | 1 | 0.909091 |
| NOT-OR2S2 AND NOT-NTRK3 AND GPNMB | 0.952381 | 1 | 0.909091 |
| NOT-GIPR AND GPNMB AND NOT-TSPAN8 | 0.952381 | 1 | 0.909091 |
| NOT-GIPR AND GPNMB AND NOT-KCNK5 | 1 | 1 | 1 |
| NOT-TM4SF5 AND GPNMB AND NOT-SYT8 | 0.952381 | 1 | 0.909091 |
| NOT-SLC5A5 AND GPNMB AND NOT-NTRK3 | 0.952381 | 1 | 0.909091 |
| NOT-TAAR8 AND TSPAN11 AND NOT-CLDN8 | 1 | 1 | 1 |
| NOT-OR2S2 AND GPNMB AND NOT-ATP1A2 | 0.952381 | 1 | 0.909091 |
| NOT-OR2S2 AND GPNMB AND NOT-ATP1A2 | 0.952381 | 1 | 0.909091 |
| NOT-TM4SF5 AND GPNMB AND NOT-TSPAN8 | 0.952381 | 1 | 0.909091 |
| NOT-SLC5A5 AND GPNMB AND PTPRJ | 0.952381 | 1 | 0.909091 |
| NOT-GIPR AND GPNMB AND NOT-NPY1R | 0.952381 | 1 | 0.909091 |
| NOT-GIPR AND TSPAN11 AND NOT-EPCAM | 0.952381 | 1 | 0.909091 |
| NOT-OR2S2 AND NOT-ATP1A2 AND L1CAM | 0.952381 | 1 | 0.909091 |
| NOT-TM4SF5 AND GPNMB AND NOT-NPY1R | 0.952381 | 1 | 0.909091 |
| NOT-GIPR AND WNT5A AND NOT-EPCAM | 0.952381 | 1 | 0.909091 |
| NOT-OR2S2 AND GPNMB AND PTPRJ | 0.952381 | 1 | 0.909091 |
| NOT-SLC5A5 AND GPNMB AND NOT-NPY1R | 0.952381 | 1 | 0.909091 |
| NOT-SLC5A5 AND GPNMB AND NOT-NRXN1 | 0.952381 | 1 | 0.909091 |
| NOT-GIPR AND GPNMB AND BEST1 | 0.952381 | 1 | 0.909091 |
| NOT-SLC5A5 AND GPNMB AND NOT-CNGA1 | 0.952381 | 1 | 0.909091 |
| NOT-TM4SF5 AND LGR4 AND NOT-EPCAM | 0.952381 | 1 | 0.909091 |
| NOT-SLC34A3 AND LGR4 AND NOT-EPCAM | 0.952381 | 1 | 0.909091 |
| NOT-TAAR8 AND LGR4 AND NOT-EPCAM | 0.952381 | 1 | 0.909091 |
| NOT-SLC5A5 AND LGR4 AND NOT-EPCAM | 0.952381 | 1 | 0.909091 |
| NOT-OR2S2 AND GPNMB AND NOT-CFTR | 1 | 1 | 1 |
| NOT-SLC5A5 AND GPNMB AND NOT-GPRC5D | 0.952381 | 1 | 0.909091 |
| NOT-SLC5A5 AND GPNMB AND NOT-ACSL1 | 0.952381 | 1 | 0.909091 |
| NOT-OR2S2 AND GPNMB AND NOT-CFTR | 1 | 1 | 1 |
| NOT-SLC5A5 AND TSPAN11 AND NOT-CLDN8 | 1 | 1 | 1 |
| NOT-SLC34A3 AND PCDHB14 AND NOT-CLDN8 | 1 | 1 | 1 |
| NOT-GPR21 AND TSPAN11 AND NOT-CLDN8 | 1 | 1 | 1 |
| NOT-OR2S2 AND SDC1 AND NOT-TSPAN8 | 0.952381 | 1 | 0.909091 |
| NOT-SLC5A5 AND SDC1 AND NOT-TSPAN8 | 0.952381 | 1 | 0.909091 |
| NOT-OR2S2 AND NOT-ATP1A2 AND THY1 | 0.952381 | 1 | 0.909091 |
| NOT-OR2S2 AND GPNMB AND NOT-NPR3 | 1 | 1 | 1 |
| NOT-SLC5A5 AND PCDHB14 AND NOT-CLDN8 | 1 | 1 | 1 |
| NOT-SLC5A5 AND FZD7 AND NOT-CLDN8 | 1 | 1 | 1 |
| NOT-SLC5A5 AND GPNMB AND NOT-NPR3 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| CDH6 AND NOT-CDH11 AND SDCBP | 0.857143 | 1 | 0.75 | NOT-OR2S2 AND GPNMB AND NOT-TSPAN8 | 0.952381 | 1 | 0.909091 |
| CDH6 AND NOT-CORIN AND C8B | 0.857143 | 1 | 0.75 | NOT-OR2S2 AND GPNMB AND NOT-SGCG | 0.952381 | 1 | 0.909091 |
| CDH6 AND CD63 AND STAB1 | 0.857143 | 1 | 0.75 | NOT-SLC5A5 AND SDC1 AND NOT-CADM2 | 1 | 1 | 1 |
| CDH6 AND NOT-OPALIN AND OR51M1 | 0.857143 | 1 | 0.75 | NOT-SLC5A5 AND GPNMB AND NOT-EDAR | 1 | 1 | 1 |
| CDH6 AND NOT-MEGF10 AND NOT-ACPP | 0.857143 | 1 | 0.75 | NOT-GIPR AND GPNMB AND NOT-CADM2 | 1 | 1 | 1 |
| CDH6 AND NOT-DPP6 AND CALHM3 | 0.857143 | 1 | 0.75 | NOT-GIPR AND GPNMB AND NOT-ATP1A2 | 1 | 1 | 1 |
| CDH6 AND ATP1B1 AND OR3A1 | 0.857143 | 1 | 0.75 | NOT-TM4SF5 AND GPNMB AND NOT-EDAR | 1 | 1 | 1 |
| CDH6 AND ATP1B1 AND OR7C1 | 0.857143 | 1 | 0.75 | NOT-SLC5A5 AND VCAM1 AND NOT-TSPAN8 | 0.952381 | 1 | 0.909091 |
| CDH6 AND NOT-MEGF10 AND ATP1B1 | 0.857143 | 1 | 0.75 | NOT-OR2S2 AND NOT-ATP1A2 AND STEAP1 | 0.952381 | 1 | 0.909091 |
| COMPLEX-CDH6/ATRAID/PPAPDC1B | 0.857143 | 1 | 0.75 | COMPLEX-SGCD/TPBG/TM4SF5 | 0.952381 | 1 | 0.909091 |
| CDH6 AND NOT-ACPP AND NOT-SLC4A8 | 0.857143 | 1 | 0.75 | NOT-SLC5A5 AND VCAM1 AND NOT-CADM2 | 1 | 1 | 1 |
| CDH6 AND NOT-NRG4 AND HLA-DRB1 | 0.857143 | 1 | 0.75 | NOT-GIPR AND TSPAN11 AND NOT-CLDN8 | 1 | 1 | 1 |
| CDH6 AND NOT-MEGF10 AND NOT-HAS3 | 0.857143 | 1 | 0.75 | NOT-OR2S2 AND NOT-NTRK3 AND VCAM1 | 0.952381 | 1 | 0.909091 |
| CDH6 AND NOT-NPY2R AND CATSPER3 | 0.857143 | 1 | 0.75 | NOT-CD300LB AND PCYT1A AND NOT-ATP1A2 | 0.952381 | 1 | 0.909091 |
| CDH6 AND NOT-ATP1B3 AND NOT-CRB1 | 0.857143 | 1 | 0.75 | NOT-SLC5A5 AND SDC1 AND NOT-NTRK3 | 0.952381 | 1 | 0.909091 |
| COMPLEX-CDH6/CDH11/ATRAID | 0.857143 | 1 | 0.75 | NOT-TM4SF5 AND NOT-CADM2 AND TPBG | 0.956522 | 0.916667 | 1 |
| CDH6 AND ABCB5 AND NOT-OR2B2 | 0.857143 | 1 | 0.75 | NOT-TM4SF5 AND NOT-ATP1A2 AND SDC1 | 1 | 1 | 1 |
| CDH6 AND NOT-LRP4 AND CD276 | 0.857143 | 1 | 0.75 | NOT-TM4SF5 AND GPNMB AND GPR3 | 0.952381 | 1 | 0.909091 |
| KCNJ16 AND NOT-COLQ AND CD276 | 0.857143 | 1 | 0.75 | NOT-SLC5A5 AND TNFRSF19 AND NOT-CLDN8 | 1 | 1 | 1 |
| CDH6 AND NOT-LGR5 AND OR51M1 | 0.857143 | 1 | 0.75 | NOT-SLC34A3 AND GPNMB AND NOT-KCNK5 | 1 | 1 | 1 |
| CDH6 AND ABCB5 AND NOT-SLC26A3 | 0.857143 | 1 | 0.75 | NOT-TM4SF5 AND GPNMB AND NOT-SLC6A2 | 0.952381 | 1 | 0.909091 |
| CDH6 AND NOT-LRRTM2 AND NOT-CD276 | 0.857143 | 1 | 0.75 | NOT-SLC5A5 AND GPNMB AND NOT-SLC6A2 | 0.952381 | 1 | 0.909091 |
| CDH6 AND ATP1B1 AND CD19 | 0.857143 | 1 | 0.75 | NOT-SLC5A5 AND VCAM1 AND NOT-NTRK3 | 0.952381 | 1 | 0.909091 |
| CDH6 AND NOT-LYPD6B AND GPNMB | 0.857143 | 1 | 0.75 | NOT-TM4SF5 AND LGR4 AND NOT-CLDN4 | 0.952381 | 1 | 0.909091 |
| CDH6 AND NOT-KCNJ12 AND CD276 | 0.857143 | 1 | 0.75 | NOT-CD300LB AND GPNMB AND PTPRJ | 0.952381 | 1 | 0.909091 |
| CDH6 AND ABCB5 AND NOT-HTR1A | 0.857143 | 1 | 0.75 | NOT-TM4SF5 AND GPNMB AND NOT-ATP1A2 | 0.952381 | 1 | 0.909091 |
| CDH6 AND NOT-TAS2R14 AND ABCB5 | 0.857143 | 1 | 0.75 | NOT-TM4SF5 AND GPNMB AND NOT-NTRK3 | 0.952381 | 1 | 0.909091 |
| CDH6 AND NOT-HAS1 AND GPNMB | 0.857143 | 1 | 0.75 | NOT-TM4SF5 AND NOT-NTRK3 AND SDC1 | 0.952381 | 1 | 0.909091 |
| CDH6 AND NOT-GPR52 AND ABCB5 | 0.857143 | 1 | 0.75 | NOT-SLC5A5 AND GPNMB AND NOT-CYP4F12 | 0.952381 | 1 | 0.909091 |
| CDH6 AND NOT-PTPRZ1 AND CD276 | 0.857143 | 1 | 0.75 | NOT-GIPR AND LGR4 AND NOT-EPCAM | 0.952381 | 1 | 0.909091 |
| CDH6 AND ABCB5 AND NOT-SCIMP | 0.857143 | 1 | 0.75 | NOT-GIPR AND GPNMB AND NOT-CNGA1 | 1 | 1 | 1 |
| CDH6 AND ABCB5 AND NOT-TACR3 | 0.857143 | 1 | 0.75 | NOT-SLC5A5 AND GPNMB AND NOT-SCNN1G | 1 | 1 | 1 |
| CDH16 AND NOT-SCNN1B AND CD276 | 0.857143 | 1 | 0.75 | NOT-OR2S2 AND GPNMB AND NOT-NPY1R | 0.952381 | 1 | 0.909091 |
| CDH6 AND NOT-COLQ AND CD276 | 0.857143 | 1 | 0.75 | NOT-OR2S2 AND GPNMB AND NOT-CYP4F12 | 0.952381 | 1 | 0.909091 |
| CDH6 AND NOT-PMEL AND DSC2 | 0.857143 | 1 | 0.75 | NOT-GIPR AND PCDHB14 AND NOT-EPCAM | 0.952381 | 1 | 0.909091 |
| CDH6 AND ABCB5 AND NOT-HRH4 | 0.857143 | 1 | 0.75 | NOT-TM4SF5 AND TSPAN11 AND NOT-EPCAM | 0.952381 | 1 | 0.909091 |
| CDH6 AND JTB AND FCRL2 | 0.857143 | 1 | 0.75 | NOT-OR51I2 AND TNFRSF19 AND NOT-CLDN8 | 0.952381 | 1 | 0.909091 |
| CDH6 AND NOT-FGFR3 AND GPNMB | 0.857143 | 1 | 0.75 | NOT-TM4SF5 AND GPNMB AND NOT-CNGA1 | 0.952381 | 1 | 0.909091 |
| CDH6 AND NOT-ATP1B3 AND NOT-ERBB2 | 0.857143 | 1 | 0.75 | NOT-SLC5A5 AND WNT5A AND NOT-EPCAM | 0.952381 | 1 | 0.909091 |
| CDH6 AND ATP1B1 AND ABCB5 | 0.857143 | 1 | 0.75 | NOT-TM4SF5 AND SDC1 AND NOT-KIAA1324 | 1 | 1 | 1 |
| CDH6 AND NOT-SHH AND ABCB5 | 0.857143 | 1 | 0.75 | ITM2B AND NOT-TMPRSS2 AND SDC1 | 0.956522 | 0.916667 | 1 |
| CDH6 AND NOT-NRG4 AND ERBB2 | 0.857143 | 1 | 0.75 | NOT-SLC5A5 AND TSPAN11 AND NOT-EPCAM | 0.952381 | 1 | 0.909091 |
| CDH6 AND NOT-LYPD6B AND ERBB2 | 0.857143 | 1 | 0.75 | NOT-TM4SF5 AND GPNMB AND NOT-NRXN1 | 0.952381 | 1 | 0.909091 |
| CDH6 AND NOT-ATP1B3 AND NOT-ABCB5 | 0.857143 | 1 | 0.75 | NOT-SLC34A3 AND ANO1 AND NOT-EPCAM | 0.952381 | 1 | 0.909091 |
| SLC3A1 AND CD276 AND NOT-GDPD2 | 0.857143 | 1 | 0.75 | COMPLEX-LDLRAD3/PMEL/CDH1 | 1 | 1 | 1 |
| CDH6 AND NOT-COLQ AND PTK7 | 0.857143 | 1 | 0.75 | COMPLEX-MERTK/PMEL/RNF144A | 1 | 1 | 1 |
| SLC3A1 AND CD276 AND NOT-SLC35G1 | 0.857143 | 1 | 0.75 | COMPLEX-MLANA/FREM2/GPRC5C | 1 | 1 | 1 |
| CDH6 AND NOT-NCAM2 AND CD276 | 0.857143 | 1 | 0.75 | COMPLEX-MLANA/FREM2/TMEM100 | 1 | 1 | 1 |
| CDH6 AND ABCB5 AND NOT-NPY2R | 0.857143 | 1 | 0.75 | COMPLEX-PMEL/NIPA2/ST3GAL5 | 1 | 1 | 1 |
| CDH6 AND NOT-COLQ AND GPNMB | 0.857143 | 1 | 0.75 | COMPLEX-LDLRAD3/MARCH1/PMEL | 1 | 1 | 1 |
| SLC3A1 AND CD276 AND NOT-ATP1B3 | 0.857143 | 1 | 0.75 | COMPLEX-MLANA/FREM2/NPY5R | 1 | 1 | 1 |
| SLC3A1 AND CD276 AND NOT-SLC26A3 | 0.857143 | 1 | 0.75 | COMPLEX-MLANA/FREM2/NPR3 | 1 | 1 | 1 |
| CDH6 AND NOT-GPR63 AND ABCB5 | 0.857143 | 1 | 0.75 | COMPLEX-HTRA2/PMEL/NIPA2 | 1 | 1 | 1 |
| CDH6 AND ABCB5 AND NOT-WNT4 | 0.857143 | 1 | 0.75 | COMPLEX-MLANA/HRH2/FREM2 | 1 | 1 | 1 |
| CDH6 AND NOT-ATP1B3 AND NOT-CD276 | 0.857143 | 1 | 0.75 | COMPLEX-LDLRAD3/PMP22/PMEL | 1 | 1 | 1 |
| SLC3A1 AND CD276 AND NOT-RHBDL2 | 0.857143 | 1 | 0.75 | COMPLEX-IL31RA/MLANA/FREM2 | 1 | 1 | 1 |
| CDH6 AND NOT-DPP6 AND ERBB2 | 0.857143 | 1 | 0.75 | COMPLEX-LDLRAD3/ATP2A3/PMEL | 1 | 1 | 1 |
| CDH6 AND ABCB5 AND NOT-DUOX1 | 0.857143 | 1 | 0.75 | COMPLEX-LDLRAD3/ASPH/PMEL | 1 | 1 | 1 |
| KCNJ16 AND NOT-SLC6A14 AND CD276 | 0.857143 | 1 | 0.75 | COMPLEX-LDLRAD3/FAM26F/PMEL | 1 | 1 | 1 |
| CDH6 AND ATP1B1 AND ERBB2 | 0.857143 | 1 | 0.75 | COMPLEX-LDLRAD3/BCAM/PMEL | 1 | 1 | 1 |
| CDH6 AND NOT-SLC20A2 AND GPNMB | 0.857143 | 1 | 0.75 | COMPLEX-LDLRAD3/SHISA6/PMEL | 1 | 1 | 1 |
| CDH6 AND NOT-PMEL AND ITGAM | 0.857143 | 1 | 0.75 | COMPLEX-MLANA/FREM2/ZP2 | 1 | 1 | 1 |
| CDH6 AND NOT-SYT8 AND ERBB2 | 0.857143 | 1 | 0.75 | COMPLEX-MLANA/FREM2/AQP10 | 1 | 1 | 1 |
| CDH6 AND NOT-REEP2 AND CD276 | 0.857143 | 1 | 0.75 | COMPLEX-LDLRAD3/SI/PMEL | 1 | 1 | 1 |
| CDH6 AND NOT-ADCYAP1R1 AND CD276 | 0.857143 | 1 | 0.75 | COMPLEX-LDLRAD3/PMEL/TAS1R2 | 1 | 1 | 1 |
| SLC3A1 AND CD276 AND NOT-DSC2 | 0.857143 | 1 | 0.75 | COMPLEX-LDLRAD3/PMEL/TMPRSS2 | 1 | 1 | 1 |
| KCNJ16 AND NOT-MUC15 AND CD276 | 0.857143 | 1 | 0.75 | COMPLEX-LDLRAD3/PMEL/VAMP7 | 1 | 1 | 1 |
| CDH6 AND NOT-HAS1 AND CD276 | 0.857143 | 1 | 0.75 | COMPLEX-LDLRAD3/PMEL/SLC26A10 | 1 | 1 | 1 |
| SLC3A1 AND CD276 AND NOT-SMPD3 | 0.857143 | 1 | 0.75 | COMPLEX-HCST/LDLRAD3/PMEL | 1 | 1 | 1 |
| CDH6 AND NOT-TAS2R16 AND CD276 | 0.857143 | 1 | 0.75 | COMPLEX-LDLRAD3/SCN4A/PMEL | 1 | 1 | 1 |
| SLC3A1 AND CD276 AND NOT-PTPRF | 0.857143 | 1 | 0.75 | COMPLEX-VAMP5/LDLRAD3/PMEL | 1 | 1 | 1 |
| CDH6 AND NOT-PRRT2 AND ABCB5 | 0.857143 | 1 | 0.75 | COMPLEX-LDLRAD3/ESYT2/PMEL | 1 | 1 | 1 |
| CDH6 AND NOT-COLQ AND ERBB2 | 0.857143 | 1 | 0.75 | COMPLEX-LDLRAD3/C2orf83/PMEL | 1 | 1 | 1 |
| CDH6 AND NOT-DPP6 AND NOT-CD276 | 0.857143 | 1 | 0.75 | COMPLEX-LDLRAD3/KCNH2/PMEL | 1 | 1 | 1 |
| CDH6 AND NOT-AKAP6 AND ABCB5 | 0.857143 | 1 | 0.75 | COMPLEX-SLC27A4/PMEL/RNF144A | 1 | 1 | 1 |
| CDH6 AND NOT-NRG4 AND PTK7 | 0.857143 | 1 | 0.75 | COMPLEX-PMEL/CD81/RNF144A | 1 | 1 | 1 |
| CDH6 AND JTB AND ERBB2 | 0.857143 | 1 | 0.75 | COMPLEX-LDLRAD3/HFE/PMEL | 1 | 1 | 1 |

FIG. 15 (cont.)

| Antigen Pair Logic | F1 | Precision | Recall |
|---|---|---|---|
| CDH6 AND NOT-PMEL AND ZDHHC5 | 0.857143 | 1 | 0.75 |
| COMPLEX-CDH6/EPHB2/LRRC8B | 0.857143 | 1 | 0.75 |
| CDH6 AND NOT-KCNJ12 AND GPNMB | 0.857143 | 1 | 0.75 |
| CDH6 AND NOT-FGFR3 AND CD276 | 0.857143 | 1 | 0.75 |
| CDH6 AND NOT-CORIN AND NOT-CD276 | 0.857143 | 1 | 0.75 |
| CDH6 AND NOT-PMEL AND CLPTM1 | 0.857143 | 1 | 0.75 |
| CDH6 AND NOT-ADCYAP1R1 AND ABCB5 | 0.857143 | 1 | 0.75 |
| CDH6 AND NOT-PMEL AND ITGA6 | 0.857143 | 1 | 0.75 |
| CDH6 AND NOT-PMEL AND NOT-FZD6 | 0.857143 | 1 | 0.75 |
| CDH6 AND NOT-SYT8 AND GPNMB | 0.857143 | 1 | 0.75 |
| CDH6 AND NOT-KCNK2 AND GPNMB | 0.857143 | 1 | 0.75 |
| CDH6 AND ATP1B1 AND PTK7 | 0.857143 | 1 | 0.75 |
| CDH6 AND NOT-SLC7A5 AND SDCBP | 0.857143 | 1 | 0.75 |
| CDH6 AND CD63 AND MUC4 | 0.857143 | 1 | 0.75 |
| CDH6 AND ATP1B1 AND CD22 | 0.857143 | 1 | 0.75 |
| CDH6 AND NOT-SLC7A5 AND SLC25A5 | 0.857143 | 1 | 0.75 |
| CDH6 AND CD63 AND CD19 | 0.857143 | 1 | 0.75 |
| CDH6 AND NOT-ADCYAP1R1 AND GPNMB | 0.857143 | 1 | 0.75 |
| KCNJ16 AND NOT-KRT5 AND CD276 | 0.857143 | 1 | 0.75 |
| KCNJ16 AND NOT-SCNN1B AND CD276 | 0.857143 | 1 | 0.75 |
| CDH6 AND CD63 AND RAET1E | 0.857143 | 1 | 0.75 |
| KCNJ16 AND NOT-MUC15 AND SDC1 | 0.857143 | 1 | 0.75 |
| SLC3A1 AND CD276 AND GPR63 | 0.857143 | 1 | 0.75 |
| SLC3A1 AND CD276 AND EPHB6 | 0.857143 | 1 | 0.75 |
| SLC3A1 AND CD276 AND NOT-DPP6 | 0.857143 | 1 | 0.75 |
| SLC3A1 AND CD276 AND LY6D | 0.857143 | 1 | 0.75 |
| SLC3A1 AND CD276 AND XG | 0.857143 | 1 | 0.75 |
| SLC3A1 AND CD276 AND MUC15 | 0.857143 | 1 | 0.75 |
| CDH6 AND NOT-PMEL AND ATP1B1 | 0.857143 | 1 | 0.75 |
| CDH6 AND NOT-PMEL AND CAV1 | 0.857143 | 1 | 0.75 |
| CDH6 AND NOT-OR1G1 AND PTK7 | 0.857143 | 1 | 0.75 |
| CDH6 AND NOT-PMEL AND ITGA2 | 0.857143 | 1 | 0.75 |
| CDH6 AND NOT-PMEL AND LRRC32 | 0.857143 | 1 | 0.75 |
| CDH6 AND ATP1B1 AND CD79A | 0.857143 | 1 | 0.75 |
| CDH6 AND NOT-MEGF10 AND CD276 | 0.857143 | 1 | 0.75 |
| CDH6 AND NOT-SLCO1A2 AND ABCB5 | 0.857143 | 1 | 0.75 |
| CDH6 AND ABCB5 AND NOT-KCNA1 | 0.857143 | 1 | 0.75 |
| CDH6 AND ABCB5 AND NOT-GPR135 | 0.857143 | 1 | 0.75 |
| CDH6 AND NOT-PMEL AND CALHM3 | 0.857143 | 1 | 0.75 |
| CDH6 AND NOT-SLC9B1 AND ABCB5 | 0.857143 | 1 | 0.75 |
| CDH6 AND NOT-MOG AND ABCB5 | 0.857143 | 1 | 0.75 |
| CDH6 AND ABCA12 AND NOT-PMEL | 0.857143 | 1 | 0.75 |
| SLC3A1 AND CD276 AND NOT-CHRND | 0.857143 | 1 | 0.75 |
| CDH6 AND NOT-HTR5A AND CD276 | 0.857143 | 1 | 0.75 |
| CDH6 AND NOT-SLC4A8 AND ABCB5 | 0.857143 | 1 | 0.75 |
| CDH6 AND ABCB5 AND NOT-CATSPERD | 0.857143 | 1 | 0.75 |
| CDH6 AND ABCB5 AND NOT-P2RY4 | 0.857143 | 1 | 0.75 |
| CDH6 AND NOT-GPR26 AND ABCB5 | 0.857143 | 1 | 0.75 |
| COMPLEX-CDH6/GPNMB/MEGF10 | 0.857143 | 1 | 0.75 |
| COMPLEX-CDH6/ERBB2/MEGF10 | 0.857143 | 1 | 0.75 |
| CDH6 AND NOT-HTR5A AND GPNMB | 0.857143 | 1 | 0.75 |
| SLC3A1 AND CD276 AND DSC1 | 0.857143 | 1 | 0.75 |
| SLC3A1 AND CD276 AND CRB1 | 0.857143 | 1 | 0.75 |
| CDH6 AND NOT-PVRL1 AND GPNMB | 0.857143 | 1 | 0.75 |
| SLC3A1 AND CD276 AND NOT-CABP7 | 0.818182 | 0.9 | 0.75 |
| SLC3A1 AND CD276 AND NOT-HTR5A | 0.818182 | 0.9 | 0.75 |
| SLC3A1 AND CD276 AND MEGF10 | 0.818182 | 0.9 | 0.75 |
| SLC3A1 AND CD276 AND NOT-OR2L2 | 0.818182 | 0.9 | 0.75 |
| KCNJ16 AND NOT-CRB1 AND CD276 | 0.818182 | 0.9 | 0.75 |
| KCNJ16 AND NOT-MEGF10 AND CD276 | 0.857143 | 1 | 0.75 |
| KCNJ16 AND NOT-HTR5A AND CD276 | 0.818182 | 0.9 | 0.75 |
| CDH6 AND NOT-CHRND AND PTK7 | 0.8 | 1 | 0.666667 |
| KCNJ16 AND NOT-OR2L2 AND CD276 | 0.8 | 1 | 0.666667 |
| CDH6 AND NOT-CHRND AND ERBB2 | 0.8 | 1 | 0.666667 |
| CDH6 AND NOT-CHRND AND ABCB5 | 0.8 | 1 | 0.666667 |
| CDH6 AND NOT-CABP7 AND CD276 | 0.8 | 1 | 0.666667 |
| CDH6 AND NOT-AGTR2 AND ERBB2 | 0.8 | 1 | 0.666667 |
| CLDN2 AND ATRAID AND NOT-GABRA2 | 0.8 | 1 | 0.666667 |
| CDH6 AND NOT-CHRND AND NOT-SDC1 | 0.8 | 1 | 0.666667 |
| CDH6 AND NOT-HTR5A AND ERBB2 | 0.8 | 1 | 0.666667 |
| KCNJ16 AND NOT-CHRND AND CD276 | 0.8 | 1 | 0.666667 |
| SLC3A1 AND CD276 AND SLC13A5 | 0.8 | 1 | 0.666667 |
| CDH6 AND NOT-CALN1 AND CD276 | 0.8 | 1 | 0.666667 |
| CDH6 AND NOT-CHRND AND CD276 | 0.8 | 1 | 0.666667 |
| VCAM1 AND ABCA12 AND NOT-SLC24A4 | 0.8 | 1 | 0.666667 |
| CDH6 AND NOT-MEGF10 AND ABCA12 | 0.857143 | 1 | 0.75 |
| CDH6 AND NOT-MEGF10 AND NOX1 | 0.857143 | 1 | 0.75 |

| Antigen Pair Logic | F1 | Precision | Recall |
|---|---|---|---|
| COMPLEX-ABCC9/MLANA/FREM2 | 1 | 1 | 1 |
| COMPLEX-LDLRAD3/GRIA3/PMEL | 1 | 1 | 1 |
| COMPLEX-LDLRAD3/GPM6B/PMEL | 1 | 1 | 1 |
| COMPLEX-LDLRAD3/GP5/PMEL | 1 | 1 | 1 |
| COMPLEX-LDLRAD3/OR1A2/PMEL | 1 | 1 | 1 |
| COMPLEX-LDLRAD3/TAS2R50/PMEL | 1 | 1 | 1 |
| COMPLEX-LDLRAD3/TAS2R39/PMEL | 1 | 1 | 1 |
| COMPLEX-LDLRAD3/TPSG1/PMEL | 1 | 1 | 1 |
| COMPLEX-LDLRAD3/FRRS1L/PMEL | 1 | 1 | 1 |
| COMPLEX-LDLRAD3/BACE1/PMEL | 1 | 1 | 1 |
| COMPLEX-LDLRAD3/ACSL1/PMEL | 1 | 1 | 1 |
| COMPLEX-LDLRAD3/F3/PMEL | 1 | 1 | 1 |
| COMPLEX-LDLRAD3/CADM4/PMEL | 1 | 1 | 1 |
| COMPLEX-LDLRAD3/MARVELD2/PMEL | 1 | 1 | 1 |
| COMPLEX-LDLRAD3/CTSZ/PMEL | 1 | 1 | 1 |
| COMPLEX-LDLRAD3/IHH/PMEL | 1 | 1 | 1 |
| COMPLEX-ATP1A1/PMEL/RNF144A | 1 | 1 | 1 |
| COMPLEX-GPR176/PMEL/RNF144A | 1 | 1 | 1 |
| COMPLEX-SLCO2B1/PMEL/RNF144A | 1 | 1 | 1 |
| COMPLEX-DCBLD2/PMEL/RNF144A | 1 | 1 | 1 |
| COMPLEX-LDLRAD3/KCNA3/PMEL | 1 | 1 | 1 |
| COMPLEX-HRH1/PMEL/RNF144A | 1 | 1 | 1 |
| COMPLEX-SLCO4C1/PMEL/RNF144A | 1 | 1 | 1 |
| COMPLEX-LRP5/PMEL/RNF144A | 1 | 1 | 1 |
| COMPLEX-MLANA/TMEM235/SLC2A1 | 1 | 1 | 1 |
| COMPLEX-MLANA/HTR1E/SLC2A1 | 1 | 1 | 1 |
| COMPLEX-MLANA/NMUR2/SLC2A1 | 1 | 1 | 1 |
| COMPLEX-MLANA/ABCA12/OR10J1 | 1 | 1 | 1 |
| COMPLEX-MLANA/ABCA12/TMEM235 | 1 | 1 | 1 |
| COMPLEX-MLANA/ABCA12/GHR | 1 | 1 | 1 |
| COMPLEX-MLANA/ABCA12/SCARA5 | 1 | 1 | 1 |
| COMPLEX-MLANA/ABCA12/CCKBR | 1 | 1 | 1 |
| COMPLEX-MLANA/SLC2A1/CCKBR | 1 | 1 | 1 |
| COMPLEX-MLANA/ABCA12/NOX1 | 1 | 1 | 1 |
| COMPLEX-MLANA/ABCA12/ATP13A5 | 1 | 1 | 1 |
| COMPLEX-MLANA/NPFFR1/SLC2A1 | 1 | 1 | 1 |
| COMPLEX-MLANA/OR10J1/SLC2A1 | 1 | 1 | 1 |
| COMPLEX-MLANA/GHR/SLC2A1 | 1 | 1 | 1 |
| COMPLEX-MLANA/ABCA12/NPFFR1 | 1 | 1 | 1 |
| NOT-CHRNA2 AND TTYH2 AND KDR | 1 | 1 | 1 |
| COMPLEX-MLANA/SCARA5/SLC2A1 | 1 | 1 | 1 |
| COMPLEX-MLANA/ATP13A5/SLC2A1 | 1 | 1 | 1 |
| COMPLEX-MLANA/NOX1/SLC2A1 | 1 | 1 | 1 |
| NOT-CHRNA2 AND TTYH2 AND KDR | 1 | 1 | 1 |
| COMPLEX-MLANA/CDH20/SLC2A1 | 1 | 1 | 1 |
| COMPLEX-MLANA/ABCA12/NMUR2 | 1 | 1 | 1 |
| COMPLEX-MLANA/ABCA12/CDH20 | 1 | 1 | 1 |
| COMPLEX-MLANA/ABCA12/HTR1E | 1 | 1 | 1 |
| MLANA AND NOT-NOX1 AND NOT-SYT4 | 1 | 1 | 1 |
| MLANA AND NOT-NOX1 AND EFNB2 | 1 | 1 | 1 |
| MLANA AND NOT-OR10J1 AND NOT-LRIG3 | 1 | 1 | 1 |
| MLANA AND NOT-NOX1 AND NOT-OR10J1 | 1 | 1 | 1 |
| MLANA AND NOT-NOX1 AND LRIG3 | 1 | 1 | 1 |
| MLANA AND NOT-NOX1 AND NOT-KCNA1 | 1 | 1 | 1 |
| COMPLEX-MLANA/ABCA12/SLC28A1 | 1 | 1 | 1 |
| COMPLEX-MLANA/ABCA12/SLC22A13 | 1 | 1 | 1 |
| COMPLEX-MLANA/ABCA12/SLC22A6 | 1 | 1 | 1 |
| COMPLEX-MLANA/ABCA12/CACNG8 | 1 | 1 | 1 |
| COMPLEX-MLANA/ABCA12/LRFN2 | 1 | 1 | 1 |
| COMPLEX-MLANA/ABCA12/SLC4A5 | 1 | 1 | 1 |
| COMPLEX-MLANA/ABCA12/SLC10A1 | 1 | 1 | 1 |
| COMPLEX-MLANA/ABCA12/GPR50 | 1 | 1 | 1 |
| COMPLEX-MLANA/ABCA12/GPR137B | 1 | 1 | 1 |
| COMPLEX-MLANA/ABCA12/CACNA1S | 1 | 1 | 1 |
| COMPLEX-MLANA/ABCA12/GJA10 | 1 | 1 | 1 |
| COMPLEX-MLANA/ABCA12/UPK3A | 1 | 1 | 1 |
| COMPLEX-MLANA/ABCA12/SLC22A5 | 1 | 1 | 1 |
| COMPLEX-HRH3/MLANA/SLC2A1 | 1 | 1 | 1 |
| COMPLEX-CLDN16/MLANA/SLC2A1 | 1 | 1 | 1 |
| COMPLEX-CHRNA4/MLANA/SLC2A1 | 1 | 1 | 1 |
| COMPLEX-HCN4/MLANA/SLC2A1 | 1 | 1 | 1 |
| COMPLEX-CLCN1/MLANA/SLC2A1 | 1 | 1 | 1 |
| COMPLEX-MLANA/GHSR/SLC2A1 | 1 | 1 | 1 |
| COMPLEX-MLANA/TSPAN16/SLC2A1 | 1 | 1 | 1 |
| COMPLEX-MLANA/GRIN2B/SLC2A1 | 1 | 1 | 1 |
| COMPLEX-MRGPRX2/MLANA/SLC2A1 | 1 | 1 | 1 |
| COMPLEX-MLANA/EPHA10/SLC2A1 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| CDH6 AND NOT-OPALIN AND ABCA12 | 0.857143 | 1 | 0.75 | COMPLEX-MLANA/AMHR2/SLC2A1 | 1 | 1 | 1 |
| CDH6 AND CHRNA2 AND NOT-CRB1 | 0.857143 | 1 | 0.75 | COMPLEX-MLANA/ABCA12/HTR6 | 1 | 1 | 1 |
| CDH6 AND NOT-SCN1A AND CATSPER3 | 0.857143 | 1 | 0.75 | COMPLEX-MLANA/OR2L2/SLC2A1 | 1 | 1 | 1 |
| CDH6 AND NOT-SLCO1A2 AND CATSPER3 | 0.857143 | 1 | 0.75 | COMPLEX-MLANA/ABCA12/SLC6A18 | 1 | 1 | 1 |
| CDH6 AND NOT-OPALIN AND CATSPER3 | 0.857143 | 1 | 0.75 | COMPLEX-MLANA/OR1C1/SLC2A1 | 1 | 1 | 1 |
| CDH6 AND NOT-CD207 AND SLC12A9 | 0.857143 | 1 | 0.75 | COMPLEX-GPR156/MLANA/SLC2A1 | 1 | 1 | 1 |
| CDH6 AND C8B AND NOT-DSC1 | 0.857143 | 1 | 0.75 | COMPLEX-LRRN4/MLANA/SLC2A1 | 1 | 1 | 1 |
| CDH6 AND NOT-MEGF10 AND CATSPER3 | 0.857143 | 1 | 0.75 | COMPLEX-SLC5A8/MLANA/SLC2A1 | 1 | 1 | 1 |
| CDH6 AND NOT-SLC9B1 AND CALHM3 | 0.857143 | 1 | 0.75 | COMPLEX-MLANA/CALHM1/SLC2A1 | 1 | 1 | 1 |
| CDH6 AND NOT-MOG AND CHRNA2 | 0.857143 | 1 | 0.75 | COMPLEX-MRGPRF/MLANA/SLC2A1 | 1 | 1 | 1 |
| CDH6 AND NOT-CHRND AND NOT-OXTR | 0.857143 | 1 | 0.75 | COMPLEX-LRIG3/MLANA/SLC2A1 | 1 | 1 | 1 |
| CDH6 AND NOT-CD207 AND ABCA12 | 0.857143 | 1 | 0.75 | COMPLEX-FGF6/MLANA/SLC2A1 | 1 | 1 | 1 |
| CDH6 AND NOT-KCNA1 AND CATSPER3 | 0.857143 | 1 | 0.75 | COMPLEX-CHRNG/MLANA/SLC2A1 | 1 | 1 | 1 |
| CDH6 AND NOT-SLCO1A2 AND CHRNA2 | 0.857143 | 1 | 0.75 | COMPLEX-CHRND/MLANA/SLC2A1 | 1 | 1 | 1 |
| CDH6 AND NOT-SLC4A8 AND CALHM3 | 0.857143 | 1 | 0.75 | COMPLEX-CYP4A11/MLANA/SLC2A1 | 1 | 1 | 1 |
| CDH6 AND NOT-SLC4A8 AND CHRNA2 | 0.857143 | 1 | 0.75 | COMPLEX-CNGA4/MLANA/SLC2A1 | 1 | 1 | 1 |
| CDH6 AND NOT-SCN1A AND ABCA12 | 0.857143 | 1 | 0.75 | COMPLEX-SLC22A12/MLANA/SLC2A1 | 1 | 1 | 1 |
| CDH6 AND NOX1 AND NOT-MOG | 0.857143 | 1 | 0.75 | COMPLEX-SLC5A11/MLANA/SLC2A1 | 1 | 1 | 1 |
| CDH6 AND NOT-CD207 AND C8B | 0.857143 | 1 | 0.75 | COMPLEX-MLANA/ABCA12/GPR135 | 1 | 1 | 1 |
| COMPLEX-CDH6/CALHM3/MEGF10 | 0.857143 | 1 | 0.75 | COMPLEX-CHRNA2/MLANA/SLC2A1 | 1 | 1 | 1 |
| COMPLEX-CDH6/DSC1/MEGF10 | 0.857143 | 1 | 0.75 | COMPLEX-MLANA/ABCA12/GABBR2 | 1 | 1 | 1 |
| CDH6 AND NOT-SLCO1A2 AND CALHM3 | 0.857143 | 1 | 0.75 | COMPLEX-CACNG2/MLANA/SLC2A1 | 1 | 1 | 1 |
| CDH6 AND HLA-DRB1 AND NOT-CD207 | 0.857143 | 1 | 0.75 | COMPLEX-MLANA/ABCA12/IGDCC3 | 1 | 1 | 1 |
| CDH6 AND NOT-KCNA1 AND CALHM3 | 0.857143 | 1 | 0.75 | COMPLEX-MLANA/ABCA12/PCDH8 | 1 | 1 | 1 |
| NOT-SCARA5 AND CAV2 AND CD74 | 0.869565 | 0.909091 | 0.833333 | COMPLEX-MLANA/ABCA12/KCNH1 | 1 | 1 | 1 |
| KCNJ16 AND NOT-SCN1A AND ABCA12 | 0.818182 | 0.9 | 0.75 | COMPLEX-MLANA/ABCA12/CACNG6 | 1 | 1 | 1 |
| KCNJ16 AND NOT-SCN1A AND NOT-CATSPER3 | 0.818182 | 0.9 | 0.75 | COMPLEX-LRIG3/MLANA/ABCA12 | 1 | 1 | 1 |
| CDH6 AND NOT-CHRND AND ABCA12 | 0.8 | 1 | 0.666667 | COMPLEX-MLANA/SLC2A1/UMOD | 1 | 1 | 1 |
| CDH6 AND CATSPERD AND NOT-CALHM3 | 0.8 | 1 | 0.666667 | COMPLEX-MLANA/SLC2A1/CALN1 | 1 | 1 | 1 |
| CDH6 AND NOT-CHRND AND CHRNA2 | 0.8 | 1 | 0.666667 | COMPLEX-MLANA/SLC2A1/CASR | 1 | 1 | 1 |
| CDH6 AND NOT-CHRND AND CATSPER3 | 0.8 | 1 | 0.666667 | COMPLEX-MLANA/SLC2A1/CCKAR | 1 | 1 | 1 |
| CDH6 AND NOT-CHRND AND VANGL1 | 0.8 | 1 | 0.666667 | COMPLEX-MLANA/ABCA12/CCKAR | 1 | 1 | 1 |
| KCNJ16 AND HLA-DRB1 AND NOT-CD207 | 0.818182 | 0.9 | 0.75 | COMPLEX-MLANA/SLC2A1/OTOF | 1 | 1 | 1 |
| TSPAN4 AND NOT-SCARA5 AND CD74 | 0.846154 | 0.785714 | 0.916667 | COMPLEX-MLANA/ABCA12/CASR | 1 | 1 | 1 |
| TSPAN4 AND NOT-SCARA5 AND VANGL1 | 0.857143 | 1 | 0.75 | COMPLEX-MLANA/ABCA12/CALN1 | 1 | 1 | 1 |
| ABCA1 AND NOT-SCARA5 AND VANGL1 | 0.8 | 1 | 0.666667 | COMPLEX-GPR156/MLANA/ABCA12 | 1 | 1 | 1 |
| GGTLC1 AND NOT-SCARA5 AND ATRAID | 0.818182 | 0.9 | 0.75 | COMPLEX-LRRN4/MLANA/ABCA12 | 1 | 1 | 1 |
| KCNJ16 AND HLA-DRB1 AND NOT-DSC1 | 0.857143 | 1 | 0.75 | COMPLEX-SLC5A8/MLANA/ABCA12 | 1 | 1 | 1 |
| NOT-SCARA5 AND NOT-SLC4A8 AND ABCA3 | 0.909091 | 1 | 0.833333 | COMPLEX-MLANA/ABCA12/UMOD | 1 | 1 | 1 |
| SLC3A1 AND CATSPER3 AND NOT-MEGF10 | 0.8 | 1 | 0.666667 | COMPLEX-CHRNG/MLANA/ABCA12 | 1 | 1 | 1 |
| KCNJ16 AND NOT-DSC1 AND C8B | 0.818182 | 0.9 | 0.75 | COMPLEX-MLANA/ABCA12/OR52D1 | 1 | 1 | 1 |
| SLC3A1 AND CD276 AND NOT-GPA33 | 0.857143 | 1 | 0.75 | COMPLEX-MLANA/ABCA12/SLC10A2 | 1 | 1 | 1 |
| SLC3A1 AND CD276 AND NOT-MUC4 | 0.857143 | 1 | 0.75 | COMPLEX-MLANA/ABCA12/SLC1A6 | 1 | 1 | 1 |
| CDH6 AND NOT-LGR5 AND ERBB2 | 0.857143 | 1 | 0.75 | COMPLEX-MLANA/ABCA12/ABCG8 | 1 | 1 | 1 |
| CDH6 AND NOT-LGR5 AND GPNMB | 0.857143 | 1 | 0.75 | COMPLEX-MLANA/ABCA12/CACNG7 | 1 | 1 | 1 |
| CDH6 AND NOT-LGR5 AND CD276 | 0.857143 | 1 | 0.75 | COMPLEX-CLDN16/MLANA/ABCA12 | 1 | 1 | 1 |
| CDH6 AND NOT-PMEL AND GPNMB | 0.857143 | 1 | 0.75 | COMPLEX-MLANA/ABCA12/GJD2 | 1 | 1 | 1 |
| SLC3A1 AND CD276 AND NOT-SDC1 | 0.857143 | 1 | 0.75 | NOT-SLC5A5 AND GPNMB AND NOT-CLDN8 | 1 | 1 | 1 |
| SLC3A1 AND CD276 AND NOT-PMEL | 0.818182 | 0.9 | 0.75 | NOT-GIPR AND GPNMB AND NOT-CLDN8 | 1 | 1 | 1 |
| CDH6 AND NOT-PMEL AND ERBB2 | 0.8 | 1 | 0.666667 | NOT-TM4SF5 AND GPNMB AND NOT-CLDN8 | 1 | 1 | 1 |
| KCNJ16 AND NOT-LGR5 AND CD276 | 0.8 | 1 | 0.666667 | NOT-GIPR AND GPNMB AND NOT-EPCAM | 0.952381 | 1 | 0.909091 |
| CLDN2 AND NOT-HHIP AND CD276 | 0.8 | 1 | 0.666667 | NOT-SLC5A5 AND GPNMB AND NOT-VTCN1 | 0.952381 | 1 | 0.909091 |
| CLDN2 AND ATRAID AND CD276 | 0.8 | 1 | 0.666667 | NOT-TM4SF5 AND GPNMB AND NOT-VTCN1 | 0.952381 | 1 | 0.909091 |
| CLDN2 AND CD276 AND CD63 | 0.8 | 1 | 0.666667 | NOT-SLC5A5 AND GPNMB AND NOT-ERBB2 | 1 | 1 | 1 |
| CLDN2 AND GPNMB AND NOT-PLA2R1 | 0.8 | 1 | 0.666667 | NOT-OR2S2 AND GPNMB AND NOT-CLDN8 | 1 | 1 | 1 |
| CLDN2 AND PTK7 AND NOT-NPY2R | 0.8 | 1 | 0.666667 | NOT-SLC34A3 AND GPNMB AND NOT-CLDN8 | 1 | 1 | 1 |
| NOT-SLITRK6 AND ERBB2 AND NOT-LGR5 | 0.8 | 1 | 0.666667 | NOT-SLC5A5 AND GPNMB AND NOT-IL20RA | 0.952381 | 1 | 0.909091 |
| CLDN2 AND CD276 AND NOT-LRRTM2 | 0.8 | 1 | 0.666667 | NOT-GIPR AND GPNMB AND NOT-VTCN1 | 0.952381 | 1 | 0.909091 |
| CLDN2 AND CD276 AND NOT-PTPRZ1 | 0.8 | 1 | 0.666667 | NOT-TAAR8 AND GPNMB AND NOT-EPCAM | 0.952381 | 1 | 0.909091 |
| CLDN2 AND PTK7 AND NOT-DPP6 | 0.8 | 1 | 0.666667 | NOT-TM4SF5 AND SDC1 AND NOT-EPCAM | 0.952381 | 1 | 0.909091 |
| NOT-IL11RA AND ATRAID AND NOT-MUC4 | 0.8 | 1 | 0.666667 | NOT-SLC5A5 AND GPNMB AND NOT-EPCAM | 0.952381 | 1 | 0.909091 |
| VCAM1 AND ATP1B1 AND NOT-CD276 | 0.857143 | 1 | 0.75 | NOT-TM4SF5 AND GPNMB AND NOT-EPCAM | 0.952381 | 1 | 0.909091 |
| CLDN2 AND ITGAM AND NOT-PMEL | 0.8 | 1 | 0.666667 | NOT-OR51M1 AND GPNMB AND NOT-ERBB2 | 0.952381 | 1 | 0.909091 |
| VCAM1 AND ATP1B1 AND ABCB5 | 0.857143 | 1 | 0.75 | NOT-TM4SF5 AND GPNMB AND NOT-ERBB2 | 1 | 1 | 1 |
| CLDN2 AND ABCA12 AND NOT-SCN1A | 0.8 | 1 | 0.666667 | NOT-TM4SF5 AND GPNMB AND NOT-ERBB2 | 1 | 1 | 1 |
| VCAM1 AND ABCA12 AND NOT-MOG | 0.818182 | 0.9 | 0.75 | NOT-TMEM150B AND GPNMB AND NOT-ERBB2 | 1 | 1 | 1 |
| VCAM1 AND ABCA12 AND NOT-CHRND | 0.818182 | 0.9 | 0.75 | NOT-TAAR8 AND GPNMB AND NOT-CLDN8 | 1 | 1 | 1 |
| VCAM1 AND ABCA12 AND NOT-CRB1 | 0.818182 | 0.9 | 0.75 | NOT-GIPR AND GPNMB AND NOT-IL20RA | 0.952381 | 1 | 0.909091 |
| VCAM1 AND ABCA12 AND NOT-CD207 | 0.857143 | 1 | 0.75 | NOT-TM4SF5 AND GPNMB AND NOT-CLDN4 | 0.952381 | 1 | 0.909091 |
| VCAM1 AND ABCA12 AND NOT-OPALIN | 0.8 | 1 | 0.666667 | NOT-OR2S2 AND GPNMB AND NOT-VTCN1 | 0.952381 | 1 | 0.909091 |
| VCAM1 AND CALHM3 AND NOT-P2RY4 | 0.818182 | 0.9 | 0.75 | NOT-OR2S2 AND SDC1 AND NOT-EPCAM | 0.952381 | 1 | 0.909091 |
| VCAM1 AND CALHM3 AND NOT-GPR135 | 0.857143 | 1 | 0.75 | NOT-CD300LB AND GPNMB AND NOT-EPCAM | 0.952381 | 1 | 0.909091 |
| VCAM1 AND CALHM3 AND NOT-SLC9B1 | 0.8 | 1 | 0.666667 | NOT-TM4SF5 AND GPNMB AND NOT-IL20RA | 0.952381 | 1 | 0.909091 |
| VCAM1 AND CALHM3 AND NOT-CD207 | 0.857143 | 1 | 0.75 | NOT-CD300LB AND GPNMB AND NOT-CLDN8 | 1 | 1 | 1 |
| CLDN2 AND CALHM3 AND NOT-DSC1 | 0.8 | 1 | 0.666667 | NOT-GIPR AND GPNMB AND NOT-ERBB2 | 1 | 1 | 1 |
| VCAM1 AND CALHM3 AND NOT-CATSPERD | 0.857143 | 1 | 0.75 | NOT-GIPR AND GPNMB AND NOT-ERBB2 | 1 | 1 | 1 |
| VCAM1 AND NOX1 AND NOT-CD207 | 0.8 | 1 | 0.666667 | NOT-SLC5A5 AND GPNMB AND NOT-CEACAM6 | 1 | 1 | 1 |

FIG. 15 (cont.)

| Antigen Pair Logic | F1 | Precision | Recall |
|---|---|---|---|
| VCAM1 AND OXTR AND NOT-CHRND | 0.818182 | 0.9 | 0.75 |
| VCAM1 AND CHRNA2 AND NOT-MOG | 0.818182 | 0.9 | 0.75 |
| VCAM1 AND NOT-MEGF10 AND NOT-CATSPER3 | 0.818182 | 0.9 | 0.75 |
| VCAM1 AND NOX1 AND NOT-CATSPERD | 0.8 | 1 | 0.666667 |
| VCAM1 AND CATSPER3 AND NOT-CHRND | 0.857143 | 1 | 0.75 |
| VCAM1 AND CHRNA2 AND NOT-CHRND | 0.818182 | 0.9 | 0.75 |
| NOT-SCARA5 AND AXL AND NOT-SLC4A8 | 0.916667 | 0.916667 | 0.916667 |
| VCAM1 AND CHRNA2 AND NOT-CRB1 | 0.818182 | 0.9 | 0.75 |
| CLDN2 AND HLA-DRB1 AND NOT-DSC1 | 0.8 | 1 | 0.666667 |
| NOT-SCARA5 AND AXL AND CD74 | 0.916667 | 0.916667 | 0.916667 |
| VCAM1 AND CATSPER3 AND NOT-DSC1 | 0.857143 | 1 | 0.75 |
| VCAM1 AND CATSPER3 AND NOT-CD207 | 0.857143 | 1 | 0.75 |
| VCAM1 AND CATSPER3 AND NOT-SCN1A | 0.8 | 1 | 0.666667 |
| VCAM1 AND CATSPER3 AND NOT-CRB1 | 0.857143 | 1 | 0.75 |
| VCAM1 AND CATSPER3 AND NOT-KCNA1 | 0.818182 | 0.9 | 0.75 |
| VCAM1 AND NOT-SCARA5 AND ERBB2 | 0.857143 | 1 | 0.75 |
| VCAM1 AND NOT-SCARA5 AND SDC1 | 0.8 | 1 | 0.666667 |
| VCAM1 AND ABCB5 AND NOT-MOG | 0.818182 | 0.9 | 0.75 |
| CLDN2 AND PTK7 AND NOT-DSC1 | 0.8 | 1 | 0.666667 |
| VCAM1 AND ABCA12 AND NOT-PMEL | 0.818182 | 0.9 | 0.75 |
| VCAM1 AND ABCB5 AND NOT-GPR135 | 0.857143 | 1 | 0.75 |
| VCAM1 AND ABCB5 AND NOT-CRB1 | 0.818182 | 0.9 | 0.75 |
| VCAM1 AND ABCB5 AND NOT-P2RY4 | 0.818182 | 0.9 | 0.75 |
| VCAM1 AND ABCB5 AND NOT-CHRND | 0.818182 | 0.9 | 0.75 |
| VCAM1 AND CALHM3 AND NOT-PMEL | 0.818182 | 0.9 | 0.75 |
| VCAM1 AND ABCB5 AND NOT-SLC9B1 | 0.8 | 1 | 0.666667 |
| VCAM1 AND ABCB5 AND NOT-CATSPERD | 0.857143 | 1 | 0.75 |
| VCAM1 AND NOT-CHRND AND NOT-CD276 | 0.818182 | 0.9 | 0.75 |
| VCAM1 AND SDC1 AND NOT-MEGF10 | 0.8 | 1 | 0.666667 |
| VCAM1 AND NOT-CD276 AND NOT-GPR6 | 0.8 | 1 | 0.666667 |
| VCAM1 AND NOT-CHRND AND PTK7 | 0.818182 | 0.9 | 0.75 |
| VCAM1 AND NOT-CD276 AND NOT-OR2L2 | 0.8 | 1 | 0.666667 |
| NOT-SCARA5 AND AXL AND ERBB2 | 0.88 | 0.846154 | 0.916667 |
| NOT-SCARA5 AND AXL AND SDC1 | 0.869565 | 0.909091 | 0.833333 |
| NOT-LGR5 AND CD276 AND NOT-STEAP4 | 0.857143 | 1 | 0.75 |
| CLDN2 AND NOT-LGR5 AND CD276 | 0.8 | 1 | 0.666667 |
| VCAM1 AND NOT-LGR5 AND NOT-CD276 | 0.8 | 1 | 0.666667 |
| VCAM1 AND SDC1 AND NOT-CD276 | 0.8 | 1 | 0.666667 |
| VCAM1 AND NOT-CD276 AND NOT-GPA33 | 0.857143 | 1 | 0.75 |
| NOT-LGR5 AND CD276 AND NOT-CLDN11 | 0.818182 | 0.9 | 0.75 |
| NOT-CEACAM5 AND CD276 AND NOT-LGR5 | 0.818182 | 0.9 | 0.75 |
| NOT-LGR5 AND EGFR AND ERBB2 | 0.8 | 1 | 0.666667 |
| NOT-LGR5 AND EGFR AND GPNMB | 0.8 | 1 | 0.666667 |
| TNFRSF12A AND NOT-SCARA5 AND CD74 | 0.818182 | 0.9 | 0.75 |
| GGTLC1 AND CALHM3 AND NOT-SLC9B1 | 0.818182 | 0.9 | 0.75 |
| TNFRSF12A AND CATSPER3 AND NOT-SLCO1A2 | 0.8 | 1 | 0.666667 |
| Colon Cancer | | | |
| BIRC5 AND TSPAN8 AND NOT-SEMA6D | 1 | 1 | 1 |
| HEPH AND CLDN1 AND NOT-CD200R1 | 1 | 1 | 1 |
| DPEP1 AND TMEM123 AND ATP2C2 | 1 | 1 | 1 |
| DPEP1 AND TMEM123 AND HEPH | 1 | 1 | 1 |
| MUC13 AND EDNRA AND NOT-NPY5R | 1 | 1 | 1 |
| MUC13 AND EDNRA AND NOT-NGFR | 1 | 1 | 1 |
| HEPH AND CLDN1 AND NOT-CATSPER2 | 1 | 1 | 1 |
| MUC13 AND EDNRA AND NOT-MUSK | 1 | 1 | 1 |
| HEPH AND CLDN1 AND NOT-ADCY9 | 1 | 1 | 1 |
| MUC13 AND EDNRA AND NOT-MPZ | 1 | 1 | 1 |
| MUC13 AND EDNRA AND NOT-MMP16 | 1 | 1 | 1 |
| HEPH AND CLDN1 AND NOT-GPR146 | 1 | 1 | 1 |
| DPEP1 AND TMEM123 AND NOT-GLP2R | 1 | 1 | 1 |
| MUC13 AND EDNRA AND NOT-MC4R | 1 | 1 | 1 |
| DPEP1 AND TMEM123 AND NOT-CD7 | 1 | 1 | 1 |
| HEPH AND CLDN1 AND NOT-FZD10 | 1 | 1 | 1 |
| MUC13 AND EDNRA AND NOT-ERVFRD-1 | 1 | 1 | 1 |
| HEPH AND CLDN1 AND NOT-BTN2A1 | 1 | 1 | 1 |
| DPEP1 AND TMEM123 AND NOT-XPR1 | 1 | 1 | 1 |
| DPEP1 AND NOT-SLC22A7 AND NOT-SLC52A3 | 1 | 1 | 1 |
| COMPLEX-SLC22A7/OR10A5/DPEP1 | 1 | 1 | 1 |
| HEPH AND CLDN1 AND NOT-RAMP2 | 1 | 1 | 1 |
| DPEP1 AND NOT-SLC22A7 AND NOT-ADRA1B | 1 | 1 | 1 |
| MUC13 AND EDNRA AND NOT-PCDHB8 | 1 | 1 | 1 |
| DPEP1 AND NOT-SLC22A7 AND MCOLN2 | 1 | 1 | 1 |
| MUC13 AND EDNRA AND NOT-PCDHGA11 | 1 | 1 | 1 |
| HEPH AND CLDN1 AND F3 | 1 | 1 | 1 |
| DPEP1 AND NOT-SLC22A7 AND NOT-FCGRT | 1 | 1 | 1 |
| HEPH AND CLDN1 AND NOT-PIANP | 1 | 1 | 1 |
| MUC13 AND EDNRA AND NOT-DCHS2 | 1 | 1 | 1 |

| Antigen Pair Logic | F1 | Precision | Recall |
|---|---|---|---|
| NOT-TM4SF5 AND GPNMB AND NOT-CEACAM6 | 1 | 1 | 1 |
| NOT-SLC34A3 AND GPNMB AND NOT-LGR5 | 0.952381 | 1 | 0.909091 |
| NOT-SLC34A3 AND GPNMB AND NOT-IL20RA | 0.952381 | 1 | 0.909091 |
| NOT-OR2S2 AND GPNMB AND NOT-IL20RA | 0.952381 | 1 | 0.909091 |
| NOT-SLC5A5 AND GPNMB AND NOT-EGFR | 0.952381 | 1 | 0.909091 |
| COMPLEX-CD300LB/EDNRB/CLDN6 | 0.9 | 1 | 0.818182 |
| COMPLEX-EDNRB/SDC1/SLC14A2 | 0.9 | 1 | 0.818182 |
| COMPLEX-GPNMB/EDNRB/PCDHGA9 | 0.9 | 1 | 0.818182 |
| COMPLEX-EDNRB/SLC5A5/TPBG | 0.9 | 1 | 0.818182 |
| COMPLEX-GPNMB/EDNRB/GPR15 | 0.9 | 1 | 0.818182 |
| COMPLEX-EDNRB/OR5I2/SDC1 | 0.9 | 1 | 0.818182 |
| COMPLEX-GPNMB/EDNRB/GCGR | 0.9 | 1 | 0.818182 |
| COMPLEX-CD300C/EDNRB/SDC1 | 0.9 | 1 | 0.818182 |
| EDNRB AND NOT-AQP10 AND GPNMB | 0.9 | 1 | 0.818182 |
| COMPLEX-GPNMB/EDNRB/TACSTD2 | 0.9 | 1 | 0.818182 |
| COMPLEX-GPNMB/EDNRB/LRRC4B | 0.9 | 1 | 0.818182 |
| NOT-SLC5A5 AND GPNMB AND NOT-FOLR1 | 0.9 | 1 | 0.818182 |
| COMPLEX-GPNMB/EDNRB/SLC14A2 | 0.9 | 1 | 0.818182 |
| COMPLEX-GPNMB/EDNRB/HCRTR1 | 0.9 | 1 | 0.818182 |
| COMPLEX-FCRL1/EDNRB/TM4SF5 | 0.9 | 1 | 0.818182 |
| EDNRB AND NOT-SSTR1 AND NOT-AQP10 | 0.9 | 1 | 0.818182 |
| COMPLEX-CD300C/EDNRB/SSTR1 | 0.9 | 1 | 0.818182 |
| COMPLEX-GPNMB/EDNRB/FLRT3 | 0.9 | 1 | 0.818182 |
| COMPLEX-GPNMB/EDNRB/ATP1A1 | 0.9 | 1 | 0.818182 |
| COMPLEX-CHRM4/EDNRB/STEAP2 | 0.9 | 1 | 0.818182 |
| COMPLEX-EDNRB/STEAP2/OR2S2 | 0.9 | 1 | 0.818182 |
| COMPLEX-EDNRB/STEAP2/OR4D1 | 0.9 | 1 | 0.818182 |
| COMPLEX-CD300LB/EDNRB/STEAP2 | 0.9 | 1 | 0.818182 |
| COMPLEX-CD300C/EDNRB/STEAP2 | 0.9 | 1 | 0.818182 |
| COMPLEX-CLDN23/EDNRB/SLC5A5 | 0.9 | 1 | 0.818182 |
| COMPLEX-FCRL1/EDNRB/GIPR | 0.9 | 1 | 0.818182 |
| COMPLEX-GPNMB/EDNRB/OSMR | 0.9 | 1 | 0.818182 |
| COMPLEX-GPNMB/CD300C/EDNRB | 0.9 | 1 | 0.818182 |
| COMPLEX-GPNMB/EDNRB/IHH | 0.9 | 1 | 0.818182 |
| COMPLEX-EDNRB/OR4D1/VCAM1 | 0.9 | 1 | 0.818182 |
| COMPLEX-EDNRB/RNF43/SLC5A5 | 0.9 | 1 | 0.818182 |
| COMPLEX-EDNRB/SDC1/TAAR8 | 0.9 | 1 | 0.818182 |
| COMPLEX-GPNMB/TSPAN9/EDNRB | 0.9 | 1 | 0.818182 |
| COMPLEX-GPNMB/CHRM4/EDNRB | 0.9 | 1 | 0.818182 |
| EDNRB AND VCAM1 AND NOT-AQP10 | 0.9 | 1 | 0.818182 |
| COMPLEX-EDNRB/ITGAV/TAAR8 | 0.9 | 1 | 0.818182 |
| COMPLEX-EDNRB/OR5I2/VCAM1 | 0.9 | 1 | 0.818182 |
| COMPLEX-EDNRB/GIPR/FCRL2 | 0.9 | 1 | 0.818182 |
| COMPLEX-EDNRB/TPBG/TM4SF5 | 0.9 | 1 | 0.818182 |
| COMPLEX-GPNMB/CD300LB/EDNRB | 0.9 | 1 | 0.818182 |
| NOT-GIPR AND GPNMB AND NOT-CLDN4 | 0.9 | 1 | 0.818182 |
| COMPLEX-EDNRB/OR2S2/VCAM1 | 0.9 | 1 | 0.818182 |
| COMPLEX-EDNRB/SDC1/TM4SF5 | 0.9 | 1 | 0.818182 |
| COMPLEX-EDNRB/SLC5A5/VCAM1 | 0.9 | 1 | 0.818182 |
| NOT-SLC5A5 AND GPNMB AND NOT-CLDN4 | 0.9 | 1 | 0.818182 |
| COMPLEX-EDNRB/STEAP2/TAAR8 | 0.9 | 1 | 0.818182 |
| COMPLEX-FCRL1/SLC34A3/EDNRB | 0.9 | 1 | 0.818182 |
| COMPLEX-EDNRB/GPR15/SDC1 | 0.9 | 1 | 0.818182 |
| COMPLEX-GPNMB/EDNRB/FGFR3 | 0.9 | 1 | 0.818182 |
| COMPLEX-EDNRB/STEAP2/SLC5A5 | 0.9 | 1 | 0.818182 |
| NOT-OR2S2 AND GPNMB AND NOT-FOLR1 | 0.9 | 1 | 0.818182 |
| COMPLEX-GPNMB/CHRM5/EDNRB | 0.9 | 1 | 0.818182 |
| COMPLEX-EDNRB/SDC1/SLC5A5 | 0.9 | 1 | 0.818182 |
| COMPLEX-GPNMB/EDNRB/ANO1 | 0.9 | 1 | 0.818182 |
| COMPLEX-SLC34A3/EDNRB/FCRL2 | 0.9 | 1 | 0.818182 |
| NOT-TAAR8 AND GPNMB AND NOT-VTCN1 | 0.952381 | 1 | 0.909091 |
| NOT-OR2S2 AND GPNMB AND NOT-EPCAM | 0.952381 | 1 | 0.909091 |
| NOT-SLC5A5 AND SDC1 AND NOT-EPCAM | 0.952381 | 1 | 0.909091 |
| NOT-CLDN19 AND GPNMB AND NOT-CLDN8 | 1 | 1 | 1 |
| NOT-CHRNA2 AND GPNMB AND NOT-CLDN8 | 1 | 1 | 1 |
| NOT-CHRNA2 AND SDC1 AND NOT-CLDN8 | 1 | 1 | 1 |
| GPR137B AND NOT-CLDN8 AND ERBB3 | 1 | 1 | 1 |
| GPR137B AND NOT-CLDN8 AND ERBB3 | 1 | 1 | 1 |
| GPR137B AND NOT-CLDN8 AND ERBB2 | 0.952381 | 1 | 0.909091 |
| NOT-CLDN19 AND GPNMB AND NOT-LGR5 | 0.952381 | 1 | 0.909091 |
| GPR137B AND NOT-CLDN8 AND ERBB2 | 0.952381 | 1 | 0.909091 |
| NOT-CLDN19 AND GPNMB AND NOT-IL20RA | 0.952381 | 1 | 0.909091 |
| NOT-CLDN19 AND GPNMB AND NOT-VTCN1 | 0.952381 | 1 | 0.909091 |
| NOT-CHRNA2 AND SDC1 AND NOT-VTCN1 | 0.952381 | 1 | 0.909091 |
| NOT-CLDN19 AND GPNMB AND NOT-ERBB2 | 1 | 1 | 1 |
| NOT-CLDN19 AND GPNMB AND NOT-ERBB2 | 1 | 1 | 1 |
| NOT-CHRNA2 AND VCAM1 AND NOT-CLDN8 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| MUC13 AND EDNRA AND NOT-EQTN | 1 | 1 | 1 | GPR137B AND NOT-IL20RA AND ERBB3 | 0.952381 | 1 | 0.909091 |
| HEPH AND CLDN1 AND NOT-ADRB2 | 1 | 1 | 1 | GPR137B AND NOT-CLDN8 AND L1CAM | 0.952381 | 1 | 0.909091 |
| MUC13 AND EDNRA AND SLC38A2 | 1 | 1 | 1 | NOT-CHRNA2 AND GPNMB AND NOT-VTCN1 | 0.952381 | 1 | 0.909091 |
| HEPH AND CLDN1 AND CYBA | 1 | 1 | 1 | NOT-CACNG6 AND SDC1 AND NOT-EPCAM | 0.952381 | 1 | 0.909091 |
| HEPH AND CLDN1 AND NOT-CTLA4 | 1 | 1 | 1 | NOT-CHRNA2 AND SDC1 AND NOT-EPCAM | 0.952381 | 1 | 0.909091 |
| MUC13 AND EDNRA AND NOT-ADAM22 | 1 | 1 | 1 | NOT-CLDN19 AND GPNMB AND NOT-EPCAM | 0.952381 | 1 | 0.909091 |
| HEPH AND CLDN1 AND NOT-CD300LG | 1 | 1 | 1 | GPR137B AND NOT-ERBB2 AND ERBB3 | 1 | 1 | 1 |
| MUC13 AND EDNRA AND NOT-PKD1 | 1 | 1 | 1 | GPR137B AND NOT-ERBB2 AND ERBB3 | 1 | 1 | 1 |
| DPEP1 AND NOT-SLC22A7 AND NOT-CNST | 1 | 1 | 1 | NOT-CHRNA2 AND GPNMB AND NOT-ERBB2 | 1 | 1 | 1 |
| MUC13 AND EDNRA AND NOT-C14orf180 | 1 | 1 | 1 | NOT-CLDN19 AND GPNMB AND NOT-EGFR | 1 | 1 | 1 |
| MUC13 AND EDNRA AND NOT-LAG3 | 1 | 1 | 1 | GPR137B AND NOT-CLDN8 AND SDC1 | 0.956522 | 0.916667 | 1 |
| MUC13 AND EDNRA AND NOT-HCRTR1 | 1 | 1 | 1 | COMPLEX-CHRNA2/ITGAV/L1CAM | 0.952381 | 1 | 0.909091 |
| DPEP1 AND TMEM123 AND NOT-TNFRSF25 | 1 | 1 | 1 | GPR137B AND NOT-CLDN8 AND SDC1 | 0.956522 | 0.916667 | 1 |
| DPEP1 AND NOT-ZP2 AND TM4SF5 | 1 | 1 | 1 | NOT-CLDN19 AND GPNMB AND NOT-CEACAM6 | 1 | 1 | 1 |
| DPEP1 AND TMEM123 AND NOT-SLC4A4 | 1 | 1 | 1 | NOT-CHRNA2 AND GPNMB AND NOT-IL20RA | 0.952381 | 1 | 0.909091 |
| MUC13 AND EDNRA AND NOT-CD274 | 1 | 1 | 1 | NOT-CHRNA2 AND ENG AND NOT-ERBB2 | 1 | 1 | 1 |
| MUC13 AND EDNRA AND NOT-GRIA3 | 1 | 1 | 1 | NOT-CHRNA2 AND ITGAV AND NOT-CLDN8 | 0.916667 | 0.846154 | 1 |
| DPEP1 AND TMEM123 AND NOT-UNC5C | 1 | 1 | 1 | NOT-CHRNA2 AND ERBB2 AND NOT-CLDN8 | 0.916667 | 0.846154 | 1 |
| DPEP1 AND TMEM123 AND NOT-ITGA8 | 1 | 1 | 1 | GPR137B AND NOT-EPCAM AND ERBB3 | 0.952381 | 1 | 0.909091 |
| MUC13 AND EDNRA AND NOT-SLC9A9 | 1 | 1 | 1 | NOT-CHRNA2 AND VCAM1 AND NOT-VTCN1 | 0.952381 | 1 | 0.909091 |
| MUC13 AND EDNRA AND NOT-GPR25 | 1 | 1 | 1 | GPR137B AND NOT-EGFR AND ERBB3 | 0.952381 | 1 | 0.909091 |
| MUC13 AND EDNRA AND NOT-SLC9C2 | 1 | 1 | 1 | COMPLEX-CHRNA2/ABCB5/VCAM1 | 1 | 1 | 1 |
| MUC13 AND EDNRA AND NOT-IZUMO1 | 1 | 1 | 1 | NOT-CHRNA2 AND GPNMB AND NOT-EPCAM | 0.952381 | 1 | 0.909091 |
| MUC13 AND EDNRA AND NOT-GPR17 | 1 | 1 | 1 | NOT-CACNG6 AND GPNMB AND NOT-EPCAM | 0.952381 | 1 | 0.909091 |
| MUC13 AND EDNRA AND NOT-NPBWR2 | 1 | 1 | 1 | NOT-CLDN19 AND GPNMB AND NOT-CLDN1 | 1 | 1 | 1 |
| MUC13 AND EDNRA AND NOT-OR8D2 | 1 | 1 | 1 | NOT-GJD2 AND GPNMB AND NOT-EPCAM | 0.952381 | 1 | 0.909091 |
| DPEP1 AND TMEM123 AND NOT-COL25A1 | 1 | 1 | 1 | NOT-CHRNA2 AND SDC1 AND NOT-IL20RA | 0.952381 | 1 | 0.909091 |
| DPEP1 AND TMEM123 AND NOT-LRRC8C | 1 | 1 | 1 | GPR137B AND NOT-CLDN8 AND IL13RA2 | 0.952381 | 1 | 0.909091 |
| MUC13 AND EDNRA AND NOT-GLP1R | 1 | 1 | 1 | NOT-CHRNA2 AND SDC1 AND NOT-CEACAM6 | 1 | 1 | 1 |
| MUC13 AND EDNRA AND NOT-SIGLEC9 | 1 | 1 | 1 | GPR137B AND NOT-CLDN8 AND THY1 | 0.952381 | 1 | 0.909091 |
| DPEP1 AND NOT-ZP2 AND DEGS1 | 1 | 1 | 1 | NOT-CHRNA2 AND VCAM1 AND NOT-IL20RA | 0.952381 | 1 | 0.909091 |
| DPEP1 AND NOT-ZP2 AND GALR3 | 1 | 1 | 1 | GPR137B AND NOT-IL20RA AND SDC1 | 0.909091 | 0.909091 | 0.909091 |
| DPEP1 AND TMEM123 AND NOT-COLQ | 1 | 1 | 1 | NOT-CACNG6 AND GPNMB AND NOT-CLDN8 | 1 | 1 | 1 |
| DPEP1 AND TMEM123 AND NOT-ADAM23 | 1 | 1 | 1 | NOT-GJD2 AND GPNMB AND NOT-CLDN8 | 1 | 1 | 1 |
| MUC13 AND EDNRA AND NOT-KCNIP3 | 1 | 1 | 1 | NOT-CLDN19 AND VCAM1 AND NOT-CLDN8 | 1 | 1 | 1 |
| DPEP1 AND TMEM123 AND NOT-SYT12 | 1 | 1 | 1 | GPR137B AND NOT-LGR5 AND ERBB3 | 0.952381 | 1 | 0.909091 |
| MUC13 AND EDNRA AND NOT-AOC2 | 1 | 1 | 1 | GPR137B AND NOT-CLDN8 AND AXL | 0.952381 | 1 | 0.909091 |
| HEPH AND CLDN1 AND NOT-NAALAD2 | 1 | 1 | 1 | NOT-CHRNA2 AND SDC1 AND NOT-EGFR | 0.952381 | 1 | 0.909091 |
| DPEP1 AND NOT-ZP2 AND TNFSF15 | 1 | 1 | 1 | NOT-CACNG6 AND GPNMB AND NOT-CLDN4 | 0.952381 | 1 | 0.909091 |
| MUC13 AND EDNRA AND NOT-KCNS2 | 1 | 1 | 1 | NOT-CACNG6 AND GPNMB AND NOT-VTCN1 | 0.952381 | 1 | 0.909091 |
| MUC13 AND EDNRA AND NOT-KCNK3 | 1 | 1 | 1 | NOT-CHRNA2 AND SDC1 AND NOT-FOLR1 | 0.9 | 1 | 0.818182 |
| MUC13 AND EDNRA AND NOT-KCNJ14 | 1 | 1 | 1 | COMPLEX-GPNMB/EDNRB/GRIK4 | 0.9 | 1 | 0.818182 |
| MUC13 AND EDNRA AND NOT-KCNJ4 | 1 | 1 | 1 | COMPLEX-EDNRB/GPR137B/CLDN8 | 0.9 | 1 | 0.818182 |
| MUC13 AND EDNRA AND NOT-KCNC3 | 1 | 1 | 1 | GPR137B AND NOT-CLDN8 AND TNC | 0.9 | 1 | 0.818182 |
| MUC13 AND EDNRA AND NOT-KCNA3 | 1 | 1 | 1 | COMPLEX-GPNMB/EDNRB/GPR26 | 0.9 | 1 | 0.818182 |
| DPEP1 AND NOT-ZP2 AND ATP2C2 | 1 | 1 | 1 | COMPLEX-EDNRB/SLC10A2/FCRL2 | 0.9 | 1 | 0.818182 |
| MUC13 AND EDNRA AND NOT-ITGA9 | 1 | 1 | 1 | GPR137B AND NOT-IL20RA AND ERBB2 | 0.9 | 1 | 0.818182 |
| MUC13 AND EDNRA AND NOT-ITGA2B | 1 | 1 | 1 | COMPLEX-CHRNA2/L1CAM/VCAM1 | 0.9 | 1 | 0.818182 |
| MUC13 AND EDNRA AND NOT-INSRR | 1 | 1 | 1 | COMPLEX-CHRNA2/EDNRB/MST1R | 0.9 | 1 | 0.818182 |
| MUC13 AND EDNRA AND NOT-AQP4 | 1 | 1 | 1 | COMPLEX-FCRL1/EDNRB/SLC10A2 | 0.9 | 1 | 0.818182 |
| DPEP1 AND NOT-ZP2 AND HEPH | 1 | 1 | 1 | COMPLEX-OR1Q1/EDNRB/SDC1 | 0.9 | 1 | 0.818182 |
| MUC13 AND EDNRA AND NOT-IL5RA | 1 | 1 | 1 | COMPLEX-EDNRB/STEAP2/SLC10A2 | 0.9 | 1 | 0.818182 |
| DPEP1 AND TMEM123 AND NOT-CACNA1H | 1 | 1 | 1 | COMPLEX-GPNMB/EDNRB/LRFN2 | 0.9 | 1 | 0.818182 |
| MUC13 AND EDNRA AND NOT-PAQR9 | 1 | 1 | 1 | COMPLEX-CLDN19/EDNRB/RNF43 | 0.9 | 1 | 0.818182 |
| DPEP1 AND TMEM123 AND NOT-VNN2 | 1 | 1 | 1 | NOT-CLDN19 AND GPNMB AND NOT-FOLR1 | 0.9 | 1 | 0.818182 |
| MUC13 AND EDNRA AND NOT-HTR3A | 1 | 1 | 1 | COMPLEX-EDNRB/STEAP2/CACNG6 | 0.9 | 1 | 0.818182 |
| MUC13 AND EDNRA AND NOT-APLP1 | 1 | 1 | 1 | GPR137B AND NOT-CLDN8 AND FAP | 0.9 | 1 | 0.818182 |
| DPEP1 AND NOT-ZP2 AND ACVR1 | 1 | 1 | 1 | COMPLEX-EDNRB/RNF43/GPR137B | 0.9 | 1 | 0.818182 |
| LY75 AND THY1 AND NOT-CLDN10 | 1 | 1 | 1 | COMPLEX-GPNMB/EDNRB/VN1R2 | 0.9 | 1 | 0.818182 |
| DPEP1 AND NOT-SPAM1 AND NOT-FLVCR2 | 1 | 1 | 1 | COMPLEX-GPNMB/EDNRB/OR3A1 | 0.9 | 1 | 0.818182 |
| DPEP1 AND NOT-SPAM1 AND NOT-IL17RB | 1 | 1 | 1 | NOT-CHRNA2 AND STEAP1 AND NOT-SSTR1 | 0.9 | 1 | 0.818182 |
| BIRC5 AND IFITM1 AND NOT-FUT3 | 1 | 1 | 1 | COMPLEX-GPNMB/EDNRB/CACNG6 | 0.9 | 1 | 0.818182 |
| DPEP1 AND NOT-SLC13A3 AND FXYD6 | 1 | 1 | 1 | NOT-CHRNA2 AND STEAP1 AND NOT-ERBB2 | 0.9 | 1 | 0.818182 |
| DPEP1 AND NOT-PCDHGB6 AND CDH11 | 1 | 1 | 1 | COMPLEX-CLDN19/EDNRB/FCRL2 | 0.9 | 1 | 0.818182 |
| DPEP1 AND SLC39A10 AND NOT-NMBR | 1 | 1 | 1 | COMPLEX-EDNRB/GPR137B/MUC16 | 0.9 | 1 | 0.818182 |
| TGFBI AND NOT-LPAR1 AND STEAP2 | 1 | 1 | 1 | COMPLEX-CHRNA2/EDNRB/STEAP2 | 0.9 | 1 | 0.818182 |
| DPEP1 AND NOT-SPAM1 AND NOT-GDPD2 | 1 | 1 | 1 | COMPLEX-CHRNA2/EDNRB/CLDN1 | 0.9 | 1 | 0.818182 |
| DPEP1 AND NOT-CSMD3 AND JPH1 | 1 | 1 | 1 | COMPLEX-GPNMB/EDNRB/ABCG8 | 0.9 | 1 | 0.818182 |
| DPEP1 AND NOT-NMBR AND PCDH18 | 1 | 1 | 1 | COMPLEX-EDNRB/STEAP2/NOX1 | 0.9 | 1 | 0.818182 |
| DPEP1 AND FXYD5 AND NOT-NMBR | 1 | 1 | 1 | COMPLEX-FCRL1/CLDN19/EDNRB | 0.9 | 1 | 0.818182 |
| DPEP1 AND NOT-SPAM1 AND NOT-CDHR5 | 1 | 1 | 1 | COMPLEX-CHRNA2/EDNRB/RNF43 | 0.9 | 1 | 0.818182 |
| DPEP1 AND NOT-CD1B AND NOT-SLC7A13 | 1 | 1 | 1 | EDNRB AND NOT-CHRNA2 AND IL11RA | 0.9 | 1 | 0.818182 |
| DPEP1 AND NOT-SPAM1 AND OLR1 | 1 | 1 | 1 | COMPLEX-EDNRB/SLAMF7/GPR137B | 0.9 | 1 | 0.818182 |
| DPEP1 AND NOT-MMP16 AND CD93 | 1 | 1 | 1 | COMPLEX-CHRNA2/CLDN23/EDNRB | 0.9 | 1 | 0.818182 |
| DPEP1 AND NOT-NMBR AND NINJ2 | 1 | 1 | 1 | COMPLEX-EDNRB/GPR137B/CLDN1 | 0.9 | 1 | 0.818182 |
| DPEP1 AND NOT-SPAM1 AND ABCC1 | 1 | 1 | 1 | EDNRB AND GPR137B AND IL11RA | 0.9 | 1 | 0.818182 |
| DPEP1 AND NOT-SPAM1 AND TACSTD2 | 1 | 1 | 1 | COMPLEX-EDNRB/SDC1/ABCG8 | 0.9 | 1 | 0.818182 |

FIG. 15 (cont.)

| Antigen Pair Logic | F1 | Precision | Recall | Antigen Pair Logic | F1 | Precision | Recall |
|---|---|---|---|---|---|---|---|
| DPEP1 AND NOT-SPAM1 AND OR7A10 | 1 | 1 | 1 | COMPLEX-EDNRB/SSTR5/GPR137B | 0.9 | 1 | 0.818182 |
| DPEP1 AND NOT-NMBR AND ITGA4 | 1 | 1 | 1 | COMPLEX-GPNMB/SLC22A12/EDNRB | 0.9 | 1 | 0.818182 |
| DPEP1 AND NOT-SLC13A1 AND CDH7 | 1 | 1 | 1 | COMPLEX-EDNRB/GPR137B/CLDN2 | 0.9 | 1 | 0.818182 |
| DPEP1 AND LRP8 AND NOT-NMBR | 1 | 1 | 1 | COMPLEX-CLDN23/CLDN19/EDNRB | 0.9 | 1 | 0.818182 |
| DPEP1 AND NOT-SPAM1 AND NOT-SLC2A9 | 1 | 1 | 1 | COMPLEX-CLDN19/EDNRB/STEAP2 | 0.9 | 1 | 0.818182 |
| DPEP1 AND SLC52A2 AND NOT-NMBR | 1 | 1 | 1 | COMPLEX-EDNRB/GPR137B/TPBG | 0.9 | 1 | 0.818182 |
| IFI6 AND GJB3 AND NOT-MAGEA11 | 1 | 1 | 1 | COMPLEX-EDNRB/SDC1/GPR137B | 0.9 | 1 | 0.818182 |
| DPEP1 AND NOT-SPAM1 AND NOT-SLC15A1 | 1 | 1 | 1 | COMPLEX-MLANA/SLC2A1/SSTR1 | 1 | 1 | 1 |
| DPEP1 AND NOT-SPAM1 AND NOT-SLC8A1 | 1 | 1 | 1 | COMPLEX-MLANA/SLC2A1/LGR5 | 1 | 1 | 1 |
| DPEP1 AND NOT-SPAM1 AND NOT-SLC5A1 | 1 | 1 | 1 | COMPLEX-MLANA/ABCA12/SSTR1 | 1 | 1 | 1 |
| DPEP1 AND NOT-SPAM1 AND NOT-SLC3A1 | 1 | 1 | 1 | COMPLEX-MLANA/EPCAM/SLC2A1 | 1 | 1 | 1 |
| DPEP1 AND NOT-SPAM1 AND SLC1A4 | 1 | 1 | 1 | COMPLEX-MLANA/ABCA12/EPCAM | 1 | 1 | 1 |
| DPEP1 AND NOT-SPAM1 AND NOT-SORT1 | 1 | 1 | 1 | COMPLEX-MLANA/ABCA12/LGR5 | 1 | 1 | 1 |
| DPEP1 AND NOT-GABRD AND CYBB | 1 | 1 | 1 | COMPLEX-MLANA/SLC2A1/SSTR5 | 1 | 1 | 1 |
| DPEP1 AND NOT-PCDHGB6 AND MSMO1 | 1 | 1 | 1 | COMPLEX-CLDN3/MLANA/ABCA12 | 1 | 1 | 1 |
| IFI6 AND GJB3 AND NOT-FLOT2 | 1 | 1 | 1 | COMPLEX-MLANA/ABCA12/VTCN1 | 1 | 1 | 1 |
| DPEP1 AND NOT-PCDHGB6 AND TNFRSF12A | 1 | 1 | 1 | COMPLEX-MLANA/ABCA12/ULBP3 | 1 | 1 | 1 |
| DPEP1 AND NOT-CSMD3 AND SLC1A4 | 1 | 1 | 1 | COMPLEX-EGFR/MLANA/ABCA12 | 1 | 1 | 1 |
| IFI6 AND GJB3 AND NOT-NCAM1 | 1 | 1 | 1 | COMPLEX-ERBB2/MLANA/ABCA12 | 1 | 1 | 1 |
| DPEP1 AND NOT-SPAM1 AND NOT-ABCD4 | 1 | 1 | 1 | COMPLEX-DPEP1/MLANA/ABCA12 | 1 | 1 | 1 |
| DPEP1 AND NOT-SLC13A1 AND ABCA8 | 1 | 1 | 1 | COMPLEX-MLANA/SLC2A1/CLDN1 | 1 | 1 | 1 |
| IFI6 AND GJB3 AND NOT-VTCN1 | 1 | 1 | 1 | COMPLEX-DPEP1/MLANA/SLC2A1 | 1 | 1 | 1 |
| DPEP1 AND NOT-SPAM1 AND PTPRM | 1 | 1 | 1 | COMPLEX-ERBB2/MLANA/SLC2A1 | 1 | 1 | 1 |
| IFI6 AND GJB3 AND NOT-MUC16 | 1 | 1 | 1 | COMPLEX-MLANA/SLC2A1/SSTR3 | 1 | 1 | 1 |
| DPEP1 AND NOT-SPAM1 AND NOT-PTPRF | 1 | 1 | 1 | COMPLEX-MLANA/ABCA12/SSTR5 | 1 | 1 | 1 |
| DPEP1 AND NOT-PCDHGB6 AND S1PR1 | 1 | 1 | 1 | COMPLEX-CLDN3/MLANA/SLC2A1 | 1 | 1 | 1 |
| DPEP1 AND NOT-SPAM1 AND JPH1 | 1 | 1 | 1 | COMPLEX-MLANA/ABCA12/CLDN1 | 1 | 1 | 1 |
| DPEP1 AND NOT-SPAM1 AND KCNMA1 | 1 | 1 | 1 | COMPLEX-MLANA/ABCA12/SSTR3 | 1 | 1 | 1 |
| LY75 AND THY1 AND NOT-CALN1 | 1 | 1 | 1 | COMPLEX-DNAJB8/MLANA/ABCA12 | 1 | 1 | 1 |
| DPEP1 AND PLP2 AND NOT-CDH22 | 1 | 1 | 1 | COMPLEX-DNAJB8/MLANA/SLC2A1 | 1 | 1 | 1 |
| DPEP1 AND NOT-CDH7 AND CD44 | 1 | 1 | 1 | COMPLEX-MLANA/ABCA12/ULBP1 | 1 | 1 | 1 |
| DPEP1 AND NOT-SPAM1 AND NOT-AQP11 | 1 | 1 | 1 | COMPLEX-MLANA/SLC2A1/ULBP3 | 1 | 1 | 1 |
| LY75 AND THY1 AND NOT-SLC12A5 | 1 | 1 | 1 | COMPLEX-MLANA/SLC2A1/VTCN1 | 1 | 1 | 1 |
| DPEP1 AND NOT-CLDN20 AND KCNE3 | 1 | 1 | 1 | COMPLEX-MLANA/SLC2A1/ULBP1 | 1 | 1 | 1 |
| DPEP1 AND NOX1 AND NOT-SIGLEC9 | 1 | 1 | 1 | COMPLEX-EGFR/MLANA/SLC2A1 | 1 | 1 | 1 |
| DPEP1 AND NOT-EPHA10 AND SLC22A3 | 1 | 1 | 1 | COMPLEX-MLANA/SLC2A1/CLDN8 | 1 | 1 | 1 |
| DPEP1 AND NOT-KCNA10 AND KCNE3 | 1 | 1 | 1 | MLANA AND GPR137B AND IL11RA | 1 | 1 | 1 |
| DPEP1 AND NOT-TAS2R39 AND CEACAM7 | 1 | 1 | 1 | MLANA AND NOT-CLDN1 AND GPR137B | 1 | 1 | 1 |
| DPEP1 AND KCNE3 AND NOT-GRIN2C | 1 | 1 | 1 | MLANA AND GPR137B AND NOT-ERBB2 | 1 | 1 | 1 |
| DPEP1 AND NOT-SPAM1 AND MYOF | 1 | 1 | 1 | MLANA AND NOT-CHRNA2 AND IL11RA | 1 | 1 | 1 |
| COMPLEX-DPEP1/SERINC5/SPAM1 | 1 | 1 | 1 | COMPLEX-CLDN7/MLANA/ABCA12 | 1 | 1 | 1 |
| DPEP1 AND KCNE3 AND NOT-GPR12 | 1 | 1 | 1 | COMPLEX-MLANA/STEAP2/NOX1 | 1 | 1 | 1 |
| DPEP1 AND NOT-SPAM1 AND NOT-TSPAN12 | 1 | 1 | 1 | COMPLEX-TNFRSF13C/MLANA/ABCA12 | 1 | 1 | 1 |
| DPEP1 AND KCNE3 AND NOT-OR10J1 | 1 | 1 | 1 | MLANA AND NOT-CHRNA2 AND NOT-CLDN1 | 1 | 1 | 1 |
| DPEP1 AND NOX1 AND NOT-TAS2R39 | 1 | 1 | 1 | COMPLEX-MLANA/PTGER4/TPBG | 1 | 1 | 1 |
| DPEP1 AND NOT-SPAM1 AND ABCA1 | 1 | 1 | 1 | COMPLEX-TNFRSF13C/MLANA/SLC2A1 | 1 | 1 | 1 |
| IFI6 AND CLDN3 AND NOT-IL18RAP | 1 | 1 | 1 | COMPLEX-MLANA/ABCA12/CLDN8 | 1 | 1 | 1 |
| DPEP1 AND NOT-SPAM1 AND NOT-DSC2 | 1 | 1 | 1 | MLANA AND NOT-CHRNA2 AND NOT-ERBB2 | 1 | 1 | 1 |
| DPEP1 AND NOT-DSC1 AND KCNE3 | 1 | 1 | 1 | COMPLEX-MLANA/OR10J1/ULBP1 | 1 | 1 | 1 |
| DPEP1 AND NOT-ABCG5 AND SLC22A3 | 1 | 1 | 1 | COMPLEX-SLC34A2/MLANA/SLC2A1 | 1 | 1 | 1 |
| DPEP1 AND NOT-SLC2A2 AND SLC22A3 | 1 | 1 | 1 | COMPLEX-SLC34A2/MLANA/ABCA12 | 1 | 1 | 1 |
| DPEP1 AND NOT-OR1C1 AND NOT-SIGLEC9 | 1 | 1 | 1 | COMPLEX-CLDN7/MLANA/SLC2A1 | 1 | 1 | 1 |
| DPEP1 AND KCNE3 AND NOT-SLC30A10 | 1 | 1 | 1 | COMPLEX-MLANA/SLC2A1/SST | 1 | 1 | 1 |
| DPEP1 AND KCNE3 AND NOT-CD36 | 1 | 1 | 1 | COMPLEX-MLANA/ABCA12/ENPP3 | 0.952381 | 1 | 0.909091 |
| LY75 AND THY1 AND NOT-STEAP4 | 1 | 1 | 1 | COMPLEX-MLANA/ABCA12/CD34 | 0.952381 | 1 | 0.909091 |
| DPEP1 AND MMD AND NOT-NMBR | 1 | 1 | 1 | COMPLEX-MLANA/ENPP3/SLC2A1 | 0.952381 | 1 | 0.909091 |
| DPEP1 AND NOT-SPAM1 AND NOT-AQP7 | 1 | 1 | 1 | COMPLEX-CLDN19/PMEL/VCAM1 | 0.952381 | 1 | 0.909091 |
| IFI6 AND BIRC5 AND NOT-CLEC1A | 1 | 1 | 1 | COMPLEX-MLANA/SLC2A1/CD34 | 0.952381 | 1 | 0.909091 |
| IFI6 AND MUC13 AND NOT-CLEC1A | 1 | 1 | 1 | COMPLEX-MLANA/LCT/TPBG | 0.952381 | 1 | 0.909091 |
| DPEP1 AND NOT-SIGLEC9 AND CEACAM7 | 1 | 1 | 1 | COMPLEX-GPA33/MLANA/ABCA12 | 0.952381 | 1 | 0.909091 |
| DPEP1 AND NOT-ATP1B2 AND NOT-CSMD3 | 1 | 1 | 1 | COMPLEX-MLANA/ABCA12/CEACAM6 | 0.952381 | 1 | 0.909091 |
| IFI6 AND GPA33 AND NOT-FCER2 | 1 | 1 | 1 | COMPLEX-GPA33/MLANA/SLC2A1 | 0.952381 | 1 | 0.909091 |
| DPEP1 AND NOT-GABBR2 AND KCNE3 | 1 | 1 | 1 | COMPLEX-MLANA/SLC2A1/CLDN5 | 0.952381 | 1 | 0.909091 |
| BIRC5 AND IFITM1 AND NOT-SLC13A2 | 1 | 1 | 1 | COMPLEX-MLANA/ABCA12/CLDN5 | 0.952381 | 1 | 0.909091 |
| DPEP1 AND NOT-GRM2 AND NOT-SPAM1 | 1 | 1 | 1 | COMPLEX-MLANA/MOK/SLC2A1 | 1 | 1 | 1 |
| IFI6 AND EPHB2 AND NOT-FCER2 | 1 | 1 | 1 | COMPLEX-MLANA/ABCA12/MOK | 1 | 1 | 1 |
| DPEP1 AND KCNE3 AND NOT-FCAMR | 1 | 1 | 1 | COMPLEX-MLANA/TRPM4/SLC2A1 | 0.952381 | 1 | 0.909091 |
| DPEP1 AND NOT-OR2C3 AND KCNE3 | 1 | 1 | 1 | COMPLEX-MLANA/BIRC5/SLC2A1 | 0.952381 | 1 | 0.909091 |
| DPEP1 AND KCNE3 AND NOT-TRPM3 | 1 | 1 | 1 | COMPLEX-MLANA/ABCA12/IL11RA | 1 | 1 | 1 |
| DPEP1 AND NOT-SPAM1 AND NOT-APLP2 | 1 | 1 | 1 | COMPLEX-ENG/MLANA/SLC2A1 | 1 | 1 | 1 |
| DPEP1 AND NOT-SIGLEC9 AND CD93 | 1 | 1 | 1 | COMPLEX-ENG/MLANA/ABCA12 | 1 | 1 | 1 |
| DPEP1 AND NOT-SPAM1 AND NOT-HMOX1 | 1 | 1 | 1 | COMPLEX-MLANA/IL11RA/SLC2A1 | 1 | 1 | 1 |
| LY75 AND THY1 AND NOT-SLC1A6 | 1 | 1 | 1 | COMPLEX-RAET1E/MLANA/SLC2A1 | 0.952381 | 1 | 0.909091 |
| DPEP1 AND NOT-SPAM1 AND NOT-TRHDE | 1 | 1 | 1 | COMPLEX-MLANA/SLC2A1/SSTR4 | 1 | 1 | 1 |
| DPEP1 AND NOT-SPAM1 AND TGFBR3 | 1 | 1 | 1 | COMPLEX-MLANA/ABCA12/TRPM4 | 0.952381 | 1 | 0.909091 |
| IFI6 AND SLC26A3 AND NOT-TNFRSF13C | 1 | 1 | 1 | COMPLEX-MLANA/ABCA12/BIRC5 | 0.952381 | 1 | 0.909091 |
| DPEP1 AND NOT-SPAM1 AND TRPC1 | 1 | 1 | 1 | COMPLEX-RAET1E/MLANA/ABCA12 | 0.952381 | 1 | 0.909091 |

FIG. 15 (cont.)

| Antigen Pair Logic | F1 | Precision | Recall | Antigen Pair Logic | F1 | Precision | Recall |
|---|---|---|---|---|---|---|---|
| DPEP1 AND NOT-P2RX6 AND NOT-LCT | 1 | 1 | 1 | COMPLEX-MLANA/ABCA12/SSTR4 | 1 | 1 | 1 |
| DPEP1 AND NOT-GPC3 AND NOT-DISP1 | 1 | 1 | 1 | COMPLEX-CLDN19/MLANA/STEAP2 | 1 | 1 | 1 |
| DPEP1 AND NOT-GPC3 AND NOT-ADRA1B | 1 | 1 | 1 | COMPLEX-MLANA/GPR137B/CLDN2 | 1 | 1 | 1 |
| DPEP1 AND NOT-GPC3 AND NOT-SLC5A1 | 1 | 1 | 1 | COMPLEX-MLANA/STEAP2/ABCG8 | 1 | 1 | 1 |
| DPEP1 AND NOT-GPC3 AND NOT-UNC5D | 1 | 1 | 1 | COMPLEX-ERBB3/MLANA/GPR137B | 1 | 1 | 1 |
| DPEP1 AND NOT-GPC3 AND NOT-SLC34A3 | 1 | 1 | 1 | COMPLEX-MLANA/SSTR4/GPR137B | 1 | 1 | 1 |
| DPEP1 AND NOT-SLC5A12 AND NOT-GPC3 | 1 | 1 | 1 | COMPLEX-MLANA/ABCA12/ANXA1 | 1 | 1 | 1 |
| DPEP1 AND NOT-GPC3 AND NOT-TMEM25 | 1 | 1 | 1 | COMPLEX-MLANA/SLC2A1/CLDN9 | 1 | 1 | 1 |
| DPEP1 AND NOT-TRHDE AND NOT-GPC3 | 1 | 1 | 1 | COMPLEX-MLANA/GPR137B/CLDN9 | 1 | 1 | 1 |
| DPEP1 AND NOT-GPC3 AND NOT-SLC51A | 1 | 1 | 1 | COMPLEX-MLANA/STEAP2/CACNG6 | 1 | 1 | 1 |
| DPEP1 AND NOT-GPC3 AND NOT-ENPEP | 1 | 1 | 1 | COMPLEX-AFP/MLANA/SLC2A1 | 0.952381 | 1 | 0.909091 |
| GUCY2C AND NOT-ABHD6 AND NOT-GPC3 | 1 | 1 | 1 | COMPLEX-MLANA/ABCA12/CLDN6 | 1 | 1 | 1 |
| SLC26A3 AND THY1 AND NOT-GPC3 | 1 | 1 | 1 | COMPLEX-MLANA/ABCA12/CLDN9 | 1 | 1 | 1 |
| DPEP1 AND NOT-GPC3 AND EPHB4 | 1 | 1 | 1 | COMPLEX-MLANA/ABCA12/GUCY2C | 0.952381 | 1 | 0.909091 |
| DPEP1 AND NOT-GPC3 AND FGFR1 | 1 | 1 | 1 | COMPLEX-AFP/MLANA/ABCA12 | 0.952381 | 1 | 0.909091 |
| DPEP1 AND NOT-GPC3 AND GJB3 | 1 | 1 | 1 | COMPLEX-FCRL1/MLANA/GJD2 | 1 | 1 | 1 |
| DPEP1 AND NOT-KCNG2 AND NOT-GPC3 | 1 | 1 | 1 | COMPLEX-MLANA/ABCA12/MST1R | 1 | 1 | 1 |
| JPH1 AND CLDN1 AND NOT-GPC3 | 1 | 1 | 1 | COMPLEX-MLANA/ABCA12/CLDN2 | 1 | 1 | 1 |
| MUC13 AND SLC39A10 AND NOT-MUC1 | 1 | 1 | 1 | COMPLEX-CLDN19/MLANA/RNF43 | 1 | 1 | 1 |
| DPEP1 AND NOT-GPC3 AND ITGA4 | 1 | 1 | 1 | COMPLEX-MLANA/MST1R/SLC2A1 | 1 | 1 | 1 |
| DPEP1 AND NOT-GPC3 AND PCDH17 | 1 | 1 | 1 | COMPLEX-MLANA/ANXA1/SLC2A1 | 1 | 1 | 1 |
| MUC13 AND CDH3 AND NOT-MUC1 | 1 | 1 | 1 | COMPLEX-MLANA/SLC2A1/CLDN6 | 1 | 1 | 1 |
| DPEP1 AND NOT-GPC3 AND KCNE3 | 1 | 1 | 1 | COMPLEX-STEAP1/PMEL/RNF144A | 1 | 1 | 1 |
| DPEP1 AND NOT-GPC3 AND CDH5 | 1 | 1 | 1 | COMPLEX-MLANA/FREM2/EPCAM | 1 | 1 | 1 |
| DPEP1 AND NOT-GPC3 AND NOT-SLC1A | 1 | 1 | 1 | COMPLEX-LDLRAD3/ANXA1/PMEL | 1 | 1 | 1 |
| DPEP1 AND NOT-GPC3 AND NOT-EMB | 1 | 1 | 1 | COMPLEX-LDLRAD3/MUC4/PMEL | 1 | 1 | 1 |
| DPEP1 AND NOT-GPC3 AND NOT-SLC51B | 1 | 1 | 1 | COMPLEX-LDLRAD3/RNF43/PMEL | 1 | 1 | 1 |
| DPEP1 AND NOT-GPC3 AND CALCRL | 1 | 1 | 1 | COMPLEX-LDLRAD3/PMEL/BMPR1B | 1 | 1 | 1 |
| DPEP1 AND NOT-GPC3 AND PLP2 | 1 | 1 | 1 | COMPLEX-BIRC5/PMEL/RNF144A | 1 | 1 | 1 |
| DPEP1 AND NOT-GPC3 AND MMD | 1 | 1 | 1 | COMPLEX-FAP/PMEL/RNF144A | 1 | 1 | 1 |
| DPEP1 AND NOT-GPC3 AND FXYD5 | 1 | 1 | 1 | COMPLEX-CLDN4/LDLRAD3/PMEL | 1 | 1 | 1 |
| DPEP1 AND NOT-GPC3 AND KCNJ2 | 1 | 1 | 1 | COMPLEX-LDLRAD3/EPHA3/PMEL | 1 | 1 | 1 |
| KCNE3 AND THY1 AND NOT-GPC3 | 1 | 1 | 1 | COMPLEX-LDLRAD3/MUC1/PMEL | 1 | 1 | 1 |
| DPEP1 AND NOT-GPC3 AND PIGU | 1 | 1 | 1 | COMPLEX-LDLRAD3/PMEL/CD33 | 1 | 1 | 1 |
| MUC13 AND SLC39A10 AND NOT-MSLN | 1 | 1 | 1 | COMPLEX-LDLRAD3/PMEL/CD38 | 1 | 1 | 1 |
| DPEP1 AND NOT-GPC3 AND CDH3 | 1 | 1 | 1 | COMPLEX-CLDN3/LDLRAD3/PMEL | 1 | 1 | 1 |
| MEP1A AND THY1 AND NOT-ERBB2 | 1 | 1 | 1 | COMPLEX-MOK/PMEL/NIPA2 | 1 | 1 | 1 |
| XK AND CLDN1 AND NOT-GPC3 | 1 | 1 | 1 | COMPLEX-LDLRAD3/IL13RA1/PMEL | 1 | 1 | 1 |
| GUCY2C AND EDNRA AND NOT-GPC3 | 1 | 1 | 1 | COMPLEX-MLANA/FREM2/LGR5 | 1 | 1 | 1 |
| MEP1A AND THY1 AND NOT-GPC3 | 1 | 1 | 1 | COMPLEX-GPA33/LDLRAD3/PMEL | 1 | 1 | 1 |
| DPEP1 AND NOT-GPC3 AND NOT-SLC22A24 | 1 | 1 | 1 | COMPLEX-HHLA2/LDLRAD3/PMEL | 1 | 1 | 1 |
| DPEP1 AND NOT-GPC3 AND NOT-SCAMP5 | 1 | 1 | 1 | COMPLEX-LDLRAD3/TRPM4/PMEL | 1 | 1 | 1 |
| DPEP1 AND NOT-GPC3 AND CFTR | 1 | 1 | 1 | COMPLEX-MLANA/FREM2/SSTR1 | 1 | 1 | 1 |
| GUCY2C AND NOT-CEACAM1 AND NOT-GPC3 | 1 | 1 | 1 | COMPLEX-L1CAM/PMEL/RNF144A | 1 | 1 | 1 |
| DPEP1 AND NOT-GPC3 AND LRP8 | 1 | 1 | 1 | COMPLEX-FCRL1/PMEL/RNF144A | 1 | 1 | 1 |
| DPEP1 AND NOT-GPC3 AND CKAP4 | 1 | 1 | 1 | COMPLEX-LDLRAD3/GUCY2C/PMEL | 1 | 1 | 1 |
| DPEP1 AND NOT-GPC3 AND ADCY7 | 1 | 1 | 1 | COMPLEX-HTRA2/TNC/PMEL | 1 | 1 | 1 |
| DPEP1 AND NOT-ADRA1B AND ERBB2 | 1 | 1 | 1 | COMPLEX-HTRA2/PMEL/LGR5 | 1 | 1 | 1 |
| DPEP1 AND NOT-GPC3 AND KCNE3 | 1 | 1 | 1 | COMPLEX-HTRA2/PMEL/VTCN1 | 1 | 1 | 1 |
| DPEP1 AND NOT-GPC3 AND NOT-ABCC2 | 1 | 1 | 1 | COMPLEX-HTRA2/PMEL/SSTR1 | 1 | 1 | 1 |
| MEP1A AND CLDN1 AND NOT-ERBB2 | 1 | 1 | 1 | COMPLEX-HTRA2/PMEL/CD34 | 1 | 1 | 1 |
| DPEP1 AND NOT-GPC3 AND KCNN4 | 1 | 1 | 1 | COMPLEX-HTRA2/PMEL/CLDN1 | 1 | 1 | 1 |
| DPEP1 AND NOT-GPC3 AND CDH3 | 1 | 1 | 1 | COMPLEX-ERBB2/HTRA2/PMEL | 1 | 1 | 1 |
| GUCY2C AND SLC39A10 AND NOT-GPC3 | 1 | 1 | 1 | COMPLEX-CLDN7/HTRA2/PMEL | 1 | 1 | 1 |
| DPEP1 AND NOT-GPC3 AND NOT-PMP22 | 1 | 1 | 1 | COMPLEX-HTRA2/EPCAM/PMEL | 1 | 1 | 1 |
| DPEP1 AND NOT-GPC3 AND APCDD1 | 1 | 1 | 1 | COMPLEX-HTRA2/ENPP3/PMEL | 1 | 1 | 1 |
| ATP10B AND THY1 AND NOT-GPC3 | 1 | 1 | 1 | COMPLEX-ERBB2/MLANA/FREM2 | 1 | 1 | 1 |
| MEP1A AND THY1 AND NOT-MUC1 | 1 | 1 | 1 | COMPLEX-MLANA/FREM2/ULBP1 | 1 | 1 | 1 |
| DPEP1 AND NOT-GPC3 AND ADORA2B | 1 | 1 | 1 | COMPLEX-MLANA/FREM2/SSTR3 | 1 | 1 | 1 |
| DPEP1 AND NOT-GPC3 AND CKAP4 | 1 | 1 | 1 | COMPLEX-DPEP1/MLANA/FREM2 | 1 | 1 | 1 |
| DPEP1 AND NOT-GPC3 AND NOT-PRLR | 1 | 1 | 1 | COMPLEX-MLANA/FREM2/SSTR5 | 1 | 1 | 1 |
| DPEP1 AND NOT-GPC3 AND NOT-ADAM10 | 1 | 1 | 1 | COMPLEX-MLANA/FREM2/ULBP3 | 1 | 1 | 1 |
| DPEP1 AND NOT-GPC3 AND SEMA4C | 1 | 1 | 1 | COMPLEX-MLANA/FREM2/VTCN1 | 1 | 1 | 1 |
| MUC13 AND NOT-FLVCR2 AND NOT-MUC1 | 1 | 1 | 1 | COMPLEX-EGFR/MLANA/FREM2 | 1 | 1 | 1 |
| DPEP1 AND NOT-GPC3 AND NOT-SLC52A1 | 1 | 1 | 1 | COMPLEX-MLANA/FREM2/CLDN1 | 1 | 1 | 1 |
| DPEP1 AND NOT-GPC3 AND EDAR | 1 | 1 | 1 | COMPLEX-CLDN3/MLANA/FREM2 | 1 | 1 | 1 |
| DPEP1 AND TMEM123 AND NOT-GPC3 | 1 | 1 | 1 | COMPLEX-DNAJB8/MLANA/FREM2 | 1 | 1 | 1 |
| GPA33 AND SLC39A10 AND NOT-GPC3 | 1 | 1 | 1 | COMPLEX-CLDN4/PMEL/NIPA2 | 1 | 1 | 1 |
| GUCY2C AND NOT-FLVCR2 AND NOT-MUC1 | 1 | 1 | 1 | COMPLEX-CEACAM5/PMEL/NIPA2 | 1 | 1 | 1 |
| DPEP1 AND NOT-GPC3 AND NOT-NAALADL1 | 1 | 1 | 1 | COMPLEX-FOLR1/PMEL/MARVELD1 | 1 | 1 | 1 |
| DPEP1 AND NOT-GPC3 AND TSPAN2 | 1 | 1 | 1 | COMPLEX-EGFR/PMEL/NIPA2 | 1 | 1 | 1 |
| GPA33 AND SLC39A10 AND NOT-MUC1 | 1 | 1 | 1 | COMPLEX-SLC34A2/MLANA/FREM2 | 1 | 1 | 1 |
| DPEP1 AND NOT-GPC3 AND NOT-ATP6V0A1 | 1 | 1 | 1 | COMPLEX-CD160/PMEL/NIPA2 | 1 | 1 | 1 |
| DPEP1 AND NOT-GPC3 AND NOT-ABCB1 | 1 | 1 | 1 | COMPLEX-HHLA2/PMEL/NIPA2 | 1 | 1 | 1 |
| DPEP1 AND NOT-GPC3 AND NOT-SLC46A1 | 1 | 1 | 1 | COMPLEX-AFP/PMEL/NIPA2 | 1 | 1 | 1 |
| DPEP1 AND NOT-GPC3 AND NOT-AQP1 | 1 | 1 | 1 | COMPLEX-CDH3/MLANA/SSTR1 | 1 | 1 | 1 |
| DPEP1 AND NOT-GPC3 AND PLXNC1 | 1 | 1 | 1 | COMPLEX-DDX3X/PMEL/NIPA2 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| DPEP1 AND NOT-GPC3 AND NOT-SLC27A4 | 1 | 1 | 1 | COMPLEX-MLANA/SLC27A1/EPCAM | 1 | 1 | 1 |
| DPEP1 AND NOT-GPC3 AND NOT-AQP3 | 1 | 1 | 1 | COMPLEX-RAET1E/PMEL/NIPA2 | 1 | 1 | 1 |
| DPEP1 AND NOT-GPC3 AND NOT-KCNG1 | 1 | 1 | 1 | COMPLEX-MSLN/PMEL/NIPA2 | 1 | 1 | 1 |
| DPEP1 AND NOT-KCNJ13 AND NOT-GPC3 | 1 | 1 | 1 | COMPLEX-CLDN7/PMEL/NIPA2 | 1 | 1 | 1 |
| DPEP1 AND NOT-GPC3 AND NOT-PTPRH | 1 | 1 | 1 | COMPLEX-GPA33/PMEL/NIPA2 | 1 | 1 | 1 |
| TSPAN8 AND THY1 AND NOT-GPC3 | 1 | 1 | 1 | COMPLEX-SLC34A2/PMEL/NIPA2 | 1 | 1 | 1 |
| DPEP1 AND NOT-GPC3 AND PCDH7 | 1 | 1 | 1 | COMPLEX-CD52/PMEL/NIPA2 | 1 | 1 | 1 |
| NOT-LIFR AND THY1 AND MUC1 | 1 | 1 | 1 | COMPLEX-MLANA/LGR5/NRP1 | 1 | 1 | 1 |
| DPEP1 AND NOT-GPC3 AND NOT-KLRB1 | 1 | 1 | 1 | COMPLEX-ANXA1/PMEL/MARVELD1 | 1 | 1 | 1 |
| DPEP1 AND NOT-GPC3 AND NOT-SLC2A13 | 1 | 1 | 1 | COMPLEX-CNIH3/MLANA/LGR5 | 1 | 1 | 1 |
| DPEP1 AND NOT-ATP6V0A1 AND ERBB2 | 1 | 1 | 1 | COMPLEX-L1CAM/PMEL/MARVELD1 | 1 | 1 | 1 |
| MUC13 AND EDNRA AND NOT-GPC3 | 1 | 1 | 1 | COMPLEX-CEACAM6/PMEL/MARVELD1 | 1 | 1 | 1 |
| DPEP1 AND NOT-GPC3 AND NOT-ATP6V0A1 | 1 | 1 | 1 | COMPLEX-MLANA/SSTR1/NRP1 | 1 | 1 | 1 |
| JPH1 AND CLDN1 AND NOT-GPC3 | 1 | 1 | 1 | COMPLEX-PMEL/MARVELD1/CLDN8 | 1 | 1 | 1 |
| DPEP1 AND NOT-GPC3 AND PDPN | 1 | 1 | 1 | COMPLEX-CNIH3/MLANA/SSTR1 | 1 | 1 | 1 |
| GUCY2C AND CDH3 AND NOT-MUC1 | 1 | 1 | 1 | COMPLEX-FOLR1/HTRA2/PMEL | 1 | 1 | 1 |
| DPEP1 AND NOT-GPC3 AND NOT-SLC19A3 | 1 | 1 | 1 | COMPLEX-HTRA2/IL11RA/PMEL | 1 | 1 | 1 |
| DPEP1 AND NOT-GPC3 AND JPH1 | 1 | 1 | 1 | COMPLEX-HTRA2/L1CAM/PMEL | 1 | 1 | 1 |
| MEP1A AND SLC7A5 AND NOT-MUC1 | 1 | 1 | 1 | COMPLEX-HTRA2/CEACAM6/PMEL | 1 | 1 | 1 |
| DPEP1 AND NOT-GPC3 AND NOT-CD7 | 1 | 1 | 1 | COMPLEX-MLANA/SLC20A2/LGR5 | 1 | 1 | 1 |
| BIRC5 AND EPCAM AND NOT-SLC41A2 | 1 | 1 | 1 | COMPLEX-HTRA2/PMEL/BMPR1B | 1 | 1 | 1 |
| BIRC5 AND NOT-MUC15 AND CLDN1 | 1 | 1 | 1 | COMPLEX-HTRA2/PMEL/SST | 1 | 1 | 1 |
| GUCY2C AND SLC7A5 AND NOT-AMN | 1 | 1 | 1 | COMPLEX-HTRA2/PMEL/TYR | 1 | 1 | 1 |
| MUC13 AND SLC7A5 AND NOT-KCNG3 | 1 | 1 | 1 | COMPLEX-MLANA/MACF1/SSTR1 | 1 | 1 | 1 |
| GUCY2C AND SLC7A5 AND NOT-PDCD1LG2 | 1 | 1 | 1 | COMPLEX-HSPA5/PMEL/MARVELD1 | 1 | 1 | 1 |
| GUCY2C AND SLC7A5 AND NOT-ATP8B4 | 1 | 1 | 1 | COMPLEX-MLANA/PMEL/MARVELD1 | 1 | 1 | 1 |
| GUCY2C AND SLC7A5 AND NOT-CATSPERB | 1 | 1 | 1 | COMPLEX-MAGEA1/PMEL/NIPA2 | 1 | 1 | 1 |
| GUCY2C AND SLC7A5 AND NOT-SLC30A2 | 1 | 1 | 1 | COMPLEX-B4GALNT1/PMEL/NIPA2 | 1 | 1 | 1 |
| GUCY2C AND SLC7A5 AND NOT-UPK1B | 1 | 1 | 1 | COMPLEX-KDR/PMEL/NIPA2 | 1 | 1 | 1 |
| GPA33 AND SLC7A5 AND NOT-C1QTNF1 | 1 | 1 | 1 | COMPLEX-CDH3/MLANA/PMEL | 1 | 1 | 1 |
| GUCY2C AND SLC7A5 AND NOT-TMPRSS2 | 1 | 1 | 1 | COMPLEX-MLANA/FREM2/PMEL | 0.952381 | 1 | 0.909091 |
| MUC13 AND CLDN1 AND LY75 | 1 | 1 | 1 | COMPLEX-CNIH3/MLANA/PMEL | 0.952381 | 1 | 0.909091 |
| GUCY2C AND THY1 AND NOT-KCNG3 | 1 | 1 | 1 | MLANA AND NOT-SLC5A5 AND KDR | 1 | 1 | 1 |
| DPEP1 AND NOT-EVC AND TNC | 1 | 1 | 1 | MLANA AND NOT-OR2S2 AND KDR | 1 | 1 | 1 |
| DPEP1 AND IFITM1 AND LGR5 | 1 | 1 | 1 | MLANA AND NOT-CD300LB AND KDR | 1 | 1 | 1 |
| GUCY2C AND SLC7A5 AND NOT-VAMP2 | 1 | 1 | 1 | COMPLEX-MLANA/PMEL/NRP1 | 0.952381 | 1 | 0.909091 |
| DPEP1 AND SLC7A5 AND NOT-KCNE1 | 1 | 1 | 1 | MLANA AND NOT-IHH AND KDR | 1 | 1 | 1 |
| GUCY2C AND SLC7A5 AND NOT-SLCO5A1 | 1 | 1 | 1 | COMPLEX-MLANA/CLEC1A/PMEL | 0.952381 | 1 | 0.909091 |
| GUCY2C AND SLC7A5 AND NOT-COLQ | 1 | 1 | 1 | MLANA AND NOT-SLC34A3 AND KDR | 1 | 1 | 1 |
| GUCY2C AND SLC7A5 AND NOT-CD99L2 | 1 | 1 | 1 | COMPLEX-MLANA/SLC27A1/PMEL | 0.952381 | 1 | 0.909091 |
| GUCY2C AND SLC7A5 AND NOT-OR1G1 | 1 | 1 | 1 | COMPLEX-MLANA/SLCO4A1/PMEL | 0.952381 | 1 | 0.909091 |
| GUCY2C AND SLC7A5 AND NOT-CACNA1H | 1 | 1 | 1 | COMPLEX-MLANA/MACF1/PMEL | 0.952381 | 1 | 0.909091 |
| GUCY2C AND SLC7A5 AND NOT-VNN2 | 1 | 1 | 1 | COMPLEX-MLANA/PMEL/SLC20A2 | 0.952381 | 1 | 0.909091 |
| GUCY2C AND SLC7A5 AND NOT-IL18RAP | 1 | 1 | 1 | MLANA AND NOT-TM4SF5 AND KDR | 1 | 1 | 1 |
| DPEP1 AND NOT-MAGEA1 AND SLC52A2 | 1 | 1 | 1 | MLANA AND NOT-GIPR AND KDR | 1 | 1 | 1 |
| GUCY2C AND SLC7A5 AND NOT-ADAM23 | 1 | 1 | 1 | COMPLEX-MLANA/KCNN4/PMEL | 0.952381 | 1 | 0.909091 |
| DPEP1 AND NOT-CLDN18 AND SLC52A2 | 1 | 1 | 1 | COMPLEX-MLANA/MACF1/B4GALNT1 | 1 | 1 | 1 |
| GUCY2C AND SLC7A5 AND NOT-TNFRSF25 | 1 | 1 | 1 | COMPLEX-MLANA/B4GALNT1/SLCO4A1 | 1 | 1 | 1 |
| GUCY2C AND SLC7A5 AND NOT-UNC5C | 1 | 1 | 1 | COMPLEX-MLANA/B4GALNT1/SLC20A2 | 1 | 1 | 1 |
| GUCY2C AND SLC7A5 AND NOT-CAV3 | 1 | 1 | 1 | COMPLEX-MLANA/B4GALNT1/PLXDC1 | 0.956522 | 0.916667 | 1 |
| GUCY2C AND SLC7A5 AND NOT-ABCC11 | 1 | 1 | 1 | COMPLEX-MLANA/PLXDC1/PMEL | 0.909091 | 0.909091 | 0.909091 |
| GUCY2C AND SLC7A5 AND NOT-ITGA8 | 1 | 1 | 1 | COMPLEX-MLANA/GLG1/KDR | 0.9 | 1 | 0.818182 |
| GUCY2C AND SLC7A5 AND NOT-RELT | 1 | 1 | 1 | COMPLEX-MLANA/KCNN4/KDR | 0.9 | 1 | 0.818182 |
| GUCY2C AND SLC7A5 AND NOT-GALR3 | 1 | 1 | 1 | COMPLEX-MLANA/SLCO4A1/KDR | 0.9 | 1 | 0.818182 |
| GUCY2C AND SLC7A5 AND NOT-COL25A1 | 1 | 1 | 1 | COMPLEX-MLANA/MACF1/KDR | 0.9 | 1 | 0.818182 |
| GUCY2C AND SLC7A5 AND NOT-LRRC8C | 1 | 1 | 1 | COMPLEX-CNIH3/MLANA/KDR | 0.9 | 1 | 0.818182 |
| DPEP1 AND TMED1 AND NOT-IL11RA | 1 | 1 | 1 | COMPLEX-MLANA/KDR/SLC20A2 | 0.9 | 1 | 0.818182 |
| DPEP1 AND SLC7A5 AND NOT-TEK | 1 | 1 | 1 | COMPLEX-CDH3/MLANA/KDR | 0.9 | 1 | 0.818182 |
| DPEP1 AND NOT-SLC26A7 AND TNC | 1 | 1 | 1 | COMPLEX-MLANA/FREM2/KDR | 0.9 | 1 | 0.818182 |
| DPEP1 AND NOT-IL12RB2 AND PTK7 | 1 | 1 | 1 | COMPLEX-MLANA/B4GALNT1/APLP2 | 0.88 | 0.785714 | 1 |
| DPEP1 AND NOT-CD79B AND CLEC2B | 1 | 1 | 1 | COMPLEX-MLANA/KDR/PLXDC1 | 0.857143 | 0.9 | 0.818182 |
| GUCY2C AND SLC7A5 AND NOT-SCTR | 1 | 1 | 1 | COMPLEX-MLANA/APLP2/PMEL | 0.833333 | 0.769231 | 0.909091 |
| GUCY2C AND SLC7A5 AND NOT-SCN4B | 1 | 1 | 1 | NOT-OR2S2 AND KDR AND NOT-B4GALNT1 | 0.842105 | 1 | 0.727273 |
| DPEP1 AND SLC7A5 AND NOT-LIFR | 1 | 1 | 1 | NOT-GIPR AND KDR AND NOT-B4GALNT1 | 0.842105 | 1 | 0.727273 |
| GUCY2C AND SLC7A5 AND NOT-SLC5A7 | 1 | 1 | 1 | MLANA AND NOT-NOX1 AND KDR | 1 | 1 | 1 |
| DPEP1 AND IFITM1 AND NOT-CD79B | 1 | 1 | 1 | MLANA AND NOT-GJD2 AND KDR | 1 | 1 | 1 |
| DPEP1 AND NOT-CD79B AND RYK | 1 | 1 | 1 | MLANA AND NOT-CACNG6 AND KDR | 1 | 1 | 1 |
| MUC13 AND THY1 AND NOT-IL1R2 | 1 | 1 | 1 | COMPLEX-MLANA/ABCA12/PMEL | 0.952381 | 1 | 0.909091 |
| DPEP1 AND NOT-SLC6A9 AND TNC | 1 | 1 | 1 | COMPLEX-MLANA/PMEL/SLC2A1 | 0.952381 | 1 | 0.909091 |
| GUCY2C AND SLC7A5 AND NOT-TMEM8A | 1 | 1 | 1 | MLANA AND NOT-CLDN19 AND KDR | 1 | 1 | 1 |
| DPEP1 AND KCNJ2 AND NOT-CD79B | 1 | 1 | 1 | MLANA AND GPR137B AND KDR | 1 | 1 | 1 |
| GUCY2C AND SLC7A5 AND NOT-PTPRN | 1 | 1 | 1 | MLANA AND NOT-CHRNA2 AND KDR | 1 | 1 | 1 |
| GUCY2C AND SLC7A5 AND NOT-PTPRG | 1 | 1 | 1 | MLANA AND NOT-SLC10A2 AND KDR | 1 | 1 | 1 |
| DPEP1 AND ANXA1 AND NOT-VSTM4 | 1 | 1 | 1 | COMPLEX-MLANA/B4GALNT1/SLC2A1 | 1 | 1 | 1 |
| GUCY2C AND SLC7A5 AND NOT-PTPRC | 1 | 1 | 1 | COMPLEX-MLANA/KDR/SLC2A1 | 0.9 | 1 | 0.818182 |
| GUCY2C AND SLC7A5 AND NOT-LRRC4 | 1 | 1 | 1 | COMPLEX-MLANA/ABCA12/KDR | 0.9 | 1 | 0.818182 |
| GUCY2C AND SLC7A5 AND NOT-CDH24 | 1 | 1 | 1 | COMPLEX-MLANA/FOLR1/TPBG | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| GUCY2C AND SLC7A5 AND NOT-SPN | 1 | 1 | 1 | COMPLEX-CLDN7/MLANA/TPBG | 1 | 1 | 1 |
| GUCY2C AND SLC7A5 AND NOT-SHH | 1 | 1 | 1 | COMPLEX-MLANA/CEACAM6/TPBG | 0.952381 | 1 | 0.909091 |
| GUCY2C AND SLC7A5 AND NOT-SIGLEC1 | 1 | 1 | 1 | COMPLEX-MSLN/MLANA/TPBG | 0.916667 | 0.846154 | 1 |
| BIRC5 AND NOT-ADCY7 AND CLDN1 | 1 | 1 | 1 | COMPLEX-MLANA/TPBG/CLDN1 | 0.916667 | 0.846154 | 1 |
| DPEP1 AND NOT-IL12RB2 AND STEAP2 | 1 | 1 | 1 | COMPLEX-MLANA/FLOT2/TPBG | 0.916667 | 0.846154 | 1 |
| GUCY2C AND SLC7A5 AND NOT-SLCO2A1 | 1 | 1 | 1 | COMPLEX-ERBB2/MLANA/TPBG | 0.916667 | 0.846154 | 1 |
| GUCY2C AND SLC7A5 AND NOT-SLC18A2 | 1 | 1 | 1 | COMPLEX-DPEP1/MLANA/TPBG | 0.916667 | 0.846154 | 1 |
| GUCY2C AND SLC7A5 AND NOT-SLC15A2 | 1 | 1 | 1 | COMPLEX-CSPG4/MLANA/TPBG | 0.916667 | 0.846154 | 1 |
| DPEP1 AND NOT-IL12RB2 AND ANXA1 | 1 | 1 | 1 | COMPLEX-CR2/MLANA/TPBG | 0.916667 | 0.846154 | 1 |
| GUCY2C AND SLC7A5 AND NOT-SLC6A8 | 1 | 1 | 1 | COMPLEX-MLANA/TPBG/CLDN8 | 0.916667 | 0.846154 | 1 |
| GUCY2C AND SLC7A5 AND NOT-SLC6A2 | 1 | 1 | 1 | COMPLEX-MLANA/SLC39A6/TPBG | 0.916667 | 0.846154 | 1 |
| GUCY2C AND SLC7A5 AND NOT-BMP2 | 1 | 1 | 1 | COMPLEX-MLANA/TPBG/ULBP2 | 0.916667 | 0.846154 | 1 |
| DPEP1 AND SLC7A5 AND NOT-OR10A4 | 1 | 1 | 1 | COMPLEX-MLANA/TPBG/TYR | 0.916667 | 0.846154 | 1 |
| GUCY2C AND SLC7A5 AND NOT-SLC1A1 | 1 | 1 | 1 | COMPLEX-MLANA/SSTR3/TPBG | 0.916667 | 0.846154 | 1 |
| DPEP1 AND NOT-IL12RB2 AND IL20RA | 1 | 1 | 1 | COMPLEX-SLC34A2/MLANA/TPBG | 0.916667 | 0.846154 | 1 |
| GUCY2C AND SLC7A5 AND NOT-SLC13A3 | 1 | 1 | 1 | COMPLEX-MLANA/MUC4/TPBG | 0.916667 | 0.846154 | 1 |
| DPEP1 AND GUCY2C AND NOT-SLC1A1 | 1 | 1 | 1 | COMPLEX-MLANA/FOLR2/TPBG | 0.916667 | 0.846154 | 1 |
| DPEP1 AND NOT-SST AND NOT-SUSD2 | 1 | 1 | 1 | COMPLEX-MLANA/IGF1R/TPBG | 0.916667 | 0.846154 | 1 |
| DPEP1 AND ITGAV AND NOT-PCDH9 | 1 | 1 | 1 | COMPLEX-MLANA/ITGAV/TPBG | 0.916667 | 0.846154 | 1 |
| DPEP1 AND ITGAV AND NOT-SLC16A2 | 1 | 1 | 1 | COMPLEX-MLANA/MAGEA4/TPBG | 0.916667 | 0.846154 | 1 |
| MUC13 AND CLDN1 AND NOT-SLC38A6 | 1 | 1 | 1 | COMPLEX-MLANA/TPBG/MUC16 | 0.916667 | 0.846154 | 1 |
| DPEP1 AND OAS1 AND NOT-ABHD6 | 1 | 1 | 1 | COMPLEX-MLANA/TPBG/CLDN9 | 0.916667 | 0.846154 | 1 |
| DPEP1 AND CEACAM6 AND NOT-ABHD6 | 1 | 1 | 1 | COMPLEX-MLANA/TPBG/CLDN6 | 0.916667 | 0.846154 | 1 |
| DPEP1 AND ITGAV AND NOT-SMO | 1 | 1 | 1 | COMPLEX-MLANA/TPBG/CLDN12 | 0.916667 | 0.846154 | 1 |
| MUC13 AND CLDN1 AND NOT-CRHR2 | 1 | 1 | 1 | COMPLEX-MLANA/TPBG/PROM1 | 0.916667 | 0.846154 | 1 |
| DPEP1 AND CLDN4 AND NOT-ABHD6 | 1 | 1 | 1 | COMPLEX-MLANA/TPBG/LGR5 | 0.916667 | 0.846154 | 1 |
| DPEP1 AND OAS1 AND NOT-SLC5A1 | 1 | 1 | 1 | COMPLEX-MLANA/TPBG/CD276 | 0.916667 | 0.846154 | 1 |
| MUC13 AND CLDN1 AND NOT-SLC26A9 | 1 | 1 | 1 | COMPLEX-MLANA/TPBG/ULBP1 | 0.916667 | 0.846154 | 1 |
| DPEP1 AND ITGAV AND NOT-TIE1 | 1 | 1 | 1 | COMPLEX-MLANA/TPBG/PSCA | 0.916667 | 0.846154 | 1 |
| DPEP1 AND NOT-SLC15A1 AND OAS1 | 1 | 1 | 1 | COMPLEX-MLANA/TPBG/VTCN1 | 0.916667 | 0.846154 | 1 |
| XK AND CLDN1 AND NOT-CD160 | 1 | 1 | 1 | COMPLEX-MLANA/TPBG/ULBP3 | 0.916667 | 0.846154 | 1 |
| DPEP1 AND ITGAV AND NOT-TRPC5 | 1 | 1 | 1 | COMPLEX-MLANA/SSTR4/TPBG | 0.916667 | 0.846154 | 1 |
| DPEP1 AND ITGAV AND NOT-SLC8A2 | 1 | 1 | 1 | COMPLEX-MLANA/SSTR1/TPBG | 0.916667 | 0.846154 | 1 |
| DPEP1 AND ITGAV AND NOT-TRPV1 | 1 | 1 | 1 | COMPLEX-MLANA/SDC1/TPBG | 0.916667 | 0.846154 | 1 |
| DPEP1 AND ITGAV AND NOT-SLC4A1 | 1 | 1 | 1 | COMPLEX-MLANA/OAS1/TPBG | 0.916667 | 0.846154 | 1 |
| MUC13 AND CLDN1 AND NOT-PCDHGB7 | 1 | 1 | 1 | COMPLEX-MLANA/EPCAM/TPBG | 0.916667 | 0.846154 | 1 |
| DPEP1 AND NOT-SLC13A1 AND PCDHA9 | 1 | 1 | 1 | COMPLEX-MLANA/SST/TPBG | 0.916667 | 0.846154 | 1 |
| CDH17 AND THY1 AND NOT-PTPRT | 1 | 1 | 1 | COMPLEX-MLANA/SSTR5/TPBG | 0.916667 | 0.846154 | 1 |
| IFI6 AND EPHB2 AND NOT-MMP24 | 1 | 1 | 1 | COMPLEX-MLANA/TPBG/CLDN2 | 0.916667 | 0.846154 | 1 |
| CDH17 AND THY1 AND NOT-CLDN16 | 1 | 1 | 1 | COMPLEX-MLANA/TPBG/TNFSF11 | 0.916667 | 0.846154 | 1 |
| IFI6 AND EPHB2 AND NOT-CHRNB4 | 1 | 1 | 1 | COMPLEX-MLANA/TPBG/SLC7A5 | 0.916667 | 0.846154 | 1 |
| CDH17 AND THY1 AND NOT-CDH18 | 1 | 1 | 1 | COMPLEX-MLANA/IL11RA/TPBG | 0.916667 | 0.846154 | 1 |
| IFI6 AND EPHB2 AND NOT-NKAIN4 | 1 | 1 | 1 | COMPLEX-MLANA/SSTR2/TPBG | 0.916667 | 0.846154 | 1 |
| IFI6 AND EPHB2 AND NOT-SLCO6A1 | 1 | 1 | 1 | COMPLEX-MLANA/SLAMF7/TPBG | 0.916667 | 0.846154 | 1 |
| IFI6 AND EPHB2 AND NOT-SLC32A1 | 1 | 1 | 1 | COMPLEX-MLANA/MUC1/TPBG | 0.916667 | 0.846154 | 1 |
| IFI6 AND EPHB2 AND NOT-LRRN4 | 1 | 1 | 1 | COMPLEX-SPON2/MLANA/TPBG | 0.916667 | 0.846154 | 1 |
| IFI6 AND EPHB2 AND NOT-KCNV2 | 1 | 1 | 1 | COMPLEX-MLANA/MST1R/TPBG | 0.916667 | 0.846154 | 1 |
| CLDN7 AND TGFBI AND NOT-PAQR8 | 1 | 1 | 1 | COMPLEX-MLANA/TNC/TPBG | 0.916667 | 0.846154 | 1 |
| IFI6 AND EPHB2 AND NOT-DSC1 | 1 | 1 | 1 | COMPLEX-ALDH1A1/MLANA/TPBG | 0.916667 | 0.846154 | 1 |
| IFI6 AND EPHB2 AND NOT-AGTR2 | 1 | 1 | 1 | COMPLEX-EPHA3/MLANA/TPBG | 0.916667 | 0.846154 | 1 |
| IFI6 AND EPHB2 AND NOT-S1PR1 | 1 | 1 | 1 | COMPLEX-EGFR/MLANA/TPBG | 0.916667 | 0.846154 | 1 |
| DPEP1 AND NOT-EPHA8 AND NOT-KCNK12 | 1 | 1 | 1 | COMPLEX-DDX3X/MLANA/TPBG | 0.916667 | 0.846154 | 1 |
| CDH17 AND THY1 AND NOT-ADAM29 | 1 | 1 | 1 | COMPLEX-CBX3/MLANA/TPBG | 0.916667 | 0.846154 | 1 |
| CDH17 AND THY1 AND NOT-HRH3 | 1 | 1 | 1 | COMPLEX-MLANA/TPBG/CD22 | 0.916667 | 0.846154 | 1 |
| IFI6 AND EPHB2 AND NOT-TMEFF2 | 1 | 1 | 1 | COMPLEX-MLANA/TPBG/TNFRSF8 | 0.916667 | 0.846154 | 1 |
| CDH17 AND THY1 AND NOT-CHRND | 1 | 1 | 1 | COMPLEX-TNFRSF13C/MLANA/TPBG | 0.916667 | 0.846154 | 1 |
| IFI6 AND CLDN7 AND NOT-MLANA | 1 | 1 | 1 | COMPLEX-CLDN3/MLANA/TPBG | 0.916667 | 0.846154 | 1 |
| NOX1 AND THY1 AND NOT-SLC22A12 | 1 | 1 | 1 | COMPLEX-MLANA/IL3RA/TPBG | 0.916667 | 0.846154 | 1 |
| NOX1 AND THY1 AND NOT-CSMD2 | 1 | 1 | 1 | COMPLEX-MLANA/ANXA1/TPBG | 0.916667 | 0.846154 | 1 |
| NOX1 AND THY1 AND NOT-CHRND | 1 | 1 | 1 | COMPLEX-MLANA/GAGE1/TPBG | 0.916667 | 0.846154 | 1 |
| MUC13 AND TGFBI AND CDH11 | 1 | 1 | 1 | COMPLEX-ERBB4/MLANA/TPBG | 0.916667 | 0.846154 | 1 |
| NOX1 AND THY1 AND NOT-HRH3 | 1 | 1 | 1 | COMPLEX-ENG/MLANA/TPBG | 0.916667 | 0.846154 | 1 |
| NOX1 AND THY1 AND NOT-PTPRT | 1 | 1 | 1 | COMPLEX-CLDN23/MLANA/TPBG | 0.916667 | 0.846154 | 1 |
| NOX1 AND THY1 AND NOT-ADAM29 | 1 | 1 | 1 | COMPLEX-DNAJB8/MLANA/TPBG | 0.916667 | 0.846154 | 1 |
| NOX1 AND THY1 AND NOT-CLDN16 | 1 | 1 | 1 | COMPLEX-AFP/MLANA/TPBG | 0.869565 | 0.833333 | 0.909091 |
| NOX1 AND THY1 AND NOT-CDH18 | 1 | 1 | 1 | COMPLEX-MLANA/SEMA5B/TPBG | 0.869565 | 0.833333 | 0.909091 |
| CDH17 AND THY1 AND NOT-MRGPRX2 | 1 | 1 | 1 | COMPLEX-MLANA/CLDN5/TPBG | 0.869565 | 0.833333 | 0.909091 |
| CDH17 AND THY1 AND NOT-SLC22A12 | 1 | 1 | 1 | COMPLEX-MLANA/PCYT1A/TPBG | 0.869565 | 0.833333 | 0.909091 |
| CDH17 AND THY1 AND NOT-CSMD2 | 1 | 1 | 1 | COMPLEX-MLANA/ENPP3/TPBG | 0.869565 | 0.833333 | 0.909091 |
| IFI6 AND MUC13 AND NOT-MLANA | 1 | 1 | 1 | COMPLEX-MLANA/TPBG/WT1 | 0.869565 | 0.833333 | 0.909091 |
| IFI6 AND EPHB2 AND NOT-ATP8A1 | 1 | 1 | 1 | COMPLEX-MLANA/TRPM4/TPBG | 0.869565 | 0.833333 | 0.909091 |
| IFI6 AND EPHB2 AND NOT-SYT11 | 1 | 1 | 1 | COMPLEX-MLANA/GUCY2C/TPBG | 0.869565 | 0.833333 | 0.909091 |
| DPEP1 AND NOT-KIRREL2 AND CD93 | 1 | 1 | 1 | COMPLEX-RAET1E/MLANA/TPBG | 0.869565 | 0.833333 | 0.909091 |
| NOX1 AND THY1 AND NOT-ANTXR2 | 1 | 1 | 1 | COMPLEX-GPA33/MLANA/TPBG | 0.869565 | 0.833333 | 0.909091 |
| DPEP1 AND NOT-KCNK10 AND NOX1 | 1 | 1 | 1 | COMPLEX-MLANA/TPBG/CD70 | 0.869565 | 0.833333 | 0.909091 |
| IFI6 AND EPHB2 AND NOT-KCNJ9 | 1 | 1 | 1 | COMPLEX-MLANA/STEAP2/TPBG | 0.869565 | 0.833333 | 0.909091 |
| DPEP1 AND NOX1 AND NOT-AQP6 | 1 | 1 | 1 | | | | |

FIG. 15 (cont.)

| Antigen Pair Logic | F1 | Precision | Recall |
|---|---|---|---|
| IFI6 AND EPHB2 AND NOT-MAG | 1 | 1 | 1 |
| DPEP1 AND NOX1 AND NOT-HTR6 | 1 | 1 | 1 |
| DPEP1 AND NOX1 AND NOT-VN1R2 | 1 | 1 | 1 |
| DPEP1 AND NOX1 AND NOT-GRM4 | 1 | 1 | 1 |
| IFI6 AND IL20RA AND NOT-SLCO6A1 | 1 | 1 | 1 |
| CDH17 AND TGFBI AND NOT-PCYT1A | 1 | 1 | 1 |
| IFI6 AND EPHB2 AND NOT-MIP | 1 | 1 | 1 |
| IFI6 AND GUCY2C AND NOT-SLCO6A1 | 1 | 1 | 1 |
| IFI6 AND EPHB2 AND NOT-NMBR | 1 | 1 | 1 |
| DPEP1 AND NOX1 AND NOT-GABRA5 | 1 | 1 | 1 |
| IFI6 AND EPHB2 AND NOT-SLCO6A1 | 1 | 1 | 1 |
| DPEP1 AND IFI6 AND NOT-SLCO6A1 | 1 | 1 | 1 |
| DPEP1 AND NOT-HTR3C AND NOT-SHISA9 | 1 | 1 | 1 |
| DPEP1 AND NOX1 AND NOT-RXFP3 | 1 | 1 | 1 |
| IFI6 AND EPHB2 AND NOT-KCNH1 | 1 | 1 | 1 |
| IFI6 AND EPHB2 AND NOT-GABRD | 1 | 1 | 1 |
| CDH17 AND TGFBI AND NOT-ENPP3 | 1 | 1 | 1 |
| IFI6 AND EPHB2 AND NOT-GHRHR | 1 | 1 | 1 |
| DPEP1 AND NOT-SLC1A6 AND FXYD6 | 1 | 1 | 1 |
| IFI6 AND EPHB2 AND NOT-GPR78 | 1 | 1 | 1 |
| CDH17 AND TGFBI AND CLDN1 | 1 | 1 | 1 |
| IFI6 AND EPHB2 AND NOT-GNRHR | 1 | 1 | 1 |
| IFI6 AND EPHB2 AND NOT-GRIK1 | 1 | 1 | 1 |
| DPEP1 AND NOX1 AND NOT-CCKBR | 1 | 1 | 1 |
| IFI6 AND EPHB2 AND NOT-GRIK4 | 1 | 1 | 1 |
| DPEP1 AND NOT-SLC10A2 AND NOX1 | 1 | 1 | 1 |
| DPEP1 AND NOX1 AND NOT-SLC9A1 | 1 | 1 | 1 |
| IFI6 AND NOX1 AND NOT-GRIN2C | 1 | 1 | 1 |
| CDH17 AND TGFBI AND THY1 | 1 | 1 | 1 |
| IFI6 AND EPHB2 AND NOT-KCNA10 | 1 | 1 | 1 |
| DPEP1 AND NOX1 AND NOT-PTGER4 | 1 | 1 | 1 |
| DPEP1 AND NOX1 AND NOT-AJAP1 | 1 | 1 | 1 |
| NOX1 AND THY1 AND NOT-MRGPRX2 | 1 | 1 | 1 |
| NOX1 AND THY1 AND NOT-CALHM3 | 1 | 1 | 1 |
| DPEP1 AND NOT-SLC28A1 AND NKAIN2 | 1 | 1 | 1 |
| NOX1 AND THY1 AND NOT-PORCN | 1 | 1 | 1 |
| NOX1 AND THY1 AND NOT-ABCG4 | 1 | 1 | 1 |
| NOX1 AND THY1 AND NOT-SCN1A | 1 | 1 | 1 |
| NOX1 AND THY1 AND NOT-CACNG8 | 1 | 1 | 1 |
| DPEP1 AND NOT-SLC28A1 AND NOT-ATP4B | 1 | 1 | 1 |
| NOX1 AND THY1 AND NOT-JPH3 | 1 | 1 | 1 |
| NOX1 AND THY1 AND NOT-ATP8B2 | 1 | 1 | 1 |
| DPEP1 AND NOT-SLC13A1 AND KCNK12 | 1 | 1 | 1 |
| NOX1 AND THY1 AND NOT-SLC12A9 | 1 | 1 | 1 |
| NOX1 AND THY1 AND NOT-MRAP | 1 | 1 | 1 |
| NOX1 AND THY1 AND NOT-PCDHAC2 | 1 | 1 | 1 |
| NOX1 AND THY1 AND NOT-ENPP1 | 1 | 1 | 1 |
| NOX1 AND THY1 AND NOT-KCNK9 | 1 | 1 | 1 |
| NOX1 AND THY1 AND NOT-KCNK4 | 1 | 1 | 1 |
| NOX1 AND THY1 AND NOT-OXTR | 1 | 1 | 1 |
| NOX1 AND THY1 AND NOT-OPRK1 | 1 | 1 | 1 |
| NOX1 AND THY1 AND NOT-GPR135 | 1 | 1 | 1 |
| NOX1 AND THY1 AND NOT-SLC6A7 | 1 | 1 | 1 |
| NOX1 AND THY1 AND NOT-ASTN1 | 1 | 1 | 1 |
| NOX1 AND THY1 AND NOT-SLC6A13 | 1 | 1 | 1 |
| NOX1 AND THY1 AND NOT-OTOF | 1 | 1 | 1 |
| NOX1 AND THY1 AND NOT-CD1A | 1 | 1 | 1 |
| DPEP1 AND NOT-ATP4B AND NOT-ABCG5 | 1 | 1 | 1 |
| DPEP1 AND NOT-SLC13A1 AND CD72 | 1 | 1 | 1 |
| IFI6 AND CLDN3 AND NOT-FLOT2 | 1 | 1 | 1 |
| DPEP1 AND NOT-SLC1A6 AND STEAP2 | 1 | 1 | 1 |
| DPEP1 AND NOT-SLC6A11 AND STEAP2 | 1 | 1 | 1 |
| DPEP1 AND NOT-SLC13A1 AND STEAP2 | 1 | 1 | 1 |
| DPEP1 AND NOT-SPAM1 AND STEAP2 | 1 | 1 | 1 |
| DPEP1 AND STEAP2 AND NOT-DGKE | 1 | 1 | 1 |
| DPEP1 AND NOT-CNTNAP4 AND STEAP2 | 1 | 1 | 1 |
| DPEP1 AND STEAP2 AND NOT-SLC22A6 | 1 | 1 | 1 |
| DPEP1 AND ITGAV AND NOT-KCNK12 | 1 | 1 | 1 |
| DPEP1 AND ITGAV AND NOT-CACNG2 | 1 | 1 | 1 |
| DPEP1 AND NOT-CACNG2 AND TNC | 1 | 1 | 1 |
| DPEP1 AND NOT-KCNH4 AND STEAP2 | 1 | 1 | 1 |
| DPEP1 AND NOT-KCNH4 AND ANXA1 | 1 | 1 | 1 |
| DPEP1 AND NOT-KCNH4 AND PTK7 | 1 | 1 | 1 |
| CLDN7 AND SLC7A5 AND NOT-TMPRSS11B | 1 | 1 | 1 |
| DPEP1 AND STEAP2 AND NOT-MPL | 1 | 1 | 1 |
| CLDN7 AND SLC7A5 AND NOT-PORCN | 1 | 1 | 1 |
| DPEP1 AND NOT-CHRND AND MST1R | 1 | 1 | 1 |

| Antigen Pair Logic | F1 | Precision | Recall |
|---|---|---|---|
| COMPLEX-MLANA/TPBG/CD34 | 0.869565 | 0.833333 | 0.909091 |
| COMPLEX-MLANA/BIRC5/TPBG | 0.869565 | 0.833333 | 0.909091 |
| COMPLEX-MLANA/L1CAM/TPBG | 0.869565 | 0.833333 | 0.909091 |
| COMPLEX-MLANA/CLDN18/TPBG | 0.818182 | 0.818182 | 0.818182 |
| COMPLEX-MLANA/CLDN11/TPBG | 0.818182 | 0.818182 | 0.818182 |
| COMPLEX-MLANA/GPC3/TPBG | 0.818182 | 0.818182 | 0.818182 |
| COMPLEX-MLANA/AXL/TPBG | 0.818182 | 0.818182 | 0.818182 |
| COMPLEX-MLANA/B4GALNT1/TPBG | 0.916667 | 0.846154 | 1 |
| COMPLEX-MLANA/PMEL/TPBG | 0.869565 | 0.833333 | 0.909091 |
| COMPLEX-MLANA/KDR/TPBG | 0.818182 | 0.818182 | 0.818182 |
| NOT-SLC34A2 AND GPNMB AND ERBB2 | 0.952381 | 1 | 0.909091 |
| NOT-VTCN1 AND GPNMB AND ERBB2 | 0.842105 | 1 | 0.727273 |
| EDNRB AND GPNMB AND ERBB2 | 0.842105 | 1 | 0.727273 |
| NOT-TNFRSF13C AND GPNMB AND NOT-ERBB2 | 0.9 | 1 | 0.818182 |
| NOT-AFP AND GPNMB AND NOT-ERBB2 | 0.952381 | 1 | 0.909091 |
| CLDN23 AND GPNMB AND NOT-ERBB2 | 0.842105 | 1 | 0.727273 |
| NOT-CLDN6 AND GPNMB AND ERBB2 | 0.952381 | 1 | 0.909091 |
| GPNMB AND NOT-MUC4 AND ERBB2 | 0.952381 | 1 | 0.909091 |
| GPNMB AND FLOT2 AND NOT-ERBB2 | 0.9 | 1 | 0.818182 |
| TNC AND NOT-ERBB2 AND GPNMB | 0.842105 | 1 | 0.727273 |
| GPNMB AND OAS1 AND ERBB2 | 0.842105 | 1 | 0.727273 |
| GPNMB AND NOT-HHLA2 AND ERBB2 | 0.9 | 1 | 0.818182 |
| GPNMB AND NOT-SST AND ERBB2 | 0.909091 | 0.909091 | 0.909091 |
| ENG AND GPNMB AND NOT-ERBB2 | 0.857143 | 0.9 | 0.818182 |
| Neuroblastoma | | | |
| SLC10A4 AND TMEM97 AND NOT-AGPAT3 | 0.994012 | 1 | 0.988095 |
| SLC10A4 AND NOT-NTM AND NOT-HTR1B | 0.994012 | 1 | 0.988095 |
| COMPLEX-SLC10A4/SLC6A8/SLC15A2 | 0.994012 | 1 | 0.988095 |
| COMPLEX-SLC10A4/SLC6A1/SLC15A2 | 0.994012 | 1 | 0.988095 |
| SLC10A4 AND NOT-CD99L2 AND NOT-SLC5A1 | 0.994012 | 1 | 0.988095 |
| SLC10A4 AND NOT-PAQR6 AND NOT-MCOLN2 | 0.994012 | 1 | 0.988095 |
| COMPLEX-SLC10A4/CLCA4/SLC7A10 | 0.994012 | 1 | 0.988095 |
| COMPLEX-SLC10A4/CLSTN2/SLC15A2 | 0.994012 | 1 | 0.988095 |
| COMPLEX-IGSF11/SLC10A4/SLC7A10 | 0.994012 | 1 | 0.988095 |
| SLC10A4 AND NOT-NTRK2 AND NOT-SLC5A1 | 0.994012 | 1 | 0.988095 |
| COMPLEX-SLC10A4/JAM2/SLC15A2 | 0.994012 | 1 | 0.988095 |
| COMPLEX-SLC10A4/SLC15A1/SLC15A2 | 0.994012 | 1 | 0.988095 |
| SLC10A4 AND NOT-CD99L2 AND NOT-OR5I1 | 0.994012 | 1 | 0.988095 |
| COMPLEX-SLC10A4/SLC15A2/VMP1 | 0.994012 | 1 | 0.988095 |
| SLC10A4 AND NOT-PAQR6 AND NOT-TNFRSF14 | 0.994012 | 1 | 0.988095 |
| SLC10A4 AND NOT-AQP4 AND NOT-CRHR2 | 0.994012 | 1 | 0.988095 |
| SLC10A4 AND NOT-APLP1 AND NOT-PCDHAC1 | 0.994012 | 1 | 0.988095 |
| COMPLEX-SLC10A4/PRRG1/SLC15A2 | 0.994012 | 1 | 0.988095 |
| COMPLEX-SLC10A4/SLC15A2/SYP | 0.994012 | 1 | 0.988095 |
| COMPLEX-SLC10A4/PTPRZ1/SLC15A2 | 0.994012 | 1 | 0.988095 |
| SLC10A4 AND NOT-AQP4 AND NOT-SLC5A1 | 0.994012 | 1 | 0.988095 |
| SLC10A4 AND NOT-PAQR6 AND NOT-IL17RC | 0.994012 | 1 | 0.988095 |
| COMPLEX-SLC10A4/SLC22A23/SLC15A2 | 0.994012 | 1 | 0.988095 |
| SLC10A4 AND NOT-SLC22A23 AND NOT-MRGPRX3 | 0.994012 | 1 | 0.988095 |
| SLC10A4 AND NOT-PAQR6 AND NOT-MRGPRX3 | 0.994012 | 1 | 0.988095 |
| COMPLEX-MRGPRX3/SLC10A4/ABCG2 | 0.994012 | 1 | 0.988095 |
| COMPLEX-IGSF11/SLC10A4/TRPC6 | 0.994012 | 1 | 0.988095 |
| SLC10A4 AND NOT-PAQR6 AND NOT-AGPAT3 | 0.994012 | 1 | 0.988095 |
| COMPLEX-SLC10A4/TMEM100/SLC15A2 | 0.994012 | 1 | 0.988095 |
| SLC10A4 AND NOT-SLC22A23 AND NOT-OR10H3 | 0.994012 | 1 | 0.988095 |
| COMPLEX-SLC10A4/PLP1/SLC15A2 | 0.994012 | 1 | 0.988095 |
| COMPLEX-SLC10A4/ATP1A2/SLC15A2 | 0.994012 | 1 | 0.988095 |
| COMPLEX-SLC10A4/ATP1A2/SLC15A2 | 0.994012 | 1 | 0.988095 |
| SLC10A4 AND NOT-SLC22A23 AND NOT-SLC5A1 | 0.994012 | 1 | 0.988095 |
| SLC10A4 AND NOT-GPR62 AND NOT-ABCA4 | 0.994012 | 1 | 0.988095 |
| COMPLEX-IGSF11/SLC10A4/NTSR1 | 0.994012 | 1 | 0.988095 |
| COMPLEX-SLC10A4/NTSR1/STYK1 | 0.994012 | 1 | 0.988095 |
| COMPLEX-SLC10A4/NTSR1/SCN2B | 0.994012 | 1 | 0.988095 |
| COMPLEX-SLC10A4/NTSR1/ABCG2 | 0.994012 | 1 | 0.988095 |
| COMPLEX-CHRNB3/SLC10A4/SLC7A10 | 0.994012 | 1 | 0.988095 |
| COMPLEX-MRGPRX3/IGSF11/SLC10A4 | 0.994012 | 1 | 0.988095 |
| SLC10A4 AND NOT-GJC2 AND NOT-PHEX | 0.994012 | 1 | 0.988095 |
| COMPLEX-SLC10A4/PRRG1/SLC15A2 | 0.994012 | 1 | 0.988095 |
| COMPLEX-SLC10A4/SLC15A2/ATRN | 0.994012 | 1 | 0.988095 |
| COMPLEX-CHRNB3/SLC10A4/CADM2 | 0.994012 | 1 | 0.988095 |
| COMPLEX-SLC10A4/SHISA6/STYK1 | 0.994012 | 1 | 0.988095 |
| COMPLEX-SLC10A4/SHISA6/SCN2B | 0.994012 | 1 | 0.988095 |
| COMPLEX-CX3CR1/SLC2A12/SLC10A4 | 0.994012 | 1 | 0.988095 |
| SLC10A4 AND NOT-PAQR6 AND NOT-USP48 | 0.994012 | 1 | 0.988095 |
| SLC10A4 AND NOT-PAQR6 AND NOT-SLC16A2 | 0.994012 | 1 | 0.988095 |
| COMPLEX-GPR62/SLC10A4/STX3 | 0.994012 | 1 | 0.988095 |
| COMPLEX-SLC2A12/SLC10A4/SLC7A8 | 0.994012 | 1 | 0.988095 |

FIG. 15 (cont.)

| Antigen Pair Logic | F1 | Precision | Recall | Antigen Pair Logic | F1 | Precision | Recall |
|---|---|---|---|---|---|---|---|
| DPEP1 AND ITGAV AND NOT-CHRNA4 | 1 | 1 | 1 | COMPLEX-SLC10A4/KCNJ10/LGR4 | 0.994012 | 1 | 0.988095 |
| DPEP1 AND GUCY2C AND NOT-SLC9A1 | 1 | 1 | 1 | COMPLEX-SLC10A4/KCNJ10/CEACAM1 | 0.994012 | 1 | 0.988095 |
| DPEP1 AND NOT-SLC10A2 AND GUCY2C | 1 | 1 | 1 | COMPLEX-SLC10A4/KCNJ10/TRPV4 | 0.994012 | 1 | 0.988095 |
| DPEP1 AND NOT-CD1B AND GUCY2C | 1 | 1 | 1 | SLC10A4 AND NOT-GPR62 AND NOT-HTR6 | 0.994012 | 1 | 0.988095 |
| DPEP1 AND NOT-ANPEP AND GPA33 | 1 | 1 | 1 | COMPLEX-SLC10A4/TMEM235/ABCG2 | 0.994012 | 1 | 0.988095 |
| BIRC5 AND GPA33 AND NOT-SLC9A1 | 1 | 1 | 1 | COMPLEX-SLC10A4/KCNJ10/VIPR1 | 0.994012 | 1 | 0.988095 |
| IFI6 AND CEACAM6 AND LGR5 | 1 | 1 | 1 | SLC10A4 AND NOT-ACSL6 AND NOT-NPY5R | 0.994012 | 1 | 0.988095 |
| DPEP1 AND NOT-TMPRSS11B AND CLDN1 | 1 | 1 | 1 | SLC10A4 AND NOT-NKAIN2 AND NOT-USP48 | 0.994012 | 1 | 0.988095 |
| DPEP1 AND NOT-CLDN19 AND CLDN1 | 1 | 1 | 1 | SLC10A4 AND NOT-ACSL6 AND NOT-DCHS2 | 0.994012 | 1 | 0.988095 |
| DPEP1 AND NOT-SV2C AND CLDN1 | 1 | 1 | 1 | COMPLEX-SLC32A1/SLC10A4/SLC15A2 | 0.994012 | 1 | 0.988095 |
| DPEP1 AND NOT-SLC12A5 AND STEAP2 | 1 | 1 | 1 | SLC10A4 AND NOT-NKAIN2 AND NOT-LY6D | 0.994012 | 1 | 0.988095 |
| DPEP1 AND NOT-OR52D1 AND STEAP2 | 1 | 1 | 1 | SLC10A4 AND NOT-NKAIN2 AND NOT-TNFRSF14 | 0.994012 | 1 | 0.988095 |
| CLDN7 AND THY1 AND NOT-SLCO6A1 | 1 | 1 | 1 | COMPLEX-SLC10A4/GABRA2/SLC15A2 | 0.994012 | 1 | 0.988095 |
| IFI6 AND CLDN3 AND NOT-DDX3X | 1 | 1 | 1 | SLC10A4 AND NOT-KCNJ10 AND NOT-SLC5A1 | 0.994012 | 1 | 0.988095 |
| DPEP1 AND SLC7A5 AND NOT-KCNU1 | 1 | 1 | 1 | COMPLEX-SLC10A4/GABRB1/SLC15A2 | 0.994012 | 1 | 0.988095 |
| DPEP1 AND NOT-PCDHB1 AND CD70 | 1 | 1 | 1 | COMPLEX-SLC10A4/GABRG1/SLC15A2 | 0.994012 | 1 | 0.988095 |
| IFI6 AND CEACAM5 AND NOT-SSTR4 | 1 | 1 | 1 | SLC10A4 AND NOT-SYPL1 AND NOT-KCNJ10 | 0.994012 | 1 | 0.988095 |
| DPEP1 AND NOT-PCDHB1 AND PTK7 | 1 | 1 | 1 | COMPLEX-SLC10A4/KCNJ10/AMN | 0.994012 | 1 | 0.988095 |
| DPEP1 AND NOT-PCDHB1 AND IL20RA | 1 | 1 | 1 | SLC10A4 AND NOT-KCNJ10 AND NOT-FAM73B | 0.994012 | 1 | 0.988095 |
| DPEP1 AND NOT-PCDHB1 AND ANXA1 | 1 | 1 | 1 | SLC10A4 AND NOT-KCNJ10 AND NOT-ABCC3 | 0.994012 | 1 | 0.988095 |
| DPEP1 AND NOT-PCDHB1 AND STEAP2 | 1 | 1 | 1 | COMPLEX-IGSF11/SLC10A4/GLRA3 | 0.994012 | 1 | 0.988095 |
| DPEP1 AND NOT-GABBR2 AND CD276 | 1 | 1 | 1 | SLC10A4 AND NOT-NKAIN2 AND NOT-ABCG1 | 0.994012 | 1 | 0.988095 |
| BIRC5 AND NOX1 AND ITGAV | 1 | 1 | 1 | SLC10A4 AND TUSC3 AND NOT-GLRA3 | 0.994012 | 1 | 0.988095 |
| DPEP1 AND NOT-GABBR2 AND THY1 | 1 | 1 | 1 | SLC10A4 AND NOT-CDH26 AND NOT-HTR1F | 0.994012 | 1 | 0.988095 |
| GUCY2C AND THY1 AND NOT-CHRND | 1 | 1 | 1 | SLC10A4 AND NOT-KCNJ10 AND NOT-P2RY2 | 0.994012 | 1 | 0.988095 |
| DPEP1 AND NOT-SLC28A1 AND MAGEA4 | 1 | 1 | 1 | SLC10A4 AND NOT-KCNJ10 AND NOT-HFE | 0.994012 | 1 | 0.988095 |
| IFI6 AND MUC13 AND NOT-SDC1 | 1 | 1 | 1 | SLC10A4 AND NOT-NKAIN2 AND NOT-SLC52A1 | 0.994012 | 1 | 0.988095 |
| DPEP1 AND NOT-CD1B AND NOT-CD79B | 1 | 1 | 1 | SLC10A4 AND NOT-NTRK2 AND SLC38A1 | 0.994012 | 1 | 0.988095 |
| MUC13 AND THY1 AND NOT-MUC12 | 1 | 1 | 1 | SLC10A4 AND NOT-CD99L2 AND NOT-ADAM7 | 0.994012 | 1 | 0.988095 |
| IFI6 AND CEACAM5 AND SLC7A5 | 1 | 1 | 1 | SLC10A4 AND NOT-KCNJ10 AND NOT-APCDD1 | 0.994012 | 1 | 0.988095 |
| DPEP1 AND NOT-SLC9B1 AND STEAP2 | 1 | 1 | 1 | COMPLEX-NKAIN2/SLC10A4/TAS2R38 | 0.994012 | 1 | 0.988095 |
| DPEP1 AND STEAP2 AND NOT-NKAIN2 | 1 | 1 | 1 | SLC10A4 AND NOT-NKAIN2 AND NOT-SLC46A2 | 0.994012 | 1 | 0.988095 |
| DPEP1 AND NOT-KCNU1 AND STEAP2 | 1 | 1 | 1 | COMPLEX-SLC10A4/FGFR2/KCNJ10 | 0.994012 | 1 | 0.988095 |
| DPEP1 AND NOT-EPHA8 AND STEAP2 | 1 | 1 | 1 | COMPLEX-SLC10A4/SLC7A10/SLC8A3 | 0.994012 | 1 | 0.988095 |
| DPEP1 AND STEAP2 AND NOT-CRB1 | 1 | 1 | 1 | SLC10A4 AND NOT-CD99L2 AND NOT-HTR1F | 0.994012 | 1 | 0.988095 |
| DPEP1 AND STEAP2 AND NOT-GABRA1 | 1 | 1 | 1 | SLC10A4 AND NOT-KCNJ10 AND NOT-OR10H3 | 0.994012 | 1 | 0.988095 |
| DPEP1 AND STEAP2 AND NOT-GABRG3 | 1 | 1 | 1 | SLC10A4 AND NOT-CD99L2 AND NOT-GRIN2B | 0.994012 | 1 | 0.988095 |
| DPEP1 AND STEAP2 AND NOT-GRIN2B | 1 | 1 | 1 | SLC10A4 AND NOT-KCNJ10 AND NOT-MR1 | 0.994012 | 1 | 0.988095 |
| DPEP1 AND STEAP2 AND NOT-GUCY2F | 1 | 1 | 1 | COMPLEX-SLC10A4/SLC7A10/CALN1 | 0.994012 | 1 | 0.988095 |
| DPEP1 AND NOT-SST AND NOT-CACNG2 | 1 | 1 | 1 | SLC10A4 AND NOT-NKAIN2 AND NOT-RXFP1 | 0.994012 | 1 | 0.988095 |
| DPEP1 AND NOT-HTR1D AND STEAP2 | 1 | 1 | 1 | SLC10A4 AND NOT-CD99L2 AND NOT-OR5P3 | 0.994012 | 1 | 0.988095 |
| DPEP1 AND NOT-HTR2C AND STEAP2 | 1 | 1 | 1 | SLC10A4 AND NOT-KCNJ10 AND NOT-ITPR2 | 0.994012 | 1 | 0.988095 |
| DPEP1 AND NOT-GABRB1 AND CLDN1 | 1 | 1 | 1 | COMPLEX-SLC10A4/KCNJ10/LIM2 | 0.994012 | 1 | 0.988095 |
| DPEP1 AND NOT-GPR22 AND CLDN1 | 1 | 1 | 1 | SLC10A4 AND NOT-KCNJ10 AND NOT-BCAM | 0.994012 | 1 | 0.988095 |
| IFI6 AND ITGB6 AND NOT-EDNRB | 1 | 1 | 1 | SLC10A4 AND NOT-NKAIN2 AND NOT-SCNN1A | 0.994012 | 1 | 0.988095 |
| DPEP1 AND NOT-TSHR AND STEAP2 | 1 | 1 | 1 | SLC10A4 AND NOT-KCNJ10 AND NOT-MGST2 | 0.994012 | 1 | 0.988095 |
| IFI6 AND CLDN7 AND NOT-FCRL1 | 1 | 1 | 1 | COMPLEX-CACNG3/SLC10A4/SLC15A2 | 0.994012 | 1 | 0.988095 |
| IFI6 AND MUC13 AND NOT-FCRL1 | 1 | 1 | 1 | SLC10A4 AND NOT-NKAIN2 AND NOT-BRS3 | 0.994012 | 1 | 0.988095 |
| IFI6 AND BIRC5 AND NOT-CLDN9 | 1 | 1 | 1 | COMPLEX-SLC10A4/OPCML/SLC15A2 | 0.994012 | 1 | 0.988095 |
| IFI6 AND BIRC5 AND NOT-SLC7A5 | 1 | 1 | 1 | SLC10A4 AND NOT-GRM1 AND NOT-OPN5 | 0.994012 | 1 | 0.988095 |
| IFI6 AND CEACAM5 AND NOT-CD79B | 1 | 1 | 1 | COMPLEX-IGSF11/SLC10A4/SLC2A1 | 0.994012 | 1 | 0.988095 |
| IFI6 AND MUC13 AND NOT-BIRC5 | 1 | 1 | 1 | COMPLEX-SLC10A4/GPR26/SLC15A2 | 0.994012 | 1 | 0.988095 |
| IFI6 AND BIRC5 AND NOT-CD180 | 1 | 1 | 1 | COMPLEX-IGSF11/SLC10A4/GABRA1 | 0.994012 | 1 | 0.988095 |
| IFI6 AND BIRC5 AND NOT-ITGB3 | 1 | 1 | 1 | SLC10A4 AND NOT-GPR62 AND NOT-SLC12A3 | 0.994012 | 1 | 0.988095 |
| IFI6 AND BIRC5 AND NOT-IGF1R | 1 | 1 | 1 | COMPLEX-MDGA2/SLC10A4/SLC15A2 | 0.994012 | 1 | 0.988095 |
| IFI6 AND BIRC5 AND NOT-GAGE1 | 1 | 1 | 1 | COMPLEX-SLC10A4/HLA-DRB1/ABCG2 | 0.994012 | 1 | 0.988095 |
| IFI6 AND STEAP1 AND EPCAM | 1 | 1 | 1 | SLC10A4 AND NOT-GPR62 AND NOT-LRRC8E | 0.994012 | 1 | 0.988095 |
| IFI6 AND BIRC5 AND NOT-DKK1 | 1 | 1 | 1 | SLC10A4 AND NOT-AQP4 AND NOT-ATP1B4 | 0.994012 | 1 | 0.988095 |
| DPEP1 AND SLC7A5 AND NOT-MIP | 1 | 1 | 1 | COMPLEX-SLC2A12/SLC10A4/GABRB1 | 0.994012 | 1 | 0.988095 |
| DPEP1 AND NOT-HTR1F AND CLDN1 | 1 | 1 | 1 | COMPLEX-SLC10A4/SCN8A/ABCG2 | 0.994012 | 1 | 0.988095 |
| IFI6 AND MUC13 AND NOT-ITGB6 | 1 | 1 | 1 | COMPLEX-SLC10A4/SLC8A3/SLC15A2 | 0.994012 | 1 | 0.988095 |
| IFI6 AND BIRC5 AND NOT-EDNRB | 1 | 1 | 1 | COMPLEX-SLC2A12/SLC10A4/GPR26 | 0.994012 | 1 | 0.988095 |
| IFI6 AND BIRC5 AND NOT-DDX3X | 1 | 1 | 1 | SLC10A4 AND NOT-SSTR1 AND NOT-LHCGR | 0.994012 | 1 | 0.988095 |
| DPEP1 AND ITGAV AND NOT-SLC22A16 | 1 | 1 | 1 | COMPLEX-BVES/SLC10A4/CLDN11 | 0.994012 | 1 | 0.988095 |
| IFI6 AND BIRC5 AND NOT-TNFRSF13C | 1 | 1 | 1 | COMPLEX-SLC10A4/AQP4/ITGB3 | 0.994012 | 1 | 0.988095 |
| IFI6 AND CLDN3 AND ITGAV | 1 | 1 | 1 | SLC10A4 AND NOT-GPR62 AND NOT-EGFR | 0.994012 | 1 | 0.988095 |
| DPEP1 AND NOT-SV2C AND PTK7 | 1 | 1 | 1 | SLC10A4 AND NOT-CD99L2 AND NOT-ITGB3 | 0.994012 | 1 | 0.988095 |
| DPEP1 AND NOT-SV2C AND IL20RA | 1 | 1 | 1 | COMPLEX-SLC10A4/FOLH1/SLC15A2 | 0.994012 | 1 | 0.988095 |
| DPEP1 AND NOT-SV2C AND ANXA1 | 1 | 1 | 1 | SLC10A4 AND NOT-SSTR1 AND NOT-RRH | 0.994012 | 1 | 0.988095 |
| DPEP1 AND NOT-SLC28A1 AND ITGAV | 1 | 1 | 1 | SLC10A4 AND NOT-AGPAT3 AND NOT-ABCB5 | 0.994012 | 1 | 0.988095 |
| DPEP1 AND ITGAV AND NOT-ADAM7 | 1 | 1 | 1 | COMPLEX-SLC27A5/SLC10A4/CLDN11 | 0.994012 | 1 | 0.988095 |
| DPEP1 AND ITGAV AND NOT-TAS1R1 | 1 | 1 | 1 | SLC10A4 AND NOT-SSTR1 AND NOT-OPN5 | 0.994012 | 1 | 0.988095 |
| DPEP1 AND NOT-SLC28A1 AND GPA33 | 1 | 1 | 1 | COMPLEX-SLC10A4/CLDN11/PCDH10 | 0.994012 | 1 | 0.988095 |
| DPEP1 AND NOT-TSHR AND ANXA1 | 1 | 1 | 1 | COMPLEX-SLC10A4/ALDH1A1/PAQR6 | 0.994012 | 1 | 0.988095 |
| DPEP1 AND NOT-TSHR AND IL20RA | 1 | 1 | 1 | COMPLEX-CLDN4/SLC10A4/AQP4 | 0.994012 | 1 | 0.988095 |
| DPEP1 AND NOT-TSHR AND PTK7 | 1 | 1 | 1 | SLC10A4 AND NOT-KCNJ16 AND NOT-EGFR | 0.994012 | 1 | 0.988095 |
| DPEP1 AND NOT-OPRK1 AND CLDN1 | 1 | 1 | 1 | SLC10A4 AND NOT-AQP4 AND NOT-EGFR | 0.994012 | 1 | 0.988095 |

FIG. 15 (cont.)

| Antigen Pair Logic | F1 | Precision | Recall | Antigen Pair Logic | F1 | Precision | Recall |
|---|---|---|---|---|---|---|---|
| DPEP1 AND NOT-ENPP1 AND CLDN1 | 1 | 1 | 1 | SLC10A4 AND NOT-AQP4 AND NOT-EGFR | 0.994012 | 1 | 0.988095 |
| DPEP1 AND NOT-CD1B AND NOT-GPC3 | 1 | 1 | 1 | COMPLEX-SLC10A4/SLC15A2/CLDN1 | 0.994012 | 1 | 0.988095 |
| IFI6 AND CLDN3 AND NOT-GPC3 | 1 | 1 | 1 | COMPLEX-CELSR2/SLC10A4/CLDN11 | 0.994012 | 1 | 0.988095 |
| DPEP1 AND NOT-GPC3 AND NOT-CCR9 | 1 | 1 | 1 | COMPLEX-SLC10A4/NCAM1/SLC15A2 | 0.994012 | 1 | 0.988095 |
| DPEP1 AND NOT-GPC3 AND NOT-SLC10A2 | 1 | 1 | 1 | SLC10A4 AND NOT-GPR62 AND NOT-EGFR | 0.994012 | 1 | 0.988095 |
| NOX1 AND THY1 AND NOT-GPC3 | 1 | 1 | 1 | COMPLEX-SLC10A4/CLDN11/RET | 0.994012 | 1 | 0.988095 |
| NOX1 AND THY1 AND NOT-ERBB2 | 1 | 1 | 1 | COMPLEX-GPR62/SLC10A4/ITGB3 | 0.994012 | 1 | 0.988095 |
| IFI6 AND CLDN4 AND NOT-GPC3 | 1 | 1 | 1 | COMPLEX-SLC10A4/GPM6B/CLDN11 | 0.994012 | 1 | 0.988095 |
| IFI6 AND EPHB2 AND NOT-GPC3 | 1 | 1 | 1 | COMPLEX-CHRNB3/SLC10A4/CLDN11 | 0.994012 | 1 | 0.988095 |
| IFI6 AND NOT-GPC3 AND ITGB6 | 1 | 1 | 1 | COMPLEX-SLC10A4/SLC7A10/SSTR1 | 0.994012 | 1 | 0.988095 |
| DPEP1 AND NOX1 AND NOT-MUC1 | 1 | 1 | 1 | COMPLEX-SLC10A4/CLDN11/SLC15A2 | 0.994012 | 1 | 0.988095 |
| IFI6 AND MUC13 AND NOT-MUC1 | 1 | 1 | 1 | COMPLEX-SLC10A4/SLC15A2/SSTR1 | 0.994012 | 1 | 0.988095 |
| IFI6 AND CLDN7 AND NOT-MUC1 | 1 | 1 | 1 | COMPLEX-SLC2A12/SLC10A4/SSTR1 | 0.994012 | 1 | 0.988095 |
| IFI6 AND MUC13 AND NOT-GPC3 | 1 | 1 | 1 | COMPLEX-SLC2A12/SLC10A4/TPBG | 0.994012 | 1 | 0.988095 |
| IFI6 AND NOT-GPC3 AND BIRC5 | 1 | 1 | 1 | COMPLEX-GJB6/SLC10A4/CLDN1 | 0.994012 | 1 | 0.988095 |
| IFI6 AND CLDN3 AND NOT-MUC1 | 1 | 1 | 1 | COMPLEX-IGSF11/SLC10A4/ERBB4 | 0.994012 | 1 | 0.988095 |
| DPEP1 AND NOT-GPC3 AND NOT-FLVCR1 | 1 | 1 | 1 | COMPLEX-SLC10A4/TNFRSF21/CLDN11 | 0.994012 | 1 | 0.988095 |
| CLDN7 AND TGFBI AND NOT-MUC1 | 1 | 1 | 1 | COMPLEX-SLC10A4/NCAM1/SLC7A10 | 0.994012 | 1 | 0.988095 |
| IFI6 AND STEAP1 AND NOT-GPC3 | 1 | 1 | 1 | COMPLEX-PTPRU/SLC10A4/SSTR1 | 0.994012 | 1 | 0.988095 |
| IFI6 AND CLDN4 AND NOT-GPC3 | 1 | 1 | 1 | SLC10A4 AND NOT-AQP4 AND NOT-TYR | 0.994012 | 1 | 0.988095 |
| DPEP1 AND NOT-GPC3 AND CEACAM7 | 1 | 1 | 1 | SLC10A4 AND NOT-STYK1 AND NOT-CLDN11 | 0.994012 | 1 | 0.988095 |
| DPEP1 AND NOT-GPC3 AND NOT-SLC31A1 | 1 | 1 | 1 | SLC10A4 AND NOT-AQP4 AND NOT-DNAJB8 | 0.994012 | 1 | 0.988095 |
| DPEP1 AND NOT-GPC3 AND ALCAM | 1 | 1 | 1 | SLC10A4 AND NOT-PAQR6 AND NOT-TYR | 0.994012 | 1 | 0.988095 |
| IFI6 AND NOT-GPC3 AND EPCAM | 1 | 1 | 1 | SLC10A4 AND NOT-PAQR6 AND NOT-DNAJB8 | 0.994012 | 1 | 0.988095 |
| DPEP1 AND NOT-CLDN20 AND NOT-GPC3 | 1 | 1 | 1 | SLC10A4 AND NOT-GPR62 AND NOT-TYR | 0.994012 | 1 | 0.988095 |
| IFI6 AND NOT-GPC3 AND BIRC5 | 1 | 1 | 1 | SLC10A4 AND NOT-GPR62 AND NOT-DNAJB8 | 0.994012 | 1 | 0.988095 |
| DPEP1 AND NOT-SLC13A1 AND NOT-GPC3 | 1 | 1 | 1 | COMPLEX-SLC2A12/SLC10A4/NCAM1 | 0.994012 | 1 | 0.988095 |
| DPEP1 AND NOT-SLC13A1 AND ERBB2 | 1 | 1 | 1 | COMPLEX-SLC10A4/SLC7A10/SSTR1 | 0.994012 | 1 | 0.988095 |
| CDH17 AND CLDN1 AND NOT-MSLN | 1 | 1 | 1 | COMPLEX-CELSR2/SLC10A4/CLDN11 | 0.994012 | 1 | 0.988095 |
| DPEP1 AND NOT-ENPP1 AND MUC1 | 1 | 1 | 1 | SLC10A4 AND NOT-SSTR1 AND NOT-CLEC4D | 0.994012 | 1 | 0.988095 |
| DPEP1 AND NOT-GPC3 AND CEACAM7 | 1 | 1 | 1 | COMPLEX-NKAIN2/SLC10A4/CLDN18 | 0.994012 | 1 | 0.988095 |
| DPEP1 AND IFI6 AND NOT-ERBB2 | 1 | 1 | 1 | COMPLEX-SLC10A4/TMEFF2/CLDN11 | 0.994012 | 1 | 0.988095 |
| IFI6 AND MUC13 AND NOT-MSLN | 1 | 1 | 1 | COMPLEX-CACNG3/SLC10A4/CLDN11 | 0.994012 | 1 | 0.988095 |
| DPEP1 AND NOT-SLC28A1 AND NOT-GPC3 | 1 | 1 | 1 | SLC10A4 AND NOT-SSTR1 AND NOT-GNRHR | 0.994012 | 1 | 0.988095 |
| DPEP1 AND NOT-GPC3 AND NOT-SLC16A5 | 1 | 1 | 1 | COMPLEX-NKAIN2/SLC10A4/KDR | 0.994012 | 1 | 0.988095 |
| DPEP1 AND NOT-GPC3 AND CD44 | 1 | 1 | 1 | COMPLEX-SLC10A4/CLDN11/SLC2A1 | 0.994012 | 1 | 0.988095 |
| DPEP1 AND NOT-GPC3 AND NOT-SLC2A2 | 1 | 1 | 1 | SLC10A4 AND NOT-KCNJ10 AND NOT-DNAJB8 | 0.994012 | 1 | 0.988095 |
| DPEP1 AND NOT-GPC3 AND NOT-ABCG5 | 1 | 1 | 1 | SLC10A4 AND NOT-KCNJ10 AND NOT-TYR | 0.994012 | 1 | 0.988095 |
| DPEP1 AND NOT-ANPEP AND NOT-GPC3 | 1 | 1 | 1 | SLC10A4 AND NOT-SSTR1 AND NOT-GLRA3 | 0.994012 | 1 | 0.988095 |
| DPEP1 AND NOT-GPC3 AND NOX1 | 1 | 1 | 1 | COMPLEX-MDGA2/SLC10A4/CLDN11 | 0.994012 | 1 | 0.988095 |
| DPEP1 AND NOT-GPC3 AND CD93 | 1 | 1 | 1 | COMPLEX-SLC10A4/CLDN11/PAQR8 | 0.994012 | 1 | 0.988095 |
| DPEP1 AND NOT-GPC3 AND NOT-MUC17 | 1 | 1 | 1 | SLC10A4 AND NOT-KCNJ10 AND NOT-MSLN | 0.994012 | 1 | 0.988095 |
| DPEP1 AND NOT-EPHA8 AND NOT-GPC3 | 1 | 1 | 1 | SLC10A4 AND NOT-KCNJ10 AND NOT-EGFR | 0.994012 | 1 | 0.988095 |
| DPEP1 AND NOT-LCT AND NOT-GPC3 | 1 | 1 | 1 | SLC10A4 AND NOT-NKAIN2 AND NOT-MSLN | 0.994012 | 1 | 0.988095 |
| DPEP1 AND NOT-GPC3 AND PTGIS | 1 | 1 | 1 | SLC10A4 AND NOT-SSTR1 AND NOT-SCN10A | 0.994012 | 1 | 0.988095 |
| DPEP1 AND NOT-GPC3 AND NOT-GRIN2C | 1 | 1 | 1 | COMPLEX-SLC10A4/KCNJ10/CLDN18 | 0.994012 | 1 | 0.988095 |
| IFI6 AND MUC13 AND NOT-ERBB2 | 1 | 1 | 1 | SLC10A4 AND NOT-SSTR1 AND NOT-SLC13A1 | 0.994012 | 1 | 0.988095 |
| DPEP1 AND NOT-GPC3 AND NOT-CD1A | 1 | 1 | 1 | SLC10A4 AND NOT-NKAIN2 AND NOT-EGFR | 0.994012 | 1 | 0.988095 |
| DPEP1 AND NOT-GPC3 AND NOT-SLC13A2 | 1 | 1 | 1 | SLC10A4 AND NOT-NKAIN2 AND NOT-MSLN | 0.994012 | 1 | 0.988095 |
| DPEP1 AND NOT-GPC3 AND FXYD6 | 1 | 1 | 1 | COMPLEX-SLC10A4/ITGB3/KCNJ10 | 0.994012 | 1 | 0.988095 |
| DPEP1 AND NOT-GPC3 AND NOT-FLVCR1 | 1 | 1 | 1 | COMPLEX-NKAIN2/SLC10A4/IL13RA1 | 0.994012 | 1 | 0.988095 |
| DPEP1 AND NOT-GPC3 AND NOT-CLDN15 | 1 | 1 | 1 | COMPLEX-CACNG3/SLC10A4/CLDN11 | 0.994012 | 1 | 0.988095 |
| DPEP1 AND NOT-CHRND AND NOT-GPC3 | 1 | 1 | 1 | SLC10A4 AND NOT-NKAIN2 AND NOT-DNAJB8 | 0.994012 | 1 | 0.988095 |
| CDH17 AND SLC7A5 AND NOT-GPC3 | 1 | 1 | 1 | SLC10A4 AND NOT-SSTR1 AND NOT-MRGPRX2 | 0.994012 | 1 | 0.988095 |
| CDH17 AND SLC7A5 AND NOT-ERBB2 | 1 | 1 | 1 | COMPLEX-SLC10A4/GABRB1/CLDN11 | 0.994012 | 1 | 0.988095 |
| IFI6 AND STEAP1 AND NOT-GPC3 | 1 | 1 | 1 | SLC10A4 AND NOT-SSTR1 AND NOT-MRGPRX2 | 0.994012 | 1 | 0.988095 |
| NOX1 AND THY1 AND NOT-MUC1 | 1 | 1 | 1 | SLC10A4 AND NOT-SSTR1 AND NOT-GLRA3 | 0.994012 | 1 | 0.988095 |
| NOX1 AND SLC7A5 AND NOT-GPC3 | 1 | 1 | 1 | COMPLEX-SLC10A4/KCNJ10/CLDN18 | 0.994012 | 1 | 0.988095 |
| NOX1 AND SLC7A5 AND NOT-ERBB2 | 1 | 1 | 1 | SLC10A4 AND NOT-NKAIN2 AND NOT-TYR | 0.994012 | 1 | 0.988095 |
| IFI6 AND IL20RA AND NOT-MUC1 | 1 | 1 | 1 | COMPLEX-SLC10A4/GPR26/CLDN11 | 0.994012 | 1 | 0.988095 |
| DPEP1 AND NOT-GPC3 AND NOT-ABCG5 | 1 | 1 | 1 | COMPLEX-NKAIN2/SLC10A4/IL13RA1 | 0.994012 | 1 | 0.988095 |
| DPEP1 AND NOT-ABCG5 AND ERBB2 | 1 | 1 | 1 | COMPLEX-NKAIN2/SLC10A4/KDR | 0.994012 | 1 | 0.988095 |
| IFI6 AND CLDN3 AND NOT-MUC1 | 1 | 1 | 1 | COMPLEX-CSPG5/SLC10A4/CLDN11 | 0.994012 | 1 | 0.988095 |
| IFI6 AND NOT-GPC3 AND EPCAM | 1 | 1 | 1 | SLC10A4 AND NOT-SSTR1 AND NOT-GNRHR | 0.994012 | 1 | 0.988095 |
| IFI6 AND MUC13 AND NOT-GPC3 | 1 | 1 | 1 | COMPLEX-MDGA2/SLC10A4/CLDN11 | 0.994012 | 1 | 0.988095 |
| NOX1 AND CLDN1 AND NOT-GPC3 | 1 | 1 | 1 | SLC10A4 AND NOT-FOLH1 AND NOT-GLRA3 | 0.994012 | 1 | 0.988095 |
| IFI6 AND GPA33 AND NOT-ERBB2 | 1 | 1 | 1 | SLC10A4 AND NOT-GABRB2 AND NOT-EGFR | 0.994012 | 1 | 0.988095 |
| DPEP1 AND NOT-GPC3 AND NOT-PTPRR | 1 | 1 | 1 | COMPLEX-SLC10A4/CLDN11/PAQR8 | 0.994012 | 1 | 0.988095 |
| DPEP1 AND NOT-SLC13A1 AND NOT-GPC3 | 1 | 1 | 1 | SLC10A4 AND NOT-SSTR1 AND NOT-CACNG6 | 0.994012 | 1 | 0.988095 |
| DPEP1 AND NOT-GPC3 AND VANGL1 | 1 | 1 | 1 | COMPLEX-CSMD3/SLC10A4/CLDN11 | 0.994012 | 1 | 0.988095 |
| DPEP1 AND NOT-GPC3 AND CD163 | 1 | 1 | 1 | COMPLEX-SLC10A4/KCNJ10/KDR | 0.994012 | 1 | 0.988095 |
| DPEP1 AND NOT-GPC3 AND CD44 | 1 | 1 | 1 | SLC10A4 AND NOT-SSTR1 AND NOT-ADAM7 | 0.994012 | 1 | 0.988095 |
| CDH17 AND THY1 AND NOT-ERBB2 | 1 | 1 | 1 | SLC10A4 AND NOT-GABRB2 AND NOT-EGFR | 0.994012 | 1 | 0.988095 |
| CDH17 AND THY1 AND NOT-GPC3 | 1 | 1 | 1 | SLC10A4 AND NOT-SSTR1 AND NOT-ADAM7 | 0.994012 | 1 | 0.988095 |
| IFI6 AND GPA33 AND NOT-ERBB2 | 1 | 1 | 1 | SLC10A4 AND NOT-SSTR1 AND SLC38A1 | 0.994012 | 1 | 0.988095 |
| DPEP1 AND NOT-SPAM1 AND MUC1 | 1 | 1 | 1 | SLC10A4 AND NOT-GABRB2 AND NOT-TYR | 0.994012 | 1 | 0.988095 |
| DPEP1 AND NOT-SLC13A1 AND MUC1 | 1 | 1 | 1 | COMPLEX-SLC10A4/KCNJ10/ULBP3 | 0.994012 | 1 | 0.988095 |

FIG. 15 (cont.)

| Antigen Pair Logic | F1 | Precision | Recall | Antigen Pair Logic | F1 | Precision | Recall |
|---|---|---|---|---|---|---|---|
| IFI6 AND CEACAM5 AND NOT-GPC3 | 1 | 1 | 1 | COMPLEX-SEMA4D/SLC10A4/CLDN11 | 0.994012 | 1 | 0.988095 |
| DPEP1 AND NOT-SLC28A1 AND ERBB2 | 1 | 1 | 1 | SLC10A4 AND NOT-KCNJ10 AND NOT-EGFR | 0.994012 | 1 | 0.988095 |
| IFI6 AND GUCY2C AND NOT-ERBB2 | 1 | 1 | 1 | COMPLEX-SLC10A4/TMEM235/CLDN11 | 0.994012 | 1 | 0.988095 |
| DPEP1 AND NOT-SLC28A1 AND NOT-GPC3 | 1 | 1 | 1 | COMPLEX-SEMA4D/SLC10A4/CLDN11 | 0.994012 | 1 | 0.988095 |
| DPEP1 AND NOT-GPC3 AND NOT-SLC31A1 | 1 | 1 | 1 | SLC10A4 AND NOT-SSTR1 AND NOT-SLC13A1 | 0.994012 | 1 | 0.988095 |
| CLDN3 AND TGFBI AND NOT-MUC1 | 1 | 1 | 1 | COMPLEX-SLC10A4/NTSR2/SSTR1 | 0.994012 | 1 | 0.988095 |
| TGFBI AND NOT-IL11RA AND MUC1 | 1 | 1 | 1 | SLC10A4 AND NOT-SSTR1 AND NOT-SCN10A | 0.994012 | 1 | 0.988095 |
| DPEP1 AND NOT-GPC3 AND NOT-SLC9A1 | 1 | 1 | 1 | SLC10A4 AND NOT-KCNJ10 AND NOT-MSLN | 0.994012 | 1 | 0.988095 |
| IFI6 AND IL20RA AND NOT-MUC1 | 1 | 1 | 1 | COMPLEX-LYPD1/SLC10A4/CLDN11 | 0.994012 | 1 | 0.988095 |
| DPEP1 AND NOT-LCT AND NOT-GPC3 | 1 | 1 | 1 | SLC10A4 AND NOT-SSTR1 AND NOT-HTR6 | 0.988095 | 0.988095 | 0.988095 |
| CDH17 AND THY1 AND NOT-MUC1 | 1 | 1 | 1 | SLC10A4 AND NOT-SSTR1 AND NOT-SEMA4B | 0.988095 | 0.988095 | 0.988095 |
| IFI6 AND MUC13 AND NOT-MUC1 | 1 | 1 | 1 | SLC10A4 AND NOT-SSTR1 AND NOT-CNGA4 | 0.988095 | 0.988095 | 0.988095 |
| DPEP1 AND NOT-SLC28A1 AND MSLN | 1 | 1 | 1 | SLC10A4 AND NOT-SSTR1 AND NOT-STEAP4 | 0.988095 | 0.988095 | 0.988095 |
| DPEP1 AND NOT-GPC3 AND CDH11 | 1 | 1 | 1 | SLC10A4 AND NOT-SSTR1 AND NOT-GPR6 | 0.988095 | 0.988095 | 0.988095 |
| DPEP1 AND NOT-CHRND AND NOT-GPC3 | 1 | 1 | 1 | COMPLEX-SLC10A4/TMEM235/CEACAM6 | 0.988095 | 0.988095 | 0.988095 |
| IFI6 AND MUC13 AND NOT-ERBB2 | 1 | 1 | 1 | SLC10A4 AND NOT-SSTR1 AND NOT-RXFP3 | 0.988095 | 0.988095 | 0.988095 |
| DPEP1 AND NOT-SLC13A1 AND MSLN | 1 | 1 | 1 | SLC10A4 AND NOT-SSTR1 AND NOT-OR2L2 | 0.988095 | 0.988095 | 0.988095 |
| DPEP1 AND NOT-CHRND AND ERBB2 | 1 | 1 | 1 | SLC10A4 AND NOT-DTNA AND NOT-TYR | 0.988095 | 0.988095 | 0.988095 |
| IFI6 AND GPA33 AND NOT-MSLN | 1 | 1 | 1 | SLC10A4 AND NOT-SSTR1 AND NOT-GRIK1 | 0.988095 | 0.988095 | 0.988095 |
| HEPH AND SLC39A10 AND CDH1 | 1 | 1 | 1 | SLC10A4 AND NOT-SSTR1 AND NOT-ROS1 | 0.988095 | 0.988095 | 0.988095 |
| HEPH AND SLC39A10 AND KCNQ4 | 1 | 1 | 1 | SLC10A4 AND NOT-SSTR1 AND NOT-SCARA5 | 0.988095 | 0.988095 | 0.988095 |
| HEPH AND SLC39A10 AND HTR3B | 1 | 1 | 1 | SLC10A4 AND NOT-TMEM235 AND NOT-EGFR | 0.988095 | 0.988095 | 0.988095 |
| HEPH AND SLC39A10 AND NOT-CDHR1 | 1 | 1 | 1 | COMPLEX-SLC10A4/ULBP3/OPALIN | 0.988095 | 0.988095 | 0.988095 |
| HEPH AND SLC39A10 AND NOT-CD7 | 1 | 1 | 1 | COMPLEX-SLC10A4/TMEM235/IL13RA1 | 0.988095 | 0.988095 | 0.988095 |
| HEPH AND SLC39A10 AND NOT-IGSF8 | 1 | 1 | 1 | SLC10A4 AND NOT-SSTR1 AND NOT-SCARA5 | 0.988095 | 0.988095 | 0.988095 |
| HEPH AND SLC39A10 AND GLP2R | 1 | 1 | 1 | COMPLEX-SLC10A4/TMEM235/SLC7A5 | 0.988095 | 0.988095 | 0.988095 |
| HEPH AND SLC39A10 AND NOT-FADS2 | 1 | 1 | 1 | COMPLEX-SLC10A4/HTR5A/SSTR1 | 0.988095 | 0.988095 | 0.988095 |
| HEPH AND SLC39A10 AND ABCG2 | 1 | 1 | 1 | SLC10A4 AND NOT-SSTR1 AND NOT-LRRC8E | 0.988095 | 0.988095 | 0.988095 |
| HEPH AND SLC39A10 AND AKAP6 | 1 | 1 | 1 | SLC10A4 AND NOT-KCNA1 AND NOT-EGFR | 0.988095 | 0.988095 | 0.988095 |
| LY75 AND JPH1 AND NOT-KCNG3 | 1 | 1 | 1 | COMPLEX-SLC10A4/TMEM235/EPCAM | 0.988095 | 0.988095 | 0.988095 |
| HEPH AND SLC39A10 AND NOT-CELSR1 | 1 | 1 | 1 | COMPLEX-SLC10A4/GABRA5/CLDN11 | 0.988095 | 0.988095 | 0.988095 |
| HEPH AND SLC39A10 AND NOT-ATP2C2 | 1 | 1 | 1 | COMPLEX-SLC10A4/GABRA5/CLDN11 | 0.988095 | 0.988095 | 0.988095 |
| NOT-LIFR AND CDH3 AND NOT-ATP13A4 | 1 | 1 | 1 | SLC10A4 AND NOT-SSTR1 AND NOT-CNGA4 | 0.988095 | 0.988095 | 0.988095 |
| NOT-SLC16A7 AND MMD AND ITGA2 | 1 | 1 | 1 | SLC10A4 AND NOT-SSTR1 AND NOT-XCR1 | 0.988095 | 0.988095 | 0.988095 |
| XK AND TACSTD2 AND NOT-PDE6B | 1 | 1 | 1 | COMPLEX-SLC10A4/EPHA3/TMEM235 | 0.988095 | 0.988095 | 0.988095 |
| XK AND TACSTD2 AND ATRAID | 1 | 1 | 1 | SLC10A4 AND NOT-SSTR1 AND NOT-ATP1B4 | 0.988095 | 0.988095 | 0.988095 |
| HEPH AND SLC39A10 AND NOT-SYT12 | 1 | 1 | 1 | GPR19 AND PTK7 AND NOT-KCNA1 | 0.957576 | 0.975309 | 0.940476 |
| HEPH AND SLC39A10 AND NOT-ACVR1 | 1 | 1 | 1 | GPR19 AND PTK7 AND NOT-OR5P3 | 0.946108 | 0.951807 | 0.940476 |
| HEPH AND SLC39A10 AND ITGA8 | 1 | 1 | 1 | CACNA1B AND NOT-MRGPRX2 AND PTK7 | 0.939024 | 0.9625 | 0.916667 |
| HEPH AND SLC39A10 AND SYT7 | 1 | 1 | 1 | GPR19 AND PTK7 AND NOT-GNRHR | 0.934911 | 0.929412 | 0.940476 |
| HEPH AND SLC39A10 AND NOT-DEGS1 | 1 | 1 | 1 | GPR19 AND PTK7 AND NOT-OR2L2 | 0.934911 | 0.929412 | 0.940476 |
| HEPH AND SLC39A10 AND CAV3 | 1 | 1 | 1 | GPR19 AND PTK7 AND NOT-MRGPRX2 | 0.934911 | 0.929412 | 0.940476 |
| HEPH AND SLC39A10 AND UNC5C | 1 | 1 | 1 | KCNQ2 AND NOT-MRGPRX2 AND PTK7 | 0.932515 | 0.962025 | 0.904762 |
| HEPH AND SLC39A10 AND SLC4A4 | 1 | 1 | 1 | GPR19 AND PTK7 AND NOT-CACNA1S | 0.929412 | 0.918605 | 0.940476 |
| HEPH AND SLC39A10 AND NOT-TNFRSF25 | 1 | 1 | 1 | GPR19 AND PTK7 AND NOT-GABRG3 | 0.929412 | 0.918605 | 0.940476 |
| HEPH AND SLC39A10 AND NOT-ADAM23 | 1 | 1 | 1 | CACNA1B AND NOT-CACNA1S AND PTK7 | 0.925 | 0.973684 | 0.880952 |
| HEPH AND SLC39A10 AND TNFRSF11A | 1 | 1 | 1 | KCNQ2 AND NOT-CACNA1S AND PTK7 | 0.924051 | 0.986486 | 0.869048 |
| HEPH AND SLC39A10 AND IL18RAP | 1 | 1 | 1 | GPR19 AND PTK7 AND NOT-SLC13A1 | 0.923977 | 0.908046 | 0.940476 |
| HEPH AND SLC39A10 AND VNN2 | 1 | 1 | 1 | GPR19 AND PTK7 AND NOT-LCT | 0.923977 | 0.908046 | 0.940476 |
| HEPH AND SLC39A10 AND CACNA1H | 1 | 1 | 1 | GPR19 AND PTK7 AND NOT-ADAM7 | 0.923977 | 0.908046 | 0.940476 |
| HEPH AND SLC39A10 AND SIGLEC10 | 1 | 1 | 1 | GPR19 AND PTK7 AND NOT-CACNG7 | 0.923977 | 0.908046 | 0.940476 |
| HEPH AND SLC39A10 AND NOT-RHOT2 | 1 | 1 | 1 | GPR19 AND PTK7 AND NOT-KCNA10 | 0.923077 | 0.917647 | 0.928571 |
| HEPH AND SLC39A10 AND NOT-TSPAN18 | 1 | 1 | 1 | CACNA1B AND NOT-ROS1 AND PTK7 | 0.922156 | 0.927711 | 0.916667 |
| HEPH AND SLC39A10 AND TM4SF5 | 1 | 1 | 1 | CACNA1B AND NOT-GNRHR AND PTK7 | 0.922156 | 0.927711 | 0.916667 |
| HEPH AND SLC39A10 AND NOT-DUOXA1 | 1 | 1 | 1 | CACNA1B AND NOT-OR5P3 AND PTK7 | 0.922156 | 0.927711 | 0.916667 |
| XK AND TACSTD2 AND NOT-LIFR | 1 | 1 | 1 | NKAIN1 AND NOT-GGTLC1 AND PTK7 | 0.920245 | 0.949367 | 0.892857 |
| XK AND TACSTD2 AND NOT-KCNJ12 | 1 | 1 | 1 | GPR19 AND PTK7 AND NOT-TMPRSS11B | 0.918605 | 0.897727 | 0.940476 |
| XK AND TACSTD2 AND NOT-SLC13A4 | 1 | 1 | 1 | GPR19 AND PTK7 AND NOT-ROS1 | 0.918605 | 0.897727 | 0.940476 |
| XK AND TACSTD2 AND NOT-C1orf101 | 1 | 1 | 1 | GPR19 AND PTK7 AND NOT-TRPM1 | 0.918605 | 0.897727 | 0.940476 |
| HEPH AND TACSTD2 AND NOT-LIFR | 1 | 1 | 1 | KCNQ2 AND PTK7 AND NOT-TRPM1 | 0.918239 | 0.973333 | 0.869048 |
| NOT-SLC16A7 AND TM4SF5 AND NOT-FLVCR2 | 1 | 1 | 1 | KCNQ2 AND PTK7 AND NOT-CACNG7 | 0.918239 | 0.973333 | 0.869048 |
| JPH1 AND TM4SF5 AND NOT-FLVCR2 | 1 | 1 | 1 | GPR19 AND PTK7 AND NOT-GJA10 | 0.917647 | 0.906977 | 0.928571 |
| ATP10B AND NOT-FLVCR2 AND NOT-SEMA6A | 1 | 1 | 1 | GPR19 AND PTK7 AND NOT-SLC22A11 | 0.917647 | 0.906977 | 0.928571 |
| TM4SF5 AND CDH3 AND NOT-P2RX6 | 1 | 1 | 1 | CACNA1B AND PTK7 AND NOT-CACNG7 | 0.916667 | 0.916667 | 0.916667 |
| TM4SF5 AND CDH3 AND NOT-KCNQ5 | 1 | 1 | 1 | GPR19 AND PTK7 AND NOT-CLDN17 | 0.916667 | 0.916667 | 0.916667 |
| HEPH AND SLC39A10 AND NOT-CNNM4 | 1 | 1 | 1 | CACNA1B AND NOT-SLC22A11 AND PTK7 | 0.915663 | 0.926829 | 0.904762 |
| HEPH AND SLC39A10 AND PRRG1 | 1 | 1 | 1 | KCNQ2 AND NOT-OR5P3 AND PTK7 | 0.915663 | 0.926829 | 0.904762 |
| TM4SF5 AND CDH3 AND NOT-KCNS2 | 1 | 1 | 1 | ASTN1 AND NOT-MLC1 AND NOT-CLDN1 | 0.914286 | 0.879121 | 0.952381 |
| ATP10B AND AMIGO2 AND NOT-SLC36A1 | 1 | 1 | 1 | GPR19 AND PTK7 AND NOT-GRIN2B | 0.913295 | 0.88764 | 0.940476 |
| NOT-SLC16A7 AND CALCRL AND IGSF9 | 1 | 1 | 1 | GPR19 AND PTK7 AND NOT-SLC5A8 | 0.913295 | 0.88764 | 0.940476 |
| NOT-SLC16A7 AND CALCRL AND CA12 | 1 | 1 | 1 | GPR19 AND PTK7 AND NOT-TRHR | 0.913295 | 0.88764 | 0.940476 |
| ATP10B AND AMIGO2 AND NOT-ACVR1C | 1 | 1 | 1 | GPR19 AND PTK7 AND NOT-MIP | 0.913295 | 0.88764 | 0.940476 |
| JPH1 AND NOT-AQP4 AND FXYD5 | 1 | 1 | 1 | GPR19 AND PTK7 AND NOT-MOG | 0.913295 | 0.88764 | 0.940476 |
| XK AND AMIGO2 AND NOT-ADCY5 | 1 | 1 | 1 | KCNQ2 AND NOT-GGTLC1 AND PTK7 | 0.9125 | 0.960526 | 0.869048 |
| TM4SF5 AND NOT-LIFR AND TACSTD2 | 1 | 1 | 1 | KCNQ2 AND PTK7 AND NOT-SLC5A8 | 0.9125 | 0.960526 | 0.869048 |
| TSPAN8 AND NOT-LIFR AND TACSTD2 | 1 | 1 | 1 | GPR19 AND PTK7 AND NOT-UMODL1 | 0.912281 | 0.896552 | 0.928571 |
| MEP1A AND TACSTD2 AND NOT-LIFR | 1 | 1 | 1 | ASTN1 AND NOT-MLC1 AND NOT-WT1 | 0.911243 | 0.905882 | 0.916667 |

FIG. 15 (cont.)

| Antigen Pair Logic | F1 | Precision | Recall |
|---|---|---|---|
| HEPH AND SLC39A10 AND NOT-ATP6V0A1 | 1 | 1 | 1 |
| XK AND TACSTD2 AND NOT-CRHR2 | 1 | 1 | 1 |
| XK AND TACSTD2 AND NOT-CNR1 | 1 | 1 | 1 |
| XK AND TACSTD2 AND NOT-TLR6 | 1 | 1 | 1 |
| COMPLEX-ATP6V0A1/EVA1A/HEPH | 1 | 1 | 1 |
| HEPH AND NOT-ATP6V0A1 AND WNT5A | 1 | 1 | 1 |
| HEPH AND NOT-ATP6V0A1 AND SLC3A2 | 1 | 1 | 1 |
| HEPH AND NOT-ATP6V0A1 AND TM4SF1 | 1 | 1 | 1 |
| IYD AND TACSTD2 AND NOT-LIFR | 1 | 1 | 1 |
| HEPH AND NOT-ATP6V0A1 AND NOT-BEST4 | 1 | 1 | 1 |
| NOT-LIFR AND TACSTD2 AND TSPAN1 | 1 | 1 | 1 |
| NOT-LIFR AND TACSTD2 AND TSPAN15 | 1 | 1 | 1 |
| NOT-LIFR AND TACSTD2 AND PARM1 | 1 | 1 | 1 |
| PVRL3 AND NOT-LIFR AND TACSTD2 | 1 | 1 | 1 |
| COMPLEX-IL6R/EVA1A/HEPH | 1 | 1 | 1 |
| HEPH AND SLC39A10 AND ABCC11 | 1 | 1 | 1 |
| HEPH AND SLC39A10 AND COL25A1 | 1 | 1 | 1 |
| HEPH AND SLC39A10 AND NOT-IL20RB | 1 | 1 | 1 |
| HEPH AND SLC39A10 AND NOT-PTGER3 | 1 | 1 | 1 |
| HEPH AND SLC39A10 AND NOT-NLGN2 | 1 | 1 | 1 |
| HEPH AND SLC39A10 AND ISLR2 | 1 | 1 | 1 |
| HEPH AND SLC39A10 AND LRRC4C | 1 | 1 | 1 |
| HEPH AND SLC39A10 AND PTPRG | 1 | 1 | 1 |
| HEPH AND SLC39A10 AND PTPRN | 1 | 1 | 1 |
| HEPH AND SLC39A10 AND NOT-JAM2 | 1 | 1 | 1 |
| HEPH AND SLC39A10 AND NOT-LGR6 | 1 | 1 | 1 |
| HEPH AND SLC39A10 AND RHCE | 1 | 1 | 1 |
| HEPH AND SLC39A10 AND SLC5A7 | 1 | 1 | 1 |
| HEPH AND SLC39A10 AND RTN2 | 1 | 1 | 1 |
| HEPH AND SLC39A10 AND NOT-SCN1B | 1 | 1 | 1 |
| HEPH AND SLC39A10 AND NOT-SCN4B | 1 | 1 | 1 |
| HEPH AND SLC39A10 AND SCTR | 1 | 1 | 1 |
| HEPH AND SLC39A10 AND SECTM1 | 1 | 1 | 1 |
| HEPH AND SLC39A10 AND NOT-PERP | 1 | 1 | 1 |
| HEPH AND SLC39A10 AND DSCAML1 | 1 | 1 | 1 |
| HEPH AND SLC39A10 AND CYSLTR2 | 1 | 1 | 1 |
| HEPH AND SLC39A10 AND EVA1A | 1 | 1 | 1 |
| HEPH AND SLC39A10 AND NOT-SLC17A7 | 1 | 1 | 1 |
| HEPH AND SLC39A10 AND NOT-GPR173 | 1 | 1 | 1 |
| HEPH AND SLC39A10 AND TAS2R5 | 1 | 1 | 1 |
| HEPH AND SLC39A10 AND SLC6A20 | 1 | 1 | 1 |
| HEPH AND SLC39A10 AND NOT-TRPM7 | 1 | 1 | 1 |
| NOT-SLC16A7 AND TGFBI AND JPH1 | 1 | 1 | 1 |
| IFI6 AND MEP1A AND NOT-ADRB3 | 1 | 1 | 1 |
| IFI6 AND B3GNT3 AND NOT-DUOX1 | 1 | 1 | 1 |
| IFI6 AND MEP1A AND CD9 | 1 | 1 | 1 |
| IFI6 AND NOT-CLEC2D AND LY75 | 1 | 1 | 1 |
| NOX1 AND IFITM1 AND NOT-LRMP | 1 | 1 | 1 |
| IFI6 AND NOT-CLEC2D AND PAQR5 | 1 | 1 | 1 |
| IFI6 AND SLC39A4 AND NOT-CLEC2D | 1 | 1 | 1 |
| IFI6 AND NOT-SLC16A7 AND TMEM47 | 1 | 1 | 1 |
| IFI6 AND SLC5A1 AND NOT-TMEM47 | 1 | 1 | 1 |
| IFI6 AND ATP10B AND ATP1B1 | 1 | 1 | 1 |
| NOX1 AND AMIGO2 AND NOT-LRMP | 1 | 1 | 1 |
| IFI6 AND PPAP2C AND NOT-CLEC2D | 1 | 1 | 1 |
| NOX1 AND EDNRA AND NOT-LRMP | 1 | 1 | 1 |
| IFI6 AND SLC26A3 AND ATP1B1 | 1 | 1 | 1 |
| IFI6 AND ST14 AND NOT-ADRB3 | 1 | 1 | 1 |
| IFI6 AND NOT-ADRB3 AND SLC52A2 | 1 | 1 | 1 |
| IFI6 AND NOT-CLEC2D AND CXCR1 | 1 | 1 | 1 |
| IFI6 AND NOT-CLEC2D AND ATP6V0A2 | 1 | 1 | 1 |
| IFI6 AND GJB3 AND NOT-IL1RL1 | 1 | 1 | 1 |
| IFI6 AND MEP1A AND NOT-ISLR2 | 1 | 1 | 1 |
| IFI6 AND NOT-SLC19A3 AND ADAM15 | 1 | 1 | 1 |
| IFI6 AND SLC35G1 AND NOT-ISLR2 | 1 | 1 | 1 |
| IFI6 AND NOT-SLC19A3 AND GAL3ST1 | 1 | 1 | 1 |
| IFI6 AND PPAP2C AND NOT-IZUMO1 | 1 | 1 | 1 |
| IFI6 AND DUOX2 AND NOT-GPR63 | 1 | 1 | 1 |
| IFI6 AND SLC39A4 AND NOT-IZUMO1 | 1 | 1 | 1 |
| IFI6 AND DUOX2 AND NOT-KCNH7 | 1 | 1 | 1 |
| IFI6 AND DUOX2 AND NOT-SLC16A7 | 1 | 1 | 1 |
| IFI6 AND NOT-CLEC2D AND CYBA | 1 | 1 | 1 |
| IFI6 AND NOT-ADRB3 AND SLC27A4 | 1 | 1 | 1 |
| IFI6 AND DUOX2 AND NOT-KCNB2 | 1 | 1 | 1 |
| IFI6 AND DUOX2 AND NOT-ACVR2B | 1 | 1 | 1 |
| IFI6 AND DUOX2 AND NOT-NRG2 | 1 | 1 | 1 |
| IFI6 AND SLC35G1 AND NOT-ADRB3 | 1 | 1 | 1 |

| Antigen Pair Logic | F1 | Precision | Recall |
|---|---|---|---|
| GPR19 AND PTK7 AND NOT-CLRN1 | 0.911243 | 0.905882 | 0.916667 |
| CACNA1B AND NOT-ADAM7 AND PTK7 | 0.911243 | 0.905882 | 0.916667 |
| CACNA1B AND NOT-OR2L2 AND PTK7 | 0.911243 | 0.905882 | 0.916667 |
| CACNA1B AND NOT-TMPRSS11B AND PTK7 | 0.911243 | 0.905882 | 0.916667 |
| CACNA1B AND NOT-GRIN2B AND PTK7 | 0.911243 | 0.905882 | 0.916667 |
| SLC6A15 AND NOT-KCNA1 AND PTK7 | 0.910256 | 0.986111 | 0.845238 |
| KCNQ2 AND NOT-TMPRSS11B AND PTK7 | 0.91018 | 0.915663 | 0.904762 |
| CACNA1B AND NOT-GGTLC1 AND PTK7 | 0.91018 | 0.915663 | 0.904762 |
| KCNQ2 AND NOT-GNRHR AND PTK7 | 0.91018 | 0.915663 | 0.904762 |
| KCNQ2 AND NOT-ROS1 AND PTK7 | 0.91018 | 0.915663 | 0.904762 |
| CACNA1B AND NOT-CLRN1 AND PTK7 | 0.91018 | 0.915663 | 0.904762 |
| KCNQ2 AND NOT-SLC22A11 AND PTK7 | 0.909091 | 0.925926 | 0.892857 |
| GPR19 AND PTK7 AND NOT-SLC12A3 | 0.908046 | 0.877778 | 0.940476 |
| GPR19 AND PTK7 AND NOT-SLC28A1 | 0.908046 | 0.877778 | 0.940476 |
| KCNQ2 AND NOT-MOG AND PTK7 | 0.905882 | 0.895349 | 0.916667 |
| CACNA1B AND NOT-GABRG3 AND PTK7 | 0.905882 | 0.895349 | 0.916667 |
| CACNA1B AND NOT-MOG AND PTK7 | 0.905882 | 0.895349 | 0.916667 |
| CACNA1B AND NOT-LCT AND PTK7 | 0.905882 | 0.895349 | 0.916667 |
| KCNQ2 AND NOT-GPR6 AND PTK7 | 0.904762 | 0.904762 | 0.904762 |
| KCNQ2 AND NOT-GRIN2B AND PTK7 | 0.904762 | 0.904762 | 0.904762 |
| GPR19 AND PTK7 AND NOT-UPK3A | 0.902857 | 0.868132 | 0.940476 |
| GPR19 AND PTK7 AND NOT-CCR9 | 0.902857 | 0.868132 | 0.940476 |
| KCNQ2 AND PTK7 AND NOT-UMODL1 | 0.901235 | 0.935897 | 0.869048 |
| KCNQ2 AND PTK7 AND NOT-GPR61 | 0.901235 | 0.935897 | 0.869048 |
| CACNA1B AND NOT-MIP AND PTK7 | 0.900585 | 0.885057 | 0.916667 |
| CACNA1B AND NOT-SLC13A1 AND PTK7 | 0.900585 | 0.885057 | 0.916667 |
| CACNA1B AND PTK7 AND NOT-SLC5A8 | 0.900585 | 0.885057 | 0.916667 |
| CACNA1B AND NOT-TRPM1 AND PTK7 | 0.900585 | 0.885057 | 0.916667 |
| CACNA1B AND NOT-SLC28A1 AND PTK7 | 0.900585 | 0.885057 | 0.916667 |
| CACNA1B AND NOT-SLC12A3 AND PTK7 | 0.900585 | 0.885057 | 0.916667 |
| KCNQ2 AND NOT-ADAM7 AND PTK7 | 0.899408 | 0.894118 | 0.904762 |
| KCNQ2 AND NOT-KCNA10 AND PTK7 | 0.898204 | 0.903614 | 0.892857 |
| KCNQ2 AND NOT-CLRN1 AND PTK7 | 0.898204 | 0.903614 | 0.892857 |
| NKAIN1 AND NOT-CLDN8 AND NOT-CALHM1 | 0.89697 | 0.91358 | 0.880952 |
| ASTN1 AND NOT-MLC1 AND NOT-TYR | 0.901734 | 0.876404 | 0.928571 |
| NKAIN1 AND NOT-CLRN1 AND PTK7 | 0.89441 | 0.935065 | 0.857143 |
| CACNA1B AND NOT-CLDN17 AND PTK7 | 0.894118 | 0.883721 | 0.904762 |
| KCNQ2 AND NOT-LCT AND PTK7 | 0.894118 | 0.883721 | 0.904762 |
| KCNQ2 AND NOT-OR2L2 AND PTK7 | 0.894118 | 0.883721 | 0.904762 |
| SCN2A AND PTK7 AND NOT-CACNA1S | 0.893082 | 0.946667 | 0.845238 |
| UNC5A AND PTK7 AND NOT-MRGPRX2 | 0.898734 | 0.959459 | 0.845238 |
| SCN2A AND PTK7 AND NOT-CACNG7 | 0.893082 | 0.946667 | 0.845238 |
| UNC5A AND PTK7 AND NOT-ROS1 | 0.904459 | 0.972603 | 0.845238 |
| ASTN1 AND NOT-NKAIN2 AND NOT-CLDN8 | 0.893082 | 0.946667 | 0.845238 |
| SCN2A AND PTK7 AND NOT-OR5P3 | 0.893082 | 0.946667 | 0.845238 |
| COMPLEX-SSTR1/NKAIN1/TMPRSS11D | 0.892857 | 0.892857 | 0.892857 |
| GPR19 AND PTK7 AND NOT-GPR6 | 0.892655 | 0.849462 | 0.940476 |
| GPR19 AND PTK7 AND NOT-HTR1F | 0.892655 | 0.849462 | 0.940476 |
| SLC6A15 AND PTK7 AND NOT-OR5P3 | 0.89172 | 0.958904 | 0.833333 |
| SLC6A15 AND NOT-MRGPRX2 AND PTK7 | 0.89172 | 0.958904 | 0.833333 |
| CACNA1B AND PTK7 AND NOT-UMODL1 | 0.888889 | 0.873563 | 0.904762 |
| NOT-EGFR AND ATP7A AND NOT-BTN3A1 | 0.888889 | 0.873563 | 0.904762 |
| KCNQ2 AND NOT-SLC13A1 AND PTK7 | 0.888889 | 0.873563 | 0.904762 |
| CACNA1B AND PTK7 AND NOT-PCDH15 | 0.888889 | 0.873563 | 0.904762 |
| KCNQ2 AND NOT-HTR1F AND PTK7 | 0.888889 | 0.873563 | 0.904762 |
| KCNQ2 AND NOT-SLC12A3 AND PTK7 | 0.888889 | 0.873563 | 0.904762 |
| GPR19 AND PTK7 AND NOT-OR1C1 | 0.88764 | 0.840426 | 0.940476 |
| NOT-EGFR AND PTK7 AND EBP | 0.938272 | 0.974359 | 0.904762 |
| NOT-EGFR AND CD276 AND NOT-EMP3 | 0.934911 | 0.929412 | 0.940476 |
| NOT-EGFR AND PTK7 AND NOT-EMP3 | 0.927711 | 0.939024 | 0.916667 |
| NOT-EGFR AND PTK7 AND NOT-ROS1 | 0.934911 | 0.929412 | 0.940476 |
| NOT-EGFR AND PTK7 AND NOT-DSC1 | 0.946108 | 0.951807 | 0.940476 |
| NOT-EGFR AND PTK7 AND NOT-GGTLC1 | 0.934911 | 0.929412 | 0.940476 |
| KCNQ2 AND PTK7 AND NOT-GUCY2C | 0.924051 | 0.986486 | 0.869048 |
| NOT-EGFR AND PTK7 AND NOT-BTN3A1 | 0.940476 | 0.940476 | 0.940476 |
| NOT-EGFR AND PTK7 AND NOT-TMPRSS11B | 0.951807 | 0.963415 | 0.940476 |
| NOT-EGFR AND PTK7 AND NOT-LCT | 0.946108 | 0.951807 | 0.940476 |
| NOT-EGFR AND PTK7 AND NOT-CACNA1S | 0.934911 | 0.929412 | 0.940476 |
| CACNA1B AND PTK7 AND NOT-GUCY2C | 0.916667 | 0.916667 | 0.916667 |
| COMPLEX-EGFR/NKAIN1/CD33 | 0.914634 | 0.9375 | 0.892857 |
| GPR19 AND PTK7 AND NOT-ITGB3 | 0.913295 | 0.88764 | 0.940476 |
| NOT-EGFR AND PTK7 AND ATP13A5 | 0.91018 | 0.915663 | 0.904762 |
| NOT-EGFR AND CD276 AND NOT-DSC1 | 0.909091 | 0.869565 | 0.952381 |
| GPR19 AND PTK7 AND NOT-CLDN2 | 0.908046 | 0.877778 | 0.940476 |
| GPR19 AND PTK7 AND NOT-GUCY2C | 0.908046 | 0.877778 | 0.940476 |
| KCNQ2 AND PTK7 AND NOT-CLDN2 | 0.906832 | 0.948052 | 0.869048 |
| CACNA1B AND PTK7 AND NOT-CLDN2 | 0.905882 | 0.895349 | 0.916667 |

FIG. 15 (cont.)

| Antigen Pair Logic | F1 | Precision | Recall |
|---|---|---|---|
| IFI6 AND SLC39A4 AND NOT-OR10H1 | 1 | 1 | 1 |
| IFI6 AND ST14 AND NOT-ISLR2 | 1 | 1 | 1 |
| IFI6 AND TNFRSF11A AND NOT-ADRB3 | 1 | 1 | 1 |
| IFI6 AND ATP10B AND NOT-IL1RL1 | 1 | 1 | 1 |
| IFI6 AND AKAP1 AND NOT-SLC19A3 | 1 | 1 | 1 |
| IFI6 AND PTPRH AND NOT-INSRR | 1 | 1 | 1 |
| IFI6 AND B3GNT3 AND NOT-SLC38A4 | 1 | 1 | 1 |
| IFI6 AND SLC44A3 AND NOT-SLC26A7 | 1 | 1 | 1 |
| IFI6 AND GPRC5A AND NOT-INSRR | 1 | 1 | 1 |
| IFI6 AND SLC26A3 AND NOT-SLC26A7 | 1 | 1 | 1 |
| IFI6 AND ATP10B AND NOT-SLC26A7 | 1 | 1 | 1 |
| IFI6 AND CDCP1 AND NOT-INSRR | 1 | 1 | 1 |
| IFI6 AND OR2F1 AND NOT-SLC26A7 | 1 | 1 | 1 |
| IFI6 AND NOT-SLC4A3 AND PIGU | 1 | 1 | 1 |
| IFI6 AND PAQR5 AND NOT-PTPRM | 1 | 1 | 1 |
| IFI6 AND NOT-ATP6V0A1 AND KCNMA1 | 1 | 1 | 1 |
| IFI6 AND DUOX2 AND NOT-INSRR | 1 | 1 | 1 |
| IFI6 AND KCNK1 AND NOT-INSRR | 1 | 1 | 1 |
| IFI6 AND ITGA2 AND NOT-SLC26A7 | 1 | 1 | 1 |
| IFI6 AND MEP1A AND NOT-SLC4A3 | 1 | 1 | 1 |
| IFI6 AND PPAP2C AND NOT-RXFP1 | 1 | 1 | 1 |
| IFI6 AND ST14 AND NOT-SLC4A3 | 1 | 1 | 1 |
| IFI6 AND SLC39A4 AND NOT-PTPRM | 1 | 1 | 1 |
| IFI6 AND JPH1 AND NOT-ATP6V0A1 | 1 | 1 | 1 |
| IFI6 AND CYBA AND NOT-CCR3 | 1 | 1 | 1 |
| IFI6 AND KCNK1 AND NOT-GPR55 | 1 | 1 | 1 |
| IFI6 AND SLC26A3 AND NOT-IL1RL1 | 1 | 1 | 1 |
| IFI6 AND SLC44A3 AND NOT-IL1RL1 | 1 | 1 | 1 |
| IFI6 AND NOT-CCR3 AND ATP6V0A2 | 1 | 1 | 1 |
| IFI6 AND NOT-CCR3 AND CXCR1 | 1 | 1 | 1 |
| IFI6 AND GPRC5A AND NOT-PEAR1 | 1 | 1 | 1 |
| IFI6 AND MEP1A AND NOT-IL17RB | 1 | 1 | 1 |
| IFI6 AND PAQR5 AND NOT-CCR3 | 1 | 1 | 1 |
| IFI6 AND LGR4 AND NOT-SLC38A4 | 1 | 1 | 1 |
| IFI6 AND SLC39A4 AND NOT-CCR3 | 1 | 1 | 1 |
| IFI6 AND DUOX2 AND NOT-GPR55 | 1 | 1 | 1 |
| IFI6 AND PPAP2C AND NOT-CCR3 | 1 | 1 | 1 |
| IFI6 AND SLC5A1 AND NOT-ATP6V0A1 | 1 | 1 | 1 |
| IFI6 AND SLC5A1 AND NOT-SLC38A4 | 1 | 1 | 1 |
| IFI6 AND JPH1 AND NOT-SLC38A4 | 1 | 1 | 1 |
| IFI6 AND IL17RB AND NOT-SLC38A4 | 1 | 1 | 1 |
| IFI6 AND DUOX2 AND NOT-VIPR2 | 1 | 1 | 1 |
| IFI6 AND NOT-SLC19A3 AND FAT4 | 1 | 1 | 1 |
| IFI6 AND NOT-SLC16A7 AND PAQR5 | 1 | 1 | 1 |
| IFI6 AND SLC44A3 AND NOT-CHRNE | 1 | 1 | 1 |
| IFI6 AND ATP10B AND NOT-PCDH20 | 1 | 1 | 1 |
| IFI6 AND SLC26A3 AND NOT-PCDH20 | 1 | 1 | 1 |
| IFI6 AND DUOX2 AND NOT-TAS2R50 | 1 | 1 | 1 |
| IFI6 AND CFTR AND NOT-CHRNE | 1 | 1 | 1 |
| IFI6 AND SYT13 AND NOT-NPY2R | 1 | 1 | 1 |
| IFI6 AND DUOX2 AND NOT-GLRA1 | 1 | 1 | 1 |
| IFI6 AND SYT13 AND VIMP | 1 | 1 | 1 |
| IFI6 AND DUOX2 AND PTK7 AND NOT-NLGN4Y | 1 | 1 | 1 |
| IFI6 AND MEP1A AND NOT-SLC8A1 | 1 | 1 | 1 |
| IFI6 AND SYT13 AND NOT-WDR19 | 1 | 1 | 1 |
| IFI6 AND DUOX2 AND NOT-GRM2 | 1 | 1 | 1 |
| IFI6 AND DUOX2 AND NOT-HCRTR2 | 1 | 1 | 1 |
| IFI6 AND SLC26A3 AND NOT-CHRNE | 1 | 1 | 1 |
| IFI6 AND ATP10B AND NOT-CHRNE | 1 | 1 | 1 |
| IFI6 AND OR2F1 AND NOT-CHRNE | 1 | 1 | 1 |
| IFI6 AND SYT13 AND NOT-GRIA2 | 1 | 1 | 1 |
| IFI6 AND DUOX2 AND NOT-FGFR2 | 1 | 1 | 1 |
| MEP1A AND SLC39A10 AND NOT-GPC3 | 1 | 1 | 1 |
| MEP1A AND TACSTD2 AND NOT-GPC3 | 1 | 1 | 1 |
| NOT-SLC16A7 AND SLC39A10 AND MUC1 | 1 | 1 | 1 |
| XK AND CDH3 AND NOT-MUC1 | 1 | 1 | 1 |
| MEP1A AND CDH3 AND NOT-MUC1 | 1 | 1 | 1 |
| ATP10B AND NOT-FLVCR2 AND NOT-MUC1 | 1 | 1 | 1 |
| MEP1A AND TACSTD2 AND NOT-GPC3 | 1 | 1 | 1 |
| MEP1A AND SLC39A10 AND NOT-MUC1 | 1 | 1 | 1 |
| MEP1A AND SLC39A10 AND NOT-ERBB2 | 1 | 1 | 1 |
| NOT-LIFR AND CD81 AND MUC1 | 1 | 1 | 1 |
| HEPH AND SLC39A10 AND NOT-ERBB2 | 1 | 1 | 1 |
| IYD AND CDH3 AND NOT-MUC1 | 1 | 1 | 1 |
| IYD AND SLC39A10 AND NOT-GPC3 | 1 | 1 | 1 |
| IYD AND NOT-ABHD6 AND NOT-GPC3 | 1 | 1 | 1 |
| HEPH AND SLC39A10 AND MSLN | 1 | 1 | 1 |

| Antigen Pair Logic | F1 | Precision | Recall |
|---|---|---|---|
| CACNA1B AND NOT-ITGB3 AND PTK7 | 0.900585 | 0.885057 | 0.916667 |
| NKAIN1 AND NOT-CLDN8 AND NOT-SSTR1 | 0.898204 | 0.903614 | 0.892857 |
| NOT-EGFR AND PTK7 AND OR1C1 | 0.89697 | 0.91358 | 0.880952 |
| KCNQ2 AND PTK7 AND NOT-MUC16 | 0.89441 | 0.935065 | 0.857143 |
| KCNQ2 AND NOT-ITGB3 AND PTK7 | 0.894118 | 0.883721 | 0.904762 |
| SCN2A AND PTK7 AND NOT-GUCY2C | 0.893082 | 0.946667 | 0.845238 |
| NKAIN1 AND NOT-CLDN8 AND NOT-GPA33 | 0.887574 | 0.882353 | 0.892857 |
| CACNA1B AND PTK7 AND NOT-MUC16 | 0.883721 | 0.863636 | 0.904762 |
| UNC5A AND PTK7 AND NOT-CLDN2 | 0.881988 | 0.922078 | 0.845238 |
| UNC5A AND PTK7 AND NOT-GUCY2C | 0.881988 | 0.922078 | 0.845238 |
| NOT-EGFR AND BMPR1B AND NOT-BTN3A1 | 0.878049 | 0.9 | 0.857143 |
| NOT-EGFR AND BMPR1B AND NOT-DSC1 | 0.878049 | 0.9 | 0.857143 |
| NOT-EGFR AND BMPR1B AND NOT-EMP3 | 0.878049 | 0.9 | 0.857143 |
| SCN2A AND PTK7 AND NOT-ITGB3 | 0.876543 | 0.910256 | 0.845238 |
| SCN2A AND PTK7 AND NOT-CLDN2 | 0.871166 | 0.898734 | 0.845238 |
| NKAIN1 AND NOT-CLDN8 AND NOT-CLDN18 | 0.867052 | 0.842697 | 0.892857 |
| NOT-EGFR AND FLVCR1 AND NOT-CD37 | 0.866242 | 0.931507 | 0.809524 |
| GPR85 AND PTK7 AND NOT-GUCY2C | 0.866242 | 0.931507 | 0.809524 |
| UNC5A AND PTK7 AND NOT-ITGB3 | 0.865854 | 0.8875 | 0.845238 |
| SLC6A15 AND PTK7 AND NOT-GUCY2C | 0.864198 | 0.897436 | 0.833333 |
| SLC6A15 AND PTK7 AND NOT-CLDN2 | 0.864198 | 0.897436 | 0.833333 |
| SCN2A AND PTK7 AND NOT-MUC16 | 0.864198 | 0.897436 | 0.833333 |
| GPR85 AND PTK7 AND NOT-CLDN2 | 0.860759 | 0.918919 | 0.809524 |
| UNC5A AND PTK7 AND NOT-MUC16 | 0.858896 | 0.886076 | 0.833333 |
| NOT-EGFR AND ATP7A AND NOT-CD33 | 0.858757 | 0.817204 | 0.904762 |
| NOT-EGFR AND PTK7 AND UMODL1 | 0.853503 | 0.917808 | 0.797619 |
| NOT-EGFR AND PTK7 AND TRPM1 | 0.853503 | 0.917808 | 0.797619 |
| SLC6A15 AND NOT-ITGB3 AND PTK7 | 0.848485 | 0.864198 | 0.833333 |
| NOT-EGFR AND ATP7A AND NOT-CD37 | 0.847458 | 0.806452 | 0.892857 |
| SLC4A8 AND NOT-MUC16 AND PTK7 | 0.847059 | 0.837209 | 0.857143 |
| JPH3 AND NOT-ITGB3 AND PTK7 | 0.845238 | 0.845238 | 0.845238 |
| GPR85 AND PTK7 AND NOT-ITGB3 | 0.84472 | 0.883117 | 0.809524 |
| NOT-EGFR AND FLVCR1 AND NOT-CD33 | 0.84472 | 0.883117 | 0.809524 |
| ASTN1 AND PTK7 AND NOT-CLDN2 | 0.843373 | 0.853659 | 0.833333 |
| SYT4 AND PTK7 AND NOT-GUCY2C | 0.841463 | 0.8625 | 0.821429 |
| NOT-CLDN4 AND PTK7 AND EBP | 0.840909 | 0.804348 | 0.880952 |
| TMEFF2 AND PTK7 AND NOT-ITGB3 | 0.840237 | 0.835294 | 0.845238 |
| L1CAM AND NOT-MOG AND NOT-PTK7 | 0.836158 | 0.795699 | 0.880952 |
| NOT-RNF43 AND PTK7 AND EBP | 0.840237 | 0.835294 | 0.845238 |
| NKAIN1 AND NOT-CLDN8 AND NOT-ITGB3 | 0.833333 | 0.78125 | 0.892857 |
| SYT4 AND PTK7 AND NOT-CLDN2 | 0.831325 | 0.841463 | 0.821429 |
| SYT11 AND NOT-EGFR AND CD37 | 0.830409 | 0.816092 | 0.845238 |
| ASTN1 AND BIRC5 AND NOT-ITGB3 | 0.828947 | 0.926471 | 0.75 |
| COMPLEX-PTK7/NKAIN1/CLDN2 | 0.828729 | 0.773196 | 0.892857 |
| ASTN1 AND PTK7 AND NOT-FOLH1 | 0.828402 | 0.823529 | 0.833333 |
| SYT4 AND PTK7 AND NOT-MUC16 | 0.826347 | 0.831325 | 0.821429 |
| NOT-EGFR AND PTK7 AND GPR61 | 0.825806 | 0.901408 | 0.761905 |
| NKAIN1 AND NOT-CD34 AND NOT-SSTR1 | 0.825 | 0.868421 | 0.785714 |
| NOT-EGFR AND LPPR3 AND NOT-CD33 | 0.825 | 0.868421 | 0.785714 |
| SLC6A15 AND PTK7 AND NOT-MUC16 | 0.823529 | 0.813953 | 0.833333 |
| ASTN1 AND PTK7 AND NOT-ITGB3 | 0.823529 | 0.813953 | 0.833333 |
| ASTN1 AND PTK7 AND NOT-ITGB3 | 0.823529 | 0.813953 | 0.833333 |
| NOT-EGFR AND PTK7 AND SLC5A8 | 0.823529 | 0.913043 | 0.75 |
| NKAIN1 AND NOT-CLDN8 AND NOT-SLC34A2 | 0.820225 | 0.776596 | 0.869048 |
| GPR158 AND PTK7 AND NOT-ITGB3 | 0.818792 | 0.938462 | 0.72619 |
| TMEFF2 AND PTK7 AND NOT-CLDN2 | 0.818182 | 0.782609 | 0.857143 |
| ASTN1 AND BIRC5 AND NOT-FOLH1 | 0.818182 | 0.9 | 0.75 |
| CNIH2 AND NOT-MUC16 AND PTK7 | 0.833333 | 0.902778 | 0.77381 |
| NOT-CLDN1 AND PTK7 AND NOT-GGTLC1 | 0.811429 | 0.78022 | 0.845238 |
| NOT-CLDN4 AND PTK7 AND NOT-ATP13A5 | 0.811429 | 0.78022 | 0.845238 |
| NOT-LRIG3 AND PTK7 AND NOT-ITGB3 | 0.810127 | 0.864865 | 0.761905 |
| ASTN1 AND NOT-ERBB4 AND NOT-CLDN8 | 0.813333 | 0.924242 | 0.72619 |
| GPR158 AND PTK7 AND NOT-CLDN2 | 0.805195 | 0.885714 | 0.738095 |
| NOT-EGFR AND FLVCR1 AND NOT-CD79B | 0.804734 | 0.8 | 0.809524 |
| SLC6A15 AND NOT-EGFR AND CD37 | 0.802548 | 0.863014 | 0.75 |
| NOT-EGFR AND ATP8B2 AND NOT-CD33 | 0.80226 | 0.763441 | 0.845238 |
| NOT-CLDN1 AND PTK7 AND NOT-KCNA1 | 0.813559 | 0.774194 | 0.857143 |
| SLC10A4 AND NOT-NKAIN2 AND NOT-SEMA4B | 0.994012 | 1 | 0.988095 |
| SLC10A4 AND NOT-NKAIN2 AND NOT-SCN10A | 0.994012 | 1 | 0.988095 |
| SLC10A4 AND NOT-NKAIN2 AND NOT-ATP1B4 | 0.994012 | 1 | 0.988095 |
| SLC10A4 AND NOT-TMEM235 AND NOT-SLC9B1 | 0.994012 | 1 | 0.988095 |
| COMPLEX-SEMA4D/CSMD3/SLC10A4 | 0.994012 | 1 | 0.988095 |
| SLC10A4 AND NOT-DTNA AND NOT-SLC13A1 | 0.994012 | 1 | 0.988095 |
| SLC10A4 AND NOT-NKAIN2 AND NOT-ROS1 | 0.994012 | 1 | 0.988095 |
| SLC10A4 AND NOT-KCNJ10 AND NOT-SLC9B1 | 0.994012 | 1 | 0.988095 |
| SLC10A4 AND NOT-NKAIN2 AND NOT-XCR1 | 0.994012 | 1 | 0.988095 |
| SLC10A4 AND NOT-MLC1 AND NOT-GLRA3 | 0.994012 | 1 | 0.988095 |

FIG. 15 (cont.)

| Antigen Pair Logic | F1 | Precision | Recall | Antigen Pair Logic | F1 | Precision | Recall |
|---|---|---|---|---|---|---|---|
| MEP1A AND SLC39A10 AND NOT-MSLN | 1 | 1 | 1 | SLC10A4 AND NOT-DTNA AND NOT-SLC13A1 | 0.994012 | 1 | 0.988095 |
| ATP10B AND AMIGO2 AND NOT-ERBB2 | 1 | 1 | 1 | SLC10A4 AND NOT-NKAIN2 AND NOT-MRAP | 0.994012 | 1 | 0.988095 |
| LY75 AND EDNRA AND NOT-GPC3 | 1 | 1 | 1 | SLC10A4 AND NOT-NKAIN2 AND NOT-ROS1 | 0.994012 | 1 | 0.988095 |
| NOT-GPC3 AND CDH3 AND NOT-ATP13A4 | 1 | 1 | 1 | SLC10A4 AND NOT-NKAIN2 AND NOT-ADAM7 | 0.994012 | 1 | 0.988095 |
| KCNE3 AND EDNRA AND NOT-GPC3 | 1 | 1 | 1 | SLC10A4 AND NOT-KCNJ10 AND NOT-SEMA4B | 0.994012 | 1 | 0.988095 |
| XK AND EDNRA AND NOT-GPC3 | 1 | 1 | 1 | SLC10A4 AND NOT-MLC1 AND NOT-SLC9B1 | 0.994012 | 1 | 0.988095 |
| NOT-SLC16A7 AND EDNRA AND NOT-GPC3 | 1 | 1 | 1 | SLC10A4 AND NOT-OPALIN AND NOT-SLC9B1 | 0.994012 | 1 | 0.988095 |
| NOT-LIFR AND CD81 AND ERBB2 | 1 | 1 | 1 | SLC10A4 AND NOT-NKAIN2 AND NOT-LRRC8E | 0.994012 | 1 | 0.988095 |
| SLC26A3 AND TACSTD2 AND NOT-GPC3 | 1 | 1 | 1 | SLC10A4 AND NOT-KCNJ10 AND NOT-ATP1B4 | 0.994012 | 1 | 0.988095 |
| HEPH AND EDNRA AND NOT-GPC3 | 1 | 1 | 1 | SLC10A4 AND NOT-GABRB2 AND NOT-GLRA3 | 0.994012 | 1 | 0.988095 |
| HEPH AND NOT-FLVCR2 AND NOT-MUC1 | 1 | 1 | 1 | SLC10A4 AND NOT-KCNJ10 AND NOT-XCR1 | 0.994012 | 1 | 0.988095 |
| SLC26A3 AND SLC39A10 AND NOT-GPC3 | 1 | 1 | 1 | SLC10A4 AND NOT-HCN2 AND NOT-GLRA3 | 0.994012 | 1 | 0.988095 |
| HEPH AND NOT-ABHD6 AND NOT-GPC3 | 1 | 1 | 1 | COMPLEX-SLC10A4/HTR5A/KCNJ10 | 0.994012 | 1 | 0.988095 |
| MEP1A AND AMIGO2 AND NOT-ERBB2 | 1 | 1 | 1 | SLC10A4 AND NOT-KCNJ10 AND NOT-GPR6 | 0.994012 | 1 | 0.988095 |
| NOT-GPC3 AND CDH3 AND NOT-DUOX1 | 1 | 1 | 1 | SLC10A4 AND NOT-KCNJ10 AND NOT-MRAP | 0.994012 | 1 | 0.988095 |
| HEPH AND TACSTD2 AND NOT-GPC3 | 1 | 1 | 1 | SLC10A4 AND NOT-GABRB2 AND NOT-SLC13A1 | 0.994012 | 1 | 0.988095 |
| NOT-GPC3 AND CDH3 AND NOT-GPR87 | 1 | 1 | 1 | SLC10A4 AND NOT-MOG AND NOT-GLRA3 | 0.994012 | 1 | 0.988095 |
| SLC26A3 AND EDNRA AND NOT-GPC3 | 1 | 1 | 1 | SLC10A4 AND NOT-MEGF10 AND NOT-GLRA3 | 0.994012 | 1 | 0.988095 |
| ATP10B AND SLC39A10 AND NOT-ERBB2 | 1 | 1 | 1 | SLC10A4 AND NOT-NKAIN2 AND NOT-STEAP4 | 0.994012 | 1 | 0.988095 |
| SLC26A3 AND SLC39A10 AND NOT-ERBB2 | 1 | 1 | 1 | SLC10A4 AND NOT-OPALIN AND NOT-SLC9B1 | 0.994012 | 1 | 0.988095 |
| NOT-SLC16A7 AND SLC39A10 AND NOT-GPC3 | 1 | 1 | 1 | SLC10A4 AND NOT-NKAIN2 AND NOT-SLC12A3 | 0.994012 | 1 | 0.988095 |
| HEPH AND NOT-CEACAM1 AND NOT-GPC3 | 1 | 1 | 1 | SLC10A4 AND NOT-NKAIN2 AND NOT-SLC13A1 | 0.994012 | 1 | 0.988095 |
| MEP1A AND TACSTD2 AND NOT-MUC1 | 1 | 1 | 1 | SLC10A4 AND NOT-NKAIN2 AND NOT-NMBR | 0.994012 | 1 | 0.988095 |
| HEPH AND TACSTD2 AND NOT-GPC3 | 1 | 1 | 1 | COMPLEX-NKAIN2/SLC10A4/GUCY2F | 0.994012 | 1 | 0.988095 |
| NOT-GPC3 AND CDH3 AND NOT-GPR87 | 1 | 1 | 1 | SLC10A4 AND NOT-ACSL6 AND NOT-SLC13A1 | 0.994012 | 1 | 0.988095 |
| NOT-GPC3 AND CDH3 AND NOT-DUOX1 | 1 | 1 | 1 | SLC10A4 AND NOT-KCNJ10 AND NOT-MRGPRX2 | 0.994012 | 1 | 0.988095 |
| MEP1A AND NOT-CEACAM1 AND NOT-GPC3 | 1 | 1 | 1 | SLC10A4 AND NOT-TTYH2 AND NOT-GLRA3 | 0.994012 | 1 | 0.988095 |
| SLC26A3 AND TACSTD2 AND NOT-GPC3 | 1 | 1 | 1 | SLC10A4 AND NOT-NKAIN2 AND NOT-SLC28A1 | 0.994012 | 1 | 0.988095 |
| JPH1 AND CDH3 AND NOT-GPC3 | 1 | 1 | 1 | SLC10A4 AND NOT-KCNJ10 AND NOT-ROS1 | 0.994012 | 1 | 0.988095 |
| NOT-GPC3 AND CDH3 AND NOT-CLCA2 | 1 | 1 | 1 | COMPLEX-CHRNA4/SLC10A4/KCNJ10 | 0.994012 | 1 | 0.988095 |
| NOT-GPC3 AND CDH3 AND NOT-PVRL4 | 1 | 1 | 1 | SLC10A4 AND NOT-GABRB2 AND NOT-GNRHR | 0.994012 | 1 | 0.988095 |
| NOT-FAT2 AND CDH3 AND NOT-GPC3 | 1 | 1 | 1 | SLC10A4 AND NOT-KCNJ10 AND NOT-OR2L2 | 0.994012 | 1 | 0.988095 |
| SLC26A3 AND NOT-ABHD6 AND NOT-GPC3 | 1 | 1 | 1 | SLC10A4 AND NOT-NKAIN2 AND SLC38A1 | 0.994012 | 1 | 0.988095 |
| NOT-GPC3 AND CDH3 AND NOT-PTPRZ1 | 1 | 1 | 1 | SLC10A4 AND NOT-NKAIN2 AND NOT-HTR6 | 0.994012 | 1 | 0.988095 |
| PVRL3 AND CDH3 AND NOT-GPC3 | 1 | 1 | 1 | SLC10A4 AND NOT-TTYH2 AND NOT-SLC9B1 | 0.994012 | 1 | 0.988095 |
| NOT-GPC3 AND CDH3 AND NOT-MUC15 | 1 | 1 | 1 | SLC10A4 AND NOT-KCNJ10 AND NOT-SLC13A1 | 0.994012 | 1 | 0.988095 |
| PVRL3 AND CDH3 AND NOT-GPC3 | 1 | 1 | 1 | SLC10A4 AND NOT-NKAIN2 AND NOT-SLC9B1 | 0.994012 | 1 | 0.988095 |
| JPH1 AND CDH3 AND NOT-GPC3 | 1 | 1 | 1 | SLC10A4 AND NOT-GABRB2 AND NOT-MRGPRX2 | 0.994012 | 1 | 0.988095 |
| ITM2C AND TACSTD2 AND NOT-GPC3 | 1 | 1 | 1 | COMPLEX-SLC10A4/NTSR2/OPALIN | 0.994012 | 1 | 0.988095 |
| NOT-GPC3 AND CDH3 AND NOT-LTB4R | 1 | 1 | 1 | COMPLEX-SLC10A4/GRM7/KCNJ6 | 0.994012 | 1 | 0.988095 |
| NOT-GPC3 AND CDH3 AND NOT-KRT5 | 1 | 1 | 1 | SLC10A4 AND NOT-MOG AND NOT-GLRA3 | 0.994012 | 1 | 0.988095 |
| ATP10B AND SLC39A10 AND NOT-GPC3 | 1 | 1 | 1 | SLC10A4 AND NOT-ACSL6 AND NOT-GLRA3 | 0.994012 | 1 | 0.988095 |
| HEPH AND SLCO4A1 AND NOT-ERBB2 | 1 | 1 | 1 | SLC10A4 AND NOT-ACSL6 AND NOT-SLC13A1 | 0.994012 | 1 | 0.988095 |
| SLC26A3 AND NOT-CEACAM1 AND NOT-GPC3 | 1 | 1 | 1 | COMPLEX-SLC10A4/KCNJ10/SLC22A11 | 0.994012 | 1 | 0.988095 |
| MEP1A AND NOT-ABHD6 AND NOT-GPC3 | 1 | 1 | 1 | SLC10A4 AND NOT-GABRB2 AND SLC38A1 | 0.994012 | 1 | 0.988095 |
| XK AND CDH3 AND NOT-GPC3 | 1 | 1 | 1 | SLC10A4 AND NOT-MOG AND NOT-SLC9B1 | 0.994012 | 1 | 0.988095 |
| NOT-LIFR AND EDNRA AND MUC1 | 1 | 1 | 1 | SLC10A4 AND NOT-KCNJ10 AND NOT-ROS1 | 0.994012 | 1 | 0.988095 |
| NOT-FAT2 AND CDH3 AND NOT-GPC3 | 1 | 1 | 1 | SLC10A4 AND NOT-TMEM235 AND NOT-SLC9B1 | 0.994012 | 1 | 0.988095 |
| JPH1 AND IFITM1 AND MUC1 | 1 | 1 | 1 | SLC10A4 AND NOT-GABRB2 AND NOT-ADAM7 | 0.994012 | 1 | 0.988095 |
| SLC26A3 AND SLCO4A1 AND NOT-ERBB2 | 1 | 1 | 1 | COMPLEX-SLC10A4/GRIN2C/KCNJ10 | 0.994012 | 1 | 0.988095 |
| IYD AND TACSTD2 AND NOT-GPC3 | 1 | 1 | 1 | SLC10A4 AND NOT-NKAIN2 AND NOT-CASR | 0.994012 | 1 | 0.988095 |
| HEPH AND CDH3 AND NOT-MUC1 | 1 | 1 | 1 | SLC10A4 AND NOT-NKAIN2 AND NOT-GLRA3 | 0.994012 | 1 | 0.988095 |
| NOT-SLC16A7 AND CDH3 AND NOT-GPC3 | 1 | 1 | 1 | COMPLEX-CHRNA4/SLC10A4/KCNJ10 | 0.994012 | 1 | 0.988095 |
| MEP1A AND SLCO4A1 AND NOT-ERBB2 | 1 | 1 | 1 | SLC10A4 AND NOT-NKAIN2 AND SLC38A1 | 0.994012 | 1 | 0.988095 |
| XK AND CDH3 AND NOT-GPC3 | 1 | 1 | 1 | SLC10A4 AND NOT-KCNJ10 AND NOT-MRGPRX2 | 0.994012 | 1 | 0.988095 |
| NOT-SLC16A7 AND SLCO4A1 AND MUC1 | 1 | 1 | 1 | SLC10A4 AND NOT-KCNJ10 AND NOT-SLC9B1 | 0.994012 | 1 | 0.988095 |
| NOT-GPC3 AND CDH3 AND NOT-DUOXA1 | 1 | 1 | 1 | SLC10A4 AND NOT-SEMA4D AND NOT-HTR1F | 0.994012 | 1 | 0.988095 |
| NOT-GPC3 AND CDH3 AND NOT-DUOXA1 | 1 | 1 | 1 | SLC10A4 AND NOT-KCNJ10 AND NOT-GNRHR | 0.994012 | 1 | 0.988095 |
| NOT-GPC3 AND CDH3 AND NOT-LTB4R | 1 | 1 | 1 | COMPLEX-SLC10A4/CRB2/KCNJ10 | 0.994012 | 1 | 0.988095 |
| HEPH AND TACSTD2 AND NOT-ERBB2 | 1 | 1 | 1 | SLC10A4 AND NOT-KCNJ10 AND NOT-SEMA4B | 0.994012 | 1 | 0.988095 |
| NOT-GPC3 AND CDH3 AND NOT-MUC15 | 1 | 1 | 1 | SLC10A4 AND NOT-KCNJ10 AND NOT-GPR6 | 0.994012 | 1 | 0.988095 |
| NOT-SLC16A7 AND CDH3 AND NOT-GPC3 | 1 | 1 | 1 | SLC10A4 AND NOT-KCNJ10 AND NOT-HTR6 | 0.994012 | 1 | 0.988095 |
| NOT-ZP2 AND JPH1 AND ERBB2 | 0.909091 | 0.833333 | 1 | SLC10A4 AND NOT-NKAIN2 AND NOT-SLC13A1 | 0.994012 | 1 | 0.988095 |
| CCRL2 AND NOT-FLVCR2 AND MUC1 | 0.909091 | 0.833333 | 1 | SLC10A4 AND NOT-KCNJ10 AND NOT-SCN10A | 0.994012 | 1 | 0.988095 |
| TSPAN8 AND EDNRA AND NOT-GPC3 | 1 | 1 | 1 | SLC10A4 AND NOT-NKAIN2 AND NOT-SLC12A3 | 0.994012 | 1 | 0.988095 |
| IYD AND SLC39A10 AND NOT-ERBB2 | 0.909091 | 0.833333 | 1 | COMPLEX-SLC10A4/KCNJ10/OPRM1 | 0.994012 | 1 | 0.988095 |
| NOT-SLC16A7 AND WNT5A AND MUC1 | 1 | 1 | 1 | SLC10A4 AND NOT-SEMA4D AND NOT-HTR1F | 0.994012 | 1 | 0.988095 |
| IYD AND NOT-FLVCR2 AND NOT-GPC3 | 0.909091 | 0.833333 | 1 | SLC10A4 AND NOT-DTNA AND NOT-GLRA3 | 0.994012 | 1 | 0.988095 |
| NOT-GPC3 AND CDH3 AND NOT-AQP3 | 1 | 1 | 1 | SLC10A4 AND NOT-KCNJ10 AND NOT-RXFP3 | 0.994012 | 1 | 0.988095 |
| NOT-SLC16A7 AND EDNRA AND MUC1 | 1 | 1 | 1 | SLC10A4 AND NOT-NKAIN2 AND NOT-ATP1B4 | 0.994012 | 1 | 0.988095 |
| JPH1 AND TMEM97 AND NOT-GPC3 | 1 | 1 | 1 | SLC10A4 AND NOT-KCNJ10 AND SLC38A1 | 0.994012 | 1 | 0.988095 |
| JPH1 AND NOT-KCNB1 AND ERBB2 | 0.909091 | 0.833333 | 1 | SLC10A4 AND NOT-KCNJ10 AND NOT-CASR | 0.994012 | 1 | 0.988095 |
| TM4SF5 AND CDH3 AND NOT-GPC3 | 1 | 1 | 1 | SLC10A4 AND NOT-KCNJ10 AND NOT-CACNG6 | 0.994012 | 1 | 0.988095 |
| MEP1A AND SLC22A3 AND NOT-GPC3 | 1 | 1 | 1 | SLC10A4 AND NOT-KCNJ10 AND SLC38A1 | 0.994012 | 1 | 0.988095 |
| HEPH AND NOT-FLVCR2 AND NOT-ERBB2 | 0.909091 | 0.833333 | 1 | COMPLEX-SLC10A4/KCNJ10/SLC6A6 | 0.994012 | 1 | 0.988095 |
| MEP1A AND AMIGO2 AND NOT-MSLN | 0.909091 | 0.833333 | 1 | SLC10A4 AND NOT-MEGF10 AND NOT-SLC9B1 | 0.994012 | 1 | 0.988095 |
| JPH1 AND TACSTD2 AND NOT-GPC3 | 0.909091 | 0.833333 | 1 | SLC10A4 AND NOT-TTYH2 AND NOT-GLRA3 | 0.994012 | 1 | 0.988095 |

FIG. 15 (cont.)

| Antigen Pair Logic | F1 | Precision | Recall | Antigen Pair Logic | F1 | Precision | Recall |
|---|---|---|---|---|---|---|---|
| NOT-SLC16A7 AND TMEM97 AND NOT-MUC1 | 1 | 1 | 1 | SLC10A4 AND NOT-HCN2 AND NOT-GLRA3 | 0.994012 | 1 | 0.988095 |
| ITM2C AND CDH3 AND NOT-GPC3 | 1 | 1 | 1 | SLC10A4 AND NOT-NKAIN2 AND NOT-GPR6 | 0.994012 | 1 | 0.988095 |
| ATP10B AND AMIGO2 AND NOT-GPC3 | 0.909091 | 0.833333 | 1 | COMPLEX-SLC10A4/GRM3/KCNJ10 | 0.994012 | 1 | 0.988095 |
| NOT-ZP2 AND PRRG1 AND MUC1 | 1 | 1 | 1 | SLC10A4 AND NOT-NKAIN2 AND NOT-RXFP3 | 0.994012 | 1 | 0.988095 |
| NOT-SLC7A2 AND EDNRA AND ERBB2 | 0.909091 | 0.833333 | 1 | SLC10A4 AND NOT-SSTR1 AND NOT-TYR | 0.994012 | 1 | 0.988095 |
| COMPLEX-ERBB2/ATP10B/FLVCR2 | 0.909091 | 0.833333 | 1 | SLC10A4 AND NOT-SSTR1 AND NOT-EGFR | 0.994012 | 1 | 0.988095 |
| HEPH AND NOT-SLC22A23 AND MUC1 | 0.909091 | 0.833333 | 1 | COMPLEX-SLC10A4/ERBB4/CLDN11 | 0.994012 | 1 | 0.988095 |
| SLC26A3 AND NOT-FLVCR2 AND ERBB2 | 0.909091 | 0.833333 | 1 | COMPLEX-SLC10A4/CLDN11/CLDN1 | 0.994012 | 1 | 0.988095 |
| IFI6 AND NOX1 AND NOT-CNR1 | 1 | 1 | 1 | SLC10A4 AND NOT-SSTR1 AND NOT-EGFR | 0.994012 | 1 | 0.988095 |
| IFI6 AND NOX1 AND NOT-ADAM15 | 1 | 1 | 1 | COMPLEX-SLC10A4/CLDN11/SLC7A5 | 0.988095 | 0.988095 | 0.988095 |
| IFI6 AND NOX1 AND NOT-S1PR4 | 1 | 1 | 1 | SLC10A4 AND NOT-SSTR1 AND NOT-MSLN | 0.988095 | 0.988095 | 0.988095 |
| IFI6 AND NOX1 AND NOT-IL17RC | 1 | 1 | 1 | COMPLEX-SLC10A4/CLDN11/SLC7A5 | 0.988095 | 0.988095 | 0.988095 |
| IFI6 AND NOX1 AND NOT-SLITRK6 | 1 | 1 | 1 | SLC10A4 AND NOT-SSTR1 AND NOT-MSLN | 0.988095 | 0.988095 | 0.988095 |
| IFI6 AND NOX1 AND NOT-JAM3 | 1 | 1 | 1 | SLC10A4 AND NOT-SSTR1 AND NOT-DNAJB8 | 0.988095 | 0.988095 | 0.988095 |
| IFI6 AND NOX1 AND NOT-FCRL4 | 1 | 1 | 1 | SLC10A4 AND NOT-CLDN11 AND NOT-EGFR | 0.987952 | 1 | 0.97619 |
| IFI6 AND NOX1 AND NOT-KCNH6 | 1 | 1 | 1 | SLC10A4 AND NOT-CLDN11 AND NOT-MSLN | 0.987952 | 1 | 0.97619 |
| IFI6 AND NOX1 AND NOT-SLC19A3 | 1 | 1 | 1 | SLC10A4 AND CD276 AND NOT-CLDN18 | 0.987952 | 1 | 0.97619 |
| IFI6 AND NOX1 AND NOT-IGFLR1 | 1 | 1 | 1 | SLC10A4 AND NOT-CLDN11 AND NOT-EGFR | 0.987952 | 1 | 0.97619 |
| IFI6 AND NOX1 AND NOT-TGFBR2 | 1 | 1 | 1 | SLC10A4 AND CD276 AND NOT-DNAJB8 | 0.987952 | 1 | 0.97619 |
| IFI6 AND NOX1 AND NOT-SYP | 1 | 1 | 1 | SLC10A4 AND PTK7 AND NOT-TYR | 0.987952 | 1 | 0.97619 |
| IFI6 AND NOX1 AND NOT-SLC22A1 | 1 | 1 | 1 | SLC10A4 AND NOT-CLDN11 AND NOT-DNAJB8 | 0.987952 | 1 | 0.97619 |
| IFI6 AND NOX1 AND NOT-DNER | 1 | 1 | 1 | SLC10A4 AND NOT-CLDN11 AND NOT-TYR | 0.987952 | 1 | 0.97619 |
| IFI6 AND SLC26A3 AND NOT-KCNU1 | 1 | 1 | 1 | SLC10A4 AND CD276 AND NOT-TYR | 0.987952 | 1 | 0.97619 |
| IFI6 AND SLC26A3 AND NOT-GABRA1 | 1 | 1 | 1 | SLC10A4 AND CD276 AND NOT-CLDN18 | 0.987952 | 1 | 0.97619 |
| IFI6 AND SLC26A3 AND NOT-ADAM2 | 1 | 1 | 1 | COMPLEX-SLC10A4/EPCAM/CLDN11 | 0.987952 | 1 | 0.97619 |
| IFI6 AND SLC26A3 AND NOT-LAMP5 | 1 | 1 | 1 | SLC10A4 AND CD276 AND NOT-ITGB3 | 0.987952 | 1 | 0.97619 |
| IFI6 AND SLC26A3 AND NOT-IL17RA | 1 | 1 | 1 | SLC10A4 AND NOT-CLDN11 AND NOT-MSLN | 0.987952 | 1 | 0.97619 |
| IFI6 AND SLC26A3 AND NOT-CRB1 | 1 | 1 | 1 | SLC10A4 AND PTK7 AND NOT-ITGB3 | 0.987952 | 1 | 0.97619 |
| IFI6 AND SLC26A3 AND NOT-LHFPL5 | 1 | 1 | 1 | SLC10A4 AND PTK7 AND NOT-CLDN18 | 0.987952 | 1 | 0.97619 |
| IFI6 AND SLC26A3 AND NOT-EPHA8 | 1 | 1 | 1 | SLC10A4 AND PTK7 AND NOT-ITGB3 | 0.987952 | 1 | 0.97619 |
| IFI6 AND SLC26A3 AND NOT-EMP3 | 1 | 1 | 1 | SLC10A4 AND PTK7 AND NOT-CLDN18 | 0.987952 | 1 | 0.97619 |
| IFI6 AND SLC26A3 AND NOT-EPHA2 | 1 | 1 | 1 | COMPLEX-SLC10A4/LGR5/CD22 | 0.982249 | 0.976471 | 0.988095 |
| IFI6 AND SLC26A3 AND NOT-PPAPDC1A | 1 | 1 | 1 | COMPLEX-EGFR/SLC10A4/CD37 | 0.982249 | 0.976471 | 0.988095 |
| IFI6 AND SLC26A3 AND NOT-DRD5 | 1 | 1 | 1 | COMPLEX-SLC10A4/CLDN11/PROM1 | 0.982249 | 0.976471 | 0.988095 |
| IFI6 AND SLC26A3 AND NOT-SLC30A8 | 1 | 1 | 1 | COMPLEX-SLC10A4/CLDN11/CLDN8 | 0.982249 | 0.976471 | 0.988095 |
| IFI6 AND SLC26A3 AND NOT-PAQR7 | 1 | 1 | 1 | COMPLEX-CLDN7/SLC10A4/CLDN11 | 0.982249 | 0.976471 | 0.988095 |
| IFI6 AND SLC26A3 AND NOT-NKAIN2 | 1 | 1 | 1 | COMPLEX-EGFR/SLC10A4/MUC1 | 0.982249 | 0.976471 | 0.988095 |
| IFI6 AND NOX1 AND NOT-NRXN2 | 1 | 1 | 1 | COMPLEX-EGFR/SLC10A4/SSTR2 | 0.982249 | 0.976471 | 0.988095 |
| IFI6 AND SLC26A3 AND NOT-SLC9B1 | 1 | 1 | 1 | COMPLEX-EGFR/SLC10A4/ITGB3 | 0.982249 | 0.976471 | 0.988095 |
| IFI6 AND SLC26A3 AND NOT-MUC17 | 1 | 1 | 1 | COMPLEX-SLC10A4/CLDN11/CD22 | 0.982249 | 0.976471 | 0.988095 |
| IFI6 AND SLC26A3 AND NOT-ANO4 | 1 | 1 | 1 | COMPLEX-CLDN7/SLC10A4/LGR5 | 0.982249 | 0.976471 | 0.988095 |
| IFI6 AND SLC26A3 AND NOT-BTN3A1 | 1 | 1 | 1 | COMPLEX-SLC10A4/LGR5/CD22 | 0.982249 | 0.976471 | 0.988095 |
| IFI6 AND SLC26A3 AND NOT-GPR83 | 1 | 1 | 1 | COMPLEX-EGFR/SLC10A4/CD33 | 0.982249 | 0.976471 | 0.988095 |
| IFI6 AND SLC26A3 AND NOT-NRG3 | 1 | 1 | 1 | COMPLEX-SLC10A4/CLDN11/LGR5 | 0.982249 | 0.976471 | 0.988095 |
| IFI6 AND SLC26A3 AND NOT-SEMA4B | 1 | 1 | 1 | COMPLEX-EGFR/SLC10A4/SLAMF7 | 0.982249 | 0.976471 | 0.988095 |
| IFI6 AND SLC26A3 AND NOT-BTN3A3 | 1 | 1 | 1 | COMPLEX-SLC10A4/CLDN11/CD22 | 0.982249 | 0.976471 | 0.988095 |
| IFI6 AND NOX1 AND NOT-KCNE2 | 1 | 1 | 1 | COMPLEX-SLC10A4/ERBB3/CLDN11 | 0.982249 | 0.976471 | 0.988095 |
| IFI6 AND NOX1 AND NOT-LRIG2 | 1 | 1 | 1 | COMPLEX-EGFR/SLC10A4/ITGB3 | 0.982249 | 0.976471 | 0.988095 |
| IFI6 AND NOX1 AND NOT-CD27 | 1 | 1 | 1 | COMPLEX-EGFR/SLC10A4/CD37 | 0.982249 | 0.976471 | 0.988095 |
| IFI6 AND NOX1 AND NOT-SLC20A1 | 1 | 1 | 1 | COMPLEX-MSLN/CLDN7/SLC10A4 | 0.982249 | 0.976471 | 0.988095 |
| IFI6 AND CEACAM7 AND NOT-TAS2R3 | 1 | 1 | 1 | COMPLEX-EGFR/SLC10A4/CD33 | 0.982249 | 0.976471 | 0.988095 |
| IFI6 AND NOX1 AND NOT-TMEM63B | 1 | 1 | 1 | COMPLEX-EGFR/SLC10A4/ITGB6 | 0.982249 | 0.976471 | 0.988095 |
| IFI6 AND NOX1 AND NOT-PAQR5 | 1 | 1 | 1 | COMPLEX-EGFR/SLC10A4/ITGB6 | 0.982249 | 0.976471 | 0.988095 |
| IFI6 AND NOX1 AND NOT-EQTN | 1 | 1 | 1 | SLC10A4 AND PTK7 AND NOT-ABCB5 | 0.982036 | 0.987952 | 0.97619 |
| IFI6 AND NOX1 AND SLC38A2 | 1 | 1 | 1 | SLC10A4 AND NOT-SSTR1 AND NOT-STEAP2 | 0.982036 | 0.987952 | 0.97619 |
| IFI6 AND NOX1 AND NOT-C11orf24 | 1 | 1 | 1 | SLC10A4 AND NOT-SSTR1 AND NOT-ENPP3 | 0.982036 | 0.987952 | 0.97619 |
| IFI6 AND NOX1 AND NOT-ADAM22 | 1 | 1 | 1 | SLC10A4 AND NOT-NCAM1 AND NOT-TYR | 0.982036 | 0.987952 | 0.97619 |
| IFI6 AND NOX1 AND NOT-PDGFRB | 1 | 1 | 1 | SLC10A4 AND NOT-NCAM1 AND NOT-EGFR | 0.982036 | 0.987952 | 0.97619 |
| IFI6 AND NOX1 AND NOT-PCDH12 | 1 | 1 | 1 | SLC10A4 AND CD276 AND NOT-ABCB5 | 0.982036 | 0.987952 | 0.97619 |
| IFI6 AND NOX1 AND NOT-NUCB2 | 1 | 1 | 1 | SLC10A4 AND NOT-SSTR1 AND NOT-PCYT1A | 0.982036 | 0.987952 | 0.97619 |
| IFI6 AND NOX1 AND NOT-NGFR | 1 | 1 | 1 | SLC10A4 AND NOT-NCAM1 AND NOT-EGFR | 0.982036 | 0.987952 | 0.97619 |
| IFI6 AND NOX1 AND NOT-MPZ | 1 | 1 | 1 | SLC10A4 AND NOT-SSTR1 AND NOT-HHLA2 | 0.982036 | 0.987952 | 0.97619 |
| IFI6 AND NOX1 AND NOT-MC4R | 1 | 1 | 1 | SLC10A4 AND CD276 AND NOT-ABCB5 | 0.982036 | 0.987952 | 0.97619 |
| IFI6 AND NOX1 AND NOT-LRP1 | 1 | 1 | 1 | SLC10A4 AND NOT-SSTR1 AND NOT-IL20RA | 0.982036 | 0.987952 | 0.97619 |
| IFI6 AND NOX1 AND NOT-C14orf180 | 1 | 1 | 1 | SLC10A4 AND PTK7 AND NOT-ULBP3 | 0.982036 | 0.987952 | 0.97619 |
| IFI6 AND ATP10B AND NOT-GPC3 | 1 | 1 | 1 | SLC10A4 AND NOT-SSTR1 AND NOT-RNF43 | 0.982036 | 0.987952 | 0.97619 |
| IFI6 AND ST14 AND NOT-GPC3 | 1 | 1 | 1 | SLC10A4 AND NOT-SSTR1 AND NOT-STEAP2 | 0.982036 | 0.987952 | 0.97619 |
| IFI6 AND MEP1A AND NOT-GPC3 | 1 | 1 | 1 | SLC10A4 AND CD276 AND NOT-MST1R | 0.982036 | 0.987952 | 0.97619 |
| IFI6 AND MEP1A AND NOT-ERBB2 | 1 | 1 | 1 | SLC10A4 AND CD276 AND NOT-MST1R | 0.982036 | 0.987952 | 0.97619 |
| IFI6 AND SLC39A4 AND NOT-MUC1 | 1 | 1 | 1 | ASTN1 AND NOT-TRPC3 AND NOT-MLC1 | 0.939024 | 0.9625 | 0.916667 |
| IFI6 AND SLC5A1 AND NOT-GPC3 | 1 | 1 | 1 | GPR19 AND NOT-DSC1 AND NOT-KCNA1 | 0.927711 | 0.939024 | 0.916667 |
| NOX1 AND SLC39A10 AND NOT-GPC3 | 1 | 1 | 1 | ASTN1 AND NOT-MLC1 AND NOT-ENPP1 | 0.912281 | 0.896552 | 0.928571 |
| NOX1 AND AMIGO2 AND NOT-ERBB2 | 1 | 1 | 1 | ASTN1 AND SLC38A1 AND NOT-MLC1 | 0.911392 | 0.972973 | 0.857143 |
| NOX1 AND NOT-CA12 AND NOT-GPC3 | 1 | 1 | 1 | ASTN1 AND NOT-LRRC8E AND NOT-CSMD3 | 0.911243 | 0.905882 | 0.916667 |
| IFI6 AND NOT-GPC3 AND SLC27A4 | 1 | 1 | 1 | ASTN1 AND NOT-NKAIN2 AND NOT-EMP3 | 0.910256 | 0.986111 | 0.845238 |
| IFI6 AND NOT-GPC3 AND PCDH18 | 1 | 1 | 1 | ASTN1 AND NOT-SCN10A AND NOT-MLC1 | 0.909091 | 0.869565 | 0.952381 |
| IFI6 AND NOT-GPC3 AND PAQR5 | 1 | 1 | 1 | ASTN1 AND NOT-MLC1 AND SLC4A8 | 0.904762 | 0.904762 | 0.904762 |

FIG. 15 (cont.)

| Antigen Pair Logic | F1 | Precision | Recall |
|---|---|---|---|
| IFI6 AND SLC39A4 AND NOT-GPC3 | 1 | 1 | 1 |
| IFI6 AND MEP1A AND NOT-GPC3 | 1 | 1 | 1 |
| IFI6 AND NOT-GPC3 AND MCAM | 1 | 1 | 1 |
| IFI6 AND NOT-GPC3 AND TM4SF1 | 1 | 1 | 1 |
| IFI6 AND NOT-LIFR AND MUC1 | 1 | 1 | 1 |
| IFI6 AND NOT-ITGAL AND MUC1 | 1 | 1 | 1 |
| IFI6 AND SLC5A1 AND NOT-ERBB2 | 1 | 1 | 1 |
| IFI6 AND NOT-CNR1 AND MUC1 | 1 | 1 | 1 |
| NOX1 AND NOT-CEACAM1 AND NOT-GPC3 | 1 | 1 | 1 |
| TGFBI AND NOT-MAL AND MUC1 | 1 | 1 | 1 |
| IFI6 AND ATP10B AND NOT-MSLN | 1 | 1 | 1 |
| CDH17 AND SLC39A10 AND NOT-MUC1 | 1 | 1 | 1 |
| IFI6 AND NOT-GPC3 AND SGCB | 1 | 1 | 1 |
| IFI6 AND NOT-GPC3 AND JAG1 | 1 | 1 | 1 |
| NOX1 AND NOT-FLVCR2 AND NOT-MUC1 | 1 | 1 | 1 |
| MEP1A AND TGFBI AND NOT-MUC1 | 1 | 1 | 1 |
| IFI6 AND SLC39A4 AND NOT-ERBB2 | 1 | 1 | 1 |
| IFI6 AND SLC39A4 AND NOT-GPC3 | 1 | 1 | 1 |
| IFI6 AND MEP1A AND NOT-MSLN | 1 | 1 | 1 |
| IFI6 AND CFTR AND NOT-ERBB2 | 1 | 1 | 1 |
| CDH17 AND SLC39A10 AND NOT-ERBB2 | 1 | 1 | 1 |
| CDH17 AND SLC39A10 AND NOT-GPC3 | 1 | 1 | 1 |
| IFI6 AND SLC26A3 AND NOT-GPC3 | 1 | 1 | 1 |
| TGFBI AND NOT-ABCA8 AND MUC1 | 1 | 1 | 1 |
| IFI6 AND ATP10B AND NOT-MUC1 | 1 | 1 | 1 |
| IFI6 AND NOT-GPC3 AND PDGFRB | 1 | 1 | 1 |
| IFI6 AND SLC5A1 AND NOT-GPC3 | 1 | 1 | 1 |
| CDH17 AND TACSTD2 AND NOT-GPC3 | 1 | 1 | 1 |
| IFI6 AND NOT-GPC3 AND SGCB | 1 | 1 | 1 |
| IFI6 AND NOT-TUSC3 AND MUC1 | 1 | 1 | 1 |
| IFI6 AND NOT-GPC3 AND SLCO2A1 | 1 | 1 | 1 |
| IFI6 AND NOT-LIFR AND ERBB2 | 1 | 1 | 1 |
| IFI6 AND NOT-SLC7A2 AND ERBB2 | 1 | 1 | 1 |
| IFI6 AND TNFRSF11A AND NOT-GPC3 | 1 | 1 | 1 |
| IFI6 AND JPH1 AND NOT-GPC3 | 1 | 1 | 1 |
| IFI6 AND NOT-GPC3 AND PARM1 | 1 | 1 | 1 |
| IFI6 AND NOT-GPC3 AND TSPAN15 | 1 | 1 | 1 |
| IFI6 AND NOT-NAALAD2 AND MUC1 | 1 | 1 | 1 |
| IFI6 AND SLC26A3 AND NOT-ERBB2 | 1 | 1 | 1 |
| CDH17 AND TACSTD2 AND NOT-GPC3 | 1 | 1 | 1 |
| IFI6 AND NOT-GPC3 AND EDNRA | 1 | 1 | 1 |
| IFI6 AND NOT-GPC3 AND PARM1 | 1 | 1 | 1 |
| IFI6 AND NOT-NAALAD2 AND ERBB2 | 1 | 1 | 1 |
| IFI6 AND NOT-GPC3 AND B3GNT3 | 1 | 1 | 1 |
| IFI6 AND CFTR AND NOT-ERBB2 | 1 | 1 | 1 |
| IFI6 AND SLC39A4 AND NOT-ERBB2 | 1 | 1 | 1 |
| IFI6 AND TNFRSF11A AND NOT-GPC3 | 1 | 1 | 1 |
| CDH17 AND NOT-FLVCR2 AND NOT-MUC1 | 1 | 1 | 1 |
| IFI6 AND NOT-GPC3 AND EPHB3 | 1 | 1 | 1 |
| IFI6 AND SLC39A4 AND NOT-MSLN | 1 | 1 | 1 |
| IFI6 AND SLC26A3 AND NOT-MUC1 | 1 | 1 | 1 |
| IFI6 AND NOT-GPC3 AND EDNRA | 1 | 1 | 1 |
| CDH17 AND SLC39A10 AND NOT-MSLN | 1 | 1 | 1 |
| IFI6 AND NOT-NAALAD2 AND ERBB2 | 1 | 1 | 1 |
| MEP1A AND TGFBI AND NOT-MUC1 | 1 | 1 | 1 |
| IFI6 AND NOT-GPC3 AND SLC52A3 | 1 | 1 | 1 |
| IFI6 AND NOT-GPC3 AND FZD7 | 1 | 1 | 1 |
| CDH17 AND NOT-CEACAM1 AND NOT-GPC3 | 1 | 1 | 1 |
| IFI6 AND NOT-TRPC6 AND MUC1 | 1 | 1 | 1 |
| IFI6 AND NOT-LIFR AND MUC1 | 1 | 1 | 1 |
| IFI6 AND NOT-GPC3 AND HAS2 | 1 | 1 | 1 |
| TGFBI AND NOT-LIFR AND MUC1 | 1 | 1 | 1 |
| IFI6 AND NOT-GPC3 AND JAG1 | 1 | 1 | 1 |
| IFI6 AND NOT-GPC3 AND GPRC5A | 1 | 1 | 1 |
| IFI6 AND NOT-GPC3 AND B3GNT3 | 1 | 1 | 1 |
| IFI6 AND NOT-SLC7A2 AND ERBB2 | 1 | 1 | 1 |
| IFI6 AND NOT-GPC3 AND EFNB1 | 1 | 1 | 1 |
| IFI6 AND NOT-NAALAD2 AND MUC1 | 1 | 1 | 1 |
| IFI6 AND SLC35G1 AND NOT-GPC3 | 1 | 1 | 1 |
| IFI6 AND NOT-GPC3 AND C1orf210 | 1 | 1 | 1 |
| IFI6 AND NOT-LIFR AND ERBB2 | 1 | 1 | 1 |
| IFI6 AND PTPRH AND NOT-GPC3 | 1 | 1 | 1 |
| IFI6 AND NOT-GPC3 AND SLC27A4 | 1 | 1 | 1 |
| IFI6 AND SLC39A4 AND NOT-MUC1 | 1 | 1 | 1 |
| IFI6 AND NOT-GPC3 AND BMP2 | 1 | 1 | 1 |
| IFI6 AND NOT-TRPC6 AND MUC1 | 1 | 1 | 1 |
| IFI6 AND NOT-GPC3 AND CDH3 | 1 | 1 | 1 |

| Antigen Pair Logic | F1 | Precision | Recall |
|---|---|---|---|
| ASTN1 AND NOT-MLC1 AND NOT-SLC13A5 | 0.902857 | 0.868132 | 0.940476 |
| ASTN1 AND NOT-LRRC8E AND NOT-OMG | 0.902439 | 0.925 | 0.880952 |
| ASTN1 AND NOT-MLC1 AND NOT-ATP13A5 | 0.901734 | 0.876404 | 0.928571 |
| GPR19 AND ASTN1 AND NOT-GABRD | 0.901734 | 0.876404 | 0.928571 |
| GPR19 AND ASTN1 AND NOT-MLC1 | 0.901734 | 0.876404 | 0.928571 |
| ASTN1 AND NOT-GABRB2 AND NOT-MLC1 | 0.901235 | 0.935897 | 0.869048 |
| ASTN1 AND NOT-GABRB2 AND NOT-MOG | 0.901235 | 0.935897 | 0.869048 |
| COMPLEX-KCNA1/KCNQ2/LRRTM4 | 0.901099 | 0.836735 | 0.97619 |
| ASTN1 AND NOT-CSMD3 AND NOT-EMP3 | 0.9 | 0.947368 | 0.857143 |
| COMPLEX-KCNQ2/SLC12A5/LRRTM4 | 0.898876 | 0.851064 | 0.952381 |
| COMPLEX-GRM3/KCNQ2/LRRTM4 | 0.898876 | 0.851064 | 0.952381 |
| ASTN1 AND NOT-NKAIN2 AND NOT-LRRC8E | 0.898734 | 0.959459 | 0.845238 |
| ASTN1 AND FXYD6 AND NOT-MLC1 | 0.898204 | 0.903614 | 0.892857 |
| COMPLEX-KCNA2/KCNQ2/LRRTM4 | 0.896552 | 0.866667 | 0.928571 |
| COMPLEX-GABRB2/KCNQ2/LRRTM4 | 0.896175 | 0.828283 | 0.97619 |
| ASTN1 AND NOT-LRRC8E AND ATP7A | 0.894118 | 0.883721 | 0.904762 |
| ASTN1 AND NOT-NKAIN2 AND NOT-SLC28A1 | 0.893082 | 0.946667 | 0.845238 |
| ASTN1 AND NOT-NKAIN2 AND NOT-GRIN2B | 0.893082 | 0.946667 | 0.845238 |
| ASTN1 AND NOT-NKAIN2 AND NOT-OR8B2 | 0.893082 | 0.946667 | 0.845238 |
| ASTN1 AND NOT-NKAIN2 AND NOT-LCT | 0.893082 | 0.946667 | 0.845238 |
| ASTN1 AND NOT-NKAIN2 AND NOT-ADAM30 | 0.893082 | 0.946667 | 0.845238 |
| COMPLEX-MOG/ASTN1/NKAIN1 | 0.892857 | 0.892857 | 0.892857 |
| COMPLEX-SLC9B1/ASTN1/NKAIN1 | 0.898204 | 0.903614 | 0.892857 |
| COMPLEX-KCNQ2/ATP2B2/LRRTM4 | 0.891304 | 0.82 | 0.97619 |
| COMPLEX-MLC1/KCNQ2/LRRTM4 | 0.891304 | 0.82 | 0.97619 |
| ASTN1 AND NOT-KCNA2 AND NOT-EMP3 | 0.890323 | 0.971831 | 0.821429 |
| SCN2A AND NOT-MLC1 AND ASTN1 | 0.890244 | 0.9125 | 0.869048 |
| ASTN1 AND NOT-MLC1 AND NOT-SCARA5 | 0.888889 | 0.923077 | 0.857143 |
| ASTN1 AND NOT-MLC1 AND NOT-SLC22A11 | 0.88764 | 0.840426 | 0.940476 |
| ASTN1 AND NOT-MLC1 AND NOT-TSPAN16 | 0.887574 | 0.882353 | 0.892857 |
| ASTN1 AND NOT-SLCO1C1 AND NOT-EMP3 | 0.886364 | 0.847826 | 0.928571 |
| GPR19 AND ASTN1 AND NOT-SLC39A12 | 0.886364 | 0.847826 | 0.928571 |
| COMPLEX-CSMD3/KCNQ2/LRRTM4 | 0.886364 | 0.847826 | 0.928571 |
| COMPLEX-NKAIN2/ASTN1/PHLDB2 | 0.893082 | 0.946667 | 0.845238 |
| COMPLEX-KCNA2/SYT4/CACNA1B | 0.886364 | 0.847826 | 0.928571 |
| SCN2A AND NOT-KCNA1 AND NOT-DSC1 | 0.886228 | 0.891566 | 0.880952 |
| ASTN1 AND NOT-MLC1 AND NOT-ATP4B | 0.884848 | 0.901235 | 0.869048 |
| COMPLEX-KCNA1/SYT4/CACNA1B | 0.883978 | 0.824742 | 0.952381 |
| COMPLEX-GABRB2/SYT4/CACNA1B | 0.883978 | 0.824742 | 0.952381 |
| ASTN1 AND NOT-MLC1 AND TMEFF2 | 0.883721 | 0.863636 | 0.904762 |
| ASTN1 AND NOT-MLC1 AND NOT-CACNG1 | 0.883721 | 0.863636 | 0.904762 |
| ASTN1 AND NOT-MLC1 AND NOT-GPRC6A | 0.887574 | 0.882353 | 0.892857 |
| COMPLEX-ATP2B2/SYT4/CACNA1B | 0.882682 | 0.831579 | 0.940476 |
| NKAIN1 AND NOT-KCNA7 AND NOT-SLC22A5 | 0.880952 | 0.880952 | 0.880952 |
| ASTN1 AND NOT-MLC1 AND NOT-CD1B | 0.880503 | 0.933333 | 0.833333 |
| ASTN1 AND NOT-MLC1 AND NOT-VN1R2 | 0.913295 | 0.88764 | 0.940476 |
| ASTN1 AND NOT-MLC1 AND NOT-ROS1 | 0.888889 | 0.833333 | 0.952381 |
| ASTN1 AND NOT-MLC1 AND NOT-ROS1 | 0.888889 | 0.833333 | 0.952381 |
| ASTN1 AND NOT-ADAM30 AND NOT-CSMD3 | 0.88 | 0.846154 | 0.916667 |
| ASTN1 AND NOT-GABRB2 AND NOT-OPALIN | 0.879518 | 0.890244 | 0.869048 |
| ASTN1 AND NOT-KCNA2 AND NOT-MLC1 | 0.878981 | 0.945205 | 0.821429 |
| ASTN1 AND NOT-MLC1 AND NOT-ADAM7 | 0.883978 | 0.824742 | 0.952381 |
| ASTN1 AND NOT-MLC1 AND NOT-OR1C1 | 0.878613 | 0.853933 | 0.904762 |
| ASTN1 AND NOT-MLC1 AND NOT-TMPRSS11E | 0.878981 | 0.945205 | 0.821429 |
| ASTN1 AND NOT-OPALIN AND SLC4A8 | 0.878613 | 0.853933 | 0.904762 |
| ASTN1 AND NOT-MLC1 AND NOT-LCT | 0.896552 | 0.866667 | 0.928571 |
| ASTN1 AND NOT-CSMD3 AND NOT-SLC28A1 | 0.878049 | 0.9 | 0.857143 |
| ASTN1 AND SLC38A1 AND NOT-OPALIN | 0.878049 | 0.9 | 0.857143 |
| ASTN1 AND NOT-MLC1 AND NOT-CD207 | 0.881356 | 0.83871 | 0.928571 |
| GPR85 AND NOT-KCNA1 AND NOT-DSC1 | 0.877419 | 0.957746 | 0.809524 |
| COMPLEX-ASTN1/ROS1/NKAIN1 | 0.877193 | 0.862069 | 0.892857 |
| COMPLEX-KCNQ2/OMG/LRRTM4 | 0.877193 | 0.862069 | 0.892857 |
| COMPLEX-GRM3/SYT4/CACNA1B | 0.876404 | 0.829787 | 0.928571 |
| ASTN1 AND NOT-CACNG6 AND NOT-MLC1 | 0.876404 | 0.829787 | 0.928571 |
| ASTN1 AND NOT-LRRC8E AND NOT-SLCO1C1 | 0.876404 | 0.829787 | 0.928571 |
| ASTN1 AND NOT-MLC1 AND NOT-CATSPER3 | 0.876404 | 0.829787 | 0.928571 |
| SLC6A15 AND NOT-KCNA1 AND DSC1 | 0.875817 | 0.971014 | 0.797619 |
| NKAIN1 AND NOT-MIP AND NOT-PHLDB2 | 0.87574 | 0.870588 | 0.880952 |
| ASTN1 AND NOT-MLC1 AND NOT-CALHM1 | 0.902439 | 0.925 | 0.880952 |
| ASTN1 AND NOT-MLC1 AND NOT-KCNU1 | 0.875 | 0.836957 | 0.916667 |
| ASTN1 AND NOT-MOG AND CHRNB4 | 0.875 | 0.921053 | 0.833333 |
| ASTN1 AND NOT-MLC1 AND NOT-ADAM30 | 0.874317 | 0.808081 | 0.952381 |
| ASTN1 AND NOT-MLC1 AND NOT-PCDHB1 | 0.874317 | 0.808081 | 0.952381 |
| ASTN1 AND NOT-MLC1 AND NOT-ADAM30 | 0.874317 | 0.808081 | 0.952381 |
| ASTN1 AND NOT-MLC1 AND NOT-OR7C1 | 0.88764 | 0.840426 | 0.940476 |
| ASTN1 AND NOT-MLC1 AND NOT-ADAM29 | 0.873563 | 0.844444 | 0.904762 |
| COMPLEX-KCNA2/KCNQ2/CACNA1B | 0.872928 | 0.814433 | 0.940476 |

FIG. 15 (cont.)

| Antigen Pair Logic | F1 | Precision | Recall | Antigen Pair Logic | F1 | Precision | Recall |
|---|---|---|---|---|---|---|---|
| IFI6 AND NOT-GPC3 AND MMP14 | 1 | 1 | 1 | COMPLEX-KCNQ2/SCN1A/LRRTM4 | 0.872928 | 0.814433 | 0.940476 |
| IFI6 AND NOT-DNER AND MUC1 | 1 | 1 | 1 | COMPLEX-KCNQ2/LRRTM4/OPALIN | 0.87234 | 0.788462 | 0.97619 |
| IFI6 AND NOT-GPC3 AND SMAGP | 1 | 1 | 1 | ASTN1 AND NOT-MLC1 AND NOT-HTR6 | 0.871508 | 0.821053 | 0.928571 |
| IFI6 AND IFITM1 AND MUC1 | 1 | 1 | 1 | COMPLEX-GABRB2/KCNQ2/CACNA1B | 0.870968 | 0.794118 | 0.964286 |
| IFI6 AND ATP10B AND NOT-ERBB2 | 1 | 1 | 1 | COMPLEX-KCNA1/KCNQ2/CACNA1B | 0.870968 | 0.794118 | 0.964286 |
| NOX1 AND EDNRA AND NOT-ERBB2 | 1 | 1 | 1 | COMPLEX-OMG/SYT4/CACNA1B | 0.870056 | 0.827957 | 0.916667 |
| NOX1 AND EDNRA AND NOT-GPC3 | 1 | 1 | 1 | ASTN1 AND NOT-MC2R AND NOT-MLC1 | 0.870056 | 0.827957 | 0.916667 |
| IFI6 AND SLC35G1 AND NOT-GPC3 | 1 | 1 | 1 | COMPLEX-KCNQ2/SLCO1C1/LRRTM4 | 0.869565 | 0.8 | 0.952381 |
| CDH17 AND CDH3 AND NOT-MUC1 | 1 | 1 | 1 | COMPLEX-KCNQ2/ATP2B2/CACNA1B | 0.869565 | 0.8 | 0.952381 |
| DPEP1 AND NOT-SST AND NOT-GPC3 | 1 | 1 | 1 | ASTN1 AND NOT-MLC1 AND CNTNAP2 | 0.869048 | 0.869048 | 0.869048 |
| DPEP1 AND NOT-GPC3 AND SLC7A5 | 1 | 1 | 1 | ASTN1 AND ATP7A AND NOT-EMP3 | 0.868571 | 0.835165 | 0.904762 |
| GPA33 AND THY1 AND NOT-ERBB2 | 1 | 1 | 1 | NOT-EGFR AND PTK7 AND NOT-ITGB3 | 0.946108 | 0.951807 | 0.940476 |
| GUCY2C AND THY1 AND NOT-GPC3 | 1 | 1 | 1 | NOT-EGFR AND PTK7 AND NOT-CD33 | 0.934911 | 0.929412 | 0.940476 |
| GUCY2C AND THY1 AND NOT-ERBB2 | 1 | 1 | 1 | NOT-EGFR AND CD276 AND NOT-CD33 | 0.91954 | 0.888889 | 0.952381 |
| MUC13 AND SLC7A5 AND NOT-GPC3 | 1 | 1 | 1 | NOT-EGFR AND PTK7 AND CD37 | 0.825806 | 0.901408 | 0.761905 |
| MUC13 AND SLC7A5 AND NOT-ERBB2 | 1 | 1 | 1 | NOT-EGFR AND HSPA5 AND NOT-CD33 | 0.816754 | 0.728972 | 0.928571 |
| GPA33 AND SLC7A5 AND NOT-ERBB2 | 1 | 1 | 1 | NOT-EGFR AND PTK7 AND CD79B | 0.807947 | 0.910448 | 0.72619 |
| DPEP1 AND NOT-GPC3 AND ITGAV | 1 | 1 | 1 | COMPLEX-SLC26A9/SLC10A4/B4GALNT1 | 0.982249 | 0.976471 | 0.988095 |
| GPA33 AND SLC7A5 AND NOT-GPC3 | 1 | 1 | 1 | COMPLEX-SLC26A9/SLC10A4/B4GALNT1 | 0.982249 | 0.976471 | 0.988095 |
| DPEP1 AND NOT-GPC3 AND NOT-CLDN7 | 1 | 1 | 1 | COMPLEX-SLC10A4/OPN5/B4GALNT1 | 0.982249 | 0.976471 | 0.988095 |
| MUC13 AND THY1 AND NOT-ERBB2 | 1 | 1 | 1 | COMPLEX-SLC10A4/OPN5/B4GALNT1 | 0.982249 | 0.976471 | 0.988095 |
| MUC13 AND SLC7A5 AND NOT-MUC1 | 1 | 1 | 1 | COMPLEX-SLC10A4/B4GALNT1/PCDHAC1 | 0.982249 | 0.976471 | 0.988095 |
| CLDN3 AND THY1 AND NOT-GPC3 | 1 | 1 | 1 | COMPLEX-SLC10A4/B4GALNT1/ACE2 | 0.982249 | 0.976471 | 0.988095 |
| DPEP1 AND NOT-GPC3 AND SPON2 | 1 | 1 | 1 | COMPLEX-SLC10A4/B4GALNT1/CATSPERG | 0.982249 | 0.976471 | 0.988095 |
| DPEP1 AND NOT-GPC3 AND NOT-PCYT1A | 1 | 1 | 1 | COMPLEX-SLC10A4/B4GALNT1/CATSPERG | 0.982249 | 0.976471 | 0.988095 |
| DPEP1 AND NOT-GPC3 AND NOT-ENPP3 | 1 | 1 | 1 | COMPLEX-SLC10A4/B4GALNT1/ACE2 | 0.982249 | 0.976471 | 0.988095 |
| GUCY2C AND SLC7A5 AND NOT-ERBB2 | 1 | 1 | 1 | COMPLEX-SLC10A4/B4GALNT1/PCDHAC1 | 0.982249 | 0.976471 | 0.988095 |
| GUCY2C AND SLC7A5 AND NOT-GPC3 | 1 | 1 | 1 | COMPLEX-SLC10A4/B4GALNT1/GPR143 | 0.988095 | 0.988095 | 0.988095 |
| DPEP1 AND NOT-GPC3 AND THY1 | 1 | 1 | 1 | COMPLEX-SLC10A4/B4GALNT1/GPR143 | 0.988095 | 0.988095 | 0.988095 |
| GUCY2C AND THY1 AND NOT-MUC1 | 1 | 1 | 1 | COMPLEX-SLC10A4/B4GALNT1/S1PR5 | 0.976471 | 0.965116 | 0.988095 |
| GPA33 AND THY1 AND NOT-GPC3 | 1 | 1 | 1 | COMPLEX-SLC10A4/B4GALNT1/CLCA2 | 0.976471 | 0.965116 | 0.988095 |
| MUC13 AND THY1 AND NOT-GPC3 | 1 | 1 | 1 | COMPLEX-SLC10A4/B4GALNT1/CDH26 | 0.976471 | 0.965116 | 0.988095 |
| DPEP1 AND NOT-GPC3 AND CLDN1 | 1 | 1 | 1 | COMPLEX-CRHR2/SLC10A4/B4GALNT1 | 0.976471 | 0.965116 | 0.988095 |
| DPEP1 AND NOT-GPC3 AND KDR | 1 | 1 | 1 | COMPLEX-SLC10A4/B4GALNT1/GJB5 | 0.976471 | 0.965116 | 0.988095 |
| DPEP1 AND NOT-GPC3 AND CLDN1 | 1 | 1 | 1 | COMPLEX-SLC10A4/B4GALNT1/GJB5 | 0.976471 | 0.965116 | 0.988095 |
| DPEP1 AND NOT-GPC3 AND STEAP2 | 1 | 1 | 1 | COMPLEX-RRH/SLC10A4/B4GALNT1 | 0.976471 | 0.965116 | 0.988095 |
| DPEP1 AND NOT-GPC3 AND NOT-GPA33 | 1 | 1 | 1 | COMPLEX-SLC10A4/B4GALNT1/CLCA2 | 0.976471 | 0.965116 | 0.988095 |
| DPEP1 AND NOT-GPC3 AND NOT-TNFRSF13C | 1 | 1 | 1 | COMPLEX-CRHR2/SLC10A4/B4GALNT1 | 0.976471 | 0.965116 | 0.988095 |
| GPA33 AND SLC7A5 AND NOT-MUC1 | 1 | 1 | 1 | COMPLEX-RRH/SLC10A4/B4GALNT1 | 0.976471 | 0.965116 | 0.988095 |
| DPEP1 AND NOT-GPC3 AND NOT-CD160 | 1 | 1 | 1 | COMPLEX-SLC10A4/B4GALNT1/CDH26 | 0.976471 | 0.965116 | 0.988095 |
| DPEP1 AND NOT-GPC3 AND SLC39A6 | 1 | 1 | 1 | COMPLEX-SLC10A4/B4GALNT1/S1PR5 | 0.976471 | 0.965116 | 0.988095 |
| DPEP1 AND NOT-GPC3 AND STEAP1 | 1 | 1 | 1 | COMPLEX-SLC10A4/GABRA6/B4GALNT1 | 0.97619 | 0.97619 | 0.97619 |
| DPEP1 AND BIRC5 AND NOT-MSLN | 1 | 1 | 1 | COMPLEX-SLC10A4/GABRA6/B4GALNT1 | 0.97619 | 0.97619 | 0.97619 |
| DPEP1 AND NOT-GPC3 AND PTK7 | 1 | 1 | 1 | COMPLEX-OR5I1/SLC10A4/B4GALNT1 | 0.982249 | 0.976471 | 0.988095 |
| DPEP1 AND NOT-GPC3 AND THY1 | 1 | 1 | 1 | COMPLEX-SLC10A4/B4GALNT1/XKRX | 0.97619 | 0.97619 | 0.97619 |
| CLDN3 AND SLC7A5 AND NOT-MUC1 | 1 | 1 | 1 | COMPLEX-SLC10A4/B4GALNT1/TAS2R39 | 0.976471 | 0.965116 | 0.988095 |
| DPEP1 AND NOT-GPC3 AND CD70 | 1 | 1 | 1 | COMPLEX-SLC10A4/B4GALNT1/GPR101 | 0.982249 | 0.976471 | 0.988095 |
| DPEP1 AND NOT-GPC3 AND PTK7 | 1 | 1 | 1 | COMPLEX-SLC10A4/B4GALNT1/TAS2R39 | 0.976471 | 0.965116 | 0.988095 |
| DPEP1 AND NOT-GPC3 AND IL20RA | 1 | 1 | 1 | COMPLEX-SLC10A4/B4GALNT1/GRPR | 0.976471 | 0.965116 | 0.988095 |
| DPEP1 AND NOT-GPC3 AND ANXA1 | 1 | 1 | 1 | COMPLEX-SLC10A4/B4GALNT1/MAS1 | 0.982249 | 0.976471 | 0.988095 |
| DPEP1 AND NOT-GPC3 AND STEAP2 | 1 | 1 | 1 | COMPLEX-SLC10A4/B4GALNT1/GRPR | 0.976471 | 0.965116 | 0.988095 |
| DPEP1 AND NOT-GPC3 AND NOT-GPA33 | 1 | 1 | 1 | COMPLEX-SLC10A4/B4GALNT1/OR51B2 | 0.982249 | 0.976471 | 0.988095 |
| DPEP1 AND NOT-GPC3 AND CD276 | 1 | 1 | 1 | COMPLEX-OR5I1/SLC10A4/B4GALNT1 | 0.982249 | 0.976471 | 0.988095 |
| CLDN3 AND SLC7A5 AND NOT-GPC3 | 1 | 1 | 1 | COMPLEX-SLC10A4/B4GALNT1/HRH4 | 0.982249 | 0.976471 | 0.988095 |
| DPEP1 AND NOT-SST AND NOT-GPC3 | 1 | 1 | 1 | COMPLEX-CNR2/SLC10A4/B4GALNT1 | 0.97619 | 0.97619 | 0.97619 |
| GUCY2C AND SLC7A5 AND NOT-MUC1 | 1 | 1 | 1 | COMPLEX-SLC10A4/B4GALNT1/XKRX | 0.97619 | 0.97619 | 0.97619 |
| DPEP1 AND NOT-GPC3 AND ITGAV | 1 | 1 | 1 | COMPLEX-SLC10A4/B4GALNT1/GPR101 | 0.982249 | 0.976471 | 0.988095 |
| DPEP1 AND NOT-GPC3 AND NOT-TNFRSF13C | 1 | 1 | 1 | COMPLEX-SLC10A4/B4GALNT1/OR51B2 | 0.982249 | 0.976471 | 0.988095 |
| DPEP1 AND NOT-GPC3 AND NOT-CLDN7 | 1 | 1 | 1 | COMPLEX-SLC10A4/B4GALNT1/MAS1 | 0.982249 | 0.976471 | 0.988095 |
| DPEP1 AND NOT-GPC3 AND BIRC5 | 1 | 1 | 1 | COMPLEX-SLC10A4/B4GALNT1/HRH4 | 0.982249 | 0.976471 | 0.988095 |
| DPEP1 AND NOT-GPC3 AND ROR1 | 1 | 1 | 1 | COMPLEX-CNR2/SLC10A4/B4GALNT1 | 0.97619 | 0.97619 | 0.97619 |
| MUC13 AND THY1 AND NOT-MUC1 | 1 | 1 | 1 | COMPLEX-SLC10A4/B4GALNT1/ERVFRD-1 | 0.982249 | 0.976471 | 0.988095 |
| DPEP1 AND NOT-GPC3 AND BIRC5 | 1 | 1 | 1 | COMPLEX-SLC10A4/B4GALNT1/TAS2R41 | 0.982249 | 0.976471 | 0.988095 |
| DPEP1 AND NOT-GPC3 AND NOT-HHLA2 | 1 | 1 | 1 | COMPLEX-SLC10A4/B4GALNT1/DCHS2 | 0.988095 | 0.988095 | 0.988095 |
| GPA33 AND THY1 AND NOT-MUC1 | 1 | 1 | 1 | COMPLEX-SLC10A4/B4GALNT1/HTR1B | 0.982249 | 0.976471 | 0.988095 |
| DPEP1 AND NOT-GPC3 AND NOT-IL13RA1 | 1 | 1 | 1 | COMPLEX-SLC10A4/B4GALNT1/DCHS2 | 0.988095 | 0.988095 | 0.988095 |
| DPEP1 AND NOT-GPC3 AND PTK7 | 1 | 1 | 1 | COMPLEX-SLC10A4/B4GALNT1/OR7A17 | 0.976471 | 0.965116 | 0.988095 |
| DPEP1 AND NOT-GPC3 AND ANXA1 | 1 | 1 | 1 | COMPLEX-SLC10A4/B4GALNT1/OR10A3 | 0.976471 | 0.965116 | 0.988095 |
| DPEP1 AND NOT-GPC3 AND TNC | 1 | 1 | 1 | COMPLEX-SLC10A4/B4GALNT1/HTR1B | 0.982249 | 0.976471 | 0.988095 |
| DPEP1 AND NOT-GPC3 AND SLC7A5 | 1 | 1 | 1 | COMPLEX-SLC10A4/B4GALNT1/OR7A17 | 0.976471 | 0.965116 | 0.988095 |
| CLDN3 AND THY1 AND NOT-MUC1 | 1 | 1 | 1 | COMPLEX-SLC10A4/B4GALNT1/TAS2R41 | 0.982249 | 0.976471 | 0.988095 |
| DPEP1 AND CEACAM6 AND NOT-GPC3 | 1 | 1 | 1 | COMPLEX-SLC10A4/B4GALNT1/DUOX1 | 0.97076 | 0.954023 | 0.988095 |
| DPEP1 AND NOT-GPC3 AND NOT-SLC34A2 | 1 | 1 | 1 | COMPLEX-SLC10A4/B4GALNT1/MEP1B | 0.97076 | 0.954023 | 0.988095 |
| DPEP1 AND CEACAM6 AND NOT-GPC3 | 1 | 1 | 1 | COMPLEX-SLC10A4/B4GALNT1/IL12RB2 | 0.97076 | 0.954023 | 0.988095 |
| CLDN7 AND THY1 AND NOT-GPC3 | 1 | 1 | 1 | COMPLEX-SLC10A4/B4GALNT1/HFE | 0.97076 | 0.954023 | 0.988095 |
| DPEP1 AND NOT-GPC3 AND MET | 1 | 1 | 1 | COMPLEX-SLC10A4/B4GALNT1/MEP1B | 0.97076 | 0.954023 | 0.988095 |
| DPEP1 AND NOT-GPC3 AND NOT-GUCY2C | 1 | 1 | 1 | COMPLEX-SLC10A4/B4GALNT1/CNGB3 | 0.97076 | 0.954023 | 0.988095 |

FIG. 15 (cont.)

| Antigen Pair Logic | F1 | Precision | Recall |
|---|---|---|---|
| GPA33 AND SLC7A5 AND NOT-MSLN | 1 | 1 | 1 |
| DPEP1 AND NOT-TNFRSF13C AND ERBB2 | 1 | 1 | 1 |
| MUC13 AND SLC7A5 AND NOT-MSLN | 1 | 1 | 1 |
| BIRC5 AND NOT-IL11RA AND MUC1 | 1 | 1 | 1 |
| CLDN7 AND THY1 AND NOT-ERBB2 | 1 | 1 | 1 |
| BIRC5 AND NOT-GPC3 AND CLDN1 | 1 | 1 | 1 |
| DPEP1 AND NOT-MAGEA11 AND MUC1 | 1 | 1 | 1 |
| BIRC5 AND NOT-GPC3 AND CLDN1 | 1 | 1 | 1 |
| DPEP1 AND NOT-CLDN18 AND MUC1 | 1 | 1 | 1 |
| DPEP1 AND NOT-MAGEA1 AND MUC1 | 1 | 1 | 1 |
| BIRC5 AND NOT-IL11RA AND ERBB2 | 1 | 1 | 1 |
| DPEP1 AND ITGAV AND ERBB2 | 0.909091 | 0.833333 | 1 |
| DPEP1 AND SLC7A5 AND NOT-MUC1 | 0.909091 | 0.833333 | 1 |
| DPEP1 AND ITGAV AND MUC1 | 0.909091 | 0.833333 | 1 |
| DPEP1 AND ITGAV AND MUC1 | 0.909091 | 0.833333 | 1 |
| GUCY2C AND ITGAV AND ERBB2 | 1 | 1 | 1 |
| GUCY2C AND ITGAV AND NOT-MUC1 | 0.888889 | 1 | 0.8 |
| CEACAM6 AND ITGAV AND NOT-MUC1 | 0.888889 | 1 | 0.8 |
| MUC13 AND ITGAV AND NOT-MUC1 | 0.888889 | 1 | 0.8 |
| DPEP1 AND NOT-SST AND BIRC5 | 1 | 1 | 1 |
| GPA33 AND SLC7A5 AND NOT-ABCA5 | 1 | 1 | 1 |
| BIRC5 AND CLDN3 AND NOT-CLDN23 | 1 | 1 | 1 |
| GPA33 AND SLC7A5 AND NOT-GAGE1 | 1 | 1 | 1 |
| GPA33 AND SLC7A5 AND NOT-IGF1R | 1 | 1 | 1 |
| GPA33 AND SLC7A5 AND NOT-IL13RA1 | 1 | 1 | 1 |
| GPA33 AND SLC7A5 AND NOT-ITGB3 | 1 | 1 | 1 |
| DPEP1 AND NOT-IGF1R AND PTK7 | 1 | 1 | 1 |
| GPA33 AND SLC7A5 AND NOT-CD180 | 1 | 1 | 1 |
| BIRC5 AND MUC13 AND NOT-CLDN23 | 1 | 1 | 1 |
| GPA33 AND SLC7A5 AND NOT-MUC4 | 1 | 1 | 1 |
| GPA33 AND SLC7A5 AND NOT-SEMA5B | 1 | 1 | 1 |
| GPA33 AND SLC7A5 AND NOT-TRPM4 | 1 | 1 | 1 |
| GPA33 AND SLC7A5 AND NOT-TNFRSF17 | 1 | 1 | 1 |
| GPA33 AND SLC7A5 AND NOT-SSTR4 | 1 | 1 | 1 |
| GPA33 AND SLC7A5 AND NOT-ULBP3 | 1 | 1 | 1 |
| MUC13 AND SLC7A5 AND NOT-SST | 1 | 1 | 1 |
| DPEP1 AND NOT-MAGEA11 AND MET | 1 | 1 | 1 |
| GPA33 AND SLC7A5 AND NOT-EDNRB | 1 | 1 | 1 |
| DPEP1 AND SLC7A5 AND NOT-KDR | 1 | 1 | 1 |
| DPEP1 AND ITGAV AND NOT-CLDN9 | 1 | 1 | 1 |
| DPEP1 AND CEACAM6 AND SLC7A5 | 1 | 1 | 1 |
| BIRC5 AND CLDN3 AND NOT-CLDN7 | 1 | 1 | 1 |
| MUC13 AND SLC7A5 AND NOT-TNFRSF10A | 1 | 1 | 1 |
| MUC13 AND SLC7A5 AND NOT-CLDN6 | 1 | 1 | 1 |
| DPEP1 AND NOT-SST AND NOT-TYR | 1 | 1 | 1 |
| MUC13 AND SLC7A5 AND NOT-CD22 | 1 | 1 | 1 |
| BIRC5 AND GPA33 AND NOT-CLDN7 | 1 | 1 | 1 |
| MUC13 AND SLC7A5 AND NOT-CD79B | 1 | 1 | 1 |
| DPEP1 AND NOT-SST AND NOT-MAGEA11 | 1 | 1 | 1 |
| GPA33 AND SLC7A5 AND NOT-TNFRSF13C | 1 | 1 | 1 |
| GPA33 AND SLC7A5 AND NOT-CLDN7 | 1 | 1 | 1 |
| BIRC5 AND GUCY2C AND NOT-CLDN7 | 1 | 1 | 1 |
| GPA33 AND SLC7A5 AND NOT-DDX3X | 1 | 1 | 1 |
| BIRC5 AND MUC13 AND NOT-CLDN7 | 1 | 1 | 1 |
| GPA33 AND SLC7A5 AND NOT-FCRL5 | 1 | 1 | 1 |
| GPA33 AND SLC7A5 AND NOT-CLDN9 | 1 | 1 | 1 |
| GPA33 AND SLC7A5 AND NOT-CD33 | 1 | 1 | 1 |
| GPA33 AND SLC7A5 AND NOT-CD38 | 1 | 1 | 1 |
| MUC13 AND CLDN1 AND ITGAV | 1 | 1 | 1 |
| DPEP1 AND ITGAV AND CLDN4 | 1 | 1 | 1 |
| DPEP1 AND NOT-SST AND ANXA1 | 1 | 1 | 1 |
| GUCY2C AND SLC7A5 AND NOT-CD37 | 1 | 1 | 1 |
| DPEP1 AND CEACAM6 AND ITGAV | 1 | 1 | 1 |
| MUC13 AND CLDN1 AND NOT-CLDN3 | 1 | 1 | 1 |
| MUC13 AND CLDN1 AND NOT-MAGEA11 | 1 | 1 | 1 |
| DPEP1 AND ITGAV AND NOT-WT1 | 1 | 1 | 1 |
| MUC13 AND CLDN1 AND NOT-ENPP3 | 1 | 1 | 1 |
| GUCY2C AND THY1 AND NOT-FCRL1 | 1 | 1 | 1 |
| GUCY2C AND THY1 AND NOT-CLDN23 | 1 | 1 | 1 |
| DPEP1 AND ITGAV AND OAS1 | 1 | 1 | 1 |
| DPEP1 AND THY1 AND NOT-IGF1R | 1 | 1 | 1 |
| MUC13 AND THY1 AND ITGAV | 1 | 1 | 1 |
| GPA33 AND THY1 AND ITGAV | 1 | 1 | 1 |
| DPEP1 AND CEACAM5 AND ANXA1 | 1 | 1 | 1 |
| GPA33 AND SLC7A5 AND NOT-CD79A | 1 | 1 | 1 |
| CLDN3 AND THY1 AND NOT-CSPG4 | 1 | 1 | 1 |
| CLDN3 AND THY1 AND NOT-ENG | 1 | 1 | 1 |

| Antigen Pair Logic | F1 | Precision | Recall |
|---|---|---|---|
| COMPLEX-SLC10A4/B4GALNT1/KCNJ4 | 0.97076 | 0.954023 | 0.988095 |
| COMPLEX-SLC10A4/B4GALNT1/KCNIP3 | 0.97076 | 0.954023 | 0.988095 |
| COMPLEX-SLC10A4/B4GALNT1/CLEC12B | 0.97076 | 0.954023 | 0.988095 |
| COMPLEX-SLC10A4/B4GALNT1/CACNA1I | 0.97076 | 0.954023 | 0.988095 |
| COMPLEX-SLC10A4/B4GALNT1/CNGB3 | 0.97076 | 0.954023 | 0.988095 |
| COMPLEX-SLC10A4/B4GALNT1/GPR32 | 0.97076 | 0.954023 | 0.988095 |
| COMPLEX-SLC10A4/B4GALNT1/DUOX1 | 0.97076 | 0.954023 | 0.988095 |
| COMPLEX-SLC10A4/B4GALNT1/KCNIP3 | 0.97076 | 0.954023 | 0.988095 |
| COMPLEX-SLC10A4/B4GALNT1/IL12RB2 | 0.97076 | 0.954023 | 0.988095 |
| COMPLEX-SLC10A4/B4GALNT1/CACNA1I | 0.97076 | 0.954023 | 0.988095 |
| COMPLEX-SLC10A4/B4GALNT1/KCNJ4 | 0.97076 | 0.954023 | 0.988095 |
| COMPLEX-SLC10A4/B4GALNT1/HFE | 0.97076 | 0.954023 | 0.988095 |
| COMPLEX-SLC10A4/B4GALNT1/GLP1R | 0.970414 | 0.964706 | 0.97619 |
| COMPLEX-SLC10A4/B4GALNT1/GLP1R | 0.970414 | 0.964706 | 0.97619 |
| COMPLEX-SLC10A4/MS4A2/B4GALNT1 | 0.970414 | 0.964706 | 0.97619 |
| COMPLEX-SLC10A4/MS4A2/B4GALNT1 | 0.970414 | 0.964706 | 0.97619 |
| COMPLEX-SLC10A4/B4GALNT1/DUOXA1 | 0.97006 | 0.975904 | 0.964286 |
| COMPLEX-SLC10A4/B4GALNT1/OR4D1 | 0.97006 | 0.975904 | 0.964286 |
| COMPLEX-SLC10A4/B4GALNT1/OR51I1 | 0.97006 | 0.975904 | 0.964286 |
| COMPLEX-SLC10A4/B4GALNT1/OR1J4 | 0.97006 | 0.975904 | 0.964286 |
| COMPLEX-SLC10A4/B4GALNT1/SLC14A2 | 0.97006 | 0.975904 | 0.964286 |
| COMPLEX-SLC10A4/B4GALNT1/FASLG | 0.97006 | 0.975904 | 0.964286 |
| COMPLEX-SLC10A4/B4GALNT1/KCNJ1 | 0.97006 | 0.975904 | 0.964286 |
| COMPLEX-SLC10A4/B4GALNT1/SLC14A2 | 0.97006 | 0.975904 | 0.964286 |
| COMPLEX-SLC10A4/B4GALNT1/DUOXA1 | 0.97006 | 0.975904 | 0.964286 |
| COMPLEX-SLC10A4/B4GALNT1/HTR1F | 0.994012 | 1 | 0.988095 |
| COMPLEX-SLC10A4/B4GALNT1/HTR1F | 0.994012 | 1 | 0.988095 |
| COMPLEX-MRGPRX2/SLC10A4/B4GALNT1 | 0.976471 | 0.965116 | 0.988095 |
| COMPLEX-SLC9B1/SLC10A4/B4GALNT1 | 0.976471 | 0.965116 | 0.988095 |
| COMPLEX-SLC10A4/B4GALNT1/ADAM7 | 0.976471 | 0.965116 | 0.988095 |
| COMPLEX-SLC9B1/SLC10A4/B4GALNT1 | 0.976471 | 0.965116 | 0.988095 |
| COMPLEX-SLC10A4/B4GALNT1/GNRHR | 0.976471 | 0.965116 | 0.988095 |
| COMPLEX-SLC10A4/B4GALNT1/GNRHR | 0.976471 | 0.965116 | 0.988095 |
| COMPLEX-SLC10A4/B4GALNT1/ADAM7 | 0.976471 | 0.965116 | 0.988095 |
| COMPLEX-MRGPRX2/SLC10A4/B4GALNT1 | 0.976471 | 0.965116 | 0.988095 |
| COMPLEX-KCNU1/SLC10A4/B4GALNT1 | 0.97619 | 0.97619 | 0.97619 |
| COMPLEX-SLC10A4/B4GALNT1/CACNG6 | 0.97619 | 0.97619 | 0.97619 |
| COMPLEX-SLC10A4/GABRA1/B4GALNT1 | 0.97619 | 0.97619 | 0.97619 |
| COMPLEX-SLC10A4/GABRA1/B4GALNT1 | 0.97619 | 0.97619 | 0.97619 |
| COMPLEX-SLC10A4/GPRC6A/B4GALNT1 | 0.97619 | 0.97619 | 0.97619 |
| COMPLEX-KCNU1/SLC10A4/B4GALNT1 | 0.97619 | 0.97619 | 0.97619 |
| COMPLEX-SLC10A4/B4GALNT1/OR8B2 | 0.976471 | 0.965116 | 0.988095 |
| COMPLEX-OR5P3/SLC10A4/B4GALNT1 | 0.982249 | 0.976471 | 0.988095 |
| COMPLEX-SLC10A4/B4GALNT1/GRIN2B | 0.988095 | 0.988095 | 0.988095 |
| COMPLEX-OR5P3/SLC10A4/B4GALNT1 | 0.982249 | 0.976471 | 0.988095 |
| COMPLEX-TMPRSS11B/SLC10A4/B4GALNT1 | 0.982249 | 0.976471 | 0.988095 |
| COMPLEX-SLC10A4/B4GALNT1/GRM6 | 0.982249 | 0.976471 | 0.988095 |
| COMPLEX-TMPRSS11B/SLC10A4/B4GALNT1 | 0.982249 | 0.976471 | 0.988095 |
| COMPLEX-SLC10A4/B4GALNT1/LCT | 0.976471 | 0.965116 | 0.988095 |
| COMPLEX-SLC10A4/B4GALNT1/LCT | 0.976471 | 0.965116 | 0.988095 |
| COMPLEX-SLC10A4/B4GALNT1/OR8B2 | 0.976471 | 0.965116 | 0.988095 |
| COMPLEX-SLC10A4/B4GALNT1/GRIN2B | 0.988095 | 0.988095 | 0.988095 |
| COMPLEX-SLC10A4/B4GALNT1/GLRA3 | 0.994012 | 1 | 0.988095 |
| COMPLEX-SLC10A4/B4GALNT1/GLRA3 | 0.994012 | 1 | 0.988095 |
| COMPLEX-SLC10A4/B4GALNT1/SCN10A | 0.97076 | 0.954023 | 0.988095 |
| COMPLEX-SLC10A4/CALHM1/B4GALNT1 | 0.97076 | 0.954023 | 0.988095 |
| COMPLEX-ADAM30/SLC10A4/B4GALNT1 | 0.97076 | 0.954023 | 0.988095 |
| COMPLEX-SLC10A4/GABRA5/B4GALNT1 | 0.97076 | 0.954023 | 0.988095 |
| COMPLEX-SLC10A4/CALHM1/B4GALNT1 | 0.97076 | 0.954023 | 0.988095 |
| COMPLEX-ADAM30/SLC10A4/B4GALNT1 | 0.97076 | 0.954023 | 0.988095 |
| COMPLEX-SLC10A4/B4GALNT1/LRRC8E | 0.97076 | 0.954023 | 0.988095 |
| COMPLEX-SLC10A4/B4GALNT1/PCDHB1 | 0.97076 | 0.954023 | 0.988095 |
| COMPLEX-SLC10A4/B4GALNT1/SCN1A | 0.97076 | 0.954023 | 0.988095 |
| COMPLEX-SLC10A4/B4GALNT1/SCN1A | 0.97076 | 0.954023 | 0.988095 |
| COMPLEX-SLC10A4/B4GALNT1/LRRC8E | 0.97076 | 0.954023 | 0.988095 |
| COMPLEX-SLC10A4/GABRA5/B4GALNT1 | 0.97076 | 0.954023 | 0.988095 |
| COMPLEX-SLC10A4/B4GALNT1/SCN10A | 0.97076 | 0.954023 | 0.988095 |
| COMPLEX-SLC10A4/B4GALNT1/CD207 | 0.970414 | 0.964706 | 0.97619 |
| COMPLEX-SLC10A4/B4GALNT1/SLC22A16 | 0.970414 | 0.964706 | 0.97619 |
| COMPLEX-SLC10A4/B4GALNT1/SLC22A16 | 0.970414 | 0.964706 | 0.97619 |
| COMPLEX-CLDN16/SLC10A4/B4GALNT1 | 0.97006 | 0.975904 | 0.964286 |
| COMPLEX-SLC10A4/B4GALNT1/PCDH11X | 0.97006 | 0.975904 | 0.964286 |
| COMPLEX-HTR3C/SLC10A4/B4GALNT1 | 0.97006 | 0.975904 | 0.964286 |
| COMPLEX-HTR3C/SLC10A4/B4GALNT1 | 0.97006 | 0.975904 | 0.964286 |
| COMPLEX-SLC10A4/B4GALNT1/PCDH11X | 0.97006 | 0.975904 | 0.964286 |
| COMPLEX-CLDN16/SLC10A4/B4GALNT1 | 0.97006 | 0.975904 | 0.964286 |
| COMPLEX-SLC10A4/B4GALNT1/SLC28A1 | 0.965116 | 0.943182 | 0.988095 |

FIG. 15 (cont.)

| Antigen Pair Logic | F1 | Precision | Recall | Antigen Pair Logic | F1 | Precision | Recall |
|---|---|---|---|---|---|---|---|
| CLDN3 AND THY1 AND NOT-MAGEA4 | 1 | 1 | 1 | COMPLEX-SLC10A4/B4GALNT1/ROS1 | 0.965116 | 0.943182 | 0.988095 |
| DPEP1 AND CEACAM6 AND THY1 | 1 | 1 | 1 | COMPLEX-SLC10A4/B4GALNT1/CACNG8 | 0.965116 | 0.943182 | 0.988095 |
| CLDN3 AND THY1 AND NOT-CD72 | 1 | 1 | 1 | COMPLEX-CNGA4/SLC10A4/B4GALNT1 | 0.965116 | 0.943182 | 0.988095 |
| DPEP1 AND BIRC5 AND NOT-TNFRSF8 | 1 | 1 | 1 | COMPLEX-SLC10A4/B4GALNT1/HTR6 | 0.965116 | 0.943182 | 0.988095 |
| DPEP1 AND NOT-ERBB4 AND PTK7 | 1 | 1 | 1 | COMPLEX-CNGA4/SLC10A4/B4GALNT1 | 0.965116 | 0.943182 | 0.988095 |
| DPEP1 AND ANXA1 AND NOT-DLL3 | 1 | 1 | 1 | COMPLEX-SLC10A4/B4GALNT1/HTR6 | 0.965116 | 0.943182 | 0.988095 |
| GUCY2C AND SLC7A5 AND NOT-CSPG4 | 1 | 1 | 1 | COMPLEX-SLC10A4/B4GALNT1/TRPM3 | 0.965116 | 0.943182 | 0.988095 |
| DPEP1 AND NOT-ERBB4 AND ANXA1 | 1 | 1 | 1 | COMPLEX-SLC10A4/B4GALNT1/ROS1 | 0.965116 | 0.943182 | 0.988095 |
| BIRC5 AND GPA33 AND ITGAV | 1 | 1 | 1 | COMPLEX-SLC10A4/B4GALNT1/SLC28A1 | 0.965116 | 0.943182 | 0.988095 |
| GUCY2C AND SLC7A5 AND NOT-MAGEA4 | 1 | 1 | 1 | COMPLEX-SLC10A4/B4GALNT1/GPR26 | 0.965116 | 0.943182 | 0.988095 |
| BIRC5 AND GPA33 AND NOT-MST1R | 1 | 1 | 1 | COMPLEX-SLC10A4/B4GALNT1/AJAP1 | 0.964706 | 0.953488 | 0.97619 |
| DPEP1 AND SLC7A5 AND NOT-MAGEA4 | 1 | 1 | 1 | COMPLEX-SLC10A4/B4GALNT1/SLC1A6 | 0.964706 | 0.953488 | 0.97619 |
| MUC13 AND SLC7A5 AND NOT-FCRL2 | 1 | 1 | 1 | COMPLEX-SLC10A4/B4GALNT1/GJA10 | 0.964706 | 0.953488 | 0.97619 |
| GUCY2C AND THY1 AND NOT-ERBB4 | 1 | 1 | 1 | COMPLEX-SLC10A4/B4GALNT1/GJA10 | 0.964706 | 0.953488 | 0.97619 |
| DPEP1 AND ITGAV AND GUCY2C | 1 | 1 | 1 | COMPLEX-SLC10A4/B4GALNT1/CLRN1 | 0.964286 | 0.964286 | 0.964286 |
| CLDN3 AND SLC7A5 AND NOT-FCRL1 | 1 | 1 | 1 | COMPLEX-SLC10A4/B4GALNT1/DPP10 | 0.964286 | 0.964286 | 0.964286 |
| DPEP1 AND CEACAM6 AND NOT-CLDN7 | 1 | 1 | 1 | COMPLEX-SLC10A4/B4GALNT1/CLRN1 | 0.964286 | 0.964286 | 0.964286 |
| BIRC5 AND MUC13 AND NOT-CLDN23 | 1 | 1 | 1 | COMPLEX-SLC10A4/B4GALNT1/GRIN2C | 0.963855 | 0.97561 | 0.952381 |
| DPEP1 AND CEACAM6 AND SLC7A5 | 1 | 1 | 1 | COMPLEX-SLC10A4/B4GALNT1/SLC12A3 | 0.959538 | 0.932584 | 0.988095 |
| DPEP1 AND ITGAV AND OAS1 | 1 | 1 | 1 | COMPLEX-SLC10A4/B4GALNT1/OR2L2 | 0.959538 | 0.932584 | 0.988095 |
| CLDN3 AND SLC7A5 AND NOT-ERBB4 | 1 | 1 | 1 | COMPLEX-SLC10A4/B4GALNT1/SLC12A3 | 0.959538 | 0.932584 | 0.988095 |
| GUCY2C AND SLC7A5 AND NOT-CLDN3 | 1 | 1 | 1 | COMPLEX-SLC10A4/B4GALNT1/OR2L2 | 0.959538 | 0.932584 | 0.988095 |
| DPEP1 AND THY1 AND NOT-ERBB4 | 1 | 1 | 1 | COMPLEX-SLC10A4/B4GALNT1/CLDN17 | 0.959064 | 0.942529 | 0.97619 |
| CLDN3 AND SLC7A5 AND NOT-ANXA1 | 1 | 1 | 1 | COMPLEX-SLC10A4/B4GALNT1/CLDN17 | 0.959064 | 0.942529 | 0.97619 |
| DPEP1 AND NOT-MAGEA1 AND THY1 | 1 | 1 | 1 | COMPLEX-SLC10A4/MLANA/B4GALNT1 | 0.95858 | 0.952941 | 0.964286 |
| CLDN3 AND SLC7A5 AND NOT-HLA-DOB | 1 | 1 | 1 | COMPLEX-SLC10A4/MLANA/B4GALNT1 | 0.95858 | 0.952941 | 0.964286 |
| DPEP1 AND NOT-CLDN18 AND THY1 | 1 | 1 | 1 | COMPLEX-SLC10A4/CATSPERD/B4GALNT1 | 0.958084 | 0.963855 | 0.952381 |
| BIRC5 AND EPCAM AND ITGAV | 1 | 1 | 1 | COMPLEX-SLC10A4/NFASC/B4GALNT1 | 0.958084 | 0.963855 | 0.952381 |
| DPEP1 AND STEAP2 AND NOT-ULBP3 | 1 | 1 | 1 | COMPLEX-SLC10A4/B4GALNT1/CRB2 | 0.954023 | 0.922222 | 0.988095 |
| CLDN3 AND SLC7A5 AND NOT-PMEL | 1 | 1 | 1 | COMPLEX-SLC10A4/B4GALNT1/GPR6 | 0.954023 | 0.922222 | 0.988095 |
| GPA33 AND SLC7A5 AND NOT-CLDN3 | 1 | 1 | 1 | COMPLEX-SLC22A12/SLC10A4/B4GALNT1 | 0.954023 | 0.922222 | 0.988095 |
| DPEP1 AND CEACAM6 AND BIRC5 | 1 | 1 | 1 | COMPLEX-SLC10A4/B4GALNT1/CACNA1S | 0.954023 | 0.922222 | 0.988095 |
| MUC13 AND SLC7A5 AND NOT-SSX1 | 1 | 1 | 1 | COMPLEX-SLC10A4/B4GALNT1/RXFP3 | 0.954023 | 0.922222 | 0.988095 |
| CLDN7 AND SLC7A5 AND NOT-PCYT1A | 1 | 1 | 1 | COMPLEX-SLC10A4/B4GALNT1/GPR6 | 0.954023 | 0.922222 | 0.988095 |
| DPEP1 AND NOT-TNFRSF13C AND CD52 | 1 | 1 | 1 | COMPLEX-SLC22A12/SLC10A4/B4GALNT1 | 0.954023 | 0.922222 | 0.988095 |
| BIRC5 AND EPCAM AND NOT-CLDN7 | 1 | 1 | 1 | COMPLEX-SLC10A4/B4GALNT1/OR2L13 | 0.954023 | 0.922222 | 0.988095 |
| DPEP1 AND ITGAV AND BIRC5 | 1 | 1 | 1 | COMPLEX-SLC10A4/B4GALNT1/ATP7A | 0.954023 | 0.922222 | 0.988095 |
| IFI6 AND NOX1 AND NOT-OTOF | 1 | 1 | 1 | COMPLEX-S1PR1/SLC10A4/B4GALNT1 | 0.954023 | 0.922222 | 0.988095 |
| IFI6 AND CEACAM7 AND NOT-SLC22A16 | 1 | 1 | 1 | COMPLEX-SLC10A4/B4GALNT1/TYR | 0.976471 | 0.965116 | 0.988095 |
| IFI6 AND CEACAM7 AND NOT-SLC12A3 | 1 | 1 | 1 | COMPLEX-SLC10A4/B4GALNT1/ITGB3 | 0.976471 | 0.965116 | 0.988095 |
| IFI6 AND MUC12 AND NOT-GRIA4 | 1 | 1 | 1 | COMPLEX-SLC10A4/B4GALNT1/ITGB3 | 0.976471 | 0.965116 | 0.988095 |
| IFI6 AND FUT3 AND NOT-AOC3 | 1 | 1 | 1 | COMPLEX-SLC10A4/B4GALNT1/ABCB5 | 0.97076 | 0.954023 | 0.988095 |
| IFI6 AND MUC12 AND NOT-CHRND | 1 | 1 | 1 | COMPLEX-SLC10A4/B4GALNT1/ABCB5 | 0.97076 | 0.954023 | 0.988095 |
| IFI6 AND MUC12 AND NOT-GPR50 | 1 | 1 | 1 | COMPLEX-SLC10A4/B4GALNT1/CLDN18 | 0.97076 | 0.954023 | 0.988095 |
| IFI6 AND CEACAM7 AND NOT-TMPRSS11D | 1 | 1 | 1 | COMPLEX-SLC10A4/B4GALNT1/CLDN18 | 0.97076 | 0.954023 | 0.988095 |
| IFI6 AND MUC12 AND NOT-RXFP3 | 1 | 1 | 1 | COMPLEX-SLC10A4/B4GALNT1/ITGB6 | 0.97006 | 0.975904 | 0.964286 |
| IFI6 AND MUC12 AND NOT-CNGA4 | 1 | 1 | 1 | COMPLEX-SLC10A4/B4GALNT1/ITGB6 | 0.97006 | 0.975904 | 0.964286 |
| IFI6 AND CEACAM7 AND NOT-GRIN1 | 1 | 1 | 1 | COMPLEX-DNAJB8/SLC10A4/B4GALNT1 | 0.959538 | 0.932584 | 0.988095 |
| IFI6 AND VANGL1 AND NOT-ADAM7 | 1 | 1 | 1 | COMPLEX-SLC10A4/B4GALNT1/PROM1 | 0.959538 | 0.932584 | 0.988095 |
| IFI6 AND MUC12 AND NOT-CRB2 | 1 | 1 | 1 | COMPLEX-SLC10A4/B4GALNT1/IL20RA | 0.95858 | 0.952941 | 0.964286 |
| IFI6 AND MUC12 AND NOT-SLC12A5 | 1 | 1 | 1 | COMPLEX-SLC10A4/B4GALNT1/ULBP3 | 0.954023 | 0.922222 | 0.988095 |
| IFI6 AND FUT3 AND NOT-SLC12A5 | 1 | 1 | 1 | COMPLEX-HHLA2/SLC10A4/B4GALNT1 | 0.953488 | 0.931818 | 0.97619 |
| IFI6 AND MUC12 AND NOT-SLC4A5 | 1 | 1 | 1 | COMPLEX-SLC10A4/B4GALNT1/MST1R | 0.948571 | 0.912088 | 0.988095 |
| FUT3 AND NOT-CHRND AND CDH11 | 1 | 1 | 1 | COMPLEX-SLC10A4/B4GALNT1/MST1R | 0.948571 | 0.912088 | 0.988095 |
| IFI6 AND MUC12 AND NOT-CACNG2 | 1 | 1 | 1 | COMPLEX-SLC10A4/ERBB4/B4GALNT1 | 0.947368 | 0.931034 | 0.964286 |
| IFI6 AND VANGL1 AND NOT-ATP6V0A4 | 1 | 1 | 1 | COMPLEX-SLC10A4/ERBB4/B4GALNT1 | 0.947368 | 0.931034 | 0.964286 |
| IFI6 AND CEACAM7 AND NOT-IFNAR2 | 1 | 1 | 1 | COMPLEX-SLC10A4/B4GALNT1/CD22 | 0.942529 | 0.911111 | 0.97619 |
| IFI6 AND NOX1 AND NOT-IFNAR2 | 1 | 1 | 1 | COMPLEX-SLC10A4/B4GALNT1/RNF43 | 0.942529 | 0.911111 | 0.97619 |
| IFI6 AND MUC12 AND NOT-CRB1 | 1 | 1 | 1 | COMPLEX-SLC10A4/B4GALNT1/RNF43 | 0.942529 | 0.911111 | 0.97619 |
| IFI6 AND VANGL1 AND NOT-HTR1F | 1 | 1 | 1 | COMPLEX-SLC10A4/B4GALNT1/ENPP3 | 0.942529 | 0.911111 | 0.97619 |
| IFI6 AND MUC12 AND NOT-MLANA | 1 | 1 | 1 | COMPLEX-SLC10A4/B4GALNT1/CD22 | 0.942529 | 0.911111 | 0.97619 |
| IFI6 AND CEACAM7 AND NOT-KCNK9 | 1 | 1 | 1 | COMPLEX-SLC10A4/B4GALNT1/ENPP3 | 0.942529 | 0.911111 | 0.97619 |
| IFI6 AND MUC12 AND NOT-SLC10A2 | 1 | 1 | 1 | COMPLEX-SLC10A4/ENG/B4GALNT1 | 0.937143 | 0.901099 | 0.97619 |
| IFI6 AND CEACAM7 AND NOT-PTGER4 | 1 | 1 | 1 | COMPLEX-SLC10A4/B4GALNT1/ULBP1 | 0.936416 | 0.910112 | 0.964286 |
| IFI6 AND NOX1 AND NOT-NETO1 | 1 | 1 | 1 | COMPLEX-SLC10A4/FOLR1/B4GALNT1 | 0.932515 | 0.962025 | 0.904762 |
| IFI6 AND NOX1 AND NOT-MEGF10 | 1 | 1 | 1 | COMPLEX-TNFRSF13C/SLC10A4/B4GALNT1 | 0.929412 | 0.918605 | 0.940476 |
| IFI6 AND NOX1 AND NOT-KIRREL3 | 1 | 1 | 1 | COMPLEX-SLC10A4/B4GALNT1/CLDN6 | 0.928571 | 0.928571 | 0.928571 |
| IFI6 AND NOX1 AND NOT-SLC22A16 | 1 | 1 | 1 | COMPLEX-SLC10A4/B4GALNT1/HSPA5 | 0.926554 | 0.88172 | 0.97619 |
| IFI6 AND NOX1 AND NOT-ADAM21 | 1 | 1 | 1 | COMPLEX-SLC10A4/B4GALNT1/CD34 | 0.924855 | 0.898876 | 0.952381 |
| IFI6 AND NOX1 AND NOT-CCKBR | 1 | 1 | 1 | COMPLEX-SLC10A4/B4GALNT1/IL13RA1 | 0.922222 | 0.864583 | 0.988095 |
| IFI6 AND NOX1 AND NOT-CD1B | 1 | 1 | 1 | COMPLEX-SLC10A4/B4GALNT1/IL13RA1 | 0.922222 | 0.864583 | 0.988095 |
| IFI6 AND NOX1 AND NOT-GUCY2F | 1 | 1 | 1 | COMPLEX-SLC10A4/B4GALNT1/STEAP1 | 0.922156 | 0.927711 | 0.916667 |
| IFI6 AND CEACAM7 AND NOT-SLC5A8 | 1 | 1 | 1 | COMPLEX-SLC10A4/B4GALNT1/CEACAM6 | 0.922156 | 0.927711 | 0.916667 |
| IFI6 AND CEACAM7 AND NOT-PIRT | 1 | 1 | 1 | COMPLEX-SLC10A4/ALK/B4GALNT1 | 0.91954 | 0.888889 | 0.952381 |
| IFI6 AND CEACAM7 AND NOT-GJA3 | 1 | 1 | 1 | COMPLEX-SLC10A4/FLOT2/B4GALNT1 | 0.918605 | 0.897727 | 0.940476 |
| IFI6 AND MUC12 AND NOT-MLNR | 1 | 1 | 1 | COMPLEX-SLC10A4/B4GALNT1/STEAP2 | 0.914634 | 0.9375 | 0.892857 |
| NOX1 AND NOT-CD1B AND CDH11 | 1 | 1 | 1 | COMPLEX-SLC10A4/B4GALNT1/STEAP2 | 0.914634 | 0.9375 | 0.892857 |

FIG. 15 (cont.)

| Antigen Pair Logic | F1 | Precision | Recall |
|---|---|---|---|
| IFI6 AND NOX1 AND NOT-CD1B | 1 | 1 | 1 |
| NOX1 AND NOT-CD1B AND SLC6A6 | 1 | 1 | 1 |
| IFI6 AND MUC12 AND NOT-CLCN1 | 1 | 1 | 1 |
| IFI6 AND CEACAM7 AND NOT-GUCY2F | 1 | 1 | 1 |
| IFI6 AND VANGL1 AND NOT-SLC22A25 | 1 | 1 | 1 |
| IFI6 AND MUC12 AND NOT-GPR12 | 1 | 1 | 1 |
| IFI6 AND FUT3 AND NOT-GPR12 | 1 | 1 | 1 |
| IFI6 AND CEACAM7 AND NOT-PAQR7 | 1 | 1 | 1 |
| IFI6 AND CEACAM7 AND NOT-GABRA5 | 1 | 1 | 1 |
| IFI6 AND NOX1 AND NOT-GABRA5 | 1 | 1 | 1 |
| IFI6 AND MUC12 AND NOT-DGKE | 1 | 1 | 1 |
| IFI6 AND VANGL1 AND NOT-TSHR | 1 | 1 | 1 |
| IFI6 AND VANGL1 AND NOT-MOG | 1 | 1 | 1 |
| CDH17 AND TGFBI AND NOT-CHRND | 1 | 1 | 1 |
| NOX1 AND TGFBI AND NOT-CHRND | 1 | 1 | 1 |
| IFI6 AND CEACAM7 AND NOT-IL13 | 1 | 1 | 1 |
| IFI6 AND NOX1 AND NOT-IL13 | 1 | 1 | 1 |
| IFI6 AND VANGL1 AND NOT-GRM4 | 1 | 1 | 1 |
| NOX1 AND NOT-EPHA10 AND NOT-PCDHA6 | 1 | 1 | 1 |
| NOX1 AND NOT-EPHA10 AND CD44 | 1 | 1 | 1 |
| IFI6 AND CEACAM7 AND NOT-CD36 | 1 | 1 | 1 |
| IFI6 AND NOT-SLCO6A1 AND ATP8B1 | 1 | 1 | 1 |
| IFI6 AND NOX1 AND NOT-KCNK16 | 1 | 1 | 1 |
| IFI6 AND NOT-STEAP4 AND VANGL1 | 1 | 1 | 1 |
| IFI6 AND VANGL1 AND NOT-CACNG2 | 1 | 1 | 1 |
| IFI6 AND VANGL1 AND NOT-GABRA5 | 1 | 1 | 1 |
| IFI6 AND VANGL1 AND NOT-OR3A2 | 1 | 1 | 1 |
| IFI6 AND VANGL1 AND NOT-SLC6A15 | 1 | 1 | 1 |
| IFI6 AND VANGL1 AND NOT-AJAP1 | 1 | 1 | 1 |
| IFI6 AND VANGL1 AND NOT-SLC4A5 | 1 | 1 | 1 |
| IFI6 AND VANGL1 AND NOT-SCN2A | 1 | 1 | 1 |
| IFI6 AND MUC12 AND NOT-GPR26 | 1 | 1 | 1 |
| IFI6 AND CEACAM7 AND NOT-MLC1 | 1 | 1 | 1 |
| NOX1 AND TGFBI AND NOT-DISP2 | 1 | 1 | 1 |
| MUC12 AND TGFBI AND NOT-SLC9A1 | 1 | 1 | 1 |
| IFI6 AND NOT-CD36 AND NOT-PIRT | 1 | 1 | 1 |
| IFI6 AND CEACAM7 AND NOT-KCNK16 | 1 | 1 | 1 |
| IFI6 AND MUC12 AND NOT-CDH22 | 1 | 1 | 1 |
| IFI6 AND CEACAM7 AND NOT-GRIN2C | 1 | 1 | 1 |
| IFI6 AND CEACAM7 AND NOT-GPRC6A | 1 | 1 | 1 |
| NOX1 AND TGFBI AND NOT-MUC1 | 1 | 1 | 1 |
| CDH17 AND TGFBI AND NOT-MUC1 | 1 | 1 | 1 |
| IFI6 AND CEACAM7 AND NOT-MUC1 | 1 | 1 | 1 |
| IFI6 AND MUC12 AND NOT-MUC1 | 1 | 1 | 1 |
| CDH17 AND TGFBI AND NOT-MUC1 | 1 | 1 | 1 |
| IFI6 AND NOT-MLC1 AND MUC1 | 1 | 1 | 1 |
| IFI6 AND MUC12 AND NOT-MUC1 | 1 | 1 | 1 |
| IFI6 AND MUC12 AND NOT-GPC3 | 1 | 1 | 1 |
| IFI6 AND CEACAM7 AND NOT-GPC3 | 1 | 1 | 1 |
| IFI6 AND MUC12 AND NOT-GPC3 | 1 | 1 | 1 |
| IFI6 AND CEACAM7 AND NOT-GPC3 | 1 | 1 | 1 |
| IFI6 AND CEACAM7 AND NOT-ERBB2 | 1 | 1 | 1 |
| IFI6 AND NOT-KCNV2 AND MUC1 | 1 | 1 | 1 |
| IFI6 AND NOT-KCNV2 AND MUC1 | 1 | 1 | 1 |
| IFI6 AND NOT-GPC3 AND SLC1A5 | 1 | 1 | 1 |
| IFI6 AND NOT-GPC3 AND CDH11 | 1 | 1 | 1 |
| IFI6 AND NOT-GPC3 AND EFNB2 | 1 | 1 | 1 |
| IFI6 AND NOT-GPC3 AND LRIG3 | 1 | 1 | 1 |
| IFI6 AND NOT-GPC3 AND TNFRSF12A | 1 | 1 | 1 |
| NOX1 AND TGFBI AND NOT-MUC1 | 1 | 1 | 1 |
| IFI6 AND NOX1 AND NOT-GPC3 | 1 | 1 | 1 |
| IFI6 AND NOT-STEAP4 AND MUC1 | 1 | 1 | 1 |
| IFI6 AND CEACAM7 AND NOT-ERBB2 | 1 | 1 | 1 |
| IFI6 AND NOT-GPC3 AND ATP8B1 | 1 | 1 | 1 |
| IFI6 AND MUC12 AND NOT-ERBB2 | 1 | 1 | 1 |
| IFI6 AND CEACAM7 AND NOT-MSLN | 1 | 1 | 1 |
| IFI6 AND NOT-GPC3 AND VANGL1 | 1 | 1 | 1 |
| CDH17 AND NOT-SLC9A1 AND ERBB2 | 1 | 1 | 1 |
| IFI6 AND NOT-GPC3 AND VANGL1 | 1 | 1 | 1 |
| CDH17 AND NOT-SLC9A1 AND NOT-GPC3 | 1 | 1 | 1 |
| IFI6 AND NOT-GPR26 AND MUC1 | 1 | 1 | 1 |
| IFI6 AND NOT-ATP8A2 AND MUC1 | 1 | 1 | 1 |
| IFI6 AND NOT-SPAM1 AND MUC1 | 1 | 1 | 1 |
| IFI6 AND NOT-MDGA2 AND MUC1 | 1 | 1 | 1 |
| IFI6 AND NOT-MDGA2 AND MUC1 | 1 | 1 | 1 |
| IFI6 AND NOT-GPR26 AND ERBB2 | 1 | 1 | 1 |
| IFI6 AND NOT-GPR26 AND MUC1 | 1 | 1 | 1 |

| Antigen Pair Logic | F1 | Precision | Recall |
|---|---|---|---|
| COMPLEX-GPNMB/SLC10A4/B4GALNT1 | 0.913295 | 0.88764 | 0.940476 |
| COMPLEX-SLC10A4/B4GALNT1/ANXA1 | 0.912281 | 0.896552 | 0.928571 |
| COMPLEX-DDX3X/SLC10A4/B4GALNT1 | 0.907975 | 0.936709 | 0.880952 |
| COMPLEX-SLC10A4/B4GALNT1/CLDN8 | 0.903614 | 0.914634 | 0.892857 |
| COMPLEX-SLC10A4/B4GALNT1/THY1 | 0.902439 | 0.925 | 0.880952 |
| COMPLEX-SPON2/SLC10A4/B4GALNT1 | 0.901734 | 0.876404 | 0.928571 |
| COMPLEX-SLC10A4/B4GALNT1/IGF1R | 0.900585 | 0.885057 | 0.916667 |
| APLP1 AND CD276 AND NOT-B4GALNT1 | 0.900585 | 0.885057 | 0.916667 |
| COMPLEX-SLC10A4/B4GALNT1/VCAM1 | 0.899408 | 0.894118 | 0.904762 |
| COMPLEX-SLC10A4/B4GALNT1/MAGEA1 | 0.888889 | 0.873563 | 0.904762 |
| COMPLEX-AFP/SLC10A4/B4GALNT1 | 0.882353 | 0.872093 | 0.892857 |
| COMPLEX-CLDN23/SLC10A4/B4GALNT1 | 0.882353 | 0.872093 | 0.892857 |
| COMPLEX-SLC10A4/B4GALNT1/TNFRSF8 | 0.878049 | 0.9 | 0.857143 |
| COMPLEX-SLC10A4/B4GALNT1/SDC1 | 0.873418 | 0.932432 | 0.821429 |
| COMPLEX-SLC10A4/B4GALNT1/ULBP2 | 0.872727 | 0.888889 | 0.857143 |
| COMPLEX-SLC10A4/B4GALNT1/IL11RA | 0.871166 | 0.898734 | 0.845238 |
| COMPLEX-SLC10A4/B4GALNT1/IL11RA | 0.871166 | 0.898734 | 0.845238 |
| COMPLEX-SLC10A4/B4GALNT1/ROR1 | 0.86747 | 0.878049 | 0.857143 |
| COMPLEX-SLC10A4/B4GALNT1/OAS1 | 0.866242 | 0.931507 | 0.809524 |
| COMPLEX-SLC10A4/B4GALNT1/GPC3 | 0.865854 | 0.8875 | 0.845238 |
| COMPLEX-SLC10A4/B4GALNT1/IL13RA2 | 0.862275 | 0.86747 | 0.857143 |
| COMPLEX-SLC10A4/SLC39A6/B4GALNT1 | 0.860606 | 0.876543 | 0.845238 |
| COMPLEX-SLC10A4/SLC39A6/B4GALNT1 | 0.860606 | 0.876543 | 0.845238 |
| COMPLEX-SLC10A4/B4GALNT1/CD37 | 0.855422 | 0.865854 | 0.845238 |
| COMPLEX-SLC10A4/B4GALNT1/GUCY2C | 0.855422 | 0.865854 | 0.845238 |
| COMPLEX-SLC10A4/EPHB2/B4GALNT1 | 0.848485 | 0.864198 | 0.833333 |
| COMPLEX-CLDN3/SLC10A4/B4GALNT1 | 0.846626 | 0.873418 | 0.821429 |
| COMPLEX-SLC10A4/B4GALNT1/PMEL | 0.841463 | 0.8625 | 0.821429 |
| COMPLEX-SLC10A4/B4GALNT1/SSTR5 | 0.841463 | 0.8625 | 0.821429 |
| COMPLEX-SLC10A4/B4GALNT1/EPCAM | 0.838323 | 0.843373 | 0.833333 |
| COMPLEX-DLL3/SLC10A4/B4GALNT1 | 0.834356 | 0.860759 | 0.809524 |
| COMPLEX-SLC10A4/B4GALNT1/TNFRSF10A | 0.829268 | 0.85 | 0.809524 |
| COMPLEX-SLC10A4/ABCA5/B4GALNT1 | 0.82716 | 0.858974 | 0.797619 |
| COMPLEX-SLC10A4/B4GALNT1/CD180 | 0.82716 | 0.858974 | 0.797619 |
| COMPLEX-SLC10A4/B4GALNT1/SSTR2 | 0.822785 | 0.878378 | 0.77381 |
| SCN3B AND NOT-B4GALNT1 AND CD276 | 0.820513 | 0.888889 | 0.761905 |
| COMPLEX-SLC10A4/B4GALNT1/IL2RA | 0.819876 | 0.857143 | 0.785714 |
| COMPLEX-SLC10A4/EPHA3/B4GALNT1 | 0.817073 | 0.8375 | 0.797619 |
| COMPLEX-SLC10A4/ERBB2/B4GALNT1 | 0.815287 | 0.876712 | 0.761905 |
| COMPLEX-SLC10A4/B4GALNT1/CD38 | 0.8125 | 0.855263 | 0.77381 |
| COMPLEX-SLC10A4/B4GALNT1/CD38 | 0.8125 | 0.855263 | 0.77381 |
| COMPLEX-MLC1/B4GALNT1/ASTN1 | 0.820513 | 0.720721 | 0.952381 |
| Oligodendroglioma | | | |
| GRIA2 AND BMPR1A AND NOT-PTPRM | 0.965517 | 1 | 0.933333 |
| GRIA2 AND BMPR1A AND NOT-FLRT2 | 0.965517 | 1 | 0.933333 |
| GRIA2 AND ANTXR1 AND NOT-RNF144A | 0.928571 | 1 | 0.866667 |
| GRIA2 AND BMPR1A AND NOT-RNF144A | 0.965517 | 1 | 0.933333 |
| GRIA2 AND ANTXR1 AND NOT-SLMAP | 0.928571 | 1 | 0.866667 |
| GRIA2 AND ANTXR1 AND NOT-ADIPOR1 | 0.928571 | 1 | 0.866667 |
| GRIA2 AND ANTXR1 AND NOT-PTPRM | 0.928571 | 1 | 0.866667 |
| GRIA2 AND BMPR1A AND NOT-FAT4 | 0.965517 | 1 | 0.933333 |
| GRIA2 AND ANTXR1 AND NOT-IL4R | 0.928571 | 1 | 0.866667 |
| NRCAM AND TSPAN11 AND NOT-SCAMP5 | 0.928571 | 1 | 0.866667 |
| GRIA2 AND BMPR1A AND NOT-KIT | 0.965517 | 1 | 0.933333 |
| LRRTM2 AND BMPR1A AND NOT-PTPRM | 0.903226 | 0.875 | 0.933333 |
| LRRTM2 AND BMPR1A AND NOT-RNF144A | 0.903226 | 0.875 | 0.933333 |
| GRIA2 AND ANTXR1 AND NOT-ATRN | 0.928571 | 1 | 0.866667 |
| GRIA2 AND ANTXR1 AND NOT-KCNS3 | 0.928571 | 1 | 0.866667 |
| GRIA2 AND ANTXR1 AND NOT-CNNM2 | 0.928571 | 1 | 0.866667 |
| GRIA2 AND ANTXR1 AND NOT-TRPV2 | 0.928571 | 1 | 0.866667 |
| GRIA2 AND ANTXR1 AND NOT-TAAR5 | 0.928571 | 1 | 0.866667 |
| GRIA2 AND ANTXR1 AND NOT-SLC2A8 | 0.928571 | 1 | 0.866667 |
| GRIA2 AND ANTXR1 AND NOT-EVI2B | 0.928571 | 1 | 0.866667 |
| GRIA2 AND ANTXR1 AND NOT-SCN4B | 0.928571 | 1 | 0.866667 |
| GRIA2 AND ANTXR1 AND NOT-FAT4 | 0.928571 | 1 | 0.866667 |
| GRIA2 AND ANTXR1 AND NOT-BTN2A1 | 0.928571 | 1 | 0.866667 |
| GRIA2 AND ANTXR1 AND NOT-TNFRSF14 | 0.928571 | 1 | 0.866667 |
| GRIA2 AND ANTXR1 AND NOT-SLC7A2 | 0.928571 | 1 | 0.866667 |
| GRIA2 AND ANTXR1 AND NOT-FCGR3B | 0.928571 | 1 | 0.866667 |
| GRIA2 AND ANTXR1 AND NOT-VAPA | 0.928571 | 1 | 0.866667 |
| GRIA2 AND ANTXR1 AND NOT-ABCB1 | 0.928571 | 1 | 0.866667 |
| GRIA2 AND ANTXR1 AND NOT-FLRT2 | 0.928571 | 1 | 0.866667 |
| GRIA2 AND ANTXR1 AND NOT-RHCG | 0.928571 | 1 | 0.866667 |
| GRIA2 AND ANTXR1 AND NOT-LGR4 | 0.928571 | 1 | 0.866667 |
| GRIA2 AND ANTXR1 AND NOT-SLC17A5 | 0.928571 | 1 | 0.866667 |
| GRIA2 AND ANTXR1 AND NOT-FZD6 | 0.928571 | 1 | 0.866667 |
| GRIA2 AND ANTXR1 AND NOT-CLEC1A | 0.928571 | 1 | 0.866667 |

FIG. 15 (cont.)

| Antigen Pair Logic | F1 | Precision | Recall |
|---|---|---|---|
| IFI6 AND NOT-ATP8A2 AND MUC1 | 1 | 1 | 1 |
| IFI6 AND MUC12 AND NOT-ERBB2 | 1 | 1 | 1 |
| NOX1 AND NOT-SLC9A1 AND ERBB2 | 1 | 1 | 1 |
| NOX1 AND NOT-SLC9A1 AND NOT-GPC3 | 1 | 1 | 1 |
| IFI6 AND NOT-SPAM1 AND MUC1 | 1 | 1 | 1 |
| IFI6 AND NOT-GPC3 AND NOT-SLC6A6 | 1 | 1 | 1 |
| IFI6 AND NOT-OR2L2 AND MUC1 | 1 | 1 | 1 |
| IFI6 AND NOT-GPC3 AND NOT-IFNAR2 | 1 | 1 | 1 |
| IFI6 AND NOT-STEAP4 AND ERBB2 | 1 | 1 | 1 |
| IFI6 AND NOT-OR3A2 AND MUC1 | 1 | 1 | 1 |
| IFI6 AND MUC1 AND NOT-SLC4A5 | 1 | 1 | 1 |
| IFI6 AND NOT-OR3A2 AND MUC1 | 1 | 1 | 1 |
| IFI6 AND NOT-TSHR AND MUC1 | 1 | 1 | 1 |
| IFI6 AND NOT-GABRA5 AND MUC1 | 1 | 1 | 1 |
| IFI6 AND NOT-SLCO6A1 AND MUC1 | 1 | 1 | 1 |
| IFI6 AND NOT-DSC1 AND MUC1 | 1 | 1 | 1 |
| IFI6 AND NOT-SLC9B1 AND MUC1 | 1 | 1 | 1 |
| IFI6 AND NOT-GPC3 AND NOT-SEMA4D | 1 | 1 | 1 |
| IFI6 AND NOT-GPC3 AND EPHA2 | 1 | 1 | 1 |
| IFI6 AND NOT-GPC3 AND PROCR | 1 | 1 | 1 |
| IFI6 AND MUC1 AND NOT-SLC4A5 | 1 | 1 | 1 |
| IFI6 AND NOT-GPC3 AND NOT-IFNAR2 | 1 | 1 | 1 |
| IFI6 AND MUC1 AND NOT-AGTR2 | 1 | 1 | 1 |
| IFI6 AND NOT-DTNA AND MUC1 | 1 | 1 | 1 |
| IFI6 AND NOT-GPC3 AND NOT-SLC23A2 | 1 | 1 | 1 |
| IFI6 AND NOT-STEAP4 AND ERBB2 | 1 | 1 | 1 |
| IFI6 AND NOT-GPC3 AND NOT-STEAP4 | 1 | 1 | 1 |
| IFI6 AND NOT-MOG AND MUC1 | 1 | 1 | 1 |
| IFI6 AND NOT-DSC1 AND MUC1 | 1 | 1 | 1 |
| IFI6 AND NOT-OR2L2 AND MUC1 | 1 | 1 | 1 |
| IFI6 AND NOT-SCN1A AND MUC1 | 1 | 1 | 1 |
| IFI6 AND NOT-TSHR AND MUC1 | 1 | 1 | 1 |
| IFI6 AND NOT-SLC9B1 AND MUC1 | 1 | 1 | 1 |
| IFI6 AND NOT-GABRA5 AND MUC1 | 1 | 1 | 1 |
| IFI6 AND NOT-GPC3 AND NOT-SEMA4D | 1 | 1 | 1 |
| IFI6 AND NOT-DTNA AND MUC1 | 1 | 1 | 1 |
| IFI6 AND NOT-SCN1A AND MUC1 | 1 | 1 | 1 |
| IFI6 AND MUC1 AND NOT-SLC13A5 | 1 | 1 | 1 |
| IFI6 AND MUC1 AND NOT-SLC13A5 | 1 | 1 | 1 |
| IFI6 AND NOT-GPC3 AND NOT-STEAP4 | 1 | 1 | 1 |
| IFI6 AND NOT-MOG AND MUC1 | 1 | 1 | 1 |
| IFI6 AND MUC1 AND MRGPRF | 1 | 1 | 1 |
| IFI6 AND NOT-SLC1A2 AND MUC1 | 1 | 1 | 1 |
| IFI6 AND NOT-HTR2C AND MUC1 | 1 | 1 | 1 |
| IFI6 AND VANGL1 AND NOT-MUC1 | 0.909091 | 0.833333 | 1 |
| IFI6 AND NOT-GPC3 AND CLDN19 | 0.909091 | 0.833333 | 1 |
| IFI6 AND NOT-GPC3 AND NOT-P2RX3 | 0.909091 | 0.833333 | 1 |
| IFI6 AND NOT-SLC13A1 AND MUC1 | 1 | 1 | 1 |
| IFI6 AND NOT-PIRT AND MUC1 | 1 | 1 | 1 |
| IFI6 AND NOT-GPC3 AND NOT-DGKE | 0.909091 | 0.833333 | 1 |
| IFI6 AND NOT-GPC3 AND NOT-MLC1 | 1 | 1 | 1 |
| IFI6 AND NOT-GPC3 AND NOT-GRM4 | 0.909091 | 0.833333 | 1 |
| IFI6 AND NOT-GPC3 AND NOT-KCNV2 | 0.909091 | 0.833333 | 1 |
| IFI6 AND NOT-GPC3 AND NOT-BTN3A3 | 1 | 1 | 1 |
| IFI6 AND NOT-GPC3 AND NOT-ANTXR2 | 1 | 1 | 1 |
| IFI6 AND NOT-SLC1A2 AND NOT-GPC3 | 0.909091 | 0.833333 | 1 |
| IFI6 AND NOT-GPC3 AND NOT-GABRD | 0.909091 | 0.833333 | 1 |
| IFI6 AND NOT-GPC3 AND NOT-GRM4 | 0.909091 | 0.833333 | 1 |
| IFI6 AND NOT-GPC3 AND MUC1 | 1 | 1 | 1 |
| IFI6 AND NOT-GPC3 AND ERBB2 | 1 | 1 | 1 |
| IFI6 AND NOT-GPC3 AND MUC1 | 1 | 1 | 1 |
| IFI6 AND NOT-GPC3 AND ERBB2 | 1 | 1 | 1 |
| DPEP1 AND NOT-GPC3 AND MUC1 | 1 | 1 | 1 |
| ITGAV AND NOT-GPC3 AND MUC1 | 1 | 1 | 1 |
| ITGAV AND MUC1 AND NOT-ERBB2 | 0.909091 | 0.833333 | 1 |
| NOT-GPC3 AND WNT5A AND MUC1 | 1 | 1 | 1 |
| Ependymoma | | | |
| COMPLEX-CSPG5/UNC5D/FZD3 | 1 | 1 | 1 |
| FZD3 AND CD44 AND NOT-SLC9A9 | 1 | 1 | 1 |
| FZD3 AND CD44 AND NOT-DLL1 | 1 | 1 | 1 |
| FZD3 AND CD44 AND NOT-CDH19 | 1 | 1 | 1 |
| FZD3 AND CD44 AND NOT-TMEM150B | 1 | 1 | 1 |
| FZD3 AND CD44 AND NOT-GPR17 | 1 | 1 | 1 |
| FZD3 AND CD44 AND NOT-UTS2R | 1 | 1 | 1 |
| FZD3 AND CD44 AND NOT-GPR4 | 1 | 1 | 1 |
| FZD3 AND CD44 AND GPM6B | 1 | 1 | 1 |
| FZD3 AND CD44 AND NOT-GPR31 | 1 | 1 | 1 |

| Antigen Pair Logic | F1 | Precision | Recall |
|---|---|---|---|
| GRIA2 AND ANTXR1 AND NOT-EMCN | 0.928571 | 1 | 0.866667 |
| SCAMP5 AND TSPAN11 AND NOT-BDKRB2 | 0.903226 | 0.875 | 0.933333 |
| GRIA2 AND ANTXR1 AND NOT-PRIMA1 | 0.928571 | 1 | 0.866667 |
| GRIA2 AND BMPR1A AND NOT-SCN4B | 0.965517 | 1 | 0.933333 |
| GRIA2 AND BMPR1A AND NOT-CNNM2 | 0.965517 | 1 | 0.933333 |
| GRIA2 AND BMPR1A AND NOT-IFITM2 | 0.928571 | 1 | 0.866667 |
| GRIA2 AND BMPR1A AND NOT-SLMAP | 0.965517 | 1 | 0.933333 |
| SCAMP5 AND ANTXR1 AND NOT-SLC30A5 | 0.896552 | 0.928571 | 0.866667 |
| SCAMP5 AND ANTXR1 AND NOT-FLRT2 | 0.896552 | 0.928571 | 0.866667 |
| SCAMP5 AND ANTXR1 AND NOT-MYOF | 0.896552 | 0.928571 | 0.866667 |
| NRCAM AND SLC22A4 AND NOT-PTPRM | 0.896552 | 0.928571 | 0.866667 |
| NCAM2 AND ANTXR1 AND NOT-TSPAN8 | 0.928571 | 1 | 0.866667 |
| LRRTM2 AND TSPAN11 AND NOT-SFRP1 | 0.903226 | 0.875 | 0.933333 |
| GRIA2 AND BMPR1A AND BSG | 0.965517 | 1 | 0.933333 |
| GRIA2 AND ANTXR1 AND NOT-SLCO4A1 | 0.928571 | 1 | 0.866667 |
| GRIA2 AND ANTXR1 AND NOT-PANX1 | 0.928571 | 1 | 0.866667 |
| SCAMP5 AND ANTXR1 AND NOT-GPR160 | 0.896552 | 0.928571 | 0.866667 |
| GRIA2 AND ANTXR1 AND NOT-AGTRAP | 0.928571 | 1 | 0.866667 |
| SCAMP5 AND ANTXR1 AND NOT-LSR | 0.896552 | 0.928571 | 0.866667 |
| GRIA2 AND ANTXR1 AND NOT-CHIC2 | 0.928571 | 1 | 0.866667 |
| GRIA2 AND ANTXR1 AND NOT-CD4 | 0.928571 | 1 | 0.866667 |
| GRIA2 AND ANTXR1 AND NOT-ABCD4 | 0.928571 | 1 | 0.866667 |
| FAIM2 AND BMPR1A AND NOT-IFITM2 | 0.896552 | 0.928571 | 0.866667 |
| GRIA2 AND VANGL2 AND NOT-TLR7 | 0.888889 | 1 | 0.8 |
| GRIA2 AND VANGL2 AND NOT-SLMAP | 0.888889 | 1 | 0.8 |
| GPM6A AND CALCRL AND NOT-IGSF6 | 0.888889 | 1 | 0.8 |
| GRIA2 AND BMP2 AND NOT-SLMAP | 0.888889 | 1 | 0.8 |
| GRIA2 AND VANGL2 AND NOT-VAPA | 0.888889 | 1 | 0.8 |
| SCAMP5 AND VANGL2 AND NOT-EVI2B | 0.888889 | 1 | 0.8 |
| GRIA2 AND VANGL2 AND NOT-HAVCR2 | 0.888889 | 1 | 0.8 |
| SCAMP5 AND VANGL2 AND NOT-SLC30A5 | 0.888889 | 1 | 0.8 |
| SCAMP5 AND VANGL2 AND NOT-PKD2L1 | 0.888889 | 1 | 0.8 |
| GRIA2 AND CALCRL AND NOT-SLC24A1 | 0.888889 | 1 | 0.8 |
| PTPRZ1 AND SIRPG AND NOT-ACPP | 0.888889 | 1 | 0.8 |
| GRIA2 AND CALCRL AND NOT-ATP2A2 | 0.888889 | 1 | 0.8 |
| GPM6A AND CALCRL AND NOT-HAVCR2 | 0.888889 | 1 | 0.8 |
| GRIA2 AND VANGL2 AND NOT-SLC24A1 | 0.888889 | 1 | 0.8 |
| GRIA2 AND VANGL2 AND NOT-IL1R1 | 0.888889 | 1 | 0.8 |
| GRIA2 AND VANGL2 AND NOT-LSR | 0.888889 | 1 | 0.8 |
| GRIA2 AND VANGL2 AND NOT-ROM1 | 0.888889 | 1 | 0.8 |
| GRIA2 AND CALCRL AND NOT-KCNS3 | 0.888889 | 1 | 0.8 |
| GRIA2 AND VANGL2 AND NOT-CD1C | 0.888889 | 1 | 0.8 |
| GRIA2 AND VANGL2 AND NOT-SLC17A5 | 0.888889 | 1 | 0.8 |
| GRIA2 AND VANGL2 AND NOT-CLEC4E | 0.888889 | 1 | 0.8 |
| GRIA2 AND VANGL2 AND NOT-CHIC2 | 0.888889 | 1 | 0.8 |
| GRIA2 AND VANGL2 AND NOT-ABCB1 | 0.888889 | 1 | 0.8 |
| GRIA2 AND BMP2 AND NOT-SLC17A5 | 0.888889 | 1 | 0.8 |
| GRIA2 AND CALCRL AND NOT-KIT | 0.888889 | 1 | 0.8 |
| SCAMP5 AND VANGL2 AND NOT-AGTRAP | 0.888889 | 1 | 0.8 |
| FAIM2 AND BMP2 AND NOT-ACSL1 | 0.888889 | 1 | 0.8 |
| SCAMP5 AND VANGL2 AND NOT-CSF3R | 0.888889 | 1 | 0.8 |
| GRIA2 AND BEST3 AND NOT-SLMAP | 0.967742 | 0.9375 | 1 |
| GRIA2 AND BEST3 AND NOT-SCN4B | 0.967742 | 0.9375 | 1 |
| BEST3 AND LRRTM2 AND NOT-PLA2R1 | 0.967742 | 0.9375 | 1 |
| BEST3 AND LRRTM2 AND NOT-SLMAP | 0.9375 | 0.882353 | 1 |
| GRIA2 AND TNFRSF10B AND NOT-FLRT2 | 0.928571 | 1 | 0.866667 |
| SCAMP5 AND BEST3 AND NOT-SCN4B | 0.9375 | 0.882353 | 1 |
| GRIA2 AND BEST3 AND NOT-KIT | 0.967742 | 0.9375 | 1 |
| GRIA2 AND BEST3 AND NOT-VAPA | 0.967742 | 0.9375 | 1 |
| CDH10 AND BMPR1A AND NOT-PTPRM | 0.965517 | 1 | 0.933333 |
| GRIA2 AND BEST3 AND NOT-RNF144A | 0.967742 | 0.9375 | 1 |
| BEST3 AND LRRTM2 AND NOT-RNF144A | 0.9375 | 0.882353 | 1 |
| BEST3 AND ATP9A AND NOT-ABCC5 | 0.9375 | 0.882353 | 1 |
| BEST3 AND ATP9A AND NOT-PLA2R1 | 0.967742 | 0.9375 | 1 |
| GRIA2 AND BEST3 AND NOT-TRPV1 | 0.967742 | 0.9375 | 1 |
| NCAM2 AND BEST3 AND NOT-TSPAN5 | 0.9375 | 0.882353 | 1 |
| NCAM2 AND BEST3 AND NOT-SLMAP | 0.9375 | 0.882353 | 1 |
| BEST3 AND LRRTM2 AND NOT-CNNM4 | 0.9375 | 0.882353 | 1 |
| NCAM2 AND BEST3 AND NOT-GPR52 | 0.9375 | 0.882353 | 1 |
| NCAM2 AND BEST3 AND NOT-SCN4B | 0.9375 | 0.882353 | 1 |
| BEST3 AND LRRTM2 AND NOT-SLC26A10 | 0.9375 | 0.882353 | 1 |
| NCAM2 AND BEST3 AND NOT-ABCC5 | 0.9375 | 0.882353 | 1 |
| BEST3 AND LRRTM2 AND NOT-SCNN1G | 0.9375 | 0.882353 | 1 |
| GRIA2 AND TNFRSF10B AND NOT-IL4R | 0.928571 | 1 | 0.866667 |
| SCAMP5 AND BEST3 AND NOT-FLRT2 | 0.9375 | 0.882353 | 1 |
| GRIA2 AND BEST3 AND NOT-FLRT2 | 0.967742 | 0.9375 | 1 |
| NCAM2 AND BEST3 AND NOT-SLC5A6 | 0.9375 | 0.882353 | 1 |

FIG. 15 (cont.)

| Antigen Pair Logic | F1 | Precision | Recall |
|---|---|---|---|
| FZD3 AND NOT-GLRB AND CD44 | 1 | 1 | 1 |
| FZD3 AND CD44 AND NOT-HTRA2 | 1 | 1 | 1 |
| FZD3 AND CD44 AND NOT-GLP1R | 1 | 1 | 1 |
| FZD3 AND CD44 AND NOT-KCNH5 | 1 | 1 | 1 |
| FZD3 AND CD44 AND NOT-CACNG5 | 1 | 1 | 1 |
| FZD3 AND CD44 AND NOT-GJB1 | 1 | 1 | 1 |
| FZD3 AND CD44 AND NOT-GJA5 | 1 | 1 | 1 |
| FZD3 AND CD44 AND NOT-EPHA6 | 1 | 1 | 1 |
| FZD3 AND CD44 AND NOT-GPR32 | 1 | 1 | 1 |
| FZD3 AND CD44 AND NOT-APOB | 1 | 1 | 1 |
| FZD3 AND CD44 AND NOT-GYPE | 1 | 1 | 1 |
| FZD3 AND CD44 AND NOT-ICAM3 | 1 | 1 | 1 |
| FZD3 AND CD44 AND NOT-ANO9 | 1 | 1 | 1 |
| FZD3 AND CD44 AND NOT-HTR7 | 1 | 1 | 1 |
| FZD3 AND CD44 AND NOT-HTR3A | 1 | 1 | 1 |
| FZD3 AND CD44 AND NOT-HTR2B | 1 | 1 | 1 |
| FZD3 AND CD44 AND NOT-APLP2 | 1 | 1 | 1 |
| FZD3 AND CD44 AND NOT-SLC2A8 | 1 | 1 | 1 |
| FZD3 AND NOT-SLC25A4 AND CD44 | 1 | 1 | 1 |
| FZD3 AND CD44 AND NOT-ANK1 | 1 | 1 | 1 |
| FZD3 AND CD44 AND NOT-GPR39 | 1 | 1 | 1 |
| FZD3 AND NOT-GPR37 AND CD44 | 1 | 1 | 1 |
| FZD3 AND CD44 AND NOT-GIPR | 1 | 1 | 1 |
| FZD3 AND CD44 AND NOT-OR10H3 | 1 | 1 | 1 |
| FZD3 AND CD44 AND NOT-SLC16A8 | 1 | 1 | 1 |
| FZD3 AND NOT-FNDC5 AND CD44 | 1 | 1 | 1 |
| FZD3 AND CD44 AND NOT-FLRT1 | 1 | 1 | 1 |
| FZD3 AND CD44 AND NOT-FRRS1L | 1 | 1 | 1 |
| FZD3 AND CD44 AND NOT-KCNE4 | 1 | 1 | 1 |
| FZD3 AND NOT-BACE1 AND CD44 | 1 | 1 | 1 |
| FZD3 AND CD44 AND NOT-CLEC5A | 1 | 1 | 1 |
| FZD3 AND CD44 AND NOT-VSIG2 | 1 | 1 | 1 |
| FZD3 AND CD44 AND NOT-FPR1 | 1 | 1 | 1 |
| FZD3 AND CD44 AND NOT-LPAR3 | 1 | 1 | 1 |
| FZD3 AND CD44 AND NOT-TNFRSF13B | 1 | 1 | 1 |
| FZD3 AND CD44 AND NOT-PLXND1 | 1 | 1 | 1 |
| FZD3 AND CD44 AND NOT-NLGN4Y | 1 | 1 | 1 |
| FZD3 AND CD44 AND NOT-FGFR2 | 1 | 1 | 1 |
| FZD3 AND CD44 AND NOT-CDHR3 | 1 | 1 | 1 |
| FZD3 AND CD44 AND NOT-ZDHHC20 | 1 | 1 | 1 |
| FZD3 AND CD44 AND NOT-FAM26E | 1 | 1 | 1 |
| FZD3 AND CD44 AND NOT-MCOLN2 | 1 | 1 | 1 |
| FZD3 AND CD44 AND NOT-OR10A3 | 1 | 1 | 1 |
| NOT-SPPL2A AND BMP2 AND DNAJC5 | 1 | 1 | 1 |
| SLC7A11 AND NOT-FXYD5 AND CCR7 | 1 | 1 | 1 |
| SLC7A11 AND NOT-FXYD5 AND ACE | 1 | 1 | 1 |
| NOT-SLC16A7 AND OR10H2 AND TMEM50B | 1 | 1 | 1 |
| NOT-SLC16A7 AND OR10H2 AND WNT5A | 1 | 1 | 1 |
| SLC7A11 AND NOT-FXYD5 AND QSOX2 | 1 | 1 | 1 |
| SLC7A11 AND NOT-FXYD5 AND CLEC4C | 1 | 1 | 1 |
| SLC7A11 AND NOT-FXYD5 AND DSC3 | 1 | 1 | 1 |
| SLC7A11 AND NOT-FXYD5 AND SCAMP5 | 1 | 1 | 1 |
| SLC7A11 AND NOT-FXYD5 AND EGF | 1 | 1 | 1 |
| NOT-SLC16A7 AND OR10H2 AND TSPAN6 | 1 | 1 | 1 |
| SLC7A11 AND NOT-FXYD5 AND EPHB1 | 1 | 1 | 1 |
| SLC7A11 AND NOT-FXYD5 AND EVI2B | 1 | 1 | 1 |
| SLC7A11 AND NOT-FXYD5 AND DAGLB | 1 | 1 | 1 |
| SLC7A11 AND NOT-FXYD5 AND SLC35G1 | 1 | 1 | 1 |
| SLC7A11 AND NOT-FXYD5 AND CD300LB | 1 | 1 | 1 |
| SLC7A11 AND NOT-FXYD5 AND GJD3 | 1 | 1 | 1 |
| SLC7A11 AND NOT-FXYD5 AND NOT-ACVR1C | 1 | 1 | 1 |
| SLC7A11 AND NOT-FXYD5 AND SGCZ | 1 | 1 | 1 |
| NOT-SLC16A7 AND OR10H2 AND AMN | 1 | 1 | 1 |
| NOT-SLC16A7 AND OR10H2 AND NIPA2 | 1 | 1 | 1 |
| SLC7A11 AND NOT-FXYD5 AND CR1 | 1 | 1 | 1 |
| SLC7A11 AND NOT-FXYD5 AND MUC15 | 1 | 1 | 1 |
| SLC7A11 AND NOT-FXYD5 AND OR10A5 | 1 | 1 | 1 |
| SLC7A11 AND NOT-FXYD5 AND ADRA1D | 1 | 1 | 1 |
| SLC7A11 AND NOT-FXYD5 AND C1orf210 | 1 | 1 | 1 |
| SLC7A11 AND NOT-FXYD5 AND PLB1 | 1 | 1 | 1 |
| SLC7A11 AND NOT-FXYD5 AND BTLA | 1 | 1 | 1 |
| NOT-SLC16A7 AND OR10H2 AND ITSN1 | 1 | 1 | 1 |
| SLC7A11 AND NOT-FXYD5 AND TENM4 | 1 | 1 | 1 |
| SLC7A11 AND NOT-FXYD5 AND OR1A2 | 1 | 1 | 1 |
| SLC7A11 AND NOT-FXYD5 AND OR2M4 | 1 | 1 | 1 |
| SLC7A11 AND NOT-FXYD5 AND NOT-YIPF3 | 1 | 1 | 1 |
| SLC7A11 AND NOT-FXYD5 AND OR8B8 | 1 | 1 | 1 |

| Antigen Pair Logic | F1 | Precision | Recall |
|---|---|---|---|
| BEST3 AND LRRTM2 AND NOT-ESYT3 | 0.9375 | 0.882353 | 1 |
| NCAM2 AND BEST3 AND NOT-IL4R | 0.9375 | 0.882353 | 1 |
| NCAM2 AND BEST3 AND NOT-NTRK3 | 0.9375 | 0.882353 | 1 |
| GRIA2 AND BEST3 AND NOT-PERP | 0.933333 | 0.933333 | 0.933333 |
| BEST3 AND ATP9A AND NOT-SCN4B | 0.967742 | 0.9375 | 1 |
| ASTN1 AND CYP4F2 AND NOT-SLC2A13 | 0.928571 | 1 | 0.866667 |
| BEST3 AND LRRTM2 AND NOT-F10 | 0.9375 | 0.882353 | 1 |
| BEST3 AND ATP9A AND NOT-CNNM4 | 0.9375 | 0.882353 | 1 |
| GRIA2 AND BEST3 AND NOT-LGR4 | 0.967742 | 0.9375 | 1 |
| NCAM2 AND BEST3 AND NOT-CNNM2 | 0.9375 | 0.882353 | 1 |
| BEST3 AND LRRTM2 AND NOT-KIT | 0.9375 | 0.882353 | 1 |
| SCAMP5 AND BEST3 AND NOT-PERP | 0.933333 | 0.933333 | 0.933333 |
| NCAM2 AND BEST3 AND NOT-EFNB3 | 0.9375 | 0.882353 | 1 |
| BEST3 AND ATP9A AND NOT-SCNN1G | 0.9375 | 0.882353 | 1 |
| NCAM2 AND BEST3 AND NOT-SLC12A6 | 0.9375 | 0.882353 | 1 |
| BEST3 AND LRRTM2 AND NOT-AMICA1 | 0.9375 | 0.882353 | 1 |
| GRIA2 AND BEST3 AND NOT-BTN2A1 | 0.967742 | 0.9375 | 1 |
| LSAMP AND BEST3 AND NOT-ABCC5 | 0.9375 | 0.882353 | 1 |
| NCAM2 AND BEST3 AND NOT-SLC2A13 | 0.967742 | 0.9375 | 1 |
| BEST3 AND TM7SF2 AND NOT-PLA2R1 | 0.909091 | 0.833333 | 1 |
| GRIA2 AND TNFRSF10B AND NOT-PTPRM | 0.928571 | 1 | 0.866667 |
| FAIM2 AND BEST3 AND NOT-SCN4B | 0.909091 | 0.833333 | 1 |
| GRIA2 AND TNFRSF10B AND NOT-GPR52 | 0.928571 | 1 | 0.866667 |
| GRIA2 AND TNFRSF10B AND NOT-DIO2 | 0.928571 | 1 | 0.866667 |
| FAIM2 AND BEST3 AND NOT-SLC2A13 | 0.909091 | 0.833333 | 1 |
| FAIM2 AND BEST3 AND NOT-CLCN5 | 0.909091 | 0.833333 | 1 |
| GRIA2 AND BMPR1A AND NOT-PROCR | 0.965517 | 1 | 0.933333 |
| GRIA2 AND BEST3 AND NOT-GPR52 | 0.967742 | 0.9375 | 1 |
| GRIA2 AND BEST3 AND NOT-CLCN5 | 0.967742 | 0.9375 | 1 |
| GRIA2 AND BEST3 AND NOT-IFITM2 | 0.933333 | 0.933333 | 0.933333 |
| SCAMP5 AND BEST3 AND NOT-GPR52 | 0.909091 | 0.833333 | 1 |
| SCAMP5 AND BEST3 AND NOT-CLCN5 | 0.9375 | 0.882353 | 1 |
| BEST3 AND ATP9A AND NOT-FAT2 | 0.9375 | 0.882353 | 1 |
| BEST3 AND LRRTM2 AND NOT-SYT2 | 0.933333 | 0.933333 | 0.933333 |
| LRRC4C AND BEST3 AND NOT-GPR52 | 0.9375 | 0.882353 | 1 |
| GRIA2 AND BEST3 AND NOT-CD1C | 0.967742 | 0.9375 | 1 |
| BEST3 AND ATP9A AND NOT-NRXN3 | 1 | 1 | 1 |
| NCAM2 AND BEST3 AND NOT-LRFN1 | 0.903226 | 0.875 | 0.933333 |
| ASTN1 AND GJB3 AND NOT-SLC2A13 | 0.933333 | 0.933333 | 0.933333 |
| SCN2A AND TSPAN11 AND NOT-SLITRK6 | 0.967742 | 0.9375 | 1 |
| GRIA2 AND ANTXR1 AND NOT-BST2 | 0.928571 | 1 | 0.866667 |
| GRIA2 AND ANTXR1 AND NOT-PTPRT | 0.928571 | 1 | 0.866667 |
| GRIA2 AND ANTXR1 AND NOT-CD1B | 0.928571 | 1 | 0.866667 |
| LSAMP AND BEST3 AND NOT-SLC26A10 | 0.9375 | 0.882353 | 1 |
| GRIA2 AND ANTXR1 AND NOT-PROCR | 0.928571 | 1 | 0.866667 |
| LSAMP AND BEST3 AND NOT-SCN4B | 0.967742 | 0.9375 | 1 |
| COMPLEX-CRB1/GRIK5/ADAM9 | 0.965517 | 1 | 0.933333 |
| GRIA2 AND TNFRSF10B AND SERINC1 | 0.928571 | 1 | 0.866667 |
| SCN2A AND TSPAN11 AND NOT-ITGA8 | 0.909091 | 0.833333 | 1 |
| COMPLEX-CRB1/GRIK5/ITGB8 | 0.965517 | 1 | 0.933333 |
| GRIA2 AND TNFRSF10B AND NOT-TNFRSF14 | 0.928571 | 1 | 0.866667 |
| GRIA2 AND TNFRSF10B AND NOT-SLMAP | 0.928571 | 1 | 0.866667 |
| GRIA2 AND TNFRSF10B AND NOT-SLC7A2 | 0.928571 | 1 | 0.866667 |
| GRIA2 AND TNFRSF10B AND NOT-ABCB1 | 0.928571 | 1 | 0.866667 |
| OMG AND BMPR1A AND NOT-FLRT2 | 0.933333 | 0.933333 | 0.933333 |
| GRIA2 AND TNFRSF10B AND NOT-CD1C | 0.928571 | 1 | 0.866667 |
| GRIA2 AND BMPR1A AND NOT-PTPRT | 0.965517 | 1 | 0.933333 |
| SCAMP5 AND ANTXR1 AND NOT-PROCR | 0.896552 | 0.928571 | 0.866667 |
| GRIA2 AND BEST3 AND NOT-TRPV2 | 0.933333 | 0.933333 | 0.933333 |
| GRIA2 AND BEST3 AND NOT-IL4R | 0.967742 | 0.9375 | 1 |
| GRIA2 AND BEST3 AND NOT-CNNM2 | 0.967742 | 0.9375 | 1 |
| SCAMP5 AND BEST3 AND NOT-TAAR5 | 0.909091 | 0.833333 | 1 |
| COMPLEX-ATP10A/BCAN/ATRN | 0.928571 | 1 | 0.866667 |
| COMPLEX-SCAMP5/FCGR3B/BCAN | 0.928571 | 1 | 0.866667 |
| BCAN AND NOT-KCNJ8 AND SIRPG | 0.928571 | 1 | 0.866667 |
| BCAN AND NOT-TNFSF15 AND HAVCR2 | 0.928571 | 1 | 0.866667 |
| BCAN AND NOT-TRPM7 AND SIRPG | 0.928571 | 1 | 0.866667 |
| COMPLEX-SCAMP5/AGTRAP/BCAN | 0.928571 | 1 | 0.866667 |
| BCAN AND NOT-LTB4R AND SLC22A4 | 0.928571 | 1 | 0.866667 |
| BCAN AND NOT-CD2 AND SLC22A4 | 0.928571 | 1 | 0.866667 |
| COMPLEX-LY9/ABCB1/BCAN | 0.928571 | 1 | 0.866667 |
| COMPLEX-ABCB1/BCAN/TLR5 | 0.928571 | 1 | 0.866667 |
| BCAN AND NOT-KLRB1 AND SIRPG | 0.928571 | 1 | 0.866667 |
| COMPLEX-GOLM1/ABCB1/BCAN | 0.928571 | 1 | 0.866667 |
| COMPLEX-ATP10A/BCAN/RHOT2 | 0.928571 | 1 | 0.866667 |
| COMPLEX-CLEC4E/ATP10A/BCAN | 0.928571 | 1 | 0.866667 |
| BCAN AND NOT-CYP4F12 AND HAVCR2 | 0.928571 | 1 | 0.866667 |

FIG. 15 (cont.)

| Antigen Pair Logic | F1 | Precision | Recall | Antigen Pair Logic | F1 | Precision | Recall |
|---|---|---|---|---|---|---|---|
| SLC7A11 AND NOT-FXYD5 AND OR10A3 | 1 | 1 | 1 | COMPLEX-CCR7/ATP10A/BCAN | 0.928571 | 1 | 0.866667 |
| SLC7A11 AND NOT-FXYD5 AND OR4D1 | 1 | 1 | 1 | COMPLEX-F10/ABCB1/BCAN | 0.928571 | 1 | 0.866667 |
| NOT-SLC16A7 AND OR10H2 AND RYK | 1 | 1 | 1 | COMPLEX-COL17A1/ATP10A/BCAN | 0.928571 | 1 | 0.866667 |
| SLC7A11 AND NOT-FXYD5 AND CACNG5 | 1 | 1 | 1 | COMPLEX-ATP10A/BCAN/CD1E | 0.928571 | 1 | 0.866667 |
| NOT-SLC16A7 AND OR10H2 AND SLC30A5 | 1 | 1 | 1 | COMPLEX-FLRT3/ATP10A/BCAN | 0.928571 | 1 | 0.866667 |
| SLC7A11 AND NOT-FXYD5 AND TPSG1 | 1 | 1 | 1 | COMPLEX-FLRT3/BCAN/PPAP2A | 0.928571 | 1 | 0.866667 |
| SLC7A11 AND NOT-PLXND1 AND NOT-FXYD5 | 1 | 1 | 1 | BCAN AND NOT-EFNB3 AND NOT-SLC6A1 | 0.928571 | 1 | 0.866667 |
| SLC16A2 AND NOT-SLC16A7 AND OR10H2 | 1 | 1 | 1 | COMPLEX-ABCB1/BCAN/PPAP2A | 0.928571 | 1 | 0.866667 |
| SLC7A11 AND NOT-FXYD5 AND FLT3 | 1 | 1 | 1 | BCAN AND NOT-TMPRSS2 AND SIRPG | 0.928571 | 1 | 0.866667 |
| NOT-SLC16A7 AND OR10H2 AND BRCA1 | 1 | 1 | 1 | COMPLEX-PLA2R1/ATP10A/BCAN | 0.928571 | 1 | 0.866667 |
| SLC7A11 AND NOT-FXYD5 AND NCSTN | 1 | 1 | 1 | COMPLEX-EPHB4/ATP10A/BCAN | 0.928571 | 1 | 0.866667 |
| NOT-SLC16A7 AND OR10H2 AND NOT-SLC22A1 | 1 | 1 | 1 | BCAN AND NOT-F10 AND SLC22A4 | 0.928571 | 1 | 0.866667 |
| NOT-SLC16A7 AND OR10H2 AND SLC20A2 | 1 | 1 | 1 | COMPLEX-GOLM1/ATP10A/BCAN | 0.928571 | 1 | 0.866667 |
| NOT-SLC16A7 AND OR10H2 AND BMP2 | 1 | 1 | 1 | COMPLEX-F10/ATP10A/BCAN | 0.928571 | 1 | 0.866667 |
| NOT-TNFSF10 AND GPR34 AND NOT-CLDN11 | 1 | 1 | 1 | COMPLEX-ATP10A/SCNN1G/BCAN | 0.928571 | 1 | 0.866667 |
| FZD3 AND NOT-CNTNAP1 AND NOT-CD180 | 1 | 1 | 1 | BCAN AND NOT-FAT2 AND SLC22A4 | 0.928571 | 1 | 0.866667 |
| FZD3 AND NOT-CNTNAP1 AND IL13RA1 | 1 | 1 | 1 | COMPLEX-SCAMP5/ABCB1/BCAN | 0.928571 | 1 | 0.866667 |
| FZD3 AND NOT-CNTNAP1 AND ABCB5 | 1 | 1 | 1 | BCAN AND NOT-ADRB1 AND HAVCR2 | 0.928571 | 1 | 0.866667 |
| FZD3 AND NOT-CNTNAP1 AND NOT-EPHB2 | 1 | 1 | 1 | BCAN AND NOT-F10 AND CD84 | 0.928571 | 1 | 0.866667 |
| FZD3 AND NOT-CNTNAP1 AND DDX3X | 1 | 1 | 1 | COMPLEX-KLRB1/ABCB1/BCAN | 0.928571 | 1 | 0.866667 |
| SLC7A11 AND WNT3 AND NOT-CD70 | 1 | 1 | 1 | BCAN AND NOT-CD27 AND CLEC4A | 0.928571 | 1 | 0.866667 |
| SLC7A11 AND WNT3 AND NOT-FCRL5 | 1 | 1 | 1 | BCAN AND NOT-LTB4R AND CD84 | 0.928571 | 1 | 0.866667 |
| SLC7A11 AND WNT3 AND NOT-ULBP2 | 1 | 1 | 1 | COMPLEX-ABCB1/BCAN/TSPAN14 | 0.928571 | 1 | 0.866667 |
| SLC7A11 AND WNT3 AND NOT-TPBG | 1 | 1 | 1 | COMPLEX-ABCB1/BCAN/CD40 | 0.928571 | 1 | 0.866667 |
| FZD3 AND NOT-CNTNAP1 AND NOT-MAGEA1 | 1 | 1 | 1 | BCAN AND NOT-PTPRJ AND MME | 0.928571 | 1 | 0.866667 |
| FZD3 AND NOT-SLCO4A1 AND CR2 | 1 | 1 | 1 | COMPLEX-ATP10A/BCAN/PPAP2A | 0.928571 | 1 | 0.866667 |
| FZD3 AND NOT-SLCO4A1 AND CEACAM6 | 1 | 1 | 1 | BCAN AND NOT-ADCY4 AND CD84 | 0.928571 | 1 | 0.866667 |
| FZD3 AND NOT-SLCO4A1 AND MUC1 | 1 | 1 | 1 | COMPLEX-ADRB1/ATP10A/BCAN | 0.928571 | 1 | 0.866667 |
| FZD3 AND NOT-SLCO4A1 AND ITGB6 | 1 | 1 | 1 | BCAN AND NOT-ANO9 AND HAVCR2 | 0.928571 | 1 | 0.866667 |
| FZD3 AND NOT-SLCO4A1 AND ITGB3 | 1 | 1 | 1 | COMPLEX-ATP10A/BCAN/ITGA8 | 0.928571 | 1 | 0.866667 |
| FZD3 AND NOT-SLCO4A1 AND IL13RA1 | 1 | 1 | 1 | COMPLEX-ABCB1/BCAN/CD1C | 0.928571 | 1 | 0.866667 |
| FZD3 AND NOT-SLCO4A1 AND ABCB5 | 1 | 1 | 1 | COMPLEX-LTB/ATP10A/BCAN | 0.928571 | 1 | 0.866667 |
| FZD3 AND NOT-SLCO4A1 AND CTAG2 | 1 | 1 | 1 | COMPLEX-PCDH18/ATP10A/BCAN | 0.928571 | 1 | 0.866667 |
| FZD3 AND NOT-SLCO4A1 AND ANXA1 | 1 | 1 | 1 | COMPLEX-KCNS3/ATP10A/BCAN | 0.928571 | 1 | 0.866667 |
| FZD3 AND NOT-SLCO4A1 AND DDX3X | 1 | 1 | 1 | BCAN AND NOT-SLC18A2 AND SIRPG | 0.928571 | 1 | 0.866667 |
| FZD3 AND NOT-SLCO4A1 AND RAET1E | 1 | 1 | 1 | BCAN AND NOT-PCDH18 AND HAVCR2 | 0.928571 | 1 | 0.866667 |
| FZD3 AND NOT-CNTNAP1 AND NOT-SDC1 | 1 | 1 | 1 | COMPLEX-ATP10A/BCAN/TSPAN14 | 0.928571 | 1 | 0.866667 |
| FZD3 AND NOT-SLCO4A1 AND FCRL1 | 1 | 1 | 1 | BCAN AND NOT-NCAM2 AND CLEC1A | 0.928571 | 1 | 0.866667 |
| FZD3 AND NOT-SLCO4A1 AND CD160 | 1 | 1 | 1 | COMPLEX-SCAMP5/BCAN/CD4 | 0.928571 | 1 | 0.866667 |
| FZD3 AND NOT-SLCO4A1 AND SLC34A2 | 1 | 1 | 1 | COMPLEX-FAT2/ATP10A/BCAN | 0.928571 | 1 | 0.866667 |
| FZD3 AND NOT-SLCO4A1 AND MSLN | 1 | 1 | 1 | COMPLEX-VAMP5/SCAMP5/BCAN | 0.928571 | 1 | 0.866667 |
| FZD3 AND NOT-CNTNAP1 AND NOT-CD72 | 1 | 1 | 1 | ASTN1 AND BEST3 AND NOT-IFITM2 | 0.933333 | 0.933333 | 0.933333 |
| FZD3 AND NOT-CNTNAP1 AND CD33 | 1 | 1 | 1 | ASTN1 AND BEST3 AND NOT-FLRT2 | 0.967742 | 0.9375 | 1 |
| FZD3 AND NOT-CNTNAP1 AND VTCN1 | 1 | 1 | 1 | ASTN1 AND BEST3 AND NOT-SLC2A13 | 1 | 1 | 1 |
| FZD3 AND NOT-CNTNAP1 AND NOT-SSTR5 | 1 | 1 | 1 | ASTN1 AND BEST3 AND NOT-SCN4B | 0.967742 | 0.9375 | 1 |
| FZD3 AND NOT-CNTNAP1 AND NOT-SSTR4 | 1 | 1 | 1 | ASTN1 AND BEST3 AND NOT-SLC5A6 | 0.967742 | 0.9375 | 1 |
| NOT-TRPM4 AND TSPAN11 AND APCDD1 | 1 | 1 | 1 | ASTN1 AND BEST3 AND NOT-MTUS1 | 0.967742 | 0.9375 | 1 |
| SLC7A11 AND WNT3 AND NOT-THY1 | 1 | 1 | 1 | ASTN1 AND BEST3 AND NOT-SLC31A2 | 0.967742 | 0.9375 | 1 |
| FZD3 AND NOT-SLCO4A1 AND ENPP3 | 1 | 1 | 1 | ASTN1 AND BEST3 AND NOT-TM4SF1 | 0.933333 | 0.933333 | 0.933333 |
| SLC7A11 AND WNT3 AND NOT-ERBB4 | 1 | 1 | 1 | ASTN1 AND BEST3 AND NOT-ABCC5 | 0.967742 | 0.9375 | 1 |
| SLC7A11 AND WNT3 AND NOT-EPHB2 | 1 | 1 | 1 | OMG AND BEST3 AND NOT-SCN4B | 0.967742 | 0.9375 | 1 |
| SLC7A11 AND NOT-ENG AND WNT3 | 1 | 1 | 1 | ASTN1 AND BEST3 AND NOT-LPAR1 | 0.967742 | 0.9375 | 1 |
| SLC7A11 AND WNT3 AND NOT-DNAJB8 | 1 | 1 | 1 | ASTN1 AND BEST3 AND NOT-TSPAN8 | 0.967742 | 0.9375 | 1 |
| SLC7A11 AND WNT3 AND NOT-HHLA2 | 1 | 1 | 1 | ASTN1 AND BEST3 AND NOT-SLC12A6 | 0.967742 | 0.9375 | 1 |
| SLC7A11 AND WNT3 AND NOT-SLC34A2 | 1 | 1 | 1 | ASTN1 AND BEST3 AND NOT-EFNB3 | 0.967742 | 0.9375 | 1 |
| SLC7A11 AND WNT3 AND NOT-MSLN | 1 | 1 | 1 | ASTN1 AND BEST3 AND NOT-NRXN2 | 0.965517 | 1 | 0.933333 |
| SLC7A11 AND WNT3 AND NOT-GPA33 | 1 | 1 | 1 | ASTN1 AND BEST3 AND NOT-ABCB1 | 0.967742 | 0.9375 | 1 |
| SLC7A11 AND NOT-NINJ2 AND TNFRSF8 | 1 | 1 | 1 | OMG AND BEST3 AND NOT-SLC26A10 | 0.967742 | 0.9375 | 1 |
| SLC7A11 AND NOT-NINJ2 AND MUC16 | 1 | 1 | 1 | ASTN1 AND BEST3 AND NOT-EVI2B | 0.967742 | 0.9375 | 1 |
| SLC7A11 AND NOT-NINJ2 AND ULBP1 | 1 | 1 | 1 | ASTN1 AND BEST3 AND SERINC1 | 0.967742 | 0.9375 | 1 |
| SLC7A11 AND NOT-NINJ2 AND VTCN1 | 1 | 1 | 1 | CDH10 AND BEST3 AND NOT-SCN4B | 0.9375 | 0.882353 | 1 |
| SLC7A11 AND NOT-NINJ2 AND ULBP3 | 1 | 1 | 1 | ASTN1 AND BEST3 AND NOT-CLEC4A | 0.967742 | 0.9375 | 1 |
| SLC7A11 AND NOT-NINJ2 AND FCRL2 | 1 | 1 | 1 | ASTN1 AND BEST3 AND NOT-ECSCR | 0.967742 | 0.9375 | 1 |
| SLC7A11 AND NOT-NINJ2 AND CA9 | 1 | 1 | 1 | ASTN1 AND BEST3 AND NOT-HAVCR2 | 0.967742 | 0.9375 | 1 |
| SLC7A11 AND WNT3 AND NOT-FOLH1 | 1 | 1 | 1 | ASTN1 AND BEST3 AND NOT-SLC30A5 | 0.967742 | 0.9375 | 1 |
| SLC7A11 AND WNT3 AND NOT-SSTR5 | 1 | 1 | 1 | ASTN1 AND BEST3 AND NOT-TGFBR2 | 0.967742 | 0.9375 | 1 |
| SLC7A11 AND WNT3 AND NOT-SST | 1 | 1 | 1 | ASTN1 AND BEST3 AND NOT-PKD2L1 | 0.967742 | 0.9375 | 1 |
| SLC7A11 AND WNT3 AND NOT-ENPP3 | 1 | 1 | 1 | ASTN1 AND BEST3 AND NOT-MYOF | 0.967742 | 0.9375 | 1 |
| SLC7A11 AND NOT-IL13RA1 AND WNT3 | 1 | 1 | 1 | ASTN1 AND BEST3 AND NOT-HLA-G | 0.967742 | 0.9375 | 1 |
| SLC7A11 AND WNT3 AND NOT-IL3RA | 1 | 1 | 1 | NCAM2 AND BEST3 AND NOT-JPH3 | 0.9375 | 0.882353 | 1 |
| SLC7A11 AND WNT3 AND NOT-GPC3 | 1 | 1 | 1 | ASTN1 AND BEST3 AND NOT-SLC16A1 | 0.967742 | 0.9375 | 1 |
| SLC7A11 AND WNT3 AND NOT-B4GALNT1 | 1 | 1 | 1 | ASTN1 AND BEST3 AND NOT-CD84 | 0.967742 | 0.9375 | 1 |
| FZD3 AND NOT-SLCO4A1 AND OAS1 | 1 | 1 | 1 | ASTN1 AND BEST3 AND NOT-SCARB1 | 0.967742 | 0.9375 | 1 |
| FZD3 AND NOT-SLCO4A1 AND IL20RA | 1 | 1 | 1 | ASTN1 AND BEST3 AND NOT-SLC26A2 | 0.967742 | 0.9375 | 1 |
| SLC7A11 AND NOT-NINJ2 AND SSTR5 | 1 | 1 | 1 | NCAM2 AND BEST3 AND NOT-PTPRT | 0.9375 | 0.882353 | 1 |
| GRPR AND NOT-LTBR AND NOT-CD22 | 1 | 1 | 1 | ASTN1 AND BEST3 AND NOT-CD4 | 0.967742 | 0.9375 | 1 |
| COMPLEX-CSPG5/SLC32A1/FZD3 | 1 | 1 | 1 | ASTN1 AND BEST3 AND NOT-CSF3R | 0.933333 | 0.933333 | 0.933333 |

FIG. 15 (cont.)

| Antigen Pair Logic | F1 | Precision | Recall |
|---|---|---|---|
| GRM6 AND ZDHHC17 AND NOT-GJA10 | 1 | 1 | 1 |
| GRM6 AND ZDHHC17 AND NOT-CALN1 | 1 | 1 | 1 |
| CADM1 AND NOT-SLC6A6 AND CCKAR | 1 | 1 | 1 |
| GRM6 AND ZDHHC17 AND NOT-TRPM8 | 1 | 1 | 1 |
| FZD3 AND NOT-KCNK9 AND SLC43A1 | 1 | 1 | 1 |
| GRM6 AND ZDHHC17 AND NOT-CACNA1S | 1 | 1 | 1 |
| GRM6 AND ZDHHC17 AND NOT-UNC5A | 1 | 1 | 1 |
| ZDHHC17 AND NOT-SEMA4D AND CALHM1 | 1 | 1 | 1 |
| ZDHHC17 AND CALHM1 AND NOT-CACNG3 | 1 | 1 | 1 |
| FZD3 AND NOT-KCNK9 AND PCDH11Y | 1 | 1 | 1 |
| ZDHHC17 AND CALHM1 AND NOT-SLC17A2 | 1 | 1 | 1 |
| ZDHHC17 AND CALHM1 AND NOT-MUC12 | 1 | 1 | 1 |
| ZDHHC17 AND CALHM1 AND NOT-HCN4 | 1 | 1 | 1 |
| GRM6 AND ZDHHC17 AND NOT-CLSTN3 | 1 | 1 | 1 |
| GRM6 AND ZDHHC17 AND NOT-SLC28A1 | 1 | 1 | 1 |
| GRM6 AND ZDHHC17 AND NOT-TRPC3 | 1 | 1 | 1 |
| GRM6 AND ZDHHC17 AND NOT-AJAP1 | 1 | 1 | 1 |
| FZD3 AND NOT-KCNK9 AND TNFRSF10B | 1 | 1 | 1 |
| GRM6 AND ZDHHC17 AND NOT-RXFP3 | 1 | 1 | 1 |
| FZD3 AND NOT-CNTNAP4 AND NOT-KCNK9 | 1 | 1 | 1 |
| GRM6 AND ZDHHC17 AND NOT-PCDH15 | 1 | 1 | 1 |
| FZD3 AND NOT-KCNK9 AND VAMP8 | 1 | 1 | 1 |
| GRM6 AND ZDHHC17 AND NOT-GPR135 | 1 | 1 | 1 |
| GRM6 AND ZDHHC17 AND NOT-ABCG5 | 1 | 1 | 1 |
| GRM6 AND ZDHHC17 AND NOT-NPFFR1 | 1 | 1 | 1 |
| FZD3 AND NOT-KCNK9 AND LAPTM5 | 1 | 1 | 1 |
| FZD3 AND NOT-KCNK9 AND CACNA1S | 1 | 1 | 1 |
| ZDHHC17 AND CALHM1 AND NOT-OR4N4 | 1 | 1 | 1 |
| ZDHHC17 AND CALHM1 AND NOT-GHR | 1 | 1 | 1 |
| COMPLEX-CSPG5/B4GALNT1/FZD3 | 1 | 1 | 1 |
| GPM6B AND NOT-ANO4 AND CBX3 | 1 | 1 | 1 |
| GRM6 AND ZDHHC17 AND NOT-CD70 | 1 | 1 | 1 |
| ZDHHC17 AND CALHM1 AND NOT-CD160 | 1 | 1 | 1 |
| ZDHHC17 AND CALHM1 AND NOT-CLDN7 | 1 | 1 | 1 |
| ZDHHC17 AND CALHM1 AND NOT-CSPG4 | 1 | 1 | 1 |
| ZDHHC17 AND CALHM1 AND NOT-CLEC14A | 1 | 1 | 1 |
| NOT-SLC6A6 AND SGCZ AND FCRL2 | 1 | 1 | 1 |
| NOT-SLC6A6 AND SGCZ AND ABCB5 | 1 | 1 | 1 |
| GPM6B AND NOT-ANO4 AND NOT-FOLH1 | 1 | 1 | 1 |
| COL25A1 AND NOT-SLC6A6 AND ITGAV | 1 | 1 | 1 |
| COL25A1 AND NOT-SLC6A6 AND TNC | 1 | 1 | 1 |
| NOT-SLC16A7 AND GHRHR AND NOT-CLDN7 | 1 | 1 | 1 |
| NOT-SLC6A6 AND SSTR3 AND EQTN | 1 | 1 | 1 |
| NOT-SLC6A6 AND EQTN AND NOT-EPCAM | 1 | 1 | 1 |
| NOT-SLC6A6 AND EQTN AND MSLN | 1 | 1 | 1 |
| NOT-SLC16A7 AND KCNH1 AND PROM1 | 1 | 1 | 1 |
| NOT-SLC16A7 AND KCNH1 AND DDX3X | 1 | 1 | 1 |
| NOT-SLC16A7 AND KCNH1 AND CBX3 | 1 | 1 | 1 |
| NOT-SLC6A6 AND MSLN AND NOT-CD151 | 1 | 1 | 1 |
| GRM6 AND ZDHHC17 AND NOT-CD38 | 1 | 1 | 1 |
| GRM6 AND ZDHHC17 AND NOT-CD180 | 1 | 1 | 1 |
| GRM6 AND ZDHHC17 AND NOT-MST1R | 1 | 1 | 1 |
| GRM6 AND ZDHHC17 AND NOT-SEMA5B | 1 | 1 | 1 |
| GRM6 AND ZDHHC17 AND NOT-TRPM4 | 1 | 1 | 1 |
| GRM6 AND ZDHHC17 AND NOT-MOK | 1 | 1 | 1 |
| GRM6 AND ZDHHC17 AND NOT-SSTR2 | 1 | 1 | 1 |
| MEGF10 AND NOT-ADCY9 AND NOT-FOLH1 | 1 | 1 | 1 |
| GRM6 AND ZDHHC17 AND NOT-WT1 | 1 | 1 | 1 |
| MEGF10 AND NOT-ADCY9 AND NOT-ERBB3 | 1 | 1 | 1 |
| MEGF10 AND NOT-ADCY9 AND DDX3X | 1 | 1 | 1 |
| GPM6B AND NOT-ANO4 AND MSLN | 1 | 1 | 1 |
| GRM6 AND ZDHHC17 AND NOT-ULBP2 | 1 | 1 | 1 |
| GRM6 AND ZDHHC17 AND NOT-FCRL5 | 1 | 1 | 1 |
| NOT-SLC6A6 AND MSLN AND ATP1A4 | 1 | 1 | 1 |
| NOT-SLC6A6 AND MSLN AND BRS3 | 1 | 1 | 1 |
| NOT-SLC6A6 AND MSLN AND SLC12A4 | 1 | 1 | 1 |
| GPM6B AND NOT-ANO4 AND TNFRSF8 | 1 | 1 | 1 |
| NOT-SLC6A6 AND MSLN AND STRA6 | 1 | 1 | 1 |
| CDH23 AND NOT-SLC6A6 AND MSLN | 1 | 1 | 1 |
| NOT-SLC6A6 AND MSLN AND TRPV4 | 1 | 1 | 1 |
| NOT-ATP11C AND CDH11 AND CBX3 | 1 | 1 | 1 |
| NOT-SLC6A6 AND MSLN AND IL20RB | 1 | 1 | 1 |
| NOT-SLC6A6 AND MSLN AND P2RY13 | 1 | 1 | 1 |
| NOT-SLC6A6 AND MSLN AND PMP22 | 1 | 1 | 1 |
| NOT-SLC6A6 AND MSLN AND NTM | 1 | 1 | 1 |
| NOT-SLC6A6 AND MSLN AND TAS2R16 | 1 | 1 | 1 |
| MEGF10 AND NOT-SEMA4D AND LGR5 | 1 | 1 | 1 |

| Antigen Pair Logic | F1 | Precision | Recall |
|---|---|---|---|
| ASTN1 AND BEST3 AND NOT-DIO2 | 1 | 1 | 1 |
| ASTN1 AND BEST3 AND NOT-CX3CL1 | 0.967742 | 0.9375 | 1 |
| ASTN1 AND BEST3 AND NOT-OSMR | 0.933333 | 0.933333 | 0.933333 |
| ASTN1 AND BEST3 AND NOT-PCDH19 | 0.967742 | 0.9375 | 1 |
| ASTN1 AND BEST3 AND NOT-C1orf210 | 0.933333 | 0.933333 | 0.933333 |
| ASTN1 AND BEST3 AND NOT-CXCR2 | 0.933333 | 0.933333 | 0.933333 |
| BEST3 AND DISP2 AND NOT-AQP7 | 0.909091 | 0.833333 | 1 |
| NCAM2 AND BEST3 AND NOT-ANTXR2 | 0.9375 | 0.882353 | 1 |
| NCAM2 AND BEST3 AND NOT-CDH22 | 0.903226 | 0.875 | 0.933333 |
| OMG AND BEST3 AND NOT-FLRT2 | 0.967742 | 0.9375 | 1 |
| GRIA2 AND TNFRSF10B AND NOT-SLC30A10 | 0.928571 | 1 | 0.866667 |
| GRIA2 AND TNFRSF10B AND NOT-SLC5A10 | 0.928571 | 1 | 0.866667 |
| GRIA2 AND TNFRSF10B AND NOT-PTPRT | 0.928571 | 1 | 0.866667 |
| ASTN1 AND BEST3 AND NOT-TNFSF10 | 0.896552 | 0.928571 | 0.866667 |
| GRIA2 AND BEST3 AND NOT-PTPRT | 0.967742 | 0.9375 | 1 |
| GRIA2 AND BEST3 AND NOT-SLC30A10 | 0.967742 | 0.9375 | 1 |
| OMG AND BEST3 AND NOT-CLCN5 | 0.967742 | 0.9375 | 1 |
| CDH10 AND BEST3 AND NOT-PTPRM | 0.9375 | 0.882353 | 1 |
| OMG AND BEST3 AND NOT-GPR52 | 0.967742 | 0.9375 | 1 |
| COMPLEX-CRB1/GRIK5/CD82 | 0.9375 | 0.882353 | 1 |
| GRIA2 AND TNFRSF10B AND NOT-PROCR | 0.928571 | 1 | 0.866667 |
| GRIA2 AND TNFRSF10B AND NOT-BTN3A1 | 0.928571 | 1 | 0.866667 |
| GRIA2 AND TNFRSF10B AND NOT-BST2 | 0.928571 | 1 | 0.866667 |
| COMPLEX-NKAIN4/GOLM1/THBD | 0.888889 | 1 | 0.8 |
| NKAIN4 AND NOT-PIK3IP1 AND P2RY13 | 0.888889 | 1 | 0.8 |
| NKAIN4 AND NOT-OPCML AND HLA-G | 0.888889 | 1 | 0.8 |
| COMPLEX-ATP9A/NKAIN4/VANGL1 | 0.888889 | 1 | 0.8 |
| NKAIN4 AND NOT-LAT AND P2RY13 | 0.888889 | 1 | 0.8 |
| COMPLEX-NKAIN4/APOLD1/AOC3 | 0.888889 | 1 | 0.8 |
| COMPLEX-NKAIN4/GOLM1/SMPD2 | 0.888889 | 1 | 0.8 |
| ASTN1 AND TSPAN11 AND NOT-SLC5A11 | 0.888889 | 1 | 0.8 |
| COMPLEX-NKAIN4/EMP2/DISP2 | 0.888889 | 1 | 0.8 |
| ASTN1 AND TSPAN11 AND NOT-ANTXR2 | 0.888889 | 1 | 0.8 |
| COMPLEX-NKAIN4/FLRT3/GHR | 0.888889 | 1 | 0.8 |
| COMPLEX-NKAIN4/TSPAN14/DISP2 | 0.888889 | 1 | 0.8 |
| COMPLEX-ATP9A/NKAIN4/SLC39A8 | 0.888889 | 1 | 0.8 |
| NKAIN4 AND NOT-FAIM2 AND SLC30A10 | 0.888889 | 1 | 0.8 |
| ASTN1 AND TSPAN11 AND NOT-CNTNAP4 | 0.888889 | 1 | 0.8 |
| COMPLEX-NKAIN4/GOLM1/LRRC8E | 0.888889 | 1 | 0.8 |
| NKAIN4 AND NOT-SMPD2 AND IL1RAP | 0.888889 | 1 | 0.8 |
| COMPLEX-NKAIN4/SLCO1B3/NTM | 0.888889 | 1 | 0.8 |
| COMPLEX-NKAIN4/SMPD2/VLDLR | 0.888889 | 1 | 0.8 |
| GRIA2 AND F2R AND NOT-PROCR | 0.888889 | 1 | 0.8 |
| COMPLEX-ATP10A/BCAN/LRRC8E | 0.928571 | 1 | 0.866667 |
| BCAN AND NOT-KCNC1 AND CD163L1 | 0.928571 | 1 | 0.866667 |
| BCAN AND NOT-OPCML AND SLC24A1 | 0.928571 | 1 | 0.866667 |
| BCAN AND NOT-GHR AND IGSF6 | 0.928571 | 1 | 0.866667 |
| BCAN AND NOT-TGFBR2 AND NOT-ASTN1 | 0.928571 | 1 | 0.866667 |
| COMPLEX-ATP10A/PTGIS/BCAN | 0.928571 | 1 | 0.866667 |
| COMPLEX-ASTN1/ATP10A/BCAN | 0.928571 | 1 | 0.866667 |
| COMPLEX-SCARA5/ABCB1/BCAN | 0.928571 | 1 | 0.866667 |
| BCAN AND NOT-GHR AND SLC22A4 | 0.928571 | 1 | 0.866667 |
| COMPLEX-EPHA2/ATP10A/BCAN | 0.928571 | 1 | 0.866667 |
| COMPLEX-KCNC1/ABCB1/BCAN | 0.928571 | 1 | 0.866667 |
| COMPLEX-ABCB1/SCN2A/BCAN | 0.928571 | 1 | 0.866667 |
| BCAN AND NOT-SLC43A1 AND HAVCR2 | 0.928571 | 1 | 0.866667 |
| BCAN AND NOT-NCAM2 AND CD1B | 0.928571 | 1 | 0.866667 |
| BCAN AND NOT-PLVAP AND HAVCR2 | 0.928571 | 1 | 0.866667 |
| BCAN AND NOT-SELP AND SIRPG | 0.928571 | 1 | 0.866667 |
| COMPLEX-PIK3IP1/ATP10A/BCAN | 0.928571 | 1 | 0.866667 |
| BCAN AND NOT-SMPD2 AND CD84 | 0.928571 | 1 | 0.866667 |
| BCAN AND NOT-RHOT2 AND NOT-ASTN1 | 0.928571 | 1 | 0.866667 |
| BCAN AND NOT-CLEC4A AND NOT-ASTN1 | 0.928571 | 1 | 0.866667 |
| BCAN AND NOT-SIRPG AND NOT-ASTN1 | 0.928571 | 1 | 0.866667 |
| BCAN AND NOT-PIK3IP1 AND HAVCR2 | 0.928571 | 1 | 0.866667 |
| BCAN AND NOT-GHR AND HAVCR2 | 0.928571 | 1 | 0.866667 |
| COMPLEX-ABCB1/GPR158/BCAN | 0.928571 | 1 | 0.866667 |
| COMPLEX-ATP10A/BCAN/SLC43A1 | 0.928571 | 1 | 0.866667 |
| COMPLEX-NCAM2/BCAN/LRRTM4 | 0.928571 | 1 | 0.866667 |
| COMPLEX-GHR/ATP10A/BCAN | 0.928571 | 1 | 0.866667 |
| BCAN AND NOT-EMCN AND NOT-ASTN1 | 0.928571 | 1 | 0.866667 |
| BCAN AND NOT-ABCD4 AND NOT-ASTN1 | 0.928571 | 1 | 0.866667 |
| COMPLEX-LAT/ATP10A/BCAN | 0.928571 | 1 | 0.866667 |
| BCAN AND NOT-SLC24A2 AND CLEC4A | 0.928571 | 1 | 0.866667 |
| BCAN AND NOT-TMED1 AND NOT-ASTN1 | 0.928571 | 1 | 0.866667 |
| COMPLEX-SCAMP5/BCAN/SLC39A8 | 0.928571 | 1 | 0.866667 |
| BCAN AND NOT-SMPD2 AND CD1C | 0.928571 | 1 | 0.866667 |

FIG. 15 (cont.)

| Antigen Pair Logic | F1 | Precision | Recall |
|---|---|---|---|
| GRM8 AND NOT-SLC6A6 AND CBX3 | 1 | 1 | 1 |
| NOT-SLC6A6 AND TAS1R1 AND SSTR3 | 1 | 1 | 1 |
| NOT-SLC6A6 AND SLC9B1 AND NOT-EPCAM | 1 | 1 | 1 |
| NOT-SLC6A6 AND PCDHGC4 AND TNFSF11 | 1 | 1 | 1 |
| GRM8 AND NOT-SLC6A6 AND DDX3X | 1 | 1 | 1 |
| NOT-SLC6A6 AND PCDHGC4 AND FCRL2 | 1 | 1 | 1 |
| SLC7A5 AND NOT-SLC6A6 AND NPFFR1 | 1 | 1 | 1 |
| NOT-SLC6A6 AND SLC9B1 AND ITGB3 | 1 | 1 | 1 |
| GRM8 AND NOT-SLC6A6 AND SLC39A6 | 1 | 1 | 1 |
| SLC7A5 AND NOT-SLC6A6 AND CHRNG | 1 | 1 | 1 |
| GRM8 AND NOT-SLC6A6 AND ITGAV | 1 | 1 | 1 |
| GRM8 AND NOT-SLC6A6 AND ITGB3 | 1 | 1 | 1 |
| SLC7A5 AND NOT-SLC6A6 AND LAPTM5 | 1 | 1 | 1 |
| NOT-SLC6A6 AND GPR78 AND AFP | 1 | 1 | 1 |
| NOT-SLC6A6 AND GPR78 AND CBX3 | 1 | 1 | 1 |
| OTOF AND NOT-SLC6A6 AND CBX3 | 1 | 1 | 1 |
| MEGF10 AND NOT-SLC6A6 AND SLC7A5 | 1 | 1 | 1 |
| ABCB5 AND NOT-SLC6A6 AND UMODL1 | 1 | 1 | 1 |
| NOT-SLC6A6 AND PCDHGC4 AND ITGB3 | 1 | 1 | 1 |
| GRM8 AND NOT-SLC6A6 AND MOK | 1 | 1 | 1 |
| NOT-SLC6A6 AND MSLN AND CATSPER3 | 1 | 1 | 1 |
| NOT-SLC6A6 AND CDH11 AND CLDN5 | 1 | 1 | 1 |
| MEGF10 AND NOT-SLC6A6 AND DDX3X | 1 | 1 | 1 |
| NOT-SLC6A6 AND MSLN AND KCNJ6 | 1 | 1 | 1 |
| MEGF10 AND NOT-SLC6A6 AND FAP | 1 | 1 | 1 |
| NOT-SLC6A6 AND UMODL1 AND HLA-DOB | 1 | 1 | 1 |
| NOT-SLC6A6 AND UMODL1 AND FAP | 1 | 1 | 1 |
| NOT-SLC6A6 AND UMODL1 AND ERBB4 | 1 | 1 | 1 |
| NOT-SLC6A6 AND MSLN AND OXTR | 1 | 1 | 1 |
| NOT-SLC6A6 AND UMODL1 AND DDX3X | 1 | 1 | 1 |
| NOT-SLC6A6 AND UMODL1 AND CBX3 | 1 | 1 | 1 |
| SLC7A5 AND NOT-SLC6A6 AND FLVCR1 | 1 | 1 | 1 |
| MEGF10 AND NOT-SLC6A6 AND MOK | 1 | 1 | 1 |
| SLC7A5 AND NOT-SLC6A6 AND MLNR | 1 | 1 | 1 |
| SLC7A5 AND NOT-SLC6A6 AND OXTR | 1 | 1 | 1 |
| SLC7A5 AND NOT-SLC6A6 AND P2RX3 | 1 | 1 | 1 |
| MEGF10 AND NOT-SLC6A6 AND TNFSF11 | 1 | 1 | 1 |
| NOT-SLC6A6 AND TAS1R1 AND TNFSF11 | 1 | 1 | 1 |
| MEGF10 AND NOT-SLC6A6 AND TNFRSF10A | 1 | 1 | 1 |
| NOT-SLC6A6 AND MSLN AND OR52D1 | 1 | 1 | 1 |
| NOT-SLC6A6 AND LRRN4 AND IGF1R | 1 | 1 | 1 |
| NOT-SLC6A6 AND GHRHR AND ITGAV | 1 | 1 | 1 |
| GRM8 AND NOT-SLC6A6 AND MSLN | 1 | 1 | 1 |
| NOT-SLC6A6 AND KCNK9 AND TYR | 1 | 1 | 1 |
| NOT-SLC6A6 AND MLANA AND MUC13 | 1 | 1 | 1 |
| NOT-SLC6A6 AND MSLN AND CSMD2 | 1 | 1 | 1 |
| NOT-SLC6A6 AND ROS1 AND ABCB5 | 1 | 1 | 1 |
| NOT-SLC6A6 AND CLDN17 AND MSLN | 1 | 1 | 1 |
| NOT-SLC6A6 AND CLDN17 AND IGF1R | 1 | 1 | 1 |
| NOT-SLC6A6 AND MLANA AND MSLN | 1 | 1 | 1 |
| NOT-SLC6A6 AND SLC12A3 AND SEMA5B | 1 | 1 | 1 |
| NOT-SLC6A6 AND CLDN17 AND ITGB3 | 1 | 1 | 1 |
| NOT-SLC6A6 AND CLDN17 AND CD37 | 1 | 1 | 1 |
| SLC22A14 AND NOT-SLC6A6 AND SLC39A6 | 1 | 1 | 1 |
| NOT-SLC6A6 AND CLDN17 AND TNFSF11 | 1 | 1 | 1 |
| NOT-SLC6A6 AND CLDN17 AND CLDN5 | 1 | 1 | 1 |
| NOT-SLC6A6 AND CLDN17 AND NOT-TRPM4 | 1 | 1 | 1 |
| NOT-SLC6A6 AND MSLN AND SLC13A5 | 1 | 1 | 1 |
| NOT-SLC6A6 AND SLC12A3 AND TNFSF11 | 1 | 1 | 1 |
| NOT-SLC6A6 AND MSLN AND SLC17A3 | 1 | 1 | 1 |
| NOT-SLC6A6 AND PCDHGC4 AND FOLR1 | 1 | 1 | 1 |
| NOT-SLC6A6 AND PCDHGC4 AND DKK1 | 1 | 1 | 1 |
| NOT-SLC6A6 AND SSTR3 AND KCNK9 | 1 | 1 | 1 |
| NOT-SLC6A6 AND SLC12A3 AND ITGAV | 1 | 1 | 1 |
| NOT-SLC6A6 AND PCDHGC4 AND ERBB4 | 1 | 1 | 1 |
| MC2R AND NOT-CD52 AND UMODL1 | 1 | 1 | 1 |
| NOT-SLC6A6 AND SLC12A3 AND ITGB3 | 1 | 1 | 1 |
| NOT-SLC6A6 AND MSLN AND KCNK9 | 1 | 1 | 1 |
| NOT-SLC6A6 AND PCDHGC4 AND DDX3X | 1 | 1 | 1 |
| NOT-SLC6A6 AND KCNK9 AND ERBB2 | 1 | 1 | 1 |
| NOT-SLC6A6 AND KCNK9 AND CSPG4 | 1 | 1 | 1 |
| ADCY10 AND NOT-CD52 AND CD33 | 1 | 1 | 1 |
| NOT-SLC6A6 AND SSTR3 AND ABCB5 | 1 | 1 | 1 |
| NOT-SLC6A6 AND SSTR3 AND CBX3 | 1 | 1 | 1 |
| NOT-SLC6A6 AND SSTR3 AND DDX3X | 1 | 1 | 1 |
| NOT-SLC6A6 AND SSTR3 AND MSLN | 1 | 1 | 1 |
| NOT-SLC6A6 AND SSTR3 AND IGF1R | 1 | 1 | 1 |

| Antigen Pair Logic | F1 | Precision | Recall |
|---|---|---|---|
| BCAN AND NOT-SELP AND HAVCR2 | 0.928571 | 1 | 0.866667 |
| NCAM2 AND BEST3 AND NOT-ULBP2 | 0.967742 | 0.9375 | 1 |
| BEST3 AND LRRTM2 AND NOT-TRPM4 | 0.9375 | 0.882353 | 1 |
| GRIA2 AND EGFR AND NOT-PTPRT | 0.903226 | 0.875 | 0.933333 |
| GRIA2 AND TNFRSF10B AND NOT-ULBP2 | 0.928571 | 1 | 0.866667 |
| GRIA2 AND EGFR AND NOT-SLC30A10 | 0.903226 | 0.875 | 0.933333 |
| GRIA2 AND EGFR AND NOT-SLC5A10 | 0.903226 | 0.875 | 0.933333 |
| GRIA2 AND BEST3 AND NOT-RAET1E | 0.967742 | 0.9375 | 1 |
| BEST3 AND ATP9A AND NOT-IL20RA | 0.9375 | 0.882353 | 1 |
| BEST3 AND ATP9A AND NOT-TRPM4 | 0.9375 | 0.882353 | 1 |
| BEST3 AND ATP9A AND NOT-MST1R | 0.9375 | 0.882353 | 1 |
| GRIA2 AND BEST3 AND NOT-ULBP2 | 0.967742 | 0.9375 | 1 |
| GRIA2 AND TNFRSF10B AND NOT-CLDN1 | 0.928571 | 1 | 0.866667 |
| GRIA2 AND TNFRSF10B AND NOT-RAET1E | 0.928571 | 1 | 0.866667 |
| DLL3 AND NOT-SMPD2 AND CYP4F12 | 0.888889 | 1 | 0.8 |
| ASTN1 AND VANGL2 AND NOT-IL13RA1 | 0.888889 | 1 | 0.8 |
| DLL3 AND NOT-GHR AND SIRPG | 0.888889 | 1 | 0.8 |
| COMPLEX-NKAIN4/ITGAV/CA12 | 0.888889 | 1 | 0.8 |
| COMPLEX-ITGAV/BCAN/PPAP2A | 0.928571 | 1 | 0.866667 |
| BCAN AND NOT-CLDN5 AND CLEC4A | 0.928571 | 1 | 0.866667 |
| BCAN AND NOT-CD37 AND CD84 | 0.928571 | 1 | 0.866667 |
| BCAN AND NOT-NRXN2 AND VCAM1 | 0.928571 | 1 | 0.866667 |
| COMPLEX-CLDN7/ATP10A/BCAN | 0.928571 | 1 | 0.866667 |
| BCAN AND NOT-MS4A1 AND SIRPG | 0.928571 | 1 | 0.866667 |
| COMPLEX-ATP10A/BCAN/CLDN5 | 0.928571 | 1 | 0.866667 |
| COMPLEX-ATP10A/BCAN/CD34 | 0.928571 | 1 | 0.866667 |
| COMPLEX-ERBB3/ATP10A/BCAN | 0.928571 | 1 | 0.866667 |
| BCAN AND NOT-AQP9 AND VCAM1 | 0.928571 | 1 | 0.866667 |
| COMPLEX-ITGAV/ATP10A/BCAN | 0.928571 | 1 | 0.866667 |
| BCAN AND NOT-TRPM4 AND SLC22A4 | 0.928571 | 1 | 0.866667 |
| COMPLEX-TRPM4/ATP10A/BCAN | 0.928571 | 1 | 0.866667 |
| BCAN AND NOT-RAET1E AND HAVCR2 | 0.928571 | 1 | 0.866667 |
| BCAN AND NOT-CLDN1 AND SIRPG | 0.928571 | 1 | 0.866667 |
| COMPLEX-RAET1E/ATP10A/BCAN | 0.928571 | 1 | 0.866667 |
| BCAN AND NOT-TRPM4 AND NOT-LRP11 | 0.928571 | 1 | 0.866667 |
| GRIA2 AND EGFR AND NOT-RAET1E | 0.903226 | 0.875 | 0.933333 |
| GRIA2 AND EGFR AND NOT-ULBP2 | 0.903226 | 0.875 | 0.933333 |
| DLL3 AND NOT-MUC1 AND ATP10A | 0.888889 | 1 | 0.8 |
| DLL3 AND NOT-LSAMP AND CLDN5 | 0.888889 | 1 | 0.8 |
| DLL3 AND NOT-CD34 AND FAIM2 | 0.888889 | 1 | 0.8 |
| DLL3 AND NOT-ITGB6 AND GLDN | 0.888889 | 1 | 0.8 |
| DLL3 AND NOT-TRPM4 AND SIRPG | 0.888889 | 1 | 0.8 |
| DLL3 AND NOT-TRPM4 AND IL1RAP | 0.888889 | 1 | 0.8 |
| DLL3 AND NOT-CA12 AND CLDN5 | 0.888889 | 1 | 0.8 |
| DLL3 AND NOT-CLDN5 AND FAIM2 | 0.888889 | 1 | 0.8 |
| COMPLEX-DLL3/EPCAM/PTPRE | 0.888889 | 1 | 0.8 |
| DLL3 AND NOT-MS4A1 AND SIRPG | 0.888889 | 1 | 0.8 |
| DLL3 AND NOT-TRPM4 AND ATP10A | 0.888889 | 1 | 0.8 |
| DLL3 AND NOT-TRPM4 AND GLDN | 0.888889 | 1 | 0.8 |
| DLL3 AND NOT-IL20RA AND SIRPG | 0.888889 | 1 | 0.8 |
| DLL3 AND NOT-CLDN7 AND ATP10A | 0.888889 | 1 | 0.8 |
| DLL3 AND NOT-TRPM4 AND CD4 | 0.888889 | 1 | 0.8 |
| DLL3 AND NOT-ITGB6 AND ATP10A | 0.888889 | 1 | 0.8 |
| DLL3 AND NOT-MUC1 AND GLDN | 0.888889 | 1 | 0.8 |
| NCAM2 AND EGFR AND NOT-CLDN1 | 0.888889 | 1 | 0.8 |
| NCAM2 AND EGFR AND NOT-CD34 | 0.888889 | 1 | 0.8 |
| DLL3 AND NOT-LYVE1 AND CLDN5 | 0.888889 | 1 | 0.8 |
| NCAM2 AND EGFR AND NOT-IL13RA1 | 0.888889 | 1 | 0.8 |
| DLL3 AND NOT-CD34 AND SCAMP5 | 0.888889 | 1 | 0.8 |
| DLL3 AND NOT-RAET1E AND SCAMP5 | 0.888889 | 1 | 0.8 |
| COMPLEX-DLL3/KLRF1/TRPM4 | 0.888889 | 1 | 0.8 |
| NCAM2 AND EGFR AND NOT-ULBP2 | 0.888889 | 1 | 0.8 |
| COMPLEX-DLL3/CXADR/TRPM4 | 0.888889 | 1 | 0.8 |
| DLL3 AND NOT-CLDN5 AND ATP10A | 0.857143 | 0.923077 | 0.8 |
| DLL3 AND NOT-RAET1E AND GLDN | 0.857143 | 0.923077 | 0.8 |
| DLL3 AND NOT-TRPM4 AND CD84 | 0.888889 | 1 | 0.8 |
| DLL3 AND NOT-CLDN5 AND NT5E | 0.857143 | 0.923077 | 0.8 |
| LSAMP AND EGFR AND NOT-CLDN1 | 0.857143 | 0.923077 | 0.8 |
| COMPLEX-DLL3/ATP1B3/TRPM4 | 0.857143 | 0.923077 | 0.8 |
| DLL3 AND NOT-LSAMP AND IL13RA1 | 0.857143 | 0.923077 | 0.8 |
| DLL3 AND NOT-CLDN1 AND SIRPG | 0.857143 | 0.923077 | 0.8 |
| VANGL2 AND NOT-IL20RA AND CLDN5 | 0.857143 | 0.923077 | 0.8 |
| DLL3 AND NOT-P2RX5 AND CD84 | 0.857143 | 0.923077 | 0.8 |
| DLL3 AND NOT-CD34 AND CD84 | 0.857143 | 0.923077 | 0.8 |
| DLL3 AND NOT-LSAMP AND CLDN1 | 0.857143 | 0.923077 | 0.8 |
| DLL3 AND NOT-CD34 AND ATP10A | 0.857143 | 0.923077 | 0.8 |
| DLL3 AND NOT-FZD7 AND NOT-MST1R | 0.846154 | 1 | 0.733333 |

FIG. 15 (cont.)

| Antigen Pair Logic | F1 | Precision | Recall | Antigen Pair Logic | F1 | Precision | Recall |
|---|---|---|---|---|---|---|---|
| NOT-SLC6A6 AND SSTR3 AND ITGAV | 1 | 1 | 1 | COMPLEX-ATP9A/DLL3/MST1R | 0.846154 | 1 | 0.733333 |
| SLC7A5 AND NOT-SLC6A6 AND SLC39A6 | 1 | 1 | 1 | DLL3 AND NOT-IL3RA AND P2RY13 | 0.846154 | 1 | 0.733333 |
| GRM6 AND NOT-CD33 AND CBX3 | 1 | 1 | 1 | DLL3 AND NOT-MUC1 AND P2RY13 | 0.846154 | 1 | 0.733333 |
| MEGF10 AND NOT-SEMA4D AND CD44 | 1 | 1 | 1 | DLL3 AND NOT-TRPM4 AND P2RY13 | 0.846154 | 1 | 0.733333 |
| NOT-SLC6A6 AND KCNK9 AND ABHD3 | 1 | 1 | 1 | DLL3 AND NOT-ITGB6 AND P2RY13 | 0.846154 | 1 | 0.733333 |
| NOT-SLC6A6 AND KCNK9 AND HTR3C | 1 | 1 | 1 | DLL3 AND NOT-CLDN7 AND P2RY13 | 0.846154 | 1 | 0.733333 |
| NOT-SLC6A6 AND KCNK9 AND SLC31A1 | 1 | 1 | 1 | DLL3 AND NOT-TNFRSF17 AND P2RY13 | 0.846154 | 1 | 0.733333 |
| NOT-SLC6A6 AND KCNK9 AND GJB4 | 1 | 1 | 1 | LSAMP AND EGFR AND NOT-IL13RA1 | 0.827586 | 0.857143 | 0.8 |
| NOT-SLC6A6 AND KCNK9 AND SLC22A12 | 1 | 1 | 1 | LSAMP AND EGFR AND NOT-RAET1E | 0.827586 | 0.857143 | 0.8 |
| NOT-SLC6A6 AND KCNK9 AND PROCR | 1 | 1 | 1 | LSAMP AND EGFR AND NOT-CD34 | 0.827586 | 0.857143 | 0.8 |
| GRM8 AND NOT-SLC6A6 AND GYPC | 1 | 1 | 1 | NRXN2 AND EGFR AND NOT-RAET1E | 0.827586 | 0.857143 | 0.8 |
| GRM8 AND NOT-SLC6A6 AND ERVW-1 | 1 | 1 | 1 | IFITM10 AND NOT-CLDN1 AND NOT-TRPM4 | 0.827586 | 0.857143 | 0.8 |
| GRM8 AND NOT-SLC6A6 AND SLC6A18 | 1 | 1 | 1 | GRIA2 AND SSX1 AND ITGAV | 0.846154 | 1 | 0.733333 |
| GRM8 AND NOT-SLC6A6 AND MIP | 1 | 1 | 1 | NCAM2 AND CLDN1 AND NOT-EPCAM | 0.823529 | 0.736842 | 0.933333 |
| SLC22A14 AND NOT-SLC6A6 AND FLVCR1 | 1 | 1 | 1 | NLGN3 AND NOT-TRPM4 AND NOT-STEAP2 | 0.933333 | 0.933333 | 0.933333 |
| GRM8 AND NOT-SLC6A6 AND OXTR | 1 | 1 | 1 | VANGL2 AND NOT-PMEL AND CLDN5 | 0.827586 | 0.857143 | 0.8 |
| GRM8 AND NOT-SLC6A6 AND CHRNA9 | 1 | 1 | 1 | COMPLEX-SEZ6/KCNQ2/BCAN | 0.928571 | 1 | 0.866667 |
| GRM8 AND NOT-SLC6A6 AND TRPC7 | 1 | 1 | 1 | COMPLEX-SLC5A11/ASTN1/BCAN | 0.928571 | 1 | 0.866667 |
| GRM8 AND NOT-SLC6A6 AND PTGIR | 1 | 1 | 1 | BCAN AND NOT-KCNC1 AND SLC5A10 | 0.928571 | 1 | 0.866667 |
| GRM8 AND NOT-SLC6A6 AND SLC2A1 | 1 | 1 | 1 | ASTN1 AND BEST3 AND NOT-RAET1E | 0.967742 | 0.9375 | 1 |
| GRM8 AND NOT-SLC6A6 AND NOT-STEAP4 | 1 | 1 | 1 | ASTN1 AND BEST3 AND NOT-ULBP2 | 0.967742 | 0.9375 | 1 |
| GRM8 AND NOT-SLC6A6 AND UMODL1 | 1 | 1 | 1 | ASTN1 AND BEST3 AND NOT-CLDN5 | 0.967742 | 0.9375 | 1 |
| NOT-SLC6A6 AND KCNK9 AND NOT-SLC12A5 | 1 | 1 | 1 | ASTN1 AND BEST3 AND NOT-CD34 | 0.967742 | 0.9375 | 1 |
| GRM8 AND NOT-SLC6A6 AND GPR156 | 1 | 1 | 1 | ASTN1 AND BEST3 AND NOT-IL13RA1 | 0.967742 | 0.9375 | 1 |
| NOT-SLC6A6 AND KCNK9 AND CD163 | 1 | 1 | 1 | BEST3 AND NOT-AOC3 AND CLDN5 | 0.9375 | 0.882353 | 1 |
| NOT-SLC6A6 AND KCNK9 AND KCNK16 | 1 | 1 | 1 | COMPLEX-NKAIN4/CLDN5/CD1A | 0.888889 | 1 | 0.8 |
| NOT-SLC6A6 AND KCNK9 AND PCDH11Y | 1 | 1 | 1 | COMPLEX-CDH10/NKAIN4/CD34 | 0.888889 | 1 | 0.8 |
| NOT-SLC6A6 AND SLC12A3 AND KCNK9 | 1 | 1 | 1 | COMPLEX-NKAIN4/ITGAV/SCN2A | 0.888889 | 1 | 0.8 |
| NOT-SLC6A6 AND KCNK9 AND NPFFR1 | 1 | 1 | 1 | COMPLEX-CDH10/NKAIN4/CLDN5 | 0.888889 | 1 | 0.8 |
| GRM8 AND NOT-SLC6A6 AND FLVCR1 | 1 | 1 | 1 | ASTN1 AND EGFR AND NOT-GYPC | 0.888889 | 1 | 0.8 |
| NOT-SLC6A6 AND KCNK9 AND GJD2 | 1 | 1 | 1 | ASTN1 AND EGFR AND NOT-PTPRT | 0.888889 | 1 | 0.8 |
| GRM8 AND NOT-SLC6A6 AND OR8D1 | 1 | 1 | 1 | ASTN1 AND F2R AND NOT-CLDN1 | 0.888889 | 1 | 0.8 |
| NOT-SLC6A6 AND PCDHGC4 AND KCNK9 | 1 | 1 | 1 | OMG AND BEST3 AND NOT-RAET1E | 0.967742 | 0.9375 | 1 |
| NOT-SLC6A6 AND KCNK9 AND MIP | 1 | 1 | 1 | CDH10 AND BEST3 AND NOT-RAET1E | 0.9375 | 0.882353 | 1 |
| NOT-SLC6A6 AND GPR78 AND KCNK9 | 1 | 1 | 1 | OMG AND BEST3 AND NOT-CLDN5 | 0.967742 | 0.9375 | 1 |
| NOT-SLC6A6 AND CLDN17 AND KCNK9 | 1 | 1 | 1 | ASTN1 AND EGFR AND NOT-ANTXR2 | 0.888889 | 1 | 0.8 |
| GRM8 AND NOT-SLC6A6 AND PCDH11Y | 1 | 1 | 1 | ASTN1 AND F2R AND NOT-IL13RA1 | 0.888889 | 1 | 0.8 |
| GRM8 AND NOT-SLC6A6 AND GPR50 | 1 | 1 | 1 | ASTN1 AND EGFR AND NOT-SLC30A10 | 0.888889 | 1 | 0.8 |
| NOT-SLC6A6 AND UMODL1 AND GPR19 | 1 | 1 | 1 | GPR158 AND BEST3 AND NOT-RAET1E | 0.9375 | 0.882353 | 1 |
| NOT-SLC6A6 AND UMODL1 AND SLC32A1 | 1 | 1 | 1 | OMG AND F2R AND NOT-RAET1E | 0.888889 | 1 | 0.8 |
| NOT-SLC6A6 AND TAS1R1 AND NOT-STEAP4 | 1 | 1 | 1 | ASTN1 AND EGFR AND NOT-CNTNAP4 | 0.888889 | 1 | 0.8 |
| NOT-SLC6A6 AND TAS1R1 AND GPR61 | 1 | 1 | 1 | ASTN1 AND TNFRSF10B AND NOT-IL13RA1 | 0.928571 | 1 | 0.866667 |
| NOT-SLC6A6 AND TAS1R1 AND NOT-AOC3 | 1 | 1 | 1 | ASTN1 AND EGFR AND NOT-CD163 | 0.888889 | 1 | 0.8 |
| NOT-SLC6A6 AND TAS1R1 AND CD44 | 1 | 1 | 1 | BEST3 AND SCN2A AND NOT-CLDN1 | 0.967742 | 0.9375 | 1 |
| NOT-SLC6A6 AND UMODL1 AND HCN4 | 1 | 1 | 1 | COMPLEX-SEZ6/EGFR/KCNQ2 | 1 | 1 | 1 |
| NOT-SLC6A6 AND GPR78 AND SLC2A2 | 1 | 1 | 1 | SCN2A AND EGFR AND NOT-ANTXR2 | 0.857143 | 0.923077 | 0.8 |
| NOT-SLC6A6 AND GPR78 AND GJD2 | 1 | 1 | 1 | OMG AND EGFR AND NOT-SLC30A10 | 0.857143 | 0.923077 | 0.8 |
| NOT-SLC6A6 AND GPR78 AND MRAP | 1 | 1 | 1 | CDH10 AND EGFR AND NOT-SLC30A10 | 0.857143 | 0.923077 | 0.8 |
| NOT-SLC6A6 AND UMODL1 AND CHRNG | 1 | 1 | 1 | COMPLEX-DLL3/CD93/DISP2 | 0.857143 | 0.923077 | 0.8 |
| NOT-SLC6A6 AND UMODL1 AND MRGPRX2 | 1 | 1 | 1 | CDH10 AND EGFR AND NOT-SLCO1B3 | 0.857143 | 0.923077 | 0.8 |
| NOT-SLC6A6 AND GPR78 AND GABRA3 | 1 | 1 | 1 | ASTN1 AND F2R AND NOT-VCAM1 | 0.888889 | 1 | 0.8 |
| NOT-SLC6A6 AND UMODL1 AND GPR156 | 1 | 1 | 1 | ASTN1 AND CXCL16 AND NOT-IL13RA1 | 0.875 | 0.823529 | 0.933333 |
| NOT-SLC6A6 AND TAS1R1 AND OXTR | 1 | 1 | 1 | COMPLEX-DLL3/CD93/OPCML | 0.857143 | 0.923077 | 0.8 |
| NOT-SLC6A6 AND UMODL1 AND KCNV2 | 1 | 1 | 1 | CDH10 AND EGFR AND NOT-SLC39A8 | 0.857143 | 0.923077 | 0.8 |
| NOT-SLC6A6 AND UMODL1 AND HTR3C | 1 | 1 | 1 | ASTN1 AND F2R AND ERBB3 | 0.888889 | 1 | 0.8 |
| NOT-SLC6A6 AND UMODL1 AND FGF6 | 1 | 1 | 1 | COMPLEX-NKAIN4/ERBB4/DISP2 | 0.846154 | 1 | 0.733333 |
| NOT-SLC6A6 AND UMODL1 AND CNIH2 | 1 | 1 | 1 | ASTN1 AND EGFR AND NOT-SLC31A1 | 0.846154 | 1 | 0.733333 |
| NOT-SLC6A6 AND UMODL1 AND OR1C1 | 1 | 1 | 1 | COMPLEX-NKAIN4/VCAM1/DISP2 | 0.846154 | 1 | 0.733333 |
| NOT-SLC6A6 AND UMODL1 AND OR10J1 | 1 | 1 | 1 | COMPLEX-NKAIN4/SCN2A/PROM1 | 0.846154 | 1 | 0.733333 |
| MEGF10 AND NOT-SLC6A6 AND MLANA | 1 | 1 | 1 | COMPLEX-NKAIN4/SCN2A/VCAM1 | 0.846154 | 1 | 0.733333 |
| NOT-SLC6A6 AND PCDHGC4 AND MLANA | 1 | 1 | 1 | BEST3 AND NOT-SCARA5 AND CLDN5 | 0.9375 | 0.882353 | 1 |
| NOT-SLC6A6 AND MLANA AND P2RX4 | 1 | 1 | 1 | ASTN1 AND TNFRSF10B AND NOT-CLDN1 | 0.928571 | 1 | 0.866667 |
| NOT-SLC6A6 AND MLANA AND OXTR | 1 | 1 | 1 | CDH10 AND TNFRSF10B AND NOT-STEAP1 | 0.928571 | 1 | 0.866667 |
| NOT-SLC6A6 AND TAS1R1 AND UPK3A | 1 | 1 | 1 | ASTN1 AND F2R AND CLDN5 | 0.888889 | 1 | 0.8 |
| NOT-SLC6A6 AND TAS1R1 AND KCNJ6 | 1 | 1 | 1 | OMG AND TNFRSF10B AND RAET1E | 0.83871 | 0.8125 | 0.866667 |
| GRM8 AND NOT-SLC6A6 AND CD44 | 1 | 1 | 1 | SCN2A AND EGFR AND NOT-SLC5A10 | 0.857143 | 0.923077 | 0.8 |
| NOT-SLC6A6 AND SLC4A5 AND ZACN | 1 | 1 | 1 | GPR158 AND F2R AND NOT-RAET1E | 0.888889 | 1 | 0.8 |
| NOT-SLC6A6 AND CLDN17 AND MMP24 | 1 | 1 | 1 | OMG AND TNFRSF10B AND NOT-CD34 | 0.83871 | 0.8125 | 0.866667 |
| NOT-SLC6A6 AND CLDN17 AND CABP7 | 1 | 1 | 1 | CDH10 AND F2R AND NOT-STEAP1 | 0.888889 | 1 | 0.8 |
| NOT-SLC6A6 AND CLDN17 AND CNIH2 | 1 | 1 | 1 | SCN2A AND EGFR AND NOT-CD1B | 0.857143 | 0.923077 | 0.8 |
| NOT-SLC6A6 AND CLDN17 AND GABRB1 | 1 | 1 | 1 | KCNC1 AND EGFR AND NOT-SLC5A10 | 0.827586 | 0.857143 | 0.8 |
| NOT-SLC6A6 AND CLDN17 AND GPR22 | 1 | 1 | 1 | KCNC1 AND EGFR AND NOT-SLC39A8 | 0.827586 | 0.857143 | 0.8 |
| NOT-SLC6A6 AND CLDN17 AND FLVCR1 | 1 | 1 | 1 | ASTN1 AND TNC AND NOT-CNTNAP4 | 0.827586 | 0.857143 | 0.8 |
| NOT-SLC6A6 AND CLDN17 AND LCT | 1 | 1 | 1 | ASTN1 AND TNC AND NOT-SLC5A11 | 0.827586 | 0.857143 | 0.8 |
| NOT-SLC6A6 AND CLDN17 AND OXTR | 1 | 1 | 1 | CDH10 AND CXCL16 AND NOT-STEAP1 | 0.823529 | 0.736842 | 0.933333 |
| NOT-SLC6A6 AND CLDN17 AND CACNA1B | 1 | 1 | 1 | ASTN1 AND CSPG4 AND NOT-SLC5A11 | 0.823529 | 0.736842 | 0.933333 |
| OTOF AND NOT-SLC6A6 AND CLDN17 | 1 | 1 | 1 | ASTN1 AND F2R AND NOT-RAET1E | 0.846154 | 1 | 0.733333 |

FIG. 15 (cont.)

| Antigen Pair Logic | F1 | Precision | Recall |
|---|---|---|---|
| NOT-SLC6A6 AND TAS1R1 AND GUCY2D | 1 | 1 | 1 |
| NOT-SLC16A7 AND ABCB5 AND MSLN | 1 | 1 | 1 |
| SLC16A2 AND NOT-ENG AND CD160 | 1 | 1 | 1 |
| SLC16A2 AND NOT-IL13RA1 AND SLC34A2 | 1 | 1 | 1 |
| SLC16A2 AND NOT-IL13RA1 AND NOT-CD52 | 1 | 1 | 1 |
| SLC16A2 AND NOT-IL13RA1 AND MSLN | 1 | 1 | 1 |
| SLC16A2 AND NOT-ENG AND CD38 | 1 | 1 | 1 |
| SLC16A2 AND NOT-ENG AND MS4A1 | 1 | 1 | 1 |
| SLC16A2 AND NOT-ENG AND NOT-CLDN12 | 1 | 1 | 1 |
| SLC16A2 AND NOT-ENG AND TNFRSF10A | 1 | 1 | 1 |
| SLC16A2 AND NOT-ENG AND LGR5 | 1 | 1 | 1 |
| SLC16A2 AND NOT-ENG AND VTCN1 | 1 | 1 | 1 |
| SLC16A2 AND NOT-ENG AND CA9 | 1 | 1 | 1 |
| SLC16A2 AND NOT-ENG AND NOT-VCAM1 | 1 | 1 | 1 |
| SLC16A2 AND NOT-ENG AND TYR | 1 | 1 | 1 |
| SLC16A2 AND NOT-ENG AND SSX1 | 1 | 1 | 1 |
| SLC16A2 AND NOT-ENG AND NOT-SDC1 | 1 | 1 | 1 |
| SLC16A2 AND NOT-ENG AND MUC13 | 1 | 1 | 1 |
| SLC16A2 AND NOT-ENG AND NOT-TRPM4 | 1 | 1 | 1 |
| SLC16A2 AND NOT-ENG AND ENPP3 | 1 | 1 | 1 |
| SLC16A2 AND NOT-ENG AND OAS1 | 1 | 1 | 1 |
| SLC16A2 AND NOT-ENG AND CEACAM6 | 1 | 1 | 1 |
| SLC16A2 AND NOT-ENG AND MUC1 | 1 | 1 | 1 |
| SLC16A2 AND NOT-ENG AND NOT-EPCAM | 1 | 1 | 1 |
| SLC16A2 AND NOT-ENG AND ITGB6 | 1 | 1 | 1 |
| SLC16A2 AND NOT-ENG AND ITGB3 | 1 | 1 | 1 |
| SLC16A2 AND NOT-ENG AND ABCB5 | 1 | 1 | 1 |
| SLC16A2 AND NOT-ENG AND CTAG2 | 1 | 1 | 1 |
| SLC16A2 AND NOT-ENG AND AFP | 1 | 1 | 1 |
| SLC16A2 AND NOT-ENG AND DDX3X | 1 | 1 | 1 |
| SLC16A2 AND NOT-IL13RA1 AND CD160 | 1 | 1 | 1 |
| SLC16A2 AND NOT-IL13RA1 AND FCRL1 | 1 | 1 | 1 |
| SLC16A2 AND NOT-IL13RA1 AND DDX3X | 1 | 1 | 1 |
| SLC16A2 AND NOT-IL13RA1 AND VTCN1 | 1 | 1 | 1 |
| SLC7A11 AND NOT-ENG AND FCRL1 | 1 | 1 | 1 |
| SLC7A11 AND NOT-ENG AND CBX3 | 1 | 1 | 1 |
| SLC16A2 AND NOT-IL13RA1 AND CD70 | 1 | 1 | 1 |
| SLC16A2 AND NOT-IL13RA1 AND CD38 | 1 | 1 | 1 |
| SLC16A2 AND NOT-IL13RA1 AND CD33 | 1 | 1 | 1 |
| SLC16A2 AND NOT-IL13RA1 AND TNFRSF10A | 1 | 1 | 1 |
| SLC16A2 AND NOT-IL13RA1 AND LGR5 | 1 | 1 | 1 |
| SLC16A2 AND NOT-IL13RA1 AND NOT-CD276 | 1 | 1 | 1 |
| SLC16A2 AND NOT-IL13RA1 AND CA9 | 1 | 1 | 1 |
| SLC16A2 AND NOT-IL13RA1 AND AFP | 1 | 1 | 1 |
| SLC16A2 AND NOT-IL13RA1 AND TYR | 1 | 1 | 1 |
| SLC16A2 AND NOT-IL13RA1 AND SSX1 | 1 | 1 | 1 |
| SLC16A2 AND NOT-IL13RA1 AND SLAMF7 | 1 | 1 | 1 |
| SLC16A2 AND NOT-IL13RA1 AND MUC13 | 1 | 1 | 1 |
| SLC16A2 AND NOT-IL13RA1 AND NOT-TRPM4 | 1 | 1 | 1 |
| SLC16A2 AND NOT-IL13RA1 AND ENPP3 | 1 | 1 | 1 |
| SLC16A2 AND NOT-IL13RA1 AND CEACAM6 | 1 | 1 | 1 |
| SLC16A2 AND NOT-IL13RA1 AND MUC1 | 1 | 1 | 1 |
| SLC16A2 AND NOT-IL13RA1 AND ITGB6 | 1 | 1 | 1 |
| SLC16A2 AND NOT-IL13RA1 AND ITGB3 | 1 | 1 | 1 |
| SLC16A2 AND NOT-IL13RA1 AND ABCB5 | 1 | 1 | 1 |
| SLC16A2 AND NOT-IL13RA1 AND CTAG2 | 1 | 1 | 1 |
| SLC16A2 AND NOT-ENG AND FCRL1 | 1 | 1 | 1 |
| SLC16A2 AND NOT-ENG AND SLC34A2 | 1 | 1 | 1 |
| SLC16A2 AND NOT-ENG AND MSLN | 1 | 1 | 1 |
| TMEM231 AND NOT-EPCAM AND MUC13 | 1 | 1 | 1 |
| TMEM231 AND NOT-EPCAM AND CD180 | 1 | 1 | 1 |
| TMEM231 AND NOT-EPCAM AND ITGB6 | 1 | 1 | 1 |
| TMEM231 AND NOT-EPCAM AND ABCB5 | 1 | 1 | 1 |
| TMEM231 AND NOT-EPCAM AND GUCY2C | 1 | 1 | 1 |
| TMEM231 AND NOT-EPCAM AND GAGE1 | 1 | 1 | 1 |
| TMEM231 AND NOT-EPCAM AND HHLA2 | 1 | 1 | 1 |
| PTPRA AND NOT-IL13RA1 AND MOK | 1 | 1 | 1 |
| PTPRA AND NOT-IL13RA1 AND NOT-FOLH1 | 1 | 1 | 1 |
| SLC5A4 AND NOT-CD52 AND PTK7 | 1 | 1 | 1 |
| SLC5A4 AND NOT-CD52 AND SLC39A6 | 1 | 1 | 1 |
| SLC5A4 AND NOT-CD52 AND CBX3 | 1 | 1 | 1 |
| FADS2 AND NOT-TRPM4 AND MOK | 1 | 1 | 1 |
| FADS2 AND NOT-TRPM4 AND NOT-FOLH1 | 1 | 1 | 1 |
| FADS2 AND NOT-TRPM4 AND NOT-ERBB3 | 1 | 1 | 1 |
| FADS2 AND NOT-TRPM4 AND DDX3X | 1 | 1 | 1 |
| FADS2 AND NOT-TRPM4 AND CBX3 | 1 | 1 | 1 |
| NOT-TRPM4 AND APCDD1 AND CD70 | 1 | 1 | 1 |

| Antigen Pair Logic | F1 | Precision | Recall |
|---|---|---|---|
| CDH10 AND F2R AND NOT-CD34 | 0.888889 | 1 | 0.8 |
| ASTN1 AND F2R AND NOT-CD34 | 0.846154 | 1 | 0.733333 |
| ASTN1 AND TNFRSF10B AND NOT-VCAM1 | 0.928571 | 1 | 0.866667 |
| ASTN1 AND TNFRSF10B AND CLDN5 | 0.928571 | 1 | 0.866667 |
| SCN2A AND EGFR AND NOT-CD93 | 0.857143 | 0.923077 | 0.8 |
| ASTN1 AND GJD2 AND NOT-ULBP2 | 0.888889 | 1 | 0.8 |
| KCNC1 AND CD1B AND ST8SIA1 | 0.83871 | 0.8125 | 0.866667 |
| CDH10 AND TNFRSF10B AND NOT-CD34 | 0.928571 | 1 | 0.866667 |
| COMPLEX-DLL3/CD93/KCNC1 | 0.814815 | 0.916667 | 0.733333 |
| COMPLEX-DLL3/SLCO1B3/KCNC1 | 0.814815 | 0.916667 | 0.733333 |
| SCN2A AND EGFR AND NOT-VAMP8 | 0.814815 | 0.916667 | 0.733333 |
| COMPLEX-DLL3/ANTXR2/SCN2A | 0.814815 | 0.916667 | 0.733333 |
| COMPLEX-DLL3/ATP2B2/DISP2 | 0.814815 | 0.916667 | 0.733333 |
| OPCML AND BEST3 AND NOT-RAET1E | 0.8125 | 0.764706 | 0.866667 |
| GPR158 AND TNFRSF10B AND NOT-CD34 | 0.8125 | 0.764706 | 0.866667 |
| ASTN1 AND GJD2 AND NOT-RAET1E | 0.888889 | 1 | 0.8 |
| IGDCC3 AND ASTN1 AND NOT-ULBP2 | 0.965517 | 1 | 0.933333 |
| CDH10 AND F2R AND NOT-RAET1E | 0.888889 | 1 | 0.8 |
| ASTN1 AND TNFRSF10B AND NOT-RAET1E | 0.846154 | 1 | 0.733333 |
| CDH10 AND TNFRSF10B AND NOT-RAET1E | 0.928571 | 1 | 0.866667 |
| ASTN1 AND TSHR AND NOT-RAET1E | 0.8 | 0.8 | 0.8 |
| OPCML AND EGFR AND NOT-SLC39A8 | 0.8 | 0.8 | 0.8 |
| OPCML AND F2R AND NOT-CD34 | 0.8 | 0.8 | 0.8 |
| OPCML AND F2R AND NOT-RAET1E | 0.8 | 0.8 | 0.8 |
| OPCML AND EGFR AND NOT-CD93 | 0.8 | 0.8 | 0.8 |
| OPCML AND EGFR AND NOT-CD1B | 0.8 | 0.8 | 0.8 |
| ASTN1 AND TSHR AND NOT-ULBP2 | 0.8 | 0.8 | 0.8 |
| ASTN1 AND TSHR AND NOT-CD34 | 0.8 | 0.8 | 0.8 |
| ASTN1 AND CSPG4 AND NOT-PTPRT | 0.8 | 0.7 | 0.933333 |
| ASTN1 AND CSPG4 AND NOT-SLC30A10 | 0.8 | 0.7 | 0.933333 |
| DLL3 AND NOT-SCN2A AND NOT-SLC39A8 | 0.8 | 1 | 0.666667 |
| ASTN1 AND NOT-SST AND SLCO1B3 | 0.8 | 1 | 0.666667 |
| BCAN AND NOT-CLDN5 AND SLC5A10 | 0.928571 | 1 | 0.866667 |
| BCAN AND NOT-SMPD2 AND VCAM1 | 0.928571 | 1 | 0.866667 |
| ASTN1 AND EGFR AND NOT-CD34 | 0.888889 | 1 | 0.8 |
| ASTN1 AND EGFR AND NOT-IL13RA1 | 0.888889 | 1 | 0.8 |
| ASTN1 AND EGFR AND NOT-CLDN1 | 0.888889 | 1 | 0.8 |
| ASTN1 AND EGFR AND NOT-ULBP2 | 0.888889 | 1 | 0.8 |
| ASTN1 AND EGFR AND NOT-STEAP1 | 0.888889 | 1 | 0.8 |
| CDH10 AND EGFR AND NOT-STEAP1 | 0.857143 | 0.923077 | 0.8 |
| COMPLEX-DLL3/ITGAV/SCN2A | 0.857143 | 0.923077 | 0.8 |
| OMG AND EGFR AND NOT-RAET1E | 0.857143 | 0.923077 | 0.8 |
| CDH10 AND EGFR AND NOT-RAET1E | 0.857143 | 0.923077 | 0.8 |
| SCN2A AND EGFR AND NOT-CD34 | 0.857143 | 0.923077 | 0.8 |
| SCN2A AND EGFR AND NOT-CLDN1 | 0.857143 | 0.923077 | 0.8 |
| COMPLEX-DLL3/KCNC1/VCAM1 | 0.857143 | 0.923077 | 0.8 |
| CDH10 AND EGFR AND NOT-CD34 | 0.857143 | 0.923077 | 0.8 |
| ASTN1 AND EGFR AND NOT-RAET1E | 0.846154 | 1 | 0.733333 |
| COMPLEX-DLL3/SCN2A/VCAM1 | 0.814815 | 0.916667 | 0.733333 |
| SCN2A AND EGFR AND NOT-IL13RA1 | 0.814815 | 0.916667 | 0.733333 |
| SCN2A AND EGFR AND NOT-PROM1 | 0.814815 | 0.916667 | 0.733333 |
| ST8SIA1 AND DISP2 AND MUC1 | 0.846154 | 1 | 0.733333 |
| SCN2A AND EGFR AND NOT-RAET1E | 0.857143 | 0.923077 | 0.8 |
| ASTN1 AND MUC1 AND CLDN5 | 0.866667 | 0.866667 | 0.866667 |
| GPR158 AND EGFR AND NOT-CD34 | 0.8 | 0.8 | 0.8 |
| OPCML AND EGFR AND NOT-CD34 | 0.8 | 0.8 | 0.8 |
| GPR158 AND EGFR AND NOT-RAET1E | 0.8 | 0.8 | 0.8 |
| SSX1 AND NOT-AOC3 AND CLDN5 | 0.8 | 0.8 | 0.8 |
| OPCML AND EGFR AND NOT-RAET1E | 0.8 | 0.8 | 0.8 |
| ASTN1 AND CSPG4 AND NOT-CLDN5 | 0.8 | 0.7 | 0.933333 |
| ASTN1 AND CSPG4 AND NOT-IL13RA1 | 0.8 | 0.7 | 0.933333 |
| ASTN1 AND CSPG4 AND NOT-ULBP2 | 0.8 | 0.7 | 0.933333 |
| DLL3 AND NOT-SCN2A AND CLDN5 | 0.8 | 1 | 0.666667 |
| ASTN1 AND CSPG4 AND NOT-RAET1E | 0.8 | 0.7 | 0.933333 |
| ASTN1 AND CA9 AND CLDN5 | 0.8 | 0.8 | 0.8 |
| ASTN1 AND NOT-ABCA5 AND VCAM1 | 0.814815 | 0.916667 | 0.733333 |
| ASTN1 AND CD33 AND CLDN5 | 0.8 | 0.7 | 0.933333 |
| ASTN1 AND NOT-EPCAM AND IL13RA1 | 0.83871 | 0.8125 | 0.866667 |
| ASTN1 AND TNC AND NOT-IL13RA1 | 0.827586 | 0.857143 | 0.8 |
| MEGF11 AND CD34 AND NOT-TRPM4 | 0.8 | 1 | 0.666667 |
| ASTN1 AND TNC AND RAET1E | 0.827586 | 0.857143 | 0.8 |
| ASTN1 AND MUC13 AND NOT-RAET1E | 0.8 | 1 | 0.666667 |
| SSX1 AND NOT-EPHA2 AND ITGAV | 0.827586 | 0.857143 | 0.8 |
| SCN2A AND SSX1 AND NOT-CLDN1 | 0.8 | 0.8 | 0.8 |
| ASTN1 AND PTK7 AND NOT-IL13RA1 | 0.8 | 1 | 0.666667 |
| ASTN1 AND PTK7 AND NOT-CLDN1 | 0.8 | 1 | 0.666667 |
| BEST3 AND STEAP2 AND NOT-TRPM4 | 0.83871 | 0.8125 | 0.866667 |

FIG. 15 (cont.)

| Antigen Pair Logic | F1 | Precision | Recall |
|---|---|---|---|
| NOT-TRPM4 AND APCDD1 AND DDX3X | 1 | 1 | 1 |
| TMEM231 AND NOT-STEAP1 AND VTCN1 | 1 | 1 | 1 |
| TMEM231 AND NOT-STEAP1 AND DDX3X | 1 | 1 | 1 |
| TMEM231 AND NOT-EPCAM AND TNFRSF17 | 1 | 1 | 1 |
| TMEM231 AND NOT-EPCAM AND SSTR3 | 1 | 1 | 1 |
| TMEM231 AND NOT-EPCAM AND FCRL2 | 1 | 1 | 1 |
| FZD3 AND NOT-ERBB4 AND NOT-BIRC5 | 1 | 1 | 1 |
| FZD3 AND NOT-ERBB4 AND CD70 | 1 | 1 | 1 |
| FZD3 AND NOT-ERBB4 AND NOT-MS4A1 | 1 | 1 | 1 |
| FZD3 AND NOT-ERBB4 AND PROM1 | 1 | 1 | 1 |
| FZD3 AND NOT-ERBB4 AND NOT-THY1 | 1 | 1 | 1 |
| FZD3 AND NOT-ERBB4 AND NOT-SSTR4 | 1 | 1 | 1 |
| FZD3 AND NOT-SST AND NOT-ERBB4 | 1 | 1 | 1 |
| Esophageal cancer | | | |
| SLC39A4 AND NOT-ST6GALNAC6 AND CDH3 | 0.833333 | 1 | 0.714286 |
| SLC39A4 AND NOT-ST6GALNAC6 AND LAMP3 | 0.833333 | 1 | 0.714286 |
| SLC39A4 AND NOT-ST6GALNAC6 AND F2RL2 | 0.88 | 1 | 0.785714 |
| SLC39A4 AND NOT-ST6GALNAC6 AND TACSTD2 | 0.814815 | 0.846154 | 0.785714 |
| SLC39A4 AND NOT-CDHR1 AND F2RL2 | 0.962963 | 1 | 0.928571 |
| SLC39A4 AND NOT-ST6GALNAC6 AND NOT-CYBRD1 | 0.814815 | 0.846154 | 0.785714 |
| SLC39A4 AND NOT-CDHR1 AND CDH3 | 0.923077 | 1 | 0.857143 |
| SLC39A4 AND NOT-CA12 AND GJB3 | 0.888889 | 0.923077 | 0.857143 |
| SLC39A4 AND NOT-ST6GALNAC6 AND TM4SF1 | 0.88 | 1 | 0.785714 |
| SLC39A4 AND NOT-TNFRSF25 AND F2RL2 | 0.8 | 0.909091 | 0.714286 |
| SLC39A4 AND NOT-ABCC11 AND TACSTD2 | 0.923077 | 1 | 0.857143 |
| SLC39A4 AND NOT-CA12 AND CDH3 | 0.857143 | 0.857143 | 0.857143 |
| SLC39A4 AND NOT-CA12 AND CDH3 | 0.857143 | 0.857143 | 0.857143 |
| SLC39A4 AND NOT-PTGDR2 AND F2RL2 | 0.8 | 0.909091 | 0.714286 |
| SLC39A4 AND TACSTD2 AND NOT-LIFR | 0.827586 | 0.8 | 0.857143 |
| SLC39A4 AND NOT-C1QTNF1 AND F2RL2 | 0.8 | 0.909091 | 0.714286 |
| SLC52A2 AND NOT-ST6GALNAC6 AND NOT-ACVR1B | 0.833333 | 1 | 0.714286 |
| SLC52A2 AND NOT-CD300LG AND TACSTD2 | 0.833333 | 1 | 0.714286 |
| SLC52A2 AND NOT-ST6GALNAC6 AND NOT-PLXNA2 | 0.833333 | 1 | 0.714286 |
| SLC52A2 AND NOT-ST6GALNAC6 AND FAM57A | 0.833333 | 1 | 0.714286 |
| SLC39A4 AND NOT-ABCC11 AND CDH3 | 0.88 | 1 | 0.785714 |
| SLC39A4 AND NOT-SGCA AND F2RL2 | 0.8 | 0.909091 | 0.714286 |
| SLC39A4 AND NOT-CDHR1 AND NOT-ATP10A | 0.83871 | 0.764706 | 0.928571 |
| SLC39A4 AND NOT-CA12 AND PTPRK | 0.833333 | 1 | 0.714286 |
| SLC39A4 AND NOT-MMP24 AND TACSTD2 | 0.846154 | 0.916667 | 0.785714 |
| CDH17 AND TACSTD2 AND NOT-CD300LG | 0.88 | 1 | 0.785714 |
| SLC39A4 AND NOT-ST6GALNAC6 AND NOT-SLC30A10 | 0.846154 | 0.916667 | 0.785714 |
| SLC39A4 AND CXCL16 AND NOT-DUOX1 | 0.8 | 0.909091 | 0.714286 |
| SLC39A4 AND NOT-CD1A AND CDH3 | 0.923077 | 1 | 0.857143 |
| SLC39A4 AND NOT-MMP24 AND CDH3 | 0.8 | 0.909091 | 0.714286 |
| SLC39A4 AND CXCL16 AND NOT-ATP10A | 0.8 | 0.909091 | 0.714286 |
| SLC39A4 AND CXCL16 AND NOT-PTH1R | 0.833333 | 1 | 0.714286 |
| SLC39A4 AND NOT-CNGA4 AND TACSTD2 | 0.833333 | 1 | 0.714286 |
| SLC39A4 AND NOT-ST6GALNAC6 AND NOT-CALHM1 | 0.833333 | 1 | 0.714286 |
| SLC39A4 AND CXCL16 AND NOT-WDR19 | 0.8 | 0.909091 | 0.714286 |
| SLC39A4 AND CXCL16 AND NOT-ADCY4 | 0.833333 | 1 | 0.714286 |
| SLC39A4 AND NOT-ATP8B2 AND OSMR | 0.833333 | 1 | 0.714286 |
| SLC39A4 AND NOT-CNGA4 AND F2RL2 | 0.833333 | 1 | 0.714286 |
| SLC39A4 AND NOT-MMP24 AND F2RL2 | 0.846154 | 0.916667 | 0.785714 |
| ST14 AND APOLD1 AND NOT-CD36 | 0.846154 | 0.916667 | 0.785714 |
| SLC39A4 AND NOT-ST6GALNAC6 AND NOT-KCNH4 | 0.814815 | 0.846154 | 0.785714 |
| SLC39A4 AND NOT-ATP8B2 AND F2RL2 | 0.866667 | 0.8125 | 0.928571 |
| SLC39A4 AND NOT-ATP8B2 AND F2RL2 | 0.866667 | 0.8125 | 0.928571 |
| SLC39A4 AND CXCL16 AND NOT-ST3GAL5 | 0.833333 | 1 | 0.714286 |
| SLC39A4 AND NOT-ATP8B2 AND TLR2 | 0.833333 | 1 | 0.714286 |
| SLC39A4 AND NOT-KCNH4 AND ANO1 | 0.833333 | 1 | 0.714286 |
| SLC39A4 AND LRRC8E AND NOT-ANO8 | 0.846154 | 0.916667 | 0.785714 |
| SLC39A4 AND CXCL16 AND NOT-GLDN | 0.833333 | 1 | 0.714286 |
| SLC39A4 AND NOT-ATP8B2 AND ABCC1 | 0.88 | 1 | 0.785714 |
| SLC39A4 AND NOT-CDHR1 AND NOT-ATP8B2 | 0.83871 | 0.764706 | 0.928571 |
| SLC39A4 AND NOT-CD1A AND F2RL2 | 0.962963 | 1 | 0.928571 |
| SLC39A4 AND NOT-GJB4 AND F2RL2 | 0.923077 | 1 | 0.857143 |
| SLC39A4 AND NOT-GJB4 AND F2RL2 | 0.923077 | 1 | 0.857143 |
| SLC39A4 AND NOT-CD1A AND TACSTD2 | 0.928571 | 0.928571 | 0.928571 |
| SLC39A4 AND CDH3 AND NOT-ATP8B2 | 0.857143 | 0.857143 | 0.857143 |
| SLC39A4 AND CDH3 AND NOT-ATP8B2 | 0.857143 | 0.857143 | 0.857143 |
| SLC39A4 AND NOT-GJB4 AND TACSTD2 | 0.888889 | 0.923077 | 0.857143 |
| SLC39A4 AND NOT-GJB4 AND TACSTD2 | 0.888889 | 0.923077 | 0.857143 |
| SLC39A4 AND NOT-CA12 AND VANGL1 | 0.833333 | 1 | 0.714286 |
| SLC39A4 AND NOT-ATP8B2 AND LDLRAD3 | 0.833333 | 1 | 0.714286 |
| SLC39A4 AND NOT-ST6GALNAC6 AND CLDN1 | 0.88 | 1 | 0.785714 |
| ST14 AND NOT-DUOXA1 AND CLDN1 | 0.962963 | 1 | 0.928571 |
| SLC39A4 AND NOT-ST6GALNAC6 AND SLC7A5 | 0.88 | 1 | 0.785714 |

| Antigen Pair Logic | F1 | Precision | Recall |
|---|---|---|---|
| ST8SIA1 AND DISP2 AND MUC13 | 0.83871 | 0.8125 | 0.866667 |
| SSX1 AND NOT-SCARA5 AND CLDN5 | 0.8 | 0.8 | 0.8 |
| ASTN1 AND MUC13 AND NOT-IL13RA1 | 0.888889 | 1 | 0.8 |
| NOT-AOC3 AND CLDN5 AND VTCN1 | 0.846154 | 1 | 0.733333 |
| COMPLEX-ITGAV/OMG/MUC13 | 0.896552 | 0.928571 | 0.866667 |
| NOT-AOC3 AND CLDN5 AND MUC13 | 0.827586 | 0.857143 | 0.8 |
| ASTN1 AND MUC13 AND NOT-ULBP2 | 0.888889 | 1 | 0.8 |
| SSX1 AND NOT-EPHA2 AND CLDN5 | 0.827586 | 0.857143 | 0.8 |
| ASTN1 AND RAET1E AND ST8SIA1 | 0.83871 | 0.8125 | 0.866667 |
| ASTN1 AND MUC13 AND NOT-CD34 | 0.888889 | 1 | 0.8 |
| COMPLEX-ITGAV/MUC13/GPR158 | 0.83871 | 0.8125 | 0.866667 |
| ASTN1 AND BEST3 AND NOT-SLC5A11 | 0.967742 | 0.9375 | 1 |
| ASTN1 AND BEST3 AND NOT-PTPRT | 0.967742 | 0.9375 | 1 |
| ASTN1 AND BEST3 AND NOT-SLC30A10 | 0.967742 | 0.9375 | 1 |
| ASTN1 AND BEST3 AND NOT-CNTNAP4 | 0.967742 | 0.9375 | 1 |
| ASTN1 AND BEST3 AND NOT-GYPC | 0.933333 | 0.933333 | 0.933333 |
| ASTN1 AND BEST3 AND NOT-ANTXR2 | 0.967742 | 0.9375 | 1 |
| ASTN1 AND BEST3 AND NOT-FMNL1 | 0.933333 | 0.933333 | 0.933333 |
| COMPLEX-NKAIN4/SLCO1B3/SCN2A | 0.888889 | 1 | 0.8 |
| COMPLEX-CDH10/NKAIN4/SLC39A8 | 0.888889 | 1 | 0.8 |
| OMG AND BEST3 AND NOT-SLC30A10 | 0.967742 | 0.9375 | 1 |
| OPCML AND BEST3 AND NOT-CD1B | 0.882353 | 0.789474 | 1 |
| CDH10 AND BEST3 AND NOT-SLC30A10 | 0.9375 | 0.882353 | 1 |
| GPR158 AND BEST3 AND NOT-SLC39A8 | 0.9375 | 0.882353 | 1 |
| OPCML AND BEST3 AND NOT-SLC39A8 | 0.909091 | 0.833333 | 1 |
| ASTN1 AND F2R AND NOT-CD163 | 0.888889 | 1 | 0.8 |
| BEST3 AND SCN2A AND NOT-SLC5A10 | 0.967742 | 0.9375 | 1 |
| OMG AND BEST3 AND NOT-SLCO1B3 | 0.857143 | 0.923077 | 0.8 |
| COMPLEX-NKAIN4/SLCO1B3/KCNC1 | 0.846154 | 1 | 0.733333 |
| ASTN1 AND F2R AND NOT-ANTXR2 | 0.846154 | 1 | 0.733333 |
| COMPLEX-NKAIN4/CD93/KCNC1 | 0.846154 | 1 | 0.733333 |
| ASTN1 AND F2R AND NOT-GYPC | 0.846154 | 1 | 0.733333 |
| COMPLEX-ANTXR2/NKAIN4/SCN2A | 0.846154 | 1 | 0.733333 |
| COMPLEX-NKAIN4/ATP2B2/DISP2 | 0.846154 | 1 | 0.733333 |
| ASTN1 AND F2R AND SLC30A10 | 0.846154 | 1 | 0.733333 |
| ASTN1 AND TNFRSF10B AND NOT-GYPC | 0.888889 | 1 | 0.8 |
| OMG AND TNFRSF10B AND NOT-SLC30A10 | 0.83871 | 0.8125 | 0.866667 |
| OMG AND TNFRSF10B AND SLCO1B3 | 0.866667 | 0.866667 | 0.866667 |
| OMG AND TNFRSF10B AND CD1B | 0.83871 | 0.8125 | 0.866667 |
| COMPLEX-SEZ6/KCNQ2/SLC30A1 | 0.888889 | 1 | 0.8 |
| ASTN1 AND TNFRSF10B AND NOT-ANTXR2 | 0.928571 | 1 | 0.866667 |
| COMPLEX-SEZ6/KCNQ2/TNFRSF10B | 0.928571 | 1 | 0.866667 |
| ASTN1 AND F2R AND LRRTM4 | 0.888889 | 1 | 0.8 |
| CDH10 AND F2R AND SLC30A10 | 0.888889 | 1 | 0.8 |
| BEST3 AND DISP2 AND NOT-SLC13A2 | 0.827586 | 0.857143 | 0.8 |
| OPCML AND BEST3 AND NOT-SLCO1B3 | 0.827586 | 0.857143 | 0.8 |
| ASTN1 AND F2R AND PTPRT | 0.888889 | 1 | 0.8 |
| COMPLEX-SEMA4B/SEZ6/KCNQ2 | 0.928571 | 1 | 0.866667 |
| COMPLEX-SEZ6/KCNQ2/GPR37L1 | 0.823529 | 0.736842 | 0.933333 |
| COMPLEX-SEZ6/BEST3/KCNQ2 | 0.9375 | 0.882353 | 1 |
| OPCML AND F2R AND NOT-SLC39A8 | 0.888889 | 1 | 0.8 |
| ASTN1 AND TNFRSF10B AND NOT-CD163 | 0.928571 | 1 | 0.866667 |
| CDH10 AND TNFRSF10B AND SLC30A10 | 0.928571 | 1 | 0.866667 |
| ASTN1 AND CXCL16 AND NOT-GYPC | 0.83871 | 0.8125 | 0.866667 |
| ASTN1 AND GJD2 AND NOT-PTPRT | 0.888889 | 1 | 0.8 |
| ASTN1 AND TNFRSF10B AND PTPRT | 0.928571 | 1 | 0.866667 |
| ASTN1 AND NOT-SLC12A5 AND SLCO1B3 | 0.814815 | 0.916667 | 0.733333 |
| DTNA AND NOT-SLC5A11 AND ASTN1 | 0.896552 | 0.928571 | 0.866667 |
| ASTN1 AND TNFRSF10B AND NOT-SLC31A1 | 0.846154 | 1 | 0.733333 |
| ASTN1 AND TNFRSF10B AND NOT-SLC30A10 | 0.928571 | 1 | 0.866667 |
| ASTN1 AND TNFRSF10B AND LRRTM4 | 0.928571 | 1 | 0.866667 |
| CDH10 AND NOT-DGKE AND SLCO1B3 | 0.814815 | 0.916667 | 0.733333 |
| COMPLEX-SEZ6/F2R/KCNQ2 | 0.928571 | 1 | 0.866667 |
| ASTN1 AND CXCL16 AND NOT-CNTNAP4 | 0.875 | 0.823529 | 0.933333 |
| ASTN1 AND GJD2 AND NOT-SLC30A10 | 0.888889 | 1 | 0.8 |
| ASTN1 AND F2R AND SLCO1B3 | 0.888889 | 1 | 0.8 |
| OMG AND CD1B AND PPAPDC1B | 0.857143 | 0.923077 | 0.8 |
| ASTN1 AND CXCL16 AND PTPRT | 0.875 | 0.823529 | 0.933333 |
| ASTN1 AND TNFRSF10B AND SLCO1B3 | 0.928571 | 1 | 0.866667 |
| COMPLEX-SEZ6/KCNQ2/P2RX4 | 0.810811 | 0.681818 | 1 |
| ASTN1 AND TSHR AND NOT-SLC30A10 | 0.8 | 0.8 | 0.8 |
| OPCML AND F2R AND NOT-CD1B | 0.8 | 0.8 | 0.8 |
| BEST3 AND SLC24A2 AND NOT-SLCO1B3 | 0.8 | 0.8 | 0.8 |
| ASTN1 AND TSHR AND NOT-PTPRT | 0.8 | 0.8 | 0.8 |
| COMPLEX-NKAIN4/CD93/SCN2A | 0.8 | 1 | 0.666667 |
| ASTN1 AND TSHR AND NOT-SLCO1B3 | 0.8 | 0.8 | 0.8 |
| CDH10 AND NOT-ATP8A2 AND SLCO1B3 | 0.8 | 1 | 0.666667 |

FIG. 15 (cont.)

| Antigen Pair Logic | F1 | Precision | Recall |
|---|---|---|---|
| SLC39A4 AND CLDN1 AND NOT-GPR146 | 0.857143 | 0.857143 | 0.857143 |
| ST14 AND NOT-DUOX1 AND CLDN1 | 0.962963 | 1 | 0.928571 |
| SLC39A4 AND CLDN1 AND NOT-FGFR1 | 0.888889 | 0.923077 | 0.857143 |
| PTPRK AND NOT-WDR19 AND CLDN1 | 0.833333 | 1 | 0.714286 |
| SLC39A4 AND NOT-GPR146 AND SLC7A5 | 0.846154 | 0.916667 | 0.785714 |
| SLC39A4 AND NOT-CA12 AND TPBG | 0.814815 | 0.846154 | 0.785714 |
| SLC39A4 AND SLC7A5 AND NOT-ANO8 | 0.928571 | 0.928571 | 0.928571 |
| SLC39A4 AND SLC7A5 AND NOT-ANO8 | 0.928571 | 0.928571 | 0.928571 |
| SLC39A4 AND CLDN1 AND NOT-ADCY4 | 0.827586 | 0.8 | 0.857143 |
| SLC39A4 AND CLDN1 AND NOT-ADCY4 | 0.827586 | 0.8 | 0.857143 |
| SLC39A4 AND NOT-ST6GALNAC6 AND NOT-ABCA5 | 0.814815 | 0.846154 | 0.785714 |
| SLC39A4 AND NOT-IL11RA AND F2RL2 | 0.866667 | 0.8125 | 0.928571 |
| SLC39A4 AND NOT-IL11RA AND F2RL2 | 0.866667 | 0.8125 | 0.928571 |
| EPCAM AND NOT-ABHD6 AND ST14 | 0.8 | 0.909091 | 0.714286 |
| EPCAM AND NOT-ABHD6 AND GJB2 | 0.8 | 0.909091 | 0.714286 |
| SLC39A4 AND CLDN1 AND NOT-CADM1 | 0.833333 | 1 | 0.714286 |
| SLC39A4 AND NOT-ADCY9 AND CLDN1 | 0.846154 | 0.916667 | 0.785714 |
| SLC39A4 AND CLDN1 AND NOT-TGFB3 | 0.814815 | 0.846154 | 0.785714 |
| SLC39A4 AND CLDN1 AND NOT-PTH1R | 0.846154 | 0.916667 | 0.785714 |
| SLC39A4 AND NOT-CDHR1 AND NOT-IL11RA | 0.866667 | 0.8125 | 0.928571 |
| SLC39A4 AND NOT-SCTR AND CLDN1 | 0.833333 | 1 | 0.714286 |
| SLC39A4 AND CXCL16 AND NOT-ATP8B2 | 0.833333 | 1 | 0.714286 |
| SLC39A4 AND NOT-CNGA4 AND NOT-SLC30A10 | 0.8 | 0.909091 | 0.714286 |
| SLC39A4 AND NOT-CNGA4 AND SLC6A6 | 0.833333 | 1 | 0.714286 |
| SLC39A4 AND NOT-MMP24 AND SLC6A6 | 0.846154 | 0.916667 | 0.785714 |
| SLC39A4 AND NOT-KCNH4 AND LRRC8E | 0.857143 | 0.857143 | 0.857143 |
| SLC39A4 AND NOT-SLC30A10 AND CDH17 | 0.857143 | 0.857143 | 0.857143 |
| SLC39A4 AND NOT-CD1A AND NOT-SLC30A10 | 0.866667 | 0.8125 | 0.928571 |
| SLC39A4 AND NOT-CD1A AND SLC6A6 | 0.928571 | 0.928571 | 0.928571 |
| SLC39A4 AND NOT-GJB4 AND LRRC8E | 0.88 | 1 | 0.785714 |
| SLC39A4 AND CXCL16 AND NOT-SHISA9 | 0.833333 | 1 | 0.714286 |
| SLC39A4 AND CXCL16 AND NOT-CHRNG | 0.8 | 0.909091 | 0.714286 |
| SLC39A4 AND NOT-KCNK4 AND SLC6A6 | 0.814815 | 0.846154 | 0.785714 |
| SLC39A4 AND CXCL16 AND FUT3 | 0.833333 | 1 | 0.714286 |
| SLC39A4 AND NOT-CXCL16 AND NOT-GPR22 | 0.8 | 0.909091 | 0.714286 |
| SLC39A4 AND NOT-MMP24 AND SLC7A5 | 0.846154 | 0.916667 | 0.785714 |
| SLC39A4 AND NOT-STAB1 AND CLDN1 | 0.8 | 0.909091 | 0.714286 |
| SLC39A4 AND NOT-MMP24 AND CLDN1 | 0.88 | 1 | 0.785714 |
| SLC39A4 AND CXCL16 AND NOT-IL11RA | 0.8 | 0.909091 | 0.714286 |
| SLC39A4 AND NOT-CD1A AND CLDN1 | 0.923077 | 1 | 0.857143 |
| CDH17 AND CLDN1 AND NOT-CD300LG | 0.88 | 1 | 0.785714 |
| SLC39A4 AND NOT-ATP8B2 AND CLDN1 | 0.923077 | 1 | 0.857143 |
| SLC39A4 AND NOT-ATP8B2 AND CLDN1 | 0.923077 | 1 | 0.857143 |
| SLC39A4 AND NOT-MMP24 AND NOT-GPA33 | 0.8 | 0.909091 | 0.714286 |
| SLC39A4 AND CLDN1 AND NOT-FXYD6 | 0.888889 | 0.923077 | 0.857143 |
| SLC39A4 AND NOT-ATP8B2 AND SLC7A5 | 0.928571 | 0.928571 | 0.928571 |
| SLC39A4 AND NOT-ATP8B2 AND SLC7A5 | 0.928571 | 0.928571 | 0.928571 |
| SLC39A4 AND NOT-CNGA4 AND SLC7A5 | 0.8 | 0.909091 | 0.714286 |
| SLC39A4 AND NOT-ATP8B2 AND SPON2 | 0.866667 | 0.8125 | 0.928571 |
| CDH17 AND CLDN1 AND NOT-WDR19 | 0.962963 | 1 | 0.928571 |
| SLC39A4 AND NOT-CNGA4 AND NOT-GPA33 | 0.833333 | 1 | 0.714286 |
| SLC39A4 AND NOT-GPA33 AND CDH17 | 0.88 | 1 | 0.785714 |
| SLC39A4 AND NOT-CD1A AND SLC7A5 | 0.962963 | 1 | 0.928571 |
| SLC39A4 AND CXCL16 AND EPCAM | 0.833333 | 1 | 0.714286 |
| EPCAM AND NOT-SLC22A5 AND GJB2 | 0.88 | 1 | 0.785714 |
| SLC39A4 AND NOT-SEZ6 AND SLC7A5 | 0.8 | 0.909091 | 0.714286 |
| CDH17 AND CLDN1 AND NOT-GPR1 | 0.923077 | 1 | 0.857143 |
| SLC39A4 AND NOT-KCNH4 AND CLDN1 | 0.923077 | 1 | 0.857143 |
| CDH17 AND CLDN1 AND NOT-CDON | 0.962963 | 1 | 0.928571 |
| SLC39A4 AND SLC7A5 AND NOT-FXYD6 | 0.896552 | 0.866667 | 0.928571 |
| EPCAM AND NOT-SLC22A5 AND SEMA4B | 0.814815 | 0.846154 | 0.785714 |
| COMPLEX-PROCR/CD82/EPCAM | 0.833333 | 1 | 0.714286 |
| EPCAM AND SLC7A5 AND NOT-FXYD6 | 0.8125 | 0.722222 | 0.928571 |
| EPCAM AND SLC7A5 AND NOT-SHISA9 | 0.896552 | 0.866667 | 0.928571 |
| EPCAM AND SLC7A5 AND FUT3 | 0.928571 | 0.928571 | 0.928571 |
| EPCAM AND SDC1 AND NOT-FXYD6 | 0.88 | 1 | 0.785714 |
| EPCAM AND SDC1 AND NOT-AOC3 | 0.833333 | 1 | 0.714286 |
| EPCAM AND SLC7A5 AND SMPD2 | 0.833333 | 1 | 0.714286 |
| EPCAM AND SDC1 AND NOT-SHISA9 | 0.88 | 1 | 0.785714 |
| EPCAM AND SDC1 AND FUT3 | 0.88 | 1 | 0.785714 |
| COMPLEX-PROCR/EPCAM/SDC1 | 0.923077 | 1 | 0.857143 |
| EPCAM AND SDC1 AND SEMA4B | 0.833333 | 1 | 0.714286 |
| EPCAM AND THY1 AND SMPD2 | 0.8 | 0.909091 | 0.714286 |
| EPCAM AND PROCR AND CLDN1 | 0.962963 | 1 | 0.928571 |
| EPCAM AND CLDN1 AND FUT3 | 0.923077 | 1 | 0.857143 |
| EPCAM AND F2R AND NOT-IL11RA | 0.8125 | 0.722222 | 0.928571 |
| EPCAM AND SLC7A5 AND NOT-FGFR1 | 0.896552 | 0.866667 | 0.928571 |

| Antigen Pair Logic | F1 | Precision | Recall |
|---|---|---|---|
| ASTN1 AND F2R AND NOT-SLC31A1 | 0.8 | 1 | 0.666667 |
| COMPLEX-SEZ6/KCNQ2/CXCL16 | 0.8 | 0.7 | 0.933333 |
| SEZ6 AND SLC30A1 AND NOT-GHR | 0.8 | 1 | 0.666667 |
| ASTN1 AND CXCL16 AND NOT-SLC5A11 | 0.903226 | 0.875 | 0.933333 |
| CDH10 AND NOT-CACNA1B AND SLCO1B3 | 0.8 | 1 | 0.666667 |
| CDH10 AND NOT-KIAA0319 AND SLCO1B3 | 0.8 | 1 | 0.666667 |
| COMPLEX-NKAIN4/SLCO1B3/ASTN1 | 0.8 | 1 | 0.666667 |
| ASTN1 AND F2R AND CNTNAP4 | 0.846154 | 1 | 0.733333 |
| ASTN1 AND TSHR AND NOT-ANTXR2 | 0.8 | 0.8 | 0.8 |
| ASTN1 AND CXCL16 AND LRRTM4 | 0.875 | 0.823529 | 0.933333 |
| COMPLEX-NKAIN4/CD93/DISP2 | 0.8 | 1 | 0.666667 |
| COMPLEX-NKAIN4/SLCO1B3/OPCML | 0.8 | 1 | 0.666667 |
| ASTN1 AND CXCL16 AND NOT-CD163 | 0.875 | 0.823529 | 0.933333 |
| ASTN1 AND SCN10A AND NOT-CD163 | 0.827586 | 0.857143 | 0.8 |
| IGDCC3 AND ASTN1 AND NOT-PTPRT | 0.965517 | 1 | 0.933333 |
| ASTN1 AND GID2 AND NOT-SLC31A1 | 0.888889 | 1 | 0.8 |
| CDH10 AND SLCO1B3 AND NOT-PTPRT | 0.846154 | 1 | 0.733333 |
| ASTN1 AND BEST2 AND NOT-SLC30A10 | 0.8 | 0.7 | 0.933333 |
| ASTN1 AND BEST2 AND NOT-PTPRT | 0.8 | 0.7 | 0.933333 |
| COMPLEX-BTN3A3/SEZ6/KCNQ2 | 0.965517 | 1 | 0.933333 |
| ASTN1 AND TNFRSF10B AND NOT-CNTNAP4 | 0.928571 | 1 | 0.866667 |
| ASTN1 AND TNFRSF10B AND NOT-SLC5A11 | 0.928571 | 1 | 0.866667 |
| COMPLEX-SEZ6/CACNG4/KCNQ2 | 0.848485 | 0.777778 | 0.933333 |
| ASTN1 AND CDH11 AND NOT-CNTNAP4 | 0.8 | 0.8 | 0.8 |
| DISP2 AND NOT-PTGER4 AND SEMA4B | 0.8 | 0.8 | 0.8 |
| ASTN1 AND SLC22A11 AND NOT-SLC30A10 | 0.827586 | 0.857143 | 0.8 |
| DLL3 AND NOT-TRPM4 AND SLAMF7 | 0.846154 | 1 | 0.733333 |
| SSX1 AND NOT-CLDN1 AND CLDN5 | 0.827586 | 0.857143 | 0.8 |
| ST8SIA1 AND NOT-EPCAM AND CLDN5 | 0.827586 | 0.857143 | 0.8 |
| ST8SIA1 AND NOT-IL20RA AND CLDN5 | 0.83871 | 0.8125 | 0.866667 |
| ST8SIA1 AND CLDN5 AND NOT-MST1R | 0.83871 | 0.8125 | 0.866667 |
| ST8SIA1 AND NOT-TRPM4 AND CD34 | 0.83871 | 0.8125 | 0.866667 |
| ST8SIA1 AND CLDN5 AND NOT-PMEL | 0.83871 | 0.8125 | 0.866667 |
| ST8SIA1 AND CLDN5 AND NOT-ITGB6 | 0.83871 | 0.8125 | 0.866667 |
| ST8SIA1 AND CLDN5 AND NOT-PROM1 | 0.8 | 0.8 | 0.8 |
| ST8SIA1 AND NOT-TRPM4 AND NOT-SLAMF7 | 0.83871 | 0.8125 | 0.866667 |
| Ovarian Cancer | | | |
| KCNK15 AND NOT-BMP2 AND NOT-FPR1 | 1 | 1 | 1 |
| KCNK15 AND NOT-BMP2 AND NOT-KCNQ4 | 1 | 1 | 1 |
| KCNK15 AND NOT-BMP2 AND NOT-FPR1 | 1 | 1 | 1 |
| KCNK15 AND NOT-BMP2 AND NOT-KCNQ4 | 1 | 1 | 1 |
| KCNK15 AND NOT-BMP2 AND NOT-ITM2A | 1 | 1 | 1 |
| KCNK15 AND NOT-BMP2 AND NOT-PTH1R | 1 | 1 | 1 |
| KCNK15 AND NOT-BMP2 AND NOT-TNFSF12 | 1 | 1 | 1 |
| KCNK15 AND NOT-BMP2 AND ADRA1B | 1 | 1 | 1 |
| KCNK15 AND NOT-BMP2 AND NOT-PDGFRB | 1 | 1 | 1 |
| KCNK15 AND NOT-BMP2 AND NOT-ITGA5 | 1 | 1 | 1 |
| KCNK15 AND NOT-BMP2 AND NOT-PDGFRB | 1 | 1 | 1 |
| KCNK15 AND NOT-BMP2 AND NOT-ITGA5 | 1 | 1 | 1 |
| KCNK15 AND NOT-BMP2 AND SLC51B | 1 | 1 | 1 |
| KCNK15 AND NOT-BMP2 AND GJD4 | 1 | 1 | 1 |
| KCNK15 AND NOT-BMP2 AND NOT-FGFR4 | 0.96 | 0.923077 | 1 |
| KCNK15 AND NOT-BMP2 AND NOT-LRPAP1 | 0.96 | 0.923077 | 1 |
| KCNK15 AND NOT-BMP2 AND NOT-IL7R | 0.96 | 0.923077 | 1 |
| KCNK15 AND NOT-BMP2 AND NOT-HMOX2 | 0.96 | 0.923077 | 1 |
| KCNK15 AND NOT-BMP2 AND NOT-PNPLA2 | 0.96 | 0.923077 | 1 |
| KCNK15 AND NOT-BMP2 AND NOT-ICAM3 | 0.96 | 0.923077 | 1 |
| KCNK15 AND NOT-BMP2 AND NOT-ANO9 | 0.96 | 0.923077 | 1 |
| KCNK15 AND NOT-BMP2 AND DPP6 | 0.96 | 0.923077 | 1 |
| KCNK15 AND NOT-BMP2 AND NOT-ADRB2 | 0.96 | 0.923077 | 1 |
| KCNK15 AND NOT-BMP2 AND NOT-CXCR2 | 0.96 | 0.923077 | 1 |
| KCNK15 AND NOT-BMP2 AND NOT-CPT1C | 0.96 | 0.923077 | 1 |
| KCNK15 AND NOT-BMP2 AND NOT-MFSD10 | 0.96 | 0.923077 | 1 |
| KCNK15 AND NOT-BMP2 AND SLC17A4 | 0.96 | 0.923077 | 1 |
| KCNK15 AND NOT-BMP2 AND NOT-STOM | 0.96 | 0.923077 | 1 |
| KCNK15 AND NOT-DSC3 AND NOT-ADRB2 | 0.96 | 0.923077 | 1 |
| KCNK15 AND NOT-BMP2 AND NOT-STX8 | 0.96 | 0.923077 | 1 |
| KCNK15 AND NOT-BMP2 AND SCTR | 0.96 | 0.923077 | 1 |
| KCNK15 AND NOT-BMP2 AND NOT-CSF3R | 0.96 | 0.923077 | 1 |
| KCNK15 AND NOT-BMP2 AND NOT-CYP4F12 | 0.96 | 0.923077 | 1 |
| KCNK15 AND NOT-BMP2 AND NOT-CCR1 | 0.96 | 0.923077 | 1 |
| KCNK15 AND NOT-BMP2 AND NOT-FNDC4 | 0.96 | 0.923077 | 1 |
| KCNK15 AND NOT-BMP2 AND NOT-SLC1A4 | 0.96 | 0.923077 | 1 |
| KCNK15 AND NOT-BMP2 AND NOT-TGOLN2 | 0.96 | 0.923077 | 1 |
| KCNK15 AND NOT-BMP2 AND NOT-TNFRSF1B | 0.96 | 0.923077 | 1 |
| KCNK15 AND NOT-BMP2 AND NOT-TMED10 | 0.96 | 0.923077 | 1 |
| KCNK15 AND NOT-BMP2 AND NOT-CDHR3 | 0.96 | 0.923077 | 1 |

FIG. 15 (cont.)

| Antigen Pair Logic | F1 | Precision | Recall |
|---|---|---|---|
| EPCAM AND SLC7A5 AND NOT-CD300LG | 0.827586 | 0.8 | 0.857143 |
| EPCAM AND SLC7A5 AND NOT-ATP10A | 0.8125 | 0.722222 | 0.928571 |
| EPCAM AND SLC7A5 AND GJB2 | 0.962963 | 1 | 0.928571 |
| SLC39A4 AND NOT-IL11RA AND CLDN1 | 0.888889 | 0.923077 | 0.857143 |
| SLC39A4 AND NOT-IL11RA AND CLDN1 | 0.888889 | 0.923077 | 0.857143 |
| EPCAM AND SLC7A5 AND NOT-SLC15A2 | 0.83871 | 0.764706 | 0.928571 |
| SLC39A4 AND NOT-ABCA5 AND CLDN1 | 0.846154 | 0.916667 | 0.785714 |
| SLC39A4 AND NOT-ABCA5 AND CLDN1 | 0.846154 | 0.916667 | 0.785714 |
| EPCAM AND SLC7A5 AND NOT-WDR19 | 0.896552 | 0.866667 | 0.928571 |
| EPCAM AND SLC7A5 AND PPAP2C | 0.923077 | 1 | 0.857143 |
| EPCAM AND SLC7A5 AND NOT-MARVELD1 | 0.827586 | 0.8 | 0.857143 |
| SLC39A4 AND SLC7A5 AND EPCAM | 0.928571 | 0.928571 | 0.928571 |
| SLC39A4 AND SLC7A5 AND EPCAM | 0.928571 | 0.928571 | 0.928571 |
| SLC39A4 AND CLDN1 AND EPCAM | 0.827586 | 0.8 | 0.857143 |
| EPCAM AND SLC7A5 AND ACVR1C | 0.857143 | 0.857143 | 0.857143 |
| EPCAM AND SLC7A5 AND ATP1B1 | 0.827586 | 0.8 | 0.857143 |
| EPCAM AND SLC7A5 AND LGR4 | 0.8125 | 0.722222 | 0.928571 |
| SLC39A4 AND NOT-ABCA5 AND SLC7A5 | 0.857143 | 0.857143 | 0.857143 |
| SLC39A4 AND NOT-ABCA5 AND SLC7A5 | 0.857143 | 0.857143 | 0.857143 |
| SLC39A4 AND NOT-IL11RA AND SPON2 | 0.83871 | 0.764706 | 0.928571 |
| EPCAM AND GJB2 AND CLDN1 | 0.962963 | 1 | 0.928571 |
| SLC39A4 AND NOT-IL11RA AND SLC7A5 | 0.928571 | 0.928571 | 0.928571 |
| SLC39A4 AND NOT-IL11RA AND SLC7A5 | 0.928571 | 0.928571 | 0.928571 |
| EPCAM AND SLC7A5 AND ST14 | 0.866667 | 0.8125 | 0.928571 |
| MUC13 AND CLDN1 AND NOT-WDR19 | 0.928571 | 0.928571 | 0.928571 |
| EPCAM AND SLC7A5 AND NOT-BMP2 | 0.8125 | 0.722222 | 0.928571 |
| EPCAM AND SLC7A5 AND NOT-SLC13A4 | 0.928571 | 0.928571 | 0.928571 |
| EPCAM AND SLC7A5 AND NOT-GRIN3B | 0.814815 | 0.846154 | 0.785714 |
| EPCAM AND SLC7A5 AND NOT-GRIK2 | 0.896552 | 0.866667 | 0.928571 |
| SLC39A4 AND NOT-GPA33 AND MUC13 | 0.88 | 1 | 0.785714 |
| EPCAM AND SLC7A5 AND GPR35 | 0.866667 | 0.8125 | 0.928571 |
| EPCAM AND SLC7A5 AND NOT-IL11RA | 0.83871 | 0.764706 | 0.928571 |
| EPCAM AND SLC7A5 AND NOT-FOLR1 | 0.962963 | 1 | 0.928571 |
| EPCAM AND SLC7A5 AND NOT-SLC34A2 | 0.8125 | 0.722222 | 0.928571 |
| EPCAM AND SLC7A5 AND NOT-GPNMB | 0.827586 | 0.8 | 0.857143 |
| EPCAM AND SDC1 AND NOT-IL11RA | 0.88 | 1 | 0.785714 |
| EPCAM AND THY1 AND NOT-IL11RA | 0.846154 | 0.916667 | 0.785714 |
| EPCAM AND SDC1 AND NOT-FOLR1 | 0.88 | 1 | 0.785714 |
| EPCAM AND SDC1 AND NOT-BMPR1B | 0.88 | 1 | 0.785714 |
| EPCAM AND SDC1 AND NOT-SLC34A2 | 0.88 | 1 | 0.785714 |
| EPCAM AND THY1 AND NOT-FOLR1 | 0.866667 | 0.8125 | 0.928571 |
| EPCAM AND NOT-FOLR1 AND CLDN1 | 0.962963 | 1 | 0.928571 |
| EPCAM AND NOT-SLC34A2 AND CLDN1 | 0.962963 | 1 | 0.928571 |
| EPCAM AND NOT-FOLR1 AND SPON2 | 0.83871 | 0.764706 | 0.928571 |
| EPCAM AND CLDN1 AND NOT-BMPR1B | 0.896552 | 0.866667 | 0.928571 |
| Glioblastoma | | | |
| NLGN4X AND LAPTM5 AND NOT-PTPRM | 0.903226 | 1 | 0.823529 |
| GPM6A AND LAPTM5 AND P2RY1 | 0.914286 | 0.888889 | 0.941176 |
| NRCAM AND NOT-PTPRM AND LAPTM5 | 0.9375 | 1 | 0.882353 |
| PTPRZ1 AND SIRPG AND SYT11 | 0.9375 | 1 | 0.882353 |
| GPM6B AND LAPTM5 AND RHCG | 0.969697 | 1 | 0.941176 |
| GPM6A AND LAPTM5 AND RHCG | 0.969697 | 1 | 0.941176 |
| NRCAM AND NOT-PTPRM AND BTN3A3 | 0.882353 | 0.882353 | 0.882353 |
| NLGN4X AND LAPTM5 AND NOT-YIPF3 | 0.903226 | 1 | 0.823529 |
| NLGN4X AND LAPTM5 AND NOT-ZDHHC5 | 0.903226 | 1 | 0.823529 |
| PTPRZ1 AND LAPTM5 AND NOT-YIPF3 | 0.9375 | 1 | 0.882353 |
| PTPRZ1 AND NOT-STX8 AND BST2 | 0.875 | 0.933333 | 0.823529 |
| PTPRZ1 AND NOT-STX8 AND ATP7A | 0.903226 | 1 | 0.823529 |
| NRCAM AND NOT-PTPRM AND PPAPDC1B | 0.903226 | 1 | 0.823529 |
| GPM6A AND SLC2A10 AND NOT-FLVCR1 | 0.903226 | 1 | 0.823529 |
| PTPRZ1 AND LAPTM5 AND NOT-SDC2 | 0.903226 | 1 | 0.823529 |
| PTPRZ1 AND LAPTM5 AND NOT-ZDHHC5 | 0.9375 | 1 | 0.882353 |
| GPM6B AND LAPTM5 AND NOT-APLP1 | 0.969697 | 1 | 0.941176 |
| GRIA3 AND KCNK15 AND CDH11 | 0.882353 | 0.882353 | 0.882353 |
| GPM6B AND F2R AND NOT-TSPAN14 | 0.866667 | 1 | 0.764706 |
| GPM6B AND F2R AND CD81 | 0.866667 | 1 | 0.764706 |
| GPM6B AND F2R AND OR1A1 | 0.866667 | 1 | 0.764706 |
| GPM6B AND F2R AND NOT-CDHR2 | 0.866667 | 1 | 0.764706 |
| GPM6B AND F2R AND NOT-TMEM127 | 0.866667 | 1 | 0.764706 |
| GPM6B AND F2R AND NOT-KCNMB2 | 0.866667 | 1 | 0.764706 |
| GPM6B AND F2R AND NOT-SLC44A3 | 0.866667 | 1 | 0.764706 |
| COMPLEX-F2R/GPM6B/KITLG | 0.866667 | 1 | 0.764706 |
| GPM6B AND F2R AND NOT-CNNM2 | 0.866667 | 1 | 0.764706 |
| GPM6B AND F2R AND C3AR1 | 0.866667 | 1 | 0.764706 |
| GPM6B AND F2R AND NOT-SLC12A6 | 0.866667 | 1 | 0.764706 |
| GPM6B AND F2R AND NOT-HMOX2 | 0.866667 | 1 | 0.764706 |
| GPM6B AND F2R AND NOT-GDE1 | 0.866667 | 1 | 0.764706 |

| Antigen Pair Logic | F1 | Precision | Recall |
|---|---|---|---|
| KCNK15 AND NOT-BMP2 AND NOT-CD8B | 0.96 | 0.923077 | 1 |
| KCNK15 AND NOT-BMP2 AND NOT-PIEZO1 | 0.96 | 0.923077 | 1 |
| COMPLEX-PCDHB3/KCNK15/BMP2 | 0.96 | 0.923077 | 1 |
| KCNK15 AND NOT-BMP2 AND NOT-AQP4 | 0.96 | 0.923077 | 1 |
| KCNK15 AND NOT-BMP2 AND SCTR | 0.96 | 0.923077 | 1 |
| KCNK15 AND NOT-BMP2 AND NOT-PTPRCAP | 0.96 | 0.923077 | 1 |
| KCNK15 AND NOT-BMP2 AND NOT-ATP2C2 | 0.96 | 0.923077 | 1 |
| KCNK15 AND NOT-BMP2 AND NOT-ATP2C2 | 0.96 | 0.923077 | 1 |
| KCNK15 AND NOT-BMP2 AND MARCH1 | 0.96 | 0.923077 | 1 |
| KCNK15 AND NOT-BMP2 AND NOT-SLC39A4 | 0.96 | 0.923077 | 1 |
| COMPLEX-PTH2R/KCNK15/BMP2 | 0.96 | 0.923077 | 1 |
| KCNK15 AND NOT-BMP2 AND NOT-POPDC2 | 0.96 | 0.923077 | 1 |
| KCNK15 AND NOT-BMP2 AND NOT-CAV1 | 0.96 | 0.923077 | 1 |
| KCNK15 AND NOT-BMP2 AND NOT-RHOT2 | 0.96 | 0.923077 | 1 |
| KCNK15 AND NOT-BMP2 AND NOT-TCIRG1 | 0.96 | 0.923077 | 1 |
| KCNK15 AND NOT-BMP2 AND NOT-SLC23A1 | 0.96 | 0.923077 | 1 |
| KCNK15 AND NOT-BMP2 AND NOT-LILRB3 | 0.96 | 0.923077 | 1 |
| KCNK15 AND NOT-BMP2 AND NOT-CSF3R | 0.96 | 0.923077 | 1 |
| KCNK15 AND NOT-BMP2 AND TNFRSF25 | 0.96 | 0.923077 | 1 |
| KCNK15 AND NOT-BMP2 AND NOT-NUCB2 | 0.96 | 0.923077 | 1 |
| KCNK15 AND NOT-BMP2 AND NOT-C10orf54 | 0.96 | 0.923077 | 1 |
| KCNK15 AND NOT-BMP2 AND NOT-SELPLG | 0.96 | 0.923077 | 1 |
| KCNK15 AND NOT-BMP2 AND NOT-ABCA3 | 0.96 | 0.923077 | 1 |
| KCNK15 AND NOT-BMP2 AND NOT-CDHR3 | 0.96 | 0.923077 | 1 |
| KCNK15 AND NOT-BMP2 AND NOT-SCN4B | 0.96 | 0.923077 | 1 |
| KCNK15 AND NOT-BMP2 AND NOT-BBS4 | 0.96 | 0.923077 | 1 |
| KCNK15 AND NOT-BMP2 AND NOT-CD3D | 0.96 | 0.923077 | 1 |
| KCNK15 AND NOT-BMP2 AND NOT-TNFRSF14 | 0.96 | 0.923077 | 1 |
| KCNK15 AND NOT-BMP2 AND NOT-PCDH9 | 0.96 | 0.923077 | 1 |
| KCNK15 AND NOT-BMP2 AND NOT-DNAJC1 | 0.96 | 0.923077 | 1 |
| KCNK15 AND NOT-BMP2 AND NOT-CX3CL1 | 0.96 | 0.923077 | 1 |
| KCNK15 AND NOT-BMP2 AND NOT-SELPLG | 0.96 | 0.923077 | 1 |
| KCNK15 AND NOT-BMP2 AND NOT-RHBG | 0.96 | 0.923077 | 1 |
| KCNK15 AND NOT-SLC31A2 AND NOT-CDHR3 | 0.96 | 0.923077 | 1 |
| KCNK15 AND NOT-BMP2 AND NOT-VAMP1 | 0.96 | 0.923077 | 1 |
| KCNK15 AND NOT-BMP2 AND NOT-IGSF9 | 0.96 | 0.923077 | 1 |
| KCNK15 AND NOT-BMP2 AND NOT-C5AR1 | 0.96 | 0.923077 | 1 |
| KCNK15 AND NOT-BMP2 AND NOT-PNPLA2 | 0.96 | 0.923077 | 1 |
| KCNK15 AND NOT-BMP2 AND NOT-CD2 | 0.96 | 0.923077 | 1 |
| KCNK15 AND NOT-BMP2 AND NOT-DHRS3 | 0.96 | 0.923077 | 1 |
| KCNK15 AND NOT-BMP2 AND NOT-ENTPD2 | 0.96 | 0.923077 | 1 |
| KCNK15 AND NOT-BMP2 AND NOT-PIEZO1 | 0.96 | 0.923077 | 1 |
| KCNK15 AND NOT-BMP2 AND NOT-FCGR3B | 0.96 | 0.923077 | 1 |
| KCNK15 AND NOT-BMP2 AND NOT-ICAM3 | 0.96 | 0.923077 | 1 |
| KCNK15 AND NOT-SLC31A2 AND CELSR3 | 0.96 | 0.923077 | 1 |
| KCNK15 AND NOT-BMP2 AND NOT-IL7R | 0.96 | 0.923077 | 1 |
| KCNK15 AND NOT-BMP2 AND NOT-COMT | 0.96 | 0.923077 | 1 |
| KCNK15 AND NOT-SLC31A2 AND TNFRSF25 | 0.96 | 0.923077 | 1 |
| KCNK15 AND NOT-BMP2 AND NOT-CD8B | 0.96 | 0.923077 | 1 |
| KCNK15 AND NOT-BMP2 AND NOT-GPR20 | 0.96 | 0.923077 | 1 |
| KCNK15 AND NOT-BMP2 AND NOT-GGT5 | 0.96 | 0.923077 | 1 |
| KCNK15 AND NOT-BMP2 AND NOT-PCDH9 | 0.96 | 0.923077 | 1 |
| KCNK15 AND NOT-BMP2 AND NOT-MFSD3 | 0.96 | 0.923077 | 1 |
| KCNK15 AND NOT-SLC31A2 AND CELSR3 | 0.96 | 0.923077 | 1 |
| KCNK15 AND NOT-BMP2 AND NOT-TMED10 | 0.96 | 0.923077 | 1 |
| KCNK15 AND NOT-BMP2 AND MARCH1 | 0.96 | 0.923077 | 1 |
| KCNK15 AND NOT-BMP2 AND NOT-SLC29A4 | 0.96 | 0.923077 | 1 |
| KCNK15 AND NOT-BMP2 AND NOT-ADCY9 | 0.96 | 0.923077 | 1 |
| KCNK15 AND NOT-BMP2 AND NOT-ZFYVE27 | 0.96 | 0.923077 | 1 |
| KCNK15 AND NOT-BMP2 AND NOT-CSF1R | 0.96 | 0.923077 | 1 |
| KCNK15 AND NOT-BMP2 AND GAGE1 | 1 | 1 | 1 |
| KCNK15 AND NOT-BMP2 AND NOT-GPC3 | 1 | 1 | 1 |
| KCNK15 AND NOT-BMP2 AND HLA-DOB | 1 | 1 | 1 |
| KCNK15 AND NOT-BMP2 AND NOT-PROM1 | 0.96 | 0.923077 | 1 |
| KCNK15 AND NOT-BMP2 AND NOT-ANXA1 | 0.96 | 0.923077 | 1 |
| KCNK15 AND NOT-BMP2 AND NOT-PROM1 | 0.96 | 0.923077 | 1 |
| COMPLEX-KCNK15/BMP2/VTCN1 | 0.96 | 0.923077 | 1 |
| KCNK15 AND NOT-BMP2 AND GPNMB | 0.96 | 0.923077 | 1 |
| KCNK15 AND NOT-BMP2 AND NOT-CD52 | 0.96 | 0.923077 | 1 |
| COMPLEX-KCNK15/BMP2/CLDN6 | 0.96 | 0.923077 | 1 |
| KCNK15 AND NOT-BMP2 AND BMPR1B | 0.96 | 0.923077 | 1 |
| KCNK15 AND NOT-BMP2 AND NOT-TRPM4 | 0.96 | 0.923077 | 1 |
| COMPLEX-ALK/KCNK15/BMP2 | 0.96 | 0.923077 | 1 |
| KCNK15 AND NOT-BMP2 AND NOT-SPON2 | 0.96 | 0.923077 | 1 |
| KCNK15 AND NOT-BMP2 AND NOT-CD52 | 0.96 | 0.923077 | 1 |
| KCNK15 AND NOT-BMP2 AND NOT-SDC1 | 0.96 | 0.923077 | 1 |
| COMPLEX-IL11RA/KCNK15/BMP2 | 0.96 | 0.923077 | 1 |

FIG. 15 (cont.)

| Antigen Pair Logic | F1 | Precision | Recall | Antigen Pair Logic | F1 | Precision | Recall |
|---|---|---|---|---|---|---|---|
| NLGN4X AND LAPTM5 AND NOT-SDC2 | 0.866667 | 1 | 0.764706 | COMPLEX-CEACAM6/KCNK15/BMP2 | 0.96 | 0.923077 | 1 |
| GPM6B AND F2R AND NOT-RHCG | 0.866667 | 1 | 0.764706 | COMPLEX-MST1R/KCNK15/BMP2 | 0.96 | 0.923077 | 1 |
| GPM6B AND F2R AND NOT-CRIM1 | 0.866667 | 1 | 0.764706 | COMPLEX-KCNK15/BMP2/LGR5 | 0.96 | 0.923077 | 1 |
| COMPLEX-F2R/SLC16A9/GPM6B | 0.866667 | 1 | 0.764706 | COMPLEX-KCNK15/BMP2/TPBG | 0.96 | 0.923077 | 1 |
| GPM6B AND F2R AND NOT-ADRA2C | 0.866667 | 1 | 0.764706 | COMPLEX-IGF1R/KCNK15/BMP2 | 0.96 | 0.923077 | 1 |
| GPM6B AND F2R AND TMEM119 | 0.866667 | 1 | 0.764706 | COMPLEX-MET/KCNK15/BMP2 | 0.96 | 0.923077 | 1 |
| GPM6B AND F2R AND NOT-UNC5D | 0.866667 | 1 | 0.764706 | COMPLEX-KCNK15/CXCR5/BMP2 | 0.96 | 0.923077 | 1 |
| GPM6B AND F2R AND PTCHD1 | 0.866667 | 1 | 0.764706 | COMPLEX-SLC31A2/KCNK15/CLDN6 | 0.96 | 0.923077 | 1 |
| GPM6B AND F2R AND NOT-EPHA4 | 0.866667 | 1 | 0.764706 | COMPLEX-RNF43/KCNK15/BMP2 | 0.96 | 0.923077 | 1 |
| GPM6B AND F2R AND NOT-TMEM65 | 0.866667 | 1 | 0.764706 | COMPLEX-STEAP1/KCNK15/BMP2 | 0.96 | 0.923077 | 1 |
| GPM6A AND ABCA1 AND ADAM29 | 0.866667 | 1 | 0.764706 | COMPLEX-ALDH1A1/KCNK15/BMP2 | 0.96 | 0.923077 | 1 |
| GPM6B AND F2R AND SIRPG | 0.866667 | 1 | 0.764706 | COMPLEX-KCNK15/BMP2/MUC16 | 0.96 | 0.923077 | 1 |
| GPM6B AND F2R AND NOT-THSD7A | 0.866667 | 1 | 0.764706 | COMPLEX-ERBB3/KCNK15/BMP2 | 0.96 | 0.923077 | 1 |
| GPM6B AND F2R AND NOT-MFAP3L | 0.866667 | 1 | 0.764706 | COMPLEX-DKK1/KCNK15/BMP2 | 0.96 | 0.923077 | 1 |
| GPM6B AND F2R AND NOT-TENM1 | 0.866667 | 1 | 0.764706 | COMPLEX-KCNK15/BMP2/SSTR2 | 0.96 | 0.923077 | 1 |
| NRCAM AND LAPTM5 AND NOT-YIPF3 | 0.9375 | 1 | 0.882353 | COMPLEX-KCNK15/BMP2/CLDN9 | 0.96 | 0.923077 | 1 |
| NLGN4X AND LAPTM5 AND NOT-CD40 | 0.903226 | 1 | 0.823529 | COMPLEX-KCNK15/BMP2/CD19 | 0.96 | 0.923077 | 1 |
| NLGN4X AND LAPTM5 AND NOT-SLC12A6 | 0.903226 | 1 | 0.823529 | COMPLEX-ERBB4/KCNK15/BMP2 | 0.96 | 0.923077 | 1 |
| NLGN4X AND LAPTM5 AND NOT-ITGB7 | 0.903226 | 1 | 0.823529 | COMPLEX-SLC31A2/KCNK15/VTCN1 | 0.96 | 0.923077 | 1 |
| NLGN4X AND LAPTM5 AND NOT-LILRB2 | 0.903226 | 1 | 0.823529 | COMPLEX-ABCA5/KCNK15/BMP2 | 0.96 | 0.923077 | 1 |
| NLGN4X AND LAPTM5 AND NOT-PNPLA2 | 0.903226 | 1 | 0.823529 | COMPLEX-IL2RA/KCNK15/BMP2 | 0.96 | 0.923077 | 1 |
| GPM6A AND ADAM29 AND DISP1 | 0.9375 | 1 | 0.882353 | COMPLEX-KCNK15/BMP2/FCRL5 | 0.96 | 0.923077 | 1 |
| GPM6B AND LAPTM5 AND KITLG | 0.864865 | 0.8 | 0.941176 | COMPLEX-DNAJB8/KCNK15/BMP2 | 0.96 | 0.923077 | 1 |
| GPM6A AND WLS AND ADAM29 | 0.888889 | 0.842105 | 0.941176 | KCNK15 AND NOT-DSC3 AND GAGE1 | 1 | 1 | 1 |
| NRCAM AND NOT-VAMP1 AND BTN3A3 | 0.875 | 0.933333 | 0.823529 | KCNK15 AND NOT-DSC3 AND NOT-ENG | 1 | 1 | 1 |
| NLGN4X AND LAPTM5 AND NOT-ITSN1 | 0.903226 | 1 | 0.823529 | KCNK15 AND NOT-BMP2 AND NOT-IL20RA | 0.96 | 0.923077 | 1 |
| GPM6A AND VAMP8 AND RHCG | 0.909091 | 0.9375 | 0.882353 | KCNK15 AND NOT-DSC3 AND NOT-ENG | 1 | 1 | 1 |
| GPM6A AND TLR2 AND ADAM29 | 0.909091 | 0.9375 | 0.882353 | KCNK15 AND NOT-DSC3 AND NOT-CSPG4 | 1 | 1 | 1 |
| NRCAM AND NOT-STX8 AND ATP7A | 0.875 | 0.933333 | 0.823529 | KCNK15 AND NOT-SLC31A2 AND GPNMB | 0.96 | 0.923077 | 1 |
| PTPRZ1 AND NOT-UNC5D AND SYT11 | 0.909091 | 0.9375 | 0.882353 | KCNK15 AND NOT-DSC3 AND HLA-DOB | 0.956522 | 1 | 0.916667 |
| GPM6A AND HLA-B AND ADAM29 | 0.857143 | 0.833333 | 0.882353 | KCNK15 AND NOT-BMP2 AND NOT-CD70 | 0.96 | 0.923077 | 1 |
| GPM6B AND LAPTM5 AND P2RY1 | 0.857143 | 0.833333 | 0.882353 | KCNK15 AND NOT-BMP2 AND NOT-IL20RA | 0.96 | 0.923077 | 1 |
| GPM6B AND VAMP8 AND RHCG | 0.857143 | 0.833333 | 0.882353 | KCNK15 AND NOT-BMP2 AND NOT-CD70 | 0.96 | 0.923077 | 1 |
| NRCAM AND LAPTM5 AND NOT-ZDHHC5 | 0.9375 | 1 | 0.882353 | KCNK15 AND NOT-SLC31A2 AND NOT-IL20RA | 0.96 | 0.923077 | 1 |
| PTPRZ1 AND LAPTM5 AND NOT-PNPLA2 | 0.9375 | 1 | 0.882353 | KCNK15 AND NOT-BMP2 AND NOT-CLDN8 | 0.96 | 0.923077 | 1 |
| NRCAM AND TLR2 AND NOT-S1PR1 | 0.9375 | 1 | 0.882353 | KCNK15 AND NOT-AQP9 AND NOT-ENG | 0.96 | 0.923077 | 1 |
| GPM6A AND ATRAID AND ADAM29 | 0.866667 | 1 | 0.764706 | KCNK15 AND NOT-BMP2 AND NOT-CLDN8 | 0.96 | 0.923077 | 1 |
| GPM6A AND SLC2A10 AND NOT-ZDHHC2 | 0.9375 | 1 | 0.882353 | KCNK15 AND NOT-SLC31A2 AND NOT-IL20RA | 0.96 | 0.923077 | 1 |
| GPM6A AND SLC2A10 AND ADAM29 | 0.9375 | 1 | 0.882353 | KCNK15 AND NOT-DSC3 AND NOT-CLEC14A | 0.96 | 0.923077 | 1 |
| NRCAM AND LAPTM5 AND NOT-PNPLA2 | 0.9375 | 1 | 0.882353 | COMPLEX-SLC31A2/IL2RA/KCNK15 | 0.96 | 0.923077 | 1 |
| PTPRZ1 AND NOT-ATP2C1 AND GPR158 | 0.875 | 0.933333 | 0.823529 | COMPLEX-SLC31A2/DKK1/KCNK15 | 0.96 | 0.923077 | 1 |
| MLC1 AND SLC7A7 AND NOT-SLC12A6 | 0.848485 | 0.875 | 0.823529 | KCNK15 AND NOT-DSC3 AND NOT-TNC | 0.96 | 0.923077 | 1 |
| MLC1 AND TLR2 AND NOT-LTB | 0.848485 | 0.875 | 0.823529 | COMPLEX-SLC31A2/TRPM4/KCNK15 | 0.96 | 0.923077 | 1 |
| GPM6A AND NOT-ATP8A2 AND RHCG | 0.848485 | 0.875 | 0.823529 | COMPLEX-SLC31A2/GAGE1/KCNK15 | 0.96 | 0.923077 | 1 |
| SYT11 AND ADAM12 AND NOT-HMOX2 | 0.848485 | 0.875 | 0.823529 | COMPLEX-SLC31A2/STEAP1/KCNK15 | 0.96 | 0.923077 | 1 |
| MLC1 AND TLR2 AND NOT-GPR146 | 0.848485 | 0.875 | 0.823529 | COMPLEX-SLC31A2/HLA-DOB/KCNK15 | 0.96 | 0.923077 | 1 |
| GPR158 AND SLC30A5 AND NOT-ATP2C1 | 0.848485 | 0.875 | 0.823529 | KCNK15 AND NOT-DSC3 AND NOT-AXL | 1 | 1 | 1 |
| GPR158 AND ABCA1 AND NOT-SYT2 | 0.848485 | 0.875 | 0.823529 | COMPLEX-SLC31A2/IGF1R/KCNK15 | 0.96 | 0.923077 | 1 |
| PTPRZ1 AND NOT-TM9SF2 AND NOT-GPR158 | 0.875 | 0.933333 | 0.823529 | KCNK15 AND NOT-DSC3 AND NOT-CD34 | 1 | 1 | 1 |
| GPM6B AND TCIRG1 AND SLC4A8 | 0.848485 | 0.875 | 0.823529 | COMPLEX-SLC31A2/EGFR/KCNK15 | 0.96 | 0.923077 | 1 |
| AQP4 AND RHCG AND NOT-SLC16A5 | 0.866667 | 1 | 0.764706 | KCNK15 AND NOT-DSC3 AND NOT-CLDN5 | 0.96 | 0.923077 | 1 |
| NRCAM AND LAPTM5 AND NOT-ITSN1 | 0.9375 | 1 | 0.882353 | COMPLEX-SLC31A2/ALDH1A1/KCNK15 | 0.96 | 0.923077 | 1 |
| NRCAM AND LAPTM5 AND NOT-SLC12A6 | 0.9375 | 1 | 0.882353 | COMPLEX-SLC31A2/KCNK15/ST8SIA1 | 0.96 | 0.923077 | 1 |
| NRCAM AND LAPTM5 AND NOT-LILRB2 | 0.9375 | 1 | 0.882353 | KCNK15 AND NOT-DSC3 AND NOT-P2RX5 | 0.96 | 0.923077 | 1 |
| GPM6A AND VAMP8 AND P2RY1 | 0.857143 | 0.833333 | 0.882353 | COMPLEX-SLC31A2/ERBB3/KCNK15 | 0.96 | 0.923077 | 1 |
| MLC1 AND SLC7A7 AND NOT-ITGB7 | 0.848485 | 0.875 | 0.823529 | KCNK15 AND NOT-DSC3 AND NOT-GPC3 | 1 | 1 | 1 |
| MLC1 AND SLC2A10 AND NOT-ABCC10 | 0.866667 | 1 | 0.764706 | COMPLEX-SLC31A2/ERBB4/KCNK15 | 0.96 | 0.923077 | 1 |
| MLC1 AND SLC2A10 AND NOT-LEPR | 0.866667 | 1 | 0.764706 | COMPLEX-SLC31A2/KCNK15/ULBP2 | 0.96 | 0.923077 | 1 |
| MLC1 AND SLC2A10 AND NOT-STS | 0.866667 | 1 | 0.764706 | COMPLEX-SLC31A2/ABCA5/KCNK15 | 0.96 | 0.923077 | 1 |
| MLC1 AND SLC2A10 AND NOT-EPHA1 | 0.866667 | 1 | 0.764706 | COMPLEX-SLC31A2/PCYT1A/KCNK15 | 0.96 | 0.923077 | 1 |
| PTPRZ1 AND NOT-PIK3IP1 AND ITGAM | 0.875 | 0.933333 | 0.823529 | COMPLEX-SLC31A2/KCNK15/ULBP2 | 0.96 | 0.923077 | 1 |
| FAT3 AND KCNK15 AND LAPTM5 | 0.842105 | 0.761905 | 0.941176 | COMPLEX-SLC31A2/KCNK15/MUC16 | 0.96 | 0.923077 | 1 |
| GPM6B AND SIRPG AND CD163 | 0.842105 | 0.761905 | 0.941176 | COMPLEX-SLC31A2/TRPM4/KCNK15 | 0.96 | 0.923077 | 1 |
| SYT11 AND SLC7A7 AND NOT-ITGB7 | 0.842105 | 0.761905 | 0.941176 | COMPLEX-SLC31A2/CEACAM6/KCNK15 | 0.96 | 0.923077 | 1 |
| SYT11 AND SIRPG AND WLS | 0.918919 | 0.85 | 1 | KCNK15 AND NOT-DSC3 AND MUC16 | 1 | 1 | 1 |
| PTPRZ1 AND NOT-VAMP1 AND BTN3A3 | 0.903226 | 1 | 0.823529 | KCNK15 AND NOT-SLC31A2 AND NOT-ANXA1 | 0.96 | 0.923077 | 1 |
| NRCAM AND CYBA AND NOT-TSPAN5 | 0.9375 | 1 | 0.882353 | KCNK15 AND NOT-PTGDR AND GAGE1 | 0.96 | 0.923077 | 1 |
| PTPRZ1 AND NOT-SLC2A12 AND FZD7 | 0.909091 | 0.9375 | 0.882353 | KCNK15 AND NOT-DSC3 AND NOT-CLDN23 | 0.96 | 0.923077 | 1 |
| PTPRZ1 AND NOT-LRP11 AND ZDHHC5 | 0.903226 | 1 | 0.823529 | KCNK15 AND NOT-DSC3 AND NOT-CLDN23 | 0.96 | 0.923077 | 1 |
| NRCAM AND RHCG AND NOT-PARM1 | 0.909091 | 0.9375 | 0.882353 | KCNK15 AND NOT-TNFSF13B AND HLA-DOB | 0.956522 | 1 | 0.916667 |
| PTPRZ1 AND SIRPG AND GPM6B | 0.9375 | 1 | 0.882353 | KCNK15 AND NOT-DSC3 AND NOT-CD52 | 0.96 | 0.923077 | 1 |
| NRCAM AND CYBA AND NOT-RER1 | 0.9375 | 1 | 0.882353 | KCNK15 AND NOT-DSC3 AND NOT-FOLR2 | 0.96 | 0.923077 | 1 |
| PTPRZ1 AND NOT-SLC2A12 AND RHCG | 0.9375 | 1 | 0.882353 | KCNK15 AND NOT-DSC3 AND NOT-SLC39A6 | 0.96 | 0.923077 | 1 |
| PTPRZ1 AND SIRPG AND NOT-ADIPOR1 | 0.9375 | 1 | 0.882353 | KCNK15 AND NOT-DSC3 AND NOT-SPON2 | 0.96 | 0.923077 | 1 |
| PTPRZ1 AND NOT-SLC2A12 AND NOT-TSPAN5 | 0.909091 | 0.9375 | 0.882353 | KCNK15 AND NOT-DSC3 AND BMPR1B | 0.96 | 0.923077 | 1 |
| GPM6A AND SLC2A10 AND NOT-PTPRM | 0.9375 | 1 | 0.882353 | KCNK15 AND NOT-DSC3 AND NOT-CD52 | 0.96 | 0.923077 | 1 |
| PTPRZ1 AND KCNK15 AND FAT3 | 0.903226 | 1 | 0.823529 | KCNK15 AND NOT-DSC3 AND NOT-ABCA5 | 0.96 | 0.923077 | 1 |

FIG. 15 (cont.)

| Antigen Pair Logic | F1 | Precision | Recall |
|---|---|---|---|
| PTPRZ1 AND KCNK15 AND GRIA3 | 0.903226 | 1 | 0.823529 |
| PTPRZ1 AND KCNK15 AND IGSF11 | 0.903226 | 1 | 0.823529 |
| GPM6B AND SIRPG AND SLC3A2 | 0.903226 | 1 | 0.823529 |
| GPM6B AND SIRPG AND CYBA | 0.882353 | 0.882353 | 0.882353 |
| GPM6A AND CD99 AND RHCG | 0.882353 | 0.882353 | 0.882353 |
| GPM6A AND OR1A1 AND DISP1 | 0.882353 | 0.882353 | 0.882353 |
| NRCAM AND SLC22A4 AND NOT-YIPF3 | 0.882353 | 0.882353 | 0.882353 |
| NRCAM AND NOT-PTPRM AND SLC7A7 | 0.9375 | 1 | 0.882353 |
| GPM6A AND WLS AND OR1A1 | 0.888889 | 0.842105 | 0.941176 |
| NRCAM AND CYBA AND NOT-ZDHHC5 | 0.9375 | 1 | 0.882353 |
| GPM6B AND SIRPG AND WLS | 0.909091 | 0.9375 | 0.882353 |
| PTPRZ1 AND NOT-SLC2A12 AND TMEM119 | 0.875 | 0.933333 | 0.823529 |
| GPM6B AND OR1A1 AND SLC3A2 | 0.875 | 0.933333 | 0.823529 |
| PTPRZ1 AND NOT-STX8 AND NOT-RECK | 0.875 | 0.933333 | 0.823529 |
| GPM6A AND OR1A1 AND TLR2 | 0.909091 | 0.9375 | 0.882353 |
| NRCAM AND SLC7A7 AND NOT-YIPF3 | 0.9375 | 1 | 0.882353 |
| NRCAM AND SLC22A4 AND NOT-GPR146 | 0.882353 | 0.882353 | 0.882353 |
| NRCAM AND CTNS AND NOT-SLC26A11 | 0.9375 | 1 | 0.882353 |
| NRCAM AND CTNS AND NOT-VAMP1 | 0.9375 | 1 | 0.882353 |
| GPM6A AND SLC7A7 AND NOT-SLC12A6 | 0.882353 | 0.882353 | 0.882353 |
| GPM6A AND SLC7A7 AND NOT-ITGB7 | 0.882353 | 0.882353 | 0.882353 |
| GPM6A AND HLA-B AND RHCG | 0.909091 | 0.9375 | 0.882353 |
| COMPLEX-SLC9A6/PTPRZ1/TLR2 | 0.909091 | 0.9375 | 0.882353 |
| PTPRZ1 AND NOT-VAMP1 AND NOT-TRPM7 | 0.875 | 0.933333 | 0.823529 |
| GPM6A AND HLA-B AND P2RY1 | 0.9375 | 1 | 0.882353 |
| GPM6A AND SLC2A10 AND NOT-RHBG | 0.9375 | 1 | 0.882353 |
| GPM6A AND SLC2A10 AND NOT-STX8 | 0.903226 | 1 | 0.823529 |
| GPM6A AND SLC2A10 AND NOT-TSPAN5 | 0.9375 | 1 | 0.882353 |
| PTPRZ1 AND FZD7 AND NOT-TRPM7 | 0.909091 | 0.9375 | 0.882353 |
| NRCAM AND SLC22A4 AND NOT-SLC1A1 | 0.882353 | 0.882353 | 0.882353 |
| GPM6A AND OR1A1 AND SLC30A5 | 0.866667 | 1 | 0.764706 |
| PTPRZ1 AND NOT-STX8 AND CD9 | 0.866667 | 1 | 0.764706 |
| NRCAM AND NOT-PTPRM AND SLC2A10 | 0.866667 | 1 | 0.764706 |
| PTPRZ1 AND NOT-MTUS1 AND NOT-CDHR2 | 0.866667 | 1 | 0.764706 |
| NRCAM AND NOT-PTPRM AND BTN3A2 | 0.866667 | 1 | 0.764706 |
| GPM6A AND SLC2A10 AND NOT-SLC9A6 | 0.866667 | 1 | 0.764706 |
| GPM6A AND PLP2 AND OR1A1 | 0.866667 | 1 | 0.764706 |
| PTPRZ1 AND NOT-MTUS1 AND NOT-CAV2 | 0.866667 | 1 | 0.764706 |
| PTPRZ1 AND NOT-MTUS1 AND NOT-VAMP1 | 0.866667 | 1 | 0.764706 |
| GPM6A AND IL10RA AND OR1A1 | 0.866667 | 1 | 0.764706 |
| GPM6A AND ABCA1 AND RHCG | 0.866667 | 1 | 0.764706 |
| GPM6B AND AQP4 AND RHCG | 0.875 | 0.933333 | 0.823529 |
| PTPRZ1 AND SLC7A7 AND NOT-YIPF3 | 0.903226 | 1 | 0.823529 |
| NRCAM AND BTN3A2 AND NOT-VAMP1 | 0.866667 | 1 | 0.764706 |
| GPM6A AND SLC2A10 AND NOT-ABCC10 | 0.9375 | 1 | 0.882353 |
| PTPRZ1 AND IL10RA AND NOT-ZDHHC5 | 0.903226 | 1 | 0.823529 |
| NRCAM AND SLC7A7 AND NOT-SLC12A6 | 0.9375 | 1 | 0.882353 |
| PTPRZ1 AND IL10RA AND GRIA3 | 0.903226 | 1 | 0.823529 |
| NRCAM AND SLC22A4 AND NOT-AQP7 | 0.882353 | 0.882353 | 0.882353 |
| COMPLEX-MTUS1/PTPRZ1/SLC33A1 | 0.866667 | 1 | 0.764706 |
| PTPRZ1 AND SLC7A7 AND NOT-ZDHHC5 | 0.903226 | 1 | 0.823529 |
| NRCAM AND BTN3A2 AND NOT-HEG1 | 0.866667 | 1 | 0.764706 |
| PTPRZ1 AND NOT-VAMP1 AND NOT-TM9SF2 | 0.875 | 0.933333 | 0.823529 |
| PTPRZ1 AND NOT-VAMP1 AND NOT-ZDHHC5 | 0.875 | 0.933333 | 0.823529 |
| COMPLEX-ABCA8/PTPRZ1/STX8 | 0.875 | 0.933333 | 0.823529 |
| COMPLEX-PTPRZ1/CAV2/STX8 | 0.875 | 0.933333 | 0.823529 |
| COMPLEX-PTPRCAP/PTPRZ1/STX8 | 0.875 | 0.933333 | 0.823529 |
| PTPRZ1 AND NOT-UNC5D AND GPM6B | 0.909091 | 0.9375 | 0.882353 |
| COMPLEX-PTPRZ1/STX8/SLC12A6 | 0.875 | 0.933333 | 0.823529 |
| COMPLEX-PAG1/PTPRZ1/STX8 | 0.875 | 0.933333 | 0.823529 |
| COMPLEX-TMEM150C/PTPRZ1/STX8 | 0.875 | 0.933333 | 0.823529 |
| COMPLEX-TMEM65/PTPRZ1/STX8 | 0.875 | 0.933333 | 0.823529 |
| GPM6A AND SLC2A10 AND NOT-STS | 0.9375 | 1 | 0.882353 |
| PTPRZ1 AND FZD7 AND NOT-LEPR | 0.909091 | 0.9375 | 0.882353 |
| PTPRZ1 AND IL10RA AND FAT3 | 0.903226 | 1 | 0.823529 |
| PTPRZ1 AND FZD7 AND NOT-AQP7 | 0.909091 | 0.9375 | 0.882353 |
| COMPLEX-ZDHHC5/PTPRZ1/STX8 | 0.875 | 0.933333 | 0.823529 |
| GPM6B AND OR1A1 AND WLS | 0.857143 | 0.833333 | 0.882353 |
| GPM6B AND HLA-B AND RHCG | 0.882353 | 0.882353 | 0.882353 |
| GPM6B AND HLA-B AND OR1A1 | 0.857143 | 0.833333 | 0.882353 |
| GPM6A AND SLC2A10 AND NOT-TMEM127 | 0.9375 | 1 | 0.882353 |
| GPM6A AND SLC2A10 AND NOT-SLC41A3 | 0.9375 | 1 | 0.882353 |
| NRCAM AND TLR2 AND NOT-GPR146 | 0.9375 | 1 | 0.882353 |
| PTPRZ1 AND SLC7A7 AND FAT3 | 0.903226 | 1 | 0.823529 |
| GPM6B AND SLC3A2 AND NOT-CDHR2 | 0.903226 | 1 | 0.823529 |
| GPM6B AND TLR2 AND RHCG | 0.882353 | 0.882353 | 0.882353 |
| GPM6A AND WLS AND RHCG | 0.941176 | 0.941176 | 0.941176 |

| Antigen Pair Logic | F1 | Precision | Recall |
|---|---|---|---|
| KCNK15 AND NOT-BMP2 AND PIRT | 1 | 1 | 1 |
| KCNK15 AND NOT-GHR AND NOT-FPR1 | 1 | 1 | 1 |
| KCNK15 AND NOT-BMP2 AND NOT-AOC3 | 1 | 1 | 1 |
| KCNK15 AND NOT-SYT4 AND NOT-RAMP3 | 1 | 1 | 1 |
| KCNK15 AND NOT-GHR AND SLC51B | 1 | 1 | 1 |
| KCNK15 AND NOT-GHR AND NOT-FPR1 | 1 | 1 | 1 |
| KCNK15 AND NOT-SYT4 AND NOT-RAMP3 | 1 | 1 | 1 |
| KCNK15 AND NOT-BMP2 AND NOT-ESAM | 1 | 1 | 1 |
| KCNK15 AND NOT-BMP2 AND DCC | 1 | 1 | 1 |
| KCNK15 AND NOT-BMP2 AND NOT-ESAM | 1 | 1 | 1 |
| KCNK15 AND NOT-BMP2 AND NOT-EMP3 | 1 | 1 | 1 |
| KCNK15 AND NOT-THBD AND NOT-LRFN5 | 1 | 1 | 1 |
| KCNK15 AND NOT-THBD AND NOT-LRFN5 | 1 | 1 | 1 |
| KCNK15 AND NOT-BMP2 AND NOT-CD93 | 0.96 | 0.923077 | 1 |
| KCNK15 AND NOT-GHR AND NOT-KCNQ4 | 0.96 | 0.923077 | 1 |
| KCNK15 AND NOT-BMP2 AND NOT-ATP4B | 0.96 | 0.923077 | 1 |
| KCNK15 AND NOT-GHR AND GJD4 | 0.96 | 0.923077 | 1 |
| KCNK15 AND NOT-BMP2 AND NOT-SLC9A1 | 0.96 | 0.923077 | 1 |
| KCNK15 AND NOT-GHR AND NOT-SLC31A2 | 0.96 | 0.923077 | 1 |
| KCNK15 AND NOT-GHR AND NOT-IL7R | 0.96 | 0.923077 | 1 |
| KCNK15 AND NOT-GHR AND NOT-FCGR3B | 0.96 | 0.923077 | 1 |
| KCNK15 AND NOT-GHR AND NOT-PNPLA2 | 0.96 | 0.923077 | 1 |
| KCNK15 AND NOT-BMP2 AND LYPD1 | 0.96 | 0.923077 | 1 |
| KCNK15 AND NOT-BMP2 AND NOT-DYSF | 0.96 | 0.923077 | 1 |
| KCNK15 AND NOT-GHR AND NOT-SLC47A1 | 0.96 | 0.923077 | 1 |
| KCNK15 AND NOT-BMP2 AND NOT-CD36 | 0.96 | 0.923077 | 1 |
| KCNK15 AND NOT-GHR AND NOT-CD68 | 0.96 | 0.923077 | 1 |
| KCNK15 AND NOT-BMP2 AND NOT-LRRC8E | 0.96 | 0.923077 | 1 |
| KCNK15 AND NOT-GHR AND NOT-ADRB2 | 0.96 | 0.923077 | 1 |
| KCNK15 AND NOT-BMP2 AND DRD5 | 0.96 | 0.923077 | 1 |
| KCNK15 AND NOT-BMP2 AND NOT-ABCA12 | 0.96 | 0.923077 | 1 |
| KCNK15 AND NOT-BMP2 AND NOT-SLC22A18 | 0.96 | 0.923077 | 1 |
| KCNK15 AND NOT-GHR AND CELSR3 | 0.96 | 0.923077 | 1 |
| KCNK15 AND NOT-GHR AND NOT-PDGFRB | 0.96 | 0.923077 | 1 |
| KCNK15 AND NOT-GHR AND NOT-ENPP2 | 0.96 | 0.923077 | 1 |
| KCNK15 AND NOT-BMP2 AND SLC4A5 | 0.96 | 0.923077 | 1 |
| KCNK15 AND NOT-BMP2 AND NOT-CD163 | 0.96 | 0.923077 | 1 |
| KCNK15 AND NOT-GHR AND SLC17A4 | 0.96 | 0.923077 | 1 |
| KCNK15 AND NOT-BMP2 AND NOT-SLC9A1 | 0.96 | 0.923077 | 1 |
| KCNK15 AND NOT-GHR AND NOT-PDGFRB | 0.96 | 0.923077 | 1 |
| KCNK15 AND NOT-BMP2 AND NOT-LRRC8E | 0.96 | 0.923077 | 1 |
| KCNK15 AND NOT-GHR AND CRB3 | 0.96 | 0.923077 | 1 |
| KCNK15 AND NOT-GHR AND NOT-KCNQ4 | 0.96 | 0.923077 | 1 |
| KCNK15 AND NOT-GHR AND NOT-ST6GALNAC6 | 0.96 | 0.923077 | 1 |
| KCNK15 AND NOT-SYT4 AND NOT-ADRB2 | 0.96 | 0.923077 | 1 |
| KCNK15 AND NOT-GHR AND NOT-CTSZ | 0.96 | 0.923077 | 1 |
| KCNK15 AND NOT-GHR AND NOT-SLC31A2 | 0.96 | 0.923077 | 1 |
| KCNK15 AND NOT-GHR AND NOT-ITGA5 | 0.96 | 0.923077 | 1 |
| KCNK15 AND NOT-GHR AND NOT-MR1 | 0.96 | 0.923077 | 1 |
| KCNK15 AND NOT-BMP2 AND NOT-CD44 | 0.96 | 0.923077 | 1 |
| KCNK15 AND NOT-GHR AND NOT-SLC22A4 | 0.96 | 0.923077 | 1 |
| KCNK15 AND NOT-GHR AND NOT-MR1 | 0.96 | 0.923077 | 1 |
| KCNK15 AND NOT-BMP2 AND CHRNG | 0.96 | 0.923077 | 1 |
| KCNK15 AND NOT-BMP2 AND NOT-FCGR3B | 0.96 | 0.923077 | 1 |
| KCNK15 AND NOT-BMP2 AND NOT-CD36 | 0.96 | 0.923077 | 1 |
| KCNK15 AND NOT-GHR AND NOT-HEPH | 0.96 | 0.923077 | 1 |
| KCNK15 AND NOT-GHR AND NOT-PCDHGA10 | 0.96 | 0.923077 | 1 |
| KCNK15 AND NOT-GHR AND NOT-ITGA5 | 0.96 | 0.923077 | 1 |
| KCNK15 AND NOT-GHR AND NOT-BMP2 | 0.96 | 0.923077 | 1 |
| KCNK15 AND NOT-GHR AND CEACAM1 | 0.96 | 0.923077 | 1 |
| KCNK15 AND NOT-GHR AND NOT-CD68 | 0.96 | 0.923077 | 1 |
| KCNK15 AND NOT-BMP2 AND FXYD7 | 0.96 | 0.923077 | 1 |
| KCNK15 AND NOT-SYT4 AND NOT-IL7R | 0.96 | 0.923077 | 1 |
| KCNK15 AND NOT-BMP2 AND NOT-TTYH2 | 0.96 | 0.923077 | 1 |
| KCNK15 AND NOT-BMP2 AND NOT-GPR137B | 0.96 | 0.923077 | 1 |
| KCNK15 AND NOT-GHR AND NOT-PNPLA2 | 0.96 | 0.923077 | 1 |
| KCNK15 AND NOT-GHR AND NOT-TNFSF12 | 0.96 | 0.923077 | 1 |
| KCNK15 AND NOT-GHR AND NOT-IL7R | 0.96 | 0.923077 | 1 |
| KCNK15 AND NOT-BMP2 AND NOT-GGTLC1 | 0.96 | 0.923077 | 1 |
| KCNK15 AND NOT-BMP2 AND NOT-CD44 | 0.96 | 0.923077 | 1 |
| KCNK15 AND NOT-SYT4 AND NOT-IL7R | 0.96 | 0.923077 | 1 |
| KCNK15 AND NOT-BMP2 AND NOT-MEGF11 | 0.96 | 0.923077 | 1 |
| KCNK15 AND NOT-GHR AND NOT-SLC31A2 | 0.96 | 0.923077 | 1 |
| KCNK15 AND NOT-GHR AND SCNN1A | 0.96 | 0.923077 | 1 |
| KCNK15 AND NOT-GHR AND NOT-ST6GALNAC6 | 0.96 | 0.923077 | 1 |
| KCNK15 AND NOT-GHR AND GPR143 | 0.96 | 0.923077 | 1 |
| KCNK15 AND NOT-GHR AND SUSD3 | 0.96 | 0.923077 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND ITGA2 AND NOT-ZDHHC5 | 0.909091 | 0.9375 | 0.882353 | KCNK15 AND NOT-BMP2 AND NOT-CD163 | 0.96 | 0.923077 | 1 |
| PTPRZ1 AND FZD7 AND NOT-JAG2 | 0.909091 | 0.9375 | 0.882353 | KCNK15 AND NOT-BMP2 AND NOT-MEGF11 | 0.96 | 0.923077 | 1 |
| GPM6A AND SLC2A10 AND NOT-EPHA1 | 0.9375 | 1 | 0.882353 | KCNK15 AND NOT-GHR AND SUSD3 | 0.96 | 0.923077 | 1 |
| GPM6A AND SLC2A10 AND OR1A1 | 0.9375 | 1 | 0.882353 | KCNK15 AND NOT-BMP2 AND NOT-CD93 | 0.96 | 0.923077 | 1 |
| PTPRZ1 AND NOT-VAMP1 AND NOT-RER1 | 0.875 | 0.933333 | 0.823529 | KCNK15 AND NOT-ABCA8 AND NOT-CD44 | 0.956522 | 1 | 0.916667 |
| NRCAM AND NOT-TMEM150C AND SLC30A5 | 0.866667 | 1 | 0.764706 | KCNK15 AND NOT-THBD AND PTPRG | 0.956522 | 1 | 0.916667 |
| GPM6B AND SLC7A7 AND FNDC4 | 0.857143 | 0.833333 | 0.882353 | KCNK15 AND NOT-GHR AND TACR2 | 0.956522 | 1 | 0.916667 |
| GPM6B AND SLC3A2 AND NOT-HMOX2 | 0.903226 | 1 | 0.823529 | KCNK15 AND NOT-BMP2 AND SLC2A1 | 0.956522 | 1 | 0.916667 |
| AQP4 AND RHCG AND NOT-MME | 0.866667 | 1 | 0.764706 | KCNK15 AND NOT-ABCA8 AND NOT-THBD | 0.956522 | 1 | 0.916667 |
| NRCAM AND NOT-PTPRM AND DIABLO | 0.875 | 0.933333 | 0.823529 | KCNK15 AND NOT-GHR AND GPR35 | 0.956522 | 1 | 0.916667 |
| AQP4 AND RHCG AND NOT-SLC26A9 | 0.866667 | 1 | 0.764706 | KCNK15 AND NOT-THBD AND NOT-ADRB2 | 0.956522 | 1 | 0.916667 |
| PTPRZ1 AND NOT-STX8 AND VCAM1 | 0.903226 | 1 | 0.823529 | COMPLEX-CHRNB4/KCNK15/BMP2 | 0.96 | 0.923077 | 1 |
| PTPRZ1 AND VCAM1 AND NOT-ITM2A | 0.9375 | 1 | 0.882353 | COMPLEX-SLC31A2/KCNK15/SYT4 | 0.96 | 0.923077 | 1 |
| PTPRZ1 AND VCAM1 AND NOT-CYB5R1 | 0.9375 | 1 | 0.882353 | COMPLEX-TAS2R10/KCNK15/BMP2 | 0.96 | 0.923077 | 1 |
| NRCAM AND VCAM1 AND NOT-SLC12A6 | 0.909091 | 0.9375 | 0.882353 | KCNK15 AND NOT-SYT4 AND NOT-ECSCR | 1 | 1 | 1 |
| PTPRZ1 AND SLC7A7 AND NOT-TRPM4 | 0.903226 | 1 | 0.823529 | COMPLEX-SLC31A2/KCNK15/SYT4 | 0.96 | 0.923077 | 1 |
| GPM6B AND OR1A1 AND CBX3 | 0.875 | 0.933333 | 0.823529 | COMPLEX-CATSPER3/KCNK15/BMP2 | 0.96 | 0.923077 | 1 |
| PTPRZ1 AND VCAM1 AND NOT-TRPM7 | 0.9375 | 1 | 0.882353 | COMPLEX-KCNK15/MSMO1/BMP2 | 0.96 | 0.923077 | 1 |
| PTPRZ1 AND NOT-GDE1 AND VCAM1 | 0.9375 | 1 | 0.882353 | COMPLEX-ATP8A1/KCNK15/BMP2 | 0.96 | 0.923077 | 1 |
| NRCAM AND VCAM1 AND NOT-YIPF3 | 0.909091 | 0.9375 | 0.882353 | COMPLEX-OXTR/KCNK15/BMP2 | 0.96 | 0.923077 | 1 |
| NRCAM AND VCAM1 AND NOT-GPR146 | 0.909091 | 0.9375 | 0.882353 | COMPLEX-NMBR/KCNK15/BMP2 | 0.96 | 0.923077 | 1 |
| PTPRZ1 AND VCAM1 AND NOT-SLC12A2 | 0.9375 | 1 | 0.882353 | COMPLEX-MTNR1B/KCNK15/BMP2 | 0.96 | 0.923077 | 1 |
| COMPLEX-GPNMB/PTPRZ1/STX8 | 0.875 | 0.933333 | 0.823529 | KCNK15 AND NOT-GHR AND PIRT | 1 | 1 | 1 |
| PTPRZ1 AND VCAM1 AND NOT-CAV2 | 0.9375 | 1 | 0.882353 | KCNK15 AND NOT-GHR AND NOT-CD44 | 0.96 | 0.923077 | 1 |
| PTPRZ1 AND VCAM1 AND NOT-JAG2 | 0.9375 | 1 | 0.882353 | KCNK15 AND NOT-GHR AND NOT-CD44 | 0.96 | 0.923077 | 1 |
| PTPRZ1 AND VCAM1 AND NOT-EPHA1 | 0.9375 | 1 | 0.882353 | KCNK15 AND NOT-GHR AND NOT-EMP3 | 0.96 | 0.923077 | 1 |
| PTPRZ1 AND VCAM1 AND NOT-PERP | 0.9375 | 1 | 0.882353 | KCNK15 AND NOT-SYT4 AND NOT-SELP | 1 | 1 | 1 |
| PTPRZ1 AND VCAM1 AND NOT-YIPF3 | 0.9375 | 1 | 0.882353 | KCNK15 AND NOT-SYT4 AND NOT-SELP | 1 | 1 | 1 |
| PTPRZ1 AND TLR2 AND NOT-MST1R | 0.903226 | 1 | 0.823529 | KCNK15 AND NOT-SYT4 AND NOT-CD93 | 0.96 | 0.923077 | 1 |
| NRCAM AND VCAM1 AND NOT-SLC12A2 | 0.909091 | 0.9375 | 0.882353 | KCNK15 AND NOT-SYT4 AND NOT-CD93 | 0.96 | 0.923077 | 1 |
| PTPRZ1 AND FZD7 AND NOT-TRPM4 | 0.909091 | 0.9375 | 0.882353 | KCNK15 AND NOT-GHR AND GJA10 | 0.96 | 0.923077 | 1 |
| PTPRZ1 AND VCAM1 AND NOT-GPR153 | 0.9375 | 1 | 0.882353 | KCNK15 AND NOT-SYT4 AND NOT-CD44 | 0.96 | 0.923077 | 1 |
| AQP4 AND RHCG AND NOT-ITGB6 | 0.866667 | 1 | 0.764706 | KCNK15 AND NOT-GHR AND FXYD7 | 0.96 | 0.923077 | 1 |
| PTPRZ1 AND VCAM1 AND NOT-PTPRF | 0.9375 | 1 | 0.882353 | KCNK15 AND NOT-SYT4 AND NOT-CD44 | 0.96 | 0.923077 | 1 |
| PTPRZ1 AND VCAM1 AND NOT-ZDHHC5 | 0.9375 | 1 | 0.882353 | KCNK15 AND NOT-SYT4 AND NOT-CD44 | 0.96 | 0.923077 | 1 |
| PTPRZ1 AND FZD7 AND NOT-MST1R | 0.909091 | 0.9375 | 0.882353 | KCNK15 AND SLC2A1 AND NOT-CD44 | 0.956522 | 1 | 0.916667 |
| PTPRZ1 AND VCAM1 AND NOT-AQP7 | 0.9375 | 1 | 0.882353 | KCNK15 AND NOT-THBD AND SLC2A1 | 0.956522 | 1 | 0.916667 |
| PTPRZ1 AND VCAM1 AND NOT-GJB2 | 0.9375 | 1 | 0.882353 | KCNK15 AND NOT-SYT4 AND NOT-CD163 | 0.96 | 0.923077 | 1 |
| PTPRZ1 AND NOT-STS AND VCAM1 | 0.9375 | 1 | 0.882353 | KCNK15 AND NOT-GABRG1 AND NOT-CD163 | 0.96 | 0.923077 | 1 |
| PTPRZ1 AND VCAM1 AND NOT-LEPR | 0.9375 | 1 | 0.882353 | KCNK15 AND NOT-SYT4 AND NOT-KCNK6 | 1 | 1 | 1 |
| PTPRZ1 AND IL13RA1 AND NOT-ZDHHC5 | 0.903226 | 1 | 0.823529 | KCNK15 AND NOT-SYT4 AND NOT-CD163 | 0.96 | 0.923077 | 1 |
| PTPRZ1 AND VCAM1 AND NOT-CAV1 | 0.903226 | 1 | 0.823529 | KCNK15 AND NOT-GABRG1 AND NOT-SELP | 1 | 1 | 1 |
| PTPRZ1 AND VCAM1 AND FAT3 | 0.903226 | 1 | 0.823529 | KCNK15 AND NOT-GABRG1 AND NOT-CD163 | 0.96 | 0.923077 | 1 |
| AQP4 AND RHCG AND NOT-TRPM4 | 0.866667 | 1 | 0.764706 | KCNK15 AND NOT-GABRG1 AND NOT-SELP | 1 | 1 | 1 |
| PTPRZ1 AND VCAM1 AND NOT-TMEM219 | 0.9375 | 1 | 0.882353 | KCNK15 AND NOT-SYT4 AND NOT-TTYH2 | 0.96 | 0.923077 | 1 |
| GPM6B AND SIRPG AND CBX3 | 0.875 | 0.933333 | 0.823529 | KCNK15 AND NOT-GABRG1 AND NOT-CD93 | 0.96 | 0.923077 | 1 |
| PTPRZ1 AND NOT-TRPM4 AND C3AR1 | 0.9375 | 1 | 0.882353 | KCNK15 AND SLC2A1 AND NOT-SELP | 0.956522 | 1 | 0.916667 |
| PTPRZ1 AND VCAM1 AND NOT-ORAI1 | 0.9375 | 1 | 0.882353 | KCNK15 AND NOT-GABRG1 AND NOT-CD44 | 0.96 | 0.923077 | 1 |
| PTPRZ1 AND VCAM1 AND NOT-CXADR | 0.9375 | 1 | 0.882353 | KCNK15 AND NOT-THBD AND LHFPL5 | 0.956522 | 1 | 0.916667 |
| PTPRZ1 AND VCAM1 AND NOT-MFSD5 | 0.9375 | 1 | 0.882353 | KCNK15 AND NOT-THBD AND NOT-SYT4 | 1 | 1 | 1 |
| AQP4 AND RHCG AND NOT-SDC1 | 0.866667 | 1 | 0.764706 | KCNK15 AND NOT-GABRG1 AND NOT-CD44 | 0.96 | 0.923077 | 1 |
| AQP4 AND RHCG AND NOT-MUC1 | 0.866667 | 1 | 0.764706 | KCNK15 AND NOT-THBD AND NOT-SYT4 | 1 | 1 | 1 |
| AQP4 AND RHCG AND NOT-CLDN23 | 0.866667 | 1 | 0.764706 | KCNK15 AND SLC2A1 AND NOT-CD93 | 0.956522 | 1 | 0.916667 |
| AQP4 AND RHCG AND NOT-CLDN7 | 0.866667 | 1 | 0.764706 | KCNK15 AND NOT-GABRG1 AND NOT-TTYH2 | 0.96 | 0.923077 | 1 |
| PTPRZ1 AND VCAM1 AND NOT-TSPAN14 | 0.9375 | 1 | 0.882353 | KCNK15 AND NOT-LRRN4 AND NOT-CD163 | 0.96 | 0.923077 | 1 |
| IGSF11 AND KCNK15 AND TNC | 0.83871 | 0.928571 | 0.764706 | KCNK15 AND NOT-LRRN4 AND NOT-CD163 | 0.96 | 0.923077 | 1 |
| GPM6B AND TNC AND SIRPG | 0.83871 | 0.928571 | 0.764706 | KCNK15 AND NOT-LRRN4 AND NOT-SELP | 1 | 1 | 1 |
| NRCAM AND VCAM1 AND NOT-CDHR2 | 0.909091 | 0.9375 | 0.882353 | KCNK15 AND NOT-LRRN4 AND NOT-CD93 | 0.956522 | 1 | 0.916667 |
| NRCAM AND VCAM1 AND NOT-APLP2 | 0.875 | 0.933333 | 0.823529 | KCNK15 AND NOT-LRRN4 AND NOT-SELP | 1 | 1 | 1 |
| COMPLEX-TSPAN5/EDNRB/PTPRZ1 | 0.83871 | 0.928571 | 0.764706 | KCNK15 AND NOT-LRRN4 AND NOT-CD93 | 0.956522 | 1 | 0.916667 |
| PTPRZ1 AND VCAM1 AND PTPRC | 0.903226 | 1 | 0.823529 | KCNK15 AND NOT-LRRN4 AND NOT-CD44 | 0.96 | 0.923077 | 1 |
| NRCAM AND VCAM1 AND NOT-ERMAP | 0.909091 | 0.9375 | 0.882353 | KCNK15 AND NOT-LRRN4 AND NOT-TTYH2 | 0.96 | 0.923077 | 1 |
| PTPRZ1 AND SLC2A10 AND NOT-TRPM4 | 0.903226 | 1 | 0.823529 | KCNK15 AND NOT-CLDN15 AND NOT-KCNK6 | 1 | 1 | 1 |
| PTPRZ1 AND VCAM1 AND NOT-TSPAN4 | 0.9375 | 1 | 0.882353 | KCNK15 AND NOT-CLDN15 AND NOT-CD44 | 0.96 | 0.923077 | 1 |
| PTPRZ1 AND VCAM1 AND NOT-CDHR2 | 0.9375 | 1 | 0.882353 | KCNK15 AND NOT-CLDN15 AND NOT-TTYH2 | 0.96 | 0.923077 | 1 |
| PTPRZ1 AND VCAM1 AND NOT-AQP9 | 0.9375 | 1 | 0.882353 | KCNK15 AND NOT-CLDN15 AND NOT-CD44 | 0.96 | 0.923077 | 1 |
| PTPRZ1 AND VCAM1 AND NOT-PKN2 | 0.9375 | 1 | 0.882353 | KCNK15 AND NOT-GHR AND NOT-PAQR8 | 0.923077 | 0.857143 | 1 |
| PTPRZ1 AND VCAM1 AND PNPLA2 | 0.9375 | 1 | 0.882353 | KCNK15 AND NOT-GHR AND EFNB2 | 0.923077 | 0.857143 | 1 |
| AQP4 AND RHCG AND NOT-SLAMF7 | 0.866667 | 1 | 0.764706 | KCNK15 AND NOT-GHR AND NOT-TGFBI | 0.923077 | 0.857143 | 1 |
| AQP4 AND RHCG AND NOT-IL20RA | 0.866667 | 1 | 0.764706 | KCNK15 AND NOT-GHR AND NOT-ALCAM | 0.923077 | 0.857143 | 1 |
| PTPRZ1 AND TLR2 AND VCAM1 | 0.903226 | 1 | 0.823529 | KCNK15 AND NOT-GHR AND NOT-MRGPRF | 0.923077 | 0.857143 | 1 |
| PTPRZ1 AND NOT-SLC3A1 AND VCAM1 | 0.9375 | 1 | 0.882353 | COMPLEX-FUT3/GHR/KCNK15 | 0.923077 | 0.857143 | 1 |
| PTPRZ1 AND VCAM1 AND NOT-OR3A3 | 0.9375 | 1 | 0.882353 | KCNK15 AND NOT-GHR AND ATP8A1 | 0.923077 | 0.857143 | 1 |
| PTPRZ1 AND RHCG AND NOT-MST1R | 0.9375 | 1 | 0.882353 | KCNK15 AND NOT-GABRG1 AND NOT-GYPC | 0.923077 | 0.857143 | 1 |
| PTPRZ1 AND VCAM1 AND NOT-PTPRS | 0.9375 | 1 | 0.882353 | KCNK15 AND NOT-LRRN4 AND NOT-GYPC | 0.923077 | 0.857143 | 1 |
| NLGN1 AND SLC7A7 AND NOT-TRPM4 | 0.866667 | 1 | 0.764706 | KCNK15 AND NOT-GHR AND NOT-MSMO1 | 0.923077 | 0.857143 | 1 |
| PTPRZ1 AND NOT-STS AND NOT-CLDN12 | 0.909091 | 0.9375 | 0.882353 | KCNK15 AND NOT-GHR AND NOT-ZDHHC2 | 0.923077 | 0.857143 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND VCAM1 AND NOT-ERMAP | 0.9375 | 1 | 0.882353 | KCNK15 AND NOT-GHR AND NOT-ATP7A | 0.923077 | 0.857143 | 1 |
| PTPRZ1 AND CD70 AND CCR1 | 0.903226 | 1 | 0.823529 | COMPLEX-GHR/KCNK15/SLC22A16 | 0.923077 | 0.857143 | 1 |
| PTPRZ1 AND VCAM1 AND NOT-SLC7A6 | 0.9375 | 1 | 0.882353 | KCNK15 AND NOT-GHR AND NOT-MSMO1 | 0.923077 | 0.857143 | 1 |
| AQP4 AND RHCG AND NOT-MST1R | 0.866667 | 1 | 0.764706 | KCNK15 AND NOT-GHR AND NOT-FAT1 | 0.923077 | 0.857143 | 1 |
| NRCAM AND VCAM1 AND NOT-SLC33A1 | 0.909091 | 0.9375 | 0.882353 | KCNK15 AND NOT-LRRN4 AND NOT-AOC3 | 0.923077 | 0.857143 | 1 |
| PTPRZ1 AND VCAM1 AND CCR1 | 0.903226 | 1 | 0.823529 | KCNK15 AND NOT-GHR AND FXYD6 | 0.923077 | 0.857143 | 1 |
| GPM6B AND OR1A1 AND IL13RA1 | 0.833333 | 0.789474 | 0.882353 | KCNK15 AND NOT-GHR AND HLA-DRB1 | 0.923077 | 0.857143 | 1 |
| PTPRZ1 AND VCAM1 AND NOT-KCNJ2 | 0.827586 | 1 | 0.705882 | COMPLEX-SLC2A9/GHR/KCNK15 | 0.923077 | 0.857143 | 1 |
| GPM6B AND TNC AND FNDC4 | 0.827586 | 1 | 0.705882 | KCNK15 AND NOT-GHR AND CD163 | 0.923077 | 0.857143 | 1 |
| AQP4 AND RHCG AND NOT-CLDN1 | 0.827586 | 1 | 0.705882 | KCNK15 AND NOT-GHR AND CHRNG | 0.923077 | 0.857143 | 1 |
| COMPLEX-EMP1/NRCAM/VCAM1 | 0.827586 | 1 | 0.705882 | KCNK15 AND NOT-GABRG1 AND NOT-SCARA5 | 0.923077 | 0.857143 | 1 |
| PTPRZ1 AND VCAM1 AND NOT-TMEM50B | 0.9375 | 1 | 0.882353 | KCNK15 AND NOT-GHR AND NOT-MRGPRF | 0.923077 | 0.857143 | 1 |
| GPM6B AND SLC2A10 AND NOT-TRPM4 | 0.827586 | 1 | 0.705882 | KCNK15 AND NOT-GHR AND CD163 | 0.923077 | 0.857143 | 1 |
| PTPRZ1 AND CCR1 AND NOT-TRPM4 | 0.903226 | 1 | 0.823529 | KCNK15 AND NOT-SYT4 AND NOT-GYPC | 0.923077 | 0.857143 | 1 |
| PTPRZ1 AND NOT-MST1R AND TMEM119 | 0.875 | 0.933333 | 0.823529 | KCNK15 AND NOT-LRRN4 AND NOT-LAT | 0.923077 | 0.857143 | 1 |
| PTPRZ1 AND VCAM1 AND NOT-SLC12A6 | 0.9375 | 1 | 0.882353 | KCNK15 AND NOT-GABRG1 AND NOT-GYPC | 0.923077 | 0.857143 | 1 |
| PTPRZ1 AND VCAM1 AND NOT-CNNM4 | 0.9375 | 1 | 0.882353 | KCNK15 AND NOT-LRRN4 AND NOT-SCARA5 | 0.923077 | 0.857143 | 1 |
| PTPRZ1 AND VCAM1 AND NOT-FZD4 | 0.9375 | 1 | 0.882353 | KCNK15 AND NOT-LRRN4 AND NOT-LAT | 0.923077 | 0.857143 | 1 |
| PTPRZ1 AND RHCG AND NOT-TRPM4 | 0.9375 | 1 | 0.882353 | KCNK15 AND NOT-GHR AND NOT-ANPEP | 0.923077 | 0.857143 | 1 |
| PTPRZ1 AND VCAM1 AND FAM26F | 0.903226 | 1 | 0.823529 | KCNK15 AND NOT-SYT4 AND NOT-LAT | 0.923077 | 0.857143 | 1 |
| PTPRZ1 AND VCAM1 AND ITGAM | 0.903226 | 1 | 0.823529 | COMPLEX-GHR/SLC13A5/KCNK15 | 0.923077 | 0.857143 | 1 |
| PTPRZ1 AND VCAM1 AND NOT-SLC12A7 | 0.9375 | 1 | 0.882353 | KCNK15 AND NOT-GABRG1 AND NOT-SCARA5 | 0.923077 | 0.857143 | 1 |
| GPM6B AND SLC3A2 AND NOT-CLDN11 | 0.903226 | 1 | 0.823529 | COMPLEX-GHR/CXCL16/KCNK15 | 0.923077 | 0.857143 | 1 |
| GPM6B AND SLC3A2 AND NOT-EDNRB | 0.827586 | 1 | 0.705882 | KCNK15 AND NOT-GHR AND NOT-ALCAM | 0.923077 | 0.857143 | 1 |
| NRCAM AND VCAM1 AND NOT-FGFR2 | 0.909091 | 0.9375 | 0.882353 | KCNK15 AND NOT-GHR AND NOT-SLC9A1 | 0.923077 | 0.857143 | 1 |
| PTPRZ1 AND VCAM1 AND NOT-SLC33A1 | 0.9375 | 1 | 0.882353 | KCNK15 AND NOT-GHR AND EPHA10 | 0.923077 | 0.857143 | 1 |
| NRCAM AND VCAM1 AND NOT-TRPM7 | 0.909091 | 0.9375 | 0.882353 | KCNK15 AND NOT-SYT4 AND NOT-SCARA5 | 0.923077 | 0.857143 | 1 |
| NLGN4X AND VCAM1 AND NOT-LEPR | 0.823529 | 0.823529 | 0.823529 | COMPLEX-GHR/KCNK15/CDH22 | 0.923077 | 0.857143 | 1 |
| PTPRZ1 AND VCAM1 AND NOT-TMEM127 | 0.9375 | 1 | 0.882353 | KCNK15 AND NOT-GHR AND NOT-MEGF11 | 0.923077 | 0.857143 | 1 |
| NRCAM AND VCAM1 AND CYB5R1 | 0.909091 | 0.9375 | 0.882353 | KCNK15 AND NOT-LRRN4 AND NOT-GYPC | 0.923077 | 0.857143 | 1 |
| PTPRZ1 AND VCAM1 AND NOT-TMEM97 | 0.9375 | 1 | 0.882353 | KCNK15 AND NOT-GHR AND NOT-MEGF11 | 0.923077 | 0.857143 | 1 |
| GPM6A AND ANXA1 AND OR1A1 | 0.823529 | 0.823529 | 0.823529 | KCNK15 AND NOT-GHR AND NOT-ATP7A | 0.923077 | 0.857143 | 1 |
| NRCAM AND NOT-STS AND VCAM1 | 0.9375 | 1 | 0.882353 | KCNK15 AND NOT-SYT4 AND NOT-SCARA5 | 0.923077 | 0.857143 | 1 |
| NLGN4X AND LAPTM5 AND NOT-VANGL1 | 0.903226 | 1 | 0.823529 | KCNK15 AND NOT-GABRG1 AND NOT-LAT | 0.923077 | 0.857143 | 1 |
| SYT11 AND LAPTM5 AND RHCG | 1 | 1 | 1 | KCNK15 AND NOT-LRRN4 AND NOT-AOC3 | 0.923077 | 0.857143 | 1 |
| GPM6B AND F2R AND SLC4A8 | 0.866667 | 1 | 0.764706 | COMPLEX-GHR/KCNK15/SLC2A1 | 0.923077 | 0.857143 | 1 |
| GPM6B AND F2R AND SLCO1C1 | 0.866667 | 1 | 0.764706 | COMPLEX-PTPRT/GHR/KCNK15 | 0.923077 | 0.857143 | 1 |
| GPM6B AND F2R AND NOT-AJAP1 | 0.866667 | 1 | 0.764706 | KCNK15 AND NOT-GHR AND NOT-ATP8B2 | 0.923077 | 0.857143 | 1 |
| SYT11 AND F2R AND NOT-SLC12A6 | 0.866667 | 1 | 0.764706 | COMPLEX-SLC17A2/GHR/KCNK15 | 0.923077 | 0.857143 | 1 |
| MLC1 AND SLC2A10 AND NOT-FLVCR1 | 0.866667 | 1 | 0.764706 | KCNK15 AND NOT-GHR AND NOT-CSMD3 | 0.923077 | 0.857143 | 1 |
| SYT11 AND F2R AND TMEM100 | 0.866667 | 1 | 0.764706 | KCNK15 AND NOT-LRRN4 AND NOT-SCARA5 | 0.923077 | 0.857143 | 1 |
| LYPD1 AND LAPTM5 AND NOT-ITGB7 | 0.903226 | 1 | 0.823529 | COMPLEX-GHR/MPL/KCNK15 | 0.923077 | 0.857143 | 1 |
| GPR158 AND F2R AND NOT-SYT2 | 0.83871 | 0.928571 | 0.764706 | COMPLEX-GHR/GRM7/KCNK15 | 0.923077 | 0.857143 | 1 |
| GPR158 AND F2R AND NOT-ATP2C1 | 0.83871 | 0.928571 | 0.764706 | KCNK15 AND NOT-GHR AND HLA-DOB | 0.96 | 0.923077 | 1 |
| GPR158 AND F2R AND NOT-HEG1 | 0.83871 | 0.928571 | 0.764706 | KCNK15 AND NOT-GHR AND GAGE1 | 0.96 | 0.923077 | 1 |
| GPR158 AND F2R AND NOT-TMEM127 | 0.83871 | 0.928571 | 0.764706 | KCNK15 AND NOT-GHR AND FOLH1 | 0.956522 | 1 | 0.916667 |
| GPR158 AND F2R AND NOT-TM9SF2 | 0.83871 | 0.928571 | 0.764706 | KCNK15 AND NOT-SYT4 AND MUC16 | 1 | 1 | 1 |
| GPR158 AND F2R AND NOT-LRRC4 | 0.83871 | 0.928571 | 0.764706 | KCNK15 AND NOT-THBD AND NOT-IL20RA | 1 | 1 | 1 |
| GPR158 AND F2R AND OR1A1 | 0.83871 | 0.928571 | 0.764706 | KCNK15 AND NOT-THBD AND NOT-IL20RA | 1 | 1 | 1 |
| LYPD1 AND LAPTM5 AND NOT-SLC12A6 | 0.903226 | 1 | 0.823529 | COMPLEX-GHR/KCNK15/VTCN1 | 0.923077 | 0.857143 | 1 |
| MLC1 AND SLC2A10 AND NOT-VANGL1 | 0.866667 | 1 | 0.764706 | KCNK15 AND NOT-GHR AND NOT-MOK | 0.923077 | 0.857143 | 1 |
| MLC1 AND SLC2A10 AND NOT-PIK3IP1 | 0.866667 | 1 | 0.764706 | KCNK15 AND NOT-LRRN4 AND BMPR1B | 0.923077 | 0.857143 | 1 |
| MLC1 AND SLC2A10 AND NOT-ZDHHC2 | 0.866667 | 1 | 0.764706 | KCNK15 AND NOT-GHR AND NOT-PCYT1A | 0.923077 | 0.857143 | 1 |
| GPR158 AND F2R AND NOT-EPHA4 | 0.83871 | 0.928571 | 0.764706 | KCNK15 AND NOT-GHR AND ALDH1A1 | 0.923077 | 0.857143 | 1 |
| GPR158 AND F2R AND NOT-ABCA3 | 0.83871 | 0.928571 | 0.764706 | KCNK15 AND NOT-GHR AND GPNMB | 0.923077 | 0.857143 | 1 |
| GPR158 AND F2R AND NOT-IL6ST | 0.83871 | 0.928571 | 0.764706 | KCNK15 AND NOT-GHR AND NOT-ANXA1 | 0.923077 | 0.857143 | 1 |
| LYPD1 AND LAPTM5 AND NOT-LILRB2 | 0.903226 | 1 | 0.823529 | KCNK15 AND NOT-GHR AND NOT-CLDN23 | 0.923077 | 0.857143 | 1 |
| GPR158 AND OR51B6 AND NOT-AJAP1 | 0.842105 | 0.761905 | 0.941176 | KCNK15 AND NOT-GHR AND NOT-CD70 | 0.923077 | 0.857143 | 1 |
| SYT11 AND CDH11 AND RHCG | 0.914286 | 0.888889 | 0.941176 | KCNK15 AND NOT-GHR AND NOT-TPBG | 0.923077 | 0.857143 | 1 |
| MLC1 AND BTN3A3 AND NOT-USP48 | 0.866667 | 1 | 0.764706 | KCNK15 AND NOT-GHR AND NOT-ULBP2 | 0.923077 | 0.857143 | 1 |
| SYT11 AND VAMP8 AND RHCG | 0.888889 | 0.842105 | 0.941176 | KCNK15 AND NOT-GHR AND NOT-MET | 0.923077 | 0.857143 | 1 |
| LYPD1 AND LAPTM5 AND NOT-CD40 | 0.903226 | 1 | 0.823529 | COMPLEX-CD52/GHR/KCNK15 | 0.923077 | 0.857143 | 1 |
| SYT11 AND NOT-ATP8A2 AND RHCG | 0.833333 | 0.789474 | 0.882353 | KCNK15 AND NOT-GHR AND NOT-SDC1 | 0.923077 | 0.857143 | 1 |
| LYPD1 AND LAPTM5 AND NOT-SDC2 | 0.866667 | 1 | 0.764706 | KCNK15 AND NOT-GHR AND NOT-IL11RA | 0.923077 | 0.857143 | 1 |
| LYPD1 AND LAPTM5 AND NOT-YIPF3 | 0.903226 | 1 | 0.823529 | KCNK15 AND NOT-TPBG AND NOT-CD163 | 0.923077 | 0.857143 | 1 |
| GPM6A AND EMP3 AND ADAM29 | 0.827586 | 1 | 0.705882 | KCNK15 AND NOT-LRRN4 AND NOT-TNC | 0.923077 | 0.857143 | 1 |
| GPM6A AND F2R AND ADAM29 | 0.827586 | 1 | 0.705882 | KCNK15 AND NOT-GHR AND NOT-ST8SIA1 | 0.923077 | 0.857143 | 1 |
| MLC1 AND BTN3A3 AND NOT-RER1 | 0.903226 | 1 | 0.823529 | KCNK15 AND NOT-SYT4 AND NOT-TNC | 0.923077 | 0.857143 | 1 |
| GPR158 AND OR51B6 AND NOT-ABCG4 | 0.864865 | 0.8 | 0.941176 | COMPLEX-CD52/GHR/KCNK15 | 0.923077 | 0.857143 | 1 |
| NRCAM AND ATP7A AND NOT-ATP8B1 | 0.909091 | 0.9375 | 0.882353 | COMPLEX-GHR/KCNK15/CXCR5 | 0.923077 | 0.857143 | 1 |
| LYPD1 AND LAPTM5 AND NOT-ZDHHC5 | 0.903226 | 1 | 0.823529 | KCNK15 AND NOT-GABRG1 AND NOT-TNC | 0.923077 | 0.857143 | 1 |
| MLC1 AND TNFSF13B AND NOT-ZDHHC2 | 0.9375 | 1 | 0.882353 | KCNK15 AND NOT-GHR AND NOT-ULBP2 | 0.923077 | 0.857143 | 1 |
| GPR158 AND IL1RAP AND NOT-ABCG4 | 0.827586 | 1 | 0.705882 | KCNK15 AND NOT-GABRG1 AND BMPR1B | 0.923077 | 0.857143 | 1 |
| SYT11 AND NOT-CNTNAP2 AND RHCG | 0.909091 | 0.9375 | 0.882353 | COMPLEX-GHR/KCNK15/MUC16 | 0.923077 | 0.857143 | 1 |
| MLC1 AND BTN3A3 AND NOT-TM9SF2 | 0.903226 | 1 | 0.823529 | COMPLEX-GHR/KCNK15/CLDN9 | 0.923077 | 0.857143 | 1 |
| MLC1 AND BTN3A3 AND NOT-SNAP23 | 0.866667 | 1 | 0.764706 | COMPLEX-ALK/GHR/KCNK15 | 0.923077 | 0.857143 | 1 |
| LYPD1 AND LAPTM5 AND NOT-PNPLA2 | 0.903226 | 1 | 0.823529 | KCNK15 AND NOT-GHR AND NOT-DKK1 | 0.923077 | 0.857143 | 1 |

FIG. 15 (cont.)

| Antigen Pair Logic | F1 | Precision | Recall |
|---|---|---|---|
| GPM6A AND CD93 AND BST2 | 0.827586 | 1 | 0.705882 |
| LYPD1 AND LAPTM5 AND NOT-ITSN1 | 0.903226 | 1 | 0.823529 |
| SYT11 AND CD163 AND NOT-SLC12A6 | 0.842105 | 0.761905 | 0.941176 |
| SYT11 AND NOT-GRM3 AND RHCG | 0.8125 | 0.866667 | 0.764706 |
| GPM6A AND TGFBI AND BST2 | 0.8125 | 0.866667 | 0.764706 |
| GPR158 AND CD163L1 AND NOT-ABCG4 | 0.8125 | 0.866667 | 0.764706 |
| MLC1 AND NOT-S1PR1 AND TLR2 | 0.8125 | 0.866667 | 0.764706 |
| GPM6A AND CD163 AND ADAM29 | 0.827586 | 1 | 0.705882 |
| PTPRZ1 AND NOT-ATP8B1 AND ATP7A | 0.866667 | 1 | 0.764706 |
| MLC1 AND TNFSF13B AND NOT-FLVCR1 | 0.848485 | 0.875 | 0.823529 |
| GPR158 AND FAM57A AND NOT-AJAP1 | 0.83871 | 0.928571 | 0.764706 |
| GPM6B AND NOT-AJAP1 AND PPAPDC1B | 0.823529 | 0.823529 | 0.823529 |
| GPR158 AND SLC11A1 AND NOT-ABCG4 | 0.827586 | 1 | 0.705882 |
| SYT11 AND NOT-SYT4 AND RHCG | 0.848485 | 0.875 | 0.823529 |
| LYPD1 AND PSENEN AND CD163 | 0.827586 | 1 | 0.705882 |
| PTPRZ1 AND NOT-PIK3IP1 AND NOT-FAT1 | 0.909091 | 0.9375 | 0.882353 |
| GPR158 AND SLC11A1 AND NOT-AJAP1 | 0.827586 | 1 | 0.705882 |
| GPR158 AND F2R AND NOT-VAMP5 | 0.8 | 0.923077 | 0.705882 |
| GPM6A AND CD93 AND ADAM29 | 0.8 | 0.923077 | 0.705882 |
| GPM6A AND ANTXR2 AND ADAM29 | 0.8 | 0.923077 | 0.705882 |
| SYT11 AND RHCG AND BST2 | 0.829268 | 0.708333 | 1 |
| NRCAM AND CD163 AND NOT-PPAPDC1B | 0.9375 | 1 | 0.882353 |
| SYT11 AND CD163 AND RHCG | 0.941176 | 0.941176 | 0.941176 |
| GPR158 AND CD58 AND NOT-VAMP1 | 0.827586 | 1 | 0.705882 |
| GPR158 AND RHCG AND NOT-ABCG4 | 0.842105 | 0.761905 | 0.941176 |
| GPR158 AND OR51B6 AND BST2 | 0.864865 | 0.8 | 0.941176 |
| GPR158 AND FAM57A AND NOT-ABCG4 | 0.83871 | 0.928571 | 0.764706 |
| FXYD6 AND LAPTM5 AND NOT-LILRB2 | 0.848485 | 0.875 | 0.823529 |
| FXYD6 AND LAPTM5 AND NOT-CD40 | 0.848485 | 0.875 | 0.823529 |
| CDH10 AND LAPTM5 AND NOT-ZDHHC5 | 0.810811 | 0.75 | 0.882353 |
| PCDH8 AND LAPTM5 AND NOT-CD40 | 0.8125 | 0.866667 | 0.764706 |
| GPR158 AND CD58 AND NOT-SYT2 | 0.8 | 0.923077 | 0.705882 |
| SYT11 AND CD163 AND FNDC4 | 0.864865 | 0.8 | 0.941176 |
| GPM6A AND CD163 AND NOT-PPAPDC1B | 0.827586 | 1 | 0.705882 |
| PTPRZ1 AND NOT-FLVCR1 AND BST2 | 0.875 | 0.933333 | 0.823529 |
| GPM6B AND F2R AND NOT-CLDN11 | 0.866667 | 1 | 0.764706 |
| PTPRZ1 AND LAPTM5 AND VCAM1 | 0.9375 | 1 | 0.882353 |
| PTPRZ1 AND VCAM1 AND GPR158 | 0.9375 | 1 | 0.882353 |
| NRCAM AND LAPTM5 AND VCAM1 | 0.9375 | 1 | 0.882353 |
| NOT-AOC3 AND EDNRB AND ABCA1 | 0.848485 | 0.875 | 0.823529 |
| PTPRZ1 AND VCAM1 AND NOT-PIK3IP1 | 0.9375 | 1 | 0.882353 |
| NRCAM AND VCAM1 AND NOT-ZDHHC2 | 0.909091 | 0.9375 | 0.882353 |
| NRCAM AND BTN3A3 AND VCAM1 | 0.857143 | 0.833333 | 0.882353 |
| NOT-AOC3 AND EDNRB AND ABCC3 | 0.83871 | 0.928571 | 0.764706 |
| CD163L1 AND NOT-AOC3 AND EDNRB | 0.83871 | 0.928571 | 0.764706 |
| MLC1 AND SLC2A10 AND NOT-TRPM4 | 0.866667 | 1 | 0.764706 |
| PTPRZ1 AND VCAM1 AND NOT-SMPD2 | 0.9375 | 1 | 0.882353 |
| PTPRZ1 AND VCAM1 AND NOT-ZDHHC2 | 0.9375 | 1 | 0.882353 |
| SYT11 AND IL1RAP AND EDNRB | 0.827586 | 1 | 0.705882 |
| PTPRZ1 AND VCAM1 AND BST2 | 0.9375 | 1 | 0.882353 |
| PTPRZ1 AND VCAM1 AND BTN3A3 | 0.9375 | 1 | 0.882353 |
| OR51B6 AND EDNRB AND NOT-AOC3 | 0.914286 | 0.888889 | 0.941176 |
| OR51B6 AND NOT-ATP8B1 AND EDNRB | 0.833333 | 0.789474 | 0.882353 |
| SLC11A1 AND NOT-AOC3 AND EDNRB | 0.827586 | 1 | 0.705882 |
| GPR158 AND ADAM12 AND VCAM1 | 0.848485 | 0.875 | 0.823529 |
| NOT-ATP8B1 AND SLC3A2 AND NOT-CD52 | 0.875 | 0.933333 | 0.823529 |
| TENM1 AND NOT-KCNK6 AND TNC | 0.8125 | 0.866667 | 0.764706 |
| GPM6A AND TNC AND ADAM29 | 0.8125 | 0.866667 | 0.764706 |
| GPM6B AND TNC AND NOT-AJAP1 | 0.8125 | 0.866667 | 0.764706 |
| SYT11 AND RHCG AND NOT-SST | 0.848485 | 0.875 | 0.823529 |
| SYT11 AND IL13RA1 AND NOT-SLC12A6 | 0.842105 | 0.761905 | 0.941176 |
| COMPLEX-PIK3IP1/EDNRB/PTPRZ1 | 0.909091 | 0.9375 | 0.882353 |
| TNC AND NOT-KCNK6 AND TSPAN5 | 0.875 | 0.933333 | 0.823529 |
| SYT11 AND RHCG AND GPNMB | 0.914286 | 0.888889 | 0.941176 |
| GPR158 AND OR1A1 AND CBX3 | 0.909091 | 0.9375 | 0.882353 |
| NOT-ATP8B1 AND EDNRB AND SLC3A2 | 0.903226 | 1 | 0.823529 |
| FAT3 AND TNC AND KCND2 | 0.8125 | 0.866667 | 0.764706 |
| SRR AND NOT-AOC3 AND EDNRB | 0.827586 | 1 | 0.705882 |
| PCDH12 AND NOT-AOC3 AND EDNRB | 0.8 | 0.923077 | 0.705882 |
| GPM6A AND BST2 AND CBX3 | 0.8 | 0.923077 | 0.705882 |
| SYT11 AND ABCC3 AND EDNRB | 0.8 | 0.923077 | 0.705882 |
| NOT-ATP8B1 AND ABCA1 AND NOT-CD52 | 0.8 | 0.923077 | 0.705882 |
| GPM6A AND BST2 AND PCYT1A | 0.8 | 0.923077 | 0.705882 |
| NOT-AOC3 AND EDNRB AND IL1RAP | 0.8 | 0.923077 | 0.705882 |
| SYT11 AND RHCG AND AXL | 0.820513 | 0.727273 | 0.941176 |
| TNC AND NOT-AOC3 AND GLDN | 0.83871 | 0.928571 | 0.764706 |
| GPR158 AND SLC7A7 AND NOT-TRPM4 | 0.820513 | 0.727273 | 0.941176 |

| Antigen Pair Logic | F1 | Precision | Recall |
|---|---|---|---|
| KCNK15 AND NOT-SYT4 AND BMPR1B | 0.923077 | 0.857143 | 1 |
| COMPLEX-GHR/KCNK15/CLDN6 | 0.923077 | 0.857143 | 1 |
| KCNK15 AND NOT-GHR AND NOT-STEAP1 | 0.923077 | 0.857143 | 1 |
| KCNK15 AND NOT-CLDN15 AND MUC16 | 0.956522 | 1 | 0.916667 |
| KCNK15 AND NOT-GHR AND NOT-CD70 | 0.923077 | 0.857143 | 1 |
| KCNK15 AND NOT-GHR AND NOT-CLDN23 | 0.923077 | 0.857143 | 1 |
| KCNK15 AND NOT-GHR AND NOT-HSPA5 | 0.923077 | 0.857143 | 1 |
| KCNK15 AND NOT-PROCR AND NOT-ENG | 1 | 1 | 1 |
| KCNK15 AND NOT-PROCR AND NOT-CD52 | 0.96 | 0.923077 | 1 |
| KCNK15 AND NOT-SYT4 AND NOT-GPNMB | 0.96 | 0.923077 | 1 |
| KCNK15 AND NOT-PROCR AND NOT-IL20RA | 0.96 | 0.923077 | 1 |
| KCNK15 AND NOT-CLDN15 AND NOT-IL3RA | 0.916667 | 0.916667 | 0.916667 |
| KCNK15 AND NOT-SYT4 AND NOT-IL3RA | 0.916667 | 0.916667 | 0.916667 |
| KCNK15 AND NOT-GHR AND RNF43 | 0.916667 | 0.916667 | 0.916667 |
| KCNK15 AND NOT-PROCR AND NOT-TRPM4 | 0.96 | 0.923077 | 1 |
| KCNK15 AND NOT-PROCR AND ULBP2 | 0.916667 | 0.916667 | 0.916667 |
| KCNK15 AND NOT-PROCR AND NOT-CLDN8 | 0.96 | 0.923077 | 1 |
| KCNK15 AND NOT-THBD AND CLDN9 | 0.909091 | 1 | 0.833333 |
| KCNK15 AND NOT-THBD AND BIRC5 | 0.909091 | 1 | 0.833333 |
| KCNK15 AND NOT-THBD AND NCAM1 | 0.909091 | 1 | 0.833333 |
| COMPLEX-MRGPRF/EDNRB/KCNK15 | 0.96 | 0.923077 | 1 |
| KCNK15 AND NOT-PTGER4 AND NOT-ENG | 0.923077 | 0.857143 | 1 |
| KCNK15 AND NOT-GABRG1 AND NOT-GPNMB | 0.96 | 0.923077 | 1 |
| KCNK15 AND NOT-LRRN4 AND NOT-GPNMB | 0.96 | 0.923077 | 1 |
| COMPLEX-EDNRB/ALCAM/KCNK15 | 0.96 | 0.923077 | 1 |
| COMPLEX-EDNRB/ATP7A/KCNK15 | 0.923077 | 0.857143 | 1 |
| COMPLEX-BTN3A3/EDNRB/KCNK15 | 0.96 | 0.923077 | 1 |
| KCNK15 AND NOT-CLDN15 AND NOT-TNC | 0.888889 | 0.8 | 1 |
| KCNK15 AND NOT-LRRN4 AND NOT-SPON2 | 0.888889 | 0.8 | 1 |
| KCNK15 AND NOT-LRRN4 AND NOT-AXL | 0.888889 | 0.8 | 1 |
| KCNK15 AND NOT-KDR AND NOT-CD44 | 0.96 | 0.923077 | 1 |
| KCNK15 AND NOT-PTGER4 AND NOT-CLDN23 | 0.888889 | 0.8 | 1 |
| KCNK15 AND NOT-PTGER4 AND NOT-CD52 | 0.923077 | 0.857143 | 1 |
| KCNK15 AND NOT-PIK3IP1 AND NOT-IL3RA | 0.916667 | 0.916667 | 0.916667 |
| KCNK15 AND NOT-PTGER4 AND NOT-IL20RA | 0.888889 | 0.8 | 1 |
| COMPLEX-EDNRB/KCNK15/MSMO1 | 0.916667 | 0.916667 | 0.916667 |
| KCNK15 AND NOT-PTGER4 AND NOT-CLDN8 | 0.923077 | 0.857143 | 1 |
| KCNK15 AND NOT-ANTXR2 AND NOT-IL20RA | 1 | 1 | 1 |
| KCNK15 AND NOT-GHR AND MS4A1 | 0.88 | 0.846154 | 0.916667 |
| KCNK15 AND NOT-GHR AND SST | 0.88 | 0.846154 | 0.916667 |
| KCNK15 AND NOT-ASTN1 AND NOT-CLDN8 | 0.88 | 0.846154 | 0.916667 |
| KCNK15 AND NOT-GHR AND TNC | 0.88 | 0.846154 | 0.916667 |
| KCNK15 AND NOT-FOLR2 AND NOT-NPHS2 | 0.96 | 0.923077 | 1 |
| COMPLEX-ANTXR2/KCNK15/ULBP2 | 1 | 1 | 1 |
| KCNK15 AND NOT-SLC39A8 AND NOT-ENG | 0.909091 | 1 | 0.833333 |
| COMPLEX-ANTXR2/KCNK15/VCAM1 | 1 | 1 | 1 |
| KCNK15 AND NOT-FOLR2 AND NOT-CNTNAP4 | 0.96 | 0.923077 | 1 |
| KCNK15 AND NOT-PTGER4 AND NOT-TRPM4 | 0.888889 | 0.8 | 1 |
| KCNK15 AND NOT-PHLDB2 AND NOT-CD52 | 0.888889 | 0.8 | 1 |
| KCNK15 AND NOT-GHR AND ROR1 | 0.869565 | 0.909091 | 0.833333 |
| KCNK15 AND NOT-FOLR2 AND CD93 | 0.869565 | 0.909091 | 0.833333 |
| KCNK15 AND NOT-CD163 AND NOT-DPEP1 | 0.869565 | 0.909091 | 0.833333 |
| COMPLEX-EDNRB/KCNK15/CD163 | 0.869565 | 0.909091 | 0.833333 |
| KCNK15 AND NOT-AMHR2 AND NOT-CLDN8 | 0.88 | 0.846154 | 0.916667 |
| KCNK15 AND NOT-TTYH2 AND NOT-IL20RA | 0.916667 | 0.916667 | 0.916667 |
| KCNK15 AND NOT-NPHS2 AND NOT-GPNMB | 0.96 | 0.923077 | 1 |
| KCNK15 AND NOT-CD44 AND NOT-DPEP1 | 0.869565 | 0.909091 | 0.833333 |
| KCNK15 AND NOT-MRGPRF AND NOT-GPNMB | 1 | 1 | 1 |
| KCNK15 AND NOT-CD44 AND NOT-CXCR5 | 0.869565 | 0.909091 | 0.833333 |
| KCNK15 AND NOT-CD44 AND NCAM1 | 0.869565 | 0.909091 | 0.833333 |
| KCNK15 AND NOT-SYT4 AND GAGE1 | 0.857143 | 0.75 | 1 |
| KCNK15 AND NOT-ADAM2 AND ULBP2 | 0.857143 | 1 | 0.75 |
| KCNK15 AND NOT-CD44 AND SST | 0.916667 | 0.916667 | 0.916667 |
| KCNK15 AND NOT-DPP10 AND NOT-CLDN8 | 0.857143 | 0.75 | 1 |
| MUC16 AND NOT-CD74 AND NOT-THBD | 0.8 | 1 | 0.666667 |
| MUC16 AND NOT-CD74 AND NOT-SCARA5 | 0.8 | 1 | 0.666667 |
| MUC16 AND NOT-CD44 AND NOT-MSMO1 | 0.8 | 1 | 0.666667 |
| MUC16 AND NOT-CD44 AND NOT-LRRC8E | 0.8 | 1 | 0.666667 |
| MUC16 AND NOT-CD44 AND NOT-SYT4 | 0.8 | 1 | 0.666667 |
| MUC16 AND NOT-CD44 AND NOT-CDH9 | 0.8 | 1 | 0.666667 |
| NOT-CD44 AND RNF43 AND NOT-ANTXR2 | 0.833333 | 0.833333 | 0.833333 |
| ERBB4 AND NOT-CD74 AND NOT-DTNA | 0.8 | 0.769231 | 0.833333 |
| NOT-ADAM2 AND LRRC8E AND NOT-PTK7 | 0.909091 | 1 | 0.833333 |
| COMPLEX-CLDN23/EDNRB/KCNK15 | 0.96 | 0.923077 | 1 |
| COMPLEX-EDNRB/KCNK15/VCAM1 | 0.916667 | 0.916667 | 0.916667 |
| KCNK15 AND NOT-TPBG AND NOT-CLDN8 | 0.88 | 0.846154 | 0.916667 |
| KCNK15 AND NOT-KDR AND NOT-CLDN8 | 0.88 | 0.846154 | 0.916667 |

FIG. 15 (cont.)

| Antigen Pair Logic | F1 | Precision | Recall |
|---|---|---|---|
| GPR158 AND OR51B6 AND VCAM1 | 0.864865 | 0.8 | 0.941176 |
| GPR158 AND PCYT1A AND NOT-ATP2C1 | 0.8 | 0.923077 | 0.705882 |
| COMPLEX-EDNRB/ATP8B1/PTPRZ1 | 0.909091 | 0.9375 | 0.882353 |
| GPR158 AND OR51B6 AND EDNRB | 0.888889 | 0.842105 | 0.941176 |
| FZD3 AND VCAM1 AND LAPTM5 | 0.8 | 0.923077 | 0.705882 |
| GPR158 AND OR1A1 AND PCYT1A | 0.8 | 0.923077 | 0.705882 |
| COMPLEX-EDNRB/FLVCR1/PTPRZ1 | 0.875 | 0.933333 | 0.823529 |
| SYT11 AND IL13RA1 AND FNDC4 | 0.833333 | 0.789474 | 0.882353 |
| TNC AND NOT-KCNK6 AND PRIMA1 | 0.8125 | 0.866667 | 0.764706 |
| LYPD1 AND SLC2A10 AND NOT-TRPM4 | 0.866667 | 1 | 0.764706 |
| COMPLEX-PTPRZ1/BST2/CLDN12 | 0.909091 | 0.9375 | 0.882353 |
| GPR158 AND PCYT1A AND NOT-TMEM127 | 0.8 | 0.923077 | 0.705882 |
| SYT11 AND RHCG AND CBX3 | 0.83871 | 0.928571 | 0.764706 |
| SYT11 AND PCYT1A AND NOT-SLC12A6 | 0.8 | 0.923077 | 0.705882 |
| SYT11 AND WLS AND EDNRB | 0.866667 | 1 | 0.764706 |
| PAQR6 AND LAPTM5 AND VCAM1 | 0.8125 | 0.866667 | 0.764706 |
| GPR158 AND RHCG AND VCAM1 | 0.820513 | 0.727273 | 0.941176 |
| SLC11A1 AND NOT-IL15RA AND EDNRB | 0.827586 | 1 | 0.705882 |
| GPR158 AND PCYT1A AND NOT-ABCA3 | 0.8 | 0.923077 | 0.705882 |
| SLCO1C1 AND SLC2A10 AND NOT-TRPM4 | 0.866667 | 1 | 0.764706 |
| OR51B6 AND NOT-CD19 AND CD83 | 0.857143 | 0.833333 | 0.882353 |
| PTPRS AND RHCG AND NOT-ERBB2 | 0.888889 | 0.842105 | 0.941176 |
| PTPRZ1 AND VCAM1 AND NOT-TRPM4 | 0.9375 | 1 | 0.882353 |
| NRCAM AND CD70 AND VCAM1 | 0.909091 | 0.9375 | 0.882353 |
| PTPRZ1 AND VCAM1 AND CD70 | 0.9375 | 1 | 0.882353 |
| GPM6B AND TNC AND NOT-CLDN11 | 0.8125 | 0.866667 | 0.764706 |
| COMPLEX-EDNRB/PTPRZ1/CD70 | 0.909091 | 0.9375 | 0.882353 |
| OR51B6 AND EDNRB AND NOT-RNF43 | 0.888889 | 0.842105 | 0.941176 |
| BMPR1B AND EDNRB AND FAM57A | 0.8 | 0.923077 | 0.705882 |
| OR51B6 AND EDNRB AND NOT-TRPM4 | 0.864865 | 0.8 | 0.941176 |
| OR51B6 AND EDNRB AND NOT-CLDN8 | 0.864865 | 0.8 | 0.941176 |
| BMPR1B AND PTPRS AND CD70 | 0.8125 | 0.866667 | 0.764706 |
| PTPRS AND NOT-CLDN8 AND SLC39A6 | 0.83871 | 0.928571 | 0.764706 |
| GPR158 AND F2R AND NOT-AJAP1 | 0.83871 | 0.928571 | 0.764706 |
| GPR158 AND F2R AND NOT-ABCG4 | 0.83871 | 0.928571 | 0.764706 |
| LYPD1 AND LAPTM5 AND NOT-VANGL1 | 0.903226 | 1 | 0.823529 |
| GPR158 AND F2R AND NOT-BST2 | 0.8 | 0.923077 | 0.705882 |
| CDH10 AND LAPTM5 AND NOT-VANGL1 | 0.810811 | 0.75 | 0.882353 |
| PCDH8 AND LAPTM5 AND NOT-VANGL1 | 0.8125 | 0.866667 | 0.764706 |
| LYPD1 AND CD163 AND NOT-PPAPDC1B | 0.903226 | 1 | 0.823529 |
| LYPD1 AND BST2 AND NOT-GPR158 | 0.83871 | 0.928571 | 0.764706 |
| LYPD1 AND BST2 AND NOT-PPAPDC1B | 0.875 | 0.933333 | 0.823529 |
| LYPD1 AND BST2 AND NOT-FLVCR1 | 0.875 | 0.933333 | 0.823529 |
| SCN2A AND LAPTM5 AND NOT-VANGL1 | 0.866667 | 1 | 0.764706 |
| MLC1 AND NOT-FLVCR1 AND BST2 | 0.8 | 0.923077 | 0.705882 |
| SYT11 AND F2R AND EDNRB | 0.866667 | 1 | 0.764706 |
| BMPR1B AND NOT-VANGL1 AND LAPTM5 | 0.820513 | 0.727273 | 0.941176 |
| GPR158 AND PCYT1A AND NOT-AJAP1 | 0.8 | 0.923077 | 0.705882 |
| NOT-ATP8B1 AND NOT-CD52 AND LAPTM5 | 0.8 | 0.923077 | 0.705882 |
| SLCO1C1 AND LAPTM5 AND VCAM1 | 0.823529 | 0.823529 | 0.823529 |
| GPR158 AND BST2 AND PCYT1A | 0.8 | 0.923077 | 0.705882 |
| GPR158 AND PCYT1A AND NOT-ABCG4 | 0.827586 | 1 | 0.705882 |
| LYPD1 AND BST2 AND NOT-CLDN12 | 0.875 | 0.933333 | 0.823529 |
| NOT-ATP8B1 AND EDNRB AND SLC31A1 | 0.8 | 0.923077 | 0.705882 |
| EDNRB AND NOT-IL15RA AND CXCL16 | 0.83871 | 0.928571 | 0.764706 |
| TNC AND NOT-AOC3 AND EDNRB | 0.848485 | 0.875 | 0.823529 |
| SYT11 AND EDNRB AND CBX3 | 0.857143 | 0.833333 | 0.882353 |
| BMPR1B AND VCAM1 AND LAPTM5 | 0.842105 | 0.761905 | 0.941176 |
| GPR158 AND VCAM1 AND PCYT1A | 0.8 | 0.923077 | 0.705882 |
| GPR158 AND EDNRB AND PCYT1A | 0.8 | 0.923077 | 0.705882 |
| Glioma | | | |
| GPM6A AND F2R AND NOT-SLC6A5 | 0.985294 | 1 | 0.971014 |
| GPM6A AND F2R AND NOT-HTR7 | 0.992701 | 1 | 0.985507 |
| GPM6A AND F2R AND NOT-TNFRSF18 | 0.985294 | 1 | 0.971014 |
| GPM6A AND F2R AND NOT-C14orf180 | 0.992701 | 1 | 0.985507 |
| GPM6A AND F2R AND NOT-SLC6A3 | 0.985294 | 1 | 0.971014 |
| GPM6A AND F2R AND NOT-OR7A17 | 0.992701 | 1 | 0.985507 |
| GPM6A AND F2R AND NOT-SLC7A4 | 0.992701 | 1 | 0.985507 |
| GPM6A AND F2R AND NOT-SLC30A2 | 0.985294 | 1 | 0.971014 |
| GPM6A AND F2R AND NOT-HRH2 | 0.977778 | 1 | 0.956522 |
| GPM6A AND F2R AND NOT-FZD10 | 0.977778 | 1 | 0.956522 |
| GPM6A AND F2R AND NOT-SLC1A7 | 0.977778 | 1 | 0.956522 |
| GPM6A AND F2R AND NOT-PCDHA5 | 0.985294 | 1 | 0.971014 |
| GPM6A AND F2R AND NOT-MC3R | 0.992701 | 1 | 0.985507 |
| GPM6A AND F2R AND NOT-AQP8 | 0.992701 | 1 | 0.985507 |
| GPM6A AND F2R AND NOT-MEP1B | 0.992701 | 1 | 0.985507 |
| GPM6A AND F2R AND NOT-LY9 | 0.992701 | 1 | 0.985507 |

| Antigen Pair Logic | F1 | Precision | Recall |
|---|---|---|---|
| KCNK15 AND NOT-ENG AND NOT-GPNMB | 1 | 1 | 1 |
| KCNK15 AND NOT-SPON2 AND NOT-IL20RA | 0.909091 | 1 | 0.833333 |
| KCNK15 AND NOT-CD52 AND NOT-GPNMB | 0.96 | 0.923077 | 1 |
| KCNK15 AND NOT-GPNMB AND NOT-CLDN8 | 0.96 | 0.923077 | 1 |
| KCNK15 AND NOT-GPNMB AND NOT-TRPM4 | 0.96 | 0.923077 | 1 |
| KCNK15 AND NOT-GPNMB AND NOT-IL20RA | 0.96 | 0.923077 | 1 |
| KCNK15 AND NOT-MET AND NOT-CLDN8 | 0.916667 | 0.916667 | 0.916667 |
| KCNK15 AND NOT-ENG AND NOT-VCAM1 | 0.827586 | 0.705882 | 1 |
| KCNK15 AND NOT-KDR AND NOT-CD52 | 0.827586 | 0.705882 | 1 |
| KCNK15 AND NOT-MET AND NOT-CD52 | 0.827586 | 0.705882 | 1 |
| KCNK15 AND NOT-ENG AND NOT-VCAM1 | 0.827586 | 0.705882 | 1 |
| COMPLEX-EDNRB/IL20RA/KCNK15 | 0.827586 | 0.705882 | 1 |
| KCNK15 AND NOT-ROR1 AND NOT-CLDN8 | 0.88 | 0.846154 | 0.916667 |
| COMPLEX-CD52/KCNK15/SST | 0.827586 | 0.705882 | 1 |
| COMPLEX-ALDH1A1/KCNK15/VCAM1 | 0.818182 | 0.9 | 0.75 |
| KCNK15 AND NOT-ENG AND NOT-MET | 0.8 | 0.666667 | 1 |
| MUC16 AND NOT-PROM1 AND CELSR3 | 0.8 | 1 | 0.666667 |
| MUC16 AND NOT-MTUS1 AND NOT-MS4A1 | 0.8 | 1 | 0.666667 |
| MUC16 AND NOT-CLDN23 AND CELSR3 | 0.8 | 1 | 0.666667 |
| COMPLEX-CLDN23/OAS1/KCNK15 | 0.8 | 0.666667 | 1 |
| MUC16 AND NOT-PROM1 AND NOT-JAM3 | 0.8 | 1 | 0.666667 |
| COMPLEX-CLDN23/KCNK15/SST | 0.8 | 0.666667 | 1 |
| COMPLEX-CLDN23/ENG/KCNK15 | 0.8 | 0.666667 | 1 |
| COMPLEX-CLDN23/ENG/KCNK15 | 0.8 | 0.666667 | 1 |
| KCNK15 AND NOT-ENG AND NOT-ROR1 | 0.8 | 0.666667 | 1 |
| MUC16 AND NOT-MTUS1 AND NOT-CD52 | 0.8 | 1 | 0.666667 |
| COMPLEX-ENG/OAS1/KCNK15 | 0.8 | 0.666667 | 1 |
| COMPLEX-ENG/IL20RA/KCNK15 | 0.8 | 0.666667 | 1 |
| COMPLEX-ENG/STEAP1/KCNK15 | 0.8 | 0.666667 | 1 |
| MUC16 AND NOT-MTUS1 AND NOT-P2RX5 | 0.8 | 1 | 0.666667 |
| COMPLEX-ENG/IL20RA/KCNK15 | 0.8 | 0.666667 | 1 |
| COMPLEX-ENG/KCNK15/SST | 0.8 | 0.666667 | 1 |
| COMPLEX-ENG/TNC/KCNK15 | 0.8 | 0.666667 | 1 |
| KCNK15 AND NOT-KDR AND NOT-ENG | 0.8 | 0.666667 | 1 |
| COMPLEX-ENG/IL11RA/KCNK15 | 0.8 | 0.666667 | 1 |
| MUC16 AND NOT-PTK7 AND CELSR3 | 0.8 | 1 | 0.666667 |
| MUC16 AND NOT-IGF1R AND CELSR3 | 0.8 | 1 | 0.666667 |
| MUC16 AND SUSD3 AND NOT-CD19 | 0.8 | 1 | 0.666667 |
| NOT-CD44 AND LRRC8E AND NOT-ADAM2 | 0.909091 | 1 | 0.833333 |
| NOT-ADAM2 AND LRRC8E AND NOT-CD74 | 0.909091 | 1 | 0.833333 |
| NOT-GRID1 AND LRRC8E AND NOT-CD44 | 0.8 | 1 | 0.666667 |
| NOT-CD44 AND LRRC8E AND NOT-MRGPRF | 0.8 | 0.769231 | 0.833333 |
| EPHA10 AND LRRC8E AND NOT-SELP | 0.818182 | 0.9 | 0.75 |
| NOT-EMP3 AND LRRC8E AND NOT-CD44 | 0.8 | 1 | 0.666667 |
| NOT-ADAM2 AND LRRC8E AND NOT-MLANA | 0.909091 | 1 | 0.833333 |
| NOT-CD44 AND LRRC8E AND NOT-MLC1 | 0.8 | 1 | 0.666667 |
| KCNK15 AND NOT-DSC3 AND NOT-ERBB2 | 1 | 1 | 1 |
| KCNK15 AND NOT-TNFSF13B AND NOT-ERBB2 | 1 | 1 | 1 |
| KCNK15 AND NOT-PTPRZ1 AND NOT-ERBB2 | 1 | 1 | 1 |
| KCNK15 AND NOT-PTGDR AND NOT-ERBB2 | 0.888889 | 0.8 | 1 |
| KCNK15 AND NOT-CNIH3 AND NOT-ERBB2 | 0.888889 | 0.8 | 1 |
| KCNK15 AND NOT-SLC44A1 AND NOT-ERBB2 | 0.8 | 0.666667 | 1 |
| KCNK15 AND NOT-LSAMP AND NOT-ERBB2 | 0.8 | 0.666667 | 1 |
| KCNK15 AND NOT-SYT1 AND NOT-ERBB2 | 0.8 | 0.666667 | 1 |
| KCNK15 AND NOT-TRPA1 AND NOT-ERBB2 | 0.8 | 0.666667 | 1 |
| KCNK15 AND CELSR3 AND NOT-ERBB2 | 0.8 | 0.666667 | 1 |
| KCNK15 AND NOT-CLEC4M AND NOT-ERBB2 | 0.8 | 0.666667 | 1 |
| KCNK15 AND NOT-SGCG AND NOT-ERBB2 | 0.8 | 0.666667 | 1 |
| KCNK15 AND NOT-CNGB3 AND NOT-ERBB2 | 0.8 | 0.666667 | 1 |
| COMPLEX-STX6/ERBB2/KCNK15 | 0.8 | 0.666667 | 1 |
| KCNK15 AND NOT-SCTR AND NOT-ERBB2 | 0.8 | 0.666667 | 1 |
| KCNK15 AND NOT-LMBRD1 AND NOT-ERBB2 | 0.8 | 0.666667 | 1 |
| KCNK15 AND NOT-BBS4 AND NOT-ERBB2 | 0.8 | 0.666667 | 1 |
| NOT-SLC16A7 AND PCDH18 AND NOT-ERBB2 | 0.8 | 0.666667 | 1 |
| NOT-PPAP2B AND PCDH18 AND NOT-ERBB2 | 0.923077 | 0.857143 | 1 |
| KCNK15 AND NOT-CLDN15 AND NOT-ERBB2 | 0.8 | 0.666667 | 1 |
| KCNK15 AND NOT-GABRG1 AND NOT-ERBB2 | 0.8 | 0.666667 | 1 |
| KCNK15 AND NOT-LRRN4 AND NOT-ERBB2 | 0.8 | 0.666667 | 1 |
| KCNK15 AND NOT-SYT4 AND NOT-ERBB2 | 0.8 | 0.666667 | 1 |
| MUC16 AND NOT-ERBB2 AND CELSR3 | 0.8 | 1 | 0.666667 |
| Prostate Cancer | | | |
| OR51E2 AND NOT-ACE AND NOT-BMP2 | 1 | 1 | 1 |
| COMPLEX-NPY2R/SGCD/OR51E2 | 1 | 1 | 1 |
| OR51E2 AND NOT-DAGLB AND NOT-DAGLA | 1 | 1 | 1 |
| OR51E2 AND NOT-ACE AND NOT-TLR5 | 1 | 1 | 1 |
| COMPLEX-PIANP/SGCD/OR51E2 | 1 | 1 | 1 |
| COMPLEX-GRPR/SGCD/OR51E2 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| GPM6A AND F2R AND NOT-OR10H1 | 0.985294 | 1 | 0.971014 | OR51E2 AND NOT-ACE AND NOT-KCNK1 | 1 | 1 | 1 |
| GPM6A AND F2R AND NOT-GPR87 | 0.992701 | 1 | 0.985507 | OR51E2 AND NOT-ACE AND NOT-ADRA2C | 1 | 1 | 1 |
| GPM6A AND F2R AND NOT-ITGA9 | 0.985294 | 1 | 0.971014 | OR51E2 AND NOT-SI AND NOT-MYADM | 1 | 1 | 1 |
| PTPRZ1 AND F2R AND NOT-SYT8 | 0.985294 | 1 | 0.971014 | OR51E2 AND NOT-ABCG2 AND NOT-ACE | 1 | 1 | 1 |
| GPM6A AND F2R AND NOT-GPR35 | 0.977778 | 1 | 0.956522 | OR51E2 AND NOT-FLRT3 AND NOT-SI | 1 | 1 | 1 |
| GPM6A AND F2R AND NOT-OR2S2 | 0.977778 | 1 | 0.956522 | OR51E2 AND NOT-ACE AND NOT-CD69 | 1 | 1 | 1 |
| GPM6A AND F2R AND NOT-TAAR5 | 0.992701 | 1 | 0.985507 | OR51E2 AND NOT-FAT4 AND NOT-SI | 1 | 1 | 1 |
| GPM6A AND F2R AND NOT-GJB3 | 0.992701 | 1 | 0.985507 | OR51E2 AND NOT-FAT4 AND NOT-ACE | 1 | 1 | 1 |
| COMPLEX-SULF2/PTPRZ1/SLC1A6 | 0.985294 | 1 | 0.971014 | OR51E2 AND NOT-ACE AND KCNG3 | 1 | 1 | 1 |
| GPM6A AND F2R AND NOT-ILDR1 | 0.992701 | 1 | 0.985507 | OR51E2 AND NOT-SLC25A4 AND PTPRCAP | 1 | 1 | 1 |
| GPM6A AND F2R AND NOT-OPN1SW | 0.985294 | 1 | 0.971014 | OR51E2 AND NOT-STX2 AND NOT-SLC2A5 | 1 | 1 | 1 |
| GPM6A AND F2R AND NOT-KLRD1 | 0.992701 | 1 | 0.985507 | OR51E2 AND NOT-ACE AND NOT-SLC8A1 | 1 | 1 | 1 |
| GPM6A AND F2R AND CD63 | 0.992701 | 1 | 0.985507 | OR51E2 AND NOT-CX3CL1 AND NOT-SLC2A5 | 1 | 1 | 1 |
| GPM6A AND F2R AND NOT-OR10A4 | 0.992701 | 1 | 0.985507 | OR51E2 AND NOT-ACE AND NOT-LEPR | 1 | 1 | 1 |
| PTPRZ1 AND F2R AND NOT-WNT3 | 0.985294 | 1 | 0.971014 | OR51E2 AND NOT-VAMP1 AND NOT-SLC2A5 | 1 | 1 | 1 |
| PTPRZ1 AND F2R AND NOT-GJB5 | 0.985294 | 1 | 0.971014 | COMPLEX-GJB6/SGCD/OR51E2 | 1 | 1 | 1 |
| GPM6A AND F2R AND NOT-ADAM28 | 0.992701 | 1 | 0.985507 | OR51E2 AND NOT-MCAM AND NOT-DAGLA | 1 | 1 | 1 |
| GPM6A AND F2R AND NOT-ICAM2 | 0.992701 | 1 | 0.985507 | COMPLEX-GLDN/LSR/OR51E2 | 1 | 1 | 1 |
| GPM6A AND F2R AND NOT-PAQR9 | 0.992701 | 1 | 0.985507 | COMPLEX-SGCD/ABCC8/OR51E2 | 1 | 1 | 1 |
| GPM6A AND F2R AND NOT-ENTPD2 | 0.992701 | 1 | 0.985507 | COMPLEX-ITPR3/SGCD/OR51E2 | 1 | 1 | 1 |
| GPM6A AND F2R AND NOT-PAQR6 | 0.992701 | 1 | 0.985507 | OR51E2 AND NOT-CX3CL1 AND NOT-ACE | 1 | 1 | 1 |
| GPM6A AND F2R AND NOT-C1QTNF1 | 0.992701 | 1 | 0.985507 | OR51E2 AND NOT-KCNE4 AND NOT-ACE | 1 | 1 | 1 |
| GPM6A AND F2R AND NOT-ZDHHC20 | 0.992701 | 1 | 0.985507 | COMPLEX-PCDHB7/SGCD/OR51E2 | 1 | 1 | 1 |
| GPM6A AND F2R AND NOT-KCNE2 | 0.992701 | 1 | 0.985507 | OR51E2 AND NOT-ACE AND NOT-CLCA4 | 1 | 1 | 1 |
| GPM6A AND F2R AND NOT-SLC38A4 | 0.992701 | 1 | 0.985507 | OR51E2 AND NOT-STX4 AND NOT-DAGLA | 1 | 1 | 1 |
| GPM6A AND F2R AND NOT-PIGR | 0.992701 | 1 | 0.985507 | OR51E2 AND NOT-ACE AND NOT-FLRT3 | 1 | 1 | 1 |
| GPM6A AND F2R AND SLC25A3 | 0.992701 | 1 | 0.985507 | OR51E2 AND NOT-CD247 AND NOT-VIMP | 1 | 1 | 1 |
| GPM6A AND F2R AND NOT-CLEC4D | 0.992701 | 1 | 0.985507 | OR51E2 AND NOT-SLC24A3 AND GABRB3 | 1 | 1 | 1 |
| GPM6A AND F2R AND NOT-MGAM | 0.985294 | 1 | 0.971014 | OR51E2 AND NOT-EFNB3 AND NPFFR2 | 1 | 1 | 1 |
| GPM6A AND F2R AND NOT-NCAM2 | 0.992701 | 1 | 0.985507 | OR51E2 AND NOT-STX4 AND NOT-SLC2A5 | 1 | 1 | 1 |
| GPM6A AND F2R AND NOT-RXFP2 | 0.992701 | 1 | 0.985507 | OR51E2 AND NOT-ACE AND NOT-ENPP2 | 1 | 1 | 1 |
| GPM6A AND F2R AND NOT-OR51M1 | 0.985294 | 1 | 0.971014 | COMPLEX-OR51E2/CACNA1H/CD40 | 1 | 1 | 1 |
| GPM6A AND F2R AND NOT-HCRTR1 | 0.985294 | 1 | 0.971014 | OR51E2 AND NOT-STX7 AND NOT-DAGLA | 1 | 1 | 1 |
| GPM6A AND TSPAN6 AND NOT-SLC9B1 | 0.970588 | 0.985075 | 0.956522 | COMPLEX-NTSR1/SGCD/OR51E2 | 1 | 1 | 1 |
| GPM6A AND TSPAN6 AND NOT-FGF6 | 0.970588 | 0.985075 | 0.956522 | COMPLEX-FZD2/SGCD/OR51E2 | 1 | 1 | 1 |
| GPM6A AND TSPAN6 AND NOT-ABCG5 | 0.970588 | 0.985075 | 0.956522 | OR51E2 AND NOT-SEMA6D AND NOT-ACE | 1 | 1 | 1 |
| GPM6A AND TSPAN6 AND NOT-OR3A2 | 0.970588 | 0.985075 | 0.956522 | OR51E2 AND NOT-EFNB3 AND NOT-CD81 | 1 | 1 | 1 |
| GPM6A AND TSPAN6 AND NOT-ZP4 | 0.970588 | 0.985075 | 0.956522 | COMPLEX-GLDN/OR51E2/CDH1 | 1 | 1 | 1 |
| GPM6A AND F2R AND NOT-GPR18 | 0.992701 | 1 | 0.985507 | COMPLEX-KCND1/SGCD/OR51E2 | 1 | 1 | 1 |
| GPM6A AND TSPAN6 AND NOT-SLC26A8 | 0.970588 | 0.985075 | 0.956522 | OR51E2 AND NOT-TPCN2 AND NOT-SLC2A5 | 1 | 1 | 1 |
| GPM6A AND TSPAN6 AND NOT-BEST2 | 0.970588 | 0.985075 | 0.956522 | OR51E2 AND NOT-FAT4 AND NOT-ACE | 1 | 1 | 1 |
| GPM6A AND TSPAN6 AND NOT-MUC17 | 0.970588 | 0.985075 | 0.956522 | OR51E2 AND NOT-TM7SF3 AND NOT-ACE | 1 | 1 | 1 |
| GPM6A AND TSPAN6 AND NOT-LRRN4 | 0.970588 | 0.985075 | 0.956522 | COMPLEX-TACSTD2/SGCD/OR51E2 | 1 | 1 | 1 |
| GPM6A AND TSPAN6 AND NOT-KCNJ9 | 0.970588 | 0.985075 | 0.956522 | OR51E2 AND NOT-DNER AND NOT-EFNB3 | 1 | 1 | 1 |
| GPM6A AND F2R AND NOT-CDH24 | 0.977778 | 1 | 0.956522 | OR51E2 AND NOT-SGCA AND NOT-DAGLA | 1 | 1 | 1 |
| GPM6A AND F2R AND NOT-ITGAD | 0.970149 | 1 | 0.942029 | COMPLEX-NRG1/SGCD/OR51E2 | 1 | 1 | 1 |
| COMPLEX-TNFRSF12A/SULF2/PTPRZ1 | 0.970149 | 1 | 0.942029 | OR51E2 AND NOT-KCNJ15 AND KCNMB2 | 1 | 1 | 1 |
| COMPLEX-IFNAR2/SULF2/PTPRZ1 | 0.970149 | 1 | 0.942029 | OR51E2 AND NOT-ADCY5 AND NOT-DAGLA | 1 | 1 | 1 |
| GPM6A AND F2R AND NOT-PTPRH | 0.977778 | 1 | 0.956522 | OR51E2 AND NOT-SLC23A1 AND NOT-DAGLA | 1 | 1 | 1 |
| GPM6A AND PLGRKT AND NOT-FGF6 | 0.970149 | 1 | 0.942029 | OR51E2 AND NOT-SLC24A3 AND NOT-DAGLA | 1 | 1 | 1 |
| PTPRZ1 AND NOT-LRP11 AND NOT-KCNA7 | 0.985507 | 0.985507 | 0.985507 | OR51E2 AND NOT-SLC23A1 AND NOT-SLC2A5 | 1 | 1 | 1 |
| GPM6A AND TSPAN6 AND NOT-SLC22A11 | 0.977778 | 1 | 0.956522 | OR51E2 AND NOT-JPH1 AND NOT-ACE | 1 | 1 | 1 |
| GPM6A AND TSPAN6 AND NOT-KCNA4 | 0.970588 | 0.985075 | 0.956522 | OR51E2 AND NOT-TM7SF3 AND SIRPG | 1 | 1 | 1 |
| GPM6A AND TSPAN6 AND NOT-GJB4 | 0.970588 | 0.985075 | 0.956522 | OR51E2 AND VMP1 AND NOT-MYADM | 1 | 1 | 1 |
| GPM6A AND TSPAN6 AND ATP13A5 | 0.970588 | 0.985075 | 0.956522 | COMPLEX-ADRB1/GLDN/OR51E2 | 1 | 1 | 1 |
| GPM6A AND PLGRKT AND NOT-MUC17 | 0.970149 | 1 | 0.942029 | COMPLEX-SGCD/SLC8A1/OR51E2 | 1 | 1 | 1 |
| PTPRZ1 AND NOT-LRP11 AND NOT-FUT3 | 0.985294 | 1 | 0.971014 | OR51E2 AND NOT-ACE AND NOT-FLRT3 | 1 | 1 | 1 |
| GPM6A AND SLC40A1 AND NOT-SLCO1A2 | 0.970588 | 0.985075 | 0.956522 | OR51E2 AND NOT-FAT4 AND NOT-SI | 1 | 1 | 1 |
| PTPRZ1 AND F2R AND NOT-PVRL4 | 0.985294 | 1 | 0.971014 | OR51E2 AND NOT-ACE AND NOT-CD69 | 1 | 1 | 1 |
| PTPRZ1 AND F2R AND NOT-GPR87 | 0.985294 | 1 | 0.971014 | OR51E2 AND NOT-ACE AND NOT-SLC16A14 | 1 | 1 | 1 |
| COMPLEX-CRB1/KIAA1324/PTPRZ1 | 0.970588 | 0.985075 | 0.956522 | OR51E2 AND NOT-ADCY5 AND PTPRCAP | 1 | 1 | 1 |
| PTPRZ1 AND NOT-GJB5 AND NOT-GRM3 | 0.992701 | 1 | 0.985507 | OR51E2 AND NOT-SLC2A5 AND NOT-MYADM | 1 | 1 | 1 |
| PTPRZ1 AND NOT-PVRL4 AND NOT-GRM3 | 0.992701 | 1 | 0.985507 | OR51E2 AND NOT-SLC25A4 AND GABRB3 | 1 | 1 | 1 |
| PTPRZ1 AND NOT-GRM3 AND NOT-GPR87 | 0.992701 | 1 | 0.985507 | OR51E2 AND NOT-ACE AND NOT-PTPRE | 1 | 1 | 1 |
| PTPRZ1 AND NOT-LRP11 AND NOT-MTNR1B | 0.985507 | 0.985507 | 0.985507 | OR51E2 AND NOT-ACE AND NOT-ADCY3 | 1 | 1 | 1 |
| GPM6A AND PLGRKT AND NOT-LRRN4 | 0.970149 | 1 | 0.942029 | OR51E2 AND NOT-PDE6B AND NOT-PLP2 | 1 | 1 | 1 |
| GPM6A AND PLGRKT AND NOT-ZP4 | 0.970149 | 1 | 0.942029 | OR51E2 AND NOT-SLC2A5 AND NOT-WDR19 | 1 | 1 | 1 |
| GPM6A AND PLGRKT AND NOT-BEST2 | 0.970149 | 1 | 0.942029 | COMPLEX-OR10A5/SGCD/OR51E2 | 1 | 1 | 1 |
| PTPRZ1 AND NOT-CD3G AND NOT-LRP11 | 0.977778 | 1 | 0.956522 | OR51E2 AND NOT-SDC3 AND NOT-ACE | 1 | 1 | 1 |
| COMPLEX-TNFSF13B/SULF2/PTPRZ1 | 0.977778 | 1 | 0.956522 | OR51E2 AND NOT-ACE AND NOT-CNTN1 | 1 | 1 | 1 |
| PTPRZ1 AND NOT-LRP11 AND HLA-B | 0.992701 | 1 | 0.985507 | OR51E2 AND NOT-PDE6B AND KCNMB2 | 1 | 1 | 1 |
| COMPLEX-MSR1/SULF2/PTPRZ1 | 0.985294 | 1 | 0.971014 | OR51E2 AND NOT-NDRG4 AND NOT-SLC2A5 | 1 | 1 | 1 |
| COMPLEX-MERTK/SULF2/PTPRZ1 | 0.977778 | 1 | 0.956522 | OR51E2 AND NOT-HAS3 AND NOT-DAGLA | 1 | 1 | 1 |
| PTPRZ1 AND NOT-EFNA5 AND NOT-PAQR6 | 0.978102 | 0.985294 | 0.971014 | OR51E2 AND NOT-ACE AND NOT-SIRPA | 1 | 1 | 1 |
| PTPRZ1 AND NOT-EFNA5 AND IFNGR2 | 0.985294 | 1 | 0.971014 | OR51E2 AND NOT-HAS3 AND PTPRCAP | 1 | 1 | 1 |
| PTPRZ1 AND NOT-EFNA5 AND SLC39A14 | 0.985294 | 1 | 0.971014 | OR51E2 AND NOT-NRSN2 AND NOT-SLC2A5 | 1 | 1 | 1 |
| PTPRZ1 AND NOT-LRP11 AND NOT-SLC6A3 | 0.978102 | 0.985294 | 0.971014 | OR51E2 AND NOT-DYSF AND PTPRCAP | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NOT-LRP11 AND NOT-SLC6A5 | 0.978102 | 0.985294 | 0.971014 | OR51E2 AND NOT-UNC5B AND SLCO1A2 | 1 | 1 | 1 |
| GPM6A AND TSPAN6 AND CD63 | 0.977778 | 1 | 0.956522 | TRPM8 AND NOT-CAV1 AND APOLD1 | 1 | 1 | 1 |
| GPM6A AND HLA-B AND NOT-AQP8 | 0.977778 | 1 | 0.956522 | TRPM8 AND NOT-SLC2A5 AND NOT-TENM2 | 1 | 1 | 1 |
| PTPRZ1 AND NOT-EFNA5 AND NRP1 | 0.978102 | 0.985294 | 0.971014 | OR51E2 AND NOT-SI AND SLCO1A2 | 1 | 1 | 1 |
| PTPRZ1 AND NOT-LRP11 AND NOT-OR1D2 | 0.985507 | 0.985507 | 0.985507 | OR51E2 AND NOT-ACE AND SLCO1A2 | 1 | 1 | 1 |
| COMPLEX-ITGB8/SULF2/PTPRZ1 | 0.985294 | 1 | 0.971014 | TRPM8 AND NOT-SLC2A5 AND NOT-STX4 | 1 | 1 | 1 |
| COMPLEX-SLCO2B1/KIAA1324/PTPRZ1 | 0.985507 | 0.985507 | 0.985507 | TRPM8 AND NOT-SLC2A5 AND NOT-VAMP1 | 1 | 1 | 1 |
| GPM6A AND TSPAN6 AND NOT-GPR87 | 0.970588 | 0.985075 | 0.956522 | TRPM8 AND NOT-SLC2A5 AND NOT-FZD7 | 1 | 1 | 1 |
| GPM6A AND TSPAN6 AND NOT-C14orf180 | 0.970588 | 0.985075 | 0.956522 | OR51E2 AND NOT-SYT4 AND NOT-SLC2A5 | 1 | 1 | 1 |
| GPM6A AND TSPAN6 AND ATP12A | 0.970588 | 0.985075 | 0.956522 | TRPM8 AND NOT-SLC2A5 AND NOT-SLC25A4 | 1 | 1 | 1 |
| GPM6A AND TSPAN6 AND NOT-HTR7 | 0.970588 | 0.985075 | 0.956522 | OR51E2 AND NOT-KCNJ15 AND GPR19 | 1 | 1 | 1 |
| GPM6A AND TSPAN6 AND NOT-SLC7A4 | 0.970588 | 0.985075 | 0.956522 | OR51E2 AND NOT-CD247 AND SLCO1A2 | 1 | 1 | 1 |
| COMPLEX-CNGA3/KIAA1324/PTPRZ1 | 0.978102 | 0.985294 | 0.971014 | OR51E2 AND NOT-IL17RA AND NOT-DAGLA | 1 | 1 | 1 |
| GPM6A AND TSPAN6 AND NOT-OR7A17 | 0.970588 | 0.985075 | 0.956522 | OR51E2 AND SLCO1A2 AND CD63 | 1 | 1 | 1 |
| GPM6A AND TSPAN6 AND NOT-TMEM219 | 0.970588 | 0.985075 | 0.956522 | TRPM8 AND NOT-SLC18A2 AND NOT-CLSTN2 | 1 | 1 | 1 |
| GPM6A AND SLC40A1 AND NOT-PAQR6 | 0.970588 | 0.985075 | 0.956522 | OR51E2 AND NOT-FMNL1 AND NOT-PLP2 | 1 | 1 | 1 |
| COMPLEX-SULF2/PTPRZ1/GPR65 | 0.985294 | 1 | 0.971014 | OR51E2 AND NOT-SLC39A2 AND NPFFR2 | 1 | 1 | 1 |
| COMPLEX-SULF2/PTPRZ1/SLC16A1 | 0.970149 | 1 | 0.942029 | TRPM8 AND NOT-FADS2 AND NOT-FZD1 | 1 | 1 | 1 |
| PTPRZ1 AND NOT-EFNA5 AND NOT-PRRG1 | 0.978102 | 0.985294 | 0.971014 | TRPM8 AND NOT-ATP1A2 AND NOT-FADS2 | 1 | 1 | 1 |
| PTPRZ1 AND HLA-G AND NOT-OR7A10 | 0.992701 | 1 | 0.985507 | OR51E2 AND NOT-SLC39A2 AND NOT-VIMP | 1 | 1 | 1 |
| PTPRZ1 AND NOT-EFNA5 AND NOT-SLC22A1 | 0.985294 | 1 | 0.971014 | TRPM8 AND NOT-GPR161 AND KCNS3 | 1 | 1 | 1 |
| COMPLEX-GRIK3/NRCAM/PTPRZ1 | 0.992701 | 1 | 0.985507 | TRPM8 AND NOT-GPR161 AND LDLRAD3 | 1 | 1 | 1 |
| PTPRZ1 AND NOT-EFNA5 AND STX6 | 0.985294 | 1 | 0.971014 | OR51E2 AND NOT-PTH1R AND SLCO1A2 | 1 | 1 | 1 |
| GPM6A AND TSPAN6 AND NOT-KCNB1 | 0.970588 | 0.985075 | 0.956522 | TRPM8 AND NOT-CAV1 AND NOT-CLSTN2 | 1 | 1 | 1 |
| PTPRZ1 AND NOT-LRP11 AND TMBIM6 | 0.992701 | 1 | 0.985507 | TRPM8 AND NOT-SLC2A5 AND NOT-GGT7 | 1 | 1 | 1 |
| PTPRZ1 AND NOT-LRP11 AND TMBIM6 | 0.992701 | 1 | 0.985507 | OR51E2 AND NOT-SI AND SLCO1A2 | 1 | 1 | 1 |
| PTPRZ1 AND NOT-LRP11 AND NOT-SLC6A2 | 0.992701 | 1 | 0.985507 | OR51E2 AND NOT-PTH1R AND GPR19 | 1 | 1 | 1 |
| PTPRZ1 AND NOT-LRP11 AND NOT-CD40LG | 0.978102 | 0.985294 | 0.971014 | OR51E2 AND NOT-FMNL1 AND KCNMB2 | 1 | 1 | 1 |
| GPM6A AND TSPAN6 AND NOT-AQP8 | 0.977778 | 1 | 0.956522 | TRPM8 AND NOT-FADS2 AND NOT-SDC3 | 1 | 1 | 1 |
| GPM6A AND TSPAN6 AND NOT-MEP1B | 0.970588 | 0.985075 | 0.956522 | OR51E2 AND NOT-FMNL1 AND NOT-MYADM | 1 | 1 | 1 |
| GPM6A AND TSPAN6 AND NOT-MC3R | 0.970588 | 0.985075 | 0.956522 | OR51E2 AND NOT-CD247 AND GPR19 | 1 | 1 | 1 |
| GPM6A AND TSPAN6 AND NOT-LY9 | 0.970588 | 0.985075 | 0.956522 | OR51E2 AND NOT-CD247 AND GPR19 | 1 | 1 | 1 |
| COMPLEX-SULF2/PTPRZ1/TGFA | 0.970149 | 1 | 0.942029 | TRPM8 AND NOT-SLC2A5 AND NOT-SGCE | 1 | 1 | 1 |
| GPM6A AND TSPAN6 AND NOT-KLRD1 | 0.970588 | 0.985075 | 0.956522 | OR51E2 AND NOT-DYSF AND GABRB3 | 1 | 1 | 1 |
| GPM6A AND TSPAN6 AND NOT-PIGR | 0.970588 | 0.985075 | 0.956522 | OR51E2 AND GJA1 AND SLCO1A2 | 1 | 1 | 1 |
| GPM6A AND SLC40A1 AND NOT-RHBDL2 | 0.970588 | 0.985075 | 0.956522 | OR51E2 AND NOT-PDE6B AND SLCO1A2 | 1 | 1 | 1 |
| GPM6A AND TSPAN6 AND NOT-GPR18 | 0.970588 | 0.985075 | 0.956522 | TRPM8 AND NOT-CAV1 AND PANX1 | 1 | 1 | 1 |
| PTPRZ1 AND NOT-LRP11 AND TSPAN6 | 0.977778 | 1 | 0.956522 | OR51E2 AND NOT-PDE6B AND SLCO1A2 | 1 | 1 | 1 |
| PTPRZ1 AND NOT-LRP11 AND NOT-BPI | 0.992701 | 1 | 0.985507 | TRPM8 AND NOT-SLC2A5 AND NOT-MYOF | 1 | 1 | 1 |
| GPM6A AND SLC40A1 AND NOT-HTR7 | 0.970588 | 0.985075 | 0.956522 | TRPM8 AND NOT-CAV1 AND SLC6A14 | 1 | 1 | 1 |
| COMPLEX-ADORA3/KIAA1324/PTPRZ1 | 0.985507 | 0.985507 | 0.985507 | TRPM8 AND NOT-CAV1 AND PANX1 | 1 | 1 | 1 |
| COMPLEX-CD300A/SULF2/PTPRZ1 | 0.985294 | 1 | 0.971014 | COMPLEX-PTPRF/OR51E2/DYSF | 1 | 1 | 1 |
| PTPRZ1 AND NOT-SYT2 AND NOT-LRP11 | 0.985507 | 0.985507 | 0.985507 | TRPM8 AND NOT-CAV1 AND ICAM3 | 1 | 1 | 1 |
| GPM6A AND CD63 AND NOT-TNFSF9 | 0.992701 | 1 | 0.985507 | TRPM8 AND NOT-CAV1 AND IFNGR2 | 1 | 1 | 1 |
| PTPRZ1 AND NOT-LRP11 AND NOT-SLC5A1 | 0.985507 | 0.985507 | 0.985507 | TRPM8 AND NOT-CAV1 AND NUCB2 | 1 | 1 | 1 |
| PTPRZ1 AND NOT-LRP11 AND NOT-ATP4A | 0.978102 | 0.985294 | 0.971014 | TRPM8 AND NOT-SLC2A5 AND NOT-STX2 | 1 | 1 | 1 |
| GPM6A AND PLGRKT AND NOT-HTR7 | 0.970149 | 1 | 0.942029 | TRPM8 AND NOT-SLC2A5 AND NOT-SLC16A9 | 1 | 1 | 1 |
| PTPRZ1 AND NOT-LRP11 AND NOT-HRH2 | 0.978102 | 0.985294 | 0.971014 | TRPM8 AND NOT-SLC2A5 AND NOT-KCNE4 | 1 | 1 | 1 |
| PTPRZ1 AND NOT-LRP11 AND NOT-MAS1 | 0.985507 | 0.985507 | 0.985507 | OR51E2 AND NOT-DYSF AND NOT-DAGLA | 1 | 1 | 1 |
| PTPRZ1 AND NOT-LRP11 AND NOT-LTA | 0.985507 | 0.985507 | 0.985507 | TRPM8 AND NOT-SLC2A5 AND NOT-SLC16A2 | 1 | 1 | 1 |
| PTPRZ1 AND NOT-LRP11 AND NOT-DIO3 | 0.978102 | 0.985294 | 0.971014 | OR51E2 AND NOT-SLC39A2 AND NOT-PLP2 | 1 | 1 | 1 |
| PTPRZ1 AND NOT-LRP11 AND NOT-MAS1 | 0.985507 | 0.985507 | 0.985507 | OR51E2 AND NOT-SYT4 AND NOT-SLC2A5 | 1 | 1 | 1 |
| COMPLEX-NRCAM/PTPRZ1/GPR65 | 0.977778 | 1 | 0.956522 | TRPM8 AND NOT-CAV1 AND MYADM | 1 | 1 | 1 |
| PTPRZ1 AND NOT-LRP11 AND NOT-LTK | 0.985294 | 1 | 0.971014 | TRPM8 AND NOT-SLC2A5 AND NOT-PANX1 | 1 | 1 | 1 |
| COMPLEX-NRCAM/PTPRZ1/SLC16A1 | 0.970149 | 1 | 0.942029 | TRPM8 AND NOT-SLC2A5 AND NOT-MPZ | 1 | 1 | 1 |
| PTPRZ1 AND NOT-EFNA5 AND NOT-GJB1 | 0.978102 | 0.985294 | 0.971014 | TRPM8 AND NOT-CAV1 AND CD69 | 1 | 1 | 1 |
| GPM6A AND TSPAN6 AND NOT-IL4R | 0.970588 | 0.985075 | 0.956522 | OR51E2 AND NOT-UNC5B AND GPR19 | 1 | 1 | 1 |
| GPM6A AND TSPAN6 AND NOT-CD300LG | 0.970588 | 0.985075 | 0.956522 | COMPLEX-KCNJ6/SGCD/OR51E2 | 1 | 1 | 1 |
| GPM6A AND TSPAN6 AND NOT-ADTRP | 0.970588 | 0.985075 | 0.956522 | TRPM8 AND NOT-SLC2A5 AND NOT-PTGER2 | 1 | 1 | 1 |
| GPM6A AND TSPAN6 AND NOT-ZDHHC20 | 0.970588 | 0.985075 | 0.956522 | TRPM8 AND NOT-SLC2A5 AND NOT-SLC24A3 | 1 | 1 | 1 |
| GPM6A AND TSPAN6 AND NOT-GJB3 | 0.970588 | 0.985075 | 0.956522 | TRPM8 AND NOT-SLC2A5 AND NOT-SGCA | 1 | 1 | 1 |
| PTPRZ1 AND NOT-LRP11 AND NOT-KCNB2 | 0.985507 | 0.985507 | 0.985507 | OR51E2 AND NOT-FMNL1 AND NOT-VIMP | 1 | 1 | 1 |
| PTPRZ1 AND NOT-EFNA5 AND NOT-GPR62 | 0.978102 | 0.985294 | 0.971014 | TRPM8 AND NOT-UNC5B AND NOT-PLP2 | 1 | 1 | 1 |
| COMPLEX-MERTK/NRCAM/PTPRZ1 | 0.977778 | 1 | 0.956522 | TRPM8 AND NOT-SLC2A5 AND NOT-ABHD6 | 1 | 1 | 1 |
| GPM6A AND TSPAN6 AND NOT-PAQR6 | 0.970588 | 0.985075 | 0.956522 | TRPM8 AND NOT-SLC2A5 AND NOT-JAM3 | 1 | 1 | 1 |
| PTPRZ1 AND NOT-LRP11 AND NOT-TRPM6 | 0.985507 | 0.985507 | 0.985507 | TRPM8 AND NOT-SLC2A5 AND NOT-GPR161 | 1 | 1 | 1 |
| PTPRZ1 AND NOT-LRP11 AND NOT-HPN | 0.985507 | 0.985507 | 0.985507 | TRPM8 AND NOT-GPR161 AND NOT-CLSTN2 | 1 | 1 | 1 |
| PTPRZ1 AND NOT-LRP11 AND ITGAE | 0.985294 | 1 | 0.971014 | TRPM8 AND NOT-PANX1 AND LDLRAD3 | 1 | 1 | 1 |
| GPM6A AND TSPAN6 AND NOT-ILDR1 | 0.970588 | 0.985075 | 0.956522 | TRPM8 AND NOT-GPR161 AND SLC6A14 | 1 | 1 | 1 |
| COMPLEX-CD300A/NRCAM/PTPRZ1 | 0.992701 | 1 | 0.985507 | TRPM8 AND NOT-CAV1 AND NOT-UNC5B | 1 | 1 | 1 |
| GPM6A AND TSPAN6 AND NOT-SELE | 0.970588 | 0.985075 | 0.956522 | TRPM8 AND NOT-UNC5B AND NOT-CD81 | 1 | 1 | 1 |
| PTPRZ1 AND NOT-LRP11 AND NOT-HTR7 | 0.978102 | 0.985294 | 0.971014 | OR51E2 AND NOT-ACE AND NOT-PAQR8 | 1 | 1 | 1 |
| PTPRZ1 AND NOT-LRP11 AND IFNGR2 | 0.992701 | 1 | 0.985507 | OR51E2 AND NOT-EFNB3 AND SLCO1A2 | 1 | 1 | 1 |
| PTPRZ1 AND NOT-LRP11 AND IFNGR2 | 0.992701 | 1 | 0.985507 | COMPLEX-SYT4/OR51E2/FADS2 | 1 | 1 | 1 |
| PTPRZ1 AND NOT-LRP11 AND NOT-RHAG | 0.992701 | 1 | 0.985507 | OR51E2 AND NOT-SLC2A5 AND NOT-EMP3 | 1 | 1 | 1 |
| PTPRZ1 AND NOT-LRP11 AND NOT-CXCR6 | 0.977778 | 1 | 0.956522 | TRPM8 AND NOT-SLC2A5 AND NOT-TPCN2 | 1 | 1 | 1 |
| PTPRZ1 AND HLA-B AND NOT-SLC6A14 | 0.992701 | 1 | 0.985507 | TRPM8 AND NOT-SLC2A5 AND NOT-STX2 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND HLA-B AND GPM6A | 0.992701 | 1 | 0.985507 | OR51E2 AND NOT-KCNJ15 AND SLCO1A2 | 1 | 1 | 1 |
| PTPRZ1 AND HLA-B AND PCDH17 | 0.992701 | 1 | 0.985507 | COMPLEX-ANO6/OXTR/OR51E2 | 1 | 1 | 1 |
| GPM6A AND PRCP AND NOT-PAQR6 | 0.970149 | 1 | 0.942029 | TRPM8 AND NOT-CAV1 AND GOLM1 | 1 | 1 | 1 |
| COMPLEX-SULF2/PTPRZ1/LRP11 | 0.970588 | 0.985075 | 0.956522 | TRPM8 AND NOT-CAV1 AND FZD5 | 1 | 1 | 1 |
| PTPRZ1 AND HLA-B AND NOT-SPINT1 | 0.992701 | 1 | 0.985507 | TRPM8 AND NOT-CAV1 AND SLC2A3 | 1 | 1 | 1 |
| GPM6A AND TSPAN6 AND NOT-OR10A4 | 0.970588 | 0.985075 | 0.956522 | TRPM8 AND NOT-POPDC2 AND NOT-UNC5B | 1 | 1 | 1 |
| PTPRZ1 AND HLA-B AND NOT-GPR87 | 0.992701 | 1 | 0.985507 | TRPM8 AND NOT-CAV1 AND SLC19A2 | 1 | 1 | 1 |
| PTPRZ1 AND NOT-LRP11 AND HLA-G | 0.992701 | 1 | 0.985507 | TRPM8 AND NOT-SLC2A5 AND NOT-ABCC6 | 1 | 1 | 1 |
| PTPRZ1 AND HLA-B AND GPM6B | 0.992701 | 1 | 0.985507 | OR51E2 AND NOT-EFNB3 AND GPR19 | 1 | 1 | 1 |
| PTPRZ1 AND HLA-B AND NOT-PROM2 | 0.992701 | 1 | 0.985507 | TRPM8 AND NOT-SLC2A5 AND NOT-STX7 | 1 | 1 | 1 |
| PTPRZ1 AND HLA-B AND NOT-PERP | 0.992701 | 1 | 0.985507 | OR51E2 AND NOT-DNER AND NOT-FMNL1 | 1 | 1 | 1 |
| PTPRZ1 AND NOT-LRP11 AND HLA-G | 0.992701 | 1 | 0.985507 | OR51E2 AND NOT-CD247 AND SLCO1A2 | 1 | 1 | 1 |
| COMPLEX-CD320/KIAA1324/PTPRZ1 | 0.985507 | 0.985507 | 0.985507 | TRPM8 AND NOT-CAV1 AND NOT-CLSTN2 | 1 | 1 | 1 |
| GPM6A AND HLA-B AND NOT-RHBDL2 | 0.977778 | 1 | 0.956522 | TRPM8 AND NOT-PCDH7 AND LDLRAD3 | 1 | 1 | 1 |
| PTPRZ1 AND NOT-LRP11 AND NOT-CLDN6 | 0.978102 | 0.985294 | 0.971014 | COMPLEX-PTCHD1/OXTR/OR51E2 | 1 | 1 | 1 |
| COMPLEX-MSR1/PTPRZ1/BCAN | 0.992701 | 1 | 0.985507 | TRPM8 AND NOT-ROR2 AND NOT-SLC2A5 | 1 | 1 | 1 |
| PTPRZ1 AND NOT-LRP11 AND CBX3 | 0.992701 | 1 | 0.985507 | TRPM8 AND NOT-ROR2 AND NOT-CLSTN2 | 1 | 1 | 1 |
| GPM6A AND TSPAN6 AND NOT-FOLR1 | 0.970588 | 0.985075 | 0.956522 | COMPLEX-OMG/SGCD/OR51E2 | 1 | 1 | 1 |
| GPM6A AND TSPAN6 AND NOT-RAET1E | 0.970588 | 0.985075 | 0.956522 | OR51E2 AND NOT-EFNB3 AND GPR19 | 1 | 1 | 1 |
| PTPRZ1 AND NOT-LRP11 AND NOT-GPA33 | 0.985507 | 0.985507 | 0.985507 | STEAP2 AND NOT-CAV1 AND SLC39A14 | 1 | 1 | 1 |
| PTPRZ1 AND NOT-LRP11 AND NOT-GPA33 | 0.985507 | 0.985507 | 0.985507 | STEAP2 AND NOT-GPR161 AND SLC6A14 | 1 | 1 | 1 |
| COMPLEX-MERTK/PTPRZ1/BCAN | 0.985294 | 1 | 0.971014 | STEAP2 AND NOT-SLC16A14 AND NOT-ACE | 1 | 1 | 1 |
| COMPLEX-CD300A/PTPRZ1/BCAN | 0.992701 | 1 | 0.985507 | STEAP2 AND NOT-PCDH7 AND SLC6A14 | 1 | 1 | 1 |
| PTPRZ1 AND CBX3 AND NOT-SYT8 | 0.977778 | 1 | 0.956522 | COMPLEX-SGCD/CA9/OR51E2 | 1 | 1 | 1 |
| PTPRZ1 AND CBX3 AND NOT-GJB5 | 0.977778 | 1 | 0.956522 | STEAP2 AND NOT-CAV1 AND CXCR4 | 1 | 1 | 1 |
| PTPRZ1 AND NOT-EPCAM AND IFNGR2 | 0.992701 | 1 | 0.985507 | STEAP2 AND NOT-CAV1 AND SLC6A14 | 1 | 1 | 1 |
| PTPRZ1 AND NOT-LRP11 AND NOT-SSTR3 | 0.985507 | 0.985507 | 0.985507 | STEAP2 AND NOT-CAV1 AND SLC30A5 | 1 | 1 | 1 |
| GPM6A AND TSPAN6 AND NOT-SLAMF7 | 0.970588 | 0.985075 | 0.956522 | STEAP2 AND NOT-CAV1 AND ICAM3 | 1 | 1 | 1 |
| PTPRZ1 AND CBX3 AND NOT-SPINT1 | 0.977778 | 1 | 0.956522 | STEAP2 AND NOT-CAV1 AND MYADM | 1 | 1 | 1 |
| PTPRZ1 AND CBX3 AND NOT-PROM2 | 0.977778 | 1 | 0.956522 | STEAP2 AND NOT-CAV1 AND VMP1 | 1 | 1 | 1 |
| PTPRZ1 AND CBX3 AND GPM6A | 0.977778 | 1 | 0.956522 | STEAP2 AND NOT-CAV1 AND IFNGR2 | 1 | 1 | 1 |
| COMPLEX-ABCA5/ITGB8/PTPRZ1 | 0.985507 | 0.985507 | 0.985507 | STEAP2 AND NOT-CAV1 AND GOLM1 | 1 | 1 | 1 |
| PTPRZ1 AND NOT-EPCAM AND HLA-G | 0.992701 | 1 | 0.985507 | STEAP2 AND NOT-CAV1 AND CD69 | 1 | 1 | 1 |
| PTPRZ1 AND CBX3 AND GPM6B | 0.977778 | 1 | 0.956522 | STEAP2 AND NOT-SLC2A5 AND NOT-SGCE | 1 | 1 | 1 |
| PTPRZ1 AND CBX3 AND NOT-GPR87 | 0.977778 | 1 | 0.956522 | STEAP2 AND NOT-PCDH7 AND LDLRAD3 | 1 | 1 | 1 |
| PTPRZ1 AND CBX3 AND PCDH17 | 0.977778 | 1 | 0.956522 | STEAP2 AND NOT-CAV1 AND SLC39A14 | 1 | 1 | 1 |
| PTPRZ1 AND CBX3 AND NOT-SLC6A14 | 0.977778 | 1 | 0.956522 | STEAP2 AND NOT-SLC2A5 AND NOT-STX7 | 1 | 1 | 1 |
| PTPRZ1 AND CBX3 AND NOT-PERP | 0.977778 | 1 | 0.956522 | STEAP2 AND NOT-ROR2 AND SLC6A14 | 1 | 1 | 1 |
| PTPRZ1 AND HLA-B AND NOT-CLDN23 | 0.992701 | 1 | 0.985507 | STEAP2 AND NOT-PCDH7 AND LDLRAD3 | 1 | 1 | 1 |
| PTPRZ1 AND HLA-B AND NOT-TRPM4 | 0.977778 | 1 | 0.956522 | STEAP2 AND NOT-SGCE AND LDLRAD3 | 1 | 1 | 1 |
| GPM6A AND SLC40A1 AND NOT-FOLR1 | 0.970588 | 0.985075 | 0.956522 | STEAP2 AND NOT-CAV1 AND MYADM | 1 | 1 | 1 |
| PTPRZ1 AND HLA-B AND NCAM1 | 0.992701 | 1 | 0.985507 | STEAP2 AND NOT-CAV1 AND FZD5 | 1 | 1 | 1 |
| COMPLEX-HRH1/PTPRZ1/BCAN | 0.970149 | 1 | 0.942029 | STEAP2 AND NOT-CAV1 AND CXCR4 | 1 | 1 | 1 |
| COMPLEX-PTPRZ1/BCAN/GPR65 | 0.992701 | 1 | 0.985507 | STEAP2 AND NOT-MYADM AND LDLRAD3 | 1 | 1 | 1 |
| GPM6A AND HLA-B AND NOT-RAET1E | 0.963504 | 0.970588 | 0.956522 | COMPLEX-KDR/NPY2R/OR51E2 | 1 | 1 | 1 |
| PTPRZ1 AND NOT-SYT2 AND NOT-CLDN23 | 0.985507 | 0.985507 | 0.985507 | STEAP2 AND NOT-SLC2A5 AND NOT-SGCE | 1 | 1 | 1 |
| PTPRZ1 AND NOT-SYT2 AND NOT-TRPM4 | 0.970588 | 0.985075 | 0.956522 | COMPLEX-KDR/TENM2/OR51E2 | 1 | 1 | 1 |
| GPM6A AND TSPAN6 AND NOT-ERBB3 | 0.962963 | 0.984848 | 0.942029 | OR51E2 AND NOT-DKK1 AND NOT-SLC2A5 | 1 | 1 | 1 |
| GPM6A AND TSPAN6 AND NOT-CLDN1 | 0.962963 | 0.984848 | 0.942029 | OR51E2 AND NOT-ACE AND NOT-ITGB6 | 1 | 1 | 1 |
| PTPRZ1 AND NOT-SYT2 AND NCAM1 | 0.985507 | 0.985507 | 0.985507 | OR51E2 AND NOT-DKK1 AND NOT-ACE | 1 | 1 | 1 |
| COMPLEX-PMEPA1/PTPRZ1/BCAN | 0.962406 | 1 | 0.927536 | STEAP2 AND NOT-CAV1 AND GOLM1 | 1 | 1 | 1 |
| COMPLEX-ITGA7/PTPRZ1/BCAN | 0.962406 | 1 | 0.927536 | STEAP2 AND NOT-SLC2A5 AND NOT-VAMP1 | 1 | 1 | 1 |
| COMPLEX-MET/NRCAM/PTPRZ1 | 0.962406 | 1 | 0.927536 | STEAP2 AND NOT-SLC2A5 AND NOT-TENM2 | 1 | 1 | 1 |
| COMPLEX-SLCO2B1/CLDN7/PTPRZ1 | 0.978102 | 0.985294 | 0.971014 | STEAP2 AND NOT-ROR2 AND LDLRAD3 | 1 | 1 | 1 |
| PTPRZ1 AND NOT-LRP11 AND NOT-CLDN9 | 0.985507 | 0.985507 | 0.985507 | STEAP2 AND NOT-ABHD6 AND LDLRAD3 | 1 | 1 | 1 |
| COMPLEX-SLC6A14/PTPRZ1/BCAN | 0.970149 | 1 | 0.942029 | STEAP2 AND NOT-CAV1 AND SLC6A14 | 1 | 1 | 1 |
| PTPRZ1 AND NOT-LRP11 AND NOT-ULBP3 | 0.985507 | 0.985507 | 0.985507 | COMPLEX-KDR/PCDHGB6/OR51E2 | 1 | 1 | 1 |
| PTPRZ1 AND NOT-LRP11 AND NOT-SSTR5 | 0.985507 | 0.985507 | 0.985507 | COMPLEX-MAGEA4/SGCD/OR51E2 | 1 | 1 | 1 |
| PTPRZ1 AND NOT-LRP11 AND NOT-DNAJB8 | 0.985507 | 0.985507 | 0.985507 | STEAP2 AND NOT-MYADM AND SLC6A14 | 1 | 1 | 1 |
| PTPRZ1 AND NOT-LRP11 AND NOT-SSTR5 | 0.985507 | 0.985507 | 0.985507 | STEAP2 AND NOT-SGCE AND LDLRAD3 | 1 | 1 | 1 |
| PTPRZ1 AND NOT-LRP11 AND NOT-FCRL2 | 0.985507 | 0.985507 | 0.985507 | STEAP2 AND NOT-GPR161 AND SLC6A14 | 1 | 1 | 1 |
| PTPRZ1 AND NOT-LRP11 AND NOT-CLDN4 | 0.985507 | 0.985507 | 0.985507 | STEAP2 AND NOT-ABHD6 AND LDLRAD3 | 1 | 1 | 1 |
| PTPRZ1 AND CBX3 AND NOT-F11R | 0.977778 | 1 | 0.956522 | STEAP2 AND NOT-CAV1 AND GOLM1 | 1 | 1 | 1 |
| PTPRZ1 AND CBX3 AND NOT-TMEM30B | 0.977778 | 1 | 0.956522 | COMPLEX-KCNK3/KDR/OR51E2 | 1 | 1 | 1 |
| PTPRZ1 AND CBX3 AND IGSF11 | 0.977778 | 1 | 0.956522 | COMPLEX-DKK1/SGCD/OR51E2 | 1 | 1 | 1 |
| PTPRZ1 AND CBX3 AND NOT-MGST2 | 0.977778 | 1 | 0.956522 | OR51E2 AND NOT-DKK1 AND NOT-SLC2A5 | 1 | 1 | 1 |
| PTPRZ1 AND CBX3 AND APLP1 | 0.977778 | 1 | 0.956522 | STEAP2 AND NOT-CAV1 AND PROS1 | 1 | 1 | 1 |
| PTPRZ1 AND NOT-EPCAM AND NOT-AQP8 | 0.992701 | 1 | 0.985507 | STEAP2 AND NOT-PCDH7 AND SLC6A14 | 1 | 1 | 1 |
| PTPRZ1 AND CBX3 AND NOT-GJB3 | 0.977778 | 1 | 0.956522 | STEAP2 AND NOT-SLC18A2 AND SLC6A14 | 1 | 1 | 1 |
| PTPRZ1 AND CBX3 AND ATP1B2 | 0.977778 | 1 | 0.956522 | STEAP2 AND NOT-GPR161 AND LDLRAD3 | 1 | 1 | 1 |
| PTPRZ1 AND CBX3 AND NOT-PVRL4 | 0.977778 | 1 | 0.956522 | STEAP2 AND NOT-MYADM AND LDLRAD3 | 1 | 1 | 1 |
| PTPRZ1 AND HLA-B AND NOT-SDC1 | 0.992701 | 1 | 0.985507 | COMPLEX-KDR/IYD/OR51E2 | 1 | 1 | 1 |
| PTPRZ1 AND NOT-EPCAM AND TMBIM6 | 0.992701 | 1 | 0.985507 | STEAP2 AND NOT-SLC16A14 AND NOT-ACE | 1 | 1 | 1 |
| PTPRZ1 AND SLC40A1 AND NOT-CLDN23 | 0.977778 | 1 | 0.956522 | STEAP2 AND NOT-SLC2A5 AND NOT-STX7 | 1 | 1 | 1 |
| PTPRZ1 AND NOT-SYT2 AND NOT-SDC1 | 0.985507 | 0.985507 | 0.985507 | STEAP2 AND NOT-CAV1 AND VMP1 | 1 | 1 | 1 |
| PTPRZ1 AND NOT-RAET1E AND HLA-G | 0.985294 | 1 | 0.971014 | OR51E2 AND NOT-ACE AND NOT-AXL | 1 | 1 | 1 |
| PTPRZ1 AND SLC40A1 AND NOT-TRPM4 | 0.962406 | 1 | 0.927536 | STEAP2 AND NOT-PANX1 AND LDLRAD3 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| GPM6A AND ABCA1 AND NOT-RAET1E | 0.963504 | 0.970588 | 0.956522 | COMPLEX-CD180/SGCD/OR51E2 | 1 | 1 | 1 |
| PTPRZ1 AND SLC40A1 AND NCAM1 | 0.977778 | 1 | 0.956522 | STEAP2 AND NOT-SLC2A5 AND NOT-VAMP1 | 1 | 1 | 1 |
| GPM6A AND PLGRKT AND NOT-FOLR1 | 0.970149 | 1 | 0.942029 | STEAP2 AND NOT-SLC18A2 AND SLC6A14 | 1 | 1 | 1 |
| PTPRZ1 AND NOT-CD3G AND NOT-CLDN23 | 0.977778 | 1 | 0.956522 | STEAP2 AND NOT-ROR2 AND LDLRAD3 | 1 | 1 | 1 |
| PTPRZ1 AND NOT-KCNB2 AND NOT-TRPM4 | 0.970588 | 0.985075 | 0.956522 | STEAP2 AND NOT-CAV1 AND IFNGR2 | 1 | 1 | 1 |
| PTPRZ1 AND NOT-CD3G AND NCAM1 | 0.977778 | 1 | 0.956522 | STEAP2 AND NOT-MYADM AND SLC6A14 | 1 | 1 | 1 |
| PTPRZ1 AND NOT-KCNB2 AND NOT-CLDN23 | 0.985507 | 0.985507 | 0.985507 | COMPLEX-CLEC14A/FNDC4/OR51E2 | 1 | 1 | 1 |
| COMPLEX-CLDN7/ADORA3/PTPRZ1 | 0.985507 | 0.985507 | 0.985507 | OR51E2 AND NOT-ACE AND NOT-ITGB6 | 1 | 1 | 1 |
| PTPRZ1 AND NOT-LRP11 AND NOT-CEACAM5 | 0.985507 | 0.985507 | 0.985507 | OR51E2 AND NOT-SLC2A5 AND TNFRSF13C | 1 | 1 | 1 |
| PTPRZ1 AND NOT-LRP11 AND NOT-CLDN18 | 0.978102 | 0.985294 | 0.971014 | OR51E2 AND NOT-SLC2A5 AND BIRC5 | 1 | 1 | 1 |
| PTPRZ1 AND NOT-CD3G AND NOT-TRPM4 | 0.962406 | 1 | 0.927536 | STEAP2 AND NOT-GGT7 AND SLC6A14 | 1 | 1 | 1 |
| PTPRZ1 AND NOT-KCNB2 AND NCAM1 | 0.985507 | 0.985507 | 0.985507 | STEAP2 AND NOT-CAV1 AND PANX1 | 1 | 1 | 1 |
| COMPLEX-TNFSF13B/CLDN7/PTPRZ1 | 0.978102 | 0.985294 | 0.971014 | STEAP2 AND NOT-SLC16A2 AND SLC6A14 | 1 | 1 | 1 |
| PTPRZ1 AND CBX3 AND NOT-WNT3 | 0.977778 | 1 | 0.956522 | STEAP2 AND NOT-CAV1 AND NOT-ICAM4 | 1 | 1 | 1 |
| PTPRZ1 AND CBX3 AND NOT-BTC | 0.977778 | 1 | 0.956522 | STEAP2 AND LDLRAD3 AND NOT-ITM2C | 1 | 1 | 1 |
| PTPRZ1 AND NOT-EPCAM AND NOT-ESYT3 | 0.985507 | 0.985507 | 0.985507 | STEAP2 AND NOT-SLC2A5 AND NOT-SLC16A2 | 1 | 1 | 1 |
| PTPRZ1 AND CBX3 AND NOT-RECK | 0.977778 | 1 | 0.956522 | COMPLEX-STEAP2/FURIN/FNDC4 | 1 | 1 | 1 |
| PTPRZ1 AND NOT-EPCAM AND SLC39A14 | 0.992701 | 1 | 0.985507 | STEAP2 AND NOT-PLP2 AND LDLRAD3 | 1 | 1 | 1 |
| PTPRZ1 AND CBX3 AND NOT-SLC15A1 | 0.977778 | 1 | 0.956522 | STEAP2 AND NOT-FADS2 AND GOLM1 | 1 | 1 | 1 |
| PTPRZ1 AND CBX3 AND NOT-ACVR2A | 0.977778 | 1 | 0.956522 | STEAP2 AND NOT-FZD1 AND LILRB2 | 1 | 1 | 1 |
| PTPRZ1 AND CBX3 AND SLC6A1 | 0.977778 | 1 | 0.956522 | STEAP2 AND NOT-SLC2A5 AND NOT-CNTN1 | 1 | 1 | 1 |
| GPM6A AND SLC40A1 AND NOT-CLDN1 | 0.970588 | 0.985075 | 0.956522 | STEAP2 AND NOT-GPR161 AND GOLM1 | 1 | 1 | 1 |
| GPM6A AND SLC40A1 AND NOT-ERBB3 | 0.962963 | 0.984848 | 0.942029 | STEAP2 AND NOT-MYADM AND GOLM1 | 1 | 1 | 1 |
| PTPRZ1 AND NOT-LRP11 AND NOT-RAET1E | 0.985294 | 1 | 0.971014 | STEAP2 AND NPFFR2 AND NOT-UNC5B | 1 | 1 | 1 |
| COMPLEX-PTPRZ1/RYR1/BCAN | 0.970588 | 0.985075 | 0.956522 | OR51E2 AND NOT-ACE AND NOT-CLDN11 | 1 | 1 | 1 |
| COMPLEX-PTPRZ1/BCAN/SLC22A4 | 0.962406 | 1 | 0.927536 | STEAP2 AND NOT-ROR2 AND NOT-UNC5B | 1 | 1 | 1 |
| GPM6A AND SLC40A1 AND NOT-RAET1E | 0.970588 | 0.985075 | 0.956522 | STEAP2 AND NOT-SLC18A2 AND NOT-UNC5B | 1 | 1 | 1 |
| GPM6A AND SLC40A1 AND NOT-SLAMF7 | 0.962963 | 0.984848 | 0.942029 | STEAP2 AND NOT-MAL AND NOT-SLC52A3 | 1 | 1 | 1 |
| COMPLEX-ITGB8/PTPRZ1/BCAN | 0.977778 | 1 | 0.956522 | STEAP2 AND NOT-STX2 AND LDLRAD3 | 1 | 1 | 1 |
| COMPLEX-PTPRZ1/BCAN/NRP2 | 0.962406 | 1 | 0.927536 | STEAP2 AND NOT-SLC25A4 AND LDLRAD3 | 1 | 1 | 1 |
| GPM6A AND PLGRKT AND NOT-RAET1E | 0.970149 | 1 | 0.942029 | OR51E2 AND NOT-ACE AND NOT-SLC34A2 | 1 | 1 | 1 |
| PTPRZ1 AND JAM2 AND NOT-GPA33 | 0.985294 | 1 | 0.971014 | OR51E2 AND NOT-ACE AND CD70 | 1 | 1 | 1 |
| COMPLEX-TNFSF13B/PTPRZ1/BCAN | 0.992701 | 1 | 0.985507 | STEAP2 AND NOT-ABCC6 AND LDLRAD3 | 1 | 1 | 1 |
| PTPRZ1 AND JAM2 AND NCAM1 | 0.985294 | 1 | 0.971014 | STEAP2 AND NOT-SLC18A2 AND GOLM1 | 1 | 1 | 1 |
| PTPRZ1 AND JAM2 AND NOT-SDC1 | 0.985294 | 1 | 0.971014 | STEAP2 AND NOT-NPY1R AND LDLRAD3 | 1 | 1 | 1 |
| PTPRZ1 AND SLC40A1 AND NOT-SDC1 | 0.977778 | 1 | 0.956522 | OR51E2 AND NOT-ACE AND NOT-MST1R | 1 | 1 | 1 |
| COMPLEX-PTPRZ1/BCAN/SIGLEC10 | 0.992701 | 1 | 0.985507 | TRPM8 AND NOT-CAV1 AND VCAM1 | 1 | 1 | 1 |
| PTPRZ1 AND JAM2 AND NOT-MUC1 | 0.985294 | 1 | 0.971014 | STEAP2 AND NOT-CAV1 AND STEAP4 | 1 | 1 | 1 |
| PTPRZ1 AND NOT-CD3G AND NOT-MUC1 | 0.977778 | 1 | 0.956522 | STEAP2 AND SLCO1A2 AND LDLRAD3 | 1 | 1 | 1 |
| PTPRZ1 AND NOT-SYT2 AND NOT-MUC1 | 0.985507 | 0.985507 | 0.985507 | TRPM8 AND NOT-TNC AND NOT-UNC5B | 1 | 1 | 1 |
| PTPRZ1 AND TSPAN6 AND NOT-MUC1 | 0.962406 | 1 | 0.927536 | STEAP2 AND SLCO1A2 AND LDLRAD3 | 1 | 1 | 1 |
| PTPRZ1 AND NOT-KCNB2 AND NOT-MUC1 | 0.985507 | 0.985507 | 0.985507 | TRPM8 AND NOT-CAV1 AND CLDN8 | 1 | 1 | 1 |
| PTPRZ1 AND NOT-HAS1 AND NOT-MUC1 | 0.955224 | 0.984615 | 0.927536 | STEAP2 AND NOT-CAV1 AND PTGER4 | 1 | 1 | 1 |
| PTPRZ1 AND NOT-CD5 AND NOT-MUC1 | 0.985294 | 1 | 0.971014 | STEAP2 AND SLCO1A2 AND NOT-SLC2A5 | 1 | 1 | 1 |
| PTPRZ1 AND NOT-S1PR5 AND NOT-MUC1 | 0.978102 | 0.985294 | 0.971014 | STEAP2 AND NOT-CAV1 AND CD163 | 1 | 1 | 1 |
| PTPRZ1 AND NOT-ACVR1B AND NOT-MUC1 | 0.978102 | 0.985294 | 0.971014 | STEAP2 AND NOT-SYT4 AND NOT-SLC2A5 | 1 | 1 | 1 |
| PTPRZ1 AND BFAR AND NOT-MUC1 | 0.992701 | 1 | 0.985507 | STEAP2 AND NOT-SYT4 AND NOT-SLC2A5 | 1 | 1 | 1 |
| PTPRZ1 AND XPR1 AND NOT-MUC1 | 0.970149 | 1 | 0.942029 | STEAP2 AND NOT-ROR2 AND F2R | 1 | 1 | 1 |
| COMPLEX-FAT2/MUC1/PTPRZ1 | 0.985507 | 0.985507 | 0.985507 | COMPLEX-SLC39A6/SLC22A18/OR51E2 | 1 | 1 | 1 |
| PTPRZ1 AND HLA-G AND NOT-ERBB2 | 0.985294 | 1 | 0.971014 | STEAP2 AND NOT-PCDH7 AND PTGER4 | 1 | 1 | 1 |
| COMPLEX-C1orf210/MUC1/PTPRZ1 | 0.992701 | 1 | 0.985507 | STEAP2 AND NOT-GPR161 AND PTGER4 | 1 | 1 | 1 |
| PTPRZ1 AND NOT-FLT3 AND NOT-MUC1 | 0.985294 | 1 | 0.971014 | STEAP2 AND NOT-ATP1A2 AND F2R | 1 | 1 | 1 |
| PTPRZ1 AND NOT-SYT1 AND NOT-MUC1 | 0.985507 | 0.985507 | 0.985507 | TRPM8 AND NOT-PCDH7 AND MUC1 | 1 | 1 | 1 |
| PTPRZ1 AND NOT-TNFSF9 AND NOT-MUC1 | 0.985294 | 1 | 0.971014 | TRPM8 AND NOT-SGCE AND CLDN8 | 1 | 1 | 1 |
| PTPRZ1 AND NOT-RHBDL2 AND NOT-MUC1 | 0.970149 | 1 | 0.942029 | TRPM8 AND NOT-FZD1 AND ABCA5 | 1 | 1 | 1 |
| PTPRZ1 AND NOT-ESYT3 AND NOT-EPHA2 | 0.985507 | 0.985507 | 0.985507 | STEAP2 AND SLCO1A2 AND NOT-UNC5B | 1 | 1 | 1 |
| PTPRZ1 AND NOT-ESYT3 AND NOT-MUC1 | 0.985507 | 0.985507 | 0.985507 | STEAP2 AND NOT-SLC2A5 AND NOT-DYSF | 1 | 1 | 1 |
| PTPRZ1 AND NOT-ESYT3 AND NOT-MUC1 | 0.985507 | 0.985507 | 0.985507 | TRPM8 AND NOT-FZD1 AND RNF43 | 1 | 1 | 1 |
| COMPLEX-FUT1/MUC1/PTPRZ1 | 0.985507 | 0.985507 | 0.985507 | STEAP2 AND NOT-DNER AND NOT-SLC39A2 | 1 | 1 | 1 |
| PTPRZ1 AND NOT-SLC18A2 AND NOT-MUC1 | 0.985294 | 1 | 0.971014 | TRPM8 AND NOT-SLC52A3 AND CLDN8 | 1 | 1 | 1 |
| PTPRZ1 AND NOT-PRPH2 AND NOT-MUC1 | 0.978102 | 0.985294 | 0.971014 | TRPM8 AND NOT-ATP1A2 AND VCAM1 | 1 | 1 | 1 |
| PTPRZ1 AND NOT-OR7A10 AND NOT-MUC1 | 0.955224 | 0.984615 | 0.927536 | TRPM8 AND NOT-FADS2 AND NOT-LGR5 | 1 | 1 | 1 |
| PTPRZ1 AND NOT-SIGLEC6 AND NOT-MUC1 | 0.992701 | 1 | 0.985507 | STEAP2 AND NOT-SLC2A5 AND NOT-PAQR8 | 1 | 1 | 1 |
| COMPLEX-DSC3/MUC1/PTPRZ1 | 0.985294 | 1 | 0.971014 | TRPM8 AND NOT-CSPG4 AND NOT-UNC5B | 1 | 1 | 1 |
| PTPRZ1 AND NOT-SYT8 AND NOT-EPHA2 | 0.985507 | 0.985507 | 0.985507 | STEAP2 AND SLCO1A2 AND GOLM1 | 1 | 1 | 1 |
| PTPRZ1 AND NOT-KCNG3 AND NOT-MUC1 | 0.977778 | 1 | 0.956522 | STEAP2 AND NOT-FZD1 AND THBD | 1 | 1 | 1 |
| PTPRZ1 AND NOT-CD40LG AND NOT-MUC1 | 0.978102 | 0.985294 | 0.971014 | TRPM8 AND NOT-SLC2A5 AND NOT-EGFR | 1 | 1 | 1 |
| PTPRZ1 AND NOT-ESYT3 AND NOT-ERBB2 | 0.978102 | 0.985294 | 0.971014 | TRPM8 AND NOT-LSAMP AND CLDN8 | 1 | 1 | 1 |
| COMPLEX-MUC1/PTPRZ1/GPR68 | 0.985507 | 0.985507 | 0.985507 | STEAP2 AND NOT-SLC2A5 AND NOT-SYT11 | 1 | 1 | 1 |
| PTPRZ1 AND TMBIM6 AND NOT-ERBB2 | 0.978102 | 0.985294 | 0.971014 | STEAP2 AND NOT-SLC2A5 AND NOT-DYSF | 1 | 1 | 1 |
| COMPLEX-MUC1/PTGER3/PTPRZ1 | 0.985294 | 1 | 0.971014 | STEAP2 AND NOT-PCDH7 AND F2R | 1 | 1 | 1 |
| PTPRZ1 AND NOT-UPK1A AND NOT-MUC1 | 0.978102 | 0.985294 | 0.971014 | STEAP2 AND NOT-DYSF AND LDLRAD3 | 1 | 1 | 1 |
| PTPRZ1 AND NOT-CXCR3 AND NOT-MUC1 | 0.970149 | 1 | 0.942029 | STEAP2 AND NPFFR2 AND NOT-SLC39A2 | 1 | 1 | 1 |
| PTPRZ1 AND NOT-LY6K AND NOT-MUC1 | 0.970588 | 0.985075 | 0.956522 | STEAP2 AND NOT-SLC2A5 AND NOT-GYPC | 1 | 1 | 1 |
| PTPRZ1 AND NOT-BPI AND NOT-MUC1 | 0.992701 | 1 | 0.985507 | STEAP2 AND NOT-PLP2 AND NOT-SLC39A2 | 1 | 1 | 1 |
| PTPRZ1 AND TMBIM6 AND NOT-MUC1 | 0.985507 | 0.985507 | 0.985507 | TRPM8 AND NOT-SLC2A5 AND NOT-DKK1 | 1 | 1 | 1 |
| COMPLEX-MUC1/SLC46A2/PTPRZ1 | 0.978102 | 0.985294 | 0.971014 | STEAP2 AND SLCO1A2 AND NOT-CLSTN2 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| COMPLEX-MUC1/PTPRZ1/SLC28A3 | 0.985507 | 0.985507 | 0.985507 | STEAP2 AND NOT-PLP2 AND NOT-SLC39A2 | 1 | 1 | 1 |
| COMPLEX-EDAR/MUC1/PTPRZ1 | 0.962963 | 0.984848 | 0.942029 | TRPM8 AND NOT-ATP1A2 AND MUC1 | 1 | 1 | 1 |
| PTPRZ1 AND HLA-C AND NOT-MUC1 | 0.978102 | 0.985294 | 0.971014 | TRPM8 AND NOT-SLC18A2 AND CLDN8 | 1 | 1 | 1 |
| PTPRZ1 AND NOT-SYT5 AND NOT-MUC1 | 0.985507 | 0.985507 | 0.985507 | STEAP2 AND NOT-MYADM AND PTGER4 | 1 | 1 | 1 |
| PTPRZ1 AND IFNGR2 AND NOT-ERBB2 | 0.985294 | 1 | 0.971014 | TRPM8 AND NOT-SLC2A5 AND BIRC5 | 1 | 1 | 1 |
| PTPRZ1 AND NOT-CD8B AND NOT-MUC1 | 0.992701 | 1 | 0.985507 | TRPM8 AND NOT-ROR2 AND MUC1 | 1 | 1 | 1 |
| PTPRZ1 AND NOT-OR1D2 AND NOT-MUC1 | 0.985507 | 0.985507 | 0.985507 | TRPM8 AND NOT-ATP1A2 AND MUC1 | 1 | 1 | 1 |
| PTPRZ1 AND NOT-F10 AND NOT-MUC1 | 0.978102 | 0.985294 | 0.971014 | TRPM8 AND NOT-SLC2A5 AND P2RX5 | 1 | 1 | 1 |
| PTPRZ1 AND NOT-GPR143 AND NOT-MUC1 | 0.978102 | 0.985294 | 0.971014 | TRPM8 AND NOT-SLC2A5 AND NOT-IL13RA2 | 1 | 1 | 1 |
| PTPRZ1 AND NOT-SYT8 AND ERBB2 | 0.985507 | 0.985507 | 0.985507 | TRPM8 AND NOT-SLC2A5 AND NOT-IL11RA | 1 | 1 | 1 |
| COMPLEX-MUC1/PTPRZ1/SCNN1A | 0.978102 | 0.985294 | 0.971014 | TRPM8 AND NOT-PANX1 AND CLDN8 | 1 | 1 | 1 |
| PTPRZ1 AND NOT-GJB5 AND ERBB2 | 0.985507 | 0.985507 | 0.985507 | TRPM8 AND NOT-PCDH7 AND MUC1 | 1 | 1 | 1 |
| PTPRZ1 AND TNFRSF21 AND NOT-MUC1 | 0.977778 | 1 | 0.956522 | STEAP2 AND NOT-SLC2A5 AND NOT-SLC4A8 | 1 | 1 | 1 |
| COMPLEX-MUC1/ATP2A3/PTPRZ1 | 0.970588 | 0.985075 | 0.956522 | TRPM8 AND NOT-FADS2 AND CLDN8 | 1 | 1 | 1 |
| COMPLEX-MUC1/PTPRZ1/PVRL4 | 0.992701 | 1 | 0.985507 | STEAP2 AND NOT-POPDC2 AND NOT-SLC39A2 | 1 | 1 | 1 |
| COMPLEX-GJB5/MUC1/PTPRZ1 | 0.985507 | 0.985507 | 0.985507 | TRPM8 AND NOT-TNC AND SLC6A14 | 1 | 1 | 1 |
| COMPLEX-MUC1/PTPRZ1/SYT8 | 0.985507 | 0.985507 | 0.985507 | TRPM8 AND NOT-POPDC2 AND VCAM1 | 1 | 1 | 1 |
| COMPLEX-MUC1/PTPRZ1/PVRL4 | 0.992701 | 1 | 0.985507 | STEAP2 AND NOT-POPDC2 AND NOT-SLC39A2 | 1 | 1 | 1 |
| COMPLEX-GJB5/MUC1/PTPRZ1 | 0.985507 | 0.985507 | 0.985507 | TRPM8 AND NOT-TNC AND NOT-CLSTN2 | 1 | 1 | 1 |
| COMPLEX-EPHA2/HLA-G/PTPRZ1 | 0.992701 | 1 | 0.985507 | TRPM8 AND NOT-TNC AND NOT-CLSTN2 | 1 | 1 | 1 |
| COMPLEX-MUC1/PTPRZ1/SYT8 | 0.985507 | 0.985507 | 0.985507 | TRPM8 AND NOT-PCDH7 AND CLDN8 | 1 | 1 | 1 |
| PTPRZ1 AND NOT-DIO3 AND NOT-MUC1 | 0.978102 | 0.985294 | 0.971014 | STEAP2 AND NOT-POPDC2 AND PTGER4 | 1 | 1 | 1 |
| COMPLEX-COL17A1/MUC1/PTPRZ1 | 0.985507 | 0.985507 | 0.985507 | STEAP2 AND SLCO1A2 AND KCNS3 | 1 | 1 | 1 |
| PTPRZ1 AND NOT-OR1J2 AND NOT-MUC1 | 0.978102 | 0.985294 | 0.971014 | TRPM8 AND NOT-GPR161 AND VCAM1 | 1 | 1 | 1 |
| PTPRZ1 AND NOT-ADRA2B AND NOT-MUC1 | 0.985507 | 0.985507 | 0.985507 | TRPM8 AND NOT-LSAMP AND BIRC5 | 1 | 1 | 1 |
| COMPLEX-MUC1/PTPRZ1/ITM2C | 0.978102 | 0.985294 | 0.971014 | TRPM8 AND NOT-PCDH7 AND VCAM1 | 1 | 1 | 1 |
| PTPRZ1 AND NOT-MRGPRX1 AND NOT-ERBB2 | 0.978102 | 0.985294 | 0.971014 | TRPM8 AND NOT-GPR161 AND CLDN8 | 1 | 1 | 1 |
| COMPLEX-MUC1/PON2/PTPRZ1 | 0.978102 | 0.985294 | 0.971014 | STEAP2 AND SLCO1A2 AND SLC6A14 | 1 | 1 | 1 |
| PTPRZ1 AND NOT-RHCG AND NOT-MUC1 | 0.978102 | 0.985294 | 0.971014 | STEAP2 AND SLCO1A2 AND GOLM1 | 1 | 1 | 1 |
| COMPLEX-MUC15/MUC1/PTPRZ1 | 0.978102 | 0.985294 | 0.971014 | TRPM8 AND NOT-SLC2A5 AND NOT-LGR5 | 1 | 1 | 1 |
| PTPRZ1 AND NOT-ISLR2 AND NOT-ERBB2 | 0.978102 | 0.985294 | 0.971014 | STEAP2 AND SLCO1A2 AND NOT-CLSTN2 | 1 | 1 | 1 |
| PTPRZ1 AND NOT-CLCNKB AND NOT-MUC1 | 0.970588 | 0.985075 | 0.956522 | STEAP2 AND NOT-GPR161 AND F2R | 1 | 1 | 1 |
| PTPRZ1 AND NOT-ADAM11 AND NOT-MUC1 | 0.985507 | 0.985507 | 0.985507 | STEAP2 AND NOT-ATP1A2 AND PTGER4 | 1 | 1 | 1 |
| PTPRZ1 AND NOT-GPR87 AND ERBB2 | 0.985507 | 0.985507 | 0.985507 | STEAP2 AND NOT-SLC2A5 AND SLC2A2 | 1 | 1 | 1 |
| PTPRZ1 AND NOT-LY6G6D AND NOT-MUC1 | 0.978102 | 0.985294 | 0.971014 | STEAP2 AND NOT-SLC18A2 AND F2R | 1 | 1 | 1 |
| COMPLEX-MUC1/PTPRZ1/SLC1A3 | 0.970588 | 0.985075 | 0.956522 | STEAP2 AND NOT-SYT4 AND NOT-LSAMP | 1 | 1 | 1 |
| PTPRZ1 AND NOT-SLC6A4 AND NOT-MUC1 | 0.985294 | 1 | 0.971014 | TRPM8 AND NOT-ROR2 AND VCAM1 | 1 | 1 | 1 |
| COMPLEX-MUC1/PTPRZ1/CD1E | 0.985507 | 0.985507 | 0.985507 | TRPM8 AND NOT-POPDC2 AND CLDN8 | 1 | 1 | 1 |
| PTPRZ1 AND NOT-P2RY2 AND NOT-MUC1 | 0.962963 | 0.984848 | 0.942029 | TRPM8 AND NOT-FADS2 AND NOT-LGR5 | 1 | 1 | 1 |
| PTPRZ1 AND NOT-STAB2 AND NOT-MUC1 | 0.970588 | 0.985075 | 0.956522 | STEAP2 AND NOT-SLC2A5 AND NOT-EMP3 | 1 | 1 | 1 |
| PTPRZ1 AND SRR AND NOT-MUC1 | 0.977778 | 1 | 0.956522 | TRPM8 AND NOT-SLC2A5 AND NOT-CSPG4 | 1 | 1 | 1 |
| PTPRZ1 AND NOT-KLB AND NOT-MUC1 | 0.970588 | 0.985075 | 0.956522 | TRPM8 AND NOT-ROR2 AND CLDN8 | 1 | 1 | 1 |
| COMPLEX-CFTR/MUC1/PTPRZ1 | 0.985507 | 0.985507 | 0.985507 | TRPM8 AND NOT-LSAMP AND BIRC5 | 1 | 1 | 1 |
| PTPRZ1 AND NOT-SCN2B AND NOT-MUC1 | 0.985507 | 0.985507 | 0.985507 | TRPM8 AND NOT-SLC2A5 AND NOT-ITGB6 | 1 | 1 | 1 |
| PTPRZ1 AND NOT-ISLR2 AND NOT-MUC1 | 0.985507 | 0.985507 | 0.985507 | TRPM8 AND NOT-SLC2A5 AND NOT-LGR5 | 1 | 1 | 1 |
| PTPRZ1 AND NOT-MRGPRX1 AND NOT-MUC1 | 0.985507 | 0.985507 | 0.985507 | STEAP2 AND NOT-ROR2 AND PTGER4 | 1 | 1 | 1 |
| PTPRZ1 AND NOT-OR4D1 AND NOT-MUC1 | 0.985507 | 0.985507 | 0.985507 | STEAP2 AND NOT-DYSF AND LDLRAD3 | 1 | 1 | 1 |
| PTPRZ1 AND NOT-MRGPRX1 AND NOT-MUC1 | 0.985507 | 0.985507 | 0.985507 | TRPM8 AND NOT-SLC2A5 AND NOT-IL11RA | 1 | 1 | 1 |
| PTPRZ1 AND NOT-SLC6A5 AND NOT-MUC1 | 0.978102 | 0.985294 | 0.971014 | STEAP2 AND SLCO1A2 AND NOT-UNC5B | 1 | 1 | 1 |
| PTPRZ1 AND NOT-SLC6A3 AND NOT-MUC1 | 0.978102 | 0.985294 | 0.971014 | TRPM8 AND NOT-ABHD6 AND CLDN8 | 1 | 1 | 1 |
| PTPRZ1 AND VAMP3 AND NOT-MUC1 | 0.985507 | 0.985507 | 0.985507 | STEAP2 AND NOT-POPDC2 AND CD163 | 1 | 1 | 1 |
| COMPLEX-MARVELD2/MUC1/PTPRZ1 | 0.985507 | 0.985507 | 0.985507 | STEAP2 AND NOT-SLC2A5 AND NOT-PAQR8 | 1 | 1 | 1 |
| PTPRZ1 AND NOT-BDKRB1 AND NOT-MUC1 | 0.985507 | 0.985507 | 0.985507 | STEAP2 AND NOT-POPDC2 AND STEAP4 | 1 | 1 | 1 |
| PTPRZ1 AND NOT-SLC1A7 AND NOT-MUC1 | 0.970588 | 0.985075 | 0.956522 | TRPM8 AND NOT-FZD1 AND CLDN8 | 1 | 1 | 1 |
| PTPRZ1 AND NOT-TRPV6 AND NOT-MUC1 | 0.985507 | 0.985507 | 0.985507 | TRPM8 AND NOT-GPR161 AND MUC1 | 1 | 1 | 1 |
| PTPRZ1 AND NOT-CRHR1 AND NOT-MUC1 | 0.985507 | 0.985507 | 0.985507 | STEAP2 AND NOT-SLC2A5 AND NOT-GYPC | 1 | 1 | 1 |
| PTPRZ1 AND NOT-OR4D1 AND NOT-ERBB2 | 0.978102 | 0.985294 | 0.971014 | TRPM8 AND NOT-GPR161 AND MUC1 | 1 | 1 | 1 |
| PTPRZ1 AND NOT-LTA AND NOT-ERBB2 | 0.978102 | 0.985294 | 0.971014 | STEAP2 AND NOT-SLC2A5 AND NOT-TTYH2 | 1 | 1 | 1 |
| PTPRZ1 AND NOT-IL1RL2 AND NOT-MUC1 | 0.985507 | 0.985507 | 0.985507 | STEAP2 AND NOT-CAV1 AND ABCA5 | 1 | 1 | 1 |
| PTPRZ1 AND NOT-OR1F1 AND NOT-ERBB2 | 0.985294 | 1 | 0.971014 | STEAP2 AND NOT-CAV1 AND CLDN8 | 1 | 1 | 1 |
| GPM6A AND F2R AND NOT-FOLR1 | 0.992701 | 1 | 0.985507 | STEAP2 AND NOT-CAV1 AND VCAM1 | 1 | 1 | 1 |
| GPM6A AND F2R AND NOT-RAET1E | 0.985294 | 1 | 0.971014 | COMPLEX-KDR/CLDN5/OR51E2 | 1 | 1 | 1 |
| GPM6A AND F2R AND NOT-MUC16 | 0.970149 | 1 | 0.942029 | STEAP2 AND NOT-UNC5B AND NOT-TNC | 1 | 1 | 1 |
| PTPRZ1 AND CBX3 AND ASTN1 | 0.977778 | 1 | 0.956522 | STEAP2 AND NOT-SLC18A2 AND CLDN8 | 1 | 1 | 1 |
| PTPRZ1 AND NOT-SLC6A15 AND NOT-CLDN23 | 0.978102 | 0.985294 | 0.971014 | STEAP2 AND NOT-FADS2 AND CLDN8 | 1 | 1 | 1 |
| PTPRZ1 AND NOT-SLC6A15 AND NOT-TRPM4 | 0.970588 | 0.985075 | 0.956522 | STEAP2 AND NOT-ROR2 AND VCAM1 | 1 | 1 | 1 |
| COMPLEX-PTPRZ1/BCAN/SLC1A6 | 0.970149 | 1 | 0.942029 | STEAP2 AND NOT-FZD1 AND ABCA5 | 1 | 1 | 1 |
| PTPRZ1 AND NOT-SLC6A15 AND NCAM1 | 0.978102 | 0.985294 | 0.971014 | STEAP2 AND NOT-POPDC2 AND VCAM1 | 1 | 1 | 1 |
| PTPRZ1 AND F2R AND NOT-SDC1 | 0.985294 | 1 | 0.971014 | STEAP2 AND BIRC5 AND NOT-LSAMP | 1 | 1 | 1 |
| PTPRZ1 AND F2R AND NOT-TRPM4 | 0.985294 | 1 | 0.971014 | STEAP2 AND BIRC5 AND NOT-KCNJ15 | 1 | 1 | 1 |
| PTPRZ1 AND F2R AND NCAM1 | 0.985294 | 1 | 0.971014 | STEAP2 AND NOT-MYADM AND MUC1 | 1 | 1 | 1 |
| PTPRZ1 AND NOT-EPCAM AND NOT-EPHA10 | 0.985507 | 0.985507 | 0.985507 | STEAP2 AND NOT-POPDC2 AND VCAM1 | 1 | 1 | 1 |
| PTPRZ1 AND CBX3 AND GPR158 | 0.977778 | 1 | 0.956522 | STEAP2 AND NOT-ROR2 AND CLDN8 | 1 | 1 | 1 |
| PTPRZ1 AND CBX3 AND NOT-ATP8B1 | 0.977778 | 1 | 0.956522 | STEAP2 AND NOT-POPDC2 AND ABCA5 | 1 | 1 | 1 |
| PTPRZ1 AND NOT-SLC6A15 AND NOT-SDC1 | 0.978102 | 0.985294 | 0.971014 | STEAP2 AND NOT-ATP1A2 AND VCAM1 | 1 | 1 | 1 |
| PTPRZ1 AND F2R AND NOT-CLDN23 | 0.985294 | 1 | 0.971014 | STEAP2 AND NOT-GPR161 AND MUC1 | 1 | 1 | 1 |
| PTPRZ1 AND NOT-ABCG4 AND NOT-TRPM4 | 0.962963 | 0.984848 | 0.942029 | STEAP2 AND NOT-GPR161 AND MUC1 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| COMPLEX-TNFRSF12A/PTPRZ1/BCAN | 0.962406 | 1 | 0.927536 | STEAP2 AND BIRC5 AND NOT-SLC2A5 | 1 | 1 | 1 |
| PTPRZ1 AND CBX3 AND NOT-SLC13A2 | 0.977778 | 1 | 0.956522 | STEAP2 AND BIRC5 AND NOT-EFNB1 | 1 | 1 | 1 |
| PTPRZ1 AND CBX3 AND NOT-KCNK6 | 0.977778 | 1 | 0.956522 | STEAP2 AND NOT-ROR2 AND MUC1 | 1 | 1 | 1 |
| PTPRZ1 AND CBX3 AND SLC1A2 | 0.977778 | 1 | 0.956522 | STEAP2 AND NOT-PCDH7 AND CLDN8 | 1 | 1 | 1 |
| PTPRZ1 AND F2R AND NOT-SSTR3 | 0.985294 | 1 | 0.971014 | STEAP2 AND NOT-MYADM AND MUC1 | 1 | 1 | 1 |
| PTPRZ1 AND NOT-NKAIN2 AND NOT-TRPM4 | 0.970588 | 0.985075 | 0.956522 | STEAP2 AND NOT-PCDH7 AND CLDN8 | 1 | 1 | 1 |
| PTPRZ1 AND NOT-NKAIN2 AND NOT-CLDN23 | 0.985507 | 0.985507 | 0.985507 | STEAP2 AND NOT-PANX1 AND CLDN8 | 1 | 1 | 1 |
| PTPRZ1 AND F2R AND NOT-SSTR5 | 0.985294 | 1 | 0.971014 | STEAP2 AND NOT-ATP1A2 AND MUC1 | 1 | 1 | 1 |
| PTPRZ1 AND F2R AND NOT-GPA33 | 0.985294 | 1 | 0.971014 | STEAP2 AND NOT-ROR2 AND CLDN8 | 1 | 1 | 1 |
| PTPRZ1 AND NOT-NKAIN2 AND NCAM1 | 0.985507 | 0.985507 | 0.985507 | STEAP2 AND NOT-ROR2 AND MUC1 | 1 | 1 | 1 |
| PTPRZ1 AND NOT-ABCG4 AND NOT-CLDN23 | 0.978102 | 0.985294 | 0.971014 | STEAP2 AND NOT-FZD1 AND RNF43 | 1 | 1 | 1 |
| PTPRZ1 AND NOT-ABCG4 AND NCAM1 | 0.978102 | 0.985294 | 0.971014 | STEAP2 AND NOT-GPR161 AND VCAM1 | 1 | 1 | 1 |
| PTPRZ1 AND NOT-EPCAM AND NOT-LRRC52 | 0.985507 | 0.985507 | 0.985507 | STEAP2 AND NOT-ATP1A2 AND VCAM1 | 1 | 1 | 1 |
| PTPRZ1 AND NOT-EPCAM AND NOT-DIO1 | 0.985507 | 0.985507 | 0.985507 | STEAP2 AND NOT-ABHD6 AND CLDN8 | 1 | 1 | 1 |
| PTPRZ1 AND NOT-EPCAM AND NOT-SLC17A1 | 0.985507 | 0.985507 | 0.985507 | STEAP2 AND NOT-ABHD6 AND CLDN8 | 1 | 1 | 1 |
| PTPRZ1 AND NOT-EPCAM AND NOT-SLC17A3 | 0.985507 | 0.985507 | 0.985507 | STEAP2 AND NOT-PCDH7 AND MUC1 | 1 | 1 | 1 |
| PTPRZ1 AND NOT-EPCAM AND NOT-ABCG5 | 0.985507 | 0.985507 | 0.985507 | STEAP2 AND NOT-POPDC2 AND CLDN8 | 1 | 1 | 1 |
| PTPRZ1 AND NOT-EPCAM AND NOT-GRIN2B | 0.992701 | 1 | 0.985507 | STEAP2 AND NOT-MYADM AND VCAM1 | 1 | 1 | 1 |
| PTPRZ1 AND CBX3 AND NOT-SCARA5 | 0.977778 | 1 | 0.956522 | STEAP2 AND NOT-TNC AND SLC6A14 | 1 | 1 | 1 |
| PTPRZ1 AND NOT-EPCAM AND NOT-ADAM30 | 0.985507 | 0.985507 | 0.985507 | STEAP2 AND NOT-MYADM AND CLDN8 | 1 | 1 | 1 |
| PTPRZ1 AND NOT-HCN1 AND NOT-TRPM4 | 0.970588 | 0.985075 | 0.956522 | STEAP2 AND NOT-MYADM AND VCAM1 | 1 | 1 | 1 |
| PTPRZ1 AND NOT-HCN1 AND NOT-CLDN23 | 0.978102 | 0.985294 | 0.971014 | STEAP2 AND NOT-PCDH7 AND MUC1 | 1 | 1 | 1 |
| PTPRZ1 AND NOT-NKAIN2 AND NOT-SDC1 | 0.985507 | 0.985507 | 0.985507 | STEAP2 AND BIRC5 AND NOT-SLC2A5 | 1 | 1 | 1 |
| PTPRZ1 AND NOT-HCN1 AND NCAM1 | 0.978102 | 0.985294 | 0.971014 | STEAP2 AND NOT-FADS2 AND CLDN8 | 1 | 1 | 1 |
| PTPRZ1 AND F2R AND NOT-SSTR4 | 0.985294 | 1 | 0.971014 | STEAP2 AND NOT-SLC52A3 AND CLDN8 | 1 | 1 | 1 |
| PTPRZ1 AND NOT-ATP8A2 AND NOT-TRPM4 | 0.970588 | 0.985075 | 0.956522 | STEAP2 AND NOT-TNC AND SLC6A14 | 1 | 1 | 1 |
| PTPRZ1 AND NOT-SCN8A AND NOT-TRPM4 | 0.962963 | 0.984848 | 0.942029 | STEAP2 AND NOT-PCDH7 AND VCAM1 | 1 | 1 | 1 |
| PTPRZ1 AND NOT-ATP8A2 AND NOT-CLDN23 | 0.985507 | 0.985507 | 0.985507 | STEAP2 AND NOT-SLC18A2 AND CLDN8 | 1 | 1 | 1 |
| PTPRZ1 AND NOT-SCN8A AND NOT-CLDN23 | 0.978102 | 0.985294 | 0.971014 | STEAP2 AND NOT-PCDH7 AND VCAM1 | 1 | 1 | 1 |
| PTPRZ1 AND NOT-SCN8A AND NCAM1 | 0.978102 | 0.985294 | 0.971014 | STEAP2 AND NOT-SLC52A3 AND CLDN8 | 1 | 1 | 1 |
| PTPRZ1 AND NOT-ABCG4 AND NOT-SDC1 | 0.978102 | 0.985294 | 0.971014 | STEAP2 AND NOT-ATP1A2 AND MUC1 | 1 | 1 | 1 |
| PTPRZ1 AND NOT-ATP8A2 AND NCAM1 | 0.985507 | 0.985507 | 0.985507 | STEAP2 AND NOT-ROR2 AND VCAM1 | 1 | 1 | 1 |
| PTPRZ1 AND NOT-KIAA0319 AND NOT-SDC1 | 0.985507 | 0.985507 | 0.985507 | STEAP2 AND NOT-GPR161 AND CLDN8 | 1 | 1 | 1 |
| PTPRZ1 AND CBX3 AND NOT-SLC43A1 | 0.977778 | 1 | 0.956522 | STEAP2 AND NOT-POPDC2 AND CLDN8 | 1 | 1 | 1 |
| PTPRZ1 AND CBX3 AND NOT-GUCY2D | 0.977778 | 1 | 0.956522 | STEAP2 AND NOT-FZD1 AND CLDN8 | 1 | 1 | 1 |
| PTPRZ1 AND CBX3 AND NOT-THBD | 0.977778 | 1 | 0.956522 | STEAP2 AND NOT-MYADM AND CLDN8 | 1 | 1 | 1 |
| PTPRZ1 AND NOT-HCN1 AND NOT-SDC1 | 0.978102 | 0.985294 | 0.971014 | STEAP2 AND NOT-SGCE AND CLDN8 | 1 | 1 | 1 |
| PTPRZ1 AND NOT-ATP8A2 AND NOT-SDC1 | 0.985507 | 0.985507 | 0.985507 | STEAP2 AND NOT-SGCE AND CLDN8 | 1 | 1 | 1 |
| PTPRZ1 AND NOT-SCN8A AND NOT-SDC1 | 0.978102 | 0.985294 | 0.971014 | STEAP2 AND NOT-SGCD AND EPHA3 | 1 | 1 | 1 |
| PTPRZ1 AND NOT-CDH8 AND NOT-CLDN23 | 0.985507 | 0.985507 | 0.985507 | STEAP2 AND NOT-MYADM AND RNF43 | 1 | 1 | 1 |
| PTPRZ1 AND NOT-CDH8 AND NOT-TRPM4 | 0.970588 | 0.985075 | 0.956522 | STEAP2 AND NOT-GPR161 AND RNF43 | 1 | 1 | 1 |
| COMPLEX-PTPRZ1/BCAN/TNFRSF10B | 0.962406 | 1 | 0.927536 | STEAP2 AND BIRC5 AND NOT-DUOXA1 | 1 | 1 | 1 |
| PTPRZ1 AND NOT-CACNA1B AND NOT-CLDN23 | 0.985507 | 0.985507 | 0.985507 | STEAP2 AND BIRC5 AND NOT-PTPRU | 1 | 1 | 1 |
| PTPRZ1 AND NOT-CACNA1B AND NOT-TRPM4 | 0.970588 | 0.985075 | 0.956522 | STEAP2 AND BIRC5 AND NOT-SGCD | 1 | 1 | 1 |
| PTPRZ1 AND NOT-CDH8 AND NCAM1 | 0.985507 | 0.985507 | 0.985507 | STEAP2 AND NOT-MYADM AND ABCA5 | 1 | 1 | 1 |
| PTPRZ1 AND NOT-CACNA1B AND NCAM1 | 0.985507 | 0.985507 | 0.985507 | STEAP2 AND NOT-MYADM AND TRPM4 | 1 | 1 | 1 |
| PTPRZ1 AND NOT-KIAA0319 AND NOT-CLDN23 | 0.985507 | 0.985507 | 0.985507 | STEAP2 AND BIRC5 AND NOT-CD40 | 1 | 1 | 1 |
| PTPRZ1 AND NOT-KIAA0319 AND NOT-TRPM4 | 0.985507 | 0.985507 | 0.985507 | STEAP2 AND CLDN8 AND NOT-SLC3A2 | 1 | 1 | 1 |
| PTPRZ1 AND NOT-KIAA0319 AND NCAM1 | 0.985507 | 0.985507 | 0.985507 | STEAP2 AND NOT-ROR2 AND RNF43 | 1 | 1 | 1 |
| PTPRZ1 AND CBX3 AND NOT-MRGPRF | 0.977778 | 1 | 0.956522 | STEAP2 AND NOT-FADS2 AND TRPM4 | 1 | 1 | 1 |
| PTPRZ1 AND CBX3 AND SLC22A14 | 0.977778 | 1 | 0.956522 | STEAP2 AND NOT-SGCD AND VCAM1 | 1 | 1 | 1 |
| PTPRZ1 AND NOT-HTR5A AND NCAM1 | 0.978102 | 0.985294 | 0.971014 | STEAP2 AND NOT-CAV1 AND TRPM4 | 1 | 1 | 1 |
| PTPRZ1 AND NOT-HTR5A AND NOT-TRPM4 | 0.970588 | 0.985075 | 0.956522 | STEAP2 AND NOT-PCDH7 AND RNF43 | 1 | 1 | 1 |
| PTPRZ1 AND CBX3 AND GABRB1 | 0.977778 | 1 | 0.956522 | STEAP2 AND NOT-ROR2 AND TRPM4 | 1 | 1 | 1 |
| PTPRZ1 AND NOT-HTR5A AND NOT-CLDN23 | 0.978102 | 0.985294 | 0.971014 | STEAP2 AND NOT-GPR161 AND ABCA5 | 1 | 1 | 1 |
| PTPRZ1 AND NOT-SLC32A1 AND NOT-CLDN23 | 0.970588 | 0.985075 | 0.956522 | STEAP2 AND NOT-SLC52A3 AND TRPM4 | 1 | 1 | 1 |
| PTPRZ1 AND NOT-GRM3 AND NOT-CLDN23 | 0.992701 | 1 | 0.985507 | STEAP2 AND NOT-SGCD AND MUC1 | 1 | 1 | 1 |
| PTPRZ1 AND NOT-GRM3 AND NOT-TRPM4 | 0.977778 | 1 | 0.956522 | STEAP2 AND NOT-SGCE AND TRPM4 | 1 | 1 | 1 |
| PTPRZ1 AND NOT-SLC32A1 AND NOT-TRPM4 | 0.955224 | 0.984615 | 0.927536 | STEAP2 AND NOT-FADS2 AND NOT-NCAM1 | 1 | 1 | 1 |
| PTPRZ1 AND NOT-DGKE AND NCAM1 | 0.985507 | 0.985507 | 0.985507 | STEAP2 AND NOT-ROR2 AND ABCA5 | 1 | 1 | 1 |
| PTPRZ1 AND CBX3 AND CRB1 | 0.962406 | 1 | 0.927536 | STEAP2 AND NOT-GPR161 AND TRPM4 | 1 | 1 | 1 |
| PTPRZ1 AND NOT-CDH8 AND NOT-SDC1 | 0.985507 | 0.985507 | 0.985507 | STEAP2 AND NOT-PCDH7 AND ABCA5 | 1 | 1 | 1 |
| PTPRZ1 AND NOT-GABRA2 AND NOT-CLDN23 | 0.985507 | 0.985507 | 0.985507 | STEAP2 AND NOT-PCDH7 AND TRPM4 | 1 | 1 | 1 |
| PTPRZ1 AND NOT-GRM3 AND NCAM1 | 0.992701 | 1 | 0.985507 | STEAP2 AND NOT-SLC16A2 AND MUC1 | 1 | 1 | 1 |
| PTPRZ1 AND NOT-DGKE AND NOT-TRPM4 | 0.970588 | 0.985075 | 0.956522 | STEAP2 AND NOT-SGCE AND MUC1 | 1 | 1 | 1 |
| PTPRZ1 AND NOT-SLC32A1 AND NCAM1 | 0.970588 | 0.985075 | 0.956522 | STEAP2 AND NOT-STX4 AND CLDN8 | 1 | 1 | 1 |
| PTPRZ1 AND NOT-CACNA1B AND NOT-SDC1 | 0.985507 | 0.985507 | 0.985507 | STEAP2 AND NOT-SLC2A5 AND NOT-L1CAM | 1 | 1 | 1 |
| PTPRZ1 AND NOT-GABRA2 AND NOT-TRPM4 | 0.970588 | 0.985075 | 0.956522 | COMPLEX-TMC1/STEAP2/EPCAM | 1 | 1 | 1 |
| PTPRZ1 AND NOT-GABRA2 AND NCAM1 | 0.985507 | 0.985507 | 0.985507 | STEAP2 AND CLDN8 AND NOT-SLC20A2 | 1 | 1 | 1 |
| PTPRZ1 AND NOT-CLDN6 AND ASTN1 | 0.978102 | 0.985294 | 0.971014 | STEAP2 AND NOT-SLC24A3 AND VCAM1 | 1 | 1 | 1 |
| PTPRZ1 AND NOT-GRM1 AND NOT-CLDN23 | 0.970588 | 0.985075 | 0.956522 | STEAP2 AND NOT-PLP2 AND MUC1 | 1 | 1 | 1 |
| PTPRZ1 AND NOT-GRM1 AND NOT-TRPM4 | 0.955224 | 0.984615 | 0.927536 | STEAP2 AND NOT-STX2 AND VCAM1 | 1 | 1 | 1 |
| PTPRZ1 AND NOT-SLC26A8 AND NOT-CLDN23 | 0.985507 | 0.985507 | 0.985507 | STEAP2 AND NOT-MCAM AND VCAM1 | 1 | 1 | 1 |
| PTPRZ1 AND NOT-SLC26A8 AND NOT-TRPM4 | 0.970588 | 0.985075 | 0.956522 | STEAP2 AND NOT-ADCY5 AND CLDN8 | 1 | 1 | 1 |
| PTPRZ1 AND NOT-SLC26A8 AND NCAM1 | 0.985507 | 0.985507 | 0.985507 | STEAP2 AND NOT-SLC25A4 AND VCAM1 | 1 | 1 | 1 |
| PTPRZ1 AND NOT-GRM1 AND NCAM1 | 0.970588 | 0.985075 | 0.956522 | STEAP2 AND NOT-ADCY5 AND MUC1 | 1 | 1 | 1 |
| PTPRZ1 AND CBX3 AND SLC8A3 | 0.977778 | 1 | 0.956522 | STEAP2 AND NOT-UNC5B AND NOT-CSPG4 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| GPM6A AND ITGAV AND PTGER4 | 0.956522 | 0.956522 | 0.956522 | STEAP2 AND NOT-ABCC6 AND VCAM1 | 1 | 1 | 1 |
| PTPRZ1 AND NOT-HTR5A AND NOT-SDC1 | 0.978102 | 0.985294 | 0.971014 | COMPLEX-PRRT2/STEAP2/VCAM1 | 1 | 1 | 1 |
| PTPRZ1 AND CBX3 AND NKAIN4 | 0.970149 | 1 | 0.942029 | STEAP2 AND NOT-SLC2A5 AND P2RX5 | 1 | 1 | 1 |
| COMPLEX-PTPRZ1/BCAN/CD58 | 0.985294 | 1 | 0.971014 | STEAP2 AND CLDN8 AND NOT-DNER | 1 | 1 | 1 |
| GPM6A AND ITGAV AND BEST2 | 0.956522 | 0.956522 | 0.956522 | FOLH1 AND HPN AND NOT-ABHD6 | 1 | 1 | 1 |
| GPM6A AND ITGAV AND STAB1 | 0.94964 | 0.942857 | 0.956522 | FOLH1 AND HPN AND NOT-ABHD6 | 1 | 1 | 1 |
| PTPRZ1 AND CBX3 AND NOT-CLDN23 | 0.977778 | 1 | 0.956522 | FOLH1 AND FZD4 AND NOT-NPY1R | 1 | 1 | 1 |
| PTPRZ1 AND CBX3 AND NOT-TRPM4 | 0.962406 | 1 | 0.927536 | FOLH1 AND HPN AND NOT-NPY1R | 1 | 1 | 1 |
| PTPRZ1 AND CBX3 AND NCAM1 | 0.977778 | 1 | 0.956522 | FOLH1 AND NOT-ABCC6 AND FZD4 | 1 | 1 | 1 |
| PTPRZ1 AND CBX3 AND NOT-SDC1 | 0.977778 | 1 | 0.956522 | FOLH1 AND FZD4 AND NOT-NPY1R | 1 | 1 | 1 |
| PTPRZ1 AND NOT-EPCAM AND NOT-GPA33 | 0.985507 | 0.985507 | 0.985507 | FOLH1 AND NOT-ABCC6 AND HPN | 1 | 1 | 1 |
| COMPLEX-TRPM4/RNF43/PTPRZ1 | 0.970588 | 0.985075 | 0.956522 | FOLH1 AND HPN AND NOT-NPY1R | 1 | 1 | 1 |
| COMPLEX-CLDN7/PTPRZ1/CD37 | 0.985507 | 0.985507 | 0.985507 | FOLH1 AND NOT-ABCC6 AND FZD4 | 1 | 1 | 1 |
| PTPRZ1 AND CBX3 AND NOT-FOLR1 | 0.977778 | 1 | 0.956522 | FOLH1 AND HPN AND NOT-SLC38A4 | 1 | 1 | 1 |
| PTPRZ1 AND NOT-CLDN6 AND NCAM1 | 0.978102 | 0.985294 | 0.971014 | FOLH1 AND HPN AND NOT-SLC38A4 | 1 | 1 | 1 |
| PTPRZ1 AND NOT-CLDN6 AND NOT-TRPM4 | 0.962963 | 0.984848 | 0.942029 | FOLH1 AND BCAM AND NOT-LSAMP | 1 | 1 | 1 |
| PTPRZ1 AND NOT-CLDN6 AND NOT-CLDN23 | 0.978102 | 0.985294 | 0.971014 | FOLH1 AND NOT-ABCC6 AND FZD5 | 1 | 1 | 1 |
| COMPLEX-EGFR/PTPRZ1/CLDN8 | 0.985507 | 0.985507 | 0.985507 | FOLH1 AND ADRB2 AND NOT-SLC52A3 | 1 | 1 | 1 |
| GPM6A AND ITGAV AND MUC16 | 0.956522 | 0.956522 | 0.956522 | FOLH1 AND ADRB2 AND NOT-CAV1 | 1 | 1 | 1 |
| PTPRZ1 AND NOT-CLDN6 AND NOT-SDC1 | 0.978102 | 0.985294 | 0.971014 | FOLH1 AND GOLM1 AND NOT-VIMP | 1 | 1 | 1 |
| PTPRZ1 AND NOT-GPA33 AND NOT-CLDN1 | 0.978102 | 0.985294 | 0.971014 | FOLH1 AND NOT-DNER AND LDLRAD3 | 1 | 1 | 1 |
| COMPLEX-MET/PTPRZ1/CLDN8 | 0.978102 | 0.985294 | 0.971014 | FOLH1 AND ADRB2 AND NOT-CAV1 | 1 | 1 | 1 |
| COMPLEX-TRPM4/PTPRZ1/CLDN8 | 0.985507 | 0.985507 | 0.985507 | FOLH1 AND ADRB2 AND NOT-ABHD6 | 1 | 1 | 1 |
| GPM6A AND ITGAV AND FOLR1 | 0.94964 | 0.942857 | 0.956522 | FOLH1 AND HPN AND NOT-ABCG2 | 1 | 1 | 1 |
| PTPRZ1 AND NOT-CLDN8 AND NOT-GPA33 | 0.978102 | 0.985294 | 0.971014 | FOLH1 AND ADRB2 AND NOT-LSAMP | 1 | 1 | 1 |
| PTPRZ1 AND NOT-RAET1E AND NOT-GPA33 | 0.985294 | 1 | 0.971014 | FOLH1 AND NOT-DNER AND LDLRAD3 | 1 | 1 | 1 |
| PTPRZ1 AND NOT-CEACAM6 AND NOT-GPA33 | 0.985294 | 1 | 0.971014 | FOLH1 AND NOT-ABHD6 AND FZD5 | 1 | 1 | 1 |
| PTPRZ1 AND NOT-GPA33 AND NOT-CLDN23 | 0.985507 | 0.985507 | 0.985507 | FOLH1 AND ADRB2 AND NOT-SLC52A3 | 1 | 1 | 1 |
| PTPRZ1 AND NOT-GPA33 AND NOT-TRPM4 | 0.970588 | 0.985075 | 0.956522 | FOLH1 AND NOT-ABCC6 AND ICAM3 | 1 | 1 | 1 |
| PTPRZ1 AND NOT-GPA33 AND NOT-CLDN23 | 0.985507 | 0.985507 | 0.985507 | FOLH1 AND NOT-ABHD6 AND IFNGR2 | 1 | 1 | 1 |
| PTPRZ1 AND NOT-GPA33 AND NOT-TRPM4 | 0.970588 | 0.985075 | 0.956522 | FOLH1 AND HPN AND NOT-ABCG2 | 1 | 1 | 1 |
| PTPRZ1 AND NOT-GPA33 AND NCAM1 | 0.985507 | 0.985507 | 0.985507 | FOLH1 AND ADRB2 AND NOT-ABHD6 | 1 | 1 | 1 |
| COMPLEX-CSPG4/TRPM4/PTPRZ1 | 0.962406 | 1 | 0.927536 | FOLH1 AND NOT-ABCC6 AND FZD5 | 1 | 1 | 1 |
| COMPLEX-FOLR1/PTPRZ1/CLDN8 | 0.978102 | 0.985294 | 0.971014 | FOLH1 AND GOLM1 AND NOT-VIMP | 1 | 1 | 1 |
| COMPLEX-GPNMB/PTPRZ1/BCAN | 0.985294 | 1 | 0.971014 | FOLH1 AND NOT-ABCC6 AND SLC6A14 | 1 | 1 | 1 |
| GPM6A AND ITGAV AND RAET1E | 0.94964 | 0.942857 | 0.956522 | FOLH1 AND NOT-ABHD6 AND FZD5 | 1 | 1 | 1 |
| PTPRZ1 AND ITGAV AND NOT-SDC1 | 0.985294 | 1 | 0.971014 | FOLH1 AND NOT-ABCC6 AND ICAM3 | 1 | 1 | 1 |
| COMPLEX-IL20RA/PTPRZ1/CLDN12 | 0.962963 | 0.984848 | 0.942029 | FOLH1 AND GOLM1 AND NOT-ABHD6 | 1 | 1 | 1 |
| COMPLEX-ITGAV/MET/PTPRZ1 | 0.985294 | 1 | 0.971014 | ANO7 AND NOT-LSAMP AND FOLH1 | 1 | 1 | 1 |
| PTPRZ1 AND NOT-CEACAM6 AND NOT-SSTR5 | 0.985294 | 1 | 0.971014 | FOLH1 AND CD320 AND NOT-LSAMP | 1 | 1 | 1 |
| PTPRZ1 AND NOT-CEACAM6 AND NOT-SSTR3 | 0.985294 | 1 | 0.971014 | FOLH1 AND ITGA5 AND NOT-CAV1 | 1 | 1 | 1 |
| COMPLEX-PTPRZ1/TPBG/CLDN8 | 0.985507 | 0.985507 | 0.985507 | FOLH1 AND POPDC2 AND NOT-CAV1 | 1 | 1 | 1 |
| PTPRZ1 AND NOT-GPA33 AND NOT-SDC1 | 0.985507 | 0.985507 | 0.985507 | FOLH1 AND BCAM AND NOT-SGCD | 1 | 1 | 1 |
| PTPRZ1 AND NOT-GPA33 AND NOT-SDC1 | 0.985507 | 0.985507 | 0.985507 | FOLH1 AND IL1RAPL1 AND NOT-PLP1 | 1 | 1 | 1 |
| PTPRZ1 AND NOT-MST1R AND NOT-GPA33 | 0.985507 | 0.985507 | 0.985507 | FOLH1 AND HPN AND NOT-SLC47A1 | 1 | 1 | 1 |
| COMPLEX-CBX3/PTPRZ1/TPBG | 0.977778 | 1 | 0.956522 | FOLH1 AND HPN AND NOT-SLC47A1 | 1 | 1 | 1 |
| PTPRZ1 AND NOT-ITGB6 AND NOT-GPA33 | 0.985294 | 1 | 0.971014 | FOLH1 AND ADRB2 AND NOT-NPY1R | 1 | 1 | 1 |
| PTPRZ1 AND NOT-CLDN4 AND NOT-GPA33 | 0.985294 | 1 | 0.971014 | FOLH1 AND ADRB2 AND NOT-ROR2 | 1 | 1 | 1 |
| COMPLEX-ITGAV/PTPRZ1/BMPR1B | 0.992701 | 1 | 0.985507 | FOLH1 AND GOLM1 AND NOT-ABCC6 | 1 | 1 | 1 |
| GPM6A AND ITGAV AND CLDN1 | 0.94964 | 0.942857 | 0.956522 | FOLH1 AND TMPRSS2 AND NOT-SLC2A5 | 1 | 1 | 1 |
| GPM6A AND ITGAV AND SLAMF7 | 0.94964 | 0.942857 | 0.956522 | FOLH1 AND ADRB2 AND NOT-ROR2 | 1 | 1 | 1 |
| PTPRZ1 AND NOT-TYR AND NOT-GPA33 | 0.977778 | 1 | 0.956522 | FOLH1 AND ADRB2 AND NOT-SLC18A2 | 1 | 1 | 1 |
| PTPRZ1 AND ITGAV AND NOT-TRPM4 | 0.985294 | 1 | 0.971014 | COMPLEX-FOLH1/DAGLA/OR51E2 | 1 | 1 | 1 |
| PTPRZ1 AND ITGAV AND NOT-CLDN23 | 0.985294 | 1 | 0.971014 | FOLH1 AND GOLM1 AND NOT-ABCC6 | 1 | 1 | 1 |
| PTPRZ1 AND ITGAV AND NCAM1 | 0.985294 | 1 | 0.971014 | FOLH1 AND ADRB2 AND NOT-NPY1R | 1 | 1 | 1 |
| PTPRZ1 AND NOT-CLDN1 AND NOT-SSTR3 | 0.978102 | 0.985294 | 0.971014 | FOLH1 AND FZD4 AND NOT-SGCE | 1 | 1 | 1 |
| COMPLEX-IL20RA/TRPM4/PTPRZ1 | 0.970588 | 0.985075 | 0.956522 | FOLH1 AND AGTRAP AND NOT-SLC2A5 | 1 | 1 | 1 |
| PTPRZ1 AND NOT-GPA33 AND NOT-VTCN1 | 0.978102 | 0.985294 | 0.971014 | FOLH1 AND SLC39A10 AND NOT-LSAMP | 1 | 1 | 1 |
| PTPRZ1 AND NOT-SLAMF7 AND NOT-GPA33 | 0.977778 | 1 | 0.956522 | FOLH1 AND ADRB2 AND NOT-ABCC6 | 1 | 1 | 1 |
| COMPLEX-PTPRZ1/BCAN/BMPR1B | 0.938462 | 1 | 0.884058 | FOLH1 AND NOT-ABCC6 AND SLC19A2 | 1 | 1 | 1 |
| COMPLEX-TRPM4/PTPRZ1/BCAN | 0.938462 | 1 | 0.884058 | FOLH1 AND NOT-ABHD6 AND PANX1 | 1 | 1 | 1 |
| PTPRZ1 AND NOT-CLDN4 AND SDC1 | 0.962963 | 0.984848 | 0.942029 | FOLH1 AND TMPRSS2 AND NOT-SLC2A5 | 1 | 1 | 1 |
| COMPLEX-CLDN11/PTPRZ1/CD37 | 0.970588 | 0.985075 | 0.956522 | FOLH1 AND BCAM AND NOT-SLC2A5 | 1 | 1 | 1 |
| COMPLEX-CLDN7/TRPM4/PTPRZ1 | 0.970588 | 0.985075 | 0.956522 | FOLH1 AND GOLM1 AND NOT-SEMA6D | 1 | 1 | 1 |
| COMPLEX-HSPA5/TRPM4/PTPRZ1 | 0.977778 | 1 | 0.956522 | FOLH1 AND NOT-ABCC6 AND SLC30A5 | 1 | 1 | 1 |
| PTPRZ1 AND NOT-GPA33 AND NOT-STEAP2 | 0.985507 | 0.985507 | 0.985507 | FOLH1 AND NOT-ABCC6 AND IFNGR2 | 1 | 1 | 1 |
| PTPRZ1 AND NOT-GPA33 AND CD276 | 0.992701 | 1 | 0.985507 | FOLH1 AND ADRB2 AND NOT-SLC18A2 | 1 | 1 | 1 |
| PTPRZ1 AND NOT-CXCR5 AND NOT-CLDN23 | 0.962406 | 1 | 0.927536 | FOLH1 AND ADRB2 AND NOT-SGCE | 1 | 1 | 1 |
| PTPRZ1 AND NOT-CXCR5 AND NCAM1 | 0.962406 | 1 | 0.927536 | FOLH1 AND ADRB2 AND NOT-ATP1A2 | 1 | 1 | 1 |
| PTPRZ1 AND NCAM1 AND NOT-SSTR3 | 0.985507 | 0.985507 | 0.985507 | FOLH1 AND ADRB2 AND NOT-SLC16A2 | 1 | 1 | 1 |
| PTPRZ1 AND NOT-CLDN23 AND NOT-SSTR3 | 0.985507 | 0.985507 | 0.985507 | FOLH1 AND HPN AND NOT-TGFBR3 | 1 | 1 | 1 |
| PTPRZ1 AND NOT-CLDN1 AND NOT-SSTR5 | 0.978102 | 0.985294 | 0.971014 | FOLH1 AND ADRB2 AND NOT-PCDH7 | 1 | 1 | 1 |
| COMPLEX-ROR1/PTPRZ1/PMEL | 0.978102 | 0.985294 | 0.971014 | FOLH1 AND ADRB2 AND NOT-PCDH7 | 1 | 1 | 1 |
| PTPRZ1 AND NCAM1 AND NOT-SSTR3 | 0.985507 | 0.985507 | 0.985507 | FOLH1 AND GOLM1 AND NOT-ABCC6 | 1 | 1 | 1 |
| COMPLEX-CEACAM6/TRPM4/PTPRZ1 | 0.992701 | 1 | 0.985507 | FOLH1 AND ADRB2 AND NOT-ABCC6 | 1 | 1 | 1 |
| PTPRZ1 AND NOT-CLDN23 AND NOT-CLDN18 | 0.978102 | 0.985294 | 0.971014 | FOLH1 AND GOLM1 AND NOT-SEMA6D | 1 | 1 | 1 |
| COMPLEX-ABCB5/PTPRZ1/BCAN | 0.992701 | 1 | 0.985507 | FOLH1 AND FZD4 AND NOT-DNER | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NOT-CEACAM5 AND NOT-GPA33 | 0.985507 | 0.985507 | 0.985507 | FOLH1 AND GOLM1 AND NOT-ITGA6 | 1 | 1 | 1 |
| PTPRZ1 AND NCAM1 AND NOT-CLDN18 | 0.978102 | 0.985294 | 0.971014 | FOLH1 AND SLC39A10 AND NOT-LSAMP | 1 | 1 | 1 |
| PTPRZ1 AND NOT-GPA33 AND SLC39A6 | 0.970149 | 1 | 0.942029 | FOLH1 AND AGTRAP AND NOT-LSAMP | 1 | 1 | 1 |
| PTPRZ1 AND NOT-GPA33 AND NOT-TNFRSF10A | 0.978102 | 0.985294 | 0.971014 | FOLH1 AND HPN AND NOT-TGFBR3 | 1 | 1 | 1 |
| PTPRZ1 AND SLC39A6 AND NCAM1 | 0.970149 | 1 | 0.942029 | FOLH1 AND ADRB2 AND NOT-SGCE | 1 | 1 | 1 |
| COMPLEX-GPNMB/CLDN7/PTPRZ1 | 0.985507 | 0.985507 | 0.985507 | FOLH1 AND NOT-ABHD6 AND VMP1 | 1 | 1 | 1 |
| COMPLEX-EDNRB/TRPM4/PTPRZ1 | 0.938462 | 1 | 0.884058 | FOLH1 AND FZD4 AND NOT-SGCE | 1 | 1 | 1 |
| PTPRZ1 AND NOT-TYR AND NOT-SSTR5 | 0.985294 | 1 | 0.971014 | FOLH1 AND ADRB2 AND NOT-GPR161 | 1 | 1 | 1 |
| COMPLEX-PTPRZ1/BCAN/SSTR3 | 0.977778 | 1 | 0.956522 | FOLH1 AND ADRB2 AND NOT-PANX1 | 1 | 1 | 1 |
| PTPRZ1 AND NOT-TYR AND NOT-SSTR3 | 0.985294 | 1 | 0.971014 | FOLH1 AND FZD4 AND NOT-DNER | 1 | 1 | 1 |
| PTPRZ1 AND NOT-TYR AND NOT-FOLR1 | 0.985294 | 1 | 0.971014 | FOLH1 AND NOT-ABHD6 AND PANX1 | 1 | 1 | 1 |
| PTPRZ1 AND NOT-HHLA2 AND NOT-SDC1 | 0.985507 | 0.985507 | 0.985507 | FOLH1 AND ADRB2 AND NOT-PANX1 | 1 | 1 | 1 |
| PTPRZ1 AND NOT-STEAP2 AND NOT-SSTR5 | 0.985507 | 0.985507 | 0.985507 | FOLH1 AND NOT-ABHD6 AND VMP1 | 1 | 1 | 1 |
| PTPRZ1 AND NOT-STEAP2 AND NOT-SSTR3 | 0.985507 | 0.985507 | 0.985507 | FOLH1 AND NOT-ABHD6 AND DHRS3 | 1 | 1 | 1 |
| COMPLEX-IL13RA1/MET/PTPRZ1 | 0.977778 | 1 | 0.956522 | FOLH1 AND AGTRAP AND NOT-LSAMP | 1 | 1 | 1 |
| COMPLEX-GPNMB/PTPRZ1/CLDN8 | 0.978102 | 0.985294 | 0.971014 | FOLH1 AND NOT-ABCC6 AND IFNGR2 | 1 | 1 | 1 |
| PTPRZ1 AND NOT-CXCR5 AND NOT-SDC1 | 0.962406 | 1 | 0.927536 | FOLH1 AND NOT-ABHD6 AND DHRS3 | 1 | 1 | 1 |
| PTPRZ1 AND NOT-CEACAM6 AND NOT-SSTR4 | 0.985294 | 1 | 0.971014 | FOLH1 AND AGTRAP AND NOT-SLC2A5 | 1 | 1 | 1 |
| GPM6A AND CBX3 AND NOT-FOLR1 | 0.962406 | 1 | 0.927536 | FOLH1 AND ADRB2 AND NOT-SLC2A5 | 1 | 1 | 1 |
| PTPRZ1 AND NOT-CLDN23 AND NOT-DNAJB8 | 0.985507 | 0.985507 | 0.985507 | FOLH1 AND ADRB2 AND NOT-POPDC2 | 1 | 1 | 1 |
| PTPRZ1 AND NOT-SSTR3 AND NOT-SDC1 | 0.985507 | 0.985507 | 0.985507 | FOLH1 AND STYK1 AND NOT-SLC52A3 | 0.888889 | 0.8 | 1 |
| PTPRZ1 AND NCAM1 AND NOT-SSTR5 | 0.985507 | 0.985507 | 0.985507 | COMPLEX-FOLH1/OR51E2/CD69 | 0.888889 | 0.8 | 1 |
| PTPRZ1 AND NOT-CLDN23 AND NOT-SSTR5 | 0.985507 | 0.985507 | 0.985507 | FOLH1 AND NOT-ABHD6 AND CD69 | 0.888889 | 0.8 | 1 |
| COMPLEX-FOLR1/PTPRZ1/PMEL | 0.970588 | 0.985075 | 0.956522 | FOLH1 AND NOT-ABHD6 AND ATP11B | 0.888889 | 0.8 | 1 |
| PTPRZ1 AND NCAM1 AND NOT-ULBP3 | 0.985507 | 0.985507 | 0.985507 | COMPLEX-CLCA4/FOLH1/OR51E2 | 0.888889 | 0.8 | 1 |
| PTPRZ1 AND NCAM1 AND NOT-DNAJB8 | 0.985507 | 0.985507 | 0.985507 | TRPM8 AND NOT-POPDC2 AND NOT-SLC39A2 | 1 | 1 | 1 |
| COMPLEX-TRPM4/SLAMF7/PTPRZ1 | 0.985294 | 1 | 0.971014 | TRPM8 AND NOT-SLC2A5 AND NOT-DYSF | 1 | 1 | 1 |
| COMPLEX-TRPM4/PTPRZ1/PMEL | 0.978102 | 0.985294 | 0.971014 | TRPM8 AND NOT-CAV1 AND STEAP4 | 1 | 1 | 1 |
| GPM6A AND F2R AND NOT-ZP4 | 0.992701 | 1 | 0.985507 | TRPM8 AND NOT-SLC2A5 AND SLCO1A2 | 1 | 1 | 1 |
| GPM6A AND F2R AND NOT-LRRN4 | 0.992701 | 1 | 0.985507 | OR51E2 AND NOT-FMNL1 AND SLCO1A2 | 1 | 1 | 1 |
| GPM6A AND F2R AND NOT-OR3A2 | 0.992701 | 1 | 0.985507 | TRPM8 AND NOT-CAV1 AND PTGER4 | 1 | 1 | 1 |
| GPM6A AND F2R AND NOT-TRPC3 | 0.985294 | 1 | 0.971014 | TRPM8 AND NOT-SLC39A2 AND NOT-PLP2 | 1 | 1 | 1 |
| GPM6A AND F2R AND NOT-BEST2 | 0.992701 | 1 | 0.985507 | OR51E2 AND NOT-SLC39A2 AND SLCO1A2 | 1 | 1 | 1 |
| GPM6A AND F2R AND NOT-FGF6 | 0.992701 | 1 | 0.985507 | TRPM8 AND NOT-SLC39A2 AND NOT-MYADM | 1 | 1 | 1 |
| GPM6A AND F2R AND NOT-ABCG5 | 0.992701 | 1 | 0.985507 | TRPM8 AND NOT-SLC2A5 AND NOT-DYSF | 1 | 1 | 1 |
| GPM6A AND F2R AND NOT-GPR78 | 0.985294 | 1 | 0.971014 | OR51E2 AND NOT-FMNL1 AND GPR19 | 1 | 1 | 1 |
| GPM6A AND F2R AND NOT-MUC17 | 0.992701 | 1 | 0.985507 | OR51E2 AND NOT-FMNL1 AND GPR19 | 1 | 1 | 1 |
| GPM6A AND F2R AND NOT-GJB4 | 0.992701 | 1 | 0.985507 | OR51E2 AND NOT-SLC39A2 AND GPR19 | 1 | 1 | 1 |
| GPM6A AND F2R AND NOT-SLC22A11 | 0.992701 | 1 | 0.985507 | TRPM8 AND NOT-SLC2A5 AND NOT-SYT4 | 1 | 1 | 1 |
| GPM6A AND F2R AND NOT-SLC26A8 | 0.992701 | 1 | 0.985507 | TRPM8 AND NOT-SLC39A2 AND NOT-CD81 | 1 | 1 | 1 |
| GPM6A AND F2R AND NOT-CHRND | 0.992701 | 1 | 0.985507 | OR51E2 AND NOT-FMNL1 AND SLCO1A2 | 1 | 1 | 1 |
| GPM6A AND F2R AND NOT-OR8B2 | 0.992701 | 1 | 0.985507 | TRPM8 AND NOT-CAV1 AND CD163 | 1 | 1 | 1 |
| GPM6A AND F2R AND NOT-SLC9B1 | 0.992701 | 1 | 0.985507 | COMPLEX-BFAR/TRPM8/SLC16A5 | 1 | 1 | 1 |
| GPM6A AND F2R AND NOT-GABRG3 | 0.992701 | 1 | 0.985507 | TRPM8 AND NOT-SLC2A5 AND NOT-GYPC | 1 | 1 | 1 |
| GPM6A AND F2R AND NOT-HTR6 | 0.985294 | 1 | 0.971014 | TRPM8 AND NOT-SLC2A5 AND NOT-EMP3 | 1 | 1 | 1 |
| GPM6A AND F2R AND NOT-ATP8B2 | 0.992701 | 1 | 0.985507 | OR51E2 AND NOT-SLC39A2 AND GPR19 | 1 | 1 | 1 |
| GPM6A AND F2R AND NOT-STAB1 | 0.992701 | 1 | 0.985507 | TRPM8 AND NOT-SLC2A5 AND NOT-SLC16A5 | 1 | 1 | 1 |
| GPM6A AND F2R AND NOT-PTGER4 | 0.992701 | 1 | 0.985507 | TRPM8 AND NOT-SLC2A5 AND NOT-SYT4 | 1 | 1 | 1 |
| GPM6A AND F2R AND NOT-KCNU1 | 0.992701 | 1 | 0.985507 | TRPM8 AND NOT-SLC39A2 AND NOT-MYADM | 1 | 1 | 1 |
| GPM6A AND F2R AND NOT-KCNA4 | 0.992701 | 1 | 0.985507 | OR51E2 AND NOT-SLC39A2 AND SLCO1A2 | 1 | 1 | 1 |
| GPM6A AND F2R AND NOT-ADAM21 | 0.977778 | 1 | 0.956522 | TRPM8 AND NOT-SLC2A5 AND NOT-GYPC | 1 | 1 | 1 |
| PTPRZ1 AND NOT-SLC6A15 AND ASTN1 | 0.978102 | 0.985294 | 0.971014 | TRPM8 AND NOT-SLC2A5 AND SLCO1A2 | 1 | 1 | 1 |
| GPM6A AND F2R AND NOT-KCNJ9 | 0.992701 | 1 | 0.985507 | TRPM8 AND NOT-SLC39A2 AND NOT-ITM2C | 1 | 1 | 1 |
| PTPRZ1 AND NOT-SLC6A15 AND GPR158 | 0.978102 | 0.985294 | 0.971014 | TRPM8 AND NOT-SLC39A2 AND NPFFR2 | 1 | 1 | 1 |
| PTPRZ1 AND F2R AND GPR158 | 0.985294 | 1 | 0.971014 | TRPM8 AND NOT-SLC2A5 AND NOT-IL17RA | 1 | 1 | 1 |
| PTPRZ1 AND F2R AND NOT-SLC43A1 | 0.985294 | 1 | 0.971014 | TRPM8 AND NOT-LSAMP AND NOT-SLC39A2 | 1 | 1 | 1 |
| PTPRZ1 AND F2R AND NOT-KCNK6 | 0.985294 | 1 | 0.971014 | TRPM8 AND NOT-ATP1A2 AND PTGER4 | 1 | 1 | 1 |
| PTPRZ1 AND F2R AND NOT-SCARA5 | 0.985294 | 1 | 0.971014 | COMPLEX-PAM/TRPM8/SLC16A5 | 1 | 1 | 1 |
| PTPRZ1 AND F2R AND ASTN1 | 0.985294 | 1 | 0.971014 | TRPM8 AND NOT-HAS3 AND NOT-SLC39A2 | 1 | 1 | 1 |
| PTPRZ1 AND NOT-SLC6A15 AND NOT-KCNK6 | 0.978102 | 0.985294 | 0.971014 | TRPM8 AND NOT-LSAMP AND F2R | 1 | 1 | 1 |
| PTPRZ1 AND NOT-SLC6A15 AND NOT-ATP8B1 | 0.978102 | 0.985294 | 0.971014 | TRPM8 AND NOT-SLC2A5 AND NOT-EPHA2 | 1 | 1 | 1 |
| PTPRZ1 AND NOT-SLC6A15 AND SLC1A2 | 0.978102 | 0.985294 | 0.971014 | TRPM8 AND NOT-LSAMP AND NOT-SLC4A8 | 1 | 1 | 1 |
| PTPRZ1 AND F2R AND NOT-SLC34A1 | 0.985294 | 1 | 0.971014 | TRPM8 AND NOT-LSAMP AND ATP8B1 | 1 | 1 | 1 |
| PTPRZ1 AND F2R AND NOT-SLC13A2 | 0.985294 | 1 | 0.971014 | TRPM8 AND NOT-DYSF AND LDLRAD3 | 1 | 1 | 1 |
| PTPRZ1 AND F2R AND NOT-ATP8B1 | 0.985294 | 1 | 0.971014 | TRPM8 AND NOT-UNC5B AND SLCO1A2 | 1 | 1 | 1 |
| PTPRZ1 AND F2R AND NOT-THBD | 0.985294 | 1 | 0.971014 | OR51E2 AND NOT-CHRNA2 AND NOT-SLC39A2 | 1 | 1 | 1 |
| PTPRZ1 AND F2R AND NOT-GUCY2D | 0.985294 | 1 | 0.971014 | TRPM8 AND NOT-POPDC2 AND NOT-FMNL1 | 1 | 1 | 1 |
| PTPRZ1 AND NOT-NKAIN2 AND ASTN1 | 0.985507 | 0.985507 | 0.985507 | OR51E2 AND NOT-CHRNA2 AND NOT-SLC39A2 | 1 | 1 | 1 |
| PTPRZ1 AND F2R AND SLC1A2 | 0.985294 | 1 | 0.971014 | TRPM8 AND NOT-PCDH7 AND PTGER4 | 1 | 1 | 1 |
| PTPRZ1 AND NOT-ABCG4 AND ASTN1 | 0.978102 | 0.985294 | 0.971014 | TRPM8 AND NOT-LSAMP AND NOT-SYT4 | 1 | 1 | 1 |
| PTPRZ1 AND NOT-HCN1 AND ASTN1 | 0.978102 | 0.985294 | 0.971014 | TRPM8 AND NOT-PRIMA1 AND NOT-SLC39A2 | 1 | 1 | 1 |
| PTPRZ1 AND NOT-SLC6A15 AND NOT-SCARA5 | 0.978102 | 0.985294 | 0.971014 | TRPM8 AND NOT-CLSTN2 AND SLCO1A2 | 1 | 1 | 1 |
| PTPRZ1 AND F2R AND NOT-MRGPRF | 0.985294 | 1 | 0.971014 | TRPM8 AND NOT-POPDC2 AND NOT-FMNL1 | 1 | 1 | 1 |
| PTPRZ1 AND F2R AND CD74 | 0.985294 | 1 | 0.971014 | TRPM8 AND NOT-SLC2A5 AND NOT-SLC4A8 | 1 | 1 | 1 |
| PTPRZ1 AND F2R AND NOT-BEST2 | 0.985294 | 1 | 0.971014 | OR51E2 AND NOT-CHRNA2 AND NOT-FMNL1 | 1 | 1 | 1 |
| PTPRZ1 AND F2R AND NOT-LRFN2 | 0.985294 | 1 | 0.971014 | TRPM8 AND NOT-SLC18A2 AND F2R | 1 | 1 | 1 |
| PTPRZ1 AND NOT-NKAIN2 AND GPR158 | 0.985507 | 0.985507 | 0.985507 | TRPM8 AND NOT-SLC2A5 AND NOT-SLC39A2 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND F2R AND NOT-ZP4 | 0.985294 | 1 | 0.971014 | OR51E2 AND NOT-FMNL1 AND MEGF11 | 1 | 1 | 1 |
| PTPRZ1 AND F2R AND NOT-LRRN4 | 0.985294 | 1 | 0.971014 | TRPM8 AND GOLM1 AND SLCO1A2 | 1 | 1 | 1 |
| PTPRZ1 AND F2R AND NOT-OR3A2 | 0.985294 | 1 | 0.971014 | TRPM8 AND NOT-ROR2 AND F2R | 1 | 1 | 1 |
| PTPRZ1 AND F2R AND NOT-GRIN2B | 0.985294 | 1 | 0.971014 | OR51E2 AND NOT-FMNL1 AND MEGF11 | 1 | 1 | 1 |
| PTPRZ1 AND F2R AND NOT-GPR135 | 0.985294 | 1 | 0.971014 | TRPM8 AND NOT-SLC2A5 AND NOT-STAB1 | 1 | 1 | 1 |
| PTPRZ1 AND F2R AND NOT-SLC17A3 | 0.985294 | 1 | 0.971014 | TRPM8 AND NOT-SLC2A5 AND SLC2A2 | 1 | 1 | 1 |
| PTPRZ1 AND F2R AND ATP13A5 | 0.985294 | 1 | 0.971014 | OR51E2 AND NOT-CHRNA2 AND NOT-FMNL1 | 1 | 1 | 1 |
| PTPRZ1 AND F2R AND NOT-RXFP3 | 0.985294 | 1 | 0.971014 | TRPM8 AND NOT-SLC39A2 AND NOT-ITM2C | 1 | 1 | 1 |
| PTPRZ1 AND F2R AND CRB1 | 0.985294 | 1 | 0.971014 | TRPM8 AND NOT-SLC2A5 AND NOT-SLC5A2 | 1 | 1 | 1 |
| PTPRZ1 AND NOT-SCN8A AND ASTN1 | 0.978102 | 0.985294 | 0.971014 | TRPM8 AND NOT-SLC2A5 AND NOT-STAB1 | 1 | 1 | 1 |
| PTPRZ1 AND NOT-ATP8A2 AND ASTN1 | 0.985507 | 0.985507 | 0.985507 | TRPM8 AND NOT-SLC2A5 AND NOT-TTYH2 | 1 | 1 | 1 |
| PTPRZ1 AND NOT-ABCG4 AND GPR158 | 0.978102 | 0.985294 | 0.971014 | TRPM8 AND NOT-SLC2A5 AND NOT-SLC4A8 | 1 | 1 | 1 |
| PTPRZ1 AND NOT-SLC6A15 AND NOT-THBD | 0.978102 | 0.985294 | 0.971014 | COMPLEX-RABAC1/TRPM8/SLC16A5 | 1 | 1 | 1 |
| PTPRZ1 AND NOT-SLC6A15 AND NOT-SLC43A1 | 0.978102 | 0.985294 | 0.971014 | TRPM8 AND NOT-SLC2A5 AND NOT-LAT | 1 | 1 | 1 |
| PTPRZ1 AND NOT-HCN1 AND GPR158 | 0.978102 | 0.985294 | 0.971014 | TRPM8 AND NOT-SLC2A5 AND NOT-SLC39A2 | 1 | 1 | 1 |
| PTPRZ1 AND NOT-NKAIN2 AND NOT-ATP8B1 | 0.985507 | 0.985507 | 0.985507 | TRPM8 AND NOT-SLC2A5 AND NOT-TTYH2 | 1 | 1 | 1 |
| PTPRZ1 AND F2R AND NOT-EPHA10 | 0.985294 | 1 | 0.971014 | TRPM8 AND NOT-ROR2 AND PTGER4 | 1 | 1 | 1 |
| PTPRZ1 AND NOT-NKAIN2 AND NOT-KCNK6 | 0.985507 | 0.985507 | 0.985507 | COMPLEX-GRIN2C/SLC22A18/OR51E2 | 1 | 1 | 1 |
| PTPRZ1 AND F2R AND NOT-CACNG7 | 0.985294 | 1 | 0.971014 | TRPM8 AND NOT-UNC5B AND GPR19 | 1 | 1 | 1 |
| PTPRZ1 AND F2R AND NOT-ABCG5 | 0.985294 | 1 | 0.971014 | TRPM8 AND NOT-SLC39A2 AND NOT-DNER | 1 | 1 | 1 |
| PTPRZ1 AND NOT-ATP8A2 AND GPR158 | 0.985507 | 0.985507 | 0.985507 | TRPM8 AND NOT-POPDC2 AND PTGER4 | 1 | 1 | 1 |
| PTPRZ1 AND F2R AND NOT-NMBR | 0.985294 | 1 | 0.971014 | COMPLEX-TRPM8/NRSN2/SLC16A5 | 1 | 1 | 1 |
| PTPRZ1 AND NOT-SCN8A AND GPR158 | 0.978102 | 0.985294 | 0.971014 | TRPM8 AND NOT-FZD1 AND THBD | 1 | 1 | 1 |
| PTPRZ1 AND NOT-NKAIN2 AND SLC1A2 | 0.985507 | 0.985507 | 0.985507 | TRPM8 AND NOT-SLC2A5 AND NOT-PAQR8 | 1 | 1 | 1 |
| PTPRZ1 AND F2R AND NOT-SLC22A12 | 0.985294 | 1 | 0.971014 | TRPM8 AND NOT-SLC2A5 AND NOT-BST2 | 1 | 1 | 1 |
| PTPRZ1 AND NOT-ABCG4 AND NOT-KCNK6 | 0.978102 | 0.985294 | 0.971014 | TRPM8 AND NOT-POPDC2 AND CD163 | 1 | 1 | 1 |
| PTPRZ1 AND NOT-ABCG4 AND SLC1A2 | 0.978102 | 0.985294 | 0.971014 | TRPM8 AND NOT-POPDC2 AND STEAP4 | 1 | 1 | 1 |
| PTPRZ1 AND NOT-ABCG4 AND NOT-ATP8B1 | 0.970588 | 0.985075 | 0.956522 | TRPM8 AND NOT-PRIMA1 AND NOT-SLC39A2 | 1 | 1 | 1 |
| PTPRZ1 AND NOT-CDH8 AND ASTN1 | 0.985507 | 0.985507 | 0.985507 | OR51E2 AND NOT-SLC39A2 AND MEGF11 | 1 | 1 | 1 |
| PTPRZ1 AND NOT-CACNA1B AND ASTN1 | 0.985507 | 0.985507 | 0.985507 | TRPM8 AND NOT-SLC39A2 AND NOT-VIMP | 1 | 1 | 1 |
| PTPRZ1 AND NOT-KIAA0319 AND ASTN1 | 0.985507 | 0.985507 | 0.985507 | TRPM8 AND NOT-SLC2A5 AND NOT-FXYD6 | 1 | 1 | 1 |
| PTPRZ1 AND NOT-KIAA0319 AND NOT-KCNK6 | 0.985507 | 0.985507 | 0.985507 | TRPM8 AND GOLM1 AND SLCO1A2 | 1 | 1 | 1 |
| PTPRZ1 AND NOT-SLC16A5 AND NOT-SLCO1A2 | 0.985507 | 0.985507 | 0.985507 | OR51E2 AND NOT-GUCY2D AND NOT-SLC39A2 | 1 | 1 | 1 |
| PTPRZ1 AND NOT-SLC16A5 AND ZP4 | 0.985507 | 0.985507 | 0.985507 | TRPM8 AND NOT-SLC2A5 AND NOT-SYT11 | 1 | 1 | 1 |
| PTPRZ1 AND NOT-HTR5A AND ASTN1 | 0.978102 | 0.985294 | 0.971014 | TRPM8 AND GOLM1 AND SLCO1A2 | 1 | 1 | 1 |
| PTPRZ1 AND NOT-SLC16A5 AND TNFRSF10B | 0.985294 | 1 | 0.971014 | TRPM8 AND NOT-SLC2A5 AND NOT-PAQR8 | 1 | 1 | 1 |
| PTPRZ1 AND NOT-HCN1 AND NOT-KCNK6 | 0.978102 | 0.985294 | 0.971014 | TRPM8 AND NOT-GPR161 AND PTGER4 | 1 | 1 | 1 |
| PTPRZ1 AND NOT-HCN1 AND NOT-ATP8B1 | 0.978102 | 0.985294 | 0.971014 | TRPM8 AND NOT-LSAMP AND NOT-SLC4A8 | 1 | 1 | 1 |
| PTPRZ1 AND NOT-HCN1 AND SLC1A2 | 0.978102 | 0.985294 | 0.971014 | OR51E2 AND NOT-GUCY2D AND NOT-SLC39A2 | 1 | 1 | 1 |
| PTPRZ1 AND F2R AND NOT-TRPC7 | 0.985294 | 1 | 0.971014 | COMPLEX-CDH17/SLC22A18/OR51E2 | 1 | 1 | 1 |
| PTPRZ1 AND NOT-SCN8A AND NOT-ATP8B1 | 0.978102 | 0.985294 | 0.971014 | OR51E2 AND NOT-GUCY2D AND NOT-FMNL1 | 1 | 1 | 1 |
| PTPRZ1 AND NOT-SLC6A15 AND NOT-MUC1 | 0.978102 | 0.985294 | 0.971014 | TRPM8 AND NOT-ATP1A2 AND F2R | 1 | 1 | 1 |
| PTPRZ1 AND NOT-HCN1 AND NOT-MUC1 | 0.978102 | 0.985294 | 0.971014 | OR51E2 AND NOT-SLC39A2 AND NOT-EBP | 1 | 1 | 1 |
| PTPRZ1 AND NOT-SCN8A AND NOT-MUC1 | 0.978102 | 0.985294 | 0.971014 | TRPM8 AND NOT-UNC5B AND SLCO1A2 | 1 | 1 | 1 |
| COMPLEX-MUC1/PTPRZ1/SLC16A5 | 0.985507 | 0.985507 | 0.985507 | TRPM8 AND NOT-SLC2A5 AND NOT-GRIN2C | 1 | 1 | 1 |
| PTPRZ1 AND NOT-HTR5A AND NOT-MUC1 | 0.978102 | 0.985294 | 0.971014 | TRPM8 AND NOT-SLC39A2 AND KCNMB2 | 1 | 1 | 1 |
| PTPRZ1 AND NOT-GRM3 AND NOT-MUC1 | 0.992701 | 1 | 0.985507 | COMPLEX-ABHD3/SLC13A1/OR51E2 | 1 | 1 | 1 |
| PTPRZ1 AND NOT-GABRA2 AND NOT-MUC1 | 0.985507 | 0.985507 | 0.985507 | TRPM8 AND NOT-SLC2A5 AND NOT-PHLDB2 | 1 | 1 | 1 |
| PTPRZ1 AND NOT-SLC26A8 AND NOT-MUC1 | 0.985507 | 0.985507 | 0.985507 | FOLH1 AND EPHA3 AND NOT-SGCD | 1 | 1 | 1 |
| PTPRZ1 AND NOT-KCNK9 AND NOT-MUC1 | 0.978102 | 0.985294 | 0.971014 | FOLH1 AND CLDN8 AND NOT-DNER | 1 | 1 | 1 |
| PTPRZ1 AND NOT-MTNR1B AND NOT-MUC1 | 0.977778 | 1 | 0.956522 | FOLH1 AND NOT-ABCC6 AND CLDN8 | 1 | 1 | 1 |
| PTPRZ1 AND NOT-EPHA10 AND NOT-ERBB2 | 0.978102 | 0.985294 | 0.971014 | FOLH1 AND CLDN8 AND NOT-DNER | 1 | 1 | 1 |
| PTPRZ1 AND NOT-KCNA7 AND NOT-MUC1 | 0.978102 | 0.985294 | 0.971014 | FOLH1 AND NOT-ABCC6 AND CLDN8 | 1 | 1 | 1 |
| PTPRZ1 AND NOT-PVRL1 AND NOT-MUC1 | 0.978102 | 0.985294 | 0.971014 | FOLH1 AND EPHA3 AND NOT-LSAMP | 1 | 1 | 1 |
| PTPRZ1 AND NOT-EPHA10 AND NOT-MUC1 | 0.985507 | 0.985507 | 0.985507 | FOLH1 AND EPHA3 AND NOT-FZD1 | 1 | 1 | 1 |
| PTPRZ1 AND NOT-EPHA10 AND NOT-MUC1 | 0.985507 | 0.985507 | 0.985507 | FOLH1 AND EPHA3 AND NOT-SEMA6D | 1 | 1 | 1 |
| PTPRZ1 AND NOT-GPR83 AND NOT-MUC1 | 0.978102 | 0.985294 | 0.971014 | FOLH1 AND EPHA3 AND NOT-SLC2A5 | 1 | 1 | 1 |
| PTPRZ1 AND NOT-HCN4 AND NOT-MUC1 | 0.985507 | 0.985507 | 0.985507 | FOLH1 AND NOT-ABCC6 AND MUC1 | 1 | 1 | 1 |
| PTPRZ1 AND NOT-NPHS1 AND NOT-MUC1 | 0.962963 | 0.984848 | 0.942029 | FOLH1 AND NOT-ABCC6 AND MUC1 | 1 | 1 | 1 |
| COMPLEX-FUT3/MUC1/PTPRZ1 | 0.985294 | 1 | 0.971014 | FOLH1 AND EPHA3 AND NOT-TENM2 | 1 | 1 | 1 |
| PTPRZ1 AND NOT-SLC22A9 AND NOT-MUC1 | 0.977778 | 1 | 0.956522 | FOLH1 AND EPHA3 AND NOT-SLC52A3 | 1 | 1 | 1 |
| COMPLEX-MUC1/PTPRZ1/CD1A | 0.992701 | 1 | 0.985507 | FOLH1 AND EPHA3 AND NOT-TENM2 | 1 | 1 | 1 |
| PTPRZ1 AND NOT-FGF6 AND NOT-MUC1 | 0.985507 | 0.985507 | 0.985507 | FOLH1 AND EPHA3 AND NOT-SEMA6D | 1 | 1 | 1 |
| PTPRZ1 AND NOT-GUCY2F AND NOT-MUC1 | 0.985507 | 0.985507 | 0.985507 | FOLH1 AND ADRB2 AND NOT-ST8SIA1 | 1 | 1 | 1 |
| PTPRZ1 AND NOT-HTR1E AND NOT-MUC1 | 0.985507 | 0.985507 | 0.985507 | FOLH1 AND EPHA3 AND NOT-SLC52A3 | 1 | 1 | 1 |
| PTPRZ1 AND NOT-CACNA1S AND NOT-MUC1 | 0.978102 | 0.985294 | 0.971014 | FOLH1 AND EPHA3 AND NOT-CAV1 | 0.888889 | 0.8 | 1 |
| PTPRZ1 AND NOT-TSPAN16 AND NOT-MUC1 | 0.985294 | 1 | 0.971014 | COMPLEX-FOLH1/AXL/OR51E2 | 0.888889 | 0.8 | 1 |
| COMPLEX-TMPRSS11E/MUC1/PTPRZ1 | 0.985507 | 0.985507 | 0.985507 | STEAP2 AND NOT-FZD1 AND FOLH1 | 0.888889 | 0.8 | 1 |
| COMPLEX-MUC1/PTPRZ1/SMPD2 | 0.970588 | 0.985075 | 0.956522 | COMPLEX-FOLH1/AXL/OR51E2 | 0.888889 | 0.8 | 1 |
| PTPRZ1 AND NOT-SLC13A2 AND NOT-ERBB2 | 0.978102 | 0.985294 | 0.971014 | FOLH1 AND EPHA3 AND NOT-ATP1A2 | 0.888889 | 0.8 | 1 |
| PTPRZ1 AND NOT-SLC17A3 AND NOT-ERBB2 | 0.978102 | 0.985294 | 0.971014 | FOLH1 AND EPHA3 AND NOT-GPR161 | 0.888889 | 0.8 | 1 |
| PTPRZ1 AND NOT-GPR156 AND NOT-MUC1 | 0.962963 | 0.984848 | 0.942029 | FOLH1 AND EPHA3 AND NOT-ITGA7 | 0.888889 | 0.8 | 1 |
| PTPRZ1 AND NOT-CLSTN3 AND NOT-MUC1 | 0.985507 | 0.985507 | 0.985507 | FOLH1 AND TNC AND NOT-SGCE | 0.888889 | 0.8 | 1 |
| PTPRZ1 AND NOT-MUC17 AND NOT-MUC1 | 0.985507 | 0.985507 | 0.985507 | FOLH1 AND EPHA3 AND NOT-NDRG4 | 0.888889 | 0.8 | 1 |
| PTPRZ1 AND NOT-RGSL1 AND NOT-MUC1 | 0.962963 | 0.984848 | 0.942029 | FOLH1 AND EPHA3 AND NOT-CAV1 | 0.888889 | 0.8 | 1 |
| PTPRZ1 AND NOT-KCNA10 AND NOT-MUC1 | 0.985507 | 0.985507 | 0.985507 | FOLH1 AND EPHA3 AND NOT-FADS2 | 0.888889 | 0.8 | 1 |
| PTPRZ1 AND NOT-MRGPRX2 AND NOT-ERBB2 | 0.978102 | 0.985294 | 0.971014 | FOLH1 AND TNC AND NOT-CAV1 | 0.888889 | 0.8 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NOT-MRAP AND NOT-MUC1 | 0.985507 | 0.985507 | 0.985507 | FOLH1 AND ROR1 AND NOT-CAV1 | 0.888889 | 0.8 | 1 |
| PTPRZ1 AND NOT-GRIN2B AND NOT-ERBB2 | 0.985294 | 1 | 0.971014 | FOLH1 AND EPHA3 AND NOT-SLC18A2 | 0.888889 | 0.8 | 1 |
| PTPRZ1 AND NOT-SLCO1B1 AND NOT-MUC1 | 0.985294 | 1 | 0.971014 | FOLH1 AND EPHA3 AND NOT-SLC18A2 | 0.888889 | 0.8 | 1 |
| PTPRZ1 AND NOT-ABCG8 AND NOT-MUC1 | 0.985507 | 0.985507 | 0.985507 | FOLH1 AND NOT-ABHD6 AND ROR1 | 0.888889 | 0.8 | 1 |
| PTPRZ1 AND NOT-GRIN2B AND NOT-MUC1 | 0.992701 | 1 | 0.985507 | STEAP2 AND NOT-FZD1 AND FOLH1 | 0.888889 | 0.8 | 1 |
| PTPRZ1 AND NOT-MRGPRX2 AND NOT-MUC1 | 0.985507 | 0.985507 | 0.985507 | FOLH1 AND NOT-ABCC6 AND ROR1 | 0.888889 | 0.8 | 1 |
| PTPRZ1 AND NOT-GRIN2B AND NOT-MUC1 | 0.992701 | 1 | 0.985507 | FOLH1 AND EPHA3 AND NOT-FGFR1 | 0.888889 | 0.8 | 1 |
| PTPRZ1 AND NOT-MRGPRX2 AND NOT-MUC1 | 0.985507 | 0.985507 | 0.985507 | STEAP2 AND NOT-FADS2 AND FOLH1 | 0.888889 | 0.8 | 1 |
| PTPRZ1 AND NOT-GPR22 AND NOT-MUC1 | 0.985507 | 0.985507 | 0.985507 | STEAP2 AND NOT-SLC52A3 AND FOLH1 | 0.888889 | 0.8 | 1 |
| PTPRZ1 AND NOT-KCNJ9 AND NOT-MUC1 | 0.985507 | 0.985507 | 0.985507 | STEAP2 AND NOT-FADS2 AND FOLH1 | 0.888889 | 0.8 | 1 |
| PTPRZ1 AND NOT-CCKBR AND NOT-MUC1 | 0.978102 | 0.985294 | 0.971014 | STEAP2 AND NOT-SLC52A3 AND FOLH1 | 0.888889 | 0.8 | 1 |
| PTPRZ1 AND NOT-SLC10A2 AND NOT-MUC1 | 0.978102 | 0.985294 | 0.971014 | FOLH1 AND EPHA3 AND NOT-PTPRZ1 | 0.888889 | 0.8 | 1 |
| COMPLEX-MUC1/CD207/PTPRZ1 | 0.985507 | 0.985507 | 0.985507 | FOLH1 AND EPHA3 AND NOT-PTPRZ1 | 0.888889 | 0.8 | 1 |
| PTPRZ1 AND NOT-AMHR2 AND NOT-MUC1 | 0.970588 | 0.985075 | 0.956522 | STEAP2 AND NOT-UNC5B AND FOLH1 | 1 | 1 | 1 |
| PTPRZ1 AND NOT-CASR AND NOT-ERBB2 | 0.978102 | 0.985294 | 0.971014 | STEAP2 AND NOT-UNC5B AND FOLH1 | 1 | 1 | 1 |
| PTPRZ1 AND NOT-ABCG5 AND NOT-ERBB2 | 0.978102 | 0.985294 | 0.971014 | STEAP2 AND NOT-UNC5B AND FOLH1 | 1 | 1 | 1 |
| PTPRZ1 AND NOT-LRFN2 AND NOT-ERBB2 | 0.978102 | 0.985294 | 0.971014 | FOLH1 AND EPHA3 AND NOT-ACE | 1 | 1 | 1 |
| PTPRZ1 AND NOT-SLC22A16 AND NOT-MUC1 | 0.978102 | 0.985294 | 0.971014 | FOLH1 AND ADRB2 AND NOT-TNC | 1 | 1 | 1 |
| PTPRZ1 AND CD74 AND NOT-ERBB2 | 0.978102 | 0.985294 | 0.971014 | FOLH1 AND CLDN8 AND NOT-TGFBR3 | 1 | 1 | 1 |
| PTPRZ1 AND NOT-GPR135 AND NOT-ERBB2 | 0.978102 | 0.985294 | 0.971014 | FOLH1 AND EPHA3 AND NOT-KCNN3 | 1 | 1 | 1 |
| PTPRZ1 AND NOT-PCDHAC2 AND NOT-MUC1 | 0.985507 | 0.985507 | 0.985507 | FOLH1 AND CLDN8 AND NOT-TGFBR3 | 1 | 1 | 1 |
| PTPRZ1 AND NOT-CNTNAP2 AND NOT-MUC1 | 0.978102 | 0.985294 | 0.971014 | FOLH1 AND EPHA3 AND NOT-SDC3 | 0.888889 | 0.8 | 1 |
| PTPRZ1 AND NOT-SLC22A8 AND NOT-MUC1 | 0.985507 | 0.985507 | 0.985507 | COMPLEX-FOLH1/MST1R/OR51E2 | 0.888889 | 0.8 | 1 |
| PTPRZ1 AND NOT-HTR6 AND NOT-MUC1 | 0.978102 | 0.985294 | 0.971014 | FOLH1 AND EPHA3 AND NOT-ACE | 1 | 1 | 1 |
| PTPRZ1 AND NOT-GRM7 AND NOT-MUC1 | 0.978102 | 0.985294 | 0.971014 | FOLH1 AND NOT-ABCC6 AND ABCA5 | 1 | 1 | 1 |
| PTPRZ1 AND NOT-GALR2 AND NOT-MUC1 | 0.978102 | 0.985294 | 0.971014 | FOLH1 AND EPHA3 AND NOT-SDC3 | 0.888889 | 0.8 | 1 |
| PTPRZ1 AND CD74 AND NOT-MUC1 | 0.985507 | 0.985507 | 0.985507 | FOLH1 AND CLDN8 AND NOT-KCNJ15 | 0.857143 | 1 | 0.75 |
| PTPRZ1 AND NOT-LRFN2 AND NOT-MUC1 | 0.985507 | 0.985507 | 0.985507 | FOLH1 AND EPHA3 AND NOT-PTCHD1 | 0.857143 | 1 | 0.75 |
| PTPRZ1 AND NOT-CASR AND NOT-MUC1 | 0.985507 | 0.985507 | 0.985507 | FOLH1 AND FZD4 AND NOT-ERBB4 | 0.857143 | 1 | 0.75 |
| PTPRZ1 AND NOT-ABCG5 AND NOT-MUC1 | 0.985507 | 0.985507 | 0.985507 | FOLH1 AND NOT-GPRC5B AND CLDN8 | 0.857143 | 1 | 0.75 |
| PTPRZ1 AND NOT-DSC1 AND NOT-MUC1 | 0.970588 | 0.985075 | 0.956522 | FOLH1 AND EPCAM AND NOT-SLC7A9 | 0.857143 | 1 | 0.75 |
| COMPLEX-EPHA2/PTPRZ1/SLC13A2 | 0.985507 | 0.985507 | 0.985507 | FOLH1 AND EPCAM AND NOT-MGAM | 0.857143 | 1 | 0.75 |
| COMPLEX-MUC1/PTPRZ1/SLC13A2 | 0.985507 | 0.985507 | 0.985507 | FOLH1 AND CLDN8 AND NOT-HS3ST3B1 | 0.857143 | 1 | 0.75 |
| PTPRZ1 AND CD74 AND NOT-MUC1 | 0.985507 | 0.985507 | 0.985507 | FOLH1 AND NOT-MET AND ATP11B | 0.888889 | 0.8 | 1 |
| PTPRZ1 AND NOT-LRFN2 AND NOT-MUC1 | 0.985507 | 0.985507 | 0.985507 | FOLH1 AND EPCAM AND NOT-SLC51B | 0.857143 | 1 | 0.75 |
| PTPRZ1 AND NOT-CASR AND NOT-MUC1 | 0.985507 | 0.985507 | 0.985507 | STEAP2 AND CACNA1D AND FOLH1 | 0.857143 | 1 | 0.75 |
| COMPLEX-MUC1/PTPRZ1/SLC13A2 | 0.985507 | 0.985507 | 0.985507 | FOLH1 AND EPCAM AND NOT-DSG2 | 0.857143 | 1 | 0.75 |
| PTPRZ1 AND NOT-GPR135 AND NOT-MUC1 | 0.985507 | 0.985507 | 0.985507 | FOLH1 AND EPHA3 AND NOT-NAALADL1 | 0.857143 | 1 | 0.75 |
| PTPRZ1 AND NOT-GPR135 AND NOT-MUC1 | 0.985507 | 0.985507 | 0.985507 | FOLH1 AND EPCAM AND SLC19A2 | 0.857143 | 1 | 0.75 |
| PTPRZ1 AND NOT-ABCG5 AND NOT-MUC1 | 0.985507 | 0.985507 | 0.985507 | FOLH1 AND EPCAM AND JAG2 | 0.857143 | 1 | 0.75 |
| COMPLEX-MUC1/PTPRZ1/SELP | 0.970588 | 0.985075 | 0.956522 | FOLH1 AND NOT-MET AND VMP1 | 0.888889 | 0.8 | 1 |
| PTPRZ1 AND NOT-SLC10A1 AND NOT-MUC1 | 0.977778 | 1 | 0.956522 | FOLH1 AND EPCAM AND NOT-CDHR5 | 0.857143 | 1 | 0.75 |
| PTPRZ1 AND NOT-MPL AND NOT-MUC1 | 0.978102 | 0.985294 | 0.971014 | FOLH1 AND EPCAM AND SLC14A1 | 0.857143 | 1 | 0.75 |
| PTPRZ1 AND NOT-LRRN4 AND NOT-ERBB2 | 0.978102 | 0.985294 | 0.971014 | FOLH1 AND EPCAM AND NOT-CD164 | 0.857143 | 1 | 0.75 |
| PTPRZ1 AND NOT-DIO1 AND NOT-ERBB2 | 0.978102 | 0.985294 | 0.971014 | FOLH1 AND EPHA3 AND NOT-PCDH9 | 0.857143 | 1 | 0.75 |
| PTPRZ1 AND NOT-NMBR AND NOT-ERBB2 | 0.978102 | 0.985294 | 0.971014 | FOLH1 AND EPHA3 AND NOT-LGR6 | 0.857143 | 1 | 0.75 |
| PTPRZ1 AND NOT-RXFP3 AND NOT-ERBB2 | 0.978102 | 0.985294 | 0.971014 | FOLH1 AND EPHA3 AND NOT-PTPRF | 0.857143 | 1 | 0.75 |
| PTPRZ1 AND NOT-SLC22A12 AND NOT-ERBB2 | 0.978102 | 0.985294 | 0.971014 | FOLH1 AND EPCAM AND SLC24A3 | 0.857143 | 1 | 0.75 |
| PTPRZ1 AND NOT-GUCY2D AND NOT-ERBB2 | 0.978102 | 0.985294 | 0.971014 | FOLH1 AND EPHA3 AND NOT-IL6R | 0.857143 | 1 | 0.75 |
| COMPLEX-MUC1/PTPRZ1/GGTLC1 | 0.992701 | 1 | 0.985507 | FOLH1 AND EPHA3 AND NOT-BMPR2 | 0.857143 | 1 | 0.75 |
| PTPRZ1 AND NOT-SLC17A1 AND NOT-ERBB2 | 0.978102 | 0.985294 | 0.971014 | FOLH1 AND ROR1 AND NOT-SLC52A3 | 1 | 1 | 1 |
| PTPRZ1 AND NOT-SLC34A1 AND NOT-ERBB2 | 0.978102 | 0.985294 | 0.971014 | FOLH1 AND TNC AND NOT-PRNP | 0.857143 | 1 | 0.75 |
| PTPRZ1 AND NOT-ADCY10 AND NOT-MUC1 | 0.985507 | 0.985507 | 0.985507 | FOLH1 AND ADRB2 AND NOT-PCYT1A | 0.857143 | 1 | 0.75 |
| PTPRZ1 AND NOT-BEST2 AND NOT-ERBB2 | 0.978102 | 0.985294 | 0.971014 | FOLH1 AND GOLM1 AND NOT-PCYT1A | 0.857143 | 1 | 0.75 |
| PTPRZ1 AND NOT-SLC22A2 AND NOT-ERBB2 | 0.978102 | 0.985294 | 0.971014 | FOLH1 AND CACNA1D AND NOT-CLDN11 | 0.857143 | 1 | 0.75 |
| PTPRZ1 AND ATP13A5 AND NOT-ERBB2 | 0.978102 | 0.985294 | 0.971014 | FOLH1 AND NOT-ABCG2 AND EPCAM | 0.857143 | 1 | 0.75 |
| PTPRZ1 AND NOT-LAT AND NOT-MUC1 | 0.962963 | 0.984848 | 0.942029 | FOLH1 AND EPCAM AND NOT-VIMP | 0.857143 | 1 | 0.75 |
| PTPRZ1 AND NOT-WNT7A AND NOT-MUC1 | 0.977778 | 1 | 0.956522 | FOLH1 AND EPCAM AND NOT-SI | 0.857143 | 1 | 0.75 |
| PTPRZ1 AND NOT-EPHA8 AND NOT-MUC1 | 0.985507 | 0.985507 | 0.985507 | FOLH1 AND EPHA3 AND NOT-ANTXR1 | 0.857143 | 1 | 0.75 |
| COMPLEX-ABCA12/MUC1/PTPRZ1 | 0.978102 | 0.985294 | 0.971014 | FOLH1 AND EPCAM AND NOT-SUSD2 | 0.857143 | 1 | 0.75 |
| PTPRZ1 AND NOT-UPK3A AND NOT-MUC1 | 0.985507 | 0.985507 | 0.985507 | FOLH1 AND EPCAM AND NOT-ABCB1 | 0.857143 | 1 | 0.75 |
| PTPRZ1 AND CBX3 AND NOT-MUC1 | 0.977778 | 1 | 0.956522 | FOLH1 AND NOT-PAQR5 AND BIRC5 | 0.857143 | 1 | 0.75 |
| PTPRZ1 AND NOT-CLDN6 AND NOT-MUC1 | 0.978102 | 0.985294 | 0.971014 | FOLH1 AND EPCAM AND NOT-TLR3 | 0.857143 | 1 | 0.75 |
| COMPLEX-MUC1/PTPRZ1/CLDN8 | 0.978102 | 0.985294 | 0.971014 | FOLH1 AND BMPR1B AND NOT-LSAMP | 0.857143 | 1 | 0.75 |
| COMPLEX-CLDN4/MUC1/PTPRZ1 | 0.985507 | 0.985507 | 0.985507 | FOLH1 AND EPCAM AND NOT-TRHDE | 0.857143 | 1 | 0.75 |
| PTPRZ1 AND NOT-GPA33 AND NOT-ERBB2 | 0.978102 | 0.985294 | 0.971014 | FOLH1 AND FLOT2 AND NOT-SLC2A5 | 0.888889 | 0.8 | 1 |
| PTPRZ1 AND NOT-GPA33 AND NOT-MUC1 | 0.985507 | 0.985507 | 0.985507 | FOLH1 AND EPCAM AND NOT-SLC1A1 | 0.857143 | 1 | 0.75 |
| COMPLEX-MST1R/MUC1/PTPRZ1 | 0.985507 | 0.985507 | 0.985507 | FOLH1 AND CACNA1D AND NOT-L1CAM | 0.857143 | 1 | 0.75 |
| COMPLEX-MUC1/PTPRZ1/TYR | 0.985294 | 1 | 0.971014 | FOLH1 AND EPCAM AND MCAM | 0.857143 | 1 | 0.75 |
| COMPLEX-MUC1/PTPRZ1/PMEL | 0.970588 | 0.985075 | 0.956522 | FOLH1 AND EPCAM AND NOT-TRPM6 | 0.857143 | 1 | 0.75 |
| COMPLEX-ITGB6/MUC1/PTPRZ1 | 0.985507 | 0.985507 | 0.985507 | FOLH1 AND CDH10 AND NOT-LSAMP | 1 | 1 | 1 |
| COMPLEX-CEACAM5/MUC1/PTPRZ1 | 0.985507 | 0.985507 | 0.985507 | FOLH1 AND CDH10 AND NOT-LSAMP | 1 | 1 | 1 |
| PTPRZ1 AND NOT-SSTR3 AND NOT-ERBB2 | 0.978102 | 0.985294 | 0.971014 | FOLH1 AND HPN AND NOT-CD36 | 1 | 1 | 1 |
| COMPLEX-MUC1/CEACAM6/PTPRZ1 | 0.985294 | 1 | 0.971014 | FOLH1 AND NOT-CD36 AND FZD4 | 1 | 1 | 1 |
| PTPRZ1 AND NOT-CXCR5 AND NOT-MUC1 | 0.962406 | 1 | 0.927536 | FOLH1 AND NOT-ABCC6 AND SLC43A1 | 1 | 1 | 1 |
| PTPRZ1 AND NOT-SSTR3 AND NOT-MUC1 | 0.985507 | 0.985507 | 0.985507 | FOLH1 AND NOT-ABHD6 AND SLC43A1 | 1 | 1 | 1 |
| PTPRZ1 AND NOT-SSTR3 AND NOT-MUC1 | 0.985507 | 0.985507 | 0.985507 | FOLH1 AND NOT-CD36 AND ICAM3 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NOT-CLDN18 AND NOT-MUC1 | 0.978102 | 0.985294 | 0.971014 | FOLH1 AND SLC43A1 AND NOT-FCGRT | 1 | 1 | 1 |
| PTPRZ1 AND NOT-SSTR5 AND NOT-ERBB2 | 0.978102 | 0.985294 | 0.971014 | FOLH1 AND HPN AND NOT-DYSF | 1 | 1 | 1 |
| PTPRZ1 AND NOT-IL3RA AND NOT-MUC1 | 0.985507 | 0.985507 | 0.985507 | FOLH1 AND ANTXR2 AND NOT-SLC2A5 | 1 | 1 | 1 |
| PTPRZ1 AND NOT-ULBP3 AND NOT-MUC1 | 0.985507 | 0.985507 | 0.985507 | FOLH1 AND NOT-GRIN2C AND LDLRAD3 | 1 | 1 | 1 |
| PTPRZ1 AND NOT-SSTR5 AND NOT-MUC1 | 0.985507 | 0.985507 | 0.985507 | FOLH1 AND ADRB2 AND NOT-DYSF | 1 | 1 | 1 |
| PTPRZ1 AND NOT-DNAJB8 AND NOT-MUC1 | 0.985507 | 0.985507 | 0.985507 | FOLH1 AND NOT-GRIN2C AND LDLRAD3 | 1 | 1 | 1 |
| PTPRZ1 AND SLC39A6 AND NOT-MUC1 | 0.970149 | 1 | 0.942029 | FOLH1 AND ANTXR2 AND NOT-SLC2A5 | 1 | 1 | 1 |
| PTPRZ1 AND NOT-MAGEA1 AND NOT-MUC1 | 0.955224 | 0.984615 | 0.927536 | FOLH1 AND HPN AND NOT-DYSF | 1 | 1 | 1 |
| PTPRZ1 AND NOT-CLDN9 AND NOT-MUC1 | 0.978102 | 0.985294 | 0.971014 | FOLH1 AND ADRB2 AND NOT-DYSF | 1 | 1 | 1 |
| PTPRZ1 AND NOT-HHLA2 AND NOT-MUC1 | 0.985507 | 0.985507 | 0.985507 | FOLH1 AND ATP7A AND NOT-TLR3 | 0.888889 | 0.8 | 1 |
| PTPRZ1 AND NOT-GPA33 AND NOT-EPHA2 | 0.970588 | 0.985075 | 0.956522 | FOLH1 AND NOT-CD36 AND ATP11B | 0.888889 | 0.8 | 1 |
| COMPLEX-MUC1/SEMA5B/PTPRZ1 | 0.978102 | 0.985294 | 0.971014 | FOLH1 AND NOT-GRIN2C AND NOX4 | 0.888889 | 0.8 | 1 |
| PTPRZ1 AND NOT-CD79B AND NOT-MUC1 | 0.970588 | 0.985075 | 0.956522 | FOLH1 AND SLC43A1 AND NOT-NPY1R | 1 | 1 | 1 |
| PTPRZ1 AND NOT-GUCY2C AND NOT-MUC1 | 0.985507 | 0.985507 | 0.985507 | FOLH1 AND ANTXR2 AND NOT-SLC52A3 | 0.888889 | 0.8 | 1 |
| PTPRZ1 AND NOT-TNFRSF8 AND NOT-MUC1 | 0.978102 | 0.985294 | 0.971014 | FOLH1 AND ANTXR2 AND NOT-SLC52A3 | 0.888889 | 0.8 | 1 |
| PTPRZ1 AND NOT-STEAP2 AND NOT-MUC1 | 0.985507 | 0.985507 | 0.985507 | COMPLEX-EMP3/FOLH1/OR51E2 | 0.888889 | 0.8 | 1 |
| PTPRZ1 AND NOT-FCRL5 AND NOT-MUC1 | 0.962963 | 0.984848 | 0.942029 | FOLH1 AND PTGIS AND NOT-CAV1 | 0.888889 | 0.8 | 1 |
| PTPRZ1 AND CD276 AND NOT-MUC1 | 0.985294 | 1 | 0.971014 | FOLH1 AND NOT-CD36 AND SLC19A2 | 1 | 1 | 1 |
| COMPLEX-MUC1/SLAMF7/PTPRZ1 | 0.985294 | 1 | 0.971014 | COMPLEX-FOLH1/OR51E2/PAQR8 | 0.888889 | 0.8 | 1 |
| GPM6A AND ERBB2 AND NOT-RAET1E | 0.924138 | 0.881579 | 0.971014 | FOLH1 AND CDH10 AND NOT-ATP1A2 | 0.888889 | 0.8 | 1 |
| PTPRZ1 AND NOT-FCRL2 AND NOT-MUC1 | 0.977778 | 1 | 0.956522 | FOLH1 AND NOT-ABHD6 AND F2R | 0.888889 | 0.8 | 1 |
| PTPRZ1 AND NOT-CLDN23 AND ERBB2 | 0.985507 | 0.985507 | 0.985507 | FOLH1 AND ATP7A AND NOT-TLR3 | 0.888889 | 0.8 | 1 |
| PTPRZ1 AND NCAM1 AND ERBB2 | 0.985507 | 0.985507 | 0.985507 | FOLH1 AND CDH10 AND NOT-ATP1A2 | 0.888889 | 0.8 | 1 |
| COMPLEX-MUC1/PTPRZ1/CLDN1 | 0.978102 | 0.985294 | 0.971014 | FOLH1 AND NOT-ABHD6 AND GGTLC1 | 0.888889 | 0.8 | 1 |
| COMPLEX-HLA-DOB/MUC1/PTPRZ1 | 0.978102 | 0.985294 | 0.971014 | FOLH1 AND GGTLC1 AND NOT-SGCE | 1 | 1 | 1 |
| PTPRZ1 AND NOT-CD22 AND NOT-MUC1 | 0.985294 | 1 | 0.971014 | FOLH1 AND NOT-ABHD6 AND F2R | 0.888889 | 0.8 | 1 |
| PTPRZ1 AND NOT-ERBB2 AND NOT-SSTR4 | 0.978102 | 0.985294 | 0.971014 | FOLH1 AND NOT-CD36 AND CD69 | 0.888889 | 0.8 | 1 |
| PTPRZ1 AND NOT-CD160 AND NOT-MUC1 | 0.970588 | 0.985075 | 0.956522 | FOLH1 AND CDH10 AND NOT-NDRG4 | 0.888889 | 0.8 | 1 |
| PTPRZ1 AND NOT-GAGE1 AND NOT-MUC1 | 0.985507 | 0.985507 | 0.985507 | COMPLEX-CDH10/FOLH1/OR51E2 | 0.888889 | 0.8 | 1 |
| PTPRZ1 AND NOT-MUC1 AND NOT-SSTR4 | 0.985507 | 0.985507 | 0.985507 | FOLH1 AND CDH10 AND NOT-NDRG4 | 0.888889 | 0.8 | 1 |
| COMPLEX-CLDN23/MUC1/PTPRZ1 | 0.985507 | 0.985507 | 0.985507 | FOLH1 AND TMEFF2 AND NOT-ATP1A2 | 0.888889 | 0.8 | 1 |
| COMPLEX-MUC1/NCAM1/PTPRZ1 | 0.985507 | 0.985507 | 0.985507 | FOLH1 AND NOT-ABCG2 AND SLC43A1 | 1 | 1 | 1 |
| COMPLEX-CLDN23/MUC1/PTPRZ1 | 0.985507 | 0.985507 | 0.985507 | FOLH1 AND NOT-ABCC6 AND TGFBI | 0.888889 | 0.8 | 1 |
| COMPLEX-ERBB2/PTPRZ1/TPBG | 0.970588 | 0.985075 | 0.956522 | FOLH1 AND TMEFF2 AND NOT-ATP1A2 | 0.888889 | 0.8 | 1 |
| PTPRZ1 AND NOT-TNFSF11 AND NOT-MUC1 | 0.978102 | 0.985294 | 0.971014 | FOLH1 AND NOT-CD36 AND FZD5 | 1 | 1 | 1 |
| PTPRZ1 AND NOT-MUC1 AND NOT-SSTR4 | 0.985507 | 0.985507 | 0.985507 | FOLH1 AND NOT-ABHD6 AND ATP7A | 0.888889 | 0.8 | 1 |
| PTPRZ1 AND NOT-MUC1 AND NOT-CD19 | 0.985507 | 0.985507 | 0.985507 | FOLH1 AND PTGIS AND NOT-CAV1 | 0.888889 | 0.8 | 1 |
| PTPRZ1 AND NOT-SSTR3 AND NOT-EPHA2 | 0.970588 | 0.985075 | 0.956522 | FOLH1 AND ADRB2 AND NOT-CD36 | 1 | 1 | 1 |
| PTPRZ1 AND NOT-P2RX5 AND NOT-MUC1 | 0.985507 | 0.985507 | 0.985507 | FOLH1 AND NOT-ABCC6 AND GGTLC1 | 0.888889 | 0.8 | 1 |
| PTPRZ1 AND NOT-CD79A AND NOT-MUC1 | 0.947368 | 0.984375 | 0.913043 | FOLH1 AND PTGIS AND NOT-SLC2A5 | 1 | 1 | 1 |
| PTPRZ1 AND NOT-CLDN2 AND NOT-MUC1 | 0.978102 | 0.985294 | 0.971014 | FOLH1 AND SLC43A1 AND NOT-SLC38A4 | 1 | 1 | 1 |
| COMPLEX-MUC1/PTPRZ1/TNFRSF10A | 0.962963 | 0.984848 | 0.942029 | FOLH1 AND IL1RAPL1 AND NOT-TTYH2 | 0.888889 | 0.8 | 1 |
| PTPRZ1 AND NOT-PCYT1A AND NOT-MUC1 | 0.985507 | 0.985507 | 0.985507 | FOLH1 AND PTGIS AND NOT-SLC2A5 | 1 | 1 | 1 |
| COMPLEX-MUC1/ENPP3/PTPRZ1 | 0.985507 | 0.985507 | 0.985507 | FOLH1 AND ADRB2 AND NOT-SLC22A18 | 1 | 1 | 1 |
| COMPLEX-MUC1/PTPRZ1/LGR5 | 0.978102 | 0.985294 | 0.971014 | FOLH1 AND NOT-CD36 AND EMB | 0.888889 | 0.8 | 1 |
| PTPRZ1 AND NOT-MUC1 AND NOT-TNFRSF13C | 0.978102 | 0.985294 | 0.971014 | FOLH1 AND ITGA5 AND NOT-EMP3 | 0.888889 | 0.8 | 1 |
| PTPRZ1 AND NOT-SSTR5 AND NOT-EPHA2 | 0.970588 | 0.985075 | 0.956522 | FOLH1 AND ADRB2 AND NOT-SLC22A18 | 1 | 1 | 1 |
| PTPRZ1 AND NOT-MS4A1 AND NOT-MUC1 | 0.977778 | 1 | 0.956522 | FOLH1 AND ATP7A AND NOT-SLC2A5 | 1 | 1 | 1 |
| COMPLEX-MSLN/MUC1/PTPRZ1 | 0.970588 | 0.985075 | 0.956522 | FOLH1 AND ATP7A AND NOT-SLC2A5 | 1 | 1 | 1 |
| PTPRZ1 AND NOT-MAGEA11 AND NOT-MUC1 | 0.962963 | 0.984848 | 0.942029 | FOLH1 AND FLVCR1 AND NOT-SLC2A5 | 0.888889 | 0.8 | 1 |
| PTPRZ1 AND DDX3X AND NOT-MUC1 | 0.946565 | 1 | 0.898551 | FOLH1 AND FLVCR1 AND NOT-SLC2A5 | 0.888889 | 0.8 | 1 |
| COMPLEX-MUC1/PTPRZ1/TPBG | 0.978102 | 0.985294 | 0.971014 | TRPM8 AND NOT-FADS2 AND FOLH1 | 0.888889 | 0.8 | 1 |
| COMPLEX-MUC1/PTPRZ1/TPBG | 0.978102 | 0.985294 | 0.971014 | FOLH1 AND NOT-SLC4A8 AND IL1RAPL1 | 1 | 1 | 1 |
| PTPRZ1 AND NOT-ALDH1A1 AND NOT-MUC1 | 0.955224 | 0.984615 | 0.927536 | TRPM8 AND NOT-SLC52A3 AND FOLH1 | 0.888889 | 0.8 | 1 |
| COMPLEX-EPHA2/ABCB5/PTPRZ1 | 0.970588 | 0.985075 | 0.956522 | FOLH1 AND PTGIS AND NOT-SEMA6D | 1 | 1 | 1 |
| PTPRZ1 AND NOT-MUC1 AND SPON2 | 0.985507 | 0.985507 | 0.985507 | FOLH1 AND ADRB2 AND NOT-SYT4 | 1 | 1 | 1 |
| PTPRZ1 AND NOT-MUC1 AND NOT-FOLR1 | 0.985507 | 0.985507 | 0.985507 | FOLH1 AND ATP7A AND NOT-CAV1 | 0.888889 | 0.8 | 1 |
| PTPRZ1 AND NOT-MUC1 AND NOT-FOLR1 | 0.985507 | 0.985507 | 0.985507 | FOLH1 AND BCAM AND NOT-GRIN2C | 0.888889 | 0.8 | 1 |
| PTPRZ1 AND NOT-MUC1 AND EPHA3 | 0.985507 | 0.985507 | 0.985507 | FOLH1 AND NOT-GRIN2C AND ANO8 | 0.888889 | 0.8 | 1 |
| COMPLEX-EPHA2/PTPRZ1/BMPR1B | 0.985507 | 0.985507 | 0.985507 | FOLH1 AND ADRB2 AND NOT-SYT4 | 1 | 1 | 1 |
| COMPLEX-EPHA2/PTPRZ1/ULBP2 | 0.970588 | 0.985075 | 0.956522 | FOLH1 AND NOT-ABCC6 AND F2R | 1 | 1 | 1 |
| PTPRZ1 AND NOT-MUC1 AND NOT-MUC16 | 0.962963 | 0.984848 | 0.942029 | FOLH1 AND HPN AND NOT-SLC22A18 | 1 | 1 | 1 |
| PTPRZ1 AND TNC AND NOT-MUC1 | 0.970149 | 1 | 0.942029 | FOLH1 AND PTGIS AND NOT-SEMA6D | 1 | 1 | 1 |
| PTPRZ1 AND NOT-SSTR2 AND NOT-MUC1 | 0.962963 | 0.984848 | 0.942029 | FOLH1 AND NOT-GRIN2C AND CCR2 | 0.888889 | 0.8 | 1 |
| COMPLEX-EPHA2/PTPRZ1/CD33 | 0.978102 | 0.985294 | 0.971014 | FOLH1 AND ADRB2 AND NOT-GYPC | 1 | 1 | 1 |
| COMPLEX-ERBB2/ITGB3/PTPRZ1 | 0.978102 | 0.985294 | 0.971014 | FOLH1 AND NOT-ABCC6 AND ATP7A | 0.888889 | 0.8 | 1 |
| COMPLEX-EPHA2/PTPRZ1/CLDN12 | 0.978102 | 0.985294 | 0.971014 | FOLH1 AND ATP7A AND NOT-SLC52A3 | 1 | 1 | 1 |
| COMPLEX-ERBB2/MET/PTPRZ1 | 0.978102 | 0.985294 | 0.971014 | FOLH1 AND BCAM AND NOT-SLC39A2 | 1 | 1 | 1 |
| COMPLEX-ERBB2/PTPRZ1/CD37 | 0.978102 | 0.985294 | 0.971014 | TRPM8 AND NOT-UNC5B AND FOLH1 | 1 | 1 | 1 |
| COMPLEX-ERBB2/PTPRZ1/BMPR1B | 0.978102 | 0.985294 | 0.971014 | FOLH1 AND ANTXR2 AND NOT-FADS2 | 0.888889 | 0.8 | 1 |
| COMPLEX-GPNMB/ERBB2/PTPRZ1 | 0.978102 | 0.985294 | 0.971014 | FOLH1 AND SEMA4B AND NOT-SLC52A3 | 0.888889 | 0.8 | 1 |
| COMPLEX-ERBB2/PTPRZ1/CLDN12 | 0.978102 | 0.985294 | 0.971014 | FOLH1 AND NOT-ABCC6 AND F2R | 1 | 1 | 1 |
| COMPLEX-ERBB2/ABCB5/PTPRZ1 | 0.978102 | 0.985294 | 0.971014 | FOLH1 AND NOT-SLC4A8 AND NOX4 | 0.888889 | 0.8 | 1 |
| COMPLEX-EPHA2/PTPRZ1/TPBG | 0.962963 | 0.984848 | 0.942029 | FOLH1 AND NOT-SLC4A8 AND CCR2 | 0.888889 | 0.8 | 1 |
| COMPLEX-MUC1/PTPRZ1/CD34 | 0.978102 | 0.985294 | 0.971014 | FOLH1 AND PTGIS AND NOT-SLC52A3 | 1 | 1 | 1 |
| COMPLEX-EPHA2/IL2RA/PTPRZ1 | 0.978102 | 0.985294 | 0.971014 | FOLH1 AND HPN AND NOT-SLC22A18 | 1 | 1 | 1 |
| PTPRZ1 AND NOT-MUC1 AND NOT-FOLH1 | 0.970588 | 0.985075 | 0.956522 | FOLH1 AND NOT-GRIN2C AND GPR176 | 0.888889 | 0.8 | 1 |

FIG. 15 (cont.)

| Antigen Pair Logic | F1 | Precision | Recall | Antigen Pair Logic | F1 | Precision | Recall |
|---|---|---|---|---|---|---|---|
| PTPRZ1 AND NOT-B4GALNT1 AND NOT-MUC1 | 0.970588 | 0.985075 | 0.956522 | FOLH1 AND NOT-GRIN2C AND CCR2 | 0.888889 | 0.8 | 1 |
| COMPLEX-DKK1/MUC1/PTPRZ1 | 0.985507 | 0.985507 | 0.985507 | FOLH1 AND NOT-GRIN2C AND ANO8 | 0.888889 | 0.8 | 1 |
| COMPLEX-MUC1/PTPRZ1/BMPR1B | 0.985507 | 0.985507 | 0.985507 | COMPLEX-PIK3IP1/FOLH1/OR51E2 | 0.888889 | 0.8 | 1 |
| COMPLEX-MET/MUC1/PTPRZ1 | 0.985507 | 0.985507 | 0.985507 | TRPM8 AND NOT-UNC5B AND FOLH1 | 1 | 1 | 1 |
| COMPLEX-MUC1/PTPRZ1/VCAM1 | 0.985507 | 0.985507 | 0.985507 | FOLH1 AND ATP7A AND NOT-CAV1 | 0.888889 | 0.8 | 1 |
| COMPLEX-ITGB3/MUC1/PTPRZ1 | 0.985507 | 0.985507 | 0.985507 | FOLH1 AND SEMA4B AND NOT-SLC52A3 | 0.888889 | 0.8 | 1 |
| COMPLEX-GPNMB/MUC1/PTPRZ1 | 0.985507 | 0.985507 | 0.985507 | FOLH1 AND NOT-SLC4A8 AND CCR2 | 0.888889 | 0.8 | 1 |
| SYT11 AND NOT-SLC6A15 AND EPHA8 | 0.948148 | 0.969697 | 0.927536 | FOLH1 AND ADRB2 AND NOT-SLC16A5 | 1 | 1 | 1 |
| COMPLEX-F2R/SLCO1C1/GPR158 | 0.957746 | 0.931507 | 0.985507 | FOLH1 AND ATP8B2 AND NOT-SLC2A5 | 0.888889 | 0.8 | 1 |
| SYT11 AND NOT-SLC6A15 AND GJD2 | 0.948148 | 0.969697 | 0.927536 | FOLH1 AND CDH10 AND NOT-PTPRZ1 | 0.888889 | 0.8 | 1 |
| SYT11 AND NOT-SLC6A15 AND CCR9 | 0.948148 | 0.969697 | 0.927536 | FOLH1 AND NOT-ABCC6 AND ATP7A | 0.888889 | 0.8 | 1 |
| SYT11 AND NOT-GRM1 AND GJD2 | 0.94964 | 0.942857 | 0.956522 | FOLH1 AND ATP7A AND NOT-SLC52A3 | 1 | 1 | 1 |
| SYT11 AND NOT-SLC6A15 AND MRAP | 0.932331 | 0.96875 | 0.898551 | FOLH1 AND NOT-SEMA6D AND FLVCR1 | 0.888889 | 0.8 | 1 |
| COMPLEX-ABHD3/SYT11/SLC6A15 | 0.948148 | 0.969697 | 0.927536 | FOLH1 AND ATP8B2 AND NOT-SLC2A5 | 0.888889 | 0.8 | 1 |
| SYT11 AND NOT-CNTNAP2 AND GYPC | 0.971014 | 0.971014 | 0.971014 | FOLH1 AND NOT-SEMA6D AND FLVCR1 | 0.888889 | 0.8 | 1 |
| SYT11 AND NOT-GRM1 AND CATSPER3 | 0.94964 | 0.942857 | 0.956522 | FOLH1 AND SLC43A1 AND NOT-SLC22A18 | 1 | 1 | 1 |
| SYT11 AND NOT-GRM1 AND PIK3IP1 | 0.94964 | 0.942857 | 0.956522 | FOLH1 AND NOT-GRIN2C AND SELP | 0.888889 | 0.8 | 1 |
| SYT11 AND CD93 AND ATP13A5 | 0.957143 | 0.943662 | 0.971014 | TRPM8 AND NOT-SLC39A2 AND FOLH1 | 1 | 1 | 1 |
| SYT11 AND NOT-CNTNAP2 AND TGFBI | 0.971014 | 0.971014 | 0.971014 | FOLH1 AND NOT-NRG3 AND ATP8A2 | 0.857143 | 1 | 0.75 |
| SYT11 AND NOT-CNTNAP2 AND SLC39A8 | 0.978102 | 0.985294 | 0.971014 | FOLH1 AND PTGIS AND NOT-SLC9A1 | 0.857143 | 1 | 0.75 |
| SYT11 AND NOT-GRM1 AND NOT-SLC31A1 | 0.926471 | 0.940299 | 0.913043 | FOLH1 AND STEAP4 AND NOT-GYPC | 0.857143 | 1 | 0.75 |
| SYT11 AND NOT-CNTNAP2 AND ATP13A5 | 0.971014 | 0.971014 | 0.971014 | FOLH1 AND STEAP4 AND NOT-EPHA2 | 0.857143 | 1 | 0.75 |
| COMPLEX-SYT11/GRM1/SLC39A8 | 0.94964 | 0.942857 | 0.956522 | FOLH1 AND ATP7A AND NOT-SLC9A1 | 0.857143 | 1 | 0.75 |
| SYT11 AND NOT-SLC6A15 AND NOT-SLC31A1 | 0.916031 | 0.967742 | 0.869565 | FOLH1 AND STEAP4 AND NOT-SLC22A18 | 0.857143 | 1 | 0.75 |
| SYT11 AND HTR1F AND NOT-SLC9B1 | 0.964539 | 0.944444 | 0.985507 | FOLH1 AND NOT-CD36 AND ATP7A | 0.888889 | 0.8 | 1 |
| COMPLEX-SLC31A1/SYT11/GJD2 | 0.933333 | 0.954545 | 0.913043 | FOLH1 AND SLC43A1 AND NOT-DYSF | 1 | 1 | 1 |
| SYT11 AND ATP13A5 AND NOT-MRAP | 0.978417 | 0.971429 | 0.985507 | FOLH1 AND STEAP4 AND NOT-SYT4 | 0.857143 | 1 | 0.75 |
| SYT11 AND NOT-ZACN AND ATP13A5 | 0.971429 | 0.957746 | 0.985507 | FOLH1 AND STEAP4 AND NOT-DYSF | 0.857143 | 1 | 0.75 |
| COMPLEX-SYT11/IL17RA/GABRA5 | 0.94964 | 0.942857 | 0.956522 | FOLH1 AND STEAP4 AND NOT-EMP3 | 0.857143 | 1 | 0.75 |
| GPR158 AND CD93 AND ATP13A5 | 0.892086 | 0.885714 | 0.898551 | FOLH1 AND NOT-GRIN2C AND PCDH8 | 0.857143 | 1 | 0.75 |
| COMPLEX-SYT11/IFI6/CD58 | 0.956522 | 0.956522 | 0.956522 | FOLH1 AND STEAP4 AND NOT-SEMA4D | 0.857143 | 1 | 0.75 |
| COMPLEX-SYT11/IL17RA/SLC39A8 | 0.955882 | 0.970149 | 0.942029 | FOLH1 AND NOT-SLC9A1 AND SEMA4B | 0.857143 | 1 | 0.75 |
| COMPLEX-BTN3A1/SLCO1C1/GPR158 | 0.878378 | 0.822785 | 0.942029 | FOLH1 AND GHR AND NOT-DYSF | 0.857143 | 1 | 0.75 |
| COMPLEX-SYT11/IL17RA/BST2 | 0.957143 | 0.943662 | 0.971014 | FOLH1 AND CDH10 AND NOT-NRG3 | 0.857143 | 1 | 0.75 |
| COMPLEX-SLCO1C1/GPR158/CD163 | 0.879433 | 0.861111 | 0.898551 | FOLH1 AND NOT-GRIN2C AND GRIA4 | 0.888889 | 0.8 | 1 |
| COMPLEX-CD93/SLCO1C1/GPR158 | 0.876712 | 0.831169 | 0.927536 | FOLH1 AND STEAP4 AND NOT-TNFRSF12A | 0.857143 | 1 | 0.75 |
| GPR19 AND CD93 AND NOT-IL17RA | 0.887097 | 1 | 0.797101 | FOLH1 AND NOT-SLC4A8 AND CHRNB4 | 0.888889 | 0.8 | 1 |
| GPR19 AND CD93 AND ATP13A5 | 0.887097 | 1 | 0.797101 | FOLH1 AND STEAP4 AND NOT-STAB1 | 0.857143 | 1 | 0.75 |
| GPR19 AND SLC31A1 AND NOT-SLC6A15 | 0.904762 | 1 | 0.826087 | FOLH1 AND NOT-GRIN2C AND CDH10 | 1 | 1 | 1 |
| ASTN1 AND NOT-MRAP AND SLC31A1 | 0.904762 | 1 | 0.826087 | FOLH1 AND STEAP4 AND NOT-GRIN2C | 0.857143 | 1 | 0.75 |
| COMPLEX-CLDN15/SLCO1C1/GPR158 | 0.92517 | 0.871795 | 0.985507 | FOLH1 AND STEAP4 AND NOT-BST2 | 0.857143 | 1 | 0.75 |
| SYT11 AND SLC31A1 AND NOT-ZACN | 0.938462 | 1 | 0.884058 | FOLH1 AND NOT-SLC4A8 AND CDH10 | 1 | 1 | 1 |
| COMPLEX-SLCO1C1/GPR158/PPAPDC1B | 0.888889 | 0.853333 | 0.927536 | FOLH1 AND ANTXR2 AND NOT-SLC39A2 | 0.857143 | 1 | 0.75 |
| SYT11 AND SLC31A1 AND NOT-MRAP | 0.938462 | 1 | 0.884058 | FOLH1 AND STEAP4 AND NOT-SLC4A8 | 0.857143 | 1 | 0.75 |
| GPR19 AND SLC31A1 AND NOT-MRAP | 0.921875 | 1 | 0.855072 | FOLH1 AND STEAP4 AND NOT-PAQR8 | 0.857143 | 1 | 0.75 |
| GPR19 AND HTR1F AND NOT-ROS1 | 0.857143 | 0.84507 | 0.869565 | FOLH1 AND STEAP4 AND NOT-GABRA1 | 0.857143 | 1 | 0.75 |
| GPR19 AND SLC31A1 AND NOT-GRM1 | 0.921875 | 1 | 0.855072 | FOLH1 AND NOT-SLC4A8 AND CHRNB4 | 0.888889 | 0.8 | 1 |
| GPR158 AND NOT-OPRK1 AND ABHD3 | 0.855172 | 0.815789 | 0.898551 | FOLH1 AND NOT-GRIN2C AND MDGA2 | 0.857143 | 1 | 0.75 |
| CDH10 AND SLC31A1 AND NOT-MRAP | 0.878049 | 1 | 0.782609 | FOLH1 AND NOT-GRIN2C AND MDGA2 | 0.857143 | 1 | 0.75 |
| ASTN1 AND NOT-SLC6A15 AND ABHD3 | 0.852459 | 0.981132 | 0.753623 | FOLH1 AND NOT-CD36 AND ATP8B2 | 0.857143 | 1 | 0.75 |
| GPR158 AND SLC31A1 AND NOT-MRAP | 0.930233 | 1 | 0.869565 | FOLH1 AND STEAP4 AND NOT-CDH10 | 0.857143 | 1 | 0.75 |
| GPR158 AND SLC31A1 AND NOT-ZACN | 0.930233 | 1 | 0.869565 | FOLH1 AND STEAP4 AND NOT-NKAIN2 | 0.857143 | 1 | 0.75 |
| COMPLEX-BTN3A3/SLCO1C1/GPR158 | 0.851613 | 0.767442 | 0.956522 | FOLH1 AND SLC43A1 AND NOT-SLC30A10 | 1 | 1 | 1 |
| GPR19 AND HTR1F AND NOT-SLC9B1 | 0.851064 | 0.833333 | 0.869565 | FOLH1 AND SLC43A1 AND NOT-BST2 | 1 | 1 | 1 |
| GPR19 AND SLC31A1 AND NOT-CLDN17 | 0.913386 | 1 | 0.84058 | FOLH1 AND SLC43A1 AND NOT-SCARA5 | 1 | 1 | 1 |
| GPR158 AND SLC31A1 AND NOT-GRM1 | 0.930233 | 1 | 0.869565 | FOLH1 AND NOT-GABRA2 AND ATP8A2 | 0.857143 | 1 | 0.75 |
| GPR19 AND SLC31A1 AND NOT-GJD2 | 0.921875 | 1 | 0.855072 | FOLH1 AND ATP8A2 AND NOT-SYT4 | 0.857143 | 1 | 0.75 |
| LYPD1 AND NOT-CNTNAP2 AND NOT-ATP13A5 | 0.875 | 0.949153 | 0.811594 | FOLH1 AND NOT-SLC4A8 AND ATP8A2 | 0.857143 | 1 | 0.75 |
| SCN1A AND NOT-SLC6A15 AND SLC31A1 | 0.852459 | 0.981132 | 0.753623 | FOLH1 AND NOT-PAQR8 AND ATP8A2 | 0.888889 | 0.8 | 1 |
| GPR19 AND SLC31A1 AND NOT-ZACN | 0.921875 | 1 | 0.855072 | FOLH1 AND NOT-GABRA2 AND ATP8A2 | 0.857143 | 1 | 0.75 |
| GPR19 AND GYPC AND NOT-CNTNAP2 | 0.850746 | 0.876923 | 0.826087 | FOLH1 AND NOT-CD36 AND F2R | 1 | 1 | 1 |
| CDH10 AND SLC31A1 AND NOT-ZACN | 0.878049 | 1 | 0.782609 | FOLH1 AND NOT-SLC4A8 AND ATP8A2 | 0.857143 | 1 | 0.75 |
| LYPD1 AND NOT-ZACN AND ATP13A5 | 0.876923 | 0.934426 | 0.826087 | FOLH1 AND NOT-SLC4A8 AND CACNA1E | 0.888889 | 0.8 | 1 |
| LYPD1 AND NOT-HTR1F AND ROS1 | 0.875 | 0.949153 | 0.811594 | FOLH1 AND NOT-SLC4A8 AND PCDH8 | 0.857143 | 1 | 0.75 |
| COMPLEX-IFNAR2/SLCO1C1/GPR158 | 0.87218 | 0.90625 | 0.84058 | FOLH1 AND ATP7A AND NOT-SLC16A5 | 1 | 1 | 1 |
| FXYD6 AND SLC31A1 AND NOT-MRAP | 0.842975 | 0.980769 | 0.73913 | FOLH1 AND NOT-GRIN2C AND TMPRSS11E | 0.888889 | 0.8 | 1 |
| FXYD6 AND SLC31A1 AND NOT-ZACN | 0.842975 | 0.980769 | 0.73913 | FOLH1 AND NOT-SLC4A8 AND TAS2R10 | 0.888889 | 0.8 | 1 |
| COMPLEX-GPR22/SLCO1C1/GPR158 | 0.842767 | 0.744444 | 0.971014 | FOLH1 AND NOT-GRIN2C AND CACNA1E | 0.888889 | 0.8 | 1 |
| LYPD1 AND NOT-SLC9B1 AND PCDHGC4 | 0.876923 | 0.934426 | 0.826087 | FOLH1 AND GHR AND NOT-SLC22A18 | 0.857143 | 1 | 0.75 |
| GPR158 AND SLC31A1 AND NOT-SLC2A5 | 0.930233 | 1 | 0.869565 | FOLH1 AND NOT-GRIN2C AND PPAPDC1B | 0.888889 | 0.8 | 1 |
| KCNJ10 AND NOT-GRM1 AND SLC31A1 | 0.841379 | 0.802632 | 0.884058 | FOLH1 AND PTGIS AND NOT-SLC4A8 | 1 | 1 | 1 |
| COMPLEX-SEMA4B/SLCO1C1/GPR158 | 0.860927 | 0.792683 | 0.942029 | FOLH1 AND ATP8B2 AND NOT-SLC39A2 | 0.857143 | 1 | 0.75 |
| LYPD1 AND NOT-GRM1 AND GJD2 | 0.876923 | 0.934426 | 0.826087 | FOLH1 AND NOT-SLC4A8 AND TMEFF2 | 0.888889 | 0.8 | 1 |
| CDH10 AND SLC31A1 AND NOT-CLDN17 | 0.868852 | 1 | 0.768116 | FOLH1 AND NOT-GRIN2C AND PPAPDC1B | 0.888889 | 0.8 | 1 |
| CDH10 AND CD93 AND ATP13A5 | 0.840336 | 1 | 0.724638 | FOLH1 AND NOT-SLC4A8 AND USH2A | 0.888889 | 0.8 | 1 |
| LYPD1 AND XCR1 AND NOT-MRAP | 0.897638 | 0.982759 | 0.826087 | FOLH1 AND PTGIS AND NOT-SYT4 | 0.888889 | 0.8 | 1 |
| GPR19 AND SLC31A1 AND NOT-CATSPER3 | 0.921875 | 1 | 0.855072 | FOLH1 AND SELP AND NOT-FMNL1 | 0.857143 | 1 | 0.75 |

FIG. 15 (cont.)

| Antigen Pair Logic | F1 | Precision | Recall | Antigen Pair Logic | F1 | Precision | Recall |
|---|---|---|---|---|---|---|---|
| GPR19 AND SLC31A1 AND NOT-GABRA5 | 0.913386 | 1 | 0.84058 | FOLH1 AND NOT-SLC4A8 AND TMEFF2 | 0.888889 | 0.8 | 1 |
| GPR158 AND SLC31A1 AND GJD2 | 0.930233 | 1 | 0.869565 | FOLH1 AND STEAP4 AND NOT-NFASC | 0.857143 | 1 | 0.75 |
| FXYD6 AND SLC31A1 AND NOT-SLC22A5 | 0.842975 | 0.980769 | 0.73913 | FOLH1 AND NOT-NRG3 AND CHRNB4 | 0.857143 | 1 | 0.75 |
| SCN1A AND NOT-OPRK1 AND ABHD3 | 0.839695 | 0.887097 | 0.797101 | FOLH1 AND ANTXR2 AND NOT-GRIN2C | 0.888889 | 0.8 | 1 |
| SCN2A AND SLC31A1 AND NOT-MRAP | 0.880597 | 0.907692 | 0.855072 | FOLH1 AND PTGIS AND NOT-GRIN2C | 1 | 1 | 1 |
| OMG AND ABHD3 AND NOT-OPRK1 | 0.835821 | 0.861538 | 0.811594 | FOLH1 AND STEAP4 AND NOT-TTYH2 | 0.857143 | 1 | 0.75 |
| CDH10 AND SLC31A1 AND NOT-GRM1 | 0.840336 | 1 | 0.724638 | FOLH1 AND PTGIS AND NOT-NRG3 | 0.857143 | 1 | 0.75 |
| FXYD6 AND SLC31A1 AND GJD2 | 0.842975 | 0.980769 | 0.73913 | FOLH1 AND NOT-NRG3 AND GABRA3 | 0.857143 | 1 | 0.75 |
| OMG AND SLC31A1 AND NOT-MRAP | 0.857143 | 0.890625 | 0.826087 | FOLH1 AND NOT-SLC4A8 AND NFASC | 0.888889 | 0.8 | 1 |
| GPR158 AND TGFBI AND NOT-CNTNAP2 | 0.836879 | 0.819444 | 0.855072 | FOLH1 AND PTGIS AND NOT-SLC39A2 | 0.857143 | 1 | 0.75 |
| COMPLEX-SLCO1C1/GPR158/CD58 | 0.845638 | 0.7875 | 0.913043 | FOLH1 AND PTGIS AND NOT-GRIN2C | 1 | 1 | 1 |
| COMPLEX-CDH10/ABHD3/SLC6A15 | 0.832 | 0.928571 | 0.753623 | FOLH1 AND NOT-GRIN2C AND TMEFF2 | 0.888889 | 0.8 | 1 |
| GPR19 AND SLC9B1 AND NOT-PCDHGC4 | 0.830986 | 0.808219 | 0.855072 | FOLH1 AND STEAP4 AND NOT-CNTNAP2 | 0.857143 | 1 | 0.75 |
| KCNJ10 AND SLC31A1 AND NOT-ZACN | 0.834532 | 0.828571 | 0.84058 | FOLH1 AND PTGIS AND NOT-SYT4 | 0.888889 | 0.8 | 1 |
| CDH10 AND SLC31A1 AND NOT-GJD2 | 0.878049 | 1 | 0.782609 | FOLH1 AND PTGIS AND NOT-UMOD | 0.857143 | 1 | 0.75 |
| OMG AND SLC31A1 AND NOT-CLDN17 | 0.857143 | 0.890625 | 0.826087 | FOLH1 AND NOT-NRG3 AND NPHS1 | 0.857143 | 1 | 0.75 |
| KCNJ10 AND SLC31A1 AND NOT-MRAP | 0.84058 | 0.84058 | 0.84058 | FOLH1 AND NOT-SLC4A8 AND NPHS1 | 0.888889 | 0.8 | 1 |
| CDH10 AND SLC31A1 AND NOT-SLC22A5 | 0.878049 | 1 | 0.782609 | TRPM8 AND NOT-GRIN2C AND FOLH1 | 0.888889 | 0.8 | 1 |
| FXYD6 AND SLC31A1 AND CLDN17 | 0.833333 | 0.980392 | 0.724638 | FOLH1 AND NOT-GRIN2C AND PCDH15 | 0.888889 | 0.8 | 1 |
| KCNJ10 AND SLC31A1 AND NOT-CLDN17 | 0.84058 | 0.84058 | 0.84058 | FOLH1 AND ANTXR2 AND NOT-GRIN2C | 0.888889 | 0.8 | 1 |
| GPR19 AND NOT-SLC6A15 AND GJD2 | 0.827068 | 0.859375 | 0.797101 | FOLH1 AND NOT-GRIN2C AND USH2A | 0.888889 | 0.8 | 1 |
| GPR19 AND NOT-SLC6A15 AND MRAP | 0.827068 | 0.859375 | 0.797101 | FOLH1 AND NOT-GRIN2C AND TMEFF2 | 0.888889 | 0.8 | 1 |
| LYPD1 AND ABHD3 AND NOT-OPRK1 | 0.878049 | 1 | 0.782609 | FOLH1 AND NOT-GRIN2C AND PCDH15 | 0.888889 | 0.8 | 1 |
| COMPLEX-CDH11/SLCO1C1/GPR158 | 0.826667 | 0.765432 | 0.898551 | FOLH1 AND STEAP4 AND NOT-BTN3A1 | 0.857143 | 1 | 0.75 |
| CDH10 AND NOT-OPRK1 AND ABHD3 | 0.826446 | 0.961538 | 0.724638 | FOLH1 AND NOT-SLC4A8 AND GABRA3 | 0.888889 | 0.8 | 1 |
| NKAIN4 AND SLC31A1 AND NOT-CLDN17 | 0.826446 | 0.961538 | 0.724638 | FOLH1 AND NOT-GRIN2C AND SCN2A | 0.888889 | 0.8 | 1 |
| ASTN1 AND NOT-OPRK1 AND ABHD3 | 0.826446 | 0.961538 | 0.724638 | FOLH1 AND STEAP4 AND NOT-SCN8A | 0.857143 | 1 | 0.75 |
| SCN1A AND NOT-GRM1 AND SLC31A1 | 0.854839 | 0.963636 | 0.768116 | TRPM8 AND NOT-GRIN2C AND FOLH1 | 0.888889 | 0.8 | 1 |
| SYT11 AND NOT-SLC6A15 AND CD37 | 0.948148 | 0.969697 | 0.927536 | FOLH1 AND NOT-SLC4A8 AND GABRA3 | 0.888889 | 0.8 | 1 |
| SYT11 AND NOT-SLC6A15 AND CD19 | 0.940299 | 0.969231 | 0.913043 | FOLH1 AND PTGIS AND NOT-SLC4A8 | 1 | 1 | 1 |
| SYT11 AND NOT-GRM1 AND CD19 | 0.942029 | 0.942029 | 0.942029 | FOLH1 AND ATP7A AND NOT-SLC22A18 | 0.888889 | 0.8 | 1 |
| SYT11 AND NOT-CNTNAP2 AND CD33 | 0.971014 | 0.971014 | 0.971014 | FOLH1 AND NOT-GRIN2C AND NOT-SLC22A18 | 0.888889 | 0.8 | 1 |
| SYT11 AND NOT-GRM1 AND LGR5 | 0.942029 | 0.942029 | 0.942029 | FOLH1 AND GGTLC1 AND NOT-DYSF | 1 | 1 | 1 |
| COMPLEX-ITGAV/SLCO1C1/GPR158 | 0.930556 | 0.893333 | 0.971014 | FOLH1 AND SLC43A1 AND NOT-STAB1 | 1 | 1 | 1 |
| SYT11 AND TGFBI AND NOT-ULBP2 | 0.94964 | 0.942857 | 0.956522 | FOLH1 AND ATP7A AND NOT-SLC22A18 | 0.888889 | 0.8 | 1 |
| SYT11 AND ABCB5 AND NOT-MRAP | 0.971014 | 0.971014 | 0.971014 | FOLH1 AND NOT-GRIN2C AND NMBR | 0.888889 | 0.8 | 1 |
| COMPLEX-CBX3/SLCO1C1/GPR158 | 0.911765 | 0.925373 | 0.898551 | FOLH1 AND SELP AND NOT-SLC4A8 | 1 | 1 | 1 |
| COMPLEX-GPNMB/SYT11/CNTNAP2 | 0.971014 | 0.971014 | 0.971014 | FOLH1 AND NOT-GRIN2C AND EPHA10 | 0.888889 | 0.8 | 1 |
| SYT11 AND PROCR AND NOT-CD19 | 0.956522 | 0.956522 | 0.956522 | FOLH1 AND EPHA3 AND NOT-SYT4 | 0.888889 | 0.8 | 1 |
| SYT11 AND ATP13A5 AND LGR5 | 0.942029 | 0.942029 | 0.942029 | FOLH1 AND EPHA3 AND NOT-SYT4 | 0.888889 | 0.8 | 1 |
| SYT11 AND ATP13A5 AND NOT-ULBP2 | 0.957143 | 0.943662 | 0.971014 | FOLH1 AND ROR1 AND NOT-GYPC | 0.888889 | 0.8 | 1 |
| SYT11 AND PLVAP AND NOT-CD19 | 0.910448 | 0.938462 | 0.884058 | FOLH1 AND ROR1 AND NOT-EMP3 | 0.888889 | 0.8 | 1 |
| SYT11 AND NOT-MRAP AND FOLR1 | 0.978417 | 0.971429 | 0.985507 | STEAP2 AND NOT-SLC39A2 AND FOLH1 | 1 | 1 | 1 |
| SYT11 AND HTR1F AND NOT-CD19 | 0.964539 | 0.944444 | 0.985507 | FOLH1 AND EPHA3 AND NOT-GRIN2C | 1 | 1 | 1 |
| SYT11 AND CLDN16 AND NOT-CD19 | 0.964539 | 0.944444 | 0.985507 | STEAP2 AND NOT-SLC39A2 AND FOLH1 | 1 | 1 | 1 |
| SYT11 AND NOT-MRAP AND CD19 | 0.955882 | 0.970149 | 0.942029 | FOLH1 AND EPHA3 AND NOT-GRIN2C | 1 | 1 | 1 |
| SYT11 AND NOT-GUCY2D AND CD19 | 0.942029 | 0.942029 | 0.942029 | FOLH1 AND STEAP4 AND NOT-CSPG4 | 0.857143 | 1 | 0.75 |
| COMPLEX-SEMA4D/SYT11/STEAP2 | 0.964539 | 0.944444 | 0.985507 | FOLH1 AND EPCAM AND NOT-PAQR8 | 0.857143 | 1 | 0.75 |
| COMPLEX-SLC31A1/SYT11/P2RX5 | 0.957143 | 0.943662 | 0.971014 | FOLH1 AND NOT-EDNRB AND ATP7A | 0.857143 | 1 | 0.75 |
| COMPLEX-SYT11/STEAP2/SLC39A8 | 0.964539 | 0.944444 | 0.985507 | FOLH1 AND NOT-CD36 AND MUC1 | 0.888889 | 0.8 | 1 |
| COMPLEX-SYT11/IL17RA/SSTR1 | 0.942029 | 0.942029 | 0.942029 | FOLH1 AND NOT-EDNRB AND PTGIS | 0.857143 | 1 | 0.75 |
| SYT11 AND NOT-ZACN AND NOT-ULBP2 | 0.892308 | 0.95082 | 0.84058 | FOLH1 AND EPHA3 AND NOT-SLC9A1 | 0.857143 | 1 | 0.75 |
| COMPLEX-GPNMB/SYT11/ZACN | 0.971429 | 0.957746 | 0.985507 | FOLH1 AND EPCAM AND TMEFF2 | 0.857143 | 1 | 0.75 |
| SYT11 AND NOT-GABRA5 AND ULBP2 | 0.875 | 0.949153 | 0.811594 | FOLH1 AND EPCAM AND NOT-CD58 | 0.857143 | 1 | 0.75 |
| SYT11 AND ATP13A5 AND NOT-SSTR1 | 0.918519 | 0.939394 | 0.898551 | FOLH1 AND EPHA3 AND NOT-SLC39A2 | 0.857143 | 1 | 0.75 |
| BCAN AND NOT-CLDN17 AND SLC31A1 | 0.868852 | 1 | 0.768116 | FOLH1 AND PCDH8 AND NOT-NCAM1 | 0.857143 | 1 | 0.75 |
| BCAN AND NOT-MRAP AND SLC31A1 | 0.868852 | 1 | 0.768116 | FOLH1 AND CDH10 AND NOT-NCAM1 | 1 | 1 | 1 |
| BCAN AND NOT-CATSPER3 AND SLC31A1 | 0.868852 | 1 | 0.768116 | FOLH1 AND EPCAM AND LRRC8E | 0.857143 | 1 | 0.75 |
| BCAN AND NOT-ZACN AND SLC31A1 | 0.868852 | 1 | 0.768116 | FOLH1 AND CDH10 AND NOT-NCAM1 | 1 | 1 | 1 |
| BCAN AND NOT-GJD2 AND SLC31A1 | 0.868852 | 1 | 0.768116 | FOLH1 AND EPCAM AND CDH10 | 0.857143 | 1 | 0.75 |
| SYT11 AND NOT-GABRA5 AND CD19 | 0.866142 | 0.948276 | 0.797101 | COMPLEX-FOLH1/STEAP2/SLC16A5 | 0.857143 | 1 | 0.75 |
| SYT11 AND CD58 AND NOT-ULBP2 | 0.925373 | 0.953846 | 0.898551 | FOLH1 AND NOT-EDNRB AND CD163 | 0.857143 | 1 | 0.75 |
| GPR19 AND SLC31A1 AND NOT-CD19 | 0.921875 | 1 | 0.855072 | FOLH1 AND STEAP4 AND NOT-AXL | 0.857143 | 1 | 0.75 |
| COMPLEX-SYT11/SLC22A5/SSTR1 | 0.918519 | 0.939394 | 0.898551 | FOLH1 AND NOT-GRIN2C AND BIRC5 | 0.888889 | 0.8 | 1 |
| BCAN AND NOT-GABRA5 AND SLC31A1 | 0.859504 | 1 | 0.753623 | FOLH1 AND CLDN8 AND NOT-CLDN10 | 1 | 1 | 1 |
| COMPLEX-HSPA5/SLCO1C1/GPR158 | 0.928571 | 0.915493 | 0.942029 | FOLH1 AND EPHA3 AND NOT-CALN1 | 0.857143 | 1 | 0.75 |
| LYPD1 AND NOT-KCNA7 AND CD19 | 0.873016 | 0.964912 | 0.797101 | FOLH1 AND EPHA3 AND NOT-UMOD | 0.857143 | 1 | 0.75 |
| COMPLEX-TNC/SLCO1C1/GPR158 | 0.882759 | 0.842105 | 0.927536 | FOLH1 AND EPHA3 AND NOT-NRG3 | 0.857143 | 1 | 0.75 |
| SYT11 AND IL17RA AND NOT-ULBP2 | 0.907692 | 0.967213 | 0.855072 | FOLH1 AND NOT-GRIN2C AND BIRC5 | 0.888889 | 0.8 | 1 |
| GPR19 AND NOT-P2RX5 AND SLC31A1 | 0.887097 | 1 | 0.797101 | FOLH1 AND CLDN8 AND NOT-SLC13A2 | 0.857143 | 1 | 0.75 |
| LYPD1 AND NOT-HTR1F AND CD19 | 0.875 | 0.949153 | 0.811594 | FOLH1 AND NOT-DPEP1 AND ATP8B1 | 0.857143 | 1 | 0.75 |
| COMPLEX-SLC39A6/SLCO1C1/GPR158 | 0.839161 | 0.810811 | 0.869565 | FOLH1 AND EPHA3 AND NOT-SLC22A18 | 0.888889 | 0.8 | 1 |
| LYPD1 AND ABCB5 AND NOT-MRAP | 0.897638 | 0.982759 | 0.826087 | FOLH1 AND EPHA3 AND NOT-SLC22A18 | 0.888889 | 0.8 | 1 |
| LYPD1 AND NOT-GRM1 AND CD19 | 0.868217 | 0.933333 | 0.811594 | FOLH1 AND NOT-CD36 AND IL20RA | 0.857143 | 1 | 0.75 |
| GPR158 AND SLC31A1 AND NOT-P2RX5 | 0.930233 | 1 | 0.869565 | FOLH1 AND EPCAM AND NOT-SLC30A10 | 0.857143 | 1 | 0.75 |
| CDH10 AND SLC31A1 AND NOT-P2RX5 | 0.868852 | 1 | 0.768116 | FOLH1 AND NOT-MET AND ATP7A | 0.888889 | 0.8 | 1 |
| LYPD1 AND NOT-GUCY2D AND CD19 | 0.868217 | 0.933333 | 0.811594 | FOLH1 AND TMEFF2 AND NOT-NCAM1 | 0.888889 | 0.8 | 1 |

FIG. 15 (cont.)

| Antigen Pair Logic | F1 | Precision | Recall | Antigen Pair Logic | F1 | Precision | Recall |
|---|---|---|---|---|---|---|---|
| LYPD1 AND NOT-MRAP AND CD19 | 0.888889 | 0.982456 | 0.811594 | FOLH1 AND IL20RA AND NOT-SLC9A1 | 0.857143 | 1 | 0.75 |
| COMPLEX-OMG/GPR158/BCAN | 0.832117 | 0.838235 | 0.826087 | FOLH1 AND NOT-GRIN2C AND ROR1 | 1 | 1 | 1 |
| NCAM1 AND NOT-SLC6A15 AND SLC31A1 | 0.830769 | 0.885246 | 0.782609 | FOLH1 AND TNC AND NOT-SYT4 | 0.888889 | 0.8 | 1 |
| KCNJ10 AND SLC31A1 AND NOT-P2RX5 | 0.87218 | 0.90625 | 0.84058 | FOLH1 AND CLDN8 AND NOT-SLC9A1 | 0.857143 | 1 | 0.75 |
| FXYD6 AND SLC31A1 AND CD19 | 0.833333 | 0.980392 | 0.724638 | FOLH1 AND TMEFF2 AND NOT-NCAM1 | 0.888889 | 0.8 | 1 |
| GPR19 AND HTR1F AND NOT-CD19 | 0.827586 | 0.789474 | 0.869565 | FOLH1 AND ROR1 AND NOT-PAQR8 | 0.888889 | 0.8 | 1 |
| CDH10 AND SLC31A1 AND NOT-CD19 | 0.878049 | 1 | 0.782609 | FOLH1 AND STEAP4 AND NOT-NCAM1 | 0.857143 | 1 | 0.75 |
| GPR19 AND NOT-GRM1 AND STEAP2 | 0.827068 | 0.859375 | 0.797101 | FOLH1 AND PTGIS AND NOT-ITGB3 | 0.857143 | 1 | 0.75 |
| LYPD1 AND PLVAP AND NOT-CD19 | 0.845528 | 0.962963 | 0.753623 | FOLH1 AND ANTXR2 AND EPCAM | 0.857143 | 1 | 0.75 |
| LYPD1 AND TGFBI AND NOT-ULBP2 | 0.876923 | 0.934426 | 0.826087 | COMPLEX-FOLH1/STEAP2/SLC43A1 | 1 | 1 | 1 |
| GPR158 AND NOT-CNTNAP2 AND GPNMB | 0.863309 | 0.857143 | 0.869565 | FOLH1 AND STEAP4 AND NOT-ITGB6 | 0.857143 | 1 | 0.75 |
| COMPLEX-SLCO1C1/GPR158/CD276 | 0.887417 | 0.817073 | 0.971014 | FOLH1 AND ROR1 AND NOT-SLC22A18 | 0.888889 | 0.8 | 1 |
| LYPD1 AND NOT-CATSPER3 AND ULBP2 | 0.890625 | 0.966102 | 0.826087 | FOLH1 AND TNC AND NOT-EMP3 | 0.888889 | 0.8 | 1 |
| GPR19 AND PROCR AND NOT-CD19 | 0.822695 | 0.805556 | 0.84058 | FOLH1 AND EPCAM AND NOT-SLC22A18 | 0.857143 | 1 | 0.75 |
| GPR19 AND ATP1B4 AND NOT-CD19 | 0.821918 | 0.779221 | 0.869565 | FOLH1 AND NOT-SLC4A8 AND SLC39A6 | 0.888889 | 0.8 | 1 |
| NKAIN4 AND SLC31A1 AND NOT-CD19 | 0.836066 | 0.962264 | 0.73913 | FOLH1 AND EPHA3 AND NOT-CLSTN3 | 0.857143 | 1 | 0.75 |
| GPR19 AND LGR5 AND NOT-GRM1 | 0.820896 | 0.846154 | 0.797101 | FOLH1 AND EPHA3 AND NOT-ABCA12 | 0.888889 | 0.8 | 1 |
| OMG AND SLC31A1 AND NOT-P2RX5 | 0.850746 | 0.876923 | 0.826087 | FOLH1 AND EPHA3 AND NOT-GRIN2A | 0.857143 | 1 | 0.75 |
| CDH10 AND TGFBI AND NOT-ULBP2 | 0.848 | 0.946429 | 0.768116 | STEAP2 AND NOT-GRIN2C AND FOLH1 | 0.888889 | 0.8 | 1 |
| GPR19 AND PLVAP AND NOT-CD19 | 0.819444 | 0.786667 | 0.855072 | FOLH1 AND NOT-DPEP1 AND BTN3A1 | 0.857143 | 1 | 0.75 |
| GPR19 AND CLDN16 AND NOT-CD19 | 0.821918 | 0.779221 | 0.869565 | FOLH1 AND STEAP4 AND NOT-LGR5 | 0.857143 | 1 | 0.75 |
| SYT11 AND SLC39A8 AND NOT-SSTR1 | 0.896 | 1 | 0.811594 | FOLH1 AND PTGIS AND NOT-B4GALNT1 | 0.857143 | 1 | 0.75 |
| GPR158 AND GPNMB AND NOT-MRAP | 0.857143 | 0.947368 | 0.782609 | FOLH1 AND NOT-GRIN2C AND CLDN8 | 1 | 1 | 1 |
| GPR19 AND ABCB5 AND NOT-MRAP | 0.848921 | 0.842857 | 0.855072 | FOLH1 AND NOT-DPEP1 AND LRRC8E | 0.857143 | 1 | 0.75 |
| GPR19 AND RXFP3 AND NOT-CD19 | 0.827586 | 0.789474 | 0.869565 | FOLH1 AND NOT-GRIN2C AND TPBG | 0.857143 | 1 | 0.75 |
| GPR19 AND NOT-STEAP2 AND GABRA5 | 0.813793 | 0.776316 | 0.855072 | FOLH1 AND EPHA3 AND NOT-SLC4A8 | 1 | 1 | 1 |
| COMPLEX-LYPD1/ULBP2/CD58 | 0.876923 | 0.934426 | 0.826087 | FOLH1 AND CDH10 AND NOT-LGR5 | 1 | 1 | 1 |
| COMPLEX-SLCO1C1/GPR158/ST8SIA1 | 0.867647 | 0.880597 | 0.855072 | FOLH1 AND ATP7A AND NOT-ITGB6 | 0.888889 | 0.8 | 1 |
| ASTN1 AND SLC31A1 AND NOT-CD19 | 0.896 | 1 | 0.811594 | FOLH1 AND NOT-GRIN2C AND MOK | 0.888889 | 0.8 | 1 |
| COMPLEX-IL13RA1/SLCO1C1/GPR158 | 0.861314 | 0.867647 | 0.855072 | FOLH1 AND STEAP4 AND NOT-CD180 | 0.857143 | 1 | 0.75 |
| GPR158 AND GPNMB AND NOT-ZACN | 0.80597 | 0.830769 | 0.782609 | FOLH1 AND ATP7A AND NOT-ITGB6 | 0.888889 | 0.8 | 1 |
| COMPLEX-ASTN1/TGFBI/ULBP2 | 0.859375 | 0.932203 | 0.797101 | FOLH1 AND STEAP4 AND NOT-MUC1 | 0.857143 | 1 | 0.75 |
| SYT11 AND NOT-SSTR1 AND MRAP | 0.900763 | 0.951613 | 0.855072 | FOLH1 AND STEAP4 AND NOT-MUC16 | 0.857143 | 1 | 0.75 |
| CDH10 AND CD58 AND NOT-ULBP2 | 0.830568 | 1 | 0.710145 | FOLH1 AND NOT-GRIN2C AND TNC | 0.888889 | 0.8 | 1 |
| NCAM1 AND ABHD3 AND NOT-OPRK1 | 0.878049 | 1 | 0.782609 | FOLH1 AND PTGIS AND NOT-DPEP1 | 0.857143 | 1 | 0.75 |
| GPR19 AND GPNMB AND NOT-CNTNAP2 | 0.803419 | 0.979167 | 0.681159 | STEAP2 AND NOT-GRIN2C AND FOLH1 | 0.888889 | 0.8 | 1 |
| NKAIN4 AND SLC31A1 AND NOT-P2RX5 | 0.803279 | 0.924528 | 0.710145 | STEAP2 AND NOT-GRIN2C AND FOLH1 | 0.888889 | 0.8 | 1 |
| MLC1 AND CD58 AND NOT-ULBP2 | 0.80315 | 0.87931 | 0.73913 | FOLH1 AND PTGIS AND NOT-PMEL | 0.857143 | 1 | 0.75 |
| NCAM1 AND SLC31A1 AND NOT-MRAP | 0.868852 | 1 | 0.768116 | FOLH1 AND STEAP4 AND NOT-L1CAM | 0.857143 | 1 | 0.75 |
| GPR19 AND NOT-CNTNAP2 AND STEAP2 | 0.825397 | 0.912281 | 0.753623 | FOLH1 AND STEAP4 AND NOT-CLDN11 | 0.857143 | 1 | 0.75 |
| GPR19 AND GPNMB AND NOT-ZACN | 0.803419 | 0.979167 | 0.681159 | FOLH1 AND STEAP4 AND NOT-SLAMF7 | 0.857143 | 1 | 0.75 |
| NOT-ATP8B1 AND SLC31A1 AND NOT-CD19 | 0.823529 | 0.835821 | 0.811594 | FOLH1 AND EPHA3 AND NOT-SLC4A8 | 1 | 1 | 1 |
| GPR19 AND LGR5 AND ATP13A5 | 0.8 | 0.763158 | 0.84058 | FOLH1 AND NOT-DPEP1 AND FLVCR1 | 0.857143 | 1 | 0.75 |
| GPR19 AND GPNMB AND NOT-MRAP | 0.810345 | 1 | 0.681159 | FOLH1 AND STEAP4 AND NOT-EPHA3 | 0.857143 | 1 | 0.75 |
| COMPLEX-SLCO1C1/GPR158/CLDN12 | 0.902778 | 0.866667 | 0.942029 | FOLH1 AND CDH10 AND NOT-LGR5 | 1 | 1 | 1 |
| LYPD1 AND NOT-ULBP2 AND IL17RA | 0.859375 | 0.932203 | 0.797101 | FOLH1 AND SELP AND NOT-PMEL | 0.857143 | 1 | 0.75 |
| CDH10 AND NOT-CNTNAP2 AND GPNMB | 0.803419 | 0.979167 | 0.681159 | FOLH1 AND STEAP4 AND NOT-CD33 | 0.857143 | 1 | 0.75 |
| COMPLEX-SYT11/SSTR1/ULBP2 | 0.956522 | 0.956522 | 0.956522 | FOLH1 AND SELP AND NOT-ITGB3 | 0.857143 | 1 | 0.75 |
| SYT11 AND NOT-STEAP2 AND ULBP2 | 0.964539 | 0.944444 | 0.985507 | FOLH1 AND ROR1 AND NOT-DYSF | 0.888889 | 0.8 | 1 |
| SYT11 AND LGR5 AND CD19 | 0.934307 | 0.941176 | 0.927536 | FOLH1 AND NOT-CD36 AND NOT-LGR5 | 0.888889 | 0.8 | 1 |
| BCAN AND NOT-CD19 AND SLC31A1 | 0.868852 | 1 | 0.768116 | FOLH1 AND NOT-GRIN2C AND IL2RA | 0.888889 | 0.8 | 1 |
| GPR19 AND LGR5 AND NOT-CD19 | 0.805556 | 0.773333 | 0.84058 | FOLH1 AND CLDN8 AND NOT-ATP6V0A4 | 1 | 1 | 1 |
| NOT-EPCAM AND SLC31A1 AND NOT-P2RX5 | 0.892086 | 0.885714 | 0.898551 | FOLH1 AND CLDN8 AND NOT-KCNC2 | 0.857143 | 1 | 0.75 |
| ITGAV AND NOT-GPNMB AND NOT-MRAP | 0.852713 | 0.916667 | 0.797101 | FOLH1 AND NOT-MET AND NOT-SLC4A8 | 0.888889 | 0.8 | 1 |
| ITGAV AND NOT-PROCR AND NOT-CD19 | 0.848485 | 0.888889 | 0.811594 | FOLH1 AND CLDN8 AND NOT-SLC39A8 | 0.857143 | 1 | 0.75 |
| ITGAV AND NOT-GPNMB AND CNTNAP2 | 0.833333 | 0.873016 | 0.797101 | FOLH1 AND ROR1 AND NOT-STAB1 | 0.888889 | 0.8 | 1 |
| NOT-EPCAM AND SLC31A1 AND NOT-CD19 | 0.882759 | 0.842105 | 0.927536 | FOLH1 AND GGTLC1 AND NOT-ITGB6 | 1 | 1 | 1 |
| COMPLEX-GPR19/SSTR1/ULBP2 | 0.834532 | 0.828571 | 0.84058 | FOLH1 AND EPCAM AND PPAPDC1B | 0.857143 | 1 | 0.75 |
| NOT-CEACAM6 AND SLC39A8 AND STEAP2 | 0.874074 | 0.893939 | 0.855072 | FOLH1 AND EPHA3 AND NOT-TNFRSF10B | 0.8 | 0.666667 | 1 |
| ITGAV AND NOT-MRAP AND SSTR1 | 0.955882 | 0.970149 | 0.942029 | FOLH1 AND NOT-DPEP1 AND CLDN8 | 0.857143 | 1 | 0.75 |
| NOT-CEACAM6 AND SLC39A8 AND SSTR1 | 0.863014 | 0.818182 | 0.913043 | FOLH1 AND EPHA3 AND NOT-B4GALNT1 | 0.857143 | 1 | 0.75 |
| ITGAV AND NOT-MRAP AND CD19 | 0.876923 | 0.934426 | 0.826087 | FOLH1 AND NOT-EDNRB AND CLDN8 | 0.857143 | 1 | 0.75 |
| NOT-RNF43 AND SLC31A1 AND NOT-CD19 | 0.867133 | 0.837838 | 0.898551 | FOLH1 AND EPCAM AND IL20RA | 0.857143 | 1 | 0.75 |
| EDNRB AND NOT-MRAP AND NOT-FOLR1 | 0.8 | 0.892857 | 0.724638 | FOLH1 AND EPHA3 AND EPCAM | 0.857143 | 1 | 0.75 |
| ITGAV AND RXFP3 AND CD19 | 0.859259 | 0.878788 | 0.84058 | FOLH1 AND EPHA3 AND NOT-EDNRB | 0.857143 | 1 | 0.75 |
| NOT-RNF43 AND SLC31A1 AND NOT-P2RX5 | 0.875912 | 0.882353 | 0.869565 | FOLH1 AND EPHA3 AND NOT-ITGB3 | 0.857143 | 1 | 0.75 |
| ITGAV AND NOT-MRAP AND FOLR1 | 0.918519 | 0.939394 | 0.898551 | FOLH1 AND NOT-EDNRB AND IL20RA | 0.857143 | 1 | 0.75 |
| ITGAV AND NOT-MRAP AND NOT-ABCB5 | 0.910448 | 0.938462 | 0.884058 | FOLH1 AND CLDN8 AND NOT-PROM1 | 0.857143 | 1 | 0.75 |
| NOT-CEACAM6 AND SLC31A1 AND NOT-P2RX5 | 0.93617 | 0.916667 | 0.956522 | FOLH1 AND EPHA3 AND NOT-LGR5 | 0.888889 | 0.8 | 1 |
| ITGAV AND CD19 AND SLC6A15 | 0.852941 | 0.865672 | 0.84058 | FOLH1 AND EPHA3 AND NOT-LGR5 | 0.888889 | 0.8 | 1 |
| ITGAV AND CD19 AND ATP1B4 | 0.84058 | 0.84058 | 0.84058 | FOLH1 AND EPHA3 AND NOT-NCAM1 | 0.857143 | 1 | 0.75 |
| ITGAV AND CD19 AND NOT-KCNA7 | 0.863636 | 0.904762 | 0.826087 | FOLH1 AND EPHA3 AND NOT-NCAM1 | 0.857143 | 1 | 0.75 |
| ITGAV AND PCDHGC4 AND CD19 | 0.846715 | 0.852941 | 0.84058 | FOLH1 AND EPCAM AND CLDN8 | 0.857143 | 1 | 0.75 |
| ITGAV AND CD19 AND NOT-XCR1 | 0.876923 | 0.934426 | 0.826087 | FOLH1 AND EPCAM AND NOT-GUCY2C | 0.857143 | 1 | 0.75 |
| ITGAV AND CD19 AND GABRA5 | 0.846715 | 0.852941 | 0.84058 | FOLH1 AND EPHA3 AND NOT-IL3RA | 0.857143 | 1 | 0.75 |
| ITGAV AND CD19 AND HTR1F | 0.846715 | 0.852941 | 0.84058 | FOLH1 AND CLDN8 AND NOT-TNFRSF17 | 0.888889 | 0.8 | 1 |
| ITGAV AND CD19 AND SLC2A2 | 0.852941 | 0.865672 | 0.84058 | FOLH1 AND EPHA3 AND NOT-CD33 | 0.888889 | 0.8 | 1 |

FIG. 15 (cont.)

| Antigen Pair Logic | F1 | Precision | Recall |
|---|---|---|---|
| ITGAV AND CD19 AND ROS1 | 0.842105 | 0.875 | 0.811594 |
| NOT-CEACAM6 AND CNTNAP2 AND GPNMB | 0.827586 | 0.789474 | 0.869565 |
| ITGAV AND CD19 AND CLDN16 | 0.84058 | 0.84058 | 0.84058 |
| ITGAV AND CD19 AND GRM1 | 0.834532 | 0.828571 | 0.84058 |
| ITGAV AND CD19 AND SLC12A3 | 0.846715 | 0.852941 | 0.84058 |
| ITGAV AND CD19 AND ABCG5 | 0.859259 | 0.878788 | 0.84058 |
| ITGAV AND CD19 AND SLC22A2 | 0.850746 | 0.876923 | 0.826087 |
| ITGAV AND CD19 AND GUCY2D | 0.814815 | 0.833333 | 0.797101 |
| ITGAV AND CD19 AND NOT-SLC10A2 | 0.819672 | 0.943396 | 0.724638 |
| COMPLEX-ITGAV/TGFBI/ULBP2 | 0.842857 | 0.830986 | 0.855072 |
| ITGAV AND ULBP2 AND NOT-ZACN | 0.909091 | 0.878378 | 0.942029 |
| NOT-CLDN4 AND SLC31A1 AND NOT-P2RX5 | 0.859155 | 0.835616 | 0.884058 |
| NOT-CLDN4 AND SLC31A1 AND NOT-CD19 | 0.857143 | 0.807692 | 0.913043 |
| ITGAV AND SSTR1 AND NOT-SLC22A5 | 0.916667 | 0.88 | 0.956522 |
| ITGAV AND ULBP2 AND NOT-CATSPER3 | 0.942029 | 0.942029 | 0.942029 |
| ITGAV AND SSTR1 AND NOT-CATSPER3 | 0.956522 | 0.956522 | 0.956522 |
| ITGAV AND CD19 AND LGR5 | 0.833333 | 0.873016 | 0.797101 |
| ITGAV AND ULBP2 AND SSTR1 | 0.902778 | 0.866667 | 0.942029 |
| Leiomyosarcoma | | | |
| BVES AND NOT-ATP7B AND KIAA0754 | 0.857143 | 0.8 | 0.923077 |
| DDR2 AND NOT-TM7SF2 AND NOT-TNFRSF13B | 0.869565 | 1 | 0.769231 |
| DDR2 AND NOT-TM7SF2 AND NOT-COL17A1 | 0.869565 | 1 | 0.769231 |
| NOT-MAL AND BVES AND KIAA0754 | 0.96 | 1 | 0.923077 |
| DDR2 AND NOT-TM7SF2 AND NOT-KIAA1919 | 0.869565 | 1 | 0.769231 |
| DDR2 AND NOT-TM7SF2 AND NOT-TNFSF14 | 0.869565 | 1 | 0.769231 |
| DDR2 AND NOT-TM7SF2 AND NOT-FPR2 | 0.869565 | 1 | 0.769231 |
| DDR2 AND NOT-TM7SF2 AND NOT-CFTR | 0.869565 | 1 | 0.769231 |
| DDR2 AND NOT-SLC5A1 AND TAS2R4 | 0.869565 | 1 | 0.769231 |
| DDR2 AND NOT-TM7SF2 AND NOT-GJB6 | 0.818182 | 1 | 0.692308 |
| DDR2 AND NOT-SLC5A1 AND GPR84 | 0.818182 | 1 | 0.692308 |
| BVES AND NOT-CHL1 AND KIAA0754 | 0.814815 | 0.785714 | 0.846154 |
| NOT-TSPAN8 AND BVES AND KIAA0754 | 0.814815 | 0.785714 | 0.846154 |
| NOT-F11R AND ATP2A2 AND NOT-NLGN3 | 0.923077 | 0.923077 | 0.923077 |
| BVES AND NOT-SLC5A1 AND KIAA0754 | 0.857143 | 0.8 | 0.923077 |
| DDR2 AND NOT-F11R AND NOT-ROM1 | 0.833333 | 0.909091 | 0.769231 |
| DDR2 AND NOT-TM7SF2 AND CD244 | 0.818182 | 1 | 0.692308 |
| DDR2 AND NOT-TM7SF2 AND KCNJ1 | 0.869565 | 1 | 0.769231 |
| DDR2 AND NOT-TM7SF2 AND CHRM3 | 0.869565 | 1 | 0.769231 |
| NOT-F11R AND ATP2A2 AND NOT-GJB1 | 0.923077 | 0.923077 | 0.923077 |
| DDR2 AND NOT-TM7SF2 AND NOT-SLC16A4 | 0.869565 | 1 | 0.769231 |
| DDR2 AND NOT-GDPD2 AND KCNG3 | 0.869565 | 1 | 0.769231 |
| DDR2 AND NOT-F11R AND NOT-SYP | 0.833333 | 0.909091 | 0.769231 |
| DDR2 AND NOT-F11R AND NOT-TM7SF2 | 0.869565 | 1 | 0.769231 |
| DDR2 AND NOT-F11R AND TMEM63B | 0.8 | 0.833333 | 0.769231 |
| DDR2 AND NOT-F11R AND TMIGD2 | 0.8 | 0.833333 | 0.769231 |
| DDR2 AND NOT-F11R AND ANO7 | 0.8 | 0.833333 | 0.769231 |
| BVES AND NOT-MFAP3L AND KIAA0754 | 0.8 | 0.833333 | 0.769231 |
| DDR2 AND NOT-F11R AND NOT-EMCN | 0.8 | 0.833333 | 0.769231 |
| DDR2 AND NOT-F11R AND SCNN1A | 0.8 | 0.833333 | 0.769231 |
| VMP1 AND NOT-F11R AND SLC5A7 | 0.833333 | 0.909091 | 0.769231 |
| DDR2 AND NOT-TM7SF2 AND NOT-SPN | 0.869565 | 1 | 0.769231 |
| DDR2 AND NOT-TM7SF2 AND CCR6 | 0.818182 | 1 | 0.692308 |
| DDR2 AND NOT-TM7SF2 AND CXCR1 | 0.869565 | 1 | 0.769231 |
| DDR2 AND NOT-TM7SF2 AND PIEZO1 | 0.869565 | 1 | 0.769231 |
| DDR2 AND NOT-TM7SF2 AND GPR52 | 0.869565 | 1 | 0.769231 |
| DDR2 AND NOT-TM7SF2 AND NOT-GPR160 | 0.869565 | 1 | 0.769231 |
| DDR2 AND NOT-TM7SF2 AND ATP12A | 0.869565 | 1 | 0.769231 |
| DDR2 AND NOT-GDPD2 AND CCR6 | 0.818182 | 1 | 0.692308 |
| DDR2 AND NOT-F11R AND CLSTN1 | 0.869565 | 1 | 0.769231 |
| DDR2 AND NOT-TM7SF2 AND NOT-HAVCR2 | 0.818182 | 1 | 0.692308 |
| DDR2 AND NOT-F11R AND NOT-GJB1 | 0.833333 | 0.909091 | 0.769231 |
| PCDH18 AND NOT-SLC5A1 AND TAS2R4 | 0.818182 | 1 | 0.692308 |
| DDR2 AND NOT-TM7SF2 AND NOT-MGAM | 0.869565 | 1 | 0.769231 |
| DDR2 AND NOT-TM7SF2 AND NOT-ICAM4 | 0.869565 | 1 | 0.769231 |
| DDR2 AND NOT-TM7SF2 AND ADRB3 | 0.818182 | 1 | 0.692308 |
| DDR2 AND NOT-F11R AND NOT-AQP7 | 0.869565 | 1 | 0.769231 |
| DDR2 AND NOT-F11R AND NOT-NLGN3 | 0.833333 | 0.909091 | 0.769231 |
| VMP1 AND NOT-F11R AND SYT9 | 0.869565 | 1 | 0.769231 |
| VMP1 AND NOT-F11R AND KCNJ16 | 0.833333 | 0.909091 | 0.769231 |
| SLC4A7 AND BVES AND NOT-RHBDL2 | 0.869565 | 1 | 0.769231 |
| VMP1 AND NOT-F11R AND NOT-EMCN | 0.833333 | 0.909091 | 0.769231 |
| DDR2 AND NOT-TM7SF2 AND C2orf83 | 0.869565 | 1 | 0.769231 |
| DDR2 AND NOT-TM7SF2 AND NOT-EVI2B | 0.869565 | 1 | 0.769231 |
| DDR2 AND NOT-F11R AND NOT-SLC24A4 | 0.869565 | 1 | 0.769231 |
| VMP1 AND NOT-F11R AND SLC5A12 | 0.869565 | 1 | 0.769231 |
| VMP1 AND NOT-F11R AND IL23R | 0.869565 | 1 | 0.769231 |
| BVES AND NOT-SLC27A5 AND KIAA0754 | 0.8 | 0.705882 | 0.923077 |

| Antigen Pair Logic | F1 | Precision | Recall |
|---|---|---|---|
| FOLH1 AND ROR1 AND NOT-LGR5 | 1 | 1 | 1 |
| FOLH1 AND EPCAM AND NOT-SST | 0.857143 | 1 | 0.75 |
| FOLH1 AND EPCAM AND NOT-CEACAM5 | 0.857143 | 1 | 0.75 |
| FOLH1 AND EPCAM AND CLDN11 | 0.857143 | 1 | 0.75 |
| FOLH1 AND NOT-MET AND CLDN8 | 0.8 | 0.666667 | 1 |
| COMPLEX-FOLH1/STEAP2/PSCA | 0.8 | 0.666667 | 1 |
| FOLH1 AND EPHA3 AND NOT-MUC1 | 0.8 | 0.666667 | 1 |
| FOLH1 AND EPHA3 AND NOT-TNC | 0.8 | 0.666667 | 1 |
| FOLH1 AND EPHA3 AND NOT-KDR | 0.8 | 0.666667 | 1 |
| FOLH1 AND EPHA3 AND NOT-ST8SIA1 | 0.8 | 0.666667 | 1 |
| FOLH1 AND EPHA3 AND NOT-AXL | 0.8 | 0.666667 | 1 |
| FOLH1 AND EPHA3 AND NOT-TNFRSF17 | 0.8 | 0.666667 | 1 |
| FOLH1 AND EPHA3 AND NOT-L1CAM | 0.8 | 0.666667 | 1 |
| FOLH1 AND EPHA3 AND NOT-L1CAM | 0.8 | 0.666667 | 1 |
| FOLH1 AND EPHA3 AND NOT-CEACAM6 | 0.8 | 0.666667 | 1 |
| FOLH1 AND EPHA3 AND NOT-DKK1 | 0.8 | 0.666667 | 1 |
| FOLH1 AND EPHA3 AND NOT-MUC1 | 0.8 | 0.666667 | 1 |
| FOLH1 AND EPHA3 AND NOT-CSPG4 | 0.8 | 0.666667 | 1 |
| COMPLEX-FOLH1/STEAP2/ENPP3 | 0.8 | 0.666667 | 1 |
| FOLH1 AND EPHA3 AND NOT-AXL | 0.8 | 0.666667 | 1 |
| FOLH1 AND EPHA3 AND NOT-CSPG4 | 0.8 | 0.666667 | 1 |
| STEAP2 AND FOLH1 AND NOT-DPEP1 | 0.857143 | 1 | 0.75 |
| FOLH1 AND CLDN8 AND NOT-CD33 | 0.888889 | 0.8 | 1 |
| FOLH1 AND CLDN8 AND NOT-CD33 | 0.888889 | 0.8 | 1 |
| FOLH1 AND CLDN8 AND NOT-CEACAM6 | 0.857143 | 1 | 0.75 |
| FOLH1 AND NOT-ALDH1A1 AND MUC1 | 0.857143 | 1 | 0.75 |
| STEAP2 AND NOT-KDR AND FOLH1 | 0.8 | 0.666667 | 1 |
| FOLH1 AND NOT-MET AND IL20RA | 0.857143 | 1 | 0.75 |
| FOLH1 AND NOT-PROM1 AND MUC1 | 0.857143 | 1 | 0.75 |
| FOLH1 AND ROR1 AND NOT-CD33 | 1 | 1 | 1 |
| FOLH1 AND ROR1 AND NOT-SLAMF7 | 0.888889 | 0.8 | 1 |
| FOLH1 AND CLDN8 AND NOT-FCRL5 | 0.8 | 0.666667 | 1 |
| FOLH1 AND CLDN8 AND NOT-CD22 | 0.857143 | 1 | 0.75 |
| FOLH1 AND ROR1 AND NOT-ITGB6 | 0.857143 | 1 | 0.75 |
| FOLH1 AND EPCAM AND NOT-ITGB6 | 0.857143 | 1 | 0.75 |
| FOLH1 AND NOT-ALDH1A1 AND CLDN8 | 0.857143 | 1 | 0.75 |
| FOLH1 AND ROR1 AND NOT-NCAM1 | 0.857143 | 1 | 0.75 |
| FOLH1 AND ROR1 AND NOT-FOLR2 | 0.888889 | 0.8 | 1 |
| FOLH1 AND ROR1 AND NOT-SST | 0.888889 | 0.8 | 1 |
| FOLH1 AND ROR1 AND NOT-CSPG4 | 0.888889 | 0.8 | 1 |
| FOLH1 AND ROR1 AND NOT-GUCY2C | 0.888889 | 0.8 | 1 |
| FOLH1 AND NOT-MET AND NOT-LGR5 | 0.888889 | 0.8 | 1 |
| FOLH1 AND IL20RA AND NOT-CD33 | 0.888889 | 0.8 | 1 |
| FOLH1 AND CLDN8 AND NOT-SLAMF7 | 0.888889 | 0.8 | 1 |
| FOLH1 AND NOT-DPEP1 AND ERBB2 | 0.857143 | 1 | 0.75 |
| FOLH1 AND CLDN8 AND NOT-SLAMF7 | 0.888889 | 0.8 | 1 |
| FOLH1 AND IL20RA AND NOT-TNFRSF17 | 0.8 | 0.666667 | 1 |
| FOLH1 AND CLDN8 AND NOT-CD180 | 0.888889 | 0.8 | 1 |
| FOLH1 AND NOT-CEACAM6 AND MUC1 | 0.857143 | 1 | 0.75 |
| FOLH1 AND IL20RA AND NOT-CD33 | 0.888889 | 0.8 | 1 |
| FOLH1 AND CLDN8 AND NOT-CD180 | 0.888889 | 0.8 | 1 |
| FOLH1 AND NOT-LGR5 AND FAP | 0.857143 | 1 | 0.75 |
| FOLH1 AND EPCAM AND IL13RA2 | 0.857143 | 1 | 0.75 |
| FOLH1 AND ROR1 AND NOT-AXL | 0.888889 | 0.8 | 1 |
| STEAP2 AND CLDN8 AND NOT-FOLH1 | 0.857143 | 1 | 0.75 |
| FOLH1 AND ROR1 AND NOT-CEACAM5 | 0.888889 | 0.8 | 1 |
| FOLH1 AND ROR1 AND NOT-CD160 | 0.888889 | 0.8 | 1 |
| STEAP2 AND CLDN8 AND NOT-FOLH1 | 0.857143 | 1 | 0.75 |
| TRPM8 AND NOT-SLC39A2 AND NOT-TNC | 1 | 1 | 1 |
| TRPM8 AND NOT-SLC39A2 AND NOT-TNC | 1 | 1 | 1 |
| TRPM8 AND NOT-CSPG4 AND NOT-SLC39A2 | 1 | 1 | 1 |
| TRPM8 AND BIRC5 AND NOT-FMNL1 | 1 | 1 | 1 |
| TRPM8 AND BIRC5 AND NOT-FMNL1 | 1 | 1 | 1 |
| COMPLEX-IGF1R/TRPM8/SLC16A5 | 1 | 1 | 1 |
| STEAP2 AND EPHA10 AND NOT-SLC39A2 | 1 | 1 | 1 |
| TRPM8 AND NOT-IL17RA AND TRPM4 | 1 | 1 | 1 |
| STEAP2 AND SLC43A1 AND NOT-IL17RA | 1 | 1 | 1 |
| STEAP2 AND SLCO1A2 AND SLC43A1 | 1 | 1 | 1 |
| TRPM8 AND NOT-GYPC AND VCAM1 | 1 | 1 | 1 |
| TRPM8 AND NOT-GYPC AND MUC1 | 1 | 1 | 1 |
| TRPM8 AND NOT-SYT4 AND CLDN8 | 1 | 1 | 1 |
| STEAP2 AND NOT-GYPC AND PTGER4 | 1 | 1 | 1 |
| STEAP2 AND GPR19 AND NOT-SLC39A2 | 1 | 1 | 1 |
| TRPM8 AND NOT-GYPC AND MUC1 | 1 | 1 | 1 |
| STEAP2 AND NOT-GYPC AND F2R | 1 | 1 | 1 |
| STEAP2 AND GPR19 AND NOT-SLC39A2 | 1 | 1 | 1 |
| TRPM8 AND NOT-IL17RA AND CLDN8 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| VMP1 AND NOT-F11R AND EQTN | 0.869565 | 1 | 0.769231 | TRPM8 AND NOT-TNC AND F2R | 1 | 1 | 1 |
| VMP1 AND NOT-F11R AND KCNH7 | 0.869565 | 1 | 0.769231 | TRPM8 AND NOT-DYSF AND CLDN8 | 1 | 1 | 1 |
| DDR2 AND NOT-F11R AND NOT-TNFSF9 | 0.833333 | 0.909091 | 0.769231 | TRPM8 AND NOT-SLC39A2 AND BIRC5 | 1 | 1 | 1 |
| VMP1 AND NOT-F11R AND GABRR3 | 0.869565 | 1 | 0.769231 | TRPM8 AND NOT-SLC39A2 AND WT1 | 1 | 1 | 1 |
| VMP1 AND NOT-F11R AND RRH | 0.869565 | 1 | 0.769231 | TRPM8 AND NOT-GUCY2D AND TRPM4 | 1 | 1 | 1 |
| VMP1 AND NOT-F11R AND AKAP6 | 0.869565 | 1 | 0.769231 | TRPM8 AND NOT-DYSF AND TRPM4 | 1 | 1 | 1 |
| NOT-F11R AND ATP2A2 AND NOT-SYP | 0.96 | 1 | 0.923077 | TRPM8 AND NOT-SLC5A2 AND TRPM4 | 1 | 1 | 1 |
| DDR2 AND NOT-TM7SF2 AND NOT-OR51E1 | 0.869565 | 1 | 0.769231 | STEAP2 AND EPHA10 AND NOT-FMNL1 | 1 | 1 | 1 |
| DDR2 AND NOT-TM7SF2 AND TAS2R4 | 0.869565 | 1 | 0.769231 | TRPM8 AND NOT-GYPC AND TRPM4 | 1 | 1 | 1 |
| DDR2 AND NOT-TM7SF2 AND NOT-IGSF6 | 0.869565 | 1 | 0.769231 | STEAP2 AND SLC43A1 AND NOT-GUCY2D | 1 | 1 | 1 |
| DDR2 AND NOT-TM7SF2 AND CLEC4A | 0.869565 | 1 | 0.769231 | STEAP2 AND SLC43A1 AND NOT-DYSF | 1 | 1 | 1 |
| DDR2 AND NOT-TM7SF2 AND NOT-SEMA4G | 0.869565 | 1 | 0.769231 | STEAP2 AND NOT-GYPC AND SLC43A1 | 1 | 1 | 1 |
| DDR2 AND NOT-F11R AND NOT-ASGR1 | 0.833333 | 0.909091 | 0.769231 | STEAP2 AND SLC43A1 AND NOT-EBP | 1 | 1 | 1 |
| VMP1 AND BVES AND NOT-RHBDL2 | 0.88 | 0.916667 | 0.846154 | STEAP2 AND NOT-SLC4A8 AND NOT-ANPEP | 1 | 1 | 1 |
| DDR2 AND NOT-F11R AND NOT-BEST1 | 0.833333 | 0.909091 | 0.769231 | TRPM8 AND NOT-SLC39A2 AND ABCB5 | 1 | 1 | 1 |
| DDR2 AND NOT-F11R AND P2RY1 | 0.8 | 0.833333 | 0.769231 | TRPM8 AND NOT-SLC39A2 AND BIRC5 | 1 | 1 | 1 |
| BVES AND NOT-GDPD2 AND KIAA0754 | 0.888889 | 0.857143 | 0.923077 | STEAP2 AND NOT-SYT4 AND SLC43A1 | 1 | 1 | 1 |
| VMP1 AND NOT-F11R AND TMIGD2 | 0.833333 | 0.909091 | 0.769231 | STEAP2 AND SLC43A1 AND NOT-SLC5A2 | 1 | 1 | 1 |
| VMP1 AND NOT-F11R AND PCDHGB6 | 0.869565 | 1 | 0.769231 | TRPM8 AND NOT-TNC AND SLC43A1 | 1 | 1 | 1 |
| VMP1 AND NOT-F11R AND C2orf83 | 0.833333 | 0.909091 | 0.769231 | TRPM8 AND NOT-SYT4 AND TRPM4 | 1 | 1 | 1 |
| VMP1 AND NOT-F11R AND IL20RB | 0.869565 | 1 | 0.769231 | STEAP2 AND SLC43A1 AND NOT-CHRNA2 | 1 | 1 | 1 |
| BVES AND HLA-B AND NOT-RHBDL2 | 0.869565 | 1 | 0.769231 | STEAP2 AND GPR19 AND SLC43A1 | 1 | 1 | 1 |
| VMP1 AND NOT-F11R AND GPR3 | 0.869565 | 1 | 0.769231 | TRPM8 AND NOT-CHRNA2 AND TRPM4 | 1 | 1 | 1 |
| DDR2 AND NOT-GDPD2 AND GJB6 | 0.869565 | 1 | 0.769231 | STEAP2 AND NOT-SLC39A2 AND NOT-SLC31A1 | 1 | 1 | 1 |
| DDR2 AND NOT-GDPD2 AND TAS2R4 | 0.869565 | 1 | 0.769231 | STEAP2 AND NOT-SYT4 AND NOT-FMNL1 | 1 | 1 | 1 |
| DDR2 AND NOT-GDPD2 AND GPR82 | 0.869565 | 1 | 0.769231 | STEAP2 AND GPR19 AND NOT-FMNL1 | 1 | 1 | 1 |
| DDR2 AND NOT-GDPD2 AND OR2B2 | 0.869565 | 1 | 0.769231 | STEAP2 AND GPR19 AND F2R | 1 | 1 | 1 |
| NOT-F11R AND BRCA1 AND NOT-ICAM4 | 0.818182 | 1 | 0.692308 | STEAP2 AND NOT-DYSF AND NOT-SLC39A2 | 1 | 1 | 1 |
| NOT-CRB3 AND BVES AND KIAA0754 | 0.846154 | 0.846154 | 0.846154 | COMPLEX-STEAP2/SCN2A/SLC16A5 | 1 | 1 | 1 |
| BVES AND KIAA0754 AND NOT-DSC3 | 0.88 | 0.916667 | 0.846154 | TRPM8 AND NOT-DYSF AND VCAM1 | 1 | 1 | 1 |
| DDR2 AND NOT-F11R AND NOT-MTUS1 | 0.833333 | 0.909091 | 0.769231 | STEAP2 AND NOT-SLC39A2 AND RGSL1 | 1 | 1 | 1 |
| BVES AND KIAA0754 AND NOT-SLC7A10 | 0.8125 | 0.684211 | 1 | STEAP2 AND NOT-SLC39A2 AND NOT-EBP | 1 | 1 | 1 |
| VMP1 AND NOT-F11R AND TRDN | 0.869565 | 1 | 0.769231 | TRPM8 AND NOT-SYT4 AND ABCA5 | 1 | 1 | 1 |
| VMP1 AND NOT-F11R AND TAS2R5 | 0.869565 | 1 | 0.769231 | TRPM8 AND NOT-EPHA2 AND CLDN8 | 1 | 1 | 1 |
| VMP1 AND NOT-F11R AND OR2K2 | 0.869565 | 1 | 0.769231 | TRPM8 AND NOT-DYSF AND PTGER4 | 1 | 1 | 1 |
| VMP1 AND NOT-F11R AND SLC5A1 | 0.869565 | 1 | 0.769231 | STEAP2 AND NOT-SLC39A2 AND TMPRSS11D | 1 | 1 | 1 |
| VMP1 AND NOT-F11R AND GJB5 | 0.869565 | 1 | 0.769231 | STEAP2 AND NOT-GYPC AND STEAP4 | 1 | 1 | 1 |
| VMP1 AND NOT-F11R AND F2RL2 | 0.833333 | 0.909091 | 0.769231 | STEAP2 AND NOT-GYPC AND CD163 | 1 | 1 | 1 |
| VMP1 AND NOT-F11R AND SLC6A2 | 0.833333 | 0.909091 | 0.769231 | TRPM8 AND NOT-TNC AND PTGER4 | 1 | 1 | 1 |
| DDR2 AND NOT-TM7SF2 AND NOT-MLC1 | 0.869565 | 1 | 0.769231 | STEAP2 AND GPR19 AND NOT-FMNL1 | 1 | 1 | 1 |
| DDR2 AND NOT-TM7SF2 AND NOT-SLC5A11 | 0.869565 | 1 | 0.769231 | STEAP2 AND NOT-SLC39A2 AND UMODL1 | 1 | 1 | 1 |
| DDR2 AND NOT-TM7SF2 AND GJD2 | 0.869565 | 1 | 0.769231 | STEAP2 AND NOT-SYT4 AND NOT-FMNL1 | 1 | 1 | 1 |
| DDR2 AND NOT-F11R AND NOT-SLC6A11 | 0.818182 | 1 | 0.692308 | STEAP2 AND NOT-SLC39A2 AND NOT-EPHA2 | 1 | 1 | 1 |
| DDR2 AND NOT-TM7SF2 AND NOT-KIAA0319 | 0.869565 | 1 | 0.769231 | COMPLEX-STEAP2/TMPRSS11E/SLC16A5 | 1 | 1 | 1 |
| DDR2 AND NOT-TM7SF2 AND NOT-LRRN4 | 0.869565 | 1 | 0.769231 | TRPM8 AND NOT-SLC5A2 AND CLDN8 | 1 | 1 | 1 |
| DDR2 AND NOT-TM7SF2 AND CACNG1 | 0.869565 | 1 | 0.769231 | STEAP2 AND NOT-SLC39A2 AND PCDHA9 | 1 | 1 | 1 |
| ATP8B2 AND NOT-PIGR AND EMP2 | 0.869565 | 1 | 0.769231 | STEAP2 AND SLC2A2 AND NOT-SLC39A2 | 1 | 1 | 1 |
| ATP8B2 AND NOT-PIGR AND CDH5 | 0.869565 | 1 | 0.769231 | COMPLEX-GABRB2/STEAP2/SLC16A5 | 1 | 1 | 1 |
| ATP8B2 AND NOT-PIGR AND PMP22 | 0.833333 | 0.909091 | 0.769231 | TRPM8 AND NOT-SLC39A2 AND P2RX5 | 1 | 1 | 1 |
| ATP8B2 AND NOT-PIGR AND LRP11 | 0.869565 | 1 | 0.769231 | TRPM8 AND NOT-GUCY2D AND CLDN8 | 1 | 1 | 1 |
| DDR2 AND NOT-TM7SF2 AND ATP13A5 | 0.869565 | 1 | 0.769231 | TRPM8 AND NOT-DYSF AND ABCA5 | 1 | 1 | 1 |
| DDR2 AND NOT-F11R AND NOT-MLC1 | 0.833333 | 0.909091 | 0.769231 | TRPM8 AND NOT-CSPG4 AND PTGER4 | 1 | 1 | 1 |
| DDR2 AND NOT-F11R AND NOT-GRID2 | 0.833333 | 0.909091 | 0.769231 | STEAP2 AND NOT-SLC39A2 AND NOT-IL17RA | 1 | 1 | 1 |
| DDR2 AND NOT-F11R AND NOT-SLC5A11 | 0.833333 | 0.909091 | 0.769231 | STEAP2 AND GPR19 AND PTGER4 | 1 | 1 | 1 |
| DDR2 AND NOT-F11R AND NOT-KIAA0319 | 0.833333 | 0.909091 | 0.769231 | STEAP2 AND NOT-SLC39A2 AND NOT-CHRNA2 | 1 | 1 | 1 |
| DDR2 AND NOT-F11R AND ABCA12 | 0.8 | 0.833333 | 0.769231 | STEAP2 AND NOT-SLC39A2 AND CACNG7 | 1 | 1 | 1 |
| DDR2 AND NOT-F11R AND CYP4A11 | 0.8 | 0.833333 | 0.769231 | STEAP2 AND NOT-SLC39A2 AND NOT-IL17RA | 1 | 1 | 1 |
| VMP1 AND NOT-F11R AND NOT-SELP | 0.833333 | 0.909091 | 0.769231 | STEAP2 AND NOT-SLC39A2 AND CACNG7 | 1 | 1 | 1 |
| NOT-F11R AND VANGL1 AND NOT-GDPD2 | 1 | 1 | 1 | STEAP2 AND NOT-SLC39A2 AND NOT-CHRNA2 | 1 | 1 | 1 |
| NOT-F11R AND VANGL1 AND NOT-ICAM4 | 1 | 1 | 1 | TRPM8 AND NOT-DYSF AND MUC1 | 1 | 1 | 1 |
| DDR2 AND NOT-F11R AND NOT-GABRB1 | 0.833333 | 0.909091 | 0.769231 | TRPM8 AND NOT-SLC39A2 AND FAP | 1 | 1 | 1 |
| NOT-F11R AND VANGL1 AND NOT-ICAM4 | 1 | 1 | 1 | TRPM8 AND NOT-CSPG4 AND F2R | 1 | 1 | 1 |
| NOT-F11R AND VANGL1 AND NOT-TNFRSF13B | 1 | 1 | 1 | STEAP2 AND SLC2A2 AND NOT-SLC39A2 | 1 | 1 | 1 |
| NOT-F11R AND ATP2A2 AND NOT-SLC5A11 | 0.923077 | 0.923077 | 0.923077 | STEAP2 AND NOT-SLC39A2 AND NOT-GUCY2D | 1 | 1 | 1 |
| DDR2 AND NOT-TM7SF2 AND SLC22A18 | 0.869565 | 1 | 0.769231 | STEAP2 AND NOT-SLC39A2 AND TMPRSS11D | 1 | 1 | 1 |
| DDR2 AND NOT-F11R AND NOT-SLCO1A2 | 0.869565 | 1 | 0.769231 | STEAP2 AND NOT-SLC39A2 AND NOT-GABRA1 | 1 | 1 | 1 |
| DDR2 AND NOT-F11R AND NOT-MAG | 0.833333 | 0.909091 | 0.769231 | STEAP2 AND NOT-SLC39A2 AND NOT-GUCY2D | 1 | 1 | 1 |
| DDR2 AND NOT-F11R AND NOT-KCNK10 | 0.833333 | 0.909091 | 0.769231 | STEAP2 AND NOT-SLC39A2 AND PCDHA9 | 1 | 1 | 1 |
| NOT-F11R AND VANGL1 AND NOT-ABCB1 | 0.962963 | 0.928571 | 1 | STEAP2 AND NOT-SLC39A2 AND MEGF11 | 1 | 1 | 1 |
| TGFBI AND NOT-F11R AND SLC5A7 | 0.818182 | 1 | 0.692308 | TRPM8 AND NOT-FMNL1 AND P2RX5 | 1 | 1 | 1 |
| VMP1 AND NOT-F11R AND SLC39A12 | 0.833333 | 0.909091 | 0.769231 | STEAP2 AND NOT-SLC39A2 AND NPHS2 | 1 | 1 | 1 |
| DDR2 AND NOT-F11R AND NOT-GABRA4 | 0.833333 | 0.909091 | 0.769231 | STEAP2 AND NOT-SLC39A2 AND NPHS1 | 1 | 1 | 1 |
| VMP1 AND NOT-F11R AND PCDHA9 | 0.833333 | 0.909091 | 0.769231 | TRPM8 AND NOT-SLC39A2 AND NOT-HSPA5 | 1 | 1 | 1 |
| NOT-F11R AND VANGL1 AND NOT-DIO3 | 1 | 1 | 1 | STEAP2 AND NOT-SLC39A2 AND NMBR | 1 | 1 | 1 |
| NOT-F11R AND VANGL1 AND NOT-ATP7B | 1 | 1 | 1 | STEAP2 AND SLC2A2 AND NOT-FMNL1 | 1 | 1 | 1 |
| NOT-F11R AND VANGL1 AND NOT-PCDHA10 | 1 | 1 | 1 | TRPM8 AND NOT-CHRNA2 AND CLDN8 | 1 | 1 | 1 |
| NOT-F11R AND VANGL1 AND NOT-PRR7 | 0.923077 | 0.923077 | 0.923077 | STEAP2 AND NOT-SLC39A2 AND MEGF11 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| DDR2 AND NOT-GDPD2 AND SV2C | 0.869565 | 1 | 0.769231 | STEAP2 AND NOT-SLC39A2 AND NOT-GABRA1 | 1 | 1 | 1 |
| ATP8B2 AND NOT-EREG AND NOT-ICAM4 | 0.8 | 0.833333 | 0.769231 | STEAP2 AND SLC2A2 AND NOT-FMNL1 | 1 | 1 | 1 |
| DDR2 AND NOT-TM7SF2 AND NOT-SLC17A3 | 0.818182 | 1 | 0.692308 | TRPM8 AND NOT-DYSF AND MUC1 | 1 | 1 | 1 |
| NOT-F11R AND VANGL1 AND NOT-ACE2 | 0.88 | 0.916667 | 0.846154 | TRPM8 AND NOT-DKK1 AND F2R | 1 | 1 | 1 |
| DDR2 AND NOT-F11R AND NOT-ADCY8 | 0.833333 | 0.909091 | 0.769231 | STEAP2 AND NOT-TNC AND NOT-SLC39A2 | 1 | 1 | 1 |
| NOT-F11R AND VANGL1 AND NOT-CRHR1 | 0.962963 | 0.928571 | 1 | STEAP2 AND SLCO1A2 AND CLDN8 | 1 | 1 | 1 |
| VMP1 AND NOT-F11R AND OPRK1 | 0.869565 | 1 | 0.769231 | STEAP2 AND BIRC5 AND NOT-FMNL1 | 1 | 1 | 1 |
| DDR2 AND NOT-F11R AND NOT-CHRNG | 0.833333 | 0.909091 | 0.769231 | STEAP2 AND SLCO1A2 AND CLDN8 | 1 | 1 | 1 |
| VMP1 AND NOT-F11R AND ADCY8 | 0.869565 | 1 | 0.769231 | STEAP2 AND BIRC5 AND NOT-FMNL1 | 1 | 1 | 1 |
| VMP1 AND NOT-F11R AND AJAP1 | 0.869565 | 1 | 0.769231 | STEAP2 AND NOT-TNC AND NOT-SLC39A2 | 1 | 1 | 1 |
| DDR2 AND NOT-F11R AND NOT-HCN2 | 0.833333 | 0.909091 | 0.769231 | STEAP2 AND SLCO1A2 AND TRPM4 | 1 | 1 | 1 |
| NOT-F11R AND VANGL1 AND NOT-SLC8A2 | 1 | 1 | 1 | STEAP2 AND NOT-SYT4 AND CLDN8 | 1 | 1 | 1 |
| VMP1 AND NOT-F11R AND SLC13A5 | 0.833333 | 0.909091 | 0.769231 | STEAP2 AND CLDN8 AND NOT-IL17RA | 1 | 1 | 1 |
| ATP8B2 AND NOT-GDPD2 AND NOT-GPR160 | 0.833333 | 0.909091 | 0.769231 | TRPM8 AND NOT-DKK1 AND CLDN8 | 1 | 1 | 1 |
| VMP1 AND NOT-F11R AND GRM1 | 0.869565 | 1 | 0.769231 | STEAP2 AND NOT-GYPC AND MUC1 | 1 | 1 | 1 |
| ATP8B2 AND NOT-TNFRSF13B AND NOT-EREG | 0.833333 | 0.909091 | 0.769231 | STEAP2 AND BIRC5 AND NOT-SLC39A2 | 1 | 1 | 1 |
| VMP1 AND NOT-F11R AND LRRTM4 | 0.869565 | 1 | 0.769231 | STEAP2 AND NOT-SLC39A2 AND NOT-CSPG4 | 1 | 1 | 1 |
| NOT-F11R AND ATP2A2 AND NOT-KIAA0319 | 0.923077 | 0.923077 | 0.923077 | STEAP2 AND NOT-GYPC AND MUC1 | 1 | 1 | 1 |
| VMP1 AND BVES AND LRRC52 | 0.88 | 0.916667 | 0.846154 | TRPM8 AND NOT-TNC AND CLDN8 | 1 | 1 | 1 |
| DDR2 AND NOT-EPCAM AND TAS2R4 | 0.833333 | 0.909091 | 0.769231 | STEAP2 AND NOT-SLC39A2 AND NOT-CSPG4 | 1 | 1 | 1 |
| DDR2 AND NOT-TM7SF2 AND NOT-FCRL2 | 0.869565 | 1 | 0.769231 | STEAP2 AND CLDN8 AND NOT-DYSF | 1 | 1 | 1 |
| DDR2 AND NOT-EPCAM AND C2orf83 | 0.8 | 0.833333 | 0.769231 | STEAP2 AND NOT-GYPC AND VCAM1 | 1 | 1 | 1 |
| DDR2 AND NOT-EPCAM AND SLC5A7 | 0.8 | 0.833333 | 0.769231 | STEAP2 AND CLDN8 AND NOT-DYSF | 1 | 1 | 1 |
| DDR2 AND NOT-F11R AND SSTR5 | 0.8 | 0.833333 | 0.769231 | COMPLEX-IGF1R/EPCAM/TRPM8 | 1 | 1 | 1 |
| DDR2 AND NOT-EPCAM AND IL23R | 0.8 | 0.833333 | 0.769231 | STEAP2 AND CLDN8 AND NOT-IL17RA | 1 | 1 | 1 |
| SLC4A7 AND NOT-ITGB6 AND CDH5 | 0.8 | 0.833333 | 0.769231 | STEAP2 AND NOT-SYT4 AND CLDN8 | 1 | 1 | 1 |
| DDR2 AND NOT-F11R AND NOT-ERBB4 | 0.833333 | 0.909091 | 0.769231 | STEAP2 AND GPR19 AND CLDN8 | 1 | 1 | 1 |
| DDR2 AND NOT-F11R AND NOT-CD22 | 0.833333 | 0.909091 | 0.769231 | STEAP2 AND NOT-TNC AND F2R | 1 | 1 | 1 |
| BIRC5 AND NOT-F11R AND CDH5 | 0.818182 | 1 | 0.692308 | STEAP2 AND NOT-GYPC AND VCAM1 | 1 | 1 | 1 |
| SLC4A7 AND NOT-EPCAM AND ZNRF3 | 0.833333 | 0.909091 | 0.769231 | COMPLEX-STEAP2/IGF1R/SLC16A5 | 1 | 1 | 1 |
| NOT-F11R AND ATP2A2 AND NOT-CD22 | 0.96 | 1 | 0.923077 | TRPM8 AND NOT-TNC AND TRPM4 | 1 | 1 | 1 |
| BIRC5 AND NOT-SMAGP AND PMP22 | 0.818182 | 1 | 0.692308 | STEAP2 AND CLDN8 AND NOT-CD36 | 1 | 1 | 1 |
| VMP1 AND NOT-F11R AND FCRL1 | 0.833333 | 0.909091 | 0.769231 | STEAP2 AND NOT-SLC39A2 AND WT1 | 1 | 1 | 1 |
| VMP1 AND NOT-F11R AND LGR5 | 0.869565 | 1 | 0.769231 | STEAP2 AND NOT-SLC39A2 AND ABCB5 | 1 | 1 | 1 |
| VMP1 AND NOT-F11R AND RAET1E | 0.833333 | 0.909091 | 0.769231 | STEAP2 AND SLCO1A2 AND RNF43 | 1 | 1 | 1 |
| BVES AND NOT-ERBB4 AND KIAA0754 | 0.866667 | 0.764706 | 1 | STEAP2 AND NOT-SYT4 AND TRPM4 | 1 | 1 | 1 |
| BIRC5 AND NOT-F11R AND EMCN | 0.818182 | 1 | 0.692308 | STEAP2 AND EPHA10 AND MUC1 | 1 | 1 | 1 |
| NOT-CEACAM6 AND BVES AND MYOF | 0.827586 | 0.75 | 0.923077 | STEAP2 AND NOT-EMP3 AND VCAM1 | 1 | 1 | 1 |
| VMP1 AND NOT-F11R AND BMPR1B | 0.833333 | 0.909091 | 0.769231 | STEAP2 AND EPHA10 AND VCAM1 | 1 | 1 | 1 |
| VMP1 AND NOT-F11R AND NOT-MSLN | 0.833333 | 0.909091 | 0.769231 | STEAP2 AND SLCO1A2 AND ABCA5 | 1 | 1 | 1 |
| VMP1 AND NOT-F11R AND NOT-CD79B | 0.833333 | 0.909091 | 0.769231 | STEAP2 AND CLDN8 AND NOT-PTGER4 | 1 | 1 | 1 |
| BIRC5 AND NOT-F11R AND NOTCH4 | 0.818182 | 1 | 0.692308 | STEAP2 AND NOT-EMP3 AND CLDN8 | 1 | 1 | 1 |
| NOT-ERBB3 AND GPR17 AND BVES | 0.818182 | 1 | 0.692308 | STEAP2 AND SLC43A1 AND NOT-TNC | 1 | 1 | 1 |
| NOT-F11R AND SLC10A3 AND NOT-CLDN6 | 0.916667 | 1 | 0.846154 | STEAP2 AND CLDN8 AND NOT-EPHA2 | 1 | 1 | 1 |
| NOT-EPCAM AND OXGR1 AND NOT-IL27RA | 0.857143 | 0.8 | 0.923077 | STEAP2 AND CLDN8 AND MEGF11 | 1 | 1 | 1 |
| BIRC5 AND NOT-GDPD2 AND AQP4 | 0.818182 | 1 | 0.692308 | STEAP2 AND GPR19 AND VCAM1 | 1 | 1 | 1 |
| BIRC5 AND NOT-F11R AND LIFR | 0.818182 | 1 | 0.692308 | STEAP2 AND GPR19 AND ABCA5 | 1 | 1 | 1 |
| BIRC5 AND NOT-GDPD2 AND CADM2 | 0.818182 | 1 | 0.692308 | STEAP2 AND NOT-GYPC AND CLDN8 | 1 | 1 | 1 |
| BIRC5 AND NOT-F11R AND PMP22 | 0.818182 | 1 | 0.692308 | TRPM8 AND NOT-TNC AND MUC1 | 1 | 1 | 1 |
| BIRC5 AND NOT-F11R AND DSC2 | 0.818182 | 1 | 0.692308 | TRPM8 AND NOT-CSPG4 AND VCAM1 | 1 | 1 | 1 |
| BIRC5 AND NOT-F11R AND SLC2A13 | 0.818182 | 1 | 0.692308 | STEAP2 AND CLDN8 AND NOT-CHRNA2 | 1 | 1 | 1 |
| BIRC5 AND NOT-F11R AND PODXL | 0.818182 | 1 | 0.692308 | TRPM8 AND NOT-TNC AND ABCA5 | 1 | 1 | 1 |
| VMP1 AND NOT-F11R AND SSTR5 | 0.869565 | 1 | 0.769231 | STEAP2 AND CLDN8 AND NOT-SLC5A2 | 1 | 1 | 1 |
| VMP1 AND NOT-F11R AND NOT-CD22 | 0.833333 | 0.909091 | 0.769231 | TRPM8 AND NOT-TNC AND VCAM1 | 1 | 1 | 1 |
| SLC4A7 AND NOT-EPCAM AND CDH5 | 0.833333 | 0.909091 | 0.769231 | STEAP2 AND CLDN8 AND NOT-GUCY2D | 1 | 1 | 1 |
| SLC4A7 AND BVES AND NOT-CLDN2 | 0.869565 | 1 | 0.769231 | STEAP2 AND NOT-SYT4 AND ABCA5 | 1 | 1 | 1 |
| DDR2 AND NOT-GDPD2 AND FCRL2 | 0.869565 | 1 | 0.769231 | STEAP2 AND NOT-SLC39A2 AND NOT-DKK1 | 1 | 1 | 1 |
| VMP1 AND NOT-F11R AND NOT-CLDN6 | 0.833333 | 0.909091 | 0.769231 | STEAP2 AND NOT-DYSF AND VCAM1 | 1 | 1 | 1 |
| NOT-EPCAM AND BRCA1 AND FZD7 | 0.818182 | 1 | 0.692308 | STEAP2 AND CLDN8 AND NOT-EPHA2 | 1 | 1 | 1 |
| NOT-F11R AND ATP2A2 AND NOT-ERBB4 | 0.96 | 1 | 0.923077 | STEAP2 AND NOT-SLC39A2 AND NOT-DKK1 | 1 | 1 | 1 |
| NOT-F11R AND STX2 AND NOT-CD22 | 0.869565 | 1 | 0.769231 | STEAP2 AND NOT-DKK1 AND F2R | 1 | 1 | 1 |
| NOT-EPCAM AND OXGR1 AND NOT-MAL | 0.923077 | 0.923077 | 0.923077 | STEAP2 AND NOT-TNC AND PTGER4 | 1 | 1 | 1 |
| NOT-EPCAM AND ATP2A2 AND NOT-CCR6 | 0.923077 | 0.923077 | 0.923077 | STEAP2 AND NOT-GYPC AND CLDN8 | 1 | 1 | 1 |
| VMP1 AND NOT-F11R AND NOT-TNFRSF17 | 0.833333 | 0.909091 | 0.769231 | STEAP2 AND GPR19 AND MUC1 | 1 | 1 | 1 |
| VMP1 AND NOT-F11R AND NOT-FCRL2 | 0.833333 | 0.909091 | 0.769231 | TRPM8 AND NOT-CSPG4 AND CLDN8 | 1 | 1 | 1 |
| NOT-ERBB3 AND BVES AND NOT-PAQR9 | 0.846154 | 0.846154 | 0.846154 | STEAP2 AND NOT-SLC39A2 AND FAP | 1 | 1 | 1 |
| NOT-F11R AND SLC10A3 AND NOT-FCRL2 | 0.916667 | 1 | 0.846154 | TRPM8 AND NOT-TNC AND MUC1 | 1 | 1 | 1 |
| BIRC5 AND NOT-GDPD2 AND CDH5 | 0.818182 | 1 | 0.692308 | STEAP2 AND CLDN8 AND MEGF11 | 1 | 1 | 1 |
| BIRC5 AND NOT-MGST2 AND PMP22 | 0.818182 | 1 | 0.692308 | STEAP2 AND GPR19 AND MUC1 | 1 | 1 | 1 |
| BIRC5 AND NOT-SEMA4G AND PMP22 | 0.818182 | 1 | 0.692308 | STEAP2 AND NOT-CSPG4 AND PTGER4 | 1 | 1 | 1 |
| NOT-EPCAM AND BRCA1 AND OXGR1 | 0.818182 | 1 | 0.692308 | TRPM8 AND NOT-CSPG4 AND ABCA5 | 1 | 1 | 1 |
| SLC4A7 AND NOT-CCR6 AND NOT-EPCAM | 0.869565 | 1 | 0.769231 | TRPM8 AND NOT-DKK1 AND ABCA5 | 1 | 1 | 1 |
| BIRC5 AND NOT-F11R AND RTN4 | 0.818182 | 1 | 0.692308 | TRPM8 AND NOT-CSPG4 AND MUC1 | 1 | 1 | 1 |
| BIRC5 AND NOT-F11R AND SLC38A2 | 0.818182 | 1 | 0.692308 | STEAP2 AND CLDN8 AND NOT-CHRNA2 | 1 | 1 | 1 |
| BIRC5 AND NOT-F11R AND BCAP31 | 0.818182 | 1 | 0.692308 | STEAP2 AND NOT-DYSF AND ABCA5 | 1 | 1 | 1 |
| BIRC5 AND NOT-F11R AND NOT-SLAMF1 | 0.818182 | 1 | 0.692308 | STEAP2 AND NOT-CSPG4 AND F2R | 1 | 1 | 1 |
| BIRC5 AND NOT-F11R AND CLSTN1 | 0.818182 | 1 | 0.692308 | STEAP2 AND NOT-GYPC AND ABCA5 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| BIRC5 AND NOT-F11R AND VAPA | 0.818182 | 1 | 0.692308 | STEAP2 AND NOT-SLC39A2 AND FAP | 1 | 1 | 1 |
| VMP1 AND NOT-F11R AND NOT-FCRL5 | 0.833333 | 0.909091 | 0.769231 | STEAP2 AND NOT-DYSF AND MUC1 | 1 | 1 | 1 |
| VMP1 AND NOT-F11R AND NOT-ERBB4 | 0.833333 | 0.909091 | 0.769231 | STEAP2 AND NOT-DYSF AND VCAM1 | 1 | 1 | 1 |
| NOT-F11R AND ATP2A2 AND NOT-CLDN6 | 0.96 | 1 | 0.923077 | STEAP2 AND CLDN8 AND NOT-SLC5A2 | 1 | 1 | 1 |
| CD276 AND NOT-F11R AND NOT-ICAM4 | 0.818182 | 1 | 0.692308 | TRPM8 AND NOT-CSPG4 AND MUC1 | 1 | 1 | 1 |
| DDR2 AND NOT-GDPD2 AND CR2 | 0.818182 | 1 | 0.692308 | STEAP2 AND NOT-SLC4A8 AND WT1 | 0.888889 | 0.8 | 1 |
| BIRC5 AND NOT-F11R AND AQP4 | 0.818182 | 1 | 0.692308 | STEAP2 AND NOT-PAQR7 AND MUC1 | 1 | 1 | 1 |
| NOT-F11R AND CBX3 AND NOT-KCNA3 | 0.96 | 1 | 0.923077 | STEAP2 AND NOT-SLC4A8 AND ABCB5 | 0.888889 | 0.8 | 1 |
| BIRC5 AND NOT-MARVELD2 AND PMP22 | 0.818182 | 1 | 0.692308 | STEAP2 AND NOT-SLC4A8 AND P2RX5 | 0.888889 | 0.8 | 1 |
| NOT-F11R AND SLC10A3 AND NOT-CD22 | 0.916667 | 1 | 0.846154 | STEAP2 AND NOT-NCAM1 AND SLC17A1 | 0.888889 | 0.8 | 1 |
| BVES AND NOT-ITGB6 AND KIAA0754 | 0.857143 | 0.8 | 0.923077 | STEAP2 AND NOT-CD36 AND VCAM1 | 1 | 1 | 1 |
| VMP1 AND NOT-EPCAM AND ZNRF3 | 0.814815 | 0.785714 | 0.846154 | TRPM8 AND NOT-CSPG4 AND RNF43 | 0.888889 | 0.8 | 1 |
| NOT-F11R AND VANGL1 AND NOT-CLDN6 | 1 | 1 | 1 | STEAP2 AND NOT-SLC4A8 AND NOT-CSPG4 | 0.888889 | 0.8 | 1 |
| NOT-EPCAM AND VANGL1 AND NOT-ICAM4 | 0.962963 | 0.928571 | 1 | TRPM8 AND NOT-TNC AND GPNMB | 0.888889 | 0.8 | 1 |
| NOT-EPCAM AND VANGL1 AND NOT-TM4SF1 | 0.857143 | 0.8 | 0.923077 | STEAP2 AND NOT-EMP3 AND MUC1 | 0.888889 | 0.8 | 1 |
| NOT-RNF43 AND VANGL1 AND NOT-TSPAN3 | 0.888889 | 0.857143 | 0.923077 | STEAP2 AND NOT-DYSF AND RNF43 | 0.888889 | 0.8 | 1 |
| NOT-RNF43 AND VANGL1 AND GPR160 | 0.8 | 0.833333 | 0.769231 | TRPM8 AND NOT-NCAM1 AND NOT-IGF1R | 0.888889 | 0.8 | 1 |
| NOT-EPCAM AND VANGL1 AND NOT-CRHR1 | 0.896552 | 0.8125 | 1 | TRPM8 AND NOT-LGR5 AND IL2RA | 0.888889 | 0.8 | 1 |
| NOT-RNF43 AND VANGL1 AND NOT-S1PR4 | 0.923077 | 0.923077 | 0.923077 | STEAP2 AND BIRC5 AND NOT-GRIN2C | 0.888889 | 0.8 | 1 |
| NOT-RNF43 AND VANGL1 AND NPY5R | 0.88 | 0.916667 | 0.846154 | STEAP2 AND NOT-CD36 AND MUC1 | 1 | 1 | 1 |
| NOT-EPCAM AND VANGL1 AND NOT-AVPR2 | 0.928571 | 0.866667 | 1 | STEAP2 AND NOT-SLC22A18 AND CLDN8 | 1 | 1 | 1 |
| NOT-EPCAM AND VANGL1 AND NOT-DIO3 | 0.896552 | 0.8125 | 1 | STEAP2 AND SLC43A1 AND FAP | 1 | 1 | 1 |
| NOT-EPCAM AND VANGL1 AND NOT-PCDHA10 | 0.962963 | 0.928571 | 1 | STEAP2 AND NOT-NCAM1 AND SLC13A2 | 0.888889 | 0.8 | 1 |
| NOT-EPCAM AND VANGL1 AND NOT-CCR6 | 0.928571 | 0.866667 | 1 | STEAP2 AND NOT-SLC4A8 AND NOT-CSPG4 | 0.888889 | 0.8 | 1 |
| NOT-ERBB3 AND VANGL1 AND NOT-S1PR4 | 0.88 | 0.916667 | 0.846154 | STEAP2 AND NOT-GYPC AND GPNMB | 0.888889 | 0.8 | 1 |
| BIRC5 AND NOT-F11R AND FXYD6 | 0.818182 | 1 | 0.692308 | STEAP2 AND SLC2A2 AND NOT-LGR5 | 0.888889 | 0.8 | 1 |
| NOT-EPCAM AND VANGL1 AND NOT-GPR182 | 0.928571 | 0.866667 | 1 | STEAP2 AND NOT-NCAM1 AND SELP | 0.888889 | 0.8 | 1 |
| NOT-EPCAM AND VANGL1 AND IGSF6 | 0.814815 | 0.785714 | 0.846154 | STEAP2 AND BIRC5 AND CLDN8 | 1 | 1 | 1 |
| NOT-EPCAM AND VANGL1 AND NOT-NPY5R | 0.962963 | 0.928571 | 1 | STEAP2 AND CLDN8 AND NOT-DKK1 | 1 | 1 | 1 |
| NOT-SCNN1A AND VANGL1 AND NOT-CLDN6 | 0.923077 | 0.923077 | 0.923077 | STEAP2 AND CLDN8 AND NOT-DKK1 | 1 | 1 | 1 |
| ATP8B2 AND NOT-EREG AND NOT-CD22 | 0.869565 | 1 | 0.769231 | STEAP2 AND BIRC5 AND CLDN8 | 1 | 1 | 1 |
| NOT-F11R AND VANGL1 AND NOT-CD22 | 1 | 1 | 1 | STEAP2 AND CLDN8 AND NOT-TNC | 1 | 1 | 1 |
| BIRC5 AND NOT-GDPD2 AND CLDN20 | 0.818182 | 1 | 0.692308 | STEAP2 AND NOT-CSPG4 AND VCAM1 | 1 | 1 | 1 |
| NOT-F11R AND VANGL1 AND NOT-FCRL2 | 1 | 1 | 1 | STEAP2 AND NOT-DKK1 AND ABCA5 | 1 | 1 | 1 |
| ATP8B2 AND NOT-F11R AND NOT-CD22 | 0.869565 | 1 | 0.769231 | STEAP2 AND NOT-CSPG4 AND VCAM1 | 1 | 1 | 1 |
| NOT-ERBB3 AND VANGL1 AND NOT-ICAM4 | 0.88 | 0.916667 | 0.846154 | STEAP2 AND NOT-CSPG4 AND MUC1 | 1 | 1 | 1 |
| NOT-F11R AND VANGL1 AND NOT-CD79B | 0.962963 | 0.928571 | 1 | STEAP2 AND NOT-TNC AND MUC1 | 1 | 1 | 1 |
| NOT-F11R AND VANGL1 AND NOT-MSLN | 0.962963 | 0.928571 | 1 | STEAP2 AND NOT-TNC AND MUC1 | 1 | 1 | 1 |
| ATP8B2 AND NOT-F11R AND NOT-CLDN6 | 0.8 | 0.833333 | 0.769231 | STEAP2 AND NOT-CSPG4 AND MUC1 | 1 | 1 | 1 |
| NOT-F11R AND VANGL1 AND NOT-CLDN2 | 0.962963 | 0.928571 | 1 | STEAP2 AND NOT-CSPG4 AND ABCA5 | 1 | 1 | 1 |
| NOT-F11R AND VANGL1 AND NOT-ERBB4 | 1 | 1 | 1 | STEAP2 AND NOT-TNC AND VCAM1 | 1 | 1 | 1 |
| ATP8B2 AND NOT-F11R AND NOT-FCRL2 | 0.869565 | 1 | 0.769231 | STEAP2 AND NOT-TNC AND ABCA5 | 1 | 1 | 1 |
| BIRC5 AND NOT-F11R AND LRRTM4 | 0.818182 | 1 | 0.692308 | STEAP2 AND P2RX5 AND NOT-NCAM1 | 0.888889 | 0.8 | 1 |
| NOT-F11R AND CBX3 AND NOT-SORL1 | 0.923077 | 0.923077 | 0.923077 | STEAP2 AND CLDN8 AND WT1 | 1 | 1 | 1 |
| TGFBI AND NOT-F11R AND NOT-TNFRSF17 | 0.818182 | 1 | 0.692308 | STEAP2 AND NOT-NCAM1 AND SSTR1 | 0.888889 | 0.8 | 1 |
| NOT-CEACAM6 AND VANGL1 AND NOT-TSPAN3 | 0.827586 | 0.75 | 0.923077 | STEAP2 AND NOT-NCAM1 AND CD160 | 0.888889 | 0.8 | 1 |
| BIRC5 AND NOT-F11R AND PAQR7 | 0.818182 | 1 | 0.692308 | STEAP2 AND BIRC5 AND NOT-LGR5 | 0.888889 | 0.8 | 1 |
| ATP8B2 AND NOT-FCRL2 AND NOT-TM7SF2 | 0.869565 | 1 | 0.769231 | COMPLEX-EDNRB/STEAP2/P2RX5 | 0.888889 | 0.8 | 1 |
| BIRC5 AND NOT-F11R AND SLC13A1 | 0.818182 | 1 | 0.692308 | STEAP2 AND NOT-NCAM1 AND NOT-IGF1R | 0.888889 | 0.8 | 1 |
| NOT-F11R AND VANGL1 AND NOT-LGR5 | 0.869565 | 1 | 0.769231 | STEAP2 AND BIRC5 AND NOT-LGR5 | 0.888889 | 0.8 | 1 |
| ATP8B2 AND NOT-FCRL2 AND NOT-PERP | 0.869565 | 1 | 0.769231 | STEAP2 AND NOT-CSPG4 AND GPNMB | 0.888889 | 0.8 | 1 |
| ATP8B2 AND NOT-FCRL2 AND NOT-TACSTD2 | 0.869565 | 1 | 0.769231 | COMPLEX-EDNRB/STEAP2/SSTR1 | 0.888889 | 0.8 | 1 |
| ATP8B2 AND NOT-FCRL2 AND NOT-MGST2 | 0.869565 | 1 | 0.769231 | STEAP2 AND BIRC5 AND NOT-NCAM1 | 0.888889 | 0.8 | 1 |
| NOT-ERBB3 AND CEACAM7 AND PMP22 | 0.818182 | 1 | 0.692308 | STEAP2 AND NOT-TNC AND GPNMB | 0.888889 | 0.8 | 1 |
| NOT-F11R AND VANGL1 AND NOT-CLDN18 | 0.962963 | 0.928571 | 1 | STEAP2 AND NOT-CSPG4 AND RNF43 | 0.888889 | 0.8 | 1 |
| NOT-EPCAM AND BRCA1 AND SLC13A1 | 0.818182 | 1 | 0.692308 | STEAP2 AND NOT-TNC AND RNF43 | 0.888889 | 0.8 | 1 |
| NOT-F11R AND VANGL1 AND NOT-KDR | 0.888889 | 0.857143 | 0.923077 | STEAP2 AND NOT-NCAM1 AND MOK | 0.888889 | 0.8 | 1 |
| NOT-CEACAM6 AND VANGL1 AND NOT-ABCB8 | 0.827586 | 0.75 | 0.923077 | STEAP2 AND IL2RA AND NOT-LGR5 | 0.888889 | 0.8 | 1 |
| NOT-SCNN1B AND VANGL1 AND NOT-CLDN6 | 0.923077 | 0.923077 | 0.923077 | STEAP2 AND NOT-DKK1 AND RNF43 | 0.888889 | 0.8 | 1 |
| BIRC5 AND NOT-F11R AND SCN2A | 0.818182 | 1 | 0.692308 | STEAP2 AND NOT-CSPG4 AND CLDN8 | 1 | 1 | 1 |
| BIRC5 AND NOT-F11R AND OPRK1 | 0.818182 | 1 | 0.692308 | STEAP2 AND CLDN8 AND NOT-KDR | 1 | 1 | 1 |
| BIRC5 AND NOT-F11R AND KCND2 | 0.818182 | 1 | 0.692308 | STEAP2 AND CLDN8 AND ABCB5 | 1 | 1 | 1 |
| BIRC5 AND NOT-F11R AND NOT-GABRB1 | 0.818182 | 1 | 0.692308 | STEAP2 AND NOT-CSPG4 AND CLDN8 | 1 | 1 | 1 |
| BIRC5 AND NOT-F11R AND NOT-KCNK12 | 0.818182 | 1 | 0.692308 | STEAP2 AND BIRC5 AND TRPM4 | 1 | 1 | 1 |
| BIRC5 AND NOT-F11R AND ATP13A5 | 0.818182 | 1 | 0.692308 | STEAP2 AND NOT-DKK1 AND GPNMB | 0.888889 | 0.8 | 1 |
| NOT-CRB3 AND VANGL1 AND NOT-CLDN6 | 0.923077 | 0.923077 | 0.923077 | STEAP2 AND CLDN8 AND FAP | 1 | 1 | 1 |
| ATP8B2 AND NOT-COL17A1 AND NOT-CD22 | 0.869565 | 1 | 0.769231 | STEAP2 AND NOT-TNC AND IL13RA1 | 0.888889 | 0.8 | 1 |
| NOT-F11R AND VANGL1 AND NOT-SSTR5 | 0.962963 | 0.928571 | 1 | STEAP2 AND NOT-DKK1 AND IL13RA1 | 0.888889 | 0.8 | 1 |
| ATP8B2 AND NOT-KIAA1324 AND NOT-CLDN1 | 0.8 | 0.833333 | 0.769231 | STEAP2 AND P2RX5 AND VCAM1 | 1 | 1 | 1 |
| NOT-ERBB3 AND VANGL1 AND NOT-CRHR1 | 0.846154 | 0.846154 | 0.846154 | STEAP2 AND NOT-DKK1 AND VCAM1 | 1 | 1 | 1 |
| BIRC5 AND NOT-GDPD2 AND PHLDB2 | 0.818182 | 1 | 0.692308 | STEAP2 AND CLDN8 AND FAP | 1 | 1 | 1 |
| BIRC5 AND NOT-F11R AND CYP4A11 | 0.818182 | 1 | 0.692308 | STEAP2 AND P2RX5 AND MUC1 | 1 | 1 | 1 |
| BIRC5 AND NOT-F11R AND SLC39A12 | 0.818182 | 1 | 0.692308 | STEAP2 AND P2RX5 AND MUC1 | 1 | 1 | 1 |
| BIRC5 AND NOT-F11R AND HCN2 | 0.818182 | 1 | 0.692308 | STEAP2 AND P2RX5 AND GPNMB | 0.888889 | 0.8 | 1 |
| BIRC5 AND NOT-F11R AND ASTN1 | 0.818182 | 1 | 0.692308 | STEAP2 AND NOT-DKK1 AND MUC1 | 0.888889 | 0.8 | 1 |
| BIRC5 AND NOT-F11R AND GUCY2F | 0.818182 | 1 | 0.692308 | STEAP2 AND NOT-DKK1 AND MUC1 | 0.888889 | 0.8 | 1 |
| BIRC5 AND NOT-F11R AND GABRA4 | 0.818182 | 1 | 0.692308 | STEAP2 AND NOT-DKK1 AND VCAM1 | 1 | 1 | 1 |

FIG. 15 (cont.)

| Antigen Pair Logic | F1 | Precision | Recall | Antigen Pair Logic | F1 | Precision | Recall |
|---|---|---|---|---|---|---|---|
| TGFBI AND NOT-F11R AND KDR | 0.818182 | 1 | 0.692308 | COMPLEX-CBX3/STEAP2/IGF1R | 1 | 1 | 1 |
| BIRC5 AND NOT-F11R AND SLC17A3 | 0.818182 | 1 | 0.692308 | STEAP2 AND CLDN8 AND NOT-CLDN5 | 1 | 1 | 1 |
| BIRC5 AND NOT-F11R AND GJD2 | 0.818182 | 1 | 0.692308 | STEAP2 AND P2RX5 AND VCAM1 | 1 | 1 | 1 |
| BIRC5 AND NOT-F11R AND SLCO1A2 | 0.818182 | 1 | 0.692308 | STEAP2 AND NOT-DKK1 AND IL13RA1 | 0.888889 | 0.8 | 1 |
| BIRC5 AND NOT-F11R AND NOT-MTNR1B | 0.818182 | 1 | 0.692308 | COMPLEX-FAP/STEAP2/CLDN5 | 0.888889 | 0.8 | 1 |
| BIRC5 AND NOT-F11R AND SLC6A11 | 0.818182 | 1 | 0.692308 | STEAP2 AND NOT-TNC AND IL13RA1 | 0.888889 | 0.8 | 1 |
| ATP8B2 AND NOT-GDPD2 AND NOT-TNFRSF17 | 0.833333 | 0.909091 | 0.769231 | STEAP2 AND NOT-ERBB4 AND CLDN8 | 0.857143 | 1 | 0.75 |
| BIRC5 AND NOT-F11R AND KDR | 0.818182 | 1 | 0.692308 | STEAP2 AND CLDN8 AND NOT-DDX3X | 0.857143 | 1 | 0.75 |
| BIRC5 AND NOT-ITGB6 AND CDH5 | 0.818182 | 1 | 0.692308 | STEAP2 AND CLDN8 AND CLDN6 | 1 | 1 | 1 |
| BIRC5 AND NOT-F11R AND NOT-CD79B | 0.818182 | 1 | 0.692308 | STEAP2 AND EPCAM AND FAP | 0.857143 | 1 | 0.75 |
| BIRC5 AND NOT-EPCAM AND TMPRSS5 | 0.818182 | 1 | 0.692308 | STEAP2 AND NOT-EDNRB AND CLDN8 | 0.857143 | 1 | 0.75 |
| BIRC5 AND NOT-EPCAM AND SLC5A7 | 0.818182 | 1 | 0.692308 | STEAP2 AND CLDN8 AND NOT-SLC7A5 | 0.857143 | 1 | 0.75 |
| BIRC5 AND NOT-EPCAM AND CDH5 | 0.818182 | 1 | 0.692308 | STEAP2 AND CLDN8 AND NOT-ANXA1 | 0.857143 | 1 | 0.75 |
| BIRC5 AND NOT-EPCAM AND EQTN | 0.818182 | 1 | 0.692308 | STEAP2 AND NOT-TPBG AND CLDN8 | 0.857143 | 1 | 0.75 |
| BIRC5 AND NOT-EPCAM AND EMP1 | 0.818182 | 1 | 0.692308 | STEAP2 AND CLDN8 AND NOT-IL13RA1 | 0.857143 | 1 | 0.75 |
| BIRC5 AND NOT-EPCAM AND FZD7 | 0.818182 | 1 | 0.692308 | STEAP2 AND NOT-B4GALNT1 AND SSTR1 | 0.857143 | 1 | 0.75 |
| BIRC5 AND NOT-EPCAM AND PCDHAC1 | 0.818182 | 1 | 0.692308 | STEAP2 AND NOT-B4GALNT1 AND CLDN23 | 0.857143 | 1 | 0.75 |
| BIRC5 AND NOT-F11R AND NOT-MS4A1 | 0.818182 | 1 | 0.692308 | STEAP2 AND NOT-B4GALNT1 AND NOT-IGF1R | 0.857143 | 1 | 0.75 |
| BIRC5 AND NOT-EPCAM AND ZNRF3 | 0.818182 | 1 | 0.692308 | STEAP2 AND NOT-NCAM1 AND NOT-HSPA5 | 0.888889 | 0.8 | 1 |
| BIRC5 AND NOT-ITGB6 AND PMP22 | 0.818182 | 1 | 0.692308 | STEAP2 AND NOT-B4GALNT1 AND MOK | 0.857143 | 1 | 0.75 |
| BIRC5 AND NOT-ITGB6 AND EMP2 | 0.818182 | 1 | 0.692308 | STEAP2 AND EPCAM AND LGR5 | 0.857143 | 1 | 0.75 |
| BIRC5 AND NOT-F11R AND NOT-CD22 | 0.818182 | 1 | 0.692308 | STEAP2 AND P2RX5 AND NOT-DPEP1 | 0.857143 | 1 | 0.75 |
| BIRC5 AND NOT-F11R AND NOT-FCRL5 | 0.818182 | 1 | 0.692308 | STEAP2 AND NOT-EDNRB AND EPHA3 | 0.857143 | 1 | 0.75 |
| BIRC5 AND NOT-F11R AND NOT-FCRL1 | 0.818182 | 1 | 0.692308 | STEAP2 AND NOT-FLOT2 AND VCAM1 | 0.857143 | 1 | 0.75 |
| BIRC5 AND NOT-EPCAM AND NOT-CCR6 | 0.818182 | 1 | 0.692308 | COMPLEX-STEAP2/EPCAM/VCAM1 | 0.857143 | 1 | 0.75 |
| BIRC5 AND NOT-ITGB6 AND CD151 | 0.818182 | 1 | 0.692308 | STEAP2 AND NOT-NCAM1 AND VCAM1 | 1 | 1 | 1 |
| BIRC5 AND NOT-EREG AND NOT-CLDN6 | 0.818182 | 1 | 0.692308 | STEAP2 AND NOT-PCYT1A AND VCAM1 | 0.857143 | 1 | 0.75 |
| NOT-EPCAM AND BRCA1 AND KDR | 0.818182 | 1 | 0.692308 | STEAP2 AND NOT-CLDN12 AND VCAM1 | 0.857143 | 1 | 0.75 |
| BIRC5 AND NOT-MGST2 AND IL13RA1 | 0.818182 | 1 | 0.692308 | STEAP2 AND NOT-CD34 AND VCAM1 | 0.857143 | 1 | 0.75 |
| BIRC5 AND NOT-F11R AND MSLN | 0.818182 | 1 | 0.692308 | STEAP2 AND ABCB5 AND MUC1 | 1 | 1 | 1 |
| BIRC5 AND NOT-GDPD2 AND NOT-P2RX5 | 0.818182 | 1 | 0.692308 | COMPLEX-STEAP2/EPCAM/SSTR1 | 0.857143 | 1 | 0.75 |
| BIRC5 AND NOT-F11R AND NOT-FCRL2 | 0.818182 | 1 | 0.692308 | COMPLEX-STEAP2/IL11RA/EPCAM | 0.857143 | 1 | 0.75 |
| BIRC5 AND NOT-MGST2 AND NOT-FCRL2 | 0.818182 | 1 | 0.692308 | STEAP2 AND NOT-B4GALNT1 AND TNFRSF10A | 0.857143 | 1 | 0.75 |
| NOT-F11R AND CBX3 AND KDR | 0.96 | 1 | 0.923077 | COMPLEX-CD160/STEAP2/EPCAM | 0.857143 | 1 | 0.75 |
| NOT-EPCAM AND CBX3 AND NOT-CD40LG | 0.962963 | 0.928571 | 1 | COMPLEX-STEAP2/HLA-DOB/EPCAM | 0.857143 | 1 | 0.75 |
| BIRC5 AND NOT-F11R AND SSTR5 | 0.818182 | 1 | 0.692308 | STEAP2 AND NOT-SLC7A5 AND MUC1 | 0.857143 | 1 | 0.75 |
| BIRC5 AND NOT-COL17A1 AND NOT-P2RX5 | 0.818182 | 1 | 0.692308 | STEAP2 AND WT1 AND NOT-LGR5 | 0.888889 | 0.8 | 1 |
| NOT-F11R AND CBX3 AND NOT-CD79B | 0.96 | 1 | 0.923077 | STEAP2 AND EPCAM AND NOT-HSPA5 | 0.857143 | 1 | 0.75 |
| BIRC5 AND NOT-GDPD2 AND KDR | 0.818182 | 1 | 0.692308 | STEAP2 AND ABCB5 AND NOT-LGR5 | 0.888889 | 0.8 | 1 |
| BIRC5 AND NOT-MST1R AND CDH5 | 0.818182 | 1 | 0.692308 | STEAP2 AND NOT-B4GALNT1 AND CD160 | 0.857143 | 1 | 0.75 |
| CD276 AND NOT-GDPD2 AND CR2 | 0.818182 | 1 | 0.692308 | STEAP2 AND EPCAM AND NOT-IGF1R | 0.857143 | 1 | 0.75 |
| CBX3 AND NOT-ITGB6 AND CDH5 | 0.923077 | 0.923077 | 0.923077 | STEAP2 AND CLDN8 AND NOT-DPEP1 | 0.857143 | 1 | 0.75 |
| NOT-F11R AND CBX3 AND NOT-CD22 | 0.96 | 1 | 0.923077 | STEAP2 AND NOT-ANXA1 AND VCAM1 | 0.857143 | 1 | 0.75 |
| NOT-EPCAM AND CBX3 AND ZNRF3 | 1 | 1 | 1 | STEAP2 AND NOT-NCAM1 AND TNFRSF10A | 0.888889 | 0.8 | 1 |
| BIRC5 AND NOT-F11R AND NOT-CLDN6 | 0.818182 | 1 | 0.692308 | STEAP2 AND CLDN8 AND NOT-CLDN12 | 0.857143 | 1 | 0.75 |
| BIRC5 AND NOT-GDPD2 AND NOT-CD79A | 0.818182 | 1 | 0.692308 | STEAP2 AND NOT-PCYT1A AND MUC1 | 0.857143 | 1 | 0.75 |
| BIRC5 AND NOT-EREG AND NOT-CD22 | 0.818182 | 1 | 0.692308 | STEAP2 AND NOT-B4GALNT1 AND MUC1 | 0.857143 | 1 | 0.75 |
| BIRC5 AND NOT-F11R AND NOT-TNFRSF17 | 0.818182 | 1 | 0.692308 | TRPM8 AND NOT-SLC39A2 AND SLCO1A2 | 1 | 1 | 1 |
| NOT-ERBB3 AND ITGB5 AND MSLN | 0.814815 | 0.785714 | 0.846154 | TRPM8 AND NOT-SLC39A2 AND GPR19 | 1 | 1 | 1 |
| NOT-EPCAM AND CBX3 AND CDH5 | 1 | 1 | 1 | TRPM8 AND NOT-IL17RA AND SLC43A1 | 1 | 1 | 1 |
| NOT-F11R AND CBX3 AND NOT-FCRL2 | 0.96 | 1 | 0.923077 | TRPM8 AND NOT-SLC39A2 AND EPHA10 | 1 | 1 | 1 |
| NOT-EPCAM AND CBX3 AND NOT-CCR6 | 1 | 1 | 1 | TRPM8 AND SLCO1A2 AND NOT-FMNL1 | 1 | 1 | 1 |
| COMPLEX-FGFR1/CLDN1/CD79B | 0.818182 | 1 | 0.692308 | TRPM8 AND NOT-SLC39A2 AND NOT-IL17RA | 1 | 1 | 1 |
| BIRC5 AND NOT-MST1R AND GPR84 | 0.818182 | 1 | 0.692308 | TRPM8 AND NOT-SLC39A2 AND NOT-GUCY2D | 1 | 1 | 1 |
| BIRC5 AND NOT-F11R AND LGR5 | 0.818182 | 1 | 0.692308 | TRPM8 AND NOT-SLC39A2 AND NOT-CHRNA2 | 1 | 1 | 1 |
| SLC4A7 AND NOT-CD79A AND NOT-MST1R | 0.833333 | 0.909091 | 0.769231 | TRPM8 AND NOT-SLC39A2 AND NOT-EPHA2 | 1 | 1 | 1 |
| NOT-F11R AND VANGL1 AND NOT-PAQR7 | 0.827586 | 0.75 | 0.923077 | TRPM8 AND NOT-SLC39A2 AND NOT-CHRNA2 | 1 | 1 | 1 |
| NOT-F11R AND VANGL1 AND NOT-SLC6A11 | 0.916667 | 1 | 0.846154 | TRPM8 AND NOT-SLC39A2 AND MEGF11 | 1 | 1 | 1 |
| NOT-F11R AND VANGL1 AND NOT-SLC5A11 | 0.962963 | 0.928571 | 1 | TRPM8 AND NOT-GYPC AND PTGER4 | 1 | 1 | 1 |
| NOT-F11R AND VANGL1 AND NOT-MTNR1B | 1 | 1 | 1 | TRPM8 AND SLCO1A2 AND NOT-FMNL1 | 1 | 1 | 1 |
| NOT-F11R AND VANGL1 AND NOT-ATP13A5 | 0.96 | 1 | 0.923077 | TRPM8 AND NOT-GYPC AND F2R | 1 | 1 | 1 |
| NOT-F11R AND VANGL1 AND NOT-SLC1A6 | 1 | 1 | 1 | TRPM8 AND NOT-SLC39A2 AND NOT-GUCY2D | 1 | 1 | 1 |
| NOT-F11R AND VANGL1 AND NOT-SELP | 0.896552 | 0.8125 | 1 | TRPM8 AND NOT-FMNL1 AND GPR19 | 1 | 1 | 1 |
| NOT-F11R AND VANGL1 AND NOT-GRIN1 | 0.962963 | 0.928571 | 1 | TRPM8 AND NOT-SLC39A2 AND NOT-EBP | 1 | 1 | 1 |
| NOT-F11R AND VANGL1 AND NOT-GUCY2F | 0.962963 | 0.928571 | 1 | TRPM8 AND NOT-SLC39A2 AND NOT-EPHA2 | 1 | 1 | 1 |
| NOT-F11R AND VANGL1 AND NOT-HRH3 | 0.962963 | 0.928571 | 1 | TRPM8 AND NOT-SLC39A2 AND NOT-PTGER4 | 1 | 1 | 1 |
| NOT-F11R AND VANGL1 AND NOT-WNT7A | 0.869565 | 1 | 0.769231 | TRPM8 AND NOT-GYPC AND SLC43A1 | 1 | 1 | 1 |
| NOT-F11R AND VANGL1 AND NOT-ABCG8 | 0.962963 | 0.928571 | 1 | TRPM8 AND NOT-GUCY2D AND SLC43A1 | 1 | 1 | 1 |
| NOT-F11R AND VANGL1 AND NOT-KCNQ2 | 1 | 1 | 1 | COMPLEX-SLC5A2/TRPM8/SLC16A5 | 1 | 1 | 1 |
| NOT-F11R AND VANGL1 AND NOT-GPR6 | 0.916667 | 1 | 0.846154 | TRPM8 AND NOT-FMNL1 AND EPHA10 | 1 | 1 | 1 |
| NOT-F11R AND VANGL1 AND NOT-KCNA10 | 0.962963 | 0.928571 | 1 | TRPM8 AND NOT-SYT4 AND SLC43A1 | 1 | 1 | 1 |
| NOT-F11R AND VANGL1 AND NOT-SEZ6 | 0.962963 | 0.928571 | 1 | TRPM8 AND NOT-SLC22A18 AND NOT-SLC39A2 | 1 | 1 | 1 |
| NOT-F11R AND VANGL1 AND NOT-DGKE | 0.896552 | 0.8125 | 1 | TRPM8 AND NOT-CHRNA2 AND SLC43A1 | 1 | 1 | 1 |
| NOT-F11R AND VANGL1 AND NOT-KIAA0319 | 0.962963 | 0.928571 | 1 | TRPM8 AND NOT-SLC39A2 AND NOT-ANPEP | 1 | 1 | 1 |
| NOT-F11R AND VANGL1 AND NOT-OR8D1 | 0.962963 | 0.928571 | 1 | TRPM8 AND NOT-SLC39A2 AND NOT-CD36 | 1 | 1 | 1 |
| TGFBI AND NOT-F11R AND SLCO1A2 | 0.818182 | 1 | 0.692308 | TRPM8 AND NOT-DYSF AND SLC43A1 | 1 | 1 | 1 |
| NOT-F11R AND VANGL1 AND NOT-FGF6 | 0.962963 | 0.928571 | 1 | TRPM8 AND NOT-SLC4A8 AND NOT-ANPEP | 1 | 1 | 1 |

FIG. 15 (cont.)

| Antigen Pair Logic | F1 | Precision | Recall |
|---|---|---|---|
| NOT-F11R AND VANGL1 AND NOT-SV2C | 1 | 1 | 1 |
| NOT-F11R AND VANGL1 AND NOT-IGDCC3 | 0.869565 | 1 | 0.769231 |
| NOT-F11R AND VANGL1 AND NOT-ADCY8 | 0.962963 | 0.928571 | 1 |
| NOT-F11R AND VANGL1 AND NOT-MC2R | 1 | 1 | 1 |
| NOT-F11R AND VANGL1 AND NOT-HTR1E | 1 | 1 | 1 |
| NOT-F11R AND VANGL1 AND NOT-SLC22A6 | 0.962963 | 0.928571 | 1 |
| NOT-F11R AND VANGL1 AND NOT-CACNG6 | 0.96 | 1 | 0.923077 |
| NOT-F11R AND VANGL1 AND NOT-LRRN4 | 0.962963 | 0.928571 | 1 |
| NOT-F11R AND VANGL1 AND NOT-HCN2 | 0.88 | 0.916667 | 0.846154 |
| NOT-F11R AND VANGL1 AND NOT-MLC1 | 0.962963 | 0.928571 | 1 |
| NOT-F11R AND VANGL1 AND NOT-SLC22A11 | 1 | 1 | 1 |
| NOT-F11R AND VANGL1 AND NOT-LYPD1 | 0.923077 | 0.923077 | 0.923077 |
| NOT-F11R AND VANGL1 AND NOT-GPR37L1 | 0.962963 | 0.928571 | 1 |
| NOT-ADRA2A AND VANGL1 AND MLANA | 0.869565 | 1 | 0.769231 |
| NOT-F11R AND VANGL1 AND NOT-CRB2 | 0.96 | 1 | 0.923077 |
| NOT-F11R AND VANGL1 AND NOT-RXFP3 | 0.962963 | 0.928571 | 1 |
| ATP8B2 AND NOT-F11R AND NOT-DGKE | 0.8 | 0.833333 | 0.769231 |
| NOT-F11R AND VANGL1 AND NOT-SLC1A2 | 0.833333 | 0.909091 | 0.769231 |
| NOT-F11R AND VANGL1 AND NOT-FXYD7 | 0.962963 | 0.928571 | 1 |
| NOT-F11R AND VANGL1 AND NOT-CACNA1S | 0.88 | 0.916667 | 0.846154 |
| NOT-F11R AND VANGL1 AND NOT-CACNG7 | 0.96 | 1 | 0.923077 |
| NOT-F11R AND VANGL1 AND NOT-CLCN1 | 0.962963 | 0.928571 | 1 |
| NOT-F11R AND VANGL1 AND NOT-MAG | 0.962963 | 0.928571 | 1 |
| NOT-F11R AND VANGL1 AND NOT-ZP4 | 0.923077 | 0.923077 | 0.923077 |
| NOT-F11R AND VANGL1 AND NOT-GABRA4 | 1 | 1 | 1 |
| NOT-F11R AND VANGL1 AND NOT-CLCN1 | 0.962963 | 0.928571 | 1 |
| EMP3 AND NOT-MLANA AND VANGL1 | 0.869565 | 1 | 0.769231 |
| ATP8B2 AND NOT-MLC1 AND CYP4A11 | 0.833333 | 0.909091 | 0.769231 |
| NOT-SMPD2 AND VANGL1 AND LRRN4 | 0.869565 | 1 | 0.769231 |
| ATP8B2 AND NOT-MLC1 AND SV2C | 0.833333 | 0.909091 | 0.769231 |
| ATP8B2 AND NOT-GUCY2F AND VANGL1 | 0.869565 | 1 | 0.769231 |
| ATP8B2 AND NOT-SLC39A2 AND VANGL1 | 0.869565 | 1 | 0.769231 |
| GYPC AND VANGL1 AND NOT-GRIN1 | 0.833333 | 0.909091 | 0.769231 |
| NOT-ATP8A1 AND LRRN4 AND NOT-SV2C | 0.8 | 0.833333 | 0.769231 |
| NOT-SORL1 AND VANGL1 AND NOT-SLC39A2 | 0.869565 | 1 | 0.769231 |
| ATP8B2 AND NOT-GPR12 AND VANGL1 | 0.833333 | 0.909091 | 0.769231 |
| GYPC AND VANGL1 AND NOT-KCNA10 | 0.88 | 0.916667 | 0.846154 |
| PHLDB2 AND NOT-SLC39A2 AND VANGL1 | 0.928571 | 0.866667 | 1 |
| GYPC AND VANGL1 AND NOT-CLCN1 | 0.88 | 0.916667 | 0.846154 |
| GYPC AND VANGL1 AND NOT-GPR12 | 0.88 | 0.916667 | 0.846154 |
| GYPC AND VANGL1 AND NOT-SLC13A5 | 0.88 | 0.916667 | 0.846154 |
| PHLDB2 AND NOT-MLANA AND VANGL1 | 0.818182 | 1 | 0.692308 |
| GYPC AND VANGL1 AND NOT-SLC39A2 | 0.88 | 0.916667 | 0.846154 |
| EMP3 AND NOT-GPR12 AND VANGL1 | 0.88 | 0.916667 | 0.846154 |
| NOT-EPCAM AND VANGL1 AND CLDN20 | 0.962963 | 0.928571 | 1 |
| NOT-EPCAM AND VANGL1 AND NOT-KCNA10 | 0.896552 | 0.8125 | 1 |
| NOT-EPCAM AND VANGL1 AND NOT-GRIN1 | 0.896552 | 0.8125 | 1 |
| NOT-EPCAM AND VANGL1 AND NOT-CLCN1 | 0.896552 | 0.8125 | 1 |
| NOT-EPCAM AND VANGL1 AND NOT-HRH3 | 0.896552 | 0.8125 | 1 |
| NOT-EPCAM AND VANGL1 AND NOT-GUCY2F | 0.896552 | 0.8125 | 1 |
| NOT-ERBB3 AND VANGL1 AND NOT-HRH3 | 0.846154 | 0.846154 | 0.846154 |
| NOT-ERBB3 AND VANGL1 AND NOT-GRIN1 | 0.846154 | 0.846154 | 0.846154 |
| NOT-ERBB3 AND VANGL1 AND NOT-KCNA10 | 0.846154 | 0.846154 | 0.846154 |
| NOT-ERBB3 AND VANGL1 AND NOT-GUCY2F | 0.846154 | 0.846154 | 0.846154 |
| NOT-CEACAM6 AND VANGL1 AND NOT-LRRN4 | 0.888889 | 0.857143 | 0.923077 |
| BIRC5 AND NOT-MLC1 AND CYP4A11 | 0.818182 | 1 | 0.692308 |
| NOT-ERBB3 AND VANGL1 AND NOT-CLCN1 | 0.846154 | 0.846154 | 0.846154 |
| NOT-ERBB3 AND VANGL1 AND NOT-SLC13A5 | 0.846154 | 0.846154 | 0.846154 |
| ATP8B2 AND NOT-FCRL2 AND NOT-SLC22A18 | 0.869565 | 1 | 0.769231 |
| ATP8B2 AND NOT-CD79B AND NOT-SLC13A1 | 0.833333 | 0.909091 | 0.769231 |
| NOT-CEACAM6 AND VANGL1 AND NOT-GRIN1 | 0.827586 | 0.75 | 0.923077 |
| NOT-ERBB3 AND VANGL1 AND NOT-SLC22A11 | 0.846154 | 0.846154 | 0.846154 |
| BIRC5 AND NOT-MLC1 AND NOT-SLC22A18 | 0.818182 | 1 | 0.692308 |
| NOT-CEACAM6 AND VANGL1 AND SLC13A5 | 0.827586 | 0.75 | 0.923077 |
| NOT-CEACAM6 AND VANGL1 AND GPR12 | 0.814815 | 0.785714 | 0.846154 |
| NOT-ERBB3 AND VANGL1 AND SLC39A2 | 0.869565 | 1 | 0.769231 |
| NOT-CEACAM6 AND VANGL1 AND GUCY2F | 0.827586 | 0.75 | 0.923077 |
| NOT-CEACAM6 AND VANGL1 AND NOT-SLC22A11 | 0.888889 | 0.857143 | 0.923077 |
| ATP8B2 AND NOT-CD79A AND NOT-KIAA0319 | 0.833333 | 0.909091 | 0.769231 |
| NOT-CLDN4 AND VANGL1 AND NOT-GRIN1 | 0.888889 | 0.857143 | 0.923077 |
| ATP8B2 AND NOT-KIAA0319 AND NOT-P2RX5 | 0.833333 | 0.909091 | 0.769231 |
| BIRC5 AND NOT-MLC1 AND SLC13A1 | 0.818182 | 1 | 0.692308 |
| NOT-CLDN4 AND VANGL1 AND NOT-HRH3 | 0.888889 | 0.857143 | 0.923077 |
| NOT-CLDN4 AND VANGL1 AND NOT-GUCY2F | 0.888889 | 0.857143 | 0.923077 |
| NOT-CLDN4 AND VANGL1 AND NOT-KCNA10 | 0.888889 | 0.857143 | 0.923077 |
| NOT-CLDN4 AND VANGL1 AND NOT-CLCN1 | 0.888889 | 0.857143 | 0.923077 |
| NOT-SMPD2 AND VANGL1 AND CLDN18 | 0.818182 | 1 | 0.692308 |

| Antigen Pair Logic | F1 | Precision | Recall |
|---|---|---|---|
| TRPM8 AND NOT-SLC5A2 AND SLC43A1 | 1 | 1 | 1 |
| TRPM8 AND NOT-SLC39A2 AND SLCO6A1 | 1 | 1 | 1 |
| TRPM8 AND NOT-SLC39A2 AND NOT-SEMA4D | 1 | 1 | 1 |
| TRPM8 AND NOT-SLC39A2 AND NOT-STAB1 | 1 | 1 | 1 |
| TRPM8 AND NOT-SLC39A2 AND NOT-TNFRSF12A | 1 | 1 | 1 |
| TRPM8 AND NOT-SLC39A2 AND NOT-STAB1 | 1 | 1 | 1 |
| TRPM8 AND NOT-SLC39A2 AND PCDHA9 | 1 | 1 | 1 |
| TRPM8 AND NOT-IL17RA AND F2R | 1 | 1 | 1 |
| TRPM8 AND NOT-SLC39A2 AND TMPRSS11D | 1 | 1 | 1 |
| TRPM8 AND NOT-SLC39A2 AND NPHS1 | 1 | 1 | 1 |
| TRPM8 AND NOT-SLC39A2 AND NOT-GABRA1 | 1 | 1 | 1 |
| TRPM8 AND NOT-SLC39A2 AND NMBR | 1 | 1 | 1 |
| TRPM8 AND NOT-SYT4 AND NOT-FMNL1 | 1 | 1 | 1 |
| TRPM8 AND NOT-FMNL1 AND SLC2A2 | 1 | 1 | 1 |
| TRPM8 AND NOT-SLC39A2 AND NOT-TNFRSF12A | 1 | 1 | 1 |
| TRPM8 AND NOT-SLC39A2 AND NOT-GABRA1 | 1 | 1 | 1 |
| TRPM8 AND NOT-SLC39A2 AND TMEM235 | 1 | 1 | 1 |
| TRPM8 AND NOT-SLC39A2 AND RGSL1 | 1 | 1 | 1 |
| TRPM8 AND NOT-SLC39A2 AND NPHS2 | 1 | 1 | 1 |
| TRPM8 AND NOT-SLC39A2 AND ADAM2 | 1 | 1 | 1 |
| TRPM8 AND NOT-SLC39A2 AND NOT-SLC5A2 | 1 | 1 | 1 |
| TRPM8 AND NOT-DYSF AND PTGER4 | 1 | 1 | 1 |
| TRPM8 AND NOT-SLC39A2 AND CACNG7 | 1 | 1 | 1 |
| TRPM8 AND NOT-SLC39A2 AND SLC2A2 | 1 | 1 | 1 |
| TRPM8 AND NOT-SLC39A2 AND UMODL1 | 1 | 1 | 1 |
| TRPM8 AND NOT-SLC39A2 AND NOT-SLC5A2 | 1 | 1 | 1 |
| TRPM8 AND NOT-EPHA2 AND F2R | 1 | 1 | 1 |
| TRPM8 AND NOT-SLC39A2 AND NOT-SHISA9 | 1 | 1 | 1 |
| TRPM8 AND NOT-GYPC AND NOT-SLC39A2 | 0.888889 | 0.8 | 1 |
| TRPM8 AND NOT-SLC4A8 AND NMBR | 0.888889 | 0.8 | 1 |
| TRPM8 AND NOT-SYT4 AND FLVCR1 | 0.888889 | 0.8 | 1 |
| TRPM8 AND NOT-SLC4A8 AND USH2A | 0.888889 | 0.8 | 1 |
| TRPM8 AND NOT-GYPC AND CD93 | 0.888889 | 0.8 | 1 |
| TRPM8 AND NOT-SLC4A8 AND SLC2A2 | 0.888889 | 0.8 | 1 |
| TRPM8 AND NOT-SLC4A8 AND EPHA10 | 0.888889 | 0.8 | 1 |
| TRPM8 AND NOT-EPHA2 AND SLC43A1 | 1 | 1 | 1 |
| TRPM8 AND NOT-SLC4A8 AND NOT-GUCY2D | 0.888889 | 0.8 | 1 |
| TRPM8 AND NOT-GRIN2C AND GPR19 | 0.888889 | 0.8 | 1 |
| TRPM8 AND NOT-SLC22A18 AND NOT-GRIN2C | 0.888889 | 0.8 | 1 |
| TRPM8 AND NOT-GRIN2C AND SLCO1A2 | 0.888889 | 0.8 | 1 |
| TRPM8 AND NOT-SLC4A8 AND AGTR2 | 0.888889 | 0.8 | 1 |
| TRPM8 AND NOT-SLC4A8 AND MEGF11 | 0.888889 | 0.8 | 1 |
| TRPM8 AND NOT-SLC4A8 AND SLCO1A2 | 0.888889 | 0.8 | 1 |
| TRPM8 AND NOT-GRIN2C AND ATP8A2 | 0.888889 | 0.8 | 1 |
| TRPM8 AND NOT-SLC4A8 AND GRIA4 | 0.888889 | 0.8 | 1 |
| TRPM8 AND NOT-SLC4A8 AND CACNA1E | 0.888889 | 0.8 | 1 |
| TRPM8 AND NOT-SLC4A8 AND SLCO1A2 | 0.888889 | 0.8 | 1 |
| TRPM8 AND NOT-SLC4A8 AND SLCO6A1 | 0.888889 | 0.8 | 1 |
| TRPM8 AND NOT-SLC39A2 AND NOT-CDH10 | 1 | 1 | 1 |
| TRPM8 AND NOT-SLC4A8 AND NOT-CHRNA2 | 0.888889 | 0.8 | 1 |
| TRPM8 AND NOT-SYT4 AND NOT-ANPEP | 0.888889 | 0.8 | 1 |
| TRPM8 AND NOT-SLC39A2 AND NOT-VAMP8 | 1 | 1 | 1 |
| TRPM8 AND NOT-SLC4A8 AND NOT-CHRNA2 | 0.888889 | 0.8 | 1 |
| TRPM8 AND NOT-GRIN2C AND SLC2A2 | 0.888889 | 0.8 | 1 |
| TRPM8 AND NOT-GABRA1 AND SLC43A1 | 1 | 1 | 1 |
| TRPM8 AND NOT-GRIN2C AND MEGF11 | 0.888889 | 0.8 | 1 |
| TRPM8 AND NOT-GYPC AND CDH10 | 0.888889 | 0.8 | 1 |
| TRPM8 AND NOT-SLC4A8 AND ABCA12 | 0.888889 | 0.8 | 1 |
| TRPM8 AND NOT-SYT4 AND NOT-SLC39A2 | 0.888889 | 0.8 | 1 |
| TRPM8 AND NOT-DYSF AND CD93 | 0.888889 | 0.8 | 1 |
| TRPM8 AND NOT-GRIN2C AND SLC43A1 | 1 | 1 | 1 |
| TRPM8 AND NOT-GRIN2C AND GRIA4 | 0.888889 | 0.8 | 1 |
| TRPM8 AND NOT-SLC4A8 AND NOT-EBP | 0.888889 | 0.8 | 1 |
| TRPM8 AND NOT-STAB1 AND SLC43A1 | 1 | 1 | 1 |
| TRPM8 AND NOT-IL17RA AND NOT-SLC4A8 | 0.888889 | 0.8 | 1 |
| TRPM8 AND NOT-SLC4A8 AND ADAM2 | 0.888889 | 0.8 | 1 |
| TRPM8 AND NOT-SLC4A8 AND GPR19 | 0.888889 | 0.8 | 1 |
| TRPM8 AND NOT-SLC4A8 AND NOT-GUCY2D | 0.888889 | 0.8 | 1 |
| Sarcoma | | | |
| TGFBI AND NOT-SPINT1 AND PRLR | 0.903226 | 1 | 0.823529 |
| ADAM12 AND NOT-ACPP AND CD74 | 0.944444 | 0.894737 | 1 |
| TGFBI AND NOT-SPINT1 AND KCNH7 | 0.909091 | 0.9375 | 0.882353 |
| TGFBI AND NOT-SPINT1 AND KIR2DL3 | 0.909091 | 0.9375 | 0.882353 |
| ADAM12 AND NOT-SPINT1 AND GABRB1 | 0.941176 | 0.941176 | 0.941176 |
| ADAM12 AND NOT-ABCB1 AND OR4N4 | 0.894737 | 0.809524 | 1 |
| TGFBI AND NOT-SPINT1 AND TAS2R9 | 0.903226 | 1 | 0.823529 |

FIG. 15 (cont.)

| Antigen Pair Logic | F1 | Precision | Recall |
|---|---|---|---|
| NOT-CLDN4 AND VANGL1 AND NOT-SLC22A11 | 0.888889 | 0.857143 | 0.923077 |
| NOT-CLDN4 AND VANGL1 AND MLANA | 0.916667 | 1 | 0.846154 |
| NOT-CLDN4 AND VANGL1 AND SLC13A5 | 0.923077 | 0.923077 | 0.923077 |
| FAP AND NOT-GRIN1 AND SV2C | 0.818182 | 1 | 0.692308 |
| GYPC AND VANGL1 AND NOT-CLDN6 | 0.88 | 0.916667 | 0.846154 |
| ATP8B2 AND NOT-CD22 AND SLC13A1 | 0.869565 | 1 | 0.769231 |
| BIRC5 AND NOT-KIAA0319 AND CYP4A11 | 0.818182 | 1 | 0.692308 |
| NOT-RNF43 AND VANGL1 AND NOT-CLDN6 | 0.923077 | 0.923077 | 0.923077 |
| NOT-EPCAM AND VANGL1 AND NOT-CLDN6 | 0.962963 | 0.928571 | 1 |
| NOT-ERBB3 AND VANGL1 AND NOT-CLDN6 | 0.88 | 0.916667 | 0.846154 |
| NOT-EPCAM AND VANGL1 AND NOT-MSLN | 0.896552 | 0.8125 | 1 |
| NOT-EPCAM AND VANGL1 AND NOT-KDR | 0.857143 | 0.8 | 0.923077 |
| BIRC5 AND NOT-EPCAM AND CLDN20 | 0.818182 | 1 | 0.692308 |
| NOT-CLDN4 AND VANGL1 AND NOT-CLDN6 | 0.923077 | 0.923077 | 0.923077 |
| BIRC5 AND NOT-EPCAM AND SLC13A1 | 0.818182 | 1 | 0.692308 |
| NOT-CEACAM6 AND VANGL1 AND NOT-CLDN6 | 0.857143 | 0.8 | 0.923077 |
| NOT-CEACAM6 AND VANGL1 AND NOT-SLC34A2 | 0.857143 | 0.8 | 0.923077 |
| NOT-ERBB3 AND VANGL1 AND NOT-CLDN2 | 0.846154 | 0.846154 | 0.846154 |
| NOT-CEACAM6 AND VANGL1 AND NOT-CLDN2 | 0.888889 | 0.857143 | 0.923077 |
| ATP8B2 AND NOT-ITGB6 AND KDR | 0.833333 | 0.909091 | 0.769231 |
| NOT-ERBB3 AND VANGL1 AND SLC34A2 | 0.818182 | 1 | 0.692308 |
| NOT-CEACAM6 AND VANGL1 AND NOT-MSLN | 0.827586 | 0.75 | 0.923077 |
| ATP8B2 AND NOT-ERBB4 AND NOT-P2RX5 | 0.869565 | 1 | 0.769231 |
| ATP8B2 AND NOT-ERBB4 AND KDR | 0.869565 | 1 | 0.769231 |
| ATP8B2 AND NOT-EPCAM AND KDR | 0.833333 | 0.909091 | 0.769231 |
| ATP8B2 AND NOT-CD79A AND NOT-MST1R | 0.833333 | 0.909091 | 0.769231 |
| BIRC5 AND NOT-SLC22A18 AND NOT-FCRL2 | 0.818182 | 1 | 0.692308 |
| BIRC5 AND NOT-MST1R AND NOT-MLC1 | 0.818182 | 1 | 0.692308 |
| NOT-CLDN4 AND VANGL1 AND NOT-CLDN2 | 0.888889 | 0.857143 | 0.923077 |
| BIRC5 AND NOT-MST1R AND SLC6A11 | 0.818182 | 1 | 0.692308 |
| FAP AND NOT-CLDN6 AND SLC13A1 | 0.818182 | 1 | 0.692308 |
| BIRC5 AND NOT-MST1R AND GRID2 | 0.818182 | 1 | 0.692308 |
| NOT-ITGB6 AND SLC6A18 AND KDR | 0.8 | 0.833333 | 0.769231 |
| NOT-ATP8A1 AND SSTR5 AND NOT-ERBB4 | 0.8 | 0.833333 | 0.769231 |
| FAP AND NOT-CD22 AND SLC13A1 | 0.818182 | 1 | 0.692308 |
| BIRC5 AND NOT-EPCAM AND KDR | 0.818182 | 1 | 0.692308 |
| BIRC5 AND NOT-ITGB6 AND KDR | 0.818182 | 1 | 0.692308 |
| BIRC5 AND NOT-CD79B AND NOT-MST1R | 0.818182 | 1 | 0.692308 |
| NOT-EPCAM AND CBX3 AND KDR | 0.8125 | 0.684211 | 1 |
| BIRC5 AND NOT-MST1R AND KDR | 0.818182 | 1 | 0.692308 |
| CBX3 AND NOT-ITGB6 AND KDR | 0.827586 | 0.75 | 0.923077 |
| BIRC5 AND NOT-MST1R AND NOT-MS4A1 | 0.818182 | 1 | 0.692308 |
| BIRC5 AND NOT-MST1R AND NOT-FCRL1 | 0.818182 | 1 | 0.692308 |
| BIRC5 AND NOT-MST1R AND SSTR5 | 0.818182 | 1 | 0.692308 |
| FAP AND NOT-MSLN AND NOT-MST1R | 0.818182 | 1 | 0.692308 |
| CBX3 AND NOT-MST1R AND NOT-MS4A1 | 0.916667 | 1 | 0.846154 |
| CBX3 AND NOT-MST1R AND NOT-CD79A | 0.96 | 1 | 0.923077 |
| CBX3 AND NOT-MST1R AND NOT-CD79B | 0.96 | 1 | 0.923077 |
| FAP AND NOT-MST1R AND FCRL1 | 0.818182 | 1 | 0.692308 |
| CBX3 AND NOT-MST1R AND NOT-FCRL1 | 0.916667 | 1 | 0.846154 |
| FAP AND NOT-MST1R AND MS4A1 | 0.818182 | 1 | 0.692308 |
| AML | | | |
| NOT-PTPRK AND NOT-GPR171 AND HCST | 0.963107 | 0.939394 | 0.988048 |
| NOT-PTPRK AND NOT-GPR171 AND HCST | 0.963107 | 0.939394 | 0.988048 |
| NOT-PODXL AND NOT-GPR171 AND HCST | 0.963107 | 0.939394 | 0.988048 |
| NOT-PODXL AND NOT-GPR171 AND HCST | 0.963107 | 0.939394 | 0.988048 |
| NOT-PTPRK AND NOT-GPR171 AND PTGER2 | 0.962963 | 0.942748 | 0.984064 |
| NOT-SGCE AND HCST AND NOT-GPR171 | 0.962818 | 0.946154 | 0.98008 |
| COMPLEX-FLT3/HEG1/RHAG | 0.96124 | 0.935849 | 0.988048 |
| COMPLEX-FLT3/SIT1/RHAG | 0.96124 | 0.935849 | 0.988048 |
| COMPLEX-TIGIT/FLT3/RHAG | 0.961089 | 0.939163 | 0.984064 |
| COMPLEX-FLT3/PODXL/RHAG | 0.963107 | 0.939394 | 0.988048 |
| NOT-PTPRK AND CD46 AND NOT-P2RY10 | 0.960474 | 0.952941 | 0.968127 |
| NOT-PTPRK AND CD46 AND NOT-P2RY10 | 0.960474 | 0.952941 | 0.968127 |
| NOT-PTPRK AND CSF3R AND NOT-BTN3A2 | 0.960474 | 0.952941 | 0.968127 |
| NOT-PTPRK AND CSF3R AND NOT-BTN3A2 | 0.960474 | 0.952941 | 0.968127 |
| COMPLEX-ABCC5/FLT3/RHAG | 0.961089 | 0.939163 | 0.984064 |
| NOT-WLS AND HCST AND NOT-GPR171 | 0.96 | 0.963855 | 0.956175 |
| COMPLEX-FLT3/RHAG/BMPR2 | 0.961089 | 0.939163 | 0.984064 |
| COMPLEX-FLT3/LAMP3/RHAG | 0.96124 | 0.935849 | 0.988048 |
| COMPLEX-FLT3/SLC9A9/RHAG | 0.96124 | 0.935849 | 0.988048 |
| NOT-PTPRK AND CSF3R AND NOT-P2RY10 | 0.965116 | 0.939623 | 0.992032 |
| NOT-PTPRK AND CSF3R AND NOT-P2RY10 | 0.965116 | 0.939623 | 0.992032 |
| COMPLEX-FLT3/RHAG/TSPAN6 | 0.959381 | 0.932331 | 0.988048 |
| COMPLEX-FLT3/TMEM150C/RHAG | 0.959381 | 0.932331 | 0.988048 |
| COMPLEX-AGTR1/FLT3/RHAG | 0.959381 | 0.932331 | 0.988048 |
| COMPLEX-FLT3/AMIGO2/RHAG | 0.959381 | 0.932331 | 0.988048 |

| Antigen Pair Logic | F1 | Precision | Recall |
|---|---|---|---|
| ADAM12 AND NOT-ST14 AND SV2C | 0.85 | 0.73913 | 1 |
| ADAM12 AND NOT-ST14 AND PCDHGC4 | 0.85 | 0.73913 | 1 |
| ADAM12 AND NOT-ST14 AND GABRB1 | 0.864865 | 0.8 | 0.941176 |
| ADAM12 AND NOT-ABCB1 AND GJA10 | 0.829268 | 0.708333 | 1 |
| ADAM12 AND NOT-ST14 AND GABRG1 | 0.864865 | 0.8 | 0.941176 |
| ADAM12 AND NOT-ST14 AND BEST3 | 0.85 | 0.73913 | 1 |
| ADAM12 AND NOT-SPINT1 AND CRB1 | 0.944444 | 0.894737 | 1 |
| ADAM12 AND NOT-SPINT1 AND SV2C | 0.944444 | 0.894737 | 1 |
| ADAM12 AND NOT-ST14 AND OR4N4 | 0.894737 | 0.809524 | 1 |
| ADAM12 AND NOT-ST14 AND MLANA | 0.85 | 0.73913 | 1 |
| TGFBI AND NOT-SPINT1 AND PRRG2 | 0.875 | 0.933333 | 0.823529 |
| ADAM12 AND NOT-HPN AND MLANA | 0.882353 | 0.882353 | 0.882353 |
| ADAM12 AND NOT-SPINT1 AND ACSL6 | 0.842105 | 0.761905 | 0.941176 |
| ADAM12 AND NOT-ILDR1 AND CALN1 | 0.894737 | 0.809524 | 1 |
| ADAM12 AND NOT-ST14 AND LCT | 0.85 | 0.73913 | 1 |
| ADAM12 AND NOT-ACPP AND SLC39A12 | 0.918919 | 0.85 | 1 |
| PLXND1 AND NOT-ABCB1 AND GJA10 | 0.903226 | 1 | 0.823529 |
| TGFBI AND NOT-SPINT1 AND KCNK7 | 0.909091 | 0.9375 | 0.882353 |
| ATP8B2 AND NOT-ABCB1 AND NOT-CLCA4 | 0.8 | 0.923077 | 0.705882 |
| ADAM12 AND NOT-ST14 AND GRIN2A | 0.809524 | 0.68 | 1 |
| ADAM12 AND NOT-ILDR1 AND GUCY2F | 0.888889 | 0.842105 | 0.941176 |
| TGFBI AND NOT-SPINT1 AND OR7A17 | 0.909091 | 0.9375 | 0.882353 |
| ADAM12 AND NOT-ST14 AND ASTN1 | 0.829268 | 0.708333 | 1 |
| TGFBI AND NOT-SPINT1 AND TAS2R14 | 0.909091 | 0.9375 | 0.882353 |
| ADAM12 AND GP5 AND NOT-OR8D1 | 0.829268 | 0.708333 | 1 |
| ADAM12 AND GP5 AND NOT-LRFN2 | 0.871795 | 0.772727 | 1 |
| ADAM12 AND GP5 AND NOT-HTR6 | 0.842105 | 0.761905 | 0.941176 |
| ADAM12 AND GP5 AND NOT-AGTR2 | 0.85 | 0.73913 | 1 |
| OSMR AND NOT-ACPP AND NOT-AMHR2 | 0.903226 | 1 | 0.823529 |
| DDR2 AND NOT-WNT4 AND LCT | 0.8 | 0.923077 | 0.705882 |
| ADAM12 AND NOT-ACPP AND PCDHGC4 | 0.918919 | 0.85 | 1 |
| ADAM12 AND NOT-ILDR1 AND PCDHAC2 | 0.918919 | 0.85 | 1 |
| ADAM12 AND NOT-ABCB1 AND FSHR | 0.85 | 0.73913 | 1 |
| ADAM12 AND NOT-ST14 AND CALN1 | 0.829268 | 0.708333 | 1 |
| ADAM12 AND NOT-ILDR1 AND HCN4 | 0.944444 | 0.894737 | 1 |
| ATP8B2 AND NOT-ABCB1 AND NOT-SPINT1 | 0.8 | 0.923077 | 0.705882 |
| ATP8B2 AND NOT-ABCB1 AND GLRA1 | 0.8 | 0.923077 | 0.705882 |
| ATP8B2 AND NOT-ABCB1 AND NOT-ST14 | 0.8 | 0.923077 | 0.705882 |
| ATP8B2 AND NOT-ABCB1 AND CORIN | 0.8 | 0.923077 | 0.705882 |
| ATP8B2 AND NOT-ABCB1 AND NOT-FGFR3 | 0.8 | 0.923077 | 0.705882 |
| ATP8B2 AND NOT-ABCB1 AND GP5 | 0.8 | 0.923077 | 0.705882 |
| ADAM12 AND NOT-ST14 AND KCNV1 | 0.810811 | 0.75 | 0.882353 |
| ATP8B2 AND NOT-ABCB1 AND OR10H2 | 0.8 | 0.923077 | 0.705882 |
| TGFBI AND NOT-SPINT1 AND APP | 0.9375 | 1 | 0.882353 |
| ADAM12 AND NOT-ST14 AND GJA10 | 0.809524 | 0.68 | 1 |
| ADAM12 AND NOT-SPINT1 AND CSMD2 | 0.944444 | 0.894737 | 1 |
| ADAM12 AND NOT-SPINT1 AND GUCY2F | 0.918919 | 0.85 | 1 |
| ADAM12 AND NOT-ST14 AND GABRA2 | 0.894737 | 0.809524 | 1 |
| ADAM12 AND NOT-ST14 AND CRB2 | 0.85 | 0.73913 | 1 |
| TGFBI AND NOT-SPINT1 AND CDH5 | 0.9375 | 1 | 0.882353 |
| ADAM12 AND NOT-ST14 AND NETO1 | 0.894737 | 0.809524 | 1 |
| TGFBI AND NOT-SPINT1 AND GJD4 | 0.909091 | 0.9375 | 0.882353 |
| ADAM12 AND NOT-SPINT1 AND ADCY10 | 0.944444 | 0.894737 | 1 |
| ADAM12 AND NOT-SPINT1 AND NOT-ATP8B1 | 0.810811 | 0.75 | 0.882353 |
| OSMR AND NOT-ACPP AND NOT-ADAM30 | 0.866667 | 1 | 0.764706 |
| SLC2A10 AND NOT-CXADR AND GRIK4 | 0.827586 | 1 | 0.705882 |
| TGFBI AND NOT-SPINT1 AND AQP4 | 0.827586 | 1 | 0.705882 |
| TGFBI AND NOT-SPINT1 AND ERVFRD-1 | 0.909091 | 0.9375 | 0.882353 |
| ADAM12 AND NOT-ST14 AND GABRA5 | 0.871795 | 0.772727 | 1 |
| ADAM12 AND NOT-SPINT1 AND MPL | 0.871795 | 0.772727 | 1 |
| ADAM12 AND NOT-SPINT1 AND PCDHAC2 | 0.944444 | 0.894737 | 1 |
| ADAM12 AND GP5 AND NOT-OPALIN | 0.829268 | 0.708333 | 1 |
| OSMR AND NOT-ACPP AND NOT-SLC22A6 | 0.903226 | 1 | 0.823529 |
| OSMR AND NOT-CXADR AND GRIK4 | 0.8125 | 0.866667 | 0.764706 |
| OSMR AND NOT-ACPP AND NOT-GPR135 | 0.903226 | 1 | 0.823529 |
| OSMR AND NOT-ACPP AND NOT-GUCY2F | 0.903226 | 1 | 0.823529 |
| TGFBI AND NOT-SPINT1 AND ATP12A | 0.909091 | 0.9375 | 0.882353 |
| ADAM12 AND NOT-ST14 AND GUCY2F | 0.829268 | 0.708333 | 1 |
| ADAM12 AND NOT-ACPP AND ASTN1 | 0.894737 | 0.809524 | 1 |
| ADAM12 AND NOT-ST14 AND CNTNAP4 | 0.829268 | 0.708333 | 1 |
| ADAM12 AND NOT-ILDR1 AND LYPD1 | 0.85 | 0.73913 | 1 |
| ADAM12 AND NOT-ACPP AND SV2C | 0.918919 | 0.85 | 1 |
| OSMR AND NOT-STEAP4 AND NOT-ACPP | 0.827586 | 1 | 0.705882 |
| ADAM12 AND NOT-CXADR AND GRIK4 | 0.944444 | 0.894737 | 1 |
| TGFBI AND NOT-ACPP AND PRLR | 0.8 | 0.923077 | 0.705882 |
| ADAM12 AND GP5 AND NOT-SLC39A2 | 0.85 | 0.73913 | 1 |
| ADAM12 AND NOT-SPINT1 AND NOT-ATP8A2 | 0.871795 | 0.772727 | 1 |

FIG. 15 (cont.)

| Antigen Pair Logic | F1 | Precision | Recall | Antigen Pair Logic | F1 | Precision | Recall |
|---|---|---|---|---|---|---|---|
| COMPLEX-FLT3/KLRF1/RHAG | 0.959381 | 0.932331 | 0.988048 | DDR2 AND NOT-WNT4 AND OR4N4 | 0.8 | 0.923077 | 0.705882 |
| COMPLEX-FLT3/EMCN/RHAG | 0.959381 | 0.932331 | 0.988048 | ADAM12 AND GP5 AND NOT-GABRB1 | 0.809524 | 0.68 | 1 |
| COMPLEX-FLT3/CRIM1/RHAG | 0.959381 | 0.932331 | 0.988048 | ADAM12 AND NOT-ST14 AND SCN2A | 0.894737 | 0.809524 | 1 |
| COMPLEX-FLT3/PROS1/RHAG | 0.959381 | 0.932331 | 0.988048 | ADAM12 AND OR4N4 AND NOT-CLEC4M | 0.871795 | 0.772727 | 1 |
| COMPLEX-FLT3/KLRD1/RHAG | 0.959381 | 0.932331 | 0.988048 | TSPAN4 AND NOT-GDPD2 AND VANGL1 | 0.9375 | 1 | 0.882353 |
| COMPLEX-FLT3/RHAG/ST3GAL5 | 0.959381 | 0.932331 | 0.988048 | ADAM12 AND NOT-ST14 AND MPL | 0.809524 | 0.68 | 1 |
| COMPLEX-FLT3/RHAG/FAT4 | 0.959381 | 0.932331 | 0.988048 | ADAM12 AND NOT-ST14 AND ADCY10 | 0.85 | 0.73913 | 1 |
| NOT-PTPRK AND NOT-GPR171 AND CSF3R | 0.959223 | 0.935606 | 0.984064 | ADAM12 AND NOT-ST14 AND OR5P3 | 0.85 | 0.73913 | 1 |
| NOT-PTPRK AND NOT-GPR171 AND CSF3R | 0.959223 | 0.935606 | 0.984064 | ADAM12 AND NOT-ACPP AND ACSL6 | 0.820513 | 0.727273 | 0.941176 |
| COMPLEX-FLT3/RHAG/PPAP2B | 0.959064 | 0.938931 | 0.98008 | OSMR AND NOT-SPINT1 AND NOT-GUCY2F | 0.875 | 0.933333 | 0.823529 |
| COMPLEX-FLT3/RHAG/APOLD1 | 0.959064 | 0.938931 | 0.98008 | TGFBI AND NOT-CXADR AND NOT-ABCB1 | 0.9375 | 1 | 0.882353 |
| COMPLEX-FLT3/RHAG/TRPC1 | 0.959064 | 0.938931 | 0.98008 | ADAM12 AND GP5 AND NOT-ACSL6 | 0.829268 | 0.708333 | 1 |
| COMPLEX-FLT3/RHAG/CAV1 | 0.959381 | 0.932331 | 0.988048 | TGFBI AND NOT-SPINT1 AND ADCY10 | 0.909091 | 0.9375 | 0.882353 |
| COMPLEX-FLT3/ITGB5/RHAG | 0.959381 | 0.932331 | 0.988048 | TGFBI AND NOT-SPINT1 AND CRB1 | 0.875 | 0.933333 | 0.823529 |
| COMPLEX-DAG1/FLT3/RHAG | 0.959381 | 0.932331 | 0.988048 | TGFBI AND NOT-SPINT1 AND CASR | 0.909091 | 0.9375 | 0.882353 |
| COMPLEX-FLT3/RHAG/TEK | 0.959381 | 0.932331 | 0.988048 | TGFBI AND NOT-SPINT1 AND GRIK4 | 0.909091 | 0.9375 | 0.882353 |
| COMPLEX-FLT3/ENPP2/RHAG | 0.963107 | 0.939394 | 0.988048 | TGFBI AND NOT-SPINT1 AND PCDHAC2 | 0.909091 | 0.9375 | 0.882353 |
| COMPLEX-FLT3/PTPRM/RHAG | 0.96124 | 0.935849 | 0.988048 | TGFBI AND NOT-SPINT1 AND GUCY2F | 0.909091 | 0.9375 | 0.882353 |
| COMPLEX-FLT3/RHAG/HEPH | 0.963107 | 0.939394 | 0.988048 | TGFBI AND NOT-SPINT1 AND NRG3 | 0.875 | 0.933333 | 0.823529 |
| COMPLEX-FLT3/RHAG/ACVR2A | 0.958904 | 0.942308 | 0.976096 | TGFBI AND NOT-SPINT1 AND GHSR | 0.909091 | 0.9375 | 0.882353 |
| COMPLEX-FLT3/ABHD6/RHAG | 0.963107 | 0.939394 | 0.988048 | TGFBI AND NOT-SPINT1 AND SLC5A8 | 0.909091 | 0.9375 | 0.882353 |
| COMPLEX-FLT3/KCNMA1/RHAG | 0.963107 | 0.939394 | 0.988048 | TGFBI AND NOT-SPINT1 AND SV2C | 0.875 | 0.933333 | 0.823529 |
| COMPLEX-FLT3/FPR3/RHAG | 0.959381 | 0.932331 | 0.988048 | ATP8B2 AND NOT-ABCB1 AND GJA10 | 0.8 | 0.923077 | 0.705882 |
| NOT-PODXL AND NOT-GPR171 AND CSF3R | 0.959223 | 0.935606 | 0.984064 | TGFBI AND NOT-SPINT1 AND MPL | 0.909091 | 0.9375 | 0.882353 |
| NOT-PODXL AND NOT-GPR171 AND CSF3R | 0.959223 | 0.935606 | 0.984064 | TGFBI AND NOT-SPINT1 AND CSMD2 | 0.9375 | 1 | 0.882353 |
| NOT-PTPRK AND NOT-KLRB1 AND HCST | 0.95825 | 0.956349 | 0.960159 | TGFBI AND NOT-ACPP AND GPR135 | 0.8 | 0.923077 | 0.705882 |
| COMPLEX-FLT3/RHAG/JAM3 | 0.959381 | 0.932331 | 0.988048 | TGFBI AND NOT-SPINT1 AND CCKAR | 0.909091 | 0.9375 | 0.882353 |
| NOT-PTPRK AND NOT-GPR171 AND ESYT2 | 0.958084 | 0.96 | 0.956175 | TGFBI AND NOT-SPINT1 AND GABRB1 | 0.875 | 0.933333 | 0.823529 |
| COMPLEX-FLT3/GOLM1/RHAG | 0.961089 | 0.939163 | 0.984064 | TGFBI AND NOT-SPINT1 AND ACSL6 | 0.875 | 0.933333 | 0.823529 |
| COMPLEX-FLT3/ST6GALNAC6/RHAG | 0.959381 | 0.932331 | 0.988048 | TGFBI AND NOT-ACPP AND GHSR | 0.8 | 0.923077 | 0.705882 |
| COMPLEX-TSPAN9/FLT3/RHAG | 0.959381 | 0.932331 | 0.988048 | TGFBI AND NOT-ACPP AND EPHA10 | 0.8 | 0.923077 | 0.705882 |
| COMPLEX-FLT3/SLC17A5/RHAG | 0.959381 | 0.932331 | 0.988048 | ADAM12 AND NOT-MMP24 AND ASTN1 | 0.842105 | 0.761905 | 0.941176 |
| COMPLEX-FLT3/CHIC1/RHAG | 0.959381 | 0.932331 | 0.988048 | ADAM12 AND NOT-PCDHAC2 AND AGTR2 | 0.848485 | 0.875 | 0.823529 |
| COMPLEX-FLT3/SLC25A4/RHAG | 0.957529 | 0.928839 | 0.988048 | TGFBI AND NOT-ACPP AND CALN1 | 0.8 | 0.923077 | 0.705882 |
| COMPLEX-ADRA2A/FLT3/RHAG | 0.957529 | 0.928839 | 0.988048 | TGFBI AND NOT-ACPP AND ADCY10 | 0.8 | 0.923077 | 0.705882 |
| COMPLEX-FLT3/MR1/RHAG | 0.957529 | 0.928839 | 0.988048 | TGFBI AND NOT-ACPP AND ASTN1 | 0.8 | 0.923077 | 0.705882 |
| NOT-PTPRK AND P2RX1 AND NOT-P2RY10 | 0.957529 | 0.928839 | 0.988048 | TGFBI AND NOT-ACPP AND SHISA9 | 0.8 | 0.923077 | 0.705882 |
| NOT-PTPRK AND P2RX1 AND NOT-P2RY10 | 0.957529 | 0.928839 | 0.988048 | TGFBI AND NOT-ACPP AND ADAM30 | 0.8 | 0.923077 | 0.705882 |
| COMPLEX-FLT3/RHAG/ABCG1 | 0.957529 | 0.928839 | 0.988048 | TGFBI AND NOT-ACPP AND SV2C | 0.8 | 0.923077 | 0.705882 |
| NOT-WLS AND HCST AND NOT-CD3G | 0.965795 | 0.97561 | 0.956175 | OSMR AND NOT-LRRN4 AND GRIK4 | 0.83871 | 0.928571 | 0.764706 |
| NOT-PODXL AND NOT-LTB AND HCST | 0.957404 | 0.975207 | 0.940239 | TGFBI AND NOT-SPINT1 AND ATP8B1 | 0.9375 | 1 | 0.882353 |
| NOT-PODXL AND NOT-LTB AND HCST | 0.957404 | 0.975207 | 0.940239 | ADAM12 AND PCDHGC4 AND NOT-HTR6 | 0.864865 | 0.8 | 0.941176 |
| COMPLEX-FLT3/IFNAR1/RHAG | 0.957364 | 0.932075 | 0.984064 | ADAM12 AND NOT-MMP24 AND CRB2 | 0.894737 | 0.809524 | 1 |
| COMPLEX-FLT3/SLC2A8/RHAG | 0.957364 | 0.932075 | 0.984064 | TGFBI AND NOT-ACPP AND OR1C1 | 0.8 | 0.923077 | 0.705882 |
| COMPLEX-SLC16A10/FLT3/RHAG | 0.957364 | 0.932075 | 0.984064 | ADAM12 AND PCDHGC4 AND NOT-SLC39A2 | 0.918919 | 0.85 | 1 |
| COMPLEX-FLT3/DST | 0.957364 | 0.932075 | 0.984064 | ADAM12 AND SV2C AND NOT-HTR6 | 0.864865 | 0.8 | 0.941176 |
| COMPLEX-FLT3/RHAG/CD40 | 0.957364 | 0.932075 | 0.984064 | ADAM12 AND NOT-PCDHAC2 AND TSPAN16 | 0.857143 | 0.833333 | 0.882353 |
| COMPLEX-FLT3/RHAG/KL | 0.957364 | 0.932075 | 0.984064 | TGFBI AND NOT-ACPP AND PIRT | 0.8 | 0.923077 | 0.705882 |
| NOT-PTPRK AND P2RX1 AND NOT-CLEC4A | 0.958904 | 0.942308 | 0.976096 | OSMR AND NOT-AGTR2 AND GRIK4 | 0.83871 | 0.928571 | 0.764706 |
| COMPLEX-FLT3/RHAG/STX7 | 0.957198 | 0.935361 | 0.98008 | ADAM12 AND OR4N4 AND NOT-HTR6 | 0.914286 | 0.888889 | 0.941176 |
| COMPLEX-FLT3/CLEC4A/RHAG | 0.957198 | 0.935361 | 0.98008 | ADAM12 AND NOT-MMP24 AND CALN1 | 0.871795 | 0.772727 | 1 |
| COMPLEX-FLT3/SIRPG/RHAG | 0.957198 | 0.935361 | 0.98008 | ADAM12 AND SV2C AND NOT-AGTR2 | 0.871795 | 0.772727 | 1 |
| COMPLEX-FLT3/GPR171/RHAG | 0.957198 | 0.935361 | 0.98008 | TGFBI AND NOT-ACPP AND GPR156 | 0.8 | 0.923077 | 0.705882 |
| COMPLEX-FLT3/HMOX2/RHAG | 0.957198 | 0.935361 | 0.98008 | ADAM12 AND GRIK4 AND NOT-HTR6 | 0.888889 | 0.842105 | 0.941176 |
| COMPLEX-FLT3/RHAG/CD27 | 0.957031 | 0.938697 | 0.976096 | ADAM12 AND PCDHGC4 AND NOT-AGTR2 | 0.871795 | 0.772727 | 1 |
| NOT-PERP AND HCST AND NOT-GPR171 | 0.956863 | 0.942085 | 0.972112 | ADAM12 AND CALN1 AND NOT-SLC22A6 | 1 | 1 | 1 |
| COMPLEX-FLT3/IL7R/RHAG | 0.959223 | 0.935606 | 0.984064 | ADAM12 AND OR4N4 AND NOT-SLC39A2 | 0.918919 | 0.85 | 1 |
| NOT-PTPRK AND CXCR4 AND NOT-P2RY10 | 0.959693 | 0.925926 | 0.996016 | ADAM12 AND PCDHGC4 AND NOT-NPBWR1 | 0.944444 | 0.894737 | 1 |
| NOT-PTPRK AND CXCR4 AND NOT-P2RY10 | 0.959693 | 0.925926 | 0.996016 | ADAM12 AND SV2C AND NOT-NPBWR1 | 0.944444 | 0.894737 | 1 |
| NOT-PODXL AND HCST AND NOT-KLRB1 | 0.956349 | 0.952569 | 0.960159 | ADAM12 AND GRIK4 AND NOT-AGER | 0.871795 | 0.772727 | 1 |
| NOT-WLS AND CSF3R AND NOT-GPR171 | 0.96 | 0.963855 | 0.956175 | ADAM12 AND GJA10 AND NOT-HTR6 | 0.820513 | 0.727273 | 0.941176 |
| NOT-WLS AND CSF3R AND NOT-KLRB1 | 0.955823 | 0.963563 | 0.948207 | ADAM12 AND LRRC52 AND NOT-FXYD7 | 0.894737 | 0.809524 | 1 |
| COMPLEX-FLT3/SLC22A17/RHAG | 0.955684 | 0.925373 | 0.988048 | ADAM12 AND CRB2 AND NOT-HTR6 | 0.864865 | 0.8 | 0.941176 |
| COMPLEX-FLT3/PLXNA2/RHAG | 0.955684 | 0.925373 | 0.988048 | ADAM12 AND NOT-SLC22A6 AND JPH3 | 1 | 1 | 1 |
| COMPLEX-GPR176/FLT3/RHAG | 0.955684 | 0.925373 | 0.988048 | ADAM12 AND GJA10 AND NOT-SLC39A2 | 0.871795 | 0.772727 | 1 |
| COMPLEX-ABCA3/FLT3/RHAG | 0.955684 | 0.925373 | 0.988048 | ADAM12 AND CALN1 AND NOT-HTR6 | 0.842105 | 0.761905 | 0.941176 |
| COMPLEX-FLT3/JAM2/RHAG | 0.955684 | 0.925373 | 0.988048 | ADAM12 AND NOT-SLC22A6 AND PLVAP | 1 | 1 | 1 |
| COMPLEX-FLT3/RHAG/ZNRF3 | 0.955684 | 0.925373 | 0.988048 | FAP AND NOT-SLMAP AND CASR | 0.866667 | 1 | 0.764706 |
| COMPLEX-FLT3/RHAG/FZD7 | 0.955684 | 0.925373 | 0.988048 | FAP AND NOT-SLMAP AND NOT-GABRB1 | 0.866667 | 1 | 0.764706 |
| COMPLEX-FLT3/NPC1/RHAG | 0.955684 | 0.925373 | 0.988048 | FAP AND NOT-ABCB1 AND GJA10 | 0.866667 | 1 | 0.764706 |
| NOT-PODXL AND HCST AND NOT-CD28 | 0.957031 | 0.938697 | 0.976096 | ADAM12 AND NOT-EPCAM AND GRIK4 | 0.918919 | 0.85 | 1 |
| COMPLEX-FLT3/SLC39A1/RHAG | 0.955513 | 0.928571 | 0.984064 | FAP AND NOT-SLMAP AND GJA10 | 0.866667 | 1 | 0.764706 |
| COMPLEX-FLT3/LGR6/RHAG | 0.955513 | 0.928571 | 0.984064 | FAP AND NOT-SLMAP AND ADCY10 | 0.866667 | 1 | 0.764706 |
| NOT-PTPRK AND LTBR AND NOT-CLEC4A | 0.955466 | 0.971193 | 0.940239 | FAP AND NOT-SLMAP AND PCDHGC4 | 0.866667 | 1 | 0.764706 |
| NOT-PTPRK AND NOT-GPR171 AND P2RX4 | 0.968254 | 0.964427 | 0.972112 | FAP AND NOT-SLMAP AND PCDHAC2 | 0.866667 | 1 | 0.764706 |
| NOT-PTPRK AND P2RX1 AND NOT-BTN3A1 | 0.96699 | 0.943182 | 0.992032 | FAP AND NOT-SLMAP AND SV2C | 0.866667 | 1 | 0.764706 |
| NOT-PTPRK AND NOT-IL2RB AND P2RX4 | 0.963563 | 0.979424 | 0.948207 | FAP AND NOT-ABCB1 AND OR4N4 | 0.866667 | 1 | 0.764706 |

FIG. 15 (cont.)

| Antigen Pair Logic | F1 | Precision | Recall | Antigen Pair Logic | F1 | Precision | Recall |
|---|---|---|---|---|---|---|---|
| NOT-PHLDB2 AND HCST AND TAAR5 | 0.964 | 0.967871 | 0.960159 | NOT-EPCAM AND VANGL1 AND NOT-ABCB1 | 0.882353 | 0.882353 | 0.882353 |
| NOT-PHLDB2 AND NOT-KIAA1324 AND LTBR | 0.967742 | 0.979592 | 0.956175 | FAP AND NOT-SLMAP AND OR8D1 | 0.866667 | 1 | 0.764706 |
| NOT-PHLDB2 AND NOT-KIAA1324 AND LTBR | 0.967742 | 0.979592 | 0.956175 | FAP AND NOT-SLMAP AND FXYD7 | 0.866667 | 1 | 0.764706 |
| NOT-PTPRK AND LTBR AND NOT-BTN3A1 | 0.963855 | 0.97166 | 0.956175 | FAP AND NOT-SLMAP AND CRB1 | 0.866667 | 1 | 0.764706 |
| NOT-WLS AND SLC22A16 AND P2RX1 | 0.961303 | 0.983333 | 0.940239 | FAP AND NOT-SLMAP AND ROS1 | 0.866667 | 1 | 0.764706 |
| NOT-PHLDB2 AND HCST AND NOT-CD27 | 0.961089 | 0.939163 | 0.984064 | FAP AND NOT-SLMAP AND GHSR | 0.866667 | 1 | 0.764706 |
| NOT-PHLDB2 AND CXCR4 AND NOT-P2RY10 | 0.961089 | 0.939163 | 0.984064 | FAP AND NOT-SLMAP AND LCT | 0.866667 | 1 | 0.764706 |
| COMPLEX-S1PR1/FLT3/RHAG | 0.961089 | 0.939163 | 0.984064 | FAP AND NOT-SLMAP AND NOT-DIO1 | 0.827586 | 1 | 0.705882 |
| NOT-PHLDB2 AND HCST AND NOT-SIRPG | 0.961089 | 0.939163 | 0.984064 | NOT-EPCAM AND SLC2A10 AND GRIK4 | 0.827586 | 1 | 0.705882 |
| NOT-PTPRK AND NOT-GPR171 AND SLC39A8 | 0.96063 | 0.949416 | 0.972112 | FAP AND NOT-SLMAP AND ACSL6 | 0.827586 | 1 | 0.705882 |
| NOT-PTPRK AND NOT-PHLDB2 AND TAAR5 | 0.960317 | 0.956522 | 0.964143 | NOT-EPCAM AND VANGL1 AND NOT-LTA | 0.882353 | 0.882353 | 0.882353 |
| NOT-PTPRK AND NOT-PHLDB2 AND TAAR5 | 0.960317 | 0.956522 | 0.964143 | NOT-EPCAM AND SLC31A1 AND NOT-ABCB1 | 0.833333 | 0.789474 | 0.882353 |
| NOT-PHLDB2 AND CXCR4 AND TAAR5 | 0.960317 | 0.956522 | 0.964143 | FAP AND NOT-ATP13A5 AND NOT-CXADR | 0.827586 | 1 | 0.705882 |
| NOT-PTPRK AND P2RX4 AND NOT-KLRD1 | 0.959677 | 0.971429 | 0.948207 | FAP AND NOT-SLMAP AND CCKAR | 0.866667 | 1 | 0.764706 |
| NOT-WLS AND SLC22A16 AND HCST | 0.959514 | 0.975309 | 0.944223 | ADAM12 AND NOT-EPCAM AND ACSL6 | 0.820513 | 0.727273 | 0.941176 |
| COMPLEX-FLT3/ATP8B1/RHAG | 0.959381 | 0.932331 | 0.988048 | NOT-EPCAM AND VANGL1 AND NOT-CORIN | 0.833333 | 0.789474 | 0.882353 |
| NOT-PTPRK AND NOT-GPR171 AND CD44 | 0.959381 | 0.932331 | 0.988048 | FAP AND NOT-SLMAP AND FSHR | 0.866667 | 1 | 0.764706 |
| NOT-PTPRK AND NOT-GPR171 AND CD44 | 0.959381 | 0.932331 | 0.988048 | FAP AND NOT-SLMAP AND CRB2 | 0.866667 | 1 | 0.764706 |
| COMPLEX-FLT3/GHR/RHAG | 0.959381 | 0.932331 | 0.988048 | FAP AND NOT-SLMAP AND NOT-OR4N4 | 0.866667 | 1 | 0.764706 |
| NOT-WLS AND CSF3R AND NOT-PHLDB2 | 0.961924 | 0.967742 | 0.956175 | ADAM12 AND NOT-CLDN8 AND PCDHGC4 | 0.871795 | 0.772727 | 1 |
| NOT-PTPRK AND CD44 AND NOT-P2RY10 | 0.970646 | 0.953846 | 0.988048 | NOT-EPCAM AND FAM57A AND NOT-GUCY2F | 0.823529 | 0.823529 | 0.823529 |
| NOT-ANTXR1 AND EMP3 AND NOT-P2RY10 | 0.960938 | 0.942529 | 0.98008 | TGFBI AND NOT-EPCAM AND NOT-ABCB1 | 0.9375 | 1 | 0.882353 |
| NOT-WLS AND LTBR AND NOT-PHLDB2 | 0.960825 | 0.995726 | 0.928287 | NOT-EPCAM AND VANGL1 AND NOT-TSPAN32 | 0.909091 | 0.9375 | 0.882353 |
| COMPLEX-BTN3A1/FLT3/RHAG | 0.96124 | 0.935849 | 0.988048 | ADAM12 AND NOT-CLDN8 AND LCT | 0.871795 | 0.772727 | 1 |
| NOT-PODXL AND P2RX1 AND NOT-BTN3A1 | 0.957692 | 0.925651 | 0.992032 | NOT-EPCAM AND SLC2A10 AND CALN1 | 0.827586 | 1 | 0.705882 |
| NOT-WLS AND SLC22A16 AND ATP6AP2 | 0.957576 | 0.971311 | 0.944223 | NOT-EPCAM AND VANGL1 AND CD4 | 0.875 | 0.933333 | 0.823529 |
| NOT-WLS AND SLC22A16 AND ATP13A1 | 0.957576 | 0.971311 | 0.944223 | NOT-EPCAM AND SLC2A10 AND CRB1 | 0.827586 | 1 | 0.705882 |
| NOT-WLS AND SLC22A16 AND LAMP1 | 0.957576 | 0.971311 | 0.944223 | NOT-EPCAM AND SLC2A10 AND GJA10 | 0.827586 | 1 | 0.705882 |
| NOT-WLS AND SLC22A16 AND TGOLN2 | 0.957404 | 0.975207 | 0.940239 | NOT-EPCAM AND FAM57A AND GJA10 | 0.823529 | 0.823529 | 0.823529 |
| NOT-PTPRK AND P2RX4 AND NOT-CD247 | 0.957404 | 0.975207 | 0.940239 | FAP AND NOT-ATP13A5 AND NOT-IL22RA1 | 0.827586 | 1 | 0.705882 |
| COMPLEX-FLT3/IFNAR2/RHAG | 0.957364 | 0.932075 | 0.984064 | DDR2 AND NOT-CLDN8 AND GJA10 | 0.8 | 0.923077 | 0.705882 |
| NOT-WLS AND SLC22A16 AND VAMP2 | 0.95723 | 0.979167 | 0.936255 | DDR2 AND NOT-CLDN8 AND LCT | 0.8 | 0.923077 | 0.705882 |
| COMPLEX-FLT3/RHAG/PHLDB2 | 0.957198 | 0.935361 | 0.98008 | ATP8B2 AND NOT-ABCB1 AND NOT-EPCAM | 0.8 | 0.923077 | 0.705882 |
| COMPLEX-EFNB2/FLT3/RHAG | 0.957031 | 0.938697 | 0.976096 | ATP8B2 AND NOT-ABCB1 AND NOT-CLDN8 | 0.8 | 0.923077 | 0.705882 |
| NOT-PHLDB2 AND HCST AND NOT-GPR171 | 0.957031 | 0.938697 | 0.976096 | FAP AND NOT-AGTR2 AND GP5 | 0.827586 | 1 | 0.705882 |
| NOT-PTPRK AND NOT-SIRPG AND P2RX4 | 0.957031 | 0.938697 | 0.976096 | FAP AND NOT-LTA AND LRRC52 | 0.866667 | 1 | 0.764706 |
| NOT-PHLDB2 AND HCST AND NOT-CD3G | 0.957031 | 0.938697 | 0.976096 | NOT-EPCAM AND SLC2A10 AND KCNK10 | 0.827586 | 1 | 0.705882 |
| NOT-PTPRK AND P2RX4 AND NOT-CD8B | 0.959184 | 0.983264 | 0.936255 | FAP AND NOT-GUCY2F AND GPR160 | 0.827586 | 1 | 0.705882 |
| NOT-PTPRK AND NOT-CD3G AND P2RX4 | 0.96063 | 0.949416 | 0.972112 | FAP AND NOT-OR8D1 AND EDA | 0.866667 | 1 | 0.764706 |
| NOT-PHLDB2 AND HCST AND LTBR | 0.958743 | 0.945736 | 0.972112 | ADAM12 AND NOT-CLDN8 AND OR4N4 | 0.894737 | 0.809524 | 1 |
| NOT-PHLDB2 AND HCST AND LTBR | 0.958743 | 0.945736 | 0.972112 | ADAM12 AND NOT-CLDN8 AND GJA10 | 0.829268 | 0.708333 | 1 |
| COMPLEX-BTN3A3/FLT3/RHAG | 0.959223 | 0.935606 | 0.984064 | FAP AND NOT-LTA AND EPHA10 | 0.866667 | 1 | 0.764706 |
| NOT-PHLDB2 AND HCST AND ATP2A2 | 0.962376 | 0.956693 | 0.968127 | FAP AND NOT-LTA AND CALN1 | 0.866667 | 1 | 0.764706 |
| NOT-PHLDB2 AND HCST AND PIEZO1 | 0.956349 | 0.952569 | 0.960159 | FAP AND NOT-LTA AND PCDHAC2 | 0.866667 | 1 | 0.764706 |
| NOT-PHLDB2 AND CLEC12A AND NOT-KIAA1324 | 0.956 | 0.959839 | 0.952191 | ADAM12 AND NOT-SLC34A2 AND PCDHGC4 | 0.842105 | 0.761905 | 0.941176 |
| NOT-PTPRK AND EMP3 AND NOT-P2RY10 | 0.955854 | 0.922222 | 0.992032 | NOT-EPCAM AND SLC2A10 AND GUCY2F | 0.827586 | 1 | 0.705882 |
| NOT-PHLDB2 AND HCST AND NOT-KIAA1324 | 0.984127 | 0.980237 | 0.988048 | NOT-EPCAM AND SLC2A10 AND GABRA5 | 0.827586 | 1 | 0.705882 |
| NOT-PHLDB2 AND HCST AND NOT-KIAA1324 | 0.984127 | 0.980237 | 0.988048 | OSMR AND NOT-EPCAM AND GRIK4 | 0.8125 | 0.866667 | 0.764706 |
| NOT-PHLDB2 AND HCST AND NOT-PLXDC1 | 0.959381 | 0.932331 | 0.988048 | DDR2 AND NOT-CLDN8 AND OR4N4 | 0.8 | 0.923077 | 0.705882 |
| COMPLEX-SLC31A1/FLT3/RHAG | 0.955513 | 0.928571 | 0.984064 | ADAM12 AND NOT-CLDN7 AND GABRB1 | 0.864865 | 0.8 | 0.941176 |
| NOT-WLS AND SLC22A16 AND CSF3R | 0.955466 | 0.971193 | 0.940239 | FAP AND NOT-OR8D1 AND ICOS | 0.866667 | 1 | 0.764706 |
| NOT-PHLDB2 AND HCST AND TSPAN3 | 0.955285 | 0.975104 | 0.936255 | NOT-EPCAM AND SLC2A10 AND MPL | 0.827586 | 1 | 0.705882 |
| NOT-PHLDB2 AND HCST AND TSPAN3 | 0.955285 | 0.975104 | 0.936255 | DDR2 AND NOT-CLDN8 AND GUCY2F | 0.8 | 0.923077 | 0.705882 |
| NOT-PHLDB2 AND CXCR4 AND ESYT2 | 0.955166 | 0.935115 | 0.976096 | FAP AND NOT-OR8D1 AND KIR2DL3 | 0.866667 | 1 | 0.764706 |
| NOT-PHLDB2 AND HCST AND NOT-CD2 | 0.955166 | 0.935115 | 0.976096 | FAP AND NOT-OR8D1 AND CADM2 | 0.866667 | 1 | 0.764706 |
| NOT-PTPRK AND P2RX4 AND NOT-CD8A | 0.955102 | 0.979079 | 0.932271 | FAP AND NOT-XCR1 AND NOT-ST14 | 0.827586 | 1 | 0.705882 |
| NOT-PTPRK AND NOT-CD2 AND P2RX4 | 0.954918 | 0.983122 | 0.928287 | FAP AND NOT-NPC1L1 AND LRRC52 | 0.866667 | 1 | 0.764706 |
| NOT-MTUS1 AND CD46 AND NOT-BTN3A1 | 0.954813 | 0.94186 | 0.968127 | FAP AND NOT-OR8D1 AND GPR63 | 0.866667 | 1 | 0.764706 |
| NOT-SGCE AND EMP3 AND NOT-P2RY10 | 0.954635 | 0.945313 | 0.964143 | FAP AND NOT-AGTR2 AND TAS2R9 | 0.827586 | 1 | 0.705882 |
| FLT3 AND EMP3 AND NOT-LAMP3 | 0.954357 | 0.995671 | 0.916335 | OSMR AND NOT-CLDN7 AND NOT-GUCY2F | 0.875 | 0.933333 | 0.823529 |
| NOT-WLS AND CSF3R AND NOT-BTN3A3 | 0.954455 | 0.948819 | 0.960159 | OSMR AND NOT-EPCAM AND ACSL6 | 0.8125 | 0.866667 | 0.764706 |
| NOT-PHLDB2 AND HCST AND NOT-TIGIT | 0.961089 | 0.939163 | 0.984064 | TGFBI AND NOT-SPINT1 AND CD34 | 0.9375 | 1 | 0.882353 |
| NOT-PTPRK AND CD44 AND NOT-KLRB1 | 0.954092 | 0.956 | 0.952191 | FAP AND NOT-NPC1L1 AND SLC34A1 | 0.866667 | 1 | 0.764706 |
| NOT-PTPRK AND CD44 AND NOT-KLRB1 | 0.954092 | 0.956 | 0.952191 | FAP AND NOT-NPC1L1 AND JPH3 | 0.866667 | 1 | 0.764706 |
| NOT-PHLDB2 AND NOT-KIAA1324 AND PTGER2 | 0.966601 | 0.953488 | 0.98008 | NOT-EPCAM AND SLC2A10 AND OR4N4 | 0.827586 | 1 | 0.705882 |
| COMPLEX-FLT3/RHAG/SLC8A3 | 0.953846 | 0.921933 | 0.988048 | ADAM12 AND NOT-ABCB1 AND CORIN | 0.85 | 0.73913 | 1 |
| COMPLEX-SEMA4D/FLT3/RHAG | 0.953846 | 0.921933 | 0.988048 | ADAM12 AND NOT-ABCB1 AND GP5 | 0.871795 | 0.772727 | 1 |
| COMPLEX-FLT3/RHAG/KCNK6 | 0.953846 | 0.921933 | 0.988048 | ADAM12 AND NOT-ST14 AND CORIN | 0.85 | 0.73913 | 1 |
| NOT-PHLDB2 AND HCST AND NOT-BTN3A2 | 0.956522 | 0.94902 | 0.964143 | ADAM12 AND NOT-ABCB1 AND AQP4 | 0.894737 | 0.809524 | 1 |
| NOT-PTPRK AND P2RX4 AND NOT-P2RY10 | 0.953722 | 0.963415 | 0.944223 | ADAM12 AND NOT-HPN AND CORIN | 0.944444 | 0.894737 | 1 |
| NOT-WLS AND SLC22A16 AND ITGB2 | 0.953722 | 0.963415 | 0.944223 | ADAM12 AND NOT-ST14 AND TAS2R40 | 0.894737 | 0.809524 | 1 |
| NOT-PHLDB2 AND HCST AND KIT | 0.953722 | 0.963415 | 0.944223 | ADAM12 AND NOT-ST14 AND AQP4 | 0.894737 | 0.809524 | 1 |
| NOT-WLS AND SLC22A16 AND PLP2 | 0.953722 | 0.963415 | 0.944223 | TSPAN4 AND NOT-GDPD2 AND GPR173 | 0.820513 | 0.727273 | 0.941176 |
| NOT-WLS AND SLC22A16 AND CXCR4 | 0.953722 | 0.963415 | 0.944223 | ADAM12 AND GP5 AND NOT-OR7A17 | 0.918919 | 0.85 | 1 |
| NOT-WLS AND SLC22A16 AND CD53 | 0.953722 | 0.963415 | 0.944223 | PLXND1 AND NOT-ABCB1 AND GP5 | 0.866667 | 1 | 0.764706 |
| NOT-WLS AND SLC22A16 AND EVI2B | 0.953722 | 0.963415 | 0.944223 | ADAM12 AND NOT-ST14 AND GPR63 | 0.85 | 0.73913 | 1 |
| COMPLEX-EMP3/FLT3/RHAG | 0.953668 | 0.925094 | 0.984064 | ADAM12 AND NOT-ABCB1 AND ICOS | 0.85 | 0.73913 | 1 |

FIG. 15 (cont.)

| Antigen Pair Logic | F1 | Precision | Recall | Antigen Pair Logic | F1 | Precision | Recall |
|---|---|---|---|---|---|---|---|
| COMPLEX-NKAIN2/FLT3/RHAG | 0.953668 | 0.925094 | 0.984064 | OSMR AND NOT-SLC19A3 AND NOT-ST14 | 0.848485 | 0.875 | 0.823529 |
| NOT-PHLDB2 AND HCST AND NOT-KLRB1 | 0.953908 | 0.959677 | 0.948207 | ADAM12 AND NOT-ILDR1 AND KIR2DL3 | 0.944444 | 0.894737 | 1 |
| NOT-PTPRK AND CSF3R AND NOT-BTN3A1 | 0.972763 | 0.95057 | 0.996016 | ADAM12 AND NOT-ST14 AND TAS2R14 | 0.871795 | 0.772727 | 1 |
| NOT-WLS AND CSF3R AND NOT-BTN3A1 | 0.956522 | 0.94902 | 0.964143 | ADAM12 AND NOT-ST14 AND KCNH7 | 0.829268 | 0.708333 | 1 |
| NOT-PHLDB2 AND NOT-KIAA1324 AND ESYT2 | 0.965657 | 0.979508 | 0.952191 | ADAM12 AND NOT-SPINT1 AND PRLR | 0.971429 | 0.944444 | 1 |
| NOT-PTPRK AND P2RX4 AND NOT-TIGIT | 0.96146 | 0.979339 | 0.944223 | ADAM12 AND NOT-SPINT1 AND TAS2R14 | 0.971429 | 0.944444 | 1 |
| NOT-PTPRK AND NOT-CD2 AND CD44 | 0.952941 | 0.938224 | 0.968127 | OSMR AND NOT-ABCB1 AND NOT-CXADR | 0.875 | 0.933333 | 0.823529 |
| NOT-PTPRK AND NOT-CD2 AND CD44 | 0.952941 | 0.938224 | 0.968127 | OSMR AND NOT-SLC19A3 AND NOT-ACPP | 0.875 | 0.933333 | 0.823529 |
| COMPLEX-FLT3/FXYD6/RHAG | 0.952941 | 0.938224 | 0.968127 | ADAM12 AND NOT-UPK1B AND CORIN | 0.848485 | 0.875 | 0.823529 |
| P2RY8 AND NOT-PHLDB2 AND TAAR5 | 0.953722 | 0.963415 | 0.944223 | ADAM12 AND GP5 AND NOT-ACPP | 0.85 | 0.73913 | 1 |
| P2RY8 AND NOT-PHLDB2 AND TAAR5 | 0.953722 | 0.963415 | 0.944223 | ADAM12 AND NOT-ST14 AND OR10A4 | 0.829268 | 0.708333 | 1 |
| NOT-PTPRK AND NOT-TIGIT AND CD44 | 0.957364 | 0.932075 | 0.984064 | DDR2 AND NOT-ABCB1 AND CORIN | 0.827586 | 1 | 0.705882 |
| NOT-PTPRK AND NOT-TIGIT AND CD44 | 0.957364 | 0.932075 | 0.984064 | ADAM12 AND NOT-ABCB1 AND GLRA1 | 0.810811 | 0.75 | 0.882353 |
| FLT3 AND EMP3 AND NOT-ABHD6 | 0.952381 | 0.991379 | 0.916335 | ADAM12 AND NOT-SPINT1 AND KCNH7 | 0.918919 | 0.85 | 1 |
| FLT3 AND NOT-TSPAN6 AND EMP3 | 0.952381 | 0.991379 | 0.916335 | ADAM12 AND GP5 AND NOT-WNT1 | 0.85 | 0.73913 | 1 |
| FLT3 AND NOT-PODXL AND EMP3 | 0.952381 | 0.991379 | 0.916335 | ADAM12 AND NOT-SPINT1 AND KIR2DL3 | 0.971429 | 0.944444 | 1 |
| FLT3 AND EMP3 AND NOT-FAT4 | 0.952381 | 0.991379 | 0.916335 | ADAM12 AND NOT-ST14 AND FLT3LG | 0.85 | 0.73913 | 1 |
| FLT3 AND EMP3 AND NOT-HEPH | 0.952381 | 0.991379 | 0.916335 | DDR2 AND NOT-WNT4 AND CORIN | 0.8 | 0.923077 | 0.705882 |
| NOT-EMP2 AND LTBR AND NOT-BTN3A1 | 0.952381 | 0.948617 | 0.956175 | ADAM12 AND NOT-ILDR1 AND CADM2 | 0.944444 | 0.894737 | 1 |
| COMPLEX-EDNRB/FLT3/RHAG | 0.963107 | 0.939394 | 0.988048 | ADAM12 AND NOT-ST14 AND TAAR1 | 0.85 | 0.73913 | 1 |
| COMPLEX-FLT3/HLA-DOB/RHAG | 0.959381 | 0.932331 | 0.988048 | OSMR AND NOT-ABCB1 AND NOT-SPINT1 | 0.875 | 0.933333 | 0.823529 |
| COMPLEX-ALDH1A1/FLT3/RHAG | 0.958904 | 0.942308 | 0.976096 | ADAM12 AND NOT-ST14 AND GPR17 | 0.871795 | 0.772727 | 1 |
| COMPLEX-FLT3/AXL/RHAG | 0.957198 | 0.935361 | 0.98008 | ADAM12 AND NOT-ST14 AND CADM2 | 0.894737 | 0.809524 | 1 |
| COMPLEX-FLT3/ABCA5/RHAG | 0.957198 | 0.935361 | 0.98008 | ADAM12 AND NOT-ACPP AND OR5P2 | 0.918919 | 0.85 | 1 |
| COMPLEX-FLT3/PCYT1A/RHAG | 0.96124 | 0.935849 | 0.988048 | ADAM12 AND NOT-SPINT1 AND NOT-PAM | 0.842105 | 0.761905 | 0.941176 |
| COMPLEX-FLT3/RHAG/CLDN12 | 0.955513 | 0.928571 | 0.984064 | ADAM12 AND NOT-SIGLEC6 AND NOT-GPR160 | 0.85 | 0.73913 | 1 |
| COMPLEX-FLT3/OAS1/RHAG | 0.95534 | 0.931818 | 0.98008 | PLXND1 AND NOT-ABCB1 AND CORIN | 0.903226 | 1 | 0.823529 |
| COMPLEX-EDNRB/FLT3/ST14 | 0.954545 | 0.991416 | 0.920319 | OSMR AND NOT-ABCB1 AND NOT-ST14 | 0.875 | 0.933333 | 0.823529 |
| COMPLEX-EDNRB/FLT3/PLXNA2 | 0.954545 | 0.991416 | 0.920319 | ADAM12 AND NOT-ILDR1 AND KCNK7 | 0.894737 | 0.809524 | 1 |
| COMPLEX-EDNRB/FLT3/TMPRSS2 | 0.954545 | 0.991416 | 0.920319 | PLXND1 AND NOT-ABCB1 AND TAS2R9 | 0.866667 | 1 | 0.764706 |
| COMPLEX-SPON2/FLT3/RHAG | 0.953846 | 0.921933 | 0.988048 | DDR2 AND NOT-WNT4 AND ICOS | 0.8 | 0.923077 | 0.705882 |
| COMPLEX-FLT3/RNF43/RHAG | 0.953846 | 0.921933 | 0.988048 | ADAM12 AND NOT-ST14 AND OR10H2 | 0.85 | 0.73913 | 1 |
| NOT-PTPRK AND CD37 AND NOT-P2RY10 | 0.953125 | 0.934866 | 0.972112 | ADAM12 AND NOT-ST14 AND TRPA1 | 0.85 | 0.73913 | 1 |
| NOT-PTPRK AND CD37 AND NOT-P2RY10 | 0.953125 | 0.934866 | 0.972112 | ADAM12 AND NOT-ST14 AND ICOS | 0.809524 | 0.68 | 1 |
| NOT-WLS AND CSF3R AND NOT-MS4A1 | 0.952756 | 0.941634 | 0.964143 | ADAM12 AND NOT-ABCB1 AND OR10H2 | 0.85 | 0.73913 | 1 |
| COMPLEX-FLT3/RHAG/TNFRSF10A | 0.952015 | 0.918519 | 0.988048 | ADAM12 AND GP5 AND NOT-GPR160 | 0.829268 | 0.708333 | 1 |
| COMPLEX-FLT3/IL11RA/RHAG | 0.952015 | 0.918519 | 0.988048 | ADAM12 AND GP5 AND NOT-CLEC4M | 0.809524 | 0.68 | 1 |
| COMPLEX-FLT3/RHAG/VTCN1 | 0.952015 | 0.918519 | 0.988048 | ADAM12 AND NOT-SPINT1 AND CDH5 | 0.971429 | 0.944444 | 1 |
| COMPLEX-FLT3/HSPA5/RHAG | 0.952015 | 0.918519 | 0.988048 | OSMR AND NOT-ACPP AND NOT-GPR160 | 0.875 | 0.933333 | 0.823529 |
| NOT-PTPRK AND CSF3R AND NOT-SLAMF7 | 0.950382 | 0.912088 | 0.992032 | OSMR AND NOT-ACPP AND NOT-FUT1 | 0.903226 | 1 | 0.823529 |
| NOT-SGCE AND HCST AND NOT-CD160 | 0.95 | 0.918216 | 0.984064 | ADAM12 AND NOT-ST14 AND CATSPER1 | 0.85 | 0.73913 | 1 |
| COMPLEX-FLT3/RHAG/CD79B | 0.949219 | 0.931034 | 0.968127 | ADAM12 AND NOT-ACPP AND NOT-FUT1 | 0.894737 | 0.809524 | 1 |
| NOT-WLS AND CSF3R AND NOT-HLA-DOB | 0.94902 | 0.934363 | 0.964143 | ADAM12 AND NOT-HPN AND CADM2 | 1 | 1 | 1 |
| NOT-WLS AND P2RX1 AND NOT-FCRL2 | 0.948819 | 0.937743 | 0.960159 | ADAM12 AND NOT-ST14 AND KIR2DL3 | 0.894737 | 0.809524 | 1 |
| NOT-WLS AND P2RX1 AND NOT-CD22 | 0.948819 | 0.937743 | 0.960159 | ADAM12 AND NOT-ACPP AND TAS2R14 | 0.918919 | 0.85 | 1 |
| NOT-WLS AND P2RX1 AND NOT-FCRL5 | 0.948819 | 0.937743 | 0.960159 | ADAM12 AND NOT-HPN AND TAS2R14 | 0.971429 | 0.944444 | 1 |
| NOT-WLS AND P2RX1 AND NOT-HLA-DOB | 0.948819 | 0.937743 | 0.960159 | ADAM12 AND NOT-SPINT1 AND PRRG2 | 0.888889 | 0.842105 | 0.941176 |
| NOT-PTPRK AND P2RX1 AND NOT-SLAMF7 | 0.948375 | 0.911765 | 0.988048 | COMPLEX-SFRP1/ST14/OSMR | 0.83871 | 0.928571 | 0.764706 |
| NOT-PODXL AND CSF3R AND NOT-CD160 | 0.948177 | 0.914815 | 0.984064 | OSMR AND NOT-ABCB1 AND NOT-CLCA4 | 0.875 | 0.933333 | 0.823529 |
| NOT-WLS AND P2RX1 AND NOT-CR2 | 0.946955 | 0.934109 | 0.960159 | OSMR AND NOT-ABCB1 AND NOT-FGFR3 | 0.875 | 0.933333 | 0.823529 |
| COMPLEX-FLT3/TMPRSS2/CLDN5 | 0.946721 | 0.974684 | 0.920319 | OSMR AND NOT-ACPP AND NOT-FPR2 | 0.827586 | 1 | 0.705882 |
| NOT-PODXL AND HCST AND NOT-CD160 | 0.946565 | 0.908425 | 0.988048 | ADAM12 AND NOT-SPINT1 AND AQP4 | 0.909091 | 0.9375 | 0.882353 |
| NOT-PTPRK AND NOT-CD160 AND HCST | 0.94636 | 0.911439 | 0.984064 | COMPLEX-TM4SF1/ACPP/OSMR | 0.827586 | 1 | 0.705882 |
| COMPLEX-FLT3/RHAG/CD37 | 0.945525 | 0.923954 | 0.968127 | STX2 AND NOT-CXADR AND NOT-ABCB1 | 0.9375 | 1 | 0.882353 |
| NOT-DAG1 AND DDX3X AND NOT-P2RY10 | 0.954813 | 0.94186 | 0.968127 | ADAM12 AND NOT-MARVELD2 AND KIR2DL3 | 0.971429 | 0.944444 | 1 |
| NOT-WLS AND CSF3R AND NOT-CR2 | 0.945313 | 0.927203 | 0.964143 | ADAM12 AND NOT-ST14 AND ESYT3 | 0.894737 | 0.809524 | 1 |
| NOT-WLS AND P2RX1 AND NOT-MS4A1 | 0.945098 | 0.930502 | 0.960159 | ADAM12 AND GP5 AND NOT-OR5K1 | 0.829268 | 0.708333 | 1 |
| NOT-WLS AND P2RX1 AND NOT-FCRL1 | 0.945098 | 0.930502 | 0.960159 | ADAM12 AND GP5 AND NOT-TLR9 | 0.829268 | 0.708333 | 1 |
| NOT-PTPRK AND P2RX1 AND NOT-HLA-DOB | 0.944972 | 0.902174 | 0.992032 | ADAM12 AND NOT-MARVELD2 AND TAS2R9 | 0.864865 | 0.8 | 0.941176 |
| NOT-PTPRK AND CSF3R AND NOT-MS4A1 | 0.944551 | 0.908088 | 0.984064 | ADAM12 AND GP5 AND NOT-GJB3 | 0.829268 | 0.708333 | 1 |
| NOT-PTPRK AND CD70 AND NOT-CD247 | 0.944551 | 0.908088 | 0.984064 | OSMR AND NOT-ACPP AND NOT-VSIG2 | 0.903226 | 1 | 0.823529 |
| NOT-PTPRK AND CD70 AND NOT-CD247 | 0.944551 | 0.908088 | 0.984064 | OSMR AND NOT-ACPP AND NOT-AQP4 | 0.903226 | 1 | 0.823529 |
| NOT-PODXL AND CSF3R AND NOT-MS4A1 | 0.944551 | 0.908088 | 0.984064 | OSMR AND NOT-ACPP AND NOT-NPC1L1 | 0.903226 | 1 | 0.823529 |
| FLT3 AND CD37 AND NOT-PTPRK | 0.943633 | 0.991228 | 0.900398 | ADAM12 AND NOT-SPINT1 AND OR7A17 | 0.971429 | 0.944444 | 1 |
| FLT3 AND CD37 AND NOT-PODXL | 0.943633 | 0.991228 | 0.900398 | COMPLEX-ST14/KCNK5/OSMR | 0.875 | 0.933333 | 0.823529 |
| NOT-WLS AND CSF3R AND NOT-FCRL2 | 0.94347 | 0.923664 | 0.964143 | ADAM12 AND NOT-SPINT1 AND TAS2R9 | 0.888889 | 0.842105 | 0.941176 |
| NOT-WLS AND CSF3R AND NOT-FCRL5 | 0.94347 | 0.923664 | 0.964143 | DDR2 AND NOT-ABCB1 AND ICOS | 0.827586 | 1 | 0.705882 |
| NOT-PODXL AND P2RX1 AND NOT-HLA-DOB | 0.943182 | 0.898917 | 0.992032 | ADAM12 AND NOT-ST14 AND IL1RAPL1 | 0.809524 | 0.68 | 1 |
| COMPLEX-FLT3/FOLR2/RHAG | 0.943026 | 0.930233 | 0.956175 | ADAM12 AND NOT-ST14 AND CDH26 | 0.829268 | 0.708333 | 1 |
| NOT-PTPRK AND P2RX1 AND NOT-FCRL5 | 0.942966 | 0.901818 | 0.988048 | ADAM12 AND NOT-SIGLEC6 AND NOT-ST14 | 0.85 | 0.73913 | 1 |
| NOT-PODXL AND P2RX1 AND NOT-FCRL5 | 0.942966 | 0.901818 | 0.988048 | ADAM12 AND NOT-ST14 AND CHRM4 | 0.85 | 0.73913 | 1 |
| COMPLEX-GPNMB/FLT3/RHAG | 0.942801 | 0.933594 | 0.952191 | DDR2 AND NOT-ABCB1 AND GP5 | 0.827586 | 1 | 0.705882 |
| COMPLEX-FLT3/ITGAV/RHAG | 0.942574 | 0.937008 | 0.948207 | ADAM12 AND NOT-ST14 AND CD200R1 | 0.833333 | 0.789474 | 0.882353 |
| NOT-PTPRK AND P2RX1 AND NOT-MS4A1 | 0.942529 | 0.907749 | 0.98008 | ADAM12 AND GP5 AND NOT-FXYD4 | 0.871795 | 0.772727 | 1 |
| NOT-PTPRK AND CD37 AND NOT-TIGIT | 0.942085 | 0.913858 | 0.972112 | ADAM12 AND GP5 AND NOT-OR2K2 | 0.894737 | 0.809524 | 1 |
| NOT-PTPRK AND CD37 AND NOT-TIGIT | 0.942085 | 0.913858 | 0.972112 | ADAM12 AND GP5 AND NOT-OR10C1 | 0.871795 | 0.772727 | 1 |
| NOT-WLS AND CSF3R AND NOT-FCRL1 | 0.941634 | 0.920152 | 0.964143 | OSMR AND NOT-ABCB1 AND CD63 | 0.83871 | 0.928571 | 0.764706 |

FIG. 15 (cont.)

| Antigen Pair Logic | F1 | Precision | Recall | Antigen Pair Logic | F1 | Precision | Recall |
|---|---|---|---|---|---|---|---|
| NOT-PTPRK AND NOT-GPR171 AND CD37 | 0.941634 | 0.920152 | 0.964143 | OSMR AND NOT-CXADR AND NOT-ERVFRD-1 | 0.875 | 0.933333 | 0.823529 |
| NOT-PTPRK AND NOT-GPR171 AND CD37 | 0.941634 | 0.920152 | 0.964143 | FAP AND NOT-ABCB1 AND ICOS | 0.866667 | 1 | 0.764706 |
| NOT-PTPRK AND CD37 AND NOT-CCR7 | 0.941406 | 0.923372 | 0.960159 | FAP AND NOT-ABCB1 AND CORIN | 0.866667 | 1 | 0.764706 |
| NOT-WLS AND HCST AND NOT-CD160 | 0.941406 | 0.923372 | 0.960159 | FAP AND NOT-ABCB1 AND OR10H2 | 0.866667 | 1 | 0.764706 |
| NOT-PODXL AND P2RX1 AND NOT-CD160 | 0.940952 | 0.90146 | 0.984064 | FAP AND NOT-SLMAP AND OR10H2 | 0.866667 | 1 | 0.764706 |
| NOT-PTPRK AND P2RX1 AND NOT-CD160 | 0.940727 | 0.904412 | 0.98008 | FAP AND NOT-SLMAP AND GPR63 | 0.866667 | 1 | 0.764706 |
| NOT-PODXL AND P2RX1 AND NOT-MS4A1 | 0.940727 | 0.904412 | 0.98008 | FAP AND NOT-SLMAP AND JPH2 | 0.866667 | 1 | 0.764706 |
| NOT-PERP AND HCST AND NOT-MS4A1 | 0.940727 | 0.904412 | 0.98008 | FAP AND NOT-SLMAP AND TAS2R9 | 0.866667 | 1 | 0.764706 |
| NOT-WLS AND CSF3R AND NOT-TNFRSF17 | 0.940711 | 0.933333 | 0.948207 | FAP AND NOT-SLMAP AND ICOS | 0.866667 | 1 | 0.764706 |
| NOT-WLS AND P2RX1 AND NOT-TNFRSF17 | 0.940239 | 0.940239 | 0.940239 | FAP AND NOT-SLMAP AND SLC9A3 | 0.866667 | 1 | 0.764706 |
| NOT-PTPRK AND CD70 AND NOT-KLRD1 | 0.943182 | 0.898917 | 0.992032 | FAP AND NOT-SLMAP AND CORIN | 0.866667 | 1 | 0.764706 |
| NOT-PTPRK AND CD70 AND NOT-KLRD1 | 0.943182 | 0.898917 | 0.992032 | ADAM12 AND NOT-EPCAM AND NOT-ABCB1 | 0.918919 | 0.85 | 1 |
| NOT-WLS AND CSF3R AND NOT-CD22 | 0.939806 | 0.916667 | 0.964143 | FAP AND NOT-SLMAP AND CADM2 | 0.866667 | 1 | 0.764706 |
| NOT-PODXL AND CSF3R AND NOT-FCRL5 | 0.939623 | 0.892473 | 0.992032 | FAP AND NOT-ABCB1 AND NOT-CXADR | 0.866667 | 1 | 0.764706 |
| NOT-WLS AND P2RX1 AND NOT-CXCR5 | 0.939571 | 0.919847 | 0.960159 | ADAM12 AND NOT-EPCAM AND SLC39A14 | 0.918919 | 0.85 | 1 |
| NOT-PTPRK AND CD37 AND NOT-CD28 | 0.939571 | 0.919847 | 0.960159 | FAP AND NOT-ABCB1 AND ST14 | 0.866667 | 1 | 0.764706 |
| NOT-PTPRK AND CD37 AND NOT-CD28 | 0.939571 | 0.919847 | 0.960159 | FAP AND NOT-SLMAP AND GP5 | 0.866667 | 1 | 0.764706 |
| NOT-PTPRK AND P2RX1 AND SLC7A5 | 0.94636 | 0.911439 | 0.984064 | FAP AND NOT-SLMAP AND CHRM4 | 0.866667 | 1 | 0.764706 |
| NOT-PTPRK AND P2RX1 AND SLC7A5 | 0.94636 | 0.911439 | 0.984064 | FAP AND NOT-SIGLEC6 AND GPR160 | 0.866667 | 1 | 0.764706 |
| NOT-MTUS1 AND CD46 AND NOT-CD160 | 0.939335 | 0.923077 | 0.956175 | FAP AND NOT-SLMAP AND ABCC2 | 0.866667 | 1 | 0.764706 |
| NOT-PTPRK AND CD70 AND NOT-CCR7 | 0.946565 | 0.908425 | 0.988048 | FAP AND NOT-SLMAP AND RTP1 | 0.866667 | 1 | 0.764706 |
| NOT-PODXL AND NOT-LTB AND CD37 | 0.938776 | 0.962343 | 0.916335 | FAP AND NOT-SLMAP AND OR7A17 | 0.866667 | 1 | 0.764706 |
| NOT-PODXL AND NOT-LTB AND CD37 | 0.938776 | 0.962343 | 0.916335 | FAP AND NOT-SLMAP AND SLC26A4 | 0.866667 | 1 | 0.764706 |
| NOT-PODXL AND CD37 AND NOT-CLEC2D | 0.938462 | 0.907063 | 0.972112 | ADAM12 AND NOT-CLDN8 AND CORIN | 0.871795 | 0.772727 | 1 |
| NOT-PERP AND HCST AND NOT-CD160 | 0.938462 | 0.907063 | 0.972112 | FAP AND NOT-SLMAP AND NOT-ST14 | 0.866667 | 1 | 0.764706 |
| NOT-PTPRK AND NOT-TIGIT AND CD70 | 0.944762 | 0.905109 | 0.988048 | FAP AND NOT-SLMAP AND NOT-GJB1 | 0.866667 | 1 | 0.764706 |
| NOT-PTPRK AND NOT-TIGIT AND CD70 | 0.944762 | 0.905109 | 0.988048 | FAP AND NOT-SLMAP AND IL20RB | 0.866667 | 1 | 0.764706 |
| NOT-MTUS1 AND NOT-IL2RB AND DDX3X | 0.93837 | 0.936508 | 0.940239 | FAP AND NOT-SLMAP AND TAS2R40 | 0.866667 | 1 | 0.764706 |
| NOT-WLS AND CXCR4 AND NOT-CR2 | 0.938224 | 0.910112 | 0.968127 | FAP AND NOT-ABCB1 AND FGFR3 | 0.827586 | 1 | 0.705882 |
| NOT-PODXL AND NOT-GPR171 AND DDX3X | 0.938224 | 0.910112 | 0.968127 | FAP AND NOT-SIGLEC6 AND IL22RA1 | 0.827586 | 1 | 0.705882 |
| NOT-PTPRK AND CSF3R AND NOT-FCRL1 | 0.937984 | 0.913208 | 0.964143 | FAP AND NOT-ABCB1 AND TAS2R9 | 0.827586 | 1 | 0.705882 |
| NOT-DAG1 AND DDX3X AND NOT-GPR171 | 0.937984 | 0.913208 | 0.964143 | NOT-EPCAM AND SLC2A10 AND NOT-ABCB1 | 0.827586 | 1 | 0.705882 |
| NOT-WLS AND P2RX1 AND NOT-CD72 | 0.937743 | 0.91635 | 0.960159 | FAP AND NOT-ABCB1 AND GP5 | 0.827586 | 1 | 0.705882 |
| NOT-PTPRK AND CD37 AND NOT-TRAT1 | 0.937743 | 0.91635 | 0.960159 | ADAM12 AND NOT-SPINT1 AND NOT-CLDN6 | 0.918919 | 0.85 | 1 |
| NOT-PTPRK AND NOT-GPR171 AND ANXA1 | 0.937618 | 0.892086 | 0.988048 | ADAM12 AND NOT-CLDN8 AND TAS2R40 | 0.894737 | 0.809524 | 1 |
| NOT-PODXL AND TAAR5 AND NOT-CD160 | 0.941406 | 0.923372 | 0.960159 | FAP AND NOT-SLMAP AND CLEC12A | 0.866667 | 1 | 0.764706 |
| NOT-WLS AND P2RX1 AND NOT-CD79A | 0.9375 | 0.91954 | 0.956175 | ADAM12 AND NOT-EPCAM AND GPR82 | 0.894737 | 0.809524 | 1 |
| NOT-PERP AND HCST AND NOT-HLA-DOB | 0.937381 | 0.894928 | 0.984064 | NOT-EPCAM AND FAM57A AND NOT-ABCB1 | 0.823529 | 0.823529 | 0.823529 |
| NOT-PTPRK AND CD37 AND NOT-KLRD1 | 0.936902 | 0.900735 | 0.976096 | FAP AND NOT-SLMAP AND FLT3LG | 0.866667 | 1 | 0.764706 |
| NOT-PTPRK AND CSF3R AND NOT-FCRL5 | 0.942748 | 0.904762 | 0.984064 | FAP AND NOT-SLMAP AND NOT-ERVFRD-1 | 0.866667 | 1 | 0.764706 |
| NOT-PTPRK AND CSF3R AND NOT-HLA-DOB | 0.93633 | 0.883392 | 0.996016 | NOT-EPCAM AND FAM57A AND KIR2DL3 | 0.848485 | 0.875 | 0.823529 |
| NOT-PODXL AND NOT-GPR171 AND CD33 | 0.954455 | 0.948819 | 0.960159 | ADAM12 AND NOT-EPCAM AND NOT-PRLR | 0.820513 | 0.727273 | 0.941176 |
| NOT-PODXL AND NOT-GPR171 AND CD33 | 0.954455 | 0.948819 | 0.960159 | FAP AND NOT-SLMAP AND NOT-OR10A4 | 0.827586 | 1 | 0.705882 |
| NOT-PTPRK AND NOT-IL7R AND CD33 | 0.95069 | 0.941406 | 0.960159 | FAP AND NOT-SLMAP AND GRIN3B | 0.827586 | 1 | 0.705882 |
| NOT-PTPRK AND NOT-IL7R AND CD33 | 0.95069 | 0.941406 | 0.960159 | FAP AND NOT-SLMAP AND TAS2R14 | 0.866667 | 1 | 0.764706 |
| NOT-PODXL AND CD33 AND NOT-BTN3A2 | 0.949698 | 0.95935 | 0.940239 | NOT-EPCAM AND FAM57A AND NOT-LTA | 0.823529 | 0.823529 | 0.823529 |
| NOT-PODXL AND CD33 AND NOT-KLRD1 | 0.949416 | 0.927757 | 0.972112 | ADAM12 AND GP5 AND NOT-SLC34A2 | 0.829268 | 0.708333 | 1 |
| NOT-PTPRK AND NOT-BTN3A2 AND CD33 | 0.94929 | 0.966942 | 0.932271 | FAP AND NOT-HPN AND GPR160 | 0.866667 | 1 | 0.764706 |
| NOT-PTPRK AND NOT-BTN3A2 AND CD33 | 0.94929 | 0.966942 | 0.932271 | ADAM12 AND NOT-CLDN8 AND AQP4 | 0.894737 | 0.809524 | 1 |
| NOT-PODXL AND CD33 AND NOT-PTGDR | 0.949219 | 0.931034 | 0.968127 | NOT-EPCAM AND FAM57A AND NOT-TSPAN32 | 0.823529 | 0.823529 | 0.823529 |
| NOT-PTPRK AND NOT-GPR171 AND CD33 | 0.948413 | 0.944664 | 0.952191 | NOT-EPCAM AND FAM57A AND NOT-CORIN | 0.823529 | 0.823529 | 0.823529 |
| NOT-PTPRK AND NOT-GPR171 AND CD33 | 0.948413 | 0.944664 | 0.952191 | ADAM12 AND NOT-CLDN8 AND TAS2R14 | 0.894737 | 0.809524 | 1 |
| NOT-PODXL AND CD33 AND NOT-CD8B | 0.945313 | 0.927203 | 0.964143 | NOT-EPCAM AND FAM57A AND NOT-SLC24A4 | 0.848485 | 0.875 | 0.823529 |
| NOT-PTPRK AND NOT-KLRF1 AND CD33 | 0.945098 | 0.930502 | 0.960159 | OSMR AND NOT-ABCB1 AND NOT-CLDN8 | 0.83871 | 0.928571 | 0.764706 |
| NOT-PTPRK AND NOT-CD247 AND CD33 | 0.945098 | 0.930502 | 0.960159 | NOT-EPCAM AND SLC2A10 AND SLC9A5 | 0.827586 | 1 | 0.705882 |
| NOT-PTPRK AND NOT-KLRF1 AND CD33 | 0.945098 | 0.930502 | 0.960159 | OSMR AND NOT-ACPP AND NOT-IL3RA | 0.866667 | 1 | 0.764706 |
| NOT-PTPRK AND NOT-CD247 AND CD33 | 0.945098 | 0.930502 | 0.960159 | NOT-EPCAM AND SLC2A10 AND OR10H2 | 0.827586 | 1 | 0.705882 |
| NOT-PTPRK AND NOT-P2RY10 AND CD33 | 0.960317 | 0.956522 | 0.964143 | NOT-EPCAM AND SLC2A10 AND CORIN | 0.827586 | 1 | 0.705882 |
| NOT-PTPRK AND NOT-P2RY10 AND CD33 | 0.960317 | 0.956522 | 0.964143 | ADAM12 AND GP5 AND NOT-CLDN7 | 0.829268 | 0.708333 | 1 |
| NOT-PODXL AND CD33 AND NOT-P2RY10 | 0.943907 | 0.917293 | 0.972112 | DDR2 AND NOT-CLDN8 AND MUC15 | 0.8 | 0.923077 | 0.705882 |
| NOT-PODXL AND CD33 AND NOT-SIRPG | 0.94347 | 0.923664 | 0.964143 | DDR2 AND NOT-CLDN8 AND TAS2R40 | 0.8 | 0.923077 | 0.705882 |
| NOT-PODXL AND CD33 AND NOT-SIRPG | 0.94347 | 0.923664 | 0.964143 | NOT-EPCAM AND SLC2A10 AND GPR82 | 0.827586 | 1 | 0.705882 |
| NOT-PODXL AND CD33 AND NOT-LY9 | 0.943907 | 0.917293 | 0.972112 | DDR2 AND NOT-CLDN8 AND PRLR | 0.8 | 0.923077 | 0.705882 |
| NOT-PODXL AND CD33 AND NOT-SIT1 | 0.945525 | 0.923954 | 0.968127 | DDR2 AND NOT-CLDN8 AND CORIN | 0.8 | 0.923077 | 0.705882 |
| NOT-PODXL AND CD33 AND NOT-KLRB1 | 0.942801 | 0.933594 | 0.952191 | DDR2 AND NOT-CLDN8 AND KIR2DL3 | 0.8 | 0.923077 | 0.705882 |
| NOT-PODXL AND NOT-LTB AND CD33 | 0.942623 | 0.970464 | 0.916335 | OSMR AND NOT-SPINT1 AND NOT-CLDN6 | 0.875 | 0.933333 | 0.823529 |
| NOT-PODXL AND NOT-LTB AND CD33 | 0.942623 | 0.970464 | 0.916335 | DDR2 AND NOT-CLDN8 AND TAS2R9 | 0.8 | 0.923077 | 0.705882 |
| NOT-PTPRK AND NOT-KLRB1 AND CD33 | 0.942116 | 0.944 | 0.940239 | DDR2 AND NOT-CLDN8 AND CD4 | 0.8 | 0.923077 | 0.705882 |
| NOT-PTPRK AND NOT-KLRB1 AND CD33 | 0.942116 | 0.944 | 0.940239 | NOT-EPCAM AND FAM57A AND NOT-OR7A17 | 0.848485 | 0.875 | 0.823529 |
| NOT-PTPRK AND NOT-CD8B AND CD33 | 0.940945 | 0.929961 | 0.952191 | NOT-EPCAM AND FAM57A AND NOT-TAS2R9 | 0.8125 | 0.866667 | 0.764706 |
| NOT-PTPRK AND NOT-CD8B AND CD33 | 0.940945 | 0.929961 | 0.952191 | OSMR AND NOT-ABCB1 AND NOT-EPCAM | 0.875 | 0.933333 | 0.823529 |
| NOT-PODXL AND CD33 AND NOT-BTLA | 0.947368 | 0.927481 | 0.968127 | FAP AND NOT-SLMAP AND NOT-GPR160 | 0.866667 | 1 | 0.764706 |
| NOT-PODXL AND CD33 AND NOT-CD28 | 0.942801 | 0.933594 | 0.952191 | ADAM12 AND GP5 AND NOT-SSTR5 | 0.871795 | 0.772727 | 1 |
| NOT-PODXL AND NOT-AMIGO2 AND CD33 | 0.940711 | 0.933333 | 0.948207 | DDR2 AND NOT-CLDN8 AND TAS2R14 | 0.8 | 0.923077 | 0.705882 |
| NOT-PODXL AND NOT-AMIGO2 AND CD33 | 0.940711 | 0.933333 | 0.948207 | DDR2 AND NOT-CLDN8 AND OR7A17 | 0.8 | 0.923077 | 0.705882 |
| NOT-PTPRK AND NOT-BTLA AND CD33 | 0.943249 | 0.926923 | 0.960159 | DDR2 AND NOT-CLDN8 AND FLT3LG | 0.8 | 0.923077 | 0.705882 |
| NOT-PTPRK AND NOT-BTLA AND CD33 | 0.943249 | 0.926923 | 0.960159 | FAP AND NOT-KCNMB2 AND NOT-ACPP | 0.866667 | 1 | 0.764706 |

FIG. 15 (cont.)

| Antigen Pair Logic | F1 | Precision | Recall | Antigen Pair Logic | F1 | Precision | Recall |
|---|---|---|---|---|---|---|---|
| NOT-PODXL AND CD33 AND NOT-CD8A | 0.939335 | 0.923077 | 0.956175 | FAP AND NOT-NPC1L1 AND EDA | 0.866667 | 1 | 0.764706 |
| NOT-PTPRK AND CD33 AND NOT-CLEC2D | 0.945098 | 0.930502 | 0.960159 | ADAM12 AND NOT-ST14 AND FCRL1 | 0.809524 | 0.68 | 1 |
| NOT-PODXL AND CD33 AND NOT-CLEC4A | 0.955645 | 0.967347 | 0.944223 | ADAM12 AND GP5 AND NOT-MUC16 | 0.918919 | 0.85 | 1 |
| NOT-SGCB AND CD33 AND NOT-KLRF1 | 0.938614 | 0.933071 | 0.944223 | FAP AND NOT-LTA AND TAS2R9 | 0.866667 | 1 | 0.764706 |
| NOT-PODXL AND CD33 AND NOT-IL7R | 0.938224 | 0.910112 | 0.968127 | FAP AND NOT-LTA AND IL1RAPL1 | 0.866667 | 1 | 0.764706 |
| NOT-PTPRK AND NOT-TIGIT AND CD33 | 0.947368 | 0.927481 | 0.968127 | FAP AND NOT-LTA AND CADM2 | 0.866667 | 1 | 0.764706 |
| NOT-PTPRK AND NOT-TIGIT AND CD33 | 0.947368 | 0.927481 | 0.968127 | NOT-EPCAM AND SLC2A10 AND KIR2DL3 | 0.827586 | 1 | 0.705882 |
| NOT-PODXL AND CD33 AND NOT-FCRL3 | 0.947368 | 0.927481 | 0.968127 | OSMR AND NOT-FOLR1 AND NOT-ST14 | 0.83871 | 0.928571 | 0.764706 |
| NOT-PTPRK AND NOT-SIRPG AND CD33 | 0.9375 | 0.91954 | 0.956175 | OSMR AND NOT-EPCAM AND NOT-PRLR | 0.83871 | 0.928571 | 0.764706 |
| NOT-PTPRK AND NOT-SIRPG AND CD33 | 0.9375 | 0.91954 | 0.956175 | NOT-EPCAM AND SLC2A10 AND GJD4 | 0.827586 | 1 | 0.705882 |
| NOT-PODXL AND CD33 AND NOT-HEG1 | 0.9375 | 0.91954 | 0.956175 | OSMR AND NOT-CXADR AND NOT-CLDN6 | 0.875 | 0.933333 | 0.823529 |
| NOT-PODXL AND CD33 AND NOT-HEG1 | 0.9375 | 0.91954 | 0.956175 | NOT-EPCAM AND SLC2A10 AND TAS2R9 | 0.827586 | 1 | 0.705882 |
| NOT-PTPRK AND NOT-CD8A AND CD33 | 0.937008 | 0.92607 | 0.948207 | FAP AND NOT-NPC1L1 AND GPR160 | 0.866667 | 1 | 0.764706 |
| NOT-PTPRK AND NOT-CD8A AND CD33 | 0.937008 | 0.92607 | 0.948207 | FAP AND NOT-NPC1L1 AND ICOS | 0.866667 | 1 | 0.764706 |
| NOT-PODXL AND CD33 AND NOT-SLAMF6 | 0.942085 | 0.913858 | 0.972112 | FAP AND NOT-PTGER3 AND NOT-ACPP | 0.827586 | 1 | 0.705882 |
| NOT-PTPRK AND CD33 AND NOT-STX7 | 0.965795 | 0.97561 | 0.956175 | FAP AND NOT-MFSD3 AND CADM2 | 0.827586 | 1 | 0.705882 |
| NOT-PODXL AND CD33 AND NOT-KLRF1 | 0.936508 | 0.932806 | 0.940239 | NOT-EPCAM AND FAM57A AND NOT-MUC15 | 0.8125 | 0.866667 | 0.764706 |
| NOT-PTPRK AND CD33 AND NOT-CLEC4A | 0.959514 | 0.975309 | 0.944223 | FAP AND NOT-MFSD3 AND IL1RAPL1 | 0.827586 | 1 | 0.705882 |
| NOT-PODXL AND CD33 AND NOT-CD3G | 0.93617 | 0.909774 | 0.964143 | ADAM12 AND NOT-VTCN1 AND CADM2 | 0.871795 | 0.772727 | 1 |
| NOT-PTPRK AND CD33 AND NOT-SIT1 | 0.941406 | 0.923372 | 0.960159 | ADAM12 AND NOT-CLDN8 AND FLT3LG | 0.871795 | 0.772727 | 1 |
| NOT-PTPRK AND CD33 AND NOT-SIT1 | 0.941406 | 0.923372 | 0.960159 | FAP AND NOT-EPCAM AND CD4 | 0.866667 | 1 | 0.764706 |
| NOT-PODXL AND CD33 AND NOT-PAG1 | 0.935167 | 0.922481 | 0.948207 | FAP AND NOT-ABCB1 AND NOT-EPCAM | 0.866667 | 1 | 0.764706 |
| NOT-PODXL AND CD33 AND NOT-STX7 | 0.968 | 0.971888 | 0.964143 | FAP AND NOT-SLMAP AND NOT-CLDN7 | 0.866667 | 1 | 0.764706 |
| NOT-PODXL AND CD33 AND NOT-CD247 | 0.934615 | 0.903346 | 0.968127 | FAP AND NOT-SLMAP AND NOT-SLC34A2 | 0.866667 | 1 | 0.764706 |
| NOT-PODXL AND CD33 AND NOT-TIGIT | 0.934615 | 0.903346 | 0.968127 | FAP AND NOT-CLDN6 AND NOT-SPINT1 | 0.866667 | 1 | 0.764706 |
| NOT-PODXL AND CD33 AND NOT-TIGIT | 0.934615 | 0.903346 | 0.968127 | FAP AND NOT-CLDN6 AND NOT-ACPP | 0.866667 | 1 | 0.764706 |
| NOT-PTPRK AND NOT-WLS AND CD33 | 0.934132 | 0.936 | 0.932271 | FAP AND NOT-CLDN8 AND CORIN | 0.827586 | 1 | 0.705882 |
| NOT-PTPRK AND NOT-WLS AND CD33 | 0.934132 | 0.936 | 0.932271 | FAP AND NOT-CLDN8 AND KIR2DL3 | 0.827586 | 1 | 0.705882 |
| NOT-PODXL AND CD33 AND NOT-CLEC2D | 0.947368 | 0.927481 | 0.968127 | FAP AND NOT-CLDN8 AND CD4 | 0.827586 | 1 | 0.705882 |
| NOT-PODXL AND NOT-CD27 AND CD33 | 0.933868 | 0.939516 | 0.928287 | FAP AND NOT-CLDN8 AND AQP4 | 0.827586 | 1 | 0.705882 |
| NOT-PODXL AND CD33 AND NOT-NPC1 | 0.934911 | 0.925781 | 0.944223 | FAP AND NOT-CLDN8 AND TAS2R40 | 0.827586 | 1 | 0.705882 |
| NOT-PODXL AND CD33 AND NOT-ADTRP | 0.938462 | 0.907063 | 0.972112 | FAP AND NOT-CLDN6 AND NOT-ST14 | 0.866667 | 1 | 0.764706 |
| NOT-PODXL AND CD33 AND NOT-CD40LG | 0.945525 | 0.923954 | 0.968127 | FAP AND NOT-CLDN6 AND NOT-CDHR1 | 0.866667 | 1 | 0.764706 |
| NOT-PODXL AND CD33 AND NOT-ST3GAL5 | 0.939335 | 0.923077 | 0.956175 | FAP AND NOT-CLDN8 AND FLT3LG | 0.827586 | 1 | 0.705882 |
| NOT-PTPRK AND CD33 AND NOT-CD300A | 0.931393 | 0.973913 | 0.89243 | NOT-EPCAM AND FAM57A AND NOT-CXCR5 | 0.823529 | 0.823529 | 0.823529 |
| NOT-PTPRK AND CD33 AND NOT-CCR7 | 0.946535 | 0.940945 | 0.952191 | FAP AND NOT-EPCAM AND ITGB2 | 0.827586 | 1 | 0.705882 |
| NOT-PODXL AND CD33 AND NOT-CD5 | 0.945313 | 0.927203 | 0.964143 | FAP AND NOT-TSPAN32 AND NOT-EPCAM | 0.827586 | 1 | 0.705882 |
| NOT-SGCB AND CD33 AND NOT-SIRPG | 0.930966 | 0.921875 | 0.940239 | DDR2 AND NOT-CLDN8 AND MUC4 | 0.8 | 0.923077 | 0.705882 |
| NOT-PODXL AND CD33 AND NOT-PAG1 | 0.930502 | 0.902622 | 0.960159 | FAP AND NOT-LTA AND NOT-EPCAM | 0.866667 | 1 | 0.764706 |
| NOT-PTPRK AND CD33 AND NOT-TNFSF10 | 0.939516 | 0.95102 | 0.928287 | FAP AND NOT-EPCAM AND NOT-TAS2R14 | 0.866667 | 1 | 0.764706 |
| NOT-PTPRK AND NOT-CD3G AND CD33 | 0.930233 | 0.90566 | 0.956175 | NOT-EPCAM AND SLC2A10 AND CD34 | 0.827586 | 1 | 0.705882 |
| NOT-PTPRK AND NOT-CD3G AND CD33 | 0.930233 | 0.90566 | 0.956175 | NOT-EPCAM AND SLC2A10 AND MUC4 | 0.827586 | 1 | 0.705882 |
| NOT-SGCB AND CD33 AND NOT-CD8B | 0.930966 | 0.921875 | 0.940239 | ADAM12 AND NOT-CLDN8 AND MUC4 | 0.85 | 0.73913 | 1 |
| NOT-PTPRK AND CD33 AND NOT-IL18R1 | 0.930233 | 0.90566 | 0.956175 | FAP AND NOT-NPC1L1 AND MUC4 | 0.866667 | 1 | 0.764706 |
| NOT-PTPRK AND NOT-CD40LG AND CD33 | 0.946955 | 0.934109 | 0.960159 | NOT-EPCAM AND FOLH1 AND CD63 | 0.823529 | 0.823529 | 0.823529 |
| NOT-PTPRK AND NOT-CD40LG AND CD33 | 0.946955 | 0.934109 | 0.960159 | FAP AND NOT-EPCAM AND NOT-OR7A17 | 0.866667 | 1 | 0.764706 |
| NOT-SGCB AND CD33 AND NOT-P2RY10 | 0.937876 | 0.943548 | 0.932271 | FAP AND NOT-EPCAM AND TGFA | 0.866667 | 1 | 0.764706 |
| NOT-PODXL AND NOT-IL2RB AND CD33 | 0.929134 | 0.918288 | 0.940239 | FAP AND NOT-EPCAM AND KIR2DL3 | 0.866667 | 1 | 0.764706 |
| NOT-PTPRK AND NOT-NPC1 AND CD33 | 0.929134 | 0.918288 | 0.940239 | FAP AND NOT-EPCAM AND NOT-SLC9A3 | 0.827586 | 1 | 0.705882 |
| NOT-PODXL AND NOT-IL2RB AND CD33 | 0.929134 | 0.918288 | 0.940239 | FAP AND NOT-EPCAM AND NOT-CDH26 | 0.827586 | 1 | 0.705882 |
| NOT-PTPRK AND NOT-NPC1 AND CD33 | 0.929134 | 0.918288 | 0.940239 | FAP AND NOT-EPCAM AND TAS2R9 | 0.866667 | 1 | 0.764706 |
| NOT-PTPRK AND CD33 AND NOT-CD5 | 0.928709 | 0.899254 | 0.960159 | FAP AND NOT-EPCAM AND NRG1 | 0.866667 | 1 | 0.764706 |
| NOT-PODXL AND CD33 AND NOT-CCR6 | 0.929254 | 0.893382 | 0.968127 | FAP AND NOT-EPCAM AND NOT-OR10H2 | 0.827586 | 1 | 0.705882 |
| NOT-PODXL AND CD33 AND NOT-ITGAL | 0.927875 | 0.908397 | 0.948207 | FAP AND NOT-GRIN3B AND MUC4 | 0.866667 | 1 | 0.764706 |
| NOT-PODXL AND CD33 AND NOT-EPHA4 | 0.927757 | 0.887273 | 0.972112 | ADAM12 AND NOT-CLDN7 AND NOT-MUC16 | 0.871795 | 0.772727 | 1 |
| NOT-PTPRK AND CD33 AND NOT-TGFBR2 | 0.960317 | 0.956522 | 0.964143 | FAP AND NOT-TSPAN32 AND CLDN7 | 0.827586 | 1 | 0.705882 |
| NOT-PTPRK AND NOT-CD27 AND CD33 | 0.931452 | 0.942857 | 0.920319 | VMP1 AND NOT-EPCAM AND CD34 | 0.8125 | 0.866667 | 0.764706 |
| NOT-TMEM47 AND NOT-IL2RB AND CD33 | 0.927308 | 0.914729 | 0.940239 | FAP AND NOT-EPCAM AND TLR4 | 0.827586 | 1 | 0.705882 |
| NOT-PODXL AND CD33 AND NOT-HMOX2 | 0.927203 | 0.892989 | 0.964143 | ADAM12 AND NOT-CLDN7 AND MUC4 | 0.829268 | 0.708333 | 1 |
| NOT-PTPRK AND CD33 AND NOT-DPP4 | 0.927203 | 0.892989 | 0.964143 | FAP AND NOT-TAS2R14 AND NOT-SLC34A2 | 0.866667 | 1 | 0.764706 |
| NOT-PODXL AND CD33 AND NOT-ICOS | 0.926733 | 0.92126 | 0.932271 | FAP AND NOT-OR7A17 AND NOT-VTCN1 | 0.866667 | 1 | 0.764706 |
| NOT-PTPRK AND CD33 AND NOT-ADTRP | 0.934363 | 0.906367 | 0.964143 | FAP AND NOT-SSTR5 AND TAS2R9 | 0.866667 | 1 | 0.764706 |
| NOT-PTPRK AND CD33 AND NOT-HVCN1 | 0.92562 | 0.961373 | 0.89243 | FAP AND NOT-TAS2R14 AND NOT-CLDN7 | 0.866667 | 1 | 0.764706 |
| NOT-PTPRK AND CD33 AND NOT-HMOX2 | 0.954092 | 0.956 | 0.952191 | FAP AND NOT-CXCR5 AND ICOS | 0.866667 | 1 | 0.764706 |
| NOT-PTPRK AND NOT-PHLDB2 AND P2RX4 | 0.96063 | 0.949416 | 0.972112 | FAP AND NOT-CXCR5 AND OR10H2 | 0.866667 | 1 | 0.764706 |
| NOT-PHLDB2 AND EMP3 AND NOT-P2RY10 | 0.967742 | 0.979592 | 0.956175 | FAP AND NOT-SSTR5 AND GP5 | 0.866667 | 1 | 0.764706 |
| NOT-WLS AND SLC22A16 AND VAMP8 | 0.957576 | 0.971311 | 0.944223 | FAP AND NOT-TAS2R14 AND NOT-VTCN1 | 0.827586 | 1 | 0.705882 |
| NOT-PHLDB2 AND EMP3 AND TAAR5 | 0.95723 | 0.979167 | 0.936255 | FAP AND NOT-CXCR5 AND GPR63 | 0.866667 | 1 | 0.764706 |
| NOT-PHLDB2 AND EMP3 AND NOT-SLC44A2 | 0.96 | 0.963855 | 0.956175 | FAP AND NOT-TAS2R14 AND MUC16 | 0.866667 | 1 | 0.764706 |
| NOT-PHLDB2 AND HCST AND NOT-LAT | 0.957031 | 0.938697 | 0.976096 | SLC38A6 AND NOT-EPCAM AND MUC4 | 0.8125 | 0.866667 | 0.764706 |
| NOT-PHLDB2 AND NOT-KIAA1324 AND P2RX4 | 0.956863 | 0.942085 | 0.972112 | FAP AND NOT-CXCR5 AND GP5 | 0.866667 | 1 | 0.764706 |
| NOT-WLS AND SLC22A16 AND EMP3 | 0.955466 | 0.971193 | 0.940239 | FAP AND NOT-CXCR5 AND IL1RAPL1 | 0.866667 | 1 | 0.764706 |
| NOT-PHLDB2 AND HCST AND P2RX4 | 0.964427 | 0.956863 | 0.972112 | NOT-EPCAM AND GPNMB AND CD4 | 0.882353 | 0.882353 | 0.882353 |
| NOT-PHLDB2 AND HCST AND P2RX4 | 0.964427 | 0.956863 | 0.972112 | FAP AND NOT-VTCN1 AND GPR63 | 0.827586 | 1 | 0.705882 |
| NOT-PHLDB2 AND NOT-SLC4A4 AND P2RX4 | 0.954635 | 0.945313 | 0.964143 | FAP AND NOT-VTCN1 AND CADM2 | 0.827586 | 1 | 0.705882 |
| NOT-PHLDB2 AND NOT-SLC4A4 AND P2RX4 | 0.954635 | 0.945313 | 0.964143 | FAP AND NOT-TAS2R14 AND CXCR5 | 0.827586 | 1 | 0.705882 |
| NOT-PHLDB2 AND CXCR4 AND P2RX4 | 0.96063 | 0.949416 | 0.972112 | FAP AND NOT-MUC16 AND ICOS | 0.866667 | 1 | 0.764706 |

FIG. 15 (cont.)

| Antigen Pair Logic | F1 | Precision | Recall | Antigen Pair Logic | F1 | Precision | Recall |
|---|---|---|---|---|---|---|---|
| NOT-PHLDB2 AND CXCR4 AND P2RX4 | 0.96063 | 0.949416 | 0.972112 | ROR1 AND NOT-ABCB1 AND NOT-EPCAM | 0.866667 | 1 | 0.764706 |
| NOT-PHLDB2 AND EMP3 AND NOT-BTN3A2 | 0.953722 | 0.963415 | 0.944223 | ROR1 AND NOT-CLDN6 AND NOT-CXADR | 0.866667 | 1 | 0.764706 |
| NOT-WLS AND SLC22A16 AND LAPTM5 | 0.953722 | 0.963415 | 0.944223 | ROR1 AND NOT-CLDN6 AND NOT-SPINT1 | 0.866667 | 1 | 0.764706 |
| NOT-PHLDB2 AND HCST AND SLC39A8 | 0.96146 | 0.979339 | 0.944223 | ROR1 AND NOT-CLDN6 AND NOT-ACPP | 0.866667 | 1 | 0.764706 |
| NOT-PHLDB2 AND NOT-ABHD6 AND P2RX4 | 0.953125 | 0.934866 | 0.972112 | FAP AND NOT-CXCR5 AND NOT-ST14 | 0.866667 | 1 | 0.764706 |
| NOT-PHLDB2 AND NOT-ABHD6 AND P2RX4 | 0.953125 | 0.934866 | 0.972112 | FAP AND NOT-SLC34A2 AND NOT-TAS2R9 | 0.827586 | 1 | 0.705882 |
| SLC22A16 AND NOT-PHLDB2 AND FXYD5 | 0.952577 | 0.987179 | 0.920319 | FAP AND NOT-CXCR5 AND CHRM4 | 0.866667 | 1 | 0.764706 |
| FLT3 AND EMP3 AND NOT-ATP8B1 | 0.952381 | 0.991379 | 0.916335 | FAP AND NOT-AGTR2 AND PCDHGC4 | 0.866667 | 1 | 0.764706 |
| FLT3 AND EMP3 AND NOT-GHR | 0.952381 | 0.991379 | 0.916335 | FAP AND NOT-GUCY2F AND FXYD7 | 0.827586 | 1 | 0.705882 |
| NOT-PHLDB2 AND NOT-SLC25A4 AND P2RX4 | 0.956863 | 0.942085 | 0.972112 | FAP AND NOT-AGTR2 AND PCDHAC2 | 0.866667 | 1 | 0.764706 |
| NOT-PHLDB2 AND NOT-SLC25A4 AND P2RX4 | 0.956863 | 0.942085 | 0.972112 | FAP AND NOT-OR8D1 AND LRRC52 | 0.866667 | 1 | 0.764706 |
| NOT-PHLDB2 AND HCST AND SLC30A1 | 0.952015 | 0.918519 | 0.988048 | FAP AND NOT-OR8D1 AND SLC34A1 | 0.866667 | 1 | 0.764706 |
| NOT-PHLDB2 AND HCST AND SLC30A1 | 0.952015 | 0.918519 | 0.988048 | FAP AND NOT-OR8D1 AND PCDHAC2 | 0.866667 | 1 | 0.764706 |
| NOT-PHLDB2 AND CXCR4 AND NOT-SEMA4D | 0.95183 | 0.921642 | 0.984064 | FAP AND NOT-OR8D1 AND EPHA10 | 0.866667 | 1 | 0.764706 |
| P2RY8 AND NOT-PHLDB2 AND P2RX4 | 0.956175 | 0.956175 | 0.956175 | FAP AND NOT-OR8D1 AND GJA10 | 0.866667 | 1 | 0.764706 |
| P2RY8 AND NOT-PHLDB2 AND P2RX4 | 0.956175 | 0.956175 | 0.956175 | FAP AND NOT-TSPAN16 AND PCDHAC2 | 0.866667 | 1 | 0.764706 |
| SLC22A16 AND HCST AND NOT-PHLDB2 | 0.950617 | 0.982979 | 0.920319 | FAP AND NOT-OR8D1 AND SLC5A8 | 0.827586 | 1 | 0.705882 |
| COMPLEX-FLT3/ATP8B1/CD44 | 0.950617 | 0.982979 | 0.920319 | TGFBI AND NOT-EPCAM AND NOT-ACSL6 | 0.909091 | 0.9375 | 0.882353 |
| SLC22A16 AND NOT-PHLDB2 AND CD69 | 0.950413 | 0.987124 | 0.916335 | FAP AND NOT-CRB2 AND HTR6 | 0.827586 | 1 | 0.705882 |
| NOT-PTPRK AND CD44 AND NOT-BTN3A1 | 0.950192 | 0.915129 | 0.988048 | FAP AND NOT-SLC39A2 AND GJA10 | 0.866667 | 1 | 0.764706 |
| NOT-PHLDB2 AND ITGA5 AND P2RX4 | 0.951417 | 0.967078 | 0.936255 | FAP AND NOT-SLC39A2 AND FXYD7 | 0.866667 | 1 | 0.764706 |
| NOT-PTPRK AND NOT-LAT AND SLC30A1 | 0.957529 | 0.928839 | 0.988048 | FAP AND NOT-SLC39A2 AND PCDHGC4 | 0.866667 | 1 | 0.764706 |
| NOT-PTPRK AND NOT-LAT AND SLC30A1 | 0.957529 | 0.928839 | 0.988048 | NOT-EPCAM AND SLC31A1 AND NOT-ACSL6 | 0.833333 | 0.789474 | 0.882353 |
| NOT-PHLDB2 AND NOT-KCNK1 AND P2RX4 | 0.9501 | 0.952 | 0.948207 | FAP AND NOT-NPBWR1 AND SV2C | 0.866667 | 1 | 0.764706 |
| NOT-PHLDB2 AND P2RX4 AND NOT-TSPAN15 | 0.949416 | 0.927757 | 0.972112 | FAP AND NOT-SLC39A2 AND PLVAP | 0.866667 | 1 | 0.764706 |
| NOT-PHLDB2 AND NOT-MRAP2 AND P2RX4 | 0.949416 | 0.927757 | 0.972112 | FAP AND NOT-NPBWR1 AND GHSR | 0.866667 | 1 | 0.764706 |
| NOT-PHLDB2 AND NOT-MRAP2 AND P2RX4 | 0.949416 | 0.927757 | 0.972112 | FAP AND NOT-NPBWR1 AND CALN1 | 0.866667 | 1 | 0.764706 |
| NOT-PHLDB2 AND P2RX4 AND NOT-TSPAN15 | 0.949416 | 0.927757 | 0.972112 | FAP AND NOT-NPBWR1 AND PCDHGC4 | 0.866667 | 1 | 0.764706 |
| NOT-PHLDB2 AND HCST AND NOT-BTN3A1 | 0.966862 | 0.946565 | 0.988048 | FAP AND NOT-HTR6 AND PCDHGC4 | 0.827586 | 1 | 0.705882 |
| SLC22A16 AND NOT-LAMP3 AND NOT-GHR | 0.94929 | 0.966942 | 0.932271 | FAP AND NOT-HTR6 AND SV2C | 0.827586 | 1 | 0.705882 |
| SLC22A16 AND NOT-TSPAN1 AND NOT-PHLDB2 | 0.948665 | 0.978814 | 0.920319 | FAP AND NOT-HTR6 AND CALN1 | 0.827586 | 1 | 0.705882 |
| SLC22A16 AND P2RY8 AND NOT-PHLDB2 | 0.948665 | 0.978814 | 0.920319 | ROR1 AND NOT-AGTR2 AND PLVAP | 0.866667 | 1 | 0.764706 |
| SLC22A16 AND NOT-SLC6A16 AND NOT-PHLDB2 | 0.948665 | 0.978814 | 0.920319 | FAP AND NOT-NPBWR1 AND ADCY10 | 0.866667 | 1 | 0.764706 |
| SLC22A16 AND NOT-LAMP3 AND NOT-PHLDB2 | 0.948665 | 0.978814 | 0.920319 | FAP AND NOT-HTR6 AND GJA10 | 0.827586 | 1 | 0.705882 |
| SLC22A16 AND ICAM3 AND NOT-PHLDB2 | 0.948665 | 0.978814 | 0.920319 | ROR1 AND NOT-OR8D1 AND PLVAP | 0.866667 | 1 | 0.764706 |
| NOT-PTPRK AND NOT-PHLDB2 AND CD44 | 0.948375 | 0.911765 | 0.988048 | FAP AND NOT-HTR6 AND PLVAP | 0.827586 | 1 | 0.705882 |
| NOT-PHLDB2 AND CXCR4 AND NOT-BTN3A1 | 0.948375 | 0.911765 | 0.988048 | FAP AND NOT-NPBWR1 AND ROS1 | 0.866667 | 1 | 0.764706 |
| NOT-PTPRK AND NOT-PHLDB2 AND CD44 | 0.948375 | 0.911765 | 0.988048 | ROR1 AND NOT-SLC22A6 AND PLVAP | 0.866667 | 1 | 0.764706 |
| NOT-PHLDB2 AND NOT-KIAA1324 AND VAMP8 | 0.961089 | 0.939163 | 0.984064 | ROR1 AND NOT-GPR78 AND PLVAP | 0.866667 | 1 | 0.764706 |
| NOT-PHLDB2 AND NOT-KIAA1324 AND VAMP8 | 0.961089 | 0.939163 | 0.984064 | ROR1 AND PLVAP AND NOT-SLC39A2 | 0.866667 | 1 | 0.764706 |
| NOT-PHLDB2 AND CXCR4 AND NOT-SEMA4B | 0.948177 | 0.914815 | 0.984064 | ROR1 AND NOT-CCR9 AND PLVAP | 0.866667 | 1 | 0.764706 |
| NOT-PTPRK AND NOT-LAT AND P2RX4 | 0.947791 | 0.955466 | 0.940239 | FAP AND NOT-AGTR2 AND SV2C | 0.827586 | 1 | 0.705882 |
| SLC22A16 AND NOT-ATP8B1 AND NOT-EPHA4 | 0.947154 | 0.966805 | 0.928287 | ROR1 AND NOT-OR8D1 AND LRRC52 | 0.866667 | 1 | 0.764706 |
| SLC22A16 AND NOT-TMEM231 AND NOT-PHLDB2 | 0.946721 | 0.974684 | 0.920319 | FAP AND NOT-AGER AND ROS1 | 0.866667 | 1 | 0.764706 |
| SLC22A16 AND NOT-TSPAN6 AND NOT-PHLDB2 | 0.946721 | 0.974684 | 0.920319 | STAB1 AND FSHR AND NOT-CXCR5 | 0.827586 | 1 | 0.705882 |
| SLC22A16 AND NOT-LSR AND NOT-PHLDB2 | 0.946721 | 0.974684 | 0.920319 | ROR1 AND NOT-AGTR2 AND PCDHGC4 | 0.866667 | 1 | 0.764706 |
| SLC22A16 AND NOT-TUSC3 AND NOT-PHLDB2 | 0.946721 | 0.974684 | 0.920319 | ROR1 AND NOT-OR8D1 AND EPHA10 | 0.866667 | 1 | 0.764706 |
| NOT-PHLDB2 AND HCST AND VAMP8 | 0.946565 | 0.908425 | 0.988048 | ROR1 AND NOT-AGTR2 AND PCDHAC2 | 0.866667 | 1 | 0.764706 |
| NOT-PHLDB2 AND HCST AND VAMP8 | 0.946565 | 0.908425 | 0.988048 | ROR1 AND NOT-OR8D1 AND SLC34A1 | 0.866667 | 1 | 0.764706 |
| P2RY8 AND NOT-PHLDB2 AND SLC39A8 | 0.946535 | 0.940945 | 0.952191 | ROR1 AND PLVAP AND NOT-HTR6 | 0.866667 | 1 | 0.764706 |
| SLC22A16 AND CXCR4 AND NOT-PHLDB2 | 0.946502 | 0.978723 | 0.916335 | FAP AND NOT-CLDN8 AND CD93 | 0.827586 | 1 | 0.705882 |
| SLC22A16 AND EVI2B AND NOT-PHLDB2 | 0.946502 | 0.978723 | 0.916335 | FAP AND NOT-CLDN8 AND CD74 | 0.827586 | 1 | 0.705882 |
| NOT-ATP8B1 AND CD44 AND NOT-KLRB1 | 0.946322 | 0.944444 | 0.948207 | FAP AND NOT-CLDN8 AND LCT | 0.827586 | 1 | 0.705882 |
| NOT-PHLDB2 AND TAAR5 AND NOT-FAT1 | 0.9499 | 0.955645 | 0.944223 | FAP AND NOT-CLDN8 AND GJA10 | 0.827586 | 1 | 0.705882 |
| NOT-PHLDB2 AND GLIPR1 AND P2RX4 | 0.945892 | 0.951613 | 0.940239 | FAP AND NOT-CLDN8 AND GUCY2F | 0.827586 | 1 | 0.705882 |
| NOT-PHLDB2 AND SELL AND P2RX4 | 0.950298 | 0.948413 | 0.952191 | FAP AND NOT-GUCY2F AND NOT-EPCAM | 0.827586 | 1 | 0.705882 |
| NOT-PHLDB2 AND SELL AND P2RX4 | 0.950298 | 0.948413 | 0.952191 | FAP AND VAMP8 AND NOT-CLDN7 | 0.866667 | 1 | 0.764706 |
| P2RY8 AND NOT-PHLDB2 AND SLC30A1 | 0.945736 | 0.920755 | 0.972112 | NOT-EPCAM AND SLC31A1 AND CD34 | 0.882353 | 0.882353 | 0.882353 |
| P2RY8 AND NOT-PHLDB2 AND SLC30A1 | 0.945736 | 0.920755 | 0.972112 | TGFBI AND NOT-EPCAM AND CD34 | 0.9375 | 1 | 0.882353 |
| NOT-ATP8B1 AND CD44 AND NOT-GPR171 | 0.945736 | 0.920755 | 0.972112 | FAP AND NOT-SSTR5 AND GHSR | 0.866667 | 1 | 0.764706 |
| NOT-PHLDB2 AND NOT-PTPRF AND P2RX4 | 0.945736 | 0.920755 | 0.972112 | FAP AND NOT-SSTR5 AND PCDHAC2 | 0.866667 | 1 | 0.764706 |
| NOT-PHLDB2 AND NOT-PTPRF AND P2RX4 | 0.945736 | 0.920755 | 0.972112 | FAP AND NOT-SSTR5 AND GJA10 | 0.866667 | 1 | 0.764706 |
| NOT-PHLDB2 AND EVI2B AND SLC30A1 | 0.945946 | 0.917603 | 0.976096 | FAP AND NOT-SSTR5 AND SV2C | 0.866667 | 1 | 0.764706 |
| NOT-PHLDB2 AND EVI2B AND SLC30A1 | 0.945946 | 0.917603 | 0.976096 | FAP AND NOT-SSTR5 AND ADCY10 | 0.866667 | 1 | 0.764706 |
| NOT-PHLDB2 AND TAAR5 AND P2RX4 | 0.945892 | 0.951613 | 0.940239 | FAP AND NOT-SSTR5 AND GRIK4 | 0.866667 | 1 | 0.764706 |
| NOT-SGCE AND EMP3 AND NOT-BTN3A1 | 0.951456 | 0.92803 | 0.976096 | FAP AND NOT-SSTR5 AND PCDHGC4 | 0.827586 | 1 | 0.705882 |
| NOT-PHLDB2 AND NOT-LRIG3 AND LTBR | 0.945098 | 0.930502 | 0.960159 | FAP AND NOT-CXCR5 AND SV2C | 0.866667 | 1 | 0.764706 |
| NOT-PHLDB2 AND NOT-LRIG3 AND LTBR | 0.945098 | 0.930502 | 0.960159 | FAP AND NOT-CXCR5 AND PCDHGC4 | 0.827586 | 1 | 0.705882 |
| NOT-PHLDB2 AND EMP3 AND NOT-LY9 | 0.945098 | 0.930502 | 0.960159 | FAP AND NOT-CXCR5 AND GRIK4 | 0.866667 | 1 | 0.764706 |
| NOT-PHLDB2 AND NOT-LRIG3 AND LTBR | 0.945098 | 0.930502 | 0.960159 | FAP AND NOT-SLC39A2 AND NOT-CLDN7 | 0.866667 | 1 | 0.764706 |
| NOT-PHLDB2 AND FXYD5 AND P2RX4 | 0.964427 | 0.956863 | 0.972112 | FAP AND NOT-CXCR5 AND ROS1 | 0.866667 | 1 | 0.764706 |
| NOT-PHLDB2 AND FXYD5 AND P2RX4 | 0.964427 | 0.956863 | 0.972112 | FAP AND NOT-SLC34A2 AND ACSL6 | 0.827586 | 1 | 0.705882 |
| NOT-PHLDB2 AND EMP3 AND NOT-SIRPG | 0.944882 | 0.933852 | 0.956175 | FAP AND NOT-SLC34A2 AND PCDHGC4 | 0.866667 | 1 | 0.764706 |
| NOT-PHLDB2 AND EMP3 AND NOT-CD27 | 0.944882 | 0.933852 | 0.956175 | ROR1 AND NOT-CLDN6 AND PLVAP | 0.866667 | 1 | 0.764706 |
| NOT-PHLDB2 AND FXYD5 AND SLC30A1 | 0.955684 | 0.925373 | 0.988048 | ROR1 AND NOT-CLDN8 AND CD93 | 0.866667 | 1 | 0.764706 |
| NOT-PHLDB2 AND FXYD5 AND SLC30A1 | 0.955684 | 0.925373 | 0.988048 | ROR1 AND NOT-CLDN8 AND CD74 | 0.866667 | 1 | 0.764706 |
| SLC22A16 AND NOT-PSENEN AND NOT-PHLDB2 | 0.944785 | 0.970588 | 0.920319 | FAP AND NOT-MUC16 AND GHSR | 0.866667 | 1 | 0.764706 |

FIG. 15 (cont.)

| Antigen Pair Logic | F1 | Precision | Recall | Antigen Pair Logic | F1 | Precision | Recall |
|---|---|---|---|---|---|---|---|
| SLC22A16 AND NOT-TSPAN15 AND NOT-PHLDB2 | 0.944785 | 0.970588 | 0.920319 | FAP AND NOT-SLC34A2 AND GJA10 | 0.866667 | 1 | 0.764706 |
| SLC22A16 AND NOT-SLC25A4 AND NOT-PHLDB2 | 0.944785 | 0.970588 | 0.920319 | FAP AND NOT-VTCN1 AND CRB1 | 0.827586 | 1 | 0.705882 |
| NOT-PHLDB2 AND CXCR4 AND SLC30A1 | 0.944762 | 0.905109 | 0.988048 | FAP AND NOT-CXCR5 AND FSHR | 0.866667 | 1 | 0.764706 |
| NOT-PHLDB2 AND HCST AND NOT-GABRB1 | 0.944762 | 0.905109 | 0.988048 | FAP AND NOT-MUC16 AND PCDHGC4 | 0.866667 | 1 | 0.764706 |
| NOT-PHLDB2 AND HCST AND ALCAM | 0.944762 | 0.905109 | 0.988048 | FAP AND NOT-MUC16 AND GRIK4 | 0.866667 | 1 | 0.764706 |
| NOT-PHLDB2 AND CXCR4 AND SLC30A1 | 0.944762 | 0.905109 | 0.988048 | ROR1 AND NOT-EPCAM AND NOT-GUCY2F | 0.866667 | 1 | 0.764706 |
| NOT-PHLDB2 AND HCST AND GYPC | 0.944762 | 0.905109 | 0.988048 | ROR1 AND NOT-CLDN8 AND OR4N4 | 0.866667 | 1 | 0.764706 |
| SLC22A16 AND NOT-SLC7A2 AND NOT-PHLDB2 | 0.944559 | 0.974576 | 0.916335 | FAP AND NOT-CLDN7 AND SLC22A8 | 0.866667 | 1 | 0.764706 |
| SLC22A16 AND NOT-KIAA1324 AND NOT-PHLDB2 | 0.944559 | 0.974576 | 0.916335 | FAP AND NOT-CLDN7 AND ACSL6 | 0.827586 | 1 | 0.705882 |
| SLC22A16 AND NOT-ENPP5 AND NOT-PHLDB2 | 0.944559 | 0.974576 | 0.916335 | ROR1 AND NOT-CLDN8 AND ACSL6 | 0.827586 | 1 | 0.705882 |
| NOT-PHLDB2 AND EMP3 AND NOT-BTN3A1 | 0.962076 | 0.964 | 0.960159 | ROR1 AND NOT-CLDN8 AND GUCY2F | 0.866667 | 1 | 0.764706 |
| NOT-PHLDB2 AND EMP3 AND SLC39A8 | 0.954918 | 0.983122 | 0.928287 | ROR1 AND NOT-EPCAM AND NOT-PCDHAC2 | 0.827586 | 1 | 0.705882 |
| SLC22A16 AND NOT-SLC4A8 AND NOT-PHLDB2 | 0.946721 | 0.974684 | 0.920319 | FAP AND NOT-CLDN7 AND GHSR | 0.866667 | 1 | 0.764706 |
| NOT-PHLDB2 AND NOT-FAT1 AND P2RX4 | 0.946322 | 0.944444 | 0.948207 | FAP AND NOT-CLDN7 AND CASR | 0.866667 | 1 | 0.764706 |
| NOT-PHLDB2 AND NOT-FAT1 AND P2RX4 | 0.946322 | 0.944444 | 0.948207 | ROR1 AND NOT-CLDN8 AND LCT | 0.866667 | 1 | 0.764706 |
| SLC22A16 AND EMP3 AND NOT-PHLDB2 | 0.944099 | 0.982759 | 0.908367 | ROR1 AND NOT-CLDN8 AND PCDHGC4 | 0.866667 | 1 | 0.764706 |
| SLC22A16 AND NOT-KIAA0319 AND NOT-PHLDB2 | 0.942857 | 0.966527 | 0.920319 | ROR1 AND NOT-EPCAM AND NOT-GRIK4 | 0.827586 | 1 | 0.705882 |
| SLC22A16 AND NOT-OXTR AND NOT-PHLDB2 | 0.942857 | 0.966527 | 0.920319 | COMPLEX-OR4N4/EPCAM/ROR1 | 0.83871 | 0.928571 | 0.764706 |
| SLC22A16 AND NOT-GRM7 AND NOT-PHLDB2 | 0.942857 | 0.966527 | 0.920319 | ROR1 AND NOT-SSTR5 AND SV2C | 0.827586 | 1 | 0.705882 |
| SLC22A16 AND NOT-SMPD2 AND NOT-PHLDB2 | 0.942387 | 0.974468 | 0.912351 | ROR1 AND NOT-CXCR5 AND SV2C | 0.827586 | 1 | 0.705882 |
| SLC22A16 AND NOT-LRIG3 AND NOT-PHLDB2 | 0.940937 | 0.9625 | 0.920319 | ROR1 AND NOT-CXCR5 AND OR4N4 | 0.866667 | 1 | 0.764706 |
| SLC22A16 AND NOT-PHLDB2 AND NOT-SLC22A5 | 0.940937 | 0.9625 | 0.920319 | ROR1 AND NOT-CLDN7 AND VAMP8 | 0.83871 | 0.928571 | 0.764706 |
| SLC22A16 AND NOT-PTPRT AND NOT-PHLDB2 | 0.940937 | 0.9625 | 0.920319 | ROR1 AND NOT-CRB2 AND CXCR5 | 0.827586 | 1 | 0.705882 |
| NOT-PHLDB2 AND NOT-LRIG3 AND P2RX4 | 0.94027 | 0.910448 | 0.972112 | ROR1 AND NOT-SSTR5 AND PCDHAC2 | 0.866667 | 1 | 0.764706 |
| NOT-PHLDB2 AND NOT-LRIG3 AND P2RX4 | 0.94027 | 0.910448 | 0.972112 | ROR1 AND NOT-CLDN8 AND GJA10 | 0.827586 | 1 | 0.705882 |
| NOT-ATP8B1 AND CD44 AND NOT-BTN3A1 | 0.944123 | 0.914179 | 0.976096 | FAP AND NOT-CLDN8 AND MUC4 | 0.827586 | 1 | 0.705882 |
| SLC22A16 AND NOT-ATP8B1 AND NOT-PHLDB2 | 0.938776 | 0.962343 | 0.916335 | FAP AND NOT-EPCAM AND NOT-CXCR5 | 0.866667 | 1 | 0.764706 |
| NOT-PHLDB2 AND P2RX4 AND NOT-SLC22A5 | 0.940039 | 0.913534 | 0.968127 | FAP AND NOT-CXCR5 AND NOT-CLDN7 | 0.866667 | 1 | 0.764706 |
| NOT-PHLDB2 AND P2RX4 AND NOT-SLC22A5 | 0.940039 | 0.913534 | 0.968127 | FAP AND NOT-EPCAM AND NOT-CXCR5 | 0.866667 | 1 | 0.764706 |
| SLC22A16 AND NOT-SLC31A1 AND NOT-PHLDB2 | 0.936605 | 0.962185 | 0.912351 | ROR1 AND NOT-EPCAM AND CD34 | 0.83871 | 0.928571 | 0.764706 |
| NOT-PHLDB2 AND CD44 AND SLCO1B3 | 0.940711 | 0.933333 | 0.948207 | ROR1 AND NOT-CLDN8 AND MUC4 | 0.866667 | 1 | 0.764706 |
| NOT-PHLDB2 AND CD44 AND P2RX4 | 0.958084 | 0.96 | 0.956175 | ROR1 AND NOT-CLDN7 AND CD34 | 0.83871 | 0.928571 | 0.764706 |
| NOT-PHLDB2 AND NOT-ATP8B1 AND P2RX4 | 0.934615 | 0.903346 | 0.968127 | NOT-EPCAM AND IL13RA1 AND CD34 | 0.827586 | 1 | 0.705882 |
| NOT-PHLDB2 AND NOT-ATP8B1 AND P2RX4 | 0.934615 | 0.903346 | 0.968127 | ATP8B2 AND NOT-SLC39A2 AND PLVAP | 0.827586 | 1 | 0.705882 |
| SLC22A16 AND NOT-FAT1 AND NOT-PHLDB2 | 0.933884 | 0.969957 | 0.900398 | EMP3 AND PLVAP AND NOT-AGTR2 | 0.827586 | 1 | 0.705882 |
| SLC22A16 AND NOT-ATP8B1 AND NOT-SEMA4D | 0.933602 | 0.943089 | 0.924303 | ATP8B2 AND NOT-GPR78 AND PLVAP | 0.827586 | 1 | 0.705882 |
| SLC22A16 AND EMP3 AND NOT-CDH11 | 0.933333 | 0.946721 | 0.920319 | EMP3 AND NOT-ACSL6 AND GJA10 | 0.827586 | 1 | 0.705882 |
| NOT-PHLDB2 AND P2RX4 AND NOT-OXTR | 0.933078 | 0.897059 | 0.972112 | EMP3 AND PLVAP AND NOT-GPR78 | 0.827586 | 1 | 0.705882 |
| NOT-PHLDB2 AND P2RX4 AND NOT-OXTR | 0.933078 | 0.897059 | 0.972112 | EMP3 AND NOT-CCR9 AND PLVAP | 0.827586 | 1 | 0.705882 |
| NOT-PHLDB2 AND P2RX4 AND NOT-SLC4A8 | 0.945736 | 0.920755 | 0.972112 | EMP3 AND PLVAP AND NOT-SLC22A6 | 0.827586 | 1 | 0.705882 |
| NOT-PHLDB2 AND P2RX4 AND NOT-SLC4A8 | 0.945736 | 0.920755 | 0.972112 | EMP3 AND PLVAP AND NOT-OR8D1 | 0.827586 | 1 | 0.705882 |
| NOT-GHR AND EMP3 AND NOT-BTN3A1 | 0.932039 | 0.909091 | 0.956175 | Stomach Cancer | | | |
| SLC22A16 AND EMP3 AND NOT-GHR | 0.931452 | 0.942857 | 0.920319 | GPRC5A AND NOT-SCNN1B AND NOT-SGCG | 0.941176 | 0.952381 | 0.930233 |
| NOT-PHLDB2 AND SLC39A8 AND NOT-SLC22A5 | 0.931393 | 0.973913 | 0.89243 | GPRC5A AND NOT-SCNN1B AND NOT-ITGB5 | 0.953488 | 0.953488 | 0.953488 |
| NOT-PHLDB2 AND SLC39A8 AND NOT-LRIG3 | 0.931393 | 0.973913 | 0.89243 | ST14 AND NOT-SCNN1B AND NOT-SGCG | 0.91954 | 0.909091 | 0.930233 |
| NOT-PHLDB2 AND SLC39A8 AND NOT-ATP8B1 | 0.931393 | 0.973913 | 0.89243 | ST14 AND NOT-SCNN1B AND ITGB5 | 0.883721 | 0.883721 | 0.883721 |
| NOT-ATP8B1 AND CD44 AND NOT-BTN3A3 | 0.931034 | 0.896679 | 0.968127 | LSR AND NOT-SLC16A9 AND NOT-LAMP2 | 0.9 | 0.972973 | 0.837209 |
| NOT-PHLDB2 AND EMP3 AND NOT-PIK3IP1 | 0.930966 | 0.921875 | 0.940239 | LSR AND NOT-SLC16A9 AND LRP8 | 0.897436 | 1 | 0.813953 |
| SLC22A16 AND NOT-SLC31A1 AND NOT-GHR | 0.929577 | 0.939024 | 0.920319 | GPRC5A AND NOT-SLC16A9 AND NOT-HEG1 | 0.8 | 0.864865 | 0.744186 |
| NOT-PHLDB2 AND NOT-PTPRT AND P2RX4 | 0.929524 | 0.890511 | 0.972112 | PTPRH AND NOT-AQP8 AND SPINT1 | 0.842105 | 0.969697 | 0.744186 |
| NOT-PHLDB2 AND NOT-PTPRT AND P2RX4 | 0.929524 | 0.890511 | 0.972112 | LSR AND NOT-SLC16A9 AND XPR1 | 0.9 | 0.972973 | 0.837209 |
| SLC22A16 AND NOT-PHLDB2 AND NOT-IFNAR2 | 0.929006 | 0.946281 | 0.912351 | FXYD3 AND NOT-SCNN1B AND PLXND1 | 0.8 | 0.730769 | 0.883721 |
| NOT-CDH11 AND EMP3 AND NOT-BTN3A1 | 0.940039 | 0.913534 | 0.968127 | SMAGP AND NOT-SCNN1B AND NOT-ITGB5 | 0.952381 | 0.97561 | 0.930233 |
| NOT-PHLDB2 AND SLC39A8 AND NOT-KIAA0319 | 0.927536 | 0.965517 | 0.89243 | TSPAN8 AND PLXND1 AND NOT-FXYD3 | 0.831169 | 0.941176 | 0.744186 |
| NOT-PHLDB2 AND SLC39A8 AND NOT-PTPRT | 0.927536 | 0.965517 | 0.89243 | FXYD3 AND NOT-SCNN1B AND PDGFRB | 0.8 | 0.730769 | 0.883721 |
| NOT-ATP8B1 AND CD44 AND NOT-LAT | 0.927481 | 0.89011 | 0.968127 | TSPAN8 AND PDGFRB AND NOT-FXYD3 | 0.842105 | 0.969697 | 0.744186 |
| SLC22A16 AND CD44 AND NOT-MRGPRF | 0.930894 | 0.950207 | 0.912351 | FXYD3 AND NOT-SCNN1B AND PANX1 | 0.878049 | 0.923077 | 0.837209 |
| NOT-PHLDB2 AND SLC39A8 AND NOT-FAT1 | 0.926931 | 0.973684 | 0.884462 | LSR AND NOT-SLC16A9 AND HEG1 | 0.91358 | 0.973684 | 0.860465 |
| NOT-PHLDB2 AND NOT-ATP8B1 AND VAMP8 | 0.926829 | 0.875887 | 0.984064 | LSR AND NOT-SLC16A9 AND RELL1 | 0.925 | 1 | 0.860465 |
| NOT-PHLDB2 AND NOT-ATP8B1 AND VAMP8 | 0.926829 | 0.875887 | 0.984064 | PTPRH AND PDGFRB AND FXYD3 | 0.883721 | 0.883721 | 0.883721 |
| NOT-PHLDB2 AND P2RX4 AND NOT-SEMA4B | 0.930502 | 0.902622 | 0.960159 | PTPRH AND PDGFRB AND SPINT1 | 0.941176 | 0.952381 | 0.930233 |
| NOT-GHR AND EMP3 AND NOT-BTN3A3 | 0.926357 | 0.901887 | 0.952191 | FXYD3 AND NOT-SCNN1B AND FADS2 | 0.853933 | 0.826087 | 0.883721 |
| NOT-PHLDB2 AND P2RX4 AND NOT-SLC31A1 | 0.92543 | 0.889706 | 0.964143 | LSR AND NOT-SLC16A9 AND PCDHB7 | 0.925 | 1 | 0.860465 |
| NOT-PHLDB2 AND P2RX4 AND NOT-SLC31A1 | 0.92543 | 0.889706 | 0.964143 | LSR AND NOT-SLC16A9 AND NOT-SLC12A1 | 0.91358 | 0.973684 | 0.860465 |
| SLC22A16 AND NOT-ATP8B1 AND NOT-SYT11 | 0.924644 | 0.945833 | 0.904382 | LSR AND NOT-FXYD3 AND NOT-SLCO4C1 | 0.823529 | 0.833333 | 0.813953 |
| SLC22A16 AND NOT-ATP8B1 AND NOT-PAQR8 | 0.923695 | 0.931174 | 0.916335 | LSR AND NOT-SLC16A9 AND STX7 | 0.9 | 0.972973 | 0.837209 |
| NOT-PHLDB2 AND SLC39A8 AND NOT-SLC31A1 | 0.923077 | 0.965217 | 0.884462 | CLDN18 AND NOT-SLCO4C1 AND SLC39A10 | 0.857143 | 0.878049 | 0.837209 |
| NOT-PHLDB2 AND VAMP8 AND NOT-SLC22A5 | 0.92365 | 0.867133 | 0.988048 | CLDN18 AND NOT-SGCG AND LRP11 | 0.886076 | 0.972222 | 0.813953 |
| NOT-PHLDB2 AND VAMP8 AND NOT-SLC22A5 | 0.92365 | 0.867133 | 0.988048 | CLDN18 AND NOT-SLCO4C1 AND LRP11 | 0.888889 | 0.947368 | 0.837209 |
| NOT-ATP8B1 AND SLC30A1 AND NOT-S1PR1 | 0.922481 | 0.898113 | 0.948207 | PTPRH AND NOT-SLC26A3 AND EPCAM | 0.976744 | 0.976744 | 0.976744 |
| NOT-ATP8B1 AND VAMP8 AND NOT-S1PR1 | 0.922481 | 0.898113 | 0.948207 | CLDN18 AND NOT-SCNN1B AND NOT-SGCG | 0.833333 | 0.853659 | 0.813953 |
| NOT-ATP8B1 AND VAMP8 AND NOT-LAT | 0.933837 | 0.888489 | 0.984064 | CLDN18 AND NOT-SLCO4C1 AND ZDHHC5 | 0.911392 | 1 | 0.837209 |
| NOT-ATP8B1 AND SLC30A1 AND NOT-LAT | 0.923364 | 0.869718 | 0.984064 | CLDN18 AND NOT-EVA1A AND BCAP31 | 0.878049 | 0.923077 | 0.837209 |
| NOT-CDH11 AND EMP3 AND NOT-BTN3A3 | 0.93617 | 0.909774 | 0.964143 | CLDN18 AND NOT-SCNN1B AND ITGB5 | 0.827586 | 0.818182 | 0.837209 |
| NOT-ATP8B1 AND VAMP8 AND NOT-BTN3A1 | 0.943182 | 0.898917 | 0.992032 | CLDN18 AND NOT-SLCO4C1 AND NPC1 | 0.878049 | 0.923077 | 0.837209 |
| NOT-ATP8B1 AND VAMP8 AND NOT-BTN3A3 | 0.937381 | 0.894928 | 0.984064 | EPCAM AND GJB2 AND NOT-SLC26A3 | 0.966292 | 0.934783 | 1 |
| NOT-PHLDB2 AND P2RX4 AND NOT-FUT3 | 0.93666 | 0.903704 | 0.972112 | CLDN18 AND NOT-SLCO4C1 AND S100A10 | 0.847059 | 0.857143 | 0.837209 |

FIG. 15 (cont.)

| Antigen Pair Logic | F1 | Precision | Recall | Antigen Pair Logic | F1 | Precision | Recall |
|---|---|---|---|---|---|---|---|
| NOT-ATP8B1 AND CD44 AND NOT-S1PR1 | 0.91945 | 0.906977 | 0.932271 | CLDN18 AND NOT-EVA1A AND SLMAP | 0.837209 | 0.837209 | 0.837209 |
| NOT-PHLDB2 AND P2RX4 AND NOT-SMPD2 | 0.919231 | 0.888476 | 0.952191 | CLDN18 AND NOT-SLCO4C1 AND RYK | 0.819277 | 0.85 | 0.790698 |
| NOT-PHLDB2 AND P2RX4 AND NOT-SMPD2 | 0.919231 | 0.888476 | 0.952191 | CLDN18 AND NOT-SLCO4C1 AND ITGB5 | 0.835443 | 0.916667 | 0.767442 |
| NOT-GHR AND EMP3 AND NOT-STEAP4 | 0.918489 | 0.916667 | 0.920319 | CLDN18 AND NOT-SLCO4C1 AND CD99 | 0.814815 | 0.868421 | 0.767442 |
| NOT-GHR AND EMP3 AND NOT-STEAP4 | 0.918489 | 0.916667 | 0.920319 | CLDN18 AND NOT-SGCG AND ZDHHC5 | 0.897436 | 1 | 0.813953 |
| NOT-PHLDB2 AND NOT-FAT1 AND VAMP8 | 0.918406 | 0.876812 | 0.964143 | CLDN18 AND NOT-EVA1A AND RYK | 0.819277 | 0.85 | 0.790698 |
| NOT-PHLDB2 AND NOT-FAT1 AND SLC30A1 | 0.918406 | 0.876812 | 0.964143 | EPCAM AND SLC16A1 AND NOT-SLC26A3 | 0.945055 | 0.895833 | 1 |
| NOT-PHLDB2 AND NOT-FAT1 AND SLC30A1 | 0.918406 | 0.876812 | 0.964143 | CLDN18 AND NOT-SLCO4C1 AND CLSTN1 | 0.809524 | 0.829268 | 0.790698 |
| NOT-PHLDB2 AND VAMP8 AND NOT-SEMA4B | 0.938931 | 0.901099 | 0.98008 | CLDN18 AND NOT-SLCO4C1 AND LRP8 | 0.809524 | 0.829268 | 0.790698 |
| NOT-ATP8B1 AND SLC30A1 AND NOT-BTN3A1 | 0.929368 | 0.87108 | 0.996016 | CLDN18 AND NOT-SLCO4C1 AND FADS2 | 0.808989 | 0.782609 | 0.837209 |
| NOT-CDH11 AND EMP3 AND NOT-S1PR1 | 0.917323 | 0.906615 | 0.928287 | MUC13 AND NOT-SLC51B AND MMD | 0.868421 | 1 | 0.767442 |
| NOT-ATP8B1 AND SLC30A1 AND NOT-BTN3A3 | 0.920518 | 0.858621 | 0.992032 | CLDN18 AND NOT-SLCO4C1 AND ITGA2 | 0.897436 | 1 | 0.813953 |
| NOT-PHLDB2 AND SLC39A8 AND NOT-SMPD2 | 0.916318 | 0.964758 | 0.87251 | CLDN18 AND NOT-SLCO4C1 AND SLC3A2 | 0.878049 | 0.923077 | 0.837209 |
| NOT-PHLDB2 AND P2RX4 AND NOT-CACNG6 | 0.929524 | 0.890511 | 0.972112 | CLDN18 AND NOT-SLCO4C1 AND MTDH | 0.9 | 0.972973 | 0.837209 |
| NOT-PHLDB2 AND CD36 AND P2RX4 | 0.922432 | 0.973451 | 0.876494 | CLDN18 AND NOT-SGCG AND ITGB5 | 0.883117 | 1 | 0.790698 |
| SLC22A16 AND NOT-ATP8B1 AND NOT-FLVCR1 | 0.915811 | 0.944915 | 0.888446 | EPCAM AND NOT-SCNN1B AND CYBA | 1 | 1 | 1 |
| NOT-ATP8B1 AND CD44 AND NOT-IFNAR2 | 0.915572 | 0.865248 | 0.972112 | TM4SF5 AND NOT-SLC26A3 AND EPCAM | 0.888889 | 0.851064 | 0.930233 |
| NOT-ATP8B1 AND CD44 AND NOT-IFNAR2 | 0.915572 | 0.865248 | 0.972112 | CLDN18 AND NOT-SGCG AND PIGU | 0.868421 | 1 | 0.767442 |
| NOT-PHLDB2 AND EMP3 AND NOT-S1PR1 | 0.91498 | 0.930041 | 0.900398 | CLDN18 AND NOT-SGCG AND S100A10 | 0.897436 | 1 | 0.813953 |
| NOT-GHR AND EMP3 AND NOT-LAT | 0.912959 | 0.887218 | 0.940239 | CLDN18 AND NOT-SLCO4C1 AND PLGRKT | 0.888889 | 0.947368 | 0.837209 |
| NOT-CDH11 AND EMP3 AND NOT-LAT | 0.912879 | 0.870036 | 0.960159 | CLDN18 AND NOT-SLCO4C1 AND NOT-SGCG | 0.823529 | 0.833333 | 0.813953 |
| NOT-PHLDB2 AND NOT-SLC31A1 AND VAMP8 | 0.912801 | 0.854167 | 0.98008 | CLDN18 AND SLC4A11 AND NOT-CADM3 | 0.875 | 0.945946 | 0.813953 |
| NOT-PHLDB2 AND NOT-SLC31A1 AND VAMP8 | 0.912801 | 0.854167 | 0.98008 | CLDN18 AND NOT-KLRF1 AND ZDHHC5 | 0.911392 | 1 | 0.837209 |
| NOT-ATP8B1 AND VAMP8 AND NOT-IFNAR2 | 0.913444 | 0.849315 | 0.988048 | CLDN18 AND NOT-SLCO4C1 AND ATRAID | 0.875 | 0.945946 | 0.813953 |
| NOT-ATP8B1 AND VAMP8 AND NOT-IFNAR2 | 0.913444 | 0.849315 | 0.988048 | MUC13 AND NOT-SLC16A9 AND LRP8 | 0.897436 | 1 | 0.813953 |
| NOT-PHLDB2 AND LAPTM5 AND NOT-LRIG3 | 0.915129 | 0.852234 | 0.988048 | CLDN18 AND NOT-SLCO4C1 AND TCIRG1 | 0.847059 | 0.857143 | 0.837209 |
| NOT-PHLDB2 AND LAPTM5 AND NOT-ATP8B1 | 0.913444 | 0.849315 | 0.988048 | EPCAM AND SLC12A2 AND NOT-SLC26A3 | 0.952381 | 0.97561 | 0.930233 |
| NOT-PHLDB2 AND LAPTM5 AND NOT-ATP8B1 | 0.913444 | 0.849315 | 0.988048 | CLDN18 AND NOT-EVA1A AND ATRAID | 0.875 | 0.945946 | 0.813953 |
| NOT-PHLDB2 AND SLC39A8 AND SLCO1B3 | 0.911765 | 0.964444 | 0.864542 | EPCAM AND NOT-SCNN1B AND PIGU | 0.914894 | 0.843137 | 1 |
| NOT-PHLDB2 AND LAPTM5 AND NOT-PTPRT | 0.911765 | 0.846416 | 0.988048 | EPCAM AND NOT-SLCO4C1 AND NOT-SLC26A3 | 0.886598 | 0.796296 | 1 |
| NOT-PHLDB2 AND LAPTM5 AND NOT-GRM7 | 0.911765 | 0.846416 | 0.988048 | EPCAM AND NOT-SCNN1B AND ZDHHC5 | 1 | 1 | 1 |
| NOT-STEAP4 AND EMP3 AND NOT-CDH11 | 0.916667 | 0.913043 | 0.920319 | CLDN18 AND NOT-SGCG AND SLC3A2 | 0.897436 | 1 | 0.813953 |
| NOT-PHLDB2 AND P2RX4 AND NOT-PPAPDC1B | 0.910506 | 0.889734 | 0.932271 | CLDN18 AND NOT-SLCO4C1 AND MGST2 | 0.9 | 0.972973 | 0.837209 |
| NOT-PHLDB2 AND EMP3 AND SLC7A5 | 0.962076 | 0.964 | 0.960159 | CLDN18 AND NOT-EVA1A AND PLGRKT | 0.888889 | 0.947368 | 0.837209 |
| NOT-PHLDB2 AND EMP3 AND SLC7A5 | 0.962076 | 0.964 | 0.960159 | CLDN18 AND NOT-ECSCR AND ATP13A1 | 0.837838 | 1 | 0.72093 |
| NOT-PHLDB2 AND SLC7A5 AND VAMP8 | 0.948177 | 0.914815 | 0.984064 | EPCAM AND SEMA4G AND NOT-SLC26A3 | 0.826923 | 0.704918 | 1 |
| NOT-PHLDB2 AND SLC7A5 AND VAMP8 | 0.948177 | 0.914815 | 0.984064 | MUC13 AND PLXND1 AND NOT-FXYD3 | 0.888889 | 0.947368 | 0.837209 |
| NOT-PHLDB2 AND NOT-ERBB3 AND P2RX4 | 0.947573 | 0.924242 | 0.972112 | MUC13 AND NOT-SLC16A9 AND HEG1 | 0.9 | 0.972973 | 0.837209 |
| NOT-PHLDB2 AND EMP3 AND NOT-CR2 | 0.945098 | 0.930502 | 0.960159 | EPCAM AND NOT-SCNN1B AND TMEM63B | 0.895833 | 0.811321 | 1 |
| NOT-PHLDB2 AND SLC7A5 AND PTGER4 | 0.957364 | 0.932075 | 0.984064 | CLDN18 AND NOT-SGCG AND PLGRKT | 0.897436 | 1 | 0.813953 |
| NOT-PHLDB2 AND NOT-ALDH1A1 AND P2RX4 | 0.943026 | 0.930233 | 0.956175 | CLDN18 AND NOT-SGCG AND ZNRF3 | 0.823529 | 0.833333 | 0.813953 |
| SLC22A16 AND NOT-ERBB3 AND NOT-PHLDB2 | 0.942857 | 0.966527 | 0.920319 | MUC13 AND PDGFRB AND NOT-FXYD3 | 0.902439 | 0.948718 | 0.860465 |
| SLC22A16 AND NOT-CLDN8 AND NOT-PHLDB2 | 0.942857 | 0.966527 | 0.920319 | CLDN18 AND NOT-SLCO4C1 AND SPINT1 | 0.911392 | 1 | 0.837209 |
| SLC22A16 AND NOT-STEAP2 AND NOT-PHLDB2 | 0.942857 | 0.966527 | 0.920319 | EPCAM AND NOT-SCNN1B AND NOT-PKHD1 | 0.886598 | 0.796296 | 1 |
| SLC22A16 AND NOT-ERBB4 AND NOT-PHLDB2 | 0.942857 | 0.966527 | 0.920319 | EPCAM AND KCNN4 AND NOT-SLC26A3 | 0.930233 | 0.930233 | 0.930233 |
| SLC22A16 AND NOT-BMPR1B AND NOT-PHLDB2 | 0.942623 | 0.970464 | 0.916335 | CLDN18 AND NOT-EVA1A AND PSENEN | 0.847059 | 0.857143 | 0.837209 |
| NOT-PHLDB2 AND EMP3 AND NOT-MS4A1 | 0.941176 | 0.926641 | 0.956175 | CLDN18 AND NOT-CXCR2 AND SLC39A10 | 0.804878 | 0.846154 | 0.767442 |
| SLC22A16 AND NOT-CLDN7 AND NOT-PHLDB2 | 0.940937 | 0.9625 | 0.920319 | CLDN18 AND NOT-SLCO4C1 AND BMPR2 | 0.818182 | 0.8 | 0.837209 |
| SLC22A16 AND SLC7A5 AND NOT-PHLDB2 | 0.940937 | 0.9625 | 0.920319 | CLDN18 AND NOT-SLCO4C1 AND STX7 | 0.883117 | 1 | 0.790698 |
| SLC22A16 AND NOT-ERBB2 AND NOT-PHLDB2 | 0.940937 | 0.9625 | 0.920319 | CLDN18 AND NOT-SLCO4C1 AND VAMP3 | 0.875 | 0.945946 | 0.813953 |
| SLC22A16 AND NOT-VTCN1 AND NOT-PHLDB2 | 0.940937 | 0.9625 | 0.920319 | CLDN18 AND LRP11 AND NOT-STX1B | 0.9 | 0.972973 | 0.837209 |
| SLC22A16 AND NOT-SDC1 AND NOT-PHLDB2 | 0.940937 | 0.9625 | 0.920319 | MUC13 AND NOT-SLCO4C1 AND FADS2 | 0.865979 | 0.777778 | 0.976744 |
| SLC22A16 AND NOT-RNF43 AND NOT-PHLDB2 | 0.940937 | 0.9625 | 0.920319 | EPCAM AND NOT-SCNN1B AND VNN3 | 0.886598 | 0.796296 | 1 |
| NOT-PHLDB2 AND SLC7A5 AND P2RX4 | 0.940039 | 0.913534 | 0.968127 | MUC13 AND NOT-ANO10 AND NOT-SLCO4C1 | 0.836735 | 0.745455 | 0.953488 |
| NOT-PHLDB2 AND EMP3 AND NOT-HLA-DOB | 0.939571 | 0.919847 | 0.960159 | EPCAM AND NOT-CA4 AND NOT-CDHR3 | 0.837209 | 0.837209 | 0.837209 |
| NOT-PHLDB2 AND CD44 AND SLC7A5 | 0.96063 | 0.949416 | 0.972112 | EPCAM AND CDH3 AND NOT-CDHR3 | 0.833333 | 0.754717 | 0.930233 |
| SLC22A16 AND NOT-EPCAM AND NOT-PHLDB2 | 0.938776 | 0.962343 | 0.916335 | CLDN18 AND SLC4A11 AND NOT-PTPRN | 0.911392 | 1 | 0.837209 |
| SLC22A16 AND NOT-MET AND NOT-PHLDB2 | 0.938525 | 0.966245 | 0.912351 | CLDN18 AND NOT-SLCO4C1 AND NOT-CLSTN2 | 0.819277 | 0.85 | 0.790698 |
| NOT-PHLDB2 AND EMP3 AND NOT-FCRL1 | 0.9375 | 0.91954 | 0.956175 | EPCAM AND NOT-SCNN1B AND ADAM10 | 0.955556 | 0.914894 | 1 |
| NOT-PHLDB2 AND EMP3 AND NOT-CD22 | 0.9375 | 0.91954 | 0.956175 | MUC13 AND NOT-SLCO4C1 AND NOT-FXYD3 | 0.901099 | 0.854167 | 0.953488 |
| NOT-PHLDB2 AND EMP3 AND NOT-FCRL5 | 0.9375 | 0.91954 | 0.956175 | CLDN18 AND SLC4A11 AND NOT-SLC47A2 | 0.835443 | 0.916667 | 0.767442 |
| NOT-PHLDB2 AND SLC7A5 AND NOT-GRM3 | 0.937381 | 0.894928 | 0.984064 | EPCAM AND NOT-SCNN1B AND MCOLN2 | 0.905263 | 0.826923 | 1 |
| NOT-PHLDB2 AND SLC7A5 AND NOT-DTNA | 0.937381 | 0.894928 | 0.984064 | MUC13 AND NOT-SLCO4C1 AND HEG1 | 0.891304 | 0.836735 | 0.953488 |
| NOT-PHLDB2 AND NOT-CEACAM5 AND P2RX4 | 0.93666 | 0.903704 | 0.972112 | EPCAM AND GPR35 AND NOT-SLC26A3 | 0.895833 | 0.811321 | 1 |
| NOT-PHLDB2 AND P2RX4 AND NOT-CLDN3 | 0.93666 | 0.903704 | 0.972112 | CLDN18 AND NOT-CX3CL1 AND ESYT2 | 0.835443 | 0.916667 | 0.767442 |
| SLC22A16 AND NOT-STEAP1 AND NOT-PHLDB2 | 0.936345 | 0.966102 | 0.908367 | GPRC5A AND NOT-SCNN1B AND CD44 | 0.953488 | 0.953488 | 0.953488 |
| SLC22A16 AND NOT-FOLH1 AND NOT-PHLDB2 | 0.936345 | 0.966102 | 0.908367 | CDH17 AND NOT-SLC51B AND ZDHHC5 | 0.860465 | 0.860465 | 0.860465 |
| NOT-PHLDB2 AND NOT-ERBB3 AND SLC30A1 | 0.935849 | 0.888889 | 0.988048 | CDH17 AND NOT-SLC51B AND SLC25A5 | 0.870588 | 0.880952 | 0.860465 |
| NOT-PHLDB2 AND NOT-ERBB3 AND SLC30A1 | 0.935849 | 0.888889 | 0.988048 | B3GNT3 AND NOT-SCNN1B AND CD44 | 0.945055 | 0.895833 | 1 |
| NOT-PHLDB2 AND EMP3 AND NOT-FCRL2 | 0.935673 | 0.916031 | 0.956175 | CDH17 AND NOT-AQP8 AND NOT-SPINT1 | 0.853333 | 1 | 0.744186 |
| NOT-PHLDB2 AND SLC7A5 AND LAPTM5 | 0.935606 | 0.891697 | 0.984064 | ST14 AND NOT-SCNN1B AND CD44 | 0.942529 | 0.931818 | 0.953488 |
| NOT-PHLDB2 AND SLC7A5 AND NOT-CSPG5 | 0.935606 | 0.891697 | 0.984064 | GPRC5A AND NOT-SCNN1B AND TGFBI | 0.941176 | 0.952381 | 0.930233 |
| NOT-PHLDB2 AND SLC7A5 AND NOT-SLC1A2 | 0.935606 | 0.891697 | 0.984064 | TSPAN1 AND NOT-SLCO4C1 AND CD93 | 0.903226 | 0.84 | 0.976744 |
| NOT-PHLDB2 AND EMP3 AND NOT-CD79A | 0.935421 | 0.919231 | 0.952191 | ST14 AND NOT-SCNN1B AND TGFBI | 0.930233 | 0.930233 | 0.930233 |
| SLC22A16 AND EMP3 AND NOT-KDR | 0.935223 | 0.950617 | 0.920319 | LSR AND NOT-SCNN1B AND CD44 | 0.938272 | 1 | 0.883721 |
| NOT-PHLDB2 AND NOT-CEACAM5 AND VAMP8 | 0.935849 | 0.888889 | 0.988048 | TSPAN1 AND NOT-SCNN1B AND CD44 | 0.875 | 0.792453 | 0.976744 |
| NOT-PHLDB2 AND NOT-CLDN7 AND P2RX4 | 0.934866 | 0.900369 | 0.972112 | FXYD3 AND NOT-SCNN1B AND CATSPERD | 0.844444 | 0.808511 | 0.883721 |

FIG. 15 (cont.)

| Antigen Pair Logic | F1 | Precision | Recall |
|---|---|---|---|
| NOT-PHLDB2 AND P2RX4 AND NOT-ERBB2 | 0.934866 | 0.900369 | 0.972112 |
| NOT-PHLDB2 AND NOT-CLDN8 AND P2RX4 | 0.934866 | 0.900369 | 0.972112 |
| NOT-PHLDB2 AND P2RX4 AND NOT-RNF43 | 0.934866 | 0.900369 | 0.972112 |
| NOT-PHLDB2 AND NOT-CLDN8 AND P2RX4 | 0.934866 | 0.900369 | 0.972112 |
| NOT-PHLDB2 AND NOT-SDC1 AND P2RX4 | 0.934866 | 0.900369 | 0.972112 |
| NOT-PHLDB2 AND P2RX4 AND NOT-RNF43 | 0.934866 | 0.900369 | 0.972112 |
| NOT-PHLDB2 AND NOT-SDC1 AND P2RX4 | 0.934866 | 0.900369 | 0.972112 |
| NOT-PHLDB2 AND NOT-CLDN7 AND P2RX4 | 0.934866 | 0.900369 | 0.972112 |
| NOT-PHLDB2 AND P2RX4 AND NOT-ERBB2 | 0.934866 | 0.900369 | 0.972112 |
| NOT-PHLDB2 AND P2RX4 AND NOT-EPCAM | 0.934615 | 0.903346 | 0.968127 |
| NOT-PHLDB2 AND P2RX4 AND NOT-EPCAM | 0.934615 | 0.903346 | 0.968127 |
| NOT-PHLDB2 AND NOT-ERBB3 AND VAMP8 | 0.934087 | 0.885714 | 0.988048 |
| NOT-PHLDB2 AND NOT-ERBB3 AND VAMP8 | 0.934087 | 0.885714 | 0.988048 |
| NOT-PHLDB2 AND SLC7A5 AND NOT-SLC24A2 | 0.933837 | 0.888489 | 0.984064 |
| NOT-PHLDB2 AND SLC39A8 AND NOT-SDC1 | 0.933333 | 0.978166 | 0.89243 |
| NOT-PHLDB2 AND P2RX4 AND NOT-CLDN23 | 0.932821 | 0.9 | 0.968127 |
| SLC22A16 AND SLC7A5 AND CD44 | 0.933063 | 0.950413 | 0.916335 |
| NOT-PHLDB2 AND SLC7A5 AND NOT-KCNJ10 | 0.937381 | 0.894928 | 0.984064 |
| NOT-PHLDB2 AND P2RX4 AND NOT-FOLH1 | 0.937743 | 0.91635 | 0.960159 |
| NOT-PHLDB2 AND SLC39A8 AND NOT-ERBB3 | 0.931393 | 0.973913 | 0.89243 |
| NOT-PHLDB2 AND SLC39A8 AND NOT-ERBB2 | 0.931393 | 0.973913 | 0.89243 |
| NOT-PHLDB2 AND SLC39A8 AND NOT-STEAP2 | 0.931393 | 0.973913 | 0.89243 |
| NOT-PHLDB2 AND SLC39A8 AND SLC7A5 | 0.931393 | 0.973913 | 0.89243 |
| NOT-PHLDB2 AND SLC39A8 AND NOT-CLDN8 | 0.931393 | 0.973913 | 0.89243 |
| NOT-PHLDB2 AND SLC39A8 AND NOT-CLDN7 | 0.931393 | 0.973913 | 0.89243 |
| COMPLEX-VTCN1/PHLDB2/CD44 | 0.93666 | 0.903704 | 0.972112 |
| NOT-PHLDB2 AND NOT-STEAP1 AND P2RX4 | 0.930502 | 0.902622 | 0.960159 |
| NOT-PHLDB2 AND NOT-STEAP1 AND P2RX4 | 0.930502 | 0.902622 | 0.960159 |
| SLC22A16 AND NOT-CLDN8 AND NOT-GHR | 0.930417 | 0.928571 | 0.932271 |
| NOT-PHLDB2 AND SLC7A5 AND PPAPDC1B | 0.929524 | 0.890511 | 0.972112 |
| NOT-PHLDB2 AND P2RX4 AND NOT-VTCN1 | 0.929524 | 0.890511 | 0.972112 |
| NOT-PHLDB2 AND P2RX4 AND NOT-VTCN1 | 0.929524 | 0.890511 | 0.972112 |
| NOT-PHLDB2 AND SLC39A8 AND NOT-RNF43 | 0.929461 | 0.969697 | 0.89243 |
| NOT-PHLDB2 AND P2RX4 AND NOT-MUC13 | 0.93666 | 0.903704 | 0.972112 |
| NOT-ATP8B1 AND CD44 AND NOT-CD160 | 0.929254 | 0.893382 | 0.968127 |
| NOT-PHLDB2 AND SLC39A8 AND NOT-EPCAM | 0.929167 | 0.973799 | 0.888446 |
| SLC22A16 AND EMP3 AND NOT-AXL | 0.929006 | 0.946281 | 0.912351 |
| NOT-PHLDB2 AND DDX3X AND NOT-SLC4A8 | 0.928983 | 0.896296 | 0.964143 |
| SLC22A16 AND SLC7A5 AND NOT-GHR | 0.928 | 0.931727 | 0.924303 |
| SLC22A16 AND NOT-CLDN8 AND CD44 | 0.931174 | 0.946502 | 0.916335 |
| NOT-PHLDB2 AND SLC39A8 AND NOT-VTCN1 | 0.927536 | 0.965517 | 0.89243 |
| NOT-PHLDB2 AND P2RX4 AND NOT-MOK | 0.927481 | 0.89011 | 0.968127 |
| NOT-PHLDB2 AND SLC7A5 AND NOT-SYT11 | 0.927203 | 0.892989 | 0.964143 |
| NOT-PHLDB2 AND SLC39A8 AND NOT-MUC1 | 0.926931 | 0.973684 | 0.884462 |
| NOT-PHLDB2 AND NOT-FAT1 AND DDX3X | 0.926923 | 0.895911 | 0.960159 |
| NOT-PHLDB2 AND NOT-MET AND P2RX4 | 0.926641 | 0.898876 | 0.956175 |
| NOT-PHLDB2 AND NOT-MET AND P2RX4 | 0.926641 | 0.898876 | 0.956175 |
| SLC22A16 AND NOT-ERBB2 AND EMP3 | 0.926441 | 0.924603 | 0.928287 |
| NOT-AXL AND EMP3 AND NOT-BTN3A1 | 0.931298 | 0.893773 | 0.972112 |
| NOT-ATP8B1 AND CD44 AND NOT-MS4A1 | 0.925714 | 0.886861 | 0.968127 |
| SLC22A16 AND NOT-MUC1 AND NOT-PHLDB2 | 0.92562 | 0.961373 | 0.89243 |
| NOT-PHLDB2 AND SLC7A5 AND NOT-GABRB1 | 0.925094 | 0.872792 | 0.984064 |
| NOT-PHLDB2 AND SLC39A8 AND NOT-STEAP1 | 0.924686 | 0.973568 | 0.880478 |
| SLC22A16 AND EMP3 AND NOT-EDNRB | 0.924644 | 0.945833 | 0.904382 |
| NOT-ATP8B1 AND VAMP8 AND NOT-HLA-DOB | 0.924214 | 0.862069 | 0.996016 |
| NOT-ATP8B1 AND VAMP8 AND NOT-MS4A1 | 0.935606 | 0.891697 | 0.984064 |
| NOT-PHLDB2 AND CD33 AND SLCO1B3 | 0.941414 | 0.954918 | 0.928287 |
| NOT-PHLDB2 AND CD33 AND SLC30A1 | 0.948413 | 0.944664 | 0.952191 |
| NOT-PHLDB2 AND CD33 AND NOT-ATP8B1 | 0.939096 | 0.926357 | 0.952191 |
| NOT-PHLDB2 AND CD33 AND NOT-LRIG3 | 0.939096 | 0.926357 | 0.952191 |
| NOT-PHLDB2 AND CD33 AND P2RX4 | 0.959016 | 0.987342 | 0.932271 |
| NOT-PHLDB2 AND CD33 AND NOT-SLC22A5 | 0.939096 | 0.926357 | 0.952191 |
| NOT-PHLDB2 AND CD33 AND NOT-SLC31A1 | 0.934911 | 0.925781 | 0.944223 |
| NOT-PHLDB2 AND CD33 AND NOT-SMPD2 | 0.932806 | 0.92549 | 0.940239 |
| CD33 AND NOT-ATP8B1 AND NOT-SEMA4D | 0.910156 | 0.89272 | 0.928287 |
| CD33 AND NOT-ATP8B1 AND NOT-PIK3IP1 | 0.888889 | 0.901639 | 0.876494 |
| CD33 AND NOT-IFNAR2 AND NOT-ATP8B1 | 0.91453 | 0.986175 | 0.85259 |
| CD33 AND NOT-ATP8B1 AND NOT-PAQR8 | 0.865784 | 0.823741 | 0.912351 |
| CD33 AND NOT-ATP8B1 AND NOT-SYT11 | 0.865385 | 0.836431 | 0.896414 |
| CD33 AND NOT-ATP8B1 AND NOT-FLVCR1 | 0.859345 | 0.83209 | 0.888446 |
| CD33 AND NOT-ATP8B1 AND NOT-PPAPDC1B | 0.825263 | 0.875 | 0.780876 |
| CD33 AND NOT-ATP8B1 AND NOT-SLCO1B3 | 0.800693 | 0.708589 | 0.920319 |
| NOT-PHLDB2 AND HCST AND SLC7A5 | 0.966862 | 0.946565 | 0.988048 |
| NOT-PHLDB2 AND HCST AND SLC7A5 | 0.966862 | 0.946565 | 0.988048 |
| NOT-PHLDB2 AND SLC7A5 AND PTGER2 | 0.966601 | 0.953488 | 0.98008 |
| NOT-PHLDB2 AND CXCR4 AND SLC7A5 | 0.957529 | 0.928839 | 0.988048 |
| NOT-PHLDB2 AND CXCR4 AND SLC7A5 | 0.957529 | 0.928839 | 0.988048 |

| Antigen Pair Logic | F1 | Precision | Recall |
|---|---|---|---|
| PPAP2C AND NOT-SCNN1B AND TGFBI | 0.931818 | 0.911111 | 0.953488 |
| TSPAN8 AND NOT-SCNN1B AND CD44 | 0.883117 | 1 | 0.790698 |
| CDH17 AND NOT-SLC16A9 AND SLC25A5 | 0.888889 | 0.947368 | 0.837209 |
| TSPAN1 AND NOT-SCNN1B AND TGFBI | 0.904762 | 0.926829 | 0.883721 |
| CDH17 AND NOT-SPPL2A AND SLC25A5 | 0.8 | 0.765957 | 0.837209 |
| PTPRH AND NOT-SLC30A10 AND SPINT1 | 0.965517 | 0.954545 | 0.976744 |
| PIGR AND NOT-SLCO4C1 AND CD93 | 0.83871 | 0.78 | 0.906977 |
| CDH17 AND NOT-SCNN1B AND ITGB5 | 0.876404 | 0.847826 | 0.906977 |
| TM4SF5 AND NOT-SLC30A10 AND ESYT2 | 0.879121 | 0.833333 | 0.930233 |
| TSPAN8 AND NOT-SCNN1B AND TGFBI | 0.857143 | 0.970588 | 0.767442 |
| PTPRH AND CD44 AND NOT-SCNN1B | 0.869565 | 0.816327 | 0.930233 |
| IYD AND NOT-SCNN1B AND CD44 | 0.883117 | 1 | 0.790698 |
| KCNE3 AND NOT-SLCO4C1 AND CD44 | 0.803738 | 0.671875 | 1 |
| FXYD3 AND NOT-SCNN1B AND CD44 | 0.850575 | 0.840909 | 0.860465 |
| FXYD3 AND NOT-SCNN1B AND CD93 | 0.835165 | 0.791667 | 0.883721 |
| CDH17 AND PODXL AND SLC25A5 | 0.878049 | 0.923077 | 0.837209 |
| TMPRSS2 AND NOT-SCNN1B AND TGFBI | 0.928571 | 0.95122 | 0.906977 |
| KCNE3 AND NOT-SLCO4C1 AND CD93 | 0.865979 | 0.777778 | 0.976744 |
| B3GNT3 AND NOT-SCNN1B AND TGFBI | 0.95122 | 1 | 0.906977 |
| CDH17 AND NOT-FXYD3 AND ABCA1 | 0.818182 | 0.8 | 0.837209 |
| DSG2 AND NOT-SCNN1B AND CD44 | 0.934783 | 0.877551 | 1 |
| TM4SF5 AND NOT-SLC30A10 AND LRP8 | 0.842105 | 0.769231 | 0.930233 |
| FXYD3 AND NOT-SCNN1B AND TGFBI | 0.850575 | 0.840909 | 0.860465 |
| CDH17 AND NOT-SLC16A9 AND LITAF | 0.857143 | 0.878049 | 0.837209 |
| ABCC3 AND NOT-SCNN1B AND CD44 | 0.886598 | 0.796296 | 1 |
| FZD5 AND NOT-SCNN1B AND CD44 | 0.91358 | 0.973684 | 0.860465 |
| TMPRSS2 AND NOT-SCNN1B AND CD44 | 0.906977 | 0.906977 | 0.906977 |
| CDH17 AND NOT-FXYD3 AND NRP1 | 0.804598 | 0.795455 | 0.813953 |
| PIGR AND NOT-SCNN1B AND CD44 | 0.863636 | 0.844444 | 0.883721 |
| LSR AND NOT-SLC30A10 AND PRRG1 | 0.904762 | 0.926829 | 0.883721 |
| PPAP2C AND NOT-SCNN1B AND CD44 | 0.930233 | 0.930233 | 0.930233 |
| LSR AND NOT-SLC16A9 AND NOT-SLC31A1 | 0.857143 | 0.970588 | 0.767442 |
| TNFRSF21 AND NOT-SCNN1B AND TGFBI | 0.850575 | 0.840909 | 0.860465 |
| ST14 AND NOT-SLC16A9 AND NOT-CD1A | 0.808989 | 0.782609 | 0.837209 |
| TM4SF5 AND CD44 AND NOT-SCNN1B | 0.95122 | 1 | 0.906977 |
| ITGA2 AND NOT-SCNN1B AND CD44 | 0.813187 | 0.770833 | 0.860465 |
| TM4SF5 AND NOT-SLC30A10 AND CD99 | 0.870588 | 0.880952 | 0.860465 |
| SLC12A2 AND NOT-SCNN1B AND CD44 | 0.909091 | 0.888889 | 0.930233 |
| DSG2 AND NOT-SCNN1B AND TGFBI | 0.903226 | 0.84 | 0.976744 |
| LSR AND NOT-SLCO4C1 AND CD44 | 0.835165 | 0.791667 | 0.883721 |
| PIGR AND NOT-SCNN1B AND TGFBI | 0.844444 | 0.808511 | 0.883721 |
| COMPLEX-ALCAM/SLC16A9/LSR | 0.91358 | 0.973684 | 0.860465 |
| TM4SF5 AND NOT-SLC30A10 AND PCDHB7 | 0.835165 | 0.791667 | 0.883721 |
| PVRL3 AND NOT-SCNN1B AND CD44 | 0.871795 | 0.971429 | 0.790698 |
| SEMA4G AND NOT-SCNN1B AND CD44 | 0.913043 | 0.857143 | 0.976744 |
| CLDN18 AND NOT-SCNN1B AND CD44 | 0.847059 | 0.857143 | 0.837209 |
| CDH17 AND NOT-SLC26A3 AND EPCAM | 0.953488 | 0.953488 | 0.953488 |
| CLDN18 AND NOT-SLCO4C1 AND CD44 | 0.837209 | 0.837209 | 0.837209 |
| CLDN18 AND NOT-SLCO4C1 AND CD93 | 0.827586 | 0.818182 | 0.837209 |
| CLDN18 AND LRP11 AND NOT-AOC3 | 0.9 | 0.972973 | 0.837209 |
| CLDN18 AND NOT-SCNN1B AND TGFBI | 0.846154 | 0.942857 | 0.767442 |
| CLDN18 AND NOT-SLCO4C1 AND VANGL1 | 0.875 | 0.945946 | 0.813953 |
| EPCAM AND NOT-SCNN1B AND TGFBI | 0.965517 | 0.954545 | 0.976744 |
| MUC13 AND NOT-SCNN1B AND CD44 | 0.988235 | 1 | 0.976744 |
| CEACAM5 AND NOT-SCNN1B AND CD44 | 0.888889 | 0.947368 | 0.837209 |
| MUC13 AND NOT-SCNN1B AND TGFBI | 0.938272 | 1 | 0.883721 |
| EPCAM AND FXYD5 AND NOT-S1PR1 | 0.965517 | 0.954545 | 0.976744 |
| CLDN18 AND NOT-ECSCR AND CD58 | 0.842105 | 0.969697 | 0.744186 |
| CLDN7 AND NOT-SCNN1B AND CD44 | 0.930233 | 0.930233 | 0.930233 |
| CLDN18 AND NOT-EVA1A AND CD58 | 0.9 | 0.972973 | 0.837209 |
| CDH17 AND NOT-SLC16A9 AND ANXA1 | 0.857143 | 0.878049 | 0.837209 |
| EPCAM AND NOT-SLCO4C1 AND CD93 | 0.94382 | 0.913043 | 0.976744 |
| EPCAM AND NOT-SCNN1B AND CD44 | 0.976744 | 0.976744 | 0.976744 |
| CLDN18 AND NOT-EVA1A AND SLC31A1 | 0.853333 | 1 | 0.744186 |
| MST1R AND NOT-SCNN1B AND CD44 | 0.942529 | 0.931818 | 0.953488 |
| EPCAM AND CDH3 AND NOT-CATSPERD | 0.888889 | 0.851064 | 0.930233 |
| EPCAM AND FXYD5 AND NOT-C8B | 0.977273 | 0.955556 | 1 |
| CLDN18 AND SLC2A1 AND NOT-HEG1 | 0.814815 | 0.868421 | 0.767442 |
| CLDN18 AND SLC2A1 AND NOT-SLC6A1 | 0.864198 | 0.921053 | 0.813953 |
| CLDN18 AND SLC4A11 AND NOT-SLC22A9 | 0.888889 | 0.947368 | 0.837209 |
| EPCAM AND NOT-CA4 AND NOT-CATSPERD | 0.837209 | 0.837209 | 0.837209 |
| EPCAM AND NOT-CA4 AND NOT-OXTR | 0.809524 | 0.829268 | 0.790698 |
| EPCAM AND NOT-SCNN1B AND SEMA4B | 0.914894 | 0.843137 | 1 |
| MST1R AND NOT-SCNN1B AND TGFBI | 0.941176 | 0.952381 | 0.930233 |
| EPCAM AND NOT-SCNN1B AND CATSPERD | 0.886598 | 0.796296 | 1 |
| CLDN18 AND NOT-SLCO4C1 AND SEMA4B | 0.886076 | 0.972222 | 0.813953 |
| CLDN18 AND NOT-SGCG AND SLC31A1 | 0.837838 | 1 | 0.72093 |

FIG. 15 (cont.)

| Antigen Pair Logic | F1 | Precision | Recall | Antigen Pair Logic | F1 | Precision | Recall |
|---|---|---|---|---|---|---|---|
| NOT-PHLDB2 AND SLC7A5 AND LTBR | 0.965795 | 0.97561 | 0.956175 | CLDN18 AND SLC2A1 AND NOT-GPR18 | 0.847059 | 0.857143 | 0.837209 |
| NOT-PHLDB2 AND SLC7A5 AND LTBR | 0.965795 | 0.97561 | 0.956175 | CLDN18 AND SLC2A1 AND SLC25A5 | 0.9 | 0.972973 | 0.837209 |
| NOT-PHLDB2 AND CLEC12A AND SLC7A5 | 0.96371 | 0.97551 | 0.952191 | EPCAM AND FAT1 AND NOT-SLC26A3 | 0.903226 | 0.84 | 0.976744 |
| FLT3 AND EMP3 AND NOT-EDNRB | 0.952381 | 0.991379 | 0.916335 | MUC13 AND NOT-SLCO4C1 AND CD44 | 0.875 | 0.792453 | 0.976744 |
| NOT-PHLDB2 AND NOT-KIAA1324 AND ANXA1 | 0.959223 | 0.935606 | 0.984064 | EPCAM AND S1PR1 AND NOT-CA4 | 0.831169 | 0.941176 | 0.744186 |
| NOT-PHLDB2 AND NOT-KIAA1324 AND DDX3X | 0.962376 | 0.956693 | 0.968127 | CEACAM5 AND NOT-SCNN1B AND TGFBI | 0.883117 | 1 | 0.790698 |
| NOT-PHLDB2 AND HCST AND NOT-HLA-DOB | 0.952015 | 0.918519 | 0.988048 | EPCAM AND CDH3 AND NOT-OXTR | 0.808511 | 0.745098 | 0.883721 |
| NOT-PHLDB2 AND SLC7A5 AND PLP2 | 0.955513 | 0.928571 | 0.984064 | CLDN18 AND SLC2A1 AND NOT-ZNRF3 | 0.833333 | 0.853659 | 0.813953 |
| NOT-PHLDB2 AND SLC7A5 AND PLP2 | 0.955513 | 0.928571 | 0.984064 | EPCAM AND NOT-SLCO4C1 AND CD44 | 0.933333 | 0.893617 | 0.976744 |
| NOT-PHLDB2 AND HCST AND NOT-CR2 | 0.96124 | 0.935849 | 0.988048 | CLDN18 AND SLC2A1 AND NOT-PLGRKT | 0.833333 | 0.853659 | 0.813953 |
| COMPLEX-FLT3/GHR/CLDN8 | 0.950617 | 0.982979 | 0.920319 | ERBB3 AND NOT-SCNN1B AND CD44 | 0.857143 | 0.763636 | 0.976744 |
| NOT-PHLDB2 AND SLC7A5 AND TLR2 | 0.954813 | 0.94186 | 0.968127 | CLDN18 AND SLC2A1 AND STX7 | 0.886076 | 0.972222 | 0.813953 |
| NOT-PHLDB2 AND HCST AND DDX3X | 0.95 | 0.918216 | 0.984064 | EPCAM AND F2R AND NOT-SLC26A3 | 0.977273 | 0.955556 | 1 |
| NOT-PHLDB2 AND EVI2B AND SLC7A5 | 0.949612 | 0.924528 | 0.976096 | CLDN18 AND NOT-KLRF1 AND SLC31A1 | 0.853333 | 1 | 0.744186 |
| NOT-PHLDB2 AND EVI2B AND SLC7A5 | 0.949612 | 0.924528 | 0.976096 | MUC13 AND NOT-SLC30A10 AND PRRG1 | 0.94382 | 0.913043 | 0.976744 |
| NOT-PHLDB2 AND NOT-ERBB3 AND LTBR | 0.949416 | 0.927757 | 0.972112 | CLDN18 AND NOT-S1PR1 AND ITGA2 | 0.883117 | 1 | 0.790698 |
| NOT-PHLDB2 AND NOT-ERBB3 AND LTBR | 0.949416 | 0.927757 | 0.972112 | CLDN18 AND SLC2A1 AND PCDHB7 | 0.847059 | 0.857143 | 0.837209 |
| P2RY8 AND NOT-PHLDB2 AND NOT-CR2 | 0.95499 | 0.938462 | 0.972112 | EPCAM AND FXYD5 AND NOT-CATSPERD | 0.988506 | 0.977273 | 1 |
| P2RY8 AND NOT-PHLDB2 AND NOT-CR2 | 0.95499 | 0.938462 | 0.972112 | EPCAM AND TTYH3 AND NOT-SLC26A3 | 0.848485 | 0.75 | 0.976744 |
| NOT-PHLDB2 AND HCST AND CD70 | 0.95534 | 0.931818 | 0.98008 | EPCAM AND NOT-SCNN1B AND S1PR1 | 0.886364 | 0.866667 | 0.906977 |
| NOT-PHLDB2 AND CXCR4 AND NOT-CR2 | 0.948375 | 0.911765 | 0.988048 | CLDN18 AND LRP11 AND NOT-SLC39A2 | 0.888889 | 0.947368 | 0.837209 |
| NOT-PHLDB2 AND TAAR5 AND NOT-STEAP2 | 0.957916 | 0.96371 | 0.952191 | CLDN18 AND NOT-CD83 AND CD93 | 0.819277 | 0.85 | 0.790698 |
| FLT3 AND NOT-AXL AND EMP3 | 0.948025 | 0.991304 | 0.908367 | EPCAM AND NOT-SLCO4C1 AND CATSPERD | 0.803738 | 0.671875 | 1 |
| NOT-PHLDB2 AND HCST AND SLC39A6 | 0.947977 | 0.91791 | 0.98008 | EPCAM AND FXYD5 AND SEMA4B | 0.965517 | 0.954545 | 0.976744 |
| NOT-PHLDB2 AND HCST AND NOT-MS4A1 | 0.95183 | 0.921642 | 0.984064 | CLDN18 AND SLC4A11 AND NOT-SLC31A1 | 0.847059 | 0.857143 | 0.837209 |
| NOT-PHLDB2 AND HCST AND NOT-FCRL5 | 0.947977 | 0.91791 | 0.98008 | CLDN18 AND SLC4A11 AND NOT-ANTXR2 | 0.814815 | 0.868421 | 0.767442 |
| NOT-PHLDB2 AND TAAR5 AND NOT-ERBB3 | 0.954092 | 0.956 | 0.952191 | CLDN18 AND NOT-CSF3R AND CD58 | 0.871795 | 0.971429 | 0.790698 |
| P2RY8 AND NOT-PHLDB2 AND SLC7A5 | 0.951267 | 0.931298 | 0.972112 | EPCAM AND F2R AND NOT-C1orf210 | 0.934783 | 0.877551 | 1 |
| P2RY8 AND NOT-PHLDB2 AND SLC7A5 | 0.951267 | 0.931298 | 0.972112 | CLDN18 AND NOT-S1PR1 AND SDC4 | 0.833333 | 0.853659 | 0.813953 |
| NOT-PHLDB2 AND CYSLTR1 AND SLC7A5 | 0.946502 | 0.978723 | 0.916335 | CLDN18 AND SLC4A11 AND CD93 | 0.878049 | 0.923077 | 0.837209 |
| NOT-PHLDB2 AND PIEZO1 AND NOT-ERBB3 | 0.946322 | 0.944444 | 0.948207 | CLDN18 AND SLC2A1 AND MTDH | 0.9 | 0.972973 | 0.837209 |
| P2RY8 AND NOT-PHLDB2 AND NOT-HLA-DOB | 0.949416 | 0.927757 | 0.972112 | CLDN18 AND LRP11 AND CD1A | 0.875 | 0.945946 | 0.813953 |
| NOT-PHLDB2 AND SLC7A5 AND ESYT2 | 0.954092 | 0.956 | 0.952191 | EPCAM AND S1PR1 AND CDH3 | 0.888889 | 0.851064 | 0.930233 |
| SLC22A16 AND NOT-ABHD6 AND NOT-KDR | 0.945455 | 0.959016 | 0.932271 | CLDN18 AND CACNG6 AND ESYT2 | 0.878049 | 0.923077 | 0.837209 |
| NOT-PHLDB2 AND FXYD5 AND SLC7A5 | 0.964981 | 0.942966 | 0.988048 | CLDN18 AND NOT-FXYD6 AND SLC25A3 | 0.810811 | 0.967742 | 0.697674 |
| NOT-PHLDB2 AND FXYD5 AND SLC7A5 | 0.964981 | 0.942966 | 0.988048 | EPCAM AND NOT-CATSPERD AND NOT-PARM1 | 0.814815 | 0.868421 | 0.767442 |
| CSF3R AND NOT-PHLDB2 AND SLC7A5 | 0.952965 | 0.978992 | 0.928287 | EPCAM AND PDPN AND NOT-S1PR1 | 0.888889 | 0.851064 | 0.930233 |
| NOT-PHLDB2 AND GLIPR1 AND SLC7A5 | 0.944882 | 0.933852 | 0.956175 | EPCAM AND THY1 AND NOT-S1PR1 | 0.816327 | 0.727273 | 0.930233 |
| NOT-PHLDB2 AND HCST AND NOT-CEACAM5 | 0.944762 | 0.905109 | 0.988048 | EPCAM AND THY1 AND NOT-C8B | 0.816327 | 0.727273 | 0.930233 |
| NOT-PHLDB2 AND TAAR5 AND NOT-CLDN8 | 0.944664 | 0.937255 | 0.952191 | EPCAM AND THY1 AND SEMA4B | 0.860215 | 0.8 | 0.930233 |
| SLC22A16 AND NOT-LAMP3 AND NOT-EDNRB | 0.944559 | 0.974576 | 0.916335 | EPCAM AND THY1 AND NOT-OXTR | 0.816327 | 0.727273 | 0.930233 |
| NOT-PHLDB2 AND HCST AND NOT-FCRL1 | 0.944551 | 0.908088 | 0.984064 | EPCAM AND THY1 AND NOT-FCRL1 | 0.824742 | 0.740741 | 0.930233 |
| NOT-PHLDB2 AND SLC7A5 AND CD46 | 0.953125 | 0.934866 | 0.972112 | CLDN18 AND NOT-FOLR1 AND SLC31A1 | 0.842105 | 0.969697 | 0.744186 |
| NOT-PHLDB2 AND SLC7A5 AND CD46 | 0.953125 | 0.934866 | 0.972112 | CLDN18 AND NOT-SLC34A2 AND SLC30A1 | 0.818182 | 0.8 | 0.837209 |
| NOT-PHLDB2 AND SLC7A5 AND ICAM3 | 0.948177 | 0.914815 | 0.984064 | CLDN18 AND EPCAM AND NOT-S1PR1 | 0.888889 | 0.947368 | 0.837209 |
| NOT-PHLDB2 AND SLC7A5 AND ICAM3 | 0.948177 | 0.914815 | 0.984064 | EPCAM AND SPON2 AND NOT-CATSPERD | 0.931818 | 0.911111 | 0.953488 |
| NOT-PHLDB2 AND HCST AND NOT-CD79A | 0.944338 | 0.911111 | 0.98008 | CLDN18 AND NOT-SLC34A2 AND SLC31A1 | 0.853333 | 1 | 0.744186 |
| NOT-PTPRK AND NOT-PHLDB2 AND CD70 | 0.944338 | 0.911111 | 0.98008 | EPCAM AND NOT-ENPP3 AND SEMA4B | 0.901099 | 0.854167 | 0.953488 |
| NOT-PTPRK AND NOT-PHLDB2 AND CD70 | 0.944338 | 0.911111 | 0.98008 | CLDN18 AND EPCAM AND NOT-CATSPERD | 0.888889 | 0.947368 | 0.837209 |
| NOT-PTPRK AND SLC22A16 AND CD37 | 0.94433 | 0.978632 | 0.912351 | EPCAM AND SPON2 AND NOT-OXTR | 0.906977 | 0.906977 | 0.906977 |
| NOT-PHLDB2 AND HCST AND NOT-CD160 | 0.944123 | 0.914179 | 0.976096 | EPCAM AND SLC7A5 AND NOT-C8B | 0.917647 | 0.928571 | 0.906977 |
| NOT-PHLDB2 AND FXYD5 AND DDX3X | 0.948177 | 0.914815 | 0.984064 | EPCAM AND SLC7A5 AND NOT-S1PR1 | 0.917647 | 0.928571 | 0.906977 |
| NOT-PHLDB2 AND SLC7A5 AND LILRB2 | 0.951456 | 0.92803 | 0.976096 | EPCAM AND FAP AND NOT-S1PR1 | 0.817204 | 0.76 | 0.883721 |
| NOT-PHLDB2 AND SLC7A5 AND TCIRG1 | 0.944338 | 0.911111 | 0.98008 | EPCAM AND SPON2 AND S1PR1 | 0.942529 | 0.931818 | 0.953488 |
| NOT-PHLDB2 AND NOT-CEACAM5 AND LTBR | 0.943249 | 0.926923 | 0.960159 | EPCAM AND NOT-CLDN8 AND SEMA4B | 0.842105 | 0.969697 | 0.744186 |
| NOT-PHLDB2 AND CXCR4 AND NOT-CXCR5 | 0.942966 | 0.901818 | 0.988048 | EPCAM AND FAP AND NOT-C8B | 0.835165 | 0.791667 | 0.883721 |
| NOT-PHLDB2 AND TAAR5 AND SLC7A5 | 0.942801 | 0.933594 | 0.952191 | EPCAM AND NOT-ENPP3 AND NOT-S1PR1 | 0.803922 | 0.694915 | 0.953488 |
| NOT-PHLDB2 AND TAAR5 AND NOT-RNF43 | 0.942801 | 0.933594 | 0.952191 | EPCAM AND FAP AND NOT-CATSPERD | 0.873563 | 0.863636 | 0.883721 |
| NOT-PHLDB2 AND TAAR5 AND NOT-CLDN7 | 0.942801 | 0.933594 | 0.952191 | EPCAM AND SLC7A5 AND CATSPERD | 0.917647 | 0.928571 | 0.906977 |
| NOT-PHLDB2 AND SLC7A5 AND ATP2A3 | 0.942801 | 0.933594 | 0.952191 | EPCAM AND NOT-ENPP3 AND NOT-C8B | 0.815534 | 0.7 | 0.976744 |
| NOT-PHLDB2 AND SLC7A5 AND NOT-FAIM2 | 0.942748 | 0.904762 | 0.984064 | EPCAM AND NOT-ENPP3 AND NOT-CATSPERD | 0.815534 | 0.7 | 0.976744 |
| NOT-PHLDB2 AND SLC7A5 AND NOT-PLP1 | 0.942748 | 0.904762 | 0.984064 | EPCAM AND NOT-CATSPERD AND CLDN1 | 0.955556 | 0.914894 | 1 |
| NOT-PHLDB2 AND SLC7A5 AND NOT-GPRC5B | 0.942748 | 0.904762 | 0.984064 | CLDN18 AND RNF43 AND NOT-SLC22A9 | 0.86747 | 0.9 | 0.837209 |
| NOT-PHLDB2 AND SLC7A5 AND SLC10A3 | 0.946154 | 0.914498 | 0.98008 | EPCAM AND SPON2 AND NOT-C8B | 0.931818 | 0.911111 | 0.953488 |
| SLC22A16 AND NOT-ABHD6 AND NOT-AXL | 0.944785 | 0.970588 | 0.920319 | MUC13 AND CD93 AND NOT-CD33 | 0.821918 | 1 | 0.697674 |
| NOT-PHLDB2 AND EVI2B AND NOT-CR2 | 0.942308 | 0.910781 | 0.976096 | MUC17 AND SLC7A5 AND NOT-PTK7 | 0.853333 | 1 | 0.744186 |
| NOT-PHLDB2 AND EVI2B AND DDX3X | 0.942085 | 0.913858 | 0.972112 | CLDN18 AND RNF43 AND NOT-KCND2 | 0.809524 | 0.829268 | 0.790698 |
| NOT-PHLDB2 AND HCST AND HSPA5 | 0.94186 | 0.916981 | 0.968127 | EPCAM AND NOT-OXTR AND CLDN1 | 0.945055 | 0.895833 | 1 |
| P2RY8 AND NOT-PHLDB2 AND NOT-FCRL5 | 0.941634 | 0.920152 | 0.964143 | CLDN18 AND RNF43 AND NOT-ANTXR2 | 0.804878 | 0.846154 | 0.767442 |
| P2RY8 AND NOT-PHLDB2 AND NOT-FCRL5 | 0.941634 | 0.920152 | 0.964143 | ATP8B1 AND SLC7A5 AND PTK7 | 0.897436 | 1 | 0.813953 |
| SLC22A16 AND P2RY8 AND NOT-CR2 | 0.945233 | 0.96281 | 0.928287 | MUC13 AND S1PR1 AND EPCAM | 0.826667 | 0.96875 | 0.72093 |
| NOT-PHLDB2 AND SLC7A5 AND NOT-ATP1A2 | 0.940952 | 0.90146 | 0.984064 | EPCAM AND NOT-BMPR1B AND SLC6A6 | 0.848485 | 0.75 | 0.976744 |
| NOT-PHLDB2 AND CXCR4 AND DDX3X | 0.940952 | 0.90146 | 0.984064 | EPCAM AND S1PR1 AND CLDN1 | 0.945055 | 0.895833 | 1 |
| NOT-PHLDB2 AND CD300LF AND SLC7A5 | 0.940937 | 0.9625 | 0.920319 | CLDN18 AND RNF43 AND CD58 | 0.911392 | 1 | 0.837209 |
| P2RY8 AND NOT-PHLDB2 AND DDX3X | 0.940039 | 0.913534 | 0.968127 | EPCAM AND VCAM1 AND EPHA2 | 0.839506 | 0.894737 | 0.790698 |
| NOT-SGCE AND EMP3 AND NOT-CD160 | 0.940039 | 0.913534 | 0.968127 | EPCAM AND NOT-BMPR1B AND EPHA2 | 0.839506 | 0.894737 | 0.790698 |
| NOT-PHLDB2 AND NKG7 AND SLC7A5 | 0.939759 | 0.947368 | 0.932271 | EPCAM AND VCAM1 AND SLC6A6 | 0.84 | 0.736842 | 0.976744 |

FIG. 15 (cont.)

| Antigen Pair Logic | F1 | Precision | Recall | Antigen Pair Logic | F1 | Precision | Recall |
|---|---|---|---|---|---|---|---|
| NOT-PHLDB2 AND NOT-ERBB3 AND TYROBP | 0.944762 | 0.905109 | 0.988048 | EPCAM AND BST2 AND VCAM1 | 0.9 | 0.972973 | 0.837209 |
| NOT-PHLDB2 AND NOT-ERBB3 AND TYROBP | 0.944762 | 0.905109 | 0.988048 | EPCAM AND S1PR1 AND NOT-GPA33 | 0.807692 | 0.688525 | 0.976744 |
| SLC22A16 AND P2RY8 AND NOT-FCRL5 | 0.944785 | 0.970588 | 0.920319 | EPCAM AND VCAM1 AND NOT-BEST2 | 0.82 | 0.719298 | 0.953488 |
| NOT-PHLDB2 AND LTBR AND NOT-ERBB2 | 0.939571 | 0.919847 | 0.960159 | EPCAM AND NOT-SLC22A5 AND VCAM1 | 0.850575 | 0.840909 | 0.860465 |
| NOT-PHLDB2 AND LTBR AND NOT-ERBB2 | 0.939571 | 0.919847 | 0.960159 | EPCAM AND NOT-BMPR1B AND NOT-BEST2 | 0.815534 | 0.7 | 0.976744 |
| NOT-PHLDB2 AND NOT-SDC1 AND LTBR | 0.939571 | 0.919847 | 0.960159 | MST1R AND NOT-TYR AND CD93 | 0.837838 | 1 | 0.72093 |
| NOT-PHLDB2 AND NOT-SDC1 AND LTBR | 0.939571 | 0.919847 | 0.960159 | EPCAM AND NOT-CATSPERD AND MOK | 0.804598 | 0.795455 | 0.813953 |
| NOT-PHLDB2 AND LTBR AND NOT-CLDN3 | 0.939571 | 0.919847 | 0.960159 | EPCAM AND VCAM1 AND NOT-SLC30A10 | 0.803738 | 0.671875 | 1 |
| SLC22A16 AND P2RY8 AND NOT-MS4A1 | 0.939516 | 0.95102 | 0.928287 | CLDN18 AND SLC2A1 AND CD93 | 0.878049 | 0.923077 | 0.837209 |
| NOT-PHLDB2 AND NOT-ERBB3 AND TMEM219 | 0.939394 | 0.895307 | 0.988048 | CLDN18 AND NOT-AOC3 AND SLC31A1 | 0.805556 | 1 | 0.674419 |
| NOT-PHLDB2 AND SLC7A5 AND NOT-PTPRZ1 | 0.939163 | 0.898182 | 0.984064 | CLDN18 AND NOT-GYPC AND SLC31A1 | 0.805556 | 1 | 0.674419 |
| NOT-PHLDB2 AND CXCR4 AND NOT-MS4A1 | 0.939163 | 0.898182 | 0.984064 | EPCAM AND BST2 AND NOT-S1PR1 | 0.886076 | 0.972222 | 0.813953 |
| NOT-PHLDB2 AND SLC7A5 AND CD69 | 0.939163 | 0.898182 | 0.984064 | EPCAM AND BST2 AND NOT-CATSPERD | 0.9 | 0.972973 | 0.837209 |
| NOT-PHLDB2 AND SLC7A5 AND NOT-AQP4 | 0.939163 | 0.898182 | 0.984064 | EPCAM AND F2R AND NOT-CATSPERD | 0.886598 | 0.796296 | 1 |
| NOT-PHLDB2 AND SLC7A5 AND NOT-PTPRZ1 | 0.939163 | 0.898182 | 0.984064 | EPCAM AND F2R AND NOT-S1PR1 | 0.86 | 0.754386 | 1 |
| NOT-PHLDB2 AND SLC7A5 AND CD69 | 0.939163 | 0.898182 | 0.984064 | EPCAM AND BST2 AND NOT-C8B | 0.9 | 0.972973 | 0.837209 |
| NOT-PTPRK AND NOT-PHLDB2 AND DDX3X | 0.939163 | 0.898182 | 0.984064 | EPCAM AND NOT-CATSPERD AND SLC6A6 | 0.875 | 0.792453 | 0.976744 |
| NOT-PHLDB2 AND NOT-PTPRF AND DDX3X | 0.939163 | 0.898182 | 0.984064 | EPCAM AND NOT-CATSPERD AND EPHA2 | 0.894118 | 0.904762 | 0.883721 |
| NOT-PHLDB2 AND CD33 AND NOT-KIAA1324 | 0.961771 | 0.971545 | 0.952191 | EPCAM AND NOT-SLC22A5 AND NOT-CATSPERD | 0.804348 | 0.755102 | 0.860465 |
| NOT-PHLDB2 AND CD33 AND NOT-LRRC4 | 0.95122 | 0.970954 | 0.932271 | EPCAM AND BST2 AND SEMA4B | 0.886076 | 0.972222 | 0.813953 |
| NOT-PHLDB2 AND CD33 AND NOT-SLC25A4 | 0.944664 | 0.937255 | 0.952191 | EPCAM AND BST2 AND NOT-OXTR | 0.9 | 0.972973 | 0.837209 |
| NOT-PODXL AND CD33 AND NOT-BTN3A3 | 0.954813 | 0.94186 | 0.968127 | EPCAM AND CDH20 AND S1PR1 | 0.8 | 0.765957 | 0.837209 |
| NOT-PODXL AND NOT-PHLDB2 AND CD33 | 0.945098 | 0.930502 | 0.960159 | EPCAM AND TTYH3 AND S1PR1 | 0.844444 | 0.808511 | 0.883721 |
| NOT-PODXL AND NOT-PHLDB2 AND CD33 | 0.945098 | 0.930502 | 0.960159 | ATP8B1 AND ENG AND NOT-SLC31A1 | 0.857143 | 0.878049 | 0.837209 |
| NOT-PHLDB2 AND CD33 AND NOT-PSENEN | 0.961771 | 0.971545 | 0.952191 | EPCAM AND NOT-OXTR AND SLC6A6 | 0.831683 | 0.724138 | 0.976744 |
| NOT-PHLDB2 AND CD33 AND NOT-PTPRZ1 | 0.944664 | 0.937255 | 0.952191 | THY1 AND NOT-SLC39A2 AND CD58 | 0.804124 | 0.722222 | 0.906977 |
| NOT-PHLDB2 AND CD33 AND NOT-ABHD6 | 0.942801 | 0.933594 | 0.952191 | EPCAM AND S1PR1 AND EPHA2 | 0.860759 | 0.944444 | 0.790698 |
| NOT-PHLDB2 AND CD33 AND NOT-LAMP3 | 0.942801 | 0.933594 | 0.952191 | EPCAM AND S1PR1 AND NOT-BEST2 | 0.803922 | 0.694915 | 0.953488 |
| NOT-PHLDB2 AND CD33 AND NOT-STIM2 | 0.942801 | 0.933594 | 0.952191 | EPCAM AND NOT-SLC22A5 AND S1PR1 | 0.822222 | 0.787234 | 0.860465 |
| NOT-PHLDB2 AND HCST AND CD33 | 0.942748 | 0.904762 | 0.984064 | CLDN18 AND SLC30A10 AND CD58 | 0.853659 | 0.897436 | 0.813953 |
| NOT-PHLDB2 AND CD33 AND EVI2B | 0.942574 | 0.937008 | 0.948207 | EPCAM AND NOT-OXTR AND EPHA2 | 0.839506 | 0.894737 | 0.790698 |
| NOT-PHLDB2 AND CD33 AND NOT-UGT8 | 0.942801 | 0.933594 | 0.952191 | MST1R AND NOT-SLC39A2 AND CD44 | 0.921348 | 0.891304 | 0.953488 |
| NOT-PHLDB2 AND CD33 AND OR6A2 | 0.953535 | 0.967213 | 0.940239 | MUC17 AND S1PR1 AND NOT-RNF43 | 0.826667 | 0.96875 | 0.72093 |
| COMPLEX-SLC4A1/PHLDB2/CD33 | 0.949612 | 0.924528 | 0.976096 | EPCAM AND CXCL16 AND NOT-CATSPERD | 0.853333 | 1 | 0.744186 |
| NOT-PHLDB2 AND CD33 AND NOT-SLC22A4 | 0.94929 | 0.966942 | 0.932271 | EPCAM AND S1PR1 AND SLC6A6 | 0.875 | 0.792453 | 0.976744 |
| NOT-PTPRK AND NOT-PHLDB2 AND CD33 | 0.94186 | 0.916981 | 0.968127 | EPCAM AND S1PR1 AND NOT-SLC30A10 | 0.811321 | 0.68254 | 1 |
| NOT-PTPRK AND NOT-PHLDB2 AND CD33 | 0.94186 | 0.916981 | 0.968127 | EPCAM AND S1PR1 AND LRFN2 | 0.82 | 0.719298 | 0.953488 |
| NOT-PHLDB2 AND CD33 AND NOT-ABCC5 | 0.946322 | 0.944444 | 0.948207 | EPCAM AND NOT-SLC22A5 AND NOT-OXTR | 0.804348 | 0.755102 | 0.860465 |
| NOT-PHLDB2 AND CD33 AND NOT-DAG1 | 0.940945 | 0.929961 | 0.952191 | EPCAM AND NOT-CATSPERD AND ICAM1 | 0.826087 | 0.77551 | 0.883721 |
| NOT-PHLDB2 AND CD33 AND NOT-SLC6A16 | 0.940945 | 0.929961 | 0.952191 | EPCAM AND S1PR1 AND MLNR | 0.8125 | 0.735294 | 0.906977 |
| NOT-PHLDB2 AND CD33 AND NOT-TSPAN1 | 0.940945 | 0.929961 | 0.952191 | CLDN18 AND NOT-SLC34A2 AND ESYT2 | 0.878049 | 0.923077 | 0.837209 |
| NOT-PHLDB2 AND CD33 AND ITGB2 | 0.940945 | 0.929961 | 0.952191 | CLDN18 AND NOT-SLC34A2 AND S100A10 | 0.878049 | 0.923077 | 0.837209 |
| NOT-PHLDB2 AND CD33 AND NOT-PPAP2C | 0.940945 | 0.929961 | 0.952191 | EPCAM AND THY1 AND SLC25A5 | 0.860215 | 0.8 | 0.930233 |
| NOT-PHLDB2 AND CD33 AND CD53 | 0.940476 | 0.936759 | 0.944223 | EPCAM AND THY1 AND CYBA | 0.898876 | 0.869565 | 0.930233 |
| NOT-PODXL AND CD33 AND NOT-BTN3A1 | 0.970179 | 0.968254 | 0.972112 | CLDN18 AND NOT-SLC34A2 AND SLMAP | 0.837209 | 0.837209 | 0.837209 |
| NOT-PHLDB2 AND NOT-LAT AND CD33 | 0.939571 | 0.919847 | 0.960159 | EPCAM AND THY1 AND NOT-PKHD1 | 0.91954 | 0.909091 | 0.930233 |
| NOT-PODXL AND NOT-LAT AND CD33 | 0.939571 | 0.919847 | 0.960159 | CLDN18 AND NOT-SLCO4C1 AND SLC39A6 | 0.857143 | 0.970588 | 0.767442 |
| NOT-PTPRK AND CD33 AND NOT-BTN3A1 | 0.96994 | 0.975806 | 0.964143 | CLDN18 AND NOT-SLCO4C1 AND ANXA1 | 0.853659 | 0.897436 | 0.813953 |
| NOT-PHLDB2 AND CD33 AND NOT-SLC2A10 | 0.939096 | 0.926357 | 0.952191 | CLDN18 AND NOT-SLC34A2 AND STX7 | 0.886076 | 0.972222 | 0.813953 |
| NOT-PHLDB2 AND CD33 AND NOT-CACFD1 | 0.939096 | 0.926357 | 0.952191 | CLDN18 AND NOT-SGCG AND ANXA1 | 0.897436 | 1 | 0.813953 |
| NOT-PHLDB2 AND CD33 AND NOT-SCNN1A | 0.939096 | 0.926357 | 0.952191 | EPCAM AND THY1 AND NCSTN | 0.816327 | 0.727273 | 0.930233 |
| NOT-PHLDB2 AND CD33 AND NOT-CFTR | 0.939096 | 0.926357 | 0.952191 | MUC13 AND NOT-SLC16A9 AND ANXA1 | 0.91358 | 0.973684 | 0.860465 |
| NOT-PHLDB2 AND CD33 AND NOT-GOLM1 | 0.939096 | 0.926357 | 0.952191 | EPCAM AND BIRC5 AND NOT-SLC26A3 | 0.963855 | 1 | 0.930233 |
| NOT-PHLDB2 AND CD33 AND NOT-C1orf210 | 0.939096 | 0.926357 | 0.952191 | EPCAM AND THY1 AND PIGU | 0.842105 | 0.769231 | 0.930233 |
| NOT-PHLDB2 AND CD33 AND NOT-ITPR3 | 0.939096 | 0.926357 | 0.952191 | EPCAM AND THY1 AND VNN3 | 0.833333 | 0.754717 | 0.930233 |
| NOT-PHLDB2 AND CD33 AND NOT-TSPAN3 | 0.939096 | 0.926357 | 0.952191 | EPCAM AND THY1 AND TSPAN13 | 0.857143 | 0.970588 | 0.767442 |
| NOT-PHLDB2 AND CD33 AND NOT-PERP | 0.939096 | 0.926357 | 0.952191 | CLDN18 AND NOT-SLC34A2 AND SLC3A2 | 0.9 | 0.972973 | 0.837209 |
| NOT-PHLDB2 AND CD33 AND NOT-EMP2 | 0.939096 | 0.926357 | 0.952191 | EPCAM AND THY1 AND C1orf210 | 0.8 | 0.730769 | 0.883721 |
| NOT-PHLDB2 AND CD33 AND NOT-ST6GALNAC6 | 0.939096 | 0.926357 | 0.952191 | MUC13 AND NOT-SLCO4C1 AND SLC39A6 | 0.876404 | 0.847826 | 0.906977 |
| NOT-PHLDB2 AND CD33 AND NOT-SLC38A6 | 0.939096 | 0.926357 | 0.952191 | CLDN18 AND NOT-SLC34A2 AND ATRAID | 0.875 | 0.945946 | 0.813953 |
| NOT-PHLDB2 AND CD33 AND NOT-TMPRSS2 | 0.939096 | 0.926357 | 0.952191 | CLDN18 AND NOT-SLC34A2 AND PLGRKT | 0.888889 | 0.947368 | 0.837209 |
| NOT-PHLDB2 AND CD33 AND NOT-WDR19 | 0.939096 | 0.926357 | 0.952191 | CLDN18 AND NOT-SLC34A2 AND PAM | 0.804598 | 0.795455 | 0.813953 |
| NOT-PHLDB2 AND CD33 AND NOT-STOML3 | 0.939096 | 0.926357 | 0.952191 | EPCAM AND EPHB2 AND NOT-SLC26A3 | 0.901099 | 0.854167 | 0.953488 |
| NOT-PHLDB2 AND CD33 AND NOT-SEMA5A | 0.939096 | 0.926357 | 0.952191 | CLDN18 AND NOT-SLC34A2 AND SPINT1 | 0.911392 | 1 | 0.837209 |
| NOT-PHLDB2 AND CD33 AND NOT-SLC17A5 | 0.939096 | 0.926357 | 0.952191 | CLDN18 AND NOT-SLC34A2 AND FXYD3 | 0.837209 | 0.837209 | 0.837209 |
| NOT-PHLDB2 AND CD33 AND NOT-PROS1 | 0.939096 | 0.926357 | 0.952191 | EPCAM AND NOT-CA4 AND NOT-BMPR1B | 0.857143 | 0.878049 | 0.837209 |
| NOT-PHLDB2 AND CD33 AND NOT-LSR | 0.939096 | 0.926357 | 0.952191 | EPCAM AND THY1 AND CDHR3 | 0.816327 | 0.727273 | 0.930233 |
| NOT-PHLDB2 AND CD33 AND NOT-PON2 | 0.939096 | 0.926357 | 0.952191 | CLDN18 AND SLC4A11 AND NOT-TYR | 0.864198 | 0.921053 | 0.813953 |
| NOT-PHLDB2 AND CD33 AND NOT-TSPAN6 | 0.939096 | 0.926357 | 0.952191 | CLDN18 AND NOT-SLC34A2 AND MTDH | 0.9 | 0.972973 | 0.837209 |
| NOT-PTPRK AND CD33 AND NOT-IFNAR2 | 0.944882 | 0.933852 | 0.956175 | EPCAM AND MST1R AND NOT-SLC26A3 | 0.953488 | 0.953488 | 0.953488 |
| NOT-PHLDB2 AND CD33 AND NOT-GPRC5A | 0.937008 | 0.92607 | 0.948207 | EPCAM AND VCAM1 AND NOT-CA4 | 0.831169 | 0.941176 | 0.744186 |
| NOT-PHLDB2 AND CD33 AND NOT-AQP3 | 0.937008 | 0.92607 | 0.948207 | CLDN18 AND NOT-CD33 AND ATP13A1 | 0.86747 | 0.9 | 0.837209 |
| NOT-PHLDB2 AND CD33 AND NOT-ATP2C2 | 0.937008 | 0.92607 | 0.948207 | EPCAM AND NOT-ENPP3 AND PIGU | 0.91954 | 0.909091 | 0.930233 |
| P2RY8 AND NOT-PHLDB2 AND CD33 | 0.93666 | 0.903704 | 0.972112 | EPCAM AND SPON2 AND NOT-CDHR3 | 0.931818 | 0.911111 | 0.953488 |
| NOT-PHLDB2 AND CD33 AND CD69 | 0.9499 | 0.955645 | 0.944223 | EPCAM AND CDH3 AND NOT-BMPR1B | 0.869565 | 0.816327 | 0.930233 |
| COMPLEX-FXYD5/PHLDB2/CD33 | 0.935849 | 0.888889 | 0.988048 | EPCAM AND SLC7A5 AND LRP11 | 0.939759 | 0.975 | 0.906977 |
| NOT-PHLDB2 AND CXCR4 AND CD33 | 0.935849 | 0.888889 | 0.988048 | EPCAM AND NOT-SLCO4C1 AND SLC39A6 | 0.824742 | 0.740741 | 0.930233 |

FIG. 15 (cont.)

| Antigen Pair Logic | F1 | Precision | Recall |
|---|---|---|---|
| COMPLEX-LPAR1/PHLDB2/CD33 | 0.939096 | 0.926357 | 0.952191 |
| NOT-PHLDB2 AND CD33 AND NOT-AMIGO2 | 0.934911 | 0.925781 | 0.944223 |
| NOT-PHLDB2 AND CD33 AND SELL | 0.934132 | 0.936 | 0.932271 |
| NOT-PHLDB2 AND CD33 AND LTBR | 0.933602 | 0.943089 | 0.924303 |
| NOT-PODXL AND CD33 AND NOT-IFNAR2 | 0.941634 | 0.920152 | 0.964143 |
| NOT-PHLDB2 AND CD33 AND NOT-ST14 | 0.930693 | 0.925197 | 0.936255 |
| NOT-PTPRK AND NOT-S1PR1 AND CD33 | 0.930502 | 0.902622 | 0.960159 |
| NOT-PTPRK AND CD33 AND NOT-SEMA4D | 0.930502 | 0.902622 | 0.960159 |
| NOT-PTPRK AND NOT-S1PR1 AND CD33 | 0.930502 | 0.902622 | 0.960159 |
| NOT-PHLDB2 AND CD33 AND NOT-LRP11 | 0.930417 | 0.928571 | 0.932271 |
| NOT-PTPRK AND CD33 AND NOT-BTN3A3 | 0.956 | 0.959839 | 0.952191 |
| NOT-PHLDB2 AND CD33 AND NOT-TSPAN31 | 0.928571 | 0.924901 | 0.932271 |
| NOT-PODXL AND CD33 AND NOT-S1PR1 | 0.925253 | 0.938525 | 0.912351 |
| NOT-PHLDB2 AND CD33 AND NOT-CD46 | 0.925 | 0.969432 | 0.884462 |
| NOT-PODXL AND CD33 AND NOT-STEAP4 | 0.953157 | 0.975 | 0.932271 |
| NOT-PODXL AND CD33 AND NOT-SEMA4D | 0.923954 | 0.883636 | 0.968127 |
| NOT-PTPRK AND CD33 AND NOT-PIK3IP1 | 0.91498 | 0.930041 | 0.900398 |
| CD33 AND NOT-ATP8B1 AND NOT-CD27 | 0.926148 | 0.928 | 0.924303 |
| NOT-PTPRK AND CD33 AND NOT-KCNK6 | 0.907721 | 0.860714 | 0.960159 |
| NOT-PTPRK AND CD33 AND NOT-FMNL1 | 0.907692 | 0.877323 | 0.940239 |
| NOT-PODXL AND CD33 AND NOT-TGFBI | 0.907258 | 0.918367 | 0.896414 |
| NOT-PODXL AND CD33 AND NOT-SLC6A6 | 0.906367 | 0.855124 | 0.964143 |
| NOT-PTPRK AND CD33 AND NOT-TGFBI | 0.906122 | 0.92887 | 0.884462 |
| NOT-PTPRK AND CD33 AND NOT-AOC3 | 0.904315 | 0.85461 | 0.960159 |
| NOT-PODXL AND CD33 AND NOT-PIK3IP1 | 0.904315 | 0.85461 | 0.960159 |
| NOT-PTPRK AND CD33 AND NOT-IL17RA | 0.904215 | 0.870849 | 0.940239 |
| CD33 AND NOT-AOC3 AND NOT-EPHA4 | 0.932271 | 0.932271 | 0.932271 |
| CD33 AND NOT-STX7 AND NOT-GHR | 0.956701 | 0.991453 | 0.924303 |
| CD33 AND NOT-STX7 AND NOT-ATP8B1 | 0.954733 | 0.987234 | 0.924303 |
| NOT-PODXL AND NOT-GPR137B AND CD33 | 0.898969 | 0.931624 | 0.868526 |
| NOT-PTPRK AND NOT-GPR137B AND CD33 | 0.898969 | 0.931624 | 0.868526 |
| CD33 AND NOT-LAT AND NOT-DAG1 | 0.910931 | 0.925926 | 0.896414 |
| CD33 AND NOT-ATP8B1 AND NOT-HVCN1 | 0.91453 | 0.986175 | 0.85259 |
| CD33 AND NOT-ATP8B1 AND NOT-PAG1 | 0.927126 | 0.942387 | 0.912351 |
| COMPLEX-SLC4A1/STEAP4/CD33 | 0.896679 | 0.835052 | 0.968127 |
| NOT-PHLDB2 AND CD33 AND NOT-ADIPOR1 | 0.892704 | 0.967442 | 0.828685 |
| CD33 AND NOT-SEMA4D AND NOT-DAG1 | 0.903101 | 0.879245 | 0.928287 |
| COMPLEX-SLC4A1/TGFBI/CD33 | 0.891945 | 0.879845 | 0.904382 |
| CD33 AND NOT-EPHA4 AND NOT-GHR | 0.915187 | 0.90625 | 0.924303 |
| CD33 AND NOT-BTN3A1 AND NOT-DAG1 | 0.945233 | 0.96281 | 0.928287 |
| COMPLEX-BTN3A1/SLC4A1/CD33 | 0.931818 | 0.888087 | 0.98008 |
| NOT-PTPRK AND CD70 AND NOT-HLA-DOB | 0.927374 | 0.870629 | 0.992032 |
| NOT-PTPRK AND CD70 AND NOT-SLAMF7 | 0.932331 | 0.882562 | 0.988048 |
| NOT-PTPRK AND CD70 AND NOT-FCRL5 | 0.925094 | 0.872792 | 0.984064 |
| NOT-PTPRK AND CD70 AND NOT-MS4A1 | 0.930057 | 0.884892 | 0.98008 |
| P2RY8 AND NOT-HLA-DOB AND NOT-AXL | 0.922787 | 0.875 | 0.976096 |
| NOT-PTPRK AND SLC7A5 AND DDX3X | 0.922495 | 0.877698 | 0.972112 |
| NOT-PTPRK AND CD37 AND NOT-CD160 | 0.921905 | 0.883212 | 0.964143 |
| P2RY8 AND NOT-ST8SIA1 AND NOT-MS4A1 | 0.935673 | 0.916031 | 0.956175 |
| P2RY8 AND NOT-MS4A1 AND NOT-KDR | 0.927757 | 0.887273 | 0.972112 |
| NOT-PTPRK AND CD70 AND NOT-SPON2 | 0.923933 | 0.864583 | 0.992032 |
| P2RY8 AND NOT-HLA-DOB AND NOT-CLDN8 | 0.926829 | 0.875887 | 0.984064 |
| P2RY8 AND NOT-ST8SIA1 AND NOT-FCRL1 | 0.924855 | 0.895522 | 0.956175 |
| NOT-PTPRK AND CD37 AND NOT-SLAMF7 | 0.919021 | 0.871429 | 0.972112 |
| NOT-PTPRK AND SLC7A5 AND NOT-SLAMF7 | 0.918519 | 0.858131 | 0.988048 |
| NOT-PODXL AND CD37 AND NOT-CD160 | 0.918406 | 0.876812 | 0.964143 |
| NOT-PODXL AND CD37 AND NOT-MS4A1 | 0.918406 | 0.876812 | 0.964143 |
| NOT-PODXL AND CD37 AND NOT-MS4A1 | 0.918406 | 0.876812 | 0.964143 |
| P2RY8 AND NOT-ST8SIA1 AND NOT-FCRL5 | 0.930769 | 0.899628 | 0.964143 |
| P2RY8 AND NOT-MS4A1 AND NOT-AXL | 0.920152 | 0.88 | 0.964143 |
| P2RY8 AND NOT-MS4A1 AND NOT-AXL | 0.920152 | 0.88 | 0.964143 |
| P2RY8 AND NOT-PCYT1A AND NOT-CR2 | 0.936902 | 0.900735 | 0.976096 |
| COMPLEX-MST1R/PTPRK/SLC7A5 | 0.917293 | 0.868327 | 0.972112 |
| P2RY8 AND NOT-HLA-DOB AND NOT-EDNRB | 0.916667 | 0.873646 | 0.964143 |
| COMPLEX-PTPRK/SSTR4/SLC7A5 | 0.915572 | 0.865248 | 0.972112 |
| NOT-PTPRK AND SLC7A5 AND NOT-HLA-DOB | 0.915441 | 0.849829 | 0.992032 |
| P2RY8 AND NOT-MS4A1 AND NOT-EDNRB | 0.915709 | 0.881919 | 0.952191 |
| NOT-PTPRK AND CD70 AND NOT-FCRL1 | 0.914498 | 0.857143 | 0.98008 |
| NOT-PTPRK AND SLC7A5 AND NOT-FCRL5 | 0.914179 | 0.859649 | 0.976096 |
| NOT-PTPRK AND CD37 AND NOT-FCRL5 | 0.913208 | 0.867384 | 0.964143 |
| NOT-PTPRK AND CD70 AND NOT-CD22 | 0.918216 | 0.860627 | 0.984064 |
| P2RY8 AND NOT-MS4A1 AND NOT-TNC | 0.927757 | 0.887273 | 0.972112 |
| P2RY8 AND NOT-ST8SIA1 AND NOT-FCRL2 | 0.927203 | 0.892989 | 0.964143 |
| NOT-PTPRK AND SLC7A5 AND NOT-CD160 | 0.911439 | 0.848797 | 0.984064 |
| P2RY8 AND NOT-ST8SIA1 AND NOT-CR2 | 0.918406 | 0.876812 | 0.964143 |
| COMPLEX-PTPRK/VTCN1/SLC7A5 | 0.910448 | 0.85614 | 0.972112 |
| NOT-PODXL AND CD37 AND NOT-FCRL5 | 0.910448 | 0.85614 | 0.972112 |

| Antigen Pair Logic | F1 | Precision | Recall |
|---|---|---|---|
| EPCAM AND SPON2 AND EMP1 | 0.964706 | 0.97619 | 0.953488 |
| EPCAM AND NOT-ENPP3 AND CLSTN1 | 0.831683 | 0.724138 | 0.976744 |
| EPCAM AND NOT-CLDN8 AND PIGU | 0.810811 | 0.967742 | 0.697674 |
| EPCAM AND SPON2 AND NOT-VNN3 | 0.931818 | 0.911111 | 0.953488 |
| EPCAM AND SPON2 AND HEPH | 0.931818 | 0.911111 | 0.953488 |
| EPCAM AND SPON2 AND PRRG1 | 0.931818 | 0.911111 | 0.953488 |
| EPCAM AND CDH3 AND VCAM1 | 0.833333 | 0.754717 | 0.930233 |
| EPCAM AND FAP AND SLC25A5 | 0.853933 | 0.826087 | 0.883721 |
| CLDN18 AND EPCAM AND NOT-CDHR3 | 0.875 | 0.945946 | 0.813953 |
| CLDN18 AND NOT-SLC34A2 AND F11R | 0.883117 | 1 | 0.790698 |
| EPCAM AND SLC7A5 AND CYBA | 0.95122 | 1 | 0.906977 |
| CLDN18 AND EPCAM AND NOT-OR2S2 | 0.883117 | 1 | 0.790698 |
| EPCAM AND SLC7A5 AND NOT-FXYD3 | 0.917647 | 0.928571 | 0.906977 |
| EPCAM AND BIRC5 AND NOT-C1orf210 | 0.925 | 1 | 0.860465 |
| EPCAM AND NOT-SCNN1B AND VCAM1 | 0.934783 | 0.877551 | 1 |
| EPCAM AND NOT-ENPP3 AND ZDHHC5 | 0.965517 | 0.954545 | 0.976744 |
| EPCAM AND NOT-CLDN8 AND ZDHHC5 | 0.857143 | 0.970588 | 0.767442 |
| EPCAM AND SLC7A5 AND C1orf210 | 0.891566 | 0.925 | 0.860465 |
| EPCAM AND FAP AND CYBA | 0.853933 | 0.826087 | 0.883721 |
| EPCAM AND SLC7A5 AND VNN3 | 0.917647 | 0.928571 | 0.906977 |
| EPCAM AND FAP AND NOT-OR2S2 | 0.886076 | 0.972222 | 0.813953 |
| EPCAM AND NOT-ENPP3 AND NOT-PKHD1 | 0.875 | 0.792453 | 0.976744 |
| CLDN18 AND EPCAM AND VNN3 | 0.888889 | 0.947368 | 0.837209 |
| EPCAM AND SLC7A5 AND NOT-SLC26A3 | 0.904762 | 0.926829 | 0.883721 |
| EPCAM AND SLC7A5 AND OR2S2 | 0.904762 | 0.926829 | 0.883721 |
| EPCAM AND SLC7A5 AND NOT-EMP1 | 0.835443 | 0.916667 | 0.767442 |
| MUC13 AND NOT-SPPL2A AND NOT-BMPR1B | 0.88172 | 0.82 | 0.953488 |
| CLDN18 AND NOT-SLC34A2 AND SPPL2A | 0.883117 | 1 | 0.790698 |
| MUC13 AND SLC7A5 AND NOT-FXYD3 | 0.897436 | 1 | 0.813953 |
| EPCAM AND NOT-SCNN1B AND NOT-BMPR1B | 0.886598 | 0.796296 | 1 |
| CLDN18 AND EPCAM AND PIGU | 0.883117 | 1 | 0.790698 |
| EPCAM AND NOT-CLDN8 AND TMEM63B | 0.804878 | 0.846154 | 0.767442 |
| EPCAM AND NOT-ENPP3 AND CYBA | 0.954545 | 0.933333 | 0.976744 |
| EPCAM AND NOT-CLDN8 AND CYBA | 0.857143 | 0.970588 | 0.767442 |
| EPCAM AND NOT-CLDN8 AND ADAM10 | 0.835443 | 0.916667 | 0.767442 |
| CDH17 AND NOT-SCNN1B AND CD44 | 0.911111 | 0.87234 | 0.953488 |
| CDH17 AND NOT-SCNN1B AND TGFBI | 0.870588 | 0.880952 | 0.860465 |
| CDH17 AND NOT-SLC30A10 AND SDC4 | 0.953488 | 0.953488 | 0.953488 |
| CDH17 AND NOT-FXYD3 AND CD93 | 0.857143 | 0.8125 | 0.906977 |
| CDH17 AND NOT-SLC30A10 AND SPINT1 | 0.931818 | 0.911111 | 0.953488 |
| CDH17 AND NOT-SLC30A10 AND SLC25A5 | 0.901099 | 0.854167 | 0.953488 |
| CDH17 AND NOT-SLC30A10 AND PCDHB7 | 0.811881 | 0.706897 | 0.953488 |
| CDH17 AND NOT-SLC30A10 AND F11R | 0.911111 | 0.87234 | 0.953488 |
| CDH17 AND NOT-SLC30A10 AND MTDH | 0.931818 | 0.911111 | 0.953488 |
| PTPRH AND NOT-SLC30A10 AND CD58 | 0.87234 | 0.803922 | 0.953488 |
| FUT3 AND NOT-SCNN1B AND CD44 | 0.869565 | 0.816327 | 0.930233 |
| MUC17 AND NOT-SLC30A10 AND LRP8 | 0.853333 | 1 | 0.744186 |
| MUC17 AND NOT-SLC30A10 AND ESYT2 | 0.853333 | 1 | 0.744186 |
| MUC17 AND NOT-SPPL2A AND NOT-GPR22 | 0.842105 | 0.969697 | 0.744186 |
| CDH17 AND NOT-SLC30A10 AND CD99 | 0.823529 | 0.833333 | 0.813953 |
| ATP8B1 AND CD93 AND NOT-SLC6A1 | 0.826667 | 0.96875 | 0.72093 |
| ATP8B1 AND PLXND1 AND NOT-SLC31A1 | 0.871795 | 0.971429 | 0.790698 |
| PVRL3 AND NOT-SLC30A10 AND CD58 | 0.839506 | 0.894737 | 0.790698 |
| SYT13 AND NOT-SLC30A10 AND CD58 | 0.909091 | 0.888889 | 0.930233 |
| COMPLEX-MUC17/CD93/LRP8 | 0.853333 | 1 | 0.744186 |
| ATP8B1 AND CD93 AND NOT-STX7 | 0.871795 | 0.971429 | 0.790698 |
| COMPLEX-MUC17/CD93/SPINT1 | 0.826667 | 0.96875 | 0.72093 |
| MUC17 AND NOT-SCNN1B AND CD44 | 0.853333 | 1 | 0.744186 |
| FUT3 AND NOT-SCNN1B AND TGFBI | 0.886076 | 0.972222 | 0.813953 |
| ATP8B1 AND TGFBI AND NOT-SCNN1B | 0.883117 | 1 | 0.790698 |
| ATP8B1 AND NOT-SCNN1B AND CD44 | 0.91358 | 0.973684 | 0.860465 |
| MUC17 AND NOT-GPR22 AND PCDHB7 | 0.842105 | 0.969697 | 0.744186 |
| MUC17 AND NOT-SPPL2A AND NOT-MRAP | 0.842105 | 0.969697 | 0.744186 |
| MUC17 AND NOT-SPPL2A AND NOT-CD1A | 0.842105 | 0.969697 | 0.744186 |
| MUC17 AND NOT-SPPL2A AND NOT-KCND2 | 0.842105 | 0.969697 | 0.744186 |
| MUC17 AND SLC39A10 AND NOT-CD1A | 0.831169 | 0.941176 | 0.744186 |
| MUC17 AND SLC39A10 AND NOT-OMG | 0.831169 | 0.941176 | 0.744186 |
| MUC17 AND SLC39A10 AND NOT-SLCO1C1 | 0.831169 | 0.941176 | 0.744186 |
| TSPAN8 AND CD93 AND SLC2A1 | 0.826667 | 0.96875 | 0.72093 |
| MUC17 AND NOT-SLCO4C1 AND GYPC | 0.815789 | 0.939394 | 0.72093 |
| TSPAN8 AND CD93 AND SLC31A1 | 0.826667 | 0.96875 | 0.72093 |
| MUC17 AND LRP11 AND NOT-AOC3 | 0.831169 | 0.941176 | 0.744186 |
| MUC17 AND NOT-SLCO4C1 AND PTGIS | 0.826667 | 0.96875 | 0.72093 |
| MUC17 AND SYT11 AND NOT-ZDHHC5 | 0.810811 | 0.967742 | 0.697674 |
| MUC17 AND LRP11 AND NOT-SLC39A2 | 0.831169 | 0.941176 | 0.744186 |
| MUC17 AND HEG1 AND NOT-GPR6 | 0.831169 | 0.941176 | 0.744186 |
| MUC17 AND NOT-SLCO4C1 AND VANGL1 | 0.831169 | 0.941176 | 0.744186 |

FIG. 15 (cont.)

| Antigen Pair Logic | F1 | Precision | Recall | Antigen Pair Logic | F1 | Precision | Recall |
|---|---|---|---|---|---|---|---|
| CXCR4 AND NOT-SLAMF7 AND NOT-KDR | 0.913958 | 0.878676 | 0.952191 | MUC17 AND PCDHB7 AND NOT-ATP13A5 | 0.842105 | 0.969697 | 0.744186 |
| P2RY8 AND NOT-GPNMB AND NOT-MS4A1 | 0.909441 | 0.880597 | 0.940239 | MUC17 AND CSF2RB AND NOT-ATP13A5 | 0.831169 | 0.941176 | 0.744186 |
| P2RY8 AND NOT-GPNMB AND NOT-MS4A1 | 0.909441 | 0.880597 | 0.940239 | COMPLEX-MUC17/ATP13A5/SPPL2A | 0.842105 | 0.969697 | 0.744186 |
| P2RY8 AND NOT-HLA-DOB AND NOT-CLDN5 | 0.926829 | 0.875887 | 0.984064 | COMPLEX-MUC17/CACNG6/SPPL2A | 0.842105 | 0.969697 | 0.744186 |
| NOT-PTPRK AND SLC7A5 AND NOT-ALDH1A1 | 0.907721 | 0.860714 | 0.960159 | EPCAM AND SPON2 AND NOT-BMPR1B | 0.942529 | 0.931818 | 0.953488 |
| P2RY8 AND NOT-MS4A1 AND NOT-CLDN8 | 0.920755 | 0.874552 | 0.972112 | EPCAM AND SPON2 AND VCAM1 | 0.942529 | 0.931818 | 0.953488 |
| P2RY8 AND NOT-MS4A1 AND NOT-CLDN8 | 0.920755 | 0.874552 | 0.972112 | MUC13 AND SLC7A5 AND NOT-PTK7 | 0.938272 | 1 | 0.883721 |
| P2RY8 AND NOT-MS4A1 AND NOT-CLDN11 | 0.924242 | 0.880866 | 0.972112 | EPCAM AND NOT-CLDN8 AND VCAM1 | 0.835443 | 0.916667 | 0.767442 |
| NOT-PODXL AND CD37 AND NOT-HLA-DOB | 0.907407 | 0.847751 | 0.976096 | CLDN18 AND RNF43 AND NOT-TYR | 0.843373 | 0.875 | 0.813953 |
| NOT-PTPRK AND CD37 AND NOT-HLA-DOB | 0.907407 | 0.847751 | 0.976096 | CEACAM5 AND SLC7A5 AND PTK7 | 0.814815 | 0.868421 | 0.767442 |
| P2RY8 AND NOT-MS4A1 AND NOT-STEAP1 | 0.919847 | 0.882784 | 0.960159 | EPCAM AND NOT-BMPR1B AND CLDN1 | 0.955556 | 0.914894 | 1 |
| P2RY8 AND NOT-MS4A1 AND NOT-PCYT1A | 0.938224 | 0.910112 | 0.968127 | EPCAM AND VCAM1 AND CLDN1 | 0.945055 | 0.895833 | 1 |
| NOT-PTPRK AND CD37 AND NOT-FCRL1 | 0.90631 | 0.871324 | 0.944223 | EPCAM AND NOT-BMPR1B AND NOT-GPA33 | 0.807692 | 0.688525 | 0.976744 |
| P2RY8 AND NOT-MS4A1 AND NOT-CEACAM5 | 0.924242 | 0.880866 | 0.972112 | EPCAM AND VCAM1 AND NOT-GPA33 | 0.823529 | 0.711864 | 0.976744 |
| P2RY8 AND NOT-MS4A1 AND NOT-RNF43 | 0.922495 | 0.877698 | 0.972112 | EPCAM AND TNC AND NOT-BMPR1B | 0.808511 | 0.745098 | 0.883721 |
| P2RY8 AND NOT-MS4A1 AND NOT-ITGAV | 0.905222 | 0.879699 | 0.932271 | EPCAM AND VCAM1 AND NOT-SSTR2 | 0.824742 | 0.740741 | 0.930233 |
| P2RY8 AND NOT-MS4A1 AND NOT-FOLR2 | 0.904854 | 0.882576 | 0.928287 | EPCAM AND FCRL5 AND BMPR1B | 0.836735 | 0.745455 | 0.953488 |
| P2RY8 AND NOT-HLA-DOB AND NOT-GPNMB | 0.904215 | 0.870849 | 0.940239 | EPCAM AND VCAM1 AND MOK | 0.818182 | 0.8 | 0.837209 |
| CXCR4 AND NOT-SLAMF7 AND NOT-SDC1 | 0.903592 | 0.859712 | 0.952191 | CDH17 AND NOT-SLC30A10 AND CD58 | 0.909091 | 0.888889 | 0.930233 |
| P2RY8 AND NOT-MS4A1 AND NOT-ROR1 | 0.920755 | 0.874552 | 0.972112 | COMPLEX-SLC31A1/MUC17/CD1A | 0.815789 | 0.939394 | 0.72093 |
| P2RY8 AND NOT-MS4A1 AND NOT-GPC3 | 0.920755 | 0.874552 | 0.972112 | MUC17 AND CD44 AND NOT-SLC39A2 | 0.842105 | 0.969697 | 0.744186 |
| P2RY8 AND NOT-FCRL1 AND NOT-TNC | 0.903346 | 0.84669 | 0.968127 | ATP8B1 AND AOC3 AND NOT-SLC31A1 | 0.847059 | 0.857143 | 0.837209 |
| NOT-PTPRK AND CD70 AND NOT-CD79A | 0.903108 | 0.834459 | 0.984064 | ATP8B1 AND SYT11 AND NOT-SLC31A1 | 0.829268 | 0.871795 | 0.790698 |
| CXCR4 AND NOT-HLA-DOB AND NOT-KDR | 0.902033 | 0.841379 | 0.972112 | ATP8B1 AND CD44 AND NOT-SLC39A2 | 0.888889 | 0.947368 | 0.837209 |
| NOT-PODXL AND CD37 AND NOT-CR2 | 0.902033 | 0.841379 | 0.972112 | FAT1 AND NOT-SLC39A2 AND CD44 | 0.828283 | 0.732143 | 0.953488 |
| P2RY8 AND NOT-MS4A1 AND NOT-CLDN23 | 0.920455 | 0.877256 | 0.968127 | ATP8B1 AND ANTXR2 AND TMPRSS11D | 0.823529 | 0.833333 | 0.813953 |
| P2RY8 AND NOT-PCYT1A AND NOT-FCRL1 | 0.920455 | 0.877256 | 0.968127 | ATP8B1 AND ANTXR2 AND SLCO1C1 | 0.853659 | 0.897436 | 0.813953 |
| NOT-EDNRB AND ITGB2 AND NOT-HLA-DOB | 0.900735 | 0.836177 | 0.976096 | ATP8B1 AND ANTXR2 AND NKAIN2 | 0.875 | 0.945946 | 0.813953 |
| CXCR4 AND NOT-HLA-DOB AND NOT-SDC1 | 0.900369 | 0.838488 | 0.972112 | FAT1 AND NOT-SLC30A10 AND CD58 | 0.863158 | 0.788462 | 0.953488 |
| CD37 AND NOT-MS4A1 AND P2RY8 | 0.900196 | 0.884615 | 0.916335 | TTYH3 AND NOT-CD1A AND AOC3 | 0.8 | 0.809524 | 0.790698 |

(cont. at top)

US 11,400,116 B2

SYSTEMS AND METHODS FOR TARGETING CANCER CELLS

CROSS-REFERENCE

This application claims the benefit of U.S. Provisional Patent Application No. 62/333,106, filed May 6, 2016, which application is incorporated herein by reference in its entirety.

STATEMENT REGARDING FEDERALLY SPONSORED RESEARCH

This invention was made with government support under Grant No. GM071966 and GM071508 awarded by the National Institutes of Health/NIGMS and Grant No. HL117798 awarded by the National Institutes of Health/NHLBI. This invention was also made with government support under Grant No. R01 CA196277 awarded by the National Institutes of Health. The government has certain rights in the invention.

INCORPORATION BY REFERENCE OF SEQUENCE LISTING PROVIDED AS A TEXT FILE

A Sequence Listing is provided herewith as a text file, "UCSF-537WO_SeqList_ST25.txt" created on May 5, 2017 and having a size of 37,675 KB. The contents of the text file are incorporated by reference herein in their entirety.

INTRODUCTION

Immune cell activation can be engineered ex vivo through expression of various designer antigen-triggered immune cell receptors including, e.g., synthetic chimeric antigen receptors (CAR), synthetic Notch polypeptides (synNotch), inhibitory CARs (iCARs), split CARs, and engineered T cell Receptors (TCR). A goal of such immune cell activation is targeting and killing of cancer cells in a patient, while avoiding or at least minimizing killing of non-cancerous cells.

SUMMARY

The present disclosure provides an immune cell genetically modified to produce two antigen-triggered polypeptides, each recognizing a different cell surface antigen. The present disclosure provides a system comprising two antigen-triggered polypeptides (or nucleic acids encoding same), each recognizing a different cell surface antigen. The present disclosure provides a method of killing a target cancer cell, using a genetically modified immune cell or a system of the present disclosure. The present disclosure provides a computational method to identify target antigen pairs on a cancer cell.

BRIEF DESCRIPTION OF THE DRAWINGS

FIG. 1 provides antigen combinations for various cancers.

FIG. 2 provides amino acid sequences of antigens within antigen combinations.

FIG. 4 provides cancer-associated target antigens in clinical trials.

FIG. 6A-6F provide schematic depictions of exemplary split CARs.

FIG. 9 provides clinical antigen AND-gate combinations for various exemplary cancers.

FIG. 10 provides clinical antigen AND NOT-gate combinations for various exemplary cancers.

FIG. 11 provides novel antigen AND-gate combinations for various exemplary cancers.

FIG. 12 provides novel antigen AND NOT-gate combinations for various exemplary cancers.

FIG. 13 provides clinical-clinical antigen combinations for various exemplary cancers.

FIG. 14 provides single antigens useful for various exemplary cancers.

FIG. 15 provides three antigen combinations for various exemplary cancers.

DEFINITIONS

Figure 3A:
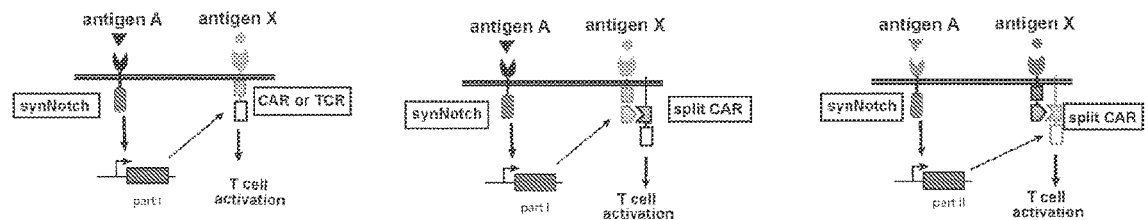
FIG. 3A-3D provide schematic depictions of various antigen-triggered polypeptides; and AND and AND-NOT logic gates using the antigen-triggered polypeptides.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

The terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. *Sci Transl Med* (2013); 5(215):215ra172; Glienke et al. *Front Pharmacol* (2015) 6:21; Kakarla & Gottschalk 52 *Cancer J* (2014) 20(2):151-5; Riddell et al. *Cancer J* (2014) 20(2):141-4; Pegram et al. *Cancer J* (2014) 20(2):127-33; Cheadle et al. *Immunol Rev* (2014) 257(1):91-106; Barrett et al. *Annu Rev Med* (2014) 65:333-47; Sadelain et al. *Cancer Discov* (2013) 3(4):388-98; Cartellieri et al., *J Biomed Biotechnol* (2010) 956304; the disclosures of which are incorporated herein by reference in their entirety.

As used herein, the term "immune cells" generally includes white blood cells (leukocytes) which are derived from hematopoietic stem cells (HSC) produced in the bone marrow "Immune cells" includes, e.g., lymphocytes (T cells, B cells, natural killer (NK) cells) and myeloid-derived cells (neutrophil, eosinophil, basophil, monocyte, macrophage, dendritic cells).

"T cell" includes all types of immune cells expressing CD3 including T-helper cells (CD4+ cells), cytotoxic T-cells (CD8+ cells), T-regulatory cells (Treg) and gamma-delta T cells.

A "cytotoxic cell" includes CD8+ T cells, natural-killer (NK) cells, and neutrophils, which cells are capable of mediating cytotoxicity responses.

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment," as used herein, covers any treatment of a disease in a mammal, e g, in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines (e.g., rats, mice), lagomorphs (e.g., rabbits), non-human primates, humans, canines, felines, ungulates (e.g., equines, bovines, ovines, porcines, caprines), etc. In some cases, the individual is a human.

A "therapeutically effective amount" or "efficacious amount" refers to the amount of an agent, or combined amounts of two agents, that, when administered to a mammal or other subject for treating a disease, is sufficient to effect such treatment for the disease. The "therapeutically effective amount" will vary depending on the agent(s), the disease and its severity and the age, weight, etc., of the subject to be treated.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a target antigen" includes a plurality of such antigens and reference to "the system" includes reference to one or more systems and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides an immune cell genetically modified to produce two antigen-triggered polypeptides, each recognizing a different cell surface antigen. The present disclosure provides a system of two antigen-triggered polypeptides, each recognizing a different cell surface antigen. The present disclosure provides a method of killing a target cancer cell, using a genetically modified immune cell or a system of the present disclosure.

The present disclosure provides an in vitro genetically modified cytotoxic immune cell, where the cytotoxic immune cell is genetically modified to produce two different antigen-triggered polypeptides that recognize two different cell surface antigens, and where at least one of the two different cell surface antigens is present on the surface of a target cancer cell. In some cases, the two different antigen-triggered polypeptides comprise: a) a first antigen-triggered polypeptide that binds specifically to a first target cell surface antigen present on a target cancer cell; and b) a second antigen-triggered polypeptide that binds specifically to a second target cell surface antigen. In some cases, the genetically modified cytotoxic immune cell is a genetically modified cytotoxic T cell or a genetically modified natural killer cell. In some cases, the two different antigen-triggered polypeptides provide an AND gate; thus, for example, in some cases, the genetically modified cytotoxic immune cell is activated to kill a target cancer cell only when the target cancer cell expresses both of the two different cell surface antigens on its cell surface. In some cases, the two different antigen-triggered polypeptides provide an AND-NOT gate; thus, for example, in some cases, the genetically modified cytotoxic immune cell: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface.

The present disclosure provides a system for killing a target cancer cell, the system comprising: a) a first antigen-triggered polypeptide that binds specifically to a first target antigen present on the target cancer cell, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide. In some cases, the system provides an AND gate; thus, for example, in some cases, the first target antigen and the second target antigen are both present on the surface of a target cancer cell. In some cases, the system provides an AND-NOT gate; thus, for example, in some cases: a) the first target antigen and the second target antigen are both present on the surface of a non-cancerous cell; and b) the first target antigen, but not the second target antigen, is present on the surface of a target cancer cell. A system of the present disclosure can be introduced ex vivo into an immune cell obtained from a patient, to generate a modified immune cell; and the modified immune cell can be introduced into the patient from whom the immune cell was obtained.

The present disclosure provides a method of killing a target cancer cell in an individual. In some cases, a method of the present disclosure for killing a target cell in an individual comprises: a) introducing a system of the present disclosure into an immune cell (e.g., a CD8$^+$ T cell; an NK cell) obtained from the individual, generating a modified immune cell; and b) administering the modified immune cell to the individual, where the modified immune cell kills the target cancer cell in the individual.

The present disclosure provides a method of killing a target cancer cell in an individual. In some cases, a method of the present disclosure for killing a target cell in an individual comprises administering a genetically modified cytotoxic immune cell (e.g., a genetically modified CD8$^+$ T cell; a genetically modified NK cell) of the present disclosure to the individual, where the genetically modified immune cell kills the target cancer cell in the individual.

As noted above, a genetically modified cytotoxic immune cell of the present disclosure, and a system of the present disclosure, involve at least two antigen-triggered polypeptides that recognize two different cell surface antigens. A pair of antigen-triggered polypeptides recognizes and binds to a pair of target antigens; antigen binding activates the antigen-triggered polypeptides. Thus, a first antigen-triggered polypeptide binds a first member of a target antigen pair; and a second antigen-triggered polypeptide binds a second member of the target antigen pair. Target antigen combinations (also referred to herein as "target antigen pairs") are provided in FIG. 1 and FIG. 9-14. At least one of the two antigens of a target antigen pair listed in FIG. 1 or FIG. 9-14 is present on the surface of a target cancer cell. In some cases, the second target antigen of a target antigen pair is present on the surface of the same target cancer cell as the first target antigen of the target antigen pair. In some cases, the first target antigen of the target antigen pair is present on the surface of a target cancer cell, and the second target antigen of a target antigen pair is not present on the surface of the same target cancer cell; in these cases, both antigens of the target antigen pair are present on the surface of a non-cancerous cell. The target antigen combinations presented in FIG. 1 and FIG. 9-14 provide for an AND logic gate or an AND-NOT logic gate for a particular cancer cell type.

Where a target antigen pair provides for an AND logic gate, both antigens must be present on the surface of a target cancer cell in order for a genetically modified cytotoxic immune cell of the present disclosure to kill the target cancer cell, where in this case the genetically modified cytotoxic immune cell is genetically modified to express two antigen-triggered polypeptides, each recognizing one of the target antigens of the target antigen pair. For example, where a target antigen pair present in FIG. 1 and/or FIG. 9-14 is indicated as providing an AND logic gate, both target antigens of the target antigen pair must be present on the surface of a target cancer cell in order for a genetically modified cytotoxic immune cell of the present disclosure to kill the target cancer cell; and the genetically modified cytotoxic immune cell must express both a first antigen-triggered polypeptide that specifically binds the first target antigen of the target antigen pair and a second triggered polypeptide that specifically binds the second antigen of the target antigen pair. For example, in some cases, expression of the second antigen-triggered polypeptide is induced when the first antigen-triggered polypeptide binds to the first target antigen of the target antigen pair.

Where a target antigen pair provides an AND-NOT logic gate, a genetically modified cytotoxic immune cell of the present disclosure: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface; in these cases, the genetically modified cytotoxic immune cell must express both a first antigen-triggered polypeptide that specifically binds the first target antigen of the target antigen pair and a second triggered polypeptide that specifically binds the second antigen of the target antigen pair. For example, in some cases, binding of the second antigen-triggered polypeptide to the second target cell surface antigen (expressed on a non-cancerous cell) inhibits T cell activation that would normally be induced by binding of the first antigen-triggered polypeptide to the first target antigen (present on the cancer cell surface and on the non-cancerous cell surface). In this manner, unintended/undesired killing of a non-cancerous cell is reduced, because the target cancer cell expressing the first target antigen and not the second target antigen will be preferentially killed over the non-cancerous cell expressing both the first target antigen and the second target antigen. Since the cancer cell does not express the second target cell surface antigen (expressed on a non-cancerous cell), binding of the first antigen-triggered polypeptide to the first target antigen (present on the cancer cell surface) results in activation of the genetically modified cytotoxic T cell and killing of the cancer cell.

In some cases, the first antigen-triggered polypeptide is a synNotch receptor and the second antigen-triggered polypeptide is a chimeric antigen receptor (CAR). In some cases, the first antigen-triggered polypeptide is a synNotch receptor and the second antigen-triggered polypeptide is a T cell receptor (TCR). In some cases, the first antigen-triggered polypeptide is a synNotch receptor, and the second antigen-triggered polypeptide is a split CAR (e.g., an ON-switch CAR). In some cases, the first antigen-triggered polypeptide is a synNotch receptor, and the second antigen-triggered polypeptide is one polypeptide chain of a split CAR (e.g., an ON-switch CAR). In some cases, the first antigen-triggered polypeptide is a synNotch receptor, and the second antigen-triggered polypeptide is another synNotch receptor. Any or either of the first and second antigen-triggered polypeptides of the subject systems may independently be a synNotch receptor, a CAR, a TCR or the like. In some cases, both the first and second antigen-triggered polypeptides of the subject systems may be a synNotch receptor, a CAR, a TCR or the like.

In some cases, the first antigen-triggered polypeptide is a CAR, and the second antigen-triggered polypeptide is an antigen-binding inhibitory polypeptide, such as e.g. an inhibitory CAR (iCAR). In some cases, the first antigen-triggered polypeptide is a TCR, and the second antigen-triggered polypeptide is an antigen-binding inhibitory polypeptide, such as e.g. an iCAR. In some cases, the first antigen-triggered polypeptide is an ON-switch CAR, and the second antigen-triggered polypeptide is an antigen-binding inhibitory polypeptide, such as e.g. an iCAR. In some cases, the first antigen-triggered polypeptide is a CAR, and the second antigen-triggered polypeptide is a synNotch receptor. In some cases, the first antigen-triggered polypeptide is a TCR, and the second antigen-triggered polypeptide is a synNotch receptor. In some cases, the first antigen-triggered polypeptide is an ON-switch CAR, and the second antigen-triggered polypeptide is a synNotch receptor.

In some cases, the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

AND Gate Target Antigen Pairs

Figure 3B:
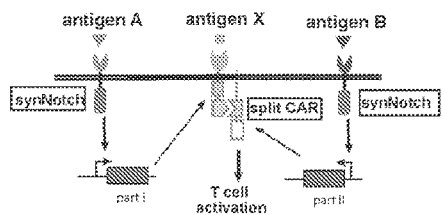

As noted above, in some cases, expression of the second antigen-triggered polypeptide in a genetically modified immune cell is induced only when the first antigen-triggered polypeptide binds to the first target antigen of the target antigen pair, where the binding to the first target antigen activates the first antigen-triggered polypeptide. Non-limiting examples of 2-input AND gates (AND gates based on 2 target antigens) and 3-input AND gates (AND gates based on 3 target antigens) are depicted schematically in FIG. 3A-3B.

For example, in some cases, the first antigen-triggered polypeptide is a synNotch receptor and activation of the synNotch receptor by binding to the first antigen (present on a target cancer cell) induces expression of the second antigen-triggered polypeptide. The second antigen-triggered polypeptide binds to the second antigen of the target antigen pair, where the second antigen is expressed on the surface of the target cancer cell. As an example, in some cases, the first antigen-triggered polypeptide is a synNotch receptor and the second antigen-triggered polypeptide is a single chain CAR. As another example, in some cases, the first antigen-triggered polypeptide is a synNotch receptor and the second antigen-triggered polypeptide is a TCR. For example, in some cases, the synNotch polypeptide comprises an intracellular domain comprising a transcriptional activator, and activation of the synNotch receptor by binding to the first antigen (present on a target cancer cell) induces release of the transcriptional activator; the released transcriptional activator activates transcription of the TCR or the single-chain CAR.

As another example, in some cases, the first antigen-triggered polypeptide is a synNotch receptor and activation of the synNotch receptor by binding to the first antigen (present on a target cancer cell) induces expression of the second antigen-triggered polypeptide, where the second antigen-triggered polypeptide is a heterodimeric ("two chain" or "split") CAR comprising a first polypeptide chain and a second polypeptide chain. The heterodimeric CAR binds to the second antigen of the target antigen pair, where the second antigen is expressed on the surface of the target cancer cell. For example, in some cases, the first antigen-triggered polypeptide is a synNotch receptor and the second antigen-triggered polypeptide is a split CAR (e.g., an ON-switch CAR). In some cases, activation of the synNotch receptor by binding to the first antigen (present on a target cancer cell) induces expression of only the first polypeptide chain of the heterodimeric CAR; expression of the second polypeptide chain of the heterodimeric CAR can be constitutive. For example, in some cases, the synNotch polypeptide comprises an intracellular domain comprising a transcriptional activator, and activation of the synNotch receptor by binding to the first antigen (present on a target cancer cell) induces release of the transcriptional activator; the released transcriptional activator activates transcription of the first polypeptide chain of the heterodimeric CAR. In some cases, activation of the synNotch receptor by binding to the first antigen (present on a target cancer cell) induces expression of only the second polypeptide chain of the heterodimeric CAR; expression of the first polypeptide chain of the heterodimeric CAR can be constitutive. Once the first polypeptide chain of the heterodimeric CAR is produced in the cell, it heterodimerizes with the second polypeptide chain of the heterodimeric CAR. As another example, in some cases, the synNotch polypeptide comprises an intracellular domain comprising a transcriptional activator, and activation of the synNotch receptor by binding to the first antigen (present on a target cancer cell) induces release of the transcriptional activator; the released transcriptional activator activates transcription of the second polypeptide chain of the heterodimeric CAR.

In AND gate systems, unintended/undesired killing of non-target cells is reduced; for example, a cell that expresses on its cell surface only one of the target antigen pair is not killed by a genetically modified cytotoxic immune cell of the present disclosure.

In some cases, a genetically modified immune cell or a system of the present disclosure provides for a 3-input AND gate, comprising: 1) a first target antigen of an AND-gate target antigen pair depicted in FIG. 1 or FIG. 9-14; 2) a second target antigen of the AND-gate target antigen pair; and 3) a third target antigen, where the third target antigen is a target antigen depicted in FIG. 4 or Table 3, where e.g., the third target antigen may be a target antigen for the same cancer cell type as the target antigen pair. As one non-limiting example, where the target AND-gate antigen pair is SYT11 AND TNFRSF17 (for a glioma cell) (as shown in FIG. 1), a suitable third target antigen is EphA2 (as shown in FIG. 4).

AND-NOT Gate Target Antigen Pairs

Figure 3C:
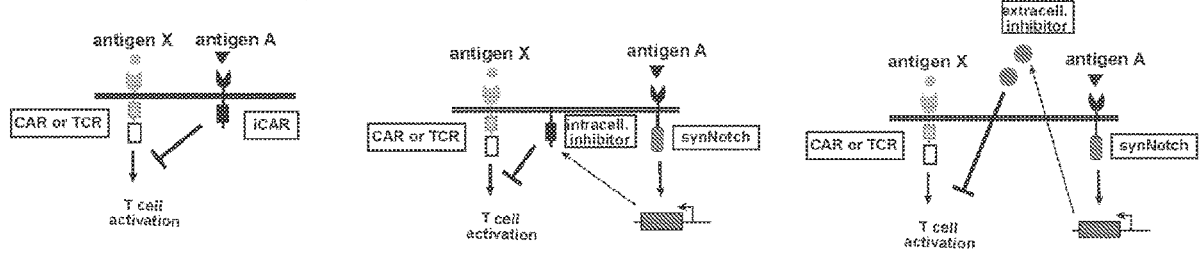
Figure 3D:
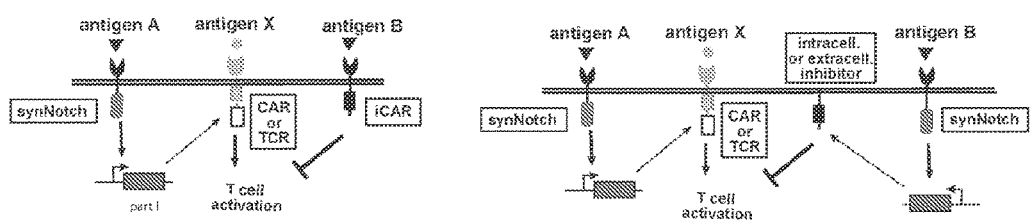
Figure 5A:
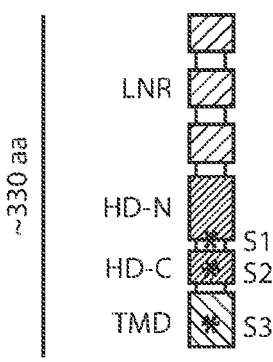
FIG. 5A-5G provide schematic depictions of exemplary synNotch receptor Notch regulatory regions.
Figure 5B:
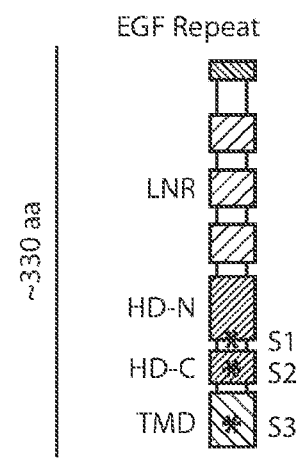
Figure 5C:
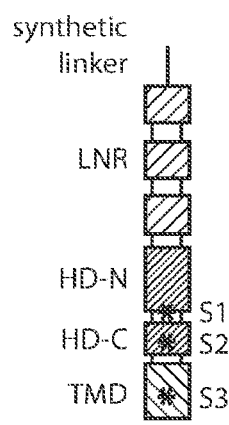
Figure 5D:
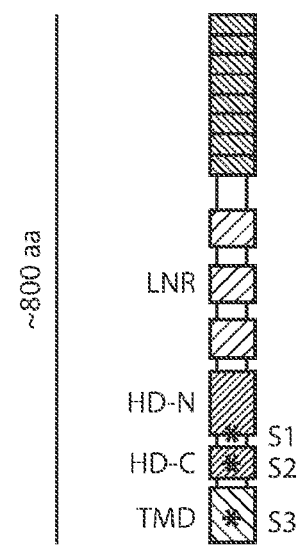
Figure 5E:
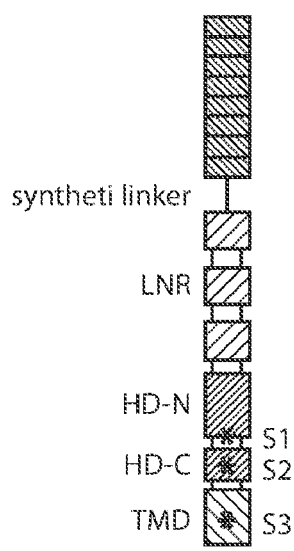
Figure 5F:
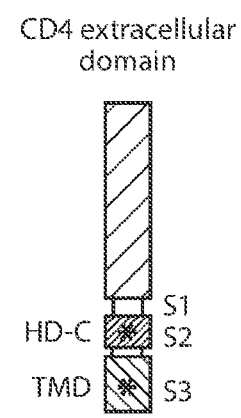
Figure 5G:
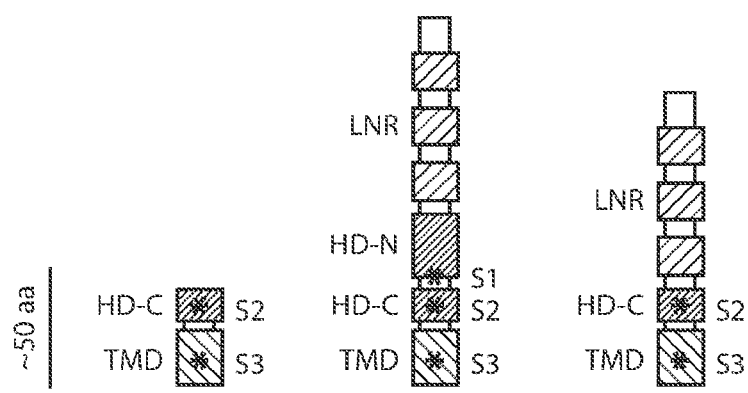

As noted above, in some cases, where a target antigen pair provides an AND-NOT logic gate, a genetically modified cytotoxic immune cell of the present disclosure: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface; in these cases, the genetically modified cytotoxic immune cell must express both a first antigen-triggered polypeptide that specifically binds the first target antigen of the target antigen pair and a second triggered polypeptide that specifically binds the second antigen of the target antigen pair. Non-limiting examples of 2-input AND-NOT gates (AND-NOT gates based on 2 target antigens) and 3-input AND-NOT gates (AND-NOT gates based on 3 target antigens) are depicted schematically in FIG. 3C-3D.

As an example, in some cases, the first antigen-triggered polypeptide is a CAR, and the second antigen-triggered polypeptide is an iCAR. Binding of the iCAR to the second antigen (present on the surface of a non-cancerous cell, but not on the surface of a target cancer cell) of a target antigen pair inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is an iCAR. Binding of the iCAR to the second antigen (present on the surface of a non-cancerous cell, but not on the surface of a target cancer cell) of a target antigen pair blocks or reduces T-cell activation mediated by activation of the TCR upon binding to the first antigen (present on the surface of the target cancer cell and on the surface of the non-cancerous cell) of the target antigen pair.

The above provides examples of AND-NOT gates where the inhibitory component is an iCAR; however, as will be readily understood, the inhibitory components of combinatorial antigen gates having "NOT" functionality are not so limited and may generally include any polypeptide configured to inhibit an activity, e.g., an activity induced by binding of a first activating antigen in an AND-NOT gate, including where such inhibition is conferred through the presence of an inhibitory domain. Inhibitory components of combinatorial antigen gates having "NOT" functionality may be specific for an antigen present on a non-target cell, including e.g., where such antigen is absent or present in low amounts on the surface of a target cell.

As another example, in some cases, the first antigen-triggered polypeptide is a CAR, and the second antigen-triggered polypeptide is a synNotch polypeptide comprising an intracellular domain that, when released upon activation of the synNotch polypeptide by binding to the second target antigen, induces expression of an intracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a synNotch polypeptide comprising an intracellular domain that, when released upon activation of the synNotch polypeptide by binding to the second target antigen, induces expression of an intracellular inhibitor that inhibits T-cell activation mediated by activation of the TCR upon binding to the first antigen (present on the surface of the target cancer cell and on the surface of the non-cancerous cell) of the target antigen pair.

As another example, in some cases, the first antigen-triggered polypeptide is a CAR, and the second antigen-triggered polypeptide is a synNotch polypeptide comprising an intracellular domain that, when released upon activation of the synNotch polypeptide by binding to the second target antigen, induces expression of an extracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a synNotch polypeptide comprising an intracellular domain that, when released upon activation of the synNotch polypeptide by binding to the second target antigen, induces expression of an extracellular inhibitor that inhibits T-cell activation mediated by activation of the TCR upon binding to the first antigen (present on the surface of the target cancer cell and on the surface of the non-cancerous cell) of the target antigen pair.

In some cases, a genetically modified immune cell or a system of the present disclosure provides for a 3-input AND, AND-NOT gate, comprising: 1) a first target antigen of an AND-NOT gate target antigen pair depicted in FIG. 1 or FIG. 9-14; 2) a second target antigen of the AND-NOT gate target antigen pair; and 3) a third target antigen, where the third target antigen is a target antigen depicted in FIG. 4 or Table 3, including e.g., where the third target antigen may be a target antigen for the same cancer cell type as the target antigen pair. In some cases, the 3-input AND, AND-NOT gate comprises: 1) the first target antigen of an AND-NOT gate target antigen pair depicted in FIG. 1 or FIG. 9-14; AND-NOT; 2) the second target antigen of the AND-NOT gate target antigen pair; AND 3) the third target antigen. In some cases, the 3-input AND, AND-NOT gate comprises: 1) the second target antigen of an AND-NOT gate target antigen pair depicted in FIG. 1 or FIG. 9-14; AND-NOT 2) the first target antigen of the AND-NOT gate target antigen pair; AND 3) the third target antigen.

As one non-limiting example, where the target AND-NOT gate antigen pair is NLGN1 AND-NOT TNFRSF17 (for a glioma cell) (as shown in FIG. 1), a suitable third target antigen is EphA2 (as shown in FIG. 4).

Antigen-Triggered Polypeptides

As noted above, an antigen-triggered polypeptide can be a synNotch polypeptide; a CAR; or a TCR. A CAR can be an ON-switch ("split") CAR, a single-chain CAR, an iCAR, etc. Schematic depictions of examples of antigen-triggered polypeptides are provided in FIG. 5 and FIG. 6A-6F.

synNotch Polypeptides

As noted above, in some cases an antigen-triggered polypeptide produced in a genetically modified immune cell of the present disclosure, or present in a system of the present disclosure, or encoded by a nucleotide sequence in a nucleic acid present in a system of the present disclosure, is a synNotch receptor (a "synNotch polypeptide"). synNotch polypeptides are described in PCT/US16/19188, the disclosure of which is incorporated herein by reference in its entirety. Schematic depictions of exemplary synNotch polypeptides are provided in FIG. 5A-5G.

In some cases, a synNotch polypeptide is a chimeric Notch polypeptide comprising, from N-terminus to C-terminus and in covalent linkage: a) an extracellular domain comprising an antigen binding member that is not naturally present in a Notch receptor polypeptide and that specifically binds to an antigen; b) a Notch regulatory region comprising a Lin 12-Notch repeat, an S2 proteolytic cleavage site, and a transmembrane domain comprising an S3 proteolytic cleavage site; c) an intracellular domain comprising a transcriptional activator or a transcriptional repressor that is heterologous to the Notch regulatory region and replaces a naturally-occurring intracellular Notch domain, wherein binding of the antigen binding member to the antigen, present on a cell or other solid support, induces cleavage at the S2 and S3 proteolytic cleavage sites, thereby releasing the intracellular domain.

In some cases, a synNotch polypeptide is a chimeric Notch polypeptide comprising, from N-terminus to C-terminus and in covalent linkage: a) an extracellular domain comprising a single-chain Fv (scFv) or a nanobody that specifically binds to an antigen; b) a Notch regulatory region comprising a Lin 12-Notch repeat, a heterodimerization domain comprising an S2 proteolytic cleavage site and a transmembrane domain comprising an S3 proteolytic cleavage site; and c) an intracellular domain, heterologous to the Notch regulatory region, comprising a transcriptional activator comprising a DNA binding domain, wherein the transcriptional activator replaces a naturally-occurring intracellular notch domain, and wherein binding of the scFv or the nanobody to the antigen in trans induces cleavage at the S2 and S3 proteolytic cleavage sites, thereby releasing the intracellular domain and wherein the chimeric Notch polypeptide does not bind its naturally-occurring ligand Delta.

In some cases, a synNotch polypeptide comprises, from N-terminal to C-terminal and in covalent linkage: a) an extracellular domain that specifically binds to an antigen (e.g., a single-chain Fv (scFv), a nanobody, and the like); b) a Notch receptor polypeptide comprising one or more proteolytic cleavage sites and having at least 50%, at least 55%, at least 60%, at least 65%, at least 70%, at least 75%, at least 80%, at least 85%, at least 90%, at least 95%, at least 98%, at least 99%, or 100%, amino acid sequence identity to a Notch receptor polypeptide as described below; and c) an intracellular domain comprising a transcriptional regulator (e.g., a transcriptional activator or a transcriptional repressor). When the synNotch polypeptide is present in a cell, binding of the extracellular domain (e.g., the scFv or the nanobody) to the antigen induces cleavage of the Notch receptor polypeptide at the one or more proteolytic cleavage sites, thereby releasing the intracellular domain. In some cases, the intracellular domain comprises a transcriptional activator. In some cases, the intracellular domain comprises a transcriptional repressor.

In some cases, a Notch receptor polypeptide comprises an amino acid sequence having at least 50%, at least 55%, at least 60%, at least 65%, at least 70%, at least 75%, at least 80%, at least 85%, at least 90%, at least 95%, at least 98%, at least 99%, or 100%, amino acid sequence identity to the amino acid sequence of a Notch receptor including e.g., any of SEQ ID NOs: 7240-7245 and 7468-7475. In some instances, the Notch regulatory region of a Notch receptor polypeptide is a mammalian Notch regulatory region, including but not limited to e.g., a mouse Notch (e.g., mouse Notch1, mouse Notch2, mouse Notch3 or mouse Notch4) regulatory region, a rat Notch regulatory region (e.g., rat Notch1, rat Notch2 or rat Notch3), a human Notch regulatory region (e.g., human Notch1, human Notch2, human Notch3 or human Notch4), and the like or a Notch regulatory region derived from a mammalian Notch regulatory region and having at least 50%, at least 55%, at least 60%, at least 65%, at least 70%, at least 75%, at least 80%, at least 85%, at least 90%, at least 95%, at least 98%, at least 99%, or 100%, amino acid sequence identity to the amino acid sequence of a mammalian Notch regulatory region of a mammalian Notch receptor amino acid sequence, including e.g., SEQ ID NOs: 7240-7245 and 7468-7475.

Subject Notch regulatory regions may include or exclude various components (e.g., domains, cleavage sites, etc.) thereof. Examples of such components of Notch regulatory regions that may be present or absent in whole or in part, as appropriate, include e.g., one or more EGF-like repeat domains, one or more Lin12/Notch repeat domains, one or more heterodimerization domains (e.g., HD-N or HD-C), a transmembrane domain, one or more proteolytic cleavage sites (e.g., a furin-like protease site (e.g., an 51 site), an ADAM-family protease site (e.g., an S2 site) and/or a gamma-secretase protease site (e.g., an S3 site)), and the like. Notch receptor polypeptides may, in some instances, exclude all or a portion of one or more Notch extracellular domains, including e.g., Notch-ligand binding domains such as Delta-binding domains. Notch receptor polypeptides may, in some instances, include one or more non-functional versions of one or more Notch extracellular domains, including e.g., Notch-ligand binding domains such as Delta-binding domains. Notch receptor polypeptides may, in some instances, exclude all or a portion of one or more Notch intracellular domains, including e.g., Notch Rbp-associated molecule domains (i.e., RAM domains), Notch Ankyrin repeat domains, Notch transactivation domains, Notch PEST domains, and the like. Notch receptor polypeptides may, in some instances, include one or more non-functional versions of one or more Notch intracellular domains, including e.g., non-functional Notch Rbp-associated molecule domains (i.e., RAM domains), non-functional Notch Ankyrin repeat domains, non-functional Notch transactivation domains, non-functional Notch PEST domains, and the like.

In some cases, a Notch receptor polypeptide has a length of from about 310 amino acids (aa) to about 320 aa (e.g., 310 aa, 311 aa, 312 aa, 313 aa, 314 aa, 315 aa, 316 aa, 317 aa, 318 aa, 319 aa, or 320 aa).

In some cases, a Notch receptor polypeptide comprises an amino acid sequence having at least 50%, at least 55%, at least 60%, at least 65%, at least 70%, at least 75%, at least 80%, at least 85%, at least 90%, at least 95%, at least 98%, at least 99%, or 100%, amino acid sequence identity to the following amino acid sequence:
PPQIEEACELPECQVDAGNKVCNLQCNN-
HACGWDGGDCSLNFNDPWKNCTQSLQCWKYFSDG
HCDSQCNSAGCLFDGFDCQLTEGQCN-
PLYDQYCKDHFSDGHCDQGCNSAECEWDGLD-
CAEHV PERLAAGTLVLVVLLPPDQLRNNSFHFL-
RELSHVLHTNVVFKRDAQGQQMIFPYYGHEEELRKH
PIKRSTVGWATSSLLPGTSGGRQRRELDPMDIRG-
SIVYLEIDNRQCVQSSSQCFQSATDVAAFLG
ALASLGSLNIPYKIEAVKSEPVEPPLPSQLHLMY-
VAAAAFVLLFFVGCGVLLS (SEQ ID NO:7246); and has a length of from 300 amino acids to 310 amino acids (e.g., 300, 301, 302, 303, 304, 305, 306, 307, 308, 309, or 310 amino acids).

In some cases, a Notch receptor polypeptide comprises an amino acid sequence having at least 50%, at least 55%, at least 60%, at least 65%, at least 70%, at least 75%, at least 80%, at least 85%, at least 90%, at least 95%, at least 98%, at least 99%, or 100%, amino acid sequence identity to the following amino acid sequence: PCVGSNPCYNQGTCEPTSENPFYRCLCPAKFNGLL-CHILDYSFTGGAGRDIPPPQIEEACELPECQ VDAG-NKVCNLQCNNHACGWDGGDCSLNFNDPW-KNCTQSLQCWKYFSDGHCDSQCNSAGCLF DGFDCQLTEGQCNPLYDQYCKDHFSDGHCDQGCN-SAECEWDGLDCAEHVPERLAAGTLVLVV LLPPDQLRNNSFHFL-RELSHVLHTNVVFKRDAQGQQMIFPYYGHEEELRKH-PIKRSTVGWATSS LLPGTSGGRQRRELDPMDIRG-SIVYLEIDNRQCVQSSSQCFQSATDVAAFLGALASLG SLNIPYKI EAVKSEPVEPPLPSQLHLMYVAAAAFVLL-FFVGCGVLLS (SEQ ID NO:7247); and has a length of from 350 amino acids to 370 amino acids (e.g., 350 351, 352, 353, 354, 355, 356, 357, 358, 359, 360, 361, 362, 363, 364, 365, 366, 367, 368, 369, or 370 amino acids).

In some cases, the intracellular domain comprises a transcriptional activator, and release of the intracellular domain causes the transcriptional activator to induce expression of an endogenous gene product in a cell. In some cases, the intracellular domain comprises a transcriptional activator, and release of the intracellular domain causes the transcriptional activator to induce expression of a heterologous gene product (e.g., a CAR; a TCR; a therapeutic antibody). For example, in some cases, a transcriptional control element, responsive to the transcriptional activator, is operably linked to a nucleotide sequence encoding a CAR or a TCR. As another example, a transcriptional control element, responsive to the transcriptional activator, is operably linked to a nucleotide sequence encoding a therapeutic antibody for the treatment of cancer.

In some cases, the intracellular domain comprises a transcriptional activator, and release of the intracellular domain causes the transcriptional activator to induce expression of an intracellular inhibitor that inhibits T-cell activation. In some cases, the intracellular domain comprises a transcriptional activator, and release of the intracellular domain causes the transcriptional activator to induce expression of an inhibitor that is secreted from the cell (an extracellular inhibitor), where the extracellular inhibitor inhibits T-cell activation.

In some cases, the Notch receptor polypeptide comprises, at its N-terminus, one or more epidermal growth factor (EGF) repeats. In some cases, the Notch receptor polypeptide comprises, at its N-terminus, 2 to 11 EGF repeats; e.g., in some cases, the Notch receptor polypeptide comprises, at its N-terminus, 2, 3, 4, 5, 6, 7, 8, 9, 10, or 11 epidermal growth factor (EGF) repeats. An EGF repeat can have a length of from 35 amino acids (aa) to 45 aa (e.g., 35, 36, 37, 38, 39, 40, 41, 42, 43, 44, or 45 aa). An EGF repeat can comprise an amino acid sequence having at least 75%, at least 80%, at least 85%, at least 90%, at least 95%, at least 98%, at least 99%, or 100%, amino acid sequence identity to the following sequence: PCVGSNPCYNQGTCEPTSEN-PFYRCLCPAKFNGLLCH (SEQ ID NO:7248); and can have a length of from 35 amino acids to 40 amino acids (e.g., 35, 36, 37, 38, 39, or 40 amino acids. An EGF repeat can comprise an amino acid sequence having at least 75%, at least 80%, at least 85%, at least 90%, at least 95%, at least 98%, at least 99%, or 100%, amino acid sequence identity to the following sequence: PCLGGNPCYNQGTCEPTS-ESPFYRCLCPAKFNGLLCH (SEQ ID NO:7249); and can have a length of from 37 amino acids to 40 amino acids (e.g., 37, 38, 39, or 40 amino acids.

In some cases, the Notch receptor polypeptide comprises a synthetic linker between the one or more EGF repeats and the one or more proteolytic cleavage sites.

In some cases, the Notch receptor polypeptide has a length from 50 amino acids to 1000 amino acids. For example, in some cases, the Notch receptor polypeptide has a length of from 50 amino acids (aa) to 75 aa, from 75 aa to 100 aa, from 100 aa to 150 aa, from 150 aa to 200 aa, from 200 aa to 250 aa, from 250 aa to 300 aa, from 300 aa to 400 aa, from 400 aa to 500 aa, from 500 aa to 600 aa, from 600 aa to 700 aa, from 700 aa to 800 aa, from 800 aa to 900 aa, or from 900 aa to 1000 aa. In some cases, the Notch receptor polypeptide has a length from 300 amino acids to 400 amino acids.

In some cases, the one or more proteolytic cleavage sites comprises an S2 proteolytic cleavage site, an S3 proteolytic cleavage site or a combination thereof. In some cases, an S3 proteolytic cleavage site comprises the amino acid sequence VLLS (SEQ ID NO:7250). In some cases, an S3 proteolytic cleavage site comprises the amino acid sequence GVLLS (SEQ ID NO:7251). In some cases, the one or more proteolytic cleavage sites comprises an S2 proteolytic cleavage site that is an ADAM family type protease cleavage site, such as e.g., an ADAM-17-type protease cleavage site comprising an Ala-Val dipeptide sequence. In some cases, the one or more proteolytic cleavage sites comprises an S3 proteolytic cleavage site that is a gamma-secretase (γ-secretase) cleavage site comprising a Gly-Val dipeptide sequence. In some cases, the one or more proteolytic cleavage sites further comprises an S1 proteolytic cleavage site. In some cases, the S1 proteolytic cleavage site is a furin-like protease cleavage site comprising the amino acid sequence Arg-X-(Arg/Lys)-Arg, where X is any amino acid. In some cases, the Notch receptor polypeptide does not include an S1 proteolytic cleavage site.

CARs

As noted above, in some cases an antigen-triggered polypeptide produced in a genetically modified immune cell of the present disclosure, or present in a system of the present disclosure, or encoded by a nucleotide sequence in a nucleic acid present in a system of the present disclosure, is a chimeric antigen receptor. Schematic depictions of split CARs are provided in FIG. 6A-6F.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled. CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. Sci Transl Med (2013); 5(215):215ra172; Glienke et al. Front Pharmacol (2015) 6:21; Kakarla & Gottschalk 52 Cancer J (2014) 20(2):151-5; Riddell et al. Cancer J (2014) 20(2):141-4; Pegram et al. Cancer J (2014) 20(2):127-33; Cheadle et al Immunol Rev (2014) 257(1):91-106; Barrett et al. Annu Rev Med (2014) 65:333-47; Sadelain et al. Cancer Discov (2013) 3(4):388-98; Cartellieri et al., J Biomed Biotechnol (2010) 956304; the disclosures of which are incorporated herein by reference in their entirety.

Spit CAR may be extracellularly split or intracellularly split and may or may not be conditionally heterodimerizable. For example, split CAR systems that are not conditionally heterodimerizable may contain a constitutive heterodimerization domain or other binding pair (e.g., a Fc binding pair or other orthogonal binding pair) that does not depend on the presence of one or more additional molecules for the heterodimerization that results in the formation of an active CAR from assembly of the split portions.

In some instances, an extracellularly split CAR may be split extracellularly at the antigen binding domain into two parts including e.g., where the first part of the split CAR contains an extracellular Fc binding domain that specifically binds to second part of the split CAR that contains the antigen recognition domain.

In some instances, an extracellularly split CAR may be split extracellularly at the antigen binding domain into two parts including e.g., where the first part of the split CAR contains an first part of an orthogonal protein binding pair that specifically binds to the second part of the orthogonal protein binding pair that is contained in the second part of the split CAR that contains the antigen recognition domain.

In some instances, an intracellularly split CAR may be split intracellularly proximal to the transmembrane domain into two parts including e.g., where the first part of the split CAR includes the antigen recognition domain, a transmembrane domain and an intracellular first portion of a constitutive heterodimerization domain and the second part of the split CAR includes a transmembrane domain, the second portion of the constitutive heterodimerization domain proximal to the transmembrane domain, one or more co-stimulatory domains and one or more signaling domains (e.g., ITAM domains).

In some instances, an intracellularly split CAR may be split into two parts intracellularly proximal to an intracellular domain or between two intracellular domains including e.g., where the first part of the split CAR includes the antigen recognition domain, a transmembrane domain, one or more co-stimulatory domains and an intracellular first portion of a constitutive heterodimerization domain and the second part of the split CAR includes a transmembrane domain, one or more co-stimulatory domains, one or more signaling domains (e.g., ITAM domains) and the second portion of the constitutive heterodimerization domain between the one or more co-stimulatory domains and the one or more signaling domains.

In some instances, an intracellularly split CAR may be split into two parts intracellularly between intracellular domains including e.g., where the first part of the split CAR includes the antigen recognition domain, a transmembrane domain, one or more co-stimulatory domains and an intracellular first portion of a constitutive heterodimerization domain proximal to the intracellular terminus of the first part of the split CAR and the second part of the split CAR includes a transmembrane domain, one or more signaling domains (e.g., ITAM domains) and the second portion of the constitutive heterodimerization domain between the transmembrane domain and the one or more signaling domains.

An inhibitory CAR (iCAR) expressed on an immunoresponsive cell specifically binds to an antigen, whereupon binding its antigen the iCAR inhibits the immunoresponsive cell. By "inhibits an immunoresponsive cell" or "suppresses an immunoresponsive cell" is meant induction of signal transduction or changes in protein expression in the cell resulting in suppression of an immune response (e.g., decrease in cytokine production).

Generally, but not exclusively, an iCAR is employed as a component of a bispecific CAR system where the activity of an immunostimulatory CAR (e.g., a CAR or CAR variant) is repressed by the iCAR upon binding of the iCAR to its antigen. An iCAR will generally include an extracellular domain that binds an antigen; a transmembrane domain operably linked to the extracellular domain; and an intracellular domain that activates intracellular signaling to decrease an immune response, the intracellular domain operably linked to the transmembrane domain. In some embodiments, the intracellular signaling domain is selected from the group consisting of a CTLA-4 polypeptide, a PD-1 polypeptide, a LAG-3 polypeptide, a 2B4 polypeptide, and a BTLA polypeptide. In certain embodiments, the transmembrane domain is selected from the group consisting of a CD4 polypeptide, a CD8 polypeptide, a CTLA-4 polypeptide, a PD-1 polypeptide, a LAG-3 polypeptide, a 2B4 polypeptide, and a BTLA polypeptide. In some instances, an iCAR, as described herein, may be or may be derived from one or more of the iCARs described in U.S. Patent Application Publication No. 20150376296, the disclosure of which is incorporated herein by reference in its entirety.

Any convenient extracellular binding domain (i.e., antigen binding domain) may find use in an iCAR including but not limited to e.g., a Fab, scFv, a monovalent or polyvalent ligand, etc., provided the domain is sufficient for specific binding of the iCAR to its antigen. In the contexts of therapy, the antigen binding domain of an iCAR will generally bind a healthy cell antigen in order to repress an immune response that may be otherwise triggered by presentation of a target antigen on the surface of a healthy cell. For example, in the contexts of cancer therapy, the antigen binding domain of an iCAR will generally bind a non-tumor or healthy cell antigen. For example, the extracellular domain may be a binding domain that does not bind one or more tumor antigens, including but not limited to e.g., CD19, CAIX, CEA, CD5, CD7, CD10, CD20, CD22, CD30, CD33, CD34, CD38, CD41, CD44, CD49f, CD56, CD74, CD123, CD133, CD138, a cytomegalovirus (CMV) infected cell antigen, EGP-2, EGP-40, EpCAM, erb-B2,3,4, F8P, Fetal acetylcholine receptor, folate receptor-a, GD2, GD3, HER-2, hTERT, IL-13R-.alpha.2, K-light chain, KDR, LeY, L1 cell adhesion molecule, MAGE-A1, Mesothelin, Muc-1, Muc-16, NKG2D ligands, NY-ESO-1, oncofetal antigen (h5T4), PSCA, PSMA, ROR1, TAG-72, VEGF-R2, WT-1, and the like. Antigens to which the extracellular domain of an iCAR does not bind are, however, not limited to cancer antigens and may likewise exclude any target antigen to which an immunostimulatory CAR is directed.

In some instances, the antigen binding domain of an iCAR will bind a non-tumor antigen including but not limited to e.g., CD33, CD38, a human leukocyte antigen (HLA), an organ specific antigen, a blood-brain barrier specific antigen, an Epithelial-mesenchymal transition (EMT) antigen, E-cadherin, cytokeratin, Opioid-binding protein/cell adhesion molecule (OPCML), HYLA2, Deleted in Colorectal Carcinoma (DCC), Scaffold/Matrix attachment region-binding protein 1 (SMAR1), cell surface carbohydrate, mucin type O-glycan, etc.

In certain instances, an antigen to which the extracellular domain of an iCAR binds may be an antigen listed in Table 2, provided as FIG. 2. In some cases, an antigen to which the extracellular domain of an iCAR binds may be an antigen listed in Table 1, provided as FIG. 1, or in FIG. 9-14, which antigen is described as the "NOT" portion of an antigen logic gate.

TCRs

As noted above, in some cases an antigen-triggered polypeptide produced in a genetically modified immune cell of the present disclosure, or present in a system of the present disclosure, or encoded by a nucleotide sequence in a nucleic acid present in a system of the present disclosure, is a T-cell receptor (TCR).

A TCR generally includes an alpha chain and a beta chain; and recognizes antigen when presented by a major histocompatibility complex. In some cases, the TCR is an engineered TCR. Any engineered TCR having immune cell activation function can be induced using a method of the present disclosure. Such TCRs include, e.g., antigen-specific TCRs, Monoclonal TCRs (MTCRs), Single chain MTCRs, High Affinity CDR2 Mutant TCRs, CD1-binding MTCRs, High Affinity NY-ESO TCRs, VYG HLA-A24 Telomerase TCRs, including e.g., those described in PCT Pub Nos. WO 2003/020763, WO 2004/033685, WO 2004/044004, WO 2005/114215, WO 2006/000830, WO 2008/038002, WO 2008/039818, WO 2004/074322, WO 2005/113595, WO 2006/125962; Strommes et al. Immunol Rev. 2014; 257(1): 145-64; Schmitt et al. Blood. 2013; 122(3):348-56; Chapuls et al. Sci Transl Med. 2013; 5(174):174ra27; Thaxton et al. Hum Vaccin Immunother. 2014; 10(11):3313-21 (PMID: 25483644); Gschweng et al. Immunol Rev. 2014; 257(1): 237-49 (PMID:24329801); Hinrichs et al. Immunol Rev. 2014; 257(1):56-71 (PMID:24329789); Zoete et al. Front Immunol. 2013; 4:268 (PMID:24062738); Marr et al. Clin Exp Immunol. 2012; 167(2):216-25 (PMID:22235997); Zhang et al. Adv Drug Deliv Rev. 2012; 64(8):756-62 (PMID:22178904); Chhabra et al. Scientific World Journal. 2011; 11:121-9 (PMID:21218269); Boulter et al. Clin Exp Immunol. 2005; 142(3):454-60 (PMID:16297157); Sami et al. Protein Eng Des Sel. 2007; 20(8):397-403; Boulter et al. Protein Eng. 2003; 16(9):707-11; Ashfield et al. IDrugs. 2006; 9(8):554-9; Li et al. Nat Biotechnol. 2005; 23(3):349-54; Dunn et al. Protein Sci. 2006; 15(4):710-21; Liddy et al. Mol Biotechnol. 2010; 45(2); Liddy et al. Nat Med. 2012; 18(6):980-7; Oates, et al. Oncoimmunology. 2013; 2(2): e22891; McCormack, et al. Cancer Immunol Immunother. 2013 April; 62(4):773-85; Bossi et al. Cancer Immunol Immunother. 2014; 63(5):437-48 and Oates, et al. Mol Immunol. 2015 October; 67(2 Pt A):67-74; the disclosures of which are incorporated herein by reference in their entirety.

Antigen-Binding Inhibitory Polypeptides

In some cases an antigen-triggered polypeptide produced in a genetically modified immune cell of the present disclosure, or present in a system of the present disclosure, or encoded by a nucleotide sequence in a nucleic acid present in a system of the present disclosure, may be an inhibitory polypeptide. The term "antigen-binding inhibitory polypeptide", as used herein, will generally describe a polypeptide, specific for an antigen, that upon binding the antigen inhibits the activity of a second polypeptide (e.g., an activating antigen-specific polypeptide, such as a CAR or TCR or other synthetic stimulatory immune cell receptor) and/or an activity of a cell (e.g., immune activation). iCARs, as described above, are an example of an antigen-binding inhibitory polypeptide; however, the term antigen-binding inhibitory polypeptide is not so limited.

Antigen-binding inhibitory polypeptides will vary and will generally function to mediate repression of an activated or activatable immune cell, including e.g., an immune cell expressing a stimulatory receptor, such as a CAR or TCR. An antigen-binding inhibitory polypeptide will include an inhibitory domain that functions to repress immune cell activation, including e.g., immune cell activation attributed to a stimulatory receptor, such as a CAR or TCR. Domains useful as inhibitory domains will vary depending on the particular context of immune cell activation and repression, including e.g., the particular type of activated cell to be repressed and the desired degree of repression. Exemplary non-limited examples of inhibitory domains include but are not limited to domains and motifs thereof derived from immune receptors including, e.g., co-inhibitory molecules, immune checkpoint molecules, immune tolerance molecules, and the like.

Suitable intracellular inhibitory domains may be any functional unit of a polypeptide as short as a 3 amino acid linear motif and as long as an entire protein, where size of the inhibitory domain is restricted only in that the domain must be sufficiently large as to retain its function and sufficiently small so as to be compatible with the other components of the polypeptide. Accordingly, an inhibitory domain may range in size from 3 amino acids in length to 1000 amino acids or more and, in some instances, can have a length of from about 30 amino acids to about 70 amino acids (aa), e.g., an inhibitory domain can have a length of from about 30 aa to about 35 aa, from about 35 aa to about 40 aa, from about 40 aa to about 45 aa, from about 45 aa to about 50 aa, from about 50 aa to about 55 aa, from about 55 aa to about 60 aa, from about 60 aa to about 65 aa, or from about 65 aa to about 70 aa. In other cases, an inhibitory domain can have a length of from about 70 aa to about 100 aa, from about 100 aa to about 200 aa, or greater than 200 aa.

In some instances, "co-inhibitory domains" find use in the subject polypeptides. Such co-inhibitory domains are generally polypeptides derived from receptors. Co-inhibition generally refers to the secondary inhibition of primary antigen-specific activation mechanisms which prevents co-stimulation. Co-inhibition, e.g., T cell co-inhibition, and the factors involved have been described in Chen & Flies. Nat Rev Immunol (2013) 13(4):227-42 and Thaventhiran et al. J Clin Cell Immunol (2012) S12, the disclosures of which are incorporated herein by reference in their entirety. In some embodiments, co-inhibitory domains homodimerize. In some instances, useful co-inhibitory domains have been modified to constitutively dimerize, including constitutively homodimerize. A subject co-inhibitory domain can be an intracellular portion of a transmembrane protein (i.e., the co-inhibitory domain can be derived from a transmembrane protein). Non-limiting examples of suitable co-inhibitory polypeptides include, but are not limited to, CTLA-4 and PD-1. In some instances, a co-inhibitory domain, e.g., as used in a subject polypeptide may include a co-inhibitory domain selected from PD-1, CTLA4, HPK1, SHPT, SHP2, Sts1 and Csk. In some instances, a co-inhibitory domain of subject polypeptide comprises an amino acid sequence having at least about 75%, at least about 80%, at least about 85%, at least about 90%, at least about 95%, at least about 98%, or 100% amino acid sequence identity to a co-inhibitory domain as described herein.

In some instances, an antigen-binding inhibitory polypeptide may include a domain of a dimerization pair, such as e.g., a synthetic immune cell receptor (ICR) repressor useful as a component of a heteromeric, conditionally repressible synthetic ICR. Components of a heteromeric, conditionally repressible synthetic ICR may include a synthetic stimulatory ICR and a synthetic ICR repressor, where e.g., the synthetic stimulatory ICR and the synthetic ICR repressor specifically bind the antigens of an antigen pair described herein. Heteromeric, conditionally repressible synthetic ICRs, and components thereof, are described in PCT Application No. PCT/US2016/062612; the disclosure of which is incorporated herein by reference in its entirety.

Genetically Modified Immune Cells

The present disclosure provides a cytotoxic immune cell genetically modified to produce two antigen-triggered polypeptides, each recognizing a different cell surface antigen.

To generate a genetically modified cytotoxic immune cell of the present disclosure, a parent cytotoxic immune cell is genetically modified to produce: a) a first antigen-triggered polypeptide that binds specifically to a first target cell surface antigen present on a target cancer cell; and b) a second antigen-triggered polypeptide that binds specifically to a second target cell surface antigen. Suitable parent cytotoxic immune cells include $CD8^+$ T cells, natural killer (NK) cells, and the like. Thus, in some cases, a genetically modified cytotoxic immune cell of the present disclosure is a genetically modified $CD8^+$ T cell. In other cases, a genetically modified cytotoxic immune cell of the present disclosure is a genetically modified NK cell.

In some cases, the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

In some cases, a genetically modified cytotoxic immune cell of the present disclosure is genetically modified to express a first antigen-triggered polypeptide and a second antigen-triggered polypeptide that bind to antigens of a 2-input AND-gate target antigen pair. In some cases, a genetically modified cytotoxic immune cell of the present disclosure is genetically modified to express a first antigen-triggered polypeptide and a second antigen-triggered polypeptide that bind to antigens of a 3-input AND-gate target antigen pair. Non-limiting examples of 2-input AND gates (AND gates based on 2 target antigens) and 3-input AND gates (AND gates based on 3 target antigens) are depicted schematically in FIG. 3A-3B.

For example, in some cases, the first antigen-triggered polypeptide is a synNotch receptor and activation of the synNotch receptor by binding to the first antigen (present on a target cancer cell) induces expression of the second antigen-triggered polypeptide. The second antigen-triggered polypeptide binds to the second antigen of the target antigen pair, where the second antigen is expressed on the surface of the target cancer cell. As an example, in some cases, the first antigen-triggered polypeptide is a synNotch receptor and the second antigen-triggered polypeptide is a single chain CAR. As another example, in some cases, the first antigen-triggered polypeptide is a synNotch receptor and the second antigen-triggered polypeptide is a TCR. For example, in some cases, the synNotch polypeptide comprises an intracellular domain comprising a transcriptional activator, and activation of the synNotch receptor by binding to the first antigen (present on a target cancer cell) induces release of the transcriptional activator; the released transcriptional activator activates transcription of the TCR or the single-chain CAR.

As another example, in some cases, the first antigen-triggered polypeptide is a synNotch receptor and activation of the synNotch receptor by binding to the first antigen (present on a target cancer cell) induces expression of the second antigen-triggered polypeptide, where the second antigen-triggered polypeptide is a heterodimeric ("two chain" or "split") CAR comprising a first polypeptide chain and a second polypeptide chain. The heterodimeric CAR binds to the second antigen of the target antigen pair, where the second antigen is expressed on the surface of the target cancer cell. For example, in some cases, the first antigen-triggered polypeptide is a synNotch receptor and the second antigen-triggered polypeptide is a split CAR (e.g., an ON-switch CAR). In some cases, activation of the synNotch receptor by binding to the first antigen (present on a target cancer cell) induces expression of only the first polypeptide chain of the heterodimeric CAR; expression of the second polypeptide chain of the heterodimeric CAR can be constitutive. For example, in some cases, the synNotch polypeptide comprises an intracellular domain comprising a transcriptional activator, and activation of the synNotch receptor by binding to the first antigen (present on a target cancer cell) induces release of the transcriptional activator; the released transcriptional activator activates transcription of the first polypeptide chain of the heterodimeric CAR. In some cases, activation of the synNotch receptor by binding to the first antigen (present on a target cancer cell) induces expression of only the second polypeptide chain of the heterodimeric CAR; expression of the first polypeptide chain of the heterodimeric CAR can be constitutive. Once the first polypeptide chain of the heterodimeric CAR is produced in the cell, it heterodimerizes with the second polypeptide chain of the heterodimeric CAR. As another example, in some cases, the synNotch polypeptide comprises an intracellular domain comprising a transcriptional activator, and activation of the synNotch receptor by binding to the first antigen (present on a target cancer cell) induces release of the transcriptional activator; the released transcriptional activator activates transcription of the second polypeptide chain of the heterodimeric CAR.

In some cases, a genetically modified cytotoxic immune cell of the present disclosure is genetically modified to express a first antigen-triggered polypeptide and a second antigen-triggered polypeptide that bind to antigens of a 2-input AND-NOT-gate target antigen pair. In some cases, a genetically modified cytotoxic immune cell of the present disclosure is genetically modified to express a first antigen-triggered polypeptide and a second antigen-triggered polypeptide that bind to antigens of a 3-input AND-NOT-gate target antigen pair. Non-limiting examples of 2-input AND-NOT gates (AND-NOT gates based on 2 target antigens) and 3-input AND-NOT gates (AND-NOT gates based on 3 target antigens) are depicted schematically in FIG. 3C-3D.

As an example, in some cases, the first antigen-triggered polypeptide is a CAR, and the second antigen-triggered polypeptide is an iCAR. Binding of the iCAR to the second antigen (present on the surface of a non-cancerous cell, but not on the surface of a target cancer cell) of a target antigen pair inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is an iCAR. Binding of the iCAR to the second antigen (present on the surface of a non-cancerous cell, but not on the surface of a target cancer cell) of a target antigen pair blocks or reduces T-cell activation mediated by activation of the TCR upon binding to the first antigen (present on the surface of the target cancer cell and on the surface of the non-cancerous cell) of the target antigen pair.

As another example, in some cases, the first antigen-triggered polypeptide is a CAR, and the second antigen-triggered polypeptide is a synNotch polypeptide comprising an intracellular domain that, when released upon activation of the synNotch polypeptide by binding to the second target antigen, induces expression of an intracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a synNotch polypeptide comprising an intracellular domain that, when released upon activation of the synNotch polypeptide by binding to the second target antigen, induces expression of an intracellular inhibitor that inhibits T-cell activation mediated by activation of the TCR upon binding to the first antigen (present on the surface of the target cancer cell and on the surface of the non-cancerous cell) of the target antigen pair.

As another example, in some cases, the first antigen-triggered polypeptide is a CAR, and the second antigen-triggered polypeptide is a synNotch polypeptide comprising an intracellular domain that, when released upon activation of the synNotch polypeptide by binding to the second target antigen, induces expression of an extracellular inhibitor that inhibits T-cell activation mediated by activation of the CAR upon binding to the first antigen (present on the surface of the target cancer cell and on the surface of the non-cancerous cell) of the target antigen pair. As another example, in some cases, the first antigen-triggered polypeptide is a TCR, and the second antigen-triggered polypeptide is a synNotch polypeptide comprising an intracellular domain that, when released upon activation of the synNotch polypeptide by binding to the second target antigen, induces expression of an extracellular inhibitor that inhibits T-cell activation mediated by activation of the TCR upon binding to the first antigen (present on the surface of the target cancer cell and on the surface of the non-cancerous cell) of the target antigen pair.

In some cases, a genetically modified immune cell of the present disclosure provides for a 3-input AND, AND-NOT gate, comprising: 1) a first target antigen of an AND-NOT gate target antigen pair depicted in FIG. 1 or FIG. 9-14; 2) a second target antigen of the AND-NOT gate target antigen pair; and 3) a third target antigen, where the third target antigen is a target antigen depicted in FIG. 4 or Table 3, where the third target antigen is a target antigen for the same cancer cell type as the target antigen pair. In some cases, the 3-input AND, AND-NOT gate comprises: 1) the first target antigen of an AND-NOT gate target antigen pair depicted in FIG. 1 or FIG. 9-14; AND-NOT 2) the second target antigen of the AND-NOT gate target antigen pair; AND 3) the third target antigen. In some cases, the 3-input AND, AND-NOT gate comprises: 1) the second target antigen of an AND-NOT gate target antigen pair depicted in FIG. 1 or FIG. 9-14; AND-NOT 2) the first target antigen of the AND-NOT gate target antigen pair; AND 3) the third target antigen.

As one non-limiting example, where the target AND-NOT gate antigen pair is NLGN1 AND-NOT TNFRSF17 (for a glioma cell) (as shown in FIG. 1), a suitable third target antigen is EphA2 (as shown in FIG. 4).

Systems for Inhibiting Cancer Cells

The present disclosure provides a system for inhibiting or killing a target cancer cell. A system of the present disclosure comprises: a) a first antigen-triggered polypeptide that binds specifically to a first target antigen present on the target cancer cell, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide.

In some cases, the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

In some cases, as noted above, a system of the present disclosure comprises: a) a first antigen-triggered polypeptide that binds specifically to a first target antigen present on a target cancer cell; and b) a second antigen-triggered polypeptide that binds specifically to a second target antigen. In these instances, the polypeptides per se are introduced into an immune cell (e.g., $CD8^+$ T cells and/or NK cells obtained from an individual). Methods of introducing polypeptides into a cell are known in the art; and any known method can be used. For example, in some cases, the first and the second antigen-triggered polypeptides comprise a protein transduction domain (PTD) at the N-terminus or the C-terminus of the polypeptides.

In some cases, as noted above, a system of the present disclosure comprises: a) a first nucleic acid comprising a nucleotide sequence encoding a first antigen-triggered polypeptide that binds specifically to a first target antigen present on a target cancer cell; and b) a second nucleic acid comprising a nucleotide sequence encoding a second antigen-triggered polypeptide that binds specifically to a second target antigen. In some cases, the first and the second antigen-triggered polypeptides are encoded by nucleotide sequences on separate nucleic acids. In other cases, the first and the second antigen-triggered polypeptides are encoded by nucleotide sequences present in the same nucleic acid. In some cases, the nucleic acid is a recombinant expression vector. In some cases, a system of the present disclosure comprises: a) a first recombinant expression vector comprising a nucleotide sequence encoding a first antigen-triggered polypeptide that binds specifically to a first target antigen present on a target cancer cell; and b) a second recombinant expression vector comprising a nucleotide sequence encoding a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter. In some cases, a system of the present disclosure comprises a recombinant expression vector comprising nucleotide sequences encoding: a) a first antigen-triggered polypeptide that binds specifically to a first target antigen present on a target cancer cell; and b) a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter.

Suitable promoters include, but are not limited to; cytomegalovirus immediate early promoter; herpes simplex virus thymidine kinase promoter; early and late SV40 promoters; promoter present in long terminal repeats from a retrovirus; a metallothionein-I promoter; and various art-known promoters. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

In some instances, nucleic acids present in a system of the present disclosure include immune cell specific promoters that are expressed in one or more immune cell types, including but not limited to lymphocytes, hematopoietic stem cells and/or progeny thereof (i.e., immune cell progenitors), etc. Any convenient and appropriate promoter of an immune cell specific gene may find use in nucleic acids of the present disclosure. In some instances, an immune cell specific promoter of a nucleic acid present in a system of the present disclosure may be a T cell specific promoter. In some instances, an immune cell specific promoter of a nucleic acid present in a system of the present disclosure may be a light and/or heavy chain immunoglobulin gene promoter and may or may not include one or more related enhancer elements.

In some instances, an immune cell specific promoter of a nucleic acid present in a system of the present disclosure may be a promoter of a B29 gene promoter, a CD14 gene promoter, a CD43 gene promoter, a CD45 gene promoter, a CD68 gene promoter, a IFN-β gene promoter, a WASP gene promoter, a T-cell receptor β-chain gene promoter, a V9 γ (TRGV9) gene promoter, a V2 δ (TRDV2) gene promoter, and the like.

In some instances, an immune cell specific promoter present in a system of a nucleic acid of the present disclosure may be a viral promoter expressed in immune cells. As such, in some instances, viral promoters useful in nucleic acids present in a system of the present disclosure include viral promoters derived from immune cells viruses, including but not limited to, e.g., lentivirus promoters (e.g., HIV, SIV, FIV, EIAV, or Visna promoters) including e.g., LTR promoter, etc., Retroviridae promoters including, e.g., HTLV-I promoter, HTLV-II promoter, etc., and the like.

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) Proc. Natl. Acad. Sci. USA 90:7739; and Marodon et al. (2003) Blood 101:3416. As another example, a CD8 gene promoter can be used. NK cell-specific expression can be achieved by use of an Ncr1 (p46) promoter; see, e.g., Eckelhart et al. (2011) Blood 117:1565.

Expression vectors generally have convenient restriction sites located near the promoter sequence to provide for the insertion of nucleic acid sequences encoding heterologous proteins. A selectable marker operative in the expression host may be present. Suitable recombinant expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

Antigen Combinations

A system of the present disclosure targets antigen combinations, where the targeting provides for killing of a target cancer cell. A genetically modified immune cell of the present disclosure targets antigen combinations, where the targeting provides for killing of a target cancer cell. Antigen combinations may also reduce off-target effects and/or increase specificity for a target cancer cell, where e.g., an antigen combination includes one or more AND NOT combinations. Examples of target antigen combinations, and corresponding exemplary but non-limiting target cancer cells, are depicted in FIG. 1 and FIG. 9-14. The following antigen combinations are exemplary, and not meant to be limiting.

Liposarcoma Antigen Target Combinations

In some cases, an antigen combination for targeting a liposarcoma cell comprises EVA1B AND NOT ITGA6. In some cases, the ITGA6 polypeptide comprises an amino acid sequence having at least 85%, at least 90%, at least 95%, at least 98%, at least 99%, or 100%, amino acid sequence identity to the amino acid sequence set forth in SEQ ID NOs: 62 or 998. In some cases, the EVA1B polypeptide comprises an amino acid sequence having at least 85%, at least 90%, at least 95%, at least 98%, at least 99%, or 100%, amino acid sequence identity to the amino acid sequence set forth in SEQ ID NO: 4400.

In some cases, an antigen combination for targeting a liposarcoma cell comprises ADAM12 AND NOT TACSTD2. In some cases, the TACSTD2 polypeptide comprises an amino acid sequence having at least 85%, at least 90%, at least 95%, at least 98%, at least 99%, or 100%, amino acid sequence identity to the amino acid sequence set forth in SEQ ID NO: 2631. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

Glioblastoma Antigen Target Combinations

In some cases, an antigen combination for targeting a glioblastoma cell comprises PTPRZ1 AND FOLR2. In some cases, the FOLR2 polypeptide comprises an amino acid sequence having at least 85%, at least 90%, at least 95%, at least 98%, at least 99%, or 100%, amino acid sequence identity to the amino acid sequence set forth in SEQ ID NO: 261, 1261, 1262 or 1263. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND IGF1R. In some cases, the IGF1R polypeptide comprises an amino acid sequence having at least 85%, at least 90%, at least 95%, at least 98%, at least 99%, or 100%, amino acid sequence identity to the amino acid sequence set forth in SEQ ID NO: 308. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND NCAM1. In some cases, the NCAM1 polypeptide comprises an amino acid sequence having at least 85%, at least 90%, at least 95%, at least 98%, at least 99%, or 100%, amino acid sequence identity to the amino acid sequence set forth in SEQ ID NOs: 173, 949 or 6595. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND CD70. In some cases, the CD70 polypeptide comprises an amino acid sequence having at least 85%, at least 90%, at least 95%, at least 98%, at least 99%, or 100%, amino acid sequence identity to the amino acid sequence set forth in SEQ ID NO: 2331. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND AXL. In some cases, the AXL polypeptide comprises an amino acid sequence having at least 85%, at least 90%, at least 95%, at least 98%, at least 99%, or 100%, amino acid sequence identity to the amino acid sequence set forth in SEQ ID NOs: 2438 or 4847. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND NOT NAALAD2. In some cases, the NAALAD2 polypeptide comprises an amino acid sequence having at least 85%, at least 90%, at least 95%, at least 98%, at least 99%, or 100%, amino acid sequence identity to the amino acid sequence set forth in SEQ ID NO: 3289. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND NOT TMEM170B. In some cases, the TMEM170B polypeptide comprises an amino acid sequence having at least 85%, at least 90%, at least 95%, at least 98%, at least 99%, or 100%, amino acid sequence identity to the amino acid sequence set forth in SEQ ID NO: 1195. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND NOT PIGK. In some cases, the PIGK polypeptide comprises an amino acid sequence having at least 85%, at least 90%, at least 95%, at least 98%, at least 99%, or 100%, amino acid sequence identity to the amino acid sequence set forth in SEQ ID NO: 3293. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND CDH5. In some cases, the CDH5 polypeptide comprises an amino acid sequence having at least 85%, at least 90%, at least 95%, at least 98%, at least 99%, or 100%, amino acid sequence identity to the amino acid sequence set forth in SEQ ID NO: 2475. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioblastoma cell comprises PTPRZ1 AND NOT 100507547?. In some cases, the 100507547? polypeptide comprises an amino acid sequence having at least 85%, at least 90%, at least 95%, at least 98%, at least 99%, or 100%, amino acid sequence identity to the amino acid sequence set forth in SEQ ID NO: 7099. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

Additional examples of target antigen pairs for targeting a glioblastoma cell are provided in FIG. 1 and FIG. 9-14.

Breast Adenocarcinoma Target Antigen Combinations

In some cases, an antigen combination for targeting a breast adenocarcinoma cell comprises CYB561 AND NOT SLC2A12. In some cases, the SLC2A12 polypeptide comprises an amino acid sequence having at least 85%, at least 90%, at least 95%, at least 98%, at least 99%, or 100%, amino acid sequence identity to the amino acid sequence set forth in SEQ ID NO: 5933. In some cases, the CYB561 polypeptide comprises an amino acid sequence having at least 85%, at least 90%, at least 95%, at least 98%, at least 99%, or 100%, amino acid sequence identity to the amino acid sequence set forth in SEQ ID NOs: 646, 647 or 2500.

In some cases, an antigen combination for targeting a breast adenocarcinoma cell comprises RHBDF1 AND NOT TMEM256. In some cases, the TMEM256 polypeptide comprises an amino acid sequence having at least 85%, at least 90%, at least 95%, at least 98%, at least 99%, or 100%, amino acid sequence identity to the amino acid sequence set forth in SEQ ID NO: 6112. In some cases, the RHBDF1 polypeptide comprises an amino acid sequence having at least 85%, at least 90%, at least 95%, at least 98%, at least 99%, or 100%, amino acid sequence identity to the amino acid sequence set forth in SEQ ID NO: 4919.

In some cases, an antigen combination for targeting a breast adenocarcinoma cell comprises HSD3B7 AND NOT TMEM256. In some cases, the TMEM256 polypeptide comprises an amino acid sequence having at least 85%, at least 90%, at least 95%, at least 98%, at least 99%, or 100%, amino acid sequence identity to the amino acid sequence set forth in SEQ ID NO: 6112. In some cases, the HSD3B7 polypeptide comprises an amino acid sequence having at least 85%, at least 90%, at least 95%, at least 98%, at least 99%, or 100%, amino acid sequence identity to the amino acid sequence set forth in SEQ ID NO: 1560, 1699, 1700, 4387 or 5132.

In some cases, an antigen combination for targeting a breast adenocarcinoma cell comprises ADAM12 AND NOT TMEM256. In some cases, the TMEM256 polypeptide comprises an amino acid sequence having at least 85%, at least 90%, at least 95%, at least 98%, at least 99%, or 100%, amino acid sequence identity to the amino acid sequence set forth in SEQ ID NO: 6112. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a breast adenocarcinoma cell comprises SLC5A6 AND NOT TMEM256. In some cases, the TMEM256 polypeptide comprises an amino acid sequence having at least 85%, at least 90%, at least 95%, at least 98%, at least 99%, or 100%, amino acid sequence identity to the amino acid sequence set forth in SEQ ID NO: 6112. In some cases, the SLC5A6 polypeptide comprises an amino acid sequence having at least 85%, at least 90%, at least 95%, at least 98%, at least 99%, or 100%, amino acid sequence identity to the amino acid sequence set forth in SEQ ID NO: 4767.

In some cases, an antigen combination for targeting a breast adenocarcinoma cell comprises GGT5 AND NOT TSPAN8. In some cases, the TSPAN8 polypeptide comprises an amino acid sequence having at least 85%, at least 90%, at least 95%, at least 98%, at least 99%, or 100%, amino acid sequence identity to the amino acid sequence set forth in SEQ ID NO: 3085. In some cases, the GGT5 polypeptide comprises an amino acid sequence having at least 85%, at least 90%, at least 95%, at least 98%, at least 99%, or 100%, amino acid sequence identity to the amino acid sequence set forth in SEQ ID NOs: 1173, 1174 or 2968.

In some cases, an antigen combination for targeting a breast adenocarcinoma cell comprises ADAM12 AND NOT ADGRD1. In some cases, the ADGRD1 polypeptide comprises an amino acid sequence having at least 85%, at least 90%, at least 95%, at least 98%, at least 99%, or 100%, amino acid sequence identity to the amino acid sequence set forth in SEQ ID NO: 6838. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a breast adenocarcinoma cell comprises LTBP3 AND NOT HBD. In some cases, the HBD polypeptide comprises an amino acid sequence having at least 85%, at least 90%, at least 95%, at least 98%, at least 99%, or 100%, amino acid sequence identity to the amino acid sequence set forth in SEQ ID NO: 148. In some cases, the LTBP3 polypeptide comprises an amino acid sequence having at least 85%, at least 90%, at least 95%, at least 98%, at least 99%, or 100%, amino acid sequence identity to the amino acid sequence set forth in SEQ ID NOs: 1421, 2072 or 4761.

In some cases, an antigen combination for targeting a breast adenocarcinoma cell comprises MARVELD3 AND NOT TMEM220. In some cases, the TMEM220 polypeptide comprises an amino acid sequence having at least 85%, at least 90%, at least 95%, at least 98%, at least 99%, or 100%, amino acid sequence identity to the amino acid sequence set forth in SEQ ID NO: 429. In some cases, the MARVELD3 polypeptide comprises an amino acid sequence having at least 85%, at least 90%, at least 95%, at least 98%, at least 99%, or 100%, amino acid sequence identity to the amino acid sequence set forth in SEQ ID NOs: 653 or 5518.

In some cases, an antigen combination for targeting a breast adenocarcinoma cell comprises RHBDF1 AND NOT SMIM5. In some cases, the SMIM5 polypeptide comprises an amino acid sequence having at least 85%, at least 90%, at least 95%, at least 98%, at least 99%, or 100%, amino acid sequence identity to the amino acid sequence set forth in SEQ ID NO: 2039. In some cases, the RHBDF1 polypeptide comprises an amino acid sequence having at least 85%, at least 90%, at least 95%, at least 98%, at least 99%, or 100%, amino acid sequence identity to the amino acid sequence set forth in SEQ ID NO: 4919.

Additional examples of target antigen pairs for targeting a breast adenocarcinoma cell are provided in FIG. 1 and FIG. 9-14.

Glioma Target Antigen Combinations

In some cases, an antigen combination for targeting a glioma cell comprises NLGN1 AND NOT TNFRSF17. In some cases, the TNFRSF17 polypeptide comprises an amino acid sequence having at least 85%, at least 90%, at least 95%, at least 98%, at least 99%, or 100%, amino acid sequence identity to the amino acid sequence set forth in SEQ ID NO: 2312. In some cases, the NLGN1 polypeptide comprises an amino acid sequence having at least 85%, at least 90%, at least 95%, at least 98%, at least 99%, or 100%, amino acid sequence identity to the amino acid sequence set forth in SEQ ID NO: 4016.

In some cases, an antigen combination for targeting a glioma cell comprises ITGAV AND NOT TNFRSF17. In some cases, the TNFRSF17 polypeptide comprises an amino acid sequence having at least 85%, at least 90%, at least 95%, at least 98%, at least 99%, or 100%, amino acid sequence identity to the amino acid sequence set forth in SEQ ID NO: 2312. In some cases, the ITGAV polypeptide comprises an amino acid sequence having at least 85%, at least 90%, at least 95%, at least 98%, at least 99%, or 100%, amino acid sequence identity to the amino acid sequence set forth in SEQ ID NOs: 1802, 1803 or 2579.

In some cases, an antigen combination for targeting a glioma cell comprises SYT11 AND TNFRSF17. In some cases, the TNFRSF17 polypeptide comprises an amino acid sequence having at least 85%, at least 90%, at least 95%, at least 98%, at least 99%, or 100%, amino acid sequence identity to the amino acid sequence set forth in SEQ ID NO: 2312. In some cases, the SYT11 polypeptide comprises an amino acid sequence having at least 85%, at least 90%, at least 95%, at least 98%, at least 99%, or 100%, amino acid sequence identity to the amino acid sequence set forth in SEQ ID NO: 6023.

In some cases, an antigen combination for targeting a glioma cell comprises SCRG1 AND TNFRSF17. In some cases, the TNFRSF17 polypeptide comprises an amino acid sequence having at least 85%, at least 90%, at least 95%, at least 98%, at least 99%, or 100%, amino acid sequence identity to the amino acid sequence set forth in SEQ ID NO: 2312. In some cases, the SCRG1 polypeptide comprises an amino acid sequence having at least 85%, at least 90%, at least 95%, at least 98%, at least 99%, or 100%, amino acid sequence identity to the amino acid sequence set forth in SEQ ID NO: 3667.

In some cases, an antigen combination for targeting a glioma cell comprises AGPAT5 AND NOT TNFRSF17. In some cases, the TNFRSF17 polypeptide comprises an amino acid sequence having at least 85%, at least 90%, at least 95%, at least 98%, at least 99%, or 100%, amino acid sequence identity to the amino acid sequence set forth in SEQ ID NO: 2312. In some cases, the AGPAT5 polypeptide comprises an amino acid sequence having at least 85%, at least 90%, at least 95%, at least 98%, at least 99%, or 100%, amino acid sequence identity to the amino acid sequence set forth in SEQ ID NO: 4429.

In some cases, an antigen combination for targeting a glioma cell comprises PTPRZ1 AND NOT TNFRSF17. In some cases, the TNFRSF17 polypeptide comprises an amino acid sequence having at least 85%, at least 90%, at least 95%, at least 98%, at least 99%, or 100%, amino acid sequence identity to the amino acid sequence set forth in SEQ ID NO: 2312. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting a glioma cell comprises NRCAM AND NOT FOLH1. In some cases, the FOLH1 polypeptide comprises an amino acid sequence having at least 85%, at least 90%, at least 95%, at least 98%, at least 99%, or 100%, amino acid sequence identity to the amino acid sequence set forth in SEQ ID NOs: 631 or 3057. In some cases, the NRCAM polypeptide comprises an amino acid sequence having at least 85%, at least 90%, at least 95%, at least 98%, at least 99%, or 100%, amino acid sequence identity to the amino acid sequence set forth in SEQ ID NOs: 768, 769 or 3195.

In some cases, an antigen combination for targeting a glioma cell comprises PRAF2 AND NOT FOLH1. In some cases, the FOLH1 polypeptide comprises an amino acid sequence having at least 85%, at least 90%, at least 95%, at least 98%, at least 99%, or 100%, amino acid sequence identity to the amino acid sequence set forth in SEQ ID NOs: 631 or 3057. In some cases, the PRAF2 polypeptide comprises an amino acid sequence having at least 85%, at least 90%, at least 95%, at least 98%, at least 99%, or 100%, amino acid sequence identity to the amino acid sequence set forth in SEQ ID NO: 3649.

In some cases, an antigen combination for targeting a glioma cell comprises XPR1 AND FOLH1. In some cases, the FOLH1 polypeptide comprises an amino acid sequence having at least 85%, at least 90%, at least 95%, at least 98%, at least 99%, or 100%, amino acid sequence identity to the amino acid sequence set forth in SEQ ID NOs: 631 or 3057. In some cases, the XPR1 polypeptide comprises an amino acid sequence having at least 85%, at least 90%, at least 95%, at least 98%, at least 99%, or 100%, amino acid sequence identity to the amino acid sequence set forth in SEQ ID NOs: 1546 or 3112.

In some cases, an antigen combination for targeting a glioma cell comprises SYT11 AND NOT FOLH1. In some cases, the FOLH1 polypeptide comprises an amino acid sequence having at least 85%, at least 90%, at least 95%, at least 98%, at least 99%, or 100%, amino acid sequence identity to the amino acid sequence set forth in SEQ ID NOs: 631 or 3057. In some cases, the SYT11 polypeptide comprises an amino acid sequence having at least 85%, at least 90%, at least 95%, at least 98%, at least 99%, or 100%, amino acid sequence identity to the amino acid sequence set forth in SEQ ID NO: 6023.

Additional examples of target antigen pairs for targeting a glioma cell are provided in FIG. 1 and FIG. 9-14.

Breast Carcinoma (e.g., Ductal Breast Carcinoma) Target Antigen Combinations

In some cases, an antigen combination for targeting a breast carcinoma cell comprises CACFD1 AND NOT TMED6. In some cases, the TMED6 polypeptide comprises an amino acid sequence having at least 85%, at least 90%, at least 95%, at least 98%, at least 99%, or 100%, amino acid sequence identity to the amino acid sequence set forth in SEQ ID NO: 5889. In some cases, the CACFD1 polypeptide comprises an amino acid sequence having at least 85%, at least 90%, at least 95%, at least 98%, at least 99%, or 100%, amino acid sequence identity to the amino acid sequence set forth in SEQ ID NOs: 1566 or 4310.

In some cases, an antigen combination for targeting a breast carcinoma cell comprises CACFD1 AND NOT TMEM61. In some cases, the TMEM61 polypeptide comprises an amino acid sequence having at least 85%, at least 90%, at least 95%, at least 98%, at least 99%, or 100%, amino acid sequence identity to the amino acid sequence set forth in SEQ ID NO: 6652. In some cases, the CACFD1 polypeptide comprises an amino acid sequence having at least 85%, at least 90%, at least 95%, at least 98%, at least 99%, or 100%, amino acid sequence identity to the amino acid sequence set forth in SEQ ID NOs: 1566 or 4310.

In some cases, an antigen combination for targeting a breast carcinoma cell comprises CACFD1 AND NOT CDHR2. In some cases, the CDHR2 polypeptide comprises an amino acid sequence having at least 85%, at least 90%, at least 95%, at least 98%, at least 99%, or 100%, amino acid sequence identity to the amino acid sequence set forth in SEQ ID NOs: 2306 or 4321. In some cases, the CACFD1 polypeptide comprises an amino acid sequence having at least 85%, at least 90%, at least 95%, at least 98%, at least 99%, or 100%, amino acid sequence identity to the amino acid sequence set forth in SEQ ID NOs: 1566 or 4310.

In some cases, an antigen combination for targeting a breast carcinoma cell comprises CACFD1 AND NOT TMEM246. In some cases, the TMEM246 polypeptide comprises an amino acid sequence having at least 85%, at least 90%, at least 95%, at least 98%, at least 99%, or 100%, amino acid sequence identity to the amino acid sequence set forth in SEQ ID NO: 5332. In some cases, the CACFD1 polypeptide comprises an amino acid sequence having at least 85%, at least 90%, at least 95%, at least 98%, at least 99%, or 100%, amino acid sequence identity to the amino acid sequence set forth in SEQ ID NOs: 1566 or 4310.

In some cases, an antigen combination for targeting a breast carcinoma cell comprises CACFD1 AND NOT SLC4A4. In some cases, the SLC4A4 polypeptide comprises an amino acid sequence having at least 85%, at least 90%, at least 95%, at least 98%, at least 99%, or 100%, amino acid sequence identity to the amino acid sequence set forth in SEQ ID NOs: 1125, 1504 or 2885. In some cases, the CACFD1 polypeptide comprises an amino acid sequence having at least 85%, at least 90%, at least 95%, at least 98%, at least 99%, or 100%, amino acid sequence identity to the amino acid sequence set forth in SEQ ID NOs: 1566 or 4310.

In some cases, an antigen combination for targeting a breast carcinoma cell comprises C10orf35 AND NOT SLC4A4. In some cases, the SLC4A4 polypeptide comprises an amino acid sequence having at least 85%, at least 90%, at least 95%, at least 98%, at least 99%, or 100%, amino acid sequence identity to the amino acid sequence set forth in SEQ ID NOs: 1125, 1504 or 2885. In some cases, the C10orf35 polypeptide comprises an amino acid sequence having at least 85%, at least 90%, at least 95%, at least 98%, at least 99%, or 100%, amino acid sequence identity to the amino acid sequence set forth in SEQ ID NO: 5959.

In some cases, an antigen combination for targeting a breast carcinoma cell comprises RNF121 AND NOT PTCH1. In some cases, the PTCH1 polypeptide comprises an amino acid sequence having at least 85%, at least 90%, at least 95%, at least 98%, at least 99%, or 100%, amino acid sequence identity to the amino acid sequence set forth in SEQ ID NO: 77, 1071, 1072, 1073, 1074, 1075 or 1076. In some cases, the RNF121 polypeptide comprises an amino acid sequence having at least 85%, at least 90%, at least 95%, at least 98%, at least 99%, or 100%, amino acid sequence identity to the amino acid sequence set forth in SEQ ID NO: 4420.

Renal Carcinoma Target Antigen Combinations

In some cases, an antigen combination for targeting a renal carcinoma cell comprises CAV2 AND NOT SCARA5. In some cases, the SCARA5 polypeptide comprises an amino acid sequence having at least 85%, at least 90%, at least 95%, at least 98%, at least 99%, or 100%, amino acid sequence identity to the amino acid sequence set forth in SEQ ID NO: 6392. In some cases, the CAV2 polypeptide comprises an amino acid sequence having at least 85%, at least 90%, at least 95%, at least 98%, at least 99%, or 100%, amino acid sequence identity to the amino acid sequence set forth in SEQ ID NOs: 2320 or 6759.

Pancreas Carcinoma (e.g., Pancreatic Ductal Carcinoma) Target Antigen Combinations In some cases, an antigen combination for targeting a pancreas carcinoma cell comprises CTRB2 AND NOT CDH18. In some cases, the CDH18 polypeptide comprises an amino acid sequence having at least 85%, at least 90%, at least 95%, at least 98%, at least 99%, or 100%, amino acid sequence identity to the amino acid sequence set forth in SEQ ID NOs: 2192 or 3172. In some cases, the CTRB2 polypeptide comprises an amino acid sequence having at least 85%, at least 90%, at least 95%, at least 98%, at least 99%, or 100%, amino acid sequence identity to the amino acid sequence set forth in SEQ ID NO: 701.

In some cases, an antigen combination for targeting a pancreas carcinoma cell comprises TM4SF4 AND NOT ABCC2. In some cases, the ABCC2 polypeptide comprises an amino acid sequence having at least 85%, at least 90%, at least 95%, at least 98%, at least 99%, or 100%, amino acid sequence identity to the amino acid sequence set forth in SEQ ID NO: 117. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND NOT TMEM56. In some cases, the TMEM56 polypeptide comprises an amino acid sequence having at least 85%, at least 90%, at least 95%, at least 98%, at least 99%, or 100%, amino acid sequence identity to the amino acid sequence set forth in SEQ ID NO: 6068. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND NOT CYP3A7. In some cases, the CYP3A7 polypeptide comprises an amino acid sequence having at least 85%, at least 90%, at least 95%, at least 98%, at least 99%, or 100%, amino acid sequence identity to the amino acid sequence set forth in SEQ ID NO: 239. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND NOT CYP2J2. In some cases, the CYP2J2 polypeptide comprises an amino acid sequence having at least 85%, at least 90%, at least 95%, at least 98%, at least 99%, or 100%, amino acid sequence identity to the amino acid sequence set forth in SEQ ID NO: 243. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND NOT CLYBL. In some cases, the CLYBL polypeptide comprises an amino acid sequence having at least 85%, at least 90%, at least 95%, at least 98%, at least 99%, or 100%, amino acid sequence identity to the amino acid sequence set forth in SEQ ID NO: 6965. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND NOT SLC35D1. In some cases, the SLC35D1 polypeptide comprises an amino acid sequence having at least 85%, at least 90%, at least 95%, at least 98%, at least 99%, or 100%, amino acid sequence identity to the amino acid sequence set forth in SEQ ID NO: 4040. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND NOT G6PC. In some cases, the G6PC polypeptide comprises an amino acid sequence having at least 85%, at least 90%, at least 95%, at least 98%, at least 99%, or 100%, amino acid sequence identity to the amino acid sequence set forth in SEQ ID NO: 45. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises TM4SF4 AND GJA1. In some cases, the GJA1 polypeptide comprises an amino acid sequence having at least 85%, at least 90%, at least 95%, at least 98%, at least 99%, or 100%, amino acid sequence identity to the amino acid sequence set forth in SEQ ID NO: 51. In some cases, the TM4SF4 polypeptide comprises an amino acid sequence having at least 85%, at least 90%, at least 95%, at least 98%, at least 99%, or 100%, amino acid sequence identity to the amino acid sequence set forth in SEQ ID NO: 3086.

In some cases, an antigen combination for targeting a pancreas carcinoma cell comprises CTRB2 AND NPTN. In some cases, the NPTN polypeptide comprises an amino acid sequence having at least 85%, at least 90%, at least 95%, at least 98%, at least 99%, or 100%, amino acid sequence identity to the amino acid sequence set forth in SEQ ID NOs: 2004, 2005, 3774 or 4295. In some cases, the CTRB2 polypeptide comprises an amino acid sequence having at least 85%, at least 90%, at least 95%, at least 98%, at least 99%, or 100%, amino acid sequence identity to the amino acid sequence set forth in SEQ ID NO: 701.

Additional examples of target antigen pairs for targeting a pancreas carcinoma cell are provided in FIG. 1 and FIG. 9-14.

Melanoma Target Antigen Combinations

In some cases, an antigen combination for targeting a melanoma cell comprises DBI AND NOT FCN2. In some cases, the FCN2 polypeptide comprises an amino acid sequence having at least 85%, at least 90%, at least 95%, at least 98%, at least 99%, or 100%, amino acid sequence identity to the amino acid sequence set forth in SEQ ID NOs: 2966 or 4122. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises KIAA1549L AND DBI. In some cases, the KIAA1549L polypeptide comprises an amino acid sequence having at least 85%, at least 90%, at least 95%, at least 98%, at least 99%, or 100%, amino acid sequence identity to the amino acid sequence set forth in SEQ ID NO: 3718. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises TMED3 AND DBI. In some cases, the TMED3 polypeptide comprises an amino acid sequence having at least 85%, at least 90%, at least 95%, at least 98%, at least 99%, or 100%, amino acid sequence identity to the amino acid sequence set forth in SEQ ID NO: 3691. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises SFXN3 AND NOT DBI. In some cases, the SFXN3 polypeptide comprises an amino acid sequence having at least 85%, at least 90%, at least 95%, at least 98%, at least 99%, or 100%, amino acid sequence identity to the amino acid sequence set forth in SEQ ID NO: 5209. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises GPR19 AND DBI. In some cases, the GPR19 polypeptide comprises an amino acid sequence having at least 85%, at least 90%, at least 95%, at least 98%, at least 99%, or 100%, amino acid sequence identity to the amino acid sequence set forth in SEQ ID NO: 3446. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises DBI AND NOT ITGA2B. In some cases, the ITGA2B polypeptide comprises an amino acid sequence having at least 85%, at least 90%, at least 95%, at least 98%, at least 99%, or 100%, amino acid sequence identity to the amino acid sequence set forth in SEQ ID NO: 123. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises DBI AND NOT VSTM1. In some cases, the VSTM1 polypeptide comprises an amino acid sequence having at least 85%, at least 90%, at least 95%, at least 98%, at least 99%, or 100%, amino acid sequence identity to the amino acid sequence set forth in SEQ ID NO: 6800. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises DBI AND BNIP1. In some cases, the BNIP1 polypeptide comprises an amino acid sequence having at least 85%, at least 90%, at least 95%, at least 98%, at least 99%, or 100%, amino acid sequence identity to the amino acid sequence set forth in SEQ ID NOs: 2317, 3842, 3843 or 3844. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises DBI AND NOT CD300LB. In some cases, the CD300LB polypeptide comprises an amino acid sequence having at least 85%, at least 90%, at least 95%, at least 98%, at least 99%, or 100%, amino acid sequence identity to the amino acid sequence set forth in SEQ ID NO: 6404. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

In some cases, an antigen combination for targeting a melanoma cell comprises MANBAL AND DBI. In some cases, the MANBAL polypeptide comprises an amino acid sequence having at least 85%, at least 90%, at least 95%, at least 98%, at least 99%, or 100%, amino acid sequence identity to the amino acid sequence set forth in SEQ ID NOs: 425 or 4873. In some cases, the DBI polypeptide comprises an amino acid sequence having at least 85%, at least 90%, at least 95%, at least 98%, at least 99%, or 100%, amino acid sequence identity to the amino acid sequence set forth in SEQ ID NOs: 1006, 1007 and 4684.

Additional examples of target antigen pairs for targeting a melanoma cell are provided in FIG. 1 and FIG. 9-14.

Anaplastic Lymphoma (e.g., Anaplastic Large-Cell Lymphoma) Target Antigen Combinations In some cases, an antigen combination for targeting an anaplastic lymphoma cell comprises TNFRSF8 AND NOT GPC3. In some cases, the GPC3 polypeptide comprises an amino acid sequence having at least 85%, at least 90%, at least 95%, at least 98%, at least 99%, or 100%, amino acid sequence identity to the amino acid sequence set forth in SEQ ID NOs: 2089, 2090, 2091 or 3062. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT L1CAM. In some cases, the L1CAM polypeptide comprises an amino acid sequence having at least 85%, at least 90%, at least 95%, at least 98%, at least 99%, or 100%, amino acid sequence identity to the amino acid sequence set forth in SEQ ID NOs: 126, 1743 or 4990. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT TNFRSF10A. In some cases, the TNFRSF10A polypeptide comprises an amino acid sequence having at least 85%, at least 90%, at least 95%, at least 98%, at least 99%, or 100%, amino acid sequence identity to the amino acid sequence set forth in SEQ ID NO: 2911. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT ERBB2. In some cases, the ERBB2 polypeptide comprises an amino acid sequence having at least 85%, at least 90%, at least 95%, at least 98%, at least 99%, or 100%, amino acid sequence identity to the amino acid sequence set forth in SEQ ID NOs: 474 or 3051. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT IL11RA. In some cases, the IL11RA polypeptide comprises an amino acid sequence having at least 85%, at least 90%, at least 95%, at least 98%, at least 99%, or 100%, amino acid sequence identity to the amino acid sequence set forth in SEQ ID NOs: 1701, 3066 or 5993. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT SYT15. In some cases, the SYT15 polypeptide comprises an amino acid sequence having at least 85%, at least 90%, at least 95%, at least 98%, at least 99%, or 100%, amino acid sequence identity to the amino acid sequence set forth in SEQ ID NOs: 5268 or 6605. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT CYP4F2. In some cases, the CYP4F2 polypeptide comprises an amino acid sequence having at least 85%, at least 90%, at least 95%, at least 98%, at least 99%, or 100%, amino acid sequence identity to the amino acid sequence set forth in SEQ ID NO: 988. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT KCNK13. In some cases, the KCNK13 polypeptide comprises an amino acid sequence having at least 85%, at least 90%, at least 95%, at least 98%, at least 99%, or 100%, amino acid sequence identity to the amino acid sequence set forth in SEQ ID NO: 4869. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

In some cases, an antigen combination for targeting an anaplastic lymphoma cell comprises TNFRSF8 AND NOT NTN1. In some cases, the NTN1 polypeptide comprises an amino acid sequence having at least 85%, at least 90%, at least 95%, at least 98%, at least 99%, or 100%, amino acid sequence identity to the amino acid sequence set forth in SEQ ID NO: 3138. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140.

Additional examples of target antigen pairs for targeting an anaplastic lymphoma cell are provided in FIG. 1 and FIG. 9-14.

Leiomyosarcoma Target Antigen Combinations

In some cases, an antigen combination for targeting a leiomyosarcoma cell comprises VANGL1 AND NOT SGPP2. In some cases, the SGPP2 polypeptide comprises an amino acid sequence having at least 85%, at least 90%, at least 95%, at least 98%, at least 99%, or 100%, amino acid sequence identity to the amino acid sequence set forth in SEQ ID NO: 6046. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises VANGL1 AND NOT KRTCAP3. In some cases, the KRTCAP3 polypeptide comprises an amino acid sequence having at least 85%, at least 90%, at least 95%, at least 98%, at least 99%, or 100%, amino acid sequence identity to the amino acid sequence set forth in SEQ ID NOs: 2225 or 6396. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises NEMP1 AND NOT SMIM5. In some cases, the SMIM5 polypeptide comprises an amino acid sequence having at least 85%, at least 90%, at least 95%, at least 98%, at least 99%, or 100%, amino acid sequence identity to the amino acid sequence set forth in SEQ ID NO: 2039. In some cases, the NEMP1 polypeptide comprises an amino acid sequence having at least 85%, at least 90%, at least 95%, at least 98%, at least 99%, or 100%, amino acid sequence identity to the amino acid sequence set forth in SEQ ID NOs: 1451 or 4053.

In some cases, an antigen combination for targeting a leiomyosarcoma cell comprises ATP2A2 AND NOT CRB3. In some cases, the CRB3 polypeptide comprises an amino acid sequence having at least 85%, at least 90%, at least 95%, at least 98%, at least 99%, or 100%, amino acid sequence identity to the amino acid sequence set forth in SEQ ID NO: 5838 or 6403. In some cases, the ATP2A2 polypeptide comprises an amino acid sequence having at least 85%, at least 90%, at least 95%, at least 98%, at least 99%, or 100%, amino acid sequence identity to the amino acid sequence set forth in SEQ ID NOs: 1561, 2432 or 6245.

In some cases, an antigen combination for targeting a leiomyosarcoma cell comprises VANGL1 AND NOT F11R. In some cases, the F11R polypeptide comprises an amino acid sequence having at least 85%, at least 90%, at least 95%, at least 98%, at least 99%, or 100%, amino acid sequence identity to the amino acid sequence set forth in SEQ ID NO: 4278. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises VANGL1 AND NOT RNF43. In some cases, the RNF43 polypeptide comprises an amino acid sequence having at least 85%, at least 90%, at least 95%, at least 98%, at least 99%, or 100%, amino acid sequence identity to the amino acid sequence set forth in SEQ ID NO: 4337. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises VANGL1 AND NOT SCNN1A. In some cases, the SCNN1A polypeptide comprises an amino acid sequence having at least 85%, at least 90%, at least 95%, at least 98%, at least 99%, or 100%, amino acid sequence identity to the amino acid sequence set forth in SEQ ID NO: 756, 1946 or 1947. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises VANGL1 AND NOT SMIM5. In some cases, the SMIM5 polypeptide comprises an amino acid sequence having at least 85%, at least 90%, at least 95%, at least 98%, at least 99%, or 100%, amino acid sequence identity to the amino acid sequence set forth in SEQ ID NO: 2039. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises VANGL1 AND NOT ERMP1. In some cases, the ERMP1 polypeptide comprises an amino acid sequence having at least 85%, at least 90%, at least 95%, at least 98%, at least 99%, or 100%, amino acid sequence identity to the amino acid sequence set forth in SEQ ID NO: 5098. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

In some cases, an antigen combination for targeting a leiomyosarcoma cell comprises VANGL1 AND NOT CRB3. In some cases, the CRB3 polypeptide comprises an amino acid sequence having at least 85%, at least 90%, at least 95%, at least 98%, at least 99%, or 100%, amino acid sequence identity to the amino acid sequence set forth in SEQ ID NO: 5838 or 6403. In some cases, the VANGL1 polypeptide comprises an amino acid sequence having at least 85%, at least 90%, at least 95%, at least 98%, at least 99%, or 100%, amino acid sequence identity to the amino acid sequence set forth in SEQ ID NO: 5808.

Additional examples of target antigen pairs for targeting a leiomyocarcoma cell are provided in FIG. 1 and FIG. 9-14.

Astrocytoma Target Antigen Combinations

In some cases, an antigen combination for targeting an astrocytoma cell comprises PTPRZ1 AND CLCN5. In some cases, the CLCN5 polypeptide comprises an amino acid sequence having at least 85%, at least 90%, at least 95%, at least 98%, at least 99%, or 100%, amino acid sequence identity to the amino acid sequence set forth in SEQ ID NOs: 22, 1361 or 1362. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND ADGRE1. In some cases, the ADGRE1 polypeptide comprises an amino acid sequence having at least 85%, at least 90%, at least 95%, at least 98%, at least 99%, or 100%, amino acid sequence identity to the amino acid sequence set forth in SEQ ID NO: 2514. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND F2R. In some cases, the F2R polypeptide comprises an amino acid sequence having at least 85%, at least 90%, at least 95%, at least 98%, at least 99%, or 100%, amino acid sequence identity to the amino acid sequence set forth in SEQ ID NO: 2519. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND CYB561A3. In some cases, the CYB561A3 polypeptide comprises an amino acid sequence having at least 85%, at least 90%, at least 95%, at least 98%, at least 99%, or 100%, amino acid sequence identity to the amino acid sequence set forth in SEQ ID NOs: 646, 647 or 2500. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND IL27. In some cases, the IL27 polypeptide comprises an amino acid sequence having at least 85%, at least 90%, at least 95%, at least 98%, at least 99%, or 100%, amino acid sequence identity to the amino acid sequence set forth in SEQ ID NO: 5969. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND NOT GHITM. In some cases, the GHITM polypeptide comprises an amino acid sequence having at least 85%, at least 90%, at least 95%, at least 98%, at least 99%, or 100%, amino acid sequence identity to the amino acid sequence set forth in SEQ ID NO: 3930. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND NOT PRRT3. In some cases, the PRRT3 polypeptide comprises an amino acid sequence having at least 85%, at least 90%, at least 95%, at least 98%, at least 99%, or 100%, amino acid sequence identity to the amino acid sequence set forth in SEQ ID NO: 7014. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND HAS2. In some cases, the HAS2 polypeptide comprises an amino acid sequence having at least 85%, at least 90%, at least 95%, at least 98%, at least 99%, or 100%, amino acid sequence identity to the amino acid sequence set forth in SEQ ID NO: 3273. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND LCAT. In some cases, the LCAT polypeptide comprises an amino acid sequence having at least 85%, at least 90%, at least 95%, at least 98%, at least 99%, or 100%, amino acid sequence identity to the amino acid sequence set forth in SEQ ID NO: 71. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

In some cases, an antigen combination for targeting an astrocytoma cell comprises PTPRZ1 AND NOT EPCAM. In some cases, the EPCAM polypeptide comprises an amino acid sequence having at least 85%, at least 90%, at least 95%, at least 98%, at least 99%, or 100%, amino acid sequence identity to the amino acid sequence set forth in SEQ ID NO: 2632. In some cases, the PTPRZ1 polypeptide comprises an amino acid sequence having at least 85%, at least 90%, at least 95%, at least 98%, at least 99%, or 100%, amino acid sequence identity to the amino acid sequence set forth in SEQ ID NO: 2726.

Additional examples of target antigen pairs for targeting an astrocytoma are provided in FIG. 1 and FIG. 9-14.

Ovarian Cancer (e.g., Serous Cystadenocarcinoma; Papillary Adenocarcinoma) Target Antigen Combinations In some cases, an antigen combination for targeting an ovarian cancer cell (e.g., a cystadenocarcinoma) comprises SVOPL AND NOT ARL6IP5. In some cases, the ARL6IP5 polypeptide comprises an amino acid sequence having at least 85%, at least 90%, at least 95%, at least 98%, at least 99%, or 100%, amino acid sequence identity to the amino acid sequence set forth in SEQ ID NO: 3483. In some cases, the SVOPL polypeptide comprises an amino acid sequence having at least 85%, at least 90%, at least 95%, at least 98%, at least 99%, or 100%, amino acid sequence identity to the amino acid sequence set forth in SEQ ID NOs: 1618 or 6423.

In some cases, an antigen combination for targeting an ovarian cancer cell comprises FAAH2 AND NOT ARL6IP5. In some cases, the ARL6IP5 polypeptide comprises an amino acid sequence having at least 85%, at least 90%, at least 95%, at least 98%, at least 99%, or 100%, amino acid sequence identity to the amino acid sequence set forth in SEQ ID NO: 3483. In some cases, the FAAH2 polypeptide comprises an amino acid sequence having at least 85%, at least 90%, at least 95%, at least 98%, at least 99%, or 100%, amino acid sequence identity to the amino acid sequence set forth in SEQ ID NO: 6408.

In some cases, an antigen combination for targeting an ovarian cancer cell comprises GAL3ST4 AND NOT ARL6IP5. In some cases, the ARL6IP5 polypeptide comprises an amino acid sequence having at least 85%, at least 90%, at least 95%, at least 98%, at least 99%, or 100%, amino acid sequence identity to the amino acid sequence set forth in SEQ ID NO: 3483. In some cases, the GAL3ST4 polypeptide comprises an amino acid sequence having at least 85%, at least 90%, at least 95%, at least 98%, at least 99%, or 100%, amino acid sequence identity to the amino acid sequence set forth in SEQ ID NO: 5061.

In some cases, an antigen combination for targeting an ovarian cancer cell comprises SYNE4 AND NOT FAXDC2. In some cases, the FAXDC2 polypeptide comprises an amino acid sequence having at least 85%, at least 90%, at least 95%, at least 98%, at least 99%, or 100%, amino acid sequence identity to the amino acid sequence set forth in SEQ ID NOs: 4206 or 5337. In some cases, the SYNE4 polypeptide comprises an amino acid sequence having at least 85%, at least 90%, at least 95%, at least 98%, at least 99%, or 100%, amino acid sequence identity to the amino acid sequence set forth in SEQ ID NO: 814.

In some cases, an antigen combination for targeting an ovarian cancer cell comprises SYNE4 AND NOT OS9. In some cases, the OS9 polypeptide comprises an amino acid sequence having at least 85%, at least 90%, at least 95%, at least 98%, at least 99%, or 100%, amino acid sequence identity to the amino acid sequence set forth in SEQ ID NOs: 650, 651, 652 or 3569. In some cases, the SYNE4 polypeptide comprises an amino acid sequence having at least 85%, at least 90%, at least 95%, at least 98%, at least 99%, or 100%, amino acid sequence identity to the amino acid sequence set forth in SEQ ID NO: 814.

In some cases, an antigen combination for targeting an ovarian cancer cell comprises SVOPL AND NOT ANTXR2.

In some cases, the ANTXR2 polypeptide comprises an amino acid sequence having at least 85%, at least 90%, at least 95%, at least 98%, at least 99%, or 100%, amino acid sequence identity to the amino acid sequence set forth in SEQ ID NOs: 1876 or 5582. In some cases, the SVOPL polypeptide comprises an amino acid sequence having at least 85%, at least 90%, at least 95%, at least 98%, at least 99%, or 100%, amino acid sequence identity to the amino acid sequence set forth in SEQ ID NOs: 1618 or 6423.

In some cases, an antigen combination for targeting an ovarian cancer cell comprises SVOPL AND NOT COMT. In some cases, the COMT polypeptide comprises an amino acid sequence having at least 85%, at least 90%, at least 95%, at least 98%, at least 99%, or 100%, amino acid sequence identity to the amino acid sequence set forth in SEQ ID NO: 232, 1531, 1532 or 3683. In some cases, the SVOPL polypeptide comprises an amino acid sequence having at least 85%, at least 90%, at least 95%, at least 98%, at least 99%, or 100%, amino acid sequence identity to the amino acid sequence set forth in SEQ ID NOs: 1618 or 6423.

In some cases, an antigen combination for targeting an ovarian cancer cell comprises SVOPL AND NOT SLC31A2. In some cases, the SLC31A2 polypeptide comprises an amino acid sequence having at least 85%, at least 90%, at least 95%, at least 98%, at least 99%, or 100%, amino acid sequence identity to the amino acid sequence set forth in SEQ ID NO: 2490. In some cases, the SVOPL polypeptide comprises an amino acid sequence having at least 85%, at least 90%, at least 95%, at least 98%, at least 99%, or 100%, amino acid sequence identity to the amino acid sequence set forth in SEQ ID NOs: 1618 or 6423.

In some cases, an antigen combination for targeting an ovarian cancer cell comprises SVOPL AND NOT MFSD4. In some cases, the MFSD4 polypeptide comprises an amino acid sequence having at least 85%, at least 90%, at least 95%, at least 98%, at least 99%, or 100%, amino acid sequence identity to the amino acid sequence set forth in SEQ ID NO: 6617. In some cases, the SVOPL polypeptide comprises an amino acid sequence having at least 85%, at least 90%, at least 95%, at least 98%, at least 99%, or 100%, amino acid sequence identity to the amino acid sequence set forth in SEQ ID NOs: 1618 or 6423.

In some cases, an antigen combination for targeting an ovarian cancer cell comprises SVOPL AND NOT FMO5. In some cases, the FMO5 polypeptide comprises an amino acid sequence having at least 85%, at least 90%, at least 95%, at least 98%, at least 99%, or 100%, amino acid sequence identity to the amino acid sequence set forth in SEQ ID NOs: 1775, 1776 or 2379. In some cases, the SVOPL polypeptide comprises an amino acid sequence having at least 85%, at least 90%, at least 95%, at least 98%, at least 99%, or 100%, amino acid sequence identity to the amino acid sequence set forth in SEQ ID NOs: 1618 or 6423.

Additional examples of target antigen pairs for targeting an ovarian cancer cell (e.g., a cystadenocarcinoma) are provided in FIG. 1 and FIG. 9-14.

Neuroblastoma Target Antigen Combinations

In some cases, an antigen combination for targeting a neuroblastoma cell comprises MARCH11 AND SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the MARCH11 polypeptide comprises an amino acid sequence having at least 85%, at least 90%, at least 95%, at least 98%, at least 99%, or 100%, amino acid sequence identity to the amino acid sequence set forth in SEQ ID NO: 1209.

In some cases, an antigen combination for targeting a neuroblastoma cell comprises SLC10A4 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the SLC10A4 polypeptide comprises an amino acid sequence having at least 85%, at least 90%, at least 95%, at least 98%, at least 99%, or 100%, amino acid sequence identity to the amino acid sequence set forth in SEQ ID NO: 6095.

In some cases, an antigen combination for targeting a neuroblastoma cell comprises ST8SIA2 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the ST8SIA2 polypeptide comprises an amino acid sequence having at least 85%, at least 90%, at least 95%, at least 98%, at least 99%, or 100%, amino acid sequence identity to the amino acid sequence set forth in SEQ ID NO: 3413.

In some cases, an antigen combination for targeting a neuroblastoma cell comprises VANGL2 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the VANGL2 polypeptide comprises an amino acid sequence having at least 85%, at least 90%, at least 95%, at least 98%, at least 99%, or 100%, amino acid sequence identity to the amino acid sequence set forth in SEQ ID NO: 4631.

In some cases, an antigen combination for targeting a neuroblastoma cell comprises DIABLO AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the DIABLO polypeptide comprises an amino acid sequence having at least 85%, at least 90%, at least 95%, at least 98%, at least 99%, or 100%, amino acid sequence identity to the amino acid sequence set forth in SEQ ID NOs: 4591 or 5805.

In some cases, an antigen combination for targeting a neuroblastoma cell comprises SLC10A4 AND NOT WT1. In some cases, the WT1 polypeptide comprises an amino acid sequence having at least 85%, at least 90%, at least 95%, at least 98%, at least 99%, or 100%, amino acid sequence identity to the amino acid sequence set forth in SEQ ID NOs: 111, 5031, 5032 or 5033. In some cases, the SLC10A4 polypeptide comprises an amino acid sequence having at least 85%, at least 90%, at least 95%, at least 98%, at least 99%, or 100%, amino acid sequence identity to the amino acid sequence set forth in SEQ ID NO: 6095.

In some cases, an antigen combination for targeting a neuroblastoma cell comprises ST8SIA2 AND NOT WT1. In some cases, the WT1 polypeptide comprises an amino acid sequence having at least 85%, at least 90%, at least 95%, at least 98%, at least 99%, or 100%, amino acid sequence identity to the amino acid sequence set forth in SEQ ID NOs: 111, 5031, 5032 or 5033. In some cases, the ST8SIA2 polypeptide comprises an amino acid sequence having at least 85%, at least 90%, at least 95%, at least 98%, at least 99%, or 100%, amino acid sequence identity to the amino acid sequence set forth in SEQ ID NO: 3413.

In some cases, an antigen combination for targeting a neuroblastoma cell comprises ST8SIA2 AND NOT FAP. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055. In some cases, the ST8SIA2 polypeptide comprises an amino acid sequence having at least 85%, at least 90%, at least 95%, at least 98%, at least 99%, or 100%, amino acid sequence identity to the amino acid sequence set forth in SEQ ID NO: 3413.

In some cases, an antigen combination for targeting a neuroblastoma cell comprises SLC10A4 AND NOT MAGEA1. In some cases, the MAGEA1 polypeptide comprises an amino acid sequence having at least 85%, at least 90%, at least 95%, at least 98%, at least 99%, or 100%, amino acid sequence identity to the amino acid sequence set forth in SEQ ID NO: 3191. In some cases, the SLC10A4 polypeptide comprises an amino acid sequence having at least 85%, at least 90%, at least 95%, at least 98%, at least 99%, or 100%, amino acid sequence identity to the amino acid sequence set forth in SEQ ID NO: 6095.

In some cases, an antigen combination for targeting a neuroblastoma cell comprises MARCH11 AND NOT MET. In some cases, the MARCH11 polypeptide comprises an amino acid sequence having at least 85%, at least 90%, at least 95%, at least 98%, at least 99%, or 100%, amino acid sequence identity to the amino acid sequence set forth in SEQ ID NO: 1209. In some cases, the MET polypeptide comprises an amino acid sequence having at least 85%, at least 90%, at least 95%, at least 98%, at least 99%, or 100%, amino acid sequence identity to the amino acid sequence set forth in SEQ ID NOs: 76 or 1332.

Additional examples of target antigen pairs for targeting a neuroblastoma cell are provided in FIG. 1 and FIG. 9-14.

Mantle Cell Lymphoma Target Antigen Combinations

In some cases, an antigen combination for targeting a mantle-cell lymphoma cell comprises CLECL1 AND NOT EPHA3. In some cases, the EPHA3 polypeptide comprises an amino acid sequence having at least 85%, at least 90%, at least 95%, at least 98%, at least 99%, or 100%, amino acid sequence identity to the amino acid sequence set forth in SEQ ID NOs: 3237 or 6669. In some cases, the CLECL1 polypeptide comprises an amino acid sequence having at least 85%, at least 90%, at least 95%, at least 98%, at least 99%, or 100%, amino acid sequence identity to the amino acid sequence set forth in SEQ ID NO: 6267.

In some cases, an antigen combination for targeting a mantle-cell lymphoma cell comprises CELSR1 AND NOT ERBB2. In some cases, the ERBB2 polypeptide comprises an amino acid sequence having at least 85%, at least 90%, at least 95%, at least 98%, at least 99%, or 100%, amino acid sequence identity to the amino acid sequence set forth in SEQ ID NOs: 474 or 3051. In some cases, the CELSR1 polypeptide comprises an amino acid sequence having at least 85%, at least 90%, at least 95%, at least 98%, at least 99%, or 100%, amino acid sequence identity to the amino acid sequence set forth in SEQ ID NO: 3895.

In some cases, an antigen combination for targeting a mantle-cell lymphoma cell comprises QSOX2 AND NOT ERBB2. In some cases, the ERBB2 polypeptide comprises an amino acid sequence having at least 85%, at least 90%, at least 95%, at least 98%, at least 99%, or 100%, amino acid sequence identity to the amino acid sequence set forth in SEQ ID NOs: 474 or 3051. In some cases, the QSOX2 polypeptide comprises an amino acid sequence having at least 85%, at least 90%, at least 95%, at least 98%, at least 99%, or 100%, amino acid sequence identity to the amino acid sequence set forth in SEQ ID NO: 6621.

In some cases, an antigen combination for targeting a mantle-cell lymphoma cell comprises CLECL1 AND NOT CD160. In some cases, the CD160 polypeptide comprises an amino acid sequence having at least 85%, at least 90%, at least 95%, at least 98%, at least 99%, or 100%, amino acid sequence identity to the amino acid sequence set forth in SEQ ID NO: 3624. In some cases, the CLECL1 polypeptide comprises an amino acid sequence having at least 85%, at least 90%, at least 95%, at least 98%, at least 99%, or 100%, amino acid sequence identity to the amino acid sequence set forth in SEQ ID NO: 6267.

In some cases, an antigen combination for targeting a mantle-cell lymphoma cell comprises CELSR1 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the CELSR1 polypeptide comprises an amino acid sequence having at least 85%, at least 90%, at least 95%, at least 98%, at least 99%, or 100%, amino acid sequence identity to the amino acid sequence set forth in SEQ ID NO: 3895.

In some cases, an antigen combination for targeting a mantle-cell lymphoma cell comprises TNFRSF13C AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the TNFRSF13C polypeptide comprises an amino acid sequence having at least 85%, at least 90%, at least 95%, at least 98%, at least 99%, or 100%, amino acid sequence identity to the amino acid sequence set forth in SEQ ID NO: 5547.

In some cases, an antigen combination for targeting a mantle-cell lymphoma cell comprises CELSR1 AND NOT ERBB3. In some cases, the ERBB3 polypeptide comprises an amino acid sequence having at least 85%, at least 90%, at least 95%, at least 98%, at least 99%, or 100%, amino acid sequence identity to the amino acid sequence set forth in SEQ ID NOs: 476 or 2517. In some cases, the CELSR1 polypeptide comprises an amino acid sequence having at least 85%, at least 90%, at least 95%, at least 98%, at least 99%, or 100%, amino acid sequence identity to the amino acid sequence set forth in SEQ ID NO: 3895.

In some cases, an antigen combination for targeting a mantle-cell lymphoma cell comprises TNFRSF13C AND NOT FAP. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055. In some cases, the TNFRSF13C polypeptide comprises an amino acid sequence having at least 85%, at least 90%, at least 95%, at least 98%, at least 99%, or 100%, amino acid sequence identity to the amino acid sequence set forth in SEQ ID NO: 5547.

In some cases, an antigen combination for targeting a mantle-cell lymphoma cell comprises SNN AND NOT NCAM1. In some cases, the NCAM1 polypeptide comprises an amino acid sequence having at least 85%, at least 90%, at least 95%, at least 98%, at least 99%, or 100%, amino acid sequence identity to the amino acid sequence set forth in SEQ ID NOs: 173, 949 or 6595. In some cases, the SNN polypeptide comprises an amino acid sequence having at least 85%, at least 90%, at least 95%, at least 98%, at least 99%, or 100%, amino acid sequence identity to the amino acid sequence set forth in SEQ ID NO: 2843.

In some cases, an antigen combination for targeting a mantle-cell lymphoma cell comprises TNFRSF10A AND NOT NCAM1. In some cases, the NCAM1 polypeptide comprises an amino acid sequence having at least 85%, at least 90%, at least 95%, at least 98%, at least 99%, or 100%, amino acid sequence identity to the amino acid sequence set forth in SEQ ID NOs: 173, 949 or 6595. In some cases, the TNFRSF10A polypeptide comprises an amino acid sequence having at least 85%, at least 90%, at least 95%, at least 98%, at least 99%, or 100%, amino acid sequence identity to the amino acid sequence set forth in SEQ ID NO: 2911.

Additional examples of target antigen pairs for targeting a mantle cell lymphoma are provided in FIG. 1 and FIG. 9-14.

Sarcoma Target Antigen Combinations

In some cases, an antigen combination for targeting a sarcoma cell comprises ADAM12 AND NOT ERBB4. In some cases, the ERBB4 polypeptide comprises an amino acid sequence having at least 85%, at least 90%, at least 95%, at least 98%, at least 99%, or 100%, amino acid sequence identity to the amino acid sequence set forth in SEQ ID NOs: 914 or 3238. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a sarcoma cell comprises AXL AND NOT ST6GALNAC2. In some cases, the ST6GALNAC2 polypeptide comprises an amino acid sequence having at least 85%, at least 90%, at least 95%, at least 98%, at least 99%, or 100%, amino acid sequence identity to the amino acid sequence set forth in SEQ ID NO: 3493. In some cases, the AXL polypeptide comprises an amino acid sequence having at least 85%, at least 90%, at least 95%, at least 98%, at least 99%, or 100%, amino acid sequence identity to the amino acid sequence set forth in SEQ ID NOs: 2438 or 4847.

In some cases, an antigen combination for targeting a sarcoma cell comprises ADAM12 AND NOT ERBB3. In some cases, the ERBB3 polypeptide comprises an amino acid sequence having at least 85%, at least 90%, at least 95%, at least 98%, at least 99%, or 100%, amino acid sequence identity to the amino acid sequence set forth in SEQ ID NOs: 476 or 2517. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a sarcoma cell comprises ADAM12 AND NOT NAALAD2. In some cases, the NAALAD2 polypeptide comprises an amino acid sequence having at least 85%, at least 90%, at least 95%, at least 98%, at least 99%, or 100%, amino acid sequence identity to the amino acid sequence set forth in SEQ ID NO: 3289. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a sarcoma cell comprises TRAM2 AND NOT TMEM265. In some cases, the TMEM265 polypeptide comprises an amino acid sequence having at least 85%, at least 90%, at least 95%, at least 98%, at least 99%, or 100%, amino acid sequence identity to the amino acid sequence set forth in SEQ ID NO: 7113. In some cases, the TRAM2 polypeptide comprises an amino acid sequence having at least 85%, at least 90%, at least 95%, at least 98%, at least 99%, or 100%, amino acid sequence identity to the amino acid sequence set forth in SEQ ID NO: 3738.

In some cases, an antigen combination for targeting a sarcoma cell comprises ADAM12 AND NOT PDZK1IP1. In some cases, the PDZK1IP1 polypeptide comprises an amino acid sequence having at least 85%, at least 90%, at least 95%, at least 98%, at least 99%, or 100%, amino acid sequence identity to the amino acid sequence set forth in SEQ ID NO: 3359. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a sarcoma cell comprises TRAM2 AND NOT LPCAT3. In some cases, the LPCAT3 polypeptide comprises an amino acid sequence having at least 85%, at least 90%, at least 95%, at least 98%, at least 99%, or 100%, amino acid sequence identity to the amino acid sequence set forth in SEQ ID NO: 3362. In some cases, the TRAM2 polypeptide comprises an amino acid sequence having at least 85%, at least 90%, at least 95%, at least 98%, at least 99%, or 100%, amino acid sequence identity to the amino acid sequence set forth in SEQ ID NO: 3738.

In some cases, an antigen combination for targeting a sarcoma cell comprises CD163L1 AND NOT PRSS16. In some cases, the PRSS16 polypeptide comprises an amino acid sequence having at least 85%, at least 90%, at least 95%, at least 98%, at least 99%, or 100%, amino acid sequence identity to the amino acid sequence set forth in SEQ ID NO: 3389. In some cases, the CD163L1 polypeptide comprises an amino acid sequence having at least 85%, at least 90%, at least 95%, at least 98%, at least 99%, or 100%, amino acid sequence identity to the amino acid sequence set forth in SEQ ID NO: 6416.

In some cases, an antigen combination for targeting a sarcoma cell comprises ADAM12 AND NOT PRSS16. In some cases, the PRSS16 polypeptide comprises an amino acid sequence having at least 85%, at least 90%, at least 95%, at least 98%, at least 99%, or 100%, amino acid sequence identity to the amino acid sequence set forth in SEQ ID NO: 3389. In some cases, the ADAM12 polypeptide comprises an amino acid sequence having at least 85%, at least 90%, at least 95%, at least 98%, at least 99%, or 100%, amino acid sequence identity to the amino acid sequence set forth in SEQ ID NOs: 2839 or 4815.

In some cases, an antigen combination for targeting a sarcoma cell comprises TRAM2 AND NOT PRSS16. In some cases, the PRSS16 polypeptide comprises an amino acid sequence having at least 85%, at least 90%, at least 95%, at least 98%, at least 99%, or 100%, amino acid sequence identity to the amino acid sequence set forth in SEQ ID NO: 3389. In some cases, the TRAM2 polypeptide comprises an amino acid sequence having at least 85%, at least 90%, at least 95%, at least 98%, at least 99%, or 100%, amino acid sequence identity to the amino acid sequence set forth in SEQ ID NO: 3738.

Additional examples of target antigen pairs for targeting a sarcoma cell are provided in FIG. 1 and FIG. 9-14.

Non-Small Cell Lung Cancer Target Antigen Combinations

In some cases, an antigen combination for targeting a non-small cell lung cancer cell comprises FAP AND NOT LRRN4CL. In some cases, the LRRN4CL polypeptide comprises an amino acid sequence having at least 85%, at least 90%, at least 95%, at least 98%, at least 99%, or 100%, amino acid sequence identity to the amino acid sequence set forth in SEQ ID NO: 6935. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT GALNT16. In some cases, the GALNT16 polypeptide comprises an amino acid sequence having at least 85%, at least 90%, at least 95%, at least 98%, at least 99%, or 100%, amino acid sequence identity to the amino acid sequence set forth in SEQ ID NOs: 2226 or 4700. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT PTGFR. In some cases, the PTGFR polypeptide comprises an amino acid sequence having at least 85%, at least 90%, at least 95%, at least 98%, at least 99%, or 100%, amino acid sequence identity to the amino acid sequence set forth in SEQ ID NOs 346 or 804. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT LCAT. In some cases, the LCAT polypeptide comprises an amino acid sequence having at least 85%, at least 90%, at least 95%, at least 98%, at least 99%, or 100%, amino acid sequence identity to the amino acid sequence set forth in SEQ ID NO: 71. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT SFRP1. In some cases, the SFRP1 polypeptide comprises an amino acid sequence having at least 85%, at least 90%, at least 95%, at least 98%, at least 99%, or 100%, amino acid sequence identity to the amino acid sequence set forth in SEQ ID NO: 2753. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT ITGA7. In some cases, the ITGA7 polypeptide comprises an amino acid sequence having at least 85%, at least 90%, at least 95%, at least 98%, at least 99%, or 100%, amino acid sequence identity to the amino acid sequence set forth in SEQ ID NOs: 1800, 1801 or 2576. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT ABCB1. In some cases, the ABCB1 polypeptide comprises an amino acid sequence having at least 85%, at least 90%, at least 95%, at least 98%, at least 99%, or 100%, amino acid sequence identity to the amino acid sequence set forth in SEQ ID NO: 331. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT RECK. In some cases, the RECK polypeptide comprises an amino acid sequence having at least 85%, at least 90%, at least 95%, at least 98%, at least 99%, or 100%, amino acid sequence identity to the amino acid sequence set forth in SEQ ID NO: 4774. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT ENPP1. In some cases, the ENPP1 polypeptide comprises an amino acid sequence having at least 85%, at least 90%, at least 95%, at least 98%, at least 99%, or 100%, amino acid sequence identity to the amino acid sequence set forth in SEQ ID NO: 3456. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

In some cases, an antigen combination for targeting a non-small-cell lung cancer cell comprises FAP AND NOT TGFBR3. In some cases, the TGFBR3 polypeptide comprises an amino acid sequence having at least 85%, at least 90%, at least 95%, at least 98%, at least 99%, or 100%, amino acid sequence identity to the amino acid sequence set forth in SEQ ID NO: 2803. In some cases, the FAP polypeptide comprises an amino acid sequence having at least 85%, at least 90%, at least 95%, at least 98%, at least 99%, or 100%, amino acid sequence identity to the amino acid sequence set forth in SEQ ID NO: 3055.

Additional examples of target antigen pairs for targeting a non-small-cell lung cancer cell are provided in FIG. 1 and FIG. 9-14.

Acute Myeloid Leukemia (AML) Target Antigen Combinations

In some cases, an antigen combination for targeting an acute myeloid leukemia cell comprises SLC22A16 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the SLC22A16 polypeptide comprises an amino acid sequence having at least 85%, at least 90%, at least 95%, at least 98%, at least 99%, or 100%, amino acid sequence identity to the amino acid sequence set forth in SEQ ID NO: 5452.

In some cases, an antigen combination for targeting an acute myeloid leukemia cell comprises FUT4 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the FUT4 polypeptide comprises an amino acid sequence having at least 85%, at least 90%, at least 95%, at least 98%, at least 99%, or 100%, amino acid sequence identity to the amino acid sequence set forth in SEQ ID NO: 2534.

In some cases, an antigen combination for targeting an acute myeloid leukemia cell comprises ELANE AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the ELANE polypeptide comprises an amino acid sequence having at least 85%, at least 90%, at least 95%, at least 98%, at least 99%, or 100%, amino acid sequence identity to the amino acid sequence set forth in SEQ ID NO: 2513.

In some cases, an antigen combination for targeting an acute myeloid leukemia cell comprises MS4A3 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the MS4A3 polypeptide comprises an amino acid sequence having at least 85%, at least 90%, at least 95%, at least 98%, at least 99%, or 100%, amino acid sequence identity to the amino acid sequence set forth in SEQ ID NO: 721, 735 or 3443.

In some cases, an antigen combination for targeting an acute myeloid leukemia cell comprises TMC8 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the TMC8 polypeptide comprises an amino acid sequence having at least 85%, at least 90%, at least 95%, at least 98%, at least 99%, or 100%, amino acid sequence identity to the amino acid sequence set forth in SEQ ID NO: 6065.

In some cases, an antigen combination for targeting an acute myeloid leukemia cell comprises NOT PFN2 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the PFN2 polypeptide comprises an amino acid sequence having at least 85%, at least 90%, at least 95%, at least 98%, at least 99%, or 100%, amino acid sequence identity to the amino acid sequence set forth in SEQ ID NOs: 2695 or 5556.

In some cases, an antigen combination for targeting an acute myeloid leukemia cell comprises CD33 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the CD33 polypeptide comprises an amino acid sequence having at least 85%, at least 90%, at least 95%, at least 98%, at least 99%, or 100%, amino acid sequence identity to the amino acid sequence set forth in SEQ ID NOs: 1062 or 2462.

In some cases, an antigen combination for targeting an acute myeloid leukemia cell comprises FUT4 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the FUT4 polypeptide comprises an amino acid sequence having at least 85%, at least 90%, at least 95%, at least 98%, at least 99%, or 100%, amino acid sequence identity to the amino acid sequence set forth in SEQ ID NO: 2534.

In some cases, an antigen combination for targeting an acute myeloid leukemia cell comprises NRROS AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the NRROS polypeptide comprises an amino acid sequence having at least 85%, at least 90%, at least 95%, at least 98%, at least 99%, or 100%, amino acid sequence identity to the amino acid sequence set forth in SEQ ID NO: 6817.

In some cases, an antigen combination for targeting an acute myeloid leukemia cell comprises FUT4 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the FUT4 polypeptide comprises an amino acid sequence having at least 85%, at least 90%, at least 95%, at least 98%, at least 99%, or 100%, amino acid sequence identity to the amino acid sequence set forth in SEQ ID NO: 2534.

Additional examples of target antigen pairs for targeting an AML cell are provided in FIG. 1 and FIG. 9-14.

Stomach Cancer Target Antigen Combinations

In some cases, an antigen combination for targeting a stomach cancer cell comprises MUC13 AND NOT SLC30A10. In some cases, the SLC30A10 polypeptide comprises an amino acid sequence having at least 85%, at least 90%, at least 95%, at least 98%, at least 99%, or 100%, amino acid sequence identity to the amino acid sequence set forth in SEQ ID NO: 4487. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND NOT SCNN1B. In some cases, the SCNN1B polypeptide comprises an amino acid sequence having at least 85%, at least 90%, at least 95%, at least 98%, at least 99%, or 100%, amino acid sequence identity to the amino acid sequence set forth in SEQ ID NO: 96. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND APOLD1. In some cases, the APOLD1 polypeptide comprises an amino acid sequence having at least 85%, at least 90%, at least 95%, at least 98%, at least 99%, or 100%, amino acid sequence identity to the amino acid sequence set forth in SEQ ID NOs: 1423 or 5181. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND GREM1. In some cases, the GREM1 polypeptide comprises an amino acid sequence having at least 85%, at least 90%, at least 95%, at least 98%, at least 99%, or 100%, amino acid sequence identity to the amino acid sequence set forth in SEQ ID NO: 3812. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND NOT DHRS9. In some cases, the DHRS9 polypeptide comprises an amino acid sequence having at least 85%, at least 90%, at least 95%, at least 98%, at least 99%, or 100%, amino acid sequence identity to the amino acid sequence set forth in SEQ ID NOs: 1628, 1629, 3364 or 6865. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND NOT TRPM6. In some cases, the TRPM6 polypeptide comprises an amino acid sequence having at least 85%, at least 90%, at least 95%, at least 98%, at least 99%, or 100%, amino acid sequence identity to the amino acid sequence set forth in SEQ ID NO: 4319. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND NOT CLDN8. In some cases, the CLDN8 polypeptide comprises an amino acid sequence having at least 85%, at least 90%, at least 95%, at least 98%, at least 99%, or 100%, amino acid sequence identity to the amino acid sequence set forth in SEQ ID NO: 6874. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND NOT SLC26A2. In some cases, the SLC26A2 polypeptide comprises an amino acid sequence having at least 85%, at least 90%, at least 95%, at least 98%, at least 99%, or 100%, amino acid sequence identity to the amino acid sequence set forth in SEQ ID NO: 32. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises MUC13 AND NOT CWH43. In some cases, the CWH43 polypeptide comprises an amino acid sequence having at least 85%, at least 90%, at least 95%, at least 98%, at least 99%, or 100%, amino acid sequence identity to the amino acid sequence set forth in SEQ ID NO: 5119. In some cases, the MUC13 polypeptide comprises an amino acid sequence having at least 85%, at least 90%, at least 95%, at least 98%, at least 99%, or 100%, amino acid sequence identity to the amino acid sequence set forth in SEQ ID NO: 5442.

In some cases, an antigen combination for targeting a stomach cancer cell comprises GREM1 AND TNFRSF10B. In some cases, the TNFRSF10B polypeptide comprises an amino acid sequence having at least 85%, at least 90%, at least 95%, at least 98%, at least 99%, or 100%, amino acid sequence identity to the amino acid sequence set forth in SEQ ID NO: 2910 or 5994. In some cases, the GREM1 polypeptide comprises an amino acid sequence having at least 85%, at least 90%, at least 95%, at least 98%, at least 99%, or 100%, amino acid sequence identity to the amino acid sequence set forth in SEQ ID NO: 3812.

Additional examples of target antigen pairs for targeting a stomach cancer cell are provided in FIG. 1 and FIG. 9-14.

Diffuse Large B-Cell Lymphoma Target Antigen Combinations

In some cases, an antigen combination for targeting a diffuse large B-cell lymphoma cell comprises PLA2G2D AND NOT GABRD. In some cases, the GABRD polypeptide comprises an amino acid sequence having at least 85%, at least 90%, at least 95%, at least 98%, at least 99%, or 100%, amino acid sequence identity to the amino acid sequence set forth in SEQ ID NO: 271. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT BMPR1B. In some cases, the BMPR1B polypeptide comprises an amino acid sequence having at least 85%, at least 90%, at least 95%, at least 98%, at least 99%, or 100%, amino acid sequence identity to the amino acid sequence set forth in SEQ ID NO: 2315. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT CRYGC. In some cases, the CRYGC polypeptide comprises an amino acid sequence having at least 85%, at least 90%, at least 95%, at least 98%, at least 99%, or 100%, amino acid sequence identity to the amino acid sequence set forth in SEQ ID NO: 4754. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768/

In some cases, an antigen combination for targeting a diffuse large B-cell lymphoma cell comprises PLA2G2D AND NOT HCN4. In some cases, the HCN4 polypeptide comprises an amino acid sequence having at least 85%, at least 90%, at least 95%, at least 98%, at least 99%, or 100%, amino acid sequence identity to the amino acid sequence set forth in SEQ ID NO: 3292. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT SLC17A4. In some cases, the SLC17A4 polypeptide comprises an amino acid sequence having at least 85%, at least 90%, at least 95%, at least 98%, at least 99%, or 100%, amino acid sequence identity to the amino acid sequence set forth in SEQ ID NO: 3294. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT CDH7. In some cases, the CDH7 polypeptide comprises an amino acid sequence having at least 85%, at least 90%, at least 95%, at least 98%, at least 99%, or 100%, amino acid sequence identity to the amino acid sequence set forth in SEQ ID NOs: 3031 or 5510. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT CDH12. In some cases, the CDH12 polypeptide comprises an amino acid sequence having at least 85%, at least 90%, at least 95%, at least 98%, at least 99%, or 100%, amino acid sequence identity to the amino acid sequence set forth in SEQ ID NO: 2955. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT CLEC3A. In some cases, the CLEC3A polypeptide comprises an amino acid sequence having at least 85%, at least 90%, at least 95%, at least 98%, at least 99%, or 100%, amino acid sequence identity to the amino acid sequence set forth in SEQ ID NO: 3356. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT PDZK1IP1. In some cases, the PDZK1IP1 polypeptide comprises an amino acid sequence having at least 85%, at least 90%, at least 95%, at least 98%, at least 99%, or 100%, amino acid sequence identity to the amino acid sequence set forth in SEQ ID NO: 3359. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

In some cases, an antigen combination for targeting a diffuse large B-cell lymphoma cell comprises PLA2G2D AND NOT TENM1. In some cases, the TENM1 polypeptide comprises an amino acid sequence having at least 85%, at least 90%, at least 95%, at least 98%, at least 99%, or 100%, amino acid sequence identity to the amino acid sequence set forth in SEQ ID NOs: 2049, 2050 or 3896. In some cases, the PLA2G2D polypeptide comprises an amino acid sequence having at least 85%, at least 90%, at least 95%, at least 98%, at least 99%, or 100%, amino acid sequence identity to the amino acid sequence set forth in SEQ ID NO: 3768.

Additional examples of target antigen pairs for targeting a diffuse large B-cell lymphoma are provided in FIG. 1 and FIG. 9-14.

Lung Cancer (e.g., Lung Adenocarcinoma) Target Antigen Combinations

In some cases, an antigen combination for targeting a lung cancer cell comprises SFTPD AND NOT IL3RA. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the IL3RA polypeptide comprises an amino acid sequence having at least 85%, at least 90%, at least 95%, at least 98%, at least 99%, or 100%, amino acid sequence identity to the amino acid sequence set forth in SEQ ID NO: 2567.

In some cases, an antigen combination for targeting a lung cancer cell comprises SFTPD AND NOT CDH5. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the CDH5 polypeptide comprises an amino acid sequence having at least 85%, at least 90%, at least 95%, at least 98%, at least 99%, or 100%, amino acid sequence identity to the amino acid sequence set forth in SEQ ID NO: 2475.

In some cases, an antigen combination for targeting a lung cancer cell comprises SFTPC AND NOT RAMP2. In some cases, the SFTPC polypeptide comprises an amino acid sequence having at least 85%, at least 90%, at least 95%, at least 98%, at least 99%, or 100%, amino acid sequence identity to the amino acid sequence set forth in SEQ ID NO: 2754. In some cases, the RAMP2 polypeptide comprises an amino acid sequence having at least 85%, at least 90%, at least 95%, at least 98%, at least 99%, or 100%, amino acid sequence identity to the amino acid sequence set forth in SEQ ID NO: 3385.

In some cases, an antigen combination for targeting a lung cancer cell comprises SFTPD AND NOT RAMP2. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the RAMP2 polypeptide comprises an amino acid sequence having at least 85%, at least 90%, at least 95%, at least 98%, at least 99%, or 100%, amino acid sequence identity to the amino acid sequence set forth in SEQ ID NO: 3385.

In some cases, an antigen combination for targeting a lung cancer cell comprises SFTPD AND NOT SIRPB1. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the SIRPB1 polypeptide comprises an amino acid sequence having at least 85%, at least 90%, at least 95%, at least 98%, at least 99%, or 100%, amino acid sequence identity to the amino acid sequence set forth in SEQ ID NO: 1082, 1573 or 3426.

In some cases, an antigen combination for targeting a lung cancer cell comprises SFTPD AND NOT ABCA8. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the ABCA8 polypeptide comprises an amino acid sequence having at least 85%, at least 90%, at least 95%, at least 98%, at least 99%, or 100%, amino acid sequence identity to the amino acid sequence set forth in SEQ ID NO: 3640.

In some cases, an antigen combination for targeting a lung cancer cell comprises SLC34A2 AND NOT DLL1. In some cases, the DLL1 polypeptide comprises an amino acid sequence having at least 85%, at least 90%, at least 95%, at least 98%, at least 99%, or 100%, amino acid sequence identity to the amino acid sequence set forth in SEQ ID NO: 3326. In some cases, the SLC34A2 polypeptide comprises an amino acid sequence having at least 85%, at least 90%, at least 95%, at least 98%, at least 99%, or 100%, amino acid sequence identity to the amino acid sequence set forth in SEQ ID NO: 3490.

In some cases, an antigen combination for targeting a lung cancer cell comprises SFTPC AND NOT LYVE1. In some cases, the LYVE1 polypeptide comprises an amino acid sequence having at least 85%, at least 90%, at least 95%, at least 98%, at least 99%, or 100%, amino acid sequence identity to the amino acid sequence set forth in SEQ ID NO: 3547. In some cases, the SFTPC polypeptide comprises an amino acid sequence having at least 85%, at least 90%, at least 95%, at least 98%, at least 99%, or 100%, amino acid sequence identity to the amino acid sequence set forth in SEQ ID NO: 2754.

In some cases, an antigen combination for targeting a lung cancer cell comprises SFTPD AND NOT LYVE1. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the LYVE1 polypeptide comprises an amino acid sequence having at least 85%, at least 90%, at least 95%, at least 98%, at least 99%, or 100%, amino acid sequence identity to the amino acid sequence set forth in SEQ ID NO: 3547.

In some cases, an antigen combination for targeting a lung cancer cell comprises SFTPD AND NOT PNPLA6. In some cases, the SFTPD polypeptide comprises an amino acid sequence having at least 85%, at least 90%, at least 95%, at least 98%, at least 99%, or 100%, amino acid sequence identity to the amino acid sequence set forth in SEQ ID NO: 2755. In some cases, the PNPLA6 polypeptide comprises an amino acid sequence having at least 85%, at least 90%, at least 95%, at least 98%, at least 99%, or 100%, amino acid sequence identity to the amino acid sequence set forth in SEQ ID NOs: 2146, 2147, 2148, 2149 or 3551.

Additional examples of target antigen pairs for targeting a lung cancer cell are provided in FIG. 1 and FIG. 9-14.

Oligodendroglioma Target Antigen Combinations

In some cases, an antigen combination for targeting an oligodendroglioma cell comprises NLGN3 AND NOT FOLR2. In some cases, the FOLR2 polypeptide comprises an amino acid sequence having at least 85%, at least 90%, at least 95%, at least 98%, at least 99%, or 100%, amino acid sequence identity to the amino acid sequence set forth in SEQ ID NOs: 261, 1261, 1262 or 1263. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT SLAMF7. In some cases, the SLAMF7 polypeptide comprises an amino acid sequence having at least 85%, at least 90%, at least 95%, at least 98%, at least 99%, or 100%, amino acid sequence identity to the amino acid sequence set forth in SEQ ID NO: 4788. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT SDC1. In some cases, the SDC1 polypeptide comprises an amino acid sequence having at least 85%, at least 90%, at least 95%, at least 98%, at least 99%, or 100%, amino acid sequence identity to the amino acid sequence set forth in SEQ ID NOs: 496 or 2747. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT TNFRSF8. In some cases, the TNFRSF8 polypeptide comprises an amino acid sequence having at least 85%, at least 90%, at least 95%, at least 98%, at least 99%, or 100%, amino acid sequence identity to the amino acid sequence set forth in SEQ ID NOs: 2323 or 6140. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT IL11RA. In some cases, the IL11RA polypeptide comprises an amino acid sequence having at least 85%, at least 90%, at least 95%, at least 98%, at least 99%, or 100%, amino acid sequence identity to the amino acid sequence set forth in SEQ ID NOs: 1701, 3066 or 5993. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT MUC1. In some cases, the MUC1 polypeptide comprises an amino acid sequence having at least 85%, at least 90%, at least 95%, at least 98%, at least 99%, or 100%, amino acid sequence identity to the amino acid sequence set forth in SEQ ID NOs: 661, 662, 922, 923, 924, 925 or 2657. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT KDR. In some cases, the KDR polypeptide comprises an amino acid sequence having at least 85%, at least 90%, at least 95%, at least 98%, at least 99%, or 100%, amino acid sequence identity to the amino acid sequence set forth in SEQ ID NO: 2607. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT IGF1R. In some cases, the IGF1R polypeptide comprises an amino acid sequence having at least 85%, at least 90%, at least 95%, at least 98%, at least 99%, or 100%, amino acid sequence identity to the amino acid sequence set forth in SEQ ID NO: 308. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT ALK. In some cases, the ALK polypeptide comprises an amino acid sequence having at least 85%, at least 90%, at least 95%, at least 98%, at least 99%, or 100%, amino acid sequence identity to the amino acid sequence set forth in SEQ ID NO: 3013. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

In some cases, an antigen combination for targeting an oligodendroglioma cell comprises NLGN3 AND NOT ERBB3. In some cases, the ERBB3 polypeptide comprises an amino acid sequence having at least 85%, at least 90%, at least 95%, at least 98%, at least 99%, or 100%, amino acid sequence identity to the amino acid sequence set forth in SEQ ID NOs: 476 or 2517. In some cases, the NLGN3 polypeptide comprises an amino acid sequence having at least 85%, at least 90%, at least 95%, at least 98%, at least 99%, or 100%, amino acid sequence identity to the amino acid sequence set forth in SEQ ID NOs: 2174, 4543 or 6589.

Additional examples of target antigen pairs for targeting an oligodendroglioma cell are provided in FIG. 1 and FIG. 9-14.

Other Antigen Combinations

In some cases, an antigen combination may be selected for targeting a cancer where two antigens of the combination are "clinical antigens" (i.e., the antigen has been evaluated clinically (i.e., in an immunotherapy clinical trial) and found to be a marker for one or more cancers). An antigen combination having two or more clinical antigens may include any clinical antigen including those described herein.

Combinations of clinical antigens include combinations where an antigen is highly expressed (H) in a target cancer, where an antigen is lowly expressed (L) in a target cancer, where two antigens are highly expressed (HH) in a target cancer, where two antigens are lowly expressed (LL) in a target cancer, where a first antigen is highly expressed and the second antigen is lowly expressed (HL) in a target cancer, where a first antigen is lowly expressed and the second antigen is highly expressed (LH) in a target cancer, where two antigens are expressed (i.e., an "OR" gate) in a target cancer.

For example, in some instances, the following clinical-clinical antigen pairs may be employed in a subject antigen combination, alone or in combination with other antigens, where the pair is listed with one or more non-limiting exemplary cancers and an exemplary expression or gating structure as defined above: MLANA:PMEL (Melanoma; H), MLANA:B4GALNT1 (Melanoma; OR), MLANA:KDR (Melanoma; HL), EPCAM:MET (Breast; HL), MSLN:EP-CAM (Breast; HL), IL3RA:CD33 (Leukemia, Myeloid, Acute; HH), EPCAM:TYR (Breast; HL), EPCAM:ROR1 (Breast; HH), CD19:MS4A1 (Lymphoma, Large B-Cell, Diffuse; OR), ERBB2:ROR1 (Breast; HL), ERBB2:TYR (Breast; HL), ERBB2:EPCAM (Breast; HH), MSLN: ERBB2 (Lung Adenocarcinoma; HL), MSLN:MUC1 (Lung Adenocarcinoma; H), ERBB2:MUC1 (Lung Adenocarcinoma; HL), ERBB2:MET (Breast; HL), MSLN:GPC3 (Colon; LH), EPHA2:ERBB2 (Glioma; LH), EPHA2:MUC1 (Glioma; LH), MUC1:ROR1 (Lung Carcinoma; LH), GPC3:MUC1 (Colon; LH), ERBB2:GPC3 (Colon; LH), CD19:CD22 (Lymphoma, Large B-Cell, Diffuse; HL), ROR1:TYR (Breast; LH), MS4A1:CD22 (Lymphoma, Large B-Cell, Diffuse; HL), MSLN:ERBB2 (Carcinoma, Pancreatic Ductal; HL), MET:ROR1 (Breast; LH), MET: TYR (Breast; LH), MSLN:ROR1 (Breast; HL), MSLN: TYR (Breast; HL), MUC1:TNFRSF10A (Lung Carcinoma; OR), MSLN:MET (Breast; HL), ROR1:TNFRSF10A (Lung Carcinoma; LH), MSLN:ERBB2 (Lung Carcinoma; HL), MSLN:GPC3 (Lung Carcinoma; LH), MSLN:MUC1 (Lung Carcinoma; LH), MSLN:ROR1 (Lung Carcinoma; LH), MSLN:TYR (Lung Carcinoma; LH), MSLN:TNFRSF10A (Lung Carcinoma; LH), ERBB2:GPC3 (Lung Carcinoma; -), ERBB2:MUC1 (Lung Carcinoma; LH), ERBB2:ROR1 (Lung Carcinoma; LH), GPC3:MUC1 (Lung Carcinoma; LH), GPC3:ROR1 (Lung Carcinoma; LH), GPC3:TYR (Lung Carcinoma; LH), GPC3:TNFRSF10A (Lung Carcinoma; LH), MUC1:TYR (Lung Carcinoma; LH), ROR1:TYR (Lung Carcinoma; LH), TYR: TNFRSF10A (Lung Carcinoma; LH), MSLN:ERBB2 (Ovarian Neoplasms, Cystadenocarcinoma, Adenocarcinoma; HL), Flt3:CD123 (acute myeloid leukemia; HH), Flt3:CD33 (acute myeloid leukemia; HH) and GPC3:AFP (hepatocellular carcinoma; HH).

In some cases, useful clinical-clinical antigen pairs may include Flt3:CD123, for example as an AND-gate. In some instances, Flt3:CD123 may find use in targeting acute myeloid leukemia. In some cases, useful clinical-clinical antigen pairs may include Flt3:CD33, for example as an AND-gate. In some instances, Flt3:CD33 may find use in targeting acute myeloid leukemia. In some cases, useful clinical-clinical antigen pairs may include GPC3:AFP, for example as an AND-gate. In some instances, GPC3:AFP may find use in targeting hepatocellular carcinoma.

In some cases, an antigen combination may include one or more antigens of interest, where an "antigen of interest" may include clinical antigens as well as antigens that are of clinical interest for reasons other than having been identified as associated with a particular cancer type. Such other reasons include but are not limited to e.g., association with cancer stem cells (i.e., a cancer stem cell marker). Antigens of interest that may be included in antigen combinations include, e.g., those listed in Table 3 below.

TABLE 3

| | | |
|---|---|---|
| ALK (SEQ ID NO: 3013) | ULBP2 (SEQ ID NO: 5133) | CLDN1 (SEQ ID NO: 4771) |
| AXL (SEQ ID NO: 2438) | ULBP3 (SEQ ID NO: 7298) | CLDN10 (SEQ ID NO: 1975) |
| CD276 (SEQ ID NO: 685) | RAET1E (SEQ ID NO: 5840) | CLDN11 (SEQ ID NO: 3322) |
| NCR3LG1 (SEQ ID NO: 7428) | RAET1G (SEQ ID NO: 7369) | CLDN12 (SEQ ID NO: 3711) |
| TNFRSF17 (SEQ ID NO: 2312) | RAET1L (SEQ ID NO: 7368) | CLDN14 (SEQ ID NO: 1902) |
| CA9 (SEQ ID NO: 2318) | CD34 (SEQ ID NO: 697) | CLDN15 (SEQ ID NO: 3920) |
| IL3RA (SEQ ID NO: 2567) | ALDH1A1 (SEQ ID NO: 7313) | CLDN16 (SEQ ID NO: 3520) |
| SDC1 (SEQ ID NO: 496) | PROM1 (SEQ ID NO: 1878) | CLDN17 (SEQ ID NO: 3713) |

TABLE 3-continued

| | | |
|---|---|---|
| CD160 (SEQ ID NO: 3624) | FLOT2 (SEQ ID NO: 7359) | CLDN18 (SEQ ID NO: 387) |
| L1CAM (SEQ ID NO: 126) | CD24 (SEQ ID NO: 7446) | CLDN19 (SEQ ID NO: 1296) |
| CD19 (SEQ ID NO: 2460) | CBX3 (SEQ ID NO: 7304) | CLDN2 (SEQ ID NO: 2267) |
| MS4A1 (SEQ ID NO: 4853) | ABCA5 (SEQ ID NO: 4483) | CLDN20 (SEQ ID NO: 7334) |
| CD22 (SEQ ID NO: 2461) | ABCB5 (SEQ ID NO: 7412) | CLDN24 (SEQ ID NO: 7422) |
| TNFRSF8 (SEQ ID NO: 2323) | IGB1 (SEQ ID NO: 7309) | CLDN22 (SEQ ID NO: 7381) |
| CD33 (SEQ ID NO: 1062) | LGR5 (SEQ ID NO: 2866) | CLDN23 (SEQ ID NO: 6713) |
| CD38 (SEQ ID NO: 2465) | ALCAM (SEQ ID NO: 2420) | CLDN3 (SEQ ID NO: 2343) |
| CD44 (SEQ ID NO: 172) | THY1 (SEQ ID NO: 7454) | CLDN4 (SEQ ID NO: 2342) |
| CD70 (SEQ ID NO: 2331) | DNAJB8 (SEQ ID NO: 7318) | CLDN5 (SEQ ID NO: 1443) |
| SLAMF7 (SEQ ID NO: 4788) | DDX3X (SEQ ID NO: 7424) | CLDN6 (SEQ ID NO: 4792) |
| EPCAM (SEQ ID NO: 2632) | DLL3 (SEQ ID NO: 4275) | CLDN7 (SEQ ID NO: 2344) |
| EPHA2 (SEQ ID NO: 3042) | BMPR1B (SEQ ID NO: 2315) | CLDN8 (SEQ ID NO: 6874) |
| EPHA3 (SEQ ID NO: 3237) | SLC7A5 (SEQ ID NO: 7352) | CLDN9 (SEQ ID NO: 4752) |
| ERBB3 (SEQ ID NO: 476) | STEAP1 (SEQ ID NO: 3777) | CLEC14A (SEQ ID NO: 6440) |
| ERBB4 (SEQ ID NO: 914) | IL13RA (SEQ ID NO: 2415) | CTAG1A (SEQ ID NO: 7312) |
| FAP (SEQ ID NO: 3055) | SLC34A2 (SEQ ID NO: 3490) | CTAG2 (SEQ ID NO: 7442) |
| FOLR1 (SEQ ID NO: 260) | SEMA5B (SEQ ID NO: 7357) | DKK1 (SEQ ID NO: 7282) |
| FOLR2 (SEQ ID NO: 261) | GPR37L1 (SEQ ID NO: 3118) | DPEP1 (SEQ ID NO: 7391) |
| B4GALNT1 (SEQ ID NO: 2385) | RNF43 (SEQ ID NO: 4337) | EDNRB (SEQ ID NO: 33) |
| ST8SIA1 (SEQ ID NO: 2758) | STEAP2 (SEQ ID NO: 879) | EGFR (SEQ ID NO: 3235) |
| GPA33 (SEQ ID NO: 3374) | TRPM4 (SEQ ID NO: 4315) | ENG (SEQ ID NO: 35) |
| GPC3 (SEQ ID NO: 2089) | TDGF1 (SEQ ID NO: 7419) | ENPP3 (SEQ ID NO: 3199) |
| ERBB2 (SEQ ID NO: 474) | CR2 (SEQ ID NO: 493) | GAGE1 (SEQ ID NO: 7360) |
| CTAG1B (SEQ ID NO: 7258) | CD79B (SEQ ID NO: 178) | GPNMB (SEQ ID NO: 454) |
| CSPG4 (SEQ ID NO: 2497) | FCRL2 (SEQ ID NO: 5166) | GUCY2C (SEQ ID NO: 3179) |
| IGF1R (SEQ ID NO: 308) | CEACAM6 (SEQ ID NO: 7445) | HAVCR1 (SEQ ID NO: 7417) |
| IL11RA (SEQ ID NO: 1701) | IL20RA (SEQ ID NO: 3936) | HHLA2 (SEQ ID NO: 3626) |
| IL13RA2 (SEQ ID NO: 185) | BCAN (SEQ ID NO: 7332) | HSPA5 (SEQ ID NO: 7305) |
| IGK (SEQ ID NO: 7467) | EPHB2 (SEQ ID NO: 3047) | IL2RA (SEQ ID NO: 7271) |
| MAGEA1 (SEQ ID NO: 3191) | TNFRSF13C (SEQ ID NO: 5547) | ITGAV (SEQ ID NO: 1802) |
| MAGEA3 (SEQ ID NO: 7279) | CD74 (SEQ ID NO: 7351) | ITGB6 (SEQ ID NO: 313) |
| MLANA (SEQ ID NO: 3302) | CD79A (SEQ ID NO: 7257) | MAGEA11 (SEQ ID NO: 7346) |
| MSLN (SEQ ID NO: 3377) | CXCR5 (SEQ ID NO: 7256) | MAGEA4 (SEQ ID NO: 7341) |
| MET (SEQ ID NO: 76) | HLA-DOB (SEQ ID NO: 2555) | MOK (SEQ ID NO: 7436) |
| MUC13 (SEQ ID NO: 5442) | P2RX5 (SEQ ID NO: 2680) | MST1R (SEQ ID NO: 2656) |
| MUC17 (SEQ ID NO: 835) | CD72 (SEQ ID NO: 2470) | MUC4 (SEQ ID NO: 3070) |
| MUC1 (SEQ ID NO: 661) | CD180 (SEQ ID NO: 3318) | OAS1 (SEQ ID NO: 7354) |
| MUC16 (SEQ ID NO: 5067) | FCRL1 (SEQ ID NO: 1941) | PCYT1A (SEQ ID NO: 7455) |
| NCAM1 (SEQ ID NO: 173) | FCRL5 (SEQ ID NO: 5213) | PMEL (SEQ ID NO: 3597) |

TABLE 3-continued

| | | |
|---|---|---|
| PSCA (SEQ ID NO: 3340) | TMEFF2 (SEQ ID NO: 4183) | PRR4 (SEQ ID NO: 7429) |
| FOLH1 (SEQ ID NO: 631) | SST (SEQ ID NO: 7266) | PTK7 (SEQ ID NO: 2709) |
| TNFSF11 (SEQ ID NO: 2871) | SSTR2 (SEQ ID NO: 928) | SLC39A6 (SEQ ID NO: 1158) |
| ROR1 (SEQ ID NO: 1070) | SSTR5 (SEQ ID NO: 937) | SPON2 (SEQ ID NO: 7392) |
| TNFRSF10A (SEQ ID NO: 2911) | SSTR1 (SEQ ID NO: 927) | SSTR4 (SEQ ID NO: 936) |
| TNFRSF10B (SEQ ID NO: 2910) | SSTR3 (SEQ ID NO: 935) | SSX1 (SEQ ID NO: 7438) |
| KDR (SEQ ID NO: 2607) | AFP (SEQ ID NO: 7252) | TDGF1P3 (SEQ ID NO: 7466) |
| WT1 (SEQ ID NO: 111) | AGER (SEQ ID NO: 1470) | TNC (SEQ ID NO: 2562) |
| ITGB1 (SEQ ID NO: 7310) | ANXA1 (SEQ ID NO: 7253) | TPBG (SEQ ID NO: 2164) |
| ITGB3 (SEQ ID NO: 64) | BAGE (SEQ ID NO: 7269) | TYR (SEQ ID NO: 110) |
| FUT3 (SEQ ID NO: 43) | BIRC5 (SEQ ID NO: 7342) | VCAM1 (SEQ ID NO: 946) |
| CEACAM5 (SEQ ID NO: 7444) | CD37 (SEQ ID NO: 823) | VTCN1 (SEQ ID NO: 5057) |
| ULBP1 (SEQ ID NO: 7458) | CD52 (SEQ ID NO: 2478) | |

In some cases, useful antigen combinations may include an antigen combination that includes a clinical antigen in combination with a tissue antigen (e.g., an antigen expressed in normal brain tissue) in an AND NOT gate. For example, useful antigen combinations may include a GD2 (B4GALNT1; SEQ ID NO:2385) clinical antigen AND NOT a tissue antigen selected from: OPALIN (SEQ ID NO:833), TMEM235 (SEQ ID NO:1869), GABRA1 (SEQ ID NO:262), KCNJ9 (SEQ ID NO:3190), GRM3 (SEQ ID NO:290), SEZ6 (SEQ ID NO:1143), NTSR2 (SEQ ID NO:3753), KCNK4 (SEQ ID NO:5486), SLCO1A2 (SEQ ID NO:7290), SLC24A2 (SEQ ID NO:4632), MOG (SEQ ID NO:528), GABRG1 (SEQ ID NO:6354), GABRG2 (SEQ ID NO:272), CNTNAP4 (SEQ ID NO:5492), DSCAM (SEQ ID NO:2354), CACNG3 (SEQ ID NO:3510), CRB1 (SEQ ID NO:6891), CDH10 (SEQ ID NO:3552), HRH3 (SEQ ID NO:3657), GRIK1 (SEQ ID NO:280), SLC39A12 (SEQ ID NO:1826), GPR158 (SEQ ID NO:4716), CACNG2 (SEQ ID NO:3430), SYT3 (SEQ ID NO:7410), HTR5A (SEQ ID NO:4993), CACNG7 (SEQ ID NO:5264), GPR37L1 (SEQ ID NO:3118), LRRTM3 (SEQ ID NO:7362), GLRA2 (SEQ ID NO:1281), CHRNB2 (SEQ ID NO:228), KCNQ2 (SEQ ID NO:3067), JPH3 (SEQ ID NO:4690), GPR19 (SEQ ID NO:3446), ADCY8 (SEQ ID NO:1248), SPOCK3 (SEQ ID NO:845), SLC32A1 (SEQ ID NO:5606), OPCML (SEQ ID NO:594), GABRA3 (SEQ ID NO:264), GRM5 (SEQ ID NO:292), SCN1A (SEQ ID NO:2133), SLC5A11 (SEQ ID NO:5546), KCNC1 (SEQ ID NO:1249), SLC12A5 (SEQ ID NO:1506), GRM4 (SEQ ID NO:291), GRM1 (SEQ ID NO:288), GRIA4 (SEQ ID NO:279), MEGF11 (SEQ ID NO:5354), CACNA1B (SEQ ID NO:211), LYPD1 (SEQ ID NO:970), GRID2 (SEQ ID NO:2398), SCN2A (SEQ ID NO:842), NKAIN2 (SEQ ID NO:864), UNC5A (SEQ ID NO:5690), SLC4A10 (SEQ ID NO:7421), TMEFF2 (SEQ ID NO:4183), CSMD3 (SEQ ID NO:5532), PPAPDC1A (SEQ ID NO:715), HAPLN4 (SEQ ID NO:4968), GPR85 (SEQ ID NO:1920), ANTXR2 (SEQ ID NO:1876), CACNG4 (SEQ ID NO:3934), CSPG5 (SEQ ID NO:3516), KCNK10 (SEQ ID NO:4784), CHRNA4 (SEQ ID NO:225), CNTNAP2 (SEQ ID NO:3871), KCNJ10 (SEQ ID NO:2597), GABRB2 (SEQ ID NO:269), GRIN1 (SEQ ID NO:282), CRB2 (SEQ ID NO:6381), SHISA7 (SEQ ID NO:7406), NKAIN4 (SEQ ID NO:6122), HTR2C (SEQ ID NO:301), CACNG8 (SEQ ID NO:5263), NRG3 (SEQ ID NO:569), ABCG4 (SEQ ID NO:1668), CDH8 (SEQ ID NO:2476), GABRD (SEQ ID NO:271), KIRREL3 (SEQ ID NO:2022), GABRB1 (SEQ ID NO:268), KCNA2 (SEQ ID NO:3181), CDH20 (SEQ ID NO:5261), IGDCC3 (SEQ ID NO:3159), KCNJ6 (SEQ ID NO:2596), CNIH2 (SEQ ID NO:6658), KCNK12 (SEQ ID NO:7295), CDH18 (SEQ ID NO:2192), CSMD2 (SEQ ID NO:5530), SYT4 (SEQ ID NO:4722), OR2L13 (SEQ ID NO:6468), CDH9 (SEQ ID NO:4198), GABRA2 (SEQ ID NO:263), KCNF1 (SEQ ID NO:2592), MAG (SEQ ID NO:2634), CALN1 (SEQ ID NO:645), GRIN2B (SEQ ID NO:284), GRM7 (SEQ ID NO:294), VSTM2A (SEQ ID NO:7459), GPR61 (SEQ ID NO:5271), OMG (SEQ ID NO:2672), KCNA1 (SEQ ID NO:66), GPR83 (SEQ ID NO:4239), ATP8A2 (SEQ ID NO:4237), GABBR2 (SEQ ID NO:3288), GPR12 (SEQ ID NO:3255), TRPM3 (SEQ ID NO:519), SLC8A3 (SEQ ID NO:1424), KCND2 (SEQ ID NO:7288), GSG1L (SEQ ID NO:1236), SLC30A10 (SEQ ID NO:4487), ASTN1 (SEQ ID NO:3016), GPR179 (SEQ ID NO:7447), LRFN2 (SEQ ID NO:4711), CACNA1E (SEQ ID NO:214), CALY (SEQ ID NO:4119), SLC6A15 (SEQ ID NO:1932), KIAA0319 (SEQ ID NO:2227), SYT6 (SEQ ID NO:6957), PTPRR (SEQ ID NO:2724), KCTD8 (SEQ ID NO:7331), GPR22 (SEQ ID NO:3261), SLC4A8 (SEQ ID NO:818), LAMP5 (SEQ ID NO:3729), MEGF10 (SEQ ID NO:5355), FXYD7 (SEQ ID NO:4864), KCNK9 (SEQ ID NO:4257), SLC1A6 (SEQ ID NO:3206), MLC1 (SEQ ID NO:4042), OPRK1 (SEQ ID NO:325), ATP2B2 (SEQ ID NO:353), ACSL6 (SEQ ID NO:560), THBD (SEQ ID NO:108), PTPRT (SEQ ID NO:3622), PCDHGC4 (SEQ ID NO:2688), CLDN10 (SEQ ID NO:1975), KCNV1 (SEQ ID NO:3925), LPPR3 (SEQ ID NO:5096), SLCO1C1 (SEQ ID NO:1885), PCDH8 (SEQ ID NO:2690), ANO4 (SEQ ID NO:6566), LRRTM4 (SEQ ID NO:1505), PCDH15 (SEQ ID NO:1688), CCKBR (SEQ ID NO:6481), GABRA5 (SEQ ID NO:266), SLC6A12 (SEQ ID NO:1290), GRIN2A (SEQ ID NO:283), SLC1A2 (SEQ ID NO:2977), SLC43A1 (SEQ ID NO:2856), KCNC2 (SEQ ID NO:5836), ELFN2 (SEQ ID NO:5534), ATP7A (SEQ ID NO:10), GRIK4 (SEQ ID NO:3965), LRRC55 (SEQ ID NO:448), HCN2 (SEQ ID NO:7377), NKAIN1 (SEQ ID NO:5039), DPP10 (SEQ ID NO:432), AJAP1 (SEQ ID NO:894), NPFFR1 (SEQ ID NO:4886), TRPC3 (SEQ ID NO:1434), TGFBI (SEQ ID NO:107), SLC6A7 (SEQ ID NO:7370), GABRA4 (SEQ ID NO:265), SLC13A5 (SEQ ID NO:1732), GRIN2C (SEQ ID NO:285), HCN1 (SEQ ID NO:4763), SLC26A8 (SEQ ID NO:5552), PPIC (SEQ ID NO:336), NETO1 (SEQ ID NO:7427), TNFRSF10B (SEQ ID NO:2910), CDH22 (SEQ ID NO:4803), SLC6A13 (SEQ ID NO:4264), DISP2 (SEQ ID NO:7320), SLC6A11 (SEQ ID NO:3890), CD93 (SEQ ID NO:3698), EPHA10 (SEQ ID NO:1160), PHLDB2 (SEQ ID NO:1490), OXTR (SEQ ID NO:7326), WNT7A (SEQ ID NO:3089), GYPC (SEQ ID NO:7432), KCNA4 (SEQ ID NO:2589), PCDHAC2 (SEQ ID NO:4498), HGFAC (SEQ ID NO:2405), DRD1 (SEQ ID NO:253), SHISA9 (SEQ ID NO:7418), SCN8A (SEQ ID NO:3879), ICAM1 (SEQ ID NO:7382), PIRT (SEQ ID NO:1201), A4GALT (SEQ ID NO:4291), MRGPRF (SEQ ID NO:1129), CD248 (SEQ ID NO:4649), CD58 (SEQ ID NO:7405), CD44 (SEQ ID NO:172), EPHA2 (SEQ ID NO:3042) or PROCR (SEQ ID NO:3480). In some instances, such antigen combinations may be useful in targeting melanoma.

Useful antigen combinations may include a MAGEA1 (SEQ ID NO:3191) clinical antigen AND NOT a tissue antigen (e.g., a brain tissue antigen) selected from: OPALIN (SEQ ID NO:833), TMEM235 (SEQ ID NO:1869), GABRA1 (SEQ ID NO:262), KCNJ9 (SEQ ID NO:3190), GRM3 (SEQ ID NO:290), SEZ6 (SEQ ID NO:1143), NTSR2 (SEQ ID NO:3753), KCNK4 (SEQ ID NO:5486), SLCO1A2 (SEQ ID NO:7290), SLC24A2 (SEQ ID NO:4632), MOG (SEQ ID NO:528), GABRG1 (SEQ ID NO:6354), GABRG2 (SEQ ID NO:272), CNTNAP4 (SEQ ID NO:5492), DSCAM (SEQ ID NO:2354), CACNG3 (SEQ ID NO:3510), CRB1 (SEQ ID NO:6891), CDH10 (SEQ ID NO:3552), HRH3 (SEQ ID NO:3657), GRIK1 (SEQ ID NO:280), SLC39A12 (SEQ ID NO:1826), GPR158 (SEQ ID NO:4716), CACNG2 (SEQ ID NO:3430), SYT3 (SEQ ID NO:7410), HTR5A (SEQ ID NO:4993), CACNG7 (SEQ ID NO:5264), GPR37L1 (SEQ ID NO:3118), LRRTM3 (SEQ ID NO:7362), GLRA2 (SEQ ID NO:1281), CHRNB2 (SEQ ID NO:228), KCNQ2 (SEQ ID NO:3067), JPH3 (SEQ ID NO:4690), GPR19 (SEQ ID NO:3446), ADCY8 (SEQ ID NO:1248), SPOCK3 (SEQ ID NO:845), SLC32A1 (SEQ ID NO:5606), OPCML (SEQ ID NO:594), GABRA3 (SEQ ID NO:264), GRM5 (SEQ ID NO:292), SCN1A (SEQ ID NO:2133), SLC5A11 (SEQ ID NO:5546), KCNC1 (SEQ ID NO:1249), SLC12A5 (SEQ ID NO:1506), GRM4 (SEQ ID NO:291), GRM1 (SEQ ID NO:288), GRIA4 (SEQ ID NO:279), MEGF11 (SEQ ID NO:5354), CACNA1B (SEQ ID NO:211), LYPD1 (SEQ ID NO:970), GRID2 (SEQ ID NO:2398), SCN2A (SEQ ID NO:842), NKAIN2 (SEQ ID NO:864), UNC5A (SEQ ID NO:5690), SLC4A10 (SEQ ID NO:7421), TMEFF2 (SEQ ID NO:4183), CSMD3 (SEQ ID NO:5532), PPAPDC1A (SEQ ID NO:715), HAPLN4 (SEQ ID NO:4968), GPR85 (SEQ ID NO:1920), ANTXR2 (SEQ ID NO:1876), CACNG4 (SEQ ID NO:3934), CSPG5 (SEQ ID NO:3516), KCNK10 (SEQ ID NO:4784), CHRNA4 (SEQ ID NO:225), CNTNAP2 (SEQ ID NO:3871), KCNJ10 (SEQ ID NO:2597), GABRB2 (SEQ ID NO:269), GRIN1 (SEQ ID NO:282), CRB2 (SEQ ID NO:6381), SHISA7 (SEQ ID NO:7406), NKAIN4 (SEQ ID NO:6122), HTR2C (SEQ ID NO:301), CACNG8 (SEQ ID NO:5263), NRG3 (SEQ ID NO:569), ABCG4 (SEQ ID NO:1668), CDH8 (SEQ ID NO:2476), GABRD (SEQ ID NO:271), KIRREL3 (SEQ ID NO:2022), GABRB1 (SEQ ID NO:268), KCNA2 (SEQ ID NO:3181), CDH20 (SEQ ID NO:5261), IGDCC3 (SEQ ID NO:3159), KCNJ6 (SEQ ID NO:2596), CNIH2 (SEQ ID NO:6658), KCNK12 (SEQ ID NO:7295), CDH18 (SEQ ID NO:2192), CSMD2 (SEQ ID NO:5530), SYT4 (SEQ ID NO:4722), OR2L13 (SEQ ID NO:6468), CDH9 (SEQ ID NO:4198), GABRA2 (SEQ ID NO:263), KCNF1 (SEQ ID NO:2592), MAG (SEQ ID NO:2634), CALN1 (SEQ ID NO:645), GRIN2B (SEQ ID NO:284), GRM7 (SEQ ID NO:294), VSTM2A (SEQ ID NO:7459), GPR61 (SEQ ID NO:5271), OMG (SEQ ID NO:2672), KCNA1 (SEQ ID NO:66), GPR83 (SEQ ID NO:4239), ATP8A2 (SEQ ID NO:4237), GABBR2 (SEQ ID NO:3288), GPR12 (SEQ ID NO:3255), TRPM3 (SEQ ID NO:519), SLC8A3 (SEQ ID NO:1424), KCND2 (SEQ ID NO:7288), GSG1L (SEQ ID NO:1236), SLC30A10 (SEQ ID NO:4487), ASTN1 (SEQ ID NO:3016), GPR179 (SEQ ID NO:7447), LRFN2 (SEQ ID NO:4711), CACNA1E (SEQ ID NO:214), CALY (SEQ ID NO:4119), SLC6A15 (SEQ ID NO:1932), KIAA0319 (SEQ ID NO:2227), SYT6 (SEQ ID NO:6957), PTPRR (SEQ ID NO:2724), KCTD8 (SEQ ID NO:7331), GPR22 (SEQ ID NO:3261), SLC4A8 (SEQ ID NO:818), LAMP5 (SEQ ID NO:3729), MEGF10 (SEQ ID NO:5355), FXYD7 (SEQ ID NO:4864), KCNK9 (SEQ ID NO:4257), SLC1A6 (SEQ ID NO:3206), MLC1 (SEQ ID NO:4042), OPRK1 (SEQ ID NO:325), ATP2B2 (SEQ ID NO:353), ACSL6 (SEQ ID NO:560), THBD (SEQ ID NO:108), PTPRT (SEQ ID NO:3622), PCDHGC4 (SEQ ID NO:2688), CLDN10 (SEQ ID NO:1975), KCNV1 (SEQ ID NO:3925), LPPR3 (SEQ ID NO:5096), SLCO1C1 (SEQ ID NO:1885), PCDH8 (SEQ ID NO:2690), ANO4 (SEQ ID NO:6566), LRRTM4 (SEQ ID NO:1505), PCDH15 (SEQ ID NO:1688), CCKBR (SEQ ID NO:6481), GABRA5 (SEQ ID NO:266), SLC6A12 (SEQ ID NO:1290), GRIN2A (SEQ ID NO:283), SLC1A2 (SEQ ID NO:2977), SLC43A1 (SEQ ID NO:2856), KCNC2 (SEQ ID NO:5836), ELFN2 (SEQ ID NO:5534), ATP7A (SEQ ID NO:10), GRIK4 (SEQ ID NO:3965), LRRC55 (SEQ ID NO:448), HCN2 (SEQ ID NO:7377), NKAIN1 (SEQ ID NO:5039), DPP10 (SEQ ID NO:432), AJAP1 (SEQ ID NO:894), NPFFR1 (SEQ ID NO:4886), TRPC3 (SEQ ID NO:1434), TGFBI (SEQ ID NO:107), SLC6A7 (SEQ ID NO:7370), GABRA4 (SEQ ID NO:265), SLC13A5 (SEQ ID NO:1732), GRIN2C (SEQ ID NO:285), HCN1 (SEQ ID NO:4763), SLC26A8 (SEQ ID NO:5552), PPIC (SEQ ID NO:336), NETO1 (SEQ ID NO:7427), TNFRSF10B (SEQ ID NO:2910), CDH22 (SEQ ID NO:4803), SLC6A13 (SEQ ID NO:4264), DISP2 (SEQ ID NO:7320), SLC6A11 (SEQ ID NO:3890), CD93 (SEQ ID NO:3698), EPHA10 (SEQ ID NO:1160), PHLDB2 (SEQ ID NO:1490), OXTR (SEQ ID NO:7326), WNT7A (SEQ ID NO:3089), GYPC (SEQ ID NO:7432), KCNA4 (SEQ ID NO:2589), PCDHAC2 (SEQ ID NO:4498), HGFAC (SEQ ID NO:2405), DRD1 (SEQ ID NO:253), SHISA9 (SEQ ID NO:7418), SCN8A (SEQ ID NO:3879), ICAM1 (SEQ ID NO:7382), PIRT (SEQ ID NO:1201), A4GALT (SEQ ID NO:4291), MRGPRF (SEQ ID NO:1129), CD248 (SEQ ID NO:4649), CD58 (SEQ ID NO:7405), CD44 (SEQ ID NO:172), EPHA2 (SEQ ID NO:3042) or PROCR (SEQ ID NO:3480). In some instances, such antigen combinations may be useful in targeting melanoma.

Useful antigen combinations may include a MAGEA3 (SEQ ID NO:7279) clinical antigen AND NOT a tissue antigen (e.g., a brain tissue antigen) selected from: OPALIN (SEQ ID NO:833), TMEM235 (SEQ ID NO:1869), GABRA1 (SEQ ID NO:262), KCNJ9 (SEQ ID NO:3190), GRM3 (SEQ ID NO:290), SEZ6 (SEQ ID NO:1143), NTSR2 (SEQ ID NO:3753), KCNK4 (SEQ ID NO:5486), SLCO1A2 (SEQ ID NO:7290), SLC24A2 (SEQ ID NO:4632), MOG (SEQ ID NO:528), GABRG1 (SEQ ID NO:6354), GABRG2 (SEQ ID NO:272), CNTNAP4 (SEQ ID NO:5492), DSCAM (SEQ ID NO:2354), CACNG3 (SEQ ID NO:3510), CRB1 (SEQ ID NO:6891), CDH10 (SEQ ID NO:3552), HRH3 (SEQ ID NO:3657), GRIK1 (SEQ ID NO:280), SLC39A12 (SEQ ID NO:1826), GPR158 (SEQ ID NO:4716), CACNG2 (SEQ ID NO:3430), SYT3 (SEQ ID NO:7410), HTR5A (SEQ ID NO:4993), CACNG7 (SEQ ID NO:5264), GPR37L1 (SEQ ID NO:3118), LRRTM3 (SEQ ID NO:7362), GLRA2 (SEQ ID NO:1281), CHRNB2 (SEQ ID NO:228), KCNQ2 (SEQ ID NO:3067), JPH3 (SEQ ID NO:4690), GPR19 (SEQ ID NO:3446), ADCY8 (SEQ ID NO:1248), SPOCK3 (SEQ ID NO:845), SLC32A1 (SEQ ID NO:5606), OPCML (SEQ ID NO:594), GABRA3 (SEQ ID NO:264), GRM5 (SEQ ID NO:292), SCN1A (SEQ ID NO:2133), SLC5A11 (SEQ ID NO:5546), KCNC1 (SEQ ID NO:1249), SLC12A5 (SEQ ID NO:1506), GRM4 (SEQ ID NO:291), GRM1 (SEQ ID NO:288), GRIA4 (SEQ ID NO:279), MEGF11 (SEQ ID NO:5354), CACNA1B (SEQ ID NO:211), LYPD1 (SEQ ID NO:970), GRID2 (SEQ ID NO:2398), SCN2A (SEQ ID NO:842), NKAIN2 (SEQ ID NO:864), UNC5A (SEQ ID NO:5690), SLC4A10 (SEQ ID NO:7421), TMEFF2 (SEQ ID NO:4183), CSMD3 (SEQ ID NO:5532), PPAPDC1A (SEQ ID NO:715), HAPLN4 (SEQ ID NO:4968), GPR85 (SEQ ID NO:1920), ANTXR2 (SEQ ID NO:1876), CACNG4 (SEQ ID NO:3934), CSPG5 (SEQ ID NO:3516), KCNK10 (SEQ ID NO:4784), CHRNA4 (SEQ ID NO:225), CNTNAP2 (SEQ ID NO:3871), KCNJ10 (SEQ ID NO:2597), GABRB2 (SEQ ID NO:269), GRIN1 (SEQ ID NO:282), CRB2 (SEQ ID NO:6381), SHISA7 (SEQ ID NO:7406), NKAIN4 (SEQ ID NO:6122), HTR2C (SEQ ID NO:301), CACNG8 (SEQ ID NO:5263), NRG3 (SEQ ID NO:569), ABCG4 (SEQ ID NO:1668), CDH8 (SEQ ID NO:2476), GABRD (SEQ ID NO:271), KIRREL3 (SEQ ID NO:2022), GABRB1 (SEQ ID NO:268), KCNA2 (SEQ ID NO:3181), CDH20 (SEQ ID NO:5261), IGDCC3 (SEQ ID NO:3159), KCNJ6 (SEQ ID NO:2596), CNIH2 (SEQ ID NO:6658), KCNK12 (SEQ ID NO:7295), CDH18 (SEQ ID NO:2192), CSMD2 (SEQ ID NO:5530), SYT4 (SEQ ID NO:4722), OR2L13 (SEQ ID NO:6468), CDH9 (SEQ ID NO:4198), GABRA2 (SEQ ID NO:263), KCNF1 (SEQ ID NO:2592), MAG (SEQ ID NO:2634), CALN1 (SEQ ID NO:645), GRIN2B (SEQ ID NO:284), GRM7 (SEQ ID NO:294), VSTM2A (SEQ ID NO:7459), GPR61 (SEQ ID NO:5271), OMG (SEQ ID NO:2672), KCNA1 (SEQ ID NO:66), GPR83 (SEQ ID NO:4239), ATP8A2 (SEQ ID NO:4237), GABBR2 (SEQ ID NO:3288), GPR12 (SEQ ID NO:3255), TRPM3 (SEQ ID NO:519), SLC8A3 (SEQ ID NO:1424), KCND2 (SEQ ID NO:7288), GSG1L (SEQ ID NO:1236), SLC30A10 (SEQ ID NO:4487), ASTN1 (SEQ ID NO:3016), GPR179 (SEQ ID NO:7447), LRFN2 (SEQ ID NO:4711), CACNA1E (SEQ ID NO:214), CALY (SEQ ID NO:4119), SLC6A15 (SEQ ID NO:1932), KIAA0319 (SEQ ID NO:2227), SYT6 (SEQ ID NO:6957), PTPRR (SEQ ID NO:2724), KCTD8 (SEQ ID NO:7331), GPR22 (SEQ ID NO:3261), SLC4A8 (SEQ ID NO:818), LAMP5 (SEQ ID NO:3729), MEGF10 (SEQ ID NO:5355), FXYD7 (SEQ ID NO:4864), KCNK9 (SEQ ID NO:4257), SLC1A6 (SEQ ID NO:3206), MLC1 (SEQ ID NO:4042), OPRK1 (SEQ ID NO:325), ATP2B2 (SEQ ID NO:353), ACSL6 (SEQ ID NO:560), THBD (SEQ ID NO:108), PTPRT (SEQ ID NO:3622), PCDHGC4 (SEQ ID NO:2688), CLDN10 (SEQ ID NO:1975), KCNV1 (SEQ ID NO:3925), LPPR3 (SEQ ID NO:5096), SLCO1C1 (SEQ ID NO:1885), PCDH8 (SEQ ID NO:2690), ANO4 (SEQ ID NO:6566), LRRTM4 (SEQ ID NO:1505), PCDH15 (SEQ ID NO:1688), CCKBR (SEQ ID NO:6481), GABRA5 (SEQ ID NO:266), SLC6A12 (SEQ ID NO:1290), GRIN2A (SEQ ID NO:283), SLC1A2 (SEQ ID NO:2977), SLC43A1 (SEQ ID NO:2856), KCNC2 (SEQ ID NO:5836), ELFN2 (SEQ ID NO:5534), ATP7A (SEQ ID NO:10), GRIK4 (SEQ ID NO:3965), LRRC55 (SEQ ID NO:448), HCN2 (SEQ ID NO:7377), NKAIN1 (SEQ ID NO:5039), DPP10 (SEQ ID NO:432), AJAP1 (SEQ ID NO:894), NPFFR1 (SEQ ID NO:4886), TRPC3 (SEQ ID NO:1434), TGFBI (SEQ ID NO:107), SLC6A7 (SEQ ID NO:7370), GABRA4 (SEQ ID NO:265), SLC13A5 (SEQ ID NO:1732), GRIN2C (SEQ ID NO:285), HCN1 (SEQ ID NO:4763), SLC26A8 (SEQ ID NO:5552), PPIC (SEQ ID NO:336), NETO1 (SEQ ID NO:7427), TNFRSF10B (SEQ ID NO:2910), CDH22 (SEQ ID NO:4803), SLC6A13 (SEQ ID NO:4264), DISP2 (SEQ ID NO:7320), SLC6A11 (SEQ ID NO:3890), CD93 (SEQ ID NO:3698), EPHA10 (SEQ ID NO:1160), PHLDB2 (SEQ ID NO:1490), OXTR (SEQ ID NO:7326), WNT7A (SEQ ID NO:3089), GYPC (SEQ ID NO:7432), KCNA4 (SEQ ID NO:2589), PCDHAC2 (SEQ ID NO:4498), HGFAC (SEQ ID NO:2405), DRD1 (SEQ ID NO:253), SHISA9 (SEQ ID NO:7418), SCN8A (SEQ ID NO:3879), ICAM1 (SEQ ID NO:7382), PIRT (SEQ ID NO:1201), A4GALT (SEQ ID NO:4291), MRGPRF (SEQ ID NO:1129), CD248 (SEQ ID NO:4649), CD58 (SEQ ID NO:7405), CD44 (SEQ ID NO:172), EPHA2 (SEQ ID NO:3042) or PROCR (SEQ ID NO:3480). In some instances, such antigen combinations may be useful in targeting melanoma.

Useful antigen combinations may include a MART1 (MLANA; SEQ ID NO:3302) clinical antigen AND NOT a tissue antigen (e.g., a brain tissue antigen) selected from: OPALIN (SEQ ID NO:833), TMEM235 (SEQ ID NO:1869), GABRA1 (SEQ ID NO:262), KCNJ9 (SEQ ID NO:3190), GRM3 (SEQ ID NO:290), SEZ6 (SEQ ID NO:1143), NTSR2 (SEQ ID NO:3753), KCNK4 (SEQ ID NO:5486), SLCO1A2 (SEQ ID NO:7290), SLC24A2 (SEQ ID NO:4632), MOG (SEQ ID NO:528), GABRG1 (SEQ ID NO:6354), GABRG2 (SEQ ID NO:272), CNTNAP4 (SEQ ID NO:5492), DSCAM (SEQ ID NO:2354), CACNG3 (SEQ ID NO:3510), CRB1 (SEQ ID NO:6891), CDH10 (SEQ ID NO:3552), HRH3 (SEQ ID NO:3657), GRIK1 (SEQ ID NO:280), SLC39A12 (SEQ ID NO:1826), GPR158 (SEQ ID NO:4716), CACNG2 (SEQ ID NO:3430), SYT3 (SEQ ID NO:7410), HTR5A (SEQ ID NO:4993), CACNG7 (SEQ ID NO:5264), GPR37L1 (SEQ ID NO:3118), LRRTM3 (SEQ ID NO:7362), GLRA2 (SEQ ID NO:1281), CHRNB2 (SEQ ID NO:228), KCNQ2 (SEQ ID NO:3067), JPH3 (SEQ ID NO:4690), GPR19 (SEQ ID NO:3446), ADCY8 (SEQ ID NO:1248), SPOCK3 (SEQ ID NO:845), SLC32A1 (SEQ ID NO:5606), OPCML (SEQ ID NO:594), GABRA3 (SEQ ID NO:264), GRM5 (SEQ ID NO:292), SCN1A (SEQ ID NO:2133), SLC5A11 (SEQ ID NO:5546), KCNC1 (SEQ ID NO:1249), SLC12A5 (SEQ ID NO:1506), GRM4 (SEQ ID NO:291), GRM1 (SEQ ID NO:288), GRIA4 (SEQ ID NO:279), MEGF11 (SEQ ID NO:5354), CACNA1B (SEQ ID NO:211), LYPD1 (SEQ ID NO:970), GRID2 (SEQ ID NO:2398), SCN2A (SEQ ID NO:842), NKAIN2 (SEQ ID NO:864), UNC5A (SEQ ID NO:5690), SLC4A10 (SEQ ID NO:7421), TMEFF2 (SEQ ID NO:4183), CSMD3 (SEQ ID NO:5532), PPAPDC1A (SEQ ID NO:715), HAPLN4 (SEQ ID NO:4968), GPR85 (SEQ ID NO:1920), ANTXR2 (SEQ ID NO:1876), CACNG4 (SEQ ID NO:3934), CSPG5 (SEQ ID NO:3516), KCNK10 (SEQ ID NO:4784), CHRNA4 (SEQ ID NO:225), CNTNAP2 (SEQ ID NO:3871), KCNJ10 (SEQ ID NO:2597), GABRB2 (SEQ ID NO:269), GRIN1 (SEQ ID NO:282), CRB2 (SEQ ID NO:6381), SHISA7 (SEQ ID NO:7406), NKAIN4 (SEQ ID NO:6122), HTR2C (SEQ ID NO:301), CACNG8 (SEQ ID NO:5263), NRG3 (SEQ ID NO:569), ABCG4 (SEQ ID NO:1668), CDH8 (SEQ ID NO:2476), GABRD (SEQ ID NO:271), KIRREL3 (SEQ ID NO:2022), GABRB1 (SEQ ID NO:268), KCNA2 (SEQ ID NO:3181), CDH20 (SEQ ID NO:5261), IGDCC3 (SEQ ID NO:3159), KCNJ6 (SEQ ID NO:2596), CNIH2 (SEQ ID NO:6658), KCNK12 (SEQ ID NO:7295), CDH18 (SEQ ID NO:2192), CSMD2 (SEQ ID NO:5530), SYT4 (SEQ ID NO:4722), OR2L13 (SEQ ID NO:6468), CDH9 (SEQ ID NO:4198), GABRA2 (SEQ ID NO:263), KCNF1 (SEQ ID NO:2592), MAG (SEQ ID NO:2634), CALN1 (SEQ ID NO:645), GRIN2B (SEQ ID NO:284), GRM7 (SEQ ID NO:294), VSTM2A (SEQ ID NO:7459), GPR61 (SEQ ID NO:5271), OMG (SEQ ID NO:2672), KCNA1 (SEQ ID NO:66), GPR83 (SEQ ID NO:4239), ATP8A2 (SEQ ID NO:4237), GABBR2 (SEQ ID NO:3288), GPR12 (SEQ ID NO:3255), TRPM3 (SEQ ID NO:519), SLC8A3 (SEQ ID NO:1424), KCND2 (SEQ ID NO:7288), GSG1L (SEQ ID NO:1236), SLC30A10 (SEQ ID NO:4487), ASTN1 (SEQ ID NO:3016), GPR179 (SEQ ID NO:7447), LRFN2 (SEQ ID NO:4711), CACNA1E (SEQ ID NO:214), CALY (SEQ ID NO:4119), SLC6A15 (SEQ ID NO:1932), KIAA0319 (SEQ ID NO:2227), SYT6 (SEQ ID NO:6957), PTPRR (SEQ ID NO:2724), KCTD8 (SEQ ID NO:7331), GPR22 (SEQ ID NO:3261), SLC4A8 (SEQ ID NO:818), LAMP5 (SEQ ID NO:3729), MEGF10 (SEQ ID NO:5355), FXYD7 (SEQ ID NO:4864), KCNK9 (SEQ ID NO:4257), SLC1A6 (SEQ ID NO:3206), MLC1 (SEQ ID NO:4042), OPRK1 (SEQ ID NO:325), ATP2B2 (SEQ ID NO:353), ACSL6 (SEQ ID NO:560), THBD (SEQ ID NO:108), PTPRT (SEQ ID NO:3622), PCDHGC4 (SEQ ID NO:2688), CLDN10 (SEQ ID NO:1975), KCNV1 (SEQ ID NO:3925), LPPR3 (SEQ ID NO:5096), SLCO1C1 (SEQ ID NO:1885), PCDH8 (SEQ ID NO:2690), ANO4 (SEQ ID NO:6566), LRRTM4 (SEQ ID NO:1505), PCDH15 (SEQ ID NO:1688), CCKBR (SEQ ID NO:6481), GABRA5 (SEQ ID NO:266), SLC6A12 (SEQ ID NO:1290), GRIN2A (SEQ ID NO:283), SLC1A2 (SEQ ID NO:2977), SLC43A1 (SEQ ID NO:2856), KCNC2 (SEQ ID NO:5836), ELFN2 (SEQ ID NO:5534), ATP7A (SEQ ID NO:10), GRIK4 (SEQ ID NO:3965), LRRC55 (SEQ ID NO:448), HCN2 (SEQ ID NO:7377), NKAIN1 (SEQ ID NO:5039), DPP10 (SEQ ID NO:432), AJAP1 (SEQ ID NO:894), NPFFR1 (SEQ ID NO:4886), TRPC3 (SEQ ID NO:1434), TGFBI (SEQ ID NO:107), SLC6A7 (SEQ ID NO:7370), GABRA4 (SEQ ID NO:265), SLC13A5 (SEQ ID NO:1732), GRIN2C (SEQ ID NO:285), HCN1 (SEQ ID NO:4763), SLC26A8 (SEQ ID NO:5552), PPIC (SEQ ID NO:336), NETO1 (SEQ ID NO:7427), TNFRSF10B (SEQ ID NO:2910), CDH22 (SEQ ID NO:4803), SLC6A13 (SEQ ID NO:4264), DISP2 (SEQ ID NO:7320), SLC6A11 (SEQ ID NO:3890), CD93 (SEQ ID NO:3698), EPHA10 (SEQ ID NO:1160), PHLDB2 (SEQ ID NO:1490), OXTR (SEQ ID NO:7326), WNT7A (SEQ ID NO:3089), GYPC (SEQ ID NO:7432), KCNA4 (SEQ ID NO:2589), PCDHAC2 (SEQ ID NO:4498), HGFAC (SEQ ID NO:2405), DRD1 (SEQ ID NO:253), SHISA9 (SEQ ID NO:7418), SCN8A (SEQ ID NO:3879), ICAM1 (SEQ ID NO:7382), PIRT (SEQ ID NO:1201), A4GALT (SEQ ID NO:4291), MRGPRF (SEQ ID NO:1129), CD248 (SEQ ID NO:4649), CD58 (SEQ ID NO:7405), CD44 (SEQ ID NO:172), EPHA2 (SEQ ID NO:3042) or PROCR (SEQ ID NO:3480). In some instances, such antigen combinations may be useful in targeting melanoma.

Third Antigens

As noted above, in some cases, a genetically modified cytotoxic immune cell of the present disclosure, or a system of the present disclosure, can include an antigen-triggered polypeptide (or a nucleic acid comprising a nucleotide sequence encoding the same) that specifically binds a third target antigen present on the surface of a cancer cell. Examples of such third target antigens are depicted in FIG. 4 and Table 3. The third target antigen can be included except where contraindicated by a target antigen pair listed in FIG. 1 or FIG. 9-14. In some cases, the third antigen comprises an amino acid sequence having at least 85%, at least 90%, at least 95%, at least 98%, at least 99%, or 100%, amino acid sequence identity to one of the amino acid sequences depicted in SEQ ID NOs: 7119-7467.

Where a third antigen (e.g., an antigen listed in FIG. 4 or Table 3) is included in the target antigen combination, the third antigen will be associated with the same cancer cell type as the target antigen pair (e.g., from FIG. 1 or FIG. 9-14). FIG. 1 and FIG. 9-14 provide exemplary target cancer cell types associate with a given target antigen pair. FIG. 4 also provides exemplary target cancer cell types associate with a given target antigen.

In some instances, a particular antigen (e.g., an antigen of an antigen pair as described in FIG. 1 or FIG. 9-14, a clinical antigen as described in FIG. 4, etc.) may be employed in an antigen combination, including combinations having two antigens, combinations having three antigens, etc., for treating a cancer other than the exemplary cancer with which it is identified. For example, although FIG. 4 identifies "exemplary cancers" for each antigen, use of the antigen in antigen combinations will not be limited to the specifically identified cancer(s) and the particular antigen may be employed in antigen combinations for the treatment of other cancers besides those specifically listed as exemplary.

Examples of hematological malignancy antigens include, e.g., CD19 (as expressed in e.g., B-cells), CD20 (as expressed in e.g., B-cells), CD22 (as expressed in e.g., B-cells), CD30 (as expressed in e.g., B-cells), CD33 (as expressed in e.g., Myeloid cells), CD70 (as expressed in e.g., B-cell/T-cells), CD123 (as expressed in e.g., Myeloid cells), Kappa (as expressed in e.g., B-cells), Lewis Y (as expressed in e.g., Myeloid cells), NKG2D ligands (as expressed in e.g., Myeloid cells), ROR1 (as expressed in e.g., B-cells), SLAMF7/CS1 (as expressed in e.g., myeloma cells, natural killer cells, T cells, and most B-cell types), CD138 (as expressed in e.g., malignant plasma cells in multiple myelomas), CD56 (as expressed in e.g., myeloma cells, neural cells, natural killer cells, T cells, and trabecular osteoblasts) CD38 (as expressed in e.g., B-cell/T-cells) and CD160 (as expressed in e.g., NK cells/T-cells), and the like. Examples of solid tumor antigens include, e.g., B7H3 (as expressed in e.g., Sarcoma, glioma), CAIX (as expressed in e.g., Kidney), CD44 v6/v7 (as expressed in e.g., Cervical cancer), CD171 (as expressed in e.g., Neuroblastoma), CEA (as expressed in e.g., Colon), EGFRvIII (as expressed in e.g., Glioma), EGP2 (as expressed in e.g., Carcinomas), EGP40 (as expressed in e.g., Colon), EphA2 (as expressed in e.g., Glioma, lung), ErbB2(HER2) (as expressed in e.g., Breast, lung, prostate, glioma), ErbB receptor family (as expressed in e.g., Breast, lung, prostate, glioma), ErbB3/4 (as expressed in e.g., Breast, ovarian), HLA-A1/MAGE1 (as expressed in e.g., Melanoma), HLA-A2/NY-ESO-1 (as expressed in e.g., Sarcoma, melanoma), FR-a (as expressed in e.g., Ovarian), FAP† (as expressed in e.g., Cancer associated fibroblasts), FAR (as expressed in e.g., Rhabdomyosarcoma), GD2 (as expressed in e.g., Neuroblastoma, sarcoma, melanoma), GD3 (as expressed in e.g., Melanoma, lung cancer), HMW-MAA (as expressed in e.g., Melanoma), IL11Ra (as expressed in e.g., Osteosarcoma), IL13Ra2 (as expressed in e.g., Glioma), Lewis Y (as expressed in e.g., Breast/ovarian/ pancreatic), Mesothelin (as expressed in e.g., Mesothelioma, breast, pancreas), Muc1 (as expressed in e.g., Ovarian, breast, prostate), NCAM (as expressed in e.g., Neuroblastoma, colorectal), NKG2D ligands (as expressed in e.g., Ovarian, sacoma), PSCA (as expressed in e.g., Prostate, pancreatic), PSMA (as expressed in e.g., Prostate), TAG72 (as expressed in e.g., Colon), VEGFR-2 (as expressed in e.g., Tumor vasculature), Axl (as expressed in e.g., Lung cancer), Met (as expressed in e.g., Lung cancer), α5β3 (as expressed in e.g., Tumor vasculature), α5β1 (as expressed in e.g., Tumor vasculature), TRAIL-R1/TRAIL-R2 (as expressed in e.g., Solid tumors (colon, lung, pancreas) and hematological malignancies), RANKL (as expressed in e.g., Prostate cancer and bone metastases), Tenacin (as expressed in e.g., Glioma, epithelial tumors (breast, prostate)), EpCAM (as expressed in e.g., Epithelial tumors (breast, colon, lung)), CEA (as expressed in e.g., Epithelial tumors (breast, colon, lung)), gpA33 (as expressed in e.g., Colorectal carcinoma), Mucins (as expressed in e.g., Epithelial tumors (breast, colon, lung, ovarian)), TAG-72 (as expressed in e.g., Epithelial tumors (breast, colon, lung)), EphA3 (as expressed in e.g., Lung, kidney, melanoma, glioma, hematological malignancies) and IGF1R (as expressed in e.g., Lung, breast, head and neck, prostate, thyroid, glioma). Examples of surface and intracellular antigens include, e.g., Her2 (gene symbol ERBB2), MAGE-A1 (gene symbol MAGEA1), MART-1 (gene symbol MLANA), NY-ESO (gene symbol CTAG1), WT1 (gene symbol WT1), MUC17 and MUC13. Examples of other antigens include, e.g., BCMA (gene symbol TNFRSF17), B7H6 (gene symbol NCR3LG1), CAIX (gene symbol CA9), CD123 (gene symbol IL3RA), CD138 (gene symbol SDC1), CD171 (gene symbol L1CAM), CD19 (gene symbol CD19), CD20 (gene symbol CD20), CD22 (gene symbol CD22), CD30 (gene symbol TNFRSF8), CD33 (gene symbol CD33), CD38 (gene symbol CD38), CD44, splice variants incl 7 and 8 (denoted vX in literature) (gene symbol CD44), CEA, CS1 (gene symbol SLAMF7), EGFRvIII (gene symbol EGFR, vIII deletion variant), EGP2, EGP40 (gene symbol EPCAM), Erb family member (gene symbol ERBB1, ERBB2, ERBB3, ERBB4), FAP (gene symbol FAP), fetal acetylcholine receptor (gene symbol AChR), Folate receptor alpha (gene symbol FOLR1), Folate receptor beta (gene symbol FOLR2), GD2, GD3, GPC3 (gene symbol GPC3), Her2/neu (gene symbol ERBB2), IL-13Ra2 (gene symbol IL13RA2), Kappa light chain (gene symbol IGK), Lewis-Y, Mesothelin (gene symbol MSLN), Mucin-1 (gene symbol MUC1), Mucin-16 (gene symbol MUC16), NKG2D ligands, prostate specific membrane antigen (PSMA) (gene symbol FOLH1), prostate stem cell antigen (PSCA) (gene symbol PSCA), receptor tyrosine kinase-like orphan receptor 1 (gene symbol ROR1), and Anaplastic Lymphoma Receptor Tyrosine Kinase (gene symbol ALK).

In some cases, useful third antigens may include an antigen selected from Table 3 above.

Useful three antigen combinations may or may not include a clinical antigen as an added "third antigen". For example, in some instances, a useful three antigen combination may include a clinical antigen and two or more antigens that provide AND NOT functionality, including e.g., the combinations including a clinical antigen and two tissue specific AND NOT antigens (e.g., brain tissue and cardiac tissue) as described in more detail below. In some cases, useful three antigen combinations may not include a clinical antigen. Useful three antigen combinations may include various logic combinations including but not limited to e.g., antigen 1 AND antigen 2 AND antigen 3, antigen 1 AND antigen 2 AND NOT antigen 3, antigen 1 AND NOT antigen 2 AND NOT antigen 3, and the like. In some instances, the logic of a three antigen combination may be complex where "complex" logic, as used herein, refers to combinations having multiple positive prediction nodes in the associated tree or, e.g., where the logic contains one or more OR propositions. In some instances, useful three antigen combinations include those depicted in FIG. 15.

In some cases, useful three antigen combinations include an antigen combination that includes a clinical antigen in combination with two or more tissue antigens (e.g., a first antigen expressed in normal tissue, e.g., normal brain tissue, and a second antigen expressed in normal tissue, e.g., normal cardiac tissue) in a double AND NOT gate (i.e., clinical antigen AND NOT normal tissue antigen 1 AND NOT normal tissue antigen 2).

For example, useful antigen combinations may include a MAGEA1 (SEQ ID NO:3191) clinical antigen AND NOT a cardiac tissue specific antigen (such as GJA3 (SEQ ID NO:4854), HCN4 (SEQ ID NO:3292) or BMP10 (SEQ ID NO:3945)) AND NOT a brain tissue antigen selected from: OPALIN (SEQ ID NO:833), TMEM235 (SEQ ID NO:1869), GABRA1 (SEQ ID NO:262), KCNJ9 (SEQ ID NO:3190), GRM3 (SEQ ID NO:290), SEZ6 (SEQ ID NO:1143), NTSR2 (SEQ ID NO:3753), KCNK4 (SEQ ID NO:5486), SLCO1A2 (SEQ ID NO:7290), SLC24A2 (SEQ ID NO:4632), MOG (SEQ ID NO:528), GABRG1 (SEQ ID NO:6354), GABRG2 (SEQ ID NO:272), CNTNAP4 (SEQ ID NO:5492), DSCAM (SEQ ID NO:2354), CACNG3 (SEQ ID NO:3510), CRB1 (SEQ ID NO:6891), CDH10 (SEQ ID NO:3552), HRH3 (SEQ ID NO:3657), GRIK1 (SEQ ID NO:280), SLC39A12 (SEQ ID NO:1826), GPR158 (SEQ ID NO:4716), CACNG2 (SEQ ID NO:3430), SYT3 (SEQ ID NO:7410), HTR5A (SEQ ID NO:4993), CACNG7 (SEQ ID NO:5264), GPR37L1 (SEQ ID NO:3118), LRRTM3 (SEQ ID NO:7362), GLRA2 (SEQ ID NO:1281), CHRNB2 (SEQ ID NO:228), KCNQ2 (SEQ ID NO:3067), JPH3 (SEQ ID NO:4690), GPR19 (SEQ ID NO:3446), ADCY8 (SEQ ID NO:1248), SPOCK3 (SEQ ID NO:845), SLC32A1 (SEQ ID NO:5606), OPCML (SEQ ID NO:594), GABRA3 (SEQ ID NO:264), GRM5 (SEQ ID NO:292), SCN1A (SEQ ID NO:2133), SLC5A11 (SEQ ID NO:5546), KCNC1 (SEQ ID NO:1249), SLC12A5 (SEQ ID NO:1506), GRM4 (SEQ ID NO:291), GRM1 (SEQ ID NO:288), GRIA4 (SEQ ID NO:279), MEGF11 (SEQ ID NO:5354), CACNA1B (SEQ ID NO:211), LYPD1 (SEQ ID NO:970), GRID2 (SEQ ID NO:2398), SCN2A (SEQ ID NO:842), NKAIN2 (SEQ ID NO:864), UNC5A (SEQ ID NO:5690), SLC4A10 (SEQ ID NO:7421), TMEFF2 (SEQ ID NO:4183), CSMD3 (SEQ ID NO:5532), PPAPDC1A (SEQ ID NO:715), HAPLN4 (SEQ ID NO:4968), GPR85 (SEQ ID NO:1920), ANTXR2 (SEQ ID NO:1876), CACNG4 (SEQ ID NO:3934), CSPG5 (SEQ ID NO:3516), KCNK10 (SEQ ID NO:4784), CHRNA4 (SEQ ID NO:225), CNTNAP2 (SEQ ID NO:3871), KCNJ10 (SEQ ID NO:2597), GABRB2 (SEQ ID NO:269), GRIN1 (SEQ ID NO:282), CRB2 (SEQ ID NO:6381), SHISA7 (SEQ ID NO:7406), NKAIN4 (SEQ ID NO:6122), HTR2C (SEQ ID NO:301), CACNG8 (SEQ ID NO:5263), NRG3 (SEQ ID NO:569), ABCG4 (SEQ ID NO:1668), CDH8 (SEQ ID NO:2476), GABRD (SEQ ID NO:271), KIRREL3 (SEQ ID NO:2022), GABRB1 (SEQ ID NO:268), KCNA2 (SEQ ID NO:3181), CDH20 (SEQ ID NO:5261), IGDCC3 (SEQ ID NO:3159), KCNJ6 (SEQ ID NO:2596), CNIH2 (SEQ ID NO:6658), KCNK12 (SEQ ID NO:7295), CDH18 (SEQ ID NO:2192), CSMD2 (SEQ ID NO:5530), SYT4 (SEQ ID NO:4722), OR2L13 (SEQ ID NO:6468), CDH9 (SEQ ID NO:4198), GABRA2 (SEQ ID NO:263), KCNF1 (SEQ ID NO:2592), MAG (SEQ ID NO:2634), CALN1 (SEQ ID NO:645), GRIN2B (SEQ ID NO:284), GRM7 (SEQ ID NO:294), VSTM2A (SEQ ID NO:7459), GPR61 (SEQ ID NO:5271), OMG (SEQ ID NO:2672), KCNA1 (SEQ ID NO:66), GPR83 (SEQ ID NO:4239), ATP8A2 (SEQ ID NO:4237), GABBR2 (SEQ ID NO:3288), GPR12 (SEQ ID NO:3255), TRPM3 (SEQ ID NO:519), SLC8A3 (SEQ ID NO:1424), KCND2 (SEQ ID NO:7288), GSG1L (SEQ ID NO:1236), SLC30A10 (SEQ ID NO:4487), ASTN1 (SEQ ID NO:3016), GPR179 (SEQ ID NO:7447), LRFN2 (SEQ ID NO:4711), CACNA1E (SEQ ID NO:214), CALY (SEQ ID NO:4119), SLC6A15 (SEQ ID NO:1932), KIAA0319 (SEQ ID NO:2227), SYT6 (SEQ ID NO:6957), PTPRR (SEQ ID NO:2724), KCTD8 (SEQ ID NO:7331), GPR22 (SEQ ID NO:3261), SLC4A8 (SEQ ID NO:818), LAMP5 (SEQ ID NO:3729), MEGF10 (SEQ ID NO:5355), FXYD7 (SEQ ID NO:4864), KCNK9 (SEQ ID NO:4257), SLC1A6 (SEQ ID NO:3206), MLC1 (SEQ ID NO:4042), OPRK1 (SEQ ID NO:325), ATP2B2 (SEQ ID NO:353), ACSL6 (SEQ ID NO:560), THBD (SEQ ID NO:108), PTPRT (SEQ ID NO:3622), PCDHGC4 (SEQ ID NO:2688), CLDN10 (SEQ ID NO:1975), KCNV1 (SEQ ID NO:3925), LPPR3 (SEQ ID NO:5096), SLCO1C1 (SEQ ID NO:1885), PCDH8 (SEQ ID NO:2690), ANO4 (SEQ ID NO:6566), LRRTM4 (SEQ ID NO:1505), PCDH15 (SEQ ID NO:1688), CCKBR (SEQ ID NO:6481), GABRA5 (SEQ ID NO:266), SLC6A12 (SEQ ID NO:1290), GRIN2A (SEQ ID NO:283), SLC1A2 (SEQ ID NO:2977), SLC43A1 (SEQ ID NO:2856), KCNC2 (SEQ ID NO:5836), ELFN2 (SEQ ID NO:5534), ATP7A (SEQ ID NO:10), GRIK4 (SEQ ID NO:3965), LRRC55 (SEQ ID NO:448), HCN2 (SEQ ID NO:7377), NKAIN1 (SEQ ID NO:5039), DPP10 (SEQ ID NO:432), AJAP1 (SEQ ID NO:894), NPFFR1 (SEQ ID NO:4886), TRPC3 (SEQ ID NO:1434), TGFBI (SEQ ID NO:107), SLC6A7 (SEQ ID NO:7370), GABRA4 (SEQ ID NO:265), SLC13A5 (SEQ ID NO:1732), GRIN2C (SEQ ID NO:285), HCN1 (SEQ ID NO:4763), SLC26A8 (SEQ ID NO:5552), PPIC (SEQ ID NO:336), NETO1 (SEQ ID NO:7427), TNFRSF10B (SEQ ID NO:2910), CDH22 (SEQ ID NO:4803), SLC6A13 (SEQ ID NO:4264), DISP2 (SEQ ID NO:7320), SLC6A11 (SEQ ID NO:3890), CD93 (SEQ ID NO:3698), EPHA10 (SEQ ID NO:1160), PHLDB2 (SEQ ID NO:1490), OXTR (SEQ ID NO:7326), WNT7A (SEQ ID NO:3089), GYPC (SEQ ID NO:7432), KCNA4 (SEQ ID NO:2589), PCDHAC2 (SEQ ID NO:4498), HGFAC (SEQ ID NO:2405), DRD1 (SEQ ID NO:253), SHISA9 (SEQ ID NO:7418), SCN8A (SEQ ID NO:3879), ICAM1 (SEQ ID NO:7382), PIRT (SEQ ID NO:1201), A4GALT (SEQ ID NO:4291), MRGPRF (SEQ ID NO:1129), CD248 (SEQ ID NO:4649), CD58 (SEQ ID NO:7405), CD44 (SEQ ID NO:172), EPHA2 (SEQ ID NO:3042) or PROCR (SEQ ID NO:3480). In some instances, such antigen combinations may be useful in targeting melanoma.

Useful antigen combinations may include a MAGEA3 (SEQ ID NO:7279) clinical antigen AND NOT a cardiac tissue specific antigen (such as GJA3 (SEQ ID NO:4854), HCN4 (SEQ ID NO:3292) or BMP10 (SEQ ID NO:3945)) AND NOT a brain tissue antigen selected from: OPALIN (SEQ ID NO:833), TMEM235 (SEQ ID NO:1869), GABRA1 (SEQ ID NO:262), KCNJ9 (SEQ ID NO:3190), GRM3 (SEQ ID NO:290), SEZ6 (SEQ ID NO:1143), NTSR2 (SEQ ID NO:3753), KCNK4 (SEQ ID NO:5486), SLCO1A2 (SEQ ID NO:7290), SLC24A2 (SEQ ID NO:4632), MOG (SEQ ID NO:528), GABRG1 (SEQ ID NO:6354), GABRG2 (SEQ ID NO:272), CNTNAP4 (SEQ ID NO:5492), DSCAM (SEQ ID NO:2354), CACNG3 (SEQ ID NO:3510), CRB1 (SEQ ID NO:6891), CDH10 (SEQ ID NO:3552), HRH3 (SEQ ID NO:3657), GRIK1 (SEQ ID NO:280), SLC39A12 (SEQ ID NO:1826), GPR158 (SEQ ID NO:4716), CACNG2 (SEQ ID NO:3430), SYT3 (SEQ ID NO:7410), HTR5A (SEQ ID NO:4993), CACNG7 (SEQ ID NO:5264), GPR37L1 (SEQ ID NO:3118), LRRTM3 (SEQ ID NO:7362), GLRA2 (SEQ ID NO:1281), CHRNB2 (SEQ ID NO:228), KCNQ2 (SEQ ID NO:3067), JPH3 (SEQ ID NO:4690), GPR19 (SEQ ID NO:3446), ADCY8 (SEQ ID NO:1248), SPOCK3 (SEQ ID NO:845), SLC32A1 (SEQ ID NO:5606), OPCML (SEQ ID NO:594), GABRA3 (SEQ ID NO:264), GRM5 (SEQ ID NO:292), SCN1A (SEQ ID NO:2133), SLC5A11 (SEQ ID NO:5546), KCNC1 (SEQ ID NO:1249), SLC12A5 (SEQ ID NO:1506), GRM4 (SEQ ID NO:291), GRM1 (SEQ ID NO:288), GRIA4 (SEQ ID NO:279), MEGF11 (SEQ ID NO:5354), CACNA1B (SEQ ID NO:211), LYPD1 (SEQ ID NO:970), GRID2 (SEQ ID NO:2398), SCN2A (SEQ ID NO:842), NKAIN2 (SEQ ID NO:864), UNC5A (SEQ ID NO:5690), SLC4A10 (SEQ ID NO:7421), TMEFF2 (SEQ ID NO:4183), CSMD3 (SEQ ID NO:5532), PPAPDC1A (SEQ ID NO:715), HAPLN4 (SEQ ID NO:4968), GPR85 (SEQ ID NO:1920), ANTXR2 (SEQ ID NO:1876), CACNG4 (SEQ ID NO:3934), CSPG5 (SEQ ID NO:3516), KCNK10 (SEQ ID NO:4784), CHRNA4 (SEQ ID NO:225), CNTNAP2 (SEQ ID NO:3871), KCNJ10 (SEQ ID NO:2597), GABRB2 (SEQ ID NO:269), GRIN1 (SEQ ID NO:282), CRB2 (SEQ ID NO:6381), SHISA7 (SEQ ID NO:7406), NKAIN4 (SEQ ID NO:6122), HTR2C (SEQ ID NO:301), CACNG8 (SEQ ID NO:5263), NRG3 (SEQ ID NO:569), ABCG4 (SEQ ID NO:1668), CDH8 (SEQ ID NO:2476), GABRD (SEQ ID NO:271), KIRREL3 (SEQ ID NO:2022), GABRB1 (SEQ ID NO:268), KCNA2 (SEQ ID NO:3181), CDH20 (SEQ ID NO:5261), IGDCC3 (SEQ ID NO:3159), KCNJ6 (SEQ ID NO:2596), CNIH2 (SEQ ID NO:6658), KCNK12 (SEQ ID NO:7295), CDH18 (SEQ ID NO:2192), CSMD2 (SEQ ID NO:5530), SYT4 (SEQ ID NO:4722), OR2L13 (SEQ ID NO:6468), CDH9 (SEQ ID NO:4198), GABRA2 (SEQ ID NO:263), KCNF1 (SEQ ID NO:2592), MAG (SEQ ID NO:2634), CALN1 (SEQ ID NO:645), GRIN2B (SEQ ID NO:284), GRM7 (SEQ ID NO:294), VSTM2A (SEQ ID NO:7459), GPR61 (SEQ ID NO:5271), OMG (SEQ ID NO:2672), KCNA1 (SEQ ID NO:66), GPR83 (SEQ ID NO:4239), ATP8A2 (SEQ ID NO:4237), GABBR2 (SEQ ID NO:3288), GPR12 (SEQ ID NO:3255), TRPM3 (SEQ ID NO:519), SLC8A3 (SEQ ID NO:1424), KCND2 (SEQ ID NO:7288), GSG1L (SEQ ID NO:1236), SLC30A10 (SEQ ID NO:4487), ASTN1 (SEQ ID NO:3016), GPR179 (SEQ ID NO:7447), LRFN2 (SEQ ID NO:4711), CACNA1E (SEQ ID NO:214), CALY (SEQ ID NO:4119), SLC6A15 (SEQ ID NO:1932), KIAA0319 (SEQ ID NO:2227), SYT6 (SEQ ID NO:6957), PTPRR (SEQ ID NO:2724), KCTD8 (SEQ ID NO:7331), GPR22 (SEQ ID NO:3261), SLC4A8 (SEQ ID NO:818), LAMP5 (SEQ ID NO:3729), MEGF10 (SEQ ID NO:5355), FXYD7 (SEQ ID NO:4864), KCNK9 (SEQ ID NO:4257), SLC1A6 (SEQ ID NO:3206), MLC1 (SEQ ID NO:4042), OPRK1 (SEQ ID NO:325), ATP2B2 (SEQ ID NO:353), ACSL6 (SEQ ID NO:560), THBD (SEQ ID NO:108), PTPRT (SEQ ID NO:3622), PCDHGC4 (SEQ ID NO:2688), CLDN10 (SEQ ID NO:1975), KCNV1 (SEQ ID NO:3925), LPPR3 (SEQ ID NO:5096), SLCO1C1 (SEQ ID NO:1885), PCDH8 (SEQ ID NO:2690), ANO4 (SEQ ID NO:6566), LRRTM4 (SEQ ID NO:1505), PCDH15 (SEQ ID NO:1688), CCKBR (SEQ ID NO:6481), GABRA5 (SEQ ID NO:266), SLC6A12 (SEQ ID NO:1290), GRIN2A (SEQ ID NO:283), SLC1A2 (SEQ ID NO:2977), SLC43A1 (SEQ ID NO:2856), KCNC2 (SEQ ID NO:5836), ELFN2 (SEQ ID NO:5534), ATP7A (SEQ ID NO:10), GRIK4 (SEQ ID NO:3965), LRRC55 (SEQ ID NO:448), HCN2 (SEQ ID NO:7377), NKAIN1 (SEQ ID NO:5039), DPP10 (SEQ ID NO:432), AJAP1 (SEQ ID NO:894), NPFFR1 (SEQ ID NO:4886), TRPC3 (SEQ ID NO:1434), TGFBI (SEQ ID NO:107), SLC6A7 (SEQ ID NO:7370), GABRA4 (SEQ ID NO:265), SLC13A5 (SEQ ID NO:1732), GRIN2C (SEQ ID NO:285), HCN1 (SEQ ID NO:4763), SLC26A8 (SEQ ID NO:5552), PPIC (SEQ ID NO:336), NETO1 (SEQ ID NO:7427), TNFRSF10B (SEQ ID NO:2910), CDH22 (SEQ ID NO:4803), SLC6A13 (SEQ ID NO:4264), DISP2 (SEQ ID NO:7320), SLC6A11 (SEQ ID NO:3890), CD93 (SEQ ID NO:3698), EPHA10 (SEQ ID NO:1160), PHLDB2 (SEQ ID NO:1490), OXTR (SEQ ID NO:7326), WNT7A (SEQ ID NO:3089), GYPC (SEQ ID NO:7432), KCNA4 (SEQ ID NO:2589), PCDHAC2 (SEQ ID NO:4498), HGFAC (SEQ ID NO:2405), DRD1 (SEQ ID NO:253), SHISA9 (SEQ ID NO:7418), SCN8A (SEQ ID NO:3879), ICAM1 (SEQ ID NO:7382), PIRT (SEQ ID NO:1201), A4GALT (SEQ ID NO:4291), MRGPRF (SEQ ID NO:1129), CD248 (SEQ ID NO:4649), CD58 (SEQ ID NO:7405), CD44 (SEQ ID NO:172), EPHA2 (SEQ ID NO:3042) or PROCR (SEQ ID NO:3480). In some instances, such antigen combinations may be useful in targeting melanoma.

Methods of Killing Target Cancer Cells

The present disclosure provides methods for killing a target cancer cell. The present disclosure provides a method of killing a target cancer cell in an individual. In some cases, a method of the present disclosure for killing a target cell in an individual comprises: a) introducing a system of the present disclosure into an immune cell (e.g., a CD8$^+$ T cell; an NK cell) obtained from the individual, generating a modified immune cell; and b) administering the modified immune cell to the individual, where the modified immune cell kills the target cancer cell in the individual. In some cases, the modified cytotoxic T cell does not substantially kill non-target cells such as non-cancerous cells.

Example 1 provides an example of a method of killing a liposarcoma in an individual; and Example 2 provides an example of a method of killing a glioblastoma in an individual. This example is illustrative of how a CD8$^+$ cell (or other immune cell) genetically modified to express first and second antigen-triggered polypeptides targeting any of the target antigen pairs depicted in FIG. 1 or FIG. 9-14 to target the corresponding cancer cells listed in FIG. 1 or FIG. 9-14, can be used to kill a target cancer cell in an individual, and thereby to treat the cancer in the individual.

The present disclosure provides a method of killing a target cancer cell in an individual. In some cases, a method of the present disclosure for killing a target cell in an individual comprises administering a genetically modified cytotoxic immune cell (e.g., a genetically modified CD8$^+$ T cell; a genetically modified NK cell) of the present disclosure to the individual, where the genetically modified immune cell kills the target cancer cell in the individual. In some cases, the modified cytotoxic T cell does not substantially kill non-target cells such as non-cancerous cells.

Where the target antigen pair targeted by a method of the present disclosure is an AND-NOT gate target antigen pair, a method of the present disclosure provides for killing of a target cancer cell, but not a non-cancerous cell. For example, in some cases, a method of the present disclosure provides for a ratio of killing of cancer cells to non-cancerous cells of at least 10:1, at least 15:1, at least 20:1 at least 25:1, at least 50:1, at least 100:1, at least 500:1, at least $10^3$:1, at least $10^4$:1, or at least $10^5$:1.

Where the target antigen pair targeted by a method of the present disclosure is an AND gate target antigen pair, a method of the present disclosure provides for highly specific killing of a target cancer cell, and not a non-target (e.g., non-cancerous cell). For example, in some cases, a method of the present disclosure provides for a ratio of killing of cancer cells to non-cancerous cells of at least 10:1, at least 15:1, at least 20:1 at least 25:1, at least 50:1, at least 100:1, at least 500:1, at least $10^3$:1, at least $10^4$:1, or at least $10^5$:1.

Methods Comprising Use of a System of the Present Disclosure

As noted above, in some cases, a method of the present disclosure for killing a target cell in an individual comprises: a) introducing a system of the present disclosure into an immune cell (e.g., a CD8$^+$ T cell; an NK cell) obtained from the individual, generating a modified immune cell; and b) administering the modified immune cell to the individual, where the modified immune cell kills the target cancer cell in the individual. In some cases, the modified cytotoxic T cell does not substantially kill non-target cells such as non-cancerous cells.

T cells can be obtained from an individual (e.g., an individual having a cancer; an individual diagnosed as having a cancer; an individual being treated for a cancer with chemotherapy, radiation therapy, antibody therapy, surgery, etc.) using well-established methods. In some cases, a mixed population of cells is obtained from an individual; and CD8$^+$ T cells and/or NK cells are isolated from the mixed population, such that a population of CD8$^+$ T cells and/or NK cells is obtained that is at least 75%, at least 80%, at least 85%, at least 90%, at least 95%, or more than 98% pure, i.e., the purified cell population includes less than 25%, less than 20%, less than 15%, less than 10%, less than 5%, or less than 2%, of cells other than CD8$^+$ T cells and or NK cells. A system of the present disclosure is then introduced into the purified CD8$^+$ T cells and/or NK cells, to generate modified CD8$^+$ T cells and/or modified NK cells that express the first antigen-triggered polypeptide and the second antigen-triggered polypeptide.

In some cases, as noted above, a system of the present disclosure comprises: a) a first antigen-triggered polypeptide that binds specifically to a first target antigen present on a target cancer cell; and b) a second antigen-triggered polypeptide that binds specifically to a second target antigen. In these instances, the polypeptides per se are introduced into an immune cell (e.g., CD8$^+$ T cells and/or NK cells obtained from an individual). Methods of introducing polypeptides into a cell are known in the art; and any known method can be used. For example, in some cases, the first and the second antigen-triggered polypeptides comprise a protein transduction domain (PTD) at the N-terminus or the C-terminus of the polypeptides.

In some cases, as noted above, a system of the present disclosure comprises: a) a first nucleic acid comprising a nucleotide sequence encoding a first antigen-triggered polypeptide that binds specifically to a first target antigen present on a target cancer cell; and b) a second nucleic acid comprising a nucleotide sequence encoding a second antigen-triggered polypeptide that binds specifically to a second target antigen. In some cases, the first and the second antigen-triggered polypeptides are encoded by nucleotide sequences on separate nucleic acids. In other cases, the first and the second antigen-triggered polypeptides are encoded by nucleotide sequences present in the same nucleic acid. In some cases, the nucleic acid is a recombinant expression vector. In some cases, a system of the present disclosure comprises: a) a first recombinant expression vector comprising a nucleotide sequence encoding a first antigen-triggered polypeptide that binds specifically to a first target antigen present on a target cancer cell; and b) a second recombinant expression vector comprising a nucleotide sequence encoding a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter. In some cases, a system of the present disclosure comprises a recombinant expression vector comprising nucleotide sequences encoding: a) a first antigen-triggered polypeptide that binds specifically to a first target antigen present on a target cancer cell; and b) a second antigen-triggered polypeptide that binds specifically to a second target antigen. In some cases, the nucleotide sequences are operably linked to a constitutive promoter. In some cases, the nucleotide sequences are operably linked to a regulatable promoter (e.g., an inducible promoter, a reversible promoter, etc.). In some cases, the nucleotide sequences are operably linked to an immune cell promoter, e.g., a T-cell specific promoter. Suitable promoters include, but are not limited to; cytomegalovirus immediate early promoter; herpes simplex virus thymidine kinase promoter; early and late SV40 promoters; promoter present in long terminal repeats from a retrovirus; a metallothionein-I promoter; and various art-known promoters. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

In some instances, nucleic acids present in a system of the present disclosure include immune cell specific promoters that are expressed in one or more immune cell types, including but not limited to lymphocytes, hematopoietic stem cells and/or progeny thereof (i.e., immune cell progenitors), etc. Any convenient and appropriate promoter of an immune cell specific gene may find use in nucleic acids of the present disclosure. In some instances, an immune cell specific promoter of a nucleic acid present in a system of the present disclosure may be a T cell specific promoter. In some instances, an immune cell specific promoter of a nucleic acid present in a system of the present disclosure may be a light and/or heavy chain immunoglobulin gene promoter and may or may not include one or more related enhancer elements.

In some instances, an immune cell specific promoter of a nucleic acid present in a system of the present disclosure may be a promoter of a B29 gene promoter, a CD14 gene promoter, a CD43 gene promoter, a CD45 gene promoter, a CD68 gene promoter, a IFN-β gene promoter, a WASP gene promoter, a T-cell receptor β-chain gene promoter, a V9 γ (TRGV9) gene promoter, a V2 δ (TRDV2) gene promoter, and the like.

In some instances, an immune cell specific promoter present in a system of a nucleic acid of the present disclosure may be a viral promoter expressed in immune cells. As such, in some instances, viral promoters useful in nucleic acids present in a system of the present disclosure include viral promoters derived from immune cells viruses, including but not limited to, e.g., lentivirus promoters (e.g., human immunodeficiency virus (HIV), SIV, FIV, EIAV, or Visna promoters) including e.g., long terminal repeat (LTR) promoter, etc., Retroviridae promoters including, e.g., HTLV-I promoter, HTLV-II promoter, etc., and the like.

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) *Proc. Natl. Acad. Sci. USA* 90:7739; and Marodon et al. (2003) *Blood* 101:3416. As another example, a CD8 gene promoter can be used. NK cell-specific expression can be achieved by use of an Ncr1 (p46) promoter; see, e.g., Eckelhart et al. (2011) *Blood* 117:1565.

Expression vectors generally have convenient restriction sites located near the promoter sequence to provide for the insertion of nucleic acid sequences encoding heterologous proteins. A selectable marker operative in the expression host may be present. Suitable recombinant expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

A method of the present disclosure for killing a target cell in an individual comprising: a) introducing a system of the present disclosure into an immune cell (e.g., a $CD8^+$ T cell; an NK cell) obtained from the individual, generating a modified immune cell; and b) administering the modified immune cell to the individual, where the modified immune cell kills the target cancer cell in the individual, involves administering an effective amount of the modified immune cells to the individual.

In some cases, an effective amount (e.g., an effective number) of modified immune cells is an amount that, when administered in one or more doses to an individual having a cancer, decreases the number of cancer cells in the individual by at least about 10%, at least about 15%, at least about 20%, at least about 25%, at least about 30%, at least about 40%, at least about 50%, at least about 75%, at least about 80%, at least about 90%, at least about 95%, or at least 98%, compared to the number of cancer cells in the individual before said administration.

In some cases, from about $10^2$ to about $10^9$ modified immune cells are administered to an individual in a single dose. In some cases, a single dose of modified immune cells disclosure contains from $10^2$ to about $10^4$, from about $10^4$ to about $10^5$, from about $10^5$ to about $10^6$, from about $10^6$ to about $10^7$, from about $10^7$ to about $10^8$, or from about $10^8$ to about $10^9$ modified immune cells. In some cases, a single dose of modified immune cells is administered. Multiple doses can also be administered, as needed and/or as determined by a medical professional. For example, 2, 3, 4, 5, 6, 7, 8, 9, 10, or more than 10, doses can be administered. If multiple doses are administered, the multiple doses can be administered at various frequencies, including, e.g., once per week, twice per month, once per month, once every 2 months, once every 3 months, once every 4 months, once every 6 months, or once per year.

In some cases, the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an acute myeloid leukemia (AML) cell, a stomach cancer cell, a B-cell cancer cell, a lung cancer cell, or an oligodendroglioma.

Methods Comprising Use of a Genetically Modified Cytotoxic T Cell of the Present Disclosure As noted above, in some cases, a method of the present disclosure for killing a target cell in an individual comprises administering a genetically modified cytotoxic immune cell (e.g., a genetically modified CD8+ T cell; a genetically modified NK cell) of the present disclosure to the individual, where the genetically modified immune cell kills the target cancer cell in the individual. In some cases, the modified cytotoxic T cell does not substantially kill non-target cells such as non-cancerous cells.

T cells can be obtained from an individual (e.g., an individual having a cancer; an individual diagnosed as having a cancer; an individual being treated for a cancer with chemotherapy, radiation therapy, antibody therapy, surgery, etc.) using well-established methods. In some cases, a mixed population of cells is obtained from an individual; and CD8+ T cells and/or NK cells are isolated from the mixed population, such that a population of CD8+ T cells and/or NK cells is obtained that is at least 75%, at least 80%, at least 85%, at least 90%, at least 95%, or more than 98% pure, i.e., the purified cell population includes less than 25%, less than 20%, less than 15%, less than 10%, less than 5%, or less than 2%, of cells other than CD8+ T cells and or NK cells. The purified CD8+ T cells and/or NK cells are then genetically modified to express the first antigen-triggered polypeptide and the second antigen-triggered polypeptide.

A method of the present disclosure for killing a target cell in an individual comprising administering a genetically modified cytotoxic immune cell (e.g., a genetically modified CD8+ T cell; a genetically modified NK cell) of the present disclosure to the individual involves administering an effective amount of a genetically modified cytotoxic immune cell of the present disclosure to the individual.

In some cases, an effective amount (e.g., an effective number) of genetically modified cytotoxic immune cells of the present disclosure is an amount that, when administered in one or more doses to an individual having a cancer, decreases the number of cancer cells in the individual by at least about 10%, at least about 15%, at least about 20%, at least about 25%, at least about 30%, at least about 40%, at least about 50%, at least about 75%, at least about 80%, at least about 90%, at least about 95%, or at least 98%, compared to the number of cancer cells in the individual before said administration.

In some cases, from about $10^2$ to about $10^9$ genetically modified cytotoxic immune cells of the present disclosure are administered to an individual in a single dose. In some cases, a single dose of genetically modified cytotoxic immune cells of the present disclosure contains from $10^2$ to about $10^4$, from about $10^4$ to about $10^5$, from about $10^5$ to about $10^6$, from about $10^6$ to about $10^7$, from about $10^7$ to about $10^8$, or from about $10^8$ to about $10^9$ genetically modified cytotoxic immune cells of the present disclosure. In some cases, a single dose of genetically modified cytotoxic immune cells of the present disclosure is administered. Multiple doses can also be administered, as needed and/or as determined by a medical professional. For example, 2, 3, 4, 5, 6, 7, 8, 9, 10, or more than 10, doses can be administered. If multiple doses are administered, the multiple doses can be administered at various frequencies, including, e.g., once per week, twice per month, once per month, once every 2 months, once every 3 months, once every 4 months, once every 6 months, or once per year.

In some cases, the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an acute myeloid leukemia (AML) cell, a stomach cancer cell, a B-cell cancer cell, a lung cancer cell, or an oligodendroglioma.

Individuals Suitable for Treatment

Individuals suitable for treatment using a method of the present disclosure include an individual having a cancer; an individual diagnosed as having a cancer; an individual being treated for a cancer with chemotherapy, radiation therapy, antibody therapy, surgery, etc.); an individual who has been treated for a cancer (e.g., with one or more of chemotherapy, radiation therapy, antibody therapy, surgery, etc.), and who has failed to respond to the treatment; an individual who has been treated for a cancer (e.g., with one or more of chemotherapy, radiation therapy, antibody therapy, surgery, etc.), and who initially responded to the treatment but who subsequently relapsed, i.e., the cancer recurred.

Cancers that can be treated with a method of the present disclosure include liposarcoma, glioblastoma, breast cancer, renal cancer, pancreatic cancer, melanoma, anaplastic lymphoma, leiomyosarcoma, astrocytoma, ovarian cancer, neuroblastoma, mantle cell lymphoma, sarcoma, non-small cell lung cancer, acute myeloid leukemia (AML), stomach cancer, B-cell cancer, lung cancer, and oligodendroglioma.

In some cases, an individual to which a treatment of the present disclosure is administered is an individual expressing one or more antigens relevant to the subject treatment, including e.g., one or more target (i.e., cancer) antigens and/or one or more non-target (i.e., non-cancer or normal) antigens. Antigen expression may be determined by any convenient means. For example, in some instances, a subject may be evaluated for expression (or lack thereof) of one or more antigens relevant to the subject treatment, including one or more or all of the antigens of a particular antigen combination utilized in the treatment. Such evaluations (i.e., antigen expression testing) may be performed at any convenient time before, during or after a particular treatment regimen and using any convenient sample obtained from a subject (e.g., a tissue sample, a biopsy sample, etc.). Evaluations of antigen expression may be employed predictively (e.g., to predict the efficacy of an antigen combination based therapy), concurrently (e.g., to confirm the expression of antigens of an antigen combination during therapy), retrospectively (e.g., to analyze the expression of antigens of an antigen combination after therapy, e.g., to correlate expression of treatment outcomes, e.g., as part of a clinical trial utilizing an antigen combination described herein), or the like.

Computational Methods

The instant disclosure includes computational methods of identifying antigen combinations for targeting cancer cells of various types. The computational methods will generally be based on the measured expression of a plurality of cell surface antigens and/or genes encoding cell surface antigens for a first specific population of cells relative to a second specific population of cells. For example, in some instances, the cell surface antigen expression within a population of cancer cells is measured relative to the cell surface antigen expression within a population of corresponding cells, where corresponding cells will generally be non-cancerous cells of the same type or derived from the same tissue as the cancer cells. In certain cases, gene or protein expression is compared between two tissues of the same type where one tissue contains a cancer and the other tissue is healthy or is otherwise suspected to not contain the cancer. In some cases, cell surface antigen expression within a population of cancer cells or a cancerous tissue is measured relative to the cell surface antigen expression within a population of corresponding cells or to the cell surface antigen expression within a corresponding tissue, where corresponding cells or tissue will generally be non-cancerous cells or tissue of the same type or derived from the same tissue as the cancer cells; in some cases, the non-cancerous cells (or normal tissue) are cells or tissue for which cell surface antigen expression data are publicly available. The antigen expression level(s) for a particular population of cells or tissue may be referred to as an expression dataset (e.g., a cancer tissue dataset, a normal tissue data set, a cancer cell dataset, a normal cell dataset, etc.).

Any convenient method may find use in comparing antigen expression of the cells and/or tissues, including methods for evaluating mRNA expression and methods for evaluating protein expression, including but not limited to e.g., RNA microarray methods, quantitative RNA sequencing (RNAseq) methods, quantitative polymerase chain reaction (qPCR) methods, protein microarray methods, quantitative mass-spec method, proteomics methods, and the like. In certain cases, existing data sets including but not limited to e.g., RNA microarray data sets, quantitative RNA sequencing (RNAseq) data sets, qPCR data sets, protein microarray data sets, quantitative mass-spec data sets, proteomics methods, etc., may be used in the computational methods as described herein. In some cases, a combination of two or three of these methods is used for comparing antigen expression of cells/tissues. In some instances, the data set may be a curated, including a human curated dataset or computationally annotated dataset. In some cases, single cell measurements, or micro dissected data, are used. In some cases, multiple (2, 3, 4, 5, 6, 7, 8, 9, 10, or more than 10) datasets are used. In some cases, e.g., where multiple data sets are used, each sample within each dataset is curated.

In some embodiments, an expression dataset comparing a cancerous biological sample vs. a corresponding normal biological sample may be utilized in the subject computational methods. A "biological sample" encompasses a variety of sample types obtained from an individual. The definition encompasses blood and other liquid samples of biological origin, solid tissue samples such as a biopsy specimen or tissue cultures or cells derived therefrom and the progeny thereof. The definition also includes samples that have been manipulated in any way after their procurement, such as by treatment with reagents, solubilization, microdissection, or enrichment for certain components, such as polynucleotides or polypeptides. A "biological sample" can be a single cell, or can be derived from a single cell. A "biological sample" can be a plurality of cells, or can be derived from a plurality of cells. The term "biological sample" encompasses a clinical sample, and also includes cells in culture, cell supernatants, cell lysates, serum, plasma, biological fluid, and tissue samples. The term "biological sample" includes urine, saliva, cerebrospinal fluid, interstitial fluid, ocular fluid, synovial fluid, bronchoalveolar lavage fluid, blood fractions such as plasma and serum, and the like, provided such samples contain the subject cells for which expression is to be measured. The term "biological sample" also includes solid tissue samples, tissue culture samples, and cellular samples.

Following procurement of expression datasets, whether measured de novo or obtained from a previously collected dataset or a combination thereof, the datasets will generally be normalized. In some cases, normalization is performed by computing the relative levels of expression to a reference gene or reference gene set. In some cases, normalization is performed by comparing all measurements of a dataset as a whole or globally, e.g., by computationally modeling the dataset. Useful normalization methods will vary and may include but are not limited to e.g., Single-channel array normalization (SCAN), Universal exPression Codes (UPC) normalization, and the like, as described in e.g., Piccolo et al. (2012) Genomics, 100(6), pp. 337-344; Piccolo et al. (2013) PNAS, 110(44), pp. 17778-17783; the disclosures of which are incorporated herein by reference in their entirety. Normalization may allow not only for comparison of data points within a dataset but also between two or more datasets.

An expression dataset may be used to produce parameters for a target antigen and/or target antigen pairs. Useful target antigen parameters include, but are not limited to, the relative expression levels of a particular antigen and/or the relative expression levels of a pair of antigens compared to other antigen pairs derived from the data set. Useful target antigen parameters include, but are not limited to, relative expression levels of a particular antigen on a cancer cell or cancerous tissue compared to the expression levels of the antigen on a corresponding non-cancerous cell of the same cell type or corresponding non-cancerous tissues of the same tissue type and/or relative expression levels of a pair of antigens on a cancer cell or cancerous tissue compared to their levels on a corresponding non-cancerous cell of the same cell type or corresponding non-cancerous tissues of the same tissue type.

In some cases, a portion of the data (e.g., a portion of a larger dataset) is selected for training of a processor used in generating an algorithm for identifying antigen pairs. Such a selected portion of the data (e.g., a selected portion of a larger dataset) may be referred to as a "training data set" and may include data of various types including but not limited to e.g., any of those described herein. In using a training dataset, individual antigen expression levels may be compared pairwise to identify significant differences between the datasets and/or pairs of antigen expression levels may be compared pairwise to identify significant differences between the antigen pairs of the datasets. Such comparisons may be performed iteratively using the training set and/or may be expanded to include the entire dataset or datasets. From a training set of expression data, antigens and/or antigen pairs that discriminate between cell or tissue populations (e.g., cancer vs. non-cancer) may be selected and used in generating an algorithm for selecting and/or ranking antigens and/or antigen pairs of one or more larger datasets.

In some instances, the pairing algorithm may be constrained to select one or more antigens for each pairing that meets a specified criteria including e.g., where one of the antigens is a clinical antigen (i.e., has been evaluated clinically (i.e., in an immunotherapy clinical trial) and found to be a marker for one or more cancers), where two or more of the antigens are clinical antigens, where one or more of the antigens is not a clinical antigen, where two or more of the antigens are not clinical antigens, where one of the antigens is a clinical antigen and one of the antigens is not a clinical antigen, etc. In some instances, the pairing algorithm may be constrained to select only those antigens that contain a transmembrane domain, including or excluding putative transmembrane domains. In some cases, a clinical antigen that has been the target of immunotherapy for a first cancer cell type can be identified, using a computational method of the present disclosure, as a target antigen for a second cancer cell type (i.e., a cancer cell type that is different from the first cancer cell type).

Figure 7:
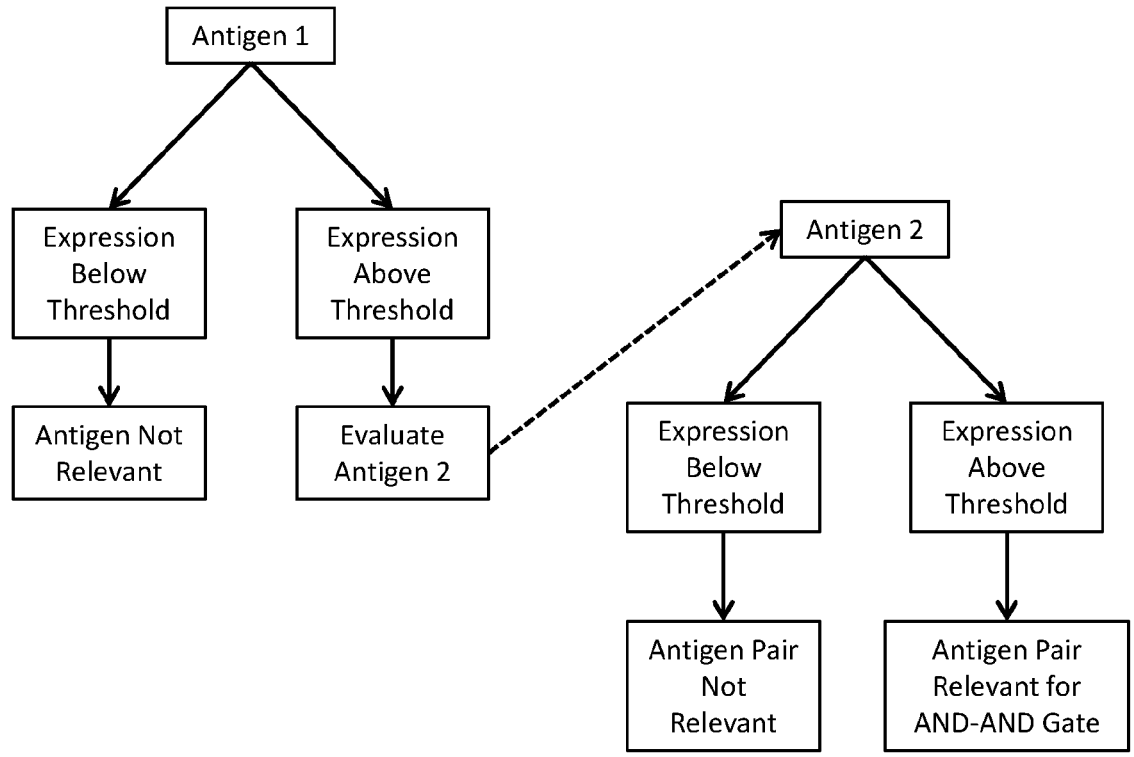
FIG. 7 provides an example of a decision tree for identifying AND gate antigen pairs.
Figure 8:
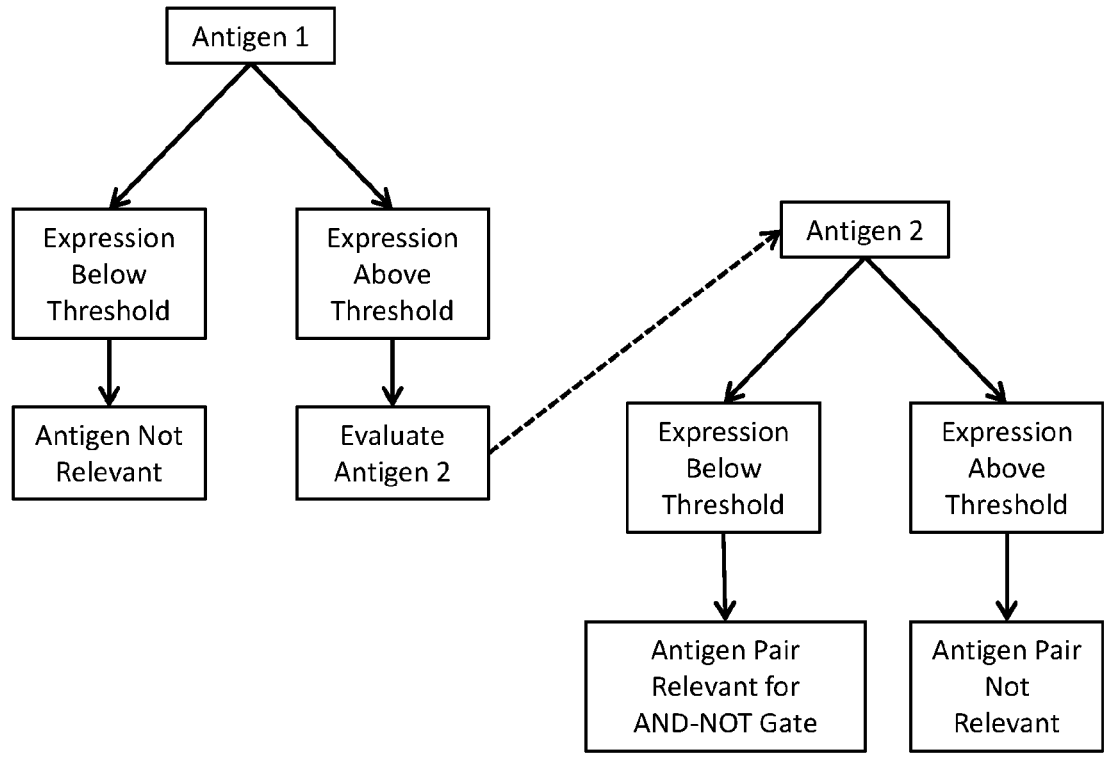
FIG. 8 provides an example of a decision tree for identifying AND-NOT gate antigen pairs.

An algorithm for identifying antigen combinations (e.g., antigen pairs) useful in antigen logic gates of the subject disclosure may include a decision-tree classifier, where the training dataset may be used to develop an algorithm that identifies a classification model that best fits the antigen parameters to the class labels (i.e., the populations) of the training dataset. Decision tree classifiers are organized as a series of test questions to separate antigens based on their different characteristics or expression parameters. The decision tree may iteratively test antigen pairs for the ability to differentiate a cancer cell from a non-cancer cell. A non-limiting examples of such decision trees are provided in FIG. 7, which schematically depicts a decision tree for identifying an AND-AND gate antigen pair, and FIG. 8, which schematically depicts a decision tree for identifying an AND-NOT gate antigen pair.

Various calculated performance measures or statistical values, and/or combinations thereof, may find use in an algorithm to identify useful antigen combinations. For example, in some instances, an algorithm, as described herein, may include a measure of the fraction of retrieved antigen combinations that are relevant (e.g., a precision statistic or a positive predictive value statistic) and/or a measure of the fraction of relevant antigen combinations that are retrieved (e.g., a recall statistic or a sensitivity statistic). In some instances, an algorithm, as described herein, may include a combined statistic of precision and recall including but not limited to e.g., the harmonic mean of precision and recall or, e.g., a F-score such as e.g., an F1 statistic, where the F1 statistic is calculated as ((the product of the precision and recall statistics) divided by (the sum or the precision and recall statistics)) multiplied by two. Precision, recall and F-score (e.g., F1 statistic), as well as various other statistical measures useful in an antigen combination determining algorithm that may be employed, include but are not limited to e.g., those described in Pizzuti et al. *Evolutionary Computation, Machine Learning and Data Mining in Bioinformatics: 9th European Conference*, EvoBIO (2011), Torino, Italy, Apr. 27-29, 2011; Lee J K, *Statistical Bioinformatics: For Biomedical and Life Science Researchers* (2011), John Wiley & Sons; Mirkin B, *Core Concepts in Data Analysis: Summarization, Correlation and Visualization* (2011) Springer Science & Business Media; Kohane et al. *Microarrays for an Integrative Genomics* (2005) MIT Press; and the like.

The precision statistic, in this context, may be used to indicate the proportion of cancer samples of those samples from the test data that are predicted to trigger a cytotoxic response. Normal samples with expression patterns that correspond to the targeted logic may count as false positives and may impact the precision score. As normal samples come not only from multiple individuals, but from a wide variety of distinct body tissues, precision can be used to describe the level of risk of unwanted off-tumor reactivity associated with a particular targeting configuration.

The recall statistic, in this context, may be used to indicate the proportion of cancer samples in the test data with expression patterns that conform to the desired targeting logic. Cancer samples in the test data with expression patterns that do not match the targeting logic may count as false negatives and impact the recall score. As tumor samples come from different tumors or patients, they reflect heterogeneity both of tumors and individuals. Therefore recall can be used to describe the efficacy or generalizability of a given targeting configuration.

An F-score (e.g., an F1 statistic) represents a combination of precision and recall, that, in this context, captures the tradeoff between safety and efficacy, and allows for a summary of the performance of different configurations along a single axis. Various constants for the F-score may be employed that will combine precision and recall in such a way as to emphasize one or the other, depending on the particular context.

Any convenient calculated statistic may be used independently or in combination as a cutoff value for computationally identifying useful antigen combinations as described herein. For example, in some instances, a precision statistic may be used as a precision cutoff in an algorithm for identifying a useful antigen combination. Useful precision cutoff values will vary depending on the particular computational method employed and may range from less than 0.7 to 1.0 including but not limited to e.g., 0.7 to 1.0, 0.75 to 1.0, 0.76 to 1, 0.77 to 1, 0.78 to 1, 0.79 to 1, 0.8 to 1, 0.81 to 1, 0.82 to 1, 0.83 to 1, 0.84 to 1, 0.85 to 1, 0.86 to 1, 0.87 to 1, 0.88 to 1, 0.89 to 1, 0.9 to 1, 0.91 to 1, 0.92 to 1, 0.93 to 1, 0.94 to 1, 0.95 to 1, 0.96 to 1, 0.97 to 1, 0.98 to 1, etc. In some cases, the precision cutoff values can range from 0.5 to 0.7 or 0.5 to 1.0; e.g., from 0.55 to 0.7, from 0.60 to 0.7, from 0.5 to 1.0, from 0.6 to 1.0, or from 0.65 to 0.7.

In some instances, a recall statistic may be used as a recall cutoff in an algorithm for identifying a useful antigen combination. Useful recall cutoff values will vary depending on the particular computational method employed and may range from less than 0.7 to 1.0 including but not limited to e.g., 0.7 to 1.0, 0.75 to 1.0, 0.76 to 1, 0.77 to 1, 0.78 to 1, 0.79 to 1, 0.8 to 1, 0.81 to 1, 0.82 to 1, 0.83 to 1, 0.84 to 1, 0.85 to 1, 0.86 to 1, 0.87 to 1, 0.88 to 1, 0.89 to 1, 0.9 to 1, 0.91 to 1, 0.92 to 1, 0.93 to 1, 0.94 to 1, 0.95 to 1, 0.96 to 1, 0.97 to 1, 0.98 to 1, etc.

In some instances, an F-score (such as an F1 statistic for example) may be used as a F1 cutoff in an algorithm for identifying a useful antigen combination. Useful F1 cutoff values will vary depending on the particular computational method employed and may range from less than 0.8 to 1.0 including but not limited to e.g., 0.8 to 1.0, 0.81 to 1, 0.82 to 1, 0.83 to 1, 0.84 to 1, 0.85 to 1, 0.86 to 1, 0.87 to 1, 0.88 to 1, 0.89 to 1, 0.9 to 1, 0.91 to 1, 0.92 to 1, 0.93 to 1, 0.94 to 1, 0.95 to 1, 0.96 to 1, 0.97 to 1, 0.98 to 1, 0.99 to 1, etc. In some cases, the F1 cutoff values can range from 0.5 to 1.0; e.g., from 0.55 to 0.7, from 0.60 to 0.7, from 0.5 to 1.0, from 0.6 to 1.0, from 0.65 to 0.8, or from 0.7 to 1.0.

In some instances, two or more statistics, including two or more different statistics may be used in combination including but not limited to e.g., 2 or more different statistics, 3 or more different statistics, 4 or more different statistics, 5 or more different statistics, 6 or more different statistics, 7 or more different statistics, 8 or more different statistics, 9 or more different statistics, 10 or more different statistics, etc.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered as below are provided. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. An in vitro or ex vivo genetically modified cytotoxic immune cell, wherein the cytotoxic immune cell is genetically modified to produce two different polypeptides that recognize two different cell surface antigens, wherein at least one of the two different cell surface antigens is present on the surface of a target cancer cell.

2. The genetically modified cytotoxic immune cell of aspect 1, wherein the two different polypeptides comprise: a) a first antigen-triggered polypeptide that binds specifically to a first target cell surface antigen present on a target cancer cell; and b) a second antigen-triggered polypeptide that binds specifically to a second target cell surface antigen.

3. The genetically modified cytotoxic immune cell of aspect 1 or aspect 2, wherein the cytotoxic immune cell is a cytotoxic T cell or a natural killer cell.

4. The genetically modified cytotoxic immune cell of any one of aspect 1-3, wherein the immune cell is activated to kill a target cancer cell only when the target cancer cell expresses both of the two different cell surface antigens on its cell surface.

5. The genetically modified cytotoxic immune cell of aspect 2 or aspect 3, wherein the cytotoxic immune cell: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface.

6. The genetically modified cytotoxic immune cell any one of aspects 2-5, wherein the first antigen-triggered polypeptide is a synNotch receptor and wherein the second antigen-triggered polypeptide is a chimeric antigen receptor (CAR). In some cases, the CAR is an ON-switch CAR.

7. The genetically modified cytotoxic immune cell any one of aspects 2-5, wherein the first antigen-triggered polypeptide is a synNotch receptor and wherein the second antigen-triggered polypeptide is a T cell receptor (TCR).

8. The genetically modified cytotoxic immune cell any one of aspects 2-5, wherein the first antigen-triggered polypeptide is a CAR, and wherein the second antigen-triggered polypeptide is an iCAR.

9. The genetically modified cytotoxic immune cell any one of aspects 2-5, wherein the first antigen-triggered polypeptide is a CAR, and wherein the second antigen-triggered polypeptide is a synNotch receptor.

10. The genetically modified cytotoxic immune cell any one of aspects 2-5, wherein the first antigen-triggered polypeptide is a synNotch receptor and wherein activation of the synNotch receptor induces expression of the second antigen-triggered polypeptide.

11. The genetically modified cytotoxic immune cell any one of aspects 2-5, wherein the first antigen-triggered polypeptide is a synNotch receptor and wherein activation of the synNotch receptor induces expression of an immune inhibitory polypeptide.

12. The genetically modified cytotoxic immune cell any one of aspects 1-11, wherein the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

13. The genetically modified cytotoxic immune cell any one of aspects 1-12, wherein the two different cell surface antigens are a target antigen pair selected from a target antigen pair depicted in FIG. 1 or FIG. 9-14.

14. The genetically modified cytotoxic immune cell of any one of aspects 1-13, wherein the genetically modified to produce a third antigen-triggered polypeptide that recognizes an additional cell surface antigen present on the target cancer cell.

15. The genetically modified cytotoxic immune cell of aspect 14, wherein the additional cell surface antigen is selected from an antigen depicted in FIG. 4 or Table 3.

16. The genetically modified cytotoxic immune cell of aspect 14, wherein the additional cell surface antigen is selected from: a) an α-folate receptor; b) carbonic anhydrase IX (CAIX); c) CD19; d) CD20; e) CD22; f) CD33; g) CD44v7/8; h) carcinoembryonic antigen; i) epithelial glycoprotein-2 (EGP-2); j) epithelial glycoprotein-40 (EGP-40); k) erb-B2; l) folate binding protein (FBP); m) fetal acetylcholine receptor; n) GD2 ganglioside; o) GD3 ganglioside; p) Her2/neu; q) IL-13R-a2; r) kinase insert domain receptor (KDR); s) immunoglobulin kappa light chain; t) LeY; u) melanoma antigen E-A1 (MAGE-A1); v) mesothelin; w) epithelial mucin MUC1; x) prostate stem cell antigen (PSCA); y) prostate-specific membrane antigen (PSMA); z) tumor-associated glycoprotein-72 (TAG-72); and aa) vascular endothelial growth factor receptor-2 (VEGF-R2).

17. A method of killing a target cancer cell in an individual, the method comprising administering to the individual an effective number of the genetically modified cytotoxic immune cell of any one of aspects 1-16, wherein said genetically modified cytotoxic immune cell kills the target cancer cell in the individual.

18. The method of aspect 17, wherein the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

19. A system for killing a target cancer cell, the system comprising: a) a first antigen-triggered polypeptide that binds specifically to a first target antigen present on the target cancer cell, or a first nucleic acid comprising a nucleotide sequence encoding the first antigen-triggered polypeptide; and b) a second antigen-triggered polypeptide that binds specifically to a second target antigen, or a second nucleic acid comprising a nucleotide sequence encoding the second antigen-triggered polypeptide. In some cases, the system comprises: a) a first nucleic acid comprising a nucleotide sequence encoding first antigen-triggered polypeptide that binds specifically to a first target antigen present on the target cancer cell; and b) a second nucleic acid comprising a nucleotide sequence encoding a second antigen-triggered polypeptide that binds specifically to a second target antigen. In some cases, the first and the second nucleic acids are recombinant expression vectors. In some cases, the first and the second nucleic acids are present in separate recombinant expression vectors. In some cases, the first and the second nucleic acids are present in a single recombinant expression vectors. In some cases, the nucleotide sequences are operably linked to promoters. In some cases, the promoters are T-cell-specific promoters. In some cases, the promoters are constitutive promoters. In some cases, the promoters are regulatable promoters.

20. The system of aspect 19, wherein the first antigen-triggered polypeptide is a synNotch polypeptide, and the second antigen-triggered polypeptide is a chimeric antigen receptor (CAR).

21. The system of aspect 19, wherein the first antigen-triggered polypeptide is a synNotch polypeptide, and the second antigen-triggered polypeptide is an inhibitory CAR (iCAR).

22. The system of aspect 19, wherein the first antigen-triggered polypeptide is a synNotch polypeptide, and the second antigen-triggered polypeptide is a split CAR.

23. The system of aspect 19, wherein the first target antigen and the second target antigen are both present on the surface of a target cancer cell.

24. The system of aspect 19, wherein: a) the first target antigen and the second target antigen are both present on the surface of a non-cancerous cell; and b) wherein the first target antigen, but not the second target antigen, is present on the surface of a target cancer cell.

25. The system of any one of aspects 19-24, wherein the first target antigen and the second target antigen are selected from a target antigen pair depicted in FIG. 1 or FIG. 9-14.

26. The system of any one of aspects 19-24, wherein the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

27. The system of aspect 19, wherein the second target antigen is present on the target cancer cell.

28. The system of aspect 19, wherein the second target antigen is not present on the target cancer cell.

29. The system of aspect 19, wherein the first antigen-triggered polypeptide induces production of an antibody upon binding to the first target antigen.

30. The system of aspect 19, wherein the first antigen-triggered polypeptide induces production of a cytokine upon binding to the first target antigen.

31. A method of killing a target cancer cell in an individual, the method comprising: a) introducing the system of any one of aspects 19-30 into a cytotoxic T cell in vitro or ex vivo, generating a modified cytotoxic T cell; and b) administering the modified cytotoxic T cell to the individual.

32. The method of aspect 31, wherein the target cancer cell is a liposarcoma, a glioblastoma, a breast cancer cell, a renal cancer cell, a pancreatic cancer cell, a melanoma, an anaplastic lymphoma, a leiomyosarcoma, an astrocytoma, an ovarian cancer cell, a neuroblastoma, a mantle cell lymphoma, a sarcoma, a non-small cell lung cancer cell, an AML cell, a stomach cancer cell, a B-cell cancer cell, a lung cancer cell, or an oligodendroglioma.

33. The method of aspect 31 or 32, wherein the modified cytotoxic T cell is activated to kill the target cancer cell only when the target cancer cell expresses both the first target antigen and the second target antigen on its cell surface.

34. The method of aspect 31 or 32, wherein the modified cytotoxic T cell: a) is activated to kill a target cancer cell that expresses the first target cell surface antigen, but not the second target cell surface antigen, on its cell surface; and b) is inhibited from killing a non-cancerous cell if the non-cancerous cell expresses both the first target cell surface antigen and the second target cell surface antigen on its cell surface.

35. A method of identifying a combination of target antigens for targeting a cancer cell, the method comprising: a) generating a training set of target antigen parameters by determining, from a training set of expression data, pairs of antigens that discriminate between cancer cells and non-cancerous cells, thereby generating an algorithm; b) applying the algorithm to a test set of expression data, to generate a combination of target antigens.

36. The method of aspect 35, wherein step (a) comprises selecting pairs of target antigens that comprise: i) a first target antigen that is expressed at a high level on cancer cells of a selected cancer cell type; and ii) a second target antigen that is expressed at a high level on cancer cells of the selected cancer cell type; or i) a first target antigen that is expressed at a high level on cancer cells of a selected cancer cell type and on non-cancerous cells of the same cell type; and ii) a second target antigen that is expressed at a high level on non-cancerous cells of the same cell type but not on cancer cells of the same cell type.

37. The method of aspects 35 or 36, wherein the algorithm comprises one or more of an F1 cutoff, a precision cutoff, a recall cutoff, or combination thereof.

38. The method of any of aspects 35 to 37, wherein step (a) comprises training a computer software with the training set, and wherein step (b) comprises applying the algorithm using the trained computer software.

39. The method of any of aspects 35 to 38, wherein the expression data comprises gene expression data, proteomics expression data or a combination thereof.

40. The method of aspect 39, wherein the gene expression data comprises microarray data.

41. The method of aspect 40, wherein the microarray data comprises mRNA expression data.

42. The method of any of aspects 35 to 41, wherein the training comprises selecting target antigens that are transmembrane polypeptides.

43. The method of any of aspects 35 to 42, further comprising comparing the output of the expression data to a reference dataset.

44. The method of aspect 43, wherein the reference dataset comprises a RNAseq dataset.

45. The method of any of aspects 35 to 44, wherein applying the algorithm is performed iteratively.

46. An in vitro or ex vivo genetically modified cytotoxic immune cell, wherein the cytotoxic immune cell is genetically modified to produce a first polypeptide that recognizes a first cell surface antigen present on the surface of a target cancer cell and a second polypeptide that recognizes a second cell surface antigen present on the surface of a non-target cell.

47. The genetically modified cytotoxic immune cell of aspect 46, wherein the non-target cell is a cell of a normal tissue.

48. The genetically modified cytotoxic immune cell of aspect 47, wherein the normal tissue is brain tissue.

49. The genetically modified cytotoxic immune cell of aspects 47 or 48, wherein the second cell surface antigen is selected from the group consisting of: OPALIN, TMEM235, GABRA1, KCNJ9, GRM3, SEZ6, NTSR2, KCNK4, SLCO1A2, SLC24A2, MOG, GABRG1, GABRG2, CNT- NAP4, DSCAM, CACNG3, CRB1, CDH10, HRH3, GRIK1, SLC39A12, GPR158, CACNG2, SYT3, HTR5A, CACNG7, GPR37L1, LRRTM3, GLRA2, CHRNB2, KCNQ2, JPH3, GPR19, ADCY8, SPOCK3, SLC32A1, OPCML, GABRA3, GRM5, SCN1A, SLC5A11, KCNC1, SLC12A5, GRM4, GRM1, GRIA4, MEGF11, CACNA1B, LYPD1, GRID2, SCN2A, NKAIN2, UNC5A, SLC4A10, TMEFF2, CSMD3, PPAPDC1A, HAPLN4, GPR85, ANTXR2, CACNG4, CSPG5, KCNK10, CHRNA4, CNTNAP2, KCNJ10, GABRB2, GRIN1, CRB2, SHISA7, NKAIN4, HTR2C, CACNG8, NRG3, ABCG4, CDH8, GABRD, KIRREL3, GABRB1, KCNA2, CDH20, IGDCC3, KCNJ6, CNIH2, KCNK12, CDH18, CSMD2, SYT4, OR2L13, CDH9, GABRA2, KCNF1, MAG, CALN1, GRIN2B, GRM7, VSTM2A, GPR61, OMG, KCNA1, GPR83, ATP8A2, GABBR2, GPR12, TRPM3, SLC8A3, KCND2, GSG1L, SLC30A10, ASTN1, GPR179, LRFN2, CACNA1E, CALY, SLC6A15, KIAA0319, SYT6, PTPRR, KCTD8, GPR22, SLC4A8, LAMP5, MEGF10, FXYD7, KCNK9, SLC1A6, MLC1, OPRK1, ATP2B2, ACSL6, THBD, PTPRT, PCDHGC4, CLDN10, KCNV1, LPPR3, SLCO1C1, PCDH8, ANO4, LRRTM4, PCDH15, CCKBR, GABRA5, SLC6A12, GRIN2A, SLC1A2, SLC43A1, KCNC2, ELFN2, ATP7A, GRIK4, LRRC55, HCN2, NKAIN1, DPP10, AJAP1, NPFFR1, TRPC3, TGFBI, SLC6A7, GABRA4, SLC13A5, GRIN2C, HCN1, SLC26A8, PPIC, NETO1, TNFRSF10B, CDH22, SLC6A13, DISP2, SLC6A11, CD93, EPHA10, PHLDB2, OXTR, WNT7A, GYPC, KCNA4, PCDHAC2, HGFAC, DRD1, SHISA9, SCN8A, ICAM1, PIRT, A4GALT, MRGPRF, CD248, CD58, CD44, EPHA2 and PROCR.

50. The genetically modified cytotoxic immune cell of any of aspects 46 to 49, wherein the cytotoxic immune cell is further genetically modified to produce a third polypeptides that recognizes a third cell surface antigen, wherein the third cell surface antigen is present on the surface of a second non-target cell.

51. The genetically modified cytotoxic immune cell of aspect 50, wherein the second non-target cell is a cell of a second normal tissue.

52. The genetically modified cytotoxic immune cell of aspect 51, wherein the second normal tissue is cardiac tissue.

53. The genetically modified cytotoxic immune cell of aspect 52, wherein the third cell surface antigen is selected from the group consisting of: GJA3, HCN4 and BMP10.

54. The genetically modified cytotoxic immune cell of any of aspects 46 to 53, wherein the first cell surface antigen is selected from the group consisting of: GD2 (B4GALNT1), MAGEA1, MAGEA3 and MART1 (MLANA).

55. The genetically modified cytotoxic immune cell of any of aspects 46 to 54, wherein the first and second polypeptides each comprise an antigen-triggered polypeptide.

56. The genetically modified cytotoxic immune cell of any of aspects 46 to 55, wherein the cytotoxic immune cell is a cytotoxic T cell or a natural killer cell.

57. The genetically modified cytotoxic immune cell of any of aspects 46 to 55, wherein the target cell is a melanoma.

58. A method of killing a target cancer cell in an individual, the method comprising administering to the individual an effective number of the genetically modified cytotoxic immune cell of any of aspects 46 to 57, wherein said genetically modified cytotoxic immune cell kills the target cancer cell in the individual.

59. The method of aspect 58, wherein the genetically modified cytotoxic immune cell does not substantially kill the non-target cell.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal(ly); s.c., subcutaneous(ly); and the like.

Example 1: Use of an AND-NOT Gate Antigen Pair as Target Antigens $CD8^+$ T cells are isolated from a patient with a liposarcoma. The $CD8^+$ T cells are genetically modified with: a) a recombinant expression vector comprising a nucleotide sequence encoding a synNotch polypeptide that includes: i) a single-chain Fv (scFv) that is specific for an EVA1B polypeptide; and ii) an intracellular domain comprising a transcription activator; and b) a recombinant expression vector comprising a nucleotide sequence encoding an iCAR that comprises an antigen-binding portion (e.g., a scFv) specific for an ITGA6 polypeptide. From $10^6$ to $10^9$ genetically modified $CD8^+$ T cells are administered to the patient in a single dose intravenously.

Example 2: Use of an AND Gate Antigen Pair as Target Antigens $CD8^+$ T cells are isolated from a patient with a glioblastoma. The $CD8^+$ T cells are genetically modified with: a) a recombinant expression vector comprising a nucleotide sequence encoding a synNotch polypeptide that includes: i) an scFv that is specific for a PTPRZ1 polypeptide; and ii) an intracellular domain comprising a transcription activator; and b) a recombinant expression vector comprising a nucleotide sequence encoding a CAR that comprises an antigen-binding portion (e.g., a scFv) specific for a FOLR2 polypeptide. From $10^6$ to $10^9$ genetically modified $CD8^+$ T cells are administered to the patient in a single dose intravenously. Upon binding of the genetically modified $CD8^+$ T cells to a PTPRZ1 present on the surface of a glioblastoma in the patient, the transcription activator is released from the synNotch polypeptide. The CAR is encoded by a nucleotide sequence that is operably linked to a promoter element that is controlled by the released transcription activator. The released transcription activator induces expression of the CAR in the genetically modified $CD8^+$ T cells. The CAR binds to a FOLR2 polypeptide present on the surface of the glioblastoma in the patient.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (7475 sequences)

SEQ ID NO: 1 - protein, 290 aa, Homo sapiens
MDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLRNIFKISLGRNLVPKPGDGSLTI

SEQ ID NO: 2 - protein, 503 aa, Homo sapiens
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 3 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 4 - protein, 387 aa, Homo sapiens
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 5 - protein, 413 aa, Homo sapiens
MGQPGNGSAFLLAPNRSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 6 - protein, 408 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 7 - protein, 1880 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 8 - protein, 533 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 9 - protein, 589 aa, Homo sapiens
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 10 - protein, 1500 aa, Homo sapiens
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMIYMMVMDHHFATLHHNQNMSKEEMINLHSSMFLERQILPGLSVMNLLSFLLCVPVQFFGGWYFYIQAYKALKHKTANMDVLIVLATTIAFAYSLIILLVAMYERAKVNPITFFDTPPMLFVFIALGRWLEHIAKGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRKTVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 11 - protein, 1465 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 12 - protein, 371 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 13 - protein, 602 aa, Homo sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 14 - protein, 591 aa, Homo sapiens
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 15 - protein, 1873 aa, Homo sapiens
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 16 - protein, 472 aa, Homo sapiens
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 17 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 18 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 19 - protein, 457 aa, Homo sapiens
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 20 - protein, 493 aa, Homo sapiens
MARAPLGVLLLLGLLGRGVGKNEELRLYHHLFNNYDPGSRPVREPEDTVTISLKVTLTNLISLNEKEETLTTSVWIGIDWQDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 21 - protein, 988 aa, Homo sapiens
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDWIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGLPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 22 - protein, 746 aa, Homo sapiens
MDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 23 - protein, 687 aa, Homo sapiens
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFAAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 24 - protein, 438 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 25 - protein, 690 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 26 - protein, 146 aa, Homo sapiens
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 27 - protein, 195 aa, Homo sapiens
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 28 - protein, 503 aa, Homo sapiens
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 29 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 30 - protein, 427 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 31 - protein, 764 aa, Homo sapiens
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 32 - protein, 739 aa, Homo sapiens
MSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQIKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 33 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 34 - protein, 292 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 35 - protein, 625 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTREYPRPPQ

SEQ ID NO: 36 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 37 - protein, 746 aa, Homo sapiens
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 38 - protein, 244 aa, Homo sapiens
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 39 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 40 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 41 - protein, 695 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 42 - protein, 365 aa, Homo sapiens
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 43 - protein, 361 aa, Homo sapiens
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 44 - protein, 359 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRYQTRGIAAWFT

SEQ ID NO: 45 - protein, 357 aa, Homo sapiens
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 46 - protein, 952 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPVEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 47 - protein, 685 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 48 - protein, 477 aa, Homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 49 - protein, 638 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 50 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 51 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 52 - protein, 283 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 53 - protein, 449 aa, Homo sapiens
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 54 - protein, 652 aa, Homo sapiens
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTSEPAPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 55 - protein, 177 aa, Homo sapiens
MPAWGALFLLWATAEATKDCPSPCTCRALETMGLWVDCRGHGLTALPALPARTRHLLLANNSLQSVPPGAFDHLPQLQTLDVTQNPWHCDCSLTYLRLWLEDRTPEALLQVRCASPSLAAHGPLGRLTGYQLGSCGWQLQASWVRPGVLWDVALVAVAALGLALLAGLLCATTEALD

SEQ ID NO: 56 - protein, 1103 aa, Homo sapiens
MTACARRAGGLPDPGLCGPAWWAPSLPRLPRALPRLPLLLLLLLLQPPALSAVFTVGVLGPWACDPIFSRARPDLAARLAAARLNRDPGLAGGPRFEVALLPEPCRTPGSLGAVSSALARVSGLVGPVNPAACRPAELLAEEAGIALVPWGCPWTQAEGTTAPAVTPAADALYALLRAFGWARVALVTAPQDLWVEAGRSLSTALRARGLPVASVTSMEPLDLSGAREALRKVRDGPRVTAVIMVMHSVLLGGEEQRYLLEAAEELGLTDGSLVFLPFDTIHYALSPGPEALAALANSSQLRRAHDAVLTLTRHCPSEGSVLDSLRRAQERRELPSDLNLQQVSPLFGTIYDAVFLLARGVAEARAAAGGRWVSGAAVARHIRDAQVPGFCGDLGGDEEPPFVLLDTDAAGDRLFATYMLDPARGSFLSAGTRMHFPRGGSAPGPDPSCWFDPNNICGGGLEPGLVFLGFLLVVGMGLAGAFLAHYVRHRLLHMQMVSGPNKIILTVDDITFLHPHGGTSRKVAQGSRSSLGARSMSDIRSGPSQHLDSPNIGVYEGDRVWLKKFPGDQHIAIRPATKTAFSKLQELRHENVALYLGLFLARGAEGPAALWEGNLAVVSEHCTRGSLQDLLAQREIKLDWMFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 57 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 58 - protein, 462 aa, Homo sapiens
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 59 - protein, 310 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 60 - protein, 372 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 61 - protein, 1382 aa, Homo sapiens
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 62 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 63 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 64 - protein, 788 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 65 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 66 - protein, 495 aa, Homo sapiens
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 67 - protein, 676 aa, Homo sapiens [sequence omitted]

SEQ ID NO: 68 - protein, 129 aa, Homo sapiens
MILSNTTAVTPFLTKLWQETVQQGGNMSGLARRSPRSSDGKLEALYVLMVLGFFGFFTLGIMLSYIRSKKLEHSNDPFNVYIESDAWQEKDKAYVQARVLESYRSCYVVENHLAIEQPNTHLPETKPSP

SEQ ID NO: 69 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 70 - protein, 976 aa, Homo sapiens [sequence omitted]

SEQ ID NO: 71 - protein, 440 aa, Homo sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 72 - protein, 291 aa, Homo sapiens
MVREQYTTATEGICIERPENQYVYKIGIYGWRKRCLYLFVLLLLIILVVNLALTIWILKVMWFSPAGMGHLCVTKDGLRLEGESEFLFPLYAKEIHSRVDSSLLLQSTQNVTVNARNSEGEVTGRLKVGPKMVEVQNQQFQINSNDGKPLFTVDEKEVVVGTDKLRVTGPEGALFEHSVETPLVRADPFQDLRLESPTRSLSMDAPRGVHIQAHAGKIEALSQMDILFHSSDGMLVLDAETVCLPKLVQGTWGPSGSSQSLYEICVCPDGKLYLSVAGVSTTCQEHSHICL

SEQ ID NO: 73 - protein, 318 aa, Homo sapiens
MAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 74 - protein, 699 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 75 - protein, 1159 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 76 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 77 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 78 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 79 - protein, 404 aa, Homo sapiens
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 80 - protein, 838 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 81 - protein, 854 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 82 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 83 - protein, 968 aa, Homo sapiens
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 84 - protein, 144 aa, Homo sapiens
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 85 - protein, 160 aa, Homo sapiens
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 86 - protein, 354 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 87 - protein, 498 aa, Homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 88 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 89 - protein, 676 aa, Homo sapiens
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 90 - protein, 593 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 91 - protein, 305 aa, Homo sapiens
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCKPQNIREVGFEYMNRELLWHGFAEFLIFLLPLINVQKLKAKLSSWCIPLTGAPNSDNTLATSGKECALCGEWPTMPHTIGCEHIFCYFCAKSSFLFDVYFTCPKCGTEVHSLQPLKSGIEMSEVNAL

SEQ ID NO: 92 - protein, 346 aa, Homo sapiens
MALLKVKFDQKKRVKLAQGLWLMNWFSVLAGIIIFSLGLFLKIELRKRSDVMNNSESHFVPNSLIGMGVLSCVFNSLAGKICYDALDPAKYARWKPWLKPYLAICVLFNIILFLVALCCFLLRGSLENTLGQGLKNGMKYYRDTDTPGRCFMKKTIDMLQIEFKCCGNNGFRDWFEIQWISNRYLDFSSKEVKDRIKSNVDGRYLVDGVPFSCCNPSSPRPCIQYQITNNSAHYSYDHQTEELNLWVRGCRAALLSYYSSLMNSMGVVTLLIWLFEVTITIGLRYLQTSLDGVSNPEESESESQGWLLERSVPETWKAFLESVKKLGKGNQVEAEGADAGQAPEAG

SEQ ID NO: 93 - protein, 409 aa, Homo sapiens
MRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 94 - protein, 351 aa, Homo sapiens
MAPVLPLVLPLQPRIRLAQGLWLLSWLLALAGGVILLCSGHLLVQLRHLGTFLAPSCQFPVLPQAALAAGAVALGTGLVGVGASRASLNAALYPPWRGVLGPLLVAGTAGGGGLLVVALGLALALPGSLDEALEEGLVTALAHYKDTEVPGHCQAKRLVDELQLRYHCCGRHGYKDWFGVQWVSSRYLDPGDRDVADRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 95 - protein, 1836 aa, Homo sapiens
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 96 - protein, 640 aa, Homo sapiens
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 97 - protein, 290 aa, Homo sapiens
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 98 - protein, 1099 aa, Homo sapiens
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIVMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 99 - protein, 1030 aa, Homo sapiens
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIGVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 100 - protein, 685 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 101 - protein, 911 aa, Homo sapiens
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 102 - protein, 664 aa, Homo sapiens
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 103 - protein, 254 aa, Homo sapiens
MQVQCQQSPVLAGSATLVALGALALYVAKPSGYGKHTESLKPAATRLPARAAWFLQELPSFAVPAGILARQPLSLFGPPGTVLLGLFCLHYFHRTFVYSLLNRGRPYPAILILRGTAFCTGNGVLQGYYLIYCAEYPDGWYTDIRFSLGVFLFILGMGINIHSDYILRQLRKPGEISYRIPQGGLFTYVSGANFLGEIIEWIGYALATWSLPALAFAFFSLCFLGLRAFHHHRFYLKMFEDYPKSRKALIPFIF

SEQ ID NO: 104 - protein, 2273 aa, Homo sapiens [sequence omitted]

SEQ ID NO: 105 - protein, 583 aa, Homo sapiens
MPLRKMKIPFLLLFFLWEAESHAASRPNIILVMADDLGIGDPGCYGNKTIRTPNIDRLASGGVKLTQHLAASPLCTPSRAAFMTGRYPVRSGMASWSRTGVFLFTASSGGLPTDEITFAKLLKDQGYSTALIGKWHLGMSCHSKTDFCHHPLHHGFNYFYGISLTNLRDCKPGEGSVFTTGFKRLVFLPLQIVGVTLLTLAALNCLGLLHVPLGVFFSLLFLAALILTLFLGFLHYFRPLNCFMMRNYEIIQQPMSYDNLTQRLTVEAAQFIQRNTETPFLLVLSYLHVHTALFSSKDFAGKSQHGVYGDAVEEMDWSVGQILNLLDELRLANDTLIYFTSDQGAHVEEVSSKGEIHGGSNGIYKGGKANNWEGGIRVPGILRWPRVIQAGQKIDEPTSNMDIFPTVAKLAGAPLPEDRIIDGRDLMPLLEGKSQRSDHEFLFHYCNAYLNAVRWHPQNSTSIWKAFFFTPNFNPVGSNGCFATHVCFCFGSYVTHHDPPLLFDISKDPRERNPLTPASEPRFYEILKVMQEAADRHTQTLPEVPDQFSWNNFLWKPWLQLCCPSTGLSCQCDREKQDKRLSR

SEQ ID NO: 106 - protein, 1581 aa, Homo sapiens
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 107 - protein, 683 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 108 - protein, 575 aa, Homo sapiens
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 109 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 110 - protein, 529 aa, Homo sapiens [sequence omitted]

SEQ ID NO: 111 - protein, 497 aa, Homo sapiens
MQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 112 - protein, 667 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 113 - protein, 485 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 114 - protein, 4563 aa, Homo sapiens
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 115 - protein, 301 aa, Homo sapiens
MADQPKPISPLKNLLAGGFGGVCLVFVGHPLDTVKVRLQTQPPSLPGQPPMYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 116 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 117 - protein, 1545 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 118 - protein, 570 aa, Homo sapiens
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 119 - protein, 328 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 120 - protein, 727 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 121 - protein, 348 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 122 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 123 - protein, 1039 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 124 - protein, 732 aa, Homo sapiens
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 125 - protein, 590 aa, Homo sapiens
MSRQSSVSFRSGGSRSFSTASAITPSVSRTSFTSVSRSGGGGGGGFGRVSLAGACGVGGYGSRSLYNLGGSKRISISTSGGSFRNRFGAGAGGGYGFGGGAGSGFGFGGGAGGGFGLGGGAGFGGGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRNTKHEISEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNISVVTSSVSSGYGSGSGYGGGLGGGLGGGLGGGLAGGSSGSYYSSSSGGVGLGGGLSVGGSGFSASSGRGLGVGFGSGGGSSSSVKFVSTTSSSRKSFKS

SEQ ID NO: 126 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 127 - protein, 780 aa, Homo sapiens
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 128 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 129 - protein, 1279 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 130 - protein, 749 aa, Homo sapiens
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 131 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 132 - protein, 610 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 133 - protein, 348 aa, Homo sapiens
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVALVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 134 - protein, 643 aa, Homo sapiens
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 135 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 136 - protein, 533 aa, Homo sapiens
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 137 - protein, 271 aa, Homo sapiens
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 138 - protein, 253 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 139 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 140 - protein, 1497 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLSGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 141 - protein, 512 aa, Homo sapiens [sequence omitted]

SEQ ID NO: 142 - protein, 724 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 143 - protein, 488 aa, Homo sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 144 - protein, 437 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 145 - protein, 343 aa, Homo sapiens
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 146 - protein, 522 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 147 - protein, 211 aa, Homo sapiens
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 148 - protein, 147 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 149 - protein, 556 aa, Homo sapiens
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 150 - protein, 422 aa, Homo sapiens
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCKFCRQ

SEQ ID NO: 151 - protein, 390 aa, Homo sapiens
MLSRKGIIPEEYVLTRLAEDPAKPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 152 - protein, 860 aa, Homo sapiens [sequence omitted]

SEQ ID NO: 153 - protein, 297 aa, Homo sapiens
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 154 - protein, 248 aa, Homo sapiens
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 155 - protein, 277 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 156 - protein, 348 aa, Homo sapiens [sequence omitted]

SEQ ID NO: 157 - protein, 5038 aa, Homo sapiens
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 158 - protein, 631 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 159 - protein, 933 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 160 - protein, 537 aa, Homo sapiens
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 161 - protein, 219 aa, Homo sapiens
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 162 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 163 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 164 - protein, 233 aa, Homo sapiens
MWQLLLPTALLLLVSAGMRTEDLPKAVVFLEPQWYSVLEKDSVTLKCQGAYSPEDNSTQWFHNENLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 165 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 166 - protein, 550 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 167 - protein, 352 aa, Homo sapiens [sequence omitted]

SEQ ID NO: 168 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 169 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 170 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 171 - protein, 728 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 172 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 173 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 174 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 175 - protein, 561 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 176 - protein, 471 aa, Homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 177 - protein, 391 aa, Homo sapiens
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 178 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 179 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 180 - protein, 557 aa, Homo sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 181 - protein, 1152 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 182 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 183 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 184 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 185 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 186 - protein, 2489 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFTLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 187 - protein, 385 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGKKSKRSMNDPY

SEQ ID NO: 188 - protein, 205 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 189 - protein, 614 aa, Homo sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 190 - protein, 326 aa, Homo sapiens
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 191 - protein, 332 aa, Homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 192 - protein, 318 aa, Homo sapiens
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 193 - protein, 572 aa, Homo sapiens
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 194 - protein, 520 aa, Homo sapiens
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 195 - protein, 466 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 196 - protein, 465 aa, Homo sapiens
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 197 - protein, 450 aa, Homo sapiens
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 198 - protein, 462 aa, Homo sapiens
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 199 - protein, 477 aa, Homo sapiens
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 200 - protein, 359 aa, Homo sapiens [sequence omitted]

SEQ ID NO: 201 - protein, 363 aa, Homo sapiens
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 202 - protein, 1023 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 203 - protein, 1020 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 204 - protein, 1035 aa, Homo sapiens
MGKAENYELYSVELGPGPGGDMAAKMSKKKKAGGGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLAIALIAVVVVTGCFGYYQEFKSTNIIASFKNLVPQQATVIRDGDKFQINADQLVVGDLVEMKGGDRVPADIRILAAQGCKVDNSSLTGESEPQTRSPECTHESPLETRNIAFFSTMCLEGTVQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 205 - protein, 291 aa, Homo sapiens
MAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 206 - protein, 418 aa, Homo sapiens
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 207 - protein, 424 aa, Homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 208 - protein, 353 aa, Homo sapiens
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 209 - protein, 169 aa, Homo sapiens
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATTVAWYQVSPLAARLLYPYLAWLAFTTTLNYCVWRDNHGWRGGRRLPE

SEQ ID NO: 210 - protein, 312 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 211 - protein, 2339 aa, Homo sapiens [sequence omitted]

SEQ ID NO: 212 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 213 - protein, 2181 aa, Homo sapiens
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 214 - protein, 2270 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 215 - protein, 222 aa, Homo sapiens
MSQTKMLKVRVTLFCILAGIVLAMTAVVTDHWAVLSPHMEHHNTTCEAAHFGLWRICTKRIPMDDSKTCGPITLPGEKNCSYFRHFNPGESSEIFEFTTQKEYSISAAAIAIFSLGFIILGSLCVLLSLGKKRDYLLRPASMFYAFAGLCILVSVEVMRQSVKRMIDSEDTVWIEYYYSWSFACACAAFILLFLGGLALLLFSLPRMPRNPWESCMDAEPEH

SEQ ID NO: 216 - protein, 428 aa, Homo sapiens
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 217 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 218 - protein, 116 aa, Homo sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 219 - protein, 460 aa, Homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 220 - protein, 466 aa, Homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 221 - protein, 590 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 222 - protein, 479 aa, Homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 223 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 224 - protein, 505 aa, Homo sapiens
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 225 - protein, 627 aa, Homo sapiens
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 226 - protein, 468 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 227 - protein, 501 aa, Homo sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 228 - protein, 502 aa, Homo sapiens
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 229 - protein, 458 aa, Homo sapiens
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 230 - protein, 498 aa, Homo sapiens
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNNADGTYEVSVYTNLIVRSNGSVLWLPPAIYKSACKIEVKYFPFDQQNCTLKFRSWTYDHTEIDMVLMTPTASMDDFTPSGEWDIVALPGRRTVNPQDPSYVDVTYDFIIKRKPLFYTINLIIPCVLTTLLAILVFYLPSDCGEKMTLCISVLLALTFFLLLISKIVPPTSLDVPLIGKYLMFTMVLVTFSIVTSVCVLNVHHRSPSTHTMAPWVKRCFLHKLPTFLFMKRPGPDSSPARAFPPSKSCVTKPEATATSTSPSNFYGNSMYFVNPASAASKSPAGSTPVAIPRDFWLRSSGRFRQDVQEALEGVSFIAQHMKNDDEDQSVVEDWKYVAMVVDRLFLWVFMFVCVLGTVGLFLPPLFQTHAASEGPYAAQRD

SEQ ID NO: 231 - protein, 517 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 232 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 233 - protein, 554 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSSSPQLQESVFHLLVPSVILVLLAVGGLLFYRWRRRSHQEPQRADSPLEQPEGSPLTQDDRQVELPV

SEQ ID NO: 234 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 235 - protein, 836 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 236 - protein, 516 aa, Homo sapiens
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 237 - protein, 494 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVYPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 238 - protein, 494 aa, Homo sapiens
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 239 - protein, 503 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 240 - protein, 494 aa, Homo sapiens
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 241 - protein, 490 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 242 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 243 - protein, 502 aa, Homo sapiens
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 244 - protein, 502 aa, Homo sapiens
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRSLGPVGFMKSAISLAEDEEWKRIRSLLSPTFTSGKLKEMFPIIAQYGDVLVRNLRREAEKGKPVTLKDIFGAYSMDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 245 - protein, 519 aa, Homo sapiens
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 246 - protein, 511 aa, Homo sapiens
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 247 - protein, 509 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 248 - protein, 617 aa, Homo sapiens
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 249 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 250 - protein, 480 aa, Homo sapiens
MNASEFRRRGKEMVDYVANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 251 - protein, 248 aa, Homo sapiens
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 252 - protein, 271 aa, Homo sapiens
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRKKTRLAG

SEQ ID NO: 253 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 254 - protein, 443 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 255 - protein, 400 aa, Homo sapiens
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 256 - protein, 419 aa, Homo sapiens
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 257 - protein, 477 aa, Homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 258 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 259 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 260 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 261 - protein, 255 aa, Homo sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 262 - protein, 456 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 263 - protein, 451 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 264 - protein, 492 aa, Homo sapiens
MIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKKKTPAAPAKKTSTTFNIVGTTYPINLAKDTEFSTISKGAAPSASSTPTIIASPKATYVQDSPTETKTYNSVSKVDKISRIIFPVLFAIFNLVYWATYVNRESAIKGMIRKQ

SEQ ID NO: 265 - protein, 554 aa, Homo sapiens [sequence omitted]

SEQ ID NO: 266 - protein, 462 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 267 - protein, 453 aa, Homo sapiens
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 268 - protein, 474 aa, Homo sapiens
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 269 - protein, 474 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 270 - protein, 473 aa, Homo sapiens [sequence omitted]

SEQ ID NO: 271 - protein, 452 aa, Homo sapiens [sequence omitted]

SEQ ID NO: 272 - protein, 467 aa, Homo sapiens
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 273 - protein, 758 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 274 - protein, 423 aa, Homo sapiens
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 275 - protein, 497 aa, Homo sapiens
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 276 - protein, 883 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 277 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 278 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALGNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 279 - protein, 902 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLGTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 280 - protein, 918 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 281 - protein, 919 aa, Homo sapiens [sequence omitted]

SEQ ID NO: 282 - protein, 885 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 283 - protein, 1464 aa, Homo sapiens [sequence omitted]

SEQ ID NO: 284 - protein, 1484 aa, Homo sapiens [sequence omitted]

SEQ ID NO: 285 - protein, 1233 aa, Homo sapiens
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 286 - protein, 1336 aa, Homo sapiens
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 287 - protein, 371 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 288 - protein, 1194 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPSHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 289 - protein, 872 aa, Homo sapiens [sequence omitted]

SEQ ID NO: 290 - protein, 879 aa, Homo sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 291 - protein, 912 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 292 - protein, 1180 aa, Homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 293 - protein, 877 aa, Homo sapiens
MARPRRAREPLLVALLPLAWLAQAGLARAAGSVRLAGGLTLGGLFPVHARGAAGRACGQLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 294 - protein, 915 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 295 - protein, 888 aa, Homo sapiens [sequence omitted]

SEQ ID NO: 296 - protein, 487 aa, Homo sapiens
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 297 - protein, 390 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 298 - protein, 377 aa, Homo sapiens
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 299 - protein, 366 aa, Homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 300 - protein, 481 aa, Homo sapiens
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 301 - protein, 458 aa, Homo sapiens
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 302 - protein, 484 aa, Homo sapiens
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 303 - protein, 388 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 304 - protein, 440 aa, Homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 305 - protein, 445 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 306 - protein, 275 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 307 - protein, 331 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 308 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 309 - protein, 2491 aa, Homo sapiens
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 310 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 311 - protein, 1032 aa, Homo sapiens [sequence omitted]

SEQ ID NO: 312 - protein, 1163 aa, Homo sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 313 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 314 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 315 - protein, 419 aa, Homo sapiens
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINQKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 316 - protein, 427 aa, Homo sapiens
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 317 - protein, 520 aa, Homo sapiens
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 318 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 319 - protein, 103 aa, Homo sapiens
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 320 - protein, 750 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 321 - protein, 97 aa, Homo sapiens
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 322 - protein, 540 aa, Homo sapiens
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 323 - protein, 384 aa, Homo sapiens
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 324 - protein, 372 aa, Homo sapiens
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 325 - protein, 380 aa, Homo sapiens
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 326 - protein, 370 aa, Homo sapiens
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 327 - protein, 400 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 328 - protein, 974 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 329 - protein, 1141 aa, Homo sapiens
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 330 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 331 - protein, 1280 aa, Homo sapiens
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 332 - protein, 737 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 333 - protein, 354 aa, Homo sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 334 - protein, 680 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 335 - protein, 216 aa, Homo sapiens
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 336 - protein, 212 aa, Homo sapiens
MGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 337 - protein, 622 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 338 - protein, 218 aa, Homo sapiens
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 339 - protein, 202 aa, Homo sapiens
MRGHPSLLLLYMALTTCLDTSPSEETDQEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 340 - protein, 342 aa, Homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 341 - protein, 359 aa, Homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 342 - protein, 402 aa, Homo sapiens
MSPCGPLNLSLAGEATTCAAPWVPNTSAVPPSGASPALPIFSMTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 343 - protein, 358 aa, Homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 344 - protein, 425 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQAPLLPTSTVIDPSRFCAQPFRWFLDLSFPAMSSSHPQLPLTLASFKLLREPCSVQLS

SEQ ID NO: 345 - protein, 488 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 346 - protein, 359 aa, Homo sapiens
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 347 - protein, 500 aa, Homo sapiens
MAWAALLGLLAALLLLLLLSRRRTRRPGEPPLDLGSIPWLGYALDFGKDAASFLTRMKEKHGDIFTILVGGRYVTVLLDPHSYDAVVWEPRTRLDFHAYAIFLMERIFDVQLPHYSPSDEKARMKLTLLHRELQALTEAMYTNLHAVLLGDATEAGSGWHEMGLLDFSYSFLLRAGYLTLYGIEALPRTHESQAQDRVHSADVFHTFRQLDRLLPKLARGSLSVGDKDHMCSVKSRLWKLLSPARLARRAHRSKWLESYLLHLEEMGVSEEMQARALVLQLWATQGNMGPAAFWLLLFLLKNPEALAAVRGELESILWQAEQPVSQTTTLPQKVLDSTPVLDSVLSESLRLTAAPFITREVVVDLAMPMADGREFNLRRGDRLLLFPFLSPQRDPEIYTDPEVFKYNRFLNPDGSEKKDFYKDGKRLKNYNMPWGAGHNHCLGRSYAVNSIKQFVFLVLVHLDLELINADVEIPEFDLSRYGFGLMQPEHDVPVRYRIRP

SEQ ID NO: 348 - protein, 599 aa, Homo sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 349 - protein, 92 aa, Homo sapiens [sequence omitted]

SEQ ID NO: 350 - protein, 1220 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 351 - protein, 1176 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQMDVVNAFQSGSSIQGALRRQPSIASQHHDVTNISTPTHVVFSSSTASTTVGYSSGECIS

SEQ ID NO: 352 - protein, 255 aa, Homo sapiens
MVSWMISRAVVLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSKPAPSESAGYGIPLKDGDEKTDEEAEGPYSDNEMLTHKGLRRSQSMKSVKTTKGRKEVRYGSLKYKVKKRPQVYF

SEQ ID NO: 353 - protein, 1243 aa, Homo sapiens [sequence omitted]

SEQ ID NO: 354 - protein, 1220 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 355 - protein, 699 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 356 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 357 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 358 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 359 - protein, 346 aa, Homo sapiens
MMDKFRMIFQFLQSNQESFMNGICGIMALASAQMYSAFDFNCPCLPGYNAAYSAGILLAPPLVLFLLGLVMNNNVSMLAEEWKRPLGRRAKDPAVLRYMFCSMAQRALIAPVVWVAVTLLDGKCFLCAFCTAVPVSALGNGSLAPGLPAPELARLLARVPCPEIYDGDWLLAREVAVRYLRCISQALGWSFVLLTTLLAFVVRSVRPCFTQAAFLKSKYWSHYIDIERKLFDETCTEHAKAFAKVCIQQFFEAMNHDLELGHTHGTLATAPASAAAPTTPDGAEEEREKLRGITDQGTMNRLLTSWHKCKPPLRLGQEEPPLMGNGWAGGGPRPPRKEVATYFSKV

SEQ ID NO: 360 - protein, 92 aa, Homo sapiens
MKLCVTVLSLLVLVAAFCSLALSAPMGSDPPTACCFSYTARKLPRNFVVDYYETSSLCSQPAVVFQTKRGKQVCADPSESWVQEYVYDLELN

SEQ ID NO: 361 - protein, 350 aa, Homo sapiens
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSALLQEERLDAVTLLYATSLPSFCLLAGAALVLEAGVAPPPTAGDSRLWACILLSCLLSVLYNLASFSLLALTSALTVHVLGNLTVVGNLILSRLLFGSRLSALSYVGIALTLSGMFLYHNCEFVASWAARRGLWRRDQPSKGL

SEQ ID NO: 362 - protein, 492 aa, Homo sapiens
MVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 363 - protein, 888 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILGLALGEEWTAAG

SEQ ID NO: 364 - protein, 949 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 365 - protein, 939 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 366 - protein, 377 aa, Homo sapiens
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRVPEDTWGCFFVCNLLYALGPHLLAYRCLQWPAFFHQPPPSDPLALHKKQH

SEQ ID NO: 367 - protein, 472 aa, Homo sapiens; identical to SEQ ID NO: 16

SEQ ID NO: 368 - protein, 472 aa, Homo sapiens; identical to SEQ ID NO: 16

SEQ ID NO: 369 - protein, 108 aa, Homo sapiens
MVDVKCLSDCKLQNQLEKLGFSPGPILPSTRKLYEKKLVQLLVSPPCAPPVMNGPRELDGAQDSDDSEGGLQEHQAPESHMGLSPKRETTARKTRLSRAGEKKVSQWA

SEQ ID NO: 370 - protein, 456 aa, Homo sapiens
MASALSLGNKCDPFLRCVLCRGGGALQGPRGRGPDDFESQLSPPGSARRLVRSKRACGNPPDAFGLSRASVHPPLPRVSIGCSSGPGRAKRERVGGAAWRQRKMAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 371 - protein, 681 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNGPMSRGKSWSSPATQPSSSVSWWCSGPTWSSVRPGGIRSSSRG

SEQ ID NO: 372 - protein, 179 aa, Homo sapiens
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQVRGGCHGQGPRPCIHSVTHDLAA

SEQ ID NO: 373 - protein, 1576 aa, Homo sapiens
MENILCFLNSYTETGLSPDSHWLDIDPNFICLSGLGLFILYLFYVVLTLYSSPTEKNNDIQKHQGRAKRRRKGGTFKGFPDWKSFQREEEEERKLLSLLKSFGPPVSCSPRGQHHDTNHFRRLLCPDPVCRVCKRATADIQQLLSWESLKDAAPSVSPLASSASATESSFTLASTPSATPPEDLILSPRPKASPPPPLILSPDLITTLADLFSPSPLRDPLPPQPVSPLDSKFPIDHSPPQQLPFPLLPPHHIERVESSLQPEASLSLNTIFSFGSTLCQDISQAMNPIDSCARHHGPPIPSALPPEDCTVTQSKSSLTILKTFPEMLSLGGSGGSSTSAPTIKGIDHSHLASSEFTWWQPHAKDSFSSNFVPSDFMEELLTLHSSEAFLGGHSVANLIEPVNISFLSHDILALLERQVKKRGDFLMWKENGKKPGSFPKQLRPNYQLNSSRNMLTSIAVKHDLAESFPFWASKGKLEWQHIHQQPPHSKCFEDHLEQKYVQLFWGLPSLHSESLHPTVLVQRGHSSMFVFFNGITNTSISHESPVLPPPQPLSLPSTQPLPLPQTLPQGQSPHLTQVKSLAQPQSPFRALLPSPLFLIRICGVCFHRPQNEARSLLPSEINHLEWNVLQKVQESLWGLPSVVQKSQEDFCPPAPNPELVRKSFKVHVPISIIPGDFPLSSEVRKKLEQHIRRRLIQRRWGLPRRIHESLSLLRPQSKISELSVSERIHGPLNISLVEGQRCNVLKKSASSFPRSFHERSSNMLSMENVGNYQGYSQETVPKDHLLHGPETSSDKDLRSNSERDLETHMMHLSGNDSGVRLGQKQLENALTVRLSKKFEEINEGRMPGTVHSSWHSVKQTMSLPEKSHSQIKHRNLVTLVSEDHCVDTSQEISFLSSNKQKMLEAHIKTFRMRMLWGLPLKVLESIEIFKSKADLSTSFSHFDLPSSATFISQGDSKDGVSKSRSRSTFQGEKLGTTSSVPILDRPHPVSSPVVQEGQGTLRRQFSDTDHDLIETDSKDGASTSLRRGTTDFQSEKLDSTSSFPILGHSYLVTSPVNQEKQGTLRREFSDTDNDLTESVRTTEDGRQTFLPPPHSIVDEVSQKQTVLASRCSAELPIMQAGAGCESWDKRKSSFHNVDRLQGSRKTFPVTNALQSQTRNNLTTSKSGSCSLTNVKASTSNETEIFPPRISVPQDPKSSYLKNQMLSQLKLVQRKHSQPQSHFTDMSFALDNLSSKDLLTNSQGISSGDMGTSQVVHVHLEDSGIRVAQKQEPRVPTCVLQKCQVTNFPPAVNRVSPVRPKGGELDGGDAGLGTSQRRRKSLPVHNKTSGEVLGSKSSPTLKTQPPPENLFRKWMKTSLQWFNKPSISYEEQESSWEKGSSLSSCVQNIGRVIRAAFTGTTEAQKIRKDTREFLEEKLGHRHGIDITCPQEPLSFPVGLGKAQHNPEVHVRAEPVQGCPCNYRAPSCKVTRTKSCSQQAIFVGQNYPTRIRQIIDKDRQPQKVEAFKGKILCQSHPQSMPHRKPVPHPNPTCRRQVSLVCPAVPTSAKSPVFSDVPFLTGQKMLPKHLQGGKFPPTK

SEQ ID NO: 374 - protein, 66 aa, Homo sapiens
MEVDAPGVDGRDGLRERRGFSEGGRQNFDVRPQSGANGLPKHSYWLDLWLFILFDVVVFLFVYFLP

SEQ ID NO: 375 - protein, 200 aa, Homo sapiens
MRQGLLVLALVLVLVLVLAAGSQVQEWYPRESHALNWNKFSGFWYILATATDAQGFLPARDKRKLGASVVKVNKVGQLRVLLAFRRLKGCQSQEVILRKDGKKPVFGNACAYAAGPREGQEGVKGVKAFHVLSTDYSYGLVYLRLGRATQNYKNLLLFHRQNVSSFQSLKEFMDACDILGLSKAAVILPKDASRTHTILP

SEQ ID NO: 376 - protein, 165 aa, Homo sapiens
MIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 377 - protein, 774 aa, Homo sapiens
MRGPIVLHICLAFCSLLLFSVATQCLAFPKIERRREIAHVHAEKGQSDKMNTDDLENSSVTSKQTPQLVVSEDPMMMSAVPSATSLNKAFSINKETQPGQAGLMQTERPGVSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGMLVPVGVGIAGALFILGALYSIKVMNRRRRNGFKRHKRKQREFNSMQDRVMLLADSSEDEF

SEQ ID NO: 378 - protein, 933 aa, Homo sapiens
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 379 - protein, 1270 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 380 - protein, 1216 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSAGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 381 - protein, 517 aa, Homo sapiens
MTVPGGFRSCTETDISSKIFINSTLTPPAGSERHYDATLLTLLVVGSYSLCIIPLLATFTGKKTGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 382 - protein, 246 aa, Homo sapiens
MGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 383 - protein, 328 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 384 - protein, 305 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 385 - protein, 297 aa, Homo sapiens
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 386 - protein, 336 aa, Homo sapiens
MRAPSMDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 387 - protein, 261 aa, Homo sapiens
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 388 - protein, 301 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 389 - protein, 418 aa, Homo sapiens; identical to SEQ ID NO: 82

SEQ ID NO: 390 - protein, 418 aa, Homo sapiens; identical to SEQ ID NO: 82

SEQ ID NO: 391 - protein, 376 aa, Homo sapiens
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKWKDDKSHFEDMIDYFCDIHEPLQLLIFPEGTDLTENSKSRSNAFAEKNGLQKYEYVLHPRTTGFTFVVDRLREGKNLDAVHDITVAYPHNIPQSEKHLLQGDFPREIHFHVHRYPIDTLPTSKEDLQLWCHKRWEEKEERLRSFYQGEKNFYFTGQSVIPPCKSELRVLVVKLLSILYWTLFSPAMCLLIYLYSLVKWYFIITIVIFVLQERIFGGLEIIELACYRLLHKQPHLNSKKNE

SEQ ID NO: 392 - protein, 142 aa, Homo sapiens
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 393 - protein, 416 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 394 - protein, 404 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 395 - protein, 410 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSWARSWAYRDSLKAEENRKLQKMKDEQHQKSELLELKRQQQEQERAKIHQTEHRRVNNAFLDRLQGKSQPGGLEQSGGCWNMNSGNSWGSLLVFSRHLRVYEKILTPIWPSSTDLEKPHEMLFLNVILFSLTVFTLISTAHTLDRAVRSDWLLLVLIYACLEELIPELIFNLYCQGNATLFF

SEQ ID NO: 396 - protein, 291 aa, Homo sapiens
MSMPLHQISAIPSQDAISARVYRSKTKEKEREEQNEKTLGHFMSHSSNISKAGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 397 - protein, 291 aa, Homo sapiens; identical to SEQ ID NO: 396

SEQ ID NO: 398 - protein, 290 aa, Homo sapiens
MGILSFLPVLATESDWADCKSPQPWGHMLLWTAVLFLAPVAGTPAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 399 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 400 - protein, 309 aa, Homo sapiens
MGILSFLPVLATESDWADCKSPQPWGHMLLWTAVLFLAPVAGTPAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 401 - protein, 543 aa, Homo sapiens
MAGAIIENMSTKKLCIVGGILLVFQIIAFLVGGLIGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 402 - protein, 532 aa, Homo sapiens
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 403 - protein, 409 aa, Homo sapiens
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 404 - protein, 778 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 405 - protein, 311 aa, Homo sapiens
MSGENNSSVTEFILAGLSEQPELQLPLFLLFLGIYVVTVVGNLGMTTLIWLSSHLHTPMYYFLSSLSFIDFCHSTVITPKMLVNFVTEKNIISYPECMTQLYFFLVFAIAECHMLAAMAYDRYMAICSPLLYSVIISNKACFSLILGVYIIGLVCASVHTGCMFRVQFCKFDLINHYFCDLLPLLKLSCSSIYVNKLLILCVGAFNILVPSLTILCSYIFIIASILHIRSTEGRSKAFSTCSSHMLAVVIFFGSAAFMYLQPSSISSMDQGKVSSVFYTIIVPMLNPLIYSLRNKDVHVSLKKMLQRRTLL

SEQ ID NO: 406 - protein, 308 aa, Homo sapiens
MTMENYSMAAQFVLDGLTQQAELQLPLFLLFLGIYVVTVVGNLGMILLIAVSPLLHTPMYYFLSSLSFVDFCYSSVITPKMLVNFLGKKNTILYSECMVQLFFFVVFVVAEGYLLTAMAYDRYVAICSPLLYNAIMSSWVCSLLVLAAFFLGFLSALTHTSAMMKLSFCKSHIINHYFCDVLPLLNLSCSNTHLNELLLFIIAGFNTLVPTLAVAVSYAFILYSILHIRSSEGRSKAFGTCSSHLMAVVIFFGSITFMYFKPPSSNSLDQEKVSSVFYTTVIPMLNPLIYSLRNKDVKKALRKVLVGK

SEQ ID NO: 407 - protein, 311 aa, Homo sapiens
MATSNHSSGAEFILAGLTQRPELQLPLFLLFLGIYVVTVVGNLGMIFLIALSSQLYPPVYYFLSHLSFIDLCYSSVITPKMLVNFVPEENIISFLECITQLYFFLIFVIAEGYLLTAMEYDRYVAICRPLLYNIVMSHRVCSIMMAVVYSLGFLWATVHTTRMSVLSFCRSHTVSHYFCDILPLLTLSCSSTHINEILLFIIGGVNTLATTLAVLISYAFIFSSILGIHSTEGQSKAFGTCSSHLLAVGIFFGSITFMYFKPPSSTTMEKEKVSSVFYITIIPMLNPLIYSLRNKDVKNALKKMTRGRQSS

SEQ ID NO: 408 - protein, 2188 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 409 - protein, 467 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 410 - protein, 141 aa, Homo sapiens
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 411 - protein, 269 aa, Homo sapiens
MSSDHLNNSTLKEAQFKDLFLKKAELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 412 - protein, 251 aa, Homo sapiens
MSSDHLNNSTLKEAQFKDLFLKKAELEFAQIIIIVVVVTVMVVVIVCLLNHYKVSTRSFINRPNQSRRREDGLPQIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 413 - protein, 896 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKRTDIL

SEQ ID NO: 414 - protein, 958 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKMLEGSMFVKSHHHSLISSTQGHKHCGRPQGPLHRKTRDLCSLVYLLTLPPLLSYDPAKSPSVRNTQE

SEQ ID NO: 415 - protein, 307 aa, Homo sapiens
MTAGSPEECGEVRRSPEGRVSRLGRRLGRRRRPRSPPEPLRVRARLRLRSPSGAFAALGALVVLVGMGIAVAGYWPHRAGAPGSRAANASSPQMSELRREGRGGGRAHGPHERLRLLGPVIMGVGLFVFICANTLLYENRDLETRRLRQGVLRAQALRPPDGPGWDCALLPSPGPRSPRAVGCAEPEIWDPSPRRGTSPVPSVRSLRSEPANPRLGLPALLNSYPLKGPGLPPPWGPRTQTGHVIITVQPSGSCIEHSKSLDLGLGELLLGAPAARDCAHRSWPRLDRLSLGGYAKLGGGGDLGARV

SEQ ID NO: 416 - protein, 297 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRDASIPQFKPEIQVYENIHLARLGPPAHKPR

SEQ ID NO: 417 - protein, 133 aa, Homo sapiens
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 418 - protein, 135 aa, Homo sapiens
MSEPQPRGAERDLYRDTWVRYLGYANEVGEAFRSLVPAAVVWLSYGVASSYVLADAIDKGKKAGEVGGFPPGLQPAQALPNSGEAQLLLIILWYLACASASCFMSTSYSCQGMWTPGSLVSKDPGTWVGLSWTEA

SEQ ID NO: 419 - protein, 847 aa, Homo sapiens
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 420 - protein, 88 aa, Homo sapiens
MASVVPVKDKKLLEVKLGELPSWILMRDFSPSGIFGAFQRGYYRYYNKYINVKKGSISGITMVLACYVLFSYSFSYKHLKHERLRKYH

SEQ ID NO: 421 - protein, 55 aa, Homo sapiens
MASVGECPAPVPVKDKKLLEVKLGELPSWILMRDFSPSGIFGAFQREHERLRKYH

SEQ ID NO: 422 - protein, 314 aa, Homo sapiens
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 423 - protein, 634 aa, Homo sapiens
MAPKKKIVKKNKGDINEMTIIVEDSPLNKLNALNGLLEGGNGLSCISSELTDASYGPNLLEGLSKMRQENFLCDLVIGTKTKSFDVHKSVMASCSEYFYNILKKDPSIQRVDLNDISPLGLATVIAYAYTGKLTLSLYTIGSIISAAVYLQIHTLVKMCSDFLIREMSVENCMYVVNIAETYSLKNAKAAAQKFIRDNFLEFAESDQFMKLTFEQINELLIDDDLQLPSEIVAFQIAMKWLEFDQKRVKYAADLLSNIRFGTISAQDLVNYVQSVPRMMQDADCHRLLVDAMNYHLLPYHQNTLQSRRTRIRGGCRVLVTVGGRPGLTEKSLSRDILYRDPENGWSKLTEMPAKSFNQCVAVMDGFLYVAGGEDQNDARNQAKHAVSNFCRYDPRFNTWIHLASMNQKRTHFSLSVFNGLVYAAGGRNAEGSLASLECYVPSTNQWQPKTPLEVARCCHASAVADGRVLVTGGYIANAYSRSVCAYDPASDSWQELPNLSTPRGWHCAVTLSDRVYVMGGSQLGPRGERVDVLTVECYSPATGQWSYAAPLQVGVSTAGVSALHGRAYLVGGWNEGEKKYKKCIQCFSPELNEWTEDDELPEATVGVSCCTLSMPNNVTRESRASSVSSVPVSI

SEQ ID NO: 424 - protein, 634 aa, Homo sapiens
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 425 - protein, 85 aa, Homo sapiens
MASDLDFSPPEVPEPTFLENLLRYGLFLGAIFQLICVLAIIVPIPKSHEAEAEPSEPRSAEVTRKPKAAVPSVNKRPKKETKKKR

SEQ ID NO: 426 - protein, 259 aa, Homo sapiens
MLLRSWFGNKDFQALPILARLPSMPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 427 - protein, 604 aa, Homo sapiens
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPELI

SEQ ID NO: 428 - protein, 294 aa, Homo sapiens
MERLTLTRTIGGPLLTATLLGKTTINDYQVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 429 - protein, 160 aa, Homo sapiens
MAPALWRACNGLMAAFFALAALVQVNDPDAEVWVVVYTIPAVLTLLVGLNPEVTGNVIWKSISAIHILFCTVWAVGLASYLLHRTQQNILHEEEGRELSGLVIITAWIILCHSSSKNPVGGRIQLAIAIVITLFPFISWVYIYINKEMRSSWPTHCKTVI

SEQ ID NO: 430 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 431 - protein, 504 aa, Homo sapiens; identical to SEQ ID NO: 430

SEQ ID NO: 432 - protein, 789 aa, Homo sapiens
MRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHIAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 433 - protein, 194 aa, Homo sapiens
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVSYPGSRRVCLFE

SEQ ID NO: 434 - protein, 372 aa, Homo sapiens
MEAKEKQHLLDARPAIRSYTGSLWQEGAGWIPLPRPGLDLQAIELAAQSNHHCHAQKGPDSHCDPKKGKAQRQLYVASAICLLFMIGEVVGGYLAHSLAVMTDAAHLLTDFASMLISLFSLWMSSRPATKTMNFGWQRAEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 435 - protein, 1188 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 436 - protein, 313 aa, Homo sapiens
MKRENQSSVSEFLLLDLPIWPEQQAVFFTLFLGMYLITVLGNLLIILLIRLDSHLHTPMFFFLSHLALTDISLSSVTVPKMLLSMQTQDQSILYAGCVTQMYFFIFFTDLDNFLLTSMAYDRYVAICHPLRYTTIMKEGLCNLLVTVSWILSCTNALSHTLLLAQLSFCADNTIPHFFCDLVALLKLSCSDISLNELVIFTVGQAVITLPLICILISYGHIGVTILKAPSTKGIFKALSTCGSHLSVVSLYYGTIIGLYFLPSSSASSDKDVIASVMYTVITPLLNPFIYSLRNRDIKGALERLFNRATVLSQ

SEQ ID NO: 437 - protein, 317 aa, Homo sapiens
MEIDNQTWVREFILLGLSSDWCTQISLFSLFLVTYLMTVLGNCLIVLLIRLDSRLHTPMYFFLTNLSLVDVSYATSVVPQLLAHFLAEHKAIPFQSCAAQLFFSLALGGIEFVLLAVMAYDRHVAVSDRLRYSAIMHGGLCARLAITSWVSGSINSLVQTAITFQLPMCTNKFIDHISCELLAVVRLACVDTSSNEAAIMVSSIVLLMTPFCLVLLSYIRIISTILKIQSREGRKKAFHTCASHLTVVALCYGTTIFTYIQPHSGPSVLQEKLISVFYAIVMPLLNPVIYSLRNKEVKGAWHKLLEKFSGLTSKLGT

SEQ ID NO: 438 - protein, 312 aa, Homo sapiens
MENYNQTSTDFILLGLFPQSRIGLFVFTLIFLIFLMALIGNLSMILLIFLDIHLHTPMYFLLSQLSLIDLNYISTIVPKMVYDFLYGNKSISFTGCGIQSFFFLTLAVAEGLLLTSMAYDRYVAICFPLHYPIRISKRVCVMMITGSWMISSINSCAHTVYALCIPYCKSRAINHFFCDVPAMLTLACTDTWVYESTVFLSSTIFLVLPFTGIACSYGRVLLAVYRMHSAEGRKKAYSTCSTHLTVVSFYYAPFAYTYVRPRSLRSPTEDKILAVFYTILTPMLNPIIYSLRNKEVMGALTQVIQKIFSVKM

SEQ ID NO: 439 - protein, 355 aa, Homo sapiens
MEPEKQTEISEFFLQGLSEKPEHQTLLFTMFLSTYLVTIIGNALIILAIITDSHLHTPMYFFLFNLSLVDTLLSSTTVPKMLANIQAQSRAIPFVGCLTQMYAFHLFGTMDSFLLAVMAIDRFVAIVHPQRYLVLMCSPVCGLLLGASWMITNLQSLIHTCLMAQLTFCAGSEISHFFCDLMPLLKLSGSDTHTNELVIFAFGIVVGTSPFSCILLSYIRIFWTVFKIPSTRGKWKAFSTCGLHLTVVSLSYGTIFAVYLQPTSPSSSQKDKAAALMCGVFIPMLNPFIYSIRNKDMKAALGKLIGKVAVPCPRPEQLLDVYHVPGSLLAARDTEMHPIPYPGGVQSLAGNRDME

SEQ ID NO: 440 - protein, 308 aa, Homo sapiens
MAEENHTMKNEFILTGFTDHPELKTLLFVVFFAIYLITVVGNISLVALIFTHRRLHTPMYIFLGNLALVDSCCACAITPKMLENFFSENKRISLYECAVQFYFLCTVETADCFLLAAMAYDRYVAICNPLQYHIMMSKKLCIQMTTGAFIAGNLHSMIHVGLVFRLVFCGSNHINHFYCDILPLYRLSCVDPYINELVLFIFSGSVQVFTIGSVLISYLYILLTIFKMKSKEGRAKAFSTCASHFLSVSLFYGSLFFMYVRPNLLEEGDKDIPAAILFTIVVPLLNPFIYSLRNREVISVLRKILMKK

SEQ ID NO: 441 - protein, 312 aa, Homo sapiens
MGLNKSASTFQLTGFPGMEKAHHWIFIPLLAAYISILLGNGTLLFLIRNDHNLHEPMYYFLAMLAATDLGVTLTTMPTVLGVLWLDHREIGHGACFSQAYFIHTLSVMESGVLLAMAYDCFITIRSPLRYTSILTNTQVMKIGVRVLTRAGLSIMPIVVRLHWFPYCRSHVLSHAFCLHQDVIKLACADITFNRLYPVVVLFAMVLLDFLIIFFSYILILKTVMGIGSGGERAKALNTCVSHICCILVFYVTVVCLTFIHRFGKHVPHVVHITMSYIHFLFPPFMNPFIYSIKTKQIQSGILRLFSLPHSRA

SEQ ID NO: 442 - protein, 312 aa, Homo sapiens
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 443 - protein, 326 aa, Homo sapiens
MSVQYSLSPQFMLLSNITQFSPIFYLTSFPGLEGIKHWIFIPFFFMYMVAISGNCFILIIIKTNPRLHTPMYYLLSLLALTDLGLCVSTLPTTMGIFWFNSHSIYFGACQIQMFCIHSFSFMESSVLLMMSFDRLVAICHPLRYSVIITGQQVVRAGLIVIFRGPVATIPIVLLLKAFPYCGSVVLSHSFCLHQEVIQLACTDITFNNLYGLMVVVFTVMLDLVLIALSYGLILHTVAGLASQEEQRRAFQTCTAPLCAVLVFFVPMMGLSLVHRFGKHAPPAIHLLMANVYLFVPPMLNPIIYSIKTKEIHRAIIKFLGLKKASK

SEQ ID NO: 444 - protein, 318 aa, Homo sapiens
MSDSNLSDNHLPDTFFLTGIPGLEAAHFWIAIPFCAMYLVALVGNAALILVIAMDNALHAPMYLFLCLLSLTDLALSSTTVPKMLAILWLHAGEISFGGCLAQMFCVHSIYALESSILLAMAFDRYVAICNPLRYTTILNHAVIGRIGFVGLFRSVAIVSPFIFLLRRLPYCGHRVMTHTYCEHMGIARLACANITVNIVYGLTVALLAMGLDSILIAISYGFILHAVFHLPSHDAQHKALSTCGSHIGIILVFYIPAFFSFLTHRFGHHEVPKHVHIFLANLYVLVPPVLNPILYGARTKEIRSRLLKLLHLGKTSI

SEQ ID NO: 445 - protein, 309 aa, Homo sapiens
MKSWNNTIILEFLLLGISEEPELQAFLFGLFLSMYLVTVLGNLLIILATISDSHLHTPMYFFLSNLSFVDICFVSTTVPKMLVNIQTHNKVITYAGCITQMCFFLLFVGLDNFLLTVMAYDRFVAICHPLHYMVIMNPQLCGLLVLASWIMSVLNSMLQSLMVLPLPFCTHMEIPHFFCEINQVVHLACSDTFLNDIVMYFAVALLGGGPLTGILYSYSKIVSSIRAISSAQGKYKAFSTCASHLSVVSLFYGTCLGVYLSSAATHNSHTGAAASVMYTVVTPMLNPFIYSLRNKHIKGAMKTFFRGKQ

SEQ ID NO: 446 - protein, 346 aa, Homo sapiens
MIIYKQGITFLQKENNNTIHLNTMFFLSPAETHQRMAAENHSFVTKFILVGLTEKSELQLPLFLVFLGIYVVTVLGNLGMITLIGLSSHLHTPMYCFLSSLSFIDFCHSTVITPKMLVNFVTEKNIISYPECMTQLYFFLVFAIAECHMLAAMAYDGYVAICSPLLYSIIISNKACFSLILVVYVIGLICASAHIGCMFRVQFCKFDVINHYFCDLISILKLSCSSTYINELLILIFSGINILVPSLTILSSYIFIIASILRIRYTEGRSKAFSTCSSHISAVSVFFGSAAFMYLQPSSVSSMDQGKVSSVFYTIVVPMLNPLIYSLRNKDVHVALKKTLGKRTFL

SEQ ID NO: 447 - protein, 360 aa, Homo sapiens
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 448 - protein, 341 aa, Homo sapiens
MLRSPTFTDAGPRCSCLPVSQTLDSMDTVLMGSLQHCCCLLPKMGDTWAQLPWPGPPHPAMLLISLLLAAGLMHSDAGTSCPVLCTCRNQVVDCSSQRLFSVPPDLPMDTRNLSLAHNRITAVPPGYLTCYMELQVLDLHNNSLMELPRGLFLHAKRLAHLDLSYNNFSHVPADMFQEAHGLVHIDLSHNPWLRRVHPQAFQGLMQLRDLDLSYGGLAFLSLEALEGLPGLVTLQIGGNPWVCGCTMEPLLKWLRNRIQRCTADSQLAECRGPPEVEGAPLFSLTEESFKACHLTLTLDDYLFIAFVGFVVSIASVATNFLLGITANCCHRWSKASEEEEI

SEQ ID NO: 449 - protein, 313 aa, Homo sapiens
MSLASGPGPGWLLFSFGMGLVSGSKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKDYIFLLLIGFCIFAAGTVAAWLTGVCAVLYQNTRHKSSEEDEDEAGTRVEVSRRIFQTQTSSVQEFPQLI

SEQ ID NO: 450 - protein, 313 aa, Homo sapiens
MNWENESSPKEFILLGFSDRAWLQMPLFVVLLISYTITIFGNVSIMMVCILDPKLHTPMYFFLTNLSILDLCYTTTTVPHMLVNIGCNKKTISYAGCVAHLIIFLALGATECLLLAVMSFDRYVAVCRPLHYVVIMNYWFCLRMAAFSWLIGFGNSVLQSSLTLNMPRCGHQEVDHFFCEVPALLKLSCADTKPIEAELFFFSVLILLIPVTLILISYGFIAQAVLKIRSAEGRQKAFGTCGSHMIVVSLFYGTAIYMYLQPPSSTSKDWGKMVSLFYGIITSMLNSLIYSLRNKDMKEAFKRLMPRIFFCKK

SEQ ID NO: 451 - protein, 316 aa, Homo sapiens
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 452 - protein, 311 aa, Homo sapiens
MELENQTRVTKFILVGFPGSLSMRAAMFLIFLVAYILTVAENVIIILLVLQNRPLHKPMYFFLANLSFLETWYISVTVPKLLFSFWSVNNSISFTLCMIQLYFFIALMCTECVLLAAMAYDRYVAICRPLHYPTIMSHGLCFRLALGSWAIGFGISLAKIYFISCLSFCGPNVINHFFCDISPVLNLSCTDMSITELVDFILALVIFLFPLFITVLSYGCILATILCMPTGKQKAFSTCASHLVVVTIFYSAIIFMYARPRVIHAFNMNKIISIFYAIVTPSLNPFIYCLRNREVKEALKKLAYCQASRSD

SEQ ID NO: 453 - protein, 314 aa, Homo sapiens
MLGLNGTPFQPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 454 - protein, 572 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 455 - protein, 460 aa, Homo sapiens
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPRNPSALCSGSRLSEPLLPAGLEPGSPLRSFPGCRRRPH

SEQ ID NO: 456 - protein, 1240 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 457 - protein, 619 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGNCPCSPWH

SEQ ID NO: 458 - protein, 2347 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRKAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 459 - protein, 313 aa, Homo sapiens
MLARNNSLVTEFILAGLTDHPEFRQPLFFLFLVIYIVTMVGNLGLITLFGLNSHLHTPMYYFLFNLSFIDLCYSSVFTPKMLMNFVSKKNIISNVGCMTRLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGTNITVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 460 - protein, 312 aa, Homo sapiens
MADDNFTVVTEFILLGLTDHAELKAVLFVVFLVIYAITLLRNLGMILLIQITSKLHTPMYFLLSCLSFVDACYSSAIAPKMLVNLLVVKATISFSACMVQHLCFGVFITTEGFLLSVMAYDRYVAIVSPLLYTVAMSDRKCVELVTGSWIGGIVNTLIHTISLRRLSFCRLNAVSHFFCDIPSLLKLSCSDTSMNELLLLTFSGVIAMATFLTVIISYIFIAFASLRIHSASGRQQAFSTCASHLTAVTIFYGTLIFSYIQPSSQYFVEQEKVVSMFYTLGIPMLNLLIHSLRNKDVKEAVKRAIEMKHFLC

SEQ ID NO: 461 - protein, 827 aa, Homo sapiens
MASADKNGGSVSSVSSSRLQSRKPPNLSITIPPPEKETQAPGEQDSMLPERKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 462 - protein, 140 aa, Homo sapiens
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 463 - protein, 312 aa, Homo sapiens
MSSSGSSHPFLLTGFPGLEEAHHWISVFFLFMYISILFGNGTLLLLIKEDHNLHEPMYFFLAMLAATDLGLALTTMPTVLGVLWLDHREIGSAACFSQAYFIHSLSFLESGILLAMAYDRFIAICNPLRYTSVLTNTRVVKIGLGVLMRGFVSVVPPIRPLYFFLYCHSHVLSHAFCLHQDVIKLACADTTFNRLYPAVLVVFIFVLDYLIIFISYVLILKTVLSIASREERAKALITCVSHICCVLVFYVTVIGLSLIHRFGKQVPHIVHLIMSYAYFLFPPLMNPITYSVKTKQIQNAILHLFTTHRIGT

SEQ ID NO: 464 - protein, 389 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVYYINFTDFASYEVVVDEKPFLQCTRSIETGKTNYNTCYTAGVCLLKARQKIAVKMVHADISINMSKHTTFFGAIRLGEAPAS

SEQ ID NO: 465 - protein, 135 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQGHQ

SEQ ID NO: 466 - protein, 147 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQVSHLVGAAAAPSPRG

SEQ ID NO: 467 - protein, 386 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNGGVLNDWSRITMNPKVFKLHPRSGELEVLVDGTYFIYSQVYYINFTDFASYEVVVDEKPFLQCTRSIETGKTNYNTCYTAGVCLLKARQKIAVKMVHADISINMSKHTTFFGAIRLGEAPAS

SEQ ID NO: 468 - protein, 135 aa, Homo sapiens; identical to SEQ ID NO: 465

SEQ ID NO: 469 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 470 - protein, 270 aa, Homo sapiens
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 471 - protein, 156 aa, Homo sapiens
MIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 472 - protein, 655 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGK

SEQ ID NO: 473 - protein, 610 aa, Homo sapiens
MRGAARLGRPGRSCLPGARGLRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

(The sequence listing continues in the following parts.)

What is claimed is:

1. A method of killing a pancreatic cancer cell in an individual, the method comprising:
    administering a genetically modified immune cell to the individual, wherein the genetically modified cytotoxic immune cell comprises:
    (a) a nucleic acid encoding a chimeric antigen receptor (CAR) that that is activated by binding to mesothelin (MSLN) on another cell; and
    (b) antigen-triggered polypeptide that comprises an extracellular domain that binds to fibroblast activation protein α (FAP), a transmembrane domain, and an intracellular domain comprising a transcriptional activator,
    wherein the antigen-triggered polypeptide comprises one or more protease cleavage sites that are cleaved when the antigen-triggered polypeptide binds to FAP on another cell, and
    wherein cleavage of the antigen-triggered polypeptide at the one or more protease cleavage sites results in release of the transcriptional activator and expression of the CAR.

2. The method of claim 1, wherein the immune cell is a cytotoxic T cell.

3. The method of claim 1, wherein the extracellular domain of the antigen-triggered polypeptide has a protease cleavage site for an ADAM protease and the transmembrane domain of the antigen-triggered polypeptide has a protease cleavage site for γ-secretase.

* * * * *